United States Patent 7,795,419 (VIRAL AND VIRAL ASSOCIATED MIRNAS AND USES THEREOF) - sequence listing, part 6

SEQ ID NO: 147877 - RNA, 64 nt, Human
cagagaaccucucaauaaaugauuugucgccugucugacugauuuacccuaggauaaagacucu

SEQ ID NO: 147878 - RNA, 64 nt, Human
ugugugacauagauuugaacauaauugcuggacacugacugauguacuguggcagacagaacua

SEQ ID NO: 147879 - RNA, 64 nt, Human
gccccuggcagggacggccggcccgcccccgugacugacugacagaugcagggauggccgaggc

SEQ ID NO: 147880 - RNA, 64 nt, Human
uuuccucucacccuuuauuuaugaagcugcagcccugacugagacauagggcugaguuuauugu

SEQ ID NO: 147881 - RNA, 64 nt, Human
uggagaguguuaccacagccuaaccuagucuauccugacugacagaaaggacuuguucauuucg

SEQ ID NO: 147882 - RNA, 64 nt, Human
caggagcccggugcuaggggaagcauccccaggccugacugagcggcaggggagcacggcccgu

SEQ ID NO: 147883 - RNA, 64 nt, Human
ugucauagucccagaggauaagcaauaccuauuucugacugagucucccagcccagacccaggg

SEQ ID NO: 147884 - RNA, 64 nt, Human
ggacucugcucccugucugagaccacccccggcucugacugagaguaaggggacugucagggcc

SEQ ID NO: 147885 - RNA, 64 nt, Human
agucuaagccuuuagagaaaauucauucuuuuuucugacugaucacagcauacgugugacccag

SEQ ID NO: 147886 - RNA, 64 nt, Human
cucaguaucuacaacacacaagacucaguaggcccugacugaugucucuuacaugaaugugacu

SEQ ID NO: 147887 - RNA, 64 nt, Human
ugugggugcuccuggcucaacccaaccaacaggacugacugacuggcaggacaaggucuggcau

SEQ ID NO: 147888 - RNA, 64 nt, Human
cucgugaugauucauuucaaaauccugagugagucugacugaaaaauacgagagaaaagagagu

SEQ ID NO: 147889 - RNA, 64 nt, Human
aggaacugacuauucuagccuaucuccugugccccugacugagcagaagcccccacagcuggcc

SEQ ID NO: 147890 - RNA, 64 nt, Human
agucugagccuuuaaggggaauuccuucccuuuucugacugauuacagcauacaucugaccagu

SEQ ID NO: 147891 - RNA, 64 nt, Human
cugcuguauaauacuuuccauuuucuagaauuuucugacugauguaauaaaguguuuccucuua

SEQ ID NO: 147892 - RNA, 64 nt, Human
uuuguuauauaaaaaaauuguaaauguuuaauaucugacugaaauuaaacgagcgaagaugagc

SEQ ID NO: 147893 - RNA, 64 nt, Human
agaugauaucugaaaccagagagacuuggaaugucugacugacuucuauuuaacagcuugagua

SEQ ID NO: 147894 - RNA, 64 nt, Human
ugauguuccacuccacuuuguauagacaucugcccugacugaauguguucugucacucagcuuu

SEQ ID NO: 147895 - RNA, 64 nt, Human
cuucuauagcaucacuuaaaacacguuuuaaggacugacugaggcaguuugaggauuaguuuag

SEQ ID NO: 147896 - RNA, 64 nt, Human
uuuauuuauugggaaagugagggagggagacagacugacugacagccauggguggucagauggu

SEQ ID NO: 147897 - RNA, 64 nt, Human
gucacaagucucugguaccaaaagggacccauggcugacugacagcaaggccuauggggaagaa

SEQ ID NO: 147898 - RNA, 64 nt, Human
gugguuuuucagacaccugcagcaagaagaaauacugacugacuaggcauuauuuucuauacau

SEQ ID NO: 147899 - RNA, 64 nt, Human
agggagacucagcucuccuugggggcuggcccagcugacugaggguacacaggauugggucuag

SEQ ID NO: 147900 - RNA, 64 nt, Human
uggcuucaccucacccuaaucccccgggagggagcugacugaugcaaaaagcugagggggccug

SEQ ID NO: 147901 - RNA, 58 nt, Human
cuuuugcuuuccaguuuuagaagccaaacugacugaggagugggacgguucguuugaa

SEQ ID NO: 147902 - RNA, 64 nt, Human
uacuuucaaauaccuauauuagaaagauauugaucugacugaaauauaaccuaccugccaguaa

SEQ ID NO: 147903 - RNA, 64 nt, Human
ccugugcccacccugacagacacccuggcuggcccugacugacuguauucucuggccacauuca

SEQ ID NO: 147904 - RNA, 64 nt, Human
ucugagugucccgcggugcccgccaacccgcuuccugacugaccugagcaaggucuuacuaagc

SEQ ID NO: 147905 - RNA, 64 nt, Human
uucucucccugggucugcguucccuccccugggccugacugagccugcucauuguuuuucccuu

SEQ ID NO: 147906 - RNA, 64 nt, Human
aaaucuguaaauaggagguggagggcaagccauccugacugagcaguuuuuaaccgcagguucu

SEQ ID NO: 147907 - RNA, 64 nt, Human
aguagguacaguggacaaaaauagcccagggugacugacugaauuuaaacccauaauggcuuua

SEQ ID NO: 147908 - RNA, 64 nt, Human
augucccccccacauaaagagagcuucucagagccugacugaagagcugacguuuugcuuuuuc

SEQ ID NO: 147909 - RNA, 64 nt, Human
uugcuuguuggggacacacucauaacuauuucaccugacugacaagcauaaaaggcuaacuugu

SEQ ID NO: 147910 - RNA, 64 nt, Human
uaccucuucuagcccuuagaagucugaggccagacugacugagggggccugaagcuacaugcac

SEQ ID NO: 147911 - RNA, 64 nt, Human
cuccuucugcacgauccaauaggagacaccaguucugacugaaccaugcccccaccuaagucac

SEQ ID NO: 147912 - RNA, 64 nt, Human
ugauaucuuuuucaucacauuacaaguuauuucucugacugaauagacagugguauagguugac

SEQ ID NO: 147913 - RNA, 64 nt, Human
ggacuccauccccaaacccacuaaucacaucccacugacugacccucugugaucaaagacccuc

SEQ ID NO: 147914 - RNA, 64 nt, Human
caacucuauaaaauggaauggaacuagaagugcacugacugacagcauguugcaaucacagaua

SEQ ID NO: 147915 - RNA, 64 nt, Human
ugcauuugccaguuuauucuuuuguuucuuuuaucugacugacucugucaaacaagugucaaag

SEQ ID NO: 147916 - RNA, 64 nt, Human
aaggucacucgaagauaagggauggggaugggggcugacugacaaaaaauuuuagccccagguc

SEQ ID NO: 147917 - RNA, 64 nt, Human
guaaauguuucuggacuuuauguuauuuaauuuacugacugaaauccaauuuggaauuugguag

SEQ ID NO: 147918 - RNA, 64 nt, Human
aguaucaucuugauaguguuacuucagcauaugacugacugauuuuaugaagggaguuuagcug

SEQ ID NO: 147919 - RNA, 64 nt, Human
gagcugaaggcccagaaucccgcuagaauauauccugacugaucagaggauaugacagcuuacc

SEQ ID NO: 147920 - RNA, 64 nt, Human
aaggccaagcuggucuagccugacauccuagcuccugacugaacacuauagacuucccagcagc

SEQ ID NO: 147921 - RNA, 64 nt, Human
uuaaaaaaauaauuggaagcacaagugcauggcacugacugaaugcuguuaauauuucuaaaag

SEQ ID NO: 147922 - RNA, 64 nt, Human
cagaaaucagaucuuggggagagucccuuccuaccugacugaccucccauaaggcugaugcuga

SEQ ID NO: 147923 - RNA, 64 nt, Human
cagcuggaaacuaagcagauacugguccugcauucugacugagauugugucuucuuuaugagga

SEQ ID NO: 147924 - RNA, 64 nt, Human
cuaugacaugagcacacccaacgcaccccugcacuacuaugagaccguucgcauggcagccauc

SEQ ID NO: 147925 - RNA, 64 nt, Human
auacuaucuguauacaugugcacaugcggcauuuuacuaugaaauuuaauaugcuggguuuuuu

SEQ ID NO: 147926 - RNA, 64 nt, Human
acccccugcugcacacgcuagcauaucuggaaccuacuaugaaaaugaaaggacccuuauaggu

SEQ ID NO: 147927 - RNA, 64 nt, Human
caaagagccuguuguauugcuuaccauguccccauacuaugaggagaaguuuuguggugccgcu

SEQ ID NO: 147928 - RNA, 64 nt, Human
caccuucauagcauacuccuucccccucaggugauacuaugaccaugaguagcaucagccagaa

SEQ ID NO: 147929 - RNA, 64 nt, Human
auaguuuuaagguuucucaagauguggcucuaccuacuaugaugaaaauugaagugggucaaaa

SEQ ID NO: 147930 - RNA, 64 nt, Human
ggucaguguaaaguuuuauccuugauagucuaguuacuaugacccuccccacuuuuuuaaaacc

SEQ ID NO: 147931 - RNA, 64 nt, Human
guaggcucuauaguaggcuuaagagugagucuuauacuaugaagccagccacaagauacuaaca

SEQ ID NO: 147932 - RNA, 64 nt, Human
uguaaaugcuuauuuuaucauagucuuuagccucuacuaugaguaaaauguucucuucggccgg

SEQ ID NO: 147933 - RNA, 64 nt, Human
ucuguggcuuuccggauuugcacauuuccugggguacuaugaacgugagugggguauuuuguuc

SEQ ID NO: 147934 - RNA, 64 nt, Human
aguuggaugaauuacuagagguaauaacaaaucuuacuaugaaaucaagagguuuaagaacaua

SEQ ID NO: 147935 - RNA, 64 nt, Human
agcaccaggcccacggaaaguggcuaauguuagcuacuaugaauggugccagugaagacacuga

SEQ ID NO: 147936 - RNA, 64 nt, Human
gcaccaguuuguagucccucuguuucgcacagaguacuaugacaaggaaacaucagaauuacua

SEQ ID NO: 147937 - RNA, 64 nt, Human
gugaauuaguuuuaaaaugauauuguuauauacauacuaugaaauauguauaacuuuaacuucu

SEQ ID NO: 147938 - RNA, 64 nt, Human
uuauaaaaaggccauguagaaaauuuauuaaaacuacuaugacugcuacauucaggaauaugcc

SEQ ID NO: 147939 - RNA, 64 nt, Human
aucacugcuuccauagauuggcauuuuuagcuauuacuaugacuuauauaacuuauacauauaa

SEQ ID NO: 147940 - RNA, 64 nt, Human
aaaauaauggaaagugucuguuuugugguguauauacuaugaauaaaaucacagcauuuucuaa

SEQ ID NO: 147941 - RNA, 64 nt, Human
aaguuuucuuauggcaaaaauaauguaaauaaguuacuaugaucugcauuuugccagaaacuca

SEQ ID NO: 147942 - RNA, 64 nt, Human
agaaacccauguccucucuccauagggccuguuuuacuaugauguaaaaauuaggucauguaca

SEQ ID NO: 147943 - RNA, 64 nt, Human
gaccugaaaaagccuaucaaauacuaucaaaauguacuaugacauugaguccuucacugcuucc

SEQ ID NO: 147944 - RNA, 64 nt, Human
cuaaaucucaauguaaaauucuuuuuuuucuuauuacuaugaaauggauggaauaaggaggggg

SEQ ID NO: 147945 - RNA, 64 nt, Human
cugaaaaauggaugucuagaacugguccugcaauuacuaugaagucaaaaauuaaacuagacua

SEQ ID NO: 147946 - RNA, 64 nt, Human
aaccugagagaaugcuagucauaacuguacuaguuacuaugaaaauggaaauaauuaucuuaga

SEQ ID NO: 147947 - RNA, 64 nt, Human
uuguaaauugggauuuuguuaaucaaauuuauuguacuaugacuaaaugaaauuauuucuuaca

SEQ ID NO: 147948 - RNA, 64 nt, Human
uuuuuaccaaauuuaaaagauccuuuuuaguuaauacuaugacaguacuaaaaauauaugaaua

SEQ ID NO: 147949 - RNA, 64 nt, Human
ucaagacaacaaagaucauucauuugguucuuuauacuaugaaacuugaguaaguauuaccucc

SEQ ID NO: 147950 - RNA, 64 nt, Human
ucaggugcuaaauaaacaacaaaaugguaaccucuacuaugaaguguuuccaaugaugggauau

SEQ ID NO: 147951 - RNA, 64 nt, Human
caaacuuauagaaauaaaaauuauuagaaagaaauacuaugaacaauugaaugccaacaaauua

SEQ ID NO: 147952 - RNA, 64 nt, Human
uugugaauaacaucaauuaauguaacuaguuaauuacuaugauuaucaccuccugauagugaac

SEQ ID NO: 147953 - RNA, 64 nt, Human
ccaguugagacaaucaccacaguuauuacccaaauacuaugaacauauuuuuguaaaccaguca

SEQ ID NO: 147954 - RNA, 64 nt, Human
uguagacuauaugaaucaauuauuacaucuguuuuacuaugaaaaaaaaauuaauacuacuagc

SEQ ID NO: 147955 - RNA, 64 nt, Human
caaauuucuauuucugccucugacaaaaagaacuuacuaugaaagaaauaguuguuuuaucaau

SEQ ID NO: 147956 - RNA, 64 nt, Human
cauccaagaaaugaugagagagagagaaauuauauacuaugaaaagugcacccccacacucugc

SEQ ID NO: 147957 - RNA, 64 nt, Human
gaccacuuaccaaguaucugaagagaugaguucauacuaugauuuagaaagugguucaauuccc

SEQ ID NO: 147958 - RNA, 64 nt, Human
uguugacuggacccucaguucccacacugcuaauuacuaugaaagcugcucuggccucgucuuc

SEQ ID NO: 147959 - RNA, 64 nt, Human
aguugugagcauucuuuuuuuccuucucaaaaccuacuaugauuuguuuuacugaacaaagguu

SEQ ID NO: 147960 - RNA, 64 nt, Human
aggggaauuuugcagugacaggauuuuagucucuuacuaugaauacuaauuucgaaccauagcu

SEQ ID NO: 147961 - RNA, 64 nt, Human
caucacaacuuacaaugcugcucauuguugugaguacuaugagauucaaauuuuucuaacauau

SEQ ID NO: 147962 - RNA, 64 nt, Human
uacugaauucuguaauaugaacuaggaacgcauuuacuaugagaaaauauggcucuuaagcagu

SEQ ID NO: 147963 - RNA, 64 nt, Human
aauagucccugcuuuaagggacuacgauaauguguacuaugacaaacgugcuuuauucuucuaa

SEQ ID NO: 147964 - RNA, 64 nt, Human
uuugacaauguggaauuaccaaauuaaaagagaauacuaugaauguauucauauuuuuucuaua

SEQ ID NO: 147965 - RNA, 64 nt, Human
ccaagauauauccuuauuuucauuuccaaacaacuacuaugauaaaugugaagaagauucuguu

SEQ ID NO: 147966 - RNA, 64 nt, Human
auuuggauugccugcucucuuuaaagcgaauucauacuaugacagcagaaacaaaacuucagau

SEQ ID NO: 147967 - RNA, 64 nt, Human
uuaagauuucauugagggcaaggcugguggcagguacuaugaauguaauucauaauuuaaaagg

SEQ ID NO: 147968 - RNA, 64 nt, Human
agaguccaaaaugcacuggucacgaaacgucuaauacuaugacuguuaaaaugucagacuauaa

SEQ ID NO: 147969 - RNA, 64 nt, Human
gggucuuaugcaaauuuucuauuucuaaaacuacuacuaugauauacaagugcuguugagcaua

SEQ ID NO: 147970 - RNA, 64 nt, Human
uucuuauuucuaaguagauagaaagcaauaaaaauacuaugaaaugaaagaacuuguucacagg

SEQ ID NO: 147971 - RNA, 64 nt, Human
ugcaagguacaaggcccacacccucucugagagauacuaugauuaaaaaagcuuuauaucuugg

SEQ ID NO: 147972 - RNA, 64 nt, Human
gauguagguauuaacaaucuuuucugccuccaacuacuaugaaguuggcagcaacagaggggcc

SEQ ID NO: 147973 - RNA, 64 nt, Human
uauaaccaauucauuaaauguaauucauaaaauguacuaugaaaaaaauuauacgcuaugggau

SEQ ID NO: 147974 - RNA, 64 nt, Human
aaaauggggaaauuaucacuuacaaguauuuguuuacuaugaaauuuuaaauacacauuuaugc

SEQ ID NO: 147975 - RNA, 64 nt, Human
uuucugccuguuacaaauaucaaggaagaccugcuacuaugaaauagaugacauuaaucugucu

SEQ ID NO: 147976 - RNA, 64 nt, Human
cugcuacucauaaguuggaccagaggaagccccuuacuaugaucucaggagcuugcaagaagca

SEQ ID NO: 147977 - RNA, 64 nt, Human
aauuuagaaaacaggugcuuaauugcaauaaaauuacuaugaaguauauuaaaaaucacgacau

SEQ ID NO: 147978 - RNA, 62 nt, Human
gaggaagaagagacgaacauuaaagaugucuauuuacuaugagcucacuguguuguuucaua

SEQ ID NO: 147979 - RNA, 64 nt, Human
cauauuuuaacuuauuaaaucuucuauuauuauguacuaugauuuauuccuacuaaaacauaaa

SEQ ID NO: 147980 - RNA, 60 nt, Human
uacuauuuucuuucagcuaaccccugcaucuacuaugaugaauacuucgacugugacaua

SEQ ID NO: 147981 - RNA, 64 nt, Human
ccuagugagaauauccaguagguuauccuauaguuacuaugaaguuaacacagcccaaaaaccu

SEQ ID NO: 147982 - RNA, 64 nt, Human
gaacucacaggaaguuacuucaagcacuugccaguacuaugauauucaaguaccuugcagcauu

SEQ ID NO: 147983 - RNA, 64 nt, Human
gcucaagguaagguagcuuuggcagcagggcugauacuaugaggcugaaacaauccuugugaug

SEQ ID NO: 147984 - RNA, 64 nt, Human
auacauaaaggugcuucaaaauauguagaaacauuacuaugaaaucaguuuuuaaaagauauac

SEQ ID NO: 147985 - RNA, 64 nt, Human
auuuucaaaauaagaaaauaaccuuuauaugauauacuaugacuaggcuguguauuucuuuuca

SEQ ID NO: 147986 - RNA, 64 nt, Human
gaucacuugagcccaggagauuaagacuguaguauacuaugaucgugccuguggcuagccacug

SEQ ID NO: 147987 - RNA, 64 nt, Human
caaaggauggucugugggaaaauauauuagaaguuacuaugaagaaugccccaaagacaaguua

SEQ ID NO: 147988 - RNA, 64 nt, Human
cucuaaaaucucacugagugauuucaccuucgccuacuaugaaaugucucaucagaccugacau

SEQ ID NO: 147989 - RNA, 64 nt, Human
uguaauuuccugacuuuuccuagaugucagccacuacuaugaauucaagcuuguguagucagau

SEQ ID NO: 147990 - RNA, 64 nt, Human
aagggagaaauacacuguaugaaguauauguugauacuaugacauguugccaacaccuugagaa

SEQ ID NO: 147991 - RNA, 64 nt, Human
guuuauccuaagcacuuguuugucagcccucucauacuaugaacauauggguagagaguauauu

SEQ ID NO: 147992 - RNA, 64 nt, Human
auugguguuagaaccacuaaacaucuucaaaugguacuaugaggaaaaaaagaaaaacauuuuu

SEQ ID NO: 147993 - RNA, 64 nt, Human
accuaauuuuuaguuuuuaaacuauuuuaaaauauacuaugauuuuauauguauauuuccuaua

SEQ ID NO: 147994 - RNA, 64 nt, Human
agagagagagagagagcgagagagagagacauguuacuaugaaagacuuguauuuuuuauuguc

SEQ ID NO: 147995 - RNA, 64 nt, Human
acugccuuggucugugcaggcugcuguaaugaaauacuaugaacuuggcagcuuauaaacaaca

SEQ ID NO: 147996 - RNA, 64 nt, Human
agauaauuucuuuauugaaacuaucaggaaguuuuacuaugaaauuuuacauacaugauggaaa

SEQ ID NO: 147997 - RNA, 64 nt, Human
cuauugcuauuacuaguacuauuacuaguacuaguacuaugacacuguuaauaguacuauuaac

SEQ ID NO: 147998 - RNA, 64 nt, Human
aguuucucuaguucuauaguuuauuuguugaagguacuaugaccaaagaaucagcugcucuaca

SEQ ID NO: 147999 - RNA, 64 nt, Human
ugguauaaggaaauaucauaauguaaugaggugguacuaugauuaaaagccacuguuacauuuc

SEQ ID NO: 148000 - RNA, 64 nt, Human
uucaauacuuguaaacuggaaaucagaaaauauuuacuaugaacaggaaaaucugacauauagc

SEQ ID NO: 148001 - RNA, 64 nt, Human
uuuaaauggaacuaucuccaaauuuuucuaagacuacuaugaacaguuuucuuuuaaaauuuug

SEQ ID NO: 148002 - RNA, 64 nt, Human
ucuauggcugucccgauuugcgcauuuccugggguacuaugaacgugagugggguauuuuguuc

SEQ ID NO: 148003 - RNA, 64 nt, Human
ucccuuuuguauguuucuacuguuaaugccauauuacuaugagauaauuuguugcauagugucc

SEQ ID NO: 148004 - RNA, 64 nt, Human
ucugccuucuagagagagaucagaauuaaacuaguacuaugaaauguccuuuugaauguuaggu

SEQ ID NO: 148005 - RNA, 64 nt, Human
ggauuugaugcuuuucucucagcauagguaugcuuacuaugaccuuccaaguuugacuuguaua

SEQ ID NO: 148006 - RNA, 64 nt, Human
ucuguggcuuucccgauuugcacauguccugggguacuaugaacgugagugggguauuuuguuc

SEQ ID NO: 148007 - RNA, 64 nt, Human
augcacaaacuguaggaaacuauaggaaagcauuuacuaugagguuauauuuuauggaguauau

SEQ ID NO: 148008 - RNA, 64 nt, Human
aucacucaguuuggugcuuuaaauuaagucuguuuacuaugaaacaagagucauuuuuagagga

SEQ ID NO: 148009 - RNA, 64 nt, Human
caaauuggaaggaaauaugaaugaagcccuggaguacuaugagcgggcccugagacuggcugcu

SEQ ID NO: 148010 - RNA, 64 nt, Human
uguuuaguguuuucucagaaucagcaacucaagguacuaugaggauuuuucucacugacauaau

SEQ ID NO: 148011 - RNA, 64 nt, Human
guagucaugcuaauuauauaauauuuuuaauauauacuaugaggcccuaucuuuugcauccuac

SEQ ID NO: 148012 - RNA, 64 nt, Human
aacgacuaagucuugcucaaauguuauuaugagguacuaugagugacuuacauguguuuuaaaa

SEQ ID NO: 148013 - RNA, 64 nt, Human
uggaagaaauggcuaugaacagaaacuacauuucuacuaugaucagaagaacaugauuuuacaa

SEQ ID NO: 148014 - RNA, 64 nt, Human
augcauuuuuuuaaggcaaaauuucucccuuaucuacuaugaugacuucagaagauacaauggu

SEQ ID NO: 148015 - RNA, 64 nt, Human
aaaucacacauaugcacacauacauauuuaugguuacuaugauuguuauuauuuguccaaucaa

SEQ ID NO: 148016 - RNA, 64 nt, Human
cuaaaaaaaaaaaagcuuuuguuuuguauuuguuuacuaugagucguuauuuaauuucucuuga

SEQ ID NO: 148017 - RNA, 64 nt, Human
aaacaccauuuaauaguuauaacgucguuacuuguacuaugaaggaaaauacucagugucagcu

SEQ ID NO: 148018 - RNA, 64 nt, Human
cauuuuugaauacagcugcauuauaaaccaaauuuacuaugaaguccuuugcuguggaggcaau

SEQ ID NO: 148019 - RNA, 64 nt, Human
ugucuuuuuuaaauaugaaguacuuaaauguacuuacuaugauaggaaauauaaugugugccuu

SEQ ID NO: 148020 - RNA, 64 nt, Human
cagacuaggcaaauuuuuuuaguuuauaauguuuuacuaugauuuagggcuuuuuuuucaaaga

SEQ ID NO: 148021 - RNA, 64 nt, Human
ucuaggauguauuuuucuuguaucuuuuucuuccuacuaugauacuaguaauucauaagggauc

SEQ ID NO: 148022 - RNA, 64 nt, Human
guguugcuacuagacugaggguuuccaggaguaguacuaugacaucauguaaacacauucaguu

SEQ ID NO: 148023 - RNA, 64 nt, Human
aucuaguucaugugcauuaggcugccguauauacuacuaugauauuuagcugcaguaucaaugu

SEQ ID NO: 148024 - RNA, 64 nt, Human
aagucuuguguucagcaauaucuaaagauaauguuacuaugacaacauuuuuacuguccuuuaa

SEQ ID NO: 148025 - RNA, 64 nt, Human
ugagcagggccuagucuuagccaauauuaaaacauacuaugaagccucugauacuuaaacagca

SEQ ID NO: 148026 - RNA, 64 nt, Human
gaagcccaguauuugcuacuguuuuuccuuuuuuuacuaugacaggaaaauaaaugcaauuuua

SEQ ID NO: 148027 - RNA, 64 nt, Human
gccaggaaucuauuguguuuuucuucugccaauuuacuaugauuguguaugugccgcuaccacc

SEQ ID NO: 148028 - RNA, 64 nt, Human
aguccaucugaugccaguguugaguaaacucaacuacuaugaaauuucaccuaauguuuucagu

SEQ ID NO: 148029 - RNA, 64 nt, Human
ugagaagcgucaggucccacuucugccaugcagcuacuaugagcccucggggccuccuccuggg

SEQ ID NO: 148030 - RNA, 64 nt, Human
ucuauucugacuacucgcuauuuuguaguaguuguacuaugauaaucuguuuauuggauggacc

SEQ ID NO: 148031 - RNA, 64 nt, Human
uuuuuagacuucugaacaucaguauguucgaggguacuaugauauuuugguuuggaauugcccu

SEQ ID NO: 148032 - RNA, 64 nt, Human
uuguuguuguaaaauugaaaucaggcauuuaacauacuaugaaaacaccaggagucaaugauua

SEQ ID NO: 148033 - RNA, 64 nt, Human
gcuuaguggucaaauauguugaaaaccuuuccaauacuaugaaugaaugcaaaucuuaaugcac

SEQ ID NO: 148034 - RNA, 64 nt, Human
guuuaauuuguaaagcuuagcaaauaaaaucuuguacuaugaauagcuucuugcuuuaugacuu

SEQ ID NO: 148035 - RNA, 64 nt, Human
guaaccccaagcaaauauagaagacuguauuuuuuacuaugauauccauuuuccagaauuguga

SEQ ID NO: 148036 - RNA, 64 nt, Human
gaguggaagccuuuauugggauaaucuuccuaaauacuaugacaauuguccauuuuucuucugg

SEQ ID NO: 148037 - RNA, 64 nt, Human
ucagauuguaauauguaaaugguaugucauucgcuacuaugauuuaauuugaaauauggucuuu

SEQ ID NO: 148038 - RNA, 64 nt, Human
ucauaugcccguguuugucacuuacaaaaauguuuacuaugaacacacagaaauaaaaaauagg

SEQ ID NO: 148039 - RNA, 63 nt, Human
cacaacuuggacaaaaguaacacagaagaaccuuacuaugauaaucuacuuggaauguggaua

SEQ ID NO: 148040 - RNA, 63 nt, Human
gaauaaucuauaucacuuuaacaaauaaauguuuuacuaugacagaauuugcacauugccuga

SEQ ID NO: 148041 - RNA, 64 nt, Human
aaaaguauuaaugugcuugacaccaugacugaaauacuaugaucuuguuugucaauaaaaagca

SEQ ID NO: 148042 - RNA, 64 nt, Human
gugguuuuaacauuggguguuuuuguuuuguuuuuacuaugaaaagacagcuuaaggaagagcu

SEQ ID NO: 148043 - RNA, 64 nt, Human
aaggugggaguauauuuuuauuuccuaaaugccauacuaugaagaucaaagucuuaaguguguu

SEQ ID NO: 148044 - RNA, 64 nt, Human
acaauguuuggaaaaacaugggacuguaugucauuacuaugacugauagcagaauaauaaugca

SEQ ID NO: 148045 - RNA, 64 nt, Human
uuaaaaucucaggcuauucuguuaauguuccugcuacuaugaacccaaacuuuuuuuuuccccc

SEQ ID NO: 148046 - RNA, 64 nt, Human
uggccuuuucacauuucuaaaucccaucuugauauacuaugaauacucuagaaugauguaaagc

SEQ ID NO: 148047 - RNA, 64 nt, Human
guuuaacaaaucuaaucucuuauucuaauaaauauacuaugaaauaaaaaaaaaaggaugaaag

SEQ ID NO: 148048 - RNA, 64 nt, Human
uauuacuauuucuuaugccuuuuaaaauacuguuuacuaugaagacaauguuuuuaauuacaaa

SEQ ID NO: 148049 - RNA, 64 nt, Human
aggccccacccacuggagagccccgccccuaagguacuaugaguccucaggggucaaguucaga

SEQ ID NO: 148050 - RNA, 64 nt, Human
aaaccuuugcuggguuuucuguucaauaaaguuuuacuaugaaugacccuggcagagacuccug

SEQ ID NO: 148051 - RNA, 64 nt, Human
auuaaaggccaugcugaucuugcauaacuauaaguacuaugaaugaauuugguugguuuuggug

SEQ ID NO: 148052 - RNA, 64 nt, Human
cuuucucuuucuuuucccuuugggcccuuggccuuacuaugaugauaugagauucuuuaugaaa

SEQ ID NO: 148053 - RNA, 64 nt, Human
auuacaauaacagagauauauguaaaauugccaauacuaugagagcuucuuuguucaaauguau

SEQ ID NO: 148054 - RNA, 64 nt, Human
agaggggagagagccgcgggguccugcccgugguuacuaugaauguauugcuguuggaggacau

SEQ ID NO: 148055 - RNA, 64 nt, Human
cugggagguagauagguaaauaccaaguauuuauuacuaugacugcuccccagcccuggcucug

SEQ ID NO: 148056 - RNA, 64 nt, Human
gguuuuuaggagucugagcauccaucaauaccuguacuaugaugggcuucuguucucugcugag

SEQ ID NO: 148057 - RNA, 64 nt, Human
aucgucacacagcugugauaagaguagauuauuuuacuaugaaauaauucugaauagaugaaag

SEQ ID NO: 148058 - RNA, 64 nt, Human
uuuauugagaacuuguuucauaaauggauaucccuacuaugacugugaaaacaugucaaguguc

SEQ ID NO: 148059 - RNA, 64 nt, Human
uaccuacaagaucccgcgucagcggauuauggauuacuaugagaccaacagccagugcuccaag

SEQ ID NO: 148060 - RNA, 64 nt, Human
ucuugcugcuaaugucuccuugugauauuugucauacuaugaaugucuucauuagucauuuaaa

SEQ ID NO: 148061 - RNA, 64 nt, Human
auaaacacaguugcaggaaaguauguuagcuauauacuaugaaguacucuuaguuuacuuaugu

SEQ ID NO: 148062 - RNA, 64 nt, Human
uuaaagagauucuguuauuagcaccaugaacucguacuaugaaauuuuuaagccuuuuauuuuu

SEQ ID NO: 148063 - RNA, 64 nt, Human
cguaugcuguucccuucaaugugauaucagagauuacuaugaauguuaguuucauuccgugaaa

SEQ ID NO: 148064 - RNA, 64 nt, Human
agaugggaagcauagauaucuauauuuuuauuucuacuaugagggccuuguaauaaauuucuaa

SEQ ID NO: 148065 - RNA, 64 nt, Human
uacucugaaagaaaaaugacguaaccacagcguguacuaugaaagcuguuauuuuaauaaagaa

SEQ ID NO: 148066 - RNA, 64 nt, Human
ccugaggcaagcaccacacuuaccacuguauguguacuaugaucccaacaggcuugugacauag

SEQ ID NO: 148067 - RNA, 64 nt, Human
ggaguagaugggaauuugagggagaauacagagauacuaugaacguauuugacauuuuuaauac

SEQ ID NO: 148068 - RNA, 64 nt, Human
cauuuaucuaugaccaauaggaagagcaaccaguuacuaugagugaaagggagccagaagacug

SEQ ID NO: 148069 - RNA, 64 nt, Human
uguccccuccccggucccccgcccugcucaccucuacuaugaaggugcccccaggucaccugug

SEQ ID NO: 148070 - RNA, 64 nt, Human
aaguaugcaugaaagaauucacacuggggagaaauacuaugaauguaaggauaugaguguuguu

SEQ ID NO: 148071 - RNA, 64 nt, Human
auaaaaaauaaaagaucguaugauaugagauacauacuaugaaaugaagauagacacauuugga

SEQ ID NO: 148072 - RNA, 64 nt, Human
ugggaaguccuucagcagcaauucaaaacuuaaauacuaugauguuuaauaaguauuauagugu

SEQ ID NO: 148073 - RNA, 64 nt, Human
ucaaaagugugcucaaaaaugaaacccaugcucuuacuaugaaagaacguuaguacccagguuu

SEQ ID NO: 148074 - RNA, 64 nt, Human
uacagucuucacugaaguguuugguacaaggaucuacuaugaacuugcugcugugauaggcaag

SEQ ID NO: 148075 - RNA, 64 nt, Human
ggaaaaagaugccaacauacccguauuuaccaaguacuaugauaauggcuagaguauaaaaaug

SEQ ID NO: 148076 - RNA, 64 nt, Human
aaagaaauaagaugguauuaggcaaaucuuacuauacuaugaaaagcauuaccuugccuauuuu

SEQ ID NO: 148077 - RNA, 64 nt, Human
ggaauguuaaauaacgcuuuuauacuguauuuuguacuaugauguaacuccccuuccuuauggc

SEQ ID NO: 148078 - RNA, 64 nt, Human
gggcucuuugagguggguggcuucuuuuggaaaguacuaugaacgucucgaagcaguauucuag

SEQ ID NO: 148079 - RNA, 64 nt, Human
acuuugacacugcagguauuccauuuucaugguuuacuaugaaaagucauuuuucauauuaugu

SEQ ID NO: 148080 - RNA, 64 nt, Human
acuggccaguugaauauauucuauuccauguccauacuaugacaaucuuauugucaacacuaua

SEQ ID NO: 148081 - RNA, 64 nt, Human
aauucaucuauucaacagauauuuauuguguuauuacuaugagucaggcucuguuuauuguuuc

SEQ ID NO: 148082 - RNA, 64 nt, Human
cagcauaggugaaaaucauauuugggcuauuguauacuaugaacaauuuguaaaugucuuaauu

SEQ ID NO: 148083 - RNA, 64 nt, Human
ucuuuuuuuggcaaacauacauaauguuacaucauacuaugaugaacauccauguacuuuucac

SEQ ID NO: 148084 - RNA, 64 nt, Human
uugaccaaccuucuucuaacaaggugcucauuccuacuaugaauccagaauaaacacgccaaga

SEQ ID NO: 148085 - RNA, 64 nt, Human
aguuucaugacuuacugcuuaacgaauaacuaacuacuaugauauucuggacauuuuaggaaau

SEQ ID NO: 148086 - RNA, 64 nt, Human
uuaaggaaaucuuacaaguauuacauuaaaaagauacuaugacugccaccugccauuuaccuuc

SEQ ID NO: 148087 - RNA, 64 nt, Human
acgacaaagcaugguuuguggcuuuuugcaaaauuacuaugaaccaaaaguugacaaauguucc

SEQ ID NO: 148088 - RNA, 62 nt, Human
ccacucugguguagacagaggacuuuguccaagucucacacuaaacaugcccgggcuucgau

SEQ ID NO: 148089 - RNA, 62 nt, Human
uguaacagccaccuggagaacuucauaaagaugucucacagcccuggggacaccugcccagu

SEQ ID NO: 148090 - RNA, 62 nt, Human
accugauacuguaaacauacuguaauaauaaugucucacauggaaacagaaaacgcuggguc

SEQ ID NO: 148091 - RNA, 62 nt, Human
auguucagguggucaguguucuacucagaaaugucucacagcccagcuggguugcaauucca

SEQ ID NO: 148092 - RNA, 62 nt, Human
accauuuuaagccucuaaaagaccucgggcaagucucacagaaacugagcugcagacgggga

SEQ ID NO: 148093 - RNA, 62 nt, Human
cccuucucugggugugggcccuuauugcagcugucucacagccugagcugugguacagagaa

SEQ ID NO: 148094 - RNA, 62 nt, Human
cacuggugugaaugaaagagagacccagccgcgucucacacagguggaauugcacuucuuaa

SEQ ID NO: 148095 - RNA, 62 nt, Human
uaaaagaaaguuagguuauaagaaacagaggcgucucacauuuuuacuugguguaauuaaua

SEQ ID NO: 148096 - RNA, 62 nt, Human
uauuguuuggaauuguuuuaaagucaguuugagucucacaagaagguaaguagaguuucuua

SEQ ID NO: 148097 - RNA, 62 nt, Human
ccccaguuuccuggcgaugagccauuuauugugucucacaccagccucauuuccaacuccga

SEQ ID NO: 148098 - RNA, 62 nt, Human
uuggccuuugggaacuuugcuccaacuggugugucucacacaaugccucccaaaacacugcu

SEQ ID NO: 148099 - RNA, 62 nt, Human
uuccuguacauuuuacagucgcacagcaagcagucucacagaaggcaggcuaguccauucac

SEQ ID NO: 148100 - RNA, 62 nt, Human
uccucugaauuauaauaacauagccagauguagucucacacuguuuuucauacucuuaagug

SEQ ID NO: 148101 - RNA, 61 nt, Human
gacgcuggaaccuguauacacaauaaaggacagucucacagacuucuggaggccgccugcc

SEQ ID NO: 148102 - RNA, 62 nt, Human
auggcugggggagggacugcugacccaccaaggucucacacuccuccugccagcucugucac

SEQ ID NO: 148103 - RNA, 62 nt, Human
cagcuaggccaauaggaacagaccgggaccuugucucacacugaugauaccucacauguuga

SEQ ID NO: 148104 - RNA, 62 nt, Human
cuggaggagaaguauuccuguugcugucuucagucucacagagaagcuccugcuacuucccc

SEQ ID NO: 148105 - RNA, 62 nt, Human
auuugcucucuaaacuucccucuaguuggcaagucucacauauucaucagcaggaguggagg

SEQ ID NO: 148106 - RNA, 62 nt, Human
uuuccccuccugucuucccgguaucccuuggagucucacaagguuuacuuugguaugguucu

SEQ ID NO: 148107 - RNA, 62 nt, Human
ucagauggagcuuccuacucacguugauuuaugucucacaauccuggguauuguuaauucaa

SEQ ID NO: 148108 - RNA, 62 nt, Human
ggcuucuaaugcuucagauagaauacaguugggucucacauaacccuuuacauugugaaaua

SEQ ID NO: 148109 - RNA, 62 nt, Human
ucucugucuagaaauaccauagaccauauauagucucacauugauaauugaaacuagaaggg

SEQ ID NO: 148110 - RNA, 62 nt, Human
cuaauuucauuuuacaguguauguaacgcuuagucucacagugucuuuaacucaucuuugca

SEQ ID NO: 148111 - RNA, 62 nt, Human
cacuuccuguuugggccccucucccauccagugucucacagcccugcuuaccagauaaugcu

SEQ ID NO: 148112 - RNA, 62 nt, Human
gaaaacucuaugcuggccacugauuccuuugagucucacaaaacccuacuuaggucaucagg

SEQ ID NO: 148113 - RNA, 62 nt, Human
uaauacuaggagaagacugaaucauuaaugaugucucacaaauuacuguguaccuaaguggu

SEQ ID NO: 148114 - RNA, 62 nt, Human
ugugucuccuuucccccgaaguagaugaaacagucucacauacccaacugcucaucaacaga

SEQ ID NO: 148115 - RNA, 62 nt, Human
uacaauaucuuuaaaugaacacacgaguguaugucucacaauauauauacacaagugugcau

SEQ ID NO: 148116 - RNA, 62 nt, Human
auauagcaguguagcuguucucucuagauggugucucacaauggauuucuguugcuugacua

SEQ ID NO: 148117 - RNA, 62 nt, Human
accuuuuuccuccguuuuuuuuuugagauggagucucacacagucacccgggauuggaaugc

SEQ ID NO: 148118 - RNA, 62 nt, Human
uaaaguuccagaauaaucuccuuugacuccaggucucacauccaggucauacugaugcaaga

SEQ ID NO: 148119 - RNA, 62 nt, Human
aacuaaucaggcaggaaaaaagcccagccacugucucacagauuguuuuuuguauauuguag

SEQ ID NO: 148120 - RNA, 62 nt, Human
accuguuaaaagccacgcagcagacucauggggucucacaaauccguguccgggugcgcucc

SEQ ID NO: 148121 - RNA, 62 nt, Human
agaaugcuccaugcuauuuuauggaaacuuuggucucacauccguagcugauuauccucuuu

SEQ ID NO: 148122 - RNA, 62 nt, Human
aauaaugcaaaaauugcacaguggaagaaggggucucacaaaaagcaauccauccuguagua

SEQ ID NO: 148123 - RNA, 62 nt, Human
uuuugugaaugguguucagccuauaagacgaagucucacaagaccuauaggaaaguuuacca

SEQ ID NO: 148124 - RNA, 62 nt, Human
uugcauauugcccaauaagcagaagccauaaggucucacacuuuucuuauaaugcaauagaa

SEQ ID NO: 148125 - RNA, 62 nt, Human
ccucuucugauaguuggggaaacugaggccuugucucacaguuggaugcuuuucccaguugu

SEQ ID NO: 148126 - RNA, 62 nt, Human
gcugauacacagcacacagggaaaggaagacagucucacagaggaagggcagguguccuacg

SEQ ID NO: 148127 - RNA, 62 nt, Human
caacaaguagcuaaagucuggcuaugcucacagucucacaucugguuggggugggcuccuua

SEQ ID NO: 148128 - RNA, 62 nt, Human
guuuucuagcauguuuccuuuuacuugguucugucucacaaagcugggagguagaugauucu

SEQ ID NO: 148129 - RNA, 62 nt, Human
uuuauggauauacaagcaaaugggaauguagagucucacauucucucuuuauacacaaaagu

SEQ ID NO: 148130 - RNA, 62 nt, Human
agacacaggaaucacuguuuuccuugaccagggucucacacccuggaggaauguuaaguaag

SEQ ID NO: 148131 - RNA, 62 nt, Human
ucugcaacuuuaagcagcucuugcuaaucagugucucacacuggcguagaaguuuuuguacu

SEQ ID NO: 148132 - RNA, 62 nt, Human
uaguagacccauuuuacaggugagagaaccaagucucacagaggccuggguucaagucccac

SEQ ID NO: 148133 - RNA, 62 nt, Human
caaaugucugaguaaacagauaucccuuccaagucucacaccucccuuagucccacucuugc

SEQ ID NO: 148134 - RNA, 62 nt, Human
acgucccaucaacaaagcaucgaugauggacagucucacacuauuuuuaucauauguuucuu

SEQ ID NO: 148135 - RNA, 62 nt, Human
aggacaagaagucuauuguuuggacuguguuugucucacaaucaccacaaaauaaaagugua

SEQ ID NO: 148136 - RNA, 62 nt, Human
uaacucauaggugcauucuuuuuuucuuuggugucucacaaauuacccaauuguugaauaaa

SEQ ID NO: 148137 - RNA, 62 nt, Human
gugagaguucccucaucugaaaucauguaucugucucacaaauacaagcauaaguagaagau

SEQ ID NO: 148138 - RNA, 62 nt, Human
aaagaauaauuuggaaucagcuaugcaaaucagucucacaauagcgugagcuaacugagaga

SEQ ID NO: 148139 - RNA, 62 nt, Human
cauuuuuagaaaggggcaguuuaaagcacaaugucucacaugggacaaaguuccaaaaugcc

SEQ ID NO: 148140 - RNA, 62 nt, Human
uaagcuaugaguugaaauguucugucaaaugugucucacaucuacacguggcuuggaggcuu

SEQ ID NO: 148141 - RNA, 62 nt, Human
aguuggggugaugggcuucuuucugcacuggagucucacaucuguuagcuuugacacucaag

SEQ ID NO: 148142 - RNA, 62 nt, Human
acuuuacugccgagaaacuuucaguagaugaagucucacaguuggugauuucuccgcucugu

SEQ ID NO: 148143 - RNA, 62 nt, Human
ucugccuaauagggucccccagggccccaccugucucacaagaacuucacucaaccccgugc

SEQ ID NO: 148144 - RNA, 62 nt, Human
caaaguuguguuucuuuuguguccuuaagcuugucucacaagaaagaugccaggccucuaaa

SEQ ID NO: 148145 - RNA, 62 nt, Human
augaauaaauggacaaaugaguaaaugagaaagucucacaccaugaaagaugcuaguccaau

SEQ ID NO: 148146 - RNA, 62 nt, Human
auauacugagguuugaguuucacuuucuuuaagucucacauugcuaacaugacauuagcugu

SEQ ID NO: 148147 - RNA, 62 nt, Human
uucccagcuuaaauuaacaauuguuaguauuagucucacacauaagugccauacauuuuauc

SEQ ID NO: 148148 - RNA, 62 nt, Human
agacuuacuuuuaaauauacucuuuggaguuagucucacaauguccauuccccuagcuccug

SEQ ID NO: 148149 - RNA, 62 nt, Human
ucucagccacucuucuuaaugaggcucccccugucucacauugaguugggcccauugguuau

SEQ ID NO: 148150 - RNA, 62 nt, Human
gacccaccagagccuauagaaucaauuccuuggucucacagccauguagacaagcccugguc

SEQ ID NO: 148151 - RNA, 62 nt, Human
auuuaccuuccuucccuuccugcucccagacagucucacaaguaaacaccagcagcucauag

SEQ ID NO: 148152 - RNA, 62 nt, Human
uuuuauccauagccauugcucccuugucaagugucucacaaggacauggaagaauguguuau

SEQ ID NO: 148153 - RNA, 62 nt, Human
aaaacucaaaggcucuuuucagagccacucaagucucacauaaagagcuuuaauauugaauu

SEQ ID NO: 148154 - RNA, 62 nt, Human
uucagacaucuccaaacucauccuuguguauagucucacacccuuccccauaaguauaaaug

SEQ ID NO: 148155 - RNA, 62 nt, Human
aaauugcagcacuacuuuaaauauuagauuaugucucacauagcacugcucauuuuacuuuu

SEQ ID NO: 148156 - RNA, 62 nt, Human
gucaagaugggcaacucagauggagcagcuuagucucacaguuugcuugucuauuuauuuua

SEQ ID NO: 148157 - RNA, 62 nt, Human
agccuuguccacacacacaucucacgccccuggucucacagccucacaccuuguccuuccac

SEQ ID NO: 148158 - RNA, 62 nt, Human
aggaguggccaugugagggcauggagucauuagucucacaaacacacuuuggacugaagagg

SEQ ID NO: 148159 - RNA, 62 nt, Human
cggguaugcaagccuaaaucuuuguacacuuugucucacagaauaguucugaggcuccauga

SEQ ID NO: 148160 - RNA, 62 nt, Human
gaucuucuuggagcgagcagaugcaaucucuugucucacaugcuagcaacauaccagguaac

SEQ ID NO: 148161 - RNA, 62 nt, Human
uugccauuuauuuaguaccagacauagugcuggucucacagcuuaauauuugguaaugaaua

SEQ ID NO: 148162 - RNA, 62 nt, Human
aagagaagagcucugcacuucccuuuguuguagucucacaguauaacagauauucuaauucu

SEQ ID NO: 148163 - RNA, 62 nt, Human
uguuuacauaagagaaagaggccagacauggugucucacacguuuaaucccagcacuuuggg

SEQ ID NO: 148164 - RNA, 62 nt, Human
auccacagcauucaaggucaggucuacucaaagucucacauggaaaagugaguucugccuuu

SEQ ID NO: 148165 - RNA, 62 nt, Human
cccuaucuucagguuaccauugcgcccucagggucucacaccuugggguugucagguucccg

SEQ ID NO: 148166 - RNA, 62 nt, Human
ucuuauuauacauguuaacaccuuuuacaguugucucacaggucuuggauauuucauucuau

SEQ ID NO: 148167 - RNA, 62 nt, Human
ggugcuaacuguaugugucuuuaucagugauggucucacagagccaacucacucuuaugaaa

SEQ ID NO: 148168 - RNA, 62 nt, Human
ccugccagggaggcagcuaccucgggaggaaggucucacaucugucucugggcacccaugcu

SEQ ID NO: 148169 - RNA, 62 nt, Human
uucuaggcccuuuucuaugucuuuacaucucugucucacacacacacacguauacacacaca

SEQ ID NO: 148170 - RNA, 62 nt, Human
gcagcggguagggcacagggaagagggagggugucucacaaccaaccaguucagaaugauac

SEQ ID NO: 148171 - RNA, 62 nt, Human
ggcaaaagucacuaucaaaugguugcuuauuugucucacacagccauauaguuuuuccugga

SEQ ID NO: 148172 - RNA, 62 nt, Human
ugcugugguuuugucccuugccuuccugccuagucucacaugucccuguuccucuuccccug

SEQ ID NO: 148173 - RNA, 62 nt, Human
ugcugugauuuugucccuugccuuccugccuagucucacaugucccugucccucucgcccug

SEQ ID NO: 148174 - RNA, 62 nt, Human
augcccguuccccucugccuggcagaaucacagucucacauacugucuuguacugacacauc

SEQ ID NO: 148175 - RNA, 62 nt, Human
aaccacucagagauggaucccauucccuaaaggucucacagcaaaggagcaggacucccagg

SEQ ID NO: 148176 - RNA, 62 nt, Human
cauccggagaauugccucuaccuggaccuuuugucucacacagcaguacccugaccugcugu

SEQ ID NO: 148177 - RNA, 62 nt, Human
uuuauauugagauucuuuguggcuauuggugugucucacaggcaaaauuugauuuggcuaaa

SEQ ID NO: 148178 - RNA, 62 nt, Human
aaaaauuuuuuuagaugauucuauauaacuucgucucacaaauaguguagguaucuggguuu

SEQ ID NO: 148179 - RNA, 62 nt, Human
uaaaccuccaaaaugaucaccuuugacuccacgucucacaaucaucucucucaaguucgaag

SEQ ID NO: 148180 - RNA, 62 nt, Human
gauucuugccucuagcaaugacaaccugugaugucucacaguagagcacuuagcgcagaauc

SEQ ID NO: 148181 - RNA, 62 nt, Human
augacgaugccgugugucucgucuccugacaugucucacagacgcuccugaaguuaggucau

SEQ ID NO: 148182 - RNA, 62 nt, Human
augugucacuggauuaauuuaucugauaaugugucucacaagaaucuguuagaucguuuauu

SEQ ID NO: 148183 - RNA, 62 nt, Human
uucccccauauuguucuugugguagugaauaagucucacaagaucugaugguuuuaucaggg

SEQ ID NO: 148184 - RNA, 62 nt, Human
ucuagcgcauuugauuucuccagguuugcugugucucacagaggcaguaggaacccagcucu

SEQ ID NO: 148185 - RNA, 62 nt, Human
cugucccucuucaggaagaaagagcucauucugucucacaagccaccggcauccuguaucag

SEQ ID NO: 148186 - RNA, 62 nt, Human
cagcccugggacccuccgaggugggugugcgggucucacaggugcuuccugggacuuccugu

SEQ ID NO: 148187 - RNA, 62 nt, Human
cugcggaaggggucaggcucaacugcugaugugucucacacguagcagacaaggggugucug

SEQ ID NO: 148188 - RNA, 62 nt, Human
acugcaccagccuggcaacagagcaagacuccgucucacaaaaaugaauaaauaaaauaaaa

SEQ ID NO: 148189 - RNA, 62 nt, Human
cucuccaugcccugggucacuuccuuuuuugggucucacagaccccuccaggggcugacacc

SEQ ID NO: 148190 - RNA, 62 nt, Human
aggugaaacauuuucucccuggauuuuuaccagucucacaugauuccagccaucaccuuaga

SEQ ID NO: 148191 - RNA, 62 nt, Human
uucuuuuacaaugaaaggggugaagagugagggucucacaguuccuuaccucaaagucccuu

SEQ ID NO: 148192 - RNA, 62 nt, Human
gacacagccccauguacacggccucaagggaugucucacauccucugucuauuugagacuua

SEQ ID NO: 148193 - RNA, 62 nt, Human
ugcauugcugcauccugggaaggggguauauggucucacaaguuguugucauuguuuuuuug

SEQ ID NO: 148194 - RNA, 62 nt, Human
uaauugaugcauuguggccccugaucuucccugucucacacuucuuuucucccaucccgguu

SEQ ID NO: 148195 - RNA, 62 nt, Human
uucagaaaccaaggcuaagggacuggucuaaagucucacagguaguauaugguggagccaac

SEQ ID NO: 148196 - RNA, 62 nt, Human
guugguucaaggacaacaccagaaugaagagggucucacaagacaccuguuauccucuucuu

SEQ ID NO: 148197 - RNA, 62 nt, Human
agaggccgguagggcaggggcugcuaguggcugucucacauacaccaguaauccuguuaaag

SEQ ID NO: 148198 - RNA, 62 nt, Human
gagggugaauguuucuucuuucucaucuacucgucucacacugagugguguuagucacugag

SEQ ID NO: 148199 - RNA, 62 nt, Human
cugcuuugcucuguaucuggcuggacugaucugucucacaagaagccaugaggccauaggga

SEQ ID NO: 148200 - RNA, 62 nt, Human
uuuuuguuuauguguuuguuuuuugagacagagucucacacuguggcccaggcuggacucca

SEQ ID NO: 148201 - RNA, 62 nt, Human
ccagguauaaauguuucucuuuuuuuaaacaugucucacauagaguaucuccgaaugcagcu

SEQ ID NO: 148202 - RNA, 62 nt, Human
uuguacaauugagaucaagugaauuggccccggucucacauuuucagugaagucagacucag

SEQ ID NO: 148203 - RNA, 62 nt, Human
gcaaaauuagaccucaagucugccucuacugugucucacaucaccauguagaagaaugggcg

SEQ ID NO: 148204 - RNA, 62 nt, Human
uacucuucauugaauuuaguuugucuaaaauagucucacagguaaaaaacauaacaacaaug

SEQ ID NO: 148205 - RNA, 62 nt, Human
agaagaagcagagcucuaguuuagccuuucuugucucacagaugugcuguaucccaggcaua

SEQ ID NO: 148206 - RNA, 62 nt, Human
ggugacaguuugugacauucugucuucaugaggucucacagucgacgcuccuguaaucauuc

SEQ ID NO: 148207 - RNA, 62 nt, Human
gaaaauuacgacaguuaagggcugggugcggugucucacaccuguaaucccagcacuuuggg

SEQ ID NO: 148208 - RNA, 62 nt, Human
ccugucucagcaccuccucccccaauucccaggucucacaucccaccccuccugcccuccaa

SEQ ID NO: 148209 - RNA, 62 nt, Human
cuuuuuuucugaaucugcuguucuacccaugugucucacauucauuuguauuauuucaagaa

SEQ ID NO: 148210 - RNA, 62 nt, Human
ucugugaaaaacuuguauacacaagcguccaugucucacacaaauauugaugugauuauucu

SEQ ID NO: 148211 - RNA, 62 nt, Human
uugagccugcagcacacacuaggccaccugcagucucacaggccaugcccuggguagacagg

SEQ ID NO: 148212 - RNA, 62 nt, Human
aaagauaauuauaguuacauguauugauuuaagucucacacacugugcuaauaaguccuuug

SEQ ID NO: 148213 - RNA, 62 nt, Human
cugagcaggaccucugaaacccuggaccaguggucucacauggugcuacgccugcauguaaa

SEQ ID NO: 148214 - RNA, 62 nt, Human
ggcuuugcucuuucagugagcuaggcaaucaagucucacagauugcugccucagagcaaugg

SEQ ID NO: 148215 - RNA, 62 nt, Human
uuauuuagcaagcccagaccuuccggucuaacgucucacaccacgacggacuccccuuccua

SEQ ID NO: 148216 - RNA, 62 nt, Human
aaaagagcauuugccuucuuuaaugaaugauggucucacaauucaguugacuuugaccuaau

SEQ ID NO: 148217 - RNA, 62 nt, Human
augaaauaauacuucagccaccagguuuuucugucucacauacauaagcagcauuucauugc

SEQ ID NO: 148218 - RNA, 62 nt, Human
aauaagagccugaagcaaugcuuacaauagaugucucacacagaacaauacaaauauguaaa

SEQ ID NO: 148219 - RNA, 62 nt, Human
uuuuguugaguuuucacucuucuaaugcaagggucucacacugugaaccacuuaggauguga

SEQ ID NO: 148220 - RNA, 62 nt, Human
cgaggccuacaacuuaggggcuggaaucacaggucucacauagagaaauagccagcuugaau

SEQ ID NO: 148221 - RNA, 62 nt, Human
cucauuacaccuauauuagcuugcuugaaguugucucacagcucacuuguauucuguugacu

SEQ ID NO: 148222 - RNA, 62 nt, Human
gcacacuggaucaaaaugcugcuuuccucugugucucacagcuuggcugagcucugucucug

SEQ ID NO: 148223 - RNA, 62 nt, Human
ucaaacagcuuccugaauuuuaauuuuguguugucucacagaaagccuuaucauaaauucca

SEQ ID NO: 148224 - RNA, 62 nt, Human
cuuuaaaaacuacaucuuuccuaugcaagagugucucacaugugcuuaaccgaggugcuucu

SEQ ID NO: 148225 - RNA, 62 nt, Human
ccucaggcuucugcagcccagggcacuagaacgucucacacucagagccggcuggcccggga

SEQ ID NO: 148226 - RNA, 62 nt, Human
aaggcauuuacucuaugucggggggucccugugucucacagcgguaaucguguguugcaucg

SEQ ID NO: 148227 - RNA, 62 nt, Human
ugcacauggccacucuuggccuaauaaaggaggucucacagucuucugucugggaugugcgc

SEQ ID NO: 148228 - RNA, 62 nt, Human
ccuagccauggugaaugaccagggcgaaguuagucucacagaauaccagggcuagaagacau

SEQ ID NO: 148229 - RNA, 62 nt, Human
aguccuggcagugccguggauggcggcaggaagucucacaucauagaggaccccuccuccuc

SEQ ID NO: 148230 - RNA, 62 nt, Human
aguugcauuuguugagacuuuaauggagauuugucucacaagugggaaagacugaagaaaca

SEQ ID NO: 148231 - RNA, 62 nt, Human
agagacagggucucaccauguuggccaggcuggucucacacugaccucaggugauccacccg

SEQ ID NO: 148232 - RNA, 62 nt, Human
aggccgaccuucucggaaaauucacccuaaaagucucacaaaagaaugaguucauggggaga

SEQ ID NO: 148233 - RNA, 62 nt, Human
cgucugcucuucagugaagaagcugguuuagagucucacagaaaacuuuugacuguauuuau

SEQ ID NO: 148234 - RNA, 62 nt, Human
gccuuacucauuucuaagugcaauaagggagugucucacaggauugcaccugugacauccug

SEQ ID NO: 148235 - RNA, 62 nt, Human
cccucagcucccacaagcuacccugggugacagucucacaucacgacccggagguccccuuc

SEQ ID NO: 148236 - RNA, 62 nt, Human
cagccaacuuuugcauguuuuguagagauggggucucacaguguugcccaggcuggucucaa

SEQ ID NO: 148237 - RNA, 62 nt, Human
gcagggcaugguggacaguaaugcugaguucugucucacacugaucaggcucagggccagag

SEQ ID NO: 148238 - RNA, 62 nt, Human
auuuugcuugccuggaauuuuaaaguucuuccgucucacaacucacaagaaacuuucugggu

SEQ ID NO: 148239 - RNA, 62 nt, Human
aauucuuggucuaugauaaauaaaguucaguagucucacauuccccaucuauuacccuaggu

SEQ ID NO: 148240 - RNA, 62 nt, Human
cucaguaaccccaucaacuugguggcccuggugucucacacuuguauccuucugcccucgag

SEQ ID NO: 148241 - RNA, 62 nt, Human
uuguaaggaagcgguggcggcuggugaagcaagucucacaugucggcguucuuggccaaugg

SEQ ID NO: 148242 - RNA, 62 nt, Human
ggccuuacgaagguuaagagaacuuuccccgugucucacagguagguagaggcagagcugga

SEQ ID NO: 148243 - RNA, 62 nt, Human
gaaugaguuaaauaucauugauagucuugugugucucacauaucagcuuuuucauaaggaaa

SEQ ID NO: 148244 - RNA, 62 nt, Human
caaggaaaaauacugaauuaguaauuuuaaaagucucacaaagaaaaucccaggccuagaug

SEQ ID NO: 148245 - RNA, 62 nt, Human
cacugucacauagacagcccugcaugcccccugucucacacaguuuguaaugaagacagcuc

SEQ ID NO: 148246 - RNA, 62 nt, Human
ccuuaauuucuuaguccucaccagaagaacaggucucacaaguauauauuugaugucuguaa

SEQ ID NO: 148247 - RNA, 62 nt, Human
gaggcacauucgugcacauucucacagacaccgucucacacguuggcuuuggacaaccaggc

SEQ ID NO: 148248 - RNA, 62 nt, Human
ugccaggagcccccuuucaggacacagcgggggucucacacuugcuguccccauccauggcc

SEQ ID NO: 148249 - RNA, 62 nt, Human
uuacagguuuucuugcagcugguaccauccaugucucacagcccuggccacugacagaucag

SEQ ID NO: 148250 - RNA, 62 nt, Human
uauauauauauguucuuguuuuuugagacagagucucacacuguugcccaggcuggagugca

SEQ ID NO: 148251 - RNA, 62 nt, Human
augagucacugaaaggccuucauggucucucggucucacaaggaccucuuaaccccucaaua

SEQ ID NO: 148252 - RNA, 62 nt, Human
augugcaaggauucccuucauguaaauucuuggucucacaugacacuuggucauucuuccag

SEQ ID NO: 148253 - RNA, 62 nt, Human
caaaaaguuuacuuucuucauggauauucuuggucucacauacuuguaaucaaguuuuucca

SEQ ID NO: 148254 - RNA, 62 nt, Human
ucuaaggauuacuuuuuuaaggaacauugucggucucacaugaugcuuguaaugaauuuuuc

SEQ ID NO: 148255 - RNA, 62 nt, Human
gaagagcccaggggcuggucccagaacaggcagucucacaagcacgcagcacacuggagugg

SEQ ID NO: 148256 - RNA, 62 nt, Human
augccgggcccucacucucucgccuguucugugucucacaugcuuuuucuuucaaaauuggg

SEQ ID NO: 148257 - RNA, 62 nt, Human
ugcuaagcuuucacuuauuuccuauuguguuggucucacaacacaccaauccugauacaaug

SEQ ID NO: 148258 - RNA, 62 nt, Human
aaguucucuuggcagaucuggguaaugugugugucucacauuuuuaucauguuuuuaugacu

SEQ ID NO: 148259 - RNA, 62 nt, Human
ugagucucagagcaggggaguggcuucccaaggucucacagcuuguccccaggggccaggca

SEQ ID NO: 148260 - RNA, 62 nt, Human
auuuucaaggagcuaaaagaagauuuuaaauggucucacaaaaacagauaaauauuugcaca

SEQ ID NO: 148261 - RNA, 62 nt, Human
guuuauguuaagaggauugggccaggcguggugucucacaccuguaaucccagcacuuugag

SEQ ID NO: 148262 - RNA, 62 nt, Human
acaccuaacuguguggcagaggcuucauuuaggucucacaacucacuagacaucaaaaugug

SEQ ID NO: 148263 - RNA, 62 nt, Human
gcuccucugauggggaacacccugaaguagucgucucacaaaggcuuuccuuggccacagug

SEQ ID NO: 148264 - RNA, 62 nt, Human
aaagagggacuacauauuucaggauauuguuggucucacaugacucuugauagaguuugcca

SEQ ID NO: 148265 - RNA, 62 nt, Human
guuuucuuuucuuuuuucuuuuuugagacagggucucacacugucacccaggcuggagugca

SEQ ID NO: 148266 - RNA, 62 nt, Human
ccaauuccagagcugucuggugaucacuuuaugucucacagggacccacauccaaacaugua

SEQ ID NO: 148267 - RNA, 62 nt, Human
cggacagggccacauuugcaugagacauggcugucucacaggucacagagccauuacaacag

SEQ ID NO: 148268 - RNA, 62 nt, Human
cucauuccccaccuucaacucccaccuuacaugucucacacuaucccaugguuggcauuaca

SEQ ID NO: 148269 - RNA, 62 nt, Human
guggggagaauugagaauagucaggccuaucagucucacagaaucaccccucuaccuuugau

SEQ ID NO: 148270 - RNA, 62 nt, Human
cuuagggaugugcuugcaaacccuucucaagggucucacaaccccaacaucuucagacuggc

SEQ ID NO: 148271 - RNA, 62 nt, Human
uguucccgauuuacuaaaauagguaaccaggcgucucacagucgccguccugucaagagcgc

SEQ ID NO: 148272 - RNA, 62 nt, Human
gcacccccucuaguucuaauaaagccgccucugucucacaccaaccucuguccugucugugg

SEQ ID NO: 148273 - RNA, 62 nt, Human
uugcugcuguaucuccuggccucugcuuuugugucucacaaaaacagagcuugucucaccau

SEQ ID NO: 148274 - RNA, 62 nt, Human
gcugccagagaaaguuggugcugcucauacuggucucacagucuaaguaagugucugugaug

SEQ ID NO: 148275 - RNA, 62 nt, Human
uucuucuucccauggugcuuuccuguuucucagucucacauuucucaacaaggcaaaaacaa

SEQ ID NO: 148276 - RNA, 62 nt, Human
cgggguguguguguggcguugaucuuuagccugucucacaccaguucagaaaacacuagacc

SEQ ID NO: 148277 - RNA, 62 nt, Human
cuaauaauuucugccaucuuuauaauuucuuugucucacagaagacuaggagaaagaucuuu

SEQ ID NO: 148278 - RNA, 62 nt, Human
ucauuaauuucaccuuuuuggagguguacagggucucacacauaaauuauugugcauggcau

SEQ ID NO: 148279 - RNA, 62 nt, Human
agaauacaagaaauguuucuggagcuaguuaugucucacaauuuuguagaaucuuacagcau

SEQ ID NO: 148280 - RNA, 62 nt, Human
ucaacggguuuccuaccuguagaauucuggcagucucacaaucuucuuucauuuuuuucugu

SEQ ID NO: 148281 - RNA, 62 nt, Human
gccucacaauugugguggaaggugaaaggcaugucucacauggcagcagacaagagaagaaa

SEQ ID NO: 148282 - RNA, 62 nt, Human
uauuagaguauauuagggaaaguguguauuuggucucacaggcuguucagggauaaucuaaa

SEQ ID NO: 148283 - RNA, 62 nt, Human
ucucagaggaccagagugacugaggguaaagugucucacagcccaugcugaauuuucugcau

SEQ ID NO: 148284 - RNA, 62 nt, Human
uuuugcuuauauguacuuuuuaaugaacacgugucucacacacaaaaagaauuaaggauuuu

SEQ ID NO: 148285 - RNA, 62 nt, Human
auaaaguacuaagggaucaugcuuauccuagggucucacagaagagaggacauauuuaauua

SEQ ID NO: 148286 - RNA, 62 nt, Human
gggccacucaccgaccugagucaguguccucugucucacagggccccucucccuucuguuca

SEQ ID NO: 148287 - RNA, 64 nt, Human
agcuugcucccaccugcccccuccacuucccucagaugaugaggagccagggcuaagggggcag

SEQ ID NO: 148288 - RNA, 64 nt, Human
ccacaggcccgcuaagccccaaaggcaggaucuagaugaugaugaacaugauuaugaagaaaua

SEQ ID NO: 148289 - RNA, 64 nt, Human
caggcccgcuaagccccaaaggcaggaucuagaugaugaugaacaugauuaugaagaaauacuu

SEQ ID NO: 148290 - RNA, 64 nt, Human
cugccugccugccugccugccugucugccuaugugaugaugaaaucucugcauggcugcaauga

SEQ ID NO: 148291 - RNA, 64 nt, Human
agucaagaucaacauuccaggguugguaauguuggaugaugaaacauucauuuuuaccuugugg

SEQ ID NO: 148292 - RNA, 64 nt, Human
auuuugagaaugguaaagaaauacacagggaggggaugaugacuauuaguggacucuuguuuuu

SEQ ID NO: 148293 - RNA, 64 nt, Human
uuuuugauaauuuaaauauugcugcugcuuuguagaugaugagaagaaauguuaaagugcuuuc

SEQ ID NO: 148294 - RNA, 64 nt, Human
gcccaagggcuccagacacaccugaacacaucgugaugaugacguccucucaacucucuuugua

SEQ ID NO: 148295 - RNA, 64 nt, Human
gugaaaugguuacagcuauuauagucauuucacagaugaugaaacuaagauucagagcagcuga

SEQ ID NO: 148296 - RNA, 64 nt, Human
uuuaaugauguuauucuagaauguuuucuuuccagaugaugauucagaagcuaauuuuaaaaaa

SEQ ID NO: 148297 - RNA, 64 nt, Human
acguggugucucacucugaaaagcaggaauguaagaugaugaaagagacaauguaauacuguug

SEQ ID NO: 148298 - RNA, 64 nt, Human
auucuuggaaaaguggcaagaccaaaaugacaaugaugaugauaaugaugaugacgacgacaac

SEQ ID NO: 148299 - RNA, 64 nt, Human
guggcaagaccaaaaugacaaugaugaugauaaugaugaugacgacgacaacgaugaugcuugu

SEQ ID NO: 148300 - RNA, 64 nt, Human
gaugucugggaugugaagaggcaaggcagaaauggaugaugaacaucaaaaacugucagaggac

SEQ ID NO: 148301 - RNA, 64 nt, Human
uauauuugaaaugaaaaucuccaacacauuagaagaugaugauguuagaugcccaucgugugcc

SEQ ID NO: 148302 - RNA, 64 nt, Human
gacaguagagaaugugagaggaucucaugguucugaugaugauuauccaacaaacaucuggccc

SEQ ID NO: 148303 - RNA, 64 nt, Human
cagucucauacugagugauuugaguagaaccacugaugaugauuuuauaaauugugugaagcga

SEQ ID NO: 148304 - RNA, 64 nt, Human
auuucaccucuccagacuuccauuucuucacaaggaugaugauggaaauaaaaugacuggcgug

SEQ ID NO: 148305 - RNA, 54 nt, Human
auaugaaguucauuuuuuagacuugaugaugaaugaagaaugcauggaggacug

SEQ ID NO: 148306 - RNA, 64 nt, Human
gugugagaugguaugcauuucuguagugauuagugaugaugagugauuuuuauaugcuuuuuaa

SEQ ID NO: 148307 - RNA, 64 nt, Human
aguaauucucuauaccaagauaugcuaggaguaggaugaugauucaaagugguaacccaaauuc

SEQ ID NO: 148308 - RNA, 64 nt, Human
auaaucugucuguucccuggagaugggaauagaggaugaugacaguuuauuuucuacacuuccc

SEQ ID NO: 148309 - RNA, 64 nt, Human
uaaugugauaugaaaauaucuggguuuuucuuuugaugaugaaguauugcuaauauuaccgugg

SEQ ID NO: 148310 - RNA, 64 nt, Human
auucuccagaaggaacuugggagaugauggugcagaugaugaaacuggguucaucccaguucca

SEQ ID NO: 148311 - RNA, 64 nt, Human
ccuacuagauggacaggcugagguguuuggcagugaugaugaccacauucaguuugugcaggua

SEQ ID NO: 148312 - RNA, 64 nt, Human
uucuccuaagaaaaauccgcugugggcagagaacgaugaugauuuaaugguguuuacuccuuua

SEQ ID NO: 148313 - RNA, 64 nt, Human
gaauaaaugaaaccaaucucaauuuagagguauggaugaugacagaaagcccaauagaagcuua

SEQ ID NO: 148314 - RNA, 64 nt, Human
ccaccuugacacaguaacuuccucuuauagucaagaugaugauuaaguguuuaauuuuuauucc

SEQ ID NO: 148315 - RNA, 64 nt, Human
ugagcgugaccuugcaauguucaacauuaacauugaugaugacuacgucccgugucuccagggg

SEQ ID NO: 148316 - RNA, 64 nt, Human
agagcuggguuccuugggaggaaguuguaguggugaugaugaugaugauaaugaugaugaugau

SEQ ID NO: 148317 - RNA, 64 nt, Human
gcuggguuccuugggaggaaguuguaguggugaugaugaugaugauaaugaugaugaugauggu

SEQ ID NO: 148318 - RNA, 64 nt, Human
ggguuccuugggaggaaguuguaguggugaugaugaugaugauaaugaugaugaugaugguggu

SEQ ID NO: 148319 - RNA, 64 nt, Human
aggaaguuguaguggugaugaugaugaugauaaugaugaugaugauggugguguugaugguggc

SEQ ID NO: 148320 - RNA, 64 nt, Human
aaguuguaguggugaugaugaugaugauaaugaugaugaugauggugguguugaugguggcggu

SEQ ID NO: 148321 - RNA, 64 nt, Human
auacaguuuuuuauguaaaauauuaaaagacuaugaugaugacauuuauaaaauggcucuugug

SEQ ID NO: 148322 - RNA, 64 nt, Human
ucaguaguggggaauucugugacagcugauugaagaugaugaugaagaaccucugcauucuagu

SEQ ID NO: 148323 - RNA, 64 nt, Human
guaguggggaauucugugacagcugauugaagaugaugaugaagaaccucugcauucuaguuac

SEQ ID NO: 148324 - RNA, 64 nt, Human
agguuagugacaaaauuggccagagagugggggugaugaugaccaagaauuacaaguagaaugg

SEQ ID NO: 148325 - RNA, 64 nt, Human
uuguauauacuucugcaauuauaagauguuuuuugaugaugaaagcuuuccuaagguaauucuu

SEQ ID NO: 148326 - RNA, 64 nt, Human
uuuaaaggcucuacaauugaaugagcucaccauggaugaugauaccgccgugcucgucauugac

SEQ ID NO: 148327 - RNA, 64 nt, Human
gggagguguacccaacagcucauugagagcgggcgaugaugacaguggcggcuuuguggagugg

SEQ ID NO: 148328 - RNA, 64 nt, Human
uauaugauuuauucacaguuccucaaggccuggggaugaugaucaguuauaccuauuuuugugc

SEQ ID NO: 148329 - RNA, 64 nt, Human
agaguagaaauaaaagugaaugaaagauuaaacagaugaugagaauuucuaaaaagauuagcaa

SEQ ID NO: 148330 - RNA, 64 nt, Human
ggaugaaaagauuucaggcaaagacuugcaggaagaugaugauaacggcgaugugaaucgucaa

SEQ ID NO: 148331 - RNA, 64 nt, Human
aaauuuucuuuguagguuugauccagaucgguuugaugaugaauuaguaaugaaaacuuuuucc

SEQ ID NO: 148332 - RNA, 64 nt, Human
ugcuacuggugcaauuggaucaguguaugauauggaugaugaugaaauggaccccaauuaugcc

SEQ ID NO: 148333 - RNA, 64 nt, Human
uacuggugcaauuggaucaguguaugauauggaugaugaugaaauggaccccaauuaugccaga

SEQ ID NO: 148334 - RNA, 64 nt, Human
caccuuucuacauuuugcugacagauaacuaaccgaugaugaggccgagguaaaagagacaucu

SEQ ID NO: 148335 - RNA, 64 nt, Human
auccuguggugcccccuucccccugccuugugaugaugaugagugagucuccccuuaauuagac

SEQ ID NO: 148336 - RNA, 64 nt, Human
gaaauccuguggugcccccuucccccugccuugugaugaugaugagugagucuccccuuaauua

SEQ ID NO: 148337 - RNA, 64 nt, Human
uagaaguucuaagcgggagaugacucccuacugggaugaugaaggauggcauccuagugaagaa

SEQ ID NO: 148338 - RNA, 64 nt, Human
uguuuucauuaucucaaaacugcacugucaagaugaugaugaucuuuaaaauacacacucaaau

SEQ ID NO: 148339 - RNA, 64 nt, Human
uuuuguuuucauuaucucaaaacugcacugucaagaugaugaugaucuuuaaaauacacacuca

SEQ ID NO: 148340 - RNA, 64 nt, Human
gcacaucagagaaagaaacugcauguuuguuguugaugaugaaauaaaaaugcuagcgacaguc

SEQ ID NO: 148341 - RNA, 64 nt, Human
ccagaagcccucgggcaugcccagugcaccaugggaugaugaaauuaaggagaacagcugaguc

SEQ ID NO: 148342 - RNA, 64 nt, Human
acuggcaguugucaucaaacauaaugaugaguaagaugaugaaugagauguaaaugugccaaga

SEQ ID NO: 148343 - RNA, 64 nt, Human
aaaggaugcuuucggaaaacacgcuguauaccuagaugaugacuaaaugcaaaauccuugggcu

SEQ ID NO: 148344 - RNA, 64 nt, Human
cacaccuccaagaucaagauccuguucugagucagaugaugaugacagcagugaaacuccuccu

SEQ ID NO: 148345 - RNA, 64 nt, Human
accuccaagaucaagauccuguucugagucagaugaugaugacagcagugaaacuccuccucac

SEQ ID NO: 148346 - RNA, 64 nt, Human
ggagaguucaagugaugagcagacgccuagucgggaugaugauagccaguccaggaguccaagu

SEQ ID NO: 148347 - RNA, 64 nt, Human
cuuuauccaaaagcacaucuugugcuccaugcaggaugaugacagaauugaucugauguuacug

SEQ ID NO: 148348 - RNA, 64 nt, Human
aaagaaaugucagacacucuuuggauuugauucagaugaugaaaguaagucuucugucuucuua

SEQ ID NO: 148349 - RNA, 64 nt, Human
uucauggaaaccccacaccaaggcaagaggcagagaugaugauuccauuucauauauacacuca

SEQ ID NO: 148350 - RNA, 64 nt, Human
cuuguuuugugacuggaccacugcccaggugcuugaugaugaccaggagugugcucugggaaug

SEQ ID NO: 148351 - RNA, 64 nt, Human
uaugagcugacuccaaauggacagcccagaagcugaugaugagaauucuuaucacucaccuuua

SEQ ID NO: 148352 - RNA, 64 nt, Human
uuccuugagccuguuuccacaccuguaaaguggggaugaugauccuaucucacugcuuuuguga

SEQ ID NO: 148353 - RNA, 64 nt, Human
auguagguguugagcuccugguuuucuguguuuggaugaugaagauuuggacccuuccauucau

SEQ ID NO: 148354 - RNA, 64 nt, Human
cuccuagaguuuugacuugggacucuaguguuaagaugaugagcccgugcaucagguccuucug

SEQ ID NO: 148355 - RNA, 64 nt, Human
cuuccccuucacaguguacuugcggaagcuguuggaugaugagcagccccugcggcugcggcuc

SEQ ID NO: 148356 - RNA, 64 nt, Human
gcuagaagcuaaauuugccgaguuagaagguggagaugaugauauugaagagaugggagaagaa

SEQ ID NO: 148357 - RNA, 64 nt, Human
auugaagagguuuucacucucugcuaaagugguagaugaugaaauuuacuacuucagguaaagc

SEQ ID NO: 148358 - RNA, 64 nt, Human
cguggccucuguauuugcaaaugcagauaaaggugaugaugagaagaauacagacaacucagag

SEQ ID NO: 148359 - RNA, 64 nt, Human
auggugaaagagagaugccguguuuugaaaguaagaugaugaaaugaauuuuuaauucaagaaa

SEQ ID NO: 148360 - RNA, 64 nt, Human
aaucacaaacucauuuucugguuuuuagaaaguagaugaugauuucagaggaguaaggcaugcc

SEQ ID NO: 148361 - RNA, 64 nt, Human
cuccucucccuacugugacccuggaggcucuuaagaugaugaugguuuuuuuuauugggcugag

SEQ ID NO: 148362 - RNA, 64 nt, Human
caugacagcuaacagggacgggcuuucuuuggaagaugaugaaauuguggaaugaugguugcac

SEQ ID NO: 148363 - RNA, 64 nt, Human
ggcucagaggauagcgguuuccaucauaaaccaagaugaugaguucagccuuuaucccucgugg

SEQ ID NO: 148364 - RNA, 64 nt, Human
gggucagaggauagcgguuuccaucauaaaccaagaugaugaguucagccuuuaucccucgugg

SEQ ID NO: 148365 - RNA, 64 nt, Human
gaggcaagccgccucuucucggccaucgacugcagaugaugaaagagcgggauucaacuuuguu

SEQ ID NO: 148366 - RNA, 64 nt, Human
gaaguaguugagggagagauugggggaauggggagaugaugaugauggucaaagggugcaaaau

SEQ ID NO: 148367 - RNA, 64 nt, Human
guaguugagggagagauugggggaauggggagaugaugaugauggucaaagggugcaaaaucuc

SEQ ID NO: 148368 - RNA, 64 nt, Human
ucuguuuguuuuuuaaacuaugcaccagguuucugaugaugaaauaaagcaccuguuuguuuua

SEQ ID NO: 148369 - RNA, 64 nt, Human
gccucacuggucccagaucagggcuccagggacagaugaugagucucaaacgagccagccaggg

SEQ ID NO: 148370 - RNA, 64 nt, Human
caguugcagauagccuauuuauuauaaauuaugagaugaugaaaauaauaaagccaguggaaau

SEQ ID NO: 148371 - RNA, 64 nt, Human
aauguaauuucguugcuauaguaguuugcuaaaagaugaugaaaaugcagaaugucuuuuuaaa

SEQ ID NO: 148372 - RNA, 64 nt, Human
gaaaaaaacaaaauaaauuuugugugauaauuuugaugaugaaagguggaaguucuaccuagau

SEQ ID NO: 148373 - RNA, 64 nt, Human
guaaaauuacugaauaucagaaaaaauguuaauugaugaugaagcuuauucccaaaaugccuuu

SEQ ID NO: 148374 - RNA, 64 nt, Human
acaguauuaguuuguggcuauaaaugauuauuuagaugaugacugaaaauguguauaaaguaau

SEQ ID NO: 148375 - RNA, 64 nt, Human
ucauugaguauauugcuucaagguacaaacccaggaugaugauguugucaccacugucucuuaa

SEQ ID NO: 148376 - RNA, 64 nt, Human
cugaaguuuuuuaaauuuauggcuauuuuuacacgaugaugaauuuugacaguuugugcauuuu

SEQ ID NO: 148377 - RNA, 64 nt, Human
gauuuaaaaauguauuuuuaaaaauguuuacauugaugaugaguaauauugcauguguuuucag

SEQ ID NO: 148378 - RNA, 64 nt, Human
gcuuuccacaaaaugucaccucgcugcacuaaaggaugaugaauccuaaucauuaaaggaauug

SEQ ID NO: 148379 - RNA, 64 nt, Human
aaauggauuacacauguauacaaagauacgauuugaugaugacacuggcacauuauucuaaacu

SEQ ID NO: 148380 - RNA, 64 nt, Human
acuccauuuugagcaggcugcuuaaagugguggugaugaugaugaugaugauggcagcuuuaua

SEQ ID NO: 148381 - RNA, 64 nt, Human
ccauuuugagcaggcugcuuaaagugguggugaugaugaugaugaugauggcagcuuuauaucg

SEQ ID NO: 148382 - RNA, 64 nt, Human
uuuugagcaggcugcuuaaagugguggugaugaugaugaugaugauggcagcuuuauaucgagu

SEQ ID NO: 148383 - RNA, 64 nt, Human
ugagcaggcugcuuaaagugguggugaugaugaugaugaugauggcagcuuuauaucgagugcc

SEQ ID NO: 148384 - RNA, 64 nt, Human
ucuuggaagagcacccggagcugaagcugucccugaugaugaaggugaaacgucagcccuggcc

SEQ ID NO: 148385 - RNA, 64 nt, Human
cauuagguauuaauugcaugggucuaacuacauugaugaugagaguuuaauuccaacuagagua

SEQ ID NO: 148386 - RNA, 64 nt, Human
cauaaauuucagugccucuuguaagcauuaaacugaugaugaagaaaguuccugauuugagaaa

SEQ ID NO: 148387 - RNA, 64 nt, Human
ucuuuuuacaugggaugaauugugcacuucuacugaugaugacuacagcagaagugauguuaua

SEQ ID NO: 148388 - RNA, 64 nt, Human
uauuucccauaagccccucagaaaggcuaacugugaugaugacacuuugguacaauuuagaugu

SEQ ID NO: 148389 - RNA, 64 nt, Human
cauuuuugugcccccucugcuuacugugacagucgaugaugaaucuugcguugccauuuucugc

SEQ ID NO: 148390 - RNA, 64 nt, Human
agugaugugucuguaucuuuaauguaaauagagagaugaugaaaaaagagucuauuuuaguguu

SEQ ID NO: 148391 - RNA, 64 nt, Human
acuaaacuuauucucucauccgaaguccaaagaggaugaugaagcccugggcuuugccugguuu

SEQ ID NO: 148392 - RNA, 64 nt, Human
uaaacuugauguaauugguuugggagggggcagugaugaugacuucugaaacaaaauuuggauu

SEQ ID NO: 148393 - RNA, 64 nt, Human
uuguucuuuguguuuuaggugcagcucaguggaagaugaugacaaccagaagacaugagcuaag

SEQ ID NO: 148394 - RNA, 64 nt, Human
ugcuugaacauguauuuaggggcaaguuucucaugaugaugaaaaaguaucaagucauauugcu

SEQ ID NO: 148395 - RNA, 64 nt, Human
uauuacugauuggguagagggggaaaaggagaaugaugaugauaguuuccuucugucuauugac

SEQ ID NO: 148396 - RNA, 64 nt, Human
uacacauggagagaugccccauggugggcaggcagaugaugaaguacuggcagguaggcagccu

SEQ ID NO: 148397 - RNA, 64 nt, Human
caaaaggaaauugcaucuugugacuuaguagacugaugaugauauccauuuuguagacucauca

SEQ ID NO: 148398 - RNA, 64 nt, Human
ugaccuuaagagggaagggaaaaaagugugaaaggaugaugaagaaaauaauuuuacuauuucu

SEQ ID NO: 148399 - RNA, 64 nt, Human
cuucaaucaggaagcuauuugccuggcuccagcagaugaugagauaaugagguaguggguuuuu

SEQ ID NO: 148400 - RNA, 64 nt, Human
caucaucaaaacaccaaagacucaagacacagaagaugaugagggagcucaguggaauuguacc

SEQ ID NO: 148401 - RNA, 64 nt, Human
cuuucaggcaaugauuuacaaaaguagcauaguagaugaugacaacugugaacucugacauaaa

SEQ ID NO: 148402 - RNA, 64 nt, Human
aaaucugcugaucucuguagaaucuuagaggcuugaugaugaugguguuggugaaaauaagaaa

SEQ ID NO: 148403 - RNA, 64 nt, Human
aacucuaaaagguuaauuucugucaaaugcaguagaugaugaaagaaagguugguauuaucagg

SEQ ID NO: 148404 - RNA, 64 nt, Human
gaccuuccaaaacauuggcuuugacaucugccaagaugaugauuccauccaccuggaguccauc

SEQ ID NO: 148405 - RNA, 64 nt, Human
gggcaauagagcgagacccugucucuuaaaaaacgaugaugaugaacacagaggacggggcacu

SEQ ID NO: 148406 - RNA, 64 nt, Human
caauagagcgagacccugucucuuaaaaaacgaugaugaugaacacagaggacggggcacugug

SEQ ID NO: 148407 - RNA, 64 nt, Human
agcauauccugagucauuugaccaagacacagaagaugaugaaugggaaaaaaaacauagagau

SEQ ID NO: 148408 - RNA, 64 nt, Human
gauaaguuuucaguaauaauaaccuauuuaaucagaugaugauguguuugaaaauaguguucaa

SEQ ID NO: 148409 - RNA, 64 nt, Human
cugccuuucccaaagugguuagguuuggaaaagagaugaugaugguaauauuuuauuugugcuu

SEQ ID NO: 148410 - RNA, 64 nt, Human
gaauuuuaaaagaugcaauguagaggggaaaagagaugaugaaaauauuuaaaggcccuaucug

SEQ ID NO: 148411 - RNA, 64 nt, Human
auucaagcucucagcuacuccugaaacgggcagagaugaugaacagaaguguauguaaauacag

SEQ ID NO: 148412 - RNA, 64 nt, Human
augauacagccaugcugacauucaucaccgcaaagaugaugauuccagucucugguuccuuucc

SEQ ID NO: 148413 - RNA, 64 nt, Human
gccauggcucuucccagcagccugugcaaauucugaugaugaccccacccccgcacacgcacac

SEQ ID NO: 148414 - RNA, 64 nt, Human
uaucaaaaccugagcuaaaaccaaugcaucagcugaugaugacagcagagaguggcagggcuga

SEQ ID NO: 148415 - RNA, 64 nt, Human
cacagugggcgacagaucugaagugaagacaggagaugaugagaaaagcucaccgcaucagcug

SEQ ID NO: 148416 - RNA, 64 nt, Human
ucaaaggcugcaacccuauggccucuuggagacagaugaugacuggcaaggacuagagagcagg

SEQ ID NO: 148417 - RNA, 64 nt, Human
aauaacccacuagugccugagcucagugcugcuggaugaugagggagaucaagaaaaagccacg

SEQ ID NO: 148418 - RNA, 64 nt, Human
ugguccugcagcagccccuggcaaugagcugccugaugaugagucccaagguacauuguucuac

SEQ ID NO: 148419 - RNA, 64 nt, Human
aauauuaccauucuucuauggaaagaaaacuuuugaugaugaaacaauaaagauuuuaaauauc

SEQ ID NO: 148420 - RNA, 64 nt, Human
cagcaggaagcccaagugaaauuaauauuaugcagaugaugaaagggaccucugaacaggauuu

SEQ ID NO: 148421 - RNA, 64 nt, Human
ugacgaaaugcuuauagagaguagcuccgaccuagaugaugauucuuccuguagcaucuggccc

SEQ ID NO: 148422 - RNA, 64 nt, Human
ggacuguaaaucucucgcagacccugggagcucagaugaugaugauguuaguaguuuggaagaa

SEQ ID NO: 148423 - RNA, 64 nt, Human
cuguaaaucucucgcagacccugggagcucagaugaugaugauguuaguaguuuggaagaagaa

SEQ ID NO: 148424 - RNA, 64 nt, Human
gccuucaggacccagagggcuuccuauucaaggagaugaugaccuggguccagggcccagaccu

SEQ ID NO: 148425 - RNA, 64 nt, Human
cucaaucaagaaugagaagcuugaaugggcaguagaugaugaagagaaaaaaaagucucccuca

SEQ ID NO: 148426 - RNA, 64 nt, Human
uucguuuacuugccuacagugcuguacgcaauaagaugaugaucccaaaauaugguaaagugaa

SEQ ID NO: 148427 - RNA, 64 nt, Human
cgugcaugcaaacagcgauuugcaaagaccguaugaugaugaucaugaucuuacuggugaauua

SEQ ID NO: 148428 - RNA, 64 nt, Human
aggucaaaaaucagauuauuuucauucaaaugaggaugaugagucacuguaauaucaaaaaauc

SEQ ID NO: 148429 - RNA, 64 nt, Human
aaugauaaagcagugauguggauuucuguauucugaugaugagucucuucagaguacugcucau

SEQ ID NO: 148430 - RNA, 64 nt, Human
uaagauguuuguguaaagaaauuucuaauguaaagaugaugauuuugaaaaauuuuauauauuc

SEQ ID NO: 148431 - RNA, 64 nt, Human
gcagcccaguggaaccacaaaaaggccaauuucagaugaugacuguccaagugccuccaaagug

SEQ ID NO: 148432 - RNA, 64 nt, Human
ccauagaagaagcugcagaagaaaugaagaaagugaugaugauuuagauuuugauauugauuua

SEQ ID NO: 148433 - RNA, 64 nt, Human
gagcaagaggaacaugcuuguuuugaaaacucgagaugaugagggugguacaugcaguguguuc

SEQ ID NO: 148434 - RNA, 64 nt, Human
gcauaauuucucaauaucuuuagcacaguauggugaugaugacuuuuaagcauuuacaucacgu

SEQ ID NO: 148435 - RNA, 64 nt, Human
cauuggggcgaaugaaccaaguuucgccaugcuggaugaugaaauggauucccaucccaaaguc

SEQ ID NO: 148436 - RNA, 64 nt, Human
augggaaauuugcugagcccccaccagggaaccggaugaugaaacagggauaccucacagcuug

SEQ ID NO: 148437 - RNA, 64 nt, Human
aaccaccugcguggcuaggaugauuaauuaugaggaugaugauuuuuuuugugauaacaguauu

SEQ ID NO: 148438 - RNA, 64 nt, Human
gaauauagcaauuaccuaugacggauuagaggaagaugaugaggucuuugaaguaauucugaac

SEQ ID NO: 148439 - RNA, 64 nt, Human
auuccuaccuccucuagugcagggacccaaguuagaugaugagaaaaugccaaacaaagggagg

SEQ ID NO: 148440 - RNA, 63 nt, Human
acaaugauggcauuuuaacuuauucaugauuagagaugaugauaugguuuggauauuuguugu

SEQ ID NO: 148441 - RNA, 64 nt, Human
uugccaacaaaucuaguucuauacaguuucuugggaugaugauaauaaacauuuauugagcaau

SEQ ID NO: 148442 - RNA, 64 nt, Human
ugauuaauauuauuaauauaauaaugaugaugaugaugaugaaaacuaaggauuuuucaagaga

SEQ ID NO: 148443 - RNA, 64 nt, Human
auaugauuaauauuauuaauauaauaaugaugaugaugaugaugaaaacuaaggauuuuucaag

SEQ ID NO: 148444 - RNA, 64 nt, Human
aggauaugauuaauauuauuaauauaauaaugaugaugaugaugaugaaaacuaaggauuuuuc

SEQ ID NO: 148445 - RNA, 64 nt, Human
uuaaggauaugauuaauauuauuaauauaauaaugaugaugaugaugaugaaaacuaaggauuu

SEQ ID NO: 148446 - RNA, 64 nt, Human
ccuuggccagggcugacuccuuaaauuucuggaugaugaugauuguuauuuaauagccagaggc

SEQ ID NO: 148447 - RNA, 64 nt, Human
ccaccuuggccagggcugacuccuuaaauuucuggaugaugaugauuguuauuuaauagccaga

SEQ ID NO: 148448 - RNA, 64 nt, Human
ugucuuccgcuagaacaacgucuacaaaugugaagaugaugacuucuggcacgcggucaugagg

SEQ ID NO: 148449 - RNA, 64 nt, Human
agguaaaucagacuaugaaguuuuuuuuauacaggaugaugacuauggaaagaguacucuuguu

SEQ ID NO: 148450 - RNA, 64 nt, Human
guacauucuagugugguguauacugguggcuguugaugaugauuuuuuuuuuuuuacacaauuc

SEQ ID NO: 148451 - RNA, 64 nt, Human
ucguuuguauucuaccuuuguaaaacagccuauagaugaugauguguuugggauacugcuuauu

SEQ ID NO: 148452 - RNA, 64 nt, Human
auuaacuacugaauaaugcuaccaggaugcuaaagaugaugauguuaacccauuccaguacagu

SEQ ID NO: 148453 - RNA, 64 nt, Human
caggguaaggcaggaggaagugggugagcuccgagaugaugagcacaugaagccuguggccccu

SEQ ID NO: 148454 - RNA, 64 nt, Human
gcauaugaagucuuucuucccccaacucuugaacgaugaugauauucagacgaagcauugaugu

SEQ ID NO: 148455 - RNA, 64 nt, Human
uuuaaaauauauaucuuuauaaaguaauauucaggaugaugauaaaaauuguuuauauuguuau

SEQ ID NO: 148456 - RNA, 64 nt, Human
agguauuccguuuaucacaguccacuuaaaaaaugaugaugaugauaaaaaccacgacccaacc

SEQ ID NO: 148457 - RNA, 64 nt, Human
uauuccguuuaucacaguccacuuaaaaaaugaugaugaugauaaaaaccacgacccaaccagg

SEQ ID NO: 148458 - RNA, 64 nt, Human
aagagauaaagcuuacuugacuuucaaauggagagaugaugaaaacccacucauucacucuuuc

SEQ ID NO: 148459 - RNA, 64 nt, Human
aaaauaaucauucuuauuucaugaaaauuguggggaugaugaaauaaguuaacaccuuuaaagu

SEQ ID NO: 148460 - RNA, 64 nt, Human
cauuuagugugaauauuccuuuauuuugcugcuugaugaugagagggagggcugcugccacaga

SEQ ID NO: 148461 - RNA, 64 nt, Human
gaagcaaacauuuuuuucuaagaauugcuucucagaugaugauaucaaauguauaugcuuuugc

SEQ ID NO: 148462 - RNA, 64 nt, Human
gggcuguguuuucgaugaugaugaugaucaugaugaugaugauuuuaacaguuuuacuucuggc

SEQ ID NO: 148463 - RNA, 64 nt, Human
cuggggcuguguuuucgaugaugaugaugaucaugaugaugaugauuuuaacaguuuuacuucu

SEQ ID NO: 148464 - RNA, 64 nt, Human
cuguaaagcaaacuggggcuguguuuucgaugaugaugaugaucaugaugaugaucaucaugau

SEQ ID NO: 148465 - RNA, 64 nt, Human
gggcuguaaagcaaacuggggcuguguuuucgaugaugaugaugaucaugaugaugaucaucau

SEQ ID NO: 148466 - RNA, 64 nt, Human
cuugggcuguaaagcaaacuggggcuguguuuucgaugaugaugaugaucaugaugaugaucau

SEQ ID NO: 148467 - RNA, 64 nt, Human
ugggagcacuuuguaggcauugcaugaaccaugggaugaugauucuguggagguauugccuugu

SEQ ID NO: 148468 - RNA, 64 nt, Human
ugcauuacaacuuguuuucuuauguaauaauaaugaugaugaugaugauaauaauaaauauuuu

SEQ ID NO: 148469 - RNA, 64 nt, Human
auuacaacuuguuuucuuauguaauaauaaugaugaugaugaugauaauaauaaauauuuuuga

SEQ ID NO: 148470 - RNA, 64 nt, Human
acaacuuguuuucuuauguaauaauaaugaugaugaugaugauaauaauaaauauuuuugagug

SEQ ID NO: 148471 - RNA, 64 nt, Human
uuggaaucuagccgauggaaaauaccuaauuguggaugaugauugcgcagggagggguacgugg

SEQ ID NO: 148472 - RNA, 64 nt, Human
cccagcacacaaggaagaccagauguagcuacaggaugaugaaacaugguuucaaacgaguucu

SEQ ID NO: 148473 - RNA, 64 nt, Human
uugcuaccaaacagucauguauuaacucucuuuggaugaugaaguuuaaagagucaauaaauag

SEQ ID NO: 148474 - RNA, 64 nt, Human
aauuuuauucagauaaucuguaccucaucaaucagaugaugacaauuuacuucccaggucucau

SEQ ID NO: 148475 - RNA, 64 nt, Human
ccacgcaaggcugcaccucuguguguugggagacgaugaugauguccauugcugugugauggcu

SEQ ID NO: 148476 - RNA, 64 nt, Human
gauucccguccggugucacaguucagucagugaggaugaugaaguagauacagucuucaggaca

SEQ ID NO: 148477 - RNA, 64 nt, Human
agauaguucaccugugaacgaacaucagcuuacagaugaugaggacuuaagguugcaagaauga

SEQ ID NO: 148478 - RNA, 64 nt, Human
uuuggccagucuuguuuuuuaggcaccuuugcaugaugaugacucuugaacagagcaaaaaaca

SEQ ID NO: 148479 - RNA, 64 nt, Human
uaaauauauauuauauuuaaacauucauggcauagaugaugauuuacagacaauuuaaaaguuc

SEQ ID NO: 148480 - RNA, 64 nt, Human
uucgggcugagcagcugcagggagcccccuuucugaugaugaaacugaugcuugagccccgacc

SEQ ID NO: 148481 - RNA, 64 nt, Human
guauugccuguuaauugcugcuaauucuaauucugaugaugacuccuacuccauuguuuacccc

SEQ ID NO: 148482 - RNA, 64 nt, Human
cacccugcuagaugucaucucuggauugcacauggaugaugaaggaacucagcauugaaaguug

SEQ ID NO: 148483 - RNA, 64 nt, Human
ugggcagaaaaaaguaaaacuugcugcugcugcugaugaugaugaugaugaagaugaugaugau

SEQ ID NO: 148484 - RNA, 64 nt, Human
gcagaaaaaaguaaaacuugcugcugcugcugaugaugaugaugaugaagaugaugaugaugau

SEQ ID NO: 148485 - RNA, 64 nt, Human
gaaaaaaguaaaacuugcugcugcugcugaugaugaugaugaugaagaugaugaugaugaugau

SEQ ID NO: 148486 - RNA, 64 nt, Human
aaaaguaaaacuugcugcugcugcugaugaugaugaugaugaagaugaugaugaugaugaugac

SEQ ID NO: 148487 - RNA, 64 nt, Human
acuugcugcugcugcugaugaugaugaugaugaagaugaugaugaugaugaugacgaggaagcu

SEQ ID NO: 148488 - RNA, 64 nt, Human
ugcugcugcugcugaugaugaugaugaugaagaugaugaugaugaugaugacgaggaagcugaa

SEQ ID NO: 148489 - RNA, 64 nt, Human
ugcugcugcugaugaugaugaugaugaagaugaugaugaugaugaugacgaggaagcugaagaa

SEQ ID NO: 148490 - RNA, 64 nt, Human
ugcugcugaugaugaugaugaugaagaugaugaugaugaugaugacgaggaagcugaagaaaaa

SEQ ID NO: 148491 - RNA, 64 nt, Human
ugcugaugaugaugaugaugaagaugaugaugaugaugaugacgaggaagcugaagaaaaagcg

SEQ ID NO: 148492 - RNA, 64 nt, Human
gcuaaugaauuaggcaggggagcuauuuuuugaagaugaugaacuaaauguugaagacaaguuu

SEQ ID NO: 148493 - RNA, 64 nt, Human
ucuggaugcccgggauggcaaugagguggagccugaugaugaccacuucuccauugugaguggc

SEQ ID NO: 148494 - RNA, 64 nt, Human
cagccagcccaggauccguccucauuuuauuggugaugaugaaugggaaugaaaucagggggcu

SEQ ID NO: 148495 - RNA, 64 nt, Human
uaaauugaauugguuuuuuuacugaagcuauugugaugaugauuauuuauuaguaacugguuau

SEQ ID NO: 148496 - RNA, 64 nt, Human
auauucacaucuaauagguuaauauguacauuuggaugaugauuuuucuugauaacauuaacau

SEQ ID NO: 148497 - RNA, 64 nt, Human
caacaguggcccgugccaaagcacuuaccaaagugaugaugacuaagguuggucaugccaagua

SEQ ID NO: 148498 - RNA, 64 nt, Human
aaccaguuuaauuuuuuuuuuccucauuguuggggaugaugagaagaaaugauuugggaaaauu

SEQ ID NO: 148499 - RNA, 64 nt, Human
aauugucacagugucccuucuacuucccucuauugaugaugaugaugaugaugaugaugaugau

SEQ ID NO: 148500 - RNA, 64 nt, Human
ugucacagugucccuucuacuucccucuauugaugaugaugaugaugaugaugaugaugaugau

SEQ ID NO: 148501 - RNA, 64 nt, Human
cacagugucccuucuacuucccucuauugaugaugaugaugaugaugaugaugaugaugaugau

SEQ ID NO: 148502 - RNA, 64 nt, Human
agugucccuucuacuucccucuauugaugaugaugaugaugaugaugaugaugaugaugaugau

SEQ ID NO: 148503 - RNA, 64 nt, Human
gucccuucuacuucccucuauugaugaugaugaugaugaugaugaugaugaugaugaugaugau

SEQ ID NO: 148504 - RNA, 64 nt, Human
ccuucuacuucccucuauugaugaugaugaugaugaugaugaugaugaugaugaugaugaugau

SEQ ID NO: 148505 - RNA, 64 nt, Human
ucuacuucccucuauugaugaugaugaugaugaugaugaugaugaugaugaugaugaugauggu

SEQ ID NO: 148506 - RNA, 64 nt, Human
acuucccucuauugaugaugaugaugaugaugaugaugaugaugaugaugaugaugaugguuuu

SEQ ID NO: 148507 - RNA, 64 nt, Human
ucccucuauugaugaugaugaugaugaugaugaugaugaugaugaugaugaugaugguuuuuuc

SEQ ID NO: 148508 - RNA, 64 nt, Human
cucuauugaugaugaugaugaugaugaugaugaugaugaugaugaugaugaugguuuuuucuaa

SEQ ID NO: 148509 - RNA, 64 nt, Human
uauugaugaugaugaugaugaugaugaugaugaugaugaugaugaugaugguuuuuucuaauca

SEQ ID NO: 148510 - RNA, 64 nt, Human
ugaugaugaugaugaugaugaugaugaugaugaugaugaugaugaugguuuuuucuaaucagaa

SEQ ID NO: 148511 - RNA, 64 nt, Human
ugaugaugaugaugaugaugaugaugaugaugaugaugaugaugguuuuuucuaaucagaagaa

SEQ ID NO: 148512 - RNA, 64 nt, Human
ugcccagaagcuuggggcagagguccuagcaggagaugaugaauucucguggcucucggccuuc

SEQ ID NO: 148513 - RNA, 64 nt, Human
uauuuuuguacauuugagccaugucacacaaacugaugaugacaggucagcaguauucuauuug

SEQ ID NO: 148514 - RNA, 64 nt, Human
gauuucagaaucaggagucagcucugacaaugaagaugaugaugaugaagaagaugggaauuac

SEQ ID NO: 148515 - RNA, 64 nt, Human
uucagaaucaggagucagcucugacaaugaagaugaugaugaugaagaagaugggaauuaccuu

SEQ ID NO: 148516 - RNA, 64 nt, Human
agaaucaggagucagcucugacaaugaagaugaugaugaugaagaagaugggaauuaccuucau

SEQ ID NO: 148517 - RNA, 64 nt, Human
ucugcuuccccuggaaaaaaaucguguuaagcuagaugaugacagugaugaugaugaagaaagc

SEQ ID NO: 148518 - RNA, 64 nt, Human
ggaaaaaaaucguguuaagcuagaugaugacagugaugaugaugaagaaagcaaagaaggccaa

SEQ ID NO: 148519 - RNA, 64 nt, Human
aaaaaaucguguuaagcuagaugaugacagugaugaugaugaagaaagcaaagaaggccaagaa

SEQ ID NO: 148520 - RNA, 64 nt, Human
gcuucugccaaaaaaaaaaagagaagaagaugacgaugaugaccagucguacuaucuuacugag

SEQ ID NO: 148521 - RNA, 64 nt, Human
ucuauguacagggguauuauauauauacauauaagaugaugauauauauaaugaugauauguau

SEQ ID NO: 148522 - RNA, 64 nt, Human
uugcugcuucucaauaucauagacacagugaauagaugaugacuauauggcuuauauacaaaca

SEQ ID NO: 148523 - RNA, 64 nt, Human
uaaauacaaaaauacauaaaaauacauaaaaucugaugaugaauauaaaaaaguaaccaaccuc

SEQ ID NO: 148524 - RNA, 64 nt, Human
aaacauugagggaacacaaauuuaugggcuuccugaugaugauucuucuaggcaucauguccua

SEQ ID NO: 148525 - RNA, 64 nt, Human
acauuucuacccagguuuugcuagagcagugugagaugaugaagguguauuuuugcugcuuuac

SEQ ID NO: 148526 - RNA, 64 nt, Human
uccaccuauaugaccaaucccuaauugcuguccugaugaugagucauuccaauuuacuggauuu

SEQ ID NO: 148527 - RNA, 64 nt, Human
ucccagggccauggagguccugcugcuggucugggaugaugaugccccuggaaaccuuccugca

SEQ ID NO: 148528 - RNA, 64 nt, Human
ugcauuugagauaggguuggaauauaguacucuagaugaugaauguguuugcuuuguguuuggu

SEQ ID NO: 148529 - RNA, 64 nt, Human
aauaugaaagauuuuaaaugaaaaaaauuuguuggaugaugauuuuugaaaaauagucaccaac

SEQ ID NO: 148530 - RNA, 64 nt, Human
guuccauccauagcauauuuccagaauaucccuagaugaugaauuuaaacaugccuucucagaa

SEQ ID NO: 148531 - RNA, 64 nt, Human
ucagguuaagauauagucuguggauggaucaucugaugaugauggauaaauuugauuuuugcuu

SEQ ID NO: 148532 - RNA, 64 nt, Human
gggggugacuuuuugaacuguuuauuauaugguggaugaugauuucaucucacgugcuggacgc

SEQ ID NO: 148533 - RNA, 64 nt, Human
agagaugauguuugcauuucuguuaugacagagagaugaugaaaguaggcagggcuguguuccu

SEQ ID NO: 148534 - RNA, 64 nt, Human
gagugauuaggcagcagcugaagccaccccugcugaugaugagcaagugccugcugcaggucca

SEQ ID NO: 148535 - RNA, 64 nt, Human
uugugaaugguaugaacuuuuaaaccauauuauugaugaugaaaauuauuuccugggaacucag

SEQ ID NO: 148536 - RNA, 64 nt, Human
agggacugaauuuaaauauuuguaagaacuuugugaugaugaguaauugucagacgugggauag

SEQ ID NO: 148537 - RNA, 64 nt, Human
aucauguuguuaaaauuaugaaucugauuuuuaugaugaugaaaauuuuaccagcagaaggauu

SEQ ID NO: 148538 - RNA, 64 nt, Human
gugagccgagauugcaccacugcaguucagccuggaugaugagagugagacuccaucgcaaaaa

SEQ ID NO: 148539 - RNA, 64 nt, Human
aguugaagaucuuugacauagguucuucuauagugaugaugaucucauucagaagaugcuuagc

SEQ ID NO: 148540 - RNA, 64 nt, Human
uuuaaagggucuacaacugaaugagcucaccauggaugaugauacugccgugcucgucauugac

SEQ ID NO: 148541 - RNA, 64 nt, Human
uaaggcuugcauuucccucccuguuucaguaaaagaugaugaaagccacuaucaauccucacug

SEQ ID NO: 148542 - RNA, 64 nt, Human
ucauuuuuaccagggcuuggggacccaaugcaaagaugaugacuauuuaauaaaauggaaaauu

SEQ ID NO: 148543 - RNA, 64 nt, Human; identical to SEQ ID NO: 148540

SEQ ID NO: 148544 - RNA, 64 nt, Human
guugucuuaaugcauuuauugagaacagcauugagaugaugaacaagggguuagcaauagcaaa

SEQ ID NO: 148545 - RNA, 64 nt, Human
ugcauguccagcuggauucuggccugccaaagaagaugaugauuaaaaacauagauauugcuug

SEQ ID NO: 148546 - RNA, 64 nt, Human
guauauacauauauauauuuucacuugcuuucaagaugaugaccacacauggauuuugauaugu

SEQ ID NO: 148547 - RNA, 64 nt, Human
ccugaaggaggucuaccccgacucagguucugccgaugaugagaggaucuugagguucuuggaa

SEQ ID NO: 148548 - RNA, 64 nt, Human
uagccagagagucaugccacguggucauuaaaccgaugaugauugaggcguggcagcguccuug

SEQ ID NO: 148549 - RNA, 64 nt, Human
gggucugguagauuauccugaugaugaugaagaugaugaugaggaugaagauaaggaagauacg

SEQ ID NO: 148550 - RNA, 64 nt, Human
cgugggucugguagauuauccugaugaugaugaagaugaugaugaggaugaagauaaggaagau

SEQ ID NO: 148551 - RNA, 64 nt, Human
gggaggccucgugggucugguagauuauccugaugaugaugaagaugaugaugaggaugaagau

SEQ ID NO: 148552 - RNA, 64 nt, Human
acagggaggccucgugggucugguagauuauccugaugaugaugaagaugaugaugaggaugaa

SEQ ID NO: 148553 - RNA, 64 nt, Human
agcuguagugucuccaucugacaaaacuaaaaaugaugaugauauuauggauccaauaaguaaa

SEQ ID NO: 148554 - RNA, 64 nt, Human
uuccucaaaguuguaguugucuguugaugauggugaugaugaugaugaugacgauagugaugcc

SEQ ID NO: 148555 - RNA, 64 nt, Human
cucaaaguuguaguugucuguugaugauggugaugaugaugaugaugacgauagugaugccaca

SEQ ID NO: 148556 - RNA, 64 nt, Human
aaaguuguaguugucuguugaugauggugaugaugaugaugaugacgauagugaugccacacau

SEQ ID NO: 148557 - RNA, 64 nt, Human
guuguaguugucuguugaugauggugaugaugaugaugaugacgauagugaugccacacauucu

SEQ ID NO: 148558 - RNA, 64 nt, Human
gaaaaacguacgcaagaggacauggauccaaaaugaugaugaagcaucucccauggggagguga

SEQ ID NO: 148559 - RNA, 64 nt, Human
aguauacucacuuaucucauccauggauguaaaugaugaugaaucaacauaguaacugaaauga

SEQ ID NO: 148560 - RNA, 64 nt, Human
ugcagaauaguguaaaaugcgcuucaagaauguugaugaugaugauauagaauuguggcuuuag

SEQ ID NO: 148561 - RNA, 64 nt, Human
agaauaguguaaaaugcgcuucaagaauguugaugaugaugauauagaauuguggcuuuaguag

SEQ ID NO: 148562 - RNA, 64 nt, Human
uuaccuuaccuacaaaaguggcuccuguuuguuugaugaugauugguuuuauuuuugaaauauu

SEQ ID NO: 148563 - RNA, 64 nt, Human
ugccuaaaaaggacaggugguuugacucauggaugaugaugaugucacugugccacuuggacag

SEQ ID NO: 148564 - RNA, 64 nt, Human
aaaugccuaaaaaggacaggugguuugacucauggaugaugaugaugucacugugccacuugga

SEQ ID NO: 148565 - RNA, 64 nt, Human
ugugggggacacugcugaugauucccaagauugagaugaugacggugaugacgacugggugaac

SEQ ID NO: 148566 - RNA, 64 nt, Human
ucccacaugaguacauauuggccagcggcuccgagaugaugaacuccggggucugagagugggc

SEQ ID NO: 148567 - RNA, 64 nt, Human
guuuuuggucugacccacugcuuuuggucugugugaugaugaaaugaggucagagccugcaguu

SEQ ID NO: 148568 - RNA, 64 nt, Human
uuuuauacugcuaagugcuugguugggguggugagaugaugauuagaucaggggugaggcugag

SEQ ID NO: 148569 - RNA, 64 nt, Human
acauggcaaugaugaguuuuuaaaaaacaguguggaugaugauaugcuuuugugagcaagcaaa

SEQ ID NO: 148570 - RNA, 64 nt, Human
ucauuaacugaaaaguagcagcuucucuauccaggaugaugagucaacagguuucacuaauauu

SEQ ID NO: 148571 - RNA, 64 nt, Human
ggaagaagauguccgugagaacaucauuacuuaugaugaugaaggggguggggaagaagacaca

SEQ ID NO: 148572 - RNA, 64 nt, Human
gaagcagagcucgccaccuucuggaggccacugugaugaugagccaagcaauuuggagccaagu

SEQ ID NO: 148573 - RNA, 64 nt, Human
cuggccacgcacaggcucuggcucuggaaggagggaugaugagugggcguuuucccggcaggcc

SEQ ID NO: 148574 - RNA, 64 nt, Human
aaaacuaccuaucugguacuaugcuuuuuaucuggaugaugaaauaaucuguacaacaaacccu

SEQ ID NO: 148575 - RNA, 64 nt, Human
auaggaagaaaauaugggaauuugauuacacauagaugaugauguuuauuuaaaaaaaaaacaa

SEQ ID NO: 148576 - RNA, 64 nt, Human
guuauacaacuuggcuuguuuaccuccacaugcugaugaugacuauuuuuuuuuuuugaguuca

SEQ ID NO: 148577 - RNA, 64 nt, Human
uucuauggagaacguugccuuauacucuacuucagaugaugaacacuguguacugugugugcuu

SEQ ID NO: 148578 - RNA, 64 nt, Human
ucuuuugauggguuuagucuugcccuggagugccgaugaugauucucccuccagagccacgcuu

SEQ ID NO: 148579 - RNA, 64 nt, Human
auucccugagacuuuucaggagagccagcccacagaugaugaagaaaugauggaaguucauuug

SEQ ID NO: 148580 - RNA, 64 nt, Human
aagagaguggcauccacuugugguaaccccuuacgaugaugacaucccacacacuaagagguac

SEQ ID NO: 148581 - RNA, 64 nt, Human
agaccugaaagauaacacuccuucaggaaaaagugaugaugauuuugcugacuuccacuccagu

SEQ ID NO: 148582 - RNA, 64 nt, Human
ccaucaucgaaacuccagaaauuuauccacuguggaugaugacaucgcuuuccuuuggucaagg

SEQ ID NO: 148583 - RNA, 64 nt, Human
ccucuggcucugagcccuguucugaccaaaucaugaugaugaguauuuggggguggguggguaa

SEQ ID NO: 148584 - RNA, 64 nt, Human
gggaguuggucugagugacaaggaauugguuucagaugaugaagaaagaggaacgggcuuggaa

SEQ ID NO: 148585 - RNA, 64 nt, Human
ggacgugaaauacuucgaugaugaugaugaugaugaugaugauaauaauaauaauaauaacaac

SEQ ID NO: 148586 - RNA, 64 nt, Human
ucuggacgugaaauacuucgaugaugaugaugaugaugaugaugauaauaauaauaauaauaac

SEQ ID NO: 148587 - RNA, 64 nt, Human
agcucuggacgugaaauacuucgaugaugaugaugaugaugaugaugauaauaauaauaauaau

SEQ ID NO: 148588 - RNA, 64 nt, Human
cuuagcucuggacgugaaauacuucgaugaugaugaugaugaugaugaugauaauaauaauaau

SEQ ID NO: 148589 - RNA, 64 nt, Human
ugucuuagcucuggacgugaaauacuucgaugaugaugaugaugaugaugaugauaauaauaau

SEQ ID NO: 148590 - RNA, 64 nt, Human
ucuugucuuagcucuggacgugaaauacuucgaugaugaugaugaugaugaugaugauaauaau

SEQ ID NO: 148591 - RNA, 64 nt, Human
uagucuugucuuagcucuggacgugaaauacuucgaugaugaugaugaugaugaugaugauaau

SEQ ID NO: 148592 - RNA, 64 nt, Human
ggugugcuccugaaugaagguuucuauguaagcagaugaugauuuuaccugucaauaccagcac

SEQ ID NO: 148593 - RNA, 64 nt, Human
ggugacuccagccucuuucuccuggaggucacaagaugaugauugcguagauguugccuggugc

SEQ ID NO: 148594 - RNA, 64 nt, Human
ugcuauuuuucauugacucuauugaacucuuuaggaugaugacugaucauacaaaacguauuau

SEQ ID NO: 148595 - RNA, 64 nt, Human
cauuccuuauucccaggcaagcuauagucagacagaugaugaaaguaacaugaaaacuggugau

SEQ ID NO: 148596 - RNA, 64 nt, Human
gcaguggucccuaguagccucucaagcuaauggggaugaugauccugguuuagccagaguucaa

SEQ ID NO: 148597 - RNA, 64 nt, Human
uuguuuuuauuuuuuuaucaugaacauuaaaugugaugaugauuucuuuucccugcacacaucu

SEQ ID NO: 148598 - RNA, 64 nt, Human
gaacuuugggcagagaucauguuagaaucaaguggaugaugagaccaauuacaggccgucucuc

SEQ ID NO: 148599 - RNA, 64 nt, Human
ucuugugggugccaacuuagggguugagcagguugaugaugagaucccagugagaagauggggg

SEQ ID NO: 148600 - RNA, 64 nt, Human
ucucuuggcucauauuucuuuucuaucucaucuugaugaugauagucaucaucaagaauuuaau

SEQ ID NO: 148601 - RNA, 64 nt, Human
ucucuuggcucauauuucuuuucuuucucaucuugaugaugaucgucaucaucaagaauuuaau

SEQ ID NO: 148602 - RNA, 64 nt, Human
gaaaauaccagcagugucauuuagggguuccuuugaugaugacuacugcuguuaacugaccuca

SEQ ID NO: 148603 - RNA, 64 nt, Human
aggagcuggggcaggccccauccugggcauuggagaugaugaaaccgagcagaccuggcccaug

SEQ ID NO: 148604 - RNA, 64 nt, Human
gagggguugcgggggagcuggaaauaaaccuggagaugaugaugaugaugaugaugaugaugau

SEQ ID NO: 148605 - RNA, 64 nt, Human
ggguugcgggggagcuggaaauaaaccuggagaugaugaugaugaugaugaugaugaugaugga

SEQ ID NO: 148606 - RNA, 64 nt, Human
uugcgggggagcuggaaauaaaccuggagaugaugaugaugaugaugaugaugaugauggagcg

SEQ ID NO: 148607 - RNA, 64 nt, Human
cgggggagcuggaaauaaaccuggagaugaugaugaugaugaugaugaugaugauggagcggau

SEQ ID NO: 148608 - RNA, 64 nt, Human
gggagcuggaaauaaaccuggagaugaugaugaugaugaugaugaugaugauggagcggaucug

SEQ ID NO: 148609 - RNA, 64 nt, Human
cccucgaagagccuggccagagagggaagacacagaugaugaagcuggagccagggcugccggu

SEQ ID NO: 148610 - RNA, 64 nt, Human
ccggcaagggguggagcuggaggagucucagcuggaugaugagaagggcugaaauguugccaag

SEQ ID NO: 148611 - RNA, 64 nt, Human
acccaggguucaggcguguuuucugugaauguuggaugaugaauuuuugucucuucugguggag

SEQ ID NO: 148612 - RNA, 64 nt, Human
caccguuuccagauguaauacugcaaagaaaaccgaugaugaggccgggugcgguggcucacac

SEQ ID NO: 148613 - RNA, 64 nt, Human
cuuuggacugaacaaugacccccaaaauucguaugaugaugaagcucucucuaaauauuuucuu

SEQ ID NO: 148614 - RNA, 64 nt, Human
uuuaacucaaggccuggggcaggggcguuuaauugaugaugacagaggacacagguuuuugcca

SEQ ID NO: 148615 - RNA, 64 nt, Human
gucggccgcuacuaggacugcccccggacccugcgaugaugacccgggcgcaaccugguggggg

SEQ ID NO: 148616 - RNA, 64 nt, Human
gucuugugauccuccuuauugauuuuucccucacgaugaugaacaauuaucucccguuacucac

SEQ ID NO: 148617 - RNA, 64 nt, Human
aggaguucuccuggagcaacuugaggguaauaaugaugaugauauaauaauaauagccacuauu

SEQ ID NO: 148618 - RNA, 64 nt, Human
agucugaauuagagagcacuuggaaagggcagaggaugaugaacuaugaugucacucaucaucc

SEQ ID NO: 148619 - RNA, 64 nt, Human
aucacucuugccauuaccuacaucuauuagcauagaugaugaaaagcuguuacuggugauuaua

SEQ ID NO: 148620 - RNA, 64 nt, Human
aagauucaugcagucccaaaaggcacuguccugggaugaugagagauuauaaggugauuucaua

SEQ ID NO: 148621 - RNA, 64 nt, Human
ucugcacgggaccuauuagaguauuuuccacaaugaugaugauuucagcagggaugacgucauc

SEQ ID NO: 148622 - RNA, 64 nt, Human
cacugguuuuguugccccagggcugcuuugcugugaugaugauugcauuucaacacaugccaga

SEQ ID NO: 148623 - RNA, 64 nt, Human
uagcaagaauugaggaagaauggugugggagagggaugaugaagagagagagggccugcuggag

SEQ ID NO: 148624 - RNA, 64 nt, Human
gcugcugcugaccgaaccucagccucucagacuugaugaugaaguaggugguccugaaaguuaa

SEQ ID NO: 148625 - RNA, 64 nt, Human
gggauuguuaggauggagcccaggccacauggaugaugaugauucucccccacagguucgaacc

SEQ ID NO: 148626 - RNA, 64 nt, Human
auggggauuguuaggauggagcccaggccacauggaugaugaugauucucccccacagguucga

SEQ ID NO: 148627 - RNA, 64 nt, Human
uacucuguggcucucagggccaauaaagccaugugaugaugagggucagcuugccugauggcug

SEQ ID NO: 148628 - RNA, 64 nt, Human
aguuugaguucgagccaaccaccucuguugguuagaugaugaauaaaaagguucugaagaaaag

SEQ ID NO: 148629 - RNA, 64 nt, Human
cucuggaccuuauccuugaaagaugaucaaaagcgaugaugagggaggcagucaucacgcaggu

SEQ ID NO: 148630 - RNA, 64 nt, Human
aaagaaauguaaacagaucgcacagaguaaagaagaugaugauguaauagugaauaaaccucau

SEQ ID NO: 148631 - RNA, 64 nt, Human
gguuccuguggagaaaaauggugaagaaaacaaagaugaugauaauguuuucagcagcaauuug

SEQ ID NO: 148632 - RNA, 64 nt, Human
gccaacagggaauucuaaacaacuaaaaacuccagaugaugaaugcacaacauaaugaugguua

SEQ ID NO: 148633 - RNA, 64 nt, Human
cucccacgugcugccucccuuaggaggggacacugaugaugaggucucggagccggcauccuuc

SEQ ID NO: 148634 - RNA, 64 nt, Human
aaaaaagcuauuuuuauaaauucguuaugaauuggaugaugacuauauugaggauaaaauuucu

SEQ ID NO: 148635 - RNA, 64 nt, Human
agacgcuggggcccaagaucaucauugugaagcggaugaugaaggacgucuucuucuuccucuu

SEQ ID NO: 148636 - RNA, 64 nt, Human
auaggugucuacugcagauauuucaucaaauaaggaugaugaagaaaacucuaugcacacuacg

SEQ ID NO: 148637 - RNA, 64 nt, Human
aaaggcacuuuuauugagaaugagaagaacuuuagaugaugauguauuuaugcccuuauauccc

SEQ ID NO: 148638 - RNA, 64 nt, Human
uaagauggcagaucaccuugaaggccuuuccagugaugaugaagaaacuucuacagauauuacu

SEQ ID NO: 148639 - RNA, 64 nt, Human
aacuauucccuugcaagugagauuauauaguaaagaugaugaaccagcuguaaaacuacaacua

SEQ ID NO: 148640 - RNA, 64 nt, Human
uaauucacugaagacacaggucccacagggagcggaugaugaagcagacccccuccugucauca

SEQ ID NO: 148641 - RNA, 64 nt, Human
ccgcugagcuucccuuggacacuaacucuucccagaugaugacaaugaaauuagugccuguuuu

SEQ ID NO: 148642 - RNA, 64 nt, Human
ugcguuugaagccucgcgucacucagucgcgugggaugaugaguccguuguugucugccuuggc

SEQ ID NO: 148643 - RNA, 64 nt, Human
ccgccgggcacccccccccaggcuccuggugccagaugaugacgaccuggguggaaaccuaccc

SEQ ID NO: 148644 - RNA, 64 nt, Human
uggacaguaccuagagucugugcgccccuuguuggaugaugaggaauauuaccgcauggaguug

SEQ ID NO: 148645 - RNA, 64 nt, Human
ugauguucucugacccagcagaaaucaucaucaugaugaugauaauuuauuaacuuuuuggaag

SEQ ID NO: 148646 - RNA, 64 nt, Human
ggugauuuaugaagagaucagagacccugaggaagaugaugaguaacuccguaagugaaccuuu

SEQ ID NO: 148647 - RNA, 64 nt, Human
ucugaacccuccaaaggaacucuagagggcgagggaugaugagggaagcaauagguagcugggg

SEQ ID NO: 148648 - RNA, 64 nt, Human
caucugaccaguuuucucuuaaagccauuuccaugaugaugaugaugggacucaauuguauuuu

SEQ ID NO: 148649 - RNA, 64 nt, Human
cugaccaguuuucucuuaaagccauuuccaugaugaugaugaugggacucaauuguauuuuuua

SEQ ID NO: 148650 - RNA, 64 nt, Human
auccacacccugcuugcuccuguguaacagcucagaugaugaauaauaauaaaacuguacuuuu

SEQ ID NO: 148651 - RNA, 64 nt, Human
gucucagcuucagguucuucaccucuaagauggggaugaugaaaacaguaccugucaugcagaa

SEQ ID NO: 148652 - RNA, 64 nt, Human
guccuggagggggcuccauucuccagucagaguagaugaugaggcccaugccccucacccccac

SEQ ID NO: 148653 - RNA, 64 nt, Human
aguuuucuaggugagcuucauucccugaaaggaggaugaugauaucuaggcauaaccuagccug

SEQ ID NO: 148654 - RNA, 64 nt, Human
gggagucaacucaacauggcagaaccauuuuugagaugaugauacaacagguagugaaacagcu

SEQ ID NO: 148655 - RNA, 64 nt, Human
gaaaugaauuaaaaaugugaaaucggguuaaagugaugaugauaaaauagcaugcaagaaacaa

SEQ ID NO: 148656 - RNA, 64 nt, Human
cuucuugaaauuugugauggccaagaaagaaaaugaugaugacauuaggcuucuaaaggacaua

SEQ ID NO: 148657 - RNA, 64 nt, Human
ugccccuuucagagacggagcaccugagaugugggaggugcagcauguuccccugggccccuca

SEQ ID NO: 148658 - RNA, 64 nt, Human
ggaugguggaagguggggacguugguggcuggcugaggugcaugggccccacacaggacagcug

SEQ ID NO: 148659 - RNA, 64 nt, Human
uguccauucacuguguauagauggcagaacuuuugaggugcaauguuuaauuguuaaaaauagu

SEQ ID NO: 148660 - RNA, 64 nt, Human
gcugccaaccucacagaguguuugcuaggcgagagaggugcagggaagaggcagagguaugcac

SEQ ID NO: 148661 - RNA, 64 nt, Human
aaguuauucuugcaccacaugcucaaaucuucuugaggugcauuaacucuuuuagguaacuaga

SEQ ID NO: 148662 - RNA, 64 nt, Human
uuuacaaagggcuuaggcugcauuuccuucuauagaggugcauucuuguagaaauuuguagcau

SEQ ID NO: 148663 - RNA, 64 nt, Human
ggacugguucuguguagauagagauggugucaaggaggugcaggauggagaugggagauuucau

SEQ ID NO: 148664 - RNA, 64 nt, Human
aucagagacugagaugggagaggccugagacggagaggugcauuucugcuggugacuggaggag

SEQ ID NO: 148665 - RNA, 64 nt, Human
gggauaaucugccuuguauuuagucagagggcuagaggugcagauuucauauuuucuuaaugaa

SEQ ID NO: 148666 - RNA, 64 nt, Human
gggcugcgugaaaaacccagcugggccugggguggaggugcacacgggcuggggcucagcuccu

SEQ ID NO: 148667 - RNA, 64 nt, Human
uuuggugcuaauaugacauaugacaauaagccacgaggugcaguaaguacccgacuaaaguuuc

SEQ ID NO: 148668 - RNA, 64 nt, Human
ccagcucucucugcucaccuuccaaaggcaccuggaggugcaagccucaugcaucuccuuuccu

SEQ ID NO: 148669 - RNA, 64 nt, Human
agucagggucugguuggcuccccauugccugcccgaggugcaaggugggguauaaaacuggaua

SEQ ID NO: 148670 - RNA, 64 nt, Human
uucugugggcccuggccagacaggguuaccuggugaggugcagagagucccucuaguggccauu

SEQ ID NO: 148671 - RNA, 64 nt, Human
auggaauagguaggcaagccaggacuccgggaaggaggugcagccaggaugcucugguggagcu

SEQ ID NO: 148672 - RNA, 64 nt, Human
ucuuacuuggucagaagugcuaaaucugcuaguagaggugcaugccuuucauugcuuuucaaaa

SEQ ID NO: 148673 - RNA, 64 nt, Human
gagcccacagcuuugaccacugugauccagaagagaggugcacuacgugggaagugcugauucc

SEQ ID NO: 148674 - RNA, 64 nt, Human
augcaggacaauugcauuuuaguuuuauuuuguggaggugcagaauauuuacucuuucugucca

SEQ ID NO: 148675 - RNA, 64 nt, Human
caugaaggggguuggggucugugugaguaguggggaggugcauguguauccacaugugugcaua

SEQ ID NO: 148676 - RNA, 64 nt, Human
auucugcuccuuccccaucguugcccccauuucugaggugcacugggaggcuccccuucuauuu

SEQ ID NO: 148677 - RNA, 64 nt, Human
augggaguugagcccuggaauggggcucuauggagaggugcauaggacucggcagaaauggccu

SEQ ID NO: 148678 - RNA, 64 nt, Human
cagcauaguggaggggagaggcagaacuggaggagaggugcagugaagguucucuacagcuaag

SEQ ID NO: 148679 - RNA, 64 nt, Human
gacuugauguugcuguaccagggcuuccuccccagaggugcagcuugcguuuugagggugauug

SEQ ID NO: 148680 - RNA, 64 nt, Human
gucugugagcuuggugguuauuuguacauaaucggaggugcagaaucuuggaauugucugaaca

SEQ ID NO: 148681 - RNA, 64 nt, Human
acgcagguggacuuggggcaaguucagaucagaagaggugcaggcuggcaccugcggcagguac

SEQ ID NO: 148682 - RNA, 64 nt, Human
gugcucaggccaggugugaauccugagguccauggaggugcagagaugagauuacuccuauuca

SEQ ID NO: 148683 - RNA, 64 nt, Human
uuuguggacugguucagggaaggaggggaaaagggaggugcagagagcucuaagccagugugcu

SEQ ID NO: 148684 - RNA, 64 nt, Human
uggaguuauuucaccacaaaucaacaaugugccugaggugcaugggaaauauaguuagcuauac

SEQ ID NO: 148685 - RNA, 64 nt, Human
aucuuugauuagacaagccugggaagagaauguugaggugcagagcucaccagccaaguucaug

SEQ ID NO: 148686 - RNA, 64 nt, Human
caugaccaccacugagggcccggagcaggguggggaggugcaguggcacccccagagccaacag

SEQ ID NO: 148687 - RNA, 64 nt, Human
guccuuugccaguggaaggaguuccugcuaaggggaggugcaggaggugagcugauaccugagu

SEQ ID NO: 148688 - RNA, 64 nt, Human
ccaggccuacccuacugcccgcugcguccugcuggaggugcaagugccugcugcccuugugcag

SEQ ID NO: 148689 - RNA, 64 nt, Human
ccccacccauaccacagcauccccuagagagagugaggugcagggacccgagggccagguuagc

SEQ ID NO: 148690 - RNA, 64 nt, Human
ucccaugauguccuggcuuuguggcaaccccagggaggugcagcaguuucacuccuuccuccac

SEQ ID NO: 148691 - RNA, 64 nt, Human
ucugaggccauuacauuccugggaauaacauggugaggugcagggugguggugguggugaaaca

SEQ ID NO: 148692 - RNA, 64 nt, Human
uguaacaauggguguagcuccccugcccaucuuggaggugcauggcccaucagggaucuuuaaa

SEQ ID NO: 148693 - RNA, 64 nt, Human
gccucugauggagcaggcucuggcucuguaaggagaggugcagcugcagcaguguucuaccgga

SEQ ID NO: 148694 - RNA, 62 nt, Human
caggagcacucucccucugaggggucuucucugaggugcaugguucuuuuggaagaaaugag

SEQ ID NO: 148695 - RNA, 64 nt, Human
ccagaccuauguucugcuugcguuuuugaaacaggaggugcacguaccacccaauuaucuaugg

SEQ ID NO: 148696 - RNA, 64 nt, Human
aauguucgaguaccucagggacauuuaagaguuggaggugcaaauauauuccaaaagggugcaa

SEQ ID NO: 148697 - RNA, 64 nt, Human
gugugcugucugcaccugcaaggggggcacuggagaggugcacugugagaaggugcaguguccc

SEQ ID NO: 148698 - RNA, 57 nt, Human
cccucuggaaagcacacugaugggguggaggugcagagcuuuccaguauagcccugu

SEQ ID NO: 148699 - RNA, 64 nt, Human
caggugguugaccucuaggaccagggcccucucagaggugcagcuuccaugucaguugguguug

SEQ ID NO: 148700 - RNA, 64 nt, Human
uugugagcuguuggcaugugguuagaagccaucagaggugcaagggcuuagaaaagacccuggc

SEQ ID NO: 148701 - RNA, 64 nt, Human
aacaugcuacauccugcccaagacugcaccucuggaggugcagggcacccuugagaagccccuc

SEQ ID NO: 148702 - RNA, 64 nt, Human
gcggucaggggcaaggcuuuuggaugauaagagugaggugcagucagcucuagauugggggugg

SEQ ID NO: 148703 - RNA, 64 nt, Human
cuuuuuaugccugccauacccgcuaaugcuccucgaggugcaggagcagguugcugagccagug

SEQ ID NO: 148704 - RNA, 64 nt, Human
uuauguuuuuaagugccuuggcaggcucacuucugaggugcaaaacauagauauagaacugaac

SEQ ID NO: 148705 - RNA, 64 nt, Human
cauuuugacacaauguuugugaaacaccuuuggagaggugcacuucugaaugcugccucugccg

SEQ ID NO: 148706 - RNA, 64 nt, Human
uguugggcuucugugaaauacacagguggaaacagaggugcaagccagaggcaauguaauaugc

SEQ ID NO: 148707 - RNA, 64 nt, Human
ggcugcuaugaccuguguucacucugguuacagggaggugcaaaccauucugucucccagccuu

SEQ ID NO: 148708 - RNA, 64 nt, Human
cgucaagacgugggaucagaaucuuccaacuuuagaggugcaauggaagacacuacgcuacuug

SEQ ID NO: 148709 - RNA, 64 nt, Human
cucuuucuggacguguuuagauaguuuccaccaugaggugcaaaacgagacagaagagugagaa

SEQ ID NO: 148710 - RNA, 64 nt, Human
uguuuuuauuuugcagauaugaagagcauuuuaagaggugcagccucuggaaguggaucaaacu

SEQ ID NO: 148711 - RNA, 64 nt, Human
gaagcaugauauguacuauagugauucuguuuuugaggugcaaaaaacauacauauauaccagu

SEQ ID NO: 148712 - RNA, 64 nt, Human
ggcuccaggccccaccuccuccuccauacguucagaggugcagcuggaggcugcuguggggacc

SEQ ID NO: 148713 - RNA, 64 nt, Human
aaaaaaaugcacagaaaccauugggggggauucagaggugcauccacggaucuucuugagcugu

SEQ ID NO: 148714 - RNA, 64 nt, Human
cauguuuuucaucauuugaucuggcagcagggcagaggugcaccaggaguaaaaaccuuucaaa

SEQ ID NO: 148715 - RNA, 60 nt, Human
uuaguaauggggaacauuaagauacucugugaggugcaagacuucaggguggggugggca

SEQ ID NO: 148716 - RNA, 64 nt, Human
guauuagugcuagucucagauaggugcuuccccugaggugcaggggaagaccaaaguuugcaac

SEQ ID NO: 148717 - RNA, 64 nt, Human
ccacaaggggugaggaaaggacagcagcaggaaggaggugcagugcgcagaugagggcacagga

SEQ ID NO: 148718 - RNA, 64 nt, Human
aggaauuguauuuguugccuuuuuuauauuagaugaggugcaaaaauuuuaaugcuagucagua

SEQ ID NO: 148719 - RNA, 64 nt, Human
uuauuacccuuugcuguuugaggagccagaaauagaggugcaguuagaggacggucacuuuuuc

SEQ ID NO: 148720 - RNA, 64 nt, Human
accucuccucagcccaugcccagcugucaggagagaggugcagggaggaaggccuugugcuggg

SEQ ID NO: 148721 - RNA, 64 nt, Human
guuacaugauuuuccuacacucuguaauuuugcugaggugcaauuuggaacucugcaagaccua

SEQ ID NO: 148722 - RNA, 64 nt, Human
aacugcugugaauuguacauuucuguguuuuuuggaggugcaguuaaacuuuuaagcuuaagug

SEQ ID NO: 148723 - RNA, 64 nt, Human
ucucucauuuauucuguuuaucucccuggcucuggaggugcagccacuggucuucacuuuaaug

SEQ ID NO: 148724 - RNA, 64 nt, Human
aaaaagccuuacauuaauuuaauguuugcacucugaggugcaacuuaacagggagggccugaga

SEQ ID NO: 148725 - RNA, 64 nt, Human
augggguagauggguggagagggaggggauaagagaggugcauguugguauuuaaaguagugga

SEQ ID NO: 148726 - RNA, 54 nt, Human
aggaguuacccaguccuugagaaggaggugcauguacguaccuaugugcauaca

SEQ ID NO: 148727 - RNA, 64 nt, Human
aaaaaaaagauuugcuaagaucaaaggauauucagaggugcaucuuuuucuguaagagugacau

SEQ ID NO: 148728 - RNA, 64 nt, Human
guggcuguaggacucgaauuuacagaaagccacagaggugcaacuugaggcucugcuagcaagc

SEQ ID NO: 148729 - RNA, 50 nt, Human
ucauccaccaugugcaguaagaggugcauauccacucagcugaagaagcu

SEQ ID NO: 148730 - RNA, 64 nt, Human
gaccaaggaucugugcuacccgcuccccuccuuggaggugcagugaugaugggaguuauuuuua

SEQ ID NO: 148731 - RNA, 64 nt, Human
caacacacagccaugaggagccucaguuuugaaagaggugcauaauaaaacuacuaaccagagg

SEQ ID NO: 148732 - RNA, 64 nt, Human
ucgucuuugagaagacgguagcuucugcaguuaggaggugcagacacuugcucuccuauguagu

SEQ ID NO: 148733 - RNA, 64 nt, Human
agcacucuuugacugcugaaggaaccccauggaugaggugcaggcuacuucacucuuuuuuuuu

SEQ ID NO: 148734 - RNA, 64 nt, Human
ucccaauggugcuuggagggggaagagaucccaggaggugcaguggagggggcaagcuuugcuc

SEQ ID NO: 148735 - RNA, 64 nt, Human
ucuagucuacuucaaaauuuuuuacacguuugcagaggugcaaucaaauggaauuaagucucuc

SEQ ID NO: 148736 - RNA, 64 nt, Human
cugaugagcugcagguuuuuugaacucacuucuggaggugcagagccacaaacgcacuuucggg

SEQ ID NO: 148737 - RNA, 64 nt, Human
ccaauuaaauauaacuccgccaguguaagggugugaggugcaguuguccaggagacgauuuugu

SEQ ID NO: 148738 - RNA, 64 nt, Human
cauucacuccuggagaaugguauaggaauuuggagaggugcauuauuucuuucuggccacuggg

SEQ ID NO: 148739 - RNA, 64 nt, Human
uuaaggcccaaaugaaggcaugucaggagaguuagaggugcaucacacauccgcuucauauguu

SEQ ID NO: 148740 - RNA, 64 nt, Human
uuuagaucuugauuucuuggucauuucucaaccugaggugcauagcauauucccacauuccauu

SEQ ID NO: 148741 - RNA, 64 nt, Human
aaaaugaaaagcaacucaaaacaacuucaacguggaggugcauuuauaauucagucugcauuua

SEQ ID NO: 148742 - RNA, 64 nt, Human
ggcccacggcugcugcuugggccaaaaacauacagaggugcauggcuggcagucuugaaauugu

SEQ ID NO: 148743 - RNA, 64 nt, Human
ccucucccuccaccuccucuccaccugcuggugagaggugcaaagaggcagaucuuugcugcca

SEQ ID NO: 148744 - RNA, 64 nt, Human
accacaaggccugccucugacuggggcugacacggaggugcauuagcccaggcuggagguagcc

SEQ ID NO: 148745 - RNA, 64 nt, Human
aucuagacaugcuaccagacauggggaaccauuagaggugcaaucuacauugggcaucugguca

SEQ ID NO: 148746 - RNA, 64 nt, Human
cucauaguguuaacacugguucugcaauaucucugaggugcaaagaaugcacuuuucccuaugg

SEQ ID NO: 148747 - RNA, 64 nt, Human
cucuguguaccccuccacccgcugcgggcugagggaggugcagggccuucucugaccccugccu

SEQ ID NO: 148748 - RNA, 64 nt, Human
ugacuugaaguauacucaguuaaaaucggggcuggaggugcagacggugucugaccggaggaug

SEQ ID NO: 148749 - RNA, 64 nt, Human
gucccacgccgccucugcucagaccacugugugggaggugcacagcacagccugcggguaaagu

SEQ ID NO: 148750 - RNA, 64 nt, Human
ggggucaggggacugguagucacccaaucuuggagaggugcaaaaagcacugggggcuacccgu

SEQ ID NO: 148751 - RNA, 64 nt, Human
ugucacugcuugagggagaauccucccuucccaggaggugcagacuucuuaaaaggagcucgcg

SEQ ID NO: 148752 - RNA, 64 nt, Human
aauucugucauauuuacuucuaauucuacucucagaggugcaaaaagauacuuaucuaacugga

SEQ ID NO: 148753 - RNA, 64 nt, Human
gguagcaaucacaaacuaaagacugcggcuuguugaggugcaauacccugacucccaaaguuag

SEQ ID NO: 148754 - RNA, 64 nt, Human
ucugugucugcgugaccucacccagccuaggagggaggugcauucaggguagauuugccucuca

SEQ ID NO: 148755 - RNA, 64 nt, Human
ucagauggcaagggcagugcguggaaaggccggggaggugcagaaaccagagcccagggcaaug

SEQ ID NO: 148756 - RNA, 64 nt, Human
cggagugcucugggagccaggccagggugugagggaggugcagaggcauccggggcgggagcaa

SEQ ID NO: 148757 - RNA, 64 nt, Human
uucccaggcuggggugggggccugagcagacacagaggugcaggcaccaggauucuccacuucu

SEQ ID NO: 148758 - RNA, 64 nt, Human
gugagcaggaggcccuaagccgcagcaguggauagaggugcagcucucugccucucugcccuuu

SEQ ID NO: 148759 - RNA, 64 nt, Human
cuccaguuaaagggccuguuucuuacuggccugugaggugcaccguagugccuugggccugugu

SEQ ID NO: 148760 - RNA, 64 nt, Human
uccaggguucuuccugagagaggcagauuugagugaggugcauaggauugccaaaacuuucgug

SEQ ID NO: 148761 - RNA, 64 nt, Human
gagccucucugcuuuagcuaaagacgacugagaagaggugcaaggaagcgggcuccaggagcaa

SEQ ID NO: 148762 - RNA, 64 nt, Human
gucuucccaaccucagcugccuguauucaugccagaggugcaaaggcugccagccagugcugcu

SEQ ID NO: 148763 - RNA, 64 nt, Human
ccugggggaguccguggcgaugggcgcugggguggaggugcaggagccccaggaccugcuuuuc

SEQ ID NO: 148764 - RNA, 64 nt, Human
uuuaagcaaauagagccgucugggauuuguaacugaggugcaacugucaugaggcccaggcagc

SEQ ID NO: 148765 - RNA, 64 nt, Human
cagcuguugagugagcugcuaugacuuugguagagaggugcaauauguuuuuugaaccagcuau

SEQ ID NO: 148766 - RNA, 64 nt, Human
cccacaccucucucugaguccccaggaacacacagaggugcacaucacauucccuuguccacac

SEQ ID NO: 148767 - RNA, 64 nt, Human
ccccggcggaagccguagcuuucccugccaccuggaggugcaucugucugccugucuaucccug

SEQ ID NO: 148768 - RNA, 64 nt, Human
ucccggagugcccgugaagcguguuuuugcuccugaggugcauuuucucaucauccuugcuuua

SEQ ID NO: 148769 - RNA, 64 nt, Human
cuuggagacacggcuuguuccagaugaggaaacugaggugcaaagcaguuaagcaacuggucca

SEQ ID NO: 148770 - RNA, 64 nt, Human
caacuguuacugagucugcacgaacuuagauaaugaggugcaggguuauuugcauuuaaauugc

SEQ ID NO: 148771 - RNA, 64 nt, Human
aagcucaggacauggaggugccggaugcaggaaggaggugcagacggaaggaggaggaaggaag

SEQ ID NO: 148772 - RNA, 64 nt, Human
cccuuccuuaagcccaguccuguguccucugaaagaggugcagucacucacaccugcuugcgcu

SEQ ID NO: 148773 - RNA, 64 nt, Human
cuaaccuggccucacgcuggguaagcuuaagguagaggugcaggauuagcaagcccaccuggcu

SEQ ID NO: 148774 - RNA, 64 nt, Human
ggaauugccugcuggggugaugcagggaggaggggaggugcagggaagaggggccggccucagc

SEQ ID NO: 148775 - RNA, 64 nt, Human
ugaagauguggcaacccaugcccccuuuucugaggaggugcauggccugagcauuguuugucug

SEQ ID NO: 148776 - RNA, 64 nt, Human
uuugaggaccaauaucuguucguguugaggagaugaggugcagacuccacacuggggucuuaga

SEQ ID NO: 148777 - RNA, 64 nt, Human
cacuucucuccccagaagcucacacgcagcgucugaggugcagggcccaggugugcugggguga

SEQ ID NO: 148778 - RNA, 64 nt, Human
ggggccagucuugugcuccuggacaugcgguacugaggugcagacaagggucuccacuguggug

SEQ ID NO: 148779 - RNA, 64 nt, Human
aguucuugggaaucuuggagccuaaagagaaaccgaggugcaaauucauuucauggugacugac

SEQ ID NO: 148780 - RNA, 64 nt, Human
aggaggugccuuguaagcuaacugggcggagguggaggugcagugucaacuguggcucuguaac

SEQ ID NO: 148781 - RNA, 64 nt, Human
aucauauuucauaccgauuccauuauguuuucgugaggugcauuauguuuucaugaggugcaca

SEQ ID NO: 148782 - RNA, 64 nt, Human
cauuauguuuucgugaggugcauuauguuuucaugaggugcacaaaucauuaauuauagugcau

SEQ ID NO: 148783 - RNA, 64 nt, Human
auaaucuugccuuagugaucaugauuacacaaaagaggugcacugccaauaaguaucucuaauu

SEQ ID NO: 148784 - RNA, 64 nt, Human
augcagcaggcaacaacugccccuucuuuaugcagaggugcagaaccagggacuccugggccca

SEQ ID NO: 148785 - RNA, 64 nt, Human
gcccagcucagauucaagaaaagggugugaaguagaggugcaguuaaguggggggccacuaguc

SEQ ID NO: 148786 - RNA, 64 nt, Human
acgacugaauaagggaaaaguuagggaacccugagaggugcagcccuuccgcugugccccgccc

SEQ ID NO: 148787 - RNA, 64 nt, Human
cuuucucccuucccuccucuugcuccucaaguaagaggugcagagaugagguccuucuggacua

SEQ ID NO: 148788 - RNA, 64 nt, Human
gugauggcccucuugagccuugggcagggugggugaggugcagaugaccaggagugugugaaug

SEQ ID NO: 148789 - RNA, 64 nt, Human
cauaugccacccuucccccaaagcugauagggcagaggugcacuuuaugaaacuggcacuugac

SEQ ID NO: 148790 - RNA, 64 nt, Human
uugggaaagauaggaaugacuguuucaaagaagagaggugcacauaauuuaugcaggcaaguau

SEQ ID NO: 148791 - RNA, 64 nt, Human
ugaaaagcacaugugaauucguguauagugggcugaggugcagcugaucucuagcuaaucaaca

SEQ ID NO: 148792 - RNA, 64 nt, Human
uaaaccguguauuuauuacauugcugccuuuguugaggugcaaggaguguaaaauguauauuuu

SEQ ID NO: 148793 - RNA, 64 nt, Human
uugguaugaugcauauacaaguuggaagacuaaagaggugcagugugaucugagccuccaucau

SEQ ID NO: 148794 - RNA, 64 nt, Human
aaaugucaauaguuguuuuuuaaaauccaaaucagaggugcaggccaccaguuaaaugccgucu

SEQ ID NO: 148795 - RNA, 64 nt, Human
cccacaguaagcaccauggucagggagguggcaggaggugcaaagacagaaguauugagagaaa

SEQ ID NO: 148796 - RNA, 64 nt, Human
ugauuccuggcugaggggucaguuuuauggcugggaggugcagaauuacacagaagucccaguc

SEQ ID NO: 148797 - RNA, 64 nt, Human
aaggagcagaguugcaaauuaacaacuugcaaaugaggugcaaauaaaaugcagaugauugcgc

SEQ ID NO: 148798 - RNA, 64 nt, Human; identical to SEQ ID NO: 148797

SEQ ID NO: 148799 - RNA, 64 nt, Human
uguuuauuauucuaacaagguguggagugucagcgaggugcaauguggggagaauacauuguag

SEQ ID NO: 148800 - RNA, 64 nt, Human
uaugugaagaaacauuaucuuuaaagucaucugggaggugcagguaaguaaagagaaacaauuu

SEQ ID NO: 148801 - RNA, 64 nt, Human
cucuauuaacuuuuuuccuuuuaccaauaacuuugaggugcaaaacucaaacuuaugugggucu

SEQ ID NO: 148802 - RNA, 64 nt, Human
gucaaugagaaucaaauggaaacauaucauucuggaggugcacuuacucuucuacaauguggcc

SEQ ID NO: 148803 - RNA, 64 nt, Human
uguuggaagucuuugguauaugcaaaugaaaggagaggugcaacaacuuaguuuaauuauaaaa

SEQ ID NO: 148804 - RNA, 64 nt, Human
gcacacugaacuuguagggagugugauuuuguuggaggugcacauggucucugaauuugacaga

SEQ ID NO: 148805 - RNA, 64 nt, Human
ugugcucugaugcuacuucugccuagcccuggcggaggugcaggcccugucagcuggaacugga

SEQ ID NO: 148806 - RNA, 64 nt, Human
agcuacagaguucuuuucuugggaccuagacugggaggugcaaugucaggaccuccaggugaau

SEQ ID NO: 148807 - RNA, 64 nt, Human
uaagauacauccagaaaguccuggccaugaauuggaggugcagaguccugcagagccucugggc

SEQ ID NO: 148808 - RNA, 64 nt, Human
gcugucccucugaggccuagugaaaaagcugcaggaggugcauccuccaccucuaaucuuggag

SEQ ID NO: 148809 - RNA, 64 nt, Human
gagcugcuuguggguuucugggguggaaggcagggaggugcaacuggcagggccugaucagagg

SEQ ID NO: 148810 - RNA, 64 nt, Human
uuauagugguaaagaaacagguuguucacuugcugaggugcaaaaauucuuaagacuucuguuu

SEQ ID NO: 148811 - RNA, 64 nt, Human
ccaaaccuguggagcaguguggggcauccugccagaggugcacaggcuggaguuucaggcacug

SEQ ID NO: 148812 - RNA, 64 nt, Human
acaagggcuguucaugaaaagggagacuuacugggaggugcaagacaguggcauuucuccucuc

SEQ ID NO: 148813 - RNA, 64 nt, Human
guuuguggaccauagaagucuucaccucugguuugaggugcagggcugucuuuuguacuggagg

SEQ ID NO: 148814 - RNA, 64 nt, Human
ucuaaaacagcagcgaccucggccccuauccagagaggugcagcaagagagccauuucccugug

SEQ ID NO: 148815 - RNA, 64 nt, Human
agagcccaagcagcacucaggagaggggagaaaggaggugcaccuggcagcccacauuuuuguu

SEQ ID NO: 148816 - RNA, 64 nt, Human
ugcauucuucagguaaugggggcucauugugagggaggugcagaggcagcagaggauuggcaua

SEQ ID NO: 148817 - RNA, 64 nt, Human
cucccauggagggagccgggcccuugcugcucaggaggugcagacugccccgugcucugggccu

SEQ ID NO: 148818 - RNA, 64 nt, Human
ucuaaaacauacgcuaucauuggcccauguugcugaggugcauugugaacaauaccuuuaguga

SEQ ID NO: 148819 - RNA, 62 nt, Human
guggugguggcaaggacugaguccaggccugugaggugcagagugcccagaacuggacucag

SEQ ID NO: 148820 - RNA, 64 nt, Human
augcucccagauucucgaccuucccccggcccgggaggugcagccugcgucugccucugucgug

SEQ ID NO: 148821 - RNA, 64 nt, Human
agucggucguguuuuuaacacagagucucuagaagaggugcagacaucccgucugacugucccu

SEQ ID NO: 148822 - RNA, 64 nt, Human
cagcagccgugcagagccugggcuccggcagggagaggugcaggggagucaccgcccagaccuc

SEQ ID NO: 148823 - RNA, 64 nt, Human
gguggcuggucucgucugccgggggaaggguggggaggugcaaugggaugggaggcaggaugcu

SEQ ID NO: 148824 - RNA, 64 nt, Human
uguuucuguuuaguccguaaguuaccaugcuaaugaggugcacacaauaacuuagcacuacucc

SEQ ID NO: 148825 - RNA, 64 nt, Human
uuuugaaauggagucucguucugucgcccaggcugaggugcaguagugcaaucuccgcucacua

SEQ ID NO: 148826 - RNA, 64 nt, Human
auuucuugaaauaauaaauauuuuauugggaugugaggugcagaagaggaacugugcuggauuc

SEQ ID NO: 148827 - RNA, 64 nt, Human
cuaguguggggcgaaucucacggaccugaccucagaggugcaccagugccgcccagguagauaa

SEQ ID NO: 148828 - RNA, 64 nt, Human
ggggagggagccaacgccucagguggagugggcagaggugcaagagagggauguacugaagcuu

SEQ ID NO: 148829 - RNA, 64 nt, Human
ugugaugagacuagccaaacaaucucgucaucuggaggugcagaucuuagcggaccaauauggc

SEQ ID NO: 148830 - RNA, 64 nt, Human
agaugugggcuccggcuggauuuggguuuugugggaggugcaggggccaagagagacgugguag

SEQ ID NO: 148831 - RNA, 64 nt, Human
cagagcuggcucuggggagcugggcuaggaagaggaggugcagcccagacucuuccuagccuuu

SEQ ID NO: 148832 - RNA, 64 nt, Human
gaggccacacugacugcccacccagcuguggcgggaggugcagagcagagggcuuuagggagca

SEQ ID NO: 148833 - RNA, 64 nt, Human
gaggaggguguaagggucgacgcgugcugaaugggaggugcagguccucggugcguuggcagaa

SEQ ID NO: 148834 - RNA, 64 nt, Human
caaguuacacauuauagccagaaucuguaucacagaggugcaagcugacagcagagcucagucc

SEQ ID NO: 148835 - RNA, 64 nt, Human
gcaugaggggacuccuucaaaagaguuuucucaggaggugcacguuucaucaauuugaagaaag

SEQ ID NO: 148836 - RNA, 64 nt, Human
cucaucggcggcggugcucaugcaccacagcaaggaggugcauggccgggagcgcauccacggc

SEQ ID NO: 148837 - RNA, 64 nt, Human
gucugguguuuuuaacuugaucaugaucagcucugaggugcaacuucuucacauacuguacaua

SEQ ID NO: 148838 - RNA, 64 nt, Human
auuauuuguucaauaaacuggcugagcuuagagagaggugcagaauuccugguucugagcaggu

SEQ ID NO: 148839 - RNA, 64 nt, Human
ugaaaaacucaggcugccauagguucugcgaugagaggugcaggaggcaggagccuggcccagg

SEQ ID NO: 148840 - RNA, 64 nt, Human
aaacgacgggcaccuggaaccagucacggcuugggaggugcaggugccccguguuaggcgccuu

SEQ ID NO: 148841 - RNA, 64 nt, Human
ccccgcccccaucccguccacguugcugugucgugaggugcagcgggucacccuguggcccguc

SEQ ID NO: 148842 - RNA, 64 nt, Human
acaguggcccaggccuguaaucccaucacuuugggaggugcaggcaggcagauggcuugagccc

SEQ ID NO: 148843 - RNA, 64 nt, Human
guaaaaggacagagauuaagaucagcaaagggaggaggugcacagcacacguuccacgacagau

SEQ ID NO: 148844 - RNA, 64 nt, Human
aaacuugcuuaguccugcaacguucuccacucucgaggugcagaagcauacaucuuuauaaaaa

SEQ ID NO: 148845 - RNA, 64 nt, Human
uauuuuuguguggaaccauuuaucuuaaaacauugaggugcaguuuucauacacaaaaccuucu

SEQ ID NO: 148846 - RNA, 64 nt, Human
uggacuguuuuguauaacuguacaguguuuaauagaggugcauaaucagcuguuguuacuggua

SEQ ID NO: 148847 - RNA, 64 nt, Human
caaaaauuccaguagcauccagauccuuaagccagaggugcaugcuucuuuuuaaguaugaggg

SEQ ID NO: 148848 - RNA, 64 nt, Human
gaaggcaccagaggugaagcugcccagggcuccggaggugcagcuaaaggccaccaaggcagaa

SEQ ID NO: 148849 - RNA, 64 nt, Human
gccugagauggcugugcccgaugugcaccuccccgaggugcagcugccgaaagugucagagauu

SEQ ID NO: 148850 - RNA, 64 nt, Human
gccugaaauggccgugcccgaugugcaccucccagaggugcagcugcccaaagucugugaaaug

SEQ ID NO: 148851 - RNA, 64 nt, Human
gccugagauggcugugccagagguucgacuccccgaggugcagcugccaaaagucucagagaug

SEQ ID NO: 148852 - RNA, 64 nt, Human
gucagagguggcugugccagaggugcggcuuccagaggugcagcugccgaaagugccagagaug

SEQ ID NO: 148853 - RNA, 64 nt, Human
uucucuuucccgcaggggacucccagccucgcuggaggugcagaggccuggccucugucuguuu

SEQ ID NO: 148854 - RNA, 64 nt, Human
ucucugcuuuggagaaagacccagagaucaggcagaggugcagauucaaucauuacucauaacc

SEQ ID NO: 148855 - RNA, 64 nt, Human
gucugugcccucccgcugacuccugcuguguccugaggugcauuuccuguuguacacacaaggg

SEQ ID NO: 148856 - RNA, 64 nt, Human
agccccccgcccuucugagaguuggcgggucacugaggugcauucugggcuccagggacgccac

SEQ ID NO: 148857 - RNA, 64 nt, Human
gaugucccaguauguuucuuucugccccguugaagaggugcagccucaggcugagaaacacuga

SEQ ID NO: 148858 - RNA, 64 nt, Human
gcugccuggucugucuggaucccgagguauggcagaggugcaagaccuaguccccuuuccucua

SEQ ID NO: 148859 - RNA, 64 nt, Human
aggggcuuggccugcgccccgccagcugcccgcagaggugcagccucgaggaaucugagggcgu

SEQ ID NO: 148860 - RNA, 64 nt, Human
cucugggaccugcagcucugccuuugcuggcugggaggugcacacgcgagguauaggcuccaga

SEQ ID NO: 148861 - RNA, 64 nt, Human
cacaguggggaauccaagggucacaguauggggagaggugcacccugccaccugcuaacuucuc

SEQ ID NO: 148862 - RNA, 64 nt, Human
aggcugugcacucagggagggagggugggacacagaggugcaucuagggucccaccuguacccu

SEQ ID NO: 148863 - RNA, 64 nt, Human
ucuagcagaggccccacagaaggcucagggcaccgaggugcacuugccggccugggaggugucc

SEQ ID NO: 148864 - RNA, 64 nt, Human
cacaggccgcccugcgggugaacaaagcagccacgaggugcaacaagguccucugucagucaca

SEQ ID NO: 148865 - RNA, 64 nt, Human
caugggucuggauuuccaagaaagcggagaccucgaggugcaggacugucggggcgagguggcc

SEQ ID NO: 148866 - RNA, 64 nt, Human
ccucaggucgcuggagugcaccagucuuggggaagaggugcaggagaagcuguguuuuuuaucu

SEQ ID NO: 148867 - RNA, 64 nt, Human
caccuuggguugcuggagcucaccagucuugagggaggugcaggggaaacuguguuuuuuaucu

SEQ ID NO: 148868 - RNA, 64 nt, Human
cagaagggcuggaaaggaugcugccaggugacccgaggugcacucgccccagggagauggagua

SEQ ID NO: 148869 - RNA, 64 nt, Human
agcgcuccagcacaucagucccgacgcuuccugugaggugcacgcuccgcagcccagcccagcc

SEQ ID NO: 148870 - RNA, 64 nt, Human
ggcgccugcagggcugcuacagggaccuggucaggaggugcacauggugcccugcccucaccca

SEQ ID NO: 148871 - RNA, 64 nt, Human
ccucaggccucugagggcaccaggcccuggagaagaggugcaauucaggguguguguguguuuu

SEQ ID NO: 148872 - RNA, 64 nt, Human
gcagggacucuuuccuuacugggcccaggaguucgaggugcaguuuggcaaccuguguccuggc

SEQ ID NO: 148873 - RNA, 64 nt, Human
agccugauucucugcucccaggagccagugacaugaggugcagaggcccacccagcccccuacc

SEQ ID NO: 148874 - RNA, 64 nt, Human
uaggacuugaaugauucggcuaccaccuguuccagaggugcagacaagagguggcgagagcccc

SEQ ID NO: 148875 - RNA, 64 nt, Human
cggccacgaccacagacacgcaugcacacacgcagaggugcagagcgaggaggccggcaaaucc

SEQ ID NO: 148876 - RNA, 64 nt, Human
gagauacuuuuauauauuuguaugggacucugaggaggugcaaccuguauauauauugcauucg

SEQ ID NO: 148877 - RNA, 64 nt, Human
ugacaugagggccauucuuguggacugguugguggaggugcagguguccuuugagaugacccau

SEQ ID NO: 148878 - RNA, 64 nt, Human
ggaccaucacacgugaagcaccaggcugggagaugaggugcacacaguugcagcuaggucgggg

SEQ ID NO: 148879 - RNA, 64 nt, Human
ggcucugggcagcagcagggaucuggugguaugugaggugcaugcgggcagugaugggagaagg

SEQ ID NO: 148880 - RNA, 64 nt, Human
cauuuuuuugugugaaguaaauuaaucaacuagagaggugcaaaacguucucaguugauaucug

SEQ ID NO: 148881 - RNA, 64 nt, Human
cucucucacucuccguacagcugaagaguugggcgaggugcagagacuucuagcuggacaaccu

SEQ ID NO: 148882 - RNA, 64 nt, Human
acuccuggauccuaucugcccuggacaaggugcugaggugcauuguccugcuuucuugggacuu

SEQ ID NO: 148883 - RNA, 64 nt, Human
uaggccaaucagaagcuaacagcaguuucagguagaggugcaugccuaauguuaguuaguguag

SEQ ID NO: 148884 - RNA, 64 nt, Human
caaccgacugaagggguguugcaccuaaucaucagaggugcaguugggugcuuaaccuuuuugc

SEQ ID NO: 148885 - RNA, 64 nt, Human
augcaugcgggguuuaauaccuaggugauggguugaggugcagcaaaaccaccauggcacacgu

SEQ ID NO: 148886 - RNA, 64 nt, Human
ucugcuuggcgaccucccugcgugcacggccuaggaggugcacgggccaccauagucacacugg

SEQ ID NO: 148887 - RNA, 62 nt, Human
agaacuaagaagggagggcgagugggucuccauuccccgagaagccgggggcagggugggau

SEQ ID NO: 148888 - RNA, 62 nt, Human
acagcauucggcguauaccuaaggagaguuuuuuccccgaacugacagcaacgauuccaacc

SEQ ID NO: 148889 - RNA, 62 nt, Human
cugaaucccuccuauucaccuugcugcuguuauuccccgaaugcgcaacauaccccccauca

SEQ ID NO: 148890 - RNA, 62 nt, Human
cuuuucaugcccaucccgaugaaccugcaucauuccccgacacugccaagccaacccuggaa

SEQ ID NO: 148891 - RNA, 62 nt, Human
ggggacugcaccagaaagugucuaaccuuguguuccccgaaauccuuucucugacuuaggaa

SEQ ID NO: 148892 - RNA, 62 nt, Human
ccacucuuuccaucagcccuacccuacccucauuccccgacacccucuggcuugaaccaugg

SEQ ID NO: 148893 - RNA, 62 nt, Human
ggaaugaguuggcucuggacguuucugcccuguuccccgaucagagcuccucugcaggaaac

SEQ ID NO: 148894 - RNA, 62 nt, Human
agaaggguauauuauuugaaggaucuuuuuauuuccccgaggucuuucgcacuggagacagc

SEQ ID NO: 148895 - RNA, 62 nt, Human
ugaaggugacuuucauggaaguuucauuucuuuuccccgauuguaccaacugcauguacuuu

SEQ ID NO: 148896 - RNA, 62 nt, Human
ugucucuucucgccccugccgccugccccagcuuccccgacuccaucugcagcucugccauu

SEQ ID NO: 148897 - RNA, 62 nt, Human
ccaccuuagggcugaugauucucaaaucuguauuccccgaucuugcauuugagcuccagccc

SEQ ID NO: 148898 - RNA, 62 nt, Human
ugggccuuccugccaguggcccccaguuuuucuuccccgaggcccacucggccuggccuucc

SEQ ID NO: 148899 - RNA, 62 nt, Human
auucuuuaaacgcucuagguacgaugacaguguuccccgauaccaugcuguaaggauccgga

SEQ ID NO: 148900 - RNA, 62 nt, Human
ugccgucuggcuaggacucccuucuuccuuccuuccccgagaaggccucaauguggcgagga

SEQ ID NO: 148901 - RNA, 62 nt, Human
gcucagcgcccaccgcccaccaccccuccugcuuccccgagccugacccuguuccgcccacu

SEQ ID NO: 148902 - RNA, 62 nt, Human
cucuuacuuuugguguuggagagacucuacgcuuccccgauggaugguacuucuucugcucu

SEQ ID NO: 148903 - RNA, 62 nt, Human
gcucccacuuugccuucugccaugaguaaaaauuccccgaggacucccuagaagcagauguu

SEQ ID NO: 148904 - RNA, 62 nt, Human
ugcugugcccuauccccacugauaccaucugauuccccgaugccugugccuguuccaccugg

SEQ ID NO: 148905 - RNA, 62 nt, Human
guuauuuuaaacaucuuuguggugagaauuuuuuccccgauauucuccuucugucaaaguca

SEQ ID NO: 148906 - RNA, 62 nt, Human
uauuaagcauaaaguguugccaccauaccuccuuccccgagugacucuggauuuggugcugg

SEQ ID NO: 148907 - RNA, 62 nt, Human
gauugaaugcugcccagggucaguguaucuaauuccccgagacccucguuugauagugcuuc

SEQ ID NO: 148908 - RNA, 62 nt, Human
uguuugcaaaauggccaaaaaaaaaaaccggcuuccccgagcagcugcccugaaaguagggg

SEQ ID NO: 148909 - RNA, 62 nt, Human
uuccuauguccacagcugaccccaagcagccguuccccgacuccucaccccugagccucacc

SEQ ID NO: 148910 - RNA, 62 nt, Human
gaaugcucuuggacucgguucuccaggccugauuccccgacuccauccuuuuucagggguua

SEQ ID NO: 148911 - RNA, 62 nt, Human
uggcuucagcggaagucugcugaccccuuauauuccccgagaguauaaagagaucggaaaua

SEQ ID NO: 148912 - RNA, 62 nt, Human
cugucaaugaugcacuaaccucccaaccugauuuccccgaaucugagggaaggugagggagu

SEQ ID NO: 148913 - RNA, 62 nt, Human
aguguggggaaccaaaacuucgugucuccccuuuccccgaugccaucagcauagacuugacu

SEQ ID NO: 148914 - RNA, 62 nt, Human
cuguuguccauccaguccacugacaagaggguuuccccgagagccgaaguggacugaagcua

SEQ ID NO: 148915 - RNA, 62 nt, Human
agcacacccuuaggcaggcgccccuuccaccuuuccccgagaccgucgucgcuggagggggc

SEQ ID NO: 148916 - RNA, 62 nt, Human
aguguguuaugggugcugaacucucucucuuuuuccccgauuuuccagagcuaggcugugga

SEQ ID NO: 148917 - RNA, 62 nt, Human
ccuacccugauguuuuacucauuggaauguuuuuccccgauuguggaugacuucuuuucuga

SEQ ID NO: 148918 - RNA, 62 nt, Human
cauccaccuggcaggugaccuggaggaguagcuuccccgaggacccccaggcuuggccugug

SEQ ID NO: 148919 - RNA, 62 nt, Human
ccggccccccaacuucagggacccaccgcccauuccccgagagcugucggaaccagaugcaa

SEQ ID NO: 148920 - RNA, 62 nt, Human
ugugugaucucgucuuccagcgugccgcucaguuccccgaauccgugugcacacgugugauc

SEQ ID NO: 148921 - RNA, 62 nt, Human
agggagaggaagcucuagcuccgggccugaguuuccccgaggcugcgucggaggagcugcag

SEQ ID NO: 148922 - RNA, 62 nt, Human
ggauuguccuggcuuugucgacaaagucccacuuccccgaguauuaagggcccuugguauca

SEQ ID NO: 148923 - RNA, 62 nt, Human
aacgggggugccaggagccccaggcugagggcuuccccgaaagucugggaccagguccaggu

SEQ ID NO: 148924 - RNA, 62 nt, Human
cugcucuguuccucagguggggcccagagcccuuccccgagacugcugaugucuguaaccac

SEQ ID NO: 148925 - RNA, 62 nt, Human
cgaucccugggaccaaccgcauccucagcuucuuccccgagaaaugcuggagcaggcuguuc

SEQ ID NO: 148926 - RNA, 62 nt, Human
cccccacgcucuggaugucucugcucuguuccuuccccgagccccugccccggcuccccgcc

SEQ ID NO: 148927 - RNA, 62 nt, Human
augcagaaugacgaugccugccuuggugcugcuuccccgagugcugccuccuggucaaggag

SEQ ID NO: 148928 - RNA, 62 nt, Human
cugcuucuuagggcccucucccugccccagcuuuccccgaccaaucacgccuacagugcuuu

SEQ ID NO: 148929 - RNA, 62 nt, Human
ggggccuggucugcuuucccgggccugaaagcuuccccgagguuugcagggucagggaggag

SEQ ID NO: 148930 - RNA, 62 nt, Human
acccgggggugccgacgcccuggggcgcagacuuccccgagccgucgcugacuuggccugga

SEQ ID NO: 148931 - RNA, 62 nt, Human
aaaaagcuccuggggcguccaggccgcgcccuuuccccgacgcccacccaaccccaagccag

SEQ ID NO: 148932 - RNA, 62 nt, Human
gggagcagagccugggccuccccuaagaggcuuuccccgaggcagcucuggaaucugugccc

SEQ ID NO: 148933 - RNA, 62 nt, Human
augaugggacaggccuaacaacacauguaagcuuccccgagagcuuucagcugguucaccuc

SEQ ID NO: 148934 - RNA, 62 nt, Human
ccugugggggaagagcacagcccucccgccccuuccccgagggaugaugccacaccaagcug

SEQ ID NO: 148935 - RNA, 62 nt, Human
agaacccacugauggcucauuagaucugucccuuccccgagguccgugugugacuuugagca

SEQ ID NO: 148936 - RNA, 62 nt, Human
uccuggccucacugaucuacaacuucguccuguuccccgacaccaagacccuggcgcagcgg

SEQ ID NO: 148937 - RNA, 62 nt, Human
cucccuccacucuucccgcgaacaucacaccguuccccgaccaagccgugugcaauacaaca

SEQ ID NO: 148938 - RNA, 62 nt, Human
cugucucacagcugacaaagauguucuuccucuuccccgacccacauuucaagcggacaaag

SEQ ID NO: 148939 - RNA, 62 nt, Human
ugguaugauguauauuuaauuaaagcacacuuuuccccgaccguauacuuaaaaugacaaag

SEQ ID NO: 148940 - RNA, 62 nt, Human
aucucacugcagucugaaucuagacaucgccauuccccgaggugcgaccucagacuaaugac

SEQ ID NO: 148941 - RNA, 62 nt, Human
uaugcauucacauugaguguggcucauuuucuuuccccgaacgccaugacuguucagaagca

SEQ ID NO: 148942 - RNA, 62 nt, Human
ccucgagccuggggcugcccuaccucuacccauuccccgaccagagcuuugcccuugcuugg

SEQ ID NO: 148943 - RNA, 62 nt, Human
gacacagacguuaggcauuuccugcugaacguuuccccgaagagucagccccgacuuccuga

SEQ ID NO: 148944 - RNA, 62 nt, Human
ggaaccgaccccuaguugagagcaccuugcaguuccccgagaacuuucugauucacagucuc

SEQ ID NO: 148945 - RNA, 62 nt, Human
auaauggaaugcuacuaagauacuccauauucuuccccgaaucacacagacaguuucugaca

SEQ ID NO: 148946 - RNA, 62 nt, Human
ucugggugugucucacuuagaaaucgugguucuuccccgagggugcauguugcaggagggag

SEQ ID NO: 148947 - RNA, 62 nt, Human
aggagacagugugggaaacgcuccugcuuuaauuccccgagaaacggcucuuccugccugga

SEQ ID NO: 148948 - RNA, 62 nt, Human
cuuuucccuucucugucccauugcuuucuccuuuccccgacgcacagaauaaacaugaagcu

SEQ ID NO: 148949 - RNA, 62 nt, Human
uuuuggcaccuuacuugaccauuuguuucuguuuccccgacuggggcaggguguuuagaauu

SEQ ID NO: 148950 - RNA, 62 nt, Human
ggacaguguacuccucuccugccagccuccccuuccccgaggugugguggcugcagucucag

SEQ ID NO: 148951 - RNA, 62 nt, Human
gacgguuucuagccucugagaugcuaauuuauuuccccgaguccucagguacagcgggcugu

SEQ ID NO: 148952 - RNA, 62 nt, Human
ugacccugcuuaccugggagcacacuuuucccuuccccgaugaccugggaugguggccaggc

SEQ ID NO: 148953 - RNA, 62 nt, Human
cacccucuaccaucuguaaacaacugggugccuuccccgaccacaccccaaugccuucccag

SEQ ID NO: 148954 - RNA, 62 nt, Human
uggcuucagcgaaagucugcuaaccccuuacauuccccgagaguguaaagagaucggaaaua

SEQ ID NO: 148955 - RNA, 62 nt, Human
aagugagacuccacccuccccaccuggcucauuuccccgaugacccuggauuguaggaaagu

SEQ ID NO: 148956 - RNA, 62 nt, Human
gcuacaaguguuuuagauguuacuaccuuauuuuccccgaauucuauuuuuguccuugcaga

SEQ ID NO: 148957 - RNA, 62 nt, Human
gccaucccucuguugccaucagcuugauuggcuuccccgagggccagcagggcugggggcuc

SEQ ID NO: 148958 - RNA, 62 nt, Human
ccaccccugcgcugugcugaccccaccgccucuuccccgaucccuggacuccgacucccugg

SEQ ID NO: 148959 - RNA, 62 nt, Human
acagugggggccaggccugccuuggucuccccuuccccgagucuugccucaccccaggugug

SEQ ID NO: 148960 - RNA, 62 nt, Human
gccaaggaagcuggaggaaucccugacucaacuuccccgaaggaggccucuguggcggccag

SEQ ID NO: 148961 - RNA, 62 nt, Human
uccaguccucguucuagaggaaggaguaggacuuccccgauccccguagggcuucagcuuuu

SEQ ID NO: 148962 - RNA, 62 nt, Human
ggcagcgugugggucccgcacucugcccccauuuccccgauguccccugcgggcgcgggcag

SEQ ID NO: 148963 - RNA, 62 nt, Human
aaccggcgaggcugggccagccgcuccaccauuuccccgacugcauggagacaguagaauua

SEQ ID NO: 148964 - RNA, 62 nt, Human
ugagguggcccugaagaugccccgccuuaguuuuccccgauuuggggcucgagcaaaggaag

SEQ ID NO: 148965 - RNA, 62 nt, Human
gccaaaggcaaggcccacgggcuggaugucacuuccccgacugucucuugguuggcuugucc

SEQ ID NO: 148966 - RNA, 62 nt, Human
gacacaccccaaggcagcccaacccccaccccuuccccgacacccaagccccuccccacguc

SEQ ID NO: 148967 - RNA, 62 nt, Human
ccaugagcugccaggcagucaaaaacagaagcuuccccgacuugugagucccugagaugugc

SEQ ID NO: 148968 - RNA, 62 nt, Human
cggggcuccccacgcccccaugcagugaccgcuuccccgaugugagccgccucggagugugg

SEQ ID NO: 148969 - RNA, 62 nt, Human
uaaagcgugugagguugggugauagccguuccuuccccgacacccucaauuuccccaucucu

SEQ ID NO: 148970 - RNA, 62 nt, Human
aggcaccaagggaaggccccauuccggggcuguuccccgaggaggaagggaaggggcucugu

SEQ ID NO: 148971 - RNA, 62 nt, Human
uuguggcguuauucaaagaggagacuuugaaauuccccgauggcuggaauguggagcccagg

SEQ ID NO: 148972 - RNA, 62 nt, Human
gcugguguccauccagcacugaccagcccugauuccccgaccaccgcccaggguggagaagg

SEQ ID NO: 148973 - RNA, 62 nt, Human
ccuccagcaccugcaggcagcuuggaaguuucuuccccgaguggagcuucgacccacccacu

SEQ ID NO: 148974 - RNA, 62 nt, Human
ccuagaacacucucucccaaguauaugucugguuccccgacucacuuuauucaagucccugc

SEQ ID NO: 148975 - RNA, 62 nt, Human
uagaaaagaaccuacgugaccaucggggcagguuccccgauacccaaugaccccagagcagu

SEQ ID NO: 148976 - RNA, 62 nt, Human
ugaagaccucccuucuugccucuccagacguguuccccgaggagaucuuccuuccguccuuc

SEQ ID NO: 148977 - RNA, 62 nt, Human
uccgaguucgcccuucccccaccuccuugucuuuccccgaccgagcaccagacugcagaaug

SEQ ID NO: 148978 - RNA, 62 nt, Human
uuauuucuauguuuguguuaccauguuaacuuuuccccgagagaaaguguuaacauugagac

SEQ ID NO: 148979 - RNA, 62 nt, Human
ucccgagacggcugagugaccccaagaaaggcuuccccgacacccagacagaggcugcaggg

SEQ ID NO: 148980 - RNA, 62 nt, Human
caucauaacuuuacagaauugaaucuagagucuuccccgaaaagcccagaaacuucucugca

SEQ ID NO: 148981 - RNA, 62 nt, Human
agacaauagccuuugcugacaccccagccuacuuccccgauccugggcucccucuugauuac

SEQ ID NO: 148982 - RNA, 64 nt, Human
aaaauuuuaaaagaaaaugugacuucaaaggaaaggaacaaauuuucaaagacuugggggagug

SEQ ID NO: 148983 - RNA, 64 nt, Human
gcucccuucauuuugggacugaggcugcagcauuggaacaaaagagcauuauuucaauuuuucu

SEQ ID NO: 148984 - RNA, 64 nt, Human
auuguaugcgucagugagccuucuaucaccuucuggaacaaagucacuugaaaucucuugauga

SEQ ID NO: 148985 - RNA, 64 nt, Human
aacauucacuuucugccucugaggaaagauacagggaacaaaaaucaauuuguacagucuuaau

SEQ ID NO: 148986 - RNA, 64 nt, Human
cagcgcaggauguaaauagcacuaacgaucgacuggaacaaagugaccgcuguguaaaacuacu

SEQ ID NO: 148987 - RNA, 64 nt, Human
gacaggcuuaggggaaagagcuuguccuaucucaggaacaaaauuauaggcugugggcagaggg

SEQ ID NO: 148988 - RNA, 64 nt, Human
cucucagagagaagugggcaggagggguccucaaggaacaaagaagauaaagcacaaaucgcag

SEQ ID NO: 148989 - RNA, 64 nt, Human
uccuuuuucaaauuaagugugcaugauuguauauggaacaaauacuaaggucccagggugggag

SEQ ID NO: 148990 - RNA, 64 nt, Human
ucuacaucuacagcuguucacuggaagcgcugagggaacaaaugguuggcaugcagcccccuca

SEQ ID NO: 148991 - RNA, 64 nt, Human
uccucaguagagacuagugaugcauuagcuucugggaacaaacuuguaucgguucuuaauuaaa

SEQ ID NO: 148992 - RNA, 64 nt, Human
ggaagcuguguugaaacagaaaaauaagucaaaaggaacaaaaauuacaaagaaccaugcagga

SEQ ID NO: 148993 - RNA, 64 nt, Human
cugcuuucaucccaugccucaucaaugaggaaagggaacaaaguguauaaaacugccacaauug

SEQ ID NO: 148994 - RNA, 64 nt, Human
cugaagcaaaaugauaggcaucauucuaacuucaggaacaaaagccaguucuguuuuaugaaau

SEQ ID NO: 148995 - RNA, 64 nt, Human
gggcccaaacagccucaguuaacugcauaauucaggaacaaaaccagcuugcuuuguugcacgc

SEQ ID NO: 148996 - RNA, 64 nt, Human
agccuggaguuaaauugagacuucuaaaaugauuggaacaaagacuaaguugugccagauguaa

SEQ ID NO: 148997 - RNA, 64 nt, Human
ccagcagcaggggaaagauuauauuuuauaagagggaacaaauuuucacaauuugaaaagccca

SEQ ID NO: 148998 - RNA, 64 nt, Human
aguggguugcuauuuucuagauuuuacuuuuuagggaacaaaauaaaauccuuuguuaaaacug

SEQ ID NO: 148999 - RNA, 64 nt, Human
gucugucauggggaaacuauauuuuugagcacauggaacaaauuauacuuccucauucauauua

SEQ ID NO: 149000 - RNA, 64 nt, Human
uaguccuauaauuuucagcuuaauuauaaacaaaggaacaaauaaguggaagggcagcuauuac

SEQ ID NO: 149001 - RNA, 64 nt, Human
guuuaaagagaagcaaauuaaacauccugaaucgggaacaaaggguuuuaucuaauaaaguguc

SEQ ID NO: 149002 - RNA, 64 nt, Human
gcuaucacugaaacucuuuccucuuuucaaccugggaacaaauuuuaguuuucauuuuagguuu

SEQ ID NO: 149003 - RNA, 64 nt, Human
uagcauuuuuuaaauugugcaugagcucaaagggggaacaaaauagauacacccaucaugguca

SEQ ID NO: 149004 - RNA, 64 nt, Human
augucuuauuaaaaaacaacaaaaaaagacaaauggaacaaagaagcugugaccccagcaggau

SEQ ID NO: 149005 - RNA, 64 nt, Human
uugauucgaaggaugaagacgaagaagcaagggaggaacaaaugaagaaccaucuuuguucaug

SEQ ID NO: 149006 - RNA, 64 nt, Human
gugucauggugcagagguaggcauucugagcaggggaacaaaauaagggccuagaaacucaccc

SEQ ID NO: 149007 - RNA, 64 nt, Human
cucccuguugcccuccuuuucccguuuagucccaggaacaaaaaagggcauuuuggguacaggg

SEQ ID NO: 149008 - RNA, 64 nt, Human
gauucaguacuccucaaccacucuccuaaugauuggaacaaaagcaaacaaaaaagaaaucucu

SEQ ID NO: 149009 - RNA, 64 nt, Human
agauaaagcugcaggaaauagcauuccaggcaaaggaacaaaacuggugcagacccagcugcua

SEQ ID NO: 149010 - RNA, 64 nt, Human
ucccaugaaucuucugcucuuguuugugugacauggaacaaauaacuucuuugccaccacuuug

SEQ ID NO: 149011 - RNA, 64 nt, Human
agucacagagaugagcccuauuacuugauauucaggaacaaagguaccugaacauucugauaau

SEQ ID NO: 149012 - RNA, 64 nt, Human
aaguguucauguucuagugaacacagcuuguucaggaacaaacacuaaaacgauuugaguagag

SEQ ID NO: 149013 - RNA, 64 nt, Human
uuuuaaugaggaccaauguacaguugaaauaacuggaacaaauuauuuuuggugugugugacaa

SEQ ID NO: 149014 - RNA, 64 nt, Human
uuuaaguacugcuuuuauggcaguuuauaauauaggaacaaauuuguacuuggggauugguaaa

SEQ ID NO: 149015 - RNA, 64 nt, Human
auucaagguauagucuuguuucucagaaucccagggaacaaagcaauugucugccucucccucu

SEQ ID NO: 149016 - RNA, 64 nt, Human
uagagacauaacugacuuuuguaaaugcugcugaggaacaaaugaaggucauccgggagagaaa

SEQ ID NO: 149017 - RNA, 64 nt, Human
ugacccuccuuuaugggaggaucaggaccaggugggaacaaaggaggcucagagaagaaagacg

SEQ ID NO: 149018 - RNA, 64 nt, Human
auugauguguaacuguaugcagacugguuguaguggaacaaaucugauaacuaugcagguuuaa

SEQ ID NO: 149019 - RNA, 64 nt, Human
ugcucccucucgcucucucacuccacuacuuuuuggaacaaagugauggcagaaugcgguggug

SEQ ID NO: 149020 - RNA, 64 nt, Human
ggcccaguggaacagucacccuucugggcaagggggaacaaaucacaccucugggcuucagggu

SEQ ID NO: 149021 - RNA, 64 nt, Human
aauuguccuugccuuuccagcuuaauuauuuuaaggaacaaaugaaaacucugggcugggugga

SEQ ID NO: 149022 - RNA, 64 nt, Human
auucuggcuucuguuuuauuccaagaagcuucuuggaacaaaucaguaggaauugaaaagaaag

SEQ ID NO: 149023 - RNA, 64 nt, Human
acaaaaggaucaugugugucagcaggggccguuuggaacaaaccuagucauuaaugaguaagau

SEQ ID NO: 149024 - RNA, 64 nt, Human
auagauaccacugaaugaaauuaaauguugauuaggaacaaauuuaaggcuuaaaaaauacuuu

SEQ ID NO: 149025 - RNA, 64 nt, Human
uauagaaauuuauuuuauuaggaaauuugucuuuggaacaaaguggcagcuauaaaauuauuuu

SEQ ID NO: 149026 - RNA, 64 nt, Human
gaucagcccuauguaaguuaagaucauaauauguggaacaaauggaauuguaagugcuuucaaa

SEQ ID NO: 149027 - RNA, 64 nt, Human
agaugcaguuaccuuagagacuuauuuauuugcaggaacaaauggugccugaauauuaacagug

SEQ ID NO: 149028 - RNA, 64 nt, Human
cacuguucagucuguuauggaaaaggagaacuagggaacaaauguugcucagggcuggugucag

SEQ ID NO: 149029 - RNA, 64 nt, Human
agcauaagggaaaaugucacguaaacuagaucagggaacaaaauccucuccuuguggaaauauc

SEQ ID NO: 149030 - RNA, 64 nt, Human
cugagccaccccacccggccuauuuucuuaaaggggaacaaaugaucuugacaacauauuauuc

SEQ ID NO: 149031 - RNA, 64 nt, Human
gggauuaugacagguauuaccaaaaacaccaaaaggaacaaaggggccugcguuaaaaccuaau

SEQ ID NO: 149032 - RNA, 64 nt, Human
auugcucugggcuguuuuaaagcccauuucacgaggaacaaagauuuacuuccuguccugccau

SEQ ID NO: 149033 - RNA, 64 nt, Human
ucuugacuagucaaggacugggaacgugccagggggaacaaaguaagcuugaugggcuggaacu

SEQ ID NO: 149034 - RNA, 64 nt, Human
aggugcugcacugguugcugauuauggucaugauggaacaaagacagauaccuucagaguaugu

SEQ ID NO: 149035 - RNA, 64 nt, Human
guguauuuuagaaauaguaacuucuaaagagucuggaacaaaguggugauuaaaauuccuaaug

SEQ ID NO: 149036 - RNA, 64 nt, Human
ucaguucuuggcugccguccuguggcagcuuaauggaacaaaaauuacagacuuuggugaacca

SEQ ID NO: 149037 - RNA, 64 nt, Human
auggauggaugguagggauguuaauaauuuuaguggaacaaagccugugaaaugauuguacaua

SEQ ID NO: 149038 - RNA, 64 nt, Human
acaguuuauugauuucaaauugucugguacuauuggaacaaauauuuagaauaaaaaaauuucc

SEQ ID NO: 149039 - RNA, 64 nt, Human
uucuauaauaaaaagagguucuaaccauuauuugggaacaaagagaguuuucaucuuuuuucag

SEQ ID NO: 149040 - RNA, 64 nt, Human
caacgaugaugugagucgaagaguggacaaacagggaacaaagaaacagaugccccagccugcu

SEQ ID NO: 149041 - RNA, 64 nt, Human
uauuuugaaauggacugugaaggaaaaggggacaggaacaaaggaccaaaaauaagcuacaugu

SEQ ID NO: 149042 - RNA, 64 nt, Human
gagccacuaauguaagauacagaaacauagcugaggaacaaauagaccauuuccauacuaaacc

SEQ ID NO: 149043 - RNA, 64 nt, Human
ggaucugaguuauuuugcuaaacuugggggaggaggaacaaauaaauggagucuuuauugugua

SEQ ID NO: 149044 - RNA, 64 nt, Human
uguuuugaaauucgguaucucacugagcuaaucuggaacaaaccucucaccucaggccagaagg

SEQ ID NO: 149045 - RNA, 64 nt, Human
uauaauugucuacagaagcaagagcaaucuggaaggaacaaaaauguuuucugugauuaacagu

SEQ ID NO: 149046 - RNA, 64 nt, Human
uaacucugguauccaacuggguguauucuaguguggaacaaaaaacagugaacacaagugcuua

SEQ ID NO: 149047 - RNA, 64 nt, Human
uacaagcagcuucugagucaaguguucuaauuuuggaacaaagcagguuuuacugcuuuuccag

SEQ ID NO: 149048 - RNA, 64 nt, Human
cuccccuaagaagauggauguccucaaaagagaaggaacaaaccuccuugggaauccacauuuu

SEQ ID NO: 149049 - RNA, 50 nt, Human
cuacccgucaggccuugugaggaacaaacuccuggguuggcagcaugcac

SEQ ID NO: 149050 - RNA, 64 nt, Human
acagaaaugacugccggucauuugaaugagaccuggaacaaaucguuucucagaaguacuuuuc

SEQ ID NO: 149051 - RNA, 64 nt, Human
gacaggucucaaguccuucccagcauacacacagggaacaaacacauaccacaaaccgguaacu

SEQ ID NO: 149052 - RNA, 64 nt, Human
gcacaucaugagccuucagucaggguuugucagaggaacaaaccaggggacacuuuguuagaaa

SEQ ID NO: 149053 - RNA, 64 nt, Human
uguugccuugcuaggauccacccuccuauaauauggaacaaauaucugaaugaaauccacccua

SEQ ID NO: 149054 - RNA, 64 nt, Human
uccagaacaugacaacagagagcugcguccacagggaacaaagcccugaccucucucuccacau

SEQ ID NO: 149055 - RNA, 64 nt, Human
uccaagauauuuuucacaaaauagaaacucauauggaacaaaauaagaaaccccagccaugaaa

SEQ ID NO: 149056 - RNA, 64 nt, Human
auuggggauuacauuucaacuugagguuugggcgggaacaaauagucaaauuauauuacccauc

SEQ ID NO: 149057 - RNA, 64 nt, Human
ucucucugaauuuuaauuuccucucauuaaaauaggaacaaaauuugcuauccuuuagauuagg

SEQ ID NO: 149058 - RNA, 64 nt, Human
caggaugggacuccccagggaacgcagggugaagggaacaaagcuggaggcucuggagcugggu

SEQ ID NO: 149059 - RNA, 64 nt, Human
uaaaggccugguucuaaguccuuuuuaaagccauggaacaaaaccugauacaucacccuaacag

SEQ ID NO: 149060 - RNA, 64 nt, Human
agcuccuauuuuguacuccuggcuagaaugcuguggaacaaauacaaagugaaaaaaguucucu

SEQ ID NO: 149061 - RNA, 64 nt, Human
uuuacuguuagacuaaucaaaaauaacuuuaaaaggaacaaagaaacuccaacauuucacauua

SEQ ID NO: 149062 - RNA, 64 nt, Human
ggaaucaagaccaauaccaaggagaaauuccuagggaacaaaaauuccaaugaggaauugaccu

SEQ ID NO: 149063 - RNA, 64 nt, Human
ccugacuguggaguugggauguggaaguggggcuggaacaaagcuucugccuagggaggagcua

SEQ ID NO: 149064 - RNA, 64 nt, Human
uugacaccccacaguggaagggagcaucaggagaggaacaaaaaaagggaucucagggagaggc

SEQ ID NO: 149065 - RNA, 64 nt, Human
uaaaaggaaaacauguuucuucaaauugcauaauggaacaaauggcaaugugaguagguuacau

SEQ ID NO: 149066 - RNA, 64 nt, Human
auuuuucuuauaggcuuuuuguuaaaauagugaaggaacaaauguuaaaggguaagauaauuuc

SEQ ID NO: 149067 - RNA, 64 nt, Human
cucccucucaccacccucuucugccuaugagcggggaacaaaaaggccagaugacagguaagug

SEQ ID NO: 149068 - RNA, 64 nt, Human
cccugccaggcccagccuucuuagccccaacuugggaacaaagugcaacaugggaucauggguu

SEQ ID NO: 149069 - RNA, 64 nt, Human
ugaccacaccaacacugacccuugaaccaauaaaggaacaaaugacuauuaaagcacaaauugu

SEQ ID NO: 149070 - RNA, 64 nt, Human
uauuuggaagcuucaaaagguuucuauauguaauggaacaaaaggggaauucucuuuuccuaua

SEQ ID NO: 149071 - RNA, 64 nt, Human
cuucugcgguaauucaucacauaguaucuuaaagggaacaaauaauguuucauccuauggaaau

SEQ ID NO: 149072 - RNA, 64 nt, Human
uugacuucuugcuucagucaucagccagcaagagggaacaaaacuguucuuuugcauuuugccg

SEQ ID NO: 149073 - RNA, 64 nt, Human
uuuugggggaacagggagcauucacagggucuugggaacaaaggccugggccuccccguuugaa

SEQ ID NO: 149074 - RNA, 64 nt, Human
uguggaaaucaaauuuaaccaagaaaaaaagauuggaacaaaugcucucuuacauuuuauuauc

SEQ ID NO: 149075 - RNA, 64 nt, Human
caaagcagugcucugaguaucacaucacacaaaaggaacaaaagcgaaacacacaaaccagccu

SEQ ID NO: 149076 - RNA, 64 nt, Human
uacuaaccuuuuauaucuugccuucaagugagaaggaacaaacaacucucagugguuacuacuu

SEQ ID NO: 149077 - RNA, 64 nt, Human
auaggugacucacugaaaugccuuuauaaauacuggaacaaauccugcugcaaaaaugaaagcg

SEQ ID NO: 149078 - RNA, 64 nt, Human
cuuguaaauucacauuguuuggaaaaauucuuuuggaacaaaaaauuagguacaugauaacugg

SEQ ID NO: 149079 - RNA, 64 nt, Human
ucccccauuuuauugcaucaaaaauugagcauugggaacaaaguuggggucaagaggaaagaau

SEQ ID NO: 149080 - RNA, 64 nt, Human
aaugguuuacacuuuaacaagaaauuuuggauauggaacaaagaauucuuagacuuguauuccu

SEQ ID NO: 149081 - RNA, 64 nt, Human
ucauguaguggaauuaaauauaccucuuacuucaggaacaaaguuaacaaauauguuugaugau

SEQ ID NO: 149082 - RNA, 64 nt, Human
aaaauauuuucacaaccagaguagaaaacgugcuggaacaaaauugcgaaggcuuuugccuccc

SEQ ID NO: 149083 - RNA, 64 nt, Human
uggaagccagaaaagacaaagaaauauccagaaaggaacaaagucuuguggacaccuugauuuu

SEQ ID NO: 149084 - RNA, 64 nt, Human
guaaauuuuucuaaacacaauuguuauagccagaggaacaaagaugauauaaaauauuguugcu

SEQ ID NO: 149085 - RNA, 64 nt, Human
uacugcuuuuguuguaguugucauaauuacauuuggaacaaaaggugugggcuuuggggucuuc

SEQ ID NO: 149086 - RNA, 64 nt, Human
aguuuuaugaagaguaaguggaaccugggaugcaggaacaaaagaaggaaauguugggcaaaca

SEQ ID NO: 149087 - RNA, 64 nt, Human
auuaugcauaaauguaaaacaccccuaaacaaagggaacaaaugaauuuuugguuauauuguuu

SEQ ID NO: 149088 - RNA, 64 nt, Human
cuuuggaaaaaaacuaccacuguggucuuaaaagggaacaaaauauaccauaggcuaaaacuaa

SEQ ID NO: 149089 - RNA, 64 nt, Human
uacugcuguugcgcugcuuuauuuaaugcacuguggaacaaaauauaaggguacuguuggggug

SEQ ID NO: 149090 - RNA, 64 nt, Human
uggagcauggcacggcauggauuaacacggcagaggaacaaaggugugcucugagcuucuucau

SEQ ID NO: 149091 - RNA, 64 nt, Human
ucuuuuacuuaaccaggcuuauggcaugaucucuggaacaaauuuguaggaaaaaauuacucca

SEQ ID NO: 149092 - RNA, 64 nt, Human
uaauuuucccuaaagcaugcuuauugacaauugaggaacaaaguguuguggagcagaagaagga

SEQ ID NO: 149093 - RNA, 64 nt, Human
ucucagcugagcugugagggcuuccagggaaaauggaacaaaaugguguucuuagguaaugggu

SEQ ID NO: 149094 - RNA, 64 nt, Human
caacaacacaguaucccaggauauggaggcaaggggaacaaagagcaugagucuuuuuccaaga

SEQ ID NO: 149095 - RNA, 64 nt, Human
auucccuccuuuuguucuuccuuccugccuuaguggaacaaaaaccaacacauaguuuuaagcu

SEQ ID NO: 149096 - RNA, 64 nt, Human
ggagcguccauuccucuggagucucuccuuguuuggaacaaaucgcuucgccuuuuucuacuug

SEQ ID NO: 149097 - RNA, 64 nt, Human
uggauauaacauuauuauuauuuugauaaaauauggaacaaaucaauucuauuaauaagugguc

SEQ ID NO: 149098 - RNA, 64 nt, Human
uacucuuaaaacuuguuuguggucagcacaacaaggaacaaaacaaagcuuugaaaaaacuuua

SEQ ID NO: 149099 - RNA, 64 nt, Human
aaacaaugauaaauuucucagcuuguccagaccuggaacaaaauuucuggaauaagaaauuugu

SEQ ID NO: 149100 - RNA, 64 nt, Human
ccuuuuauagcacuuuagcacaggcaaugcuacaggaacaaaguuucaaugcugcugagaguga

SEQ ID NO: 149101 - RNA, 64 nt, Human
ggaguugaacugguaccugauucacggguggacuggaacaaacaggaauguaccagaccuaugu

SEQ ID NO: 149102 - RNA, 64 nt, Human
auuguacaaacauauucaucacuuuaacaauaagggaacaaaauuuaguauucaagcugaguga

SEQ ID NO: 149103 - RNA, 64 nt, Human
uguggcaagauacuuugguugguuaaaauaauauggaacaaaggauccacugaagugaucucug

SEQ ID NO: 149104 - RNA, 64 nt, Human
uuugaacuaagcaucuuuauaugcuuguguaacaggaacaaaguaacagccuuucaauucauau

SEQ ID NO: 149105 - RNA, 64 nt, Human
aauauuaaauguauacauuuugugcuauguuuugggaacaaaucuguuugauuuauauaguuuu

SEQ ID NO: 149106 - RNA, 64 nt, Human
auacagcagcuguuauaacacgaccagucaauguggaacaaacuguuucugugcaaccccuuug

SEQ ID NO: 149107 - RNA, 64 nt, Human
agaaacaaauacauuuuaauuaaacaaucuauauggaacaaacauucccaaauucuaagaauaa

SEQ ID NO: 149108 - RNA, 64 nt, Human
accccacauuggccaguggacucauccauucuuuggaacaaaucccccccacuccaaaguccau

SEQ ID NO: 149109 - RNA, 64 nt, Human
aguuauuuccuuuuauaauacuuuucuuccccauggaacaaaugggaucaauuugugaguuuuu

SEQ ID NO: 149110 - RNA, 64 nt, Human
guucacugagggguggcacgggaccacuccagguggaacaaacagaaaugacugugguguggag

SEQ ID NO: 149111 - RNA, 64 nt, Human
acuuucuccaguaaaugaggaaccguaacucuuuggaacaaaccaaaauauagcagauguaauu

SEQ ID NO: 149112 - RNA, 64 nt, Human
agggaaaaagaagaaaaagagaaagaugaaaauaggaacaaauaaagacaaacaacauuaaggg

SEQ ID NO: 149113 - RNA, 64 nt, Human
ucuuucccauuuugugcauuuguuuugaugcuggggaacaaaauuagcaaaacuauugcuugcu

SEQ ID NO: 149114 - RNA, 64 nt, Human
agcacccagcucugucuugguagguuugggcuaaggaacaaaucucuccuuugcucgugguuag

SEQ ID NO: 149115 - RNA, 64 nt, Human
gggauguaauccuuacauugcuuuuccaaggaagggaacaaaagucuagugauuaguaugccaa

SEQ ID NO: 149116 - RNA, 64 nt, Human
ugauuaaaaucgaacuuuauuacauacugauucuggaacaaaacaguuagaaaaacuuuaaaaa

SEQ ID NO: 149117 - RNA, 64 nt, Human
ugcauguguuuggagauuauuuucuguaaugcugggaacaaaccuguuuuaaaagcacacugcu

SEQ ID NO: 149118 - RNA, 64 nt, Human
ugggauuauaggugugagccaccgcacccaguugggaacaaagccuuuuuaacacacguaaggg

SEQ ID NO: 149119 - RNA, 64 nt, Human
uaauaauuuuggaucauuuucuuuccuuuaaaggggaacaaagccuuuuuuuuuuuugagacgg

SEQ ID NO: 149120 - RNA, 64 nt, Human
acggauguaacauuucaugugaucgugcaccacuggaacaaaaccaaaaugugaccauaacugu

SEQ ID NO: 149121 - RNA, 64 nt, Human
gaaaauggugucucucaucauuugcucuguuaagggaacaaauuagcacuuuuuagaagucuga

SEQ ID NO: 149122 - RNA, 64 nt, Human
uugguauuuuugaugcugcuuccaauuuuaaaagggaacaaagcugccauaaaucgaaauguuc

SEQ ID NO: 149123 - RNA, 64 nt, Human
auggcuucagagguggaagauaaacagugacgggggaacaaacagacaacaagaagguuuggaa

SEQ ID NO: 149124 - RNA, 64 nt, Human
uacugcccuucuuggaaguuugcaggauuggaugggaacaaauucagaggaucuuaggugcugg

SEQ ID NO: 149125 - RNA, 64 nt, Human
cuuuuucccuuuuaaaaugcuuccucaacgaaggggaacaaauaccuggauaagagaauccuuu

SEQ ID NO: 149126 - RNA, 64 nt, Human
uucucaagcaguuuuucugaguaguuucugaggaggaacaaauuacaaguguacccaauaacug

SEQ ID NO: 149127 - RNA, 64 nt, Human
auuaacaagaaguaugcaggugcaaaaaagugguggaacaaauaccaacauccauccaaaauga

SEQ ID NO: 149128 - RNA, 64 nt, Human
gcugucuuucaggguaucauuuuuaaagguauaaggaacaaacuuuaauguauugaaaugcaua

SEQ ID NO: 149129 - RNA, 64 nt, Human
uauuuguaccuccagaauggcagaucccucagcaggaacaaaggcauauugacgguucucucag

SEQ ID NO: 149130 - RNA, 64 nt, Human
auagauccccuuaaagaaaaaauacaggcuuuagggaacaaagggacaagcagaacaggugugg

SEQ ID NO: 149131 - RNA, 64 nt, Human
uuccuucuuuuuaguuuuggggaucauuuugaguggaacaaagugaccucuugcauccauaaca

SEQ ID NO: 149132 - RNA, 64 nt, Human
cugucauuuuguuuauucuacugcaguagccaguggaacaaaguuuguaguuauuuugccacuu

SEQ ID NO: 149133 - RNA, 64 nt, Human
ccuuauuguuccugaucucuuagucccauaaaugggaacaaauacagcuuucugcuucuuucuu

SEQ ID NO: 149134 - RNA, 64 nt, Human
agccugugaggaccgagaggagaaaugagaagaaggaacaaaaauauuauuucuauguaauuua

SEQ ID NO: 149135 - RNA, 64 nt, Human
cuacaaucaaucaaaucaauagucagucuuguaaggaacaaaaauuagccaugagccaaaagua

SEQ ID NO: 149136 - RNA, 64 nt, Human
uauagauauaugauuuucuagugaguguauguuaggaacaaaagacaaaauaguaucaacacau

SEQ ID NO: 149137 - RNA, 64 nt, Human
aacacagguucuaaauuuaaaacaaauaauaauuggaacaaauaaagguucuuguacccagagu

SEQ ID NO: 149138 - RNA, 64 nt, Human
gcuaaaugacugacauucauuccauuuaauugggggaacaaaaggccucagguaaggaugagga

SEQ ID NO: 149139 - RNA, 55 nt, Human
auggaucccuuacuauuuagaauaaggaacaaaauaaacccuuguguauguauca

SEQ ID NO: 149140 - RNA, 64 nt, Human
guuauuuaacuucaauuuaccuuaccuguaaaauggaacaaauaauaucuccuuaagauugcuc

SEQ ID NO: 149141 - RNA, 64 nt, Human
uuguggaacacauuccacacuuugaaaucuucguggaacaaaagauauuuguggaaccaaucuu

SEQ ID NO: 149142 - RNA, 64 nt, Human
cuucuccuguggucaguaaguugcccagagagaaggaacaaaggucuggaguuuacagaauguc

SEQ ID NO: 149143 - RNA, 64 nt, Human
cugauagaauucuggucaucagauguacugcaauggaacaaaacucaucuggcugcaucccagg

SEQ ID NO: 149144 - RNA, 64 nt, Human
ugauuuuccaguucaaaaaaaugggcaggaguggggaacaaaacaauuaacguaagagcuacaa

SEQ ID NO: 149145 - RNA, 64 nt, Human
aaguguuuaaauuugagaucaaggagaagauaguggaacaaaauguuauauagauaauauuuuu

SEQ ID NO: 149146 - RNA, 64 nt, Human
auaaucauuaagccuauuguuuaaugcaaaauauggaacaaaugugaacugguaaaggucgauc

SEQ ID NO: 149147 - RNA, 64 nt, Human
uuuucaguccuaaucguagaaucugaaauaaacaggaacaaagacguuccuuaggcccugugcu

SEQ ID NO: 149148 - RNA, 64 nt, Human
ugacuucuuuugacaaaggacuuuaggaaaaagaggaacaaagacauuauuugagaauuaaauu

SEQ ID NO: 149149 - RNA, 64 nt, Human
augugcaaaagaccuuuuuguagccaaacaaguuggaacaaaacucucggugaaugaaccacug

SEQ ID NO: 149150 - RNA, 64 nt, Human
aguuccauguacuguaaauauuuuucacauaaagggaacaaaugucuaguuuuauuuguauagg

SEQ ID NO: 149151 - RNA, 64 nt, Human
uuacuguuugcauaucagguugaacaaaaugcuuggaacaaaauuaagcauuauuucuagacca

SEQ ID NO: 149152 - RNA, 64 nt, Human
uauuuaggcuauuucugaagggcacagggaagggggaacaaauaucuucacuucaguuuuauuu

SEQ ID NO: 149153 - RNA, 64 nt, Human
uagauuugauuauguauacaugacaccuaaagagggaacaaaaguuaguuuuauuuuuuuaaua

SEQ ID NO: 149154 - RNA, 64 nt, Human
aagaaaucaaguugguauuuuugauguggaaaagggaacaaaaguggaaacauggcuacuuuug

SEQ ID NO: 149155 - RNA, 64 nt, Human
auuucaggauacaaaagcccaaauuacccgcuacggaacaaagaugaauacaguaaaagagucg

SEQ ID NO: 149156 - RNA, 64 nt, Human
cccccccaacacaccuauaaaaacccaaauuuuuggaacaaagauaauggaaccuccauuuuca

SEQ ID NO: 149157 - RNA, 64 nt, Human
uccaugcuuauguauccaaacacagagacccaugggaacaaaugagacacauauagauacugag

SEQ ID NO: 149158 - RNA, 64 nt, Human
aaucugcacagcaaagugaaacacacagauaauaggaacaaaauguaguucccaugugccaaac

SEQ ID NO: 149159 - RNA, 64 nt, Human
auauuaugcauacugagcuagaccagaagagucuggaacaaaauaaacacagccuuuauaauca

SEQ ID NO: 149160 - RNA, 64 nt, Human
ugccgcacauuacuggguaaaagcagggcagcagggaacaaaacuccagacucuugggccgucc

SEQ ID NO: 149161 - RNA, 64 nt, Human
acgccugagccuccggggccacgcuucguucucaggaacaaaaccugaggcagcccuuuggaug

SEQ ID NO: 149162 - RNA, 64 nt, Human
cauuagaauagaacucauaucuuuuaaauauauaggaacaaauaaauaaauuguugugugugca

SEQ ID NO: 149163 - RNA, 64 nt, Human
ggucguauuuuuuuaaaaaguauuucacaagaauggaacaaaucuacuuauccaguuauaccuu

SEQ ID NO: 149164 - RNA, 64 nt, Human
ggagggcccauggggguaggagcaguugaaccugggaacaaaccucacuugagcugugccuaga

SEQ ID NO: 149165 - RNA, 64 nt, Human
cuacauuuauuuaauaugauggucuuugcaaaaaggaacaaaacaacacaaaagcccaccaggc

SEQ ID NO: 149166 - RNA, 64 nt, Human
ugaagcaagcacugaauaaaaaccuccugaacugggaacaaagaucuacaggcaagcaagaugc

SEQ ID NO: 149167 - RNA, 64 nt, Human
ggguucugccuguucccaaacuuuuuccauuccaggaacaaaggagaagccacuuuccccagga

SEQ ID NO: 149168 - RNA, 64 nt, Human
ucuuaacaagaacuccaaagcuggaaagcaggagggaacaaaggugaacaugaaggcgaggaug

SEQ ID NO: 149169 - RNA, 64 nt, Human
uuuccauuuguuucuuuaacauuaccaaaagcagggaacaaagcucuuauucaacugcgaauuc

SEQ ID NO: 149170 - RNA, 64 nt, Human
aagugaggaauaaauagcagaaaaauaccuuaaaggaacaaaaaauccauuuuuuauaauaaug

SEQ ID NO: 149171 - RNA, 64 nt, Human
gaaagaggaacugggguugcuaaccaggaugcugggaacaaaggccucuugaagcccagccaca

SEQ ID NO: 149172 - RNA, 64 nt, Human
ggugggguuaguugcauggaccaggugaggugguggaacaaaaggccagguagaggaagaauau

SEQ ID NO: 149173 - RNA, 64 nt, Human
ccuuaagauuguuuaucuggagcccacauaguguggaacaaaaagucaccuagaaagcauccuu

SEQ ID NO: 149174 - RNA, 64 nt, Human
uggauacacgaggaaaaggaaagagucucagaguggaacaaagagugggaagaggugaucugua

SEQ ID NO: 149175 - RNA, 64 nt, Human
agcacccauuaaacaaguccuggcaggacucacaggaacaaacgaggucccuguuaggguucua

SEQ ID NO: 149176 - RNA, 64 nt, Human
cacaaggcugcuuucugcacucucuguggccacaggaacaaagaugcgaguugaagaucccuuu

SEQ ID NO: 149177 - RNA, 64 nt, Human
gugagaaggaagggagaagguggcauaacuuuuuggaacaaaagaaaacacaaaauccuagcuu

SEQ ID NO: 149178 - RNA, 64 nt, Human
uucuuccagcuuuuccacacucucuuuaugcgcaggaacaaacagcuguugagugagcugcuau

SEQ ID NO: 149179 - RNA, 64 nt, Human
uuaaaacuuuuuuuuuucuauuaaaacuuaaaggggaacaaaacuugaaaaagcccuguucuuc

SEQ ID NO: 149180 - RNA, 64 nt, Human
cucccuguuagugaaggacacugcuguuagugaaggaacaaagucuaugaguccuaaaauuuua

SEQ ID NO: 149181 - RNA, 64 nt, Human
gugugcucugcugcaugugagcuuguggguuagaggaacaaauaucuagacauucaaucuucac

SEQ ID NO: 149182 - RNA, 64 nt, Human
gggugacuugccucagaggcuauaucccagugggggaacaaagaggagccugguaaaaaacagc

SEQ ID NO: 149183 - RNA, 64 nt, Human
gaguaauaaugguuuccaaagaguauuuuuuaaaggaacaaaacgagcaugaauuaacucuuca

SEQ ID NO: 149184 - RNA, 64 nt, Human
uuuuaugaauuagcugauaaggcuguauguuucuggaacaaaauauuggucaucuaaaaacuuu

SEQ ID NO: 149185 - RNA, 64 nt, Human
ucuaaccuguucuaaccucuaagcauuuucuaauggaacaaaauagaugagguggaugaacauu

SEQ ID NO: 149186 - RNA, 64 nt, Human
aacacagccucaugggacagaaauuugagggaggggaacaaagaauacuuuggggggaaaaaag

SEQ ID NO: 149187 - RNA, 64 nt, Human
auuuuugcucuucucaguuuacucauuguccccuggaacaaaucacugacaucuacaaccauua

SEQ ID NO: 149188 - RNA, 64 nt, Human
auauacuucagaauuugagagcagaaguuaauguggaacaaaaguuuucaccaucucucaagcc

SEQ ID NO: 149189 - RNA, 64 nt, Human
gacgaggcccuauuccaugccccucuuuaaugguggaacaaauguuaaacugcucaucuaaaga

SEQ ID NO: 149190 - RNA, 64 nt, Human
caaaaauaucuucauacuuccucauccccucauuggaacaaaaccuuaaacugggagaaccuua

SEQ ID NO: 149191 - RNA, 64 nt, Human
aaggaaggagaggcuuggaaagccuugugucuugggaacaaaaggccuuugagcauaugggucc

SEQ ID NO: 149192 - RNA, 64 nt, Human
auuguaguauauuuuguccuucccucuucccugaggaacaaagcacguaucuuuagucucuuug

SEQ ID NO: 149193 - RNA, 64 nt, Human
gaugaauuucuaaaauauccuccaaugugugcauggaacaaauaaucaaaagaaccagacugug

SEQ ID NO: 149194 - RNA, 64 nt, Human
cguccucuuuugccggucagggcuggcacgcaggggaacaaaggaaggagcaucagcagggucu

SEQ ID NO: 149195 - RNA, 64 nt, Human
agagagcugagaggagcaguugugacucuacccaggaacaaacugugccugaaccugaggugcc

SEQ ID NO: 149196 - RNA, 64 nt, Human
agaguaguuagagaauauguaugccugcaauaugggaacaaauuagaggagacuuuuuuuuuuc

SEQ ID NO: 149197 - RNA, 64 nt, Human
acuuuauuuuuauugguuccugaagacgggacaaggaacaaauacauacguuaauaugagagau

SEQ ID NO: 149198 - RNA, 64 nt, Human
gaacuacuacucacaguuaccacuuggggucaguggaacaaaaugcauauaugguuuugacauu

SEQ ID NO: 149199 - RNA, 64 nt, Human
cauacuguuacugaagaaagcaccaagucuuaauggaacaaagaccauagaaugaauuauuuua

SEQ ID NO: 149200 - RNA, 64 nt, Human
agaauccaauuuccuuccuucccuccacagguuuggaacaaacucucccuucacuuguugcccu

SEQ ID NO: 149201 - RNA, 64 nt, Human
gcauuguccugcagucguauaguauagcagugcaggaacaaacagcacuugccagcaaagucug

SEQ ID NO: 149202 - RNA, 64 nt, Human
cccaucuaguaacaucucagaaauuucauccagaggaacaaaaaaauuaaaaauagaacauagc

SEQ ID NO: 149203 - RNA, 64 nt, Human
gacagagagauguagagacagugauagagacagaggaacaaaaagagcagcagugagaaggcaa

SEQ ID NO: 149204 - RNA, 64 nt, Human
ugauauuuuuucuacgccaaaacagacgggaaagggaacaaaauaaagugaaauccaauacacg

SEQ ID NO: 149205 - RNA, 64 nt, Human
ucacuacuuuuccugauuaagggaucugugcuggggaacaaagcuuuugcaguaccuuauauug

SEQ ID NO: 149206 - RNA, 64 nt, Human
ucagcucugcuguguuaacuuugugaaacuggauggaacaaacuuuaacuuaccaagcaccaag

SEQ ID NO: 149207 - RNA, 64 nt, Human
acccugcuuauuugucucacugguuaucuaaugaggaacaaacacuaaccuaagguacacaucc

SEQ ID NO: 149208 - RNA, 64 nt, Human
ggaaacagugaccauuuucagaguaaucaaaucuggaacaaaugaaacaucuuuuagccaccac

SEQ ID NO: 149209 - RNA, 64 nt, Human
ucuagaauuuccuuggggucuuucagagggugggggaacaaaccccuaugcacuuuucuuuuuu

SEQ ID NO: 149210 - RNA, 64 nt, Human
guauugauaaccacugggguuccgcauugaagcaggaacaaauugccucuuuuucuggccuucu

SEQ ID NO: 149211 - RNA, 64 nt, Human
ggaauguuuagaagaccaaaaguccccaaugacaggaacaaaagcaaccaauuuuuaacuuucu

SEQ ID NO: 149212 - RNA, 64 nt, Human
uuguuuaucuauaugucaaaauacuuguaaauugggaacaaacuucucucagcuucuugaaguu

SEQ ID NO: 149213 - RNA, 64 nt, Human
ccaauccuuccacauacuguuaagauguagacuuggaacaaagcuguugggacccagagcaaug

SEQ ID NO: 149214 - RNA, 64 nt, Human
auacucugcaaguugaccuggccucucccccacaggaacaaaacacugccuccagagucuuuaa

SEQ ID NO: 149215 - RNA, 64 nt, Human
ucaggaguggugacugagguuuuuauguagaaggggaacaaaaaaaaaaauaucugaauuuuga

SEQ ID NO: 149216 - RNA, 64 nt, Human
gccaaaucuuagucccaugaucuguccccaaaggggaacaaagggaccucugacagcuuagauu

SEQ ID NO: 149217 - RNA, 64 nt, Human
gcguagugcugaacauuaagcuuucugggccacuggaacaaagaacuaggaucucacaggaaaa

SEQ ID NO: 149218 - RNA, 64 nt, Human
cccuccuucuuuaguuuaaccaucagggcagacaggaacaaaguauuucaaagcuuguuccauc

SEQ ID NO: 149219 - RNA, 64 nt, Human
ucagagggggaagaguuagaaugggucaguggcuggaacaaaguucugguuaaggaggaaauua

SEQ ID NO: 149220 - RNA, 64 nt, Human
uuuuagauuauagaacauggauucaaaagugacuggaacaaauuggcugacaccuuacugguaa

SEQ ID NO: 149221 - RNA, 64 nt, Human
gggcuucacagcuugaguuaaccuugcuuuuccgggaacaaaaugaugucaugucagcuccgcc

SEQ ID NO: 149222 - RNA, 64 nt, Human
uucuauaaaaccugauaaccgaaaauuggccaacggaacaaauguccucggcuuacugauugac

SEQ ID NO: 149223 - RNA, 64 nt, Human
gaagauguugcuaauguauuuuacuucaacauagggaacaaacuuuuuaaguauauuaauaaac

SEQ ID NO: 149224 - RNA, 64 nt, Human
gauugauaaaaccugggaguaagguaagaaaaauggaacaaauuuuuaucuaaaaauuccuguc

SEQ ID NO: 149225 - RNA, 64 nt, Human
uaugugaaaaguuuugagaacugugaaauguuuaggaacaaacuguugaaauccauuggaaggg

SEQ ID NO: 149226 - RNA, 64 nt, Human
uuaagaucugauaugcuaucauugccuuaauaauggaacaaaauagaagcauaucuaacacuuu

SEQ ID NO: 149227 - RNA, 64 nt, Human
gaugugcaggaagaaaagccccucuucauuccggggaacaaagacggguauuguugggaaagga

SEQ ID NO: 149228 - RNA, 64 nt, Human
auuugaaaguuauuggaaauuuuauucaaaccguggaacaaauguaugugauuuuguuauacuu

SEQ ID NO: 149229 - RNA, 64 nt, Human
aaaaguauuacgaugaaauuguuaggguauuaauggaacaaacccaguuucacucucuugacac

SEQ ID NO: 149230 - RNA, 64 nt, Human
uuuacaagcccaaacuaauauaaaugauugaaugggaacaaaucucuugugcagaagaauuuca

SEQ ID NO: 149231 - RNA, 64 nt, Human
uugauuuccugaagcucucucuguuccuuauuugggaacaaaaauugcgaagacucaucuuucc

SEQ ID NO: 149232 - RNA, 64 nt, Human
acuuuucuuaacaaccuggccgcguuuagaccaaggaacaaaaaaaccacaaaggccaaacugc

SEQ ID NO: 149233 - RNA, 64 nt, Human
ccaugaauugaaaacugaaauagugggcaaaucaggaacaaaccaucacugauuuacugauuua

SEQ ID NO: 149234 - RNA, 64 nt, Human
uaugacacagccaacauuuugugaaacaaugacuggaacaaaacagcagccauacuuaccuuug

SEQ ID NO: 149235 - RNA, 64 nt, Human
gagccaccaugagaacagaaucacuggucuaaaaggaacaaagggauguucacuguaugccucu

SEQ ID NO: 149236 - RNA, 64 nt, Human
caugucagaaaagugcaguagaagcaaagcuacuggaacaaagauagaccuugacaacauagac

SEQ ID NO: 149237 - RNA, 64 nt, Human
ccuucauggauagucuuuaaucucugaucuuuuuggaacaaacuguuuuacauuccuuucauuu

SEQ ID NO: 149238 - RNA, 64 nt, Human
gcuguggaaaugaacuguguauauacuucugggaggaacaaauuuaaucauuucuucuguuaag

SEQ ID NO: 149239 - RNA, 64 nt, Human
ucugugcaaacuggaggacuccuuccaacuuccuggaacaaagcgacaucgccagcagcaggcu

SEQ ID NO: 149240 - RNA, 64 nt, Human
acagugugcucacucucagagccauggauuaccuggaacaaagugcagauuagugcccacgguc

SEQ ID NO: 149241 - RNA, 64 nt, Human
gggaaaggccuggaaaggaugagggaacaggcaaggaacaaaggcaaccuuugcacacucaccu

SEQ ID NO: 149242 - RNA, 64 nt, Human
gaggcugggcuucuuucucucauuuguuccuuguggaacaaaugggcaaaagaagugugaaaau

SEQ ID NO: 149243 - RNA, 64 nt, Human
ggaauuuuugagccucugcuuagugaaacacaaaggaacaaagcagcuauaaacuaaauagaau

SEQ ID NO: 149244 - RNA, 64 nt, Human
gaaggaaagagaucuugccuuuugaaaagaugaaggaacaaagguugagagaacauuuaguucg

SEQ ID NO: 149245 - RNA, 64 nt, Human
ggaacaucacauuccucugcccuuccugcaggcaggaacaaacagggcugccuucuggccuugu

SEQ ID NO: 149246 - RNA, 64 nt, Human
ugcuuguuggcuccagucuuccgacaaacuaacaggaacaaaaugaauucugggaauccacagc

SEQ ID NO: 149247 - RNA, 64 nt, Human
cccuuccccagaggaauuguggagacugucccauggaacaaacccucaggcaccagcacagggc

SEQ ID NO: 149248 - RNA, 64 nt, Human
gggcggggcagacagcagaccaccaaggguucagggaacaaagaccaguuacuuggaguggggg

SEQ ID NO: 149249 - RNA, 64 nt, Human
uggcgggggucgggggucuucuguuucacuaacaggaacaaagacagaaaccaugacagggcug

SEQ ID NO: 149250 - RNA, 64 nt, Human
aaaagugcacauuaaaaaggaaaguuugccaggaggaacaaagagauugugguggugcuaaagg

SEQ ID NO: 149251 - RNA, 64 nt, Human
uucaauuagagucccaggauugcaagagcuaauaggaacaaauacucuccccccgcccaccccc

SEQ ID NO: 149252 - RNA, 64 nt, Human
uuacuucauuuuuucccucuaauuauuuaagauuggaacaaaaguauaaauauuauuuauuuga

SEQ ID NO: 149253 - RNA, 64 nt, Human
uuccucugaagccuugaaggguuuucagauccaaggaacaaaggggaaaauagacaaaggagug

SEQ ID NO: 149254 - RNA, 64 nt, Human
gggcuaggccggcacuggagaggccggagccuuuggaacaaaccgugcggaacgcguccagggg

SEQ ID NO: 149255 - RNA, 64 nt, Human
gccaaccuucuaucagaguuaaacuuuugacaagggaacaaaucucaaacugauccaucaguca

SEQ ID NO: 149256 - RNA, 64 nt, Human
gucagucauuacagccccuuaugccucuuccaugggaacaaauacugugcagauguuuguaagu

SEQ ID NO: 149257 - RNA, 64 nt, Human
ccacagacugaacucgcagggaaugcagcaggaaggaacaaagacaggcaaacggcaacguagc

SEQ ID NO: 149258 - RNA, 64 nt, Human
cccacuccuacccagccagcccucaaaacacaaaggaacaaagacaguccacucagacacuuau

SEQ ID NO: 149259 - RNA, 64 nt, Human
ugacaacagcgugagauuucaacagaacuuguuuggaacaaauacucacuuaaaacuucagcag

SEQ ID NO: 149260 - RNA, 64 nt, Human
ccuggcgcggggaagggguggaaggguggagguaggaacaaaauugcgccgcuccuggagaccu

SEQ ID NO: 149261 - RNA, 64 nt, Human
cguccauguccauguucguguuagcacuuacgugggaacaaauaccaauuugucuuuucuccua

SEQ ID NO: 149262 - RNA, 64 nt, Human
auauacaccauggaauacuauucagccacaaaaaggaacaaaauaauggcauucacagcaaccu

SEQ ID NO: 149263 - RNA, 64 nt, Human
acuaaaaaauguugagugguuaucuuuguaugguggaacaaagucacuguaauuuucaucuuug

SEQ ID NO: 149264 - RNA, 64 nt, Human
gcaaaaguaaaugaagcccaggaaaacaccuuugggaacaaacucuuccuuugauggaaaaugc

SEQ ID NO: 149265 - RNA, 64 nt, Human
ugugaagaucaaguucagugcugugggauuuuuaggaacaaaaaacugugacgucuggauuugg

SEQ ID NO: 149266 - RNA, 64 nt, Human
cugggaaaaaucuugugguuauuuccuuuaaaaaggaacaaaacuuuaguauuuaauuaguuga

SEQ ID NO: 149267 - RNA, 50 nt, Human
augaauggcuccucaaguagggaacaaagccaagaagaaucccaccucag

SEQ ID NO: 149268 - RNA, 64 nt, Human
uuugcuuacuucauuuuuuucucuaaucaagacuggaacaaaaguauaaauauuauuuauuuca

SEQ ID NO: 149269 - RNA, 64 nt, Human
caccacccccggcaggccuucccugacccagccaggaacaaacaagggaccaagugcacacauu

SEQ ID NO: 149270 - RNA, 64 nt, Human
agacacauagguggguuuauguuucaccucauuuggaacaaaagaggacagaagcagaccacuc

SEQ ID NO: 149271 - RNA, 64 nt, Human
ccagggaaucuaauauccccaaauuagggcaauuggaacaaagugaaggacauagagguauauu

SEQ ID NO: 149272 - RNA, 64 nt, Human
cacaaaugcagccaagucauguaauuagucaucuggaacaaagacuaaaaacagcagagaauug

SEQ ID NO: 149273 - RNA, 64 nt, Human
cauuuuacaaguugcaauauauuguuucguucauggaacaaauauaggcugaauucaaacaugc

SEQ ID NO: 149274 - RNA, 64 nt, Human
ucuaaccucugaacauaaauuuggucaaauaauuggaacaaagggaaacagauacuugauauga

SEQ ID NO: 149275 - RNA, 64 nt, Human
uaucugauauacaaaaaaguaggaucaaagucuaggaacaaacauugguuauuucacugaaaca

SEQ ID NO: 149276 - RNA, 64 nt, Human
uauuuggggcucauugucuuuguaauuacggagaggaacaaaccaucuauugaaacaacaagug

SEQ ID NO: 149277 - RNA, 64 nt, Human
ugcuuguuuagagaucagcagucuuggaugggagggaacaaagcuaaauaaauguuaguuuggu

SEQ ID NO: 149278 - RNA, 64 nt, Human
uaacucuccuugucugaacuuggugauagcaaugggaacaaaguggguagacuaacagagagca

SEQ ID NO: 149279 - RNA, 64 nt, Human
augguauuuggaauuccgaauugacagguuaucuggaacaaaggagcuucuuuuuuuuucuagg

SEQ ID NO: 149280 - RNA, 64 nt, Human
ccucccccugaccccgccccggccuucuggggaaggaacaaaguccccaaacaaagcaaccagc

SEQ ID NO: 149281 - RNA, 64 nt, Human
gugaaggccgccugccggggacucagacacucagggaacaaaauggucagccagagcuggggaa

SEQ ID NO: 149282 - RNA, 64 nt, Human
aguuggaaguaaagcacuccucagcaaauguaaaggaacaaaaauuauaacaaacugucucuca

SEQ ID NO: 149283 - RNA, 64 nt, Human
uccagaaucuacaaugaacucaaacaaauuuacaggaacaaacaaccccaucaaaaagucggca

SEQ ID NO: 149284 - RNA, 64 nt, Human
ugguugucacacuuuagguaagauaauucauauuggaacaaacuacaagugcaaacaauguggc

SEQ ID NO: 149285 - RNA, 64 nt, Human
ucuacuauccuugcuaaguuuucauagaaaauaaggaacaaagagaaacuuguaauggucucug

SEQ ID NO: 149286 - RNA, 64 nt, Human
aaaugaaaaaagagcaggcauccauuuccauacaggaacaaaauaggaggcagcacuacagacc

SEQ ID NO: 149287 - RNA, 64 nt, Human
cuccuccaaaggaucacaacuccuugccggcaagggaacaaaacuggauagagaaugaguuuga

SEQ ID NO: 149288 - RNA, 64 nt, Human
uagugcuauguuauagaaccuacaaaaaagaaauggaacaaauguaguggauccagggaacgcu

SEQ ID NO: 149289 - RNA, 64 nt, Human
gccagugagcuaggguggaggggcuguguuuauuggaacaaagggugguaccaaaaugcauccc

SEQ ID NO: 149290 - RNA, 64 nt, Human
cuccacccuuuccaacaagccaucuugguaacugggaacaaacacaccccaccccguuuuuccu

SEQ ID NO: 149291 - RNA, 64 nt, Human
agcuucaguauaaaagacaaaacuuccuguuuguggaacaaaaguucgaaagaaaaaacaaaac

SEQ ID NO: 149292 - RNA, 64 nt, Human
ugaacucuucacugaguggccacaauuuucacugggaacaaaaaguauaaucacuguuuugagu

SEQ ID NO: 149293 - RNA, 64 nt, Human
uuguuauuaaacgucuguggagcuucugcugcaaggaacaaaaaagaaaaaaaucaaaaaagcg

SEQ ID NO: 149294 - RNA, 64 nt, Human
gaugugggaaaccuucaggaaccuggccacuauaggaacaaaacaaaaagaauggaacauugaa

SEQ ID NO: 149295 - RNA, 64 nt, Human
auucugaagaaaucuuggggagggaaggggaguuggaacaaaugucuguucccuggaggccagu

SEQ ID NO: 149296 - RNA, 64 nt, Human
guguucgauucugcccuauuuauguuucuacucgggaacaaacguugguugugugugugugugu

SEQ ID NO: 149297 - RNA, 64 nt, Human
gguguuccuuacaggaaacauucuuggugcaagaggaacaaagaaagggacuccugcagcgucc

SEQ ID NO: 149298 - RNA, 64 nt, Human
acauuuauugaaacaagucacucugagaagaccaggaacaaaguucucuuggcagaucugggua

SEQ ID NO: 149299 - RNA, 64 nt, Human
gcucacacacucucauucacacacacaaaucucaggaacaaacggucccagaguccuccggacc

SEQ ID NO: 149300 - RNA, 64 nt, Human
cuguuuucauuuaauucaguuuuguguuaaggguggaacaaagcucuguucuagagggaaaguu

SEQ ID NO: 149301 - RNA, 64 nt, Human
uugcuccaggcggacaaggcugacaagcaauccaggaacaaaauacucaccaggacgaggaaga

SEQ ID NO: 149302 - RNA, 64 nt, Human
cuccaucaccaugaagccugggauugggccacgaggaacaaacagcagaugcccuugccuucca

SEQ ID NO: 149303 - RNA, 64 nt, Human
aauccauuggggucuaguuuggaaucugacaacuggaacaaaaagaaccuugaauccggugcau

SEQ ID NO: 149304 - RNA, 64 nt, Human
ugggauuugguuuuuugggucuuuuuuuuuuaagggaacaaaaaaugguuaaaugaggucugcu

SEQ ID NO: 149305 - RNA, 64 nt, Human
aaugaauaaacauaaaugauaccaucagugcuuaggaacaaaguaaaguaggguaagggaaugc

SEQ ID NO: 149306 - RNA, 64 nt, Human
uagaaggacauaaccguguuuucaguguuucuauggaacaaacuuguacauuuuauuucacuug

SEQ ID NO: 149307 - RNA, 64 nt, Human
uuacaaaccuaaguguuuuauauccuagagucaaggaacaaauuuccuuaggauuauaguauua

SEQ ID NO: 149308 - RNA, 64 nt, Human
aaucaguacaaucacacaaggaggaugaaacgccggaacaaaaaugagguguguagaacagggu

SEQ ID NO: 149309 - RNA, 64 nt, Human
uauacagcauggucgccccuugcccuggagucugggaacaaagagaggagccagccuccccgca

SEQ ID NO: 149310 - RNA, 64 nt, Human
ucucgagccccuacagcucuacgggaggccucccggaacaaaagcggaagaggggccagccuca

SEQ ID NO: 149311 - RNA, 64 nt, Human
ggugagaggauuuaaagucagucacaaaggcuugggaacaaaaggaauucucuuccaagaaugc

SEQ ID NO: 149312 - RNA, 64 nt, Human
gguuucaguuucauuugcauaaagguauugagagggaacaaaaaacauaaagcugagaaucuug

SEQ ID NO: 149313 - RNA, 64 nt, Human
aaguaaauuuuaaaaaaaagaacaaaauauaagaggaacaaagaagcaaaacaacaggaaaugu

SEQ ID NO: 149314 - RNA, 64 nt, Human
gcugcaucacccacucagccuuccaaagggaacaggaacaaauuuccccagcaccacuguuugg

SEQ ID NO: 149315 - RNA, 64 nt, Human
ccuuuccccauccucuaucuaucccucuuucccaggaacaaaucaaaagguggauuaucuucug

SEQ ID NO: 149316 - RNA, 64 nt, Human
aucauuggccuagaaagucucugauauuuggaggggaacaaaaaucacucacaagcaauccaug

SEQ ID NO: 149317 - RNA, 64 nt, Human
cuuuuauuagcucuugugggcuaucaagagaauuggaacaaaaccuugugacuuuuagguaaga

SEQ ID NO: 149318 - RNA, 64 nt, Human
ucucuggauuucagguuucuugcuguugaaaaaaggaacaaagcguuacugaaaagaagguaac

SEQ ID NO: 149319 - RNA, 64 nt, Human
ggucuuguuuuguugauuuuucuuuuuuaauuuuggaacaaaugcuuuuccaacccaugagugc

SEQ ID NO: 149320 - RNA, 64 nt, Human
caagacaugggacauuuaaauccucaaggaguuuggaacaaaauaaacagaucuaaaaauuugg

SEQ ID NO: 149321 - RNA, 64 nt, Human
cuucaucugagagaggcuaaaauguuuucagcuaggaacaaaucuuccuggucgaaaguuagua

SEQ ID NO: 149322 - RNA, 64 nt, Human
aggauuuuuaaauuguauuuugcucaaaucuaugggaacaaaagucaagguaucacuaccuaga

SEQ ID NO: 149323 - RNA, 64 nt, Human
uucaugcuagaaacaggaagauuggaaucugccuggaacaaagaacugcaccuaagcagaccag

SEQ ID NO: 149324 - RNA, 64 nt, Human
aacucaugguuaaagaccuuugaucaggacuggaggaacaaagguuuguguauuaguccauuuu

SEQ ID NO: 149325 - RNA, 64 nt, Human
caaacagcugccuuacaauucacucauuccauguggaacaaacauuuaucagaugccuauuaug

SEQ ID NO: 149326 - RNA, 64 nt, Human
acacacacacacacacacacacacagagagauaaggaacaaaaguguuuucuguuguuuugggg

SEQ ID NO: 149327 - RNA, 64 nt, Human
gcguaaggaugugugaguuuugcuuuugacuccaggaacaaaaagguaaaucccacaucccagu

SEQ ID NO: 149328 - RNA, 64 nt, Human
uuuacaaugugcaauaacucagcaguuaaauaguggaacaaaauugaaggguggucaguaguuu

SEQ ID NO: 149329 - RNA, 64 nt, Human
ugcccucugcccuuuugccuguccucaggccgcuggaacaaaggaaggacagcucauuccucau

SEQ ID NO: 149330 - RNA, 64 nt, Human
aaacucucaguuguuuauuauccugaucaagcauggaacaaagcauguuucaggaucagaucaa

SEQ ID NO: 149331 - RNA, 64 nt, Human; identical to SEQ ID NO: 149323

SEQ ID NO: 149332 - RNA, 64 nt, Human
guuuuuaccgauuuauagagcagucaaauccgaagugcucgagugcuuagaaacccccucuggu

SEQ ID NO: 149333 - RNA, 64 nt, Human
gucuuauucccugaggcucccuugacucaggacugugcucgaauugugggugguuuuuugucuu

SEQ ID NO: 149334 - RNA, 64 nt, Human
gagacuccagcagggaaugcccuucacucuguaggugcucgagccccaaucgaggauacagugu

SEQ ID NO: 149335 - RNA, 64 nt, Human
aacgucuguuucauacauuugccaugcagugacugugcucgaaaggugaaaucaaugguaaaga

SEQ ID NO: 149336 - RNA, 64 nt, Human
ucaacaggugcagcccagugggucagaggaaagcgugcucgaaggaugccauggucagggcagg

SEQ ID NO: 149337 - RNA, 64 nt, Human
cagcaggauggcacuucccauuucucugugguuagugcucgagugaaaaccucuuucagcugag

SEQ ID NO: 149338 - RNA, 64 nt, Human
ggcaggaaguuaccuuccuggugcacacaccgaagugcucgagggagaggcugccgcccccucu

SEQ ID NO: 149339 - RNA, 64 nt, Human
uuagcagggacuugcccaacggcacagcugauuggugcucgacucccagcaugcauauuuuguu

SEQ ID NO: 149340 - RNA, 64 nt, Human
cuugggccuuggggcucagccacagccugacacagugcucgaccuugauagcauggggccccug

SEQ ID NO: 149341 - RNA, 64 nt, Human
aagcauacuguggccuaccagcaucuggaagugugugcucgaucuguaugugugcagagguggu

SEQ ID NO: 149342 - RNA, 64 nt, Human
auaaacgcuugguuuuacaugaacaaaaaguggugugcucgaaaaagacauuacugaugccuuu

SEQ ID NO: 149343 - RNA, 64 nt, Human
ccgccagcccugccccugaauuggaagcagcccugugcucgaugggaggggcucccaggccggc

SEQ ID NO: 149344 - RNA, 64 nt, Human
cugcccuggcggagagacagcaaggggccggcaggugcucgaugggccccccagggcuucucca

SEQ ID NO: 149345 - RNA, 64 nt, Human
cucaucgggagacagcauggaacucucucucgcagugcucgaggcugugugucaguguuugcug

SEQ ID NO: 149346 - RNA, 64 nt, Human
aaucuuuguuuuggcaauccauccuuuggcuuccgugcucgagccguuuuuacccagcugggua

SEQ ID NO: 149347 - RNA, 64 nt, Human
ugcauguuaaguguuaauaucaaacauucuuuacgugcucgagguauugcuuuuaacauucuac

SEQ ID NO: 149348 - RNA, 64 nt, Human
cacuuuaugccggaugugcuuuucuccaauaucagugcucgagacacagugaagcaaauuaaaa

SEQ ID NO: 149349 - RNA, 64 nt, Human
ucgacugcaguccccuguguuugccagagauacugugcucgaaguagagguuuuacucuacuca

SEQ ID NO: 149350 - RNA, 64 nt, Human
ucugaucuuggcccauaggugaaccaccaaaauagugcucgagucuuagguuacugucaucaaa

SEQ ID NO: 149351 - RNA, 64 nt, Human
guuaacucugucuugaauucucuguuuaugcaaugugcucgaaagaaaaaaauguuaaaaauau

SEQ ID NO: 149352 - RNA, 64 nt, Human
cuccggcaagugaaacccagaggguguuuccgaggugcucgacaguagguauuuuuggaagcuc

SEQ ID NO: 149353 - RNA, 64 nt, Human
auaacucagacccagucuuguggauggaaauguagugcucgagucacauucugcuuaaaguugu

SEQ ID NO: 149354 - RNA, 64 nt, Human
ucucuugcugggguuugcccuggaggugaggugagugcucgagggaggggagugcuuucugccc

SEQ ID NO: 149355 - RNA, 64 nt, Human
agugagggccuuagcaccugggccagcagcugcugugcucgauuucucgcugggccuuagcugc

SEQ ID NO: 149356 - RNA, 64 nt, Human
ccuggcacgcugagccucaggcaccagccucccugugcucgacagcaaagucuugacuccuucc

SEQ ID NO: 149357 - RNA, 64 nt, Human
ugggcggagccaccccagggccugcucccagggagugcucgaggcgcaucaggcccguuuuuua

SEQ ID NO: 149358 - RNA, 54 nt, Human
aaaggaagaaagugacguaaucacgugcucgaugaagaacaguuggcacuuugc

SEQ ID NO: 149359 - RNA, 64 nt, Human
gcucacauggcgcccagcacugggcuucagccaggugcucgagagcuuugaggccaugaucucu

SEQ ID NO: 149360 - RNA, 64 nt, Human
uaguccauauaaaccugcagagugauuuuccagagugcucgauacuguuaauuacaucuccauu

SEQ ID NO: 149361 - RNA, 64 nt, Human
ccucuguccgcaugccuggggccuucgcccccacgugcucgacaggggaacccgcccggacggc

SEQ ID NO: 149362 - RNA, 64 nt, Human
uuuuaggacuuucucuucuacacagcaauacgucgugcucgaguauccuuguagcaaagcacau

SEQ ID NO: 149363 - RNA, 64 nt, Human
ggggucgcugguuggccgggcccaggcgcgcggggacgcggaggccgcgcauccuuucccagcu

SEQ ID NO: 149364 - RNA, 64 nt, Human
uuuuucuuguguauacaaguauauauuuuuguuugacgcggacuaaaucauuuucauuuaauuu

SEQ ID NO: 149365 - RNA, 58 nt, Human
agugugccuuccucucguagcucggaaggacgcggaacggcgggcgaggcggaaggca

SEQ ID NO: 149366 - RNA, 64 nt, Human
ggccugagccugaccgggccauucccaaauuugggacgcggaaggagaggcucucggagcagaa

SEQ ID NO: 149367 - RNA, 64 nt, Human
cccgggccggggacccacucugcccagccggagggacgcggaggaggaagaggguagacagggg

SEQ ID NO: 149368 - RNA, 64 nt, Human
caggguucugagaacauuucacagaagugccugagacgcggagacauggcugguguuaaaugga

SEQ ID NO: 149369 - RNA, 64 nt, Human
gcagccggcccugcagcgcuacuuucugccagcggacgcggacccugacaccuacagcugaccg

SEQ ID NO: 149370 - RNA, 64 nt, Human
caccccugccccaccccgucugcaugcucacauggacgcggacggacacacucauuacacacuc

SEQ ID NO: 149371 - RNA, 64 nt, Human
gcuggagugugaggagggcgagcugucuuucuaugacgcggagcgccacugccaccuguacacc

SEQ ID NO: 149372 - RNA, 64 nt, Human
uugccucuccaaaaagagcuuccuuucgugacgagacgcggacgcagguccacccucgggcccu

SEQ ID NO: 149373 - RNA, 64 nt, Human
ggaacagcgucuucauucauuucuguugggaccagacgcggagccugggugcgcgagccgcccu

SEQ ID NO: 149374 - RNA, 64 nt, Human
gacucugcccaugugcuuuugccuguggaauggagacgcggacccuggauagugguucuaugac

SEQ ID NO: 149375 - RNA, 64 nt, Human
gcuuccggacggcgccgaccgccggagcccaagugacgcggagcucgucgcauuuguuauaaau

SEQ ID NO: 149376 - RNA, 64 nt, Human
cacaggcgggcggcuucccacacacccgucacaagacgcggacaugcaggucucggcgcgagcu

SEQ ID NO: 149377 - RNA, 64 nt, Human
ggcggcugguaucccgcggcggcucuggaagcuggacgcggaccacggcccgggagcuagaaac

SEQ ID NO: 149378 - RNA, 64 nt, Human
guggcugguaguguuugugugggaagcagcucaagacgcggaccgcgugacauuaaggagagcu

SEQ ID NO: 149379 - RNA, 64 nt, Human
cacgcacauuccguugccuuacccgauggcuugugacgcggagagaaccgauuaaaaccguuug

SEQ ID NO: 149380 - RNA, 64 nt, Human
uauacaccauuuauauaccuacacgcacgcaagagacgcggagagauaggcgaugcagacucgc

SEQ ID NO: 149381 - RNA, 56 nt, Human
uggugcaaauggcccagugacccccagacgcggaaaccggguggcagcgcccagcc

SEQ ID NO: 149382 - RNA, 64 nt, Human
ccggcacucggacuaccuggccccgcuggugaccgacgcggacaacugacccgccaggcgggag

SEQ ID NO: 149383 - RNA, 64 nt, Human
guagcucaccccggucacgcaugaaggcaaaagcaggucagaagcgaauacucugccauuaucu

SEQ ID NO: 149384 - RNA, 64 nt, Human
gcacauugggaggccaaggcagguggaucaccugaggucagaaguuugagaccagccuggccaa

SEQ ID NO: 149385 - RNA, 64 nt, Human
ggcaguauccccaguggaaagagcgugggccucaaggucagacaagccugguuuggaauccagg

SEQ ID NO: 149386 - RNA, 64 nt, Human
gcacuuugggaggccaaggugaguggaucaccugaggucagaaguuugagaccagccugaccaa

SEQ ID NO: 149387 - RNA, 64 nt, Human
guuacaguucauaucaggaugacccuacauacccaggucagauugacgggaccagaagggaaca

SEQ ID NO: 149388 - RNA, 51 nt, Human
auuucuugcaggucugcuaaaaggucagaguaaugcagaaugcgugccuuc

SEQ ID NO: 149389 - RNA, 64 nt, Human
accuaccuaaguagauuuuagguggguuccuauuaggucagauuuuuagcuucccuaauuaccu

SEQ ID NO: 149390 - RNA, 64 nt, Human
caacacuuugggaggccgaggcgggcggaucacgaggucagaucaagaacauccuggcuaacac

SEQ ID NO: 149391 - RNA, 64 nt, Human
cuugggaaagaaacuuucaccugagcuucaccugaggucagacugcaguuucagaaagguggaa

SEQ ID NO: 149392 - RNA, 64 nt, Human
ugaguccaaaccaagcccuuccaagagagaacaaaggucagagauguugaagauuccagcaaau

SEQ ID NO: 149393 - RNA, 64 nt, Human
agaguaggucaggccaaggcagguggaucaccugaggucagaaguucaagaccagccuggccaa

SEQ ID NO: 149394 - RNA, 64 nt, Human
guuuauagagaaaagauauauuuuuaaaagcucuaggucagaaguacuacacagugcuuuuaaa

SEQ ID NO: 149395 - RNA, 64 nt, Human
gccugcugugaccacugggagggaagaggagaggaggucagaggaccugggugaggacuagggc

SEQ ID NO: 149396 - RNA, 64 nt, Human
ggaagcacagcagguuuauccagaugaacugagaaggucagauuagggcggggagaagagcauc

SEQ ID NO: 149397 - RNA, 64 nt, Human
guuggcagaaguuccauguauaugggaucuuuacaggucagaucuuguuacaggaaauuucaaa

SEQ ID NO: 149398 - RNA, 64 nt, Human
gcgguuucccuucgcagauguguauacucaugauaggucagaaaguguauccgcuacaauaaag

SEQ ID NO: 149399 - RNA, 64 nt, Human
ugagcuauaagagggguggacacagggugggcugaggucagagguugguggggugucaucaccc

SEQ ID NO: 149400 - RNA, 64 nt, Human
augacagcaaagucuccuuauguauaaugaaacaaggucagagacagauuugauauuaaaaaau

SEQ ID NO: 149401 - RNA, 64 nt, Human
aauagccaagaauggcagccucagcgcagaggcaaggucagaaagagacggcgcuucagaguuu

SEQ ID NO: 149402 - RNA, 64 nt, Human
gaacuaggaccgacagugacuucaccagcuugcuaggucagaaugagagacuggugggucuguc

SEQ ID NO: 149403 - RNA, 64 nt, Human
aaucgaagcccaaggaugagcuaugacagcguccaggucagacggaugggugacuagacccaug

SEQ ID NO: 149404 - RNA, 64 nt, Human
cacccuagcccucucccucuaggcucugccuucgaggucagaggagagauagccuguggcccug

SEQ ID NO: 149405 - RNA, 64 nt, Human
guguaaugguucuccuggggcugucacauuuuauaggucagagugugacuucuuaauauggugc

SEQ ID NO: 149406 - RNA, 64 nt, Human
acgaucccauauuguauuaucacuugucuucuagaggucagaauuccauaauauaugucacuca

SEQ ID NO: 149407 - RNA, 64 nt, Human
cuuuaacagugagguggaucuuuaccucugauagaggucagaaugagguccuggggagaaucua

SEQ ID NO: 149408 - RNA, 64 nt, Human
cuaaagcacuuguaacuuugaaccgucugucuggaggucagagccuguuggaaagcagggguag

SEQ ID NO: 149409 - RNA, 64 nt, Human
caggucuggccugacccccaacaaagaagccuggaggucagagaagcaaaugcggagccugcuc

SEQ ID NO: 149410 - RNA, 64 nt, Human
aaaagaauguccaaugguaggaauuucaagguguaggucagauauuugagaauaggggauuuuu

SEQ ID NO: 149411 - RNA, 64 nt, Human
cuuauucaauucuucugaccucagaacuggcagaaggucagaugugacuacagaacucuaggug

SEQ ID NO: 149412 - RNA, 64 nt, Human
cagcucuuugggaggcugaagcggguggaucaugaggucagaagaucaagaccauacuggcuaa

SEQ ID NO: 149413 - RNA, 64 nt, Human
ucaaaaauggaguuccacuucuccccgcagaccuaggucagacuuuuccuuucaucuuuguguu

SEQ ID NO: 149414 - RNA, 64 nt, Human
aaauaaaaauaacguuuuaugacuauuuauugcaaggucagaguuacagauuguuauaaauugu

SEQ ID NO: 149415 - RNA, 64 nt, Human
uacuaauugcauuugcauuuuaagguacuacugaaggucagaucaaaguugaaaugcaaaaaua

SEQ ID NO: 149416 - RNA, 64 nt, Human
ugagcacugauguaaauuacuuagaucuucuuugaggucagaauucagcgaucacgguaggcag

SEQ ID NO: 149417 - RNA, 64 nt, Human
ccgcacuuugggaggccgagccggguggaucaugaggucagacguucaacaccagccuggccaa

SEQ ID NO: 149418 - RNA, 64 nt, Human
agugauuaaaacugauugugcagaauauucuaagaggucagaaauugguguguauaacuacauu

SEQ ID NO: 149419 - RNA, 64 nt, Human
gcugcuucuagaaucuaugcaggggauagcagugaggucagaagucuuucccgggagagagaug

SEQ ID NO: 149420 - RNA, 64 nt, Human
uuuuugagacgaggugagaucugaguauaaagauaggucagaaguauuuuaaagggcuuaaugu

SEQ ID NO: 149421 - RNA, 64 nt, Human
ugagccucucuacuuuuggaaaaaugaacaugugaggucagauuuuuuuuuuuuuuuuuaaguc

SEQ ID NO: 149422 - RNA, 64 nt, Human
cagcacuuugggaggccgaggugggcagaucaugaggucagaagaucgagaccauccuggcuaa

SEQ ID NO: 149423 - RNA, 64 nt, Human
gcugcacuacaacagauucuuaccgucuccacaaaggucagagauuguaaauggucaauacuga

SEQ ID NO: 149424 - RNA, 64 nt, Human
uaauaaaaauaacguuuuaugacuauuuauugcaaggucagauuuacagauuguuauaaauugu

SEQ ID NO: 149425 - RNA, 64 nt, Human
caggcaaucaacaaacguuucuugagcuagaccaaggucagauuugaaaagaacagaaggacug

SEQ ID NO: 149426 - RNA, 64 nt, Human
aauaucuguauacaaguguugcuucaaaguaccaaggucagaaauugauugaguacgguuuacu

SEQ ID NO: 149427 - RNA, 64 nt, Human
caaguacaguauaggcuggaaagaccuuaucugaaggucagaaacauugacucagaaaaaaggu

SEQ ID NO: 149428 - RNA, 64 nt, Human
caugcaaggcaauuaaaucacugugacagcacagaggucagaguuccgucauuuugcauuacuu

SEQ ID NO: 149429 - RNA, 64 nt, Human
uguuuucuccuuuuucucaagugauauuugccuuaggucagauucuacuaguuuaaagcaaaac

SEQ ID NO: 149430 - RNA, 64 nt, Human
auggcaguucagcgcaaggagagggagggcccacaggucagaaaaagcuccagagaccucacag

SEQ ID NO: 149431 - RNA, 64 nt, Human
ucccgguuucagaagcugcagcuggucuguuuccaggucagaaaccauuguucagaagaccucc

SEQ ID NO: 149432 - RNA, 64 nt, Human
aaaucagccaaaggacugagaaggaguuaccuuaaggucagagaaaaccaagagaguguggugu

SEQ ID NO: 149433 - RNA, 64 nt, Human
aggcugagaccugucaggccauacugacaagcagaggucagagacacugguggggagcuggcaa

SEQ ID NO: 149434 - RNA, 64 nt, Human
cauuuugggaguucagaggaggccuacaagggcaaggucagauggcagagcaagguugguccuc

SEQ ID NO: 149435 - RNA, 64 nt, Human
ggaauuucuacaauaauaaacccaucaucuccauaggucagaucgaagugcauuccaaugcuaa

SEQ ID NO: 149436 - RNA, 64 nt, Human
aggugcuuucauacacauugucucaauuccugugaggucagaauuaucucugcauuugaaacuu

SEQ ID NO: 149437 - RNA, 64 nt, Human
gagagacaacaggaacaacgcugcaccaaagaaaaggucagaauaaaaggcagcacagcuggug

SEQ ID NO: 149438 - RNA, 64 nt, Human
ugguguggcucucuggacuuaacgucacucucagaggucagaaccuuggagaucagaacugauu

SEQ ID NO: 149439 - RNA, 64 nt, Human
cuuuggaccucagaauuuucaccuggaacaugagaggucagaugacauaaugaauauguucuaa

SEQ ID NO: 149440 - RNA, 64 nt, Human
uuucaaaaaaauguuuuuaaaaaccuauuuugaaaggucagaauuuuguuggucugaauacaaa

SEQ ID NO: 149441 - RNA, 64 nt, Human
gcaugugaguaaucauugcuucugauuauugaagaggucagauuaugaaugaaaggauaaaaug

SEQ ID NO: 149442 - RNA, 64 nt, Human
guagaaugaggguuguuaauccaucacaagcaaaaggucagaacaguuaaacacugccuuuccu

SEQ ID NO: 149443 - RNA, 64 nt, Human
uucuccgaggggcuggagcggggaucugaugaaaaggucagacugaaacgccuugcacggcugc

SEQ ID NO: 149444 - RNA, 64 nt, Human
cuuccaaguacucagcuuuuucguauuucaaauaaggucagaccuuuuauacuuuugaccaaau

SEQ ID NO: 149445 - RNA, 64 nt, Human
ucucaaaucuggcuacugcaaaaccaguuuugacaggucagauuuucauauguauagguauaaa

SEQ ID NO: 149446 - RNA, 64 nt, Human
agagacccugagaccuggggcacccuggcuggccaggucagaagcauccugacugcagaggucc

SEQ ID NO: 149447 - RNA, 64 nt, Human
ccaugugucagauuaucagaacaauuuuguuaccaggucagaaauuguguucuuugacaacaga

SEQ ID NO: 149448 - RNA, 64 nt, Human
aguucauuugaguagcagaccuaacaaauauuugaggucagaacccuaccauguuaaaacaaac

SEQ ID NO: 149449 - RNA, 64 nt, Human
ccagagcucucagaaugaggauuuuuuuguaaauaggucagaagacgauggaacuguccugggu

SEQ ID NO: 149450 - RNA, 64 nt, Human
gcacuuugggaggccgagguagguggaucgccugaggucagaaguucaagaccagccuggccaa

SEQ ID NO: 149451 - RNA, 64 nt, Human
ugcuucuuuuucagguguguugugaaaguuuggaaggucagaccuuuuucuccaagaaggacaa

SEQ ID NO: 149452 - RNA, 64 nt, Human
ccugaaaagcuggacugagaauuggccuugaaucaggucagaguguuaacugucaacaugaagu

SEQ ID NO: 149453 - RNA, 64 nt, Human
cguuguacauugucccagacuguuuguaaacaugaggucagacauguguaagguagacgccuau

SEQ ID NO: 149454 - RNA, 50 nt, Human
ugucccuggagguauucugaaggucagaagagagauauacaacagcgagg

SEQ ID NO: 149455 - RNA, 64 nt, Human
gcugaaauggagguugaauauccuacuguguaacaggucagaauuucaagcucuggguaauaac

SEQ ID NO: 149456 - RNA, 64 nt, Human
augcagccuuucuaccaaguuuucaccuuguuucaggucagaggaaugauagaauuugucauuu

SEQ ID NO: 149457 - RNA, 64 nt, Human
cuguuuuacugguaaaggaaauccucugauggacaggucagagugaaggaagguugugcuggua

SEQ ID NO: 149458 - RNA, 64 nt, Human
aagcacaggcuacucagacuuggccacaggucauaggucagagaauuuuuucuucaaauguaga

SEQ ID NO: 149459 - RNA, 64 nt, Human
acacuuuaggagaccaaggcgggcagaucacuugaggucagaaguuugagaccagccaggccaa

SEQ ID NO: 149460 - RNA, 64 nt, Human
ccagaagccucugccucccuagcuuuucugcuauaggucagagaugggcugaacugagccuagc

SEQ ID NO: 149461 - RNA, 64 nt, Human
ugcugucccugagacugaggcagguuccuuuuccaggucagagguggagguagaucuuucucuc

SEQ ID NO: 149462 - RNA, 64 nt, Human
gaggagauggccauaggagaggaggguuccucuuaggucagauggagguucucagagccaaguc

SEQ ID NO: 149463 - RNA, 64 nt, Human
gcucgaagcagguuuaggaccagguccccuugagaggucagaggggccucugugggugcugggu

SEQ ID NO: 149464 - RNA, 64 nt, Human
uaucacauaccacauuguuaucaauucaucaguaaggucagaugcuguuugcacaccuccagca

SEQ ID NO: 149465 - RNA, 64 nt, Human
aagaucugagacugagaugucccccaagggugacaggucagauuuauuucagucagugcaaguc

SEQ ID NO: 149466 - RNA, 64 nt, Human
cugggggaucaccagccccaaggucccgaagggcaggucagagggagagaggcuggagaccugg

SEQ ID NO: 149467 - RNA, 64 nt, Human
aauuuaugaaagacccauuuccaggacugaaccuaggucagagcucuaaauugguccuucuauu

SEQ ID NO: 149468 - RNA, 64 nt, Human
uacaagccugauaauguuauaacccuguuuauucaggucagauuuaugccaacuuugcugagaa

SEQ ID NO: 149469 - RNA, 64 nt, Human
ugguucucuucugacaucuaagaagacugcagcaaggucagagguuuuagccuccugaggcuga

SEQ ID NO: 149470 - RNA, 64 nt, Human
gcucugaaacuugggaaggugagggauucaggggaggucagaggaucccacuuccugagcaugg

SEQ ID NO: 149471 - RNA, 64 nt, Human
gagccaugcaugauuagugguuacccuauugaauaggucagaaguagaaucuuuucaucaucac

SEQ ID NO: 149472 - RNA, 64 nt, Human
caugcuaacagcaauuucauaguaaauguaaauaaggucagaggaucuaacauagaagcugaug

SEQ ID NO: 149473 - RNA, 64 nt, Human
caugggcuuucccccauccccccgggauugggcaaggucagacuuagaguacagcuguuuuccu

SEQ ID NO: 149474 - RNA, 64 nt, Human
ccuccacaguggguggaagagugcaaggucugccaggucagauggagacgcagaaccugcuggu

SEQ ID NO: 149475 - RNA, 64 nt, Human
ugcugacauggguggcccauuggaaaggagaaccaggucagaugauguaacagccccaaggagc

SEQ ID NO: 149476 - RNA, 64 nt, Human
gccaggaugagugucgggcucucgugugugcaaaaggucagaugugacugcugcuguuugccug

SEQ ID NO: 149477 - RNA, 64 nt, Human
guuguguggacauuaugugauuuacuauauaaggaggucagagauggacuguggccaggcuucc

SEQ ID NO: 149478 - RNA, 64 nt, Human
aaugaauuuccagauacuuauuaccaaguagguaaggucagaagcuggaguucagagaaugugu

SEQ ID NO: 149479 - RNA, 64 nt, Human
cagcacuuugggaggccaaggcgagcggaucaugaggucagaagaucuagaacagccuggucaa

SEQ ID NO: 149480 - RNA, 64 nt, Human
aucugguauuucaaaauugcauuucuuguauaauaggucagauuuauuaacuacucauacuuuu

SEQ ID NO: 149481 - RNA, 64 nt, Human
guuuucuguuuaaaucauuguauaaaguaauugcaggucagaauuauaccacagaacuguuuau

SEQ ID NO: 149482 - RNA, 64 nt, Human
uugguucauugcccuucaccugguagagaaagagaggucagaaauagcaagcaaaaagcaggac

SEQ ID NO: 149483 - RNA, 64 nt, Human
aauuccuagcugccugugucacccugucccacugaggucagaguccuacaguggcucaugcagc

SEQ ID NO: 149484 - RNA, 64 nt, Human
gaggcuugggggagguguugaaauucucauuuacaggucagauagagcaguguacgucuuuucu

SEQ ID NO: 149485 - RNA, 64 nt, Human
uguggauugcugguguccagcaugacccauaaacaggucagaagaaugauggaauguuuuagaa

SEQ ID NO: 149486 - RNA, 64 nt, Human
cagcaggagaacgccaccgccuagugugaaugcuaggucagaagcugcuuuuucacacugaaac

SEQ ID NO: 149487 - RNA, 64 nt, Human
ucucauuaucuccaugauaaagauggggaaacuaaggucagaaggguuaacucaacugucuauu

SEQ ID NO: 149488 - RNA, 64 nt, Human
uucugaugcaucguuuucuuugcugugccaaagcaggucagaagagggagaggaggggcugggg

SEQ ID NO: 149489 - RNA, 64 nt, Human
cagcacuuugggaggccgaggcaggcugaucacgaggucagaagaucaagaccauccuggccaa

SEQ ID NO: 149490 - RNA, 64 nt, Human
aguggccuggucccccacaggcaguuagggccccaggucagaccucaccaugaugauuuguucc

SEQ ID NO: 149491 - RNA, 64 nt, Human
agccagcaaggggccgugccagugcccagagagcaggucagacaacaggcaacccugaggcagc

SEQ ID NO: 149492 - RNA, 64 nt, Human
acacuuugggaggccgaggcagguggaucaccugaggucagaaguucaagaccagccuggccaa

SEQ ID NO: 149493 - RNA, 64 nt, Human
auugagaaccagcuaccuugugguagggaauaagaggucagacacaaauuaagacaacucccau

SEQ ID NO: 149494 - RNA, 64 nt, Human
gaucuuuaaaaguugaagagggaggcaaaagaggaggucagagugauccuguauaagaaagaca

SEQ ID NO: 149495 - RNA, 64 nt, Human
cauccauucgagaacugaagcggccuccgggaugaggucagaggccccaccugauuuuccuggu

SEQ ID NO: 149496 - RNA, 64 nt, Human
ugccgagaccugaagaggguaagugacuugcccaaggucagagccacuuggugacagagccagg

SEQ ID NO: 149497 - RNA, 64 nt, Human
acuguuacuuuccuaaggaguccuucuacagaauaggucagaucuuggccucccaaaccccuua

SEQ ID NO: 149498 - RNA, 64 nt, Human
aagaagcaacauuuugagaauggaagcaggucugaggucagaagaaguagagaaugaaggaaaa

SEQ ID NO: 149499 - RNA, 64 nt, Human
aacccgucucagcagguccacagcaccugggcagaggucagagaccaggggaggccgggccuug

SEQ ID NO: 149500 - RNA, 64 nt, Human
aaaauccauucaaaggguuuucuuuuucauuacuaggucagaacauuuugagucaccuugggag

SEQ ID NO: 149501 - RNA, 64 nt, Human
uuaguuagguguaauucaguagcuuuaaauucucaggucagaacauaacauuucucauuuguua

SEQ ID NO: 149502 - RNA, 64 nt, Human
agcaguacaucugcuauaucugccgggacccaccaggucagagguggagugcaaaauaucguua

SEQ ID NO: 149503 - RNA, 64 nt, Human
ccggcuucuacuguacaggacacuggccccucucaggucagaagacaugccuggagggaugucu

SEQ ID NO: 149504 - RNA, 64 nt, Human
gcacuuugggaggcugaggcggguggaucacuugaggucagaaguucaagaccagccugaccaa

SEQ ID NO: 149505 - RNA, 64 nt, Human
gaaauaaagacuggaaagggggauuccuuguuaaaggucagauuuuaaauugcauauaaaauga

SEQ ID NO: 149506 - RNA, 64 nt, Human
uccuacucuguaacccuagagggcaccucugcugaggucagacaucuccuugaugucugugauc

SEQ ID NO: 149507 - RNA, 64 nt, Human
ggcuggauggaaggggcccuccacacuuccugggaggucagagacaaacuguuucagagaguca

SEQ ID NO: 149508 - RNA, 64 nt, Human
cuuuaagugaauuuuaacaaauaugacacagaaaaggucagaugcuguuguauaaaauuuuuua

SEQ ID NO: 149509 - RNA, 64 nt, Human
guggcaugguaaggcucccugagucccuuacuccaggucagaugccagugggacucaugcgccc

SEQ ID NO: 149510 - RNA, 64 nt, Human
gauuguuuccuuuauagagugucucagggugcagaggucagacuaagaaauauuccaaaugucu

SEQ ID NO: 149511 - RNA, 64 nt, Human
uauuauggaaagccaucaacuggguguggggaguaggucagaggguuagugaaaguccagggga

SEQ ID NO: 149512 - RNA, 64 nt, Human
uccuagcuuucaguuuccuuaucugcaaaguggaaggucagaccagaugaugcucugguacucc

SEQ ID NO: 149513 - RNA, 64 nt, Human
uccuggagccagccccacccaccccugagaacagaggucagacacagcugcguaacauccaucc

SEQ ID NO: 149514 - RNA, 64 nt, Human
gaaauguugaucucuuagucuucuauagacaaggaggucagacuggagugaauguuguaaaagu

SEQ ID NO: 149515 - RNA, 64 nt, Human
caguguuaugauaucuuccaguuuuugcuuucauaggucagagaucuaucuugugugugcguua

SEQ ID NO: 149516 - RNA, 64 nt, Human
aacagagaaaauaaugcuuauguaucugaagaaaaggucagaucuauuggaaaugacagcccga

SEQ ID NO: 149517 - RNA, 64 nt, Human
acagguuuaccagaucuggaacauuacuuauuugaggucagagaacaaaacaagaaccuggcca

SEQ ID NO: 149518 - RNA, 64 nt, Human
aaaaggaaauccaagcccugagguaggaaugagcaggucagauucaaggcagugaggucaggcc

SEQ ID NO: 149519 - RNA, 64 nt, Human
gaagguagagggcugucagcccugaaaaacacacaggucagacauuuaaaaggcauggguuucg

SEQ ID NO: 149520 - RNA, 64 nt, Human
ucccuuaugaggcuuagaauuucaaccacgugucaggucagacaguauuauaaacuguacuuug

SEQ ID NO: 149521 - RNA, 64 nt, Human
uugcugggagcaaaaacuagaaugauacaaagaaaggucagagaaaugcaugggaauauuuuuu

SEQ ID NO: 149522 - RNA, 64 nt, Human
uaguuccucuuuugauaaggcuguuaacauuacaaggucagagagaggaauggaaucgacagua

SEQ ID NO: 149523 - RNA, 64 nt, Human
caggugcaaacacacaaggaguuuggugggcuuaaggucagaggaguguguagggagggaugua

SEQ ID NO: 149524 - RNA, 64 nt, Human
gggaaccacagaggaaggaugaggugggauguggaggucagagcaucucacgagagucccucag

SEQ ID NO: 149525 - RNA, 64 nt, Human
cgagaacccacugaucucaccacuggggcaagcuaggucagagcuuagugauucacacugaaau

SEQ ID NO: 149526 - RNA, 64 nt, Human
cagcaccuugggaggcugaggcgggcagaucaugaggucagaagauaaagaccacccuggccaa

SEQ ID NO: 149527 - RNA, 64 nt, Human
ugggaaagagcauccucuggcaggugcucccaccaggucagacccaguccuggacuucaagagu

SEQ ID NO: 149528 - RNA, 59 nt, Human
guuuguguugggauuacugacucauaaccaggucagaaauuuuauucagauaaucugua

SEQ ID NO: 149529 - RNA, 64 nt, Human
aucgugggcacugcugaggaaugauccuagugguaggucagaagaagaugcugugaacaccagg

SEQ ID NO: 149530 - RNA, 64 nt, Human
gcuagcccaaggcuggggaaggggaggagacuccaggucagaaugugaggucucagucugugau

SEQ ID NO: 149531 - RNA, 64 nt, Human
ggaagggacgagucuaggcugagggcaagaugggaggucagaggugacagaagcguucaggggu

SEQ ID NO: 149532 - RNA, 64 nt, Human
ggcccauagggcugaguggggucgggugaggcagaggucagaaacagaagagcugcaguugcug

SEQ ID NO: 149533 - RNA, 64 nt, Human
agaggagcccaggcccuggcccugcuggggcugaaggucagaaguaauccugagaaauguuuca

SEQ ID NO: 149534 - RNA, 64 nt, Human
ucacacuggucugcugucgcucucaguucucgauaggucagagcagagguggaaaaacagcaug

SEQ ID NO: 149535 - RNA, 64 nt, Human
gguaagaugacguaaaugacccacuccuaaacugaggucagaccaccuaggcuuccaccuggug

SEQ ID NO: 149536 - RNA, 64 nt, Human
cagacuggggcagugacuggaaaaggaaaacuaaaggucagaauccgggaucaggaacuguuuu

SEQ ID NO: 149537 - RNA, 64 nt, Human
agugcuuuccacagaugcugguccucaguggauuaggucagaagcucauguucugauaguucuu

SEQ ID NO: 149538 - RNA, 64 nt, Human
aucccaaggagaagaaauacagaaaacccaagagaggucagacuggcucuuguuaccggagcca

SEQ ID NO: 149539 - RNA, 64 nt, Human
uucaaucacacugaauuggcaggauaagaaaaauaggucagauaaguaugggaugauaguugaa

SEQ ID NO: 149540 - RNA, 64 nt, Human
aucagaauguucauauaccagcugguuucugaagaggucagaaugaucuuucuccauacugacu

SEQ ID NO: 149541 - RNA, 64 nt, Human
caggucucacuaguuagaaaccugugggccauggaggucagacauccaucuuguccaucuauag

SEQ ID NO: 149542 - RNA, 64 nt, Human
cgacaggcccuugguggggucugucuuuuccuugaggucagaggucaggagcagggcugggguc

SEQ ID NO: 149543 - RNA, 64 nt, Human
aaagaucuacaugaaugcaaaacauuucauuaugaggucagacuaggauaauguccaacuaaaa

SEQ ID NO: 149544 - RNA, 64 nt, Human
gcacuuugggaagcugaggcggguggaucacuugaggucagaaauuugagacgagccuggccaa

SEQ ID NO: 149545 - RNA, 64 nt, Human
cagaaggucagacuccaugucugccuugaccucaaggucagaagguucccaaaccccuggggcu

SEQ ID NO: 149546 - RNA, 64 nt, Human
auaaaauucaaaaaagugugaugugcugcucagaaggucagacuccaugucugccuugaccuca

SEQ ID NO: 149547 - RNA, 64 nt, Human
accucgccagagaagcucuucaaccagaggguauaggucagagggauauaagagccagcaucca

SEQ ID NO: 149548 - RNA, 64 nt, Human
gcacuuugggaggccaaggcagguggaucaccugaggucagaaguuugaaaccagccuggacua

SEQ ID NO: 149549 - RNA, 64 nt, Human
caugucaucagggcccucugcacuccacaugaugaggucagacccacacggugcaaaucuuugg

SEQ ID NO: 149550 - RNA, 64 nt, Human
cauagauuuugaaauguuuuuuuaaugaaaaugaaggucagagagaauaauugcccugaccaca

SEQ ID NO: 149551 - RNA, 64 nt, Human
uaugaagagguuaacgcggccccuccacaccuggaggucagaaccuggccuguccucugucuuc

SEQ ID NO: 149552 - RNA, 64 nt, Human
agcgcuuuacccugcaggguuuugcuaaccucaaaggucagaaagguaaaaguagugccugccc

SEQ ID NO: 149553 - RNA, 64 nt, Human
uuuuuuuaaauaccacugucuuuagcuguccaggaggucagaguguuuuuucugucuuugggcc

SEQ ID NO: 149554 - RNA, 64 nt, Human
cguuguuauuaaagaauccuuaucuauaaaagguaggucagaucccccuccccccagguuccuc

SEQ ID NO: 149555 - RNA, 64 nt, Human
auacauaaaagagaucucugagugagagggaaagaggucagauuuauacaacugagcgccagag

SEQ ID NO: 149556 - RNA, 64 nt, Human
ugugugccucuagucccagcuacuugggaggcugaggucagaggauggcuugagcccaagaggc

SEQ ID NO: 149557 - RNA, 64 nt, Human
uacugauacccaaaaauauauuccagguaaagccaggucagaauuaggcuuuugcaggaauuua

SEQ ID NO: 149558 - RNA, 64 nt, Human
cccaucucccccucauaucccugacccaaagcaaaggucagagccuuucgccuccuucuauucc

SEQ ID NO: 149559 - RNA, 64 nt, Human
gcacuuugggaggccauggcggguggaucacuugaggucagaaguucaagaccagccugaccaa

SEQ ID NO: 149560 - RNA, 64 nt, Human
uguuguucugcaaaaguggcaagcauggagagagaggucagacuggcuaggcugcagggggaau

SEQ ID NO: 149561 - RNA, 64 nt, Human
cacaggccaggcccagucacagcugggcuuccacaggucagaauaugggacaggacauggucag

SEQ ID NO: 149562 - RNA, 64 nt, Human
uccaugacaguagccauggagucccaccugugccaggucagagcccacccggcagguuucagag

SEQ ID NO: 149563 - RNA, 64 nt, Human
uaggacagggcucagagggcuaggcacggagggaaggucagaggagaaggcaggcagggcccag

SEQ ID NO: 149564 - RNA, 64 nt, Human
ugccugcccagagccugcaggacagcacgccuugaggucagaggccuggcccuucuuuacagau

SEQ ID NO: 149565 - RNA, 64 nt, Human
caauauaaaggacauccucaucaucacggggugaaggucagacuaaggcagccuucuucacagg

SEQ ID NO: 149566 - RNA, 64 nt, Human
agucuucggacucauucuguaaauggaggagcugaggucagaggggggcugugaacuacucaag

SEQ ID NO: 149567 - RNA, 64 nt, Human
caggcaguggucacuacagccugauugguccuccaggucagaacggugccccacaguggucagu

SEQ ID NO: 149568 - RNA, 64 nt, Human
gcacuuugggaggcugagggagguagaucaccugaggucagaaguucgagaccagccuuaccaa

SEQ ID NO: 149569 - RNA, 64 nt, Human
gggguggggcgggucuauggggagaaagggagcgaggucagaggagggcauggguuggcagggu

SEQ ID NO: 149570 - RNA, 64 nt, Human
uagccccugacaacucaguggggugaaguuuuggaggucagagucugcuuucguaggcucuuua

SEQ ID NO: 149571 - RNA, 64 nt, Human
ggugguggcagcuggagggacccaugcagcacccaggucagagcagacccuccccugccggccu

SEQ ID NO: 149572 - RNA, 64 nt, Human
uacugugcagacugaccaccggccucccgccugcaggucagaggcucugacacugucugguuuc

SEQ ID NO: 149573 - RNA, 64 nt, Human
acccacugcuuuuggucugugugaugaugaaaugaggucagagccugcaguuauuaacacuaac

SEQ ID NO: 149574 - RNA, 64 nt, Human
ugucaucuacccaggacauucccaugaugaguacaggucagauugugccacaaggugggccucc

SEQ ID NO: 149575 - RNA, 64 nt, Human
cagggcugcucaaagaguagaguaauuguaaccgaggucagagcucugggguuggcagagauga

SEQ ID NO: 149576 - RNA, 64 nt, Human
gggaucagccaagcuucguuccaucuuuuccuaaaggucagagcugcagccuagggggcacugc

SEQ ID NO: 149577 - RNA, 50 nt, Human
augagaggaaaacugacuagaggucagagguggcuuucugaggccuggaa

SEQ ID NO: 149578 - RNA, 64 nt, Human
gguacccacauuuugaauaguaguuaucacucuuaggucagacagccaucagaauucucccaca

SEQ ID NO: 149579 - RNA, 64 nt, Human
gcuugagagcuccaacgggaagauggcuucacggaggucagaagagaaggaggccggcgagauc

SEQ ID NO: 149580 - RNA, 64 nt, Human
agcacccauccccugccagagcccuuccguucugaggucagacacacaaaaccuucgucaauug

SEQ ID NO: 149581 - RNA, 64 nt, Human
gaauggcaagacaguagaugagucugguuaagcgaggucagacauccaccagaaucaacucagc

SEQ ID NO: 149582 - RNA, 64 nt, Human
gacgcaggucacauucaccugugggcagagggacaggucagacacccaggcccaccccagagac

SEQ ID NO: 149583 - RNA, 64 nt, Human
accuuagucagcuuugcugaugggauuuagggccaggucagaguuucuuuucauaacugccuga

SEQ ID NO: 149584 - RNA, 64 nt, Human
cccaguaccaaauggugcuucagcucuaacauggaggucagagaaagggacuuggaccaauaaa

SEQ ID NO: 149585 - RNA, 64 nt, Human
gcacuuugggagauggaggcgggaaaaucauuugaggucagaaguucaaggccagccuggacga

SEQ ID NO: 149586 - RNA, 64 nt, Human
ucuagcacccagaggcaugacaggcccugcucagaggucagagggucugggcagaggagggacc

SEQ ID NO: 149587 - RNA, 64 nt, Human
gcagcccagggguaaguaaacaaaguauggaugaaggucagauuuucuugucaguuucugagaa

SEQ ID NO: 149588 - RNA, 64 nt, Human
aguuaguuacuuguuaaugcuagucacagccaggaggucagaaggaauuuucuacuucuggauc

SEQ ID NO: 149589 - RNA, 64 nt, Human
agacagauccugacauagcuuuggccuggguguuaggucagaaggaguacuggugcgugggggc

SEQ ID NO: 149590 - RNA, 64 nt, Human
uuuaugaauagauuucccuuucuuccugaccccaaggucagaggagacuauauauuccauggcu

SEQ ID NO: 149591 - RNA, 64 nt, Human
cuauccaccccaaugccucucagcaaacugggcgaggucagauuagacaggcuugggacagcag

SEQ ID NO: 149592 - RNA, 64 nt, Human
acauaucuuagugguaaacagcuuuuuuuuuuuaaggucagauugccucagguuuagaaagagg

SEQ ID NO: 149593 - RNA, 64 nt, Human
cagcauuuugggaggcugagguggccagaucccaaggucagaagaucgagaccauccuggcuaa

SEQ ID NO: 149594 - RNA, 64 nt, Human
uagcuaccuuccugccugugcaccuaaaaaccucaggucagaacuaggaaaagaguuuuguuuu

SEQ ID NO: 149595 - RNA, 64 nt, Human
uagcaccagcugucccaccuccaggguccugaccaggucagagauguccccugccaugcagagc

SEQ ID NO: 149596 - RNA, 64 nt, Human
cccaccgggucccgccggauaaaugacaggcccgaggucagaauggccauccccgggccccguc

SEQ ID NO: 149597 - RNA, 64 nt, Human
agccccagggcuccugugaguggauucacccccaaggucagaauggcaacuccuggaacagcac

SEQ ID NO: 149598 - RNA, 64 nt, Human
aguacagucgcgcuuacgaccuggcuagaacacaaggucagaugauaaacagaagcacaggaac

SEQ ID NO: 149599 - RNA, 64 nt, Human
ccaaguccauguaacucuuuagaacaagaggaauaggucagauagaagaagcuguguaauguau

SEQ ID NO: 149600 - RNA, 64 nt, Human
uccagaaccaagugcuauggaugccagauuggagaggucagacaccucgcccugcugcauuugc

SEQ ID NO: 149601 - RNA, 64 nt, Human
guggcauucagagggaaucaaagagccuuggugaaggucagagcuaaauggcuccuuaaggaug

SEQ ID NO: 149602 - RNA, 64 nt, Human
cugggcccugucgccccuccuuuuggccugggggaggucagaacauucgaaucucugccccuca

SEQ ID NO: 149603 - RNA, 64 nt, Human
gagcagcagggcagaagggcccucccuccagccuaggucagagguggggacagagaacuccccu

SEQ ID NO: 149604 - RNA, 64 nt, Human
auguccggcacuugcucccuugcugccccuucucaggucagaggcggguguuccagggccugcc

SEQ ID NO: 149605 - RNA, 64 nt, Human
ucauuugaggaugucuuauaaagacugaaggcaaaggucagauugcuuacggguguuauuuuua

SEQ ID NO: 149606 - RNA, 64 nt, Human
gccucaccccugcauggucggaaaucuucguuucaggucagaacagccuggggucuguggguaa

SEQ ID NO: 149607 - RNA, 64 nt, Human
guaugagagagagaguguguguuuguguguuucaaggucagaacagguuuuuuuguuuuuguuu

SEQ ID NO: 149608 - RNA, 64 nt, Human
cuaacguccacuagcuuacugaguuaucaggugcaggucagacucuuggcuacagugagaggca

SEQ ID NO: 149609 - RNA, 64 nt, Human
aucagguuuauuuuguaaccaaagucuuuuuuagaggucagacuuccuaaucaaaggccugggc

SEQ ID NO: 149610 - RNA, 64 nt, Human
ccgcccucccguccucccagagcugcuggcgcugaggucagagcgggucugauggggagcuccg

SEQ ID NO: 149611 - RNA, 64 nt, Human
uggcgggcccucuccccaccucaccucuuaauaaaggucagacacuggccaggcgaggccgcgg

SEQ ID NO: 149612 - RNA, 64 nt, Human
caggaucaguccuucucucggguucuggcccccaaggucagagcaagcaucuuccugacagcau

SEQ ID NO: 149613 - RNA, 64 nt, Human
cacauuguuuuucucagaaccaggauucucugagaggucagagcaucucgcuguuuuuuuguug

SEQ ID NO: 149614 - RNA, 64 nt, Human
caccguccacuccuccuacuguauuuuauuggacaggucagacucgccgggggcccggcgaggg

SEQ ID NO: 149615 - RNA, 64 nt, Human
auaggagcucagcaggcagacgaaugaggaauaaaggucagagaaggucagagcugagugacgu

SEQ ID NO: 149616 - RNA, 64 nt, Human
agcaggcagacgaaugaggaauaaaggucagagaaggucagagcugagugacguuuggaaucca

SEQ ID NO: 149617 - RNA, 64 nt, Human
auaugcaggagugaagccuucaaaaugauaaguaaggucagaauuuagcaaaaguauaaugagg

SEQ ID NO: 149618 - RNA, 64 nt, Human
ugcuaugugcaggguggaagggagggaaguugacaggucagaagaucaggaaagaggucggggc

SEQ ID NO: 149619 - RNA, 64 nt, Human
gggcucccucccucggaggacaucgucuguguccaggucagaaaguggcccaggaagggggcag

SEQ ID NO: 149620 - RNA, 64 nt, Human
aaaccaaacuugcaguugauuuggggucauguuuaggucagaaucaccgugcccuugaacaagc

SEQ ID NO: 149621 - RNA, 64 nt, Human
accucugccaucuacuaccuaagugaccuugggaaggucagaaaaaucucucagggccucggug

SEQ ID NO: 149622 - RNA, 64 nt, Human
uguuccuguauuguggccuggugccauuuuugucaggucagaggucaccaugaaaaggaggcag

SEQ ID NO: 149623 - RNA, 64 nt, Human
acccagcaggcaccccccggggaggcaggggcagaggucagaaggggugucugggaccuggaug

SEQ ID NO: 149624 - RNA, 64 nt, Human
gggaggccaaggugcaaggcaggcagaucauuugaggucagaaauucgagaccagcguggucaa

SEQ ID NO: 149625 - RNA, 64 nt, Human
uuugauucaaauucaaaacuuaacagcacaaaccaggucagaguuacuuucgguuagaauuuau

SEQ ID NO: 149626 - RNA, 64 nt, Human
uaaccuagaauucagaugauccuggaauuaaggcaggucagaggacuguaaugauagaauuaaa

SEQ ID NO: 149627 - RNA, 64 nt, Human
auagugcuguuagaauuacaugaguuagauguggaggucagaguggaagcaggugugagagggu

SEQ ID NO: 149628 - RNA, 64 nt, Human
ccauucuccccuacaguuuuaugcucagacauggaggucagagccacaagggaaaggggagagg

SEQ ID NO: 149629 - RNA, 64 nt, Human
acacuuugguagacugaugugaguggaucaccuaaggucagaaguucaagagcacccuggcuaa

SEQ ID NO: 149630 - RNA, 64 nt, Human
gcacgguuggaggccaaggcacauaggucacuugaggucagaaguuugaaaccagcauggccaa

SEQ ID NO: 149631 - RNA, 64 nt, Human
cgggauucgggucucuaagaugucuuaugaaugcaggucagagggucacauguuaacacuagag

SEQ ID NO: 149632 - RNA, 64 nt, Human
guuggcaagaagcucagcacugcauuccugaccgaggucagaaccagaucaaucucagaaucuc

SEQ ID NO: 149633 - RNA, 64 nt, Human
uucauuguaacaaaauucaaucaaaaaggcagcuaggucagaaggaaacauaccacucucaugg

SEQ ID NO: 149634 - RNA, 64 nt, Human
uggagaggcaggcauaggcagggaaccgagcagcaggucagagcaggcgagcugacauucugca

SEQ ID NO: 149635 - RNA, 64 nt, Human
gccaggcuaaggguggcucaguuccaucaucuggaggucagacacacuguccagaggcagaacu

SEQ ID NO: 149636 - RNA, 64 nt, Human
gaugagcucagcagaaccgcacagccagagccccaggucagaagugcagaccaggguucucagc

SEQ ID NO: 149637 - RNA, 64 nt, Human
ucaccgaagcagccaccugcuguaguuggaccugaggucagaggcggggcaucagaggcucaag

SEQ ID NO: 149638 - RNA, 64 nt, Human
auccauggugacggagguggcaaugacaucaucaaggucagaggguaaauuccuaacaggagac

SEQ ID NO: 149639 - RNA, 64 nt, Human
cguucugagcugaggagagucccguggacaucggaggucagaggugggcccuccccuggaccua

SEQ ID NO: 149640 - RNA, 64 nt, Human
cugccucucaggcacucuccucgcccaguuucugaggucagacgagugucugcgaugucuuccc

SEQ ID NO: 149641 - RNA, 64 nt, Human
ugagaccucucuggagacccagauccccuagagcaggucagagaccauccagaaucccagaauu

SEQ ID NO: 149642 - RNA, 64 nt, Human
gggguggggcuaccagguagcaguugacaacccaaggucagaggaguggcccucagugucaucu

SEQ ID NO: 149643 - RNA, 64 nt, Human
ggcucacccagagucagggagagaugaaaauaauaggucagaaugcaagugacuuaaucacagu

SEQ ID NO: 149644 - RNA, 64 nt, Human
caaccguguuuucuccagaucugucuagauacaaaggucagaaaucuuauuuuuauacuuuuau

SEQ ID NO: 149645 - RNA, 64 nt, Human
aaacaauuguuggauagcuggaaacaguguuuuuaggucagaccaggcuuuuggucuuucaaaa

SEQ ID NO: 149646 - RNA, 64 nt, Human
ucccagacuggggaagggaggugucuagaaacccaggucagacacacucucugggcucaagauu

SEQ ID NO: 149647 - RNA, 64 nt, Human
gaugagauccgggagacugacacgaagccagcagaggucagaggggacucugaccacagcccgc

SEQ ID NO: 149648 - RNA, 64 nt, Human
gagguuggagcagagagcuggaaagguaagacugaggucagaaaggugcagagaugaaaagauu

SEQ ID NO: 149649 - RNA, 64 nt, Human
cgcacggaugcagaaaacuuaauggaggaggcugaggucagaaugggaagaguuuuuaaaaaau

SEQ ID NO: 149650 - RNA, 64 nt, Human
ggggaucaccacggcucuagggcauucuaggaugaggucagaccccuuggccauugguguuauu

SEQ ID NO: 149651 - RNA, 64 nt, Human
ccuacaacaguuccauugucagcacagccuaggaaggucagauccuguauuaauuacucuuagu

SEQ ID NO: 149652 - RNA, 64 nt, Human
ugugcucccgcccagccugcugaggccuccgcucaggucagaagcccagcugcugauggacacg

SEQ ID NO: 149653 - RNA, 64 nt, Human
ccagccucaguuuacccguaaaugcacuagcgcgaggucagaaaucacaagccugggcauggcc

SEQ ID NO: 149654 - RNA, 64 nt, Human
gagcagguggccuccuaugacccucguaggugcgaggucagaagccagcaggcucucugaacuc

SEQ ID NO: 149655 - RNA, 64 nt, Human
cagauacuucugugggcccugaagugggcucucaaggucagaccaagguugcugaucucagucc

SEQ ID NO: 149656 - RNA, 64 nt, Human
ugacugauggaggccccggcccacgugaccagcaaggucagaggcccagccagauuccauccug

SEQ ID NO: 149657 - RNA, 64 nt, Human
ggcugagcuggaggugggcagggcugcuccaggcaggucagagcagugcagggggaggagagga

SEQ ID NO: 149658 - RNA, 64 nt, Human
guucagucuacaccuaagcagguagacauccgcgaggucagaugcuuuccaacaugacaccuga

SEQ ID NO: 149659 - RNA, 64 nt, Human
guuugcucccauuacucaaaaugcaggacagaucaggucagagcccaggaauucucacagguuc

SEQ ID NO: 149660 - RNA, 64 nt, Human
uuuuauuccuccccaccccaaccccuuaaaaaaaaggucagaaggacaaagcugguuuguuugg

SEQ ID NO: 149661 - RNA, 64 nt, Human
uucaucauguuuucuaaaauucuguugguuuuagaggucagauuccucccaaccaggcuaauaa

SEQ ID NO: 149662 - RNA, 64 nt, Human
aaaggugauuccuaucacuugucaagguagggagaggucagaugcccaagccuuugaccacggu

SEQ ID NO: 149663 - RNA, 64 nt, Human
uguccucuucugcagguccagcccuggcgagggcaggucagaggaagugaagaaaucaagagca

SEQ ID NO: 149664 - RNA, 64 nt, Human
ugcuuucuuaauuucuuauaagucuuacauguuuaggucagauaaccauuuuuucuucauuccu

SEQ ID NO: 149665 - RNA, 64 nt, Human
ucccccaaaagccagcgcuguucuacaauaguucaggucagacaucuaagauccccaggccaaa

SEQ ID NO: 149666 - RNA, 64 nt, Human
cuagaguccuacuuacauaguugaaauaucaaggaggucagaagaaaauuggacuggugaaaac

SEQ ID NO: 149667 - RNA, 63 nt, Human
agaggcgcggggccacacccgugaaccaugcagacggccgaagaagucuuaggcagggcgccc

SEQ ID NO: 149668 - RNA, 63 nt, Human
ggccagcacaccuaacccauggauguggaaccuacggccgagaaggaauguugcaugagucgg

SEQ ID NO: 149669 - RNA, 63 nt, Human
aaaacauuaguggccgcugccccagcuacagagacggccgaaaugcuuucacuccuuagcuuu

SEQ ID NO: 149670 - RNA, 63 nt, Human
gaagcuccacauguccauggaaguuugugauguacggccgacccuacaggcaguuaacaugca

SEQ ID NO: 149671 - RNA, 61 nt, Human
caccacaucgacuacuauaaaaagacaaccaacggccgacugccugugaaguggauggcac

SEQ ID NO: 149672 - RNA, 63 nt, Human
gagaccccgggugggugagcgcuggcuucucaaacggccgaaguugccucuuuuaggaaucuc

SEQ ID NO: 149673 - RNA, 63 nt, Human
ugcacugccccucccacccggccccgcccaggcacggccgaccccgccccgggcaccgcccac

SEQ ID NO: 149674 - RNA, 63 nt, Human
ggagccgccuccacgcugugcucccucccaacaacggccgagccugcaccgacaacccccugg

SEQ ID NO: 149675 - RNA, 63 nt, Human
uaccauuucacaaaguuggagaucugcaaccucacggccgaugcucugcagucugacaagcuu

SEQ ID NO: 149676 - RNA, 63 nt, Human
ggggggagccauccagaccgaacagcgcccuccacggccgagucccccgccgcuggaccuggu

SEQ ID NO: 149677 - RNA, 63 nt, Human
agcccggggacggccgugcuccgucccucgccaacggccgagcuugugauucugagcuugcaa

SEQ ID NO: 149678 - RNA, 63 nt, Human
gccaccagcggcccucggagguacccaggccccacggccgagccucuggccggagaucggccg

SEQ ID NO: 149679 - RNA, 63 nt, Human
cugaacuuugccgucuuguaagggugggggcugacggccgacccugggaggaggugacaucgc

SEQ ID NO: 149680 - RNA, 63 nt, Human
ccgcccccagcagcacagaccccgccgccuccuacggccgacucuggguucccuucagguguu

SEQ ID NO: 149681 - RNA, 63 nt, Human
uccgggauuguuuccccaaguuguuacgccuggacggccgagaguuauccgcaccagugauug

SEQ ID NO: 149682 - RNA, 62 nt, Human
gacccaccaggaggaaagaggcccagcucucagcugacgauggaggcagaaccggagucggg

SEQ ID NO: 149683 - RNA, 62 nt, Human
cagucauccacaccauugcucuggggccgucugcugacgaagaacuggagacccugucaaau

SEQ ID NO: 149684 - RNA, 62 nt, Human
gguuuuuaaaggagcgcccacgaaguguaguggcugacgauuucaaccucacacagcaguuu

SEQ ID NO: 149685 - RNA, 62 nt, Human
gcugcuuugcucuuucaaaacagaaccuccaggcugacgaggcaagacaaagccucccacca

SEQ ID NO: 149686 - RNA, 62 nt, Human
uguccuggagggggcagaggccaggccccagugcugacgaggagcccagauuugggccuaau

SEQ ID NO: 149687 - RNA, 62 nt, Human
uccucucucccuccagucugauuuuauaaagugcugacgagauugggaauaaagaggcauaa

SEQ ID NO: 149688 - RNA, 62 nt, Human
uguguccgugaagugagucccgucugccaggagcugacgaaccacgaaugcuucugccugug

SEQ ID NO: 149689 - RNA, 62 nt, Human
agcagacuaugggcagcccagugcugccaccugcugacgacccuugagaagcugccauaucu

SEQ ID NO: 149690 - RNA, 62 nt, Human
gacccuguggcagcuuugaugugcgcaagacagcugacgacugagcccugcuucugcugggg

SEQ ID NO: 149691 - RNA, 62 nt, Human
uucaggcacuuguggccccucaaggaccucacgcugacgagcaaucaggugagagggaggcc

SEQ ID NO: 149692 - RNA, 62 nt, Human
cagauuuuugccuagcacucgguuuugguggagcugacgauuuugagggcugaggcugguua

SEQ ID NO: 149693 - RNA, 62 nt, Human
cucagaaagaggucuccccauccccauucggggcugacgauggggggcugauggcugccccu

SEQ ID NO: 149694 - RNA, 62 nt, Human
cuuggcaacuccagggcgcuccguucaagaaugcugacgaaaagcaauauccaaagucuugu

SEQ ID NO: 149695 - RNA, 62 nt, Human
agcacggguccacagaguuccagagaaugaaugcugacgacuaagcaccagccuccacuccc

SEQ ID NO: 149696 - RNA, 62 nt, Human
caacaagccagccuuugguaagcucggugccugcugacgaacucugagaucccaauggugug

SEQ ID NO: 149697 - RNA, 62 nt, Human
ccgcccaggaucagauugcaugugacucugaagcugacgaacuuccauggcccucauuaaug

SEQ ID NO: 149698 - RNA, 62 nt, Human
ugccaggacaaugaaauacuccagcaccuguggcugacgaauuuguuucuacagaaauaaca

SEQ ID NO: 149699 - RNA, 62 nt, Human
ugggucugugagguucuguaaacugugcuagugcugacgauguucuguacaacuuaacucac

SEQ ID NO: 149700 - RNA, 62 nt, Human
caugugcucugaggccaggccccagcucugcugcugacgagcugugugguccugggcagagu

SEQ ID NO: 149701 - RNA, 62 nt, Human
ggacaagcacuuucucagaagcccguggcccugcugacgagagacagcccacccccagccug

SEQ ID NO: 149702 - RNA, 62 nt, Human
ccaucaacuuguaggcggccaaggccgccugugcugacgaggcccggagcugcuccugcugc

SEQ ID NO: 149703 - RNA, 62 nt, Human
cuuuccuccgcagaaagcaaaguuuggggagggcugacgauuuuguagaacacaacagugac

SEQ ID NO: 149704 - RNA, 62 nt, Human
auaaauaauggagcaugcagugagcacaucuagcugacgauaaucacaccuuuucccccguc

SEQ ID NO: 149705 - RNA, 62 nt, Human
aaggaaauaauugccaaauaccuaggcccauugcugacgauuaguucuaaaaucuuauuccu

SEQ ID NO: 149706 - RNA, 61 nt, Human
auggcuaaagccucucuugauuuaggcuugggcugacgacaaaguuguacauccugaaccc

SEQ ID NO: 149707 - RNA, 62 nt, Human
ccuuucccuuccgcgccugccccaucgggcucgcugacgaggaagcgcugucccugugauga

SEQ ID NO: 149708 - RNA, 62 nt, Human
uaggagccccaguagcccaggagcuugggugugcugacgagcaggguggugaguagagcccu

SEQ ID NO: 149709 - RNA, 62 nt, Human
auccuggaaccaaaccccugcagauacuaagggcugacgaucuagguaagacuggauuuaac

SEQ ID NO: 149710 - RNA, 62 nt, Human
cauggagguguccuguugaagcccuugaucccgcugacgacgcccacgucgaggccccaccg

SEQ ID NO: 149711 - RNA, 62 nt, Human
acggagcacagucauaaguggagguucagggugcugacgaaauccaagcugcucugguugaa

SEQ ID NO: 149712 - RNA, 62 nt, Human
cagggaggcaccauucaggaaccuggaccaaagcugacgaggcugggccaagccagggaugg

SEQ ID NO: 149713 - RNA, 62 nt, Human
ccgucucugauucucccuuuaugaagcugcaggcugacgagagauggucccuucccauuggc

SEQ ID NO: 149714 - RNA, 62 nt, Human
cuuuauuaugugguuagcauagguuauacuuugcugacgauucacauuuuauuaguuugguu

SEQ ID NO: 149715 - RNA, 62 nt, Human
ggccuggaggggccuggggcccgggaccggaggcugacgaggcuggacuuccucgaguggcc

SEQ ID NO: 149716 - RNA, 62 nt, Human
cccccauuuuccagggggguuguaauuuauaagcugacgaagguagccagacuuccggagga

SEQ ID NO: 149717 - RNA, 62 nt, Human
aguaccugccccuucaccucucagacgaggcagcugacgaggcagcuggcccagucuuggga

SEQ ID NO: 149718 - RNA, 62 nt, Human
ggagcaggugggucgauccugcuugaguaaucgcugacgagcuucgugcugcugcuuuccug

SEQ ID NO: 149719 - RNA, 62 nt, Human
ccuuggccucacaggcaaagaauaacuuaaaagcugacgauuugaauaaauuauguuacagu

SEQ ID NO: 149720 - RNA, 64 nt, Human
cauuggcccaggugguggagacagagacaggccccugaacgauaagcaccaagagaccccaagg

SEQ ID NO: 149721 - RNA, 64 nt, Human
gaucuccucucaucagucucaccuccugcagcaacugaacgagcagcgcaggcaagauguauuu

SEQ ID NO: 149722 - RNA, 64 nt, Human
ccgucgccuccuucccuccuagggcauccccugccugaacgaagacuuccgccgcgaagcccga

SEQ ID NO: 149723 - RNA, 64 nt, Human
agauuggaucucccaaguuuuaauugaaaggagacugaacgaaaaccuuucugcuuucuguccg

SEQ ID NO: 149724 - RNA, 64 nt, Human
caccugggaaaacagaggaaucuaccuguggugacugaacgagggauaauucaaacugacaacc

SEQ ID NO: 149725 - RNA, 64 nt, Human
gugggaaaaaacagcuccuccauuuccuugaaaacugaacgauuauuaaaaauagauuaaacuu

SEQ ID NO: 149726 - RNA, 64 nt, Human
gagcuacauggaccccaugaacgaguacaacgcgcugaacgaggccaagcagaugaucgccguc

SEQ ID NO: 149727 - RNA, 64 nt, Human
ggauuguaucaaguagaugggacaacauucugcucugaacgaaaaguaauuuuagagacauaac

SEQ ID NO: 149728 - RNA, 64 nt, Human
ugcgccaaggguucagugucugucuucagcccugcugaacgaagaggauacuaaagagagggga

SEQ ID NO: 149729 - RNA, 64 nt, Human
cagugcuguauguccaauuguuaaauguaccauucugaacgauguuaaagcaagugugguuuau

SEQ ID NO: 149730 - RNA, 64 nt, Human
ucugcugaaaccuuaaucucagacuuccagccuccugaacgaagaaagaauaaauuucggcugu

SEQ ID NO: 149731 - RNA, 64 nt, Human
cuggacauugcauccuuauucacacauguggcagcugaacgaggugcuguugugggugucucag

SEQ ID NO: 149732 - RNA, 64 nt, Human
caacauuuuugaauacauuaaaagaaguaaccaacugaacgacaaagcaugguauuugaauuuu

SEQ ID NO: 149733 - RNA, 64 nt, Human
ugagagggaggagaugcaggaugcccacgucauccugaacgacaucaccgaggaguguaggccc

SEQ ID NO: 149734 - RNA, 64 nt, Human
ggcaaaugcagaauuauaguugggccugagaugucugaacgaugcuugggugguaauuuuaaua

SEQ ID NO: 149735 - RNA, 64 nt, Human
cuaaggugcagagucagaauaugaacuguugcaacugaacgaggaagggaugcuguuggcuuca

SEQ ID NO: 149736 - RNA, 64 nt, Human
agggcuucaaggcccucagagaugaucaguccaacugaacgaccuuacaaaugaggaaaccaag

SEQ ID NO: 149737 - RNA, 64 nt, Human
acugccagucaccaaggccaugggcauggaugugcugaacgaggccauugguacccucaccgcc

SEQ ID NO: 149738 - RNA, 64 nt, Human
cuuucuuguccuauacccagcugggguugcugcccugaacgaacugcguguggggccggcacau

SEQ ID NO: 149739 - RNA, 64 nt, Human
uuucugaaggcauuguuugagguugaucucagcacugaacgauuucaagcccuacgcaccagaa

SEQ ID NO: 149740 - RNA, 64 nt, Human
ccgugccauucugccucuuaccuggaagaucaggcugaacgaucaaaagcugaaacauaaguag

SEQ ID NO: 149741 - RNA, 64 nt, Human
uuauccaauaacauugugggaaagguuugggggacugaacgagcauaaauaaauguagcaaaau

SEQ ID NO: 149742 - RNA, 64 nt, Human
gguuuacagugaagaaagccuguuguuuaagugacugaacgauccuucaaagucucaaugaaau

SEQ ID NO: 149743 - RNA, 64 nt, Human
cuucuaaaaauugagguuaagauauagcuagugucugaacgacacuccuuaaaguaaguuccaa

SEQ ID NO: 149744 - RNA, 64 nt, Human
auaccuguuggacugccugaacuuugcuacuagccugaacgacagugccuuggaaaggcaggcu

SEQ ID NO: 149745 - RNA, 64 nt, Human
caagccagugaaauacagacuuaauuugucaugacugaacgaauuuguuuauuucccauuaggu

SEQ ID NO: 149746 - RNA, 64 nt, Human
caucuuccaugggacuuccccccaacaacugagucugaacgaaugccacgugcccucacccagc

SEQ ID NO: 149747 - RNA, 64 nt, Human
uuugcagggcgauucgggaggcccccuggugugucugaacgauggccgcaugacuuuggugggc

SEQ ID NO: 149748 - RNA, 64 nt, Human
uauaaaagccaaauaguuuuuaaagaucucggugcugaacgacagucccaguucccauuugugu

SEQ ID NO: 149749 - RNA, 64 nt, Human
gcuagcagguggacauucugguauuuuagacugacugaacgaaacccagaggcugguuccagag

SEQ ID NO: 149750 - RNA, 64 nt, Human
uccauuuuagaaccauuaaucucuuuauccauugcugaacgacugugacuauucaguaacgaag

SEQ ID NO: 149751 - RNA, 64 nt, Human
aucugaagguuauggccuuuugacaagagggauucugaacgacuaaauuagucaguuugcucgc

SEQ ID NO: 149752 - RNA, 56 nt, Human
ccaucugcuccguuucuugaaguuugcugaacgaggacucacagcugcaacguggg

SEQ ID NO: 149753 - RNA, 64 nt, Human
ugaaaagcagccgaccguguggaguacuuccgugcugaacgauugggacuagacgcugaaaucc

SEQ ID NO: 149754 - RNA, 64 nt, Human
cuacaccaucaagacugugucuacacuaucuuggcugaacgagaagagauguaaaugcugggug

SEQ ID NO: 149755 - RNA, 57 nt, Human
aguggagggcuggcaagugaaguagcacugaacgaagccagggguucagaugacacu

SEQ ID NO: 149756 - RNA, 64 nt, Human
ccaagacacaccuccccaaccucagucuucccaucugaacgauggguccugaggcacagcucug

SEQ ID NO: 149757 - RNA, 64 nt, Human
ucuggaagaugguuuuuuaaaaaauccuggccugcugaacgaauaguuucuucugcaacauuug

SEQ ID NO: 149758 - RNA, 64 nt, Human
aaggcauuaucggguggcucccuugcuccaggaacugaacgaggcccuuuucauaccuuaaaua

SEQ ID NO: 149759 - RNA, 64 nt, Human
uuauuaggagagauacucucuccuguuuucuccacugaacgagacucaucuugcucuucuaggu

SEQ ID NO: 149760 - RNA, 64 nt, Human
uuccugauauugacucucuuuauaccuacccaagcugaacgacccuccuuuucuuaaauaaaau

SEQ ID NO: 149761 - RNA, 64 nt, Human
uuuucaggucugcagaaccauagcuuccacgcaccugaacgagcacagaaugaacugacggugg

SEQ ID NO: 149762 - RNA, 64 nt, Human
cccgccucaccccacagggaccccagugcaucagcugaacgagaccauugacuacaacgagcag

SEQ ID NO: 149763 - RNA, 64 nt, Human
cccagacccaucuuguauuuuguggcccagaaaacugaacgauuauuuuguuccuccguagucc

SEQ ID NO: 149764 - RNA, 64 nt, Human
gggagagugaaugugugagaacacuaagaccacucugaacgaugauaaugaguuggggggugga

SEQ ID NO: 149765 - RNA, 64 nt, Human
uugucugaaacauagauagaucccacguugaugucugaacgaccgucuuuugaaaacucaucgg

SEQ ID NO: 149766 - RNA, 64 nt, Human
agcccaaguggaagaaaaugagggcuugagucgccugaacgaagagcaggaagagguugcugag

SEQ ID NO: 149767 - RNA, 64 nt, Human
cguguucugucugugucuucaggagucucauggccugaacgaccaccucgaccugaugcagagc

SEQ ID NO: 149768 - RNA, 64 nt, Human
uuggugagcauuuagagggaagcagggcagaacucugaacgacaauacgucucucugagcagag

SEQ ID NO: 149769 - RNA, 64 nt, Human
uugaacuuucagucaucuuuuucguggugucucacugaacgauguguuagaacauguguuccau

SEQ ID NO: 149770 - RNA, 64 nt, Human
aauccucagaaagccuugccuuuagagaacgucacugaacgaaugauuagaggagugcuacuuu

SEQ ID NO: 149771 - RNA, 64 nt, Human
gucuagcaaaugcuaaggccccucaggcugggcucugaacgaggaccuggacucagagccagac

SEQ ID NO: 149772 - RNA, 64 nt, Human
gcagcauuguaacugcuuaauaaaugacaucucacugaacgaaugagugcuguguaagugaugg

SEQ ID NO: 149773 - RNA, 64 nt, Human
cacuguggaauacaagacagugaacucugucugccugaacgagccauguaaauuaaguucuaga

SEQ ID NO: 149774 - RNA, 63 nt, Human
uauggagcaacaggaaacuggugauaaagcucagcugaacgacagaagguucuauuccuccgc

SEQ ID NO: 149775 - RNA, 64 nt, Human
gggaaggaaaauauugagcuaggcacauuacucucugaacgaaauucauauuaucuuauuaagg

SEQ ID NO: 149776 - RNA, 64 nt, Human
cuuucuucccgccucuccagguugacagccuucucugaacgaccucuccauuacucucaugcuu

SEQ ID NO: 149777 - RNA, 64 nt, Human
aacagaggugauguuaggucuggagcaaaaauuccugaacgacagggaguauucuggccucuga

SEQ ID NO: 149778 - RNA, 64 nt, Human
aguuuaugagaauucuucaaaucccgugugcacgcugaacgacacagcucaguuuaaccgaaug

SEQ ID NO: 149779 - RNA, 64 nt, Human
uccaggcugaggugggaggaucgcuugagcccaagagguugaggcugcagugagccaugaucgc

SEQ ID NO: 149780 - RNA, 64 nt, Human
ccuguauuaaacacaagccccccaagcaaaagaagagguugaguuugcugccaggauucagauc

SEQ ID NO: 149781 - RNA, 64 nt, Human
aguccauaaaaugugaaaacuggagaagaucuuagagguugaagcccaccuucucuuuucacau

SEQ ID NO: 149782 - RNA, 64 nt, Human
gagagauacuuagagggagggaguagguuuugaagagguugauggugguggggagggaaggccu

SEQ ID NO: 149783 - RNA, 64 nt, Human
ccaacuucauuuguuuacuugaaaauucccccucgagguugagagaaccucugagguggcugua

SEQ ID NO: 149784 - RNA, 64 nt, Human
aguuuggucccuggguccugagccucaggggagggagguugauagcuacuggggauuuuguaua

SEQ ID NO: 149785 - RNA, 64 nt, Human
gugguggcaugugccuauaaucccagcuacuugggagguugaagcagaauugcuugaacccagg

SEQ ID NO: 149786 - RNA, 64 nt, Human
ucuugucuucauucagugauauguagggaggaaggagguugauagcauagauggcaacugauuc

SEQ ID NO: 149787 - RNA, 64 nt, Human
uuucacuuggaauuacuaagaucggaguuuugcagagguugauuaaagcaaccauacccaagaa

SEQ ID NO: 149788 - RNA, 64 nt, Human
gggaggcugaggcaggaggaucccuugaguccaggagguugaggcugcagugagcugugauugu

SEQ ID NO: 149789 - RNA, 64 nt, Human
ucgguaugcuuucccucaaccgacccuggcucaggagguugaugccaugggaaccugaaccuga

SEQ ID NO: 149790 - RNA, 64 nt, Human
acucacuugucuucuaugaagacggacucuucaugagguugaauuucaugccaguuuguauuuu

SEQ ID NO: 149791 - RNA, 64 nt, Human
caggaugcaauucuucuucuaccaaugggcaauagagguugagagagauucagcaucuuucugg

SEQ ID NO: 149792 - RNA, 64 nt, Human
cuuuagacccugggugggcucugugcagucacuggagguugaagccaaguggggugcugggagg

SEQ ID NO: 149793 - RNA, 64 nt, Human
guuccuacucagacuguugcacucuaaaccuagggagguugaagaaugagacccuuagguuuua

SEQ ID NO: 149794 - RNA, 64 nt, Human
gccagcacguucuccagacucuagauguuuagaugagguugagcuaugauaugugcuugugugu

SEQ ID NO: 149795 - RNA, 64 nt, Human
cccaacuacuuagaggaggaucgcuugaucucaggagguugaggcugcagugaauuaugauugu

SEQ ID NO: 149796 - RNA, 64 nt, Human
uguaaauaguuuauuuauagagaacccuaccucugagguugacucaaagguuaaagaaggcuca

SEQ ID NO: 149797 - RNA, 64 nt, Human
ggagagcaucugcucugagacggauggaaggagagagguugaggaugcacuggccuguucugua

SEQ ID NO: 149798 - RNA, 64 nt, Human
gagcacagggucggggggguccccauucuuggaagagguugagaagacuccugggcuucagccu

SEQ ID NO: 149799 - RNA, 64 nt, Human
uuaauacuuguuauuuuauacugaauuagccuuggagguugacugugcaauguuauuuacuguu

SEQ ID NO: 149800 - RNA, 64 nt, Human
ggagcucuuugacucucgugggaaucccacuguugagguugaucucuucaccucagaaggucuc

SEQ ID NO: 149801 - RNA, 64 nt, Human
uggacgugagauuccuuauaaucuaauuauaccugagguugagcaagaaaugucuuccuuuaga

SEQ ID NO: 149802 - RNA, 64 nt, Human
ccucugucaguccugggggugacugggaaccagagagguugagcagaauuccuggaccugggug

SEQ ID NO: 149803 - RNA, 64 nt, Human
cucuguguguguccguaucuuguucgguguccucgagguugagcuucacuccacugcggcagag

SEQ ID NO: 149804 - RNA, 64 nt, Human
ucuucccuguccauuucugugacuaagcugugcagagguugacagcagggcaaguuacauugau

SEQ ID NO: 149805 - RNA, 64 nt, Human
ccaucauuucuaguauauuaggaaacugggaugggagguugauuugcucucuaaacuucccucu

SEQ ID NO: 149806 - RNA, 64 nt, Human
uuccuuagguuuuucuuugaaaaccugggauugagagguugaugaauggaaauucuuucacuuc

SEQ ID NO: 149807 - RNA, 64 nt, Human
agaugucuaagacaggaggaucacaagagcccaggagguugagaaugcagugagcuuguaauug

SEQ ID NO: 149808 - RNA, 64 nt, Human
ugggaggcugaggcacgagauuccuugaacccaagagguugaggcuauguugagcugagaucac

SEQ ID NO: 149809 - RNA, 64 nt, Human
acccaccuaauuaggggugcuaauaaaacaugcugagguugagauaaagacgggacauaagggg

SEQ ID NO: 149810 - RNA, 64 nt, Human; identical to SEQ ID NO: 84575

SEQ ID NO: 149811 - RNA, 64 nt, Human
aaagaauuauccagacaaaaauaucaauggugcugagguugagaaaaccugacuuaaggggcug

SEQ ID NO: 149812 - RNA, 64 nt, Human
gucuccacggcagugaggaagccagccgggaagagagguugagucacccauccccgagguggcu

SEQ ID NO: 149813 - RNA, 64 nt, Human
guggaaauguuauaucugggguacuuacaugauugagguugacuauaugagguacuguuagucu

SEQ ID NO: 149814 - RNA, 64 nt, Human
uuuuuggaucucagagauucuccucugugggaaagagguugagcuuccuggugucccucagagu

SEQ ID NO: 149815 - RNA, 64 nt, Human
uuuggaaaagacuuuauaaauguuggcuuaaaaagagguugagcaccagaaucucagaauuuac

SEQ ID NO: 149816 - RNA, 64 nt, Human
agggucaggucauggguauguggagaaugguuuggagguugaggacaaccacaggugucucauu

SEQ ID NO: 149817 - RNA, 64 nt, Human
uccaaacuagauuuguugacuucaccaguuuuaggagguugaaccuaaagaaauggaugacugg

SEQ ID NO: 149818 - RNA, 64 nt, Human
uccgaauugcccauaugcucuugggccucaggaagagguugaacaaaaacaaauucuuuuaauu

SEQ ID NO: 149819 - RNA, 64 nt, Human
gaguucaauuagugguuguaaagcucauuuuggggagguugauugcaaaggaaauuugaaagau

SEQ ID NO: 149820 - RNA, 64 nt, Human
ggggggaguuggcggggaggaaauaaggcuaacagagguugaccuaaaauuagccuuacaaagg

SEQ ID NO: 149821 - RNA, 64 nt, Human
agaugauugauaagugaggaaacugaggcuuacagagguugaagaccaacaagcuaauaaauaa

SEQ ID NO: 149822 - RNA, 64 nt, Human
ccagaaugcuuuguuuuuaccagauucaccauuagagguugauggggcaacugcagcccaugac

SEQ ID NO: 149823 - RNA, 64 nt, Human
auuuuaauauggccuuuaaaaauuccaaauauuugagguugaaaauguccuggcuuuuaaaaua

SEQ ID NO: 149824 - RNA, 64 nt, Human
cgacaugcucuggaaaucccaaaugccacagucugagguugauaucuaaaaucuaugccuucaa

SEQ ID NO: 149825 - RNA, 63 nt, Human
caagaacuagaaauaaauaaggauggugauagagagguugaagaagaaaugaagaagcaugaa

SEQ ID NO: 149826 - RNA, 64 nt, Human
cuucuuauggaccuugcaacuuuguugcuagcuugagguugauuauugugguuguauuguucac

SEQ ID NO: 149827 - RNA, 64 nt, Human
augguggcucaugucuauaaucccagcacuuugggagguugaggugggaggauugcuugaaccc

SEQ ID NO: 149828 - RNA, 64 nt, Human; identical to SEQ ID NO: 84581

SEQ ID NO: 149829 - RNA, 64 nt, Human
gugguggcuggcgccuguaaucccagcuacucaggagguugaggcagcagaauugcuugaaccc

SEQ ID NO: 149830 - RNA, 64 nt, Human
ccuguuucucucugugucucaaugccugggacuggagguugauaguuuaaguguguucuuaccg

SEQ ID NO: 149831 - RNA, 64 nt, Human
gcauggucucaucuccgcaucaggaauucaccuggagguugaaaagagaaaagaaaaagcacca

SEQ ID NO: 149832 - RNA, 64 nt, Human
gugccagggccgagggcuggucugcaugcuggaagagguugagaguuuuggaauugauuccaug

SEQ ID NO: 149833 - RNA, 64 nt, Human
ugauaucuguaucuuuucucuaaucagagauacagagguugaguauaaaauaaaccugcucaga

SEQ ID NO: 149834 - RNA, 64 nt, Human
uaauaucaaagaauugaaugaauacaacagaauugagguugaaaaauauuugauugccacauuc

SEQ ID NO: 149835 - RNA, 64 nt, Human
ccuuuaugcuuucaaacugaauuaaacccauugugagguugacacugggaggggcuagaagauu

SEQ ID NO: 149836 - RNA, 64 nt, Human
agauuuggcuauacuuaagauauuuaaagaggaugagguugagucgugaguauaauuuagaagc

SEQ ID NO: 149837 - RNA, 64 nt, Human
ugcauugaugccugaaaaauauguauaaagaaaugagguugacucuucugagcaguucaucuuu

SEQ ID NO: 149838 - RNA, 64 nt, Human
gucacuugaguggguacacugccuacagaaccuugagguugacuccugcuucaguucucagcug

SEQ ID NO: 149839 - RNA, 64 nt, Human
agagcacucauaaugcaauaugugaauaaucagugagguugauuuuucuuuuuuccuaccguuu

SEQ ID NO: 149840 - RNA, 64 nt, Human
gacuggguaggaaagaggaagcaaauagaagagagagguugaaaaacaaaauggguuacuugau

SEQ ID NO: 149841 - RNA, 64 nt, Human
ucaaaaaaaaaauuuuuuuccugagaggaagccugagguugaccagcucugggguuuguaaggc

SEQ ID NO: 149842 - RNA, 64 nt, Human
ucuagauuacauuuucauugacuuaaaugcuuuagagguugaacaggugauuccauuaccuagu

SEQ ID NO: 149843 - RNA, 64 nt, Human
gaggagggaaaaggaccagggucaagggggaccagagguugaccacuguggaauguacuggaga

SEQ ID NO: 149844 - RNA, 64 nt, Human
auauuggacaggaggacaguauuucagaaaaggagagguugacagucauccacaaggcauagcc

SEQ ID NO: 149845 - RNA, 64 nt, Human
cagugacucaaugccugugaucccaguacuuugggagguugaggcgggcagaucacuugagguc

SEQ ID NO: 149846 - RNA, 64 nt, Human; identical to SEQ ID NO: 84587

SEQ ID NO: 149847 - RNA, 64 nt, Human
aggaggcugaggcaggaggaucacuugagcccaggagguugaggcuggagugagccaugacugu

SEQ ID NO: 149848 - RNA, 64 nt, Human
gucccuccuacuaggaggcuugucauacugucuagagguugacucuuaguucuguaaauaaaga

SEQ ID NO: 149849 - RNA, 64 nt, Human
uuuauugcuuugauuucucccaaagaauaacuuggagguugacuaauaagaaaguuggcauaaa

SEQ ID NO: 149850 - RNA, 64 nt, Human
agguacaaaucuuuuuuuaaauaaguauuuuguugagguugaagaauugcuggcaauuaaaaga

SEQ ID NO: 149851 - RNA, 64 nt, Human
gaucccguucagaaaaccacuuuauugcaaugcagagguugagaggaggacuugguugauguuu

SEQ ID NO: 149852 - RNA, 64 nt, Human
aaaaacaaaaugaaauaauuugaguuguauuacagagguugacauuguucagggaugggacaaa

SEQ ID NO: 149853 - RNA, 64 nt, Human
gggauauaaauauauacacuuaaauagagaaaaagagguugauugaauugugccuuugagugaa

SEQ ID NO: 149854 - RNA, 64 nt, Human
uggaugacaacucuuuuugucacaguuagagaaugagguugacuaaugcauauuaugaauugag

SEQ ID NO: 149855 - RNA, 64 nt, Human
gugguggccggcgccuguagucccagcuacucaugagguugaggcaggagaauggcgugaaccg

SEQ ID NO: 149856 - RNA, 64 nt, Human
ugaugccgcggugagggacggcgcccacauaggcgagguugagcugcuggucccagcugaggac

SEQ ID NO: 149857 - RNA, 64 nt, Human
aaagaauuauccagcccaaaaugucauuagugcugagguugagaaauacuccucuaaaguagau

SEQ ID NO: 149858 - RNA, 64 nt, Human
gguaugagcaguaggcuuauguacaccucuuauagagguugauaggacugcuuggguccuccac

SEQ ID NO: 149859 - RNA, 64 nt, Human
gcuugaacccaggagguggagguugcaaugagccgagguugagccaucgcacuccagcggugaa

SEQ ID NO: 149860 - RNA, 64 nt, Human
aucuaccuaauaaguaccuaaauacgcugaaauggagguugaauauccuacuguguaacagguc

SEQ ID NO: 149861 - RNA, 64 nt, Human
aggaggcugagguggcagaauagcuuaugccuaggagguugaggcugcagugagcugugauuau

SEQ ID NO: 149862 - RNA, 64 nt, Human
augguggugcaugccugugauuccagcuacuugggagguugaggcaggagaaucauuugaacuc

SEQ ID NO: 149863 - RNA, 64 nt, Human
aaaaacugaaaaaaaaaaaugaaugacucacauagagguugagccaaugacuguggccucauua

SEQ ID NO: 149864 - RNA, 64 nt, Human
caucacccagauaauuuacaguucuguuaacagugagguugauaaaguauuacugauaaaaaau

SEQ ID NO: 149865 - RNA, 64 nt, Human
cuucccauguuacuaaauuaauuuauguuuuugagagguugagucucaaaguguaaacaauaaa

SEQ ID NO: 149866 - RNA, 64 nt, Human
cuagccucuuugaucauuucugugguguucaguggagguugacagcucccuaaagauuuuccug

SEQ ID NO: 149867 - RNA, 64 nt, Human
ccaaaugguguuaucaaaucucuuagauuccaaagagguugaauaauuaauguucaaaggcaag

SEQ ID NO: 149868 - RNA, 64 nt, Human
aguauaaauuuacuuucucaaauucuugccaugagagguugaugaguuaauuaaaggagaagau

SEQ ID NO: 149869 - RNA, 64 nt, Human
gcaguacauuuacugugcuuuucacaccaucucagagguugaggagcauacugaaaauugcccu

SEQ ID NO: 149870 - RNA, 64 nt, Human
gcagaagaaaacaguauuucugaaggcauuguuugagguugaucucagcacugaacgauuucaa

SEQ ID NO: 149871 - RNA, 64 nt, Human
auguuugcacuaagauuuuauuuggaaugcaagagagguugaaagaggauucaguaguacacau

SEQ ID NO: 149872 - RNA, 64 nt, Human
aauauaaauuuguuuucucaaauauuugcuaugagagguugauggauuaauuaaauaagucaau

SEQ ID NO: 149873 - RNA, 64 nt, Human
agaaggcugaggugggagguucacuugaaccugggagguugagguugcagugagcacagaucac

SEQ ID NO: 149874 - RNA, 64 nt, Human
cacuauuguuaguuagcugaaaauccuagggaaugagguugauugggagcgcuuucacgaugcg

SEQ ID NO: 149875 - RNA, 64 nt, Human
gcauuuugauaaaauuaauuuuguuguuuccuuugagguugaucguuguguuguuguuuugcug

SEQ ID NO: 149876 - RNA, 64 nt, Human
uugguggcgcaugccuauagucccagcuacuugggagguugagguaggaggaucgcuugaaccc

SEQ ID NO: 149877 - RNA, 64 nt, Human
cuaugacuuuuuaccuccuuuaaacacaucaucugagguugaguuuuaugacaguauguaguug

SEQ ID NO: 149878 - RNA, 64 nt, Human
aggcauaaaagugaaacugcuaaauauguauagagagguugacgugugauacgugggacaguuc

SEQ ID NO: 149879 - RNA, 64 nt, Human
gcauauucccuagagcucaagaaagcugguccaggagguugaaaaagcuauuuuguuguuaaau

SEQ ID NO: 149880 - RNA, 64 nt, Human
uacacacgcgcaaaacacccagagacggcacaaggagguugaacucauguuucaguucgcgaac

SEQ ID NO: 149881 - RNA, 64 nt, Human
ccuguccuuauuagacaccugcucaguguggcuggagguugaaaugccaccaggaaaaugccac

SEQ ID NO: 149882 - RNA, 64 nt, Human
uuguggugcaugcuuguggucccagcuacuuugggagguugaggcaggaggaucgcuugagccc

SEQ ID NO: 149883 - RNA, 64 nt, Human
cugcucugauaagaggaggcucacuugagcccaggagguugaggcugcagugagcagagcgugc

SEQ ID NO: 149884 - RNA, 64 nt, Human
uuguuucuuaaguugggaaacagaaugggccagggagguugagugacugaagaccaaggguugg

SEQ ID NO: 149885 - RNA, 64 nt, Human
ggaaagcugaggcagaaggaucccuugagccuaggagguugaggcugcagugagcuaugaucgc

SEQ ID NO: 149886 - RNA, 64 nt, Human
gacugugccauuuuacaguguaccaaaugagaaugagguugaaauguaugcaguaagguacuca

SEQ ID NO: 149887 - RNA, 64 nt, Human
uugauggcaugcgccuguaaucccagcuacucgggagguugaggcaggagaaucgcuuaaaccc

SEQ ID NO: 149888 - RNA, 64 nt, Human
gugcacagaaagugcugcgaguggugcauggugagagguugaugcagguacuuagcccuugggg

SEQ ID NO: 149889 - RNA, 64 nt, Human
acagaaauagacuuaauaaagguuuaaagcugaagagguugaagcuaaaaggaaaagguuguug

SEQ ID NO: 149890 - RNA, 64 nt, Human
augcgcuacguaacucuucuguuguagcaguucugagguugaacugagcucuugucauuuucca

SEQ ID NO: 149891 - RNA, 64 nt, Human
gggaagacagagugaugcaccuucccgcugcugugagguugauuaaacuugagcugugacgggu

SEQ ID NO: 149892 - RNA, 64 nt, Human; identical to SEQ ID NO: 149823

SEQ ID NO: 149893 - RNA, 64 nt, Human
ugacccuuugucuucuaaugaaauaaagauugaagagguugagucaggacugagcuggugaaga

SEQ ID NO: 149894 - RNA, 64 nt, Human
guguggcaaagaacacccgugcuggggucgggaugagguugaagggucuuggucaauguacgua

SEQ ID NO: 149895 - RNA, 64 nt, Human; identical to SEQ ID NO: 149823

SEQ ID NO: 149896 - RNA, 64 nt, Human
gcaagaagugcauccuaauccuuugauuauuaaugagguugaauauuugugugcuaucgguagc

SEQ ID NO: 149897 - RNA, 64 nt, Human
ccuucguggcaucucugugcugugugcuggggaggagguugauguaauggugacucuuuucuga

SEQ ID NO: 149898 - RNA, 64 nt, Human
augguggcgcaugccuguagucgcagcuacucgcgagguugaggcaggagaauugcuugaaccc

SEQ ID NO: 149899 - RNA, 64 nt, Human
augguggugcacaucgguaguccuggcuacuagagagguugaggugggaggaucacuugaaccu

SEQ ID NO: 149900 - RNA, 64 nt, Human
aaaagcaugucuuugggguugguuccuagaggcagagguugaagauggaagagggagcucugga

SEQ ID NO: 149901 - RNA, 64 nt, Human
gggacagcuuguggggauggcuaugggggaaggggagguugagaaaggaaguucucgacaccag

SEQ ID NO: 149902 - RNA, 64 nt, Human
gacacuguuaugcccuguccuaaaugugaagacagagguugaauuuuuuaaaaaauaucuuuaa

SEQ ID NO: 149903 - RNA, 64 nt, Human
uauugccugaccugaugaacuguuaauaucuggugagguugaguuaucaugcuacuaauauuuu

SEQ ID NO: 149904 - RNA, 64 nt, Human
cccuggagaggccaagugccuucuaggaaguuaggagguugaggcacagccugugcagagaggg

SEQ ID NO: 149905 - RNA, 64 nt, Human
uucuacuuuggagaacagguuaccuuuugaaaaugagguugaguuucuuccuuucugaugcauu

SEQ ID NO: 149906 - RNA, 64 nt, Human
aaucacucagaggccaaaucuguaaaaucaaaaugagguugaagacaauuagugaaaguaaugu

SEQ ID NO: 149907 - RNA, 64 nt, Human
auuacuugagcccaggaggauuacuucaaccugggagguugaggcugcagugagcuguguuucg

SEQ ID NO: 149908 - RNA, 64 nt, Human
gugguagcucacaccuauaaucccagcacuuugggagguugagguagguagauugcuugagccc

SEQ ID NO: 149909 - RNA, 64 nt, Human
augguggcacacaccuguagucccagcuacucaggagguugaggugggaagauugcuugagccc

SEQ ID NO: 149910 - RNA, 64 nt, Human
auaguggcucaugccuguacucucagcuacuugggagguugaggugggaggauugcuugagccc

SEQ ID NO: 149911 - RNA, 64 nt, Human
ggcucaaggggugggaugcggcuccugcaggagagagguugagaccuggucaaauuuauuuccu

SEQ ID NO: 149912 - RNA, 64 nt, Human
caccacacuggcacaggcgggagccuucuacgcagagguugaggcccacaacacggugaccucu

SEQ ID NO: 149913 - RNA, 64 nt, Human
uugagaaaaugaauuuuacuauguacugaauuuagagguugagaauaauaggaucuguguuauu

SEQ ID NO: 149914 - RNA, 64 nt, Human
cagugaccucuacugacuucucugauaccagcuggagguugagcucuucuuaaaguauucuucu

SEQ ID NO: 149915 - RNA, 64 nt, Human; identical to SEQ ID NO: 84591

SEQ ID NO: 149916 - RNA, 64 nt, Human
cuauuuuuuauaaaagagccuauucaauagcucagagguugaacucugguuaaacaagauaaua

SEQ ID NO: 149917 - RNA, 64 nt, Human
ugaguuucugauucuccgggagccguucaauggugagguugaugggaagacuuccuucccaaag

SEQ ID NO: 149918 - RNA, 64 nt, Human
gggacguagccuuuucuugcucuggaagcccagggagguugagcagugagagagggaagggacu

SEQ ID NO: 149919 - RNA, 64 nt, Human
aguuuccauucacccaucugaaagauuuuaagaugagguugaauucuaguuuagaguuagcaga

SEQ ID NO: 149920 - RNA, 64 nt, Human
guaucucugcaagcagagauuucucuuugguuuugagguugaagugucuuuggcccauuuguaa

SEQ ID NO: 149921 - RNA, 64 nt, Human
aaagaauuuuccaacccaaaauaucauuaguccugagguugagaaacccuguccuagccuaacu

SEQ ID NO: 149922 - RNA, 64 nt, Human
ucagcaggcuccgugcagcccuugggaacagugagagguugaaggucauaacgagagugggaac

SEQ ID NO: 149923 - RNA, 64 nt, Human
aaagaugcuuaggcaccuaagcaaauaauacuuagagguugaauuuggucuacaggcuagcagu

SEQ ID NO: 149924 - RNA, 64 nt, Human
cugauuagggaaccuguauaaggguauugagugugagguugaggugggacauuugcugagcaag

SEQ ID NO: 149925 - RNA, 64 nt, Human
uguuagaucaaauaucucuaauugaagaacaugugagguugaaagagcaccagccagggcaaca

SEQ ID NO: 149926 - RNA, 64 nt, Human
gguuuagaguuuuuaaccugaucuguagagcagagagguugaaagcacuuaacucuuguuuagu

SEQ ID NO: 149927 - RNA, 64 nt, Human
gaagcaguggagggguuggccucccuucuacugggagguugacucucucugggagacucuuggu

SEQ ID NO: 149928 - RNA, 64 nt, Human
gcaauggggaugggguuggggagacguuuacaaagagguugaucauuuaauaaccucucaguuu

SEQ ID NO: 149929 - RNA, 64 nt, Human
gggaggcugaguugggaggaucacuugagccugggagguugaggcugcagugaacugagaucac

SEQ ID NO: 149930 - RNA, 64 nt, Human
accguggcacacgcucauaguucuagcugcuugggagguugaggagggaggauggcuugaacac

SEQ ID NO: 149931 - RNA, 64 nt, Human
cagaaaguagaauagugguugccaaugucucagggagguugaaauaggagaugaccacuaauug

SEQ ID NO: 149932 - RNA, 64 nt, Human
cagaaaguagaauagugguugccaaugucugagggagguugaaauaggagaugaccucuaacug

SEQ ID NO: 149933 - RNA, 64 nt, Human
cuugugaagccuugagggcuggcagaaggguuaggagguugaacucuagauucccuuccugucu

SEQ ID NO: 149934 - RNA, 64 nt, Human
agaaggcugaggugggaggauugcuuguuccccggagguugaagcuacagugagccuugauugu

SEQ ID NO: 149935 - RNA, 64 nt, Human
gaacacucuguaggcccaugggucccuuacuagagagguugagugaauuugccuucaguuaaca

SEQ ID NO: 149936 - RNA, 64 nt, Human
ucacaagaaaauuuucaaguuuugaagggaauuugagguugaucugguuuucaagauguaguua

SEQ ID NO: 149937 - RNA, 64 nt, Human
auaguggugcacgccugcagucccagcuacucaggagguugaggcagaagaaucgcuugaaccc

SEQ ID NO: 149938 - RNA, 64 nt, Human
uugguaccugguuuuguguuguguauauauacaugagguugaacagugaaaggaaaguucagua

SEQ ID NO: 149939 - RNA, 64 nt, Human
ggcugggaggcauugaagggauggggagggaagugagguugauuaauggguacgaaaauauagu

SEQ ID NO: 149940 - RNA, 64 nt, Human
ugguguugcaugucuguagucacagcuacucagggagguugaggcagcaggauugcuggagccc

SEQ ID NO: 149941 - RNA, 64 nt, Human
ccccguuugcccuacgccccuuuugguacaccuagagguugauuuccuuuuucaucgaugguac

SEQ ID NO: 149942 - RNA, 64 nt, Human
gauaugcuuaguaaugcuacgugugauuuuucuggagguugauaacuuugcuugcaguagauuu

SEQ ID NO: 149943 - RNA, 64 nt, Human
auagugucacgcaccugugaucccagcuacuuaggagguugaggcugggaggaucacuugagcc

SEQ ID NO: 149944 - RNA, 64 nt, Human
ucauugcauaagauacagauguaaauugcauggagagguugauaugcaccuguacaguaauuca

SEQ ID NO: 149945 - RNA, 64 nt, Human
ggggggcugagguggcaggaucgcuugagccugggagguugagacugcagugagccaagauugc

SEQ ID NO: 149946 - RNA, 64 nt, Human
caccugggaacacaguucugggcaaagaggauccgagguugagaggaaggagggucccggugua

SEQ ID NO: 149947 - RNA, 64 nt, Human
ccagcugcucuugucagcccucuggccucuggaugagguugaguucuccacaacagcucccaag

SEQ ID NO: 149948 - RNA, 64 nt, Human
aaagggggugauaaaugacaaucaaaucgacauggagguugagcaccucuguacucagcccucu

SEQ ID NO: 149949 - RNA, 64 nt, Human
cacaggcaggcugggguccucgcuggccuugccagagguugagccgccccaggguaugaggaga

SEQ ID NO: 149950 - RNA, 64 nt, Human; identical to SEQ ID NO: 84595

SEQ ID NO: 149951 - RNA, 64 nt, Human
auuucuuaaaagacuagauucuauggaucaaacagagguugaugcaaaaacaccacuguuaagg

SEQ ID NO: 149952 - RNA, 64 nt, Human
guuaaaucacuuuugcuuguguuuauuacugcuugagguugagccuuuugaguauuuaaaaaau

SEQ ID NO: 149953 - RNA, 64 nt, Human
cuuguaaggcuguggcagaagugcuuuagcccaggagguugaggcugcagugagccauguccac

SEQ ID NO: 149954 - RNA, 64 nt, Human
ccucauuuuuuaguugaggaaacugaggcucauagagguugaaagauuuauucaagaucccaaa

SEQ ID NO: 149955 - RNA, 64 nt, Human
augguggugugugccuguagucccagcuacuauggagguugaggugggaggaucgcuugagccc

SEQ ID NO: 149956 - RNA, 64 nt, Human
acaguggcucaugucugcaaucccagcgauuugggagguugagcugguaggaucacaauaggcc

SEQ ID NO: 149957 - RNA, 64 nt, Human
gugguggcacacaccuguagucccagcuacucaggagguugagguaggagaauugcuugaaccu

SEQ ID NO: 149958 - RNA, 64 nt, Human
cuuuuuuuacauuuuaaucuuuuccauuaauuaagagguugaaaagaagugcaguguaagaaaa

SEQ ID NO: 149959 - RNA, 64 nt, Human
aaaagcugcuucacuugggcaauggugaaggugggagguugauuggggcaaauccaggcacucc

SEQ ID NO: 149960 - RNA, 64 nt, Human
augguggugcaugccuguauucccagcuacucaggagguugaggugggaggaucacuugagccc

SEQ ID NO: 149961 - RNA, 64 nt, Human
caggaggcugaggcuagaggauccuugagcccaggagguugaggcugcagugaggugugauugc

SEQ ID NO: 149962 - RNA, 64 nt, Human
cugaggcaggagaauuuuuugagcccaggaugcagagguugaagugagccaagaucgugccacu

SEQ ID NO: 149963 - RNA, 64 nt, Human
ucuuagggggccccaagaggagaggagaagugcugagguugauguuacgacugcaagaauucuu

SEQ ID NO: 149964 - RNA, 64 nt, Human
agaacuuggggacucgguucugugagggggaaaagagguugaaaagaggguuuccucuuauuuc

SEQ ID NO: 149965 - RNA, 64 nt, Human
cuguuucuuuaaagcacuuuguacuguuauucaggagguugauaaucuccuugacccaugucuu

SEQ ID NO: 149966 - RNA, 64 nt, Human
aaauagcuggaguuuuucuuauucagguuuaauggagguugaauugauuuuuaaacacauauaa

SEQ ID NO: 149967 - RNA, 64 nt, Human
uguaaagaccuccccaggugaugauaugcaguccgagguugagacugcccuguccugcaagguc

SEQ ID NO: 149968 - RNA, 64 nt, Human
uguuaauugauuuggggauguuugccccgaaugagagguugaggaaaagacuguggguggggag

SEQ ID NO: 149969 - RNA, 64 nt, Human
cacccgaauuuucccaccccugcuucuccccgaggagguugagcucuugagcaaguugggacuu

SEQ ID NO: 149970 - RNA, 64 nt, Human
ucucaguccuaacccuggggccagagauugguccgagguugagaauuccuuccuccucauccuu

SEQ ID NO: 149971 - RNA, 64 nt, Human
guucuuuucuacccugcgggcccgcacguuuuaugagguugauaucggugcuauguguuugguu

SEQ ID NO: 149972 - RNA, 64 nt, Human
gugguggcggacgccuguauucacagcuacucgggagguugaggcaggagaauggggugaaccc

SEQ ID NO: 149973 - RNA, 64 nt, Human
cugugcaauggcacagccgcagagcuugguuugggagguugaagugcucuggggagaauucgua

SEQ ID NO: 149974 - RNA, 64 nt, Human
ggccgacguggcauuugcugaccgaaugcucauagagguugacccccacagggucacgcaggac

SEQ ID NO: 149975 - RNA, 64 nt, Human
acucacaagaaacuuucuggguuugugacauacagagguugaauugaguauauauuugaaaagg

SEQ ID NO: 149976 - RNA, 64 nt, Human
guaauuucuugugccucuaauagcccaagaaugggagguugaucagaucugacaugauuccuuc

SEQ ID NO: 149977 - RNA, 64 nt, Human
gggaggcugagccaggaggaucacuugagcccgggagguugaggcugcaguggggggucauaau

SEQ ID NO: 149978 - RNA, 64 nt, Human
aguucuuggugcucuguguucccagaggcaggcggagguugaagaaaggaaccugggaugaggg

SEQ ID NO: 149979 - RNA, 64 nt, Human
agaaucggccagugggccuucgggagggcggggggagguugauuuucaugauucaugagcuggg

SEQ ID NO: 149980 - RNA, 64 nt, Human
gaggggauugagcagaagcucggguaugagcccugagguugacugccgguuauuuuucuguccu

SEQ ID NO: 149981 - RNA, 64 nt, Human
cugaggcaggagaaucgcuugaaccugggaaguggagguugagugagccgggaccgugccauug

SEQ ID NO: 149982 - RNA, 64 nt, Human
agcacuuugggaggcugaggcaggugguucacuggagguugaguucgagaccagccuggccaca

SEQ ID NO: 149983 - RNA, 64 nt, Human
auagauguagucuugacgaauauugcuuacuggugagguugaggaauaucacacucgucuuucc

SEQ ID NO: 149984 - RNA, 64 nt, Human
agcccucuuuccccacugggcguccuaccccagugagguugaaggcaccaauuccaagaauccc

SEQ ID NO: 149985 - RNA, 64 nt, Human; identical to SEQ ID NO: 84599

SEQ ID NO: 149986 - RNA, 64 nt, Human
aaccuacuaaaaagagagaugaaaaaaaaucagcgagguugauguagauaauaauuucuauggg

SEQ ID NO: 149987 - RNA, 64 nt, Human
uuacagcaguauuugauauaccuaacuuguuauggagguugauugauaucugaucccugcaaaa

SEQ ID NO: 149988 - RNA, 64 nt, Human
gggaggcuguggugggaggauugcuugaguccaggagguugaggcugcagucagcucagauugc

SEQ ID NO: 149989 - RNA, 64 nt, Human
cgaagaguuagugcccccaaacgucacuguugcugagguugaaaauaaucaugcagucauuccu

SEQ ID NO: 149990 - RNA, 64 nt, Human
augguggcccaugccuguaguacgagcuacucaggagguugaggcaggggaaucacuagaaccc

SEQ ID NO: 149991 - RNA, 64 nt, Human
cugaggcaggagaauugcuugaacccgggaggcagagguugaagugagcugagaucgcgccauu

SEQ ID NO: 149992 - RNA, 64 nt, Human
aaagaaaauggaguucugagagcuaggaaacugggagguugagccaggagcaggggaacuuggg

SEQ ID NO: 149993 - RNA, 64 nt, Human
gaggcugagaggugggaggaugccuugagcuugagagguugaagcugcagugagcugugaucgc

SEQ ID NO: 149994 - RNA, 64 nt, Human
ccugggaaagaagugggaucuagggcccugggaggagguugagccuggggaaggaaaaagcagg

SEQ ID NO: 149995 - RNA, 64 nt, Human
gugguggugcaccgccuguggucccagcuccucagagguugaguagaggcugaggugagcggag

SEQ ID NO: 149996 - RNA, 64 nt, Human
gggugggugggcgggaggacuuugcuauggauuugagguugaccuuaugcgcguagguuuuggu

SEQ ID NO: 149997 - RNA, 64 nt, Human
ucaggugaucacaggugucuuguggccuccaugggagguugaaaaccagagaaggugaaggggg

SEQ ID NO: 149998 - RNA, 64 nt, Human
cgccggggaagauggggcugauuucccaccuagagagguugauggcagaaggaaaauggggagg

SEQ ID NO: 149999 - RNA, 64 nt, Human
aggaggcuugggugggaggauugccugagaccaggagguugaggcugcagugagccgugauuuc

SEQ ID NO: 150000 - RNA, 64 nt, Human
cucugcaggaugggugaaaccacaugggguuuuggagguugaauaggaguucuccuggagcaac

SEQ ID NO: 150001 - RNA, 64 nt, Human
acaguggcucacgccuguaaucccagcacuuugggagguugaggugggcagaucgccugagguc

SEQ ID NO: 150002 - RNA, 64 nt, Human
acugggacuucggcuagggaggaagguagaguaagagguugaagauaacagagugcaaaguuuc

SEQ ID NO: 150003 - RNA, 64 nt, Human
guuguugcggagacacugcagacuccacugugccgagguugaacucuuuuuuguugcucaaguu

SEQ ID NO: 150004 - RNA, 64 nt, Human
ccacaucuuuggagccucgggauaaaaugacagugagguugaaaagugaaaacccuagaacuug

SEQ ID NO: 150005 - RNA, 64 nt, Human
cauggauaucaguucugccucacauuucccacuugagguugaggcguacuggagacaacaccuc

SEQ ID NO: 150006 - RNA, 64 nt, Human
cugaagcaggagaggugcuggaaccugggaggcggagguugaagugagccgagauugcgcuauu

SEQ ID NO: 150007 - RNA, 64 nt, Human
cuggucuaagauaagagauaaaacaucagguggugagguugagguuuggggcuugguagcaguu

SEQ ID NO: 150008 - RNA, 64 nt, Human
gaauuugguguggaaagcauaggaggccccuuccgagguugacaccguguccuccgcgguguuu

SEQ ID NO: 150009 - RNA, 64 nt, Human
gucuuucugaaauguguauuugagauuagaaauugagguugagaggaacucaggagauuuuuuu

SEQ ID NO: 150010 - RNA, 64 nt, Human
aaacucaccuucuauuuacucugugacuuuaugagagguugagggaaaaguggaagcuguacuu

SEQ ID NO: 150011 - RNA, 64 nt, Human
aguuuaccaucugaaaaagcuggauuuucuuuaagagguugauuauaaaguuuucuaaauuuau

SEQ ID NO: 150012 - RNA, 64 nt, Human
ccaaaagaauccuaggcaguggcucauuguaugugagguugaaccacgugaaauugccaauauu

SEQ ID NO: 150013 - RNA, 64 nt, Human
ucauucucucuuuaguuuaacuaugcaaagagaggagguugagaguguucuggcagcuggagcu

SEQ ID NO: 150014 - RNA, 64 nt, Human
aaagaguauggauaacuauauuuucuggauucuggagguugauaaccauaugcacuuaacauua

SEQ ID NO: 150015 - RNA, 64 nt, Human
gaaacgcugaggugggaggaucagaugagcuugggagguugaggcugcagugagccuuggucau

SEQ ID NO: 150016 - RNA, 64 nt, Human
uucaaacgucaccuguucccaccccagacccaaagagguugauucaguugccuucugcaacgca

SEQ ID NO: 150017 - RNA, 64 nt, Human
auccaggugugauuuauguguuaaccucagucacgagguugaucagcuaauugugggaccaaaa

SEQ ID NO: 150018 - RNA, 64 nt, Human
ggaaccugaagcccugagaaggagagcuuggaaggagguugagcucuucacugugucuuuccau

SEQ ID NO: 150019 - RNA, 64 nt, Human
gcccagccuuaccccucauucucacagcacagaugagguugagaccaugcagucaaugcauugc

SEQ ID NO: 150020 - RNA, 64 nt, Human; identical to SEQ ID NO: 84603

SEQ ID NO: 150021 - RNA, 64 nt, Human
ccuagcugaacuaugguuuggugucugaucuugagagguugauguaaccuuuuaaaggccucag

SEQ ID NO: 150022 - RNA, 64 nt, Human
ucagucggcauuugcgucaucuuuaguagauccugagguugaccagcagcccauggggccugaa

SEQ ID NO: 150023 - RNA, 64 nt, Human
aagccccaggagaacaggcuggacagaggagaaggagguugacuguugcacccacacugaaaga

SEQ ID NO: 150024 - RNA, 64 nt, Human
gagugaagggacauggcugagcugggcaugugcugagguugacuuagggaacaagcccugggau

SEQ ID NO: 150025 - RNA, 64 nt, Human
ggugacagaaaagcaagggacaucccgucccugggagguugaguggaaucugcaguccagugcc

SEQ ID NO: 150026 - RNA, 64 nt, Human
cacacacacacacauuuaaaugauauaaaaagaagagguugaaagauuauuaaauaacuuauca

SEQ ID NO: 150027 - RNA, 64 nt, Human
uauaaucuaaaucaagauuaccaaaauaauuucagagguugaugugguaaccuuuaagcgaagu

SEQ ID NO: 150028 - RNA, 64 nt, Human
auuuggauucuguuucaugcaaauuugcaucccggagguugaaguuggaguuugagguuggaaa

SEQ ID NO: 150029 - RNA, 64 nt, Human
ggggaguggggaaggcuugggcauggccccguuggagguugauuugcuguuuuguuucuugucu

SEQ ID NO: 150030 - RNA, 64 nt, Human
acagugcaugguggccucugguggguuucaaguugagguugaucuugaucuacaauuguuggga

SEQ ID NO: 150031 - RNA, 64 nt, Human
ugcccuccuguacuauuuacucaguauuuuucuugagguugaucugaggucuaacauuguuauc

SEQ ID NO: 150032 - RNA, 64 nt, Human
ucucccuuagcccaaaagaucugaacuggaagcagagguugagauucugccucccaggagaggg

SEQ ID NO: 150033 - RNA, 64 nt, Human
uuucaagauaggugagauuuaaaauaaauaggaugagguugaagaaaaguauauuggagcgcag

SEQ ID NO: 150034 - RNA, 64 nt, Human
ugcacacacacacauuuaaaggauauaaaaagaagagguugaaagauuauuaaauaacuuauca

SEQ ID NO: 150035 - RNA, 64 nt, Human
caggagcugugguaggaggauggcuugagcucaagagguugaggcugcagugagcccugauugu

SEQ ID NO: 150036 - RNA, 64 nt, Human
agggaacaaaugguuggcaugcagcccccucaggcgccccgagaccucaucuuccggugagugc

SEQ ID NO: 150037 - RNA, 64 nt, Human
ccaccuccaccgggcugcaguucccggcgagcggcgccccgacugcggggccacccgccugcgc

SEQ ID NO: 150038 - RNA, 64 nt, Human
ggggcuccugccugcccaagcggcugagaaccagcgccccgaugccugaggcugggagccugag

SEQ ID NO: 150039 - RNA, 64 nt, Human
cggcccgcuccgcccccagcaccgccccgggggccgccccgaggcccuuccggcgcgcacccgg

SEQ ID NO: 150040 - RNA, 64 nt, Human
guccuaaagaguuauucaaaugaaggugguucgacgccccgaaccucaccugaccucaacuaac

SEQ ID NO: 150041 - RNA, 64 nt, Human
ucuggcucuuucucucuugucccuccauaugauccgccccgacgccgucuucucuaauuaaaau

SEQ ID NO: 150042 - RNA, 64 nt, Human
cccagagcugggccacacagugggugcugggccucgccccgaagcuucuggugcagcagccucu

SEQ ID NO: 150043 - RNA, 64 nt, Human
uagaguguuaauagcagcaguccucccccuaccccgccccgagaccccaccccgagaccccacc

SEQ ID NO: 150044 - RNA, 64 nt, Human
cgcaccccaguaugacugccgagcacugaggggucgccccgagagaagagccaggguccuucac

SEQ ID NO: 150045 - RNA, 64 nt, Human
gauaauuuucaacuauggggcuucaguacugcagcgccccgagccaggcucugugcuucugccu

SEQ ID NO: 150046 - RNA, 64 nt, Human
agccagggcggagagccauacccuggccccagcgcgccccgacacacaugcuuuucuccaugac

SEQ ID NO: 150047 - RNA, 64 nt, Human
uuuggugauguuggaggaguaccccccagcccaccgccccgauuccuuuuugcuucugguuugg

SEQ ID NO: 150048 - RNA, 64 nt, Human
ggacgcggacggacacacucauuacacacucacacgccccgacugcacccgguguccaucuaua

SEQ ID NO: 150049 - RNA, 64 nt, Human
cggggccuuugcggucccgcccggcugagacgcucgccccgacgcauggacccgagaggcgacg

SEQ ID NO: 150050 - RNA, 64 nt, Human
gauccgaggggcugacacacacucgcagacgagccgccccgaggcgaaaccucgcgguuccucu

SEQ ID NO: 150051 - RNA, 64 nt, Human
gccuacccacuguggccccggugcucugcccccacgccccgaccaucuggucuugguagauguc

SEQ ID NO: 150052 - RNA, 64 nt, Human
caagcuuucgacuagcgccucuccccggggcccgcgccccgagccccacgcgcaagacagccca

SEQ ID NO: 150053 - RNA, 64 nt, Human
aaugggauucugaauauuugcaauguggaguuuccgccccgaucucacgucagugagggucucc

SEQ ID NO: 150054 - RNA, 64 nt, Human
cgggccgccccccgcgcucggcccccgggggccccgccccgaagcagccuccugaaaccaaaac

SEQ ID NO: 150055 - RNA, 64 nt, Human
gcacaucacagacauggugugcccugccuguggccgccccgaccucaccgaugacacacaguug

SEQ ID NO: 150056 - RNA, 64 nt, Human
ucaugccagaguacaaaacacauaguucuuuccccgccccgaaugugacaaugguuuucauagu

SEQ ID NO: 150057 - RNA, 64 nt, Human
caaacaaaugaauccagcguggaggaaggcgcgccgccccgagcuggagggccuggcucccacc

SEQ ID NO: 150058 - RNA, 64 nt, Human
acagagaaccguucguguugggcuucucucugaacgccccgaaccuugcaucaaggcuccuugg

SEQ ID NO: 150059 - RNA, 64 nt, Human
cugagauugucuuuguuggucuuuguuuaauaaacgccccgaccuuccucaugauugcucacag

SEQ ID NO: 150060 - RNA, 64 nt, Human
cgcucugagagggaacgggggggguguccaggcgcgccccgagugcuagugccuucuuuuggga

SEQ ID NO: 150061 - RNA, 55 nt, Human
ccaagcccgcccggggcugagcgcacgccccgagguccgagaccgccacgcacag

SEQ ID NO: 150062 - RNA, 64 nt, Human
ggggccugugucgggcguggggccugcaggugggcgccccgaccacgacuuggcuuccuugugc

SEQ ID NO: 150063 - RNA, 64 nt, Human
caacgaacaaacguccccucccucccucccucuccgccccgagcgcccuucuuugagccagacg

SEQ ID NO: 150064 - RNA, 64 nt, Human
ccauucacuucacucaguuccugucccauuuaaccgccccgauccuugaucuuccauuaccuuc

SEQ ID NO: 150065 - RNA, 64 nt, Human
uccuggcguccccauccuccaaagggccugggcccgccccgagggggcagcgagaggagcuucc

SEQ ID NO: 150066 - RNA, 64 nt, Human
gaccccacgcagcccugaucgcaggaggccuggccgccccgacccccuccacggggcuggccua

SEQ ID NO: 150067 - RNA, 64 nt, Human
uucaggaggaagccaucgcaggggaccugggagacgccccgagguguuugugcuucacccccag

SEQ ID NO: 150068 - RNA, 64 nt, Human
gcgcuggccagccccgaggagccgcugccuucaccgccccgacgccuuuuauccuuuuuuaaac

SEQ ID NO: 150069 - RNA, 64 nt, Human
cacccacccucgcccccacuggccaccccucccucgccccgacugccccgccccacccucaccc

SEQ ID NO: 150070 - RNA, 64 nt, Human
gcggcgcgcaggcuccucggaacguccggcucugcgccccgacgcggcuccuggauccgcuccu

SEQ ID NO: 150071 - RNA, 64 nt, Human
cuaaaggcugcccuccacacccgcgccccgcgcgcgccccgaaaggucaccucacucagcacca

SEQ ID NO: 150072 - RNA, 64 nt, Human; identical to SEQ ID NO: 150036

SEQ ID NO: 150073 - RNA, 64 nt, Human; identical to SEQ ID NO: 150037

SEQ ID NO: 150074 - RNA, 64 nt, Human; identical to SEQ ID NO: 150038

SEQ ID NO: 150075 - RNA, 64 nt, Human; identical to SEQ ID NO: 150039

SEQ ID NO: 150076 - RNA, 64 nt, Human; identical to SEQ ID NO: 150040

SEQ ID NO: 150077 - RNA, 64 nt, Human; identical to SEQ ID NO: 150041

SEQ ID NO: 150078 - RNA, 64 nt, Human; identical to SEQ ID NO: 150042

SEQ ID NO: 150079 - RNA, 64 nt, Human; identical to SEQ ID NO: 150043

SEQ ID NO: 150080 - RNA, 64 nt, Human; identical to SEQ ID NO: 150044

SEQ ID NO: 150081 - RNA, 64 nt, Human; identical to SEQ ID NO: 150045

SEQ ID NO: 150082 - RNA, 64 nt, Human; identical to SEQ ID NO: 150046

SEQ ID NO: 150083 - RNA, 64 nt, Human; identical to SEQ ID NO: 150047

SEQ ID NO: 150084 - RNA, 64 nt, Human; identical to SEQ ID NO: 150048

SEQ ID NO: 150085 - RNA, 64 nt, Human; identical to SEQ ID NO: 150049

SEQ ID NO: 150086 - RNA, 64 nt, Human; identical to SEQ ID NO: 150050

SEQ ID NO: 150087 - RNA, 64 nt, Human; identical to SEQ ID NO: 150051

SEQ ID NO: 150088 - RNA, 64 nt, Human; identical to SEQ ID NO: 150052

SEQ ID NO: 150089 - RNA, 64 nt, Human; identical to SEQ ID NO: 150053

SEQ ID NO: 150090 - RNA, 64 nt, Human; identical to SEQ ID NO: 150054

SEQ ID NO: 150091 - RNA, 64 nt, Human; identical to SEQ ID NO: 150055

SEQ ID NO: 150092 - RNA, 64 nt, Human; identical to SEQ ID NO: 150056

SEQ ID NO: 150093 - RNA, 64 nt, Human; identical to SEQ ID NO: 150057

SEQ ID NO: 150094 - RNA, 64 nt, Human; identical to SEQ ID NO: 150058

SEQ ID NO: 150095 - RNA, 64 nt, Human; identical to SEQ ID NO: 150059

SEQ ID NO: 150096 - RNA, 64 nt, Human; identical to SEQ ID NO: 150060

SEQ ID NO: 150097 - RNA, 55 nt, Human; identical to SEQ ID NO: 150061

SEQ ID NO: 150098 - RNA, 64 nt, Human; identical to SEQ ID NO: 150062

SEQ ID NO: 150099 - RNA, 64 nt, Human; identical to SEQ ID NO: 150063

SEQ ID NO: 150100 - RNA, 64 nt, Human; identical to SEQ ID NO: 150064

SEQ ID NO: 150101 - RNA, 64 nt, Human; identical to SEQ ID NO: 150065

SEQ ID NO: 150102 - RNA, 64 nt, Human; identical to SEQ ID NO: 150066

SEQ ID NO: 150103 - RNA, 64 nt, Human; identical to SEQ ID NO: 150067

SEQ ID NO: 150104 - RNA, 64 nt, Human; identical to SEQ ID NO: 150068

SEQ ID NO: 150105 - RNA, 64 nt, Human; identical to SEQ ID NO: 150069

SEQ ID NO: 150106 - RNA, 64 nt, Human; identical to SEQ ID NO: 150070

SEQ ID NO: 150107 - RNA, 64 nt, Human; identical to SEQ ID NO: 150071

SEQ ID NO: 150108 - RNA, 64 nt, Human
ccucagcugcagggaggcagaaggcaaggcaggccccacggacacacuugggcugcucugaaau

SEQ ID NO: 150109 - RNA, 64 nt, Human
ccagccugccuuuuagcacuuggauacacacagacccacggagcucucuguguuuggccucuca

SEQ ID NO: 150110 - RNA, 64 nt, Human
ucugugcugguuguuagaacucaucuccagguagcccacggauacgugguuggcacagacacaa

SEQ ID NO: 150111 - RNA, 64 nt, Human
auaccucgagccacaaccgaccagaugccagggacccacggagcccuuaugacaucagcaauac

SEQ ID NO: 150112 - RNA, 64 nt, Human
cccuucacucccucccuggcucugccagucgguucccacggagccauuuuuagcucugaucagc

SEQ ID NO: 150113 - RNA, 64 nt, Human
gcugggcuccgcguccuaggaccgccggcgccuccccacggacgccaggcaggccaggccgcuc

SEQ ID NO: 150114 - RNA, 64 nt, Human
caaucccugaccguuccaggcacugagcugggcacccacggaaggacaugcuguccagacugug

SEQ ID NO: 150115 - RNA, 64 nt, Human
ugauuggcagaaauuaaucagcucccaaugggagcccacggaacuaaguagggucccaagaaaa

SEQ ID NO: 150116 - RNA, 64 nt, Human
ccuucugauugucuuagacacugugguugcaaaacccacggaaagccucauuuguguggaaagu

SEQ ID NO: 150117 - RNA, 58 nt, Human
uggacccuuucuuuaacugagcucaugccccacggagacuuagcagguuccaggagug

SEQ ID NO: 150118 - RNA, 64 nt, Human
cuggguggcacaccacccgaggggggccccgggacccacggagcccucccuaugucugcaaagu

SEQ ID NO: 150119 - RNA, 64 nt, Human
cugccccagagcggagcucgaagcacccagguugcccacggaaaauccaauaaaaagacaccag

SEQ ID NO: 150120 - RNA, 64 nt, Human
uaauauauguaaagcacuuuaacacagcaccaggcccacggaaaguggcuaauguuagcuacua

SEQ ID NO: 150121 - RNA, 64 nt, Human
cuccccagcauuccagccccucuggucgcuccugcccacggagucguggggugugcugggagcu

SEQ ID NO: 150122 - RNA, 64 nt, Human
ucauucugguucccugcugcgcugcuuggugugacccacggaggauccacucccaggaugacgu

SEQ ID NO: 150123 - RNA, 64 nt, Human
cagugugacaguggcagccucuagcccucagcuucccacggaaucagauggauccuccacgauu

SEQ ID NO: 150124 - RNA, 64 nt, Human
gaccagcaucaucugagaggcuggagcagggucacccacggacagagaccaagagagguccugc

SEQ ID NO: 150125 - RNA, 64 nt, Human
caggaggagaaagggugucugcugccuggugaggcccacggacuucugagagccaggaauccug

SEQ ID NO: 150126 - RNA, 64 nt, Human
aaauccuucaauauuuaaaauguuucuuacaauacccacggagcacuuuuaugguuccagccga

SEQ ID NO: 150127 - RNA, 64 nt, Human
gcgcuggcugcagcucacguccagccaugggaaucccacggaccucucgcgugucaacagacga

SEQ ID NO: 150128 - RNA, 64 nt, Human
gugagcugaugccaccccagcaucugucuuuucacccacggagggcacagaaccaccagcaaag

SEQ ID NO: 150129 - RNA, 64 nt, Human
agcuuuacagggcaguguuucagauggcccugagcccacggaaaaggccagguagaccuccaaa

SEQ ID NO: 150130 - RNA, 64 nt, Human
aagucaacagugaaauacgccagaacugcuuuaucccacggaaaaugccaaucucuucuaaaaa

SEQ ID NO: 150131 - RNA, 64 nt, Human
aaagugcagugagcaugucuaauguuccuuaaaucccacggagaggagcagcuuugggaacugu

SEQ ID NO: 150132 - RNA, 64 nt, Human
uggaggccacauccugccccaccccacccccacucccacggacacuaaaacgcuaauaauuuau

SEQ ID NO: 150133 - RNA, 64 nt, Human
augucaagagagggaguaacaugucuucucauugcccacggacccaaccucuguccaggugccc

SEQ ID NO: 150134 - RNA, 64 nt, Human
ccaagggcccagcugucuugccugcccgugggcacccacggacguggcuuggugcugaggauag

SEQ ID NO: 150135 - RNA, 53 nt, Human
agaaaggacugggaagcugaggacccacggacucuucacacagccuagacgcu

SEQ ID NO: 150136 - RNA, 64 nt, Human
ccugagccccaccggcgcuggcggcgcgcccugccccacggacccgggcagugaaccagagauc

SEQ ID NO: 150137 - RNA, 64 nt, Human
aagggcccuagcaguguuaacaaauugcugagaucccacggagucuuucaaaaaucucuguaga

SEQ ID NO: 150138 - RNA, 64 nt, Human
ccuuuccuggucucucuuccuuuccuugcucucacccacggauaaaaccagaagcgacaggagg

SEQ ID NO: 150139 - RNA, 64 nt, Human
aaaaacagagaagcugccugcguaaaaagugccacccacggaggcaggacacaggcagcgugug

SEQ ID NO: 150140 - RNA, 64 nt, Human
ugugaccgaggagcaggguccccagggggcagcucccacggagcgggcuugaacagggaccacc

SEQ ID NO: 150141 - RNA, 64 nt, Human
uguccaaguccaaauccugaaggagacgcgggagcccacggagaacgcuccaggagggccuguc

SEQ ID NO: 150142 - RNA, 64 nt, Human
gcggcagccucaggggccucaggggagcccccaccccacggauguugucaggaaucaugaucug

SEQ ID NO: 150143 - RNA, 64 nt, Human
ugccccacccaacuccacagggcuguuuugccuccccacggaaggcgggcugaggagacaacca

SEQ ID NO: 150144 - RNA, 64 nt, Human
cacccacacucuuuuuagguguaaaagauggagucccacggaggaggggcagagccaggaggca

SEQ ID NO: 150145 - RNA, 64 nt, Human
gccuuguuugaguuuuuccucccagugagacugccccacggagacagaggaaagggcuggcucc

SEQ ID NO: 150146 - RNA, 64 nt, Human
gggcuggugggucugcagcuggugugggaacuuccccacggauggcgguggaggggguucgcac

SEQ ID NO: 150147 - RNA, 64 nt, Human
acucucggcugcugccccagcccgcgccagacagcccacggauccguucucagcggagccagau

SEQ ID NO: 150148 - RNA, 64 nt, Human
ucccaugggcucuggccccaagauguuggggggccccacggagaguugacuugguagaguuccu

SEQ ID NO: 150149 - RNA, 53 nt, Human
ugcucuggacauauaacugacugcccacggaaagugcagaaugcuccuccacc

SEQ ID NO: 150150 - RNA, 64 nt, Human
agcccugaaggaccuagggagcccagcccaccuucccacggacugggguucccucacaugugca

SEQ ID NO: 150151 - RNA, 64 nt, Human
gccaggugugugguggggacaacagcacgugcagcccacggaagggcucuuucacagcuggcag

SEQ ID NO: 150152 - RNA, 64 nt, Human
cagcccagcgggcgggccccuuccgagggagccucccacggagugaagagacaugggggacuuu

SEQ ID NO: 150153 - RNA, 64 nt, Human
agguaaaaaacugucacgguacgaaaucuuagugcccacggaggccucgagcagagagaaugaa

SEQ ID NO: 150154 - RNA, 64 nt, Human
caggggguguggcaggagcucccagcacuggagacccacggacucaacccaguuaccucacaug

SEQ ID NO: 150155 - RNA, 64 nt, Human
aggcaccugcugcacacacaagcaucucacucggcccacggagggggccaggcuuccuuugccu

SEQ ID NO: 150156 - RNA, 54 nt, Human
ccccaccaccccaggacugaugggcccacggaccccugggaagaggccccgccu

SEQ ID NO: 150157 - RNA, 64 nt, Human
ggacugcccucggugcucauagggaauggcugggcccacggaaggucggccugggauguggccu

SEQ ID NO: 150158 - RNA, 64 nt, Human
auugaaaaucaguuagaaccaauguauuucuugccccacggaacacuauuccuauaagauagcu

SEQ ID NO: 150159 - RNA, 64 nt, Human
ugagggguuucggcccagccccagccugccggagcccacggagcuaccucuaccuccacuccug

SEQ ID NO: 150160 - RNA, 64 nt, Human
aaucccugaggauagauggcacccauggcccccacccacggaaggacuugaguuguuuacaagc

SEQ ID NO: 150161 - RNA, 64 nt, Human
ggagcccccucccugcaaccagccugaguucagccccacggacaaagggacacacagcccccaa

SEQ ID NO: 150162 - RNA, 64 nt, Human
uuugcucagcacacucuccugggccccaaggagucccacggaauggggaaagcgggaacccugg

SEQ ID NO: 150163 - RNA, 64 nt, Human
cccaaccucagagugaaggcaggguggcagccuccccacggacuccaugcggcccgcuggcuca

SEQ ID NO: 150164 - RNA, 64 nt, Human
ucuauuuaugucuccgcuuuguaccauaaccgaacccacggaaagacgcugcgcgggugcagaa

SEQ ID NO: 150165 - RNA, 64 nt, Human
gcgcugaucgcuggugcugagcccugcccugggccccacggacagucagccugccggccucccu

SEQ ID NO: 150166 - RNA, 64 nt, Human
gagagagaaggagagagacaguagccaagagaaccccacggacaagauuuuucauuucacccaa

SEQ ID NO: 150167 - RNA, 64 nt, Human
gagacugcacugcggucccucccccagcccgaggcccacggagguuccucgggggacagucuca

SEQ ID NO: 150168 - RNA, 61 nt, Human
ggguggugcccggcauguaagccccgcccaccccacggaggccacagccacacagccacgc

SEQ ID NO: 150169 - RNA, 64 nt, Human
gggcagaggacccggugccugccuggcagaugugcccacggaggcccccagcugcccuccgagc

SEQ ID NO: 150170 - RNA, 64 nt, Human
gcccuuaaucagcccucugugacauagguagcagcccacggagauccuaagcuggcugucuugu

SEQ ID NO: 150171 - RNA, 64 nt, Human
uuugcuuugcacuucggaaccuguugcguuuugacccacggagguggaggaguaacuuuuugac

SEQ ID NO: 150172 - RNA, 64 nt, Human
aaauaaacagacauaagaugucaucacgaaacugcccacggaucuuuaggcuuucugcauugac

SEQ ID NO: 150173 - RNA, 64 nt, Human
cccaccaugaccugggugcucugagcccacgguucccacggagcugacuucuccggggugccug

SEQ ID NO: 150174 - RNA, 64 nt, Human
ccgccucugacgcauugacacgugagcacuggcucccacggagggugcgccugccgccagcggc

SEQ ID NO: 150175 - RNA, 64 nt, Human
gccucgagaggggccgaugcccagagacacagcccccacggacaaaaccccccagauaucaucu

SEQ ID NO: 150176 - RNA, 64 nt, Human
gguggacuccgcggcacaugcuucccaagguggucccacggaggguguuacugggcaccagugg

SEQ ID NO: 150177 - RNA, 64 nt, Human
gguugugaggcgcugcggaggccccuugucuguucccacggacgggggcucgggcgcggacuaa

SEQ ID NO: 150178 - RNA, 64 nt, Human
cgcccccaggaaugcaagugguuuccuggugcuucccacggaggaguuuuggcagccagacuuc

SEQ ID NO: 150179 - RNA, 64 nt, Human
gacggacaugcacguggcagaucaugauuuccagcccacggagccagcauuugaaccuuguaua

SEQ ID NO: 150180 - RNA, 64 nt, Human
gcugugcaggcagcccauccaccccaguggaguucccacggacgcuucugcucaugguccaagg

SEQ ID NO: 150181 - RNA, 64 nt, Human
ugggaaaugcaaaaauaacaaaauaguuacugugcccacggagccuacccgauuauagcagagg

SEQ ID NO: 150182 - RNA, 64 nt, Human
cuguagucacaugaauugaaaaggagacgcugcucccacggaggggagcaggaaugcugcacug

SEQ ID NO: 150183 - RNA, 64 nt, Human
auaaaaguccucacuguagaucucuaaauuucaacccacggaaaugaaagccuuuugucugaaa

SEQ ID NO: 150184 - RNA, 64 nt, Human
gucccuccagcaaaaacagcagcccuaauagcagcccacggacuuuggggaggagcaaagggag

SEQ ID NO: 150185 - RNA, 64 nt, Human
gacccccacgaggccccccagagaggaggaagaucccacggaggaacacaugagguuagggacc

SEQ ID NO: 150186 - RNA, 64 nt, Human
aacauaaaggaggaugucccuggucuguuccauccccacggaugguguugcugcugggcaacag

SEQ ID NO: 150187 - RNA, 64 nt, Human
cucagccggcugucccagccagccccgcagagcgcccacggacaguguccacucuggcaaggug

SEQ ID NO: 150188 - RNA, 64 nt, Human
ggauucugaucugauccuuagggggugcccuggccccacggacccgacucagcuugagacacuc

SEQ ID NO: 150189 - RNA, 64 nt, Human
gccccauaguggugcgggcacuggacccccgggccccacggaggccgcggucugaacugcuuuc

SEQ ID NO: 150190 - RNA, 64 nt, Human
gggggaacaagaaaaauauaaaaagugaucucugcccacggaaaggauuuaauccaaauggucc

SEQ ID NO: 150191 - RNA, 64 nt, Human
uucaggaagugaauugaugaggacuguccccaugcccacggaugcucagcagcccgccgcacug

SEQ ID NO: 150192 - RNA, 64 nt, Human
uucugcagaaaagcuccagcaggcgcugccuucacccacggaucugcccaggcugaaggcacac

SEQ ID NO: 150193 - RNA, 64 nt, Human
aaauccuuccucuccucccagucccaccccuugccccacggaguccuggggacgcagugcccca

SEQ ID NO: 150194 - RNA, 64 nt, Human
agccaggcgccccccccucuaaggguccucuggccccacggacagcaggacccggacacccugu

SEQ ID NO: 150195 - RNA, 64 nt, Human
uguugagccugggcggcgugagcucuguguuggacccacggaggagggagucacugcagggaaa

SEQ ID NO: 150196 - RNA, 64 nt, Human
caucucauugggacugguuagacagugggugcagcccacggagggugagcugaagcaggguggg

SEQ ID NO: 150197 - RNA, 64 nt, Human
acuagggacagggcugugccggccugggccagggcccacggacccgcagcucagggcgccugcc

SEQ ID NO: 150198 - RNA, 64 nt, Human
acacugccggaagagcacagggacacagccagagcccacggagggcccuucccgcaaagcagaa

SEQ ID NO: 150199 - RNA, 64 nt, Human
guuaagagaugcuccuccaagggucucuucugaucccacggauccugcagagcgugucaggaau

SEQ ID NO: 150200 - RNA, 64 nt, Human
agagaaggggcccaagagagacagcacaggcagccccacggacgacgcgagggccccacguccc

SEQ ID NO: 150201 - RNA, 64 nt, Human
ucugaggcuugcuuggcuuguguccaugcuuaaacccacggaagggggagacucuuucggauuu

SEQ ID NO: 150202 - RNA, 64 nt, Human
cggcggauugucugaaugacacauauacagagcccccacggauuucugcacacucugggucugu

SEQ ID NO: 150203 - RNA, 64 nt, Human
gcggccccuccucugcuucccccugaacccaccccccacggaaaccagcccugcgggcuaagca

SEQ ID NO: 150204 - RNA, 64 nt, Human
acucuccaagggguacccccaccccgcuaccuuccccacggacgggccccuccuggagcccaua

SEQ ID NO: 150205 - RNA, 64 nt, Human
cccggccugguaaccagcccaucagcacacggcucccacggagcaucucagaagauugggccgc

SEQ ID NO: 150206 - RNA, 64 nt, Human
uaaaaaccaaaaaguccuaaccccugcucggggccccacggaugcugguggacugugugccccu

SEQ ID NO: 150207 - RNA, 64 nt, Human
ugccugagagagcucagcacacacacagcucagacccacggacaggaccccgggacagaacccc

SEQ ID NO: 150208 - RNA, 64 nt, Human
gugugaccagacaugcuuccugcuccccgcuuagcccacggagugacugugguugugguggggg

SEQ ID NO: 150209 - RNA, 64 nt, Human
ggggccugaagggaaaugaggcagcugcuguguccccacggaaacaaccaucuggggacugcug

SEQ ID NO: 150210 - RNA, 64 nt, Human
uggggagaggggcuccuguucugccguggagcugcccacggagcaccucacagaagauugagaa

SEQ ID NO: 150211 - RNA, 64 nt, Human
ggccacaacugaccccgagggaccagucuucauacccacggaaaguuauugggacccugcuuac

SEQ ID NO: 150212 - RNA, 64 nt, Human
gagaugcagccccguggacaugaagacacaaucucccacggacagcuuucccccuuccgcccuc

SEQ ID NO: 150213 - RNA, 64 nt, Human
cuggauccaggggcccccggaaggcguggagacacccacggaccagggaggccaagcagccgag

SEQ ID NO: 150214 - RNA, 64 nt, Human
gugaaaucuggcuuuugagaacacaaacuuuucccccacggaccucccuuuaucacuuuaauag

SEQ ID NO: 150215 - RNA, 59 nt, Human
uccugaguggugagcaucuuagcuuagcaccaaccaacacagucucaccuagaaaacag

SEQ ID NO: 150216 - RNA, 59 nt, Human
cucacucuacccccaacaccaccccuugcccaaccaaugcacacaguagggcuugguga

SEQ ID NO: 150217 - RNA, 59 nt, Human
uguucuuuauuuuacaugagggcuacuuuccaaccaaauaaagucaauuuuucuaagaa

SEQ ID NO: 150218 - RNA, 59 nt, Human
cccacaccggcaaguaccagccagcaacaccaaccaaaugcuacucucuuuaaagucca

SEQ ID NO: 150219 - RNA, 59 nt, Human
aggacauccacacaauaguaggaaucuccccaaccaaucugugaauuucaugggggcca

SEQ ID NO: 150220 - RNA, 59 nt, Human
cccuaguacgacuccgcccaguguguggaccaaccaaauagcauucuuugcugucaggu

SEQ ID NO: 150221 - RNA, 59 nt, Human
gagcagcuggacacccagccaaggcccugccaaccaacugccucucugaggaggaggug

SEQ ID NO: 150222 - RNA, 59 nt, Human
acugaguuaaggcaggaaaagaaauaagcccaaccaacuugccaaagguaucuuugucc

SEQ ID NO: 150223 - RNA, 59 nt, Human
ggaaacuugcagugggucaguggucugugccaaccaaacgauagccccauccaagccag

SEQ ID NO: 150224 - RNA, 59 nt, Human
agagauuggacuuuuucuuguuuaaaaccccaaccaaaaaaaauaauaaggcaugauug

SEQ ID NO: 150225 - RNA, 59 nt, Human
ccccaccccucuuuuccaguccuugccuuccaaccaaaagaaauggauguuuuggugga

SEQ ID NO: 150226 - RNA, 59 nt, Human
acguccucucucgaucugcaagccuuucaccaaccaaauaguugccucucucgucacca

SEQ ID NO: 150227 - RNA, 59 nt, Human
aagcaacuacuuuccuagaguaucauuugccaaccaaaaggcuuucagaggugugaaug

SEQ ID NO: 150228 - RNA, 59 nt, Human
acuugaugaccacacggggcagagagaaaccaaccaaggccagcaccuccgucggaagc

SEQ ID NO: 150229 - RNA, 59 nt, Human
gggccggaccuccugcuggcucucgcccaccaaccaaguguuacaagccccagaaugcu

SEQ ID NO: 150230 - RNA, 59 nt, Human
uucccuaagaucugcuuuuucuauuucucccaaccaaauccucuuaaagacccuuugcu

SEQ ID NO: 150231 - RNA, 59 nt, Human
guuucaaguacucaagacugacuuacagaccaaccaaccaccuugcuggaacccuugcu

SEQ ID NO: 150232 - RNA, 59 nt, Human
cuuuuucucccuaccccccaaccccuagcccaaccaaugcuagaauuucuugcucugaa

SEQ ID NO: 150233 - RNA, 59 nt, Human
cuauuuuuuugcccccaguuccacaagauccaaccaagaauucuguauccugggacagu

SEQ ID NO: 150234 - RNA, 59 nt, Human
cacuguucugggguuuguucucuacccuuccaaccaaucacaccccugccuuuuuuuuu

SEQ ID NO: 150235 - RNA, 59 nt, Human
uacaguucugagcagugggcggcugcaagccaaccaauauuuucugucauuuguuugua

SEQ ID NO: 150236 - RNA, 59 nt, Human
ugaucuuacuacuacaaagaaaaaaaaacccaaccaaucugcaauucaaaucagaaagu

SEQ ID NO: 150237 - RNA, 59 nt, Human
agcauggugaaccaucagagaaucuagaaccaaccaagcuaggaacaucagccuggugc

SEQ ID NO: 150238 - RNA, 59 nt, Human
uaccccccuacuuaauguaauucaggacuccaaccaagaggauuucuucaaaucucagc

SEQ ID NO: 150239 - RNA, 59 nt, Human
cuagaagaaaccucuuagagaauucaguaccaaccaagcuucagcccacuuucacaccc

SEQ ID NO: 150240 - RNA, 59 nt, Human
uuaaaguacuugggcuucagaaguaagagccaaccaacugaaaaccugagauggagaua

SEQ ID NO: 150241 - RNA, 59 nt, Human
ccugggcuguccacacagaaaacaaaaacccaaccaaaccaagcccuguugugcucacu

SEQ ID NO: 150242 - RNA, 59 nt, Human
ucucccucgugcuccccaaaucaccacaaccaaccaauaccgcgauccaugagggacuc

SEQ ID NO: 150243 - RNA, 59 nt, Human
acucagagccuuccuugagcuaaacucggccaaccaaggcacgcagcauguccccucag

SEQ ID NO: 150244 - RNA, 59 nt, Human
ucccugugcaguucagagggcaagugaacccaaccaacaaugucgucaucuaagcccug

SEQ ID NO: 150245 - RNA, 59 nt, Human
ggcuuucguucguccaaacaacacuugauccaaccaaaguuccaaugugacuguggauc

SEQ ID NO: 150246 - RNA, 59 nt, Human
ccuggauccaucaggccacuugaugacccccaaccaaguggcucccacacccuguuuua

SEQ ID NO: 150247 - RNA, 59 nt, Human
ucuguggguuaauaguuaaaagaauguucccaaccaaaaaauucuuaccguaauauuau

SEQ ID NO: 150248 - RNA, 59 nt, Human
auaaucaacguacagugagcucuuugaagccaaccaaggcaggcagaacccucuuaaau

SEQ ID NO: 150249 - RNA, 59 nt, Human
aggagacaaaugcugauugggauggaagaccaaccaagagaucaagcuaucucugcgaa

SEQ ID NO: 150250 - RNA, 59 nt, Human
aacagaaacaagcgauuauuucaaaucaaccaaccaacucaguauccuguguuuugaua

SEQ ID NO: 150251 - RNA, 51 nt, Human
accugcccucaccagacugagccaaccaaccacuguggggcaugugggagu

SEQ ID NO: 150252 - RNA, 59 nt, Human
ucaccugcuuugaaauuagccuuagauugccaaccaauagaugagaauuuugaggaaaa

SEQ ID NO: 150253 - RNA, 59 nt, Human
gcagagaugacuugcaucccagcuuuccaccaaccaaauucaaacauucacugcuuauu

SEQ ID NO: 150254 - RNA, 59 nt, Human
aaaauuuaaauugggggaucauaauaauuccaaccaagugacaacucugacaucaaggu

SEQ ID NO: 150255 - RNA, 59 nt, Human
guuugggaucaauaggaaagcauaugcagccaaccaagaugcaaauguuuugaaaugau

SEQ ID NO: 150256 - RNA, 59 nt, Human
cagagggucucugagggcaagagacauggccaaccaagggcaaggagugacccugugga

SEQ ID NO: 150257 - RNA, 59 nt, Human
aguuggcucuuaaaaggugggagagcagcccaaccaauccccaauccuuuucuucugaa

SEQ ID NO: 150258 - RNA, 59 nt, Human
aaggacuuugcugaccacugcauggggauccaaccaauucaauuaaugucuucauauug

SEQ ID NO: 150259 - RNA, 59 nt, Human
acaguuccguauagacucaacucaucugcccaaccaaguauguuccuccugaauuccuc

SEQ ID NO: 150260 - RNA, 59 nt, Human
aguuggccucuccucccaggugcacauagccaaccaaugugagguuggcggacugcgcc

SEQ ID NO: 150261 - RNA, 59 nt, Human
uuauccaaaauguucuggaugcaucaucuccaaccaaggaccccuuauuuaucaugccu

SEQ ID NO: 150262 - RNA, 59 nt, Human
caggagacagggcucaggcugccggagcuccaaccaaacucugucccacuucacgcacg

SEQ ID NO: 150263 - RNA, 59 nt, Human
gugaccaugacaguaaugaaaccagggucccaaccaagaaaucuaacucaaacguccca

SEQ ID NO: 150264 - RNA, 59 nt, Human
ucauaagaauguggaacccgccauggcccccaaccaauguacaagcuauuauuuagagu

SEQ ID NO: 150265 - RNA, 59 nt, Human
auaacugaaguauucacuacucuuguaaaccaaccaagaggaggagaaagaugacccag

SEQ ID NO: 150266 - RNA, 59 nt, Human
uuggaagaggaaaacaggaacccaccaaaccaaccaaucaaccaaacaaagaaaaaauu

SEQ ID NO: 150267 - RNA, 59 nt, Human
uaauguaaaugacgaguuaaugggugcagccaaccaaccuggcacauguauucauaugu

SEQ ID NO: 150268 - RNA, 59 nt, Human
ugcuggaaguuaucgauaggacuguguggccaaccaagugcuugugagaucacugacac

SEQ ID NO: 150269 - RNA, 59 nt, Human
ggguccacuuucugagaugcuuucuaaaaccaaccaacugauaaaaaguagaugagacu

SEQ ID NO: 150270 - RNA, 59 nt, Human
auauuuguuguaaaagugaaacuuguuugccaaccaauaaacaacugauugagauuuag

SEQ ID NO: 150271 - RNA, 59 nt, Human
gcucaaugccacuguccaaguuacgacuuccaaccaaacuauauuaagcagcccagccu

SEQ ID NO: 150272 - RNA, 57 nt, Human
gcuuacuacuucaggccuagggguuauccaaccaagcauucuuggggaaagagaaau

SEQ ID NO: 150273 - RNA, 59 nt, Human
ugugguuaguuccacaucuguggauucaaccaaccaaggacggaaaaugcuuaaaaaau

SEQ ID NO: 150274 - RNA, 59 nt, Human
ccucuccacuuuaaccucuucuaaaauacccaaccaaaagaucacuguuucucucaaca

SEQ ID NO: 150275 - RNA, 59 nt, Human
aauuaagaagcaaacaaaaagagagcaacccaaccaaaacaaaucacauucuugcacaa

SEQ ID NO: 150276 - RNA, 59 nt, Human
uaugaauaaaauuguuauuucaauaguacccaaccaaagaugcuuaaaaaccuucuaug

SEQ ID NO: 150277 - RNA, 59 nt, Human
guacagcuuucuacuucuuuguaagaacaccaaccaaccaagguuuaagugauuaauag

SEQ ID NO: 150278 - RNA, 59 nt, Human
agcuuucuacuucuuuguaagaacaccaaccaaccaagguuuaagugauuaauaggcuu

SEQ ID NO: 150279 - RNA, 59 nt, Human
auguguggagcauaacuaaaacccacagcccaaccaaaccuugagaaugcgaaacauuc

SEQ ID NO: 150280 - RNA, 59 nt, Human
ggaaagaaaacuaacaaccaaccaaccaaccaaccaaccacaaaccacccuaaaaugac

SEQ ID NO: 150281 - RNA, 59 nt, Human
aaaaggaaagaaaacuaacaaccaaccaaccaaccaaccaaccacaaaccacccuaaaa

SEQ ID NO: 150282 - RNA, 59 nt, Human
auuaaaaaggaaagaaaacuaacaaccaaccaaccaaccaaccaaccacaaaccacccu

SEQ ID NO: 150283 - RNA, 59 nt, Human
auaaauuaaaaaggaaagaaaacuaacaaccaaccaaccaaccaaccaaccacaaacca

SEQ ID NO: 150284 - RNA, 59 nt, Human
gcaaguuggaaguuuaauuagcuuuccaaccaaccaaauuucugcauucgagucuuaac

SEQ ID NO: 150285 - RNA, 59 nt, Human
uugagcaaguuggaaguuuaauuagcuuuccaaccaaccaaauuucugcauucgagucu

SEQ ID NO: 150286 - RNA, 59 nt, Human
cucauaaaauauauacuuuauuaaaucauccaaccaaagcauaggaaacauugacccag

SEQ ID NO: 150287 - RNA, 59 nt, Human
ugugugaggcuggauuuucuuugccuacuccaaccaaagcgacacaucacagcagacug

SEQ ID NO: 150288 - RNA, 59 nt, Human
uaagacuuuuauaagacuagcuuaaaacaccaaccaacauuauuuuugcaaaagugagu

SEQ ID NO: 150289 - RNA, 59 nt, Human
agaugaucaagaucuaaaggaaauuaaucccaaccaacaaacuuaaaaguuuaucuacc

SEQ ID NO: 150290 - RNA, 59 nt, Human
guuaaggaaaugcuuaccaucccccacccccaaccaaguucuuccagacuaaagaauua

SEQ ID NO: 150291 - RNA, 59 nt, Human
gugaaccauguaugaaaauccagugggccccaaccaaggagacagacagacuugggucu

SEQ ID NO: 150292 - RNA, 59 nt, Human
ucuuuaccgauguauuuuccuacucauagccaaccaauaaauucaguaucuguuucaaa

SEQ ID NO: 150293 - RNA, 59 nt, Human
ggguucuugaaacagcaacagucaaaugcccaaccaacugcaaccaugaucugguacag

SEQ ID NO: 150294 - RNA, 59 nt, Human
cccauuaaaccuugcuuaugauauaggcaccaaccaaaccucuugcucugcuauaucuc

SEQ ID NO: 150295 - RNA, 59 nt, Human
agaacucugggaaaacuugggaauggcaaccaaccaaaaucauuuuuaaucauuuauua

SEQ ID NO: 150296 - RNA, 59 nt, Human
uuuacacacuugacuuuuuaaaaauacaaccaaccaaccaccacaacuucuuauacauu

SEQ ID NO: 150297 - RNA, 59 nt, Human
uaccauuuggagcuggacaacauuugacaccaaccaaucauacuggacaaggcccuuag

SEQ ID NO: 150298 - RNA, 59 nt, Human
gaaagagcaagucagcuugugccgcauccccaaccaauccacagccuggaguaccuuuc

SEQ ID NO: 150299 - RNA, 59 nt, Human
gcacggagccgcgggacagccaagcaccuccaaccaaauaagacuuccacucgaugaug

SEQ ID NO: 150300 - RNA, 59 nt, Human
caagcaccaugucagugucguacaaucuaccaaccaaccagugcugaagagauuuuaga

SEQ ID NO: 150301 - RNA, 59 nt, Human
gaaaaaagaaugacucaaauguauuauugccaaccaagucgucaaaucuaaugucaagu

SEQ ID NO: 150302 - RNA, 59 nt, Human
cagaaauguugccagaaaaaguaucuccuccaaccaaaacaucucaauaaaaccauuuu

SEQ ID NO: 150303 - RNA, 59 nt, Human
acuacauccacauuauugacuuuuggaaaccaaccaaauuacuuaagaaauggaaaagu

SEQ ID NO: 150304 - RNA, 59 nt, Human
acccgaccccaccugcggugccuucagccccaaccaaagacacuagugcacccccuuca

SEQ ID NO: 150305 - RNA, 59 nt, Human
aacuaaaaauuacgcuaucuagaauuguaccaaccaaaaucucguauuggcagaucuug

SEQ ID NO: 150306 - RNA, 59 nt, Human
aaacaccgagccucauuaacccaagugaaccaaccaaagucaccaguucagaagugcua

SEQ ID NO: 150307 - RNA, 59 nt, Human
ugggcugagaaggggaaaccaggaucuccccaaccaagggccuauacuuuuauuuuuca

SEQ ID NO: 150308 - RNA, 59 nt, Human
augaaacaaaucuaaaagugaaacaaaaaccaaccaacaaauacaacacaaagcaauua

SEQ ID NO: 150309 - RNA, 59 nt, Human
ucauggaugucuggucccucugcacagcuccaaccaacaggacuguagggugaugacga

SEQ ID NO: 150310 - RNA, 59 nt, Human
aaguccaaaggcauuuucuccugugcugaccaaccaaauaauauguauagacacacaca

SEQ ID NO: 150311 - RNA, 59 nt, Human
aaggguggcauucugcugaccacagcacuccaaccaaaagccaaaaaccaaagcaagac

SEQ ID NO: 150312 - RNA, 59 nt, Human
caugggcagguacugacugaagaugcaauccaaccaaagccauuacauuuuuugaguua

SEQ ID NO: 150313 - RNA, 59 nt, Human
uccaggacaaugccauccuucauauuccuccaaccaaagcaagcacagcacaugggaga

SEQ ID NO: 150314 - RNA, 59 nt, Human
uuaucuucucaggacucauuguuccacccccaaccaauuugaaugccuacaauaaguuc

SEQ ID NO: 150315 - RNA, 59 nt, Human
ggccccaguggcaaccaugugguaaguggccaaccaagcccuacccagggucacccaac

SEQ ID NO: 150316 - RNA, 59 nt, Human
uguuaagacuuaaaagccauauaauuccaccaaccaaaauuaaucccuuuugucauauu

SEQ ID NO: 150317 - RNA, 59 nt, Human
uguggaaaccaggaaauugcuccucucagccaaccaagguugaccacacaccacccuuc

SEQ ID NO: 150318 - RNA, 59 nt, Human
aaaacugcuuuuuuuuuuccagcaaguauccaaccaacuugguucugcuucaauaaauc

SEQ ID NO: 150319 - RNA, 59 nt, Human
gugucuugucuccauuuggauaaaaggaaccaaccaacaaacaaugccaucacuggaau

SEQ ID NO: 150320 - RNA, 59 nt, Human
cuuggggaacagagagagcagguguacacccaaccaaagugauugugcccuugguuggg

SEQ ID NO: 150321 - RNA, 59 nt, Human
gaagcaaaauggcacagggcuaguugccaccaaccaauuuacugaugaaugaagcccag

SEQ ID NO: 150322 - RNA, 59 nt, Human
uaaaaucuagaaagaccuuagagaaccagccaaccaacucucucauuuuaaaagugaag

SEQ ID NO: 150323 - RNA, 59 nt, Human
ccuccccuccaccugccccagugcccagaccaaccaaggcccugacagcccugccuucu

SEQ ID NO: 150324 - RNA, 59 nt, Human
cuguguccagccugccacccauacguaggccaaccaagcacuucaugaagaggaggccu

SEQ ID NO: 150325 - RNA, 59 nt, Human
guguauuaaguaaauaaauaaguaaauaaccaaccaacccugaggaacaucuuguuucu

SEQ ID NO: 150326 - RNA, 59 nt, Human
aagcuacucuucauuuaagacugcucuccccaaccaagacacauuugccuggaaauuca

SEQ ID NO: 150327 - RNA, 59 nt, Human
cuccucacucucuaccucccugccgcuuuccaaccaaguaugucugcuuugguaucuuu

SEQ ID NO: 150328 - RNA, 52 nt, Human
acauugaucaagauuuguaggaccaaccaaccuaagagcaauaaauguuuuu

SEQ ID NO: 150329 - RNA, 59 nt, Human
auuagucaguaaugaagacgacagccuggccaaccaagggaaaggaaauuaguaucuuu

SEQ ID NO: 150330 - RNA, 59 nt, Human
gcauuguaccuagugguaccuagugacuuccaaccaaagccuuugaguaugcacuaaau

SEQ ID NO: 150331 - RNA, 59 nt, Human
cacagguacagcuguuucuuggaaauccuccaaccaaauagcaguuuuccuaacuugau

SEQ ID NO: 150332 - RNA, 59 nt, Human
uuacucagcuuccuuccugaccaagucugccaaccaauggccagcuaugcgccucaucc

SEQ ID NO: 150333 - RNA, 59 nt, Human
gauuacgacagguuugguuuuuaaauuuuccaaccaaguggaaaggcaaguuggucuua

SEQ ID NO: 150334 - RNA, 59 nt, Human
gcugacaaugacagguugacuguguacccccaaccaaggagcuggggcccaaggccagu

SEQ ID NO: 150335 - RNA, 59 nt, Human
ccuacaggagccugugcagauggccaugcccaaccaauaacgagacgguuccccucccu

SEQ ID NO: 150336 - RNA, 59 nt, Human
cacugugcuggguguguugcauggcccucccaaccaauucaguauuuuucuccccauuu

SEQ ID NO: 150337 - RNA, 59 nt, Human
acaccacugugguccccuccacacucaccccaaccaaagcuaauggccuaguugggucc

SEQ ID NO: 150338 - RNA, 59 nt, Human
ugugcgcuugucagaccaucagaccagggccaaccaaucagaaggcaacuuacuguaua

SEQ ID NO: 150339 - RNA, 59 nt, Human
ccccccgguaugggaaccagcaccucccaccaaccaaccacacccggugggggcacagc

SEQ ID NO: 150340 - RNA, 59 nt, Human
ucuucuugguaaaugaugcuaugcuuuuuccaaccaagccagaaaccugugucaucuuu

SEQ ID NO: 150341 - RNA, 59 nt, Human
acugccccaccccugggggaaaccuggcuccaaccaaccccuccccugccuccaccaua

SEQ ID NO: 150342 - RNA, 59 nt, Human
caccuuccaggcgccuucgcccuggggauccaaccaacuuguaucgagugggcggggca

SEQ ID NO: 150343 - RNA, 59 nt, Human
auuauuuauauucaacugacagacaaaaaccaaccaacgacaaaacaaaaacccccaau

SEQ ID NO: 150344 - RNA, 59 nt, Human
cccuccuguccucuguguucccgcggaaaccaaccaaaccgugcgcugugacccauugc

SEQ ID NO: 150345 - RNA, 51 nt, Human
ccauugaagagguugauuaagccaaccaaguguagauguagcauuguucca

SEQ ID NO: 150346 - RNA, 59 nt, Human
aaaauugucuccuaauuuggggagaugaaccaaccaaucaaugacaagaaaacgcuuac

SEQ ID NO: 150347 - RNA, 59 nt, Human
uaucuauaugacgcucuuaaaaaaacaucccaaccaaaaccaaccaaacaaaaacaucc

SEQ ID NO: 150348 - RNA, 59 nt, Human
acgcucuuaaaaaaacaucccaaccaaaaccaaccaaacaaaaacauccucacaacucc

SEQ ID NO: 150349 - RNA, 59 nt, Human
gaggagugaaagaauuaaguggguagacaccaaccaaaaugacuuugaaagcagugagc

SEQ ID NO: 150350 - RNA, 59 nt, Human
ucucaagcaagccuccugaaccacuggccccaaccaacccacugguggggugggaggag

SEQ ID NO: 150351 - RNA, 59 nt, Human
gucugguggcagcgcagagcccaaucauuccaaccaaagcaggguuggggaaucccgaa

SEQ ID NO: 150352 - RNA, 59 nt, Human
aagcauugacgcagccccuacacuccaucccaaccaagaaacugcauuuccuggggcca

SEQ ID NO: 150353 - RNA, 59 nt, Human
uguuuuuaaagcugcucauuucauuuuguccaaccaaaaagaaaagggagauaacuaau

SEQ ID NO: 150354 - RNA, 59 nt, Human
cagucacaagaagucuuauuuacaugccaccaaccaaccucagaaacccauaaugucau

SEQ ID NO: 150355 - RNA, 59 nt, Human
agaaauauuaauaccacauggggagaaccccaaccaaagaaaucugaaauauauaguaa

SEQ ID NO: 150356 - RNA, 59 nt, Human
cugcucuagagagaggucaugauaucauaccaaccaaauggaaaugacaaauguuuuau

SEQ ID NO: 150357 - RNA, 59 nt, Human
gccaggaguaccccuugaggcuaauucuaccaaccaagggauuugugcucuucaucugu

SEQ ID NO: 150358 - RNA, 59 nt, Human
ucccaggcauacuauaaaacgaagagugcccaaccaagcuuugaaucguauuaacaaug

SEQ ID NO: 150359 - RNA, 59 nt, Human
cugcaggagcagggcggcugccgacucccccaaccaaggaaggagccccugaguccgcc

SEQ ID NO: 150360 - RNA, 59 nt, Human
ucccccagcacuugcggccgcucagcccuccaaccaagaccuaagucacacaucauaau

SEQ ID NO: 150361 - RNA, 59 nt, Human
ucacuugaggccaggaguucaagaccagcccaaccaacauggugaaacccugucuccac

SEQ ID NO: 150362 - RNA, 59 nt, Human
guauuugucauacaauauggguccuaaauccaaccaacuacacauuuuaucugguguuc

SEQ ID NO: 150363 - RNA, 59 nt, Human
uauguauucacugaccaaaaauucacugaccaaccaaccaaacuccacacuucaucuga

SEQ ID NO: 150364 - RNA, 59 nt, Human
uauucacugaccaaaaauucacugaccaaccaaccaaacuccacacuucaucugauccc

SEQ ID NO: 150365 - RNA, 59 nt, Human
uuauaaaaguuccuaggaggcuagaagagccaaccaacagagaagggaaagcagucugu

SEQ ID NO: 150366 - RNA, 59 nt, Human
uccaagagguccccucagcaucaagcagcccaaccaaggcgugcaucgagccuugcacc

SEQ ID NO: 150367 - RNA, 59 nt, Human
uaaggucaagggaaaaccccgucucuauaccaaccaaaccaauucaccaacacaguugg

SEQ ID NO: 150368 - RNA, 59 nt, Human
uaauuuugauauauucaaagaugugauucccaaccaacucaggaugaaguaacuagugu

SEQ ID NO: 150369 - RNA, 59 nt, Human
gcacuuuugauagauuacgucuaauccucccaaccaaccagcaggguagcuauuacugu

SEQ ID NO: 150370 - RNA, 52 nt, Human
uuuucgagacagcacugugaauccaaccaaaaugucaaguccguuccgaagg

SEQ ID NO: 150371 - RNA, 59 nt, Human
ggguuuuuuuuuuuccuuuguuaagaaagccaaccaaucacaaugauauagucauuguu

SEQ ID NO: 150372 - RNA, 59 nt, Human
caagcaucuuuagaaaucugaucucggcuccaaccaacagccaccuuccagggaugggg

SEQ ID NO: 150373 - RNA, 59 nt, Human
ucguguccagggggaugauggagagcuguccaaccaagagagcgggagggagggaagga

SEQ ID NO: 150374 - RNA, 59 nt, Human
auugugauuguaauuacugaguugaagcuccaaccaauuugaauuuguuucuuaaccuu

SEQ ID NO: 150375 - RNA, 59 nt, Human
ugucccagaacauuucugugcuuaauuacccaaccaaagagaucugaaguauguauguc

SEQ ID NO: 150376 - RNA, 59 nt, Human
uagcuucuuuguucacaauucaguuccucccaaccaaccagucuucacuucaagagggc

SEQ ID NO: 150377 - RNA, 59 nt, Human
aaaaaugugaaucuuaccagcaguuccagccaaccaagugauucuucuucauucuugau

SEQ ID NO: 150378 - RNA, 59 nt, Human
agcggacaguuugaaacuuggggcauaugccaaccaaaacuucguuucugcaugucaga

SEQ ID NO: 150379 - RNA, 59 nt, Human
gggacgaguguucagugggccacagugaaccaaccaaaccaaccccgaaucaucgcucu

SEQ ID NO: 150380 - RNA, 59 nt, Human
gcaggcuggcucccgggggucucugauggccaaccaaggggccacccagggaccucuaa

SEQ ID NO: 150381 - RNA, 59 nt, Human
ccccuccuucaacucuccccagaaauagcccaaccaagcgaguggauguccccaccacu

SEQ ID NO: 150382 - RNA, 59 nt, Human
aaaauauuacagauuaauaauaaauuaaaccaaccaaugauaaacacuacucaguccac

SEQ ID NO: 150383 - RNA, 59 nt, Human
caguaucgacaaagauuacauucugaguaccaaccaaacccuaaauugaaagacaaaac

SEQ ID NO: 150384 - RNA, 59 nt, Human
uacaacuagcauugccucaaaaacugggaccaaccaaagugugucaacccuguuuccuu

SEQ ID NO: 150385 - RNA, 59 nt, Human
uaagaucuuuuccaaaguuuuucuuagaaccaaccaaaaaacaauccgaguaggcccaa

SEQ ID NO: 150386 - RNA, 59 nt, Human
uguccccucacuuguccaagaccaaagcuccaaccaaacaauaccccaucguuugacug

SEQ ID NO: 150387 - RNA, 59 nt, Human
ccguuucgucucuuggaaacagcuccccaccaaccaagauuucuuuuucuaacuucugc

SEQ ID NO: 150388 - RNA, 59 nt, Human
cucuuuucccaccaacuccuauuucccuaccaaccaaggagccuccagaaggaaaggag

SEQ ID NO: 150389 - RNA, 59 nt, Human
aaaaauuaaggggagagaggaaaacaaaaccaaccaaccccuaaaaucauuuucuuauu

SEQ ID NO: 150390 - RNA, 59 nt, Human
acuaugguacuaauaaaaaccuaaauucuccaaccaauuuuuuuaaacugccaggaaca

SEQ ID NO: 150391 - RNA, 59 nt, Human
caugcuuuccuagcugaagucauacuagcccaaccaacauggcagcuaacacaugaaug

SEQ ID NO: 150392 - RNA, 59 nt, Human
cagggcagggcaaggcggacugaugccguccaaccaauuaucucacuuguuuuguguuc

SEQ ID NO: 150393 - RNA, 59 nt, Human
ggugaaaguagcaggaacaacaacaaaagccaaccaaaaacaagguagccagugcaaga

SEQ ID NO: 150394 - RNA, 59 nt, Human
guaaauaugacuccuuucucuaucccaagccaaccaagagcacauucuuaaaggaaaag

SEQ ID NO: 150395 - RNA, 59 nt, Human
agcagaagaaaaauuacuuaguccuuaggccaaccaauuuaacugcagugucauguuuc

SEQ ID NO: 150396 - RNA, 59 nt, Human
uaugggaagcuaguuggaaaacuucaguuccaaccaauucuuagauugaaucuggccuc

SEQ ID NO: 150397 - RNA, 59 nt, Human
caugcaaggccaauuggacaaccucaguuccaaccaauucuuggauugaguuuggccuc

SEQ ID NO: 150398 - RNA, 59 nt, Human
aaaaaccagacaagauggcuaggccaucaccaaccaacggacuuaccuuacaucuuugu

SEQ ID NO: 150399 - RNA, 59 nt, Human
ccccccucucccagcccugguaggguuccccaaccaaagacggcuccauuaaaaacgga

SEQ ID NO: 150400 - RNA, 59 nt, Human
cccuccaucccaaccuggcucccucccacccaaccaacuuuccccccaacccggaaaca

SEQ ID NO: 150401 - RNA, 59 nt, Human
auaauaaaacaugcaucauuuuucauuugccaaccaagcacaaaguuauuuuauacuga

SEQ ID NO: 150402 - RNA, 59 nt, Human
uuaaauaggcaagguacccagugauaacaccaaccaaaccacuccuaucugcaugauuc

SEQ ID NO: 150403 - RNA, 59 nt, Human
uaccaggaacauaggaguggauuccugccccaaccaaaccgcauucguguggauuuuuu

SEQ ID NO: 150404 - RNA, 59 nt, Human
caaggaguaugugggcuuugcaacccuccccaaccaaguccaccgaaaguccgugaaga

SEQ ID NO: 150405 - RNA, 59 nt, Human
gcacuguuuacaauagcaaagacuuggaaccaaccaaaauacccacaaaugauagaccg

SEQ ID NO: 150406 - RNA, 59 nt, Human
ccuuccccguugucauagcuauuucauugccaaccaacuccaucacaugguuguugaua

SEQ ID NO: 150407 - RNA, 59 nt, Human
gguaaaaaaugugaaauugggauuagggaccaaccaaaauauuucauuaaugcuuucaa

SEQ ID NO: 150408 - RNA, 59 nt, Human
caggauagcaugagauagucucaauguggccaaccaaaaggacaaaacugacaggaaug

SEQ ID NO: 150409 - RNA, 59 nt, Human
ccuuggguauuacaaguuuuugucuggagccaaccaagcuugccaccaacauauugaga

SEQ ID NO: 150410 - RNA, 59 nt, Human
gaaaugguccuuuuuuuuucuauaaaucaccaaccaacuaucuaaauggacauuugggg

SEQ ID NO: 150411 - RNA, 59 nt, Human
gggguggggccguggcugaagccggcuccccaaccaaaaugcugcaccaaagcucgggc

SEQ ID NO: 150412 - RNA, 59 nt, Human
uuuuuuuuccugccuaauuucugugauuuccaaccaacaugaaaugacuauaaaugguu

SEQ ID NO: 150413 - RNA, 59 nt, Human
cucagaauuuuaaccaaaaggaguuggcuccaaccaaugggagccuuccccucacuucu

SEQ ID NO: 150414 - RNA, 59 nt, Human
cugggguugaggugauaaucaauagcuuaccaaccaaaaagaguccaggaccagaugga

SEQ ID NO: 150415 - RNA, 59 nt, Human
ccuucccuucacccucacuggaucuuggcccaaccaaaucccuuguuuuguauuuucuu

SEQ ID NO: 150416 - RNA, 59 nt, Human
ggguagcccucggccggggagugaggccaccaaccaaagucaguuccuucccaccugug

SEQ ID NO: 150417 - RNA, 59 nt, Human
ugaugacuugugggugcuccuggcucaacccaaccaacaggacugacugacuggcagga

SEQ ID NO: 150418 - RNA, 59 nt, Human
uaauucuacaagaggaaucaccugguuucccaaccaauaaaauggcauuuuaagaaaua

SEQ ID NO: 150419 - RNA, 59 nt, Human
gaauucuugcccuccccucucuucuccucccaaccaaaacccuccgauccagccccagg

SEQ ID NO: 150420 - RNA, 59 nt, Human
ugggaccauuggcugggaccccucauuaaccaaccaagcacuuguaccucccuggcaua

SEQ ID NO: 150421 - RNA, 59 nt, Human
ugacaagggaggaaagaccaaaaaaacaaccaaccaaaaaaaaaaaaaaaaaggaaaga

SEQ ID NO: 150422 - RNA, 59 nt, Human
uucucagaguuccaguuucaaccagaguuccaaccaaugggcuccauccucuggauucu

SEQ ID NO: 150423 - RNA, 59 nt, Human
ugcugauaaaacagauugcaguaaagaagccaaccaaaucccaccaaaaccaaguuggc

SEQ ID NO: 150424 - RNA, 59 nt, Human
ggauuacaggugugagccacagcaccuggccaaccaacacuucucagggccucuuucau

SEQ ID NO: 150425 - RNA, 59 nt, Human
ucucugugauuacaugguccuucaaacucccaaccaaagugagaaaagcggcaugcagu

SEQ ID NO: 150426 - RNA, 59 nt, Human
ucuugggcugaccacagcuucucccuuucccaaccaauaaaguaaccacuuucagcacg

SEQ ID NO: 150427 - RNA, 59 nt, Human
gauggugauggugugcacguuucauuaauccaaccaaaaauaaugaaauaaaauuugag

SEQ ID NO: 150428 - RNA, 59 nt, Human
aaaugccuuacacauuccuuacaaauaaaccaaccaaccuacacagcguuauccaggcc

SEQ ID NO: 150429 - RNA, 59 nt, Human
agaaggucacuuggcuccauugccugcuuccaaccaaugggcaggagagaaggccuuua

SEQ ID NO: 150430 - RNA, 59 nt, Human
uuugucuucaacgaauuaugaaaucuguaccaaccaacggcuggaaaugcaaaguaagu

SEQ ID NO: 150431 - RNA, 59 nt, Human
uucaacauaugcauaaccuuaguauuuucccaaccaauagaaacuauuuauuguaagcu

SEQ ID NO: 150432 - RNA, 59 nt, Human
cgggccuggcuucccaucuccauggcaacccaaccaaaccaacaacacagcuggggcgg

SEQ ID NO: 150433 - RNA, 59 nt, Human
acccaaacuucccagagaguaugugagaaccaaccaaugaaaacagucccaucgcucuu

SEQ ID NO: 150434 - RNA, 59 nt, Human
auccaaacauccuggagaguaucugagaaccaaccaaguaaaagucucguugcucauau

SEQ ID NO: 150435 - RNA, 59 nt, Human
acccaaacuucccagagaguaucugagaaccaaccaaugaaaacagucccaucgcucuu

SEQ ID NO: 150436 - RNA, 59 nt, Human
guguuguguaaagagacuggccaacaggaccaaccaagcaccuuaccucucccauacaa

SEQ ID NO: 150437 - RNA, 59 nt, Human
auuccaucuucccgaucuucuuugcuucuccaaccaaaacaucaauguuuauuaguucu

SEQ ID NO: 150438 - RNA, 59 nt, Human
uacaaauuaguugccugacuuugguuuuuccaaccaaggaauuuaaaacuguuauuuuu

SEQ ID NO: 150439 - RNA, 59 nt, Human
cugaggucaggaguucgagaccagccuggccaaccaacauggugaaaccucgugucuac

SEQ ID NO: 150440 - RNA, 58 nt, Human
ggccgcagggcuuccccgccuggcgccugcccuccagggcuggggccucgccuggcgg

SEQ ID NO: 150441 - RNA, 58 nt, Human
caaaaacaaaaguaaacuccuuucccuggcccuccaaacauauauucugugagauaac

SEQ ID NO: 150442 - RNA, 58 nt, Human
ugaagcacccagucucguaccauuuugagcccuccagcacuacuuauuuucccccacc

SEQ ID NO: 150443 - RNA, 58 nt, Human
ggcucuuucugggccaaguuccucuagugcccuccacagccgcagccucccucugacc

SEQ ID NO: 150444 - RNA, 58 nt, Human
cccucccagccccaugugccugccgccugcccuccacacaucccuguccccccaaccc

SEQ ID NO: 150445 - RNA, 58 nt, Human
cacuggcuguagccacuucaguccaucugcccuccagaggagggguuucuuccugauu

SEQ ID NO: 150446 - RNA, 58 nt, Human
agagaggaggccccacagcuugcccuuugcccuccaucccuggcuguccugaguggug

SEQ ID NO: 150447 - RNA, 58 nt, Human
ggacccggaucauucacugugauacccugcccuccagagggugcgcucagagacacgg

SEQ ID NO: 150448 - RNA, 58 nt, Human
cuuccccuucagugcuuacuuggcuccagcccuccagcugcagccccuggggaaaagc

SEQ ID NO: 150449 - RNA, 58 nt, Human
cagcaccaggccccagcucccuccgggggcccuccaggaaccaccaagcucucucacg

SEQ ID NO: 150450 - RNA, 50 nt, Human
uuuuggcccugccugcuuaagcccuccagcccgcccacugcccguugccu

SEQ ID NO: 150451 - RNA, 58 nt, Human
acacacaugcacaagucaugugcgaacagcccuccaaagccuaugccacagacagcuc

SEQ ID NO: 150452 - RNA, 58 nt, Human
cacagaccgccaaggugaaggcccuccugcccuccauggugaagggccugaagaacau

SEQ ID NO: 150453 - RNA, 58 nt, Human
aaaaugguuccgacuugucccucucucagcccuccauggccuggcacgaggggauggg

SEQ ID NO: 150454 - RNA, 58 nt, Human
uugaagacccaagucugccuuucacagagcccuccauuccaaguuuaguuuuugucaa

SEQ ID NO: 150455 - RNA, 58 nt, Human
cccuggccauccuccuggaauguggucugcccuccaccagagcuccugccugccagga

SEQ ID NO: 150456 - RNA, 58 nt, Human
uuuccuaauucaggaccccacucaucuagcccuccaagagccuccgccaaauuguagc

SEQ ID NO: 150457 - RNA, 58 nt, Human
acaguccccugauccccuaccucugccugcccuccagccccaucaccagcuucuugcu

SEQ ID NO: 150458 - RNA, 58 nt, Human
ucaguuaaugccagugaggucagcuucugcccuccagcaauacaugugcagggguugc

SEQ ID NO: 150459 - RNA, 58 nt, Human
uucuaauaccaccaccccugugcuucaggcccuccaaaccccuguguuccccaaaugu

SEQ ID NO: 150460 - RNA, 58 nt, Human
gcccccugcugccuucucuaugcagccugcccuccaucauccaccccagaauugcucu

SEQ ID NO: 150461 - RNA, 58 nt, Human
uccaguguagggcacaacccuggggacugcccuccauagccugucccgacugccgacu

SEQ ID NO: 150462 - RNA, 58 nt, Human
cuucuuccaaauauauaaaaaaggaauugcccuccagguaaucccuuuccuuuuuccc

SEQ ID NO: 150463 - RNA, 58 nt, Human
ggugagaucucaacucacugcaaccucugcccuccagguucaagugauucuccucccu

SEQ ID NO: 150464 - RNA, 58 nt, Human
accaucugugacccuucccugccauugggcccuccaccuguggcucacaucucgccag

SEQ ID NO: 150465 - RNA, 58 nt, Human
guugcaguaagccgagaccaugcuuauugcccuccagucugggcaacaaaaaugaaac

SEQ ID NO: 150466 - RNA, 58 nt, Human
ucucccacagagugcuggacuguuccaggcccuccagugggcugaugcugggacccuu

SEQ ID NO: 150467 - RNA, 58 nt, Human
uuuuuuuggcgagucaccagugacccgagcccuccacaccagccuccuguaucucauc

SEQ ID NO: 150468 - RNA, 58 nt, Human
accauucuuguccuuccccaguuuccucgcccuccaccccuccagcuucaugcucagu

SEQ ID NO: 150469 - RNA, 58 nt, Human
cccccgccugccaccuccccccacaagugcccuccaggcuuuucuuggggaagauacc

SEQ ID NO: 150470 - RNA, 58 nt, Human
ccccuauccaggcccgaauccuuccgcugcccuccaagcgcccucuggggacagacca

SEQ ID NO: 150471 - RNA, 58 nt, Human
gccugcccuccuauauggauucuucagggcccuccacaucugagguggcucauuccca

SEQ ID NO: 150472 - RNA, 58 nt, Human
ggggcaaaucacagcaauauuccacagcgcccuccagaguuaccuggggaggaccgag

SEQ ID NO: 150473 - RNA, 58 nt, Human
ggcuuacaucaaaacaccucagagggcugcccuccagaggcugcacccagaacagugg

SEQ ID NO: 150474 - RNA, 58 nt, Human
cucuggaguucucucaucggaggcccaugcccuccacuccacugccuuuggaaggguc

SEQ ID NO: 150475 - RNA, 58 nt, Human
aaugagggagggggcgcucaggacccaggcccuccaugggcuagugugaguggcagcc

SEQ ID NO: 150476 - RNA, 58 nt, Human
cccagguggaccauccucccaaacuagggcccuccacucuauccagggcaggccaggg

SEQ ID NO: 150477 - RNA, 58 nt, Human
acccuggugccuggcagguucucccucugcccuccacugggcccaguggcucagggac

SEQ ID NO: 150478 - RNA, 58 nt, Human
auguggcucuaucuuuuaaaaccucaaggcccuccacuguccuaagauaaagccucuc

SEQ ID NO: 150479 - RNA, 58 nt, Human
cagcuuaaccccugccaucccaugcugggcccuccaggccaagagucucagcuggccg

SEQ ID NO: 150480 - RNA, 58 nt, Human
agucugggggcuucacaagggcaggagagcccuccaucacugacuuccagaucaggga

SEQ ID NO: 150481 - RNA, 58 nt, Human
ggugcuuggaagagccggccuugggugggcccuccaccgccucuacccucacugggug

SEQ ID NO: 150482 - RNA, 58 nt, Human
ggaaucagcaggccucugugcucccucugcccuccagaacucagugacucuugaacau

SEQ ID NO: 150483 - RNA, 58 nt, Human
ucuccccaaaucagggcucuagacccgagcccuccaaaccuggacucugggacuuagg

SEQ ID NO: 150484 - RNA, 58 nt, Human
ugccuuugcuugauguuguagaugaguugcccuccaccuggcuggagagauggcacau

SEQ ID NO: 150485 - RNA, 58 nt, Human
uccuaagggaagggacaguuccuggaaggcccuccagcuggaugcuggggaucagcga

SEQ ID NO: 150486 - RNA, 58 nt, Human
ucuccacccaccucccaaacuccugccugcccuccagacugucugcccauacaccugu

SEQ ID NO: 150487 - RNA, 58 nt, Human
aaugcgaugucagauggaugguaauggugcccuccaguggcugugagaccucauugcg

SEQ ID NO: 150488 - RNA, 58 nt, Human
aucaugggcaaggaagggaauucccacagcccuccaguguacugaggguacuggccua

SEQ ID NO: 150489 - RNA, 58 nt, Human
uaccaccagacugacuccaggacucacugcccuccagaaaacagaggugacaaaugug

SEQ ID NO: 150490 - RNA, 64 nt, Human; identical to SEQ ID NO: 84607

SEQ ID NO: 150491 - RNA, 58 nt, Human
uucuagaggacaacaagugaccagggcugcccuccacccucacccuccacccuuugcu

SEQ ID NO: 150492 - RNA, 58 nt, Human
ucugcccuagcgcucucuuccagaagaugcccuccaauccuuuccacccuauucccua

SEQ ID NO: 150493 - RNA, 58 nt, Human
cuccccaucccaccuggcuccagagccugcccuccacagcuugcugccaagcuacucc

SEQ ID NO: 150494 - RNA, 58 nt, Human
guuaguggauggaaggggcugacagacagcccuccaucuaaacugcccccucugcccu

SEQ ID NO: 150495 - RNA, 58 nt, Human
cagggaccacauccaccccagccccacugcccuccagggccaggauucaggccucuga

SEQ ID NO: 150496 - RNA, 58 nt, Human
gguugcagugaguggagaucgcaccacugcccuccagccuaggugacagaaugagacu

SEQ ID NO: 150497 - RNA, 58 nt, Human
cauaauuucgcaacuguccuuuuggguugcccuccaacacauuacuuccauuucagaa

SEQ ID NO: 150498 - RNA, 58 nt, Human
auccucgcacccuccgcucccuccacuggcccuccaggucgauucccugggcuccagg

SEQ ID NO: 150499 - RNA, 58 nt, Human
ucucuucuuucucucugagggagagggagcccuccaaacuucagauccuguggguuua

SEQ ID NO: 150500 - RNA, 58 nt, Human
uuuaggagacaggagucaccagggcacagcccuccaggcccgccucaggaaggaauga

SEQ ID NO: 150501 - RNA, 58 nt, Human
ugugccugagcucccgcugcccaggggagcccuccacgccggcucuuccccacccuca

SEQ ID NO: 150502 - RNA, 58 nt, Human
aucauaccuugaccuguaccucuucucugcccuccacuucccugcccuggaguccguu

SEQ ID NO: 150503 - RNA, 58 nt, Human
agggaagaaggaacaguggaggcgggacgcccuccaucuccucggagccccgcgaggu

SEQ ID NO: 150504 - RNA, 58 nt, Human
ucaaaaugguccccaucagccuggagcagcccuccagaccuggguggaauuccagggu

SEQ ID NO: 150505 - RNA, 58 nt, Human
cuguccucccacagaccugcagugaggggcccuccaugcgcagaugaggggccacuga

SEQ ID NO: 150506 - RNA, 58 nt, Human
uccugccugcgggcaccuacaagguugugcccuccaccuaccugccggacacagaggg

SEQ ID NO: 150507 - RNA, 58 nt, Human
uuucccacauuuuccuguuuucuucugagcccuccaaacuguuccagccucugccugu

SEQ ID NO: 150508 - RNA, 58 nt, Human
cccuuuuucaccacuccccuuccccaucgcccuccagccccacucccuguaggauuuu

SEQ ID NO: 150509 - RNA, 58 nt, Human
uccucucccucacaagcgcucccagccugcccuccagcugcugcucuccccucccagu

SEQ ID NO: 150510 - RNA, 58 nt, Human
aguguauacaaaaacuaaauagacuucugcccuccaacaucuuuuuauugcauuacuu

SEQ ID NO: 150511 - RNA, 58 nt, Human
cguugcagugaucccagauugugccacugcccuccagccugggugacagagugagauu

SEQ ID NO: 150512 - RNA, 58 nt, Human
uuaggcuucuaagaaaggaugggacucugcccuccaggcaaggaguaaauggccccag

SEQ ID NO: 150513 - RNA, 58 nt, Human
cugcuucaguucucagcuguuuaccacagcccuccaggguccaaagauugaggagcuu

SEQ ID NO: 150514 - RNA, 58 nt, Human
cacaaagccuuuggugguucugcccucugcccuccagcuuuacccaccagaguaagca

SEQ ID NO: 150515 - RNA, 58 nt, Human
uuaacugaagccugcuccuucuuguucugcccuccagagauuugcucaaaugaucaau

SEQ ID NO: 150516 - RNA, 54 nt, Human
augaugucagcuaccucugacccugcccuccagccugggacaauaaaagccuuu

SEQ ID NO: 150517 - RNA, 58 nt, Human
gcccccgugcgagcggcaccccugcccugcccuccacagaauuggguuccaagggcug

SEQ ID NO: 150518 - RNA, 58 nt, Human
agguuccuggacagaucaggcuagcccugcccuccacccacaccugcccgcuccccac

SEQ ID NO: 150519 - RNA, 58 nt, Human
ugcuuguuuguaauucauuuuauacaaagcccuccagccuguuuguggggcugaaacc

SEQ ID NO: 150520 - RNA, 58 nt, Human
cucugaggggcugaggggugaggccagggcccuccagggggagggguagccagcuugg

SEQ ID NO: 150521 - RNA, 55 nt, Human
agauuccagcucaucacuagaggcagcccuccauggacccaugaaaacugagaug

SEQ ID NO: 150522 - RNA, 58 nt, Human
ugaauccuucccacacuccuccaugguugcccuccagggucuagcccagccuauuugu

SEQ ID NO: 150523 - RNA, 58 nt, Human
uucagaccagaccugaauagucuccuaugcccuccaaaagucggguccuugcuccugc

SEQ ID NO: 150524 - RNA, 58 nt, Human
ucauuaguaagguaagucuuagaucagagcccuccagcccuucuuuuugaaaccuccc

SEQ ID NO: 150525 - RNA, 58 nt, Human
aaugugauaaugacaugauuucccaccugcccuccaagaaaauggugacucacucuca

SEQ ID NO: 150526 - RNA, 58 nt, Human
guggauagaggugaaggagguagggagugcccuccaagugcaaaaauaacaaauauga

SEQ ID NO: 150527 - RNA, 58 nt, Human
uuauuugaauucacuguguggagcccuagcccuccauucucgacauuccccaaccucc

SEQ ID NO: 150528 - RNA, 58 nt, Human
ggcugcagugugcugugauugugacacugcccuccagccugggugacagagugagacc

SEQ ID NO: 150529 - RNA, 58 nt, Human
cugcucucugcagagggggucauuccaggcccuccagugugugugauagucaccaugc

SEQ ID NO: 150530 - RNA, 58 nt, Human
cugggccaugccaggccagagggcaguggcccuccaccuuguuccugcccuuuaacuu

SEQ ID NO: 150531 - RNA, 58 nt, Human
agcugaagcuggugcgcccugucucugugcccuccagcaagaagccacccuccuugca

SEQ ID NO: 150532 - RNA, 58 nt, Human
uacuggagcccuggauuuuugcaguucugcccuccaccuugcuaucugcaccaggagg

SEQ ID NO: 150533 - RNA, 58 nt, Human
cagagguagaagggaccucaagcaccacgcccuccagggcagccgugcagacgaccuu

SEQ ID NO: 150534 - RNA, 58 nt, Human
ggcgggccacccugccagccagcagcuggcccuccaccaucuucacauuccaagacug

SEQ ID NO: 150535 - RNA, 58 nt, Human
ccuugcucuccccagccugccaagcccagcccuccagagccagcccuccuggguaccg

SEQ ID NO: 150536 - RNA, 58 nt, Human
uuaugcccuccagagcuccaagauauaagcccuccaagggaucagaagcuccaaguuc

SEQ ID NO: 150537 - RNA, 58 nt, Human
ucucucaggaagcuucuagagacuuuaugcccuccagagcuccaagauauaagcccuc

SEQ ID NO: 150538 - RNA, 58 nt, Human
ugcguuccugggaagggcugcgaggccugcccuccaaaccugacuggggaugggcggc

SEQ ID NO: 150539 - RNA, 58 nt, Human
ucccucuuuguguuucagaucaguacccgcccuccaucaaugguggucgugugauuga

SEQ ID NO: 150540 - RNA, 58 nt, Human
uuuccccugugaugagcagaugaccaccgcccuccagggucagcguuuggcuguuugu

SEQ ID NO: 150541 - RNA, 58 nt, Human
gauaaaauccaucccguguuugccacacgcccuccaguccucaguucccacugccuaa

SEQ ID NO: 150542 - RNA, 58 nt, Human
gguugcagugagccaagaucgcuccauugcccuccagccugggugacaagagcaaaac

SEQ ID NO: 150543 - RNA, 58 nt, Human
cuggguugggaguuagugcauaucaucagcccuccaucuaaugugauugcuaagaugu

SEQ ID NO: 150544 - RNA, 58 nt, Human
ccugccugcccgccagccacgcgugucagcccuccaguucuccuucaguugacgccag

SEQ ID NO: 150545 - RNA, 58 nt, Human
auggugacugucaugguucuacagaaaugcccuccaugugucccucuaauguugcaug

SEQ ID NO: 150546 - RNA, 58 nt, Human
uauucauaaauguucuauacaguggacagcccuccagaaugguacuucagugccuagu

SEQ ID NO: 150547 - RNA, 58 nt, Human
gaaaagaacacuugcccagggcagcuuugcccuccaagaggcucccuccugucucuaa

SEQ ID NO: 150548 - RNA, 58 nt, Human
ggcacagaccacugugguugauggcauggcccuccaacuuggaauaggauuuuccuuu

SEQ ID NO: 150549 - RNA, 58 nt, Human
ccccauggagagacagcauugcuccccagcccuccagaaaccuugagcagauccaggg

SEQ ID NO: 150550 - RNA, 58 nt, Human
cggggcuuucagccccacccugaugccugcccuccaggauggcugguuuagucugggu

SEQ ID NO: 150551 - RNA, 58 nt, Human
gccugucccugaaagagaagauggccaugcccuccauguguaagaacaaugccagggc

SEQ ID NO: 150552 - RNA, 58 nt, Human
uugcuguagaaacacauaacaaagggcagcccuccacuucugguauaauuguguagcc

SEQ ID NO: 150553 - RNA, 58 nt, Human
ugggaugcaaguauugcuaaauauguuagcccuccagguuaaaguugauucagcuuua

SEQ ID NO: 150554 - RNA, 58 nt, Human
uuguguuugcuuuuccggaccccacucugcccuccaaaaagacaaaaaaaaaaaaaaa

SEQ ID NO: 150555 - RNA, 58 nt, Human
ccuagacuguuacuuuggcaauuuccuggcccuccacuccucauccccacaaucuggc

SEQ ID NO: 150556 - RNA, 58 nt, Human
augacauggccuuacuccagaaucccaggcccuccacugugacucuccuacuggugcu

SEQ ID NO: 150557 - RNA, 58 nt, Human
cgugugcagcucucugcgucccuccugggcccuccagcgucagacacuaaugggaguu

SEQ ID NO: 150558 - RNA, 58 nt, Human
agcugagguccuggugccaggggcccaggcccuccaaccauaaacaguccaggaugga

SEQ ID NO: 150559 - RNA, 58 nt, Human
ugggcaugccaugucugagcggcgcagagcccuccaggccugcaggggcaaggggcug

SEQ ID NO: 150560 - RNA, 58 nt, Human
gcccacacagcccugggacacugcccuggcccuccauacucugcucccuacuggcugu

SEQ ID NO: 150561 - RNA, 58 nt, Human
cacagcuguuguucggggcuguggaacugcccuccaagcugcuggucuacuugucggu

SEQ ID NO: 150562 - RNA, 58 nt, Human
guccagaacuaagugggaguggaggcaggcccuccacagaagcucugcagcaggggcu

SEQ ID NO: 150563 - RNA, 58 nt, Human
ccccccccaguccuccgcaugagcuguugcccuccaggggccuggcacagcuggccuu

SEQ ID NO: 150564 - RNA, 58 nt, Human
uccaccccacaguuccuccugggaucuggcccuccagggaaguggagccuccagcccc

SEQ ID NO: 150565 - RNA, 58 nt, Human
auauuuuuaggaaacucucgcaguccccgcccuccaucucaccucacccgucucccaa

SEQ ID NO: 150566 - RNA, 58 nt, Human
uauuuguccuucucaaagcaaaccagaggcccuccacugucacccuaaauagagguag

SEQ ID NO: 150567 - RNA, 58 nt, Human
gcagaggcaaauccacagaaggggggcugcccuccacacacacacgcccgucacccac

SEQ ID NO: 150568 - RNA, 58 nt, Human
gcugugauggcuaacugauguuuauaaugcccuccauccagguagcaagaugugugua

SEQ ID NO: 150569 - RNA, 58 nt, Human
gccuacagagacuauagagcuagacaaagcccuccaaacuggccccuccugcucacug

SEQ ID NO: 150570 - RNA, 58 nt, Human
cgucacccuugcuauccccuggagcacugcccuccagagcugcccuucccaggaagga

SEQ ID NO: 150571 - RNA, 58 nt, Human
ggcagacauuauugguaaacaagaucuugcccuccaaugaaaugacuuacauguuuua

SEQ ID NO: 150572 - RNA, 58 nt, Human
aauucuaaaccaaucaaaugucugggaagcccuccaagaaaaaaaauagaaaagcacu

SEQ ID NO: 150573 - RNA, 58 nt, Human
ggcgcgggguggcugcugcccccuccuugcccuccacgcccugcccccugcauccccu

SEQ ID NO: 150574 - RNA, 58 nt, Human
aaaaagauuaagcaagugaaauucugcugcccuccaccauuuauuuuuacagugcuuu

SEQ ID NO: 150575 - RNA, 58 nt, Human
gauugaaacucauaccccauugcccuuugcccuccagucuccccuucagaaacaucuc

SEQ ID NO: 150576 - RNA, 58 nt, Human
gugucuuccaggcccucccacagcuugugcccuccacaguguggacucaggucccaua

SEQ ID NO: 150577 - RNA, 58 nt, Human
gaagcacugaggugggcuggacaugggugcccuccacgucccucauauccccaggcac

SEQ ID NO: 150578 - RNA, 58 nt, Human
gaaagccaagcuggcggccaccgcaggggcccuccacauucuggccgguaacuggggg

SEQ ID NO: 150579 - RNA, 58 nt, Human
agacacggggcgucuccagguggucccagcccuccagauguuucuagcucuccaggug

SEQ ID NO: 150580 - RNA, 58 nt, Human
aguuuuguuauaguuguuuucuaacccagcccuccacugccaaaggccaaaagcucag

SEQ ID NO: 150581 - RNA, 58 nt, Human
acaucacugcucuuuuagauaaaccucugcccuccacuccuugcuugaguggguuaaa

SEQ ID NO: 150582 - RNA, 58 nt, Human
cguucgaugugcgguuggcccccagcgcgcccuccagagcugcggugucucccugccu

SEQ ID NO: 150583 - RNA, 58 nt, Human
uuguuuuguaacuuugguugauguuaaggcccuccauuuuggaaagcaggaaaacagg

SEQ ID NO: 150584 - RNA, 58 nt, Human
guggagaugccgccuacacacgauccuggcccuccaccugccuccaggccacgaaaug

SEQ ID NO: 150585 - RNA, 58 nt, Human
gcauccaggcgcgugucaucuaccagaugcccuccaccgccauuucuuggucugucua

SEQ ID NO: 150586 - RNA, 58 nt, Human
ucuggaguuaacuugcaagcauauuggugcccuccaugaccaccucuggcuuaggacu

SEQ ID NO: 150587 - RNA, 58 nt, Human
cacgcggcucguucccccgcuccucggggcccuccaaggugucuccguagucagcagg

SEQ ID NO: 150588 - RNA, 58 nt, Human
ucuguuuuaaguaugagaggcuuauagugcccuccauuguaaauccauagucaucuuu

SEQ ID NO: 150589 - RNA, 58 nt, Human
uuagagugcugagcuccugggccucccagcccuccaguggccugugggugagggaagc

SEQ ID NO: 150590 - RNA, 58 nt, Human
gcagaggaaaccccuuccugggccugcugcccuccacggagcagcagcacccuccagc

SEQ ID NO: 150591 - RNA, 58 nt, Human
ucaugccucaggcuuuggcagguauccugcccuccaucuuauuccaguguguucaccu

SEQ ID NO: 150592 - RNA, 58 nt, Human
uuauuucuucauacgacauaacagaauugcccuccaagucacacaagcuccaagacua

SEQ ID NO: 150593 - RNA, 58 nt, Human
ugucagucuguccacguggagagaaguugcccuccaggccgacaggaggccaugccca

SEQ ID NO: 150594 - RNA, 58 nt, Human
aucccucuguacaggcuggauggaaggggcccuccacacuuccugggaggucagagac

SEQ ID NO: 150595 - RNA, 58 nt, Human
cccaacagcagugaucucagggcagacagcccuccacuccagcucugagacccuuuuc

SEQ ID NO: 150596 - RNA, 58 nt, Human
cugucgucacugacuucaugacagucuggcccuccagacaagagcagcgcuggcaucg

SEQ ID NO: 150597 - RNA, 58 nt, Human
cugcccguacuccuccacccagaugagggcccuccagagccugcaggcaucugugggg

SEQ ID NO: 150598 - RNA, 58 nt, Human
accuucgagcuuugcagaccugcggucagcccuccaugcgcaagacuaaagcagcgga

SEQ ID NO: 150599 - RNA, 58 nt, Human
ccggcaccccggccccgcagcgcgacucgcccuccagccccaacccccggcccggcgc

SEQ ID NO: 150600 - RNA, 58 nt, Human
gagauuccagaagccucuccuccccgccgcccuccaccccugccuuucagcguugugg

SEQ ID NO: 150601 - RNA, 52 nt, Human
ccgccccugccccgcucugagggcccuccagaccugcucgggugcuggggcc

SEQ ID NO: 150602 - RNA, 58 nt, Human
ggggcugugagaggaucaucuggggcaggcccuccacuuccaagcaagcagauggggg

SEQ ID NO: 150603 - RNA, 58 nt, Human
gccccaauccagagaagcgcuguugcccgcccuccacccacuaggugaacagcaggau

SEQ ID NO: 150604 - RNA, 58 nt, Human
ccggugccuccucuggggaagggaaccagcccuccagagcaggagacuggcaagagcu

SEQ ID NO: 150605 - RNA, 58 nt, Human
ugugggcagccuggcggaaaagauccaggcccuccacuucuccuugaggcagcuggag

SEQ ID NO: 150606 - RNA, 58 nt, Human
caccagggcagguugcgcugacucugcggcccuccaggacggacaccgggugaccccu

SEQ ID NO: 150607 - RNA, 58 nt, Human
auauuguucuuuugauaugcaguuuccagcccuccaaugaguccccagcacagaucuc

SEQ ID NO: 150608 - RNA, 58 nt, Human
ugaacuucaaccugagggggccgacagugcccuccaagacagagacgacugaacuuuu

SEQ ID NO: 150609 - RNA, 58 nt, Human
uuacucaaauccuuggcacuacuacaaugcccuccauucuucagggcugagaauugac

SEQ ID NO: 150610 - RNA, 58 nt, Human
caggagaggacugugcuggaucaugcuugcccuccacagggaauacagcauccuuaca

SEQ ID NO: 150611 - RNA, 58 nt, Human
agccugcauuuccucgcagccucucagugcccuccagccccgcgaccauguggccaca

SEQ ID NO: 150612 - RNA, 58 nt, Human
cgcgggugcgcccuggcacccucucccugcccuccagcguuuccacugucgcccgcgc

SEQ ID NO: 150613 - RNA, 58 nt, Human
ccaguggggugccaugcacaggccacaggcccuccaccucaccuccagcucaggggcc

SEQ ID NO: 150614 - RNA, 58 nt, Human
uaaauaaauaagggaaauuccuaacuuugcccuccaaagucuaacuuugguuuucuug

SEQ ID NO: 150615 - RNA, 58 nt, Human
accaggagaugaggguuaggugugcccagcccuccagacccggccuuucugguuaacc

SEQ ID NO: 150616 - RNA, 58 nt, Human
ggugggcucuuuguccuggugcccaggagcccuccagcccccugcccacagaagggaa

SEQ ID NO: 150617 - RNA, 58 nt, Human
acccuggacguuuuucugcucucuucuggcccuccauggagucaugggccucggccuc

SEQ ID NO: 150618 - RNA, 58 nt, Human
cccugggacccuuaauuucuuguccccugcccuccaugggcaguuauauucugcauca

SEQ ID NO: 150619 - RNA, 58 nt, Human
uuuuuuuuucuccuuuacuccaaacucagcccuccaguuucuucagauguaaacccug

SEQ ID NO: 150620 - RNA, 58 nt, Human
gagacagaaucccuggggugcuggacuggcccuccagaggguaagccauguccggagu

SEQ ID NO: 150621 - RNA, 58 nt, Human
cugcucucuguacaggaggccucucgcugcccuccaggcuucuucccuucuucaggcu

SEQ ID NO: 150622 - RNA, 58 nt, Human
ugcugggugggccacacucagccugacugcccuccaugggggcauucuggcacccccu

SEQ ID NO: 150623 - RNA, 58 nt, Human
ccggcugggccccagaccccagcuuccugcccuccaccgggagucugcaugguuggga

SEQ ID NO: 150624 - RNA, 58 nt, Human
ugucucuugccugucccaccugugcccugcccuccagcuuguauuuaagucccugggc

SEQ ID NO: 150625 - RNA, 58 nt, Human
caauuccaucagaccaaggcugcaaguggcccuccauucguguguguauuuaggggcu

SEQ ID NO: 150626 - RNA, 58 nt, Human
caaccuugccccccacccaagaagcccugcccuccagccacagcaguccacagcagca

SEQ ID NO: 150627 - RNA, 58 nt, Human
agcaaagugagccauagugggccaggcugcccuccaugcugggccccagcccaggucu

SEQ ID NO: 150628 - RNA, 58 nt, Human
ucguuccucagccucauggugaacucgcgcccuccagccugaucccccgcucccuccu

SEQ ID NO: 150629 - RNA, 58 nt, Human
cacuuuugcuugcccuccuggcuggggugcccuccaugucaugcacgugaugcauuuc

SEQ ID NO: 150630 - RNA, 58 nt, Human
uucuacaaucaaauccauucauuauugcgcccuccagguccccuccuuuuugcagaag

SEQ ID NO: 150631 - RNA, 58 nt, Human
cuagauguucccaccuucagugcuccacgcccuccauagaccuucagagaaggugaaa

SEQ ID NO: 150632 - RNA, 58 nt, Human
agggcaggggcauugggaaugggugggugcccuccagagaggggcugcuaccucccag

SEQ ID NO: 150633 - RNA, 58 nt, Human
gugcuggugcuguguccccaaaaccggggcccuccacagaggccccuucccagcgaca

SEQ ID NO: 150634 - RNA, 58 nt, Human
auuccaagcaauauugcagauugagcaggcccuccagcugcuggccacagaggcuccu

SEQ ID NO: 150635 - RNA, 58 nt, Human
gcucucugcucgagagccaauacccugugcccuccacucaucuggauuuacaggaacu

SEQ ID NO: 150636 - RNA, 58 nt, Human
cagcugauccugauccaccuccgcccaggcccuccaagcucuacucaccccuagggcc

SEQ ID NO: 150637 - RNA, 58 nt, Human
ccagggucuggcugagugggaucagguggcccuccaacucagcacaggaaauaaguag

SEQ ID NO: 150638 - RNA, 58 nt, Human
gcugaggacaacggaacccccuuucccugcccuccagagacugauccuagccaggcac

SEQ ID NO: 150639 - RNA, 58 nt, Human
gucccuccugccuuccuucucuucccaagcccuccaauccccaucccaggcuugcugu

SEQ ID NO: 150640 - RNA, 58 nt, Human
guggguccccuccaggaaccaaggaguggcccuccagguggcagcacuaaggacaccc

SEQ ID NO: 150641 - RNA, 58 nt, Human
aucagcccugaacgguugagagcguggagcccuccaggccuuugcucuccccucuagg

SEQ ID NO: 150642 - RNA, 58 nt, Human
cacuucccugcccaggccaccucccacagcccuccacuggucuggccagaugcacugg

SEQ ID NO: 150643 - RNA, 58 nt, Human
ccacccugaagguggauaagccaaccaugcccuccauagagguccccuauccuuaaau

SEQ ID NO: 150644 - RNA, 58 nt, Human
uggccaucugcuccucccugcccccguggcccuccaucaccuucugcuccuaggaggc

SEQ ID NO: 150645 - RNA, 58 nt, Human
cauuggcucgcucccccccccccaccgugcccuccaucacgcccugcccccagggugg

SEQ ID NO: 150646 - RNA, 58 nt, Human
ugccucagccugggcccugugcccuugagcccuccaccccuggcccaagaccccccca

SEQ ID NO: 150647 - RNA, 58 nt, Human
gagcaggugggcacuggcuggguacggugcccuccacaggacucucccuacugccuga

SEQ ID NO: 150648 - RNA, 58 nt, Human
uucucauuuccgccucuccagacacugcgcccuccacccucacucugccauuguucca

SEQ ID NO: 150649 - RNA, 58 nt, Human
caucauccuugacagugauguuuuucaggcccuccauugagaaccugaggaaaucugu

SEQ ID NO: 150650 - RNA, 58 nt, Human
aggcagccccaccugcaggagaacgucagcccuccaggggaucagccccugccaguuc

SEQ ID NO: 150651 - RNA, 58 nt, Human
cggacccugaacucagacucuacagauugcccuccaagugaggacuuggcucccccac

SEQ ID NO: 150652 - RNA, 58 nt, Human
gagccccuaaguccuucaucauaccacugcccuccaaaucuacucuucuuuuaagcaa

SEQ ID NO: 150653 - RNA, 58 nt, Human
ccccuccaacucccagggacucauuacagcccuccauuaagcagaggcuggcacggcu

SEQ ID NO: 150654 - RNA, 58 nt, Human
aauccuucagcaacaaggcuggcuuggugcccuccaagcaucuaauggcuuauuaaau

SEQ ID NO: 150655 - RNA, 58 nt, Human
guugccugggguucuguauuucuucucugcccuccaauccccgacugcuaugauguuu

SEQ ID NO: 150656 - RNA, 58 nt, Human
cuucacagauuuguccaggcugccccuggcccuccaugacacacccccgauuccugga

SEQ ID NO: 150657 - RNA, 58 nt, Human
uggccuucuggggcaccgauucuaccaggcccuccagcugcguggucuccgcagacca

SEQ ID NO: 150658 - RNA, 58 nt, Human
gcccuccggagagugggcuuggcccuaggcccuccagcucagccagaaaaagcccaga

SEQ ID NO: 150659 - RNA, 58 nt, Human
gguguccacccgugucccucaugggugagcccuccagcugugagcccaggcagugugg

SEQ ID NO: 150660 - RNA, 58 nt, Human
gcuugcaguaagcugagaucgcgccacugcccuccagccugggcaacagagcaagacu

SEQ ID NO: 150661 - RNA, 58 nt, Human
cgaagcucccugacagccgagacuggcagcccuccaucugguccguacccucgccaga

SEQ ID NO: 150662 - RNA, 58 nt, Human
cagauacaugucagugcagagguucucugcccuccagaagcccucgucugggaauucg

SEQ ID NO: 150663 - RNA, 58 nt, Human
ggugggauuuuugcauaagcacuuugcugcccuccaguggcugcuugaggaaacgcag

SEQ ID NO: 150664 - RNA, 58 nt, Human
gcugggaucucaggcagggugugcgucagcccuccaacccccagaggggcgccugugg

SEQ ID NO: 150665 - RNA, 58 nt, Human
gaggucugggcccaucccaggccucaaggcccuccaggccuguggggagcacuggagg

SEQ ID NO: 150666 - RNA, 58 nt, Human
gcccugucaugugccuugggcuccuccugcccuccaucucagccauuggggcagggac

SEQ ID NO: 150667 - RNA, 58 nt, Human
augguggugugccgauaccuccucgccugcccuccaagccccagcugccuuccuuuug

SEQ ID NO: 150668 - RNA, 58 nt, Human
uucccaugucccagccuggccuguggcugcccuccaucccuuccccagagauggcucc

SEQ ID NO: 150669 - RNA, 58 nt, Human
agagucuggguccaggccuggccauguggcccuccaguguaugagagggcccugccug

SEQ ID NO: 150670 - RNA, 58 nt, Human
ugccuucugugaguuuaaaugugcuggugcccuccagaaaagccucggccucagcucc

SEQ ID NO: 150671 - RNA, 58 nt, Human
agccucccccagcacuugcggccgcucagcccuccaaccaagaccuaagucacacauc

SEQ ID NO: 150672 - RNA, 58 nt, Human
ccagugaccauauuuaugaaaagcuguagcccuccaaggucugggaauuuaucgagaa

SEQ ID NO: 150673 - RNA, 58 nt, Human
gaccugugucaaauccguccauugaucugcccuccagcacacauuuacugagcuucug

SEQ ID NO: 150674 - RNA, 58 nt, Human
guuuccugcuugcccggccaccacccaugcccuccauagggugagguggagccauggu

SEQ ID NO: 150675 - RNA, 58 nt, Human
uggagguauuguggguucauuugaguaagcccuccaaagauaccauucaaauaaccug

SEQ ID NO: 150676 - RNA, 58 nt, Human
ccaguguucgcugugggaucaccuucuggcccuccagcagcaugauggcacgcugucg

SEQ ID NO: 150677 - RNA, 58 nt, Human
uucccaggucucacaucccaccccuccugcccuccaacccuucugccuugaaagcugg

SEQ ID NO: 150678 - RNA, 58 nt, Human
aagcucuuggaagggguaacagugaaccgcccuccaugggcuccacaucuuuuccuuu

SEQ ID NO: 150679 - RNA, 58 nt, Human
cucuaguucaacugugccagaggaaacagcccuccagugcccaccugccucacuccuc

SEQ ID NO: 150680 - RNA, 58 nt, Human
gaccaaaugucccaggcacacagcccaugcccuccaccauggaguacauuuucucccu

SEQ ID NO: 150681 - RNA, 58 nt, Human
guuacccuauaugucuaaaaggggaggagcccuccauuccaauuguccaccccuuucc

SEQ ID NO: 150682 - RNA, 58 nt, Human
ucuucaagcaccuuccccaacccacguugcccuccaggccucuguccagcccuuccuc

SEQ ID NO: 150683 - RNA, 58 nt, Human
ccccccugagccccaccuccuccagggagcccuccaggaagccccuucccugacuccu

SEQ ID NO: 150684 - RNA, 58 nt, Human
gguugcagugagcugagauuggaccacugcccuccagccugggugauagagugagacu

SEQ ID NO: 150685 - RNA, 58 nt, Human
uggaggcgagaugagcuggcgcagccccgcccuccauccuccccacaucccugcagcc

SEQ ID NO: 150686 - RNA, 58 nt, Human
agagcugggcaacagcagugauggcgaugcccuccaccucuuuccuccaguggagugg

SEQ ID NO: 150687 - RNA, 58 nt, Human
uccagauacguuugccagcaaagcugcugcccuccaggauguauaugcagacgccucc

SEQ ID NO: 150688 - RNA, 58 nt, Human
cagcaccugggcaguguccccaccccaggcccuccacauccuccucccugucuggugu

SEQ ID NO: 150689 - RNA, 58 nt, Human
cgucuuacucuaccucagacaugaggaggcccuccauuccugguuucuguagcuugca

SEQ ID NO: 150690 - RNA, 58 nt, Human
cuccagcgucagugccaagacugagcgggcccuccaguguuguccaaggaaauguaga

SEQ ID NO: 150691 - RNA, 58 nt, Human
cuggagcucagaaaggcagagccaucuggcccuccaggguguccccagccaucaggag

SEQ ID NO: 150692 - RNA, 58 nt, Human
gccugccucccagcgaguacgucaucgugcccuccaccuacgagccccaccaggaggg

SEQ ID NO: 150693 - RNA, 58 nt, Human
guggcacucagcaccuccuugugcuagagcccuccaucaccuucacgcugucccacca

SEQ ID NO: 150694 - RNA, 58 nt, Human
aaggcugauaacggcguaagaugaaguggcccuccacaaaggcugguuaggggacagu

SEQ ID NO: 150695 - RNA, 58 nt, Human
caaucugucagccgacgcagggcuggaggcccuccauuucccuccccuuuuaauuuau

SEQ ID NO: 150696 - RNA, 58 nt, Human
cagcucugcucaacugcgucuucucucagcccuccacacacacucacccccacuccca

SEQ ID NO: 150697 - RNA, 58 nt, Human
cucccagcccggccagccugagcuugcugcccuccaguagagacagaggggcaguguu

SEQ ID NO: 150698 - RNA, 58 nt, Human
gcuccauucuuccuucccucaacucucugcccuccacagagcuauggagaaggcugga

SEQ ID NO: 150699 - RNA, 55 nt, Human
cuguggcuggggcucccugagacccgcccuccagcugcccucccuggcaccccug

SEQ ID NO: 150700 - RNA, 58 nt, Human
ccuguuuaucaacggcaccauuccugcagcccuccagacuuccugcccuuagcaagug

SEQ ID NO: 150701 - RNA, 58 nt, Human
caggaaugggaaaaggacagcacaggaugcccuccaaggaugagcugguccagagaua

SEQ ID NO: 150702 - RNA, 58 nt, Human
ugggggcuucuccccaggagaccacgcugcccuccaagaccaggagcagcugugagcu

SEQ ID NO: 150703 - RNA, 58 nt, Human
ccuguccuaagccugacgccugcaccgggcccuccagcccuccccugcccagauagcu

SEQ ID NO: 150704 - RNA, 58 nt, Human
cagauccugggaccccugggccgugccugcccuccaccuugagugccauacucccaac

SEQ ID NO: 150705 - RNA, 58 nt, Human
auggggggagccauccagaccgaacagcgcccuccacggccgagucccccgccgcugg

SEQ ID NO: 150706 - RNA, 58 nt, Human
gcauugccugugacugaggcggagcccagcccuccagcgucugccuccaggagcugca

SEQ ID NO: 150707 - RNA, 58 nt, Human
gggccagaauggcuguccuugucguagagcccuccacauuuucuuuuucuuuuuugag

SEQ ID NO: 150708 - RNA, 58 nt, Human
caagugugagccaccgcgccuggcccaagcccuccacauuuucaauccaggagccuug

SEQ ID NO: 150709 - RNA, 58 nt, Human
uuauucuggcagaggagggagcaucagugcccuccaggauagacuuuucccaagccua

SEQ ID NO: 150710 - RNA, 58 nt, Human
caccaccugcacauguguagccccaccagcccuccaaggcauugcucgcccaagcagc

SEQ ID NO: 150711 - RNA, 58 nt, Human
cucucacuccuugaaaacacuguucucugcccuccaagaccuucuccuucaccuuugu

SEQ ID NO: 150712 - RNA, 58 nt, Human
ccccgcggggcagggcucgggaccugcagcccuccaugccugacccuccccccacccc

SEQ ID NO: 150713 - RNA, 58 nt, Human
acccguagccccuggcuaggucgaaacagcccuccaccucccagccaagaucugucuu

SEQ ID NO: 150714 - RNA, 58 nt, Human
aagccuuugacuuaaggguugcuugcuugcccuccaaauguccuuucucagaggggcc

SEQ ID NO: 150715 - RNA, 58 nt, Human
ggacaucucaccucccccauggcacagagcccuccacaccccuggaccagggcauccg

SEQ ID NO: 150716 - RNA, 58 nt, Human
gaccuggacccuggccagaagagcccuggcccuccagcaaggcagcaccugcucugau

SEQ ID NO: 150717 - RNA, 58 nt, Human
acagacuccagacagaggggcccuuggggcccuccaaccucaggugaugagcugagaa

SEQ ID NO: 150718 - RNA, 58 nt, Human
cacuggggaaagccucagcccaauucgggcccuccaauuacugaggcauacguaacag

SEQ ID NO: 150719 - RNA, 58 nt, Human
acugcccugugaagaaagcccuuucccagcccuccaccacuuccacccuggcgagugg

SEQ ID NO: 150720 - RNA, 58 nt, Human
ggggacugacgggggccaccaccgccccgcccuccagcgccuccucccaggguggcug

SEQ ID NO: 150721 - RNA, 58 nt, Human
acugcguucuucaagggaugaauccagagcccuccaugaggccaagcuuguccuucaa

SEQ ID NO: 150722 - RNA, 58 nt, Human
uaaaccccaugaggggucaggcugaugugcccuccagcaguaucugagaagcugcuac

SEQ ID NO: 150723 - RNA, 58 nt, Human
ccacuggccccagggcuggagcugcccugcccuccauaggcaacuggugcagggacug

SEQ ID NO: 150724 - RNA, 58 nt, Human
agcugacugugcuggcuggcucuggcuggcccuccacuggccccagggcuggagcugc

SEQ ID NO: 150725 - RNA, 58 nt, Human
cucagugccccuuaaauuucugcccugagcccuccacgucagugccaucggucuagaa

SEQ ID NO: 150726 - RNA, 58 nt, Human
caaagucugagggucuuccuuuaugcuugcccuccacacuaagagaaguuggcgucuc

SEQ ID NO: 150727 - RNA, 58 nt, Human
agcaaugguuguuccuaagguauugcuugcccuccaugucuuccuaaagagcagaacu

SEQ ID NO: 150728 - RNA, 58 nt, Human
uuggaguccuggucucccuaagggaauagcccuccaccuguggcccccauugcauuca

SEQ ID NO: 150729 - RNA, 58 nt, Human
cuggucuagcuccucuccaaacagccaugcccuccaaaugcuagagaccugggcccug

SEQ ID NO: 150730 - RNA, 58 nt, Human
ccagcucaagcgcuggggccugcugccagcccuccaccuuccccaccccuugggccau

SEQ ID NO: 150731 - RNA, 58 nt, Human
agaucacccugcucugacccagcccccagcccuccaguaccuucugccagaagacuca

SEQ ID NO: 150732 - RNA, 58 nt, Human
uaggggcugggccucggaccccacuccggcccuccagagccccacagccccaucugcg

SEQ ID NO: 150733 - RNA, 58 nt, Human
aguaaugaggaaacugagcauuucuuuugcccuccagggugccaagacccuacauaug

SEQ ID NO: 150734 - RNA, 58 nt, Human
cuagucugugugcugugguuccuggggugcccuccacugcccucuguucaguaacagg

SEQ ID NO: 150735 - RNA, 58 nt, Human
accuggggggauuggagggaaaugaccugcccuccaccaccacccaaagugugggauu

SEQ ID NO: 150736 - RNA, 58 nt, Human
gcccagcagguccugagugaagccgugggcccuccaaaugcucguuuuauagcaaccu

SEQ ID NO: 150737 - RNA, 58 nt, Human
gacaucaguggcauggcuccagucugcugcccuccaucccgacauggacccggagcua

SEQ ID NO: 150738 - RNA, 58 nt, Human
cugcugaaguguuaggaagagggugggugcccuccagaccuggggacugaguggggaa

SEQ ID NO: 150739 - RNA, 58 nt, Human
ccugaaccugcacaccuacgugcgcagggcccuccaccgccacuaugggcccgagcuc

SEQ ID NO: 150740 - RNA, 58 nt, Human
ggaagucacuggagugcugccaggggccgcccuccaagguuaaugagaggcccacauc

SEQ ID NO: 150741 - RNA, 58 nt, Human
ccagccucaccaccgcaucccaccuccugcccuccauaccucuaguugugucugaugc

SEQ ID NO: 150742 - RNA, 58 nt, Human
agccucccgaguagcugggacuacaggugcccuccaccacgcuuggcuaauuuuuuug

SEQ ID NO: 150743 - RNA, 58 nt, Human
acaggcuuuacccuuugagaaaaaggcagcccuccagauuuuguagacauuuuucuua

SEQ ID NO: 150744 - RNA, 54 nt, Human
ugggagcuuuggcugagugauacugcccuccagcucuuuccuccuuccauggaa

SEQ ID NO: 150745 - RNA, 58 nt, Human
ugacaccauguuggggguuguguguggugcccuccacguggcagaugugagccugcgg

SEQ ID NO: 150746 - RNA, 58 nt, Human
cuugggagcaggccuuuuuguguccucggcccuccacccuugguggggaggggaccca

SEQ ID NO: 150747 - RNA, 58 nt, Human
aaaccucacaggguccccacacaacagugcccuccagaagcagccccucggaggcaga

SEQ ID NO: 150748 - RNA, 58 nt, Human
auccaggaggcucucauauccuggaauugcccuccagguauccucagucuuucugcuu

SEQ ID NO: 150749 - RNA, 58 nt, Human
cuugggagccugggcuugaaggacaguugcccuccaggagguuccucacacacaacuc

SEQ ID NO: 150750 - RNA, 58 nt, Human
gguggggggucccaaagaguuugaugaggcccuccacaccugcggcccaauccaaggu

SEQ ID NO: 150751 - RNA, 58 nt, Human
gaggagggcggggggcaccuacuacaucgcccuccacaucccugauuccuguuguuau

SEQ ID NO: 150752 - RNA, 54 nt, Human
agcuggagaacaggcccuaacccugcccuccaccgccggcuccacacugccgga

SEQ ID NO: 150753 - RNA, 58 nt, Human
agccucccccuguccccucuaugaccucgcccuccacaaaugggaaaaccagacuacu

SEQ ID NO: 150754 - RNA, 50 nt, Human
uggacgccaugcuggacugagcccuccagcagugcccacugugaccugcc

SEQ ID NO: 150755 - RNA, 58 nt, Human
gggucuggggcuuccccgccacaucgcggcccuccagccuggccuaacacuuggggag

SEQ ID NO: 150756 - RNA, 58 nt, Human
aucccacgcccccucccggccccucccugcccuccauucagggagaaaccucuccuuc

SEQ ID NO: 150757 - RNA, 58 nt, Human
uaaacaaagggcccugaaguuugagugcgcccuccauuugcccugugcugaacuugcu

SEQ ID NO: 150758 - RNA, 58 nt, Human
cuccuccacaaacgcuggcgggugugccgcccuccagccucuccgcccccguccccuc

SEQ ID NO: 150759 - RNA, 58 nt, Human
uuucacacccccuccucaagcugggccugcccuccaagugcuuguuauauaccuccac

SEQ ID NO: 150760 - RNA, 58 nt, Human
cugacaggaaugcacauucgauuuucaagcccuccagagcuugaacaacaacuuuagg

SEQ ID NO: 150761 - RNA, 58 nt, Human
gggguguggcugggccugucacccuggggcccuccagguaggcccguuuucacgugga

SEQ ID NO: 150762 - RNA, 58 nt, Human
ggcggcucuucuggaacgcagggcccgggcccuccagccccgcccggcccagguaucc

SEQ ID NO: 150763 - RNA, 58 nt, Human
uuggugacuguggcagcgggaguucccggcccuccacacccggggccagacccucggg

SEQ ID NO: 150764 - RNA, 58 nt, Human
ccugugaccucccauggagcccagccccgcccuccacaccuccggcgcuccgcaccca

SEQ ID NO: 150765 - RNA, 58 nt, Human
ggcugcagugaguugugauugcaccacugcccuccagccugggcaacagagugaaacc

SEQ ID NO: 150766 - RNA, 58 nt, Human
acugccucauggaaaauccuccggagccgcccuccauuguggguuccugagaguagga

SEQ ID NO: 150767 - RNA, 58 nt, Human
agcacagcuggggcggggacccagccuugcccuccacccgaggcucugggacaaggcg

SEQ ID NO: 150768 - RNA, 58 nt, Human
ggccaccaguucuucggccagcaccucugcccuccagaaccugcagccuggaggggug

SEQ ID NO: 150769 - RNA, 58 nt, Human
ggagacccaagggguccaggaggugggcgcccuccauccuucgagaagcuucccaggc

SEQ ID NO: 150770 - RNA, 58 nt, Human
ggcagggcccacugagggaacaucaguggcccuccagucagguucuguggguuuggaa

SEQ ID NO: 150771 - RNA, 58 nt, Human
gaggccccacagacuuacagaagaaguggcccuccauagacauguguagcaucaaaac

SEQ ID NO: 150772 - RNA, 58 nt, Human
uuaugcaucacaguuaacaugucagcuggcccuccaggcccccgcccccaucccgucc

SEQ ID NO: 150773 - RNA, 58 nt, Human
ccuucagccuggucucccccucuucucugcccuccacccccgucucugcacugagaua

SEQ ID NO: 150774 - RNA, 58 nt, Human
accagcuuagcugacacacccccagcuggcccuccacccccaccucaagugccuuauu

SEQ ID NO: 150775 - RNA, 58 nt, Human
uuggcaccuccauucccuguugcugaaggcccuccagcauccccuuaagcaucuguac

SEQ ID NO: 150776 - RNA, 58 nt, Human
uuuuuaauaucgggggguggaccacgccgcccuccauccgugcugcaugaaaaacauu

SEQ ID NO: 150777 - RNA, 58 nt, Human
guaccuggugaacugcguccgcaucccugcccuccagucccuccugcuuuuuagccgg

SEQ ID NO: 150778 - RNA, 58 nt, Human
gcccugcccaccuccgugcagcugaccugcccuccagcccaggacuaggggcaggacu

SEQ ID NO: 150779 - RNA, 58 nt, Human
caaggaauccuugccuuuaaggugacaggcccuccacaggcuuccagacuugaaggaa

SEQ ID NO: 150780 - RNA, 58 nt, Human
ccaccugcagcaugacagcacccugcuggcccuccagggggcccugggccucuaugau

SEQ ID NO: 150781 - RNA, 58 nt, Human
agccauggggaaguuccagcugagcagagcccuccacagcucagcaaagccucuguag

SEQ ID NO: 150782 - RNA, 58 nt, Human
gagcugaggaagcgccgcuccaccgucugcccuccaaggacccgcauggaggcagugg

SEQ ID NO: 150783 - RNA, 58 nt, Human
ccucggaggagaagucagcauuuuugaagcccuccacaccguuccggaagagcuggca

SEQ ID NO: 150784 - RNA, 58 nt, Human
agugaggcucuguccaauacauggcucugcccuccagaacuucaggcucucagugacc

SEQ ID NO: 150785 - RNA, 58 nt, Human
cgggggccacgggcugcaugcugggcgggcccuccagagaaggacacaaacguguuuc

SEQ ID NO: 150786 - RNA, 58 nt, Human
cggggcagggccuaacaaggaaaccugggcccuccaagccagguugaggucugguaac

SEQ ID NO: 150787 - RNA, 58 nt, Human
agguggaugguuaggucugcugggaugggcccuccaagcccaagccuccugcuccggg

SEQ ID NO: 150788 - RNA, 58 nt, Human
ccaccagccaccacccuccgacccccuagcccuccacaagaagcagcauugagagagc

SEQ ID NO: 150789 - RNA, 58 nt, Human
ggacgggggucccgagguggaaaccauugcccuccagaacaaccgugagaaccaggca

SEQ ID NO: 150790 - RNA, 58 nt, Human
gccucccaaauagcugggacuacaaggugcccuccagcaugccuggcugauuuuugua

SEQ ID NO: 150791 - RNA, 58 nt, Human
ccucuaccugcggcugcaggagcugguggcccuccaagggcagcauccacccugcagc

SEQ ID NO: 150792 - RNA, 58 nt, Human
ccccucagcagaggcagcugguggcuuugcccuccaccugccaacccuugggcucgga

SEQ ID NO: 150793 - RNA, 58 nt, Human
ccccacccccgacccucgcgaauaaaaggcccuccaucugcccaaagcucuggacucc

SEQ ID NO: 150794 - RNA, 58 nt, Human
ugagguccugugcccucguccagcugcugcccuccacagcgguucuucacaggauccc

SEQ ID NO: 150795 - RNA, 58 nt, Human
aacuucagacauuccagcucccccacucgcccuccacuaccucugagagcccagccac

SEQ ID NO: 150796 - RNA, 58 nt, Human
ccuugucugcacuguucaaaccucugccgcccuccacaccucuaaacaucuccccucu

SEQ ID NO: 150797 - RNA, 58 nt, Human
cccgagacugauuccuuuagaauuaacagcccuccaugcugugcaacaggacaucaga

SEQ ID NO: 150798 - RNA, 58 nt, Human
ggaccucgggacugcgcgugaggccccggcccuccaaauccaaauccagacgcaggcc

SEQ ID NO: 150799 - RNA, 58 nt, Human
ggacugacugccaggcugcgugcgcccugcccuccacccagccuccuggacucggccu

SEQ ID NO: 150800 - RNA, 58 nt, Human
acucaugggcucugcccuucugcucggugcccuccacgugaggcggggcaccugcaug

SEQ ID NO: 150801 - RNA, 58 nt, Human
gauaguucugcagucugcgccuuuccacgcccuccagccccgggggagauaaggucau

SEQ ID NO: 150802 - RNA, 58 nt, Human
gagcagugagcagcccuuuagcaaaaucgcccuccaguccuuccuggagaugccuuca

SEQ ID NO: 150803 - RNA, 55 nt, Human
ccgugcgcccggccugcuagagcgcgcccuccaccccggcccccgaacugugccu

SEQ ID NO: 150804 - RNA, 58 nt, Human
cccaucccugucucucccuuucacccuugcccuccaguccucuaccucuggccugccc

SEQ ID NO: 150805 - RNA, 58 nt, Human
agccugugcagccugggcugcugucauugcccuccaguaagggcucaggguuuugcuu

SEQ ID NO: 150806 - RNA, 55 nt, Human
gugcuggugagcaggcauagcagaggcccuccagagagacugcccugcacgccau

SEQ ID NO: 150807 - RNA, 58 nt, Human
cuccacagccccggguccucugucuaacgcccuccauuucacgcccuccaucucacag

SEQ ID NO: 150808 - RNA, 58 nt, Human
guccucugucuaacgcccuccauuucacgcccuccaucucacagucaagauaaaggcc

SEQ ID NO: 150809 - RNA, 58 nt, Human
aggaacgcguguucauccucagugaucugcccuccagcaucucggcagcaucucaucc

SEQ ID NO: 150810 - RNA, 58 nt, Human
gcagacccugcccacgccccauucgccagcccuccacguccucccaggcuggcucugg

SEQ ID NO: 150811 - RNA, 58 nt, Human
agcgccaaugagguucccugcaacccccgcccuccagcccaccgcccaaccuuuuaca

SEQ ID NO: 150812 - RNA, 58 nt, Human
ggggcuguggggccagaagcugggccaagcccuccagccagaguugccagcaggcgag

SEQ ID NO: 150813 - RNA, 58 nt, Human
ccuuugguuccuggacauuugguauucugcccuccacucugguacuaucagaguaggg

SEQ ID NO: 150814 - RNA, 58 nt, Human
cucccggcaucuggcauccgagccucccgcccuccagggugcgcuucccucucuugcc

SEQ ID NO: 150815 - RNA, 58 nt, Human
uccuaguaacuguugcaguuuacaaccugcccuccagggacacgucuccaugguuuuu

SEQ ID NO: 150816 - RNA, 58 nt, Human
agcauggcuaccagggagcugcagcggagcccuccagcccucaccccaggccagcccc

SEQ ID NO: 150817 - RNA, 58 nt, Human
cgcacugcagaagcaacagcccgaccgcgcccuccagggucgucccuggcccaaggcc

SEQ ID NO: 150818 - RNA, 58 nt, Human
ggcuggugucuugagaccagccugccaggcccuccagcaggaggacagagugcccugg

SEQ ID NO: 150819 - RNA, 58 nt, Human
ccugucccucugcucccgcccggcaccagcccuccaguagauccuuucacgaccuugg

SEQ ID NO: 150820 - RNA, 58 nt, Human
cugguuccucucucccacccuaagggcagcccuccaugguccugucuguccuucugaa

SEQ ID NO: 150821 - RNA, 58 nt, Human
gggcaggguugggcugaaucaaaugggagcccuccagacauaaggaggccagaggcug

SEQ ID NO: 150822 - RNA, 58 nt, Human
gggggcguuggccgacuucuuagagaaggcccuccaugugacuuccucccaggagcca

SEQ ID NO: 150823 - RNA, 58 nt, Human
gccccugggcucuagagugacuuuugacgcccuccaucccucccgccaggcacugucc

SEQ ID NO: 150824 - RNA, 58 nt, Human
cagcagcaucuuugcugggcagggcccagcccuccacugcagaagcaucuggaagcac

SEQ ID NO: 150825 - RNA, 58 nt, Human
uggggccccacugccccuccgcugccuugcccuccauccuuccucuguuccuucuggc

SEQ ID NO: 150826 - RNA, 58 nt, Human
uuggaaacugcucuuauugugccaauaugcccuccaaacccucccaggauucaaagcu

SEQ ID NO: 150827 - RNA, 58 nt, Human
cucauggaaagacucaacuugcaacugugcccuccacacuauccuuacuucugucucc

SEQ ID NO: 150828 - RNA, 58 nt, Human
ccaucaccucccucaccucgggacaguagcccuccacuucuccagccucucagcccug

SEQ ID NO: 150829 - RNA, 58 nt, Human
cccgggguugggcaagggaaggaugguggcccuccagaggucaugaagggaccucugu

SEQ ID NO: 150830 - RNA, 58 nt, Human
uuauaaauuacaauccacucauccaccugcccuccaccaggagugggcaccccauaag

SEQ ID NO: 150831 - RNA, 58 nt, Human
ccaucacccagggcguggagaugaccacgcccuccaaacagagcaacaacaaguacgc

SEQ ID NO: 150832 - RNA, 58 nt, Human
ugacucagccuggacaccggacaugacugcccuccaggaauaaccccucccugagaca

SEQ ID NO: 150833 - RNA, 58 nt, Human
gccgcuggagacucuuaaagcccccacagcccuccagguccuccagcucugucagaug

SEQ ID NO: 150834 - RNA, 58 nt, Human
ccuuggucucuccgguugguguuaaagggcccuccacugccaccucucaugggaugga

SEQ ID NO: 150835 - RNA, 58 nt, Human
ugugcuggggccaggcgaguggagaaacgcccuccagucugagagcaggggagggaag

SEQ ID NO: 150836 - RNA, 58 nt, Human
agcugcccagcucuccuacaagguuagugcccuccaccuagggaagcaugaaccacag

SEQ ID NO: 150837 - RNA, 58 nt, Human
cggagcagaugagagagggucggggcuugcccuccaccuuggacuuggaagaagccca

SEQ ID NO: 150838 - RNA, 58 nt, Human
ccaggaccaggugggggugcggcccugugcccuccaaauucacaggggguaccuagga

SEQ ID NO: 150839 - RNA, 58 nt, Human
uucccgggggcggcgacugccgagcuccgcccuccaggcggccccacccgccugccgu

SEQ ID NO: 150840 - RNA, 58 nt, Human
gaacccuugcauccauuguugugucugugcccuccaaagagccuucagaaugcuccug

SEQ ID NO: 150841 - RNA, 58 nt, Human
uugaauuaucaacugugauuuuuauauugcccuccaagugguagaagaagauugcaaa

SEQ ID NO: 150842 - RNA, 58 nt, Human
cgcccaagccaccagggagccaaucucagcccuccacgccaaggagccuugcccacca

SEQ ID NO: 150843 - RNA, 58 nt, Human
cagccgcaucuugaucaggcuuucucaagcccuccaucggccccaccagaucuccauu

SEQ ID NO: 150844 - RNA, 58 nt, Human
aucuuccaccaccucuccggcugccccugcccuccaucacagacagcagagccgggca

SEQ ID NO: 150845 - RNA, 58 nt, Human
ugucccaccagggaggcagcagacucaggcccuccaugguccucuuugucauuuuguu

SEQ ID NO: 150846 - RNA, 58 nt, Human
gccgagcccccccugccccgagccccccgcccuccagcccaggggggaccgugggugg

SEQ ID NO: 150847 - RNA, 55 nt, Human
cgggcaaggaggugugcuaaaggcugcccuccacacccgcgccccgcgcgcgccc

SEQ ID NO: 150848 - RNA, 58 nt, Human
ugcugaaggauuuagacggggaugaagugcccuccagccucagagcuagccacaaagc

SEQ ID NO: 150849 - RNA, 58 nt, Human
aucaccacacaauaggaucccccuucuugcccuccacccccauaagauugugaagggu

SEQ ID NO: 150850 - RNA, 58 nt, Human
ggccacagugaucugagaucacaccauugcccuccagccugggugacagagugagacc

SEQ ID NO: 150851 - RNA, 64 nt, Human
cgucguaggggacaguuuccucaacaacaaaggaggacucaauguauauaucuuauaucauaag

SEQ ID NO: 150852 - RNA, 64 nt, Human
ggagcacacccugcgccucucgucguggccuccuggacucaaacuccugcuacauccuucuccg

SEQ ID NO: 150853 - RNA, 64 nt, Human
ucaagaagcugaugguggcacuucaauuugcaggggacucaaagcaggauuucagguaaaauaa

SEQ ID NO: 150854 - RNA, 64 nt, Human
accagcagaauugaaaacucuggcaauaaaacauggacucaaccauaucccuucuggcaauuuc

SEQ ID NO: 150855 - RNA, 64 nt, Human
ccguacucaguguugugaugcccccaccuagggaggacucaaugcucuuuguaugccuuaugca

SEQ ID NO: 150856 - RNA, 64 nt, Human
cuguaaugagaauuuuucacacuaacacagcgagggacucaacacgcugauucuccuccugccu

SEQ ID NO: 150857 - RNA, 64 nt, Human
uuugccauguuggccaggcuggucuugaacuccuggacucaagcaaccuacccagcguggccuc

SEQ ID NO: 150858 - RNA, 64 nt, Human
uuuaacuaaauccuauauuugaaaucauacacaaggacucaagagagauauuguguaacuagga

SEQ ID NO: 150859 - RNA, 64 nt, Human
gaguagugccugaaauugcauccagcuuuagaacggacucaaugaccuucuucuacuuguacaa

SEQ ID NO: 150860 - RNA, 64 nt, Human
caagcaaugaauugcuucuguguguuucccuguaggacucaauaguaaaugcugucugucuuac

SEQ ID NO: 150861 - RNA, 64 nt, Human
aauaaguggacacaaacuauccuuucuccaccauggacucaaucugagaacaacagcauucauu

SEQ ID NO: 150862 - RNA, 64 nt, Human
ugaaaugguuuccucccaacccccgcauuuaaagggacucaaggugccugccacuuccucagcg

SEQ ID NO: 150863 - RNA, 64 nt, Human
uccuguuuacuucauugauugcaacuacaaagguggacucaaagcaaagcacaaucaugccagc

SEQ ID NO: 150864 - RNA, 64 nt, Human
ugugcaaauaggagguuugagguccaaauuccugggacucaaauguaugcaguacuauucagaa

SEQ ID NO: 150865 - RNA, 64 nt, Human
uuaaaaagaacaugccacgauuuugucuuucuguggacucaacauucacuucgauuaaaaauag

SEQ ID NO: 150866 - RNA, 64 nt, Human
uggauaacacuggcuucaggcaaagcuugaaucaggacucaaucuacaggccagcaccuuucuc

SEQ ID NO: 150867 - RNA, 64 nt, Human
aucaaguagaaaguacagaaaaaagccacaugugggacucaaaugcaaacagacuuucccuaga

SEQ ID NO: 150868 - RNA, 64 nt, Human
uuuucuucauggguuuauguuuucguuucauuuuggacucaauuucacaucaccaaauuccuca

SEQ ID NO: 150869 - RNA, 64 nt, Human
cuuugugaaaauguaauacaaacagcagugaaugggacucaaauguugugcuuccuauaaacag

SEQ ID NO: 150870 - RNA, 64 nt, Human
aguuguuggagugguuuaaagagcugguguuuggggacucaauaaacccucacugacuuuuuag

SEQ ID NO: 150871 - RNA, 64 nt, Human
accauuaacucacugaacaaugagacaauguugaggacucaaaugaaucaaaccccgugggaau

SEQ ID NO: 150872 - RNA, 64 nt, Human
gagagcuguacccagagaguccugugcugaauguggacucaaucccuagggcuggcagaaaggg

SEQ ID NO: 150873 - RNA, 64 nt, Human
uuguauguaccacacaucuccagacguuaauaaaggacucaaagagguuuuuguacuugcgcag

SEQ ID NO: 150874 - RNA, 64 nt, Human
gccagaagugacuuauuaaacuauugaaggaaaaggacucaagaaaaauaauaaaagaccauaa

SEQ ID NO: 150875 - RNA, 64 nt, Human
aaguuaucucacugcucauguacuugcauguuugggacucaaauuuuacuugaugucuguccau

SEQ ID NO: 150876 - RNA, 64 nt, Human
auaagauacuuauguugagcuauucacaucaaggggacucaauauaucaacaauugguuuuauu

SEQ ID NO: 150877 - RNA, 64 nt, Human
uccccuugcagaggcagaauuaaagcuaaucuagggacucaaaucagcagaaugggggagacaa

SEQ ID NO: 150878 - RNA, 64 nt, Human
gagagaucugcugucagucugcuuauccuuccacggacucaaguuucuucaaucugaagauaca

SEQ ID NO: 150879 - RNA, 53 nt, Human
aaauaucugugggcuugugacacggacucaagugggcuggugacccagucaga

SEQ ID NO: 150880 - RNA, 64 nt, Human
cuccucccuggauaggaccuaauguagcacagcgggacucaaagaggaggacauuuucucuugc

SEQ ID NO: 150881 - RNA, 64 nt, Human
ugauaggaggguauggccaguuauucaucuaacuggacucaaucuuagaauaguaggaacauua

SEQ ID NO: 150882 - RNA, 64 nt, Human
ucccauaagcuaagccuuaugugagccccuucagggacucaaggguccagaagucccucccauc

SEQ ID NO: 150883 - RNA, 64 nt, Human
gucccuguguugcccagacuggucuugaacuccuggacucaagggauccuccugucuugggcuc

SEQ ID NO: 150884 - RNA, 64 nt, Human
cccgcgggcggcgggcggcgcuuccugcgccccgggacucaauuaaacccgcccggagaccacg

SEQ ID NO: 150885 - RNA, 64 nt, Human
cucccuauguugcccagguuggucucgaacuccuggacucaaaguauccucccgccucggccuc

SEQ ID NO: 150886 - RNA, 64 nt, Human
cucgcuauguugcccaggccagucucaaacuccuggacucaagcaauccucccaccuuggccuu

SEQ ID NO: 150887 - RNA, 64 nt, Human
agagacugggacuaaguguaccagagaagggcuuggacucaagcaagauuucagauuugugacc

SEQ ID NO: 150888 - RNA, 64 nt, Human
uucaccauguuggccagguuggucucaaacuccuggacucaagugaucacccuccucagccucc

SEQ ID NO: 150889 - RNA, 64 nt, Human
uucuuguauucuuuggcuuuuuuguguaguaaagggacucaaguaauguuugacagugaaggau

SEQ ID NO: 150890 - RNA, 64 nt, Human
ccacccccucucaggcacaaaagccgguguccagggacucaagaccuguaccugggguugcagg

SEQ ID NO: 150891 - RNA, 64 nt, Human
ccaagggcuuggccuggaaaggcaggcucaccugggacucaacguuccuucccccgccgccacu

SEQ ID NO: 150892 - RNA, 64 nt, Human
guucuugguuuugccuaucuacagugugauguauggacucaaucaaaaacauuaaacgcaaacu

SEQ ID NO: 150893 - RNA, 64 nt, Human
cuucaagggaaggacggacuggaggccucaccguggacucaacucugcauucuccgugccacau

SEQ ID NO: 150894 - RNA, 64 nt, Human
uggguucuuuuuugugugauuuaagacacuuuuuggacucaacguuacauuuuugaauguagua

SEQ ID NO: 150895 - RNA, 64 nt, Human
ugucauuauggccacaguuuggugcuugugcacgggacucaaagggcagcgucgaagcuggggu

SEQ ID NO: 150896 - RNA, 64 nt, Human
ccuugauuuuauguauuuaauauuagaauuuguuggacucaacuagauauauuuuuuaauuuau

SEQ ID NO: 150897 - RNA, 64 nt, Human
aacauuaaauacucaauaaaucaccaugagauggggacucaaacuucugguaaaaauacaaaua

SEQ ID NO: 150898 - RNA, 64 nt, Human
caguuuuauuuucuauuugaugaaguaagacuguggacucaauccagagccagauaguaggggg

SEQ ID NO: 150899 - RNA, 64 nt, Human
gggucuguuuugcccaggcuggucuucaacuccuggacucaaaugauccaccugccucugcuuc

SEQ ID NO: 150900 - RNA, 64 nt, Human
gaugucugcauggguccucggcacucuuggcugaggacucaaagguuuuaaucaggaucgucua

SEQ ID NO: 150901 - RNA, 64 nt, Human
uuacauaaaaccagccugcuccuggagcuucccuggacucaacuuccuaaaggcaugugaggaa

SEQ ID NO: 150902 - RNA, 64 nt, Human
uugagccaaauauaaaauuguauuuacagcugauggacucaauuugagccuucaaacuuguagu

SEQ ID NO: 150903 - RNA, 64 nt, Human
ggcuuugccuaagauccaagacagaauaaugaauggacucaaacugccuuggcuucaggggagu

SEQ ID NO: 150904 - RNA, 64 nt, Human
ucucacucuguugccaggcuggucucaaacuucuggacucaagugauccucccgccucggccuu

SEQ ID NO: 150905 - RNA, 64 nt, Human
guacugcuaaguguaccugugucaaauccgcacaggacucaauauagcaauuuauucuugaugu

SEQ ID NO: 150906 - RNA, 64 nt, Human
ucuuuaguauguuugucuuugagguggacuguugggacucaaggacuuugcugcuguuuuccua

SEQ ID NO: 150907 - RNA, 64 nt, Human
auuuacggaaugacaugaaugcugcuaaaggacuggacucaaacaaaaacgaggucaaucaugc

SEQ ID NO: 150908 - RNA, 64 nt, Human
cuaauuuuuuuugaauagcaguuauaaauguaaaggacucaaaguuuaaguaaaaagugauacu

SEQ ID NO: 150909 - RNA, 64 nt, Human
ucuaacugagcaccuuuuaaaccugcugcacauuggacucaaaaggaaaacuggaccaacaaua

SEQ ID NO: 150910 - RNA, 64 nt, Human
ucugagugccuagcggaguuccagcaaacaaaauggacucaagagagauuugauuaaugaaucg

SEQ ID NO: 150911 - RNA, 64 nt, Human
accaaguacagucucucgccugugcugucucaugggacucaaugguggugaagaaaucucaauc

SEQ ID NO: 150912 - RNA, 64 nt, Human
agcacagccauuuugccccauccccgcugcagaaggacucaaccacuccccuaagacuccagcu

SEQ ID NO: 150913 - RNA, 64 nt, Human
caucugagccuguuuccucaucaguuagauguggggacucaaucacacgcucuucaaguccggc

SEQ ID NO: 150914 - RNA, 64 nt, Human
uggagaaaguagaaauauauccgucuuugagaguggacucaaaccuuuuaaaucugaaugcgau

SEQ ID NO: 150915 - RNA, 64 nt, Human
uguaagacucugccauuaaaacauuaccgagaggggacucaaacagucuuucuuccuuugucgu

SEQ ID NO: 150916 - RNA, 58 nt, Human
ggcccuugaggacgucuuagucugguaaggacucaagagaggugaaucaugggucuca

SEQ ID NO: 150917 - RNA, 64 nt, Human
acugguggcauuguuccuuuuugaggggcuggggggacucaaauugguggcuguuuucacacag

SEQ ID NO: 150918 - RNA, 64 nt, Human
uuugccauguugccaaggcugguuucaaacuccuggacucaagaaauccacccaccucagccuc

SEQ ID NO: 150919 - RNA, 64 nt, Human
aggauaagauccuugaauauggaacuuaguuacaggacucaauaauggugggugaacauuaguc

SEQ ID NO: 150920 - RNA, 64 nt, Human
acagcugcagcauuuggagucucucucuugcugaggacucaagcccaccugaguccacuccccu

SEQ ID NO: 150921 - RNA, 64 nt, Human
uuuacaaaagugacuggcuccacucccccgcacaggacucaacagauguugacuucucaucccc

SEQ ID NO: 150922 - RNA, 64 nt, Human
aagaauuugaucucaguacccauuuaauuuuuuuggacucaagaucuaugcuuuaaaccggcaa

SEQ ID NO: 150923 - RNA, 64 nt, Human
uuaaauaagaugaauguaaaagagaaagcuuauuggacucaaacccacagauccacaccagagu

SEQ ID NO: 150924 - RNA, 64 nt, Human
cuguaaauguuacuuuccauuaaauaugggagggggacucaaauuucagaaaagcuaccaaguc

SEQ ID NO: 150925 - RNA, 64 nt, Human
uuugaaccaaaaugcucagugccuaucaacauuuggacucaagcaucaacaccaaauuauuccu

SEQ ID NO: 150926 - RNA, 64 nt, Human
uuucagguaugugugucuaucauugaaagagcauggacucaaacaucagcccugaguucuugag

SEQ ID NO: 150927 - RNA, 64 nt, Human
cacccaacuagcucuauguuuacaaauggacauaggacucaaaguuucagagaccauugcaaug

SEQ ID NO: 150928 - RNA, 64 nt, Human
guacagucuuggcuaauugcagccuccaacuccuggacucaagugauccucccaccucagccuc

SEQ ID NO: 150929 - RNA, 64 nt, Human
cucucuauguugcucaggguggucucgaauuccuggacucaagcagucugcccaccucagacuc

SEQ ID NO: 150930 - RNA, 64 nt, Human
gauugcaagagguuucuuccccaaaauauaucauggacucaagguguuauacuuuaugcuucuu

SEQ ID NO: 150931 - RNA, 64 nt, Human
ccugccccgacacccagcccagcuugccaauggcggacucaaacgccgcugacugccacccaca

SEQ ID NO: 150932 - RNA, 64 nt, Human
gaaucugaggcgaggacccccaggcuuaccuguaggacucaaagggagccaggaccccaucuga

SEQ ID NO: 150933 - RNA, 64 nt, Human
aaucucagauacuuaugaaaucucacagauguaaggacucaaguguagaagaaaauauccccuu

SEQ ID NO: 150934 - RNA, 64 nt, Human
cccauuucuuaaaagaacaacggucuuuucuucaggacucaaguugcuuuauaaaguugcugga

SEQ ID NO: 150935 - RNA, 64 nt, Human
cggcucuucuccccguguaggggagccccagcauggacucaagggacagagcacuuccagucga

SEQ ID NO: 150936 - RNA, 64 nt, Human
uguguuuuguuaugaaacacgcaagcauaaagcaggacucaagcacaaggcugacuguucuacu

SEQ ID NO: 150937 - RNA, 64 nt, Human
ccccgcaaucugagaacgaacaggaauggagagaggacucaacugggacccacguggaaaagac

SEQ ID NO: 150938 - RNA, 64 nt, Human
uggauagggacaccaggaagaggacaaacugcauggacucaagcgagcuggagccaucuucucc

SEQ ID NO: 150939 - RNA, 64 nt, Human
uuggcacaaagacaaaagcugcagugaaaauuuuggacucaaaaggagguauucuuuugauccu

SEQ ID NO: 150940 - RNA, 64 nt, Human
acaacauauuguuucaguguucaaauaaacugaaggacucaacauuacauuugaacuauauccu

SEQ ID NO: 150941 - RNA, 64 nt, Human
ggaccauggccuccugccacacaacacgcagagaggacucaagacucccgcuggccauggagug

SEQ ID NO: 150942 - RNA, 64 nt, Human
gaccuaaaauuccacuuuaggaguuugucgucuuggacucaacaacuaacaaaaugaaaaggac

SEQ ID NO: 150943 - RNA, 64 nt, Human
ggcuccagacaaugccuuuccuuucuuuuucacuggacucaaguguccaaggcuuuucauccua

SEQ ID NO: 150944 - RNA, 64 nt, Human
gacauugaagggagaaaggcaagaugugcacucuggacucaagaaacucuuaguucaguggagg

SEQ ID NO: 150945 - RNA, 64 nt, Human
ccagguggagccuucucaguuuccagaaauggagggacucaagcugccacuugggccugguuuu

SEQ ID NO: 150946 - RNA, 62 nt, Human
gaucaagaucauucagcaauaaaugcuggaaccaggacucaaccauggcuuuuggauuccgg

SEQ ID NO: 150947 - RNA, 64 nt, Human
gguguggcaggagcucccagcacuggagacccacggacucaacccaguuaccucacauggggcc

SEQ ID NO: 150948 - RNA, 64 nt, Human
gacacgcuccacugaccacccagagcugggccagggacucaacaauggggacagaaguccccca

SEQ ID NO: 150949 - RNA, 64 nt, Human
aaagaagagacagaaaauaccuuauuaucugcagggacucaaagcuguacccaaaucaagaaag

SEQ ID NO: 150950 - RNA, 64 nt, Human
uuaaacacagaaauccugaguucuucucauugguggacucaagcaauucuguagcaaauaaauc

SEQ ID NO: 150951 - RNA, 64 nt, Human
gguuauagccuuugcugguguuuuuaaaauaccuggacucaaugacaaagaccgagucuucuuu

SEQ ID NO: 150952 - RNA, 64 nt, Human
ugcccuguagccuucagaccagagguuuccuccaggacucaaucucugacccagcagaaaugug

SEQ ID NO: 150953 - RNA, 64 nt, Human
cugguagacgcccucaggagccggcugccgggggggacucaacagcagagcucugagcagcagc

SEQ ID NO: 150954 - RNA, 64 nt, Human
cucaccugccgugcguacuggcuguggaccaguaggacucaagguggacgugcguucugccuuc

SEQ ID NO: 150955 - RNA, 64 nt, Human
ucuggccugggugaggaucuggaagcuguuggcaggacucaaccaagcacugcucucuagcucc

SEQ ID NO: 150956 - RNA, 64 nt, Human
aaugauagauauagugacaguaccaagaguaccaggacucaauguuucauaugaagcccuuggu

SEQ ID NO: 150957 - RNA, 62 nt, Human
agugucuucaaaauaauugaaguauuuacaguggacucaacgcagaagaauggacgaaauga

SEQ ID NO: 150958 - RNA, 64 nt, Human
ugcugaggaccagcuguggcugggccaggacagaggacucaacccugcuccucccgguaggcca

SEQ ID NO: 150959 - RNA, 64 nt, Human
cugaagcccauccugcacacuuacuggaugcuuuggacucaacaggacauauguggccuugaag

SEQ ID NO: 150960 - RNA, 64 nt, Human
agaucuacauuucuuuggacacugcacuugauagggacucaaagaauguuauauuuuuaauuaa

SEQ ID NO: 150961 - RNA, 64 nt, Human
cucuuaagacuccuagggauguggugaagagcugggacucaagugcaguccacggugugaaaca

SEQ ID NO: 150962 - RNA, 64 nt, Human
aggacccugagggcucagccagggaggggucccaggacucaacugggccccguuucuaggaagu

SEQ ID NO: 150963 - RNA, 64 nt, Human
ggugagccuguacagaagcuggaggcagcauaaaggacucaaggaccacagccucugcccacca

SEQ ID NO: 150964 - RNA, 64 nt, Human
uuuucaaucacacuuuguggaaaaacauuuccagggacucaaaauuccaaaaagguggucaaau

SEQ ID NO: 150965 - RNA, 64 nt, Human
uuuacuggggucaaaucuuaaagcacacagcucuggacucaagacaggagguuugcguccugau

SEQ ID NO: 150966 - RNA, 64 nt, Human
cguucuuugguacacaguucugguguuccuaccaggacucaagagacaccccuuccugcugaca

SEQ ID NO: 150967 - RNA, 64 nt, Human
aaaccaaaaugugggccaugaaauuagcaaccugggacucaauaauacacuugggaauauucuu

SEQ ID NO: 150968 - RNA, 64 nt, Human
cugcagugaaaaauaauuccacuuacacagugggggacucaaagucagccacauuucacauacu

SEQ ID NO: 150969 - RNA, 64 nt, Human
agaguaaguccuguaaacacagaauuaaauuaggggacucaagcaacuauuauuauauuucucc

SEQ ID NO: 150970 - RNA, 64 nt, Human
uaccuugucaagcaagaaugucgucuucuccuauggacucaauugcuauuauuuuaaaccugca

SEQ ID NO: 150971 - RNA, 64 nt, Human
gguagacugggaguccugaccacgcaggcccuggggacucaagaccccugguuacccccacuca

SEQ ID NO: 150972 - RNA, 64 nt, Human
cugcucagcagcucugucccgggacagucaggguggacucaaucuuucugguucuccacagaag

SEQ ID NO: 150973 - RNA, 64 nt, Human
gaagucgccuggguuuuguaaaggagaauuuuuuggacucaagcugucaucuucaagcacgcca

SEQ ID NO: 150974 - RNA, 64 nt, Human
uaugacagcucuuccagcaaaggcaaaaagagccggacucaaaaggagaagaaagcugcucgug

SEQ ID NO: 150975 - RNA, 64 nt, Human
uaccuuuuuuuaucagaaaaaaauuuuaccauuaggacucaauuugaaguacuaaugcuucuca

SEQ ID NO: 150976 - RNA, 64 nt, Human
acgcaauccuaacugacuguaaccucaaacuccuggacucaagccaucucccuaccuuggccac

SEQ ID NO: 150977 - RNA, 64 nt, Human
uauauaagcaaacacuacuuuuuuuaaaacgucuggacucaaaaaaugcuuuguuccauguuuu

SEQ ID NO: 150978 - RNA, 64 nt, Human
cucuugcccuccuggcuuuauguuuauggggagaggacucaauagcuccaccccuucuggcacc

SEQ ID NO: 150979 - RNA, 64 nt, Human
aucucuuguucuuuaauuuuagggucuuguuccaggacucaaaucaguaacuuggugauuacaa

SEQ ID NO: 150980 - RNA, 64 nt, Human
ggcugcaccucuggcuagagccgaggggagagagggacucaagggaaaggcaagcuugaggcca

SEQ ID NO: 150981 - RNA, 64 nt, Human
uuaacaggcaagguccugggcauugcgcgacgcaggacucaaugcuaaagcaagccugccuggc

SEQ ID NO: 150982 - RNA, 64 nt, Human
cuguagugaaugaugugucaucauuuugagcuuuggacucaauaucuuuaguguuucccuaaau

SEQ ID NO: 150983 - RNA, 64 nt, Human
ugugggccucaaggacuugaaagcauccauguguggacucaaguccuuaccucuuccggagaug

SEQ ID NO: 150984 - RNA, 64 nt, Human
gcagggugcuauugugaggccaucucugagcaguggacucaaaagcauuuucaggcaugucaga

SEQ ID NO: 150985 - RNA, 64 nt, Human
uccacaggaagugaagaaucuguuucccagcaguggacucaaaacccaucugggcuccuaaccu

SEQ ID NO: 150986 - RNA, 64 nt, Human
cacaucuuggcacauuuaagagacagucaccccaggacucaaaaauagggaaguaacaguaacg

SEQ ID NO: 150987 - RNA, 64 nt, Human
cuuucuagaaaaagccuaacaaacagauaagguaggacucaaccaacugaaaccugacuuuccc

SEQ ID NO: 150988 - RNA, 64 nt, Human
gcugugaacagggagaugggggaggggggauggaggacucaagggauguaagggauauggcuug

SEQ ID NO: 150989 - RNA, 64 nt, Human
ggcugggcuucaguggcagcugcuuuugucuaugggacucaaugcacugacauuguuggccaaa

SEQ ID NO: 150990 - RNA, 64 nt, Human
uccugagugucagugacuugggauucccacccagggacucaagccagccacccccuucuuuccc

SEQ ID NO: 150991 - RNA, 64 nt, Human
ucugguagauguccaugcccaugugcuccugcugggacucaauucaggcuauguaugacuauga

SEQ ID NO: 150992 - RNA, 64 nt, Human
uccaccuccuaggcucaagcuuccuaaguaguugggacucaaggcuugagucaccaugccaggc

SEQ ID NO: 150993 - RNA, 64 nt, Human
cucucaagcgucaccccaggggcgucaguuuuacggacucaaggucaccucaggaagaggcagg

SEQ ID NO: 150994 - RNA, 60 nt, Human
cccacuuugcucccugcugaccagguccccggacucaagccccggacucaggcccccacc

SEQ ID NO: 150995 - RNA, 64 nt, Human
accacagcaagccaucauccuccauugcucccggggacucaagaggaaucuguuucucugcugu

SEQ ID NO: 150996 - RNA, 64 nt, Human
ucgaaugcucggugucuggguggcagcugagcugggacucaagguggcucuuggaaccugggag

SEQ ID NO: 150997 - RNA, 64 nt, Human
uguggggaagggagggguuacuccuccuccaaugggacucaaggacuugaccuccaggaguagg

SEQ ID NO: 150998 - RNA, 64 nt, Human
aagaugauagagagccuagggggaugagucuauuggacucaaagguuacauuuuguuuuuccau

SEQ ID NO: 150999 - RNA, 64 nt, Human
aacaguccgaagccuaggauaugagggcugaggaggacucaaaccguugcagucagagagacac

SEQ ID NO: 151000 - RNA, 64 nt, Human
ccuguaccccaguccugaagccccugcaguggcgggacucaagcuccugaccuuugcccggccu

SEQ ID NO: 151001 - RNA, 64 nt, Human
cuuuuaaaacaaguaguucaugaaagaagcuguuggacucaacauagaguagaguaacuaucuu

SEQ ID NO: 151002 - RNA, 64 nt, Human
ugagcucuucuucauucucacccugaucccugggggacucaaagccaaaacugcccaaagagga

SEQ ID NO: 151003 - RNA, 62 nt, Human
acaugaagaaaccuuuauaaagauuguucaaaugggacucaaucugacuaggcuugcuuuga

SEQ ID NO: 151004 - RNA, 64 nt, Human
ccugguugccaggggcugggguccaggcaucuguggacucaaggaguccaggugacgguguugc

SEQ ID NO: 151005 - RNA, 64 nt, Human
ggcacccaguugcccuuggccaccaccuguggcaggacucaagcuccucuucugcaaauguucc

SEQ ID NO: 151006 - RNA, 64 nt, Human
aggcaccagcauggagaccucaugacaaaggaagggacucaaagcagcaaugccccucauagug

SEQ ID NO: 151007 - RNA, 64 nt, Human
uucugaugcgauuuuucuguacaguaugaaauugggacucaacucuuugaaaacaccuauugag

SEQ ID NO: 151008 - RNA, 64 nt, Human
gaauaaccgccacccuugccauccugcaacagcuggacucaaguuuccaggaaguggagaugug

SEQ ID NO: 151009 - RNA, 64 nt, Human
aaguugcuucucauggauggcacugcuuuucugaggacucaagggccaagauggaggggcugac

SEQ ID NO: 151010 - RNA, 64 nt, Human
acuuauaagugggagcuaaacauugauuacacauggacucaaagaagggaacaguagacacggg

SEQ ID NO: 151011 - RNA, 64 nt, Human
guggugccacagcucacugugaccuugaccuucuggacucaagugauccuccugccucagcuuc

SEQ ID NO: 151012 - RNA, 64 nt, Human
gcccugguugagggggguuagggaggagugagugggacucaaauccagaugccuuccccguccg

SEQ ID NO: 151013 - RNA, 64 nt, Human
ccccuccgcggugggggcuuggaggugggcggcuggacucaauccacccuggggggcuccuuuc

SEQ ID NO: 151014 - RNA, 57 nt, Human
auauggugauuguugguuaagagacuuggacucaagucauaggcuucuuucagucuu

SEQ ID NO: 151015 - RNA, 64 nt, Human
ugcuuggguagccuugaagucaccagaauaacuaggacucaaauucagaccaaaccaggacuag

SEQ ID NO: 151016 - RNA, 64 nt, Human
gaggacuaagaagcaagauugggccacacugucuggacucaaagcccagcuccaccacugagca

SEQ ID NO: 151017 - RNA, 64 nt, Human
ggccgucccgucccacacuccccugggcauucuuggacucaaggccggggcucugcguggcuug

SEQ ID NO: 151018 - RNA, 64 nt, Human
aagcagcuuuagccucauagaauauuauuucuuuggacucaagcugaaauacaagccuuacauu

SEQ ID NO: 151019 - RNA, 64 nt, Human
acuuggucagagaugcugugcuucuuggaagcaaggacucaaaggcaaggugcacgcagaggac

SEQ ID NO: 151020 - RNA, 64 nt, Human
ucuuccauguugcccaggcuggucucgaacuccuggacucaagcaauccgcccaccuugacuuc

SEQ ID NO: 151021 - RNA, 64 nt, Human
cucaauuucccgcacagugccuagcacauagcaaggacucaacaaauuucauugaaugaaugaa

SEQ ID NO: 151022 - RNA, 64 nt, Human
guccucaguguguuuuuggucugguuguagggaaggacucaaguccuggaauguccuccacugg

SEQ ID NO: 151023 - RNA, 64 nt, Human
cucagacccagacuuagaacaaaaggaggagugaggacucaaggcuacaaugagguuccaguac

SEQ ID NO: 151024 - RNA, 64 nt, Human
aucacagcucaccucagugcggccuugaacuccuggacucaaucgauccucccaccucugccuc

SEQ ID NO: 151025 - RNA, 64 nt, Human
aucacagcucaccucagugcggccuugaacuccuggacucaauugauccucccacuucugccuc

SEQ ID NO: 151026 - RNA, 64 nt, Human
ucaagaaaaugacggagaacaucccagacagaugggacucaagcaggaugggugcuauauccaa

SEQ ID NO: 151027 - RNA, 64 nt, Human
aguaaugucaguggaaguuagggaaaagauucuuggacucaauuuuagaaucaaaagggaaagg

SEQ ID NO: 151028 - RNA, 64 nt, Human
acucagccucaauaagccuugucguugacuuuagggacucaauuucuccccaggguggaugggg

SEQ ID NO: 151029 - RNA, 64 nt, Human
aaugguuacuaucuauguuagugaaaaucaaauaggacucaaaguuggauauuugggauuuuuc

SEQ ID NO: 151030 - RNA, 64 nt, Human
uucucuuaaagccauuuccaugaugaugaugaugggacucaauuguauuuuuuauuucagucac

SEQ ID NO: 151031 - RNA, 64 nt, Human
gucagguagguaguucaaucuaguuguuagccaaggacucaaggacugaauuguuuuaacauaa

SEQ ID NO: 151032 - RNA, 64 nt, Human
ucaaguguguauucacacauuuacuuaaaucaagggacucaaugcuugcuuuuauuuuaaccau

SEQ ID NO: 151033 - RNA, 64 nt, Human; identical to SEQ ID NO: 151029

SEQ ID NO: 151034 - RNA, 64 nt, Human
ccuuauuccucccucauaccuagccauuucuccaaggcgcaaauggcccuggcuucauuuauuc

SEQ ID NO: 151035 - RNA, 64 nt, Human
cuccugccuggguuucauucuggcuaucccucuaaggcgcaaggugaagaagcuucugggccag

SEQ ID NO: 151036 - RNA, 64 nt, Human
gccccagcagcagguccuggugcuggcggagcccaggcgcaagccaucuaccuucuggcacagc

SEQ ID NO: 151037 - RNA, 64 nt, Human
gugagugguguccuuuggaggcaugguggaugaaaggcgcaaaggaagcaagagguuaaagaua

SEQ ID NO: 151038 - RNA, 64 nt, Human
gggcguggccaccacagagcacauggcugugucuaggcgcaagcacuuuagcaguaucuguuua

SEQ ID NO: 151039 - RNA, 64 nt, Human
acucugcaacucuuaaaaauaaauguaaugugccaggcgcaaugggauaugccugcaggcccag

SEQ ID NO: 151040 - RNA, 64 nt, Human
gguggaaccugcagaggccagcccggggcuggggaggcgcaaggagaggagggauccagugggg

SEQ ID NO: 151041 - RNA, 64 nt, Human
uccaccccgcaagcaccauccccuccggcuaagcaggcgcaagggaggcccagcgcggacaucc

SEQ ID NO: 151042 - RNA, 64 nt, Human
gugcccugagcaggaagaugugccacuuccuagcaggcgcaaggccugugcggaagaaacgccg

SEQ ID NO: 151043 - RNA, 64 nt, Human
uucucgugacccgggcggugcgggugggggcgggaggcgcaaggugucgguuuugauaaaaugg

SEQ ID NO: 151044 - RNA, 64 nt, Human
gcauugauucccaguuccagggaugaucaugagcaggcgcaaaaucagaauuaaaggucgcaca

SEQ ID NO: 151045 - RNA, 64 nt, Human
cucaaaucauggauuaggaguaaagaaagaggccaggcgcaauggcucaugccuguaaucccag

SEQ ID NO: 151046 - RNA, 64 nt, Human
ugucugcucaguagaaccuugcaggugcuguagcaggcgcaagaccguagaucucaggccucua

SEQ ID NO: 151047 - RNA, 64 nt, Human
cuugaugucggaucucuucaacaagcuggucaugaggcgcaaggguaggaggcagggccgcugc

SEQ ID NO: 151048 - RNA, 64 nt, Human
uauucuuccccgaaucacacagacaguuucugacaggcgcaacuccuccauuuuccucccgcag

SEQ ID NO: 151049 - RNA, 64 nt, Human
uccagcuggcagaauuaauuguuauuauuuuccuaggcgcaauuuccuuaaacguacaguuuaa

SEQ ID NO: 151050 - RNA, 64 nt, Human
agcagccaagccuagagcccuccggaucccauccaggcgcaaagaggaauaggagggacaugga

SEQ ID NO: 151051 - RNA, 64 nt, Human
caccugcuucggccucccaaagugcugggauuacaggcgcaagccacccagcccagcuucuuuc

SEQ ID NO: 151052 - RNA, 64 nt, Human
ggcauggcgauggugcgccuguuccacacccagcaggcgcaaccagagucucgugugugccgac

SEQ ID NO: 151053 - RNA, 64 nt, Human
cguggucccuuugacgggccggccaccguguccgaggcgcaacgcuaggccuccaggccacgca

SEQ ID NO: 151054 - RNA, 64 nt, Human
ccaucugucacgugguucaccaucaucaggcaccaggcgcaaacugcuucccgcuguuggccau

SEQ ID NO: 151055 - RNA, 64 nt, Human
uuuuuugugagacggaguuuugcucuuauugcccaggcgcaaucucggcucacugcaaccucug

SEQ ID NO: 151056 - RNA, 64 nt, Human
agcucuuccugucagggaucagggcagcacuaacaggcgcaaaaguagagcugucaagaugggc

SEQ ID NO: 151057 - RNA, 59 nt, Human
cagagcuugaacacgcguagacuggggucccgcccgacgugucuacgucggcugaagag

SEQ ID NO: 151058 - RNA, 54 nt, Human
aacuaccccaugaggccugaggagccgcccgaaggucgcggugaccuggugccu

SEQ ID NO: 151059 - RNA, 64 nt, Human
aaggcagcucgguaaaguuucccuccugcuccccccgcccgacuuugacucugaaucagcauuu

SEQ ID NO: 151060 - RNA, 64 nt, Human
cgccuagagcugugcagccggcucgaacgagaggccgcccgacuugcagaccuagguugagcag

SEQ ID NO: 151061 - RNA, 64 nt, Human
gcagacccccgcgcacaccagaaccucuggcaagccgcccgacugcaacugcugacccugcaga

SEQ ID NO: 151062 - RNA, 64 nt, Human
cagccaaaaaguuggagugaaaagacccuggcacccgcccgacaccugcgugagcccuaggauc

SEQ ID NO: 151063 - RNA, 64 nt, Human
uucacacggcggcuucggaccaacucccucacucccgcccgaggggcaggccucaaagcccgcc

SEQ ID NO: 151064 - RNA, 64 nt, Human
ggcaccaaacagcccaggacugccgagacucuggccgcccgaaggagccugcuuugguacuaug

SEQ ID NO: 151065 - RNA, 64 nt, Human
ugcugcucuuuccuggaagcuaagccugucuccaccgcccgaggccugcgccgguggcucccgc

SEQ ID NO: 151066 - RNA, 64 nt, Human
ucucacaggucggugcgcucgcucuccgcguuccccgcccgacugccgugcaguccauggcuag

SEQ ID NO: 151067 - RNA, 64 nt, Human
gcucuccaacauccuccacgccuccgccagccucccgcccgaguaccagaaccgcacggagggg

SEQ ID NO: 151068 - RNA, 64 nt, Human
cuuucccuuaggauagggcuauauuggcaaaaugccgcccgaacagacugcugacaguaaacca

SEQ ID NO: 151069 - RNA, 64 nt, Human
ucuccaagcggcccccgggcagccccagagcaccccgcccgacucccauuaaccucgagaaccu

SEQ ID NO: 151070 - RNA, 64 nt, Human
uuucccggagcguggagaggcagugcugcugcucccgcccgaggcucaugacaacucaauaaag

SEQ ID NO: 151071 - RNA, 64 nt, Human
uccaguuccgggagagcggcugcccgacucagguccgcccgaccaggaucagccccgcuccucc

SEQ ID NO: 151072 - RNA, 64 nt, Human
uuccauuucugcagcuuagcuuguguccugcccuccgcccgaggcaaaacguauccugaggacu

SEQ ID NO: 151073 - RNA, 64 nt, Human
agcaacucaguuguaacuuggggaaguuaacgauccgcccgagugcagaggaaaaccagaaacg

SEQ ID NO: 151074 - RNA, 64 nt, Human
gucgcccgcgcccgggaacccugacgcucagcucccgcccgacggcagcgccgccgccgcccag

SEQ ID NO: 151075 - RNA, 64 nt, Human
uaccaggugcucugaggggaugguggccgcccacccgcccgagggauggugccccuaggguccc

SEQ ID NO: 151076 - RNA, 64 nt, Human
aaguccguguccuaccuccgucuucgccaaggccccgcccgagccuaguuguucucccccugaa

SEQ ID NO: 151077 - RNA, 64 nt, Human
cccuaacauaaguuuucacuguggugggauggugccgcccgauaugcuugauaugcuuuuccuu

SEQ ID NO: 151078 - RNA, 64 nt, Human
cgccucuuauuuaugaagucuuugaccgucccccccgcccgaccccaccgcccucccgccccca

SEQ ID NO: 151079 - RNA, 64 nt, Human
gccugucauccauggggccauugcaggcacucugccgcccgaccuugagggcugugccaauccu

SEQ ID NO: 151080 - RNA, 64 nt, Human
acggcugcugcggaaaggaaacccccuccccgacccgcccgacggccucaggccccgccuccaa

SEQ ID NO: 151081 - RNA, 64 nt, Human
gaugcugagcauguaccgcaggccagggcaggccccgcccgaccaggaggcccugcagguaaua

SEQ ID NO: 151082 - RNA, 64 nt, Human
gggcagcuccggccaggccuuguaggaaaaggccccgcccgagguuccagcgucaacggccacu

SEQ ID NO: 151083 - RNA, 64 nt, Human
gcgggcgcagggacccaacccggugucgcugcacccgcccgagccccgcuccucgcagccgccu

SEQ ID NO: 151084 - RNA, 64 nt, Human
ccugacgggagucgcggccccaccgaggcgucggccgcccgaagagccucccaagccagcgcgg

SEQ ID NO: 151085 - RNA, 64 nt, Human
cuugccuuagaaaaggagaaaggaauuccuuuucccgcccgaacaugaagaaaaaugaccugac

SEQ ID NO: 151086 - RNA, 64 nt, Human
gccccacuauuucuagcuccacaaguguguggccccgcccgagccccugcccacgcccuuggag

SEQ ID NO: 151087 - RNA, 64 nt, Human
ggagagcugagccgcgggcagccaggcccagcccccgcccgagcucaggcugccccucuccuuc

SEQ ID NO: 151088 - RNA, 64 nt, Human
ccccaccccaugacuauugugcgauucgugagcgccgcccgagcggaguugguaacuuguuggg

SEQ ID NO: 151089 - RNA, 64 nt, Human
uuccuuuauagcgaagcaaaaaacacaagacccuccgcccgaguaaauucuucagccacgaagg

SEQ ID NO: 151090 - RNA, 64 nt, Human
uguuccuuccucugaaucgaauggaugugggugaccgcccgaaggccuucacaggauggaagua

SEQ ID NO: 151091 - RNA, 64 nt, Human
cuuggagagacugucauggaagaggguggagccgccgcccgaagcgccgaggaggcugagccac

SEQ ID NO: 151092 - RNA, 64 nt, Human
gaccgcguuccucagccuccucuccuaggucccuccgcccgacaguugugcuuuguugugguug

SEQ ID NO: 151093 - RNA, 64 nt, Human
gggccagguauagaaaccgcagugggccugcaagccgcccgagccuccccagcagccuccuaca

SEQ ID NO: 151094 - RNA, 64 nt, Human
cauugcugcuccuuagcugccaagccccauccugccgcccgagguggcugccuggagccccacu

SEQ ID NO: 151095 - RNA, 64 nt, Human
cacguugcacacgcagucugcagagccgccgccgccgcccgaaccagcccggaucugagggccc

SEQ ID NO: 151096 - RNA, 64 nt, Human
accuccacccccgccacggccacccuccuucccgccgcccgaccccgagucgggaggacuccgg

SEQ ID NO: 151097 - RNA, 64 nt, Human
gccggugacacggccgcaccugccccaaagcgggccgcccgagcguccacuccaagccugagca

SEQ ID NO: 151098 - RNA, 57 nt, Human
aaucaaggagagcuaaguccaccauuccgucgagacuuacaggcuuacgcugggcgu

SEQ ID NO: 151099 - RNA, 57 nt, Human
gacucuagccuggacaguggccaggaccgucgagaccaccagagcuaccuccccggg

SEQ ID NO: 151100 - RNA, 57 nt, Human
agcucugugucucagacggggcccucccgucgagaagcugguagucagugagugaga

SEQ ID NO: 151101 - RNA, 57 nt, Human
caagggcaaagauaacucuuaaaaaaccgucgagauuacaaugcucuagaaucagca

SEQ ID NO: 151102 - RNA, 57 nt, Human
gcuuugugaguacacagcuaacagaugcgucgagaccugagaugugcucguuuuuau

SEQ ID NO: 151103 - RNA, 57 nt, Human
aaauggcugagcuuugauaccuggggucgucgagaggcugcgggcuggcggcagucc

SEQ ID NO: 151104 - RNA, 57 nt, Human
aaaaacaaacaaacaaacagaaagcaccgucgagaaauggcuccagcgcugacuagc

SEQ ID NO: 151105 - RNA, 57 nt, Human
uuauacuauuuuuggauugugacuauccgucgagagugaugguuuuuaucugucuuu

SEQ ID NO: 151106 - RNA, 57 nt, Human
gcaugaaagaacuggaaacgcuccuuacgucgagauguuggaccuugaagcccuccu

SEQ ID NO: 151107 - RNA, 57 nt, Human
agacgaagagagauugcagagagagagcgucgagagcgagaacgcauuagaauaauu

SEQ ID NO: 151108 - RNA, 57 nt, Human
auuccaccuuggaguuggaacccugggcgucgagacaggaaggcagggcgcaguggu

SEQ ID NO: 151109 - RNA, 57 nt, Human
ucuugucgaacaggggggcgugguucucgucgagagugcauucacacucuuguuccc

SEQ ID NO: 151110 - RNA, 57 nt, Human
agacccgcgccaucggccuccaguuugcgucgagaauuccuggaagggcccugauau

SEQ ID NO: 151111 - RNA, 57 nt, Human
ggcagcugagggggcccugcauuugaccgucgagacugcagcagcgccuuuccuguc

SEQ ID NO: 151112 - RNA, 57 nt, Human
ggcuucaaguccagagcugccugucuccgucgagaacaucaagcaggaaacagacga

SEQ ID NO: 151113 - RNA, 57 nt, Human
ugccacucggaacagcgaguccucugccgucgagagcagggagggguaggguggaca

SEQ ID NO: 151114 - RNA, 57 nt, Human
ggaccccagcgcugcgccgcguccgaacgucgagaccccaccgagggcgggaggggg

SEQ ID NO: 151115 - RNA, 64 nt, Human
aggguuuuguggugccuggagccuguguccugcccugcuacaguagugauuaauagugucaugg

SEQ ID NO: 151116 - RNA, 64 nt, Human
cguucuguucugcugggaguucuagaaccacuuccugcuacaggaggggucucauguccugcug

SEQ ID NO: 151117 - RNA, 64 nt, Human
gcgccucucgucguggccuccuggacucaaacuccugcuacauccuucuccgucccccaucccu

SEQ ID NO: 151118 - RNA, 64 nt, Human
aggaccauucaugcaaugacuauuucuaaagcaccugcuacacagcaggcuguacacagcagau

SEQ ID NO: 151119 - RNA, 64 nt, Human
aauugcuaaauuccaaacagaaccagugacuuugcugcuacauauuuacuaaauugaccacuuu

SEQ ID NO: 151120 - RNA, 64 nt, Human
gggggugggguguuucugauguuauuccagccuccugcuacauuauauccagaaguaauugcgg

SEQ ID NO: 151121 - RNA, 64 nt, Human
ugcagaagagcucugguacugaauggucaaaaaccugcuacagccugaugcuuaacuauuuccc

SEQ ID NO: 151122 - RNA, 64 nt, Human
uaccugcaucugaaaaaaaaucuauagacuccagcugcuacauuagagcauaagagaugcucuc

SEQ ID NO: 151123 - RNA, 64 nt, Human
auugggaagguagaggcuggcagggaagacaaaucugcuacaaguccaugggaagacccuacaa

SEQ ID NO: 151124 - RNA, 64 nt, Human
agacaccucuaaucuggauguuaagaaugaaguucugcuacauuauaauguacagaagagcaaa

SEQ ID NO: 151125 - RNA, 63 nt, Human
uggaaguaaggagcugguagccuaccuacacagcugcuacaaaaaccaaaauacagaauggcu

SEQ ID NO: 151126 - RNA, 64 nt, Human
ugaagcagaagaucgagcaggagcuccgggucaacugcuacaugccggccaauggcgagacggu

SEQ ID NO: 151127 - RNA, 64 nt, Human
cucugggcaagucacucucccucucugggcaugucugcuacaaauggacaagauuauuucagag

SEQ ID NO: 151128 - RNA, 64 nt, Human
uuuuauuaccuuuuucaauucaacaagcaacuuucugcuacauacuuacuccgguugggugcug

SEQ ID NO: 151129 - RNA, 64 nt, Human
cucggugucugagaaguuuugucugcagcucauccugcuacagaaugaacuccuuguaauucua

SEQ ID NO: 151130 - RNA, 64 nt, Human
uccaugcccagaugaaaaggaagaguaucugucacugcuacauaguuccuuaauuugacuguaa

SEQ ID NO: 151131 - RNA, 64 nt, Human
uguuuuaaagaaugccauagauguugauucuuaacugcuacagauaaccuguaauugagcagau

SEQ ID NO: 151132 - RNA, 64 nt, Human
acaggagggcggccuccuucugagcuccuguccccugcuacaccuauuaucccagcugccuaga

SEQ ID NO: 151133 - RNA, 64 nt, Human
uaucuucuuuuaccuaucaauauucauugaacugcugcuacauccagacacugugcaaauaaau

SEQ ID NO: 151134 - RNA, 64 nt, Human
ucaacugccccaaaucucuuaauagcuucuagugcugcuacaaucuaagucaggucaccagagg

SEQ ID NO: 151135 - RNA, 64 nt, Human
ggcugugcauccugcccugucccggguuugcgcgcugcuacagagcuucacgcucuccgcucca

SEQ ID NO: 151136 - RNA, 64 nt, Human
cugcuugguaggaaugaccagggcaggaugccaccugcuacacucuugccugucccagagcccu

SEQ ID NO: 151137 - RNA, 64 nt, Human
aaaucuuguaguuucuuuuuauauuagcuccucacugcuacagccuagaaggugagaagcagau

SEQ ID NO: 151138 - RNA, 64 nt, Human
aauuuaucuugucucugggcuuggggcuuccuaacugcuacaaauacucuuaggaagagaaacc

SEQ ID NO: 151139 - RNA, 64 nt, Human
aagccuguauggcuucugcccagaacucuguccccugcuacaugucuaaguuuacuuguauuua

SEQ ID NO: 151140 - RNA, 64 nt, Human
ugccuucccgcuuaucaaggagaccgcugccauucugcuacagauggucccaaaaggagucaac

SEQ ID NO: 151141 - RNA, 64 nt, Human
cauuuuauggaagagcgacucucuggagcuacuccugcuacaauccagguucuccucagucuga

SEQ ID NO: 151142 - RNA, 64 nt, Human
accacuggugagugcuccauaguuuccuuaccugcugcuacagaauguuauuuuacaucccuau

SEQ ID NO: 151143 - RNA, 64 nt, Human
aucugcacuaauugacccaaaacguggguauuuccugcuacacaaaagccaaaagguuucaugu

SEQ ID NO: 151144 - RNA, 64 nt, Human
cuaagcuaccaaaguuauucugaaaguaugggaacugcuacaacuaacaaacauuuguuuccaa

SEQ ID NO: 151145 - RNA, 64 nt, Human
uccagcacugcuguuuaccuugcagaaggaggcacugcuacaaccauggugucuaaagauauag

SEQ ID NO: 151146 - RNA, 58 nt, Human
aaaaaaacuguggacuauaagaaauuaucugcuacauaaauuauugaagcuuuucaga

SEQ ID NO: 151147 - RNA, 64 nt, Human
gaaggggagcaccgggcgagugcaugugcuacugcugcuacaggccugucuaucuguuugucug

SEQ ID NO: 151148 - RNA, 64 nt, Human
aggccauguagaaaauuuauuaaaacuacuaugacugcuacauucaggaauaugccagugguaa

SEQ ID NO: 151149 - RNA, 64 nt, Human
ucccuucuaaacauguguaauaacuauacagagacugcuacaaaauuguauauaguuuuuggau

SEQ ID NO: 151150 - RNA, 64 nt, Human
cugguaacagcuaugcagggagggaggacccacacugcuacacuucugauccccuuugguuuua

SEQ ID NO: 151151 - RNA, 64 nt, Human
gagagagugcugggcagauggauggugagcaccacugcuacagagcacccagugauuuuacuga

SEQ ID NO: 151152 - RNA, 64 nt, Human
cuccuacaagcaaccuccacgcagacaccucguacugcuacaggugugucauuuccuuuaauag

SEQ ID NO: 151153 - RNA, 64 nt, Human
uuuacaaaugagcagagaauacgguuuugguguccugcuacaaaaagacaucggucaguaacga

SEQ ID NO: 151154 - RNA, 64 nt, Human
ccauaggacuuuauuuucaugauaucuguaaucacugcuacaaucagcucaccugaucaucugu

SEQ ID NO: 151155 - RNA, 64 nt, Human
uccauaguuccagaauuuucucagccaucugguucugcuacagcguaaaauuagacuggaaaua

SEQ ID NO: 151156 - RNA, 64 nt, Human
uuaagucucucguaguguuaaguuauagugaauacugcuacagcaauuucuaauuuuuaagaau

SEQ ID NO: 151157 - RNA, 64 nt, Human
cccaugggcucugacagaaagcagauaccucacccugcuacacauacaggauuugaacucagau

SEQ ID NO: 151158 - RNA, 64 nt, Human
ccucuuccaaaaggggacacagaagcacuggcugcugcuacagaccgcaaaagcagaaaguuuc

SEQ ID NO: 151159 - RNA, 64 nt, Human
gauaucaugcaaauuucaugaccaguaaaggcugcugcuacaauguccuaacugaaagaugauc

SEQ ID NO: 151160 - RNA, 64 nt, Human
uaccuuuguuaccuacaacuuaggagcuaggccucugcuacaagcacuugaaaaugauauuuuu

SEQ ID NO: 151161 - RNA, 64 nt, Human
uuuguucugcccagugauaacaaugggauaacgccugcuacacaucuucauugugaaacccuuc

SEQ ID NO: 151162 - RNA, 64 nt, Human
cccacaugguucucccacugcccugucugcucugcugcuacagaggggcagggccucccccagc

SEQ ID NO: 151163 - RNA, 64 nt, Human
caccagcacugaggggcccagcuggagaaugauucugcuacaaaaggagacaguugagacuuuu

SEQ ID NO: 151164 - RNA, 64 nt, Human
ucaggucauauggagaccugcaaugcacccaguacugcuacaucgacuccacgcccugccgcua

SEQ ID NO: 151165 - RNA, 64 nt, Human
aggucuuagaauuagaaacuuugauggguuaacucugcuacaugguuaaaagagauuuucuuug

SEQ ID NO: 151166 - RNA, 64 nt, Human
ggagagguaugugccccuccugggugcucaccgccugcuacacaggcaggaaugcgguugggag

SEQ ID NO: 151167 - RNA, 64 nt, Human
uguuucccugcugaccuucuucccaccuguugcccugcuacacuccccucgcuaagacaguaaa

SEQ ID NO: 151168 - RNA, 64 nt, Human
gaccucuguucugugaggaaccagggagggggcacugcuacaaugcauugaaugcaucuuuguu

SEQ ID NO: 151169 - RNA, 64 nt, Human
ccacuucagcgcugaguucaguauacacaagugucugcuacagucgccaaaucaccaguauuug

SEQ ID NO: 151170 - RNA, 64 nt, Human
gcuacgccacagacauguggagcaucggggucaucugcuacauccugugaguccuggggcacuu

SEQ ID NO: 151171 - RNA, 64 nt, Human
ggaaggugcugcaaaaccauagggaaaaaguucacugcuacaaagggaucccaacccacuggag

SEQ ID NO: 151172 - RNA, 64 nt, Human
cgcuccgcgcagcugagcgccccgcaucucgcgccugcuacaucaaagggcccgcgcacaaagc

SEQ ID NO: 151173 - RNA, 64 nt, Human
guaugagucuaaccuuguuugacauucaggucuucugcuacauuaucuucuuugagaaaaauua

SEQ ID NO: 151174 - RNA, 64 nt, Human
uugagaguggggaggacacagucuggacuugauccugcuacagauucaacauaugacuggacaa

SEQ ID NO: 151175 - RNA, 64 nt, Human
ccugcccugugaauuacugcuacaaucaaggccacugcuacaucucccagacucugggcuguca

SEQ ID NO: 151176 - RNA, 64 nt, Human
uccugugucagaaccaguccugcccugugaauuacugcuacaaucaaggccacugcuacaucuc

SEQ ID NO: 151177 - RNA, 64 nt, Human
accuccacaguagcauuucuuauuuguuuggucacugcuacaccuuagcagcucuuccccuuuc

SEQ ID NO: 151178 - RNA, 64 nt, Human
aagguagcaaaauaauagugaagauggaauaugucugcuacaaaugcuuauuuuuauuguugcu

SEQ ID NO: 151179 - RNA, 64 nt, Human
ggcuggagcagaagggccaagagggccuguggaacugcuacagaaaaggaaguguuguucugag

SEQ ID NO: 151180 - RNA, 64 nt, Human
uaugguuguuuuuguuuuccucccucuccucuggcugcuacaacuuccccuuucugguacaaga

SEQ ID NO: 151181 - RNA, 64 nt, Human
caugaaaucugcuucuuagagaggcuauauuuuucugcuacaaauauuuuauauuuauagcaaa

SEQ ID NO: 151182 - RNA, 64 nt, Human
caucaccucuggagucccgucuggacgucccuuccugcuacaggaauaaugaggcgugggcugc

SEQ ID NO: 151183 - RNA, 64 nt, Human
uuuauccugucauuaaaaaaaaaagacuguuauccugcuacacacuccugugauuucauucucu

SEQ ID NO: 151184 - RNA, 64 nt, Human
aaugggcauaucaaaacugaugacuuuuuccuuccugcuacauggguaacacuuaguuguuugu

SEQ ID NO: 151185 - RNA, 64 nt, Human
ggaccuaguaucugcaguccauguuggccacuaacugcuacauaauuacuuucaauuuccucca

SEQ ID NO: 151186 - RNA, 64 nt, Human
ugaaaagguucugucaagauuuucacuguaauggcugcuacagagauggaccaucuucaucauc

SEQ ID NO: 151187 - RNA, 64 nt, Human
cccugcauugcuuuuccuuuuaaaaaguauaggucugcuacaauagcaaaugcacguacguggg

SEQ ID NO: 151188 - RNA, 64 nt, Human
cugucaucugcugcgauccggcagccucucuucacugcuacaugugcuggaaggacaaauaaau

SEQ ID NO: 151189 - RNA, 64 nt, Human
aaucuucccucaaagaucuuaaugaguaaaacaacugcuacauacauaugcagaauguguaaua

SEQ ID NO: 151190 - RNA, 64 nt, Human
aggcgugccucguggguucuuccucuguuacauccugcuacacucauccgcaggucaccuuagu

SEQ ID NO: 151191 - RNA, 64 nt, Human
cccccagaucccacugggguccauuugggggguccugcuacacuccaccgauccccaaggaagu

SEQ ID NO: 151192 - RNA, 64 nt, Human
gaccagaccguuugccuuuucaaguuuccuaguccugcuacaagaugagcuucuuccgugguuu

SEQ ID NO: 151193 - RNA, 64 nt, Human
agaauucagucuacagccauuuaaaugaucauugcugcuacagaagugcuuuaagagaauugcc

SEQ ID NO: 151194 - RNA, 64 nt, Human
uuggcauggccuauuugaucucuggcuugugcuccugcuacacugacagacugauugcguggcu

SEQ ID NO: 151195 - RNA, 64 nt, Human
acucauaggucccugacauuuaguugauuauuuucugcuacagaccugguacacucugauuuua

SEQ ID NO: 151196 - RNA, 64 nt, Human
gcggcuacaugccucagugaaggacuaguaguuccugcuacaacuucagcaguaccuauaaagu

SEQ ID NO: 151197 - RNA, 64 nt, Human
uuuaacuucuuuugccuguuuuacuucuguaagacugcuacagcuaggcucccccuccccucuc

SEQ ID NO: 151198 - RNA, 64 nt, Human
ugcuucuccaagaccccaacugaguccccagcaccugcuacagugagcugccauuccacaccca

SEQ ID NO: 151199 - RNA, 64 nt, Human
ccuugaagaauuguauuaaugaagagguuggauucugcuacagagaguaaucugauacaagucc

SEQ ID NO: 151200 - RNA, 64 nt, Human
cuccgugcuccugaccccugcugcccaagagagccugcuacagacacaaccccgaggcaggaga

SEQ ID NO: 151201 - RNA, 64 nt, Human
cagaguucuuuaaagcucacauuuuauaguaucacugcuacaaacuauuuaaugaaauguggca

SEQ ID NO: 151202 - RNA, 64 nt, Human
ugccgguucuuggacccuugguugccuugaucaucugcuacaacuggcuacaucgaagacuagc

SEQ ID NO: 151203 - RNA, 64 nt, Human
gagagaacaggaugcccuguggcagggucuggagcugcuacagcauggccaggccugguuugaa

SEQ ID NO: 151204 - RNA, 64 nt, Human
uuuuuuaaucuuuuuaaaaacugcugugguuuugcugcuacacuaagaauugugauuugcauug

SEQ ID NO: 151205 - RNA, 54 nt, Human
ucaucgugaugcuucucugaaguucugcuacaaccucuagaucugcagcuugcc

SEQ ID NO: 151206 - RNA, 64 nt, Human
caagaaacuagucugucaucgggaaaaaguuucacugcuacauaggauuuugucaaauugaagg

SEQ ID NO: 151207 - RNA, 64 nt, Human
acauugcuaaaugaguucugcuuucuuuuuggaacugcuacaaacaaaauuagaagaaaaaaag

SEQ ID NO: 151208 - RNA, 64 nt, Human
augacucguauucagaugcuuaaagaaagcauugcugcuacaaauauuucuauuuuuagaaagg

SEQ ID NO: 151209 - RNA, 64 nt, Human
gagcaguuaauaggcuuuaaauuuaucccaaagccugcuacaccaauuacuucuaaagaaaaca

SEQ ID NO: 151210 - RNA, 64 nt, Human
uuuguuggagguaauuuaugugauucauauaccacugcuacaguguuagcugacaacauauagu

SEQ ID NO: 151211 - RNA, 64 nt, Human
ucagcauuuccuuaucccaagacuagugugcuuucugcuacacugcuaguuuucaguuuuguuc

SEQ ID NO: 151212 - RNA, 64 nt, Human
uaguauuguuuuuguaauuuaacaauaaauaagccugcuacauguaaaaagaaccaaacucaca

SEQ ID NO: 151213 - RNA, 64 nt, Human
agauugucccuucucuugcuguuguaaugcaucucugcuacagcagucauugucauccugugac

SEQ ID NO: 151214 - RNA, 64 nt, Human
aagacuggaaaguuaggagaacugacuagcuaaacugcuacaguaugcaauuucuauuacaauu

SEQ ID NO: 151215 - RNA, 64 nt, Human
aucuguagcccuaacacaugggaugaacguuuuacugcuacacccagauuuguguugaacgaaa

SEQ ID NO: 151216 - RNA, 64 nt, Human
aacuuuuugguuguuuagauccuacagaugaccucugcuacaauaaguacgaugugacuuagua

SEQ ID NO: 151217 - RNA, 64 nt, Human
caaaguuuuuagauaugaacaccuacugugaguucugcuacaaagcacaaaugaauuugucuca

SEQ ID NO: 151218 - RNA, 64 nt, Human
agcuauuucuaauuuucggcugcuaugaauaaagcugcuacaaauauuuuuguacaagacuuuu

SEQ ID NO: 151219 - RNA, 64 nt, Human
gaguuucucuaaccuacaggauggaguaaaacaacugcuacaguucagcaccuguuuuaugugc

SEQ ID NO: 151220 - RNA, 64 nt, Human
aggguuaaucacaaagagcaauuauguggucucccugcuacaugaaaccguguauacuaacaag

SEQ ID NO: 151221 - RNA, 64 nt, Human
ucaggccaucacagaacaccccagcuuccucauucugcuacaacacccaggcccucuggacauc

SEQ ID NO: 151222 - RNA, 64 nt, Human
auguuuacaagaacugguugauucugggaggcaucugcuacagucucuuuuuauauggauaugu

SEQ ID NO: 151223 - RNA, 64 nt, Human
uauuuuuucaauuuaaagguuaguauggaaucagcugcuacaagaaugcaaaaaaucuuccaaa

SEQ ID NO: 151224 - RNA, 64 nt, Human
acaaaauguaguaggcuuaaaaaaaaucuuaacucugcuacauggcucugacugcuguggggga

SEQ ID NO: 151225 - RNA, 64 nt, Human
uagcuggggagggcucuuccauccccagcacccccugcuacaccucagcagccucccccaugca

SEQ ID NO: 151226 - RNA, 64 nt, Human
uuacgagauacagguuacauuuuuuuucccaagacugcuacaugugugauguuguuuccuuacu

SEQ ID NO: 151227 - RNA, 64 nt, Human
ccugcugggacagagaauuggguucuaguggacucugcuacacuuaaaccuaugugacaaaccg

SEQ ID NO: 151228 - RNA, 64 nt, Human
cauaaggagaaaacucaggaauucugagucuucccugcuacaggaccaguucugugcaaugaac

SEQ ID NO: 151229 - RNA, 64 nt, Human
aacagaggucagacacagcugcguaacauccauccugcuacaacucuuccaccccaaacaaaag

SEQ ID NO: 151230 - RNA, 64 nt, Human
caggguccugcguggacucuggguuccaucccaccugcuacaugcucaccaggucuccauugag

SEQ ID NO: 151231 - RNA, 64 nt, Human
cuguguuagaaguagcaaugacaaugaccaaggacugcuacaccucugauuacaauucugaugu

SEQ ID NO: 151232 - RNA, 64 nt, Human
auggaucagcucuuccuguguuuguaauuuaaugcugcuacaagauguuucuguuucuuagauu

SEQ ID NO: 151233 - RNA, 64 nt, Human
gugcuaccuggguccuuuucagaagugagcuuugcugcuacaggggaagguggccucuguggag

SEQ ID NO: 151234 - RNA, 64 nt, Human
agaaagaaaugaagugacucagcuucuggcuucucugcuacaucaaauaucuuguuuaaugggg

SEQ ID NO: 151235 - RNA, 64 nt, Human
uaguuuccccuagcagacuuuuacuucucuuacacugcuacaccauuacuuucuugagacauuu

SEQ ID NO: 151236 - RNA, 64 nt, Human
ccccgaaaauguucaauaaugucccauguaaaaccugcuacaaauggcagcuuauacauagcaa

SEQ ID NO: 151237 - RNA, 64 nt, Human
ccucccugguccuugcucuuguuaacccaagaugcugcuacacagaugccaaauggaaaucuuc

SEQ ID NO: 151238 - RNA, 64 nt, Human
cgaugcuaauaaugcacccgguaccucaauucaacugcuacaaauaaaugucaaaagguugaau

SEQ ID NO: 151239 - RNA, 53 nt, Human
caauuaguacucagacaugauggcugcuacauuguguaaagaacugggcuuag

SEQ ID NO: 151240 - RNA, 64 nt, Human
uauuuccaaauuguuaaagagccagccauugaugcugcuacaugaguuccaugcucaagagcca

SEQ ID NO: 151241 - RNA, 64 nt, Human
guuuuucuuagugcuaauaccuugccucuuauuccugcuacagcagggugguaauauuggcauu

SEQ ID NO: 151242 - RNA, 64 nt, Human
gaauccacccucucuggcccugggacauugcaagcugcuacaaauaaauucuguguucuuuuga

SEQ ID NO: 151243 - RNA, 64 nt, Human
caccgccuguguauauaacguuuccgguauuacucugcuacacguagccuuuuuacuuuugggg

SEQ ID NO: 151244 - RNA, 64 nt, Human
caaagugacugcguucaucaguuuuacacuggggcugcuacauaauauuuucauuugaacgaag

SEQ ID NO: 151245 - RNA, 64 nt, Human
uuccuccagaguggcucucugcggcccuguguuccugcuacagaguguucuuuucuggagucag

SEQ ID NO: 151246 - RNA, 64 nt, Human
ggcuuuggagaauugucuuccuaaaucggggcaccugcuacagaagagaauguuucguucccuc

SEQ ID NO: 151247 - RNA, 64 nt, Human
ccucuuauaaacaagagugauagagagcugcaggcugcuacaacaaauaccauagacagguugg

SEQ ID NO: 151248 - RNA, 64 nt, Human
cuagcucaggaguuggcaaauaagaauuaaaugucugcuacaccgaaaaccucacgccucucau

SEQ ID NO: 151249 - RNA, 64 nt, Human
uauugugaccgugcggcuccaccucuuccagcugcugcuacagcugaggccuggaucccggccu

SEQ ID NO: 151250 - RNA, 64 nt, Human
acacuggugugaugaugggcuugcccauccauuacugcuacaaucaaggccaggcuuggaguuu

SEQ ID NO: 151251 - RNA, 64 nt, Human
aagccaguaaaagaaaucuugcuucacuguucaccugcuacaaguaagaguuuggugcugguag

SEQ ID NO: 151252 - RNA, 53 nt, Human
uccgggagacaagccucugagaccugcuacagaucaaagacuccuccaaaaag

SEQ ID NO: 151253 - RNA, 64 nt, Human
uuggcucuagucacuucuggcugccugguggccacugcuacagcugguccacagagaggagcac

SEQ ID NO: 151254 - RNA, 64 nt, Human
aauuuuugaauauuaaucaaaacaaaaagcaaaacugcuacacucacuuauuaauucuaguaac

SEQ ID NO: 151255 - RNA, 64 nt, Human
uggcuuuccacuuuggaugcccgggcauccgcugcugcuacaucuuagccagaacuugaagucu

SEQ ID NO: 151256 - RNA, 64 nt, Human
uaagagccaggugggauaagguaaagcaacucagcugcuacagggcuuuuaauggagaacaaag

SEQ ID NO: 151257 - RNA, 64 nt, Human
aauaaaauuuuguuuuucuguaaugucauauuugcugcuacaguagcucaauauuuuacagggc

SEQ ID NO: 151258 - RNA, 64 nt, Human
augauuccaguuuauuauccaucaaaggcuccaacugcuacaguucuccaacuucauugugcca

SEQ ID NO: 151259 - RNA, 64 nt, Human
guuaguaaacagccuaaagaaacucuuagguuuacugcuacauccauuuguuuggagagguaac

SEQ ID NO: 151260 - RNA, 64 nt, Human
gaacucagccaagcacagugguggcagggccuagcugcuacaaagaagacauguuuuagacaaa

SEQ ID NO: 151261 - RNA, 64 nt, Human
aauuuuucaucuacuucuugaacaguggucuauucugcuacaugaagaugaauacaaacaaaau

SEQ ID NO: 151262 - RNA, 64 nt, Human
gcuauuguuuacaauuauaucaccauuaaggcaacugcuacacccugcuuuguauucugggcua

SEQ ID NO: 151263 - RNA, 64 nt, Human
cgagcaggcuucuuccccccaaaacugauuacaacugcuacagagcagacaguuaagagaaaug

SEQ ID NO: 151264 - RNA, 64 nt, Human
auaagcuauggguaaaauaaugccaguaauucagcugcuacauccaagcacugaagucuuaccc

SEQ ID NO: 151265 - RNA, 64 nt, Human
uuguucuucuuaaaugugacaugaaauaauugugcugcuacauuauacuggaaauuaacagggg

SEQ ID NO: 151266 - RNA, 64 nt, Human
aguuccuucucccugcaaccucaguccaaggaaccugcuacacucugcaaauaacccacauccu

SEQ ID NO: 151267 - RNA, 64 nt, Human
auuugugcauagcuggagugaaggcggagggagccugcuacaggccgcagcccaaccccuguuu

SEQ ID NO: 151268 - RNA, 64 nt, Human
guuugucccugccaucuacugucugaggccaucgcugcuacacuuuguuuuuauuuguauuuca

SEQ ID NO: 151269 - RNA, 64 nt, Human
ugcauaugucaguggcucuggagauuguuaccaucugcuacauauauaaauagacuugcaguua

SEQ ID NO: 151270 - RNA, 64 nt, Human
acuucguucucuaguugaucucuuaaacccauaccugcuacagccaagaccugcucuuguggag

SEQ ID NO: 151271 - RNA, 64 nt, Human
gcccugauuccacuuccuuugguccaguuuuacucugcuacaggguggauuccaaaacuggcuc

SEQ ID NO: 151272 - RNA, 64 nt, Human; identical to SEQ ID NO: 151260

SEQ ID NO: 151273 - RNA, 64 nt, Human
gguguggacuuuuauauauagaucuacauaaaaacugcuacaugacaaaaaccacaccuaaaga

SEQ ID NO: 151274 - RNA, 64 nt, Human
acuguacccagugccgccaccaguucugcagcggcugcuacaaugccuuuuacgccaagaaugu

SEQ ID NO: 151275 - RNA, 64 nt, Human
ccugcgggacuggacugcucuccggcuucagaagcugcuacaggacaauaacgucauguuuaau

SEQ ID NO: 151276 - RNA, 64 nt, Human
augucccccaggcaucuugaucccagccugacugcugcuacaucuaauccccuaccaaugccuc

SEQ ID NO: 151277 - RNA, 64 nt, Human
aaguuggauuauugggcauguguggcagccugcccugcuacaugcuagacaagugugcuuuagu

SEQ ID NO: 151278 - RNA, 64 nt, Human
auuagaucuggggcccgaugaccucccuuucccacugcuacagcccuuuugacuucccccagca

SEQ ID NO: 151279 - RNA, 64 nt, Human
auucaggaacagauccaaaguuagcaguauauggcugcuacauuuccauuuucauuuucgagcc

SEQ ID NO: 151280 - RNA, 64 nt, Human
cuuaaaaguauauuuuuucuauaaacauccuuugcugcuacauuagaacuuuuauagccuaaac

SEQ ID NO: 151281 - RNA, 64 nt, Human
ccaagaucuuuguuggcccuaaacaucgcugucucugcuacagauuccuauugagagcaaugca

SEQ ID NO: 151282 - RNA, 64 nt, Human
uaagucuuauuuuuacuguuuauauauuugaaugcugcuacaacagaugaucuucaucccugaa

SEQ ID NO: 151283 - RNA, 64 nt, Human
acuagauucuggacaccagugugcggaaaugcuucugcuacauuuuuaggguuugucuacauuu

SEQ ID NO: 151284 - RNA, 64 nt, Human
agaagaggaacuaaaugacugcgaagcuggaauacugcuacaggaaguaugagaguucugaaac

SEQ ID NO: 151285 - RNA, 64 nt, Human
gucaccguccauccacauccaguguggccuggagcugcuacagagguguugggcaggccaugcc

SEQ ID NO: 151286 - RNA, 64 nt, Human
cacccucagaggagcugcaagcccguggccuggccugcuacaugcccugcuuccacguggcugc

SEQ ID NO: 151287 - RNA, 64 nt, Human
auaaccuagccuuagaagucacacaguauuacuucugcuacauauauauguuuuaagaggcagg

SEQ ID NO: 151288 - RNA, 64 nt, Human
gucagugcugcaugcacugcauaugaaauaaaaucugcuacacgccagggagaacagguguccu

SEQ ID NO: 151289 - RNA, 64 nt, Human
cccagcugggacuuacuuccaaccuccaccagcccugcuacauaccccuguuccagcauuaacu

SEQ ID NO: 151290 - RNA, 64 nt, Human
aggucagcauguuccacagguguucagagggagucugcuacaaacuaucagggcaaaaucucac

SEQ ID NO: 151291 - RNA, 64 nt, Human
gggaaaugcgaagcauuucucaucaucaucaucucugcuacagucauguuucugcaugucagcg

SEQ ID NO: 151292 - RNA, 64 nt, Human
gcaacaaagccacugauaccugagcccuuugugucugcuacaaaccaggcagguggugugugug

SEQ ID NO: 151293 - RNA, 64 nt, Human
ccugaagcuuuguguuuggcugcaccugcauaagcugcuacaaauagaauaaagaauuucauag

SEQ ID NO: 151294 - RNA, 64 nt, Human
uaaaaguauuccaugcucaguauuuuuuauuguccugcuacagcuagugugcuuuuagacuuuc

SEQ ID NO: 151295 - RNA, 64 nt, Human
acuggauccauccguccagccaagagcucuucaucugcuacaagaacauuugaaucuugggacc

SEQ ID NO: 151296 - RNA, 55 nt, Human
cucccauguaugucgauugauaucgcugcuacaucagacucuagaaaaaagggcu

SEQ ID NO: 151297 - RNA, 64 nt, Human
accucuggagucacuacugugggucgccacuccucugcuacacagcacggcuuuuucaaggcug

SEQ ID NO: 151298 - RNA, 64 nt, Human
gguaccacauucauuguuaaggaauggcugaugacugcuacacguguugggaaccugguugggg

SEQ ID NO: 151299 - RNA, 64 nt, Human
cuguccuuugcaauugcucuucuccacgucuuuccugcuacaaguguuuuagauguuacuaccu

SEQ ID NO: 151300 - RNA, 64 nt, Human
caggaggucccuagaacaugccguuucaugucaccugcuacagcucucccccagcuaguaugau

SEQ ID NO: 151301 - RNA, 64 nt, Human
aaccaguucaacucagcaaacacuuccugagcaccugcuacaugccaggcaaaaugugaaauuu

SEQ ID NO: 151302 - RNA, 64 nt, Human
uguuuuuuacucucaggggaaaguuggggacaugcugcuacaauacggcuaaucuuucauuggg

SEQ ID NO: 151303 - RNA, 64 nt, Human
agugggcaucaacucagcccgacuggaucgccaucugcuacaacaacugccuggagauacucag

SEQ ID NO: 151304 - RNA, 64 nt, Human
cuagcuugcuggucccgaaagauugcaacuuuggcugcuacagaaaggauagaaccuuuuuggg

SEQ ID NO: 151305 - RNA, 64 nt, Human
cuucucugcccaggccgcugcagcugcacagccucugcuacaccugggcugccugggaggcuuc

SEQ ID NO: 151306 - RNA, 64 nt, Human
guguccccagucaagcccaugaagcccaugcggccugcuacaugggguggggucguagggaggc

SEQ ID NO: 151307 - RNA, 64 nt, Human
aacugcacaaucaagagggaacccaugggacucucugcuacauucaguucuugugucguuugug

SEQ ID NO: 151308 - RNA, 64 nt, Human
ccagccugggggcuggcagaggcccccauauacucugcuacagcuccuaucaugaaaaauaaaa

SEQ ID NO: 151309 - RNA, 64 nt, Human
cucuaugcugcuagcccaucugcuggcaaaccaccugcuacaggaccaccugcugccaccccag

SEQ ID NO: 151310 - RNA, 64 nt, Human
ccaccgcaguccagcucccucagucuggcacccacugcuacacucagccucaugagccacuuca

SEQ ID NO: 151311 - RNA, 64 nt, Human
uuccauacagugaaggaaauuugagucuguauugcugcuacaaggguaaaaccaggaccaaugg

SEQ ID NO: 151312 - RNA, 64 nt, Human
uagcguguaccgaaaaugaagacucuccuaucuacugcuacagauccuguugaagaaagagcuu

SEQ ID NO: 151313 - RNA, 64 nt, Human
ccugugcacguuucuucucuggucgccucauuuccugcuacacugaaggggucagcugcuccag

SEQ ID NO: 151314 - RNA, 64 nt, Human
uuacuagaucacugguuauaauuugggacaaaaacugcuacaucaacuuucaucucgcccagag

SEQ ID NO: 151315 - RNA, 64 nt, Human
guguaaugaucuauagaugcucaugaagaaagaucugcuacaaguacgugauaaauuccuaucc

SEQ ID NO: 151316 - RNA, 64 nt, Human
uuuguuucugaaaauuuugucugcuaaaaaguuucugcuacagagugguagaugaaguuauauc

SEQ ID NO: 151317 - RNA, 64 nt, Human
gcauuguuaugagccuugaaggaagagacagacucugcuacauucaaccucgugacuucaugau

SEQ ID NO: 151318 - RNA, 64 nt, Human
cccccuccagcuucuggggcccaggagccucucccugcuacaggggguggggguccugcucagc

SEQ ID NO: 151319 - RNA, 64 nt, Human
uuuuuuuuuguagggccaccgccuucaaacacaacugcuacaacauucuaauaaaggcucauuu

SEQ ID NO: 151320 - RNA, 64 nt, Human
ucugacuccccgcaacuuccugccucugagagaccugcuacaagccagcuuccuuccccuccau

SEQ ID NO: 151321 - RNA, 64 nt, Human
auacauuuugguggcccacuggguacugugaggacugcuacauugauggauguuauuggcuaau

SEQ ID NO: 151322 - RNA, 64 nt, Human
uucuuagcuguaucaucccauggucccaaaagggcugcuacacauccagccaucacaugcagau

SEQ ID NO: 151323 - RNA, 64 nt, Human
cuucuucguccgaaaggaggggaggggggacucgcugcuacaagccucgcccccugugccacuc

SEQ ID NO: 151324 - RNA, 64 nt, Human
gaacuugccauuggacugagcucuuucucagaagcugcuacaagaugacaccucaugucccugc

SEQ ID NO: 151325 - RNA, 62 nt, Human
cagagcuggggagggcgugggggcaguaaagccucugcuacagccggcucuguccuguccuu

SEQ ID NO: 151326 - RNA, 64 nt, Human
uuugugauagguauuggggaacuaagggguaucucugcuacaggaaugggagugagaacauuca

SEQ ID NO: 151327 - RNA, 64 nt, Human
agagaaaccucagucagugucucaaaauaaaauccugcuacaaacauugaucucuuuucauagc

SEQ ID NO: 151328 - RNA, 64 nt, Human
augagcagaaaauauuuucccacugguguguagccugcuacaaggaguuguuggguuaaauguu

SEQ ID NO: 151329 - RNA, 64 nt, Human
aguuggccacgagagugaccucuggucguccucacugcuacacuccugacagcaccaugacagu

SEQ ID NO: 151330 - RNA, 64 nt, Human
ucugcacggcauggagugggaaccccaccagcugcugcuacaggaccugggauugccugggacu

SEQ ID NO: 151331 - RNA, 64 nt, Human
gaaaagaccccuccucucaugagcucccccaucccugcuacagaacacagcacccauggcgccu

SEQ ID NO: 151332 - RNA, 64 nt, Human
uuagaaauguacagaaaugaagaugguucaguaccugcuacauaccagaucuauuacaugauag

SEQ ID NO: 151333 - RNA, 64 nt, Human
uguacacauucugguaugaauuuguaaaaauaaccugcuacaaauugguugaauguuucugucu

SEQ ID NO: 151334 - RNA, 64 nt, Human
ugaccucuuuacccugaagcuuuugucaaauaaacugcuacaucaaccugagggcucugcauau

SEQ ID NO: 151335 - RNA, 64 nt, Human
acccucaguugagccugagcccccggcgcgggggcugcuacacuacaggacacccagcaucggc

SEQ ID NO: 151336 - RNA, 64 nt, Human
cgcccugggcucuggguucgggaagaaggacuuccugcuacaguagcuguggggagcugguggg

SEQ ID NO: 151337 - RNA, 64 nt, Human
uaugaaaugacuucuuaaauauuuaguugauagacugcuacagguaauagggacuuagcaagcu

SEQ ID NO: 151338 - RNA, 64 nt, Human
ccagguggcccaugugcccagggcgccugcagggcugcuacagggaccuggucaggaggugcac

SEQ ID NO: 151339 - RNA, 64 nt, Human
gaaccccaucuuccccaccacgccaccccuguggcugcuacaggagcacaguagugaaggccug

SEQ ID NO: 151340 - RNA, 64 nt, Human
cgagaaaggugugagccgaggcaguuccugcguucugcuacaaaaggaauggaaagggaaggga

SEQ ID NO: 151341 - RNA, 64 nt, Human
cccuccccaaaaacagauugacccaggaaugaaucugcuacaauuccaccucauucuuucacac

SEQ ID NO: 151342 - RNA, 64 nt, Human
cuaacgccauccaggcugggaggggaagagugcucugcuacacucgucccccuccugccucauc

SEQ ID NO: 151343 - RNA, 64 nt, Human
ucagccucuauggcaaggcccugcuacauggcaacugcuacaacagguacggcagccccagccc

SEQ ID NO: 151344 - RNA, 64 nt, Human
agaugaggccagccucagccucuauggcaaggcccugcuacauggcaacugcuacaacagguac

SEQ ID NO: 151345 - RNA, 64 nt, Human
aagauacugucuuucaauagaaaugauuucuaaacugcuacagauuaagaauagauaaucugau

SEQ ID NO: 151346 - RNA, 64 nt, Human
ucuaauuaauuugcuuaauucugagccauuaauccugcuacacuuugaaugauacauuaauuca

SEQ ID NO: 151347 - RNA, 64 nt, Human
acucucucagauggcucaucauaggggaaaccugcugcuacaucaugagauagcccuguggaaa

SEQ ID NO: 151348 - RNA, 64 nt, Human
cuuagguauuauacuucuuuaaaaagcucugaagcugcuacaauagaaaaaucaaaaaggguaa

SEQ ID NO: 151349 - RNA, 64 nt, Human
caguuaauuaauuaauagcuuuauauugccuuuccugcuacauuugguuuuuuccccugucccu

SEQ ID NO: 151350 - RNA, 64 nt, Human
aucucaguaggccuaaccuauaaccuagcacagacugcuacagcugcuccccucccgccaaaca

SEQ ID NO: 151351 - RNA, 64 nt, Human
ucuaauuaauuugcuuaguucugagccauuuauucugcuacacuuugaaagauauauuaguucu

SEQ ID NO: 151352 - RNA, 64 nt, Human
acccagugucuucugccucccucugcguugguaucugcuacaucccaggccaccaccuccgagg

SEQ ID NO: 151353 - RNA, 64 nt, Human
ccaggagggcagcaccugcuggggacgguggcccugccuucaugcccaggacaccagcuggguc

SEQ ID NO: 151354 - RNA, 64 nt, Human
ggaccugccccugagccgggccuucuagucguagugccuucaggguccgaggagcaucaggcuc

SEQ ID NO: 151355 - RNA, 64 nt, Human
agugguccugagcagugauuccaaacucucacugugccuucacaccauccauguguaauccacc

SEQ ID NO: 151356 - RNA, 64 nt, Human
agagugaugcuaacacuccaucugcccuguccauugccuucauauacagucuacuucguguucu

SEQ ID NO: 151357 - RNA, 64 nt, Human
acccccacuaccgccuuuauuucucuauuucccuugccuucaucaccuacauuuuuuucccagu

SEQ ID NO: 151358 - RNA, 64 nt, Human
aaacugcuucucugcucugagaagcacagcuaccugccuucacugaaauauaccucaggcugaa

SEQ ID NO: 151359 - RNA, 64 nt, Human
ccucaggcgccccgagaccucaucuuccggugagugccuucaguguugaccuaaguccucgccg

SEQ ID NO: 151360 - RNA, 64 nt, Human
uccccaggcuggguguggaggaguuggggcccccugccuucaggaggcuuguaguuuagaaggg

SEQ ID NO: 151361 - RNA, 64 nt, Human
aaccaugaauuaagaugaguccauuugccucuucugccuucacugaggguuuggguuauacacc

SEQ ID NO: 151362 - RNA, 64 nt, Human
ggucugcuaaaaggucagaguaaugcagaaugcgugccuucaucucagauuuguucaucacagg

SEQ ID NO: 151363 - RNA, 64 nt, Human
ggggaaaggcauguguuucuugcuggugacucauugccuucacaccacuggguuugccagaaac

SEQ ID NO: 151364 - RNA, 64 nt, Human
uuaacccaccaucaucccaaacucuccuguccuuugccuucauucucuuacccaccucuaccua

SEQ ID NO: 151365 - RNA, 64 nt, Human
cucccucuuuuccucacacacucuuuuucccuucugccuucaccuuugccguggguggacacag

SEQ ID NO: 151366 - RNA, 64 nt, Human
uuacaaugcuccaauuccucucuuacagcaauauugccuucacaguuauaaacuguauucaaau

SEQ ID NO: 151367 - RNA, 64 nt, Human
gcacuaaaaguuucuugagauucuuuauacucucugccuucagcaaucaauuccauucauacau

SEQ ID NO: 151368 - RNA, 64 nt, Human
uuccuuugaauuccaacuguggaccuuuuauaugugccuucacuuuagcuguuugccuuaaucu

SEQ ID NO: 151369 - RNA, 64 nt, Human
acucgcagaccugcaguucucagaccgaaggugcugccuucauccuccccaccuaaugcauuuu

SEQ ID NO: 151370 - RNA, 64 nt, Human
ggcuauuauaacauaaacugucacguagguuugcugccuucagaauaccgcaauuuaauugcgg

SEQ ID NO: 151371 - RNA, 64 nt, Human
uucucauuuauguguuuagggauagugagguuccugccuucacuaggauccacggauaugagac

SEQ ID NO: 151372 - RNA, 64 nt, Human
cuuugcaauauuuauuacacaaagaacuugcugcugccuucacauuugggguuuguguuugauu

SEQ ID NO: 151373 - RNA, 64 nt, Human
acucaagacuuccuccagaggaauuugucuucucugccuucacucagcaugggaaccaguguuc

SEQ ID NO: 151374 - RNA, 64 nt, Human
ugucccuuuuccacaguaaugggaucggcuggugugccuucagggaggaagagggaggugguca

SEQ ID NO: 151375 - RNA, 64 nt, Human
cuagaggccucuccauauggcuggucaggggagcugccuucaggcuugugccccgugugcucag

SEQ ID NO: 151376 - RNA, 64 nt, Human
cuaucuauugauaauuuagacauugaguucaaauugccuucauuuuaugauaaauaaugauuua

SEQ ID NO: 151377 - RNA, 64 nt, Human
gagcaggauccagaaggaagauuuguggccagauugccuucaucauuucaccucuccagacuuc

SEQ ID NO: 151378 - RNA, 64 nt, Human
ucugcuucucuuuccuguaaguucagcaugggugugccuucauacaauaauauuuuucucuuug

SEQ ID NO: 151379 - RNA, 64 nt, Human
uuuuuuucuuuuuugauaaaaaagcaaauaauauugccuucagauuauuucuucaaaauauaac

SEQ ID NO: 151380 - RNA, 64 nt, Human
cugucagaauugguuuggugcaggcaauagauuuugccuucaaggguuccuguggaucucagga

SEQ ID NO: 151381 - RNA, 64 nt, Human
cuagaaaguuaacugggagcuuugacucuuacugugccuucacucauagugugccuucuuagcu

SEQ ID NO: 151382 - RNA, 64 nt, Human
cuggacuccagaaaugugcaugcagaucagcuguugccuucaagauccagauaaacuuuccugu

SEQ ID NO: 151383 - RNA, 64 nt, Human
ugcccuguuuuucauugggaagcuuaucuacagaugccuucagaaucugacgagauugacucuc

SEQ ID NO: 151384 - RNA, 64 nt, Human
agucggucggcucgcucugggcgcccucgcucucugccuucaucugggcccugggcucucccgg

SEQ ID NO: 151385 - RNA, 64 nt, Human
gaagaaguugaggggugggggagagaaugacuucugccuucaucugcaguaacggggggaccua

SEQ ID NO: 151386 - RNA, 64 nt, Human
gggcuggggcuacaggucugucacuaugcucucuugccuucagacagaccauucugaauucucu

SEQ ID NO: 151387 - RNA, 64 nt, Human
aauaguaucagucggugcaacaguuggcaacaugugccuucacacuuuaccauaaagagacggg

SEQ ID NO: 151388 - RNA, 64 nt, Human
auacagauuuacaugcaauccagaucuuuaauuuugccuucacaaaagccuaaugucuguaauu

SEQ ID NO: 151389 - RNA, 64 nt, Human
ugguccaggccacagaggaugggguuaggcuucaugccuucaugcccaggcagccacagaaacc

SEQ ID NO: 151390 - RNA, 64 nt, Human
gcccgcugaggcccucugccacccaggcaggcccugccuucagcccuggcccagagcuggaaca

SEQ ID NO: 151391 - RNA, 64 nt, Human
uuuuuuuugaaauagugaggaacugaccauuauaugccuucacuggcuucuugugcaauaauau

SEQ ID NO: 151392 - RNA, 64 nt, Human
gagaaaaacuuuaugaagguaucgaaugugagaaugccuucauuuauccuauaacucacucaga

SEQ ID NO: 151393 - RNA, 64 nt, Human
cagucaugcacaucuguagccccagccauccuugugccuucaccucugauguguuucacaagca

SEQ ID NO: 151394 - RNA, 64 nt, Human
cucauuugcucucuucccuaaaaugugucccagaugccuucauuugcuguuuuacuucuauguu

SEQ ID NO: 151395 - RNA, 64 nt, Human
agagccgcagggcugagaccacguccaugcuggcugccuucaggaagcuaaaguauuguuggac

SEQ ID NO: 151396 - RNA, 64 nt, Human
ggagucuuugcacuuacacacacucuuccuguucugccuucaccuaugccgggauaagcagaga

SEQ ID NO: 151397 - RNA, 64 nt, Human
cuggaaggcaguaaguggagguuugcagcauuccugccuucaugagggcuucuaccacugacca

SEQ ID NO: 151398 - RNA, 64 nt, Human
aaugccacagucugagguugauaucuaaaaucuaugccuucaaaagagucucuguuuuuuuuuu

SEQ ID NO: 151399 - RNA, 64 nt, Human
cugaucuuaagauuuuuuuauaucuaauugcugcugccuucauuuuagguucagcaguuacuuu

SEQ ID NO: 151400 - RNA, 64 nt, Human
agauggucauauacacugugaggcacugaaauuuugccuucagagguucugaccagauuggcug

SEQ ID NO: 151401 - RNA, 64 nt, Human
guauuugguggaguuugaauuugagcaaacuaaaugccuucaucuuagguagaaagggccugaa

SEQ ID NO: 151402 - RNA, 64 nt, Human
cacugaggaccgugagcuccaggccccgugucagugccuucaaaccuccuccccuauucucagg

SEQ ID NO: 151403 - RNA, 64 nt, Human
aaaaccagccaagcuuuauucaggacacacuucuugccuucacuuucccacuuccguggccacc

SEQ ID NO: 151404 - RNA, 64 nt, Human
uggcuaccugggggugucccagggacucugucagugccuucagcccaccagcaggagcuuggag

SEQ ID NO: 151405 - RNA, 64 nt, Human
aacuggaauaguuuuuuuuuuuuuuuuuuuuuuuugccuucaacuaaaaacaaaggagauaaau

SEQ ID NO: 151406 - RNA, 64 nt, Human
aaacuccggcacuggguuugcucccugauuaaagugccuucagccaagaccaucucucccuccu

SEQ ID NO: 151407 - RNA, 64 nt, Human
aucacacuaguuuuugcuuugagcagaguuggagugccuucauccaaguaugaccacuuuuaau

SEQ ID NO: 151408 - RNA, 64 nt, Human
uauuuaauaaggguguacaguaauagaggcuugcugccuucaggaaauggacaggucaguuugu

SEQ ID NO: 151409 - RNA, 64 nt, Human
aaaagaaacaagaugcuggaugucugccaauuuuugccuucauuaccuuuuuugauaaaguuuc

SEQ ID NO: 151410 - RNA, 64 nt, Human
gcucccuaggagccacagcaccaggaagggaugcugccuucaucuaacaguauaaagcccuguu

SEQ ID NO: 151411 - RNA, 64 nt, Human
uuccugugucuugugcaugggaagcagccuucagugccuucaugaauucaccuuccagcuuccu

SEQ ID NO: 151412 - RNA, 64 nt, Human
caucaaaguagaagagcccccaaccuuuucucucugccuucaagaaggcagacauuugguauga

SEQ ID NO: 151413 - RNA, 64 nt, Human
uugugcugaggaagaugcaucaagggcuuggcugugccuucauaggucaucuaggguuuuauaa

SEQ ID NO: 151414 - RNA, 64 nt, Human
gugagugaguacagaagaaugcucaugauaguuuugccuucauucuacuuucuguggacacaga

SEQ ID NO: 151415 - RNA, 64 nt, Human
uacuauggaauuucucccagucauuuaauaaaugugccuucauuuuuucagaaguaaugacuug

SEQ ID NO: 151416 - RNA, 64 nt, Human
aaucuuugacggcagaguaguaaaugcuuccacgugccuucaacuggauauuuauagucuuacu

SEQ ID NO: 151417 - RNA, 64 nt, Human
acuggaucauagucauuauaaucacaggagacucugccuucauuauccuugcacuuaacggaag

SEQ ID NO: 151418 - RNA, 64 nt, Human
auuggaucacauauuucuacuuucagugagaguaugccuucacuauguuaaaaaauaagcucau

SEQ ID NO: 151419 - RNA, 64 nt, Human
gagcugaggaaacaagguguccuccaucccccagugccuucacaucuugaggauaugcuucugu

SEQ ID NO: 151420 - RNA, 64 nt, Human
ucaucucuucaguaacuguuaaaguguaauucucugccuucauuaucaaguccaggacaguguu

SEQ ID NO: 151421 - RNA, 64 nt, Human
gcuggggagacacaucugccuuccucugcagggaugccuucacguacugucccuaguucagccu

SEQ ID NO: 151422 - RNA, 64 nt, Human
gccugcagagggccuggcacuaucaccaccucucugccuucaugccaauaauaaagcugaucuu

SEQ ID NO: 151423 - RNA, 64 nt, Human
gaauaaagaaacagacuuuugaguuuauaugcaaugccuucauuagguaccaccggcacuuaca

SEQ ID NO: 151424 - RNA, 64 nt, Human
cccaauguuuguaaauucacaguauuuggaaaacugccuucauuuuccagugugggaaaaacuc

SEQ ID NO: 151425 - RNA, 64 nt, Human
agacaagccuccuguaugaagccagaagcacaagugccuucagagggcaguugauuccagucca

SEQ ID NO: 151426 - RNA, 64 nt, Human
ccuggguggcaccaggcaaugcaggugaaguggcugccuucaggaaauacaacuaacuaaaauc

SEQ ID NO: 151427 - RNA, 64 nt, Human
aacugagccuccagaugguagugaauggucucuuugccuucaggcuggaugaggaagucauuua

SEQ ID NO: 151428 - RNA, 64 nt, Human
cuagcccauaccucugcuggcaccuucuguaccaugccuucagaaaccuucuuaucccccucau

SEQ ID NO: 151429 - RNA, 64 nt, Human
gaaaccccaucccuaaaauauugcuguuguaaaaugccuucagaaauaaguccuagacuggacu

SEQ ID NO: 151430 - RNA, 64 nt, Human
ucuagacaucugaauuugaucucaaugguaacauugccuucaauuaacaguagcuuuugaguag

SEQ ID NO: 151431 - RNA, 64 nt, Human
aauuauugcaauuggauuucagguucccuuuuugugccuucaugcccuacuucuuaaugccucu

SEQ ID NO: 151432 - RNA, 64 nt, Human
aagggaauugacccaccccagucuagcaccacccugccuucacuucaucuacauaaagguggua

SEQ ID NO: 151433 - RNA, 64 nt, Human
ugaaugaaauccugugccguucuucagucuggagugccuucaaagaucagaaacaugauuuguu

SEQ ID NO: 151434 - RNA, 64 nt, Human
auucagggcccccagcaccccugugucugcagagugccuucaaaacucagcuguuccagccggu

SEQ ID NO: 151435 - RNA, 64 nt, Human
ucuuugcccacccugugagccucauccgugauucugccuucacacacgcagcagagguuucccu

SEQ ID NO: 151436 - RNA, 64 nt, Human
ucccagccucuugcucagagcuaggcccccaaauugccuucagcccuaacauagugucugcugc

SEQ ID NO: 151437 - RNA, 64 nt, Human
ucaccuccacgccuaccucauagcuucacagccuugccuucagccucugagcuccaggggucag

SEQ ID NO: 151438 - RNA, 64 nt, Human
uugacguuuacauuuugucacaguuggucccccuugccuucacauaccugauguuuaaauuuug

SEQ ID NO: 151439 - RNA, 64 nt, Human
acaauuuaaacuugccaguaccaacugggaugugugccuucaauuugaaaauuguauguuuuau

SEQ ID NO: 151440 - RNA, 64 nt, Human
ccugcagccagcagagcuuagcuucaaggacaccugccuucaaagccacugaggggaggaaggg

SEQ ID NO: 151441 - RNA, 64 nt, Human
uuuuaaacacuuugggauacuaaucccuagacauugccuucacuccaccuuuaguccuucugag

SEQ ID NO: 151442 - RNA, 64 nt, Human
agcugauaccgccguccuggggacuugggcuucuugccuucauaaggcacagagcagauggaga

SEQ ID NO: 151443 - RNA, 64 nt, Human
ugccucugucagaaaccgccuggacugcacgcagugccuucagcauccauggcuaaugaaagau

SEQ ID NO: 151444 - RNA, 64 nt, Human
gaugccccuuguaauguuugcauacacuagaaaaugccuucaauuuguguuuuaccagaauuuu

SEQ ID NO: 151445 - RNA, 64 nt, Human
gccccagccccuuccaggcggggaaccugcuuccugccuucacugcccccgcagcacucacaga

SEQ ID NO: 151446 - RNA, 64 nt, Human
uucccauggcaauuuaaccacauuuggaaggcacugccuucagcugaguuuaugaacaaugaau

SEQ ID NO: 151447 - RNA, 64 nt, Human
ggaaaaguagccauuaguucaggaaacucagugcugccuucagaugucauugauguuucuccug

SEQ ID NO: 151448 - RNA, 64 nt, Human
uuuaaauguuagcaggauauuuguguauuagcagugccuucaguauaagagagaaauauucauu

SEQ ID NO: 151449 - RNA, 64 nt, Human
agagauuauucucaccaacccgcugccuucaugcugccuucaaagcuagaucauguuugccuug

SEQ ID NO: 151450 - RNA, 64 nt, Human
uucucuuaaggagagauuauucucaccaacccgcugccuucaugcugccuucaaagcuagauca

SEQ ID NO: 151451 - RNA, 64 nt, Human
auguuuuaaagguuacuugaaugucacaaaauuaugccuucaucaaaacuuuaaaggaaaaauc

SEQ ID NO: 151452 - RNA, 64 nt, Human
ugugguuccauccgaaggauuguggugagccccgugccuucaguuaauaaagauuuguauugug

SEQ ID NO: 151453 - RNA, 64 nt, Human
agugacucuccucucucaggaugacgaggaccugugccuucaacaagcaaaaugcugcucacgg

SEQ ID NO: 151454 - RNA, 64 nt, Human
auuacuacuucacacucuccuucagccauuugucugccuucagucaacagaaaaugugauuuuc

SEQ ID NO: 151455 - RNA, 64 nt, Human
cuuuucucauaaacccagacgagugguaaaaauuugccuucaguuguaauaggagaguucaaac

SEQ ID NO: 151456 - RNA, 64 nt, Human
cuccucucaugguuugaaacugcaucugaaugccugccuucaauccuggccaaguuggaguaga

SEQ ID NO: 151457 - RNA, 64 nt, Human
ugccuuguguguguuuuacuaaccuuuuauaucuugccuucaagugagaaggaacaaacaacuc

SEQ ID NO: 151458 - RNA, 64 nt, Human
aguuugcaacauuuauugagaucuaagucugucuugccuucauuucucuuuuuaucucccccuu

SEQ ID NO: 151459 - RNA, 64 nt, Human
gguugauuagacuuuugaaaaacucaucaccacaugccuucacuccagaguguucucagcuaga

SEQ ID NO: 151460 - RNA, 64 nt, Human
gcagaccagggguuaccagccucacagcugcagcugccuucaagccuguaggauccacuggcgu

SEQ ID NO: 151461 - RNA, 64 nt, Human
uuuggugugagcuuuuuguuuguuuguuuaguuuugccuucauagguuauaugccaagauagua

SEQ ID NO: 151462 - RNA, 64 nt, Human
uaagaauaucuuuuguuuuauguugaguuagaaaugccuucauauagacauagucuuucagacc

SEQ ID NO: 151463 - RNA, 64 nt, Human
cuaacuuacacagaaugagaggaguaaauguucuugccuucaaauaguguuuuacguuuuuuau

SEQ ID NO: 151464 - RNA, 64 nt, Human
cuggccaguguaauuucugucaaccacggacguuugccuucauguguagaauuuacuguuguua

SEQ ID NO: 151465 - RNA, 64 nt, Human
cugucucccuagugugugacucacaccuuguggcugccuucagagcgccaccuccagaucagau

SEQ ID NO: 151466 - RNA, 64 nt, Human
auuguuuucauugauuucaaaaguuuauuuucugugccuucaagggacaacuuuuuuaacuuug

SEQ ID NO: 151467 - RNA, 64 nt, Human
agaucuguaggauuuuuagaagaccgugggccauugccuucaugccgugguaaguaccacaucu

SEQ ID NO: 151468 - RNA, 64 nt, Human
aaguaacugucuggaggugccuccauuauccucaugccuucaggaaagacuuaacaaaaacaau

SEQ ID NO: 151469 - RNA, 64 nt, Human
gcaaaugaaauaaacucuuuaggcuggcccagaaugccuucauugugaggaagggugcuccaag

SEQ ID NO: 151470 - RNA, 64 nt, Human
uacaaagaaaaaagaagggguagggauuuggcuaugccuucacuacaacauuagaauauuguaa

SEQ ID NO: 151471 - RNA, 64 nt, Human
gcaaggauucaguagagauccugaugauucuuuuugccuucaugcugguuuaccccaaagaguu

SEQ ID NO: 151472 - RNA, 64 nt, Human
uaccuuuggaauauauuuaguucaucauuugagcugccuucauacugguuuccucagccuuccu

SEQ ID NO: 151473 - RNA, 64 nt, Human
aguagaaaggguuuaaguuugcuuguauuagcugugccuucauuauuuugcuauguaaauguga

SEQ ID NO: 151474 - RNA, 61 nt, Human
ggccccaaaccaaacucuagcugauccauguugccuucaaguuuguuuuucucgggggcau

SEQ ID NO: 151475 - RNA, 64 nt, Human
uaaugugucaaauuagagagcaaaguauaacaggugccuucacuuuugagacuuagugccuuaa

SEQ ID NO: 151476 - RNA, 64 nt, Human
ugacugcaguugccuuggaaauuccuccaaaguuugccuucaucucuccucuacaguuuggagg

SEQ ID NO: 151477 - RNA, 64 nt, Human
cuugcccuauuuuaauucugcuauagaaaacaauugccuucacuuuuaaggaguaauuugaaua

SEQ ID NO: 151478 - RNA, 64 nt, Human
aguacuuagcuaguuuuauucuugguuuucccuuugccuucauucugcaaguauacuagggagc

SEQ ID NO: 151479 - RNA, 64 nt, Human
auccucuuuuauaaacuuauagaaugucaaacuuugccuucaacuguuuuuauuucuagucucu

SEQ ID NO: 151480 - RNA, 64 nt, Human
caguauuguagaaagcuaauacaaaacuauccuaugccuucaaauaguauagaaaauggaaaau

SEQ ID NO: 151481 - RNA, 64 nt, Human
ucaauuugcugucuaguugagaauagagauugugugccuucauuucauuugacauuuacccagc

SEQ ID NO: 151482 - RNA, 64 nt, Human
ugcaaagaaaaguuucaccuguauugaaucagaaugccuucaacugaaaaaaacauauccaaaa

SEQ ID NO: 151483 - RNA, 64 nt, Human
cagugaaucuugaagaaaaaucuuuugguggaggugccuucagggaaaguuuucuucacccuca

SEQ ID NO: 151484 - RNA, 64 nt, Human
gcagcaauugcuuggugagcugugcagaauugauugccuucagcacagcauccucugcccaccc

SEQ ID NO: 151485 - RNA, 64 nt, Human
agugcccugagacacuuccagccaucccuccuccugccuucauuggggcagacuugcauugcag

SEQ ID NO: 151486 - RNA, 64 nt, Human
gaacucggcagauaauaaaacagacaaaagccuuugccuucaugaagcauacauucauucaggg

SEQ ID NO: 151487 - RNA, 64 nt, Human
caccccaggacagcgcuucuccguccaaugccaaugccuucagaccccgcugggaccgaagccg

SEQ ID NO: 151488 - RNA, 64 nt, Human
uguuucuguuuuggcaaggagaguuccacauuuuugccuucauggcuuauucaguaacccauaa

SEQ ID NO: 151489 - RNA, 64 nt, Human
ugucucgaaaaggaaucugaaaacaauggaaccaugccuucauaauucuagaaaguuauuuuca

SEQ ID NO: 151490 - RNA, 64 nt, Human
ggauccaauuguggauuuauuuacaaacaucaaaugccuucaagccaauccuuuuugcuguaug

SEQ ID NO: 151491 - RNA, 64 nt, Human
auguaguuuuuguuuuaugcaagaaacagaccugugccuucaaagcccacguaaagccucaaaa

SEQ ID NO: 151492 - RNA, 64 nt, Human
agugaaaaaguggagccuccauaaucagugugguugccuucagaccugaguacuuagcugaggg

SEQ ID NO: 151493 - RNA, 64 nt, Human
ggauccugcucuccaagcagacaccucugucaguugccuucacauagucauugucccuuacugc

SEQ ID NO: 151494 - RNA, 64 nt, Human
uaacuggacauucuggggaacugggcaccaggagugccuucauacacuguaccccagcucucuu

SEQ ID NO: 151495 - RNA, 64 nt, Human
acaagauuccucaaaauauuuucuguuaauaaauugccuucauguaaacuguuucaacuccagc

SEQ ID NO: 151496 - RNA, 64 nt, Human
cccuugccugaaucuggagugggguugagcccucugccuucaaccuuaagauuuaggaaguucu

SEQ ID NO: 151497 - RNA, 64 nt, Human
gagaauauaccuuauuuauuuuuguguaggugucugccuucacaaaugucauugucuacuccua

SEQ ID NO: 151498 - RNA, 64 nt, Human
cguaucugcucuaaaaugacuuguuccuggggaaugccuucaaccaaaacacagcuaguauuuc

SEQ ID NO: 151499 - RNA, 64 nt, Human
ccagcaaaguuuucagauuguaaagguaggugcaugccuucauaaauuauuucuaaaacauuaa

SEQ ID NO: 151500 - RNA, 64 nt, Human
agacgugcgggcggcacaugccuuggggacauccugccuucaggaccguggggccuggucaguc

SEQ ID NO: 151501 - RNA, 64 nt, Human
guaaggcaucaacguguaucugugggaucuucguugccuucaguaaucagggugugaaaaaagc

SEQ ID NO: 151502 - RNA, 64 nt, Human
ucacuggaugugagcuacuugagagcaggguuuaugccuucaucagcgugaccccugugccugc

SEQ ID NO: 151503 - RNA, 64 nt, Human
uguauaacccuacaaaauacauagaaguauuauuugccuucauaauagaacccaagagucuguu

SEQ ID NO: 151504 - RNA, 64 nt, Human
ugaaggugucauacagauuugcaaaguuuaauggugccuucauuugggaugcuacucuaguauu

SEQ ID NO: 151505 - RNA, 64 nt, Human
gcaaagauaauuuucgcuggugaacuucagaacuugccuucaggguuagcuucauguaauuuua

SEQ ID NO: 151506 - RNA, 64 nt, Human
gccgauaggugcugucuccuccggggacccagacugccuucaucucugauggcagucugaucac

SEQ ID NO: 151507 - RNA, 64 nt, Human
gugacuaucuaucucccccgacuucuaccagggaugccuucacgccaaggcuguucucaccagc

SEQ ID NO: 151508 - RNA, 64 nt, Human
agcaguggggugaaauuuucuuaaccccuaagacugccuucaguaggaacaagcuggcuucugu

SEQ ID NO: 151509 - RNA, 64 nt, Human
uccuggcagugauggggaaagcuuuuucugaagcugccuucaccacugccuaccuguucacuuc

SEQ ID NO: 151510 - RNA, 64 nt, Human
gccuuuuuuaaaaauauauuugacagaaaccaggugccuucagaggcucucugauuuaaauaaa

SEQ ID NO: 151511 - RNA, 64 nt, Human
ugucuggucaucuggaacuugaaaaauccucaaaugccuucacucuuuuaccuaacucccuagu

SEQ ID NO: 151512 - RNA, 64 nt, Human
gaaauacccaaaauuccaaguucucgauuucacaugccuucaagacugaacaccgacuaagguu

SEQ ID NO: 151513 - RNA, 64 nt, Human
uaagcaagacagccauaugaugcagguuaugcagugccuucauaucuaaaacuuuuauacugca

SEQ ID NO: 151514 - RNA, 64 nt, Human
ccauuuuuuucccaguuccacaaaacacucuguuugccuucaguuuuuacucacuagacaauaa

SEQ ID NO: 151515 - RNA, 64 nt, Human
uucauaaaccacaaagucucucuagaauuuuuucugccuucacuaaaauuggacuguagccaag

SEQ ID NO: 151516 - RNA, 64 nt, Human
uaagagaauucacaccggagaacaacuuuuuaaaugccuucagugucaguugugcugcagacag

SEQ ID NO: 151517 - RNA, 64 nt, Human
ccacugccacagggguauucugccuucaggacucugccuucaggaacacgggucuguagagggu

SEQ ID NO: 151518 - RNA, 64 nt, Human
cacucugagcugugccacugccacagggguauucugccuucaggacucugccuucaggaacacg

SEQ ID NO: 151519 - RNA, 64 nt, Human
ccccuugcuucccaggcccuugacauggcuuaccugccuucacucccagcaccuugcccaacag

SEQ ID NO: 151520 - RNA, 64 nt, Human
ucggguggcgggauggggagcagcuugguccaugugccuucaggggguuguuacuugagagcuc

SEQ ID NO: 151521 - RNA, 64 nt, Human
gagcauaucagggaaagaaaaguugaugauagauugccuucacccucacagcgcacaaauaaag

SEQ ID NO: 151522 - RNA, 64 nt, Human
uacuuuucucaaaggccauuuccaaaagaauacaugccuucacaucacaaccuguacugugagu

SEQ ID NO: 151523 - RNA, 64 nt, Human
gcugcuucaaaacauaaugugcauugcuuaugaaugccuucauauacuaauacagauacucuga

SEQ ID NO: 151524 - RNA, 64 nt, Human
uguggguaguggugaaggaccgauaucagaaaaaugccuucaaguguacuaauuuauuaauaaa

SEQ ID NO: 151525 - RNA, 64 nt, Human
uuauacuuguugauuaaucggaauguuuguuguaugccuucauuuuccauuucacuuauaugug

SEQ ID NO: 151526 - RNA, 64 nt, Human
gcucaaaagcuguugggaacgccuucugaacaguugccuucagaacuaguuugagcugcucaau

SEQ ID NO: 151527 - RNA, 64 nt, Human
uggcuggugaaaccauauaaucacagaaaaacauugccuucagcauguucaguucgcagcacug

SEQ ID NO: 151528 - RNA, 64 nt, Human
ccugaggggauuugaaucacagccccgaagguccugccuucaccccauugggagagagcagggc

SEQ ID NO: 151529 - RNA, 64 nt, Human
acuuuuagcaugcugcacagaaacugguauaacaugccuucaguauacuaacacucauaugcuc

SEQ ID NO: 151530 - RNA, 59 nt, Human
aucuggaaggcgucgacuaagccucaccgugccuucagaggcuucuuccugccucuuug

SEQ ID NO: 151531 - RNA, 64 nt, Human
acagaagugcuugcccggggagucccgccugaccugccuucauguggacccuuagaacagcacu

SEQ ID NO: 151532 - RNA, 64 nt, Human
uagguucuacaggaaauacagagaugaacaacuuugccuucaaaaaugugcugccuagaaacag

SEQ ID NO: 151533 - RNA, 64 nt, Human
aaaaucagugggauucuggugcugaugaauagguugccuucagaguauuauugacagacagcuu

SEQ ID NO: 151534 - RNA, 64 nt, Human
accuguuucugagaguggaucucaagcaaguucaugccuucaaucagauguuacuuaggguggg

SEQ ID NO: 151535 - RNA, 64 nt, Human
uuagccuguagauccagaacggagccugaugugaugccuucacugguugauauauugcaaauag

SEQ ID NO: 151536 - RNA, 64 nt, Human
uucuucaccuccugccagcaaccccaaacccaagugccuucagaggauaaauaucaauggaacu

SEQ ID NO: 151537 - RNA, 64 nt, Human
uuguauaccuauguuaggaauauuuguuuuauacugccuucagguccucuguucucuuacuaau

SEQ ID NO: 151538 - RNA, 64 nt, Human
gaccucaagaucaaaugaccugugaggaauauguugccuucauccuagcugcuggggaagcggg

SEQ ID NO: 151539 - RNA, 64 nt, Human
aacugugugugccuuuaaccaguuaaaagaacagugccuucagcauacuuuuuuauuaguugua

SEQ ID NO: 151540 - RNA, 64 nt, Human
ucugugucaucucugcacacuccagcccacuuucugccuucagccauugaguggaagcugcccc

SEQ ID NO: 151541 - RNA, 64 nt, Human
cccccacuccucacaccucacaugucccaggagcugccuucauucaggcggguagcugcacugg

SEQ ID NO: 151542 - RNA, 64 nt, Human
ugcccucagcucuuagcuggucuaagaaugacgaugccuucaaaaugcugcuuccacucagggc

SEQ ID NO: 151543 - RNA, 64 nt, Human
gaaaacuggaauaagaagcaaauaaauaucauccugccuucauggaacucagcugucuguggcu

SEQ ID NO: 151544 - RNA, 64 nt, Human
cagggccgccagggugacacaggccacccuuccuugccuucaguaacucggugggcccagguuc

SEQ ID NO: 151545 - RNA, 64 nt, Human
ggagccguggggggacagcgacugggggccuccaugccuucaccacgcgcucuacggaggcuuc

SEQ ID NO: 151546 - RNA, 64 nt, Human
agccccacgaguccccaccucucagugcugacggugccuucauguccccgccggcccugccccu

SEQ ID NO: 151547 - RNA, 64 nt, Human
auaaggucccugcuccacccgaccccaccugcggugccuucagccccaaccaaagacacuagug

SEQ ID NO: 151548 - RNA, 64 nt, Human
uuuuuucccuuguaaaugccccucccccagcugcugccuucauauugaagguuuuugaguuuug

SEQ ID NO: 151549 - RNA, 64 nt, Human
ccagccccuuucuggccccaugggguuucucugaugccuucaucauagaggcccggggcugguc

SEQ ID NO: 151550 - RNA, 64 nt, Human
uuauuucagagaacacagggcaagacacauacagugccuucagauauuaagcauuccacaacau

SEQ ID NO: 151551 - RNA, 64 nt, Human
uuuguuauugcagugcaacuaaagagcaucuaugugccuucaucaagaagcccauguuuugaga

SEQ ID NO: 151552 - RNA, 64 nt, Human
cgacccacguggugacugcaaagcccuggguacuugccuucauguucugguuugguuuucccuu

SEQ ID NO: 151553 - RNA, 64 nt, Human
cagucacagccucugauuuuuuccaagaagagauugccuucaccauuguuaaaugucagccugu

SEQ ID NO: 151554 - RNA, 64 nt, Human
gaggucuccuguuggcuacacucuaaagcugcuuugccuucauguucaaacagauucaggcacc

SEQ ID NO: 151555 - RNA, 64 nt, Human
ucacccucaucccgcagcugcagagacuggaaacugccuucaaggccacggcuggucaucugcu

SEQ ID NO: 151556 - RNA, 64 nt, Human
gcaauuauacggggacucagaaggaccuggccgcugccuucauugaguuuaaagggacaggauu

SEQ ID NO: 151557 - RNA, 64 nt, Human
aacguacaguuugauccugaguaugcuugguguuugccuucagaaaaaaaaaaauacauuguaa

SEQ ID NO: 151558 - RNA, 64 nt, Human
uguccucuggcagggcugugacugcugcaagcucugccuucaccaguagcuggugccaggacag

SEQ ID NO: 151559 - RNA, 64 nt, Human
uccucuuuuuauguugaguugcugcuucccggcaugccuucauuuugcuauggggggcaggcag

SEQ ID NO: 151560 - RNA, 64 nt, Human
uuccugagcuuucuccugucgguuuggucuguuuugccuucacccauaagccccucgcacucug

SEQ ID NO: 151561 - RNA, 64 nt, Human
gccggcugccuaccaggggccuuccuguguggccugccuucaccccacucagcucaccucuccc

SEQ ID NO: 151562 - RNA, 64 nt, Human
aggacauccaguuccccagcuguaguuauguaucugccuucaagucucugacaaaugugcugug

SEQ ID NO: 151563 - RNA, 64 nt, Human
augaaaaaaauauuuuagcuuagacuaagcuaccugccuucaaaauaguuuagggaccaccacc

SEQ ID NO: 151564 - RNA, 64 nt, Human
aucucuucgcucugucuuccacaaacaaaaauucugccuucagacauuugguguuaguauuuca

SEQ ID NO: 151565 - RNA, 64 nt, Human
aagagauuuaauuaaucaugaauguguaacacagugccuucaauaaaugguauagcaaauguuu

SEQ ID NO: 151566 - RNA, 64 nt, Human
uaaccucaccaauaaaggguggauguucaacaugugccuucaaaugugacccacugagaaggaa

SEQ ID NO: 151567 - RNA, 64 nt, Human
gaaauaaauuuauuucaauauuagcaagacagcaugccuucaaaucaaucuguaaaacuaagaa

SEQ ID NO: 151568 - RNA, 64 nt, Human
ucgaaagcuguuaaauucucagguugucagguucugccuucaaggguuguuggaaaauaguccc

SEQ ID NO: 151569 - RNA, 64 nt, Human
uuacaauccaaagcaauucuacugacagaaguguugccuucauaaucaaacagcuuguuuuucc

SEQ ID NO: 151570 - RNA, 64 nt, Human
caaccuucaucucacuccugagggcccaggucucugccuucauuguugcuuuuucugguggggg

SEQ ID NO: 151571 - RNA, 64 nt, Human
cuucaggucacuuauacuucuuauuuugcuugccugccuucaucccucauuuccucccucucau

SEQ ID NO: 151572 - RNA, 64 nt, Human
ugguuuuuaagaauuucuugauacucuuauagccugccuucaauuuugauccuuuauucuuucu

SEQ ID NO: 151573 - RNA, 64 nt, Human
auauaauguguguuguaaauauccugugguuuucugccuucaccaguaugaggguagccucgga

SEQ ID NO: 151574 - RNA, 64 nt, Human
cuuaagauuguccacauccuucaugcaagacugcugccuucauguaacccugggcacagugugu

SEQ ID NO: 151575 - RNA, 64 nt, Human
ugagagcucccuugccuuaccuggaggaagaaugugccuucaggccacagucgugcugcuagaa

SEQ ID NO: 151576 - RNA, 64 nt, Human
aauugguuucauuuaaagaucaauauacuaggucugccuucacuuuauagaaaacuagcuucua

SEQ ID NO: 151577 - RNA, 64 nt, Human
uaagaagcaauaacuauuuuuccucauuaauagcugccuucaaggacuguuucagugugaguca

SEQ ID NO: 151578 - RNA, 64 nt, Human
gcuguaugcauuauuguucuuuguugcuguuuuaugccuucauauuagcaaauaugaaauucug

SEQ ID NO: 151579 - RNA, 64 nt, Human
uauuauuguucuuucacuuauucagaacauuacaugccuucaaaaugggauuguacuauaccag

SEQ ID NO: 151580 - RNA, 64 nt, Human
ucuuuuuccaguaggagagaaguuugcugaggaaugccuucaagcacaaagugaugaaugacug

SEQ ID NO: 151581 - RNA, 64 nt, Human
gaggaaugccuucaagcacaaagugaugaaugacugccuucaagucucaagaaaacacuuuucc

SEQ ID NO: 151582 - RNA, 64 nt, Human
uuugcagcugcugucugaguaguggccacuggggugccuucacugggccagucaacggggggcu

SEQ ID NO: 151583 - RNA, 64 nt, Human
uacugcucauccucaccugcccccuggcccuugcugccuucauucugucccaaugccagcuccc

SEQ ID NO: 151584 - RNA, 64 nt, Human
cugaagacccugguccaggauucgcccucucccaugccuucaagucagcaucaggcuuagggca

SEQ ID NO: 151585 - RNA, 64 nt, Human
agguguggccuuguuucuccuugcccagcagugcugccuucagcggccgugacggggccagcug

SEQ ID NO: 151586 - RNA, 64 nt, Human
cuggccacugggaguggaucgguggugaaccuguugccuucaccaaugggagaagagggcccuc

SEQ ID NO: 151587 - RNA, 64 nt, Human
uccacuguagcaaaauaagcacccccaccccaucugccuucaggucuucuucacagccugcacu

SEQ ID NO: 151588 - RNA, 64 nt, Human
gcaguacauccccuguccccuccccaaccccaagugccuucaugcccuagggccccccaagugc

SEQ ID NO: 151589 - RNA, 64 nt, Human
ugaaaugggaguuccugagauacaacaaaaugugugccuucaaagaaacugacagcuuuguauu

SEQ ID NO: 151590 - RNA, 64 nt, Human
uuacacagacccaaacaaaaaaauaauaaucaaaugccuucaauuucugagaaaaugaggcaga

SEQ ID NO: 151591 - RNA, 64 nt, Human
ucaacaccuuuuuguuaguaaucauugccaguagugccuucaucaguuaagggaggugucccag

SEQ ID NO: 151592 - RNA, 64 nt, Human
cuucauauaacaugcuucgugccaucaugauccuugccuucauauaacaaacaugcuucgucag

SEQ ID NO: 151593 - RNA, 64 nt, Human
gccuucauauaacaugcuucgugcucauggucauugccuucauauaacaugcuucgugccauca

SEQ ID NO: 151594 - RNA, 64 nt, Human
aaaguauuuugguggcagcugccaucauggucauugccuucauauaacaugcuucgugcucaug

SEQ ID NO: 151595 - RNA, 64 nt, Human; identical to SEQ ID NO: 151516

SEQ ID NO: 151596 - RNA, 64 nt, Human
uuuuaaccccucugugcuuuagcagccgugaccuugccuucauugcuucauccagugcaggccu

SEQ ID NO: 151597 - RNA, 64 nt, Human
ugaacaaauacacugaugagucaucagugaaauuugccuucacauuuuaagaaaacuuuaucuu

SEQ ID NO: 151598 - RNA, 64 nt, Human
uccgcccgagugcagaggaaaaccagaaacgccuugccuucagcugaaccaccguuugugcgag

SEQ ID NO: 151599 - RNA, 64 nt, Human
uuaaaauagcauacuguguauguuuuauaucaaaugccuucaugaaucuuucauacauauauau

SEQ ID NO: 151600 - RNA, 64 nt, Human
gcuuaauuaaaaaccuacaauuuacacaccucccugccuucaagacugugagcuuuggauagcc

SEQ ID NO: 151601 - RNA, 64 nt, Human
acuuuuuauauacuaguuacuccuaaagaugugcugccuucauaagauuuggguugauguauuu

SEQ ID NO: 151602 - RNA, 64 nt, Human
augauggaaggaaucugcuuucugaacucuaaugugccuucauugauuaucauuaaaauuauca

SEQ ID NO: 151603 - RNA, 64 nt, Human
ucagauguacacaacuuccuuaaagucaaaugucugccuucaguucccuuaagguaguucuugc

SEQ ID NO: 151604 - RNA, 64 nt, Human
aaccagccaguggaaauuacucaaacacguauugugccuucaaugagaagccuucucacugaaa

SEQ ID NO: 151605 - RNA, 64 nt, Human
acugcacagagccgugucccagacacgcugucagugccuucaacacggagccgguuuguucauu

SEQ ID NO: 151606 - RNA, 64 nt, Human
guauucagacugcaugggccggccuaggagucuuugccuucauaaauuuuaagaaccccgccca

SEQ ID NO: 151607 - RNA, 64 nt, Human
auuuuaagaguuacuuaauguuugguaacuuuuaugccuucacuuuacaaauucaagccuuaga

SEQ ID NO: 151608 - RNA, 64 nt, Human
uuccaaggaauucugagaguaggcaaacaaauuuugccuucaugguacaguucucaguuuuucu

SEQ ID NO: 151609 - RNA, 64 nt, Human
ucuucauaugccaacaggggcgcucuugacacugugccuucauuuuccagcccacagccugggu

SEQ ID NO: 151610 - RNA, 64 nt, Human
gggggguggucaccccccuucacuccagcccgccugccuucagccuuccaugagcuucaccugc

SEQ ID NO: 151611 - RNA, 64 nt, Human
uuuagacuauuccauacauuuuagguauauuuugugccuucagacacugcaaauaauaaucagc

SEQ ID NO: 151612 - RNA, 64 nt, Human
ucuagcacacaacugugaauguccuguggaauuaugccuucaguucuuuuccaaaucauuccua

SEQ ID NO: 151613 - RNA, 64 nt, Human
uuuuuuuucacugccuucauuauguaucuucucuugccuucauuauuuuauuuuauuauuucuu

SEQ ID NO: 151614 - RNA, 64 nt, Human
ccauuguuccuacauuuuguagguuuuuuuucacugccuucauuauguaucuucucuugccuuc

SEQ ID NO: 151615 - RNA, 64 nt, Human
cagccuuuuuuuuuuuucuucuguacucuucuuuugccuucaauaugaguuucauuuccucugu

SEQ ID NO: 151616 - RNA, 64 nt, Human
ccacagcuauuuagaagcaucaucacgacacauuugccuucagucuugguaaaacauuacuuau

SEQ ID NO: 151617 - RNA, 64 nt, Human
cccaggcagggcagcaugggacccagugucucagugccuucaaaacccacccccaccccuaccc

SEQ ID NO: 151618 - RNA, 64 nt, Human
uccaauacuuagcaguuggggauuaaaccauccuugccuucaguucucuccaauauuaccaggc

SEQ ID NO: 151619 - RNA, 64 nt, Human
aguuagaaauuguaacuuugauauugaauucucuugccuucaacaagcacacugacagagaaaa

SEQ ID NO: 151620 - RNA, 64 nt, Human
agaauggggcugcucugagggaaacgcugucugcugccuucauacagaugcugauuaaagugau

SEQ ID NO: 151621 - RNA, 64 nt, Human
caucccggggcgucccccgcgucuguguccuugcugccuucauccccuggggccugugaauaaa

SEQ ID NO: 151622 - RNA, 64 nt, Human
ccugugucagggagaggaggcggcgagagaggacugccuucagggcauccggagcuuccugagg

SEQ ID NO: 151623 - RNA, 64 nt, Human
ccccgguucgagagccgagucugugggcacucucugccuucaugcaccuguccuuucuaacacg

SEQ ID NO: 151624 - RNA, 64 nt, Human
uuauuuugcaaaacagugcaauagaaucuaguuaugccuucaucacuguugacaguaaauacug

SEQ ID NO: 151625 - RNA, 64 nt, Human
gcuaaaauauguaaaccuuucuagguaaaccgcuugccuucaucuugagucggaauauauuuaa

SEQ ID NO: 151626 - RNA, 64 nt, Human
uggauugccggggaugucccuuuaaacagacugcugccuucagcuaaaaacuuaauguucuuua

SEQ ID NO: 151627 - RNA, 64 nt, Human
cgaggcgcugacugcacggcugaccgccugcucgugccuucauucugcagcggcauggucccuc

SEQ ID NO: 151628 - RNA, 64 nt, Human
agauuaugagugaacccccaaauaggguguuuucugccuucaaauaaaagucaccccugcaugg

SEQ ID NO: 151629 - RNA, 64 nt, Human
uuccuccaccaggagccugggauauggcuccaucugccuucagggccuggacugcacucacaga

SEQ ID NO: 151630 - RNA, 64 nt, Human
uugggccacggugucucugcauugccugccuuuuugccuucaccucuuuucuuccccgcccccu

SEQ ID NO: 151631 - RNA, 64 nt, Human
guaccuaugucaagagaagggaugaggccaaggcugccuucaauuagaagcagccgcccacaga

SEQ ID NO: 151632 - RNA, 64 nt, Human
gccuggugucccgcagucccaggaagccgcuucuugccuucauggcugagugcugggaagggcu

SEQ ID NO: 151633 - RNA, 64 nt, Human
accuccuuccauggcucagcucuccacugggcccugccuucagccuccucacuccggaaaugca

SEQ ID NO: 151634 - RNA, 64 nt, Human
agaugucccuccuuuccuuggccugauccuugucugccuucacuucccuaggcugggcugaggg

SEQ ID NO: 151635 - RNA, 64 nt, Human
cugucugccguggcccaggacucgcccgcccaccugccuucagccugcuugccucucccuagcc

SEQ ID NO: 151636 - RNA, 64 nt, Human
uauccagccccguuuuugcugcuuccagggccucugccuucaaggcccccauggggcuguccau

SEQ ID NO: 151637 - RNA, 64 nt, Human
cacagccuaacgcugucaagacaugcuucaacauugccuucauuccuuaaaaaccuacaaaagg

SEQ ID NO: 151638 - RNA, 64 nt, Human
auaauggggaaauaauuaugaauuauagaaauuaugccuucauucucuuacauuuguguggguu

SEQ ID NO: 151639 - RNA, 64 nt, Human
uguaaugaacacauuaacgacuagauuaaaauauugccuucaagauuguucuuacuuacaagac

SEQ ID NO: 151640 - RNA, 64 nt, Human
augggcccugccuccccauaggccauuuggacucugccuucaaacaaaggcaguucaguccaca

SEQ ID NO: 151641 - RNA, 64 nt, Human
ggaagggaaucaugccuucuauauacagacagauugccuucagaagaguggaagaaaaucucca

SEQ ID NO: 151642 - RNA, 64 nt, Human
aauaaauuauugaggggacuaggcuauaugcauuugccuucauccacccauguuuauuaagaau

SEQ ID NO: 151643 - RNA, 64 nt, Human
accuccuuccauggcucagcucuccucugggcccugccuucagccuccucacuccagaaacgug

SEQ ID NO: 151644 - RNA, 64 nt, Human
cccacagauccuauccuccaagccagcccaccucugccuucaucauaucccaggauacuguuug

SEQ ID NO: 151645 - RNA, 64 nt, Human
ccacgcaguucuuuccaugggcauagguaagcugugccuucagcuguugcagaugaaauguucu

SEQ ID NO: 151646 - RNA, 64 nt, Human
gaaauucuagagcugcucugcugcaaggauuuccugccuucagacugaagaagcccccuuauca

SEQ ID NO: 151647 - RNA, 64 nt, Human
agaguuaaauauucaaauuuauuuauguucgguuugccuucaccugguguaguaaaaucaaaug

SEQ ID NO: 151648 - RNA, 64 nt, Human
ccuccccaucccaccugugugcagugcccuugccugccuucacccccaccaccacuucuccaau

SEQ ID NO: 151649 - RNA, 64 nt, Human
gucuggggaagucugugcuggcaucuccucauugugccuucaucagagcuggugccuucgggcc

SEQ ID NO: 151650 - RNA, 64 nt, Human
guccaguaccuaaucacgcucuguuccuugcuuuugccuucaagggaauuccgaguguccagca

SEQ ID NO: 151651 - RNA, 64 nt, Human
accucuuuccauggcucggcucuccucuaggcccugccuucagcuuccucacuccggaaacaug

SEQ ID NO: 151652 - RNA, 64 nt, Human
gccuuuuugaaguucugacccaccaaagaccuucugccuucacccuccuccccaccugaugucc

SEQ ID NO: 151653 - RNA, 64 nt, Human
uccagaugccaggcaugggaggcggcuugugcuuugccuucacuuggaagccaccaggaacaga

SEQ ID NO: 151654 - RNA, 64 nt, Human
cagcuugggguccaauccaucugucccuggcaugugccuucauguaguaggugcuuuccugauc

SEQ ID NO: 151655 - RNA, 64 nt, Human
ugagaaauacagugcuuuauggcucuaacauuacugccuucaguaucaaggcugccuggagaaa

SEQ ID NO: 151656 - RNA, 64 nt, Human
ccuuuggccuuagacuccguuagcuccuauuuccugccuucagacaaacaggaaacuucugcag

SEQ ID NO: 151657 - RNA, 64 nt, Human
cagaaaucucuauugaugcuuuuaaugcauugccugccuucagguuuucuucuuaccccacccc

SEQ ID NO: 151658 - RNA, 64 nt, Human
uucagaaucuuuuucugcaucaauucagucaauuugccuucaacaaagagaagucagcaaguuc

SEQ ID NO: 151659 - RNA, 64 nt, Human
gugacucagucaggacugacaguaaugugauaauugccuucauuuucaacccaggagugccucu

SEQ ID NO: 151660 - RNA, 64 nt, Human
cccaugcuggucuggcaaacacaccuuucugcuuugccuucacaaaaguaauguguucccuuuc

SEQ ID NO: 151661 - RNA, 64 nt, Human
ccccccuccgcccccaugcucucuguggccuccaugccuucaagacuucugucuguaucuaucu

SEQ ID NO: 151662 - RNA, 64 nt, Human
uccccucccugccugcuccuuggcacccccaugcugccuucagggagacaggcagggagggcuu

SEQ ID NO: 151663 - RNA, 64 nt, Human
cuuaggcaaaauaccagcugaugaaggcaucugaugccuucaucuguucagucaucuccaaaaa

SEQ ID NO: 151664 - RNA, 64 nt, Human
agccaaguuuuguugauaaaccuauuuccuagcaugccuucaggaaguugugccagacccuaga

SEQ ID NO: 151665 - RNA, 64 nt, Human
cuuuggucuggggacaauccccuuggcugcucuuugccuucaaugaguuuccugcaugacagag

SEQ ID NO: 151666 - RNA, 64 nt, Human
agcugugagaggcaucagaaccucacguucggacugccuucaucaagacaacucuaggggacca

SEQ ID NO: 151667 - RNA, 64 nt, Human
uggggagugaggugagacauagcggcccgggcgcugccuucacuccuggagugaguuuccauuu

SEQ ID NO: 151668 - RNA, 64 nt, Human
ggggcucagggaagcagucucuuucgaggcuggcugccuucacagccagcugugaggucagucc

SEQ ID NO: 151669 - RNA, 64 nt, Human
augucagaacccugucuuuuaaaaaggcagucgcugccuucagguggugcugccccagaaacuu

SEQ ID NO: 151670 - RNA, 64 nt, Human
uaagcaaagugauacaaacacagugauuugggaaugccuucauuuacaaugcaauacuuacauu

SEQ ID NO: 151671 - RNA, 64 nt, Human
ucuggggccauuuccaccacaguuggggcucuccugccuucacgcgugggugucugcuacuucc

SEQ ID NO: 151672 - RNA, 64 nt, Human
uguuccacauggucuaauuuuaacauaaauaauaugccuucacacuggauuguaaaaggcaugu

SEQ ID NO: 151673 - RNA, 64 nt, Human
ggcccaggccuccaguccuugcaugaaaggcauuugccuucauaaggaucaagguucaggccac

SEQ ID NO: 151674 - RNA, 64 nt, Human
aauucucacggaauuccuggaaaugauugugaauugccuucaaauaauagaaaaguguauuuau

SEQ ID NO: 151675 - RNA, 64 nt, Human
ccuuccucauuggccuuggaguccuacuauuucgugccuucauuuguguuacauacauagcugc

SEQ ID NO: 151676 - RNA, 64 nt, Human
agacagagcuccucaaaccauuguggauaucuucugccuucaaccacagaucaaauacuucaag

SEQ ID NO: 151677 - RNA, 64 nt, Human
ccaugggucccuuacuagagagguugagugaauuugccuucaguuaacaugggaccuucuguuu

SEQ ID NO: 151678 - RNA, 64 nt, Human
ucuaccuggaaucucucucucaacaaaagguauaugccuucaggaaugauauaaucugucccau

SEQ ID NO: 151679 - RNA, 63 nt, Human
ggaugauaauaccaagaugaagccacugguuccugccuucaaguucuuucaaguuuuuauuuu

SEQ ID NO: 151680 - RNA, 64 nt, Human
uggcuaauuuuacuuugcaugauaugccuuaauaugccuucauaaauaaccauuuuaagucaua

SEQ ID NO: 151681 - RNA, 64 nt, Human
cuuuguacuuacugcccugccugugacaguuguaugccuucauuuuguauccaacagcaaaguc

SEQ ID NO: 151682 - RNA, 64 nt, Human
gcaaacauuaccuucuuagucacgugcauauuuuugccuucauucuuaccaccuggccugcaaa

SEQ ID NO: 151683 - RNA, 64 nt, Human
agcaaagaggaagacagcuuuuaacacaguucccugccuucacaagaggugucagauuaagaug

SEQ ID NO: 151684 - RNA, 64 nt, Human
cugcacgugaucugcuggccucaggcugcugcucugccuucauugcuggagacaguagaggcau

SEQ ID NO: 151685 - RNA, 64 nt, Human
uaguucugauaguuaaauauuuugguuuguucugugccuucaguuuaaauuauuucaggauuuu

SEQ ID NO: 151686 - RNA, 64 nt, Human
ccuuauagaaauacaaguaagacuuaggauaauuugccuucaaaacaguuuuccuaaucucagc

SEQ ID NO: 151687 - RNA, 64 nt, Human
augagaaauauaaaaauaauuaaaacaaaauccuugccuucaaacgaaauggcucggccaggca

SEQ ID NO: 151688 - RNA, 64 nt, Human
auuagaccauagccacaaaauauuuaauguguugugccuucaugauguaacagaacauucucca

SEQ ID NO: 151689 - RNA, 64 nt, Human
cguugugccagguuccacucaaguaaauuaucucugccuucaaggagcuugcaguauagugaga

SEQ ID NO: 151690 - RNA, 64 nt, Human
aacacgcagauccuuugucuacagagagaaaaauugccuucaucccccaagaggaugcggugaa

SEQ ID NO: 151691 - RNA, 64 nt, Human
cuucuccugcaggagucagagcagccacauugcuugccuucauacccuggagguggggaaguua

SEQ ID NO: 151692 - RNA, 64 nt, Human
uuggcaucauccugguuuccaucuuugccuaugaugccuucaagaucuaccggacugagauggc

SEQ ID NO: 151693 - RNA, 64 nt, Human
uucaauugaaucagaaggggacaaaauuaacgauugccuucaguuuguguuguguauauuuuga

SEQ ID NO: 151694 - RNA, 64 nt, Human
aguuuauuugggcuagacuggaaugcagcaguacugccuucaggccuggacagccaggggcucc

SEQ ID NO: 151695 - RNA, 64 nt, Human
acuuauucuuucguguaaagauauguuuauuuuuugccuucagagggucagacgaccaguugcc

SEQ ID NO: 151696 - RNA, 64 nt, Human
uucuucaucuuuaaccuggcagaaacugcucacaugccuucaaaagugaaagcucaacucuacg

SEQ ID NO: 151697 - RNA, 64 nt, Human
caagccaugauggaaaaugccccuuccaaucagcugccuucacaagcagggaucagagcaacuc

SEQ ID NO: 151698 - RNA, 64 nt, Human
uuuucuuugagcuugugaaagcucuguguucuuuugccuucaaucuguugucuucaaaacaaac

SEQ ID NO: 151699 - RNA, 64 nt, Human
ggcuccagagcccugcccuaaccccuuggcugugugccuucaccucacccucuucaagcaccuu

SEQ ID NO: 151700 - RNA, 64 nt, Human
acacaacagcauugcacggggccggcacugccgcugccuucacugaaggcugcagugcuguucu

SEQ ID NO: 151701 - RNA, 64 nt, Human
ccauguucgagaccugaggcuggcucaagccggcugccuucaccgggagccacgccgugcaugg

SEQ ID NO: 151702 - RNA, 64 nt, Human
ccaccaucuuuuauaaauugccauggaaaccaagugccuucaaugaaacaagccugaauaauuu

SEQ ID NO: 151703 - RNA, 64 nt, Human
uccauccaguccugaggagccuuaggaugcagcaugccuucaggagacacugcuggaccucagc

SEQ ID NO: 151704 - RNA, 64 nt, Human
aaauugccccacggccauauccacccauugacucugccuucaucaaggaaggugggaaguaaaa

SEQ ID NO: 151705 - RNA, 64 nt, Human
uccaaggaggcacagccgucauuacuguccuccaugccuucagcagccccccucacagcuaagg

SEQ ID NO: 151706 - RNA, 64 nt, Human
ggggcagggaaggacaggacccucaggaauucagugccuucaacaacgugagagaaagagagaa

SEQ ID NO: 151707 - RNA, 64 nt, Human
uugagcagagauugggaggacuuuacugugguucugccuucacacccccuagagagcuaaugua

SEQ ID NO: 151708 - RNA, 64 nt, Human
cugggacggcggcaguauugaagcucgugacaagugccuucacacagaccccucgcaacugucc

SEQ ID NO: 151709 - RNA, 64 nt, Human
aggaaggcgaagaaucaaguaaucucuaggcaaaugccuucaaguuuuccaguucugagguaac

SEQ ID NO: 151710 - RNA, 64 nt, Human
ucccuggcaucagcuacugcaguacugggguacuugccuucaucuuuuuucugaagauaguuac

SEQ ID NO: 151711 - RNA, 64 nt, Human
aggcaggugccaggaacuccccuucuuccuggagugccuucauugaggaaggaaaucuggcccu

SEQ ID NO: 151712 - RNA, 64 nt, Human
agaaggggaguccucucuucccacaaguccauucugccuucaaaguguaaguucucaugucauu

SEQ ID NO: 151713 - RNA, 64 nt, Human
aagucccauguggggcugccaggagccaagagcaugccuucaugcccuucucugcagagcaugg

SEQ ID NO: 151714 - RNA, 64 nt, Human
agcggcugugcucuucugggagguucccgcuugcugccuucagccagggcgcuccucagagcuc

SEQ ID NO: 151715 - RNA, 64 nt, Human
gauaugagcuggagugcaaggaguccuuccacccugccuucagguucucucuggagaaagguua

SEQ ID NO: 151716 - RNA, 64 nt, Human
gucccuccgcacucuccaucagcaaccucacaccugccuucagacccggcugcaacuuccuaag

SEQ ID NO: 151717 - RNA, 64 nt, Human
uucaguguuuguauauaugccugaaaaaguauuuugccuucauuuuugaaaguaguuuuugcug

SEQ ID NO: 151718 - RNA, 64 nt, Human
cuagaaaugucaugauugagcuucagagcuaaaaugccuucacccuucccccaaguuggaauau

SEQ ID NO: 151719 - RNA, 64 nt, Human
gacuuccuagagacuuguuucugagacaguucuuugccuucacuucccugcuagcugggaaaga

SEQ ID NO: 151720 - RNA, 64 nt, Human
uaacuaaaacgcuuugcuuuuaauguuaaaguugugccuucacauuaaauaaaacauauggucu

SEQ ID NO: 151721 - RNA, 64 nt, Human
uugcucacagccacauuuccauuugcaucauuacugccuucaccugcauagucacucuuuugau

SEQ ID NO: 151722 - RNA, 64 nt, Human
accgcguucggaggacgcacccucacuccccugcugccuucacuccuuucugaccaagcaacgc

SEQ ID NO: 151723 - RNA, 64 nt, Human
gagguucauugccgugcuuucaugcagaguguuuugccuucauguuagcuuccggcuccccucc

SEQ ID NO: 151724 - RNA, 64 nt, Human
aacuagagaaggacccggaggggccuggcagccgugccuucagcucuacagcuaaucagcauuc

SEQ ID NO: 151725 - RNA, 64 nt, Human
augcuucuagccucccaguaggaggccccagccaugccuucaaccuggcaggagguguagccac

SEQ ID NO: 151726 - RNA, 64 nt, Human
aggugaagaaugucuggcuccagcccuuucucugugccuucagcagccccuguccucaccaugg

SEQ ID NO: 151727 - RNA, 64 nt, Human
accaggcuggaacccaagccccuuccuccacagcugccuucaguggguagaauggggccagggc

SEQ ID NO: 151728 - RNA, 64 nt, Human
ucucccuguggcagcaggcauggagagucagggcugccuucauggcaguaggcucuaagugggu

SEQ ID NO: 151729 - RNA, 64 nt, Human
ucuuaggagauagaugcuggauuauauaggugaaugccuucaagaaauguguaauuuaauucca

SEQ ID NO: 151730 - RNA, 64 nt, Human
agcccucagugucgaaggugagcuuguaggugccugccuucaucugguccaggacagugaccau

SEQ ID NO: 151731 - RNA, 64 nt, Human
ugcagggccucugucaauuguacgcgccaccgagugccuucaacacagcuugucucuugccugc

SEQ ID NO: 151732 - RNA, 64 nt, Human
ugggucauccguucagcacgugguggagaacaagugccuucagggcuggccucggccucgaguc

SEQ ID NO: 151733 - RNA, 64 nt, Human
agacugacacccugguucagaacaccaucaaagaugccuucaagggcugcacugugcugaccau

SEQ ID NO: 151734 - RNA, 64 nt, Human
ucucggcuaugggaaggaaggauugcucauugguugccuucaucaguuacagcaugagacggaa

SEQ ID NO: 151735 - RNA, 64 nt, Human
gacggcuggguguuucaguuugaaaauauuuuguugccuucaucuucacugcaauuuuguguaa

SEQ ID NO: 151736 - RNA, 64 nt, Human
accugaacuuuuccugcacuuucugcuucuuaauugccuucagcugaaaaucauuuuuuaugug

SEQ ID NO: 151737 - RNA, 64 nt, Human
ugggccccuccugugccggccgagaggcacacacugccuucacgacgugacugcuggaccuggc

SEQ ID NO: 151738 - RNA, 64 nt, Human
gcccugggcagccccaccucacagccagagucaaugccuucaugggaagggcucccagccacac

SEQ ID NO: 151739 - RNA, 64 nt, Human
ugucccacagggaguagcaagacccaccccacacugccuucaccaucuacaccagugacgccgc

SEQ ID NO: 151740 - RNA, 64 nt, Human
augcguugucugcccaccccuaccacaguguuugugccuucagcugagggggcagccucugggc

SEQ ID NO: 151741 - RNA, 64 nt, Human
agccaguggcuagcgcaagaccagucacucccucugccuucaggcuucugucaauuucauuauc

SEQ ID NO: 151742 - RNA, 64 nt, Human
gaaguagcagaagcagugcagcaggaacuggaagugccuucauccaggacaggaaguagcacuu

SEQ ID NO: 151743 - RNA, 64 nt, Human
aagugcuucagucuuugguuuauuucaugcacugugccuucaaaaugaaauuuuuaaaagggac

SEQ ID NO: 151744 - RNA, 64 nt, Human
ugaaugguccuggccugcaggaugggaggccagaugccuucaggagcugguggauccagcuguu

SEQ ID NO: 151745 - RNA, 64 nt, Human
aguucuguaagcuuacauugcuauuuguaaaguuugccuucacagcauuucagaugcuguugga

SEQ ID NO: 151746 - RNA, 64 nt, Human
uguugugccuggaccaucgcugccugccagcuucugccuucaacuucagcaccugccccggcag

SEQ ID NO: 151747 - RNA, 64 nt, Human
cuguggcacugccaccagcaaugcccugccuugcugccuucacccugaacauuuaguacccugc

SEQ ID NO: 151748 - RNA, 64 nt, Human
gaaacugaauguauuauucaggaagaauacugagugccuucauuuaacuaaaguugaauguaaa

SEQ ID NO: 151749 - RNA, 64 nt, Human
aauauccuuucaucaaugggauuuucuaguuuccugccuucagaguaucuaauccuuuaaugau

SEQ ID NO: 151750 - RNA, 64 nt, Human
gagcugaaccucaccaauaucuacgcucccccauugccuucacuggcacugccuucucugccga

SEQ ID NO: 151751 - RNA, 64 nt, Human
acuaacgagaacgguaaugcgacaagauacacauugccuucaucuguacauucugugauaccag

SEQ ID NO: 151752 - RNA, 64 nt, Human
gcugaggugucaggaggggacuucuggcccaccuugccuucagcccuggagugggcagagagua

SEQ ID NO: 151753 - RNA, 64 nt, Human
cuggaguagagcgagcccagcagcccuaaaaggcugccuucauggccaucuagccccaguucag

SEQ ID NO: 151754 - RNA, 64 nt, Human
guguguucagacugugcacacagaaaacaggcucugccuucacaugugagacgguggacuuuuc

SEQ ID NO: 151755 - RNA, 64 nt, Human
caccugcgcucuggugacuugggguggacgccucugccuucacuugaacacaaaugugcuuccu

SEQ ID NO: 151756 - RNA, 64 nt, Human
uuucugucuccguggagcuggaacugccugcacuugccuucagagggaggcacaguccacccag

SEQ ID NO: 151757 - RNA, 64 nt, Human
accccagugccaacuuccucucccacuagggcccugccuucagcuggugcuugcugcgauuccu

SEQ ID NO: 151758 - RNA, 64 nt, Human
auggccagggccaaauagcuaugcagagcagagaugccuucaccuggcaccaacuugucuuccu

SEQ ID NO: 151759 - RNA, 64 nt, Human
cccuggcuuuuugucuggggcuggaauaaagaggugccuucagcuggugggccgagaggcagga

SEQ ID NO: 151760 - RNA, 64 nt, Human
ccaaacuaccggaacuucucuugaaaaauggcauugccuucauggguaagcuguucugacauau

SEQ ID NO: 151761 - RNA, 64 nt, Human
ggccagagggccugcacaugcaaacuccagucccugccuucagagagcugaaaagggucccucg

SEQ ID NO: 151762 - RNA, 64 nt, Human
cuuuccauuggcuuccaacccugcuuggcuuugaugccuucaggguuggggagacagaccucuu

SEQ ID NO: 151763 - RNA, 64 nt, Human
acaugaauuacuguacuauccuguacugcaguggugccuucagggacucgaggaauguaagguu

SEQ ID NO: 151764 - RNA, 64 nt, Human
uggaggcagggaacauggggaggaggagggucggugccuucaagaaaacaggcacugcccuggu

SEQ ID NO: 151765 - RNA, 64 nt, Human
uucuuucuucccucauucuuuuauuuuugaaaagugccuucacguugcauuuuuauuggaggaa

SEQ ID NO: 151766 - RNA, 64 nt, Human
gccaggcaagggaacagguccucccaagggccucugccuucauuucuccugucaccuuccgggg

SEQ ID NO: 151767 - RNA, 64 nt, Human
acagccuaaagcugucaagagauugacucagcauugccuucauuccuuaaaauuaaaaaccuac

SEQ ID NO: 151768 - RNA, 64 nt, Human
cuggcuuuguaacuuaucuggaagggaaagcacaugccuucacgggcaggguauguuccuuuuc

SEQ ID NO: 151769 - RNA, 64 nt, Human
ucauuagaaacuaucccuaaauguaaagaucuuuugccuucaaauuuggcuuauuuuuucugau

SEQ ID NO: 151770 - RNA, 64 nt, Human
aaaaaaaaaagaaagcaguuacucuuggagcuuaugccuucauuuggcaagggaagucuuuuua

SEQ ID NO: 151771 - RNA, 64 nt, Human
cagagucacugcaccaucaggcuuggcccugcugugccuucaguacccagccagguucucuggg

SEQ ID NO: 151772 - RNA, 64 nt, Human
cuuugcaaauguagaugucugacuccacccuucaugccuucacauucucuucuucuaugcuggg

SEQ ID NO: 151773 - RNA, 64 nt, Human
guuuuggaguguuuggggugccugccauugccucugccuucaccuaagucugugcccauuguuu

SEQ ID NO: 151774 - RNA, 64 nt, Human
uuuuagaaaaagaugauagaguucaucauuauuuugccuucaucuuuguuaaggacagaaaauu

SEQ ID NO: 151775 - RNA, 64 nt, Human
aguuccuugguguguggauacuucgccccaucucugccuucaccuguguccucccugugugggu

SEQ ID NO: 151776 - RNA, 64 nt, Human
gaccucuuuucugcagaaaagcuccagcaggcgcugccuucacccacggaucugcccaggcuga

SEQ ID NO: 151777 - RNA, 64 nt, Human
ggacauuucccagcaagggcuggaggaguugccgugccuucagccugaaucgaaugucagaacc

SEQ ID NO: 151778 - RNA, 64 nt, Human
auuuuagggauguuuuuaggacaaccucccuccaugccuucagaguuaggagugagaaugauca

SEQ ID NO: 151779 - RNA, 64 nt, Human
aaguggggucuggccugggaggaggucugauaagugccuucaaggagcuuacguucuaguuagg

SEQ ID NO: 151780 - RNA, 64 nt, Human
ucaaggagcuuacguucuaguuagggaaauuggaugccuucacaaggcucagugacaaaccuga

SEQ ID NO: 151781 - RNA, 64 nt, Human
cauucccuuguucuagauucacuuuaacgcuuaaugccuucaaaguuuugguuuuuuuaagaaa

SEQ ID NO: 151782 - RNA, 64 nt, Human
uccccaccccuaaagggacgccgacgcuguuugcugccuucaccacauauuagugcuugacccu

SEQ ID NO: 151783 - RNA, 64 nt, Human
gaguugauguuuccacguggcuauuuccaagcuuugccuucaaauaaauucuguacuuaaucau

SEQ ID NO: 151784 - RNA, 64 nt, Human
guucagcacagguaaaacgguuccccucccucccugccuucauggaucaccagcucacgucaug

SEQ ID NO: 151785 - RNA, 64 nt, Human
guggaggguggagaccuaaacuuugggguccagcugccuucagccccccucccccagacuaaca

SEQ ID NO: 151786 - RNA, 64 nt, Human
auacaccuacccugcugaacaucauagccgaucuugccuucagaaugcucagaaaauuuacauu

SEQ ID NO: 151787 - RNA, 64 nt, Human
cacugcucagaggagcccuaggcccuggccgcagugccuucagcgcccgacccgggcccccacc

SEQ ID NO: 151788 - RNA, 64 nt, Human
ucccgcccagcgcuggccagccccgaggagccgcugccuucaccgccccgacgccuuuuauccu

SEQ ID NO: 151789 - RNA, 64 nt, Human
uuacucacacauagaucaagagagacacggcuccugccuucauggagcuuuuaggggaaaauga

SEQ ID NO: 151790 - RNA, 64 nt, Human
uguccacacaacaugaaccuaggcugugaccuuuugccuucacaaccucuguccaguccuuaau

SEQ ID NO: 151791 - RNA, 64 nt, Human
ugcuguuaguaauuucuuguggauuucauuguuuugccuucaaauaaagccuuuuuuuaaagac

SEQ ID NO: 151792 - RNA, 64 nt, Human
gccugcaggguuuccuugggcgcggccccaaaauugccuucaaaacaaacccgggacgguugaa

SEQ ID NO: 151793 - RNA, 64 nt, Human
guaugcgcugggcccccaccugcuggccuaccguugccuucaguggcccgcauucuuccaccag

SEQ ID NO: 151794 - RNA, 64 nt, Human
ggccacugggacccucagccuuguuuguacuguaugccuucagcauugccuaggaacacgaagc

SEQ ID NO: 151795 - RNA, 59 nt, Human
accaggaacucuacuauuagagggacgacugccuucaagcaucccugcaacugccacag

SEQ ID NO: 151796 - RNA, 64 nt, Human
gggagaaacccuaugaauguaaugaaugugggaaugccuucauuuguuuuuuugauuuuaauag

SEQ ID NO: 151797 - RNA, 64 nt, Human
gggggagucugagccgggagggcucccgagucucugccuucagcucccaaaguggguggugggc

SEQ ID NO: 151798 - RNA, 64 nt, Human
ggugaggcucauguggguguccccucucucacucugccuucaguggagcuagaccugccaggag

SEQ ID NO: 151799 - RNA, 64 nt, Human
accaggaucccugccccaccucuccccaauuaagugccuucacacagcacugguuuaauguuua

SEQ ID NO: 151800 - RNA, 64 nt, Human
uggggacacaacaaugacugaggcagccuggccuugccuucacagggcucaccauacacaagua

SEQ ID NO: 151801 - RNA, 64 nt, Human
accggcaaggccuccaggcccugagccccacuucugccuucaccucugccugggacccgagcug

SEQ ID NO: 151802 - RNA, 64 nt, Human
uaccucgaggcucuuccauccccaaacugugcccugccuucagcuuuggugaaagggagggccc

SEQ ID NO: 151803 - RNA, 64 nt, Human
guccugggugcauaggucucucggacccacucucugccuucacaguuguucaaagcugagugag

SEQ ID NO: 151804 - RNA, 64 nt, Human
gagaaagacuugaagaauguaaugccagugacaaugccuucauucagagguaagccuuuauccu

SEQ ID NO: 151805 - RNA, 64 nt, Human
uagaccugggcaucuccauugcugaaaaccgcagugccuucagcuaccauugcaagaccccaga

SEQ ID NO: 151806 - RNA, 64 nt, Human
gauuuuuaucuucuguagagcuagccgcccugacugccuucagaccuggcccuguagcuuuucu

SEQ ID NO: 151807 - RNA, 64 nt, Human
uugccuacccucuguccugccuuguuauuguaagugccuucaauacuuugcauuuugggauaau

SEQ ID NO: 151808 - RNA, 64 nt, Human
ugggccacuucuuccccuguagaugugggcuuguugccuucagccggcuucccugagggaggag

SEQ ID NO: 151809 - RNA, 64 nt, Human
uuuagcaaaaucgcccuccaguccuuccuggagaugccuucagccagcaucccagacuccacag

SEQ ID NO: 151810 - RNA, 64 nt, Human
aagacauaacagauggaagcaaaggaauccugccugccuucagcagagaauucaccgaauccua

SEQ ID NO: 151811 - RNA, 64 nt, Human
gccccgauccugccaucucugcaucgcccccugcugccuucagccuucccugggcccugaauaa

SEQ ID NO: 151812 - RNA, 64 nt, Human
ugcaugacuucaugguacuggggacaaguuuguaugccuucaccccagagcuggcuggguuaug

SEQ ID NO: 151813 - RNA, 64 nt, Human
aaagcaggaaugguguccacugcugcggaggaacugccuucagagaagguggggcuggaaaagg

SEQ ID NO: 151814 - RNA, 64 nt, Human
ucauccagguccaucuggaacuuucagugauagcugccuucagccagcaucuuugggggacucu

SEQ ID NO: 151815 - RNA, 64 nt, Human
cugccuuggacaacuuuucucauguugaagccacugccuucaccuucaccuucauccaugucca

SEQ ID NO: 151816 - RNA, 64 nt, Human
cuuccagagaaauuugagguccucgcuuguucucugccuucaagaaacaaugaccugauucugu

SEQ ID NO: 151817 - RNA, 64 nt, Human
agcaccaucuacaguugugccauuccccagccacugccuucaugcugcccccgccggacuggca

SEQ ID NO: 151818 - RNA, 64 nt, Human
gugcugugugcuguuugcauggcagggcuccagcugccuucagcccugugacgucuccucaggg

SEQ ID NO: 151819 - RNA, 64 nt, Human
cacccuagauuguggcccagaucucaggagucucugccuucagggucauccaaaaguggaccuu

SEQ ID NO: 151820 - RNA, 52 nt, Human
acuuguucaagaauaacugauaugccuucacucagaagaaaagaaaugaaug

SEQ ID NO: 151821 - RNA, 64 nt, Human
aaguggggcccggccagcacugcucguuacugucugccuucaguggucugaggucccaguauga

SEQ ID NO: 151822 - RNA, 64 nt, Human
acugugaacuuugcugguacagaggaauaauaucugccuucaccuuuuuuuuuuuggaccauag

SEQ ID NO: 151823 - RNA, 64 nt, Human
uuuugcacacugccuaaggguuaaauuguguuguugccuucaguagaaggcauuugugggcugc

SEQ ID NO: 151824 - RNA, 64 nt, Human
acguccccgugagcccgaggcuggaaguggugucugccuucaaggguuaaucccucuuuguucc

SEQ ID NO: 151825 - RNA, 64 nt, Human
uagcacuauaaacccugguugccucugaagaaacugccuucauuguauauaugugacuauuuac

SEQ ID NO: 151826 - RNA, 64 nt, Human
gcccccucggcaguuuguccccccagcuucgguaugccuucagggaaaggucacagcuggggag

SEQ ID NO: 151827 - RNA, 64 nt, Human
caggcuggguugucacugagacuagauucucaccugccuucaaagaagggccaauucccuuuaa

SEQ ID NO: 151828 - RNA, 64 nt, Human
agaguacuucguauuuuuuuuuaauugccuuguuugccuucaacuuccuugauuuucauaguuu

SEQ ID NO: 151829 - RNA, 64 nt, Human
uguuuuaucagguacccaccaacuuuauacuuucugccuucagauagaguuucuaacauuuucu

SEQ ID NO: 151830 - RNA, 64 nt, Human
cccuccucuggcacaggccaccacugcggugcugugccuucagaugggaggugggcgcgguggc

SEQ ID NO: 151831 - RNA, 64 nt, Human
auguagguugagagaggaagcgagaaguuaaggaugccuucaaaauuuuuguuuagaucaucag

SEQ ID NO: 151832 - RNA, 64 nt, Human
ccugucuuugcucccuccccucucuuagagacugugccuucagcaggacucuuaauaucugcug

SEQ ID NO: 151833 - RNA, 64 nt, Human
gagugggguggagggcggagccugcugggggcccugccuucacagagaugccgcgugcugggaa

SEQ ID NO: 151834 - RNA, 64 nt, Human
gagaauccagaccaucuuggggcagccaggcccuugccuucauuuuuacagagguagcacaacu

SEQ ID NO: 151835 - RNA, 64 nt, Human
ugaguccaguccccgcccccaaacccagcccaggugccuucagcuacuucggcuucuuaaaccc

SEQ ID NO: 151836 - RNA, 64 nt, Human
ccuuugggccugggcggcuugcuccugccagccaugccuucaggguaggcucugagcaagcugg

SEQ ID NO: 151837 - RNA, 64 nt, Human
ccugcgcaggccaacacucacugacaucgaaggcugccuucagugccuggaugucugcggccac

SEQ ID NO: 151838 - RNA, 64 nt, Human
cuacucccucccuaccuuuuccauccuccuccucugccuucaaaaaaggaaacuuucccuuggu

SEQ ID NO: 151839 - RNA, 64 nt, Human
uucucaucuguauuggagguagcagugcuagcucugccuucaggcaugcaauaugccagaacua

SEQ ID NO: 151840 - RNA, 64 nt, Human
gugagcgagggaugcuggggcggggcuuggccagugccuucagggagguggccccagaugccca

SEQ ID NO: 151841 - RNA, 64 nt, Human
aguuuuaagugugaaacuuauuucacuuucacacugccuucaggccagaagcaaaccaaauuua

SEQ ID NO: 151842 - RNA, 64 nt, Human
agggccugaguuagacuauuucccacauguucucugccuucaguggggagggggugccaccagg

SEQ ID NO: 151843 - RNA, 64 nt, Human
ggauaguucucagccuggcaaguggcucugaagcugccuucagacaaggcuagucuaggggcaa

SEQ ID NO: 151844 - RNA, 64 nt, Human
ugccaaaccagccuacagauguuccugccaguggugccuucaggcugaugccaaucuagccucu

SEQ ID NO: 151845 - RNA, 64 nt, Human
gcccuugaaggugguagcccagcuccuguuccugugccuucaaaaggcuggggcacuaugagua

SEQ ID NO: 151846 - RNA, 64 nt, Human
uguggccaaguuuugggaagugguugauucucuuugccuucauuucaccuuccucuucguuuac

SEQ ID NO: 151847 - RNA, 64 nt, Human
caccaucccccaggugaugucuggucaacuggccugccuucagcuagaauccuguuaggucggu

SEQ ID NO: 151848 - RNA, 64 nt, Human
uugacagagccugggaaggagagacgaggaggcaugccuucagcuuggucucaacauccugaag

SEQ ID NO: 151849 - RNA, 58 nt, Human
acauugaaacgcaugucuaaauguauucugccuucagaccaucuaguaccugcuggua

SEQ ID NO: 151850 - RNA, 64 nt, Human
gguaggggcaauagcgcucccuuuucaccugaaaugccuucagcucaggccuugggagugaggu

SEQ ID NO: 151851 - RNA, 64 nt, Human
uggccagcccuggagguaggcugggaccaagcucugccuucacagugcagugaagguaccuagg

SEQ ID NO: 151852 - RNA, 64 nt, Human
cucaauuucuccccaggguggaugggggaaauggugccuucaagaccuucaccaaacauacuag

SEQ ID NO: 151853 - RNA, 64 nt, Human
gacccauuccauuaaacuacauuauaaaccuuguugccuucacccuucagccucccgcuccagg

SEQ ID NO: 151854 - RNA, 64 nt, Human
gcauagauagcuagaacauaaugugagcaguguuugccuucagguggugggguuauggguaguu

SEQ ID NO: 151855 - RNA, 64 nt, Human
uagggaaacugauaaagcuugagucaacuaaaucugccuucauacuuuaucaaggggaaccaag

SEQ ID NO: 151856 - RNA, 64 nt, Human
caccugcagcugcccuggaauucccuucgcuguuugccuucaucucccuccacguuugagaggc

SEQ ID NO: 151857 - RNA, 64 nt, Human
aggaagaagcuuaggcagggcucucuuuccuucuugccuucagauguucucucccaggggcugg

SEQ ID NO: 151858 - RNA, 64 nt, Human
ugcaauuuuucuuuuuuugcaaaugccacucgacugccuucauaagcguccauaggauaucuga

SEQ ID NO: 151859 - RNA, 64 nt, Human
aagccuucuuugccuuucuucuuugucuuauuucugccuucaucucccacuucucacccaacuc

SEQ ID NO: 151860 - RNA, 64 nt, Human
aggcugguaccaguucuguaccauaugagaaaguugccuucagaaggugggaagaucauuguuc

SEQ ID NO: 151861 - RNA, 64 nt, Human
ccuauagccuuuuguugugcuuuuuugaugugucugccuucauuagacuaugaugucuuugaga

SEQ ID NO: 151862 - RNA, 64 nt, Human
gaccucauaggagucuuaggcaguuaccugaaacugccuucauucacucauuuguguauucauu

SEQ ID NO: 151863 - RNA, 64 nt, Human
aagacuaaggguuuaaaucugcuugcacuagcugugccuucauuaguuugcuauagaaauccag

SEQ ID NO: 151864 - RNA, 64 nt, Human
ccagucugggaugaaacuagaguggucucagaagugccuucaggacaauaaguggaacuacauu

SEQ ID NO: 151865 - RNA, 64 nt, Human
cugaaguggaaggauggucucaggguucugaucuugccuucauguggaccuucaucacuaccuc

SEQ ID NO: 151866 - RNA, 64 nt, Human
uuaccauguuuuccagucuguuuaacuucugcagugccuucacuacacugccuuacauaaacca

SEQ ID NO: 151867 - RNA, 64 nt, Human
gcagccaaagagcacacguuaagcaauccagaggugccuucagggcaaagaauagagagaaagg

SEQ ID NO: 151868 - RNA, 64 nt, Human
aaaugccuuuuguuuuucucugcuauacuugacuugccuucagaauauuacauuccagauaaua

SEQ ID NO: 151869 - RNA, 64 nt, Human
gaaugcaggccaguuacuuaaaaggucuucagauugccuucaguucacagugccucugcaacag

SEQ ID NO: 151870 - RNA, 64 nt, Human
uuccauaaccaucacugugccacuggguggagugugccuucagggcaucuugaaaugucccgcu

SEQ ID NO: 151871 - RNA, 64 nt, Human
aauggaccccaucccucuaaagccugcccuccuuugccuucaacuguauaugcuggguauuuca

SEQ ID NO: 151872 - RNA, 64 nt, Human
acuuucuucuccaccucuucuuuuucucaugcccugccuucaucugucuccuucugcacccaga

SEQ ID NO: 151873 - RNA, 64 nt, Human
gcagcuaagcaauagauaacauccaucguggcucugccuucaaagggaaauuuuacauauguca

SEQ ID NO: 151874 - RNA, 64 nt, Human
aggaugagaagggagcagggagaguuccagaaagggggaugaaauaggaguauuaaaaagcugc

SEQ ID NO: 151875 - RNA, 64 nt, Human
gacggucaggaaaacuguuccaaucaugaaaaggggggaugauuuuguaaaaguggcauuuccu

SEQ ID NO: 151876 - RNA, 64 nt, Human
gcggugggucuggauguggguaaacuaagguaaaggggaugauauuccacaaacuaauuaugca

SEQ ID NO: 151877 - RNA, 64 nt, Human
cccuaggccuaguggugaucccagugcucuacugggggaugagagaaaggcauuuuauagccug

SEQ ID NO: 151878 - RNA, 64 nt, Human
ggcauuuugagaaugguaaagaaauacacagggaggggaugaugacuauuaguggacucuuguu

SEQ ID NO: 151879 - RNA, 64 nt, Human
uguauauuauuguaaaauuauuuuaauaagucauggggaugacaauuugauuauuacaauuuag

SEQ ID NO: 151880 - RNA, 64 nt, Human
uaaaaaaaaaaaaaagucaaaaaaauucaaaaaaggggaugauacuagccuuaacauguaccug

SEQ ID NO: 151881 - RNA, 64 nt, Human
auaagaauuccgauauauacuugaugauugccaaggggaugaaaggaaacaacagagaugguug

SEQ ID NO: 151882 - RNA, 64 nt, Human
agagcccugggucaaaaccacucagcccaggggaggggaugaggcauugucacccuagaccccu

SEQ ID NO: 151883 - RNA, 64 nt, Human
ggggagaaccaagcccugguagggaagagguaagggggaugauucaccuccauauuuccuaagc

SEQ ID NO: 151884 - RNA, 64 nt, Human
cugugcugggaacauguaccacugagccugagauggggaugagggcagagagaggggagccccc

SEQ ID NO: 151885 - RNA, 64 nt, Human
gaaaaaaaaaaacaaaaaccuagauuccggauuaggggaugacaucccaaacagcccggaguau

SEQ ID NO: 151886 - RNA, 64 nt, Human
uuuuccagcaaauggaacucugauuuaaacagcuggggaugaaauuccucaagaugauuauucc

SEQ ID NO: 151887 - RNA, 64 nt, Human
cuuguuuuuuaguuucuguauguuuuaaucucauggggaugagcucagagaagcuccgugggcc

SEQ ID NO: 151888 - RNA, 64 nt, Human
guaaacucugagccccuugcccaccugaagcccuggggaugauguggaaauaggggcacacaca

SEQ ID NO: 151889 - RNA, 64 nt, Human; identical to SEQ ID NO: 84613

SEQ ID NO: 151890 - RNA, 64 nt, Human
ugaguacaauggggagccacugauagcuuuuuaaggggaugaauggugggauuugguuuacauu

SEQ ID NO: 151891 - RNA, 64 nt, Human
cguuuggcccucugaacaaggugcacgcgagcugggggaugaagacggcucccacuuccuuuuc

SEQ ID NO: 151892 - RNA, 64 nt, Human
aagcagcgugggauauaaucagcagugcuuacauggggaugaucgccuucuguagaauugcuca

SEQ ID NO: 151893 - RNA, 64 nt, Human
uaauaacugacuaggaaggacuaaaagccagaaaggggaugaaaaaaaaauccuuaauucaggg

SEQ ID NO: 151894 - RNA, 64 nt, Human
aauagggaauucacuuauugagaaugaaagugaaggggaugauccuaaugucuuagaaagcuag

SEQ ID NO: 151895 - RNA, 64 nt, Human
agccucaagucuccuucgagcuuuauauccauuuggggaugaagucuacuuugacagcuagcaa

SEQ ID NO: 151896 - RNA, 64 nt, Human
guuuuucuaucauagacaccauaggggaaaguuuggggaugaaggagagcuuaaagguguuuca

SEQ ID NO: 151897 - RNA, 64 nt, Human
agaaugacugauagacuugcugaugugcauguggggggaugagguguguauaugccuuucuccu

SEQ ID NO: 151898 - RNA, 64 nt, Human
uucagucccagagggguggucaccccacccuucaggggaugagaaguuuucaagggguauuacu

SEQ ID NO: 151899 - RNA, 64 nt, Human
uggucagagaaugggauucagauugggaacuuguggggaugagagugaccagguugaacuggga

SEQ ID NO: 151900 - RNA, 64 nt, Human
uuuacaaaguuugaaucuucuauaaacuaagaaaggggaugauccuuagauuugcauuaaaaua

SEQ ID NO: 151901 - RNA, 64 nt, Human
ccuugaaucugagacuggcugcccauucugagauggggaugaagguaagaugccgcaucaccag

SEQ ID NO: 151902 - RNA, 64 nt, Human
gcagugggccagcugagaguacgccuugaggaggggggaugaggccuuaaucugggaggccuau

SEQ ID NO: 151903 - RNA, 64 nt, Human
aggugaccucuuaguuuugaacuuauuuaaguguggggaugaauuuuucaucagaagugcuuac

SEQ ID NO: 151904 - RNA, 64 nt, Human
agugacaucaaagccuggccuaauuguuccuauuggggaugaggguggcaugaggaggucccac

SEQ ID NO: 151905 - RNA, 64 nt, Human
agugcuuuuuuguuacacaggagggcuuuuuuggggggaugaccaguacagacaugccaguuag

SEQ ID NO: 151906 - RNA, 64 nt, Human; identical to SEQ ID NO: 84619

SEQ ID NO: 151907 - RNA, 64 nt, Human
caguguuucugucagucuuuccugcucagccaggggggaugauaccggggacucuccagagcca

SEQ ID NO: 151908 - RNA, 64 nt, Human
gucaacggauguguagcuuuucagaaacuuaauuggggaugaauagaaaaccuguaagcuuuga

SEQ ID NO: 151909 - RNA, 64 nt, Human
caggaaacaguacaagauggcuaaggagaacaggggggaugauggggccaccgagaggccgaag

SEQ ID NO: 151910 - RNA, 64 nt, Human
gguuuggggacgggugggaaugaccccuaggcaaggggaugagaccgcaggaggaaauggcggg

SEQ ID NO: 151911 - RNA, 64 nt, Human
gaauauaugauuuauucacaguuccucaaggccuggggaugaugaucaguuauaccuauuuuug

SEQ ID NO: 151912 - RNA, 64 nt, Human
cgagucgcaggaggaagggagaugcagccgcacaggggaugauuacccuccuaggaccgcggug

SEQ ID NO: 151913 - RNA, 64 nt, Human
uggauaguguggaguggggggaagaaaagauaggggggaugaauacuaggggaauacugugugu

SEQ ID NO: 151914 - RNA, 64 nt, Human
cagcccaccagcaggagcuuggaguuuggggaguggggaugaguccgucaagcacaacuguucu

SEQ ID NO: 151915 - RNA, 64 nt, Human
gagaggagggcuguaacgccuucagucagucucuggggaugaaacucuuaaaugcuuuguauau

SEQ ID NO: 151916 - RNA, 64 nt, Human
auuuuuuaagguucuuguguauauuuggggggugggggaugaauuauaaauuauauucagcccu

SEQ ID NO: 151917 - RNA, 64 nt, Human
uucucccagcccuguccucauccuagggccacuaggggaugaaggacccaucucaagucagcuc

SEQ ID NO: 151918 - RNA, 64 nt, Human
gaaagagcugucuaugcagccugcucuugggccuggggaugagacacacaauucauuggcuccu

SEQ ID NO: 151919 - RNA, 64 nt, Human
uaaucuggaacaaaccucucaccucaggccagaaggggaugaccuccauuugcuucucugagua

SEQ ID NO: 151920 - RNA, 64 nt, Human
agagcucuggcccgcaucucgcugugcccugaagggggaugaagggcgaugccucgcccgaggc

SEQ ID NO: 151921 - RNA, 64 nt, Human
cuguuggucauucacaucucucucugccaagaauggggaugacgcuguugaaggaagaaaugug

SEQ ID NO: 151922 - RNA, 64 nt, Human
cuggccucuggcauauucaucaaguaugaguucuggggaugagucacuguaaugaugugagcag

SEQ ID NO: 151923 - RNA, 64 nt, Human
ucucuguuugucuguuguggaaauaaaaccuucuggggaugaaucaaaacuaucugacaauuac

SEQ ID NO: 151924 - RNA, 64 nt, Human
cuucuagccagagccacuugcagacaucacggcaggggaugaggagccgggguugcugcugcug

SEQ ID NO: 151925 - RNA, 64 nt, Human
uccuuccuccaucuccaagaaugcugaaaccaagggggaugacaugugacuccuaugaucucag

SEQ ID NO: 151926 - RNA, 64 nt, Human
aggaagaaaagguaggauuauaagauuucucaauggggaugauuaaauugucucauggaaaacu

SEQ ID NO: 151927 - RNA, 64 nt, Human
ugcuggugacuuuuuuuuuuuuuuuuuuuaaauaggggaugauuuuagcuuguccuaaaucuug

SEQ ID NO: 151928 - RNA, 64 nt, Human
uaauccagugcccuacaaaggcuagaacacuacaggggaugaauucuucaaauaggagccgaug

SEQ ID NO: 151929 - RNA, 64 nt, Human
cucuuccuugagccuguuuccacaccuguaaaguggggaugaugauccuaucucacugcuuuug

SEQ ID NO: 151930 - RNA, 64 nt, Human
ggggugggaaaggugaaugccaguggggaugcggggggaugaggguaggagggacuuauagaag

SEQ ID NO: 151931 - RNA, 64 nt, Human
uauuucaggcccaaaugaaaggaaaucgccaguuggggaugaaaucacagagccuguguuuuau

SEQ ID NO: 151932 - RNA, 64 nt, Human
gggaaccuccacgcccaccaccaugagcuggaguggggaugacaagacuuguguuccucaacuu

SEQ ID NO: 151933 - RNA, 50 nt, Human
gaagugagggucacuccugaggggaugacggcguggacgaggaacagcug

SEQ ID NO: 151934 - RNA, 64 nt, Human
cgggaacugcucuuuaauuauuagugauguuugcggggaugacgaugccaaguacaccugcaag

SEQ ID NO: 151935 - RNA, 64 nt, Human
cugggagacauacgcaucaacuguggagguccgaggggaugagaagggauacccaccaucuuuc

SEQ ID NO: 151936 - RNA, 64 nt, Human
gagcauuggcaaaaagcugaggaugacaagcuuaggggaugaaaggcugccuuuucccccccuu

SEQ ID NO: 151937 - RNA, 64 nt, Human
aaaugaaagauuggcaaaggcccuugaggggcuuggggaugacaguauggaacugucugcauug

SEQ ID NO: 151938 - RNA, 64 nt, Human
uagcaaucacaacacuggcugagcggaugcaucuggggaugagguugcuuacuaagcuuugcca

SEQ ID NO: 151939 - RNA, 64 nt, Human
ggagagauaugaagaccuauucagaguuucaucuggggaugaaagcuauggaagaugauguaca

SEQ ID NO: 151940 - RNA, 64 nt, Human
agacacaccugggcgucccgaggucacauguucuggggaugauggccuucaggggucaucuggc

SEQ ID NO: 151941 - RNA, 64 nt, Human
uuucguuuugacucaaaagcagugggucucaacuggggaugauucgcuuaucugaacagcaucu

SEQ ID NO: 151942 - RNA, 64 nt, Human
auuacaugcuaaauaaauauucuccauauuuuugggggaugacauucagugaauuauuucagug

SEQ ID NO: 151943 - RNA, 64 nt, Human
cuuuguguuccacgucaguuugaggggacgguggggggaugauaugaaugucacaggaggagac

SEQ ID NO: 151944 - RNA, 64 nt, Human
auaauuagaguuuguguauuauuuuuccagguuuggggaugagucaguccuugcccauccacaa

SEQ ID NO: 151945 - RNA, 64 nt, Human
ugccuagcccagcccugggacuggaauuugaguaggggaugaggggaaauuguaauuucauucc

SEQ ID NO: 151946 - RNA, 64 nt, Human
uuuuauaaugguguuguuguggaacugaaagauuggggaugauuugguuuuuuccuugguccac

SEQ ID NO: 151947 - RNA, 64 nt, Human
gcaacauguucaucugcuaugcugucaugacuagggggaugauuauuagucacauagagcuugg

SEQ ID NO: 151948 - RNA, 64 nt, Human
ccuuuucuuuuucucccuaaacuguacaugugaaggggaugagcucaagcaggaaguucaacuu

SEQ ID NO: 151949 - RNA, 64 nt, Human
uacagauuuuguuuuguuccaauuggcauacucuggggaugaucacuuaaaaaaacagauuuua

SEQ ID NO: 151950 - RNA, 64 nt, Human
aauuuugagacuuguuucggugugucugugugauggggaugaggcugggguugggaucugaugu

SEQ ID NO: 151951 - RNA, 64 nt, Human
guuuuaguugagugcucuggucucacuaugaaguggggaugacuguggcuucauaacucuaccu

SEQ ID NO: 151952 - RNA, 64 nt, Human
uagucauccauagacuugaaaugagaccacauauggggaugagauccuucuaguuagccuagua

SEQ ID NO: 151953 - RNA, 64 nt, Human
gccuccugucucccuucaaagggagacccuuuugggggaugaguuugccagacuccccgugcug

SEQ ID NO: 151954 - RNA, 64 nt, Human
aaugagggugcccagcuuauaagaaugguguuagggggaugagcaugcuguuuaugaacggaaa

SEQ ID NO: 151955 - RNA, 64 nt, Human
ucagugguaacugcuuuggucucuucuuucaucuggggaugacaauggaccucucagcagaaac

SEQ ID NO: 151956 - RNA, 64 nt, Human
ugagucauuauccuugcuaugaugaugguguuuuggggaugagagggugcuauccauuucucau

SEQ ID NO: 151957 - RNA, 64 nt, Human
acacagaggaagagcaggcacauggaggagcuugggggaugacuagaggcagggaggggacuau

SEQ ID NO: 151958 - RNA, 64 nt, Human
cuugcucucccugagccuccauuuccuguaaaauggggaugauaccacuucauaaaguugugag

SEQ ID NO: 151959 - RNA, 64 nt, Human
guugccagaaucugcuucuggcugucgccaacauggggaugacccccauugucaucauguuggg

SEQ ID NO: 151960 - RNA, 64 nt, Human
ugggggaagauuuuaugcacagccuaguuaucaaggggaugauuugccgacauguuugagaacc

SEQ ID NO: 151961 - RNA, 64 nt, Human
uggagcacuuguuccgggauggugugguggaagaggggaugagggaaagaaauggggggccugg

SEQ ID NO: 151962 - RNA, 64 nt, Human
cauucccuccccucacaacaaagaacuccacuguggggaugaagcgcuucuucuagccacugcu

SEQ ID NO: 151963 - RNA, 64 nt, Human
gguguugggagagucuuuguguuggggaguggcaggggaugauuuguuucaggggaaaaugccc

SEQ ID NO: 151964 - RNA, 64 nt, Human
cacuguaagacuguuggacagugguguguauugaggggaugaaucggaacgauagucucaugca

SEQ ID NO: 151965 - RNA, 64 nt, Human
gacccuuggccuucccucacaccaucuccuuccaggggaugaaucuuuggggguugguuugagg

SEQ ID NO: 151966 - RNA, 64 nt, Human
gugguccccaugucccuggcacacuagcauuccgggggaugaggaauccccagcccuugaggca

SEQ ID NO: 151967 - RNA, 64 nt, Human
gaaggaacugggaagcuuagucuaauuagugccuggggaugaccuaugcaaucacaccgcuuau

SEQ ID NO: 151968 - RNA, 64 nt, Human
agcugaacuagguugcucuuuuuuggcagggaguggggaugagauuugacaccaauaugggcaa

SEQ ID NO: 151969 - RNA, 64 nt, Human
uuucugagccuccuauaccucauccgacacaaauggggaugauaccuaccuccaggguuggcgu

SEQ ID NO: 151970 - RNA, 64 nt, Human
agaugauucuucaacggagaguuugcuucugaguggggaugaauacaaucaggacuuugauuca

SEQ ID NO: 151971 - RNA, 64 nt, Human
gugggaggggcugacagcagcagccggcuguuugggggaugauggaggugacaucaggcagagg

SEQ ID NO: 151972 - RNA, 64 nt, Human
gccuuugucucuucccucuuguggggagcaaggaggggaugagcgguaccuugggagacccggu

SEQ ID NO: 151973 - RNA, 64 nt, Human
gguucagagaacuacaaacugucaaagaaaggguggggaugauaagaaaugcuaauauaaaaau

SEQ ID NO: 151974 - RNA, 64 nt, Human; identical to SEQ ID NO: 84625

SEQ ID NO: 151975 - RNA, 64 nt, Human
cuccaggaaaccaggccaucugggcaggaggccuggggaugaggguggggggggacccccaggu

SEQ ID NO: 151976 - RNA, 64 nt, Human
acaggcuaguucuaauucccuauuggguagaugaggggaugacaaagaacaguuuuuaagcuau

SEQ ID NO: 151977 - RNA, 64 nt, Human
cccagcuacccaguagcauaacuuuucacagcucggggaugaauuaacauggcugaaauaaaac

SEQ ID NO: 151978 - RNA, 64 nt, Human
uccuggcuauguauugcacauuggcaagugcucuggggaugaggcauggguauaggaagggaga

SEQ ID NO: 151979 - RNA, 64 nt, Human
cuggugugucaucagcaaagaccucagccgccucggggaugagaggggacucguggggcaagca

SEQ ID NO: 151980 - RNA, 64 nt, Human
ccagugaaaugaugugcauaugaaaauguaguuuggggaugacucuaccugaaaacuccaaaca

SEQ ID NO: 151981 - RNA, 64 nt, Human
cucagucugacuccucaacccagcagcaauuugaggggaugagggggaagaggagcugccuuuu

SEQ ID NO: 151982 - RNA, 64 nt, Human
auugcugcugcuuuaaaggauaaaguacucuuugggggaugagucugguuuguuuuguuuuauu

SEQ ID NO: 151983 - RNA, 64 nt, Human
caggagggccgacgcuguguuggcaugcgcaguaggggaugaggguuagccauaguauucuuug

SEQ ID NO: 151984 - RNA, 64 nt, Human
gggaacaaggggauucaggagaaaccaggcagcaggggaugaaauacaugaauaaagagaggca

SEQ ID NO: 151985 - RNA, 64 nt, Human
agagcuccugugaccgagagcgccacggaagccuggggaugacgucgggcagcuuuauucuuug

SEQ ID NO: 151986 - RNA, 64 nt, Human
caguuguugaggggaggauguauaaaauggucauggggaugaaaggaucucugagaccacagag

SEQ ID NO: 151987 - RNA, 64 nt, Human
ccaguguggaggcagggacagucaugggaaugugggggaugaagcccaggcagggaauggccuu

SEQ ID NO: 151988 - RNA, 64 nt, Human
uauucaucuggaaggagggaggcuuggaugagcaggggaugagagcugcagggaaauaaaugag

SEQ ID NO: 151989 - RNA, 64 nt, Human
uuuucugggcuugcguuucucuccucuaguggguggggaugacuuucaaugacuuucaauacuu

SEQ ID NO: 151990 - RNA, 64 nt, Human
ucaacacagugauggacugauccagauggcucccggggaugaauguggguggguagcuucuguc

SEQ ID NO: 151991 - RNA, 64 nt, Human
uaucuauugcaaaaccugaaggacuguaguuagcggggaugauguuaaguguggccaagcgcac

SEQ ID NO: 151992 - RNA, 64 nt, Human
gcuuugagcuccuggacucaccugaggcucccugggggaugacacucaguucugucacugucaa

SEQ ID NO: 151993 - RNA, 64 nt, Human
gagaaaauaaucauucuuauuucaugaaaauuguggggaugaugaaauaaguuaacaccuuuaa

SEQ ID NO: 151994 - RNA, 64 nt, Human
aauaacauccaaugugggcguuaucuguugucuaggggaugaauuuuaaguuacaauaaaauau

SEQ ID NO: 151995 - RNA, 64 nt, Human
uggcccggccucccuaaugucauucacauugaauggggaugaggucggacaguggcucauagag

SEQ ID NO: 151996 - RNA, 64 nt, Human
ggaagccucacuggaguuuggggccugcugcaauggggaugagaugguuuuuuguagaauuaua

SEQ ID NO: 151997 - RNA, 64 nt, Human
gccugcuuugugcuuuaauuggguaccaagcuuuggggaugacagugaguugcaagaauaguuu

SEQ ID NO: 151998 - RNA, 64 nt, Human
uccauaccccauaccuacugaauuagaaacucuaggggaugaauagugguguucucuguugcua

SEQ ID NO: 151999 - RNA, 64 nt, Human
augcugccuccaagaggugugagcccucugucucggggaugaacaagcagagucugggcuaccu

SEQ ID NO: 152000 - RNA, 64 nt, Human
guugccugcugagcugugcccuauuguguggucgggggaugaggauauggcagggaagcuuuca

SEQ ID NO: 152001 - RNA, 64 nt, Human
gacucuggucaagaagcaucgugucuggcguuguggggaugaacuuuuuguuuuguuucuuccu

SEQ ID NO: 152002 - RNA, 64 nt, Human
agugacaggggaaaaggaauuagucuaagaguaaggggaugauuauuauauugaggcuaaaacc

SEQ ID NO: 152003 - RNA, 64 nt, Human
ccaccugucaaacaaagccagaagcugagcaccaggggaugaguggagguuaaggcugaggaaa

SEQ ID NO: 152004 - RNA, 64 nt, Human
ggguggugauaagcccauuggauuguccccuuggggggaugagcuaggggugcaaggaacaccu

SEQ ID NO: 152005 - RNA, 64 nt, Human
cuuaagaaauccuuucuucucccuaaggggaugaggggaugaucuuuuguggugucuugaucaa

SEQ ID NO: 152006 - RNA, 64 nt, Human
cagaaacucuuaagaaauccuuucuucucccuaaggggaugaggggaugaucuuuugugguguc

SEQ ID NO: 152007 - RNA, 64 nt, Human
acacgguguggugggcaugagggcuuggagggguggggaugagggcucaagacacgagagaaga

SEQ ID NO: 152008 - RNA, 64 nt, Human
uaggaaaagggagugccugagguaggccuuagaaggggaugagucagauuuuuacagaggagga

SEQ ID NO: 152009 - RNA, 64 nt, Human
ugggaauauuugcauguacauaaugagguaucuuggggaugagauccaagucuaaacacaaaau

SEQ ID NO: 152010 - RNA, 64 nt, Human
gacagagcuguuggauuggcuuugauagaggaauggggaugauguaaguuuacaguauuccugg

SEQ ID NO: 152011 - RNA, 64 nt, Human
gauauuggguuauuuuguaaauuaauauuucuuuggggaugaugcugcgagcagcauagugaga

SEQ ID NO: 152012 - RNA, 64 nt, Human
ugacccagcacucaaucuguucaagacaaccaguggggaugagaggcuguaccccucacccaca

SEQ ID NO: 152013 - RNA, 64 nt, Human
cuuaaccaguuuaauuuuuuuuuuccucauuguuggggaugaugagaagaaaugauuugggaaa

SEQ ID NO: 152014 - RNA, 64 nt, Human
acugaaaccaaggucuuuucaaauguggcuaaauggggaugaggagacacggguaggacuuucu

SEQ ID NO: 152015 - RNA, 64 nt, Human
gguuuaaaauuaaaagagcauccgguuuugguauggggaugauccaggauuauguugugacuga

SEQ ID NO: 152016 - RNA, 64 nt, Human
uagcagucgcuggcagagcacacaggcugcucugggggaugagcuggugcguuuaaggaacagg

SEQ ID NO: 152017 - RNA, 64 nt, Human
ucaagucucuuaagcuauuagaaauauucccacuggggaugagggaaaaccccaugaaugcggg

SEQ ID NO: 152018 - RNA, 64 nt, Human
ccugucggagagugaggggccccgccagcccgauggggaugaggaggagagcacagcccucagc

SEQ ID NO: 152019 - RNA, 64 nt, Human
ucacugcuggaggaauuuugucaacuacccaccuggggaugaagcucacuggccacaauaccca

SEQ ID NO: 152020 - RNA, 64 nt, Human
uaacguuggaccauugugaguuaaacccacaucuggggaugaaaucccacauccucccaaguga

SEQ ID NO: 152021 - RNA, 64 nt, Human
gcauuuuauuucacaagaggagugugagggucaaggggaugaaaugaggggcugcuuuuagggc

SEQ ID NO: 152022 - RNA, 64 nt, Human
uaaggccaugcuccugacaggucuaggcaaccugggggaugacuuagguuaaugugcuaggauu

SEQ ID NO: 152023 - RNA, 64 nt, Human
uucucuggcaaguguucucagcugaaaagugguuggggaugauucuuaccuugguaauuaaaug

SEQ ID NO: 152024 - RNA, 64 nt, Human
agguagcaugugcccuaguuacagaaucuauuaaggggaugacugucucaaauauguaggacag

SEQ ID NO: 152025 - RNA, 64 nt, Human; identical to SEQ ID NO: 84629

SEQ ID NO: 152026 - RNA, 64 nt, Human
aaaaugugguuuuauugagucacaguucuuucuuggggaugaaggcugugccgagugggguccu

SEQ ID NO: 152027 - RNA, 64 nt, Human
cccacccugcacugguccaaggucggaggagacaggggaugaggaaggccucaggccacugccc

SEQ ID NO: 152028 - RNA, 64 nt, Human
uauucccccaaagcgggcuugcugcuucacccuuggggaugaaauaauggaagcugguuaaagu

SEQ ID NO: 152029 - RNA, 64 nt, Human
uuuccaagggagaagcuguucaaccacccguuugggggaugagugagccgacacuuuccuuugg

SEQ ID NO: 152030 - RNA, 64 nt, Human
aagaacagaguccauuuuccuuccuggggccauuggggaugacacucaagauacuugccagucu

SEQ ID NO: 152031 - RNA, 64 nt, Human
uccaccccccugccucaggaccucugcugaagagggggaugaagugggucuccagggaggcagu

SEQ ID NO: 152032 - RNA, 64 nt, Human
uuuggaucuauugggggaguguggccacagaccgggggaugauugaauuguucagaaccugauu

SEQ ID NO: 152033 - RNA, 64 nt, Human
gguagugggaggugggagggaagggcuuugggaaggggaugaauaucucuuuuuaccuuuaaca

SEQ ID NO: 152034 - RNA, 64 nt, Human
agaauccacuguagccuuccgcccugguauuuggggggaugaccagcccaggcguuggguguua

SEQ ID NO: 152035 - RNA, 64 nt, Human
ccccagcucggccuugggagguggucguguccagggggaugauggagagcuguccaaccaagag

SEQ ID NO: 152036 - RNA, 64 nt, Human
gguguuaaugguggccuggguugugucuuccccuggggaugaggguuggguguccauggugccc

SEQ ID NO: 152037 - RNA, 64 nt, Human
gguguccaagaugcccugggcuguguccuucccuggggaugaggguuggauguccaagaugccc

SEQ ID NO: 152038 - RNA, 64 nt, Human
gguguccaagauacccugggcuguguccuccccuggggaugaggguuggguguccauggugccc

SEQ ID NO: 152039 - RNA, 64 nt, Human
gguguccauggugcccugggcuguguccuccccuggggaugacgguuggguguccauggugccc

SEQ ID NO: 152040 - RNA, 64 nt, Human
uggguguccauggugcccugggcuguguuuccuuggggaugaggguugggugcuauggcauccu

SEQ ID NO: 152041 - RNA, 64 nt, Human
gcugugaauuuagauuacaaaugaauauuauaaaggggaugauuuuuaaccaaaggaauauauu

SEQ ID NO: 152042 - RNA, 64 nt, Human; identical to SEQ ID NO: 84633

SEQ ID NO: 152043 - RNA, 64 nt, Human
gcauagacuucucuauauguuucuacuagaccuaggggaugacgucuuuuaauaauacuggccc

SEQ ID NO: 152044 - RNA, 64 nt, Human
ccaguucauggaggccaucaccgucagugcagcaggggaugaggaugaggaugaauccggggag

SEQ ID NO: 152045 - RNA, 64 nt, Human
uggagagcgagcucuaucgcaucggccagcagcuggggaugacguucaucagugugggacaucg

SEQ ID NO: 152046 - RNA, 64 nt, Human
aagagcugccuggaugagaaacagcucagccaguggggaugaggucaccaggggaggagccugu

SEQ ID NO: 152047 - RNA, 64 nt, Human
uacaggauguuggcugcuugcagacuggucaaugggggaugacgguggggagguugccagaugu

SEQ ID NO: 152048 - RNA, 64 nt, Human
uacacuuugcuuccuucuuauuggugaaaaccagggggaugaguggcuuccauggagagauuuc

SEQ ID NO: 152049 - RNA, 64 nt, Human
cgauaaaguaacaguaugucagauaagccgguggggggaugagauuaggcugaggcagugcuag

SEQ ID NO: 152050 - RNA, 64 nt, Human
cugccgggcaccagggcuugugccaucgccccaaggggaugaaucugccacacugaggccaggg

SEQ ID NO: 152051 - RNA, 64 nt, Human
uugcaaauuucuauucucuuuuacugaaaaagcaggggaugaguuccaucagaaggugcccagc

SEQ ID NO: 152052 - RNA, 64 nt, Human
ggggugcagagcccaccuggguaccugacccccaggggaugaaaaugcaaggaugagucugcuu

SEQ ID NO: 152053 - RNA, 64 nt, Human
gauagcgcaggaaggugggucccggcaacacgcaggggaugaguggaccuggaacugacaaugg

SEQ ID NO: 152054 - RNA, 64 nt, Human
gguuuaacccuucugauagguaguuguggaugcuggggaugagaacugaauaaucuuugccugg

SEQ ID NO: 152055 - RNA, 64 nt, Human
aaaauguuuucuuggcuuggaaacugggcggccaggggaugacaguauggacuuccagugaagu

SEQ ID NO: 152056 - RNA, 64 nt, Human
caggaaagggaguugcugagggcagguccccgagggggaugagaccuggcaacauccaugccuu

SEQ ID NO: 152057 - RNA, 64 nt, Human
uagggaauggcagguucaaguuccacuucuugguggggaugagaagggagagagagcuagaggg

SEQ ID NO: 152058 - RNA, 64 nt, Human
uucccacccugugaggcuugacuugaucuggauuggggaugacaggaaucucacccucuggggu

SEQ ID NO: 152059 - RNA, 64 nt, Human; identical to SEQ ID NO: 84637

SEQ ID NO: 152060 - RNA, 64 nt, Human
uucaggaggggagccugcaggugccggcuggugaggggaugacgcgcugugggugggaggaggc

SEQ ID NO: 152061 - RNA, 64 nt, Human
acauuuuuguugcuccccaaaucccuccccacguggggaugagaaccuuccugcugugauguga

SEQ ID NO: 152062 - RNA, 64 nt, Human
ccgugccuuccagauggcugggagaugccucuguggggaugaaauggggcaccccuggccauca

SEQ ID NO: 152063 - RNA, 64 nt, Human
aguccuaggacacaggcucagccucagguugaugggggaugaugugcucccggggccugccucc

SEQ ID NO: 152064 - RNA, 64 nt, Human
ggcuuccuaaaauucaguggaaaauuaauuguuuggggaugagaaagguugaagcaccaaaagc

SEQ ID NO: 152065 - RNA, 64 nt, Human
ggaaccaggggcaagcuggggcugagcuggagguggggaugagagcagguguggggacagcaau

SEQ ID NO: 152066 - RNA, 64 nt, Human
cuuccucgagcgcgggguggggcuucgggaccccggggaugagccgggccaggucccgccccuc

SEQ ID NO: 152067 - RNA, 64 nt, Human
gggaccagguggcucucacaugggggguaacuacggggaugaucgucgugguggcagaggaggc

SEQ ID NO: 152068 - RNA, 64 nt, Human
gaagcuggcagugcucaccccaggcuucccugacggggaugacucagcacuaccccucaacaga

SEQ ID NO: 152069 - RNA, 64 nt, Human
ugacucagcagggaugauucagcagagauaacucggggaugacucugauuguccuucagcaggg

SEQ ID NO: 152070 - RNA, 64 nt, Human
aguuggcucagaugaaaaccucugucaacaaagaggggaugaaucacccuuggcccagccuccc

SEQ ID NO: 152071 - RNA, 64 nt, Human
ugaaugcgucaauaaccuccuucauagccaaguuggggaugagcuguuccugggucagggggcu

SEQ ID NO: 152072 - RNA, 64 nt, Human
ccugucauaggaagcuccuuggaagaagggauggggggaugagaucauguuuacagaccuguuu

SEQ ID NO: 152073 - RNA, 64 nt, Human
uguggaugggaauaugggaauuagggugggggugggggaugaagggaagaaaucacugugcuuu

SEQ ID NO: 152074 - RNA, 64 nt, Human
ucagugcagccauuugcccagggcugcucccgagggggaugaugggaaauucagcaguguagac

SEQ ID NO: 152075 - RNA, 64 nt, Human
ccccuccccacuuacucgaggagagaggugagggggggaugacuugcggguucugaucaggccc

SEQ ID NO: 152076 - RNA, 64 nt, Human; identical to SEQ ID NO: 84641

SEQ ID NO: 152077 - RNA, 64 nt, Human
ggcccucugccagcauaaaccacucacaccccagggggaugagcucuccaagcccaggauucug

SEQ ID NO: 152078 - RNA, 64 nt, Human
agaagagacugugcuggguguggcuuggcacccaggggaugagagcccugagcuuugggucucu

SEQ ID NO: 152079 - RNA, 64 nt, Human
caggagguauugaaggacaggagagaugucagguggggaugaagaagaggggcaggucggggga

SEQ ID NO: 152080 - RNA, 64 nt, Human
gguguucaggagcggggagcacugaugaggugcuggggaugacaggaaggaaggaacacugggc

SEQ ID NO: 152081 - RNA, 64 nt, Human
ccucuaucccggcuuuggugcgggguacacaagaggggaugaguugugugaauaccccaagacu

SEQ ID NO: 152082 - RNA, 64 nt, Human
auuuaaaaaaaaaaaaaaaaacucuguuucugcaggggaugauauuggugaguugccaaagaag

SEQ ID NO: 152083 - RNA, 64 nt, Human
gcgccaauaacaauacagugucugaguaucuccaggggaugauuucuggcucuuugucuccaau

SEQ ID NO: 152084 - RNA, 64 nt, Human
ugugaacucuguuggguguacucugcuaaguucuggggaugaggaaauuaauaaagguacaguc

SEQ ID NO: 152085 - RNA, 64 nt, Human
uuacugauugauuugaagaugauagagagccuagggggaugagucuauuggacucaaagguuac

SEQ ID NO: 152086 - RNA, 64 nt, Human
cugaaugugccuaauggagaagacccacgugcuaggggaugaggggcuuccuggguccuguucc

SEQ ID NO: 152087 - RNA, 64 nt, Human
agagcccaagguuuaaacuucucugaagggagguggggaugagaagagggguuuuuuuguacuu

SEQ ID NO: 152088 - RNA, 64 nt, Human
accaguugggaggagugagcaggccccgggggagggggaugagcgcaguuugcucgcuuuccuc

SEQ ID NO: 152089 - RNA, 64 nt, Human
ggucauggagcagcccccaaagagcuguggcuggggggaugacggccaggcucccugaccaccc

SEQ ID NO: 152090 - RNA, 64 nt, Human
ggcuggccucuugccuaccuccuugcauggacagggggaugaauauuuacuuucccaccuccuu

SEQ ID NO: 152091 - RNA, 64 nt, Human
uuccaaggggaccaaugugccacuguucuuccuuggggaugaggccuuugacuguuggauggau

SEQ ID NO: 152092 - RNA, 64 nt, Human
caauggauuuuggggacuuaggggaaaggaugcaggggaugagggauaaaaaaccauacauugg

SEQ ID NO: 152093 - RNA, 64 nt, Human; identical to SEQ ID NO: 84645

SEQ ID NO: 152094 - RNA, 64 nt, Human
gcuggguucccagucggagccuuucggggaucugggggaugagggcggaaggccuagcuccuug

SEQ ID NO: 152095 - RNA, 64 nt, Human
uggggagcggugggggugggccggggggaagcauggggaugaggcuggguggcaggauccuguc

SEQ ID NO: 152096 - RNA, 64 nt, Human
gaucuucgcaauuuugagugcuccuguggggagcggggaugagcuaaagauacaauguuucccu

SEQ ID NO: 152097 - RNA, 64 nt, Human
gccacaguccccaguagccucaagcagcaccaauggggaugacccugacaggugcccucagggg

SEQ ID NO: 152098 - RNA, 64 nt, Human
uuagucagaggccccacccccaggaagcauggauggggaugaaggcacaggcgucuccaaccuc

SEQ ID NO: 152099 - RNA, 64 nt, Human
cuuucaagagguaacagcacugggauccaagcagggggaugaaaaacucagcagagaaauucga

SEQ ID NO: 152100 - RNA, 64 nt, Human
cgcgugaucaaagccacacucugggcuccagaguggggaugacaugcacucagcucuuggcucc

SEQ ID NO: 152101 - RNA, 64 nt, Human
gaaaagagaggagcuugggcucacagaaagagaaggggaugaaaccccaaggggcccuaucuuu

SEQ ID NO: 152102 - RNA, 64 nt, Human
acggauuaacggccuggauuuaucauuggguuggggggaugacggggggugggaacaagaugga

SEQ ID NO: 152103 - RNA, 64 nt, Human
uuuuaaaggcaaagauugacauuauugaaggaaaggggaugaggacaacugugaacucacagug

SEQ ID NO: 152104 - RNA, 64 nt, Human
uugcccccacgggucuagggagaacgaacucuuuggggaugacauuuucaccgugacauuuuua

SEQ ID NO: 152105 - RNA, 64 nt, Human
ugccacuuagcacuuguauaaucagacuggaaauggggaugaggguguaaauuguauugaaaaa

SEQ ID NO: 152106 - RNA, 64 nt, Human
cuugcaguggucccuaguagccucucaagcuaauggggaugaugauccugguuuagccagaguu

SEQ ID NO: 152107 - RNA, 64 nt, Human
acaaaaaaacucauggagcgauuuuauuaucuugggggaugagaccaugagauuggaaaaugua

SEQ ID NO: 152108 - RNA, 64 nt, Human
uuucuauaagaaaucuuucagaaucagcaaaaguggggaugacccaggcaucuugauuugcaaa

SEQ ID NO: 152109 - RNA, 64 nt, Human
aggauuuuccucuagccuuugccauuaccuuuuuggggaugagguucacaguagacuuugagug

SEQ ID NO: 152110 - RNA, 64 nt, Human
acggggaggggccaggacccacccacugcuccugggggaugagguccugguuuuaaagccccgu

SEQ ID NO: 152111 - RNA, 55 nt, Human
aggacuuuguguuuuuauaaagggaggggaugaggggaaagauacaacacuauuu

SEQ ID NO: 152112 - RNA, 64 nt, Human
ucacccuccagggcugauguggggguugagauauggggaugaggaugaagaacuuuuguagaaa

SEQ ID NO: 152113 - RNA, 64 nt, Human
ggaaauaguuugaacuauuuccaaaaaucccuuaggggaugaggggugaaauuuaaaagcuccu

SEQ ID NO: 152114 - RNA, 64 nt, Human
cugccugccugccugccugcccgcccagagcuguggggaugaguguccccaccccagggccacu

SEQ ID NO: 152115 - RNA, 64 nt, Human
gugcagggcugcugagucaaccuuuuauuguacaggggaugagggaaagggagaggaugaggaa

SEQ ID NO: 152116 - RNA, 64 nt, Human
ggggaccugaugggguagcuggggugugggguugggggaugaggucagggggucuuggguggga

SEQ ID NO: 152117 - RNA, 64 nt, Human
caugauugcuacagaagcacugagauaauggaguggggaugacuguggcaaacaaaaggagauu

SEQ ID NO: 152118 - RNA, 64 nt, Human
caaagucgaugugaggaggaggcuuuauaccugaggggaugauguuaacuucagacaagaugga

SEQ ID NO: 152119 - RNA, 64 nt, Human
cuguccccgauagaauugaagcaguccacggggaggggaugauacaaggaguaaaccuuucuuu

SEQ ID NO: 152120 - RNA, 64 nt, Human
cugggcacucauggugaaaugacaggcaagaaguggggaugauguuuggggaacaagauacuug

SEQ ID NO: 152121 - RNA, 64 nt, Human
guuguggggagggaagagaaggacaggguguuggggggaugaggaccuccuacccccuuggccc

SEQ ID NO: 152122 - RNA, 64 nt, Human
auuuaucuuuaguuuuuagccauuucauuauguuggggaugaguuuccuuguuuuauucccuuu

SEQ ID NO: 152123 - RNA, 64 nt, Human
cccuggccagaucacccagaacauguugugugcuggggaugagaaguacgggaaggauuccugc

SEQ ID NO: 152124 - RNA, 64 nt, Human
agagacaacuuaggaugagggcagaaaagucuuuggggaugauucagucuguaccagacaugac

SEQ ID NO: 152125 - RNA, 64 nt, Human
cuugcguuuuucgucaucuuauuccaguucugugggggaugaguuuuuuuguggguugcuuuuu

SEQ ID NO: 152126 - RNA, 64 nt, Human
uguccccuacuuccuaggccauuucuggggcuugggggaugaaugcuguccugugcuguaaaca

SEQ ID NO: 152127 - RNA, 64 nt, Human
gaagauaaguuggagggaaagagaguaacuaauaggggaugaaauauagcagaagcuagaagaa

SEQ ID NO: 152128 - RNA, 64 nt, Human
cguguagcacuacgacguuauguuuggguaauguggggaugaacugcaugaggcucugauuaag

SEQ ID NO: 152129 - RNA, 64 nt, Human
agcuggucagggcugaguacaguccuggggguaaggggaugacaugcccaggugucagcucaaa

SEQ ID NO: 152130 - RNA, 64 nt, Human
cagugcacacaggaagaaauugaggcuuauggauggggaugacuucccuaagaucccaugggac

SEQ ID NO: 152131 - RNA, 64 nt, Human
aaagaaaaaucccccuuauuuagaaauguuccugggggaugaagaaaccauaauuacuugagac

SEQ ID NO: 152132 - RNA, 64 nt, Human
ggcacuaggggccacuggggggcuggggucuccaggggaugacuguuuucaaucucugggccaa

SEQ ID NO: 152133 - RNA, 64 nt, Human
uuacauaaaauguguuuuugaaucaaugcaguuuggggaugaauauaauuaaaauauguuuaau

SEQ ID NO: 152134 - RNA, 64 nt, Human
aaugcuuauccaugaauguccucuuagaccauuuggggaugaagccaucuuaauaauuaguaau

SEQ ID NO: 152135 - RNA, 64 nt, Human
acaaaagaagaugaaaauggaaguggcaauauaaggggaugaggaaggcaugccuggacaaacc

SEQ ID NO: 152136 - RNA, 64 nt, Human
ggccccucugcucacagagcccccucaccucccuggggaugaggggccaggccaugacccugaa

SEQ ID NO: 152137 - RNA, 64 nt, Human
cugagccagcguccaggguacaggugcgggugguggggaugaaggccugaccagggagggagaa

SEQ ID NO: 152138 - RNA, 64 nt, Human
ggccuccuugaggaauagggauggggagcccucuggggaugagcaaggccuuccaggacaggcu

SEQ ID NO: 152139 - RNA, 64 nt, Human
ggcacaaugggaccucuguuguacauuccgguugggggaugagcguugcuauuuaauuacuaau

SEQ ID NO: 152140 - RNA, 64 nt, Human
gcaaaggcaggucuggagggugggucuugagauuggggaugaggguggugagccccugggcgug

SEQ ID NO: 152141 - RNA, 64 nt, Human
ugugggacaguugggcuuuguucauucuagccacggggaugaaagggaucuuuugcauugcaga

SEQ ID NO: 152142 - RNA, 64 nt, Human
ggcuuccccuucagggccacaacaggcuguagaaggggaugacgaggacaucagagguuagacu

SEQ ID NO: 152143 - RNA, 64 nt, Human
uccuccuucugaaggaccucauccuuccucacagggggaugaccaagaaaucauuuuguggcug

SEQ ID NO: 152144 - RNA, 64 nt, Human; identical to SEQ ID NO: 84649

SEQ ID NO: 152145 - RNA, 64 nt, Human
cccucuuaagaccccucucagggugccacugaugggggaugagggaaggcccucucucuacucc

SEQ ID NO: 152146 - RNA, 64 nt, Human
gcauccugauaccauucuauucuccagacauggaggggaugauaaaggaaauaggaucuccacu

SEQ ID NO: 152147 - RNA, 64 nt, Human
ucuuauuugugagcaguucaggcuaucuccugauggggaugaggccaaggcuuucuuaucuuuu

SEQ ID NO: 152148 - RNA, 64 nt, Human
guaaaccaguuuuucuagggauggcccuuggcugggggaugacagugugggagcugugggguac

SEQ ID NO: 152149 - RNA, 64 nt, Human
auuuuggaauauuugcauauacaugcgauaucuuggggaugagacucaagacuaaacaugaaau

SEQ ID NO: 152150 - RNA, 64 nt, Human
cuugucucagcuucagguucuucaccucuaagauggggaugaugaaaacaguaccugucaugca

SEQ ID NO: 152151 - RNA, 64 nt, Human
uagaccuucugguagaagaaauaauauccagacaggggaugauuuggcuucagcaggcugcagg

SEQ ID NO: 152152 - RNA, 64 nt, Human
auuguaacacgggaagccgggaagugagagaaaaggggaugagugcagggcagaggugagggaa

SEQ ID NO: 152153 - RNA, 64 nt, Human
gaaauguuucuuuauggccauuuuggagggagcaggggaugaggcuuggcauaguccaaaauuu

SEQ ID NO: 152154 - RNA, 64 nt, Human
gccaccccaaagugcuuugcugaaggauuuagacggggaugaagugcccuccagccucagagcu

SEQ ID NO: 152155 - RNA, 64 nt, Human
cugccaaauuuucucaugaucucaccuauacuuuggggaugauaauccaaaaguauuucacagc

SEQ ID NO: 152156 - RNA, 62 nt, Human
caaaaacugaacuucgggggucguucugugccuuccagcaucuuguacagcaaauccugacu

SEQ ID NO: 152157 - RNA, 62 nt, Human
gcuuccuagaggacagccuugccgccacacaguuccagcagagccaggccagccuccuccac

SEQ ID NO: 152158 - RNA, 62 nt, Human
agucugcagugugacuuaacuuguguauugcauuccagcagaccacugaaccagacagcgaa

SEQ ID NO: 152159 - RNA, 62 nt, Human
gccgcccagauuccugcaguggagaggaggucuuccagcagcagcaggucuggagggcugag

SEQ ID NO: 152160 - RNA, 62 nt, Human
aguuuagucauccaacaagaagaaauaugaaauuccagcaauaagaaaugaacaaaagauug

SEQ ID NO: 152161 - RNA, 62 nt, Human
aaaggaguaaaacauaguugcuccuaacuuuuuuccagcagcagcaagugguaauaaacaug

SEQ ID NO: 152162 - RNA, 62 nt, Human
ccacauggugcugauggacaucagacggagacuuccagcaaucuguugguuuugcaagucug

SEQ ID NO: 152163 - RNA, 62 nt, Human
caguaauguauacaaauugucuuuuuguguacuuccagcauagguuuggauauaugaacauu

SEQ ID NO: 152164 - RNA, 62 nt, Human
ggggaucaagcacuggccucugccccuccuccuuccagcaccugccagagcuucuccaggag

SEQ ID NO: 152165 - RNA, 62 nt, Human
cagucuuagucugcaaacuggcauuuccgauuuuccagcauaaaaauccaccugugucugcu

SEQ ID NO: 152166 - RNA, 62 nt, Human
agacugauuaucucaugugagccaggacauucuuccagcaagguuggccucuggauggugaa

SEQ ID NO: 152167 - RNA, 62 nt, Human
uuccuucugauucugccugaauagcugagagguuccagcaaaagcuugaagucuugccugga

SEQ ID NO: 152168 - RNA, 62 nt, Human
uuacucaagaaauauuugcaacauuaguuuuuuuccagcaucagcaauugcuacucaauugu

SEQ ID NO: 152169 - RNA, 50 nt, Human
ucaguggcucaugccuauaauuccagcacuuugggaggccaaggcagaag

SEQ ID NO: 152170 - RNA, 62 nt, Human
gaaucaccuucuuuauaaagcgucagucaugcuuccagcaagaggcagcaucagucauggcu

SEQ ID NO: 152171 - RNA, 62 nt, Human
caagagagaacaaaggucagagauguugaagauuccagcaaauuucuccucuuauuucuacc

SEQ ID NO: 152172 - RNA, 62 nt, Human
acagagggcaaggagagaagugagagcuacaauuccagcauuggagaagcgaggggcggggc

SEQ ID NO: 152173 - RNA, 62 nt, Human
acaugagccuugccacuuccuuuuucucuuacuuccagcacacuagacauagcaaaaguguu

SEQ ID NO: 152174 - RNA, 62 nt, Human
auauauuuaauauauaaaauuaagacuuuugcuuccagcaaguauguuagacuagauauuau

SEQ ID NO: 152175 - RNA, 62 nt, Human
uguccaguuuggccuccugcccaaacuguccauuccagcagcuccugcccccuucucuguac

SEQ ID NO: 152176 - RNA, 62 nt, Human
ucucuuagcaaccgucuguagcaaagaagugcuuccagcaucacuccagcaacacgcccaug

SEQ ID NO: 152177 - RNA, 62 nt, Human
gauccaaaguauaguacaaccacagcucagaauuccagcaguucauccagucagagcaaaau

SEQ ID NO: 152178 - RNA, 62 nt, Human
uggcggcucuucucgcuugggucauggucaucuuccagcaccugcugugcugggaaggccga

SEQ ID NO: 152179 - RNA, 62 nt, Human
auaccaggcuuggagcugguaaccuccagggcuuccagcacggggccucugccuggugugac

SEQ ID NO: 152180 - RNA, 62 nt, Human
gcaccaaggaaaggaaagaugagccuccugucuuccagcaacaacccucacauaugcacuga

SEQ ID NO: 152181 - RNA, 62 nt, Human
uggagguugcauucccuacuuccuaaacucucuuccagcaucgauguucuguagcucugacc

SEQ ID NO: 152182 - RNA, 62 nt, Human
agaguggccagaggaaagugagaggcguccauuuccagcagacacaauggaggcugacagag

SEQ ID NO: 152183 - RNA, 62 nt, Human
acuuguggcaaacaaccucguuuccuuacaaauuccagcaugugacuuuggugccguuacuu

SEQ ID NO: 152184 - RNA, 62 nt, Human
aaaaaaaaaguuugguguuuuuaaccaugcuguuccagcaaagaugauaccuuaaacuccca

SEQ ID NO: 152185 - RNA, 62 nt, Human
cugcgcccagcuauacuguauauuuuaagaaguuccagcauguugcaucucugcauuuaucc

SEQ ID NO: 152186 - RNA, 62 nt, Human
aaacauguaccauguuuuauaaaccucuugauuuccagcaacauacuauagaaaacaccugc

SEQ ID NO: 152187 - RNA, 62 nt, Human
uuuguuuuuaguauuuaguguagauguacacauuccagcaaauguauuugcaauuauguggu

SEQ ID NO: 152188 - RNA, 62 nt, Human
guuaagccuucagguacguuguggacuaggcuuuccagcaagguuuuuguagcuauuugcuu

SEQ ID NO: 152189 - RNA, 62 nt, Human
ucauuucacuucuaauaauuucuguuauaaauuuccagcauuuuaaugaaaaucuaaugaug

SEQ ID NO: 152190 - RNA, 62 nt, Human
guugaaagaagauuaggggaaaagaggucaccuuccagcagugaaaugaacaaauagaagau

SEQ ID NO: 152191 - RNA, 62 nt, Human
uuuuuuuuaaucugaagccccugauuuuauuuuuccagcaucacucuaaggaagagugugga

SEQ ID NO: 152192 - RNA, 62 nt, Human
uuaacuuguuuuccaagagauaacaccaacuguuccagcaauaauuuguuuuuuaauucaga

SEQ ID NO: 152193 - RNA, 62 nt, Human
cuccaucaauguacuuugaacuaccugacucauuccagcacuacagaaguguguuuuacuca

SEQ ID NO: 152194 - RNA, 62 nt, Human
uauucacagaaaaugggcaccuucucucucucuuccagcauguugcuuuugaaaguaucaug

SEQ ID NO: 152195 - RNA, 62 nt, Human
uaccugagucaaacaccuaaggauaacaucauuuccagcaugugguucaaauaauauuuucc

SEQ ID NO: 152196 - RNA, 62 nt, Human
uaaugucugcucuuguguagcucaggagacaauuccagcacagacacuacaguuaacgcuga

SEQ ID NO: 152197 - RNA, 62 nt, Human
auuucagcucacugcaaccuucgccaccuggguuccagcaauucuccugccucagccucccg

SEQ ID NO: 152198 - RNA, 62 nt, Human
cuauugagcuugcagggaagccaagcuugcaguuccagcaagcaaagauuuuuuuuaauaga

SEQ ID NO: 152199 - RNA, 55 nt, Human
uggccaaauacucagcguagaaaacuuccagcacauugggguggagggccugccu

SEQ ID NO: 152200 - RNA, 62 nt, Human
auggcucaggugucaggggaggccggaggguuuuccagcauuugccucaugccagcaccuuu

SEQ ID NO: 152201 - RNA, 62 nt, Human
agucauuccuucuuuuuaaaauggugcuuaaguuccagcagaugccacauaagggguuugcc

SEQ ID NO: 152202 - RNA, 62 nt, Human
uccacuaaaaaaagauauguaaaaaagauacuuuccagcacauaaauaaaggcuggaauuuu

SEQ ID NO: 152203 - RNA, 62 nt, Human
uugacugguauuuuuuacugaggagcaacucauuccagcaucaacaauaagauaaccuuuaa

SEQ ID NO: 152204 - RNA, 62 nt, Human
uuaaccucaucuacaagcauuugcccuguggauuccagcauuugccauuccuggaaucaagg

SEQ ID NO: 152205 - RNA, 62 nt, Human
cucucaacaccaugauuccuuuaacaacauguuuccagcauucccagguaggccaagguguc

SEQ ID NO: 152206 - RNA, 62 nt, Human
ggucaccucuggcugcaggcauccagggauuauuccagcaaucugcagguagggaguggguc

SEQ ID NO: 152207 - RNA, 62 nt, Human
ccaggggggugaguucaugccucuccuguauuuuccagcaagugggguauguguggugguuu

SEQ ID NO: 152208 - RNA, 62 nt, Human
agagcagaagggagggcuugggacuccugucuuuccagcaugcccuggggugcaguggucag

SEQ ID NO: 152209 - RNA, 62 nt, Human
gagagaaucauuuaaugaagccuauuuuucuguuccagcaacuguuuuuaugaaagaaaaac

SEQ ID NO: 152210 - RNA, 62 nt, Human
uuggguuuuuauacccacgguaggauucugcauuccagcauuaaaucugcuucauuuuagaa

SEQ ID NO: 152211 - RNA, 62 nt, Human
cggauugcaccugaauccuaucugacguuucauuccagcaagaggggcuggggaagauuaca

SEQ ID NO: 152212 - RNA, 62 nt, Human
ccacucagauguucgacgcccccuaagguccauuccagcacccaccugaguuccgaggagca

SEQ ID NO: 152213 - RNA, 62 nt, Human
accugguggcauuuccagaaccucagccccgauuccagcacccaccaccgccugacccugug

SEQ ID NO: 152214 - RNA, 62 nt, Human
cuuuucuuccuuauggggcuacauuuguucauuuccagcaguagcauaaacuuacggugaca

SEQ ID NO: 152215 - RNA, 62 nt, Human
ggaaacucuucucuccaaaucccaggccuggcuuccagcaccauccagcugugcccaagaag

SEQ ID NO: 152216 - RNA, 62 nt, Human
accauuuucuuuucuugggagccaguggauuuuuccagcagugaagggacauucucuacacu

SEQ ID NO: 152217 - RNA, 62 nt, Human
agaacgauaugucuguccaucuuucuccuuucuuccagcacacacagcuaagagauaagaag

SEQ ID NO: 152218 - RNA, 62 nt, Human
ccuguguuguuacaggcugugcagugcaacaauuccagcaaaaauacccuauccccgcacuu

SEQ ID NO: 152219 - RNA, 62 nt, Human
cugacugacaccaucuugaugccaguacuggauuccagcauucagcaggugcagaucucggc

SEQ ID NO: 152220 - RNA, 62 nt, Human
agauacaagcaagaauaguauuugaaagacuuuuccagcauacuucucaauucuuugcuuua

SEQ ID NO: 152221 - RNA, 62 nt, Human
acucagacuccaaacacggaacgaauucagacuuccagcacgagcugacugacaucacuguu

SEQ ID NO: 152222 - RNA, 62 nt, Human
gcuuuuugucccuuuccuucuaucacccuacauuccagcaucuuaccuucauaugcaguaaa

SEQ ID NO: 152223 - RNA, 62 nt, Human
ucuccaagucccaguuugagugugggaugugcuuccagcagugccuucccuuuaugaaagac

SEQ ID NO: 152224 - RNA, 62 nt, Human
ucucuuaguucuucucuaacauaguacuuucuuuccagcaaaagcaaaauguguuuucagau

SEQ ID NO: 152225 - RNA, 62 nt, Human
acaaucaacuuuucugagcugguguaagccaguuccagcacaccauugcaugaauucacaaa

SEQ ID NO: 152226 - RNA, 62 nt, Human
guguuguguuuacaucugacauuaaauuauuuuuccagcauacaagauuuaaauuugggaag

SEQ ID NO: 152227 - RNA, 62 nt, Human
gaggucaauagaguguagaguuucagaaaggauuccagcagguuuauaugugaauauaagug

SEQ ID NO: 152228 - RNA, 53 nt, Human
augaccagauggagucuuaacacuuccagcaaacucaaucucagcgugugacc

SEQ ID NO: 152229 - RNA, 62 nt, Human
uagaggccagacgcaguggcucacgccuguaauuccagcacuuugggaggccgagguaggcg

SEQ ID NO: 152230 - RNA, 62 nt, Human
auuaggccggguacaguggcucaugccuauaauuccagcacuuugggaggcagaggugggcg

SEQ ID NO: 152231 - RNA, 62 nt, Human
aacugacagucacguuuuacugguaacuuauuuuccagcacaugaagccaccaguuucauuc

SEQ ID NO: 152232 - RNA, 62 nt, Human
aaggguugggaaaauccaaauucucuuccugguuccagcacugauuuuguacauaaacauua

SEQ ID NO: 152233 - RNA, 62 nt, Human
augagaccaggcacaguggcucacgacuguaauuccagcaguuuaggaagccgaagugugca

SEQ ID NO: 152234 - RNA, 62 nt, Human
cuccugccgggcgcgguggcucaugccuguaauuccagcacuuugggaggcagaguugggag

SEQ ID NO: 152235 - RNA, 62 nt, Human
agaguugcccuuuacagaaucacucgagcccuuuccagcacuguuggucugaugaacaaggu

SEQ ID NO: 152236 - RNA, 62 nt, Human
ucugauaaggauguccagagcucuuuaacccauuccagcagagacucauacagaucaaaauc

SEQ ID NO: 152237 - RNA, 62 nt, Human
aagaugaggguagaagauguuaagaucccagguuccagcaacugaugccacugacuaacaac

SEQ ID NO: 152238 - RNA, 62 nt, Human
uagugcauguacacgaaugcccuacgucauccuuccagcaccacugcugcaugggucacucu

SEQ ID NO: 152239 - RNA, 62 nt, Human
uugucagugcuauaaauuguuuaaugaggccauuccagcagaaaucaacagaauaauugauu

SEQ ID NO: 152240 - RNA, 62 nt, Human
aaaagcauuucucucaugugcgcccucagggcuuccagcaggauugagucacccugacgaug

SEQ ID NO: 152241 - RNA, 62 nt, Human
uuuucucugcacugguuuguuuaaaggacuucuuccagcaauaaguugaaagaauaaaccac

SEQ ID NO: 152242 - RNA, 62 nt, Human
caucuaaaaaauaggcuauacuacaauugcacuuccagcacuuugagaacgaguugaauacc

SEQ ID NO: 152243 - RNA, 62 nt, Human
caugagauuugcuuacuuuuguauacuguauuuuccagcauuacagaaccuugguuauuguu

SEQ ID NO: 152244 - RNA, 62 nt, Human
aauccguagaacagagagacuguagaaaaauauuccagcacuugaguuguguguggcagcag

SEQ ID NO: 152245 - RNA, 62 nt, Human
auuuaaggccugucuguaauggcaucugaauguuccagcagccuaacugugcucugcuccag

SEQ ID NO: 152246 - RNA, 62 nt, Human
ggauaagguaccuuucacauagagaucauccuuuccagcaugaggaacuagccaccaacucu

SEQ ID NO: 152247 - RNA, 62 nt, Human
cauguuuagcaacacggcugaucuuucaguguuuccagcaacaaccuaagcaccguuaucag

SEQ ID NO: 152248 - RNA, 62 nt, Human
aaaauggcuuaagauguuuuucagauccugaauuccagcaaaagagcuauugccaaccaguu

SEQ ID NO: 152249 - RNA, 62 nt, Human
ccucgcuguuggagcaaaccauuauaccuuacuuccagcaagcaaagugcuuugacuucuug

SEQ ID NO: 152250 - RNA, 62 nt, Human
acuagaugcagcccauaguuggccccccuagcuuccagcaguccacuaucugccagaggagc

SEQ ID NO: 152251 - RNA, 62 nt, Human
uuuagccugugucaaauguaagucccaaguauuuccagcaggaaguaaugucuuccucagcc

SEQ ID NO: 152252 - RNA, 62 nt, Human
gaggugagggguagagagucagccucccucccuuccagcagcgacccagcuucccuccacuu

SEQ ID NO: 152253 - RNA, 62 nt, Human
agacugugcaggagccccaaccuguccuccaauuccagcauucacagcugaugagcagugca

SEQ ID NO: 152254 - RNA, 62 nt, Human
cuuaggccaggcguggugacucacaccuguaauuccagcacuucaggaggccaaggugggaa

SEQ ID NO: 152255 - RNA, 62 nt, Human
caugggcagaauauuauaaaaagagugucauauuccagcauuugaauuggaaagagaagagu

SEQ ID NO: 152256 - RNA, 62 nt, Human
ucauuucacagaaaaaggcugaauuucauuuuuuccagcaugaaagccaggaucgguuagug

SEQ ID NO: 152257 - RNA, 62 nt, Human
ccccuggcacucuuguucccacaccccaacacuuccagcauuuagcuggccacauggcggag

SEQ ID NO: 152258 - RNA, 62 nt, Human
aucucggcucacugcaaccuccgccuccuugguuccagcaauucuucugccucagccucccg

SEQ ID NO: 152259 - RNA, 62 nt, Human
cccaauccauccccuuacuuucugccauggaguuccagcaggucacucucccuggcacaccu

SEQ ID NO: 152260 - RNA, 62 nt, Human
gaaaaccugauaggugagacuacuucaguuuauuccagcaagaaagauugugaugcaagauu

SEQ ID NO: 152261 - RNA, 62 nt, Human
gaaaaccagauagauggguugacaucaguuuauuccagcaagaaagaaaagauuguuaugca

SEQ ID NO: 152262 - RNA, 62 nt, Human
ccaggacacuuuagugcaaagagcugagcacauuccagcagggaaacgaacuccgaugugcg

SEQ ID NO: 152263 - RNA, 62 nt, Human
augggaaguuucuaucauuucauuuucugcguuuccagcaugcccuuggaaaagacucccuu

SEQ ID NO: 152264 - RNA, 62 nt, Human
uuacagcuucaccaggagaaugugcaacuuuauuccagcauucgaugcauuuuuauagaaac

SEQ ID NO: 152265 - RNA, 62 nt, Human
ucauacuguuaaugucaaauaucaaaaauguuuuccagcaauaucaaguuauggcaauggca

SEQ ID NO: 152266 - RNA, 62 nt, Human
gaccagaauuaucuuuguacuaaaagagaaguuuccagcaaaacccucaucagcauuacaag

SEQ ID NO: 152267 - RNA, 62 nt, Human
gccccaggcaacagugggaggagagaacugguuuccagcaguccauuguguggccuucccca

SEQ ID NO: 152268 - RNA, 62 nt, Human
uuacucagaugaccugaggaaaggagggaaaguuccagcaguuucaugagaugcaguauuga

SEQ ID NO: 152269 - RNA, 62 nt, Human
uggaaugaccaaaagaugggacuccuccuuuauuccagcauggaggguuuuaaauggaggau

SEQ ID NO: 152270 - RNA, 62 nt, Human
gaaaaccagauagauaggacaacuucaguuuauuccagcaagaaagaaaagauuguuaugca

SEQ ID NO: 152271 - RNA, 62 nt, Human
uguuuugaacgaagauuuuaaagaacucaacuuuccagcauccuccucuguucuaaccacuu

SEQ ID NO: 152272 - RNA, 62 nt, Human
ggccaaagcacuucacugcucugggcugcagcuuccagcacugaaucagaggccacacagcc

SEQ ID NO: 152273 - RNA, 62 nt, Human
accuuggacuucugcccagugacuuuauuacauuccagcagcuuacucccguggccgcacuu

SEQ ID NO: 152274 - RNA, 62 nt, Human
acuuuuugagacagacugaauauaucuaaaauuuccagcaauaaaaaaaaaagcauuuaacu

SEQ ID NO: 152275 - RNA, 62 nt, Human
auuacccaaaccacucugacagucuccuccaguuccagcaaugccuagagacaugcucccug

SEQ ID NO: 152276 - RNA, 62 nt, Human
uuaaauagagcaauuuggaagugauuccaauuuuccagcauuucuucauuugauucucuuuu

SEQ ID NO: 152277 - RNA, 62 nt, Human
aauaaauaaauagcaaccaguacuccaggugauuccagcauaacuuauccaugguuuguguc

SEQ ID NO: 152278 - RNA, 62 nt, Human
acuucucuacuccauuauuucucuacuuuuccuuccagcaaaccugaaacgugagggagaug

SEQ ID NO: 152279 - RNA, 62 nt, Human
aaagagcagagaucucucugggcccuagacauuuccagcaaaaccuggaacuuucaugccaa

SEQ ID NO: 152280 - RNA, 62 nt, Human
ggggccuccaguccuucacucagugucaucccuuccagcagcucccugggccucuuggucca

SEQ ID NO: 152281 - RNA, 62 nt, Human
aucaacauaaauuauuucuucccccuucccuuuuccagcacucaaccaaggagcaaagcuca

SEQ ID NO: 152282 - RNA, 62 nt, Human
gcuggaggagaggcggagcugugccccagcuguuccagcagcuugucuggcgucaacuggcu

SEQ ID NO: 152283 - RNA, 62 nt, Human
ugggcuccuuaacuucauaaauagcuaguaucuuccagcaguaguaacagucuggauaacuu

SEQ ID NO: 152284 - RNA, 62 nt, Human
uacuccccaauuuagucuagacacaauuucauuuccagcauuuuuauaaacuaccaaauuag

SEQ ID NO: 152285 - RNA, 50 nt, Human
cagcuccuucagguguuugauuccagcauguaguauacauuguauguguu

SEQ ID NO: 152286 - RNA, 62 nt, Human
augagcuguuggaagaaaagaaucacaguacuuuccagcagucagucccugguuccuagaug

SEQ ID NO: 152287 - RNA, 62 nt, Human
auuauuagauuccagcaaucugaaaucuauuauuccagcagucugaaaccuaaauauguuau

SEQ ID NO: 152288 - RNA, 62 nt, Human
gugucagucaucuucaaaggcagauuauuagauuccagcaaucugaaaucuauuauuccagc

SEQ ID NO: 152289 - RNA, 62 nt, Human
uguuuuagaugaacaucccuuaauuugagguguuccagcagcuguuuuuggagaagacaaag

SEQ ID NO: 152290 - RNA, 62 nt, Human
caucaccccagcgccauuuguaaagagcaacuuuccagcaguacauuugaagcacuuuuuaa

SEQ ID NO: 152291 - RNA, 62 nt, Human
aacccggugcucgcugggcuuuuccucugagauuccagcagguggcgcuggagggagucagg

SEQ ID NO: 152292 - RNA, 62 nt, Human
gaauuuguuucuaguuuggugaugccuaacuuuuccagcaaagaugauggaaaauaguuaua

SEQ ID NO: 152293 - RNA, 62 nt, Human
agguaacuggaauguauauacuuuugcuaauguuccagcaacacugcuauuauacuauccaa

SEQ ID NO: 152294 - RNA, 62 nt, Human
uugagaaggaacuggacccagcucuaccccgauuccagcaugugagcuucaugcuuccucac

SEQ ID NO: 152295 - RNA, 62 nt, Human
auaaauguguuucuuucuuaauaguauccuaguuccagcauauauucaacaugaauuuuauc

SEQ ID NO: 152296 - RNA, 62 nt, Human
cgggggcuaagccagccuggcgccccugcagauuccagcagggucccucugaguggggccag

SEQ ID NO: 152297 - RNA, 62 nt, Human
accgaggcccaugcgaagcuuuccacuauggcuuccagcacugucccggugagcgcugcugg

SEQ ID NO: 152298 - RNA, 62 nt, Human
ccuggucauccuaauaaugggaugagggaaguuuccagcagauuucaggcuguucuuaaagu

SEQ ID NO: 152299 - RNA, 62 nt, Human
aaagucuguaaauauguuaaugaggccaauuuuuccagcauuuauaauuauuuuuuucacuu

SEQ ID NO: 152300 - RNA, 62 nt, Human
gagagauuuauaaaaguaaacaaaagaaaaccuuccagcaacaaauuaaaaaauaauaacaa

SEQ ID NO: 152301 - RNA, 62 nt, Human
gcuuaggcagacaucgaaccucucugggauguuuccagcaaaagugagcuuuucuaaucguc

SEQ ID NO: 152302 - RNA, 62 nt, Human
cagcugggguuccaggcaugguuuaggcccuguuccagcaauaagaaccaaucugcuguaca

SEQ ID NO: 152303 - RNA, 62 nt, Human
gacagugucuucguuugauuacugccaguuauuuccagcaugcuaaaucccuacccacguuc

SEQ ID NO: 152304 - RNA, 62 nt, Human
gcagggcuggggcucuuagccaccagcugcuguuccagcacuuucagcgcaagaucucccug

SEQ ID NO: 152305 - RNA, 62 nt, Human
ucagggugggguggucucugauagguagcauuuuccagcacuuugcaaggaauguuuuguag

SEQ ID NO: 152306 - RNA, 62 nt, Human
gcucacagcugugcucugagugccuagcggaguuccagcaaacaaaauggacucaagagaga

SEQ ID NO: 152307 - RNA, 62 nt, Human
ggaugggaagacacauguuaaguuuuguggccuuccagcacuuacuauuuucagcuuuuuaa

SEQ ID NO: 152308 - RNA, 62 nt, Human
ugggaggaaaaagauggaguagcuuggaaagauuccagcacugagccgugggccggucauga

SEQ ID NO: 152309 - RNA, 62 nt, Human
auuugcugcugguaacaguuccaccauuuagguuccagcaccaagcaaacuaacacccgacu

SEQ ID NO: 152310 - RNA, 62 nt, Human
caaccuuauuaggcauuuuagaauccauacuguuccagcagaacuggacuaauucuguggac

SEQ ID NO: 152311 - RNA, 62 nt, Human
auuaucuuuaaagcccuacuuuaacuccuuaauuccagcauacagcuaaaacuggauguaua

SEQ ID NO: 152312 - RNA, 62 nt, Human
uggagggcagcugucuugugcauuacuuguguuuccagcaccaaaguugugggacauguugc

SEQ ID NO: 152313 - RNA, 62 nt, Human
cuaguggauguuaagugguaucuaccugugauuuccagcaagauuacuguuaucucugcucu

SEQ ID NO: 152314 - RNA, 62 nt, Human
gaguuugcauuuugaccuguucagugucugucuuccagcacgguguguacacuucuucaaaa

SEQ ID NO: 152315 - RNA, 62 nt, Human
ugggacugucuggcacucuguguauuuaugcguuccagcaucuggaaccucccaucccugcc

SEQ ID NO: 152316 - RNA, 62 nt, Human
uuuuacaaacacaacaaaauguaguaacuuuuuuccagcauacaguaggcacauucaaagug

SEQ ID NO: 152317 - RNA, 62 nt, Human
aaaaaauuugucugaaacauuucauaauuuguuuccagcaugagguaucuaaggauuuagac

SEQ ID NO: 152318 - RNA, 62 nt, Human
ugguuugcuuauuuuugcaagauggauacuaauuccagcauucucuccucuuugccuuuaug

SEQ ID NO: 152319 - RNA, 62 nt, Human
cuucccuccguggcguagggagcacuguuucuuuccagcaagccuguucagguuuggccagg

SEQ ID NO: 152320 - RNA, 62 nt, Human
accuucuugcagagugauuuugaccaaugccuuuccagcaccuuccccugguuaugacaggg

SEQ ID NO: 152321 - RNA, 62 nt, Human
uuccuaguacaucuuuuaaaaaguuacuaauuuuccagcaguacaaauauuaacaauuauau

SEQ ID NO: 152322 - RNA, 62 nt, Human
auuuagugaggagcuacauguauuuccaagaauuccagcauagauuauaauuuaaauaaucg

SEQ ID NO: 152323 - RNA, 62 nt, Human
aaaacauuccuauuaccuuucugaggcuggcuuuccagcaauuguuucaaaggaaaauagau

SEQ ID NO: 152324 - RNA, 62 nt, Human
uccugugcuggugacccagcaucugaguuagguuccagcauguaaagagcugggagggcgga

SEQ ID NO: 152325 - RNA, 62 nt, Human
uaugagggccuugagucccccaaaacaccggguuccagcaccacacucagcccucauuggcu

SEQ ID NO: 152326 - RNA, 62 nt, Human
uguucaaauacuaaagauccucagguccagaauuccagcaucauuuauucuuuuaaaauuuu

SEQ ID NO: 152327 - RNA, 62 nt, Human
cucuagagaaaaacuucaucuucaucucggaauuccagcagccauccagguauaauggugag

SEQ ID NO: 152328 - RNA, 62 nt, Human
acacgcagcuuuguucucaccucuaccugucauuccagcaucccugccucuugucacaaacu

SEQ ID NO: 152329 - RNA, 62 nt, Human
agauggccgggcgugguggcucaugccuguaauuccagcacuuugggaggcuaaggcgggag

SEQ ID NO: 152330 - RNA, 62 nt, Human
uuuuggccgagcaugguggcucaccccuguaauuccagcacuuugggaggcuggggcaggcg

SEQ ID NO: 152331 - RNA, 62 nt, Human
caucuaaccacuuguuucuaaggcacugccuauuccagcacuuucaaguagcugugauauua

SEQ ID NO: 152332 - RNA, 62 nt, Human
gacauuauaucauggcauuuuauuccuaaaucuuccagcaugcauccccaaaaaacaagaaa

SEQ ID NO: 152333 - RNA, 62 nt, Human
guacgaguuccacaaaauuugauccuuauugcuuccagcaaguagcaugaacuucuguguuc

SEQ ID NO: 152334 - RNA, 62 nt, Human
ccuccaccugccuccaggccacgaaaugggaauuccagcacuaagccaggcaccgggcagaa

SEQ ID NO: 152335 - RNA, 62 nt, Human
gauuuucacguauuaggcacuuuaguugaaucuuccagcaaaagcugucuacuuucucuuuu

SEQ ID NO: 152336 - RNA, 62 nt, Human
cuggccgggcacgguggcucaugccuauaaaauuccagcacuuugggaggccaaggcaggag

SEQ ID NO: 152337 - RNA, 62 nt, Human
uucaccauggccaccgcagaacaccgaaguaauuccagcauagcggggaagauguugaccaa

SEQ ID NO: 152338 - RNA, 62 nt, Human
ucaguagaugcuauuauucauaagaacugugauuccagcaaacuaggguaauuggugccuuu

SEQ ID NO: 152339 - RNA, 62 nt, Human
aaaccaaaaauagacaacuuuuucuucagccauuccagcauagagaacaaaaccuuauggaa

SEQ ID NO: 152340 - RNA, 62 nt, Human
uuguuaccuuuuuaaucaagggcaacuuccuuuuccagcacuaccauuguaagguuuuuuuc

SEQ ID NO: 152341 - RNA, 62 nt, Human
uccuccucccgcuucuugaccccacagauguauuccagcagagagcaacacaccagucauca

SEQ ID NO: 152342 - RNA, 62 nt, Human
acaacacagcauugguugacaaauugaagcguuuccagcaggagaaugaagaauugaaagcu

SEQ ID NO: 152343 - RNA, 62 nt, Human
uuguguggcagcuguauuuucugcaccaccauuuccagcagcaaucggcucucagaagaagu

SEQ ID NO: 152344 - RNA, 62 nt, Human
guuuuaagaccucaguaaccauuucagccucuuuccagcaaacccuucuccauaguauuuca

SEQ ID NO: 152345 - RNA, 62 nt, Human
auuuaaaaaccucaguaaucguuuuagcuucuuuccagcaaacucuucuccacaguagccca

SEQ ID NO: 152346 - RNA, 62 nt, Human
ugaaggggagagagggaaaaucaagugguauuuuccagcacuuuguaugauuuuggaugagu

SEQ ID NO: 152347 - RNA, 62 nt, Human
gugcuuguuguuuuuuauauuugugaugacucuuccagcaguuguugacaauuguuagaggu

SEQ ID NO: 152348 - RNA, 62 nt, Human
ccuccaaacccaaccuuucauuuccuacuucauuccagcaggaggcacuuaggggagacucg

SEQ ID NO: 152349 - RNA, 62 nt, Human
gaaaacuucagaagcaaacaauauugucucccuuccagcaauaagugguaguuaugugaagu

SEQ ID NO: 152350 - RNA, 62 nt, Human
acagggaaaugcagggggcaggacuugggagguuccagcaggcgggggagccccgaccagug

SEQ ID NO: 152351 - RNA, 62 nt, Human
uggaaccauuagaaaguucuuccaaaaucucauuccagcauaguuuuggauuuuucuuuugu

SEQ ID NO: 152352 - RNA, 62 nt, Human
ugccacuuagacauaauccauuccacucauuauuccagcaaacacuuacugacaaaucgggu

SEQ ID NO: 152353 - RNA, 62 nt, Human
ggccaaauaugcacuuucccuagaaagccauauuccagcagugaaacuugugcuauagugua

SEQ ID NO: 152354 - RNA, 62 nt, Human
auguauaugcccauucucucuuucuggaguuuuuccagcauacaauacaugcacgugcacac

SEQ ID NO: 152355 - RNA, 62 nt, Human
gcauuggcaccccuccagccuggaggccaggcuuccagcaacuuccuucugcccuagagcaa

SEQ ID NO: 152356 - RNA, 62 nt, Human
ccccaaaccagcagaucuuacugaagaugauguuccagcagcagcgacuuagccccaggagc

SEQ ID NO: 152357 - RNA, 62 nt, Human
ucagucuuuguagaagcagguggugguggaaauuccagcaggugggucccgcagaggcccug

SEQ ID NO: 152358 - RNA, 62 nt, Human
ccuauugcguggcugcugguguguggggucaguuccagcagaugaaugugucauguggcaca

SEQ ID NO: 152359 - RNA, 62 nt, Human
gguuggugggacagccaggccagaugaccugauuccagcaaaaauaaaacucagauuugggc

SEQ ID NO: 152360 - RNA, 62 nt, Human
auuugugcauagauugaugccaaaaaagacauuuccagcauuguggaacauggugagacacu

SEQ ID NO: 152361 - RNA, 62 nt, Human
guaucacagcaguaccucucauggcuuuuugguuccagcagugagggcauuggugagaucaa

SEQ ID NO: 152362 - RNA, 62 nt, Human
uuucuagauuccaaaaauacaaacacuaguuguuccagcauuguacuuugauaagucuguac

SEQ ID NO: 152363 - RNA, 62 nt, Human
auggggugaaccucagcacucccacaccucccuuccagcaggccagugguuauggccagcac

SEQ ID NO: 152364 - RNA, 62 nt, Human
uucuuugagcauaauucacuuuaaagucauuuuuccagcaauguuuaaauuacuuucucauu

SEQ ID NO: 152365 - RNA, 62 nt, Human
uuggcuuaaagugaaaaagaagaaauagagaauuccagcagaauucagugguugucuacuau

SEQ ID NO: 152366 - RNA, 62 nt, Human
gauguuugugcgcguguguggacagucuuaucuuccagcaugauaggauuugaccauuuugg

SEQ ID NO: 152367 - RNA, 62 nt, Human
gucucaccaggcgcaguggcucacgccuguaauuccagcauguugggaggccgaggcuggug

SEQ ID NO: 152368 - RNA, 62 nt, Human
acacacaaaaaaaaauaccuguagaaauauuauuccagcauagcaggaaaacaaacaaaagu

SEQ ID NO: 152369 - RNA, 62 nt, Human
ucccuacagccggggguguggcccagagaagcuuccagcacagcccucuacccagaacaucc

SEQ ID NO: 152370 - RNA, 62 nt, Human
aggagcugggaacuugguguugcccccucaauuuccagcaccagaaagagagauuguguggg

SEQ ID NO: 152371 - RNA, 62 nt, Human
cuuggaacucccuggcauugggaacagagcauuuccagcauuuguuguuguuuuacucaccu

SEQ ID NO: 152372 - RNA, 62 nt, Human
ggugcugcuuuucugccccaccugccggcugguuccagcagcgcuggggcccagcugggggg

SEQ ID NO: 152373 - RNA, 62 nt, Human
uauuuugaauaccauuaaaacugcuuuuuuuuuuccagcaaguauccaaccaacuugguucu

SEQ ID NO: 152374 - RNA, 62 nt, Human
aucaggccaggcucaguggcucaugccuauaauuccagcacuuugggaggccaaggcagaag

SEQ ID NO: 152375 - RNA, 62 nt, Human
aacacuuacaauuuuggugcaaaagcaaacaguuccagcaggcucucuaaagaaaaacucau

SEQ ID NO: 152376 - RNA, 60 nt, Human
ccaagcucgacgccaaguagccgccgcacuuuccagcagggaucggaggacgacccgagu

SEQ ID NO: 152377 - RNA, 62 nt, Human
ugucuaguuacuugcugaaaagugaauauauuuuccagcaugucuugacaaccuguacucuu

SEQ ID NO: 152378 - RNA, 62 nt, Human
guaguccagaugccugggaaggaacaucucccuuccagcaucugcugguagcaggcugggac

SEQ ID NO: 152379 - RNA, 62 nt, Human
cuguuagugacugguuuccuguuagauaaggguuccagcagccuggggcaguaugucucagc

SEQ ID NO: 152380 - RNA, 62 nt, Human
ggaaguaaagacuuuggagcuagagaagccuuuuccagcaaugauuauugacuucaccacac

SEQ ID NO: 152381 - RNA, 62 nt, Human
uuucuuuuuuuuuuuuuuugccaaagguuuacuuccagcaucugagcucuggcucucacccc

SEQ ID NO: 152382 - RNA, 62 nt, Human
aucuugacucacugcaaccucugccucucggguuccagcaauucuccugccucagccucccg

SEQ ID NO: 152383 - RNA, 62 nt, Human
uggggugaguggcuuucaaagccuuuuagcuuuuccagcaccucagccccuucacacauuua

SEQ ID NO: 152384 - RNA, 62 nt, Human
acuuccuacaggggccaaaaccagagaaaggcuuccagcaacuucgaugaaaguaguuuggc

SEQ ID NO: 152385 - RNA, 62 nt, Human
ggcccagugcgugaggucagucaacagccaaauuccagcagcaaaauacauuuucaucaaua

SEQ ID NO: 152386 - RNA, 62 nt, Human
aagucaccacggaagguuguuuaagaugcagauuccagcauccccuccucagagaucaauuu

SEQ ID NO: 152387 - RNA, 62 nt, Human
uaauuucuuaggacagcugucuuugguuugcuuuccagcaggcguaguauauuuagucggag

SEQ ID NO: 152388 - RNA, 62 nt, Human
acagauaaggaagggauuggcaucggcuggccuuccagcaccuucucucuccaacacuucau

SEQ ID NO: 152389 - RNA, 62 nt, Human
uggacucugggcuccugcugccugggccccgauuccagcauggggcaugcuacuuaauaucu

SEQ ID NO: 152390 - RNA, 62 nt, Human
cauggcauacuuuucauguuuuaauuuuuuucuuccagcaaaauaaacacugaggcccuaaa

SEQ ID NO: 152391 - RNA, 62 nt, Human
aaucaucuaccugcuacuacuguaaaccaugguuccagcagccuguuccacacccccacacc

SEQ ID NO: 152392 - RNA, 62 nt, Human
gagggaacaacacgguuuagaaagaauccccauuccagcaguagauuuaacugaucucugag

SEQ ID NO: 152393 - RNA, 62 nt, Human
ugauaacuauuuaugaauauuugaccaaauuauuccagcaucagaauaauaagcaaaauaac

SEQ ID NO: 152394 - RNA, 62 nt, Human
auuuggagaaguugcggcagagaagccaugcguuccagcauuccacgguccagcuagugccg

SEQ ID NO: 152395 - RNA, 62 nt, Human
gagacuguggagacugcuccugagcccccagcuuccagcaggagggacagucucaccauuuc

SEQ ID NO: 152396 - RNA, 62 nt, Human
ccguacugugggcuggaaaucccaaaucuagauuccagcagaguugguucuuucugaggucu

SEQ ID NO: 152397 - RNA, 62 nt, Human
cccccgcacgugugcaugacucgcagagaauauuccagcaauuguguaccccugggccaguc

SEQ ID NO: 152398 - RNA, 62 nt, Human
aagccacacuuucccuucauccugcuuaauccuuccagcaugucucugcacuaauaaacagc

SEQ ID NO: 152399 - RNA, 62 nt, Human
ugcccacuccagcuccaucccuuauuuauuccuuccagcagggcccucuucccuagguucgg

SEQ ID NO: 152400 - RNA, 62 nt, Human
gauuuccuuuuucauuuuaagugguguggagauuccagcacucccaggacaguggagucagc

SEQ ID NO: 152401 - RNA, 62 nt, Human
cgcuucccagcaccaacauguaaccggcauguuuccagcagaagacaaaaagacaaacauga

SEQ ID NO: 152402 - RNA, 62 nt, Human
gggcccuagagcagaugugcgucccccuccucuuccagcaggucuauaaagggaagggguag

SEQ ID NO: 152403 - RNA, 62 nt, Human
aggagaugcagagccgccaggaaaauucugaguuccagcacaauuuucuuuggaaucuaaca

SEQ ID NO: 152404 - RNA, 50 nt, Human
gcugcagagacaagagauaauuccagcagaauccgucuaagaagaccuuu

SEQ ID NO: 152405 - RNA, 62 nt, Human
gaggguggaugauaccauuuccugaccccguuuuccagcauguguucuguuagauuuuuauc

SEQ ID NO: 152406 - RNA, 62 nt, Human
uuaaggcugagugugguggcucaugccuguaauuccagcacuuugggaggccgaggcaggaa

SEQ ID NO: 152407 - RNA, 62 nt, Human
ccucccugcuuaggccacucgagcaucagagcuuccagcaggaggaagggcuguaggaaugg

SEQ ID NO: 152408 - RNA, 62 nt, Human
gcggggccauccaaagcaacgcugaaggccuuuuccagcagcugggagcucccggauugcgu

SEQ ID NO: 152409 - RNA, 62 nt, Human
gcauuauguucuuaacuccuuaauguggaauuuuccagcaaaauguuuaacucaggugugau

SEQ ID NO: 152410 - RNA, 62 nt, Human
agagaaggcagggagaguagggagagaaaaccuuccagcagcccaguaaacugcgggcgaag

SEQ ID NO: 152411 - RNA, 62 nt, Human
ggggcuauuuuuaaugagagaaaaucuguucuuuccagcaugaaauacauuuagucuccuca

SEQ ID NO: 152412 - RNA, 62 nt, Human
agguguuuggugucugccuuuuuuguucuuuuuuccagcacaacauaacuuaccacugauac

SEQ ID NO: 152413 - RNA, 62 nt, Human
uuuuuaacaaauguuaucaugauuaagaaaauuuccagcacuuuaauggccaauuaacugag

SEQ ID NO: 152414 - RNA, 62 nt, Human
cuccuccaggaucuccagaaagccgccuguccuuccagcaugacccugagaccucuguguug

SEQ ID NO: 152415 - RNA, 62 nt, Human
aguuccugaagaaaaggggcagacuccucacauuccagcacuuucccaccugacuccucucc

SEQ ID NO: 152416 - RNA, 62 nt, Human
augcacaugggccgcaaaacacacagucaggcuuccagcacauucucccccauuuggaggau

SEQ ID NO: 152417 - RNA, 62 nt, Human
agauauacagaugacuuuuuaaggguccuucuuuccagcacauuuuuuuuaaaaacucaggu

SEQ ID NO: 152418 - RNA, 62 nt, Human
uauuuuuaacauguucauaauuaaaaaguauuuuccagcaguccaaagauguaaguuaucuu

SEQ ID NO: 152419 - RNA, 62 nt, Human
aaagacaagugcucaagcagcaaaauccuuacuuccagcaaaauccaaacugcugucucuua

SEQ ID NO: 152420 - RNA, 62 nt, Human
auuuuggaguguuuuccauuuuacaguuuauauuccagcacucaaaacucagggucaaguuu

SEQ ID NO: 152421 - RNA, 62 nt, Human
gugcagauuuccuguucuuuaccuggcucugcuuccagcaguauugacaccuaguccuugcu

SEQ ID NO: 152422 - RNA, 62 nt, Human
cugucgggccccccgacgccgccccauuucccuuccagcaaacucaacucggcaauccaagc

SEQ ID NO: 152423 - RNA, 62 nt, Human
ucaucccaacuugcucacuugaagaagugugauuccagcaccguuucuacaucugccaucuu

SEQ ID NO: 152424 - RNA, 62 nt, Human
uaagaacauccaggaccccuucuccuugauguuuccagcaagcuucuuuccuccuuauccuu

SEQ ID NO: 152425 - RNA, 62 nt, Human
ucugcaugaaccaugauuucuccugugagccauuccagcauaagcugugaauauguauuaac

SEQ ID NO: 152426 - RNA, 62 nt, Human
aggcacuucugucaauuuuuucaggaccuuaguuccagcagcagaauggaaaaauccuugaa

SEQ ID NO: 152427 - RNA, 58 nt, Human
cugcccaagcagucuacugaauccagccuuccagcaagagauuguuuuucaaggacaa

SEQ ID NO: 152428 - RNA, 62 nt, Human
uccacuuuaggccaauuuuucucucuuagaucuuccagcagccccagggguaggaagcuccu

SEQ ID NO: 152429 - RNA, 62 nt, Human
gggcacgugcccuucaccccauuccacccuuguuccagcaagacugggauggguacaacuga

SEQ ID NO: 152430 - RNA, 62 nt, Human
uaucugugcauggauauauuguccugccuguguuccagcaugcuuauuucaaacguccagug

SEQ ID NO: 152431 - RNA, 62 nt, Human
uauauuauacgguaaauauaguaucgucugcauuccagcaaaaauaucaacucguaaggcac

SEQ ID NO: 152432 - RNA, 62 nt, Human
uugucauuuaaaagaguauucucuggcuguauuuccagcaguuaugaacuugaguuuguaaa

SEQ ID NO: 152433 - RNA, 62 nt, Human
caggucccagucacagacgucgcuuccugggauuccagcacgaugccuccauaguugaaaga

SEQ ID NO: 152434 - RNA, 62 nt, Human
aaacagauugagucaagugacuaugacagcucuuccagcaaaggcaaaaagagugaggaggg

SEQ ID NO: 152435 - RNA, 62 nt, Human
aacaacuacaaaaagaaaaugucaacaaauuuuuccagcaagcugagaaccugggaauuccu

SEQ ID NO: 152436 - RNA, 62 nt, Human
gugaaauaacuaccuuccacucuggaaccuuauuccagcaguuguuccagggagcuucuacc

SEQ ID NO: 152437 - RNA, 62 nt, Human
gccaaauuccauacaaaaagaauuuggauguuuuccagcauuuauuaccuuacuuugcuaua

SEQ ID NO: 152438 - RNA, 62 nt, Human
cuuuuuuugggccagcccuuuuuugacauugcuuccagcaguggaaaaugggcauuugaugg

SEQ ID NO: 152439 - RNA, 62 nt, Human
aucuuuucuccucucccguuguaccgcauucuuuccagcauugugcuuuuucccugggcuua

SEQ ID NO: 152440 - RNA, 62 nt, Human
uuuagccuguagauuuauuuccauuuuccaaauuccagcacacagagaucccagccccuaug

SEQ ID NO: 152441 - RNA, 62 nt, Human
uucccaggcaguuccuacaccuacgguguguguuccagcagggaggaguuaugggcugggcu

SEQ ID NO: 152442 - RNA, 62 nt, Human
auaaauaauauguagaaauuuaaguccuccaauuccagcauauccagugaguuuugacagug

SEQ ID NO: 152443 - RNA, 62 nt, Human
ccuuccuuucuaucauuccccugcccaccuccuuccagcacugacuggaagggaaguucagg

SEQ ID NO: 152444 - RNA, 62 nt, Human
aucucggcucacugcaacuuccaccuccuggguuccagcaguucuccugccucagccuccca

SEQ ID NO: 152445 - RNA, 62 nt, Human
gaggccagguauggggugucucaugccuauaauuccagcacuuugggaggccaaggcaggca

SEQ ID NO: 152446 - RNA, 62 nt, Human
caucuucagcuugagaaaaugagguugucaguuuccagcaaggcugacauccaccagacuga

SEQ ID NO: 152447 - RNA, 62 nt, Human
cagccaccgucuccagagcccugggcagcauuuuccagcaagauguacacaaucuuuugccu

SEQ ID NO: 152448 - RNA, 62 nt, Human
guaggaguuccaacauuuauguccagagcaacuuccagcaaggcuggucugggucucugccc

SEQ ID NO: 152449 - RNA, 62 nt, Human
ucuuggccaggcaugguggcucaugccuguaauuccagcacuuugggaggccaaggcgggug

SEQ ID NO: 152450 - RNA, 62 nt, Human
ugagaacauuuauuugaaccucuuagccacauuuccagcagggcaaaccaacugaugcccug

SEQ ID NO: 152451 - RNA, 62 nt, Human
gaaauccaauuuagauuauuuuuagaguauuuuuccagcaaauucaauuuauucugaaauuu

SEQ ID NO: 152452 - RNA, 62 nt, Human
uagggacauaaguucauucaugccaaguaucuuuccagcauguuucucccauuuagaauauc

SEQ ID NO: 152453 - RNA, 62 nt, Human
caaaacuaccugacaguauuugacaguguccuuuccagcaccauuauuugggucuuucaggg

SEQ ID NO: 152454 - RNA, 62 nt, Human
cuugugagagaaauaagucauuuuaauugcauuuccagcaaggaaugacauucaguucugua

SEQ ID NO: 152455 - RNA, 62 nt, Human
uguguccugcagggaguggccaacucuccaccuuccagcaccauuaucagagggugggaaaa

SEQ ID NO: 152456 - RNA, 62 nt, Human
uaucauucugcuuccguauuuuaauuuacugauuccagcaagaccaaaucauuguaucaaau

SEQ ID NO: 152457 - RNA, 62 nt, Human
ucgucacaucaaugcaaaagguccugauuuuguuccagcaaaacacagugcaauguucucag

SEQ ID NO: 152458 - RNA, 62 nt, Human
agcuuugcauagcaacggcacacguggcacgauuccagcagaguuuaucucacaccguuuau

SEQ ID NO: 152459 - RNA, 62 nt, Human
uugggccugaggaggggucucuccaggcauuguuccagcacggaggugaugugucacgggcc

SEQ ID NO: 152460 - RNA, 62 nt, Human
ucacugcugaagaugccccugcucccucuggguuccagcagaggugauucuuacauaugauc

SEQ ID NO: 152461 - RNA, 62 nt, Human
ugaacacaaaguugcuagaugcucuuguugacuuccagcagaugggaugggggaaacacagc

SEQ ID NO: 152462 - RNA, 62 nt, Human
aucucgguucacugcaaccucugccuuccagguuccagcaauucuccuaccucagcucccaa

SEQ ID NO: 152463 - RNA, 62 nt, Human
cuguuucacaguugauuauacuucaugcuguuuuccagcaugguauuauuaagggauuuaaa

SEQ ID NO: 152464 - RNA, 62 nt, Human
uucccacccucagugggcaccacacaccccacuuccagcagaguccugccuccucccaaucc

SEQ ID NO: 152465 - RNA, 62 nt, Human
ugccuuacuuuuuaauauguauuuauaaaguauuccagcaaaagaggauguagccucuggga

SEQ ID NO: 152466 - RNA, 62 nt, Human
ugaagguagugagugccccaucacuggagguauuccagcagagucuaggcagucgucugcca

SEQ ID NO: 152467 - RNA, 62 nt, Human
auuggguucauuuaugcccuauacaaagggcauuccagcagcugaaacucuucaauguuuga

SEQ ID NO: 152468 - RNA, 62 nt, Human
gcaggucgaauucaugaccugaagcugaauacuuccagcauauuuauucaggguguaggugg

SEQ ID NO: 152469 - RNA, 62 nt, Human
ucugucugcuccuacuccucacaucuggaggauuccagcaggagggguuuuggaggggaccu

SEQ ID NO: 152470 - RNA, 62 nt, Human
aacuuaauugcauaugguauauaaagaaccaguuccagcagggagauuucuuuaaguggacu

SEQ ID NO: 152471 - RNA, 62 nt, Human
cucgcuucuucccaauuuaguaacuuagaugcuuccagcacauacguagguagcuaccccag

SEQ ID NO: 152472 - RNA, 62 nt, Human
cugucaucagauccagaagaaauauccugguuuuccagcauguuuacccacauguuuuggcc

SEQ ID NO: 152473 - RNA, 62 nt, Human
aagcuugaagugccccgaggagcagguagaauuuccagcagggccuugguggauuaaccaag

SEQ ID NO: 152474 - RNA, 62 nt, Human
auccucagacgguggcuggugccuuuggcuacuuccagcaggauaccaaggguuugguggac

SEQ ID NO: 152475 - RNA, 62 nt, Human
ggggguuggccauuuaugcugacaugccauccuuccagcaaacguacgggaaugugcuuuca

SEQ ID NO: 152476 - RNA, 62 nt, Human
gcagaauaaggcaaaagggaaaguguucuagguuccagcacaccugcaaagauaaagugugc

SEQ ID NO: 152477 - RNA, 62 nt, Human
acgggggacguuuagagggcacgugggaaauuuuccagcaaucaaugccuugagaaacuuaa

SEQ ID NO: 152478 - RNA, 62 nt, Human
ugggccuggccgaggggcggaggcacagcugcuuccagcagccagcauucaguggccuuguc

SEQ ID NO: 152479 - RNA, 62 nt, Human
uaaauuuuacuacguguaacaaaagucugcuuuuccagcaugagcacacuggagcccucugc

SEQ ID NO: 152480 - RNA, 62 nt, Human
ucuuggccaaagaccaaauuccuuggcaugccuuccagcacccugcaaaaugagacccucgu

SEQ ID NO: 152481 - RNA, 62 nt, Human
agugggccgggcgugauggcucacaccuguaauuccagcacuuugggaggucgagguaggca

SEQ ID NO: 152482 - RNA, 62 nt, Human
cugcagcauggaucagcaaggcucuuucguucuuccagcaaaggcuuccaagguacaacuca

SEQ ID NO: 152483 - RNA, 62 nt, Human
uuaucuauacauaucuuuauuaaucacuauuguuccagcaguuuucaagucaaauuaauaau

SEQ ID NO: 152484 - RNA, 62 nt, Human
aguguggacuaacccgccgccaccacccucuguuccagcaggcucugcaugaaucuuugugc

SEQ ID NO: 152485 - RNA, 62 nt, Human
ccaaccuccaccagcccugcuacauaccccuguuccagcauuaacuaccaggcaccaaaaca

SEQ ID NO: 152486 - RNA, 52 nt, Human
ucuuugcugucaggcagugaauuuccagcaccaggggagaaggggcgucuuc

SEQ ID NO: 152487 - RNA, 62 nt, Human
aaugcucuuuucucacuaauaggaacuuguaauuccagcaguaauuuaaaggcuuucagaga

SEQ ID NO: 152488 - RNA, 62 nt, Human
gucuggccaggcguggugguucaggccuguaauuccagcacuuugggaggccgaggagggag

SEQ ID NO: 152489 - RNA, 62 nt, Human
gcaggacugagcuguccggguucuccccacacuuccagcacagcugugcucuguguccugcc

SEQ ID NO: 152490 - RNA, 62 nt, Human
gggaagguggccaggcucgaagcagucucuguuuccagcacugcacccucaggaagucgccc

SEQ ID NO: 152491 - RNA, 62 nt, Human
guacguacgcagccuccagggcaccauacuguuuccagcagccaacccuuuucucccaucac

SEQ ID NO: 152492 - RNA, 62 nt, Human
guaagguggggugaggcggaucccgcgcgcaguuccagcagguguguccccagcgcccgcug

SEQ ID NO: 152493 - RNA, 62 nt, Human
agccccucgacucgucccguggccgccuguuuuuccagcaaaccacgcuaacuagcugacca

SEQ ID NO: 152494 - RNA, 62 nt, Human
aucucggcucacugcaaccucugccucccagguuccagcaauucuccugccucagccucccu

SEQ ID NO: 152495 - RNA, 62 nt, Human
uccugugcgaccugagcggggguggcugccauuuccagcaugcaggugacuuccaaagaaug

SEQ ID NO: 152496 - RNA, 62 nt, Human
caucacccucacccacucugguggccacuucauuccagcagcugcaccccagcgucaggccu

SEQ ID NO: 152497 - RNA, 62 nt, Human
auucggccgggcaugguggcucacaccuguaauuccagcacuuugggaggccaaggcaggcg

SEQ ID NO: 152498 - RNA, 62 nt, Human
aacugcuggaacucgaggugaggaucagccuuuuccagcauccugugagagaccagagagag

SEQ ID NO: 152499 - RNA, 62 nt, Human
acuauuauguagugcauuuuaacuuaaauuuuuuccagcaacauguuacuuauuuaagauac

SEQ ID NO: 152500 - RNA, 62 nt, Human
ugccuuuuccaccuuaucguuccaucacuuuauuccagcacuucucuguguuuuacagaccu

SEQ ID NO: 152501 - RNA, 62 nt, Human
agacgucggccauuuaguaauuuaaagcgaauuuccagcagcaagcaugcuuugauaucugg

SEQ ID NO: 152502 - RNA, 62 nt, Human
cccuagaagugggguggggcggcuccagggcuuuccagcauacccugccccuggaugggaaa

SEQ ID NO: 152503 - RNA, 62 nt, Human
aggcacagaaaacuccugcugauggucucagcuuccagcagcacaaaagcagaugauguacu

SEQ ID NO: 152504 - RNA, 62 nt, Human
gacaaauuagcaugcaagcuuggucaaacuuuuuccagcaaaauggaagcaaagacaaaaga

SEQ ID NO: 152505 - RNA, 62 nt, Human
cccggguuccuuccuagaaauguggcagcccauuccagcacacaggcuucugcagcaaucuc

SEQ ID NO: 152506 - RNA, 62 nt, Human
ugccuccugcccccgaugcccaaagcagcaucuuccagcacuuuccaucgaggacuugggug

SEQ ID NO: 152507 - RNA, 62 nt, Human
augcugcacaauaugagcaugcaaaaagcuuuuuccagcagaacauguucccucgucuccag

SEQ ID NO: 152508 - RNA, 62 nt, Human
auuuuggcucccugcaaccuccgccuccuggauuccagcaauucuccugccucggcuuccca

SEQ ID NO: 152509 - RNA, 62 nt, Human
cagagggaggcacaguccacccagauccaccuuuccagcaagacccccaguggcugcccagc

SEQ ID NO: 152510 - RNA, 62 nt, Human
uucucugcaaacaaguugccaucugguuugccuuccagcacuaaaguaauggaacuuugaug

SEQ ID NO: 152511 - RNA, 62 nt, Human
ggcgcagcaucucugaagcuuggaaagcugucuuccagcagccuccguggccucggguuccu

SEQ ID NO: 152512 - RNA, 62 nt, Human
aagaaaaucauaggccaagauagggaggggcauuccagcaaaccccguguuaaugcuacugu

SEQ ID NO: 152513 - RNA, 62 nt, Human
accagcaccugccucugagaccucgcucucuguuccagcaacccugguuggggggucagacu

SEQ ID NO: 152514 - RNA, 62 nt, Human
gaagaaauaaaauacucaacuuggucccuaucuuccagcagguuagaggccuuuagggaaga

SEQ ID NO: 152515 - RNA, 62 nt, Human
aggugccugguuugcagcaggcucuccgcucuuuccagcaaagcugcucagagagggugucc

SEQ ID NO: 152516 - RNA, 62 nt, Human
uucauauaucauuccuuaaauuccagucauuguuccagcauaaugagauggaaucugccagu

SEQ ID NO: 152517 - RNA, 62 nt, Human
uuuggauggaagauaagauagggaagauuaaguuccagcauuucugacuuguuauuuugagu

SEQ ID NO: 152518 - RNA, 62 nt, Human
gcaaucaaugauagguuuauaaucuuagauuauuccagcaaaguguggauugcauuguuagg

SEQ ID NO: 152519 - RNA, 62 nt, Human
gcaucuugaaucccaucuauaagaacacaaucuuccagcauacguuugcuuuuucagaaacu

SEQ ID NO: 152520 - RNA, 62 nt, Human
acagguuccaucauggagaauggagugagcucuuccagcacagcugacaagucccagaagca

SEQ ID NO: 152521 - RNA, 62 nt, Human
ugcaaagcugaagaccauggauuucauggugauuccagcaaguacagagauucuaugaagcc

SEQ ID NO: 152522 - RNA, 62 nt, Human
aauacuaaauucauccucacuuuauguugaucuuccagcaacguuuauauauuuaguaauuu

SEQ ID NO: 152523 - RNA, 62 nt, Human
gagauucagggaaugagaccaccucucauuucuuccagcaugaucgcgcccugcucccgugc

SEQ ID NO: 152524 - RNA, 62 nt, Human
gguguaucaagggcgcccuuaaagcuggaacauuccagcaagcuucuugcgcuucucugcac

SEQ ID NO: 152525 - RNA, 62 nt, Human
uacagucuucucuaguuucugaggugaauugauuccagcacccucaggaauaccuauauuca

SEQ ID NO: 152526 - RNA, 62 nt, Human
ccuacacauccuucaaaacccaccugguacuguuccagcaucuucccuggauggcuggagga

SEQ ID NO: 152527 - RNA, 62 nt, Human
agucugggagaaacagagccagacauagacaguuccagcaucacagaaccagaagaagagac

SEQ ID NO: 152528 - RNA, 62 nt, Human
augguuuauucuuucuaacuccauauaagcuuuuccagcaaagauuguaauaacacauuuau

SEQ ID NO: 152529 - RNA, 62 nt, Human
ccaggggccggggccggaacaugugccucccguuccagcaucuggcugcccgggggaggaag

SEQ ID NO: 152530 - RNA, 62 nt, Human
uuuuuuguguugagaaaauuaaaaauucauuguuccagcaguuugaaaauaaauuguugucg

SEQ ID NO: 152531 - RNA, 62 nt, Human
gcucgacaaggggcgcaggguggcugucuuuguuccagcacuguucaggcugccugucaucc

SEQ ID NO: 152532 - RNA, 62 nt, Human
cuuuugaagaaugaaugaaaccuuccuaagccuuccagcaauuuccccccaacuccgauggg

SEQ ID NO: 152533 - RNA, 54 nt, Human
ugacauccaccgacuucugacuccuuccagcaggcagcuggccucuccaaggaa

SEQ ID NO: 152534 - RNA, 62 nt, Human
ugaaaugugugaacguuuugaaaagcuacagcuuccagcagccaaaagcaacuguuguuuug

SEQ ID NO: 152535 - RNA, 62 nt, Human
ugggacuuccuaaacuuuccaaaaccuuccucuuccagcaacugaaccucgccauaaggcac

SEQ ID NO: 152536 - RNA, 62 nt, Human
gucuuggcucacugcaaccuccaccucccagguuccagcaauucuccugccucagccucccc

SEQ ID NO: 152537 - RNA, 62 nt, Human
uuagggcagggcacgguggcucacgccuguaauuccagcacuuugggaggccgaggcgggca

SEQ ID NO: 152538 - RNA, 62 nt, Human
cugccugccagcucugaagagagcagcaguucuuccagcacagcgcuugagcucugcuaagg

SEQ ID NO: 152539 - RNA, 62 nt, Human
gagaugcacauuccuagugaaauugcacaggcuuccagcaugcuggagggaacagaaaaggc

SEQ ID NO: 152540 - RNA, 62 nt, Human
aaucacuugaugggugguaccaccuagaauucuuccagcagccuguaaugggagggcuacag

SEQ ID NO: 152541 - RNA, 62 nt, Human
acaguuuuccccugacauaugcaggggauuaauuccagcagucccugaucauaccuaaaucc

SEQ ID NO: 152542 - RNA, 62 nt, Human
acagucaucccuugauaccugcuggguauugguuccagcacuccgugagccauguccagucc

SEQ ID NO: 152543 - RNA, 62 nt, Human
gccugguuggcguccacaagcaauaccucucguuccagcaggaccaagggagccagccucca

SEQ ID NO: 152544 - RNA, 62 nt, Human
aaaucaaaaucugagucugagacauacacacuuuccagcaagauggguccugacucaaaacc

SEQ ID NO: 152545 - RNA, 62 nt, Human
acgugucucucuccaagucugugacgcugacuuuccagcacgugaaggugggucacagguau

SEQ ID NO: 152546 - RNA, 62 nt, Human
gaaaccauucuuuauacuugcauguaaacaucuuccagcaacaaucauuuauuguuaaaccu

SEQ ID NO: 152547 - RNA, 62 nt, Human
auugggccaggugugguuucucacaccuguaauuccagcacgguuggaggccaaggcacaua

SEQ ID NO: 152548 - RNA, 62 nt, Human
auugcacugggggccauggcucaugccuguaauuccagcacuuugagaggcaaagacaggua

SEQ ID NO: 152549 - RNA, 62 nt, Human
ucucacccccaacgaugccaaucacgacaacuuuccagcacacucccccgacccucgcggac

SEQ ID NO: 152550 - RNA, 62 nt, Human
ccugagaguugguuuggaccaauucccugguuuuccagcagaugaaacaggcccaaagaggu

SEQ ID NO: 152551 - RNA, 62 nt, Human
caagcuuucuuugacgguuucucccauccguguuccagcaucuaaccuuuuacuuuugcaua

SEQ ID NO: 152552 - RNA, 62 nt, Human
agauggauuugacacacucaccauuuaaucauuuccagcaaaauauauguuuggcugaaauu

SEQ ID NO: 152553 - RNA, 62 nt, Human
ccaugccugcuccugccucucucccaacauguuuccagcaaguagaugccccuguguguguu

SEQ ID NO: 152554 - RNA, 62 nt, Human
ucucauuugauuuugcuugugcagaaaauaguuuccagcacauggauugaucugagagagaa

SEQ ID NO: 152555 - RNA, 62 nt, Human
aaacggaagaauagccagcggagcauggacuguuccagcacgggccagauggccagcugucg

SEQ ID NO: 152556 - RNA, 62 nt, Human
uccagagcucggaaucuacagcguccagccauuuccagcaagagcgcuucccauuccggaga

SEQ ID NO: 152557 - RNA, 62 nt, Human
cacucagcacgcucacuaacccagcaugccacuuccagcaggcaugcaguccuggcccagcu

SEQ ID NO: 152558 - RNA, 62 nt, Human
uggguucuugcaagagcgcguggggacaguucuuccagcaggcacugguuuuguugccccag

SEQ ID NO: 152559 - RNA, 62 nt, Human
ggccuuccgggucucgcagccugaagccuggauuccagcagugaaugcuagacagaaaccaa

SEQ ID NO: 152560 - RNA, 62 nt, Human
aauuagauguuuauaaagaaauggguuuauuuuuccagcauaaaccucagaauuuaaggaaa

SEQ ID NO: 152561 - RNA, 62 nt, Human
acaauggcuucaacgagaagcagguuuauuuuuuccagcacauaaaagaaaaauaauguuuc

SEQ ID NO: 152562 - RNA, 60 nt, Human
gagguguccccccacucugauucuugcccuuuccagcagcugcagcugccguuucucucu

SEQ ID NO: 152563 - RNA, 62 nt, Human
cauuacuaagggggucaggcacugcaugcucguuccagcaccaucugggacuggguacagua

SEQ ID NO: 152564 - RNA, 62 nt, Human
uaccuauuucugacaugcagcacugccaucucuuccagcaccaucaggguuuuaauggcccu

SEQ ID NO: 152565 - RNA, 62 nt, Human
auguggcagaaaucagcuggggcuuguuuagcuuccagcacacucucagucauagcaugugu

SEQ ID NO: 152566 - RNA, 62 nt, Human
cccucccaucuugaggucguucuccacauuccuuccagcacaccuguccuuuccauagcccu

SEQ ID NO: 152567 - RNA, 62 nt, Human
aaggagggagggaggggcagaguggagugucauuccagcauuccucucagaagggagagagg

SEQ ID NO: 152568 - RNA, 62 nt, Human
cgucgcccucccaggccacuaggcucugacucuuccagcacccauggaugugccagaggccu

SEQ ID NO: 152569 - RNA, 62 nt, Human
ggcacagaauucucauucuguuauccaguucauuccagcaaucauaguuaauacaguacuug

SEQ ID NO: 152570 - RNA, 62 nt, Human
uggggacucuaacaugugagcucauuaaauucuuccagcauucuaaaggaggguuugugauu

SEQ ID NO: 152571 - RNA, 62 nt, Human
gaggcgugaguguaagaacugggagauuccuuuuccagcaggccuggguagcugccuuccca

SEQ ID NO: 152572 - RNA, 62 nt, Human
uuuacugcuguaacuccaguuccuagaacaauuuccagcacauagcaaguguucaguaaaua

SEQ ID NO: 152573 - RNA, 62 nt, Human
cugcacaggcaaugaaaaaccaugugggugauuuccagcagaccugugguauuggccaggag

SEQ ID NO: 152574 - RNA, 62 nt, Human
ggcugcugcccuucaacaacaagcccugauuuuuccagcaaugccagaaaccuggauuuuaa

SEQ ID NO: 152575 - RNA, 62 nt, Human
gcuguugugugaucaaacaugucucuguguaguuccagcaaaucaagcugagcuuugaaaaa

SEQ ID NO: 152576 - RNA, 62 nt, Human
gaccauggacuggggguggggcaugguggggauuccagcaucugcgaacccaagcaaugggg

SEQ ID NO: 152577 - RNA, 62 nt, Human
gaugaugggagaugcagccuugaucaugugacuuccagcaugaucaccuacugccuucugag

SEQ ID NO: 152578 - RNA, 62 nt, Human
agcucagacccaccacaucgccccagaggcuuuuccagcacccaugauguuucggacugacc

SEQ ID NO: 152579 - RNA, 62 nt, Human
aaccgugaugcgguugucacuuaguucugugguuccagcagaucucagugggcugguugauu

SEQ ID NO: 152580 - RNA, 62 nt, Human
ucaaccuccucaucgccauguucaacuacaccuuccagcaggugcaggagcacacggaccag

SEQ ID NO: 152581 - RNA, 62 nt, Human
accugaaggagaacuaccuccagaaccgacaguuccagcaaaagcagcggcccgagcagaag

SEQ ID NO: 152582 - RNA, 62 nt, Human
cagucucuacguagagcuguuaucauaggcauuuccagcaaugugagcuaaccccucuuacu

SEQ ID NO: 152583 - RNA, 62 nt, Human
gacuccacgaccugccagcuguuuccaggaucuuccagcaugcugcuugucccugaauagcu

SEQ ID NO: 152584 - RNA, 62 nt, Human
guuugucagccuuucuccuguuuauggguuucuuccagcagaacagagacauugccaaccau

SEQ ID NO: 152585 - RNA, 62 nt, Human
guccccggcgggacugucaauggaggcagggguuccagcacaaaguuuacuucugggcaauu

SEQ ID NO: 152586 - RNA, 62 nt, Human
gauguuccgggcauacugcugugcucugugcuuuccagcaggcgcuccucccucacgcagga

SEQ ID NO: 152587 - RNA, 62 nt, Human
agcaggcccgaaagaggcacccuuccaucugauuccagcacaaccuucaagcugcuuuuugu

SEQ ID NO: 152588 - RNA, 62 nt, Human
cauuuuccuaggguuaacaccucaccaaguucuuccagcaaaaugcuuauuagaguuuuugu

SEQ ID NO: 152589 - RNA, 62 nt, Human
gggagacagaggacuggacccugggucucagguuccagcaagucaggcuagggaccuggggg

SEQ ID NO: 152590 - RNA, 62 nt, Human
gcgaccuguggacuaaaaucugccacgauugguuccagcaagugugagcagagaccccgugc

SEQ ID NO: 152591 - RNA, 62 nt, Human
gcugccaggacacggauuguccagggauuacauuccagcaucuuauuagguaucuggaucug

SEQ ID NO: 152592 - RNA, 62 nt, Human
cgaaauuucucauuaacagcccaugaacccaauuccagcaccguugccuccugacauaccaa

SEQ ID NO: 152593 - RNA, 62 nt, Human
ucuuucccuggugaugguccccugcccugucuuuccagcauccacucucccuuguccuccug

SEQ ID NO: 152594 - RNA, 62 nt, Human
cugcucccugaaccucuuaacuuaauaaaacguuccagcagcucugguguccuagauggcug

SEQ ID NO: 152595 - RNA, 62 nt, Human
uaaugaaaaauaaagcaucccaucucucggcguuccagcauccugucaauuucccuuuugcu

SEQ ID NO: 152596 - RNA, 62 nt, Human
ccugcagucuuacuagucagccacaguccagguuccagcaacacuagcuaccuaccaaacaa

SEQ ID NO: 152597 - RNA, 62 nt, Human
acuguuucguggcccuauuaauggucagacuguuccagcaugagguucuuagaaugacaggu

SEQ ID NO: 152598 - RNA, 62 nt, Human
ugaggcuuaaggcgcauguggcacaccacuccuuccagcaguagucgcuuuacuguuaccug

SEQ ID NO: 152599 - RNA, 62 nt, Human
acgccuguugcaaccccauccaggagacauauuuccagcagcuggcaccugcagcacggagc

SEQ ID NO: 152600 - RNA, 62 nt, Human
cccagcuggaggcagcugggugaggguccugguuccagcagagcacuggggcccauccaagu

SEQ ID NO: 152601 - RNA, 62 nt, Human
uauauuuguucccauuuuccuucaccgugacauuccagcauugucugacugugaggugggcc

SEQ ID NO: 152602 - RNA, 62 nt, Human
ucuuucccuggugaugguccccugcccugucuuuccagcauccacucugucuuguccuccug

SEQ ID NO: 152603 - RNA, 62 nt, Human
ucuuucccuggugauggucucucgcucugucuuuccagcauccacucucccuuguccuucug

SEQ ID NO: 152604 - RNA, 62 nt, Human
guccugaaggccugucucccacuaaccccgccuuccagcacuuucugucauuccaggcuggg

SEQ ID NO: 152605 - RNA, 62 nt, Human
uuggcccaugacuuuggaacauggcuggcagcuuccagcagaagucacgcuccccauccccc

SEQ ID NO: 152606 - RNA, 62 nt, Human
ggagcuguuaucacuaccaguuucuggcacaauuccagcacaauuaugacaauucagagaag

SEQ ID NO: 152607 - RNA, 62 nt, Human
gaaacuggaaugcuguuacuuugauaauuacuuuccagcagguguuuuccuucacaaugguu

SEQ ID NO: 152608 - RNA, 62 nt, Human
aggacuaugcccagucucgguuccaguucuacuuccagcagaaggggcagcugaccaguguc

SEQ ID NO: 152609 - RNA, 62 nt, Human
ccagcaguggguagggugcaaucugguguguguuccagcagugagacgguguuauugugaag

SEQ ID NO: 152610 - RNA, 62 nt, Human
ccuagcagugcgcgccccgccuguguuugcccuuccagcagugacccucccuucuagucuuu

SEQ ID NO: 152611 - RNA, 62 nt, Human
cuggcgcugacaccacagcagcugggccccucuuccagcagcggccguauccauccccaggg

SEQ ID NO: 152612 - RNA, 62 nt, Human
aaguugucuuuguagaaaaugaagagccuuucuuccagcaaaaaucccugcuguaugcaaua

SEQ ID NO: 152613 - RNA, 62 nt, Human
aucuagggcagacacacaaccuccuccuccucuuccagcaaggaacgcaccgaaaagucaca

SEQ ID NO: 152614 - RNA, 62 nt, Human
ucuaagcagugagaaucuuuucuaugccucuauuccagcaaaaaguagaaguaucaaauaaa

SEQ ID NO: 152615 - RNA, 62 nt, Human
ccugcacaggcauccuucccuuuauagauugauuccagcaaaggcggaauaaaacaaauuuc

SEQ ID NO: 152616 - RNA, 62 nt, Human
caccagucuaggcaugacuggcuucugaaaaauuccagcacaccuccucgaaccucauuguc

SEQ ID NO: 152617 - RNA, 62 nt, Human
gggcaaaaguccauucucauuugguccauuaguuccagcaauugaaauuuaugugaauuauu

SEQ ID NO: 152618 - RNA, 62 nt, Human
gacagaagaaaucugcuucccuaccauggcuauuccagcaccccaaccuguaauugccaagu

SEQ ID NO: 152619 - RNA, 62 nt, Human
ggaaagcccugacggacuucauucaagaggaauuccagcaucugaagacucaggcagagcag

SEQ ID NO: 152620 - RNA, 62 nt, Human
uuuuccuguugcaugacagauuuaacuauucuuuccagcaguggaggugcugucagagucca

SEQ ID NO: 152621 - RNA, 62 nt, Human
aacuuaugugaugacuugaucgaggcaggcuuuuccagcaucacuguccugguuccaucucu

SEQ ID NO: 152622 - RNA, 62 nt, Human
gcccaauacacacagcuccauuaugcaauccauuccagcaaauuccccgugucuguggucac

SEQ ID NO: 152623 - RNA, 62 nt, Human
accacacugggggcuuccuccaagccccgcucuuccagcacuuccaccggcagagucccaga

SEQ ID NO: 152624 - RNA, 62 nt, Human
uuugguugugcaaauguauuuacuaugcguguuuccagcaguuggcauuaaagugccuuuuu

SEQ ID NO: 152625 - RNA, 62 nt, Human
auccuggcucacugcaaccuccaccucccggguuccagcaaauucuccugccucagccuccc

SEQ ID NO: 152626 - RNA, 64 nt, Human
uaaaccuucccucuaaguguagagggaagacccuuacguggaguuuccuagugggcuucucaac

SEQ ID NO: 152627 - RNA, 64 nt, Human
ccuucucuccucccauccggcaacagucugaaaguacguggaggacgggaccggaagacgagag

SEQ ID NO: 152628 - RNA, 64 nt, Human
aaggauuucucuaacccuauccuaauuguccacauacguggaaacaauccuguuacucuguccc

SEQ ID NO: 152629 - RNA, 64 nt, Human
guaauaaucgaauucauuuaacaugaaucuugaguacguggaccauugcuugcauguuaacuuu

SEQ ID NO: 152630 - RNA, 64 nt, Human
ugggaaaaacaauggacauuaguuuuuaaaaaguuacguggaagcaagauuucuauauuuguuu

SEQ ID NO: 152631 - RNA, 62 nt, Human
uucacaaucauggcggaaggugaaaggcaugucuuacguggagggagacaagacagaaugag

SEQ ID NO: 152632 - RNA, 64 nt, Human
gcauucaguaaauguguguugaaggacugggacguacguggaggcugcuggaccuggucagaga

SEQ ID NO: 152633 - RNA, 62 nt, Human
uuaagguucauggauucuaaaaugaaccuaaauacguggagaauuucuugaauaguuuuguu

SEQ ID NO: 152634 - RNA, 64 nt, Human
aguucagucuguagggagugaagccacagacucuuacguggagagugcacugaccuguagguca

SEQ ID NO: 152635 - RNA, 64 nt, Human
ccacauguugauaauuguugaaacuagaugaugguacguggacauucauuauaccauucucccc

SEQ ID NO: 152636 - RNA, 64 nt, Human
guuaacuaugguuuuuuauuagucuauuaaaagauacguggagauauuaaauuauaccuaaagc

SEQ ID NO: 152637 - RNA, 64 nt, Human
guuaagggagcuacgcugugguuuauucuuaaguuacguggauaaacuaaccucuaacagaaau

SEQ ID NO: 152638 - RNA, 64 nt, Human
auccaucauguaacccucaugaaaauuaucuuuauacguggacuauaauaaaauauugaauuaa

SEQ ID NO: 152639 - RNA, 64 nt, Human
ugaaaucucuacacauuucauccuuuugcuugcuuacguggacuggggcauggccuaagacaag

SEQ ID NO: 152640 - RNA, 64 nt, Human
aguuaaguucauucagacauaauuauauaaaaacuacguggauguaccgucauuugaggacuug

SEQ ID NO: 152641 - RNA, 64 nt, Human
cacugaagaacuaaaaaugcaauuuagguaaucuuacguggagacaggucaaccaaagagggag

SEQ ID NO: 152642 - RNA, 64 nt, Human
cuuucugugagauuuuuccaacaagcaugugauuuacguggaauucugacagugcagggagccc

SEQ ID NO: 152643 - RNA, 64 nt, Human
gggggcgagcagccuaccagaugucgauuugcacuacguggagcuucuuauauagguacucuuu

SEQ ID NO: 152644 - RNA, 64 nt, Human
gaugccaccauucccacggggacugaagacacauuacguggaccuggucccaggcucagugagg

SEQ ID NO: 152645 - RNA, 64 nt, Human
aaguuuauuuuuuaucacaagcaccuuugaaauguacguggaaaacgucggcugcucgugagaa

SEQ ID NO: 152646 - RNA, 64 nt, Human
uggauacuccaugugacaugguuucucccuauguuacguggauguuuguaacguaagucaauga

SEQ ID NO: 152647 - RNA, 64 nt, Human
ucugagaacacggugugucucgacacguaccacguacguggaaacacaagagcccaccacuuga

SEQ ID NO: 152648 - RNA, 64 nt, Human
guuggcaagcucuugguucuacguggaugauuucuacguggauguucuccugaguccuuaauuc

SEQ ID NO: 152649 - RNA, 64 nt, Human
gucagguuuuucaguguuggcaagcucuugguucuacguggaugauuucuacguggauguucuc

SEQ ID NO: 152650 - RNA, 64 nt, Human
uccccucugugaucucauuucaucugcacugccauacguggagugagcaagacagggcuuacca

SEQ ID NO: 152651 - RNA, 64 nt, Human
ugugacauaugggaagacaacagauucagaaauuuacguggauaggacuuuagacaccacccag

SEQ ID NO: 152652 - RNA, 64 nt, Human
ccagcucugccaggcccauucccagcugcugcaguacguggagcgauacgggugagaugugacc

SEQ ID NO: 152653 - RNA, 64 nt, Human
cagcugaauagagggaguagaaagcuucugaguuuacguggagggguuuagccagccccuagau

SEQ ID NO: 152654 - RNA, 64 nt, Human
gaauuaacaaugagaaagagagaaguguaucuguuacguggauauaugggccagccuggauaua

SEQ ID NO: 152655 - RNA, 64 nt, Human
agcaguagcagcucuguuuacggagcauuaaccuuacguggaguuauuuccugcauuuccuccu

SEQ ID NO: 152656 - RNA, 64 nt, Human
guaaauaauuuuguaagaggcuucaaaauguuuauacguggaaacacaccuacaugaaaagcag

SEQ ID NO: 152657 - RNA, 64 nt, Human
cuguuucuagugccaguucuuaugcuaagcagguuacguggaauauaucacuuaacucaaaaag

SEQ ID NO: 152658 - RNA, 64 nt, Human
gccugagaaagcagcaagaggacaugaugaaaaauacguggaguugaugagaaaggggagccaa

SEQ ID NO: 152659 - RNA, 64 nt, Human
cauugauuuuuaaccucaaaaugguguugagauuuacguggaacccuaaagcaguaaaauaaaa

SEQ ID NO: 152660 - RNA, 64 nt, Human
gacacuccuggcuggacgccaggccagugccgccuacguggagacuguccacacagcugccuca

SEQ ID NO: 152661 - RNA, 64 nt, Human
gacagcgcgcuuucgccgugggcuggacaaugacuacguggagucaccaugcugagucgcccuu

SEQ ID NO: 152662 - RNA, 64 nt, Human
aacgugggguacugugugugcacauagacacacuuacguggaauuacaguuguggguuuaucca

SEQ ID NO: 152663 - RNA, 64 nt, Human
agcucucugccuccggucacucuugcuguggugcuacguggaagugaauggagacugaucucaa

SEQ ID NO: 152664 - RNA, 64 nt, Human
gugagaccacagaucuguggacacaccauuuguguacguggaauuuuguguuucaguguuugaa

SEQ ID NO: 152665 - RNA, 64 nt, Human
agacaaacuucccagacaagcuccuuugugccucuacguggagaggguguggaaaguuaucaca

SEQ ID NO: 152666 - RNA, 64 nt, Human
aagcagggcaagggagaucuggcauuuucugcuuuacguggagggagaacaggcacauuagccu

SEQ ID NO: 152667 - RNA, 64 nt, Human
cuacugccucacaucacugcagagugcccugagcuacguggagcugcugccccggggaggccug

SEQ ID NO: 152668 - RNA, 64 nt, Human
aguucaguucugaaaaguaagguugggaccuggguacguggaucccugaguagaucccagcauc

SEQ ID NO: 152669 - RNA, 64 nt, Human
ucaggugacccugaucacccucuggguguacguguacguggacccaaacaaugugcuggacgcc

SEQ ID NO: 152670 - RNA, 64 nt, Human
cuccuacgaggagaccaacgaaguggagauucgauacguggacuacggcggauauaagagggug

SEQ ID NO: 152671 - RNA, 64 nt, Human
ucaagggugacuuggggacuugguggagagggacuacguggaagaccuggggccagccugggac

SEQ ID NO: 152672 - RNA, 64 nt, Human
agcuugauucucagcacuugggggaucuguuguguacguggagagggaugaggugcugggaggg

SEQ ID NO: 152673 - RNA, 64 nt, Human
guuuccuugugcgaugauggccacuaaagcauaguacguggaugucagugagacagcaugagag

SEQ ID NO: 152674 - RNA, 64 nt, Human
uggaaacacacuaccccgucggacuucgaauuucuacguggaugugcaugaagcucuuguuuuc

SEQ ID NO: 152675 - RNA, 64 nt, Human
uggcuuacaaguccuuaauuuaucaaauauaugauacguggacauuuccucauagucugugguu

SEQ ID NO: 152676 - RNA, 64 nt, Human
cagaggcaagcacuggugagucuaggacagauuuuacguggagaguugaacuacuccagaaacu

SEQ ID NO: 152677 - RNA, 64 nt, Human
acauaggagcuggggauucuacaguaucugugaauacguggacuccuuuuuauaaggaguuuua

SEQ ID NO: 152678 - RNA, 64 nt, Human
ggggaggacagacguucacacugccacguaugucuacguggauuuuugguuuucagcuuccccc

SEQ ID NO: 152679 - RNA, 64 nt, Human
aacucgauccuagccugugucagcuggauguguuuacguggagaggcguggccacuuuuuaggu

SEQ ID NO: 152680 - RNA, 64 nt, Human
gccccccgguaagugacaaccccucuugacucaguacguggacaccauccuccggccuccuucc

SEQ ID NO: 152681 - RNA, 64 nt, Human
uguagcauuguucuugauuaguuuggcacuccauuacguggaggcagcacagugcagacagacc

SEQ ID NO: 152682 - RNA, 64 nt, Human
ccccaggcaccucacaggccccaggaaaggcccagccaccgaagccgccuguggacagccugag

SEQ ID NO: 152683 - RNA, 64 nt, Human
ucagccucccaaaaugcugggauuacaggcgugagccaccgagccuggccgguuaacaucuuuu

SEQ ID NO: 152684 - RNA, 64 nt, Human
agaccugugggugugagccuggccguccuccggggccaccgaccgcagccagccccuccccagg

SEQ ID NO: 152685 - RNA, 64 nt, Human
cggcaggagucccacuccuccuggggugcugccugccaccgagagcucccccaccuguaccacc

SEQ ID NO: 152686 - RNA, 64 nt, Human
agcaguauagccacccggccuggccgccaccaccgccaccgagagccccgccuccagcagccgg

SEQ ID NO: 152687 - RNA, 64 nt, Human
gggcccuaggguacagggugcugcccagcaggucgccaccgagugucuucucauuuuauuucag

SEQ ID NO: 152688 - RNA, 64 nt, Human
gaaugacuaaaacaucuuaaguaaaugaggaauagccaccgagaugcucagagauaauauaagc

SEQ ID NO: 152689 - RNA, 64 nt, Human
gaagcaccucuccgagccaugugagcccccugaugccaccgagcaggggcagcuucaugaccga

SEQ ID NO: 152690 - RNA, 64 nt, Human
caagauggcuaaggagaacaggggggaugauggggccaccgagaggccgaagaaggccaaggag

SEQ ID NO: 152691 - RNA, 64 nt, Human
ucauuuucauuaaaaaugaaagccaaauuuauaugccaccgauugcaggacacaagcacaguuu

SEQ ID NO: 152692 - RNA, 64 nt, Human
ccgggcuccgcgugccccgcccgcuggagcaccugccaccgaggcgcgcguggggccacugccg

SEQ ID NO: 152693 - RNA, 64 nt, Human
aucucgcuucaggaagaaaaguaccucauccucggccaccgaaaccacgugagugagaugagcc

SEQ ID NO: 152694 - RNA, 64 nt, Human
gugaguacucauaaaggacacuggaucaaguucagccaccgaauugcuuuuaucaguguuaaag

SEQ ID NO: 152695 - RNA, 64 nt, Human
uugaccucccaaagugcugggauuacagacaugagccaccgagccuggccaauuuuuguguuuu

SEQ ID NO: 152696 - RNA, 64 nt, Human
cucucccacugcagaacauggccucuagauuaaugccaccgauucaggaacaccuccgacaguc

SEQ ID NO: 152697 - RNA, 64 nt, Human
gggcaagaggagcucaagucggucugggcccguugccaccgacucccaccuccagcacccaugc

SEQ ID NO: 152698 - RNA, 64 nt, Human
guacucccuggucagggacaaguguuuccugucagccaccgagugccugcagaagaucauguga

SEQ ID NO: 152699 - RNA, 64 nt, Human
cuucuccucugagaaggcucccggcugccuccccgccaccgagcuuguagccugaaugccuggc

SEQ ID NO: 152700 - RNA, 64 nt, Human
gccccggguggugagcgggcaggaaccuggcgccgccaccgagacugagccuccugcagacggg

SEQ ID NO: 152701 - RNA, 64 nt, Human
uggagcugagagacaguaaaauaauaacugacaugccaccgaaguacaaaguaaaauaaauaaa

SEQ ID NO: 152702 - RNA, 64 nt, Human
aauaagccucagcuuucuaagaucuaacaagauagccaccgagauccuuaucgaaacucauuuu

SEQ ID NO: 152703 - RNA, 64 nt, Human
ucggccuaccgaagugcuaggauuacagacguaagccaccgagccuggucuaguuugcauuuuu

SEQ ID NO: 152704 - RNA, 64 nt, Human
ucugccucccaaagugcugggaucacaggcaugagccaccgaacccagccuuauucugcuuaaa

SEQ ID NO: 152705 - RNA, 64 nt, Human
guugccaucgugcugggacgacaccagcucuauugccaccgaugaguagcugaggucagugugc

SEQ ID NO: 152706 - RNA, 64 nt, Human
cacagaccagacucgcuucccauggugggaaacagccaccgagaagguucuagcucuagaaagg

SEQ ID NO: 152707 - RNA, 55 nt, Human
agaacugcauuagccgcugaggagagccaccgaaggccccaacaggggaugcuca

SEQ ID NO: 152708 - RNA, 64 nt, Human
gggacuguguuucuuuaaggaugcugaccuggaggccaccgagaggcuggggcuggggcugacc

SEQ ID NO: 152709 - RNA, 64 nt, Human
uucccugugcuggcuggaguccccagagauaucagccaccgagucuccuggucugucuccaggc

SEQ ID NO: 152710 - RNA, 52 nt, Human
agaugcccaugccuguguagccgccaccgagggacagccgagggaccgaugg

SEQ ID NO: 152711 - RNA, 64 nt, Human
gaccgggcggugcggcuguuucacaacacuccuggccaccgagccaugguggaggagaugcagg

SEQ ID NO: 152712 - RNA, 64 nt, Human
cacagacagguugucaucagcuugucccauucaagccaccgagcucaccacagacacaguggag

SEQ ID NO: 152713 - RNA, 64 nt, Human
gccccucagcagaggaaggggaguccccuccuccgccaccgagaguccugugcuucggaaugaa

SEQ ID NO: 152714 - RNA, 64 nt, Human
gaggagagcaaauaucauuauaugaaaguccucugccaccgaguuccuaauuuucuuuguucaa

SEQ ID NO: 152715 - RNA, 64 nt, Human
uguucuggaaaccaggcucgccggagcuggccaagccaccgacuugcuucucaaauucacuuca

SEQ ID NO: 152716 - RNA, 64 nt, Human
acuugucuggaggcccagcugggcacuaaugucugccaccgacuauguuacaguguauaaauga

SEQ ID NO: 152717 - RNA, 64 nt, Human
cgugccuuugauuucggacagauugggccucacagccaccgauucagcugccagggucccugga

SEQ ID NO: 152718 - RNA, 64 nt, Human
ggguaagggcaggccccuccaacaggugcucacagccaccgaggcaggggcugcagccacccac

SEQ ID NO: 152719 - RNA, 64 nt, Human
aaagugugggcagaauuacaauuacaaagugccagccaccgaauaaagauaaaaguucaguucu

SEQ ID NO: 152720 - RNA, 64 nt, Human
aaaugaccauaaacaguaucaauguaucacugaggccaccgaaaaggacauuucuaccuaggca

SEQ ID NO: 152721 - RNA, 64 nt, Human
gucauuuuuagcucgaccacaucaucaggucuuugccaccgaggcauaguguagaacagucccg

SEQ ID NO: 152722 - RNA, 64 nt, Human
cagcuccuuccuuccuucccccaggaacacggaggccaccgagggggcugggccuaucaggagg

SEQ ID NO: 152723 - RNA, 64 nt, Human
ugaaggguuacuuguaggucguggcuucugagcggccaccgaugcugcucucugcgggugacag

SEQ ID NO: 152724 - RNA, 64 nt, Human
cauuggaguguuagaaacuagaauagaccucuccgccaccgagcugcugugucacgcccucagc

SEQ ID NO: 152725 - RNA, 64 nt, Human
gacuccaaucccagaauugcucacugagcgcuaugccaccgaagcguugaccugaacauauuag

SEQ ID NO: 152726 - RNA, 64 nt, Human
cuggaggccgcugagguccugguggaacacacgugccaccgaggagcugucaccggccugaccg

SEQ ID NO: 152727 - RNA, 64 nt, Human
cagaucuuggggagcugccccacaagccccgcuggccaccgagggcugcagccgcugcgcugcc

SEQ ID NO: 152728 - RNA, 64 nt, Human
gcagaggccugcagggccucugucaauuguacgcgccaccgagugccuucaacacagcuugucu

SEQ ID NO: 152729 - RNA, 61 nt, Human
ccuugcuucuccagauuuagcauccugcagagccaccgagaaaauaaaaaagcugggcuug

SEQ ID NO: 152730 - RNA, 64 nt, Human
cugcuccuaaggguagaaaacuccaggguccccugccaccgacugcccagccacuccaagcccc

SEQ ID NO: 152731 - RNA, 64 nt, Human
uuguuuuaucacucuggacugugcagagccaccugccaccgagaucugcauuccgacugccuau

SEQ ID NO: 152732 - RNA, 64 nt, Human
gugguucuggagccauugugggugagggucgagggccaccgaggucccgcgcaccgcugccugc

SEQ ID NO: 152733 - RNA, 64 nt, Human
ggccaaacugcaggcaaccaccucgggccgcugggccaccgagcugcccuggaugggcugcugg

SEQ ID NO: 152734 - RNA, 64 nt, Human
cagcucugagccaucggcuuuguggucaucaugugccaccgagcugggacuucuggcaucacuu

SEQ ID NO: 152735 - RNA, 64 nt, Human
gcaguaucgguuugagaucauccuugggaacccggccaccgaacucaguguugcaacucacuuu

SEQ ID NO: 152736 - RNA, 64 nt, Human
aggacugcggguugcuggcuuguacaccgcagcugccaccgagacaccagccucugauggcuca

SEQ ID NO: 152737 - RNA, 64 nt, Human
agaacuuugaugacgagugaugccaggaagccaggccaccgaagcccccacccuacccuuauuc

SEQ ID NO: 152738 - RNA, 64 nt, Human
cagcuguccccgauaccacgagcugcugcgggaggccaccgaggccgccgaguaccaggaggcc

SEQ ID NO: 152739 - RNA, 64 nt, Human
cgcuguggggagcgcgcccggaccuggcaguggagccaccgagcgagcagcucgguccagugac

SEQ ID NO: 152740 - RNA, 64 nt, Human
agaagauugcuuaauucacauaagauuccuagaagccaccgaauccaaucaugguaaaaaugug

SEQ ID NO: 152741 - RNA, 64 nt, Human
ugauccccgcccagaaguaggcgccugcccaccugccaccgacugcuggaacccagccaguggg

SEQ ID NO: 152742 - RNA, 64 nt, Human
gcagccugcagagccacagucagccugcccacaugccaccgagcaaacgcaucuugcuuuucac

SEQ ID NO: 152743 - RNA, 64 nt, Human
agcugagacuagaauucaggguccucacucccaggccaccgaaccaugcagccccuucuuuggg

SEQ ID NO: 152744 - RNA, 64 nt, Human
ggguaucuugcccuauaagauaaacagucaaaaugccaccgagcuguucacuagugaugugugg

SEQ ID NO: 152745 - RNA, 64 nt, Human
caggagccuggacccggccucccggggcugcggcgccaccgagcccggcaaaugcgcacgaccu

SEQ ID NO: 152746 - RNA, 64 nt, Human
ugagcagagagggaaagauuaauuuacacugcuggccaccgaaggcagguguuuccuggguagu

SEQ ID NO: 152747 - RNA, 64 nt, Human
ggcaucaccaacacggccucccugcagcugcccugccaccgacagaccccgauuaaacccacac

SEQ ID NO: 152748 - RNA, 64 nt, Human
auaugcuguguaucucaccagguagcugucaggggccaccgagagugucguuaaaaaugggcau

SEQ ID NO: 152749 - RNA, 64 nt, Human; identical to SEQ ID NO: 71650

SEQ ID NO: 152750 - RNA, 64 nt, Human; identical to SEQ ID NO: 71651

SEQ ID NO: 152751 - RNA, 64 nt, Human; identical to SEQ ID NO: 71652

SEQ ID NO: 152752 - RNA, 64 nt, Human; identical to SEQ ID NO: 71653

SEQ ID NO: 152753 - RNA, 64 nt, Human; identical to SEQ ID NO: 71654

SEQ ID NO: 152754 - RNA, 64 nt, Human; identical to SEQ ID NO: 71655

SEQ ID NO: 152755 - RNA, 64 nt, Human; identical to SEQ ID NO: 71656

SEQ ID NO: 152756 - RNA, 64 nt, Human; identical to SEQ ID NO: 71657

SEQ ID NO: 152757 - RNA, 64 nt, Human; identical to SEQ ID NO: 71658

SEQ ID NO: 152758 - RNA, 64 nt, Human; identical to SEQ ID NO: 71659

SEQ ID NO: 152759 - RNA, 64 nt, Human; identical to SEQ ID NO: 71660

SEQ ID NO: 152760 - RNA, 64 nt, Human; identical to SEQ ID NO: 71661

SEQ ID NO: 152761 - RNA, 64 nt, Human; identical to SEQ ID NO: 71662

SEQ ID NO: 152762 - RNA, 64 nt, Human; identical to SEQ ID NO: 71663

SEQ ID NO: 152763 - RNA, 64 nt, Human; identical to SEQ ID NO: 71664

SEQ ID NO: 152764 - RNA, 64 nt, Human; identical to SEQ ID NO: 71665

SEQ ID NO: 152765 - RNA, 64 nt, Human; identical to SEQ ID NO: 71666

SEQ ID NO: 152766 - RNA, 64 nt, Human; identical to SEQ ID NO: 71667

SEQ ID NO: 152767 - RNA, 64 nt, Human; identical to SEQ ID NO: 71668

SEQ ID NO: 152768 - RNA, 64 nt, Human; identical to SEQ ID NO: 71669

SEQ ID NO: 152769 - RNA, 64 nt, Human; identical to SEQ ID NO: 71670

SEQ ID NO: 152770 - RNA, 64 nt, Human; identical to SEQ ID NO: 71671

SEQ ID NO: 152771 - RNA, 64 nt, Human; identical to SEQ ID NO: 71672

SEQ ID NO: 152772 - RNA, 64 nt, Human; identical to SEQ ID NO: 71673

SEQ ID NO: 152773 - RNA, 64 nt, Human; identical to SEQ ID NO: 71674

SEQ ID NO: 152774 - RNA, 64 nt, Human; identical to SEQ ID NO: 71675

SEQ ID NO: 152775 - RNA, 64 nt, Human; identical to SEQ ID NO: 71676

SEQ ID NO: 152776 - RNA, 64 nt, Human; identical to SEQ ID NO: 71677

SEQ ID NO: 152777 - RNA, 64 nt, Human; identical to SEQ ID NO: 71678

SEQ ID NO: 152778 - RNA, 64 nt, Human; identical to SEQ ID NO: 71679

SEQ ID NO: 152779 - RNA, 64 nt, Human; identical to SEQ ID NO: 71680

SEQ ID NO: 152780 - RNA, 64 nt, Human; identical to SEQ ID NO: 71681

SEQ ID NO: 152781 - RNA, 64 nt, Human; identical to SEQ ID NO: 71682

SEQ ID NO: 152782 - RNA, 64 nt, Human; identical to SEQ ID NO: 84653

SEQ ID NO: 152783 - RNA, 64 nt, Human; identical to SEQ ID NO: 71683

SEQ ID NO: 152784 - RNA, 64 nt, Human; identical to SEQ ID NO: 71684

SEQ ID NO: 152785 - RNA, 64 nt, Human; identical to SEQ ID NO: 71685

SEQ ID NO: 152786 - RNA, 64 nt, Human; identical to SEQ ID NO: 71686

SEQ ID NO: 152787 - RNA, 64 nt, Human; identical to SEQ ID NO: 71687

SEQ ID NO: 152788 - RNA, 64 nt, Human; identical to SEQ ID NO: 71688

SEQ ID NO: 152789 - RNA, 64 nt, Human; identical to SEQ ID NO: 71689

SEQ ID NO: 152790 - RNA, 64 nt, Human; identical to SEQ ID NO: 71690

SEQ ID NO: 152791 - RNA, 64 nt, Human; identical to SEQ ID NO: 71691

SEQ ID NO: 152792 - RNA, 64 nt, Human; identical to SEQ ID NO: 71692

SEQ ID NO: 152793 - RNA, 64 nt, Human; identical to SEQ ID NO: 71693

SEQ ID NO: 152794 - RNA, 64 nt, Human; identical to SEQ ID NO: 71694

SEQ ID NO: 152795 - RNA, 64 nt, Human; identical to SEQ ID NO: 71695

SEQ ID NO: 152796 - RNA, 64 nt, Human; identical to SEQ ID NO: 71696

SEQ ID NO: 152797 - RNA, 64 nt, Human; identical to SEQ ID NO: 71697

SEQ ID NO: 152798 - RNA, 64 nt, Human; identical to SEQ ID NO: 71698

SEQ ID NO: 152799 - RNA, 64 nt, Human; identical to SEQ ID NO: 71699

SEQ ID NO: 152800 - RNA, 64 nt, Human; identical to SEQ ID NO: 84659

SEQ ID NO: 152801 - RNA, 64 nt, Human; identical to SEQ ID NO: 71700

SEQ ID NO: 152802 - RNA, 64 nt, Human; identical to SEQ ID NO: 71701

SEQ ID NO: 152803 - RNA, 64 nt, Human; identical to SEQ ID NO: 71702

SEQ ID NO: 152804 - RNA, 64 nt, Human; identical to SEQ ID NO: 71703

SEQ ID NO: 152805 - RNA, 64 nt, Human; identical to SEQ ID NO: 71704

SEQ ID NO: 152806 - RNA, 64 nt, Human; identical to SEQ ID NO: 71705

SEQ ID NO: 152807 - RNA, 64 nt, Human; identical to SEQ ID NO: 71706

SEQ ID NO: 152808 - RNA, 64 nt, Human; identical to SEQ ID NO: 71707

SEQ ID NO: 152809 - RNA, 64 nt, Human; identical to SEQ ID NO: 71708

SEQ ID NO: 152810 - RNA, 64 nt, Human; identical to SEQ ID NO: 71709

SEQ ID NO: 152811 - RNA, 64 nt, Human; identical to SEQ ID NO: 71710

SEQ ID NO: 152812 - RNA, 64 nt, Human; identical to SEQ ID NO: 71711

SEQ ID NO: 152813 - RNA, 64 nt, Human; identical to SEQ ID NO: 71712

SEQ ID NO: 152814 - RNA, 64 nt, Human; identical to SEQ ID NO: 71713

SEQ ID NO: 152815 - RNA, 64 nt, Human; identical to SEQ ID NO: 71714

SEQ ID NO: 152816 - RNA, 64 nt, Human; identical to SEQ ID NO: 71715

SEQ ID NO: 152817 - RNA, 64 nt, Human; identical to SEQ ID NO: 71716

SEQ ID NO: 152818 - RNA, 64 nt, Human; identical to SEQ ID NO: 84663

SEQ ID NO: 152819 - RNA, 64 nt, Human; identical to SEQ ID NO: 71717

SEQ ID NO: 152820 - RNA, 64 nt, Human; identical to SEQ ID NO: 71718

SEQ ID NO: 152821 - RNA, 64 nt, Human; identical to SEQ ID NO: 71719

SEQ ID NO: 152822 - RNA, 64 nt, Human; identical to SEQ ID NO: 71720

SEQ ID NO: 152823 - RNA, 63 nt, Human; identical to SEQ ID NO: 71721

SEQ ID NO: 152824 - RNA, 64 nt, Human; identical to SEQ ID NO: 71722

SEQ ID NO: 152825 - RNA, 64 nt, Human; identical to SEQ ID NO: 71723

SEQ ID NO: 152826 - RNA, 64 nt, Human; identical to SEQ ID NO: 71724

SEQ ID NO: 152827 - RNA, 64 nt, Human; identical to SEQ ID NO: 71725

SEQ ID NO: 152828 - RNA, 64 nt, Human; identical to SEQ ID NO: 71726

SEQ ID NO: 152829 - RNA, 64 nt, Human; identical to SEQ ID NO: 71727

SEQ ID NO: 152830 - RNA, 64 nt, Human; identical to SEQ ID NO: 71728

SEQ ID NO: 152831 - RNA, 64 nt, Human; identical to SEQ ID NO: 71729

SEQ ID NO: 152832 - RNA, 64 nt, Human; identical to SEQ ID NO: 71730

SEQ ID NO: 152833 - RNA, 64 nt, Human; identical to SEQ ID NO: 71731

SEQ ID NO: 152834 - RNA, 64 nt, Human; identical to SEQ ID NO: 71732

SEQ ID NO: 152835 - RNA, 64 nt, Human; identical to SEQ ID NO: 71733

SEQ ID NO: 152836 - RNA, 64 nt, Human; identical to SEQ ID NO: 84667

SEQ ID NO: 152837 - RNA, 64 nt, Human; identical to SEQ ID NO: 71734

SEQ ID NO: 152838 - RNA, 64 nt, Human; identical to SEQ ID NO: 71735

SEQ ID NO: 152839 - RNA, 64 nt, Human; identical to SEQ ID NO: 71736

SEQ ID NO: 152840 - RNA, 64 nt, Human; identical to SEQ ID NO: 71737

SEQ ID NO: 152841 - RNA, 64 nt, Human; identical to SEQ ID NO: 71738

SEQ ID NO: 152842 - RNA, 64 nt, Human; identical to SEQ ID NO: 71739

SEQ ID NO: 152843 - RNA, 64 nt, Human; identical to SEQ ID NO: 71740

SEQ ID NO: 152844 - RNA, 64 nt, Human; identical to SEQ ID NO: 71741

SEQ ID NO: 152845 - RNA, 64 nt, Human; identical to SEQ ID NO: 71742

SEQ ID NO: 152846 - RNA, 64 nt, Human; identical to SEQ ID NO: 71743

SEQ ID NO: 152847 - RNA, 64 nt, Human; identical to SEQ ID NO: 71744

SEQ ID NO: 152848 - RNA, 64 nt, Human; identical to SEQ ID NO: 71745

SEQ ID NO: 152849 - RNA, 64 nt, Human; identical to SEQ ID NO: 71746

SEQ ID NO: 152850 - RNA, 64 nt, Human; identical to SEQ ID NO: 71747

SEQ ID NO: 152851 - RNA, 57 nt, Human; identical to SEQ ID NO: 71748

SEQ ID NO: 152852 - RNA, 64 nt, Human; identical to SEQ ID NO: 71749

SEQ ID NO: 152853 - RNA, 64 nt, Human; identical to SEQ ID NO: 71750

SEQ ID NO: 152854 - RNA, 64 nt, Human; identical to SEQ ID NO: 71751

SEQ ID NO: 152855 - RNA, 64 nt, Human; identical to SEQ ID NO: 71752

SEQ ID NO: 152856 - RNA, 64 nt, Human; identical to SEQ ID NO: 71753

SEQ ID NO: 152857 - RNA, 64 nt, Human; identical to SEQ ID NO: 71754

SEQ ID NO: 152858 - RNA, 64 nt, Human; identical to SEQ ID NO: 71755

SEQ ID NO: 152859 - RNA, 64 nt, Human; identical to SEQ ID NO: 71756

SEQ ID NO: 152860 - RNA, 64 nt, Human; identical to SEQ ID NO: 71757

SEQ ID NO: 152861 - RNA, 64 nt, Human; identical to SEQ ID NO: 71758

SEQ ID NO: 152862 - RNA, 64 nt, Human; identical to SEQ ID NO: 71759

SEQ ID NO: 152863 - RNA, 64 nt, Human; identical to SEQ ID NO: 71760

SEQ ID NO: 152864 - RNA, 64 nt, Human; identical to SEQ ID NO: 71761

SEQ ID NO: 152865 - RNA, 56 nt, Human; identical to SEQ ID NO: 71762

SEQ ID NO: 152866 - RNA, 64 nt, Human; identical to SEQ ID NO: 71763

SEQ ID NO: 152867 - RNA, 64 nt, Human; identical to SEQ ID NO: 71764

SEQ ID NO: 152868 - RNA, 64 nt, Human; identical to SEQ ID NO: 71765

SEQ ID NO: 152869 - RNA, 64 nt, Human; identical to SEQ ID NO: 71766

SEQ ID NO: 152870 - RNA, 64 nt, Human; identical to SEQ ID NO: 71767

SEQ ID NO: 152871 - RNA, 64 nt, Human; identical to SEQ ID NO: 71768

SEQ ID NO: 152872 - RNA, 64 nt, Human; identical to SEQ ID NO: 71769

SEQ ID NO: 152873 - RNA, 64 nt, Human; identical to SEQ ID NO: 71770

SEQ ID NO: 152874 - RNA, 64 nt, Human; identical to SEQ ID NO: 71771

SEQ ID NO: 152875 - RNA, 64 nt, Human; identical to SEQ ID NO: 71772

SEQ ID NO: 152876 - RNA, 64 nt, Human; identical to SEQ ID NO: 71773

SEQ ID NO: 152877 - RNA, 64 nt, Human; identical to SEQ ID NO: 71774

SEQ ID NO: 152878 - RNA, 64 nt, Human; identical to SEQ ID NO: 71775

SEQ ID NO: 152879 - RNA, 64 nt, Human; identical to SEQ ID NO: 71776

SEQ ID NO: 152880 - RNA, 64 nt, Human; identical to SEQ ID NO: 71777

SEQ ID NO: 152881 - RNA, 64 nt, Human; identical to SEQ ID NO: 71778

SEQ ID NO: 152882 - RNA, 64 nt, Human; identical to SEQ ID NO: 71779

SEQ ID NO: 152883 - RNA, 64 nt, Human; identical to SEQ ID NO: 71780

SEQ ID NO: 152884 - RNA, 64 nt, Human; identical to SEQ ID NO: 71781

SEQ ID NO: 152885 - RNA, 64 nt, Human; identical to SEQ ID NO: 71782

SEQ ID NO: 152886 - RNA, 64 nt, Human; identical to SEQ ID NO: 71783

SEQ ID NO: 152887 - RNA, 64 nt, Human; identical to SEQ ID NO: 71784

SEQ ID NO: 152888 - RNA, 64 nt, Human; identical to SEQ ID NO: 71785

SEQ ID NO: 152889 - RNA, 64 nt, Human; identical to SEQ ID NO: 71786

SEQ ID NO: 152890 - RNA, 64 nt, Human; identical to SEQ ID NO: 84671

SEQ ID NO: 152891 - RNA, 64 nt, Human; identical to SEQ ID NO: 71787

SEQ ID NO: 152892 - RNA, 64 nt, Human; identical to SEQ ID NO: 71788

SEQ ID NO: 152893 - RNA, 64 nt, Human; identical to SEQ ID NO: 71789

SEQ ID NO: 152894 - RNA, 64 nt, Human; identical to SEQ ID NO: 71790

SEQ ID NO: 152895 - RNA, 64 nt, Human; identical to SEQ ID NO: 71791

SEQ ID NO: 152896 - RNA, 64 nt, Human; identical to SEQ ID NO: 71792

SEQ ID NO: 152897 - RNA, 64 nt, Human; identical to SEQ ID NO: 71793

SEQ ID NO: 152898 - RNA, 64 nt, Human; identical to SEQ ID NO: 71794

SEQ ID NO: 152899 - RNA, 64 nt, Human; identical to SEQ ID NO: 71795

SEQ ID NO: 152900 - RNA, 64 nt, Human; identical to SEQ ID NO: 71796

SEQ ID NO: 152901 - RNA, 64 nt, Human; identical to SEQ ID NO: 71797

SEQ ID NO: 152902 - RNA, 64 nt, Human; identical to SEQ ID NO: 71798

SEQ ID NO: 152903 - RNA, 64 nt, Human; identical to SEQ ID NO: 71799

SEQ ID NO: 152904 - RNA, 64 nt, Human; identical to SEQ ID NO: 71800

SEQ ID NO: 152905 - RNA, 64 nt, Human; identical to SEQ ID NO: 71801

SEQ ID NO: 152906 - RNA, 64 nt, Human; identical to SEQ ID NO: 71802

SEQ ID NO: 152907 - RNA, 64 nt, Human; identical to SEQ ID NO: 71803

SEQ ID NO: 152908 - RNA, 64 nt, Human; identical to SEQ ID NO: 84675

SEQ ID NO: 152909 - RNA, 64 nt, Human; identical to SEQ ID NO: 71804

SEQ ID NO: 152910 - RNA, 64 nt, Human; identical to SEQ ID NO: 71805

SEQ ID NO: 152911 - RNA, 64 nt, Human; identical to SEQ ID NO: 71806

SEQ ID NO: 152912 - RNA, 64 nt, Human; identical to SEQ ID NO: 71807

SEQ ID NO: 152913 - RNA, 64 nt, Human; identical to SEQ ID NO: 71808

SEQ ID NO: 152914 - RNA, 64 nt, Human; identical to SEQ ID NO: 71809

SEQ ID NO: 152915 - RNA, 64 nt, Human; identical to SEQ ID NO: 71810

SEQ ID NO: 152916 - RNA, 64 nt, Human; identical to SEQ ID NO: 71811

SEQ ID NO: 152917 - RNA, 64 nt, Human; identical to SEQ ID NO: 71812

SEQ ID NO: 152918 - RNA, 64 nt, Human; identical to SEQ ID NO: 71813

SEQ ID NO: 152919 - RNA, 64 nt, Human; identical to SEQ ID NO: 71814

SEQ ID NO: 152920 - RNA, 64 nt, Human; identical to SEQ ID NO: 71815

SEQ ID NO: 152921 - RNA, 64 nt, Human; identical to SEQ ID NO: 71816

SEQ ID NO: 152922 - RNA, 64 nt, Human; identical to SEQ ID NO: 71817

SEQ ID NO: 152923 - RNA, 64 nt, Human; identical to SEQ ID NO: 71818

SEQ ID NO: 152924 - RNA, 64 nt, Human; identical to SEQ ID NO: 71819

SEQ ID NO: 152925 - RNA, 64 nt, Human; identical to SEQ ID NO: 71820

SEQ ID NO: 152926 - RNA, 64 nt, Human; identical to SEQ ID NO: 84679

SEQ ID NO: 152927 - RNA, 64 nt, Human; identical to SEQ ID NO: 71821

SEQ ID NO: 152928 - RNA, 64 nt, Human; identical to SEQ ID NO: 71822

SEQ ID NO: 152929 - RNA, 64 nt, Human; identical to SEQ ID NO: 71823

SEQ ID NO: 152930 - RNA, 64 nt, Human; identical to SEQ ID NO: 71824

SEQ ID NO: 152931 - RNA, 64 nt, Human; identical to SEQ ID NO: 71825

SEQ ID NO: 152932 - RNA, 64 nt, Human; identical to SEQ ID NO: 71813

SEQ ID NO: 152933 - RNA, 64 nt, Human; identical to SEQ ID NO: 71827

SEQ ID NO: 152934 - RNA, 64 nt, Human; identical to SEQ ID NO: 71828

SEQ ID NO: 152935 - RNA, 64 nt, Human; identical to SEQ ID NO: 71829

SEQ ID NO: 152936 - RNA, 64 nt, Human; identical to SEQ ID NO: 71830

SEQ ID NO: 152937 - RNA, 64 nt, Human; identical to SEQ ID NO: 71831

SEQ ID NO: 152938 - RNA, 64 nt, Human; identical to SEQ ID NO: 71832

SEQ ID NO: 152939 - RNA, 64 nt, Human; identical to SEQ ID NO: 71833

SEQ ID NO: 152940 - RNA, 64 nt, Human; identical to SEQ ID NO: 71834

SEQ ID NO: 152941 - RNA, 64 nt, Human; identical to SEQ ID NO: 71835

SEQ ID NO: 152942 - RNA, 64 nt, Human; identical to SEQ ID NO: 71836

SEQ ID NO: 152943 - RNA, 64 nt, Human; identical to SEQ ID NO: 71837

SEQ ID NO: 152944 - RNA, 64 nt, Human; identical to SEQ ID NO: 84683

SEQ ID NO: 152945 - RNA, 64 nt, Human; identical to SEQ ID NO: 71838

SEQ ID NO: 152946 - RNA, 64 nt, Human; identical to SEQ ID NO: 71839

SEQ ID NO: 152947 - RNA, 64 nt, Human; identical to SEQ ID NO: 71840

SEQ ID NO: 152948 - RNA, 64 nt, Human; identical to SEQ ID NO: 71841

SEQ ID NO: 152949 - RNA, 64 nt, Human; identical to SEQ ID NO: 71842

SEQ ID NO: 152950 - RNA, 64 nt, Human; identical to SEQ ID NO: 71843

SEQ ID NO: 152951 - RNA, 64 nt, Human; identical to SEQ ID NO: 71844

SEQ ID NO: 152952 - RNA, 64 nt, Human; identical to SEQ ID NO: 71845

SEQ ID NO: 152953 - RNA, 64 nt, Human; identical to SEQ ID NO: 71846

SEQ ID NO: 152954 - RNA, 64 nt, Human; identical to SEQ ID NO: 71847

SEQ ID NO: 152955 - RNA, 64 nt, Human; identical to SEQ ID NO: 71848

SEQ ID NO: 152956 - RNA, 64 nt, Human; identical to SEQ ID NO: 71849

SEQ ID NO: 152957 - RNA, 64 nt, Human; identical to SEQ ID NO: 71850

SEQ ID NO: 152958 - RNA, 64 nt, Human; identical to SEQ ID NO: 71851

SEQ ID NO: 152959 - RNA, 64 nt, Human; identical to SEQ ID NO: 71852

SEQ ID NO: 152960 - RNA, 64 nt, Human; identical to SEQ ID NO: 71853

SEQ ID NO: 152961 - RNA, 64 nt, Human; identical to SEQ ID NO: 71854

SEQ ID NO: 152962 - RNA, 64 nt, Human; identical to SEQ ID NO: 84687

SEQ ID NO: 152963 - RNA, 64 nt, Human; identical to SEQ ID NO: 71855

SEQ ID NO: 152964 - RNA, 64 nt, Human; identical to SEQ ID NO: 71856

SEQ ID NO: 152965 - RNA, 64 nt, Human; identical to SEQ ID NO: 71857

SEQ ID NO: 152966 - RNA, 64 nt, Human; identical to SEQ ID NO: 71858

SEQ ID NO: 152967 - RNA, 64 nt, Human; identical to SEQ ID NO: 71859

SEQ ID NO: 152968 - RNA, 64 nt, Human; identical to SEQ ID NO: 71860

SEQ ID NO: 152969 - RNA, 64 nt, Human; identical to SEQ ID NO: 71861

SEQ ID NO: 152970 - RNA, 64 nt, Human; identical to SEQ ID NO: 71862

SEQ ID NO: 152971 - RNA, 64 nt, Human; identical to SEQ ID NO: 71863

SEQ ID NO: 152972 - RNA, 64 nt, Human; identical to SEQ ID NO: 71864

SEQ ID NO: 152973 - RNA, 64 nt, Human; identical to SEQ ID NO: 71865

SEQ ID NO: 152974 - RNA, 64 nt, Human; identical to SEQ ID NO: 71866

SEQ ID NO: 152975 - RNA, 64 nt, Human; identical to SEQ ID NO: 71867

SEQ ID NO: 152976 - RNA, 64 nt, Human; identical to SEQ ID NO: 71868

SEQ ID NO: 152977 - RNA, 64 nt, Human; identical to SEQ ID NO: 71869

SEQ ID NO: 152978 - RNA, 64 nt, Human; identical to SEQ ID NO: 71870

SEQ ID NO: 152979 - RNA, 64 nt, Human; identical to SEQ ID NO: 71871

SEQ ID NO: 152980 - RNA, 64 nt, Human; identical to SEQ ID NO: 84693

SEQ ID NO: 152981 - RNA, 64 nt, Human; identical to SEQ ID NO: 71872

SEQ ID NO: 152982 - RNA, 64 nt, Human; identical to SEQ ID NO: 71873

SEQ ID NO: 152983 - RNA, 64 nt, Human; identical to SEQ ID NO: 71874

SEQ ID NO: 152984 - RNA, 64 nt, Human; identical to SEQ ID NO: 71875

SEQ ID NO: 152985 - RNA, 64 nt, Human; identical to SEQ ID NO: 71876

SEQ ID NO: 152986 - RNA, 64 nt, Human; identical to SEQ ID NO: 71877

SEQ ID NO: 152987 - RNA, 64 nt, Human; identical to SEQ ID NO: 71878

SEQ ID NO: 152988 - RNA, 64 nt, Human; identical to SEQ ID NO: 71879

SEQ ID NO: 152989 - RNA, 64 nt, Human; identical to SEQ ID NO: 71880

SEQ ID NO: 152990 - RNA, 64 nt, Human; identical to SEQ ID NO: 71881

SEQ ID NO: 152991 - RNA, 64 nt, Human; identical to SEQ ID NO: 71882

SEQ ID NO: 152992 - RNA, 64 nt, Human; identical to SEQ ID NO: 71883

SEQ ID NO: 152993 - RNA, 64 nt, Human; identical to SEQ ID NO: 71884

SEQ ID NO: 152994 - RNA, 64 nt, Human; identical to SEQ ID NO: 71885

SEQ ID NO: 152995 - RNA, 64 nt, Human; identical to SEQ ID NO: 71886

SEQ ID NO: 152996 - RNA, 64 nt, Human; identical to SEQ ID NO: 71887

SEQ ID NO: 152997 - RNA, 64 nt, Human; identical to SEQ ID NO: 71888

SEQ ID NO: 152998 - RNA, 64 nt, Human; identical to SEQ ID NO: 84697

SEQ ID NO: 152999 - RNA, 64 nt, Human; identical to SEQ ID NO: 71889

SEQ ID NO: 153000 - RNA, 64 nt, Human; identical to SEQ ID NO: 71890

SEQ ID NO: 153001 - RNA, 51 nt, Human; identical to SEQ ID NO: 71891

SEQ ID NO: 153002 - RNA, 64 nt, Human; identical to SEQ ID NO: 71892

SEQ ID NO: 153003 - RNA, 64 nt, Human; identical to SEQ ID NO: 71893

SEQ ID NO: 153004 - RNA, 64 nt, Human; identical to SEQ ID NO: 71894

SEQ ID NO: 153005 - RNA, 64 nt, Human; identical to SEQ ID NO: 71895

SEQ ID NO: 153006 - RNA, 64 nt, Human; identical to SEQ ID NO: 71896

SEQ ID NO: 153007 - RNA, 64 nt, Human; identical to SEQ ID NO: 71897

SEQ ID NO: 153008 - RNA, 64 nt, Human; identical to SEQ ID NO: 71898

SEQ ID NO: 153009 - RNA, 64 nt, Human; identical to SEQ ID NO: 71899

SEQ ID NO: 153010 - RNA, 64 nt, Human; identical to SEQ ID NO: 71900

SEQ ID NO: 153011 - RNA, 64 nt, Human; identical to SEQ ID NO: 71901

SEQ ID NO: 153012 - RNA, 64 nt, Human; identical to SEQ ID NO: 71902

SEQ ID NO: 153013 - RNA, 64 nt, Human; identical to SEQ ID NO: 71903

SEQ ID NO: 153014 - RNA, 64 nt, Human; identical to SEQ ID NO: 71904

SEQ ID NO: 153015 - RNA, 64 nt, Human; identical to SEQ ID NO: 71905

SEQ ID NO: 153016 - RNA, 64 nt, Human; identical to SEQ ID NO: 84701

SEQ ID NO: 153017 - RNA, 64 nt, Human; identical to SEQ ID NO: 71906

SEQ ID NO: 153018 - RNA, 64 nt, Human; identical to SEQ ID NO: 71907

SEQ ID NO: 153019 - RNA, 64 nt, Human; identical to SEQ ID NO: 71908

SEQ ID NO: 153020 - RNA, 64 nt, Human; identical to SEQ ID NO: 71909

SEQ ID NO: 153021 - RNA, 64 nt, Human; identical to SEQ ID NO: 71910

SEQ ID NO: 153022 - RNA, 64 nt, Human; identical to SEQ ID NO: 71911

SEQ ID NO: 153023 - RNA, 64 nt, Human; identical to SEQ ID NO: 71912

SEQ ID NO: 153024 - RNA, 64 nt, Human; identical to SEQ ID NO: 71913

SEQ ID NO: 153025 - RNA, 64 nt, Human; identical to SEQ ID NO: 71914

SEQ ID NO: 153026 - RNA, 64 nt, Human; identical to SEQ ID NO: 71915

SEQ ID NO: 153027 - RNA, 64 nt, Human; identical to SEQ ID NO: 71916

SEQ ID NO: 153028 - RNA, 64 nt, Human; identical to SEQ ID NO: 71917

SEQ ID NO: 153029 - RNA, 64 nt, Human; identical to SEQ ID NO: 71918

SEQ ID NO: 153030 - RNA, 64 nt, Human; identical to SEQ ID NO: 71919

SEQ ID NO: 153031 - RNA, 64 nt, Human; identical to SEQ ID NO: 71920

SEQ ID NO: 153032 - RNA, 64 nt, Human; identical to SEQ ID NO: 71921

SEQ ID NO: 153033 - RNA, 64 nt, Human; identical to SEQ ID NO: 71922

SEQ ID NO: 153034 - RNA, 51 nt, Human; identical to SEQ ID NO: 84705

SEQ ID NO: 153035 - RNA, 64 nt, Human; identical to SEQ ID NO: 71923

SEQ ID NO: 153036 - RNA, 64 nt, Human; identical to SEQ ID NO: 71924

SEQ ID NO: 153037 - RNA, 64 nt, Human; identical to SEQ ID NO: 71925

SEQ ID NO: 153038 - RNA, 64 nt, Human; identical to SEQ ID NO: 71926

SEQ ID NO: 153039 - RNA, 64 nt, Human; identical to SEQ ID NO: 71927

SEQ ID NO: 153040 - RNA, 64 nt, Human; identical to SEQ ID NO: 71928

SEQ ID NO: 153041 - RNA, 64 nt, Human; identical to SEQ ID NO: 71929

SEQ ID NO: 153042 - RNA, 64 nt, Human; identical to SEQ ID NO: 71930

SEQ ID NO: 153043 - RNA, 64 nt, Human; identical to SEQ ID NO: 71931

SEQ ID NO: 153044 - RNA, 64 nt, Human; identical to SEQ ID NO: 71932

SEQ ID NO: 153045 - RNA, 64 nt, Human; identical to SEQ ID NO: 71933

SEQ ID NO: 153046 - RNA, 64 nt, Human; identical to SEQ ID NO: 71934

SEQ ID NO: 153047 - RNA, 64 nt, Human; identical to SEQ ID NO: 71935

SEQ ID NO: 153048 - RNA, 64 nt, Human; identical to SEQ ID NO: 71936

SEQ ID NO: 153049 - RNA, 64 nt, Human; identical to SEQ ID NO: 71937

SEQ ID NO: 153050 - RNA, 64 nt, Human; identical to SEQ ID NO: 71938

SEQ ID NO: 153051 - RNA, 64 nt, Human; identical to SEQ ID NO: 71939

SEQ ID NO: 153052 - RNA, 64 nt, Human; identical to SEQ ID NO: 84709

SEQ ID NO: 153053 - RNA, 64 nt, Human; identical to SEQ ID NO: 71940

SEQ ID NO: 153054 - RNA, 64 nt, Human; identical to SEQ ID NO: 71941

SEQ ID NO: 153055 - RNA, 64 nt, Human; identical to SEQ ID NO: 71942

SEQ ID NO: 153056 - RNA, 64 nt, Human; identical to SEQ ID NO: 71943

SEQ ID NO: 153057 - RNA, 64 nt, Human; identical to SEQ ID NO: 71944

SEQ ID NO: 153058 - RNA, 64 nt, Human; identical to SEQ ID NO: 71945

SEQ ID NO: 153059 - RNA, 64 nt, Human; identical to SEQ ID NO: 71946

SEQ ID NO: 153060 - RNA, 64 nt, Human; identical to SEQ ID NO: 71947

SEQ ID NO: 153061 - RNA, 64 nt, Human; identical to SEQ ID NO: 71948

SEQ ID NO: 153062 - RNA, 64 nt, Human; identical to SEQ ID NO: 71949

SEQ ID NO: 153063 - RNA, 64 nt, Human; identical to SEQ ID NO: 71950

SEQ ID NO: 153064 - RNA, 64 nt, Human; identical to SEQ ID NO: 71951

SEQ ID NO: 153065 - RNA, 64 nt, Human; identical to SEQ ID NO: 71952

SEQ ID NO: 153066 - RNA, 64 nt, Human; identical to SEQ ID NO: 71953

SEQ ID NO: 153067 - RNA, 64 nt, Human; identical to SEQ ID NO: 71954

SEQ ID NO: 153068 - RNA, 64 nt, Human; identical to SEQ ID NO: 71955

SEQ ID NO: 153069 - RNA, 64 nt, Human; identical to SEQ ID NO: 71956

SEQ ID NO: 153070 - RNA, 64 nt, Human; identical to SEQ ID NO: 84713

SEQ ID NO: 153071 - RNA, 64 nt, Human; identical to SEQ ID NO: 71957

SEQ ID NO: 153072 - RNA, 64 nt, Human; identical to SEQ ID NO: 71958

SEQ ID NO: 153073 - RNA, 64 nt, Human; identical to SEQ ID NO: 71959

SEQ ID NO: 153074 - RNA, 64 nt, Human; identical to SEQ ID NO: 71960

SEQ ID NO: 153075 - RNA, 64 nt, Human; identical to SEQ ID NO: 71961

SEQ ID NO: 153076 - RNA, 64 nt, Human; identical to SEQ ID NO: 71962

SEQ ID NO: 153077 - RNA, 64 nt, Human; identical to SEQ ID NO: 71963

SEQ ID NO: 153078 - RNA, 64 nt, Human; identical to SEQ ID NO: 71964

SEQ ID NO: 153079 - RNA, 64 nt, Human; identical to SEQ ID NO: 71965

SEQ ID NO: 153080 - RNA, 64 nt, Human; identical to SEQ ID NO: 71966

SEQ ID NO: 153081 - RNA, 64 nt, Human; identical to SEQ ID NO: 71967

SEQ ID NO: 153082 - RNA, 64 nt, Human; identical to SEQ ID NO: 71968

SEQ ID NO: 153083 - RNA, 64 nt, Human; identical to SEQ ID NO: 71969

SEQ ID NO: 153084 - RNA, 64 nt, Human; identical to SEQ ID NO: 71970

SEQ ID NO: 153085 - RNA, 64 nt, Human; identical to SEQ ID NO: 71971

SEQ ID NO: 153086 - RNA, 64 nt, Human; identical to SEQ ID NO: 71972

SEQ ID NO: 153087 - RNA, 64 nt, Human; identical to SEQ ID NO: 71973

SEQ ID NO: 153088 - RNA, 64 nt, Human; identical to SEQ ID NO: 84717

SEQ ID NO: 153089 - RNA, 64 nt, Human; identical to SEQ ID NO: 71974

SEQ ID NO: 153090 - RNA, 64 nt, Human; identical to SEQ ID NO: 71975

SEQ ID NO: 153091 - RNA, 64 nt, Human; identical to SEQ ID NO: 71976

SEQ ID NO: 153092 - RNA, 64 nt, Human; identical to SEQ ID NO: 71977

SEQ ID NO: 153093 - RNA, 64 nt, Human; identical to SEQ ID NO: 71978

SEQ ID NO: 153094 - RNA, 64 nt, Human; identical to SEQ ID NO: 71979

SEQ ID NO: 153095 - RNA, 64 nt, Human; identical to SEQ ID NO: 71980

SEQ ID NO: 153096 - RNA, 64 nt, Human; identical to SEQ ID NO: 71981

SEQ ID NO: 153097 - RNA, 64 nt, Human; identical to SEQ ID NO: 71982

SEQ ID NO: 153098 - RNA, 64 nt, Human; identical to SEQ ID NO: 71983

SEQ ID NO: 153099 - RNA, 64 nt, Human; identical to SEQ ID NO: 71984

SEQ ID NO: 153100 - RNA, 64 nt, Human; identical to SEQ ID NO: 71985

SEQ ID NO: 153101 - RNA, 64 nt, Human; identical to SEQ ID NO: 71986

SEQ ID NO: 153102 - RNA, 64 nt, Human; identical to SEQ ID NO: 71987

SEQ ID NO: 153103 - RNA, 64 nt, Human; identical to SEQ ID NO: 71988

SEQ ID NO: 153104 - RNA, 64 nt, Human; identical to SEQ ID NO: 71989

SEQ ID NO: 153105 - RNA, 64 nt, Human; identical to SEQ ID NO: 71990

SEQ ID NO: 153106 - RNA, 64 nt, Human; identical to SEQ ID NO: 84721

SEQ ID NO: 153107 - RNA, 64 nt, Human; identical to SEQ ID NO: 71991

SEQ ID NO: 153108 - RNA, 64 nt, Human; identical to SEQ ID NO: 71992

SEQ ID NO: 153109 - RNA, 64 nt, Human; identical to SEQ ID NO: 71993

SEQ ID NO: 153110 - RNA, 64 nt, Human; identical to SEQ ID NO: 71994

SEQ ID NO: 153111 - RNA, 64 nt, Human; identical to SEQ ID NO: 71995

SEQ ID NO: 153112 - RNA, 64 nt, Human; identical to SEQ ID NO: 71996

SEQ ID NO: 153113 - RNA, 64 nt, Human; identical to SEQ ID NO: 71997

SEQ ID NO: 153114 - RNA, 64 nt, Human; identical to SEQ ID NO: 71998

SEQ ID NO: 153115 - RNA, 64 nt, Human; identical to SEQ ID NO: 71999

SEQ ID NO: 153116 - RNA, 64 nt, Human; identical to SEQ ID NO: 72000

SEQ ID NO: 153117 - RNA, 64 nt, Human; identical to SEQ ID NO: 72001

SEQ ID NO: 153118 - RNA, 64 nt, Human; identical to SEQ ID NO: 72002

SEQ ID NO: 153119 - RNA, 64 nt, Human; identical to SEQ ID NO: 72003

SEQ ID NO: 153120 - RNA, 64 nt, Human; identical to SEQ ID NO: 72004

SEQ ID NO: 153121 - RNA, 64 nt, Human; identical to SEQ ID NO: 72005

SEQ ID NO: 153122 - RNA, 64 nt, Human; identical to SEQ ID NO: 72006

SEQ ID NO: 153123 - RNA, 64 nt, Human; identical to SEQ ID NO: 72007

SEQ ID NO: 153124 - RNA, 64 nt, Human; identical to SEQ ID NO: 84725

SEQ ID NO: 153125 - RNA, 64 nt, Human; identical to SEQ ID NO: 72008

SEQ ID NO: 153126 - RNA, 63 nt, Human; identical to SEQ ID NO: 72009

SEQ ID NO: 153127 - RNA, 64 nt, Human; identical to SEQ ID NO: 72010

SEQ ID NO: 153128 - RNA, 64 nt, Human; identical to SEQ ID NO: 72011

SEQ ID NO: 153129 - RNA, 64 nt, Human; identical to SEQ ID NO: 72012

SEQ ID NO: 153130 - RNA, 64 nt, Human; identical to SEQ ID NO: 72013

SEQ ID NO: 153131 - RNA, 64 nt, Human; identical to SEQ ID NO: 72014

SEQ ID NO: 153132 - RNA, 64 nt, Human; identical to SEQ ID NO: 72015

SEQ ID NO: 153133 - RNA, 64 nt, Human; identical to SEQ ID NO: 72016

SEQ ID NO: 153134 - RNA, 64 nt, Human; identical to SEQ ID NO: 72017

SEQ ID NO: 153135 - RNA, 64 nt, Human; identical to SEQ ID NO: 72018

SEQ ID NO: 153136 - RNA, 57 nt, Human; identical to SEQ ID NO: 72019

SEQ ID NO: 153137 - RNA, 64 nt, Human; identical to SEQ ID NO: 72020

SEQ ID NO: 153138 - RNA, 64 nt, Human; identical to SEQ ID NO: 72021

SEQ ID NO: 153139 - RNA, 64 nt, Human; identical to SEQ ID NO: 72022

SEQ ID NO: 153140 - RNA, 64 nt, Human; identical to SEQ ID NO: 72023

SEQ ID NO: 153141 - RNA, 64 nt, Human; identical to SEQ ID NO: 72024

SEQ ID NO: 153142 - RNA, 64 nt, Human; identical to SEQ ID NO: 84729

SEQ ID NO: 153143 - RNA, 64 nt, Human; identical to SEQ ID NO: 72025

SEQ ID NO: 153144 - RNA, 64 nt, Human; identical to SEQ ID NO: 72026

SEQ ID NO: 153145 - RNA, 64 nt, Human; identical to SEQ ID NO: 72027

SEQ ID NO: 153146 - RNA, 64 nt, Human; identical to SEQ ID NO: 72028

SEQ ID NO: 153147 - RNA, 64 nt, Human; identical to SEQ ID NO: 72029

SEQ ID NO: 153148 - RNA, 64 nt, Human; identical to SEQ ID NO: 72030

SEQ ID NO: 153149 - RNA, 64 nt, Human; identical to SEQ ID NO: 72031

SEQ ID NO: 153150 - RNA, 64 nt, Human; identical to SEQ ID NO: 72032

SEQ ID NO: 153151 - RNA, 64 nt, Human; identical to SEQ ID NO: 72033

SEQ ID NO: 153152 - RNA, 64 nt, Human; identical to SEQ ID NO: 72034

SEQ ID NO: 153153 - RNA, 64 nt, Human; identical to SEQ ID NO: 72035

SEQ ID NO: 153154 - RNA, 64 nt, Human; identical to SEQ ID NO: 72036

SEQ ID NO: 153155 - RNA, 64 nt, Human; identical to SEQ ID NO: 72037

SEQ ID NO: 153156 - RNA, 64 nt, Human; identical to SEQ ID NO: 72038

SEQ ID NO: 153157 - RNA, 64 nt, Human; identical to SEQ ID NO: 72039

SEQ ID NO: 153158 - RNA, 64 nt, Human; identical to SEQ ID NO: 72040

SEQ ID NO: 153159 - RNA, 64 nt, Human; identical to SEQ ID NO: 72041

SEQ ID NO: 153160 - RNA, 64 nt, Human; identical to SEQ ID NO: 84733

SEQ ID NO: 153161 - RNA, 64 nt, Human; identical to SEQ ID NO: 72042

SEQ ID NO: 153162 - RNA, 64 nt, Human; identical to SEQ ID NO: 72043

SEQ ID NO: 153163 - RNA, 64 nt, Human; identical to SEQ ID NO: 72044

SEQ ID NO: 153164 - RNA, 64 nt, Human; identical to SEQ ID NO: 72045

SEQ ID NO: 153165 - RNA, 64 nt, Human; identical to SEQ ID NO: 72046

SEQ ID NO: 153166 - RNA, 64 nt, Human; identical to SEQ ID NO: 72047

SEQ ID NO: 153167 - RNA, 64 nt, Human; identical to SEQ ID NO: 72048

SEQ ID NO: 153168 - RNA, 64 nt, Human; identical to SEQ ID NO: 72049

SEQ ID NO: 153169 - RNA, 64 nt, Human; identical to SEQ ID NO: 72050

SEQ ID NO: 153170 - RNA, 64 nt, Human; identical to SEQ ID NO: 72051

SEQ ID NO: 153171 - RNA, 64 nt, Human; identical to SEQ ID NO: 72052

SEQ ID NO: 153172 - RNA, 64 nt, Human; identical to SEQ ID NO: 72053

SEQ ID NO: 153173 - RNA, 64 nt, Human; identical to SEQ ID NO: 72054

SEQ ID NO: 153174 - RNA, 64 nt, Human; identical to SEQ ID NO: 72055

SEQ ID NO: 153175 - RNA, 64 nt, Human; identical to SEQ ID NO: 72056

SEQ ID NO: 153176 - RNA, 64 nt, Human; identical to SEQ ID NO: 72057

SEQ ID NO: 153177 - RNA, 64 nt, Human; identical to SEQ ID NO: 72058

SEQ ID NO: 153178 - RNA, 64 nt, Human; identical to SEQ ID NO: 84737

SEQ ID NO: 153179 - RNA, 64 nt, Human; identical to SEQ ID NO: 72059

SEQ ID NO: 153180 - RNA, 64 nt, Human; identical to SEQ ID NO: 72060

SEQ ID NO: 153181 - RNA, 64 nt, Human; identical to SEQ ID NO: 72061

SEQ ID NO: 153182 - RNA, 64 nt, Human; identical to SEQ ID NO: 72062

SEQ ID NO: 153183 - RNA, 64 nt, Human; identical to SEQ ID NO: 72063

SEQ ID NO: 153184 - RNA, 64 nt, Human; identical to SEQ ID NO: 72064

SEQ ID NO: 153185 - RNA, 64 nt, Human; identical to SEQ ID NO: 72065

SEQ ID NO: 153186 - RNA, 64 nt, Human; identical to SEQ ID NO: 72066

SEQ ID NO: 153187 - RNA, 64 nt, Human; identical to SEQ ID NO: 72067

SEQ ID NO: 153188 - RNA, 64 nt, Human; identical to SEQ ID NO: 72068

SEQ ID NO: 153189 - RNA, 64 nt, Human; identical to SEQ ID NO: 72069

SEQ ID NO: 153190 - RNA, 56 nt, Human; identical to SEQ ID NO: 72070

SEQ ID NO: 153191 - RNA, 64 nt, Human; identical to SEQ ID NO: 72071

SEQ ID NO: 153192 - RNA, 64 nt, Human; identical to SEQ ID NO: 72072

SEQ ID NO: 153193 - RNA, 64 nt, Human; identical to SEQ ID NO: 72073

SEQ ID NO: 153194 - RNA, 64 nt, Human; identical to SEQ ID NO: 72074

SEQ ID NO: 153195 - RNA, 64 nt, Human; identical to SEQ ID NO: 72075

SEQ ID NO: 153196 - RNA, 64 nt, Human; identical to SEQ ID NO: 84741

SEQ ID NO: 153197 - RNA, 64 nt, Human; identical to SEQ ID NO: 72076

SEQ ID NO: 153198 - RNA, 64 nt, Human; identical to SEQ ID NO: 72077

SEQ ID NO: 153199 - RNA, 64 nt, Human; identical to SEQ ID NO: 72078

SEQ ID NO: 153200 - RNA, 64 nt, Human; identical to SEQ ID NO: 72079

SEQ ID NO: 153201 - RNA, 64 nt, Human; identical to SEQ ID NO: 72080

SEQ ID NO: 153202 - RNA, 64 nt, Human; identical to SEQ ID NO: 72081

SEQ ID NO: 153203 - RNA, 64 nt, Human; identical to SEQ ID NO: 72082

SEQ ID NO: 153204 - RNA, 64 nt, Human; identical to SEQ ID NO: 72083

SEQ ID NO: 153205 - RNA, 64 nt, Human; identical to SEQ ID NO: 72084

SEQ ID NO: 153206 - RNA, 64 nt, Human; identical to SEQ ID NO: 72085

SEQ ID NO: 153207 - RNA, 64 nt, Human; identical to SEQ ID NO: 72086

SEQ ID NO: 153208 - RNA, 64 nt, Human; identical to SEQ ID NO: 72087

SEQ ID NO: 153209 - RNA, 64 nt, Human; identical to SEQ ID NO: 72088

SEQ ID NO: 153210 - RNA, 64 nt, Human; identical to SEQ ID NO: 72089

SEQ ID NO: 153211 - RNA, 64 nt, Human; identical to SEQ ID NO: 72090

SEQ ID NO: 153212 - RNA, 64 nt, Human; identical to SEQ ID NO: 72091

SEQ ID NO: 153213 - RNA, 64 nt, Human; identical to SEQ ID NO: 72092

SEQ ID NO: 153214 - RNA, 64 nt, Human; identical to SEQ ID NO: 84745

SEQ ID NO: 153215 - RNA, 64 nt, Human; identical to SEQ ID NO: 72093

SEQ ID NO: 153216 - RNA, 64 nt, Human; identical to SEQ ID NO: 72094

SEQ ID NO: 153217 - RNA, 64 nt, Human; identical to SEQ ID NO: 72095

SEQ ID NO: 153218 - RNA, 64 nt, Human; identical to SEQ ID NO: 72096

SEQ ID NO: 153219 - RNA, 64 nt, Human; identical to SEQ ID NO: 72097

SEQ ID NO: 153220 - RNA, 64 nt, Human; identical to SEQ ID NO: 72098

SEQ ID NO: 153221 - RNA, 64 nt, Human; identical to SEQ ID NO: 72099

SEQ ID NO: 153222 - RNA, 64 nt, Human; identical to SEQ ID NO: 72100

SEQ ID NO: 153223 - RNA, 64 nt, Human; identical to SEQ ID NO: 72101

SEQ ID NO: 153224 - RNA, 64 nt, Human; identical to SEQ ID NO: 72102

SEQ ID NO: 153225 - RNA, 64 nt, Human; identical to SEQ ID NO: 72103

SEQ ID NO: 153226 - RNA, 64 nt, Human; identical to SEQ ID NO: 72104

SEQ ID NO: 153227 - RNA, 64 nt, Human; identical to SEQ ID NO: 72105

SEQ ID NO: 153228 - RNA, 64 nt, Human; identical to SEQ ID NO: 72106

SEQ ID NO: 153229 - RNA, 64 nt, Human; identical to SEQ ID NO: 72107

SEQ ID NO: 153230 - RNA, 64 nt, Human; identical to SEQ ID NO: 72108

SEQ ID NO: 153231 - RNA, 64 nt, Human; identical to SEQ ID NO: 72109

SEQ ID NO: 153232 - RNA, 64 nt, Human; identical to SEQ ID NO: 84749

SEQ ID NO: 153233 - RNA, 64 nt, Human; identical to SEQ ID NO: 72110

SEQ ID NO: 153234 - RNA, 64 nt, Human; identical to SEQ ID NO: 72111

SEQ ID NO: 153235 - RNA, 64 nt, Human; identical to SEQ ID NO: 72112

SEQ ID NO: 153236 - RNA, 64 nt, Human; identical to SEQ ID NO: 72113

SEQ ID NO: 153237 - RNA, 64 nt, Human; identical to SEQ ID NO: 72114

SEQ ID NO: 153238 - RNA, 64 nt, Human; identical to SEQ ID NO: 72115

SEQ ID NO: 153239 - RNA, 64 nt, Human; identical to SEQ ID NO: 72116

SEQ ID NO: 153240 - RNA, 64 nt, Human; identical to SEQ ID NO: 72117

SEQ ID NO: 153241 - RNA, 64 nt, Human; identical to SEQ ID NO: 72118

SEQ ID NO: 153242 - RNA, 64 nt, Human; identical to SEQ ID NO: 72119

SEQ ID NO: 153243 - RNA, 64 nt, Human; identical to SEQ ID NO: 72120

SEQ ID NO: 153244 - RNA, 64 nt, Human; identical to SEQ ID NO: 72121

SEQ ID NO: 153245 - RNA, 64 nt, Human; identical to SEQ ID NO: 72122

SEQ ID NO: 153246 - RNA, 64 nt, Human; identical to SEQ ID NO: 72123

SEQ ID NO: 153247 - RNA, 64 nt, Human; identical to SEQ ID NO: 72124

SEQ ID NO: 153248 - RNA, 64 nt, Human; identical to SEQ ID NO: 72125

SEQ ID NO: 153249 - RNA, 64 nt, Human; identical to SEQ ID NO: 72126

SEQ ID NO: 153250 - RNA, 64 nt, Human; identical to SEQ ID NO: 84753

SEQ ID NO: 153251 - RNA, 64 nt, Human; identical to SEQ ID NO: 72127

SEQ ID NO: 153252 - RNA, 64 nt, Human; identical to SEQ ID NO: 72128

SEQ ID NO: 153253 - RNA, 64 nt, Human; identical to SEQ ID NO: 72129

SEQ ID NO: 153254 - RNA, 64 nt, Human; identical to SEQ ID NO: 72130

SEQ ID NO: 153255 - RNA, 64 nt, Human; identical to SEQ ID NO: 72131

SEQ ID NO: 153256 - RNA, 64 nt, Human; identical to SEQ ID NO: 72132

SEQ ID NO: 153257 - RNA, 64 nt, Human; identical to SEQ ID NO: 72133

SEQ ID NO: 153258 - RNA, 64 nt, Human; identical to SEQ ID NO: 72134

SEQ ID NO: 153259 - RNA, 64 nt, Human; identical to SEQ ID NO: 72135

SEQ ID NO: 153260 - RNA, 64 nt, Human; identical to SEQ ID NO: 72136

SEQ ID NO: 153261 - RNA, 64 nt, Human; identical to SEQ ID NO: 72137

SEQ ID NO: 153262 - RNA, 64 nt, Human; identical to SEQ ID NO: 72138

SEQ ID NO: 153263 - RNA, 64 nt, Human; identical to SEQ ID NO: 72139

SEQ ID NO: 153264 - RNA, 64 nt, Human; identical to SEQ ID NO: 72140

SEQ ID NO: 153265 - RNA, 64 nt, Human; identical to SEQ ID NO: 72141

SEQ ID NO: 153266 - RNA, 64 nt, Human; identical to SEQ ID NO: 72142

SEQ ID NO: 153267 - RNA, 64 nt, Human; identical to SEQ ID NO: 72143

SEQ ID NO: 153268 - RNA, 64 nt, Human; identical to SEQ ID NO: 84757

SEQ ID NO: 153269 - RNA, 64 nt, Human; identical to SEQ ID NO: 72144

SEQ ID NO: 153270 - RNA, 64 nt, Human; identical to SEQ ID NO: 72145

SEQ ID NO: 153271 - RNA, 64 nt, Human; identical to SEQ ID NO: 72146

SEQ ID NO: 153272 - RNA, 64 nt, Human; identical to SEQ ID NO: 72147

SEQ ID NO: 153273 - RNA, 64 nt, Human; identical to SEQ ID NO: 72148

SEQ ID NO: 153274 - RNA, 64 nt, Human; identical to SEQ ID NO: 72149

SEQ ID NO: 153275 - RNA, 64 nt, Human; identical to SEQ ID NO: 72150

SEQ ID NO: 153276 - RNA, 64 nt, Human; identical to SEQ ID NO: 72151

SEQ ID NO: 153277 - RNA, 64 nt, Human; identical to SEQ ID NO: 72152

SEQ ID NO: 153278 - RNA, 64 nt, Human; identical to SEQ ID NO: 72153

SEQ ID NO: 153279 - RNA, 64 nt, Human; identical to SEQ ID NO: 72154

SEQ ID NO: 153280 - RNA, 54 nt, Human; identical to SEQ ID NO: 72155

SEQ ID NO: 153281 - RNA, 64 nt, Human; identical to SEQ ID NO: 72156

SEQ ID NO: 153282 - RNA, 64 nt, Human; identical to SEQ ID NO: 72157

SEQ ID NO: 153283 - RNA, 64 nt, Human; identical to SEQ ID NO: 72158

SEQ ID NO: 153284 - RNA, 64 nt, Human; identical to SEQ ID NO: 72159

SEQ ID NO: 153285 - RNA, 64 nt, Human; identical to SEQ ID NO: 72160

SEQ ID NO: 153286 - RNA, 64 nt, Human; identical to SEQ ID NO: 72161

SEQ ID NO: 153287 - RNA, 64 nt, Human; identical to SEQ ID NO: 72162

SEQ ID NO: 153288 - RNA, 64 nt, Human; identical to SEQ ID NO: 72163

SEQ ID NO: 153289 - RNA, 64 nt, Human; identical to SEQ ID NO: 72164

SEQ ID NO: 153290 - RNA, 64 nt, Human; identical to SEQ ID NO: 72165

SEQ ID NO: 153291 - RNA, 64 nt, Human; identical to SEQ ID NO: 72166

SEQ ID NO: 153292 - RNA, 64 nt, Human; identical to SEQ ID NO: 72167

SEQ ID NO: 153293 - RNA, 64 nt, Human; identical to SEQ ID NO: 72168

SEQ ID NO: 153294 - RNA, 64 nt, Human; identical to SEQ ID NO: 72169

SEQ ID NO: 153295 - RNA, 64 nt, Human; identical to SEQ ID NO: 72170

SEQ ID NO: 153296 - RNA, 64 nt, Human; identical to SEQ ID NO: 72171

SEQ ID NO: 153297 - RNA, 64 nt, Human; identical to SEQ ID NO: 72172

SEQ ID NO: 153298 - RNA, 64 nt, Human; identical to SEQ ID NO: 72173

SEQ ID NO: 153299 - RNA, 64 nt, Human; identical to SEQ ID NO: 72174

SEQ ID NO: 153300 - RNA, 64 nt, Human; identical to SEQ ID NO: 72175

SEQ ID NO: 153301 - RNA, 64 nt, Human; identical to SEQ ID NO: 72176

SEQ ID NO: 153302 - RNA, 64 nt, Human; identical to SEQ ID NO: 72177

SEQ ID NO: 153303 - RNA, 64 nt, Human; identical to SEQ ID NO: 72178

SEQ ID NO: 153304 - RNA, 64 nt, Human; identical to SEQ ID NO: 84761

SEQ ID NO: 153305 - RNA, 64 nt, Human; identical to SEQ ID NO: 72179

SEQ ID NO: 153306 - RNA, 64 nt, Human; identical to SEQ ID NO: 72180

SEQ ID NO: 153307 - RNA, 64 nt, Human; identical to SEQ ID NO: 72181

SEQ ID NO: 153308 - RNA, 64 nt, Human; identical to SEQ ID NO: 72182

SEQ ID NO: 153309 - RNA, 64 nt, Human; identical to SEQ ID NO: 72183

SEQ ID NO: 153310 - RNA, 64 nt, Human; identical to SEQ ID NO: 72184

SEQ ID NO: 153311 - RNA, 64 nt, Human; identical to SEQ ID NO: 72185

SEQ ID NO: 153312 - RNA, 64 nt, Human; identical to SEQ ID NO: 72186

SEQ ID NO: 153313 - RNA, 64 nt, Human; identical to SEQ ID NO: 72187

SEQ ID NO: 153314 - RNA, 64 nt, Human; identical to SEQ ID NO: 72188

SEQ ID NO: 153315 - RNA, 64 nt, Human; identical to SEQ ID NO: 72189

SEQ ID NO: 153316 - RNA, 64 nt, Human; identical to SEQ ID NO: 72190

SEQ ID NO: 153317 - RNA, 64 nt, Human; identical to SEQ ID NO: 72191

SEQ ID NO: 153318 - RNA, 64 nt, Human; identical to SEQ ID NO: 72192

SEQ ID NO: 153319 - RNA, 64 nt, Human; identical to SEQ ID NO: 72193

SEQ ID NO: 153320 - RNA, 64 nt, Human; identical to SEQ ID NO: 72194

SEQ ID NO: 153321 - RNA, 64 nt, Human; identical to SEQ ID NO: 72195

SEQ ID NO: 153322 - RNA, 64 nt, Human; identical to SEQ ID NO: 84765

SEQ ID NO: 153323 - RNA, 64 nt, Human; identical to SEQ ID NO: 72196

SEQ ID NO: 153324 - RNA, 64 nt, Human; identical to SEQ ID NO: 72197

SEQ ID NO: 153325 - RNA, 64 nt, Human; identical to SEQ ID NO: 72198

SEQ ID NO: 153326 - RNA, 64 nt, Human; identical to SEQ ID NO: 72199

SEQ ID NO: 153327 - RNA, 64 nt, Human; identical to SEQ ID NO: 72200

SEQ ID NO: 153328 - RNA, 64 nt, Human; identical to SEQ ID NO: 72201

SEQ ID NO: 153329 - RNA, 64 nt, Human; identical to SEQ ID NO: 71728

SEQ ID NO: 153330 - RNA, 64 nt, Human; identical to SEQ ID NO: 72203

SEQ ID NO: 153331 - RNA, 64 nt, Human; identical to SEQ ID NO: 72204

SEQ ID NO: 153332 - RNA, 64 nt, Human; identical to SEQ ID NO: 72205

SEQ ID NO: 153333 - RNA, 64 nt, Human; identical to SEQ ID NO: 72206

SEQ ID NO: 153334 - RNA, 64 nt, Human; identical to SEQ ID NO: 72207

SEQ ID NO: 153335 - RNA, 64 nt, Human; identical to SEQ ID NO: 72208

SEQ ID NO: 153336 - RNA, 64 nt, Human; identical to SEQ ID NO: 72209

SEQ ID NO: 153337 - RNA, 64 nt, Human; identical to SEQ ID NO: 72210

SEQ ID NO: 153338 - RNA, 64 nt, Human; identical to SEQ ID NO: 72211

SEQ ID NO: 153339 - RNA, 64 nt, Human; identical to SEQ ID NO: 72212

SEQ ID NO: 153340 - RNA, 64 nt, Human; identical to SEQ ID NO: 84769

SEQ ID NO: 153341 - RNA, 64 nt, Human; identical to SEQ ID NO: 72213

SEQ ID NO: 153342 - RNA, 64 nt, Human; identical to SEQ ID NO: 72214

SEQ ID NO: 153343 - RNA, 64 nt, Human; identical to SEQ ID NO: 72215

SEQ ID NO: 153344 - RNA, 64 nt, Human; identical to SEQ ID NO: 72216

SEQ ID NO: 153345 - RNA, 64 nt, Human; identical to SEQ ID NO: 72217

SEQ ID NO: 153346 - RNA, 64 nt, Human; identical to SEQ ID NO: 72218

SEQ ID NO: 153347 - RNA, 64 nt, Human; identical to SEQ ID NO: 72219

SEQ ID NO: 153348 - RNA, 64 nt, Human; identical to SEQ ID NO: 72220

SEQ ID NO: 153349 - RNA, 64 nt, Human; identical to SEQ ID NO: 72221

SEQ ID NO: 153350 - RNA, 64 nt, Human; identical to SEQ ID NO: 72222

SEQ ID NO: 153351 - RNA, 64 nt, Human; identical to SEQ ID NO: 72223

SEQ ID NO: 153352 - RNA, 64 nt, Human; identical to SEQ ID NO: 72224

SEQ ID NO: 153353 - RNA, 64 nt, Human; identical to SEQ ID NO: 72225

SEQ ID NO: 153354 - RNA, 64 nt, Human; identical to SEQ ID NO: 72226

SEQ ID NO: 153355 - RNA, 64 nt, Human; identical to SEQ ID NO: 72227

SEQ ID NO: 153356 - RNA, 64 nt, Human; identical to SEQ ID NO: 72228

SEQ ID NO: 153357 - RNA, 64 nt, Human; identical to SEQ ID NO: 72229

SEQ ID NO: 153358 - RNA, 64 nt, Human; identical to SEQ ID NO: 84772

SEQ ID NO: 153359 - RNA, 62 nt, Human; identical to SEQ ID NO: 72230

SEQ ID NO: 153360 - RNA, 64 nt, Human; identical to SEQ ID NO: 72231

SEQ ID NO: 153361 - RNA, 64 nt, Human; identical to SEQ ID NO: 72232

SEQ ID NO: 153362 - RNA, 64 nt, Human; identical to SEQ ID NO: 72233

SEQ ID NO: 153363 - RNA, 64 nt, Human; identical to SEQ ID NO: 72222

SEQ ID NO: 153364 - RNA, 64 nt, Human; identical to SEQ ID NO: 72235

SEQ ID NO: 153365 - RNA, 64 nt, Human; identical to SEQ ID NO: 72236

SEQ ID NO: 153366 - RNA, 64 nt, Human; identical to SEQ ID NO: 72237

SEQ ID NO: 153367 - RNA, 64 nt, Human; identical to SEQ ID NO: 121340

SEQ ID NO: 153368 - RNA, 64 nt, Human; identical to SEQ ID NO: 121341

SEQ ID NO: 153369 - RNA, 63 nt, Human; identical to SEQ ID NO: 121342

SEQ ID NO: 153370 - RNA, 64 nt, Human; identical to SEQ ID NO: 121343

SEQ ID NO: 153371 - RNA, 64 nt, Human; identical to SEQ ID NO: 121344

SEQ ID NO: 153372 - RNA, 64 nt, Human; identical to SEQ ID NO: 121345

SEQ ID NO: 153373 - RNA, 64 nt, Human; identical to SEQ ID NO: 121346

SEQ ID NO: 153374 - RNA, 64 nt, Human; identical to SEQ ID NO: 121347

SEQ ID NO: 153375 - RNA, 64 nt, Human; identical to SEQ ID NO: 121348

SEQ ID NO: 153376 - RNA, 64 nt, Human; identical to SEQ ID NO: 121349

SEQ ID NO: 153377 - RNA, 64 nt, Human; identical to SEQ ID NO: 121350

SEQ ID NO: 153378 - RNA, 64 nt, Human; identical to SEQ ID NO: 121351

SEQ ID NO: 153379 - RNA, 64 nt, Human; identical to SEQ ID NO: 121352

SEQ ID NO: 153380 - RNA, 64 nt, Human; identical to SEQ ID NO: 121353

SEQ ID NO: 153381 - RNA, 64 nt, Human; identical to SEQ ID NO: 121354

SEQ ID NO: 153382 - RNA, 64 nt, Human; identical to SEQ ID NO: 121355

SEQ ID NO: 153383 - RNA, 64 nt, Human; identical to SEQ ID NO: 121356

SEQ ID NO: 153384 - RNA, 64 nt, Human; identical to SEQ ID NO: 121357

SEQ ID NO: 153385 - RNA, 64 nt, Human; identical to SEQ ID NO: 121358

SEQ ID NO: 153386 - RNA, 64 nt, Human; identical to SEQ ID NO: 121359

SEQ ID NO: 153387 - RNA, 64 nt, Human; identical to SEQ ID NO: 121360

SEQ ID NO: 153388 - RNA, 64 nt, Human; identical to SEQ ID NO: 121361

SEQ ID NO: 153389 - RNA, 64 nt, Human; identical to SEQ ID NO: 121362

SEQ ID NO: 153390 - RNA, 64 nt, Human; identical to SEQ ID NO: 121363

SEQ ID NO: 153391 - RNA, 64 nt, Human; identical to SEQ ID NO: 121364

SEQ ID NO: 153392 - RNA, 64 nt, Human; identical to SEQ ID NO: 121365

SEQ ID NO: 153393 - RNA, 64 nt, Human; identical to SEQ ID NO: 121366

SEQ ID NO: 153394 - RNA, 64 nt, Human; identical to SEQ ID NO: 121367

SEQ ID NO: 153395 - RNA, 64 nt, Human; identical to SEQ ID NO: 121368

SEQ ID NO: 153396 - RNA, 64 nt, Human; identical to SEQ ID NO: 121369

SEQ ID NO: 153397 - RNA, 64 nt, Human; identical to SEQ ID NO: 121370

SEQ ID NO: 153398 - RNA, 64 nt, Human; identical to SEQ ID NO: 121371

SEQ ID NO: 153399 - RNA, 64 nt, Human; identical to SEQ ID NO: 121372

SEQ ID NO: 153400 - RNA, 64 nt, Human; identical to SEQ ID NO: 121373

SEQ ID NO: 153401 - RNA, 64 nt, Human; identical to SEQ ID NO: 121374

SEQ ID NO: 153402 - RNA, 64 nt, Human; identical to SEQ ID NO: 121375

SEQ ID NO: 153403 - RNA, 52 nt, Human; identical to SEQ ID NO: 121376

SEQ ID NO: 153404 - RNA, 64 nt, Human; identical to SEQ ID NO: 121377

SEQ ID NO: 153405 - RNA, 64 nt, Human; identical to SEQ ID NO: 121378

SEQ ID NO: 153406 - RNA, 64 nt, Human; identical to SEQ ID NO: 121379

SEQ ID NO: 153407 - RNA, 64 nt, Human; identical to SEQ ID NO: 121380

SEQ ID NO: 153408 - RNA, 64 nt, Human; identical to SEQ ID NO: 121381

SEQ ID NO: 153409 - RNA, 64 nt, Human; identical to SEQ ID NO: 121382

SEQ ID NO: 153410 - RNA, 64 nt, Human; identical to SEQ ID NO: 121383

SEQ ID NO: 153411 - RNA, 64 nt, Human; identical to SEQ ID NO: 121384

SEQ ID NO: 153412 - RNA, 64 nt, Human; identical to SEQ ID NO: 121385

SEQ ID NO: 153413 - RNA, 64 nt, Human; identical to SEQ ID NO: 121386

SEQ ID NO: 153414 - RNA, 64 nt, Human; identical to SEQ ID NO: 121387

SEQ ID NO: 153415 - RNA, 64 nt, Human; identical to SEQ ID NO: 121388

SEQ ID NO: 153416 - RNA, 64 nt, Human; identical to SEQ ID NO: 121389

SEQ ID NO: 153417 - RNA, 64 nt, Human; identical to SEQ ID NO: 121390

SEQ ID NO: 153418 - RNA, 64 nt, Human; identical to SEQ ID NO: 121391

SEQ ID NO: 153419 - RNA, 64 nt, Human; identical to SEQ ID NO: 121392

SEQ ID NO: 153420 - RNA, 64 nt, Human; identical to SEQ ID NO: 121393

SEQ ID NO: 153421 - RNA, 64 nt, Human; identical to SEQ ID NO: 121394

SEQ ID NO: 153422 - RNA, 64 nt, Human; identical to SEQ ID NO: 121395

SEQ ID NO: 153423 - RNA, 64 nt, Human; identical to SEQ ID NO: 121396

SEQ ID NO: 153424 - RNA, 64 nt, Human; identical to SEQ ID NO: 121397

SEQ ID NO: 153425 - RNA, 64 nt, Human; identical to SEQ ID NO: 121398

SEQ ID NO: 153426 - RNA, 64 nt, Human; identical to SEQ ID NO: 121399

SEQ ID NO: 153427 - RNA, 64 nt, Human; identical to SEQ ID NO: 121400

SEQ ID NO: 153428 - RNA, 64 nt, Human; identical to SEQ ID NO: 121401

SEQ ID NO: 153429 - RNA, 64 nt, Human; identical to SEQ ID NO: 121402

SEQ ID NO: 153430 - RNA, 64 nt, Human; identical to SEQ ID NO: 121403

SEQ ID NO: 153431 - RNA, 64 nt, Human; identical to SEQ ID NO: 121404

SEQ ID NO: 153432 - RNA, 64 nt, Human; identical to SEQ ID NO: 121405

SEQ ID NO: 153433 - RNA, 64 nt, Human; identical to SEQ ID NO: 121406

SEQ ID NO: 153434 - RNA, 64 nt, Human; identical to SEQ ID NO: 121407

SEQ ID NO: 153435 - RNA, 61 nt, Human; identical to SEQ ID NO: 121408

SEQ ID NO: 153436 - RNA, 64 nt, Human; identical to SEQ ID NO: 121409

SEQ ID NO: 153437 - RNA, 51 nt, Human; identical to SEQ ID NO: 121410

SEQ ID NO: 153438 - RNA, 64 nt, Human; identical to SEQ ID NO: 121411

SEQ ID NO: 153439 - RNA, 64 nt, Human; identical to SEQ ID NO: 121412

SEQ ID NO: 153440 - RNA, 64 nt, Human; identical to SEQ ID NO: 121413

SEQ ID NO: 153441 - RNA, 64 nt, Human; identical to SEQ ID NO: 121414

SEQ ID NO: 153442 - RNA, 64 nt, Human; identical to SEQ ID NO: 121415

SEQ ID NO: 153443 - RNA, 64 nt, Human; identical to SEQ ID NO: 121416

SEQ ID NO: 153444 - RNA, 64 nt, Human; identical to SEQ ID NO: 121417

SEQ ID NO: 153445 - RNA, 64 nt, Human; identical to SEQ ID NO: 121418

SEQ ID NO: 153446 - RNA, 64 nt, Human; identical to SEQ ID NO: 121419

SEQ ID NO: 153447 - RNA, 64 nt, Human; identical to SEQ ID NO: 121420

SEQ ID NO: 153448 - RNA, 64 nt, Human; identical to SEQ ID NO: 121421

SEQ ID NO: 153449 - RNA, 64 nt, Human; identical to SEQ ID NO: 121422

SEQ ID NO: 153450 - RNA, 64 nt, Human; identical to SEQ ID NO: 121423

SEQ ID NO: 153451 - RNA, 64 nt, Human; identical to SEQ ID NO: 121424

SEQ ID NO: 153452 - RNA, 64 nt, Human; identical to SEQ ID NO: 121425

SEQ ID NO: 153453 - RNA, 64 nt, Human; identical to SEQ ID NO: 121426

SEQ ID NO: 153454 - RNA, 64 nt, Human; identical to SEQ ID NO: 121427

SEQ ID NO: 153455 - RNA, 64 nt, Human; identical to SEQ ID NO: 121428

SEQ ID NO: 153456 - RNA, 64 nt, Human; identical to SEQ ID NO: 121429

SEQ ID NO: 153457 - RNA, 64 nt, Human; identical to SEQ ID NO: 121430

SEQ ID NO: 153458 - RNA, 64 nt, Human; identical to SEQ ID NO: 121431

SEQ ID NO: 153459 - RNA, 64 nt, Human; identical to SEQ ID NO: 121432

SEQ ID NO: 153460 - RNA, 64 nt, Human; identical to SEQ ID NO: 121433

SEQ ID NO: 153461 - RNA, 64 nt, Human; identical to SEQ ID NO: 121434

SEQ ID NO: 153462 - RNA, 64 nt, Human; identical to SEQ ID NO: 121435

SEQ ID NO: 153463 - RNA, 64 nt, Human; identical to SEQ ID NO: 64674

SEQ ID NO: 153464 - RNA, 64 nt, Human; identical to SEQ ID NO: 64675

SEQ ID NO: 153465 - RNA, 64 nt, Human; identical to SEQ ID NO: 64676

SEQ ID NO: 153466 - RNA, 64 nt, Human; identical to SEQ ID NO: 64677

SEQ ID NO: 153467 - RNA, 64 nt, Human; identical to SEQ ID NO: 64678

SEQ ID NO: 153468 - RNA, 64 nt, Human; identical to SEQ ID NO: 64679

SEQ ID NO: 153469 - RNA, 64 nt, Human; identical to SEQ ID NO: 64680

SEQ ID NO: 153470 - RNA, 64 nt, Human; identical to SEQ ID NO: 64681

SEQ ID NO: 153471 - RNA, 64 nt, Human; identical to SEQ ID NO: 64682

SEQ ID NO: 153472 - RNA, 63 nt, Human; identical to SEQ ID NO: 64683

SEQ ID NO: 153473 - RNA, 53 nt, Human; identical to SEQ ID NO: 64684

SEQ ID NO: 153474 - RNA, 64 nt, Human; identical to SEQ ID NO: 64685

SEQ ID NO: 153475 - RNA, 64 nt, Human; identical to SEQ ID NO: 64686

SEQ ID NO: 153476 - RNA, 64 nt, Human; identical to SEQ ID NO: 64687

SEQ ID NO: 153477 - RNA, 64 nt, Human; identical to SEQ ID NO: 64688

SEQ ID NO: 153478 - RNA, 64 nt, Human; identical to SEQ ID NO: 64689

SEQ ID NO: 153479 - RNA, 64 nt, Human; identical to SEQ ID NO: 64690

SEQ ID NO: 153480 - RNA, 64 nt, Human; identical to SEQ ID NO: 64691

SEQ ID NO: 153481 - RNA, 64 nt, Human; identical to SEQ ID NO: 64692

SEQ ID NO: 153482 - RNA, 64 nt, Human; identical to SEQ ID NO: 64693

SEQ ID NO: 153483 - RNA, 64 nt, Human; identical to SEQ ID NO: 64694

SEQ ID NO: 153484 - RNA, 64 nt, Human; identical to SEQ ID NO: 64695

SEQ ID NO: 153485 - RNA, 64 nt, Human; identical to SEQ ID NO: 64696

SEQ ID NO: 153486 - RNA, 64 nt, Human; identical to SEQ ID NO: 64697

SEQ ID NO: 153487 - RNA, 64 nt, Human; identical to SEQ ID NO: 64698

SEQ ID NO: 153488 - RNA, 64 nt, Human; identical to SEQ ID NO: 64699

SEQ ID NO: 153489 - RNA, 64 nt, Human; identical to SEQ ID NO: 64700

SEQ ID NO: 153490 - RNA, 64 nt, Human; identical to SEQ ID NO: 64701

SEQ ID NO: 153491 - RNA, 64 nt, Human; identical to SEQ ID NO: 64702

SEQ ID NO: 153492 - RNA, 64 nt, Human; identical to SEQ ID NO: 64703

SEQ ID NO: 153493 - RNA, 64 nt, Human; identical to SEQ ID NO: 64704

SEQ ID NO: 153494 - RNA, 64 nt, Human; identical to SEQ ID NO: 64705

SEQ ID NO: 153495 - RNA, 64 nt, Human; identical to SEQ ID NO: 64706

SEQ ID NO: 153496 - RNA, 64 nt, Human; identical to SEQ ID NO: 64707

SEQ ID NO: 153497 - RNA, 64 nt, Human; identical to SEQ ID NO: 64708

SEQ ID NO: 153498 - RNA, 64 nt, Human; identical to SEQ ID NO: 64709

SEQ ID NO: 153499 - RNA, 64 nt, Human; identical to SEQ ID NO: 64710

SEQ ID NO: 153500 - RNA, 64 nt, Human; identical to SEQ ID NO: 64711

SEQ ID NO: 153501 - RNA, 64 nt, Human; identical to SEQ ID NO: 64712

SEQ ID NO: 153502 - RNA, 64 nt, Human; identical to SEQ ID NO: 64713

SEQ ID NO: 153503 - RNA, 64 nt, Human; identical to SEQ ID NO: 64714

SEQ ID NO: 153504 - RNA, 64 nt, Human; identical to SEQ ID NO: 64715

SEQ ID NO: 153505 - RNA, 64 nt, Human; identical to SEQ ID NO: 64716

SEQ ID NO: 153506 - RNA, 64 nt, Human; identical to SEQ ID NO: 64717

SEQ ID NO: 153507 - RNA, 64 nt, Human; identical to SEQ ID NO: 64718

SEQ ID NO: 153508 - RNA, 64 nt, Human; identical to SEQ ID NO: 64719

SEQ ID NO: 153509 - RNA, 64 nt, Human; identical to SEQ ID NO: 64720

SEQ ID NO: 153510 - RNA, 64 nt, Human; identical to SEQ ID NO: 64721

SEQ ID NO: 153511 - RNA, 64 nt, Human; identical to SEQ ID NO: 64722

SEQ ID NO: 153512 - RNA, 64 nt, Human; identical to SEQ ID NO: 64723

SEQ ID NO: 153513 - RNA, 64 nt, Human; identical to SEQ ID NO: 64724

SEQ ID NO: 153514 - RNA, 64 nt, Human; identical to SEQ ID NO: 64725

SEQ ID NO: 153515 - RNA, 64 nt, Human; identical to SEQ ID NO: 64726

SEQ ID NO: 153516 - RNA, 64 nt, Human; identical to SEQ ID NO: 64727

SEQ ID NO: 153517 - RNA, 64 nt, Human; identical to SEQ ID NO: 64728

SEQ ID NO: 153518 - RNA, 64 nt, Human; identical to SEQ ID NO: 64729

SEQ ID NO: 153519 - RNA, 64 nt, Human; identical to SEQ ID NO: 64730

SEQ ID NO: 153520 - RNA, 64 nt, Human; identical to SEQ ID NO: 64731

SEQ ID NO: 153521 - RNA, 64 nt, Human; identical to SEQ ID NO: 64732

SEQ ID NO: 153522 - RNA, 64 nt, Human; identical to SEQ ID NO: 64733

SEQ ID NO: 153523 - RNA, 64 nt, Human; identical to SEQ ID NO: 64734

SEQ ID NO: 153524 - RNA, 64 nt, Human; identical to SEQ ID NO: 64735

SEQ ID NO: 153525 - RNA, 64 nt, Human; identical to SEQ ID NO: 64736

SEQ ID NO: 153526 - RNA, 64 nt, Human; identical to SEQ ID NO: 64737

SEQ ID NO: 153527 - RNA, 64 nt, Human; identical to SEQ ID NO: 64738

SEQ ID NO: 153528 - RNA, 64 nt, Human; identical to SEQ ID NO: 64739

SEQ ID NO: 153529 - RNA, 64 nt, Human; identical to SEQ ID NO: 64740

SEQ ID NO: 153530 - RNA, 64 nt, Human; identical to SEQ ID NO: 64741

SEQ ID NO: 153531 - RNA, 64 nt, Human; identical to SEQ ID NO: 64742

SEQ ID NO: 153532 - RNA, 52 nt, Human; identical to SEQ ID NO: 64743

SEQ ID NO: 153533 - RNA, 64 nt, Human; identical to SEQ ID NO: 64744

SEQ ID NO: 153534 - RNA, 58 nt, Human; identical to SEQ ID NO: 64745

SEQ ID NO: 153535 - RNA, 64 nt, Human; identical to SEQ ID NO: 64746

SEQ ID NO: 153536 - RNA, 64 nt, Human; identical to SEQ ID NO: 64747

SEQ ID NO: 153537 - RNA, 64 nt, Human; identical to SEQ ID NO: 64748

SEQ ID NO: 153538 - RNA, 64 nt, Human; identical to SEQ ID NO: 64749

SEQ ID NO: 153539 - RNA, 64 nt, Human; identical to SEQ ID NO: 64750

SEQ ID NO: 153540 - RNA, 64 nt, Human; identical to SEQ ID NO: 64751

SEQ ID NO: 153541 - RNA, 64 nt, Human; identical to SEQ ID NO: 64752

SEQ ID NO: 153542 - RNA, 64 nt, Human; identical to SEQ ID NO: 64753

SEQ ID NO: 153543 - RNA, 64 nt, Human; identical to SEQ ID NO: 64754

SEQ ID NO: 153544 - RNA, 64 nt, Human; identical to SEQ ID NO: 64755

SEQ ID NO: 153545 - RNA, 64 nt, Human; identical to SEQ ID NO: 64756

SEQ ID NO: 153546 - RNA, 64 nt, Human; identical to SEQ ID NO: 64757

SEQ ID NO: 153547 - RNA, 62 nt, Human
cugccgcaaggagcagagacagcacagccccccgggcccagccgccucccucucuugggacg

SEQ ID NO: 153548 - RNA, 62 nt, Human
agguggggaccuggggggagggacagggcaggcgggcccaugaagaaagccccucguugccc

SEQ ID NO: 153549 - RNA, 62 nt, Human
ugggacaccggagaaccuaucaugucagccagcgggcccacacgucggaccccgguuggcca

SEQ ID NO: 153550 - RNA, 62 nt, Human
aggaccaaagggugcagugaugggcuggguggcgggcccagggaaaugggguggggaugggc

SEQ ID NO: 153551 - RNA, 62 nt, Human
cgccugaggcuugcugucuguucucggcaccccgggcccauacaggaccagggcagcagcau

SEQ ID NO: 153552 - RNA, 62 nt, Human
ggccuuuggugaccacugagaaggacacuucacgggcccagagcuccugguacugcccuucc

SEQ ID NO: 153553 - RNA, 62 nt, Human
ccugccacuggugccucgaguagccauggcaacgggcccaguguccagucacuuagaaguuc

SEQ ID NO: 153554 - RNA, 62 nt, Human
accugaggccaccagaagacacuuccaucccucgggcccagcaguacacacuugguuuccag

SEQ ID NO: 153555 - RNA, 62 nt, Human
cagggcuccuggacccaggcuuucccauaccacgggcccaggacuguggcuccuuuucuaaa

SEQ ID NO: 153556 - RNA, 62 nt, Human
ugcccguguacauagugcauuguuucugugggcgggcccagcacuuuccgucaacguuguac

SEQ ID NO: 153557 - RNA, 62 nt, Human
caaagucucgacucacugcagccuugaccucccgggcccagguaguccucccaccucagccu

SEQ ID NO: 153558 - RNA, 54 nt, Human
cucgcugccucauccucugaacaccgggcccaaccugaucugauccagaucuug

SEQ ID NO: 153559 - RNA, 62 nt, Human
cucacagccacccugaagauagacuauaggaacgggcccauaccacacagacugcucuccaa

SEQ ID NO: 153560 - RNA, 62 nt, Human
cugcaguagcuguggccucacccugaagucagcgggcccaggccuaccucacucucucccuu

SEQ ID NO: 153561 - RNA, 62 nt, Human
ucagcagcccuggcagaacugaagagcggcaccgggcccagcaggcaaagagagaggccucc

SEQ ID NO: 153562 - RNA, 62 nt, Human
ggaacuuggggggauggcgaaugguuccugcccgggcccaaggggugcacagggcaccucca

SEQ ID NO: 153563 - RNA, 62 nt, Human
ggcccucaccugccggcgcccacagucaggcccgggcccagcgcggccagugcuccuccugc

SEQ ID NO: 153564 - RNA, 62 nt, Human
aucagaggagacugaagcagaaacccugcacacgggcccaggauguggcugauuuugugguu

SEQ ID NO: 153565 - RNA, 62 nt, Human
acugcacuaagccagugcggagcuguuagggacgggcccagcuccugcaccacggacacaga

SEQ ID NO: 153566 - RNA, 62 nt, Human
gggacucaauuaaacccgcccggagaccacgccgggcccagcgcgucugccuucuugacuca

SEQ ID NO: 153567 - RNA, 62 nt, Human
cgccugcccaccgggcggggucgcugguuggccgggcccaggcgcgcggggacgcggaggcc

SEQ ID NO: 153568 - RNA, 62 nt, Human
aguguagacgcgccggcucgggcggcgggcuccgggcccagccucgcagcggccaggagcgc

SEQ ID NO: 153569 - RNA, 62 nt, Human
cugcaucuggccugcugcuccccaguuccacacgggcccagugcugccccugcugcugcagg

SEQ ID NO: 153570 - RNA, 62 nt, Human
uuucuuucccaaaaugugccucccuuccgcugcgggcccagcugagucuauguaggugaugu

SEQ ID NO: 153571 - RNA, 62 nt, Human
ucccgcagggccuuggggcacugccuugccaucgggcccaguucuccgggccccaccugcac

SEQ ID NO: 153572 - RNA, 62 nt, Human
aauaaaaguaaacaagauagagcuugggcuugcgggcccaguuccagagguggaaguuacag

SEQ ID NO: 153573 - RNA, 62 nt, Human
aggucccacuccucagccuacacgcagaggaacgggcccaccucagagucacaccacuggcu

SEQ ID NO: 153574 - RNA, 62 nt, Human
cgagcucaggaggccgccugaggacugcacaccgggcccacaccucuccugccccucccucc

SEQ ID NO: 153575 - RNA, 62 nt, Human
uagugagugacugauugcuucauuuuaucaggcgggcccauugugaaagagcucaggggaaa

SEQ ID NO: 153576 - RNA, 62 nt, Human
gggaaagguggggaagaaggggaucucccucccgggcccacccagcugcccagccuuugccc

SEQ ID NO: 153577 - RNA, 62 nt, Human
ggaauucaaguuaccaauguaacacuggccagcgggcccagcaaucuccauguguacuuauu

SEQ ID NO: 153578 - RNA, 62 nt, Human
gcuggccuagcaagaugugcucucagaauggccgggcccaagagaugaaggaaaggagugaa

SEQ ID NO: 153579 - RNA, 56 nt, Human
ucgucuaugacuguaacugaaguggccgggcccagacaugccccuuccaaaacugg

SEQ ID NO: 153580 - RNA, 62 nt, Human
ugggcccagcucaugccucgcgguggccucuccgggcccagcucccacccagccugacggcg

SEQ ID NO: 153581 - RNA, 62 nt, Human
ccgguccaguggcugccucccggccuccucuccgggcccagcucuuugcucgcgucugcgcc

SEQ ID NO: 153582 - RNA, 62 nt, Human
gccaccacccugagauuaugcggcucuucccucgggcccagaugcagacggugccgaacgcu

SEQ ID NO: 153583 - RNA, 62 nt, Human
gaaccuuggugcagcugcagccaggaggggagcgggcccaggagccaggcucagguccagcu

SEQ ID NO: 153584 - RNA, 62 nt, Human
uucaguggcgauggcaugacagagcuagagcucgggcccagccccaggcugcagcccauucg

SEQ ID NO: 153585 - RNA, 62 nt, Human
ccaugggaauuccuccaucugcagcggucacacgggcccacccugcccuuccccaggucggc

SEQ ID NO: 153586 - RNA, 62 nt, Human
cugacuugggugagcuggaguugggggugucucgggcccaggcccuggcagagaaacaggga

SEQ ID NO: 153587 - RNA, 62 nt, Human
gaagccccuuccccaugggaagacgaggcccucgggcccagcccccacagugcugucugauc

SEQ ID NO: 153588 - RNA, 62 nt, Human
ucucugggucccggggugcauuuguuacucaucgggcccagggacauugcagaguggccuag

SEQ ID NO: 153589 - RNA, 62 nt, Human
cgagcccacgaggcuguugaggccccugcagccgggcccagcucuucuguccuuggccacca

SEQ ID NO: 153590 - RNA, 62 nt, Human
gcugccugguguguccucagcucccagggcugcgggcccaccguuuacaugugcacgcccug

SEQ ID NO: 153591 - RNA, 62 nt, Human
gaggggucgugcggaggauccuguauugugcccgggcccauggggaggacgauggugaggag

SEQ ID NO: 153592 - RNA, 55 nt, Human
cgccgcaccaaaugacuuaggccugcgggcccauccuuugugcccacccguucug

SEQ ID NO: 153593 - RNA, 62 nt, Human
ccagccaccuucccagaccugcggccucaccgcgggcccagugcccaggcuggagcgcacac

SEQ ID NO: 153594 - RNA, 62 nt, Human
ugcugccuuugcugcugacuugcagugugacucgggcccauuguucaaucucuguggcccug

SEQ ID NO: 153595 - RNA, 62 nt, Human
gcggggcagggcuguguggcaccgccagggagcgggcccaccugagucacuuuauuggguuc

SEQ ID NO: 153596 - RNA, 62 nt, Human
guugaaccuggaggugccaaaaaagccagcugcgggcccaggacagcugccgugagacuccc

SEQ ID NO: 153597 - RNA, 62 nt, Human
aucuagaaugacccugaaaugacugacagccccgggcccaagaaaaacccauaaccaccuca

SEQ ID NO: 153598 - RNA, 62 nt, Human
gggaagagggcucacaagacacauuugucccccgggcccaccacaucauccucacguguucg

SEQ ID NO: 153599 - RNA, 62 nt, Human
gcccuccagaggguaagccauguccggagucucgggcccaaggaacgauuuggagggugcuu

SEQ ID NO: 153600 - RNA, 62 nt, Human
uucaucuucuggcagcagaaauccaugaagcccgggcccaggaaaauuagaaguuuuccauu

SEQ ID NO: 153601 - RNA, 62 nt, Human
caauaugcucaggcaccgcagagagcugggcacgggcccaugugagcaucacuuuggaagua

SEQ ID NO: 153602 - RNA, 62 nt, Human
cagcacgcuagcaccccaguugcguggccagccgggcccaggcaggagcagguggcccugug

SEQ ID NO: 153603 - RNA, 62 nt, Human
uugcaggguccccuuccccggcacccaugcgccgggcccagagcucccucugccugcgggau

SEQ ID NO: 153604 - RNA, 62 nt, Human
accgccugcgggcagggggaggccagcaggcccgggcccagcaccccuucccuggcaccagg

SEQ ID NO: 153605 - RNA, 62 nt, Human
ggcaggaaaagaacugagcaugucgcaggcagcgggcccagccugagcaauggcaggaugug

SEQ ID NO: 153606 - RNA, 62 nt, Human
cuccaccgccauggcuuccaagguggucugcucgggcccaggccaucuuccaggugggguga

SEQ ID NO: 153607 - RNA, 62 nt, Human
gcugccgaaccaaaagaauuugcaccccgcugcgggcccacgugguuggggcccugcccugg

SEQ ID NO: 153608 - RNA, 62 nt, Human
gcgcaggagggacccggggccacaaggcgcugcgggcccaggugugcugggccccucucagg

SEQ ID NO: 153609 - RNA, 62 nt, Human
cgggcgaaguggguucuugugccuuccccucccgggcccaggcuccccgugcgcgggcccug

SEQ ID NO: 153610 - RNA, 62 nt, Human
uggugaucaggaaagcccgcugccccaccccucgggcccacccguacagaggcugguggucg

SEQ ID NO: 153611 - RNA, 62 nt, Human
cagggcuggaagcuuucauuugccgggacacucgggcccaugggauugcacagagcuggagg

SEQ ID NO: 153612 - RNA, 62 nt, Human
cuaaaauccuaccuaaccaucccauggucacucgggcccaugccuuccucuccuucgcuguu

SEQ ID NO: 153613 - RNA, 50 nt, Human
ggcauauccugucggggugacgggcccauggggcggguacggcuccuccc

SEQ ID NO: 153614 - RNA, 62 nt, Human
ggccuccggccucccagacuucuagagcccgccgggcccaucuuuguacucauccaccccag

SEQ ID NO: 153615 - RNA, 62 nt, Human
gccccgcaccaugcccuagccccaggucuagccgggcccauugcagggggcagcacuugggg

SEQ ID NO: 153616 - RNA, 62 nt, Human
gcaagcgggagacacccacaccccauucugggcgggcccaguggaguuuggggaggggggcg

SEQ ID NO: 153617 - RNA, 62 nt, Human
ugaugucacucaugguggacgcguucugcucacgggcccagagcccugugaaaugcaucaag

SEQ ID NO: 153618 - RNA, 62 nt, Human
uuacaggaaaauuauugacagcaaugguuucccgggcccagaaacucuggaaagauuuuguc

SEQ ID NO: 153619 - RNA, 62 nt, Human
caucaggccucaagugggcaugggggcagggacgggcccaggaacuguuguuuucucaggau

SEQ ID NO: 153620 - RNA, 62 nt, Human
uugucuucccaggcuugccccuggucagccugcgggcccaggcagcucggacaccaggcuga

SEQ ID NO: 153621 - RNA, 62 nt, Human
gccacgcagccaggacaccgggcagggccgcccgggcccagaggagcugggagccgggccgc

SEQ ID NO: 153622 - RNA, 62 nt, Human
gccacccuaaauuccagccaaccucaccuccucgggcccagcucaagcccccuuccuugcuc

SEQ ID NO: 153623 - RNA, 62 nt, Human
agagggguggagacugcuucccauccuacccucgggcccaccuggccaccugaggugggccc

SEQ ID NO: 153624 - RNA, 62 nt, Human
acauccagaaccugcagaaggugaacaccauccgggcccaugacaacccggugugcacgcug

SEQ ID NO: 153625 - RNA, 62 nt, Human
ccuuuuuugccucugagguggguggugagagacgggcccagcuguccaaggccagacguccc

SEQ ID NO: 153626 - RNA, 62 nt, Human
cucacccagagguuucacccuccuucaucucacgggcccagagcccugucucacucacccca

SEQ ID NO: 153627 - RNA, 62 nt, Human
gcaucacagugacagugucauggggagcugggcgggcccagccaaacccuccuucuuccuag

SEQ ID NO: 153628 - RNA, 62 nt, Human
cgcaggaggacugaggccaugugccauucucccgggcccagcgcccggccgucaccccaccc

SEQ ID NO: 153629 - RNA, 62 nt, Human
gugggauugagggggcugggucccccaggacacgggcccagaagagccccacgggcuuccug

SEQ ID NO: 153630 - RNA, 62 nt, Human
cccgggaccagggauggggcagcgcacaggcccgggcccagcacagaacugcccaucgggac

SEQ ID NO: 153631 - RNA, 62 nt, Human
gaacucaccuggccugggaagcaccgucugcccgggcccaagcccugccccuccagagucca

SEQ ID NO: 153632 - RNA, 62 nt, Human
acuccugggacaugugggugguggcuugaccccgggcccaugggcagcuugcuguggggcag

SEQ ID NO: 153633 - RNA, 62 nt, Human
cggucgcucaggggccccggguuugagcagaacgggcccagugcccuggguugcagacucag

SEQ ID NO: 153634 - RNA, 62 nt, Human
ucaugaguggaaagucaccuacaggacugggccgggcccagggccucuggcuucccugccca

SEQ ID NO: 153635 - RNA, 62 nt, Human
cagccccugccucccaggccagaaccugagaacgggcccagggugcuguggagaucaacuuc

SEQ ID NO: 153636 - RNA, 54 nt, Human
cuuugcgccucugcaggugacucucgggcccaagcaaccuucuggaaaacgggu

SEQ ID NO: 153637 - RNA, 60 nt, Human
uggagaagcgugucagauagcggcgugacccgggcccaccaggccacggccgccugcugu

SEQ ID NO: 153638 - RNA, 62 nt, Human
gagacaccacuacuacaagcacagucgggccgcgggcccauggacucugaguggcgacugcc

SEQ ID NO: 153639 - RNA, 55 nt, Human
cuggccugccugacuucuaaaggagcgggcccacucuggacccaccuggcgccac

SEQ ID NO: 153640 - RNA, 62 nt, Human
ugaggcccccccccccagcaauaucccaggggcgggcccaaugcccacuguacaugaggcug

SEQ ID NO: 153641 - RNA, 54 nt, Human
aaguggccaugccugugugaggggcgggcccaggcccuagacccucccccacca

SEQ ID NO: 153642 - RNA, 62 nt, Human
agcuaggcccucccaccggcucgcugcagagccgggcccagcgcgcccuguccccgugccag

SEQ ID NO: 153643 - RNA, 62 nt, Human
aaaagaaaauguaucguacaaguuaaaaugcacgggcccaagggggauuuuuuuuuucaccu

SEQ ID NO: 153644 - RNA, 62 nt, Human
accuagggcgccugcccucugcuggcuaggaccgggcccagcccagcccuuccugaagccag

SEQ ID NO: 153645 - RNA, 62 nt, Human
ugucuucagaugucagggucccugaacugcugcgggcccagucagugaugcuggcugaagcu

SEQ ID NO: 153646 - RNA, 62 nt, Human
accgccacucacgucacucggggcucgguggacgggcccagggugggagcggccggcccacc

SEQ ID NO: 153647 - RNA, 62 nt, Human
cguccaacuugugacccucgccgaccgccccgcgggcccaggcgggccgggggcggggccgu

SEQ ID NO: 153648 - RNA, 62 nt, Human
ucugaaugcaugucacgcugcaccccaugcuccgggcccacacccugcaggacaaggagcuc

SEQ ID NO: 153649 - RNA, 62 nt, Human
accagggugcaggcuccgcccccacccaaggccgggcccagccagaggaggggcagggcagg

SEQ ID NO: 153650 - RNA, 62 nt, Human
ugacagugacccucggcccccuuuugaguccucgggcccagaaucguaucccaaagcccucc

SEQ ID NO: 153651 - RNA, 62 nt, Human
gcagguagccgaccugcaggagggccuacaaacgggcccagcaagagcugggcaacagcugg

SEQ ID NO: 153652 - RNA, 62 nt, Human
caccuccaacgccccgcccacgccgcggccaccgggcccacggccaccagaaugcaauugag

SEQ ID NO: 153653 - RNA, 62 nt, Human
aauuugcuauuuuuccuguaacaucugcugaacgggcccacccacacguuguauauucagag

SEQ ID NO: 153654 - RNA, 62 nt, Human
cucagagccggcacgacccugcuguggggcggcgggcccagucguguuccugcagugggcac

SEQ ID NO: 153655 - RNA, 62 nt, Human
auggaaccucaggaugggccaaacccagacaacgggcccauggccuugggcucugauuggcu

SEQ ID NO: 153656 - RNA, 62 nt, Human
cccucccuccaggguccucucuuccacaguggcgggcccacucagccccgagaccacccaac

SEQ ID NO: 153657 - RNA, 62 nt, Human
caccaucucuccauauguaucucccuguauuucgggcccauucccucuaugucaagaguaaa

SEQ ID NO: 153658 - RNA, 62 nt, Human
gacccugcugcagaaccagcaggguguccccucgggcccaucugugucccaugucccagcac

SEQ ID NO: 153659 - RNA, 62 nt, Human
uugggcucuggucccugcggggcaggcucucccgggcccacggggcggacgcugcauaccaa

SEQ ID NO: 153660 - RNA, 62 nt, Human
cggcugccgcuaacccggggcgggcagggacgcgggcccaacaauaaaugccgcguggucug

SEQ ID NO: 153661 - RNA, 62 nt, Human
ugcccaugccuguccugcacggcucugcugcucgggcccacagcgccgucccaucacaagcc

SEQ ID NO: 153662 - RNA, 62 nt, Human
guaaguaaucccagcacuuugggaggccgagacgggcccaugacaaggucaggagaucgaga

SEQ ID NO: 153663 - RNA, 58 nt, Human
cccguugucuagaaagcugaugcagccgcgggcccagggugcuguugguguccucaga

SEQ ID NO: 153664 - RNA, 62 nt, Human
cagaaacuugccccgaguuucucuggggcccucgggcccaacuucugcuuugcacuauguuc

SEQ ID NO: 153665 - RNA, 62 nt, Human
cccacccuuccagucgggugugagggccugaccgggcccagggcaagcagaugucgcaagcc

SEQ ID NO: 153666 - RNA, 57 nt, Human
agcccggggagaaccucuaggcacaggcgggcccagaccggcuucucggcuuggauc

SEQ ID NO: 153667 - RNA, 62 nt, Human
agucaugugugcagagucagugcucgggaucccgggcccagcuuuugccuuuuuggggaugc

SEQ ID NO: 153668 - RNA, 62 nt, Human
ggggcugucugcgccuuccacgccccccaggacgggcccagaggcugggggagccccgcggc

SEQ ID NO: 153669 - RNA, 62 nt, Human
aagauugacccaguuacuugaggguagggaggcgggcccagugcaggaggcugcaucccugg

SEQ ID NO: 153670 - RNA, 62 nt, Human
ugcaggaacaacaccuccuggacgagcucucucgggcccaggccuggagcgggccaagcaga

SEQ ID NO: 153671 - RNA, 62 nt, Human
acagagauggaagccaggacaagggagcccaccgggcccagauagguacagagagcagaggc

SEQ ID NO: 153672 - RNA, 62 nt, Human
gugacucuccuucacugagugauacccugcuccgggcccaugccccaaggagcccuucagag

SEQ ID NO: 153673 - RNA, 62 nt, Human
ccuucagggagcagagcagagcaggugguggacgggcccagugcuggguguuuucaccacca

SEQ ID NO: 153674 - RNA, 62 nt, Human
guccgucccaccccuucccuucccuggcgccccgggcccaggccccucagcugucagcuggu

SEQ ID NO: 153675 - RNA, 62 nt, Human
ugcucagaaucugauaccaaagagacagggcccgggcccaggcagagagcgaccagcaggcu

SEQ ID NO: 153676 - RNA, 62 nt, Human
cagccagcguggcccuaggacaggaggagcuucgggcccagcuucacccugcgguggggcug

SEQ ID NO: 153677 - RNA, 62 nt, Human
ucggggacaggccagcggggggacggaggcggcgggcccaggagccucagccagccacgugg

SEQ ID NO: 153678 - RNA, 62 nt, Human
agccgcgugcggagccugcgcagagccccggccgggcccagcccucggagugcugccaagug

SEQ ID NO: 153679 - RNA, 62 nt, Human
accaaacuguuuuuggaaauucacaccaaggucgggcccacugcaggcagcuggcacagcgu

SEQ ID NO: 153680 - RNA, 62 nt, Human
gcacgguccucaaggauguacugcgcacugaccgggcccaccccuacuaugcggggccugag

SEQ ID NO: 153681 - RNA, 62 nt, Human
gagggaugacaagcggcccccgccuccauacccgggcccagggaagcccgcggcagcggcag

SEQ ID NO: 153682 - RNA, 64 nt, Human
gcccuugcugagauuguagagauugagugcucuggaccgcaaaagccaggcuaguccuuguagg

SEQ ID NO: 153683 - RNA, 64 nt, Human
aaguggacccugagccuagaagagcagaauccaggaccgcaaacugccaaggacaucccccuuc

SEQ ID NO: 153684 - RNA, 64 nt, Human
guggcugguguuuguaguugacauaaaggauuaagaccgcaaauuguccuucauggguagaguc

SEQ ID NO: 153685 - RNA, 64 nt, Human
ucaaccauguuggucaggcuggucucgaacuccugaccgcaagugauccacacgccuuggucuc

SEQ ID NO: 153686 - RNA, 64 nt, Human
acacuguuaguguaacgugccaguggaguggaaagaccgcaacaccugaauccuggguuuugua

SEQ ID NO: 153687 - RNA, 64 nt, Human
aaaaggggacacagaagcacuggcugcugcuacagaccgcaaaagcagaaaguuucgugaaaau

SEQ ID NO: 153688 - RNA, 64 nt, Human
uugccacaugauaaucacccuucaucagaaaugggaccgcaagugguaggcagugucccuucug

SEQ ID NO: 153689 - RNA, 64 nt, Human
uacaccaacuucuaaaaagaaaguacgaauuaaagaccgcaauaaacuuucuacagaggaacgc

SEQ ID NO: 153690 - RNA, 64 nt, Human
gccucaugcaagucauccccgacaugaccuucacgaccgcaaugcaaggaggggaagaaaguca

SEQ ID NO: 153691 - RNA, 64 nt, Human
guucacaggggcuagccaccuguacuacggugccgaccgcaaugcgaggaaugugguggccacg

SEQ ID NO: 153692 - RNA, 64 nt, Human
agucuagagcugguauucuagcccaaaucugucugaccgcaauacacagauucuuuauuccuau

SEQ ID NO: 153693 - RNA, 64 nt, Human
uucaccauguuggucaggcuagucucgaacucgugaccgcaagcgauucacccaccucagccuc

SEQ ID NO: 153694 - RNA, 64 nt, Human
ucagccugagggccugcggagccucaagaagccagaccgcaagaagcgcuacaccguggugggc

SEQ ID NO: 153695 - RNA, 64 nt, Human
agaugugguauaugaucuuaaaugaugaacaugagaccgcaaaaauucacuccuggagaucucc

SEQ ID NO: 153696 - RNA, 64 nt, Human
ccugugguuugccauccgcuguggcugcagcuuggaccgcaagggcaaauacacccugacccca

SEQ ID NO: 153697 - RNA, 64 nt, Human
uucaccguguuggccaggcugaucucgaacuccugaccgcaagugauccacccgccucggucuc

SEQ ID NO: 153698 - RNA, 64 nt, Human
ggcauucucucuggcgauggaguguggcugggcugaccgcaaaaggugccuuacacacugcccc

SEQ ID NO: 153699 - RNA, 64 nt, Human
uucaccacguuggccaggcuggucucgaacuccugaccgcaagugauccacccgccuccgccuc

SEQ ID NO: 153700 - RNA, 64 nt, Human
gaaaagccuuacccauuuugguuuucacuauugagaccgcaacugcuugcacugaucauuuugg

SEQ ID NO: 153701 - RNA, 64 nt, Human
guagccgggcucugcacccacgugcauucacauugaccgcaacucacacauucccccaccagcu

SEQ ID NO: 153702 - RNA, 64 nt, Human
auuaaaauuaaaagcaaaaccacaagaagggaaagaccgcaacucggacagcccagcgacuucc

SEQ ID NO: 153703 - RNA, 64 nt, Human
augaacuguacuggcuguugaccaccagacaccugaccgcaaauaucuuuucuuguauucccau

SEQ ID NO: 153704 - RNA, 64 nt, Human
cuagacugaaaugauacaaacuuccaucuggucugaccgcaaacaguguuuauuuggggacagg

SEQ ID NO: 153705 - RNA, 64 nt, Human
gagauccgugcgcccgaccagcaccagcaucgcggaccgcaaaggccgcccgucccgucaaaca

SEQ ID NO: 153706 - RNA, 64 nt, Human
caaagccccuggucauacaggccagggaacauaagaccgcaauucuaaguuucuagauaaacag

SEQ ID NO: 153707 - RNA, 64 nt, Human
gugcauuuauugccucuaugugcaacugacagaugaccgcaauaaugaaugagcaguuagaaau

SEQ ID NO: 153708 - RNA, 64 nt, Human
aaagagaaaacguccaggcgagcccaguuguccucgcccacaggguccugcaggcuccaucagu

SEQ ID NO: 153709 - RNA, 64 nt, Human
uucuauucaggccuucaacugauucagcaaggcccgcccacauuugggaggacagucugcauua

SEQ ID NO: 153710 - RNA, 64 nt, Human
gugucagggcucaccugggcauccaaagcggccacgcccacaauccgacagcccccaggagcag

SEQ ID NO: 153711 - RNA, 64 nt, Human
caguugcccagcagagcucuuggccccgcugcugcgcccacacucucgccagaguccccagccg

SEQ ID NO: 153712 - RNA, 64 nt, Human
gcuuccaggccacccaucugucacccuuggacagcgcccacacccuucuagcaccuccugacag

SEQ ID NO: 153713 - RNA, 64 nt, Human
gugucgguucuguuucuccccuuggcugccuguacgcccacagccuucuggcugcgacauuaua

SEQ ID NO: 153714 - RNA, 64 nt, Human
uagcuguagucuauauuagggcaguucucuagaacgcccacauuuccaccaacucaguaaacuu

SEQ ID NO: 153715 - RNA, 64 nt, Human
cuccuggugccccucgccagcuucuccugcgccccgcccacacccucggggggucacaggccca

SEQ ID NO: 153716 - RNA, 64 nt, Human
acaccaacgccgcauaggacugcccacaugggaccgcccacauaggaccgcccacauaggaccg

SEQ ID NO: 153717 - RNA, 64 nt, Human
uaggacugcccacaugggaccgcccacauaggaccgcccacauaggaccgcccacaugggaccg

SEQ ID NO: 153718 - RNA, 64 nt, Human
ugggaccgcccacauaggaccgcccacauaggaccgcccacaugggaccgcccacaugggaccg

SEQ ID NO: 153719 - RNA, 64 nt, Human
uaggaccgcccacauaggaccgcccacaugggaccgcccacaugggaccgcccacaugggaccg

SEQ ID NO: 153720 - RNA, 64 nt, Human
uaggaccgcccacaugggaccgcccacaugggaccgcccacaugggaccgcccacauagaaccg

SEQ ID NO: 153721 - RNA, 64 nt, Human
ugggaccgcccacaugggaccgcccacaugggaccgcccacauagaaccguccuccagugguga

SEQ ID NO: 153722 - RNA, 64 nt, Human
ggacgcugccggguagacucuccacucccccugccgcccacacugcagcagccacauccauaca

SEQ ID NO: 153723 - RNA, 64 nt, Human
ucugacagccauguccaccugugcccacagcuuccgcccacagaccuccagggacaggagcaaa

SEQ ID NO: 153724 - RNA, 64 nt, Human
ccuacuggguguuguucuggcccucaccugccggcgcccacagucagguaagcucaccuggggu

SEQ ID NO: 153725 - RNA, 64 nt, Human
cuagagcauggagccucuagaagccaugcucacccgcccacauuuaauuaacagcugagucccu

SEQ ID NO: 153726 - RNA, 51 nt, Human
aggccccagccgacaagugaucgcccacaagccuuacucaccucucucuaa

SEQ ID NO: 153727 - RNA, 64 nt, Human
ccaagauggacuugcugugaauggugccacacagcgcccacagacugggcccucgcacccuugg

SEQ ID NO: 153728 - RNA, 64 nt, Human
guccggaccugcuugaugccgcggugagggacggcgcccacauaggcgagguugagcugcuggu

SEQ ID NO: 153729 - RNA, 64 nt, Human
uuuguagcuucuaaugugagguuugaguccagugcgcccacagcagcaugcccuucucaccccu

SEQ ID NO: 153730 - RNA, 64 nt, Human
uccccagggaagagaaugaggaccacguggacuccgcccacacagagcuggcugcugugcccac

SEQ ID NO: 153731 - RNA, 64 nt, Human
aaggcaugagacaucuguacaggaagcaucccagcgcccacaugggcaugagacagucugcacu

SEQ ID NO: 153732 - RNA, 64 nt, Human
gugggggggcuuggccugauggugggcggggccccgcccacagggccgaccccaauacaccagc

SEQ ID NO: 153733 - RNA, 64 nt, Human
ccgccuccccugccugggcacucccuccucccugcgcccacagcccccaugccaaucuccguca

SEQ ID NO: 153734 - RNA, 64 nt, Human
gcagggagcaggcccugucaccgacgggucaccucgcccacacggccagcaccgacucaccaca

SEQ ID NO: 153735 - RNA, 64 nt, Human
cagacuucaagaccauccuggacugauggccacccgcccacagccaggccgagagcagacacca

SEQ ID NO: 153736 - RNA, 52 nt, Human
ucuccaagaggaagcccuaauccgcccacaggaagccugcaguccuggaagc

SEQ ID NO: 153737 - RNA, 64 nt, Human
ucaguccagugauuggguuuguggcuccaggccucgcccacagacggacagaccccucccuuuc

SEQ ID NO: 153738 - RNA, 64 nt, Human
ggaacaggcgagauggaacagggauuuaacuccccgcccacagguccaugggagcuugaggcag

SEQ ID NO: 153739 - RNA, 64 nt, Human
gcauuuaaucuccucuccaaaguagagagcaagucgcccacagugggcgugucuguaaauauug

SEQ ID NO: 153740 - RNA, 64 nt, Human
cuagauuccagccaccaagcggaagcaugagacccgcccacacuagccucuguguucccguuag

SEQ ID NO: 153741 - RNA, 64 nt, Human
ggugccgaacgcuggccacuggauccacgcugaccgcccacaggacuucauagcugccauccga

SEQ ID NO: 153742 - RNA, 64 nt, Human
ucaggaagcucccggaguccccgccucucuccuccgcccacagggguucgugggcacagggcuu

SEQ ID NO: 153743 - RNA, 64 nt, Human
ggagcgguggcacucgugggagggagaggacccccgcccacauccuccuuccccaggaccugag

SEQ ID NO: 153744 - RNA, 64 nt, Human
acugacuucucuuuaacuguccugagcuacaucacgcccacaaaucugucuuucauaccacucu

SEQ ID NO: 153745 - RNA, 64 nt, Human
cuaguguauaaucaaccauacuguuagucacacacgcccacaugacaaucaucugaaagucccc

SEQ ID NO: 153746 - RNA, 64 nt, Human
caggcuuuuuacaccccaagugcaugggguugcucgcccacagggcugccucagauuuuguaca

SEQ ID NO: 153747 - RNA, 64 nt, Human
acagccacgggggacugacgccagguuccccagccgcccacaacgacuuuauuuucuuacccaa

SEQ ID NO: 153748 - RNA, 64 nt, Human
ugggggcgcuugcccaggagagggaccaggggugcgcccacagccugcuccauucuccagucug

SEQ ID NO: 153749 - RNA, 64 nt, Human
caccccauuuccccagccagacacacucccaugacgcccacagcugccccuuugcccccagcuc

SEQ ID NO: 153750 - RNA, 64 nt, Human
uuuucagugagugcugcguccccaguagggauggcgcccacaggguccugugaccucggccagu

SEQ ID NO: 153751 - RNA, 64 nt, Human
uaggagucuuugccuucauaaauuuuaagaaccccgcccacaacagggaguuaaacuggaggac

SEQ ID NO: 153752 - RNA, 64 nt, Human
auccauggggcaguccaggcaucucccuaccagccgcccacauuggcuucgcugcagcgcuugc

SEQ ID NO: 153753 - RNA, 64 nt, Human
cuugagcuccgcuuuuugcugagaucacagcagccgcccacagacaguucacuuuuauuucuca

SEQ ID NO: 153754 - RNA, 64 nt, Human
cccccggagcaggggucugagccacagccgugcucgcccacaaacugauuucucacggcguguc

SEQ ID NO: 153755 - RNA, 64 nt, Human
gaugaggccaaggcugccuucaauuagaagcagccgcccacagagacaggcacugugugccugg

SEQ ID NO: 153756 - RNA, 64 nt, Human
ugcuuuaagaaaaaaggaggcaagguagggagagcgcccacacuguccaugcuccaggcccccu

SEQ ID NO: 153757 - RNA, 64 nt, Human
ggcggggcaacggcuccccauuuuucccgagccccgcccacagagcucuuagccaauccuaugc

SEQ ID NO: 153758 - RNA, 64 nt, Human
ucuuuccugagacuggaucuguucaaacagcaaacgcccacagauggcccagagguggugguag

SEQ ID NO: 153759 - RNA, 64 nt, Human
gaaggcuuggucccaucggaaguuuuggguuuuccgcccacagccgccggaaguggcuccgugg

SEQ ID NO: 153760 - RNA, 64 nt, Human
gcacugacggggcugcaggagcaggugcagugggcgcccacacuggcccugcagugaugcaggg

SEQ ID NO: 153761 - RNA, 64 nt, Human
auuaugacauuuaguaucuaagguuagaaaaccacgcccacaugcuaauauggguguugaaaac

SEQ ID NO: 153762 - RNA, 64 nt, Human
cacagucaccaaugauaucucgccaaagaaaccacgcccacaccaaugccaacacaaaacugug

SEQ ID NO: 153763 - RNA, 64 nt, Human
ucccgcccaccagcggacucggcccccaaggcuccgcccacacugaccacgccccucggcgggg

SEQ ID NO: 153764 - RNA, 64 nt, Human
caggcuagucucgaacuccugaccucagaugauccgcccacauuggccucccaaagugcuggga

SEQ ID NO: 153765 - RNA, 64 nt, Human
caacgguguugucagugugcgaacuccagagaagcgcccacaucugaaggaccugcucgcgagu

SEQ ID NO: 153766 - RNA, 64 nt, Human
cgcccccaccugcggccgccccccgccccucgcccgcccacacggccccuucccagccagcccg

SEQ ID NO: 153767 - RNA, 64 nt, Human
cugcugagcccaccccaaguaugccugccaccuacgcccacaggcagggcacacugggcagcca

SEQ ID NO: 153768 - RNA, 64 nt, Human
gaugccaguacuguggugugugagucucagcagccgcccacacgcuccuaacucugcugcaugg

SEQ ID NO: 153769 - RNA, 64 nt, Human
cuccgucucuugccucggcgccuggguggcuugccgcccacacuucaggggcccagacuuacac

SEQ ID NO: 153770 - RNA, 64 nt, Human
guucagaaacggcccagccagaccuaaacccacacgcccacaaaguggauugcacacagacaag

SEQ ID NO: 153771 - RNA, 64 nt, Human
uucccaucccaaccuugagccccaggagauaccgcgcccacacccaaucuugggacacucccua

SEQ ID NO: 153772 - RNA, 64 nt, Human
agccccuugagcagagcucugcacccagccugcccgcccacaccauccugcugguccucccagc

SEQ ID NO: 153773 - RNA, 64 nt, Human
gccgcgcucccugcacugagcggguuuaggggcucgcccacaugcaugcaggccaagacagcaa

SEQ ID NO: 153774 - RNA, 64 nt, Human
auacauacccucgcugccaggcugcucagagucccgcccacauaugagacaggcacuggcugaa

SEQ ID NO: 153775 - RNA, 64 nt, Human
ggcaggcagcaggcuccccagccagggcuugacacgcccacagucaggggccuccacaugccug

SEQ ID NO: 153776 - RNA, 64 nt, Human
ccagcguuugccuggucuggaaguccuggccggccgcccacaucgggcucaccuuaaaggucaa

SEQ ID NO: 153777 - RNA, 64 nt, Human
guccaaggauucccguacagugacugugucucaccgcccacaacccuaucgcuggagcugugag

SEQ ID NO: 153778 - RNA, 64 nt, Human
cgugcccccauuagugugccucuuuggaaauuaucgcccacauuuguaauauagucgccauuga

SEQ ID NO: 153779 - RNA, 64 nt, Human
ggacugacccccucucuuaaaacacauucccgcccgcccacaggccugaggucugggaccuuuc

SEQ ID NO: 153780 - RNA, 64 nt, Human
uuggucugcacccacccccccacccccccccccccgcccacaugcuccccagcuugcaggagga

SEQ ID NO: 153781 - RNA, 64 nt, Human
aauaguggaggccuucaacugauuagacaaggcccgcccacaucuuggagggcaucugccuuac

SEQ ID NO: 153782 - RNA, 64 nt, Human
ugagccaggggccaguuuugacaggguagcaucacgcccacagacuacacccucuccaagugcu

SEQ ID NO: 153783 - RNA, 53 nt, Human
acccgggacaccccuacugaccgcgcccacagccgcccugaggcuguaggcau

SEQ ID NO: 153784 - RNA, 64 nt, Human
aauucucgccuucugcucccagcuuggagccccgcgcccacagcuuuggccuccgguuccaucg

SEQ ID NO: 153785 - RNA, 64 nt, Human
agccgggggcgcgggcgccuuccgcagagaccugcgcccacaggugcugucuuaguggacuggg

SEQ ID NO: 153786 - RNA, 64 nt, Human
ccagcuuuaggccccgcccuccucccaauggcuccgcccacagacucccuuauuucaauggccg

SEQ ID NO: 153787 - RNA, 64 nt, Human
cagacaccuccacgcccaccugguccucucccaucgcccacaaaagggggggcacgagggacga

SEQ ID NO: 153788 - RNA, 64 nt, Human
gcccagcugucccacgcugcagcgcagacggccacgcccacacccggccuuuuagcucaggucc

SEQ ID NO: 153789 - RNA, 64 nt, Human
gcagagggagagggccaggcuccagacucccacacgcccacacagcaccucugccaggccuagg

SEQ ID NO: 153790 - RNA, 64 nt, Human
ccccccauccucacaccuaaccugcauggggcuucgcccacaaccauucuguaccccuucccca

SEQ ID NO: 153791 - RNA, 64 nt, Human
ggauuccagcaucugcgaacccaagcaaugggggcgcccacagagcaguggggagugaggggau

SEQ ID NO: 153792 - RNA, 64 nt, Human
uuuucugucaggaaaacaauguuggccugugggccgcccacaacauauccuucccucacuaccu

SEQ ID NO: 153793 - RNA, 64 nt, Human
ucuugcugccauggucucaagccugaagaggcuccgcccacaagcuggcccaugaaguuagcaa

SEQ ID NO: 153794 - RNA, 64 nt, Human
cauaccccaagaccccaagccuugacuccagcugcgcccacaggaaguccagucccgacagugc

SEQ ID NO: 153795 - RNA, 64 nt, Human
ugcucaugaagcgcuccaucacggcaccgcuggccgcccacaucuccuuggugaacaaggccgc

SEQ ID NO: 153796 - RNA, 64 nt, Human
ccucccaggggauggggacccagagugcaguggccgcccacauccauggccuaggagcuacugg

SEQ ID NO: 153797 - RNA, 64 nt, Human
cgggcuugugaggccggaauccgggcuccccuuucgcccacagucugacuuccccgcauuccag

SEQ ID NO: 153798 - RNA, 55 nt, Human
ggaagcucuuuccaggaugaacggacgcccacagaggccugcggggugggggcau

SEQ ID NO: 153799 - RNA, 64 nt, Human; identical to SEQ ID NO: 130024

SEQ ID NO: 153800 - RNA, 64 nt, Human; identical to SEQ ID NO: 130025

SEQ ID NO: 153801 - RNA, 64 nt, Human; identical to SEQ ID NO: 130026

SEQ ID NO: 153802 - RNA, 64 nt, Human; identical to SEQ ID NO: 130027

SEQ ID NO: 153803 - RNA, 64 nt, Human; identical to SEQ ID NO: 130028

SEQ ID NO: 153804 - RNA, 64 nt, Human; identical to SEQ ID NO: 130029

SEQ ID NO: 153805 - RNA, 64 nt, Human; identical to SEQ ID NO: 130030

SEQ ID NO: 153806 - RNA, 64 nt, Human; identical to SEQ ID NO: 130031

SEQ ID NO: 153807 - RNA, 64 nt, Human; identical to SEQ ID NO: 130032

SEQ ID NO: 153808 - RNA, 64 nt, Human; identical to SEQ ID NO: 130033

SEQ ID NO: 153809 - RNA, 64 nt, Human; identical to SEQ ID NO: 130034

SEQ ID NO: 153810 - RNA, 64 nt, Human; identical to SEQ ID NO: 130035

SEQ ID NO: 153811 - RNA, 64 nt, Human; identical to SEQ ID NO: 130036

SEQ ID NO: 153812 - RNA, 64 nt, Human; identical to SEQ ID NO: 130037

SEQ ID NO: 153813 - RNA, 64 nt, Human; identical to SEQ ID NO: 130038

SEQ ID NO: 153814 - RNA, 64 nt, Human; identical to SEQ ID NO: 130039

SEQ ID NO: 153815 - RNA, 64 nt, Human; identical to SEQ ID NO: 130040

SEQ ID NO: 153816 - RNA, 64 nt, Human; identical to SEQ ID NO: 130041

SEQ ID NO: 153817 - RNA, 64 nt, Human; identical to SEQ ID NO: 130042

SEQ ID NO: 153818 - RNA, 64 nt, Human; identical to SEQ ID NO: 130043

SEQ ID NO: 153819 - RNA, 56 nt, Human; identical to SEQ ID NO: 130044

SEQ ID NO: 153820 - RNA, 64 nt, Human; identical to SEQ ID NO: 130045

SEQ ID NO: 153821 - RNA, 64 nt, Human; identical to SEQ ID NO: 130046

SEQ ID NO: 153822 - RNA, 64 nt, Human; identical to SEQ ID NO: 130047

SEQ ID NO: 153823 - RNA, 64 nt, Human; identical to SEQ ID NO: 130048

SEQ ID NO: 153824 - RNA, 64 nt, Human; identical to SEQ ID NO: 130049

SEQ ID NO: 153825 - RNA, 64 nt, Human; identical to SEQ ID NO: 130050

SEQ ID NO: 153826 - RNA, 64 nt, Human; identical to SEQ ID NO: 130051

SEQ ID NO: 153827 - RNA, 64 nt, Human; identical to SEQ ID NO: 130052

SEQ ID NO: 153828 - RNA, 64 nt, Human; identical to SEQ ID NO: 130053

SEQ ID NO: 153829 - RNA, 64 nt, Human; identical to SEQ ID NO: 130054

SEQ ID NO: 153830 - RNA, 64 nt, Human; identical to SEQ ID NO: 130055

SEQ ID NO: 153831 - RNA, 64 nt, Human; identical to SEQ ID NO: 130056

SEQ ID NO: 153832 - RNA, 64 nt, Human; identical to SEQ ID NO: 130057

SEQ ID NO: 153833 - RNA, 64 nt, Human; identical to SEQ ID NO: 130058

SEQ ID NO: 153834 - RNA, 64 nt, Human; identical to SEQ ID NO: 130059

SEQ ID NO: 153835 - RNA, 64 nt, Human; identical to SEQ ID NO: 130060

SEQ ID NO: 153836 - RNA, 64 nt, Human; identical to SEQ ID NO: 130061

SEQ ID NO: 153837 - RNA, 64 nt, Human; identical to SEQ ID NO: 130062

SEQ ID NO: 153838 - RNA, 64 nt, Human; identical to SEQ ID NO: 130063

SEQ ID NO: 153839 - RNA, 64 nt, Human; identical to SEQ ID NO: 130064

SEQ ID NO: 153840 - RNA, 64 nt, Human; identical to SEQ ID NO: 130065

SEQ ID NO: 153841 - RNA, 64 nt, Human; identical to SEQ ID NO: 130066

SEQ ID NO: 153842 - RNA, 64 nt, Human; identical to SEQ ID NO: 130067

SEQ ID NO: 153843 - RNA, 64 nt, Human; identical to SEQ ID NO: 130068

SEQ ID NO: 153844 - RNA, 51 nt, Human; identical to SEQ ID NO: 130069

SEQ ID NO: 153845 - RNA, 64 nt, Human; identical to SEQ ID NO: 130070

SEQ ID NO: 153846 - RNA, 64 nt, Human; identical to SEQ ID NO: 130071

SEQ ID NO: 153847 - RNA, 64 nt, Human; identical to SEQ ID NO: 130072

SEQ ID NO: 153848 - RNA, 64 nt, Human; identical to SEQ ID NO: 130073

SEQ ID NO: 153849 - RNA, 64 nt, Human; identical to SEQ ID NO: 130074

SEQ ID NO: 153850 - RNA, 64 nt, Human; identical to SEQ ID NO: 130075

SEQ ID NO: 153851 - RNA, 64 nt, Human; identical to SEQ ID NO: 130076

SEQ ID NO: 153852 - RNA, 64 nt, Human; identical to SEQ ID NO: 130077

SEQ ID NO: 153853 - RNA, 64 nt, Human; identical to SEQ ID NO: 130078

SEQ ID NO: 153854 - RNA, 64 nt, Human; identical to SEQ ID NO: 130079

SEQ ID NO: 153855 - RNA, 64 nt, Human; identical to SEQ ID NO: 130080

SEQ ID NO: 153856 - RNA, 64 nt, Human; identical to SEQ ID NO: 130081

SEQ ID NO: 153857 - RNA, 64 nt, Human; identical to SEQ ID NO: 130082

SEQ ID NO: 153858 - RNA, 64 nt, Human; identical to SEQ ID NO: 130083

SEQ ID NO: 153859 - RNA, 64 nt, Human; identical to SEQ ID NO: 130084

SEQ ID NO: 153860 - RNA, 64 nt, Human; identical to SEQ ID NO: 130085

SEQ ID NO: 153861 - RNA, 64 nt, Human; identical to SEQ ID NO: 130086

SEQ ID NO: 153862 - RNA, 64 nt, Human; identical to SEQ ID NO: 130087

SEQ ID NO: 153863 - RNA, 64 nt, Human; identical to SEQ ID NO: 130088

SEQ ID NO: 153864 - RNA, 64 nt, Human; identical to SEQ ID NO: 130089

SEQ ID NO: 153865 - RNA, 64 nt, Human; identical to SEQ ID NO: 130090

SEQ ID NO: 153866 - RNA, 64 nt, Human; identical to SEQ ID NO: 130091

SEQ ID NO: 153867 - RNA, 64 nt, Human; identical to SEQ ID NO: 130092

SEQ ID NO: 153868 - RNA, 64 nt, Human; identical to SEQ ID NO: 130093

SEQ ID NO: 153869 - RNA, 64 nt, Human; identical to SEQ ID NO: 130094

SEQ ID NO: 153870 - RNA, 64 nt, Human; identical to SEQ ID NO: 130095

SEQ ID NO: 153871 - RNA, 64 nt, Human; identical to SEQ ID NO: 130096

SEQ ID NO: 153872 - RNA, 64 nt, Human; identical to SEQ ID NO: 130097

SEQ ID NO: 153873 - RNA, 64 nt, Human; identical to SEQ ID NO: 130098

SEQ ID NO: 153874 - RNA, 64 nt, Human; identical to SEQ ID NO: 130099

SEQ ID NO: 153875 - RNA, 64 nt, Human; identical to SEQ ID NO: 130100

SEQ ID NO: 153876 - RNA, 64 nt, Human; identical to SEQ ID NO: 130101

SEQ ID NO: 153877 - RNA, 64 nt, Human; identical to SEQ ID NO: 130102

SEQ ID NO: 153878 - RNA, 64 nt, Human; identical to SEQ ID NO: 130103

SEQ ID NO: 153879 - RNA, 64 nt, Human; identical to SEQ ID NO: 130104

SEQ ID NO: 153880 - RNA, 64 nt, Human; identical to SEQ ID NO: 130105

SEQ ID NO: 153881 - RNA, 64 nt, Human; identical to SEQ ID NO: 130106

SEQ ID NO: 153882 - RNA, 64 nt, Human; identical to SEQ ID NO: 130107

SEQ ID NO: 153883 - RNA, 64 nt, Human; identical to SEQ ID NO: 130108

SEQ ID NO: 153884 - RNA, 64 nt, Human; identical to SEQ ID NO: 130109

SEQ ID NO: 153885 - RNA, 64 nt, Human; identical to SEQ ID NO: 130110

SEQ ID NO: 153886 - RNA, 64 nt, Human; identical to SEQ ID NO: 130111

SEQ ID NO: 153887 - RNA, 64 nt, Human; identical to SEQ ID NO: 130112

SEQ ID NO: 153888 - RNA, 64 nt, Human; identical to SEQ ID NO: 130113

SEQ ID NO: 153889 - RNA, 64 nt, Human; identical to SEQ ID NO: 130114

SEQ ID NO: 153890 - RNA, 64 nt, Human; identical to SEQ ID NO: 130115

SEQ ID NO: 153891 - RNA, 64 nt, Human; identical to SEQ ID NO: 130116

SEQ ID NO: 153892 - RNA, 64 nt, Human; identical to SEQ ID NO: 130117

SEQ ID NO: 153893 - RNA, 64 nt, Human; identical to SEQ ID NO: 130118

SEQ ID NO: 153894 - RNA, 64 nt, Human; identical to SEQ ID NO: 130119

SEQ ID NO: 153895 - RNA, 64 nt, Human; identical to SEQ ID NO: 130120

SEQ ID NO: 153896 - RNA, 64 nt, Human; identical to SEQ ID NO: 130121

SEQ ID NO: 153897 - RNA, 64 nt, Human; identical to SEQ ID NO: 130122

SEQ ID NO: 153898 - RNA, 64 nt, Human; identical to SEQ ID NO: 130123

SEQ ID NO: 153899 - RNA, 64 nt, Human; identical to SEQ ID NO: 130124

SEQ ID NO: 153900 - RNA, 64 nt, Human; identical to SEQ ID NO: 130125

SEQ ID NO: 153901 - RNA, 64 nt, Human; identical to SEQ ID NO: 130126

SEQ ID NO: 153902 - RNA, 64 nt, Human; identical to SEQ ID NO: 130127

SEQ ID NO: 153903 - RNA, 64 nt, Human; identical to SEQ ID NO: 130128

SEQ ID NO: 153904 - RNA, 64 nt, Human; identical to SEQ ID NO: 130129

SEQ ID NO: 153905 - RNA, 64 nt, Human; identical to SEQ ID NO: 130130

SEQ ID NO: 153906 - RNA, 64 nt, Human; identical to SEQ ID NO: 130131

SEQ ID NO: 153907 - RNA, 64 nt, Human; identical to SEQ ID NO: 130132

SEQ ID NO: 153908 - RNA, 64 nt, Human; identical to SEQ ID NO: 130133

SEQ ID NO: 153909 - RNA, 64 nt, Human; identical to SEQ ID NO: 130134

SEQ ID NO: 153910 - RNA, 64 nt, Human; identical to SEQ ID NO: 130135

SEQ ID NO: 153911 - RNA, 64 nt, Human; identical to SEQ ID NO: 130136

SEQ ID NO: 153912 - RNA, 64 nt, Human; identical to SEQ ID NO: 130137

SEQ ID NO: 153913 - RNA, 64 nt, Human; identical to SEQ ID NO: 130138

SEQ ID NO: 153914 - RNA, 64 nt, Human; identical to SEQ ID NO: 130139

SEQ ID NO: 153915 - RNA, 64 nt, Human; identical to SEQ ID NO: 130140

SEQ ID NO: 153916 - RNA, 64 nt, Human; identical to SEQ ID NO: 130141

SEQ ID NO: 153917 - RNA, 64 nt, Human; identical to SEQ ID NO: 130142

SEQ ID NO: 153918 - RNA, 64 nt, Human; identical to SEQ ID NO: 130143

SEQ ID NO: 153919 - RNA, 64 nt, Human; identical to SEQ ID NO: 130144

SEQ ID NO: 153920 - RNA, 64 nt, Human; identical to SEQ ID NO: 130145

SEQ ID NO: 153921 - RNA, 64 nt, Human; identical to SEQ ID NO: 130146

SEQ ID NO: 153922 - RNA, 64 nt, Human; identical to SEQ ID NO: 130147

SEQ ID NO: 153923 - RNA, 64 nt, Human; identical to SEQ ID NO: 130148

SEQ ID NO: 153924 - RNA, 64 nt, Human; identical to SEQ ID NO: 130149

SEQ ID NO: 153925 - RNA, 64 nt, Human; identical to SEQ ID NO: 130150

SEQ ID NO: 153926 - RNA, 64 nt, Human; identical to SEQ ID NO: 130151

SEQ ID NO: 153927 - RNA, 64 nt, Human; identical to SEQ ID NO: 130152

SEQ ID NO: 153928 - RNA, 64 nt, Human; identical to SEQ ID NO: 130153

SEQ ID NO: 153929 - RNA, 64 nt, Human; identical to SEQ ID NO: 130154

SEQ ID NO: 153930 - RNA, 64 nt, Human; identical to SEQ ID NO: 130155

SEQ ID NO: 153931 - RNA, 64 nt, Human; identical to SEQ ID NO: 130156

SEQ ID NO: 153932 - RNA, 64 nt, Human; identical to SEQ ID NO: 130157

SEQ ID NO: 153933 - RNA, 64 nt, Human; identical to SEQ ID NO: 130158

SEQ ID NO: 153934 - RNA, 64 nt, Human; identical to SEQ ID NO: 130159

SEQ ID NO: 153935 - RNA, 64 nt, Human; identical to SEQ ID NO: 130160

SEQ ID NO: 153936 - RNA, 64 nt, Human; identical to SEQ ID NO: 130161

SEQ ID NO: 153937 - RNA, 64 nt, Human; identical to SEQ ID NO: 130162

SEQ ID NO: 153938 - RNA, 64 nt, Human; identical to SEQ ID NO: 130163

SEQ ID NO: 153939 - RNA, 64 nt, Human; identical to SEQ ID NO: 130164

SEQ ID NO: 153940 - RNA, 64 nt, Human; identical to SEQ ID NO: 130165

SEQ ID NO: 153941 - RNA, 64 nt, Human; identical to SEQ ID NO: 130166

SEQ ID NO: 153942 - RNA, 64 nt, Human; identical to SEQ ID NO: 130167

SEQ ID NO: 153943 - RNA, 64 nt, Human; identical to SEQ ID NO: 130168

SEQ ID NO: 153944 - RNA, 64 nt, Human; identical to SEQ ID NO: 130169

SEQ ID NO: 153945 - RNA, 64 nt, Human; identical to SEQ ID NO: 130170

SEQ ID NO: 153946 - RNA, 64 nt, Human; identical to SEQ ID NO: 130171

SEQ ID NO: 153947 - RNA, 64 nt, Human; identical to SEQ ID NO: 130172

SEQ ID NO: 153948 - RNA, 64 nt, Human; identical to SEQ ID NO: 130173

SEQ ID NO: 153949 - RNA, 64 nt, Human; identical to SEQ ID NO: 130174

SEQ ID NO: 153950 - RNA, 64 nt, Human; identical to SEQ ID NO: 130175

SEQ ID NO: 153951 - RNA, 64 nt, Human; identical to SEQ ID NO: 130176

SEQ ID NO: 153952 - RNA, 64 nt, Human; identical to SEQ ID NO: 130177

SEQ ID NO: 153953 - RNA, 64 nt, Human; identical to SEQ ID NO: 130178

SEQ ID NO: 153954 - RNA, 64 nt, Human; identical to SEQ ID NO: 130179

SEQ ID NO: 153955 - RNA, 64 nt, Human; identical to SEQ ID NO: 130180

SEQ ID NO: 153956 - RNA, 64 nt, Human; identical to SEQ ID NO: 130181

SEQ ID NO: 153957 - RNA, 64 nt, Human; identical to SEQ ID NO: 130182

SEQ ID NO: 153958 - RNA, 64 nt, Human; identical to SEQ ID NO: 130183

SEQ ID NO: 153959 - RNA, 64 nt, Human; identical to SEQ ID NO: 130184

SEQ ID NO: 153960 - RNA, 64 nt, Human; identical to SEQ ID NO: 130185

SEQ ID NO: 153961 - RNA, 64 nt, Human; identical to SEQ ID NO: 130186

SEQ ID NO: 153962 - RNA, 64 nt, Human; identical to SEQ ID NO: 130187

SEQ ID NO: 153963 - RNA, 64 nt, Human; identical to SEQ ID NO: 130188

SEQ ID NO: 153964 - RNA, 64 nt, Human; identical to SEQ ID NO: 130189

SEQ ID NO: 153965 - RNA, 64 nt, Human; identical to SEQ ID NO: 130190

SEQ ID NO: 153966 - RNA, 64 nt, Human; identical to SEQ ID NO: 130191

SEQ ID NO: 153967 - RNA, 64 nt, Human; identical to SEQ ID NO: 130192

SEQ ID NO: 153968 - RNA, 64 nt, Human; identical to SEQ ID NO: 130193

SEQ ID NO: 153969 - RNA, 64 nt, Human; identical to SEQ ID NO: 130194

SEQ ID NO: 153970 - RNA, 64 nt, Human; identical to SEQ ID NO: 130195

SEQ ID NO: 153971 - RNA, 64 nt, Human; identical to SEQ ID NO: 130196

SEQ ID NO: 153972 - RNA, 64 nt, Human; identical to SEQ ID NO: 130197

SEQ ID NO: 153973 - RNA, 64 nt, Human; identical to SEQ ID NO: 130198

SEQ ID NO: 153974 - RNA, 64 nt, Human; identical to SEQ ID NO: 130199

SEQ ID NO: 153975 - RNA, 64 nt, Human; identical to SEQ ID NO: 130200

SEQ ID NO: 153976 - RNA, 64 nt, Human; identical to SEQ ID NO: 130201

SEQ ID NO: 153977 - RNA, 64 nt, Human; identical to SEQ ID NO: 130202

SEQ ID NO: 153978 - RNA, 64 nt, Human; identical to SEQ ID NO: 130203

SEQ ID NO: 153979 - RNA, 64 nt, Human; identical to SEQ ID NO: 130204

SEQ ID NO: 153980 - RNA, 64 nt, Human; identical to SEQ ID NO: 130205

SEQ ID NO: 153981 - RNA, 64 nt, Human; identical to SEQ ID NO: 130206

SEQ ID NO: 153982 - RNA, 64 nt, Human; identical to SEQ ID NO: 130207

SEQ ID NO: 153983 - RNA, 64 nt, Human; identical to SEQ ID NO: 130208

SEQ ID NO: 153984 - RNA, 64 nt, Human; identical to SEQ ID NO: 130209

SEQ ID NO: 153985 - RNA, 64 nt, Human; identical to SEQ ID NO: 130210

SEQ ID NO: 153986 - RNA, 64 nt, Human; identical to SEQ ID NO: 130211

SEQ ID NO: 153987 - RNA, 64 nt, Human; identical to SEQ ID NO: 130212

SEQ ID NO: 153988 - RNA, 64 nt, Human; identical to SEQ ID NO: 130213

SEQ ID NO: 153989 - RNA, 64 nt, Human; identical to SEQ ID NO: 130214

SEQ ID NO: 153990 - RNA, 64 nt, Human; identical to SEQ ID NO: 130215

SEQ ID NO: 153991 - RNA, 64 nt, Human; identical to SEQ ID NO: 130216

SEQ ID NO: 153992 - RNA, 64 nt, Human; identical to SEQ ID NO: 130217

SEQ ID NO: 153993 - RNA, 64 nt, Human; identical to SEQ ID NO: 130218

SEQ ID NO: 153994 - RNA, 64 nt, Human; identical to SEQ ID NO: 130219

SEQ ID NO: 153995 - RNA, 64 nt, Human; identical to SEQ ID NO: 130220

SEQ ID NO: 153996 - RNA, 64 nt, Human; identical to SEQ ID NO: 130221

SEQ ID NO: 153997 - RNA, 64 nt, Human; identical to SEQ ID NO: 130222

SEQ ID NO: 153998 - RNA, 64 nt, Human; identical to SEQ ID NO: 130223

SEQ ID NO: 153999 - RNA, 64 nt, Human; identical to SEQ ID NO: 130224

SEQ ID NO: 154000 - RNA, 64 nt, Human; identical to SEQ ID NO: 130225

SEQ ID NO: 154001 - RNA, 64 nt, Human; identical to SEQ ID NO: 130226

SEQ ID NO: 154002 - RNA, 64 nt, Human; identical to SEQ ID NO: 130227

SEQ ID NO: 154003 - RNA, 64 nt, Human; identical to SEQ ID NO: 130228

SEQ ID NO: 154004 - RNA, 64 nt, Human; identical to SEQ ID NO: 130229

SEQ ID NO: 154005 - RNA, 64 nt, Human; identical to SEQ ID NO: 130230

SEQ ID NO: 154006 - RNA, 64 nt, Human; identical to SEQ ID NO: 130231

SEQ ID NO: 154007 - RNA, 64 nt, Human; identical to SEQ ID NO: 130232

SEQ ID NO: 154008 - RNA, 64 nt, Human; identical to SEQ ID NO: 130233

SEQ ID NO: 154009 - RNA, 64 nt, Human; identical to SEQ ID NO: 130234

SEQ ID NO: 154010 - RNA, 64 nt, Human; identical to SEQ ID NO: 130235

SEQ ID NO: 154011 - RNA, 64 nt, Human; identical to SEQ ID NO: 130236

SEQ ID NO: 154012 - RNA, 64 nt, Human; identical to SEQ ID NO: 130237

SEQ ID NO: 154013 - RNA, 64 nt, Human; identical to SEQ ID NO: 130238

SEQ ID NO: 154014 - RNA, 64 nt, Human; identical to SEQ ID NO: 130239

SEQ ID NO: 154015 - RNA, 64 nt, Human; identical to SEQ ID NO: 130240

SEQ ID NO: 154016 - RNA, 64 nt, Human; identical to SEQ ID NO: 130241

SEQ ID NO: 154017 - RNA, 64 nt, Human; identical to SEQ ID NO: 130242

SEQ ID NO: 154018 - RNA, 64 nt, Human; identical to SEQ ID NO: 130243

SEQ ID NO: 154019 - RNA, 64 nt, Human; identical to SEQ ID NO: 130244

SEQ ID NO: 154020 - RNA, 64 nt, Human; identical to SEQ ID NO: 130245

SEQ ID NO: 154021 - RNA, 64 nt, Human; identical to SEQ ID NO: 130246

SEQ ID NO: 154022 - RNA, 64 nt, Human; identical to SEQ ID NO: 130247

SEQ ID NO: 154023 - RNA, 64 nt, Human; identical to SEQ ID NO: 130248

SEQ ID NO: 154024 - RNA, 64 nt, Human; identical to SEQ ID NO: 130249

SEQ ID NO: 154025 - RNA, 64 nt, Human; identical to SEQ ID NO: 130250

SEQ ID NO: 154026 - RNA, 64 nt, Human; identical to SEQ ID NO: 130251

SEQ ID NO: 154027 - RNA, 64 nt, Human; identical to SEQ ID NO: 130252

SEQ ID NO: 154028 - RNA, 64 nt, Human; identical to SEQ ID NO: 130253

SEQ ID NO: 154029 - RNA, 64 nt, Human; identical to SEQ ID NO: 130254

SEQ ID NO: 154030 - RNA, 64 nt, Human; identical to SEQ ID NO: 130255

SEQ ID NO: 154031 - RNA, 64 nt, Human; identical to SEQ ID NO: 130256

SEQ ID NO: 154032 - RNA, 64 nt, Human; identical to SEQ ID NO: 130257

SEQ ID NO: 154033 - RNA, 64 nt, Human; identical to SEQ ID NO: 130258

SEQ ID NO: 154034 - RNA, 64 nt, Human; identical to SEQ ID NO: 130259

SEQ ID NO: 154035 - RNA, 64 nt, Human; identical to SEQ ID NO: 130260

SEQ ID NO: 154036 - RNA, 64 nt, Human; identical to SEQ ID NO: 130261

SEQ ID NO: 154037 - RNA, 64 nt, Human; identical to SEQ ID NO: 130262

SEQ ID NO: 154038 - RNA, 64 nt, Human; identical to SEQ ID NO: 130263

SEQ ID NO: 154039 - RNA, 64 nt, Human; identical to SEQ ID NO: 130264

SEQ ID NO: 154040 - RNA, 64 nt, Human; identical to SEQ ID NO: 130265

SEQ ID NO: 154041 - RNA, 64 nt, Human; identical to SEQ ID NO: 130266

SEQ ID NO: 154042 - RNA, 64 nt, Human; identical to SEQ ID NO: 130267

SEQ ID NO: 154043 - RNA, 64 nt, Human; identical to SEQ ID NO: 130268

SEQ ID NO: 154044 - RNA, 64 nt, Human; identical to SEQ ID NO: 130269

SEQ ID NO: 154045 - RNA, 64 nt, Human; identical to SEQ ID NO: 130270

SEQ ID NO: 154046 - RNA, 64 nt, Human; identical to SEQ ID NO: 130271

SEQ ID NO: 154047 - RNA, 64 nt, Human; identical to SEQ ID NO: 130272

SEQ ID NO: 154048 - RNA, 64 nt, Human; identical to SEQ ID NO: 130273

SEQ ID NO: 154049 - RNA, 64 nt, Human; identical to SEQ ID NO: 130274

SEQ ID NO: 154050 - RNA, 64 nt, Human; identical to SEQ ID NO: 130275

SEQ ID NO: 154051 - RNA, 64 nt, Human; identical to SEQ ID NO: 130276

SEQ ID NO: 154052 - RNA, 64 nt, Human; identical to SEQ ID NO: 130277

SEQ ID NO: 154053 - RNA, 64 nt, Human; identical to SEQ ID NO: 130278

SEQ ID NO: 154054 - RNA, 64 nt, Human; identical to SEQ ID NO: 130279

SEQ ID NO: 154055 - RNA, 64 nt, Human; identical to SEQ ID NO: 130280

SEQ ID NO: 154056 - RNA, 64 nt, Human; identical to SEQ ID NO: 130281

SEQ ID NO: 154057 - RNA, 64 nt, Human; identical to SEQ ID NO: 130282

SEQ ID NO: 154058 - RNA, 64 nt, Human; identical to SEQ ID NO: 130283

SEQ ID NO: 154059 - RNA, 64 nt, Human; identical to SEQ ID NO: 130284

SEQ ID NO: 154060 - RNA, 64 nt, Human; identical to SEQ ID NO: 130285

SEQ ID NO: 154061 - RNA, 64 nt, Human; identical to SEQ ID NO: 130286

SEQ ID NO: 154062 - RNA, 64 nt, Human; identical to SEQ ID NO: 130287

SEQ ID NO: 154063 - RNA, 64 nt, Human; identical to SEQ ID NO: 130288

SEQ ID NO: 154064 - RNA, 64 nt, Human; identical to SEQ ID NO: 130289

SEQ ID NO: 154065 - RNA, 64 nt, Human; identical to SEQ ID NO: 130290

SEQ ID NO: 154066 - RNA, 64 nt, Human; identical to SEQ ID NO: 130291

SEQ ID NO: 154067 - RNA, 64 nt, Human; identical to SEQ ID NO: 130292

SEQ ID NO: 154068 - RNA, 64 nt, Human; identical to SEQ ID NO: 130293

SEQ ID NO: 154069 - RNA, 64 nt, Human; identical to SEQ ID NO: 130294

SEQ ID NO: 154070 - RNA, 64 nt, Human; identical to SEQ ID NO: 130295

SEQ ID NO: 154071 - RNA, 64 nt, Human; identical to SEQ ID NO: 130296

SEQ ID NO: 154072 - RNA, 64 nt, Human; identical to SEQ ID NO: 130297

SEQ ID NO: 154073 - RNA, 64 nt, Human; identical to SEQ ID NO: 130298

SEQ ID NO: 154074 - RNA, 64 nt, Human; identical to SEQ ID NO: 130299

SEQ ID NO: 154075 - RNA, 64 nt, Human; identical to SEQ ID NO: 130300

SEQ ID NO: 154076 - RNA, 64 nt, Human; identical to SEQ ID NO: 130301

SEQ ID NO: 154077 - RNA, 64 nt, Human; identical to SEQ ID NO: 130302

SEQ ID NO: 154078 - RNA, 64 nt, Human; identical to SEQ ID NO: 130303

SEQ ID NO: 154079 - RNA, 64 nt, Human; identical to SEQ ID NO: 130304

SEQ ID NO: 154080 - RNA, 64 nt, Human; identical to SEQ ID NO: 130305

SEQ ID NO: 154081 - RNA, 64 nt, Human; identical to SEQ ID NO: 130306

SEQ ID NO: 154082 - RNA, 64 nt, Human; identical to SEQ ID NO: 130307

SEQ ID NO: 154083 - RNA, 64 nt, Human; identical to SEQ ID NO: 130308

SEQ ID NO: 154084 - RNA, 64 nt, Human; identical to SEQ ID NO: 130309

SEQ ID NO: 154085 - RNA, 64 nt, Human; identical to SEQ ID NO: 130310

SEQ ID NO: 154086 - RNA, 64 nt, Human; identical to SEQ ID NO: 130311

SEQ ID NO: 154087 - RNA, 64 nt, Human; identical to SEQ ID NO: 130312

SEQ ID NO: 154088 - RNA, 64 nt, Human; identical to SEQ ID NO: 130313

SEQ ID NO: 154089 - RNA, 64 nt, Human; identical to SEQ ID NO: 130314

SEQ ID NO: 154090 - RNA, 64 nt, Human; identical to SEQ ID NO: 130315

SEQ ID NO: 154091 - RNA, 64 nt, Human; identical to SEQ ID NO: 130316

SEQ ID NO: 154092 - RNA, 64 nt, Human; identical to SEQ ID NO: 130317

SEQ ID NO: 154093 - RNA, 64 nt, Human; identical to SEQ ID NO: 130318

SEQ ID NO: 154094 - RNA, 64 nt, Human; identical to SEQ ID NO: 130319

SEQ ID NO: 154095 - RNA, 64 nt, Human; identical to SEQ ID NO: 130320

SEQ ID NO: 154096 - RNA, 64 nt, Human; identical to SEQ ID NO: 130321

SEQ ID NO: 154097 - RNA, 64 nt, Human; identical to SEQ ID NO: 130322

SEQ ID NO: 154098 - RNA, 64 nt, Human; identical to SEQ ID NO: 130323

SEQ ID NO: 154099 - RNA, 64 nt, Human; identical to SEQ ID NO: 130324

SEQ ID NO: 154100 - RNA, 64 nt, Human; identical to SEQ ID NO: 130325

SEQ ID NO: 154101 - RNA, 64 nt, Human; identical to SEQ ID NO: 130326

SEQ ID NO: 154102 - RNA, 64 nt, Human; identical to SEQ ID NO: 130327

SEQ ID NO: 154103 - RNA, 64 nt, Human; identical to SEQ ID NO: 130328

SEQ ID NO: 154104 - RNA, 64 nt, Human; identical to SEQ ID NO: 130329

SEQ ID NO: 154105 - RNA, 64 nt, Human; identical to SEQ ID NO: 130330

SEQ ID NO: 154106 - RNA, 64 nt, Human; identical to SEQ ID NO: 130331

SEQ ID NO: 154107 - RNA, 64 nt, Human; identical to SEQ ID NO: 130332

SEQ ID NO: 154108 - RNA, 64 nt, Human; identical to SEQ ID NO: 130333

SEQ ID NO: 154109 - RNA, 64 nt, Human; identical to SEQ ID NO: 130334

SEQ ID NO: 154110 - RNA, 64 nt, Human; identical to SEQ ID NO: 130335

SEQ ID NO: 154111 - RNA, 64 nt, Human; identical to SEQ ID NO: 130336

SEQ ID NO: 154112 - RNA, 64 nt, Human; identical to SEQ ID NO: 130337

SEQ ID NO: 154113 - RNA, 64 nt, Human; identical to SEQ ID NO: 130338

SEQ ID NO: 154114 - RNA, 64 nt, Human; identical to SEQ ID NO: 130339

SEQ ID NO: 154115 - RNA, 64 nt, Human; identical to SEQ ID NO: 130340

SEQ ID NO: 154116 - RNA, 64 nt, Human; identical to SEQ ID NO: 130341

SEQ ID NO: 154117 - RNA, 64 nt, Human; identical to SEQ ID NO: 130342

SEQ ID NO: 154118 - RNA, 64 nt, Human; identical to SEQ ID NO: 130343

SEQ ID NO: 154119 - RNA, 64 nt, Human; identical to SEQ ID NO: 130344

SEQ ID NO: 154120 - RNA, 64 nt, Human; identical to SEQ ID NO: 130345

SEQ ID NO: 154121 - RNA, 64 nt, Human; identical to SEQ ID NO: 130346

SEQ ID NO: 154122 - RNA, 64 nt, Human; identical to SEQ ID NO: 130347

SEQ ID NO: 154123 - RNA, 64 nt, Human; identical to SEQ ID NO: 130348

SEQ ID NO: 154124 - RNA, 64 nt, Human; identical to SEQ ID NO: 130349

SEQ ID NO: 154125 - RNA, 64 nt, Human; identical to SEQ ID NO: 130350

SEQ ID NO: 154126 - RNA, 64 nt, Human; identical to SEQ ID NO: 130351

SEQ ID NO: 154127 - RNA, 64 nt, Human; identical to SEQ ID NO: 130352

SEQ ID NO: 154128 - RNA, 64 nt, Human; identical to SEQ ID NO: 130353

SEQ ID NO: 154129 - RNA, 64 nt, Human; identical to SEQ ID NO: 130354

SEQ ID NO: 154130 - RNA, 64 nt, Human; identical to SEQ ID NO: 130355

SEQ ID NO: 154131 - RNA, 64 nt, Human; identical to SEQ ID NO: 130356

SEQ ID NO: 154132 - RNA, 64 nt, Human; identical to SEQ ID NO: 130357

SEQ ID NO: 154133 - RNA, 64 nt, Human; identical to SEQ ID NO: 130358

SEQ ID NO: 154134 - RNA, 64 nt, Human; identical to SEQ ID NO: 130359

SEQ ID NO: 154135 - RNA, 64 nt, Human; identical to SEQ ID NO: 130360

SEQ ID NO: 154136 - RNA, 64 nt, Human; identical to SEQ ID NO: 130361

SEQ ID NO: 154137 - RNA, 64 nt, Human; identical to SEQ ID NO: 130362

SEQ ID NO: 154138 - RNA, 64 nt, Human; identical to SEQ ID NO: 130363

SEQ ID NO: 154139 - RNA, 64 nt, Human; identical to SEQ ID NO: 130364

SEQ ID NO: 154140 - RNA, 64 nt, Human; identical to SEQ ID NO: 130365

SEQ ID NO: 154141 - RNA, 64 nt, Human; identical to SEQ ID NO: 130366

SEQ ID NO: 154142 - RNA, 64 nt, Human; identical to SEQ ID NO: 130367

SEQ ID NO: 154143 - RNA, 64 nt, Human; identical to SEQ ID NO: 130368

SEQ ID NO: 154144 - RNA, 64 nt, Human; identical to SEQ ID NO: 130369

SEQ ID NO: 154145 - RNA, 64 nt, Human; identical to SEQ ID NO: 130370

SEQ ID NO: 154146 - RNA, 64 nt, Human; identical to SEQ ID NO: 130371

SEQ ID NO: 154147 - RNA, 64 nt, Human; identical to SEQ ID NO: 130372

SEQ ID NO: 154148 - RNA, 64 nt, Human; identical to SEQ ID NO: 130373

SEQ ID NO: 154149 - RNA, 64 nt, Human; identical to SEQ ID NO: 130374

SEQ ID NO: 154150 - RNA, 64 nt, Human; identical to SEQ ID NO: 130375

SEQ ID NO: 154151 - RNA, 64 nt, Human; identical to SEQ ID NO: 130376

SEQ ID NO: 154152 - RNA, 64 nt, Human; identical to SEQ ID NO: 130377

SEQ ID NO: 154153 - RNA, 64 nt, Human; identical to SEQ ID NO: 130378

SEQ ID NO: 154154 - RNA, 64 nt, Human; identical to SEQ ID NO: 130379

SEQ ID NO: 154155 - RNA, 64 nt, Human; identical to SEQ ID NO: 130380

SEQ ID NO: 154156 - RNA, 64 nt, Human; identical to SEQ ID NO: 130381

SEQ ID NO: 154157 - RNA, 64 nt, Human; identical to SEQ ID NO: 130382

SEQ ID NO: 154158 - RNA, 64 nt, Human; identical to SEQ ID NO: 130383

SEQ ID NO: 154159 - RNA, 64 nt, Human; identical to SEQ ID NO: 130384

SEQ ID NO: 154160 - RNA, 64 nt, Human; identical to SEQ ID NO: 130385

SEQ ID NO: 154161 - RNA, 64 nt, Human; identical to SEQ ID NO: 130386

SEQ ID NO: 154162 - RNA, 64 nt, Human; identical to SEQ ID NO: 130387

SEQ ID NO: 154163 - RNA, 64 nt, Human; identical to SEQ ID NO: 130388

SEQ ID NO: 154164 - RNA, 64 nt, Human; identical to SEQ ID NO: 130389

SEQ ID NO: 154165 - RNA, 64 nt, Human; identical to SEQ ID NO: 130390

SEQ ID NO: 154166 - RNA, 64 nt, Human; identical to SEQ ID NO: 130391

SEQ ID NO: 154167 - RNA, 64 nt, Human; identical to SEQ ID NO: 130392

SEQ ID NO: 154168 - RNA, 64 nt, Human; identical to SEQ ID NO: 130393

SEQ ID NO: 154169 - RNA, 64 nt, Human; identical to SEQ ID NO: 130394

SEQ ID NO: 154170 - RNA, 64 nt, Human; identical to SEQ ID NO: 130395

SEQ ID NO: 154171 - RNA, 64 nt, Human; identical to SEQ ID NO: 130396

SEQ ID NO: 154172 - RNA, 64 nt, Human; identical to SEQ ID NO: 130397

SEQ ID NO: 154173 - RNA, 64 nt, Human; identical to SEQ ID NO: 130398

SEQ ID NO: 154174 - RNA, 64 nt, Human; identical to SEQ ID NO: 130399

SEQ ID NO: 154175 - RNA, 64 nt, Human; identical to SEQ ID NO: 130400

SEQ ID NO: 154176 - RNA, 64 nt, Human; identical to SEQ ID NO: 130401

SEQ ID NO: 154177 - RNA, 64 nt, Human; identical to SEQ ID NO: 130402

SEQ ID NO: 154178 - RNA, 64 nt, Human; identical to SEQ ID NO: 130403

SEQ ID NO: 154179 - RNA, 64 nt, Human; identical to SEQ ID NO: 130404

SEQ ID NO: 154180 - RNA, 64 nt, Human; identical to SEQ ID NO: 130405

SEQ ID NO: 154181 - RNA, 64 nt, Human; identical to SEQ ID NO: 130406

SEQ ID NO: 154182 - RNA, 64 nt, Human; identical to SEQ ID NO: 130407

SEQ ID NO: 154183 - RNA, 64 nt, Human; identical to SEQ ID NO: 130408

SEQ ID NO: 154184 - RNA, 64 nt, Human; identical to SEQ ID NO: 130409

SEQ ID NO: 154185 - RNA, 64 nt, Human; identical to SEQ ID NO: 130410

SEQ ID NO: 154186 - RNA, 64 nt, Human; identical to SEQ ID NO: 130411

SEQ ID NO: 154187 - RNA, 64 nt, Human; identical to SEQ ID NO: 130412

SEQ ID NO: 154188 - RNA, 64 nt, Human; identical to SEQ ID NO: 130413

SEQ ID NO: 154189 - RNA, 64 nt, Human; identical to SEQ ID NO: 130414

SEQ ID NO: 154190 - RNA, 64 nt, Human; identical to SEQ ID NO: 130415

SEQ ID NO: 154191 - RNA, 64 nt, Human; identical to SEQ ID NO: 130416

SEQ ID NO: 154192 - RNA, 64 nt, Human; identical to SEQ ID NO: 130417

SEQ ID NO: 154193 - RNA, 64 nt, Human; identical to SEQ ID NO: 130418

SEQ ID NO: 154194 - RNA, 64 nt, Human; identical to SEQ ID NO: 130419

SEQ ID NO: 154195 - RNA, 64 nt, Human; identical to SEQ ID NO: 130420

SEQ ID NO: 154196 - RNA, 64 nt, Human; identical to SEQ ID NO: 130421

SEQ ID NO: 154197 - RNA, 64 nt, Human; identical to SEQ ID NO: 130422

SEQ ID NO: 154198 - RNA, 64 nt, Human; identical to SEQ ID NO: 130423

SEQ ID NO: 154199 - RNA, 64 nt, Human; identical to SEQ ID NO: 130424

SEQ ID NO: 154200 - RNA, 64 nt, Human; identical to SEQ ID NO: 130425

SEQ ID NO: 154201 - RNA, 64 nt, Human; identical to SEQ ID NO: 130426

SEQ ID NO: 154202 - RNA, 64 nt, Human; identical to SEQ ID NO: 130427

SEQ ID NO: 154203 - RNA, 64 nt, Human; identical to SEQ ID NO: 130428

SEQ ID NO: 154204 - RNA, 64 nt, Human; identical to SEQ ID NO: 130429

SEQ ID NO: 154205 - RNA, 64 nt, Human; identical to SEQ ID NO: 130430

SEQ ID NO: 154206 - RNA, 64 nt, Human; identical to SEQ ID NO: 130431

SEQ ID NO: 154207 - RNA, 64 nt, Human; identical to SEQ ID NO: 130432

SEQ ID NO: 154208 - RNA, 64 nt, Human; identical to SEQ ID NO: 130433

SEQ ID NO: 154209 - RNA, 64 nt, Human; identical to SEQ ID NO: 130434

SEQ ID NO: 154210 - RNA, 64 nt, Human; identical to SEQ ID NO: 130435

SEQ ID NO: 154211 - RNA, 64 nt, Human; identical to SEQ ID NO: 130436

SEQ ID NO: 154212 - RNA, 64 nt, Human; identical to SEQ ID NO: 130437

SEQ ID NO: 154213 - RNA, 64 nt, Human; identical to SEQ ID NO: 130438

SEQ ID NO: 154214 - RNA, 64 nt, Human; identical to SEQ ID NO: 130439

SEQ ID NO: 154215 - RNA, 64 nt, Human; identical to SEQ ID NO: 130440

SEQ ID NO: 154216 - RNA, 64 nt, Human; identical to SEQ ID NO: 130441

SEQ ID NO: 154217 - RNA, 64 nt, Human; identical to SEQ ID NO: 130442

SEQ ID NO: 154218 - RNA, 64 nt, Human; identical to SEQ ID NO: 130443

SEQ ID NO: 154219 - RNA, 64 nt, Human; identical to SEQ ID NO: 130444

SEQ ID NO: 154220 - RNA, 64 nt, Human; identical to SEQ ID NO: 130445

SEQ ID NO: 154221 - RNA, 64 nt, Human; identical to SEQ ID NO: 130446

SEQ ID NO: 154222 - RNA, 64 nt, Human; identical to SEQ ID NO: 130447

SEQ ID NO: 154223 - RNA, 64 nt, Human; identical to SEQ ID NO: 130448

SEQ ID NO: 154224 - RNA, 64 nt, Human; identical to SEQ ID NO: 130449

SEQ ID NO: 154225 - RNA, 64 nt, Human; identical to SEQ ID NO: 130450

SEQ ID NO: 154226 - RNA, 64 nt, Human; identical to SEQ ID NO: 130451

SEQ ID NO: 154227 - RNA, 64 nt, Human; identical to SEQ ID NO: 130452

SEQ ID NO: 154228 - RNA, 64 nt, Human; identical to SEQ ID NO: 130453

SEQ ID NO: 154229 - RNA, 64 nt, Human; identical to SEQ ID NO: 130454

SEQ ID NO: 154230 - RNA, 64 nt, Human; identical to SEQ ID NO: 130455

SEQ ID NO: 154231 - RNA, 64 nt, Human; identical to SEQ ID NO: 130456

SEQ ID NO: 154232 - RNA, 64 nt, Human; identical to SEQ ID NO: 130457

SEQ ID NO: 154233 - RNA, 64 nt, Human; identical to SEQ ID NO: 130458

SEQ ID NO: 154234 - RNA, 64 nt, Human; identical to SEQ ID NO: 130459

SEQ ID NO: 154235 - RNA, 64 nt, Human; identical to SEQ ID NO: 130460

SEQ ID NO: 154236 - RNA, 64 nt, Human; identical to SEQ ID NO: 130461

SEQ ID NO: 154237 - RNA, 64 nt, Human; identical to SEQ ID NO: 130462

SEQ ID NO: 154238 - RNA, 64 nt, Human; identical to SEQ ID NO: 130463

SEQ ID NO: 154239 - RNA, 64 nt, Human; identical to SEQ ID NO: 130464

SEQ ID NO: 154240 - RNA, 64 nt, Human; identical to SEQ ID NO: 130465

SEQ ID NO: 154241 - RNA, 64 nt, Human; identical to SEQ ID NO: 130466

SEQ ID NO: 154242 - RNA, 64 nt, Human; identical to SEQ ID NO: 130467

SEQ ID NO: 154243 - RNA, 64 nt, Human; identical to SEQ ID NO: 130468

SEQ ID NO: 154244 - RNA, 64 nt, Human; identical to SEQ ID NO: 130469

SEQ ID NO: 154245 - RNA, 64 nt, Human; identical to SEQ ID NO: 130470

SEQ ID NO: 154246 - RNA, 64 nt, Human; identical to SEQ ID NO: 130471

SEQ ID NO: 154247 - RNA, 64 nt, Human; identical to SEQ ID NO: 130472

SEQ ID NO: 154248 - RNA, 64 nt, Human; identical to SEQ ID NO: 130473

SEQ ID NO: 154249 - RNA, 51 nt, Human; identical to SEQ ID NO: 130474

SEQ ID NO: 154250 - RNA, 64 nt, Human; identical to SEQ ID NO: 130475

SEQ ID NO: 154251 - RNA, 64 nt, Human; identical to SEQ ID NO: 130476

SEQ ID NO: 154252 - RNA, 64 nt, Human; identical to SEQ ID NO: 130477

SEQ ID NO: 154253 - RNA, 64 nt, Human; identical to SEQ ID NO: 130478

SEQ ID NO: 154254 - RNA, 64 nt, Human; identical to SEQ ID NO: 130479

SEQ ID NO: 154255 - RNA, 64 nt, Human; identical to SEQ ID NO: 130480

SEQ ID NO: 154256 - RNA, 64 nt, Human; identical to SEQ ID NO: 130481

SEQ ID NO: 154257 - RNA, 64 nt, Human; identical to SEQ ID NO: 130482

SEQ ID NO: 154258 - RNA, 64 nt, Human; identical to SEQ ID NO: 130483

SEQ ID NO: 154259 - RNA, 64 nt, Human; identical to SEQ ID NO: 130484

SEQ ID NO: 154260 - RNA, 50 nt, Human; identical to SEQ ID NO: 130485

SEQ ID NO: 154261 - RNA, 64 nt, Human; identical to SEQ ID NO: 130486

SEQ ID NO: 154262 - RNA, 64 nt, Human; identical to SEQ ID NO: 130487

SEQ ID NO: 154263 - RNA, 64 nt, Human; identical to SEQ ID NO: 130488

SEQ ID NO: 154264 - RNA, 64 nt, Human; identical to SEQ ID NO: 130489

SEQ ID NO: 154265 - RNA, 64 nt, Human; identical to SEQ ID NO: 130490

SEQ ID NO: 154266 - RNA, 64 nt, Human; identical to SEQ ID NO: 130491

SEQ ID NO: 154267 - RNA, 64 nt, Human; identical to SEQ ID NO: 130492

SEQ ID NO: 154268 - RNA, 64 nt, Human; identical to SEQ ID NO: 130493

SEQ ID NO: 154269 - RNA, 64 nt, Human; identical to SEQ ID NO: 130494

SEQ ID NO: 154270 - RNA, 64 nt, Human; identical to SEQ ID NO: 130495

SEQ ID NO: 154271 - RNA, 64 nt, Human; identical to SEQ ID NO: 130496

SEQ ID NO: 154272 - RNA, 64 nt, Human; identical to SEQ ID NO: 130497

SEQ ID NO: 154273 - RNA, 64 nt, Human; identical to SEQ ID NO: 130498

SEQ ID NO: 154274 - RNA, 64 nt, Human; identical to SEQ ID NO: 130499

SEQ ID NO: 154275 - RNA, 64 nt, Human; identical to SEQ ID NO: 130500

SEQ ID NO: 154276 - RNA, 64 nt, Human; identical to SEQ ID NO: 130501

SEQ ID NO: 154277 - RNA, 64 nt, Human; identical to SEQ ID NO: 130502

SEQ ID NO: 154278 - RNA, 64 nt, Human; identical to SEQ ID NO: 130503

SEQ ID NO: 154279 - RNA, 64 nt, Human; identical to SEQ ID NO: 130504

SEQ ID NO: 154280 - RNA, 64 nt, Human; identical to SEQ ID NO: 130505

SEQ ID NO: 154281 - RNA, 64 nt, Human; identical to SEQ ID NO: 130506

SEQ ID NO: 154282 - RNA, 64 nt, Human; identical to SEQ ID NO: 130507

SEQ ID NO: 154283 - RNA, 64 nt, Human; identical to SEQ ID NO: 130508

SEQ ID NO: 154284 - RNA, 64 nt, Human; identical to SEQ ID NO: 130509

SEQ ID NO: 154285 - RNA, 64 nt, Human; identical to SEQ ID NO: 130510

SEQ ID NO: 154286 - RNA, 64 nt, Human; identical to SEQ ID NO: 130511

SEQ ID NO: 154287 - RNA, 64 nt, Human; identical to SEQ ID NO: 130512

SEQ ID NO: 154288 - RNA, 64 nt, Human; identical to SEQ ID NO: 130513

SEQ ID NO: 154289 - RNA, 64 nt, Human; identical to SEQ ID NO: 130514

SEQ ID NO: 154290 - RNA, 64 nt, Human; identical to SEQ ID NO: 130515

SEQ ID NO: 154291 - RNA, 64 nt, Human; identical to SEQ ID NO: 130516

SEQ ID NO: 154292 - RNA, 64 nt, Human; identical to SEQ ID NO: 130517

SEQ ID NO: 154293 - RNA, 64 nt, Human; identical to SEQ ID NO: 130518

SEQ ID NO: 154294 - RNA, 64 nt, Human; identical to SEQ ID NO: 130519

SEQ ID NO: 154295 - RNA, 64 nt, Human; identical to SEQ ID NO: 130520

SEQ ID NO: 154296 - RNA, 64 nt, Human; identical to SEQ ID NO: 130521

SEQ ID NO: 154297 - RNA, 64 nt, Human; identical to SEQ ID NO: 130522

SEQ ID NO: 154298 - RNA, 64 nt, Human; identical to SEQ ID NO: 130523

SEQ ID NO: 154299 - RNA, 64 nt, Human; identical to SEQ ID NO: 130524

SEQ ID NO: 154300 - RNA, 64 nt, Human; identical to SEQ ID NO: 130525

SEQ ID NO: 154301 - RNA, 64 nt, Human; identical to SEQ ID NO: 130526

SEQ ID NO: 154302 - RNA, 64 nt, Human; identical to SEQ ID NO: 130527

SEQ ID NO: 154303 - RNA, 64 nt, Human; identical to SEQ ID NO: 130528

SEQ ID NO: 154304 - RNA, 64 nt, Human; identical to SEQ ID NO: 130529

SEQ ID NO: 154305 - RNA, 64 nt, Human; identical to SEQ ID NO: 130530

SEQ ID NO: 154306 - RNA, 64 nt, Human; identical to SEQ ID NO: 130531

SEQ ID NO: 154307 - RNA, 64 nt, Human; identical to SEQ ID NO: 130532

SEQ ID NO: 154308 - RNA, 64 nt, Human; identical to SEQ ID NO: 130533

SEQ ID NO: 154309 - RNA, 64 nt, Human; identical to SEQ ID NO: 130534

SEQ ID NO: 154310 - RNA, 64 nt, Human; identical to SEQ ID NO: 130535

SEQ ID NO: 154311 - RNA, 64 nt, Human; identical to SEQ ID NO: 130536

SEQ ID NO: 154312 - RNA, 64 nt, Human; identical to SEQ ID NO: 130537

SEQ ID NO: 154313 - RNA, 64 nt, Human; identical to SEQ ID NO: 130538

SEQ ID NO: 154314 - RNA, 64 nt, Human; identical to SEQ ID NO: 130539

SEQ ID NO: 154315 - RNA, 64 nt, Human; identical to SEQ ID NO: 130540

SEQ ID NO: 154316 - RNA, 64 nt, Human; identical to SEQ ID NO: 130541

SEQ ID NO: 154317 - RNA, 64 nt, Human; identical to SEQ ID NO: 130542

SEQ ID NO: 154318 - RNA, 64 nt, Human; identical to SEQ ID NO: 130543

SEQ ID NO: 154319 - RNA, 64 nt, Human; identical to SEQ ID NO: 130544

SEQ ID NO: 154320 - RNA, 64 nt, Human; identical to SEQ ID NO: 130545

SEQ ID NO: 154321 - RNA, 64 nt, Human; identical to SEQ ID NO: 130546

SEQ ID NO: 154322 - RNA, 64 nt, Human; identical to SEQ ID NO: 130547

SEQ ID NO: 154323 - RNA, 54 nt, Human; identical to SEQ ID NO: 130548

SEQ ID NO: 154324 - RNA, 64 nt, Human; identical to SEQ ID NO: 130549

SEQ ID NO: 154325 - RNA, 64 nt, Human; identical to SEQ ID NO: 130550

SEQ ID NO: 154326 - RNA, 64 nt, Human; identical to SEQ ID NO: 130551

SEQ ID NO: 154327 - RNA, 64 nt, Human; identical to SEQ ID NO: 130552

SEQ ID NO: 154328 - RNA, 64 nt, Human; identical to SEQ ID NO: 130553

SEQ ID NO: 154329 - RNA, 64 nt, Human; identical to SEQ ID NO: 130554

SEQ ID NO: 154330 - RNA, 64 nt, Human; identical to SEQ ID NO: 130555

SEQ ID NO: 154331 - RNA, 64 nt, Human; identical to SEQ ID NO: 130556

SEQ ID NO: 154332 - RNA, 64 nt, Human; identical to SEQ ID NO: 130557

SEQ ID NO: 154333 - RNA, 64 nt, Human; identical to SEQ ID NO: 130558

SEQ ID NO: 154334 - RNA, 64 nt, Human; identical to SEQ ID NO: 130559

SEQ ID NO: 154335 - RNA, 64 nt, Human; identical to SEQ ID NO: 130560

SEQ ID NO: 154336 - RNA, 64 nt, Human; identical to SEQ ID NO: 130561

SEQ ID NO: 154337 - RNA, 64 nt, Human; identical to SEQ ID NO: 130562

SEQ ID NO: 154338 - RNA, 64 nt, Human; identical to SEQ ID NO: 130563

SEQ ID NO: 154339 - RNA, 64 nt, Human; identical to SEQ ID NO: 130564

SEQ ID NO: 154340 - RNA, 64 nt, Human; identical to SEQ ID NO: 130565

SEQ ID NO: 154341 - RNA, 64 nt, Human; identical to SEQ ID NO: 130566

SEQ ID NO: 154342 - RNA, 64 nt, Human; identical to SEQ ID NO: 130567

SEQ ID NO: 154343 - RNA, 64 nt, Human; identical to SEQ ID NO: 130568

SEQ ID NO: 154344 - RNA, 64 nt, Human; identical to SEQ ID NO: 130569

SEQ ID NO: 154345 - RNA, 64 nt, Human; identical to SEQ ID NO: 130570

SEQ ID NO: 154346 - RNA, 64 nt, Human; identical to SEQ ID NO: 130571

SEQ ID NO: 154347 - RNA, 64 nt, Human; identical to SEQ ID NO: 130572

SEQ ID NO: 154348 - RNA, 64 nt, Human; identical to SEQ ID NO: 130573

SEQ ID NO: 154349 - RNA, 64 nt, Human; identical to SEQ ID NO: 130574

SEQ ID NO: 154350 - RNA, 64 nt, Human; identical to SEQ ID NO: 130575

SEQ ID NO: 154351 - RNA, 64 nt, Human; identical to SEQ ID NO: 130576

SEQ ID NO: 154352 - RNA, 64 nt, Human; identical to SEQ ID NO: 130577

SEQ ID NO: 154353 - RNA, 64 nt, Human; identical to SEQ ID NO: 130578

SEQ ID NO: 154354 - RNA, 64 nt, Human; identical to SEQ ID NO: 130579

SEQ ID NO: 154355 - RNA, 64 nt, Human; identical to SEQ ID NO: 130580

SEQ ID NO: 154356 - RNA, 64 nt, Human; identical to SEQ ID NO: 130581

SEQ ID NO: 154357 - RNA, 64 nt, Human; identical to SEQ ID NO: 130582

SEQ ID NO: 154358 - RNA, 64 nt, Human; identical to SEQ ID NO: 130583

SEQ ID NO: 154359 - RNA, 64 nt, Human; identical to SEQ ID NO: 130584

SEQ ID NO: 154360 - RNA, 61 nt, Human; identical to SEQ ID NO: 130585

SEQ ID NO: 154361 - RNA, 64 nt, Human; identical to SEQ ID NO: 130586

SEQ ID NO: 154362 - RNA, 64 nt, Human; identical to SEQ ID NO: 130587

SEQ ID NO: 154363 - RNA, 64 nt, Human; identical to SEQ ID NO: 130588

SEQ ID NO: 154364 - RNA, 64 nt, Human; identical to SEQ ID NO: 130589

SEQ ID NO: 154365 - RNA, 64 nt, Human; identical to SEQ ID NO: 130590

SEQ ID NO: 154366 - RNA, 64 nt, Human; identical to SEQ ID NO: 130591

SEQ ID NO: 154367 - RNA, 64 nt, Human; identical to SEQ ID NO: 130592

SEQ ID NO: 154368 - RNA, 64 nt, Human; identical to SEQ ID NO: 130593

SEQ ID NO: 154369 - RNA, 64 nt, Human; identical to SEQ ID NO: 130594

SEQ ID NO: 154370 - RNA, 64 nt, Human; identical to SEQ ID NO: 130595

SEQ ID NO: 154371 - RNA, 64 nt, Human; identical to SEQ ID NO: 130596

SEQ ID NO: 154372 - RNA, 64 nt, Human; identical to SEQ ID NO: 130597

SEQ ID NO: 154373 - RNA, 64 nt, Human; identical to SEQ ID NO: 130598

SEQ ID NO: 154374 - RNA, 56 nt, Human; identical to SEQ ID NO: 130599

SEQ ID NO: 154375 - RNA, 64 nt, Human; identical to SEQ ID NO: 130600

SEQ ID NO: 154376 - RNA, 64 nt, Human; identical to SEQ ID NO: 130601

SEQ ID NO: 154377 - RNA, 64 nt, Human; identical to SEQ ID NO: 130602

SEQ ID NO: 154378 - RNA, 64 nt, Human; identical to SEQ ID NO: 130603

SEQ ID NO: 154379 - RNA, 64 nt, Human; identical to SEQ ID NO: 130604

SEQ ID NO: 154380 - RNA, 55 nt, Human; identical to SEQ ID NO: 130605

SEQ ID NO: 154381 - RNA, 64 nt, Human; identical to SEQ ID NO: 130606

SEQ ID NO: 154382 - RNA, 64 nt, Human; identical to SEQ ID NO: 130607

SEQ ID NO: 154383 - RNA, 64 nt, Human; identical to SEQ ID NO: 130608

SEQ ID NO: 154384 - RNA, 64 nt, Human; identical to SEQ ID NO: 130609

SEQ ID NO: 154385 - RNA, 64 nt, Human; identical to SEQ ID NO: 130610

SEQ ID NO: 154386 - RNA, 64 nt, Human; identical to SEQ ID NO: 130611

SEQ ID NO: 154387 - RNA, 64 nt, Human; identical to SEQ ID NO: 130612

SEQ ID NO: 154388 - RNA, 64 nt, Human; identical to SEQ ID NO: 130613

SEQ ID NO: 154389 - RNA, 64 nt, Human; identical to SEQ ID NO: 130614

SEQ ID NO: 154390 - RNA, 64 nt, Human; identical to SEQ ID NO: 130615

SEQ ID NO: 154391 - RNA, 64 nt, Human; identical to SEQ ID NO: 130616

SEQ ID NO: 154392 - RNA, 64 nt, Human; identical to SEQ ID NO: 130617

SEQ ID NO: 154393 - RNA, 64 nt, Human; identical to SEQ ID NO: 130618

SEQ ID NO: 154394 - RNA, 64 nt, Human; identical to SEQ ID NO: 130619

SEQ ID NO: 154395 - RNA, 64 nt, Human; identical to SEQ ID NO: 130620

SEQ ID NO: 154396 - RNA, 64 nt, Human; identical to SEQ ID NO: 130621

SEQ ID NO: 154397 - RNA, 64 nt, Human; identical to SEQ ID NO: 130622

SEQ ID NO: 154398 - RNA, 64 nt, Human; identical to SEQ ID NO: 130623

SEQ ID NO: 154399 - RNA, 64 nt, Human; identical to SEQ ID NO: 130624

SEQ ID NO: 154400 - RNA, 64 nt, Human; identical to SEQ ID NO: 130625

SEQ ID NO: 154401 - RNA, 64 nt, Human; identical to SEQ ID NO: 130626

SEQ ID NO: 154402 - RNA, 64 nt, Human; identical to SEQ ID NO: 130627

SEQ ID NO: 154403 - RNA, 64 nt, Human; identical to SEQ ID NO: 130628

SEQ ID NO: 154404 - RNA, 64 nt, Human; identical to SEQ ID NO: 130629

SEQ ID NO: 154405 - RNA, 64 nt, Human; identical to SEQ ID NO: 130630

SEQ ID NO: 154406 - RNA, 64 nt, Human; identical to SEQ ID NO: 130631

SEQ ID NO: 154407 - RNA, 64 nt, Human; identical to SEQ ID NO: 130632

SEQ ID NO: 154408 - RNA, 64 nt, Human; identical to SEQ ID NO: 130633

SEQ ID NO: 154409 - RNA, 64 nt, Human; identical to SEQ ID NO: 130634

SEQ ID NO: 154410 - RNA, 64 nt, Human; identical to SEQ ID NO: 130635

SEQ ID NO: 154411 - RNA, 64 nt, Human; identical to SEQ ID NO: 130636

SEQ ID NO: 154412 - RNA, 64 nt, Human; identical to SEQ ID NO: 130637

SEQ ID NO: 154413 - RNA, 64 nt, Human; identical to SEQ ID NO: 130638

SEQ ID NO: 154414 - RNA, 64 nt, Human; identical to SEQ ID NO: 130639

SEQ ID NO: 154415 - RNA, 64 nt, Human; identical to SEQ ID NO: 130640

SEQ ID NO: 154416 - RNA, 64 nt, Human; identical to SEQ ID NO: 130641

SEQ ID NO: 154417 - RNA, 64 nt, Human; identical to SEQ ID NO: 130642

SEQ ID NO: 154418 - RNA, 64 nt, Human; identical to SEQ ID NO: 130643

SEQ ID NO: 154419 - RNA, 64 nt, Human; identical to SEQ ID NO: 130644

SEQ ID NO: 154420 - RNA, 64 nt, Human; identical to SEQ ID NO: 130645

SEQ ID NO: 154421 - RNA, 64 nt, Human; identical to SEQ ID NO: 130646

SEQ ID NO: 154422 - RNA, 64 nt, Human; identical to SEQ ID NO: 130647

SEQ ID NO: 154423 - RNA, 64 nt, Human; identical to SEQ ID NO: 130648

SEQ ID NO: 154424 - RNA, 64 nt, Human; identical to SEQ ID NO: 130649

SEQ ID NO: 154425 - RNA, 64 nt, Human; identical to SEQ ID NO: 130650

SEQ ID NO: 154426 - RNA, 64 nt, Human; identical to SEQ ID NO: 130651

SEQ ID NO: 154427 - RNA, 64 nt, Human; identical to SEQ ID NO: 130652

SEQ ID NO: 154428 - RNA, 64 nt, Human; identical to SEQ ID NO: 130653

SEQ ID NO: 154429 - RNA, 64 nt, Human; identical to SEQ ID NO: 130654

SEQ ID NO: 154430 - RNA, 64 nt, Human; identical to SEQ ID NO: 130655

SEQ ID NO: 154431 - RNA, 64 nt, Human; identical to SEQ ID NO: 130656

SEQ ID NO: 154432 - RNA, 64 nt, Human; identical to SEQ ID NO: 130657

SEQ ID NO: 154433 - RNA, 64 nt, Human; identical to SEQ ID NO: 130658

SEQ ID NO: 154434 - RNA, 64 nt, Human; identical to SEQ ID NO: 130659

SEQ ID NO: 154435 - RNA, 64 nt, Human; identical to SEQ ID NO: 130660

SEQ ID NO: 154436 - RNA, 64 nt, Human; identical to SEQ ID NO: 130661

SEQ ID NO: 154437 - RNA, 64 nt, Human; identical to SEQ ID NO: 130662

SEQ ID NO: 154438 - RNA, 64 nt, Human; identical to SEQ ID NO: 130663

SEQ ID NO: 154439 - RNA, 64 nt, Human; identical to SEQ ID NO: 130664

SEQ ID NO: 154440 - RNA, 64 nt, Human; identical to SEQ ID NO: 130665

SEQ ID NO: 154441 - RNA, 64 nt, Human; identical to SEQ ID NO: 130666

SEQ ID NO: 154442 - RNA, 64 nt, Human; identical to SEQ ID NO: 130667

SEQ ID NO: 154443 - RNA, 64 nt, Human; identical to SEQ ID NO: 130668

SEQ ID NO: 154444 - RNA, 64 nt, Human; identical to SEQ ID NO: 130669

SEQ ID NO: 154445 - RNA, 64 nt, Human; identical to SEQ ID NO: 130670

SEQ ID NO: 154446 - RNA, 64 nt, Human; identical to SEQ ID NO: 130671

SEQ ID NO: 154447 - RNA, 64 nt, Human; identical to SEQ ID NO: 130672

SEQ ID NO: 154448 - RNA, 64 nt, Human; identical to SEQ ID NO: 130024

SEQ ID NO: 154449 - RNA, 64 nt, Human; identical to SEQ ID NO: 130025

SEQ ID NO: 154450 - RNA, 64 nt, Human; identical to SEQ ID NO: 130026

SEQ ID NO: 154451 - RNA, 64 nt, Human; identical to SEQ ID NO: 130027

SEQ ID NO: 154452 - RNA, 64 nt, Human; identical to SEQ ID NO: 130028

SEQ ID NO: 154453 - RNA, 64 nt, Human; identical to SEQ ID NO: 130029

SEQ ID NO: 154454 - RNA, 64 nt, Human; identical to SEQ ID NO: 130030

SEQ ID NO: 154455 - RNA, 64 nt, Human; identical to SEQ ID NO: 130031

SEQ ID NO: 154456 - RNA, 64 nt, Human; identical to SEQ ID NO: 130032

SEQ ID NO: 154457 - RNA, 64 nt, Human; identical to SEQ ID NO: 130033

SEQ ID NO: 154458 - RNA, 64 nt, Human; identical to SEQ ID NO: 130034

SEQ ID NO: 154459 - RNA, 64 nt, Human; identical to SEQ ID NO: 130035

SEQ ID NO: 154460 - RNA, 64 nt, Human; identical to SEQ ID NO: 130036

SEQ ID NO: 154461 - RNA, 64 nt, Human; identical to SEQ ID NO: 130037

SEQ ID NO: 154462 - RNA, 64 nt, Human; identical to SEQ ID NO: 130038

SEQ ID NO: 154463 - RNA, 64 nt, Human; identical to SEQ ID NO: 130039

SEQ ID NO: 154464 - RNA, 64 nt, Human; identical to SEQ ID NO: 130040

SEQ ID NO: 154465 - RNA, 64 nt, Human; identical to SEQ ID NO: 130041

SEQ ID NO: 154466 - RNA, 64 nt, Human; identical to SEQ ID NO: 130042

SEQ ID NO: 154467 - RNA, 64 nt, Human; identical to SEQ ID NO: 130043

SEQ ID NO: 154468 - RNA, 56 nt, Human; identical to SEQ ID NO: 130044

SEQ ID NO: 154469 - RNA, 64 nt, Human; identical to SEQ ID NO: 130045

SEQ ID NO: 154470 - RNA, 64 nt, Human; identical to SEQ ID NO: 130046

SEQ ID NO: 154471 - RNA, 64 nt, Human; identical to SEQ ID NO: 130047

SEQ ID NO: 154472 - RNA, 64 nt, Human; identical to SEQ ID NO: 130048

SEQ ID NO: 154473 - RNA, 64 nt, Human; identical to SEQ ID NO: 130049

SEQ ID NO: 154474 - RNA, 64 nt, Human; identical to SEQ ID NO: 130050

SEQ ID NO: 154475 - RNA, 64 nt, Human; identical to SEQ ID NO: 130051

SEQ ID NO: 154476 - RNA, 64 nt, Human; identical to SEQ ID NO: 130052

SEQ ID NO: 154477 - RNA, 64 nt, Human; identical to SEQ ID NO: 130053

SEQ ID NO: 154478 - RNA, 64 nt, Human; identical to SEQ ID NO: 130054

SEQ ID NO: 154479 - RNA, 64 nt, Human; identical to SEQ ID NO: 130055

SEQ ID NO: 154480 - RNA, 64 nt, Human; identical to SEQ ID NO: 130056

SEQ ID NO: 154481 - RNA, 64 nt, Human; identical to SEQ ID NO: 130057

SEQ ID NO: 154482 - RNA, 64 nt, Human; identical to SEQ ID NO: 130058

SEQ ID NO: 154483 - RNA, 64 nt, Human; identical to SEQ ID NO: 130059

SEQ ID NO: 154484 - RNA, 64 nt, Human; identical to SEQ ID NO: 130060

SEQ ID NO: 154485 - RNA, 64 nt, Human; identical to SEQ ID NO: 130061

SEQ ID NO: 154486 - RNA, 64 nt, Human; identical to SEQ ID NO: 130062

SEQ ID NO: 154487 - RNA, 64 nt, Human; identical to SEQ ID NO: 130063

SEQ ID NO: 154488 - RNA, 64 nt, Human; identical to SEQ ID NO: 130064

SEQ ID NO: 154489 - RNA, 64 nt, Human; identical to SEQ ID NO: 130065

SEQ ID NO: 154490 - RNA, 64 nt, Human; identical to SEQ ID NO: 130066

SEQ ID NO: 154491 - RNA, 64 nt, Human; identical to SEQ ID NO: 130067

SEQ ID NO: 154492 - RNA, 64 nt, Human; identical to SEQ ID NO: 130068

SEQ ID NO: 154493 - RNA, 51 nt, Human; identical to SEQ ID NO: 130069

SEQ ID NO: 154494 - RNA, 64 nt, Human; identical to SEQ ID NO: 130070

SEQ ID NO: 154495 - RNA, 64 nt, Human; identical to SEQ ID NO: 130071

SEQ ID NO: 154496 - RNA, 64 nt, Human; identical to SEQ ID NO: 130072

SEQ ID NO: 154497 - RNA, 64 nt, Human; identical to SEQ ID NO: 130073

SEQ ID NO: 154498 - RNA, 64 nt, Human; identical to SEQ ID NO: 130074

SEQ ID NO: 154499 - RNA, 64 nt, Human; identical to SEQ ID NO: 130075

SEQ ID NO: 154500 - RNA, 64 nt, Human; identical to SEQ ID NO: 130076

SEQ ID NO: 154501 - RNA, 64 nt, Human; identical to SEQ ID NO: 130077

SEQ ID NO: 154502 - RNA, 64 nt, Human; identical to SEQ ID NO: 130078

SEQ ID NO: 154503 - RNA, 64 nt, Human; identical to SEQ ID NO: 130079

SEQ ID NO: 154504 - RNA, 64 nt, Human; identical to SEQ ID NO: 130080

SEQ ID NO: 154505 - RNA, 64 nt, Human; identical to SEQ ID NO: 130081

SEQ ID NO: 154506 - RNA, 64 nt, Human; identical to SEQ ID NO: 130082

SEQ ID NO: 154507 - RNA, 64 nt, Human; identical to SEQ ID NO: 130083

SEQ ID NO: 154508 - RNA, 64 nt, Human; identical to SEQ ID NO: 130084

SEQ ID NO: 154509 - RNA, 64 nt, Human; identical to SEQ ID NO: 130085

SEQ ID NO: 154510 - RNA, 64 nt, Human; identical to SEQ ID NO: 130086

SEQ ID NO: 154511 - RNA, 64 nt, Human; identical to SEQ ID NO: 130087

SEQ ID NO: 154512 - RNA, 64 nt, Human; identical to SEQ ID NO: 130088

SEQ ID NO: 154513 - RNA, 64 nt, Human; identical to SEQ ID NO: 130089

SEQ ID NO: 154514 - RNA, 64 nt, Human; identical to SEQ ID NO: 130090

SEQ ID NO: 154515 - RNA, 64 nt, Human; identical to SEQ ID NO: 130091

SEQ ID NO: 154516 - RNA, 64 nt, Human; identical to SEQ ID NO: 130092

SEQ ID NO: 154517 - RNA, 64 nt, Human; identical to SEQ ID NO: 130093

SEQ ID NO: 154518 - RNA, 64 nt, Human; identical to SEQ ID NO: 130094

SEQ ID NO: 154519 - RNA, 64 nt, Human; identical to SEQ ID NO: 130095

SEQ ID NO: 154520 - RNA, 64 nt, Human; identical to SEQ ID NO: 130096

SEQ ID NO: 154521 - RNA, 64 nt, Human; identical to SEQ ID NO: 130097

SEQ ID NO: 154522 - RNA, 64 nt, Human; identical to SEQ ID NO: 130098

SEQ ID NO: 154523 - RNA, 64 nt, Human; identical to SEQ ID NO: 130099

SEQ ID NO: 154524 - RNA, 64 nt, Human; identical to SEQ ID NO: 130100

SEQ ID NO: 154525 - RNA, 64 nt, Human; identical to SEQ ID NO: 130101

SEQ ID NO: 154526 - RNA, 64 nt, Human; identical to SEQ ID NO: 130102

SEQ ID NO: 154527 - RNA, 64 nt, Human; identical to SEQ ID NO: 130103

SEQ ID NO: 154528 - RNA, 64 nt, Human; identical to SEQ ID NO: 130104

SEQ ID NO: 154529 - RNA, 64 nt, Human; identical to SEQ ID NO: 130105

SEQ ID NO: 154530 - RNA, 64 nt, Human; identical to SEQ ID NO: 130106

SEQ ID NO: 154531 - RNA, 64 nt, Human; identical to SEQ ID NO: 130107

SEQ ID NO: 154532 - RNA, 64 nt, Human; identical to SEQ ID NO: 130108

SEQ ID NO: 154533 - RNA, 64 nt, Human; identical to SEQ ID NO: 130109

SEQ ID NO: 154534 - RNA, 64 nt, Human; identical to SEQ ID NO: 130110

SEQ ID NO: 154535 - RNA, 64 nt, Human; identical to SEQ ID NO: 130111

SEQ ID NO: 154536 - RNA, 64 nt, Human; identical to SEQ ID NO: 130112

SEQ ID NO: 154537 - RNA, 64 nt, Human; identical to SEQ ID NO: 130113

SEQ ID NO: 154538 - RNA, 64 nt, Human; identical to SEQ ID NO: 130114

SEQ ID NO: 154539 - RNA, 64 nt, Human; identical to SEQ ID NO: 130115

SEQ ID NO: 154540 - RNA, 64 nt, Human; identical to SEQ ID NO: 130116

SEQ ID NO: 154541 - RNA, 64 nt, Human; identical to SEQ ID NO: 130117

SEQ ID NO: 154542 - RNA, 64 nt, Human; identical to SEQ ID NO: 130118

SEQ ID NO: 154543 - RNA, 64 nt, Human; identical to SEQ ID NO: 130119

SEQ ID NO: 154544 - RNA, 64 nt, Human; identical to SEQ ID NO: 130120

SEQ ID NO: 154545 - RNA, 64 nt, Human; identical to SEQ ID NO: 130121

SEQ ID NO: 154546 - RNA, 64 nt, Human; identical to SEQ ID NO: 130122

SEQ ID NO: 154547 - RNA, 64 nt, Human; identical to SEQ ID NO: 130123

SEQ ID NO: 154548 - RNA, 64 nt, Human; identical to SEQ ID NO: 130124

SEQ ID NO: 154549 - RNA, 64 nt, Human; identical to SEQ ID NO: 130125

SEQ ID NO: 154550 - RNA, 64 nt, Human; identical to SEQ ID NO: 130126

SEQ ID NO: 154551 - RNA, 64 nt, Human; identical to SEQ ID NO: 130127

SEQ ID NO: 154552 - RNA, 64 nt, Human; identical to SEQ ID NO: 130128

SEQ ID NO: 154553 - RNA, 64 nt, Human; identical to SEQ ID NO: 130129

SEQ ID NO: 154554 - RNA, 64 nt, Human; identical to SEQ ID NO: 130130

SEQ ID NO: 154555 - RNA, 64 nt, Human; identical to SEQ ID NO: 130131

SEQ ID NO: 154556 - RNA, 64 nt, Human; identical to SEQ ID NO: 130132

SEQ ID NO: 154557 - RNA, 64 nt, Human; identical to SEQ ID NO: 130133

SEQ ID NO: 154558 - RNA, 64 nt, Human; identical to SEQ ID NO: 130134

SEQ ID NO: 154559 - RNA, 64 nt, Human; identical to SEQ ID NO: 130135

SEQ ID NO: 154560 - RNA, 64 nt, Human; identical to SEQ ID NO: 130136

SEQ ID NO: 154561 - RNA, 64 nt, Human; identical to SEQ ID NO: 130137

SEQ ID NO: 154562 - RNA, 64 nt, Human; identical to SEQ ID NO: 130138

SEQ ID NO: 154563 - RNA, 64 nt, Human; identical to SEQ ID NO: 130139

SEQ ID NO: 154564 - RNA, 64 nt, Human; identical to SEQ ID NO: 130140

SEQ ID NO: 154565 - RNA, 64 nt, Human; identical to SEQ ID NO: 130141

SEQ ID NO: 154566 - RNA, 64 nt, Human; identical to SEQ ID NO: 130142

SEQ ID NO: 154567 - RNA, 64 nt, Human; identical to SEQ ID NO: 130143

SEQ ID NO: 154568 - RNA, 64 nt, Human; identical to SEQ ID NO: 130144

SEQ ID NO: 154569 - RNA, 64 nt, Human; identical to SEQ ID NO: 130145

SEQ ID NO: 154570 - RNA, 64 nt, Human; identical to SEQ ID NO: 130146

SEQ ID NO: 154571 - RNA, 64 nt, Human; identical to SEQ ID NO: 130147

SEQ ID NO: 154572 - RNA, 64 nt, Human; identical to SEQ ID NO: 130148

SEQ ID NO: 154573 - RNA, 64 nt, Human; identical to SEQ ID NO: 130149

SEQ ID NO: 154574 - RNA, 64 nt, Human; identical to SEQ ID NO: 130150

SEQ ID NO: 154575 - RNA, 64 nt, Human; identical to SEQ ID NO: 130151

SEQ ID NO: 154576 - RNA, 64 nt, Human; identical to SEQ ID NO: 130152

SEQ ID NO: 154577 - RNA, 64 nt, Human; identical to SEQ ID NO: 130153

SEQ ID NO: 154578 - RNA, 64 nt, Human; identical to SEQ ID NO: 130154

SEQ ID NO: 154579 - RNA, 64 nt, Human; identical to SEQ ID NO: 130155

SEQ ID NO: 154580 - RNA, 64 nt, Human; identical to SEQ ID NO: 130156

SEQ ID NO: 154581 - RNA, 64 nt, Human; identical to SEQ ID NO: 130157

SEQ ID NO: 154582 - RNA, 64 nt, Human; identical to SEQ ID NO: 130158

SEQ ID NO: 154583 - RNA, 64 nt, Human; identical to SEQ ID NO: 130159

SEQ ID NO: 154584 - RNA, 64 nt, Human; identical to SEQ ID NO: 130160

SEQ ID NO: 154585 - RNA, 64 nt, Human; identical to SEQ ID NO: 130161

SEQ ID NO: 154586 - RNA, 64 nt, Human; identical to SEQ ID NO: 130162

SEQ ID NO: 154587 - RNA, 64 nt, Human; identical to SEQ ID NO: 130163

SEQ ID NO: 154588 - RNA, 64 nt, Human; identical to SEQ ID NO: 130164

SEQ ID NO: 154589 - RNA, 64 nt, Human; identical to SEQ ID NO: 130165

SEQ ID NO: 154590 - RNA, 64 nt, Human; identical to SEQ ID NO: 130166

SEQ ID NO: 154591 - RNA, 64 nt, Human; identical to SEQ ID NO: 130167

SEQ ID NO: 154592 - RNA, 64 nt, Human; identical to SEQ ID NO: 130168

SEQ ID NO: 154593 - RNA, 64 nt, Human; identical to SEQ ID NO: 130169

SEQ ID NO: 154594 - RNA, 64 nt, Human; identical to SEQ ID NO: 130170

SEQ ID NO: 154595 - RNA, 64 nt, Human; identical to SEQ ID NO: 130171

SEQ ID NO: 154596 - RNA, 64 nt, Human; identical to SEQ ID NO: 130172

SEQ ID NO: 154597 - RNA, 64 nt, Human; identical to SEQ ID NO: 130173

SEQ ID NO: 154598 - RNA, 64 nt, Human; identical to SEQ ID NO: 130174

SEQ ID NO: 154599 - RNA, 64 nt, Human; identical to SEQ ID NO: 130175

SEQ ID NO: 154600 - RNA, 64 nt, Human; identical to SEQ ID NO: 130176

SEQ ID NO: 154601 - RNA, 64 nt, Human; identical to SEQ ID NO: 130177

SEQ ID NO: 154602 - RNA, 64 nt, Human; identical to SEQ ID NO: 130178

SEQ ID NO: 154603 - RNA, 64 nt, Human; identical to SEQ ID NO: 130179

SEQ ID NO: 154604 - RNA, 64 nt, Human; identical to SEQ ID NO: 130180

SEQ ID NO: 154605 - RNA, 64 nt, Human; identical to SEQ ID NO: 130181

SEQ ID NO: 154606 - RNA, 64 nt, Human; identical to SEQ ID NO: 130182

SEQ ID NO: 154607 - RNA, 64 nt, Human; identical to SEQ ID NO: 130183

SEQ ID NO: 154608 - RNA, 64 nt, Human; identical to SEQ ID NO: 130184

SEQ ID NO: 154609 - RNA, 64 nt, Human; identical to SEQ ID NO: 130185

SEQ ID NO: 154610 - RNA, 64 nt, Human; identical to SEQ ID NO: 130186

SEQ ID NO: 154611 - RNA, 64 nt, Human; identical to SEQ ID NO: 130187

SEQ ID NO: 154612 - RNA, 64 nt, Human; identical to SEQ ID NO: 130188

SEQ ID NO: 154613 - RNA, 64 nt, Human; identical to SEQ ID NO: 130189

SEQ ID NO: 154614 - RNA, 64 nt, Human; identical to SEQ ID NO: 130190

SEQ ID NO: 154615 - RNA, 64 nt, Human; identical to SEQ ID NO: 130191

SEQ ID NO: 154616 - RNA, 64 nt, Human; identical to SEQ ID NO: 130192

SEQ ID NO: 154617 - RNA, 64 nt, Human; identical to SEQ ID NO: 130193

SEQ ID NO: 154618 - RNA, 64 nt, Human; identical to SEQ ID NO: 130194

SEQ ID NO: 154619 - RNA, 64 nt, Human; identical to SEQ ID NO: 130195

SEQ ID NO: 154620 - RNA, 64 nt, Human; identical to SEQ ID NO: 130196

SEQ ID NO: 154621 - RNA, 64 nt, Human; identical to SEQ ID NO: 130197

SEQ ID NO: 154622 - RNA, 64 nt, Human; identical to SEQ ID NO: 130198

SEQ ID NO: 154623 - RNA, 64 nt, Human; identical to SEQ ID NO: 130199

SEQ ID NO: 154624 - RNA, 64 nt, Human; identical to SEQ ID NO: 130200

SEQ ID NO: 154625 - RNA, 64 nt, Human; identical to SEQ ID NO: 130201

SEQ ID NO: 154626 - RNA, 64 nt, Human; identical to SEQ ID NO: 130202

SEQ ID NO: 154627 - RNA, 64 nt, Human; identical to SEQ ID NO: 130203

SEQ ID NO: 154628 - RNA, 64 nt, Human; identical to SEQ ID NO: 130204

SEQ ID NO: 154629 - RNA, 64 nt, Human; identical to SEQ ID NO: 130205

SEQ ID NO: 154630 - RNA, 64 nt, Human; identical to SEQ ID NO: 130206

SEQ ID NO: 154631 - RNA, 64 nt, Human; identical to SEQ ID NO: 130207

SEQ ID NO: 154632 - RNA, 64 nt, Human; identical to SEQ ID NO: 130208

SEQ ID NO: 154633 - RNA, 64 nt, Human; identical to SEQ ID NO: 130209

SEQ ID NO: 154634 - RNA, 64 nt, Human; identical to SEQ ID NO: 130210

SEQ ID NO: 154635 - RNA, 64 nt, Human; identical to SEQ ID NO: 130211

SEQ ID NO: 154636 - RNA, 64 nt, Human; identical to SEQ ID NO: 130212

SEQ ID NO: 154637 - RNA, 64 nt, Human; identical to SEQ ID NO: 130213

SEQ ID NO: 154638 - RNA, 64 nt, Human; identical to SEQ ID NO: 130214

SEQ ID NO: 154639 - RNA, 64 nt, Human; identical to SEQ ID NO: 130215

SEQ ID NO: 154640 - RNA, 64 nt, Human; identical to SEQ ID NO: 130216

SEQ ID NO: 154641 - RNA, 64 nt, Human; identical to SEQ ID NO: 130217

SEQ ID NO: 154642 - RNA, 64 nt, Human; identical to SEQ ID NO: 130218

SEQ ID NO: 154643 - RNA, 64 nt, Human; identical to SEQ ID NO: 130219

SEQ ID NO: 154644 - RNA, 64 nt, Human; identical to SEQ ID NO: 130220

SEQ ID NO: 154645 - RNA, 64 nt, Human; identical to SEQ ID NO: 130221

SEQ ID NO: 154646 - RNA, 64 nt, Human; identical to SEQ ID NO: 130222

SEQ ID NO: 154647 - RNA, 64 nt, Human; identical to SEQ ID NO: 130223

SEQ ID NO: 154648 - RNA, 64 nt, Human; identical to SEQ ID NO: 130224

SEQ ID NO: 154649 - RNA, 64 nt, Human; identical to SEQ ID NO: 130225

SEQ ID NO: 154650 - RNA, 64 nt, Human; identical to SEQ ID NO: 130226

SEQ ID NO: 154651 - RNA, 64 nt, Human; identical to SEQ ID NO: 130227

SEQ ID NO: 154652 - RNA, 64 nt, Human; identical to SEQ ID NO: 130228

SEQ ID NO: 154653 - RNA, 64 nt, Human; identical to SEQ ID NO: 130229

SEQ ID NO: 154654 - RNA, 64 nt, Human; identical to SEQ ID NO: 130230

SEQ ID NO: 154655 - RNA, 64 nt, Human; identical to SEQ ID NO: 130231

SEQ ID NO: 154656 - RNA, 64 nt, Human; identical to SEQ ID NO: 130232

SEQ ID NO: 154657 - RNA, 64 nt, Human; identical to SEQ ID NO: 130233

SEQ ID NO: 154658 - RNA, 64 nt, Human; identical to SEQ ID NO: 130234

SEQ ID NO: 154659 - RNA, 64 nt, Human; identical to SEQ ID NO: 130235

SEQ ID NO: 154660 - RNA, 64 nt, Human; identical to SEQ ID NO: 130236

SEQ ID NO: 154661 - RNA, 64 nt, Human; identical to SEQ ID NO: 130237

SEQ ID NO: 154662 - RNA, 64 nt, Human; identical to SEQ ID NO: 130238

SEQ ID NO: 154663 - RNA, 64 nt, Human; identical to SEQ ID NO: 130239

SEQ ID NO: 154664 - RNA, 64 nt, Human; identical to SEQ ID NO: 130240

SEQ ID NO: 154665 - RNA, 64 nt, Human; identical to SEQ ID NO: 130241

SEQ ID NO: 154666 - RNA, 64 nt, Human; identical to SEQ ID NO: 130242

SEQ ID NO: 154667 - RNA, 64 nt, Human; identical to SEQ ID NO: 130243

SEQ ID NO: 154668 - RNA, 64 nt, Human; identical to SEQ ID NO: 130244

SEQ ID NO: 154669 - RNA, 64 nt, Human; identical to SEQ ID NO: 130245

SEQ ID NO: 154670 - RNA, 64 nt, Human; identical to SEQ ID NO: 130246

SEQ ID NO: 154671 - RNA, 64 nt, Human; identical to SEQ ID NO: 130247

SEQ ID NO: 154672 - RNA, 64 nt, Human; identical to SEQ ID NO: 130248

SEQ ID NO: 154673 - RNA, 64 nt, Human; identical to SEQ ID NO: 130249

SEQ ID NO: 154674 - RNA, 64 nt, Human; identical to SEQ ID NO: 130250

SEQ ID NO: 154675 - RNA, 64 nt, Human; identical to SEQ ID NO: 130251

SEQ ID NO: 154676 - RNA, 64 nt, Human; identical to SEQ ID NO: 130252

SEQ ID NO: 154677 - RNA, 64 nt, Human; identical to SEQ ID NO: 130253

SEQ ID NO: 154678 - RNA, 64 nt, Human; identical to SEQ ID NO: 130254

SEQ ID NO: 154679 - RNA, 64 nt, Human; identical to SEQ ID NO: 130255

SEQ ID NO: 154680 - RNA, 64 nt, Human; identical to SEQ ID NO: 130256

SEQ ID NO: 154681 - RNA, 64 nt, Human; identical to SEQ ID NO: 130257

SEQ ID NO: 154682 - RNA, 64 nt, Human; identical to SEQ ID NO: 130258

SEQ ID NO: 154683 - RNA, 64 nt, Human; identical to SEQ ID NO: 130259

SEQ ID NO: 154684 - RNA, 64 nt, Human; identical to SEQ ID NO: 130260

SEQ ID NO: 154685 - RNA, 64 nt, Human; identical to SEQ ID NO: 130261

SEQ ID NO: 154686 - RNA, 64 nt, Human; identical to SEQ ID NO: 130262

SEQ ID NO: 154687 - RNA, 64 nt, Human; identical to SEQ ID NO: 130263

SEQ ID NO: 154688 - RNA, 64 nt, Human; identical to SEQ ID NO: 130264

SEQ ID NO: 154689 - RNA, 64 nt, Human; identical to SEQ ID NO: 130265

SEQ ID NO: 154690 - RNA, 64 nt, Human; identical to SEQ ID NO: 130266

SEQ ID NO: 154691 - RNA, 64 nt, Human; identical to SEQ ID NO: 130267

SEQ ID NO: 154692 - RNA, 64 nt, Human; identical to SEQ ID NO: 130268

SEQ ID NO: 154693 - RNA, 64 nt, Human; identical to SEQ ID NO: 130269

SEQ ID NO: 154694 - RNA, 64 nt, Human; identical to SEQ ID NO: 130270

SEQ ID NO: 154695 - RNA, 64 nt, Human; identical to SEQ ID NO: 130271

SEQ ID NO: 154696 - RNA, 64 nt, Human; identical to SEQ ID NO: 130272

SEQ ID NO: 154697 - RNA, 64 nt, Human; identical to SEQ ID NO: 130273

SEQ ID NO: 154698 - RNA, 64 nt, Human; identical to SEQ ID NO: 130274

SEQ ID NO: 154699 - RNA, 64 nt, Human; identical to SEQ ID NO: 130275

SEQ ID NO: 154700 - RNA, 64 nt, Human; identical to SEQ ID NO: 130276

SEQ ID NO: 154701 - RNA, 64 nt, Human; identical to SEQ ID NO: 130277

SEQ ID NO: 154702 - RNA, 64 nt, Human; identical to SEQ ID NO: 130278

SEQ ID NO: 154703 - RNA, 64 nt, Human; identical to SEQ ID NO: 130279

SEQ ID NO: 154704 - RNA, 64 nt, Human; identical to SEQ ID NO: 130280

SEQ ID NO: 154705 - RNA, 64 nt, Human; identical to SEQ ID NO: 130281

SEQ ID NO: 154706 - RNA, 64 nt, Human; identical to SEQ ID NO: 130282

SEQ ID NO: 154707 - RNA, 64 nt, Human; identical to SEQ ID NO: 130283

SEQ ID NO: 154708 - RNA, 64 nt, Human; identical to SEQ ID NO: 130284

SEQ ID NO: 154709 - RNA, 64 nt, Human; identical to SEQ ID NO: 130285

SEQ ID NO: 154710 - RNA, 64 nt, Human; identical to SEQ ID NO: 130286

SEQ ID NO: 154711 - RNA, 64 nt, Human; identical to SEQ ID NO: 130287

SEQ ID NO: 154712 - RNA, 64 nt, Human; identical to SEQ ID NO: 130288

SEQ ID NO: 154713 - RNA, 64 nt, Human; identical to SEQ ID NO: 130289

SEQ ID NO: 154714 - RNA, 64 nt, Human; identical to SEQ ID NO: 130290

SEQ ID NO: 154715 - RNA, 64 nt, Human; identical to SEQ ID NO: 130291

SEQ ID NO: 154716 - RNA, 64 nt, Human; identical to SEQ ID NO: 130292

SEQ ID NO: 154717 - RNA, 64 nt, Human; identical to SEQ ID NO: 130293

SEQ ID NO: 154718 - RNA, 64 nt, Human; identical to SEQ ID NO: 130294

SEQ ID NO: 154719 - RNA, 64 nt, Human; identical to SEQ ID NO: 130295

SEQ ID NO: 154720 - RNA, 64 nt, Human; identical to SEQ ID NO: 130296

SEQ ID NO: 154721 - RNA, 64 nt, Human; identical to SEQ ID NO: 130297

SEQ ID NO: 154722 - RNA, 64 nt, Human; identical to SEQ ID NO: 130298

SEQ ID NO: 154723 - RNA, 64 nt, Human; identical to SEQ ID NO: 130299

SEQ ID NO: 154724 - RNA, 64 nt, Human; identical to SEQ ID NO: 130300

SEQ ID NO: 154725 - RNA, 64 nt, Human; identical to SEQ ID NO: 130301

SEQ ID NO: 154726 - RNA, 64 nt, Human; identical to SEQ ID NO: 130302

SEQ ID NO: 154727 - RNA, 64 nt, Human; identical to SEQ ID NO: 130303

SEQ ID NO: 154728 - RNA, 64 nt, Human; identical to SEQ ID NO: 130304

SEQ ID NO: 154729 - RNA, 64 nt, Human; identical to SEQ ID NO: 130305

SEQ ID NO: 154730 - RNA, 64 nt, Human; identical to SEQ ID NO: 130306

SEQ ID NO: 154731 - RNA, 64 nt, Human; identical to SEQ ID NO: 130307

SEQ ID NO: 154732 - RNA, 64 nt, Human; identical to SEQ ID NO: 130308

SEQ ID NO: 154733 - RNA, 64 nt, Human; identical to SEQ ID NO: 130309

SEQ ID NO: 154734 - RNA, 64 nt, Human; identical to SEQ ID NO: 130310

SEQ ID NO: 154735 - RNA, 64 nt, Human; identical to SEQ ID NO: 130311

SEQ ID NO: 154736 - RNA, 64 nt, Human; identical to SEQ ID NO: 130312

SEQ ID NO: 154737 - RNA, 64 nt, Human; identical to SEQ ID NO: 130313

SEQ ID NO: 154738 - RNA, 64 nt, Human; identical to SEQ ID NO: 130314

SEQ ID NO: 154739 - RNA, 64 nt, Human; identical to SEQ ID NO: 130315

SEQ ID NO: 154740 - RNA, 64 nt, Human; identical to SEQ ID NO: 130316

SEQ ID NO: 154741 - RNA, 64 nt, Human; identical to SEQ ID NO: 130317

SEQ ID NO: 154742 - RNA, 64 nt, Human; identical to SEQ ID NO: 130318

SEQ ID NO: 154743 - RNA, 64 nt, Human; identical to SEQ ID NO: 130319

SEQ ID NO: 154744 - RNA, 64 nt, Human; identical to SEQ ID NO: 130320

SEQ ID NO: 154745 - RNA, 64 nt, Human; identical to SEQ ID NO: 130321

SEQ ID NO: 154746 - RNA, 64 nt, Human; identical to SEQ ID NO: 130322

SEQ ID NO: 154747 - RNA, 64 nt, Human; identical to SEQ ID NO: 130323

SEQ ID NO: 154748 - RNA, 64 nt, Human; identical to SEQ ID NO: 130324

SEQ ID NO: 154749 - RNA, 64 nt, Human; identical to SEQ ID NO: 130325

SEQ ID NO: 154750 - RNA, 64 nt, Human; identical to SEQ ID NO: 130326

SEQ ID NO: 154751 - RNA, 64 nt, Human; identical to SEQ ID NO: 130327

SEQ ID NO: 154752 - RNA, 64 nt, Human; identical to SEQ ID NO: 130328

SEQ ID NO: 154753 - RNA, 64 nt, Human; identical to SEQ ID NO: 130329

SEQ ID NO: 154754 - RNA, 64 nt, Human; identical to SEQ ID NO: 130330

SEQ ID NO: 154755 - RNA, 64 nt, Human; identical to SEQ ID NO: 130331

SEQ ID NO: 154756 - RNA, 64 nt, Human; identical to SEQ ID NO: 130332

SEQ ID NO: 154757 - RNA, 64 nt, Human; identical to SEQ ID NO: 130333

SEQ ID NO: 154758 - RNA, 64 nt, Human; identical to SEQ ID NO: 130334

SEQ ID NO: 154759 - RNA, 64 nt, Human; identical to SEQ ID NO: 130335

SEQ ID NO: 154760 - RNA, 64 nt, Human; identical to SEQ ID NO: 130336

SEQ ID NO: 154761 - RNA, 64 nt, Human; identical to SEQ ID NO: 130337

SEQ ID NO: 154762 - RNA, 64 nt, Human; identical to SEQ ID NO: 130338

SEQ ID NO: 154763 - RNA, 64 nt, Human; identical to SEQ ID NO: 130339

SEQ ID NO: 154764 - RNA, 64 nt, Human; identical to SEQ ID NO: 130340

SEQ ID NO: 154765 - RNA, 64 nt, Human; identical to SEQ ID NO: 130341

SEQ ID NO: 154766 - RNA, 64 nt, Human; identical to SEQ ID NO: 130342

SEQ ID NO: 154767 - RNA, 64 nt, Human; identical to SEQ ID NO: 130343

SEQ ID NO: 154768 - RNA, 64 nt, Human; identical to SEQ ID NO: 130344

SEQ ID NO: 154769 - RNA, 64 nt, Human; identical to SEQ ID NO: 130345

SEQ ID NO: 154770 - RNA, 64 nt, Human; identical to SEQ ID NO: 130346

SEQ ID NO: 154771 - RNA, 64 nt, Human; identical to SEQ ID NO: 130347

SEQ ID NO: 154772 - RNA, 64 nt, Human; identical to SEQ ID NO: 130348

SEQ ID NO: 154773 - RNA, 64 nt, Human; identical to SEQ ID NO: 130349

SEQ ID NO: 154774 - RNA, 64 nt, Human; identical to SEQ ID NO: 130350

SEQ ID NO: 154775 - RNA, 64 nt, Human; identical to SEQ ID NO: 130351

SEQ ID NO: 154776 - RNA, 64 nt, Human; identical to SEQ ID NO: 130352

SEQ ID NO: 154777 - RNA, 64 nt, Human; identical to SEQ ID NO: 130353

SEQ ID NO: 154778 - RNA, 64 nt, Human; identical to SEQ ID NO: 130354

SEQ ID NO: 154779 - RNA, 64 nt, Human; identical to SEQ ID NO: 130355

SEQ ID NO: 154780 - RNA, 64 nt, Human; identical to SEQ ID NO: 130356

SEQ ID NO: 154781 - RNA, 64 nt, Human; identical to SEQ ID NO: 130357

SEQ ID NO: 154782 - RNA, 64 nt, Human; identical to SEQ ID NO: 130358

SEQ ID NO: 154783 - RNA, 64 nt, Human; identical to SEQ ID NO: 130359

SEQ ID NO: 154784 - RNA, 64 nt, Human; identical to SEQ ID NO: 130360

SEQ ID NO: 154785 - RNA, 64 nt, Human; identical to SEQ ID NO: 130361

SEQ ID NO: 154786 - RNA, 64 nt, Human; identical to SEQ ID NO: 130362

SEQ ID NO: 154787 - RNA, 64 nt, Human; identical to SEQ ID NO: 130363

SEQ ID NO: 154788 - RNA, 64 nt, Human; identical to SEQ ID NO: 130364

SEQ ID NO: 154789 - RNA, 64 nt, Human; identical to SEQ ID NO: 130365

SEQ ID NO: 154790 - RNA, 64 nt, Human; identical to SEQ ID NO: 130366

SEQ ID NO: 154791 - RNA, 64 nt, Human; identical to SEQ ID NO: 130367

SEQ ID NO: 154792 - RNA, 64 nt, Human; identical to SEQ ID NO: 130368

SEQ ID NO: 154793 - RNA, 64 nt, Human; identical to SEQ ID NO: 130369

SEQ ID NO: 154794 - RNA, 64 nt, Human; identical to SEQ ID NO: 130370

SEQ ID NO: 154795 - RNA, 64 nt, Human; identical to SEQ ID NO: 130371

SEQ ID NO: 154796 - RNA, 64 nt, Human; identical to SEQ ID NO: 130372

SEQ ID NO: 154797 - RNA, 64 nt, Human; identical to SEQ ID NO: 130373

SEQ ID NO: 154798 - RNA, 64 nt, Human; identical to SEQ ID NO: 130374

SEQ ID NO: 154799 - RNA, 64 nt, Human; identical to SEQ ID NO: 130375

SEQ ID NO: 154800 - RNA, 64 nt, Human; identical to SEQ ID NO: 130376

SEQ ID NO: 154801 - RNA, 64 nt, Human; identical to SEQ ID NO: 130377

SEQ ID NO: 154802 - RNA, 64 nt, Human; identical to SEQ ID NO: 130378

SEQ ID NO: 154803 - RNA, 64 nt, Human; identical to SEQ ID NO: 130379

SEQ ID NO: 154804 - RNA, 64 nt, Human; identical to SEQ ID NO: 130380

SEQ ID NO: 154805 - RNA, 64 nt, Human; identical to SEQ ID NO: 130381

SEQ ID NO: 154806 - RNA, 64 nt, Human; identical to SEQ ID NO: 130382

SEQ ID NO: 154807 - RNA, 64 nt, Human; identical to SEQ ID NO: 130383

SEQ ID NO: 154808 - RNA, 64 nt, Human; identical to SEQ ID NO: 130384

SEQ ID NO: 154809 - RNA, 64 nt, Human; identical to SEQ ID NO: 130385

SEQ ID NO: 154810 - RNA, 64 nt, Human; identical to SEQ ID NO: 130386

SEQ ID NO: 154811 - RNA, 64 nt, Human; identical to SEQ ID NO: 130387

SEQ ID NO: 154812 - RNA, 64 nt, Human; identical to SEQ ID NO: 130388

SEQ ID NO: 154813 - RNA, 64 nt, Human; identical to SEQ ID NO: 130389

SEQ ID NO: 154814 - RNA, 64 nt, Human; identical to SEQ ID NO: 130390

SEQ ID NO: 154815 - RNA, 64 nt, Human; identical to SEQ ID NO: 130391

SEQ ID NO: 154816 - RNA, 64 nt, Human; identical to SEQ ID NO: 130392

SEQ ID NO: 154817 - RNA, 64 nt, Human; identical to SEQ ID NO: 130393

SEQ ID NO: 154818 - RNA, 64 nt, Human; identical to SEQ ID NO: 130394

SEQ ID NO: 154819 - RNA, 64 nt, Human; identical to SEQ ID NO: 130395

SEQ ID NO: 154820 - RNA, 64 nt, Human; identical to SEQ ID NO: 130396

SEQ ID NO: 154821 - RNA, 64 nt, Human; identical to SEQ ID NO: 130397

SEQ ID NO: 154822 - RNA, 64 nt, Human; identical to SEQ ID NO: 130398

SEQ ID NO: 154823 - RNA, 64 nt, Human; identical to SEQ ID NO: 130399

SEQ ID NO: 154824 - RNA, 64 nt, Human; identical to SEQ ID NO: 130400

SEQ ID NO: 154825 - RNA, 64 nt, Human; identical to SEQ ID NO: 130401

SEQ ID NO: 154826 - RNA, 64 nt, Human; identical to SEQ ID NO: 130402

SEQ ID NO: 154827 - RNA, 64 nt, Human; identical to SEQ ID NO: 130403

SEQ ID NO: 154828 - RNA, 64 nt, Human; identical to SEQ ID NO: 130404

SEQ ID NO: 154829 - RNA, 64 nt, Human; identical to SEQ ID NO: 130405

SEQ ID NO: 154830 - RNA, 64 nt, Human; identical to SEQ ID NO: 130406

SEQ ID NO: 154831 - RNA, 64 nt, Human; identical to SEQ ID NO: 130407

SEQ ID NO: 154832 - RNA, 64 nt, Human; identical to SEQ ID NO: 130408

SEQ ID NO: 154833 - RNA, 64 nt, Human; identical to SEQ ID NO: 130409

SEQ ID NO: 154834 - RNA, 64 nt, Human; identical to SEQ ID NO: 130410

SEQ ID NO: 154835 - RNA, 64 nt, Human; identical to SEQ ID NO: 130411

SEQ ID NO: 154836 - RNA, 64 nt, Human; identical to SEQ ID NO: 130412

SEQ ID NO: 154837 - RNA, 64 nt, Human; identical to SEQ ID NO: 130413

SEQ ID NO: 154838 - RNA, 64 nt, Human; identical to SEQ ID NO: 130414

SEQ ID NO: 154839 - RNA, 64 nt, Human; identical to SEQ ID NO: 130415

SEQ ID NO: 154840 - RNA, 64 nt, Human; identical to SEQ ID NO: 130416

SEQ ID NO: 154841 - RNA, 64 nt, Human; identical to SEQ ID NO: 130417

SEQ ID NO: 154842 - RNA, 64 nt, Human; identical to SEQ ID NO: 130418

SEQ ID NO: 154843 - RNA, 64 nt, Human; identical to SEQ ID NO: 130419

SEQ ID NO: 154844 - RNA, 64 nt, Human; identical to SEQ ID NO: 130420

SEQ ID NO: 154845 - RNA, 64 nt, Human; identical to SEQ ID NO: 130421

SEQ ID NO: 154846 - RNA, 64 nt, Human; identical to SEQ ID NO: 130422

SEQ ID NO: 154847 - RNA, 64 nt, Human; identical to SEQ ID NO: 130423

SEQ ID NO: 154848 - RNA, 64 nt, Human; identical to SEQ ID NO: 130424

SEQ ID NO: 154849 - RNA, 64 nt, Human; identical to SEQ ID NO: 130425

SEQ ID NO: 154850 - RNA, 64 nt, Human; identical to SEQ ID NO: 130426

SEQ ID NO: 154851 - RNA, 64 nt, Human; identical to SEQ ID NO: 130427

SEQ ID NO: 154852 - RNA, 64 nt, Human; identical to SEQ ID NO: 130428

SEQ ID NO: 154853 - RNA, 64 nt, Human; identical to SEQ ID NO: 130429

SEQ ID NO: 154854 - RNA, 64 nt, Human; identical to SEQ ID NO: 130430

SEQ ID NO: 154855 - RNA, 64 nt, Human; identical to SEQ ID NO: 130431

SEQ ID NO: 154856 - RNA, 64 nt, Human; identical to SEQ ID NO: 130432

SEQ ID NO: 154857 - RNA, 64 nt, Human; identical to SEQ ID NO: 130433

SEQ ID NO: 154858 - RNA, 64 nt, Human; identical to SEQ ID NO: 130434

SEQ ID NO: 154859 - RNA, 64 nt, Human; identical to SEQ ID NO: 130435

SEQ ID NO: 154860 - RNA, 64 nt, Human; identical to SEQ ID NO: 130436

SEQ ID NO: 154861 - RNA, 64 nt, Human; identical to SEQ ID NO: 130437

SEQ ID NO: 154862 - RNA, 64 nt, Human; identical to SEQ ID NO: 130438

SEQ ID NO: 154863 - RNA, 64 nt, Human; identical to SEQ ID NO: 130439

SEQ ID NO: 154864 - RNA, 64 nt, Human; identical to SEQ ID NO: 130440

SEQ ID NO: 154865 - RNA, 64 nt, Human; identical to SEQ ID NO: 130441

SEQ ID NO: 154866 - RNA, 64 nt, Human; identical to SEQ ID NO: 130442

SEQ ID NO: 154867 - RNA, 64 nt, Human; identical to SEQ ID NO: 130443

SEQ ID NO: 154868 - RNA, 64 nt, Human; identical to SEQ ID NO: 130444

SEQ ID NO: 154869 - RNA, 64 nt, Human; identical to SEQ ID NO: 130445

SEQ ID NO: 154870 - RNA, 64 nt, Human; identical to SEQ ID NO: 130446

SEQ ID NO: 154871 - RNA, 64 nt, Human; identical to SEQ ID NO: 130447

SEQ ID NO: 154872 - RNA, 64 nt, Human; identical to SEQ ID NO: 130448

SEQ ID NO: 154873 - RNA, 64 nt, Human; identical to SEQ ID NO: 130449

SEQ ID NO: 154874 - RNA, 64 nt, Human; identical to SEQ ID NO: 130450

SEQ ID NO: 154875 - RNA, 64 nt, Human; identical to SEQ ID NO: 130451

SEQ ID NO: 154876 - RNA, 64 nt, Human; identical to SEQ ID NO: 130452

SEQ ID NO: 154877 - RNA, 64 nt, Human; identical to SEQ ID NO: 130453

SEQ ID NO: 154878 - RNA, 64 nt, Human; identical to SEQ ID NO: 130454

SEQ ID NO: 154879 - RNA, 64 nt, Human; identical to SEQ ID NO: 130455

SEQ ID NO: 154880 - RNA, 64 nt, Human; identical to SEQ ID NO: 130456

SEQ ID NO: 154881 - RNA, 64 nt, Human; identical to SEQ ID NO: 130457

SEQ ID NO: 154882 - RNA, 64 nt, Human; identical to SEQ ID NO: 130458

SEQ ID NO: 154883 - RNA, 64 nt, Human; identical to SEQ ID NO: 130459

SEQ ID NO: 154884 - RNA, 64 nt, Human; identical to SEQ ID NO: 130460

SEQ ID NO: 154885 - RNA, 64 nt, Human; identical to SEQ ID NO: 130461

SEQ ID NO: 154886 - RNA, 64 nt, Human; identical to SEQ ID NO: 130462

SEQ ID NO: 154887 - RNA, 64 nt, Human; identical to SEQ ID NO: 130463

SEQ ID NO: 154888 - RNA, 64 nt, Human; identical to SEQ ID NO: 130464

SEQ ID NO: 154889 - RNA, 64 nt, Human; identical to SEQ ID NO: 130465

SEQ ID NO: 154890 - RNA, 64 nt, Human; identical to SEQ ID NO: 130466

SEQ ID NO: 154891 - RNA, 64 nt, Human; identical to SEQ ID NO: 130467

SEQ ID NO: 154892 - RNA, 64 nt, Human; identical to SEQ ID NO: 130468

SEQ ID NO: 154893 - RNA, 64 nt, Human; identical to SEQ ID NO: 130469

SEQ ID NO: 154894 - RNA, 64 nt, Human; identical to SEQ ID NO: 130470

SEQ ID NO: 154895 - RNA, 64 nt, Human; identical to SEQ ID NO: 130471

SEQ ID NO: 154896 - RNA, 64 nt, Human; identical to SEQ ID NO: 130472

SEQ ID NO: 154897 - RNA, 64 nt, Human; identical to SEQ ID NO: 130473

SEQ ID NO: 154898 - RNA, 51 nt, Human; identical to SEQ ID NO: 130474

SEQ ID NO: 154899 - RNA, 64 nt, Human; identical to SEQ ID NO: 130475

SEQ ID NO: 154900 - RNA, 64 nt, Human; identical to SEQ ID NO: 130476

SEQ ID NO: 154901 - RNA, 64 nt, Human; identical to SEQ ID NO: 130477

SEQ ID NO: 154902 - RNA, 64 nt, Human; identical to SEQ ID NO: 130478

SEQ ID NO: 154903 - RNA, 64 nt, Human; identical to SEQ ID NO: 130479

SEQ ID NO: 154904 - RNA, 64 nt, Human; identical to SEQ ID NO: 130480

SEQ ID NO: 154905 - RNA, 64 nt, Human; identical to SEQ ID NO: 130481

SEQ ID NO: 154906 - RNA, 64 nt, Human; identical to SEQ ID NO: 130482

SEQ ID NO: 154907 - RNA, 64 nt, Human; identical to SEQ ID NO: 130483

SEQ ID NO: 154908 - RNA, 64 nt, Human; identical to SEQ ID NO: 130484

SEQ ID NO: 154909 - RNA, 50 nt, Human; identical to SEQ ID NO: 130485

SEQ ID NO: 154910 - RNA, 64 nt, Human; identical to SEQ ID NO: 130486

SEQ ID NO: 154911 - RNA, 64 nt, Human; identical to SEQ ID NO: 130487

SEQ ID NO: 154912 - RNA, 64 nt, Human; identical to SEQ ID NO: 130488

SEQ ID NO: 154913 - RNA, 64 nt, Human; identical to SEQ ID NO: 130489

SEQ ID NO: 154914 - RNA, 64 nt, Human; identical to SEQ ID NO: 130490

SEQ ID NO: 154915 - RNA, 64 nt, Human; identical to SEQ ID NO: 130491

SEQ ID NO: 154916 - RNA, 64 nt, Human; identical to SEQ ID NO: 130492

SEQ ID NO: 154917 - RNA, 64 nt, Human; identical to SEQ ID NO: 130493

SEQ ID NO: 154918 - RNA, 64 nt, Human; identical to SEQ ID NO: 130494

SEQ ID NO: 154919 - RNA, 64 nt, Human; identical to SEQ ID NO: 130495

SEQ ID NO: 154920 - RNA, 64 nt, Human; identical to SEQ ID NO: 130496

SEQ ID NO: 154921 - RNA, 64 nt, Human; identical to SEQ ID NO: 130497

SEQ ID NO: 154922 - RNA, 64 nt, Human; identical to SEQ ID NO: 130498

SEQ ID NO: 154923 - RNA, 64 nt, Human; identical to SEQ ID NO: 130499

SEQ ID NO: 154924 - RNA, 64 nt, Human; identical to SEQ ID NO: 130500

SEQ ID NO: 154925 - RNA, 64 nt, Human; identical to SEQ ID NO: 130501

SEQ ID NO: 154926 - RNA, 64 nt, Human; identical to SEQ ID NO: 130502

SEQ ID NO: 154927 - RNA, 64 nt, Human; identical to SEQ ID NO: 130503

SEQ ID NO: 154928 - RNA, 64 nt, Human; identical to SEQ ID NO: 130504

SEQ ID NO: 154929 - RNA, 64 nt, Human; identical to SEQ ID NO: 130505

SEQ ID NO: 154930 - RNA, 64 nt, Human; identical to SEQ ID NO: 130506

SEQ ID NO: 154931 - RNA, 64 nt, Human; identical to SEQ ID NO: 130507

SEQ ID NO: 154932 - RNA, 64 nt, Human; identical to SEQ ID NO: 130508

SEQ ID NO: 154933 - RNA, 64 nt, Human; identical to SEQ ID NO: 130509

SEQ ID NO: 154934 - RNA, 64 nt, Human; identical to SEQ ID NO: 130510

SEQ ID NO: 154935 - RNA, 64 nt, Human; identical to SEQ ID NO: 130511

SEQ ID NO: 154936 - RNA, 64 nt, Human; identical to SEQ ID NO: 130512

SEQ ID NO: 154937 - RNA, 64 nt, Human; identical to SEQ ID NO: 130513

SEQ ID NO: 154938 - RNA, 64 nt, Human; identical to SEQ ID NO: 130514

SEQ ID NO: 154939 - RNA, 64 nt, Human; identical to SEQ ID NO: 130515

SEQ ID NO: 154940 - RNA, 64 nt, Human; identical to SEQ ID NO: 130516

SEQ ID NO: 154941 - RNA, 64 nt, Human; identical to SEQ ID NO: 130517

SEQ ID NO: 154942 - RNA, 64 nt, Human; identical to SEQ ID NO: 130518

SEQ ID NO: 154943 - RNA, 64 nt, Human; identical to SEQ ID NO: 130519

SEQ ID NO: 154944 - RNA, 64 nt, Human; identical to SEQ ID NO: 130520

SEQ ID NO: 154945 - RNA, 64 nt, Human; identical to SEQ ID NO: 130521

SEQ ID NO: 154946 - RNA, 64 nt, Human; identical to SEQ ID NO: 130522

SEQ ID NO: 154947 - RNA, 64 nt, Human; identical to SEQ ID NO: 130523

SEQ ID NO: 154948 - RNA, 64 nt, Human; identical to SEQ ID NO: 130524

SEQ ID NO: 154949 - RNA, 64 nt, Human; identical to SEQ ID NO: 130525

SEQ ID NO: 154950 - RNA, 64 nt, Human; identical to SEQ ID NO: 130526

SEQ ID NO: 154951 - RNA, 64 nt, Human; identical to SEQ ID NO: 130527

SEQ ID NO: 154952 - RNA, 64 nt, Human; identical to SEQ ID NO: 130528

SEQ ID NO: 154953 - RNA, 64 nt, Human; identical to SEQ ID NO: 130529

SEQ ID NO: 154954 - RNA, 64 nt, Human; identical to SEQ ID NO: 130530

SEQ ID NO: 154955 - RNA, 64 nt, Human; identical to SEQ ID NO: 130531

SEQ ID NO: 154956 - RNA, 64 nt, Human; identical to SEQ ID NO: 130532

SEQ ID NO: 154957 - RNA, 64 nt, Human; identical to SEQ ID NO: 130533

SEQ ID NO: 154958 - RNA, 64 nt, Human; identical to SEQ ID NO: 130534

SEQ ID NO: 154959 - RNA, 64 nt, Human; identical to SEQ ID NO: 130535

SEQ ID NO: 154960 - RNA, 64 nt, Human; identical to SEQ ID NO: 130536

SEQ ID NO: 154961 - RNA, 64 nt, Human; identical to SEQ ID NO: 130537

SEQ ID NO: 154962 - RNA, 64 nt, Human; identical to SEQ ID NO: 130538

SEQ ID NO: 154963 - RNA, 64 nt, Human; identical to SEQ ID NO: 130539

SEQ ID NO: 154964 - RNA, 64 nt, Human; identical to SEQ ID NO: 130540

SEQ ID NO: 154965 - RNA, 64 nt, Human; identical to SEQ ID NO: 130541

SEQ ID NO: 154966 - RNA, 64 nt, Human; identical to SEQ ID NO: 130542

SEQ ID NO: 154967 - RNA, 64 nt, Human; identical to SEQ ID NO: 130543

SEQ ID NO: 154968 - RNA, 64 nt, Human; identical to SEQ ID NO: 130544

SEQ ID NO: 154969 - RNA, 64 nt, Human; identical to SEQ ID NO: 130545

SEQ ID NO: 154970 - RNA, 64 nt, Human; identical to SEQ ID NO: 130546

SEQ ID NO: 154971 - RNA, 64 nt, Human; identical to SEQ ID NO: 130547

SEQ ID NO: 154972 - RNA, 54 nt, Human; identical to SEQ ID NO: 130548

SEQ ID NO: 154973 - RNA, 64 nt, Human; identical to SEQ ID NO: 130549

SEQ ID NO: 154974 - RNA, 64 nt, Human; identical to SEQ ID NO: 130550

SEQ ID NO: 154975 - RNA, 64 nt, Human; identical to SEQ ID NO: 130551

SEQ ID NO: 154976 - RNA, 64 nt, Human; identical to SEQ ID NO: 130552

SEQ ID NO: 154977 - RNA, 64 nt, Human; identical to SEQ ID NO: 130553

SEQ ID NO: 154978 - RNA, 64 nt, Human; identical to SEQ ID NO: 130554

SEQ ID NO: 154979 - RNA, 64 nt, Human; identical to SEQ ID NO: 130555

SEQ ID NO: 154980 - RNA, 64 nt, Human; identical to SEQ ID NO: 130556

SEQ ID NO: 154981 - RNA, 64 nt, Human; identical to SEQ ID NO: 130557

SEQ ID NO: 154982 - RNA, 64 nt, Human; identical to SEQ ID NO: 130558

SEQ ID NO: 154983 - RNA, 64 nt, Human; identical to SEQ ID NO: 130559

SEQ ID NO: 154984 - RNA, 64 nt, Human; identical to SEQ ID NO: 130560

SEQ ID NO: 154985 - RNA, 64 nt, Human; identical to SEQ ID NO: 130561

SEQ ID NO: 154986 - RNA, 64 nt, Human; identical to SEQ ID NO: 130562

SEQ ID NO: 154987 - RNA, 64 nt, Human; identical to SEQ ID NO: 130563

SEQ ID NO: 154988 - RNA, 64 nt, Human; identical to SEQ ID NO: 130564

SEQ ID NO: 154989 - RNA, 64 nt, Human; identical to SEQ ID NO: 130565

SEQ ID NO: 154990 - RNA, 64 nt, Human; identical to SEQ ID NO: 130566

SEQ ID NO: 154991 - RNA, 64 nt, Human; identical to SEQ ID NO: 130567

SEQ ID NO: 154992 - RNA, 64 nt, Human; identical to SEQ ID NO: 130568

SEQ ID NO: 154993 - RNA, 64 nt, Human; identical to SEQ ID NO: 130569

SEQ ID NO: 154994 - RNA, 64 nt, Human; identical to SEQ ID NO: 130570

SEQ ID NO: 154995 - RNA, 64 nt, Human; identical to SEQ ID NO: 130571

SEQ ID NO: 154996 - RNA, 64 nt, Human; identical to SEQ ID NO: 130572

SEQ ID NO: 154997 - RNA, 64 nt, Human; identical to SEQ ID NO: 130573

SEQ ID NO: 154998 - RNA, 64 nt, Human; identical to SEQ ID NO: 130574

SEQ ID NO: 154999 - RNA, 64 nt, Human; identical to SEQ ID NO: 130575

SEQ ID NO: 155000 - RNA, 64 nt, Human; identical to SEQ ID NO: 130576

SEQ ID NO: 155001 - RNA, 64 nt, Human; identical to SEQ ID NO: 130577

SEQ ID NO: 155002 - RNA, 64 nt, Human; identical to SEQ ID NO: 130578

SEQ ID NO: 155003 - RNA, 64 nt, Human; identical to SEQ ID NO: 130579

SEQ ID NO: 155004 - RNA, 64 nt, Human; identical to SEQ ID NO: 130580

SEQ ID NO: 155005 - RNA, 64 nt, Human; identical to SEQ ID NO: 130581

SEQ ID NO: 155006 - RNA, 64 nt, Human; identical to SEQ ID NO: 130582

SEQ ID NO: 155007 - RNA, 64 nt, Human; identical to SEQ ID NO: 130583

SEQ ID NO: 155008 - RNA, 64 nt, Human; identical to SEQ ID NO: 130584

SEQ ID NO: 155009 - RNA, 61 nt, Human; identical to SEQ ID NO: 130585

SEQ ID NO: 155010 - RNA, 64 nt, Human; identical to SEQ ID NO: 130586

SEQ ID NO: 155011 - RNA, 64 nt, Human; identical to SEQ ID NO: 130587

SEQ ID NO: 155012 - RNA, 64 nt, Human; identical to SEQ ID NO: 130588

SEQ ID NO: 155013 - RNA, 64 nt, Human; identical to SEQ ID NO: 130589

SEQ ID NO: 155014 - RNA, 64 nt, Human; identical to SEQ ID NO: 130590

SEQ ID NO: 155015 - RNA, 64 nt, Human; identical to SEQ ID NO: 130591

SEQ ID NO: 155016 - RNA, 64 nt, Human; identical to SEQ ID NO: 130592

SEQ ID NO: 155017 - RNA, 64 nt, Human; identical to SEQ ID NO: 130593

SEQ ID NO: 155018 - RNA, 64 nt, Human; identical to SEQ ID NO: 130594

SEQ ID NO: 155019 - RNA, 64 nt, Human; identical to SEQ ID NO: 130595

SEQ ID NO: 155020 - RNA, 64 nt, Human; identical to SEQ ID NO: 130596

SEQ ID NO: 155021 - RNA, 64 nt, Human; identical to SEQ ID NO: 130597

SEQ ID NO: 155022 - RNA, 64 nt, Human; identical to SEQ ID NO: 130598

SEQ ID NO: 155023 - RNA, 56 nt, Human; identical to SEQ ID NO: 130599

SEQ ID NO: 155024 - RNA, 64 nt, Human; identical to SEQ ID NO: 130600

SEQ ID NO: 155025 - RNA, 64 nt, Human; identical to SEQ ID NO: 130601

SEQ ID NO: 155026 - RNA, 64 nt, Human; identical to SEQ ID NO: 130602

SEQ ID NO: 155027 - RNA, 64 nt, Human; identical to SEQ ID NO: 130603

SEQ ID NO: 155028 - RNA, 64 nt, Human; identical to SEQ ID NO: 130604

SEQ ID NO: 155029 - RNA, 55 nt, Human; identical to SEQ ID NO: 130605

SEQ ID NO: 155030 - RNA, 64 nt, Human; identical to SEQ ID NO: 130606

SEQ ID NO: 155031 - RNA, 64 nt, Human; identical to SEQ ID NO: 130607

SEQ ID NO: 155032 - RNA, 64 nt, Human; identical to SEQ ID NO: 130608

SEQ ID NO: 155033 - RNA, 64 nt, Human; identical to SEQ ID NO: 130609

SEQ ID NO: 155034 - RNA, 64 nt, Human; identical to SEQ ID NO: 130610

SEQ ID NO: 155035 - RNA, 64 nt, Human; identical to SEQ ID NO: 130611

SEQ ID NO: 155036 - RNA, 64 nt, Human; identical to SEQ ID NO: 130612

SEQ ID NO: 155037 - RNA, 64 nt, Human; identical to SEQ ID NO: 130613

SEQ ID NO: 155038 - RNA, 64 nt, Human; identical to SEQ ID NO: 130614

SEQ ID NO: 155039 - RNA, 64 nt, Human; identical to SEQ ID NO: 130615

SEQ ID NO: 155040 - RNA, 64 nt, Human; identical to SEQ ID NO: 130616

SEQ ID NO: 155041 - RNA, 64 nt, Human; identical to SEQ ID NO: 130617

SEQ ID NO: 155042 - RNA, 64 nt, Human; identical to SEQ ID NO: 130618

SEQ ID NO: 155043 - RNA, 64 nt, Human; identical to SEQ ID NO: 130619

SEQ ID NO: 155044 - RNA, 64 nt, Human; identical to SEQ ID NO: 130620

SEQ ID NO: 155045 - RNA, 64 nt, Human; identical to SEQ ID NO: 130621

SEQ ID NO: 155046 - RNA, 64 nt, Human; identical to SEQ ID NO: 130622

SEQ ID NO: 155047 - RNA, 64 nt, Human; identical to SEQ ID NO: 130623

SEQ ID NO: 155048 - RNA, 64 nt, Human; identical to SEQ ID NO: 130624

SEQ ID NO: 155049 - RNA, 64 nt, Human; identical to SEQ ID NO: 130625

SEQ ID NO: 155050 - RNA, 64 nt, Human; identical to SEQ ID NO: 130626

SEQ ID NO: 155051 - RNA, 64 nt, Human; identical to SEQ ID NO: 130627

SEQ ID NO: 155052 - RNA, 64 nt, Human; identical to SEQ ID NO: 130628

SEQ ID NO: 155053 - RNA, 64 nt, Human; identical to SEQ ID NO: 130629

SEQ ID NO: 155054 - RNA, 64 nt, Human; identical to SEQ ID NO: 130630

SEQ ID NO: 155055 - RNA, 64 nt, Human; identical to SEQ ID NO: 130631

SEQ ID NO: 155056 - RNA, 64 nt, Human; identical to SEQ ID NO: 130632

SEQ ID NO: 155057 - RNA, 64 nt, Human; identical to SEQ ID NO: 130633

SEQ ID NO: 155058 - RNA, 64 nt, Human; identical to SEQ ID NO: 130634

SEQ ID NO: 155059 - RNA, 64 nt, Human; identical to SEQ ID NO: 130635

SEQ ID NO: 155060 - RNA, 64 nt, Human; identical to SEQ ID NO: 130636

SEQ ID NO: 155061 - RNA, 64 nt, Human; identical to SEQ ID NO: 130637

SEQ ID NO: 155062 - RNA, 64 nt, Human; identical to SEQ ID NO: 130638

SEQ ID NO: 155063 - RNA, 64 nt, Human; identical to SEQ ID NO: 130639

SEQ ID NO: 155064 - RNA, 64 nt, Human; identical to SEQ ID NO: 130640

SEQ ID NO: 155065 - RNA, 64 nt, Human; identical to SEQ ID NO: 130641

SEQ ID NO: 155066 - RNA, 64 nt, Human; identical to SEQ ID NO: 130642

SEQ ID NO: 155067 - RNA, 64 nt, Human; identical to SEQ ID NO: 130643

SEQ ID NO: 155068 - RNA, 64 nt, Human; identical to SEQ ID NO: 130644

SEQ ID NO: 155069 - RNA, 64 nt, Human; identical to SEQ ID NO: 130645

SEQ ID NO: 155070 - RNA, 64 nt, Human; identical to SEQ ID NO: 130646

SEQ ID NO: 155071 - RNA, 64 nt, Human; identical to SEQ ID NO: 130647

SEQ ID NO: 155072 - RNA, 64 nt, Human; identical to SEQ ID NO: 130648

SEQ ID NO: 155073 - RNA, 64 nt, Human; identical to SEQ ID NO: 130649

SEQ ID NO: 155074 - RNA, 64 nt, Human; identical to SEQ ID NO: 130650

SEQ ID NO: 155075 - RNA, 64 nt, Human; identical to SEQ ID NO: 130651

SEQ ID NO: 155076 - RNA, 64 nt, Human; identical to SEQ ID NO: 130652

SEQ ID NO: 155077 - RNA, 64 nt, Human; identical to SEQ ID NO: 130653

SEQ ID NO: 155078 - RNA, 64 nt, Human; identical to SEQ ID NO: 130654

SEQ ID NO: 155079 - RNA, 64 nt, Human; identical to SEQ ID NO: 130655

SEQ ID NO: 155080 - RNA, 64 nt, Human; identical to SEQ ID NO: 130656

SEQ ID NO: 155081 - RNA, 64 nt, Human; identical to SEQ ID NO: 130657

SEQ ID NO: 155082 - RNA, 64 nt, Human; identical to SEQ ID NO: 130658

SEQ ID NO: 155083 - RNA, 64 nt, Human; identical to SEQ ID NO: 130659

SEQ ID NO: 155084 - RNA, 64 nt, Human; identical to SEQ ID NO: 130660

SEQ ID NO: 155085 - RNA, 64 nt, Human; identical to SEQ ID NO: 130661

SEQ ID NO: 155086 - RNA, 64 nt, Human; identical to SEQ ID NO: 130662

SEQ ID NO: 155087 - RNA, 64 nt, Human; identical to SEQ ID NO: 130663

SEQ ID NO: 155088 - RNA, 64 nt, Human; identical to SEQ ID NO: 130664

SEQ ID NO: 155089 - RNA, 64 nt, Human; identical to SEQ ID NO: 130665

SEQ ID NO: 155090 - RNA, 64 nt, Human; identical to SEQ ID NO: 130666

SEQ ID NO: 155091 - RNA, 64 nt, Human; identical to SEQ ID NO: 130667

SEQ ID NO: 155092 - RNA, 64 nt, Human; identical to SEQ ID NO: 130668

SEQ ID NO: 155093 - RNA, 64 nt, Human; identical to SEQ ID NO: 130669

SEQ ID NO: 155094 - RNA, 64 nt, Human; identical to SEQ ID NO: 130670

SEQ ID NO: 155095 - RNA, 64 nt, Human; identical to SEQ ID NO: 130671

SEQ ID NO: 155096 - RNA, 64 nt, Human; identical to SEQ ID NO: 130672

SEQ ID NO: 155097 - RNA, 64 nt, Human; identical to SEQ ID NO: 130024

SEQ ID NO: 155098 - RNA, 64 nt, Human; identical to SEQ ID NO: 130025

SEQ ID NO: 155099 - RNA, 64 nt, Human; identical to SEQ ID NO: 130026

SEQ ID NO: 155100 - RNA, 64 nt, Human; identical to SEQ ID NO: 130027

SEQ ID NO: 155101 - RNA, 64 nt, Human; identical to SEQ ID NO: 130028

SEQ ID NO: 155102 - RNA, 64 nt, Human; identical to SEQ ID NO: 130029

SEQ ID NO: 155103 - RNA, 64 nt, Human; identical to SEQ ID NO: 130030

SEQ ID NO: 155104 - RNA, 64 nt, Human; identical to SEQ ID NO: 130031

SEQ ID NO: 155105 - RNA, 64 nt, Human; identical to SEQ ID NO: 130032

SEQ ID NO: 155106 - RNA, 64 nt, Human; identical to SEQ ID NO: 130033

SEQ ID NO: 155107 - RNA, 64 nt, Human; identical to SEQ ID NO: 130034

SEQ ID NO: 155108 - RNA, 64 nt, Human; identical to SEQ ID NO: 130035

SEQ ID NO: 155109 - RNA, 64 nt, Human; identical to SEQ ID NO: 130036

SEQ ID NO: 155110 - RNA, 64 nt, Human; identical to SEQ ID NO: 130037

SEQ ID NO: 155111 - RNA, 64 nt, Human; identical to SEQ ID NO: 130038

SEQ ID NO: 155112 - RNA, 64 nt, Human; identical to SEQ ID NO: 130039

SEQ ID NO: 155113 - RNA, 64 nt, Human; identical to SEQ ID NO: 130040

SEQ ID NO: 155114 - RNA, 64 nt, Human; identical to SEQ ID NO: 130041

SEQ ID NO: 155115 - RNA, 64 nt, Human; identical to SEQ ID NO: 130042

SEQ ID NO: 155116 - RNA, 64 nt, Human; identical to SEQ ID NO: 130043

SEQ ID NO: 155117 - RNA, 56 nt, Human; identical to SEQ ID NO: 130044

SEQ ID NO: 155118 - RNA, 64 nt, Human; identical to SEQ ID NO: 130045

SEQ ID NO: 155119 - RNA, 64 nt, Human; identical to SEQ ID NO: 130046

SEQ ID NO: 155120 - RNA, 64 nt, Human; identical to SEQ ID NO: 130047

SEQ ID NO: 155121 - RNA, 64 nt, Human; identical to SEQ ID NO: 130048

SEQ ID NO: 155122 - RNA, 64 nt, Human; identical to SEQ ID NO: 130049

SEQ ID NO: 155123 - RNA, 64 nt, Human; identical to SEQ ID NO: 130050

SEQ ID NO: 155124 - RNA, 64 nt, Human; identical to SEQ ID NO: 130051

SEQ ID NO: 155125 - RNA, 64 nt, Human; identical to SEQ ID NO: 130052

SEQ ID NO: 155126 - RNA, 64 nt, Human; identical to SEQ ID NO: 130053

SEQ ID NO: 155127 - RNA, 64 nt, Human; identical to SEQ ID NO: 130054

SEQ ID NO: 155128 - RNA, 64 nt, Human; identical to SEQ ID NO: 130055

SEQ ID NO: 155129 - RNA, 64 nt, Human; identical to SEQ ID NO: 130056

SEQ ID NO: 155130 - RNA, 64 nt, Human; identical to SEQ ID NO: 130057

SEQ ID NO: 155131 - RNA, 64 nt, Human; identical to SEQ ID NO: 130058

SEQ ID NO: 155132 - RNA, 64 nt, Human; identical to SEQ ID NO: 130059

SEQ ID NO: 155133 - RNA, 64 nt, Human; identical to SEQ ID NO: 130060

SEQ ID NO: 155134 - RNA, 64 nt, Human; identical to SEQ ID NO: 130061

SEQ ID NO: 155135 - RNA, 64 nt, Human; identical to SEQ ID NO: 130062

SEQ ID NO: 155136 - RNA, 64 nt, Human; identical to SEQ ID NO: 130063

SEQ ID NO: 155137 - RNA, 64 nt, Human; identical to SEQ ID NO: 130064

SEQ ID NO: 155138 - RNA, 64 nt, Human; identical to SEQ ID NO: 130065

SEQ ID NO: 155139 - RNA, 64 nt, Human; identical to SEQ ID NO: 130066

SEQ ID NO: 155140 - RNA, 64 nt, Human; identical to SEQ ID NO: 130067

SEQ ID NO: 155141 - RNA, 64 nt, Human; identical to SEQ ID NO: 130068

SEQ ID NO: 155142 - RNA, 51 nt, Human; identical to SEQ ID NO: 130069

SEQ ID NO: 155143 - RNA, 64 nt, Human; identical to SEQ ID NO: 130070

SEQ ID NO: 155144 - RNA, 64 nt, Human; identical to SEQ ID NO: 130071

SEQ ID NO: 155145 - RNA, 64 nt, Human; identical to SEQ ID NO: 130072

SEQ ID NO: 155146 - RNA, 64 nt, Human; identical to SEQ ID NO: 130073

SEQ ID NO: 155147 - RNA, 64 nt, Human; identical to SEQ ID NO: 130074

SEQ ID NO: 155148 - RNA, 64 nt, Human; identical to SEQ ID NO: 130075

SEQ ID NO: 155149 - RNA, 64 nt, Human; identical to SEQ ID NO: 130076

SEQ ID NO: 155150 - RNA, 64 nt, Human; identical to SEQ ID NO: 130077

SEQ ID NO: 155151 - RNA, 64 nt, Human; identical to SEQ ID NO: 130078

SEQ ID NO: 155152 - RNA, 64 nt, Human; identical to SEQ ID NO: 130079

SEQ ID NO: 155153 - RNA, 64 nt, Human; identical to SEQ ID NO: 130080

SEQ ID NO: 155154 - RNA, 64 nt, Human; identical to SEQ ID NO: 130081

SEQ ID NO: 155155 - RNA, 64 nt, Human; identical to SEQ ID NO: 130082

SEQ ID NO: 155156 - RNA, 64 nt, Human; identical to SEQ ID NO: 130083

SEQ ID NO: 155157 - RNA, 64 nt, Human; identical to SEQ ID NO: 130084

SEQ ID NO: 155158 - RNA, 64 nt, Human; identical to SEQ ID NO: 130085

SEQ ID NO: 155159 - RNA, 64 nt, Human; identical to SEQ ID NO: 130086

SEQ ID NO: 155160 - RNA, 64 nt, Human; identical to SEQ ID NO: 130087

SEQ ID NO: 155161 - RNA, 64 nt, Human; identical to SEQ ID NO: 130088

SEQ ID NO: 155162 - RNA, 64 nt, Human; identical to SEQ ID NO: 130089

SEQ ID NO: 155163 - RNA, 64 nt, Human; identical to SEQ ID NO: 130090

SEQ ID NO: 155164 - RNA, 64 nt, Human; identical to SEQ ID NO: 130091

SEQ ID NO: 155165 - RNA, 64 nt, Human; identical to SEQ ID NO: 130092

SEQ ID NO: 155166 - RNA, 64 nt, Human; identical to SEQ ID NO: 130093

SEQ ID NO: 155167 - RNA, 64 nt, Human; identical to SEQ ID NO: 130094

SEQ ID NO: 155168 - RNA, 64 nt, Human; identical to SEQ ID NO: 130095

SEQ ID NO: 155169 - RNA, 64 nt, Human; identical to SEQ ID NO: 130096

SEQ ID NO: 155170 - RNA, 64 nt, Human; identical to SEQ ID NO: 130097

SEQ ID NO: 155171 - RNA, 64 nt, Human; identical to SEQ ID NO: 130098

SEQ ID NO: 155172 - RNA, 64 nt, Human; identical to SEQ ID NO: 130099

SEQ ID NO: 155173 - RNA, 64 nt, Human; identical to SEQ ID NO: 130100

SEQ ID NO: 155174 - RNA, 64 nt, Human; identical to SEQ ID NO: 130101

SEQ ID NO: 155175 - RNA, 64 nt, Human; identical to SEQ ID NO: 130102

SEQ ID NO: 155176 - RNA, 64 nt, Human; identical to SEQ ID NO: 130103

SEQ ID NO: 155177 - RNA, 64 nt, Human; identical to SEQ ID NO: 130104

SEQ ID NO: 155178 - RNA, 64 nt, Human; identical to SEQ ID NO: 130105

SEQ ID NO: 155179 - RNA, 64 nt, Human; identical to SEQ ID NO: 130106

SEQ ID NO: 155180 - RNA, 64 nt, Human; identical to SEQ ID NO: 130107

SEQ ID NO: 155181 - RNA, 64 nt, Human; identical to SEQ ID NO: 130108

SEQ ID NO: 155182 - RNA, 64 nt, Human; identical to SEQ ID NO: 130109

SEQ ID NO: 155183 - RNA, 64 nt, Human; identical to SEQ ID NO: 130110

SEQ ID NO: 155184 - RNA, 64 nt, Human; identical to SEQ ID NO: 130111

SEQ ID NO: 155185 - RNA, 64 nt, Human; identical to SEQ ID NO: 130112

SEQ ID NO: 155186 - RNA, 64 nt, Human; identical to SEQ ID NO: 130113

SEQ ID NO: 155187 - RNA, 64 nt, Human; identical to SEQ ID NO: 130114

SEQ ID NO: 155188 - RNA, 64 nt, Human; identical to SEQ ID NO: 130115

SEQ ID NO: 155189 - RNA, 64 nt, Human; identical to SEQ ID NO: 130116

SEQ ID NO: 155190 - RNA, 64 nt, Human; identical to SEQ ID NO: 130117

SEQ ID NO: 155191 - RNA, 64 nt, Human; identical to SEQ ID NO: 130118

SEQ ID NO: 155192 - RNA, 64 nt, Human; identical to SEQ ID NO: 130119

SEQ ID NO: 155193 - RNA, 64 nt, Human; identical to SEQ ID NO: 130120

SEQ ID NO: 155194 - RNA, 64 nt, Human; identical to SEQ ID NO: 130121

SEQ ID NO: 155195 - RNA, 64 nt, Human; identical to SEQ ID NO: 130122

SEQ ID NO: 155196 - RNA, 64 nt, Human; identical to SEQ ID NO: 130123

SEQ ID NO: 155197 - RNA, 64 nt, Human; identical to SEQ ID NO: 130124

SEQ ID NO: 155198 - RNA, 64 nt, Human; identical to SEQ ID NO: 130125

SEQ ID NO: 155199 - RNA, 64 nt, Human; identical to SEQ ID NO: 130126

SEQ ID NO: 155200 - RNA, 64 nt, Human; identical to SEQ ID NO: 130127

SEQ ID NO: 155201 - RNA, 64 nt, Human; identical to SEQ ID NO: 130128

SEQ ID NO: 155202 - RNA, 64 nt, Human; identical to SEQ ID NO: 130129

SEQ ID NO: 155203 - RNA, 64 nt, Human; identical to SEQ ID NO: 130130

SEQ ID NO: 155204 - RNA, 64 nt, Human; identical to SEQ ID NO: 130131

SEQ ID NO: 155205 - RNA, 64 nt, Human; identical to SEQ ID NO: 130132

SEQ ID NO: 155206 - RNA, 64 nt, Human; identical to SEQ ID NO: 130133

SEQ ID NO: 155207 - RNA, 64 nt, Human; identical to SEQ ID NO: 130134

SEQ ID NO: 155208 - RNA, 64 nt, Human; identical to SEQ ID NO: 130135

SEQ ID NO: 155209 - RNA, 64 nt, Human; identical to SEQ ID NO: 130136

SEQ ID NO: 155210 - RNA, 64 nt, Human; identical to SEQ ID NO: 130137

SEQ ID NO: 155211 - RNA, 64 nt, Human; identical to SEQ ID NO: 130138

SEQ ID NO: 155212 - RNA, 64 nt, Human; identical to SEQ ID NO: 130139

SEQ ID NO: 155213 - RNA, 64 nt, Human; identical to SEQ ID NO: 130140

SEQ ID NO: 155214 - RNA, 64 nt, Human; identical to SEQ ID NO: 130141

SEQ ID NO: 155215 - RNA, 64 nt, Human; identical to SEQ ID NO: 130142

SEQ ID NO: 155216 - RNA, 64 nt, Human; identical to SEQ ID NO: 130143

SEQ ID NO: 155217 - RNA, 64 nt, Human; identical to SEQ ID NO: 130144

SEQ ID NO: 155218 - RNA, 64 nt, Human; identical to SEQ ID NO: 130145

SEQ ID NO: 155219 - RNA, 64 nt, Human; identical to SEQ ID NO: 130146

SEQ ID NO: 155220 - RNA, 64 nt, Human; identical to SEQ ID NO: 130147

SEQ ID NO: 155221 - RNA, 64 nt, Human; identical to SEQ ID NO: 130148

SEQ ID NO: 155222 - RNA, 64 nt, Human; identical to SEQ ID NO: 130149

SEQ ID NO: 155223 - RNA, 64 nt, Human; identical to SEQ ID NO: 130150

SEQ ID NO: 155224 - RNA, 64 nt, Human; identical to SEQ ID NO: 130151

SEQ ID NO: 155225 - RNA, 64 nt, Human; identical to SEQ ID NO: 130152

SEQ ID NO: 155226 - RNA, 64 nt, Human; identical to SEQ ID NO: 130153

SEQ ID NO: 155227 - RNA, 64 nt, Human; identical to SEQ ID NO: 130154

SEQ ID NO: 155228 - RNA, 64 nt, Human; identical to SEQ ID NO: 130155

SEQ ID NO: 155229 - RNA, 64 nt, Human; identical to SEQ ID NO: 130156

SEQ ID NO: 155230 - RNA, 64 nt, Human; identical to SEQ ID NO: 130157

SEQ ID NO: 155231 - RNA, 64 nt, Human; identical to SEQ ID NO: 130158

SEQ ID NO: 155232 - RNA, 64 nt, Human; identical to SEQ ID NO: 130159

SEQ ID NO: 155233 - RNA, 64 nt, Human; identical to SEQ ID NO: 130160

SEQ ID NO: 155234 - RNA, 64 nt, Human; identical to SEQ ID NO: 130161

SEQ ID NO: 155235 - RNA, 64 nt, Human; identical to SEQ ID NO: 130162

SEQ ID NO: 155236 - RNA, 64 nt, Human; identical to SEQ ID NO: 130163

SEQ ID NO: 155237 - RNA, 64 nt, Human; identical to SEQ ID NO: 130164

SEQ ID NO: 155238 - RNA, 64 nt, Human; identical to SEQ ID NO: 130165

SEQ ID NO: 155239 - RNA, 64 nt, Human; identical to SEQ ID NO: 130166

SEQ ID NO: 155240 - RNA, 64 nt, Human; identical to SEQ ID NO: 130167

SEQ ID NO: 155241 - RNA, 64 nt, Human; identical to SEQ ID NO: 130168

SEQ ID NO: 155242 - RNA, 64 nt, Human; identical to SEQ ID NO: 130169

SEQ ID NO: 155243 - RNA, 64 nt, Human; identical to SEQ ID NO: 130170

SEQ ID NO: 155244 - RNA, 64 nt, Human; identical to SEQ ID NO: 130171

SEQ ID NO: 155245 - RNA, 64 nt, Human; identical to SEQ ID NO: 130172

SEQ ID NO: 155246 - RNA, 64 nt, Human; identical to SEQ ID NO: 130173

SEQ ID NO: 155247 - RNA, 64 nt, Human; identical to SEQ ID NO: 130174

SEQ ID NO: 155248 - RNA, 64 nt, Human; identical to SEQ ID NO: 130175

SEQ ID NO: 155249 - RNA, 64 nt, Human; identical to SEQ ID NO: 130176

SEQ ID NO: 155250 - RNA, 64 nt, Human; identical to SEQ ID NO: 130177

SEQ ID NO: 155251 - RNA, 64 nt, Human; identical to SEQ ID NO: 130178

SEQ ID NO: 155252 - RNA, 64 nt, Human; identical to SEQ ID NO: 130179

SEQ ID NO: 155253 - RNA, 64 nt, Human; identical to SEQ ID NO: 130180

SEQ ID NO: 155254 - RNA, 64 nt, Human; identical to SEQ ID NO: 130181

SEQ ID NO: 155255 - RNA, 64 nt, Human; identical to SEQ ID NO: 130182

SEQ ID NO: 155256 - RNA, 64 nt, Human; identical to SEQ ID NO: 130183

SEQ ID NO: 155257 - RNA, 64 nt, Human; identical to SEQ ID NO: 130184

SEQ ID NO: 155258 - RNA, 64 nt, Human; identical to SEQ ID NO: 130185

SEQ ID NO: 155259 - RNA, 64 nt, Human; identical to SEQ ID NO: 130186

SEQ ID NO: 155260 - RNA, 64 nt, Human; identical to SEQ ID NO: 130187

SEQ ID NO: 155261 - RNA, 64 nt, Human; identical to SEQ ID NO: 130188

SEQ ID NO: 155262 - RNA, 64 nt, Human; identical to SEQ ID NO: 130189

SEQ ID NO: 155263 - RNA, 64 nt, Human; identical to SEQ ID NO: 130190

SEQ ID NO: 155264 - RNA, 64 nt, Human; identical to SEQ ID NO: 130191

SEQ ID NO: 155265 - RNA, 64 nt, Human; identical to SEQ ID NO: 130192

SEQ ID NO: 155266 - RNA, 64 nt, Human; identical to SEQ ID NO: 130193

SEQ ID NO: 155267 - RNA, 64 nt, Human; identical to SEQ ID NO: 130194

SEQ ID NO: 155268 - RNA, 64 nt, Human; identical to SEQ ID NO: 130195

SEQ ID NO: 155269 - RNA, 64 nt, Human; identical to SEQ ID NO: 130196

SEQ ID NO: 155270 - RNA, 64 nt, Human; identical to SEQ ID NO: 130197

SEQ ID NO: 155271 - RNA, 64 nt, Human; identical to SEQ ID NO: 130198

SEQ ID NO: 155272 - RNA, 64 nt, Human; identical to SEQ ID NO: 130199

SEQ ID NO: 155273 - RNA, 64 nt, Human; identical to SEQ ID NO: 130200

SEQ ID NO: 155274 - RNA, 64 nt, Human; identical to SEQ ID NO: 130201

SEQ ID NO: 155275 - RNA, 64 nt, Human; identical to SEQ ID NO: 130202

SEQ ID NO: 155276 - RNA, 64 nt, Human; identical to SEQ ID NO: 130203

SEQ ID NO: 155277 - RNA, 64 nt, Human; identical to SEQ ID NO: 130204

SEQ ID NO: 155278 - RNA, 64 nt, Human; identical to SEQ ID NO: 130205

SEQ ID NO: 155279 - RNA, 64 nt, Human; identical to SEQ ID NO: 130206

SEQ ID NO: 155280 - RNA, 64 nt, Human; identical to SEQ ID NO: 130207

SEQ ID NO: 155281 - RNA, 64 nt, Human; identical to SEQ ID NO: 130208

SEQ ID NO: 155282 - RNA, 64 nt, Human; identical to SEQ ID NO: 130209

SEQ ID NO: 155283 - RNA, 64 nt, Human; identical to SEQ ID NO: 130210

SEQ ID NO: 155284 - RNA, 64 nt, Human; identical to SEQ ID NO: 130211

SEQ ID NO: 155285 - RNA, 64 nt, Human; identical to SEQ ID NO: 130212

SEQ ID NO: 155286 - RNA, 64 nt, Human; identical to SEQ ID NO: 130213

SEQ ID NO: 155287 - RNA, 64 nt, Human; identical to SEQ ID NO: 130214

SEQ ID NO: 155288 - RNA, 64 nt, Human; identical to SEQ ID NO: 130215

SEQ ID NO: 155289 - RNA, 64 nt, Human; identical to SEQ ID NO: 130216

SEQ ID NO: 155290 - RNA, 64 nt, Human; identical to SEQ ID NO: 130217

SEQ ID NO: 155291 - RNA, 64 nt, Human; identical to SEQ ID NO: 130218

SEQ ID NO: 155292 - RNA, 64 nt, Human; identical to SEQ ID NO: 130219

SEQ ID NO: 155293 - RNA, 64 nt, Human; identical to SEQ ID NO: 130220

SEQ ID NO: 155294 - RNA, 64 nt, Human; identical to SEQ ID NO: 130221

SEQ ID NO: 155295 - RNA, 64 nt, Human; identical to SEQ ID NO: 130222

SEQ ID NO: 155296 - RNA, 64 nt, Human; identical to SEQ ID NO: 130223

SEQ ID NO: 155297 - RNA, 64 nt, Human; identical to SEQ ID NO: 130224

SEQ ID NO: 155298 - RNA, 64 nt, Human; identical to SEQ ID NO: 130225

SEQ ID NO: 155299 - RNA, 64 nt, Human; identical to SEQ ID NO: 130226

SEQ ID NO: 155300 - RNA, 64 nt, Human; identical to SEQ ID NO: 130227

SEQ ID NO: 155301 - RNA, 64 nt, Human; identical to SEQ ID NO: 130228

SEQ ID NO: 155302 - RNA, 64 nt, Human; identical to SEQ ID NO: 130229

SEQ ID NO: 155303 - RNA, 64 nt, Human; identical to SEQ ID NO: 130230

SEQ ID NO: 155304 - RNA, 64 nt, Human; identical to SEQ ID NO: 130231

SEQ ID NO: 155305 - RNA, 64 nt, Human; identical to SEQ ID NO: 130232

SEQ ID NO: 155306 - RNA, 64 nt, Human; identical to SEQ ID NO: 130233

SEQ ID NO: 155307 - RNA, 64 nt, Human; identical to SEQ ID NO: 130234

SEQ ID NO: 155308 - RNA, 64 nt, Human; identical to SEQ ID NO: 130235

SEQ ID NO: 155309 - RNA, 64 nt, Human; identical to SEQ ID NO: 130236

SEQ ID NO: 155310 - RNA, 64 nt, Human; identical to SEQ ID NO: 130237

SEQ ID NO: 155311 - RNA, 64 nt, Human; identical to SEQ ID NO: 130238

SEQ ID NO: 155312 - RNA, 64 nt, Human; identical to SEQ ID NO: 130239

SEQ ID NO: 155313 - RNA, 64 nt, Human; identical to SEQ ID NO: 130240

SEQ ID NO: 155314 - RNA, 64 nt, Human; identical to SEQ ID NO: 130241

SEQ ID NO: 155315 - RNA, 64 nt, Human; identical to SEQ ID NO: 130242

SEQ ID NO: 155316 - RNA, 64 nt, Human; identical to SEQ ID NO: 130243

SEQ ID NO: 155317 - RNA, 64 nt, Human; identical to SEQ ID NO: 130244

SEQ ID NO: 155318 - RNA, 64 nt, Human; identical to SEQ ID NO: 130245

SEQ ID NO: 155319 - RNA, 64 nt, Human; identical to SEQ ID NO: 130246

SEQ ID NO: 155320 - RNA, 64 nt, Human; identical to SEQ ID NO: 130247

SEQ ID NO: 155321 - RNA, 64 nt, Human; identical to SEQ ID NO: 130248

SEQ ID NO: 155322 - RNA, 64 nt, Human; identical to SEQ ID NO: 130249

SEQ ID NO: 155323 - RNA, 64 nt, Human; identical to SEQ ID NO: 130250

SEQ ID NO: 155324 - RNA, 64 nt, Human; identical to SEQ ID NO: 130251

SEQ ID NO: 155325 - RNA, 64 nt, Human; identical to SEQ ID NO: 130252

SEQ ID NO: 155326 - RNA, 64 nt, Human; identical to SEQ ID NO: 130253

SEQ ID NO: 155327 - RNA, 64 nt, Human; identical to SEQ ID NO: 130254

SEQ ID NO: 155328 - RNA, 64 nt, Human; identical to SEQ ID NO: 130255

SEQ ID NO: 155329 - RNA, 64 nt, Human; identical to SEQ ID NO: 130256

SEQ ID NO: 155330 - RNA, 64 nt, Human; identical to SEQ ID NO: 130257

SEQ ID NO: 155331 - RNA, 64 nt, Human; identical to SEQ ID NO: 130258

SEQ ID NO: 155332 - RNA, 64 nt, Human; identical to SEQ ID NO: 130259

SEQ ID NO: 155333 - RNA, 64 nt, Human; identical to SEQ ID NO: 130260

SEQ ID NO: 155334 - RNA, 64 nt, Human; identical to SEQ ID NO: 130261

SEQ ID NO: 155335 - RNA, 64 nt, Human; identical to SEQ ID NO: 130262

SEQ ID NO: 155336 - RNA, 64 nt, Human; identical to SEQ ID NO: 130263

SEQ ID NO: 155337 - RNA, 64 nt, Human; identical to SEQ ID NO: 130264

SEQ ID NO: 155338 - RNA, 64 nt, Human; identical to SEQ ID NO: 130265

SEQ ID NO: 155339 - RNA, 64 nt, Human; identical to SEQ ID NO: 130266

SEQ ID NO: 155340 - RNA, 64 nt, Human; identical to SEQ ID NO: 130267

SEQ ID NO: 155341 - RNA, 64 nt, Human; identical to SEQ ID NO: 130268

SEQ ID NO: 155342 - RNA, 64 nt, Human; identical to SEQ ID NO: 130269

SEQ ID NO: 155343 - RNA, 64 nt, Human; identical to SEQ ID NO: 130270

SEQ ID NO: 155344 - RNA, 64 nt, Human; identical to SEQ ID NO: 130271

SEQ ID NO: 155345 - RNA, 64 nt, Human; identical to SEQ ID NO: 130272

SEQ ID NO: 155346 - RNA, 64 nt, Human; identical to SEQ ID NO: 130273

SEQ ID NO: 155347 - RNA, 64 nt, Human; identical to SEQ ID NO: 130274

SEQ ID NO: 155348 - RNA, 64 nt, Human; identical to SEQ ID NO: 130275

SEQ ID NO: 155349 - RNA, 64 nt, Human; identical to SEQ ID NO: 130276

SEQ ID NO: 155350 - RNA, 64 nt, Human; identical to SEQ ID NO: 130277

SEQ ID NO: 155351 - RNA, 64 nt, Human; identical to SEQ ID NO: 130278

SEQ ID NO: 155352 - RNA, 64 nt, Human; identical to SEQ ID NO: 130279

SEQ ID NO: 155353 - RNA, 64 nt, Human; identical to SEQ ID NO: 130280

SEQ ID NO: 155354 - RNA, 64 nt, Human; identical to SEQ ID NO: 130281

SEQ ID NO: 155355 - RNA, 64 nt, Human; identical to SEQ ID NO: 130282

SEQ ID NO: 155356 - RNA, 64 nt, Human; identical to SEQ ID NO: 130283

SEQ ID NO: 155357 - RNA, 64 nt, Human; identical to SEQ ID NO: 130284

SEQ ID NO: 155358 - RNA, 64 nt, Human; identical to SEQ ID NO: 130285

SEQ ID NO: 155359 - RNA, 64 nt, Human; identical to SEQ ID NO: 130286

SEQ ID NO: 155360 - RNA, 64 nt, Human; identical to SEQ ID NO: 130287

SEQ ID NO: 155361 - RNA, 64 nt, Human; identical to SEQ ID NO: 130288

SEQ ID NO: 155362 - RNA, 64 nt, Human; identical to SEQ ID NO: 130289

SEQ ID NO: 155363 - RNA, 64 nt, Human; identical to SEQ ID NO: 130290

SEQ ID NO: 155364 - RNA, 64 nt, Human; identical to SEQ ID NO: 130291

SEQ ID NO: 155365 - RNA, 64 nt, Human; identical to SEQ ID NO: 130292

SEQ ID NO: 155366 - RNA, 64 nt, Human; identical to SEQ ID NO: 130293

SEQ ID NO: 155367 - RNA, 64 nt, Human; identical to SEQ ID NO: 130294

SEQ ID NO: 155368 - RNA, 64 nt, Human; identical to SEQ ID NO: 130295

SEQ ID NO: 155369 - RNA, 64 nt, Human; identical to SEQ ID NO: 130296

SEQ ID NO: 155370 - RNA, 64 nt, Human; identical to SEQ ID NO: 130297

SEQ ID NO: 155371 - RNA, 64 nt, Human; identical to SEQ ID NO: 130298

SEQ ID NO: 155372 - RNA, 64 nt, Human; identical to SEQ ID NO: 130299

SEQ ID NO: 155373 - RNA, 64 nt, Human; identical to SEQ ID NO: 130300

SEQ ID NO: 155374 - RNA, 64 nt, Human; identical to SEQ ID NO: 130301

SEQ ID NO: 155375 - RNA, 64 nt, Human; identical to SEQ ID NO: 130302

SEQ ID NO: 155376 - RNA, 64 nt, Human; identical to SEQ ID NO: 130303

SEQ ID NO: 155377 - RNA, 64 nt, Human; identical to SEQ ID NO: 130304

SEQ ID NO: 155378 - RNA, 64 nt, Human; identical to SEQ ID NO: 130305

SEQ ID NO: 155379 - RNA, 64 nt, Human; identical to SEQ ID NO: 130306

SEQ ID NO: 155380 - RNA, 64 nt, Human; identical to SEQ ID NO: 130307

SEQ ID NO: 155381 - RNA, 64 nt, Human; identical to SEQ ID NO: 130308

SEQ ID NO: 155382 - RNA, 64 nt, Human; identical to SEQ ID NO: 130309

SEQ ID NO: 155383 - RNA, 64 nt, Human; identical to SEQ ID NO: 130310

SEQ ID NO: 155384 - RNA, 64 nt, Human; identical to SEQ ID NO: 130311

SEQ ID NO: 155385 - RNA, 64 nt, Human; identical to SEQ ID NO: 130312

SEQ ID NO: 155386 - RNA, 64 nt, Human; identical to SEQ ID NO: 130313

SEQ ID NO: 155387 - RNA, 64 nt, Human; identical to SEQ ID NO: 130314

SEQ ID NO: 155388 - RNA, 64 nt, Human; identical to SEQ ID NO: 130315

SEQ ID NO: 155389 - RNA, 64 nt, Human; identical to SEQ ID NO: 130316

SEQ ID NO: 155390 - RNA, 64 nt, Human; identical to SEQ ID NO: 130317

SEQ ID NO: 155391 - RNA, 64 nt, Human; identical to SEQ ID NO: 130318

SEQ ID NO: 155392 - RNA, 64 nt, Human; identical to SEQ ID NO: 130319

SEQ ID NO: 155393 - RNA, 64 nt, Human; identical to SEQ ID NO: 130320

SEQ ID NO: 155394 - RNA, 64 nt, Human; identical to SEQ ID NO: 130321

SEQ ID NO: 155395 - RNA, 64 nt, Human; identical to SEQ ID NO: 130322

SEQ ID NO: 155396 - RNA, 64 nt, Human; identical to SEQ ID NO: 130323

SEQ ID NO: 155397 - RNA, 64 nt, Human; identical to SEQ ID NO: 130324

SEQ ID NO: 155398 - RNA, 64 nt, Human; identical to SEQ ID NO: 130325

SEQ ID NO: 155399 - RNA, 64 nt, Human; identical to SEQ ID NO: 130326

SEQ ID NO: 155400 - RNA, 64 nt, Human; identical to SEQ ID NO: 130327

SEQ ID NO: 155401 - RNA, 64 nt, Human; identical to SEQ ID NO: 130328

SEQ ID NO: 155402 - RNA, 64 nt, Human; identical to SEQ ID NO: 130329

SEQ ID NO: 155403 - RNA, 64 nt, Human; identical to SEQ ID NO: 130330

SEQ ID NO: 155404 - RNA, 64 nt, Human; identical to SEQ ID NO: 130331

SEQ ID NO: 155405 - RNA, 64 nt, Human; identical to SEQ ID NO: 130332

SEQ ID NO: 155406 - RNA, 64 nt, Human; identical to SEQ ID NO: 130333

SEQ ID NO: 155407 - RNA, 64 nt, Human; identical to SEQ ID NO: 130334

SEQ ID NO: 155408 - RNA, 64 nt, Human; identical to SEQ ID NO: 130335

SEQ ID NO: 155409 - RNA, 64 nt, Human; identical to SEQ ID NO: 130336

SEQ ID NO: 155410 - RNA, 64 nt, Human; identical to SEQ ID NO: 130337

SEQ ID NO: 155411 - RNA, 64 nt, Human; identical to SEQ ID NO: 130338

SEQ ID NO: 155412 - RNA, 64 nt, Human; identical to SEQ ID NO: 130339

SEQ ID NO: 155413 - RNA, 64 nt, Human; identical to SEQ ID NO: 130340

SEQ ID NO: 155414 - RNA, 64 nt, Human; identical to SEQ ID NO: 130341

SEQ ID NO: 155415 - RNA, 64 nt, Human; identical to SEQ ID NO: 130342

SEQ ID NO: 155416 - RNA, 64 nt, Human; identical to SEQ ID NO: 130343

SEQ ID NO: 155417 - RNA, 64 nt, Human; identical to SEQ ID NO: 130344

SEQ ID NO: 155418 - RNA, 64 nt, Human; identical to SEQ ID NO: 130345

SEQ ID NO: 155419 - RNA, 64 nt, Human; identical to SEQ ID NO: 130346

SEQ ID NO: 155420 - RNA, 64 nt, Human; identical to SEQ ID NO: 130347

SEQ ID NO: 155421 - RNA, 64 nt, Human; identical to SEQ ID NO: 130348

SEQ ID NO: 155422 - RNA, 64 nt, Human; identical to SEQ ID NO: 130349

SEQ ID NO: 155423 - RNA, 64 nt, Human; identical to SEQ ID NO: 130350

SEQ ID NO: 155424 - RNA, 64 nt, Human; identical to SEQ ID NO: 130351

SEQ ID NO: 155425 - RNA, 64 nt, Human; identical to SEQ ID NO: 130352

SEQ ID NO: 155426 - RNA, 64 nt, Human; identical to SEQ ID NO: 130353

SEQ ID NO: 155427 - RNA, 64 nt, Human; identical to SEQ ID NO: 130354

SEQ ID NO: 155428 - RNA, 64 nt, Human; identical to SEQ ID NO: 130355

SEQ ID NO: 155429 - RNA, 64 nt, Human; identical to SEQ ID NO: 130356

SEQ ID NO: 155430 - RNA, 64 nt, Human; identical to SEQ ID NO: 130357

SEQ ID NO: 155431 - RNA, 64 nt, Human; identical to SEQ ID NO: 130358

SEQ ID NO: 155432 - RNA, 64 nt, Human; identical to SEQ ID NO: 130359

SEQ ID NO: 155433 - RNA, 64 nt, Human; identical to SEQ ID NO: 130360

SEQ ID NO: 155434 - RNA, 64 nt, Human; identical to SEQ ID NO: 130361

SEQ ID NO: 155435 - RNA, 64 nt, Human; identical to SEQ ID NO: 130362

SEQ ID NO: 155436 - RNA, 64 nt, Human; identical to SEQ ID NO: 130363

SEQ ID NO: 155437 - RNA, 64 nt, Human; identical to SEQ ID NO: 130364

SEQ ID NO: 155438 - RNA, 64 nt, Human; identical to SEQ ID NO: 130365

SEQ ID NO: 155439 - RNA, 64 nt, Human; identical to SEQ ID NO: 130366

SEQ ID NO: 155440 - RNA, 64 nt, Human; identical to SEQ ID NO: 130367

SEQ ID NO: 155441 - RNA, 64 nt, Human; identical to SEQ ID NO: 130368

SEQ ID NO: 155442 - RNA, 64 nt, Human; identical to SEQ ID NO: 130369

SEQ ID NO: 155443 - RNA, 64 nt, Human; identical to SEQ ID NO: 130370

SEQ ID NO: 155444 - RNA, 64 nt, Human; identical to SEQ ID NO: 130371

SEQ ID NO: 155445 - RNA, 64 nt, Human; identical to SEQ ID NO: 130372

SEQ ID NO: 155446 - RNA, 64 nt, Human; identical to SEQ ID NO: 130373

SEQ ID NO: 155447 - RNA, 64 nt, Human; identical to SEQ ID NO: 130374

SEQ ID NO: 155448 - RNA, 64 nt, Human; identical to SEQ ID NO: 130375

SEQ ID NO: 155449 - RNA, 64 nt, Human; identical to SEQ ID NO: 130376

SEQ ID NO: 155450 - RNA, 64 nt, Human; identical to SEQ ID NO: 130377

SEQ ID NO: 155451 - RNA, 64 nt, Human; identical to SEQ ID NO: 130378

SEQ ID NO: 155452 - RNA, 64 nt, Human; identical to SEQ ID NO: 130379

SEQ ID NO: 155453 - RNA, 64 nt, Human; identical to SEQ ID NO: 130380

SEQ ID NO: 155454 - RNA, 64 nt, Human; identical to SEQ ID NO: 130381

SEQ ID NO: 155455 - RNA, 64 nt, Human; identical to SEQ ID NO: 130382

SEQ ID NO: 155456 - RNA, 64 nt, Human; identical to SEQ ID NO: 130383

SEQ ID NO: 155457 - RNA, 64 nt, Human; identical to SEQ ID NO: 130384

SEQ ID NO: 155458 - RNA, 64 nt, Human; identical to SEQ ID NO: 130385

SEQ ID NO: 155459 - RNA, 64 nt, Human; identical to SEQ ID NO: 130386

SEQ ID NO: 155460 - RNA, 64 nt, Human; identical to SEQ ID NO: 130387

SEQ ID NO: 155461 - RNA, 64 nt, Human; identical to SEQ ID NO: 130388

SEQ ID NO: 155462 - RNA, 64 nt, Human; identical to SEQ ID NO: 130389

SEQ ID NO: 155463 - RNA, 64 nt, Human; identical to SEQ ID NO: 130390

SEQ ID NO: 155464 - RNA, 64 nt, Human; identical to SEQ ID NO: 130391

SEQ ID NO: 155465 - RNA, 64 nt, Human; identical to SEQ ID NO: 130392

SEQ ID NO: 155466 - RNA, 64 nt, Human; identical to SEQ ID NO: 130393

SEQ ID NO: 155467 - RNA, 64 nt, Human; identical to SEQ ID NO: 130394

SEQ ID NO: 155468 - RNA, 64 nt, Human; identical to SEQ ID NO: 130395

SEQ ID NO: 155469 - RNA, 64 nt, Human; identical to SEQ ID NO: 130396

SEQ ID NO: 155470 - RNA, 64 nt, Human; identical to SEQ ID NO: 130397

SEQ ID NO: 155471 - RNA, 64 nt, Human; identical to SEQ ID NO: 130398

SEQ ID NO: 155472 - RNA, 64 nt, Human; identical to SEQ ID NO: 130399

SEQ ID NO: 155473 - RNA, 64 nt, Human; identical to SEQ ID NO: 130400

SEQ ID NO: 155474 - RNA, 64 nt, Human; identical to SEQ ID NO: 130401

SEQ ID NO: 155475 - RNA, 64 nt, Human; identical to SEQ ID NO: 130402

SEQ ID NO: 155476 - RNA, 64 nt, Human; identical to SEQ ID NO: 130403

SEQ ID NO: 155477 - RNA, 64 nt, Human; identical to SEQ ID NO: 130404

SEQ ID NO: 155478 - RNA, 64 nt, Human; identical to SEQ ID NO: 130405

SEQ ID NO: 155479 - RNA, 64 nt, Human; identical to SEQ ID NO: 130406

SEQ ID NO: 155480 - RNA, 64 nt, Human; identical to SEQ ID NO: 130407

SEQ ID NO: 155481 - RNA, 64 nt, Human; identical to SEQ ID NO: 130408

SEQ ID NO: 155482 - RNA, 64 nt, Human; identical to SEQ ID NO: 130409

SEQ ID NO: 155483 - RNA, 64 nt, Human; identical to SEQ ID NO: 130410

SEQ ID NO: 155484 - RNA, 64 nt, Human; identical to SEQ ID NO: 130411

SEQ ID NO: 155485 - RNA, 64 nt, Human; identical to SEQ ID NO: 130412

SEQ ID NO: 155486 - RNA, 64 nt, Human; identical to SEQ ID NO: 130413

SEQ ID NO: 155487 - RNA, 64 nt, Human; identical to SEQ ID NO: 130414

SEQ ID NO: 155488 - RNA, 64 nt, Human; identical to SEQ ID NO: 130415

SEQ ID NO: 155489 - RNA, 64 nt, Human; identical to SEQ ID NO: 130416

SEQ ID NO: 155490 - RNA, 64 nt, Human; identical to SEQ ID NO: 130417

SEQ ID NO: 155491 - RNA, 64 nt, Human; identical to SEQ ID NO: 130418

SEQ ID NO: 155492 - RNA, 64 nt, Human; identical to SEQ ID NO: 130419

SEQ ID NO: 155493 - RNA, 64 nt, Human; identical to SEQ ID NO: 130420

SEQ ID NO: 155494 - RNA, 64 nt, Human; identical to SEQ ID NO: 130421

SEQ ID NO: 155495 - RNA, 64 nt, Human; identical to SEQ ID NO: 130422

SEQ ID NO: 155496 - RNA, 64 nt, Human; identical to SEQ ID NO: 130423

SEQ ID NO: 155497 - RNA, 64 nt, Human; identical to SEQ ID NO: 130424

SEQ ID NO: 155498 - RNA, 64 nt, Human; identical to SEQ ID NO: 130425

SEQ ID NO: 155499 - RNA, 64 nt, Human; identical to SEQ ID NO: 130426

SEQ ID NO: 155500 - RNA, 64 nt, Human; identical to SEQ ID NO: 130427

SEQ ID NO: 155501 - RNA, 64 nt, Human; identical to SEQ ID NO: 130428

SEQ ID NO: 155502 - RNA, 64 nt, Human; identical to SEQ ID NO: 130429

SEQ ID NO: 155503 - RNA, 64 nt, Human; identical to SEQ ID NO: 130430

SEQ ID NO: 155504 - RNA, 64 nt, Human; identical to SEQ ID NO: 130431

SEQ ID NO: 155505 - RNA, 64 nt, Human; identical to SEQ ID NO: 130432

SEQ ID NO: 155506 - RNA, 64 nt, Human; identical to SEQ ID NO: 130433

SEQ ID NO: 155507 - RNA, 64 nt, Human; identical to SEQ ID NO: 130434

SEQ ID NO: 155508 - RNA, 64 nt, Human; identical to SEQ ID NO: 130435

SEQ ID NO: 155509 - RNA, 64 nt, Human; identical to SEQ ID NO: 130436

SEQ ID NO: 155510 - RNA, 64 nt, Human; identical to SEQ ID NO: 130437

SEQ ID NO: 155511 - RNA, 64 nt, Human; identical to SEQ ID NO: 130438

SEQ ID NO: 155512 - RNA, 64 nt, Human; identical to SEQ ID NO: 130439

SEQ ID NO: 155513 - RNA, 64 nt, Human; identical to SEQ ID NO: 130440

SEQ ID NO: 155514 - RNA, 64 nt, Human; identical to SEQ ID NO: 130441

SEQ ID NO: 155515 - RNA, 64 nt, Human; identical to SEQ ID NO: 130442

SEQ ID NO: 155516 - RNA, 64 nt, Human; identical to SEQ ID NO: 130443

SEQ ID NO: 155517 - RNA, 64 nt, Human; identical to SEQ ID NO: 130444

SEQ ID NO: 155518 - RNA, 64 nt, Human; identical to SEQ ID NO: 130445

SEQ ID NO: 155519 - RNA, 64 nt, Human; identical to SEQ ID NO: 130446

SEQ ID NO: 155520 - RNA, 64 nt, Human; identical to SEQ ID NO: 130447

SEQ ID NO: 155521 - RNA, 64 nt, Human; identical to SEQ ID NO: 130448

SEQ ID NO: 155522 - RNA, 64 nt, Human; identical to SEQ ID NO: 130449

SEQ ID NO: 155523 - RNA, 64 nt, Human; identical to SEQ ID NO: 130450

SEQ ID NO: 155524 - RNA, 64 nt, Human; identical to SEQ ID NO: 130451

SEQ ID NO: 155525 - RNA, 64 nt, Human; identical to SEQ ID NO: 130452

SEQ ID NO: 155526 - RNA, 64 nt, Human; identical to SEQ ID NO: 130453

SEQ ID NO: 155527 - RNA, 64 nt, Human; identical to SEQ ID NO: 130454

SEQ ID NO: 155528 - RNA, 64 nt, Human; identical to SEQ ID NO: 130455

SEQ ID NO: 155529 - RNA, 64 nt, Human; identical to SEQ ID NO: 130456

SEQ ID NO: 155530 - RNA, 64 nt, Human; identical to SEQ ID NO: 130457

SEQ ID NO: 155531 - RNA, 64 nt, Human; identical to SEQ ID NO: 130458

SEQ ID NO: 155532 - RNA, 64 nt, Human; identical to SEQ ID NO: 130459

SEQ ID NO: 155533 - RNA, 64 nt, Human; identical to SEQ ID NO: 130460

SEQ ID NO: 155534 - RNA, 64 nt, Human; identical to SEQ ID NO: 130461

SEQ ID NO: 155535 - RNA, 64 nt, Human; identical to SEQ ID NO: 130462

SEQ ID NO: 155536 - RNA, 64 nt, Human; identical to SEQ ID NO: 130463

SEQ ID NO: 155537 - RNA, 64 nt, Human; identical to SEQ ID NO: 130464

SEQ ID NO: 155538 - RNA, 64 nt, Human; identical to SEQ ID NO: 130465

SEQ ID NO: 155539 - RNA, 64 nt, Human; identical to SEQ ID NO: 130466

SEQ ID NO: 155540 - RNA, 64 nt, Human; identical to SEQ ID NO: 130467

SEQ ID NO: 155541 - RNA, 64 nt, Human; identical to SEQ ID NO: 130468

SEQ ID NO: 155542 - RNA, 64 nt, Human; identical to SEQ ID NO: 130469

SEQ ID NO: 155543 - RNA, 64 nt, Human; identical to SEQ ID NO: 130470

SEQ ID NO: 155544 - RNA, 64 nt, Human; identical to SEQ ID NO: 130471

SEQ ID NO: 155545 - RNA, 64 nt, Human; identical to SEQ ID NO: 130472

SEQ ID NO: 155546 - RNA, 64 nt, Human; identical to SEQ ID NO: 130473

SEQ ID NO: 155547 - RNA, 51 nt, Human; identical to SEQ ID NO: 130474

SEQ ID NO: 155548 - RNA, 64 nt, Human; identical to SEQ ID NO: 130475

SEQ ID NO: 155549 - RNA, 64 nt, Human; identical to SEQ ID NO: 130476

SEQ ID NO: 155550 - RNA, 64 nt, Human; identical to SEQ ID NO: 130477

SEQ ID NO: 155551 - RNA, 64 nt, Human; identical to SEQ ID NO: 130478

SEQ ID NO: 155552 - RNA, 64 nt, Human; identical to SEQ ID NO: 130479

SEQ ID NO: 155553 - RNA, 64 nt, Human; identical to SEQ ID NO: 130480

SEQ ID NO: 155554 - RNA, 64 nt, Human; identical to SEQ ID NO: 130481

SEQ ID NO: 155555 - RNA, 64 nt, Human; identical to SEQ ID NO: 130482

SEQ ID NO: 155556 - RNA, 64 nt, Human; identical to SEQ ID NO: 130483

SEQ ID NO: 155557 - RNA, 64 nt, Human; identical to SEQ ID NO: 130484

SEQ ID NO: 155558 - RNA, 50 nt, Human; identical to SEQ ID NO: 130485

SEQ ID NO: 155559 - RNA, 64 nt, Human; identical to SEQ ID NO: 130486

SEQ ID NO: 155560 - RNA, 64 nt, Human; identical to SEQ ID NO: 130487

SEQ ID NO: 155561 - RNA, 64 nt, Human; identical to SEQ ID NO: 130488

SEQ ID NO: 155562 - RNA, 64 nt, Human; identical to SEQ ID NO: 130489

SEQ ID NO: 155563 - RNA, 64 nt, Human; identical to SEQ ID NO: 130490

SEQ ID NO: 155564 - RNA, 64 nt, Human; identical to SEQ ID NO: 130491

SEQ ID NO: 155565 - RNA, 64 nt, Human; identical to SEQ ID NO: 130492

SEQ ID NO: 155566 - RNA, 64 nt, Human; identical to SEQ ID NO: 130493

SEQ ID NO: 155567 - RNA, 64 nt, Human; identical to SEQ ID NO: 130494

SEQ ID NO: 155568 - RNA, 64 nt, Human; identical to SEQ ID NO: 130495

SEQ ID NO: 155569 - RNA, 64 nt, Human; identical to SEQ ID NO: 130496

SEQ ID NO: 155570 - RNA, 64 nt, Human; identical to SEQ ID NO: 130497

SEQ ID NO: 155571 - RNA, 64 nt, Human; identical to SEQ ID NO: 130498

SEQ ID NO: 155572 - RNA, 64 nt, Human; identical to SEQ ID NO: 130499

SEQ ID NO: 155573 - RNA, 64 nt, Human; identical to SEQ ID NO: 130500

SEQ ID NO: 155574 - RNA, 64 nt, Human; identical to SEQ ID NO: 130501

SEQ ID NO: 155575 - RNA, 64 nt, Human; identical to SEQ ID NO: 130502

SEQ ID NO: 155576 - RNA, 64 nt, Human; identical to SEQ ID NO: 130503

SEQ ID NO: 155577 - RNA, 64 nt, Human; identical to SEQ ID NO: 130504

SEQ ID NO: 155578 - RNA, 64 nt, Human; identical to SEQ ID NO: 130505

SEQ ID NO: 155579 - RNA, 64 nt, Human; identical to SEQ ID NO: 130506

SEQ ID NO: 155580 - RNA, 64 nt, Human; identical to SEQ ID NO: 130507

SEQ ID NO: 155581 - RNA, 64 nt, Human; identical to SEQ ID NO: 130508

SEQ ID NO: 155582 - RNA, 64 nt, Human; identical to SEQ ID NO: 130509

SEQ ID NO: 155583 - RNA, 64 nt, Human; identical to SEQ ID NO: 130510

SEQ ID NO: 155584 - RNA, 64 nt, Human; identical to SEQ ID NO: 130511

SEQ ID NO: 155585 - RNA, 64 nt, Human; identical to SEQ ID NO: 130512

SEQ ID NO: 155586 - RNA, 64 nt, Human; identical to SEQ ID NO: 130513

SEQ ID NO: 155587 - RNA, 64 nt, Human; identical to SEQ ID NO: 130514

SEQ ID NO: 155588 - RNA, 64 nt, Human; identical to SEQ ID NO: 130515

SEQ ID NO: 155589 - RNA, 64 nt, Human; identical to SEQ ID NO: 130516

SEQ ID NO: 155590 - RNA, 64 nt, Human; identical to SEQ ID NO: 130517

SEQ ID NO: 155591 - RNA, 64 nt, Human; identical to SEQ ID NO: 130518

SEQ ID NO: 155592 - RNA, 64 nt, Human; identical to SEQ ID NO: 130519

SEQ ID NO: 155593 - RNA, 64 nt, Human; identical to SEQ ID NO: 130520

SEQ ID NO: 155594 - RNA, 64 nt, Human; identical to SEQ ID NO: 130521

SEQ ID NO: 155595 - RNA, 64 nt, Human; identical to SEQ ID NO: 130522

SEQ ID NO: 155596 - RNA, 64 nt, Human; identical to SEQ ID NO: 130523

SEQ ID NO: 155597 - RNA, 64 nt, Human; identical to SEQ ID NO: 130524

SEQ ID NO: 155598 - RNA, 64 nt, Human; identical to SEQ ID NO: 130525

SEQ ID NO: 155599 - RNA, 64 nt, Human; identical to SEQ ID NO: 130526

SEQ ID NO: 155600 - RNA, 64 nt, Human; identical to SEQ ID NO: 130527

SEQ ID NO: 155601 - RNA, 64 nt, Human; identical to SEQ ID NO: 130528

SEQ ID NO: 155602 - RNA, 64 nt, Human; identical to SEQ ID NO: 130529

SEQ ID NO: 155603 - RNA, 64 nt, Human; identical to SEQ ID NO: 130530

SEQ ID NO: 155604 - RNA, 64 nt, Human; identical to SEQ ID NO: 130531

SEQ ID NO: 155605 - RNA, 64 nt, Human; identical to SEQ ID NO: 130532

SEQ ID NO: 155606 - RNA, 64 nt, Human; identical to SEQ ID NO: 130533

SEQ ID NO: 155607 - RNA, 64 nt, Human; identical to SEQ ID NO: 130534

SEQ ID NO: 155608 - RNA, 64 nt, Human; identical to SEQ ID NO: 130535

SEQ ID NO: 155609 - RNA, 64 nt, Human; identical to SEQ ID NO: 130536

SEQ ID NO: 155610 - RNA, 64 nt, Human; identical to SEQ ID NO: 130537

SEQ ID NO: 155611 - RNA, 64 nt, Human; identical to SEQ ID NO: 130538

SEQ ID NO: 155612 - RNA, 64 nt, Human; identical to SEQ ID NO: 130539

SEQ ID NO: 155613 - RNA, 64 nt, Human; identical to SEQ ID NO: 130540

SEQ ID NO: 155614 - RNA, 64 nt, Human; identical to SEQ ID NO: 130541

SEQ ID NO: 155615 - RNA, 64 nt, Human; identical to SEQ ID NO: 130542

SEQ ID NO: 155616 - RNA, 64 nt, Human; identical to SEQ ID NO: 130543

SEQ ID NO: 155617 - RNA, 64 nt, Human; identical to SEQ ID NO: 130544

SEQ ID NO: 155618 - RNA, 64 nt, Human; identical to SEQ ID NO: 130545

SEQ ID NO: 155619 - RNA, 64 nt, Human; identical to SEQ ID NO: 130546

SEQ ID NO: 155620 - RNA, 64 nt, Human; identical to SEQ ID NO: 130547

SEQ ID NO: 155621 - RNA, 54 nt, Human; identical to SEQ ID NO: 130548

SEQ ID NO: 155622 - RNA, 64 nt, Human; identical to SEQ ID NO: 130549

SEQ ID NO: 155623 - RNA, 64 nt, Human; identical to SEQ ID NO: 130550

SEQ ID NO: 155624 - RNA, 64 nt, Human; identical to SEQ ID NO: 130551

SEQ ID NO: 155625 - RNA, 64 nt, Human; identical to SEQ ID NO: 130552

SEQ ID NO: 155626 - RNA, 64 nt, Human; identical to SEQ ID NO: 130553

SEQ ID NO: 155627 - RNA, 64 nt, Human; identical to SEQ ID NO: 130554

SEQ ID NO: 155628 - RNA, 64 nt, Human; identical to SEQ ID NO: 130555

SEQ ID NO: 155629 - RNA, 64 nt, Human; identical to SEQ ID NO: 130556

SEQ ID NO: 155630 - RNA, 64 nt, Human; identical to SEQ ID NO: 130557

SEQ ID NO: 155631 - RNA, 64 nt, Human; identical to SEQ ID NO: 130558

SEQ ID NO: 155632 - RNA, 64 nt, Human; identical to SEQ ID NO: 130559

SEQ ID NO: 155633 - RNA, 64 nt, Human; identical to SEQ ID NO: 130560

SEQ ID NO: 155634 - RNA, 64 nt, Human; identical to SEQ ID NO: 130561

SEQ ID NO: 155635 - RNA, 64 nt, Human; identical to SEQ ID NO: 130562

SEQ ID NO: 155636 - RNA, 64 nt, Human; identical to SEQ ID NO: 130563

SEQ ID NO: 155637 - RNA, 64 nt, Human; identical to SEQ ID NO: 130564

SEQ ID NO: 155638 - RNA, 64 nt, Human; identical to SEQ ID NO: 130565

SEQ ID NO: 155639 - RNA, 64 nt, Human; identical to SEQ ID NO: 130566

SEQ ID NO: 155640 - RNA, 64 nt, Human; identical to SEQ ID NO: 130567

SEQ ID NO: 155641 - RNA, 64 nt, Human; identical to SEQ ID NO: 130568

SEQ ID NO: 155642 - RNA, 64 nt, Human; identical to SEQ ID NO: 130569

SEQ ID NO: 155643 - RNA, 64 nt, Human; identical to SEQ ID NO: 130570

SEQ ID NO: 155644 - RNA, 64 nt, Human; identical to SEQ ID NO: 130571

SEQ ID NO: 155645 - RNA, 64 nt, Human; identical to SEQ ID NO: 130572

SEQ ID NO: 155646 - RNA, 64 nt, Human; identical to SEQ ID NO: 130573

SEQ ID NO: 155647 - RNA, 64 nt, Human; identical to SEQ ID NO: 130574

SEQ ID NO: 155648 - RNA, 64 nt, Human; identical to SEQ ID NO: 130575

SEQ ID NO: 155649 - RNA, 64 nt, Human; identical to SEQ ID NO: 130576

SEQ ID NO: 155650 - RNA, 64 nt, Human; identical to SEQ ID NO: 130577

SEQ ID NO: 155651 - RNA, 64 nt, Human; identical to SEQ ID NO: 130578

SEQ ID NO: 155652 - RNA, 64 nt, Human; identical to SEQ ID NO: 130579

SEQ ID NO: 155653 - RNA, 64 nt, Human; identical to SEQ ID NO: 130580

SEQ ID NO: 155654 - RNA, 64 nt, Human; identical to SEQ ID NO: 130581

SEQ ID NO: 155655 - RNA, 64 nt, Human; identical to SEQ ID NO: 130582

SEQ ID NO: 155656 - RNA, 64 nt, Human; identical to SEQ ID NO: 130583

SEQ ID NO: 155657 - RNA, 64 nt, Human; identical to SEQ ID NO: 130584

SEQ ID NO: 155658 - RNA, 61 nt, Human; identical to SEQ ID NO: 130585

SEQ ID NO: 155659 - RNA, 64 nt, Human; identical to SEQ ID NO: 130586

SEQ ID NO: 155660 - RNA, 64 nt, Human; identical to SEQ ID NO: 130587

SEQ ID NO: 155661 - RNA, 64 nt, Human; identical to SEQ ID NO: 130588

SEQ ID NO: 155662 - RNA, 64 nt, Human; identical to SEQ ID NO: 130589

SEQ ID NO: 155663 - RNA, 64 nt, Human; identical to SEQ ID NO: 130590

SEQ ID NO: 155664 - RNA, 64 nt, Human; identical to SEQ ID NO: 130591

SEQ ID NO: 155665 - RNA, 64 nt, Human; identical to SEQ ID NO: 130592

SEQ ID NO: 155666 - RNA, 64 nt, Human; identical to SEQ ID NO: 130593

SEQ ID NO: 155667 - RNA, 64 nt, Human; identical to SEQ ID NO: 130594

SEQ ID NO: 155668 - RNA, 64 nt, Human; identical to SEQ ID NO: 130595

SEQ ID NO: 155669 - RNA, 64 nt, Human; identical to SEQ ID NO: 130596

SEQ ID NO: 155670 - RNA, 64 nt, Human; identical to SEQ ID NO: 130597

SEQ ID NO: 155671 - RNA, 64 nt, Human; identical to SEQ ID NO: 130598

SEQ ID NO: 155672 - RNA, 56 nt, Human; identical to SEQ ID NO: 130599

SEQ ID NO: 155673 - RNA, 64 nt, Human; identical to SEQ ID NO: 130600

SEQ ID NO: 155674 - RNA, 64 nt, Human; identical to SEQ ID NO: 130601

SEQ ID NO: 155675 - RNA, 64 nt, Human; identical to SEQ ID NO: 130602

SEQ ID NO: 155676 - RNA, 64 nt, Human; identical to SEQ ID NO: 130603

SEQ ID NO: 155677 - RNA, 64 nt, Human; identical to SEQ ID NO: 130604

SEQ ID NO: 155678 - RNA, 55 nt, Human; identical to SEQ ID NO: 130605

SEQ ID NO: 155679 - RNA, 64 nt, Human; identical to SEQ ID NO: 130606

SEQ ID NO: 155680 - RNA, 64 nt, Human; identical to SEQ ID NO: 130607

SEQ ID NO: 155681 - RNA, 64 nt, Human; identical to SEQ ID NO: 130608

SEQ ID NO: 155682 - RNA, 64 nt, Human; identical to SEQ ID NO: 130609

SEQ ID NO: 155683 - RNA, 64 nt, Human; identical to SEQ ID NO: 130610

SEQ ID NO: 155684 - RNA, 64 nt, Human; identical to SEQ ID NO: 130611

SEQ ID NO: 155685 - RNA, 64 nt, Human; identical to SEQ ID NO: 130612

SEQ ID NO: 155686 - RNA, 64 nt, Human; identical to SEQ ID NO: 130613

SEQ ID NO: 155687 - RNA, 64 nt, Human; identical to SEQ ID NO: 130614

SEQ ID NO: 155688 - RNA, 64 nt, Human; identical to SEQ ID NO: 130615

SEQ ID NO: 155689 - RNA, 64 nt, Human; identical to SEQ ID NO: 130616

SEQ ID NO: 155690 - RNA, 64 nt, Human; identical to SEQ ID NO: 130617

SEQ ID NO: 155691 - RNA, 64 nt, Human; identical to SEQ ID NO: 130618

SEQ ID NO: 155692 - RNA, 64 nt, Human; identical to SEQ ID NO: 130619

SEQ ID NO: 155693 - RNA, 64 nt, Human; identical to SEQ ID NO: 130620

SEQ ID NO: 155694 - RNA, 64 nt, Human; identical to SEQ ID NO: 130621

SEQ ID NO: 155695 - RNA, 64 nt, Human; identical to SEQ ID NO: 130622

SEQ ID NO: 155696 - RNA, 64 nt, Human; identical to SEQ ID NO: 130623

SEQ ID NO: 155697 - RNA, 64 nt, Human; identical to SEQ ID NO: 130624

SEQ ID NO: 155698 - RNA, 64 nt, Human; identical to SEQ ID NO: 130625

SEQ ID NO: 155699 - RNA, 64 nt, Human; identical to SEQ ID NO: 130626

SEQ ID NO: 155700 - RNA, 64 nt, Human; identical to SEQ ID NO: 130627

SEQ ID NO: 155701 - RNA, 64 nt, Human; identical to SEQ ID NO: 130628

SEQ ID NO: 155702 - RNA, 64 nt, Human; identical to SEQ ID NO: 130629

SEQ ID NO: 155703 - RNA, 64 nt, Human; identical to SEQ ID NO: 130630

SEQ ID NO: 155704 - RNA, 64 nt, Human; identical to SEQ ID NO: 130631

SEQ ID NO: 155705 - RNA, 64 nt, Human; identical to SEQ ID NO: 130632

SEQ ID NO: 155706 - RNA, 64 nt, Human; identical to SEQ ID NO: 130633

SEQ ID NO: 155707 - RNA, 64 nt, Human; identical to SEQ ID NO: 130634

SEQ ID NO: 155708 - RNA, 64 nt, Human; identical to SEQ ID NO: 130635

SEQ ID NO: 155709 - RNA, 64 nt, Human; identical to SEQ ID NO: 130636

SEQ ID NO: 155710 - RNA, 64 nt, Human; identical to SEQ ID NO: 130637

SEQ ID NO: 155711 - RNA, 64 nt, Human; identical to SEQ ID NO: 130638

SEQ ID NO: 155712 - RNA, 64 nt, Human; identical to SEQ ID NO: 130639

SEQ ID NO: 155713 - RNA, 64 nt, Human; identical to SEQ ID NO: 130640

SEQ ID NO: 155714 - RNA, 64 nt, Human; identical to SEQ ID NO: 130641

SEQ ID NO: 155715 - RNA, 64 nt, Human; identical to SEQ ID NO: 130642

SEQ ID NO: 155716 - RNA, 64 nt, Human; identical to SEQ ID NO: 130643

SEQ ID NO: 155717 - RNA, 64 nt, Human; identical to SEQ ID NO: 130644

SEQ ID NO: 155718 - RNA, 64 nt, Human; identical to SEQ ID NO: 130645

SEQ ID NO: 155719 - RNA, 64 nt, Human; identical to SEQ ID NO: 130646

SEQ ID NO: 155720 - RNA, 64 nt, Human; identical to SEQ ID NO: 130647

SEQ ID NO: 155721 - RNA, 64 nt, Human; identical to SEQ ID NO: 130648

SEQ ID NO: 155722 - RNA, 64 nt, Human; identical to SEQ ID NO: 130649

SEQ ID NO: 155723 - RNA, 64 nt, Human; identical to SEQ ID NO: 130650

SEQ ID NO: 155724 - RNA, 64 nt, Human; identical to SEQ ID NO: 130651

SEQ ID NO: 155725 - RNA, 64 nt, Human; identical to SEQ ID NO: 130652

SEQ ID NO: 155726 - RNA, 64 nt, Human; identical to SEQ ID NO: 130653

SEQ ID NO: 155727 - RNA, 64 nt, Human; identical to SEQ ID NO: 130654

SEQ ID NO: 155728 - RNA, 64 nt, Human; identical to SEQ ID NO: 130655

SEQ ID NO: 155729 - RNA, 64 nt, Human; identical to SEQ ID NO: 130656

SEQ ID NO: 155730 - RNA, 64 nt, Human; identical to SEQ ID NO: 130657

SEQ ID NO: 155731 - RNA, 64 nt, Human; identical to SEQ ID NO: 130658

SEQ ID NO: 155732 - RNA, 64 nt, Human; identical to SEQ ID NO: 130659

SEQ ID NO: 155733 - RNA, 64 nt, Human; identical to SEQ ID NO: 130660

SEQ ID NO: 155734 - RNA, 64 nt, Human; identical to SEQ ID NO: 130661

SEQ ID NO: 155735 - RNA, 64 nt, Human; identical to SEQ ID NO: 130662

SEQ ID NO: 155736 - RNA, 64 nt, Human; identical to SEQ ID NO: 130663

SEQ ID NO: 155737 - RNA, 64 nt, Human; identical to SEQ ID NO: 130664

SEQ ID NO: 155738 - RNA, 64 nt, Human; identical to SEQ ID NO: 130665

SEQ ID NO: 155739 - RNA, 64 nt, Human; identical to SEQ ID NO: 130666

SEQ ID NO: 155740 - RNA, 64 nt, Human; identical to SEQ ID NO: 130667

SEQ ID NO: 155741 - RNA, 64 nt, Human; identical to SEQ ID NO: 130668

SEQ ID NO: 155742 - RNA, 64 nt, Human; identical to SEQ ID NO: 130669

SEQ ID NO: 155743 - RNA, 64 nt, Human; identical to SEQ ID NO: 130670

SEQ ID NO: 155744 - RNA, 64 nt, Human; identical to SEQ ID NO: 130671

SEQ ID NO: 155745 - RNA, 64 nt, Human; identical to SEQ ID NO: 130672

SEQ ID NO: 155746 - RNA, 64 nt, Human; identical to SEQ ID NO: 130024

SEQ ID NO: 155747 - RNA, 64 nt, Human; identical to SEQ ID NO: 130025

SEQ ID NO: 155748 - RNA, 64 nt, Human; identical to SEQ ID NO: 130026

SEQ ID NO: 155749 - RNA, 64 nt, Human; identical to SEQ ID NO: 130027

SEQ ID NO: 155750 - RNA, 64 nt, Human; identical to SEQ ID NO: 130028

SEQ ID NO: 155751 - RNA, 64 nt, Human; identical to SEQ ID NO: 130029

SEQ ID NO: 155752 - RNA, 64 nt, Human; identical to SEQ ID NO: 130030

SEQ ID NO: 155753 - RNA, 64 nt, Human; identical to SEQ ID NO: 130031

SEQ ID NO: 155754 - RNA, 64 nt, Human; identical to SEQ ID NO: 130032

SEQ ID NO: 155755 - RNA, 64 nt, Human; identical to SEQ ID NO: 130033

SEQ ID NO: 155756 - RNA, 64 nt, Human; identical to SEQ ID NO: 130034

SEQ ID NO: 155757 - RNA, 64 nt, Human; identical to SEQ ID NO: 130035

SEQ ID NO: 155758 - RNA, 64 nt, Human; identical to SEQ ID NO: 130036

SEQ ID NO: 155759 - RNA, 64 nt, Human; identical to SEQ ID NO: 130037

SEQ ID NO: 155760 - RNA, 64 nt, Human; identical to SEQ ID NO: 130038

SEQ ID NO: 155761 - RNA, 64 nt, Human; identical to SEQ ID NO: 130039

SEQ ID NO: 155762 - RNA, 64 nt, Human; identical to SEQ ID NO: 130040

SEQ ID NO: 155763 - RNA, 64 nt, Human; identical to SEQ ID NO: 130041

SEQ ID NO: 155764 - RNA, 64 nt, Human; identical to SEQ ID NO: 130042

SEQ ID NO: 155765 - RNA, 64 nt, Human; identical to SEQ ID NO: 130043

SEQ ID NO: 155766 - RNA, 56 nt, Human; identical to SEQ ID NO: 130044

SEQ ID NO: 155767 - RNA, 64 nt, Human; identical to SEQ ID NO: 130045

SEQ ID NO: 155768 - RNA, 64 nt, Human; identical to SEQ ID NO: 130046

SEQ ID NO: 155769 - RNA, 64 nt, Human; identical to SEQ ID NO: 130047

SEQ ID NO: 155770 - RNA, 64 nt, Human; identical to SEQ ID NO: 130048

SEQ ID NO: 155771 - RNA, 64 nt, Human; identical to SEQ ID NO: 130049

SEQ ID NO: 155772 - RNA, 64 nt, Human; identical to SEQ ID NO: 130050

SEQ ID NO: 155773 - RNA, 64 nt, Human; identical to SEQ ID NO: 130051

SEQ ID NO: 155774 - RNA, 64 nt, Human; identical to SEQ ID NO: 130052

SEQ ID NO: 155775 - RNA, 64 nt, Human; identical to SEQ ID NO: 130053

SEQ ID NO: 155776 - RNA, 64 nt, Human; identical to SEQ ID NO: 130054

SEQ ID NO: 155777 - RNA, 64 nt, Human; identical to SEQ ID NO: 130055

SEQ ID NO: 155778 - RNA, 64 nt, Human; identical to SEQ ID NO: 130056

SEQ ID NO: 155779 - RNA, 64 nt, Human; identical to SEQ ID NO: 130057

SEQ ID NO: 155780 - RNA, 64 nt, Human; identical to SEQ ID NO: 130058

SEQ ID NO: 155781 - RNA, 64 nt, Human; identical to SEQ ID NO: 130059

SEQ ID NO: 155782 - RNA, 64 nt, Human; identical to SEQ ID NO: 130060

SEQ ID NO: 155783 - RNA, 64 nt, Human; identical to SEQ ID NO: 130061

SEQ ID NO: 155784 - RNA, 64 nt, Human; identical to SEQ ID NO: 130062

SEQ ID NO: 155785 - RNA, 64 nt, Human; identical to SEQ ID NO: 130063

SEQ ID NO: 155786 - RNA, 64 nt, Human; identical to SEQ ID NO: 130064

SEQ ID NO: 155787 - RNA, 64 nt, Human; identical to SEQ ID NO: 130065

SEQ ID NO: 155788 - RNA, 64 nt, Human; identical to SEQ ID NO: 130066

SEQ ID NO: 155789 - RNA, 64 nt, Human; identical to SEQ ID NO: 130067

SEQ ID NO: 155790 - RNA, 64 nt, Human; identical to SEQ ID NO: 130068

SEQ ID NO: 155791 - RNA, 51 nt, Human; identical to SEQ ID NO: 130069

SEQ ID NO: 155792 - RNA, 64 nt, Human; identical to SEQ ID NO: 130070

SEQ ID NO: 155793 - RNA, 64 nt, Human; identical to SEQ ID NO: 130071

SEQ ID NO: 155794 - RNA, 64 nt, Human; identical to SEQ ID NO: 130072

SEQ ID NO: 155795 - RNA, 64 nt, Human; identical to SEQ ID NO: 130073

SEQ ID NO: 155796 - RNA, 64 nt, Human; identical to SEQ ID NO: 130074

SEQ ID NO: 155797 - RNA, 64 nt, Human; identical to SEQ ID NO: 130075

SEQ ID NO: 155798 - RNA, 64 nt, Human; identical to SEQ ID NO: 130076

SEQ ID NO: 155799 - RNA, 64 nt, Human; identical to SEQ ID NO: 130077

SEQ ID NO: 155800 - RNA, 64 nt, Human; identical to SEQ ID NO: 130078

SEQ ID NO: 155801 - RNA, 64 nt, Human; identical to SEQ ID NO: 130079

SEQ ID NO: 155802 - RNA, 64 nt, Human; identical to SEQ ID NO: 130080

SEQ ID NO: 155803 - RNA, 64 nt, Human; identical to SEQ ID NO: 130081

SEQ ID NO: 155804 - RNA, 64 nt, Human; identical to SEQ ID NO: 130082

SEQ ID NO: 155805 - RNA, 64 nt, Human; identical to SEQ ID NO: 130083

SEQ ID NO: 155806 - RNA, 64 nt, Human; identical to SEQ ID NO: 130084

SEQ ID NO: 155807 - RNA, 64 nt, Human; identical to SEQ ID NO: 130085

SEQ ID NO: 155808 - RNA, 64 nt, Human; identical to SEQ ID NO: 130086

SEQ ID NO: 155809 - RNA, 64 nt, Human; identical to SEQ ID NO: 130087

SEQ ID NO: 155810 - RNA, 64 nt, Human; identical to SEQ ID NO: 130088

SEQ ID NO: 155811 - RNA, 64 nt, Human; identical to SEQ ID NO: 130089

SEQ ID NO: 155812 - RNA, 64 nt, Human; identical to SEQ ID NO: 130090

SEQ ID NO: 155813 - RNA, 64 nt, Human; identical to SEQ ID NO: 130091

SEQ ID NO: 155814 - RNA, 64 nt, Human; identical to SEQ ID NO: 130092

SEQ ID NO: 155815 - RNA, 64 nt, Human; identical to SEQ ID NO: 130093

SEQ ID NO: 155816 - RNA, 64 nt, Human; identical to SEQ ID NO: 130094

SEQ ID NO: 155817 - RNA, 64 nt, Human; identical to SEQ ID NO: 130095

SEQ ID NO: 155818 - RNA, 64 nt, Human; identical to SEQ ID NO: 130096

SEQ ID NO: 155819 - RNA, 64 nt, Human; identical to SEQ ID NO: 130097

SEQ ID NO: 155820 - RNA, 64 nt, Human; identical to SEQ ID NO: 130098

SEQ ID NO: 155821 - RNA, 64 nt, Human; identical to SEQ ID NO: 130099

SEQ ID NO: 155822 - RNA, 64 nt, Human; identical to SEQ ID NO: 130100

SEQ ID NO: 155823 - RNA, 64 nt, Human; identical to SEQ ID NO: 130101

SEQ ID NO: 155824 - RNA, 64 nt, Human; identical to SEQ ID NO: 130102

SEQ ID NO: 155825 - RNA, 64 nt, Human; identical to SEQ ID NO: 130103

SEQ ID NO: 155826 - RNA, 64 nt, Human; identical to SEQ ID NO: 130104

SEQ ID NO: 155827 - RNA, 64 nt, Human; identical to SEQ ID NO: 130105

SEQ ID NO: 155828 - RNA, 64 nt, Human; identical to SEQ ID NO: 130106

SEQ ID NO: 155829 - RNA, 64 nt, Human; identical to SEQ ID NO: 130107

SEQ ID NO: 155830 - RNA, 64 nt, Human; identical to SEQ ID NO: 130108

SEQ ID NO: 155831 - RNA, 64 nt, Human; identical to SEQ ID NO: 130109

SEQ ID NO: 155832 - RNA, 64 nt, Human; identical to SEQ ID NO: 130110

SEQ ID NO: 155833 - RNA, 64 nt, Human; identical to SEQ ID NO: 130111

SEQ ID NO: 155834 - RNA, 64 nt, Human; identical to SEQ ID NO: 130112

SEQ ID NO: 155835 - RNA, 64 nt, Human; identical to SEQ ID NO: 130113

SEQ ID NO: 155836 - RNA, 64 nt, Human; identical to SEQ ID NO: 130114

SEQ ID NO: 155837 - RNA, 64 nt, Human; identical to SEQ ID NO: 130115

SEQ ID NO: 155838 - RNA, 64 nt, Human; identical to SEQ ID NO: 130116

SEQ ID NO: 155839 - RNA, 64 nt, Human; identical to SEQ ID NO: 130117

SEQ ID NO: 155840 - RNA, 64 nt, Human; identical to SEQ ID NO: 130118

SEQ ID NO: 155841 - RNA, 64 nt, Human; identical to SEQ ID NO: 130119

SEQ ID NO: 155842 - RNA, 64 nt, Human; identical to SEQ ID NO: 130120

SEQ ID NO: 155843 - RNA, 64 nt, Human; identical to SEQ ID NO: 130121

SEQ ID NO: 155844 - RNA, 64 nt, Human; identical to SEQ ID NO: 130122

SEQ ID NO: 155845 - RNA, 64 nt, Human; identical to SEQ ID NO: 130123

SEQ ID NO: 155846 - RNA, 64 nt, Human; identical to SEQ ID NO: 130124

SEQ ID NO: 155847 - RNA, 64 nt, Human; identical to SEQ ID NO: 130125

SEQ ID NO: 155848 - RNA, 64 nt, Human; identical to SEQ ID NO: 130126

SEQ ID NO: 155849 - RNA, 64 nt, Human; identical to SEQ ID NO: 130127

SEQ ID NO: 155850 - RNA, 64 nt, Human; identical to SEQ ID NO: 130128

SEQ ID NO: 155851 - RNA, 64 nt, Human; identical to SEQ ID NO: 130129

SEQ ID NO: 155852 - RNA, 64 nt, Human; identical to SEQ ID NO: 130130

SEQ ID NO: 155853 - RNA, 64 nt, Human; identical to SEQ ID NO: 130131

SEQ ID NO: 155854 - RNA, 64 nt, Human; identical to SEQ ID NO: 130132

SEQ ID NO: 155855 - RNA, 64 nt, Human; identical to SEQ ID NO: 130133

SEQ ID NO: 155856 - RNA, 64 nt, Human; identical to SEQ ID NO: 130134

SEQ ID NO: 155857 - RNA, 64 nt, Human; identical to SEQ ID NO: 130135

SEQ ID NO: 155858 - RNA, 64 nt, Human; identical to SEQ ID NO: 130136

SEQ ID NO: 155859 - RNA, 64 nt, Human; identical to SEQ ID NO: 130137

SEQ ID NO: 155860 - RNA, 64 nt, Human; identical to SEQ ID NO: 130138

SEQ ID NO: 155861 - RNA, 64 nt, Human; identical to SEQ ID NO: 130139

SEQ ID NO: 155862 - RNA, 64 nt, Human; identical to SEQ ID NO: 130140

SEQ ID NO: 155863 - RNA, 64 nt, Human; identical to SEQ ID NO: 130141

SEQ ID NO: 155864 - RNA, 64 nt, Human; identical to SEQ ID NO: 130142

SEQ ID NO: 155865 - RNA, 64 nt, Human; identical to SEQ ID NO: 130143

SEQ ID NO: 155866 - RNA, 64 nt, Human; identical to SEQ ID NO: 130144

SEQ ID NO: 155867 - RNA, 64 nt, Human; identical to SEQ ID NO: 130145

SEQ ID NO: 155868 - RNA, 64 nt, Human; identical to SEQ ID NO: 130146

SEQ ID NO: 155869 - RNA, 64 nt, Human; identical to SEQ ID NO: 130147

SEQ ID NO: 155870 - RNA, 64 nt, Human; identical to SEQ ID NO: 130148

SEQ ID NO: 155871 - RNA, 64 nt, Human; identical to SEQ ID NO: 130149

SEQ ID NO: 155872 - RNA, 64 nt, Human; identical to SEQ ID NO: 130150

SEQ ID NO: 155873 - RNA, 64 nt, Human; identical to SEQ ID NO: 130151

SEQ ID NO: 155874 - RNA, 64 nt, Human; identical to SEQ ID NO: 130152

SEQ ID NO: 155875 - RNA, 64 nt, Human; identical to SEQ ID NO: 130153

SEQ ID NO: 155876 - RNA, 64 nt, Human; identical to SEQ ID NO: 130154

SEQ ID NO: 155877 - RNA, 64 nt, Human; identical to SEQ ID NO: 130155

SEQ ID NO: 155878 - RNA, 64 nt, Human; identical to SEQ ID NO: 130156

SEQ ID NO: 155879 - RNA, 64 nt, Human; identical to SEQ ID NO: 130157

SEQ ID NO: 155880 - RNA, 64 nt, Human; identical to SEQ ID NO: 130158

SEQ ID NO: 155881 - RNA, 64 nt, Human; identical to SEQ ID NO: 130159

SEQ ID NO: 155882 - RNA, 64 nt, Human; identical to SEQ ID NO: 130160

SEQ ID NO: 155883 - RNA, 64 nt, Human; identical to SEQ ID NO: 130161

SEQ ID NO: 155884 - RNA, 64 nt, Human; identical to SEQ ID NO: 130162

SEQ ID NO: 155885 - RNA, 64 nt, Human; identical to SEQ ID NO: 130163

SEQ ID NO: 155886 - RNA, 64 nt, Human; identical to SEQ ID NO: 130164

SEQ ID NO: 155887 - RNA, 64 nt, Human; identical to SEQ ID NO: 130165

SEQ ID NO: 155888 - RNA, 64 nt, Human; identical to SEQ ID NO: 130166

SEQ ID NO: 155889 - RNA, 64 nt, Human; identical to SEQ ID NO: 130167

SEQ ID NO: 155890 - RNA, 64 nt, Human; identical to SEQ ID NO: 130168

SEQ ID NO: 155891 - RNA, 64 nt, Human; identical to SEQ ID NO: 130169

SEQ ID NO: 155892 - RNA, 64 nt, Human; identical to SEQ ID NO: 130170

SEQ ID NO: 155893 - RNA, 64 nt, Human; identical to SEQ ID NO: 130171

SEQ ID NO: 155894 - RNA, 64 nt, Human; identical to SEQ ID NO: 130172

SEQ ID NO: 155895 - RNA, 64 nt, Human; identical to SEQ ID NO: 130173

SEQ ID NO: 155896 - RNA, 64 nt, Human; identical to SEQ ID NO: 130174

SEQ ID NO: 155897 - RNA, 64 nt, Human; identical to SEQ ID NO: 130175

SEQ ID NO: 155898 - RNA, 64 nt, Human; identical to SEQ ID NO: 130176

SEQ ID NO: 155899 - RNA, 64 nt, Human; identical to SEQ ID NO: 130177

SEQ ID NO: 155900 - RNA, 64 nt, Human; identical to SEQ ID NO: 130178

SEQ ID NO: 155901 - RNA, 64 nt, Human; identical to SEQ ID NO: 130179

SEQ ID NO: 155902 - RNA, 64 nt, Human; identical to SEQ ID NO: 130180

SEQ ID NO: 155903 - RNA, 64 nt, Human; identical to SEQ ID NO: 130181

SEQ ID NO: 155904 - RNA, 64 nt, Human; identical to SEQ ID NO: 130182

SEQ ID NO: 155905 - RNA, 64 nt, Human; identical to SEQ ID NO: 130183

SEQ ID NO: 155906 - RNA, 64 nt, Human; identical to SEQ ID NO: 130184

SEQ ID NO: 155907 - RNA, 64 nt, Human; identical to SEQ ID NO: 130185

SEQ ID NO: 155908 - RNA, 64 nt, Human; identical to SEQ ID NO: 130186

SEQ ID NO: 155909 - RNA, 64 nt, Human; identical to SEQ ID NO: 130187

SEQ ID NO: 155910 - RNA, 64 nt, Human; identical to SEQ ID NO: 130188

SEQ ID NO: 155911 - RNA, 64 nt, Human; identical to SEQ ID NO: 130189

SEQ ID NO: 155912 - RNA, 64 nt, Human; identical to SEQ ID NO: 130190

SEQ ID NO: 155913 - RNA, 64 nt, Human; identical to SEQ ID NO: 130191

SEQ ID NO: 155914 - RNA, 64 nt, Human; identical to SEQ ID NO: 130192

SEQ ID NO: 155915 - RNA, 64 nt, Human; identical to SEQ ID NO: 130193

SEQ ID NO: 155916 - RNA, 64 nt, Human; identical to SEQ ID NO: 130194

SEQ ID NO: 155917 - RNA, 64 nt, Human; identical to SEQ ID NO: 130195

SEQ ID NO: 155918 - RNA, 64 nt, Human; identical to SEQ ID NO: 130196

SEQ ID NO: 155919 - RNA, 64 nt, Human; identical to SEQ ID NO: 130197

SEQ ID NO: 155920 - RNA, 64 nt, Human; identical to SEQ ID NO: 130198

SEQ ID NO: 155921 - RNA, 64 nt, Human; identical to SEQ ID NO: 130199

SEQ ID NO: 155922 - RNA, 64 nt, Human; identical to SEQ ID NO: 130200

SEQ ID NO: 155923 - RNA, 64 nt, Human; identical to SEQ ID NO: 130201

SEQ ID NO: 155924 - RNA, 64 nt, Human; identical to SEQ ID NO: 130202

SEQ ID NO: 155925 - RNA, 64 nt, Human; identical to SEQ ID NO: 130203

SEQ ID NO: 155926 - RNA, 64 nt, Human; identical to SEQ ID NO: 130204

SEQ ID NO: 155927 - RNA, 64 nt, Human; identical to SEQ ID NO: 130205

SEQ ID NO: 155928 - RNA, 64 nt, Human; identical to SEQ ID NO: 130206

SEQ ID NO: 155929 - RNA, 64 nt, Human; identical to SEQ ID NO: 130207

SEQ ID NO: 155930 - RNA, 64 nt, Human; identical to SEQ ID NO: 130208

SEQ ID NO: 155931 - RNA, 64 nt, Human; identical to SEQ ID NO: 130209

SEQ ID NO: 155932 - RNA, 64 nt, Human; identical to SEQ ID NO: 130210

SEQ ID NO: 155933 - RNA, 64 nt, Human; identical to SEQ ID NO: 130211

SEQ ID NO: 155934 - RNA, 64 nt, Human; identical to SEQ ID NO: 130212

SEQ ID NO: 155935 - RNA, 64 nt, Human; identical to SEQ ID NO: 130213

SEQ ID NO: 155936 - RNA, 64 nt, Human; identical to SEQ ID NO: 130214

SEQ ID NO: 155937 - RNA, 64 nt, Human; identical to SEQ ID NO: 130215

SEQ ID NO: 155938 - RNA, 64 nt, Human; identical to SEQ ID NO: 130216

SEQ ID NO: 155939 - RNA, 64 nt, Human; identical to SEQ ID NO: 130217

SEQ ID NO: 155940 - RNA, 64 nt, Human; identical to SEQ ID NO: 130218

SEQ ID NO: 155941 - RNA, 64 nt, Human; identical to SEQ ID NO: 130219

SEQ ID NO: 155942 - RNA, 64 nt, Human; identical to SEQ ID NO: 130220

SEQ ID NO: 155943 - RNA, 64 nt, Human; identical to SEQ ID NO: 130221

SEQ ID NO: 155944 - RNA, 64 nt, Human; identical to SEQ ID NO: 130222

SEQ ID NO: 155945 - RNA, 64 nt, Human; identical to SEQ ID NO: 130223

SEQ ID NO: 155946 - RNA, 64 nt, Human; identical to SEQ ID NO: 130224

SEQ ID NO: 155947 - RNA, 64 nt, Human; identical to SEQ ID NO: 130225

SEQ ID NO: 155948 - RNA, 64 nt, Human; identical to SEQ ID NO: 130226

SEQ ID NO: 155949 - RNA, 64 nt, Human; identical to SEQ ID NO: 130227

SEQ ID NO: 155950 - RNA, 64 nt, Human; identical to SEQ ID NO: 130228

SEQ ID NO: 155951 - RNA, 64 nt, Human; identical to SEQ ID NO: 130229

SEQ ID NO: 155952 - RNA, 64 nt, Human; identical to SEQ ID NO: 130230

SEQ ID NO: 155953 - RNA, 64 nt, Human; identical to SEQ ID NO: 130231

SEQ ID NO: 155954 - RNA, 64 nt, Human; identical to SEQ ID NO: 130232

SEQ ID NO: 155955 - RNA, 64 nt, Human; identical to SEQ ID NO: 130233

SEQ ID NO: 155956 - RNA, 64 nt, Human; identical to SEQ ID NO: 130234

SEQ ID NO: 155957 - RNA, 64 nt, Human; identical to SEQ ID NO: 130235

SEQ ID NO: 155958 - RNA, 64 nt, Human; identical to SEQ ID NO: 130236

SEQ ID NO: 155959 - RNA, 64 nt, Human; identical to SEQ ID NO: 130237

SEQ ID NO: 155960 - RNA, 64 nt, Human; identical to SEQ ID NO: 130238

SEQ ID NO: 155961 - RNA, 64 nt, Human; identical to SEQ ID NO: 130239

SEQ ID NO: 155962 - RNA, 64 nt, Human; identical to SEQ ID NO: 130240

SEQ ID NO: 155963 - RNA, 64 nt, Human; identical to SEQ ID NO: 130241

SEQ ID NO: 155964 - RNA, 64 nt, Human; identical to SEQ ID NO: 130242

SEQ ID NO: 155965 - RNA, 64 nt, Human; identical to SEQ ID NO: 130243

SEQ ID NO: 155966 - RNA, 64 nt, Human; identical to SEQ ID NO: 130244

SEQ ID NO: 155967 - RNA, 64 nt, Human; identical to SEQ ID NO: 130245

SEQ ID NO: 155968 - RNA, 64 nt, Human; identical to SEQ ID NO: 130246

SEQ ID NO: 155969 - RNA, 64 nt, Human; identical to SEQ ID NO: 130247

SEQ ID NO: 155970 - RNA, 64 nt, Human; identical to SEQ ID NO: 130248

SEQ ID NO: 155971 - RNA, 64 nt, Human; identical to SEQ ID NO: 130249

SEQ ID NO: 155972 - RNA, 64 nt, Human; identical to SEQ ID NO: 130250

SEQ ID NO: 155973 - RNA, 64 nt, Human; identical to SEQ ID NO: 130251

SEQ ID NO: 155974 - RNA, 64 nt, Human; identical to SEQ ID NO: 130252

SEQ ID NO: 155975 - RNA, 64 nt, Human; identical to SEQ ID NO: 130253

SEQ ID NO: 155976 - RNA, 64 nt, Human; identical to SEQ ID NO: 130254

SEQ ID NO: 155977 - RNA, 64 nt, Human; identical to SEQ ID NO: 130255

SEQ ID NO: 155978 - RNA, 64 nt, Human; identical to SEQ ID NO: 130256

SEQ ID NO: 155979 - RNA, 64 nt, Human; identical to SEQ ID NO: 130257

SEQ ID NO: 155980 - RNA, 64 nt, Human; identical to SEQ ID NO: 130258

SEQ ID NO: 155981 - RNA, 64 nt, Human; identical to SEQ ID NO: 130259

SEQ ID NO: 155982 - RNA, 64 nt, Human; identical to SEQ ID NO: 130260

SEQ ID NO: 155983 - RNA, 64 nt, Human; identical to SEQ ID NO: 130261

SEQ ID NO: 155984 - RNA, 64 nt, Human; identical to SEQ ID NO: 130262

SEQ ID NO: 155985 - RNA, 64 nt, Human; identical to SEQ ID NO: 130263

SEQ ID NO: 155986 - RNA, 64 nt, Human; identical to SEQ ID NO: 130264

SEQ ID NO: 155987 - RNA, 64 nt, Human; identical to SEQ ID NO: 130265

SEQ ID NO: 155988 - RNA, 64 nt, Human; identical to SEQ ID NO: 130266

SEQ ID NO: 155989 - RNA, 64 nt, Human; identical to SEQ ID NO: 130267

SEQ ID NO: 155990 - RNA, 64 nt, Human; identical to SEQ ID NO: 130268

SEQ ID NO: 155991 - RNA, 64 nt, Human; identical to SEQ ID NO: 130269

SEQ ID NO: 155992 - RNA, 64 nt, Human; identical to SEQ ID NO: 130270

SEQ ID NO: 155993 - RNA, 64 nt, Human; identical to SEQ ID NO: 130271

SEQ ID NO: 155994 - RNA, 64 nt, Human; identical to SEQ ID NO: 130272

SEQ ID NO: 155995 - RNA, 64 nt, Human; identical to SEQ ID NO: 130273

SEQ ID NO: 155996 - RNA, 64 nt, Human; identical to SEQ ID NO: 130274

SEQ ID NO: 155997 - RNA, 64 nt, Human; identical to SEQ ID NO: 130275

SEQ ID NO: 155998 - RNA, 64 nt, Human; identical to SEQ ID NO: 130276

SEQ ID NO: 155999 - RNA, 64 nt, Human; identical to SEQ ID NO: 130277

SEQ ID NO: 156000 - RNA, 64 nt, Human; identical to SEQ ID NO: 130278

SEQ ID NO: 156001 - RNA, 64 nt, Human; identical to SEQ ID NO: 130279

SEQ ID NO: 156002 - RNA, 64 nt, Human; identical to SEQ ID NO: 130280

SEQ ID NO: 156003 - RNA, 64 nt, Human; identical to SEQ ID NO: 130281

SEQ ID NO: 156004 - RNA, 64 nt, Human; identical to SEQ ID NO: 130282

SEQ ID NO: 156005 - RNA, 64 nt, Human; identical to SEQ ID NO: 130283

SEQ ID NO: 156006 - RNA, 64 nt, Human; identical to SEQ ID NO: 130284

SEQ ID NO: 156007 - RNA, 64 nt, Human; identical to SEQ ID NO: 130285

SEQ ID NO: 156008 - RNA, 64 nt, Human; identical to SEQ ID NO: 130286

SEQ ID NO: 156009 - RNA, 64 nt, Human; identical to SEQ ID NO: 130287

SEQ ID NO: 156010 - RNA, 64 nt, Human; identical to SEQ ID NO: 130288

SEQ ID NO: 156011 - RNA, 64 nt, Human; identical to SEQ ID NO: 130289

SEQ ID NO: 156012 - RNA, 64 nt, Human; identical to SEQ ID NO: 130290

SEQ ID NO: 156013 - RNA, 64 nt, Human; identical to SEQ ID NO: 130291

SEQ ID NO: 156014 - RNA, 64 nt, Human; identical to SEQ ID NO: 130292

SEQ ID NO: 156015 - RNA, 64 nt, Human; identical to SEQ ID NO: 130293

SEQ ID NO: 156016 - RNA, 64 nt, Human; identical to SEQ ID NO: 130294

SEQ ID NO: 156017 - RNA, 64 nt, Human; identical to SEQ ID NO: 130295

SEQ ID NO: 156018 - RNA, 64 nt, Human; identical to SEQ ID NO: 130296

SEQ ID NO: 156019 - RNA, 64 nt, Human; identical to SEQ ID NO: 130297

SEQ ID NO: 156020 - RNA, 64 nt, Human; identical to SEQ ID NO: 130298

SEQ ID NO: 156021 - RNA, 64 nt, Human; identical to SEQ ID NO: 130299

SEQ ID NO: 156022 - RNA, 64 nt, Human; identical to SEQ ID NO: 130300

SEQ ID NO: 156023 - RNA, 64 nt, Human; identical to SEQ ID NO: 130301

SEQ ID NO: 156024 - RNA, 64 nt, Human; identical to SEQ ID NO: 130302

SEQ ID NO: 156025 - RNA, 64 nt, Human; identical to SEQ ID NO: 130303

SEQ ID NO: 156026 - RNA, 64 nt, Human; identical to SEQ ID NO: 130304

SEQ ID NO: 156027 - RNA, 64 nt, Human; identical to SEQ ID NO: 130305

SEQ ID NO: 156028 - RNA, 64 nt, Human; identical to SEQ ID NO: 130306

SEQ ID NO: 156029 - RNA, 64 nt, Human; identical to SEQ ID NO: 130307

SEQ ID NO: 156030 - RNA, 64 nt, Human; identical to SEQ ID NO: 130308

SEQ ID NO: 156031 - RNA, 64 nt, Human; identical to SEQ ID NO: 130309

SEQ ID NO: 156032 - RNA, 64 nt, Human; identical to SEQ ID NO: 130310

SEQ ID NO: 156033 - RNA, 64 nt, Human; identical to SEQ ID NO: 130311

SEQ ID NO: 156034 - RNA, 64 nt, Human; identical to SEQ ID NO: 130312

SEQ ID NO: 156035 - RNA, 64 nt, Human; identical to SEQ ID NO: 130313

SEQ ID NO: 156036 - RNA, 64 nt, Human; identical to SEQ ID NO: 130314

SEQ ID NO: 156037 - RNA, 64 nt, Human; identical to SEQ ID NO: 130315

SEQ ID NO: 156038 - RNA, 64 nt, Human; identical to SEQ ID NO: 130316

SEQ ID NO: 156039 - RNA, 64 nt, Human; identical to SEQ ID NO: 130317

SEQ ID NO: 156040 - RNA, 64 nt, Human; identical to SEQ ID NO: 130318

SEQ ID NO: 156041 - RNA, 64 nt, Human; identical to SEQ ID NO: 130319

SEQ ID NO: 156042 - RNA, 64 nt, Human; identical to SEQ ID NO: 130320

SEQ ID NO: 156043 - RNA, 64 nt, Human; identical to SEQ ID NO: 130321

SEQ ID NO: 156044 - RNA, 64 nt, Human; identical to SEQ ID NO: 130322

SEQ ID NO: 156045 - RNA, 64 nt, Human; identical to SEQ ID NO: 130323

SEQ ID NO: 156046 - RNA, 64 nt, Human; identical to SEQ ID NO: 130324

SEQ ID NO: 156047 - RNA, 64 nt, Human; identical to SEQ ID NO: 130325

SEQ ID NO: 156048 - RNA, 64 nt, Human; identical to SEQ ID NO: 130326

SEQ ID NO: 156049 - RNA, 64 nt, Human; identical to SEQ ID NO: 130327

SEQ ID NO: 156050 - RNA, 64 nt, Human; identical to SEQ ID NO: 130328

SEQ ID NO: 156051 - RNA, 64 nt, Human; identical to SEQ ID NO: 130329

SEQ ID NO: 156052 - RNA, 64 nt, Human; identical to SEQ ID NO: 130330

SEQ ID NO: 156053 - RNA, 64 nt, Human; identical to SEQ ID NO: 130331

SEQ ID NO: 156054 - RNA, 64 nt, Human; identical to SEQ ID NO: 130332

SEQ ID NO: 156055 - RNA, 64 nt, Human; identical to SEQ ID NO: 130333

SEQ ID NO: 156056 - RNA, 64 nt, Human; identical to SEQ ID NO: 130334

SEQ ID NO: 156057 - RNA, 64 nt, Human; identical to SEQ ID NO: 130335

SEQ ID NO: 156058 - RNA, 64 nt, Human; identical to SEQ ID NO: 130336

SEQ ID NO: 156059 - RNA, 64 nt, Human; identical to SEQ ID NO: 130337

SEQ ID NO: 156060 - RNA, 64 nt, Human; identical to SEQ ID NO: 130338

SEQ ID NO: 156061 - RNA, 64 nt, Human; identical to SEQ ID NO: 130339

SEQ ID NO: 156062 - RNA, 64 nt, Human; identical to SEQ ID NO: 130340

SEQ ID NO: 156063 - RNA, 64 nt, Human; identical to SEQ ID NO: 130341

SEQ ID NO: 156064 - RNA, 64 nt, Human; identical to SEQ ID NO: 130342

SEQ ID NO: 156065 - RNA, 64 nt, Human; identical to SEQ ID NO: 130343

SEQ ID NO: 156066 - RNA, 64 nt, Human; identical to SEQ ID NO: 130344

SEQ ID NO: 156067 - RNA, 64 nt, Human; identical to SEQ ID NO: 130345

SEQ ID NO: 156068 - RNA, 64 nt, Human; identical to SEQ ID NO: 130346

SEQ ID NO: 156069 - RNA, 64 nt, Human; identical to SEQ ID NO: 130347

SEQ ID NO: 156070 - RNA, 64 nt, Human; identical to SEQ ID NO: 130348

SEQ ID NO: 156071 - RNA, 64 nt, Human; identical to SEQ ID NO: 130349

SEQ ID NO: 156072 - RNA, 64 nt, Human; identical to SEQ ID NO: 130350

SEQ ID NO: 156073 - RNA, 64 nt, Human; identical to SEQ ID NO: 130351

SEQ ID NO: 156074 - RNA, 64 nt, Human; identical to SEQ ID NO: 130352

SEQ ID NO: 156075 - RNA, 64 nt, Human; identical to SEQ ID NO: 130353

SEQ ID NO: 156076 - RNA, 64 nt, Human; identical to SEQ ID NO: 130354

SEQ ID NO: 156077 - RNA, 64 nt, Human; identical to SEQ ID NO: 130355

SEQ ID NO: 156078 - RNA, 64 nt, Human; identical to SEQ ID NO: 130356

SEQ ID NO: 156079 - RNA, 64 nt, Human; identical to SEQ ID NO: 130357

SEQ ID NO: 156080 - RNA, 64 nt, Human; identical to SEQ ID NO: 130358

SEQ ID NO: 156081 - RNA, 64 nt, Human; identical to SEQ ID NO: 130359

SEQ ID NO: 156082 - RNA, 64 nt, Human; identical to SEQ ID NO: 130360

SEQ ID NO: 156083 - RNA, 64 nt, Human; identical to SEQ ID NO: 130361

SEQ ID NO: 156084 - RNA, 64 nt, Human; identical to SEQ ID NO: 130362

SEQ ID NO: 156085 - RNA, 64 nt, Human; identical to SEQ ID NO: 130363

SEQ ID NO: 156086 - RNA, 64 nt, Human; identical to SEQ ID NO: 130364

SEQ ID NO: 156087 - RNA, 64 nt, Human; identical to SEQ ID NO: 130365

SEQ ID NO: 156088 - RNA, 64 nt, Human; identical to SEQ ID NO: 130366

SEQ ID NO: 156089 - RNA, 64 nt, Human; identical to SEQ ID NO: 130367

SEQ ID NO: 156090 - RNA, 64 nt, Human; identical to SEQ ID NO: 130368

SEQ ID NO: 156091 - RNA, 64 nt, Human; identical to SEQ ID NO: 130369

SEQ ID NO: 156092 - RNA, 64 nt, Human; identical to SEQ ID NO: 130370

SEQ ID NO: 156093 - RNA, 64 nt, Human; identical to SEQ ID NO: 130371

SEQ ID NO: 156094 - RNA, 64 nt, Human; identical to SEQ ID NO: 130372

SEQ ID NO: 156095 - RNA, 64 nt, Human; identical to SEQ ID NO: 130373

SEQ ID NO: 156096 - RNA, 64 nt, Human; identical to SEQ ID NO: 130374

SEQ ID NO: 156097 - RNA, 64 nt, Human; identical to SEQ ID NO: 130375

SEQ ID NO: 156098 - RNA, 64 nt, Human; identical to SEQ ID NO: 130376

SEQ ID NO: 156099 - RNA, 64 nt, Human; identical to SEQ ID NO: 130377

SEQ ID NO: 156100 - RNA, 64 nt, Human; identical to SEQ ID NO: 130378

SEQ ID NO: 156101 - RNA, 64 nt, Human; identical to SEQ ID NO: 130379

SEQ ID NO: 156102 - RNA, 64 nt, Human; identical to SEQ ID NO: 130380

SEQ ID NO: 156103 - RNA, 64 nt, Human; identical to SEQ ID NO: 130381

SEQ ID NO: 156104 - RNA, 64 nt, Human; identical to SEQ ID NO: 130382

SEQ ID NO: 156105 - RNA, 64 nt, Human; identical to SEQ ID NO: 130383

SEQ ID NO: 156106 - RNA, 64 nt, Human; identical to SEQ ID NO: 130384

SEQ ID NO: 156107 - RNA, 64 nt, Human; identical to SEQ ID NO: 130385

SEQ ID NO: 156108 - RNA, 64 nt, Human; identical to SEQ ID NO: 130386

SEQ ID NO: 156109 - RNA, 64 nt, Human; identical to SEQ ID NO: 130387

SEQ ID NO: 156110 - RNA, 64 nt, Human; identical to SEQ ID NO: 130388

SEQ ID NO: 156111 - RNA, 64 nt, Human; identical to SEQ ID NO: 130389

SEQ ID NO: 156112 - RNA, 64 nt, Human; identical to SEQ ID NO: 130390

SEQ ID NO: 156113 - RNA, 64 nt, Human; identical to SEQ ID NO: 130391

SEQ ID NO: 156114 - RNA, 64 nt, Human; identical to SEQ ID NO: 130392

SEQ ID NO: 156115 - RNA, 64 nt, Human; identical to SEQ ID NO: 130393

SEQ ID NO: 156116 - RNA, 64 nt, Human; identical to SEQ ID NO: 130394

SEQ ID NO: 156117 - RNA, 64 nt, Human; identical to SEQ ID NO: 130395

SEQ ID NO: 156118 - RNA, 64 nt, Human; identical to SEQ ID NO: 130396

SEQ ID NO: 156119 - RNA, 64 nt, Human; identical to SEQ ID NO: 130397

SEQ ID NO: 156120 - RNA, 64 nt, Human; identical to SEQ ID NO: 130398

SEQ ID NO: 156121 - RNA, 64 nt, Human; identical to SEQ ID NO: 130399

SEQ ID NO: 156122 - RNA, 64 nt, Human; identical to SEQ ID NO: 130400

SEQ ID NO: 156123 - RNA, 64 nt, Human; identical to SEQ ID NO: 130401

SEQ ID NO: 156124 - RNA, 64 nt, Human; identical to SEQ ID NO: 130402

SEQ ID NO: 156125 - RNA, 64 nt, Human; identical to SEQ ID NO: 130403

SEQ ID NO: 156126 - RNA, 64 nt, Human; identical to SEQ ID NO: 130404

SEQ ID NO: 156127 - RNA, 64 nt, Human; identical to SEQ ID NO: 130405

SEQ ID NO: 156128 - RNA, 64 nt, Human; identical to SEQ ID NO: 130406

SEQ ID NO: 156129 - RNA, 64 nt, Human; identical to SEQ ID NO: 130407

SEQ ID NO: 156130 - RNA, 64 nt, Human; identical to SEQ ID NO: 130408

SEQ ID NO: 156131 - RNA, 64 nt, Human; identical to SEQ ID NO: 130409

SEQ ID NO: 156132 - RNA, 64 nt, Human; identical to SEQ ID NO: 130410

SEQ ID NO: 156133 - RNA, 64 nt, Human; identical to SEQ ID NO: 130411

SEQ ID NO: 156134 - RNA, 64 nt, Human; identical to SEQ ID NO: 130412

SEQ ID NO: 156135 - RNA, 64 nt, Human; identical to SEQ ID NO: 130413

SEQ ID NO: 156136 - RNA, 64 nt, Human; identical to SEQ ID NO: 130414

SEQ ID NO: 156137 - RNA, 64 nt, Human; identical to SEQ ID NO: 130415

SEQ ID NO: 156138 - RNA, 64 nt, Human; identical to SEQ ID NO: 130416

SEQ ID NO: 156139 - RNA, 64 nt, Human; identical to SEQ ID NO: 130417

SEQ ID NO: 156140 - RNA, 64 nt, Human; identical to SEQ ID NO: 130418

SEQ ID NO: 156141 - RNA, 64 nt, Human; identical to SEQ ID NO: 130419

SEQ ID NO: 156142 - RNA, 64 nt, Human; identical to SEQ ID NO: 130420

SEQ ID NO: 156143 - RNA, 64 nt, Human; identical to SEQ ID NO: 130421

SEQ ID NO: 156144 - RNA, 64 nt, Human; identical to SEQ ID NO: 130422

SEQ ID NO: 156145 - RNA, 64 nt, Human; identical to SEQ ID NO: 130423

SEQ ID NO: 156146 - RNA, 64 nt, Human; identical to SEQ ID NO: 130424

SEQ ID NO: 156147 - RNA, 64 nt, Human; identical to SEQ ID NO: 130425

SEQ ID NO: 156148 - RNA, 64 nt, Human; identical to SEQ ID NO: 130426

SEQ ID NO: 156149 - RNA, 64 nt, Human; identical to SEQ ID NO: 130427

SEQ ID NO: 156150 - RNA, 64 nt, Human; identical to SEQ ID NO: 130428

SEQ ID NO: 156151 - RNA, 64 nt, Human; identical to SEQ ID NO: 130429

SEQ ID NO: 156152 - RNA, 64 nt, Human; identical to SEQ ID NO: 130430

SEQ ID NO: 156153 - RNA, 64 nt, Human; identical to SEQ ID NO: 130431

SEQ ID NO: 156154 - RNA, 64 nt, Human; identical to SEQ ID NO: 130432

SEQ ID NO: 156155 - RNA, 64 nt, Human; identical to SEQ ID NO: 130433

SEQ ID NO: 156156 - RNA, 64 nt, Human; identical to SEQ ID NO: 130434

SEQ ID NO: 156157 - RNA, 64 nt, Human; identical to SEQ ID NO: 130435

SEQ ID NO: 156158 - RNA, 64 nt, Human; identical to SEQ ID NO: 130436

SEQ ID NO: 156159 - RNA, 64 nt, Human; identical to SEQ ID NO: 130437

SEQ ID NO: 156160 - RNA, 64 nt, Human; identical to SEQ ID NO: 130438

SEQ ID NO: 156161 - RNA, 64 nt, Human; identical to SEQ ID NO: 130439

SEQ ID NO: 156162 - RNA, 64 nt, Human; identical to SEQ ID NO: 130440

SEQ ID NO: 156163 - RNA, 64 nt, Human; identical to SEQ ID NO: 130441

SEQ ID NO: 156164 - RNA, 64 nt, Human; identical to SEQ ID NO: 130442

SEQ ID NO: 156165 - RNA, 64 nt, Human; identical to SEQ ID NO: 130443

SEQ ID NO: 156166 - RNA, 64 nt, Human; identical to SEQ ID NO: 130444

SEQ ID NO: 156167 - RNA, 64 nt, Human; identical to SEQ ID NO: 130445

SEQ ID NO: 156168 - RNA, 64 nt, Human; identical to SEQ ID NO: 130446

SEQ ID NO: 156169 - RNA, 64 nt, Human; identical to SEQ ID NO: 130447

SEQ ID NO: 156170 - RNA, 64 nt, Human; identical to SEQ ID NO: 130448

SEQ ID NO: 156171 - RNA, 64 nt, Human; identical to SEQ ID NO: 130449

SEQ ID NO: 156172 - RNA, 64 nt, Human; identical to SEQ ID NO: 130450

SEQ ID NO: 156173 - RNA, 64 nt, Human; identical to SEQ ID NO: 130451

SEQ ID NO: 156174 - RNA, 64 nt, Human; identical to SEQ ID NO: 130452

SEQ ID NO: 156175 - RNA, 64 nt, Human; identical to SEQ ID NO: 130453

SEQ ID NO: 156176 - RNA, 64 nt, Human; identical to SEQ ID NO: 130454

SEQ ID NO: 156177 - RNA, 64 nt, Human; identical to SEQ ID NO: 130455

SEQ ID NO: 156178 - RNA, 64 nt, Human; identical to SEQ ID NO: 130456

SEQ ID NO: 156179 - RNA, 64 nt, Human; identical to SEQ ID NO: 130457

SEQ ID NO: 156180 - RNA, 64 nt, Human; identical to SEQ ID NO: 130458

SEQ ID NO: 156181 - RNA, 64 nt, Human; identical to SEQ ID NO: 130459

SEQ ID NO: 156182 - RNA, 64 nt, Human; identical to SEQ ID NO: 130460

SEQ ID NO: 156183 - RNA, 64 nt, Human; identical to SEQ ID NO: 130461

SEQ ID NO: 156184 - RNA, 64 nt, Human; identical to SEQ ID NO: 130462

SEQ ID NO: 156185 - RNA, 64 nt, Human; identical to SEQ ID NO: 130463

SEQ ID NO: 156186 - RNA, 64 nt, Human; identical to SEQ ID NO: 130464

SEQ ID NO: 156187 - RNA, 64 nt, Human; identical to SEQ ID NO: 130465

SEQ ID NO: 156188 - RNA, 64 nt, Human; identical to SEQ ID NO: 130466

SEQ ID NO: 156189 - RNA, 64 nt, Human; identical to SEQ ID NO: 130467

SEQ ID NO: 156190 - RNA, 64 nt, Human; identical to SEQ ID NO: 130468

SEQ ID NO: 156191 - RNA, 64 nt, Human; identical to SEQ ID NO: 130469

SEQ ID NO: 156192 - RNA, 64 nt, Human; identical to SEQ ID NO: 130470

SEQ ID NO: 156193 - RNA, 64 nt, Human; identical to SEQ ID NO: 130471

SEQ ID NO: 156194 - RNA, 64 nt, Human; identical to SEQ ID NO: 130472

SEQ ID NO: 156195 - RNA, 64 nt, Human; identical to SEQ ID NO: 130473

SEQ ID NO: 156196 - RNA, 51 nt, Human; identical to SEQ ID NO: 130474

SEQ ID NO: 156197 - RNA, 64 nt, Human; identical to SEQ ID NO: 130475

SEQ ID NO: 156198 - RNA, 64 nt, Human; identical to SEQ ID NO: 130476

SEQ ID NO: 156199 - RNA, 64 nt, Human; identical to SEQ ID NO: 130477

SEQ ID NO: 156200 - RNA, 64 nt, Human; identical to SEQ ID NO: 130478

SEQ ID NO: 156201 - RNA, 64 nt, Human; identical to SEQ ID NO: 130479

SEQ ID NO: 156202 - RNA, 64 nt, Human; identical to SEQ ID NO: 130480

SEQ ID NO: 156203 - RNA, 64 nt, Human; identical to SEQ ID NO: 130481

SEQ ID NO: 156204 - RNA, 64 nt, Human; identical to SEQ ID NO: 130482

SEQ ID NO: 156205 - RNA, 64 nt, Human; identical to SEQ ID NO: 130483

SEQ ID NO: 156206 - RNA, 64 nt, Human; identical to SEQ ID NO: 130484

SEQ ID NO: 156207 - RNA, 50 nt, Human; identical to SEQ ID NO: 130485

SEQ ID NO: 156208 - RNA, 64 nt, Human; identical to SEQ ID NO: 130486

SEQ ID NO: 156209 - RNA, 64 nt, Human; identical to SEQ ID NO: 130487

SEQ ID NO: 156210 - RNA, 64 nt, Human; identical to SEQ ID NO: 130488

SEQ ID NO: 156211 - RNA, 64 nt, Human; identical to SEQ ID NO: 130489

SEQ ID NO: 156212 - RNA, 64 nt, Human; identical to SEQ ID NO: 130490

SEQ ID NO: 156213 - RNA, 64 nt, Human; identical to SEQ ID NO: 130491

SEQ ID NO: 156214 - RNA, 64 nt, Human; identical to SEQ ID NO: 130492

SEQ ID NO: 156215 - RNA, 64 nt, Human; identical to SEQ ID NO: 130493

SEQ ID NO: 156216 - RNA, 64 nt, Human; identical to SEQ ID NO: 130494

SEQ ID NO: 156217 - RNA, 64 nt, Human; identical to SEQ ID NO: 130495

SEQ ID NO: 156218 - RNA, 64 nt, Human; identical to SEQ ID NO: 130496

SEQ ID NO: 156219 - RNA, 64 nt, Human; identical to SEQ ID NO: 130497

SEQ ID NO: 156220 - RNA, 64 nt, Human; identical to SEQ ID NO: 130498

SEQ ID NO: 156221 - RNA, 64 nt, Human; identical to SEQ ID NO: 130499

SEQ ID NO: 156222 - RNA, 64 nt, Human; identical to SEQ ID NO: 130500

SEQ ID NO: 156223 - RNA, 64 nt, Human; identical to SEQ ID NO: 130501

SEQ ID NO: 156224 - RNA, 64 nt, Human; identical to SEQ ID NO: 130502

SEQ ID NO: 156225 - RNA, 64 nt, Human; identical to SEQ ID NO: 130503

SEQ ID NO: 156226 - RNA, 64 nt, Human; identical to SEQ ID NO: 130504

SEQ ID NO: 156227 - RNA, 64 nt, Human; identical to SEQ ID NO: 130505

SEQ ID NO: 156228 - RNA, 64 nt, Human; identical to SEQ ID NO: 130506

SEQ ID NO: 156229 - RNA, 64 nt, Human; identical to SEQ ID NO: 130507

SEQ ID NO: 156230 - RNA, 64 nt, Human; identical to SEQ ID NO: 130508

SEQ ID NO: 156231 - RNA, 64 nt, Human; identical to SEQ ID NO: 130509

SEQ ID NO: 156232 - RNA, 64 nt, Human; identical to SEQ ID NO: 130510

SEQ ID NO: 156233 - RNA, 64 nt, Human; identical to SEQ ID NO: 130511

SEQ ID NO: 156234 - RNA, 64 nt, Human; identical to SEQ ID NO: 130512

SEQ ID NO: 156235 - RNA, 64 nt, Human; identical to SEQ ID NO: 130513

SEQ ID NO: 156236 - RNA, 64 nt, Human; identical to SEQ ID NO: 130514

SEQ ID NO: 156237 - RNA, 64 nt, Human; identical to SEQ ID NO: 130515

SEQ ID NO: 156238 - RNA, 64 nt, Human; identical to SEQ ID NO: 130516

SEQ ID NO: 156239 - RNA, 64 nt, Human; identical to SEQ ID NO: 130517

SEQ ID NO: 156240 - RNA, 64 nt, Human; identical to SEQ ID NO: 130518

SEQ ID NO: 156241 - RNA, 64 nt, Human; identical to SEQ ID NO: 130519

SEQ ID NO: 156242 - RNA, 64 nt, Human; identical to SEQ ID NO: 130520

SEQ ID NO: 156243 - RNA, 64 nt, Human; identical to SEQ ID NO: 130521

SEQ ID NO: 156244 - RNA, 64 nt, Human; identical to SEQ ID NO: 130522

SEQ ID NO: 156245 - RNA, 64 nt, Human; identical to SEQ ID NO: 130523

SEQ ID NO: 156246 - RNA, 64 nt, Human; identical to SEQ ID NO: 130524

SEQ ID NO: 156247 - RNA, 64 nt, Human; identical to SEQ ID NO: 130525

SEQ ID NO: 156248 - RNA, 64 nt, Human; identical to SEQ ID NO: 130526

SEQ ID NO: 156249 - RNA, 64 nt, Human; identical to SEQ ID NO: 130527

SEQ ID NO: 156250 - RNA, 64 nt, Human; identical to SEQ ID NO: 130528

SEQ ID NO: 156251 - RNA, 64 nt, Human; identical to SEQ ID NO: 130529

SEQ ID NO: 156252 - RNA, 64 nt, Human; identical to SEQ ID NO: 130530

SEQ ID NO: 156253 - RNA, 64 nt, Human; identical to SEQ ID NO: 130531

SEQ ID NO: 156254 - RNA, 64 nt, Human; identical to SEQ ID NO: 130532

SEQ ID NO: 156255 - RNA, 64 nt, Human; identical to SEQ ID NO: 130533

SEQ ID NO: 156256 - RNA, 64 nt, Human; identical to SEQ ID NO: 130534

SEQ ID NO: 156257 - RNA, 64 nt, Human; identical to SEQ ID NO: 130535

SEQ ID NO: 156258 - RNA, 64 nt, Human; identical to SEQ ID NO: 130536

SEQ ID NO: 156259 - RNA, 64 nt, Human; identical to SEQ ID NO: 130537

SEQ ID NO: 156260 - RNA, 64 nt, Human; identical to SEQ ID NO: 130538

SEQ ID NO: 156261 - RNA, 64 nt, Human; identical to SEQ ID NO: 130539

SEQ ID NO: 156262 - RNA, 64 nt, Human; identical to SEQ ID NO: 130540

SEQ ID NO: 156263 - RNA, 64 nt, Human; identical to SEQ ID NO: 130541

SEQ ID NO: 156264 - RNA, 64 nt, Human; identical to SEQ ID NO: 130542

SEQ ID NO: 156265 - RNA, 64 nt, Human; identical to SEQ ID NO: 130543

SEQ ID NO: 156266 - RNA, 64 nt, Human; identical to SEQ ID NO: 130544

SEQ ID NO: 156267 - RNA, 64 nt, Human; identical to SEQ ID NO: 130545

SEQ ID NO: 156268 - RNA, 64 nt, Human; identical to SEQ ID NO: 130546

SEQ ID NO: 156269 - RNA, 64 nt, Human; identical to SEQ ID NO: 130547

SEQ ID NO: 156270 - RNA, 54 nt, Human; identical to SEQ ID NO: 130548

SEQ ID NO: 156271 - RNA, 64 nt, Human; identical to SEQ ID NO: 130549

SEQ ID NO: 156272 - RNA, 64 nt, Human; identical to SEQ ID NO: 130550

SEQ ID NO: 156273 - RNA, 64 nt, Human; identical to SEQ ID NO: 130551

SEQ ID NO: 156274 - RNA, 64 nt, Human; identical to SEQ ID NO: 130552

SEQ ID NO: 156275 - RNA, 64 nt, Human; identical to SEQ ID NO: 130553

SEQ ID NO: 156276 - RNA, 64 nt, Human; identical to SEQ ID NO: 130554

SEQ ID NO: 156277 - RNA, 64 nt, Human; identical to SEQ ID NO: 130555

SEQ ID NO: 156278 - RNA, 64 nt, Human; identical to SEQ ID NO: 130556

SEQ ID NO: 156279 - RNA, 64 nt, Human; identical to SEQ ID NO: 130557

SEQ ID NO: 156280 - RNA, 64 nt, Human; identical to SEQ ID NO: 130558

SEQ ID NO: 156281 - RNA, 64 nt, Human; identical to SEQ ID NO: 130559

SEQ ID NO: 156282 - RNA, 64 nt, Human; identical to SEQ ID NO: 130560

SEQ ID NO: 156283 - RNA, 64 nt, Human; identical to SEQ ID NO: 130561

SEQ ID NO: 156284 - RNA, 64 nt, Human; identical to SEQ ID NO: 130562

SEQ ID NO: 156285 - RNA, 64 nt, Human; identical to SEQ ID NO: 130563

SEQ ID NO: 156286 - RNA, 64 nt, Human; identical to SEQ ID NO: 130564

SEQ ID NO: 156287 - RNA, 64 nt, Human; identical to SEQ ID NO: 130565

SEQ ID NO: 156288 - RNA, 64 nt, Human; identical to SEQ ID NO: 130566

SEQ ID NO: 156289 - RNA, 64 nt, Human; identical to SEQ ID NO: 130567

SEQ ID NO: 156290 - RNA, 64 nt, Human; identical to SEQ ID NO: 130568

SEQ ID NO: 156291 - RNA, 64 nt, Human; identical to SEQ ID NO: 130569

SEQ ID NO: 156292 - RNA, 64 nt, Human; identical to SEQ ID NO: 130570

SEQ ID NO: 156293 - RNA, 64 nt, Human; identical to SEQ ID NO: 130571

SEQ ID NO: 156294 - RNA, 64 nt, Human; identical to SEQ ID NO: 130572

SEQ ID NO: 156295 - RNA, 64 nt, Human; identical to SEQ ID NO: 130573

SEQ ID NO: 156296 - RNA, 64 nt, Human; identical to SEQ ID NO: 130574

SEQ ID NO: 156297 - RNA, 64 nt, Human; identical to SEQ ID NO: 130575

SEQ ID NO: 156298 - RNA, 64 nt, Human; identical to SEQ ID NO: 130576

SEQ ID NO: 156299 - RNA, 64 nt, Human; identical to SEQ ID NO: 130577

SEQ ID NO: 156300 - RNA, 64 nt, Human; identical to SEQ ID NO: 130578

SEQ ID NO: 156301 - RNA, 64 nt, Human; identical to SEQ ID NO: 130579

SEQ ID NO: 156302 - RNA, 64 nt, Human; identical to SEQ ID NO: 130580

SEQ ID NO: 156303 - RNA, 64 nt, Human; identical to SEQ ID NO: 130581

SEQ ID NO: 156304 - RNA, 64 nt, Human; identical to SEQ ID NO: 130582

SEQ ID NO: 156305 - RNA, 64 nt, Human; identical to SEQ ID NO: 130583

SEQ ID NO: 156306 - RNA, 64 nt, Human; identical to SEQ ID NO: 130584

SEQ ID NO: 156307 - RNA, 61 nt, Human; identical to SEQ ID NO: 130585

SEQ ID NO: 156308 - RNA, 64 nt, Human; identical to SEQ ID NO: 130586

SEQ ID NO: 156309 - RNA, 64 nt, Human; identical to SEQ ID NO: 130587

SEQ ID NO: 156310 - RNA, 64 nt, Human; identical to SEQ ID NO: 130588

SEQ ID NO: 156311 - RNA, 64 nt, Human; identical to SEQ ID NO: 130589

SEQ ID NO: 156312 - RNA, 64 nt, Human; identical to SEQ ID NO: 130590

SEQ ID NO: 156313 - RNA, 64 nt, Human; identical to SEQ ID NO: 130591

SEQ ID NO: 156314 - RNA, 64 nt, Human; identical to SEQ ID NO: 130592

SEQ ID NO: 156315 - RNA, 64 nt, Human; identical to SEQ ID NO: 130593

SEQ ID NO: 156316 - RNA, 64 nt, Human; identical to SEQ ID NO: 130594

SEQ ID NO: 156317 - RNA, 64 nt, Human; identical to SEQ ID NO: 130595

SEQ ID NO: 156318 - RNA, 64 nt, Human; identical to SEQ ID NO: 130596

SEQ ID NO: 156319 - RNA, 64 nt, Human; identical to SEQ ID NO: 130597

SEQ ID NO: 156320 - RNA, 64 nt, Human; identical to SEQ ID NO: 130598

SEQ ID NO: 156321 - RNA, 56 nt, Human; identical to SEQ ID NO: 130599

SEQ ID NO: 156322 - RNA, 64 nt, Human; identical to SEQ ID NO: 130600

SEQ ID NO: 156323 - RNA, 64 nt, Human; identical to SEQ ID NO: 130601

SEQ ID NO: 156324 - RNA, 64 nt, Human; identical to SEQ ID NO: 130602

SEQ ID NO: 156325 - RNA, 64 nt, Human; identical to SEQ ID NO: 130603

SEQ ID NO: 156326 - RNA, 64 nt, Human; identical to SEQ ID NO: 130604

SEQ ID NO: 156327 - RNA, 55 nt, Human; identical to SEQ ID NO: 130605

SEQ ID NO: 156328 - RNA, 64 nt, Human; identical to SEQ ID NO: 130606

SEQ ID NO: 156329 - RNA, 64 nt, Human; identical to SEQ ID NO: 130607

SEQ ID NO: 156330 - RNA, 64 nt, Human; identical to SEQ ID NO: 130608

SEQ ID NO: 156331 - RNA, 64 nt, Human; identical to SEQ ID NO: 130609

SEQ ID NO: 156332 - RNA, 64 nt, Human; identical to SEQ ID NO: 130610

SEQ ID NO: 156333 - RNA, 64 nt, Human; identical to SEQ ID NO: 130611

SEQ ID NO: 156334 - RNA, 64 nt, Human; identical to SEQ ID NO: 130612

SEQ ID NO: 156335 - RNA, 64 nt, Human; identical to SEQ ID NO: 130613

SEQ ID NO: 156336 - RNA, 64 nt, Human; identical to SEQ ID NO: 130614

SEQ ID NO: 156337 - RNA, 64 nt, Human; identical to SEQ ID NO: 130615

SEQ ID NO: 156338 - RNA, 64 nt, Human; identical to SEQ ID NO: 130616

SEQ ID NO: 156339 - RNA, 64 nt, Human; identical to SEQ ID NO: 130617

SEQ ID NO: 156340 - RNA, 64 nt, Human; identical to SEQ ID NO: 130618

SEQ ID NO: 156341 - RNA, 64 nt, Human; identical to SEQ ID NO: 130619

SEQ ID NO: 156342 - RNA, 64 nt, Human; identical to SEQ ID NO: 130620

SEQ ID NO: 156343 - RNA, 64 nt, Human; identical to SEQ ID NO: 130621

SEQ ID NO: 156344 - RNA, 64 nt, Human; identical to SEQ ID NO: 130622

SEQ ID NO: 156345 - RNA, 64 nt, Human; identical to SEQ ID NO: 130623

SEQ ID NO: 156346 - RNA, 64 nt, Human; identical to SEQ ID NO: 130624

SEQ ID NO: 156347 - RNA, 64 nt, Human; identical to SEQ ID NO: 130625

SEQ ID NO: 156348 - RNA, 64 nt, Human; identical to SEQ ID NO: 130626

SEQ ID NO: 156349 - RNA, 64 nt, Human; identical to SEQ ID NO: 130627

SEQ ID NO: 156350 - RNA, 64 nt, Human; identical to SEQ ID NO: 130628

SEQ ID NO: 156351 - RNA, 64 nt, Human; identical to SEQ ID NO: 130629

SEQ ID NO: 156352 - RNA, 64 nt, Human; identical to SEQ ID NO: 130630

SEQ ID NO: 156353 - RNA, 64 nt, Human; identical to SEQ ID NO: 130631

SEQ ID NO: 156354 - RNA, 64 nt, Human; identical to SEQ ID NO: 130632

SEQ ID NO: 156355 - RNA, 64 nt, Human; identical to SEQ ID NO: 130633

SEQ ID NO: 156356 - RNA, 64 nt, Human; identical to SEQ ID NO: 130634

SEQ ID NO: 156357 - RNA, 64 nt, Human; identical to SEQ ID NO: 130635

SEQ ID NO: 156358 - RNA, 64 nt, Human; identical to SEQ ID NO: 130636

SEQ ID NO: 156359 - RNA, 64 nt, Human; identical to SEQ ID NO: 130637

SEQ ID NO: 156360 - RNA, 64 nt, Human; identical to SEQ ID NO: 130638

SEQ ID NO: 156361 - RNA, 64 nt, Human; identical to SEQ ID NO: 130639

SEQ ID NO: 156362 - RNA, 64 nt, Human; identical to SEQ ID NO: 130640

SEQ ID NO: 156363 - RNA, 64 nt, Human; identical to SEQ ID NO: 130641

SEQ ID NO: 156364 - RNA, 64 nt, Human; identical to SEQ ID NO: 130642

SEQ ID NO: 156365 - RNA, 64 nt, Human; identical to SEQ ID NO: 130643

SEQ ID NO: 156366 - RNA, 64 nt, Human; identical to SEQ ID NO: 130644

SEQ ID NO: 156367 - RNA, 64 nt, Human; identical to SEQ ID NO: 130645

SEQ ID NO: 156368 - RNA, 64 nt, Human; identical to SEQ ID NO: 130646

SEQ ID NO: 156369 - RNA, 64 nt, Human; identical to SEQ ID NO: 130647

SEQ ID NO: 156370 - RNA, 64 nt, Human; identical to SEQ ID NO: 130648

SEQ ID NO: 156371 - RNA, 64 nt, Human; identical to SEQ ID NO: 130649

SEQ ID NO: 156372 - RNA, 64 nt, Human; identical to SEQ ID NO: 130650

SEQ ID NO: 156373 - RNA, 64 nt, Human; identical to SEQ ID NO: 130651

SEQ ID NO: 156374 - RNA, 64 nt, Human; identical to SEQ ID NO: 130652

SEQ ID NO: 156375 - RNA, 64 nt, Human; identical to SEQ ID NO: 130653

SEQ ID NO: 156376 - RNA, 64 nt, Human; identical to SEQ ID NO: 130654

SEQ ID NO: 156377 - RNA, 64 nt, Human; identical to SEQ ID NO: 130655

SEQ ID NO: 156378 - RNA, 64 nt, Human; identical to SEQ ID NO: 130656

SEQ ID NO: 156379 - RNA, 64 nt, Human; identical to SEQ ID NO: 130657

SEQ ID NO: 156380 - RNA, 64 nt, Human; identical to SEQ ID NO: 130658

SEQ ID NO: 156381 - RNA, 64 nt, Human; identical to SEQ ID NO: 130659

SEQ ID NO: 156382 - RNA, 64 nt, Human; identical to SEQ ID NO: 130660

SEQ ID NO: 156383 - RNA, 64 nt, Human; identical to SEQ ID NO: 130661

SEQ ID NO: 156384 - RNA, 64 nt, Human; identical to SEQ ID NO: 130662

SEQ ID NO: 156385 - RNA, 64 nt, Human; identical to SEQ ID NO: 130663

SEQ ID NO: 156386 - RNA, 64 nt, Human; identical to SEQ ID NO: 130664

SEQ ID NO: 156387 - RNA, 64 nt, Human; identical to SEQ ID NO: 130665

SEQ ID NO: 156388 - RNA, 64 nt, Human; identical to SEQ ID NO: 130666

SEQ ID NO: 156389 - RNA, 64 nt, Human; identical to SEQ ID NO: 130667

SEQ ID NO: 156390 - RNA, 64 nt, Human; identical to SEQ ID NO: 130668

SEQ ID NO: 156391 - RNA, 64 nt, Human; identical to SEQ ID NO: 130669

SEQ ID NO: 156392 - RNA, 64 nt, Human; identical to SEQ ID NO: 130670

SEQ ID NO: 156393 - RNA, 64 nt, Human; identical to SEQ ID NO: 130671

SEQ ID NO: 156394 - RNA, 64 nt, Human; identical to SEQ ID NO: 130672

SEQ ID NO: 156395 - RNA, 64 nt, Human
accugccgcaaggagcagagacagcacagccccccgggcccagccgccucccucucuugggacg

SEQ ID NO: 156396 - RNA, 64 nt, Human
gaagguggggaccuggggggagggacagggcaggcgggcccaugaagaaagccccucguugccc

SEQ ID NO: 156397 - RNA, 64 nt, Human
cuugggacaccggagaaccuaucaugucagccagcgggcccacacgucggaccccgguuggcca

SEQ ID NO: 156398 - RNA, 64 nt, Human
acaggaccaaagggugcagugaugggcuggguggcgggcccagggaaaugggguggggaugggc

SEQ ID NO: 156399 - RNA, 64 nt, Human
ggcgccugaggcuugcugucuguucucggcaccccgggcccauacaggaccagggcagcagcau

SEQ ID NO: 156400 - RNA, 64 nt, Human
cuggccuuuggugaccacugagaaggacacuucacgggcccagagcuccugguacugcccuucc

SEQ ID NO: 156401 - RNA, 64 nt, Human
cuccugccacuggugccucgaguagccauggcaacgggcccaguguccagucacuuagaaguuc

SEQ ID NO: 156402 - RNA, 64 nt, Human
acaccugaggccaccagaagacacuuccaucccucgggcccagcaguacacacuugguuuccag

SEQ ID NO: 156403 - RNA, 64 nt, Human
gccagggcuccuggacccaggcuuucccauaccacgggcccaggacuguggcuccuuuucuaaa

SEQ ID NO: 156404 - RNA, 64 nt, Human
ccugcccguguacauagugcauuguuucugugggcgggcccagcacuuuccgucaacguuguac

SEQ ID NO: 156405 - RNA, 64 nt, Human
ggcaaagucucgacucacugcagccuugaccucccgggcccagguaguccucccaccucagccu

SEQ ID NO: 156406 - RNA, 54 nt, Human; identical to SEQ ID NO: 153558

SEQ ID NO: 156407 - RNA, 64 nt, Human
cacucacagccacccugaagauagacuauaggaacgggcccauaccacacagacugcucuccaa

SEQ ID NO: 156408 - RNA, 64 nt, Human
cgcugcaguagcuguggccucacccugaagucagcgggcccaggccuaccucacucucucccuu

SEQ ID NO: 156409 - RNA, 64 nt, Human
ccucagcagcccuggcagaacugaagagcggcaccgggcccagcaggcaaagagagaggccucc

SEQ ID NO: 156410 - RNA, 64 nt, Human
gaggaacuuggggggauggcgaaugguuccugcccgggcccaaggggugcacagggcaccucca

SEQ ID NO: 156411 - RNA, 64 nt, Human
cuggcccucaccugccggcgcccacagucaggcccgggcccagcgcggccagugcuccuccugc

SEQ ID NO: 156412 - RNA, 64 nt, Human
ggaucagaggagacugaagcagaaacccugcacacgggcccaggauguggcugauuuugugguu

SEQ ID NO: 156413 - RNA, 64 nt, Human
ccacugcacuaagccagugcggagcuguuagggacgggcccagcuccugcaccacggacacaga

SEQ ID NO: 156414 - RNA, 64 nt, Human
ccgggacucaauuaaacccgcccggagaccacgccgggcccagcgcgucugccuucuugacuca

SEQ ID NO: 156415 - RNA, 64 nt, Human
cgcgccugcccaccgggcggggucgcugguuggccgggcccaggcgcgcggggacgcggaggcc

SEQ ID NO: 156416 - RNA, 64 nt, Human
ggaguguagacgcgccggcucgggcggcgggcuccgggcccagccucgcagcggccaggagcgc

SEQ ID NO: 156417 - RNA, 64 nt, Human
cccugcaucuggccugcugcuccccaguuccacacgggcccagugcugccccugcugcugcagg

SEQ ID NO: 156418 - RNA, 64 nt, Human
uguuucuuucccaaaaugugccucccuuccgcugcgggcccagcugagucuauguaggugaugu

SEQ ID NO: 156419 - RNA, 64 nt, Human
cuucccgcagggccuuggggcacugccuugccaucgggcccaguucuccgggccccaccugcac

SEQ ID NO: 156420 - RNA, 64 nt, Human
aaaauaaaaguaaacaagauagagcuugggcuugcgggcccaguuccagagguggaaguuacag

SEQ ID NO: 156421 - RNA, 64 nt, Human
agaggucccacuccucagccuacacgcagaggaacgggcccaccucagagucacaccacuggcu

SEQ ID NO: 156422 - RNA, 64 nt, Human
ugcgagcucaggaggccgccugaggacugcacaccgggcccacaccucuccugccccucccucc

SEQ ID NO: 156423 - RNA, 64 nt, Human
gauagugagugacugauugcuucauuuuaucaggcgggcccauugugaaagagcucaggggaaa

SEQ ID NO: 156424 - RNA, 64 nt, Human
gugggaaagguggggaagaaggggaucucccucccgggcccacccagcugcccagccuuugccc

SEQ ID NO: 156425 - RNA, 64 nt, Human
gcggaauucaaguuaccaauguaacacuggccagcgggcccagcaaucuccauguguacuuauu

SEQ ID NO: 156426 - RNA, 64 nt, Human
gagcuggccuagcaagaugugcucucagaauggccgggcccaagagaugaaggaaaggagugaa

SEQ ID NO: 156427 - RNA, 56 nt, Human; identical to SEQ ID NO: 153579

SEQ ID NO: 156428 - RNA, 64 nt, Human
ucugggcccagcucaugccucgcgguggccucuccgggcccagcucccacccagccugacggcg

SEQ ID NO: 156429 - RNA, 64 nt, Human
ccccgguccaguggcugccucccggccuccucuccgggcccagcucuuugcucgcgucugcgcc

SEQ ID NO: 156430 - RNA, 64 nt, Human
cagccaccacccugagauuaugcggcucuucccucgggcccagaugcagacggugccgaacgcu

SEQ ID NO: 156431 - RNA, 64 nt, Human
gagaaccuuggugcagcugcagccaggaggggagcgggcccaggagccaggcucagguccagcu

SEQ ID NO: 156432 - RNA, 64 nt, Human
auuucaguggcgauggcaugacagagcuagagcucgggcccagccccaggcugcagcccauucg

SEQ ID NO: 156433 - RNA, 64 nt, Human
ugccaugggaauuccuccaucugcagcggucacacgggcccacccugcccuuccccaggucggc

SEQ ID NO: 156434 - RNA, 64 nt, Human
cucugacuugggugagcuggaguugggggugucucgggcccaggcccuggcagagaaacaggga

SEQ ID NO: 156435 - RNA, 64 nt, Human
gagaagccccuuccccaugggaagacgaggcccucgggcccagcccccacagugcugucugauc

SEQ ID NO: 156436 - RNA, 64 nt, Human
cuucucugggucccggggugcauuuguuacucaucgggcccagggacauugcagaguggccuag

SEQ ID NO: 156437 - RNA, 64 nt, Human
cccgagcccacgaggcuguugaggccccugcagccgggcccagcucuucuguccuuggccacca

SEQ ID NO: 156438 - RNA, 64 nt, Human
cugcugccugguguguccucagcucccagggcugcgggcccaccguuuacaugugcacgcccug

SEQ ID NO: 156439 - RNA, 64 nt, Human
gagaggggucgugcggaggauccuguauugugcccgggcccauggggaggacgauggugaggag

SEQ ID NO: 156440 - RNA, 55 nt, Human; identical to SEQ ID NO: 153592

SEQ ID NO: 156441 - RNA, 64 nt, Human
ucccagccaccuucccagaccugcggccucaccgcgggcccagugcccaggcuggagcgcacac

SEQ ID NO: 156442 - RNA, 64 nt, Human
acugcugccuuugcugcugacuugcagugugacucgggcccauuguucaaucucuguggcccug

SEQ ID NO: 156443 - RNA, 64 nt, Human
aggcggggcagggcuguguggcaccgccagggagcgggcccaccugagucacuuuauuggguuc

SEQ ID NO: 156444 - RNA, 64 nt, Human
ugguugaaccuggaggugccaaaaaagccagcugcgggcccaggacagcugccgugagacuccc

SEQ ID NO: 156445 - RNA, 64 nt, Human
ucaucuagaaugacccugaaaugacugacagccccgggcccaagaaaaacccauaaccaccuca

SEQ ID NO: 156446 - RNA, 64 nt, Human
cagggaagagggcucacaagacacauuugucccccgggcccaccacaucauccucacguguucg

SEQ ID NO: 156447 - RNA, 64 nt, Human
uggcccuccagaggguaagccauguccggagucucgggcccaaggaacgauuuggagggugcuu

SEQ ID NO: 156448 - RNA, 64 nt, Human
cuuucaucuucuggcagcagaaauccaugaagcccgggcccaggaaaauuagaaguuuuccauu

SEQ ID NO: 156449 - RNA, 64 nt, Human
uacaauaugcucaggcaccgcagagagcugggcacgggcccaugugagcaucacuuuggaagua

SEQ ID NO: 156450 - RNA, 64 nt, Human
cucagcacgcuagcaccccaguugcguggccagccgggcccaggcaggagcagguggcccugug

SEQ ID NO: 156451 - RNA, 64 nt, Human
ucuugcaggguccccuuccccggcacccaugcgccgggcccagagcucccucugccugcgggau

SEQ ID NO: 156452 - RNA, 64 nt, Human
ucaccgccugcgggcagggggaggccagcaggcccgggcccagcaccccuucccuggcaccagg

SEQ ID NO: 156453 - RNA, 64 nt, Human
ggggcaggaaaagaacugagcaugucgcaggcagcgggcccagccugagcaauggcaggaugug

SEQ ID NO: 156454 - RNA, 64 nt, Human
uccuccaccgccauggcuuccaagguggucugcucgggcccaggccaucuuccaggugggguga

SEQ ID NO: 156455 - RNA, 64 nt, Human
aagcugccgaaccaaaagaauuugcaccccgcugcgggcccacgugguuggggcccugcccugg

SEQ ID NO: 156456 - RNA, 64 nt, Human
aggcgcaggagggacccggggccacaaggcgcugcgggcccaggugugcugggccccucucagg

SEQ ID NO: 156457 - RNA, 64 nt, Human
cucgggcgaaguggguucuugugccuuccccucccgggcccaggcuccccgugcgcgggcccug

SEQ ID NO: 156458 - RNA, 64 nt, Human
gcuggugaucaggaaagcccgcugccccaccccucgggcccacccguacagaggcugguggucg

SEQ ID NO: 156459 - RNA, 64 nt, Human
gccagggcuggaagcuuucauuugccgggacacucgggcccaugggauugcacagagcuggagg

SEQ ID NO: 156460 - RNA, 64 nt, Human
cucuaaaauccuaccuaaccaucccauggucacucgggcccaugccuuccucuccuucgcuguu

SEQ ID NO: 156461 - RNA, 50 nt, Human; identical to SEQ ID NO: 153613

SEQ ID NO: 156462 - RNA, 64 nt, Human
caggccuccggccucccagacuucuagagcccgccgggcccaucuuuguacucauccaccccag

SEQ ID NO: 156463 - RNA, 64 nt, Human
ccgccccgcaccaugcccuagccccaggucuagccgggcccauugcagggggcagcacuugggg

SEQ ID NO: 156464 - RNA, 64 nt, Human
cugcaagcgggagacacccacaccccauucugggcgggcccaguggaguuuggggaggggggcg

SEQ ID NO: 156465 - RNA, 64 nt, Human
aaugaugucacucaugguggacgcguucugcucacgggcccagagcccugugaaaugcaucaag

SEQ ID NO: 156466 - RNA, 64 nt, Human
cauuacaggaaaauuauugacagcaaugguuucccgggcccagaaacucuggaaagauuuuguc

SEQ ID NO: 156467 - RNA, 64 nt, Human
gccaucaggccucaagugggcaugggggcagggacgggcccaggaacuguuguuuucucaggau

SEQ ID NO: 156468 - RNA, 64 nt, Human
cauugucuucccaggcuugccccuggucagccugcgggcccaggcagcucggacaccaggcuga

SEQ ID NO: 156469 - RNA, 64 nt, Human
uggccacgcagccaggacaccgggcagggccgcccgggcccagaggagcugggagccgggccgc

SEQ ID NO: 156470 - RNA, 64 nt, Human
cagccacccuaaauuccagccaaccucaccuccucgggcccagcucaagcccccuuccuugcuc

SEQ ID NO: 156471 - RNA, 64 nt, Human
caagagggguggagacugcuucccauccuacccucgggcccaccuggccaccugaggugggccc

SEQ ID NO: 156472 - RNA, 64 nt, Human
ggacauccagaaccugcagaaggugaacaccauccgggcccaugacaacccggugugcacgcug

SEQ ID NO: 156473 - RNA, 64 nt, Human
auccuuuuuugccucugagguggguggugagagacgggcccagcuguccaaggccagacguccc

SEQ ID NO: 156474 - RNA, 64 nt, Human
uucucacccagagguuucacccuccuucaucucacgggcccagagcccugucucacucacccca

SEQ ID NO: 156475 - RNA, 64 nt, Human
uggcaucacagugacagugucauggggagcugggcgggcccagccaaacccuccuucuuccuag

SEQ ID NO: 156476 - RNA, 64 nt, Human
uccgcaggaggacugaggccaugugccauucucccgggcccagcgcccggccgucaccccaccc

SEQ ID NO: 156477 - RNA, 64 nt, Human
cagugggauugagggggcugggucccccaggacacgggcccagaagagccccacgggcuuccug

SEQ ID NO: 156478 - RNA, 64 nt, Human
gccccgggaccagggauggggcagcgcacaggcccgggcccagcacagaacugcccaucgggac

SEQ ID NO: 156479 - RNA, 64 nt, Human
cugaacucaccuggccugggaagcaccgucugcccgggcccaagcccugccccuccagagucca

SEQ ID NO: 156480 - RNA, 64 nt, Human
ggacuccugggacaugugggugguggcuugaccccgggcccaugggcagcuugcuguggggcag

SEQ ID NO: 156481 - RNA, 64 nt, Human
cgcggucgcucaggggccccggguuugagcagaacgggcccagugcccuggguugcagacucag

SEQ ID NO: 156482 - RNA, 64 nt, Human
gcucaugaguggaaagucaccuacaggacugggccgggcccagggccucuggcuucccugccca

SEQ ID NO: 156483 - RNA, 64 nt, Human
aucagccccugccucccaggccagaaccugagaacgggcccagggugcuguggagaucaacuuc

SEQ ID NO: 156484 - RNA, 54 nt, Human; identical to SEQ ID NO: 153636

SEQ ID NO: 156485 - RNA, 60 nt, Human; identical to SEQ ID NO: 153637

SEQ ID NO: 156486 - RNA, 64 nt, Human
gugagacaccacuacuacaagcacagucgggccgcgggcccauggacucugaguggcgacugcc

SEQ ID NO: 156487 - RNA, 55 nt, Human; identical to SEQ ID NO: 153639

SEQ ID NO: 156488 - RNA, 64 nt, Human
caugaggcccccccccccagcaauaucccaggggcgggcccaaugcccacuguacaugaggcug

SEQ ID NO: 156489 - RNA, 54 nt, Human; identical to SEQ ID NO: 153641

SEQ ID NO: 156490 - RNA, 64 nt, Human
acagcuaggcccucccaccggcucgcugcagagccgggcccagcgcgcccuguccccgugccag

SEQ ID NO: 156491 - RNA, 64 nt, Human
aaaaaagaaaauguaucguacaaguuaaaaugcacgggcccaagggggauuuuuuuuuucaccu

SEQ ID NO: 156492 - RNA, 64 nt, Human
ggaccuagggcgccugcccucugcuggcuaggaccgggcccagcccagcccuuccugaagccag

SEQ ID NO: 156493 - RNA, 64 nt, Human
gcugucuucagaugucagggucccugaacugcugcgggcccagucagugaugcuggcugaagcu

SEQ ID NO: 156494 - RNA, 64 nt, Human
ccaccgccacucacgucacucggggcucgguggacgggcccagggugggagcggccggcccacc

SEQ ID NO: 156495 - RNA, 64 nt, Human
cucguccaacuugugacccucgccgaccgccccgcgggcccaggcgggccgggggcggggccgu

SEQ ID NO: 156496 - RNA, 64 nt, Human
ucucugaaugcaugucacgcugcaccccaugcuccgggcccacacccugcaggacaaggagcuc

SEQ ID NO: 156497 - RNA, 64 nt, Human
agaccagggugcaggcuccgcccccacccaaggccgggcccagccagaggaggggcagggcagg

SEQ ID NO: 156498 - RNA, 64 nt, Human
ccugacagugacccucggcccccuuuugaguccucgggcccagaaucguaucccaaagcccucc

SEQ ID NO: 156499 - RNA, 64 nt, Human
acgcagguagccgaccugcaggagggccuacaaacgggcccagcaagagcugggcaacagcugg

SEQ ID NO: 156500 - RNA, 64 nt, Human
cccaccuccaacgccccgcccacgccgcggccaccgggcccacggccaccagaaugcaauugag

SEQ ID NO: 156501 - RNA, 64 nt, Human
aaaauuugcuauuuuuccuguaacaucugcugaacgggcccacccacacguuguauauucagag

SEQ ID NO: 156502 - RNA, 64 nt, Human
cccucagagccggcacgacccugcuguggggcggcgggcccagucguguuccugcagugggcac

SEQ ID NO: 156503 - RNA, 64 nt, Human
ggauggaaccucaggaugggccaaacccagacaacgggcccauggccuugggcucugauuggcu

SEQ ID NO: 156504 - RNA, 64 nt, Human
cacccucccuccaggguccucucuuccacaguggcgggcccacucagccccgagaccacccaac

SEQ ID NO: 156505 - RNA, 64 nt, Human
gucaccaucucuccauauguaucucccuguauuucgggcccauucccucuaugucaagaguaaa

SEQ ID NO: 156506 - RNA, 64 nt, Human
ccgacccugcugcagaaccagcaggguguccccucgggcccaucugugucccaugucccagcac

SEQ ID NO: 156507 - RNA, 64 nt, Human
ccuugggcucuggucccugcggggcaggcucucccgggcccacggggcggacgcugcauaccaa

SEQ ID NO: 156508 - RNA, 64 nt, Human
ugcggcugccgcuaacccggggcgggcagggacgcgggcccaacaauaaaugccgcguggucug

SEQ ID NO: 156509 - RNA, 64 nt, Human
ccugcccaugccuguccugcacggcucugcugcucgggcccacagcgccgucccaucacaagcc

SEQ ID NO: 156510 - RNA, 64 nt, Human
auguaaguaaucccagcacuuugggaggccgagacgggcccaugacaaggucaggagaucgaga

SEQ ID NO: 156511 - RNA, 58 nt, Human; identical to SEQ ID NO: 153663

SEQ ID NO: 156512 - RNA, 64 nt, Human
cccagaaacuugccccgaguuucucuggggcccucgggcccaacuucugcuuugcacuauguuc

SEQ ID NO: 156513 - RNA, 64 nt, Human
cccccacccuuccagucgggugugagggccugaccgggcccagggcaagcagaugucgcaagcc

SEQ ID NO: 156514 - RNA, 57 nt, Human; identical to SEQ ID NO: 153666

SEQ ID NO: 156515 - RNA, 64 nt, Human
ucagucaugugugcagagucagugcucgggaucccgggcccagcuuuugccuuuuuggggaugc

SEQ ID NO: 156516 - RNA, 64 nt, Human
cgggggcugucugcgccuuccacgccccccaggacgggcccagaggcugggggagccccgcggc

SEQ ID NO: 156517 - RNA, 64 nt, Human
caaagauugacccaguuacuugaggguagggaggcgggcccagugcaggaggcugcaucccugg

SEQ ID NO: 156518 - RNA, 64 nt, Human
cuugcaggaacaacaccuccuggacgagcucucucgggcccaggccuggagcgggccaagcaga

SEQ ID NO: 156519 - RNA, 64 nt, Human
agacagagauggaagccaggacaagggagcccaccgggcccagauagguacagagagcagaggc

SEQ ID NO: 156520 - RNA, 64 nt, Human
gugugacucuccuucacugagugauacccugcuccgggcccaugccccaaggagcccuucagag

SEQ ID NO: 156521 - RNA, 64 nt, Human
guccuucagggagcagagcagagcaggugguggacgggcccagugcuggguguuuucaccacca

SEQ ID NO: 156522 - RNA, 64 nt, Human
uaguccgucccaccccuucccuucccuggcgccccgggcccaggccccucagcugucagcuggu

SEQ ID NO: 156523 - RNA, 64 nt, Human
ccugcucagaaucugauaccaaagagacagggcccgggcccaggcagagagcgaccagcaggcu

SEQ ID NO: 156524 - RNA, 64 nt, Human
ugcagccagcguggcccuaggacaggaggagcuucgggcccagcuucacccugcgguggggcug

SEQ ID NO: 156525 - RNA, 64 nt, Human
agucggggacaggccagcggggggacggaggcggcgggcccaggagccucagccagccacgugg

SEQ ID NO: 156526 - RNA, 64 nt, Human
cuagccgcgugcggagccugcgcagagccccggccgggcccagcccucggagugcugccaagug

SEQ ID NO: 156527 - RNA, 64 nt, Human
uuaccaaacuguuuuuggaaauucacaccaaggucgggcccacugcaggcagcuggcacagcgu

SEQ ID NO: 156528 - RNA, 64 nt, Human
cagcacgguccucaaggauguacugcgcacugaccgggcccaccccuacuaugcggggccugag

SEQ ID NO: 156529 - RNA, 64 nt, Human
gggagggaugacaagcggcccccgccuccauacccgggcccagggaagcccgcggcagcggcag

SEQ ID NO: 156530 - RNA, 64 nt, Human
ggccacaccacggcaaguggcagcaggggccggcccugugcacaaggaugcacuccucucggcc

SEQ ID NO: 156531 - RNA, 64 nt, Human
uagaaacauccacguaucucaucagccaucuuguccugugcauccuaacagaggaaggauccau

SEQ ID NO: 156532 - RNA, 64 nt, Human
cgcaguugugaacagacccuguucacuggagaggccugugcaguagaguguagacccuuucaug

SEQ ID NO: 156533 - RNA, 64 nt, Human
uaaaucagccagccaggcacccacagccucagcuccugugcaguuccugggcagcacaguggaa

SEQ ID NO: 156534 - RNA, 64 nt, Human
cuggcugcaccacaccccuuccccuagaugacugccugugcagagacacaguuugcaccauuag

SEQ ID NO: 156535 - RNA, 64 nt, Human
gcguggacucugcacaugucuuguacauguguagccugugcauguaugucuuggacacuguaca

SEQ ID NO: 156536 - RNA, 64 nt, Human
uuuuuaaacuuuuuuuuuuuuuccuggaaaacauccugugcagaaaaggguauauaauuuuaga

SEQ ID NO: 156537 - RNA, 64 nt, Human
acggagauguuucacgaaguuuguucaucagacuccugugcaacuuucccaauguggccuaaaa

SEQ ID NO: 156538 - RNA, 64 nt, Human
aaaggcaagggcuggucuucaggauggaggccagccugugcagaaggcugcagcugacaacagc

SEQ ID NO: 156539 - RNA, 64 nt, Human
uccacucagggcugccacuaaccuguagaacaccccugugcaaauuuuaaaaaggaacccuuuu

SEQ ID NO: 156540 - RNA, 64 nt, Human
uggugacugaacgagggauaauucaaacugacaaccugugcagucccguggaggguaggggagu

SEQ ID NO: 156541 - RNA, 64 nt, Human
acaggcacaucuccuccuuugugguuccacuuccccugugcagaucgugggaugaaacgcaugg

SEQ ID NO: 156542 - RNA, 64 nt, Human
cagagggaccuuugauaggcuacgauacuauuuuccugugcaucacacuuaacucaucuaacug

SEQ ID NO: 156543 - RNA, 64 nt, Human
uuuaugaaacuuaaccauacagaaugauauaacuccugugcaaugaaggugauaacaguaaaag

SEQ ID NO: 156544 - RNA, 64 nt, Human
acuguaaaaaaauuucacagauuuuuuuccaauaccugugcaagauacauguguagcucaaaac

SEQ ID NO: 156545 - RNA, 64 nt, Human
ucuauggaaagugguaggauuuuuuuuuuuuaauccugugcaaaggaaaagaggugcuuugugg

SEQ ID NO: 156546 - RNA, 64 nt, Human
agugucggagaagagagcuugccgacgaugccuuccugugcagagcuugggcaucuccuuuacg

SEQ ID NO: 156547 - RNA, 64 nt, Human
cugcagccuuucacuucagugcccaccuggcugaccugugcacuuggcugaggaagcagagacc

SEQ ID NO: 156548 - RNA, 64 nt, Human
gggcaguggccccggugaccuuggggccuccgacccugugcagccugggacaaaacuguuuccg

SEQ ID NO: 156549 - RNA, 64 nt, Human
auuugccagcacaggggccccagaucugccugggccugugcagcagcccagcuuccugguguau

SEQ ID NO: 156550 - RNA, 64 nt, Human
uauggaaaguacccaagucuguguaucuccuguuccugugcaucuccuaugaauuuccuggcaa

SEQ ID NO: 156551 - RNA, 64 nt, Human
ggagaauaggaagggcauuccaggcagagggaaaccugugcagagaccaagagguguggaagga

SEQ ID NO: 156552 - RNA, 64 nt, Human
cacguuuuuugguaagaaaagagaauuagccagcccugugcauucaguguauauucucaccuuu

SEQ ID NO: 156553 - RNA, 64 nt, Human
aauaggucucuaaggaaaaccagcagaacauuagccugugcaaaaccaucuguuuggggagcac

SEQ ID NO: 156554 - RNA, 64 nt, Human
gcaguggagccugaaaaggcuccacauuaggucaccugugcacagccauggcuggaaugaugaa

SEQ ID NO: 156555 - RNA, 64 nt, Human
ugcaaccuuuccuucugcuaggguguacaccuagccugugcaggugucagcccugcuagggagu

SEQ ID NO: 156556 - RNA, 64 nt, Human
cuuuggccucucuguggagucuggcucucuggcuccugugcauucuuugaauagucacucguaa

SEQ ID NO: 156557 - RNA, 64 nt, Human
acugcagugugcugccaaaugggacagcacacagccugugcacaugggacaugugaugggucuc

SEQ ID NO: 156558 - RNA, 64 nt, Human
uucagggugcacuggaagcugguguucgcuguccccugugcacuucucgcacuggggcauggag

SEQ ID NO: 156559 - RNA, 64 nt, Human
aauggugacagguucucauguggcaccccuaggaccugugcagacaguagucuguugaaucauu

SEQ ID NO: 156560 - RNA, 64 nt, Human
acgaggacucucccuuggugacucuguccuucgcccugugcacccuggggaggagagcucuggg

SEQ ID NO: 156561 - RNA, 64 nt, Human
ggcuccaggccaugucuaaugaccagcucgauucccugugcaguucagagggcaagugaaccca

SEQ ID NO: 156562 - RNA, 64 nt, Human
ggacccuuggccuaggagccuaaggaccuucaccccugugcaccacccaagaaagaggaaaacu

SEQ ID NO: 156563 - RNA, 64 nt, Human
uguagaucagagcuccaaauuuuggauuaucgggccugugcaagauuguuaacuaaggcuggga

SEQ ID NO: 156564 - RNA, 64 nt, Human
gacaaaaaaauauuucaagaguugauaaagauuaccugugcagugcagagcacuuuaaugcaac

SEQ ID NO: 156565 - RNA, 64 nt, Human
aaaaccucuccucgugcuucaaaaugacaggaauccugugcauuauacuaagaauuacaugcca

SEQ ID NO: 156566 - RNA, 64 nt, Human
acuuuaauguacuucuaucacugcauuuauuuugccugugcauaggagcaauuaggaucuaaaa

SEQ ID NO: 156567 - RNA, 64 nt, Human
gugggggccgggugggagguggcaguagucuuagccugugcacucucuuccuuggguguuuggu

SEQ ID NO: 156568 - RNA, 64 nt, Human
ugacucuucucggagucucauauuuugugggacuccugugcaaacauauguuauuaaaauuuuu

SEQ ID NO: 156569 - RNA, 64 nt, Human
ugacccuucuuggagucucauauuucguggaacuccugugcaaacauauauuauuaaauuuuuu

SEQ ID NO: 156570 - RNA, 64 nt, Human
ugucagacugcccagcucagagugcccgucagggccugugcauccgcacgcggagccgucuguu

SEQ ID NO: 156571 - RNA, 64 nt, Human
uucugggcgcucccugagucagagucucagaagaccugugcaggcuggcgugagaggagcggca

SEQ ID NO: 156572 - RNA, 64 nt, Human
ccagcaaacauugaguaccaauuauuugcuagguccugugcaaggaauacaaaaaugauuaaga

SEQ ID NO: 156573 - RNA, 64 nt, Human
uaagaaaaguuaagacuauuauuuccuucccuucccugugcagcauucaaaaucaccccuagaa

SEQ ID NO: 156574 - RNA, 64 nt, Human
ugugccacagaccuuccuacuuggccuguaaucaccugugcagccuuuugugggccuucaaaac

SEQ ID NO: 156575 - RNA, 64 nt, Human
caccuguggcucacaccuucuguuccccuccuggccugugcagaauguaaacagcagacucaua

SEQ ID NO: 156576 - RNA, 64 nt, Human
uuuugcuuuagcacuuggccccauuguagauugcccugugcaguaaacuuucaaggugucggcu

SEQ ID NO: 156577 - RNA, 51 nt, Human
uuucggcgagauacgucuaacccugugcaacagccacuacauuacuucaaa

SEQ ID NO: 156578 - RNA, 64 nt, Human
uaaccuuaggugguaguguuacuugccuuugacaccugugcauauguuuuaaugacuagaucca

SEQ ID NO: 156579 - RNA, 64 nt, Human
ccugccuuuucuaugcgccucacuagcuuaccacccugugcagguaaugcaacugacuuugucu

SEQ ID NO: 156580 - RNA, 64 nt, Human
ggguagggagcgggaguccguguucucuuuuguuccugugcaaauaaugaaagagcucgguaaa

SEQ ID NO: 156581 - RNA, 64 nt, Human
ggaggaucacuugagcacaggaguuugagaccagccugugcaacaucaugaaacaucaucucua

SEQ ID NO: 156582 - RNA, 64 nt, Human
uuaucugcgguugauugaaucuauggauguggaaccugugcauauggagggucaacuguacuau

SEQ ID NO: 156583 - RNA, 64 nt, Human
uuucaagacauccagacgcuauuaccaacauuuuccugugcauuaaccucugcaugugaaaacu

SEQ ID NO: 156584 - RNA, 64 nt, Human
cccuucccaaguccauucccacuguaggccgaugccugugcaaaggacgcagugccauaucaga

SEQ ID NO: 156585 - RNA, 64 nt, Human
cacauaggggccugcugccugccgccccgcgggaccugugcaagcacauucaccaagugcaucg

SEQ ID NO: 156586 - RNA, 64 nt, Human
gcaauagguagcccuggccucugccugccucccgccugugcacucuggaaccucuggccucagg

SEQ ID NO: 156587 - RNA, 64 nt, Human
ccuggcuggcuccagcguccucgucccuccugggccugugcaccgguggguggggcgcccauag

SEQ ID NO: 156588 - RNA, 64 nt, Human
agcauggguggcagaugguagggaauugaacuggccugugcaaugggcauggagcacaaggggu

SEQ ID NO: 156589 - RNA, 64 nt, Human
gcccugaggcugcuggauccggucugccugccucccugugcaguccagcccugccuugcugcag

SEQ ID NO: 156590 - RNA, 64 nt, Human
aggaagcacaucguccuguuuuauugcuuucuacccugugcaauauuagcaugcaagcuuggcu

SEQ ID NO: 156591 - RNA, 64 nt, Human
uuuauagaucuuguauagaaaucuuuuaccagaaccugugcauuaagagaaagcaauguugccc

SEQ ID NO: 156592 - RNA, 64 nt, Human
ucccccagccacagccaucccaccaggagcagcgccugugcagaaugaacgaagucacauaggc

SEQ ID NO: 156593 - RNA, 64 nt, Human
cacucccacggcuggggacaauggccacuuacuaccugugcacuuugccacucgggacaccugg

SEQ ID NO: 156594 - RNA, 64 nt, Human
gucaucaccuuccaagaaaguuuccuucuguuguccugugcauuauaauauacaaaauaacuua

SEQ ID NO: 156595 - RNA, 64 nt, Human
acaugggaguggggagcggagcuuggcccugcgcccugugcagggaaagggauggucaggccca

SEQ ID NO: 156596 - RNA, 64 nt, Human
gagggcaaggggaggggaauggugagauccgagcccugugcauggacuuggugagacuguugcc

SEQ ID NO: 156597 - RNA, 64 nt, Human
cuugguuugggccaccagaggcugaaguguauuuccugugcauuccaaguguugccugcaugcc

SEQ ID NO: 156598 - RNA, 64 nt, Human
aacuugccagggaccccaccccucccucucugggccugugcagugagcauggggauucccauca

SEQ ID NO: 156599 - RNA, 64 nt, Human
aagagcucccugcaaguguaaauauuaaggaugaccugugcaaaauuauacccacaccagcacu

SEQ ID NO: 156600 - RNA, 64 nt, Human
cauaaugauuuguaaaugguguuauagcugaauaccugugcaugaaaaugggcaauauuuucau

SEQ ID NO: 156601 - RNA, 64 nt, Human
uugaaggaaguuugcagucuugcagcuuuuauucccugugcaacaaaagauuagaacauguuaa

SEQ ID NO: 156602 - RNA, 64 nt, Human
uuguucaggguaaaauuugaaacaaaaaauuuuaccugugcaaaauaguuuuuuaaaaauuaua

SEQ ID NO: 156603 - RNA, 64 nt, Human
uaacugugcuguugaugaaguccucccagggaagccugugcagaugcagucaccuggaaagaac

SEQ ID NO: 156604 - RNA, 64 nt, Human
cuucucgcacauccucacguggcccuuauggugcccugugcagggugccaccacagccucauuu

SEQ ID NO: 156605 - RNA, 64 nt, Human
uauagaggccuaauaagaaugccuuuuuauaaagccugugcauuuagguagguugaagcuagga

SEQ ID NO: 156606 - RNA, 64 nt, Human
cuucucaagucagaaaacuuuucaggaagguuucccugugcauuugcaccagaugaauguuuga

SEQ ID NO: 156607 - RNA, 64 nt, Human
cccccaugagccaggacgguccccccacagucagccugugcaaaggccccguggccaggggugg

SEQ ID NO: 156608 - RNA, 64 nt, Human
uccucacgcagacacacccacagaaggacacuagccugugcacgcgcgcgugcacacacacaca

SEQ ID NO: 156609 - RNA, 64 nt, Human
gagcccccaggcgagguucggccuuccucucgccccugugcacccggagaugcccacagcacca

SEQ ID NO: 156610 - RNA, 64 nt, Human
gauuuuaugcagacuggauguaauauuuguaaucccugugcaauuuugugacgugcgguucuaa

SEQ ID NO: 156611 - RNA, 64 nt, Human
uggggccccccggagccauggggugucgggggcuccugugcaggcucaugcugcaggcggccga

SEQ ID NO: 156612 - RNA, 64 nt, Human
ggcugggguggcccgccauccccuggaguaaaugccugugcaaagcccuccucauccuugucug

SEQ ID NO: 156613 - RNA, 64 nt, Human
ucagugcuuaagacaggauucuagucuucacuugccugugcagcugggcgcugaccuuccaggu

SEQ ID NO: 156614 - RNA, 64 nt, Human
cccacauggggccacguguuggcaguggaaucagccugugcaggcuggggaucucaggcugauc

SEQ ID NO: 156615 - RNA, 64 nt, Human
aauggauggccugccugccuucccuguccguucaccugugcaaaggcuuccucagacaugccac

SEQ ID NO: 156616 - RNA, 64 nt, Human
gacacccuugacaacugcacuccuacuguaggcuccugugcauacugucgucuucuguggggga

SEQ ID NO: 156617 - RNA, 64 nt, Human
gaaauacaguacuguuucuggacccuuauaaaauccugugcaauagacacauacaugucacauu

SEQ ID NO: 156618 - RNA, 64 nt, Human
accauaauaugcuguuuacauuuauuuucuucagccugugcaaaacaaagcaauggaaaaggaa

SEQ ID NO: 156619 - RNA, 64 nt, Human
ugacugcuuucuaugagcccacgccucaucuuccccugugcacauguuuaccugauacagcagu

SEQ ID NO: 156620 - RNA, 64 nt, Human
cuuuuucccauccugcccuaugguucucuagccaccugugcaugcauguguauuucugccuggu

SEQ ID NO: 156621 - RNA, 64 nt, Human
agcggaucggacgggacaggguggagcggggaggccugugcaaagugggaaagagcugccggug

SEQ ID NO: 156622 - RNA, 64 nt, Human
ugacugaucucugugguuugguuuagaaaauuccccugugcaugguauuaccuuuuucaagcuc

SEQ ID NO: 156623 - RNA, 64 nt, Human
cuccccaaacacaucaccacucccuagggcggggccugugcaugcucucccaugacaucuccau

SEQ ID NO: 156624 - RNA, 64 nt, Human
uuuuugguccaacucuugcuguccuuucuuaccaccugugcaccccacuuggagcagugggagg

SEQ ID NO: 156625 - RNA, 64 nt, Human
ugugccugccuaaauuuguucucaccaagcacugccugugcaugcagagaaaaucugugcaucc

SEQ ID NO: 156626 - RNA, 64 nt, Human
gcacauguguggggaagccggucacauggacacaccugugcacacaugccuacaggccagcucu

SEQ ID NO: 156627 - RNA, 64 nt, Human
aggggaugccgcgcuccagcaacaccaggucaggccugugcagaccccugcccugccgcugcag

SEQ ID NO: 156628 - RNA, 64 nt, Human
augccaaauuucccucucucgugagaugggggauccugugcaggcugaugaggcacccaugaga

SEQ ID NO: 156629 - RNA, 64 nt, Human
guaaacuaauacauugucuagcauugauuugguuccugugcauauguauuuucacuaugugcuc

SEQ ID NO: 156630 - RNA, 64 nt, Human
aaauugucauagugacaccagugguucgucagcuccugugcauucuccucuaagaacucaccuc

SEQ ID NO: 156631 - RNA, 64 nt, Human
aaucauucuuauggugcucuuggagaguuucaggccugugcauguguguacagcaggagguaau

SEQ ID NO: 156632 - RNA, 64 nt, Human
augggacuuuucccaugucuucugcuguaauuauccugugcagaacuaggaagaaauuuuuuuc

SEQ ID NO: 156633 - RNA, 64 nt, Human
ggagcugccugagugucccugaucgggucucccuccugugcacccucaggucccuccuuuuccu

SEQ ID NO: 156634 - RNA, 64 nt, Human
cuuuccagaauuauuuauuccauaggguuucucuccugugcagcucucucauggguaauggggc

SEQ ID NO: 156635 - RNA, 64 nt, Human
gcaaaaaggcaggguuauuuuuacccaugagcauccugugcaggcaauagacuucccucacugu

SEQ ID NO: 156636 - RNA, 64 nt, Human
gguuuuuguuuuuaaacuuuuuuuugccauccauccugugcaauaugccguguagaauauuugu

SEQ ID NO: 156637 - RNA, 64 nt, Human
ggcagcucugcuggagggcggugccaugccuaagccugugcacaugcauccagcugcuuaagau

SEQ ID NO: 156638 - RNA, 64 nt, Human
auuuuuguguaaaggucacccacgcagaagucuuccugugcagggugcuuugguagccaucaga

SEQ ID NO: 156639 - RNA, 64 nt, Human
ccauuacaauacugcuuucucagguucuuaacagccugugcaaacucccugacuagauggucug

SEQ ID NO: 156640 - RNA, 64 nt, Human
agcccacccagcaucagagaccuucucuuccuuuccugugcaccccacccuguaacagcaccaa

SEQ ID NO: 156641 - RNA, 64 nt, Human
ccucaacacagagccccucccgccgccucagaccccugugcacauccccagggccucagccguc

SEQ ID NO: 156642 - RNA, 64 nt, Human
uguccucucccccuucagcuccugaguagcugggccugugcacugggcagguuccuggggccgc

SEQ ID NO: 156643 - RNA, 64 nt, Human
gccuuuauguaaguuacuuaguuguuugcgugugccugugcaaguguguuugugugugguugug

SEQ ID NO: 156644 - RNA, 64 nt, Human
auuuagccagaauguuuccuguggaaauaugcaaccugugcaaaauaaaaugaguuaccucaug

SEQ ID NO: 156645 - RNA, 64 nt, Human
auucagacaagaccaaaguugcuugacuucaauuccugugcauuagugugaugauuucugucac

SEQ ID NO: 156646 - RNA, 64 nt, Human
aucugugguuuugaccagagcccagauggguaauccugugcauuuggguugggguucacucuua

SEQ ID NO: 156647 - RNA, 64 nt, Human
ugacucugcuuccugcacugacccagagccucugccugugcacugcaagcugugucuacucagg

SEQ ID NO: 156648 - RNA, 64 nt, Human
uuaauggugaugccucgcguacaggaucugguuaccugugcaguugugaauacccagagguugg

SEQ ID NO: 156649 - RNA, 64 nt, Human
ugacauguaaaagugcuuagaacaggaccuaggcccugugcaauggcucacaccuguaauucca

SEQ ID NO: 156650 - RNA, 64 nt, Human
aagagauccaggucuggagcuggagagaacaggcccugugcaggaccagaaguaauuauacuaa

SEQ ID NO: 156651 - RNA, 64 nt, Human
uucagcauuccaugcacuugcuuuaaaauuuaguccugugcauacugugguguuuuuacugugc

SEQ ID NO: 156652 - RNA, 64 nt, Human
auugacaacaugugcaaaaauaccaaauuuguguccugugcaguaugaagaauucagugaauau

SEQ ID NO: 156653 - RNA, 64 nt, Human
aacugaugccaacacuuccuuuugccuuuuguuuccugugcaaacaagugagucaccccuuuga

SEQ ID NO: 156654 - RNA, 64 nt, Human
ccugcugcacacaggggcccuuuccaugcaguguccugugcaugucuggguuucagugucgucu

SEQ ID NO: 156655 - RNA, 64 nt, Human
auuuaaacaagauuugcugcauuuccggcaaugcccugugcaugccauggucccuagacaccuc

SEQ ID NO: 156656 - RNA, 64 nt, Human
uccacgugcccaucucucugcagugcccuccucgccugugcagcccgcccacccacaggcucac

SEQ ID NO: 156657 - RNA, 64 nt, Human
guucccagcagacagccauggcucuucccagcagccugugcaaauucugaugauggccccaccc

SEQ ID NO: 156658 - RNA, 51 nt, Human
gcgaagacugcuccuggugagccugugcauagggaagcggcagcaucggau

SEQ ID NO: 156659 - RNA, 64 nt, Human
aucaacucuuuguuuuccucuccaucuacuuuucccugugcauaauauccauccaaaggacaac

SEQ ID NO: 156660 - RNA, 64 nt, Human
ccacaaccauggccagcaucggcuucuugcugcaccugugcauucuccaccccuccgccaaugg

SEQ ID NO: 156661 - RNA, 64 nt, Human
ugggcugacuacuuauuuguuaggcgggagcucuccugugcauuguaggauaauuagcaguauc

SEQ ID NO: 156662 - RNA, 64 nt, Human
agcuugguggagcgucugcaccuuggcugcgccgccugugcauuugccaguuuccucccacuga

SEQ ID NO: 156663 - RNA, 64 nt, Human
uuaguggccugagagguguuuguuguggggccacccugugcaugguagaauguucagcagcauu

SEQ ID NO: 156664 - RNA, 64 nt, Human
auuaacuaggaauuagcuguauaguuaaguuaugccugugcaaagaagaggcucaaaugcuguc

SEQ ID NO: 156665 - RNA, 64 nt, Human
cuguaauuauuauuauuuucuacaauaaaugggaccugugcacaggaggaaauuuuauugucuc

SEQ ID NO: 156666 - RNA, 64 nt, Human
auacaauggcauugcaaccagagaggugcccaucccugugcagcgcuaguaaaguugacucuug

SEQ ID NO: 156667 - RNA, 64 nt, Human
cgugaggcucucagacggggagcgaggcugguuuccugugcagcagguggaguucauuuccaac

SEQ ID NO: 156668 - RNA, 64 nt, Human
accccugugacacacaacuuacucauguaacaaaccugugcauguaccccuugaaccugaaaua

SEQ ID NO: 156669 - RNA, 64 nt, Human
cuugaaucugcacccucuggagggcaucuguacuccugugcaaaaugcccaguccagagacaaa

SEQ ID NO: 156670 - RNA, 64 nt, Human
augucuuuuugucauucuuuaacaaugaauuuccccugugcauaguuauuaauaguauugguau

SEQ ID NO: 156671 - RNA, 64 nt, Human
ucacagcguccccuucugcaauguaggucuccuuccugugcaguguaacauguaucccguugcc

SEQ ID NO: 156672 - RNA, 64 nt, Human
aggaguccacugccuccaugaugcaagccagcuuccugugcagaaggucuggucggcaaacucc

SEQ ID NO: 156673 - RNA, 64 nt, Human
guucccagcagacagccauggcucuucccagcagccugugcaaauucugaugaugaccccaccc

SEQ ID NO: 156674 - RNA, 64 nt, Human
auggacuuuagcagcaauggcaaauaccuggcuaccugugcagaugaucgcaccauccgcaucu

SEQ ID NO: 156675 - RNA, 64 nt, Human
uagaaaacguacacaaguguuugcuuccuggcucccugugcauuuuugucuuaguucagacuca

SEQ ID NO: 156676 - RNA, 64 nt, Human
agugagagagcaucucccccugguccaugccccuccugugcagaagggagccugcaucccuccc

SEQ ID NO: 156677 - RNA, 64 nt, Human
uccugcccccuccccccacuuccuuucuacccugccugugcacaguggguggguuggugugucu

SEQ ID NO: 156678 - RNA, 64 nt, Human
cuccuacuggggcucuccugaggcccccuucuagccugugcaaacccuguaugugcauuaaaaa

SEQ ID NO: 156679 - RNA, 64 nt, Human
gcagagugauucaggggcuccccgggggcagacaccugugcaccccaugaguagugcccacuug

SEQ ID NO: 156680 - RNA, 64 nt, Human
acuccacuuuucccuuaaaaaugaaugucuuguuccugugcauugguggcaucacagaccccag

SEQ ID NO: 156681 - RNA, 64 nt, Human
uuaccaauaaugcaauacaaaagaccucaaaauaccugugcauuucuuguaggaaaacaacaaa

SEQ ID NO: 156682 - RNA, 64 nt, Human
aggacuccggcuuucgccgagccgcagcgggaucccugugcacccggcgcagccuacccuuggu

SEQ ID NO: 156683 - RNA, 64 nt, Human
uggaaaggacauuuuugaagaucaacuauaucuuccugugcauuccgauggaauuucaguucau

SEQ ID NO: 156684 - RNA, 64 nt, Human
gcacugucaacacccacaggagagaauaaaauuaccugugcaaagguguauuguggugugugua

SEQ ID NO: 156685 - RNA, 64 nt, Human
gaguuuauuuaugcuucagaauacaguuguuugcccugugcaugaauauacccauauuugugug

SEQ ID NO: 156686 - RNA, 64 nt, Human
cccaccaguucuuggguuccccgcucuaguuugaccugugcagcacauuccagaagguuccagg

SEQ ID NO: 156687 - RNA, 64 nt, Human
ucugcugcuccuacuuagaaguugcaggcaauauccugugcacauccacgcccuccugugugcc

SEQ ID NO: 156688 - RNA, 64 nt, Human
acccagagccgacccucagcugccuucuaggacaccugugcagggucccagacccaggccccag

SEQ ID NO: 156689 - RNA, 64 nt, Human
agcugggagguccaggcucgcucagccccacagcccugugcacggccauuaaagcuucccacag

SEQ ID NO: 156690 - RNA, 64 nt, Human
uaggcuccaguaaggauuggaggcacuuuccagcccugugcaguguugcuaccagcaagaauga

SEQ ID NO: 156691 - RNA, 64 nt, Human
gcaguacugugagguaggcaccgugacucggcugccugugcagaagguggagguggcaggcgga

SEQ ID NO: 156692 - RNA, 64 nt, Human
ugcagugagcugagauugcaccauugcacuccagccugugcaacaagagugaaacuccauuuca

SEQ ID NO: 156693 - RNA, 64 nt, Human
cuggcuuugguaggggcacccaucacccggcuugccugugcagucagugagugcuuagggcaaa

SEQ ID NO: 156694 - RNA, 64 nt, Human
uuaguugcuaguuuguacugagaguugaccucucccugugcaguuuuuuguucuaaacuuguau

SEQ ID NO: 156695 - RNA, 64 nt, Human
ccacacagaccaggccuuaaaugucgguccaggcccugugcaccuuaccccagagacagacucu

SEQ ID NO: 156696 - RNA, 64 nt, Human
uugaccccuccugaacuggccacuccccagugcuccugugcagggauaggaagugccccagggu

SEQ ID NO: 156697 - RNA, 53 nt, Human
cuggaagcagccaaaacugaggcccugugcaugcugguggccucagggacccu

SEQ ID NO: 156698 - RNA, 64 nt, Human
aauacuugagaaauguacaaaucuuucauccauaccugugcaugagcuguauucuucacagcaa

SEQ ID NO: 156699 - RNA, 64 nt, Human
agacuuugccucucuccuaguccugaguauaaauccugugcauagauuccucuagaaaggcauc

SEQ ID NO: 156700 - RNA, 64 nt, Human
uccccucccucucuucuucccuccuuccccgcucccugugcagaagggcugacaucaaaccaaa

SEQ ID NO: 156701 - RNA, 64 nt, Human
agaaggaacccuccaguccugcucucuggccacaccugugcaggcagcugagaggcagcgugca

SEQ ID NO: 156702 - RNA, 64 nt, Human
gcuuuguccacgcaggucugauggagcugcguuuccugugcauggacucugcccucagggugcc

SEQ ID NO: 156703 - RNA, 64 nt, Human
ucgggugcuucccagcacaagcugcccuugcuguccugugcagugaagggagaggcccugggug

SEQ ID NO: 156704 - RNA, 64 nt, Human
aucuuuucaggaguguaaggaaacaucauguuuaccugugcaggcacuaguccuuuacagauga

SEQ ID NO: 156705 - RNA, 64 nt, Human
auguuuucagcagugugaagaagcuugguguauaccugugcaggcacuaguccuuuacagauga

SEQ ID NO: 156706 - RNA, 64 nt, Human
auguuuucaggaguguuaagaagcaucguguuuaccugugcaggcacuaguccuuuacagauga

SEQ ID NO: 156707 - RNA, 64 nt, Human
auguuuucagcaguguaaagaagugucguguauaccugugcaggcacuaguccuuuacagauga

SEQ ID NO: 156708 - RNA, 64 nt, Human
auguuuucaggaguguaaagaagcaucguguuuaccugugcaggcacuaguccuuuacagauga

SEQ ID NO: 156709 - RNA, 64 nt, Human
auguuuucagcaguguaaagaagcgucguguauaccugugcaggcacuaguacuuuacagauga

SEQ ID NO: 156710 - RNA, 64 nt, Human
ccuuguuacacauguucuuuuuuuauccgaucaaccugugcacuuuugauauuuugauauuaua

SEQ ID NO: 156711 - RNA, 64 nt, Human
gcucccacagugccuuuuaagggggaccucaccuccugugcacagcccacccacuuuccucugc

SEQ ID NO: 156712 - RNA, 64 nt, Human
uuccuuucccccccaaaugguugcguccuuugaaccugugcaauaugaggccaaauuuaaucuu

SEQ ID NO: 156713 - RNA, 64 nt, Human
ggcaggccgggucucccaucccgaggccagcguuccugugcagagccccauccacugguucuug

SEQ ID NO: 156714 - RNA, 64 nt, Human
aaucaacugcaacuuuuugauguuaauuuuuuucccugugcaauuauaaacuauaagcaaguua

SEQ ID NO: 156715 - RNA, 64 nt, Human
ugaaugcuucauuccagagggaccagagggccucccugugcaagggaucaagcaugucuggccu

SEQ ID NO: 156716 - RNA, 64 nt, Human
gaagccugcaggaguuaaaaagggcagggcaucuccugugcaugggugaagggagagccagcuc

SEQ ID NO: 156717 - RNA, 64 nt, Human
cuaagggaagaucacuguaguuuaguucuguugaccugugcaccuaccccuuggaaaugucugc

SEQ ID NO: 156718 - RNA, 64 nt, Human
agcaaacagccaaaacaaacauuccccacccggcccugugcauaugaagucuuucuucccccaa

SEQ ID NO: 156719 - RNA, 64 nt, Human
gauuuuuguuuuuaagacucauggacauuucauaccugugcaauacugaagaccucauucuguc

SEQ ID NO: 156720 - RNA, 64 nt, Human
cagcuuuguacacugaggacacuguagccaggaaccugugcaugccacccaccgccuggacagg

SEQ ID NO: 156721 - RNA, 64 nt, Human
acuaaggugcugcaggaccuggggccagggacauccugugcagaagcuccggcugccucuuugc

SEQ ID NO: 156722 - RNA, 64 nt, Human
cugugaccaaugucuugaugcaugcacuguucccccugugcagccgcugagcgaggagaugcuc

SEQ ID NO: 156723 - RNA, 64 nt, Human
gguaaauagacuuguuuuuucuaacccagcagaaccugugcauggaugagcugggagugcuggu

SEQ ID NO: 156724 - RNA, 64 nt, Human
ucuguggguguugggggcaagugggggcugaaguccugugcaggcugcgcuggccccaccugcc

SEQ ID NO: 156725 - RNA, 64 nt, Human
acagaggcugcugucaggaagagggaggaagaagccugugcagggggcuggcuggauguucucu

SEQ ID NO: 156726 - RNA, 64 nt, Human
cagugugagcucaucucaccagaugagaagaggcccugugcauuucuuuuguuuguuuguugcu

SEQ ID NO: 156727 - RNA, 64 nt, Human
ggaaggaucacuugaagccagaguuugagaccagccugugcaacacagcaagaccccgucucua

SEQ ID NO: 156728 - RNA, 64 nt, Human
gaggagagaaagggaggcgugccugagaagguagccugugcaucuggugagugugucacgagcu

SEQ ID NO: 156729 - RNA, 64 nt, Human
gcaucugauaaccucugagauuuccaggccuaucccugugcagguacagcugcagggaagccca

SEQ ID NO: 156730 - RNA, 64 nt, Human
ggccugggacccagagccaagaaagcugagauauccugugcaccauagggacuucaccaaugga

SEQ ID NO: 156731 - RNA, 64 nt, Human
ucagacacagacaacaaggguuuuuagcuuuaagccugugcauguggacaauacucugagaaca

SEQ ID NO: 156732 - RNA, 64 nt, Human
gcccggccuugcccucaagguuuuuugcuuuucuccugugcaccuggcgaggcugaaggcgagg

SEQ ID NO: 156733 - RNA, 64 nt, Human
cucccuggggcuggggccucuuucucuggccuccccugugcaccugggggguccuggccccugu

SEQ ID NO: 156734 - RNA, 64 nt, Human
gugccuucuaggaaguuaggagguugaggcacagccugugcagagagggugggucaccccccca

SEQ ID NO: 156735 - RNA, 64 nt, Human
uuaauaaagaaggaacaucaggcaugcuaccaggccugugcagucccucagugccagugguguc

SEQ ID NO: 156736 - RNA, 64 nt, Human
ggagaaggcaaaucugugaggccggggcccugcaccugugcagcgaagcuuagcguucauccgu

SEQ ID NO: 156737 - RNA, 64 nt, Human
uuuuggccggaguguucuuuguggugagggcuuuccugugcauuguaagauguucagcaguauc

SEQ ID NO: 156738 - RNA, 64 nt, Human
ucagauuccccaccuuacccgggcccuacaggagccugugcagauggccaugcccaaccaauaa

SEQ ID NO: 156739 - RNA, 64 nt, Human
acgccaagucucuugguuguaccaugugacacacccugugcacuggucgcugucuucguggcuu

SEQ ID NO: 156740 - RNA, 64 nt, Human
ccggccagggagcgagcccagaacggaccggacgccugugcacccccagcccugccccuuggcc

SEQ ID NO: 156741 - RNA, 64 nt, Human
cuaugcccggucccggaccgacauccuggagccgccugugcagccugaugcccccucguggcug

SEQ ID NO: 156742 - RNA, 64 nt, Human
ggcuccugugagucuggggggcaccucuuucuggccugugcaccucucucuggcuuauaaaggu

SEQ ID NO: 156743 - RNA, 64 nt, Human
aaggacauucggcuguaggagcagaacacuucagccugugcagguuuauauugggaagcuguag

SEQ ID NO: 156744 - RNA, 64 nt, Human
cuuuucaaagcccacauaugguagcacaggcuggccugugcaucggcaauucucauaucuguuu

SEQ ID NO: 156745 - RNA, 64 nt, Human
ccaucaccuuuggugggggcagggccugguggcaccugugcaauaaugucuguguuucucuccc

SEQ ID NO: 156746 - RNA, 64 nt, Human
augucagccagccaccaugguuccuaccaagagcccugugcagcccguggugguugaaggaggc

SEQ ID NO: 156747 - RNA, 64 nt, Human
cauccuuauaaaagcuuaugccagcugaaauuagccugugcaaccacuaacauguggaagcauu

SEQ ID NO: 156748 - RNA, 64 nt, Human
uuuuuuacuuuugucagaaucaaggcuucggccaccugugcaauauuuucccauggaaugcagc

SEQ ID NO: 156749 - RNA, 64 nt, Human
caccggagcuguuuaccacgugaguccauaacuaccugugcacaagaaaugauggcacaucacg

SEQ ID NO: 156750 - RNA, 64 nt, Human
guauuuguuuuuguugucuuguugagaaauauccccugugcaacccacccuugguugaggauca

SEQ ID NO: 156751 - RNA, 64 nt, Human
uuccagcuugccugcccuuccucaucucucccugccugugcagaccuccacccuucuuuccucc

SEQ ID NO: 156752 - RNA, 64 nt, Human
ccugggaaggcaaguggccagugcugccacugagccugugcaggguacuugggagaaaggcccu

SEQ ID NO: 156753 - RNA, 64 nt, Human
aaacaaaaaggaagaggaaagaaugaggaaggacccugugcaagguuauuugcaggcagggaug

SEQ ID NO: 156754 - RNA, 64 nt, Human
uugaaaguggccuguuggguggaggguggaagguccugugcaggacagggaggccaccaaaggg

SEQ ID NO: 156755 - RNA, 64 nt, Human
auuagugaggagcgacacacacaccuguaggcauccugugcaaacacuuugucauuaucaagag

SEQ ID NO: 156756 - RNA, 64 nt, Human
aggcacagauccuaggaagucuguuccuguccucccugugcaggguauccuguagggugaccug

SEQ ID NO: 156757 - RNA, 64 nt, Human
ugcaggagagaaugcccagugaccagucacugacccugugcagaaccuccuggaagcgagcuuu

SEQ ID NO: 156758 - RNA, 64 nt, Human
uuugucaucaggaauacucuuugucuacugugguccugugcacguuggccucagauggacuaca

SEQ ID NO: 156759 - RNA, 64 nt, Human
gccaggcacccccagggaaggcucugguggagaaccugugcaugaaggccgucaaccaguccau

SEQ ID NO: 156760 - RNA, 64 nt, Human
agcaguagauccaggaugcaaaauccucccaauuccugugcaugugcucuuauuguaaggugcc

SEQ ID NO: 156761 - RNA, 64 nt, Human
ccaccuucccucugcugcuggggacccuccaacaccugugcaggccccauggcaccaucuaucu

SEQ ID NO: 156762 - RNA, 64 nt, Human
ggacucagugcuggcagauggcaguggaagcugcccugugcaacugugcuggcugccuccugaa

SEQ ID NO: 156763 - RNA, 64 nt, Human
uuccacucccaccccacacaacgcagacggugcgccugugcagcccucccagguggaguacacg

SEQ ID NO: 156764 - RNA, 64 nt, Human
ggagcaucuccacgaaacggggcaccacaggaucccugugcaagggcugggggcacgcucuggc

SEQ ID NO: 156765 - RNA, 64 nt, Human
gcugcaaaugucugaagccaguuaguuugauuacccugugcaaaaccuuggacauacuucugcu

SEQ ID NO: 156766 - RNA, 64 nt, Human
cccaguccuagaaauccuggguagaagugguggaccugugcaaaggagguuuuagaacucugca

SEQ ID NO: 156767 - RNA, 64 nt, Human
guugcauuugaauugugauagauuucuuuggcuaccugugcauaauguaguuuguaguaucaau

SEQ ID NO: 156768 - RNA, 64 nt, Human
guuuggaugguaaaggaaguugagagucuuuagaccugugcacagccccgcaccaaggggugcu

SEQ ID NO: 156769 - RNA, 64 nt, Human
gaagaagacuuggccuuuucucugccugcaugucccugugcagaggaaggcugucucucaaggg

SEQ ID NO: 156770 - RNA, 64 nt, Human
ggccucuaacacuuccaacuccagccaccacuuuccugugcauuuucacuccugagaagugcuc

SEQ ID NO: 156771 - RNA, 64 nt, Human
augcugugggcacaaaagaaggggcaccagagucccugugcaaacaccuagacucacuucaugg

SEQ ID NO: 156772 - RNA, 64 nt, Human
accgcccccacucccugccgugcuacacccagauccugugcaggcugccgggccccuucugcuu

SEQ ID NO: 156773 - RNA, 64 nt, Human
ccguccucagagccuuucuggaacaaggagaaugccugugcagguggacacacaggccuggccu

SEQ ID NO: 156774 - RNA, 64 nt, Human
aaagccuuaacuaagacucccgccccgggcuggcccugugcagaccuuacucaggggauguuua

SEQ ID NO: 156775 - RNA, 64 nt, Human
ggccucggaaaacaauggagugagcacaagaugcccugugcagcugcccgagggucuccgccca

SEQ ID NO: 156776 - RNA, 64 nt, Human
aguuaccagagguuaaaaauggguuuuguuguuuccugugcauucucaaacucauuuauuagau

SEQ ID NO: 156777 - RNA, 64 nt, Human
ugaauuucucauucuguauagaccagcaaacuucccugugcaaggcaaguuuacaucacaaauc

SEQ ID NO: 156778 - RNA, 64 nt, Human
uuuuaaguuaauagauuuuuucagacuugucaagccugugcaaaaaaauuaaaauggaugccuu

SEQ ID NO: 156779 - RNA, 64 nt, Human
cacacaauugauucaagcauuauacaggaacaccccugugcagcuacguuuacgucgucauuua

SEQ ID NO: 156780 - RNA, 64 nt, Human
guuaacaaaacuggagcaucugaauuacauccaaccugugcaugugauguuagguagaugugaa

SEQ ID NO: 156781 - RNA, 64 nt, Human
agguucugagggcucauccugggccaggggcccuccugugcacuguuagcuauggccacgggag

SEQ ID NO: 156782 - RNA, 64 nt, Human
ccugacgcacugccuccugcaccuucagcacaucccugugcacagcuggaagggugcauggccc

SEQ ID NO: 156783 - RNA, 64 nt, Human
cauuggcaucugcagggauauugaacccacucauccugugcagaggaugagaggaagguguuag

SEQ ID NO: 156784 - RNA, 64 nt, Human
uacccguagugcccagcauccagaccuuugugccccugugcacauuuggaagcuaaaauguaca

SEQ ID NO: 156785 - RNA, 64 nt, Human
aucuucaacacuaugugaaggguucacaucuuaaccugugcaauucagauugauacucagaaua

SEQ ID NO: 156786 - RNA, 64 nt, Human
aucugagugacuuaguguuggcaaggucccgggaccugugcagacuucuucugggcuuacccag

SEQ ID NO: 156787 - RNA, 64 nt, Human
gcuggaugccugggucucugggcacagccuggccccugugcaccgaguggccauggcaugugug

SEQ ID NO: 156788 - RNA, 64 nt, Human
ccuugaggucccccauacugaaaacugaccaaggccugugcacagguagccccucaugcugggc

SEQ ID NO: 156789 - RNA, 64 nt, Human
cgccacauagaucccgugcaggagccacauggguccugugcaggaccccuagcaguggugggcu

SEQ ID NO: 156790 - RNA, 64 nt, Human
agcugcacuucaaguucgacacgacgcccuggauccugugcaagggggacuggagccgccucca

SEQ ID NO: 156791 - RNA, 64 nt, Human
aaauguuccaaaagccauaagccugaagauuggcccugugcacgcacgcacacacacacacaca

SEQ ID NO: 156792 - RNA, 64 nt, Human
gcagguuggggguccuggggccagcaaugugguuccugugcacugagcccaccagccacagugc

SEQ ID NO: 156793 - RNA, 64 nt, Human
ccuccucccucaucuguucccugaugucacauucccugugcaaucuucccuugcccauggucug

SEQ ID NO: 156794 - RNA, 64 nt, Human
ugccuccuagaauaaagacuacauuucccagucuccugugcagguaugacuguguucuggacaa

SEQ ID NO: 156795 - RNA, 64 nt, Human
guuuuguuuugugggucauagggagcacauuucaccugugcaggaaaagaguuuucugccgucu

SEQ ID NO: 156796 - RNA, 64 nt, Human
gggcaugcucuggaacccagcaggaucacagcugccugugcacgucuucccuucucucccugcu

SEQ ID NO: 156797 - RNA, 64 nt, Human
acugaaaccugacuuucccccuguaccuucagccccugugcagguaguaaccucuugagaccuc

SEQ ID NO: 156798 - RNA, 64 nt, Human
aggcuucuuuuaaauuccaaagaagucauggaggccugugcauuugaauuguauaugcuaguga

SEQ ID NO: 156799 - RNA, 64 nt, Human
ugugccuggcaguaugguuuccucuuccucugugccugugcagcauucaucccagcuggccuug

SEQ ID NO: 156800 - RNA, 64 nt, Human
aaugcaagggggacacaugaaaggcaucagucccccugugcauaguacgaccuuuacugucgua

SEQ ID NO: 156801 - RNA, 64 nt, Human
gcacugaauaaagcacgugcaaggacucccggagccugugcagccuugguggcaaauaucucau

SEQ ID NO: 156802 - RNA, 64 nt, Human
cagagacuguuugaaucuugucucacuaguuuuuccugugcaaaaauaaaauggacagaauugc

SEQ ID NO: 156803 - RNA, 64 nt, Human
uggauaaauauguguugguacagaauggggguauccugugcauuguaggaucuuuagcaguacc

SEQ ID NO: 156804 - RNA, 64 nt, Human
cacuaucuuuagagccaauaaagagaauuaaaaaccugugcaccaggagcaucuuuuaaauaca

SEQ ID NO: 156805 - RNA, 64 nt, Human
ggcggucgucaggccugugcugagagccgcagccccugugcacaccuaacacagggcgcucccc

SEQ ID NO: 156806 - RNA, 64 nt, Human
cugcaagaucuccuagcggggaugggcggggccgccugugcagaugccaggagggcucgagcug

SEQ ID NO: 156807 - RNA, 64 nt, Human
gggcuagggagugccggaugaaaccagcucugucccugugcaggcuccaggcucccgccugaca

SEQ ID NO: 156808 - RNA, 64 nt, Human
gauaaugcccaugguacuccaugcauucaccugcccugugcaugucuggacucacggagcucac

SEQ ID NO: 156809 - RNA, 64 nt, Human
ggaauuuuuucacuuagccuuucugguuucccuuccugugcauugcccauuuucucauggaguu

SEQ ID NO: 156810 - RNA, 64 nt, Human
ccuagcuccacacccucucccaggacccaucacgccugugcaguggcccccacagaaagacuga

SEQ ID NO: 156811 - RNA, 64 nt, Human
aaaaccuugccaagcuguacacaguugcugauacccugugcaacagcucucauuuccuggcaag

SEQ ID NO: 156812 - RNA, 64 nt, Human
ucuaagaggggccgugguaauagauugcaucugcccugugcaugcgcauguuuaaccacaggcc

SEQ ID NO: 156813 - RNA, 64 nt, Human
auuagcaacacuaaaacuugaucauuaacagcccccugugcauaugaguggaucaaaccgguuc

SEQ ID NO: 156814 - RNA, 64 nt, Human
ggcccuccagcaaggcagcaccugcucugaugcaccugugcaccccuggcccucccagccaccu

SEQ ID NO: 156815 - RNA, 64 nt, Human
gggcuggcccugcuaggcuggagaagcccugucaccugugcacaucuugcugguggaggcaugg

SEQ ID NO: 156816 - RNA, 64 nt, Human
ugcacaggcacuguccccugccugcguccuggggccugugcacuguugcguccaugcucagagu

SEQ ID NO: 156817 - RNA, 64 nt, Human
cagggugcacuccuugucagucuugcccguugucccugugcauuuugcuuuccgcugucaaauc

SEQ ID NO: 156818 - RNA, 64 nt, Human
ucgccugcauuaucccauucuuauucuccucaaaccugugcauauaugacaugaaaugauaucc

SEQ ID NO: 156819 - RNA, 64 nt, Human
gcugugaucaugaauuuggggguguacuguccugccugugcaucuucucgcacugagauuuuga

SEQ ID NO: 156820 - RNA, 64 nt, Human
gcuucuugucucugggucuccagaguuugccccgccugugcacaccucacauuccagacucuag

SEQ ID NO: 156821 - RNA, 64 nt, Human
gauaauauuuuucuaauaaaugcggcugcaaccuccugugcauuuaauuaaauaggccaaauuu

SEQ ID NO: 156822 - RNA, 64 nt, Human
uguggacuagugcauauuucagacaacugcucugccugugcaaugaaaaauagccuuuaagggu

SEQ ID NO: 156823 - RNA, 64 nt, Human
uacuaugcagccauaaaaaagaaugggaucauguccugugcagcaacguggauggagcuggaag

SEQ ID NO: 156824 - RNA, 64 nt, Human
cagcuccgggguggacugaacagcggcggcugucccugugcauccuuugauuacucucaugcug

SEQ ID NO: 156825 - RNA, 64 nt, Human
ugacccaccuccugcugagaaccuuccccuaggcccugugcagaaggcuacugccccuuaggcc

SEQ ID NO: 156826 - RNA, 64 nt, Human
uguguguccuugugcaugagcuacgccugccuccccugugcaguccugggauguggcugcagca

SEQ ID NO: 156827 - RNA, 64 nt, Human
cccccccugaaucccuggcuuagcuaccuuccugccugugcaccuaaaaaccucaggucagaac

SEQ ID NO: 156828 - RNA, 64 nt, Human
gccaguuuccagaagggcuggggugagauccugaccugugcagagaguggggaggcgucagcgc

SEQ ID NO: 156829 - RNA, 64 nt, Human
ggaacugccagccccucucuuucaccuguuccauccugugcagcugacacacagcuaaggagcc

SEQ ID NO: 156830 - RNA, 64 nt, Human
ucugccaaagacucgugggggccaucacaccugcccugugcagcggagccggaccaggcucuug

SEQ ID NO: 156831 - RNA, 64 nt, Human
uuuugucuugaaaguggcaccagaggugcuucugccugugcagcgggugcugcugguaacagug

SEQ ID NO: 156832 - RNA, 64 nt, Human
cauagguaccuuuccacugccuccucccugcucuccugugcaggaaugucucugagcuguucac

SEQ ID NO: 156833 - RNA, 64 nt, Human
ggcccgucugccuggugggggugcuguccuccccccugugcacacgugagcaucgugcaugugg

SEQ ID NO: 156834 - RNA, 64 nt, Human
ccgccuuugggagcacaccugcuuugccuugcugccugugcaaauguuggacaagcagacacac

SEQ ID NO: 156835 - RNA, 64 nt, Human
uuugccagaagcucagggugcauaguaggagagaccugugcaaaucugagcuccggcuccgacc

SEQ ID NO: 156836 - RNA, 64 nt, Human
guguuagaacauguguuccauuuggaguuuugggccugugcacggucaaccccaauuaccaauu

SEQ ID NO: 156837 - RNA, 64 nt, Human
cggcucagucuuuauuuccaacacuagccgugguccugugcagucaagcucucagcuaguguuu

SEQ ID NO: 156838 - RNA, 64 nt, Human
caggacagucccucucuguggagaacugaauggcccugugcagagccauagucccacugugggu

SEQ ID NO: 156839 - RNA, 64 nt, Human
ccuccaccuaccacucacaugacacccgugagcgccugugcacacacacacacaugcacacaca

SEQ ID NO: 156840 - RNA, 64 nt, Human
aggccagcaagcuggggccuguccgccacggugcccugugcaccuuugggcugcccuggccccc

SEQ ID NO: 156841 - RNA, 55 nt, Human
cuguggacauggagaucuagaugggccugugcagcuucgggggguccugcugggg

SEQ ID NO: 156842 - RNA, 64 nt, Human
ccagcccagccccacuccucugcugaccugcugaccugugcacaccccacucccacaugggccc

SEQ ID NO: 156843 - RNA, 64 nt, Human
ucugaugaggcaugcuggcgacuggauggauaauccugugcaucaccauuguguccugugcucc

SEQ ID NO: 156844 - RNA, 61 nt, Human
aggacgcagaaaggauguaggggagagacugccugugcaccuaaccaacaccuccaggggc

SEQ ID NO: 156845 - RNA, 64 nt, Human
cugugcccugcacuguccccacagccuuccacacccugugcauaggcagcccucucacgucuug

SEQ ID NO: 156846 - RNA, 64 nt, Human
ugcugagucacccacccagccuuggagcuggaugccugugcagcagaacagaggcaacgguggc

SEQ ID NO: 156847 - RNA, 64 nt, Human
acugagaaggcaggccuccgucuucccagcgguuccugugcagaugcugcugaagagaggugcc

SEQ ID NO: 156848 - RNA, 64 nt, Human
gagugcuuucaaacugcaugagcagcugaauguuccugugcagaaauuaacagcaggaaucacg

SEQ ID NO: 156849 - RNA, 64 nt, Human
uuggcaggccuuccucgauccucagccaaaggaaccugugcaagacacuggcucagcaguuccc

SEQ ID NO: 156850 - RNA, 64 nt, Human
aggguuaaagggaggugacagggugaagagggauccugugcaggggccaccugggagauagcag

SEQ ID NO: 156851 - RNA, 64 nt, Human
acucccuggggcuggaccacaacucagcccuucaccugugcaccugugacuuauucuuuacagg

SEQ ID NO: 156852 - RNA, 63 nt, Human
cccuccacaaugagcugugaccaucccaggaggccugugcacacaucccaggcaugucccaga

SEQ ID NO: 156853 - RNA, 64 nt, Human
aguugauucaaacaagaucucugggagucuccagccugugcagaaggggcaggacugcagugca

SEQ ID NO: 156854 - RNA, 64 nt, Human
gguccacgguacuugaagaagccagagcccacauccugugcacugcugaaggacccuacgcucg

SEQ ID NO: 156855 - RNA, 64 nt, Human
ggggucuguggguaaaaucagcccuucucccaggccugugcacacacccccucagcacucccua

SEQ ID NO: 156856 - RNA, 64 nt, Human
cauagcugcuugcagcaacuugauuuccccaaguccugugcaauagccccaggauuggauuccu

SEQ ID NO: 156857 - RNA, 64 nt, Human
cugcgggcccagucagugaugcuggcugaagcugccugugcacguuucuucucuggucgccuca

SEQ ID NO: 156858 - RNA, 64 nt, Human
cgcccacucuucauuccuguuucuccucaguuccccugugcagaugggcugugaaauuaaauug

SEQ ID NO: 156859 - RNA, 64 nt, Human
aacagcagggaggucauguacuuuuuguacaacaccugugcacuaugagaaaaugguaccuuuu

SEQ ID NO: 156860 - RNA, 64 nt, Human
ucagcgagacaaagugcauguuuuuaucgaguacccugugcaccacauuauaucuggcaauucu

SEQ ID NO: 156861 - RNA, 64 nt, Human
gcuacacugcucgagguacgguaugucccaucgcccugugcaccguagagaccucagucaucuc

SEQ ID NO: 156862 - RNA, 60 nt, Human
aauccuguacaucuaaguaaugggggaaaaccugugcaaauuaauucacauacaugguuc

SEQ ID NO: 156863 - RNA, 64 nt, Human
gccaucgcccggcggucagugggcuucagaugggccugugcauccuggccaagcgucacccuca

SEQ ID NO: 156864 - RNA, 64 nt, Human
cugucuggguggggcgcggaccccucacugugcgccugugcagggggugcuggugcacguggca

SEQ ID NO: 156865 - RNA, 64 nt, Human
gcugggaggaggcccaggcucucugguggccgccccugugcaccuggccaggggaagcccgggg

SEQ ID NO: 156866 - RNA, 64 nt, Human
ugcugcaaggaacacuuccacgccccgugaggccccugugcagggaggagcugccuguucacug

SEQ ID NO: 156867 - RNA, 64 nt, Human
gccaucagaaccaacuugaugagagcucugcugcccugugcagugacuggucucauccaggacu

SEQ ID NO: 156868 - RNA, 64 nt, Human
cugagaaaagacucgggauggguguggggucuggccugugcaaggggagugguccuaaaacccc

SEQ ID NO: 156869 - RNA, 64 nt, Human
uaggguggaaugggcuuugcagggaagagggcccccugugcacgcauuccacagccugucgguc

SEQ ID NO: 156870 - RNA, 64 nt, Human
uccucucccuccaggagcccccagcauguccugaccugugcacggggauggggggacaacuccu

SEQ ID NO: 156871 - RNA, 64 nt, Human
uccuccccaacugugggggugugcccccuucaagccugugcaaugcauuagggaugccuccuuu

SEQ ID NO: 156872 - RNA, 64 nt, Human
ugcugugagccaagaucgcaccauugcacuccagccugugcaacaagcgaaacuccgucucaaa

SEQ ID NO: 156873 - RNA, 64 nt, Human
ccagugccacaggguacgcacacgcagagccccgccugugcacacgcgugucuucgugcacucc

SEQ ID NO: 156874 - RNA, 64 nt, Human
uggggagacacuggggggccuuuggcugucacucccugugcauggucugaccccaggccccuuc

SEQ ID NO: 156875 - RNA, 64 nt, Human
ggaacuggguuccaguccagcugugcugugugagccugugcaagugacaugaccucucuaaacc

SEQ ID NO: 156876 - RNA, 64 nt, Human
cccuggcuuccaggcagcucugaaauacgucccaccugugcagcuaugugacucccucccacac

SEQ ID NO: 156877 - RNA, 64 nt, Human
uaucuagagccuggguccccucuguccucauuucccugugcauauucagggacaugccucguca

SEQ ID NO: 156878 - RNA, 64 nt, Human
caaucaucaacuaccauucuauuccauguuugcaccugugcauuuucuguuugcccccauucac

SEQ ID NO: 156879 - RNA, 64 nt, Human
ugacugaugagcgagguuagaaguggaagaaauuccugugcauguucuauaaucugacacccug

SEQ ID NO: 156880 - RNA, 64 nt, Human
gcccgcuucccuucacauuagaaaacaagaucagccugugcaacauggugaaaccucaucucua

SEQ ID NO: 156881 - RNA, 64 nt, Human
ccuuaagugacaaguagcaacauggcuuggguccccugugcagcaucagcuuaugcugccacaa

SEQ ID NO: 156882 - RNA, 64 nt, Human
acuccaagcucuuuucuggagauaaucuccagucccugugcagacacugucauugcacuuucug

SEQ ID NO: 156883 - RNA, 64 nt, Human
ucucuacuucuauuucaacuuugaauuuccucuuccugugcaaauuccucuagucaagugugau

SEQ ID NO: 156884 - RNA, 64 nt, Human
uggggacccugagcccagcucugaccagguagagccugugcagccugggcugcugucauugccc

SEQ ID NO: 156885 - RNA, 64 nt, Human
cucccagcccugggcggccguaucaucaggugcuccugugcaucucggccagcacgggagccag

SEQ ID NO: 156886 - RNA, 64 nt, Human
cugauuauucucgaugcccagagaugcucaugcaccugugcacacucacauccacccauacaca

SEQ ID NO: 156887 - RNA, 64 nt, Human
cuuacuaaugugccccauguccaaguccaaccugccugugcaugaccugaucauuacauggcug

SEQ ID NO: 156888 - RNA, 64 nt, Human
ccugccugccuggugcccugucccagccccagguccugugcagggcaccugcguggcugacagc

SEQ ID NO: 156889 - RNA, 64 nt, Human
ucaacauccacuagaaauauccauguuguguagaccugugcauacaacaugcuaacuggaaaag

SEQ ID NO: 156890 - RNA, 64 nt, Human
cccucaaugugccaggcucuuccucccaugacacccugugcaccagcugcacuggcuucccccu

SEQ ID NO: 156891 - RNA, 64 nt, Human
cgggcuggagcggagcguccgugagcgcuuccucccugugcacugauccuggcccccucuuauu

SEQ ID NO: 156892 - RNA, 64 nt, Human
cugccaccuggaggacuugccuguuccgacuccaccugugcagccggggccaccccaggagaaa

SEQ ID NO: 156893 - RNA, 64 nt, Human
cuucacguauuuaugcauguggcaagcguuacuuccugugcacguagccagcccugggucuguc

SEQ ID NO: 156894 - RNA, 64 nt, Human
uccuaacauuauauucccaaaucucaaaagaucuccugugcaccugacuuuggagacgaugcuu

SEQ ID NO: 156895 - RNA, 64 nt, Human
ggagaacaaaaggaaacacagaacaugcaaaaggccugugcauucuagaccagccaauuggugg

SEQ ID NO: 156896 - RNA, 64 nt, Human
acacauggugcuccuuuaccgugacauuuucucaccugugcacagugagccgguagcuuccuuu

SEQ ID NO: 156897 - RNA, 64 nt, Human
aauccucggggggugaacagccauuccuucgugaccugugcacgccuucugcaacccuggagcu

SEQ ID NO: 156898 - RNA, 64 nt, Human
ggggccgugcucucagggcgugugcgggacgccaccugugcacaccugcucagagcacggcucc

SEQ ID NO: 156899 - RNA, 64 nt, Human
gaaauacugucacuagugguagugacuugcuuuuccugugcacacauguagcccaucaggacag

SEQ ID NO: 156900 - RNA, 64 nt, Human
ccugggacccuuggccaucaggcgaggggcugggccugugcagcugggcccuuggccagagucc

SEQ ID NO: 156901 - RNA, 64 nt, Human
gcccagcugggucaggcagggugcaguaucaugcccugugcaaccucuuggccugaucagacca

SEQ ID NO: 156902 - RNA, 64 nt, Human
gggcccucugaggcucagcccugagcuggcgucaccugugcagggcccucuggggcucagcccu

SEQ ID NO: 156903 - RNA, 64 nt, Human
ugauuaccugcugcaugaaaagugcaugggggacccugugcaucugugcauuuggcaaaauguc

SEQ ID NO: 156904 - RNA, 64 nt, Human
ugagacccuacccuaugggguauaugggcuuuuaccugugcaccagugugacaggaaagauuca

SEQ ID NO: 156905 - RNA, 64 nt, Human
aggcagcgggaaugccuuucugcagagccggacaccugugcacucgcuccguaccuggaccugc

SEQ ID NO: 156906 - RNA, 64 nt, Human
agggcuugagguuggugagguuaggugcguguuuccugugcaagucaggacaucagucugauua

SEQ ID NO: 156907 - RNA, 64 nt, Human
gugcucaaaggcuggcccuggugguggacuggcaccugugcagagugccgugugcuuguggugc

SEQ ID NO: 156908 - RNA, 64 nt, Human
ucugcugcacauagcagacuagaauucugggaacccugugcaauucagucugcucucccuugug

SEQ ID NO: 156909 - RNA, 64 nt, Human
cccaaaauccgucaguauucacuggaccucaggcccugugcaggagugcgauccgggcugggcc

SEQ ID NO: 156910 - RNA, 64 nt, Human
ucuucuggaaggucacucaggaacacccucccugccugugcaaagagaaaacaagcgccuuguu

SEQ ID NO: 156911 - RNA, 64 nt, Human
gcccagcuccuccugaucauacucugguaccuggccugugcaucggccuccugcuucaugucaa

SEQ ID NO: 156912 - RNA, 64 nt, Human
uggaacaggaacucgccugacccugcugccaccuccugugcacuuugagcaaugcccccuggga

SEQ ID NO: 156913 - RNA, 64 nt, Human
ccccaucccuggcucugagucucugucuuccuguccugugcaggcgcccuuggaucucaguuuc

SEQ ID NO: 156914 - RNA, 64 nt, Human
gggccuucagaggauuuuaugcuggaaauaugacccugugcagacugcugggggaggcaggagg

SEQ ID NO: 156915 - RNA, 64 nt, Human
uugguuuuaugaaaagcuaggaagcaaccuuucgccugugcagcgguccagcacuuaacucuaa

SEQ ID NO: 156916 - RNA, 64 nt, Human
ggcugcaggguguccucccacagucccgcuguuuccugugcauucgugacccgcuucccuccca

SEQ ID NO: 156917 - RNA, 64 nt, Human
ccaccuccccagagcccugcagucacgugaggccccugugcaguagagagccuuucuccagccc

SEQ ID NO: 156918 - RNA, 64 nt, Human
gugcugucccaugucacuugaacugauagaggggccugugcaaucuccuaaggccuguguuucu

SEQ ID NO: 156919 - RNA, 64 nt, Human
ucucggugggcuucuccugcaugggaguuguguuccugugcaagggggagcuuugcuccaggac

SEQ ID NO: 156920 - RNA, 64 nt, Human
gccucuguagcucaaggggggcagcccccagaguccugugcauucugccaaggcuccauagcuu

SEQ ID NO: 156921 - RNA, 64 nt, Human
gaggacagagacccagagugaccccugccccaccccugugcauuuccacggacuggagagaugu

SEQ ID NO: 156922 - RNA, 64 nt, Human
cuccccaacacagugaagaccccagccaccucuaccugugcacuccaaccccuucacacccacc

SEQ ID NO: 156923 - RNA, 64 nt, Human
gccaggugccacccucgccucacagccccggcccccugugcagggccguaguaccucccagcag

SEQ ID NO: 156924 - RNA, 64 nt, Human
gagaccccaccucuggcagagccacauuaccuacccugugcaugguccuggggcagcaaggaag

SEQ ID NO: 156925 - RNA, 64 nt, Human
cugcugagagcucugcccuccccucaucaccuggccugugcagaaacgcucaugcacaccuggc

SEQ ID NO: 156926 - RNA, 64 nt, Human
acuucccaugccucuauguuacccaucugugucuccugugcagaaggagaggaaggggcauuaa

SEQ ID NO: 156927 - RNA, 64 nt, Human
uuuuuuucauuaaaagaugucccagaggaaaggcccugugcagccaguauauucuaaugacugc

SEQ ID NO: 156928 - RNA, 64 nt, Human
uuccagacuggcugugccugccugugcccagcaaccugugcagccggcagugugccugguguca

SEQ ID NO: 156929 - RNA, 64 nt, Human
ugggaucagcagaggcuuaagaugggauacauggccugugcagugaggggaccuggguccuuug

SEQ ID NO: 156930 - RNA, 64 nt, Human
acaauuacccagagauauauuuauuaacagccaaccugugcaaccugcuggagcuuuauuuuua

SEQ ID NO: 156931 - RNA, 64 nt, Human
ucagcaauauuuaguacuuuccugccuuuuaguuccugugcacagccccuaagucaacuuagca

SEQ ID NO: 156932 - RNA, 64 nt, Human
gccaaguuggggggagcuggugccuggagugggcccugugcaccucaccuggcggaggcugggg

SEQ ID NO: 156933 - RNA, 64 nt, Human
gaaggggcagggcugggccagugcaucuaacagcccugugcagcagcuucccuugccucgugua

SEQ ID NO: 156934 - RNA, 64 nt, Human
uccagcagacgcccacccaccgcuagccguuguuccugugcaaaguagugugcuaugcacccac

SEQ ID NO: 156935 - RNA, 64 nt, Human
cagaguuuuuauucgucuugugauugcugacauaccugugcacucauguguauaccccugcaug

SEQ ID NO: 156936 - RNA, 64 nt, Human
gaauugagugugugcuguuuuguauaguuacuauccugugcagcagcuggagaaagcacucacc

SEQ ID NO: 156937 - RNA, 64 nt, Human
aaaguggacauagcauguacaggcaguuuucuguccugugcacaaaaaguuuaaaaaaguuguu

SEQ ID NO: 156938 - RNA, 64 nt, Human
ccuguccagcaagugcagggugccugcacuucacccugugcagagaggugggauggggccgugc

SEQ ID NO: 156939 - RNA, 64 nt, Human
aggggcaaggagccccgcggcggccugggcagcgccugugcagaccucccugcaggccgcacug

SEQ ID NO: 156940 - RNA, 64 nt, Human; identical to SEQ ID NO: 156395

SEQ ID NO: 156941 - RNA, 64 nt, Human; identical to SEQ ID NO: 156396

SEQ ID NO: 156942 - RNA, 64 nt, Human; identical to SEQ ID NO: 156397

SEQ ID NO: 156943 - RNA, 64 nt, Human; identical to SEQ ID NO: 156398

SEQ ID NO: 156944 - RNA, 64 nt, Human; identical to SEQ ID NO: 156399

SEQ ID NO: 156945 - RNA, 64 nt, Human; identical to SEQ ID NO: 156400

SEQ ID NO: 156946 - RNA, 64 nt, Human; identical to SEQ ID NO: 156401

SEQ ID NO: 156947 - RNA, 64 nt, Human; identical to SEQ ID NO: 156402

SEQ ID NO: 156948 - RNA, 64 nt, Human; identical to SEQ ID NO: 156403

SEQ ID NO: 156949 - RNA, 64 nt, Human; identical to SEQ ID NO: 156404

SEQ ID NO: 156950 - RNA, 64 nt, Human; identical to SEQ ID NO: 156405

SEQ ID NO: 156951 - RNA, 54 nt, Human; identical to SEQ ID NO: 153558

SEQ ID NO: 156952 - RNA, 64 nt, Human; identical to SEQ ID NO: 156407

SEQ ID NO: 156953 - RNA, 64 nt, Human; identical to SEQ ID NO: 156408

SEQ ID NO: 156954 - RNA, 64 nt, Human; identical to SEQ ID NO: 156409

SEQ ID NO: 156955 - RNA, 64 nt, Human; identical to SEQ ID NO: 156410

SEQ ID NO: 156956 - RNA, 64 nt, Human; identical to SEQ ID NO: 156411

SEQ ID NO: 156957 - RNA, 64 nt, Human; identical to SEQ ID NO: 156412

SEQ ID NO: 156958 - RNA, 64 nt, Human; identical to SEQ ID NO: 156413

SEQ ID NO: 156959 - RNA, 64 nt, Human; identical to SEQ ID NO: 156414

SEQ ID NO: 156960 - RNA, 64 nt, Human; identical to SEQ ID NO: 156415

SEQ ID NO: 156961 - RNA, 64 nt, Human; identical to SEQ ID NO: 156416

SEQ ID NO: 156962 - RNA, 64 nt, Human; identical to SEQ ID NO: 156417

SEQ ID NO: 156963 - RNA, 64 nt, Human; identical to SEQ ID NO: 156418

SEQ ID NO: 156964 - RNA, 64 nt, Human; identical to SEQ ID NO: 156419

SEQ ID NO: 156965 - RNA, 64 nt, Human; identical to SEQ ID NO: 156420

SEQ ID NO: 156966 - RNA, 64 nt, Human; identical to SEQ ID NO: 156421

SEQ ID NO: 156967 - RNA, 64 nt, Human; identical to SEQ ID NO: 156422

SEQ ID NO: 156968 - RNA, 64 nt, Human; identical to SEQ ID NO: 156423

SEQ ID NO: 156969 - RNA, 64 nt, Human; identical to SEQ ID NO: 156424

SEQ ID NO: 156970 - RNA, 64 nt, Human; identical to SEQ ID NO: 156425

SEQ ID NO: 156971 - RNA, 64 nt, Human; identical to SEQ ID NO: 156426

SEQ ID NO: 156972 - RNA, 56 nt, Human; identical to SEQ ID NO: 153579

SEQ ID NO: 156973 - RNA, 64 nt, Human; identical to SEQ ID NO: 156428

SEQ ID NO: 156974 - RNA, 64 nt, Human; identical to SEQ ID NO: 156429

SEQ ID NO: 156975 - RNA, 64 nt, Human; identical to SEQ ID NO: 156430

SEQ ID NO: 156976 - RNA, 64 nt, Human; identical to SEQ ID NO: 156431

SEQ ID NO: 156977 - RNA, 64 nt, Human; identical to SEQ ID NO: 156432

SEQ ID NO: 156978 - RNA, 64 nt, Human; identical to SEQ ID NO: 156433

SEQ ID NO: 156979 - RNA, 64 nt, Human; identical to SEQ ID NO: 156434

SEQ ID NO: 156980 - RNA, 64 nt, Human; identical to SEQ ID NO: 156435

SEQ ID NO: 156981 - RNA, 64 nt, Human; identical to SEQ ID NO: 156436

SEQ ID NO: 156982 - RNA, 64 nt, Human; identical to SEQ ID NO: 156437

SEQ ID NO: 156983 - RNA, 64 nt, Human; identical to SEQ ID NO: 156438

SEQ ID NO: 156984 - RNA, 64 nt, Human; identical to SEQ ID NO: 156439

SEQ ID NO: 156985 - RNA, 55 nt, Human; identical to SEQ ID NO: 153592

SEQ ID NO: 156986 - RNA, 64 nt, Human; identical to SEQ ID NO: 156441

SEQ ID NO: 156987 - RNA, 64 nt, Human; identical to SEQ ID NO: 156442

SEQ ID NO: 156988 - RNA, 64 nt, Human; identical to SEQ ID NO: 156443

SEQ ID NO: 156989 - RNA, 64 nt, Human; identical to SEQ ID NO: 156444

SEQ ID NO: 156990 - RNA, 64 nt, Human; identical to SEQ ID NO: 156445

SEQ ID NO: 156991 - RNA, 64 nt, Human; identical to SEQ ID NO: 156446

SEQ ID NO: 156992 - RNA, 64 nt, Human; identical to SEQ ID NO: 156447

SEQ ID NO: 156993 - RNA, 64 nt, Human; identical to SEQ ID NO: 156448

SEQ ID NO: 156994 - RNA, 64 nt, Human; identical to SEQ ID NO: 156449

SEQ ID NO: 156995 - RNA, 64 nt, Human; identical to SEQ ID NO: 156450

SEQ ID NO: 156996 - RNA, 64 nt, Human; identical to SEQ ID NO: 156451

SEQ ID NO: 156997 - RNA, 64 nt, Human; identical to SEQ ID NO: 156452

SEQ ID NO: 156998 - RNA, 64 nt, Human; identical to SEQ ID NO: 156453

SEQ ID NO: 156999 - RNA, 64 nt, Human; identical to SEQ ID NO: 156454

SEQ ID NO: 157000 - RNA, 64 nt, Human; identical to SEQ ID NO: 156455

SEQ ID NO: 157001 - RNA, 64 nt, Human; identical to SEQ ID NO: 156456

SEQ ID NO: 157002 - RNA, 64 nt, Human; identical to SEQ ID NO: 156457

SEQ ID NO: 157003 - RNA, 64 nt, Human; identical to SEQ ID NO: 156458

SEQ ID NO: 157004 - RNA, 64 nt, Human; identical to SEQ ID NO: 156459

SEQ ID NO: 157005 - RNA, 64 nt, Human; identical to SEQ ID NO: 156460

SEQ ID NO: 157006 - RNA, 50 nt, Human; identical to SEQ ID NO: 153613

SEQ ID NO: 157007 - RNA, 64 nt, Human; identical to SEQ ID NO: 156462

SEQ ID NO: 157008 - RNA, 64 nt, Human; identical to SEQ ID NO: 156463

SEQ ID NO: 157009 - RNA, 64 nt, Human; identical to SEQ ID NO: 156464

SEQ ID NO: 157010 - RNA, 64 nt, Human; identical to SEQ ID NO: 156465

SEQ ID NO: 157011 - RNA, 64 nt, Human; identical to SEQ ID NO: 156466

SEQ ID NO: 157012 - RNA, 64 nt, Human; identical to SEQ ID NO: 156467

SEQ ID NO: 157013 - RNA, 64 nt, Human; identical to SEQ ID NO: 156468

SEQ ID NO: 157014 - RNA, 64 nt, Human; identical to SEQ ID NO: 156469

SEQ ID NO: 157015 - RNA, 64 nt, Human; identical to SEQ ID NO: 156470

SEQ ID NO: 157016 - RNA, 64 nt, Human; identical to SEQ ID NO: 156471

SEQ ID NO: 157017 - RNA, 64 nt, Human; identical to SEQ ID NO: 156472

SEQ ID NO: 157018 - RNA, 64 nt, Human; identical to SEQ ID NO: 156473

SEQ ID NO: 157019 - RNA, 64 nt, Human; identical to SEQ ID NO: 156474

SEQ ID NO: 157020 - RNA, 64 nt, Human; identical to SEQ ID NO: 156475

SEQ ID NO: 157021 - RNA, 64 nt, Human; identical to SEQ ID NO: 156476

SEQ ID NO: 157022 - RNA, 64 nt, Human; identical to SEQ ID NO: 156477

SEQ ID NO: 157023 - RNA, 64 nt, Human; identical to SEQ ID NO: 156478

SEQ ID NO: 157024 - RNA, 64 nt, Human; identical to SEQ ID NO: 156479

SEQ ID NO: 157025 - RNA, 64 nt, Human; identical to SEQ ID NO: 156480

SEQ ID NO: 157026 - RNA, 64 nt, Human; identical to SEQ ID NO: 156481

SEQ ID NO: 157027 - RNA, 64 nt, Human; identical to SEQ ID NO: 156482

SEQ ID NO: 157028 - RNA, 64 nt, Human; identical to SEQ ID NO: 156483

SEQ ID NO: 157029 - RNA, 54 nt, Human; identical to SEQ ID NO: 153636

SEQ ID NO: 157030 - RNA, 60 nt, Human; identical to SEQ ID NO: 153637

SEQ ID NO: 157031 - RNA, 64 nt, Human; identical to SEQ ID NO: 156486

SEQ ID NO: 157032 - RNA, 55 nt, Human; identical to SEQ ID NO: 153639

SEQ ID NO: 157033 - RNA, 64 nt, Human; identical to SEQ ID NO: 156488

SEQ ID NO: 157034 - RNA, 54 nt, Human; identical to SEQ ID NO: 153641

SEQ ID NO: 157035 - RNA, 64 nt, Human; identical to SEQ ID NO: 156490

SEQ ID NO: 157036 - RNA, 64 nt, Human; identical to SEQ ID NO: 156491

SEQ ID NO: 157037 - RNA, 64 nt, Human; identical to SEQ ID NO: 156492

SEQ ID NO: 157038 - RNA, 64 nt, Human; identical to SEQ ID NO: 156493

SEQ ID NO: 157039 - RNA, 64 nt, Human; identical to SEQ ID NO: 156494

SEQ ID NO: 157040 - RNA, 64 nt, Human; identical to SEQ ID NO: 156495

SEQ ID NO: 157041 - RNA, 64 nt, Human; identical to SEQ ID NO: 156496

SEQ ID NO: 157042 - RNA, 64 nt, Human; identical to SEQ ID NO: 156497

SEQ ID NO: 157043 - RNA, 64 nt, Human; identical to SEQ ID NO: 156498

SEQ ID NO: 157044 - RNA, 64 nt, Human; identical to SEQ ID NO: 156499

SEQ ID NO: 157045 - RNA, 64 nt, Human; identical to SEQ ID NO: 156500

SEQ ID NO: 157046 - RNA, 64 nt, Human; identical to SEQ ID NO: 156501

SEQ ID NO: 157047 - RNA, 64 nt, Human; identical to SEQ ID NO: 156502

SEQ ID NO: 157048 - RNA, 64 nt, Human; identical to SEQ ID NO: 156503

SEQ ID NO: 157049 - RNA, 64 nt, Human; identical to SEQ ID NO: 156504

SEQ ID NO: 157050 - RNA, 64 nt, Human; identical to SEQ ID NO: 156505

SEQ ID NO: 157051 - RNA, 64 nt, Human; identical to SEQ ID NO: 156506

SEQ ID NO: 157052 - RNA, 64 nt, Human; identical to SEQ ID NO: 156507

SEQ ID NO: 157053 - RNA, 64 nt, Human; identical to SEQ ID NO: 156508

SEQ ID NO: 157054 - RNA, 64 nt, Human; identical to SEQ ID NO: 156509

SEQ ID NO: 157055 - RNA, 64 nt, Human; identical to SEQ ID NO: 156510

SEQ ID NO: 157056 - RNA, 58 nt, Human; identical to SEQ ID NO: 153663

SEQ ID NO: 157057 - RNA, 64 nt, Human; identical to SEQ ID NO: 156512

SEQ ID NO: 157058 - RNA, 64 nt, Human; identical to SEQ ID NO: 156513

SEQ ID NO: 157059 - RNA, 57 nt, Human; identical to SEQ ID NO: 153666

SEQ ID NO: 157060 - RNA, 64 nt, Human; identical to SEQ ID NO: 156515

SEQ ID NO: 157061 - RNA, 64 nt, Human; identical to SEQ ID NO: 156516

SEQ ID NO: 157062 - RNA, 64 nt, Human; identical to SEQ ID NO: 156517

SEQ ID NO: 157063 - RNA, 64 nt, Human; identical to SEQ ID NO: 156518

SEQ ID NO: 157064 - RNA, 64 nt, Human; identical to SEQ ID NO: 156519

SEQ ID NO: 157065 - RNA, 64 nt, Human; identical to SEQ ID NO: 156520

SEQ ID NO: 157066 - RNA, 64 nt, Human; identical to SEQ ID NO: 156521

SEQ ID NO: 157067 - RNA, 64 nt, Human; identical to SEQ ID NO: 156522

SEQ ID NO: 157068 - RNA, 64 nt, Human; identical to SEQ ID NO: 156523

SEQ ID NO: 157069 - RNA, 64 nt, Human; identical to SEQ ID NO: 156524

SEQ ID NO: 157070 - RNA, 64 nt, Human; identical to SEQ ID NO: 156525

SEQ ID NO: 157071 - RNA, 64 nt, Human; identical to SEQ ID NO: 156526

SEQ ID NO: 157072 - RNA, 64 nt, Human; identical to SEQ ID NO: 156527

SEQ ID NO: 157073 - RNA, 64 nt, Human; identical to SEQ ID NO: 156528

SEQ ID NO: 157074 - RNA, 64 nt, Human; identical to SEQ ID NO: 156529

SEQ ID NO: 157075 - RNA, 64 nt, Human; identical to SEQ ID NO: 156530

SEQ ID NO: 157076 - RNA, 64 nt, Human; identical to SEQ ID NO: 156531

SEQ ID NO: 157077 - RNA, 64 nt, Human; identical to SEQ ID NO: 156532

SEQ ID NO: 157078 - RNA, 64 nt, Human; identical to SEQ ID NO: 156533

SEQ ID NO: 157079 - RNA, 64 nt, Human; identical to SEQ ID NO: 156534

SEQ ID NO: 157080 - RNA, 64 nt, Human; identical to SEQ ID NO: 156535

SEQ ID NO: 157081 - RNA, 64 nt, Human; identical to SEQ ID NO: 156536

SEQ ID NO: 157082 - RNA, 64 nt, Human; identical to SEQ ID NO: 156537

SEQ ID NO: 157083 - RNA, 64 nt, Human; identical to SEQ ID NO: 156538

SEQ ID NO: 157084 - RNA, 64 nt, Human; identical to SEQ ID NO: 156539

SEQ ID NO: 157085 - RNA, 64 nt, Human; identical to SEQ ID NO: 156540

SEQ ID NO: 157086 - RNA, 64 nt, Human; identical to SEQ ID NO: 156541

SEQ ID NO: 157087 - RNA, 64 nt, Human; identical to SEQ ID NO: 156542

SEQ ID NO: 157088 - RNA, 64 nt, Human; identical to SEQ ID NO: 156543

SEQ ID NO: 157089 - RNA, 64 nt, Human; identical to SEQ ID NO: 156544

SEQ ID NO: 157090 - RNA, 64 nt, Human; identical to SEQ ID NO: 156545

SEQ ID NO: 157091 - RNA, 64 nt, Human; identical to SEQ ID NO: 156546

SEQ ID NO: 157092 - RNA, 64 nt, Human; identical to SEQ ID NO: 156547

SEQ ID NO: 157093 - RNA, 64 nt, Human; identical to SEQ ID NO: 156548

SEQ ID NO: 157094 - RNA, 64 nt, Human; identical to SEQ ID NO: 156549

SEQ ID NO: 157095 - RNA, 64 nt, Human; identical to SEQ ID NO: 156550

SEQ ID NO: 157096 - RNA, 64 nt, Human; identical to SEQ ID NO: 156551

SEQ ID NO: 157097 - RNA, 64 nt, Human; identical to SEQ ID NO: 156552

SEQ ID NO: 157098 - RNA, 64 nt, Human; identical to SEQ ID NO: 156553

SEQ ID NO: 157099 - RNA, 64 nt, Human; identical to SEQ ID NO: 156554

SEQ ID NO: 157100 - RNA, 64 nt, Human; identical to SEQ ID NO: 156555

SEQ ID NO: 157101 - RNA, 64 nt, Human; identical to SEQ ID NO: 156556

SEQ ID NO: 157102 - RNA, 64 nt, Human; identical to SEQ ID NO: 156557

SEQ ID NO: 157103 - RNA, 64 nt, Human; identical to SEQ ID NO: 156558

SEQ ID NO: 157104 - RNA, 64 nt, Human; identical to SEQ ID NO: 156559

SEQ ID NO: 157105 - RNA, 64 nt, Human; identical to SEQ ID NO: 156560

SEQ ID NO: 157106 - RNA, 64 nt, Human; identical to SEQ ID NO: 156561

SEQ ID NO: 157107 - RNA, 64 nt, Human; identical to SEQ ID NO: 156562

SEQ ID NO: 157108 - RNA, 64 nt, Human; identical to SEQ ID NO: 156563

SEQ ID NO: 157109 - RNA, 64 nt, Human; identical to SEQ ID NO: 156564

SEQ ID NO: 157110 - RNA, 64 nt, Human; identical to SEQ ID NO: 156565

SEQ ID NO: 157111 - RNA, 64 nt, Human; identical to SEQ ID NO: 156566

SEQ ID NO: 157112 - RNA, 64 nt, Human; identical to SEQ ID NO: 156567

SEQ ID NO: 157113 - RNA, 64 nt, Human; identical to SEQ ID NO: 156568

SEQ ID NO: 157114 - RNA, 64 nt, Human; identical to SEQ ID NO: 156569

SEQ ID NO: 157115 - RNA, 64 nt, Human; identical to SEQ ID NO: 156570

SEQ ID NO: 157116 - RNA, 64 nt, Human; identical to SEQ ID NO: 156571

SEQ ID NO: 157117 - RNA, 64 nt, Human; identical to SEQ ID NO: 156572

SEQ ID NO: 157118 - RNA, 64 nt, Human; identical to SEQ ID NO: 156573

SEQ ID NO: 157119 - RNA, 64 nt, Human; identical to SEQ ID NO: 156574

SEQ ID NO: 157120 - RNA, 64 nt, Human; identical to SEQ ID NO: 156575

SEQ ID NO: 157121 - RNA, 64 nt, Human; identical to SEQ ID NO: 156576

SEQ ID NO: 157122 - RNA, 51 nt, Human; identical to SEQ ID NO: 156577

SEQ ID NO: 157123 - RNA, 64 nt, Human; identical to SEQ ID NO: 156578

SEQ ID NO: 157124 - RNA, 64 nt, Human; identical to SEQ ID NO: 156579

SEQ ID NO: 157125 - RNA, 64 nt, Human; identical to SEQ ID NO: 156580

SEQ ID NO: 157126 - RNA, 64 nt, Human; identical to SEQ ID NO: 156581

SEQ ID NO: 157127 - RNA, 64 nt, Human; identical to SEQ ID NO: 156582

SEQ ID NO: 157128 - RNA, 64 nt, Human; identical to SEQ ID NO: 156583

SEQ ID NO: 157129 - RNA, 64 nt, Human; identical to SEQ ID NO: 156584

SEQ ID NO: 157130 - RNA, 64 nt, Human; identical to SEQ ID NO: 156585

SEQ ID NO: 157131 - RNA, 64 nt, Human; identical to SEQ ID NO: 156586

SEQ ID NO: 157132 - RNA, 64 nt, Human; identical to SEQ ID NO: 156587

SEQ ID NO: 157133 - RNA, 64 nt, Human; identical to SEQ ID NO: 156588

SEQ ID NO: 157134 - RNA, 64 nt, Human; identical to SEQ ID NO: 156589

SEQ ID NO: 157135 - RNA, 64 nt, Human; identical to SEQ ID NO: 156590

SEQ ID NO: 157136 - RNA, 64 nt, Human; identical to SEQ ID NO: 156591

SEQ ID NO: 157137 - RNA, 64 nt, Human; identical to SEQ ID NO: 156592

SEQ ID NO: 157138 - RNA, 64 nt, Human; identical to SEQ ID NO: 156593

SEQ ID NO: 157139 - RNA, 64 nt, Human; identical to SEQ ID NO: 156594

SEQ ID NO: 157140 - RNA, 64 nt, Human; identical to SEQ ID NO: 156595

SEQ ID NO: 157141 - RNA, 64 nt, Human; identical to SEQ ID NO: 156596

SEQ ID NO: 157142 - RNA, 64 nt, Human; identical to SEQ ID NO: 156597

SEQ ID NO: 157143 - RNA, 64 nt, Human; identical to SEQ ID NO: 156598

SEQ ID NO: 157144 - RNA, 64 nt, Human; identical to SEQ ID NO: 156599

SEQ ID NO: 157145 - RNA, 64 nt, Human; identical to SEQ ID NO: 156600

SEQ ID NO: 157146 - RNA, 64 nt, Human; identical to SEQ ID NO: 156601

SEQ ID NO: 157147 - RNA, 64 nt, Human; identical to SEQ ID NO: 156602

SEQ ID NO: 157148 - RNA, 64 nt, Human; identical to SEQ ID NO: 156603

SEQ ID NO: 157149 - RNA, 64 nt, Human; identical to SEQ ID NO: 156604

SEQ ID NO: 157150 - RNA, 64 nt, Human; identical to SEQ ID NO: 156605

SEQ ID NO: 157151 - RNA, 64 nt, Human; identical to SEQ ID NO: 156606

SEQ ID NO: 157152 - RNA, 64 nt, Human; identical to SEQ ID NO: 156607

SEQ ID NO: 157153 - RNA, 64 nt, Human; identical to SEQ ID NO: 156608

SEQ ID NO: 157154 - RNA, 64 nt, Human; identical to SEQ ID NO: 156609

SEQ ID NO: 157155 - RNA, 64 nt, Human; identical to SEQ ID NO: 156610

SEQ ID NO: 157156 - RNA, 64 nt, Human; identical to SEQ ID NO: 156611

SEQ ID NO: 157157 - RNA, 64 nt, Human; identical to SEQ ID NO: 156612

SEQ ID NO: 157158 - RNA, 64 nt, Human; identical to SEQ ID NO: 156613

SEQ ID NO: 157159 - RNA, 64 nt, Human; identical to SEQ ID NO: 156614

SEQ ID NO: 157160 - RNA, 64 nt, Human; identical to SEQ ID NO: 156615

SEQ ID NO: 157161 - RNA, 64 nt, Human; identical to SEQ ID NO: 156616

SEQ ID NO: 157162 - RNA, 64 nt, Human; identical to SEQ ID NO: 156617

SEQ ID NO: 157163 - RNA, 64 nt, Human; identical to SEQ ID NO: 156618

SEQ ID NO: 157164 - RNA, 64 nt, Human; identical to SEQ ID NO: 156619

SEQ ID NO: 157165 - RNA, 64 nt, Human; identical to SEQ ID NO: 156620

SEQ ID NO: 157166 - RNA, 64 nt, Human; identical to SEQ ID NO: 156621

SEQ ID NO: 157167 - RNA, 64 nt, Human; identical to SEQ ID NO: 156622

SEQ ID NO: 157168 - RNA, 64 nt, Human; identical to SEQ ID NO: 156623

SEQ ID NO: 157169 - RNA, 64 nt, Human; identical to SEQ ID NO: 156624

SEQ ID NO: 157170 - RNA, 64 nt, Human; identical to SEQ ID NO: 156625

SEQ ID NO: 157171 - RNA, 64 nt, Human; identical to SEQ ID NO: 156626

SEQ ID NO: 157172 - RNA, 64 nt, Human; identical to SEQ ID NO: 156627

SEQ ID NO: 157173 - RNA, 64 nt, Human; identical to SEQ ID NO: 156628

SEQ ID NO: 157174 - RNA, 64 nt, Human; identical to SEQ ID NO: 156629

SEQ ID NO: 157175 - RNA, 64 nt, Human; identical to SEQ ID NO: 156630

SEQ ID NO: 157176 - RNA, 64 nt, Human; identical to SEQ ID NO: 156631

SEQ ID NO: 157177 - RNA, 64 nt, Human; identical to SEQ ID NO: 156632

SEQ ID NO: 157178 - RNA, 64 nt, Human; identical to SEQ ID NO: 156633

SEQ ID NO: 157179 - RNA, 64 nt, Human; identical to SEQ ID NO: 156634

SEQ ID NO: 157180 - RNA, 64 nt, Human; identical to SEQ ID NO: 156635

SEQ ID NO: 157181 - RNA, 64 nt, Human; identical to SEQ ID NO: 156636

SEQ ID NO: 157182 - RNA, 64 nt, Human; identical to SEQ ID NO: 156637

SEQ ID NO: 157183 - RNA, 64 nt, Human; identical to SEQ ID NO: 156638

SEQ ID NO: 157184 - RNA, 64 nt, Human; identical to SEQ ID NO: 156639

SEQ ID NO: 157185 - RNA, 64 nt, Human; identical to SEQ ID NO: 156640

SEQ ID NO: 157186 - RNA, 64 nt, Human; identical to SEQ ID NO: 156641

SEQ ID NO: 157187 - RNA, 64 nt, Human; identical to SEQ ID NO: 156642

SEQ ID NO: 157188 - RNA, 64 nt, Human; identical to SEQ ID NO: 156643

SEQ ID NO: 157189 - RNA, 64 nt, Human; identical to SEQ ID NO: 156644

SEQ ID NO: 157190 - RNA, 64 nt, Human; identical to SEQ ID NO: 156645

SEQ ID NO: 157191 - RNA, 64 nt, Human; identical to SEQ ID NO: 156646

SEQ ID NO: 157192 - RNA, 64 nt, Human; identical to SEQ ID NO: 156647

SEQ ID NO: 157193 - RNA, 64 nt, Human; identical to SEQ ID NO: 156648

SEQ ID NO: 157194 - RNA, 64 nt, Human; identical to SEQ ID NO: 156649

SEQ ID NO: 157195 - RNA, 64 nt, Human; identical to SEQ ID NO: 156650

SEQ ID NO: 157196 - RNA, 64 nt, Human; identical to SEQ ID NO: 156651

SEQ ID NO: 157197 - RNA, 64 nt, Human; identical to SEQ ID NO: 156652

SEQ ID NO: 157198 - RNA, 64 nt, Human; identical to SEQ ID NO: 156653

SEQ ID NO: 157199 - RNA, 64 nt, Human; identical to SEQ ID NO: 156654

SEQ ID NO: 157200 - RNA, 64 nt, Human; identical to SEQ ID NO: 156655

SEQ ID NO: 157201 - RNA, 64 nt, Human; identical to SEQ ID NO: 156656

SEQ ID NO: 157202 - RNA, 64 nt, Human; identical to SEQ ID NO: 156657

SEQ ID NO: 157203 - RNA, 51 nt, Human; identical to SEQ ID NO: 156658

SEQ ID NO: 157204 - RNA, 64 nt, Human; identical to SEQ ID NO: 156659

SEQ ID NO: 157205 - RNA, 64 nt, Human; identical to SEQ ID NO: 156660

SEQ ID NO: 157206 - RNA, 64 nt, Human; identical to SEQ ID NO: 156661

SEQ ID NO: 157207 - RNA, 64 nt, Human; identical to SEQ ID NO: 156662

SEQ ID NO: 157208 - RNA, 64 nt, Human; identical to SEQ ID NO: 156663

SEQ ID NO: 157209 - RNA, 64 nt, Human; identical to SEQ ID NO: 156664

SEQ ID NO: 157210 - RNA, 64 nt, Human; identical to SEQ ID NO: 156665

SEQ ID NO: 157211 - RNA, 64 nt, Human; identical to SEQ ID NO: 156666

SEQ ID NO: 157212 - RNA, 64 nt, Human; identical to SEQ ID NO: 156667

SEQ ID NO: 157213 - RNA, 64 nt, Human; identical to SEQ ID NO: 156668

SEQ ID NO: 157214 - RNA, 64 nt, Human; identical to SEQ ID NO: 156669

SEQ ID NO: 157215 - RNA, 64 nt, Human; identical to SEQ ID NO: 156670

SEQ ID NO: 157216 - RNA, 64 nt, Human; identical to SEQ ID NO: 156671

SEQ ID NO: 157217 - RNA, 64 nt, Human; identical to SEQ ID NO: 156672

SEQ ID NO: 157218 - RNA, 64 nt, Human; identical to SEQ ID NO: 156673

SEQ ID NO: 157219 - RNA, 64 nt, Human; identical to SEQ ID NO: 156674

SEQ ID NO: 157220 - RNA, 64 nt, Human; identical to SEQ ID NO: 156675

SEQ ID NO: 157221 - RNA, 64 nt, Human; identical to SEQ ID NO: 156676

SEQ ID NO: 157222 - RNA, 64 nt, Human; identical to SEQ ID NO: 156677

SEQ ID NO: 157223 - RNA, 64 nt, Human; identical to SEQ ID NO: 156678

SEQ ID NO: 157224 - RNA, 64 nt, Human; identical to SEQ ID NO: 156679

SEQ ID NO: 157225 - RNA, 64 nt, Human; identical to SEQ ID NO: 156680

SEQ ID NO: 157226 - RNA, 64 nt, Human; identical to SEQ ID NO: 156681

SEQ ID NO: 157227 - RNA, 64 nt, Human; identical to SEQ ID NO: 156682

SEQ ID NO: 157228 - RNA, 64 nt, Human; identical to SEQ ID NO: 156683

SEQ ID NO: 157229 - RNA, 64 nt, Human; identical to SEQ ID NO: 156684

SEQ ID NO: 157230 - RNA, 64 nt, Human; identical to SEQ ID NO: 156685

SEQ ID NO: 157231 - RNA, 64 nt, Human; identical to SEQ ID NO: 156686

SEQ ID NO: 157232 - RNA, 64 nt, Human; identical to SEQ ID NO: 156687

SEQ ID NO: 157233 - RNA, 64 nt, Human; identical to SEQ ID NO: 156688

SEQ ID NO: 157234 - RNA, 64 nt, Human; identical to SEQ ID NO: 156689

SEQ ID NO: 157235 - RNA, 64 nt, Human; identical to SEQ ID NO: 156690

SEQ ID NO: 157236 - RNA, 64 nt, Human; identical to SEQ ID NO: 156691

SEQ ID NO: 157237 - RNA, 64 nt, Human; identical to SEQ ID NO: 156692

SEQ ID NO: 157238 - RNA, 64 nt, Human; identical to SEQ ID NO: 156693

SEQ ID NO: 157239 - RNA, 64 nt, Human; identical to SEQ ID NO: 156694

SEQ ID NO: 157240 - RNA, 64 nt, Human; identical to SEQ ID NO: 156695

SEQ ID NO: 157241 - RNA, 64 nt, Human; identical to SEQ ID NO: 156696

SEQ ID NO: 157242 - RNA, 53 nt, Human; identical to SEQ ID NO: 156697

SEQ ID NO: 157243 - RNA, 64 nt, Human; identical to SEQ ID NO: 156698

SEQ ID NO: 157244 - RNA, 64 nt, Human; identical to SEQ ID NO: 156699

SEQ ID NO: 157245 - RNA, 64 nt, Human; identical to SEQ ID NO: 156700

SEQ ID NO: 157246 - RNA, 64 nt, Human; identical to SEQ ID NO: 156701

SEQ ID NO: 157247 - RNA, 64 nt, Human; identical to SEQ ID NO: 156702

SEQ ID NO: 157248 - RNA, 64 nt, Human; identical to SEQ ID NO: 156703

SEQ ID NO: 157249 - RNA, 64 nt, Human; identical to SEQ ID NO: 156704

SEQ ID NO: 157250 - RNA, 64 nt, Human; identical to SEQ ID NO: 156705

SEQ ID NO: 157251 - RNA, 64 nt, Human; identical to SEQ ID NO: 156706

SEQ ID NO: 157252 - RNA, 64 nt, Human; identical to SEQ ID NO: 156707

SEQ ID NO: 157253 - RNA, 64 nt, Human; identical to SEQ ID NO: 156708

SEQ ID NO: 157254 - RNA, 64 nt, Human; identical to SEQ ID NO: 156709

SEQ ID NO: 157255 - RNA, 64 nt, Human; identical to SEQ ID NO: 156710

SEQ ID NO: 157256 - RNA, 64 nt, Human; identical to SEQ ID NO: 156711

SEQ ID NO: 157257 - RNA, 64 nt, Human; identical to SEQ ID NO: 156712

SEQ ID NO: 157258 - RNA, 64 nt, Human; identical to SEQ ID NO: 156713

SEQ ID NO: 157259 - RNA, 64 nt, Human; identical to SEQ ID NO: 156714

SEQ ID NO: 157260 - RNA, 64 nt, Human; identical to SEQ ID NO: 156715

SEQ ID NO: 157261 - RNA, 64 nt, Human; identical to SEQ ID NO: 156716

SEQ ID NO: 157262 - RNA, 64 nt, Human; identical to SEQ ID NO: 156717

SEQ ID NO: 157263 - RNA, 64 nt, Human; identical to SEQ ID NO: 156718

SEQ ID NO: 157264 - RNA, 64 nt, Human; identical to SEQ ID NO: 156719

SEQ ID NO: 157265 - RNA, 64 nt, Human; identical to SEQ ID NO: 156720

SEQ ID NO: 157266 - RNA, 64 nt, Human; identical to SEQ ID NO: 156721

SEQ ID NO: 157267 - RNA, 64 nt, Human; identical to SEQ ID NO: 156722

SEQ ID NO: 157268 - RNA, 64 nt, Human; identical to SEQ ID NO: 156723

SEQ ID NO: 157269 - RNA, 64 nt, Human; identical to SEQ ID NO: 156724

SEQ ID NO: 157270 - RNA, 64 nt, Human; identical to SEQ ID NO: 156725

SEQ ID NO: 157271 - RNA, 64 nt, Human; identical to SEQ ID NO: 156726

SEQ ID NO: 157272 - RNA, 64 nt, Human; identical to SEQ ID NO: 156727

SEQ ID NO: 157273 - RNA, 64 nt, Human; identical to SEQ ID NO: 156728

SEQ ID NO: 157274 - RNA, 64 nt, Human; identical to SEQ ID NO: 156729

SEQ ID NO: 157275 - RNA, 64 nt, Human; identical to SEQ ID NO: 156730

SEQ ID NO: 157276 - RNA, 64 nt, Human; identical to SEQ ID NO: 156731

SEQ ID NO: 157277 - RNA, 64 nt, Human; identical to SEQ ID NO: 156732

SEQ ID NO: 157278 - RNA, 64 nt, Human; identical to SEQ ID NO: 156733

SEQ ID NO: 157279 - RNA, 64 nt, Human; identical to SEQ ID NO: 156734

SEQ ID NO: 157280 - RNA, 64 nt, Human; identical to SEQ ID NO: 156735

SEQ ID NO: 157281 - RNA, 64 nt, Human; identical to SEQ ID NO: 156736

SEQ ID NO: 157282 - RNA, 64 nt, Human; identical to SEQ ID NO: 156737

SEQ ID NO: 157283 - RNA, 64 nt, Human; identical to SEQ ID NO: 156738

SEQ ID NO: 157284 - RNA, 64 nt, Human; identical to SEQ ID NO: 156739

SEQ ID NO: 157285 - RNA, 64 nt, Human; identical to SEQ ID NO: 156740

SEQ ID NO: 157286 - RNA, 64 nt, Human; identical to SEQ ID NO: 156741

SEQ ID NO: 157287 - RNA, 64 nt, Human; identical to SEQ ID NO: 156742

SEQ ID NO: 157288 - RNA, 64 nt, Human; identical to SEQ ID NO: 156743

SEQ ID NO: 157289 - RNA, 64 nt, Human; identical to SEQ ID NO: 156744

SEQ ID NO: 157290 - RNA, 64 nt, Human; identical to SEQ ID NO: 156745

SEQ ID NO: 157291 - RNA, 64 nt, Human; identical to SEQ ID NO: 156746

SEQ ID NO: 157292 - RNA, 64 nt, Human; identical to SEQ ID NO: 156747

SEQ ID NO: 157293 - RNA, 64 nt, Human; identical to SEQ ID NO: 156748

SEQ ID NO: 157294 - RNA, 64 nt, Human; identical to SEQ ID NO: 156749

SEQ ID NO: 157295 - RNA, 64 nt, Human; identical to SEQ ID NO: 156750

SEQ ID NO: 157296 - RNA, 64 nt, Human; identical to SEQ ID NO: 156751

SEQ ID NO: 157297 - RNA, 64 nt, Human; identical to SEQ ID NO: 156752

SEQ ID NO: 157298 - RNA, 64 nt, Human; identical to SEQ ID NO: 156753

SEQ ID NO: 157299 - RNA, 64 nt, Human; identical to SEQ ID NO: 156754

SEQ ID NO: 157300 - RNA, 64 nt, Human; identical to SEQ ID NO: 156755

SEQ ID NO: 157301 - RNA, 64 nt, Human; identical to SEQ ID NO: 156756

SEQ ID NO: 157302 - RNA, 64 nt, Human; identical to SEQ ID NO: 156757

SEQ ID NO: 157303 - RNA, 64 nt, Human; identical to SEQ ID NO: 156758

SEQ ID NO: 157304 - RNA, 64 nt, Human; identical to SEQ ID NO: 156759

SEQ ID NO: 157305 - RNA, 64 nt, Human; identical to SEQ ID NO: 156760

SEQ ID NO: 157306 - RNA, 64 nt, Human; identical to SEQ ID NO: 156761

SEQ ID NO: 157307 - RNA, 64 nt, Human; identical to SEQ ID NO: 156762

SEQ ID NO: 157308 - RNA, 64 nt, Human; identical to SEQ ID NO: 156763

SEQ ID NO: 157309 - RNA, 64 nt, Human; identical to SEQ ID NO: 156764

SEQ ID NO: 157310 - RNA, 64 nt, Human; identical to SEQ ID NO: 156765

SEQ ID NO: 157311 - RNA, 64 nt, Human; identical to SEQ ID NO: 156766

SEQ ID NO: 157312 - RNA, 64 nt, Human; identical to SEQ ID NO: 156767

SEQ ID NO: 157313 - RNA, 64 nt, Human; identical to SEQ ID NO: 156768

SEQ ID NO: 157314 - RNA, 64 nt, Human; identical to SEQ ID NO: 156769

SEQ ID NO: 157315 - RNA, 64 nt, Human; identical to SEQ ID NO: 156770

SEQ ID NO: 157316 - RNA, 64 nt, Human; identical to SEQ ID NO: 156771

SEQ ID NO: 157317 - RNA, 64 nt, Human; identical to SEQ ID NO: 156772

SEQ ID NO: 157318 - RNA, 64 nt, Human; identical to SEQ ID NO: 156773

SEQ ID NO: 157319 - RNA, 64 nt, Human; identical to SEQ ID NO: 156774

SEQ ID NO: 157320 - RNA, 64 nt, Human; identical to SEQ ID NO: 156775

SEQ ID NO: 157321 - RNA, 64 nt, Human; identical to SEQ ID NO: 156776

SEQ ID NO: 157322 - RNA, 64 nt, Human; identical to SEQ ID NO: 156777

SEQ ID NO: 157323 - RNA, 64 nt, Human; identical to SEQ ID NO: 156778

SEQ ID NO: 157324 - RNA, 64 nt, Human; identical to SEQ ID NO: 156779

SEQ ID NO: 157325 - RNA, 64 nt, Human; identical to SEQ ID NO: 156780

SEQ ID NO: 157326 - RNA, 64 nt, Human; identical to SEQ ID NO: 156781

SEQ ID NO: 157327 - RNA, 64 nt, Human; identical to SEQ ID NO: 156782

SEQ ID NO: 157328 - RNA, 64 nt, Human; identical to SEQ ID NO: 156783

SEQ ID NO: 157329 - RNA, 64 nt, Human; identical to SEQ ID NO: 156784

SEQ ID NO: 157330 - RNA, 64 nt, Human; identical to SEQ ID NO: 156785

SEQ ID NO: 157331 - RNA, 64 nt, Human; identical to SEQ ID NO: 156786

SEQ ID NO: 157332 - RNA, 64 nt, Human; identical to SEQ ID NO: 156787

SEQ ID NO: 157333 - RNA, 64 nt, Human; identical to SEQ ID NO: 156788

SEQ ID NO: 157334 - RNA, 64 nt, Human; identical to SEQ ID NO: 156789

SEQ ID NO: 157335 - RNA, 64 nt, Human; identical to SEQ ID NO: 156790

SEQ ID NO: 157336 - RNA, 64 nt, Human; identical to SEQ ID NO: 156791

SEQ ID NO: 157337 - RNA, 64 nt, Human; identical to SEQ ID NO: 156792

SEQ ID NO: 157338 - RNA, 64 nt, Human; identical to SEQ ID NO: 156793

SEQ ID NO: 157339 - RNA, 64 nt, Human; identical to SEQ ID NO: 156794

SEQ ID NO: 157340 - RNA, 64 nt, Human; identical to SEQ ID NO: 156795

SEQ ID NO: 157341 - RNA, 64 nt, Human; identical to SEQ ID NO: 156796

SEQ ID NO: 157342 - RNA, 64 nt, Human; identical to SEQ ID NO: 156797

SEQ ID NO: 157343 - RNA, 64 nt, Human; identical to SEQ ID NO: 156798

SEQ ID NO: 157344 - RNA, 64 nt, Human; identical to SEQ ID NO: 156799

SEQ ID NO: 157345 - RNA, 64 nt, Human; identical to SEQ ID NO: 156800

SEQ ID NO: 157346 - RNA, 64 nt, Human; identical to SEQ ID NO: 156801

SEQ ID NO: 157347 - RNA, 64 nt, Human; identical to SEQ ID NO: 156802

SEQ ID NO: 157348 - RNA, 64 nt, Human; identical to SEQ ID NO: 156803

SEQ ID NO: 157349 - RNA, 64 nt, Human; identical to SEQ ID NO: 156804

SEQ ID NO: 157350 - RNA, 64 nt, Human; identical to SEQ ID NO: 156805

SEQ ID NO: 157351 - RNA, 64 nt, Human; identical to SEQ ID NO: 156806

SEQ ID NO: 157352 - RNA, 64 nt, Human; identical to SEQ ID NO: 156807

SEQ ID NO: 157353 - RNA, 64 nt, Human; identical to SEQ ID NO: 156808

SEQ ID NO: 157354 - RNA, 64 nt, Human; identical to SEQ ID NO: 156809

SEQ ID NO: 157355 - RNA, 64 nt, Human; identical to SEQ ID NO: 156810

SEQ ID NO: 157356 - RNA, 64 nt, Human; identical to SEQ ID NO: 156811

SEQ ID NO: 157357 - RNA, 64 nt, Human; identical to SEQ ID NO: 156812

SEQ ID NO: 157358 - RNA, 64 nt, Human; identical to SEQ ID NO: 156813

SEQ ID NO: 157359 - RNA, 64 nt, Human; identical to SEQ ID NO: 156814

SEQ ID NO: 157360 - RNA, 64 nt, Human; identical to SEQ ID NO: 156815

SEQ ID NO: 157361 - RNA, 64 nt, Human; identical to SEQ ID NO: 156816

SEQ ID NO: 157362 - RNA, 64 nt, Human; identical to SEQ ID NO: 156817

SEQ ID NO: 157363 - RNA, 64 nt, Human; identical to SEQ ID NO: 156818

SEQ ID NO: 157364 - RNA, 64 nt, Human; identical to SEQ ID NO: 156819

SEQ ID NO: 157365 - RNA, 64 nt, Human; identical to SEQ ID NO: 156820

SEQ ID NO: 157366 - RNA, 64 nt, Human; identical to SEQ ID NO: 156821

SEQ ID NO: 157367 - RNA, 64 nt, Human; identical to SEQ ID NO: 156822

SEQ ID NO: 157368 - RNA, 64 nt, Human; identical to SEQ ID NO: 156823

SEQ ID NO: 157369 - RNA, 64 nt, Human; identical to SEQ ID NO: 156824

SEQ ID NO: 157370 - RNA, 64 nt, Human; identical to SEQ ID NO: 156825

SEQ ID NO: 157371 - RNA, 64 nt, Human; identical to SEQ ID NO: 156826

SEQ ID NO: 157372 - RNA, 64 nt, Human; identical to SEQ ID NO: 156827

SEQ ID NO: 157373 - RNA, 64 nt, Human; identical to SEQ ID NO: 156828

SEQ ID NO: 157374 - RNA, 64 nt, Human; identical to SEQ ID NO: 156829

SEQ ID NO: 157375 - RNA, 64 nt, Human; identical to SEQ ID NO: 156830

SEQ ID NO: 157376 - RNA, 64 nt, Human; identical to SEQ ID NO: 156831

SEQ ID NO: 157377 - RNA, 64 nt, Human; identical to SEQ ID NO: 156832

SEQ ID NO: 157378 - RNA, 64 nt, Human; identical to SEQ ID NO: 156833

SEQ ID NO: 157379 - RNA, 64 nt, Human; identical to SEQ ID NO: 156834

SEQ ID NO: 157380 - RNA, 64 nt, Human; identical to SEQ ID NO: 156835

SEQ ID NO: 157381 - RNA, 64 nt, Human; identical to SEQ ID NO: 156836

SEQ ID NO: 157382 - RNA, 64 nt, Human; identical to SEQ ID NO: 156837

SEQ ID NO: 157383 - RNA, 64 nt, Human; identical to SEQ ID NO: 156838

SEQ ID NO: 157384 - RNA, 64 nt, Human; identical to SEQ ID NO: 156839

SEQ ID NO: 157385 - RNA, 64 nt, Human; identical to SEQ ID NO: 156840

SEQ ID NO: 157386 - RNA, 55 nt, Human; identical to SEQ ID NO: 156841

SEQ ID NO: 157387 - RNA, 64 nt, Human; identical to SEQ ID NO: 156842

SEQ ID NO: 157388 - RNA, 64 nt, Human; identical to SEQ ID NO: 156843

SEQ ID NO: 157389 - RNA, 61 nt, Human; identical to SEQ ID NO: 156844

SEQ ID NO: 157390 - RNA, 64 nt, Human; identical to SEQ ID NO: 156845

SEQ ID NO: 157391 - RNA, 64 nt, Human; identical to SEQ ID NO: 156846

SEQ ID NO: 157392 - RNA, 64 nt, Human; identical to SEQ ID NO: 156847

SEQ ID NO: 157393 - RNA, 64 nt, Human; identical to SEQ ID NO: 156848

SEQ ID NO: 157394 - RNA, 64 nt, Human; identical to SEQ ID NO: 156849

SEQ ID NO: 157395 - RNA, 64 nt, Human; identical to SEQ ID NO: 156850

SEQ ID NO: 157396 - RNA, 64 nt, Human; identical to SEQ ID NO: 156851

SEQ ID NO: 157397 - RNA, 63 nt, Human; identical to SEQ ID NO: 156852

SEQ ID NO: 157398 - RNA, 64 nt, Human; identical to SEQ ID NO: 156853

SEQ ID NO: 157399 - RNA, 64 nt, Human; identical to SEQ ID NO: 156854

SEQ ID NO: 157400 - RNA, 64 nt, Human; identical to SEQ ID NO: 156855

SEQ ID NO: 157401 - RNA, 64 nt, Human; identical to SEQ ID NO: 156856

SEQ ID NO: 157402 - RNA, 64 nt, Human; identical to SEQ ID NO: 156857

SEQ ID NO: 157403 - RNA, 64 nt, Human; identical to SEQ ID NO: 156858

SEQ ID NO: 157404 - RNA, 64 nt, Human; identical to SEQ ID NO: 156859

SEQ ID NO: 157405 - RNA, 64 nt, Human; identical to SEQ ID NO: 156860

SEQ ID NO: 157406 - RNA, 64 nt, Human; identical to SEQ ID NO: 156861

SEQ ID NO: 157407 - RNA, 60 nt, Human; identical to SEQ ID NO: 156862

SEQ ID NO: 157408 - RNA, 64 nt, Human; identical to SEQ ID NO: 156863

SEQ ID NO: 157409 - RNA, 64 nt, Human; identical to SEQ ID NO: 156864

SEQ ID NO: 157410 - RNA, 64 nt, Human; identical to SEQ ID NO: 156865

SEQ ID NO: 157411 - RNA, 64 nt, Human; identical to SEQ ID NO: 156866

SEQ ID NO: 157412 - RNA, 64 nt, Human; identical to SEQ ID NO: 156867

SEQ ID NO: 157413 - RNA, 64 nt, Human; identical to SEQ ID NO: 156868

SEQ ID NO: 157414 - RNA, 64 nt, Human; identical to SEQ ID NO: 156869

SEQ ID NO: 157415 - RNA, 64 nt, Human; identical to SEQ ID NO: 156870

SEQ ID NO: 157416 - RNA, 64 nt, Human; identical to SEQ ID NO: 156871

SEQ ID NO: 157417 - RNA, 64 nt, Human; identical to SEQ ID NO: 156872

SEQ ID NO: 157418 - RNA, 64 nt, Human; identical to SEQ ID NO: 156873

SEQ ID NO: 157419 - RNA, 64 nt, Human; identical to SEQ ID NO: 156874

SEQ ID NO: 157420 - RNA, 64 nt, Human; identical to SEQ ID NO: 156875

SEQ ID NO: 157421 - RNA, 64 nt, Human; identical to SEQ ID NO: 156876

SEQ ID NO: 157422 - RNA, 64 nt, Human; identical to SEQ ID NO: 156877

SEQ ID NO: 157423 - RNA, 64 nt, Human; identical to SEQ ID NO: 156878

SEQ ID NO: 157424 - RNA, 64 nt, Human; identical to SEQ ID NO: 156879

SEQ ID NO: 157425 - RNA, 64 nt, Human; identical to SEQ ID NO: 156880

SEQ ID NO: 157426 - RNA, 64 nt, Human; identical to SEQ ID NO: 156881

SEQ ID NO: 157427 - RNA, 64 nt, Human; identical to SEQ ID NO: 156882

SEQ ID NO: 157428 - RNA, 64 nt, Human; identical to SEQ ID NO: 156883

SEQ ID NO: 157429 - RNA, 64 nt, Human; identical to SEQ ID NO: 156884

SEQ ID NO: 157430 - RNA, 64 nt, Human; identical to SEQ ID NO: 156885

SEQ ID NO: 157431 - RNA, 64 nt, Human; identical to SEQ ID NO: 156886

SEQ ID NO: 157432 - RNA, 64 nt, Human; identical to SEQ ID NO: 156887

SEQ ID NO: 157433 - RNA, 64 nt, Human; identical to SEQ ID NO: 156888

SEQ ID NO: 157434 - RNA, 64 nt, Human; identical to SEQ ID NO: 156889

SEQ ID NO: 157435 - RNA, 64 nt, Human; identical to SEQ ID NO: 156890

SEQ ID NO: 157436 - RNA, 64 nt, Human; identical to SEQ ID NO: 156891

SEQ ID NO: 157437 - RNA, 64 nt, Human; identical to SEQ ID NO: 156892

SEQ ID NO: 157438 - RNA, 64 nt, Human; identical to SEQ ID NO: 156893

SEQ ID NO: 157439 - RNA, 64 nt, Human; identical to SEQ ID NO: 156894

SEQ ID NO: 157440 - RNA, 64 nt, Human; identical to SEQ ID NO: 156895

SEQ ID NO: 157441 - RNA, 64 nt, Human; identical to SEQ ID NO: 156896

SEQ ID NO: 157442 - RNA, 64 nt, Human; identical to SEQ ID NO: 156897

SEQ ID NO: 157443 - RNA, 64 nt, Human; identical to SEQ ID NO: 156898

SEQ ID NO: 157444 - RNA, 64 nt, Human; identical to SEQ ID NO: 156899

SEQ ID NO: 157445 - RNA, 64 nt, Human; identical to SEQ ID NO: 156900

SEQ ID NO: 157446 - RNA, 64 nt, Human; identical to SEQ ID NO: 156901

SEQ ID NO: 157447 - RNA, 64 nt, Human; identical to SEQ ID NO: 156902

SEQ ID NO: 157448 - RNA, 64 nt, Human; identical to SEQ ID NO: 156903

SEQ ID NO: 157449 - RNA, 64 nt, Human; identical to SEQ ID NO: 156904

SEQ ID NO: 157450 - RNA, 64 nt, Human; identical to SEQ ID NO: 156905

SEQ ID NO: 157451 - RNA, 64 nt, Human; identical to SEQ ID NO: 156906

SEQ ID NO: 157452 - RNA, 64 nt, Human; identical to SEQ ID NO: 156907

SEQ ID NO: 157453 - RNA, 64 nt, Human; identical to SEQ ID NO: 156908

SEQ ID NO: 157454 - RNA, 64 nt, Human; identical to SEQ ID NO: 156909

SEQ ID NO: 157455 - RNA, 64 nt, Human; identical to SEQ ID NO: 156910

SEQ ID NO: 157456 - RNA, 64 nt, Human; identical to SEQ ID NO: 156911

SEQ ID NO: 157457 - RNA, 64 nt, Human; identical to SEQ ID NO: 156912

SEQ ID NO: 157458 - RNA, 64 nt, Human; identical to SEQ ID NO: 156913

SEQ ID NO: 157459 - RNA, 64 nt, Human; identical to SEQ ID NO: 156914

SEQ ID NO: 157460 - RNA, 64 nt, Human; identical to SEQ ID NO: 156915

SEQ ID NO: 157461 - RNA, 64 nt, Human; identical to SEQ ID NO: 156916

SEQ ID NO: 157462 - RNA, 64 nt, Human; identical to SEQ ID NO: 156917

SEQ ID NO: 157463 - RNA, 64 nt, Human; identical to SEQ ID NO: 156918

SEQ ID NO: 157464 - RNA, 64 nt, Human; identical to SEQ ID NO: 156919

SEQ ID NO: 157465 - RNA, 64 nt, Human; identical to SEQ ID NO: 156920

SEQ ID NO: 157466 - RNA, 64 nt, Human; identical to SEQ ID NO: 156921

SEQ ID NO: 157467 - RNA, 64 nt, Human; identical to SEQ ID NO: 156922

SEQ ID NO: 157468 - RNA, 64 nt, Human; identical to SEQ ID NO: 156923

SEQ ID NO: 157469 - RNA, 64 nt, Human; identical to SEQ ID NO: 156924

SEQ ID NO: 157470 - RNA, 64 nt, Human; identical to SEQ ID NO: 156925

SEQ ID NO: 157471 - RNA, 64 nt, Human; identical to SEQ ID NO: 156926

SEQ ID NO: 157472 - RNA, 64 nt, Human; identical to SEQ ID NO: 156927

SEQ ID NO: 157473 - RNA, 64 nt, Human; identical to SEQ ID NO: 156928

SEQ ID NO: 157474 - RNA, 64 nt, Human; identical to SEQ ID NO: 156929

SEQ ID NO: 157475 - RNA, 64 nt, Human; identical to SEQ ID NO: 156930

SEQ ID NO: 157476 - RNA, 64 nt, Human; identical to SEQ ID NO: 156931

SEQ ID NO: 157477 - RNA, 64 nt, Human; identical to SEQ ID NO: 156932

SEQ ID NO: 157478 - RNA, 64 nt, Human; identical to SEQ ID NO: 156933

SEQ ID NO: 157479 - RNA, 64 nt, Human; identical to SEQ ID NO: 156934

SEQ ID NO: 157480 - RNA, 64 nt, Human; identical to SEQ ID NO: 156935

SEQ ID NO: 157481 - RNA, 64 nt, Human; identical to SEQ ID NO: 156936

SEQ ID NO: 157482 - RNA, 64 nt, Human; identical to SEQ ID NO: 156937

SEQ ID NO: 157483 - RNA, 64 nt, Human; identical to SEQ ID NO: 156938

SEQ ID NO: 157484 - RNA, 64 nt, Human; identical to SEQ ID NO: 156939

SEQ ID NO: 157485 - RNA, 64 nt, Human; identical to SEQ ID NO: 156395

SEQ ID NO: 157486 - RNA, 64 nt, Human; identical to SEQ ID NO: 156396

SEQ ID NO: 157487 - RNA, 64 nt, Human; identical to SEQ ID NO: 156397

SEQ ID NO: 157488 - RNA, 64 nt, Human; identical to SEQ ID NO: 156398

SEQ ID NO: 157489 - RNA, 64 nt, Human; identical to SEQ ID NO: 156399

SEQ ID NO: 157490 - RNA, 64 nt, Human; identical to SEQ ID NO: 156400

SEQ ID NO: 157491 - RNA, 64 nt, Human; identical to SEQ ID NO: 156401

SEQ ID NO: 157492 - RNA, 64 nt, Human; identical to SEQ ID NO: 156402

SEQ ID NO: 157493 - RNA, 64 nt, Human; identical to SEQ ID NO: 156403

SEQ ID NO: 157494 - RNA, 64 nt, Human; identical to SEQ ID NO: 156404

SEQ ID NO: 157495 - RNA, 64 nt, Human; identical to SEQ ID NO: 156405

SEQ ID NO: 157496 - RNA, 54 nt, Human; identical to SEQ ID NO: 153558

SEQ ID NO: 157497 - RNA, 64 nt, Human; identical to SEQ ID NO: 156407

SEQ ID NO: 157498 - RNA, 64 nt, Human; identical to SEQ ID NO: 156408

SEQ ID NO: 157499 - RNA, 64 nt, Human; identical to SEQ ID NO: 156409

SEQ ID NO: 157500 - RNA, 64 nt, Human; identical to SEQ ID NO: 156410

SEQ ID NO: 157501 - RNA, 64 nt, Human; identical to SEQ ID NO: 156411

SEQ ID NO: 157502 - RNA, 64 nt, Human; identical to SEQ ID NO: 156412

SEQ ID NO: 157503 - RNA, 64 nt, Human; identical to SEQ ID NO: 156413

SEQ ID NO: 157504 - RNA, 64 nt, Human; identical to SEQ ID NO: 156414

SEQ ID NO: 157505 - RNA, 64 nt, Human; identical to SEQ ID NO: 156415

SEQ ID NO: 157506 - RNA, 64 nt, Human; identical to SEQ ID NO: 156416

SEQ ID NO: 157507 - RNA, 64 nt, Human; identical to SEQ ID NO: 156417

SEQ ID NO: 157508 - RNA, 64 nt, Human; identical to SEQ ID NO: 156418

SEQ ID NO: 157509 - RNA, 64 nt, Human; identical to SEQ ID NO: 156419

SEQ ID NO: 157510 - RNA, 64 nt, Human; identical to SEQ ID NO: 156420

SEQ ID NO: 157511 - RNA, 64 nt, Human; identical to SEQ ID NO: 156421

SEQ ID NO: 157512 - RNA, 64 nt, Human; identical to SEQ ID NO: 156422

SEQ ID NO: 157513 - RNA, 64 nt, Human; identical to SEQ ID NO: 156423

SEQ ID NO: 157514 - RNA, 64 nt, Human; identical to SEQ ID NO: 156424

SEQ ID NO: 157515 - RNA, 64 nt, Human; identical to SEQ ID NO: 156425

SEQ ID NO: 157516 - RNA, 64 nt, Human; identical to SEQ ID NO: 156426

SEQ ID NO: 157517 - RNA, 56 nt, Human; identical to SEQ ID NO: 153579

SEQ ID NO: 157518 - RNA, 64 nt, Human; identical to SEQ ID NO: 156428

SEQ ID NO: 157519 - RNA, 64 nt, Human; identical to SEQ ID NO: 156429

SEQ ID NO: 157520 - RNA, 64 nt, Human; identical to SEQ ID NO: 156430

SEQ ID NO: 157521 - RNA, 64 nt, Human; identical to SEQ ID NO: 156431

SEQ ID NO: 157522 - RNA, 64 nt, Human; identical to SEQ ID NO: 156432

SEQ ID NO: 157523 - RNA, 64 nt, Human; identical to SEQ ID NO: 156433

SEQ ID NO: 157524 - RNA, 64 nt, Human; identical to SEQ ID NO: 156434

SEQ ID NO: 157525 - RNA, 64 nt, Human; identical to SEQ ID NO: 156435

SEQ ID NO: 157526 - RNA, 64 nt, Human; identical to SEQ ID NO: 156436

SEQ ID NO: 157527 - RNA, 64 nt, Human; identical to SEQ ID NO: 156437

SEQ ID NO: 157528 - RNA, 64 nt, Human; identical to SEQ ID NO: 156438

SEQ ID NO: 157529 - RNA, 64 nt, Human; identical to SEQ ID NO: 156439

SEQ ID NO: 157530 - RNA, 55 nt, Human; identical to SEQ ID NO: 153592

SEQ ID NO: 157531 - RNA, 64 nt, Human; identical to SEQ ID NO: 156441

SEQ ID NO: 157532 - RNA, 64 nt, Human; identical to SEQ ID NO: 156442

SEQ ID NO: 157533 - RNA, 64 nt, Human; identical to SEQ ID NO: 156443

SEQ ID NO: 157534 - RNA, 64 nt, Human; identical to SEQ ID NO: 156444

SEQ ID NO: 157535 - RNA, 64 nt, Human; identical to SEQ ID NO: 156445

SEQ ID NO: 157536 - RNA, 64 nt, Human; identical to SEQ ID NO: 156446

SEQ ID NO: 157537 - RNA, 64 nt, Human; identical to SEQ ID NO: 156447

SEQ ID NO: 157538 - RNA, 64 nt, Human; identical to SEQ ID NO: 156448

SEQ ID NO: 157539 - RNA, 64 nt, Human; identical to SEQ ID NO: 156449

SEQ ID NO: 157540 - RNA, 64 nt, Human; identical to SEQ ID NO: 156450

SEQ ID NO: 157541 - RNA, 64 nt, Human; identical to SEQ ID NO: 156451

SEQ ID NO: 157542 - RNA, 64 nt, Human; identical to SEQ ID NO: 156452

SEQ ID NO: 157543 - RNA, 64 nt, Human; identical to SEQ ID NO: 156453

SEQ ID NO: 157544 - RNA, 64 nt, Human; identical to SEQ ID NO: 156454

SEQ ID NO: 157545 - RNA, 64 nt, Human; identical to SEQ ID NO: 156455

SEQ ID NO: 157546 - RNA, 64 nt, Human; identical to SEQ ID NO: 156456

SEQ ID NO: 157547 - RNA, 64 nt, Human; identical to SEQ ID NO: 156457

SEQ ID NO: 157548 - RNA, 64 nt, Human; identical to SEQ ID NO: 156458

SEQ ID NO: 157549 - RNA, 64 nt, Human; identical to SEQ ID NO: 156459

SEQ ID NO: 157550 - RNA, 64 nt, Human; identical to SEQ ID NO: 156460

SEQ ID NO: 157551 - RNA, 50 nt, Human; identical to SEQ ID NO: 153613

SEQ ID NO: 157552 - RNA, 64 nt, Human; identical to SEQ ID NO: 156462

SEQ ID NO: 157553 - RNA, 64 nt, Human; identical to SEQ ID NO: 156463

SEQ ID NO: 157554 - RNA, 64 nt, Human; identical to SEQ ID NO: 156464

SEQ ID NO: 157555 - RNA, 64 nt, Human; identical to SEQ ID NO: 156465

SEQ ID NO: 157556 - RNA, 64 nt, Human; identical to SEQ ID NO: 156466

SEQ ID NO: 157557 - RNA, 64 nt, Human; identical to SEQ ID NO: 156467

SEQ ID NO: 157558 - RNA, 64 nt, Human; identical to SEQ ID NO: 156468

SEQ ID NO: 157559 - RNA, 64 nt, Human; identical to SEQ ID NO: 156469

SEQ ID NO: 157560 - RNA, 64 nt, Human; identical to SEQ ID NO: 156470

SEQ ID NO: 157561 - RNA, 64 nt, Human; identical to SEQ ID NO: 156471

SEQ ID NO: 157562 - RNA, 64 nt, Human; identical to SEQ ID NO: 156472

SEQ ID NO: 157563 - RNA, 64 nt, Human; identical to SEQ ID NO: 156473

SEQ ID NO: 157564 - RNA, 64 nt, Human; identical to SEQ ID NO: 156474

SEQ ID NO: 157565 - RNA, 64 nt, Human; identical to SEQ ID NO: 156475

SEQ ID NO: 157566 - RNA, 64 nt, Human; identical to SEQ ID NO: 156476

SEQ ID NO: 157567 - RNA, 64 nt, Human; identical to SEQ ID NO: 156477

SEQ ID NO: 157568 - RNA, 64 nt, Human; identical to SEQ ID NO: 156478

SEQ ID NO: 157569 - RNA, 64 nt, Human; identical to SEQ ID NO: 156479

SEQ ID NO: 157570 - RNA, 64 nt, Human; identical to SEQ ID NO: 156480

SEQ ID NO: 157571 - RNA, 64 nt, Human; identical to SEQ ID NO: 156481

SEQ ID NO: 157572 - RNA, 64 nt, Human; identical to SEQ ID NO: 156482

SEQ ID NO: 157573 - RNA, 64 nt, Human; identical to SEQ ID NO: 156483

SEQ ID NO: 157574 - RNA, 54 nt, Human; identical to SEQ ID NO: 153636

SEQ ID NO: 157575 - RNA, 60 nt, Human; identical to SEQ ID NO: 153637

SEQ ID NO: 157576 - RNA, 64 nt, Human; identical to SEQ ID NO: 156486

SEQ ID NO: 157577 - RNA, 55 nt, Human; identical to SEQ ID NO: 153639

SEQ ID NO: 157578 - RNA, 64 nt, Human; identical to SEQ ID NO: 156488

SEQ ID NO: 157579 - RNA, 54 nt, Human; identical to SEQ ID NO: 153641

SEQ ID NO: 157580 - RNA, 64 nt, Human; identical to SEQ ID NO: 156490

SEQ ID NO: 157581 - RNA, 64 nt, Human; identical to SEQ ID NO: 156491

SEQ ID NO: 157582 - RNA, 64 nt, Human; identical to SEQ ID NO: 156492

SEQ ID NO: 157583 - RNA, 64 nt, Human; identical to SEQ ID NO: 156493

SEQ ID NO: 157584 - RNA, 64 nt, Human; identical to SEQ ID NO: 156494

SEQ ID NO: 157585 - RNA, 64 nt, Human; identical to SEQ ID NO: 156495

SEQ ID NO: 157586 - RNA, 64 nt, Human; identical to SEQ ID NO: 156496

SEQ ID NO: 157587 - RNA, 64 nt, Human; identical to SEQ ID NO: 156497

SEQ ID NO: 157588 - RNA, 64 nt, Human; identical to SEQ ID NO: 156498

SEQ ID NO: 157589 - RNA, 64 nt, Human; identical to SEQ ID NO: 156499

SEQ ID NO: 157590 - RNA, 64 nt, Human; identical to SEQ ID NO: 156500

SEQ ID NO: 157591 - RNA, 64 nt, Human; identical to SEQ ID NO: 156501

SEQ ID NO: 157592 - RNA, 64 nt, Human; identical to SEQ ID NO: 156502

SEQ ID NO: 157593 - RNA, 64 nt, Human; identical to SEQ ID NO: 156503

SEQ ID NO: 157594 - RNA, 64 nt, Human; identical to SEQ ID NO: 156504

SEQ ID NO: 157595 - RNA, 64 nt, Human; identical to SEQ ID NO: 156505

SEQ ID NO: 157596 - RNA, 64 nt, Human; identical to SEQ ID NO: 156506

SEQ ID NO: 157597 - RNA, 64 nt, Human; identical to SEQ ID NO: 156507

SEQ ID NO: 157598 - RNA, 64 nt, Human; identical to SEQ ID NO: 156508

SEQ ID NO: 157599 - RNA, 64 nt, Human; identical to SEQ ID NO: 156509

SEQ ID NO: 157600 - RNA, 64 nt, Human; identical to SEQ ID NO: 156510

SEQ ID NO: 157601 - RNA, 58 nt, Human; identical to SEQ ID NO: 153663

SEQ ID NO: 157602 - RNA, 64 nt, Human; identical to SEQ ID NO: 156512

SEQ ID NO: 157603 - RNA, 64 nt, Human; identical to SEQ ID NO: 156513

SEQ ID NO: 157604 - RNA, 57 nt, Human; identical to SEQ ID NO: 153666

SEQ ID NO: 157605 - RNA, 64 nt, Human; identical to SEQ ID NO: 156515

SEQ ID NO: 157606 - RNA, 64 nt, Human; identical to SEQ ID NO: 156516

SEQ ID NO: 157607 - RNA, 64 nt, Human; identical to SEQ ID NO: 156517

SEQ ID NO: 157608 - RNA, 64 nt, Human; identical to SEQ ID NO: 156518

SEQ ID NO: 157609 - RNA, 64 nt, Human; identical to SEQ ID NO: 156519

SEQ ID NO: 157610 - RNA, 64 nt, Human; identical to SEQ ID NO: 156520

SEQ ID NO: 157611 - RNA, 64 nt, Human; identical to SEQ ID NO: 156521

SEQ ID NO: 157612 - RNA, 64 nt, Human; identical to SEQ ID NO: 156522

SEQ ID NO: 157613 - RNA, 64 nt, Human; identical to SEQ ID NO: 156523

SEQ ID NO: 157614 - RNA, 64 nt, Human; identical to SEQ ID NO: 156524

SEQ ID NO: 157615 - RNA, 64 nt, Human; identical to SEQ ID NO: 156525

SEQ ID NO: 157616 - RNA, 64 nt, Human; identical to SEQ ID NO: 156526

SEQ ID NO: 157617 - RNA, 64 nt, Human; identical to SEQ ID NO: 156527

SEQ ID NO: 157618 - RNA, 64 nt, Human; identical to SEQ ID NO: 156528

SEQ ID NO: 157619 - RNA, 64 nt, Human; identical to SEQ ID NO: 156529

SEQ ID NO: 157620 - RNA, 64 nt, Human; identical to SEQ ID NO: 156530

SEQ ID NO: 157621 - RNA, 64 nt, Human; identical to SEQ ID NO: 156531

SEQ ID NO: 157622 - RNA, 64 nt, Human; identical to SEQ ID NO: 156532

SEQ ID NO: 157623 - RNA, 64 nt, Human; identical to SEQ ID NO: 156533

SEQ ID NO: 157624 - RNA, 64 nt, Human; identical to SEQ ID NO: 156534

SEQ ID NO: 157625 - RNA, 64 nt, Human; identical to SEQ ID NO: 156535

SEQ ID NO: 157626 - RNA, 64 nt, Human; identical to SEQ ID NO: 156536

SEQ ID NO: 157627 - RNA, 64 nt, Human; identical to SEQ ID NO: 156537

SEQ ID NO: 157628 - RNA, 64 nt, Human; identical to SEQ ID NO: 156538

SEQ ID NO: 157629 - RNA, 64 nt, Human; identical to SEQ ID NO: 156539

SEQ ID NO: 157630 - RNA, 64 nt, Human; identical to SEQ ID NO: 156540

SEQ ID NO: 157631 - RNA, 64 nt, Human; identical to SEQ ID NO: 156541

SEQ ID NO: 157632 - RNA, 64 nt, Human; identical to SEQ ID NO: 156542

SEQ ID NO: 157633 - RNA, 64 nt, Human; identical to SEQ ID NO: 156543

SEQ ID NO: 157634 - RNA, 64 nt, Human; identical to SEQ ID NO: 156544

SEQ ID NO: 157635 - RNA, 64 nt, Human; identical to SEQ ID NO: 156545

SEQ ID NO: 157636 - RNA, 64 nt, Human; identical to SEQ ID NO: 156546

SEQ ID NO: 157637 - RNA, 64 nt, Human; identical to SEQ ID NO: 156547

SEQ ID NO: 157638 - RNA, 64 nt, Human; identical to SEQ ID NO: 156548

SEQ ID NO: 157639 - RNA, 64 nt, Human; identical to SEQ ID NO: 156549

SEQ ID NO: 157640 - RNA, 64 nt, Human; identical to SEQ ID NO: 156550

SEQ ID NO: 157641 - RNA, 64 nt, Human; identical to SEQ ID NO: 156551

SEQ ID NO: 157642 - RNA, 64 nt, Human; identical to SEQ ID NO: 156552

SEQ ID NO: 157643 - RNA, 64 nt, Human; identical to SEQ ID NO: 156553

SEQ ID NO: 157644 - RNA, 64 nt, Human; identical to SEQ ID NO: 156554

SEQ ID NO: 157645 - RNA, 64 nt, Human; identical to SEQ ID NO: 156555

SEQ ID NO: 157646 - RNA, 64 nt, Human; identical to SEQ ID NO: 156556

SEQ ID NO: 157647 - RNA, 64 nt, Human; identical to SEQ ID NO: 156557

SEQ ID NO: 157648 - RNA, 64 nt, Human; identical to SEQ ID NO: 156558

SEQ ID NO: 157649 - RNA, 64 nt, Human; identical to SEQ ID NO: 156559

SEQ ID NO: 157650 - RNA, 64 nt, Human; identical to SEQ ID NO: 156560

SEQ ID NO: 157651 - RNA, 64 nt, Human; identical to SEQ ID NO: 156561

SEQ ID NO: 157652 - RNA, 64 nt, Human; identical to SEQ ID NO: 156562

SEQ ID NO: 157653 - RNA, 64 nt, Human; identical to SEQ ID NO: 156563

SEQ ID NO: 157654 - RNA, 64 nt, Human; identical to SEQ ID NO: 156564

SEQ ID NO: 157655 - RNA, 64 nt, Human; identical to SEQ ID NO: 156565

SEQ ID NO: 157656 - RNA, 64 nt, Human; identical to SEQ ID NO: 156566

SEQ ID NO: 157657 - RNA, 64 nt, Human; identical to SEQ ID NO: 156567

SEQ ID NO: 157658 - RNA, 64 nt, Human; identical to SEQ ID NO: 156568

SEQ ID NO: 157659 - RNA, 64 nt, Human; identical to SEQ ID NO: 156569

SEQ ID NO: 157660 - RNA, 64 nt, Human; identical to SEQ ID NO: 156570

SEQ ID NO: 157661 - RNA, 64 nt, Human; identical to SEQ ID NO: 156571

SEQ ID NO: 157662 - RNA, 64 nt, Human; identical to SEQ ID NO: 156572

SEQ ID NO: 157663 - RNA, 64 nt, Human; identical to SEQ ID NO: 156573

SEQ ID NO: 157664 - RNA, 64 nt, Human; identical to SEQ ID NO: 156574

SEQ ID NO: 157665 - RNA, 64 nt, Human; identical to SEQ ID NO: 156575

SEQ ID NO: 157666 - RNA, 64 nt, Human; identical to SEQ ID NO: 156576

SEQ ID NO: 157667 - RNA, 51 nt, Human; identical to SEQ ID NO: 156577

SEQ ID NO: 157668 - RNA, 64 nt, Human; identical to SEQ ID NO: 156578

SEQ ID NO: 157669 - RNA, 64 nt, Human; identical to SEQ ID NO: 156579

SEQ ID NO: 157670 - RNA, 64 nt, Human; identical to SEQ ID NO: 156580

SEQ ID NO: 157671 - RNA, 64 nt, Human; identical to SEQ ID NO: 156581

SEQ ID NO: 157672 - RNA, 64 nt, Human; identical to SEQ ID NO: 156582

SEQ ID NO: 157673 - RNA, 64 nt, Human; identical to SEQ ID NO: 156583

SEQ ID NO: 157674 - RNA, 64 nt, Human; identical to SEQ ID NO: 156584

SEQ ID NO: 157675 - RNA, 64 nt, Human; identical to SEQ ID NO: 156585

SEQ ID NO: 157676 - RNA, 64 nt, Human; identical to SEQ ID NO: 156586

SEQ ID NO: 157677 - RNA, 64 nt, Human; identical to SEQ ID NO: 156587

SEQ ID NO: 157678 - RNA, 64 nt, Human; identical to SEQ ID NO: 156588

SEQ ID NO: 157679 - RNA, 64 nt, Human; identical to SEQ ID NO: 156589

SEQ ID NO: 157680 - RNA, 64 nt, Human; identical to SEQ ID NO: 156590

SEQ ID NO: 157681 - RNA, 64 nt, Human; identical to SEQ ID NO: 156591

SEQ ID NO: 157682 - RNA, 64 nt, Human; identical to SEQ ID NO: 156592

SEQ ID NO: 157683 - RNA, 64 nt, Human; identical to SEQ ID NO: 156593

SEQ ID NO: 157684 - RNA, 64 nt, Human; identical to SEQ ID NO: 156594

SEQ ID NO: 157685 - RNA, 64 nt, Human; identical to SEQ ID NO: 156595

SEQ ID NO: 157686 - RNA, 64 nt, Human; identical to SEQ ID NO: 156596

SEQ ID NO: 157687 - RNA, 64 nt, Human; identical to SEQ ID NO: 156597

SEQ ID NO: 157688 - RNA, 64 nt, Human; identical to SEQ ID NO: 156598

SEQ ID NO: 157689 - RNA, 64 nt, Human; identical to SEQ ID NO: 156599

SEQ ID NO: 157690 - RNA, 64 nt, Human; identical to SEQ ID NO: 156600

SEQ ID NO: 157691 - RNA, 64 nt, Human; identical to SEQ ID NO: 156601

SEQ ID NO: 157692 - RNA, 64 nt, Human; identical to SEQ ID NO: 156602

SEQ ID NO: 157693 - RNA, 64 nt, Human; identical to SEQ ID NO: 156603

SEQ ID NO: 157694 - RNA, 64 nt, Human; identical to SEQ ID NO: 156604

SEQ ID NO: 157695 - RNA, 64 nt, Human; identical to SEQ ID NO: 156605

SEQ ID NO: 157696 - RNA, 64 nt, Human; identical to SEQ ID NO: 156606

SEQ ID NO: 157697 - RNA, 64 nt, Human; identical to SEQ ID NO: 156607

SEQ ID NO: 157698 - RNA, 64 nt, Human; identical to SEQ ID NO: 156608

SEQ ID NO: 157699 - RNA, 64 nt, Human; identical to SEQ ID NO: 156609

SEQ ID NO: 157700 - RNA, 64 nt, Human; identical to SEQ ID NO: 156610

SEQ ID NO: 157701 - RNA, 64 nt, Human; identical to SEQ ID NO: 156611

SEQ ID NO: 157702 - RNA, 64 nt, Human; identical to SEQ ID NO: 156612

SEQ ID NO: 157703 - RNA, 64 nt, Human; identical to SEQ ID NO: 156613

SEQ ID NO: 157704 - RNA, 64 nt, Human; identical to SEQ ID NO: 156614

SEQ ID NO: 157705 - RNA, 64 nt, Human; identical to SEQ ID NO: 156615

SEQ ID NO: 157706 - RNA, 64 nt, Human; identical to SEQ ID NO: 156616

SEQ ID NO: 157707 - RNA, 64 nt, Human; identical to SEQ ID NO: 156617

SEQ ID NO: 157708 - RNA, 64 nt, Human; identical to SEQ ID NO: 156618

SEQ ID NO: 157709 - RNA, 64 nt, Human; identical to SEQ ID NO: 156619

SEQ ID NO: 157710 - RNA, 64 nt, Human; identical to SEQ ID NO: 156620

SEQ ID NO: 157711 - RNA, 64 nt, Human; identical to SEQ ID NO: 156621

SEQ ID NO: 157712 - RNA, 64 nt, Human; identical to SEQ ID NO: 156622

SEQ ID NO: 157713 - RNA, 64 nt, Human; identical to SEQ ID NO: 156623

SEQ ID NO: 157714 - RNA, 64 nt, Human; identical to SEQ ID NO: 156624

SEQ ID NO: 157715 - RNA, 64 nt, Human; identical to SEQ ID NO: 156625

SEQ ID NO: 157716 - RNA, 64 nt, Human; identical to SEQ ID NO: 156626

SEQ ID NO: 157717 - RNA, 64 nt, Human; identical to SEQ ID NO: 156627

SEQ ID NO: 157718 - RNA, 64 nt, Human; identical to SEQ ID NO: 156628

SEQ ID NO: 157719 - RNA, 64 nt, Human; identical to SEQ ID NO: 156629

SEQ ID NO: 157720 - RNA, 64 nt, Human; identical to SEQ ID NO: 156630

SEQ ID NO: 157721 - RNA, 64 nt, Human; identical to SEQ ID NO: 156631

SEQ ID NO: 157722 - RNA, 64 nt, Human; identical to SEQ ID NO: 156632

SEQ ID NO: 157723 - RNA, 64 nt, Human; identical to SEQ ID NO: 156633

SEQ ID NO: 157724 - RNA, 64 nt, Human; identical to SEQ ID NO: 156634

SEQ ID NO: 157725 - RNA, 64 nt, Human; identical to SEQ ID NO: 156635

SEQ ID NO: 157726 - RNA, 64 nt, Human; identical to SEQ ID NO: 156636

SEQ ID NO: 157727 - RNA, 64 nt, Human; identical to SEQ ID NO: 156637

SEQ ID NO: 157728 - RNA, 64 nt, Human; identical to SEQ ID NO: 156638

SEQ ID NO: 157729 - RNA, 64 nt, Human; identical to SEQ ID NO: 156639

SEQ ID NO: 157730 - RNA, 64 nt, Human; identical to SEQ ID NO: 156640

SEQ ID NO: 157731 - RNA, 64 nt, Human; identical to SEQ ID NO: 156641

SEQ ID NO: 157732 - RNA, 64 nt, Human; identical to SEQ ID NO: 156642

SEQ ID NO: 157733 - RNA, 64 nt, Human; identical to SEQ ID NO: 156643

SEQ ID NO: 157734 - RNA, 64 nt, Human; identical to SEQ ID NO: 156644

SEQ ID NO: 157735 - RNA, 64 nt, Human; identical to SEQ ID NO: 156645

SEQ ID NO: 157736 - RNA, 64 nt, Human; identical to SEQ ID NO: 156646

SEQ ID NO: 157737 - RNA, 64 nt, Human; identical to SEQ ID NO: 156647

SEQ ID NO: 157738 - RNA, 64 nt, Human; identical to SEQ ID NO: 156648

SEQ ID NO: 157739 - RNA, 64 nt, Human; identical to SEQ ID NO: 156649

SEQ ID NO: 157740 - RNA, 64 nt, Human; identical to SEQ ID NO: 156650

SEQ ID NO: 157741 - RNA, 64 nt, Human; identical to SEQ ID NO: 156651

SEQ ID NO: 157742 - RNA, 64 nt, Human; identical to SEQ ID NO: 156652

SEQ ID NO: 157743 - RNA, 64 nt, Human; identical to SEQ ID NO: 156653

SEQ ID NO: 157744 - RNA, 64 nt, Human; identical to SEQ ID NO: 156654

SEQ ID NO: 157745 - RNA, 64 nt, Human; identical to SEQ ID NO: 156655

SEQ ID NO: 157746 - RNA, 64 nt, Human; identical to SEQ ID NO: 156656

SEQ ID NO: 157747 - RNA, 64 nt, Human; identical to SEQ ID NO: 156657

SEQ ID NO: 157748 - RNA, 51 nt, Human; identical to SEQ ID NO: 156658

SEQ ID NO: 157749 - RNA, 64 nt, Human; identical to SEQ ID NO: 156659

SEQ ID NO: 157750 - RNA, 64 nt, Human; identical to SEQ ID NO: 156660

SEQ ID NO: 157751 - RNA, 64 nt, Human; identical to SEQ ID NO: 156661

SEQ ID NO: 157752 - RNA, 64 nt, Human; identical to SEQ ID NO: 156662

SEQ ID NO: 157753 - RNA, 64 nt, Human; identical to SEQ ID NO: 156663

SEQ ID NO: 157754 - RNA, 64 nt, Human; identical to SEQ ID NO: 156664

SEQ ID NO: 157755 - RNA, 64 nt, Human; identical to SEQ ID NO: 156665

SEQ ID NO: 157756 - RNA, 64 nt, Human; identical to SEQ ID NO: 156666

SEQ ID NO: 157757 - RNA, 64 nt, Human; identical to SEQ ID NO: 156667

SEQ ID NO: 157758 - RNA, 64 nt, Human; identical to SEQ ID NO: 156668

SEQ ID NO: 157759 - RNA, 64 nt, Human; identical to SEQ ID NO: 156669

SEQ ID NO: 157760 - RNA, 64 nt, Human; identical to SEQ ID NO: 156670

SEQ ID NO: 157761 - RNA, 64 nt, Human; identical to SEQ ID NO: 156671

SEQ ID NO: 157762 - RNA, 64 nt, Human; identical to SEQ ID NO: 156672

SEQ ID NO: 157763 - RNA, 64 nt, Human; identical to SEQ ID NO: 156673

SEQ ID NO: 157764 - RNA, 64 nt, Human; identical to SEQ ID NO: 156674

SEQ ID NO: 157765 - RNA, 64 nt, Human; identical to SEQ ID NO: 156675

SEQ ID NO: 157766 - RNA, 64 nt, Human; identical to SEQ ID NO: 156676

SEQ ID NO: 157767 - RNA, 64 nt, Human; identical to SEQ ID NO: 156677

SEQ ID NO: 157768 - RNA, 64 nt, Human; identical to SEQ ID NO: 156678

SEQ ID NO: 157769 - RNA, 64 nt, Human; identical to SEQ ID NO: 156679

SEQ ID NO: 157770 - RNA, 64 nt, Human; identical to SEQ ID NO: 156680

SEQ ID NO: 157771 - RNA, 64 nt, Human; identical to SEQ ID NO: 156681

SEQ ID NO: 157772 - RNA, 64 nt, Human; identical to SEQ ID NO: 156682

SEQ ID NO: 157773 - RNA, 64 nt, Human; identical to SEQ ID NO: 156683

SEQ ID NO: 157774 - RNA, 64 nt, Human; identical to SEQ ID NO: 156684

SEQ ID NO: 157775 - RNA, 64 nt, Human; identical to SEQ ID NO: 156685

SEQ ID NO: 157776 - RNA, 64 nt, Human; identical to SEQ ID NO: 156686

SEQ ID NO: 157777 - RNA, 64 nt, Human; identical to SEQ ID NO: 156687

SEQ ID NO: 157778 - RNA, 64 nt, Human; identical to SEQ ID NO: 156688

SEQ ID NO: 157779 - RNA, 64 nt, Human; identical to SEQ ID NO: 156689

SEQ ID NO: 157780 - RNA, 64 nt, Human; identical to SEQ ID NO: 156690

SEQ ID NO: 157781 - RNA, 64 nt, Human; identical to SEQ ID NO: 156691

SEQ ID NO: 157782 - RNA, 64 nt, Human; identical to SEQ ID NO: 156692

SEQ ID NO: 157783 - RNA, 64 nt, Human; identical to SEQ ID NO: 156693

SEQ ID NO: 157784 - RNA, 64 nt, Human; identical to SEQ ID NO: 156694

SEQ ID NO: 157785 - RNA, 64 nt, Human; identical to SEQ ID NO: 156695

SEQ ID NO: 157786 - RNA, 64 nt, Human; identical to SEQ ID NO: 156696

SEQ ID NO: 157787 - RNA, 53 nt, Human; identical to SEQ ID NO: 156697

SEQ ID NO: 157788 - RNA, 64 nt, Human; identical to SEQ ID NO: 156698

SEQ ID NO: 157789 - RNA, 64 nt, Human; identical to SEQ ID NO: 156699

SEQ ID NO: 157790 - RNA, 64 nt, Human; identical to SEQ ID NO: 156700

SEQ ID NO: 157791 - RNA, 64 nt, Human; identical to SEQ ID NO: 156701

SEQ ID NO: 157792 - RNA, 64 nt, Human; identical to SEQ ID NO: 156702

SEQ ID NO: 157793 - RNA, 64 nt, Human; identical to SEQ ID NO: 156703

SEQ ID NO: 157794 - RNA, 64 nt, Human; identical to SEQ ID NO: 156704

SEQ ID NO: 157795 - RNA, 64 nt, Human; identical to SEQ ID NO: 156705

SEQ ID NO: 157796 - RNA, 64 nt, Human; identical to SEQ ID NO: 156706

SEQ ID NO: 157797 - RNA, 64 nt, Human; identical to SEQ ID NO: 156707

SEQ ID NO: 157798 - RNA, 64 nt, Human; identical to SEQ ID NO: 156708

SEQ ID NO: 157799 - RNA, 64 nt, Human; identical to SEQ ID NO: 156709

SEQ ID NO: 157800 - RNA, 64 nt, Human; identical to SEQ ID NO: 156710

SEQ ID NO: 157801 - RNA, 64 nt, Human; identical to SEQ ID NO: 156711

SEQ ID NO: 157802 - RNA, 64 nt, Human; identical to SEQ ID NO: 156712

SEQ ID NO: 157803 - RNA, 64 nt, Human; identical to SEQ ID NO: 156713

SEQ ID NO: 157804 - RNA, 64 nt, Human; identical to SEQ ID NO: 156714

SEQ ID NO: 157805 - RNA, 64 nt, Human; identical to SEQ ID NO: 156715

SEQ ID NO: 157806 - RNA, 64 nt, Human; identical to SEQ ID NO: 156716

SEQ ID NO: 157807 - RNA, 64 nt, Human; identical to SEQ ID NO: 156717

SEQ ID NO: 157808 - RNA, 64 nt, Human; identical to SEQ ID NO: 156718

SEQ ID NO: 157809 - RNA, 64 nt, Human; identical to SEQ ID NO: 156719

SEQ ID NO: 157810 - RNA, 64 nt, Human; identical to SEQ ID NO: 156720

SEQ ID NO: 157811 - RNA, 64 nt, Human; identical to SEQ ID NO: 156721

SEQ ID NO: 157812 - RNA, 64 nt, Human; identical to SEQ ID NO: 156722

SEQ ID NO: 157813 - RNA, 64 nt, Human; identical to SEQ ID NO: 156723

SEQ ID NO: 157814 - RNA, 64 nt, Human; identical to SEQ ID NO: 156724

SEQ ID NO: 157815 - RNA, 64 nt, Human; identical to SEQ ID NO: 156725

SEQ ID NO: 157816 - RNA, 64 nt, Human; identical to SEQ ID NO: 156726

SEQ ID NO: 157817 - RNA, 64 nt, Human; identical to SEQ ID NO: 156727

SEQ ID NO: 157818 - RNA, 64 nt, Human; identical to SEQ ID NO: 156728

SEQ ID NO: 157819 - RNA, 64 nt, Human; identical to SEQ ID NO: 156729

SEQ ID NO: 157820 - RNA, 64 nt, Human; identical to SEQ ID NO: 156730

SEQ ID NO: 157821 - RNA, 64 nt, Human; identical to SEQ ID NO: 156731

SEQ ID NO: 157822 - RNA, 64 nt, Human; identical to SEQ ID NO: 156732

SEQ ID NO: 157823 - RNA, 64 nt, Human; identical to SEQ ID NO: 156733

SEQ ID NO: 157824 - RNA, 64 nt, Human; identical to SEQ ID NO: 156734

SEQ ID NO: 157825 - RNA, 64 nt, Human; identical to SEQ ID NO: 156735

SEQ ID NO: 157826 - RNA, 64 nt, Human; identical to SEQ ID NO: 156736

SEQ ID NO: 157827 - RNA, 64 nt, Human; identical to SEQ ID NO: 156737

SEQ ID NO: 157828 - RNA, 64 nt, Human; identical to SEQ ID NO: 156738

SEQ ID NO: 157829 - RNA, 64 nt, Human; identical to SEQ ID NO: 156739

SEQ ID NO: 157830 - RNA, 64 nt, Human; identical to SEQ ID NO: 156740

SEQ ID NO: 157831 - RNA, 64 nt, Human; identical to SEQ ID NO: 156741

SEQ ID NO: 157832 - RNA, 64 nt, Human; identical to SEQ ID NO: 156742

SEQ ID NO: 157833 - RNA, 64 nt, Human; identical to SEQ ID NO: 156743

SEQ ID NO: 157834 - RNA, 64 nt, Human; identical to SEQ ID NO: 156744

SEQ ID NO: 157835 - RNA, 64 nt, Human; identical to SEQ ID NO: 156745

SEQ ID NO: 157836 - RNA, 64 nt, Human; identical to SEQ ID NO: 156746

SEQ ID NO: 157837 - RNA, 64 nt, Human; identical to SEQ ID NO: 156747

SEQ ID NO: 157838 - RNA, 64 nt, Human; identical to SEQ ID NO: 156748

SEQ ID NO: 157839 - RNA, 64 nt, Human; identical to SEQ ID NO: 156749

SEQ ID NO: 157840 - RNA, 64 nt, Human; identical to SEQ ID NO: 156750

SEQ ID NO: 157841 - RNA, 64 nt, Human; identical to SEQ ID NO: 156751

SEQ ID NO: 157842 - RNA, 64 nt, Human; identical to SEQ ID NO: 156752

SEQ ID NO: 157843 - RNA, 64 nt, Human; identical to SEQ ID NO: 156753

SEQ ID NO: 157844 - RNA, 64 nt, Human; identical to SEQ ID NO: 156754

SEQ ID NO: 157845 - RNA, 64 nt, Human; identical to SEQ ID NO: 156755

SEQ ID NO: 157846 - RNA, 64 nt, Human; identical to SEQ ID NO: 156756

SEQ ID NO: 157847 - RNA, 64 nt, Human; identical to SEQ ID NO: 156757

SEQ ID NO: 157848 - RNA, 64 nt, Human; identical to SEQ ID NO: 156758

SEQ ID NO: 157849 - RNA, 64 nt, Human; identical to SEQ ID NO: 156759

SEQ ID NO: 157850 - RNA, 64 nt, Human; identical to SEQ ID NO: 156760

SEQ ID NO: 157851 - RNA, 64 nt, Human; identical to SEQ ID NO: 156761

SEQ ID NO: 157852 - RNA, 64 nt, Human; identical to SEQ ID NO: 156762

SEQ ID NO: 157853 - RNA, 64 nt, Human; identical to SEQ ID NO: 156763

SEQ ID NO: 157854 - RNA, 64 nt, Human; identical to SEQ ID NO: 156764

SEQ ID NO: 157855 - RNA, 64 nt, Human; identical to SEQ ID NO: 156765

SEQ ID NO: 157856 - RNA, 64 nt, Human; identical to SEQ ID NO: 156766

SEQ ID NO: 157857 - RNA, 64 nt, Human; identical to SEQ ID NO: 156767

SEQ ID NO: 157858 - RNA, 64 nt, Human; identical to SEQ ID NO: 156768

SEQ ID NO: 157859 - RNA, 64 nt, Human; identical to SEQ ID NO: 156769

SEQ ID NO: 157860 - RNA, 64 nt, Human; identical to SEQ ID NO: 156770

SEQ ID NO: 157861 - RNA, 64 nt, Human; identical to SEQ ID NO: 156771

SEQ ID NO: 157862 - RNA, 64 nt, Human; identical to SEQ ID NO: 156772

SEQ ID NO: 157863 - RNA, 64 nt, Human; identical to SEQ ID NO: 156773

SEQ ID NO: 157864 - RNA, 64 nt, Human; identical to SEQ ID NO: 156774

SEQ ID NO: 157865 - RNA, 64 nt, Human; identical to SEQ ID NO: 156775

SEQ ID NO: 157866 - RNA, 64 nt, Human; identical to SEQ ID NO: 156776

SEQ ID NO: 157867 - RNA, 64 nt, Human; identical to SEQ ID NO: 156777

SEQ ID NO: 157868 - RNA, 64 nt, Human; identical to SEQ ID NO: 156778

SEQ ID NO: 157869 - RNA, 64 nt, Human; identical to SEQ ID NO: 156779

SEQ ID NO: 157870 - RNA, 64 nt, Human; identical to SEQ ID NO: 156780

SEQ ID NO: 157871 - RNA, 64 nt, Human; identical to SEQ ID NO: 156781

SEQ ID NO: 157872 - RNA, 64 nt, Human; identical to SEQ ID NO: 156782

SEQ ID NO: 157873 - RNA, 64 nt, Human; identical to SEQ ID NO: 156783

SEQ ID NO: 157874 - RNA, 64 nt, Human; identical to SEQ ID NO: 156784

SEQ ID NO: 157875 - RNA, 64 nt, Human; identical to SEQ ID NO: 156785

SEQ ID NO: 157876 - RNA, 64 nt, Human; identical to SEQ ID NO: 156786

SEQ ID NO: 157877 - RNA, 64 nt, Human; identical to SEQ ID NO: 156787

SEQ ID NO: 157878 - RNA, 64 nt, Human; identical to SEQ ID NO: 156788

SEQ ID NO: 157879 - RNA, 64 nt, Human; identical to SEQ ID NO: 156789

SEQ ID NO: 157880 - RNA, 64 nt, Human; identical to SEQ ID NO: 156790

SEQ ID NO: 157881 - RNA, 64 nt, Human; identical to SEQ ID NO: 156791

SEQ ID NO: 157882 - RNA, 64 nt, Human; identical to SEQ ID NO: 156792

SEQ ID NO: 157883 - RNA, 64 nt, Human; identical to SEQ ID NO: 156793

SEQ ID NO: 157884 - RNA, 64 nt, Human; identical to SEQ ID NO: 156794

SEQ ID NO: 157885 - RNA, 64 nt, Human; identical to SEQ ID NO: 156795

SEQ ID NO: 157886 - RNA, 64 nt, Human; identical to SEQ ID NO: 156796

SEQ ID NO: 157887 - RNA, 64 nt, Human; identical to SEQ ID NO: 156797

SEQ ID NO: 157888 - RNA, 64 nt, Human; identical to SEQ ID NO: 156798

SEQ ID NO: 157889 - RNA, 64 nt, Human; identical to SEQ ID NO: 156799

SEQ ID NO: 157890 - RNA, 64 nt, Human; identical to SEQ ID NO: 156800

SEQ ID NO: 157891 - RNA, 64 nt, Human; identical to SEQ ID NO: 156801

SEQ ID NO: 157892 - RNA, 64 nt, Human; identical to SEQ ID NO: 156802

SEQ ID NO: 157893 - RNA, 64 nt, Human; identical to SEQ ID NO: 156803

SEQ ID NO: 157894 - RNA, 64 nt, Human; identical to SEQ ID NO: 156804

SEQ ID NO: 157895 - RNA, 64 nt, Human; identical to SEQ ID NO: 156805

SEQ ID NO: 157896 - RNA, 64 nt, Human; identical to SEQ ID NO: 156806

SEQ ID NO: 157897 - RNA, 64 nt, Human; identical to SEQ ID NO: 156807

SEQ ID NO: 157898 - RNA, 64 nt, Human; identical to SEQ ID NO: 156808

SEQ ID NO: 157899 - RNA, 64 nt, Human; identical to SEQ ID NO: 156809

SEQ ID NO: 157900 - RNA, 64 nt, Human; identical to SEQ ID NO: 156810

SEQ ID NO: 157901 - RNA, 64 nt, Human; identical to SEQ ID NO: 156811

SEQ ID NO: 157902 - RNA, 64 nt, Human; identical to SEQ ID NO: 156812

SEQ ID NO: 157903 - RNA, 64 nt, Human; identical to SEQ ID NO: 156813

SEQ ID NO: 157904 - RNA, 64 nt, Human; identical to SEQ ID NO: 156814

SEQ ID NO: 157905 - RNA, 64 nt, Human; identical to SEQ ID NO: 156815

SEQ ID NO: 157906 - RNA, 64 nt, Human; identical to SEQ ID NO: 156816

SEQ ID NO: 157907 - RNA, 64 nt, Human; identical to SEQ ID NO: 156817

SEQ ID NO: 157908 - RNA, 64 nt, Human; identical to SEQ ID NO: 156818

SEQ ID NO: 157909 - RNA, 64 nt, Human; identical to SEQ ID NO: 156819

SEQ ID NO: 157910 - RNA, 64 nt, Human; identical to SEQ ID NO: 156820

SEQ ID NO: 157911 - RNA, 64 nt, Human; identical to SEQ ID NO: 156821

SEQ ID NO: 157912 - RNA, 64 nt, Human; identical to SEQ ID NO: 156822

SEQ ID NO: 157913 - RNA, 64 nt, Human; identical to SEQ ID NO: 156823

SEQ ID NO: 157914 - RNA, 64 nt, Human; identical to SEQ ID NO: 156824

SEQ ID NO: 157915 - RNA, 64 nt, Human; identical to SEQ ID NO: 156825

SEQ ID NO: 157916 - RNA, 64 nt, Human; identical to SEQ ID NO: 156826

SEQ ID NO: 157917 - RNA, 64 nt, Human; identical to SEQ ID NO: 156827

SEQ ID NO: 157918 - RNA, 64 nt, Human; identical to SEQ ID NO: 156828

SEQ ID NO: 157919 - RNA, 64 nt, Human; identical to SEQ ID NO: 156829

SEQ ID NO: 157920 - RNA, 64 nt, Human; identical to SEQ ID NO: 156830

SEQ ID NO: 157921 - RNA, 64 nt, Human; identical to SEQ ID NO: 156831

SEQ ID NO: 157922 - RNA, 64 nt, Human; identical to SEQ ID NO: 156832

SEQ ID NO: 157923 - RNA, 64 nt, Human; identical to SEQ ID NO: 156833

SEQ ID NO: 157924 - RNA, 64 nt, Human; identical to SEQ ID NO: 156834

SEQ ID NO: 157925 - RNA, 64 nt, Human; identical to SEQ ID NO: 156835

SEQ ID NO: 157926 - RNA, 64 nt, Human; identical to SEQ ID NO: 156836

SEQ ID NO: 157927 - RNA, 64 nt, Human; identical to SEQ ID NO: 156837

SEQ ID NO: 157928 - RNA, 64 nt, Human; identical to SEQ ID NO: 156838

SEQ ID NO: 157929 - RNA, 64 nt, Human; identical to SEQ ID NO: 156839

SEQ ID NO: 157930 - RNA, 64 nt, Human; identical to SEQ ID NO: 156840

SEQ ID NO: 157931 - RNA, 55 nt, Human; identical to SEQ ID NO: 156841

SEQ ID NO: 157932 - RNA, 64 nt, Human; identical to SEQ ID NO: 156842

SEQ ID NO: 157933 - RNA, 64 nt, Human; identical to SEQ ID NO: 156843

SEQ ID NO: 157934 - RNA, 61 nt, Human; identical to SEQ ID NO: 156844

SEQ ID NO: 157935 - RNA, 64 nt, Human; identical to SEQ ID NO: 156845

SEQ ID NO: 157936 - RNA, 64 nt, Human; identical to SEQ ID NO: 156846

SEQ ID NO: 157937 - RNA, 64 nt, Human; identical to SEQ ID NO: 156847

SEQ ID NO: 157938 - RNA, 64 nt, Human; identical to SEQ ID NO: 156848

SEQ ID NO: 157939 - RNA, 64 nt, Human; identical to SEQ ID NO: 156849

SEQ ID NO: 157940 - RNA, 64 nt, Human; identical to SEQ ID NO: 156850

SEQ ID NO: 157941 - RNA, 64 nt, Human; identical to SEQ ID NO: 156851

SEQ ID NO: 157942 - RNA, 63 nt, Human; identical to SEQ ID NO: 156852

SEQ ID NO: 157943 - RNA, 64 nt, Human; identical to SEQ ID NO: 156853

SEQ ID NO: 157944 - RNA, 64 nt, Human; identical to SEQ ID NO: 156854

SEQ ID NO: 157945 - RNA, 64 nt, Human; identical to SEQ ID NO: 156855

SEQ ID NO: 157946 - RNA, 64 nt, Human; identical to SEQ ID NO: 156856

SEQ ID NO: 157947 - RNA, 64 nt, Human; identical to SEQ ID NO: 156857

SEQ ID NO: 157948 - RNA, 64 nt, Human; identical to SEQ ID NO: 156858

SEQ ID NO: 157949 - RNA, 64 nt, Human; identical to SEQ ID NO: 156859

SEQ ID NO: 157950 - RNA, 64 nt, Human; identical to SEQ ID NO: 156860

SEQ ID NO: 157951 - RNA, 64 nt, Human; identical to SEQ ID NO: 156861

SEQ ID NO: 157952 - RNA, 60 nt, Human; identical to SEQ ID NO: 156862

SEQ ID NO: 157953 - RNA, 64 nt, Human; identical to SEQ ID NO: 156863

SEQ ID NO: 157954 - RNA, 64 nt, Human; identical to SEQ ID NO: 156864

SEQ ID NO: 157955 - RNA, 64 nt, Human; identical to SEQ ID NO: 156865

SEQ ID NO: 157956 - RNA, 64 nt, Human; identical to SEQ ID NO: 156866

SEQ ID NO: 157957 - RNA, 64 nt, Human; identical to SEQ ID NO: 156867

SEQ ID NO: 157958 - RNA, 64 nt, Human; identical to SEQ ID NO: 156868

SEQ ID NO: 157959 - RNA, 64 nt, Human; identical to SEQ ID NO: 156869

SEQ ID NO: 157960 - RNA, 64 nt, Human; identical to SEQ ID NO: 156870

SEQ ID NO: 157961 - RNA, 64 nt, Human; identical to SEQ ID NO: 156871

SEQ ID NO: 157962 - RNA, 64 nt, Human; identical to SEQ ID NO: 156872

SEQ ID NO: 157963 - RNA, 64 nt, Human; identical to SEQ ID NO: 156873

SEQ ID NO: 157964 - RNA, 64 nt, Human; identical to SEQ ID NO: 156874

SEQ ID NO: 157965 - RNA, 64 nt, Human; identical to SEQ ID NO: 156875

SEQ ID NO: 157966 - RNA, 64 nt, Human; identical to SEQ ID NO: 156876

SEQ ID NO: 157967 - RNA, 64 nt, Human; identical to SEQ ID NO: 156877

SEQ ID NO: 157968 - RNA, 64 nt, Human; identical to SEQ ID NO: 156878

SEQ ID NO: 157969 - RNA, 64 nt, Human; identical to SEQ ID NO: 156879

SEQ ID NO: 157970 - RNA, 64 nt, Human; identical to SEQ ID NO: 156880

SEQ ID NO: 157971 - RNA, 64 nt, Human; identical to SEQ ID NO: 156881

SEQ ID NO: 157972 - RNA, 64 nt, Human; identical to SEQ ID NO: 156882

SEQ ID NO: 157973 - RNA, 64 nt, Human; identical to SEQ ID NO: 156883

SEQ ID NO: 157974 - RNA, 64 nt, Human; identical to SEQ ID NO: 156884

SEQ ID NO: 157975 - RNA, 64 nt, Human; identical to SEQ ID NO: 156885

SEQ ID NO: 157976 - RNA, 64 nt, Human; identical to SEQ ID NO: 156886

SEQ ID NO: 157977 - RNA, 64 nt, Human; identical to SEQ ID NO: 156887

SEQ ID NO: 157978 - RNA, 64 nt, Human; identical to SEQ ID NO: 156888

SEQ ID NO: 157979 - RNA, 64 nt, Human; identical to SEQ ID NO: 156889

SEQ ID NO: 157980 - RNA, 64 nt, Human; identical to SEQ ID NO: 156890

SEQ ID NO: 157981 - RNA, 64 nt, Human; identical to SEQ ID NO: 156891

SEQ ID NO: 157982 - RNA, 64 nt, Human; identical to SEQ ID NO: 156892

SEQ ID NO: 157983 - RNA, 64 nt, Human; identical to SEQ ID NO: 156893

SEQ ID NO: 157984 - RNA, 64 nt, Human; identical to SEQ ID NO: 156894

SEQ ID NO: 157985 - RNA, 64 nt, Human; identical to SEQ ID NO: 156895

SEQ ID NO: 157986 - RNA, 64 nt, Human; identical to SEQ ID NO: 156896

SEQ ID NO: 157987 - RNA, 64 nt, Human; identical to SEQ ID NO: 156897

SEQ ID NO: 157988 - RNA, 64 nt, Human; identical to SEQ ID NO: 156898

SEQ ID NO: 157989 - RNA, 64 nt, Human; identical to SEQ ID NO: 156899

SEQ ID NO: 157990 - RNA, 64 nt, Human; identical to SEQ ID NO: 156900

SEQ ID NO: 157991 - RNA, 64 nt, Human; identical to SEQ ID NO: 156901

SEQ ID NO: 157992 - RNA, 64 nt, Human; identical to SEQ ID NO: 156902

SEQ ID NO: 157993 - RNA, 64 nt, Human; identical to SEQ ID NO: 156903

SEQ ID NO: 157994 - RNA, 64 nt, Human; identical to SEQ ID NO: 156904

SEQ ID NO: 157995 - RNA, 64 nt, Human; identical to SEQ ID NO: 156905

SEQ ID NO: 157996 - RNA, 64 nt, Human; identical to SEQ ID NO: 156906

SEQ ID NO: 157997 - RNA, 64 nt, Human; identical to SEQ ID NO: 156907

SEQ ID NO: 157998 - RNA, 64 nt, Human; identical to SEQ ID NO: 156908

SEQ ID NO: 157999 - RNA, 64 nt, Human; identical to SEQ ID NO: 156909

SEQ ID NO: 158000 - RNA, 64 nt, Human; identical to SEQ ID NO: 156910

SEQ ID NO: 158001 - RNA, 64 nt, Human; identical to SEQ ID NO: 156911

SEQ ID NO: 158002 - RNA, 64 nt, Human; identical to SEQ ID NO: 156912

SEQ ID NO: 158003 - RNA, 64 nt, Human; identical to SEQ ID NO: 156913

SEQ ID NO: 158004 - RNA, 64 nt, Human; identical to SEQ ID NO: 156914

SEQ ID NO: 158005 - RNA, 64 nt, Human; identical to SEQ ID NO: 156915

SEQ ID NO: 158006 - RNA, 64 nt, Human; identical to SEQ ID NO: 156916

SEQ ID NO: 158007 - RNA, 64 nt, Human; identical to SEQ ID NO: 156917

SEQ ID NO: 158008 - RNA, 64 nt, Human; identical to SEQ ID NO: 156918

SEQ ID NO: 158009 - RNA, 64 nt, Human; identical to SEQ ID NO: 156919

SEQ ID NO: 158010 - RNA, 64 nt, Human; identical to SEQ ID NO: 156920

SEQ ID NO: 158011 - RNA, 64 nt, Human; identical to SEQ ID NO: 156921

SEQ ID NO: 158012 - RNA, 64 nt, Human; identical to SEQ ID NO: 156922

SEQ ID NO: 158013 - RNA, 64 nt, Human; identical to SEQ ID NO: 156923

SEQ ID NO: 158014 - RNA, 64 nt, Human; identical to SEQ ID NO: 156924

SEQ ID NO: 158015 - RNA, 64 nt, Human; identical to SEQ ID NO: 156925

SEQ ID NO: 158016 - RNA, 64 nt, Human; identical to SEQ ID NO: 156926

SEQ ID NO: 158017 - RNA, 64 nt, Human; identical to SEQ ID NO: 156927

SEQ ID NO: 158018 - RNA, 64 nt, Human; identical to SEQ ID NO: 156928

SEQ ID NO: 158019 - RNA, 64 nt, Human; identical to SEQ ID NO: 156929

SEQ ID NO: 158020 - RNA, 64 nt, Human; identical to SEQ ID NO: 156930

SEQ ID NO: 158021 - RNA, 64 nt, Human; identical to SEQ ID NO: 156931

SEQ ID NO: 158022 - RNA, 64 nt, Human; identical to SEQ ID NO: 156932

SEQ ID NO: 158023 - RNA, 64 nt, Human; identical to SEQ ID NO: 156933

SEQ ID NO: 158024 - RNA, 64 nt, Human; identical to SEQ ID NO: 156934

SEQ ID NO: 158025 - RNA, 64 nt, Human; identical to SEQ ID NO: 156935

SEQ ID NO: 158026 - RNA, 64 nt, Human; identical to SEQ ID NO: 156936

SEQ ID NO: 158027 - RNA, 64 nt, Human; identical to SEQ ID NO: 156937

SEQ ID NO: 158028 - RNA, 64 nt, Human; identical to SEQ ID NO: 156938

SEQ ID NO: 158029 - RNA, 64 nt, Human; identical to SEQ ID NO: 156939

SEQ ID NO: 158030 - RNA, 64 nt, Human
gcccugggcccaggugggggucgccugcuuccuucccggacaggguccugcaguggccaauggu

SEQ ID NO: 158031 - RNA, 64 nt, Human
gccucggggcccaagccccuccccagcccccucucccggacagacgccuugcccaggguguguu

SEQ ID NO: 158032 - RNA, 64 nt, Human
ggugggcagggcagaaacaggccacagugcucaacccggacacccucacgaagggucgcaaguc

SEQ ID NO: 158033 - RNA, 64 nt, Human
ccugugcaucacacuuaacucaucuaacugcuuccccggacacccuccaccucuaguuguuacu

SEQ ID NO: 158034 - RNA, 64 nt, Human
gcaacacuuuaaggguucggcaaucacugucacccccggacagcagaacgcuggcaucagcuau

SEQ ID NO: 158035 - RNA, 64 nt, Human
uuugcaggcugugucuuucuaucacggauuuccacccggacacguggaacccggccuggucugu

SEQ ID NO: 158036 - RNA, 64 nt, Human
ucccuagggugacaggccagggggaaaaauuauccccggacaacaugaaacaggugaggucagg

SEQ ID NO: 158037 - RNA, 64 nt, Human
gaucccaucagaaaggugcugacuaaacugguugcccggacacucaacagccuccaccucccuu

SEQ ID NO: 158038 - RNA, 64 nt, Human
ggagagccugccguuccaacuugcccaucagagacccggacacggccugguguguggcuugcug

SEQ ID NO: 158039 - RNA, 64 nt, Human
gccuuugaggcaaaggccagcagcagauaacaaccccggacaaaucagcgaugugucaccccca

SEQ ID NO: 158040 - RNA, 64 nt, Human
ugucaugagaucccuggcuucuccccauguuguucccggacaagggcagaagggaggcauggca

SEQ ID NO: 158041 - RNA, 64 nt, Human
uaaaaaauguuagugcccacucuuccccuguacccccggacaguuaaaucagaaccucagacag

SEQ ID NO: 158042 - RNA, 64 nt, Human
cgaggauuaacagaaaggaauuacgauuauaucacccggacacacaucaugcuuaagauucaac

SEQ ID NO: 158043 - RNA, 64 nt, Human
uauccucauuuguaaucuaguugucaauaaauggcccggacaugucuugcuaacaggauauggg

SEQ ID NO: 158044 - RNA, 64 nt, Human
cagcacggcuggugagcugcaggcugcggccuugcccggacacuugguaaugccaaacaaguac

SEQ ID NO: 158045 - RNA, 58 nt, Human
ugggggcccugcucuucugagcccgucucccggacagguugaggaagcugcuccagaa

SEQ ID NO: 158046 - RNA, 64 nt, Human
cuaacgauuucucaccucgaagcgccuuuugaaccccggacagagugcacaaucggagggaauu

SEQ ID NO: 158047 - RNA, 64 nt, Human
aaccaaaaacagacaugggguggguagcugggggcccggacacuugggacccugaccccuuugu

SEQ ID NO: 158048 - RNA, 64 nt, Human
gcccacggggggcccacgggaccccccgggacuccccggacauggcccugccccuaugggacac

SEQ ID NO: 158049 - RNA, 64 nt, Human
gggcuguggacccugcguuugccgagcgcuaugccccggacaaaacgagcacagugcugacccg

SEQ ID NO: 158050 - RNA, 64 nt, Human; identical to SEQ ID NO: 84775

SEQ ID NO: 158051 - RNA, 64 nt, Human
accagcugccucugcaguuggacaagacuuggcccccggacaagacucgcccagcacuugcggc

SEQ ID NO: 158052 - RNA, 64 nt, Human
ggggacaggcaugcugccgccaguagggcggggacccggacagccaggugacuaccaguccugg

SEQ ID NO: 158053 - RNA, 64 nt, Human
cuugaaggugaggaagugaaaacuacagaccucccccggacagcccacucucuaucacgagccu

SEQ ID NO: 158054 - RNA, 64 nt, Human
gcugaacacguccucgcucccgcgcuccccgcgccccggacacagcgggacgcggccggcggcc

SEQ ID NO: 158055 - RNA, 64 nt, Human
ugcgcuuaagggacaugauuuuccauuuucuucgcccggacaacuugaaugaaaugggcacugu

SEQ ID NO: 158056 - RNA, 64 nt, Human
cccccgcacaggcccgccuggcuucgaguuggaacccggacacuugccccucacugguguggau

SEQ ID NO: 158057 - RNA, 64 nt, Human
ccucagugcacuuuggcauuugcacggugucuuccccggacagcacagcaauaaauggugugau

SEQ ID NO: 158058 - RNA, 64 nt, Human
ccuuggaccuccuuaggcgacuccugguguucgccccggacaagcgguuaagcgcgacccaggc

SEQ ID NO: 158059 - RNA, 64 nt, Human
gaguaacuaggaacaugguagaaguggagagagucccggacaugccgacucaggacaggugggu

SEQ ID NO: 158060 - RNA, 64 nt, Human
gcccggaggggcaggccuagcuucucccagaacucccggacagccaggacagccucguggcugg

SEQ ID NO: 158061 - RNA, 64 nt, Human
ggggauugccacuaaguacagcugacgguuucuccccggacacucgccuacuaaguacccuugg

SEQ ID NO: 158062 - RNA, 64 nt, Human
cauuacaaaggccacaagggguuuuauccuggaccccggacauguuccaagcccugccucaacu

SEQ ID NO: 158063 - RNA, 64 nt, Human
ugcugggauuacaggcaugagccaccacacccagcccggacagcuucuuugggagugcugcuaa

SEQ ID NO: 158064 - RNA, 64 nt, Human
uguagcuccugccggaggcaugucuacuugugaucccggacagccgaacccaagagcugguggc

SEQ ID NO: 158065 - RNA, 64 nt, Human
ucccacccagccuggcuggcggugcccacagugccccggacacauuucacaccucaggcucgug

SEQ ID NO: 158066 - RNA, 64 nt, Human
ggccacagggaccucugcagugcccccuaagugacccggacacuuccgagggggccaucaccgc

SEQ ID NO: 158067 - RNA, 64 nt, Human
uccccgcuggccauagcauuaagcccucgcccggcccggacacagggaggacgcucccggggcc

SEQ ID NO: 158068 - RNA, 64 nt, Human; identical to SEQ ID NO: 84778

SEQ ID NO: 158069 - RNA, 64 nt, Human
uaugccccaccgauacacugggaccaccccuuaccccggacaggaugaauggaucaaaggagug

SEQ ID NO: 158070 - RNA, 64 nt, Human
guugugucucuguauauccccaguugucagcagacccggacaaugcugugagagaagcauuggg

SEQ ID NO: 158071 - RNA, 64 nt, Human
cccuguaagcugugcagugugagggccuggcuuccccggacacaccuggagcagccucugaguc

SEQ ID NO: 158072 - RNA, 64 nt, Human
caucugcacuugaugacugcuccccgacccccagcccggacaccucauuccccucccacuacag

SEQ ID NO: 158073 - RNA, 64 nt, Human
gcggcccuccggauuguggugacaauauguuguacccggacauucccaaauuuaaauuuggcag

SEQ ID NO: 158074 - RNA, 64 nt, Human
accaggagggagagugcagccaggcucagggauccccggacaccucuguccagagccccuccac

SEQ ID NO: 158075 - RNA, 64 nt, Human
cugccaggacgagguaaugucagagcuccaucagcccggacagugggaacuaacuggugcauuc

SEQ ID NO: 158076 - RNA, 64 nt, Human
gaccucgaccccagaggcucagaugaaagaccgacccggacaaucauuccgguucaguaugaga

SEQ ID NO: 158077 - RNA, 64 nt, Human
gaccacacucccuacucagggcuagucuguucuucccggacaucuucugguagccgugcaggag

SEQ ID NO: 158078 - RNA, 64 nt, Human
acagagcacagcugugcuggaaguguggggagaacccggacagcucaguccugccagcagccgc

SEQ ID NO: 158079 - RNA, 64 nt, Human
guccuggccacccuggaagcucaucaggccaagacccggacagagcuucagaggaguguugagu

SEQ ID NO: 158080 - RNA, 63 nt, Human
cgggcuacgaacaccccugaggccccggacgcccccggacacaauaaaggugugaagcuucga

SEQ ID NO: 158081 - RNA, 64 nt, Human
ucuccuuuuguacuguguugugcuugcugucucucccggacacccuuaaagacugucuuuuuag

SEQ ID NO: 158082 - RNA, 64 nt, Human
ggaagugacuugcuccagacaagaggugaccaggcccggacagaaauggccugggaaguagcag

SEQ ID NO: 158083 - RNA, 64 nt, Human
gccgggccaguucucuugagaagugaggcccggccccggacagggucugggcccugcucccugu

SEQ ID NO: 158084 - RNA, 64 nt, Human
gcucgugcuagaacucgggggcccccugcccgcacccggacacuugaucgauccccaccgacgc

SEQ ID NO: 158085 - RNA, 64 nt, Human
cucggagcucugugguggaaggacgggagagggccccggacacgcgcguuuucuccugccgaac

SEQ ID NO: 158086 - RNA, 64 nt, Human; identical to SEQ ID NO: 84781

SEQ ID NO: 158087 - RNA, 64 nt, Human
ucaggggucagaagcagggacuggggcaggcgagcccggacagggaagaggggcuccgaucaaa

SEQ ID NO: 158088 - RNA, 64 nt, Human
acagaucauaggaaguggcuggucuggagucccacccggacagguggggccucagccuggggcu

SEQ ID NO: 158089 - RNA, 64 nt, Human
agaggggagagagcuggugauuccagaagggugacccggacagccuagcugggggcucccccau

SEQ ID NO: 158090 - RNA, 64 nt, Human
guuuggcugcugugucugcugcgcacgcccccuccccggacagcaccugccaccuagaaacuuu

SEQ ID NO: 158091 - RNA, 64 nt, Human
aacauuuuagaacaauaguucucaaaguguguuccccggacaagcagcaucugcaacacuuagg

SEQ ID NO: 158092 - RNA, 64 nt, Human
cagaccuggacagacagacacagccugaaacagacccggacagacagacacagccugaaacaga

SEQ ID NO: 158093 - RNA, 64 nt, Human
cccagacagacagacagacacagccugaaacagacccggacagacagacagacacagccugaaa

SEQ ID NO: 158094 - RNA, 64 nt, Human
cccggacagacagacagacacagccugaaacagacccggacagacagacagacacagccugaaa

SEQ ID NO: 158095 - RNA, 64 nt, Human; identical to SEQ ID NO: 158094

SEQ ID NO: 158096 - RNA, 64 nt, Human
gccugaaacagacccagacacagccugaaacagacccggacagacagacagacacagccugaaa

SEQ ID NO: 158097 - RNA, 64 nt, Human
ggacgcuguuugguucuaugugguuggucuguuucccggacaagaaaaauugcaaucaaauguc

SEQ ID NO: 158098 - RNA, 64 nt, Human
cucuaaggguccucuggccccacggacagcaggacccggacacccugugggaccuggccucaaa

SEQ ID NO: 158099 - RNA, 64 nt, Human
uuucccuugcaggccucuggagccucgugccuggcccggacaucuggucccucagaguggcagc

SEQ ID NO: 158100 - RNA, 64 nt, Human
gaugggagccagcaccagcaggauccgagggcgccccggacagaggucugccccacccacuucc

SEQ ID NO: 158101 - RNA, 64 nt, Human
ccgcuggagaggcaccaugggcguggaggggcuucccggacaccgcccacccgggacccgccuc

SEQ ID NO: 158102 - RNA, 64 nt, Human
uguuuccuuuucuaaguuuuauuuuucaaaccaccccggacagcccccagcucugauuccuuca

SEQ ID NO: 158103 - RNA, 64 nt, Human
cgggggugucacugcuuccuggaguucaggagaccccggacaccugggaccuguguugcugagc

SEQ ID NO: 158104 - RNA, 64 nt, Human; identical to SEQ ID NO: 84784

SEQ ID NO: 158105 - RNA, 59 nt, Human
uuggaggccgcuggaagugaggaugccgccccggacaguggcaccugggaagccuggga

SEQ ID NO: 158106 - RNA, 64 nt, Human
ugguggggaacucuaagggggacggagucaguaccccggacagggccacauuugcaugagacau

SEQ ID NO: 158107 - RNA, 64 nt, Human
gcuggcugccugcaccggccaugucgacccaggacccggacaccuggucuugggcuguguucag

SEQ ID NO: 158108 - RNA, 64 nt, Human
uucgguagagcaaguguccucugacagccguguccccggacaguucagacacccuuggggaugg

SEQ ID NO: 158109 - RNA, 64 nt, Human
gggcgcucucucccggccaugucuaugcaacucucccggacagaggggccgggcugccagccac

SEQ ID NO: 158110 - RNA, 64 nt, Human
agcagugacacucccgucgcucggugaggacguucccggacagugccucacucaccugggacug

SEQ ID NO: 158111 - RNA, 64 nt, Human
acaccccugcacacaccugcacaccgucccucuccccggacaagcccaggacacugccuuugcu

SEQ ID NO: 158112 - RNA, 64 nt, Human
aaggacagcgucaagggugacguguuuguggccccccggacagaccacccagcccuguacaggg

SEQ ID NO: 158113 - RNA, 64 nt, Human
uuggccuuaacuggcccucgggcccucucuccgccccggacaggguggcacccaccacucucag

SEQ ID NO: 158114 - RNA, 64 nt, Human
augcuccgacacagcagggaagcuccuccuguggcccggacacccauagacggugcggggggcc

SEQ ID NO: 158115 - RNA, 64 nt, Human
caggccuggcagggcaguaccacuuggagcgguacccggacaguuacgaguccaugugugagug

SEQ ID NO: 158116 - RNA, 64 nt, Human
uuuuuuaguaaccuuggaagcuguaguaauucuaaggaaucaugaaccuugccuggacauuugc

SEQ ID NO: 158117 - RNA, 64 nt, Human
gugcucccgccuccuggguauacagagagaaggcaggaaucaggaguuccagaagcauauacau

SEQ ID NO: 158118 - RNA, 64 nt, Human; identical to SEQ ID NO: 84787

SEQ ID NO: 158119 - RNA, 64 nt, Human
aguggaaaccaaguuuagauuuggggagugguaaaggaaucagcuuuuucuauuguuaggggaa

SEQ ID NO: 158120 - RNA, 64 nt, Human
agcuaccaucguccaugaugccaaagguugagagaggaaucaacauggcugcuuugcugcuucc

SEQ ID NO: 158121 - RNA, 64 nt, Human
ugauauaaaaagggacacugcagcugaaugaaaaaggaaucaaaauccacuuuguacauaaguu

SEQ ID NO: 158122 - RNA, 64 nt, Human
uuuuuuguuuccuuuuuuuccauuuuuuucucuaaggaaucaauauuucaauauguugagugug

SEQ ID NO: 158123 - RNA, 64 nt, Human
agcaguuggagagacaugacuuguuaaaaccucaaggaaucaagacauguuacucuguauuuaa

SEQ ID NO: 158124 - RNA, 64 nt, Human
auggggaagauggucuguuuugacagaaacugacaggaaucaaucaaaacaaucgaauuuugaa

SEQ ID NO: 158125 - RNA, 64 nt, Human
acucaacugaugaaaaaaacgaauuguaugauuuaggaaucaaaaacuaaaauaaguggaauua

SEQ ID NO: 158126 - RNA, 64 nt, Human
uauuccuacuuauaguuggugagcaugagggaggaggaaucauggcuaccuucuccuggcccug

SEQ ID NO: 158127 - RNA, 64 nt, Human
ggcaaauugcuacuugcaagacugacugacuucaaggaaucagaaauuaccuagaagcaccaug

SEQ ID NO: 158128 - RNA, 64 nt, Human
cacuggggcuuuuguuugggguccuuuuauccccaggaaucaauaauuuuuuugccuaggugcc

SEQ ID NO: 158129 - RNA, 64 nt, Human
ugagaaguagauaggcaucagaguaugguacuauaggaaucagaaaaauucaaaacaaaugugg

SEQ ID NO: 158130 - RNA, 64 nt, Human
gcuaaccucucaaucaggcaaacauucuucuuggaggaaucaggcaaacaucucaaaaauucuc

SEQ ID NO: 158131 - RNA, 64 nt, Human
cuguaaggaacuggaacacacauguccuauccaaaggaaucagcugcagcugcuuguugucaag

SEQ ID NO: 158132 - RNA, 52 nt, Human
uaggaaggacuuuggguuaggaaggaaucaugaggaugagggaagaagaaag

SEQ ID NO: 158133 - RNA, 64 nt, Human
ggccccucacuguggggauugaucauucucaugaaggaaucacaguuauauggcaacugcagaa

SEQ ID NO: 158134 - RNA, 64 nt, Human
uguaggagagacuggccagaggcagcuaaggggcaggaaucaaggagccuccguucccaccucu

SEQ ID NO: 158135 - RNA, 64 nt, Human
auaacaacaacaguuacuauaguggugagauggaaggaaucaaauuuugccagagaaacuaacu

SEQ ID NO: 158136 - RNA, 64 nt, Human
gugguugcuccaggauuacucccuccuccaaaaaaggaaucaaauccacgaguggaaaagccuu

SEQ ID NO: 158137 - RNA, 64 nt, Human
auuccaugagaauuguugggaaguucaugaguuuaggaaucaaaguauagcauuuagggccacu

SEQ ID NO: 158138 - RNA, 64 nt, Human
uucuggaaggaaagcagcagggaagggaauauugaggaaucaucuagaacaauuaagccgacca

SEQ ID NO: 158139 - RNA, 64 nt, Human
cuacuaaggaaagguuaaaaacuuccccucaaaaaggaaucaaccccaggaaguaauuauuuac

SEQ ID NO: 158140 - RNA, 64 nt, Human
cuuuguaauuuuuaggauguagagaguucuaaugaggaaucauuuucaugugcccugacaugua

SEQ ID NO: 158141 - RNA, 64 nt, Human
ugaaggaagagaugauuccuuuacucaaaccugcaggaaucagccuauuaacaggcaggggaaa

SEQ ID NO: 158142 - RNA, 64 nt, Human
auugcugaguugaaugguaauucugaguucuuugaggaaucaccaaccugcuuuccacaguggc

SEQ ID NO: 158143 - RNA, 64 nt, Human
cuccuuucuuuugggugcugccuauaaaucuuggaggaaucauuucuccuccucaaaaacugau

SEQ ID NO: 158144 - RNA, 64 nt, Human
ucuugaccuaccccagauauuuguguggaagaggaggaaucaccauuuacaagguggacaaaug

SEQ ID NO: 158145 - RNA, 64 nt, Human
aaaaccauuccuuuuguaugaaauguuuugacuuaggaaucauuuuauguacuuguucuaccug

SEQ ID NO: 158146 - RNA, 64 nt, Human
auacaaacauaaggcacauugugucuuuaauuucaggaaucagaaaucauaggguucugaucac

SEQ ID NO: 158147 - RNA, 57 nt, Human
cuucugugaagaaaucauaacacuuggaggaaucagaagggaagaucaacagcaagg

SEQ ID NO: 158148 - RNA, 64 nt, Human
aagguaccucuucuguaaagcuuucccugguaucaggaaucaaaauuaaucagggaucuuuuca

SEQ ID NO: 158149 - RNA, 64 nt, Human
gaugacauaagauuccucuuaaagaggaaaugucaggaaucaagccacugaauccuuaaagaga

SEQ ID NO: 158150 - RNA, 64 nt, Human
aaugcuaaauagaagaaauuguagguaagguaagaggaaucaaguucugaguggcugccaaggc

SEQ ID NO: 158151 - RNA, 64 nt, Human
cauugaaaacuugugugugcaacuuuugggggacaggaaucacuuaaaaucauauuuauuuggc

SEQ ID NO: 158152 - RNA, 64 nt, Human
ggcagucccccauggggugccgagccaacgccucaggaaucaggaggccagccugguaccaaaa

SEQ ID NO: 158153 - RNA, 64 nt, Human
aacuuauugugaaccauacuguccccaaugacuaaggaaucaaagagagagaaccaacguuccu

SEQ ID NO: 158154 - RNA, 64 nt, Human
aggaaguaauuuuggugugaucuagcaaaagaguaggaaucagcgauacaaccacuuuggaagu

SEQ ID NO: 158155 - RNA, 64 nt, Human
uguuuggacaacuuagauuggguuuauaacuauuaggaaucacugcacaguuuauuuggguugu

SEQ ID NO: 158156 - RNA, 64 nt, Human
acuuauggcaucaggaggaaacuuuaaaauaucaaggaaucacucagucacccuccuguuuugu

SEQ ID NO: 158157 - RNA, 64 nt, Human
gguccuggagagggcccuguccaguugggugaucaggaaucaaaccagcaucggaaagacuucc

SEQ ID NO: 158158 - RNA, 64 nt, Human
ggaacaacacacacacaaaaauuaaaugcaauaaaggaaucauuaaaaaaaauaguaaaugauu

SEQ ID NO: 158159 - RNA, 64 nt, Human
ccuccacuucuccccucaagaaauuuucaacgccaggaaucaugaagagacuucugcuuuucaa

SEQ ID NO: 158160 - RNA, 64 nt, Human
ugcuugaguaucucuucuuucccuuuccugucucaggaaucagcugagaauucauucgauuguc

SEQ ID NO: 158161 - RNA, 64 nt, Human
gguagcaguagagagcacugugcaccugggaaugaggaaucaggccccaagacagaaguacuug

SEQ ID NO: 158162 - RNA, 64 nt, Human
uuuauuaaguaaaugauguagcacuguagugauuaggaaucauuagcaaauguguugcuucaug

SEQ ID NO: 158163 - RNA, 64 nt, Human
uuauuucugaaguaacaagacaccuagcaacuauaggaaucauuuuuaaaaaucuuuaaggaga

SEQ ID NO: 158164 - RNA, 64 nt, Human
ucauuuuucacuuggagugacaaugggagaggucaggaaucaaguucacuuucaagaucuaagg

SEQ ID NO: 158165 - RNA, 64 nt, Human
ugacgagggcuuuuagagacugcuccuauaauugaggaaucagcagcauaggcuuuaucucccu

SEQ ID NO: 158166 - RNA, 64 nt, Human
ccagcuuucauaauuuuuaauugucaaaaccaaaaggaaucagaauaaggaucacugagaauuu

SEQ ID NO: 158167 - RNA, 64 nt, Human
aagauuaaccuuccccacuggugaugaccuaggcaggaaucaucucuugaaauaaauacuagcu

SEQ ID NO: 158168 - RNA, 64 nt, Human
ccagagaaaacccauacagacaguggccuugcccaggaaucagucuuguuucuuuuuuguuuuu

SEQ ID NO: 158169 - RNA, 64 nt, Human
gacaguuggaagaugggguucauucuuccgguucaggaaucacuauguauuuccuucuugugau

SEQ ID NO: 158170 - RNA, 64 nt, Human
uuccucacuguucucucccuugaaucucauuuguaggaaucaagagauuccuauacaugggacu

SEQ ID NO: 158171 - RNA, 64 nt, Human
ucauagaaaaaguagguacacguaaaucuguucaaggaaucauuguuuggcauugaaaauagga

SEQ ID NO: 158172 - RNA, 64 nt, Human
gagauacagcucagagugccacgcccccagaaagaggaaucaggcaaguacugucccaaggcag

SEQ ID NO: 158173 - RNA, 64 nt, Human
agccauacuuaucucucugugcuguggaagcaacaggaaucaagagcugcccuccuuguccacc

SEQ ID NO: 158174 - RNA, 64 nt, Human
gaggaggaggagauugaugacaagcaaguuacucaggaaucaaaagagaaaaaaguuucugaaa

SEQ ID NO: 158175 - RNA, 64 nt, Human
uauuggucaugagaacaaauggaugugaucaugaaggaaucagauucccuauguaaagcaguuu

SEQ ID NO: 158176 - RNA, 64 nt, Human
acagcaggggucauucacacucucacugucuugcaggaaucacaagaagucuucauaugugaac

SEQ ID NO: 158177 - RNA, 64 nt, Human
accccuucccaagcuucuguauugaaaaacaauuaggaaucauugcagauuuuuuuuuauucug

SEQ ID NO: 158178 - RNA, 64 nt, Human
ucgagcuuguagacagcuuggauccuuucucugaaggaaucauguucagguguguaauuaugcu

SEQ ID NO: 158179 - RNA, 64 nt, Human
gaaguuuuacugucuauuaauauucaggguaaauaggaaucauucagaaauguugagucuguac

SEQ ID NO: 158180 - RNA, 64 nt, Human
auuccauuuauaauaccaucagaaagaauaaaauaggaaucaacuuaacaaaacaagugcaaga

SEQ ID NO: 158181 - RNA, 64 nt, Human
uuaauuagagauagcaacuuucccagggugaccgaggaaucaguacguguugaaccccucuuuu

SEQ ID NO: 158182 - RNA, 64 nt, Human
gagccacugugcccagucaggaugucuuuaauguaggaaucauucaagaucccuccucagugcc

SEQ ID NO: 158183 - RNA, 64 nt, Human
aagaccaaauacugaaguuaagugcauuguuuucaggaaucaaaagauaaaggggccgggugug

SEQ ID NO: 158184 - RNA, 64 nt, Human
gugcucugggugagcugggaaaauacaagaaccaaggaaucaugucaggccaucaaggaguaua

SEQ ID NO: 158185 - RNA, 60 nt, Human
ugcagagagcaacaccaugaucaggggagcaggaaucaggagcucgguggauuugcaggu

SEQ ID NO: 158186 - RNA, 64 nt, Human
ucugcggggcacauauguauccauuuagagcuaaaggaaucaguguacacuacagcuaauccua

SEQ ID NO: 158187 - RNA, 64 nt, Human
gugcagugaggcccaggcagacaaccuugucccaaggaaucagcaggaugugugggccaggauc

SEQ ID NO: 158188 - RNA, 64 nt, Human
guacuuucaaugaacauaauuguuaggaccacugaggaaucaugaaaaaugaucucugcuuagu

SEQ ID NO: 158189 - RNA, 64 nt, Human
gacccugccauguugguuugacuuacuaagacacaggaaucacuguuuuccuugaccagggucu

SEQ ID NO: 158190 - RNA, 64 nt, Human
ggccuaaagaggacugugcauuuuugcuauuuaaaggaaucacaaaugaucauacuuaagugag

SEQ ID NO: 158191 - RNA, 64 nt, Human
gagaugcgucuggagagccagagggccugccugaaggaaucaccugagccuguccguccaccag

SEQ ID NO: 158192 - RNA, 64 nt, Human
uuacuuauaaacaaagucuuagagacuuccuuuuaggaaucaacuuccaugagaaguuaaaaau

SEQ ID NO: 158193 - RNA, 64 nt, Human
aauuauucauuugguuuguuucauacuucauuauaggaaucaaguaauuugaugacuaaugugg

SEQ ID NO: 158194 - RNA, 64 nt, Human
guaggauagcuacuaaauauauauuaugcaagucaggaaucauuaauuucaaaauuuaaagcca

SEQ ID NO: 158195 - RNA, 64 nt, Human
gggaccagauuaugacuagaguuuuuaugccagaaggaaucauuggugaacuuuccaagguuau

SEQ ID NO: 158196 - RNA, 64 nt, Human
cccguaacacuguguucuggauaaaaaugugauuaggaaucacgcaaagugcuuacuguguaag

SEQ ID NO: 158197 - RNA, 64 nt, Human
ccacccaaaugaccaaggcauauauaguauuuggaggaaucagggguuuggaaggaguagggag

SEQ ID NO: 158198 - RNA, 64 nt, Human
aagguuuucccucaugcgauuacuagaaaauggcaggaaucaacaaaauggagaccucccacug

SEQ ID NO: 158199 - RNA, 64 nt, Human
cccaggcagauaucaccaaaaauguuuucacuguaggaaucacaaaauaaguuuuugucaaaau

SEQ ID NO: 158200 - RNA, 64 nt, Human
gccugcucuccaguagccuggccugucagccuggaggaaucaggaaagaccccuuccucuugca

SEQ ID NO: 158201 - RNA, 64 nt, Human
auugaaguuuuggcaauugacuauagugugagccaggaaucacuggcuguuaaucuuucaaagu

SEQ ID NO: 158202 - RNA, 64 nt, Human
ccugugcuccaaaaacauacugaugccugauuuaaggaaucaggucuucagagaggaaugaaga

SEQ ID NO: 158203 - RNA, 64 nt, Human
ucaagaaaaauaauagacaaaagaaaauggcacaaggaaucacacguggugcagcuaaaacaaa

SEQ ID NO: 158204 - RNA, 64 nt, Human
ugacgcacaucugcccuaagcgaaaucugucagaaggaaucaacaaggcuccuugccuccccuc

SEQ ID NO: 158205 - RNA, 64 nt, Human
agaaguuagugauucccucucuuucuaguuugguaggaaucacccugaagaccuaguccucaau

SEQ ID NO: 158206 - RNA, 64 nt, Human
agauuuauuuccacagugauauauuaaacccaaaaggaaucaucauauuuggaugcuuaaaaua

SEQ ID NO: 158207 - RNA, 64 nt, Human
ucaacugaauaaaugacugagaacaaguuacaaaaggaaucaugaauccugguaaacaauaaag

SEQ ID NO: 158208 - RNA, 64 nt, Human
uuuucaauaagguaaauaaugaaagaucucacaaaggaaucauuguguuuaauuauuuugccau

SEQ ID NO: 158209 - RNA, 64 nt, Human
uucuaaaugucuuucugugcauauuuuuuguguuaggaaucaaaaguauuuuauaaaaggagaa

SEQ ID NO: 158210 - RNA, 64 nt, Human
ggguccauuuuugcacuuguaagucauuuuauuaaggaaucaaguucuuuuucacuuguaucac

SEQ ID NO: 158211 - RNA, 64 nt, Human
agaugugcuucaucuuagugaaauuuaauucacaaggaaucauaaauuguguuuuugaggcugg

SEQ ID NO: 158212 - RNA, 64 nt, Human
uccccuaaacuuuagaaaacaguugcuccacuuuaggaaucaaauuaugucaauaaauguuaua

SEQ ID NO: 158213 - RNA, 64 nt, Human
uauucuuuuuuuccuacuuuguuauugcaaauugaggaaucacuuuuaacuguuuuaggugugu

SEQ ID NO: 158214 - RNA, 64 nt, Human
acaaauguuuuacugacuuuucuuacugcuguaaaggaaucaggcaguuggguauugauauguu

SEQ ID NO: 158215 - RNA, 64 nt, Human
agaugccuuguuuguuaacuaacuuguggaaagcaggaaucagugucucuaaggcugcauccua

SEQ ID NO: 158216 - RNA, 64 nt, Human
ggcuaagauuuaagcugagccagggaggacuugaaggaaucaugaugagagagaagguaagugg

SEQ ID NO: 158217 - RNA, 64 nt, Human
cuuuauaacucugaucuuuuacauaaagcagaagaggaaucaacuaguuaauugcaagguuucu

SEQ ID NO: 158218 - RNA, 64 nt, Human
ugagccuuccagagagagcuauugaugauacaagaggaaucaccagggcccggaucuaagaugc

SEQ ID NO: 158219 - RNA, 64 nt, Human
cuugaauauuagagaaggagaggagcugugggucaggaaucagagagaccugcuaaaaccagac

SEQ ID NO: 158220 - RNA, 64 nt, Human
auuaacuuuuuucuguucagccagcuaccccucaaggaaucauagcucucuccucgcacuuuua

SEQ ID NO: 158221 - RNA, 64 nt, Human
ccccgacgccgucuucucuaauuaaaaugcaauaaggaaucaauucuuuucugccugagaaaga

SEQ ID NO: 158222 - RNA, 64 nt, Human
ccagaguggaacuuuuaacucaggccuuuuuaagaggaaucacaauaacugcagauuuuuaaac

SEQ ID NO: 158223 - RNA, 64 nt, Human
augggguagaaauaaaaucucugagaugaaacaaaggaaucaacaugauaaaauuuaggcgaag

SEQ ID NO: 158224 - RNA, 64 nt, Human
auuuucauacauugagaaaccaagucaaucaagcaggaaucauuuaaaaaccagauaaagccau

SEQ ID NO: 158225 - RNA, 64 nt, Human
aguguuaacaaagcacugugcuuagaggguaaaaaggaaucacaaaacaagaaucuuuccaaag

SEQ ID NO: 158226 - RNA, 64 nt, Human
uaaccuuccaaaaauuacuuaguauugcaaagucaggaaucaucaggaacguuuagcugacaaa

SEQ ID NO: 158227 - RNA, 64 nt, Human
uaacgcaggcagaacuccuuauugugggacuugaaggaaucauuuucucaucauuaauuaugca

SEQ ID NO: 158228 - RNA, 64 nt, Human
ggagagaccccaacugucuccauggagaagaacuaggaaucaccacaaggggaagaaauguaca

SEQ ID NO: 158229 - RNA, 64 nt, Human
ccuuuauauguaaugaaagcacuuauaaagaaacaggaaucauuagaccagguuguaaagaugu

SEQ ID NO: 158230 - RNA, 64 nt, Human
uuuguacucccacuuccuccaaauccauacagugaggaaucagaguguuuauagauauaugagu

SEQ ID NO: 158231 - RNA, 64 nt, Human
ugccagguuuaauucuuucauugcuugagaagaaaggaaucaaaggacuguguguaguaagcug

SEQ ID NO: 158232 - RNA, 64 nt, Human
ugcucuaauggggaaagggggcuuugcaaagccgaggaaucaagccagaugcgagcauggacuc

SEQ ID NO: 158233 - RNA, 64 nt, Human
ucuuuaguuagugauuauauuucacccaucucucaggaaucaucuccuuugcagaaugaugcag

SEQ ID NO: 158234 - RNA, 64 nt, Human
uaaugccuaccuugugaggguugcuucaaugauuaggaaucauucuguaaagucuagcacaguu

SEQ ID NO: 158235 - RNA, 64 nt, Human
gccacguuuacaggaaggugugccccagaggaggaggaaucagcucccucgcuccaguggccuu

SEQ ID NO: 158236 - RNA, 64 nt, Human
ucccuccauaaguuuaacuuuaaaacuguauuuaaggaaucaaaucuuacaaaauccuggaaga

SEQ ID NO: 158237 - RNA, 64 nt, Human
uuacagucccacucuggagcacugucugaagaugaggaaucaucuguguacggauaaguacugu

SEQ ID NO: 158238 - RNA, 64 nt, Human
uuuucauguuacuuaccaagugguguuucugguuaggaaucacagcuguaaaauugauuucagu

SEQ ID NO: 158239 - RNA, 64 nt, Human
caacugcaauaauuuguuguacaacuguuguaucaggaaucaggauuuuuuuguuguuguacuu

SEQ ID NO: 158240 - RNA, 64 nt, Human
uuucucaaaauuaacuuugccgugguuuuuaaaaaggaaucaaaaugcauuguugcauuaagcu

SEQ ID NO: 158241 - RNA, 64 nt, Human
uccaaucuuucaaaaucuugucuuagggcuugugaggaaucagaacuaacccaggacucagucc

SEQ ID NO: 158242 - RNA, 64 nt, Human
cgagcagagagggaguaggagugaagccagcugcaggaaucaaaaauugaagagagauauaucu

SEQ ID NO: 158243 - RNA, 64 nt, Human
aaauuggucacauucuguaaagcacauucuguuuaggaaucaacuuaucucaaauuguaacucg

SEQ ID NO: 158244 - RNA, 64 nt, Human
uugcaguucuaggucuuugacagcugaagaccacaggaaucaaacaggcgagacacacagaaua

SEQ ID NO: 158245 - RNA, 64 nt, Human
accacuaauuuugaaaauuaccagugugauacauaggaaucauuauucagaauguagucugguc

SEQ ID NO: 158246 - RNA, 64 nt, Human
gccucaggggagcccccaccccacggauguugucaggaaucaugaucugacuuuaauugugugu

SEQ ID NO: 158247 - RNA, 64 nt, Human
auguauuggugacuguugauuuguugaacaauucaggaaucaagggcuguggagaaacucccuc

SEQ ID NO: 158248 - RNA, 64 nt, Human
uugauuuuucuugcuuuuauagauuuuacuauauaggaaucaagauuuaagaaauuuugcauua

SEQ ID NO: 158249 - RNA, 64 nt, Human
acauuucugcagaacagauaccaaaucaauagcuaggaaucauguucaauauugaauucugccc

SEQ ID NO: 158250 - RNA, 64 nt, Human
cuugauacuuuccaaauucucugauucuagaaaaaggaaucauucuccccucccucccaccaca

SEQ ID NO: 158251 - RNA, 64 nt, Human
cacugccccaggacugucauuuuggcaucugcaaaggaaucacuuuagaaagccagcaccuggu

SEQ ID NO: 158252 - RNA, 64 nt, Human
aagcaaaaauuuuggucacuuccaagcuagaaggaggaaucagauacccuuuaauauuuuuucc

SEQ ID NO: 158253 - RNA, 64 nt, Human
guucugaauucuacagacucaucaacaugaggcaaggaaucauugaaaaccaccugugucuccu

SEQ ID NO: 158254 - RNA, 64 nt, Human
uucauaaucaggcuaacaacacucucuugaauuuaggaaucauugaaaacuccuugcacuuaga

SEQ ID NO: 158255 - RNA, 64 nt, Human
accuuguauaucaucuucgaccacaucagaaagaaggaaucauauuccuuuaugaauguguaau

SEQ ID NO: 158256 - RNA, 64 nt, Human
uuagcauucagagaaaaagccaacuugcuuaaagaggaaucacuuaaaagguaggcauaucuaa

SEQ ID NO: 158257 - RNA, 64 nt, Human
acaggaugauguguuaacaguauuaggguggaagaggaaucaagaguaaagagguagggguuua

SEQ ID NO: 158258 - RNA, 64 nt, Human
gcccaguguggaugucucuuacagagggggcccaaggaaucaccaccccgcuucaguguaaaca

SEQ ID NO: 158259 - RNA, 64 nt, Human
uguuuuacaggggauuuaucaauaauugauuuugaggaaucaguuuuuuucuauggcuaauaaa

SEQ ID NO: 158260 - RNA, 64 nt, Human
gcuccccucuguaccccaacucauuuaaaauaggaggaaucacuuuuugccuuacuuaacgcuu

SEQ ID NO: 158261 - RNA, 64 nt, Human
auuuuacaguuugcacaguauuauuuuacagaaaaggaaucagagaaucuacaacauagggccc

SEQ ID NO: 158262 - RNA, 64 nt, Human
gauaauaauuaugcugauuuuuagcaucucuuauaggaaucaaaguuuauuaaaguuacauaga

SEQ ID NO: 158263 - RNA, 64 nt, Human
aaaaggaaguccccccaucagacucuggacacccaggaaucaaaagagaaaggacuuuuuuggu

SEQ ID NO: 158264 - RNA, 64 nt, Human
aagccaaggagucauaaaaccaugagaaauaaauaggaaucaauaguuaguagugacauuggug

SEQ ID NO: 158265 - RNA, 64 nt, Human
ccuuugccagcagagccagggcagggcgagcugcaggaaucaccccucugccccugcagcugga

SEQ ID NO: 158266 - RNA, 64 nt, Human
gucuuauucgagaacuugguaaaucuguuuuuuaaggaaucauaaucauuuguauuuauacuua

SEQ ID NO: 158267 - RNA, 64 nt, Human
agaaggcaggacugaauggcagagcuagcuuugcaggaaucauuacaguugcuccuuuuucucu

SEQ ID NO: 158268 - RNA, 64 nt, Human
auuuuugcuuuuaaagaggucuuauaauggaacuaggaaucaccguuuugagagaaccugcaua

SEQ ID NO: 158269 - RNA, 64 nt, Human
uccccccugaaauguauagaauccauuugucaucaggaaucaaaacccacaguccauugugaag

SEQ ID NO: 158270 - RNA, 64 nt, Human
aaccugcuuacucauuucucaggggauuuugggaaggaaucagcaggugacaguugcuaagcaa

SEQ ID NO: 158271 - RNA, 64 nt, Human
acuuuguccagaaaagaagucuuaagauauuucaaggaaucagugucguuaucugaccguaucc

SEQ ID NO: 158272 - RNA, 64 nt, Human
gcauggaaauuaaguaggcuguuuauuuaucuaaaggaaucaaguccacucuucugccugcaac

SEQ ID NO: 158273 - RNA, 64 nt, Human
acagcagggugggacagucaguccuccgagcagcaggaaucaucccgucaccugcagccuuccc

SEQ ID NO: 158274 - RNA, 64 nt, Human
aaaagacuuagaauagucagcuauccugagcaaaaggaaucaaacuggaggaaucauauuaccu

SEQ ID NO: 158275 - RNA, 64 nt, Human
agucagcuauccugagcaaaaggaaucaaacuggaggaaucauauuaccugacuuccaauuauu

SEQ ID NO: 158276 - RNA, 64 nt, Human
uuauaaaaauugcauuauguguuucugcuaauagaggaaucauagccauuuagaauuuuuuuua

SEQ ID NO: 158277 - RNA, 64 nt, Human
gucucuggugaacaaacuuccucucuggccucucaggaaucaggguggacauggcucacaacag

SEQ ID NO: 158278 - RNA, 64 nt, Human
ggagucugagaucuguacuguuucaggauuacaaaggaaucaggauuuagccucaaguaguucc

SEQ ID NO: 158279 - RNA, 64 nt, Human
aaacaugacccuaaaucuugacuacagucaggaaaggaaucauuucuauuucuccuccauggga

SEQ ID NO: 158280 - RNA, 64 nt, Human
augcuucugagucuaggcguuguggugaauaugcaggaaucauucaugagacagaauguauuuu

SEQ ID NO: 158281 - RNA, 64 nt, Human
aagcucucccuuacagaggcaacacagaauuauaaggaaucagaaaucccccuucuaccaggcu

SEQ ID NO: 158282 - RNA, 64 nt, Human
augggugugugugugacugcaggggucguguccaaggaaucaagagucaccccagcugcugggc

SEQ ID NO: 158283 - RNA, 64 nt, Human
ucaguguguugcucaggauaccccagguacaucaaggaaucaaggagaggaaaauaugagcaau

SEQ ID NO: 158284 - RNA, 64 nt, Human
acauggcccuguuuucugcuaaaaccagauuuugaggaaucagagacccccaacacuacucacu

SEQ ID NO: 158285 - RNA, 64 nt, Human
cuuaauauaugaccaugacuuugaaaggcaaaagaggaaucaagaauaaauaaaacaaacuuaa

SEQ ID NO: 158286 - RNA, 64 nt, Human
acuuccuuugacuuucuguguaccacugggauagaggaaucaagaggacaaucuagcucuccau

SEQ ID NO: 158287 - RNA, 64 nt, Human
acaauaugcaggagcaguaaacuggcagaaaaccaggaaucagagaaagaaaauauaauuuaac

SEQ ID NO: 158288 - RNA, 64 nt, Human
guugaguggugccaugugggccgcucuauuccaaaggaaucauggauuagacccaagggcugag

SEQ ID NO: 158289 - RNA, 64 nt, Human
gagggggaggggugguacuuggcaccaauaaaggaggaaucagacccagacgcugggaguuguc

SEQ ID NO: 158290 - RNA, 64 nt, Human
ccaaaaguugcagagugguggaaugcuauguuuuaggaaucaguccagaugugaguuuuuucca

SEQ ID NO: 158291 - RNA, 64 nt, Human
uggacugccccuaggacuucuguuucaccagagcaggaaucaaguggugaggcacugaaucgcu

SEQ ID NO: 158292 - RNA, 64 nt, Human
augccauuuugcuauagacucauucauguuuuuuaggaaucagaaucauuucaggagaaaacca

SEQ ID NO: 158293 - RNA, 64 nt, Human
ucacuuguauuauuauuugaauggaugcugcuggaggaaucaguuggaauugaagacacguucu

SEQ ID NO: 158294 - RNA, 64 nt, Human
aauuaaggguagccaagaccuugcaugguagaguaggaaucauagugucagugaggucccguga

SEQ ID NO: 158295 - RNA, 64 nt, Human
aauuucaacuaaaggcugaggcacggagaagaaaaggaaucagcaacugcccugaugggccaug

SEQ ID NO: 158296 - RNA, 64 nt, Human
gcauauacuuuaauguuuuaacucuuuuggacaaaggaaucaauuacuugaaguugcuuuuuug

SEQ ID NO: 158297 - RNA, 64 nt, Human
accauucagaauaucaucuuuuagacacagcccgaggaaucaacaauaguaacucuuucuuucc

SEQ ID NO: 158298 - RNA, 64 nt, Human
uguccuggaaaaaaacugguacucaaagcugcuuaggaaucaaaauguuuucaguguguugauu

SEQ ID NO: 158299 - RNA, 64 nt, Human
ccacggcugauggucccuccaaggccgacuccuaaggaaucaccaucacccuccuuucuauucu

SEQ ID NO: 158300 - RNA, 64 nt, Human
ugauauggauugaaucugguuggucauuuccaccaggaaucagaggcagcuguuaccagguuuc

SEQ ID NO: 158301 - RNA, 64 nt, Human
gaaacccuugguccagagaggacaggcuuucuggaggaaucaggcccugggacagccucugagc

SEQ ID NO: 158302 - RNA, 64 nt, Human
uguuuuugguuuuaauuugcagagauuugcugccaggaaucaauuuugaggguucagauuuagc

SEQ ID NO: 158303 - RNA, 64 nt, Human
ugugcaggggagcacacagggcccggcagcccccaggaaucaaggauagggcuaagguuuucac

SEQ ID NO: 158304 - RNA, 64 nt, Human
acugaacuauuauguuaaugaagauggacauuuuaggaaucaccaauggcuccuugcccucaag

SEQ ID NO: 158305 - RNA, 64 nt, Human
ugacagcuagacuugaugcuugcugaaaugaggcaggaaucauaauagaaaacucagccucccu

SEQ ID NO: 158306 - RNA, 64 nt, Human
gaauccguccucuuggcucucccagcccuaucacaggaaucauuccuggguuucugucccucug

SEQ ID NO: 158307 - RNA, 64 nt, Human
ggcuaaauucaugcugcuuagaugacaucugucuaggaaucaugugccaagcagagguugggag

SEQ ID NO: 158308 - RNA, 64 nt, Human
ggaaagagaaacaagugacugagaagucuuguuaaggaaucagguuuuuucuaccugguaaaca

SEQ ID NO: 158309 - RNA, 64 nt, Human
gcaccugcauccguaguucccugaaaacccagagaggaaucagacuucacacugcaagagccuu

SEQ ID NO: 158310 - RNA, 64 nt, Human
cagcaaaccaggacucugccccuucuguuuccauaggaaucauguuggauagucagcuguacca

SEQ ID NO: 158311 - RNA, 64 nt, Human
agggugagggaugauuguaaaauuugcuccucaaaggaaucaggccagacucaauuuuggaggg

SEQ ID NO: 158312 - RNA, 64 nt, Human
gaaacagauaucauagagcugaacaaggaaacugaggaaucacccaaaugagugccaccaaguu

SEQ ID NO: 158313 - RNA, 64 nt, Human
uauggguguugaaaacuagguuacuuauaaugcaaggaaucaggaaacuuuaguuauuuauagu

SEQ ID NO: 158314 - RNA, 64 nt, Human
ucuuggguuuauuagaugaaguuuacugaaucagaggaaucagacagaggaggauagcucuuuc

SEQ ID NO: 158315 - RNA, 60 nt, Human
ugaccccagucgugucuugaugacucucccaggaaucagaaagauaguauuuacuaaaga

SEQ ID NO: 158316 - RNA, 64 nt, Human
ucucaauaauuucauuuucuuggccaaagccaaaaggaaucaaaaaauccuuggagugcuugcc

SEQ ID NO: 158317 - RNA, 64 nt, Human
gugaaugcuuucugcuguaagugucuuuuagaguaggaaucagcauagugggaugcccagcagg

SEQ ID NO: 158318 - RNA, 64 nt, Human
ugucauuuuuacggaaacccuuucggcgugcauaaggaaucacuguguacaaacuggccaagug

SEQ ID NO: 158319 - RNA, 64 nt, Human
acggcauugcucaguaaguugaggucaaaaauaaaggaaucauacaucucaaaauuuugcaaau

SEQ ID NO: 158320 - RNA, 64 nt, Human
ccuccucccuuucucccuuguggggaauguuuggaggaaucacuggcauuugauggggaauaac

SEQ ID NO: 158321 - RNA, 64 nt, Human
auaagauugcggggucggagugugggcgcguaauaggaaucacccuccuacugcgcguuuucaa

SEQ ID NO: 158322 - RNA, 64 nt, Human
ccaguuucuuuuguauugagucaagggugucaguaggaaucaaaaguuggggguggguugcaaa

SEQ ID NO: 158323 - RNA, 64 nt, Human
aauaaauggagugguauccuaucuucuuuuuuuaaggaaucaaugaauaauaaauguagauaga

SEQ ID NO: 158324 - RNA, 64 nt, Human
ccaguucauuacacaaaauguagcgggauuuuuaaggaaucagagagacugauggaguucaggg

SEQ ID NO: 158325 - RNA, 64 nt, Human
cuagauuagacaaacaguuaauagauccaccauuaggaaucaauauauuaugucauaauaaaca

SEQ ID NO: 158326 - RNA, 64 nt, Human
cauuuaaaggagcuaggagacaugauuuuaaaaaaggaaucaauagaugcuuugaagaaaauaa

SEQ ID NO: 158327 - RNA, 64 nt, Human
ccagagaguuuggaguguaggauucccucugugaaggaaucaucucuacuucucugaggacaau

SEQ ID NO: 158328 - RNA, 64 nt, Human
ugaaagggcaaagucuuaaucaaucaaacaauggaggaaucaccgacuuuacacaguauuuaau

SEQ ID NO: 158329 - RNA, 64 nt, Human
gugccauaaacaacugaaagcuugcucugccaaaaggaaucagagaacaagaacuucauuucag

SEQ ID NO: 158330 - RNA, 64 nt, Human
uuucuucccuacucauaguaugcguuccauuuugaggaaucacagauaucgaagagaugccaga

SEQ ID NO: 158331 - RNA, 64 nt, Human
acuuguggcccacaaaauuucacaaugacugcugaggaaucauucuuuuugccuguaaaauaua

SEQ ID NO: 158332 - RNA, 64 nt, Human
uuucuggucucuaggcuggggaaguccucuggguaggaaucagcaagaagauccuaaaacaaaa

SEQ ID NO: 158333 - RNA, 64 nt, Human
gacccagaguuagcaguggggauggagcaguagaaggaaucacuguuucuccuaggagucugaa

SEQ ID NO: 158334 - RNA, 64 nt, Human
auuuauuuauugaaaccccuacuuugauugacaaaggaaucaagguagaucugaccaguauucc

SEQ ID NO: 158335 - RNA, 64 nt, Human
uaaggaauuaccuaaggcaggcagcaaguagauuaggaaucaaugucuuuguacaagaaggaaa

SEQ ID NO: 158336 - RNA, 64 nt, Human
ugaugaaucuaugguucuuacagaaauuuuucaaaggaaucaauuuagagauagaguuuucaua

SEQ ID NO: 158337 - RNA, 64 nt, Human
aaaguguucagguacagcagcugaggcugcccugaggaaucaaggggccauuaccaaggggcag

SEQ ID NO: 158338 - RNA, 64 nt, Human
caaugccucccuuugcuccuggaugccccacuccaggaaucaugcuugcuccccugggccauuu

SEQ ID NO: 158339 - RNA, 64 nt, Human
ccucuuucaccuuucccuaaagacccuaaaucugaggaaucaacagggcagcagaucuguauau

SEQ ID NO: 158340 - RNA, 64 nt, Human
caagucacagauagacauuccaguuuguauucuuaggaaucauucuuaggcagugcggcagaag

SEQ ID NO: 158341 - RNA, 64 nt, Human
uguaagagcaucaggccagaugauaugagggcacaggaaucagucauggaccuaugcuuuggug

SEQ ID NO: 158342 - RNA, 64 nt, Human
ggagucuccugugaucacaucuugucucggcuguaggaaucaacagaaggagacguccucuaca

SEQ ID NO: 158343 - RNA, 64 nt, Human
ggauucuuaauuguuggcuaaguuccagucaaguaggaaucagugcagccuguaaguucuccac

SEQ ID NO: 158344 - RNA, 64 nt, Human
gcguuucaggggagggcccuuaaaggaaggcagcaggaaucagucuugucgaacaggggggcgu

SEQ ID NO: 158345 - RNA, 64 nt, Human
ccugggugcugcagauacugcagugaaguaaaacaggaaucaaucuugccugcccccagcucac

SEQ ID NO: 158346 - RNA, 64 nt, Human
cuuaaagugagagcacgccuguacuagagcaagcaggaaucagagaccuuccagaaauacuacu

SEQ ID NO: 158347 - RNA, 64 nt, Human
gauuacaaaucuccucgacugcuuuaguggggaaaggaaucaauuauuuaugaacuguccggcc

SEQ ID NO: 158348 - RNA, 64 nt, Human
gcauuggaagagcccgccgucugcaggggccuggaggaaucacuggggaugguggcacaggcac

SEQ ID NO: 158349 - RNA, 64 nt, Human
uaugaugaccaccuugggccuugggaucaugaccaggaaucacgugaagcugacaccacugaag

SEQ ID NO: 158350 - RNA, 64 nt, Human
gaaggaagaagggaaggcggaggagucuauaagaaggaaucaugauuucuauuuagcagauugg

SEQ ID NO: 158351 - RNA, 64 nt, Human
acggggacuggggaugugggagggagcagacaggaggaaucaugucaggccugugugugaaagg

SEQ ID NO: 158352 - RNA, 64 nt, Human
gggauagaugugcuagucuucuagcauaggagcaaggaaucagaggugggguuaaaggcauuuu

SEQ ID NO: 158353 - RNA, 64 nt, Human
uacgugugggcacuugugcuugagccuguauuaaaggaaucaggccaggcacaguggcucacgc

SEQ ID NO: 158354 - RNA, 64 nt, Human
aaaccucaugccuacugucugccacugcuggagaaggaaucaugguuucuagaagugccucuca

SEQ ID NO: 158355 - RNA, 64 nt, Human
uaaaaaaggcaacugaaaguaauuagacuucuuaaggaaucaaauuuauuucaagagacuacac

SEQ ID NO: 158356 - RNA, 64 nt, Human
gauguucuagaauguagauaccuuguccagccauaggaaucaaaauaaaaaacuaaaaaaguuc

SEQ ID NO: 158357 - RNA, 64 nt, Human
auaacuuuagagcacugacauaaaacgcaaaaacaggaaucaugccguuugcaaaacuaacucu

SEQ ID NO: 158358 - RNA, 64 nt, Human
acugcugcuugugaauguuaaggacagcagguagaggaaucaaagccagcagcauccuagaaag

SEQ ID NO: 158359 - RNA, 64 nt, Human
accucuccaucuucagcuucuucaucuucaccagaggaaucacucuuguggauguuuuaauucc

SEQ ID NO: 158360 - RNA, 64 nt, Human
gugauuucgugucggcuccccaggcuguggccucaggaaucaacuuaggcaguucccaacaagc

SEQ ID NO: 158361 - RNA, 64 nt, Human
cgcaggaaauuuucuuuuucacagaacuggugucaggaaucacugaagggcuaaccgugauagu

SEQ ID NO: 158362 - RNA, 64 nt, Human
aacaaauguaaugggcauauugggacucguauguaggaaucaaauaucccuccauacaguguac

SEQ ID NO: 158363 - RNA, 64 nt, Human
gaccaggcagaaggcgccuccguccuagccacucaggaaucaucgaggagcacagggaaaagga

SEQ ID NO: 158364 - RNA, 64 nt, Human
caaacaaguucuguugaaaucucacgcuguugucaggaaucaguguuauccuggaacuguuauu

SEQ ID NO: 158365 - RNA, 64 nt, Human
aaauaaaaaaacagcauuacuauuucuaaucccaaggaaucacuuuauuguaaacacuagcaga

SEQ ID NO: 158366 - RNA, 64 nt, Human
agcagcugaauguuccugugcagaaauuaacagcaggaaucacgagaaagguacgugcggugug

SEQ ID NO: 158367 - RNA, 64 nt, Human
uugccgaguucuugcaguguguauauuacuuugcaggaaucaaaauuguuuuauucagaagaca

SEQ ID NO: 158368 - RNA, 64 nt, Human
agaauguuacuuuaauauauaauccaucagacagaggaaucaauaauaaaacugcaacagaacu

SEQ ID NO: 158369 - RNA, 64 nt, Human
ccaaucuucccgucuuuaugagagaaaaggaaaaaggaaucaaagguggaagaaaaaaaaagcc

SEQ ID NO: 158370 - RNA, 64 nt, Human
acauucuuauuaauucuucaccuguuauguaugaaggaaucauuccagugcuagaaaauuuagc

SEQ ID NO: 158371 - RNA, 64 nt, Human
uaacauagcaugacaaauuuuguguugacuugaaaggaaucacaccauuauuccuuagaaguaa

SEQ ID NO: 158372 - RNA, 64 nt, Human
ccaagggcagaauguuucacccugaucuuaugggaggaaucaaacucccaaaauaguguguaua

SEQ ID NO: 158373 - RNA, 64 nt, Human
ucccauaagacaaugacauacgcuuuuaaugaaaaggaaucacguuagaggaaaaauauuuauu

SEQ ID NO: 158374 - RNA, 64 nt, Human
caagaugaguucagcuagaagucauaccacccucaggaaucagcuaaguaauuauuacuugauu

SEQ ID NO: 158375 - RNA, 64 nt, Human
gccaaaauauaaagaacuuguguagauuuucuacaggaaucaaaagaagaaaaucuucuuuacu

SEQ ID NO: 158376 - RNA, 64 nt, Human
uuugugugugaaucucacuuuccucaauguaaaaaggaaucaaguauggauuucagaggugcuc

SEQ ID NO: 158377 - RNA, 64 nt, Human
aaaagaaauugggaggguacaggcaacaggagaaaggaaucaaaccacagaaaaauacaaaggg

SEQ ID NO: 158378 - RNA, 64 nt, Human
ucuuguguaggguccagcugcuuuuggggacugcaggaaucaucuccccugggcccuggacucg

SEQ ID NO: 158379 - RNA, 64 nt, Human
uaaauaaacuugugagcuggccccaaccccuccuaggaaucacagcuccccguacuggugccgc

SEQ ID NO: 158380 - RNA, 64 nt, Human
caaguauaucaaggcacuugggcagaacaugccaaggaaucaaaugucaucucccaggaguuau

SEQ ID NO: 158381 - RNA, 64 nt, Human
cuaucuggacugucugccaaucauuuuuagagggaggaaucaguguuggauugcagagacauuu

SEQ ID NO: 158382 - RNA, 64 nt, Human
auucccagcucagggcuaaugguucacggaagccaggaaucaaacugccuggguuccaguccca

SEQ ID NO: 158383 - RNA, 64 nt, Human
ccacaggaacauccagaaccuguugaacaaagaaaggaaucaugugggccuguguuaaaucaaa

SEQ ID NO: 158384 - RNA, 64 nt, Human
cgacagacuguguccucuuucccaccuucauagcaggaaucacccggacccgacuggcugggcu

SEQ ID NO: 158385 - RNA, 64 nt, Human
uaguccccagagcuguguuccuccaagggguccgaggaaucacucacuccuggaggcuggcaag

SEQ ID NO: 158386 - RNA, 64 nt, Human
cuucaguuaccacuguacugcucaaaaacaugagaggaaucacacugcacagaaacacuaugaa

SEQ ID NO: 158387 - RNA, 64 nt, Human
cuucauuuaccgccauucugcucgagcacaugaaaggaaucacacuguacagaaacgcuaugaa

SEQ ID NO: 158388 - RNA, 64 nt, Human
ggauuguugcaaggaguaaguaguuaauacuuggaggaaucacagucauauagcauguauucug

SEQ ID NO: 158389 - RNA, 64 nt, Human
gcaauuaaaucuaaaauaaggguaauucuacaagaggaaucaccugguuucccaaccaauaaaa

SEQ ID NO: 158390 - RNA, 64 nt, Human
uucugauaaacacaaucugcuaggaacuugggaaaggaaucagagagcugcccuucagcgauua

SEQ ID NO: 158391 - RNA, 64 nt, Human
ccccaagcauccagccuggggaugggccccuuucaggaaucacccccgaggauggccucggggu

SEQ ID NO: 158392 - RNA, 64 nt, Human
ggcgcgcacgcccccaaaccagcuguuuacauacaggaaucagguauuggggccccucggaggc

SEQ ID NO: 158393 - RNA, 64 nt, Human
aaagcucagcacaguuuccuccugggaugaggagaggaaucagaaaccccacuuuggcauagag

SEQ ID NO: 158394 - RNA, 64 nt, Human
cuguacaaaugacacugcacuaggauuauugggaaggaaucauuguuccaggcauccaucuugg

SEQ ID NO: 158395 - RNA, 64 nt, Human
gcaucuacaguacagccaggcaggcaggaccuugaggaaucagacuaucugucugugugucacc

SEQ ID NO: 158396 - RNA, 64 nt, Human
uuuuuuaaaggauauuuaacuuuuauggacuagaaggaaucacgagggcuacugcacaauacau

SEQ ID NO: 158397 - RNA, 64 nt, Human
gaaaggaaaggaaaggccuggcaugggcauugugaggaaucacaggcaccgagguuguucucug

SEQ ID NO: 158398 - RNA, 64 nt, Human
uggaucacagaccugaaucuguuguguugguaaaaggaaucaacaccuuuacauugcucaauuu

SEQ ID NO: 158399 - RNA, 64 nt, Human
uucgucacuuaauuccugaauguuucagagaaacaggaaucagaaaauagcagauaucauguag

SEQ ID NO: 158400 - RNA, 64 nt, Human
cucuauauaauauuauauaugugugugguauccaaggaaucacuuuuaugagggcuaaagauaa

SEQ ID NO: 158401 - RNA, 64 nt, Human
acuggucugcuguuccagugguaagcuaugucccaggaaucaguuuaaaagcacgacaguggau

SEQ ID NO: 158402 - RNA, 64 nt, Human
aucccaggaggugacgaggcaggggcuccaggaaaggaaucagagacaauucacagagccuccc

SEQ ID NO: 158403 - RNA, 64 nt, Human
ggaauacguggggugggucuggacaaggagcggcaggaaucaccacccaucuccagcuguggag

SEQ ID NO: 158404 - RNA, 64 nt, Human
gcaaccaugagccuuaacauugccaucagaaggaaggaaucaggcaggugaaggcaacaugaug

SEQ ID NO: 158405 - RNA, 64 nt, Human
caaaccuuggcacacaggugugauacaacuuaacaggaaucaucgauucauccauaaauaauau

SEQ ID NO: 158406 - RNA, 64 nt, Human
cugaaauaggacauuuuuccuacaguaacaaaacaggaaucaaacucaaggcugugaacaaaca

SEQ ID NO: 158407 - RNA, 64 nt, Human
agcuggccuuggucagcuuagggaugaauggagaaggaaucauucaugggccucggcuaggucc

SEQ ID NO: 158408 - RNA, 64 nt, Human
acaacgucauuaagaaggauacacuuaggugauaaggaaucauuuuuggugaacuguugugucc

SEQ ID NO: 158409 - RNA, 64 nt, Human
caggcacaaaauuuaagggggcuccaaaaaacucaggaaucaagaucagcaauacagucugagu

SEQ ID NO: 158410 - RNA, 64 nt, Human
ccaaccucuguuccccacccaguucuucauuuggaggaaucaccccauuucagaguuaucaaga

SEQ ID NO: 158411 - RNA, 64 nt, Human
aaguaacaaccugaauugagucauugcuuucugaaggaaucauuguccuuucuccaguuuuugu

SEQ ID NO: 158412 - RNA, 64 nt, Human
cucagcuauguagcugauauagugaugggcaaacaggaaucacuugcuuuuauguccacuuuuu

SEQ ID NO: 158413 - RNA, 64 nt, Human
uuguuaaaaucauagaaagaucuuuuauuuuuuuaggaaucaaugacuuaacagaacucaacug

SEQ ID NO: 158414 - RNA, 64 nt, Human
ucacuuguugugcaaaagugaauuaauuucaaauaggaaucauauugcuuuugugaaacaaaga

SEQ ID NO: 158415 - RNA, 64 nt, Human
gcagcaaauuugacuugaauucacuuaggaucgcaggaaucaggggaaagugauuuuaaaggug

SEQ ID NO: 158416 - RNA, 64 nt, Human
uuguuauuagcuuuguggcuuugugaaauucuaaaggaaucaaauaauucaucaugauuuaaau

SEQ ID NO: 158417 - RNA, 64 nt, Human
uacaacucagcuauaauccugagggaacaugggaaggaaucaaagguaaagcccauucaggcau

SEQ ID NO: 158418 - RNA, 64 nt, Human
ccucucauuccaagggcaggaagaugugacucagccaugacacgugguucuggugggaugcaca

SEQ ID NO: 158419 - RNA, 64 nt, Human
gccuuucacuucugccuucuguugagaauuaucaccaugacaccugccauaccguauagagagc

SEQ ID NO: 158420 - RNA, 64 nt, Human
aucaugagcucugaagauuuucagcauuuaucucccaugacagaaauaaauuuaccucguccua

SEQ ID NO: 158421 - RNA, 64 nt, Human
agcaacacuguuuuuauguaguucauauauauuaccaugacauuuaacaucaauaucguauaug

SEQ ID NO: 158422 - RNA, 64 nt, Human
gcaggucccuuuucuuggaaggcuuguacuauggccaugacagugacauugcccucaccaugau

SEQ ID NO: 158423 - RNA, 64 nt, Human
acagcagagcaaguauucacugaguaggggugucccaugacacuauuucauauucuacagaagu

SEQ ID NO: 158424 - RNA, 64 nt, Human
guagucauuuugagagguacaaagcucauaauuaccaugacaacaugguaauguccauagacau

SEQ ID NO: 158425 - RNA, 64 nt, Human
gcagcaguuucugaugcugaggcaguuugcaaucccaugacaacuggauuuaaaaguacaguac

SEQ ID NO: 158426 - RNA, 64 nt, Human
gcaaagaguauauguaggaggugggauaucacuuccaugacauaagugcuauugcagagccgug

SEQ ID NO: 158427 - RNA, 64 nt, Human
gacuuauugcaaauggcgguuggcugaggaaaacccaugacacagcacaacucuacagacagug

SEQ ID NO: 158428 - RNA, 64 nt, Human
gucccaugucugguucugugucuaaaggccugcuccaugacacaggaugcuacaugcacuccug

SEQ ID NO: 158429 - RNA, 64 nt, Human
aaagaaaaauauuaguuuaccugagcacuuauuuccaugacagggucuaaaauauggaccauga

SEQ ID NO: 158430 - RNA, 64 nt, Human
ggguaauuaaaaacagaaaauuauagucaauauaccaugacaugaagaaugaauccauucuuug

SEQ ID NO: 158431 - RNA, 64 nt, Human
uguuuugguggugucccccuacuccgucucuaugccaugacagccuucugccccaaagccugga

SEQ ID NO: 158432 - RNA, 64 nt, Human
gcuacacugcaacuuccguccagugcugugaugcccaugacaccugcaaaauaaguucugccug

SEQ ID NO: 158433 - RNA, 64 nt, Human
auuuucugcuaccauuucuuuuccucugaagcggccaugacauucccuuuggcaacuaacguag

SEQ ID NO: 158434 - RNA, 64 nt, Human
uuaauacuuuugugcaacuguguuuugaauaaagccaugacaguguuaaaaacaaacaaaaaaa

SEQ ID NO: 158435 - RNA, 64 nt, Human
ccagagcugcagugccacuggaggagucagacuaccaugacaucguagggaaggaggggagauu

SEQ ID NO: 158436 - RNA, 64 nt, Human
uugaauacuaugugggauucacccucuuccagacccaugacaacagagagcaucuagccaugau

SEQ ID NO: 158437 - RNA, 64 nt, Human
caguccuucacuuaucaauaugcauuccuauugcccaugacagguauggaguucacacugugug

SEQ ID NO: 158438 - RNA, 64 nt, Human
cugugagcccugaacccuccaggaggcugcuuccccaugacacuagugaccaguaaaaugaaaa

SEQ ID NO: 158439 - RNA, 64 nt, Human
uuggcuguggcaggccagcugugguuuucuuuugccaugacaacuucuaauugccauguacagu

SEQ ID NO: 158440 - RNA, 64 nt, Human
aagccuagacggugucgccgccugcucccugcacccaugacaaucaccuucagaaucaugucga

SEQ ID NO: 158441 - RNA, 64 nt, Human
gaaaacccaguuagaugcaauuuggucauuaauaccaugacaucuugcuuauaaauauuccauu

SEQ ID NO: 158442 - RNA, 64 nt, Human
uauuaggaguguucugccucuacaguggcauauuccaugacauuaauagaaaacccuucuuucc

SEQ ID NO: 158443 - RNA, 64 nt, Human
auauguggggugaaaccguauacuacuuucacugccaugacacuaggcaaaaaauauuuccugu

SEQ ID NO: 158444 - RNA, 64 nt, Human
gcuggguggcccugcagccuccuccaccucaccuccaugacagcgcuaaacguuggugacgguu

SEQ ID NO: 158445 - RNA, 64 nt, Human
caguuucacucccucuugguuuuuaucaaauuugccaugacauuucaucuggguggucugaaua

SEQ ID NO: 158446 - RNA, 64 nt, Human
auucaccauuagagguugauggggcaacugcagcccaugacacaagaucucauuguucucgaug

SEQ ID NO: 158447 - RNA, 64 nt, Human
aaacacaauauucuaaguaucuuuagcccaaauaccaugacauauugagcaucuuuaaauaacc

SEQ ID NO: 158448 - RNA, 64 nt, Human
auuagacaggaucaauuguaaagugagggcuucuccaugacaccauaguucugcccaauacugc

SEQ ID NO: 158449 - RNA, 64 nt, Human
acaccacaccuuguuugcacaaaaaauaacucagccaugacaugucuguuuccaagagccacac

SEQ ID NO: 158450 - RNA, 64 nt, Human
accuuccccuccccgugcgcucuggggacugagcccaugacaccaaaccugccccuuggcugcu

SEQ ID NO: 158451 - RNA, 64 nt, Human
guguuccuuaguucccgugugaaagcagaggaacccaugacauccaagggcgugaaaggaucag

SEQ ID NO: 158452 - RNA, 64 nt, Human
uaaaaagagggacuguuaaauacaauguaugauaccaugacaaaaaucuuuccugaauugucuu

SEQ ID NO: 158453 - RNA, 64 nt, Human
aggaagacuggcuggaaacuuauuuuaaucacacccaugacaaacucuccagaucuguuuacca

SEQ ID NO: 158454 - RNA, 64 nt, Human
ucuugauugauuucauacagaagaugacugugauccaugacaucuaauaaugcccuuucuuuau

SEQ ID NO: 158455 - RNA, 64 nt, Human
ggugcuuuccuuuugucuugcauacucaaaauaaccaugacaccaagguuaugaaauagacuac

SEQ ID NO: 158456 - RNA, 64 nt, Human
ugaguggagugcugccaagaauaugcccgacuccccaugacaagacagaacuuuguaacaaaca

SEQ ID NO: 158457 - RNA, 64 nt, Human
cccauggauuaacgcccucaucccaagguccgucccaugacauaacacuccacacccgccccag

SEQ ID NO: 158458 - RNA, 64 nt, Human
uccaggaaugaaauauagauguuagcccaagacaccaugacaaaauagcccagccuuuugagag

SEQ ID NO: 158459 - RNA, 64 nt, Human
gugcaagugguagggacaagcagugaggugguggccaugacacuggagaccaagccucagcgga

SEQ ID NO: 158460 - RNA, 64 nt, Human
uggcugcccugcccuacugugggcauagcgcccgccaugacacgcugcccgugccccuagcagg

SEQ ID NO: 158461 - RNA, 64 nt, Human
cuucuuugaucagucauguguccgugaccucguuccaugacaucaggauagcuguguuugcaca

SEQ ID NO: 158462 - RNA, 64 nt, Human
aagggacauuccaucccuguacccuuagugguagccaugacacgauggccagaucauggacucc

SEQ ID NO: 158463 - RNA, 64 nt, Human
gggagguguggcccuguucuuccucaccccaguuccaugacauuggcugguauaggagccacag

SEQ ID NO: 158464 - RNA, 64 nt, Human
gaaguauuucugaguaaucuggaagaaaccugccccaugacauguauucucgguagguauuugu

SEQ ID NO: 158465 - RNA, 64 nt, Human
ugugaugccuggagccacagcagccacuuugcuaccaugacaaaaaggccaagagaaucacaga

SEQ ID NO: 158466 - RNA, 64 nt, Human
ugacagggaggaggcugagaacucaguuuugugaccaugacaguaaugaaaccagggucccaac

SEQ ID NO: 158467 - RNA, 64 nt, Human
ugcuccugcuaaugcagagccgaccuguggcuucccaugacacuccuugcuuguuguguugcuu

SEQ ID NO: 158468 - RNA, 64 nt, Human
aaauccugcaauauccuugaaauccaaaagagguccaugacauagacccaaagguauucaugag

SEQ ID NO: 158469 - RNA, 64 nt, Human
aguaaccacauaucuguagggauuuauaagucagccaugacaauuauacaccacaggcauugua

SEQ ID NO: 158470 - RNA, 64 nt, Human
uuaacccagaacccuuagguauuccuggcaguagccaugacauuggagcaccuuccucuccagc

SEQ ID NO: 158471 - RNA, 64 nt, Human
gcugguguuaaggcuguaggaggacccaguuuccccaugacagugccuucuaacuagccagaga

SEQ ID NO: 158472 - RNA, 64 nt, Human
accgccucagcagcugaacuaaaaaccugaauagccaugacaagaguuugcauuuucuugauga

SEQ ID NO: 158473 - RNA, 64 nt, Human
guucugaggaaguuaagcagcugcuucaucaaucccaugacacaugccuuguuagcaugcccau

SEQ ID NO: 158474 - RNA, 64 nt, Human
cguuacauauuuaauggggauucccacauuguccccaugacacaugagcgcucucacuuacccu

SEQ ID NO: 158475 - RNA, 64 nt, Human
ccugugagucggccuuacuccguuuccuuagcgcccaugacacgccaagucccguuucgcacuc

SEQ ID NO: 158476 - RNA, 64 nt, Human
uguaauuuaacaaacaaauuuuauuuuuuuacucccaugacagacauguuuuuccuagucgugu

SEQ ID NO: 158477 - RNA, 64 nt, Human
cucaaaggcguagagagaauuucagagggccuuaccaugacaugaggauuaaacuccaguucug

SEQ ID NO: 158478 - RNA, 64 nt, Human
ggaccuucugcauaccuguuuagaaccaaaaccaccaugacacaguuuuuauagugucuguaua

SEQ ID NO: 158479 - RNA, 64 nt, Human
acuaguggagaaugucaagacaagauacuuauuaccaugacaucugaugcaugugcagcagugg

SEQ ID NO: 158480 - RNA, 64 nt, Human
ucuaauuacucccugaggguuaguuggggcuaaaccaugacagaaguggggaaguucaaugucc

SEQ ID NO: 158481 - RNA, 64 nt, Human
gcauggggcacccaugugccgagagccuugcagaccaugacaggucccuauuaaacacaggcuu

SEQ ID NO: 158482 - RNA, 64 nt, Human
ggccccagcagaacugcugagcuuuacaugguauccaugacaacugcugauuccagugucgagg

SEQ ID NO: 158483 - RNA, 64 nt, Human
accacucccuagggcggggccugugcaugcucucccaugacaucuccaugcugguuucuccaua

SEQ ID NO: 158484 - RNA, 64 nt, Human
uguaugaugcaaaugcugaaauguacaaaaucaaccaugacaacaaagaaaaagaccuuguaca

SEQ ID NO: 158485 - RNA, 64 nt, Human
auccuucuuggccaacagaugguaucuuuccuggccaugacagugugauucccccagaggaagc

SEQ ID NO: 158486 - RNA, 64 nt, Human
ggaaaaaugcaugaagggauggauaccccauuuuccaugacaugauuauuacacauugcaugcc

SEQ ID NO: 158487 - RNA, 64 nt, Human
cauucaaaucuauauccugggacccuguaaagguccaugacauccguuggaacuuugaaaaguu

SEQ ID NO: 158488 - RNA, 64 nt, Human
uucuccuguugguuauucugagucugacacagacccaugacaugucuuauaaagccuccaaugg

SEQ ID NO: 158489 - RNA, 64 nt, Human
uuuugucauuguguacguuguguauuugaacccaccaugacagaaaguaaauuuuaggaaauag

SEQ ID NO: 158490 - RNA, 64 nt, Human
cuuagggugaugaaauaaucuguguaacaaacccccaugacacaccuuuauguauguaacaaac

SEQ ID NO: 158491 - RNA, 64 nt, Human
uggccucucaucccaggcugcagacccuucugccccaugacaggccugggugccacacagaggu

SEQ ID NO: 158492 - RNA, 64 nt, Human
uuucuauuguaaauuaccuacuaaacagugguagccaugacauggaaagucaacugauucuaca

SEQ ID NO: 158493 - RNA, 64 nt, Human
acugucacaggaaggacaugucaaucuuggucauccaugacaccacaccggcaucagaggaccc

SEQ ID NO: 158494 - RNA, 64 nt, Human
ccccccuucccucccuucuugguuccauuuccauccaugacagguacagcaucccaggagcccg

SEQ ID NO: 158495 - RNA, 64 nt, Human
uguacacuuugucucacagaauaguucugaggcuccaugacaggguuuugucauuguugauguu

SEQ ID NO: 158496 - RNA, 64 nt, Human
ccuuggauagccuagcacagugcagccuccauaaccaugacauucccgcccaagcucucagugc

SEQ ID NO: 158497 - RNA, 64 nt, Human
ucuguaggauaaucacacuuagaaaacaucugcuccaugacauucacaauaccagggaccaugg

SEQ ID NO: 158498 - RNA, 64 nt, Human
ccuuguccuccuugguaccguaucaagcucuuucccaugacauuugguuuaaaaaaaaaaaaaa

SEQ ID NO: 158499 - RNA, 64 nt, Human
acuugagcagcugaaaagcaaaagccguuguuucccaugacaauguagccuuuguggauuuggg

SEQ ID NO: 158500 - RNA, 64 nt, Human
cugagauacacaauugcaggagauuuuauuggccccaugacauccagugacagugugggagcag

SEQ ID NO: 158501 - RNA, 64 nt, Human
uggccccagcgcgccccgacacacaugcuuuucuccaugacacgaggccaguccccaggagcag

SEQ ID NO: 158502 - RNA, 64 nt, Human
aaaggguuucuuugacacauucggaaccguucacccaugacauguuuccauggcucacccuugg

SEQ ID NO: 158503 - RNA, 64 nt, Human
ugggucauuuccagaaacuucugcagaggaaagaccaugacauauguaugggauaggccucuuc

SEQ ID NO: 158504 - RNA, 64 nt, Human
aagccuggguuucuggcugcuagcguuauagcauccaugacacagaacucauuacggacauucc

SEQ ID NO: 158505 - RNA, 64 nt, Human
ggguuuacacacuuaggcaauaguccuuuccaaaccaugacaaaaacuacaaguuuauuuauaa

SEQ ID NO: 158506 - RNA, 64 nt, Human
auugaagguucuuuggguaaauauuagucucccuccaugacacugcaguauuuuuuuuaauuaa

SEQ ID NO: 158507 - RNA, 64 nt, Human
uguauaugaugcugugauugcccuggaguuccugccaugacauggaaaccuggugguauggaag

SEQ ID NO: 158508 - RNA, 64 nt, Human
ccugguuggugaugguuuuuucuuccuuguuggaccaugacaauuuagguauucugugauuguu

SEQ ID NO: 158509 - RNA, 64 nt, Human
aggguccaggagaggaaucugcagaaacauggagccaugacagauggcuuuuuggcuaggacug

SEQ ID NO: 158510 - RNA, 64 nt, Human
cugcagaccucaagccaucaugcggugggugcugccaugacagaggcugcaccccugggccagc

SEQ ID NO: 158511 - RNA, 64 nt, Human
uuaauacuguuccaccaaagugaugcagugguuaccaugacacccuaauuucauguguuuuugu

SEQ ID NO: 158512 - RNA, 64 nt, Human
ugugcuauagacauuagagagauuuuucauuuuuccaugacauuuuuccucucugcaaauggcu

SEQ ID NO: 158513 - RNA, 64 nt, Human
uuuaugggauuccuggagcgcagggcuggugaauccaugacaagguccgggagcagcagaccaa

SEQ ID NO: 158514 - RNA, 64 nt, Human
gguggguucuguuuuccaggugaaacuuuuagcuccaugacagaccagccuguaguuaucugug

SEQ ID NO: 158515 - RNA, 64 nt, Human
gaggucagacaucuccuugaugucugugaucaaaccaugacaggaugcaaccacaacacacggc

SEQ ID NO: 158516 - RNA, 64 nt, Human
auuuggcaggaguuuugacugggguaggagaaacccaugacauuagaauugaauaaaaccuaga

SEQ ID NO: 158517 - RNA, 64 nt, Human
aauggagauaacagggguggcaggguuacugagcccaugacaaugcuucucugugacucaaacc

SEQ ID NO: 158518 - RNA, 64 nt, Human
caggugggcauuucaaccaacucagucaaggaacccaugacaaagaaagucauuucaacucuua

SEQ ID NO: 158519 - RNA, 64 nt, Human
aagcaugucugggccaggcagaggugcuccucauccaugacaccaccagucugaaugguccugg

SEQ ID NO: 158520 - RNA, 64 nt, Human
ucugccauuucaaagacucauguuucugcuaugaccaugacacgauuuaaaucuuuucaaaugu

SEQ ID NO: 158521 - RNA, 64 nt, Human
ccagaggaccccacgccucucagaggcagaggucccaugacagccuuugacccacaacggccac

SEQ ID NO: 158522 - RNA, 64 nt, Human
uauggauccgugaccaaugugagggucaacagcaccaugacaacccugcaggugcucacccugc

SEQ ID NO: 158523 - RNA, 64 nt, Human
ccuuugauccaaucaaguugccacucaguauuaaccaugacaccuucuaagccaucaucuccuc

SEQ ID NO: 158524 - RNA, 64 nt, Human
agggcagggcaggggaaagaaacgcguuaaagggccaugacaugacacaguucccuggccgggu

SEQ ID NO: 158525 - RNA, 64 nt, Human
auggaaaaacuguaagugcugaaagcaaguuuagccaugacaaaccaaagagugcccaggucag

SEQ ID NO: 158526 - RNA, 64 nt, Human
aguuaggaccaccaauggauuguggaaaauggagccaugacaagaacaaagccacugacugaga

SEQ ID NO: 158527 - RNA, 64 nt, Human
caauccucaauggcaccuugguggcuucccucugccaugacagccccuaggccaggaaccauca

SEQ ID NO: 158528 - RNA, 64 nt, Human
aaaucccuagucuucaucagcucacaucacauuuccaugacaauccccuuugauuccucagaau

SEQ ID NO: 158529 - RNA, 64 nt, Human
cuccacaaaugcaaaagauguauuuuccuguggcccaugacauuugcaguuauucccagugaga

SEQ ID NO: 158530 - RNA, 64 nt, Human
acucuuuauuaaacacacuccuaaaaauaaggaaccaugacauuguagauauuuaauauuguac

SEQ ID NO: 158531 - RNA, 64 nt, Human
ccuggagaggcccauccuauaccccuuauuagagccaugacagccuacagagugaggugaggug

SEQ ID NO: 158532 - RNA, 64 nt, Human
ucuaggaccauaccuuauauaaagguauaagagaccaugacaaugucugaaaauggaauagaua

SEQ ID NO: 158533 - RNA, 64 nt, Human
uucccaucugagaacuuuauuaugucauuuuuuuccaugacacaaaauaagaauuuucuuaaua

SEQ ID NO: 158534 - RNA, 64 nt, Human
ucugagcccuuccccaggcccaggcuguagaccaccaugacagcugucgccugcggcuggugga

SEQ ID NO: 158535 - RNA, 64 nt, Human
uuauuguaauuaucauuaauuuuuuaaugauaaaccaugacaaaggauuuuacguuuauaaaau

SEQ ID NO: 158536 - RNA, 64 nt, Human
ucacccucccugccuaagcagggugggggcagagccaugacauuuuugguuuaaaggagccuuc

SEQ ID NO: 158537 - RNA, 64 nt, Human
gcccagagcccagugaggacccuucugcaucuucccaugacagaggacagagugacaggaguga

SEQ ID NO: 158538 - RNA, 64 nt, Human
gugugucaauuacaauuaaaagcacauuguuggaccaugacauaguauacucaacugacuuuaa

SEQ ID NO: 158539 - RNA, 64 nt, Human
uuuuuauuuccaggaggaagacuagugguggauuccaugacauauauuguaauucuuuucauag

SEQ ID NO: 158540 - RNA, 64 nt, Human
cccucccucgauccccccauuuucucuauucuuuccaugacacccaagggucgccuauuuuuaa

SEQ ID NO: 158541 - RNA, 64 nt, Human
aaacauucagaccugucuggguugguauugccacccaugacauuuaacauguugugaugcuuga

SEQ ID NO: 158542 - RNA, 64 nt, Human
guagacauugucucuucgugggauacuuuucaguccaugacaguuacuaaaggacauuuuagga

SEQ ID NO: 158543 - RNA, 64 nt, Human
gcgaaacccggugcaucuggcacguggccaggagccaugacaggggcgcuugggaggggccgga

SEQ ID NO: 158544 - RNA, 64 nt, Human
ucucagacuguggaaccaaagcuggcccaguuguccaugacaaaagaggcuuuugggccaaaau

SEQ ID NO: 158545 - RNA, 64 nt, Human
uugugaaaagcuguauuuauuauaaauacuagggccaugacauaguaccauugggguuaaguca

SEQ ID NO: 158546 - RNA, 64 nt, Human
acuucacagauuuguccaggcugccccuggcccuccaugacacacccccgauuccuggacaacc

SEQ ID NO: 158547 - RNA, 64 nt, Human
gaaaauaaauaagaagauaacuuccuucagaaagccaugacauugaaauaauguggucauaacu

SEQ ID NO: 158548 - RNA, 64 nt, Human
uaagaagaugacagugauucaaaugauucaaaugccaugacauuggaagaagguggucauagcu

SEQ ID NO: 158549 - RNA, 64 nt, Human
uaagaagaugagagugauucaaaugauucaaauuccaugacauuggaaaaaggucaucauagcu

SEQ ID NO: 158550 - RNA, 64 nt, Human
guccauuucccguggcauccggcugcagccacugccaugacagcaccugucauuuugccacgug

SEQ ID NO: 158551 - RNA, 64 nt, Human
uaugauuaauauauuuagaagagccacgugaaacccaugacaaaaugaaugugaauauucuuuc

SEQ ID NO: 158552 - RNA, 64 nt, Human
uccuguuuugucuuuuuuuuuuuuuuuuuuuaagccaugacaucccagaagaggacagugaauu

SEQ ID NO: 158553 - RNA, 64 nt, Human
uguuggacgagauugccccgccuugaucaggguaccaugacauaaaagguuaaagaacaggcaa

SEQ ID NO: 158554 - RNA, 64 nt, Human
aagcauuugucucuaacccauguggguagcccgaccaugacagcaccacgcuaacagugaccca

SEQ ID NO: 158555 - RNA, 64 nt, Human
auaugaaguaugcuuuguugauuauagugagaacccaugacauaguuaaccaaagaauauguuu

SEQ ID NO: 158556 - RNA, 64 nt, Human
cugaaacacacaauugacuggacagguccacgcgccaugacaaaacuauaaucaaguuauuaaa

SEQ ID NO: 158557 - RNA, 64 nt, Human
cugccccuuggcuucucagggcuuugcucugacaccaugacagcugcccggggcugagggcagc

SEQ ID NO: 158558 - RNA, 64 nt, Human
cucccuguuuaauguuuauauaauguuucucuuuccaugacaucuuaccuguaagauuucucuu

SEQ ID NO: 158559 - RNA, 64 nt, Human
agcuguugucauuuucauucggugacauucucucccaugacacccagaaggggcagaagaacca

SEQ ID NO: 158560 - RNA, 64 nt, Human
ccagucugugugccgugaugccgcacuguguuccccaugacagugguccaucaucgugcacucg

SEQ ID NO: 158561 - RNA, 64 nt, Human
uaacacagaucaaaggagaugaagggacauucugccaugacauacacuuaaccaaaacuauuca

SEQ ID NO: 158562 - RNA, 64 nt, Human
caacugguaaucacaguauuauuuagugugguuuccaugacaacaaaaauacauacgaagaaaa

SEQ ID NO: 158563 - RNA, 64 nt, Human
uugagacuauucaucaagaaugaggauauaguagccaugacauagcuugagcuauagccuuuaa

SEQ ID NO: 158564 - RNA, 64 nt, Human
cccaauagggugggggccugugggccagaggacuccaugacaguagccauggagucccaccugu

SEQ ID NO: 158565 - RNA, 64 nt, Human
gaccgcguguguugccccugcccugggcuccccgccaugacaucuucaccuugcagcuugugcu

SEQ ID NO: 158566 - RNA, 64 nt, Human
agccugcaccaggagcggccagggaggguucuccccaugacaaccccacuguacagcagaucgu

SEQ ID NO: 158567 - RNA, 64 nt, Human
uuuccccuaccaauauuaggugaucccguuuuccccaugacaauguuguagugucccccacccc

SEQ ID NO: 158568 - RNA, 64 nt, Human
uaacuuccccuacccugccccuccccaaaagaaaccaugacaaaccuagcuuuuaaaaaauauu

SEQ ID NO: 158569 - RNA, 64 nt, Human
ggaggacgaggacgacugggaauccuagggggcuccaugacaccuucccccccagacccagacu

SEQ ID NO: 158570 - RNA, 64 nt, Human
ccauagacuuaagcuuuucauuuguuacuaauauccaugacauucaguggccuugugcaaauac

SEQ ID NO: 158571 - RNA, 64 nt, Human
ugcugugaccuguuuggcucccaucuauaccuccccaugacaccuaggcugucagucucucuca

SEQ ID NO: 158572 - RNA, 64 nt, Human
gucacugucacuucaccaggcaggccuuggaguuccaugacaaaaucacuuuugucagacaaag

SEQ ID NO: 158573 - RNA, 64 nt, Human
uccagaaccugcagaaggugaacaccauccgggcccaugacaacccggugugcacgcuggucuc

SEQ ID NO: 158574 - RNA, 64 nt, Human
cugcugcacaugagccuucgccgugcauuuggagccaugacagcugauagcuccagaccugcau

SEQ ID NO: 158575 - RNA, 64 nt, Human
ucuucuguuucacuaacaggaacaaagacagaaaccaugacagggcugccccgccaggccccgg

SEQ ID NO: 158576 - RNA, 64 nt, Human
caagaagguaccucccuguguaacucaccuucccccaugacagugaguaagagacacucacagg

SEQ ID NO: 158577 - RNA, 64 nt, Human
cugauccacuuccauuuaagcuccccaggaaaucccaugacaaacuggccucuggcuggcgcgc

SEQ ID NO: 158578 - RNA, 64 nt, Human
gcuguggcccauccugauuccacaaaccucuuucccaugacaagauucacuuucuugagagcca

SEQ ID NO: 158579 - RNA, 64 nt, Human
agaccuaagcacaguuuuaugaacacaauuuugcccaugacauugccuacaggauuuccagaug

SEQ ID NO: 158580 - RNA, 64 nt, Human
ucucucuccccuccacuuuuuuuuuuugucagcuccaugacaacaugaccagcucagcaaaggc

SEQ ID NO: 158581 - RNA, 64 nt, Human
cucagagggcgaagagcacuggcauuuggcauguccaugacauuggagacuccccuagcagggu

SEQ ID NO: 158582 - RNA, 64 nt, Human
aaaacuuuucauuucacugaaaaaauaugaaaaaccaugacaauagggcugggugcaguggcuc

SEQ ID NO: 158583 - RNA, 64 nt, Human
agaguacugcaaucuuguaaguagaaaacagccaccaugacaauaaacaaaaacacuuaaaaau

SEQ ID NO: 158584 - RNA, 64 nt, Human
uucucucucucucucucucucucucucucaguauccaugacagguaugaaacauauugucucuu

SEQ ID NO: 158585 - RNA, 64 nt, Human
gugacaguagcaggaacaaggaaggguaauguuuccaugacagacacuugcuucccuugggaca

SEQ ID NO: 158586 - RNA, 64 nt, Human
aaagagacuucauuuggcaguucugaaaacaucaccaugacaucucucuccaaaguaacgaccu

SEQ ID NO: 158587 - RNA, 64 nt, Human
ccacacaggcuugacuggguggacaagaaugaacccaugacagcaccugcugcuucaaaaucaa

SEQ ID NO: 158588 - RNA, 64 nt, Human
guuuagacaguaaacguuccuuguuucuuuucucccaugacacugacaagaggaauuaccaccu

SEQ ID NO: 158589 - RNA, 64 nt, Human
ugucucccucucccuccacagucuccuuggcauuccaugacaaguuugucaaccuacacuuuua

SEQ ID NO: 158590 - RNA, 64 nt, Human
ucaauaaauaugaaccucgagaaaguucugaaggccaugacaccugccuugccucccucuucca

SEQ ID NO: 158591 - RNA, 64 nt, Human
auacguggucugcggacagggcagcgcccccagcccaugacaagggagucuuguuuucuggcuu

SEQ ID NO: 158592 - RNA, 64 nt, Human
uuguaaacuggaauuaaaaggauaguauuuuuauccaugacaggccugaagauauuacuacuua

SEQ ID NO: 158593 - RNA, 64 nt, Human
aaugauaaaaagacauccuaaaauggugaaguugccaugacaauaaaggucauagaaccuggua

SEQ ID NO: 158594 - RNA, 64 nt, Human
cugauaccuugagagauggcuggaccaauucucuccaugacaaauguuuaaucauuaguuacaa

SEQ ID NO: 158595 - RNA, 64 nt, Human
ucaauauauaaauuuugcgguuacacaauucaauccaugacagaauccaaagguuuacucuggu

SEQ ID NO: 158596 - RNA, 64 nt, Human
gcuucaugaacuaggaugaaaggaggccccugagccaugacaaggggcacauccaggauuuccg

SEQ ID NO: 158597 - RNA, 64 nt, Human
uugaauuucuuuuaucauuguuuuguaguuuucaccaugacagucuugcacauauuuuguuaaa

SEQ ID NO: 158598 - RNA, 64 nt, Human
cagaucugaauggcaugggaggugcugcccuuaaccaugacaccauuguaagagcuguccacau

SEQ ID NO: 158599 - RNA, 64 nt, Human
gcaggaggcagaauggcucugcugagccuccuacccaugacaacaccccaauaaacagaacauu

SEQ ID NO: 158600 - RNA, 64 nt, Human
uccaaguucagacaggugcccuuagagaggaaaaccaugacaggcaaaugcauuuccucuggag

SEQ ID NO: 158601 - RNA, 64 nt, Human
ugagccccaccacuacacuccagccuggaagacaccaugacacacagugaggccuggaugggga

SEQ ID NO: 158602 - RNA, 64 nt, Human
guuguucauauaauaauaugcugugagcaucuuuccaugacauuaaaucaucuuaggaaacauu

SEQ ID NO: 158603 - RNA, 64 nt, Human
augaugucacacacagacacagugacaacacacaccaugacaacgacaccuauagauauggcac

SEQ ID NO: 158604 - RNA, 64 nt, Human
ggccuuaugaggguccucuacuucaggaacacccccaugacauugcauuugggggggcucccgu

SEQ ID NO: 158605 - RNA, 64 nt, Human
ucuggucguccucacugcuacacuccugacagcaccaugacaguuuacaaaugccauggcaaca

SEQ ID NO: 158606 - RNA, 64 nt, Human
guaagugagcuuauuguugauagaaacaugaugaccaugacaaagucuuuacucagaaauauga

SEQ ID NO: 158607 - RNA, 64 nt, Human
aguaaucccagcacuuugggaggccgagacgggcccaugacaaggucaggagaucgagaccguc

SEQ ID NO: 158608 - RNA, 64 nt, Human
ccaggaggcacuugugacuagccugccaauggacccaugacaaaaguuuaaccuaaccuucauc

SEQ ID NO: 158609 - RNA, 64 nt, Human
cauuugugggcucgccaccuucaggcuuccccagccaugacacuucagccccgccacccaugcc

SEQ ID NO: 158610 - RNA, 64 nt, Human
uagauuuuuagauuccuacuuaaacaaaaacuuuccaugacaguagcauacugaugagacaaca

SEQ ID NO: 158611 - RNA, 64 nt, Human
gucacugacccccgccucuucagcaagaccacagccaugacaaacaccaggaugcaugcuccuu

SEQ ID NO: 158612 - RNA, 64 nt, Human
ggaaacaguccccugcccagaguccccucagccuccaugacaggucccucccuggccccccaac

SEQ ID NO: 158613 - RNA, 64 nt, Human
ugucccuagaauucccacugcugggccucuaucuccaugacaacaaaauaaaaacagagguugc

SEQ ID NO: 158614 - RNA, 64 nt, Human
cagcacagaggggccuuccucccccacagagcccccaugacauagucugcucugggcggaagag

SEQ ID NO: 158615 - RNA, 64 nt, Human
ugggccuggcccucaaugugccaggcucuuccucccaugacacccugugcaccagcugcacugg

SEQ ID NO: 158616 - RNA, 64 nt, Human
uuguuugguuacaguuuucaggggagcguuucuuccaugacacacagcaacaucccaaagaaau

SEQ ID NO: 158617 - RNA, 64 nt, Human
agucgccggaugcacuagcccugaagagggguguccaugacauggccugagcugggccuccacc

SEQ ID NO: 158618 - RNA, 64 nt, Human
ugugcuugguuuacagguccagugguucuucagcccaugacagaugagaaggggcuauauugaa

SEQ ID NO: 158619 - RNA, 64 nt, Human
agacuccagagaaggcucccuaagaccuugagagccaugacagguccaucagcaugaaguuggc

SEQ ID NO: 158620 - RNA, 64 nt, Human
aguuccuuuuugcaccgucaccacccaacaccuuccaugacacuuccuugcuuuggccagaagc

SEQ ID NO: 158621 - RNA, 64 nt, Human
gaauggccugggagccuguucugucuugcaucuuccaugacaugaaagggaggcuggcacuugu

SEQ ID NO: 158622 - RNA, 64 nt, Human
cccaccagucucccccaaauuaguacagaaauauccaugacaaaauuacuuacguauguuugua

SEQ ID NO: 158623 - RNA, 64 nt, Human
caagauucuauggagguuggccacagucaccacuccaugacaucccugucuuccucaacgacuu

SEQ ID NO: 158624 - RNA, 64 nt, Human
acaaugaggcaaggggcugauagagaagagucccccaugacaggaguuugugugcaacagaguc

SEQ ID NO: 158625 - RNA, 64 nt, Human
accucccacuugucaugagcuacuuuugaauuuuccaugacacucaugacuugugaugaaguca

SEQ ID NO: 158626 - RNA, 64 nt, Human
ugucuccucagggggauggggugggguacaaccaccaugacaacugccgggagggccacgcagg

SEQ ID NO: 158627 - RNA, 64 nt, Human
aucagguaacuaacugcauacacuuuuucucuuuccaugacaucaagacuuugcuaaagacaug

SEQ ID NO: 158628 - RNA, 64 nt, Human
cccugccuguguccgcuuuugcagcucaaugcagccaugacaaggaaagaaaagacaaaggaag

SEQ ID NO: 158629 - RNA, 64 nt, Human
uuuagauuuuaaaauguucccuguaaaagucagcccaugacaaggaaauuuacaaaauacuaga

SEQ ID NO: 158630 - RNA, 64 nt, Human
aagugcaaagaguggaccuuccaggcaguugcguccaugacaccaggaagaugucagugugugu

SEQ ID NO: 158631 - RNA, 64 nt, Human
caucuucucacucccuucuccuugauaacagcuaccaugacaacccugugguuuccaaggagcu

SEQ ID NO: 158632 - RNA, 64 nt, Human
aaaugaagcucacuaaaugugcugaaaguugaaaccaugacagggagcucucauagauacuagu

SEQ ID NO: 158633 - RNA, 64 nt, Human
ugaauagaaacaugacaccaaagaaagggcauugccaugacaucucaaagcaacagguaauuga

SEQ ID NO: 158634 - RNA, 64 nt, Human
caaaucaaauauuacugaucaauucaguuaguggccaugacaucucaaucuuguacuucaaaga

SEQ ID NO: 158635 - RNA, 64 nt, Human
cuacaaaaaguuuuuuuaaaaaauuaacugggcaccaugacacacaccaguagucccagcuacu

SEQ ID NO: 158636 - RNA, 64 nt, Human
acuccaugaugccccugagaugguaugcacaauuccaugacaauaugcccuuucuggggagaua

SEQ ID NO: 158637 - RNA, 64 nt, Human
gaggagugcguggcccaccaggccccccugucacccaugacaguucauucagggccgauggggc

SEQ ID NO: 158638 - RNA, 64 nt, Human
ugagauugugcuggauuauuaagcacccuaaaugccaugacagguguccuuccaagagacagaa

SEQ ID NO: 158639 - RNA, 64 nt, Human; identical to SEQ ID NO: 90358

SEQ ID NO: 158640 - RNA, 64 nt, Human; identical to SEQ ID NO: 90359

SEQ ID NO: 158641 - RNA, 64 nt, Human; identical to SEQ ID NO: 90360

SEQ ID NO: 158642 - RNA, 64 nt, Human; identical to SEQ ID NO: 90361

SEQ ID NO: 158643 - RNA, 64 nt, Human; identical to SEQ ID NO: 90362

SEQ ID NO: 158644 - RNA, 64 nt, Human; identical to SEQ ID NO: 90363

SEQ ID NO: 158645 - RNA, 64 nt, Human; identical to SEQ ID NO: 90364

SEQ ID NO: 158646 - RNA, 64 nt, Human; identical to SEQ ID NO: 90365

SEQ ID NO: 158647 - RNA, 64 nt, Human; identical to SEQ ID NO: 90366

SEQ ID NO: 158648 - RNA, 64 nt, Human; identical to SEQ ID NO: 90367

SEQ ID NO: 158649 - RNA, 64 nt, Human; identical to SEQ ID NO: 90368

SEQ ID NO: 158650 - RNA, 64 nt, Human; identical to SEQ ID NO: 90369

SEQ ID NO: 158651 - RNA, 54 nt, Human; identical to SEQ ID NO: 23168

SEQ ID NO: 158652 - RNA, 64 nt, Human; identical to SEQ ID NO: 84790

SEQ ID NO: 158653 - RNA, 64 nt, Human; identical to SEQ ID NO: 90371

SEQ ID NO: 158654 - RNA, 64 nt, Human; identical to SEQ ID NO: 90372

SEQ ID NO: 158655 - RNA, 64 nt, Human; identical to SEQ ID NO: 90373

SEQ ID NO: 158656 - RNA, 64 nt, Human; identical to SEQ ID NO: 90374

SEQ ID NO: 158657 - RNA, 64 nt, Human; identical to SEQ ID NO: 90375

SEQ ID NO: 158658 - RNA, 64 nt, Human; identical to SEQ ID NO: 90376

SEQ ID NO: 158659 - RNA, 64 nt, Human; identical to SEQ ID NO: 90377

SEQ ID NO: 158660 - RNA, 64 nt, Human; identical to SEQ ID NO: 90378

SEQ ID NO: 158661 - RNA, 64 nt, Human; identical to SEQ ID NO: 90379

SEQ ID NO: 158662 - RNA, 64 nt, Human; identical to SEQ ID NO: 90380

SEQ ID NO: 158663 - RNA, 64 nt, Human; identical to SEQ ID NO: 90381

SEQ ID NO: 158664 - RNA, 64 nt, Human; identical to SEQ ID NO: 90382

SEQ ID NO: 158665 - RNA, 64 nt, Human; identical to SEQ ID NO: 90383

SEQ ID NO: 158666 - RNA, 64 nt, Human; identical to SEQ ID NO: 90384

SEQ ID NO: 158667 - RNA, 64 nt, Human; identical to SEQ ID NO: 90385

SEQ ID NO: 158668 - RNA, 64 nt, Human; identical to SEQ ID NO: 90386

SEQ ID NO: 158669 - RNA, 64 nt, Human; identical to SEQ ID NO: 90387

SEQ ID NO: 158670 - RNA, 57 nt, Human; identical to SEQ ID NO: 23186

SEQ ID NO: 158671 - RNA, 64 nt, Human; identical to SEQ ID NO: 90389

SEQ ID NO: 158672 - RNA, 51 nt, Human; identical to SEQ ID NO: 23188

SEQ ID NO: 158673 - RNA, 64 nt, Human; identical to SEQ ID NO: 90391

SEQ ID NO: 158674 - RNA, 64 nt, Human; identical to SEQ ID NO: 90393

SEQ ID NO: 158675 - RNA, 64 nt, Human; identical to SEQ ID NO: 90394

SEQ ID NO: 158676 - RNA, 64 nt, Human; identical to SEQ ID NO: 90395

SEQ ID NO: 158677 - RNA, 64 nt, Human; identical to SEQ ID NO: 90396

SEQ ID NO: 158678 - RNA, 64 nt, Human; identical to SEQ ID NO: 90397

SEQ ID NO: 158679 - RNA, 64 nt, Human; identical to SEQ ID NO: 90398

SEQ ID NO: 158680 - RNA, 64 nt, Human; identical to SEQ ID NO: 90399

SEQ ID NO: 158681 - RNA, 64 nt, Human; identical to SEQ ID NO: 90400

SEQ ID NO: 158682 - RNA, 64 nt, Human; identical to SEQ ID NO: 90401

SEQ ID NO: 158683 - RNA, 64 nt, Human; identical to SEQ ID NO: 90402

SEQ ID NO: 158684 - RNA, 64 nt, Human; identical to SEQ ID NO: 90403

SEQ ID NO: 158685 - RNA, 64 nt, Human; identical to SEQ ID NO: 90404

SEQ ID NO: 158686 - RNA, 64 nt, Human; identical to SEQ ID NO: 90405

SEQ ID NO: 158687 - RNA, 64 nt, Human; identical to SEQ ID NO: 90406

SEQ ID NO: 158688 - RNA, 64 nt, Human; identical to SEQ ID NO: 90407

SEQ ID NO: 158689 - RNA, 64 nt, Human; identical to SEQ ID NO: 90408

SEQ ID NO: 158690 - RNA, 64 nt, Human; identical to SEQ ID NO: 90409

SEQ ID NO: 158691 - RNA, 64 nt, Human; identical to SEQ ID NO: 90410

SEQ ID NO: 158692 - RNA, 64 nt, Human; identical to SEQ ID NO: 90411

SEQ ID NO: 158693 - RNA, 64 nt, Human; identical to SEQ ID NO: 90412

SEQ ID NO: 158694 - RNA, 64 nt, Human; identical to SEQ ID NO: 90413

SEQ ID NO: 158695 - RNA, 63 nt, Human; identical to SEQ ID NO: 90414

SEQ ID NO: 158696 - RNA, 64 nt, Human; identical to SEQ ID NO: 90415

SEQ ID NO: 158697 - RNA, 64 nt, Human; identical to SEQ ID NO: 90416

SEQ ID NO: 158698 - RNA, 64 nt, Human; identical to SEQ ID NO: 90417

SEQ ID NO: 158699 - RNA, 64 nt, Human; identical to SEQ ID NO: 90418

SEQ ID NO: 158700 - RNA, 64 nt, Human; identical to SEQ ID NO: 90419

SEQ ID NO: 158701 - RNA, 64 nt, Human; identical to SEQ ID NO: 90420

SEQ ID NO: 158702 - RNA, 64 nt, Human; identical to SEQ ID NO: 90421

SEQ ID NO: 158703 - RNA, 64 nt, Human; identical to SEQ ID NO: 90422

SEQ ID NO: 158704 - RNA, 64 nt, Human; identical to SEQ ID NO: 90423

SEQ ID NO: 158705 - RNA, 64 nt, Human; identical to SEQ ID NO: 90424

SEQ ID NO: 158706 - RNA, 64 nt, Human; identical to SEQ ID NO: 90425

SEQ ID NO: 158707 - RNA, 64 nt, Human; identical to SEQ ID NO: 90426

SEQ ID NO: 158708 - RNA, 64 nt, Human; identical to SEQ ID NO: 90427

SEQ ID NO: 158709 - RNA, 64 nt, Human; identical to SEQ ID NO: 90428

SEQ ID NO: 158710 - RNA, 64 nt, Human; identical to SEQ ID NO: 90429

SEQ ID NO: 158711 - RNA, 64 nt, Human; identical to SEQ ID NO: 90430

SEQ ID NO: 158712 - RNA, 64 nt, Human; identical to SEQ ID NO: 90431

SEQ ID NO: 158713 - RNA, 64 nt, Human
uuccugugcaucacacuuaacucaucuaacugcuuccccggacacccuccaccucuaguuguua

SEQ ID NO: 158714 - RNA, 64 nt, Human
auccgcucccagacggccuuggacugcuugcauuuccccggagaaaaagggguuaauaaauggg

SEQ ID NO: 158715 - RNA, 64 nt, Human
ugucccuagggugacaggccagggggaaaaauuauccccggacaacaugaaacaggugagguca

SEQ ID NO: 158716 - RNA, 64 nt, Human
cagagccugguugucacccauuaaaggauaggucuccccggagugcacagcuccaccugggagc

SEQ ID NO: 158717 - RNA, 64 nt, Human
ugucguccugccuggccuccagcccgagucgucauccccggagucccuauacagagguccugcc

SEQ ID NO: 158718 - RNA, 64 nt, Human
gaugagugccucuguuuuccagaagauuucacaauccccggaaaacugguauggcuauucuuga

SEQ ID NO: 158719 - RNA, 64 nt, Human
agcguagccagcugcugcuugaggccauggcucguccccggaguuggggguacccguugcagag

SEQ ID NO: 158720 - RNA, 64 nt, Human
gugcacacgaugccagagagaacuuagcaggguguccccggaggagagguuugggaagcuccac

SEQ ID NO: 158721 - RNA, 64 nt, Human
gaugacgcugccgggagagcagucuucucuguaguccccggaggggacuccucggaggaaggau

SEQ ID NO: 158722 - RNA, 64 nt, Human
cucccuaucugaagaaaaaaaucaaaaacaaauguccccggaucuuucgaugcaaguccuggag

SEQ ID NO: 158723 - RNA, 64 nt, Human
aggcccacggggggcccacgggaccccccgggacuccccggacauggcccugccccuaugggac

SEQ ID NO: 158724 - RNA, 64 nt, Human
gcugagggcaagaggcccgacaggcaggccaggguccccggagaagccggauuucuucgcaaug

SEQ ID NO: 158725 - RNA, 64 nt, Human
uuucgagccaggcucuuccaaggggccagcuggguccccggagucaguccuaggcuggauggga

SEQ ID NO: 158726 - RNA, 64 nt, Human
gacgcaugcagggcccccacaggagcguguccuauccccggaccggacgcaugcagggccccca

SEQ ID NO: 158727 - RNA, 64 nt, Human
gacgcaugcagggcccccacaggagcguguccuauccccggacgcaugcagggcccccacagga

SEQ ID NO: 158728 - RNA, 64 nt, Human
gguguagggaacggccugagaggagcguguccuauccccggacgcaugcagggcccccacagga

SEQ ID NO: 158729 - RNA, 64 nt, Human
uggaggauggaaaacuacugccugcacugcccuguccccggauccugccgaacaucugggcauc

SEQ ID NO: 158730 - RNA, 64 nt, Human
caggaaauacaacccuuuugcccauuuacccuucuccccggaucccaagguggucuguugcucu

SEQ ID NO: 158731 - RNA, 64 nt, Human
gccagugaguccaagccucguuccuccuucugccuccccggagccacaggauggauuuaggagc

SEQ ID NO: 158732 - RNA, 64 nt, Human
gaagcccacauuucugggggugucgucacugccguccccggagggccagauacggccccgccca

SEQ ID NO: 158733 - RNA, 64 nt, Human
gugucucucaccccgaauuguccuuccuccuuccuccccggauuggcuugcugugccugacgga

SEQ ID NO: 158734 - RNA, 64 nt, Human
ggcaagcccucucuauguguuuuuauccccaccuuccccggaaucuggggagggcuuuuguuuu

SEQ ID NO: 158735 - RNA, 64 nt, Human
aaaaugacuuuaaggaucuuguguaucaaaccuauccccggaugugugagaauaauguguucau

SEQ ID NO: 158736 - RNA, 64 nt, Human
cgccuccuccuccccagggcgcagcgcuggcugcuccccggauaccgugaucacacgucccagg

SEQ ID NO: 158737 - RNA, 64 nt, Human
ucuggcccccaggaaaccuguugugcagagcucuuccccggagaccuccacacacccuggcuuu

SEQ ID NO: 158738 - RNA, 64 nt, Human
agcacuaaggagauugaguaaggaccuccaaaguuccccggacucaugaauucugggcccuugg

SEQ ID NO: 158739 - RNA, 64 nt, Human
gacuggccccacuucuggucucugucccucugccuccccggaagaagaugaggaaucugaggau

SEQ ID NO: 158740 - RNA, 64 nt, Human
ucuguuuccagaacagugccuuggucaucccacauccccggaccccgccugggacccccaagcu

SEQ ID NO: 158741 - RNA, 64 nt, Human
ugcucucaaugucaugcagccgcuccugccagaauccccggaagggggcaaugccagugccugg

SEQ ID NO: 158742 - RNA, 64 nt, Human
ggaauccagugggcagaggcagcuucgcaggggguccccggacggacuccuucaccgacugcac

SEQ ID NO: 158743 - RNA, 64 nt, Human
cuccucagugcacuuuggcauuugcacggugucuuccccggacagcacagcaauaaauggugug

SEQ ID NO: 158744 - RNA, 64 nt, Human
ugcuggagugccagucccugagcucagacccccguccccggaacugggccacaccacgugcccu

SEQ ID NO: 158745 - RNA, 64 nt, Human
cccuguggccucuuggagaggcgagccagggggcuccccggaccgcauggccggugagaguaga

SEQ ID NO: 158746 - RNA, 64 nt, Human
cugcauggaagguggaggacagaagcccuguggauccccggauuucacacuccuucuguuuugu

SEQ ID NO: 158747 - RNA, 62 nt, Human
acagugaccucucugcgugacaguggucccucuccccggacuugcacuuguuccuuguuucc

SEQ ID NO: 158748 - RNA, 64 nt, Human
cccuccacuucguggucugaguggagaccugugcuccccggagaggggcagcagugcgggaggg

SEQ ID NO: 158749 - RNA, 64 nt, Human
gcugccaaggagggaggagacucggguuggcuaauccccggaugaacggugcuccauucgcacc

SEQ ID NO: 158750 - RNA, 64 nt, Human
gcacacuaccccacaggugugcccauacagacauuccccggagccggcugcugugaacucgccc

SEQ ID NO: 158751 - RNA, 64 nt, Human
ccggccugcagcccagaacgggccuccccggggguccccggacgcuggcucgggacugucuuca

SEQ ID NO: 158752 - RNA, 64 nt, Human
ccugggagcggagccuaggguuccgaaggcgccauccccggaccuaggaccggugccagcccug

SEQ ID NO: 158753 - RNA, 64 nt, Human
uucuuucugcuuuuagaaauguagacauaaacacuccccggagcccacucaccuuuuuucuuuu

SEQ ID NO: 158754 - RNA, 64 nt, Human
ugccagagcccaggcuggccucaucugcaccauguccccggaccagcccuugcucugacugcgg

SEQ ID NO: 158755 - RNA, 64 nt, Human
uuggggauugccacuaaguacagcugacgguuucuccccggacacucgccuacuaaguacccuu

SEQ ID NO: 158756 - RNA, 64 nt, Human
cucugcugauggccucucggccccucugcuggcguccccggagcccagugcuggcccccuacag

SEQ ID NO: 158757 - RNA, 64 nt, Human
uguacccagggcuggcuggccugccauuugccucuccccggagacagccguucuucugcaacca

SEQ ID NO: 158758 - RNA, 64 nt, Human
cgcgcccgccgcggccccgaucggggcgggggaauccccggagaccagccuccuuaaucccuuc

SEQ ID NO: 158759 - RNA, 64 nt, Human
cccggacccaggcccaggccuaaccugcuaaauguccccggacgguucuggucuccucggccac

SEQ ID NO: 158760 - RNA, 64 nt, Human
ggaccuccucugccaacucccgccuccuccccuguccccggacucggcuccuggcagccgccuc

SEQ ID NO: 158761 - RNA, 64 nt, Human
caacucccucaccaccacgccucccugccuaccauccccggaagggugcuuauucuuuaacaaa

SEQ ID NO: 158762 - RNA, 64 nt, Human
cacuggcuccggaguuauucucugucaaaucuacuccccggaccucaaccauggcaagaaccag

SEQ ID NO: 158763 - RNA, 64 nt, Human
cacccaaaggaaccgcuccuugucccuccuggccuccccggaggcacagcagugucauggggcu

SEQ ID NO: 158764 - RNA, 64 nt, Human
ccacaagccuggaacaguccugcagaggcuacaauccccggauggggacccuucccacccucug

SEQ ID NO: 158765 - RNA, 64 nt, Human
ggcaguggagucggaagggcacacggggugcgucuccccggaguucaguuuuaccagaugaugg

SEQ ID NO: 158766 - RNA, 64 nt, Human
cagaggaaaacagccacaaacaagccaggggggcuccccggagccccagggguggggauuggug

SEQ ID NO: 158767 - RNA, 64 nt, Human
ucaacuccuccaucuaaccagcaggcucccagaguccccggaagagccugcgcagcugaagcag

SEQ ID NO: 158768 - RNA, 62 nt, Human
acgggccggaggagcagugaggggccgccugguccccggacucagccucccuccucgccggc

SEQ ID NO: 158769 - RNA, 64 nt, Human
cuggcaaggcuuucuugagccccgccccuuucuuuccccggagucccuccaccccauaacaaua

SEQ ID NO: 158770 - RNA, 64 nt, Human
ucauacauuuguggucugacuccuugggguccuuuccccggaguaccuauuguagauaacacua

SEQ ID NO: 158771 - RNA, 64 nt, Human
gguacccggggcccagggcaagcuccgcaggacuuccccggagggcugcggcguacaggcuggc

SEQ ID NO: 158772 - RNA, 64 nt, Human
gacuucuggcucacacagacccccacgcucuccauccccggaaucuagucacaacccuggaucc

SEQ ID NO: 158773 - RNA, 64 nt, Human
ugcucacaggaggcccgugguaauucuccccaccuccccggaugccccacuaguccaacuucau

SEQ ID NO: 158774 - RNA, 64 nt, Human
cuacucagaaggcugaggugggaggauugcuuguuccccggagguugaagcuacagugagccuu

SEQ ID NO: 158775 - RNA, 64 nt, Human
uucacccuguguaacaggaccccaaggaccugccuccccggaagugccuuaaccuagagggucg

SEQ ID NO: 158776 - RNA, 64 nt, Human
ccagaaauauuucccacaacuggaugcacugucguccccggacuauagacacuaccccaucagg

SEQ ID NO: 158777 - RNA, 64 nt, Human
aucucucaccaaggcugcgucaaagcacagaggcuccccggacucggagggggccagagacuga

SEQ ID NO: 158778 - RNA, 64 nt, Human
ggcccuguaagcugugcagugugagggccuggcuuccccggacacaccuggagcagccucugag

SEQ ID NO: 158779 - RNA, 64 nt, Human
cgaacgccgggugacgcgugucccccacucaccuuccccggagacccuggcgaccgccgggcgc

SEQ ID NO: 158780 - RNA, 64 nt, Human
gaaccaggagggagagugcagccaggcucagggauccccggacaccucuguccagagccccucc

SEQ ID NO: 158781 - RNA, 52 nt, Human
agacugaggcccacgcuugagguccccggagcucccgggcacauccaggaag

SEQ ID NO: 158782 - RNA, 55 nt, Human
cccacuuugcucccugcugaccagguccccggacucaagccccggacucaggccc

SEQ ID NO: 158783 - RNA, 64 nt, Human
uggcuguugugcuuuccaagcgccacaguugcccuccccggacgugguguuauguggucauuuc

SEQ ID NO: 158784 - RNA, 64 nt, Human
gggcuccugcugaccccgccacucagcagugcacuccccggaucacagcagggcguuuacauag

SEQ ID NO: 158785 - RNA, 64 nt, Human
accagcaggaauaauuugaaaugugugaggugacuccccggagggccuugggcuugggcauuug

SEQ ID NO: 158786 - RNA, 64 nt, Human
ugguccaucacuuacgacgucucccaggcuugccuccccggaucggauuccuuucccuucgauc

SEQ ID NO: 158787 - RNA, 64 nt, Human
cgucgccuaaccugguuucuagcuuugcccucacuccccggaaaaacugacacugacacagggg

SEQ ID NO: 158788 - RNA, 64 nt, Human
ccuggaagaagcuaugcugcuucccagccuggcuuccccggauguuuggcuaccuccaccccuc

SEQ ID NO: 158789 - RNA, 64 nt, Human
cuugcccagccgggacacuggagacugaagaaguuccccggagcaggacugccuuugaaggggc

SEQ ID NO: 158790 - RNA, 64 nt, Human
gcggggacaggcuagaggagacagcaagucccaguccccggagcagagagaaguggggccggcc

SEQ ID NO: 158791 - RNA, 64 nt, Human
cucccaagccagcgcggcugucacgggcagcggcuccccggaccccgcgggcucgggcgcaacu

SEQ ID NO: 158792 - RNA, 64 nt, Human
caguuuggcugcugugucugcugcgcacgcccccuccccggacagcaccugccaccuagaaacu

SEQ ID NO: 158793 - RNA, 64 nt, Human
gaaacgcaccgcuccugcgugcgcccccaccugguccccggaugcccccaccaccuggacagag

SEQ ID NO: 158794 - RNA, 64 nt, Human
agaacauuuuagaacaauaguucucaaaguguguuccccggacaagcagcaucugcaacacuua

SEQ ID NO: 158795 - RNA, 64 nt, Human
ugaagccugaccgaccuccagcagcacucggacguccccggaccagcccucagucucgguccac

SEQ ID NO: 158796 - RNA, 64 nt, Human
ccucugugacuccccuuucucuucucgucccuccuccccggagccggcacugcauguuccugga

SEQ ID NO: 158797 - RNA, 64 nt, Human
aggcgguggggacccagccgcgcgccgggagcgcuccccggaaugagccgccccacccacccca

SEQ ID NO: 158798 - RNA, 64 nt, Human
gaugaggcagugagucagaaaaaccagaacgggguccccggaucugccgggaaggcuucugagg

SEQ ID NO: 158799 - RNA, 64 nt, Human
gccucugagcgggagagucuguguguaugugucuuccccggaauccacaccaccccacccuccu

SEQ ID NO: 158800 - RNA, 64 nt, Human
cccaagccgagcaugccccgggcccccgccuccuuccccggagccccuggcccgccuggcccua

SEQ ID NO: 158801 - RNA, 64 nt, Human
cucacacuacacccucuuccuuucccaccccaccuccccggagagaaacuggacauggggccug

SEQ ID NO: 158802 - RNA, 64 nt, Human
ucccuucccuggggggaggggcgcaccccuuuuauccccggagcgcuagggcccgccccuccgc

SEQ ID NO: 158803 - RNA, 64 nt, Human
aaagacugaaauuguggagcuggagggcgcccccuccccggaguuuccucccugggacaaguga

SEQ ID NO: 158804 - RNA, 64 nt, Human
cggacggacguugguucugcacuaaaacccaucuuccccggaugugugucucaccccucauccu

SEQ ID NO: 158805 - RNA, 64 nt, Human
uguucgguagagcaaguguccucugacagccguguccccggacaguucagacacccuuggggau

SEQ ID NO: 158806 - RNA, 64 nt, Human
gcacaccccugcacacaccugcacaccgucccucuccccggacaagcccaggacacugccuuug

SEQ ID NO: 158807 - RNA, 64 nt, Human
ggcuucagccccugggguacuucuguguugugauuccccggagcugggaaggucccgaauggag

SEQ ID NO: 158808 - RNA, 64 nt, Human
cgggugcagcgagaggccauccccgagcgcuaccuccccggagcggagcacgccggcucccagu

SEQ ID NO: 158809 - RNA, 64 nt, Human
cauccaccauggaggucauuggccugaggcaaguuccccggagagucgggguccccuguggccc

SEQ ID NO: 158810 - RNA, 64 nt, Human
agaucaccuacugaggaggauccuccagggccgcuccccggacccgacaggcgcggguggaugc

SEQ ID NO: 158811 - RNA, 64 nt, Human
aguuccgccagcgccuacuucugguggcucuagguccccggauccaccacccuucccccacuga

SEQ ID NO: 158812 - RNA, 64 nt, Human
uuucacagggugggaaacgaaauucgagggaaauuccccggaaauaugagggaaaucucugcau

SEQ ID NO: 158813 - RNA, 64 nt, Human
aacaaaacaaaacaaaacaaaugacaguaacccuuccccggaaagaaauagaacaaucauggag

SEQ ID NO: 158814 - RNA, 64 nt, Human
guggagcuguguguguucuucucugagcagcuccuccccggagucccccagcacagucccagga

SEQ ID NO: 158815 - RNA, 64 nt, Human
guggaacuuacucuuucuuuuaagauaaguuguagacuucgauguuucaugcucauguacuuca

SEQ ID NO: 158816 - RNA, 64 nt, Human
aaguaagugggguugcaaccacugcaacggcuuagacuucgacucaggauccagucccuuacac

SEQ ID NO: 158817 - RNA, 64 nt, Human
cagccaagaccaucucucccuccuggugaagugugacuucgaauuaguuugcacuuccuguugg

SEQ ID NO: 158818 - RNA, 64 nt, Human
ucuggaugagcauccuaucuucguaguugguuuggacuucgauagguugauggaaggaauacuu

SEQ ID NO: 158819 - RNA, 64 nt, Human
cgaaaccuuggccaacguuaccucagccaccugggacuucgacgacgaggcauucgaugagauc

SEQ ID NO: 158820 - RNA, 64 nt, Human
aagaaugucuccugccacuccucaacugaugauagacuucgaaaacagaugagaagacuagcag

SEQ ID NO: 158821 - RNA, 64 nt, Human
uugauguuguuguugauggcaaaaaaaaaaaagcgacuucgaguuugcuccccuuugcuugaag

SEQ ID NO: 158822 - RNA, 64 nt, Human
uuggguuugccauuuuucucuuuuuucuuccucugacuucgaaaauuguugguauacauuucaa

SEQ ID NO: 158823 - RNA, 64 nt, Human
aaagcugcucuuuacuguuucuagucaaaaaugagacuucgaucaaaccauaagauuuuauacu

SEQ ID NO: 158824 - RNA, 64 nt, Human
ccaguaggggcuggccacggccaggugugggagggacuucgaagauaagagugagcggcugccu

SEQ ID NO: 158825 - RNA, 64 nt, Human
gccucaggagguggagucccugggggagaccuaugacuucgacagcaucaugcauuacgcucgg

SEQ ID NO: 158826 - RNA, 64 nt, Human
cagccuuugauucaguaaauguuaagcagcagaagacuucgaaugguugaaauucauuguuaca

SEQ ID NO: 158827 - RNA, 64 nt, Human
aucuacacagucaaauucacaggacgcuaagauagacuucgagaguuguggaucaagaggaaac

SEQ ID NO: 158828 - RNA, 64 nt, Human
gaaaaucugcucgcaucgaagcauucuucuaagcgacuucgaugccaaggaaguuguguaaaug

SEQ ID NO: 158829 - RNA, 64 nt, Human
cugcccugcugaccacacuaccuggaccugggaggacuucgaaugcuggauaagccauuaaacu

SEQ ID NO: 158830 - RNA, 64 nt, Human
ggcaagggaggggagcuucuuuuuaaaaucaagagacuucgagcgaucccaguuuccauuucaa

SEQ ID NO: 158831 - RNA, 64 nt, Human
ugucuacguugcuuccccaaaccaugagcagagggacuucgaugccaaaccagacucggguccc

SEQ ID NO: 158832 - RNA, 64 nt, Human
guuugugaugaugccaguauuuggcgcugggaucgacuucgauaaaauacuuuugccuaaucaa

SEQ ID NO: 158833 - RNA, 64 nt, Human
cuugguauaauauacaugguuaaaaugcuuaugugacuucgaguaggugaaucuuaaagaaaua

SEQ ID NO: 158834 - RNA, 64 nt, Human
cucugaauuuaauuaaaacugccuuuuaugaacagacuucgaguuuugccauuuugggcaagcc

SEQ ID NO: 158835 - RNA, 64 nt, Human
cuuaaggaccacacugaaggaaaaaaaaagaggggacuucgaaaaaaaaaaaagcccugcaaaa

SEQ ID NO: 158836 - RNA, 64 nt, Human
ggcacggggaugugcccugccugccagcaccuaggacuucgaguuggguugcagcuuaugacau

SEQ ID NO: 158837 - RNA, 64 nt, Human
cucauguuuggcauuuuaaaguaaaaacaagugugacuucgaggaccaaagaaauugucagcua

SEQ ID NO: 158838 - RNA, 64 nt, Human
cuacacccuguccaacaugaccuacaaggaggaagacuucgagcgccugcugcggcucagugac

SEQ ID NO: 158839 - RNA, 64 nt, Human
acugcuauaaugugucauugauuuucuacaaauagacuucgacuuuuuaaauugacuuuugaau

SEQ ID NO: 158840 - RNA, 64 nt, Human
gggaggcugagccaggaagaacgcuccagcccaggacuucgaggcugcaaugagcuauaauugc

SEQ ID NO: 158841 - RNA, 64 nt, Human
cggcgagguggaaguggagcccagugagguggaagacuucgaggcucgugggagccgcuucucc

SEQ ID NO: 158842 - RNA, 64 nt, Human
gugggccagugugggaaugcggcaagaaggaauugacuucgacugugaccuguggggauuucuc

SEQ ID NO: 158843 - RNA, 64 nt, Human
uuagaggcccugacccaucauugaccaaacugaugacuucgaguaagccacccagcuuuucuug

SEQ ID NO: 158844 - RNA, 64 nt, Human
auacuuaaugagcaauuacuugauuuuuaaugaugacuucgaaggagucaucacuaggugcuuu

SEQ ID NO: 158845 - RNA, 64 nt, Human
gccuuccgugugauggaaacacacuaccccgucggacuucgaauuucuacguggaugugcauga

SEQ ID NO: 158846 - RNA, 64 nt, Human
acgcuguagaggcagguuggccagucuguaccuggacuucgaauaaaucuucuguauccucgcu

SEQ ID NO: 158847 - RNA, 64 nt, Human
ugcgccguccuggggucgcugccgagagcgccuggacuucgacgucccaccagcgggcgccucc

SEQ ID NO: 158848 - RNA, 64 nt, Human
gccaaggggcccccaucacaggccgaugggguaagacuucgagagagccugauccuggggucuu

SEQ ID NO: 158849 - RNA, 64 nt, Human
uggggcuuauagaaaaggcuacuuuacucuuugugacuucgaaaucuuuucaugugccuuccau

SEQ ID NO: 158850 - RNA, 64 nt, Human
aaggucagcccugaggccagggugaaaggucccagacuucgaaugcccaccuuugggcuuuccc

SEQ ID NO: 158851 - RNA, 64 nt, Human
ggugccaggcagguccgccugugcgggugccccugacuucgaccccuagcuuaugucacagccc

SEQ ID NO: 158852 - RNA, 64 nt, Human
agagccagaaaaugcugacagccucaugcugguggacuucgaguacagcaguuauaacuauagg

SEQ ID NO: 158853 - RNA, 64 nt, Human
auccagcacccuucagcuguguguggacaaacaaggacagaaaaacccaguguccaagggccaa

SEQ ID NO: 158854 - RNA, 64 nt, Human
uauauaaaaauuuauuaaauauaaauauccccagggacagaaaccaaggccccgagcucagggc

SEQ ID NO: 158855 - RNA, 64 nt, Human
auuuugauuuucacugccaagccaaucaugugaaggacagaagcuuuugccaugggccccucac

SEQ ID NO: 158856 - RNA, 64 nt, Human
caauuuucugaccuuugaugguugagaaggguuuggacagaaaauugacaugaaaagaucuggc

SEQ ID NO: 158857 - RNA, 64 nt, Human
cuuuggauccuuauuuuguaugacuucugcugaaggacagaacauugccuuccucgugcagagc

SEQ ID NO: 158858 - RNA, 64 nt, Human
ccaucccuggggaggcucccaccaucucgccacuggacagaagcguccccuuugaccugccagc

SEQ ID NO: 158859 - RNA, 64 nt, Human
acucuuuggagcuuuuaugaauaguucauggugaggacagaacuuuucuacuuucagacagacu

SEQ ID NO: 158860 - RNA, 64 nt, Human
uccaugguucuaggcagacccucuuucuccuucgggacagaaagacaaugugaguucauuuucc

SEQ ID NO: 158861 - RNA, 64 nt, Human
agggagucucugcuuuugaagaauggcacagguaggacagaaguaucaucccuacccccuaacu

SEQ ID NO: 158862 - RNA, 64 nt, Human
ggcugcugcugaccugggcuaagaagaacucuuuggacagaauguuuaagaaccuccuacagcc

SEQ ID NO: 158863 - RNA, 64 nt, Human
uuugaccuucacauuuguucaugaguggauggauggacagaaugauggacuuuuggggguugga

SEQ ID NO: 158864 - RNA, 64 nt, Human
cacagauggauaccaacacggucagaagaaaaacggacagaacgguucuuguauauuuaaacug

SEQ ID NO: 158865 - RNA, 64 nt, Human
ccccuagaaagauuuugugcaauauauuaaauggggacagaauucuaaauggauaaaacaaugg

SEQ ID NO: 158866 - RNA, 64 nt, Human
uucagguggccagaagagcuugucagcaagaggaggacagaauucucccagcguuaacacaaaa

SEQ ID NO: 158867 - RNA, 64 nt, Human
gaaguaaauaucuuuugaauuagagaaaguguugggacagaaaguacuuuauguaacuaagugg

SEQ ID NO: 158868 - RNA, 64 nt, Human
uaccuaaguauaugauugcgaguggaaaaauaggggacagaaaucagguauuggcaguuuuucc

SEQ ID NO: 158869 - RNA, 64 nt, Human
auuacuugaguaauaggaaauuaggaggaucuagggacagaaggaaagugaaaaaugugaaaau

SEQ ID NO: 158870 - RNA, 64 nt, Human
uuacagaagaggucgcggggugagccucuuagcaggacagaaaacaaggcagcagcgcaccugc

SEQ ID NO: 158871 - RNA, 64 nt, Human
ugugagagguggggaguacuggcugugcguggcaggacagaagcacuguaaagggcucuccagc

SEQ ID NO: 158872 - RNA, 64 nt, Human
gugcugcugcuucaguggaagagaugaagccaaaggacagaaugaaaaucccuaccuucagaga

SEQ ID NO: 158873 - RNA, 64 nt, Human
uuuuccugugugccuugaaggccagagcauuuagggacagaacuugaaagagaagauggcgaaa

SEQ ID NO: 158874 - RNA, 64 nt, Human
uccauuuaacauuacugauuuuuauuaaaaaccuggacagaaaauuauaaauuauaaauaugac

SEQ ID NO: 158875 - RNA, 64 nt, Human
augugaaaucuuuaguguugugagcccuuaaaagggacagaaauugugcauucaaggagcuugg

SEQ ID NO: 158876 - RNA, 64 nt, Human
aaagauaaugaaaaugacaaucaaacuggauuauggacagaacuuggaaauauugagaauaauu

SEQ ID NO: 158877 - RNA, 64 nt, Human
aggaaagcacaacuggguccuuuauucauuucugggacagaaagagggucaguggacuuuugug

SEQ ID NO: 158878 - RNA, 64 nt, Human
aaggaaagagagagaaaacaagcaaagauagguaggacagaaaggaagacagccagauccagug

SEQ ID NO: 158879 - RNA, 64 nt, Human
uggaggaacaguaccuuggcuuggcucuugacguggacagaauuaaaaaggaccaagaagagga

SEQ ID NO: 158880 - RNA, 64 nt, Human
ggugcugugcuuugugcucuuggcugcugugcugggacagaaugggaugccaggaagagaagaa

SEQ ID NO: 158881 - RNA, 64 nt, Human
gccaucuuguuugccacauggagagagacugugaggacagaagccaaacuggaaguggaggagc

SEQ ID NO: 158882 - RNA, 64 nt, Human
cauuucuuauccccugagagcugaugauuauugaggacagaaggcucagaaacaguuugugaca

SEQ ID NO: 158883 - RNA, 64 nt, Human
uaccuguccuuuaguguagauuuuauucaucacaggacagaauaaucaaggacaaccaaaaucc

SEQ ID NO: 158884 - RNA, 64 nt, Human
cugaggacauaggcagaagcucacucuuuuccagggacagaaguggugguagauggaaggaucc

SEQ ID NO: 158885 - RNA, 64 nt, Human
cuccuuggaagaagugaucagaaggugauaagaaggacagaaaggacuauuuuaaaguuggacu

SEQ ID NO: 158886 - RNA, 64 nt, Human
guuuuguuuuauuuuugguuuugguugaacagagggacagaagaauaaguaacacucccaaaca

SEQ ID NO: 158887 - RNA, 64 nt, Human
agcugaagaacaucugggguggacccaucacuuuggacagaauuaggaccugguucuggaccaa

SEQ ID NO: 158888 - RNA, 64 nt, Human
cuucucuaauagaaaagucuccaccccuacacaaggacagaacccuccaccccuacccccaacc

SEQ ID NO: 158889 - RNA, 64 nt, Human
gugauucuuucacuuguuuauuacacuggcucguggacagaacaauuugaaaagugaaagaauu

SEQ ID NO: 158890 - RNA, 64 nt, Human
cccagcagucccuaaagcugguccccagaaagcaggacagaaagaaggagggacaggcaggcag

SEQ ID NO: 158891 - RNA, 64 nt, Human
ggcugccugaccucagggcucucuuaccuucugaggacagaaacagcugacaagaguaccauuu

SEQ ID NO: 158892 - RNA, 64 nt, Human
uaauugguguugauuggaaacuuuuucugagaugggacagaacugcuggguugucuuuuuccau

SEQ ID NO: 158893 - RNA, 64 nt, Human
aaaauguuccauacuguauuagcauccuuagaagggacagaacuaagaaauacauugcucaaau

SEQ ID NO: 158894 - RNA, 64 nt, Human
ccaggcagccagcaccaugggcaggcccugccauggacagaaaaagaguuuuucucuuguucag

SEQ ID NO: 158895 - RNA, 64 nt, Human
ccuccaguccagucccugggauagagauguugcuggacagaacucacagcucugugugugugug

SEQ ID NO: 158896 - RNA, 64 nt, Human
acuuuuuuggggguaaaaaauauagccuuuacauggacagaauuuuuuuuguuguuucagugaa

SEQ ID NO: 158897 - RNA, 64 nt, Human
guaaaacagcuuuuuacucuguuauugugguaauggacagaauauuacauacaaaaauauucug

SEQ ID NO: 158898 - RNA, 64 nt, Human
ggcccaauucuuacaaacaugugguuaaugccauggacagaagaaggcagcagguggcagaaug

SEQ ID NO: 158899 - RNA, 64 nt, Human
aucaaaccgauccagaauaccgaagguauggacaggacagaaaagcgagucgcaggaggaaggg

SEQ ID NO: 158900 - RNA, 64 nt, Human
ucaagguuugugcugagcuccuugauugccuuagggacagaauuaccccagccucuugagcuga

SEQ ID NO: 158901 - RNA, 64 nt, Human
cucaaugaaaagggaguuucguaagcaaaauagaggacagaaaugcaguucaugaacuugcugg

SEQ ID NO: 158902 - RNA, 64 nt, Human
gugguuaugagccuccaggcgcaugcuguccaguggacagaacaucuggcgguugguugauugc

SEQ ID NO: 158903 - RNA, 64 nt, Human
caugccccucucgggccuuuguggcugagaagugggacagaaagaugauuaagguaaugugucc

SEQ ID NO: 158904 - RNA, 64 nt, Human
cuggauguucuuuuuacgaggugacaagaguuggggacagaacucccauuacaacugaccaagu

SEQ ID NO: 158905 - RNA, 64 nt, Human
guuucccauaucauuguugaugaaguucaugagaggacagaagaaagguaaaacaaagacuuuc

SEQ ID NO: 158906 - RNA, 64 nt, Human
ggguguuuuagcauuacuguguaaagacuugaagggacagaagugaagaaaauaagcugcaauu

SEQ ID NO: 158907 - RNA, 64 nt, Human
aaaaauaagugguaagauaauuguaaaaugaaauggacagaauauucaauuuuccaucuaugaa

SEQ ID NO: 158908 - RNA, 64 nt, Human
uacauuuuuccccuccugggguuugcggggacagggacagaacuacaggagucaugggaaagaa

SEQ ID NO: 158909 - RNA, 64 nt, Human
cucguggccuggagccuggcuggagcucugcuagggacagaaguguuucuggaagugaugcuuc

SEQ ID NO: 158910 - RNA, 64 nt, Human
cacgugccugacgcuuccaggaagcuguagagagggacagaaggggcgguucagccaagacaga

SEQ ID NO: 158911 - RNA, 64 nt, Human
acuugcuuuucucuaggugguucauuuugaaaggggacagaaauauaacuaaaugcuuccagga

SEQ ID NO: 158912 - RNA, 64 nt, Human
gggggacagagggaccuuuaaagaaaacaaaacuggacagaaacaggaaugugagcugggggag

SEQ ID NO: 158913 - RNA, 64 nt, Human
cagaccaugccaaaguccagucugaaaugaaaggggacagaagucuugcuguccaugguggugu

SEQ ID NO: 158914 - RNA, 64 nt, Human
cauguaaauucccacuuuacauaaaaacccaucaggacagaaugaugcucaauauuuuaaaauu

SEQ ID NO: 158915 - RNA, 64 nt, Human
gagugacaguccccccccuucaagauggaagccuggacagaaaccuuggaagcccucuuaugag

SEQ ID NO: 158916 - RNA, 64 nt, Human
aaaagccagucaaaacaaaaacuuuacugaaaauggacagaaauaggaaauggacuuuuuccuu

SEQ ID NO: 158917 - RNA, 64 nt, Human
gaaauugcacuaaggaccucuuccuuugcuguauggacagaagaguucaugguugcauucaggg

SEQ ID NO: 158918 - RNA, 64 nt, Human
cacuuuuucuggaaaauaaugaucuguacagacaggacagaaugaaacuccugcgggucuuugg

SEQ ID NO: 158919 - RNA, 64 nt, Human
gauccugcuuugaaaauugauacaaacagaaucaggacagaaaaugguuccauuuugcccagug

SEQ ID NO: 158920 - RNA, 64 nt, Human
cacccuuaaaaucuuucucacugauacucucucuggacagaaaaaaggugaaauaagccuacua

SEQ ID NO: 158921 - RNA, 64 nt, Human
uuguuuucccuuauuuuaaaagugauuuuuuuaaggacagaacuucuuccaaaagagagggaug

SEQ ID NO: 158922 - RNA, 64 nt, Human
agcaaggggagacauugugguagcuaucagacauggacagaaacugacuuagugcucacaagcc

SEQ ID NO: 158923 - RNA, 64 nt, Human
aacucaacucaaucugaaaguagagugucugagaggacagaagguaaugggaacuguagcugga

SEQ ID NO: 158924 - RNA, 64 nt, Human
gugagaagacauagggauuucaaccacacaguugggacagaagggacagugcaucuguucaucc

SEQ ID NO: 158925 - RNA, 64 nt, Human
cacucaccucacuguucaaucauugagugguaaaggacagaaguauuuucuaguucuggucaga

SEQ ID NO: 158926 - RNA, 64 nt, Human
gauuguuucaaaauauuuuugcaaauugagauaaggacagaaagauugagaaacauuguauauu

SEQ ID NO: 158927 - RNA, 64 nt, Human
agucuugacucccuacuucccgucauuccucacaggacagaagcagaguggguggugguuaugu

SEQ ID NO: 158928 - RNA, 64 nt, Human
acucugaagagagagaccacugcccuuugugguuggacagaauaucuguggcaucaugggcuau

SEQ ID NO: 158929 - RNA, 64 nt, Human
agaauccacagacacaccuaagccuguggcacugggacagaauagauuuuccauuugagaggca

SEQ ID NO: 158930 - RNA, 64 nt, Human
ugucuugccagugccggcccccggcccaguucagggacagaauuauaguguuugggauucaaac

SEQ ID NO: 158931 - RNA, 64 nt, Human
ggauucucugacaaaaauuucuucuauggauucuggacagaagacacuugagggugauauguuu

SEQ ID NO: 158932 - RNA, 64 nt, Human
uggguaagaaaaugcaaaccuguuauaaguuaucggacagaaagcuaggugcucugucaccccc

SEQ ID NO: 158933 - RNA, 64 nt, Human
aaaggcuucagaguagauaucucugccaacaugaggacagaaggacuggugcgaccccccaccc

SEQ ID NO: 158934 - RNA, 64 nt, Human
gacuacucuuucggggagcucagccgccugguggggacagaauggagaaaucuugagacagcca

SEQ ID NO: 158935 - RNA, 64 nt, Human
uaucucuuuggcguuucccuacagaaaagaaauuggacagaacagaauaauaugaagcaggauc

SEQ ID NO: 158936 - RNA, 64 nt, Human
ggacauaaaauagaggcugaccuuaaaagggccaggacagaagcggcugccagcucugaaucuu

SEQ ID NO: 158937 - RNA, 64 nt, Human
ucaaagcaaaugaacuuaagcauuugggauugagggacagaaggauucugagggggcucugcga

SEQ ID NO: 158938 - RNA, 64 nt, Human
uugccaauauaaugaguauuacauuggccuugggggacagaaaggaggaaguucugacuuuuca

SEQ ID NO: 158939 - RNA, 64 nt, Human
uagaguauccaauaaaggagacaguuuagagucaggacagaaaagcuuccauaauugaacuaga

SEQ ID NO: 158940 - RNA, 64 nt, Human
agaggacuucagcucugcuguugggcugguguguggacagaaggaauggaaagccaaauuaauu

SEQ ID NO: 158941 - RNA, 64 nt, Human
uuuacugagcuggaagccucugaaaguuauuaaaggacagaauccaaaagaaugccuuuaauuc

SEQ ID NO: 158942 - RNA, 64 nt, Human
cacacaccacagccaggagaggccuuucccaccuggacagaaacuuccagaccagccccucuca

SEQ ID NO: 158943 - RNA, 64 nt, Human
caccaucccacacuguccaggccuuaacugagagggacagaagacgcuggaaggagagaaggaa

SEQ ID NO: 158944 - RNA, 64 nt, Human
ggccccagagaugaucuugcccuuccuaacuaaaggacagaagugcaauuuagcuuaaaugggu

SEQ ID NO: 158945 - RNA, 64 nt, Human
gguuuggucaguuacaaaguaauuucuuugaucuggacagaacauuuauaucaguuucaugaaa

SEQ ID NO: 158946 - RNA, 64 nt, Human
uucaaugagaagagggagacaaauauaaagaugaggacagaagcaucucuacagaugaaaauua

SEQ ID NO: 158947 - RNA, 64 nt, Human
uuaaaaauacaucauguggccaaagaaugagaaaggacagaauuaaccaaggauucuuaauugu

SEQ ID NO: 158948 - RNA, 64 nt, Human
ugccugcagagagcuguacagaagcacuuuucauggacagaaaugcucaaucgugcacugcaaa

SEQ ID NO: 158949 - RNA, 64 nt, Human
auucaucucuguauucucucagcuguuguuagaaggacagaauguuaaacuuuaucuuaauuag

SEQ ID NO: 158950 - RNA, 64 nt, Human
cauuuucagcuucucugccucucuucugauacaaggacagaagaauuggguagauauucaccuu

SEQ ID NO: 158951 - RNA, 64 nt, Human
ggcaagcugcaaagugccuugcucauuugaaaauggacagaaugugucucaggaaaacagcuag

SEQ ID NO: 158952 - RNA, 64 nt, Human
cauuauucuuggcgcacaguccaaaauacaaauuggacagaagaucuauauuguaccagaacua

SEQ ID NO: 158953 - RNA, 64 nt, Human
uuguaauauaaucagaaugaaaaauaauuuaagaggacagaagacugguacuuuuuuguuuuau

SEQ ID NO: 158954 - RNA, 64 nt, Human
aaaguguguauucuugauguuuauuggcucauguggacagaaauguacagggagaauuacauua

SEQ ID NO: 158955 - RNA, 64 nt, Human
augacuggacagacuuugaauauacucuaaaaguggacagaaaauuuacgaaaaucuuagauuu

SEQ ID NO: 158956 - RNA, 64 nt, Human
ggcuugguagcaaaguaacauuuuuuggaaaagaggacagaaaaauugaacuacagcuugagaa

SEQ ID NO: 158957 - RNA, 64 nt, Human
ugggacuugacaaaguaugugggaggggaaggaaggacagaacuugacuggcuccauuucaugg

SEQ ID NO: 158958 - RNA, 64 nt, Human
cugcccuuguucugauuuuacacaccaacucuugggacagaaacaccuuuuacacuuuggaaga

SEQ ID NO: 158959 - RNA, 64 nt, Human
aacggagaccugugaccacagcaggcugacagauggacagaaucucccguagaaagguuugguu

SEQ ID NO: 158960 - RNA, 64 nt, Human
ugcccaugggaaguaaacugcagcaggccacuggggacagaagggcccauguacuuguugggag

SEQ ID NO: 158961 - RNA, 64 nt, Human
gaggagcaccugaagaaaucaagccaggugcccaggacagaagccccagccccagccucaucua

SEQ ID NO: 158962 - RNA, 64 nt, Human
gacugccaccagucuacacauacagcagcccccuggacagaaucagcauuucagcucagcuggc

SEQ ID NO: 158963 - RNA, 64 nt, Human
uguagcucccugagagaaagacuguaacucugcaggacagaaacaagguuuuaaagcauugcca

SEQ ID NO: 158964 - RNA, 64 nt, Human
ucagcccuucuuggaauacagccuuucaagcagaggacagaaggguccuucuccuuauguggga

SEQ ID NO: 158965 - RNA, 64 nt, Human
uccaugccgcguggaugggcccaguucugggagaggacagaaaaggugguacaggguugucugc

SEQ ID NO: 158966 - RNA, 64 nt, Human
uuguuuuuacguuuucaaguucagcauuguauucggacagaagcugugacugaagacucagugc

SEQ ID NO: 158967 - RNA, 64 nt, Human
ggacauugaugaucacauucugcccuuuacuacaggacagaaaccacuuaguuuuuaauaagug

SEQ ID NO: 158968 - RNA, 64 nt, Human
ggugccugccucucuccuccaccccaggcuuagaggacagaaaaaugugaagagacgccccacc

SEQ ID NO: 158969 - RNA, 58 nt, Human
uguuccgggcaauugugugacaaaggauggacagaaggacugccugccucccucccug

SEQ ID NO: 158970 - RNA, 64 nt, Human
auuuaugacccaaauacaaaucucaauuugacugggacagaaugaggaauggagauuuuuguau

SEQ ID NO: 158971 - RNA, 64 nt, Human
agguuacuauggguuugccauuaauuucugagugggacagaaauuauaauugugcuuuuucgug

SEQ ID NO: 158972 - RNA, 64 nt, Human
aauggcacaauuguuugcuaugugcacccguccaggacagaaccgugcauaggcaaaaggagug

SEQ ID NO: 158973 - RNA, 64 nt, Human
agacgaguguggaggauagguuaagaaaggaaagggacagaagucuugcaauaggcugcagaca

SEQ ID NO: 158974 - RNA, 64 nt, Human
acaugcugcuaguaucagaggggcaguagagcuuggacagaaagaaaagaaacuugguguuagg

SEQ ID NO: 158975 - RNA, 64 nt, Human
ugugccagacacauuccaccucuccaguauugcaggacagaauauauguguuaaugaaaaugaa

SEQ ID NO: 158976 - RNA, 64 nt, Human
ugcugggcagcaccggugcccaaaucuggcugguggacagaagcaccuggagaguuggagagcu

SEQ ID NO: 158977 - RNA, 64 nt, Human
ucggccccuccucaaugggcuuucccccaacucaggacagaacaguguuuaauguaaaguuugu

SEQ ID NO: 158978 - RNA, 64 nt, Human
ucccaacucuagcugggggugggccaggcugaugggacagaauuggauacauacaccagcauuc

SEQ ID NO: 158979 - RNA, 64 nt, Human
uguugcuuucaaguaguuagaguugagcuguuaaggacagaauaaaaucauaguugaggacagc

SEQ ID NO: 158980 - RNA, 64 nt, Human
cugcccaccaggugugcugggcagacuucagcugggacagaaguccgaucucccuagggcccca

SEQ ID NO: 158981 - RNA, 64 nt, Human
uguguggcucuguauauucuguuaaaaaauuaaaggacagaaaccuuucuuuguguaugcaugu

SEQ ID NO: 158982 - RNA, 64 nt, Human
agagcacuugagcugucugaagcccaaagccugaggacagaaagacccugaugcaggucagccc

SEQ ID NO: 158983 - RNA, 64 nt, Human
auaguguauaacuuggagguuaaaagagccuuuuggacagaaaacugggccaggaaaaggcauc

SEQ ID NO: 158984 - RNA, 64 nt, Human
cauuucuaauugaagaagaaagggagggcagagaggacagaaaauuacuuggguuuacuaauuc

SEQ ID NO: 158985 - RNA, 64 nt, Human
cuuuagccagauugcuuuuugcaaccaaagcuguggacagaaaagccuccuuaagugagcugag

SEQ ID NO: 158986 - RNA, 64 nt, Human
ggagcagaaaugcaaggggcugcaugaccuaccaggacagaacuuuccccaauuacagggugac

SEQ ID NO: 158987 - RNA, 64 nt, Human
agaccaucaccagcaucuguccuucagggugcucggacagaauucuuaccacagcaaaggcaua

SEQ ID NO: 158988 - RNA, 64 nt, Human
ggcugucugcauguuuauuuuuacuucccuggguggacagaauuuaauuucucgagcuguuuuu

SEQ ID NO: 158989 - RNA, 64 nt, Human
auuuacuauaggugaagauagcccucauauucaaggacagaagcucuggcaggaguaaauuagc

SEQ ID NO: 158990 - RNA, 64 nt, Human
gcaugcuugugcagaaagaagccauagccagaaaggacagaaucucucccccacucccuugccc

SEQ ID NO: 158991 - RNA, 64 nt, Human
aacccucuuccuccccgucauuguacuguaacugggacagaagaaauaauggggauauguggaa

SEQ ID NO: 158992 - RNA, 64 nt, Human
ggccagaguggggaggguggccagccacucugagggacagaacguccucuuguguauaauaaac

SEQ ID NO: 158993 - RNA, 64 nt, Human
auaguguauaucuuggagguuaaaagagccuuuuggacagaaaacugggccaggaaaaggcauc

SEQ ID NO: 158994 - RNA, 64 nt, Human
auguguuuuuuagaguauauacuaagcucuacagggacagaaugcuuaauaaauacuuuaauaa

SEQ ID NO: 158995 - RNA, 64 nt, Human
gaaaaugaacagguucuuuaaaaugccaagcaagggacagaaaagaaagcugcuuucgaauaaa

SEQ ID NO: 158996 - RNA, 64 nt, Human
gaaccuuuccaagguggggauggaagcacagucgggacagaauucgauggauuccuuuaguugg

SEQ ID NO: 158997 - RNA, 64 nt, Human
ccccuuuuucuauuucacugucaccccucuuuguggacagaaguucgaacaugugguguugcac

SEQ ID NO: 158998 - RNA, 64 nt, Human
cccauugcccagcuucaguccauccauguuagauggacagaaauuauggccaguugaaaauacc

SEQ ID NO: 158999 - RNA, 64 nt, Human
gaauugcuacucgaaggugccagaaugacacaaaggacagaauuccuuucccaguuguuacccu

SEQ ID NO: 159000 - RNA, 64 nt, Human
agaugaagugacuuccucaaaaucacaugguucaggacagaaacaagauuaaaaccuggaucca

SEQ ID NO: 159001 - RNA, 64 nt, Human
aaggcccuaccagagggaacacggccuacugagcggacagaaugaugccaaaauauugcuuaug

SEQ ID NO: 159002 - RNA, 64 nt, Human
cuuugagagaguuuaucauugggagaagccgcagggacagaacugaacguccugcagcuucggg

SEQ ID NO: 159003 - RNA, 64 nt, Human
cgggccgcuccgcuccccugcuccugucugucucggacagaaaacacgaggcuccuugugucaa

SEQ ID NO: 159004 - RNA, 64 nt, Human
cuuuaucuguaagaacccuuaguguccuguagggggacagaaugggguggccagguggugauuu

SEQ ID NO: 159005 - RNA, 64 nt, Human
gcaaacuuaagaguaguuuauuuauauacccuggggacagaaagucagguugaaacaggaaaac

SEQ ID NO: 159006 - RNA, 64 nt, Human
uaaucaagggaggaaaaggucaccagggagaacuggacagaacugaaacacagcaacaccaguu

SEQ ID NO: 159007 - RNA, 64 nt, Human
caaaaauuacuugggggugauugucacagaggagggacagaaaggguaucugcugaccaccagc

SEQ ID NO: 159008 - RNA, 64 nt, Human
auugauaugcuggcaauauaggaugguauguaauggacagaacugaugcagaugguugaaugcg

SEQ ID NO: 159009 - RNA, 64 nt, Human
ugagaagacucuuccugggcacggcguggggacuggacagaaaaccacugcaagccccaaggag

SEQ ID NO: 159010 - RNA, 64 nt, Human
uuuccuucauggccgugaaucccagcucacccauggacagaagaccuccccucaucugaaagcc

SEQ ID NO: 159011 - RNA, 64 nt, Human
uuuucagguucauuuuuauaauguuuacuuuuuaggacagaacaguagcuaaauuaaaguaaua

SEQ ID NO: 159012 - RNA, 64 nt, Human
uuaaaaagagccuuacuuucuuuacauaccacauggacagaauuuguguaaaagugaauuaucu

SEQ ID NO: 159013 - RNA, 64 nt, Human
uuuggugggcaucaucagcuggggccugggcuguggacagaaggaugucccggguguguacacc

SEQ ID NO: 159014 - RNA, 64 nt, Human
agaggaugcagcccccagcugcauggaagguggaggacagaagcccuguggauccccggauuuc

SEQ ID NO: 159015 - RNA, 64 nt, Human
caccaaugggaccaaguccaaauggauuaauccaggacagaauagccacuugcuuaauuuucug

SEQ ID NO: 159016 - RNA, 64 nt, Human
uauccaaguuaugauuuauuuugcaacuaccucaggacagaaaagauuuauggggauuuuaaaa

SEQ ID NO: 159017 - RNA, 64 nt, Human
guccuuucugugcacuaugaacgcuucuuucccaggacagaaaauguguagucuaccuuuauuu

SEQ ID NO: 159018 - RNA, 64 nt, Human
ugcagauuaaguaaugcugggaggaauaaagaagggacagaaacauggaacauaaagcauugaa

SEQ ID NO: 159019 - RNA, 64 nt, Human
aaagugggagggcuggcuugggcugagaagggagggacagaaaagagaagacagaacaaagcug

SEQ ID NO: 159020 - RNA, 64 nt, Human
cauggcugagaugaccugguccuaggacacccuuggacagaagacuggccuaccuagcagaccu

SEQ ID NO: 159021 - RNA, 64 nt, Human
agcugcagccgccuccucguuccucuccuggaugggacagaauguggcguggagaaggucagag

SEQ ID NO: 159022 - RNA, 64 nt, Human
auaauggaaccuccauuuucaaacugaagcacagggacagaaaauauauuucuaguuaucacuu

SEQ ID NO: 159023 - RNA, 64 nt, Human
uuccagaagaaaugauauuuauauucucuauaggggacagaaaaugagaagccaucacucuuuu

SEQ ID NO: 159024 - RNA, 64 nt, Human
guucaggacguccgggaggaagcaagcaugugggggacagaacaguaguccuggacucgaaagg

SEQ ID NO: 159025 - RNA, 64 nt, Human
cuuugcugggcaucucguaaucacuuuucuuaggggacagaaucccaucuuuuccuucggcaga

SEQ ID NO: 159026 - RNA, 64 nt, Human
aaaacaaguucaaagacuuuuacuuacagauccuggacagaaagggcauaaugagucugaaggg

SEQ ID NO: 159027 - RNA, 64 nt, Human
cuguuccccacugccuguguucgcaggagccacgggacagaagacgguggccucugcugccggg

SEQ ID NO: 159028 - RNA, 64 nt, Human
ggaguccaaggcguuauugggccaccugacagcuggacagaaaaggggcagacacaccgaggau

SEQ ID NO: 159029 - RNA, 59 nt, Human
acagcagugacucagaaugaacuggcuucggacagaacaggacagauggaugucgcaca

SEQ ID NO: 159030 - RNA, 64 nt, Human
accacccagagcugggccagggacucaacaauggggacagaagucccccagugccugccagggc

SEQ ID NO: 159031 - RNA, 64 nt, Human
uauauuuguucccucuauaaaccauucaucuuucggacagaacuuacuguaaagaaagaaaucu

SEQ ID NO: 159032 - RNA, 58 nt, Human
uuguaucagagcagugcuaaaauuucuaggacagaacaacaccaguacugguuuacag

SEQ ID NO: 159033 - RNA, 64 nt, Human
uggcauagggcuacuggucucaucccagcgaucgggacagaaauugcuaauagcucaugcaacu

SEQ ID NO: 159034 - RNA, 64 nt, Human
ggcagcccuuaucagcuugugacaaccuuccccaggacagaagucauacaaggccucugggguu

SEQ ID NO: 159035 - RNA, 64 nt, Human
gaacccucaggucucuaggugagggucuugaugaggacagaaguuuagaguagguccuaagacu

SEQ ID NO: 159036 - RNA, 64 nt, Human
gugcucagggacgugcuucucuuguaaggcaggaggacagaagaggaccaagaagggagggggc

SEQ ID NO: 159037 - RNA, 64 nt, Human
aguaccagcgcccggggguguccacaaccacuugggacagaagaagguggaauuucagacagaa

SEQ ID NO: 159038 - RNA, 64 nt, Human
uucuuuuuuuuuuguuuuucgagggggcaaggagggacagaaaaguaaccucuucuuaagugga

SEQ ID NO: 159039 - RNA, 64 nt, Human
ugaaaauaaauuuaguucgccuuuauucugcacaggacagaauucuagguggaugauuuuugcc

SEQ ID NO: 159040 - RNA, 64 nt, Human
gcuguccacgggggagaagucucugcucuggacuggacagaagagagacuuuuacccuggggca

SEQ ID NO: 159041 - RNA, 64 nt, Human
ucacucauguacucauuccugguggcucaucucaggacagaaggcaauugcagcuaaggaacaa

SEQ ID NO: 159042 - RNA, 64 nt, Human
auuuacaaaaggaagaaauuccugccaucagaagggacagaaggagauggaaugaucaaaucac

SEQ ID NO: 159043 - RNA, 64 nt, Human
gcagaaaccuugcucugaagaccagagacagaagggacagaaacaggagugccuccugcugugc

SEQ ID NO: 159044 - RNA, 64 nt, Human
uguauugagcuuauuguugaaagggauuuuugaaggacagaacaauuacuccaugaugaaucuu

SEQ ID NO: 159045 - RNA, 64 nt, Human
ucccugcuaugggaaaggccaagcugcuggguggggacagaagcugcaggggagagggaagcag

SEQ ID NO: 159046 - RNA, 64 nt, Human
caagggaacacguggagagcuucuuccagaagauggacagaaacaaggaugguguggugaccau

SEQ ID NO: 159047 - RNA, 64 nt, Human
aggucggagacuacguauguaauccucacucuuuggacagaaaaaaaaaaaaaagucuuucuug

SEQ ID NO: 159048 - RNA, 64 nt, Human
aacugguauuuuguaaaugugucagagacacaugggacagaacccuacuuuuuguagaggaacu

SEQ ID NO: 159049 - RNA, 64 nt, Human
auuagcucaugcgaauauaagagaauacuucuaaggacagaaaucucugaaucaauggcuaaga

SEQ ID NO: 159050 - RNA, 64 nt, Human
ccaacauaauauuauuuucuagaaugcccuggaaggacagaauauuuaaaaauauauccaggug

SEQ ID NO: 159051 - RNA, 64 nt, Human
agggaaucaaaucagccccguuuuggagggugggggacagaagauggggcuacauuucccccau

SEQ ID NO: 159052 - RNA, 64 nt, Human
gagcugagaucgugcuacugcacuccagccugggggacagaaagagacuccgucucaaaaaaaa

SEQ ID NO: 159053 - RNA, 64 nt, Human
aggaggguaggaggggccucccuggauugaaccgggacagaaacacggugagggcccccaccac

SEQ ID NO: 159054 - RNA, 64 nt, Human
ugagucaaaagccuuagcacaguggcaaaaaaugggacagaaugaugaccagcaccucagaaac

SEQ ID NO: 159055 - RNA, 64 nt, Human
gggaaaaggacauggauuaggacuuuaaaacacuggacagaauuucccacagucuuugcccuca

SEQ ID NO: 159056 - RNA, 64 nt, Human
ucuuggggauuuggugcacacaagaccaaggaaaggacagaaugaggaaaggccuggggcagaa

SEQ ID NO: 159057 - RNA, 64 nt, Human
ccccuagacccuggcugacuuggacaaucugccaggacagaagcuggguuuucugucuagguca

SEQ ID NO: 159058 - RNA, 64 nt, Human
gcuaugauggcugcacacgaugacucauuggaugggacagaagaagaggaugaggaugagaugg

SEQ ID NO: 159059 - RNA, 64 nt, Human
auacaaaugaaauuagaagaaacacagccucaugggacagaaauuugagggaggggaacaaaga

SEQ ID NO: 159060 - RNA, 64 nt, Human
gccgccggccuucggauguaaacccacugauaacggacagaaagagaaugcccacaaguggguc

SEQ ID NO: 159061 - RNA, 64 nt, Human
acaaaggccaagaucacagaguacagucuuggagggacagaauuguuugugcuggguauuggag

SEQ ID NO: 159062 - RNA, 64 nt, Human
cccuguuucaaucacuguccuccacacaagggaaggacagaaaggagaguggccauucuuuuuu

SEQ ID NO: 159063 - RNA, 64 nt, Human
agagacuuccugccuggaacucaucugugaacugggacagaagcagaggaggcugccugcugug

SEQ ID NO: 159064 - RNA, 64 nt, Human
gcuggccauccccaggcaucucuggugucacugaggacagaagggacuagggcucuggcggggu

SEQ ID NO: 159065 - RNA, 64 nt, Human
ccuuagcucucuugcucaccacccaagaaccucaggacagaagcgagagcccauugcuccugcu

SEQ ID NO: 159066 - RNA, 64 nt, Human
ugaaacgucuaggaaaucuagaaguaguccugaaggacagaaacuaaacucuuaccauauguuu

SEQ ID NO: 159067 - RNA, 64 nt, Human
uggguugugcuaauuucuguccagaaaauaggguggacagaagcuugugggguacauggaggaa

SEQ ID NO: 159068 - RNA, 64 nt, Human
uuugccaggaucuaggaaccaccuaaugguagguggacagaaaaggaaaaaaaaaaaaauuuac

SEQ ID NO: 159069 - RNA, 64 nt, Human
gagaaagcauaguccagcaggacaguggccauuuggacagaagcccacuuaguuucuugggagc

SEQ ID NO: 159070 - RNA, 64 nt, Human
uucaccuuaaguaacacacaaaucgggaacaggaggacagaaccguuggcauuaucaggauucg

SEQ ID NO: 159071 - RNA, 64 nt, Human
ugaacuccccagggcucccgugggcucugccacuggacagaaggccuccagcuccuccgcucug

SEQ ID NO: 159072 - RNA, 64 nt, Human
gcuucaggcuacuugguaacuggaagaagcuggaggacagaagcaguacucaacuugcuguuau

SEQ ID NO: 159073 - RNA, 64 nt, Human
guggugugcagagguggggagguggcgaggauggggacagaaagcgcacagaaucuuggaccag

SEQ ID NO: 159074 - RNA, 64 nt, Human
ggcuccaaauggucaaauaagugaaugaaugaauggacagaaaauucaauccuuuauuuuuuuc

SEQ ID NO: 159075 - RNA, 64 nt, Human
cuguaaacguuugucguguacaagcucagagcuuggacagaauuuuuuguauuuguaaauuggu

SEQ ID NO: 159076 - RNA, 64 nt, Human
uccucccgccagucuccauugaaucaauggugcaggacagaaagccagucagacuaauuuccuu

SEQ ID NO: 159077 - RNA, 64 nt, Human
uaguguacuagauguacuuuuucuaaaaaggaaaggacagaaaaaaaugaagaaaggaaaggaa

SEQ ID NO: 159078 - RNA, 64 nt, Human
uacuauggugaugaucuagaacugacuuacuucaggacagaagaaaaaacaaucacacccuuaa

SEQ ID NO: 159079 - RNA, 64 nt, Human
uuuuuucaacacuuuuauuaacaaaaguaaacauggacagaacacacugccauuucugggaaga

SEQ ID NO: 159080 - RNA, 64 nt, Human
gacaaagcuccucagugagcugguguauaauccaggacagaacccaggucuccugacuccuggc

SEQ ID NO: 159081 - RNA, 64 nt, Human
gcuauuuuaaaacauuauuuugacuacuaaguggggacagaaagauccauccugaguuguggaa

SEQ ID NO: 159082 - RNA, 64 nt, Human
cagagauuagcccucauuccgcaucugucaaccaggacagaaagcauggacaagggaugagcuu

SEQ ID NO: 159083 - RNA, 64 nt, Human
gcucaccacugaggccuaauacaagaguuccuauggacagaacuacauucuuucucgcauagug

SEQ ID NO: 159084 - RNA, 64 nt, Human
gagaaggagagagaaauaugugagguaguaaggaggacagaaaacagaacagaaaagaguaaca

SEQ ID NO: 159085 - RNA, 64 nt, Human
augucucaaaggguaaacuuacuacuuucuugugggacagaaagaccuuaaaauauucauauua

SEQ ID NO: 159086 - RNA, 64 nt, Human
aauauggagcuuucauaaaaaugggaugcauugaggacagaacuagugaugggaguauguguag

SEQ ID NO: 159087 - RNA, 64 nt, Human
uuaacuuuguguguggucugcaaaauaaacagcaggacagaaauuguguuguuuuguucuuuga

SEQ ID NO: 159088 - RNA, 64 nt, Human
aauauggagcuuucauaaaaaugggaugcauugaggacagaacuagugaugggaguaugcguag

SEQ ID NO: 159089 - RNA, 64 nt, Human
ccuaguccaucucacuucuggugcuaccugaguuggacagaauucuagcucaugguugcuagga

SEQ ID NO: 159090 - RNA, 64 nt, Human
acgggguucacaagccauggucgggguccgggggggacagaaauggauuuucuuggcaauaagc

SEQ ID NO: 159091 - RNA, 64 nt, Human
uuuccuuuuuuggucuuuaugaauauauuuauauggacagaauuaagauaaacaaaauugauug

SEQ ID NO: 159092 - RNA, 64 nt, Human
aaucuauuaaggggaugacugucucaaauauguaggacagaaaugagaagccccaagcuugcuu

SEQ ID NO: 159093 - RNA, 64 nt, Human
uuuagaauuagccaaugaaauguaaauaaacuuuggacagaaaauagcaauguauuuuuuuaau

SEQ ID NO: 159094 - RNA, 64 nt, Human
aacugugaucccacuacugcauuccagccuggguggacagaacaaggcccugucucuauuuuaa

SEQ ID NO: 159095 - RNA, 56 nt, Human
cccuccagaaaauaaaguaaagccauggacagaauguggucugucagcugugaauc

SEQ ID NO: 159096 - RNA, 64 nt, Human
uuuuuagacuuucuuaaaagacguuaaaauuuuaggacagaauuuucuugauguuguuugaucu

SEQ ID NO: 159097 - RNA, 64 nt, Human
gggaaucuagggccuggaaccccuuucuucuaguggacagaacaugcuguguuccauacagccu

SEQ ID NO: 159098 - RNA, 64 nt, Human
uggcugcauuuucuuaucugaucacaauggcaggggacagaaugugcauggaguggagcaugug

SEQ ID NO: 159099 - RNA, 64 nt, Human
auaguugcaggagagcuuuuuguacaugcuuuuaggacagaauggagacuuauacacccaaagu

SEQ ID NO: 159100 - RNA, 64 nt, Human
gcaauugagcuguauaggggccaccuugcagggaggacagaaaacuaacauuuuggcccaacuu

SEQ ID NO: 159101 - RNA, 64 nt, Human
uaacaaugguuucguuuugaccaaacuuguauuaggacagaauuaaugaugcuuaaagagaaaa

SEQ ID NO: 159102 - RNA, 64 nt, Human
auuauuguccuuucaaguuaagaguauauaaucuggacagaaaauuucacaaaauucaauaaaa

SEQ ID NO: 159103 - RNA, 64 nt, Human
ugaugugauauagucuuugucuuucaugcugcugggacagaaaagacccgacauugcuucagaa

SEQ ID NO: 159104 - RNA, 64 nt, Human
cugcugccugaaauaaaaccauuaggacucacugggacagaacuuucaaguuccuucaacugug

SEQ ID NO: 159105 - RNA, 64 nt, Human
gcugcuccauauuagcuuccagagggugagugagggacagaauauuuccuucauaauggucaug

SEQ ID NO: 159106 - RNA, 64 nt, Human
uuuuguagacuuuuguguaacuauuuguaccguaggacagaaugugaggaggaaguaacacaca

SEQ ID NO: 159107 - RNA, 64 nt, Human
aaguauuuccccauggaaaggagaaagugguuugggacagaaagaaauggaaugucuucaguca

SEQ ID NO: 159108 - RNA, 64 nt, Human
gccacuuacugagggggcugggaggugucgggcgggacagaauggggagcugaggaggcauuuu

SEQ ID NO: 159109 - RNA, 64 nt, Human
uaacauguccuggggaaggaagggaaacuuucuaggacagaagucacuuucagaugucauguau

SEQ ID NO: 159110 - RNA, 64 nt, Human
guagauauuuaauaucuaagcaggggaggggacaggacagaaagccugcacugaggggugcggu

SEQ ID NO: 159111 - RNA, 64 nt, Human
ucaacaaaaacuugcaucguaacaagauuugcuuggacagaaagagggucugcaucacugccau

SEQ ID NO: 159112 - RNA, 64 nt, Human
aagaagccuaaauuagguacuagaaaaaaaaaaaggacagaaacacugccugauaugugagcaa

SEQ ID NO: 159113 - RNA, 64 nt, Human
cccauaugggaauuauuaccucucagggccgagaggacagaauggauauaaucugaauccuguu

SEQ ID NO: 159114 - RNA, 64 nt, Human
cccucggugagcaacagugucagccaugcaagcaggacagaauggugacugggugcccuuggug

SEQ ID NO: 159115 - RNA, 50 nt, Human
acacgaucugugcacagugaggacagaacaugcuugugcuucugcgcuuc

SEQ ID NO: 159116 - RNA, 64 nt, Human
acuucacauuuuuagugaacuucucuaaagaagaggacagaauauacuggacuuaaccacgaau

SEQ ID NO: 159117 - RNA, 64 nt, Human
ccugccaaaaguucucuugccccaugccugcuggggacagaagguuuucaugaacucuuuuuac

SEQ ID NO: 159118 - RNA, 64 nt, Human
uauuuguaacauuuugauuugauuuaaucuccagggacagaaauaauucauugguaaaguguaa

SEQ ID NO: 159119 - RNA, 64 nt, Human
ggaaucacauucuguuuaucaagccauaauguaaggacagaauaauacaauauuaaguccaaau

SEQ ID NO: 159120 - RNA, 64 nt, Human
uuauccaaggaaaaucuaguuaaaauaauccaauggacagaagccccaggaagggguauuucca

SEQ ID NO: 159121 - RNA, 64 nt, Human
uaggacccuuccuguggggggucuacagagucagggacagaagggaagggacccacaggaaguc

SEQ ID NO: 159122 - RNA, 64 nt, Human
gcccgggagcuccuugccugccacuucuuccaggggacagaauaacccaguggaggaugccagg

SEQ ID NO: 159123 - RNA, 64 nt, Human
ugucucacuaguuuuuccugugcaaaaauaaaauggacagaauugcagcccgcugugacucaug

SEQ ID NO: 159124 - RNA, 64 nt, Human
gagugaaaauagagggaagugucaugcaagugcuggacagaaggcggcaggugggacgagcccc

SEQ ID NO: 159125 - RNA, 64 nt, Human
caggcagcuaagggaggacgccugcccacgccugggacagaaggcuucacugcuaaucacaucg

SEQ ID NO: 159126 - RNA, 64 nt, Human
ugccccaguugcucauacaaacagaucagcaugaggacagaaggcaggagacuuuggucaguua

SEQ ID NO: 159127 - RNA, 64 nt, Human
ccaucucaugaccuguggcauugcacggugcaguggacagaagggauuauccucagccagucgc

SEQ ID NO: 159128 - RNA, 64 nt, Human
cagcaggccgccugaaucaaauccugggagguggggacagaaaucuguguuuuaagaagccuuc

SEQ ID NO: 159129 - RNA, 64 nt, Human
gucuggcacauccuuaauccugugccccugccugggacagaaauguggcuccaguugcucuguc

SEQ ID NO: 159130 - RNA, 64 nt, Human
cagcuucucgugguggcaggagguaugucugacaggacagaagcaagcuccacuguggacauga

SEQ ID NO: 159131 - RNA, 64 nt, Human
uggcacggucucugcuccccaccagggcagcacgggacagaaacgucacggaggaguagccucc

SEQ ID NO: 159132 - RNA, 64 nt, Human
aauccagucugacuucccucuggagaaugacuauggacagaaggccaccauccuccacagagca

SEQ ID NO: 159133 - RNA, 64 nt, Human
gccaccugguguggaugucacugugugaagauaaggacagaagugcagagcugcgcuuugugug

SEQ ID NO: 159134 - RNA, 64 nt, Human
aauccccauuucucuaccggcuugcuuggaguuuggacagaagcauuucaccucugaucucagc

SEQ ID NO: 159135 - RNA, 64 nt, Human
cuucccucaguucccaaagcugcccaguccauggggacagaaccgucacucagauccacauuca

SEQ ID NO: 159136 - RNA, 64 nt, Human
ccccgggguccucagccucagcaacccagggagaggacagaaacgaaccgaugguugagggauu

SEQ ID NO: 159137 - RNA, 64 nt, Human
gguuacaucauugcaguccaccgaaaaaugaugaggacagaacuguauuuccugucaccucagg

SEQ ID NO: 159138 - RNA, 64 nt, Human
gagguggcccuaucccuaggcaguggugcuaggaggacagaaggcuauaugggcguggcagagg

SEQ ID NO: 159139 - RNA, 64 nt, Human
cccgccuugugagccaggaagcagcgucucaucaggacagaagguaggaugaagacauggggua

SEQ ID NO: 159140 - RNA, 64 nt, Human
agugacuugcuccagacaagaggugaccaggcccggacagaaauggccugggaaguagcagaag

SEQ ID NO: 159141 - RNA, 64 nt, Human
agaaagcagaaaaucuaccaagaacagagucucaggacagaaccacugagucuuuuggaggcuc

SEQ ID NO: 159142 - RNA, 64 nt, Human
cguucaaagaggugaacauuaaaauauagagacaggacagaauguguucuuuucuccuuuacca

SEQ ID NO: 159143 - RNA, 64 nt, Human
ugugugaaggaggagaucaaauuucaguggcuuuggacagaaaagaaggcucuggauuuaagcg

SEQ ID NO: 159144 - RNA, 62 nt, Human
uuuaugccuacuucgccugacacugccauccuggacagaaaggcaggagcucugaguccuca

SEQ ID NO: 159145 - RNA, 64 nt, Human
ugggaacugggggugcgggaguucucccucugggggacagaaaaucugacuacuaggaagacuu

SEQ ID NO: 159146 - RNA, 64 nt, Human
ucucaucaccagcucagcuaggccgggcagacaaggacagaagacucugggccacuguaauguu

SEQ ID NO: 159147 - RNA, 64 nt, Human
caauaauugaaagaaucgauaaaaguucaucuuuggacagaaagccuuuaaaaaaaaaaucacu

SEQ ID NO: 159148 - RNA, 64 nt, Human
caucauauuagauguaagauguaagacuugcaaaggacagaaggaaucuucuguaaccacauag

SEQ ID NO: 159149 - RNA, 64 nt, Human
cgucauaucagaugagaggaagauggccucugauggacagaauuuuucucuuaacucagcuuuu

SEQ ID NO: 159150 - RNA, 64 nt, Human
cugggcagccccuuuccuccauguacacugcaggggacagaaggggggccccaucccuacccua

SEQ ID NO: 159151 - RNA, 64 nt, Human
gagcucugcccuagugugggcccagcgccagacuggacagaagcccuggggcaaccuccucggc

SEQ ID NO: 159152 - RNA, 64 nt, Human
cgagagugaagagugagccagcccuucuggagcaggacagaagauaugcaaaauguauauuuuc

SEQ ID NO: 159153 - RNA, 64 nt, Human
uaaguuuucugagaugagggucuagcccuguuggggacagaaaaguguguagaccuucuuccug

SEQ ID NO: 159154 - RNA, 64 nt, Human
ggcugggucugacaucccugccaggaagcagguuggacagaaaccacuugcuaaaagcgucucu

SEQ ID NO: 159155 - RNA, 64 nt, Human
cagcagaggacugguguaagggagggagggguagggacagaagcuagacccaaucuccuuuggg

SEQ ID NO: 159156 - RNA, 64 nt, Human
aggguaauuugauuaugaaagagugaauuuuucuggacagaaaagggagagcuaccaaauuguu

SEQ ID NO: 159157 - RNA, 64 nt, Human
cuaauuguuaacuaauuggagucacaguauucuuggacagaaaaugauauaucuugugagaacu

SEQ ID NO: 159158 - RNA, 64 nt, Human
cuauuacuuucccauucacuagguaaagaaucauggacagaacuuacacuacuuuuuaccaugu

SEQ ID NO: 159159 - RNA, 64 nt, Human
gggcccggcugggcuccccaucugcacauccugaggacagaaaaagcugggucuugcugugccc

SEQ ID NO: 159160 - RNA, 64 nt, Human
uggguuuauguuucaccucauuuggaacaaaagaggacagaagcagaccacucugugcaccaac

SEQ ID NO: 159161 - RNA, 64 nt, Human
guggagugguuugaucuauauacacugugacgauggacagaagaaaauugugaaaguucaaauu

SEQ ID NO: 159162 - RNA, 64 nt, Human
aggcuucagcccagcugcauaguugaagauuuauggacagaaggaaagugauguauggaaaaug

SEQ ID NO: 159163 - RNA, 64 nt, Human
cuacauuuaucaauaaaauguaaauuaucugaaaggacagaauauaagauuuaaccauguuuga

SEQ ID NO: 159164 - RNA, 64 nt, Human
uuuccugaaccccaaagggagcagagagauaagaggacagaagaauggagaugggaaaauccac

SEQ ID NO: 159165 - RNA, 64 nt, Human
uugauuucacauuucuacucuagauggcaacauuggacagaaaaugcaaugacauaaccaauuu

SEQ ID NO: 159166 - RNA, 64 nt, Human
gaguucaucauuauuuugccuucaucuuuguuaaggacagaaaauucccugacaggugggcaag

SEQ ID NO: 159167 - RNA, 64 nt, Human
aauuaauuuccuuacaguuuuccuagcugaugagggacagaaccagaacuagagccugagccca

SEQ ID NO: 159168 - RNA, 64 nt, Human
cgagccuggcuccaaacccucgaggcggaucuuuggacagaagcagcucuuccccgaacacugu

SEQ ID NO: 159169 - RNA, 64 nt, Human
ucagagaggaagguccgggcccucgggaagccuuggacagaacccuccaccccgcagaccaggc

SEQ ID NO: 159170 - RNA, 64 nt, Human
uuaaggagaaccacacguaggggauguacuuuugggacagaagcaaggugggagugugcucugc

SEQ ID NO: 159171 - RNA, 64 nt, Human
aaagaaacacgcgacauggacucugucaaguagaggacagaaagcaagaaaggaugcagaacug

SEQ ID NO: 159172 - RNA, 64 nt, Human
aaguucucaacccuuauuacacauaauuuauacuggacagaaauccuaaagugugaagaauguc

SEQ ID NO: 159173 - RNA, 64 nt, Human
ugcucacagacuagaacuuaacggaacaagucuaggacagaaguuaagaucugauuauuuacuu

SEQ ID NO: 159174 - RNA, 64 nt, Human
cccaguuucugccucugagggaaagcccagaaaaggacagaaacgaaguagaaaggggcccagu

SEQ ID NO: 159175 - RNA, 64 nt, Human
ggcagcagccaaagacaaguaucagcuagcaucaggacagaaagguguccaaguaccuguauca

SEQ ID NO: 159176 - RNA, 64 nt, Human
agguaggggggcuugauaacuuaacuuuccacguggacagaauuuuuuuuuuuguuuuguuuuu

SEQ ID NO: 159177 - RNA, 64 nt, Human
guccuaaagccaggaagagugacaaggcagguggggacagaaggaagaagccaggagccucccu

SEQ ID NO: 159178 - RNA, 64 nt, Human
uguggaggugaaauuacagguucaacaguaauugggacagaaacuccagguaaauggggagugg

SEQ ID NO: 159179 - RNA, 64 nt, Human
cuccccaccccaguguaauggcccuucauggcagggacagaaagguggacugggggccauuugc

SEQ ID NO: 159180 - RNA, 64 nt, Human
ucuccggacccccuucccccucaccuccaggcagggacagaauaaauguuuguauggauuuuag

SEQ ID NO: 159181 - RNA, 64 nt, Human
caggagccacaccagagugugcaggcuucauggaggacagaagcgacuuuugugccgggacuua

SEQ ID NO: 159182 - RNA, 64 nt, Human
uguuucacaagacagauucuguccuugucacccgggacagaaaacucagucuuuucacccucau

SEQ ID NO: 159183 - RNA, 64 nt, Human
caguucccuuugauaucaugaauaaacuuacacuggacagaaacccuauaaauguaaauguggg

SEQ ID NO: 159184 - RNA, 64 nt, Human
ccugcgggauugcagauaugugaauggacuccauggacagaaaagcuacgaauguauggagugu

SEQ ID NO: 159185 - RNA, 64 nt, Human
gguuagggggagcaggaagcccagauaaucagagggacagaaacaccagcugcucccccucauc

SEQ ID NO: 159186 - RNA, 64 nt, Human
cagcuccuucugaauacacaaaagaguucauacuggacagaagcugugugaauacaaacauugu

SEQ ID NO: 159187 - RNA, 64 nt, Human
gagauuccuuuccccuguagggguagagggguggggacagaaacaacuuucuccuacucuuccu

SEQ ID NO: 159188 - RNA, 64 nt, Human
gaggggaguuaccccuaaaacaaagcuauuaaagggacagaauacuuccuguuuucucaguggu

SEQ ID NO: 159189 - RNA, 64 nt, Human
uucaaggcuuaauaaccguuagcuagaccauagaggacagaaacuuuacuaauguacugaaugu

SEQ ID NO: 159190 - RNA, 64 nt, Human
uucacacgucauuagacaucagagaaucuauacuggacagaaaucuuacaaaugucaucagugu

SEQ ID NO: 159191 - RNA, 64 nt, Human
uucacaccucauuagacaucagagaaucccuacuggacagaaaucuuacaaaugucagaagugu

SEQ ID NO: 159192 - RNA, 64 nt, Human
uucacaccucaauagacaucagagaauccaugcuggacagaaaucuuacaaaugucaucagugu

SEQ ID NO: 159193 - RNA, 64 nt, Human
uucacaccucauuagacaucagagaauccaugcuggacagaaaucuuacaaaugucaucagugu

SEQ ID NO: 159194 - RNA, 64 nt, Human
ggggagggggacgggguggggaaacggaggcaggggacagaagaggggagauugggggagagau

SEQ ID NO: 159195 - RNA, 64 nt, Human
aguuauugccuaggagugugagacugauguugcuggacagaaagugauccuuagcccagugugu

SEQ ID NO: 159196 - RNA, 64 nt, Human
caccaccagggcacucacucgcagcuauagcccaggacagaaaaacugugcuuuggacaggugc

SEQ ID NO: 159197 - RNA, 64 nt, Human
auccccugagcuaacccggaggaaaggcaguccuggacagaagacugucagcagaaggaaagua

SEQ ID NO: 159198 - RNA, 64 nt, Human
agauuuuaagcuuguuuuaauggucaaaaaauuaggacagaaauaauauggacauuuauuagua

SEQ ID NO: 159199 - RNA, 64 nt, Human
accugucugccugggcuccaagugggcaggaccaggacagaaccacaggcacacacugaggggg

SEQ ID NO: 159200 - RNA, 64 nt, Human
uagauauugacucuguguucccucuuuuacagcuggacagaaagaagucaaugucacgaaauga

SEQ ID NO: 159201 - RNA, 64 nt, Human
ugugccaagaggguggcgcacccccacuccauggggacagaagcuccagcauuugcccaggacc

SEQ ID NO: 159202 - RNA, 64 nt, Human
aaauuuuaucuugaaaauaaauaacaguguuugaggacagaagaaacuaggacuguuguugaga

SEQ ID NO: 159203 - RNA, 64 nt, Human
acacugugcucucuaguagcacaaggaggaaguuggacagaacauuggguagugccuugcgggc

SEQ ID NO: 159204 - RNA, 64 nt, Human
ugccagauguuucuggcuccucacguguccuucaggacagaacagaagcacaaagacucagcca

SEQ ID NO: 159205 - RNA, 64 nt, Human
ggagggccccacaucuggagcagcaccucagaguggacagaaagcauuagcguccacgagcuca

SEQ ID NO: 159206 - RNA, 64 nt, Human
aaggccacacuggcaucucccugaccuucuccagggacagaagcaggaguaaguuucucauccc

SEQ ID NO: 159207 - RNA, 64 nt, Human
gaaucgccaaaacaaaucacgagaagagagaaggggacagaacagcgagagcaaccuggaaaau

SEQ ID NO: 159208 - RNA, 64 nt, Human
uaugcaugccaaaacuguucuaggucgacugcggggacagaacaaaaaucaaaacaaagaaccu

SEQ ID NO: 159209 - RNA, 64 nt, Human
acauccuucagucccucacaucucugacagagcgggacagaauggauauuuggcugaccuuggu

SEQ ID NO: 159210 - RNA, 64 nt, Human
gaaucgcccaguggcugcuaauaccuuggacuuuggacagaauggagcuauggacguuaauuug

SEQ ID NO: 159211 - RNA, 64 nt, Human
cagacccaccccaccugcaggcccagaccacgugggacagaacuccugcccacccuaccccgag

SEQ ID NO: 159212 - RNA, 64 nt, Human
ccugaggucugcccagggcacagggcacaggcagggacagaaagccuucuccugggggagggug

SEQ ID NO: 159213 - RNA, 64 nt, Human
uccaaagacccuggcaccuggguggguuugagcuggacagaagcuuagagacaaaggcuucaag

SEQ ID NO: 159214 - RNA, 64 nt, Human
caucaugccgggacugugacagcaaagaauccugggacagaaaccuuauccuacaccauugcug

SEQ ID NO: 159215 - RNA, 64 nt, Human
acacacacagcucagacccacggacaggaccccgggacagaaccccgggagcacugcccuagga

SEQ ID NO: 159216 - RNA, 60 nt, Human
uggcacccaugacccgauaaacucuucaggggacagaagcuuuuugucuggagcugccca

SEQ ID NO: 159217 - RNA, 64 nt, Human
cuugcucacaaaguuacaggguaggcaccugucaggacagaacagcagcagcgcuacagcccag

SEQ ID NO: 159218 - RNA, 64 nt, Human
ccucacccuuucauugccgagguuccuaccucauggacagaacaaacaccucagcaaugaaacc

SEQ ID NO: 159219 - RNA, 64 nt, Human
cccaguugaugucuugaggcuguugagaaacuuaggacagaagccuaccucaucccaggccugc

SEQ ID NO: 159220 - RNA, 64 nt, Human
ccaccugguugcccaguuccuauugaugagcucuggacagaaagaugcccguuuggccaggcug

SEQ ID NO: 159221 - RNA, 64 nt, Human
caacccauggcugugauuuguugugugguaauuuggacagaaugaaaagcaugcuuuugauuuu

SEQ ID NO: 159222 - RNA, 64 nt, Human
caaccgggguagccgcgaggaaggcgcuggcagaggacagaaauguccagucaccuccgcuguc

SEQ ID NO: 159223 - RNA, 64 nt, Human
agggagaucgaaauguuagguaaucauuuagaaaggacagaaaauauuuaaaguggcucauagg

SEQ ID NO: 159224 - RNA, 64 nt, Human
ccuuccuaacaguccgcccuacuucccccgcuuuggacagaaaaucacugugcugaucgggaag

SEQ ID NO: 159225 - RNA, 64 nt, Human
ccacucccgugaugaaacagcuagguuaauaggaggacagaaccaacgggucugugggacuggc

SEQ ID NO: 159226 - RNA, 64 nt, Human
uggaccccugagagcuucugaucccagcuauuagggacagaagaagccuccaaaucuggaaggu

SEQ ID NO: 159227 - RNA, 64 nt, Human
aauuauuuauucaugggagauaauuuauuuuaaaggacagaauuaccaagcguuacaaaaucag

SEQ ID NO: 159228 - RNA, 64 nt, Human
cacaggaaagagaaaaagaaaucuguugaagaaaggacagaagaggaaaugcuuugggaugagu

SEQ ID NO: 159229 - RNA, 64 nt, Human
cugucccggugagcucuguugucagaggcucacgggacagaaccacaugcuagggucuagggcc

SEQ ID NO: 159230 - RNA, 64 nt, Human
agagagggugaguccuccagaacucuuccuccaaggacagaaggcuccugcccccauaguggcc

SEQ ID NO: 159231 - RNA, 64 nt, Human
uuagcauggcuucacacuguuuguguagccaagaggacagaauuacaugaaugacagugcccag

SEQ ID NO: 159232 - RNA, 64 nt, Human
cuacuugcucuaugagccuuuugccagccucagaauaggcgagguaaccuugaauuucagggcc

SEQ ID NO: 159233 - RNA, 64 nt, Human
gcugucgcuggccauccauucagucgauucagucauaggcgaaucuguucugcccgaggcuugu

SEQ ID NO: 159234 - RNA, 64 nt, Human
aggaccguuccaacagcauucacugccaguucuaauaggcgaggaaaaugcccgaggcgcuguc

SEQ ID NO: 159235 - RNA, 64 nt, Human
uuuuugguagcguccacaauguuuaaaauauuucauaggcgagauccguguucuccauuuauua

SEQ ID NO: 159236 - RNA, 64 nt, Human
ugagaguuuuggaugcagugcucgcuguugcugaauaggcgaucacaacgugcauugugcuucu

SEQ ID NO: 159237 - RNA, 64 nt, Human
cggcaccagauguaccaguuuucugcaguuccuuauaggcgaagggaaccggguggaaaccaag

SEQ ID NO: 159238 - RNA, 64 nt, Human
ccugcuugaugccgcggugagggacggcgcccacauaggcgagguugagcugcuggucccagcu

SEQ ID NO: 159239 - RNA, 64 nt, Human
uucuacugccucagccucccgaguagcugggauuauaggcgagugccaucaugcccggcuaauu

SEQ ID NO: 159240 - RNA, 64 nt, Human
auugaugacagaauuucuggauaguaggauuuuaauaggcgagcaaauaaaauucaaaucaauu

SEQ ID NO: 159241 - RNA, 64 nt, Human
aggaauuccuugaaacgcccacgugauguagaucauaggcgagaugauccuuacuggagcgaga

SEQ ID NO: 159242 - RNA, 64 nt, Human
caagccacccagcccagcuucuuuccauuccuugauaggcgaguauuccaaagcugguaucgua

SEQ ID NO: 159243 - RNA, 64 nt, Human
uggaauugugugaucagaagguggaauucuagugauaggcgaccucagacccgcauucauguuc

SEQ ID NO: 159244 - RNA, 64 nt, Human
uauauaccuacacgcacgcaagagacgcggagagauaggcgaugcagacucgcgauucaaugau

SEQ ID NO: 159245 - RNA, 64 nt, Human
cauuuaacagaagggaaacugaggcucggcaagcauaggcgaguuggcaguggaacacggaucu

SEQ ID NO: 159246 - RNA, 64 nt, Human
acaaguagcuccccccacgacaugucucccuuucuuagaauauauuaaagucagagucucugag

SEQ ID NO: 159247 - RNA, 64 nt, Human
gcacuagaauuuuuggucaaaagucaaaauaguauuagaauauugaaauuauugauagcuuuca

SEQ ID NO: 159248 - RNA, 64 nt, Human
guuuuccccuuacagaaaccacagaaauauucccuuagaauaaaauaguauauuuguauuugau

SEQ ID NO: 159249 - RNA, 64 nt, Human
ggaaaacauccugugcagaaaaggguauauaauuuuagaauaccugaaggcuucuuggcuuuuc

SEQ ID NO: 159250 - RNA, 64 nt, Human
auguguuucuuuguugaacuuuguguguguguguuuagaauauaacagacauaagaaaaaauua

SEQ ID NO: 159251 - RNA, 64 nt, Human
uguggaaaucccaauugcuugaauuacugauauuuuagaauagacuuuuuaaaaugccauaugu

SEQ ID NO: 159252 - RNA, 64 nt, Human
gggagucaauuucugaccaaucaaguacacuaaauuagaauauuuuuaaaguauguaacauucc

SEQ ID NO: 159253 - RNA, 64 nt, Human
gcuacuuuauuaagaagaugcuggcugcuuuguguuagaauaggacaccccgcagcuucucugu

SEQ ID NO: 159254 - RNA, 64 nt, Human
accagggaggcaacuacacaccaaccugcuggcuuuagaauaaaagcaccaacugaacugagau

SEQ ID NO: 159255 - RNA, 64 nt, Human
uuuuuuuuuaauuuuggagguuggggugcaaucuuuagaauaugccuuaaaaggccgggcgcgg

SEQ ID NO: 159256 - RNA, 64 nt, Human
agaugucguggacuccagcucuacgucccacauuuuagaauaccccaccagcagaacaaacuca

SEQ ID NO: 159257 - RNA, 52 nt, Human
augagaaaccaccacaguagcuuuagaauagaugcggucauauucuucuuug

SEQ ID NO: 159258 - RNA, 64 nt, Human
cauaaguacuuuuacaaguugucccaguguuuuguuagaauaauguaguuaggugaguguaaau

SEQ ID NO: 159259 - RNA, 64 nt, Human
cuuacacauuuccucuuuuggaaaaaugagauacuuagaauaacaagaaaauuaagacauacug

SEQ ID NO: 159260 - RNA, 64 nt, Human
uuucuucauuuuaauccuuuucaaguggaauggcuuagaauaaguauacacuugaaaucuccuc

SEQ ID NO: 159261 - RNA, 64 nt, Human
auuuuacucugucccaguuugaaacuuaaaacucuuagaauauucucuuauuauuuauauuuuu

SEQ ID NO: 159262 - RNA, 64 nt, Human
ucauuucgacaaacaagcacuguaauuauagcuauuagaauaaaaucucuuaacuauuucaccg

SEQ ID NO: 159263 - RNA, 64 nt, Human
auaaaaaguugggauauuaacuuguuuuugcacuuuagaauagcaugagaaucucacuaauuua

SEQ ID NO: 159264 - RNA, 64 nt, Human
guuuagguguacacauuuacccaguugagcguucuuagaauaacuacugcacaaguugacaaua

SEQ ID NO: 159265 - RNA, 64 nt, Human
uaagcaucuguuagucagcucagaaacacccaucuuagaauaugaaaaauaacacaaugcuuga

SEQ ID NO: 159266 - RNA, 64 nt, Human
ggacaugcuccuaacuccuuucccauuaaagguguuagaauagaccagagggugucccuuuucc

SEQ ID NO: 159267 - RNA, 64 nt, Human
uuacaugauaaucaauuagccaaccaugagucauuuagaauagugauaaauagaauacacagaa

SEQ ID NO: 159268 - RNA, 64 nt, Human
uaaaguuuugcaacauuaaauaagugacuugguguuagaauauugccuaaaccaguuuucuauc

SEQ ID NO: 159269 - RNA, 64 nt, Human
caauuuauuaguuuucucaguauuuucccaaauauuagaauauuuacuucauuauugguuggcu

SEQ ID NO: 159270 - RNA, 64 nt, Human
aaauguaauuaauaaacaaugcucacuacacaguuuagaauagacguucucauuuauauuaucu

SEQ ID NO: 159271 - RNA, 64 nt, Human
gcaggcagagcuuugauaacucuccagagaaccuuuagaauaucuuuucaaguuuccccagcuu

SEQ ID NO: 159272 - RNA, 64 nt, Human
acuggaauauuaagaaaaugagaaauuauauuuauuagaauaaaaugugcaaauaaugacaauu

SEQ ID NO: 159273 - RNA, 64 nt, Human
agaaaaucuuuaggcuuucaaaauaaggaugacuuuagaauaauauugugucauagaauuaauu

SEQ ID NO: 159274 - RNA, 64 nt, Human
agcuucuacccuuugucccuguagccuauacaguuuagaauauuuauuuguuaauuuuauuaaa

SEQ ID NO: 159275 - RNA, 64 nt, Human
ggagagagaagaaaagaaaaaugaagaaaaguaauuagaauauuuucaacauaaagaaaagacg

SEQ ID NO: 159276 - RNA, 64 nt, Human
uuuuuucuuuuugguauuuuacauuauucacauuuuagaauaacaagaacaccaagaauuaccc

SEQ ID NO: 159277 - RNA, 64 nt, Human
guggcugacuuuuguguaagaaucauaguuugcuuuagaauacaaaucuuuaagucauuuuaac

SEQ ID NO: 159278 - RNA, 64 nt, Human
caagagccccugccccucuguuggaggcacaguuuuagaauaaggaggaggagggagaagagaa

SEQ ID NO: 159279 - RNA, 64 nt, Human
auuuuuuuacugagaacuuuaaauuaguccccuauuagaauaggguugcuacucaucuuuuuuu

SEQ ID NO: 159280 - RNA, 64 nt, Human
uucacuuaaaguaagcauuuuuaaaggauuuauuuuagaauacaaucuaugcaauccucgaacu

SEQ ID NO: 159281 - RNA, 64 nt, Human
augaacucuggugugcaugcuauuauugcugcaauuagaauauuaucacacacaaaggucucua

SEQ ID NO: 159282 - RNA, 64 nt, Human
ucugucguuuguggugcugugauggugucuacuguuagaauagcuuuucuggagguggguggca

SEQ ID NO: 159283 - RNA, 64 nt, Human
guuaaguuucuuuaccuuaagauucagaaauacuuuagaauauuauuaauuuuaaguccugucu

SEQ ID NO: 159284 - RNA, 64 nt, Human
auuuauuaaucugaagauuaaccauuuuuuugucuuagaauaucaaaaagaaaaagaaaaaggu

SEQ ID NO: 159285 - RNA, 64 nt, Human
uauaucuguaaauaacuuagcaccuuuuugucacuuagaauaauauguacuacuacuugaguga

SEQ ID NO: 159286 - RNA, 64 nt, Human
auauuaucauacucagauaaccaaauuaaaagaauuagaauaugauuuuuaauacacuuaacau

SEQ ID NO: 159287 - RNA, 64 nt, Human
auguagagggguugguagcagacaggugguuacauuagaauagucacacaaacuguucaguguu

SEQ ID NO: 159288 - RNA, 64 nt, Human
gucaaucuacacuuuuuucucauguucuaaagucuuagaauacugcuggauuguugagcaugag

SEQ ID NO: 159289 - RNA, 64 nt, Human
cagauuguuauaaauuguugagaaauuuuugugauuagaauaugaaggaaaaagcuuuguuggu

SEQ ID NO: 159290 - RNA, 64 nt, Human
uauaauuaaaaguaaggaacauuagaggauuuaauuagaauaaauacauguuuuggaaauacag

SEQ ID NO: 159291 - RNA, 64 nt, Human
uuuuuuuacaauuauuacaacacuaaagagaaguuuagaauauagagaguuuuuaaaugucucc

SEQ ID NO: 159292 - RNA, 64 nt, Human
ccuuuaugucguuggauaccuguauucuugacaguuagaauauugguagggacuuuguuaaaau

SEQ ID NO: 159293 - RNA, 64 nt, Human
ucuaauuuuuauuaauuuguaagaguaagcaccuuuagaauauuaaaaauuaauucuuuaucac

SEQ ID NO: 159294 - RNA, 64 nt, Human
gaauacucacacuaaauuaaauucaaauuucauuuuagaauaaguuaacuaaaucagucuaaua

SEQ ID NO: 159295 - RNA, 64 nt, Human
gacacaagggaacaguauuugcauuuguacugucuuagaauauuauuuauuuuuuuguauuugu

SEQ ID NO: 159296 - RNA, 64 nt, Human
gcucauuacucuaccaccaagaaccuaaaaggaauuagaauacagcagaauuggccucagugaa

SEQ ID NO: 159297 - RNA, 64 nt, Human
auuucaaauugucugguacuauuggaacaaauauuuagaauaaaaaaauuucccagucggaacu

SEQ ID NO: 159298 - RNA, 64 nt, Human
gaauuaaaaggcuugcaacuuuuucaaaaaccuguuagaauaugcuuuauuguguuuugaggag

SEQ ID NO: 159299 - RNA, 64 nt, Human
cauuuacuuacuaaagauugaggauucggaauauuuagaauaaauuaguuuucugcuuucuaau

SEQ ID NO: 159300 - RNA, 64 nt, Human
ggaaauuggcccuggcccuucaagauagccuucuuuagaauaugauuuggcuagaaagauucuu

SEQ ID NO: 159301 - RNA, 64 nt, Human
auauauguaaaguuuccaguacuagucccagaauuuagaauaugcucaacacaaaguaaacagc

SEQ ID NO: 159302 - RNA, 64 nt, Human
caagaagcauuccuuacauuaguagcaauaaauauuagaauaaauaugaaauugaacuauuuuc

SEQ ID NO: 159303 - RNA, 64 nt, Human
uuaauaaagaaauugcauuuauaaaugaucuguauuagaauauaauaaaucuccaguuauaguc

SEQ ID NO: 159304 - RNA, 64 nt, Human
acucgaagugaaaugguuaaaaauauuuauccuguuagaauaggcugcaucuuuuuaacaacuc

SEQ ID NO: 159305 - RNA, 64 nt, Human
uccccaccccaaucuaaauauggaauuugguaaauuagaauacuuuguaauuuguaagaccaaa

SEQ ID NO: 159306 - RNA, 64 nt, Human
gcuuuccugauaccagacuguuucccgugguugguuagaauauauuuuguuuugauguuuauau

SEQ ID NO: 159307 - RNA, 64 nt, Human
uuguguugccaccacuucuaaaaauuuagcaauauuagaauaggauacuagugaaguaagaaau

SEQ ID NO: 159308 - RNA, 64 nt, Human
acccuaauaggugaugcagauaauagccuacuucuuagaauaugccuguccaaaauugcagacu

SEQ ID NO: 159309 - RNA, 64 nt, Human
gagcugguuuugcuuauggucaugcugcaauuuguuagaauaauagggaucaaguuuuaaaucc

SEQ ID NO: 159310 - RNA, 64 nt, Human; identical to SEQ ID NO: 159289

SEQ ID NO: 159311 - RNA, 64 nt, Human
uguacuaguuacuaugaaaauggaaauaauuaucuuagaauauuuucaaaguagagcgugagca

SEQ ID NO: 159312 - RNA, 64 nt, Human
auccauucuagaaaaauauaucuaaaguauugcuuuagaauaguuguuccacuuucugcugcag

SEQ ID NO: 159313 - RNA, 64 nt, Human
aaugugaguaaauugaaaccaagaaaacuuguuuuuagaauauuucgucugaauaaguacagua

SEQ ID NO: 159314 - RNA, 64 nt, Human
caugguaauucauuaaaauugccuuaguaauauauuagaauauacaaauauguguguauaaaau

SEQ ID NO: 159315 - RNA, 64 nt, Human
cuugcuaauuauuuuaaacacuuuaauguugguauuagaauauuaucuucauaaguuaauaaau

SEQ ID NO: 159316 - RNA, 64 nt, Human
uuacugugaaaaagcauuuuaaaaagaaaagguuuuagaauaugaucuauuuuaugcauauugu

SEQ ID NO: 159317 - RNA, 64 nt, Human
uucagauuauuggagacuaauucuaauguggaccuuagaauacaguuuugaguagaguugauca

SEQ ID NO: 159318 - RNA, 64 nt, Human
caauaacucuuuguguuuauggaguguuguuuucuuagaauaauggagaugcagauauagauac

SEQ ID NO: 159319 - RNA, 64 nt, Human
guauggccaguuauucaucuaacuggacucaaucuuagaauaguaggaacauuauacccaguuu

SEQ ID NO: 159320 - RNA, 64 nt, Human
gcugucuuugcuuggcauuuuauaguuaaauuaauuagaauaugugguuuuaugcauaacgugu

SEQ ID NO: 159321 - RNA, 64 nt, Human
auauuccuaacacuuuguucacuagcauuuaaguuuagaauaagcccaaguaagacaauggaaa

SEQ ID NO: 159322 - RNA, 64 nt, Human
aaucauauuucuuaggaaguauaggcuacuggacuuagaauaaaaaguccccaaacccaaacaa

SEQ ID NO: 159323 - RNA, 64 nt, Human
ucaugaaaccugggaauccaaauaguuggauaacuuagaauaacuaaguuuauuaaauucuaga

SEQ ID NO: 159324 - RNA, 64 nt, Human
gcuaguuuaggucucuauagaagcccuauauaauuuagaauaugcccacugaauaucuuuaaua

SEQ ID NO: 159325 - RNA, 64 nt, Human
auauauauauugguaagagagacugcccauguguuuagaauagaauuuuuuaaaugaaaugauc

SEQ ID NO: 159326 - RNA, 64 nt, Human
uguccuguuauuuuuuauuuccacauaaagguauuuagaauauauuaaaucguuagaggagcaa

SEQ ID NO: 159327 - RNA, 64 nt, Human
auuaguuauuauaagaagaucuagauccuagauauuagaauaaaauuuauuuucuacuguaucc

SEQ ID NO: 159328 - RNA, 64 nt, Human
uagcacuuaaacuaguucauuucaaaauuaagcuuuagaauaaugcgcaauuucauguuaugcc

SEQ ID NO: 159329 - RNA, 64 nt, Human
uuuaauuguuuaaaaauuguacaaaaggaaaaaauuagaauaaguacuggcgaaccaucucugu

SEQ ID NO: 159330 - RNA, 64 nt, Human
ugagguguagagauguuauuaagaaguuuugauguuagaauaauugcuuuuggaaaauaccaaa

SEQ ID NO: 159331 - RNA, 64 nt, Human
gagcucuucugaacuguguccuuuuaauuuuugcuuagaauagaauggaacaaguuuaaauuuc

SEQ ID NO: 159332 - RNA, 64 nt, Human
ggaagauuaaggauaaucaauugacuaauuucauuuagaauauuaucaaacauuucaacuaggu

SEQ ID NO: 159333 - RNA, 64 nt, Human
ggauggcuuggacaaugaaaggaugcuguacucauuagaauacaagauuccuuuacugucccuc

SEQ ID NO: 159334 - RNA, 64 nt, Human
auacauuugacucuacagaugaaggugaacaauguuagaauaaaauugcuuuggaucuugccug

SEQ ID NO: 159335 - RNA, 64 nt, Human
augugggcuuuugcugacuuuucaaaugcauugauuagaauaccguacuuuugguugccacaga

SEQ ID NO: 159336 - RNA, 64 nt, Human
uguaauugcaaauuauauuuuugcugcugauauauuagaauaauuuuuaaaugucaucuugaaa

SEQ ID NO: 159337 - RNA, 64 nt, Human
ccccugauacagaacuacuuuugagaugguaagauuagaauaucaugaaaguuuaaacugaauc

SEQ ID NO: 159338 - RNA, 64 nt, Human
uaaauguuuaaaauauuucaauaaagauagcauguuagaauaaaagugacuucuauuauuucuu

SEQ ID NO: 159339 - RNA, 64 nt, Human
cucaaccccaguguguauuuuuguacaucaacauuuagaauacuuauggcagauaaguaaggca

SEQ ID NO: 159340 - RNA, 64 nt, Human
caacaaaaaaagaguugagugaaucuguuuacauuuagaauaauguuuuuuucuucaagagacg

SEQ ID NO: 159341 - RNA, 64 nt, Human
uuugcuuuauucuaaauuuuguaccaaagcaacuuuagaauaaucagaauauuucaucuaacug

SEQ ID NO: 159342 - RNA, 64 nt, Human
acuuacgucauuuaaugagccugggguucugguguuagaauauuuuuaaguaggcuuuacugag

SEQ ID NO: 159343 - RNA, 64 nt, Human
auccauacuggaaucuugccauauuuuuuucauuuuagaauagauuuuggcagucucaucuuag

SEQ ID NO: 159344 - RNA, 64 nt, Human
ccacaacuuguuuuuguacuuuaagguuucucaauuagaauauuucuaguugagcuguaauuug

SEQ ID NO: 159345 - RNA, 64 nt, Human
aagauguaucaguuuuauuaaaaucaguugacaauuagaauaauaaaguggauaaaggcaaauu

SEQ ID NO: 159346 - RNA, 64 nt, Human
guuuaaauuuggggauuuuaaaucagauuauaguuuagaauauuugcguauuaauuaugggcaa

SEQ ID NO: 159347 - RNA, 64 nt, Human
aaggucuaggguugauauuaacaaaggaauguacuuagaauagcaguacauuuuaugcaaauau

SEQ ID NO: 159348 - RNA, 64 nt, Human
aagauauagugagcuguuuauuuucuaguuuccuuuagaauauuuuagccacucaaagucaaca

SEQ ID NO: 159349 - RNA, 64 nt, Human
augacaccugcagaaauguauucucugaggacacuuagaauaugaggaagaggguguggcccaa

SEQ ID NO: 159350 - RNA, 64 nt, Human
guaguuaaugaguuucucuugguacugaacacuauuagaauaucauuagugauauuuuuucucu

SEQ ID NO: 159351 - RNA, 64 nt, Human
gaaaaccaucuuaucugaagacuggacuguuguuuuagaauaguaaaaucccauauugaaggaa

SEQ ID NO: 159352 - RNA, 64 nt, Human
auuaccauaaauaacaauuucagaaacuuaguuuuuagaauaaauauuaauuuuuccacuucag

SEQ ID NO: 159353 - RNA, 64 nt, Human
ccuccuagaacuccaguaaaaguugugccucaaauuagaauagaacuugaaccugaagacaaug

SEQ ID NO: 159354 - RNA, 64 nt, Human
augcaaaggcaauuauucuuuguaagcgggacauuuagaauauauuuguguacauauuauaugu

SEQ ID NO: 159355 - RNA, 64 nt, Human
ucuuccaguugaaauaggaauuggagagaaaggauuagaauauuuuaauuaggggaguagauua

SEQ ID NO: 159356 - RNA, 64 nt, Human
uuauuuagagaaacggguaauuaaaacagcagcuuuagaauagcuucuuacugaauaugcaaaa

SEQ ID NO: 159357 - RNA, 64 nt, Human
aacaacugaaauugagagucauaaauacuguggguuagaauaaaaaccauuugccaaagcaaca

SEQ ID NO: 159358 - RNA, 64 nt, Human
ggcuccacaauaaauuuuaaugagcacuacaaauuuagaauauauaaaaauaucaguaaccuau

SEQ ID NO: 159359 - RNA, 64 nt, Human
acucaaaccucucccaucucccaacaacugcacuuuagaauaccagcagugaaaugguauuacu

SEQ ID NO: 159360 - RNA, 64 nt, Human
aaaaccaauuuccugauggacuauuaaauucaucuuagaauaaauuagugaagaauuuaauuuu

SEQ ID NO: 159361 - RNA, 64 nt, Human
uucaucuuagaauaaauuagugaagaauuuaauuuuagaauaaauaauccaaucugaaauaauu

SEQ ID NO: 159362 - RNA, 64 nt, Human
gggcacuaaccucaacagauuauuccuccucuccuuagaauaaccaugaaaauacaaauuuacu

SEQ ID NO: 159363 - RNA, 64 nt, Human
ucaaucuauuauuucuuagaaacaauuuacuagcuuagaauagaaagcaauguuaucgucauau

SEQ ID NO: 159364 - RNA, 64 nt, Human
aacuucugcaaaauuccguaaugguguauuaguauuagaauagugaauaaaaugggaaaguuau

SEQ ID NO: 159365 - RNA, 64 nt, Human
aagcauuuugcucuuuuuaagaacagcaugaaauuuagaauaccaaugauagcuaucuuuaaga

SEQ ID NO: 159366 - RNA, 64 nt, Human
agugcauuguuuuuucuaccugcuugucuuauuuuuagaauaauuuagaaaaacaaaacaaagg

SEQ ID NO: 159367 - RNA, 64 nt, Human
auuugguacuuguaaauagcacuaguuagacucuuuagaauacuccaagaguuagggcagcaga

SEQ ID NO: 159368 - RNA, 64 nt, Human
agguuauaauauacaauuagcauuuuucuaauuguuagaauaucugucaauuaagcaucaugac

SEQ ID NO: 159369 - RNA, 64 nt, Human
cacccuggagaauguccaccuuguguucagaugcuuagaauaaaaugucacuguaagaucacaa

SEQ ID NO: 159370 - RNA, 64 nt, Human
guguaccccauuugguuucaccaggaacccaaauuuagaauauugaaaagccaucaaaaaguug

SEQ ID NO: 159371 - RNA, 64 nt, Human
auagaacaaaagaggauuaguagaaaauacauuauuagaauauaaaaaauguuauuacugagga

SEQ ID NO: 159372 - RNA, 64 nt, Human
gggguagggauuuggcuaugccuucacuacaacauuagaauauuguaacucacaugccuucuaa

SEQ ID NO: 159373 - RNA, 64 nt, Human
uauuauuauuauaaaaaaugugugaauaucaguuuuagaauaguuucucugguggaugcaauga

SEQ ID NO: 159374 - RNA, 64 nt, Human
augacuuuauuuuauuuuuauuuccugcauaccauuagaauaauuuuauuucauuucuucaaau

SEQ ID NO: 159375 - RNA, 64 nt, Human
aagaagcaacuuugaaguuaccucaucuuugaauuuagaauaaaaguggcacauuacauaucgg

SEQ ID NO: 159376 - RNA, 57 nt, Human
auaggauagaggaguguuaauggucacuuagaauaaaauaguuuccuuuucaugaua

SEQ ID NO: 159377 - RNA, 64 nt, Human
ugaacuuaggauguguuuuuuauucaugaaaaacuuagaauagugaacuauuaauauuuaaaaa

SEQ ID NO: 159378 - RNA, 64 nt, Human
gacuuuaaugauuuggaauacuaaauuuaauuguuuagaauauuaaguuuuccucugugcaaau

SEQ ID NO: 159379 - RNA, 64 nt, Human
ugcuggaaacaaaucauuugcuuuauauguuucauuagaauaccaaugaaacauacaacuugaa

SEQ ID NO: 159380 - RNA, 64 nt, Human
uucagguagucugaguaauagauuguuuugccacuuagaauagcauuugccacuuaguauuuua

SEQ ID NO: 159381 - RNA, 64 nt, Human
auguaaaauuugucaucuuuuucuuuucuuuuuuuuagaauagcugauauuuugauaacaaucu

SEQ ID NO: 159382 - RNA, 64 nt, Human
uaugaaggaaauaucugcuuuguguauaugccaguuagaauacugguuucuaaagucugucaaa

SEQ ID NO: 159383 - RNA, 64 nt, Human
cuggaauauauuuuucuuuuaauuuccagugacuuuagaauacacacaguuuuuccgacuuuuc

SEQ ID NO: 159384 - RNA, 64 nt, Human
ccucuguggcuguguuugaaaaaauaaaguuuuauuagaauaauccauuuucccaagcaaccuu

SEQ ID NO: 159385 - RNA, 64 nt, Human
caagggcugugcuccugcucccagcagcccucucuuagaauauuucagauggaugagcuucuga

SEQ ID NO: 159386 - RNA, 64 nt, Human
acuaaacagacuauuuaacuugaggguaauaaacuuagaauaaaauuguaaaauuguauagaga

SEQ ID NO: 159387 - RNA, 64 nt, Human
aguuuauuucuaagguauaacgucuuugaugcuuuuagaauaagaacagugucaaaucaucugu

SEQ ID NO: 159388 - RNA, 64 nt, Human
ugcucagaauccacaagucacggucuaaacacacuuagaauacuacagcauaaaucuguuagca

SEQ ID NO: 159389 - RNA, 64 nt, Human
ccauuuaauuuuuaagagaaggugaagguaacuauuagaauauaauauuugaagcagcucugcc

SEQ ID NO: 159390 - RNA, 64 nt, Human
uuacggaaaccuuuuaaagauccacauuagccuuuuagaauaaagcugcuacuuuaacagagca

SEQ ID NO: 159391 - RNA, 64 nt, Human
gaauagauuauuaaaacugaacuugaagcuaacguuagaauagugguuaacagagcuaagaaau

SEQ ID NO: 159392 - RNA, 64 nt, Human
cucaugcuggcuggguccuuagcccggcacuccguuagaauaaaccugggccuucgggaaaaga

SEQ ID NO: 159393 - RNA, 64 nt, Human
gucaugcuauuuaaauuauaauucuccacuguguuuagaauaacaucugagguucuuaaccugg

SEQ ID NO: 159394 - RNA, 64 nt, Human
aagaaauaacuuugaagggaaaaaagucauuagcuuagaauaugaagcauaucuacccauggcg

SEQ ID NO: 159395 - RNA, 64 nt, Human
aggaaagaaaucuaguauuauuuguugaaaaugguuagaauaaaacuaugacucuauaagguuu

SEQ ID NO: 159396 - RNA, 64 nt, Human
uuaugaacugaaauuuuaaucaaaagaggucauuuuagaauaacaaguauuauucuuuuuuagu

SEQ ID NO: 159397 - RNA, 64 nt, Human
uggugcuguuaauaauaauuugcuaaaaggccuuuuagaauauuucauaaaggguuuuaaacag

SEQ ID NO: 159398 - RNA, 64 nt, Human
auuacauaauaauuuuguggaagcauuuugcccuuuagaauaaauauuagauugauauagcuga

SEQ ID NO: 159399 - RNA, 64 nt, Human
uugcauaguguagucaucuauuauuauuguuuaauuagaauauuaaacccuacccuuuaacuca

SEQ ID NO: 159400 - RNA, 64 nt, Human
agccuggccuuucuccaagcaaauuauugaacuauuagaauauguuaguuaucauccuuguguc

SEQ ID NO: 159401 - RNA, 64 nt, Human
gaguuucuugugcauuacuccucucccuccuucguuagaauagguauaucagcuguguaaauag

SEQ ID NO: 159402 - RNA, 64 nt, Human
acucagucuugauaacugaaaugacuuauuucacuuagaauacauuucucccuucucugccauc

SEQ ID NO: 159403 - RNA, 64 nt, Human
acugaaaacauugaugugauucuugaaagggaauuuagaauauguuaaggccaaguagguuaac

SEQ ID NO: 159404 - RNA, 64 nt, Human
aacauaugacacuucaucuuauauuaaggaagguuuagaauaucuaauacgacuugaauucauu

SEQ ID NO: 159405 - RNA, 64 nt, Human
uucuguucaaaucaugaaaaaagacuauuuccccuuagaauagggaagcuugcuauuuuaaagc

SEQ ID NO: 159406 - RNA, 64 nt, Human
ugaacacccugacugcauuuuugcuuuuagaaaguuagaauaaauauggcgcuuugggaucaca

SEQ ID NO: 159407 - RNA, 64 nt, Human
agcuuguuaucagcuuucagggccaugguucacauuagaauaaaagguaguaauuagaacacuc

SEQ ID NO: 159408 - RNA, 64 nt, Human
cuggaaugcagaaaacauuuuaaaggcuagauuuuuagaauauucucaacuagcauucuuucca

SEQ ID NO: 159409 - RNA, 64 nt, Human
ugaaaccaugacugggcccacugucagacagaaauuagaauaggaggcacauuuuuuaccuggu

SEQ ID NO: 159410 - RNA, 64 nt, Human
uuuuauguuuauaaaguguaauuuuuagguucacuuagaauauauuuuauuuaauaaguuaaaa

SEQ ID NO: 159411 - RNA, 64 nt, Human
uuucccuuguagaaagugaggcucagauuaaauuuuagaauauuuucuaaaugucuuuuucaca

SEQ ID NO: 159412 - RNA, 64 nt, Human
caaaagcaaacuaguccaguuuaauuuuuuguacuuagaauauugcacauuuucuauauaugag

SEQ ID NO: 159413 - RNA, 64 nt, Human
cugcagcagcuugccucaugguuuucccuuuuucuuagaauauuuauucuucagagguaacaug

SEQ ID NO: 159414 - RNA, 64 nt, Human
aacuaaugaauaaucaaaauaauuucaucaacuuuuagaauauuuuauguugcuugcacuauag

SEQ ID NO: 159415 - RNA, 64 nt, Human
agguguuuguuuucuccagaauaaagguauuacuuuagaauagguauucuccucauuuugugaa

SEQ ID NO: 159416 - RNA, 64 nt, Human
augcugacauaauucuaaggaguuuuguuguauuuuagaauaaaauuauaaaguaaaaugauuc

SEQ ID NO: 159417 - RNA, 64 nt, Human
cuguccugcccgggaugcacuuuuaaaugaagaguuagaauauuuuauuggcuaauauacuuuu

SEQ ID NO: 159418 - RNA, 64 nt, Human
uuccaaucugauauaaacuaaaagggauaauauuuuagaauaugggcuuauaugugguuuuuuu

SEQ ID NO: 159419 - RNA, 64 nt, Human
ccccuggcuaugguuuuuguucuuauaacagaguuuagaauaucagagcauuucuugaaucaua

SEQ ID NO: 159420 - RNA, 64 nt, Human
gccuuauucaugaggcuuagaaaacacaaagacauuagaauaccuagguucacuggggguguau

SEQ ID NO: 159421 - RNA, 64 nt, Human
acuauuuacauaucugcauuuaaaaaagcaauucuuagaauacuuccuuuacauuauucuccua

SEQ ID NO: 159422 - RNA, 64 nt, Human
ucugcccaauuauuuuuugagcuacacuuguguuuuagaauaucuguuucuguaauauugagag

SEQ ID NO: 159423 - RNA, 64 nt, Human
aagcugcucuuuauaauaugcaccuuuuaaaaaauuagaauauuuuacugggaagacguguaac

SEQ ID NO: 159424 - RNA, 64 nt, Human
aacucuugcugauacgcgauauugauucucauuguuagaauauggagaguguuucagccucguc

SEQ ID NO: 159425 - RNA, 64 nt, Human
ccagaaucauuguugaacuaccugaaacaagucuuuagaauacuaaauauaaugcuguugucuc

SEQ ID NO: 159426 - RNA, 64 nt, Human
uuuucugggguguaccaaaaacauuugaauagguuuagaauagcuagaauaguuccuugacuuu

SEQ ID NO: 159427 - RNA, 64 nt, Human
gccucuccaguucucaugcacccugaucuuaggguuagaauacuugacccugauaccugcacca

SEQ ID NO: 159428 - RNA, 64 nt, Human
cuaauguauaacauguuaauggaaaaaaauggauuuagaauaauaaauggauuuuaaacuaucc

SEQ ID NO: 159429 - RNA, 64 nt, Human
aguaacaucauaagauaguuacauuuaugugcuguuagaauauguugauuuuuaucaggcuuuc

SEQ ID NO: 159430 - RNA, 64 nt, Human
uaugaguuucuugauauguaagaugaaaaagcauuuagaauaaucuuuuaauuuguguauauuu

SEQ ID NO: 159431 - RNA, 64 nt, Human
uuauuugccaucaucuugaacacaaaauguguauuuagaauauuuguauaacuguguaaaauaa

SEQ ID NO: 159432 - RNA, 64 nt, Human
acccauaaacaggucagaagaaugauggaauguuuuagaauaaacuccugcuuauaguauacua

SEQ ID NO: 159433 - RNA, 64 nt, Human
guaucccaaguagucugguaugaucugugguuccuuagaauauugaggaucucuuuaaaaaaug

SEQ ID NO: 159434 - RNA, 64 nt, Human
aaugaaguagagaaauguuaaauauuuuaugaguuuagaauauaguaaauaaaaggugauguaa

SEQ ID NO: 159435 - RNA, 64 nt, Human
cucuaucuccaaaaaacaaaaaagauaagcagcuuuagaauauggcgcauucaaaacagucuca

SEQ ID NO: 159436 - RNA, 64 nt, Human
uauaaaguuuuuccagauaaacuaaucaaauaaauuagaauaaugugacaacauuacaaauuua

SEQ ID NO: 159437 - RNA, 64 nt, Human
caaauacacuaauuuuccauacuuuauacuuuuguuagaauaaauuauucaaaucuaaagucug

SEQ ID NO: 159438 - RNA, 64 nt, Human
uuuuuuuuguuuuuuuuuuuuuugcuuaacaguuuuagaauacauuguacuuauacaccuuauu

SEQ ID NO: 159439 - RNA, 64 nt, Human
augcauuucccuuuccucauuacauuccacauucuuagaauaagaagugcauucaauccuagga

SEQ ID NO: 159440 - RNA, 64 nt, Human
agaaaacugagaacuaacauuaaaaaaauuaaauuuagaauaagaaugauuucuuuaauuuguc

SEQ ID NO: 159441 - RNA, 64 nt, Human
ccacacacauuagcaaaccggccucaacauauaauuagaauaaacugucuucuuguucuacuca

SEQ ID NO: 159442 - RNA, 64 nt, Human
uuuuagucuaaacagacaucuaaauuuucgagacuuagaauaacauucacuaaaguuugauaau

SEQ ID NO: 159443 - RNA, 64 nt, Human
ugaggaaaauguagagaugcucuuugugauuaacuuagaauauuaagugcuacuugagguacau

SEQ ID NO: 159444 - RNA, 64 nt, Human
ggaggcggagguucauggggaacccagcaggaaauuagaauagaaccaaaaacgccagucaugg

SEQ ID NO: 159445 - RNA, 64 nt, Human
uaaaaaaaaaucauuuacguuggaauuuuagguuuuagaauagagcugacauuaacauauauau

SEQ ID NO: 159446 - RNA, 64 nt, Human
uucaguacuacaaaaacagaauaauuuugaaguuuuagaauaaauguaauauauuuacuauaau

SEQ ID NO: 159447 - RNA, 64 nt, Human
gaauauaucuuuauacauauguaaagccaauauuuuagaauaaguauuuuaguauaaauauuuu

SEQ ID NO: 159448 - RNA, 64 nt, Human
ccacuguuuaaaaguaaaacguauuuuaacgauguuagaauaagacuaccauucuaaauaucac

SEQ ID NO: 159449 - RNA, 64 nt, Human
cuggacucuacuauugaugcagaucagagaguucuuagaauacagaauaccgaugacaaugaua

SEQ ID NO: 159450 - RNA, 64 nt, Human
cugucuggcagguaggcugggccccccagugcuguuagaauaaaaagccucgugccggaagccu

SEQ ID NO: 159451 - RNA, 64 nt, Human
auaauugugguguguugcagauuuauuuggccauuuagaauaaccaaaucaaucuggcuaacua

SEQ ID NO: 159452 - RNA, 64 nt, Human
uggacacaugaaaccuccuaaugaccuggaauuguuagaauauuugacuuuuuauaugcaaagu

SEQ ID NO: 159453 - RNA, 64 nt, Human
cgcuuuaggucagcagccucccugaagaccaaaauuagaauauccaugaccuaguuuuccaugc

SEQ ID NO: 159454 - RNA, 64 nt, Human
uaagcauuccaacuaucucauuuccaagcaaguauuagaauaccacaggaaccacaagacugca

SEQ ID NO: 159455 - RNA, 64 nt, Human
uaugugaacauccccuuggaugauuugcgguugcuuagaauaaaacuugcuacuagcaaaagaa

SEQ ID NO: 159456 - RNA, 64 nt, Human
gaaauacuuccuugcaccauuguaauaaaagcuguuagaauauuuguaaauaucuuucugcugu

SEQ ID NO: 159457 - RNA, 64 nt, Human
ugaaaaaagaaugcacgugugaguuacuaaaaaguuagaauaaugugcaugggaacagugcagc

SEQ ID NO: 159458 - RNA, 64 nt, Human
cuguuauguuaugauuuuauucuuugugaguuaauuagaauaaagucauuuucuuccaagguau

SEQ ID NO: 159459 - RNA, 64 nt, Human
uccuuuaaauuucagcuuuggcucuggcugcuuuuuagaauaaugcaagauaaaaaucacaccu

SEQ ID NO: 159460 - RNA, 64 nt, Human
guuaucuaauagggcaauuaauuccuucagcacuuuagaauaugccuuguuucauauuuuucau

SEQ ID NO: 159461 - RNA, 64 nt, Human
aauuaucuccuaauuguauguuagaauaauuuuauuagaauaauuucauacugaaauuauuuuc

SEQ ID NO: 159462 - RNA, 64 nt, Human
gugaugaauaaaauaauuaucuccuaauuguauguuagaauaauuuuauuagaauaauuucaua

SEQ ID NO: 159463 - RNA, 64 nt, Human
aaaauuauuauuuuacuuuuggaagacaagauuauuagaauauugaagaaaaauuggagacuua

SEQ ID NO: 159464 - RNA, 64 nt, Human
acuuaaauuugguuuuguuuuuucuuuuuugcuguuagaauaauuucagacccaauaaggaauu

SEQ ID NO: 159465 - RNA, 64 nt, Human
uguuguuacuguauuauauuugaaaaccuucaaauuagaauacauuguacaguuaaagaaauug

SEQ ID NO: 159466 - RNA, 64 nt, Human
ugggaaaauguaaaagcagggauaucagugggcauuagaauaaaaacuagggauacaauaacuu

SEQ ID NO: 159467 - RNA, 64 nt, Human
uugaguccaguauaauucauguaaauguuaacaauuagaauaauacucuguaugcuuuuuugau

SEQ ID NO: 159468 - RNA, 64 nt, Human
gucuugugcugacuuucuccuguccucuuccaguuuagaauaagacaggggagaaaaaggcuuu

SEQ ID NO: 159469 - RNA, 64 nt, Human
cucaaacacucauacuggguuccacaauccacuguuagaauaccuaugguuagggcuucugaac

SEQ ID NO: 159470 - RNA, 64 nt, Human
uaagauuauguaaccuagcuacuuugggauggucuuagaauauuuuucugauaacuuguuccuu

SEQ ID NO: 159471 - RNA, 64 nt, Human
uauauuuuuuguuuuaacuuuuguuuuuuaacauuuagaauauuacauuuuguauuauacagua

SEQ ID NO: 159472 - RNA, 64 nt, Human
aaucaaaagugguuucaauauuuuuuuuaguugguuagaauacuuucuucauagucacauucuc

SEQ ID NO: 159473 - RNA, 64 nt, Human
agccuggauuugauauuacaaauuuugggaaaucuuagaauaaagaacgagaacaaggaaguca

SEQ ID NO: 159474 - RNA, 64 nt, Human
gguguguagcaaaguccacauguaaauuuauagcuuagaauauucuuaagucacugucccuugu

SEQ ID NO: 159475 - RNA, 64 nt, Human
guaugaaaguacaaaaagucuaguuacaguggauuuagaauauauuuauguugaugucaaacag

SEQ ID NO: 159476 - RNA, 64 nt, Human
aacaaauauugcuaugggaguuaucuuuuuagauuuagaauaacuguuccaaugauaauuauua

SEQ ID NO: 159477 - RNA, 64 nt, Human
cagaaguaugggucagaucaugggacauaacuucuuagaauauauauauacauauguacauauu

SEQ ID NO: 159478 - RNA, 64 nt, Human
uguauucuuauaagacgacccaggaucuacuauauuagaauagaugaagcagguagcuucuuuu

SEQ ID NO: 159479 - RNA, 64 nt, Human
cagagcaaauuugaauaauuccaugauuaaacuguuagaauaacuugcuacucauggcaagauu

SEQ ID NO: 159480 - RNA, 64 nt, Human
ugagaaguaggccagguauccucacaaagaaguuuuagaauaggguuucuuuuaaguuuuuaaa

SEQ ID NO: 159481 - RNA, 64 nt, Human
guagagcucaaaacuggauuaucaccuuagcaacuuagaauaguuugaaauagaaaaaaaguau

SEQ ID NO: 159482 - RNA, 64 nt, Human
aaaagauaacuauuuccuuuucuuguugaauaccuuagaauaguuaucccccccuuuuuuuuuu

SEQ ID NO: 159483 - RNA, 55 nt, Human
aacuggaaacgaaaaguuaauccucuuagaauaccuauaaaaagauguaaacuaa

SEQ ID NO: 159484 - RNA, 64 nt, Human
caugugcuugucuaaccauuuuuuguuuuauaaauuagaauaaaauauaguugugauaaugguc

SEQ ID NO: 159485 - RNA, 64 nt, Human
gcuguuuacacaguucucaggaggcugugguuucuuagaauaugaccaugagccauuucacaga

SEQ ID NO: 159486 - RNA, 64 nt, Human
gguaaaucauuauuuaacuuagguuuuccuaaaguuagaauagucgaauguucuuuucuuuacc

SEQ ID NO: 159487 - RNA, 64 nt, Human
cuacggaucuggaaaauacuggaaaaugugauacuuagaauacuuuggcugcuaaggaaacuuc

SEQ ID NO: 159488 - RNA, 64 nt, Human
caaagaaaauuguacuugaauuauuacuauaauauuagaauaaaaauguuuaucaauauaaaag

SEQ ID NO: 159489 - RNA, 64 nt, Human
uggacauuuuuaguguaguacuguuggcucguauuuagaauauucagcuacgacaguuuuggac

SEQ ID NO: 159490 - RNA, 64 nt, Human
gucacuauuucaucaucuugguuuuucauuuguuuuagaauaccucuucuguauuuugauaacu

SEQ ID NO: 159491 - RNA, 64 nt, Human
augcauuuggcuacaguguuuugaaacagaaaccuuagaauaggucauugguaugggcugaacu

SEQ ID NO: 159492 - RNA, 64 nt, Human
ucuaauggaaagaagguaugaguugcacugaggauuagaauaguggugcguuaguggcauuauc

SEQ ID NO: 159493 - RNA, 64 nt, Human
aaacuaucaacuguauaaagagaacaaagugauuuuagaauaaaaugcaggaaaaacuuuuuua

SEQ ID NO: 159494 - RNA, 64 nt, Human
agaaucuuuguuagauauuaggucccaucaauucuuagaauaucuaaacaucuuuguugauguu

SEQ ID NO: 159495 - RNA, 64 nt, Human
uuucacugaugcuucuaucaggucccaucaauucuuagaauaucuaagaaucuuuguuagauau

SEQ ID NO: 159496 - RNA, 64 nt, Human
uuucacugaugcuucugucaggucccacuaauuauuagaauauaagaaaucuuuauuaauguuu

SEQ ID NO: 159497 - RNA, 64 nt, Human
cagagauguuaauaucauguuuuucauguucuaauuagaauacuuuauuacuuacaaacucaga

SEQ ID NO: 159498 - RNA, 64 nt, Human
cuuugaaaaaaacucagcuuuuaguuuuuuuccauuagaauacugcaaaacccauauaucuuuu

SEQ ID NO: 159499 - RNA, 64 nt, Human
ugaggcagucugacuguccuuucuacuugaaagauuagaauauguauccaaauggcauucacgu

SEQ ID NO: 159500 - RNA, 64 nt, Human
augugauuuguuaagauucuuaaauuugggccucuuagaauaauuuugaaugagaucuaccgac

SEQ ID NO: 159501 - RNA, 64 nt, Human
uugaucccauaauauaaaucauauccuuuauauuuuagaauaucucaaauguauuccuuuuuug

SEQ ID NO: 159502 - RNA, 64 nt, Human
caggugaauacaagugaguuuaacaaagaaacauuuagaauagaucugaauguaagaacuacag

SEQ ID NO: 159503 - RNA, 64 nt, Human
uguuauaggaaacugcugaauugaauccuagcuuuuagaauauuaauaggagacucaaaguuaa

SEQ ID NO: 159504 - RNA, 64 nt, Human
aagggucuuuugcagaugguacaaauuagaacaauuagaauauaguauuuugaguucuaguagu

SEQ ID NO: 159505 - RNA, 64 nt, Human
gaaugaggagagcuagaaaaccuggaguguggcauuagaauagaacucauaucuuuuaaauaua

SEQ ID NO: 159506 - RNA, 64 nt, Human
caauccuaaaauuuauaugggaaccacaaaagacuuagaauagucagcuauccugagcaaaagg

SEQ ID NO: 159507 - RNA, 64 nt, Human
aaccuuauucuauuuaggaggaugaaguugaagcuuagaauaggugccugcuuaaugguguuaa

SEQ ID NO: 159508 - RNA, 64 nt, Human
gaauuuaugcauucccuuuaaacagaacacacuuuuagaauauccacaagcuuccuaagggucu

SEQ ID NO: 159509 - RNA, 64 nt, Human
gagaugaagaaucuuccaaggcucaugcaguugcuuagaauaaucauuacuguuauaugagaaa

SEQ ID NO: 159510 - RNA, 64 nt, Human
uugaggucuaaaugaguuaacauuuucaaagcacuuagaauagugucugagacacaagagcuau

SEQ ID NO: 159511 - RNA, 64 nt, Human
auaggccugaccuuuuaaauuccugggauaaauuuuagaauauuaaauucuucaucuuuaaagg

SEQ ID NO: 159512 - RNA, 64 nt, Human
uggcagcaugcaugcuguuucuuggccuuuucuguuagaauacuuggugcuuuccaacacacuu

SEQ ID NO: 159513 - RNA, 64 nt, Human
cuguucaugcugcuuucugcgaugugcgugucuguuagaauaggcucucuacccagcuagaaca

SEQ ID NO: 159514 - RNA, 64 nt, Human
aaaacuuuuauuuuugucuaagcaauuuuauauuuuagaauaucaucuugaaccauuauaaaac

SEQ ID NO: 159515 - RNA, 64 nt, Human
auaaaaccuguuucuguuuaugaauauuauucuuuuagaauagaauaaguacaugcugcuguaa

SEQ ID NO: 159516 - RNA, 64 nt, Human
cugcauaugaauuagacauucaucacuggcauauuuagaauaucucuaaaaggacuuguuugua

SEQ ID NO: 159517 - RNA, 64 nt, Human
aaucaacugaaagagcugugcauuauaaaaucaguuagaauaguuagaacaauucuuauuuaug

SEQ ID NO: 159518 - RNA, 64 nt, Human
aucacuuauuuuaauucuacuuauaauccacggcuuagaauauuuaaacauuguuucuauuaaa

SEQ ID NO: 159519 - RNA, 64 nt, Human
uuuccuaacuugauuagcuugagcugacagacuguuagaauacaguucucuggccacagcugau

SEQ ID NO: 159520 - RNA, 64 nt, Human
aaaaugaaaauauauguucaaagauguuuuauuuuuagaauaguuauaaaaaguauuagucuua

SEQ ID NO: 159521 - RNA, 64 nt, Human
gcccagaauaggcaagguuuuauuuucuucugacuuagaauauaagucucgccaucgucaaaga

SEQ ID NO: 159522 - RNA, 64 nt, Human
gucaucugcugucauggauuuuucaauaaugaauuuagaauacaccuguuagcuacaguuaguu

SEQ ID NO: 159523 - RNA, 64 nt, Human
aagucuuagggcuuccagggguccccuggaagcuuuagaauauuuauggguuuuuuuucaaaua

SEQ ID NO: 159524 - RNA, 64 nt, Human
agccugaaauaaugggaguuuucuccuccacuuauuagaauaaggacccucagugacuaauuau

SEQ ID NO: 159525 - RNA, 64 nt, Human
guuaauuuuuaaaaugguagcgcuuuguaugcauuuagaauacaugacuaguaguuuauauuuc

SEQ ID NO: 159526 - RNA, 64 nt, Human
caguuaauuuauaauguuuaauaauauuauacuuuuagaauauuuuguuuaaauaucagauagu

SEQ ID NO: 159527 - RNA, 64 nt, Human
agauuaaaaccuuagaggugauuuuuccaguuucuuagaauauaaugacauaacugugugcuau

SEQ ID NO: 159528 - RNA, 64 nt, Human
augccaaagugauagagaugaaucaugucaguaguuagaauaacauuucaacuguuuucuuugc

SEQ ID NO: 159529 - RNA, 64 nt, Human
ugcucuuuugaaauuacucuaaguaauccauguguuagaauacagaugaaccuccguuugauuu

SEQ ID NO: 159530 - RNA, 64 nt, Human
acugaauacaguguuuucaauuuguacagaauaguuagaauauucuauuaaaguggugaaacau

SEQ ID NO: 159531 - RNA, 64 nt, Human
gguacaguucuuuguacagaaaggcaccauuauguuagaauaaauuuccagaacuuagugggaa

SEQ ID NO: 159532 - RNA, 64 nt, Human
ccaaaagagcagucgucuuucauuuuggcagaccuuagaauaucccccuagcuuaauaaaucuu

SEQ ID NO: 159533 - RNA, 64 nt, Human
auuuuucccuugguggcugcccuguggaaacaguuuagaauauuuguuuuguguguaggaaccu

SEQ ID NO: 159534 - RNA, 64 nt, Human
ggggccacaguugccuuauauguaaaugaaguguuuagaauaaaauaguuaaauuuccuuauuu

SEQ ID NO: 159535 - RNA, 64 nt, Human
uucuugagaaaaaacaaaccaaccugugugaauuuuagaauacggaacagaccuaugcucuaag

SEQ ID NO: 159536 - RNA, 64 nt, Human
cuccagcucagaacccagggcucugccccagucguuagaauauaggucucuucucccagaaucc

SEQ ID NO: 159537 - RNA, 64 nt, Human
auguauguaaaauuuucguauuuuguaaaaacccuuagaauaaauuaucauuugauuuaaauug

SEQ ID NO: 159538 - RNA, 64 nt, Human
aaacaaauacuugacucagugauacucaugaccauuagaauagucauaccuggaaugugucaaa

SEQ ID NO: 159539 - RNA, 64 nt, Human
gcuuuugguauuucauuguuaccaaguucuauuuuuagaauaaaauuguucuccuucuaaaagu

SEQ ID NO: 159540 - RNA, 64 nt, Human
gacauuuuuauacuaaaacaaacaccaaaauauuuuagaauaaauucuuagaaaguuuugagag

SEQ ID NO: 159541 - RNA, 64 nt, Human
uaacuguguaccucuauagcuauguuuuauaguuuuagaauauuaaaaccucagauauuuaugu

SEQ ID NO: 159542 - RNA, 64 nt, Human
gucucuccaucauuccaaagcuaaauguacauguuuagaauaacuuauuuuauaaacucuucgg

SEQ ID NO: 159543 - RNA, 64 nt, Human
uuucuucccauuuuaugggcaugaaauaugugguuuagaauaaggaacaagcauuauuccuuug

SEQ ID NO: 159544 - RNA, 64 nt, Human
gguccuugugauggaaagagaaaagaaaaaccaauuagaauaaggcagaauguacgugcgucau

SEQ ID NO: 159545 - RNA, 64 nt, Human
ugguuaggauauagcuaugccuuuaugguuaagauuagaauauaugauccauaaaaauuuaaag

SEQ ID NO: 159546 - RNA, 64 nt, Human
auguauaauuaacaauuaucuuguuuaaguaaauuuagaauacauuuaaguauuguggaagaaa

SEQ ID NO: 159547 - RNA, 64 nt, Human
ugcuucauagcuucauaccaacaaaauauauuuauuagaauaguaugaaaguacuggaggagcu

SEQ ID NO: 159548 - RNA, 64 nt, Human
aguaauuaagugucuuuugcccuugauuuugauauuagaauaggugauuacauggauauuuaau

SEQ ID NO: 159549 - RNA, 64 nt, Human
cuggugaagagacaauucaagccuuagugacuauuuagaauagccagugaucacuagcuaauuc

SEQ ID NO: 159550 - RNA, 64 nt, Human
ggauaaucuugguauuuuauauauuuuacagacuuuagaauaaaauaguuaagcauuaauguag

SEQ ID NO: 159551 - RNA, 64 nt, Human
uaucaaaagaaauuucuguaaaugguaugucuccuuagaauacccaaaucauaauuuuauuugu

SEQ ID NO: 159552 - RNA, 64 nt, Human
auuaacaaggacacaucugacauccuguguuugguuagaauauacagcacauugugauaacaua

SEQ ID NO: 159553 - RNA, 64 nt, Human
uauaguugaagauaaaauguugagugcacuuauuuuagaauauccuagacauaacugucuaagu

SEQ ID NO: 159554 - RNA, 64 nt, Human
uauggugaguauuaaaugaguaaauggaaacagcuuagaauagugccugacauauauuauguuc

SEQ ID NO: 159555 - RNA, 64 nt, Human
cuuucauuuuauaccaacgugaaaagugccauuuuuagaauaacuuuaaagcuuaacagguuuc

SEQ ID NO: 159556 - RNA, 64 nt, Human
agauuuagggauuugauacuuaggccuuugaauuuuagaauacaaaaagagaagcaagccagac

SEQ ID NO: 159557 - RNA, 64 nt, Human
uuucagaaauuuguguucgaguaaguaaagcauauuagaauaauuguggguugacagauuuuua

SEQ ID NO: 159558 - RNA, 64 nt, Human
acucagggaauauuuaauucugguuuuagcauuauuagaauaagacuuuauacauuaacuaaag

SEQ ID NO: 159559 - RNA, 64 nt, Human
uuuuauauugaaaauuuuuaaauauucacaaauuuuagaauaaaucaaauauuccauucuugau

SEQ ID NO: 159560 - RNA, 64 nt, Human
uaaaaaaaaaguugcccugggguuucugcaucaauuagaauaucauuaauuucuuuguaaccaa

SEQ ID NO: 159561 - RNA, 64 nt, Human
auacaugaagcuucaugcacuuaaagaaguauuuuuagaauaagaauuugcauacuuaccuagu

SEQ ID NO: 159562 - RNA, 64 nt, Human
uaauugcauugguuaaaagcagcuaaccaggucuuuagaauaugcucuagccaagucuaacuuu

SEQ ID NO: 159563 - RNA, 64 nt, Human
agugaagcauuaaaagagaaauucucagagauauuuagaauauuugacaaugguuugagaaugu

SEQ ID NO: 159564 - RNA, 64 nt, Human
uuauaacguuagcuaagaagcauauuguaagucuuuagaauaguuuaauuguaacaucuuuaau

SEQ ID NO: 159565 - RNA, 64 nt, Human
uuucuguuacuauuuuaugcacuugggagaaggcuuagaauaaaagauguagcacauuuugcuu

SEQ ID NO: 159566 - RNA, 64 nt, Human
uucaacaaauugcccuuuagucuccccguaugaguuagaauaauaaauauuuaguaggugaguu

SEQ ID NO: 159567 - RNA, 64 nt, Human
aaauaugucucaaaaaacuauuggaccuaaauaauuagaauauuacuuggucucaguuguaaag

SEQ ID NO: 159568 - RNA, 64 nt, Human
gaagcuuuuagucaaaagucaguuuauuaaauguuuagaauaccuaaacaggaagaaaauucua

SEQ ID NO: 159569 - RNA, 64 nt, Human
caugccaaguaucuuuccagcauguuucucccauuuagaauaucuagcauguaaggccuuucaa

SEQ ID NO: 159570 - RNA, 64 nt, Human
aaccccaugauaaaaggagaagacaacagugagcuuagaauaucuauaaagcaaaaaauguagu

SEQ ID NO: 159571 - RNA, 64 nt, Human
aaaacaguaugcaguauuucuuaaaguauugaaauuagaauaucaugaaauaaaucaaaacaua

SEQ ID NO: 159572 - RNA, 64 nt, Human
agagugaucuuaaauauggcaagauacagcucauuuagaauaaaaucucacauccauuauuuua

SEQ ID NO: 159573 - RNA, 64 nt, Human
uuagugcuacauuugauaauuuauuauuuacagcuuagaauauugauuucuugaauacguauaa

SEQ ID NO: 159574 - RNA, 64 nt, Human
gacaacacuaaagaaauuucuuaauauacuauuauuagaauaguagaggauaaaagauaauguu

SEQ ID NO: 159575 - RNA, 64 nt, Human
cauggguaacuuagucucaauagaguaucuguuauuagaauaauaaaggaguucauuuucagaa

SEQ ID NO: 159576 - RNA, 64 nt, Human
cuggugccacaggcugacaacugcagucuccaguuuagaauaaauauuccauaguggugacaug

SEQ ID NO: 159577 - RNA, 64 nt, Human
aaucauuucuacuucaaaaacauuucaugcaauauuagaauaaaguuccugucauuccucuaaa

SEQ ID NO: 159578 - RNA, 64 nt, Human
auugaagaggcacggccucagcagaaagugcuccuuagaauacuacagagaggaagagccugca

SEQ ID NO: 159579 - RNA, 64 nt, Human
caccccuccacaccccaaaaaaguaaguuuaggauuagaauauagcuagguccaauguuaaaua

SEQ ID NO: 159580 - RNA, 64 nt, Human
ggacuuagauuuuauucuuccuugcagaguaguguuagaauagauggccuacagaaaaaaaagg

SEQ ID NO: 159581 - RNA, 64 nt, Human
caaagaugaacucugauaugcaaaauaacuucuauuagaauaauggugcucugaagacucuucu

SEQ ID NO: 159582 - RNA, 64 nt, Human
uaucaaauaugccaauucuaaaaagagcuuaacauuagaauaguauaugguagaauuacuaguu

SEQ ID NO: 159583 - RNA, 64 nt, Human
aagcagaugaacuuuucuugaguuauuuugucuuuuagaauacacaaaauauaguauaaagaca

SEQ ID NO: 159584 - RNA, 64 nt, Human
uaucaaaaguauguuguuucaggagacuuuguauuuagaauauucauguaaaacuugugaacaa

SEQ ID NO: 159585 - RNA, 64 nt, Human
gauaugugugaccuucuuggaaugaauauugucuuuagaauacccuuugauaagcugagcuguc

SEQ ID NO: 159586 - RNA, 64 nt, Human
gcaauacguaguucuagaauaaaaguacaaaaaauuagaauaagaauucuuuaacauuuucuuu

SEQ ID NO: 159587 - RNA, 64 nt, Human
augagaaaaugguuucauuggcuuuaaagggauuuuagaauaucuuacuuugcauaguuucaug

SEQ ID NO: 159588 - RNA, 64 nt, Human
ucaacaaauggucauugaaaacacuuguuuagcauuagaauaaaauuauauauguccuugggaa

SEQ ID NO: 159589 - RNA, 64 nt, Human
cugguuagcugaaggcaagugugaaaaucagaauuuagaauauuuagagcuaagcuucuggaac

SEQ ID NO: 159590 - RNA, 64 nt, Human
cacuacaauguaugugaucgucaaugugaauagcuuagaauacugcaaaggauaagcuaauuga

SEQ ID NO: 159591 - RNA, 64 nt, Human
cucccacaauucuggaacuauaauacuguaagccuuagaauaaauaauacuuucaaguuccaau

SEQ ID NO: 159592 - RNA, 64 nt, Human
uauaucaaaagccaaaaucuuuauuuuuaugcauuuagaauauuuuaaauaguucucagauauu

SEQ ID NO: 159593 - RNA, 64 nt, Human
ugucuucacaccgaugauucugcuuuuugcuaaauuagaauaagagcuuuuuuguuucuugggu

SEQ ID NO: 159594 - RNA, 64 nt, Human
aaguuaacagggagaggaugggggaggggacaaauuagaauaggauagcaucugaugccugaga

SEQ ID NO: 159595 - RNA, 64 nt, Human
cauuacaaauauaaguauuuacaggauuuuaaaguuagaauauauuugaaugcauggguagaaa

SEQ ID NO: 159596 - RNA, 64 nt, Human
ugaccagaugcuaucaauacacuauguguccuuuuuagaauaaagauuacauaucaucauuccu

SEQ ID NO: 159597 - RNA, 64 nt, Human
cgcugaaacccacauaccaucacuuggcaauuuuuuagaauaagaccccauuauuaucuauugc

SEQ ID NO: 159598 - RNA, 64 nt, Human
agucacucuaaauggacaccacaugaaccucuguuuagaauaccuacguauguaugcauugguu

SEQ ID NO: 159599 - RNA, 64 nt, Human
gaauuuuaaagauuuauauaaugcaucaaaagccuuagaauaagaaaagcuuuuuuuaaauugc

SEQ ID NO: 159600 - RNA, 64 nt, Human
uuaauuugacucuuaauguguauauguucuuagauuagaauaaugcaacuucgaguaugcuuua

SEQ ID NO: 159601 - RNA, 64 nt, Human
cccugcagcaacuaagauggugggggagaggggguuagaauaaagcaucugaauacaguuuuca

SEQ ID NO: 159602 - RNA, 64 nt, Human
gaccagggaccaagcacagggcauuuagagcuuuuuagaauaaacugguuuucuuuaacaaggg

SEQ ID NO: 159603 - RNA, 64 nt, Human
gcugccguugaagcuaauauucaguucuguagaguuagaauaccuuuuguuguugaagauguga

SEQ ID NO: 159604 - RNA, 64 nt, Human
ugaacagauauuuuuaacuuaauggcacaaagucuuagaauauuauuaugugccccguguuccc

SEQ ID NO: 159605 - RNA, 64 nt, Human
auugcagagagagagcgucgagagcgagaacgcauuagaauaauucgugaacgggaagaacggg

SEQ ID NO: 159606 - RNA, 64 nt, Human
aagcaacgcuccuacaggacuugacauuugcuaguuagaauaucccuacucuucuaaauaauuu

SEQ ID NO: 159607 - RNA, 64 nt, Human
uuuuaaaauaaacuguuuucuuuuggaacuacaauuagaauaguuaauauucauccuuaaacca

SEQ ID NO: 159608 - RNA, 64 nt, Human
aggccgcuucguccuuuuucucugggugaugcccuuagaauaacacuauaugcaauguaacuca

SEQ ID NO: 159609 - RNA, 64 nt, Human
uugcugagagaaauauggaacuuacauuguucaauuagaauaguguucugcaaaaauauuuaua

SEQ ID NO: 159610 - RNA, 64 nt, Human
uuagcucugaagcaagagugauauacuccaggacuuagaauagugccuaaagugcugcagccaa

SEQ ID NO: 159611 - RNA, 64 nt, Human
cuuccccgugccucccaaaguuacuuuaagauccuuagaauauuucuuuaaauauuuuauagac

SEQ ID NO: 159612 - RNA, 64 nt, Human
cacaguuggcccauaaagucauguuucucucccuuuagaauagggaggggaagggaucaggugu

SEQ ID NO: 159613 - RNA, 64 nt, Human
uuuaaaaaucauauuauauguuucaauugaucuguuagaauaaccaagaaaacaaaaugcugga

SEQ ID NO: 159614 - RNA, 64 nt, Human
uuagugucacgcacaaauggggcuauuccuacgcuuagaauagggcuugucugcccacuuuaga

SEQ ID NO: 159615 - RNA, 64 nt, Human
cagaguugucuuaaauuagugguggauagaagacuuagaauagaaacuuuuaguauuaccgaug

SEQ ID NO: 159616 - RNA, 64 nt, Human
ugcccugucuuuuauuugcgggucuaaucuaauauuagaauauauuaaccgcuuaaggcauuga

SEQ ID NO: 159617 - RNA, 64 nt, Human
ccugccuggcuccugggagauaaccucuaagccauuagaauaucuugccugauaagaguguuuu

SEQ ID NO: 159618 - RNA, 64 nt, Human
ccaguuaaguuugaauuucagauagaaaauaauuuuagaauaaauauguucuaucuaauacaug

SEQ ID NO: 159619 - RNA, 64 nt, Human
auauuucuauuuagaacacagaaaaugaaaauauuuagaauaaguuguacauuugaugacaaau

SEQ ID NO: 159620 - RNA, 64 nt, Human
uggucugcaucaaucuguuugccugcuaaacaaguuagaauaggaaauaguaaaauaaauccaa

SEQ ID NO: 159621 - RNA, 64 nt, Human
uucuuaaaaucucuuuaaggccuucuuguugcuguuagaauagugcuauauaucagguauguga

SEQ ID NO: 159622 - RNA, 63 nt, Human
ugcagugaauuauuuauugugauaauaaauagcauuagaauacaagauuuuuaaugucugcgu

SEQ ID NO: 159623 - RNA, 64 nt, Human
aucugggguugggucaugacaccagcuaccaauuuuagaauauuauuucuugguuucuuuauga

SEQ ID NO: 159624 - RNA, 64 nt, Human
ugagaggcaagcuaaauguaguuauuuuauccuguuagaauacaaauucuaauuaaaauaguua

SEQ ID NO: 159625 - RNA, 64 nt, Human
auccacaccagcuuaucaaccaacacagcuaauuuuagaauagauccuuuaucuuuccauaugg

SEQ ID NO: 159626 - RNA, 64 nt, Human
ugcuuuucuuccaaugaauuaagacaaguuauuuuuagaauaguaccauuucuuuggcuuuuuc

SEQ ID NO: 159627 - RNA, 64 nt, Human
cugucuguagugccugcuguuuggaaagggugaguuagaauauguuccaagguuggugaggggc

SEQ ID NO: 159628 - RNA, 64 nt, Human
ggaaggagaauaaacagaauauuuauuacaaauguuagaauauauuucuuauacuaggaaucuc

SEQ ID NO: 159629 - RNA, 64 nt, Human
uuggugaauuucacaagcuauuuuuggaauauuuuuagaauauuuuaagaauuucacaagcuau

SEQ ID NO: 159630 - RNA, 64 nt, Human
gugacuuuuaaucuuaggaaacucugccuuccuuuuagaauaauauuuuaauugccaggcaaaa

SEQ ID NO: 159631 - RNA, 64 nt, Human
aauuucuagcguuaugcaucgccacaauccaguuuuagaauauuuccaugacccuaagaaguuu

SEQ ID NO: 159632 - RNA, 64 nt, Human
uaaagucuauguaaugguggucauuuuuucccuuuuagaauacauuaaaugguugauuugggga

SEQ ID NO: 159633 - RNA, 64 nt, Human
uuuuucacuucaguccuuuucugaagaguuugacuuagaauaaugaagguaacuagaaagugag

SEQ ID NO: 159634 - RNA, 64 nt, Human
agucauuuuuuuauuuuguuaccaacccauauucuuagaauauaaacaggacuuguuuuuuuca

SEQ ID NO: 159635 - RNA, 64 nt, Human
auagaaaaggaaagcuccagcuaaauaggaagaauuagaauauugagcuuuuuuuuccugauuu

SEQ ID NO: 159636 - RNA, 64 nt, Human
aacagugacauuugauucaauuguugagcuguaguuagaauacucaauuuuuaauuuuuuuaau

SEQ ID NO: 159637 - RNA, 64 nt, Human
uauuuaacugaccugacaaucuugaugauuuccauuagaauaacuuauucuaaggucaaaagug

SEQ ID NO: 159638 - RNA, 64 nt, Human
aguuugauaguuuguuaucauguuauacguacacuuagaauaaugauccagccaucucauucua

SEQ ID NO: 159639 - RNA, 64 nt, Human
cuucuuuaacuaccuuuggaaauacuguacaauguuagaauaauuuauuuugcuuuacaggagu

SEQ ID NO: 159640 - RNA, 64 nt, Human
aauguacaaguuuaauaaaaaggggccuuccccuuuagaauaaauuucagcaugugcuuucuuu

SEQ ID NO: 159641 - RNA, 64 nt, Human
ccucugcaccuggccuucauucuuuucguauugcuuagaauaugacaugcugaaccaggcaugg

SEQ ID NO: 159642 - RNA, 64 nt, Human
aagagguuaaugguguucagugagugaaggugaguuagaauaauauauuggagcagcaaucaau

SEQ ID NO: 159643 - RNA, 64 nt, Human
cuaaaaccauuaugauaaaauauuuguguauggauuagaauagaaagggauuauggauguaucu

SEQ ID NO: 159644 - RNA, 64 nt, Human
accgagagcuguggguaaaauuugaaaauuguauuuagaauaagaaauuuuacauuuuaaaccc

SEQ ID NO: 159645 - RNA, 64 nt, Human
gggucauaauucugccuuccucuaggggaagcuuuuagaauagugccuggcaugaaaugccuau

SEQ ID NO: 159646 - RNA, 64 nt, Human
gugggccagagaacauuggaagaaucaagagagauuagaauaucugguuucucuaguugcagua

SEQ ID NO: 159647 - RNA, 64 nt, Human
uacuaaugugaugcuuucauuaugucccuguggauuagaauagugucaguuauuucuuaaguaa

SEQ ID NO: 159648 - RNA, 64 nt, Human
aucaguuaagcaaucuuuuauguuucuauauuauuuagaauauuuguuguugcaauuuucacau

SEQ ID NO: 159649 - RNA, 64 nt, Human
gucaaguauuaacagcacaagugguagguuaacauuagaauaggaauugguguugggggggggg

SEQ ID NO: 159650 - RNA, 64 nt, Human
uuguuccguaugcuaacaugugcauggcaaaaauuuagaauagccagggucuguaggcaucaca

SEQ ID NO: 159651 - RNA, 64 nt, Human
gagguuaguacuuuuagucccuguuuuacagggguuagaauagacuguuaaggggcaacugaga

SEQ ID NO: 159652 - RNA, 64 nt, Human
uauuaaagccuuucuccuucaguagucuauuuucuuagaauaacaacucuuuuaucuauucuga

SEQ ID NO: 159653 - RNA, 64 nt, Human
guauuugauaaauauuucuuccuacauuauauuuuuagaauauuucagaaauauacauuuaugu

SEQ ID NO: 159654 - RNA, 64 nt, Human
gugaauuuggaucuuuuuacuuugagcauauauuuuagaauauguguauguuaaaggaucucca

SEQ ID NO: 159655 - RNA, 64 nt, Human
gaugacaauguuuucuuguaagaaucccaacacuuuagaauagaaaaggaccuaagauucucug

SEQ ID NO: 159656 - RNA, 64 nt, Human
acgcacaagaauaugucacauaaagaaaauguguuuagaauacugguuuucuauuuacgcauga

SEQ ID NO: 159657 - RNA, 64 nt, Human
auguaacuuuuaaaauauuaagugucuuguaugauuagaauaugugaaugaguaacuuauuuug

SEQ ID NO: 159658 - RNA, 64 nt, Human
auugauaaacccauuccguuuguugaucuguguuuuagaauaguccaagugaagcaaaacgaac

SEQ ID NO: 159659 - RNA, 64 nt, Human
cacucguuaugaccucguaaguaaaaauuaucacuuagaauaaggggugcacacuacauucccu

SEQ ID NO: 159660 - RNA, 64 nt, Human
cugugucccauagggugccuucugaauacuguuauuagaauaaguuuguugcagaacgugaccc

SEQ ID NO: 159661 - RNA, 64 nt, Human
gagaguugauggggugcagauagggguaggacuguuagaauagaaccaacccaaacugugugua

SEQ ID NO: 159662 - RNA, 64 nt, Human
uuauuuauaaaugcuuauuuuuuuccaagccaaguuagaauagagcacuuuuagaggauuucau

SEQ ID NO: 159663 - RNA, 64 nt, Human
gugggcaucuucaggugguguucugguaaaauuguuagaauagcuguaugaaggaaaccagugg

SEQ ID NO: 159664 - RNA, 64 nt, Human
ucacggcuacuaugccugaacucuaucugagccauuagaauaaugaauaauucuuaauaaugaa

SEQ ID NO: 159665 - RNA, 64 nt, Human
aaugucacuuauucauuaguguuugacauaauuuuuagaauauuuauuuugaaucaauccuuuc

SEQ ID NO: 159666 - RNA, 64 nt, Human
aaagaaaaauaauuuagcuguguuuuagacagcauuagaauauauuguucagcacaguaaaaua

SEQ ID NO: 159667 - RNA, 64 nt, Human
acaggaaucugauugcauuaagugaaaggauuauuuagaauauguuaaugcaaagcuaaaauaa

SEQ ID NO: 159668 - RNA, 64 nt, Human
gaaucuuaugucagaaauauaagcagcuauguacuuagaauagguuuugaaugggagagguaga

SEQ ID NO: 159669 - RNA, 64 nt, Human
cuucuuuaaaaaccauuuaaacugcuagauaguauuagaauaguccaauagaaaauucauucuu

SEQ ID NO: 159670 - RNA, 64 nt, Human
gagugcugcuguagaugacaaccuccauucuauuuuagaauaaauucccaacuucucuugcuuu

SEQ ID NO: 159671 - RNA, 64 nt, Human
cuuauuuagugaucuguugcaagauaacuuggaauuagaauaagcauuuccuugaaaauguuua

SEQ ID NO: 159672 - RNA, 64 nt, Human
ucuuuuuuggguugaagaagaagaaagcauagcuuuagaauagagauuuucucagaaaugugug

SEQ ID NO: 159673 - RNA, 64 nt, Human
uuuuccugguuccuuuuuuuuccucaaagcucaauuagaauagcaaaauuuauaagcuaguaaa

SEQ ID NO: 159674 - RNA, 64 nt, Human
uuuggaaauaugcacugaaagaaauguaaaacauuuagaauagcucguguuauggaaaaaagug

SEQ ID NO: 159675 - RNA, 64 nt, Human
gucuuuuuuauauaucuagcauauaagauauugcuuagaauaugguagacaucacugaagauuu

SEQ ID NO: 159676 - RNA, 64 nt, Human
cgggguaauuugaacauuggugggguauuugguauuagaauaaugguuuuaucauuauguuaga

SEQ ID NO: 159677 - RNA, 64 nt, Human
ggaacauagaaauauaaaagguaacaucuaaagcuuagaauagugugauuuuuaguaagccauu

SEQ ID NO: 159678 - RNA, 64 nt, Human
aauaaacuuuauuuccucucacuauaguguggcuuuagaauauaucaaguacaaccugaaugga

SEQ ID NO: 159679 - RNA, 64 nt, Human
aaaaaaaaugcaaaacuagaaaacuuuauucauuuuagaauagaacauaauuucuaacuguaaa

SEQ ID NO: 159680 - RNA, 64 nt, Human
uauaauaugauucacuuaugccacagauucaacauuagaauauguuuuaucucuacugucaguu

SEQ ID NO: 159681 - RNA, 64 nt, Human
uaacucugauuuuauaaucagacuuagauuguguuuagaauauuaaaugacugggcacccucuu

SEQ ID NO: 159682 - RNA, 64 nt, Human
acaaagauuauaaauguaguuaguuugauacuccuuagaauaaaaaaaugaaacaguaacaacu

SEQ ID NO: 159683 - RNA, 64 nt, Human
guacucagccuuuccuauugggccuuccccacaauuagaauauuuugacuuaguguccuguccc

SEQ ID NO: 159684 - RNA, 64 nt, Human
gaaaaaaauauaugauuguauaaugugauuuuuuuuagaauagggggaaccuuauuuauuugug

SEQ ID NO: 159685 - RNA, 64 nt, Human
auaaaagcuguuucuguuuaugaauuuuauucuuuuagaauagaauaaguacaugcugcuguaa

SEQ ID NO: 159686 - RNA, 64 nt, Human
cuuggugagacacacuuaaauaagcacguggagguuagaauagagggcagaguaaaaggaagcu

SEQ ID NO: 159687 - RNA, 64 nt, Human
ugcauuuuuguugcaauguuuauuccacuugcaguuagaauaugaauauguuuuaucacuagug

SEQ ID NO: 159688 - RNA, 64 nt, Human
uagccucaccuucccuaguucuuugcauucguccuuagaauacuguauuguuacagcugaaaga

SEQ ID NO: 159689 - RNA, 64 nt, Human
ucaccaguuuccaaguuuauugcccucaaaaucuuuagaauaguuaaauuggcuuguuuaaggu

SEQ ID NO: 159690 - RNA, 62 nt, Human
ucaugggauggaauuauuaacaguuaauaaauuuagaauaacuuaaaaaauucaauggccuu

SEQ ID NO: 159691 - RNA, 64 nt, Human
uaguguggcuaccauucacuggcaaugauuucuuuuagaauaugggaguaagaugagcuagaga

SEQ ID NO: 159692 - RNA, 64 nt, Human
ugcauuuagccuggagccccuuccucauuaugcuuuagaauauucauaggaguuccauuuguau

SEQ ID NO: 159693 - RNA, 64 nt, Human
aguuggcaugaagccauagaauuaaauuuuggcuuuagaauacagauguguucauuacauuccc

SEQ ID NO: 159694 - RNA, 64 nt, Human
acaugacagguucaugcaaauaugcucucuuucuuuagaauauuucuguagguuucuugggacu

SEQ ID NO: 159695 - RNA, 64 nt, Human; identical to SEQ ID NO: 159681

SEQ ID NO: 159696 - RNA, 64 nt, Human
acuguuuauuuuucccugcugugcccagaacauuggcguagacacaguaagaaccuaguaaaua

SEQ ID NO: 159697 - RNA, 64 nt, Human
agccccucauaggaggcccaggagggagccccaaggcguagaagccuuguugaagcugugagca

SEQ ID NO: 159698 - RNA, 64 nt, Human
ugggcaucguucccagugucccucacacuaaaacggcguagauggcaaccccccacccccaccc

SEQ ID NO: 159699 - RNA, 64 nt, Human
ucaccaucuaacuauucaggaauuguagucugagggcguagacaauuucauauaauaaauaucc

SEQ ID NO: 159700 - RNA, 64 nt, Human
cugacauuggagccugggcauccucagguggucaggcguagaucaccagaauaaacccagcuuc

SEQ ID NO: 159701 - RNA, 64 nt, Human
ucucacccaccaucagaggacuuuuaaaaucauaggcguagagaguuaggcuaucugcugaauu

SEQ ID NO: 159702 - RNA, 64 nt, Human
cugucuguaaggcguagaaucuguccgucuguaaggcguagaaugaggguuguuaauccaucac

SEQ ID NO: 159703 - RNA, 64 nt, Human
uuuccuuuuagguuuaaguccugucugucuguaaggcguagaaucuguccgucuguaaggcgua

SEQ ID NO: 159704 - RNA, 64 nt, Human
uuuaagcagcucuugcuaaucagugucucacacuggcguagaaguuuuuguacuguaaagagac

SEQ ID NO: 159705 - RNA, 64 nt, Human
aucucauggagaccugcauggcccuguuagagauggcguagaagugaaagucuuaaagggagca

SEQ ID NO: 159706 - RNA, 64 nt, Human
uaggagucagaaacuaaaugcugagucucucaaaggcguagagagaauuucagagggccuuacc

SEQ ID NO: 159707 - RNA, 64 nt, Human
agccagaagcuaagcugcagugaggcugugauugggcguagaagugggagcauugggaccucac

SEQ ID NO: 159708 - RNA, 64 nt, Human
cucaaggccacccuaccgucauauauaucacucaggcguagaagaaaagacacauauuuuauaa

SEQ ID NO: 159709 - RNA, 64 nt, Human
uuuggcuucuccugugaccccaccuugacgguggggcguagacuugacaacaucccacaguggc

SEQ ID NO: 159710 - RNA, 64 nt, Human
auguucacauaguuugaaauuaaagguacaaaauggcguagaaugaaaugccucucacccuuuc

SEQ ID NO: 159711 - RNA, 64 nt, Human
aggcaguuuauucuaaauaauuuuucucuaggaaggcguagaauuuuaaagaacugguaauagg

SEQ ID NO: 159712 - RNA, 64 nt, Human
ugcucuuugcuuuuucguugucugagaaauuguuggcguagauuuggcuucugguauguguuuc

SEQ ID NO: 159713 - RNA, 64 nt, Human
gcacgucuucccuccugucccagcuccccagccuggcguagagcaccccuccccucccccccac

SEQ ID NO: 159714 - RNA, 64 nt, Human
gugcucuaugugguucuucuuccauuggagagcuggcguagagaucugcaguguucacaaggau

SEQ ID NO: 159715 - RNA, 64 nt, Human
ccaugaaauuggcugaauaauuacuccucugccuggcguagacaugcgcuuugggaaaaaaacg

SEQ ID NO: 159716 - RNA, 64 nt, Human
gggccagccaacaguaacacuugccaagaagcauggcguagaaauuucuauguuccgaaacaca

SEQ ID NO: 159717 - RNA, 64 nt, Human
uggaauuugacuuuccauuucugagacccaagggggcguagauguaguggcaaguguggcgaug

SEQ ID NO: 159718 - RNA, 64 nt, Human
gagaacucagguagcugcaucaccaggcuugcuuggcguagauaacaauacacugaaauacucc

SEQ ID NO: 159719 - RNA, 64 nt, Human
gugaaggcuuuuuccccuaauccuggcagagcagggcguagaaaagagaggauguccgugcuua

SEQ ID NO: 159720 - RNA, 64 nt, Human
uucucaguuagcuggucaaguggaguguaaugguggcguagagaaucacaaauggaaaauaauu

SEQ ID NO: 159721 - RNA, 64 nt, Human
uucaucuuccccaagugcggggaguacaaggcauggcguagagggugcugccccaugaagccac

SEQ ID NO: 159722 - RNA, 64 nt, Human
gagagccgcccuuaccguuggucuccggaucccccagucccaucccgccguuuucggcugucuu

SEQ ID NO: 159723 - RNA, 64 nt, Human
ccauugaucuugaauuugcccucuccuagugcugcagucccacuucaaagccauuuucugagga

SEQ ID NO: 159724 - RNA, 64 nt, Human
gcaaguugccaucuauaaggauugugccaguuuacagucccacccacaaugcaugagagugccu

SEQ ID NO: 159725 - RNA, 64 nt, Human
gaagagagggucugcccugccucacuccccucuucagucccaguagacucugcucccuagcccu

SEQ ID NO: 159726 - RNA, 59 nt, Human
uguggcuuugcauucaguaaggggaccaucagucccauuacuaguuuggaaaugauuug

SEQ ID NO: 159727 - RNA, 64 nt, Human
uuuuauuugccaggggcacgaugugacauaucugcagucccagcacagugggacaaaaagaauu

SEQ ID NO: 159728 - RNA, 64 nt, Human
ccagagccugaaaacuguuuucacuggguuccaccagucccagcaaaauccucuuuguauuuau

SEQ ID NO: 159729 - RNA, 64 nt, Human
cauggucacagaccccugggggaggcuuccagcucagucccacagccccuugcuucuaagggau

SEQ ID NO: 159730 - RNA, 64 nt, Human
gcccugcucuccgcuccacccccugccaacuacucagucccacccaacuuguaaaccaauacca

SEQ ID NO: 159731 - RNA, 64 nt, Human
ggggaaacuuacguuggaugacauuuaugagggucagucccacauaccucuuucaggagacaac

SEQ ID NO: 159732 - RNA, 64 nt, Human
cuucaccccuccccagaguaagagcuggggcugacagucccacccugucauuccuaauagccca

SEQ ID NO: 159733 - RNA, 64 nt, Human
gggugcucuugaugggcuggcuguaagggagacucagucccagccucuccccucuacaacuccu

SEQ ID NO: 159734 - RNA, 64 nt, Human
ccuuacaauuacugaccauccccaguagacuccccagucccauaauuguguaucuuccagccag

SEQ ID NO: 159735 - RNA, 64 nt, Human
acuaguagaggcagucccguggagcccgccucuccagucccagccagaggggacccuggccuuu

SEQ ID NO: 159736 - RNA, 64 nt, Human
agugggauucacuccugcccugcccccaccuucccagucccacaggccaccccuggcuugggcu

SEQ ID NO: 159737 - RNA, 64 nt, Human
gcuccccgcccacccucugccuggucgcgcucuucagucccacgaggagcugacacguccucuc

SEQ ID NO: 159738 - RNA, 64 nt, Human
cugcuuucgaagacucugcugccauccguucucccagucccaaggguccacgauguacaaaguc

SEQ ID NO: 159739 - RNA, 64 nt, Human
cuguccccagcgaagaauccggcugccccugggccagucccaggaccuuugcacaggacugaug

SEQ ID NO: 159740 - RNA, 64 nt, Human
gcccuuggagggcauguagcagugucuguccugccagucccaaggcccugugggaggagacugg

SEQ ID NO: 159741 - RNA, 64 nt, Human
gagaggggucuuggcacucucuucuuacuuaaaccagucccagacaccuagacacggaccccuu

SEQ ID NO: 159742 - RNA, 64 nt, Human
ggccugagaggaauguaaggaaaccagcccagaucagucccaaggccagaguccuuuguccuac

SEQ ID NO: 159743 - RNA, 64 nt, Human
uuuugugaagacggcacggucuucccucuucccucagucccaaauccuucccaaguaagaggcu

SEQ ID NO: 159744 - RNA, 64 nt, Human
ggaugggaucacccccuucgugccucauggaauucagucccaugcacuacacucuggauggugu

SEQ ID NO: 159745 - RNA, 64 nt, Human
gauguuaaaucaugagaucagagaugcuguucaucagucccaacaagauggccuagaaaucgca

SEQ ID NO: 159746 - RNA, 64 nt, Human
uuaggagucaagauaucuggguucucacucuacucagucccagcagagcuguuguauaaccuug

SEQ ID NO: 159747 - RNA, 64 nt, Human
augagagggaagugggcagacaagaggcuggccccagucccaaggaacaagagauggucaaguc

SEQ ID NO: 159748 - RNA, 57 nt, Human
uugaccugaaugagauguagaacgccccagucccacccugcugcugcuccucccucu

SEQ ID NO: 159749 - RNA, 64 nt, Human
aauguuugcugcuuuagguggauggagaguccaccagucccacucaaugcugcucuaacucuac

SEQ ID NO: 159750 - RNA, 64 nt, Human
accacagacccuucucuggcucccaaaaggaguucagucccagagggguggucaccccacccuu

SEQ ID NO: 159751 - RNA, 64 nt, Human
cagcaaugggcugcaauuaggcagauaaagacaucagucccaguaaaugaauccauagacucau

SEQ ID NO: 159752 - RNA, 64 nt, Human
ucccaggugcucuccacacauaggaugguaaugccagucccaggggagggugugauaguaagga

SEQ ID NO: 159753 - RNA, 64 nt, Human
uucagaaaaauaccagaucauuuccuaaaaucuccagucccaaguauuacaucgugguuucccu

SEQ ID NO: 159754 - RNA, 64 nt, Human
gccagcuagagcuuccacugucagcccucacugucagucccacugcaccccccugugccugcug

SEQ ID NO: 159755 - RNA, 64 nt, Human
uauucacuaguugggucagacuaacagggacucucagucccaaaaucucacucuuauugacaau

SEQ ID NO: 159756 - RNA, 64 nt, Human
ugcugcaccuggaauugagucgcuaaagccccuccagucccagcuuugaggcugggcccaggau

SEQ ID NO: 159757 - RNA, 64 nt, Human
cucgccccuuccucaucucuggaauuuggccaggcagucccagaagacucuggagugaccuccu

SEQ ID NO: 159758 - RNA, 64 nt, Human
guuaucucuucacccacugcccucucaguaucaccagucccaaagacaggauacgucccuguaa

SEQ ID NO: 159759 - RNA, 64 nt, Human
ggaauaaaguugauucauaucaacauuagaacuccagucccaaacuaaucugucagguucacug

SEQ ID NO: 159760 - RNA, 64 nt, Human
ugccugugagcucugauuguaggaaugcaugugacagucccaguccuaugguaaugacuuagga

SEQ ID NO: 159761 - RNA, 64 nt, Human
uaugggguugcccagcuacucuuccuuucaguugcagucccaauuuuacuccgucagaaagcag

SEQ ID NO: 159762 - RNA, 64 nt, Human
gcaggucuugaacuacuucuccuccucggagccccagucccauguccacugucuauuuauugca

SEQ ID NO: 159763 - RNA, 64 nt, Human
gaauguggaggccggccgaaacugaugcugcccacagucccagugaaguuagguggguuaauua

SEQ ID NO: 159764 - RNA, 64 nt, Human
uuccaucuaagaaaugagggucuugagaaucaaccagucccaagauuagccuguuauccuguua

SEQ ID NO: 159765 - RNA, 64 nt, Human
uguuucuucaccuaaaaaaugggacuuuuugucucagucccagugaagugccagguuugauugu

SEQ ID NO: 159766 - RNA, 64 nt, Human
gucagggggccacagagaaggggcagcugagccccagucccaggguggaucuguccugcucugu

SEQ ID NO: 159767 - RNA, 64 nt, Human
gauggcaagagugcaaauacuaucuucaauccuucagucccagccagaagaaucucugaaagca

SEQ ID NO: 159768 - RNA, 64 nt, Human
gcagagggucuguugccagccugcauugauauaccagucccauuuguaaauauuuacguaccuu

SEQ ID NO: 159769 - RNA, 64 nt, Human
caauaaaugaguuagaagggccagauuucauucucagucccagagcauugcuauuuaucucaaa

SEQ ID NO: 159770 - RNA, 64 nt, Human
auuuuuaagugggcuuccauuccauggauuuaaucagucccaagaagaucaaacucagcaguac

SEQ ID NO: 159771 - RNA, 64 nt, Human
uaauuuggaucgacugaggugccaggagaaacugcagucccagguauccagacagccaccagga

SEQ ID NO: 159772 - RNA, 64 nt, Human
cgacacugccagccccguguuagcaccugggccucagucccacuugcucccaggcgccgguucu

SEQ ID NO: 159773 - RNA, 64 nt, Human
ggcugugcauugaggaccccugcuuccugguucucagucccaccccaaaaccuggcacccagaa

SEQ ID NO: 159774 - RNA, 64 nt, Human
cgcgucauuguuggaagaggagagaugcaucgagcagucccagcugcuuuucauuuauuacuuc

SEQ ID NO: 159775 - RNA, 64 nt, Human
ggagagugagggccaagaacgagccuuaagggagcagucccaagcuggagccacccagggcugg

SEQ ID NO: 159776 - RNA, 64 nt, Human
guuugcuuaaacccuuuagugcuuugugauaguucagucccagggaaagagaaaacucgcccua

SEQ ID NO: 159777 - RNA, 64 nt, Human
aagugcugaggcugagaaacccugauguaaagaucagucccaguuauaaacugaaaacagcuau

SEQ ID NO: 159778 - RNA, 64 nt, Human
uacaaucauuacuccugacacacggcugcaugaccagucccacccccccguggccaccaauggc

SEQ ID NO: 159779 - RNA, 64 nt, Human
ugaacguaauccaugcuuuaaacuggccauuaaacagucccacaugguuggauuuuuuuuuuuu

SEQ ID NO: 159780 - RNA, 64 nt, Human
ccacaugagcccaacagguccacgauggauccaccagucccaccccagccuuuuccuuucaucu

SEQ ID NO: 159781 - RNA, 64 nt, Human
aagaaauggauuguuggugcuuuggaauauguuacagucccacauuugauauuucuuauauacu

SEQ ID NO: 159782 - RNA, 64 nt, Human
uucaugaauuugugaugucuuugcuguuuacaugcagucccaagaaauggauuguuggugcuuu

SEQ ID NO: 159783 - RNA, 64 nt, Human
auaaaaauuagccaggcaugguggugugggccugcagucccagcuaccugggaggcugagucag

SEQ ID NO: 159784 - RNA, 64 nt, Human
gcuacugcucucauucugucucaucccaggaauccagucccaagugcugccugccaaucgucca

SEQ ID NO: 159785 - RNA, 55 nt, Human
uuaccagguccccuuccuaacccuccagucccaaauccaagauucuuuaaccaca

SEQ ID NO: 159786 - RNA, 64 nt, Human
ccccgacccaccccaucccuuuucucuggcacuccagucccaggccuugggccugaacuacugg

SEQ ID NO: 159787 - RNA, 64 nt, Human
gugugugcgaugguaccuguggcaagagcgagggcagucccagugagaacucucaagaccucuu

SEQ ID NO: 159788 - RNA, 64 nt, Human
aaucuuugaaaggacaaggccucugugaaugaaucagucccagggaagcauuuggugguggcgg

SEQ ID NO: 159789 - RNA, 64 nt, Human
uugaagguuuuauuuguuguuguuauuacuaguucagucccaaacuuacccuuuccuuuucaga

SEQ ID NO: 159790 - RNA, 64 nt, Human
gcacuuuccuucuccagauccccccuacccaccccagucccaaauccaguccucuggcccuugc

SEQ ID NO: 159791 - RNA, 64 nt, Human
uuaauguuaaagacuuaagacuuuaaccugcuggcagucccaaaugaaauuaugcaacuuugau

SEQ ID NO: 159792 - RNA, 64 nt, Human
cacacaccgcagggcccgacccuccugucauucacagucccauggcacauaggggaaaggaucu

SEQ ID NO: 159793 - RNA, 64 nt, Human
agcaaaaguauuugcuggaauuauugguagauggcagucccacuccuacaccugcuuugucaga

SEQ ID NO: 159794 - RNA, 64 nt, Human
aaaacucacuaugcuaggaauagacugugugcaccagucccagacacuuggcagaaguguagca

SEQ ID NO: 159795 - RNA, 64 nt, Human
gccugacccuguccugucagcuggguuuacauaccagucccauucuuccuuuucaauaccuacc

SEQ ID NO: 159796 - RNA, 64 nt, Human
cacuaugcaugucucacucacccuccacagcacucagucccaucgacguucacugaacauuggc

SEQ ID NO: 159797 - RNA, 64 nt, Human
ggaaggagagggauuauguuauagcuugucagcacagucccaaguucaauauuucugcggcaaa

SEQ ID NO: 159798 - RNA, 64 nt, Human
ggcugagcuuggcccuggacucggaacacaccugcagucccaggcugggcugugaccccaugaa

SEQ ID NO: 159799 - RNA, 64 nt, Human
uuuauguuucacauauaguuuuauacaaaguagccagucccauaaugaaaugcuguauugccau

SEQ ID NO: 159800 - RNA, 64 nt, Human
cagguggagaacuuucccuccuacacagugaggacagucccagucugcugggauaagugagaaa

SEQ ID NO: 159801 - RNA, 64 nt, Human
agcaguguaccugucuugccagcacugccagcgucagucccaggaguccacacugguccauccu

SEQ ID NO: 159802 - RNA, 64 nt, Human
ccucagcguacccgccucaccucucacccuccuccagucccacuucaggcagcaggcucgaguu

SEQ ID NO: 159803 - RNA, 64 nt, Human
aguucaguuuuccucucuguuuacagcuccuugacagucccacgcccaucuggagugggagcug

SEQ ID NO: 159804 - RNA, 64 nt, Human
ggcaagugaacucagcacucugcagugagagggacagucccauguguggcagcauugucccacu

SEQ ID NO: 159805 - RNA, 64 nt, Human
caaccccacuccucucagucccgcucacccuccucagucccaguuucugaaaggacucagcuga

SEQ ID NO: 159806 - RNA, 64 nt, Human
gagacacgaugccgagaccucaagcccugaggggcagucccaaaacccuuacagugaagauguu

SEQ ID NO: 159807 - RNA, 64 nt, Human
accauuuuaggauaccuuuacuuuaaggaccacacagucccagaggacacaucccucgggaacu

SEQ ID NO: 159808 - RNA, 64 nt, Human
uuggggcuggcgggcggcggcuuaccagcugggucagucccaucucgccccucugugccuaugc

SEQ ID NO: 159809 - RNA, 64 nt, Human
cccugaacgccuccgcaggcagauucauggagaccagucccaguagcaaccgccccuuccccaa

SEQ ID NO: 159810 - RNA, 64 nt, Human
auugcauuuguaaccaaggggugcgaaacccuggcagucccaggcagcaccaggccagggguug

SEQ ID NO: 159811 - RNA, 64 nt, Human
cauuuuaaggcugaaagauacugucgaaaucacccagucccaaccccccaauuuaaaauugauu

SEQ ID NO: 159812 - RNA, 64 nt, Human
uuugcuuugguuaaaaauggcucaaguagaaaagcagucccauucauauuaagacaguguacaa

SEQ ID NO: 159813 - RNA, 64 nt, Human
cuauaagguucucaauuaaauucuuuaaucuguccagucccaguuucucuuauuaauaaaacuu

SEQ ID NO: 159814 - RNA, 64 nt, Human
gcauuugagaauaguuuucccuauucuguggauacagucccagaguuuucagggaguacacagg

SEQ ID NO: 159815 - RNA, 64 nt, Human
cuccugugagcaccgagaagaacugggcgacucccagucccaccugugcugugacagucccacg

SEQ ID NO: 159816 - RNA, 64 nt, Human
aacugggcgacucccagucccaccugugcugugacagucccacguggcuaugacagacuguuua

SEQ ID NO: 159817 - RNA, 64 nt, Human
auugcuuuucuauucccuuuggacauacaugcuacagucccacaauguagcauuuccuuggaaa

SEQ ID NO: 159818 - RNA, 64 nt, Human
gccaucaccaccauucaucuccagaauuuguucucagucccaaacugaaacuauaccauucaaa

SEQ ID NO: 159819 - RNA, 64 nt, Human
uuuuuaugguguuuaaucuaauacacuuaagcugcagucccaaaauuagggguaaguuauaaga

SEQ ID NO: 159820 - RNA, 64 nt, Human
guaauguggaccaacuuacuuuacacauuuucaucagucccaauguauggaauuagcuuaguuu

SEQ ID NO: 159821 - RNA, 64 nt, Human
gauauauaacagcucuagcuagugguaaagugcacagucccagcuuaauucagggcagggacau

SEQ ID NO: 159822 - RNA, 64 nt, Human
aaugguaguuuguuuucuuugguagaguauauggcagucccacaucgaugauaauuggugcucc

SEQ ID NO: 159823 - RNA, 64 nt, Human
ugacaauaaguuugaaccuuuuuuuuugaaacagcagucccaguauucucagagcaugugucag

SEQ ID NO: 159824 - RNA, 64 nt, Human
agggguaggguggguaagaguccaugggggugcccagucccaggaaaggggacaaugaagggac

SEQ ID NO: 159825 - RNA, 64 nt, Human
aggcagggcccaguccaggggccccaggccuccccagucccagugugcgagccccacuuggaca

SEQ ID NO: 159826 - RNA, 64 nt, Human
ugaggacaugccucccaccaaauguccccugcuccagucccacuccugucaccccacgcucugc

SEQ ID NO: 159827 - RNA, 64 nt, Human
ccuccuaacaaguguaucucgauuaauaaccugccagucccagaucacacaucaucaucgaagu

SEQ ID NO: 159828 - RNA, 64 nt, Human
auuaccuuaggcuuuuauaaugcuccgccuacuucagucccauguuucagaagcuuuugucuau

SEQ ID NO: 159829 - RNA, 64 nt, Human
caaaaaauuagccgggcgugguggcgggcgccugcagucccagcuacucaggaggcugaggcag

SEQ ID NO: 159830 - RNA, 64 nt, Human
aggucaugggaagagcguagacagguguuacuuacagucccagauacacuaaaguuacaaacag

SEQ ID NO: 159831 - RNA, 64 nt, Human
ugaagaagucaaggguggagccagagaaggaaggcagucccagaugagccucuauuuucaucag

SEQ ID NO: 159832 - RNA, 64 nt, Human
uccaaacgugcauccucuugguuggcccccuugucagucccagacguccacuugcucuuccuua

SEQ ID NO: 159833 - RNA, 64 nt, Human
gccacaugugaaaaccugucacuugcacagaggccagucccacuaaggugaccagagugggcuc

SEQ ID NO: 159834 - RNA, 64 nt, Human
ucauugagcaucuguacauauccuucaccacccccagucccagcaccugugucaguaaagaaag

SEQ ID NO: 159835 - RNA, 64 nt, Human
acaugaguagcgaacacuuaaauuggguuuucaacagucccagcuuucacugccagggucccag

SEQ ID NO: 159836 - RNA, 64 nt, Human
uacuccucuuucuuuuguauggacaguuccccuucagucccaucccccuacacauacacccagc

SEQ ID NO: 159837 - RNA, 64 nt, Human
gcuggggcauggcaggcugggugaccgacuaccccagucccagggaagguggggcccugccccu

SEQ ID NO: 159838 - RNA, 64 nt, Human
gcacagccucuaguguccggggaccuugugggaccagucccacaccgcuggucccugcccuccc

SEQ ID NO: 159839 - RNA, 64 nt, Human
aucaggauucccuugaaagcccaggcagggugagcagucccagugguccuagugccgcaucaga

SEQ ID NO: 159840 - RNA, 64 nt, Human
gaagccaaccccccugcagcacaaauaggccccccagucccagccgugugcuggcagauagggu

SEQ ID NO: 159841 - RNA, 64 nt, Human
cugccaacuccugccgcccucugggacugccccucagucccaggagagcuaugaggccucacug

SEQ ID NO: 159842 - RNA, 64 nt, Human
cuugaaguugaaggcucuguggcuaucugacaaccagucccagccccugcuuacauuccagaca

SEQ ID NO: 159843 - RNA, 64 nt, Human
uaggauaacacuggugucugauggugaggcugcccagucccaucaggagccucagccaaggagg

SEQ ID NO: 159844 - RNA, 64 nt, Human
ugucaagaagccucuccacacucuguggcacuuccagucccauaaauccuguuucuuauccacu

SEQ ID NO: 159845 - RNA, 64 nt, Human
aacaaaucauacuccccagucaagacuucccugacagucccacuacgagaaagcugugguggga

SEQ ID NO: 159846 - RNA, 64 nt, Human
ccugcccagcucccgcacccugcguuuaggaguucagucccacagaggccacuggguucccagu

SEQ ID NO: 159847 - RNA, 64 nt, Human
aaccugcugacuucccucuggauucuucugcaaccagucccagauauugugccauuuuauccau

SEQ ID NO: 159848 - RNA, 64 nt, Human
uucugcagcaaccuggcucugugugguguuuucccagucccauauuauguccagucauacuucu

SEQ ID NO: 159849 - RNA, 64 nt, Human
ugggugggcaccugagagauuaagacuauucucccagucccacuaccagcacccccgaucccug

SEQ ID NO: 159850 - RNA, 64 nt, Human
aacaaauagcaccuguguuguuugugagcuguuucagucccaguccugaugugugugcguuguu

SEQ ID NO: 159851 - RNA, 64 nt, Human
acccacaguggagucgaccuaggccuuucuccagcagucccagucgccauugcuuuuucagcca

SEQ ID NO: 159852 - RNA, 64 nt, Human
aaccuuguuuguauagcacuuucucaagagcugucagucccacauacagaaucauuucuuuuac

SEQ ID NO: 159853 - RNA, 64 nt, Human
cuugucccauucugggauggggaauuuguccuuacagucccacucuggagcacugucugaagau

SEQ ID NO: 159854 - RNA, 64 nt, Human
uuuauacauucaacucaugauucacauguggcaucagucccaucagccggaacuagccuagaca

SEQ ID NO: 159855 - RNA, 64 nt, Human
aauucuacacaguacuuagauuuuuuuuacuuuccagucccaggaagugucaauguuuguugag

SEQ ID NO: 159856 - RNA, 64 nt, Human
uuuuuuagacggaauuaguccuuggcuucccucccagucccagcccugcuuccggcugcgaaug

SEQ ID NO: 159857 - RNA, 64 nt, Human
ccuucggacucugaaucugggcaggaagaguccucagucccaagaccaggagggggcaaugggc

SEQ ID NO: 159858 - RNA, 64 nt, Human
caucgucugcgucuguggucugugucgcuguccccagucccaccgcaguccugccgcaggccua

SEQ ID NO: 159859 - RNA, 64 nt, Human
aacacuuaaaaauuauccggguaccgugcaugugcagucccagcuacucaggaggcugaggcag

SEQ ID NO: 159860 - RNA, 64 nt, Human
cuaaaaauuagccaagugugguaauguucaccugcagucccagcuacuugggaggccaaggcac

SEQ ID NO: 159861 - RNA, 64 nt, Human
uaugcuucccguagccguggcuuuucauucugcacagucccaggucccagcuccccucuuaugg

SEQ ID NO: 159862 - RNA, 64 nt, Human
aacucuaggauuucuuuuuucuguguacguagaccagucccaucaguguauaaucucucucuca

SEQ ID NO: 159863 - RNA, 64 nt, Human
gagcagaccaaaaucagcccuagagccaaccagucagucccaaagcugugaccucugugccacu

SEQ ID NO: 159864 - RNA, 64 nt, Human
agaaaccuuagccaggcgugguggcacaugccugcagucccaguuacuugggugccugaggcag

SEQ ID NO: 159865 - RNA, 64 nt, Human
uuugguaucugcccuuugugugcuucacaagaggcagucccaugggaggugggucuggccaaug

SEQ ID NO: 159866 - RNA, 64 nt, Human
uguuucucauucuaaaauaugcauuauaauuuagcagucccauuugugauuuugcauauuuuua

SEQ ID NO: 159867 - RNA, 64 nt, Human
aauaacgcauguccauuuuagaaaauuagaaaaucagucccaccacccaaagauuauugugcau

SEQ ID NO: 159868 - RNA, 64 nt, Human
ggagcaggucaacccccaccggaccuacaacccgcagucccacaucaucucaggcgggcuggcc

SEQ ID NO: 159869 - RNA, 64 nt, Human
aacuuugaguaaauccuuuguccuauauugaauccagucccaaaguguucaggugaguuucucu

SEQ ID NO: 159870 - RNA, 64 nt, Human
guaccaguucagauucugccuguuuucaagauggcagucccaaacccaacaacuguuggccaca

SEQ ID NO: 159871 - RNA, 64 nt, Human
gggaggcggaggugacuggcuggcugucuugcaucagucccaggccucggccaggggagccagc

SEQ ID NO: 159872 - RNA, 64 nt, Human
ccaaauaguuuuuaaagaucucggugcugaacgacagucccaguucccauuugugucccauugu

SEQ ID NO: 159873 - RNA, 64 nt, Human
ccguccccugccccacaagauucaccugggccuccagucccacgcuggccccaacugcugcagc

SEQ ID NO: 159874 - RNA, 64 nt, Human
acagcccagaaaccagaagccccuauagaggccccagucccaacuccaguaaagacacucuugu

SEQ ID NO: 159875 - RNA, 63 nt, Human
agcgcagacugcaggacugaccccucacuugaccagucccauucagauccggcuuggacaggc

SEQ ID NO: 159876 - RNA, 64 nt, Human
accuagcuccgaguugaacugugcgucagcacuccagucccaucaccugaaccuucagucuccc

SEQ ID NO: 159877 - RNA, 64 nt, Human
cccaaagucugagauggauugcauauacagugugcagucccagagccuccuaaaauucuagcca

SEQ ID NO: 159878 - RNA, 64 nt, Human
guguagccuccaccugauauucaggcuacucauucagucccaaauauguauuuuccuaaguguu

SEQ ID NO: 159879 - RNA, 64 nt, Human
gcuccccugggugaugggugggcccagaagguggcagucccacaccuuguccucccaccucccu

SEQ ID NO: 159880 - RNA, 54 nt, Human
aggugccuacggugaacugaaguccagucccaccaggacccagacgccucccug

SEQ ID NO: 159881 - RNA, 64 nt, Human
acuuaaaaaauaauuccaggguucccuggaaaaccagucccaggguuccuaugaucuguaguuu

SEQ ID NO: 159882 - RNA, 64 nt, Human
gcuucucucucucucacacacacacacacacacacagucccauuugcauaucacccuucccugc

SEQ ID NO: 159883 - RNA, 64 nt, Human
acuauucagaggaaaaacagaggaugcugaaguacagucccagcacauuuccucucuaucuuuu

SEQ ID NO: 159884 - RNA, 64 nt, Human
uuccugucacccgccuggcaggcagaaggagcugcagucccacgugggccugccugggggggug

SEQ ID NO: 159885 - RNA, 64 nt, Human
cagcagccaauuauccggccuuccauaggggguucagucccaaagacauggggcuuugaaaacc

SEQ ID NO: 159886 - RNA, 64 nt, Human
ggcggugaggaguccagcacaaccuuuuccucaccagucccaugcuggcugaagaggaccagag

SEQ ID NO: 159887 - RNA, 64 nt, Human
aaaaaaccaauugaggguagugaauguaagaagacagucccagaaguaaacccucacugugaau

SEQ ID NO: 159888 - RNA, 64 nt, Human
augaccuuaaggguuacaggcaggcugcacacagcagucccaggcccugugaggggcuucagac

SEQ ID NO: 159889 - RNA, 64 nt, Human
acccaaaugccguaaucuuaaagaaaagcaaaugcagucccaguccucugaaugggucagcccc

SEQ ID NO: 159890 - RNA, 64 nt, Human
gcagccugcacuuugcacaugcucacccccagcacagucccacuggccccucaccuccccuucc

SEQ ID NO: 159891 - RNA, 64 nt, Human
ucauggaccagacucugcacccggugagugaggacagucccagcugagucccaucgauguugaa

SEQ ID NO: 159892 - RNA, 64 nt, Human
uaagaaaaagagugguucuggaaucaauguuuuccagucccaucccagaacaucaguuguaaga

SEQ ID NO: 159893 - RNA, 64 nt, Human
gauacauauauuuuuauuuugaccuaaauuuguacagucccauuguaaguguuguuucuaauua

SEQ ID NO: 159894 - RNA, 64 nt, Human
ugcaugacuucucguagauaacuucacagucauccagucccaacaccugcucuugccugguagg

SEQ ID NO: 159895 - RNA, 64 nt, Human
ccaucccgcauacccaucuucucgggcuucagcccagucccagcugaggaacaagccagugggg

SEQ ID NO: 159896 - RNA, 64 nt, Human
uccauuuuccuacaggcagucucucucuuccucacagucccacugugcaggugcuauuguuacu

SEQ ID NO: 159897 - RNA, 64 nt, Human
ggaagugaagagucuauugguuuuuacuucuaggcagucccaauuuuuaaaggcagagaaguau

SEQ ID NO: 159898 - RNA, 64 nt, Human
acggggcaguggcaaccuugucucuaugccagcucagucccaucagagagcgagcgcuacccac

SEQ ID NO: 159899 - RNA, 64 nt, Human
uaccuggggucgucgagaggcugcgggcuggcggcagucccaggggagagacaccacagaagga

SEQ ID NO: 159900 - RNA, 64 nt, Human
ugcuaauauaauagaugacaguggcaacugaaaacagucccagaaugaccccaucgagaugaaa

SEQ ID NO: 159901 - RNA, 64 nt, Human
uugcaccugggacccaggcccuuucuuugggauccagucccagccuucauccaugugauuaaga

SEQ ID NO: 159902 - RNA, 64 nt, Human
auuugguuuauuaugcggaucuuuuuuauauaugcagucccaucccuucugugccacucaaugc

SEQ ID NO: 159903 - RNA, 64 nt, Human
cugugcguggggcucccgccuccaaccccucgcccagucccagcagccagccaaacacacagaa

SEQ ID NO: 159904 - RNA, 64 nt, Human
uguuucuuauuuuaaaauucucugcuacugggcucagucccaggcccuuccuugggcuucuggg

SEQ ID NO: 159905 - RNA, 64 nt, Human
agccugcuguugauaccaugaagacugggcgccucagucccagcccuguagcugugugucuugg

SEQ ID NO: 159906 - RNA, 64 nt, Human
cccugccagccuaugaguucccagaggguuggggcagucccaugaccccaugucccagcucccc

SEQ ID NO: 159907 - RNA, 64 nt, Human
ugaccacuaauguucuagcugauggugagcggcacagucccacuuccccaucuccccaaguagg

SEQ ID NO: 159908 - RNA, 64 nt, Human
aggcagagcuugucauccccagccuggugucccgcagucccaggaagccgcuucuugccuucau

SEQ ID NO: 159909 - RNA, 64 nt, Human
ugacucugugcugagcacagagaaaagucaggugcagucccaguccuugagauuucccaguuua

SEQ ID NO: 159910 - RNA, 64 nt, Human
ggcugcagggugagcagcgugggcugcagugugucagucccaggagugagggaguggcaagcac

SEQ ID NO: 159911 - RNA, 64 nt, Human
cagccuguaccccagcccugcagcaggaagcccccagucccagcccuuugggacuguuuuaacc

SEQ ID NO: 159912 - RNA, 64 nt, Human
ggaagccccucgugcagccccuccuuagcacauccagucccagcguggcccuuggcgcgcagca

SEQ ID NO: 159913 - RNA, 64 nt, Human
uguuggagccugcaggguggugcugggacugagccagucccaggggcauguauuggccuggagg

SEQ ID NO: 159914 - RNA, 64 nt, Human
uuuuaguagugccucuaagcaagcaccgaugagucagucccacguauuuucuuuuuugucagua

SEQ ID NO: 159915 - RNA, 64 nt, Human
aguaguuuucauaaaacucauggcucugauugcacagucccacuugcuuuugauauugcuaugu

SEQ ID NO: 159916 - RNA, 64 nt, Human
gcccccuugcuucacucuaccggacagacggcagcagucccagcucugguuuccuucucgguuu

SEQ ID NO: 159917 - RNA, 64 nt, Human
cccacugcuucgugauuccagggccagagccaugcagucccagaaaccccaaccuagcuggggc

SEQ ID NO: 159918 - RNA, 64 nt, Human
caaguggaaagaggcugggguucccauuugacuccagucccaggcagccauggggaucucgggu

SEQ ID NO: 159919 - RNA, 64 nt, Human
ggggccucccacaccuucuccagcgaggaggucucagucccagccucgggagggcaccuccuuu

SEQ ID NO: 159920 - RNA, 64 nt, Human
ugguucauuacccuccccuacucagacugagcagcagucccagauaaccaagcaagcucagcuc

SEQ ID NO: 159921 - RNA, 64 nt, Human
uaucuucccuccggccacugggcuaccucuccuucagucccagaagacaagucucaccaaccca

SEQ ID NO: 159922 - RNA, 64 nt, Human
gagccugugacacuggcuaugugcuccacaguuucagucccaggucauacucuccaacaguuuu

SEQ ID NO: 159923 - RNA, 64 nt, Human
aguuagaaaaauuggccucagugugaaauuuuuccagucccauagcucauggaugccaccagcu

SEQ ID NO: 159924 - RNA, 64 nt, Human
uccaagggagagugagaccuggcagccacaacugcagucccauccucuugucagggcccuuucc

SEQ ID NO: 159925 - RNA, 64 nt, Human
ccccucucuuccuacccuuccucaccacuucccucagucccaacuccuuuucccuauuuccuuc

SEQ ID NO: 159926 - RNA, 64 nt, Human
ucccucucucucccaggucccagccccuuuuccccagucccagacaauuccauucaaucuuugg

SEQ ID NO: 159927 - RNA, 64 nt, Human
ccaggaaagguuuuccuuauuuugugugcuuucccagucccauuccucagcuucuucacaggca

SEQ ID NO: 159928 - RNA, 64 nt, Human
gguuucuauccuuccagaaaaauugggggagcugcagucccaugcacaagaugccccagggaug

SEQ ID NO: 159929 - RNA, 64 nt, Human
gacuauauuaaucaccuucuuuguaaucccuucacagucccagguuuagugaaaaacugcugua

SEQ ID NO: 159930 - RNA, 64 nt, Human
gccccagccgcuuggcgaugccagccaagcucugcagucccagcggugggaccuagggaggcau

SEQ ID NO: 159931 - RNA, 64 nt, Human
ugaggcgagaagggcugcuucccugaagcucccacagucccaucugcuucaggcccccgccuug

SEQ ID NO: 159932 - RNA, 64 nt, Human
gggacagagucuggaaagcuggucuucaggcucucagucccaggcugggcaggcacggucacuu

SEQ ID NO: 159933 - RNA, 64 nt, Human
agggaugccagcgauugcucuuuucaaaaccuaccagucccacuguggguggagaaauaaaugg

SEQ ID NO: 159934 - RNA, 64 nt, Human
gaacacccugggguuggcccagaaggaggcacaucagucccaaaauucaucacuuaacccagcg

SEQ ID NO: 159935 - RNA, 64 nt, Human
acaaaaauuagccaggcaugguggcgugcgccugcagucccagcuacuugggaggcugaguugg

SEQ ID NO: 159936 - RNA, 64 nt, Human
gugaaaauagcaggacuuguuuccauccuagaagcagucccaugugcuucuagcuggaaggagc

SEQ ID NO: 159937 - RNA, 64 nt, Human
cggccccuacucacauuuccuuggguuggagcaacagucccagagagggccacggugggagcug

SEQ ID NO: 159938 - RNA, 64 nt, Human
aaccccuggaccaucugaauggagcagccaaguucagucccacauuucuguacuguuccucuuu

SEQ ID NO: 159939 - RNA, 64 nt, Human
aagcuaggccucugaucauagaagcagauagcuucagucccagucuaggccuagauaaaugacu

SEQ ID NO: 159940 - RNA, 64 nt, Human
acaaaaauuagcugggcaugauggcacgcaccugcagucccagcuacuugggaggcugaggcag

SEQ ID NO: 159941 - RNA, 64 nt, Human
ccucagagccacuccgcuccauaucaguaucucacagucccauccuuccaaccuucuggccaga

SEQ ID NO: 159942 - RNA, 64 nt, Human
gagcuacaagcacugaagugcugccgccagcucucagucccacagcucucaggccccucucugg

SEQ ID NO: 159943 - RNA, 64 nt, Human
cuuuccaagucaagaaaugcuuugucugucacuacagucccaaccccauuuccucucccuguug

SEQ ID NO: 159944 - RNA, 64 nt, Human
ccuccaaacuccugccuguguuuguguggauacccagucccagaaccacacuguugaguuggac

SEQ ID NO: 159945 - RNA, 64 nt, Human
auuucaagcggacaaagcacaaguggcgaaucaucagucccacccugcuagcagaauaugccua

SEQ ID NO: 159946 - RNA, 64 nt, Human
ucagaauucauaauuccugagggguguuaagaagcagucccauuggugaggauauuaugacuug

SEQ ID NO: 159947 - RNA, 64 nt, Human
aaaguauuuuggauucagagaagagcucccuuaccagucccacccugaucucauggcugucucu

SEQ ID NO: 159948 - RNA, 64 nt, Human
aucauacaucuuggagaaccuuucuuacucauuucagucccaucuaaaaaugugucagcuauuc

SEQ ID NO: 159949 - RNA, 64 nt, Human
ccuggacugggcccugauucucccucuggguaaccagucccaggugaaccacaccauccugcag

SEQ ID NO: 159950 - RNA, 64 nt, Human
aaauacaaaaauuaggcauaguggugcacgccugcagucccagcuacucaggagguugaggcag

SEQ ID NO: 159951 - RNA, 64 nt, Human
cacggagcaggcauugugaacuggcugguguuugcagucccacguggcauggccuccagcccaa

SEQ ID NO: 159952 - RNA, 64 nt, Human
gguauaguggaaugagugugagcaucgggcuuugcagucccauagaacagaaaugggaugcuag

SEQ ID NO: 159953 - RNA, 64 nt, Human
gaccauguuggccgggcgcgguggcucacgccugcagucccagcacuuugggaggccaaggcgu

SEQ ID NO: 159954 - RNA, 64 nt, Human
acaaaaauuagccagggguggugguaugcaccugcagucccagcaacaugggaggcugaacagg

SEQ ID NO: 159955 - RNA, 64 nt, Human
accuugcuuguccacagcagccagucacccuggccagucccacuuccuggauaauucucuaccc

SEQ ID NO: 159956 - RNA, 64 nt, Human
auaaggcuggggaggcccgaaguccgcuagagcacagucccauccaggcugaugccaagcaccc

SEQ ID NO: 159957 - RNA, 64 nt, Human
aagggccaggagguucuggaggccccuucacuuccagucccauagcggggcucagcuauuuuuc

SEQ ID NO: 159958 - RNA, 64 nt, Human
gggcacacaggugacuuucuccuccaaccuccaucagucccagggccccuccugaggaugcucg

SEQ ID NO: 159959 - RNA, 64 nt, Human
ggacccuguccugcagucccacacugugcagacccagucccacacuguggccaggccuuacauc

SEQ ID NO: 159960 - RNA, 64 nt, Human
cuccuggcagggccaccugcaggacccuguccugcagucccacacugugcagacccagucccac

SEQ ID NO: 159961 - RNA, 64 nt, Human
cgcuuccucccucacgucugauguccugaaggugcagucccaccuguacagccccuccccgccc

SEQ ID NO: 159962 - RNA, 64 nt, Human
cccccaaauagguauauauagacugcagaagcuucagucccauauauaaacguucaugucauuu

SEQ ID NO: 159963 - RNA, 55 nt, Human
uuaggcgcaaaaagccaugaacugacagucccaguacugaaagaacauuuucauu

SEQ ID NO: 159964 - RNA, 64 nt, Human
ucaguguccuucuagcuuuagccgagaaagaaaccagucccagggaaugaaugguggucucccc

SEQ ID NO: 159965 - RNA, 64 nt, Human
ucugcagcagcagccagaccaguagcuggagccccagucccacaaggagcuuggaugugcggac

SEQ ID NO: 159966 - RNA, 64 nt, Human
uuuggggguggaaggacuugacaugaaaagaagccagucccaugacuuuggaugacaaacugcc

SEQ ID NO: 159967 - RNA, 64 nt, Human
aagguugcaucugcaggaugccuugauaacuacacagucccaaauaaaaggccuuuuucuaacc

SEQ ID NO: 159968 - RNA, 64 nt, Human
agcacugaaagucucuugccccaggaaaccccaucagucccaggcagauugggacagcugguca

SEQ ID NO: 159969 - RNA, 64 nt, Human
ucugagagugucuccaaugccugucugacaaagacagucccagcccauucuccugucuggcugg

SEQ ID NO: 159970 - RNA, 64 nt, Human
gcugagacaccuccuguuucccuuccccuugaaccagucccaguguccccuugcuccaggcuac

SEQ ID NO: 159971 - RNA, 64 nt, Human
aggcccccucucuccccaucucuggucucaaagccagucccagccugaccucucaccacacgga

SEQ ID NO: 159972 - RNA, 64 nt, Human
uugaaguagcagccuuggcugacuuuccagagcccagucccaagccuggcaccaagccugaggg

SEQ ID NO: 159973 - RNA, 64 nt, Human
caguucuggcggccagauguggugcucuggaauccagucccauuuccuuccuggccacgccugu

SEQ ID NO: 159974 - RNA, 64 nt, Human
uuucagcccagggugcucauccaggggcccagaacagucccaccugugcugcugugcccacagc

SEQ ID NO: 159975 - RNA, 54 nt, Human
agccaccgccgaacucgugacacgcagucccaagggucgcucaaagcucagacu

SEQ ID NO: 159976 - RNA, 64 nt, Human
uggggguggagggaccuugccaggaugaaccccccagucccaggcacccucuagcucccucagc

SEQ ID NO: 159977 - RNA, 64 nt, Human
cuccuucagacauugacaugagaucuuaagcaaacagucccaaaccucuuaggggugaaaaaag

SEQ ID NO: 159978 - RNA, 64 nt, Human
cccugccucuccaccugcacccugcuuccuggcccagucccagguuggagucccucugcauagc

SEQ ID NO: 159979 - RNA, 64 nt, Human
caggucaagccuugucccuuccuccucccagcaacagucccaacaagcaggcuucugagagccc

SEQ ID NO: 159980 - RNA, 64 nt, Human
ggaggcaacucgucacacccaagcugcuggccuccagucccaucucccccaacacaugugcccc

SEQ ID NO: 159981 - RNA, 64 nt, Human
acauucaucccuuugguuugggaucucaggaauacagucccaugcaaagauucucugguuuuau

SEQ ID NO: 159982 - RNA, 64 nt, Human
acugcugggggugaggacacauugccccaugagacagucccagaacacggcagcugcuggcugu

SEQ ID NO: 159983 - RNA, 64 nt, Human
uuuagucaacuggcccaaggcagcgaggcuucuacagucccacaccccauagccgccugggcug

SEQ ID NO: 159984 - RNA, 64 nt, Human
ccccaaggagcgccgcccccugcuccacagcgcccagucccaucgaccacccaagggcugagga

SEQ ID NO: 159985 - RNA, 64 nt, Human
ggaagugucaggugauuuccuagggagagguucccagucccagcaggcagaaugcccaaaacca

SEQ ID NO: 159986 - RNA, 64 nt, Human
uaguugcuuugaguugcaauugcuauuuucuucucagucccagcucagaucgaauuauauaucc

SEQ ID NO: 159987 - RNA, 64 nt, Human
aaugcgcuggcugccucccugugcgugucuggaacagucccauuaggagaggugacgucauuug

SEQ ID NO: 159988 - RNA, 64 nt, Human
uugcuaaacugaugacuuacuaugggaugggguccagucccaugaccuugggguacaauuguaa

SEQ ID NO: 159989 - RNA, 64 nt, Human
agagguugcugaggcugcuguggaccaguugcugcagucccaugaagaagaucucucaaaugag

SEQ ID NO: 159990 - RNA, 64 nt, Human
gcucugugcugugucccuucugagggucccuuugcagucccaguauauugugcgugcaccagcc

SEQ ID NO: 159991 - RNA, 64 nt, Human
accagcaguuugggagugccguccacgacccugacagucccagcccugcugccccauggccacg

SEQ ID NO: 159992 - RNA, 64 nt, Human
gaagcccugucuucacaacacaggcacacaauuucagucccagccaaagcagaagggguaauga

SEQ ID NO: 159993 - RNA, 64 nt, Human
gcggaaagacucccaaaaugugccaagaauuucccagucccaggcagggcaggggaaacuaagg

SEQ ID NO: 159994 - RNA, 64 nt, Human
cacccacucaugcuguuccugaggccgcccucuccagucccaggagccgugucuagaguuccug

SEQ ID NO: 159995 - RNA, 64 nt, Human
gcaccgugguggaggaagucacccagcuguuucucagucccagaggccgguggcugguuuugaa

SEQ ID NO: 159996 - RNA, 64 nt, Human
ucaguccccucccaucccccacgcagcuccaccccagucccaagccaccagcugucugcuccug

SEQ ID NO: 159997 - RNA, 64 nt, Human
uccaggggaugauuucuggcucuuugucuccaaucagucccacucccuccugagguccccaagg

SEQ ID NO: 159998 - RNA, 64 nt, Human
agggcaccuugugccuagacuagggcugccuggucagucccaggugaggccaagggcuuucugg

SEQ ID NO: 159999 - RNA, 64 nt, Human
cagaguggccugugagcaagagccaggggugucccagucccagccucuggggcagagcuuguag

SEQ ID NO: 160000 - RNA, 64 nt, Human
ccgagugacugaauuccuccagcaaaagcugaagcagucccagcugcuggcuuugaagaaagag

SEQ ID NO: 160001 - RNA, 64 nt, Human
guucaaugaccuggucccuuagagcuccauaucccagucccagcccuucuuugcagcugggccu

SEQ ID NO: 160002 - RNA, 64 nt, Human
gaaagcuguguuccaaugaauccuaccucuugcccagucccaggcagaguaagcagggcccacc

SEQ ID NO: 160003 - RNA, 64 nt, Human
cccaaggaugguugcuguuagcagaggauuggugcagucccagcugaagcccacugugugccaa

SEQ ID NO: 160004 - RNA, 64 nt, Human
agaaauggccuccucccuccauccugggaagucccagucccauccuggugugagaaucaaccag

SEQ ID NO: 160005 - RNA, 64 nt, Human
ugagaagucauaauaucuggcacuaguaggucuacagucccauauguuggcagcuggagccgaa

SEQ ID NO: 160006 - RNA, 64 nt, Human
ugauguauugugcccaagccaggagcugcuugggcagucccagcuccacacuggcccugagccc

SEQ ID NO: 160007 - RNA, 64 nt, Human
gaaugugagaugagguucucaaggucacaggccccagucccagccugggggcuggcagaggccc

SEQ ID NO: 160008 - RNA, 64 nt, Human
cacaaaaugaagaccuuucccuccaccacugaugcagucccaccgaaagccuccaucugcucca

SEQ ID NO: 160009 - RNA, 64 nt, Human
cuuguucugguggagcugggguuucucuccuccccagucccacaacacugccaaaaaucugugu

SEQ ID NO: 160010 - RNA, 64 nt, Human
gagagugaggacccuaccauccacuguccauauucagucccagccccagugcgcuuccucuguu

SEQ ID NO: 160011 - RNA, 64 nt, Human
acagugcugcgcuagucccuucugccacccuucccagucccaggacgggcccuggagggagaaa

SEQ ID NO: 160012 - RNA, 64 nt, Human
aucaucacaaacaucuaucuuuugcuguccuguccagucccaucaacuccacacugugccauuu

SEQ ID NO: 160013 - RNA, 64 nt, Human
cucuuccgggagcuggugacagccuugggccuuucagucccaaagcggccgaugggagucuccc

SEQ ID NO: 160014 - RNA, 64 nt, Human
gacagcacacggugagggugcggggccugcaggccagucccacggcucugugcccggugccauc

SEQ ID NO: 160015 - RNA, 64 nt, Human
ccuguguccuggguguguaccauaccugcugggccagucccacacauuuccacccugccccugg

SEQ ID NO: 160016 - RNA, 64 nt, Human
gauugccccaggucugggaagcugagggcaaauccagucccaaugguccugacuuugggcgcug

SEQ ID NO: 160017 - RNA, 64 nt, Human
uuuuauauuucacaacuauagacagucacuucugcagucccaauuuaaaaaugcagaacugcuu

SEQ ID NO: 160018 - RNA, 64 nt, Human
aacauaaaucucuccuuggcuauuuuaauagccacagucccaaacuucaucccagcuuagauuu

SEQ ID NO: 160019 - RNA, 64 nt, Human
ugcaguacaaauugaaaugggucggcucuagccccagucccauuggaagguuaaaaacuggagu

SEQ ID NO: 160020 - RNA, 64 nt, Human
cccugcagggcccaugcaccagagccacugagcccagucccauaaaccuggcccucuuugggga

SEQ ID NO: 160021 - RNA, 64 nt, Human
ugucucuuauggauguccccagcagagagguuugcagucccaagcggugucucuccugccccuu

SEQ ID NO: 160022 - RNA, 64 nt, Human
cauuauuaagaaaaaaagauuuauuuauuuaagacagucccaucaaaacuccugucuuuggaaa

SEQ ID NO: 160023 - RNA, 64 nt, Human
guaggaagcagcagcucugcuggacugggcucagcagucccauuugggauguaagccucuauug

SEQ ID NO: 160024 - RNA, 64 nt, Human
gggggucuccuuaaaugccaccucgggcaagucccagucccaguccucggccacccccagcucu

SEQ ID NO: 160025 - RNA, 64 nt, Human
gccgcggcagccugagcaccggggggugccccuccagucccagacggcaauguuccucccucca

SEQ ID NO: 160026 - RNA, 64 nt, Human
uggaguguguguguguguuuccaugguaggacuccagucccagcugcugccuaggcuccugugg

SEQ ID NO: 160027 - RNA, 64 nt, Human
aucucccuuuguggaacuccgagagccgcccugacagucccagccgccacccaaggagccccau

SEQ ID NO: 160028 - RNA, 64 nt, Human
gagccccuccacccccaaauccuuccucuccucccagucccaccccuugccccacggaguccug

SEQ ID NO: 160029 - RNA, 64 nt, Human
ccgacggccuccaggaggggccugggcagccccacagucccauuccuccacucuguaucuaugc

SEQ ID NO: 160030 - RNA, 64 nt, Human
ccuguaucacagccgccuacgcccaccuaguggccagucccagagccgcauggcagacagcuua

SEQ ID NO: 160031 - RNA, 64 nt, Human
aggcccagccucacaggccuguggccccacacaccagucccagcaaggugaccacggcugcugg

SEQ ID NO: 160032 - RNA, 64 nt, Human
cagccccucagccucaucuggagccccugaagaccagucccacccaccuuucuggccucaucug

SEQ ID NO: 160033 - RNA, 64 nt, Human
uacaaaccacagcaugcccggcuccucccagaaccagucccagccugggaggaucaaggccugg

SEQ ID NO: 160034 - RNA, 64 nt, Human
ccccucccuguccaggccccgcaggaggcagaugcagucccaggcauccuccugccccugggcu

SEQ ID NO: 160035 - RNA, 64 nt, Human
ugacuucguaccugcucaggagcccccacugucccagucccacucaggcccaucucuggcuggc

SEQ ID NO: 160036 - RNA, 64 nt, Human
uucacggaagccaggaaucaaacugccuggguuccagucccagcucugccaguuaugcccagcu

SEQ ID NO: 160037 - RNA, 64 nt, Human
gcugcugcccaauaaaccugucugcccuuuggggcagucccagccaccugugcuguugucuguc

SEQ ID NO: 160038 - RNA, 64 nt, Human
gccaacaucaguggcagcagccagggccgugguccagucccacucggggauggagugggccggc

SEQ ID NO: 160039 - RNA, 64 nt, Human
aagauggccaugacucuguguaagacagagggcacagucccaugucaugcagaggugacagggu

SEQ ID NO: 160040 - RNA, 64 nt, Human
uccggugguucaaucgcuccgccuguccccaacccagucccauuuuuauggccaaacugauucu

SEQ ID NO: 160041 - RNA, 64 nt, Human
acagggccucuuugggacuucagaggaaaucucccagucccacucucggaggguuaagagaagg

SEQ ID NO: 160042 - RNA, 64 nt, Human
acguuucuuaugaauguguacauugcaguauauucagucccaaauguuuuguucucauucacac

SEQ ID NO: 160043 - RNA, 64 nt, Human
uucaguuuuggcugggcaugauggugagcgccugcagucccagcuacuugggaggcuaagccca

SEQ ID NO: 160044 - RNA, 64 nt, Human
aagaacccugcaccggcuggcgugugcgacggcccagucccauccagagcauggagcccgaccc

SEQ ID NO: 160045 - RNA, 64 nt, Human
aagaacuuugagggucgagcagcaggggcccauucagucccagggagcagagacccccccaacc

SEQ ID NO: 160046 - RNA, 64 nt, Human
caggcucggagacgaggggagaaguuugggguuucagucccagggcuuagccggaggaagcaca

SEQ ID NO: 160047 - RNA, 64 nt, Human
caaagugaccuacccagagauugcuucucauccccagucccaaugcacauccauucccaagaaa

SEQ ID NO: 160048 - RNA, 64 nt, Human
ugagaaaaugugguguagcuauuaaagauucaugcagucccaaaaggcacuguccugggaugau

SEQ ID NO: 160049 - RNA, 64 nt, Human
uuaggugcagcugugccacgggucagcugagccacagucccagaaccaagcucucggugucucg

SEQ ID NO: 160050 - RNA, 64 nt, Human
cagagaugcugcugcaacuggaagaagcuggaaccagucccagagaggcucggccuggaaacag

SEQ ID NO: 160051 - RNA, 64 nt, Human
gugguuuccgucccuuggggaccacaggcaucagcagucccauucaagucaccugaggcaaagu

SEQ ID NO: 160052 - RNA, 64 nt, Human
guggucacggcaaaggaagacgugaugccaggaccagucccagagcaggaaugggaaggaugaa

SEQ ID NO: 160053 - RNA, 64 nt, Human
augccauugagacuaguaacgggcguucugggcacagucccacugugcacagguuugagaggac

SEQ ID NO: 160054 - RNA, 64 nt, Human
uaggugguccccaacagugccuagggguacaguacagucccauuacacuagagcagggcucuau

SEQ ID NO: 160055 - RNA, 64 nt, Human
uggcuuaagaaggucgccuaagccuaagagaagacagucccaggagaagcuggccgggaccagc

SEQ ID NO: 160056 - RNA, 64 nt, Human
acugcugggcacacucuccagcucaauaaaccaucagucccagaagcaaaggucacacagcccc

SEQ ID NO: 160057 - RNA, 64 nt, Human
ugugugagcuccugccgguuucuuggcugucagucagucccagaguggggaggaagauaugggu

SEQ ID NO: 160058 - RNA, 64 nt, Human
aguuuggaaacuccggcggcugcgugcgggguuucagucccagcuguaggcuuguaaauacccg

SEQ ID NO: 160059 - RNA, 64 nt, Human
ggucccacccuguuccuggucccggucccggucccagucccaccaggcaacuccuuccacccgg

SEQ ID NO: 160060 - RNA, 64 nt, Human
accccgggcagguggcaccuggugacaccuccuucagucccacucagcugggcggccggggcag

SEQ ID NO: 160061 - RNA, 64 nt, Human
uaaaaggccaauuuuuguccaguuuucucucuuccagucccagcugaaauuaguggaaagaaag

SEQ ID NO: 160062 - RNA, 64 nt, Human
cuccgaccccagcgccaggcuccucggagcccaacagucccaagggggcaggagacgggguggu

SEQ ID NO: 160063 - RNA, 64 nt, Human
ugggcucucaaggucagaccaagguugcugaucucagucccacugucuucagccagcugaagcu

SEQ ID NO: 160064 - RNA, 64 nt, Human
uccucuccugcugucacagcugccauccacuucucagucccagggccaucucuuggagugacaa

SEQ ID NO: 160065 - RNA, 64 nt, Human; identical to SEQ ID NO: 84793

SEQ ID NO: 160066 - RNA, 64 nt, Human
gcuuccugacugaccugagcaaggucuuacuaagcagucccaucucugugggaggcaugcaacg

SEQ ID NO: 160067 - RNA, 64 nt, Human
ucccagagaguaugugagaaccaaccaaugaaaacagucccaucgcucuuacccgguaaguaaa

SEQ ID NO: 160068 - RNA, 64 nt, Human
gagcacugcccuaggagcccggaccccacgagcucagucccagcucugccucugacucgcugug

SEQ ID NO: 160069 - RNA, 64 nt, Human
uuggccauggcuuuccugcaagaccacugacgagcagucccauggugauaaagggcagcccggc

SEQ ID NO: 160070 - RNA, 64 nt, Human
gggaugcaagaacaacccguuucuuaaauguuaccagucccagccaaucuuacggugacauuac

SEQ ID NO: 160071 - RNA, 64 nt, Human
cccagcccagagccagggaagaggaagguggggccagucccaccagugggguggccacgcccau

SEQ ID NO: 160072 - RNA, 64 nt, Human
ggagcucugcccaggugcccuggggccagcaaggcagucccaggccugccgucuccagcacggc

SEQ ID NO: 160073 - RNA, 64 nt, Human
agggguggagggcagucccucagaaucccagaggcagucccagccucagaacccaggauaggaa

SEQ ID NO: 160074 - RNA, 64 nt, Human
cuccaaccuccggggcgaccuucucuuccagccacagucccaugagggccccuagccagggaca

SEQ ID NO: 160075 - RNA, 64 nt, Human
gcagaaaacacuacauaggccuccaaggcaaaaccagucccaguuucuuuaaugggaagaagcu

SEQ ID NO: 160076 - RNA, 64 nt, Human
ucccagagaguaucugagaaccaaccaaugaaaacagucccaucgcucuuagccgguaaguaaa

SEQ ID NO: 160077 - RNA, 64 nt, Human
caaacaacauuccaccccagcaggacagugaccccagucccagcuaacucugaccugggagccc

SEQ ID NO: 160078 - RNA, 64 nt, Human
acugccgcauguggaagcaucuacccguucacuccagucccaccccacgccugacuccccucug

SEQ ID NO: 160079 - RNA, 64 nt, Human
ggaaugccgugcggaugaacuucagcacccgagucagucccagcucauccuccccaguuuacca

SEQ ID NO: 160080 - RNA, 64 nt, Human
ucaccuugucccaguccacuccuaacacuagcaucagucccacucaucucaggcugagccacau

SEQ ID NO: 160081 - RNA, 64 nt, Human
ucucugagcagcuccuccccggagucccccagcacagucccaggagaugacaggaaggaagcac

SEQ ID NO: 160082 - RNA, 64 nt, Human
ccccacccuccugcccugugcccagguguugggacagucccacccucccugcuauuuauauccc

SEQ ID NO: 160083 - RNA, 64 nt, Human
uucugccuccucugaggaaucuggcccugucugacagucccagaccccccguucucuccucuuu

SEQ ID NO: 160084 - RNA, 64 nt, Human
uuggaccccugguccaggugaucccgacccucaccagucccauuugccucccuccagcucugcu

SEQ ID NO: 160085 - RNA, 64 nt, Human
guggggccacaucgccacuuccacgcccauggcccagucccagggccccaacacuauaccuugg

SEQ ID NO: 160086 - RNA, 64 nt, Human
uuacacagcugucauuuuucuuucaaaauugcagcagucccacagaugugugcauuuggacaaa

SEQ ID NO: 160087 - RNA, 64 nt, Human
ugcuuccguacuauggcuccaacagaaauaaaauacacaacacaaauaucacuuaacauuucua

SEQ ID NO: 160088 - RNA, 64 nt, Human
ugucuccuucacacaguccacgucaccacgaaucacacaacaaaaaggaggagagauauuuugg

SEQ ID NO: 160089 - RNA, 64 nt, Human
uggugaacugaauccagcacaggccuccccuguaacacaacaggacugagcagaaccaaacacu

SEQ ID NO: 160090 - RNA, 64 nt, Human
auguguaagagaggugagaagugcucccaagcagacacaacagcagcacagaggucuggaggcc

SEQ ID NO: 160091 - RNA, 64 nt, Human
gacuucccagaguguuaauauauaucagaaaugcacacaacagaaccauaggcaacaccaacac

SEQ ID NO: 160092 - RNA, 64 nt, Human
cugcagaaauguccuaugcacucuuugcaagagcacacaacaaaugucagauaccaauuuuugc

SEQ ID NO: 160093 - RNA, 64 nt, Human
gagagcugggauggggccagagauuauaaguuugacacaacaucugagacacuaggaugaauua

SEQ ID NO: 160094 - RNA, 64 nt, Human
uuagaguuuagcuauaauuguguauucucucuuaacacaacagaauucugcugucuagaucagg

SEQ ID NO: 160095 - RNA, 64 nt, Human
aaacuaggcaauguacucuuccgauguuugugucacacaacacugaugugacuuuuauaugcuu

SEQ ID NO: 160096 - RNA, 64 nt, Human
uacucuugaaaggccaacagcaaguguuugugggacacaacacagauaauuuuuucuuaagucg

SEQ ID NO: 160097 - RNA, 64 nt, Human
guuuuuguucucauuuaugccuuuguccauuugcacacaacagaaauuguaaugagcuucacua

SEQ ID NO: 160098 - RNA, 64 nt, Human
ucucggcuucugguuuuucuuucuuuuugguagaacacaacaucuaccauucaguuaaaccuuc

SEQ ID NO: 160099 - RNA, 64 nt, Human
ccagugucucuguagcccugacauaaggaacagaacacaacaaaacacagcaaaccaugugccc

SEQ ID NO: 160100 - RNA, 64 nt, Human
uccuggggccuagauucugcacuuggggucucugacacaacacaccaucccaaaguagccggaa

SEQ ID NO: 160101 - RNA, 64 nt, Human
gugaaagaauuccugauuucuccauggagcauguacacaacaauuuugaucauauuaacuguac

SEQ ID NO: 160102 - RNA, 64 nt, Human
acauucccaauucagugagaaaaauucaucugggacacaacaggguacucuucucuguuugccc

SEQ ID NO: 160103 - RNA, 64 nt, Human
gggaguuuccuuuuuuuacucuuugucacugaugacacaacagaaaagaaacuguagaccuugg

SEQ ID NO: 160104 - RNA, 64 nt, Human
aaaugagcacccuggcuggcugcaagcagcagcuacacaacacuacagagggcagccucccugc

SEQ ID NO: 160105 - RNA, 64 nt, Human
ugucuccuucacauaguccauaucaccacaaaucacacaacaaaaaggagaagagauauuuugg

SEQ ID NO: 160106 - RNA, 51 nt, Human
aacagugucugaucaugugaaacacaacacguuuuccucucugagucccag

SEQ ID NO: 160107 - RNA, 64 nt, Human
aguaaaugugaaccuugucuaaguacuguaauccacacaacacauuauaagaagcaaaccagca

SEQ ID NO: 160108 - RNA, 64 nt, Human
gugagcauuguagauucccccguugucacuaaucacacaacaauuuugagaaguaggcuauaaa

SEQ ID NO: 160109 - RNA, 64 nt, Human
agccacuugaacguguccuuuugaggagggugggacacaacaguacagaaauaagugcuaauuu

SEQ ID NO: 160110 - RNA, 64 nt, Human
aaaauacauuauguuuuuuuucuuuaaacaaaacacacaacauguaagcauguaagaguaaaga

SEQ ID NO: 160111 - RNA, 64 nt, Human
caguaaaucuuuuuuucuuccuucauauauauauacacaacacacacacacauauguauaucua

SEQ ID NO: 160112 - RNA, 64 nt, Human
ugcugaccuguuuuuguguuuuucuuuuuuuuauacacaacauuuauuucaaacuauugggagg

SEQ ID NO: 160113 - RNA, 64 nt, Human
cgagugaauucucuagaccuuggguacuuucaguacacaacaccccuaagauuucccagugguc

SEQ ID NO: 160114 - RNA, 64 nt, Human
caaggcacugaggccacagaugugaguaagcgagacacaacacuuguccucuuggagguuacau

SEQ ID NO: 160115 - RNA, 64 nt, Human
uuuagguggaagaagugagggugcagcgugucagacacaacauucauguuacucuuacauugga

SEQ ID NO: 160116 - RNA, 64 nt, Human
uccugucugccgacuauggagucuccaccuuuggacacaacacuuacucaccauuuacucuuua

SEQ ID NO: 160117 - RNA, 64 nt, Human
uuggagaucuuugcuuccuugcuuuuauguuuguacacaacaccuaaaaccaguuuugcugcua

SEQ ID NO: 160118 - RNA, 64 nt, Human
aacccauuacuaauaccuaacaggaaauagcuaaacacaacacaccuuaucuauuagucaccuu

SEQ ID NO: 160119 - RNA, 64 nt, Human
gcauuggcaagacauuguacagaugcaaccuuuuacacaacaucauuguguaauuuguaaagau

SEQ ID NO: 160120 - RNA, 64 nt, Human
gucuccugacuuccaguccagugcuccuucuacuacacaacacugccuaguugugggcugccuu

SEQ ID NO: 160121 - RNA, 64 nt, Human
cuuuauugugucuuaaaaacaaaagcgaauuaaaacacaacaaaaaaccccaccccacaaccuu

SEQ ID NO: 160122 - RNA, 64 nt, Human
acaauagauugcaugucauacuccauuugguucaacacaacaaccuauguguuaucauuacagc

SEQ ID NO: 160123 - RNA, 64 nt, Human
gggugcucacacacccccacacccacccacccacacacaacacugggacaauucagacacgaca

SEQ ID NO: 160124 - RNA, 50 nt, Human
cuuuuccccuucgggcauaaacacaacauauguaagcaacgcuacugguu

SEQ ID NO: 160125 - RNA, 64 nt, Human
ggucugaggcagaauccaagaucugccaggaaacacacaacaaaacaucugcuguccugggugg

SEQ ID NO: 160126 - RNA, 64 nt, Human
uacaucuaagcuguucccgaaagaguguuacagaacacaacaguauuguacaauauucgauaag

SEQ ID NO: 160127 - RNA, 64 nt, Human
ugaauguuauuuuaagccgagaguuaauuuuucuacacaacauauuuccagacaucuuuuaguc

SEQ ID NO: 160128 - RNA, 64 nt, Human
aagcacagagagaggaagagagcugcuuaaacucacacaacaaugaacugcagacacagcuguu

SEQ ID NO: 160129 - RNA, 64 nt, Human
aagcaaaacaaacaaacaaaaacaaauuuuaagaacacaacaaaaaagauuugacuuccgaaua

SEQ ID NO: 160130 - RNA, 64 nt, Human
cucucccucuccucagaccucacuauucucucagacacaacaguauugaaauuagaccaauuga

SEQ ID NO: 160131 - RNA, 64 nt, Human
augguuccauuuugcccaguguuguaccacaagaacacaacaccuugccaguaucucaggcacc

SEQ ID NO: 160132 - RNA, 64 nt, Human
uuguuaagauuggugcuuuugguaacuuguacugacacaacagacaugugcuaguaucugauaa

SEQ ID NO: 160133 - RNA, 64 nt, Human
aauagauuuguacuugaauaaggugaagaauuucacacaacauacaagaguaccauuguuccuu

SEQ ID NO: 160134 - RNA, 64 nt, Human
ugcuaaauauuuugcugaagaagcaguuucucagacacaacaucucagaauuuuaauuuuuaga

SEQ ID NO: 160135 - RNA, 64 nt, Human
aggaggcauuccacacaggcacugccccaggacaacacaacaaggacagucacaacaaggacaa

SEQ ID NO: 160136 - RNA, 64 nt, Human
cacaacaaggacagucacaacaaggacaacaaggacacaacacaacacacaacaaggacaguca

SEQ ID NO: 160137 - RNA, 64 nt, Human
caaggacagucacaacaaggacaacaaggacacaacacaacacacaacaaggacagucacaaca

SEQ ID NO: 160138 - RNA, 64 nt, Human
agucacaacaaggacaacaaggacacaacacaacacacaacaaggacagucacaacaagccuag

SEQ ID NO: 160139 - RNA, 64 nt, Human
aaaacccuauuuaagagacugaucacacacguauacacaacauuacugaaagaacccugcgaau

SEQ ID NO: 160140 - RNA, 64 nt, Human
augaagcuuaucugacacauaagcuucauaaggcacacaacagccuuuuuacccuuaggaacag

SEQ ID NO: 160141 - RNA, 64 nt, Human
ggcuuguaucuggaauauauaaauaacucuuauaacacaacaauaaggagaaaaauaaaucaau

SEQ ID NO: 160142 - RNA, 64 nt, Human
agcuaauucaugcacugcaauacucuauauacaaacacaacaaugcaaauucuucuucaagacu

SEQ ID NO: 160143 - RNA, 64 nt, Human
caaucacaaaagcugugucucuguauauagcucuacacaacauguauguggauacagucauuau

SEQ ID NO: 160144 - RNA, 64 nt, Human
uuccuguuaaugcaauuauagaaauacaucggagacacaacaaauguggccauuacagguuuca

SEQ ID NO: 160145 - RNA, 64 nt, Human
gaauccccuauuuuugcacaggggcagcagauacacacaacaaugagaacucagugacuuugau

SEQ ID NO: 160146 - RNA, 64 nt, Human
auggccuuagugaguccugccuuuccuagcaugcacacaacauccucucuuugaguuuggguuc

SEQ ID NO: 160147 - RNA, 64 nt, Human
gucaguuaauguagaaauuuaaauaguaaauaaaacacaacauaaucaaagacaacucacucag

SEQ ID NO: 160148 - RNA, 64 nt, Human
uuuaaccauuguauuuaauuucccaccuuaugaaacacaacagcagcucccugacugguucgcc

SEQ ID NO: 160149 - RNA, 64 nt, Human
ugagugcaagaucuucuaaaccccaagagacuucacacaacacuuauguaugcaccccaaagac

SEQ ID NO: 160150 - RNA, 64 nt, Human
gucaccugaaauaauacauugcagcaagcaauaaacacaacauuuuguaaaguuauuuuucaga

SEQ ID NO: 160151 - RNA, 64 nt, Human
aauuguauauucagugacuuacacuaugccuagcacacaacacacacugaguaaauauuuguug

SEQ ID NO: 160152 - RNA, 64 nt, Human
gacacccagauuccauuaaaaauucugcuaaucgacacaacacauauauuugcucaugauuuca

SEQ ID NO: 160153 - RNA, 64 nt, Human
auaaaauuauuugguuaugguuauguucaucuaaacacaacaauaacuuuuauauuaauauuua

SEQ ID NO: 160154 - RNA, 64 nt, Human
aguaaccacgggguccaucuuuuacaucugguacacacaacagacgcucaguuguucuuaacca

SEQ ID NO: 160155 - RNA, 64 nt, Human
guucaucuugaauuguaaggaaugauuaauuaaaacacaacaucuuuuucuacucgaguuacag

SEQ ID NO: 160156 - RNA, 64 nt, Human
auucucauaaauucaguguguacucagaacacauacacaacaacauagggaguuguaugacuga

SEQ ID NO: 160157 - RNA, 64 nt, Human
ucgaggaggaggcuguuauuuugggccugaugugacacaacaguugcuacaaaaauacaacaug

SEQ ID NO: 160158 - RNA, 64 nt, Human
acacgcagacacacacacacacacaaaugcagacacacaacaucaagaaaacagcaagggagag

SEQ ID NO: 160159 - RNA, 64 nt, Human
acauacuauauauguuacauacuaacauauauauacacaacagaaaguuuauuggauuuaguac

SEQ ID NO: 160160 - RNA, 64 nt, Human
ucugguuccucuaauacagugcuguccaauagaaacacaacagccacaaaugcaggccacagau

SEQ ID NO: 160161 - RNA, 64 nt, Human
ggagacugacacugaagaagcuuaaaaucacuucacacaacaaaguagcacaaagcaguuuaac

SEQ ID NO: 160162 - RNA, 64 nt, Human
ugaaaggaccuuuugucacagcacuucagaaaauacacaacagccccuucugcccccgcacaga

SEQ ID NO: 160163 - RNA, 64 nt, Human
cuucagcagaguuaauaugcuuuucugaugaauuacacaacaguuuguuaauucuucauucuug

SEQ ID NO: 160164 - RNA, 64 nt, Human
gggaguaaaauugccaaaucauaugagugaagauacacaacagcaaaucaucagggagacuuuc

SEQ ID NO: 160165 - RNA, 64 nt, Human
cuuaggggaggaguggccccagaauucagcacgcacacaacacacaagggagagaacccccaga

SEQ ID NO: 160166 - RNA, 64 nt, Human
accuccuggguccaagugauccucccaccucagcacacaacaccaugcccaauuuuaagugcgu

SEQ ID NO: 160167 - RNA, 64 nt, Human
uacaggaaggagaagaacagaauuucugcacacuacacaacaugugggcuuccuguagcuccag

SEQ ID NO: 160168 - RNA, 64 nt, Human
guaaccugcuuacaucuggacuuuagaaucuggcacacaacaaaagugccuggcauccacuacu

SEQ ID NO: 160169 - RNA, 64 nt, Human
ucuuuagauucuuguuuagaacuguugauuuugaacacaacauacacugucaaacuuuacauca

SEQ ID NO: 160170 - RNA, 64 nt, Human
cccaucccccacccccacacacacacacacaugcacacaacacauacacacacacgcacagagg

SEQ ID NO: 160171 - RNA, 64 nt, Human
uuggugggaaaauagguagaaaccaaggaagcagacacaacaugcauuuauggagauucuuuuu

SEQ ID NO: 160172 - RNA, 64 nt, Human
agucgagagccacugagggacccagcacucagagacacaacacacauguguagcugcuucuggc

SEQ ID NO: 160173 - RNA, 64 nt, Human
uggggccuggucagucuguccauccucggcaaggacacaacacugccccagagggugggaccac

SEQ ID NO: 160174 - RNA, 64 nt, Human
uuaaguacuuuauauuaacucauauaauaaauggacacaacacaaaacucaaaagguacaaaag

SEQ ID NO: 160175 - RNA, 64 nt, Human
gaagucuugaggaaauguaauuaaagauauuaccacacaacaucaaguggccuugaagagacug

SEQ ID NO: 160176 - RNA, 64 nt, Human
uacuuuucaugaucgauguguucgcauugcugaaacacaacagaagaaaaauggagugcuggga

SEQ ID NO: 160177 - RNA, 64 nt, Human
aggucacauuaaauacugacuugagcagugggugacacaacacaguguuugucuuccacaggga

SEQ ID NO: 160178 - RNA, 64 nt, Human
uaaucacauucacuuuacuugaaauuauguuguuacacaacaaauuguggggccuucaaauugu

SEQ ID NO: 160179 - RNA, 64 nt, Human
caagcuugaagguggcccaugcuucucuguugucacacaacaccuuucccuguuucucuucagu

SEQ ID NO: 160180 - RNA, 64 nt, Human
uaauaaauuuaaaaucuaaaauguaaaauuuugaacacaacacuggaaaggguauccacagcag

SEQ ID NO: 160181 - RNA, 64 nt, Human
gugucuuuagagcucaguauucuuuauuuuacaaacacaacaaaauguaguaacuuuuuuccag

SEQ ID NO: 160182 - RNA, 64 nt, Human
ccaagcucccacccuggguauucaaaaacggcagacacaacauguuccuccacgcggcucacuc

SEQ ID NO: 160183 - RNA, 64 nt, Human
augaugaagauuauuacauaugaaaaaaaaacucacacaacauauuuguauugacugaaggaaa

SEQ ID NO: 160184 - RNA, 64 nt, Human
gacacaauccuaauagacaguguccuguaaauggacacaacacaauaaagucaaguuauuauug

SEQ ID NO: 160185 - RNA, 64 nt, Human
gagcuggcacacccugccuguuuucucuuuuuagacacaacagccgcaguuuggccagccacua

SEQ ID NO: 160186 - RNA, 64 nt, Human
ucacagugguuguggacauggaagaguuuugucaacacaacacuuuguccccgcuccgggagau

SEQ ID NO: 160187 - RNA, 64 nt, Human
cagagauucugcaacacgaauucgaagcaaacaaacacaacacaacagaauuccuggaaagaag

SEQ ID NO: 160188 - RNA, 64 nt, Human
auucugcaacacgaauucgaagcaaacaaacacaacacaacagaauuccuggaaagaagacgac

SEQ ID NO: 160189 - RNA, 64 nt, Human
uuaaacuugucaauacggaaaguuguuuuuucuaacacaacaaagugggaccaucucuauuccc

SEQ ID NO: 160190 - RNA, 64 nt, Human
gcugcuucuuaccagcaggagggaaacacacuucacacaacaggcuuaucagaaaccuaccaga

SEQ ID NO: 160191 - RNA, 64 nt, Human
aagcuggcucugcuuuugcccuuugucaucaccaacacaacagauagaauuuaaauauaaguau

SEQ ID NO: 160192 - RNA, 64 nt, Human
ggaaaaggcuaagaaaaaggaaaaccauucuaaaacacaacaagaaacuguccaaaugcuuugg

SEQ ID NO: 160193 - RNA, 64 nt, Human
auuuccucugaacacaggguuccagaguacuuaaacacaacauuuuuuaaaucgugauuucggc

SEQ ID NO: 160194 - RNA, 64 nt, Human
agcugagucuacauuguuaugagucaccauuuucacacaacaucaugaaucuucacuguuagua

SEQ ID NO: 160195 - RNA, 64 nt, Human
ugcacuuaggaagugcuaaauuuuaaaagcugaaacacaacagaauucuaagaaauauagucca

SEQ ID NO: 160196 - RNA, 64 nt, Human
auaaagauauucucugaaagcaaugagaacaaagacacaacauaccagaaucucugggacacau

SEQ ID NO: 160197 - RNA, 64 nt, Human
guaugaucuuccauguuuugacguuugcagucacacacaacaccuuaguuccucuaggggcugu

SEQ ID NO: 160198 - RNA, 64 nt, Human
uaaagacuuuuggaaauuuggcugaacaauuagaacacaacaggccaacucauacucauuugga

SEQ ID NO: 160199 - RNA, 64 nt, Human
uuuuuuccaaaauauugugauaagaaauuucuagacacaacagcuuaaaaucacccaaauuuca

SEQ ID NO: 160200 - RNA, 64 nt, Human
uggaccgaggaacaacuuggaagaucuaccugcaacacaacauuugugucacuguacaguuuug

SEQ ID NO: 160201 - RNA, 64 nt, Human
uuguaucugucucauaaucacagcacagcugcagacacaacaacgugcagcauuuuuuacauaa

SEQ ID NO: 160202 - RNA, 64 nt, Human
uucaagcagaaacaagcaacugagggaaaaagaaacacaacaauaguuuaagaaauuuuuuuuu

SEQ ID NO: 160203 - RNA, 64 nt, Human
uuagccuggauagccuugaaaacaaacaaaucaaacacaacacaagaaaacucaaagaaugugu

SEQ ID NO: 160204 - RNA, 64 nt, Human
aauagagcccuucugccccccacccaccaaauuuacacaacaaaaugacauguucgaaugugaa

SEQ ID NO: 160205 - RNA, 64 nt, Human
gcuuuggccaagcccuugucuucacaaauucgcaacacaacaaucagauggcaccagggacugg

SEQ ID NO: 160206 - RNA, 64 nt, Human
gcccuuccuggccuggagaaggccuuuuacacacacacaacacauacacacacacacacacaca

SEQ ID NO: 160207 - RNA, 64 nt, Human
aagaaaucauggcagagaugugagggcagaauauacacaacagaugcugaaggagaaggagggu

SEQ ID NO: 160208 - RNA, 57 nt, Human
guuugcaagugacagcauaaagacggaacacaacaaauccuuccugaagugaauuag

SEQ ID NO: 160209 - RNA, 64 nt, Human
ucuaggcagagucccgggaccauggccuccugccacacaacacgcagagaggacucaagacucc

SEQ ID NO: 160210 - RNA, 64 nt, Human
aaaucaaaaggcacugugaacuauuuugaagaaaacacaacauuuuaauacagauugaaaggac

SEQ ID NO: 160211 - RNA, 64 nt, Human
cuccuugccauggacuuuuccuguuguuguacacacacaacagaacaaaaugaagcaaaacaaa

SEQ ID NO: 160212 - RNA, 64 nt, Human
ugugaggugagcaugagcuugagcugagagacagacacaacaguaucugaaaagaauacauacu

SEQ ID NO: 160213 - RNA, 64 nt, Human
augacagugagacggugagauggauucguuuugcacacaacauucaaaacacuucauauugccc

SEQ ID NO: 160214 - RNA, 64 nt, Human
aaggucauggccacacugugacacacuacaccacacacaacagccaacagcuacaacagccuca

SEQ ID NO: 160215 - RNA, 64 nt, Human
ugggaacaaagaucuacaggcaagcaagaugcccacacaacaggcuuauuuucugugaaggaac

SEQ ID NO: 160216 - RNA, 64 nt, Human
gccucccuugguaacccaaggaaugauggaaucaacacaacauaguauguuugcuuuccuuacc

SEQ ID NO: 160217 - RNA, 64 nt, Human
gaugaaugaagccaauaggaaauaaaaaacaggcacacaacauuauuuggggaaaaacaccucu

SEQ ID NO: 160218 - RNA, 64 nt, Human
gagucccaaggaaagccccagcacuaacguaaauacacaacacacacacucuacccuauacaac

SEQ ID NO: 160219 - RNA, 64 nt, Human
gauauaggacucccaaauaaaaguaucagaauaaacacaacaauuaacugguucacauugaauu

SEQ ID NO: 160220 - RNA, 64 nt, Human
acuuuugugugugugcgcagguuuauacacauaaacacaacaauacuuggacuuauuuauuuaa

SEQ ID NO: 160221 - RNA, 64 nt, Human
accugcucggguaccugcuuacucagauacuuacacacaacaacagcagcagcagcugcuacug

SEQ ID NO: 160222 - RNA, 64 nt, Human
agucuagguugaaagauaggcagccuuacccagaacacaacauuagcagcugggaaggugucug

SEQ ID NO: 160223 - RNA, 64 nt, Human
auauauauauauaugcaugcugugaaacuugacuacacaacauaaaucacuuuuuaaauuccag

SEQ ID NO: 160224 - RNA, 64 nt, Human
auuucccuagauugugaaagugaucacgacaaucacacaacaaauaauuaagugacuugguaug

SEQ ID NO: 160225 - RNA, 64 nt, Human
uuuauauuuucaucauugacuacauauuucuuauacacaacacacaauuuaugaauuuuuucuc

SEQ ID NO: 160226 - RNA, 64 nt, Human
agcaaaguuuggggagggcugacgauuuuguagaacacaacagugacaauuuuuuuuaaaagaa

SEQ ID NO: 160227 - RNA, 64 nt, Human
gccacaaggagauggauaaugugccuguuuuuuaacacaacaaaaaagccuaccuccaaaaucc

SEQ ID NO: 160228 - RNA, 64 nt, Human
cuguuauagacauuuauggauacauuuccucuaaacacaacagggcacagcaaauacgacuuca

SEQ ID NO: 160229 - RNA, 64 nt, Human
cuucauuuggcuucgaguuccccaggcgcuguagacacaacaugaaucgggcucucugcucucu

SEQ ID NO: 160230 - RNA, 64 nt, Human
cuggcagcagaaaaggaagaacacaagagcaaacacacaacaaugaugguggcaaaguaccugu

SEQ ID NO: 160231 - RNA, 64 nt, Human
cacccgggaaaggcugccgccaccaccaccaccaacacaacagcaauggcaacaccgacagcaa

SEQ ID NO: 160232 - RNA, 64 nt, Human
ccucuuucagaaaacagaaaaaaaacacacacacacacaacaaaaauuugaaccaaaacauucc

SEQ ID NO: 160233 - RNA, 64 nt, Human
ucuccacaugcacacccugaaaacacacacagacacacaacacacacacauacacaccccugaa

SEQ ID NO: 160234 - RNA, 64 nt, Human
cucaauagcaucuuaacgugaagaucaaacaagaacacaacaagccccuacugauuucuggguu

SEQ ID NO: 160235 - RNA, 64 nt, Human
ugggccuuuaaaaaaauaaauccauccaacuuuaacacaacauuucucaguguagaaaucaugu

SEQ ID NO: 160236 - RNA, 64 nt, Human
accagucauguuccaacuucaagccgguaacugcacacaacaggccugggagcgaacuguguga

SEQ ID NO: 160237 - RNA, 64 nt, Human
ugagcaacugacuuaauuuucaagcacuugauuaacacaacacugcaaacagaagggagaaagu

SEQ ID NO: 160238 - RNA, 64 nt, Human
ccucaucaucauucccaacaacauccucugccacacacaacaaaacguaaguuucauuugggca

SEQ ID NO: 160239 - RNA, 64 nt, Human
auaaauuuggaucauguuaugauuuguaacauucacacaacaccucacuuuugaaucuauaaaa

SEQ ID NO: 160240 - RNA, 64 nt, Human
ucaaagacucucuucaagccagcacaacauuuagacacaacacuguagaaauuugagaugggca

SEQ ID NO: 160241 - RNA, 64 nt, Human
ucuauguuuaaagaaaaaaaaaaguaaaaaccaaacacaacaccucacaaguuguaacucuugg

SEQ ID NO: 160242 - RNA, 64 nt, Human
ugccuccagggcaucugggguuuuccccucccucacacaacacacucccauucucuuuagguuu

SEQ ID NO: 160243 - RNA, 64 nt, Human
gucuaaaccccugaagccuaacacaguuccuggcacacaacagguguucaacagauauugugcu

SEQ ID NO: 160244 - RNA, 64 nt, Human
aaaaccagguuagaaggaaugcaggauauuuuuaacacaacaaucugugcuuauuacacaaaau

SEQ ID NO: 160245 - RNA, 64 nt, Human
accucagccucccaaguaguugugccuccuaggcacacaacacuaugcccggcaaauuuuuugu

SEQ ID NO: 160246 - RNA, 64 nt, Human
agaaaucucacuuggauguuauguaaggggugagacacaacagucugacuaugagugaggaaaa

SEQ ID NO: 160247 - RNA, 64 nt, Human
guauaaacuuaaaaggagauuuugaacuuaacuuacacaacauuaaauccuugcacaaucaaau

SEQ ID NO: 160248 - RNA, 64 nt, Human
agcugcgaaaaaucaaacgcauucacgucauccaacacaacauggcuuucaucagaaguuacac

SEQ ID NO: 160249 - RNA, 64 nt, Human
cuguaguuggaucaagugacuucugcccaccuggacacaacaccaaaaaggcuucuuauucggg

SEQ ID NO: 160250 - RNA, 64 nt, Human
cauugcugcuaaauaacuacugucuguuuauuuaacacaacaauugaaugccugaagaaguugc

SEQ ID NO: 160251 - RNA, 64 nt, Human
caggauaugcauuagauucucuccugaaccaaaaacacaacagucauuaucugugaaccauaau

SEQ ID NO: 160252 - RNA, 64 nt, Human
acacacacacacacacacacacacacacacacacacacaacaaaucuacauauacaaacaaggg

SEQ ID NO: 160253 - RNA, 64 nt, Human
accugucaucauaacuggcuucugcuugucauccacacaacaccaggacuuaagacaaauggga

SEQ ID NO: 160254 - RNA, 64 nt, Human
uucaacauagcucuuaacaacuuccaggauauucacacaacacuuaggcuuaaaaaugagcuca

SEQ ID NO: 160255 - RNA, 64 nt, Human
augcaagaaaaucaaaugggaaucuggggacccaacacaacauccugaagauuauuaaaaggaa

SEQ ID NO: 160256 - RNA, 64 nt, Human
aaucaaacuaaauuuaagugggaugauuagauauacacaacaccaagugguacaucugcagaga

SEQ ID NO: 160257 - RNA, 64 nt, Human
uaaugcaaacugcagcgccuuuaagcauaaaguaacacaacagcauugcacggggccggcacug

SEQ ID NO: 160258 - RNA, 64 nt, Human
ccaggagagaacccacgcacaugcacaccacaacacacaacacaccucaccucacaccacagca

SEQ ID NO: 160259 - RNA, 64 nt, Human
caccacaucucaccacaccacagcacaccucaccacacaacacaccacaccccacaccgcacug

SEQ ID NO: 160260 - RNA, 64 nt, Human
agaggccuauugcuacaucaagggguucuaagccacacaacagagccuccagcagggcaggccu

SEQ ID NO: 160261 - RNA, 64 nt, Human
aucuauauuccaagcacauuuacugaaauguaaaacacaacaggaagcaaagcaaucucccuuu

SEQ ID NO: 160262 - RNA, 64 nt, Human
gaguuccuugcugucacagaugauagguucauguacacaacauuaauguuugauaaggaaagca

SEQ ID NO: 160263 - RNA, 64 nt, Human
gccuguuuuagaagguucucuccuccccaaggagacacaacaacuccuagggccacugaagaua

SEQ ID NO: 160264 - RNA, 64 nt, Human
cauauaugugugcaugucaagaaauaaaagaaucacacaacaaggagauuuuuagcaugauacu

SEQ ID NO: 160265 - RNA, 64 nt, Human
cuuuuggucaagaaagaauacaaucuugaacuguacacaacaaagguacagccaugggaauaca

SEQ ID NO: 160266 - RNA, 64 nt, Human
cucuuguaauaaaaugucuauuuuuaauguuuguacacaacaauccuucuauucuagccugcau

SEQ ID NO: 160267 - RNA, 64 nt, Human
aaauacugcagaaaugacaccaauaauggggcagacacaacagcguggcuuagauugugcccac

SEQ ID NO: 160268 - RNA, 64 nt, Human
ggaggagagaggaaaagggagggcgagaaugaccacacaacacagccuuggaccaugagcagaa

SEQ ID NO: 160269 - RNA, 64 nt, Human
uuccuggagaauucacucauugauucauuuguucacacaacaaaacuaggugacuaagugaagg

SEQ ID NO: 160270 - RNA, 64 nt, Human
acccuggugcugccucccgcacaaggagaccuggacacaacagacacacaucacaaggcgaaca

SEQ ID NO: 160271 - RNA, 64 nt, Human
ccagggagaccuccccgcccagcagcccccagagacacaacaaccuaccuuccagccuuaacuc

SEQ ID NO: 160272 - RNA, 64 nt, Human
cugcugaucacguuccaagagaaccaccauccucacacaacaaauuucugcucaacugacucau

SEQ ID NO: 160273 - RNA, 64 nt, Human
cugcuaaucaacucccaagagaacuaccauccucacacaacaaccuucagcucaacugacuugu

SEQ ID NO: 160274 - RNA, 64 nt, Human
cugcugaucaagucccaagagaaccaccauccucacacaacaacuuucugcucaacugacuuau

SEQ ID NO: 160275 - RNA, 57 nt, Human
augacugggucuaugaauaagagguggacacaacagcagucuccuucagcacggcgu

SEQ ID NO: 160276 - RNA, 64 nt, Human
uugugcaauuuuacggggaugggugggcggagggacacaacaaaauuuaagaaugacuauuugg

SEQ ID NO: 160277 - RNA, 64 nt, Human
uuaaagacagaagucacacuugaacaaaacccacacacaacaaaaccugauuugggagacggug

SEQ ID NO: 160278 - RNA, 64 nt, Human
uuccaaccucccugcccccacacacuuaucccagacacaacaccauguggucuggaggucccag

SEQ ID NO: 160279 - RNA, 64 nt, Human
uuugcccgccuccugcaaaccucacaggguccccacacaacagugcccuccagaagcagccccu

SEQ ID NO: 160280 - RNA, 64 nt, Human
ggacccucugaccccaucgaccugggcccugcccacacaacagucugagcaagagaccugcagc

SEQ ID NO: 160281 - RNA, 64 nt, Human
gaauccaauagucaauuacauaaugacuauagaaacacaacagucaccaaauuaaacuagacuu

SEQ ID NO: 160282 - RNA, 64 nt, Human
uugugcauuugggaagcaaguagccauaguacacacacaacacgcuaucagcuuggguaaggac

SEQ ID NO: 160283 - RNA, 64 nt, Human
gaagguuuagccuucauauuuuaauugcuuguauacacaacagcuguuuugcuuuuagauuucu

SEQ ID NO: 160284 - RNA, 64 nt, Human
uaucagcaaugggcuacuucaaauguuuaaucacacacaacauauucgaauugagucaagccca

SEQ ID NO: 160285 - RNA, 64 nt, Human
cagcguagauaguauugcaaaaaggggaggaaauacacaacaauaauaaauguaaaaaccugcu

SEQ ID NO: 160286 - RNA, 64 nt, Human
uauaaacaucacacacacagacagacacacacacacacaacaauuaacagucuucaggcaaaac

SEQ ID NO: 160287 - RNA, 64 nt, Human
uuuaauuuaaaauuuaaauuuuaacaaagugaugacacaacaauauguacguuuagguguggac

SEQ ID NO: 160288 - RNA, 64 nt, Human
ugaaacagaccugaacagacagacagacgcacacacacaacagaugcgcagcaacuccccgccc

SEQ ID NO: 160289 - RNA, 64 nt, Human
gaugucaggcccagagaagcaaguggcuuucaacacacaacagcagauggcaccaacgggaccc

SEQ ID NO: 160290 - RNA, 64 nt, Human
auaaagauguucuuugaaacccaugagaacaaagacacaacauaccagaaucucugggacacau

SEQ ID NO: 160291 - RNA, 64 nt, Human
acugagggacugucggcccucccagguggugucaacacaacaucacacacaggugggggggccu

SEQ ID NO: 160292 - RNA, 64 nt, Human
aguucaggugacugaggaagagccacaaaacaaaacacaacaaaaccaaaccacagaaucaucu

SEQ ID NO: 160293 - RNA, 64 nt, Human
gcagagcccaaaaugucacaguugucaagagaacacacaacagagaaacccuauaaagaaugau

SEQ ID NO: 160294 - RNA, 64 nt, Human
uacaccuaugaaaccaccacagucaagauauccaacacaacaaaagauugucccuuuauaaucc

SEQ ID NO: 160295 - RNA, 64 nt, Human
cucaccccugccccuacccgaaggcccucuguccacacaacaugaaccuaggcugugaccuuuu

SEQ ID NO: 160296 - RNA, 64 nt, Human
cugugaaggauuuguccagccuucauguuacucuacacaacaacuuaucuccuguguauugccc

SEQ ID NO: 160297 - RNA, 64 nt, Human
uuagaaaauguguugauagaaaaccuaagaauaaacacaacaaugaguuaggucuuuaucaagu

SEQ ID NO: 160298 - RNA, 64 nt, Human
aaucugaaacaagguaucuuccaucagcauaacaacacaacacuugagcuccuagccaauguau

SEQ ID NO: 160299 - RNA, 64 nt, Human
gcccaacuucaacauucauaauggccaggagaccacacaacagagacauuuaaugagagggguu

SEQ ID NO: 160300 - RNA, 64 nt, Human
uuuauguagggcacugugcuggguggggcuggggacacaacaaugacugaggcagccuggccuu

SEQ ID NO: 160301 - RNA, 64 nt, Human
uagaacaaaugcaagcccaaauauguuaaaacucacacaacaugauauauauuaaagguugcag

SEQ ID NO: 160302 - RNA, 64 nt, Human
uggaaggcuucccuucauggaaauucuuguuuucacacaacacuugguaguuuuuccagccucc

SEQ ID NO: 160303 - RNA, 64 nt, Human
ucccucucucacacauacacacacaaacacauacacacaacacuaagugccuagacuuuaaaua

SEQ ID NO: 160304 - RNA, 64 nt, Human
gacuagucagaaccuugcuuaacaugagauuuuaacacaacaaugaaauuugccuugucuuauu

SEQ ID NO: 160305 - RNA, 64 nt, Human
gucaggagguggaagugagaggagaucccaucucacacaacacacuuccacguaaugcagacca

SEQ ID NO: 160306 - RNA, 64 nt, Human
gcaguucuauaguaguccagacuuuagaaaccaaacacaacaaaauggcuuguugccaauaugg

SEQ ID NO: 160307 - RNA, 64 nt, Human
gccaccgucuuaccucugggcuuuggugcuuaacacacaacacagcugcagacccugcuggagg

SEQ ID NO: 160308 - RNA, 64 nt, Human
gcccugaaggugucgcaugaagagcuugcuucacacacaacaggauucgauacuuugccaauuc

SEQ ID NO: 160309 - RNA, 64 nt, Human
gagugcuugggauccgcauccagccgugcugagcacacaacaggcuguguguggaaauggccac

SEQ ID NO: 160310 - RNA, 64 nt, Human
gugccggccagcagagaagcagagagccagcgccacacaacaucaagaaggccgacaaccaggu

SEQ ID NO: 160311 - RNA, 64 nt, Human
gggagcaaaaaucucagaacuugaccaugaagauacacaacagacucgcaaaaauaaaguggga

SEQ ID NO: 160312 - RNA, 64 nt, Human
agacuuuaaggguuuguggggcggggcgggauuaacacaacauuuggcuuuguuuucuuuuucc

SEQ ID NO: 160313 - RNA, 64 nt, Human
ugagaaugcugaagaggagcugguucaggagaucacacaacauuuauucuucuuacagguacau

SEQ ID NO: 160314 - RNA, 64 nt, Human
cuagaaggcacugcguggccccucagaugcugggacacaacagacccgggacccagcugugcua

SEQ ID NO: 160315 - RNA, 64 nt, Human
uccucccacccccucccccugggggcaaaucaggacacaacagagggcagaggccccauuagcu

SEQ ID NO: 160316 - RNA, 64 nt, Human
uagagauuuucucagaaaugugugaaagaaccucacacaacauaauuggagucuuaaaauagag

SEQ ID NO: 160317 - RNA, 64 nt, Human
uaauuucagacuucuuccucugcauuuacacaccacacaacacacacacacacacacacacacc

SEQ ID NO: 160318 - RNA, 64 nt, Human
uguaacaaauuaccaccaauaauaugauggcuuaacacaacagaaacuuauuugcuuacauuuu

SEQ ID NO: 160319 - RNA, 64 nt, Human
gggggcauauauuggguuccauucucaccuauccacacaacauauccguauauauccccucuac

SEQ ID NO: 160320 - RNA, 64 nt, Human
aguaguguguaauauaaauucaaaccauauccacacacaacaacuaauuguaugaaacuuuuau

SEQ ID NO: 160321 - RNA, 64 nt, Human
ggucugguacaggaguuaaauaacaaugacacacacacaacaaaacaaacacaaaaccacugau

SEQ ID NO: 160322 - RNA, 64 nt, Human
cacacauacacacacacagacacacacacacgaaacacaacacagacacuacagauuuacuaca

SEQ ID NO: 160323 - RNA, 64 nt, Human
uguuugggcacucagaugcuaucuuggugcacacacacaacauugcuguucagucacaaauccg

SEQ ID NO: 160324 - RNA, 64 nt, Human
uucuauauauauucucguaugucuuauucuaccaacacaacaauaagcguguugcagucaaugu

SEQ ID NO: 160325 - RNA, 64 nt, Human
gagcuccauacacacgcugccuucgguacccaccacacaacauccaaguggccuccgucacuac

SEQ ID NO: 160326 - RNA, 64 nt, Human
acucucucccucuacuaauuuccugcugaaaauaacacaacaaaaauguaacaggggaaauuau

SEQ ID NO: 160327 - RNA, 64 nt, Human
ccauggaaugguaguugagaagaaaacuauuugcacacaacagauuuuagauacuuuuugcugc

SEQ ID NO: 160328 - RNA, 63 nt, Human
ggcuacaugacucugaaccccagggcaccuacugacgaugauaaaaacaucuaccugacucuu

SEQ ID NO: 160329 - RNA, 63 nt, Human
uugcaccgaaagcaggcccuuagggcaggaagggacgaugagcaagucugccacaccaccugg

SEQ ID NO: 160330 - RNA, 63 nt, Human
caucugcaccuacuuguucccaccuugggagaggacgaugacuugggagggacgcgugaaggg

SEQ ID NO: 160331 - RNA, 63 nt, Human
aaugacucugucuugugggugucugacaguggcgacgaugaacaugccguugguuuuauuggc

SEQ ID NO: 160332 - RNA, 63 nt, Human
acaaguacguguggcuacucauuggucuaugaggacgaugacaggcuucgacucugugguuuc

SEQ ID NO: 160333 - RNA, 63 nt, Human
ugcagcugcaggagugcuugugggcugcuaugggacgaugacuugggagcgcuaugggccugc

SEQ ID NO: 160334 - RNA, 63 nt, Human
cccucagggcuuccagcaggauugagucacccugacgaugaccggggagaagccgugugcucu

SEQ ID NO: 160335 - RNA, 63 nt, Human
auagguaucuagagcuuaaugcuacaugugagugacgaugauguacagauucuuucaguucuu

SEQ ID NO: 160336 - RNA, 63 nt, Human
uggugaagaaacugugugagcuguccugaccuggacgaugacguggggaaacccuccaccucc

SEQ ID NO: 160337 - RNA, 63 nt, Human
cuggccacagcugcacuuacaggaugccucauagacgaugaggggucugaaaggccaacccga

SEQ ID NO: 160338 - RNA, 63 nt, Human
cuuaaaaaaacacggaagcacaguuggaggugggacgaugagacuuugaaacuaucucaugcc

SEQ ID NO: 160339 - RNA, 63 nt, Human
uguaaaguuucucgguguguucuguuaauguaagacgaugaacaguuguguauaguguuuuac

SEQ ID NO: 160340 - RNA, 63 nt, Human
uucaagccuuagcaagcccagaggcccccagcagacgaugaggacauugucggcucaacaucu

SEQ ID NO: 160341 - RNA, 63 nt, Human
aucaucggguauuagaaaauguagucuggcugagacgaugaguuaucuucuacauucuagaaa

SEQ ID NO: 160342 - RNA, 63 nt, Human
aggucuuuguuauuuucaacuguucuaugcugugacgaugaggaggagaugucuguuggauuc

SEQ ID NO: 160343 - RNA, 63 nt, Human
guuguggggucaaccguacaauggugugggagugacgaugaugugaguauuuagaauguacca

SEQ ID NO: 160344 - RNA, 63 nt, Human
acucuacuugcugaccacauuucccagagcuaugacgaugagaggaagacugcgcuguauuuu

SEQ ID NO: 160345 - RNA, 63 nt, Human
guggagcaccagccucgguuuuucaggaaauccgacgaugacucuugggugagcaacggcacc

SEQ ID NO: 160346 - RNA, 63 nt, Human
cuggcagaaugugugaaugccauaucuguagaugacgaugaaugugaaggguuaauguagaaa

SEQ ID NO: 160347 - RNA, 63 nt, Human
uacuugaccuuuucuucccuggcuacagcaaaggacgaugaucugccugcuuucacuguguug

SEQ ID NO: 160348 - RNA, 63 nt, Human
acauuuuuaucuacguuuuauaacuuggugagugacgaugagagcccugcaccuggccagagu

SEQ ID NO: 160349 - RNA, 63 nt, Human
ccugcccuuucaaagaauaaccacagcucagaagacgaugacguggucaucugugucgccauc

SEQ ID NO: 160350 - RNA, 63 nt, Human
aaucacgcccuccugggccauguugucuuugaugacgaugaugccguuggggcggaggcugcc

SEQ ID NO: 160351 - RNA, 63 nt, Human
agaugucacuuuacaugggaguuauccauugaugacgaugaaaugccugauuuagaaaacaga

SEQ ID NO: 160352 - RNA, 63 nt, Human
uugaaacguaacugguucccugaccaggucaccgacgaugagggcgcaccugcuguccuggag

SEQ ID NO: 160353 - RNA, 63 nt, Human
cauccaucggcuccccauggugucuucacaccugacgaugagccaggccugagccccacacag

SEQ ID NO: 160354 - RNA, 63 nt, Human
gccguguggcccugggacccugggcccagaaaggacgaugaacuaccugcaguggugauggcc

SEQ ID NO: 160355 - RNA, 63 nt, Human
cuuugacuguaagacagggcucuguaucagugagacgaugagaaaagucccaggcuaauggca

SEQ ID NO: 160356 - RNA, 63 nt, Human
agccacgcaaggcugcaccucuguguguugggagacgaugaugauguccauugcugugugaug

SEQ ID NO: 160357 - RNA, 63 nt, Human
cucccagcccagagcagccaucaggcuggaggugacgaugaguuccugaaacuuggaggggca

SEQ ID NO: 160358 - RNA, 63 nt, Human
cguggacucacuccaccagcuuccuauaacuuggacgaugaccaggcggcuugggagaaugag

SEQ ID NO: 160359 - RNA, 63 nt, Human
aggcuucugccaaaaaaaaaaagagaagaagaugacgaugaugaccagucguacuaucuuacu

SEQ ID NO: 160360 - RNA, 63 nt, Human
uccucuuguacuucgugugcuccgacccauggugacgaugacacacccugguggcaugcccgu

SEQ ID NO: 160361 - RNA, 63 nt, Human
aacccucaguaccgucugaagcuccuggaggaggacgaugacccugaugacucggaggugauu

SEQ ID NO: 160362 - RNA, 63 nt, Human
ugcaaauggcugucucggguuuucauagaacaagacgaugacaugcuggaggcugccaaggca

SEQ ID NO: 160363 - RNA, 63 nt, Human
auggguccacucauggccucagcugagaaaggagacgaugaacguguagcugacaugcacgaa

SEQ ID NO: 160364 - RNA, 63 nt, Human
acgcuguuccgguuggcgagugacaccacugaugacgaugaugcacucgguaaguuuucuuuc

SEQ ID NO: 160365 - RNA, 58 nt, Human
uuucuuugcacuggucuugaagagaguggacgaugaggaggauacuguggccccgcug

SEQ ID NO: 160366 - RNA, 63 nt, Human
caggccccugaugcuccaaccucccggggggacgacgaugacaaugugaaaccaucacagcug

SEQ ID NO: 160367 - RNA, 63 nt, Human
uagcuauuaugcgcccgucuacagggggugcccgacgaugacggugccuucgcagucaaauua

SEQ ID NO: 160368 - RNA, 63 nt, Human
gaaguccuucuggacagugugaugccccugucagacgaugaccaguuuucaccggaagcagau

SEQ ID NO: 160369 - RNA, 63 nt, Human
ccucacccgccgggguccccuccgggcggggcagacgaugacucgccccucgcccacccgcuc

SEQ ID NO: 160370 - RNA, 63 nt, Human
agggucagacgugcuguuaagagcaaagccacagacgaugacuuguccauucucaguggaugc

SEQ ID NO: 160371 - RNA, 63 nt, Human
aggaagggccugcacgaacccuacagcgagagugacgaugauuggugcuaagcccgggcgagg

SEQ ID NO: 160372 - RNA, 63 nt, Human
gugcuggacuucuacgagccgcggcggccagaggacgaugacccuacagaacaggugggcccc

SEQ ID NO: 160373 - RNA, 63 nt, Human
cccugcccucauggugcucauucuacuugaguagacgaugaacuaguaaacaaauaaacaaga

SEQ ID NO: 160374 - RNA, 63 nt, Human
uggagcccgaguggaccaaucggaagccuaagugacgaugacccucgcauguccuaggucccu

SEQ ID NO: 160375 - RNA, 63 nt, Human
ugcuaggcagagagcgcacccuacucuuuccgugacgaugagggcggcaaaaacagacauuuc

SEQ ID NO: 160376 - RNA, 63 nt, Human
uguuuuauauauauauuuuuuccuuucaaaucagacgaugagacuagaaggagaaauacuuuc

SEQ ID NO: 160377 - RNA, 63 nt, Human
auuuaaucuggcacuuugcacugccacagaggugacgaugaacuauguauauaguuagauguu

SEQ ID NO: 160378 - RNA, 63 nt, Human
agaagguauuuuuuaacucccaagcaguagcaggacgaugauagggcuggagggcuauggauu

SEQ ID NO: 160379 - RNA, 63 nt, Human
auuuuacuggauuuaucuuaauaaaaagacucugacgaugauuguguuuuguuauaucuucaa

SEQ ID NO: 160380 - RNA, 64 nt, Human; identical to SEQ ID NO: 94951

SEQ ID NO: 160381 - RNA, 64 nt, Human; identical to SEQ ID NO: 94952

SEQ ID NO: 160382 - RNA, 64 nt, Human; identical to SEQ ID NO: 94953

SEQ ID NO: 160383 - RNA, 64 nt, Human; identical to SEQ ID NO: 94954

SEQ ID NO: 160384 - RNA, 64 nt, Human; identical to SEQ ID NO: 94955

SEQ ID NO: 160385 - RNA, 64 nt, Human; identical to SEQ ID NO: 94956

SEQ ID NO: 160386 - RNA, 64 nt, Human; identical to SEQ ID NO: 94957

SEQ ID NO: 160387 - RNA, 64 nt, Human; identical to SEQ ID NO: 94958

SEQ ID NO: 160388 - RNA, 64 nt, Human; identical to SEQ ID NO: 94959

SEQ ID NO: 160389 - RNA, 64 nt, Human; identical to SEQ ID NO: 94960

SEQ ID NO: 160390 - RNA, 64 nt, Human; identical to SEQ ID NO: 94961

SEQ ID NO: 160391 - RNA, 64 nt, Human; identical to SEQ ID NO: 94962

SEQ ID NO: 160392 - RNA, 64 nt, Human; identical to SEQ ID NO: 94963

SEQ ID NO: 160393 - RNA, 64 nt, Human; identical to SEQ ID NO: 94964

SEQ ID NO: 160394 - RNA, 64 nt, Human; identical to SEQ ID NO: 94965

SEQ ID NO: 160395 - RNA, 64 nt, Human; identical to SEQ ID NO: 94966

SEQ ID NO: 160396 - RNA, 64 nt, Human; identical to SEQ ID NO: 94967

SEQ ID NO: 160397 - RNA, 64 nt, Human; identical to SEQ ID NO: 94968

SEQ ID NO: 160398 - RNA, 64 nt, Human; identical to SEQ ID NO: 94969

SEQ ID NO: 160399 - RNA, 64 nt, Human; identical to SEQ ID NO: 94970

SEQ ID NO: 160400 - RNA, 64 nt, Human; identical to SEQ ID NO: 94971

SEQ ID NO: 160401 - RNA, 64 nt, Human; identical to SEQ ID NO: 94972

SEQ ID NO: 160402 - RNA, 64 nt, Human; identical to SEQ ID NO: 94973

SEQ ID NO: 160403 - RNA, 64 nt, Human; identical to SEQ ID NO: 94974

SEQ ID NO: 160404 - RNA, 64 nt, Human; identical to SEQ ID NO: 94975

SEQ ID NO: 160405 - RNA, 64 nt, Human; identical to SEQ ID NO: 94976

SEQ ID NO: 160406 - RNA, 64 nt, Human; identical to SEQ ID NO: 94977

SEQ ID NO: 160407 - RNA, 64 nt, Human; identical to SEQ ID NO: 94978

SEQ ID NO: 160408 - RNA, 64 nt, Human; identical to SEQ ID NO: 94979

SEQ ID NO: 160409 - RNA, 64 nt, Human; identical to SEQ ID NO: 94980

SEQ ID NO: 160410 - RNA, 64 nt, Human; identical to SEQ ID NO: 94981

SEQ ID NO: 160411 - RNA, 64 nt, Human; identical to SEQ ID NO: 94982

SEQ ID NO: 160412 - RNA, 53 nt, Human; identical to SEQ ID NO: 94983

SEQ ID NO: 160413 - RNA, 64 nt, Human; identical to SEQ ID NO: 94984

SEQ ID NO: 160414 - RNA, 64 nt, Human; identical to SEQ ID NO: 94985

SEQ ID NO: 160415 - RNA, 64 nt, Human; identical to SEQ ID NO: 94986

SEQ ID NO: 160416 - RNA, 64 nt, Human; identical to SEQ ID NO: 94987

SEQ ID NO: 160417 - RNA, 64 nt, Human; identical to SEQ ID NO: 94988

SEQ ID NO: 160418 - RNA, 64 nt, Human; identical to SEQ ID NO: 94989

SEQ ID NO: 160419 - RNA, 64 nt, Human; identical to SEQ ID NO: 94990

SEQ ID NO: 160420 - RNA, 64 nt, Human; identical to SEQ ID NO: 94991

SEQ ID NO: 160421 - RNA, 64 nt, Human; identical to SEQ ID NO: 94992

SEQ ID NO: 160422 - RNA, 64 nt, Human; identical to SEQ ID NO: 94993

SEQ ID NO: 160423 - RNA, 64 nt, Human; identical to SEQ ID NO: 94994

SEQ ID NO: 160424 - RNA, 64 nt, Human; identical to SEQ ID NO: 94995

SEQ ID NO: 160425 - RNA, 64 nt, Human; identical to SEQ ID NO: 94996

SEQ ID NO: 160426 - RNA, 64 nt, Human; identical to SEQ ID NO: 94997

SEQ ID NO: 160427 - RNA, 64 nt, Human; identical to SEQ ID NO: 94998

SEQ ID NO: 160428 - RNA, 64 nt, Human; identical to SEQ ID NO: 94999

SEQ ID NO: 160429 - RNA, 64 nt, Human; identical to SEQ ID NO: 95000

SEQ ID NO: 160430 - RNA, 64 nt, Human; identical to SEQ ID NO: 95001

SEQ ID NO: 160431 - RNA, 64 nt, Human; identical to SEQ ID NO: 95002

SEQ ID NO: 160432 - RNA, 64 nt, Human; identical to SEQ ID NO: 95003

SEQ ID NO: 160433 - RNA, 64 nt, Human; identical to SEQ ID NO: 95004

SEQ ID NO: 160434 - RNA, 64 nt, Human; identical to SEQ ID NO: 95005

SEQ ID NO: 160435 - RNA, 64 nt, Human; identical to SEQ ID NO: 95006

SEQ ID NO: 160436 - RNA, 64 nt, Human; identical to SEQ ID NO: 95007

SEQ ID NO: 160437 - RNA, 64 nt, Human; identical to SEQ ID NO: 95008

SEQ ID NO: 160438 - RNA, 64 nt, Human; identical to SEQ ID NO: 95009

SEQ ID NO: 160439 - RNA, 64 nt, Human; identical to SEQ ID NO: 95010

SEQ ID NO: 160440 - RNA, 64 nt, Human; identical to SEQ ID NO: 95011

SEQ ID NO: 160441 - RNA, 64 nt, Human; identical to SEQ ID NO: 95012

SEQ ID NO: 160442 - RNA, 64 nt, Human; identical to SEQ ID NO: 95013

SEQ ID NO: 160443 - RNA, 64 nt, Human; identical to SEQ ID NO: 95014

SEQ ID NO: 160444 - RNA, 64 nt, Human; identical to SEQ ID NO: 95015

SEQ ID NO: 160445 - RNA, 64 nt, Human; identical to SEQ ID NO: 95016

SEQ ID NO: 160446 - RNA, 64 nt, Human; identical to SEQ ID NO: 95017

SEQ ID NO: 160447 - RNA, 64 nt, Human; identical to SEQ ID NO: 95018

SEQ ID NO: 160448 - RNA, 64 nt, Human; identical to SEQ ID NO: 95019

SEQ ID NO: 160449 - RNA, 64 nt, Human; identical to SEQ ID NO: 95020

SEQ ID NO: 160450 - RNA, 64 nt, Human; identical to SEQ ID NO: 95021

SEQ ID NO: 160451 - RNA, 64 nt, Human; identical to SEQ ID NO: 95022

SEQ ID NO: 160452 - RNA, 64 nt, Human; identical to SEQ ID NO: 95023

SEQ ID NO: 160453 - RNA, 64 nt, Human; identical to SEQ ID NO: 95024

SEQ ID NO: 160454 - RNA, 64 nt, Human; identical to SEQ ID NO: 95025

SEQ ID NO: 160455 - RNA, 64 nt, Human; identical to SEQ ID NO: 95026

SEQ ID NO: 160456 - RNA, 64 nt, Human; identical to SEQ ID NO: 95027

SEQ ID NO: 160457 - RNA, 64 nt, Human; identical to SEQ ID NO: 95028

SEQ ID NO: 160458 - RNA, 64 nt, Human; identical to SEQ ID NO: 95029

SEQ ID NO: 160459 - RNA, 64 nt, Human; identical to SEQ ID NO: 95030

SEQ ID NO: 160460 - RNA, 64 nt, Human; identical to SEQ ID NO: 95031

SEQ ID NO: 160461 - RNA, 64 nt, Human; identical to SEQ ID NO: 95032

SEQ ID NO: 160462 - RNA, 64 nt, Human; identical to SEQ ID NO: 95033

SEQ ID NO: 160463 - RNA, 64 nt, Human; identical to SEQ ID NO: 95034

SEQ ID NO: 160464 - RNA, 64 nt, Human; identical to SEQ ID NO: 95035

SEQ ID NO: 160465 - RNA, 64 nt, Human; identical to SEQ ID NO: 95036

SEQ ID NO: 160466 - RNA, 64 nt, Human; identical to SEQ ID NO: 95037

SEQ ID NO: 160467 - RNA, 64 nt, Human; identical to SEQ ID NO: 95038

SEQ ID NO: 160468 - RNA, 64 nt, Human; identical to SEQ ID NO: 95039

SEQ ID NO: 160469 - RNA, 64 nt, Human; identical to SEQ ID NO: 95040

SEQ ID NO: 160470 - RNA, 64 nt, Human; identical to SEQ ID NO: 95041

SEQ ID NO: 160471 - RNA, 64 nt, Human; identical to SEQ ID NO: 95042

SEQ ID NO: 160472 - RNA, 64 nt, Human; identical to SEQ ID NO: 95043

SEQ ID NO: 160473 - RNA, 64 nt, Human; identical to SEQ ID NO: 95044

SEQ ID NO: 160474 - RNA, 64 nt, Human; identical to SEQ ID NO: 95045

SEQ ID NO: 160475 - RNA, 64 nt, Human; identical to SEQ ID NO: 95046

SEQ ID NO: 160476 - RNA, 64 nt, Human; identical to SEQ ID NO: 95047

SEQ ID NO: 160477 - RNA, 64 nt, Human; identical to SEQ ID NO: 95048

SEQ ID NO: 160478 - RNA, 64 nt, Human; identical to SEQ ID NO: 95049

SEQ ID NO: 160479 - RNA, 64 nt, Human; identical to SEQ ID NO: 95050

SEQ ID NO: 160480 - RNA, 64 nt, Human; identical to SEQ ID NO: 95051

SEQ ID NO: 160481 - RNA, 64 nt, Human; identical to SEQ ID NO: 95052

SEQ ID NO: 160482 - RNA, 64 nt, Human; identical to SEQ ID NO: 95053

SEQ ID NO: 160483 - RNA, 64 nt, Human; identical to SEQ ID NO: 95054

SEQ ID NO: 160484 - RNA, 64 nt, Human; identical to SEQ ID NO: 95055

SEQ ID NO: 160485 - RNA, 64 nt, Human; identical to SEQ ID NO: 95056

SEQ ID NO: 160486 - RNA, 64 nt, Human; identical to SEQ ID NO: 95057

SEQ ID NO: 160487 - RNA, 64 nt, Human; identical to SEQ ID NO: 95058

SEQ ID NO: 160488 - RNA, 64 nt, Human; identical to SEQ ID NO: 95059

SEQ ID NO: 160489 - RNA, 64 nt, Human; identical to SEQ ID NO: 95060

SEQ ID NO: 160490 - RNA, 64 nt, Human; identical to SEQ ID NO: 95061

SEQ ID NO: 160491 - RNA, 64 nt, Human; identical to SEQ ID NO: 95062

SEQ ID NO: 160492 - RNA, 64 nt, Human; identical to SEQ ID NO: 95063

SEQ ID NO: 160493 - RNA, 64 nt, Human; identical to SEQ ID NO: 95064

SEQ ID NO: 160494 - RNA, 64 nt, Human; identical to SEQ ID NO: 95065

SEQ ID NO: 160495 - RNA, 64 nt, Human; identical to SEQ ID NO: 95066

SEQ ID NO: 160496 - RNA, 64 nt, Human; identical to SEQ ID NO: 95067

SEQ ID NO: 160497 - RNA, 64 nt, Human; identical to SEQ ID NO: 95068

SEQ ID NO: 160498 - RNA, 64 nt, Human; identical to SEQ ID NO: 95069

SEQ ID NO: 160499 - RNA, 64 nt, Human; identical to SEQ ID NO: 95070

SEQ ID NO: 160500 - RNA, 64 nt, Human; identical to SEQ ID NO: 95071

SEQ ID NO: 160501 - RNA, 64 nt, Human; identical to SEQ ID NO: 95072

SEQ ID NO: 160502 - RNA, 64 nt, Human; identical to SEQ ID NO: 95073

SEQ ID NO: 160503 - RNA, 64 nt, Human; identical to SEQ ID NO: 95074

SEQ ID NO: 160504 - RNA, 64 nt, Human; identical to SEQ ID NO: 95075

SEQ ID NO: 160505 - RNA, 64 nt, Human; identical to SEQ ID NO: 95076

SEQ ID NO: 160506 - RNA, 64 nt, Human; identical to SEQ ID NO: 95077

SEQ ID NO: 160507 - RNA, 64 nt, Human; identical to SEQ ID NO: 95078

SEQ ID NO: 160508 - RNA, 64 nt, Human; identical to SEQ ID NO: 95079

SEQ ID NO: 160509 - RNA, 64 nt, Human; identical to SEQ ID NO: 95080

SEQ ID NO: 160510 - RNA, 53 nt, Human; identical to SEQ ID NO: 95081

SEQ ID NO: 160511 - RNA, 64 nt, Human; identical to SEQ ID NO: 95082

SEQ ID NO: 160512 - RNA, 64 nt, Human; identical to SEQ ID NO: 95083

SEQ ID NO: 160513 - RNA, 64 nt, Human; identical to SEQ ID NO: 95084

SEQ ID NO: 160514 - RNA, 51 nt, Human; identical to SEQ ID NO: 95085

SEQ ID NO: 160515 - RNA, 64 nt, Human; identical to SEQ ID NO: 95086

SEQ ID NO: 160516 - RNA, 64 nt, Human; identical to SEQ ID NO: 95087

SEQ ID NO: 160517 - RNA, 64 nt, Human; identical to SEQ ID NO: 95088

SEQ ID NO: 160518 - RNA, 64 nt, Human; identical to SEQ ID NO: 95089

SEQ ID NO: 160519 - RNA, 64 nt, Human; identical to SEQ ID NO: 95090

SEQ ID NO: 160520 - RNA, 64 nt, Human; identical to SEQ ID NO: 95091

SEQ ID NO: 160521 - RNA, 64 nt, Human; identical to SEQ ID NO: 95092

SEQ ID NO: 160522 - RNA, 64 nt, Human; identical to SEQ ID NO: 95093

SEQ ID NO: 160523 - RNA, 64 nt, Human; identical to SEQ ID NO: 95094

SEQ ID NO: 160524 - RNA, 64 nt, Human; identical to SEQ ID NO: 95095

SEQ ID NO: 160525 - RNA, 64 nt, Human; identical to SEQ ID NO: 95096

SEQ ID NO: 160526 - RNA, 64 nt, Human; identical to SEQ ID NO: 95097

SEQ ID NO: 160527 - RNA, 64 nt, Human; identical to SEQ ID NO: 95098

SEQ ID NO: 160528 - RNA, 64 nt, Human; identical to SEQ ID NO: 95099

SEQ ID NO: 160529 - RNA, 64 nt, Human; identical to SEQ ID NO: 95100

SEQ ID NO: 160530 - RNA, 58 nt, Human; identical to SEQ ID NO: 95101

SEQ ID NO: 160531 - RNA, 64 nt, Human; identical to SEQ ID NO: 95102

SEQ ID NO: 160532 - RNA, 64 nt, Human; identical to SEQ ID NO: 95103

SEQ ID NO: 160533 - RNA, 64 nt, Human; identical to SEQ ID NO: 95104

SEQ ID NO: 160534 - RNA, 64 nt, Human; identical to SEQ ID NO: 95105

SEQ ID NO: 160535 - RNA, 64 nt, Human; identical to SEQ ID NO: 95106

SEQ ID NO: 160536 - RNA, 64 nt, Human; identical to SEQ ID NO: 95107

SEQ ID NO: 160537 - RNA, 64 nt, Human; identical to SEQ ID NO: 95108

SEQ ID NO: 160538 - RNA, 64 nt, Human; identical to SEQ ID NO: 95109

SEQ ID NO: 160539 - RNA, 64 nt, Human; identical to SEQ ID NO: 95110

SEQ ID NO: 160540 - RNA, 64 nt, Human; identical to SEQ ID NO: 95111

SEQ ID NO: 160541 - RNA, 64 nt, Human; identical to SEQ ID NO: 95112

SEQ ID NO: 160542 - RNA, 64 nt, Human; identical to SEQ ID NO: 95113

SEQ ID NO: 160543 - RNA, 64 nt, Human; identical to SEQ ID NO: 95114

SEQ ID NO: 160544 - RNA, 64 nt, Human; identical to SEQ ID NO: 95115

SEQ ID NO: 160545 - RNA, 64 nt, Human; identical to SEQ ID NO: 95116

SEQ ID NO: 160546 - RNA, 64 nt, Human; identical to SEQ ID NO: 95117

SEQ ID NO: 160547 - RNA, 64 nt, Human; identical to SEQ ID NO: 95118

SEQ ID NO: 160548 - RNA, 64 nt, Human; identical to SEQ ID NO: 95119

SEQ ID NO: 160549 - RNA, 64 nt, Human; identical to SEQ ID NO: 95120

SEQ ID NO: 160550 - RNA, 64 nt, Human; identical to SEQ ID NO: 95121

SEQ ID NO: 160551 - RNA, 64 nt, Human; identical to SEQ ID NO: 95122

SEQ ID NO: 160552 - RNA, 64 nt, Human; identical to SEQ ID NO: 95123

SEQ ID NO: 160553 - RNA, 64 nt, Human; identical to SEQ ID NO: 95124

SEQ ID NO: 160554 - RNA, 64 nt, Human; identical to SEQ ID NO: 95125

SEQ ID NO: 160555 - RNA, 64 nt, Human; identical to SEQ ID NO: 95126

SEQ ID NO: 160556 - RNA, 64 nt, Human; identical to SEQ ID NO: 95127

SEQ ID NO: 160557 - RNA, 64 nt, Human; identical to SEQ ID NO: 95128

SEQ ID NO: 160558 - RNA, 64 nt, Human; identical to SEQ ID NO: 95129

SEQ ID NO: 160559 - RNA, 64 nt, Human; identical to SEQ ID NO: 95130

SEQ ID NO: 160560 - RNA, 64 nt, Human; identical to SEQ ID NO: 95131

SEQ ID NO: 160561 - RNA, 64 nt, Human; identical to SEQ ID NO: 95132

SEQ ID NO: 160562 - RNA, 64 nt, Human; identical to SEQ ID NO: 95133

SEQ ID NO: 160563 - RNA, 64 nt, Human; identical to SEQ ID NO: 95134

SEQ ID NO: 160564 - RNA, 64 nt, Human; identical to SEQ ID NO: 95135

SEQ ID NO: 160565 - RNA, 64 nt, Human; identical to SEQ ID NO: 95136

SEQ ID NO: 160566 - RNA, 64 nt, Human; identical to SEQ ID NO: 95137

SEQ ID NO: 160567 - RNA, 64 nt, Human; identical to SEQ ID NO: 95138

SEQ ID NO: 160568 - RNA, 64 nt, Human; identical to SEQ ID NO: 95139

SEQ ID NO: 160569 - RNA, 64 nt, Human; identical to SEQ ID NO: 95140

SEQ ID NO: 160570 - RNA, 64 nt, Human; identical to SEQ ID NO: 95141

SEQ ID NO: 160571 - RNA, 64 nt, Human; identical to SEQ ID NO: 95142

SEQ ID NO: 160572 - RNA, 64 nt, Human; identical to SEQ ID NO: 95143

SEQ ID NO: 160573 - RNA, 64 nt, Human; identical to SEQ ID NO: 95144

SEQ ID NO: 160574 - RNA, 64 nt, Human; identical to SEQ ID NO: 95145

SEQ ID NO: 160575 - RNA, 64 nt, Human; identical to SEQ ID NO: 95146

SEQ ID NO: 160576 - RNA, 64 nt, Human; identical to SEQ ID NO: 95147

SEQ ID NO: 160577 - RNA, 64 nt, Human; identical to SEQ ID NO: 95148

SEQ ID NO: 160578 - RNA, 64 nt, Human; identical to SEQ ID NO: 95149

SEQ ID NO: 160579 - RNA, 64 nt, Human; identical to SEQ ID NO: 95150

SEQ ID NO: 160580 - RNA, 64 nt, Human; identical to SEQ ID NO: 95151

SEQ ID NO: 160581 - RNA, 64 nt, Human; identical to SEQ ID NO: 95152

SEQ ID NO: 160582 - RNA, 64 nt, Human; identical to SEQ ID NO: 95153

SEQ ID NO: 160583 - RNA, 64 nt, Human; identical to SEQ ID NO: 95154

SEQ ID NO: 160584 - RNA, 64 nt, Human; identical to SEQ ID NO: 95155

SEQ ID NO: 160585 - RNA, 64 nt, Human; identical to SEQ ID NO: 95156

SEQ ID NO: 160586 - RNA, 64 nt, Human; identical to SEQ ID NO: 95157

SEQ ID NO: 160587 - RNA, 64 nt, Human; identical to SEQ ID NO: 95158

SEQ ID NO: 160588 - RNA, 64 nt, Human; identical to SEQ ID NO: 95159

SEQ ID NO: 160589 - RNA, 64 nt, Human; identical to SEQ ID NO: 95160

SEQ ID NO: 160590 - RNA, 56 nt, Human; identical to SEQ ID NO: 95161

SEQ ID NO: 160591 - RNA, 64 nt, Human; identical to SEQ ID NO: 95162

SEQ ID NO: 160592 - RNA, 64 nt, Human; identical to SEQ ID NO: 95163

SEQ ID NO: 160593 - RNA, 64 nt, Human; identical to SEQ ID NO: 95164

SEQ ID NO: 160594 - RNA, 64 nt, Human; identical to SEQ ID NO: 95165

SEQ ID NO: 160595 - RNA, 64 nt, Human; identical to SEQ ID NO: 95166

SEQ ID NO: 160596 - RNA, 64 nt, Human; identical to SEQ ID NO: 95167

SEQ ID NO: 160597 - RNA, 64 nt, Human; identical to SEQ ID NO: 95168

SEQ ID NO: 160598 - RNA, 64 nt, Human; identical to SEQ ID NO: 95169

SEQ ID NO: 160599 - RNA, 64 nt, Human; identical to SEQ ID NO: 95170

SEQ ID NO: 160600 - RNA, 64 nt, Human; identical to SEQ ID NO: 95171

SEQ ID NO: 160601 - RNA, 64 nt, Human; identical to SEQ ID NO: 95172

SEQ ID NO: 160602 - RNA, 64 nt, Human; identical to SEQ ID NO: 95173

SEQ ID NO: 160603 - RNA, 64 nt, Human; identical to SEQ ID NO: 95174

SEQ ID NO: 160604 - RNA, 64 nt, Human; identical to SEQ ID NO: 95175

SEQ ID NO: 160605 - RNA, 64 nt, Human; identical to SEQ ID NO: 95176

SEQ ID NO: 160606 - RNA, 64 nt, Human; identical to SEQ ID NO: 95177

SEQ ID NO: 160607 - RNA, 64 nt, Human; identical to SEQ ID NO: 95178

SEQ ID NO: 160608 - RNA, 64 nt, Human; identical to SEQ ID NO: 95179

SEQ ID NO: 160609 - RNA, 64 nt, Human; identical to SEQ ID NO: 95180

SEQ ID NO: 160610 - RNA, 64 nt, Human; identical to SEQ ID NO: 95181

SEQ ID NO: 160611 - RNA, 64 nt, Human; identical to SEQ ID NO: 95182

SEQ ID NO: 160612 - RNA, 64 nt, Human; identical to SEQ ID NO: 95183

SEQ ID NO: 160613 - RNA, 64 nt, Human; identical to SEQ ID NO: 95184

SEQ ID NO: 160614 - RNA, 64 nt, Human; identical to SEQ ID NO: 95185

SEQ ID NO: 160615 - RNA, 64 nt, Human; identical to SEQ ID NO: 95186

SEQ ID NO: 160616 - RNA, 64 nt, Human; identical to SEQ ID NO: 95187

SEQ ID NO: 160617 - RNA, 64 nt, Human; identical to SEQ ID NO: 95188

SEQ ID NO: 160618 - RNA, 64 nt, Human; identical to SEQ ID NO: 95189

SEQ ID NO: 160619 - RNA, 64 nt, Human; identical to SEQ ID NO: 95190

SEQ ID NO: 160620 - RNA, 64 nt, Human; identical to SEQ ID NO: 95191

SEQ ID NO: 160621 - RNA, 64 nt, Human; identical to SEQ ID NO: 95192

SEQ ID NO: 160622 - RNA, 64 nt, Human; identical to SEQ ID NO: 95193

SEQ ID NO: 160623 - RNA, 64 nt, Human; identical to SEQ ID NO: 95194

SEQ ID NO: 160624 - RNA, 64 nt, Human; identical to SEQ ID NO: 95195

SEQ ID NO: 160625 - RNA, 64 nt, Human; identical to SEQ ID NO: 95196

SEQ ID NO: 160626 - RNA, 64 nt, Human; identical to SEQ ID NO: 95197

SEQ ID NO: 160627 - RNA, 64 nt, Human; identical to SEQ ID NO: 95198

SEQ ID NO: 160628 - RNA, 64 nt, Human; identical to SEQ ID NO: 95199

SEQ ID NO: 160629 - RNA, 64 nt, Human; identical to SEQ ID NO: 95200

SEQ ID NO: 160630 - RNA, 64 nt, Human; identical to SEQ ID NO: 95201

SEQ ID NO: 160631 - RNA, 64 nt, Human; identical to SEQ ID NO: 95202

SEQ ID NO: 160632 - RNA, 64 nt, Human; identical to SEQ ID NO: 95203

SEQ ID NO: 160633 - RNA, 64 nt, Human; identical to SEQ ID NO: 95204

SEQ ID NO: 160634 - RNA, 64 nt, Human; identical to SEQ ID NO: 95205

SEQ ID NO: 160635 - RNA, 64 nt, Human; identical to SEQ ID NO: 95206

SEQ ID NO: 160636 - RNA, 64 nt, Human; identical to SEQ ID NO: 95207

SEQ ID NO: 160637 - RNA, 64 nt, Human; identical to SEQ ID NO: 95208

SEQ ID NO: 160638 - RNA, 64 nt, Human; identical to SEQ ID NO: 95209

SEQ ID NO: 160639 - RNA, 64 nt, Human; identical to SEQ ID NO: 95210

SEQ ID NO: 160640 - RNA, 64 nt, Human; identical to SEQ ID NO: 95211

SEQ ID NO: 160641 - RNA, 64 nt, Human; identical to SEQ ID NO: 95212

SEQ ID NO: 160642 - RNA, 64 nt, Human; identical to SEQ ID NO: 95213

SEQ ID NO: 160643 - RNA, 64 nt, Human; identical to SEQ ID NO: 95214

SEQ ID NO: 160644 - RNA, 64 nt, Human; identical to SEQ ID NO: 95215

SEQ ID NO: 160645 - RNA, 64 nt, Human; identical to SEQ ID NO: 95216

SEQ ID NO: 160646 - RNA, 64 nt, Human; identical to SEQ ID NO: 95217

SEQ ID NO: 160647 - RNA, 64 nt, Human; identical to SEQ ID NO: 95218

SEQ ID NO: 160648 - RNA, 64 nt, Human; identical to SEQ ID NO: 95219

SEQ ID NO: 160649 - RNA, 64 nt, Human; identical to SEQ ID NO: 95220

SEQ ID NO: 160650 - RNA, 64 nt, Human; identical to SEQ ID NO: 95221

SEQ ID NO: 160651 - RNA, 64 nt, Human; identical to SEQ ID NO: 95222

SEQ ID NO: 160652 - RNA, 64 nt, Human; identical to SEQ ID NO: 95223

SEQ ID NO: 160653 - RNA, 64 nt, Human; identical to SEQ ID NO: 95224

SEQ ID NO: 160654 - RNA, 64 nt, Human; identical to SEQ ID NO: 95225

SEQ ID NO: 160655 - RNA, 64 nt, Human; identical to SEQ ID NO: 95226

SEQ ID NO: 160656 - RNA, 64 nt, Human; identical to SEQ ID NO: 95227

SEQ ID NO: 160657 - RNA, 64 nt, Human; identical to SEQ ID NO: 95228

SEQ ID NO: 160658 - RNA, 64 nt, Human; identical to SEQ ID NO: 95229

SEQ ID NO: 160659 - RNA, 64 nt, Human; identical to SEQ ID NO: 95230

SEQ ID NO: 160660 - RNA, 64 nt, Human; identical to SEQ ID NO: 95231

SEQ ID NO: 160661 - RNA, 64 nt, Human; identical to SEQ ID NO: 95232

SEQ ID NO: 160662 - RNA, 64 nt, Human; identical to SEQ ID NO: 95233

SEQ ID NO: 160663 - RNA, 64 nt, Human; identical to SEQ ID NO: 95234

SEQ ID NO: 160664 - RNA, 64 nt, Human; identical to SEQ ID NO: 95235

SEQ ID NO: 160665 - RNA, 64 nt, Human; identical to SEQ ID NO: 95236

SEQ ID NO: 160666 - RNA, 64 nt, Human; identical to SEQ ID NO: 95237

SEQ ID NO: 160667 - RNA, 64 nt, Human; identical to SEQ ID NO: 95238

SEQ ID NO: 160668 - RNA, 64 nt, Human; identical to SEQ ID NO: 95239

SEQ ID NO: 160669 - RNA, 64 nt, Human; identical to SEQ ID NO: 95240

SEQ ID NO: 160670 - RNA, 64 nt, Human; identical to SEQ ID NO: 95241

SEQ ID NO: 160671 - RNA, 64 nt, Human; identical to SEQ ID NO: 95242

SEQ ID NO: 160672 - RNA, 64 nt, Human; identical to SEQ ID NO: 95243

SEQ ID NO: 160673 - RNA, 64 nt, Human; identical to SEQ ID NO: 95244

SEQ ID NO: 160674 - RNA, 64 nt, Human; identical to SEQ ID NO: 95245

SEQ ID NO: 160675 - RNA, 64 nt, Human; identical to SEQ ID NO: 95246

SEQ ID NO: 160676 - RNA, 64 nt, Human; identical to SEQ ID NO: 95247

SEQ ID NO: 160677 - RNA, 64 nt, Human; identical to SEQ ID NO: 95248

SEQ ID NO: 160678 - RNA, 64 nt, Human; identical to SEQ ID NO: 95249

SEQ ID NO: 160679 - RNA, 64 nt, Human; identical to SEQ ID NO: 95250

SEQ ID NO: 160680 - RNA, 64 nt, Human; identical to SEQ ID NO: 95251

SEQ ID NO: 160681 - RNA, 64 nt, Human; identical to SEQ ID NO: 95252

SEQ ID NO: 160682 - RNA, 64 nt, Human; identical to SEQ ID NO: 95253

SEQ ID NO: 160683 - RNA, 64 nt, Human; identical to SEQ ID NO: 95254

SEQ ID NO: 160684 - RNA, 64 nt, Human; identical to SEQ ID NO: 95255

SEQ ID NO: 160685 - RNA, 64 nt, Human; identical to SEQ ID NO: 95256

SEQ ID NO: 160686 - RNA, 64 nt, Human; identical to SEQ ID NO: 95257

SEQ ID NO: 160687 - RNA, 64 nt, Human; identical to SEQ ID NO: 95258

SEQ ID NO: 160688 - RNA, 64 nt, Human; identical to SEQ ID NO: 95259

SEQ ID NO: 160689 - RNA, 64 nt, Human; identical to SEQ ID NO: 95260

SEQ ID NO: 160690 - RNA, 64 nt, Human; identical to SEQ ID NO: 95261

SEQ ID NO: 160691 - RNA, 64 nt, Human; identical to SEQ ID NO: 95262

SEQ ID NO: 160692 - RNA, 64 nt, Human; identical to SEQ ID NO: 95263

SEQ ID NO: 160693 - RNA, 64 nt, Human; identical to SEQ ID NO: 95264

SEQ ID NO: 160694 - RNA, 64 nt, Human; identical to SEQ ID NO: 95265

SEQ ID NO: 160695 - RNA, 64 nt, Human; identical to SEQ ID NO: 95266

SEQ ID NO: 160696 - RNA, 64 nt, Human; identical to SEQ ID NO: 95267

SEQ ID NO: 160697 - RNA, 64 nt, Human; identical to SEQ ID NO: 95268

SEQ ID NO: 160698 - RNA, 64 nt, Human; identical to SEQ ID NO: 95269

SEQ ID NO: 160699 - RNA, 64 nt, Human; identical to SEQ ID NO: 95270

SEQ ID NO: 160700 - RNA, 64 nt, Human; identical to SEQ ID NO: 95271

SEQ ID NO: 160701 - RNA, 64 nt, Human; identical to SEQ ID NO: 95272

SEQ ID NO: 160702 - RNA, 64 nt, Human; identical to SEQ ID NO: 95273

SEQ ID NO: 160703 - RNA, 64 nt, Human; identical to SEQ ID NO: 95274

SEQ ID NO: 160704 - RNA, 64 nt, Human; identical to SEQ ID NO: 95275

SEQ ID NO: 160705 - RNA, 64 nt, Human; identical to SEQ ID NO: 95276

SEQ ID NO: 160706 - RNA, 64 nt, Human; identical to SEQ ID NO: 95277

SEQ ID NO: 160707 - RNA, 64 nt, Human; identical to SEQ ID NO: 95278

SEQ ID NO: 160708 - RNA, 64 nt, Human; identical to SEQ ID NO: 95279

SEQ ID NO: 160709 - RNA, 64 nt, Human; identical to SEQ ID NO: 95280

SEQ ID NO: 160710 - RNA, 64 nt, Human; identical to SEQ ID NO: 95281

SEQ ID NO: 160711 - RNA, 64 nt, Human; identical to SEQ ID NO: 95282

SEQ ID NO: 160712 - RNA, 64 nt, Human; identical to SEQ ID NO: 95283

SEQ ID NO: 160713 - RNA, 64 nt, Human; identical to SEQ ID NO: 95284

SEQ ID NO: 160714 - RNA, 64 nt, Human; identical to SEQ ID NO: 95285

SEQ ID NO: 160715 - RNA, 64 nt, Human; identical to SEQ ID NO: 95286

SEQ ID NO: 160716 - RNA, 64 nt, Human; identical to SEQ ID NO: 95287

SEQ ID NO: 160717 - RNA, 64 nt, Human; identical to SEQ ID NO: 95288

SEQ ID NO: 160718 - RNA, 64 nt, Human; identical to SEQ ID NO: 95289

SEQ ID NO: 160719 - RNA, 64 nt, Human; identical to SEQ ID NO: 95290

SEQ ID NO: 160720 - RNA, 64 nt, Human; identical to SEQ ID NO: 95291

SEQ ID NO: 160721 - RNA, 64 nt, Human; identical to SEQ ID NO: 95292

SEQ ID NO: 160722 - RNA, 64 nt, Human; identical to SEQ ID NO: 95293

SEQ ID NO: 160723 - RNA, 64 nt, Human; identical to SEQ ID NO: 95294

SEQ ID NO: 160724 - RNA, 64 nt, Human; identical to SEQ ID NO: 95295

SEQ ID NO: 160725 - RNA, 64 nt, Human; identical to SEQ ID NO: 95296

SEQ ID NO: 160726 - RNA, 64 nt, Human; identical to SEQ ID NO: 95297

SEQ ID NO: 160727 - RNA, 64 nt, Human; identical to SEQ ID NO: 95298

SEQ ID NO: 160728 - RNA, 64 nt, Human; identical to SEQ ID NO: 95299

SEQ ID NO: 160729 - RNA, 64 nt, Human; identical to SEQ ID NO: 95300

SEQ ID NO: 160730 - RNA, 64 nt, Human; identical to SEQ ID NO: 95301

SEQ ID NO: 160731 - RNA, 64 nt, Human; identical to SEQ ID NO: 95302

SEQ ID NO: 160732 - RNA, 64 nt, Human; identical to SEQ ID NO: 95303

SEQ ID NO: 160733 - RNA, 64 nt, Human; identical to SEQ ID NO: 95304

SEQ ID NO: 160734 - RNA, 64 nt, Human; identical to SEQ ID NO: 95305

SEQ ID NO: 160735 - RNA, 64 nt, Human; identical to SEQ ID NO: 95306

SEQ ID NO: 160736 - RNA, 64 nt, Human; identical to SEQ ID NO: 95307

SEQ ID NO: 160737 - RNA, 64 nt, Human; identical to SEQ ID NO: 95308

SEQ ID NO: 160738 - RNA, 64 nt, Human; identical to SEQ ID NO: 95309

SEQ ID NO: 160739 - RNA, 64 nt, Human; identical to SEQ ID NO: 95310

SEQ ID NO: 160740 - RNA, 64 nt, Human; identical to SEQ ID NO: 95311

SEQ ID NO: 160741 - RNA, 64 nt, Human; identical to SEQ ID NO: 95312

SEQ ID NO: 160742 - RNA, 64 nt, Human; identical to SEQ ID NO: 95313

SEQ ID NO: 160743 - RNA, 64 nt, Human; identical to SEQ ID NO: 95314

SEQ ID NO: 160744 - RNA, 64 nt, Human; identical to SEQ ID NO: 95315

SEQ ID NO: 160745 - RNA, 64 nt, Human; identical to SEQ ID NO: 95316

SEQ ID NO: 160746 - RNA, 64 nt, Human; identical to SEQ ID NO: 95317

SEQ ID NO: 160747 - RNA, 64 nt, Human; identical to SEQ ID NO: 95318

SEQ ID NO: 160748 - RNA, 64 nt, Human; identical to SEQ ID NO: 95319

SEQ ID NO: 160749 - RNA, 64 nt, Human; identical to SEQ ID NO: 95320

SEQ ID NO: 160750 - RNA, 64 nt, Human; identical to SEQ ID NO: 95321

SEQ ID NO: 160751 - RNA, 64 nt, Human; identical to SEQ ID NO: 95322

SEQ ID NO: 160752 - RNA, 64 nt, Human; identical to SEQ ID NO: 95323

SEQ ID NO: 160753 - RNA, 64 nt, Human; identical to SEQ ID NO: 95324

SEQ ID NO: 160754 - RNA, 64 nt, Human; identical to SEQ ID NO: 95325

SEQ ID NO: 160755 - RNA, 64 nt, Human; identical to SEQ ID NO: 95326

SEQ ID NO: 160756 - RNA, 64 nt, Human; identical to SEQ ID NO: 95327

SEQ ID NO: 160757 - RNA, 64 nt, Human; identical to SEQ ID NO: 95328

SEQ ID NO: 160758 - RNA, 64 nt, Human; identical to SEQ ID NO: 95329

SEQ ID NO: 160759 - RNA, 64 nt, Human; identical to SEQ ID NO: 95330

SEQ ID NO: 160760 - RNA, 64 nt, Human; identical to SEQ ID NO: 95331

SEQ ID NO: 160761 - RNA, 64 nt, Human; identical to SEQ ID NO: 95332

SEQ ID NO: 160762 - RNA, 64 nt, Human; identical to SEQ ID NO: 95333

SEQ ID NO: 160763 - RNA, 64 nt, Human; identical to SEQ ID NO: 95334

SEQ ID NO: 160764 - RNA, 64 nt, Human; identical to SEQ ID NO: 95335

SEQ ID NO: 160765 - RNA, 64 nt, Human; identical to SEQ ID NO: 95336

SEQ ID NO: 160766 - RNA, 64 nt, Human; identical to SEQ ID NO: 95337

SEQ ID NO: 160767 - RNA, 64 nt, Human; identical to SEQ ID NO: 95338

SEQ ID NO: 160768 - RNA, 64 nt, Human; identical to SEQ ID NO: 95339

SEQ ID NO: 160769 - RNA, 64 nt, Human; identical to SEQ ID NO: 95340

SEQ ID NO: 160770 - RNA, 64 nt, Human; identical to SEQ ID NO: 95341

SEQ ID NO: 160771 - RNA, 64 nt, Human; identical to SEQ ID NO: 95342

SEQ ID NO: 160772 - RNA, 64 nt, Human; identical to SEQ ID NO: 95343

SEQ ID NO: 160773 - RNA, 64 nt, Human; identical to SEQ ID NO: 95344

SEQ ID NO: 160774 - RNA, 64 nt, Human; identical to SEQ ID NO: 95345

SEQ ID NO: 160775 - RNA, 64 nt, Human; identical to SEQ ID NO: 95346

SEQ ID NO: 160776 - RNA, 64 nt, Human; identical to SEQ ID NO: 95347

SEQ ID NO: 160777 - RNA, 64 nt, Human; identical to SEQ ID NO: 95348

SEQ ID NO: 160778 - RNA, 64 nt, Human; identical to SEQ ID NO: 95349

SEQ ID NO: 160779 - RNA, 64 nt, Human; identical to SEQ ID NO: 95350

SEQ ID NO: 160780 - RNA, 64 nt, Human; identical to SEQ ID NO: 95351

SEQ ID NO: 160781 - RNA, 64 nt, Human; identical to SEQ ID NO: 95352

SEQ ID NO: 160782 - RNA, 64 nt, Human; identical to SEQ ID NO: 95353

SEQ ID NO: 160783 - RNA, 64 nt, Human; identical to SEQ ID NO: 95354

SEQ ID NO: 160784 - RNA, 64 nt, Human; identical to SEQ ID NO: 95355

SEQ ID NO: 160785 - RNA, 64 nt, Human; identical to SEQ ID NO: 95356

SEQ ID NO: 160786 - RNA, 64 nt, Human
gguggacuucaggggaccccaggguuuggccgugggccgugauggcagcaggcggugggaugcu

SEQ ID NO: 160787 - RNA, 64 nt, Human
cuauucagccauuccauuuuacucucuauuuaaaggccgugagcaagcuugucaugagcaaaua

SEQ ID NO: 160788 - RNA, 64 nt, Human
aucucagagugaccaacccaaagaggacagccucggccgugaaugagaagaagugcaacugccu

SEQ ID NO: 160789 - RNA, 64 nt, Human
ccaaggcgugggaugggaugguccugccgguuuaggccgugauucuggaaaaccuuggaugggc

SEQ ID NO: 160790 - RNA, 64 nt, Human
gugcgaaggggcccauggguugggcugcaggccuggccgugagcgggggcugccugcacgcucc

SEQ ID NO: 160791 - RNA, 64 nt, Human
ccuucccagggaccagcaccuucaagcgcuccagggccgugagggcaagagggggaccugccac

SEQ ID NO: 160792 - RNA, 64 nt, Human
agccaccuugugagugcaguuacugccuuuguguggccgugaccucuauuuguuugcuuuuaau

SEQ ID NO: 160793 - RNA, 64 nt, Human
acaccuccccacagccucccugcaggugcuguguggccgugaugugcagagagcagugagggag

SEQ ID NO: 160794 - RNA, 64 nt, Human
aaaaaaucucuuggauguuuaggaaggaagacuuggccgugaugugguguccuggcuuuguggu

SEQ ID NO: 160795 - RNA, 64 nt, Human
ccaaucugagccuagggcaagaaggccagaaaugggccgugagcucucacaggcucagacuaaa

SEQ ID NO: 160796 - RNA, 64 nt, Human
cuuuggguggcguugcagaucucauugcucaguaggccgugaagauuuucauccucaucccacu

SEQ ID NO: 160797 - RNA, 64 nt, Human
cucaacagacagucccugcggcagaaguggguguggccgugagccucugcaggcucaagagugu

SEQ ID NO: 160798 - RNA, 64 nt, Human
uuuuguuuuguauccuuucacuguaauaaaucauggccgugagcagaacuguauguggagucuu

SEQ ID NO: 160799 - RNA, 64 nt, Human
aucgacuccacgcccugccgcuacuucaccugagggccgugaggagaaggugggcugcgcccca

SEQ ID NO: 160800 - RNA, 64 nt, Human
gcugcuccccaugcccuucccacuuuuuggaauaggccgugagggugugaggaagaaggcuguc

SEQ ID NO: 160801 - RNA, 64 nt, Human
uacggcacagucugguccuuuggggcuugggcagggccgugacacagguucuggccaaugauuu

SEQ ID NO: 160802 - RNA, 64 nt, Human
accuguccuccugcugugccgucacccuggcaagggccgugagggcgauugcuuuguggugauu

SEQ ID NO: 160803 - RNA, 64 nt, Human
guuuggguuauuccuauaacuguauguguugaguggccgugaggcuauggaccuagccuggaau

SEQ ID NO: 160804 - RNA, 64 nt, Human
uuagcaggaugcaggcuauugcuuccacaccccuggccgugagaacgugguauguaggagaguu

SEQ ID NO: 160805 - RNA, 64 nt, Human
gccaagaaccaugcagaagccuuccuggugagguggccgugaagccgaagcagggaggugggug

SEQ ID NO: 160806 - RNA, 64 nt, Human
cuggggcuggcuuaggaggcaagaaaacugcaggggccgugaccagcccucugccuccagggag

SEQ ID NO: 160807 - RNA, 64 nt, Human
aagccuuucuucugucacugcagaauuuagaaggggccgugagcagucuucccaagcauggucc

SEQ ID NO: 160808 - RNA, 64 nt, Human
ugguggacuucgcgagagggaagaccuucuuuggggccgugaugguggggugagggaauaugag

SEQ ID NO: 160809 - RNA, 64 nt, Human
aguccccgcagauggguucugcccuguggaguauggccgugaguccccgccccagcaaagacuu

SEQ ID NO: 160810 - RNA, 64 nt, Human
ccugcgaccgcucagaagcacaaaugcuguccauggccgugaggcugccugccaggugaaugga

SEQ ID NO: 160811 - RNA, 64 nt, Human
uaaacccaguggcuucucugaccuggagcugaugggccgugaagggggccuauuuuucuccaaa

SEQ ID NO: 160812 - RNA, 64 nt, Human
ugggacugcuggugccugugguggucguacuacuggccgugaccagagagugcauuuacagaac

SEQ ID NO: 160813 - RNA, 64 nt, Human
cgcaccgaggagcgucccgugaguucaaagcaguggccgugaugcaaaaggagggcugggucuu

SEQ ID NO: 160814 - RNA, 64 nt, Human
ugucugucucuguucuccuuggcguuuccuucauggccgugaaucccagcucacccauggacag

SEQ ID NO: 160815 - RNA, 64 nt, Human
cagcuggccucuggggauucuagcuccacaaccaggccgugaggcuggagaaacuggcaguuau

SEQ ID NO: 160816 - RNA, 64 nt, Human
uuguuucuccuugcccagcagugcugccuucagcggccgugacggggccagcuggacacacggu

SEQ ID NO: 160817 - RNA, 64 nt, Human
gauguaauggugacucuuuucugaucagcaccuuggccgugauucccaaggucccagccaaagc

SEQ ID NO: 160818 - RNA, 64 nt, Human
ggggaccaggcaagaacucugacagagcuuugggggccgugaugugauugcagcuccugaggug

SEQ ID NO: 160819 - RNA, 64 nt, Human
uuuguuguauagucaaaacaaaucggugccacccggccgugacaaauccuaguagauucugugc

SEQ ID NO: 160820 - RNA, 64 nt, Human
gacccgcggcggggcggcauccccagcugguucgggccgugacggggcggccagcagggacgcg

SEQ ID NO: 160821 - RNA, 64 nt, Human
uggcuacauuucaccugcaguuaccugggcuaucggccgugauacauuuuuuaauucauuuguu

SEQ ID NO: 160822 - RNA, 64 nt, Human
cucugacuucacugccgcagcucuuuccacacggggccgugauugacccuaaaaauugcagacc

SEQ ID NO: 160823 - RNA, 64 nt, Human
cugcccgccuacacuccuacguguccagggcuugggccgugacuuaggcagaggagugcagagg

SEQ ID NO: 160824 - RNA, 64 nt, Human
ugugugauaauuacuuagugaauucaugggugugggccgugauagaauuaagugauuugauguc

SEQ ID NO: 160825 - RNA, 64 nt, Human
guuguuugguaugcgcacaguuccugugggacugggccgugaguuuuccauuggaaagaaguuc

SEQ ID NO: 160826 - RNA, 64 nt, Human
cccuucgugaccuccgugugcccgagggaagagaggccgugacuagcucuuucuccgccgugag

SEQ ID NO: 160827 - RNA, 64 nt, Human
acccuuguccuccgcuggugcgggauggacagagggccgugaggggucccccugcuugucuuca

SEQ ID NO: 160828 - RNA, 64 nt, Human
uggcccuggccucgccagagcaccugaagaagcaggccgugagcgaggcugcgagugcccuggg

SEQ ID NO: 160829 - RNA, 64 nt, Human
ucacggcucugugcucuucugugugcugcguuguggccgugaagugggagcucuccuuuccaaa

SEQ ID NO: 160830 - RNA, 64 nt, Human
uuuuuccuucuucaggguggcuguaauuccagguggccgugauuucuuucuuccccacugccca

SEQ ID NO: 160831 - RNA, 64 nt, Human
agugcugggauuacaggcuugagcuaccgcgcccggccgugaacgcuauuuucuaagcagccag

SEQ ID NO: 160832 - RNA, 64 nt, Human
ccaucuagaagcugaagacgagagugaccgcgcuggccgugaaaucgacugcugcggguccagu

SEQ ID NO: 160833 - RNA, 64 nt, Human
ugggcaacagugcagaacugccagucaugccguaggccgugaagaaagaaugugaguaacuguu

SEQ ID NO: 160834 - RNA, 64 nt, Human
cuggacgguggggucagagggcagucgguauuuaggccgugagcuucccauacuacugcagguc

SEQ ID NO: 160835 - RNA, 64 nt, Human
augguucgaggaauaggcauuggaggugguuucuggccgugauuggaugugaaguagaagaggu

SEQ ID NO: 160836 - RNA, 64 nt, Human
agccaggcgggaggagggaguggagagacugacuggccgugaugggaaugacagugagaagguc

SEQ ID NO: 160837 - RNA, 64 nt, Human
ccaccaaaccuaugagccuuccacuguggaugggggccgugauccugauggucacauugcuuua

SEQ ID NO: 160838 - RNA, 64 nt, Human
uggacuguuuccccucucagcaucgcuuuugcugggccgugaucgucccccuuugugggcugga

SEQ ID NO: 160839 - RNA, 64 nt, Human
uacugucuuaaguuuauacucuuauagacaacauggccgugaacuuuaugcuguaaauaaucag

SEQ ID NO: 160840 - RNA, 64 nt, Human
ggggcuggugggugccuaggccugggcaguggauggccgugaaugggugcccacagugucaggc

SEQ ID NO: 160841 - RNA, 64 nt, Human
cugcaguugugguacacguccccggugcuggguuggccgugacucgggggcggggcgaucgggu

SEQ ID NO: 160842 - RNA, 64 nt, Human
ggagugugggccaggcugagugcauaggugacagggccgugagcaugggccuggguguguguga

SEQ ID NO: 160843 - RNA, 64 nt, Human
gaguuagccuuucucaauuauguuuccagacuguggccgugauucuaaaggaaaaugugugcuc

SEQ ID NO: 160844 - RNA, 64 nt, Human
gaucagggugucgcggguggggggucacugcugaggccgugaggggaaucugcucaggccuguc

SEQ ID NO: 160845 - RNA, 64 nt, Human
ugcuaggaaaugaguccccugggaaaggggaccgggccgugauguuaaauaucuccggcuccca

SEQ ID NO: 160846 - RNA, 53 nt, Human
aagacgucaucuucuucuaaaagggccgugacucaaggugcaaggccccuccc

SEQ ID NO: 160847 - RNA, 64 nt, Human
uauuuauuaagugccugagacacccgguuaccuuggccgugaggacacguggccugcacccagg

SEQ ID NO: 160848 - RNA, 64 nt, Human
gaaggaacuucacucugcugcuuccgagaaccucggccgugacauucggggccgggcgggaccc

SEQ ID NO: 160849 - RNA, 64 nt, Human
ccacccgcccgcccagggcugggcugggaucggaggccgugagccucccgccccugcagacccu

SEQ ID NO: 160850 - RNA, 64 nt, Human
ggcaaccuggcgccaugaccccaggcccagucugggccgugacucugggugagucgugugacuc

SEQ ID NO: 160851 - RNA, 64 nt, Human
acgcuguccugggggcacugggaagccuagauaaggccgugagcagaaagaaggggaggauccu

SEQ ID NO: 160852 - RNA, 64 nt, Human
aaggucuuauuccagaaaggagguuaaggagaguggccgugagagugccauccgaaagaagcua

SEQ ID NO: 160853 - RNA, 64 nt, Human
agaccccaccucugugaacuuauuuuucuuucuuggccgugagccuaaccaugaucuugaggga

SEQ ID NO: 160854 - RNA, 64 nt, Human
agccgcaggaggaugcguugccugcagugcagacggccgugagcucugggcaaaccuaaacaga

SEQ ID NO: 160855 - RNA, 64 nt, Human
aaaguuuauggagaccuucaaggcccugaaggagggccgugagccugacuacucagaguacaag

SEQ ID NO: 160856 - RNA, 64 nt, Human
ggguaaaucucuguucaaggcucucagcucugaaggccgugagaccccugauuucccacuccac

SEQ ID NO: 160857 - RNA, 64 nt, Human
ccuggcccuguagcuuuucuuuuucuccaggcugggccgugagcaggugggccguugaguuacc

SEQ ID NO: 160858 - RNA, 64 nt, Human
agugcugggauuacaggcgugagccacugcgccuggccgugacugauuuuuuuucauguagaau

SEQ ID NO: 160859 - RNA, 64 nt, Human
gaccuaccuggaagcagcugacaugcugguggacggccgugacuggagcccgugccccucccuc

SEQ ID NO: 160860 - RNA, 64 nt, Human
auaaaacuuagaguuuuuaucuuccccuaaaagaggccgugauauuugcagcagccucaaauug

SEQ ID NO: 160861 - RNA, 64 nt, Human
ucagaaaauaucccuccuguugggagagggcgcaggccgugacgucuggguggcccuuaugacu

SEQ ID NO: 160862 - RNA, 64 nt, Human
guuccuaccuaaaugaagaaaccaugccuggaggggccgugaacacagaacccucaagacaagg

SEQ ID NO: 160863 - RNA, 64 nt, Human
gaccacacccaaggugggggcuguggccauguguggccgugaugucgaugauacucguuuuccc

SEQ ID NO: 160864 - RNA, 51 nt, Human
ggguggagacggacguguagcccuggcgaggccagccggcggcagcacagc

SEQ ID NO: 160865 - RNA, 64 nt, Human
agcguuucugguuuuggguguacagucuugugugccuggcgagaagaauauuuucuauuuuuuu

SEQ ID NO: 160866 - RNA, 64 nt, Human
ugcagugagccaagauugcaccauugcacuccagccuggcgacagagcaagacucugucucaaa

SEQ ID NO: 160867 - RNA, 64 nt, Human
ugcagugagccaagaucgugccacugcacuccagccuggcgacacagugagacucugucucaaa

SEQ ID NO: 160868 - RNA, 64 nt, Human
gccgcccucccuuggccgcccuacuccccaguuuccuggcgaugagccauuuauugugucucac

SEQ ID NO: 160869 - RNA, 64 nt, Human
cccagagccccaggaaaaugggagugagaagaugccuggcgagguuuuggccaggaggacguga

SEQ ID NO: 160870 - RNA, 64 nt, Human
cauagcucugugugagccagcaauaccgcugcccccuggcgacagggcagaccaaugaugccag

SEQ ID NO: 160871 - RNA, 64 nt, Human
aggccaaccggcaccacggacuccuggguggcgcccuggcgaacuuguuugugauaguuggguu

SEQ ID NO: 160872 - RNA, 64 nt, Human
ugggcggaucacaaggucaggagaucgagaccauccuggcgaacacggugaaaccccgucucua

SEQ ID NO: 160873 - RNA, 64 nt, Human
uaguaggccuuccuuccuccgcugggcugggucaccuggcgaggguuucacucaucauggaugc

SEQ ID NO: 160874 - RNA, 64 nt, Human
caaauucagccuccaucacuuaccagucaggaacccuggcgauaucacuuuaacuuucugaacc

SEQ ID NO: 160875 - RNA, 64 nt, Human
gaauguaacuccuggugugaagaugaauguaaacccuggcgacaguugagaccuuuuucuuuua

SEQ ID NO: 160876 - RNA, 64 nt, Human
uugggaacaaguguaauuuccuucccuccuuuaaccuggcgaugagcguccuuuaaaccacugu

SEQ ID NO: 160877 - RNA, 64 nt, Human
guccugccaaggggcgccaggagcagagccagggccuggcgagcuggcguggagcccacaggau

SEQ ID NO: 160878 - RNA, 64 nt, Human
cccgcagucccugcaugaccauuggcccugcuggccuggcgaugugggcauccugggguucuua

SEQ ID NO: 160879 - RNA, 64 nt, Human
cuccccuucaugcccuagccuguguucuagcuguccuggcgagacuucugugagugaagaggaa

SEQ ID NO: 160880 - RNA, 64 nt, Human
gagccaggagucgcggccccugccucccuuccucccuggcgauccucaccugcccagccauggc

SEQ ID NO: 160881 - RNA, 64 nt, Human
ugcaguguggugagaucaugccacuacacuccagccuggcgacagagcgagacuugguuucaaa

SEQ ID NO: 160882 - RNA, 64 nt, Human
cacuggugugugccgggcgccgaggccaggggccccuggcgagaaccgcacacaccccucccac

SEQ ID NO: 160883 - RNA, 64 nt, Human
ugcagugagccgagaucacgccacugcacuccagccuggcgacagagcgagacucccucucaaa

SEQ ID NO: 160884 - RNA, 64 nt, Human
ccuugacccucagccaagauugguaaagcugcguccuggcgauuccaggagacccagcuggaaa

SEQ ID NO: 160885 - RNA, 64 nt, Human
uauuuauuagagcugugagagcuugggggacacaccuggcgagcaagcucgcuuuuuaaaaaug

SEQ ID NO: 160886 - RNA, 64 nt, Human
acugccucauucagagauagaugccugcauggguccuggcgauuauuuuaaugcuggcuacacc

SEQ ID NO: 160887 - RNA, 64 nt, Human
uacccuuaaugcuugagaaccuaaagcugguuauccuggcgaacaccccuacccuucuauugcg

SEQ ID NO: 160888 - RNA, 64 nt, Human
ugcagugagacgagaucgcgccacugcacuccagccuggcgacagagcgagacgccgucucaaa

SEQ ID NO: 160889 - RNA, 64 nt, Human
ugcagugagcugagaucacgccauugcacucaagccuggcgacagagcgagacuccgucucaaa

SEQ ID NO: 160890 - RNA, 64 nt, Human
auccaucuccugguguucugcagucaucuccccuccuggcgaguucucuuuggaaauagcauga

SEQ ID NO: 160891 - RNA, 64 nt, Human
cugacuccuaaaccaaaagugcuuuaaaaaccagccuggcgaggacagcccuggacccacucca

SEQ ID NO: 160892 - RNA, 64 nt, Human
ugggacuuaaaaggcccaagcacugaaaauggaaccuggcgaaagcagaggaggagaaugaaga

SEQ ID NO: 160893 - RNA, 64 nt, Human
gaucacaccacuguacuccagcccggcacuccagccuggcgacaagagugagacuccaccucaa

SEQ ID NO: 160894 - RNA, 64 nt, Human
ccagcugccagggccuggggccacugggccagcgccuggcgauacugguugggggcaggaucau

SEQ ID NO: 160895 - RNA, 64 nt, Human
aucagguaagaggggaacagcugcuguacaucguccuggcgagugacaaugugacagaagccug

SEQ ID NO: 160896 - RNA, 64 nt, Human
ccucccugaggaguacuucacaccagcuccuuccccuggcgaucagagcucaggugaggaccgg

SEQ ID NO: 160897 - RNA, 64 nt, Human
uugcccucaagguuuuuugcuuuucuccugugcaccuggcgaggcugaaggcgagggguggagg

SEQ ID NO: 160898 - RNA, 64 nt, Human
uacagugagccgagaucauaccacugcacuccagccuggcgacagagcaagacuccaucucaaa

SEQ ID NO: 160899 - RNA, 64 nt, Human
gcccaggacguggguucagcgugggcgaggaaagccuggcgagcguggcccuguaaaagcuuuc

SEQ ID NO: 160900 - RNA, 64 nt, Human
agguucaucuccagguuucgggauucccauccguccuggcgauccugccagcagugggugggca

SEQ ID NO: 160901 - RNA, 64 nt, Human
gcacuagcugggccugguggccaccgccagagcuccuggcgacaucuuggcguggcagccucuu

SEQ ID NO: 160902 - RNA, 64 nt, Human
ccucuguacauuucccugugguucuccguccuucccuggcgagggagcugggacugaagcuuuc

SEQ ID NO: 160903 - RNA, 64 nt, Human
ggugagauaggggcagauaggagcugcaggggugccuggcgagccucugguuuuccucugcucc

SEQ ID NO: 160904 - RNA, 64 nt, Human
cguacccucgccagaggccccccuacaucaaccuccuggcgaugcccugguggagcagaugggu

SEQ ID NO: 160905 - RNA, 64 nt, Human
cugcuguuguaacacccuugauccuggaccaggcccuggcgagaugcauucacaagcacaucug

SEQ ID NO: 160906 - RNA, 64 nt, Human
gggcaggcucuuguccaguuucagggcugaaaugccuggcgaacuccauucagccaucacauau

SEQ ID NO: 160907 - RNA, 64 nt, Human
uggugcccccuccuccccggccaaggcgccuggaccuggcgaggacgcugcccgccgagcggac

SEQ ID NO: 160908 - RNA, 64 nt, Human
cucugugcuccuccuacccuuccagugcccuaggccuggcgacugccccugccuuuuagacccg

SEQ ID NO: 160909 - RNA, 64 nt, Human
ugacgcgugucccccacucaccuuccccggagacccuggcgaccgccgggcgcugacaccagac

SEQ ID NO: 160910 - RNA, 64 nt, Human
aggagaaggugugagcaugagccuauuggacacaccuggcgacguauaccaggugucccacccc

SEQ ID NO: 160911 - RNA, 64 nt, Human
ugcagugagcugagaucacaccacugcacuccagccuggcgacagagagagacuccaucucaaa

SEQ ID NO: 160912 - RNA, 64 nt, Human
gcagugagccaagaucgcaccacugcacuccagcccuggcgacagagugagacuccaucucaaa

SEQ ID NO: 160913 - RNA, 64 nt, Human
auuucugacucaucugccagcucuguccugcaugccuggcgagcuggggcccagggcagcauga

SEQ ID NO: 160914 - RNA, 64 nt, Human
ggcugacgccaagaaugaaguggcccacugcagcccuggcgagcaggcuucuuggauggacagu

SEQ ID NO: 160915 - RNA, 64 nt, Human
ugcagugagccaagguuccaccacugcacuccagccuggcgacagagcaaggcuccacucaaaa

SEQ ID NO: 160916 - RNA, 64 nt, Human
gguggaucaccugaggucaggaguuagaggccagccuggcgaaaccccaucucuacuaaaaaua

SEQ ID NO: 160917 - RNA, 64 nt, Human
ugggcagaucacgaggucaagagaucgagaccauccuggcgaacauggugaaaccccaucucua

SEQ ID NO: 160918 - RNA, 64 nt, Human
cacugaagcuggacaagagccucaauaaggacacccuggcgaggaagcuggcagugcucacccc

SEQ ID NO: 160919 - RNA, 64 nt, Human
agaaagcccuuucccagcccuccaccacuuccacccuggcgaguggagcaggggcaggcgaacc

SEQ ID NO: 160920 - RNA, 64 nt, Human
ugggacgcaaaggagggagggaagcaaggccuugccuggcgaguugucaugugguuggugguga

SEQ ID NO: 160921 - RNA, 64 nt, Human
caaugugcuaggauuacaggcaugagccacuguaccuggcgaaaaacaguuuguuaacacaggc

SEQ ID NO: 160922 - RNA, 64 nt, Human
ccccuucaggccuccuuacuccaucuuccagaccccuggcgaccaccgccccucucaguggcuc

SEQ ID NO: 160923 - RNA, 64 nt, Human
cgguggacuuuuccucuggacaaaaugacagcauccuggcgacuccacaguggagcugagcgcc

SEQ ID NO: 160924 - RNA, 64 nt, Human
ccuggaaccaccugggucggccgcccaaaucuuuccuggcgaaggggagggaagggguguucug

SEQ ID NO: 160925 - RNA, 64 nt, Human
gugccaaaccgccccucagcagggcagggccaguccuggcgaccccgguuccucuguguccucu

SEQ ID NO: 160926 - RNA, 64 nt, Human
cggguggaucacgaggucaggagaucgagaccauccuggcgaacauggugagaccccaucucua

SEQ ID NO: 160927 - RNA, 64 nt, Human
gggcgaccucaauggugcgugcauccccgagcacccuggcgaccucgugcagaccgaggccuuc

SEQ ID NO: 160928 - RNA, 64 nt, Human
aggaaagggaugcauugacacucuccugcaugcaccuggcgagaagccaccugaaagucacugu

SEQ ID NO: 160929 - RNA, 64 nt, Human
ccaucuaggggcacaggcccccacggccgggcccccuggcgacaacuuccaucauuccagagaa

SEQ ID NO: 160930 - RNA, 64 nt, Human
cuuccgcuugauuuugcacaaucccggcgauacuccuggcgauacugacuagaaagucagggag

SEQ ID NO: 160931 - RNA, 64 nt, Human
gauuagucgagacugguccucaccugcuccggcuccuggcgaccacuaccccugcgucccggcc

SEQ ID NO: 160932 - RNA, 64 nt, Human
uucagugagccaagaucgcaccacugcucuccagccuggcgacagagggagacuccaucucaaa

SEQ ID NO: 160933 - RNA, 64 nt, Human
uuaaaaaaacaacucauucccacauucuucagucccuggcgaccaccauauuuuuaagucauua

SEQ ID NO: 160934 - RNA, 64 nt, Human
uuuuuuuuuugaugagucucacucugcacuccagccuggcgacagagcaagacuccaucuaaaa

SEQ ID NO: 160935 - RNA, 64 nt, Human
aucuccacccuaaaauaguucuguugaauuucacccuggcgauguaaacugagagcuuaucuuc

SEQ ID NO: 160936 - RNA, 64 nt, Human
ugcagugagccgagauugcaccacugcauuccagccuggcgacagagugagacuccaucucaaa

SEQ ID NO: 160937 - RNA, 64 nt, Human
cuugaguccuggaguuggagaacagccuggaaagccuggcgauaccccaucucuauuuagaaac

SEQ ID NO: 160938 - RNA, 64 nt, Human
ucgccucugaaugaugcuucuuucuguguuggagccuggcgaaguuguguuuucaagcccucua

SEQ ID NO: 160939 - RNA, 64 nt, Human
ccucaccaggucucugagcugggugggaggccauccuggcgaccacugcccauuccauucaccc

SEQ ID NO: 160940 - RNA, 64 nt, Human
ucugccccugcaguggguguuacgggcggugugcccuggcgagcaagcuuugauucuugguucu

SEQ ID NO: 160941 - RNA, 64 nt, Human
ucagggugccaggaagaucucgucggagccuguuccuggcgagaguaagagccaccgggcuggg

SEQ ID NO: 160942 - RNA, 64 nt, Human
aggaccuuggagggaggaacaacgagcagaaggcccuggcgacugggcugagcccccaagugaa

SEQ ID NO: 160943 - RNA, 64 nt, Human
uuuaugagucccuguccucuucugcagguccagcccuggcgagggcaggucagaggaagugaag

SEQ ID NO: 160944 - RNA, 64 nt, Human
ugcacccccacagguuuggcuugugguuuuugucaucaguaaccuacugccugagaucaugauc

SEQ ID NO: 160945 - RNA, 64 nt, Human
caagccagcuucagagaauagugaggagaagcugaucaguaaguuugacaagcuuccaguaaag

SEQ ID NO: 160946 - RNA, 64 nt, Human
ccagacucgauguguacucuaacuuaagaaauaaaucaguaaggcagaacaagagacaugcuuu

SEQ ID NO: 160947 - RNA, 64 nt, Human
guuggccuuugcaugggaggcagguggggcuuggaucaguaagucugguucccgccucccuguc

SEQ ID NO: 160948 - RNA, 64 nt, Human
cuuucccaagaugaugguaaaacccagguuagucaucaguaaccuucucuauuauuauuauuuu

SEQ ID NO: 160949 - RNA, 64 nt, Human
auuugucagcauuccugaaaaccuacacguguauaucaguaaccaaaaugcuaugccuuuuuug

SEQ ID NO: 160950 - RNA, 64 nt, Human
aaaauaaacaagaacaaaagaauaguauaauuauaucaguaacaagaagacucaaaaaagaaac

SEQ ID NO: 160951 - RNA, 64 nt, Human
ccuuauaaguuuagaggucaugaagguuuuaaugaucaguaaagauuuaaggguugagauuuuu

SEQ ID NO: 160952 - RNA, 64 nt, Human
gccauaaaggacaauaugaacugaugccuggacuaucaguaaccccacugcacaggcacacgau

SEQ ID NO: 160953 - RNA, 64 nt, Human
auuaagacuggaaguccuauuuuauuuaaucaguaucaguaaaaagacaaaaauuacaguguga

SEQ ID NO: 160954 - RNA, 64 nt, Human
ggugcucuugaaccugugcucauuuugcaauuuuaucaguaauuugacuuagaguuuuuacgaa

SEQ ID NO: 160955 - RNA, 64 nt, Human
ucacuuuuuaaaacaucccuaacugaucgaauauaucaguaauuucagaaucagaugcauccuu

SEQ ID NO: 160956 - RNA, 64 nt, Human
guaaaacauguaauuguuucucuggcaaauuuguaucaguaauuugaaaaugagauauuaggaa

SEQ ID NO: 160957 - RNA, 64 nt, Human
cuuagcuauaugaauuuuggcauguuucagagagaucaguaaauaaaauauuagauaaaauaua

SEQ ID NO: 160958 - RNA, 64 nt, Human
auuuuucuuucacuggccugaguuaggacaugcuaucaguaauagucccaguuccauccaacuu

SEQ ID NO: 160959 - RNA, 64 nt, Human
ucugcuagcaaaaucaaguucuuuuugaaauuuuaucaguaauccagaauuuaguaguccaugc

SEQ ID NO: 160960 - RNA, 64 nt, Human
gcuagauguuuaacuuucuaagccuccauuucucaucaguaaauaauaguugcuuccuaggacu

SEQ ID NO: 160961 - RNA, 64 nt, Human
gccaucauuucccuuuccccucugaauggcagacaucaguaaucaaucuggaauguuuuucuuc

SEQ ID NO: 160962 - RNA, 64 nt, Human
auauauuuaguuugaguggaauuugucagcagauaucaguaacuuauugccgcuuauauuguac

SEQ ID NO: 160963 - RNA, 64 nt, Human
uuagauaauauuuuuguauuucucuauuuucauaaucaguaaauagugucauauaaacucauuu

SEQ ID NO: 160964 - RNA, 64 nt, Human
uacuucuucuggucagauaccaugaaugccagucaucaguaaaucuuaauacacuuuugcuuua

SEQ ID NO: 160965 - RNA, 64 nt, Human
cgauuuuguaacagaaauugcuuauaaguuuuuuaucaguaaggaccaugaucaccauuuguac

SEQ ID NO: 160966 - RNA, 64 nt, Human
aaccaucaaguccuuuuucuuggguauauauuuaaucaguaaguuaauuaguggcauaaaaaag

SEQ ID NO: 160967 - RNA, 64 nt, Human
gguggugccaggggcuggaggccccuagaaaaagaucaguaagccccaguguccccccagcccc

SEQ ID NO: 160968 - RNA, 64 nt, Human
aaauauguuugaaagcauugguagugcuuuccuuaucaguaacuggaguucuccugcuugcacu

SEQ ID NO: 160969 - RNA, 64 nt, Human
uuuuuggagaacuagccauuauuuuagccacagaaucaguaagaacagaugauaugcaacagua

SEQ ID NO: 160970 - RNA, 64 nt, Human
ucugacaaaugugaaugagcugccauuggugggaaucaguaaacuuugaaaaccuuucacugau

SEQ ID NO: 160971 - RNA, 64 nt, Human
cucuguuuuaaaaacucagaggcaauuuuuacauaucaguaauuguuuuuauaauuugugguuu

SEQ ID NO: 160972 - RNA, 64 nt, Human
agugguuuuggccauaccguauuauaccauauacaucaguaagagcucaucuuggaaccuguuu

SEQ ID NO: 160973 - RNA, 64 nt, Human
gacauuugucaccccacuggccuucucaggugcaaucaguaaaaaugcugagaacucuuggauc

SEQ ID NO: 160974 - RNA, 64 nt, Human
auccaagccauauauugaaauacaagcgugauuaaucaguaauucacauugccgauaugcauau

SEQ ID NO: 160975 - RNA, 64 nt, Human
cugagauuugguaaagaacacugccuuguuccccaucaguaaacaagguuaccuaccucaggag

SEQ ID NO: 160976 - RNA, 64 nt, Human
cuccccuuagugaucucaguucaaauauuaucuuaucaguaagacaaacccuucucccaucugc

SEQ ID NO: 160977 - RNA, 64 nt, Human
ugugaaaaacaauuuauguuugcaggguuuaaaaaucaguaaaaaugggaaugauugagcuaaa

SEQ ID NO: 160978 - RNA, 64 nt, Human
uuuuuauccuagggccaaguguugccugccaccaaucaguaaguuagucuauaacaaauuuuac

SEQ ID NO: 160979 - RNA, 64 nt, Human
uuuuaguuaguacuaaauucuuaguaaaaugcugaucaguaaaccaaucccuugaguuauauaa

SEQ ID NO: 160980 - RNA, 64 nt, Human
acugcucuuuucauucauguguugucauuuguauaucaguaauucagguacccauuucauagac

SEQ ID NO: 160981 - RNA, 64 nt, Human
cugugacugaaacaagaagguuauugcagcaaaaaucaguaacaaaaaauaguaacaauaccuu

SEQ ID NO: 160982 - RNA, 57 nt, Human
cucgcuacacagaguguuaacuguuacaucaguaacugcauuauugaauuguucuua

SEQ ID NO: 160983 - RNA, 64 nt, Human
gaaacuuguauuauaaguuuauuaguugugauguaucaguaacugcuguuaccccuuuuucaaa

SEQ ID NO: 160984 - RNA, 64 nt, Human
auugaaaugcauggguagaaauugaaccaggaaaaucaguaaagugauuguaaaaaagaaggac

SEQ ID NO: 160985 - RNA, 64 nt, Human
aguaaauugcauggacuucuuaaagaaguuugaaaucaguaaaaagacauuaggaucaugcaau

SEQ ID NO: 160986 - RNA, 64 nt, Human
auugauuguggugccucaggugaaaugagaagcuaucaguaacagcuacucucaucgaaagcac

SEQ ID NO: 160987 - RNA, 64 nt, Human
agcuacucaaaaguuuuacacacuuaaaacucagaucaguaaguguugguaccuuuuagacuca

SEQ ID NO: 160988 - RNA, 64 nt, Human
caaaaacuauuugggauauguauggguaggguaaaucaguaagagguguuauuuggaaccuugu

SEQ ID NO: 160989 - RNA, 64 nt, Human
uuuaaagacuaaaccaucucacagauuguucuguaucaguaaauaaagaucuuucccccacccu

SEQ ID NO: 160990 - RNA, 64 nt, Human
guggaucuggcauacccaaguucaguaaaugucuaucaguaagcugaugguacaugcauuuucu

SEQ ID NO: 160991 - RNA, 64 nt, Human
ccaacuuauuuguauaccuaaggcaggcauuuggaucaguaacauguuuuacuaagccuagagu

SEQ ID NO: 160992 - RNA, 64 nt, Human
guguauggcuauuuguauuuaacaagacuuaaucaucaguaauuuguauacaaagcauuguggu

SEQ ID NO: 160993 - RNA, 64 nt, Human
agaacuuuuuuaauuuuuuugaauaauuauaaguaucaguaaaggaagugaaagacaggauugc

SEQ ID NO: 160994 - RNA, 64 nt, Human
guucaaaaacacccgacgucauguauuugagcauaucaguaacccccuuaaauuuaauaccaga

SEQ ID NO: 160995 - RNA, 64 nt, Human
guugcuucaugguuuaugcucgccauggaaagcuaucaguaacaguuucaugcuuauaccaaag

SEQ ID NO: 160996 - RNA, 52 nt, Human
acucuaauucugagaacuaaaaaucaguaauuuccacaauuguauguugaau

SEQ ID NO: 160997 - RNA, 64 nt, Human
aagcagguuucuugcuucuggcuuuguucuugucaucaguaaguauaacaaacuauguaaugcu

SEQ ID NO: 160998 - RNA, 64 nt, Human
guuuaaacacuccaacacccagacuuagaauuaaaucaguaaagcaaucuguuauuuccuaucc

SEQ ID NO: 160999 - RNA, 64 nt, Human
ccuuuaaacauccacaaauucuuaaaaagauugaaucaguaaauuucauuucagcuaaaaaugg

SEQ ID NO: 161000 - RNA, 64 nt, Human
caugcuuuuuuguaacaucaaagaaaacauacccaucaguaauuucucuaauacugaccuuucu

SEQ ID NO: 161001 - RNA, 64 nt, Human
ucgauacauacaaagacguaauugcugacccacaaucaguaacauccauauugagagauuuuuc

SEQ ID NO: 161002 - RNA, 64 nt, Human
uccauuaauguaaagucauaggucauuauugcauaucaguaaucucuuggacuuuguuaaauau

SEQ ID NO: 161003 - RNA, 64 nt, Human
guuuuccaacuauguugaauaaauaguaauauuuaucaguaaauacuccuuuccaacuuccuuu

SEQ ID NO: 161004 - RNA, 64 nt, Human
ccuaugacuuuggucaugucaaucuguaagacacaucaguaaaaggguauuaugcucuguuggu

SEQ ID NO: 161005 - RNA, 64 nt, Human
ucuagucugaguuugcuaaguauauuuuaaaauaaucaguaaaguuagauuuuauccauuuuua

SEQ ID NO: 161006 - RNA, 64 nt, Human
ucucuuuucuucucaggauuuaaaauuuaauuauaucaguaaagagauuaauuuuaacguaacu

SEQ ID NO: 161007 - RNA, 64 nt, Human
auuuggauuucucaaauacauucauuaguaauuuaucaguaacauuaguuuuauuuuuguucau

SEQ ID NO: 161008 - RNA, 64 nt, Human
uauuguaaucuauguuuauaauacuacuacuguuaucaguaaugcuaaauguguaauaauguaa

SEQ ID NO: 161009 - RNA, 54 nt, Human
accaacaauauaccuuuuaauaucaucaguaacugcaggacaugauuauugagg

SEQ ID NO: 161010 - RNA, 64 nt, Human
uaaugagcacuacaaauuuagaauauauaaaaauaucaguaaccuaugaauucaucaacauaac

SEQ ID NO: 161011 - RNA, 64 nt, Human
aaaauaguaaauaggauuuuaaacagagaauuuuaucaguaauaggugucaguuuuuaaaaaau

SEQ ID NO: 161012 - RNA, 64 nt, Human
uauuauuuagucuaacagcuacuaaaaguaaaacaucaguaaacaauucuaacaugcccuuaug

SEQ ID NO: 161013 - RNA, 64 nt, Human
caaugaaggaagcuucaaaugagaacaugauggaaucaguaaccauucaaucuuuuguccuagg

SEQ ID NO: 161014 - RNA, 64 nt, Human
uuacuaagcauagcaaacagaggaagaauuuguuaucaguaagaaaaagaagaacuauauguga

SEQ ID NO: 161015 - RNA, 64 nt, Human
uuauuuguaaaauuuaguaguucauauuuaguauaucaguaauauagaagacaucuuuauaguc

SEQ ID NO: 161016 - RNA, 64 nt, Human
uuucagcuccagaauuauuguuacucauauuuuaaucaguaagucauuuaagcuaugacagagu

SEQ ID NO: 161017 - RNA, 64 nt, Human
aauaaucaguucuuaugaaaacaaauagagaaauaucaguaagucaaaucuguuugaauuauaa

SEQ ID NO: 161018 - RNA, 64 nt, Human
uacccuucuacaaaagaagugugacuagauaucaaucaguaauuaacauaucaaggagcucuuc

SEQ ID NO: 161019 - RNA, 64 nt, Human
caucgaaauguauaaaaauugcaguaucuuuaaaaucaguaaaauggacuagcauauuauuuau

SEQ ID NO: 161020 - RNA, 64 nt, Human
acuuggaaagucacuaaugugccucaguuaauacaucaguaaaauguuguguuucuuuuccagu

SEQ ID NO: 161021 - RNA, 64 nt, Human
agaauagugugaaagggaacuguuuuaguuuccuaucaguaauuguacaugcaguuaaauguuu

SEQ ID NO: 161022 - RNA, 64 nt, Human
augcaaacgucaugaggagaauuaaaggaguauuaucaguaaugaaguuuaucaugggucauca

SEQ ID NO: 161023 - RNA, 64 nt, Human
guucacuuauuguacucuggcaauuuaaaagaaaaucaguaaaauauuuugcuuguaaaaugcu

SEQ ID NO: 161024 - RNA, 64 nt, Human
gcauaagcuuguuuguauguucuggcagugacuaaucaguaaaugaugucgguuugcccaguau

SEQ ID NO: 161025 - RNA, 64 nt, Human
gaaacaaucuuuguacaaugacuagucaugcaucaucaguaauuuuacaaguucuuguaguagg

SEQ ID NO: 161026 - RNA, 64 nt, Human
augucuguuuuaaaagaaaguagcguuaagauagaucaguaaccaaaaucauaggcuuuuucug

SEQ ID NO: 161027 - RNA, 64 nt, Human
cugucuguuuuaaaagaaaguagcguuaagauagaucaguaaccaaaaucauaggcuuuuucug

SEQ ID NO: 161028 - RNA, 64 nt, Human
ucucuaauuauuacgccaacucaaguaguuaaaaaucaguaagaaaaaugucuugagcuagaag

SEQ ID NO: 161029 - RNA, 64 nt, Human
ggcagaagaaugggaauauuuuauacugacagaaaucaguaauauuuauauauuuauauuuuua

SEQ ID NO: 161030 - RNA, 64 nt, Human
cagaugugcuuccugagcauggguugugccucccaucaguaaaaaaauguuuaguucacuuccu

SEQ ID NO: 161031 - RNA, 64 nt, Human
ccuugaauaucacauaccacauuguuaucaauucaucaguaaggucagaugcuguuugcacacc

SEQ ID NO: 161032 - RNA, 64 nt, Human
ccaccugacuuaguggaugugaaagcuguuugugaucaguaaagcuaccacagauauaagggug

SEQ ID NO: 161033 - RNA, 64 nt, Human
auuagacccaccacuaggucaucuuauuugaugcaucaguaaagcagcauauucaaauguggau

SEQ ID NO: 161034 - RNA, 64 nt, Human
guaaauguuaacuguucuuggaaaaaauaaaaacaucaguaacaaaagaaauuggcugccaucg

SEQ ID NO: 161035 - RNA, 64 nt, Human
aauacguagauguugucaaguagggauuugcuuaaucaguaagucuuugugaaugaauacgaau

SEQ ID NO: 161036 - RNA, 64 nt, Human
ucauagaaaaucugcaucaaaucaguuuccaugcaucaguaauauugaaggucauaaucaguga

SEQ ID NO: 161037 - RNA, 64 nt, Human
aaugaauguuuuuuuauuuaccccacauuacccaaucaguaaaacauuuagguguuugcuaaua

SEQ ID NO: 161038 - RNA, 64 nt, Human
gauuauguauagauuacauaggaagaacaaucacaucaguaaguuauaguuuauauuaaaggua

SEQ ID NO: 161039 - RNA, 64 nt, Human
aagccuugacaaaguaaguauauuuuagagcugaaucaguaagauucuagagaaagcaaaacau

SEQ ID NO: 161040 - RNA, 64 nt, Human
uuaaggauugccagcuucaguuaagacaagaccuaucaguaaaugaauauauguuuugauuuaa

SEQ ID NO: 161041 - RNA, 64 nt, Human
auauauaaauauaaauauauucuuuacuuuuuguaucaguaaccaggcucgcacacacaggguc

SEQ ID NO: 161042 - RNA, 64 nt, Human
acauaagugauauauucuacuuaauuauuugugaaucaguaaccagaugcagcaaauaucuagg

SEQ ID NO: 161043 - RNA, 64 nt, Human
aggcaaacauacuucuccuagcugaguauuuuuuaucaguaaguacaaauacaaugcagagcuc

SEQ ID NO: 161044 - RNA, 64 nt, Human
acagggcuguguagcaugauaccaggcccaggagaucaguaauuacaaauuaaggguuaaauca

SEQ ID NO: 161045 - RNA, 64 nt, Human
aauccuuuuaaaacauuuuuguuaaaguuaguguaucaguaagaaacagaccuaguuuaaaagg

SEQ ID NO: 161046 - RNA, 64 nt, Human
ggaaugugguguuuuaaagcaguguugcauuuuaaucaguaaucuaccugguggauuuguuuuu

SEQ ID NO: 161047 - RNA, 64 nt, Human
cuaaugcaucacugugacaaaagccacacgcauuaucaguaacuuugcuugccacggaaaaggu

SEQ ID NO: 161048 - RNA, 64 nt, Human
cucgaucacuaaacauaugcauauauuuuuaaaaaucaguaaaagcauuacucuaaguguagac

SEQ ID NO: 161049 - RNA, 64 nt, Human
cgccacucaugucuccuccacaugcgguccacacaucaguaagggccuggagauguguaaagac

SEQ ID NO: 161050 - RNA, 64 nt, Human
cuuaaauccucagaugccaggggucugcucuagcaucaguaaguauuuagcagaaacuaacucc

SEQ ID NO: 161051 - RNA, 64 nt, Human
acauucuucuuccuguguggaugcuuauuugucaaucaguaaauuuguucguaaagaaaauuac

SEQ ID NO: 161052 - RNA, 64 nt, Human
ucuuuguucucucauguugauccaagccagagacaucaguaacaaauagcaccuguguuguuug

SEQ ID NO: 161053 - RNA, 64 nt, Human
gugcuucuuggaucagauccuggaacagaaaaagaucaguaaugaaaaaacugaugaagucuga

SEQ ID NO: 161054 - RNA, 64 nt, Human
cuaaaaagucagauguuugagcaguggccuacaaaucaguaauuuucggaugggagaguuucuu

SEQ ID NO: 161055 - RNA, 64 nt, Human
ucauuuuuuuuaauugaaaagaaguagugucuggaucaguaaaauuauacugugugugagugug

SEQ ID NO: 161056 - RNA, 64 nt, Human
uaguaucagaaaauacgagauuugcaggggaaacaucaguaaacuaccauuaaugucaaugccc

SEQ ID NO: 161057 - RNA, 64 nt, Human
uagauuuuaagaauggugcucuuucaugccuauuaucaguaaggggacuuguauuagagucaga

SEQ ID NO: 161058 - RNA, 64 nt, Human
gauuaauuuuuccauaaaaccauuuuuugaaccaaucaguaauuuuaagguuuuguuuguucua

SEQ ID NO: 161059 - RNA, 64 nt, Human
aaagaugaggucccugguuuuucauggcaacuugaucaguaaggauuucaccucuguuuguaac

SEQ ID NO: 161060 - RNA, 64 nt, Human
caauggguuuuccaagcugggcaagguacauuuaaucaguaaaucaguuucacaucauguauug

SEQ ID NO: 161061 - RNA, 64 nt, Human
cuggugaguucugauuauuaaauauucucuguaaaucaguaaacauguauaaaguauuuguaau

SEQ ID NO: 161062 - RNA, 64 nt, Human
guaacccuaaaauugaugucuuuugguuuaugaaaucaguaauuuuugauauuuccccaguucu

SEQ ID NO: 161063 - RNA, 64 nt, Human
uucucagugugauuccaauuauuacgaagcacuaaucaguaacgcuacaaugaucauaauugca

SEQ ID NO: 161064 - RNA, 64 nt, Human
ucuggacgacugugcaaugcugugugcucccgggaucaguaacccuuccgcuguuccugaaaua

SEQ ID NO: 161065 - RNA, 64 nt, Human
acugaccuuuguuuccuuauucaggaagauaaaaaucaguaaccuaccccaugaagauauuugg

SEQ ID NO: 161066 - RNA, 64 nt, Human
cuaaaguauuuguaaauaaaugacaugaucuagaaucaguaauuuuguguuugggguguggggg

SEQ ID NO: 161067 - RNA, 64 nt, Human
uucccacaguuuugguaagaaaccagccccaguaaucaguaagucaggcugaacugcagugacu

SEQ ID NO: 161068 - RNA, 64 nt, Human
cuaacucugcuuagagguucaaauaucaccagcaaucaguaaaaaauucagcaauaaucuuaag

SEQ ID NO: 161069 - RNA, 64 nt, Human
uuuagcacuggagcaaauagccaagggaaaucaaaucaguaacuggucauggucaugcaucuaa

SEQ ID NO: 161070 - RNA, 64 nt, Human
gucuuaaugcagccuauuaagaguuggguuaaaaaucaguaaucaguacuuuauuacaucacug

SEQ ID NO: 161071 - RNA, 64 nt, Human
aagauaugauacgugcugcuuguucaucacaaaaaucaguaagcacaauaaaguggaugccaaa

SEQ ID NO: 161072 - RNA, 64 nt, Human
aauuuauucugccguguugauagaauaacugaauaucaguaaauuguguaacagugguggauac

SEQ ID NO: 161073 - RNA, 64 nt, Human
auaaauacaauaguugaaaauuuuucucuguuacaucaguaauauuguuaaaguaauggauaga

SEQ ID NO: 161074 - RNA, 64 nt, Human
gcaacuuucauuaaaaaacaaauucagaugaaauaucaguaacugucuuggacagugcugaaau

SEQ ID NO: 161075 - RNA, 64 nt, Human
ugcugucacaaccaagaauguuaugugcaaguuuaucaguaaauaacuggaaaacagaacacuu

SEQ ID NO: 161076 - RNA, 64 nt, Human
acuacaaguuauaauguguguuaccuacacuucaaucaguaauauuagcaaaucuccaaauguu

SEQ ID NO: 161077 - RNA, 64 nt, Human
uccuaaaggaauacacugaaaguuaaggagaagaaucaguaaguguaagguguacuugguauua

SEQ ID NO: 161078 - RNA, 64 nt, Human
agguacaauagaagaaaagaucuaucaaaggcagaucaguaagcaaggucuuuguggggcaguu

SEQ ID NO: 161079 - RNA, 64 nt, Human
cuuagauaacuucuugaaaaagauggcuuaugucaucaguaaaguaccuuuauguuaugaggau

SEQ ID NO: 161080 - RNA, 64 nt, Human
gacaagaaaaaaaaacaaacaaacacuucuuuccaucaguaacacuggcaaucuuccuguuaac

SEQ ID NO: 161081 - RNA, 64 nt, Human
ugaggugguuauacuguugcuguuaaaaguugguaucaguaagauuuguguuuugugauaaucc

SEQ ID NO: 161082 - RNA, 64 nt, Human
uguucuuuucuuuuuuuuaaucccugaagggaugaucaguaacauagcuucucuuuucuguacu

SEQ ID NO: 161083 - RNA, 64 nt, Human
guaugugcccauuugcaaaacaaaaaugcuaauaaucaguaauaguccuauaaaagauguuaac

SEQ ID NO: 161084 - RNA, 64 nt, Human
cugcuauagaauacccucccagcaacaaaaccuaaucaguaaggccagcuagacccaauggcuc

SEQ ID NO: 161085 - RNA, 64 nt, Human
cccccccucuaugggaaggaugccuuuacucuuuaucaguaauaaauuaugacuguuuucauau

SEQ ID NO: 161086 - RNA, 64 nt, Human
gacauaauauguauuaaguuauacuaauguuucaaucaguaaagaaauaaaaguuuaggauuua

SEQ ID NO: 161087 - RNA, 64 nt, Human
uugauuuugaggaguaucuuauuugcuuucuaucaucaguaaaaacagcauuuaacuugcuaaa

SEQ ID NO: 161088 - RNA, 64 nt, Human
uuuuuuugguuauuuguuuuauuaaaacauguacaucaguaaagaguuuuaaacaaugaauaug

SEQ ID NO: 161089 - RNA, 64 nt, Human
uuauaaaucauguaauuuagugccacucauguaaaucaguaaaaucacaaaggucuauuuaaug

SEQ ID NO: 161090 - RNA, 64 nt, Human
acuuaggaagugccaguggguuggugaacaugccaucaguaaaagcccuggaaacaaggucaua

SEQ ID NO: 161091 - RNA, 64 nt, Human
cauauuaaaauguauucaagcucacagauuuuuaaucaguaaggccuaucuauauuaguugucu

SEQ ID NO: 161092 - RNA, 64 nt, Human
gccucuaauagucaaugauuguguagccaugccuaucaguaaaaagauuuuugagcaaacacuu

SEQ ID NO: 161093 - RNA, 64 nt, Human
acccuaagucaauauauuuuuggugguuuuagugaucaguaaucaaauuuguacuuauuaugcu

SEQ ID NO: 161094 - RNA, 64 nt, Human
guuaauauaugcaccuaccuucuuccguuagugcaucaguaaauguguuauuuugucauuuuuc

SEQ ID NO: 161095 - RNA, 64 nt, Human
gaauauuucauggccgaacucuugauagugacaaaucaguaaauacaaccaagaaaaagaaaau

SEQ ID NO: 161096 - RNA, 64 nt, Human
ggacaauuucuuggcaauugucuuacuacuagggaucaguaagauuuagauucugagcccauaa

SEQ ID NO: 161097 - RNA, 64 nt, Human
uguuggauauaaucagagaacugaaaaguaauuuaucaguaauuuuuaagaguccauguuuugu

SEQ ID NO: 161098 - RNA, 64 nt, Human
auagcuacauucugaggcaaacgacagacucuuaaucaguaaauguucacuggcauuuugaagg

SEQ ID NO: 161099 - RNA, 64 nt, Human
ccccaaacuccuuaucuuuugcagucucucugggaucaguaaaagaaaaaaaaaauaaugugcu

SEQ ID NO: 161100 - RNA, 64 nt, Human
cccuaggacaagcauagugccugcaugcuucaugaucaguaaguccuggcugcauaaaggacuc

SEQ ID NO: 161101 - RNA, 64 nt, Human
gucucccuucuuucuauuugaacguccuucacucaucaguaaaauguaauaauugccuugugcc

SEQ ID NO: 161102 - RNA, 64 nt, Human
uuuguuuucagucauuauacauugcuuugguccaaucaguaauuuuuucuuaaguguuuuguga

SEQ ID NO: 161103 - RNA, 64 nt, Human
uccucugcccacucggggcccagcugugauuuuuaucaguaauggccaugccuccacccaccuu

SEQ ID NO: 161104 - RNA, 64 nt, Human
ccuucaauucuuucaacuccuguuaauacccauaaucaguaaccuaucaagaaaagcccuuauu

SEQ ID NO: 161105 - RNA, 64 nt, Human
aagcuuuuuaacagggcauuuaaguggcuagcaaaucaguaauuaaaaauuaagcuuucuacuc

SEQ ID NO: 161106 - RNA, 64 nt, Human
gcccaauacccaaaaggguuuuauggaaacuaacaucaguaaccuaacccccgugacuauccug

SEQ ID NO: 161107 - RNA, 64 nt, Human
aaaacaaaccacugucucugcuucugaaacgggaaucaguaacucuuugcauuuucugucccac

SEQ ID NO: 161108 - RNA, 64 nt, Human
cagcuaauaaugaaguuauucuugacaugagaaaaucaguaauuggaccaggcgcgguggcucu

SEQ ID NO: 161109 - RNA, 64 nt, Human
ugauguuuuacugcaaaucuuaugggucuagauaaucaguaaaagccaucuuccauaguuggug

SEQ ID NO: 161110 - RNA, 64 nt, Human
gaaggaaggcuaagaacuguccuugaggaacuucaucaguaacucugguaaagcauccugugga

SEQ ID NO: 161111 - RNA, 64 nt, Human
caagagugaaagaguggaaacacccgaaguguccaucaguaagggacaggcuagauugauuacg

SEQ ID NO: 161112 - RNA, 64 nt, Human
gaaagacuuccuugcaggagugacucaagaauuaaucaguaaauaccuugaaaugcuuguaagc

SEQ ID NO: 161113 - RNA, 64 nt, Human
uuuguuucaguucauacuagucccuucccaauccaucaguaaagaccccaucugccuuguccau

SEQ ID NO: 161114 - RNA, 64 nt, Human
uccaauuugaaccaguggggaaaaucccacagaaaucaguaaguuuacauuucaauuucuaucu

SEQ ID NO: 161115 - RNA, 64 nt, Human
uacaaauugauuggcuuaucacaaaaaucauuucaucaguaaaccuuguuaacauuuuguacug

SEQ ID NO: 161116 - RNA, 64 nt, Human
ucuauuuucuucauaaaacaggcacaaaaguuuuaucaguaaggaauuacagauugagaaauga

SEQ ID NO: 161117 - RNA, 64 nt, Human
augucuguuuuaaaagaaaguaguguuaagauguaucaguaacugaaaugauaugcuuucucug

SEQ ID NO: 161118 - RNA, 64 nt, Human
agagaugauaaucccauacucucaauugaguuaaaucaguaaucugucgcauuucaucaagauu

SEQ ID NO: 161119 - RNA, 64 nt, Human
cacagcuuguaugaaaggguugaauuugggcuccaucaguaauuuuugacauuuucaccaaaau

SEQ ID NO: 161120 - RNA, 64 nt, Human
aacaugucauguacaccaaacauuuuauaaaucaaucaguaaauauuuuguaagacccaaaauc

SEQ ID NO: 161121 - RNA, 64 nt, Human
aagaaugaucuaauauuuuuuuaaaguaauagcuaucaguaauagcugaguguuuuuuccccua

SEQ ID NO: 161122 - RNA, 64 nt, Human
ccuuauaacucuggaguuguaguuugacagaaccaucaguaaagacauaagcaaauaaaugguc

SEQ ID NO: 161123 - RNA, 64 nt, Human
uucuuuaauuuuagggucuuguuccaggacucaaaucaguaacuuggugauuacaaggugcuga

SEQ ID NO: 161124 - RNA, 64 nt, Human
aagugauaacacgcaaaaucacaaaguagcauaaaucaguaaauuaguugaguuguuuuugggg

SEQ ID NO: 161125 - RNA, 63 nt, Human
ugacaacauguuuaauaaauaaaaaugucuugauaucaguaagaaucagagucuucucacuga

SEQ ID NO: 161126 - RNA, 64 nt, Human
gugagaguaauuuuucauuguagcuguagucuccaucaguaacagcaggcccuggaagacuuga

SEQ ID NO: 161127 - RNA, 64 nt, Human
uuugauagcugacauugugauguugauguaucacaucaguaauaggaccagcuuugaauuucug

SEQ ID NO: 161128 - RNA, 64 nt, Human
cucguuuuacauaugcuuauaaaagaagugauguaucaguaauguaucaauaaucccagcccag

SEQ ID NO: 161129 - RNA, 64 nt, Human
cagcaaaauaaguguaucagcagguuuuaucaugaucaguaaaaauguuccaaaugcuucugcu

SEQ ID NO: 161130 - RNA, 64 nt, Human
aauuuagcacaaauucucucuuaguuccagaaaaaucaguaaaugcacaugcccuguugauugg

SEQ ID NO: 161131 - RNA, 64 nt, Human
ugcauuuuuuuuuuaguuguuaucaaauuguaaaaucaguaaugugauauuuuauauucugaaa

SEQ ID NO: 161132 - RNA, 64 nt, Human
acaaaaauguuucuguuuugaaacuugaucuacaaucaguaaaaguuugauaaucaguauaucc

SEQ ID NO: 161133 - RNA, 64 nt, Human
ucuuuugauaaugcccuuuagggcacaacuaguuaucaguaacugaauguaucuuaaucauuau

SEQ ID NO: 161134 - RNA, 64 nt, Human
ccgaucugcauagccugugaaagcccacggggacaucaguaaccuucugcagccaccauccaau

SEQ ID NO: 161135 - RNA, 64 nt, Human
guaaucgguuguucuuugaacguucaaaugacucaucaguaaaaacugucuacagagaaguaaa

SEQ ID NO: 161136 - RNA, 64 nt, Human
aguggggcuuuguuuuuggauuuucuccggacucaucaguaaaccuguagaagugucgcuuucc

SEQ ID NO: 161137 - RNA, 64 nt, Human
uuucuucccaugaccccaaagccaagggcaacagaucaguaaagaacguggucagaguagaacc

SEQ ID NO: 161138 - RNA, 64 nt, Human
uagugguuaauugcaguuuauuaaagggaucauuaucaguaauuucauagcaacuguucuagug

SEQ ID NO: 161139 - RNA, 64 nt, Human
ggugacaauagcugccuuccccuaucgaacaguuaucaguaaaagacauuucaaucuuacaaag

SEQ ID NO: 161140 - RNA, 64 nt, Human
cauuuaaagaguuugaccucagagcuccaggaucaucaguaaauuugucauguuauauauuuau

SEQ ID NO: 161141 - RNA, 64 nt, Human
ugcuguugucauugcuccguuuguguuuguacuaaucaguaauaaagguuuagaaguuugaccc

SEQ ID NO: 161142 - RNA, 64 nt, Human
auaugacuugcuuuuugcugagcuuaauucagauaucaguaaaauuaagucauaaaauaaucau

SEQ ID NO: 161143 - RNA, 64 nt, Human
gguaaggaccaaaaaaacaaacaaaaaaaagaccaucaguaagggaauggaugaauaaauugug

SEQ ID NO: 161144 - RNA, 64 nt, Human
acaucauaucugacauuauuguaacuaccgugugaucaguaagauuccuguaagaaauacugcu

SEQ ID NO: 161145 - RNA, 64 nt, Human
gaguucacugaagauauugacacaauuuuaaaaaaucaguaaaggaauguauauaauauugcuc

SEQ ID NO: 161146 - RNA, 64 nt, Human
agagagaauuugcuuuaucuguugucuagagcucaucaguaacaguauucaguuagcagacaga

SEQ ID NO: 161147 - RNA, 64 nt, Human
aucacagaguagcaaggacguuugagauggguauaucaguaagaagagggcacaagaacuggcu

SEQ ID NO: 161148 - RNA, 64 nt, Human
gauagacaaggaauuucccaugguaaaaagggauaucaguaauuagaggaccgugagacucaga

SEQ ID NO: 161149 - RNA, 64 nt, Human
ucccagagcaucauagauaguuccauuaaguaaaaucaguaagaccaaaccacuggaaaacaug

SEQ ID NO: 161150 - RNA, 64 nt, Human
auaucccaaaggcuuugaccagcaaccaaguaaaaucaguaauugaggagagcagggcacaaag

SEQ ID NO: 161151 - RNA, 64 nt, Human
auuguuucuccuaucccaaguucgcuuugcaucuaucaguaaauaaaauucuucagcugccuua

SEQ ID NO: 161152 - RNA, 64 nt, Human
aucucugggagauuauuuuuccauccagggugccaucaguaaucaugccacuacucaccagugu

SEQ ID NO: 161153 - RNA, 64 nt, Human
uggaggaguuuccuggccugucacgugagguuugaucaguaaaccagugcacgcuuggccaccc

SEQ ID NO: 161154 - RNA, 64 nt, Human
aaaggggaaaggggggguuuguuuaaaauaguaaaucaguaagucacuucuaaauuuaaagaaa

SEQ ID NO: 161155 - RNA, 64 nt, Human
uauuuuuaaaugaaaauucuaaauguuguauuuuaucaguaacauuuucuaagugaagauuaau

SEQ ID NO: 161156 - RNA, 64 nt, Human
gauuuuaaagucugcauugguuauaauaacaguuaucaguaauuccugcccagaagacuuuuau

SEQ ID NO: 161157 - RNA, 64 nt, Human
aaauagucuuauauuuucaccccauaaaugcagaaucaguaauuccuuggcuuaaagcucuuau

SEQ ID NO: 161158 - RNA, 64 nt, Human
uucccuuccauuuaaaaugucuugggauaucuggaucaguaauaaaauauuucaaaggcacaga

SEQ ID NO: 161159 - RNA, 64 nt, Human
uuuuggaaaaaccuuguggauaaguggcuguuucaucaguaagcagccuuugugguuuaguuau

SEQ ID NO: 161160 - RNA, 64 nt, Human
cacauuuuccauuuccauacauaucuuuuuguucaucaguaauaacuaguuggccaacugacug

SEQ ID NO: 161161 - RNA, 64 nt, Human
caccuccccucagacuaucuuucagccuucugucaucaguaaaauuuauaaauuuuuuuuauaa

SEQ ID NO: 161162 - RNA, 64 nt, Human
aauaugugaauacagggaagcaccaacagaccauaucaguaacuucgagugaguuuccuaaggc

SEQ ID NO: 161163 - RNA, 64 nt, Human
cuacucacacacacuuauuaauuacaaaaggaaaaucaguaauuuugcagcagagaaauauggc

SEQ ID NO: 161164 - RNA, 64 nt, Human
auuuugcaaaauuuuucuacaucuaaguuaccucaucaguaagugccaugucucuaccaugcca

SEQ ID NO: 161165 - RNA, 64 nt, Human
gauagagauuaagucaugguuuaaaugaggaacaaucaguaaaucagauucuguccucuucucu

SEQ ID NO: 161166 - RNA, 64 nt, Human
ucucagaauucuuuaagacuguuuuaauugcuccaucaguaauuuugaagcacuuuccuuuuuu

SEQ ID NO: 161167 - RNA, 64 nt, Human
ggaaagcacccuugucuggggaguguuggggagcaucaguaaaagaauggacacucaggcacag

SEQ ID NO: 161168 - RNA, 64 nt, Human
caauccacaggccugaagaaacugcuuguuguguaucaguaaucauuaguggcaaugaugacau

SEQ ID NO: 161169 - RNA, 64 nt, Human
auuguuuuguuuuggauuuaaggagauguuuuagaucaguaacagcuaauaggaauaugcgagu

SEQ ID NO: 161170 - RNA, 64 nt, Human
ccuguucugccuccggcucaugcacauuuuuaccaucaguaagacgcuggggcccaagaucauc

SEQ ID NO: 161171 - RNA, 64 nt, Human
agucauuugugaaaggguacuacagcuuauugacaucaguaagguagcauucauuaccuguuua

SEQ ID NO: 161172 - RNA, 64 nt, Human
acaaguagaugccugaacuugaauuaauccacacaucaguaauguauucuaucucucuuuacau

SEQ ID NO: 161173 - RNA, 64 nt, Human
auccagcguaucuugccaguaaccagugagguguaucaguaaggugggauuauggggguagaua

SEQ ID NO: 161174 - RNA, 64 nt, Human
cauuuucgaagauuuuuuaaaaauaauauuguuaaucaguaaaaaaaaaaaauauuuuugaucu

SEQ ID NO: 161175 - RNA, 64 nt, Human
guauuccaggcuaaagguaauuaacugacagaaaaucaguaacaacauaauuacaggcugguug

SEQ ID NO: 161176 - RNA, 64 nt, Human
gacuaaaucugcaauauauaaagagcuccuacaaaucaguaacaugaagaacacucaaaaauug

SEQ ID NO: 161177 - RNA, 64 nt, Human
auucugguuccuucugccugacccugggagacauaucaguaauggauguacaaaagcaggucug

SEQ ID NO: 161178 - RNA, 64 nt, Human
uuuucaaacaugcauagcuauuuuuaucacucuaaucaguaaggcuacuaucuagacucgaaug

SEQ ID NO: 161179 - RNA, 64 nt, Human
auaaaaccuaagcaugccacagagcuauugauuaaucaguaaguaccuguaaugaguuuucagu

SEQ ID NO: 161180 - RNA, 64 nt, Human
ccuuccucuguaccacucugcuuccuuggacaauaucaguaauagcuuuguaagugauguggac

SEQ ID NO: 161181 - RNA, 64 nt, Human
uuaucgcaagugauauuuacaguaauucuuuaauaucaguaaauauccagugaggguucaaacu

SEQ ID NO: 161182 - RNA, 64 nt, Human
uaaagguuucuauuuucucugauacuuuuuugaaaucaguaaacacuguguauuguuguaaaau

SEQ ID NO: 161183 - RNA, 64 nt, Human
uaucuuaauuugaaauggcauuuaaaauaaacauaucaguaaguuucuauauguaucaaaacug

SEQ ID NO: 161184 - RNA, 64 nt, Human
uuuccuuuuuguuuaagcacucggucccuuauuuaucaguaagcagguuuuuaaaaaucuuuua

SEQ ID NO: 161185 - RNA, 64 nt, Human
augucuuuaccuaccuaaguaaaacaggaagaaaaucaguaacauuauccuuagguuuugacaa

SEQ ID NO: 161186 - RNA, 64 nt, Human
aaaauguauugauaauauuuacaucuuugaaauaaucaguaaaauggucugguacaggaguuaa

SEQ ID NO: 161187 - RNA, 64 nt, Human
ucauuugagucuuuuucuuaccuagcccccucuuaucaguaaaacaaaggacuugccaugguuc

SEQ ID NO: 161188 - RNA, 64 nt, Human
uaugucuuuuguuuaagcaccuagucccuuauguaucaguaaacagguuuuuaaaaaucuuuua

SEQ ID NO: 161189 - RNA, 64 nt, Human
ggugauguacccaugcuccgugugucugugucugcauguccacacgucugaugcaccuguguac

SEQ ID NO: 161190 - RNA, 64 nt, Human
cuagaggucagcgucgcgccgcacucuucacccgcauguccagagggcggccgggauguggagg

SEQ ID NO: 161191 - RNA, 64 nt, Human
ucagcacugucuccaugcagcaguugcugggucccauguccagcugccucuuuggcuucauggg

SEQ ID NO: 161192 - RNA, 64 nt, Human
aauuguuuucagggccuuguccagcugagagcuucauguccaccagauucugagaggugucagc

SEQ ID NO: 161193 - RNA, 64 nt, Human
aguuguuaaggcauugaccuccacccaccugccccauguccacugggcugcccaagcugcaugu

SEQ ID NO: 161194 - RNA, 64 nt, Human
cuccuggggacccaagaggcaguguugcugucugcauguccaccuuggaaucuggcugaacugg

SEQ ID NO: 161195 - RNA, 64 nt, Human
uuuuuuuuucuuuuuccguuuuuccauuuccucacauguccacgagaugcuuggguugcuuuuc

SEQ ID NO: 161196 - RNA, 64 nt, Human
auccuccucuagacaaaaccagccuuuaaaauaucauguccaggccuggaaagaauacaaaucc

SEQ ID NO: 161197 - RNA, 64 nt, Human
ggucaucugcgguaaguucuaugguauuuauuggcauguccaauuugcuugcacuuuuccacau

SEQ ID NO: 161198 - RNA, 64 nt, Human
ugacauauuuauuuuugucuauucuguaggcuuccauguccagaauccugcuuaagguuuuagg

SEQ ID NO: 161199 - RNA, 64 nt, Human
ccaggcagacgggcugaaguggggucccaaauuccauguccagagguguggggagccugccucc

SEQ ID NO: 161200 - RNA, 64 nt, Human
cugaaagaucguuuuggggacaaaagugacuugacauguccaauuucauuucagaauaaaaagc

SEQ ID NO: 161201 - RNA, 54 nt, Human
agcugaaaugcagcguuuaagagacauguccaguggccuuuggaaagguggugg

SEQ ID NO: 161202 - RNA, 64 nt, Human
ugcaugucugacauaauguaaaagagucuuggaucauguccaggauccagggucuaaaaccccu

SEQ ID NO: 161203 - RNA, 64 nt, Human
uuuuccagauaaggaaacaagccuagauaugcuacauguccaggaacaacugcagccaggaggc

SEQ ID NO: 161204 - RNA, 64 nt, Human
agcccuaauauucacacugauuaggccugggucacauguccacccugaccaaucacuguggcca

SEQ ID NO: 161205 - RNA, 64 nt, Human
gcagagugucccagccagaugugugcccucaccccauguccauuuacauguccuucaaugccca

SEQ ID NO: 161206 - RNA, 64 nt, Human
cagagguugugagaaaggcauggacuggaacaaucauguccagaggggucuggagcuuuguuuc

SEQ ID NO: 161207 - RNA, 64 nt, Human
auugagagaacuguguuuuuccgacaaacggucacauguccaucguuauggcaugugcagaaaa

SEQ ID NO: 161208 - RNA, 64 nt, Human
ucuugucugugcuaauauaaauacugaguaccagcauguccauuugaacaugcagaggguuaau

SEQ ID NO: 161209 - RNA, 64 nt, Human
aaaauggaacagugcacucuucucccuguugacccauguccaccuauugguuccccaaaaucca

SEQ ID NO: 161210 - RNA, 64 nt, Human
cuugaacuacuucuccuccucggagccccagucccauguccacugucuauuuauugcauucccu

SEQ ID NO: 161211 - RNA, 64 nt, Human
caaggacaaggacacucugacauucggcuugauccauguccaggugcaacuguguguacaccag

SEQ ID NO: 161212 - RNA, 64 nt, Human
ccucucggauguucugcaggcccagcaaacucaucauguccaaagugaaacuuuuucucuuucc

SEQ ID NO: 161213 - RNA, 64 nt, Human
uccuaaucccaagaucugugcauauguuaccauacauguccaaagagguuuugcaaaugugauu

SEQ ID NO: 161214 - RNA, 64 nt, Human
aucaccuuugaucaaaaugguuggugaaccuccacauguccaguucuguugccaaacuuuccau

SEQ ID NO: 161215 - RNA, 64 nt, Human
uccucccuucucuucacagucacauuccaagccucauguccacugguucuucuuggucucagug

SEQ ID NO: 161216 - RNA, 64 nt, Human
uggccauuuccaagcucccugcccucugcucacccauguccaaucucucaggaccccguggaau

SEQ ID NO: 161217 - RNA, 64 nt, Human
gaagcaggcuuuuuaguuucuuggcucucuuugucauguccagaggcaggcuguucuguaaaau

SEQ ID NO: 161218 - RNA, 64 nt, Human
gggcagguggccauggggaggggccauggcuuggcauguccaacagaaauaguuuuugcuguug

SEQ ID NO: 161219 - RNA, 64 nt, Human
cacuguucccuagcaugggucuugggucuauuggcauguccauggccuucccaaucaagucucu

SEQ ID NO: 161220 - RNA, 64 nt, Human
gggagugggagccuaugaccccacgucugacagccauguccaccugugcccacagcuuccgccc

SEQ ID NO: 161221 - RNA, 64 nt, Human; identical to SEQ ID NO: 84796

SEQ ID NO: 161222 - RNA, 64 nt, Human
augauguacuucacaauccaccuuggaucuccugcauguccaaaucucaguaguuaaucaagug

SEQ ID NO: 161223 - RNA, 64 nt, Human
gucagccccaagcugagagucuggucauaggagucauguccagaggccuagggagguuuuaggg

SEQ ID NO: 161224 - RNA, 64 nt, Human
ucuauuuacuacuauuaagguaaauuuucuauggcauguccauuagcuauuucaugauagauga

SEQ ID NO: 161225 - RNA, 64 nt, Human
cacuaccaaauagcucuucuggggcaggcugggccauguccaaagaggcugccccucucaccaa

SEQ ID NO: 161226 - RNA, 64 nt, Human
aagcacugauaucuggccuaaaaucuuggaaguacauguccaugaauacaaauuuuaaaggaug

SEQ ID NO: 161227 - RNA, 64 nt, Human
ucauguccugcauggaaccaguggcugugaguggcauguccacuugcuggauuaucagccagga

SEQ ID NO: 161228 - RNA, 64 nt, Human
uugguccacagucggacugcauugcuuggguccccauguccagccuugugcagugaguucuccu

SEQ ID NO: 161229 - RNA, 64 nt, Human
uucugggucaguccuaggcacaugcugcccagcacauguccaccugggaaaugagaugccaucg

SEQ ID NO: 161230 - RNA, 64 nt, Human
uguaacaacacacagccugacaccuuccccuggucauguccaguuuaaccuugaaguggcauuu

SEQ ID NO: 161231 - RNA, 64 nt, Human
uuuauaagaguuuaucagacaucucuaauuuggccauguccaguuuauacaguuuacaaaauau

SEQ ID NO: 161232 - RNA, 64 nt, Human
cauagcuuuaguuaaaacacuaagcugaauuagucauguccauucagacauaaccugaacuacu

SEQ ID NO: 161233 - RNA, 64 nt, Human
uuggggugauuuaauccaguuauaagaagaaguucauguccaaacguccucuuuaguuuuuggu

SEQ ID NO: 161234 - RNA, 64 nt, Human
ugagagguacccagaagguucccaugaagggcagcauguccaagccccugaccccagauguggc

SEQ ID NO: 161235 - RNA, 64 nt, Human
uucucgugaccuggucgugauguggcauucagugcauguccacagcuaauggaaaaacacgagg

SEQ ID NO: 161236 - RNA, 64 nt, Human
agagagcuguagagacaggaccaccaggaugcuucauguccauaacacaagagagcgcugcauu

SEQ ID NO: 161237 - RNA, 64 nt, Human
ucugcacuuugcccccugucucaaaaaugucccucauguccauuuccuguccaggagacucaug

SEQ ID NO: 161238 - RNA, 64 nt, Human
acuucugugguuugagaggaugaacccugcaggccauguccacaguucugagaggccaccugcu

SEQ ID NO: 161239 - RNA, 64 nt, Human; identical to SEQ ID NO: 84799

SEQ ID NO: 161240 - RNA, 64 nt, Human
cagucucaagcaaccauauauuaucaaggacagacauguccaacagucuauggugugacaucac

SEQ ID NO: 161241 - RNA, 64 nt, Human
ggggguaggugggcuccacaggaugggggaggagcauguccacugaguaucuuccuuauguugc

SEQ ID NO: 161242 - RNA, 64 nt, Human
aaggaguuagaaccacagcagacaccauucauuccauguccauaugcaucuacuuggcaagguc

SEQ ID NO: 161243 - RNA, 64 nt, Human
ccugagaggacccccuccccauugucaggcucuccauguccacgagcggggagggguggguucu

SEQ ID NO: 161244 - RNA, 64 nt, Human
gaaguugguuucugguccaaguuuugaccuaaaccauguccaucuucuauuaccagcacuuaca

SEQ ID NO: 161245 - RNA, 64 nt, Human
ccaauuuucuaaaaugauauggagcucugaaaggcauguccauaaggucugacaacagcuugcc

SEQ ID NO: 161246 - RNA, 64 nt, Human
guuuauuagccaggacccaagacuaaguuauuuacauguccauuguaaaugcaauguaaaugag

SEQ ID NO: 161247 - RNA, 64 nt, Human
cuagagcucacugucuacugcaacugugauuucccauguccaaaguggcucugccuccaccccc

SEQ ID NO: 161248 - RNA, 64 nt, Human
gaggguguucuggccugagaagguaaagaagaggcauguccaguaugcuuugcaggguguguuu

SEQ ID NO: 161249 - RNA, 64 nt, Human
acuguucuaaugcugaagugacuuuugccagugccauguccagguggugagguauaaguuacuu

SEQ ID NO: 161250 - RNA, 64 nt, Human
ccacacccaaagcugagccugcagggaagccccacauguccagcaccuugugccugggguguua

SEQ ID NO: 161251 - RNA, 64 nt, Human
gauucuaccaguaugugcuacuacuaacauucuucauguccaugcagaauuacuuacagacacu

SEQ ID NO: 161252 - RNA, 64 nt, Human
cuaagauaaaauauuuuagaauuauguuacuuaacauguccaauaaaauguuuucaaauugccu

SEQ ID NO: 161253 - RNA, 64 nt, Human
gcgcggaggagcuagccugaaggauucugggaaucauguccaucccuuuuccugucaguguuuu

SEQ ID NO: 161254 - RNA, 64 nt, Human
cugauucuggaggaacaugaaauuugucuuuucucauguccagaguucuauccugcccccacug

SEQ ID NO: 161255 - RNA, 64 nt, Human
acaaucugauuguuucuuuaacuuaggauccaaacauguccaaaauaaugcagaguacauaugc

SEQ ID NO: 161256 - RNA, 64 nt, Human
acuuagcaccagcuuaauuuccuuaggaagggcucauguccauuagaaaauggagucaucuuau

SEQ ID NO: 161257 - RNA, 64 nt, Human; identical to SEQ ID NO: 84802

SEQ ID NO: 161258 - RNA, 64 nt, Human
ucccuccauccucgucugucaaugacaucuccuccauguccaccgaccagacccuggcaucuga

SEQ ID NO: 161259 - RNA, 64 nt, Human
ugaaucagaggccacacagcccaaagauuagcuucauguccauuauagcauugagggagcagag

SEQ ID NO: 161260 - RNA, 64 nt, Human
uagucacaggaaauuuuuaacucuacuguagaugcauguccaugcauuuucuguguuauggaaa

SEQ ID NO: 161261 - RNA, 64 nt, Human
gcagccuucgccccaguguucugcauggauucagcauguccaacaugguaauucacuucaguuu

SEQ ID NO: 161262 - RNA, 64 nt, Human
uuacuugccaacagguaagaggaagcuuacauuacauguccaguccacauuuaaagagcacuua

SEQ ID NO: 161263 - RNA, 64 nt, Human
aggauuuauugagcagcuucuggaauauaaugugcauguccaaaaugaacucagcgcuucaaaa

SEQ ID NO: 161264 - RNA, 64 nt, Human
uccuuuuugacacugaaaguuuuguaaaagaaaucauguccauacacuuuguugcaagauguga

SEQ ID NO: 161265 - RNA, 64 nt, Human
accuucaaaguauuuguuccuuuaaauuucagaccauguccaacccagcugugcugcugggaau

SEQ ID NO: 161266 - RNA, 64 nt, Human
acuauucccuuugacuucagcugccugaaacagccauguccaaguucuucaccucuauccaaag

SEQ ID NO: 161267 - RNA, 64 nt, Human
ggucaagaggaaguaacugaaggccgucucaucccauguccaccauguaggggagggacuuugu

SEQ ID NO: 161268 - RNA, 64 nt, Human
uccugugagcuuuaugucaggagacugugaccuucauguccagcuucaaagaguugugcaugaa

SEQ ID NO: 161269 - RNA, 64 nt, Human
ucugagcggucucaguuaggccuguauguguguacauguccaaguaaagcuggaaaaugucagu

SEQ ID NO: 161270 - RNA, 64 nt, Human
caguuggcaacgagcuggggcugggggcggccuccauguccacugagaucauaggacacuccaa

SEQ ID NO: 161271 - RNA, 64 nt, Human
ucuuuuaucagcccuguccaaccuccccuccacccauguccaaguggacaggacucugacauuc

SEQ ID NO: 161272 - RNA, 64 nt, Human
cagggauauauaaagauaaauaugccugagcucccauguccaaaccauccugaagggcuguagu

SEQ ID NO: 161273 - RNA, 64 nt, Human
caaguuaaguccuaagcucacaggauccuccgagcauguccaucaccugcucuuuggcuaaggu

SEQ ID NO: 161274 - RNA, 64 nt, Human
cuaugggcgugaacggaaugggaggguugucuagcauguccaguaugagugguggauggggaau

SEQ ID NO: 161275 - RNA, 64 nt, Human; identical to SEQ ID NO: 84805

SEQ ID NO: 161276 - RNA, 64 nt, Human
cuucucagucuucaucgaucaaugacauuucauccauguccacugagcagacgcuggccucaga

SEQ ID NO: 161277 - RNA, 64 nt, Human
aggccaaaaccagggaagauucuagcuucagccucauguccauuuccagucugucagcauuaga

SEQ ID NO: 161278 - RNA, 64 nt, Human
auaaugugaggagguggggagaccaccccacccccauguccaccaugacccucuucccacgcug

SEQ ID NO: 161279 - RNA, 64 nt, Human
gaaacuuuuccaucucaugauggaugcuguugggcauguccaauguaugacuucaugaguuaca

SEQ ID NO: 161280 - RNA, 64 nt, Human
aauccaauuuaaccucauuucccagaucauuuuucauguccaguaacacagaagccaccaagua

SEQ ID NO: 161281 - RNA, 64 nt, Human
aucaucuuguuccccuggccccccacucucccuccauguccauccaaaaaccauaaaaucacug

SEQ ID NO: 161282 - RNA, 64 nt, Human
guaccauccacuugugccuuacuguauccugugucauguccaaucaguuguaaacaauggcauc

SEQ ID NO: 161283 - RNA, 64 nt, Human
ucgucgcgcugcaguauugacuuggaauccugaccauguccaucccaaaauucaguccucaguu

SEQ ID NO: 161284 - RNA, 64 nt, Human
cuuacagcauuguggaaucauguuggaagcuccacauguccauggaaguuugugauguacggcc

SEQ ID NO: 161285 - RNA, 64 nt, Human
ucaaaacugugaugaccacuacagcagaguaaagcauguccaaggaaggaugugcuguuaccuc

SEQ ID NO: 161286 - RNA, 64 nt, Human
cuccuguugcauguaacccacuggccucccugagcauguccauugacagugaggucccaccccu

SEQ ID NO: 161287 - RNA, 64 nt, Human
ccucuggugaccuguuggcuccacucuugucacucauguccagaucugcagugccagcuucucc

SEQ ID NO: 161288 - RNA, 64 nt, Human
cucgguagcaagaccccugauuuuaagcuuugcacauguccacccaaacuaaagacuacauuuu

SEQ ID NO: 161289 - RNA, 64 nt, Human
cagccuccaugcaguagagauuugaguuuaauuucauguccaugugacuuucauguuuccuauc

SEQ ID NO: 161290 - RNA, 64 nt, Human
uaguuacuguccuguugauuaauuucugccauuucauguccauaaaagagaccacccauaucau

SEQ ID NO: 161291 - RNA, 64 nt, Human
aauacucacaccacaagaaggacaaacuugugcacauguccaagaaagaaagcuucuugauuga

SEQ ID NO: 161292 - RNA, 64 nt, Human
agcuggaaagccugucacacuagagugugugugacauguccacucuaaacaugucacuuuucug

SEQ ID NO: 161293 - RNA, 64 nt, Human; identical to SEQ ID NO: 84808

SEQ ID NO: 161294 - RNA, 64 nt, Human
ccauacuggccauauuuuggaacacugaccuagacauguccagaugggagucccauuccuagca

SEQ ID NO: 161295 - RNA, 64 nt, Human
uuugaaacccagaaagaccuggaaaggagcccagcauguccaucuuuucaaagauacaacaaaa

SEQ ID NO: 161296 - RNA, 64 nt, Human
ccuccugccguggcuggggucauggucggcugcgcauguccagaagcauuuccuuccugcgacc

SEQ ID NO: 161297 - RNA, 64 nt, Human
uaauauguguaguaguugaauuguguuaucaaagcauguccaacuucuguccagaugacauuaa

SEQ ID NO: 161298 - RNA, 64 nt, Human
guggagagcuggugcccucaggaggagaccacagcauguccaucagcucagcagagcucgacag

SEQ ID NO: 161299 - RNA, 64 nt, Human
agggaauagauccuugcacauccagggcaagaaacauguccaaguuacccagaccauugauaac

SEQ ID NO: 161300 - RNA, 64 nt, Human
acaucuagaagaguugguacagaaggccaugccacauguccagaauauucaagaaugcuuauuc

SEQ ID NO: 161301 - RNA, 64 nt, Human
ggcaggguagguggggcuuucccuaauuuaucuucauguccagugagcaguguugcguuuuucc

SEQ ID NO: 161302 - RNA, 64 nt, Human
uguauucacaggaggccauaaauuagcauugugccauguccaccuguuguuccuggacucugac

SEQ ID NO: 161303 - RNA, 64 nt, Human
auccuuaaaagauugcuucguuuuuaaaauaacgcauguccauuuuagaaaauuagaaaaucag

SEQ ID NO: 161304 - RNA, 64 nt, Human
auaaguaaaaugauuuguuuuauaauuuauccaccauguccaguuugguuagcuuguuaugcaa

SEQ ID NO: 161305 - RNA, 63 nt, Human
cuaucuugcugggggacugaccacccagccacccauguccagaauaaaacccuccucugccca

SEQ ID NO: 161306 - RNA, 64 nt, Human
gauuguauguuguauauaccauucuauuaagaaacauguccacugugcuuucaaacauagauaa

SEQ ID NO: 161307 - RNA, 64 nt, Human
ggacaggccgguggcugacccaggauugcaccagcauguccauagagaagagguuuucuauguc

SEQ ID NO: 161308 - RNA, 64 nt, Human
auaaagccagcauugaucacuuaauccuguuucucauguccagccagaaaaaagaacuucagug

SEQ ID NO: 161309 - RNA, 64 nt, Human
cagacugagaaggggacaaaaagaccuuuccuuucauguccagaagaauguauguaacuaaagc

SEQ ID NO: 161310 - RNA, 64 nt, Human
auuaacauuaaaauuucaguaacugacugucccucauguccauggccuaccaucccuucugacc

SEQ ID NO: 161311 - RNA, 64 nt, Human; identical to SEQ ID NO: 84811

SEQ ID NO: 161312 - RNA, 64 nt, Human
ucccaacccuuccagaggcuuucugugaaagucucauguccaaguuccgucuucugggcugggc

SEQ ID NO: 161313 - RNA, 64 nt, Human
ugcucggcagcccagcccugggccuggguggguucauguccaaucuuguucgaucacuagauga

SEQ ID NO: 161314 - RNA, 64 nt, Human
uccugaugcaaagccaggcacaacaagggaaauccauguccaaagcauaguguggucucaacuc

SEQ ID NO: 161315 - RNA, 64 nt, Human
aggguggcuucucccagcugaguaauguggccaccauguccaagguggacucggugugaggcug

SEQ ID NO: 161316 - RNA, 64 nt, Human
agaaacguggugcccagggugcccugccucaggacauguccacacccacgucacaagcaccuga

SEQ ID NO: 161317 - RNA, 64 nt, Human
cacucuaaaauuaacuggacauuaguguacagcccauguccaagcccagagagaaaacaauggg

SEQ ID NO: 161318 - RNA, 64 nt, Human
gaaaaucaagauucaguccagcagaugcagaguccauguccaucuugugccuucuccuggacaa

SEQ ID NO: 161319 - RNA, 64 nt, Human
ggccggucacgcugcugugggcccgaguguguugcauguccacgcaccacccguucagggcccu

SEQ ID NO: 161320 - RNA, 64 nt, Human
ccaaaggccccgucuagcuuggcuggcucccgaacauguccauauuugaaggcugccucaggcc

SEQ ID NO: 161321 - RNA, 64 nt, Human
cuucugagucuccaaugucuauuauuccacacuccauguccacguguacacauuauuuagcucc

SEQ ID NO: 161322 - RNA, 64 nt, Human
cauauuuuugucuguauucacuuuauuauuugaacauguccaaauuaggacaaagcauuucugu

SEQ ID NO: 161323 - RNA, 64 nt, Human
guauguucugacaucuggcuucccuucucagccucauguccaccugccugccagccaggcuaca

SEQ ID NO: 161324 - RNA, 64 nt, Human
uugaaggaauauuguuucuaagacuguuuugagacauguccaguacaucacaaaggagaucggg

SEQ ID NO: 161325 - RNA, 64 nt, Human
augcacaacuuugugaaagaggcccugccuugugcauguccauagugaggcuacagauggcuua

SEQ ID NO: 161326 - RNA, 64 nt, Human
ucuuccuccugccaggggagagccacccacaggccauguccagccccacuucccucagccccca

SEQ ID NO: 161327 - RNA, 64 nt, Human
gcaaacugcggugagcguaguguugaauauguugcauguccauguuagaaaacagaauccaguc

SEQ ID NO: 161328 - RNA, 64 nt, Human
uuguuuuuguuuuuugacaaaauacacuauuggccauguccaucacgagaguguuuguaguaau

SEQ ID NO: 161329 - RNA, 64 nt, Human; identical to SEQ ID NO: 84814

SEQ ID NO: 161330 - RNA, 52 nt, Human
agaaggcccugcuguugugagccauguccacccugauuccugagaggccaga

SEQ ID NO: 161331 - RNA, 64 nt, Human
guaucuaugucuuucugaauuuaaaaugaaaauucauguccauauggagacuuacauauucccc

SEQ ID NO: 161332 - RNA, 64 nt, Human
ugugauagugaagucauauuuacaaaacugagaacauguccaaaauggauucuugucuccucuu

SEQ ID NO: 161333 - RNA, 64 nt, Human
cuggccccacacuggcaaugaugccacaccuugccauguccacgcuguuggucaaaccccucug

SEQ ID NO: 161334 - RNA, 64 nt, Human
uggucucucucuauauauaucuguauaucuuauacauguccauacacagaaacauaauaaacaa

SEQ ID NO: 161335 - RNA, 64 nt, Human
uuccauucauacagacacacacguacgcacacugcauguccaaggcccuaaacauugcccguug

SEQ ID NO: 161336 - RNA, 64 nt, Human
uauuggcaaguaugcagagccgugaacgucauggcauguccaaggaauuaaaugggaguucauu

SEQ ID NO: 161337 - RNA, 64 nt, Human
aaugaauauauugccuguuuugugaauacugacacauguccauaccuaaaacacuccugaguca

SEQ ID NO: 161338 - RNA, 64 nt, Human
gccaguugggcggcuucagccccgggccuccaaccauguccaugcugagaaggcagcuuucccg

SEQ ID NO: 161339 - RNA, 64 nt, Human
cagaacuguaaaagaaaauuauaaaauaauucaacauguccaucuuuuuagugauaauaaaaga

SEQ ID NO: 161340 - RNA, 64 nt, Human
uuaugacacagcagcuccuuuguaaguaccaggucauguccaucccuugguacauauaugcauu

SEQ ID NO: 161341 - RNA, 64 nt, Human
gcacauaaagaccuuccugcccaccuccuauggacauguccagggauacaggacaagagugggg

SEQ ID NO: 161342 - RNA, 64 nt, Human
ugggcguuuaagaggcuuccuuggaguggcuuugcauguccaacacucugcuguaucuuuuuuu

SEQ ID NO: 161343 - RNA, 64 nt, Human
uacaguacagugguucuacaaucuauuuauuggacauguccaugaccagaagggaaacagucau

SEQ ID NO: 161344 - RNA, 64 nt, Human
gugugauugggagggguggcagacaggaagaaaacauguccaggccccuggucuccauagagaa

SEQ ID NO: 161345 - RNA, 64 nt, Human
gguaagaggaagcccgugguucuggcuaggcucucauguccagacagcggggaccaggggaaaa

SEQ ID NO: 161346 - RNA, 64 nt, Human
ugguucccuuggauuuagggauagugucccucuccauguccaggaaacuuguaaccacccuuuu

SEQ ID NO: 161347 - RNA, 64 nt, Human; identical to SEQ ID NO: 84817

SEQ ID NO: 161348 - RNA, 64 nt, Human
ugacucccaggccaggauguuuuauuucucacaucauguccaagaaaaagaauaaauuauguuc

SEQ ID NO: 161349 - RNA, 64 nt, Human
ucacauuuucucagugugcccuucucuuaucugccauguccauagccauaauuccaccaucaua

SEQ ID NO: 161350 - RNA, 64 nt, Human
cccuaagucaggagcaugcagagcuagcccaccucauguccagcuguccacuuuccauccugga

SEQ ID NO: 161351 - RNA, 64 nt, Human
acuguccauagucuccugucccuacaucauggaucauguccaccuuuugcuaauuuaaaaucau

SEQ ID NO: 161352 - RNA, 64 nt, Human
auaugcucuaucucaagaaacaagaugauuguaacauguccaugauuaaacuauuggcagauua

SEQ ID NO: 161353 - RNA, 64 nt, Human
cugcauguagcaaauguucagcagcucaggcccccauguccaguucuguccccacuguccucaa

SEQ ID NO: 161354 - RNA, 64 nt, Human
aauaacuuuuuuuaaaaaaaacuaaaaggcgcuucauguccaguguguggcccuucugaaacuu

SEQ ID NO: 161355 - RNA, 64 nt, Human
auucucuagucgacugccagggccuuagacuccacauguccauuuuuguucagguauagcuuuu

SEQ ID NO: 161356 - RNA, 64 nt, Human
guuuuaguacauuauaggcccagcagcuuuuauucauguccaccagcuaguugcacagagaauc

SEQ ID NO: 161357 - RNA, 64 nt, Human
cucuccaugcaaguguggccagggcccuggguaucauguccacaugcccagcaagagccuugcc

SEQ ID NO: 161358 - RNA, 64 nt, Human
gagcccccuuggagacacccccccucccaaaagccauguccauccagcccuuccccccaaaccu

SEQ ID NO: 161359 - RNA, 64 nt, Human
gggauaaggacgugggcccagccacaugccaacucauguccaauacugcuuugccugguguggg

SEQ ID NO: 161360 - RNA, 64 nt, Human
uuucuccauucuguuccacugcucuucucugguucauguccaccacugacugggacccugaaga

SEQ ID NO: 161361 - RNA, 64 nt, Human
ggcaagagaugauucuuuuguuuuucuucuacuucauguccagaagaguaagagggaaaaugga

SEQ ID NO: 161362 - RNA, 64 nt, Human
ucaaauaagccaucugauuguggugacuggggcccauguccaagacaauuccuggcauauucug

SEQ ID NO: 161363 - RNA, 64 nt, Human
ugauguuuucagagccgcuguaggucucuucuugcauguccacaguaauguauuugugguuuuu

SEQ ID NO: 161364 - RNA, 64 nt, Human
acaacauccacauaagaauuuguuguaaugaguucauguccacccagauguuguguuggcagug

SEQ ID NO: 161365 - RNA, 64 nt, Human; identical to SEQ ID NO: 84820

SEQ ID NO: 161366 - RNA, 64 nt, Human
cugguggcaaaaggacuccacgccucuguggaaucauguccacagggggaccugccucccguga

SEQ ID NO: 161367 - RNA, 64 nt, Human
aauuccuaaaaucauagcacuaacauucaguagucauguccagcucuuccuuuaugucagguac

SEQ ID NO: 161368 - RNA, 64 nt, Human
uuaccuggcuuuuggcuccacgcucacucauagccauguccacaugggggcuugcacacaggau

SEQ ID NO: 161369 - RNA, 64 nt, Human
ugucuucagucauggaagagccuccauuucaucucauguccauuucuagccucuuucaaaaagc

SEQ ID NO: 161370 - RNA, 64 nt, Human
gggccaaugcaccuccccccaccccccacccucccauguccacagugggucguguguuccugga

SEQ ID NO: 161371 - RNA, 64 nt, Human
ccccuguaaacuuuccuuugcccaauuauauguacauguccauucuuaaguugguguuuggagg

SEQ ID NO: 161372 - RNA, 64 nt, Human
cuaugauggucaccagcaggagaaagcuuugaugcauguccacauaucauugacuguauccugu

SEQ ID NO: 161373 - RNA, 64 nt, Human
caggacccagccagccacauagguggagguuuuccauguccaaaugaggucaagaugccgaaau

SEQ ID NO: 161374 - RNA, 51 nt, Human
ugguugugcucggcaccugagcauguccacagguggccuccagcacacccc

SEQ ID NO: 161375 - RNA, 64 nt, Human
ccucuccaaugucuccucgaacuagcaaaagccgcauguccaugaagcugcgucguuccucugg

SEQ ID NO: 161376 - RNA, 64 nt, Human
accucuccuccgcugucaugccugcuuccgcuuccauguccaacaauucuaaccaacaaaggac

SEQ ID NO: 161377 - RNA, 64 nt, Human
augaccacacauggauuuugauauguaaauauugcauguccagcuggauucuggccugccaaag

SEQ ID NO: 161378 - RNA, 64 nt, Human
cucaguguacugccagauucgucuaaaugucugucauguccagauuuacuuugcuucuguuacu

SEQ ID NO: 161379 - RNA, 64 nt, Human
ucuguuccaucugcuguauucauuucuccaaucucauguccauuuuggugugggagucggggua

SEQ ID NO: 161380 - RNA, 64 nt, Human
ucccuucaucaccaaaggagccucuguauggaaacauguccaguguugcugcccaguguguaug

SEQ ID NO: 161381 - RNA, 64 nt, Human
uguuaaugacggaagccauagucugcuccuaauacauguccaaagcauugacuguugugucauu

SEQ ID NO: 161382 - RNA, 64 nt, Human
cauuuuauggaaaagacuaggcuuugcuuaguaucauguccauguuuccuucaccucaguggag

SEQ ID NO: 161383 - RNA, 64 nt, Human
gcuggacggagcugagaggagacccuagcaucuccauguccaucccccagaccuccccugagac

SEQ ID NO: 161384 - RNA, 64 nt, Human
ugcuuuagcccaggagguugaggcugcagugagccauguccacaccauugcacugcagccugag

SEQ ID NO: 161385 - RNA, 64 nt, Human
cuuccagacccaccagcuggaaaagugaaggaagcauguccacugacaaacgggaaacaaggua

SEQ ID NO: 161386 - RNA, 64 nt, Human
ccuuaugguaacuuguucuguaccuccuaugccucauguccagccagguugagccuaggggcca

SEQ ID NO: 161387 - RNA, 64 nt, Human
acguguagcugacaugcacgaaguuuaauuuacucauguccacgggggacguuuagagggcacg

SEQ ID NO: 161388 - RNA, 64 nt, Human
augauuuacguuuucccgagauguaaugaacugccauguccaggaagcuuggcugugagaagaa

SEQ ID NO: 161389 - RNA, 64 nt, Human
cagugccuuuaugguggagcagaauucgacaacacauguccauucagcccucugaauggaucug

SEQ ID NO: 161390 - RNA, 64 nt, Human
gugugugugugugugugucuuaggugcgcaguggcauguccacgugugugugugauugcacgug

SEQ ID NO: 161391 - RNA, 64 nt, Human
aucacccgcuaagagggagggagggcuccagacacauguccaagaagcccaggaaaggcuccag

SEQ ID NO: 161392 - RNA, 64 nt, Human
ucuggaacaagggccagguuaagaccacaugccucauguccaaagaggucucagaccuugcaca

SEQ ID NO: 161393 - RNA, 64 nt, Human
ccccagccacgaagagcuggaccagcuucaaguacauguccacagcaacaugcaggaaggccuc

SEQ ID NO: 161394 - RNA, 64 nt, Human
ucuccuucuaagugccccccacccccauagccugcauguccacucccagacgauggccaagagc

SEQ ID NO: 161395 - RNA, 64 nt, Human
cagcgacucuauagucucucuaggucauagcuuucauguccauugaagaauuaccaagcccagc

SEQ ID NO: 161396 - RNA, 64 nt, Human
cucaucccaccuccauccggaguugccuaagaugcauguccagcauaggcaggauugcucggug

SEQ ID NO: 161397 - RNA, 64 nt, Human
uguugaaggaaaaggcacuuaaauugguuacuuucauguccagcuguauauaaguccagugugu

SEQ ID NO: 161398 - RNA, 64 nt, Human
uuuuaggaagucaacuuuaguuuugcuuuguuugcauguccacugguuuuuuuauuuugauauu

SEQ ID NO: 161399 - RNA, 64 nt, Human
uuuuuucucccuuuaaggugcuaaacuugcaccucauguccacucaguaacaaguauugggacg

SEQ ID NO: 161400 - RNA, 64 nt, Human
ucuguguugcugacuacagugucugugauguccgcauguccaggccuguuugggguugccuagc

SEQ ID NO: 161401 - RNA, 64 nt, Human; identical to SEQ ID NO: 84823

SEQ ID NO: 161402 - RNA, 64 nt, Human
ggagacucagagggcgaagagcacuggcauuuggcauguccaugacauuggagacuccccuagc

SEQ ID NO: 161403 - RNA, 64 nt, Human
agagcucacauuccugucccuugggugaaaaauacauguccauccugauaucuccugaauucag

SEQ ID NO: 161404 - RNA, 64 nt, Human
cacacagaucaagcggggcagcaccuacuaccugcauguccagagcaugcucacccagcucugc

SEQ ID NO: 161405 - RNA, 64 nt, Human
gguguggaccggccgcagcccccacugaccugcccauguccagagggacuggacagccagggca

SEQ ID NO: 161406 - RNA, 64 nt, Human
guuugcugcccaaggcagcaguucaugucucguccauguccauguucguguuagcacuuacgug

SEQ ID NO: 161407 - RNA, 64 nt, Human
cuucgcucccaucaggguuggcaucaucugauggcauguccaagugugcccagcagcggaugcu

SEQ ID NO: 161408 - RNA, 64 nt, Human
ucaggaagagacggcaacguaaaggauguggcuccauguccauggugcccccuggucaacauaa

SEQ ID NO: 161409 - RNA, 64 nt, Human
ucuaagugcaaccgccuagacuuucuuucagauacauguccacauguccauuuuucagguucuc

SEQ ID NO: 161410 - RNA, 64 nt, Human
caaccgccuagacuuucuuucagauacauguccacauguccauuuuucagguucucuaaguugg

SEQ ID NO: 161411 - RNA, 64 nt, Human
gaucuuuuuaacagugugccuuuggggagggacccauguccauggcuucguugagggccaucca

SEQ ID NO: 161412 - RNA, 64 nt, Human
ugaggacccagggcgucagcacccagcacugccacauguccaccaaggaacagaauuuauuuuc

SEQ ID NO: 161413 - RNA, 64 nt, Human
ccccgguucugggcugggacccuggcuccagggccauguccagggcucugguguuugccugggu

SEQ ID NO: 161414 - RNA, 64 nt, Human
ggcuggaucggaagcaacacccauuugggguuaccauguccaucccccaaggggggcccugccc

SEQ ID NO: 161415 - RNA, 64 nt, Human
uuccuccgccuugcugcaacagagaggaaaugcccauguccacagcuuguacacacugcccccu

SEQ ID NO: 161416 - RNA, 64 nt, Human
uuuuaggaagucaacuuuaguuuugcuuuguuugcauguccacuaauuuuuuuauuuugauauu

SEQ ID NO: 161417 - RNA, 64 nt, Human
ccccaacccacucccucuguagugaggccucugccauguccagagggcacaaaacugucucaau

SEQ ID NO: 161418 - RNA, 64 nt, Human
gggucucuagccagggagaccccaucuuauucaccauguccaagauccugggaucugggcccag

SEQ ID NO: 161419 - RNA, 64 nt, Human; identical to SEQ ID NO: 84826

SEQ ID NO: 161420 - RNA, 64 nt, Human
gucucagacguuuuuccuauggacuuauuucuuccauguccaggacuuugcacaacuuugguuu

SEQ ID NO: 161421 - RNA, 64 nt, Human
gagugcaugaccuuaugguuuaacagagagaaaacauguccacucugcagaacugugauuucag

SEQ ID NO: 161422 - RNA, 64 nt, Human; identical to SEQ ID NO: 161416

SEQ ID NO: 161423 - RNA, 51 nt, Human
ucauucagauagaaaagugaucauguccaaugggagacugaagugugcagg

SEQ ID NO: 161424 - RNA, 64 nt, Human
acccccuuuucuuccuacucugugccuggagcaucauguccaccccugcagauccuuggaaaag

SEQ ID NO: 161425 - RNA, 64 nt, Human
uccuuaguaacugugaguauaugaauguguugcacauguccacaguauuggcgagauaauuaca

SEQ ID NO: 161426 - RNA, 64 nt, Human
ggaaaaccgccuuaggaacagaaagagcucagaccauguccacuuccuuucuccugaaaccuaa

SEQ ID NO: 161427 - RNA, 64 nt, Human
ugucugcuucauaaggaguaacgacugacauuagcauguccagugacaagucacauccggugua

SEQ ID NO: 161428 - RNA, 64 nt, Human
auguuuucagcagaaaugaaggauaagcaucgcacauguccagcaaugucuuugagaaugcagu

SEQ ID NO: 161429 - RNA, 64 nt, Human
gcuccaggcugugccuacacagcagugcuggugacauguccaggguuccagggcccgguggccu

SEQ ID NO: 161430 - RNA, 64 nt, Human
auccuggagucucauuaaaugccugauugugaaccauguccaccaguaucuggggugggcacgu

SEQ ID NO: 161431 - RNA, 64 nt, Human
cagcccuccugaggcccacacuuuggaggggguccauguccaagagacccugacaaggaaggag

SEQ ID NO: 161432 - RNA, 64 nt, Human
ccgcaccugguggccuuguccuugaggugagccccauguccaucugggccacugucaggaccac

SEQ ID NO: 161433 - RNA, 64 nt, Human
agggacaaagucccccccaaaacccgcagguccucauguccagacgcugcccaguccuguccug

SEQ ID NO: 161434 - RNA, 64 nt, Human
gccucuggaaaacucaggauucucacgacucuaccauguccaauggaguucagagaucguuccu

SEQ ID NO: 161435 - RNA, 64 nt, Human
guggacccccagguugcaaguuacauacccugggcauguccagaugaacgaagcgugcaaaucc

SEQ ID NO: 161436 - RNA, 64 nt, Human
accugcuggguauugguuccagcacuccgugagccauguccagucccuuuuauaaaaugacaug

SEQ ID NO: 161437 - RNA, 64 nt, Human
gcugugccaauaggaaaaagcuaccuagacuaggcauguccaaaauggcggcuccaaguucccu

SEQ ID NO: 161438 - RNA, 64 nt, Human
uguccucauuaggacaucaugucuuugucagugccauguccacaguaucugccauacucccugg

SEQ ID NO: 161439 - RNA, 64 nt, Human
agcuggagcaugagugucugacaaucagaagcaucauguccaauguccagauggccagaaugaa

SEQ ID NO: 161440 - RNA, 64 nt, Human
ggaaaaauauauuaaaaacaacaaaaaaguggcacauguccaggcagugugaggauuugcugua

SEQ ID NO: 161441 - RNA, 64 nt, Human
auccugucaaagaccuaagucuguaagcuggugccauguccauacaccaugucacuuuacucuu

SEQ ID NO: 161442 - RNA, 64 nt, Human
ucuguuuaccaaagaccgggaacaggggcccaaacauguccaguccucuucuucccucugcugg

SEQ ID NO: 161443 - RNA, 64 nt, Human
uguugaagccacugccuucaccuucaccuucauccauguccaacccccgacuucaucccaaagg

SEQ ID NO: 161444 - RNA, 64 nt, Human
aaguuaucuuuauaaucacuguaguuagauguuucauguccauucaagugacuuuuauucugag

SEQ ID NO: 161445 - RNA, 64 nt, Human
ccccucagccaucucagggugaggagcugccagucauguccagauggaaugacucccauccucu

SEQ ID NO: 161446 - RNA, 64 nt, Human
ugagaaacuuugaucucugcuuacuaaugugccccauguccaaguccaaccugccugugcauga

SEQ ID NO: 161447 - RNA, 64 nt, Human
uggacuccaagcuaacucuuugcaaauguaaacacauguccaucuuguaauaaaugcaaaaugc

SEQ ID NO: 161448 - RNA, 64 nt, Human
ggggccgggccuccggcggcccggcugcuguucccauguccacaucucugaggccugcaccccc

SEQ ID NO: 161449 - RNA, 64 nt, Human
cacuacgauaguguuagauggggaaauacugcaacauguccaguuggccagaucacuuuccaag

SEQ ID NO: 161450 - RNA, 64 nt, Human
gggagagaagggcagacccauucucaaagaccaccauguccaaggucugacagcuccccacugg

SEQ ID NO: 161451 - RNA, 64 nt, Human
cuuuuugccuccucggaagcucgcugcccagagccauguccagaacccagccggccaucuccau

SEQ ID NO: 161452 - RNA, 64 nt, Human
auguaguucauggcuacuguacugacagcgagagcauguccaucuguuggacagcacuauucua

SEQ ID NO: 161453 - RNA, 64 nt, Human
acaacucaguguugaagcccaguguccucagcuucauguccaguggauggcagaaguucauggg

SEQ ID NO: 161454 - RNA, 64 nt, Human
gacaccggcugcaccaucagcgggaagcagagcccauguccaggaugccuccugcugcccugug

SEQ ID NO: 161455 - RNA, 64 nt, Human; identical to SEQ ID NO: 84829

SEQ ID NO: 161456 - RNA, 64 nt, Human
cuggccgcccagcaggagggacugaggccagacucauguccagcaaggaacguguggugugucc

SEQ ID NO: 161457 - RNA, 64 nt, Human
gauugcaaagggacauugaaguguuuaaaagagccauguccaaacccaucuucauggauagcuc

SEQ ID NO: 161458 - RNA, 64 nt, Human
gcccacgccgagcgagggaugcuucucccuacagcauguccacucccccggcauggccaggugg

SEQ ID NO: 161459 - RNA, 64 nt, Human
aaaauuccacuggccaguugaauauauucuauuccauguccauacuaugacaaucuuauuguca

SEQ ID NO: 161460 - RNA, 64 nt, Human
gauauacguacaaaacacacagcaaguuuucuaucauguccaacacauucaacacugguauacc

SEQ ID NO: 161461 - RNA, 64 nt, Human
cgcuccguaccuggaccugcugaaucauagcccacauguccagguaaaagcagcguuuaaugaa

SEQ ID NO: 161462 - RNA, 64 nt, Human
gagaaagacacagcccagcagggcuggagacgcccauguccagcaggcgcaggccuggcaacac

SEQ ID NO: 161463 - RNA, 64 nt, Human
ccuggggucccugcugccucucaaucuccagagccauguccauggggaggugggcucugaaggg

SEQ ID NO: 161464 - RNA, 64 nt, Human
ugccccaguggauuagcaaguguggcaggcuuaacauguccagguucuccccaauaacauuguc

SEQ ID NO: 161465 - RNA, 64 nt, Human
aguuuaauuuuuaaacauaaaggucuugguuacacauguccaugcauuccaguuaacacauuua

SEQ ID NO: 161466 - RNA, 64 nt, Human
ucuucuggggucugugguccauccuccaggcauccauguccaccauagaauuugguuacuuggu

SEQ ID NO: 161467 - RNA, 64 nt, Human
guuacauguguguguguacagugcgugugauucccauguccaaagugcugucaugcugccugcu

SEQ ID NO: 161468 - RNA, 64 nt, Human
ugguaaacauagaccaaaauggaaacguugaauacauguccagcuuccagaauauccgcauuga

SEQ ID NO: 161469 - RNA, 64 nt, Human
uuggagcauuacgauccacgauuauugauguugacauguccauguaguaauuuuucuucaaguc

SEQ ID NO: 161470 - RNA, 64 nt, Human
agacugguuugaaugguuuaauuuugcaauggaucauguccaugccagguguuacaauucuuaa

SEQ ID NO: 161471 - RNA, 64 nt, Human
gagggcccaucuguugucuguaacaugccuuucacauguccaccuucuugccauguuccagcug

SEQ ID NO: 161472 - RNA, 64 nt, Human
augcuacugccauggccagugcaagccccagugucauguccaccaacuucuguccugagugaug

SEQ ID NO: 161473 - RNA, 64 nt, Human; identical to SEQ ID NO: 84832

SEQ ID NO: 161474 - RNA, 64 nt, Human
ugccuaugaaaaacugauuuguuaaaacaugcuacauguccaaaaauaaagaccagaaugacau

SEQ ID NO: 161475 - RNA, 64 nt, Human
uggcauuucacacacuguagauggucacucccuucauguccauguuagcucaugguguaagaug

SEQ ID NO: 161476 - RNA, 64 nt, Human
ccaccaugaggauaaaaccuccuucucuucuggacauguccaggaguggccguugcuacaaguc

SEQ ID NO: 161477 - RNA, 64 nt, Human
auuugucucucucuaccugucccuuuuucucuaacauguccaaaagugcuguuuuuccauagau

SEQ ID NO: 161478 - RNA, 64 nt, Human
uggacauucuaggucccugacucgccagaugcaucauguccauuuugggaaaauggacugaagu

SEQ ID NO: 161479 - RNA, 64 nt, Human
gcacuggcggauuggugggggggacaccacugagcauauccagacccacuucgagagcaagaca

SEQ ID NO: 161480 - RNA, 64 nt, Human
gauucuggggugaggauacaaagacauugucuugcauauccauaagcaggucuuagagcauuau

SEQ ID NO: 161481 - RNA, 64 nt, Human
acucucucugcuucccccuccgcucuugacccugcauauccaggaaggaacugccagccucaga

SEQ ID NO: 161482 - RNA, 64 nt, Human
ucaguugguuugguagagacuucaaacccuugcacauauccaaaaggugcaucccguaaugauc

SEQ ID NO: 161483 - RNA, 64 nt, Human
acauagauuauauuccucaagaugaagggcuuaacauauccacagcuuccucaguuugcuaacu

SEQ ID NO: 161484 - RNA, 64 nt, Human
aaaaacaucuuuucaaugaaauguguuaccauuucauauccauugaagccgaaaucugcauaag

SEQ ID NO: 161485 - RNA, 64 nt, Human
cguagacaaagaaaggaucuuguguauuuuuguccauauccaauguuauaugaacuaauuguau

SEQ ID NO: 161486 - RNA, 64 nt, Human
aaaaauggcaaaguacuguuuuagcugugcaugucauauccacaaagacuuuuagcaggugaac

SEQ ID NO: 161487 - RNA, 64 nt, Human
cuucccugccacuccucugagagggcagaacacacauauccaaguaggcuacccaccacugggu

SEQ ID NO: 161488 - RNA, 64 nt, Human
ccaggugcucuguauguuuguuuuuaauauucaucauauccaaguucacucugucuuccugagc

SEQ ID NO: 161489 - RNA, 64 nt, Human
augaaacuagucuuaacuguugagccuuuccuuucauauccacagaagacacugucucaaaugu

SEQ ID NO: 161490 - RNA, 64 nt, Human
cuuggacugcauuuuaagcccugcaggcuucugccauauccaugagaagauucuacacuagcgu

SEQ ID NO: 161491 - RNA, 64 nt, Human
acuuuaggggcuggcacaaaucugaucagagacacauauccauacacaggugaaacacauacag

SEQ ID NO: 161492 - RNA, 64 nt, Human
ugucagagcugggaguagcauggacucuggguuucauauccagcugagugagaggguuugaguc

SEQ ID NO: 161493 - RNA, 64 nt, Human
agccaucugggauaagacuuugacccaugacucccauauccacagccuguccauccuagcccau

SEQ ID NO: 161494 - RNA, 64 nt, Human
caaccccucccucugaucauuuccaguugauugucauauccaggaaaaaauggaacagugcacu

SEQ ID NO: 161495 - RNA, 64 nt, Human
cacuuacucuguuaccuaaauuuuauaguuagaucauauccaaucuacuuauuaaacuguguuc

SEQ ID NO: 161496 - RNA, 64 nt, Human
agguuugcacauguagagaagcauacuggagaagcauauccagagggcgaaagauaucucucca

SEQ ID NO: 161497 - RNA, 64 nt, Human
agguauaagacucagucuccacaugaagggagcucauauccaaggacacaaaaccacuuuaaaa

SEQ ID NO: 161498 - RNA, 64 nt, Human
ugcugagaugucuucgaaggaauuuuguuuuagccauauccaucaacuuuguauuuuacuugca

SEQ ID NO: 161499 - RNA, 64 nt, Human
uuugaaauauaacuagaaaagaaugacuugccaccauauccacuaggugucacuaccucuaacc

SEQ ID NO: 161500 - RNA, 64 nt, Human
ggggaucugccauauuuguguugguuuuuauuuucauauccagccuaaaggugguuguuuauua

SEQ ID NO: 161501 - RNA, 64 nt, Human
gauccaucaguuaguagggugcaugucagaugaucauauccaauucauauggaagucccggguc

SEQ ID NO: 161502 - RNA, 64 nt, Human
uggccuuuuaacaaacgcugggaauuuugcuugucauauccagacuggaggccgacugcccugg

SEQ ID NO: 161503 - RNA, 64 nt, Human
acucauuugcugacacaucaguuauaucuuguggcauauccauuguggaaacuggaugaacagg

SEQ ID NO: 161504 - RNA, 64 nt, Human
aaagccugcaagauuucaguuuacauaucgacagcauauccacugauuucuaaaugggcugguc

SEQ ID NO: 161505 - RNA, 64 nt, Human
auguauacaucguggaauggcuaaaucaagcuaacauauccauuaccucacauaguuauuuuuu

SEQ ID NO: 161506 - RNA, 58 nt, Human
cagcuccagagcagcccugaggauuccacauauccaaugccucacagucugcaagccu

SEQ ID NO: 161507 - RNA, 64 nt, Human; identical to SEQ ID NO: 84835

SEQ ID NO: 161508 - RNA, 64 nt, Human
guaauagccacaaaacagagggcccacugcacagcauauccaggcugccacagguggggacgag

SEQ ID NO: 161509 - RNA, 64 nt, Human
caaguaagagccaaaaaaaaaaaaaaaaaaaauccauauccauucauuaaaaaaaugagauaua

SEQ ID NO: 161510 - RNA, 64 nt, Human
accucaauuauuucacuuaaccccaggccauuaucauauccagauggucuucagaguugucuuu

SEQ ID NO: 161511 - RNA, 64 nt, Human
gccaucggucuagcauaucagucacugggcccaacauauccauuuuuaaacccuuucccccaaa

SEQ ID NO: 161512 - RNA, 64 nt, Human
agcagccuacaacugaauagcaaguggcauaaagcauauccauucagaaugaagugccuuaaau

SEQ ID NO: 161513 - RNA, 64 nt, Human
uuacauuccuucuucccauaucuuaucagcauaucauauccauuucacuccaacacucugucuu

SEQ ID NO: 161514 - RNA, 64 nt, Human
ucuuauaucuccacaaacacaaauuauauauauacauauccacacacauacauuacauauaucu

SEQ ID NO: 161515 - RNA, 64 nt, Human
gacgauuuuggacaaaucauuagaaacugggcaucauauccacaguuauguaaggcagugauau

SEQ ID NO: 161516 - RNA, 64 nt, Human
uagcuaugugguaccaagauuagcaaaugaccuucauauccacugauuuccugauguccauguc

SEQ ID NO: 161517 - RNA, 64 nt, Human
uaauuagugauauaagcauuguuuuuauugcagccauauccacuuauccaucuuaagaucugua

SEQ ID NO: 161518 - RNA, 64 nt, Human
gaauguucucacucacuaucuugucucucauacacauauccaucugcagaccauggucccuaaa

SEQ ID NO: 161519 - RNA, 64 nt, Human
ccccaucuugugguaacuugcugcuucugcacuucauauccauauuuccuauuguucacuuuau

SEQ ID NO: 161520 - RNA, 64 nt, Human
aauacugagugcuaauguuacagggccacaaucucauauccacaauuccaaaaucuccaaaccu

SEQ ID NO: 161521 - RNA, 64 nt, Human
gcauuuuacuacaaagcacaauucauuuguaaugcauauccaucuuggauucaauccaaggugc

SEQ ID NO: 161522 - RNA, 64 nt, Human
caacaugacccguaagucaagaagguagacauuucauauccagcuuccuugcuuagucuccuuu

SEQ ID NO: 161523 - RNA, 64 nt, Human
agcugagugcacuucauguuggaugcauauaauacauauccauuucuuuccucaccauccuacu

SEQ ID NO: 161524 - RNA, 64 nt, Human; identical to SEQ ID NO: 84838

SEQ ID NO: 161525 - RNA, 64 nt, Human
gugcauuugucuguccaccguaauuuuagaaaagcauauccauaacguuuacaguuguaguaca

SEQ ID NO: 161526 - RNA, 64 nt, Human
uaauagaaugagacauaaaaugaauuaauggaaacauauccacacuguacugugauauagguac

SEQ ID NO: 161527 - RNA, 64 nt, Human
ugugcguagaaguucuaguguuuucaauuuuaaacauauccaaguuugaauuccuaaaauuaug

SEQ ID NO: 161528 - RNA, 64 nt, Human
aacagcuauuuuaguaaccccaagaguuucuucucauauccauaaaauuggauuacaguauggc

SEQ ID NO: 161529 - RNA, 64 nt, Human
ucaaacauuccuuguguuaaaaaaaucaaacauucauauccacaaaauuuucugcuaaaugacu

SEQ ID NO: 161530 - RNA, 64 nt, Human
uuuaggucauuuucucuuuggauaauuuucaucgcauauccagcaacuauagaccaaaguuugc

SEQ ID NO: 161531 - RNA, 64 nt, Human
uguauugaaucagaaugccuucaacugaaaaaaacauauccaaaauaaugaggaaauguguugg

SEQ ID NO: 161532 - RNA, 64 nt, Human
auugugaugguguaagagcuaaauccucaucugucauauccagaaaucacuauauaauauauaa

SEQ ID NO: 161533 - RNA, 64 nt, Human
auauuucuucuuacacauugaacuguaucauuuucauauccacuuccccaccacugaaauaucu

SEQ ID NO: 161534 - RNA, 64 nt, Human
agaaaaauaacacagcuacuccucacugcaaaaacauauccaugcguagaaucaacaacuccag

SEQ ID NO: 161535 - RNA, 64 nt, Human
uuagccucucuuagccccuuguucuucccaaugucauauccaccaggaccuggccacagcuggc

SEQ ID NO: 161536 - RNA, 64 nt, Human
ccucccaaguaguugggaccacaggugugcaccccauauccagcuauuuuuuuucaauuuuuuu

SEQ ID NO: 161537 - RNA, 64 nt, Human
uuuacuaacaauuuuaaaccauauuuuucuucuucauauccauuucuaauccaucaaacagcuu

SEQ ID NO: 161538 - RNA, 64 nt, Human
ccuaguuuaguccaugauacuauaauugugagagcauauccagaugcuguguucucuauguaaa

SEQ ID NO: 161539 - RNA, 64 nt, Human
acagacacacacaagugccuauauaaugauaaaacauauccaaagcacccaaaccugugauucc

SEQ ID NO: 161540 - RNA, 64 nt, Human
gaugccuggccuaagcaccuggagcaggggaccccauauccacugguagccaccuccccauugc

SEQ ID NO: 161541 - RNA, 64 nt, Human; identical to SEQ ID NO: 84841

SEQ ID NO: 161542 - RNA, 56 nt, Human
ucauccaccaugugcaguaagaggugcauauccacucagcugaagaagcuguagaa

SEQ ID NO: 161543 - RNA, 64 nt, Human
auugagagccucuaugugcaaggugauauauaaucauauccaguuuaaucuucacaauauccaa

SEQ ID NO: 161544 - RNA, 64 nt, Human
cugagugucugugaaauaccucuacuuucccucccauauccagaacaaaaugauacuugacauc

SEQ ID NO: 161545 - RNA, 64 nt, Human
auuuauuuauuguaauaccucacagacguuguaccauauccaugcacauuuaguugccugccug

SEQ ID NO: 161546 - RNA, 64 nt, Human
gcaugguagaauguucagcagcauuccugccauccauauccauuaggugccaguagcacccccg

SEQ ID NO: 161547 - RNA, 64 nt, Human
uugaacauaugugguuguauauauuggaaauguacauauccaauaugaaauacuaaaacaaaca

SEQ ID NO: 161548 - RNA, 64 nt, Human
acaggggacagaugaccagguguguccaccugggcauauccaccaccucccucaccaacauugc

SEQ ID NO: 161549 - RNA, 64 nt, Human
uuuaaaauaaaaacuguuacaucacuauuuuaaacauauccaguacaauuuaaauaucacaaca

SEQ ID NO: 161550 - RNA, 64 nt, Human
aucugaauauaaucaugaugcauucaaugaaguucauauccaugaauucacuccuaauauaccc

SEQ ID NO: 161551 - RNA, 64 nt, Human
uguaagcaugacccaaccuaccacccuguuuuuacauauccaauuccaguaacucucaaauuca

SEQ ID NO: 161552 - RNA, 64 nt, Human
acacacauguacgcacacacacaugcacugcacacauauccaugcacacaaacacauauauaca

SEQ ID NO: 161553 - RNA, 64 nt, Human
aaagagaauuaagaaagguuuugaauucuuauaacauauccagccauuucaauuuugauugaaa

SEQ ID NO: 161554 - RNA, 64 nt, Human
uuuguggaacauauuccagcuuuuugaaugagugcauauccaguaguaccuuuaaaguaacacu

SEQ ID NO: 161555 - RNA, 64 nt, Human
uugcacuggugacagacaaaaucuguuuuaaaaucauauccagcacaaaaacuauuucuggcug

SEQ ID NO: 161556 - RNA, 64 nt, Human
caucuuuucugcuguguuuaggacauuugauuugcauauccaauaucuccucgaaaccuucaga

SEQ ID NO: 161557 - RNA, 64 nt, Human
uguuuaaagugauuugaaaaauacucauucugaacauauccaugcgcaaucaugauaacuguug

SEQ ID NO: 161558 - RNA, 64 nt, Human; identical to SEQ ID NO: 84844

SEQ ID NO: 161559 - RNA, 64 nt, Human
cagauugauuuuuguagccucucacugaauccaacauauccacaagcaaguuaucugucuuucu

SEQ ID NO: 161560 - RNA, 64 nt, Human
ugagaacuuucaguucaaagcaucaaauugaugccauauccaaggacaugccaaaugcugauuc

SEQ ID NO: 161561 - RNA, 64 nt, Human
acacacagagcaaacucccuuucauaaaagcccucauauccacuggcaguccccguucgcauca

SEQ ID NO: 161562 - RNA, 64 nt, Human
caaagauggacuacuucacaaaugguuauaaagucauauccacuucuuccacaaugaccacagc

SEQ ID NO: 161563 - RNA, 64 nt, Human
cuuguucacuggauugucugggaugacuugggcucauauccacaauacuugguauaagguagua

SEQ ID NO: 161564 - RNA, 64 nt, Human
uucuucauaauguacuccugggaacuggguaggacauauccauauuguaguucccaaggugucu

SEQ ID NO: 161565 - RNA, 64 nt, Human
cuugccagccgagaugggagccuagcuaauaauccauauccaggugaugucacaaaguuuggcc

SEQ ID NO: 161566 - RNA, 64 nt, Human
gaccugcggauagacaggagcgggcaggcccgcacauauccacuugcuggagcccauguuuaca

SEQ ID NO: 161567 - RNA, 64 nt, Human
cccaugaggguuauugaaucauuccuuagucuagcauauccacaguguauacacuaucugccag

SEQ ID NO: 161568 - RNA, 64 nt, Human
augcaaaauccuaaaauugaaaaaaacaucuagccauauccauaaacuauaucaucaccaagag

SEQ ID NO: 161569 - RNA, 64 nt, Human
uucugaacaaaguaggguucaaaaugcagacugucauauccagcgagucccugacccuuucugc

SEQ ID NO: 161570 - RNA, 64 nt, Human
ucauacccacuguucugaaggcuugaaaacaaaacauauccacaacauuggcuugaugugauca

SEQ ID NO: 161571 - RNA, 64 nt, Human
guaugcuugaaaagauaaauuauaucaauuuccucauauccaguauuguuccuuuugugggcaa

SEQ ID NO: 161572 - RNA, 64 nt, Human
uguauuaauccuauauaauagauugaucaugcaccauauccacaggagguuggaaaaaccaugc

SEQ ID NO: 161573 - RNA, 64 nt, Human
ugaggcucugacuuuggaccucaggugaguccagcauauccacaccacccaagaagugaccagu

SEQ ID NO: 161574 - RNA, 64 nt, Human
cuuaaaagauugaagaaagagaaacuugucaacucauauccacguuaucuagcaaaguacauaa

SEQ ID NO: 161575 - RNA, 64 nt, Human; identical to SEQ ID NO: 84847

SEQ ID NO: 161576 - RNA, 64 nt, Human
uuugguguucacuuacgaagcauacaacuagaaccauauccaagcagacucuggguugcuguua

SEQ ID NO: 161577 - RNA, 64 nt, Human
ggagcacuuuaaugcaacccagguaugcuccaugcauauccagcugggccagccucgugcuggg

SEQ ID NO: 161578 - RNA, 64 nt, Human
aaauaaugcagucagcuaagagccaacaaaaccccauauccagauaguuagcugugagccagca

SEQ ID NO: 161579 - RNA, 64 nt, Human
ggacuaggccuaaguagauuuaggcaacggguaucauauccaugaaaaaugucauuuuaagaca

SEQ ID NO: 161580 - RNA, 64 nt, Human
cacaccaggcacuaaucaccuggugaggauuuggcauauccaccaaaaaaugcauccgauuuaa

SEQ ID NO: 161581 - RNA, 64 nt, Human
cucagcuccuaccucugugccagggcagcauuuucauauccaagaucaauucccucucucagca

SEQ ID NO: 161582 - RNA, 64 nt, Human
gauagaccuuuacagcaaucaagauauuuuuguccauauccagguuagcugguaagaggauuuu

SEQ ID NO: 161583 - RNA, 64 nt, Human
accuggcuccaaccaaccccuccccugccuccaccauauccacuaccaggcacccuuuagaaca

SEQ ID NO: 161584 - RNA, 64 nt, Human
uccccccccuuuuacccuccauuuguguuuauugcauauccacuauaacaacauuaaaggaccu

SEQ ID NO: 161585 - RNA, 64 nt, Human
acugauuucuggguuucugccacggccacagguucauauccagaggaauggcagaucugagacg

SEQ ID NO: 161586 - RNA, 64 nt, Human
ggccucagcccuggcagggcucucucuucaaggccauauccaccugugcccuggggcuugggag

SEQ ID NO: 161587 - RNA, 64 nt, Human
cgugauaguauaaaccaaugugacuucaugugaucauauccaggauuuuuauucgucgcuuauu

SEQ ID NO: 161588 - RNA, 64 nt, Human
ugucuuagugcaaaaaacauacuuacauuucagacauauccaaagggaauacucacauuuuguu

SEQ ID NO: 161589 - RNA, 64 nt, Human
uauuuagaauagccagugaucacuagcuaauucucauauccaugccuuuuuguccuguuuacag

SEQ ID NO: 161590 - RNA, 64 nt, Human
cauuucuagcuaaaacuccauuuggugaaaccaacauauccauuucuuuuccuaguuacggaug

SEQ ID NO: 161591 - RNA, 64 nt, Human
caccucuuggauuggcccuggcugcugccacacacauauccaagagcucagggccaguucuggu

SEQ ID NO: 161592 - RNA, 64 nt, Human; identical to SEQ ID NO: 84850

SEQ ID NO: 161593 - RNA, 64 nt, Human
cuuacuuugaaguuuucaccaaagcaaaaagguccauauccaauaguauccuuugugcuguggc

SEQ ID NO: 161594 - RNA, 64 nt, Human
cuuuacguguguaaauuccuaccaggaaagaauacauauccaauagauuggagaaagccagaga

SEQ ID NO: 161595 - RNA, 64 nt, Human
uggagaacaugcauacuacaauuaagagagugaacauauccaucaucccucaaagugucacaau

SEQ ID NO: 161596 - RNA, 64 nt, Human
auaauauguagaaauuuaaguccuccaauuccagcauauccagugaguuuugacaguguguuua

SEQ ID NO: 161597 - RNA, 64 nt, Human
cugguggagggacucuagcuaccaugcacauguacauauccacagaauaugggaagugggaaug

SEQ ID NO: 161598 - RNA, 64 nt, Human
ccagaagaguaagagggaaaauggacauauguuucauauccaaggguauucaaacuguaguuag

SEQ ID NO: 161599 - RNA, 64 nt, Human
cuuauuaaggacuuuaaccuacucaacaguauuucauauccauugugguuaguuacucaguuau

SEQ ID NO: 161600 - RNA, 64 nt, Human
uacaggaucagagaggaucuugcucauucauggccauauccacaugcccauggccacucaguag

SEQ ID NO: 161601 - RNA, 64 nt, Human
gacugcaaaggucaaguucucuuuacuccgucaccauauccauauggaauaagggcucguccua

SEQ ID NO: 161602 - RNA, 64 nt, Human
ccaaggcaucaaggacaucccgaaacuggaaauucauauccaucugguaugaauauauaacuca

SEQ ID NO: 161603 - RNA, 64 nt, Human
ccuuggacugccuggugguuaaaauacgauuccucauauccaaggcuacuuuugaagaucccuc

SEQ ID NO: 161604 - RNA, 64 nt, Human
uuuucaaaaaaagcacaaauuaaaguaguaaauucauauccauagauaguucauucauucaaca

SEQ ID NO: 161605 - RNA, 64 nt, Human
uaagaaaguuucauggauuagagugacugaaaaacauauccaguuagaaaauugugcuuuuuuu

SEQ ID NO: 161606 - RNA, 64 nt, Human
aaccacacauauugauggagucugcauuccaccacauauccacccuugagaaguaugucaaaag

SEQ ID NO: 161607 - RNA, 64 nt, Human
auuuuauuuuuuucagggggucuuuuuuuuaauacauauccaauaaugccuuccaucugaaugu

SEQ ID NO: 161608 - RNA, 64 nt, Human
uacucuagucuuuaguacuucaaaauuaccuuuucauauccaugaucuugaguccauuuggggg

SEQ ID NO: 161609 - RNA, 63 nt, Human; identical to SEQ ID NO: 84853

SEQ ID NO: 161610 - RNA, 64 nt, Human
cuucccuuccauuaagcugaaauugccccacggccauauccacccauugacucugccuucauca

SEQ ID NO: 161611 - RNA, 64 nt, Human
ccagcuuucuaacauccuccccacaccaucucaccauauccaucucccagcauccaucugcauu

SEQ ID NO: 161612 - RNA, 64 nt, Human
cccacaucugagugaaggucuugcucuucccuuucauauccaaugucaauuccuuguacucacu

SEQ ID NO: 161613 - RNA, 64 nt, Human
gaauuucagggagcauagcaucgggaggaugcuacauauccagggacucccuccuggccuuccu

SEQ ID NO: 161614 - RNA, 64 nt, Human
uuccaguaagugaaauacaaccuaguuuuaucaccauauccaccagcaggcauggauaauuauu

SEQ ID NO: 161615 - RNA, 64 nt, Human
aucaagauauuaaaaugucggauuuaucuuuccccauauccaaguaccaaugcuguuguaaaca

SEQ ID NO: 161616 - RNA, 64 nt, Human
guuguugcgugagaacccgugugccccuucccaccauauccacccucgcuccaucuuugaacuc

SEQ ID NO: 161617 - RNA, 64 nt, Human
cacuuaaaggaggcgcuuuauagcuucucuuuggcauauccaaaugccagcaucacuguuguau

SEQ ID NO: 161618 - RNA, 64 nt, Human
ccacugcacuccagucugggugacagagagagaccauauccaaaaaaaaaaaaaguugccagag

SEQ ID NO: 161619 - RNA, 64 nt, Human
gugucugcggggaucagagcgcacagggagugcacauauccaggcaccaggacuagggcuggag

SEQ ID NO: 161620 - RNA, 64 nt, Human
uccuggcugcacagggugccacggggccaaguggcauauccagagcccuggggcggcugaugcc

SEQ ID NO: 161621 - RNA, 64 nt, Human
gaugcuagauaaugaauaaaaacugguuuagggccauauccagagugcuauauuauguaaauga

SEQ ID NO: 161622 - RNA, 64 nt, Human
aaagacacccauguuuaagauuuuucaucacuaacauauccauuaaaaguaucaacuggccagg

SEQ ID NO: 161623 - RNA, 64 nt, Human
uugguaacaaacaaaauccguauaugcaaaucaacauauccaaacaugccaagacugcuuuucc

SEQ ID NO: 161624 - RNA, 64 nt, Human
auucuuucuagaauuuggugcaggaauauguguucauauccaggcaaacggguguguuuuuauc

SEQ ID NO: 161625 - RNA, 64 nt, Human
acccaguggcuugaaacuuccugagaaacuguagcauauccagcccccuaaaauguacaaugua

SEQ ID NO: 161626 - RNA, 64 nt, Human; identical to SEQ ID NO: 84856

SEQ ID NO: 161627 - RNA, 64 nt, Human
auacaaggagggggcuauuaacacccaguacagacauauccacaaggucguaaaugcaugcuag

SEQ ID NO: 161628 - RNA, 64 nt, Human
aauggauugugcagacacugaguuuuuagaaaaacauauccacgguaaccggucccuggcaauu

SEQ ID NO: 161629 - RNA, 64 nt, Human
cuuuuucacacaccccuucaugcccggcuuuccccauauccacaugcagagggcgagcucauaa

SEQ ID NO: 161630 - RNA, 64 nt, Human
cauaacccccaggagcaaagcaaccuggaggcugcauauccaugggcgggcagcauaagagaau

SEQ ID NO: 161631 - RNA, 64 nt, Human
cuaggucaaaguuacauucauuuuaauuuugguacauauccauaaauucuccauaaaaguagga

SEQ ID NO: 161632 - RNA, 64 nt, Human
auuuuaaucaccuggucaccagacccucacggcccauauccaauucgaauuucagaaauuucuc

SEQ ID NO: 161633 - RNA, 64 nt, Human
uggcuuugacaucaagcugggugaauuagaaaggcauauccagacccuauuaaagaaaccacag

SEQ ID NO: 161634 - RNA, 64 nt, Human
gggucauaguaucugauaucaauaucguugauaacauauccacagguaacaccaugauguaggc

SEQ ID NO: 161635 - RNA, 64 nt, Human
guacugggugacucaaauuuuucacccauuuacacauauccacaaaugacugcaaaagugccac

SEQ ID NO: 161636 - RNA, 64 nt, Human
uuugaagcugucuuugguacuuguucuuugaaaucauauccaccugucucuauagguaucauuu

SEQ ID NO: 161637 - RNA, 64 nt, Human
gaauaugguggaguucaguccaauucaggucagccauauccaaaagaccacaagucauuacuaa

SEQ ID NO: 161638 - RNA, 64 nt, Human
auucuuaaagaaaagaauuuucaacccagaauuucauauccagccaaacuaagcuucauaagug

SEQ ID NO: 161639 - RNA, 64 nt, Human
cuauuuuugcuuuuguugcuuguguuuucagggccauauccaaaaaaaccuugcccggaccaac

SEQ ID NO: 161640 - RNA, 64 nt, Human
acugccaggaacuggaagcacuaggauuugacagcauauccaaauaugucagcaauuucaauaa

SEQ ID NO: 161641 - RNA, 64 nt, Human
ggacucgugccucugcgcccauucucuucucacgcauauccaugagcuuuaauuucacuuucug

SEQ ID NO: 161642 - RNA, 64 nt, Human
guucgagaccagccuggccaacauggugaaaccccauauccauuaaaaauauuuaaaaauuagc

SEQ ID NO: 161643 - RNA, 64 nt, Human; identical to SEQ ID NO: 84859

SEQ ID NO: 161644 - RNA, 64 nt, Human
uuaaaacuagaauauucaacuccauauggaaaaucauauccauggaucucuuuggcauuaugaa

SEQ ID NO: 161645 - RNA, 64 nt, Human
uuuuucuuucucauucgaaucuaccacaguuggucauauccaacccucauucaguauuucuauc

SEQ ID NO: 161646 - RNA, 64 nt, Human
gugagacagagaacagggaauuaaaugugucauacauauccacuugagggcgauuugucugaga

SEQ ID NO: 161647 - RNA, 64 nt, Human
uuccauggaaaagcuggaaaaaaacucuggaacccauauccaggcuuggugagguugcugccaa

SEQ ID NO: 161648 - RNA, 64 nt, Human
ugcccuucccugaccccauuguaauaaccaacuccauauccaaagggagguggugcucucagcc

SEQ ID NO: 161649 - RNA, 64 nt, Human
ugcugucgcugcaguaucugauaccagacauccacauauccacaagaagugccucuuaggucug

SEQ ID NO: 161650 - RNA, 64 nt, Human
gacugacuuuaucaauaaucuaaccgacaaagaucauauccauguguaugugguuagacauuuu

SEQ ID NO: 161651 - RNA, 64 nt, Human
uacugucuuucuagauggugguauuugcuaacaucauauccaacucagggaagcggacugagug

SEQ ID NO: 161652 - RNA, 64 nt, Human
gaagccggcguucgguaucagaagcgcugauggucauauccaaucucaauaucugggucaaucc

SEQ ID NO: 161653 - RNA, 64 nt, Human
agauucuccacggugguccccaaaacacugucugcauauccauaagaauugagcgcuaugggug

SEQ ID NO: 161654 - RNA, 64 nt, Human
guuuuuucuuuuucuggguccaucacucuuuagccauauccacaugggcuaaaacagguguaau

SEQ ID NO: 161655 - RNA, 64 nt, Human
guuaguuuugcuccuucuguguuuuuuucugaaccauauccauguugcugacuuuuccaaauaa

SEQ ID NO: 161656 - RNA, 64 nt, Human
guugacuuuguaaaucugcccacacccagcuggccauauccaccccucgacgccgggaugagcc

SEQ ID NO: 161657 - RNA, 64 nt, Human
gagcuggcuucaggggaagugcuauucacaggaccauauccaccacccucuuaaauuccuaaac

SEQ ID NO: 161658 - RNA, 64 nt, Human
acaaagcaucucauucauauuaccuguggaguugcauauccaaaccuuagugaguuuugaagcu

SEQ ID NO: 161659 - RNA, 64 nt, Human
gcaaaaccaagcgcgagaugcagcuagcacccuucauauccauccccguucucagcgggacaac

SEQ ID NO: 161660 - RNA, 64 nt, Human; identical to SEQ ID NO: 84862

SEQ ID NO: 161661 - RNA, 64 nt, Human
agagacuauagcuauuuaguaaaguaaguaaaggcauauccauuguguaaauuaauaguuuaaa

SEQ ID NO: 161662 - RNA, 64 nt, Human
aauuagaaugaaccuaugcacauuuuuauguacacauauccaguuauauaauugcuuccuaguu

SEQ ID NO: 161663 - RNA, 64 nt, Human
gguaacugcuaccugaugaagagcauaauuucugcauauccauccucaauaccaugguaaauuc

SEQ ID NO: 161664 - RNA, 64 nt, Human
aguggcuagagggcaucuaagggcuccagcauggcauauccaugcccacggugcuguguccaug

SEQ ID NO: 161665 - RNA, 64 nt, Human
gugucucagggucuucaguuuuucuauaaguuuccauauccaaaguucagaauucaugugaaau

SEQ ID NO: 161666 - RNA, 64 nt, Human
aaaaauugaucauuugcaaagucaaaacuauagccauauccaaaucuuuucccccucccaagag

SEQ ID NO: 161667 - RNA, 64 nt, Human
aaggguuuagagacuccccuuggcucccagucaccauauccaguguuguguaaagagacuggcc

SEQ ID NO: 161668 - RNA, 64 nt, Human
acaauccugggcauugacucugugacauuucuagcauauccaaggcaccaccagugauuucucc

SEQ ID NO: 161669 - RNA, 64 nt, Human
guugccuuuuguaauaacuuuuuuuuuguaaauacauauccauugaugccauauuuaucguuug

SEQ ID NO: 161670 - RNA, 64 nt, Human
ggaucugaugucuugucugccccgcccagcuuugcauauccauguucuaccacaggaagguggc

SEQ ID NO: 161671 - RNA, 64 nt, Human
auguaauccaguaguguguaauauaaauucaaaccauauccacacacaacaacuaauuguauga

SEQ ID NO: 161672 - RNA, 64 nt, Human
uuuuuuacaagccccagcuccucuucuugccccgcauauccagcuccucacucagcuccugccu

SEQ ID NO: 161673 - RNA, 64 nt, Human
uugaguggaaacuugaugccauucuaaaucaaggcauauccagguggcccgguugaacucacuc

SEQ ID NO: 161674 - RNA, 64 nt, Human
gggaggaagaccuggacugagcucgugugccauccauauccaucuuucacaucaaugucugucc

SEQ ID NO: 161675 - RNA, 64 nt, Human
augcuuaugaccuuucugucaaguauuagauucacauauccaaauggcagcuacugcuucaccu

SEQ ID NO: 161676 - RNA, 64 nt, Human
uaaaaauauacauguuuauguaaacaaaucuuuccauauccauagugacuuuucaaguauuuaa

SEQ ID NO: 161677 - RNA, 64 nt, Human; identical to SEQ ID NO: 84865

SEQ ID NO: 161678 - RNA, 64 nt, Human
cagaaauaggaggagguuuugaagaauaaagccucauauccaggaaaaagugaucaagugaaaa

SEQ ID NO: 161679 - RNA, 64 nt, Human
cccucagauuuuaguaguuugacaagcaagaacacauauccaaauggaauuuuacccugagaaa

SEQ ID NO: 161680 - RNA, 64 nt, Human
ggacguguguugucauuauuuguaguaguaacuacauauccaauacagcuguauguuucuuuuu

SEQ ID NO: 161681 - RNA, 64 nt, Human
ugccuugcaucguuucccucgucaugcauuuccacauauccacaaacacagaacgacuuuagac

SEQ ID NO: 161682 - RNA, 64 nt, Human
aaaaaaaaacuauucugacuagagucagguuucucauauccaucgugauaggaaggccuaagaa

SEQ ID NO: 161683 - RNA, 64 nt, Human
cggcuggcagccuucucugcccugagggucgaaggucgagcaggccggggguguccgggagguc

SEQ ID NO: 161684 - RNA, 64 nt, Human
uccccagccaggaugagggaauuagacaauggaagucgagcacuggggaaagcaggcauucugc

SEQ ID NO: 161685 - RNA, 64 nt, Human
uguccugcugcccucccacagccuccuucuguuugucgagcauuucuucuacucuugagagcuc

SEQ ID NO: 161686 - RNA, 64 nt, Human
uuauuuuuuauuccuuccuuucuacccccaaccagucgagcaaaugagcaauuuuguguuucua

SEQ ID NO: 161687 - RNA, 64 nt, Human
cuagccuugcaacaacguccuacugagagguauugucgagcauuugacauaagacagcgugaug

SEQ ID NO: 161688 - RNA, 64 nt, Human
aguccccaguagucacuuuaggaguugggacagagucgagcacccugugaaagucucccuugag

SEQ ID NO: 161689 - RNA, 64 nt, Human
gggagcgggcacaguccccucugccccugccucagucgagcacucacugugucuuugucaagug

SEQ ID NO: 161690 - RNA, 64 nt, Human
uagucccugagugugguugagguuugagguccuggucgagcagggcaguacuggaccaggucua

SEQ ID NO: 161691 - RNA, 64 nt, Human
uaucuugauuuaaaauugauagagaaaagaaacugucgagcaaguuauauaacaacuaacaaca

SEQ ID NO: 161692 - RNA, 64 nt, Human
gugauuuauuauauacagugggcguucaagucuagucgagcaagcucaggagaauguaauuaaa

SEQ ID NO: 161693 - RNA, 64 nt, Human
gucauguucccagccaagaguaugagaacauccagucgagcagaggagauucauggccugugcu

SEQ ID NO: 161694 - RNA, 64 nt, Human
agcuuaucuucccuaugaaucuccagaucugugagucgagcagauuucauguugcagauucacc

SEQ ID NO: 161695 - RNA, 64 nt, Human
uuguuuuguuuuguuuuuuaaauaauaacuaauugucgagcacugauagagaugcagauuuugg

SEQ ID NO: 161696 - RNA, 64 nt, Human
uuuacaaaacagagauuccuucaacacuggacacgucgagcauuuuguagcuuaauuaaaccuc

SEQ ID NO: 161697 - RNA, 64 nt, Human
cuggaacugccgaggacucuguuuggcggggccagucgagcagccuguguggaaagacaggagu

SEQ ID NO: 161698 - RNA, 64 nt, Human
guagcugacaggggcuugcugucguuuugagcaugucgagcaguuuacuguggcuuccuuguau

SEQ ID NO: 161699 - RNA, 64 nt, Human
cacugccaccaccagaaagcuguucgacgagacggucgagcagggugcugugggugauauggac

SEQ ID NO: 161700 - RNA, 64 nt, Human
auaaaaaucauuccuuccuugugauccaaagcuggucgagcagcuuuccuggaggaaaagguua

SEQ ID NO: 161701 - RNA, 64 nt, Human
cacuuacaaguggugaccaaaauuuuuaggugaagucgagcacucuaauuagagaacuggagga

SEQ ID NO: 161702 - RNA, 64 nt, Human
ucuacucgaaacaagauggaagccuaaagcccaagucgagcagcucccagcacugcugugcaga

SEQ ID NO: 161703 - RNA, 64 nt, Human
caggagaggcugagaccagcccacccagccaguggucgagcacugccccgccgccaaagucugc

SEQ ID NO: 161704 - RNA, 64 nt, Human
ggguuggagcccgauuuuauuuguaaaguugacagucgagcaaauguuccuauuuucgugggau

SEQ ID NO: 161705 - RNA, 64 nt, Human
ggauagaugugcuauagggcaaagaacuuugagggucgagcagcaggggcccauucagucccag

SEQ ID NO: 161706 - RNA, 64 nt, Human
gauuggccugaggcugcacuaaaauucacuuagggucgagcauccuguuugcugauaaauauua

SEQ ID NO: 161707 - RNA, 64 nt, Human
agcaagaagcgagaauucugagauccuccagaaagucgagcagcacccaccuccaaccucgggc

SEQ ID NO: 161708 - RNA, 64 nt, Human; identical to SEQ ID NO: 68052

SEQ ID NO: 161709 - RNA, 64 nt, Human; identical to SEQ ID NO: 68053

SEQ ID NO: 161710 - RNA, 64 nt, Human; identical to SEQ ID NO: 68054

SEQ ID NO: 161711 - RNA, 64 nt, Human; identical to SEQ ID NO: 68055

SEQ ID NO: 161712 - RNA, 64 nt, Human; identical to SEQ ID NO: 68056

SEQ ID NO: 161713 - RNA, 64 nt, Human; identical to SEQ ID NO: 68057

SEQ ID NO: 161714 - RNA, 64 nt, Human; identical to SEQ ID NO: 68058

SEQ ID NO: 161715 - RNA, 64 nt, Human; identical to SEQ ID NO: 68059

SEQ ID NO: 161716 - RNA, 64 nt, Human; identical to SEQ ID NO: 68060

SEQ ID NO: 161717 - RNA, 64 nt, Human; identical to SEQ ID NO: 68061

SEQ ID NO: 161718 - RNA, 64 nt, Human; identical to SEQ ID NO: 68062

SEQ ID NO: 161719 - RNA, 64 nt, Human; identical to SEQ ID NO: 68063

SEQ ID NO: 161720 - RNA, 64 nt, Human; identical to SEQ ID NO: 68064

SEQ ID NO: 161721 - RNA, 64 nt, Human; identical to SEQ ID NO: 68065

SEQ ID NO: 161722 - RNA, 64 nt, Human; identical to SEQ ID NO: 68066

SEQ ID NO: 161723 - RNA, 55 nt, Human; identical to SEQ ID NO: 68067

SEQ ID NO: 161724 - RNA, 64 nt, Human; identical to SEQ ID NO: 68068

SEQ ID NO: 161725 - RNA, 64 nt, Human; identical to SEQ ID NO: 68069

SEQ ID NO: 161726 - RNA, 64 nt, Human; identical to SEQ ID NO: 68070

SEQ ID NO: 161727 - RNA, 64 nt, Human; identical to SEQ ID NO: 68071

SEQ ID NO: 161728 - RNA, 64 nt, Human; identical to SEQ ID NO: 68072

SEQ ID NO: 161729 - RNA, 64 nt, Human; identical to SEQ ID NO: 68073

SEQ ID NO: 161730 - RNA, 64 nt, Human; identical to SEQ ID NO: 68074

SEQ ID NO: 161731 - RNA, 64 nt, Human; identical to SEQ ID NO: 68075

SEQ ID NO: 161732 - RNA, 64 nt, Human; identical to SEQ ID NO: 68076

SEQ ID NO: 161733 - RNA, 64 nt, Human; identical to SEQ ID NO: 68077

SEQ ID NO: 161734 - RNA, 64 nt, Human; identical to SEQ ID NO: 68078

SEQ ID NO: 161735 - RNA, 64 nt, Human; identical to SEQ ID NO: 68079

SEQ ID NO: 161736 - RNA, 64 nt, Human; identical to SEQ ID NO: 68080

SEQ ID NO: 161737 - RNA, 64 nt, Human; identical to SEQ ID NO: 68081

SEQ ID NO: 161738 - RNA, 64 nt, Human; identical to SEQ ID NO: 68082

SEQ ID NO: 161739 - RNA, 64 nt, Human; identical to SEQ ID NO: 68083

SEQ ID NO: 161740 - RNA, 64 nt, Human; identical to SEQ ID NO: 68084

SEQ ID NO: 161741 - RNA, 64 nt, Human; identical to SEQ ID NO: 68085

SEQ ID NO: 161742 - RNA, 64 nt, Human; identical to SEQ ID NO: 68086

SEQ ID NO: 161743 - RNA, 64 nt, Human; identical to SEQ ID NO: 84868

SEQ ID NO: 161744 - RNA, 64 nt, Human; identical to SEQ ID NO: 68087

SEQ ID NO: 161745 - RNA, 64 nt, Human; identical to SEQ ID NO: 68088

SEQ ID NO: 161746 - RNA, 64 nt, Human; identical to SEQ ID NO: 68089

SEQ ID NO: 161747 - RNA, 64 nt, Human; identical to SEQ ID NO: 68090

SEQ ID NO: 161748 - RNA, 64 nt, Human; identical to SEQ ID NO: 68091

SEQ ID NO: 161749 - RNA, 64 nt, Human; identical to SEQ ID NO: 68092

SEQ ID NO: 161750 - RNA, 64 nt, Human; identical to SEQ ID NO: 68093

SEQ ID NO: 161751 - RNA, 64 nt, Human; identical to SEQ ID NO: 68094

SEQ ID NO: 161752 - RNA, 64 nt, Human; identical to SEQ ID NO: 68095

SEQ ID NO: 161753 - RNA, 64 nt, Human; identical to SEQ ID NO: 68096

SEQ ID NO: 161754 - RNA, 64 nt, Human; identical to SEQ ID NO: 68097

SEQ ID NO: 161755 - RNA, 64 nt, Human; identical to SEQ ID NO: 68098

SEQ ID NO: 161756 - RNA, 64 nt, Human; identical to SEQ ID NO: 68099

SEQ ID NO: 161757 - RNA, 64 nt, Human; identical to SEQ ID NO: 68100

SEQ ID NO: 161758 - RNA, 64 nt, Human; identical to SEQ ID NO: 68101

SEQ ID NO: 161759 - RNA, 64 nt, Human; identical to SEQ ID NO: 68102

SEQ ID NO: 161760 - RNA, 64 nt, Human; identical to SEQ ID NO: 68103

SEQ ID NO: 161761 - RNA, 64 nt, Human; identical to SEQ ID NO: 68104

SEQ ID NO: 161762 - RNA, 64 nt, Human; identical to SEQ ID NO: 84871

SEQ ID NO: 161763 - RNA, 64 nt, Human; identical to SEQ ID NO: 68105

SEQ ID NO: 161764 - RNA, 64 nt, Human; identical to SEQ ID NO: 68106

SEQ ID NO: 161765 - RNA, 64 nt, Human; identical to SEQ ID NO: 68107

SEQ ID NO: 161766 - RNA, 64 nt, Human; identical to SEQ ID NO: 68108

SEQ ID NO: 161767 - RNA, 64 nt, Human; identical to SEQ ID NO: 68109

SEQ ID NO: 161768 - RNA, 64 nt, Human; identical to SEQ ID NO: 68110

SEQ ID NO: 161769 - RNA, 64 nt, Human; identical to SEQ ID NO: 68111

SEQ ID NO: 161770 - RNA, 64 nt, Human; identical to SEQ ID NO: 68112

SEQ ID NO: 161771 - RNA, 64 nt, Human; identical to SEQ ID NO: 68113

SEQ ID NO: 161772 - RNA, 64 nt, Human; identical to SEQ ID NO: 68114

SEQ ID NO: 161773 - RNA, 64 nt, Human; identical to SEQ ID NO: 68115

SEQ ID NO: 161774 - RNA, 64 nt, Human; identical to SEQ ID NO: 68116

SEQ ID NO: 161775 - RNA, 64 nt, Human; identical to SEQ ID NO: 68117

SEQ ID NO: 161776 - RNA, 64 nt, Human; identical to SEQ ID NO: 68118

SEQ ID NO: 161777 - RNA, 64 nt, Human; identical to SEQ ID NO: 68119

SEQ ID NO: 161778 - RNA, 57 nt, Human; identical to SEQ ID NO: 68120

SEQ ID NO: 161779 - RNA, 64 nt, Human; identical to SEQ ID NO: 68121

SEQ ID NO: 161780 - RNA, 64 nt, Human; identical to SEQ ID NO: 68122

SEQ ID NO: 161781 - RNA, 64 nt, Human; identical to SEQ ID NO: 84874

SEQ ID NO: 161782 - RNA, 64 nt, Human; identical to SEQ ID NO: 68123

SEQ ID NO: 161783 - RNA, 64 nt, Human; identical to SEQ ID NO: 68124

SEQ ID NO: 161784 - RNA, 64 nt, Human; identical to SEQ ID NO: 68125

SEQ ID NO: 161785 - RNA, 64 nt, Human; identical to SEQ ID NO: 68126

SEQ ID NO: 161786 - RNA, 63 nt, Human; identical to SEQ ID NO: 68127

SEQ ID NO: 161787 - RNA, 64 nt, Human; identical to SEQ ID NO: 68128

SEQ ID NO: 161788 - RNA, 64 nt, Human; identical to SEQ ID NO: 68129

SEQ ID NO: 161789 - RNA, 64 nt, Human; identical to SEQ ID NO: 68130

SEQ ID NO: 161790 - RNA, 64 nt, Human; identical to SEQ ID NO: 68131

SEQ ID NO: 161791 - RNA, 64 nt, Human; identical to SEQ ID NO: 68132

SEQ ID NO: 161792 - RNA, 64 nt, Human; identical to SEQ ID NO: 68133

SEQ ID NO: 161793 - RNA, 64 nt, Human; identical to SEQ ID NO: 68134

SEQ ID NO: 161794 - RNA, 64 nt, Human; identical to SEQ ID NO: 68135

SEQ ID NO: 161795 - RNA, 64 nt, Human; identical to SEQ ID NO: 68136

SEQ ID NO: 161796 - RNA, 64 nt, Human; identical to SEQ ID NO: 68137

SEQ ID NO: 161797 - RNA, 64 nt, Human; identical to SEQ ID NO: 68138

SEQ ID NO: 161798 - RNA, 64 nt, Human; identical to SEQ ID NO: 68139

SEQ ID NO: 161799 - RNA, 64 nt, Human; identical to SEQ ID NO: 68140

SEQ ID NO: 161800 - RNA, 64 nt, Human; identical to SEQ ID NO: 68141

SEQ ID NO: 161801 - RNA, 64 nt, Human; identical to SEQ ID NO: 68142

SEQ ID NO: 161802 - RNA, 64 nt, Human; identical to SEQ ID NO: 68143

SEQ ID NO: 161803 - RNA, 64 nt, Human; identical to SEQ ID NO: 68144

SEQ ID NO: 161804 - RNA, 64 nt, Human; identical to SEQ ID NO: 68145

SEQ ID NO: 161805 - RNA, 64 nt, Human; identical to SEQ ID NO: 68146

SEQ ID NO: 161806 - RNA, 64 nt, Human; identical to SEQ ID NO: 68147

SEQ ID NO: 161807 - RNA, 64 nt, Human; identical to SEQ ID NO: 68148

SEQ ID NO: 161808 - RNA, 64 nt, Human; identical to SEQ ID NO: 68149

SEQ ID NO: 161809 - RNA, 64 nt, Human; identical to SEQ ID NO: 68150

SEQ ID NO: 161810 - RNA, 64 nt, Human; identical to SEQ ID NO: 68151

SEQ ID NO: 161811 - RNA, 64 nt, Human; identical to SEQ ID NO: 68152

SEQ ID NO: 161812 - RNA, 64 nt, Human; identical to SEQ ID NO: 68153

SEQ ID NO: 161813 - RNA, 64 nt, Human; identical to SEQ ID NO: 68154

SEQ ID NO: 161814 - RNA, 51 nt, Human; identical to SEQ ID NO: 68155

SEQ ID NO: 161815 - RNA, 64 nt, Human; identical to SEQ ID NO: 68156

SEQ ID NO: 161816 - RNA, 64 nt, Human; identical to SEQ ID NO: 68157

SEQ ID NO: 161817 - RNA, 64 nt, Human; identical to SEQ ID NO: 68158

SEQ ID NO: 161818 - RNA, 64 nt, Human; identical to SEQ ID NO: 68159

SEQ ID NO: 161819 - RNA, 64 nt, Human; identical to SEQ ID NO: 68160

SEQ ID NO: 161820 - RNA, 64 nt, Human; identical to SEQ ID NO: 68161

SEQ ID NO: 161821 - RNA, 64 nt, Human; identical to SEQ ID NO: 68162

SEQ ID NO: 161822 - RNA, 64 nt, Human; identical to SEQ ID NO: 68163

SEQ ID NO: 161823 - RNA, 64 nt, Human; identical to SEQ ID NO: 68164

SEQ ID NO: 161824 - RNA, 64 nt, Human; identical to SEQ ID NO: 68165

SEQ ID NO: 161825 - RNA, 64 nt, Human; identical to SEQ ID NO: 68166

SEQ ID NO: 161826 - RNA, 64 nt, Human; identical to SEQ ID NO: 68167

SEQ ID NO: 161827 - RNA, 64 nt, Human; identical to SEQ ID NO: 68168

SEQ ID NO: 161828 - RNA, 64 nt, Human; identical to SEQ ID NO: 68169

SEQ ID NO: 161829 - RNA, 64 nt, Human; identical to SEQ ID NO: 68170

SEQ ID NO: 161830 - RNA, 64 nt, Human; identical to SEQ ID NO: 68171

SEQ ID NO: 161831 - RNA, 64 nt, Human; identical to SEQ ID NO: 68172

SEQ ID NO: 161832 - RNA, 64 nt, Human; identical to SEQ ID NO: 68173

SEQ ID NO: 161833 - RNA, 64 nt, Human; identical to SEQ ID NO: 68174

SEQ ID NO: 161834 - RNA, 64 nt, Human; identical to SEQ ID NO: 68175

SEQ ID NO: 161835 - RNA, 64 nt, Human; identical to SEQ ID NO: 68176

SEQ ID NO: 161836 - RNA, 64 nt, Human; identical to SEQ ID NO: 68177

SEQ ID NO: 161837 - RNA, 64 nt, Human; identical to SEQ ID NO: 68178

SEQ ID NO: 161838 - RNA, 64 nt, Human; identical to SEQ ID NO: 84877

SEQ ID NO: 161839 - RNA, 64 nt, Human; identical to SEQ ID NO: 68179

SEQ ID NO: 161840 - RNA, 64 nt, Human; identical to SEQ ID NO: 68180

SEQ ID NO: 161841 - RNA, 64 nt, Human; identical to SEQ ID NO: 68181

SEQ ID NO: 161842 - RNA, 64 nt, Human; identical to SEQ ID NO: 68182

SEQ ID NO: 161843 - RNA, 64 nt, Human; identical to SEQ ID NO: 68183

SEQ ID NO: 161844 - RNA, 64 nt, Human; identical to SEQ ID NO: 68184

SEQ ID NO: 161845 - RNA, 64 nt, Human; identical to SEQ ID NO: 68185

SEQ ID NO: 161846 - RNA, 64 nt, Human; identical to SEQ ID NO: 68186

SEQ ID NO: 161847 - RNA, 64 nt, Human; identical to SEQ ID NO: 68187

SEQ ID NO: 161848 - RNA, 64 nt, Human; identical to SEQ ID NO: 68188

SEQ ID NO: 161849 - RNA, 64 nt, Human; identical to SEQ ID NO: 68189

SEQ ID NO: 161850 - RNA, 64 nt, Human; identical to SEQ ID NO: 68190

SEQ ID NO: 161851 - RNA, 64 nt, Human; identical to SEQ ID NO: 68191

SEQ ID NO: 161852 - RNA, 64 nt, Human; identical to SEQ ID NO: 68192

SEQ ID NO: 161853 - RNA, 64 nt, Human; identical to SEQ ID NO: 68193

SEQ ID NO: 161854 - RNA, 64 nt, Human; identical to SEQ ID NO: 68194

SEQ ID NO: 161855 - RNA, 64 nt, Human; identical to SEQ ID NO: 68195

SEQ ID NO: 161856 - RNA, 64 nt, Human; identical to SEQ ID NO: 68196

SEQ ID NO: 161857 - RNA, 64 nt, Human; identical to SEQ ID NO: 84878

SEQ ID NO: 161858 - RNA, 64 nt, Human; identical to SEQ ID NO: 68197

SEQ ID NO: 161859 - RNA, 64 nt, Human; identical to SEQ ID NO: 68198

SEQ ID NO: 161860 - RNA, 64 nt, Human; identical to SEQ ID NO: 68199

SEQ ID NO: 161861 - RNA, 64 nt, Human; identical to SEQ ID NO: 68200

SEQ ID NO: 161862 - RNA, 64 nt, Human; identical to SEQ ID NO: 68201

SEQ ID NO: 161863 - RNA, 64 nt, Human; identical to SEQ ID NO: 68202

SEQ ID NO: 161864 - RNA, 64 nt, Human; identical to SEQ ID NO: 68203

SEQ ID NO: 161865 - RNA, 64 nt, Human; identical to SEQ ID NO: 68204

SEQ ID NO: 161866 - RNA, 64 nt, Human; identical to SEQ ID NO: 68205

SEQ ID NO: 161867 - RNA, 64 nt, Human; identical to SEQ ID NO: 68206

SEQ ID NO: 161868 - RNA, 64 nt, Human; identical to SEQ ID NO: 68207

SEQ ID NO: 161869 - RNA, 64 nt, Human; identical to SEQ ID NO: 68208

SEQ ID NO: 161870 - RNA, 64 nt, Human; identical to SEQ ID NO: 68209

SEQ ID NO: 161871 - RNA, 64 nt, Human; identical to SEQ ID NO: 68210

SEQ ID NO: 161872 - RNA, 64 nt, Human; identical to SEQ ID NO: 68211

SEQ ID NO: 161873 - RNA, 64 nt, Human; identical to SEQ ID NO: 68212

SEQ ID NO: 161874 - RNA, 64 nt, Human; identical to SEQ ID NO: 68213

SEQ ID NO: 161875 - RNA, 64 nt, Human; identical to SEQ ID NO: 68214

SEQ ID NO: 161876 - RNA, 64 nt, Human; identical to SEQ ID NO: 68215

SEQ ID NO: 161877 - RNA, 64 nt, Human; identical to SEQ ID NO: 68216

SEQ ID NO: 161878 - RNA, 64 nt, Human; identical to SEQ ID NO: 68217

SEQ ID NO: 161879 - RNA, 64 nt, Human; identical to SEQ ID NO: 68218

SEQ ID NO: 161880 - RNA, 64 nt, Human; identical to SEQ ID NO: 68219

SEQ ID NO: 161881 - RNA, 64 nt, Human; identical to SEQ ID NO: 68220

SEQ ID NO: 161882 - RNA, 64 nt, Human; identical to SEQ ID NO: 68221

SEQ ID NO: 161883 - RNA, 64 nt, Human; identical to SEQ ID NO: 68222

SEQ ID NO: 161884 - RNA, 64 nt, Human; identical to SEQ ID NO: 68223

SEQ ID NO: 161885 - RNA, 64 nt, Human; identical to SEQ ID NO: 68224

SEQ ID NO: 161886 - RNA, 64 nt, Human; identical to SEQ ID NO: 68225

SEQ ID NO: 161887 - RNA, 64 nt, Human; identical to SEQ ID NO: 68226

SEQ ID NO: 161888 - RNA, 64 nt, Human; identical to SEQ ID NO: 68227

SEQ ID NO: 161889 - RNA, 64 nt, Human; identical to SEQ ID NO: 68228

SEQ ID NO: 161890 - RNA, 64 nt, Human; identical to SEQ ID NO: 68229

SEQ ID NO: 161891 - RNA, 64 nt, Human; identical to SEQ ID NO: 68230

SEQ ID NO: 161892 - RNA, 64 nt, Human; identical to SEQ ID NO: 68231

SEQ ID NO: 161893 - RNA, 64 nt, Human; identical to SEQ ID NO: 68232

SEQ ID NO: 161894 - RNA, 64 nt, Human; identical to SEQ ID NO: 68233

SEQ ID NO: 161895 - RNA, 64 nt, Human; identical to SEQ ID NO: 84879

SEQ ID NO: 161896 - RNA, 64 nt, Human; identical to SEQ ID NO: 68234

SEQ ID NO: 161897 - RNA, 64 nt, Human; identical to SEQ ID NO: 68235

SEQ ID NO: 161898 - RNA, 64 nt, Human; identical to SEQ ID NO: 68236

SEQ ID NO: 161899 - RNA, 64 nt, Human; identical to SEQ ID NO: 68237

SEQ ID NO: 161900 - RNA, 64 nt, Human; identical to SEQ ID NO: 68238

SEQ ID NO: 161901 - RNA, 64 nt, Human; identical to SEQ ID NO: 68239

SEQ ID NO: 161902 - RNA, 64 nt, Human; identical to SEQ ID NO: 68240

SEQ ID NO: 161903 - RNA, 64 nt, Human; identical to SEQ ID NO: 68241

SEQ ID NO: 161904 - RNA, 64 nt, Human; identical to SEQ ID NO: 68242

SEQ ID NO: 161905 - RNA, 64 nt, Human; identical to SEQ ID NO: 68243

SEQ ID NO: 161906 - RNA, 64 nt, Human; identical to SEQ ID NO: 68244

SEQ ID NO: 161907 - RNA, 64 nt, Human; identical to SEQ ID NO: 68245

SEQ ID NO: 161908 - RNA, 64 nt, Human; identical to SEQ ID NO: 68246

SEQ ID NO: 161909 - RNA, 64 nt, Human; identical to SEQ ID NO: 68247

SEQ ID NO: 161910 - RNA, 64 nt, Human; identical to SEQ ID NO: 68248

SEQ ID NO: 161911 - RNA, 64 nt, Human; identical to SEQ ID NO: 68249

SEQ ID NO: 161912 - RNA, 64 nt, Human; identical to SEQ ID NO: 68250

SEQ ID NO: 161913 - RNA, 64 nt, Human; identical to SEQ ID NO: 68251

SEQ ID NO: 161914 - RNA, 64 nt, Human; identical to SEQ ID NO: 84880

SEQ ID NO: 161915 - RNA, 64 nt, Human; identical to SEQ ID NO: 68252

SEQ ID NO: 161916 - RNA, 64 nt, Human; identical to SEQ ID NO: 68253

SEQ ID NO: 161917 - RNA, 64 nt, Human; identical to SEQ ID NO: 68254

SEQ ID NO: 161918 - RNA, 64 nt, Human; identical to SEQ ID NO: 68255

SEQ ID NO: 161919 - RNA, 64 nt, Human; identical to SEQ ID NO: 68256

SEQ ID NO: 161920 - RNA, 64 nt, Human; identical to SEQ ID NO: 68257

SEQ ID NO: 161921 - RNA, 64 nt, Human; identical to SEQ ID NO: 68258

SEQ ID NO: 161922 - RNA, 64 nt, Human; identical to SEQ ID NO: 68259

SEQ ID NO: 161923 - RNA, 64 nt, Human; identical to SEQ ID NO: 68260

SEQ ID NO: 161924 - RNA, 64 nt, Human; identical to SEQ ID NO: 68261

SEQ ID NO: 161925 - RNA, 64 nt, Human; identical to SEQ ID NO: 68262

SEQ ID NO: 161926 - RNA, 64 nt, Human; identical to SEQ ID NO: 68263

SEQ ID NO: 161927 - RNA, 64 nt, Human; identical to SEQ ID NO: 68264

SEQ ID NO: 161928 - RNA, 64 nt, Human; identical to SEQ ID NO: 68265

SEQ ID NO: 161929 - RNA, 64 nt, Human; identical to SEQ ID NO: 68266

SEQ ID NO: 161930 - RNA, 64 nt, Human; identical to SEQ ID NO: 68267

SEQ ID NO: 161931 - RNA, 64 nt, Human; identical to SEQ ID NO: 68268

SEQ ID NO: 161932 - RNA, 64 nt, Human; identical to SEQ ID NO: 68269

SEQ ID NO: 161933 - RNA, 63 nt, Human
ccgcaaguucagggaagcaggcagagcggggaggugccugagcuggggccuggagaggggccu

SEQ ID NO: 161934 - RNA, 64 nt, Human; identical to SEQ ID NO: 68270

SEQ ID NO: 161935 - RNA, 64 nt, Human; identical to SEQ ID NO: 68271

SEQ ID NO: 161936 - RNA, 64 nt, Human; identical to SEQ ID NO: 68272

SEQ ID NO: 161937 - RNA, 64 nt, Human; identical to SEQ ID NO: 68273

SEQ ID NO: 161938 - RNA, 64 nt, Human; identical to SEQ ID NO: 68274

SEQ ID NO: 161939 - RNA, 64 nt, Human; identical to SEQ ID NO: 68275

SEQ ID NO: 161940 - RNA, 64 nt, Human; identical to SEQ ID NO: 68276

SEQ ID NO: 161941 - RNA, 64 nt, Human; identical to SEQ ID NO: 68277

SEQ ID NO: 161942 - RNA, 64 nt, Human; identical to SEQ ID NO: 68278

SEQ ID NO: 161943 - RNA, 64 nt, Human; identical to SEQ ID NO: 68279

SEQ ID NO: 161944 - RNA, 64 nt, Human; identical to SEQ ID NO: 68280

SEQ ID NO: 161945 - RNA, 64 nt, Human; identical to SEQ ID NO: 68281

SEQ ID NO: 161946 - RNA, 64 nt, Human; identical to SEQ ID NO: 68282

SEQ ID NO: 161947 - RNA, 64 nt, Human; identical to SEQ ID NO: 68283

SEQ ID NO: 161948 - RNA, 64 nt, Human; identical to SEQ ID NO: 68284

SEQ ID NO: 161949 - RNA, 64 nt, Human; identical to SEQ ID NO: 68285

SEQ ID NO: 161950 - RNA, 64 nt, Human; identical to SEQ ID NO: 68286

SEQ ID NO: 161951 - RNA, 64 nt, Human; identical to SEQ ID NO: 68287

SEQ ID NO: 161952 - RNA, 63 nt, Human
cccgcuccucaccuacucccucauccuaccaaggugccugaaaauguucaagacuuauguuca

SEQ ID NO: 161953 - RNA, 64 nt, Human; identical to SEQ ID NO: 68288

SEQ ID NO: 161954 - RNA, 64 nt, Human; identical to SEQ ID NO: 68289

SEQ ID NO: 161955 - RNA, 64 nt, Human; identical to SEQ ID NO: 68290

SEQ ID NO: 161956 - RNA, 64 nt, Human; identical to SEQ ID NO: 68291

SEQ ID NO: 161957 - RNA, 64 nt, Human; identical to SEQ ID NO: 68292

SEQ ID NO: 161958 - RNA, 64 nt, Human; identical to SEQ ID NO: 68293

SEQ ID NO: 161959 - RNA, 64 nt, Human; identical to SEQ ID NO: 68294

SEQ ID NO: 161960 - RNA, 64 nt, Human; identical to SEQ ID NO: 68295

SEQ ID NO: 161961 - RNA, 64 nt, Human; identical to SEQ ID NO: 68296

SEQ ID NO: 161962 - RNA, 64 nt, Human; identical to SEQ ID NO: 68297

SEQ ID NO: 161963 - RNA, 64 nt, Human; identical to SEQ ID NO: 68298

SEQ ID NO: 161964 - RNA, 64 nt, Human; identical to SEQ ID NO: 68299

SEQ ID NO: 161965 - RNA, 64 nt, Human; identical to SEQ ID NO: 68300

SEQ ID NO: 161966 - RNA, 64 nt, Human; identical to SEQ ID NO: 68301

SEQ ID NO: 161967 - RNA, 64 nt, Human; identical to SEQ ID NO: 68302

SEQ ID NO: 161968 - RNA, 64 nt, Human; identical to SEQ ID NO: 68303

SEQ ID NO: 161969 - RNA, 64 nt, Human; identical to SEQ ID NO: 68304

SEQ ID NO: 161970 - RNA, 64 nt, Human; identical to SEQ ID NO: 68305

SEQ ID NO: 161971 - RNA, 63 nt, Human
aacaauggcuaucauguacugggguuauucucugugccugacacuuuaccuguaguauuucua

SEQ ID NO: 161972 - RNA, 64 nt, Human; identical to SEQ ID NO: 68306

SEQ ID NO: 161973 - RNA, 64 nt, Human; identical to SEQ ID NO: 68307

SEQ ID NO: 161974 - RNA, 64 nt, Human; identical to SEQ ID NO: 68308

SEQ ID NO: 161975 - RNA, 64 nt, Human; identical to SEQ ID NO: 68309

SEQ ID NO: 161976 - RNA, 64 nt, Human; identical to SEQ ID NO: 68310

SEQ ID NO: 161977 - RNA, 64 nt, Human; identical to SEQ ID NO: 68311

SEQ ID NO: 161978 - RNA, 64 nt, Human; identical to SEQ ID NO: 68312

SEQ ID NO: 161979 - RNA, 64 nt, Human; identical to SEQ ID NO: 68313

SEQ ID NO: 161980 - RNA, 64 nt, Human; identical to SEQ ID NO: 68314

SEQ ID NO: 161981 - RNA, 64 nt, Human; identical to SEQ ID NO: 68315

SEQ ID NO: 161982 - RNA, 64 nt, Human; identical to SEQ ID NO: 68316

SEQ ID NO: 161983 - RNA, 64 nt, Human; identical to SEQ ID NO: 68317

SEQ ID NO: 161984 - RNA, 64 nt, Human; identical to SEQ ID NO: 68318

SEQ ID NO: 161985 - RNA, 64 nt, Human; identical to SEQ ID NO: 68319

SEQ ID NO: 161986 - RNA, 64 nt, Human; identical to SEQ ID NO: 68320

SEQ ID NO: 161987 - RNA, 64 nt, Human; identical to SEQ ID NO: 68321

SEQ ID NO: 161988 - RNA, 64 nt, Human; identical to SEQ ID NO: 68322

SEQ ID NO: 161989 - RNA, 64 nt, Human; identical to SEQ ID NO: 68323

SEQ ID NO: 161990 - RNA, 63 nt, Human
cuacagaccauaugcagacuaaauacaacacuugugccugauucugaaugguaucuuauauca

SEQ ID NO: 161991 - RNA, 64 nt, Human; identical to SEQ ID NO: 68324

SEQ ID NO: 161992 - RNA, 64 nt, Human; identical to SEQ ID NO: 68325

SEQ ID NO: 161993 - RNA, 64 nt, Human; identical to SEQ ID NO: 68326

SEQ ID NO: 161994 - RNA, 64 nt, Human; identical to SEQ ID NO: 68327

SEQ ID NO: 161995 - RNA, 64 nt, Human; identical to SEQ ID NO: 68328

SEQ ID NO: 161996 - RNA, 64 nt, Human; identical to SEQ ID NO: 68329

SEQ ID NO: 161997 - RNA, 64 nt, Human; identical to SEQ ID NO: 68330

SEQ ID NO: 161998 - RNA, 64 nt, Human; identical to SEQ ID NO: 68331

SEQ ID NO: 161999 - RNA, 64 nt, Human; identical to SEQ ID NO: 68332

SEQ ID NO: 162000 - RNA, 64 nt, Human; identical to SEQ ID NO: 68333

SEQ ID NO: 162001 - RNA, 64 nt, Human; identical to SEQ ID NO: 68334

SEQ ID NO: 162002 - RNA, 64 nt, Human; identical to SEQ ID NO: 68335

SEQ ID NO: 162003 - RNA, 64 nt, Human; identical to SEQ ID NO: 68336

SEQ ID NO: 162004 - RNA, 64 nt, Human; identical to SEQ ID NO: 68337

SEQ ID NO: 162005 - RNA, 64 nt, Human; identical to SEQ ID NO: 68338

SEQ ID NO: 162006 - RNA, 64 nt, Human; identical to SEQ ID NO: 68339

SEQ ID NO: 162007 - RNA, 64 nt, Human; identical to SEQ ID NO: 68340

SEQ ID NO: 162008 - RNA, 64 nt, Human; identical to SEQ ID NO: 68341

SEQ ID NO: 162009 - RNA, 63 nt, Human
uccaggcucagcagcgugcugauggaaguggaagugccugaagucuuacaggacucacuggau

SEQ ID NO: 162010 - RNA, 64 nt, Human; identical to SEQ ID NO: 68342

SEQ ID NO: 162011 - RNA, 64 nt, Human; identical to SEQ ID NO: 68343

SEQ ID NO: 162012 - RNA, 64 nt, Human; identical to SEQ ID NO: 68344

SEQ ID NO: 162013 - RNA, 64 nt, Human; identical to SEQ ID NO: 68345

SEQ ID NO: 162014 - RNA, 64 nt, Human; identical to SEQ ID NO: 68346

SEQ ID NO: 162015 - RNA, 64 nt, Human; identical to SEQ ID NO: 68347

SEQ ID NO: 162016 - RNA, 64 nt, Human; identical to SEQ ID NO: 68348

SEQ ID NO: 162017 - RNA, 64 nt, Human; identical to SEQ ID NO: 68349

SEQ ID NO: 162018 - RNA, 64 nt, Human; identical to SEQ ID NO: 68350

SEQ ID NO: 162019 - RNA, 64 nt, Human; identical to SEQ ID NO: 68351

SEQ ID NO: 162020 - RNA, 64 nt, Human; identical to SEQ ID NO: 68352

SEQ ID NO: 162021 - RNA, 64 nt, Human; identical to SEQ ID NO: 68353

SEQ ID NO: 162022 - RNA, 64 nt, Human; identical to SEQ ID NO: 68354

SEQ ID NO: 162023 - RNA, 64 nt, Human; identical to SEQ ID NO: 68355

SEQ ID NO: 162024 - RNA, 64 nt, Human; identical to SEQ ID NO: 68356

SEQ ID NO: 162025 - RNA, 64 nt, Human; identical to SEQ ID NO: 68357

SEQ ID NO: 162026 - RNA, 64 nt, Human; identical to SEQ ID NO: 68358

SEQ ID NO: 162027 - RNA, 64 nt, Human; identical to SEQ ID NO: 68359

SEQ ID NO: 162028 - RNA, 63 nt, Human
acauaggaacaagggggaaagucucuuacugaagugccugaaacccaaagcuagagcuucuag

SEQ ID NO: 162029 - RNA, 64 nt, Human; identical to SEQ ID NO: 68360

SEQ ID NO: 162030 - RNA, 64 nt, Human; identical to SEQ ID NO: 68361

SEQ ID NO: 162031 - RNA, 64 nt, Human; identical to SEQ ID NO: 68362

SEQ ID NO: 162032 - RNA, 64 nt, Human; identical to SEQ ID NO: 68363

SEQ ID NO: 162033 - RNA, 64 nt, Human; identical to SEQ ID NO: 68364

SEQ ID NO: 162034 - RNA, 64 nt, Human; identical to SEQ ID NO: 68365

SEQ ID NO: 162035 - RNA, 64 nt, Human; identical to SEQ ID NO: 68366

SEQ ID NO: 162036 - RNA, 64 nt, Human; identical to SEQ ID NO: 68367

SEQ ID NO: 162037 - RNA, 64 nt, Human; identical to SEQ ID NO: 68368

SEQ ID NO: 162038 - RNA, 64 nt, Human; identical to SEQ ID NO: 68369

SEQ ID NO: 162039 - RNA, 64 nt, Human; identical to SEQ ID NO: 68370

SEQ ID NO: 162040 - RNA, 64 nt, Human; identical to SEQ ID NO: 68371

SEQ ID NO: 162041 - RNA, 64 nt, Human; identical to SEQ ID NO: 68372

SEQ ID NO: 162042 - RNA, 64 nt, Human; identical to SEQ ID NO: 68373

SEQ ID NO: 162043 - RNA, 64 nt, Human; identical to SEQ ID NO: 68374

SEQ ID NO: 162044 - RNA, 64 nt, Human; identical to SEQ ID NO: 68375

SEQ ID NO: 162045 - RNA, 64 nt, Human; identical to SEQ ID NO: 68376

SEQ ID NO: 162046 - RNA, 64 nt, Human; identical to SEQ ID NO: 68377

SEQ ID NO: 162047 - RNA, 64 nt, Human; identical to SEQ ID NO: 84858

SEQ ID NO: 162048 - RNA, 64 nt, Human; identical to SEQ ID NO: 68378

SEQ ID NO: 162049 - RNA, 64 nt, Human; identical to SEQ ID NO: 68379

SEQ ID NO: 162050 - RNA, 64 nt, Human; identical to SEQ ID NO: 68380

SEQ ID NO: 162051 - RNA, 64 nt, Human; identical to SEQ ID NO: 68381

SEQ ID NO: 162052 - RNA, 64 nt, Human; identical to SEQ ID NO: 68382

SEQ ID NO: 162053 - RNA, 64 nt, Human; identical to SEQ ID NO: 68383

SEQ ID NO: 162054 - RNA, 64 nt, Human; identical to SEQ ID NO: 68384

SEQ ID NO: 162055 - RNA, 64 nt, Human; identical to SEQ ID NO: 68385

SEQ ID NO: 162056 - RNA, 64 nt, Human; identical to SEQ ID NO: 68386

SEQ ID NO: 162057 - RNA, 64 nt, Human; identical to SEQ ID NO: 68387

SEQ ID NO: 162058 - RNA, 64 nt, Human; identical to SEQ ID NO: 68388

SEQ ID NO: 162059 - RNA, 64 nt, Human; identical to SEQ ID NO: 68389

SEQ ID NO: 162060 - RNA, 64 nt, Human; identical to SEQ ID NO: 68390

SEQ ID NO: 162061 - RNA, 64 nt, Human; identical to SEQ ID NO: 68391

SEQ ID NO: 162062 - RNA, 64 nt, Human; identical to SEQ ID NO: 68392

SEQ ID NO: 162063 - RNA, 64 nt, Human; identical to SEQ ID NO: 68393

SEQ ID NO: 162064 - RNA, 64 nt, Human; identical to SEQ ID NO: 68394

SEQ ID NO: 162065 - RNA, 64 nt, Human; identical to SEQ ID NO: 68395

SEQ ID NO: 162066 - RNA, 64 nt, Human; identical to SEQ ID NO: 84860

SEQ ID NO: 162067 - RNA, 64 nt, Human; identical to SEQ ID NO: 68396

SEQ ID NO: 162068 - RNA, 64 nt, Human; identical to SEQ ID NO: 68397

SEQ ID NO: 162069 - RNA, 64 nt, Human; identical to SEQ ID NO: 68398

SEQ ID NO: 162070 - RNA, 64 nt, Human; identical to SEQ ID NO: 68399

SEQ ID NO: 162071 - RNA, 64 nt, Human; identical to SEQ ID NO: 68400

SEQ ID NO: 162072 - RNA, 64 nt, Human; identical to SEQ ID NO: 68401

SEQ ID NO: 162073 - RNA, 64 nt, Human; identical to SEQ ID NO: 68402

SEQ ID NO: 162074 - RNA, 64 nt, Human; identical to SEQ ID NO: 68403

SEQ ID NO: 162075 - RNA, 61 nt, Human; identical to SEQ ID NO: 68404

SEQ ID NO: 162076 - RNA, 64 nt, Human; identical to SEQ ID NO: 68405

SEQ ID NO: 162077 - RNA, 64 nt, Human; identical to SEQ ID NO: 68406

SEQ ID NO: 162078 - RNA, 64 nt, Human; identical to SEQ ID NO: 68407

SEQ ID NO: 162079 - RNA, 64 nt, Human; identical to SEQ ID NO: 68408

SEQ ID NO: 162080 - RNA, 64 nt, Human; identical to SEQ ID NO: 68409

SEQ ID NO: 162081 - RNA, 64 nt, Human; identical to SEQ ID NO: 68410

SEQ ID NO: 162082 - RNA, 64 nt, Human; identical to SEQ ID NO: 68411

SEQ ID NO: 162083 - RNA, 64 nt, Human; identical to SEQ ID NO: 68412

SEQ ID NO: 162084 - RNA, 64 nt, Human; identical to SEQ ID NO: 68413

SEQ ID NO: 162085 - RNA, 64 nt, Human; identical to SEQ ID NO: 84861

SEQ ID NO: 162086 - RNA, 64 nt, Human; identical to SEQ ID NO: 68414

SEQ ID NO: 162087 - RNA, 64 nt, Human; identical to SEQ ID NO: 68415

SEQ ID NO: 162088 - RNA, 64 nt, Human; identical to SEQ ID NO: 68416

SEQ ID NO: 162089 - RNA, 64 nt, Human; identical to SEQ ID NO: 68417

SEQ ID NO: 162090 - RNA, 64 nt, Human; identical to SEQ ID NO: 68418

SEQ ID NO: 162091 - RNA, 64 nt, Human; identical to SEQ ID NO: 68419

SEQ ID NO: 162092 - RNA, 64 nt, Human; identical to SEQ ID NO: 68420

SEQ ID NO: 162093 - RNA, 52 nt, Human; identical to SEQ ID NO: 68421

SEQ ID NO: 162094 - RNA, 64 nt, Human; identical to SEQ ID NO: 68422

SEQ ID NO: 162095 - RNA, 64 nt, Human; identical to SEQ ID NO: 68423

SEQ ID NO: 162096 - RNA, 64 nt, Human; identical to SEQ ID NO: 68424

SEQ ID NO: 162097 - RNA, 64 nt, Human; identical to SEQ ID NO: 68425

SEQ ID NO: 162098 - RNA, 64 nt, Human; identical to SEQ ID NO: 68426

SEQ ID NO: 162099 - RNA, 64 nt, Human; identical to SEQ ID NO: 68427

SEQ ID NO: 162100 - RNA, 64 nt, Human; identical to SEQ ID NO: 68428

SEQ ID NO: 162101 - RNA, 64 nt, Human; identical to SEQ ID NO: 68429

SEQ ID NO: 162102 - RNA, 64 nt, Human; identical to SEQ ID NO: 68430

SEQ ID NO: 162103 - RNA, 64 nt, Human; identical to SEQ ID NO: 68431

SEQ ID NO: 162104 - RNA, 64 nt, Human; identical to SEQ ID NO: 68432

SEQ ID NO: 162105 - RNA, 64 nt, Human; identical to SEQ ID NO: 68433

SEQ ID NO: 162106 - RNA, 64 nt, Human; identical to SEQ ID NO: 68434

SEQ ID NO: 162107 - RNA, 64 nt, Human; identical to SEQ ID NO: 68435

SEQ ID NO: 162108 - RNA, 64 nt, Human; identical to SEQ ID NO: 68436

SEQ ID NO: 162109 - RNA, 64 nt, Human; identical to SEQ ID NO: 68437

SEQ ID NO: 162110 - RNA, 64 nt, Human; identical to SEQ ID NO: 68438

SEQ ID NO: 162111 - RNA, 64 nt, Human; identical to SEQ ID NO: 68439

SEQ ID NO: 162112 - RNA, 64 nt, Human; identical to SEQ ID NO: 68440

SEQ ID NO: 162113 - RNA, 64 nt, Human; identical to SEQ ID NO: 68441

SEQ ID NO: 162114 - RNA, 64 nt, Human; identical to SEQ ID NO: 68442

SEQ ID NO: 162115 - RNA, 64 nt, Human; identical to SEQ ID NO: 68443

SEQ ID NO: 162116 - RNA, 64 nt, Human; identical to SEQ ID NO: 68444

SEQ ID NO: 162117 - RNA, 64 nt, Human; identical to SEQ ID NO: 68445

SEQ ID NO: 162118 - RNA, 64 nt, Human; identical to SEQ ID NO: 68446

SEQ ID NO: 162119 - RNA, 64 nt, Human; identical to SEQ ID NO: 68447

SEQ ID NO: 162120 - RNA, 64 nt, Human; identical to SEQ ID NO: 68448

SEQ ID NO: 162121 - RNA, 64 nt, Human; identical to SEQ ID NO: 68449

SEQ ID NO: 162122 - RNA, 64 nt, Human; identical to SEQ ID NO: 68450

SEQ ID NO: 162123 - RNA, 63 nt, Human
auuuauugcuuauaaagugaagagauuggaguagugccugaaauugcauccagcuuuagaacg

SEQ ID NO: 162124 - RNA, 64 nt, Human; identical to SEQ ID NO: 68451

SEQ ID NO: 162125 - RNA, 64 nt, Human; identical to SEQ ID NO: 68452

SEQ ID NO: 162126 - RNA, 64 nt, Human; identical to SEQ ID NO: 68453

SEQ ID NO: 162127 - RNA, 64 nt, Human; identical to SEQ ID NO: 68454

SEQ ID NO: 162128 - RNA, 64 nt, Human; identical to SEQ ID NO: 68455

SEQ ID NO: 162129 - RNA, 64 nt, Human; identical to SEQ ID NO: 68456

SEQ ID NO: 162130 - RNA, 64 nt, Human; identical to SEQ ID NO: 68457

SEQ ID NO: 162131 - RNA, 64 nt, Human; identical to SEQ ID NO: 68458

SEQ ID NO: 162132 - RNA, 64 nt, Human; identical to SEQ ID NO: 68459

SEQ ID NO: 162133 - RNA, 63 nt, Human
cccucagccucccaaguagcugggauuacaggcacccacgagcaugcccggcuaauuuuuugu

SEQ ID NO: 162134 - RNA, 63 nt, Human
cuaaaaaggggaggaaggcagaccuccugggagacccacgaaggguuuuuagccagggaaaac

SEQ ID NO: 162135 - RNA, 63 nt, Human
agaaagcacuuugaaauuuauuacuagcuugcuacccacgaugaaaucaacaaccuguaucug

SEQ ID NO: 162136 - RNA, 63 nt, Human
aaucacauacauacauuuaaaaaaaaaacaacaacccacgaggagucugaggcugugaauagu

SEQ ID NO: 162137 - RNA, 63 nt, Human
gucaccuccaaugacuagggugggcaaccacaaacccacgagggcagagugcugcuugcugcu

SEQ ID NO: 162138 - RNA, 63 nt, Human
uauuuuugaauaauuaccaagcagccgaagaccacccacgaaugguuaucuuacgacuguuac

SEQ ID NO: 162139 - RNA, 63 nt, Human
ggguaugaagaugcuucagagcucaugcgcguuacccacgauggcaugacuagcacagagcug

SEQ ID NO: 162140 - RNA, 63 nt, Human
aggccaagguucaauuauuucagcgcagguaucacccacgagaaauuuuuccagaguuucaca

SEQ ID NO: 162141 - RNA, 63 nt, Human
uaucauugucagaccauuuuugcugcuguggucacccacgauuucauuugucuuauacccagg

SEQ ID NO: 162142 - RNA, 63 nt, Human
aauggugaggcgaggggcuugagaggaacgcccacccacgaaggcccagggcgccagacggcc

SEQ ID NO: 162143 - RNA, 63 nt, Human
auuaguguggguauggcuaaugaguucugauucacccacgaagguuacauuuaugcugaauac

SEQ ID NO: 162144 - RNA, 63 nt, Human
gcaugggugcccccagaaguaagcagcucuuggacccacgagcagggcugcgucgguuugugg

SEQ ID NO: 162145 - RNA, 63 nt, Human
uggaguucuucaugucugucaagccuugaggacacccacgaauggcaaaucuccacgcuagac

SEQ ID NO: 162146 - RNA, 63 nt, Human
uaaucagaucaaacaccugcuccuuauugccauacccacgaacuguuaaauauaaaaaaauuc

SEQ ID NO: 162147 - RNA, 63 nt, Human
ugacugaaacauucacacagggcucuuugauggacccacgaacgcucuuagcuuucucagggg

SEQ ID NO: 162148 - RNA, 63 nt, Human
uuuuucuggcauuuucuguuccagguuucuuccacccacgagcacuuuauucuccuccgagac

SEQ ID NO: 162149 - RNA, 63 nt, Human
guuacauuccucuccacaaugaggcuaaaugucacccacgaaagaacuuuauucccuuauauu

SEQ ID NO: 162150 - RNA, 63 nt, Human
gggacaugggaagaccacgggaccucuuucacuacccacgaugaccuccggggguauccuggg

SEQ ID NO: 162151 - RNA, 63 nt, Human
cccccgugauucaauuaccucccacuuggucccacccacgacacgugggaauugugggagcua

SEQ ID NO: 162152 - RNA, 63 nt, Human
ugcccacggccuccuccuguagcuccugccugcacccacgaugcugcacgggcccgcccuggu

SEQ ID NO: 162153 - RNA, 63 nt, Human
caggcuuggggagcuuuaagccucaguuauauaacccacgaaaaacagagccuccuagaugua

SEQ ID NO: 162154 - RNA, 58 nt, Human
ugaggucauuuguacccuaggcccacgaacccacgagaauguccucugacuuccagcc

SEQ ID NO: 162155 - RNA, 63 nt, Human
ugaaacguguaucguaaaauguauuuuuauuuuacccacgagaauguuguuauuuuuagcaaa

SEQ ID NO: 162156 - RNA, 63 nt, Human
uggcucccccagcucaccguggugcuguccuugacccacgagcuguugagaagggugcagagc

SEQ ID NO: 162157 - RNA, 63 nt, Human
ccagugcuuccuucgucagcagcgccuccccagacccacgaggauacucacacugcacgccug

SEQ ID NO: 162158 - RNA, 63 nt, Human
agggaaagggagggaugaccuucccagggagaaacccacgaccuguccugucuuugaucgccu

SEQ ID NO: 162159 - RNA, 63 nt, Human
ggcccauugccccuggcacuccuugcagaggccacccacgaucuucuuugggcuuccauuucc

SEQ ID NO: 162160 - RNA, 63 nt, Human
guucuccagaaucccaggcgaugacaagucugaacccacgaaaauacccagcgcagcaucuac

SEQ ID NO: 162161 - RNA, 63 nt, Human
ggaccccccucgaagcccccuggacugauucccacccacgacucacaggcauuccucccacag

SEQ ID NO: 162162 - RNA, 63 nt, Human
gacugauucccaggaagaaaagcccaaagggaaacccacgauuccuuucgaguagauguggga

SEQ ID NO: 162163 - RNA, 63 nt, Human
aguggcuuccaauuuuuggccaugaggaagagaacccacgaacauuccuggacuugucuuuug

SEQ ID NO: 162164 - RNA, 63 nt, Human
uggcccugccugagcccgggccggccucgggccacccacgagggccucccggccuagggcccg

SEQ ID NO: 162165 - RNA, 63 nt, Human
ggcugccagcccugaggccaagcacggcuggagacccacgaccuggccugccguugcccugag

SEQ ID NO: 162166 - RNA, 63 nt, Human
uagguucccggucccgaguacagucuguaucaaacccacgauuuucuccagcucagaacccag

SEQ ID NO: 162167 - RNA, 63 nt, Human
gaauauaaggggguagugggaaaagugguacuaacccacgauucugagcccugaguaugccug

SEQ ID NO: 162168 - RNA, 63 nt, Human
cgccuucgggacgccggggacucugcggcggcgacccacgagcucgcggcccgcgcccggcuc

SEQ ID NO: 162169 - RNA, 63 nt, Human
caucuguuucucguguccgccugguugaggaggacccacgagugcugccgagguguggagggc

SEQ ID NO: 162170 - RNA, 63 nt, Human
cauguguccagagaucuuggaaaauauuuuuucacccacgauuuauuuuguuauugaugauuu

SEQ ID NO: 162171 - RNA, 63 nt, Human
ggaggugcccuaccugcauccugcugcacccccacccacgacacucgagugcaagaucgccuc

SEQ ID NO: 162172 - RNA, 63 nt, Human
uuugaguacuaccggggcuucacacucuuccagacccacgaaaaccgagagcaccuggugaug

SEQ ID NO: 162173 - RNA, 63 nt, Human
cucuacaccuucugccaccaccugcaccugccuacccacgacaaggagacagaggagcuggua

SEQ ID NO: 162174 - RNA, 63 nt, Human
guuguuucuguuucugaguggaccaacagcagaacccacgaggauuuguuuugaguauggagc

SEQ ID NO: 162175 - RNA, 63 nt, Human
aaagcaggacgcagagaagaacaaaugaggcucacccacgaggcuggguggccagcagucugg

SEQ ID NO: 162176 - RNA, 63 nt, Human
cccugaaagacugaagaaaguguagugcaugggacccacgaaacugcccuggcuccagugaaa

SEQ ID NO: 162177 - RNA, 63 nt, Human
aggacacaguggagcccacgagcacgagcuggaacccacgaggauggccuggaacccauguca

SEQ ID NO: 162178 - RNA, 63 nt, Human
ucccccccagcacaacccccccaaaacaacccaacccacgaggaccaucgggggcagagucgu

SEQ ID NO: 162179 - RNA, 63 nt, Human
cccacauccccucagaacgcugcgcccagccacacccacgaucaaguuacacagcuuuauugg

SEQ ID NO: 162180 - RNA, 63 nt, Human
agugccuuccaagcuucccccaagauccacaucacccacgacccugccacuguuuuugcugug

SEQ ID NO: 162181 - RNA, 54 nt, Human
ccagccagcaguccaaguagcuggacccacgaggaggaaccaggcuacuuuccc

SEQ ID NO: 162182 - RNA, 63 nt, Human
cuuggaacuuuaacuccugccagcccuucuaagacccacgagcggggugagagaagugugcaa

SEQ ID NO: 162183 - RNA, 63 nt, Human
agguagggacacguguccacgcaccacagacacacccacgacaccugaucucguaucacuagc

SEQ ID NO: 162184 - RNA, 63 nt, Human
ccugccuccacgcccacccagcgucgacccuugacccacgaagugcguagcaugcaguauuua

SEQ ID NO: 162185 - RNA, 63 nt, Human
gcccggcccggaacuuuucuccccaacccccaaacccacgacucacuuccacaccgucuuccc

SEQ ID NO: 162186 - RNA, 63 nt, Human
ggaugccgcgagggacggacacacguccggggcacccacgaggagggcccccagccugggaga

SEQ ID NO: 162187 - RNA, 63 nt, Human
agucuguaguuaaugucaacaguuaauuuaugaacccacgaucguuccacacugcaccaaagu

SEQ ID NO: 162188 - RNA, 63 nt, Human
guguuauuauacaaaauaauuuuuaaucugcagacccacgaaaagggucucagggacuccucc

SEQ ID NO: 162189 - RNA, 64 nt, Human
gacuccugcucucuggaggacggucaguccaugucucggagaaacgggugagcugagcuuggcg

SEQ ID NO: 162190 - RNA, 64 nt, Human
gggccuugccuggagacugggcuagcucuguaggcucggagagccuggggagggugccaacccc

SEQ ID NO: 162191 - RNA, 64 nt, Human
gaggaggugagaggcuggggugccccaagcuucccucggagaagugagaggcucucccuggcua

SEQ ID NO: 162192 - RNA, 64 nt, Human
uggagaugguugcugccauugcugcugccucugccucggagaagcccacugccccuguuggcug

SEQ ID NO: 162193 - RNA, 64 nt, Human
auguuuugguguauugucagccaucguccugggacucggagacuauggccucgccuccccaccc

SEQ ID NO: 162194 - RNA, 64 nt, Human
agaagccccuccacguuugaaaaugcgccuccuccucggagacagacgcaucggugccaccuag

SEQ ID NO: 162195 - RNA, 64 nt, Human
ggcucugccucaacuuuccuaggaaagagcccaccucggagauagcuacgguuuucucuggugg

SEQ ID NO: 162196 - RNA, 64 nt, Human
cuguuuugaagcaugggccagacccggcacugcgcucggagagccggugggccuggccuccccg

SEQ ID NO: 162197 - RNA, 64 nt, Human
caugggguggggaaggcaggcaugggguguggcccucggagaaguuaggagucccccagcucaa

SEQ ID NO: 162198 - RNA, 64 nt, Human
ggcuggcugaggccugggaccacuuggccuucuccucggagagccugccugccugggcgggccc

SEQ ID NO: 162199 - RNA, 64 nt, Human
gucuuuuuggguccucagagaaaaugcccauuuucucggagaauucucugcacuccucucugcu

SEQ ID NO: 162200 - RNA, 64 nt, Human
ccuccuccccacccgagccuggagcacucuaacccucggagacccccuaagccccguuccuccg

SEQ ID NO: 162201 - RNA, 64 nt, Human
agcuuucaguauuaaucuccaaacaucacugcugcucggagaaaccacauccccaggcauaaca

SEQ ID NO: 162202 - RNA, 64 nt, Human
gcauaccaacacgagcaggcuacugucagcuccccucggagaagagcuguucacagccagacug

SEQ ID NO: 162203 - RNA, 64 nt, Human
ucuggcuguagacaacauucuuuauauugccaaccucggagauagucggguauguggcucugga

SEQ ID NO: 162204 - RNA, 64 nt, Human
aaggccacccuaaccucuguguucaggugaacagcucggagaagcugcagcugcaggagugcuu

SEQ ID NO: 162205 - RNA, 64 nt, Human
ggguuagagggacaggccuaaucaacugaaacuccucggagaugccaucucugucucccugggu

SEQ ID NO: 162206 - RNA, 64 nt, Human
ccuuagaagcacuccucgguacucccauaauccucucggagaaaaaaaucacaaggcaacugug

SEQ ID NO: 162207 - RNA, 64 nt, Human
cuggcggagaaggccugggcccucccacuggucccucggagaucugcuggggcuaugggaaucg

SEQ ID NO: 162208 - RNA, 64 nt, Human
gauguuggcugaaagcaugaacuugcagaacucccucggagacgcagguugcaguggacauugg

SEQ ID NO: 162209 - RNA, 64 nt, Human
ggcagccuaccugguguccccuaccccaccuguucucggagaaccaaguugcuacacaggaagu

SEQ ID NO: 162210 - RNA, 64 nt, Human
uaccugucccgaggggacccuguccggguccuugcucggagaguacggccugauggcucugugc

SEQ ID NO: 162211 - RNA, 64 nt, Human
auuucccuccugggagagaaggagaucagggcaacucggagagggcugcgagcauuucccuccc

SEQ ID NO: 162212 - RNA, 64 nt, Human
cucucucucucucuguguuuccuccagcccuugucucggagacgguguuuuccucccuugcccc

SEQ ID NO: 162213 - RNA, 64 nt, Human
ccccccuucgaccucuaaacagaucccuccucuucucggagaccucccuuuccaagccugccug

SEQ ID NO: 162214 - RNA, 64 nt, Human
aggggccgcacggagggcacagucuccugucaggcucggagaggucaggagaccgaccccacca

SEQ ID NO: 162215 - RNA, 64 nt, Human
cagagcugugugcuccauagcguguagcuuuagacucggagaugagugcuuugacccagcgagg

SEQ ID NO: 162216 - RNA, 64 nt, Human
uuucucuuccacuuuccugccacuccccacuacccucggagagagguggugggaugggagagag

SEQ ID NO: 162217 - RNA, 64 nt, Human
gggagcccgugguggcgguggcugccccggccuccucggagagcagcagcaccaaccacagcau

SEQ ID NO: 162218 - RNA, 64 nt, Human
ccuccacucucuggguuuccuaggaauguccagccucggagaccuucacaaagccuugggaggg

SEQ ID NO: 162219 - RNA, 64 nt, Human
uaaguauuaccauuuucagaugaggacacuaaaucucggagaacuuaagucauuuaccugaugg

SEQ ID NO: 162220 - RNA, 64 nt, Human
gguugcgggacagaguagccagguucugccggugcucggagaagagcgcaguguuuugcaagug

SEQ ID NO: 162221 - RNA, 64 nt, Human
cuccaucccaauccaguauaucaaucaacucuaacucggagacgucuagcuggcaauguuucua

SEQ ID NO: 162222 - RNA, 64 nt, Human
ggacacagcgcgguuuuuuccacgcagcacccuucucggagacccauugcgauggccgcuccgu

SEQ ID NO: 162223 - RNA, 64 nt, Human
ugugccucaggaucaccaggugcaggcccccacccucggagaugcugcugcagugagugguucc

SEQ ID NO: 162224 - RNA, 64 nt, Human
uagauccuuuuuuguucucugaggucauaauuuccucggagaccuguuuaacaagcaaaaauca

SEQ ID NO: 162225 - RNA, 64 nt, Human
agugcccagaccccauuccacagcucugggcuuccucggagaccccuggggauggggaucuuca

SEQ ID NO: 162226 - RNA, 64 nt, Human
agagagggucuucguugcucagucagucaaguuccucggagaucugccucugccucaccuaccc

SEQ ID NO: 162227 - RNA, 64 nt, Human
acuuguuaaaaauucagccucccaggucccuccccucggagaggcugauucacugggucuggga

SEQ ID NO: 162228 - RNA, 64 nt, Human
gaggacgcugcccuggcuucaggggcugugaaugcucggagagggucaacuggaccuccccucc

SEQ ID NO: 162229 - RNA, 64 nt, Human
cuuaaacugaugucuuuucugccaccuguuaccccucggagacuccguaaccaaacucuucgga

SEQ ID NO: 162230 - RNA, 64 nt, Human
acccucuuuggccauacacuccaugccuagaugccucggagagcaucauucucugccuaggcaa

SEQ ID NO: 162231 - RNA, 64 nt, Human
cgggcgugguggcgggcgccuguagucccagcuacucggagaggcugaggcaggagaauggcgu

SEQ ID NO: 162232 - RNA, 64 nt, Human
agaucgccuuccugcgcuccaugcugggaaagcucucggagaagaucgaccagcuagagaagag

SEQ ID NO: 162233 - RNA, 64 nt, Human
auugugcgagcucaauucacuuuguaagaaaacucucggagaaauaaaaucaauaaaaagcaaa

SEQ ID NO: 162234 - RNA, 64 nt, Human
caucaggguauuuguuccaccuuggccaggccuccucggagaagcuugucccccgugugggagg

SEQ ID NO: 162235 - RNA, 64 nt, Human
aagguuuuucaagaguugguuuugcguuuccaaccucggagaauuccaggcacuccccuucccc

SEQ ID NO: 162236 - RNA, 64 nt, Human
ccugccuccagccgcccgcgccagauuuugaaaucucggagacaaaacuaguacuguaagauaa

SEQ ID NO: 162237 - RNA, 64 nt, Human
cuuagucacugccucccgaaguugcuugaaagcacucggagaauugugcaggugucauuuaucu

SEQ ID NO: 162238 - RNA, 64 nt, Human
accaauuuccccuuuuccccuggcuaccaggaaacucggagacaaucuuuucagccucagcauu

SEQ ID NO: 162239 - RNA, 64 nt, Human
auacuugaaugucggggggccugggggugggggccucggagaccgucugccuggcccugcugcc

SEQ ID NO: 162240 - RNA, 64 nt, Human
ccaucucuguccccuccacccucacuccauccaccucggagaccacccucccccagccagauac

SEQ ID NO: 162241 - RNA, 64 nt, Human
gcgggucucccggugcccgaaccgccgcuggggccucggagacuuggaggaggacgcucuggaa

SEQ ID NO: 162242 - RNA, 64 nt, Human
gacagacccaccccagcccagggcccucacccaccucggagaggcguccccaccaucggaucca

SEQ ID NO: 162243 - RNA, 64 nt, Human
acucggguucuugggaggacacucauucuccaggcucggagacgaggggagaaguuugggguuu

SEQ ID NO: 162244 - RNA, 64 nt, Human
guugucgggggagaagacuuagacccuuuugggccucggagagguggcaugauuguggaucccc

SEQ ID NO: 162245 - RNA, 64 nt, Human
uccuuggugggcuggcccuggcuagcccuugggccucggagaugaucagaggugaagaaccgcc

SEQ ID NO: 162246 - RNA, 64 nt, Human
cccacagugugcucuggcugcugggagcccaucucucggagaaacccuguccacccaaccccga

SEQ ID NO: 162247 - RNA, 64 nt, Human
ggcggggccacugcucugugcugacgggcuccgucucggagauucuuguccuguuuuuuuucug

SEQ ID NO: 162248 - RNA, 64 nt, Human
ucugcaagggccucggcucagucgugugcacuuccucggagagccuugggcugccacguccacc

SEQ ID NO: 162249 - RNA, 64 nt, Human
gacaaaaaugcuaagugggaucaagagagcagcacucggagaggguguuugccagucugagugu

SEQ ID NO: 162250 - RNA, 64 nt, Human
ugcagccucagcccaucuggcagagucccaggaacucggagacuggcacagcugcuuugucugc

SEQ ID NO: 162251 - RNA, 64 nt, Human
uuuccuugucccaggauggagcugauccaguaaccucggagacgggacccugcccagagcugag

SEQ ID NO: 162252 - RNA, 64 nt, Human
agagcguguucugccugagacccccgugagggcucucggagaaaguguguguauuccuuucuua

SEQ ID NO: 162253 - RNA, 64 nt, Human
ugcuggcuaugcaagaggacgcggccccggggggcucggagaagcuuuacagagugccagggca

SEQ ID NO: 162254 - RNA, 64 nt, Human
cccaccuucucccacugaagcaccaaggggcuugaaccguaauuuggcuaaucagaggcauuuu

SEQ ID NO: 162255 - RNA, 64 nt, Human
agcuagauagucuugugucuuguuugaccaagguaaccguaauaaaagaguccauccccauccu

SEQ ID NO: 162256 - RNA, 64 nt, Human
cugugucacuguaugugaaaggaaaugcaccaacaaccguaaacugaacguguucuuuugugcu

SEQ ID NO: 162257 - RNA, 64 nt, Human
ucuuaaguauuguaagcugcuauguauggauuuaaaccguaaucauaucuuuuuccuaucuauc

SEQ ID NO: 162258 - RNA, 64 nt, Human
uuucagaguuguuaaggguuguuaagggagcaaaaaccguaaaaauccuuccuauaagaagaaa

SEQ ID NO: 162259 - RNA, 64 nt, Human
aagugugagcuuagacgucaacccuaaaauacuuaaccguaaugcuaauugugaucauuaugaa

SEQ ID NO: 162260 - RNA, 64 nt, Human
cccaaaacuaucauguugauuaaaaauaaaaaguaaccguaaccucacacauuaacuuuauuca

SEQ ID NO: 162261 - RNA, 64 nt, Human
cuguguuccaagcacaauauuacaacuucuuuugaaccguaaauaucagaaugaauccucuucc

SEQ ID NO: 162262 - RNA, 64 nt, Human
uuaagcuuaauucugcaaucauuugucuuuuauaaaccguaaagcucuauacaagggacacuau

SEQ ID NO: 162263 - RNA, 64 nt, Human
uucuuuccaacugaaggcaguaaccauuacuucuaaccguaacacaaacacagcaaguuuuaac

SEQ ID NO: 162264 - RNA, 64 nt, Human
cuucuggcaucuauacuuucuccaguaaaugaggaaccguaacucuuuggaacaaaccaaaaua

SEQ ID NO: 162265 - RNA, 64 nt, Human
uucaaauaucucuauuuaauuuugacacugaaauaaccguaaagguuuauuuuucuguuaccuc

SEQ ID NO: 162266 - RNA, 64 nt, Human
guauggagauguauacccucuauuacacacauaaaaccguaacaaaauucauugugguguauua

SEQ ID NO: 162267 - RNA, 64 nt, Human
ucaucgucuuagcauacauauccuacacugaguaaaccguaacgggaugucaucagcaugcugg

SEQ ID NO: 162268 - RNA, 64 nt, Human
cacauaauuugaauggugcagaaaaaaaaaaagaaaccguaauuuuauuauuagauucuccaaa

SEQ ID NO: 162269 - RNA, 64 nt, Human
aucaaugaaauuguuuacuacuguuuuaaaauaaaaccguaaacucuggcagcuugagcacuug

SEQ ID NO: 162270 - RNA, 64 nt, Human
uuuguuuuguuuuaagaaguagguuguuuuccugaaccguaaacuuguaucauuuuaacuugca

SEQ ID NO: 162271 - RNA, 64 nt, Human
cuguaccugagggccaaaacaggagcagguaacgaaccguaaaaaaaggagcagguaaugaauc

SEQ ID NO: 162272 - RNA, 64 nt, Human
cccagugcacuccggucccaaauguagcagguguaaccguaacccacccccaacccguuucccg

SEQ ID NO: 162273 - RNA, 64 nt, Human
auuuccuagugagcugccaggagccagauucgggaaccguaacugaugugccaggaauggugca

SEQ ID NO: 162274 - RNA, 64 nt, Human
aacauauuauuguuacaucuuucugaaaccuucaaaccguaaggaaguguuaacuggcaagcag

SEQ ID NO: 162275 - RNA, 56 nt, Human
cagacaccaauacugaaugaauacuuaaccguaaaacugaaagaggauucuaguuc

SEQ ID NO: 162276 - RNA, 64 nt, Human
uaaucuuugugauaacauuauugccauguucuacaaccguaagaugacaguuuucaauguagug

SEQ ID NO: 162277 - RNA, 64 nt, Human
ggacaaaacagacgaguuccaaauuacguucuuaaaccguaacuauauuuaauuauuuguuuug

SEQ ID NO: 162278 - RNA, 64 nt, Human
aauauauccuguguaccucacuguccaauaugaaaaccguaaagugccuuauaggaauuugcgu

SEQ ID NO: 162279 - RNA, 64 nt, Human
uacuaacugcauguguaaauacaucauacuggcaaaccguaaaauauaaauuauguaucaucau

SEQ ID NO: 162280 - RNA, 64 nt, Human
ggaugugcgcaaauucugguucuucccaagcucuaaccguaacacgucccacccccuuuuuaaa

SEQ ID NO: 162281 - RNA, 64 nt, Human
guucugcuagcauguaaagagugguggacuuuaaaaccguaagagguaucauuacaagucaccu

SEQ ID NO: 162282 - RNA, 64 nt, Human
uagugaugcuggcuguucggauaugccaaagagaaaccguaaggugcuuccuuuaagugaaaag

SEQ ID NO: 162283 - RNA, 64 nt, Human
aaucuacgaauacaguggaccugggagaguguucaaccguaaaaccuuguuguaaaugugagaa

SEQ ID NO: 162284 - RNA, 64 nt, Human
agcuuauagcaguucaauaaacuauacuucugggaaccguaauugaaacauuuacuuuugcuuu

SEQ ID NO: 162285 - RNA, 64 nt, Human
cuuuuuuauuaauauuuuccuuuguuaaaggaggaaccguaacucuccauagcuguacauauaa

SEQ ID NO: 162286 - RNA, 64 nt, Human
aacuaugaaauauggugacuagauuuuaauucauaaccguaaaguuuuuuaaaguuuuggguua

SEQ ID NO: 162287 - RNA, 64 nt, Human
augaauuuuuuuuuaauccaauauccguugauuugauugugauuagagaaccuuggacauuuug

SEQ ID NO: 162288 - RNA, 64 nt, Human
ugugaagagaauuaacaauaaaagugugaagagcgauugugaggaacaagccugggagugauca

SEQ ID NO: 162289 - RNA, 64 nt, Human
aaccagacuuucuacguacuacuccaaagacugugauugugacuauaauacauuuuugguaauu

SEQ ID NO: 162290 - RNA, 64 nt, Human
caguuugcaccauuagccuuaccugcccugcccugauugugagacccaaauguguaggcucuaa

SEQ ID NO: 162291 - RNA, 64 nt, Human
cauuaaaucucccucccuucuguaauuguuuuuggauugugaaauuagucuuauuuuuauauac

SEQ ID NO: 162292 - RNA, 64 nt, Human
aacuaacuguuuacauaucuguccccugcuacuagauugugagcuccuugagggaaaggaacau

SEQ ID NO: 162293 - RNA, 64 nt, Human
aagaagaauggaugaacuugauucguuuuccauugauugugauaucuaucauaccugcaaaaaa

SEQ ID NO: 162294 - RNA, 64 nt, Human
aucugucagauaggaaucuaaauauuuauagugagauugugaaagcaaccuuaaaguuuugaag

SEQ ID NO: 162295 - RNA, 64 nt, Human
uaaaauuauuguauagacaucugcuucuuaaacagauugugaguucuuugagaaacagcgugga

SEQ ID NO: 162296 - RNA, 64 nt, Human
gguguucccaguguggcucccagagcuuugaccagauugugaucccagcuggccccuauguugu

SEQ ID NO: 162297 - RNA, 64 nt, Human
cccagaagguuuaaucacuucaucccaaaaaugggauugugaaugucagcaaaccauaaaaaaa

SEQ ID NO: 162298 - RNA, 64 nt, Human
agaaaugauaauuugcuaaaguuuagugcuuugagauugugaaauuauuaaucauccucugugu

SEQ ID NO: 162299 - RNA, 64 nt, Human
cuuuugggggcgcuuaugaagaugcucugaaauugauugugaugguuguacaacucugaauaca

SEQ ID NO: 162300 - RNA, 64 nt, Human
ucauuuaagcaagagaaaaacagcucuaauucgagauugugaagcaacacuucuaaauucaaag

SEQ ID NO: 162301 - RNA, 64 nt, Human
uauaggaacaaauuuguacuuggggauugguaaagauugugaguaaaugacauuuuuugguuug

SEQ ID NO: 162302 - RNA, 64 nt, Human
ucuguuuuuuccccuuuaaaggaaacuuugaaaggauugugaauacuggaaaaugacaaaacua

SEQ ID NO: 162303 - RNA, 64 nt, Human
ugaggguggagugucccauccuuuuaaucaaggugauugugauuuugacuaauaaaaaagaauu

SEQ ID NO: 162304 - RNA, 64 nt, Human
uaugggauucagugcuucuuaaagaguucuuaaggauugugauauuuuuacuugcauugaauau

SEQ ID NO: 162305 - RNA, 64 nt, Human
uugaaguuagaauuaagugaauuaaacugaauuugauugugagugaaccuagaacagcacugaa

SEQ ID NO: 162306 - RNA, 64 nt, Human
ucuggcccuucccuuugucucagugggauagauggauugugaaauggaaucucccagaaccccu

SEQ ID NO: 162307 - RNA, 64 nt, Human
aguugcugaaguuuucugaauuaauaaugacuuagauugugaccuuuuagauucgguguugagc

SEQ ID NO: 162308 - RNA, 64 nt, Human
uagaauuugugcacuugcuuaguggauuguauuggauugugacuugauguacagcgcuaagacc

SEQ ID NO: 162309 - RNA, 64 nt, Human
aauagagggggugcuggagcgcgagaggcuggcugauugugaccgaaaccagaggguuguccac

SEQ ID NO: 162310 - RNA, 64 nt, Human
ggaacaccacccaagaacgucaccuccuccaucagauugugagcuccuggagggcaggagcugu

SEQ ID NO: 162311 - RNA, 64 nt, Human
cuuuuugucucagucccagugaagugccagguuugauugugaaguccgcaugaaacacugcacc

SEQ ID NO: 162312 - RNA, 64 nt, Human
gagucuuauaauuaaugguacuccuauaauuuuugauugugagcucaccuauuuggguuaagca

SEQ ID NO: 162313 - RNA, 64 nt, Human
aagccggaggcagcuuuaaccagcccccagggaugauugugaaggaggccccuccccuugugag

SEQ ID NO: 162314 - RNA, 64 nt, Human
guuuuuaugauuuuauagucaaaagaugauuauugauugugagauagguuagguuuuggggggc

SEQ ID NO: 162315 - RNA, 64 nt, Human
auuucuaguucagaguggauagaagaacuaaagagauugugaugggugcucuaggcagggaaaa

SEQ ID NO: 162316 - RNA, 64 nt, Human
cuguaggguauuuuuaauuuugucagaaauuuuagauugugaauauuuuguaaaaaacaguaag

SEQ ID NO: 162317 - RNA, 64 nt, Human
acccccucacucccauuuccuagcaaaaucagaagauugugaagaggccggcuucaacaaaaug

SEQ ID NO: 162318 - RNA, 64 nt, Human
gcuuguauuuuuaugagggaauucugcagcuagggauugugacuccuaaauccuccucuaaaag

SEQ ID NO: 162319 - RNA, 64 nt, Human
ggcuuucuaugguauaucccagucucuugcaaacgauugugaagaaugccaguguuguuuaaga

SEQ ID NO: 162320 - RNA, 64 nt, Human
ccuugaacaaucaaggcaacuaguggagagaacugauugugagcucugccucugggucagagag

SEQ ID NO: 162321 - RNA, 64 nt, Human
uggugaaauggcuggagugauucugaaucaaggugauugugauuauagugacaaugaagaugau

SEQ ID NO: 162322 - RNA, 64 nt, Human
cuuuugugaauuugaaguagcaccaacaagccuggauugugaagguauuaagaaucggucugug

SEQ ID NO: 162323 - RNA, 64 nt, Human
cucuccugacaacccccagaauuaaaugaaccaugauugugaagaguaauuugguacaaugaag

SEQ ID NO: 162324 - RNA, 64 nt, Human
auuugauaaagcaaauauaaaugagaaauaugaggauugugaauuauugaaauuugccagucuc

SEQ ID NO: 162325 - RNA, 64 nt, Human
uucuauuccuuucuuaaaccuaccagcaaacuaggauugugauagcaaugaaugguaugaugaa

SEQ ID NO: 162326 - RNA, 50 nt, Human
aaaaugagaacaacagcuaagauugugauuuuuuuguaaaagaagcugua

SEQ ID NO: 162327 - RNA, 64 nt, Human
ugaaucccaacaagaaaacaugauuaaaaaaggugauugugacaaaacuuauggaucagaauuu

SEQ ID NO: 162328 - RNA, 64 nt, Human
cuugguuaauuaaguaaccuaaaguaugcauuaggauugugaaaugucucgugaguaugccaau

SEQ ID NO: 162329 - RNA, 64 nt, Human
uuuaaauuacaacucuuguuauaacuuuuuaaaagauugugaaaauaucaaaauauaaaugaau

SEQ ID NO: 162330 - RNA, 64 nt, Human
cuucacccuugccccuuuauucucaaggucuuuugauugugaagcaaggcccgaggccuugacu

SEQ ID NO: 162331 - RNA, 64 nt, Human
aauauuuguugaaugcaugucagguaauggucuugauugugauagcuucaagguggaacauacu

SEQ ID NO: 162332 - RNA, 64 nt, Human
ugucuuuaggugguccugaaucuugggcccuuuugauugugaauacuguguagcaggaucuuga

SEQ ID NO: 162333 - RNA, 64 nt, Human
aaaauugguuugaguuuucaaguuuacuaauuuggauugugagaaaguaccaaguaccagccgu

SEQ ID NO: 162334 - RNA, 64 nt, Human
uugagcccaggaggucgaggcugcagugugcugugauugugacacugcccuccagccuggguga

SEQ ID NO: 162335 - RNA, 64 nt, Human
aaaaaaaaaaaaaaagaaaagaaaaagauaaagggauugugaaaagagcauuuauauuggacua

SEQ ID NO: 162336 - RNA, 64 nt, Human
auacauuugacucuuuaguucacagguucccauugauugugagcaagauauuuaucucuuuagc

SEQ ID NO: 162337 - RNA, 64 nt, Human
uugccugccaucaugaagacgugccuucugccaugauugugaaguucuagccacguggaacugu

SEQ ID NO: 162338 - RNA, 64 nt, Human
ucauuucuuaguaaauuaaaaccugcagcugguggauugugaucacacauucccgaaguaauaa

SEQ ID NO: 162339 - RNA, 64 nt, Human
aggugagacuacuucaguuuauuccagcaagaaagauugugaugcaagauuucuuucuuccuga

SEQ ID NO: 162340 - RNA, 64 nt, Human
cuuuacuaaaauuuaucaaauuauacuggguucggauugugaaaacauuggccaccuaguagca

SEQ ID NO: 162341 - RNA, 64 nt, Human
acuauuuaaaaaugagauuccuaggcccaccucagauugugauaaaucugugugacugacugau

SEQ ID NO: 162342 - RNA, 64 nt, Human
gucagggcuggaacuauuguauagaagauaauaugauugugacuucuaguucuuuucuagagga

SEQ ID NO: 162343 - RNA, 64 nt, Human
aguaaugcuaaugcauggcuaguugccuuuuuaagauugugacaccaggcuuaccuuuuaaagu

SEQ ID NO: 162344 - RNA, 64 nt, Human
acuggagagaaaauuaauuccuaucccgugaguggauugugagaaauuccacccacguggagac

SEQ ID NO: 162345 - RNA, 64 nt, Human
uucucagaccacuucuaccaaaacauaaaucugugauugugaucucugaaagucaguccuuuua

SEQ ID NO: 162346 - RNA, 64 nt, Human
uucugauacaagaaugcuugggugcauauggaaagauugugaaagagugugucuugcaucaaca

SEQ ID NO: 162347 - RNA, 64 nt, Human; identical to SEQ ID NO: 162345

SEQ ID NO: 162348 - RNA, 64 nt, Human
augauagugauuauucaauuagauuuuaaguaaggauugugauauuagaggcuggaaauccuua

SEQ ID NO: 162349 - RNA, 63 nt, Human
uggaugaagagaacauaugagcacaugaguuaagauugugacugaucaugauuuauuugaaga

SEQ ID NO: 162350 - RNA, 64 nt, Human
ucaagauucuggagagucuugaacacagaauaacgauugugaccauuaugaauguaacuaauuu

SEQ ID NO: 162351 - RNA, 64 nt, Human
acuauuccaugccuuggagaaugaaucauuuuuagauugugacauaaaucuuguaaaaaccugu

SEQ ID NO: 162352 - RNA, 64 nt, Human
gaacuuauucuccaucucaagaucugcuucuagugauugugagugccuugugggcagaauccuu

SEQ ID NO: 162353 - RNA, 64 nt, Human
caugccuucccugcuggaucauuauauacauucagauugugaguggauugccuugguugacuuu

SEQ ID NO: 162354 - RNA, 64 nt, Human
guggaauagauccuguuuuuccaucugugucccagauugugacccuagacuuucaauugacaag

SEQ ID NO: 162355 - RNA, 64 nt, Human
uggaccuaggggaugugugaccuguuuguugagugauugugaaagaggaaugugggagauuggg

SEQ ID NO: 162356 - RNA, 64 nt, Human
aacuacucugggacaauaugggaggaaaagugaagauugugaugguguaagagcuaaauccuca

SEQ ID NO: 162357 - RNA, 64 nt, Human
auuuaacccuguacuuggcaaugcucaggcagcugauugugaaauauucuuguccuuuacagaa

SEQ ID NO: 162358 - RNA, 64 nt, Human
ggugucuugggcugauaacaguguuguugauucugauugugaauccccucaacucuagcagaca

SEQ ID NO: 162359 - RNA, 64 nt, Human
caucugucaccaagccuuggggauucuuccaucugauugugaugugaguugcacagcuaugaag

SEQ ID NO: 162360 - RNA, 64 nt, Human
uuucagcacaacuuugacauaagcucuacauugcgauugugacaacauagcuuaugaaaucuuu

SEQ ID NO: 162361 - RNA, 64 nt, Human
gaaggcacgauaugcguguccauccuuaccaaaggauugugaccgcagaccgagguuaguuuag

SEQ ID NO: 162362 - RNA, 64 nt, Human
ccauguucucuaccauccuuuuccuucccaugcagauugugaaauguaaugagauguaucaaga

SEQ ID NO: 162363 - RNA, 64 nt, Human
aggggagaguucauggagagagcauguguucucugauugugaggucacugugaaugauuaaauu

SEQ ID NO: 162364 - RNA, 64 nt, Human
uggcccaggaccaucauccuacuguaauaaagaugauugugaaauaaaacuggcuuuggcuucu

SEQ ID NO: 162365 - RNA, 64 nt, Human
accauaaaugcagugugacuuuucccacacacuggauugugaggcucuuaacuucuuaaaagua

SEQ ID NO: 162366 - RNA, 64 nt, Human
aacauagaauugcugcuuuuauauuuuaacugcagauugugaauuucacugccuuauauuauuu

SEQ ID NO: 162367 - RNA, 64 nt, Human
agcaguuuuaccggauuuuguuagacuaaaauuugauugugauacauugaacaaaauggaacuc

SEQ ID NO: 162368 - RNA, 64 nt, Human
ucuuguuugcuggauugacuauaacuuaagugcugauugugauuuuaaaaugauaguaccguaa

SEQ ID NO: 162369 - RNA, 64 nt, Human
aguuguagaauccgauagaugacugauggcaaaagauugugaacauguggaagaaaaucagugg

SEQ ID NO: 162370 - RNA, 64 nt, Human
uaaucacaagaaaggaaagaauuacaguuggacugauugugacagugccuugucguccucuuug

SEQ ID NO: 162371 - RNA, 64 nt, Human
gcaacaagaaguccucaccagacagaaagccuuugauugugauguaugggaaaagaacuccagu

SEQ ID NO: 162372 - RNA, 64 nt, Human
aagcugauggcaggagacuguuucacacacaggagauugugagcuguguaaguagucaucgcca

SEQ ID NO: 162373 - RNA, 64 nt, Human
ucacucagcacuuuuucuccauauucuucaagacgauugugaguaugguacguaacaggaauua

SEQ ID NO: 162374 - RNA, 64 nt, Human
aaaugugaaaaaaaaaaagaaauuugauuuuagggauugugaguaaacaaguuuauauagagag

SEQ ID NO: 162375 - RNA, 64 nt, Human
uaacauucccuuaaacaugcuguggaauaaaauggauugugaugauuuggggagcugguguuuu

SEQ ID NO: 162376 - RNA, 64 nt, Human
auuaacauuuauccauaugccuuugcaauaacuagauugugaaaagcuaacaaguguuguaaca

SEQ ID NO: 162377 - RNA, 64 nt, Human
uaaauuaaaagaauaguuauuuuacaguuccagggauugugaaauaaauguugcaguuuuuuaa

SEQ ID NO: 162378 - RNA, 64 nt, Human
aauaaugucugauguuauucuuguauuuuucugugauugugagaacucccguuccugucccaca

SEQ ID NO: 162379 - RNA, 64 nt, Human
cuugccuuaaccuaucugccugagguuggccugagauugugagucaacgacuuugcuaucuuuu

SEQ ID NO: 162380 - RNA, 64 nt, Human
uauaaaugauuuugauuuggaggccuaauuuguagauugugaaagcagcuuuuaguuuaacuua

SEQ ID NO: 162381 - RNA, 64 nt, Human
uuaaggauguaagacauuacagccuuagaagaaagauugugaaaagcuggggagaaaaugcuua

SEQ ID NO: 162382 - RNA, 64 nt, Human
uuuugagaaccacuguccaggagcgugguuuucugauugugaucugagguucugccccaacugc

SEQ ID NO: 162383 - RNA, 64 nt, Human
aguuuuaagggcugccccugccaucccuauuggagauugugaauccugcugucugugcagggcu

SEQ ID NO: 162384 - RNA, 64 nt, Human
uuaagaauagaugguuuuuaauccuggaaauugugauugugacccaugaguggaggaacuuuca

SEQ ID NO: 162385 - RNA, 64 nt, Human
acugucucugacuguugucucuuuguggucaugugauugugagcuugcuuucugacuugcauuu

SEQ ID NO: 162386 - RNA, 64 nt, Human
uguaagcauuaaacaguguauguagguuucaagagauugugaugauucuuaaauuuuaacuacc

SEQ ID NO: 162387 - RNA, 64 nt, Human
gauguuagauggaaacuuauaucucaaaugauaggauugugaugcuuuuuuuguaacaagugau

SEQ ID NO: 162388 - RNA, 64 nt, Human
ugauauguaacaguuggugauuuuagauuucuuugauugugaaacagggagcuaugagagaugu

SEQ ID NO: 162389 - RNA, 64 nt, Human
uuauuugacagagcaaaagaacccucuucugguugauugugaccuugaauacaaaauaaaagua

SEQ ID NO: 162390 - RNA, 64 nt, Human
cugacuuuggugacaguccuaaagcacaguuggugauugugagaucuguuagcggcaggcugag

SEQ ID NO: 162391 - RNA, 64 nt, Human
caguacagggucugaguucugaauggagagcauggauugugaugaggaaacaaggcuggaagag

SEQ ID NO: 162392 - RNA, 64 nt, Human
caauuggagguaaauuaugucuuaguuauaauuagauugugaaucagccaacugaaaauccuuu

SEQ ID NO: 162393 - RNA, 64 nt, Human
auggacuguuucagguaaaagagaaugaauguaugauugugaacugugaagagaaugaugcagg

SEQ ID NO: 162394 - RNA, 64 nt, Human
cuuaaauguuauuauccugcuuugguuuuagagugauugugaggcauucaaugcaaguauacag

SEQ ID NO: 162395 - RNA, 64 nt, Human
ggagaaaaagcuuaaauuccaucuugagcucuuggauugugauaauacaaugauuucauuaacu

SEQ ID NO: 162396 - RNA, 64 nt, Human
ucgaaugccuuauagccuuccucacagcacccaggauugugacugacucugcauuuuuaauucu

SEQ ID NO: 162397 - RNA, 64 nt, Human
uuuuucaauuuucacuauuacuguuguaauuauugauugugauuaaaauauuugcucccaggag

SEQ ID NO: 162398 - RNA, 64 nt, Human
uugguacauuugguuaccucauuuugccguuucagauugugaaagcucacagggguguuuuuug

SEQ ID NO: 162399 - RNA, 64 nt, Human
cuggaaucaagcugccgacagcuuucuccauccagauugugacgguugcuaccuggauccauca

SEQ ID NO: 162400 - RNA, 64 nt, Human
gcacgaaguggcugaugggaaccauuucaagacagauugugaagauugauagaaaauccuucag

SEQ ID NO: 162401 - RNA, 64 nt, Human
uccagagguuguucuacuccauacaguucacacugauugugacacauucuuaguagcuaguguc

SEQ ID NO: 162402 - RNA, 64 nt, Human
aucaugaaauguuauaaguagacauacauuuugggauugugaucuuagagguuugugugugugu

SEQ ID NO: 162403 - RNA, 64 nt, Human
auguguuuucaaaauauuauuugguaaagcaacagauugugaugggaaaauguuuucuguaggu

SEQ ID NO: 162404 - RNA, 64 nt, Human
uaauauuucauaccuaaauuaagacucugacuuggauugugaauuauaaugauaugccccuuuu

SEQ ID NO: 162405 - RNA, 64 nt, Human
ggcugcugcuucccuugugcacuugggucgcugugauugugaauaaaagugauuucguaccagc

SEQ ID NO: 162406 - RNA, 64 nt, Human
cuguuuucacacugcugauaaagacauuccucaagauugugaagaaaaagagguuuaauuggac

SEQ ID NO: 162407 - RNA, 64 nt, Human
gcuguaaaucaggccuuuugccccacagagagcugauugugaaacaucuacuagcacaccacug

SEQ ID NO: 162408 - RNA, 64 nt, Human
ucuugaaccauuauaaaacaccuuaaauaaaagugauugugacuaaggcacguuggagaacauu

SEQ ID NO: 162409 - RNA, 64 nt, Human
gugaacaauggauaacaaaaagcaaguuauggaagauugugaagaggauggaaaaacugaauac

SEQ ID NO: 162410 - RNA, 64 nt, Human
ucuaaucaaguguugauugugcgcgacugaccaggauugugaaagaguucuucuguuuguauuu

SEQ ID NO: 162411 - RNA, 64 nt, Human
ccaguuauuuacaguuaccuuuuuccuuuaaccggauugugaaagcuucauguauuuuaauuua

SEQ ID NO: 162412 - RNA, 64 nt, Human
ggcccagccaccuauuuuaacaagcccucccagugauugugauacauacuaaaguuugagaacc

SEQ ID NO: 162413 - RNA, 64 nt, Human
aggggcugcugggcaguggccugggaaugggguggauugugagaaagugcucaccaucuauaca

SEQ ID NO: 162414 - RNA, 64 nt, Human
auuaaaaggugacagguagauguuaauuucccuagauugugaaagugaucacgacaaucacaca

SEQ ID NO: 162415 - RNA, 64 nt, Human
ggagauagggagauucugacaaacuucuacucuugauugugauccuaauucaaggaauaucaag

SEQ ID NO: 162416 - RNA, 64 nt, Human
gggcuccucagcucccaccccaggcuggggcccagauugugaggucugugugcaugugugugug

SEQ ID NO: 162417 - RNA, 64 nt, Human
caugaggaggcugcaacccuauaagagggcucaagauugugaauucugcuccugccaugaggag

SEQ ID NO: 162418 - RNA, 64 nt, Human
agagaaugacaaaaauauucauguauagccaauugauugugacgugcuuguggucugugcuugc

SEQ ID NO: 162419 - RNA, 64 nt, Human
agacauccaaauuuuuuuuuaaagcagucuacuagauugugaucccuugagauauggaaggaug

SEQ ID NO: 162420 - RNA, 64 nt, Human
uaacuaugaaaggagacaaaaauuugugacaaaggauugugaagagcuuuccaucuucaugaug

SEQ ID NO: 162421 - RNA, 64 nt, Human
accuucccaagccuccagagaguucucccuccacgauugugaaaacaaaugaaaacaaaauuag

SEQ ID NO: 162422 - RNA, 64 nt, Human
aagcuuuccauggaauccugggaaaauuaauaaugauugugagaauuauaaauacagacauaaa

SEQ ID NO: 162423 - RNA, 64 nt, Human
auaacuucuugaaaauccaauaaaauuggcaaaagauugugaaaauucuggaagaauaagggaa

SEQ ID NO: 162424 - RNA, 64 nt, Human
ugcuugucuuagaagaaaguggaauaauuccacugauugugauaaugguuucaauuucuacaca

SEQ ID NO: 162425 - RNA, 64 nt, Human
gcgaaggcauauuuuucuuccaagcucaagucaggauugugacuauauauuaaugagacucagu

SEQ ID NO: 162426 - RNA, 64 nt, Human
ggguuugugacucuucccucucccugccucacaggauugugacuccccagccccugcccucaaa

SEQ ID NO: 162427 - RNA, 64 nt, Human
uauuacugagagaauaaaucauuuauuuacaugugauugugauucaucaucccuuaauuaaaua

SEQ ID NO: 162428 - RNA, 64 nt, Human
cuagcaugccuucaggaaguugugccagacccuagauugugaaggacccacuguucuucuguug

SEQ ID NO: 162429 - RNA, 64 nt, Human
accuuacccccgccccgcuuggcuucuucuuuaggauugugaugguucguucuguuuacaucag

SEQ ID NO: 162430 - RNA, 64 nt, Human
acuuuguucuccagaggccuggagaacacuuagggauugugaaaauagcaggacuuguuuccau

SEQ ID NO: 162431 - RNA, 64 nt, Human
ggcaguaaggcagggucccauuucucacugagaagauugugaauauuuccauauggauuuucua

SEQ ID NO: 162432 - RNA, 64 nt, Human
gaucuauaggaccuccuaaugagaguaucugggugauugugaccccaaaccaucucuccaaagc

SEQ ID NO: 162433 - RNA, 64 nt, Human
aauggccuuaaauucucacggaauuccuggaaaugauugugaauugccuucaaauaauagaaaa

SEQ ID NO: 162434 - RNA, 64 nt, Human
aucuuuccaggaguagaaggguuaguauggaauugauugugauucuuuugggggaaggggguua

SEQ ID NO: 162435 - RNA, 64 nt, Human
uucaugucccuccaagauuugagaucaauuuagggauugugaaauuuuuuuuucaaauuucaua

SEQ ID NO: 162436 - RNA, 64 nt, Human
gcauggguacccauuugauaagagaaaugcauuugauugugaagaagggagaguuaaauucucc

SEQ ID NO: 162437 - RNA, 64 nt, Human
agccaccaugccuggcuguuuuuuggcaaaucuugauugugauaagccccccuggaggauauga

SEQ ID NO: 162438 - RNA, 64 nt, Human
caucuggucuugcauugaaauagcauuucuuugggauugugaauagaauguagcaaaaccagau

SEQ ID NO: 162439 - RNA, 64 nt, Human
uagagaggguuuguuaagguuuauacuauuuuuggauugugacuauccgucgagagugaugguu

SEQ ID NO: 162440 - RNA, 64 nt, Human
uauuaagaacauuuuauaaaacauacgaaaaagugauugugaaggauuuuuauuugcaugauua

SEQ ID NO: 162441 - RNA, 64 nt, Human
uuugggaaaagagagccagucaagcuaguaggcugauugugaagaaaaucuaauaccuuaucuu

SEQ ID NO: 162442 - RNA, 64 nt, Human
cacccaugcuguugauugcuaaauguaauagucugauugugacgcugaauaaaugucucuaaaa

SEQ ID NO: 162443 - RNA, 64 nt, Human
gaauucauucugcauauaauuauuuauaaguauagauugugaauuuuuccauguucuuaaaauu

SEQ ID NO: 162444 - RNA, 64 nt, Human
aggaaaaaagagaacaucaccuuguaaaacugaagauugugaccagucagaauaaugucaaagu

SEQ ID NO: 162445 - RNA, 64 nt, Human
auugcacuugucccggccuguugaguuugguggggauugugaccagaagauuuugaaaauuaaa

SEQ ID NO: 162446 - RNA, 64 nt, Human
gcuguauagcucagggcuuaauuucagcuucugagauugugaugucauauuucacucucaaaac

SEQ ID NO: 162447 - RNA, 64 nt, Human
guggaauggaagaaaugucgauccuguuguaacugauugugaacacuuuuaugagcuuuaaaau

SEQ ID NO: 162448 - RNA, 64 nt, Human
cgguuucccuuuacugaauaagaugacacguggugauugugaagaugguaauuugcugcuaaua

SEQ ID NO: 162449 - RNA, 64 nt, Human
uugagugauuguuaauguugucuuaaaauuucuugauugugauacuguggucauaugcccgugu

SEQ ID NO: 162450 - RNA, 64 nt, Human
aaaaucugauuuguggucuauuuaauuacaaagagauugugauggugauaauuugaauaccauc

SEQ ID NO: 162451 - RNA, 64 nt, Human
ggaugaaaguggauuaccacagcugaccaguuaugauugugaaguuaaugcuccuauacaaggc

SEQ ID NO: 162452 - RNA, 64 nt, Human
agauacacgucacaaagaccuugcugauaaaacagauugugauaagaaaagccagucaaaaccc

SEQ ID NO: 162453 - RNA, 64 nt, Human
uauuuacagacaccauuggaaaguggauauauuagauugugagagacaacaguugccuccuuuu

SEQ ID NO: 162454 - RNA, 64 nt, Human
acaugaugguucugugauucccagagagcuggcagauugugacaaucuccaggagaaccuacag

SEQ ID NO: 162455 - RNA, 64 nt, Human
ggcuuuugacaagcauaugaauuugauccucugugauugugaugaguucagaaagaucaaguaa

SEQ ID NO: 162456 - RNA, 64 nt, Human
caagaaacauuucagaggguaaguaaacagauuugauugugaggcuucuaauaaaguaguuauu

SEQ ID NO: 162457 - RNA, 64 nt, Human
ccacuugauauaauccaacuuuaauuugauugaagauugugaggaaauuuuguaggaaauuugc

SEQ ID NO: 162458 - RNA, 64 nt, Human
cauuuuggcuauguagauacaacuuagucuuugugauugugauauauuugcuaaguuuuaaaua

SEQ ID NO: 162459 - RNA, 64 nt, Human
caggaauucaaagcugcuugcuguaacugugugagauugugaaguggucugaauucuggaauca

SEQ ID NO: 162460 - RNA, 64 nt, Human
gguucugaaagaauuugauacugccuucuccuuugauugugaaguagccccaaaugaugucguc

SEQ ID NO: 162461 - RNA, 64 nt, Human
auggccccacuuguauccagaaguucccaggggugauugugauggugguugggacuggagguug

SEQ ID NO: 162462 - RNA, 64 nt, Human
guaauacuauuugccauuguaaaaggccagcucagauugugagcccuuucuauugggacagucc

SEQ ID NO: 162463 - RNA, 64 nt, Human
cucacccuguaggacucacacacgacuccaacgggauugugagaaucaagucacucucauggga

SEQ ID NO: 162464 - RNA, 64 nt, Human
uuuaguuauagucauggcagcuccucaaccccaugauugugaugagauugggaagcccacugua

SEQ ID NO: 162465 - RNA, 64 nt, Human
uccaaagacugcuuuucuuuuagcugccagauuggauugugaauaaaaauaauucuucccucuc

SEQ ID NO: 162466 - RNA, 64 nt, Human
ggcguuggggucauaaggagacuauaacucuacagauugugaauauauuuauuuucaaguugca

SEQ ID NO: 162467 - RNA, 64 nt, Human
ugguguggcuuaacgguauuucagaaggucaucagauugugagacugcuuccuugaaacauuuu

SEQ ID NO: 162468 - RNA, 64 nt, Human
aaagauuuacggauuuuuuuccuguaacauaaaagauugugaacuuuuuuuaauuaaaaaauau

SEQ ID NO: 162469 - RNA, 64 nt, Human
aacuugagacaguagcagaugggacaugguguuugauugugagaaucagugagaauucgugcau

SEQ ID NO: 162470 - RNA, 64 nt, Human
cccaccccaugcccccaauucuguggcgcauccagauugugaaaauguacaauaaauguguaau

SEQ ID NO: 162471 - RNA, 64 nt, Human
aagccuuccuuucuggccaaggugggcgguguuagauugugaggcacguacauggggccugccg

SEQ ID NO: 162472 - RNA, 64 nt, Human
guuaggauuuuacguuauuguuauuauggaaagugauugugaugcuauuuaucuucagggucac

SEQ ID NO: 162473 - RNA, 64 nt, Human
uuacaaguccaugaauguuaaaauguacaggugggauugugaagauuuacugacaucaaaaguu

SEQ ID NO: 162474 - RNA, 64 nt, Human
auaauuuaucauucuaacuucaacguauaauagggauugugaccugauauuuggagauguaaau

SEQ ID NO: 162475 - RNA, 64 nt, Human
cugguuuuccuuuucugucauuuuucagaguuuagauugugaguccauguuuugucuguugugc

SEQ ID NO: 162476 - RNA, 64 nt, Human
aaauaggugacauggcaaaaacuggacguuuccagauugugaauaacucugugagguuacugag

SEQ ID NO: 162477 - RNA, 64 nt, Human
ugcuaccauaguaauuaauguuuccaguuaucaagauugugauuagacacauuuaccuuucuuc

SEQ ID NO: 162478 - RNA, 64 nt, Human
ggggauugcgaugauugaucugggaacauggcuggauugugauuuaaccaagaaugcugauguu

SEQ ID NO: 162479 - RNA, 64 nt, Human
aaauauuaugcuucaguuucuguugcaaauuggugauugugaaauuacagaaagugauuuucua

SEQ ID NO: 162480 - RNA, 64 nt, Human
guaaguuugguuggucagagggaguugugcuggagauugugaaaaauggguucuugaaugaucu

SEQ ID NO: 162481 - RNA, 64 nt, Human
auauauauuccauauauauguucaacucuucauagauugugaacuggcccaucaauauggucag

SEQ ID NO: 162482 - RNA, 64 nt, Human
ccuuauaauaaacauggcagcaaguaaacagugugauugugaaaaaaauauuauuuauagauuu

SEQ ID NO: 162483 - RNA, 64 nt, Human
ggccuggaggauccuggagucucauuaaaugccugauugugaaccauguccaccaguaucuggg

SEQ ID NO: 162484 - RNA, 64 nt, Human
acauaagaaaauucauacuggagagaaacccuaugauugugaaaaauauggcaaaggcuuuaac

SEQ ID NO: 162485 - RNA, 64 nt, Human
ugguccugucccagugcagagggccuggagcacggauugugaauaaagccgcacaugcugauac

SEQ ID NO: 162486 - RNA, 64 nt, Human
uagugauucucucaacccuaacaccgucuggcacgauugugaccgcugaaguacaccacgagcu

SEQ ID NO: 162487 - RNA, 64 nt, Human
uuuaaaaaauuguuacuccauacggcuaaacucggauugugaugguugaacccgucgcuaaacu

SEQ ID NO: 162488 - RNA, 64 nt, Human
gggugacggaaaguaggaagugaauuugcugugugauugugaacugguuacuuucugucucugu

SEQ ID NO: 162489 - RNA, 64 nt, Human
accacccuggcaccuuaaauaaggaagaggcccagauugugaagacggacccauauaucccuac

SEQ ID NO: 162490 - RNA, 64 nt, Human
acaucuuugucuccguugggaaguccaugcugaugauugugaaaaguuccuuuaaaacuagaag

SEQ ID NO: 162491 - RNA, 64 nt, Human
cugugcuagccguuugugccucgucucgcuguuagauugugaguucccaugggcagagacccac

SEQ ID NO: 162492 - RNA, 64 nt, Human
uaucaaaagaauucuuacaggaauauuuaugaaagauugugauggugcuuuuagcgcuaaauug

SEQ ID NO: 162493 - RNA, 64 nt, Human
ugcagauuccggauauuauaauucacaccauaaagauugugaagugguuauuggcaaacguuug

SEQ ID NO: 162494 - RNA, 64 nt, Human
agcacacuuaccuccgauuaugccuuaaagaguugauugugaagaaccaguaacuuugucccaa

SEQ ID NO: 162495 - RNA, 64 nt, Human
cagccccagccccagguugauaaaucuauugauugauugugauaguacucacuggucuccgugu

SEQ ID NO: 162496 - RNA, 64 nt, Human
uaggaggugucacaauguaggguaccaaggguuggauugugauggggcauggucguacacugcu

SEQ ID NO: 162497 - RNA, 64 nt, Human
aacccauguccucacuucaagguuaucaaucuuggauugugaugcuauugguacuugagaauac

SEQ ID NO: 162498 - RNA, 64 nt, Human
gagagacacauggggaguagacccuguguacacagauugugagugaaguuccagagauguguca

SEQ ID NO: 162499 - RNA, 64 nt, Human
uggaaaaucauaauugccgucuggaccauugauugauugugaccaguagcagaagggugccugu

SEQ ID NO: 162500 - RNA, 64 nt, Human
guauuuaaaguaaauugaggacaggcuucucccagauugugacauguauaucucagauacaugg

SEQ ID NO: 162501 - RNA, 64 nt, Human
caggccauguucccaaaggccagcgggggcccuggauugugaugcagccucgggacagggcuga

SEQ ID NO: 162502 - RNA, 64 nt, Human
guuacagcugguucuguagaaagagggaaaagaugauugugacaauucagagcauaacucagau

SEQ ID NO: 162503 - RNA, 64 nt, Human
uuuuuugaagagcaaaacuuauaauaccuccugggauugugagcuagucauucagccuguguaa

SEQ ID NO: 162504 - RNA, 64 nt, Human
auuuuuaaagaaauucuuuaaagguuuaacgcuagauugugaggaaugacacaccacucccucc

SEQ ID NO: 162505 - RNA, 64 nt, Human
gcaggauuucugcagggggcagcacagguucugggauugugaggcugugagugaagguggacaa

SEQ ID NO: 162506 - RNA, 64 nt, Human
ucauauugugagacugcucggucaagugccaggagauugugauugggagaggguaaggcaaaca

SEQ ID NO: 162507 - RNA, 64 nt, Human
ggcugugaccggaggccaggaaugccguuggguggauugugagugaaugggcccuuugagcugc

SEQ ID NO: 162508 - RNA, 64 nt, Human
gagggacuggcugaagccauggcagaagaacguggauugugaagauuucauggacauuuauuag

SEQ ID NO: 162509 - RNA, 64 nt, Human
ugcuguccugggauggccugcuaucuugaugauagauugugaauaucaggaggcagggaucacu

SEQ ID NO: 162510 - RNA, 64 nt, Human
ugcuguacaugacaucaaaaugagucaggcaauugauugugaauuccuuaaaguuuuccuuuuu

SEQ ID NO: 162511 - RNA, 64 nt, Human
uucauuuuauguuuuuucuuaacuguuauauuaugauugugacauagauuauacuacuacuaau

SEQ ID NO: 162512 - RNA, 64 nt, Human
ggccucauccuccacugaagaguauggauugaaggauugugaacuauguuuagugugauuguga

SEQ ID NO: 162513 - RNA, 64 nt, Human
uauggauugaaggauugugaacuauguuuagugugauugugaacuuggugccuaauguuccaug

SEQ ID NO: 162514 - RNA, 64 nt, Human
ggauauguugaagcuggaggagauuuugaacugugauugugaggcucagggccugguacucuag

SEQ ID NO: 162515 - RNA, 64 nt, Human
caaauaaguucuuuuaaacagucuuuuuauuguggauugugaaaucaaaaucuggagaaaugcu

SEQ ID NO: 162516 - RNA, 64 nt, Human
aguaguuauucuauuuuguguccauauuccauuagauugugauuauuaauuuucuagcuauggu

SEQ ID NO: 162517 - RNA, 64 nt, Human
agugcaauuuuaagucuaauucaugcagaugauugauugugauuauuguaagaaauuucuuaca

SEQ ID NO: 162518 - RNA, 64 nt, Human
uuuuagcaucuuuuuuuuuuuuuacaaucauucagauugugaauucaggcucagaauuuaccca

SEQ ID NO: 162519 - RNA, 64 nt, Human
acuggugauauaucucaaauuguaauuaauaauagauugugaauaaugauuuggggauucagau

SEQ ID NO: 162520 - RNA, 64 nt, Human
gcuaucuugagauuaguguugacagggaggggaggauugugaggugagggguuaauaaguuacu

SEQ ID NO: 162521 - RNA, 64 nt, Human
uacucacuuagugauuuguaaaauuugcacaugugauugugaagaaauuuguacuaccuaaaag

SEQ ID NO: 162522 - RNA, 64 nt, Human
gcauagaaagaauauaaauauccuguacacggcagauugugaacaaacuauauuccuuuaaguu

SEQ ID NO: 162523 - RNA, 64 nt, Human
cuuauauaugcugggcuggauuaagcuuuguugugauugugaccaacauucaggccacgugagc

SEQ ID NO: 162524 - RNA, 64 nt, Human
aauagcucacuaaaauuuuauauauuuguaugaugauugugaaccuccugaaugccugagacuc

SEQ ID NO: 162525 - RNA, 64 nt, Human
guacaugucuaaauauauuuuuagaaguggguaggauugugaauuucugaugcagggccuuuuu

SEQ ID NO: 162526 - RNA, 64 nt, Human
gaagaacuagugguaaaacauccaagagcacuaggauugugauacagaauuugugagguuuggu

SEQ ID NO: 162527 - RNA, 64 nt, Human
aaauuguuucagaguuuguuuuuuuuuuaguuuagauugugaggcaauuauuaaaucaaaauua

SEQ ID NO: 162528 - RNA, 64 nt, Human
cacacgcacacaagaggguaagagacaagguucugauugugaaacagagccuuucaaauugaag

SEQ ID NO: 162529 - RNA, 64 nt, Human
cgccuuugguuuaaaauguaugugguccccuaaugauugugaccccauucuguaaucaacugag

SEQ ID NO: 162530 - RNA, 64 nt, Human
gccuguuuccagggccucccacacucauuggccagauugugaacuuugucaggcuugucccucc

SEQ ID NO: 162531 - RNA, 64 nt, Human
auaggaucccccuucuugcccuccacccccauaagauugugaaggguuuacugcuccuuccauc

SEQ ID NO: 162532 - RNA, 64 nt, Human; identical to SEQ ID NO: 162516

SEQ ID NO: 162533 - RNA, 64 nt, Human
uaggucaggccguugaguucgagcuccgaugggccaccuugaauccaggacugaccgcccgugu

SEQ ID NO: 162534 - RNA, 64 nt, Human
aucauuguaagacaauuuauuaauuugagaaagucaccuugacaguucuuugcacacaaguuuu

SEQ ID NO: 162535 - RNA, 64 nt, Human
ccacuauggaugacauguugucuacucggucuagcaccuugaccgaggauggagcuaagaguuc

SEQ ID NO: 162536 - RNA, 64 nt, Human
acuuaugggugguaaggggcaaaaaagaggcccacaccuugauauccaggccauaccaggguau

SEQ ID NO: 162537 - RNA, 64 nt, Human
aguguaaaggaggguuugguccugucugcuuccucaccuugagaguaaagugcugcccucugcc

SEQ ID NO: 162538 - RNA, 64 nt, Human
cacaccugagcacuacggacagggaggcaggugccaccuugacaccucucuuccauagcaaugg

SEQ ID NO: 162539 - RNA, 64 nt, Human
gaacuucaugcuugauuugaccacugacagccuccaccuugagcacuauucuaaggagcaaaua

SEQ ID NO: 162540 - RNA, 64 nt, Human
aaauuaugauaacuguauuucuagggguauguuucaccuugauuuuggcccgguucuuucagug

SEQ ID NO: 162541 - RNA, 64 nt, Human
ucaucauacaggaugacaagacuggggcccuguucaccuugaacaugccccugggccaagaugg

SEQ ID NO: 162542 - RNA, 64 nt, Human
gguagcuagugccucucuaucaaaucaggguuugcaccuugagacauaaucuaccuuaaauagu

SEQ ID NO: 162543 - RNA, 64 nt, Human
cuuggccuggcuuucccuuggccuuccucagcuucaccuugauacugggccucuuccuugucau

SEQ ID NO: 162544 - RNA, 64 nt, Human
acagguggcuggagcagcugcuuugcaaccugaucaccuugaguucugagcagggacuaggcuu

SEQ ID NO: 162545 - RNA, 64 nt, Human
gcagcugugccaggauagcuggguccauucagagcaccuugagaaguguugcagggagguguua

SEQ ID NO: 162546 - RNA, 64 nt, Human
acacccccugugcgguuuacugugggagacagcccaccuugaaggggaaggagauggggaaggc

SEQ ID NO: 162547 - RNA, 64 nt, Human
ucugccccaucccuacccuagccuugcucucagccaccuugauagucacugggcucccugugac

SEQ ID NO: 162548 - RNA, 64 nt, Human
uucagccuucguguggcuccugguaacguggcuccaccuugaugggucaaccuuuguguggcuc

SEQ ID NO: 162549 - RNA, 64 nt, Human
acccccacagggaggcaggaaaacagccagaagccaccuugacacuuuugaacauuuccaguuc

SEQ ID NO: 162550 - RNA, 64 nt, Human
auuuggagccaggaugggucuccauucuguguggcaccuugauuggaaaauaauauccaugcgu

SEQ ID NO: 162551 - RNA, 64 nt, Human
augaccugagaggcaccuggagcccacuguuggccaccuugagcucuucaccauccaucacagg

SEQ ID NO: 162552 - RNA, 64 nt, Human
uccucauggucaaugaacauguucaggaagcgaucaccuugaugcuugaacccaaccccagaca

SEQ ID NO: 162553 - RNA, 64 nt, Human
uaguuacuuuugccuuucgcucuucuaucacagccaccuugaccuuggguaaaacccaaggucu

SEQ ID NO: 162554 - RNA, 64 nt, Human
guacccaggcccacuccagaauggccucuggacucaccuugagaagggggagcugcugggccua

SEQ ID NO: 162555 - RNA, 64 nt, Human
acccaccucugcccuguccuuggcagcugaaggacaccuugacuuccagcuuuuacgagugagc

SEQ ID NO: 162556 - RNA, 64 nt, Human
ugcacacaccucagaggcuguucuuggggcccuacaccuugaggaggggcagguaaacuccugu

SEQ ID NO: 162557 - RNA, 64 nt, Human
guuggguguucccucuucuuauuuucucucugcccaccuugacacaguaacuuccucuuauagu

SEQ ID NO: 162558 - RNA, 64 nt, Human
cccacaacucccuugcacguaaacuucagugucccaccuugaccaaaaucagcuuuguaacugu

SEQ ID NO: 162559 - RNA, 64 nt, Human
cuuucuguugacccugcaaggagcagaguguguucaccuugagucuccagcccacagccaaggu

SEQ ID NO: 162560 - RNA, 64 nt, Human
gcugugcugggagcugcagugguaaugugugggacaccuugaccaaaggggagcuuugucucgu

SEQ ID NO: 162561 - RNA, 64 nt, Human
ugcuuacagaccgaaacuggcaucuuacucuuggcaccuugacuugcacccucugagguuccaa

SEQ ID NO: 162562 - RNA, 64 nt, Human
ggcccuacuuuccucccucugcugcuuggucccucaccuugaugauguggcuucgcccccucca

SEQ ID NO: 162563 - RNA, 64 nt, Human
gcuucacucccacccuuucagcguccugccccuucaccuugacccggguucccccacucccauu

SEQ ID NO: 162564 - RNA, 64 nt, Human
cuggucucgaacucuugagcucaagcagucuacccaccuugaccucccaaagugcugggauuac

SEQ ID NO: 162565 - RNA, 64 nt, Human
cucaaggaugcacugggaagcaugccugggcuuucaccuugaagcauggucagcagcagagaga

SEQ ID NO: 162566 - RNA, 64 nt, Human
uccaugccaauaguugcuguccccuuccaggggucaccuugagaggcaugacagcuguuccaca

SEQ ID NO: 162567 - RNA, 64 nt, Human
uggggaagcaguuuggcccagcccaaggagaccccaccuugagccuuauuuccuaaugggucca

SEQ ID NO: 162568 - RNA, 64 nt, Human
ucaguaguaucaaugauuuacucaauaucugaaucaccuugauucagaaccauuucagcuguuu

SEQ ID NO: 162569 - RNA, 64 nt, Human
uugugacuucuuaguggccuagccuucuugauggcaccuugaaagugaacuucuagaaaucuac

SEQ ID NO: 162570 - RNA, 64 nt, Human
cuuccuggaagcagagcuggggagggagagccaucaccuugauaaugggaugaauggaaggagg

SEQ ID NO: 162571 - RNA, 64 nt, Human
auaaaaaucaauucuagcacugugaagcuucagacaccuugaaaguccuaacauuagaauugua

SEQ ID NO: 162572 - RNA, 64 nt, Human
uuuuuaagccaggcgggcugggaagcuugaagugcaccuugagcagguucuccuggcagcguuu

SEQ ID NO: 162573 - RNA, 64 nt, Human
cuuugccuagguugccaaaaagauguuugccuuccaccuugaugcauccuguuuugugcaauuc

SEQ ID NO: 162574 - RNA, 64 nt, Human
aaaguagguugaaagcucucuguauuuuaguuaacaccuugaauaaaauggaaaaagcaguuau

SEQ ID NO: 162575 - RNA, 64 nt, Human
acuccuccaggagagcuggauguuuugcgugcaacaccuugagcacugacugcuauuguucaaa

SEQ ID NO: 162576 - RNA, 58 nt, Human
cagcucccccgacgcuguaacuccagaccaccuugaguguggcaccuccccucccaag

SEQ ID NO: 162577 - RNA, 64 nt, Human
guuuguugugagaauugcugaagccacguagaagcaccuugaaaucuguaaaaccacaagaaag

SEQ ID NO: 162578 - RNA, 64 nt, Human
cggggggggggggggguguugucugcagaaccaccaccuugaaagauccauguucuuagagccu

SEQ ID NO: 162579 - RNA, 64 nt, Human
gagggcaacucucacuggaaaccaaaucuccuggcaccuugaucuuggauuuuacagccuccag

SEQ ID NO: 162580 - RNA, 64 nt, Human
uguuauauucuaaauuuucauuaaauauucaugucaccuugaguugucaugauaaguauguuuu

SEQ ID NO: 162581 - RNA, 64 nt, Human
ugaggacuguagucaacugguaaggaugaacugacaccuugaggaaacugaaacagcuugucau

SEQ ID NO: 162582 - RNA, 64 nt, Human
uuuccuguuccucuauuccaaguauaaguuucaccaccuugagaaauaauuuuuuuaaaaaauc

SEQ ID NO: 162583 - RNA, 64 nt, Human
acuaauauuuagugggagaccauaaugugucagccaccuugauaaaugacaggguggggaacug

SEQ ID NO: 162584 - RNA, 64 nt, Human
uuaagaagcaugaugcagauaaagucgguuuaaucaccuugagugacugggcagcagcggugga

SEQ ID NO: 162585 - RNA, 64 nt, Human
aagaaauauccagaaaggaacaaagucuuguggacaccuugauuuugguccagugagaauaugu

SEQ ID NO: 162586 - RNA, 64 nt, Human
uguguuccuuggcacaagaacucacuugaacuaucaccuugacuaucagauauguuuuugcacu

SEQ ID NO: 162587 - RNA, 64 nt, Human
gggaaaucugagccuagcucagaaaaacauaaagcaccuugaaaaagacuuggcagcuuccuga

SEQ ID NO: 162588 - RNA, 64 nt, Human
ucaguauuauuggaccaaauuugguguuuguuuucaccuugacgcucuucuuuucauuauuucu

SEQ ID NO: 162589 - RNA, 64 nt, Human
ugguguguuaccuugaaaacugaauaucaacguucaccuugauucaggaaagcugggugcuguc

SEQ ID NO: 162590 - RNA, 64 nt, Human
cagcuuacucccguggccgcacuuugaaugucaccaccuugaguuucucuuucugguaaaauuu

SEQ ID NO: 162591 - RNA, 64 nt, Human
uucacccugucccucuaauaaagcuccucugcuccaccuugaaccugucaccuggccugccacc

SEQ ID NO: 162592 - RNA, 64 nt, Human
aaaagguaaaauucacuaucauauuuuguguccccaccuugauguuacaugacucuggaacaau

SEQ ID NO: 162593 - RNA, 64 nt, Human
uuaaaccuaucuauaucugucuaucagcacaacucaccuugaauauagucuuauacuuucaagu

SEQ ID NO: 162594 - RNA, 64 nt, Human
aucuagaauucgagagugucauggacaaaaauuucaccuugagauugagcuuuuauuucccuuu

SEQ ID NO: 162595 - RNA, 64 nt, Human
aucugucuuggucacagagcugggugcugccggucaccuugagcugugguggcucccggcacac

SEQ ID NO: 162596 - RNA, 64 nt, Human
gucauucaaguuuucaucugcuuuauaauugauacaccuugagggucacuuuucuaauacuuuu

SEQ ID NO: 162597 - RNA, 64 nt, Human
gcaucucuccacucaacuccaccccaucccaucccaccuugaaaaucacugcucugaaccagug

SEQ ID NO: 162598 - RNA, 64 nt, Human
caguauuuuuuaaggcaaauaaagaugauuagcucaccuugagauaacaaucagguaagaucau

SEQ ID NO: 162599 - RNA, 64 nt, Human
auagccuguuuuccacauguaaauuugugccuuacaccuugaguuguguacacuuguaaacucu

SEQ ID NO: 162600 - RNA, 64 nt, Human
gaaaguugaucugcaccagaacccggaugacugucaccuugaagcauccuguucuccuucugug

SEQ ID NO: 162601 - RNA, 64 nt, Human
gggaagagaugacucaagccaguggaagaccacacaccuugagaaguagaagagucauaggauu

SEQ ID NO: 162602 - RNA, 64 nt, Human
cauuugacaaauuucccuuaggauuucguuaucucaccuugacccucagccaagauugguaaag

SEQ ID NO: 162603 - RNA, 64 nt, Human
uucccaccaguaaaauuauccugaguagcuaaugcaccuugagaaaaaucuggcauacugaaua

SEQ ID NO: 162604 - RNA, 64 nt, Human
aucccccaugucgcuacagaacaugggcccagagcaccuugaaggagacccuugacugugacug

SEQ ID NO: 162605 - RNA, 64 nt, Human
cuccuccugaccagcccaggaccagcuuucuugucaccuugagguccccucgccccgucacacc

SEQ ID NO: 162606 - RNA, 64 nt, Human
aaugacaacaguagaagcuuuccucuccccuucucaccuugaggagauaaaaauucucuaggca

SEQ ID NO: 162607 - RNA, 64 nt, Human
gcuggggggaguuaucaugauggugcugauugcccaccuugagugagggguggauaaacuaccc

SEQ ID NO: 162608 - RNA, 64 nt, Human
caugcuuuugccacuuuggcuucuccugugaccccaccuugacgguggggcguagacuugacaa

SEQ ID NO: 162609 - RNA, 64 nt, Human
ggaaaaauagagaacaaaaggaaaagauuguuaccaccuugauuuaauaacuucuuguuucccc

SEQ ID NO: 162610 - RNA, 64 nt, Human
auacauacccuauaccaagagggccgaaacucuucaccuugauguauguucugauacaaguugu

SEQ ID NO: 162611 - RNA, 64 nt, Human
cuaaaauauaaaggucaaucauuuauaauagaaacaccuugaccacaagcccuugauugaacau

SEQ ID NO: 162612 - RNA, 64 nt, Human
gauguaguagugucugcuguuuuggaucgaaaaucaccuugaguggaggaagugacuucacugg

SEQ ID NO: 162613 - RNA, 64 nt, Human
ugauaauuuacuuuugaucacauuaagguguucucaccuugaaaucuuauacacugaaauggcc

SEQ ID NO: 162614 - RNA, 64 nt, Human
uaacacauaaaguaaaugcuaccucugaucaaagcaccuugaauggaagguccgagucuuuuua

SEQ ID NO: 162615 - RNA, 64 nt, Human
gggcugcccuccacacacacacgcccgucacccacaccuugagcacacaccaugaagaucacca

SEQ ID NO: 162616 - RNA, 64 nt, Human
cccagugcauguacgcccucugagaugcaauaaacaccuugaacaaagaaaugcaaacauaacg

SEQ ID NO: 162617 - RNA, 64 nt, Human
uggcuuaugagauacuuugcauugucugucugcacaccuugaaucugccugcuggcucccuuac

SEQ ID NO: 162618 - RNA, 64 nt, Human
caauaaacaaaguacuaccugaaaaacauccaaacaccuugagcucucuaaccuccuuuuuguc

SEQ ID NO: 162619 - RNA, 64 nt, Human
aagagagggccucagaagaaaccaacccugccaacaccuugaucuuggacuuccagccuccaaa

SEQ ID NO: 162620 - RNA, 64 nt, Human
agcagcuucacuuccccugcgccuuuuauguccccaccuugaggccuugcagaggcgccucuca

SEQ ID NO: 162621 - RNA, 64 nt, Human
gaaacuuguguaucauaugugauuuugaaaugaacaccuugaauagcacuaauuuuuauuugug

SEQ ID NO: 162622 - RNA, 64 nt, Human
acacacacauuauuaacaaggaagugauuugcugcaccuugaguugagagggcuacauguagaa

SEQ ID NO: 162623 - RNA, 64 nt, Human
uaggaacuugaaugugagauucagcucuaguuugcaccuugauuuccccagugaaaagggagaa

SEQ ID NO: 162624 - RNA, 64 nt, Human
cuuccucuuccugccccaccugcauaggcacacacaccuugaaucugcacccucuggagggcau

SEQ ID NO: 162625 - RNA, 64 nt, Human
aaauguuacccugauuguuuauaugaauguagaacaccuugacauuucuuuuuauauauaaacu

SEQ ID NO: 162626 - RNA, 64 nt, Human
uucugaagccagaucaaacuguuaccuuguguuccaccuugaaucucacagcguccccuucugc

SEQ ID NO: 162627 - RNA, 64 nt, Human
aaggaaguuaaaagguggcuuugaaggaggaagacaccuugagccaaggaaugaagggggccug

SEQ ID NO: 162628 - RNA, 64 nt, Human
ugucuugaguagacuuggacccaaaaaaucaucucaccuugagcccacccccaccccauugucu

SEQ ID NO: 162629 - RNA, 64 nt, Human
cccaacaucucccagccuccccaggugccccccucaccuugaugggugcguucccgcagaccaa

SEQ ID NO: 162630 - RNA, 64 nt, Human
gucccagcuacucgggaggccaagacagaaggaucaccuugaggccaggaguuuaaggccagcc

SEQ ID NO: 162631 - RNA, 64 nt, Human
ugaaguauauguugauacuaugacauguugccaacaccuugagaagcauuauuuguuucuaaua

SEQ ID NO: 162632 - RNA, 64 nt, Human
gggaggguggugggcccagaccacugucuccacccaccuugacguuucuucuuucuagagcagu

SEQ ID NO: 162633 - RNA, 64 nt, Human
agaacugccuccuugccgcugccuccaggaagcccaccuugagccagagucaagggcugcagca

SEQ ID NO: 162634 - RNA, 64 nt, Human
auggggaagggccagaugcugggugggugccugucaccuugaggugaccaucuagggcaguacc

SEQ ID NO: 162635 - RNA, 64 nt, Human
uuaagggcaguaacguuaagaugcgugggcagggcaccuugaacucuggcuuagcaagcaucua

SEQ ID NO: 162636 - RNA, 64 nt, Human
uuccccauuuccuuccuucccucagucucaaagucaccuugaaagcuucaccuggccuacaacu

SEQ ID NO: 162637 - RNA, 64 nt, Human
ugccuauuugcugaccacacuccggcuccuaugucaccuugaugacuuccuauccauucugucu

SEQ ID NO: 162638 - RNA, 64 nt, Human
gggaggcccagucacaguccagcaauuccacaaccaccuugacgaaugcuugccaagcuguuuu

SEQ ID NO: 162639 - RNA, 64 nt, Human
aagagagaggcuucagaagaaacaaaaucaccagcaccuugaucuuugacuucuaaucuccaga

SEQ ID NO: 162640 - RNA, 64 nt, Human
ggacacagauuaucaacuggggggaccaaauagccaccuugauuuucuucuuuguggucuuuuu

SEQ ID NO: 162641 - RNA, 64 nt, Human
gcucaauuugcccaccugcugccuccaggaucagcaccuugaagaagugugugggcacugccac

SEQ ID NO: 162642 - RNA, 64 nt, Human
gggcuagggaacugcuggaaguucaggaugccaccaccuugaacaccuaggccagggaucccca

SEQ ID NO: 162643 - RNA, 64 nt, Human
uaacuuucaaauaggaugguugcuuaugaauucacaccuugaguauaaaacuugcagagaacau

SEQ ID NO: 162644 - RNA, 63 nt, Human
aagaggauuuuauguuauaaaagaggauuuucccaccuugacaccaggcaauguaguuagcau

SEQ ID NO: 162645 - RNA, 64 nt, Human
ggaagaguuaagcacugcuuucaguuuuaauauccaccuugaggggucgcugcuugagggcucu

SEQ ID NO: 162646 - RNA, 64 nt, Human
uuuguuucacuuuucuuaauuugccccccacccccaccuugaaagguuuuguuuuguacucucu

SEQ ID NO: 162647 - RNA, 64 nt, Human
gaagacggcccucaccagacaccaugucugcuggcaccuugaucuuggaccucccagccuccag

SEQ ID NO: 162648 - RNA, 64 nt, Human
ccaaucccguucgcucugacccuugcuggcugaucaccuugagcaacuuacuuaacaucugugu

SEQ ID NO: 162649 - RNA, 64 nt, Human
aaggcuauugaccgagcacauaccaugugccacacaccuugacaaaaucuuuuaauacaguuua

SEQ ID NO: 162650 - RNA, 64 nt, Human
gggccaagcagaaagagagaaacacuucugcugucaccuugaaugaacucaggaauagcuuccc

SEQ ID NO: 162651 - RNA, 64 nt, Human
uuuuuuuguuuuguuuuguuuuuaacaacaauagcaccuugaaaaucugcccuaaaacagugua

SEQ ID NO: 162652 - RNA, 64 nt, Human
cagcuccagcuccccucugucggugguggggccucaccuugaagagggaagucucaauauuagg

SEQ ID NO: 162653 - RNA, 64 nt, Human
acccaggcuggagugugguggugugauaauagcucaccuugaccuccuaggcucaacugaucuu

SEQ ID NO: 162654 - RNA, 64 nt, Human
auguuaguuucugccacaaugugaagaaggccuucaccuugacucuuguuauuggaugggcccu

SEQ ID NO: 162655 - RNA, 64 nt, Human
agaggugugacgggaggcuggggagagaccccagcaccuugagcacacaggagccaggaggagc

SEQ ID NO: 162656 - RNA, 64 nt, Human
ugcuguaaauacguugguuuuccuugucccuuugcaccuugacaguacguaguauacauugugg

SEQ ID NO: 162657 - RNA, 64 nt, Human
agacugugcuuuucugucuuguucagccuugacccaccuugagagagagccaccaggaaggcgc

SEQ ID NO: 162658 - RNA, 64 nt, Human
caggauuaaagucagauuaaggguacagaaagcacaccuugauacugaggccauuuagagcaau

SEQ ID NO: 162659 - RNA, 64 nt, Human
ucacuuuccccaucagcaauaccugguguucucccaccuugaaaggacucuuggcuccugccgg

SEQ ID NO: 162660 - RNA, 64 nt, Human
uuuuuuuaaaaaaauagauguuccuuuugugaagcaccuugauuccuugauuuugauuuuuugc

SEQ ID NO: 162661 - RNA, 64 nt, Human
cugaaaugauuaaugcacugauggguccugaauucaccuugagaaagacccaaaggccagucag

SEQ ID NO: 162662 - RNA, 64 nt, Human
ggcguugagugcucagaauaaugcuugaacaccucaccuugaaacuguagcaguguguucuggg

SEQ ID NO: 162663 - RNA, 64 nt, Human
cuccucccccaucuggggaugugucuguguuccacaccuugaaauaaacagacacauacguguu

SEQ ID NO: 162664 - RNA, 64 nt, Human
ggagggaaggagaccccugcaggcucccuccacccaccuugagaccugggaggacucaguuucu

SEQ ID NO: 162665 - RNA, 64 nt, Human
cgugaaggcauuacauugccucacauucacuaaccaccuugaauuaaauuuauuucuuaagaaa

SEQ ID NO: 162666 - RNA, 64 nt, Human
aaggaaugaguguaugaaaaggugaaggugggagcaccuugacccagggaugugaugguuuauu

SEQ ID NO: 162667 - RNA, 64 nt, Human
aagcaaauguuuuuuuaauggacuugcaucuccucaccuugaucaggacuaaaggacggaggcc

SEQ ID NO: 162668 - RNA, 64 nt, Human
cuuccccaguccccucagaggcccccgccagccccaccuugaaagcagcauacaggggaaggcu

SEQ ID NO: 162669 - RNA, 64 nt, Human
cgaaauugucuuuauuaaugcaaaguucuuuugucaccuugacuuugggacacuguuaccaaac

SEQ ID NO: 162670 - RNA, 64 nt, Human
cuggucuuggacuccuguacugaagcgauccucccaccuugaccucccaaagugcugggacuau

SEQ ID NO: 162671 - RNA, 64 nt, Human
aaagaguggaaugugaggagcagaccuaggcagacaccuugagacuaaaagucagagcugaagg

SEQ ID NO: 162672 - RNA, 64 nt, Human
uauccauuacauauuuaguuuuaaaaggaggagucaccuugaauuauuuucugagucaccuuga

SEQ ID NO: 162673 - RNA, 64 nt, Human
aaaaggaggagucaccuugaauuauuuucugagucaccuugaguuauuugaucucucagccugc

SEQ ID NO: 162674 - RNA, 64 nt, Human
gggaucagcuugguagacaguauuagcggagaaacaccuugaucuugguuugcaagcccuucuc

SEQ ID NO: 162675 - RNA, 64 nt, Human
gcccugggugaaugcugcugccccugcuggcagccaccuugagaccucaccgggccugugauau

SEQ ID NO: 162676 - RNA, 64 nt, Human
agagucagaaccuguacaguauauaaagcauaaacaccuugaauuugauuuuaguucaccacau

SEQ ID NO: 162677 - RNA, 64 nt, Human
cacugaaucuccuuuuguaacugguguucacugacaccuugauggcucuugauggcucuaaaaa

SEQ ID NO: 162678 - RNA, 64 nt, Human
uggaggcaggaauugagcugacugagggaagaugcaccuugaucucacccucacuccaaggcac

SEQ ID NO: 162679 - RNA, 64 nt, Human
uuuuuugugacuuuucaaaacagugaauuacugucaccuugauggacaaguuucaauaaaacuu

SEQ ID NO: 162680 - RNA, 64 nt, Human
gauuuccucuuccacaagcugccgcuuuucugggcaccuugaagcaucagggcgugaaaucaaa

SEQ ID NO: 162681 - RNA, 64 nt, Human
uagaagaagaaaauccccgugacuucuuccucaucaccuugauggcuuuauucucaccuugugg

SEQ ID NO: 162682 - RNA, 64 nt, Human
uucuacuuccccauuucaggugugagauguaacccaccuugaccauaaauuggcuuuucauagu

SEQ ID NO: 162683 - RNA, 64 nt, Human
acgaggaagagaacacaaggaaugauucaagauccaccuugagaggaaugaacuuuguuguuga

SEQ ID NO: 162684 - RNA, 60 nt, Human
agccugaaaauucuucuugaccuugacagucaccuugaaggauuucgcaaguccagaaau

SEQ ID NO: 162685 - RNA, 64 nt, Human
augaaaagcacugauaaacagaauacuuuuaaaacaccuugagaaaaaaagauaauacauacac

SEQ ID NO: 162686 - RNA, 64 nt, Human
guuuuuaaacaucuuagguauaacagcacaauuucaccuugaaaaagcaccaaaauuauggugu

SEQ ID NO: 162687 - RNA, 64 nt, Human
aaucucuggaaaacuaucagaagacaaaguuugacaccuugauacccacucucugugaauaccu

SEQ ID NO: 162688 - RNA, 64 nt, Human
aaaaaaaaaaaaaaggaaaaaaucccuaaacauucaccuugaccuuauuuaugacuuuacgugc

SEQ ID NO: 162689 - RNA, 64 nt, Human
cuaaaagccauccacagcuauggaaccugagcgacaccuugauuuguguugucaccugaccaag

SEQ ID NO: 162690 - RNA, 64 nt, Human
guguguguguguguguguguaaggggaggaaagccaccuugacagcccaggucccuccagguca

SEQ ID NO: 162691 - RNA, 64 nt, Human
agauagauguagguuaugaacccaguucauaggccaccuugaguuagaauuuugguaccuacaa

SEQ ID NO: 162692 - RNA, 64 nt, Human
gugugacgcugccuuuuuauacacuguccuccuccaccuugauggaccccuagugaugcauccu

SEQ ID NO: 162693 - RNA, 64 nt, Human
gaacaugcaaauucauguugucuccaucaguggucaccuugagggauuagacauucuaauggaa

SEQ ID NO: 162694 - RNA, 64 nt, Human
agccuccugaggacacaggaagagacggaaggagcaccuugacagacuugugugagucuucucg

SEQ ID NO: 162695 - RNA, 64 nt, Human
aaagagggcugucaacaggaacugcgucugcuggcaccuugaucuugaacuucccagccuccag

SEQ ID NO: 162696 - RNA, 64 nt, Human
ugccagaaauuuauaaagagguucuguaucuucacaccuugaauaagcauaauaccauaaaaaa

SEQ ID NO: 162697 - RNA, 64 nt, Human
cagauccugggaccccugggccgugccugcccuccaccuugagugccauacucccaacagcucc

SEQ ID NO: 162698 - RNA, 64 nt, Human
aacaccuccuggaacgaagcucccgccugcaugucaccuugaugggggcugugaguggggcagu

SEQ ID NO: 162699 - RNA, 64 nt, Human
agaaaguacuucuccacccugcucuccgaccagacaccuugacagggcacaccgggcacucaga

SEQ ID NO: 162700 - RNA, 64 nt, Human
aggagggggccucaggagaaaccaacccugcaaucaccuugaucuugggcuuucagcccccaaa

SEQ ID NO: 162701 - RNA, 64 nt, Human
agcgauugaccugugcuucugacagcccccgagacaccuugaggaggccgcuccuucccagaca

SEQ ID NO: 162702 - RNA, 64 nt, Human
cguuccccaggggagcuggggaauuccugccaagcaccuugaaugggaggggccucacagaggg

SEQ ID NO: 162703 - RNA, 64 nt, Human
aggcaccaauggcugagcaggaagggcgaggagacaccuugaucagcgucccaguuucacagcc

SEQ ID NO: 162704 - RNA, 64 nt, Human
gagacauguacaaaccuggauuuuuuuuuuauaccaccuugacccauuugcuacauuccuuuuc

SEQ ID NO: 162705 - RNA, 64 nt, Human
aaggauuccaggcuccagaaaaaaugaaugaacucaccuugacgucaaugcaauugaaucaccg

SEQ ID NO: 162706 - RNA, 64 nt, Human
ccuggagccuccagaagggacuggccucugcccacaccuugacuucaguauuucugaccuccua

SEQ ID NO: 162707 - RNA, 64 nt, Human
cuuacagccagcccuuacaguuucacucaugaagcaccuugaucuuugguguccuggacuucau

SEQ ID NO: 162708 - RNA, 64 nt, Human
ugaagccuggaggacuguugggcauguagacuggcaccuugaagauucaccauuguuuaaauaa

SEQ ID NO: 162709 - RNA, 64 nt, Human
uggaggcuccaagccucaaagugcccgcagagcccaccuugaggguuuugcuaguugguuuugu

SEQ ID NO: 162710 - RNA, 64 nt, Human
gcagggagauuucucuuccugcccucacuucuuucaccuugaacuuggauaagaacucgugucu

SEQ ID NO: 162711 - RNA, 64 nt, Human
ggugaguccucucuaucuccucuggcucuggaagcaccuugaaaaugugcauuuucaaggacac

SEQ ID NO: 162712 - RNA, 64 nt, Human
aggggaagggcgggaggauugagaagggacaagccaccuugaccguaggggaaggaggaaugug

SEQ ID NO: 162713 - RNA, 64 nt, Human
caagucugugccuggagcuccugggaaggcuacucaccuugaacaccacgcuugacaggacagc

SEQ ID NO: 162714 - RNA, 64 nt, Human
aguguucaguuuccuugggggccugcucccuucacaccuugagcccaaguccuuuuccguuggc

SEQ ID NO: 162715 - RNA, 64 nt, Human
uuaucauauauauauuuuuuaaagaagagaaaaacaccuugagccuuaaaacggugcugcuggg

SEQ ID NO: 162716 - RNA, 64 nt, Human
aauacaaaaugcuuguccaggacucagccaugcacaccuugagcagcgccggcaggaggcacgg

SEQ ID NO: 162717 - RNA, 64 nt, Human
uuguuacagacaccuuccucuguguaagucuccucaccuugaggggucuuuaguaaugcaucug

SEQ ID NO: 162718 - RNA, 64 nt, Human
ggggaggcccguccgccuggcccaccaacccgcccaccuugacugcccccagaagugugucuug

SEQ ID NO: 162719 - RNA, 64 nt, Human
caaccaccuaccagugcccaugucccuuccagcucaccuugagcagccucagaucaucucuguc

SEQ ID NO: 162720 - RNA, 64 nt, Human
aacucccgaauccucucuugaguguggaccucaacaccuugagcccuaguaaaggaacuaugca

SEQ ID NO: 162721 - RNA, 64 nt, Human
uuugcuguggugggagauaguuugacugaacccccaccuugaccuuggucuccaggggugugga

SEQ ID NO: 162722 - RNA, 64 nt, Human
cugggucacauugcuucuuauccugaacacuugacaccuugaggguagaauuuagcguuugguu

SEQ ID NO: 162723 - RNA, 64 nt, Human
uuuccuaguuguccuggugcuaacacaggagcuacaccuugauccucuccuggcaugaaaauaa

SEQ ID NO: 162724 - RNA, 64 nt, Human
aaacuccaagugauaaccagacccaucucuccuccaccuugacaaaagcagauuauaguauaca

SEQ ID NO: 162725 - RNA, 64 nt, Human
accaguuggggcgacuccuuugaaagucugucugcaccuugaagcugaggguguggccuggagg

SEQ ID NO: 162726 - RNA, 64 nt, Human
gggaaccuaugaccccagaggacgcugugaucuccaccuugaagccaggcaggcugcccugaga

SEQ ID NO: 162727 - RNA, 64 nt, Human
gaagauuuuuuuauacaaaaggccacagugaggccaccuugagucaagccgacuaaggccccuc

SEQ ID NO: 162728 - RNA, 64 nt, Human
auuuguagaagaaaucuuguauauacuauuauuacaccuugauaucuauacaaaacaucacuug

SEQ ID NO: 162729 - RNA, 64 nt, Human
uuccuuuuuuuuuaaaaaaacaaaacaaacaaaacaccuugaaucaaguuuguuuguauaugga

SEQ ID NO: 162730 - RNA, 64 nt, Human
gcauuaggcugcaacucugauauacagagacuagcaccuugaauaugccagaaauugaauuacc

SEQ ID NO: 162731 - RNA, 64 nt, Human
gugauggugauaaaacaucaaaaagugaauggaacaccuugauuggggaagauaugcaaauacu

SEQ ID NO: 162732 - RNA, 64 nt, Human
cuccuuaauucuuccugagugccaugggaugcuacaccuugaagcugacagucaucaacagggg

SEQ ID NO: 162733 - RNA, 64 nt, Human
caggacgacaccggguucaggaauauguggcuaucaccuugagcacugacaguggccuuccagg

SEQ ID NO: 162734 - RNA, 64 nt, Human
aagagcugggcaacagcuggcuugugaaaugagacaccuugaccaauaugcuuuggguggacgg

SEQ ID NO: 162735 - RNA, 64 nt, Human
ccucacagccuccagagggaaccagcccugccaccaccuugacccuggacuucuggccugcaga

SEQ ID NO: 162736 - RNA, 64 nt, Human
ucagggacccaggaacucagcuuccaaacaucugcaccuugaccggacucgccaucccgccgug

SEQ ID NO: 162737 - RNA, 64 nt, Human
ugucuuccucccgagccauggccucugcuagcuccaccuugaaggagccccccacauccucccc

SEQ ID NO: 162738 - RNA, 64 nt, Human
caggagcagaugacaguaaaauuucagugaauagcaccuugacaucuacaacuuaaaaauggug

SEQ ID NO: 162739 - RNA, 64 nt, Human
accauuuuuuggaaacccucuccucccuccuccacaccuugagugaugaccacaccaaucacug

SEQ ID NO: 162740 - RNA, 64 nt, Human
aaagagggccuucaccagaacccaagcaugcuggcaccuugaccuuggacuuucagccuccaaa

SEQ ID NO: 162741 - RNA, 64 nt, Human
uagagggaacagaagaaacagaaggggcucaguucaccuugaugauguccuucagagcugugau

SEQ ID NO: 162742 - RNA, 64 nt, Human
agacaggucccuccccuucucugugcaguagcaucaccuugaaagcaguagcaucaccaucugu

SEQ ID NO: 162743 - RNA, 64 nt, Human
uccccagcuuacaccucaagcccagcacgcagugcaccuugaacagagggaggggaggacccau

SEQ ID NO: 162744 - RNA, 64 nt, Human
aaaguuuuguuggcuucagccacacagugauuuacaccuugauugugcugcuuccaggcuguag

SEQ ID NO: 162745 - RNA, 64 nt, Human
ucuggauuuuagaguuauuugagagcccauauuucaccuugaggagggugcugcugcugugaca

SEQ ID NO: 162746 - RNA, 64 nt, Human
cuggucucaaacuccugaccucaagugauccacccaccuugacucccaaagugcugaaauuaca

SEQ ID NO: 162747 - RNA, 64 nt, Human
ccccuccuccaugggcccugcaggaggggagacccaccuugaagugggggaucaguagaggcuu

SEQ ID NO: 162748 - RNA, 64 nt, Human
ccucccuccccuguugucuggccgucgucaaccccaccuugacugaguguugagcccguccuug

SEQ ID NO: 162749 - RNA, 64 nt, Human
cauuauggccuccagaggaaaccaacccugucuccaccuugauauugcacuuccaggcuccaga

SEQ ID NO: 162750 - RNA, 64 nt, Human
guuuucaucauugagccccagacccucugagcagcaccuugaagagggcagauaaucagacuug

SEQ ID NO: 162751 - RNA, 64 nt, Human
cagguugcuauagaaacccaggcucugccucuugcaccuugagggggugggaggggcugguguc

SEQ ID NO: 162752 - RNA, 64 nt, Human
uagagggaagagaagaaacagaagcggcucaguucaccuugauaaggugcuuccgagcugggau

SEQ ID NO: 162753 - RNA, 64 nt, Human; identical to SEQ ID NO: 162752

SEQ ID NO: 162754 - RNA, 64 nt, Human
ggacacuuucgagcucccagcuccagcuucgucucaccuugaguuaggcugagccacaggcauu

SEQ ID NO: 162755 - RNA, 64 nt, Human
uuuaguaaaacaccccagagucagggaagccaaccaccuugaaaccuuuagaacaucucugcuu

SEQ ID NO: 162756 - RNA, 64 nt, Human
ucucaguuuugucccucugaagauaauuuuggaucaccuugaauuuccuuuuggacguuauuug

SEQ ID NO: 162757 - RNA, 64 nt, Human
gaaguggguccucaccagaaaacaaaucuguaagcaccuugaucuuggacuucucagccuccag

SEQ ID NO: 162758 - RNA, 64 nt, Human
aagagguggccaggguucccagaaggaaggaacucaccuugaacuuagcuuucuuugaagggua

SEQ ID NO: 162759 - RNA, 64 nt, Human
ucugguagcugagacugcaugcccagcuccaaaucaccuugauucauaucagcaguaauaauca

SEQ ID NO: 162760 - RNA, 64 nt, Human
cuugucauacuguauugacuguguacgugccuuucaccuugagcaugcuucaggauuuuuuuuu

SEQ ID NO: 162761 - RNA, 64 nt, Human
uggaaauucuuuguggcagauaacuggcuuaugacaccuugaaaaguucaagugcucauauaac

SEQ ID NO: 162762 - RNA, 64 nt, Human
gacaggagaccuggcacuggaugcagaaacaguucaccuugaagaaccucucacuucacccugg

SEQ ID NO: 162763 - RNA, 64 nt, Human
ugugguguuccacaugugccuguuuccacgccagcaccuugacuuggcagcauggagccaaggu

SEQ ID NO: 162764 - RNA, 64 nt, Human
uacauaugggucuggaaaaacuguacacuguugucaccuugaccauuaaaaaccagaaugagga

SEQ ID NO: 162765 - RNA, 64 nt, Human
gcaaaaugguuuaaugcccccuacauauuuccaucaccuugaacaauagcuuuagcuugggaau

SEQ ID NO: 162766 - RNA, 64 nt, Human
gcccacguccgucaccuccccauccccuaguccccaccuugaacaucaugagcuguuguuauua

SEQ ID NO: 162767 - RNA, 64 nt, Human
aagggaccccugcucccagccugcugagagcccccaccuugaucccaauccuuaucccaagcua

SEQ ID NO: 162768 - RNA, 64 nt, Human
cugagugacagguggcuguucagguggaccaaagcaccuugacacaaggacuccacacugugcu

SEQ ID NO: 162769 - RNA, 64 nt, Human
aaauuugaacuccuuccuaaagaaacccagcagccaccuugaaaaaggccauuguggagcccau

SEQ ID NO: 162770 - RNA, 64 nt, Human
gccaggaaaugggggaaggaacuagaaccaccugcaccuugagauguuucuguaaauggguacu

SEQ ID NO: 162771 - RNA, 64 nt, Human
cuggucucgaacuccuggacucaagcaauccgcccaccuugacuucccaaagugcugggauuau

SEQ ID NO: 162772 - RNA, 64 nt, Human
cggugcgacccaguugcugggggcuugguuuccucaccuugaaaucgggcuucacgcgucuugc

SEQ ID NO: 162773 - RNA, 64 nt, Human
cuagauugugaggaaugacacaccacucccuccccaccuugaaucccuaauuagauuaaggaau

SEQ ID NO: 162774 - RNA, 64 nt, Human
acaagccagagaacaaaccgguaagauggcagaucaccuugaaggccuuuccagugaugaugaa

SEQ ID NO: 162775 - RNA, 64 nt, Human
uuguuuuuaaccucacauuaaggaaagcacacaucaccuugaaagguugcacacuuacuccuau

SEQ ID NO: 162776 - RNA, 64 nt, Human
uauuuauuugccggacacucauuugauugauuugcaccuugaacacuauacuaggucuuuucag

SEQ ID NO: 162777 - RNA, 64 nt, Human
agagcauguguguuugaacaauaugaaaucugggcaccuugaaaaaagaacaggauaacagcaa

SEQ ID NO: 162778 - RNA, 64 nt, Human
cuucaccuuccaccugagaggggacucucguugccaccuugaccuuggcuggggcuugcauccc

SEQ ID NO: 162779 - RNA, 64 nt, Human
cucuuagcccaacucaaacuccaucagaucuucucaccuugauuuugagcuggaauguuucaau

SEQ ID NO: 162780 - RNA, 55 nt, Human
aauacaaagcaaaacaguaauauaccaccuugauuuccauuacaaaguaucugau

SEQ ID NO: 162781 - RNA, 50 nt, Human
ucccaaagagccaggaauaacaccuugauuuuguaauuuagaagcaacac

SEQ ID NO: 162782 - RNA, 64 nt, Human
aaagcuuucucaugaucauauuucacccacaucucaccuugaagaaacuuacagguagacuuac

SEQ ID NO: 162783 - RNA, 64 nt, Human
cuuuuuaauguuccauguuugguuuuaugugcagcaccuugacuucuaagaaaugaaucauguc

SEQ ID NO: 162784 - RNA, 64 nt, Human
uuauuuuuuuaaaaugagucgugggguagugcuucaccuugagaugcuuugaaagagcccuaaa

SEQ ID NO: 162785 - RNA, 64 nt, Human
ugcuuuggcaaaugccgaggaguccucgguagaccaccuugaugucugcugugacaucagaggu

SEQ ID NO: 162786 - RNA, 64 nt, Human
gagagcacaugaagcuuugcuaauuauaaccccucaccuugaccagagucauugauguccugau

SEQ ID NO: 162787 - RNA, 64 nt, Human
ccugagagcuaaaaaacugaaaggaauuuuuccacaccuugaagucacaguguuuuagaguaaa

SEQ ID NO: 162788 - RNA, 64 nt, Human
uaagcauuaggaaggcuagccaguuauucaauagcaccuugauaaugugggcaaacccuucuac

SEQ ID NO: 162789 - RNA, 64 nt, Human
uuaguuucaggccccaaaauaacacgagccccuccaccuugauagcuccuugauaucccaaucu

SEQ ID NO: 162790 - RNA, 64 nt, Human
auuagcggggagagagauggagcaucgagugacacugggccauccaggcggcucugcucccacc

SEQ ID NO: 162791 - RNA, 64 nt, Human
ccaggcccccaccacuaggacucugaggcucuuucugggccaaguuccucuagugcccuccaca

SEQ ID NO: 162792 - RNA, 64 nt, Human
gcuccacuucucagcucuccccugcccugcagcccugggccagacaaggccagaagguuucagg

SEQ ID NO: 162793 - RNA, 64 nt, Human
uccucaugugacuucugggaaggcgcucccucaucugggccaaaggaaggaggacgaagcccuc

SEQ ID NO: 162794 - RNA, 64 nt, Human
caggccucaccaaagcccacugccauggggccaucugggccauucagagacuggagugagauuu

SEQ ID NO: 162795 - RNA, 64 nt, Human
agaccugcugcucuaugcucacccccgccccauucugggccaaugugauuuuauuuauuugcuc

SEQ ID NO: 162796 - RNA, 64 nt, Human
cugggagaaacagcuucaccccagccucagggcccugggccaucacugcaguggcccugggagg

SEQ ID NO: 162797 - RNA, 64 nt, Human
gggaggcaccaggguucuuguuuggacccugccccugggccauggccaggugaccauggcuaca

SEQ ID NO: 162798 - RNA, 64 nt, Human
guuagagugauuggacccuuccuauuggucuguccugggccaacuggugggugaucucugcugc

SEQ ID NO: 162799 - RNA, 64 nt, Human
ugcucugcuucugcuuuccaaaguagcccagguccugggccagaugcaggggaggugccuaucc

SEQ ID NO: 162800 - RNA, 64 nt, Human
cucaacuccagccaccugccccagcucgacggcacugggccaguucccccucugcucugcagcu

SEQ ID NO: 162801 - RNA, 64 nt, Human
gagaccgggagguuuaggcucagauaagugagcucugggccaugagaggguagguccagaaggu

SEQ ID NO: 162802 - RNA, 64 nt, Human
gaucccuuccauggagcaggucaucucggguucacugggccagggauggucucuguuccccagc

SEQ ID NO: 162803 - RNA, 64 nt, Human
cuaaaggcaaugagauuggguggaagagaagggucugggccagggacuggagaggugggggugg

SEQ ID NO: 162804 - RNA, 64 nt, Human
auuucccuuggauaaauaccuagguaggggauugcugggccauaugauaagcauauguuucagu

SEQ ID NO: 162805 - RNA, 64 nt, Human
caauauuuauuuauugagaguuuuuuagugcaaucugggccaguauuuuuauagauuaugauua

SEQ ID NO: 162806 - RNA, 64 nt, Human
ucugucuugcaugucuccuaccaugucacugucccugggccacccagugaaagcaaagccuggg

SEQ ID NO: 162807 - RNA, 64 nt, Human
auauuugauauauuuuuaauuuuguagcguguggcugggccaggccccagcgggaggggcugag

SEQ ID NO: 162808 - RNA, 64 nt, Human
uuagguuaaaguacuugauaccagacugcggcuucugggccacaugcuauggcaugaugggggu

SEQ ID NO: 162809 - RNA, 64 nt, Human
aagcugccuuuggugacacacugagugaaagggacugggccagcucaguggaccguguggaaca

SEQ ID NO: 162810 - RNA, 51 nt, Human
gcucuggaggcugcugcugaccugggccaugaggagcacggaggagaagga

SEQ ID NO: 162811 - RNA, 64 nt, Human
ccggcagcacggcccgcuuuccuucuccuccaugcugggccagccagauaagucaggguccugg

SEQ ID NO: 162812 - RNA, 64 nt, Human
cccccacaucucuauguacauagggaacuuaguucugggccauguacagaaaauaucacuguaa

SEQ ID NO: 162813 - RNA, 64 nt, Human
caagacuggggcccuguucaccuugaacaugccccugggccaagauggggcuucaccccucccc

SEQ ID NO: 162814 - RNA, 64 nt, Human
ccaguggucuccaggggugcaggaguaacuggggcugggccagccuccccacuuacaaggcugc

SEQ ID NO: 162815 - RNA, 64 nt, Human
ggucugcacugcaaccuccaccaggaccaggauccugggccacaggcugggaugguccuuccaa

SEQ ID NO: 162816 - RNA, 64 nt, Human
cauaccaggugcuagggugccugcucuccuugcccugggccagcccaggauuguacgugggaga

SEQ ID NO: 162817 - RNA, 64 nt, Human
cggggaggagccuuggaguguaauuaccugucaucugggccaccagcuccacuggccugcccgu

SEQ ID NO: 162818 - RNA, 64 nt, Human
cucuggcucaaagaggccgagaaacccaguucuccugggccaaggaucccuucuggcaaagcug

SEQ ID NO: 162819 - RNA, 64 nt, Human
aacacguagacaggcuguaauauucaaaccaccucugggccaaugcauuuccaaaggaugccuu

SEQ ID NO: 162820 - RNA, 64 nt, Human
cgauuugagccucuccggcugccagccagggggccugggccagaccagggcucuguccuuccgu

SEQ ID NO: 162821 - RNA, 64 nt, Human
ggggucucuguuuccauuacaaacuuuguucugucugggccagagaaccuagccuuugaaaucu

SEQ ID NO: 162822 - RNA, 64 nt, Human
ccaccguguggaucugagggcgcuggcuugcgagcugggccagggaggaggaggguuggggggc

SEQ ID NO: 162823 - RNA, 64 nt, Human
cccucucucugcuccuccauucgcaagugucuuccugggccagacuccccuccaccucauguac

SEQ ID NO: 162824 - RNA, 64 nt, Human
agggcaggugcaggccgccugccccgccacgcuccugggccaacucugcaccguucuaggugcc

SEQ ID NO: 162825 - RNA, 64 nt, Human
gagaacugcaaauagggaggcccugggcuccuggcugggccagcagcugcaccucuccugucug

SEQ ID NO: 162826 - RNA, 64 nt, Human
ugccccucgcucacagaccacacacccagcccuccugggccagcccagagggcccuucagaccc

SEQ ID NO: 162827 - RNA, 64 nt, Human
aaugccaucacauggaggacgaggcccagcucagcugggccagagcccagaagugccaccucau

SEQ ID NO: 162828 - RNA, 64 nt, Human
ugugggaaaaugacugucaauaaaaugcggguuucugggccauucgucuuacuuucauuuuuug

SEQ ID NO: 162829 - RNA, 64 nt, Human
cggccucucugucaugcugggaagugccuacucucugggccacugcugcagaggccguggcacu

SEQ ID NO: 162830 - RNA, 64 nt, Human
cagcuccuguccccagcgaagaauccggcugccccugggccagucccaggaccuuugcacagga

SEQ ID NO: 162831 - RNA, 64 nt, Human
ugaagaaacagaguggccucccugcugugccaugcugggccacuggggacuuuauuuauuucua

SEQ ID NO: 162832 - RNA, 64 nt, Human
cagugagccucgacucugucccugcugaaaauagcugggccagugucucuguagcccugacaua

SEQ ID NO: 162833 - RNA, 64 nt, Human
cuaccuuccucacuguaucuuugcccagacccaccugggccaguaggccccuguccccagccac

SEQ ID NO: 162834 - RNA, 64 nt, Human
uccuggaagagcucccagaagauaaccucuccuccugggccaccuggggcaccuuaccaccgga

SEQ ID NO: 162835 - RNA, 64 nt, Human
aaggcuccucugcuugggauucuucagacagaagcugggccagcacuguggacuccuccuggga

SEQ ID NO: 162836 - RNA, 64 nt, Human
ucccaggggauucagagucuccagaaagauauggcugggccaacucuguugccuaccuggccug

SEQ ID NO: 162837 - RNA, 64 nt, Human
guauaaagcuagugugacccugcucuuccagcuccugggccagcucuggaagggcuguauuugg

SEQ ID NO: 162838 - RNA, 64 nt, Human
cugccugggaggcuuuuggugguccccacagccucugggccaagacuccugucccuucuuggga

SEQ ID NO: 162839 - RNA, 64 nt, Human
gugcaauagucagagugucccuuuuugcaggggacugggccauggguccucggcccaucugucc

SEQ ID NO: 162840 - RNA, 64 nt, Human
cuggcugcagugagagaccaaccccuaacaagggcugggccacagcagggaguccagcccuacc

SEQ ID NO: 162841 - RNA, 64 nt, Human
gucagcccuaccccaacccuucaacuaccagaaucugggccaccccagcaguauuuuuauuuaa

SEQ ID NO: 162842 - RNA, 64 nt, Human
cagcccuugacuguccuccugugagggccugaagcugggccagggcccgucgcagcggagcccc

SEQ ID NO: 162843 - RNA, 64 nt, Human
aaaaaugaguguucggugaaacaagugggauuuucugggccagcaagucuuccaaacuguauau

SEQ ID NO: 162844 - RNA, 64 nt, Human
cacuccuccaccccacacacugaagcaguagcuucugggccaaaggucagggugggcgggggcc

SEQ ID NO: 162845 - RNA, 64 nt, Human
ggcuaucccucuaaggcgcaaggugaagaagcuucugggccaggaaggaaaaaaaaaugcccac

SEQ ID NO: 162846 - RNA, 64 nt, Human
gucuuugggccccuuacucaguauccugggaacccugggccaggagguuacaguggucaucaua

SEQ ID NO: 162847 - RNA, 55 nt, Human
auggagccggcccucggugaugggucugggccaccaggaucagccaggagggcgu

SEQ ID NO: 162848 - RNA, 64 nt, Human
gacaaguguuaaggcaacauuccuuucuugugcccugggccaaaaccaaugcugaugaccuuau

SEQ ID NO: 162849 - RNA, 64 nt, Human
uuccccaucaacaaacacuugagggccuguaugccugggccaagggauuuuuacauccuugauu

SEQ ID NO: 162850 - RNA, 64 nt, Human
cucacuguugcaucuucuguaggaccauuuaagucugggccacuuaauggcugccagcauuccu

SEQ ID NO: 162851 - RNA, 64 nt, Human
aagaguaauagacaugcaaaaguuucaauaaaaacugggccauuaacaaauaaauuaauaaacu

SEQ ID NO: 162852 - RNA, 64 nt, Human
guugucaccuucaccuccuuucaagguaacuguacugggccauguugugccucccuggugagag

SEQ ID NO: 162853 - RNA, 64 nt, Human
uuauuaagaaacguaaugacauaaaagguuagcucugggccagacuucucuuacucugugggua

SEQ ID NO: 162854 - RNA, 64 nt, Human
uucaggccucugaggagcccacggggcaaagcugcugggccaguggcacucugugugggaaaau

SEQ ID NO: 162855 - RNA, 64 nt, Human
cccaucacccagcccugccucccucccagcagcccugggccacagcccccgccccuggcuuuuc

SEQ ID NO: 162856 - RNA, 64 nt, Human
ccucagucugguauccagacugugaaaucagccucugggccaaggaggguccuacagacaaggu

SEQ ID NO: 162857 - RNA, 64 nt, Human
ggugcgaagcccagaggaggcggcuugggauccucugggccaucccuggcccuguagcacagac

SEQ ID NO: 162858 - RNA, 64 nt, Human
cagcccuggagccaucacuacucacaccgugguccugggccagggccugagaugacagugggga

SEQ ID NO: 162859 - RNA, 64 nt, Human
agggacauggacccacgugcuugaggccuggcagcugggccaagacagauggggcuuuguggcc

SEQ ID NO: 162860 - RNA, 64 nt, Human
cacuaggacuacuuuuuaccaaaagagaagcagucugggccagaugcccugccaggaaagggac

SEQ ID NO: 162861 - RNA, 64 nt, Human
ucagugagauaaauuagauuuggcaucuccuguccugggccagggaucucucuacaagagcccc

SEQ ID NO: 162862 - RNA, 64 nt, Human
uccuuuguuuuauuagaaccauggaagaagguuccugggccaucaguauguguugcagagcuca

SEQ ID NO: 162863 - RNA, 64 nt, Human
gugggugagaaugaaaacuugagacucccaaguucugggccagcccauugcucugggcuguuuu

SEQ ID NO: 162864 - RNA, 64 nt, Human
uaaggguggugaugggugagcgcucuggcccaggcugggccagacucccgcccaagcaugaaca

SEQ ID NO: 162865 - RNA, 64 nt, Human
aacgccucugcagcugcagcccucguucucuuggcugggccaagagggccuuccuggauuucuu

SEQ ID NO: 162866 - RNA, 64 nt, Human
uggcccuugagggcagccugcuguacuggccaugcugggccagccccaccuggagcucaguaaa

SEQ ID NO: 162867 - RNA, 64 nt, Human
gugugcaggggcagagaaggaagggaccaggggacugggccaguauguggaggauggggccugc

SEQ ID NO: 162868 - RNA, 64 nt, Human
cugcugcuagucuccaauugccaagggaauuuaacugggccagacuaccuuuuuauacuagguc

SEQ ID NO: 162869 - RNA, 64 nt, Human
gaagucagagacuaucgggggccauggagacacucugggccauuuuuaugagguagucuaggcu

SEQ ID NO: 162870 - RNA, 64 nt, Human
cugcagccccugggagcacacacugggugcagcccugggccaggcacgggaggcccugcccugu

SEQ ID NO: 162871 - RNA, 64 nt, Human
gauccccaaccccgguggguacuggcugccugcccugggccagggaauggcuccuuauaccaaa

SEQ ID NO: 162872 - RNA, 64 nt, Human
cugucuggaagcaccauccccuaucgcaggacuccugggccacaagcagucggucagugcagac

SEQ ID NO: 162873 - RNA, 64 nt, Human
ggccugguuguacccacuggccucugccucugcccugggccaaaagggccccuccuugccaggg

SEQ ID NO: 162874 - RNA, 64 nt, Human
auuuuuuaaacugcuauuuucugaauggaacaagcugggccaaggggcccaggcccuguccucu

SEQ ID NO: 162875 - RNA, 64 nt, Human
ucuccacaggccauccauucacagccaggagaugcugggccaguuccuccaagagguguguaug

SEQ ID NO: 162876 - RNA, 64 nt, Human
ucauguucugcgguucuugaacacacggaugccucugggccaccuguccuuuuccgagggugug

SEQ ID NO: 162877 - RNA, 64 nt, Human
uggguuuuuauuaauaugcugauuaaguuauuuacugggccagucauugugcuaaauaguugcu

SEQ ID NO: 162878 - RNA, 64 nt, Human
acccauuccccugagagcaagaagccuguguggucugggccagucucugccauguccugagucu

SEQ ID NO: 162879 - RNA, 64 nt, Human
aggccagaguaucgcccugggaugugguggggagcugggccaggagagggacugacugugaccc

SEQ ID NO: 162880 - RNA, 64 nt, Human
ggcaggagcugacuguggacuggugggcuccccucugggccagcacaguccccucaccucuggc

SEQ ID NO: 162881 - RNA, 64 nt, Human
ucuuuucagaaggcuaaagucagaggaaugggggcugggccacucccuuggagcucucagaucu

SEQ ID NO: 162882 - RNA, 64 nt, Human
guuucacucuguuucccaggcuggucuugaacuccugggccaugccuggccagggacaugaauu

SEQ ID NO: 162883 - RNA, 64 nt, Human
agccaguaacugagggcccacugccugcccggcccugggccaggcccucaacagaagccaucuc

SEQ ID NO: 162884 - RNA, 64 nt, Human
gcaguguuucuuuuugaugucuuuuauuuuacaacugggccaaaggcacauuauguauauaauu

SEQ ID NO: 162885 - RNA, 64 nt, Human
cacuccugggggcuguggggaagacacccccugccugggccauggccagcucuagguggauucu

SEQ ID NO: 162886 - RNA, 64 nt, Human
gcccaugcuggcugcagucucuguggcugccugccugggccagccuguuugggagcugggacug

SEQ ID NO: 162887 - RNA, 64 nt, Human
aucaagaaaauugcauauuuccauucuggucuuucugggccagauuuuuauauugguuuucagu

SEQ ID NO: 162888 - RNA, 64 nt, Human
ccuaaacacuaccaaauagcucuucuggggcaggcugggccauguccaaagaggcugccccucu

SEQ ID NO: 162889 - RNA, 64 nt, Human
guuaggaagcuacugcaagguuccaggcuugggccugggccacagcaacagcaguggucaaaua

SEQ ID NO: 162890 - RNA, 64 nt, Human
ucacuguaaugaugugagcagggagccuuccucccugggccaccugcagagagcuuucccacca

SEQ ID NO: 162891 - RNA, 64 nt, Human
gcugagauuucuacagcaauaaaggagacacacacugggccagagaggccugccuucugccugc

SEQ ID NO: 162892 - RNA, 64 nt, Human
agaccuaauuuccuucuguucuccuuguucuguucugggccagugaagguccuuguucugauuu

SEQ ID NO: 162893 - RNA, 64 nt, Human
uggagagugcaacaguagcauaggacccuacccucugggccaagucaaagacauucugacaucu

SEQ ID NO: 162894 - RNA, 64 nt, Human
ccuucccucggggccauacuucuguuuccaucugcugggccaccagccacuuuagugaccccug

SEQ ID NO: 162895 - RNA, 64 nt, Human
uccuggggaggcugggacucccccugccacaagccugggccacagcucacauuccacugcuggg

SEQ ID NO: 162896 - RNA, 64 nt, Human
ucucgccauucucaugucagacugaaaggagggccugggccagcuuugaaaaggcaggaugaaa

SEQ ID NO: 162897 - RNA, 64 nt, Human
cggcccagauucacuugaagcagaaguuagcauccugggccaguuuguucucucagaacccaga

SEQ ID NO: 162898 - RNA, 64 nt, Human
uauguucugaguuaggcagaacauagccauggcccugggccacccugugcuaucugaaaugacc

SEQ ID NO: 162899 - RNA, 64 nt, Human
agagggcaacauguuccaagcaaaaucuccccgccugggccaugggcucacccucggggcuccc

SEQ ID NO: 162900 - RNA, 64 nt, Human
cucuccguccucagggcugugccucugggagccacugggccaggggccccgggucgcagagagc

SEQ ID NO: 162901 - RNA, 64 nt, Human
agggcuccucuggcccgcaguggccuggaucuaucugggccaugagugacgggcagugaccaga

SEQ ID NO: 162902 - RNA, 64 nt, Human
ggggccuucugcugcugccacacccagcucaggccugggccagccccugcccccagcccacuga

SEQ ID NO: 162903 - RNA, 64 nt, Human
gugcugcucugcugcucuggauggcugaaggcuccugggccaucuucaugugcugcuugaagag

SEQ ID NO: 162904 - RNA, 64 nt, Human
augggcucugcacaccaacuccaggaaacucauucugggccagcucuaugcaaagggaaaagca

SEQ ID NO: 162905 - RNA, 64 nt, Human
gcugccuucccuuugcaccagcccgagucuaggucugggccaagcacauuacaagugggaccgg

SEQ ID NO: 162906 - RNA, 64 nt, Human
acucgcccaggacauggacuggucucucagaccccugggccaccauguaggccaccacuccagg

SEQ ID NO: 162907 - RNA, 64 nt, Human
cugggaaccacagcuccacaagggggagaggcagcugggccagaccgaggucacagccacucca

SEQ ID NO: 162908 - RNA, 64 nt, Human
gcuccccacccgccagcuccaggacugccccuuccugggccaacuaaccagacaacugggaaga

SEQ ID NO: 162909 - RNA, 64 nt, Human
ggaucccgcacaagcucccuucaguccuucagggcugggccaugugguugauuuuucuaaagcu

SEQ ID NO: 162910 - RNA, 64 nt, Human
ccagacagcuucccagcaggcccuagagcccggccugggccaaugauggagggcggccgccagc

SEQ ID NO: 162911 - RNA, 64 nt, Human
agugaaucaugaucgugcgcuacugcacuccagccugggccacagagcaagacugucucaagaa

SEQ ID NO: 162912 - RNA, 64 nt, Human
accccaguccacgguguucuggcagcagggacaccugggccaaugggccaucuggaccaaaggu

SEQ ID NO: 162913 - RNA, 64 nt, Human
ugcauuccaaguguugccugcaugccuguucugucugggccacauucacagauucaggauucuc

SEQ ID NO: 162914 - RNA, 64 nt, Human
gggugcucaggugagcccucucuauagugcuucccugggccaagcugacaccagccccugaggg

SEQ ID NO: 162915 - RNA, 64 nt, Human
uucuaccugccuuugacuugcuucuaggcauagccugggccaagcaggguggggaauggaggau

SEQ ID NO: 162916 - RNA, 64 nt, Human
gcacccagugucccagccuuacuggguccuuacccugggccaaacagggagggcugauaccucc

SEQ ID NO: 162917 - RNA, 64 nt, Human
ugcuuagcugccuugagcuaaccccaagcugccucugggccaugccaggccagagggcaguggc

SEQ ID NO: 162918 - RNA, 64 nt, Human
augugccuuaaugcuucauaugaggaggaugucccugggccagggucugugugaaugugggcac

SEQ ID NO: 162919 - RNA, 64 nt, Human
uuugccuuagcaggggugacuuugucucuccuggcugggccauccuuccgccaaucuggcccuu

SEQ ID NO: 162920 - RNA, 64 nt, Human
aaccgcauuuugaggguguaaccaguagucaccucugggccagguuggaaaagaaaucaauuuu

SEQ ID NO: 162921 - RNA, 64 nt, Human
ccccggccucugucaccugagacccaaccccuagcugggccaacuccagugaauucacccauuu

SEQ ID NO: 162922 - RNA, 64 nt, Human
aguggcuccaguagcucuggauuuucugccagggcugggccauuguggugcugccccaguauga

SEQ ID NO: 162923 - RNA, 64 nt, Human
ugcgcucaugaaaaauaaggccaaaacaagaguucugggccacagcucagcccagaggguuccu

SEQ ID NO: 162924 - RNA, 64 nt, Human
agguaggcaccacagagaagaccuucuagugagccugggccaggagcccacagugccuguacag

SEQ ID NO: 162925 - RNA, 64 nt, Human
ggaccuggcccuucucccacugggcucccccauccugggccaaggccagaacuuuagugcuagg

SEQ ID NO: 162926 - RNA, 64 nt, Human
ccagcacccugucccuggagcaccucuguccugucugggccaaccuggucucccugccccaugc

SEQ ID NO: 162927 - RNA, 64 nt, Human
ccaggggcaggccaggcauggcucagugcagucccugggccagugagaggccucccccaugccu

SEQ ID NO: 162928 - RNA, 64 nt, Human
uuuaaccagcccacccagcagucaguacacaugccugggccaagucuaagaaacucagugugug

SEQ ID NO: 162929 - RNA, 57 nt, Human
aggcggcaggccucaucugaccccacccugggccacugcccugcuccagagagugga

SEQ ID NO: 162930 - RNA, 64 nt, Human
gcaacggcucugaggucucggccagcuucgacggcugggccaccgucucggugaucgcgcucuc

SEQ ID NO: 162931 - RNA, 64 nt, Human
gaaccagaagaaaccucgguucccacugauccuucugggccacguugugcggagcuccccugcu

SEQ ID NO: 162932 - RNA, 64 nt, Human
ucgugugcccaccagcggccuugaagaggcaggucugggccagaugcugggcaggaaaccccag

SEQ ID NO: 162933 - RNA, 64 nt, Human
gcugguuguugccagguugcagcugcucuugcaucugggccagaaguccucccuccugcaggcu

SEQ ID NO: 162934 - RNA, 64 nt, Human
cccgugucuggaugcacagaugccauggccugugcugggccaguggcugggggugcuagacacc

SEQ ID NO: 162935 - RNA, 64 nt, Human
auaccugggcaucgacccagccugcaggugagcucugggccauguugccuugacacagucacag

SEQ ID NO: 162936 - RNA, 64 nt, Human
gggguguucaaggccacaggacaaggggagcacccugggccacacaggcguggaggugucccca

SEQ ID NO: 162937 - RNA, 64 nt, Human
gcacuuaagcacaagcagagugcacagcuguccacugggccauuguggugugagcuucagaugg

SEQ ID NO: 162938 - RNA, 64 nt, Human
uugcaaaccaaagccauuuggcaagcccuguagccugggccauuuaagacaggggcggucucag

SEQ ID NO: 162939 - RNA, 64 nt, Human
acgcccccagacagcuugguggaggguccugcaucugggccaggcuggggugcacccagccaaa

SEQ ID NO: 162940 - RNA, 64 nt, Human
cugccacggccuccuggcuccagaggcagcugggcugggccaaggcaggaaggcgcccccaugu

SEQ ID NO: 162941 - RNA, 64 nt, Human
ggggacccuuuuacuugcccugaacauacacaugcugggccauugugauugaagucuucuaacu

SEQ ID NO: 162942 - RNA, 64 nt, Human
agcaacuaugguugauugaaaagugucucaaaaucugggccaagaaugauugcuagguccauaa

SEQ ID NO: 162943 - RNA, 64 nt, Human
aaaaucaacuuguguacugauaaaauacucuagccugggccagagaagauaauguucuuuaaug

SEQ ID NO: 162944 - RNA, 64 nt, Human
ccauccuagucaacacuggauccaccuagugccucugggccauaaggcugagcagagugagcuu

SEQ ID NO: 162945 - RNA, 64 nt, Human
cugccccgucccccuagagacucagaggacccaccugggccaaggacuccaaagccgcggggac

SEQ ID NO: 162946 - RNA, 64 nt, Human
gccacagccauggugggaguggccuggaccugcccugggccacacugacccugauacaggcaug

SEQ ID NO: 162947 - RNA, 64 nt, Human
aacguuuaacauugauuggauaaaugcuuauaggcugggccagguggcucccaccuguaguccc

SEQ ID NO: 162948 - RNA, 64 nt, Human
uguuuaaaaccaucacaacagcaauauuuuuauucugggccaccucucgacuggcacucauccc

SEQ ID NO: 162949 - RNA, 64 nt, Human
auaccucugaggaccuacccagcagucuaggacccugggccaagugcugggacuaugguacuaa

SEQ ID NO: 162950 - RNA, 64 nt, Human
agagaggaagaagagggcaggguggggaggagcucugggccagaggaugcugagcugccugggc

SEQ ID NO: 162951 - RNA, 64 nt, Human
gugugggaaccccucugccuggcaccuggauacccugggccagguaaccugagggcaggggaga

SEQ ID NO: 162952 - RNA, 64 nt, Human
uuuucaugucccccaccucauguuuucaccuuuucugggccaggcauagauuaaguaacuggga

SEQ ID NO: 162953 - RNA, 64 nt, Human
gggcaggauggucauucucaaaaacccugggguccugggccagagacaggcagggcccagucca

SEQ ID NO: 162954 - RNA, 64 nt, Human
ggccccagggcccaggagggacagugccuggagccugggccaggcccagcccaucugugugugu

SEQ ID NO: 162955 - RNA, 64 nt, Human
cgcauacacacggccaugcacgcacacacugggccugggccagggccccagagcuccugccuga

SEQ ID NO: 162956 - RNA, 64 nt, Human
ccucagccccuggccuggcugaguuuggcagggccugggccaucccugggacaaaggugcgucc

SEQ ID NO: 162957 - RNA, 64 nt, Human
auugcagccacccggccgccaaggcaggcuugggcugggccaggacacguggggugccugggac

SEQ ID NO: 162958 - RNA, 64 nt, Human
gcugagggauuuggaagccauuuggggaggcaggcugggccaaaggguagagcuggguaauaaa

SEQ ID NO: 162959 - RNA, 64 nt, Human
uccuaaauaauaacaauagcauugucaguggaggcugggccaccauggcagaccuuccaaaagu

SEQ ID NO: 162960 - RNA, 64 nt, Human
cgaggcgcggagaggcggcgggaaagagcuucggcugggccacgggcucgcgggcacucucggc

SEQ ID NO: 162961 - RNA, 64 nt, Human
ggugggugagguaugaagggcccagagcagagcccugggccaaggaacacccccuaguccugac

SEQ ID NO: 162962 - RNA, 64 nt, Human
guuccagagguggaaguuacagaagaggagguaccugggccacacgacaugagcuggaaaaucu

SEQ ID NO: 162963 - RNA, 64 nt, Human
auccgacacaggaggaaccccuucucugguugagcugggccaggccuaagaguagcaggaacuc

SEQ ID NO: 162964 - RNA, 64 nt, Human
uuagcuuccaggacuguucaaucuuuuggcuucccugggccacauuggaagaauugucuugggu

SEQ ID NO: 162965 - RNA, 64 nt, Human
gggccaggcagccuccccagcugaggcaucauuccugggccagagucguguccaccaagggaca

SEQ ID NO: 162966 - RNA, 64 nt, Human
ugcauuaucuuuaugucacugcuuugccuuuucucugggccaagucauggugaaacaagaaagc

SEQ ID NO: 162967 - RNA, 64 nt, Human
cagggaggggcagggcaaggcagggcccccagagcugggccacacagugggugcugggccucgc

SEQ ID NO: 162968 - RNA, 64 nt, Human
accucucuuuuugacagaggacaagggcguggaucugggccagaagccaaaccccuacuucuac

SEQ ID NO: 162969 - RNA, 64 nt, Human
cucgccucccugcaggggccgcuaccugguggcgcugggccacgcguaccacccggaggaguuu

SEQ ID NO: 162970 - RNA, 64 nt, Human
ggaggagcccugugcucccagcucagaggacagucugggccagaacuggaaggagacaucuguc

SEQ ID NO: 162971 - RNA, 64 nt, Human
ugcuguucucuguugccagggggcaggucugggccugggccaaccacguuuguuaucauggcug

SEQ ID NO: 162972 - RNA, 64 nt, Human
ccagagagaggggccugcaggugagcaggcagggcugggccaggucuccggggaggcagggguc

SEQ ID NO: 162973 - RNA, 64 nt, Human
aagugucucaguuugccuugcggggagggggcuccugggccaugggacuuccagugcuaaaacu

SEQ ID NO: 162974 - RNA, 64 nt, Human
cagacugaaagaaacaugccugcagggucaggaacugggccacuguucccagaacggguugugc

SEQ ID NO: 162975 - RNA, 64 nt, Human
ucacugcgaugcuggacacuacagguaucugucccugggccagcagggaccucugaagccuucu

SEQ ID NO: 162976 - RNA, 64 nt, Human
caauugugcauagauauauauaugcccacacacacugggccaugcuugccaaggaacagcccac

SEQ ID NO: 162977 - RNA, 64 nt, Human
uuuucugaccuaauaauuacgggaaauggaaagucugggccagcaucaauaaaaugacaccaaa

SEQ ID NO: 162978 - RNA, 64 nt, Human
aauccuguuaaugagaaggcugaaucacaggcaccugggccaaagggugugagcauucauguuc

SEQ ID NO: 162979 - RNA, 64 nt, Human
cccgcaggagcugggcccccucacgccugccuuccugggccagcuuccugcuugcagucacucg

SEQ ID NO: 162980 - RNA, 64 nt, Human
uuuuuuuguuggcaaaagaaucucaggaacggcccugggccaccuacuauauuaaucaugcuag

SEQ ID NO: 162981 - RNA, 64 nt, Human
uagaauguuuaacuuaagaauuauuucaguuugucugggccacacuggggcagaggggggaggg

SEQ ID NO: 162982 - RNA, 64 nt, Human
ccucccaagagggcuccucacuaucuagggagcccugggccagggcguggagagcccucagucg

SEQ ID NO: 162983 - RNA, 64 nt, Human
cuggaggccaagcagcugagccaaagaagaucaccugggccagggccuacgugacacaaggaga

SEQ ID NO: 162984 - RNA, 64 nt, Human
gccaucaggauuugcuauuuaaguggcuugacaacugggccaccaaagaacuugaacuucaccu

SEQ ID NO: 162985 - RNA, 64 nt, Human
cucccuuuugagucaguucuaaucccaugugugucugggccaccagaccgaaaugguugcugag

SEQ ID NO: 162986 - RNA, 64 nt, Human
auaugaagaccaaaugauagaacuguacuguuuucugggccagugagccagaaauugauuaagg

SEQ ID NO: 162987 - RNA, 64 nt, Human
ucaaagaacagcuguggaaagaagucacaaaacacugggccaccaggaacacaccuguagccca

SEQ ID NO: 162988 - RNA, 64 nt, Human
ccuacucagugauugggaaauucccugucuugcccugggccagagcugguguaccgcuggugga

SEQ ID NO: 162989 - RNA, 64 nt, Human
uguauuuagucaguaugucuuuuuguguaauggacugggccaaucaaaugugauaaaauuaauu

SEQ ID NO: 162990 - RNA, 64 nt, Human
cuuccccuccccgugccagcacugccgcuuccaccugggccacccaccggacccucgcacgccg

SEQ ID NO: 162991 - RNA, 64 nt, Human
gucguagcgggagacagcaacagagaguaggcggcugggccacguccuucacagggcgucaugu

SEQ ID NO: 162992 - RNA, 64 nt, Human
uccagccccagcccugggccugggcugccgacaccugggccagagccccugcugugauuggugc

SEQ ID NO: 162993 - RNA, 64 nt, Human
acuuggagguuaaaagagccuuuuggacagaaaacugggccaggaaaaggcaucucagaccaca

SEQ ID NO: 162994 - RNA, 64 nt, Human
cucagcuguguggccaugugggggcagcaggggccugggccauagcugggggaggccagacccu

SEQ ID NO: 162995 - RNA, 64 nt, Human
gagacacgggggacagcguccacacucagagggccugggccacagccccgauguuucuuuucag

SEQ ID NO: 162996 - RNA, 64 nt, Human
cgcuccaccugucugguccauagcucccuggaggcugggccaggaggcagccuccgaaccaugc

SEQ ID NO: 162997 - RNA, 64 nt, Human
gggugcagugaauggccagcggguuucuuuucugcugggccaaggcgcuuuggggguggagggg

SEQ ID NO: 162998 - RNA, 64 nt, Human
ugcagugagccgagaucgcacugcuguacccagccugggccacagugcaagacuccaucucaaa

SEQ ID NO: 162999 - RNA, 64 nt, Human
gguucauaggucauagaaggcagcaaugcacugacugggccacaucuugaaaacucguggaaag

SEQ ID NO: 163000 - RNA, 64 nt, Human
ggagggaaggggccuauccauuccauuguggaagcugggccaggugccagggacacucuccuuc

SEQ ID NO: 163001 - RNA, 64 nt, Human
ccgcccucacaccuccucgagugcccugggaccacugggccacagauggucaucaggggaagcc

SEQ ID NO: 163002 - RNA, 64 nt, Human
aacgggcgccaagacucaggggaucggcugggaacugggccagcagagcauguuggacaccccc

SEQ ID NO: 163003 - RNA, 64 nt, Human
ggaggcagcuccaacagcuugaccagaccuagaccugggccaaaagggcagccaggggcugcuc

SEQ ID NO: 163004 - RNA, 64 nt, Human
ugacccuggaacauccccagagugaaagauggagcugggccacaucagaauaaggccuuggccc

SEQ ID NO: 163005 - RNA, 64 nt, Human
ucuuggagguuaaaagagccuuuuggacagaaaacugggccaggaaaaggcaucucagaccaca

SEQ ID NO: 163006 - RNA, 64 nt, Human
aaaucauuaucauggcuacaaagucuuguguggucugggccacauccugugccaggcucccuuu

SEQ ID NO: 163007 - RNA, 64 nt, Human
aauccccaaagguccgcacccuguccugcacacccugggccacgccggccacaccccucugcug

SEQ ID NO: 163008 - RNA, 64 nt, Human
uggacagauucccaccuguauguagcacgccaugcugggccagcagugucauaggaguggaggg

SEQ ID NO: 163009 - RNA, 64 nt, Human
ugcccgccagggcucagguuccucugagcugguccugggccaggacgcaucugcauggcggugg

SEQ ID NO: 163010 - RNA, 64 nt, Human
uugaaacuagcucccagcccccauggggcagcagcugggccacaauugccccuuuccguuuucu

SEQ ID NO: 163011 - RNA, 64 nt, Human
ugaacugagcugguguugccaacucuuggcagcacugggccaaaccgaccacauaccaugagcu

SEQ ID NO: 163012 - RNA, 64 nt, Human
cauggggccugcccccugggcacccauccacaagcugggccacggagcuccagcuucucaggac

SEQ ID NO: 163013 - RNA, 64 nt, Human
accgaggucugagcgggugggcggcggccacgcacugggccacggaggagggaugcugcuccgc

SEQ ID NO: 163014 - RNA, 64 nt, Human
gacagagcucugggacagcaggcagaggccgagccugggccacagcucagccacugacuugggu

SEQ ID NO: 163015 - RNA, 64 nt, Human
gccagucccugagcucagacccccguccccggaacugggccacaccacgugcccucuuggccca

SEQ ID NO: 163016 - RNA, 64 nt, Human
cugggaaggccuuacagaagaggugacauuucagcugggccagagaucaguagagagcagcuga

SEQ ID NO: 163017 - RNA, 64 nt, Human
cucccaagccuacgggacugucugccacucggcacugggccaccugccccugcuggaggggcac

SEQ ID NO: 163018 - RNA, 64 nt, Human
gccaacagcccuguccccacaggaccugggagcccugggccagcacuucucccagucuccccga

SEQ ID NO: 163019 - RNA, 64 nt, Human
agcuaggccgucucccuggucagcuuccuugagccugggccacuccucccuggccuucuuaccu

SEQ ID NO: 163020 - RNA, 64 nt, Human
aggaccccacugucuccuagaggccccggaggagcugggccagccgcccacccccacccccagu

SEQ ID NO: 163021 - RNA, 64 nt, Human
cgugggcacucgcacuggggggcugugacagcagcugggccaggaggccguguaaugaccacac

SEQ ID NO: 163022 - RNA, 64 nt, Human
aggcaugacagaccagggugaggguugugcccagcugggccacggccaugcgugggguggccca

SEQ ID NO: 163023 - RNA, 64 nt, Human
ugcggugggugcugccaugacagaggcugcaccccugggccagcggggcugcucacccaccucu

SEQ ID NO: 163024 - RNA, 64 nt, Human
ggcacucagugagccuccugugccuggccccagccugggccaucucuuaggugagacaguugcc

SEQ ID NO: 163025 - RNA, 64 nt, Human
ugcccaccuccugggcucucccagggaagccccucugggccaaagcccauggguagcuuggcug

SEQ ID NO: 163026 - RNA, 64 nt, Human
cggcugugacacucuacccuccagaaccugacgacugggccaugugacccaaggagggauccuu

SEQ ID NO: 163027 - RNA, 64 nt, Human
cugcaacacuuugaggacauuuaugauugucccucugggccaaugcuuauacccagugaggaug

SEQ ID NO: 163028 - RNA, 64 nt, Human
agaauguuuauugugaauauguaauauuuguuggcugggccacguaacuugauuagucauuaaa

SEQ ID NO: 163029 - RNA, 64 nt, Human
guccaaaauagccaauuaacacaaccaaauacaacugggccaauauaaacauguuugaauuguc

SEQ ID NO: 163030 - RNA, 64 nt, Human
ggcgugcucauccccugcuaaggagcaggagcugcugggccaggucugcggcagugcuggggug

SEQ ID NO: 163031 - RNA, 64 nt, Human
agucgagaugacuuugaucauugguaacuugggccugggccagacaaaguauaaaacuuacaaa

SEQ ID NO: 163032 - RNA, 64 nt, Human
acagcacugggcugccaggauuccccuggcccgucugggccaacccuuccaugggugaagacaa

SEQ ID NO: 163033 - RNA, 64 nt, Human
cuuccagcuggauggagcacacacaggccuccagcugggccaugucagucucaucgucccaagg

SEQ ID NO: 163034 - RNA, 64 nt, Human
cagaggugacucuuggagcuggaggaagucaaaacugggccacuguuuguacugaugguguauu

SEQ ID NO: 163035 - RNA, 64 nt, Human
gcugcacugcacaccuguggggagacuuuuccagcugggccaagggagucagacucuaagaaca

SEQ ID NO: 163036 - RNA, 64 nt, Human
cuguaaaucacagguguccaaacuuuuggcuucccugggccacauuugaagaagaauuuucuug

SEQ ID NO: 163037 - RNA, 64 nt, Human
guuaggcuagagacagaugcugguggaggaagggcugggccaccagggaucacagaccacagga

SEQ ID NO: 163038 - RNA, 64 nt, Human
ugcugucugaguaguggccacuggggugccuucacugggccagucaacggggggcuccugccca

SEQ ID NO: 163039 - RNA, 64 nt, Human
aucgggaagcaggagcaucuucuuggcagccaggcugggccaucuucuccuggacaccugcugu

SEQ ID NO: 163040 - RNA, 64 nt, Human
gcccaggagcccccauccuaagcuccaagcaugucugggccaggcagaggugcuccucauccau

SEQ ID NO: 163041 - RNA, 64 nt, Human
cugaggagggcuggagcucgggaaguuguccuuccugggccagggccguuucuggcacugggag

SEQ ID NO: 163042 - RNA, 64 nt, Human
aggaugaggcagaggcaugaugcuuccugcucaccugggccacccucucuccaggacuugucag

SEQ ID NO: 163043 - RNA, 64 nt, Human
cccgaugcuaccccugucagacagaggcugcggccugggccagagucagggaguagcugcugcu

SEQ ID NO: 163044 - RNA, 64 nt, Human
gaggcgaggagggggcugugaguccucagaggcccugggccaccacauuucuggcagcguuucc

SEQ ID NO: 163045 - RNA, 64 nt, Human
ggauuuuagaacccuaaugcacccuggaggguagcugggccagacuucucauuucacaggugag

SEQ ID NO: 163046 - RNA, 64 nt, Human
agugcggagccccgucucccuaccccucgagcaccugggccagcggcugagcuguacauaccgu

SEQ ID NO: 163047 - RNA, 64 nt, Human
aaucugagaacccggagucgcagcgcccucgggccugggccacacgcaggcccuggugggacca

SEQ ID NO: 163048 - RNA, 64 nt, Human
ggaggguggauggcucuguggacuucuaccgggacugggccacguacaagcagggcuucggcag

SEQ ID NO: 163049 - RNA, 64 nt, Human
guuccugcacccuacacccgagcccauccagccucugggccauagacccuuccguugaaggccc

SEQ ID NO: 163050 - RNA, 64 nt, Human
ccaggcacagccggcucacggaggggccaccacgcugggccagggucucacuguacaagugggc

SEQ ID NO: 163051 - RNA, 64 nt, Human
cuggggccgucugcccguggaccuggcugaggagcugggccaucgcgaugucgcacgguaccug

SEQ ID NO: 163052 - RNA, 64 nt, Human
aaugcuuugggagguguuaacucaaaggugacuucugggccacagaucaagaaagcauuugauc

SEQ ID NO: 163053 - RNA, 64 nt, Human
cucuccuguucugacuuuaagccagaacuuguggcugggccauggaagcugugacuccucugug

SEQ ID NO: 163054 - RNA, 64 nt, Human
agaauucggugacaugccuagugcugagccuuggcugggccaugagagucuguauacucuaaaa

SEQ ID NO: 163055 - RNA, 64 nt, Human
auuuucaaacugugguccagagaauaggggaagacugggccagacgcaguggcucaugccugua

SEQ ID NO: 163056 - RNA, 64 nt, Human
uaaaaaugcauaccaugcuuucagaacaaaagcucugggccagaaaggcaauuuggcuaaaaaa

SEQ ID NO: 163057 - RNA, 64 nt, Human
augggcucuggcugcugggggagccgugucacuccugggccaugggggcaccuccugggcacuu

SEQ ID NO: 163058 - RNA, 64 nt, Human
cacccuugauuggguuuugcacuaaagaggucagcugggccaaugauauugcuccagaccgagu

SEQ ID NO: 163059 - RNA, 64 nt, Human
ccaguggguucccgcccacucacccaggagcuggcugggccaggaccgggagagggagcacugc

SEQ ID NO: 163060 - RNA, 64 nt, Human
agacagagccugccacauccucccacgccaggcccugggccagggugauuggacugagaauuug

SEQ ID NO: 163061 - RNA, 64 nt, Human
agcggaagacgccagcugccagggccuggggccacugggccagcgccuggcgauacugguuggg

SEQ ID NO: 163062 - RNA, 64 nt, Human
cgcugcuguccacgucguccagaaucacgcccuccugggccauguugucuuugaugacgaugau

SEQ ID NO: 163063 - RNA, 64 nt, Human
cauccccuggcuuucccucccuccuugccccauccugggccagccagcagggcuccuccucugg

SEQ ID NO: 163064 - RNA, 64 nt, Human
cuucugaauccauauguagagauuucagccaaggcugggccagccuuuuuugggcagucagguc

SEQ ID NO: 163065 - RNA, 64 nt, Human
cacgccuggccacgcuuuaccgacugcugacccccugggccaggugagguuggggccugugggc

SEQ ID NO: 163066 - RNA, 64 nt, Human
gccuggagggccaggagucccagacucacgcacccugggccacagggagccgggaaucggggcc

SEQ ID NO: 163067 - RNA, 64 nt, Human
gccagggaggacacgcuccacugaccacccagagcugggccagggacucaacaauggggacaga

SEQ ID NO: 163068 - RNA, 60 nt, Human
acacggacacgcucugcugaccacccagagcugggccagggaggacacgcuccacugacc

SEQ ID NO: 163069 - RNA, 64 nt, Human
gcagauggauggaguccaggccugggggcuucugcugggccagcccggccucccacacccacuu

SEQ ID NO: 163070 - RNA, 64 nt, Human
gcagcgguggaugcagagcuggcugcacccagggcugggccaguguguccuguaagacuucuug

SEQ ID NO: 163071 - RNA, 64 nt, Human
ccugauugcaucuagguggagcggauggaaugugcugggccacuguuggguggagagcagcaca

SEQ ID NO: 163072 - RNA, 64 nt, Human
auguggacaguagacuuuaucccuccuucuuacucugggccaagaccucccacuccgcccucug

SEQ ID NO: 163073 - RNA, 64 nt, Human
agguugggaaaagagguuuuucuccugcaggguacugggccaggcccucagccucagagagccu

SEQ ID NO: 163074 - RNA, 64 nt, Human
gacgcucgggcgccaggaggcuucgcuggaggggcugggccaaggagauuaagaagaaaacgac

SEQ ID NO: 163075 - RNA, 64 nt, Human
aaaugcucuuccaagccagccuaucugucccaggcugggccacugccucccuaacacagccacc

SEQ ID NO: 163076 - RNA, 64 nt, Human
caggcaccaggauucuccacuucuuccagcccugcugggccacaguucuaacugcccuuccucc

SEQ ID NO: 163077 - RNA, 64 nt, Human
ccacucugcacuuuguuucccacucccauuagcccugggccaccuccuccaguucuuccucuuu

SEQ ID NO: 163078 - RNA, 64 nt, Human
ucugcuuaccugucuggcucagcuugggcaagggcugggccauaugugcucagggacgugcuuc

SEQ ID NO: 163079 - RNA, 64 nt, Human
ucuccuggacgcagaggugacagugggagcuggccugggccaggacggcagguggcccuggaga

SEQ ID NO: 163080 - RNA, 64 nt, Human
gggccagggcccuggguggggagguguggguucccugggccaagaccagccuuuuuccucaguu

SEQ ID NO: 163081 - RNA, 64 nt, Human
gauggucacccagagccauagagcacccuuccuccugggccagagcuggguuaucaugguuggc

SEQ ID NO: 163082 - RNA, 64 nt, Human
cagcaugacauaacagugcagggcaaaauauucacugggccaauucaauacaaacaaucucuua

SEQ ID NO: 163083 - RNA, 64 nt, Human
uccaaacaguucaaucuccagcuuuauucaauggcugggccauuuuguucuuggagggacaaaa

SEQ ID NO: 163084 - RNA, 64 nt, Human
aucauugaggcuuuagguuuuugaugugaucagacugggccaugucaaacccggaauuuucacc

SEQ ID NO: 163085 - RNA, 64 nt, Human
aaugguccacugagggccuccugcucugccugggcugggccaggggcuuugaggagaggguaaa

SEQ ID NO: 163086 - RNA, 64 nt, Human
gggauguggcagcaucagugggacaagauggacacugggccacccucccaggcaccagacacag

SEQ ID NO: 163087 - RNA, 52 nt, Human
aggccucccugcauggauaguccugggccagccacaccaccgagguccaagu

SEQ ID NO: 163088 - RNA, 64 nt, Human
gcagcacgaacugcccgucagagaagugcacagccugggccagauacucccacaggugggugag

SEQ ID NO: 163089 - RNA, 64 nt, Human
gagugucugcuccucugaggccaggaggccggugcugggccagagaggacggcguggcgaaagu

SEQ ID NO: 163090 - RNA, 64 nt, Human
ucaaaacccaugaccgucagggccaccccugccucugggccagggaaaccagcuacucagggac

SEQ ID NO: 163091 - RNA, 64 nt, Human
ggcuugggggugucuucugagcucaagccugcuucugggccaggccauugucacuguuaguuga

SEQ ID NO: 163092 - RNA, 64 nt, Human
ucccuuugaaauaagggaaaggaucacagugcugcugggccaugaugguauguagaagggucug

SEQ ID NO: 163093 - RNA, 64 nt, Human
gaauaguugaacaccgggggcuuugugaaggagucugggccaagguuugcccucagcuuugcag

SEQ ID NO: 163094 - RNA, 64 nt, Human
gccacagagcucgaggcugucuucaccagcugggcugggccagccuggcccugcagggcagagc

SEQ ID NO: 163095 - RNA, 64 nt, Human
cucgcuggggccccugugugcaucuuugaggguccugggccaccaggaggggcagggucuuaua

SEQ ID NO: 163096 - RNA, 64 nt, Human
cugccagccucaguucugggagcgcuggggucgccugggccacaggccacagcagcucaccuca

SEQ ID NO: 163097 - RNA, 64 nt, Human
gacucgcagagaauauuccagcaauuguguaccccugggccagucucuuugaacccugagggug

SEQ ID NO: 163098 - RNA, 64 nt, Human
ggaucaaaaggcccauguauauaaguacugaccacugggccauaauguugcuucucaggcuaua

SEQ ID NO: 163099 - RNA, 54 nt, Human
auaucaucucacagcucugaggcccugggccagauuacuuccuccaccccuccc

SEQ ID NO: 163100 - RNA, 64 nt, Human
cccaugaccccaugucccagcuccccacacagcgcugggccagagaggcauuggugcgagggau

SEQ ID NO: 163101 - RNA, 64 nt, Human
gaggagggagcgugagccucccagagccccaggacugggccagagcacuuagguuucuuuuucc

SEQ ID NO: 163102 - RNA, 64 nt, Human
uccuccugcuggugcuccaucccccaauaccaggcugggccaccacucugaggaggguaggagg

SEQ ID NO: 163103 - RNA, 64 nt, Human
auuccucugggggcuggcgcaugcccaggaaagccugggccacacgggacacucucuucuuuau

SEQ ID NO: 163104 - RNA, 64 nt, Human
ucccagggcucagcccugcuguccugagcgucuccugggccagagagaggagauggggguggga

SEQ ID NO: 163105 - RNA, 64 nt, Human
cccugccaaggggcagagcuugacccuggaaauucugggccaucccccuccacccccacccuga

SEQ ID NO: 163106 - RNA, 64 nt, Human
gagucucacuuccccgccgccuugccccauuggccugggccaguucuccacuccuaggggccaa

SEQ ID NO: 163107 - RNA, 64 nt, Human
cccagggucugcuccugcugaggaccagcuguggcugggccaggacagaggacucaacccugcu

SEQ ID NO: 163108 - RNA, 64 nt, Human
agccuaucucccccaagcuggaggcggcagaggacugggccaagccccaaccugccucccagcc

SEQ ID NO: 163109 - RNA, 64 nt, Human
auggaagagagccaggcagccccgaaagaagagccugggccacggccacguauaaaccuccgag

SEQ ID NO: 163110 - RNA, 64 nt, Human
gcccugucccugcggcugugagagcagcaggacccugggccaguuccagagaccugggggugug

SEQ ID NO: 163111 - RNA, 64 nt, Human
aaggcugaugucuuaacugucacccauauggucccugggccaccgggcagccuggggcggugug

SEQ ID NO: 163112 - RNA, 64 nt, Human
ggagagcgcccacacuguccaugcuccaggcccccugggccagcuccgagaaggcgccagugaa

SEQ ID NO: 163113 - RNA, 64 nt, Human
uaaugcaacccagguaugcuccaugcauauccagcugggccagccucgugcugggcucugcccu

SEQ ID NO: 163114 - RNA, 64 nt, Human
augcugagcccggaaacuccacauccugugggaccugggccauagucauucugccugcccugaa

SEQ ID NO: 163115 - RNA, 64 nt, Human
aaucuguaguguuaaaaauuagauuagugauugccugggccaaguggcagguuggggaggaugg

SEQ ID NO: 163116 - RNA, 64 nt, Human
agagucugcugcaagggugagaccaggcagccugcugggccacacuguccuguuggcaucacag

SEQ ID NO: 163117 - RNA, 64 nt, Human
guuagcguaaccugguauaugcaacuaccauccucugggccaacuguggaagcugcugcacuug

SEQ ID NO: 163118 - RNA, 64 nt, Human
caagaaacucaagaacgcaucaagagcaccagcccugggccagggaagacaggcucuuccugca

SEQ ID NO: 163119 - RNA, 64 nt, Human
uccccuuccauaccccuuccuggaucuccagugccugggccaggaaagcccucuggguuccggg

SEQ ID NO: 163120 - RNA, 64 nt, Human
aaagcccucuggguuccgggaagccccguccacccugggccauggggccgguuggaaggauacu

SEQ ID NO: 163121 - RNA, 64 nt, Human
aauugucuggaaguuuugucuugggcaguaugggcugggccaaaugaaaugauuuuuauaauuc

SEQ ID NO: 163122 - RNA, 64 nt, Human
gaaaggagagccaggagcauuuaaaaaucagcaucugggccaggcaagauggcucacgccugug

SEQ ID NO: 163123 - RNA, 64 nt, Human
cugcaggugccaacccuucaucccccauguuuuccugggccauggagggcugaccuccguuucu

SEQ ID NO: 163124 - RNA, 61 nt, Human
cccucagcacugaccacugaugauggggacccugggccagcgccugcccacuuggccucag

SEQ ID NO: 163125 - RNA, 64 nt, Human
cagcuuucacacuguggcagcccagugaagcagacugggccaugaacucuccuagcccuggggc

SEQ ID NO: 163126 - RNA, 64 nt, Human
ccugucagccaauggcagcucuucucggacuccccugggccaaugauguugcgucuaauacccu

SEQ ID NO: 163127 - RNA, 64 nt, Human
gugguauguagcccggccagggccuggugugaggcugggccagccucagcucagccucccccug

SEQ ID NO: 163128 - RNA, 64 nt, Human
gccucccacucgacuuuccucuuaggaaccuggccugggccaggggccugacccucagcacuuu

SEQ ID NO: 163129 - RNA, 64 nt, Human
uaguugcccgcugggccuggggcccugcccaugccugggccagaguggcgcuggggccucggcu

SEQ ID NO: 163130 - RNA, 64 nt, Human
ugacgaugccacugcagcccgcaccuugucacugcugggccaagaagccuucacuaggaguggg

SEQ ID NO: 163131 - RNA, 64 nt, Human
agagagccuccagagagugaacagucuuccagaucugggccaaucauccuggacagaggcccgc

SEQ ID NO: 163132 - RNA, 64 nt, Human
ucuccaggguacccuccaccccagcugccaagcccugggccagcagcacccccuuguggccauc

SEQ ID NO: 163133 - RNA, 64 nt, Human
gugugcacgcaugugugugugugcacgcacugggcugggccaagcgacugaggauucgcuuggg

SEQ ID NO: 163134 - RNA, 64 nt, Human
ccagucccuagugcccaaggcagggacccugggccugggccauccauuccauuuuguuccacau

SEQ ID NO: 163135 - RNA, 64 nt, Human
cuucgggcacggcgcugauaggcuggauccagcgcugggccacccucuccuucccagcugguug

SEQ ID NO: 163136 - RNA, 64 nt, Human
gccugugugacgcugggcgagucucuuccccugucugggccaaacagggagcggguaagacaau

SEQ ID NO: 163137 - RNA, 64 nt, Human
ucuugagggggacucccugucuccugaggcccagcugggccaggacuccauccuuucagaugcc

SEQ ID NO: 163138 - RNA, 64 nt, Human
cguggagauuuuuaugccucacuuucuggagucacugggccaugaugaaucauaagucuucagu

SEQ ID NO: 163139 - RNA, 64 nt, Human
gcacugagccgagaucgcgccacugcacucuagccugggccauagagcgagaguccaucucaaa

SEQ ID NO: 163140 - RNA, 64 nt, Human
uggcugagaggcuccugggcagauggggucaaggcugggccagcccagaugaagccuaugggag

SEQ ID NO: 163141 - RNA, 64 nt, Human
ggguccuuggguuucccagcugcuuccugcucagcugggccacccccucccacccugggguugg

SEQ ID NO: 163142 - RNA, 64 nt, Human
ucagcagcgguggagacucucuccuguguguguccugggccacucuaccagugauuucagacuc

SEQ ID NO: 163143 - RNA, 64 nt, Human
cauggugccacuggggccuguggcuguaguagcccugggccagguaaccuccagggcccugacu

SEQ ID NO: 163144 - RNA, 64 nt, Human
ugacuagcggccaccucauuuccccccuugaccacugggccaguuggguggcuagguugccuca

SEQ ID NO: 163145 - RNA, 64 nt, Human
agcgcauggcuccggaagcagacacaggccaggccugggccaggagucugccaggagccaggag

SEQ ID NO: 163146 - RNA, 64 nt, Human
guggagccauugaacagcugugagccaugccucccugggccaccuccuaccccuuccuguccug

SEQ ID NO: 163147 - RNA, 64 nt, Human
uucucugccucgggucugugugaggccauggcuccugggccacccucaccgucugccucagacu

SEQ ID NO: 163148 - RNA, 64 nt, Human
ccaaagcucucuuugagguccaaaaaaggcugcccugggccauaugugcuauggagaggacucu

SEQ ID NO: 163149 - RNA, 64 nt, Human
cuccccggccaccaugauugggaucucuguggcacugggccaccucauugggguaaggaacaga

SEQ ID NO: 163150 - RNA, 64 nt, Human
agaaacgggccuaaaaccaaacggguaaaaagcccugggccaucccugucuuccugucccuugu

SEQ ID NO: 163151 - RNA, 64 nt, Human
gcaguccaacuguaacugacaguggcugccuucucugggccauggaucacaccuguaagguacu

SEQ ID NO: 163152 - RNA, 64 nt, Human
uggcgguugccggaguacacagugacccaggagucugggccagcccaccgcaaagaauucacca

SEQ ID NO: 163153 - RNA, 64 nt, Human
cgcccggaggcagagaggcuccauggccgugcugcugggccauccccaacucccuaucccaucc

SEQ ID NO: 163154 - RNA, 64 nt, Human
cccacagacucaaaguuacucuccuucccccuaccugggccagugaaauagaaagccuuucuau

SEQ ID NO: 163155 - RNA, 64 nt, Human
gcccugaguuuccauuacugugggugggguuccccugggccaaacagugauuugucucccucaa

SEQ ID NO: 163156 - RNA, 64 nt, Human
ugagugugcugacuuuuuaacaugguauuaucaacugggccaggagguaguuucucaugacggc

SEQ ID NO: 163157 - RNA, 64 nt, Human
uggacgggagaugccagccaucacucacugccaccugggccaucaacugugaauucucagcacc

SEQ ID NO: 163158 - RNA, 64 nt, Human
cucaguugcagcacugaguggucaaaauacauuucugggccaccucagggaacccaugcaucug

SEQ ID NO: 163159 - RNA, 64 nt, Human
acacagacaaauuccaccuggcaccuguuuuuggcugggccaaggagcugccucuacugcuccc

SEQ ID NO: 163160 - RNA, 64 nt, Human
uuugguuccuaucccaucgaaauuccccaaagcccugggccacugccauuggguuagucaagau

SEQ ID NO: 163161 - RNA, 64 nt, Human
ggccugggguccugguguugggcaggugguggggcugggccauggagcuggcccagaggccccu

SEQ ID NO: 163162 - RNA, 64 nt, Human
caaggccccuggcccuuacugagccugcaggguccugggccauguggguggugcuucuggaugu

SEQ ID NO: 163163 - RNA, 64 nt, Human
agguguuuaagaauugguuuugggagggcgaggacugggccagguuagaggcagauggcacagg

SEQ ID NO: 163164 - RNA, 64 nt, Human
gcagugagcggagaucgcaucauugcacucuagccugggccacagggcgagacuccgucucaaa

SEQ ID NO: 163165 - RNA, 64 nt, Human
aaaccuggacugaucuuucuuuaauagugaaccccugggccacugaagaguaacauggcuccac

SEQ ID NO: 163166 - RNA, 64 nt, Human
cuuaguaacuugcacucguuaaagaaacacggagcugggccaucgucagaacuaagucagggaa

SEQ ID NO: 163167 - RNA, 64 nt, Human
gcccaguucugcccuucuuugcuuugggauugcacugggccaucagcucaugccaggcuauggg

SEQ ID NO: 163168 - RNA, 64 nt, Human
ugugcaauagggugggguaggggcagggaaaggacugggccagggcaggcucgggagauagauu

SEQ ID NO: 163169 - RNA, 64 nt, Human
aucuguuuacacaucaaucugccucacugcuguucugggccauccccauagccauguuuacaug

SEQ ID NO: 163170 - RNA, 64 nt, Human
aaagaaagcugcguagugcugaacauuaagcuuucugggccacuggaacaaagaacuaggaucu

SEQ ID NO: 163171 - RNA, 64 nt, Human
aucucacuucucagggccucuguucuccucuccacugggccaaauagccuggcccuccccuccu

SEQ ID NO: 163172 - RNA, 64 nt, Human
accuccugcuuccuuaucaggcuguguguuaauucugggccagucuacacccucccacggggug

SEQ ID NO: 163173 - RNA, 64 nt, Human
cuguuuuggcaagaccccaccuccacgggcucuccugggccaccccugagugcccagaccccau

SEQ ID NO: 163174 - RNA, 64 nt, Human
cgauagucuguuagaauuuuauuagcgcagauuccugggccaugccggguaccgugaccuugug

SEQ ID NO: 163175 - RNA, 55 nt, Human
acgacaccauccugacaugagaggccugggccagcagcagcauugccgcuccaca

SEQ ID NO: 163176 - RNA, 64 nt, Human
aauuacaugagagaggucuggauucuuauuuuuucugggccauuagaacagauaaaugcgaagg

SEQ ID NO: 163177 - RNA, 64 nt, Human
uuucacucucucuaaaagguucugagggcucauccugggccaggggcccuccugugcacuguua

SEQ ID NO: 163178 - RNA, 64 nt, Human
gcugcacugaucacccaaugcaucacguaccccacugggccagcccugcagcccaaaacccagg

SEQ ID NO: 163179 - RNA, 64 nt, Human
uaaaccagggaccuucagcucacggccuccaggccugggccaguucuugcugcuccugccgucu

SEQ ID NO: 163180 - RNA, 64 nt, Human
cuggaagacacucagcaauuaaugaaguuaauuacugggccaacuugagaggaaaaaauggaaa

SEQ ID NO: 163181 - RNA, 64 nt, Human
aaacccgggagucagaggcugcagagagccgagacugggccacugcacuccagccuggaugaca

SEQ ID NO: 163182 - RNA, 64 nt, Human
cgggggggcccaucucuucuggccguccuugucucugggccacuuggagugugugauaaaucag

SEQ ID NO: 163183 - RNA, 64 nt, Human
ugaacuuggaaaggggaaguuggcagcaacucuccugggccacguaucaacaaucuucugacag

SEQ ID NO: 163184 - RNA, 64 nt, Human
gcccaaauuuuuacuuuguuuuucuuuuaauaggcugggccacauguuggaaauaagcuaguaa

SEQ ID NO: 163185 - RNA, 64 nt, Human
aguuuuaugauuugggugcguuuuuguguuuauacugggccagguccugguagaaccuuucaac

SEQ ID NO: 163186 - RNA, 64 nt, Human
ggggaaguuaucccucuuccggugcuuucccauccugggccacuguauccaggacaucacuccc

SEQ ID NO: 163187 - RNA, 64 nt, Human
gagucuaccuuggcaaagaccaagauauuuuuuccugggccacuggggaaucugaggggugaug

SEQ ID NO: 163188 - RNA, 64 nt, Human
ggagaugcuaggcccuggcacaguguuauguggacugggccacgauaggguggagugagcuagu

SEQ ID NO: 163189 - RNA, 64 nt, Human
gccuacccugccacuggccccuauggcgccccugcugggccacuggugagauggcauuccuucu

SEQ ID NO: 163190 - RNA, 64 nt, Human
uguuuggggagauauguuugauuauagagagacucugggccacccucaaacaccgucagaugca

SEQ ID NO: 163191 - RNA, 64 nt, Human
gaugggcagcagcuuggagcaggccaggcagggccugggccauuggaggggcuggcacuggacu

SEQ ID NO: 163192 - RNA, 64 nt, Human
cacggccacccacccuucuccccugccccguccccugggccacccuucacgcuggcuuccagcg

SEQ ID NO: 163193 - RNA, 64 nt, Human
uauauucuguuucauaugcagauuuuauucucaccugggccauuugcagaugagacuguaguuu

SEQ ID NO: 163194 - RNA, 64 nt, Human
cuguggggaccaaugaggaaagagagaggcaggucugggccaggcucacagggacuccggcaua

SEQ ID NO: 163195 - RNA, 64 nt, Human
accuggacauugggacuugggaauucacucucaacugggccauccauguugugaugcccuugaa

SEQ ID NO: 163196 - RNA, 64 nt, Human
cccccagcaggaagcgcugucugugcggcugagucugggccacuugcuuaauugcauuucuggc

SEQ ID NO: 163197 - RNA, 64 nt, Human
ccagaggggcagcgcagggcgcagagcacacccgcugggccagcagcucccaacggcgaugcua

SEQ ID NO: 163198 - RNA, 64 nt, Human
gaagccccagccccacccucugcccuucagccuacugggccaggccggaccugcccccucagug

SEQ ID NO: 163199 - RNA, 64 nt, Human
gguggagauuuccgaaaaguagucuucucugaggcugggccaagccugagggaaauggggcccu

SEQ ID NO: 163200 - RNA, 64 nt, Human
gcgccauaggcagaggcuuauaaagaaauggguucugggccaggugugguggcucaagccugua

SEQ ID NO: 163201 - RNA, 64 nt, Human
cgcgcccaccgcaggugggacucagguucgcccucugggccagguccuucacgaggagggagcu

SEQ ID NO: 163202 - RNA, 64 nt, Human
gacaucgcaggccgggaagcagugcccgccaggccugggccaggagagcuccaggaagggcacu

SEQ ID NO: 163203 - RNA, 64 nt, Human
ggauggcucagcacuugcucaucuuggauggcuucugggccaaaacugcagucacugaaugacc

SEQ ID NO: 163204 - RNA, 64 nt, Human
gaagagaggcuccauuuguggcuauuauguagaacugggccagagccaguccauugccuguuuu

SEQ ID NO: 163205 - RNA, 56 nt, Human
acaggagaagugcacccuagggccuucugggccagaggcaccaucccuucuggcca

SEQ ID NO: 163206 - RNA, 64 nt, Human
ugcaucagcaacaaccagcaucccuugaccaggccugggccagaguauuggucuccucucagcc

SEQ ID NO: 163207 - RNA, 64 nt, Human
ucgugcggcaggguccuggaggccacuugcgcggcugggccacagagucuacuuugaaggcacc

SEQ ID NO: 163208 - RNA, 64 nt, Human
ccuuggcuuucucuggcucauuguccuucuccaucugggccaauuguccuucccugcccauuca

SEQ ID NO: 163209 - RNA, 64 nt, Human
acagccacagucucaucuaucacuaaauaugaaacugggccaaggggaaaauucaguaaguuag

SEQ ID NO: 163210 - RNA, 64 nt, Human
cagcacauuccacaggcuccugaguccccgaggccugggccagcuugggcaagccaagaucaga

SEQ ID NO: 163211 - RNA, 64 nt, Human
gcaggucccagagaacuacuucuaugugccagaccugggccaggugccugagauugauguucca

SEQ ID NO: 163212 - RNA, 64 nt, Human
acccacccaggccagaugguacagccuguugcuccugggccacacaccuguacagcaugugacc

SEQ ID NO: 163213 - RNA, 64 nt, Human
uuuccauauugugauaagguaacaugggguuuuucugggccagccuuuagaacacuguuagggu

SEQ ID NO: 163214 - RNA, 64 nt, Human
cucagccuggccucugccuggccuguuucaaagucugggccacuggcagccuucucuugcucaa

SEQ ID NO: 163215 - RNA, 64 nt, Human
ggacucugcuuccuccaggagcagcagggaagcucugggccaccucccuggauagcaggaacuu

SEQ ID NO: 163216 - RNA, 64 nt, Human
acccacacagaagcagugcugcccggggccucaucugggccagcuuggacucugcuuccuccag

SEQ ID NO: 163217 - RNA, 64 nt, Human
gucugauuggcacaucaagaguuaacucugccuucugggccaaauucgaaauaaccaguccauu

SEQ ID NO: 163218 - RNA, 64 nt, Human
ucaucucaggaucggauucuguuuuagaguguuucugggccaggauccgggccccugcccuccu

SEQ ID NO: 163219 - RNA, 64 nt, Human
aauggguucucaguggucaccuuccucagcucagcugggccacuccucuucacccaccccaugg

SEQ ID NO: 163220 - RNA, 64 nt, Human
ccugaggccuacaguuuccucaggcaaggccucucugggccacuucugaaggguucugaugaaa

SEQ ID NO: 163221 - RNA, 64 nt, Human
uugcuugucugccacagcgggagcuaagccggcccugggccagcacuccgagagguggaagggg

SEQ ID NO: 163222 - RNA, 64 nt, Human
uggaugccccacuccaggaaucaugcuugcuccccugggccauuugcgguuuugugggcuucug

SEQ ID NO: 163223 - RNA, 64 nt, Human
ugaugagcugccuccauagggaacccacugccaccugggccagcuucuggagcaugagaaccug

SEQ ID NO: 163224 - RNA, 64 nt, Human
guguaguaaaucuccccggcccagcuggcgaacccugggccauccucacaugugacaaagggcc

SEQ ID NO: 163225 - RNA, 64 nt, Human
uccagccauccuccugccucagcuucccagauagcugggccacaggcgugugccaccacaccug

SEQ ID NO: 163226 - RNA, 64 nt, Human
cucagccauggcugugugcuuuggcccugcagcucugggccaccugcugguguccaccucgucc

SEQ ID NO: 163227 - RNA, 64 nt, Human
ccugccuccugggcccucacucugccuaggggagcugggccaggcacuagccuuugcccaggga

SEQ ID NO: 163228 - RNA, 64 nt, Human
uggaccugauggcccccuguggcgccuugaccugcugggccaggcugcccugggacucucagcc

SEQ ID NO: 163229 - RNA, 64 nt, Human
ccuggccagcccacuggauuggggacgggccaggcugggccaggucgggggcucagucugggag

SEQ ID NO: 163230 - RNA, 64 nt, Human
cgucaaugugaacaccucucuuugugcugaauuucugggccauucuuuuccugucuuauuucua

SEQ ID NO: 163231 - RNA, 64 nt, Human
cguggcuguccaugaguuuggccacgcccugggccugggccacuccucagcccccaacuccauu

SEQ ID NO: 163232 - RNA, 64 nt, Human
ggugacccagggcuggauccaccccugcggagcccugggccaggcaggugucugcugcucaccu

SEQ ID NO: 163233 - RNA, 53 nt, Human
cuuugguuauggacacauaacuccugggccagaggcuaaaaccccaggacccc

SEQ ID NO: 163234 - RNA, 64 nt, Human
aaguaggagcuugggguggaagagggacagccggcugggccaccugagcagaaggugguaauga

SEQ ID NO: 163235 - RNA, 64 nt, Human
gacggccuacugagcucuccacucuguuucccgccugggccauccaaccuugaaguccuaaacc

SEQ ID NO: 163236 - RNA, 64 nt, Human
cccaggaggggaagggacagaccagccccagccgcugggccaacuuccaaucauuccagcuaga

SEQ ID NO: 163237 - RNA, 64 nt, Human
uaaaaagcuccaaaugcagcuuuaaaaaauuaaucugggccagaauuucaaacggccucacuag

SEQ ID NO: 163238 - RNA, 64 nt, Human
uuuggagaugagagaggcuucgagagggugggugcugggccacaggggugcggggccagcucag

SEQ ID NO: 163239 - RNA, 64 nt, Human
gcuggccggccccaggcagugagggccuuagcaccugggccagcagcugcugugcucgauuucu

SEQ ID NO: 163240 - RNA, 64 nt, Human
gcucucugccccaacccugggcacuggccccuggcugggccauuucauggcucaaagccucugg

SEQ ID NO: 163241 - RNA, 64 nt, Human
uauuuccuccuuuuccaagaccaaggccaagaggcugggccaggcuucaguucaggccuguugc

SEQ ID NO: 163242 - RNA, 64 nt, Human
gugauuaugagugguucacagcagcccuuauaagcugggccagaaaauuucacuaggucaguaa

SEQ ID NO: 163243 - RNA, 64 nt, Human
ugugccuucagcagccccuguccucaccaugggccugggccaggugugacagaguagagguagc

SEQ ID NO: 163244 - RNA, 64 nt, Human
uuugguucccacucagcuucugccggucggcagccugggccaggcccuuuuccugcaugugcca

SEQ ID NO: 163245 - RNA, 64 nt, Human
cacucuuauugguaagcuauaggagacucaggaucugggccaaccucaaggugggggcuucaga

SEQ ID NO: 163246 - RNA, 64 nt, Human
uuucagcacagaaccugaaugccaggaaaaauuccugggccaagaagcuaaagcuaaagaaacc

SEQ ID NO: 163247 - RNA, 64 nt, Human
ggcaguuugacuucagcacugaaaaccucuccaccugggccaggguugccucagaggccaaguu

SEQ ID NO: 163248 - RNA, 64 nt, Human
gaagagcaaaaagggacaaacacuaacugcugagcugggccauuugaucuccuuucaccuugca

SEQ ID NO: 163249 - RNA, 64 nt, Human
cccuggggugcggcccuggcccccuccaccccugcugggccagagcgggugggcagugucaagg

SEQ ID NO: 163250 - RNA, 64 nt, Human
uccuugugcccguggggccgggagcgaguaaagucugggccaggcuguguguguguaucuuugc

SEQ ID NO: 163251 - RNA, 64 nt, Human
gagccuuccuaaacagccagugcagacguucucucugggccacgaagccccucggguccucccc

SEQ ID NO: 163252 - RNA, 64 nt, Human
ccccuguaggcugcauucaggagacagaaggugucugggccauccugggcggccggucagcguu

SEQ ID NO: 163253 - RNA, 64 nt, Human
ggaaaggcggggguggcugcucuuccuggcaggccugggccaucagcgaacugggccccgugag

SEQ ID NO: 163254 - RNA, 64 nt, Human
ggccucugccagcccuugcagcugcagcccaucccugggccauguccccuccaucgagugcccg

SEQ ID NO: 163255 - RNA, 64 nt, Human
uccccggccucaguuucccugcagugcucagugucugggccagucucacuggaugggaaacuca

SEQ ID NO: 163256 - RNA, 64 nt, Human
uggacccugcuuccuguguaccacugaggggcagcugggccaggagcugugcccggugccugca

SEQ ID NO: 163257 - RNA, 64 nt, Human
ccaaggggcugcgcuagcagcccuugugugugcccugggccaggcaggcgauccccgcuucccc

SEQ ID NO: 163258 - RNA, 64 nt, Human
cuggguacguggaucccugaguagaucccagcaucugggccauggagagguuggggcaacaggu

SEQ ID NO: 163259 - RNA, 64 nt, Human
gcuccuuggcuucugaaggcugaagcuccuuuggcugggccaagaaggaucuagucugcccacu

SEQ ID NO: 163260 - RNA, 64 nt, Human
uucuugccuuuguccugauccucucacagaaacacugggccaaacaguggggagagauuggaga

SEQ ID NO: 163261 - RNA, 64 nt, Human
ccagaaaggugcuuuccuucagacggugcagggccugggccagccuuacaggucaguagacuag

SEQ ID NO: 163262 - RNA, 64 nt, Human
augaugugacuuugaggccccaacaugacagccacugggccaccgggacccaagaagacagccc

SEQ ID NO: 163263 - RNA, 64 nt, Human
cucagcuaggccgggcagacaaggacagaagacucugggccacuguaauguuuguguuuagauu

SEQ ID NO: 163264 - RNA, 64 nt, Human
caaagugcugggauuacaggugugagccaccacacugggccaaugcuuaauauuuuaauguauc

SEQ ID NO: 163265 - RNA, 64 nt, Human
caccauucaggaaccuggaccaaagcugacgaggcugggccaagccagggauggggccacagcc

SEQ ID NO: 163266 - RNA, 64 nt, Human
uuggaaaggcucccuguccuagucuugaucuguucugggccaggucccagcuugagcugccucu

SEQ ID NO: 163267 - RNA, 64 nt, Human
gugccucuugggagacguccacccguuuccaagccugggccacuggcaucucuggagugugugg

SEQ ID NO: 163268 - RNA, 64 nt, Human
agcuaauucuuugaccuguugggagugaggaugucugggccacucaggggucauucauggccug

SEQ ID NO: 163269 - RNA, 64 nt, Human
auuccauguacacauguuaauuagcaguuagugacugggccaacacuuucucauaaaaauuggc

SEQ ID NO: 163270 - RNA, 64 nt, Human
uucuuccuguccucucaccuagauuguaagcucccugggccaggacuucagccugccuccgagg

SEQ ID NO: 163271 - RNA, 64 nt, Human
ggagugagacugcccuuagccugggucagccuuccugggccauaaauugggcauccgugaugcu

SEQ ID NO: 163272 - RNA, 64 nt, Human
gucacuuucucaucauuccauggggugugucugccugggccaacucugcauggagaggccaggg

SEQ ID NO: 163273 - RNA, 64 nt, Human
caaaucagaguucccagggccagacaggcucuuccugggccacagaggggaggcaucaggaaag

SEQ ID NO: 163274 - RNA, 64 nt, Human
ggucggaggccccuggcuuugugcaaggccggaucugggccagguggcgaaaggggcccagucg

SEQ ID NO: 163275 - RNA, 64 nt, Human
ucccugaguuagucucugcuuucuuuccccagggcugggccauggggagggaaggacuuucucc

SEQ ID NO: 163276 - RNA, 64 nt, Human
acaggggcuaccagaggcugauuucuccccucuccugggccaggggagggguauuaucccugcc

SEQ ID NO: 163277 - RNA, 64 nt, Human
cccacugaccaggcgggagccgccaggccugcagcugggccagugcccaggagccauccuggcg

SEQ ID NO: 163278 - RNA, 64 nt, Human
ucaaccacagcuucaucgagccgcccucugccggcugggccacugaugacuccuucucauccga

SEQ ID NO: 163279 - RNA, 64 nt, Human
cuagucucauccuccccuggcugcagaugcuuagcugggccagggauugacccaagcgcgaugc

SEQ ID NO: 163280 - RNA, 64 nt, Human
gcccaugccgaguggaugccccccacccucucuccugggccacugaggagaggggagagagcug

SEQ ID NO: 163281 - RNA, 64 nt, Human
caucuuguccugcuuccucacuguggaccccugucugggccacccuagugugcuaagcugagca

SEQ ID NO: 163282 - RNA, 64 nt, Human
caccugcacccuaggaccucacuggccauaggagcugggccacuccagacauuaauccccaccc

SEQ ID NO: 163283 - RNA, 64 nt, Human
accaggccaaacugcaggcaaccaccucgggccgcugggccaccgagcugcccuggaugggcug

SEQ ID NO: 163284 - RNA, 56 nt, Human
aguucccuccaggcuucuagaagcaucugggccagggcucauggcuggauaauuuc

SEQ ID NO: 163285 - RNA, 64 nt, Human
aaguucucaguucccuccaggcuucuagaagcaucugggccagggcucauggcuggauaauuuc

SEQ ID NO: 163286 - RNA, 64 nt, Human
cgugggcacguuuuugcaaccgguucguugauaccugggccagggaugaggacacugugcucaa

SEQ ID NO: 163287 - RNA, 56 nt, Human; identical to SEQ ID NO: 163284

SEQ ID NO: 163288 - RNA, 64 nt, Human
agcccagcaacccugccccuccccagcaucccagcugggccagagagagccgagugugccaaca

SEQ ID NO: 163289 - RNA, 64 nt, Human
ucugcagcuggugcaaaagcuguggcugccaggucugggccacauggcagcccagggggcagga

SEQ ID NO: 163290 - RNA, 64 nt, Human
ggagcagggaaguacagagugggauggucaggaccugggccauugcaaccaaaauggggacuuc

SEQ ID NO: 163291 - RNA, 64 nt, Human
aggcacuugucuacaagugugucccaacacaguccugggccacuuuccccacccuggggagcac

SEQ ID NO: 163292 - RNA, 64 nt, Human
ccugcauucugucuguccuuuuccuccuuggagccugggccagcucaaggugggcacgggggcc

SEQ ID NO: 163293 - RNA, 64 nt, Human
ugguuggucacuugacaagaaaaaccauacuuaccugggccaaggcucuguuccugccuucgca

SEQ ID NO: 163294 - RNA, 64 nt, Human
ggcuaugacgcccccggcccgugcucaacaccgccugggccacagcuaggcccucccaccggcu

SEQ ID NO: 163295 - RNA, 64 nt, Human
gagggcccacccugccugcaccuccgcgggcugacugggccacagccccgaugauucuuaacac

SEQ ID NO: 163296 - RNA, 64 nt, Human
ccugauuuucaguggcguccucauuugcauacaccugggccaucuugguuuuugcaagaaaaaa

SEQ ID NO: 163297 - RNA, 64 nt, Human
cagguccacagacaccccaccaccuaggcaggggcugggccagggcuccaaggcuugccccaga

SEQ ID NO: 163298 - RNA, 53 nt, Human
uggaccaggugcugcacugaccgcugggccacacggcugccccucagcccugc

SEQ ID NO: 163299 - RNA, 64 nt, Human
guguuggacuuagaccuccuucaguguggcucugcugggccagaggcauccugcugucccgggu

SEQ ID NO: 163300 - RNA, 64 nt, Human
ccaucaguauuuauugccuccguccgugccgucccugggccacuggccuggcgccuguuccccc

SEQ ID NO: 163301 - RNA, 64 nt, Human
cucuggccuguguccuggguguguaccauaccugcugggccagucccacacauuuccacccugc

SEQ ID NO: 163302 - RNA, 64 nt, Human
cucucggggcuggugccagugccccaggggccuccugggccacgggcuggaggggcugcccagg

SEQ ID NO: 163303 - RNA, 64 nt, Human
gaacaaagccagggggcccagaggagcaauagcccugggccacaagcguggguaggccuuucac

SEQ ID NO: 163304 - RNA, 64 nt, Human
auuucuguuggggagauuccuaggcuagaaauugcugggccauaugaaaaaucaauaguuagcu

SEQ ID NO: 163305 - RNA, 64 nt, Human
cccagugcguccaccugcccuggcuagcaugcugcugggccacaccccaagaucaggggcccug

SEQ ID NO: 163306 - RNA, 64 nt, Human
ccccaggcccugccuguguugaaagcucuggggacugggccagggaagcuccuccucagcuuug

SEQ ID NO: 163307 - RNA, 64 nt, Human
gagcucccugucucuggaaguauuuaagaaaaggcugggccaggcacgauggcucacgccugua

SEQ ID NO: 163308 - RNA, 64 nt, Human
ucugugguugaccucucagcaagugcuauccaggcugggccaaccagacccacaauuaacugag

SEQ ID NO: 163309 - RNA, 64 nt, Human
gagacgggaagaggggggcugucggcugcugcuucugggccacggggagccccaggaccuaugc

SEQ ID NO: 163310 - RNA, 64 nt, Human
cuuggauauuucuggggugacuggacuggcgccccugggccaccuuucuggagacagggagggc

SEQ ID NO: 163311 - RNA, 64 nt, Human
cccugaucucauucugagguccacauggcaccuucugggccagcagcuguggccgguguaucaa

SEQ ID NO: 163312 - RNA, 64 nt, Human
auuucaccccucccuuucuccccugcccccaggacugggccacuucuggguggggcaguggguc

SEQ ID NO: 163313 - RNA, 64 nt, Human
cccucggggcgccccccuccccccgcaagccagccugggccagccccgcuucggccccucccgg

SEQ ID NO: 163314 - RNA, 64 nt, Human
cauaaggcugagcugagaccaguugcuggugaaacugggccaaucuggggaggggaacauccuu

SEQ ID NO: 163315 - RNA, 64 nt, Human
cccugcuuggccccagcuugucugucucuggguccugggccagccaggauaccugauaauaaaa

SEQ ID NO: 163316 - RNA, 64 nt, Human
uguacuaugaaagcuguuauuuuaauaaagaacgcugggccaugaacucauaccugccaaugag

SEQ ID NO: 163317 - RNA, 64 nt, Human
ggccaaagccccaugugccuuguccaggaacugccugggccaugcgaggggccagcagagggcg

SEQ ID NO: 163318 - RNA, 56 nt, Human
agcuggugccaacuuccugauggguccugggccaggccagccagggagaagacaag

SEQ ID NO: 163319 - RNA, 64 nt, Human
cccgccuucggucuguuccuucaagcaagcuggccugggccaugugccugugaaaggcaggcuc

SEQ ID NO: 163320 - RNA, 64 nt, Human
uagggugguuauccaagggcugaauccaguggagcugggccaaguacgacaggaguccagauaa

SEQ ID NO: 163321 - RNA, 64 nt, Human
aacugaggaacuaaagaaagcugaaggugcccaccugggccaccagaaggugacacccccagaa

SEQ ID NO: 163322 - RNA, 64 nt, Human
cuucccccucuucaggugucagugcggagaggcucugggccagaccucacccccagugacuucc

SEQ ID NO: 163323 - RNA, 64 nt, Human
gaggugcugcgccaccggaagcagcacgugugagcugggccaggagcccugcccaccuccgugc

SEQ ID NO: 163324 - RNA, 64 nt, Human
cuccccacagcugguaaucuggacuuaaggauugcugggccaccgccucucugccuaccaccau

SEQ ID NO: 163325 - RNA, 64 nt, Human
guggccuuguccuugaggugagccccauguccaucugggccacugucaggaccaccuuugggag

SEQ ID NO: 163326 - RNA, 64 nt, Human
uggucccuccuuuccccccgucccacgaggccaccugggccagccccuuguccucugccuucug

SEQ ID NO: 163327 - RNA, 64 nt, Human
ccccaccaucccccgcccuccucccugugagacacugggccaaaggcucacuaccccugugcgu

SEQ ID NO: 163328 - RNA, 64 nt, Human
ucuugucacuuaggucucaucucaguggccgcuccugggccacccugucacccaagcuuuccug

SEQ ID NO: 163329 - RNA, 64 nt, Human
agccggccugacccacacccccggccaucgcucccugggccagguuuagagcagggaguuuggc

SEQ ID NO: 163330 - RNA, 64 nt, Human
aaucauuacacagguguccaaccuuuugucuucccugggccacauuggaagaagaaaaauuguc

SEQ ID NO: 163331 - RNA, 64 nt, Human
aaucccucaggacuagggacagggcugugccggccugggccagggcccacggacccgcagcuca

SEQ ID NO: 163332 - RNA, 64 nt, Human
cgaguccuugaauguggcuucaggggcuccuguccugggccagggccugaugggcaccacguga

SEQ ID NO: 163333 - RNA, 64 nt, Human
cgaccucuggccucuggggacauaaacggggcggcugggccagggcggaaggugcuccuguuuc

SEQ ID NO: 163334 - RNA, 64 nt, Human
ugcugggugacccugggugaguggcuuccucucucugggccagugccagaugugacauugaauu

SEQ ID NO: 163335 - RNA, 64 nt, Human
cccccguuuugaacauguguaaccgacagucugccugggccacagcccucucacccugguacug

SEQ ID NO: 163336 - RNA, 64 nt, Human
cgcccaaugcaaaaucgaugaaauggggaguucucugggccaggccacauucacauuccccucc

SEQ ID NO: 163337 - RNA, 64 nt, Human
ccugcucaugcgugguuugggccucugcuaacagcugggccacaugcguguaucuagagccugg

SEQ ID NO: 163338 - RNA, 64 nt, Human
cccgggacugcaggcggcggaugucaggcccugucugggccagaacugagcgcuguggggagcg

SEQ ID NO: 163339 - RNA, 64 nt, Human
ugcuuuccuggaaaaagaagccuuucagguuucccugggccagcaucuucugauggaagguggg

SEQ ID NO: 163340 - RNA, 64 nt, Human
accugaggugacccugggccuugcccccagccaacugggccaccagcuucccucccuugacucu

SEQ ID NO: 163341 - RNA, 64 nt, Human
ccacacgcaugugcgggugccauaaccggcgaggcugggccagccgcuccaccauuuccccgac

SEQ ID NO: 163342 - RNA, 64 nt, Human
cgggugguuccagccauuccugcagccaagggcacugggccagggcggcgcacgcgcaagaggc

SEQ ID NO: 163343 - RNA, 64 nt, Human
aacugcgcgugaggcgcgcggcugugggaccgcccugggccagccuccggcggggacccaggga

SEQ ID NO: 163344 - RNA, 64 nt, Human
uucuagucacuggccucaaaggaccccacagcaccugggccagaccaacagcucgagggagaac

SEQ ID NO: 163345 - RNA, 64 nt, Human
gaggccccagccuaccugcaccuccgugaggcaacugggccacagccccgaugauucguaacac

SEQ ID NO: 163346 - RNA, 64 nt, Human
agggggagggggagagggggaagccgagagggggcugggccacccccuccccucugugcaagug

SEQ ID NO: 163347 - RNA, 64 nt, Human
cucagcugccuaggaggaagggacccagcugggucugggccacaagggaggagacugcacccca

SEQ ID NO: 163348 - RNA, 64 nt, Human
cugaugggggguggggauggguggggggaugggacugggccaagggaucugggugggcauuuuu

SEQ ID NO: 163349 - RNA, 64 nt, Human
agguuucacaccuaugacauacauggaauagcaccugggccaccaugcacucaauaaagaauga

SEQ ID NO: 163350 - RNA, 64 nt, Human
uucuugaccaucuaaugaguguaaaacuguaccacugggccaagugcaguggaucaugucugua

SEQ ID NO: 163351 - RNA, 64 nt, Human
gcagugagccgagauggcgccacugcacuccagccugggccacagacccugucucaaaaaaaaa

SEQ ID NO: 163352 - RNA, 64 nt, Human
uucugaugaggcaaaauccuccagcuauuccugucugggccaguuuuguagguccaucugugca

SEQ ID NO: 163353 - RNA, 64 nt, Human
acuuccuggucaagcuuauggugcuuauuuugaucugggccacuucccuccuuccagucaugag

SEQ ID NO: 163354 - RNA, 64 nt, Human
cucuuccaagccaccuugcccgcagcccaggcuccugggccagugcucucuccucaaauggagg

SEQ ID NO: 163355 - RNA, 64 nt, Human
uucuggaacggggcgugaggacacaaggaggccucugggccacgccucccuaccagaugcagga

SEQ ID NO: 163356 - RNA, 64 nt, Human
caugagugacugcccugacguauucacugugccucugggccacuucuuccccuguagauguggg

SEQ ID NO: 163357 - RNA, 64 nt, Human
augucuuuaguguugagccucuggauucuggggucugggccaguggccauagugaagccuggga

SEQ ID NO: 163358 - RNA, 64 nt, Human
acuguagaugacuaggacaagaacaaugaccucucugggccacaguuuccuuauagacaugaug

SEQ ID NO: 163359 - RNA, 64 nt, Human
cugaaugcacgugacaccgacugacuucagggaucugggccaggagugugguggacauuggaca

SEQ ID NO: 163360 - RNA, 64 nt, Human
ugggucaagagcuggagugguggcuccauccucucugggccacuucggucuaggaacucaucuu

SEQ ID NO: 163361 - RNA, 64 nt, Human
gcuagccaaaauauuuuuguccugaguagugucacugggccaaaagauagaucaggacgacagc

SEQ ID NO: 163362 - RNA, 64 nt, Human
cauuccuaagaguggaggaggaggaggagccuugcugggccagggaaacaaaguuuacauuguc

SEQ ID NO: 163363 - RNA, 64 nt, Human
ugcuauaaguuuuagaaucuuuuaaauacauucccugggccaacagacccacacacuuagccau

SEQ ID NO: 163364 - RNA, 64 nt, Human
cuuguuuuguucguuuugggggugguggugcuggcugggccaugcuugugaagugauguguguc

SEQ ID NO: 163365 - RNA, 64 nt, Human
uugaugggaagugcagucagcagcguggaggugucugggccaccuucagaagguggauguggug

SEQ ID NO: 163366 - RNA, 64 nt, Human
agcccgggucaccaugcacaauccucuggccuggcugggccacugcccucuguccaucucuugc

SEQ ID NO: 163367 - RNA, 64 nt, Human
cuggcagucccuggcugcagaccccgagcuggcccugggccagccgcaccucugaagguuuucu

SEQ ID NO: 163368 - RNA, 64 nt, Human
ucacugcaaugcuggacacuacagguaucugucccugggccagcagggaccucugaagccuucu

SEQ ID NO: 163369 - RNA, 64 nt, Human
uuccccauucuuccuaguuuucuccucccaggaacugggccaacucaccugagucacccuaccu

SEQ ID NO: 163370 - RNA, 64 nt, Human
uucugcccucugacaccauugcagcugccugcaccugggccacauggccuucagaaccuucucu

SEQ ID NO: 163371 - RNA, 64 nt, Human
gggccuuguggcagugccaguguucggggggugucugggccacugaguacccacucggucgugg

SEQ ID NO: 163372 - RNA, 64 nt, Human
cugcauggaccucagggggcuguggggccagaagcugggccaagcccuccagccagaguugcca

SEQ ID NO: 163373 - RNA, 64 nt, Human
gaggagugaccuugggccaggccucgggaggcugcugggccagugugggugagcguggguacga

SEQ ID NO: 163374 - RNA, 64 nt, Human
ggcaaguccucaauccugugucccagaggucccucugggccacaacccaacccuucucacucuc

SEQ ID NO: 163375 - RNA, 64 nt, Human
acuccaacauugcauccuuucuggggugaagaaucugggccaaccagggguccuugggccucua

SEQ ID NO: 163376 - RNA, 64 nt, Human
gaugcacucagcuucguguuggccaagacuccuucugggccaauggggcugccucuuuuccuuu

SEQ ID NO: 163377 - RNA, 64 nt, Human
gcuggggucuccaggggaugacuguuuucaaucucugggccaagaucacaugcaggauaccaug

SEQ ID NO: 163378 - RNA, 64 nt, Human
gagucucauuccucuguccccgagccgagcucuccugggccagggucucgucaggaggugccug

SEQ ID NO: 163379 - RNA, 57 nt, Human
gggccgggcccaggaagugaggcggcgcugggccaguggacccgcccgcggcccucc

SEQ ID NO: 163380 - RNA, 64 nt, Human
ccacccuccccaccacccuccgccaucagccugccugggccagccugccuccuggccucaggau

SEQ ID NO: 163381 - RNA, 64 nt, Human
ccguuccaccucccaggccacccuuccugggcuucugggccaccugcccucggggggccccugc

SEQ ID NO: 163382 - RNA, 64 nt, Human
ggaaacaagcgggaauugcauuggggggcauuuucugggccaguuucccugccuuauuuuaccu

SEQ ID NO: 163383 - RNA, 64 nt, Human
acuugaggaagaugcuaacgcaguaaggucugugcugggccaagagcagcuuugaagcuccaga

SEQ ID NO: 163384 - RNA, 64 nt, Human
aagaccugccagggagaugggacccuugugccaccugggccagcaaagaggagggguccagaga

SEQ ID NO: 163385 - RNA, 64 nt, Human
cccuggggcuagggggagccccuucugcucagcucugggccauucuccacagcaaccccaggcu

SEQ ID NO: 163386 - RNA, 64 nt, Human
aggccaggaguccagcugcugaugggcacccgcccugggccagcugggcucaguuccugaccug

SEQ ID NO: 163387 - RNA, 64 nt, Human
aagaagaaagaaaggcccguccacaggcccggcucugggccacgugccccggaagcaggugugu

SEQ ID NO: 163388 - RNA, 64 nt, Human
ugucaaacccuaggauagucucauaaaggggaggcugggccagccugcugcugucugcuucagg

SEQ ID NO: 163389 - RNA, 64 nt, Human
aagggcccugaggucagcucccaggucggucgugcugggccaggccugguuuucacaggggcug

SEQ ID NO: 163390 - RNA, 64 nt, Human
augaagaaaagacacagagaaggaugugacaugccugggccauggagcacucugagaucucauc

SEQ ID NO: 163391 - RNA, 64 nt, Human
ccccaacccagacccccuuuucuccauguaccugcugggccagcccauuucacaggugaggaac

SEQ ID NO: 163392 - RNA, 64 nt, Human
gggcugaacuuugggagggccccuguacuaccuccugggccaagaaacuggcacagccccacac

SEQ ID NO: 163393 - RNA, 64 nt, Human
guauaguucagggguauccaauccuuuggcuucccugggccauguuggaagaauugucuugggc

SEQ ID NO: 163394 - RNA, 64 nt, Human
cuugggcuccuuuuacuuucagggggcugcuuuccugggccaggcuguguagcacuucccaccc

SEQ ID NO: 163395 - RNA, 64 nt, Human
uggccucucccucacuuugagacuuuggcaacuccugggccacacggccugccucuuugauuac

SEQ ID NO: 163396 - RNA, 64 nt, Human
aaagcugagaugcugagagagauagcucccugagcugggccaucugacuucuaccucccauguu

SEQ ID NO: 163397 - RNA, 64 nt, Human
uguccccagcaaguguaggaguggugggccugaacugggccauugaucagacuaaauaaauuaa

SEQ ID NO: 163398 - RNA, 64 nt, Human
auggccucuuccuccucagggaccucugacugcucugggccaaagaaucucuuguuucuucucc

SEQ ID NO: 163399 - RNA, 64 nt, Human
gguucugcucuuccaggcaggccagcaaguggcgcugggccacacuggcuucuuccugccccau

SEQ ID NO: 163400 - RNA, 64 nt, Human
gagaaucgcuugagcccaggaauucgagaccagccugggccacaugacaaagccccaucucuac

SEQ ID NO: 163401 - RNA, 64 nt, Human
ggcauggguggucccugcuucgauggccccaaagcugggccagaguuaagggaaagaggaggaa

SEQ ID NO: 163402 - RNA, 64 nt, Human
gucuuugugcaauaaucaguguuccuggcagagccugggccaagcugcagccuacugaggaggc

SEQ ID NO: 163403 - RNA, 64 nt, Human
uccuuuacccugacucacaagccccacugaugcucugggccaugcccggcugacggcugcugug

SEQ ID NO: 163404 - RNA, 64 nt, Human
gccuugucuucuuagcugucaccugccgaggcuucugggccacucaggccagugcaccccuggg

SEQ ID NO: 163405 - RNA, 64 nt, Human
ggcacccuucugcugcgcugauacguuucuuacacugggccauuuuagacccccagggaaacag

SEQ ID NO: 163406 - RNA, 64 nt, Human
cagcagaggacuccagccuucucggggcccaggccugggccagaagcuguugaccauaccagga

SEQ ID NO: 163407 - RNA, 64 nt, Human; identical to SEQ ID NO: 163388

SEQ ID NO: 163408 - RNA, 64 nt, Human
gaacaucccacuagcaggaaggcccuguguggcccugggccaagcacgccagcucucagcaggu

SEQ ID NO: 163409 - RNA, 64 nt, Human
ccaggccaggcccucaggaauucccugguuuccacugggccacccacuugcuggacagucugag

SEQ ID NO: 163410 - RNA, 64 nt, Human
gcccggacacccauagacggugcggggggccuggcugggccagaccccaggaaggugggguaga

SEQ ID NO: 163411 - RNA, 64 nt, Human
uugcuuuagggugucaggguccaggcugcaggggcugggccaauuuguggagaggccgggugcc

SEQ ID NO: 163412 - RNA, 64 nt, Human
ucuccagccagcccugaccccucaugcucucuggcugggccagugggcagcccucgcuucccuu

SEQ ID NO: 163413 - RNA, 64 nt, Human
cuauggcaguucucccaggauguguggcgagagccugggccagcccacagcguuccuagucagg

SEQ ID NO: 163414 - RNA, 56 nt, Human
ucaaggccgaggacgacugagggccucugggccacccucccggcuggagagcucag

SEQ ID NO: 163415 - RNA, 64 nt, Human
cuugaccccaggcugaacagaccacugcaucucacugggccagcagcccccccagcccccagcc

SEQ ID NO: 163416 - RNA, 64 nt, Human
cccagaauugggaccggggccccgcuggccagcccugggccacuucccgggucuccauugugcg

SEQ ID NO: 163417 - RNA, 64 nt, Human
uugggggaaacgggcuccuuccccugcaccuggccugggccacaccugagcgcuguggacuguc

SEQ ID NO: 163418 - RNA, 64 nt, Human
cuguuccccuagacuucucaggggccagcccagucugggccacccuuuguuucccucauccucg

SEQ ID NO: 163419 - RNA, 64 nt, Human
auaggucugaccccaguccccacucccuuucaggcugggccacagggaguugcuggcuggccac

SEQ ID NO: 163420 - RNA, 64 nt, Human
uggggagcagcuaugcaaaucccuaccuacccagcugggccagaggcacgaggcagccaggcag

SEQ ID NO: 163421 - RNA, 64 nt, Human
gcuaggucaucgggcggcacccugcacagagcuccugggccagccugcgccagggaugcugcug

SEQ ID NO: 163422 - RNA, 64 nt, Human
ccaaaggccacaggcaugagggaggcguggaccacugggccagcaccgcugaguccuaagacug

SEQ ID NO: 163423 - RNA, 64 nt, Human
cagaucaggccuuggccucugagcccugccugcucugggccaugcagaggaaggacagagggug

SEQ ID NO: 163424 - RNA, 64 nt, Human
accggauucuuucucggguucugccuagcaucaacugggccacgucggccuucagagaacagug

SEQ ID NO: 163425 - RNA, 64 nt, Human
cugguuugcuuagauuauucaagaauguggaggccugggccaaggucaaugacagugucuccau

SEQ ID NO: 163426 - RNA, 64 nt, Human
gagcauacuccaguuuacuaauacagcaggguaacugggccagauguucuuucuacagaagaau

SEQ ID NO: 163427 - RNA, 64 nt, Human
auaacagccccuuucucaagcagagaccuggccccugggccagccagauggaagggccuaucuu

SEQ ID NO: 163428 - RNA, 64 nt, Human
cuggggccuggaaagaggaagaggcugccuggggcugggccagcccgcugugcacuuugacccc

SEQ ID NO: 163429 - RNA, 64 nt, Human
ucucucaguuuucaugacaggucuauauuucuaccugggccaggccaggaaagagacuauuuaa

SEQ ID NO: 163430 - RNA, 64 nt, Human
cagcuagggccaguggggcagguugugggagggccugggccagugcacguuccagggccacauc

SEQ ID NO: 163431 - RNA, 64 nt, Human
gaguugcagccagggcuguggggaaggggcagggcugggccagugcaucuaacagcccugugca

SEQ ID NO: 163432 - RNA, 64 nt, Human
augagcuauaauuauugcaccacugaacuccagccugggccacauagcaagacccugucuccaa

SEQ ID NO: 163433 - RNA, 64 nt, Human
gcaguaagccgagaucgugccacugcacuccagccugggccacagagcaagacuccgucucaaa

SEQ ID NO: 163434 - RNA, 64 nt, Human
ccagauucuaucauugauguugcaauagaugccacugggccacggggugccuggacuaauaacu

SEQ ID NO: 163435 - RNA, 64 nt, Human
auggaugggcuggugggcagggggguggcuggggcugggccaucaccauuccagagacaaggcc

SEQ ID NO: 163436 - RNA, 64 nt, Human
aaucuggguugugaggaaauaggggagagguauccugggccacaucccagccuaacaccuguga

SEQ ID NO: 163437 - RNA, 64 nt, Human
cuaucaaaggaaaugagaaugacagccuuuuuuccugggccagaaguagaggggugggugcgua

SEQ ID NO: 163438 - RNA, 64 nt, Human
aauauguuggguuuauuuuccugugauuucuccucugggccacugauccacaguuaccaauuau

SEQ ID NO: 163439 - RNA, 64 nt, Human
gcaugagcugcagccagggccacugcgaggggggcugggccagugcaccuuccagggcuccguc

SEQ ID NO: 163440 - RNA, 64 nt, Human
gcacgaguugcagccagggccagugggagggggucugggccagugcaccuuccaaggccccauc

SEQ ID NO: 163441 - RNA, 64 nt, Human
gcacauguugcagccagggccagugggagggggucugggccagugcaccuuccagggccccauc

SEQ ID NO: 163442 - RNA, 64 nt, Human
gcacgaguugcagccagggccagugggagggggucugggccagugcaccuuccggggccgcauc

SEQ ID NO: 163443 - RNA, 64 nt, Human
gcaugaguugcagccaaggccagugggagggggacugggccagugcaccuuccagggccgcguc

SEQ ID NO: 163444 - RNA, 64 nt, Human
auuuggccagaguucgccuacagauaagaaggcacugggccaggcucacaccuguaauccuaag

SEQ ID NO: 163445 - RNA, 64 nt, Human
gcugcugggagcagaacagucccucacaccugggcccgggcaggccagcuucgugcuggaggaa

SEQ ID NO: 163446 - RNA, 64 nt, Human
gaggggguggggagcuucuguucuggugaagggacccgggcaggcccccagcaccccaugcuga

SEQ ID NO: 163447 - RNA, 60 nt, Human
cccugagcguccuguucugagggcccagggcccgggcacccacaagcccgugacagaugc

SEQ ID NO: 163448 - RNA, 64 nt, Human
cacgcagccagggcuucacacccuucaggcugcacccgggcaggccucagaacggugaggggcc

SEQ ID NO: 163449 - RNA, 64 nt, Human
caaaagugcuucauuuuucgugcccgccccgcgccccgggcaggccagucauguguuaaguugc

SEQ ID NO: 163450 - RNA, 64 nt, Human
gguccagguuccccugcugugcagggagggcagccccgggcagugggcauagggcagcucaguc

SEQ ID NO: 163451 - RNA, 64 nt, Human
cgcgucugacucuuguggccucagcaggacaggccccgggcacugccucacagccaaggcugga

SEQ ID NO: 163452 - RNA, 64 nt, Human
gagaggagcgaagauccggaacucgccaacucaccccgggcauccugcccgccgccugcucucu

SEQ ID NO: 163453 - RNA, 64 nt, Human
cagggaccacggcuuugguuccucacccacuucccccgggcagcuccagggauguggccucauu

SEQ ID NO: 163454 - RNA, 64 nt, Human
ggguaauuugaucauuaaaauuaugugaaaucugcccgggcacaccucaugccuguaaucccag

SEQ ID NO: 163455 - RNA, 64 nt, Human
aguaaaccaggacugcugcccgcacagcuucccucccgggcacucaccucgccaucccugccgu

SEQ ID NO: 163456 - RNA, 64 nt, Human
ggcugauugugaccgaaaccagaggguuguccaccccgggcaucucaucccucaacuguaaaau

SEQ ID NO: 163457 - RNA, 64 nt, Human
gccacguaugaggugccugcccugggcucuggaccccgggcacacgagggacggugcccugagc

SEQ ID NO: 163458 - RNA, 64 nt, Human
uccaggcugcacgcggcggacugggcaggccgggcccgggcacuggugggugacagucauacuu

SEQ ID NO: 163459 - RNA, 64 nt, Human
gugacagucauacuucguggagcccagcgagcaucccgggcaagcacuaccaggcugugggucu

SEQ ID NO: 163460 - RNA, 64 nt, Human
ggagcugugagaagcagcagaggggacuccccaucccgggcacacccuguccucccaccccugc

SEQ ID NO: 163461 - RNA, 64 nt, Human
gccaccaugcuugccugaagcuucggccgcgccacccgggcaaggguccucuuuuccuggcagc

SEQ ID NO: 163462 - RNA, 64 nt, Human
ggcagaucgcuugaggucaggaguucaagaccagcccgggcaacguggugaaacccggucugua

SEQ ID NO: 163463 - RNA, 64 nt, Human
cuaccugccuuacagagcagcccagguacccaggcccgggcagacaaggccccugggguaaaaa

SEQ ID NO: 163464 - RNA, 64 nt, Human
uuuuccuuccauguggucugaauguuggcaccagcccgggcaggggcaucucauuugggcagua

SEQ ID NO: 163465 - RNA, 64 nt, Human
caccccaccaucuuccgccaggugugccuggccucccgggcaucccaccaccggguaagaacuu

SEQ ID NO: 163466 - RNA, 64 nt, Human
acugcauccgguuccuccucuuucugccgacucucccgggcaaccguucugauuccuggcaugg

SEQ ID NO: 163467 - RNA, 64 nt, Human
aauuuucccuguuuggaaaguuugccccagcuuucccgggcacaccaccuuuugucccaagugu

SEQ ID NO: 163468 - RNA, 64 nt, Human
caugccgcggccccucuguuguuucagacugacacccgggcagccgagaagaacagacgcucuu

SEQ ID NO: 163469 - RNA, 64 nt, Human
gauucgacagggaagagcuuggauccccggcugccccgggcaugaguguggcuggccaugggca

SEQ ID NO: 163470 - RNA, 64 nt, Human
gaaaccccaucgcuacuaaaaauauaaaaaauuacccgggcaugguggugggcgccuguagucc

SEQ ID NO: 163471 - RNA, 64 nt, Human
accggcccugagcacgagaagagccuccgcccggcccgggcaccacccgaccucgcagggagca

SEQ ID NO: 163472 - RNA, 64 nt, Human
uccccgauccccgacaguggcucuccaagcggcccccgggcagccccagagcaccccgcccgac

SEQ ID NO: 163473 - RNA, 64 nt, Human
uccugucuaccucauacuagaaugaucgugacuacccgggcagacauuuuacuguguuucucag

SEQ ID NO: 163474 - RNA, 64 nt, Human
ugcagugcaccaagacugcgccauugcacuccagcccgggcaacaagagcgaaaccccaucucg

SEQ ID NO: 163475 - RNA, 64 nt, Human
ccaccggcgcuggcggcgcgcccugccccacggacccgggcagugaaccagagaucacgcgccg

SEQ ID NO: 163476 - RNA, 61 nt, Human
uggagaugaagcccaaauagaaggggucuggcccgggcauccacguagggggcaggggcag

SEQ ID NO: 163477 - RNA, 64 nt, Human
gggggguuagagcaggaccacagccuggugaguccccgggcagccguccugcagccgccacucc

SEQ ID NO: 163478 - RNA, 64 nt, Human
caaaguguugggauuacaggcgugagccacugcgcccgggcaagaccuuuuuuuaaaaaaaaaa

SEQ ID NO: 163479 - RNA, 64 nt, Human
ugaggccaccagaggcaggaguggcccugggggucccgggcacugucgcgcuugcugcaggcgg

SEQ ID NO: 163480 - RNA, 64 nt, Human
gggagaggcuggaggccugggcagaacagcgccgcccgggcagacggcugcuugguuccagagc

SEQ ID NO: 163481 - RNA, 64 nt, Human
gcuguguucacaugugccuuccguccagagcagucccgggcaggggugaaacuccagcaggugg

SEQ ID NO: 163482 - RNA, 64 nt, Human
gggucaguggaagccccaacgggaaaggaaacgccccgggcaaagggucuuuugcagcuuuugc

SEQ ID NO: 163483 - RNA, 64 nt, Human
guggccucauccucccccaaggcugugcuugcagcccgggcaccuucccacuuucuagcucugg

SEQ ID NO: 163484 - RNA, 64 nt, Human
aucaggacugagccaggagccccacuagccugugcccgggcauggccuggcagcucuccagcag

SEQ ID NO: 163485 - RNA, 64 nt, Human
cuuucuucuuuguaucucccuccuucccagcccacccgggcagcagacucugauggaaggaagg

SEQ ID NO: 163486 - RNA, 64 nt, Human
acugaggcuccagggugagaaggcucacuucugccccgggcacugcguccagcagcagagggga

SEQ ID NO: 163487 - RNA, 64 nt, Human
ccccauucacguugguccucagggaaaccagggucccgggcaggcccggcgcuuugcuccccac

SEQ ID NO: 163488 - RNA, 64 nt, Human
gacaccauucuccagcuucaggggauaugcucgucccgggcaccgguggcaggcagcuggccuu

SEQ ID NO: 163489 - RNA, 64 nt, Human
aaaaccucacucaccacggagucacccugagggccccgggcaguugcccuggccgcccagugac

SEQ ID NO: 163490 - RNA, 64 nt, Human
ucccauggagcucucuucccgccgcacuuucuaccccgggcagaggcgcuugcccacgggacgu

SEQ ID NO: 163491 - RNA, 64 nt, Human
uggccacagcagccuuacccaccgcucuacgugucccgggcacuucccgcagccuucccguccc

SEQ ID NO: 163492 - RNA, 64 nt, Human
aacccgcaccgugagucuggcucagcagcccccucccgggcagcuucaccccacacccaggggc

SEQ ID NO: 163493 - RNA, 64 nt, Human
augggcucacgccaggaacgccgguucccccgggcccgggcaucucgccugcgcuuccuccuga

SEQ ID NO: 163494 - RNA, 64 nt, Human
cccacugccccugccugagaacgccaucucggcucccgggcacagcugaugggguuuggggauu

SEQ ID NO: 163495 - RNA, 64 nt, Human
gaacaaacacuaaaugugccucugagauggccaccccgggcagggaccugugccuuccgccgau

SEQ ID NO: 163496 - RNA, 64 nt, Human
ugcggagagucgagaugcucccugcagcccaggccccgggcaccuccugcaaccaucucugggc

SEQ ID NO: 163497 - RNA, 64 nt, Human
cacacaaucagcgcggaccgcagcgcggcccagccccgggcacccgccucggacgcucgggcgc

SEQ ID NO: 163498 - RNA, 64 nt, Human
accuccacccucccacccccuggaagaggaagggcccgggcaucaguggcuaguccaaauaaaa

SEQ ID NO: 163499 - RNA, 64 nt, Human
ccagcuuagaacagcccuuggugagguggucaugcccgggcaaaggcccugcuuccuggaaagg

SEQ ID NO: 163500 - RNA, 64 nt, Human
uccacauuggccucugcagcugggugaccagagccccgggcacggccccagcuccguggggcuc

SEQ ID NO: 163501 - RNA, 64 nt, Human
agccugcagaacuggaggcgaccugugaaacccacccgggcaccccaacaggaacagaagcgug

SEQ ID NO: 163502 - RNA, 64 nt, Human
ccaaaagugcugggauuauaggcgugagccaccgcccgggcaaauuuuuguauuuuuaguagag

SEQ ID NO: 163503 - RNA, 64 nt, Human
gggccagggacuccuggagcaggcacauagugagcccgggcagcccugcccagcucaggccccu

SEQ ID NO: 163504 - RNA, 64 nt, Human
gggcagguggaggagcugggccucccacagggugcccgggcagugccauccuggugggggaggg

SEQ ID NO: 163505 - RNA, 64 nt, Human
ccucuggccucccgugacccccaggccgaggguccccgggcacccaggucggucaagucucggc

SEQ ID NO: 163506 - RNA, 64 nt, Human
ccacccggccccgcccaggcacggccgaccccgccccgggcaccgcccaccgagccauccugcc

SEQ ID NO: 163507 - RNA, 64 nt, Human
uucucggggccggagaagagaccaagagaccaggcccgggcagcagccuaccggccacguggaa

SEQ ID NO: 163508 - RNA, 64 nt, Human
gucauggggcugucuccccugacaggcacaacuccccgggcagaaaacgugccccaccgcaucc

SEQ ID NO: 163509 - RNA, 59 nt, Human
agaucaaugggaugauauaggcccgaguccccgggcaucuuuggggagguguucacuga

SEQ ID NO: 163510 - RNA, 64 nt, Human
ggugacacggggcccuggcuuuccacuuuggaugcccgggcauccgcugcugcuacaucuuagc

SEQ ID NO: 163511 - RNA, 64 nt, Human
ggcuuccugcccccuccuugcccaccugccugcccccgggcagcacgggagggagagcagggug

SEQ ID NO: 163512 - RNA, 64 nt, Human
cucugccucuuucuggccucacccucucccccaacccgggcacccucggcccucccugcagccu

SEQ ID NO: 163513 - RNA, 64 nt, Human
cugcccuuugugauucccucagaucugcccuaaucccgggcauuugggugggggaaucuugccu

SEQ ID NO: 163514 - RNA, 64 nt, Human
agcccuuccuccaucagaagacaggagugagggccccgggcagcaguggacgacccagccuccc

SEQ ID NO: 163515 - RNA, 64 nt, Human
cuacgaagaugaauaaagagaaucuggaccacuacccgggcaccagggaccacagcacugguuu

SEQ ID NO: 163516 - RNA, 64 nt, Human
cugcccuugccccugugcucaagcuguccaccaucccgggcacuccaaggcucagugcacccca

SEQ ID NO: 163517 - RNA, 64 nt, Human
ggcccgggaggcacacacgagucugggacucauucccgggcacaccuauggcuccuucgguauc

SEQ ID NO: 163518 - RNA, 64 nt, Human
cuccuaaggcucucauucagccuaucuugcgaggcccgggcagcuggaaaguccuccuccagcu

SEQ ID NO: 163519 - RNA, 61 nt, Human
gcaccuccaacucugccugaaaggggcagcucccgggcaagacaagguaaggucccggcac

SEQ ID NO: 163520 - RNA, 64 nt, Human
ccagcagguccacuccugguuccuguguguuuggcccgggcacaauccccacugcuuugcuaga

SEQ ID NO: 163521 - RNA, 56 nt, Human
uuucaggaccuggacagugaagggagcccgggcagccaccgucuccagagcccugg

SEQ ID NO: 163522 - RNA, 64 nt, Human
aacgucauguuuaauacagagccuccagcuggggcccgggcagucccuggaggugaguguuagg

SEQ ID NO: 163523 - RNA, 64 nt, Human
gggcuacccaggggcuuccuauccuggggccuaccccgggcaggcacccccaggggcuuauccu

SEQ ID NO: 163524 - RNA, 64 nt, Human
gaggcgcaggaccucaccgcgccagcgugaaguucccgggcauggucaugaaagcgugguucug

SEQ ID NO: 163525 - RNA, 64 nt, Human
guuggaaagaguuggauuggacccuacuugccuucccgggcaaggauaggaccuuucacgcaag

SEQ ID NO: 163526 - RNA, 64 nt, Human
gucucuucugggcacccucccacccggcugcauacccgggcagggcucccacagagacaaggag

SEQ ID NO: 163527 - RNA, 64 nt, Human
ugcagugagcugagauugugccauugcauuccagcccgggcaacaagagcgaaauuccgucuca

SEQ ID NO: 163528 - RNA, 64 nt, Human
gccaaucucuccccuuccaaagcaggcccugcuccccgggcagccucccgccgaggggcccagc

SEQ ID NO: 163529 - RNA, 64 nt, Human
uacuccucagagacugguuucccucuaaacccaucccgggcacauaccacccguguuuugcaug

SEQ ID NO: 163530 - RNA, 63 nt, Human
agacugaggcccacgcuugagguccccggagcucccgggcacauccaggaaggaccuugcuuu

SEQ ID NO: 163531 - RNA, 64 nt, Human
ggcccagccuggagcuggcgcugugcagccucaccccgggcaggggcggcccucguugucaggg

SEQ ID NO: 163532 - RNA, 64 nt, Human
gacuuaggaauacuugaugggcagcggugcagaccccgggcaccugcgugcagccuccuguucu

SEQ ID NO: 163533 - RNA, 64 nt, Human
uccacccgaggggaagaugcucucgggacaguuucccgggcagcuccuggccagcuuccagccc

SEQ ID NO: 163534 - RNA, 64 nt, Human
aacucuucugugaaauagcaauaauguccuacugcccgggcagccccagcccagcccgccggga

SEQ ID NO: 163535 - RNA, 64 nt, Human
acaccucucuccacggaaaggucacaguggacagcccgggcaguaggaugcagccccagaggcu

SEQ ID NO: 163536 - RNA, 64 nt, Human
caaaagaaguguugguaauggauaaauaacauaucccgggcagaugagcucaaccuaguaggua

SEQ ID NO: 163537 - RNA, 64 nt, Human
cacacccgcucugucuucccacugucccccccaucccgggcagggcccagugggauugaggggg

SEQ ID NO: 163538 - RNA, 64 nt, Human
ccgaccuucggucccuccgcccucccagccccgccccgggcaggggggcggcgggugggcccgc

SEQ ID NO: 163539 - RNA, 64 nt, Human
ccugcaaauaugcaaaccccccaucaucugcacacccgggcagugcucagagcccggccccagg

SEQ ID NO: 163540 - RNA, 64 nt, Human
gauaauggcuggcccuggguggggauaguuuacacccgggcagcagcaccacacaugaacccaa

SEQ ID NO: 163541 - RNA, 64 nt, Human
cugccgacugccugcacagggagagcaguugaggcccgggcagggcccccacaccagaccccaa

SEQ ID NO: 163542 - RNA, 64 nt, Human
uucugguuuaggcacacgucacgggugcgggagacccgggcacgggagacccgggccgccuuca

SEQ ID NO: 163543 - RNA, 64 nt, Human
gcacccagcacagccugcccagcccagcccugcccccgggcacugcacagccugucugggggcc

SEQ ID NO: 163544 - RNA, 64 nt, Human
uccuguggcuuccagagugugcacuuccagcccacccgggcagugcugagagggaggaggagaa

SEQ ID NO: 163545 - RNA, 64 nt, Human
agccaccccaucugggaagugaggagcgucuacgcccgggcagcugccccguccgggagggagg

SEQ ID NO: 163546 - RNA, 64 nt, Human
uguacagcaggcaggagggugggcaggcaaccuccccgggcaggguccuggccagcaguguggg

SEQ ID NO: 163547 - RNA, 64 nt, Human
gugaccccgcaccagcccugcccccaccugcccucccgggcaguacuggggaccuucccugggg

SEQ ID NO: 163548 - RNA, 64 nt, Human
cgggcggauuuggggagggcccugaggaccuggccccgggcaagggacucuccaggcuccuccu

SEQ ID NO: 163549 - RNA, 60 nt, Human
cgcugguguccacagugugaggacgcugaccccgggcagccgcugcucugaagagcuucc

SEQ ID NO: 163550 - RNA, 64 nt, Human
gaggaagccggccgcuccugugagggaggccgggcccgggcaccugagggcuucucccucugga

SEQ ID NO: 163551 - RNA, 64 nt, Human
aggguauccggugcgcagggagguggccagcgcccccgggcacugcugcucauagguaccuuuc

SEQ ID NO: 163552 - RNA, 64 nt, Human
aaagaucaucagaggcugaaaucuagaacuucaucccgggcaaugagguucucacagaaggugc

SEQ ID NO: 163553 - RNA, 64 nt, Human
cgcugccacuggggaggguggcuguugccgccugcccgggcauccugcucuggcaagcacagcc

SEQ ID NO: 163554 - RNA, 64 nt, Human
cccugcugcgucuuucuaggcccuucuugcaaaucccgggcaugagcuacucgccgucggcucu

SEQ ID NO: 163555 - RNA, 55 nt, Human
ccacuguggagcuucccugagggugcccgggcaagucuugccagcaaggcagcaa

SEQ ID NO: 163556 - RNA, 64 nt, Human
cuuuccagguagcuggcgucucugggaaccuggccccgggcaaccagccagagaaggagggccg

SEQ ID NO: 163557 - RNA, 64 nt, Human
gcggggcccuccuggcaggguagggaaggaggaccccgggcaccccccucagggccugacucac

SEQ ID NO: 163558 - RNA, 64 nt, Human
ggggggcauggguggagcagaggggcucccucaccccgggcaggcaaaggcaguggguagagga

SEQ ID NO: 163559 - RNA, 64 nt, Human
gggggcggcaguggcuccgcgcacucacccgggccccgggcaggggcgcgcuccacuucguugc

SEQ ID NO: 163560 - RNA, 64 nt, Human
cggggccgcccugccccggucacucaccugugcucccgggcauccuccugucccuggcuccuca

SEQ ID NO: 163561 - RNA, 54 nt, Human
agcuggagaugaucgucugagccccccgggcacuggguggggcagggcacgagu

SEQ ID NO: 163562 - RNA, 56 nt, Human
agaugaugacugcaaagugaaggccccccgggcagcuggcgaugcccguucucuug

SEQ ID NO: 163563 - RNA, 64 nt, Human
cuuuucuccuucucugccucccucaagaugagugcccgggcaugagaagcacaugguuccauga

SEQ ID NO: 163564 - RNA, 64 nt, Human
ucggcuuuggauauuggagcccacgugggcccaccccgggcagcagagaaggcccagcugacag

SEQ ID NO: 163565 - RNA, 64 nt, Human
cgacaucaugaccuucugucccggccgccuuagccccgggcacagggaaggcagcugggccguu

SEQ ID NO: 163566 - RNA, 64 nt, Human
ccggacaggaggagagcagugaugcggauggguacccgggcacaccagcccucagagaccugag

SEQ ID NO: 163567 - RNA, 64 nt, Human
cgugagcccaccccgccugcccucccacccccuccccgggcagcagagagagagagagagaaag

SEQ ID NO: 163568 - RNA, 64 nt, Human
acuaccggggcuccgacuacgacgaggccgauggcccgggcagcgggggcggcgaggaggccau

SEQ ID NO: 163569 - RNA, 64 nt, Human
ggauagcagcugugcacgagacaaucuugcaacacccgggcauguuugucgucguccuacaaau

SEQ ID NO: 163570 - RNA, 64 nt, Human
cccgacgcagacccggaggagcaucagcaaggggcccgggcagagaaucggcuaugucuucauu

SEQ ID NO: 163571 - RNA, 64 nt, Human
ugcagugagcugagaucgucccacugcacuccagcccgggcaacagaguaagacccugccucaa

SEQ ID NO: 163572 - RNA, 64 nt, Human
gcagcccacacaggaacgcuccucucgcgagcggcccgggcagggacccugucccaacaccaac

SEQ ID NO: 163573 - RNA, 64 nt, Human
uucagccuccuguuuggugggguggcaccuguuucccgggcaauuuaacaaugucugaaaaggg

SEQ ID NO: 163574 - RNA, 64 nt, Human
acgcaucguguccaccuggugccggcgugauugccccgggcacccccagccagaacacgcagug

SEQ ID NO: 163575 - RNA, 64 nt, Human
cuuuccauguugcugagaggaaccuggacauggucccgggcaucugaaugaucuguaggggagg

SEQ ID NO: 163576 - RNA, 64 nt, Human
ucccaaggcgugcaggggcgguccagaggaggugcccgggcaggggccgcuucgccaugugcug

SEQ ID NO: 163577 - RNA, 64 nt, Human
caagcucuuaacuauuuaaaaaugaaauuacaggcccgggcacgguggcucacaccuguaaucc

SEQ ID NO: 163578 - RNA, 64 nt, Human
agcuggagccugcccuguccacggcccguuuccacccgggcauguucgucucuccugacuucgg

SEQ ID NO: 163579 - RNA, 64 nt, Human
cccaaagcccugcugcauucgagugucccccaaccccgggcagguggcaccuggugacaccucc

SEQ ID NO: 163580 - RNA, 64 nt, Human
cucagaugcucacuggcuccucccugaccucccccccgggcaggcgagcccuggcuucuccuca

SEQ ID NO: 163581 - RNA, 50 nt, Human
aguucucacucacgcccugacccgggcagacaugauggggggugcagggg

SEQ ID NO: 163582 - RNA, 64 nt, Human
gggaccccgagaccgcgcuggcccucugcuaaagcccgggcacccgcccagccgggcugggccc

SEQ ID NO: 163583 - RNA, 64 nt, Human
cacuguauuacauaaauaaauuaaauaaaauaaccccgggcaagacuuuucuuugaaggaugac

SEQ ID NO: 163584 - RNA, 64 nt, Human
uuaaccucugagcagugauauagcauaauaaagccccgggcauuauuauuauuauuucuuuugu

SEQ ID NO: 163585 - RNA, 64 nt, Human
uuuggccacauccaccucgaggggacccuggcaccccgggcacacaaaccucugugguauaggu

SEQ ID NO: 163586 - RNA, 64 nt, Human
agaaguauuaucagaguagagcugacuuccaguacccgggcagccagcucugucuccagggagg

SEQ ID NO: 163587 - RNA, 64 nt, Human
gucugggggaaugcggagaaaagggaggcuugaccccgggcaccaugggccacuccaggauggg

SEQ ID NO: 163588 - RNA, 64 nt, Human
cagggcaggcgcauccagcaugucaguguccugccccgggcagcucucccucccgggcacgcuc

SEQ ID NO: 163589 - RNA, 64 nt, Human
gcaugucaguguccugccccgggcagcucucccucccgggcacgcucccucuggccugguggau

SEQ ID NO: 163590 - RNA, 64 nt, Human
aauagagcccggggcuacuuccacuggccaggcucccgggcaucugguugaccccagccugggg

SEQ ID NO: 163591 - RNA, 64 nt, Human
cagcagcaaaggucaccaggcucuccgcagcuaucccgggcauccaguggcagcuccccaaacc

SEQ ID NO: 163592 - RNA, 64 nt, Human
acugacucccccaucagcucaaacauuaaggguacccgggcacaaccguaccccugcccccagc

SEQ ID NO: 163593 - RNA, 64 nt, Human
cagccccugccaggccaagcccagccacugcccucccgggcagaucugggcccaggcaccucug

SEQ ID NO: 163594 - RNA, 64 nt, Human
cuacuccaacguccacgcgcauagauacaggcaucccgggcacauccacaagcugcuggcccag

SEQ ID NO: 163595 - RNA, 64 nt, Human
gcaucucauggcagugcggacccguggcuggcagcccgggcaguccuuugcaaaggcaccccuu

SEQ ID NO: 163596 - RNA, 64 nt, Human
ccagcuuggagugccacauggccgcugcccacgucccgggcacugucaugcccagcuuggagug

SEQ ID NO: 163597 - RNA, 64 nt, Human
ccagcuuggagugccacguggccgcugcccacgucccgggcacugucaugcccagcuuggagug

SEQ ID NO: 163598 - RNA, 64 nt, Human
accagauggagaggauguucaacaccacucggaucccgggcaaggacacagguaacugagcccc

SEQ ID NO: 163599 - RNA, 64 nt, Human
uccaauagguguggccccuaccagaccccgcagacccgggcacuucucagcauggccaucuucu

SEQ ID NO: 163600 - RNA, 64 nt, Human
ccuucuccagucucucuucggacagccaguaauucccgggcaaggccagagacuucaagucuau

SEQ ID NO: 163601 - RNA, 64 nt, Human
ccgggcggacagaggcugaggcucacaccccacacccgggcaggagcgcucccuggccccaaca

SEQ ID NO: 163602 - RNA, 64 nt, Human; identical to SEQ ID NO: 85186

SEQ ID NO: 163603 - RNA, 64 nt, Human; identical to SEQ ID NO: 85187

SEQ ID NO: 163604 - RNA, 64 nt, Human; identical to SEQ ID NO: 85188

SEQ ID NO: 163605 - RNA, 64 nt, Human; identical to SEQ ID NO: 85189

SEQ ID NO: 163606 - RNA, 64 nt, Human; identical to SEQ ID NO: 85190

SEQ ID NO: 163607 - RNA, 64 nt, Human; identical to SEQ ID NO: 85191

SEQ ID NO: 163608 - RNA, 64 nt, Human; identical to SEQ ID NO: 85192

SEQ ID NO: 163609 - RNA, 64 nt, Human; identical to SEQ ID NO: 85193

SEQ ID NO: 163610 - RNA, 64 nt, Human; identical to SEQ ID NO: 85194

SEQ ID NO: 163611 - RNA, 64 nt, Human; identical to SEQ ID NO: 85195

SEQ ID NO: 163612 - RNA, 64 nt, Human; identical to SEQ ID NO: 85196

SEQ ID NO: 163613 - RNA, 64 nt, Human; identical to SEQ ID NO: 85197

SEQ ID NO: 163614 - RNA, 64 nt, Human; identical to SEQ ID NO: 85198

SEQ ID NO: 163615 - RNA, 64 nt, Human; identical to SEQ ID NO: 85199

SEQ ID NO: 163616 - RNA, 64 nt, Human; identical to SEQ ID NO: 85200

SEQ ID NO: 163617 - RNA, 64 nt, Human; identical to SEQ ID NO: 85201

SEQ ID NO: 163618 - RNA, 64 nt, Human; identical to SEQ ID NO: 85202

SEQ ID NO: 163619 - RNA, 64 nt, Human; identical to SEQ ID NO: 85203

SEQ ID NO: 163620 - RNA, 64 nt, Human; identical to SEQ ID NO: 85204

SEQ ID NO: 163621 - RNA, 64 nt, Human; identical to SEQ ID NO: 85205

SEQ ID NO: 163622 - RNA, 64 nt, Human; identical to SEQ ID NO: 85206

SEQ ID NO: 163623 - RNA, 64 nt, Human; identical to SEQ ID NO: 85207

SEQ ID NO: 163624 - RNA, 64 nt, Human; identical to SEQ ID NO: 85208

SEQ ID NO: 163625 - RNA, 64 nt, Human; identical to SEQ ID NO: 85209

SEQ ID NO: 163626 - RNA, 55 nt, Human; identical to SEQ ID NO: 85210

SEQ ID NO: 163627 - RNA, 64 nt, Human; identical to SEQ ID NO: 85211

SEQ ID NO: 163628 - RNA, 64 nt, Human; identical to SEQ ID NO: 85212

SEQ ID NO: 163629 - RNA, 64 nt, Human; identical to SEQ ID NO: 85213

SEQ ID NO: 163630 - RNA, 64 nt, Human; identical to SEQ ID NO: 85214

SEQ ID NO: 163631 - RNA, 64 nt, Human; identical to SEQ ID NO: 85215

SEQ ID NO: 163632 - RNA, 64 nt, Human; identical to SEQ ID NO: 85216

SEQ ID NO: 163633 - RNA, 64 nt, Human; identical to SEQ ID NO: 85217

SEQ ID NO: 163634 - RNA, 64 nt, Human; identical to SEQ ID NO: 85218

SEQ ID NO: 163635 - RNA, 64 nt, Human; identical to SEQ ID NO: 85219

SEQ ID NO: 163636 - RNA, 64 nt, Human; identical to SEQ ID NO: 85220

SEQ ID NO: 163637 - RNA, 64 nt, Human; identical to SEQ ID NO: 85221

SEQ ID NO: 163638 - RNA, 64 nt, Human; identical to SEQ ID NO: 85222

SEQ ID NO: 163639 - RNA, 64 nt, Human; identical to SEQ ID NO: 85223

SEQ ID NO: 163640 - RNA, 64 nt, Human; identical to SEQ ID NO: 85224

SEQ ID NO: 163641 - RNA, 64 nt, Human; identical to SEQ ID NO: 85225

SEQ ID NO: 163642 - RNA, 64 nt, Human; identical to SEQ ID NO: 85226

SEQ ID NO: 163643 - RNA, 64 nt, Human; identical to SEQ ID NO: 85227

SEQ ID NO: 163644 - RNA, 64 nt, Human; identical to SEQ ID NO: 85228

SEQ ID NO: 163645 - RNA, 64 nt, Human; identical to SEQ ID NO: 85229

SEQ ID NO: 163646 - RNA, 64 nt, Human; identical to SEQ ID NO: 85230

SEQ ID NO: 163647 - RNA, 64 nt, Human; identical to SEQ ID NO: 85231

SEQ ID NO: 163648 - RNA, 64 nt, Human; identical to SEQ ID NO: 85232

SEQ ID NO: 163649 - RNA, 64 nt, Human; identical to SEQ ID NO: 85233

SEQ ID NO: 163650 - RNA, 64 nt, Human; identical to SEQ ID NO: 85234

SEQ ID NO: 163651 - RNA, 64 nt, Human; identical to SEQ ID NO: 85235

SEQ ID NO: 163652 - RNA, 64 nt, Human; identical to SEQ ID NO: 85236

SEQ ID NO: 163653 - RNA, 64 nt, Human; identical to SEQ ID NO: 85237

SEQ ID NO: 163654 - RNA, 64 nt, Human; identical to SEQ ID NO: 85238

SEQ ID NO: 163655 - RNA, 64 nt, Human; identical to SEQ ID NO: 85239

SEQ ID NO: 163656 - RNA, 64 nt, Human; identical to SEQ ID NO: 85240

SEQ ID NO: 163657 - RNA, 61 nt, Human; identical to SEQ ID NO: 85241

SEQ ID NO: 163658 - RNA, 64 nt, Human; identical to SEQ ID NO: 85242

SEQ ID NO: 163659 - RNA, 64 nt, Human; identical to SEQ ID NO: 85243

SEQ ID NO: 163660 - RNA, 64 nt, Human; identical to SEQ ID NO: 85244

SEQ ID NO: 163661 - RNA, 64 nt, Human; identical to SEQ ID NO: 85245

SEQ ID NO: 163662 - RNA, 64 nt, Human; identical to SEQ ID NO: 85246

SEQ ID NO: 163663 - RNA, 64 nt, Human; identical to SEQ ID NO: 85247

SEQ ID NO: 163664 - RNA, 64 nt, Human; identical to SEQ ID NO: 85248

SEQ ID NO: 163665 - RNA, 64 nt, Human; identical to SEQ ID NO: 85249

SEQ ID NO: 163666 - RNA, 64 nt, Human; identical to SEQ ID NO: 85250

SEQ ID NO: 163667 - RNA, 64 nt, Human; identical to SEQ ID NO: 85251

SEQ ID NO: 163668 - RNA, 64 nt, Human; identical to SEQ ID NO: 85252

SEQ ID NO: 163669 - RNA, 64 nt, Human; identical to SEQ ID NO: 85253

SEQ ID NO: 163670 - RNA, 64 nt, Human; identical to SEQ ID NO: 85254

SEQ ID NO: 163671 - RNA, 64 nt, Human; identical to SEQ ID NO: 85255

SEQ ID NO: 163672 - RNA, 64 nt, Human; identical to SEQ ID NO: 85256

SEQ ID NO: 163673 - RNA, 64 nt, Human; identical to SEQ ID NO: 85257

SEQ ID NO: 163674 - RNA, 64 nt, Human; identical to SEQ ID NO: 85258

SEQ ID NO: 163675 - RNA, 64 nt, Human; identical to SEQ ID NO: 85259

SEQ ID NO: 163676 - RNA, 64 nt, Human; identical to SEQ ID NO: 85260

SEQ ID NO: 163677 - RNA, 64 nt, Human; identical to SEQ ID NO: 85261

SEQ ID NO: 163678 - RNA, 64 nt, Human; identical to SEQ ID NO: 85262

SEQ ID NO: 163679 - RNA, 64 nt, Human; identical to SEQ ID NO: 85263

SEQ ID NO: 163680 - RNA, 64 nt, Human; identical to SEQ ID NO: 85264

SEQ ID NO: 163681 - RNA, 64 nt, Human; identical to SEQ ID NO: 85265

SEQ ID NO: 163682 - RNA, 64 nt, Human; identical to SEQ ID NO: 85266

SEQ ID NO: 163683 - RNA, 64 nt, Human; identical to SEQ ID NO: 85267

SEQ ID NO: 163684 - RNA, 64 nt, Human; identical to SEQ ID NO: 85268

SEQ ID NO: 163685 - RNA, 64 nt, Human; identical to SEQ ID NO: 85269

SEQ ID NO: 163686 - RNA, 64 nt, Human; identical to SEQ ID NO: 85270

SEQ ID NO: 163687 - RNA, 64 nt, Human; identical to SEQ ID NO: 85271

SEQ ID NO: 163688 - RNA, 64 nt, Human; identical to SEQ ID NO: 85272

SEQ ID NO: 163689 - RNA, 64 nt, Human; identical to SEQ ID NO: 85273

SEQ ID NO: 163690 - RNA, 64 nt, Human; identical to SEQ ID NO: 85274

SEQ ID NO: 163691 - RNA, 64 nt, Human; identical to SEQ ID NO: 85275

SEQ ID NO: 163692 - RNA, 64 nt, Human; identical to SEQ ID NO: 85276

SEQ ID NO: 163693 - RNA, 64 nt, Human; identical to SEQ ID NO: 85277

SEQ ID NO: 163694 - RNA, 64 nt, Human; identical to SEQ ID NO: 85278

SEQ ID NO: 163695 - RNA, 64 nt, Human; identical to SEQ ID NO: 85279

SEQ ID NO: 163696 - RNA, 64 nt, Human; identical to SEQ ID NO: 85280

SEQ ID NO: 163697 - RNA, 64 nt, Human; identical to SEQ ID NO: 85281

SEQ ID NO: 163698 - RNA, 64 nt, Human; identical to SEQ ID NO: 85282

SEQ ID NO: 163699 - RNA, 64 nt, Human; identical to SEQ ID NO: 85283

SEQ ID NO: 163700 - RNA, 64 nt, Human; identical to SEQ ID NO: 85284

SEQ ID NO: 163701 - RNA, 64 nt, Human; identical to SEQ ID NO: 85285

SEQ ID NO: 163702 - RNA, 64 nt, Human; identical to SEQ ID NO: 85286

SEQ ID NO: 163703 - RNA, 62 nt, Human; identical to SEQ ID NO: 85287

SEQ ID NO: 163704 - RNA, 64 nt, Human; identical to SEQ ID NO: 85288

SEQ ID NO: 163705 - RNA, 64 nt, Human; identical to SEQ ID NO: 85289

SEQ ID NO: 163706 - RNA, 64 nt, Human; identical to SEQ ID NO: 85290

SEQ ID NO: 163707 - RNA, 64 nt, Human; identical to SEQ ID NO: 85291

SEQ ID NO: 163708 - RNA, 64 nt, Human; identical to SEQ ID NO: 85292

SEQ ID NO: 163709 - RNA, 64 nt, Human; identical to SEQ ID NO: 85293

SEQ ID NO: 163710 - RNA, 64 nt, Human; identical to SEQ ID NO: 85294

SEQ ID NO: 163711 - RNA, 64 nt, Human; identical to SEQ ID NO: 85295

SEQ ID NO: 163712 - RNA, 64 nt, Human; identical to SEQ ID NO: 85296

SEQ ID NO: 163713 - RNA, 64 nt, Human; identical to SEQ ID NO: 85297

SEQ ID NO: 163714 - RNA, 64 nt, Human; identical to SEQ ID NO: 85298

SEQ ID NO: 163715 - RNA, 64 nt, Human; identical to SEQ ID NO: 85299

SEQ ID NO: 163716 - RNA, 64 nt, Human; identical to SEQ ID NO: 85300

SEQ ID NO: 163717 - RNA, 64 nt, Human; identical to SEQ ID NO: 85301

SEQ ID NO: 163718 - RNA, 64 nt, Human; identical to SEQ ID NO: 85302

SEQ ID NO: 163719 - RNA, 64 nt, Human; identical to SEQ ID NO: 85303

SEQ ID NO: 163720 - RNA, 64 nt, Human; identical to SEQ ID NO: 85304

SEQ ID NO: 163721 - RNA, 64 nt, Human; identical to SEQ ID NO: 85305

SEQ ID NO: 163722 - RNA, 64 nt, Human; identical to SEQ ID NO: 85306

SEQ ID NO: 163723 - RNA, 64 nt, Human; identical to SEQ ID NO: 85307

SEQ ID NO: 163724 - RNA, 64 nt, Human; identical to SEQ ID NO: 85308

SEQ ID NO: 163725 - RNA, 64 nt, Human; identical to SEQ ID NO: 85309

SEQ ID NO: 163726 - RNA, 64 nt, Human; identical to SEQ ID NO: 85310

SEQ ID NO: 163727 - RNA, 64 nt, Human; identical to SEQ ID NO: 85311

SEQ ID NO: 163728 - RNA, 64 nt, Human; identical to SEQ ID NO: 85312

SEQ ID NO: 163729 - RNA, 64 nt, Human; identical to SEQ ID NO: 85313

SEQ ID NO: 163730 - RNA, 52 nt, Human; identical to SEQ ID NO: 85314

SEQ ID NO: 163731 - RNA, 64 nt, Human; identical to SEQ ID NO: 85315

SEQ ID NO: 163732 - RNA, 64 nt, Human; identical to SEQ ID NO: 85316

SEQ ID NO: 163733 - RNA, 64 nt, Human; identical to SEQ ID NO: 85317

SEQ ID NO: 163734 - RNA, 64 nt, Human; identical to SEQ ID NO: 85318

SEQ ID NO: 163735 - RNA, 64 nt, Human; identical to SEQ ID NO: 85319

SEQ ID NO: 163736 - RNA, 64 nt, Human; identical to SEQ ID NO: 85320

SEQ ID NO: 163737 - RNA, 62 nt, Human; identical to SEQ ID NO: 85321

SEQ ID NO: 163738 - RNA, 64 nt, Human; identical to SEQ ID NO: 85322

SEQ ID NO: 163739 - RNA, 64 nt, Human; identical to SEQ ID NO: 85323

SEQ ID NO: 163740 - RNA, 64 nt, Human; identical to SEQ ID NO: 85324

SEQ ID NO: 163741 - RNA, 64 nt, Human; identical to SEQ ID NO: 85325

SEQ ID NO: 163742 - RNA, 64 nt, Human; identical to SEQ ID NO: 85326

SEQ ID NO: 163743 - RNA, 64 nt, Human; identical to SEQ ID NO: 85327

SEQ ID NO: 163744 - RNA, 64 nt, Human; identical to SEQ ID NO: 85328

SEQ ID NO: 163745 - RNA, 64 nt, Human; identical to SEQ ID NO: 85329

SEQ ID NO: 163746 - RNA, 64 nt, Human; identical to SEQ ID NO: 85330

SEQ ID NO: 163747 - RNA, 64 nt, Human; identical to SEQ ID NO: 85331

SEQ ID NO: 163748 - RNA, 64 nt, Human; identical to SEQ ID NO: 85332

SEQ ID NO: 163749 - RNA, 64 nt, Human; identical to SEQ ID NO: 85333

SEQ ID NO: 163750 - RNA, 64 nt, Human; identical to SEQ ID NO: 85334

SEQ ID NO: 163751 - RNA, 64 nt, Human; identical to SEQ ID NO: 85335

SEQ ID NO: 163752 - RNA, 64 nt, Human; identical to SEQ ID NO: 85336

SEQ ID NO: 163753 - RNA, 64 nt, Human; identical to SEQ ID NO: 85337

SEQ ID NO: 163754 - RNA, 64 nt, Human; identical to SEQ ID NO: 85338

SEQ ID NO: 163755 - RNA, 64 nt, Human; identical to SEQ ID NO: 85339

SEQ ID NO: 163756 - RNA, 64 nt, Human; identical to SEQ ID NO: 85340

SEQ ID NO: 163757 - RNA, 64 nt, Human; identical to SEQ ID NO: 85341

SEQ ID NO: 163758 - RNA, 64 nt, Human; identical to SEQ ID NO: 85342

SEQ ID NO: 163759 - RNA, 64 nt, Human; identical to SEQ ID NO: 85343

SEQ ID NO: 163760 - RNA, 64 nt, Human; identical to SEQ ID NO: 85344

SEQ ID NO: 163761 - RNA, 64 nt, Human; identical to SEQ ID NO: 85345

SEQ ID NO: 163762 - RNA, 64 nt, Human; identical to SEQ ID NO: 85346

SEQ ID NO: 163763 - RNA, 64 nt, Human; identical to SEQ ID NO: 85347

SEQ ID NO: 163764 - RNA, 64 nt, Human; identical to SEQ ID NO: 85348

SEQ ID NO: 163765 - RNA, 64 nt, Human; identical to SEQ ID NO: 85349

SEQ ID NO: 163766 - RNA, 64 nt, Human; identical to SEQ ID NO: 85350

SEQ ID NO: 163767 - RNA, 64 nt, Human; identical to SEQ ID NO: 85351

SEQ ID NO: 163768 - RNA, 64 nt, Human; identical to SEQ ID NO: 85352

SEQ ID NO: 163769 - RNA, 64 nt, Human; identical to SEQ ID NO: 85353

SEQ ID NO: 163770 - RNA, 64 nt, Human; identical to SEQ ID NO: 85354

SEQ ID NO: 163771 - RNA, 64 nt, Human; identical to SEQ ID NO: 85355

SEQ ID NO: 163772 - RNA, 64 nt, Human; identical to SEQ ID NO: 85356

SEQ ID NO: 163773 - RNA, 64 nt, Human; identical to SEQ ID NO: 85357

SEQ ID NO: 163774 - RNA, 50 nt, Human; identical to SEQ ID NO: 85358

SEQ ID NO: 163775 - RNA, 64 nt, Human; identical to SEQ ID NO: 85359

SEQ ID NO: 163776 - RNA, 64 nt, Human; identical to SEQ ID NO: 85360

SEQ ID NO: 163777 - RNA, 64 nt, Human; identical to SEQ ID NO: 85361

SEQ ID NO: 163778 - RNA, 64 nt, Human; identical to SEQ ID NO: 85362

SEQ ID NO: 163779 - RNA, 64 nt, Human; identical to SEQ ID NO: 85363

SEQ ID NO: 163780 - RNA, 64 nt, Human; identical to SEQ ID NO: 85364

SEQ ID NO: 163781 - RNA, 64 nt, Human; identical to SEQ ID NO: 85365

SEQ ID NO: 163782 - RNA, 64 nt, Human; identical to SEQ ID NO: 85366

SEQ ID NO: 163783 - RNA, 64 nt, Human; identical to SEQ ID NO: 85367

SEQ ID NO: 163784 - RNA, 64 nt, Human; identical to SEQ ID NO: 85368

SEQ ID NO: 163785 - RNA, 64 nt, Human; identical to SEQ ID NO: 85369

SEQ ID NO: 163786 - RNA, 64 nt, Human; identical to SEQ ID NO: 85370

SEQ ID NO: 163787 - RNA, 64 nt, Human; identical to SEQ ID NO: 85371

SEQ ID NO: 163788 - RNA, 64 nt, Human; identical to SEQ ID NO: 85372

SEQ ID NO: 163789 - RNA, 64 nt, Human; identical to SEQ ID NO: 85373

SEQ ID NO: 163790 - RNA, 64 nt, Human; identical to SEQ ID NO: 85374

SEQ ID NO: 163791 - RNA, 64 nt, Human; identical to SEQ ID NO: 85375

SEQ ID NO: 163792 - RNA, 64 nt, Human; identical to SEQ ID NO: 85376

SEQ ID NO: 163793 - RNA, 64 nt, Human; identical to SEQ ID NO: 85377

SEQ ID NO: 163794 - RNA, 64 nt, Human; identical to SEQ ID NO: 85378

SEQ ID NO: 163795 - RNA, 64 nt, Human; identical to SEQ ID NO: 85379

SEQ ID NO: 163796 - RNA, 52 nt, Human; identical to SEQ ID NO: 85380

SEQ ID NO: 163797 - RNA, 64 nt, Human; identical to SEQ ID NO: 85381

SEQ ID NO: 163798 - RNA, 64 nt, Human; identical to SEQ ID NO: 85382

SEQ ID NO: 163799 - RNA, 64 nt, Human; identical to SEQ ID NO: 85383

SEQ ID NO: 163800 - RNA, 64 nt, Human; identical to SEQ ID NO: 85384

SEQ ID NO: 163801 - RNA, 64 nt, Human; identical to SEQ ID NO: 85385

SEQ ID NO: 163802 - RNA, 64 nt, Human; identical to SEQ ID NO: 85386

SEQ ID NO: 163803 - RNA, 64 nt, Human; identical to SEQ ID NO: 85387

SEQ ID NO: 163804 - RNA, 64 nt, Human; identical to SEQ ID NO: 85388

SEQ ID NO: 163805 - RNA, 64 nt, Human; identical to SEQ ID NO: 85389

SEQ ID NO: 163806 - RNA, 64 nt, Human; identical to SEQ ID NO: 85390

SEQ ID NO: 163807 - RNA, 64 nt, Human; identical to SEQ ID NO: 85391

SEQ ID NO: 163808 - RNA, 64 nt, Human; identical to SEQ ID NO: 85392

SEQ ID NO: 163809 - RNA, 64 nt, Human; identical to SEQ ID NO: 85393

SEQ ID NO: 163810 - RNA, 64 nt, Human; identical to SEQ ID NO: 85394

SEQ ID NO: 163811 - RNA, 64 nt, Human; identical to SEQ ID NO: 85395

SEQ ID NO: 163812 - RNA, 64 nt, Human; identical to SEQ ID NO: 85396

SEQ ID NO: 163813 - RNA, 64 nt, Human; identical to SEQ ID NO: 85397

SEQ ID NO: 163814 - RNA, 64 nt, Human; identical to SEQ ID NO: 85398

SEQ ID NO: 163815 - RNA, 64 nt, Human; identical to SEQ ID NO: 85399

SEQ ID NO: 163816 - RNA, 64 nt, Human; identical to SEQ ID NO: 85400

SEQ ID NO: 163817 - RNA, 64 nt, Human; identical to SEQ ID NO: 85401

SEQ ID NO: 163818 - RNA, 64 nt, Human; identical to SEQ ID NO: 85402

SEQ ID NO: 163819 - RNA, 64 nt, Human; identical to SEQ ID NO: 85403

SEQ ID NO: 163820 - RNA, 64 nt, Human; identical to SEQ ID NO: 85404

SEQ ID NO: 163821 - RNA, 64 nt, Human; identical to SEQ ID NO: 85405

SEQ ID NO: 163822 - RNA, 64 nt, Human; identical to SEQ ID NO: 85406

SEQ ID NO: 163823 - RNA, 64 nt, Human; identical to SEQ ID NO: 85407

SEQ ID NO: 163824 - RNA, 64 nt, Human; identical to SEQ ID NO: 85408

SEQ ID NO: 163825 - RNA, 64 nt, Human; identical to SEQ ID NO: 85409

SEQ ID NO: 163826 - RNA, 64 nt, Human; identical to SEQ ID NO: 85410

SEQ ID NO: 163827 - RNA, 64 nt, Human; identical to SEQ ID NO: 85411

SEQ ID NO: 163828 - RNA, 64 nt, Human; identical to SEQ ID NO: 85412

SEQ ID NO: 163829 - RNA, 64 nt, Human; identical to SEQ ID NO: 85413

SEQ ID NO: 163830 - RNA, 64 nt, Human; identical to SEQ ID NO: 85414

SEQ ID NO: 163831 - RNA, 64 nt, Human; identical to SEQ ID NO: 85415

SEQ ID NO: 163832 - RNA, 64 nt, Human; identical to SEQ ID NO: 85416

SEQ ID NO: 163833 - RNA, 64 nt, Human; identical to SEQ ID NO: 85417

SEQ ID NO: 163834 - RNA, 64 nt, Human; identical to SEQ ID NO: 85418

SEQ ID NO: 163835 - RNA, 64 nt, Human; identical to SEQ ID NO: 85419

SEQ ID NO: 163836 - RNA, 64 nt, Human; identical to SEQ ID NO: 85420

SEQ ID NO: 163837 - RNA, 64 nt, Human; identical to SEQ ID NO: 85421

SEQ ID NO: 163838 - RNA, 64 nt, Human; identical to SEQ ID NO: 85422

SEQ ID NO: 163839 - RNA, 64 nt, Human; identical to SEQ ID NO: 85423

SEQ ID NO: 163840 - RNA, 64 nt, Human; identical to SEQ ID NO: 85424

SEQ ID NO: 163841 - RNA, 59 nt, Human; identical to SEQ ID NO: 85425

SEQ ID NO: 163842 - RNA, 64 nt, Human; identical to SEQ ID NO: 85426

SEQ ID NO: 163843 - RNA, 64 nt, Human; identical to SEQ ID NO: 85427

SEQ ID NO: 163844 - RNA, 64 nt, Human; identical to SEQ ID NO: 85428

SEQ ID NO: 163845 - RNA, 64 nt, Human; identical to SEQ ID NO: 85429

SEQ ID NO: 163846 - RNA, 64 nt, Human; identical to SEQ ID NO: 85430

SEQ ID NO: 163847 - RNA, 64 nt, Human; identical to SEQ ID NO: 85431

SEQ ID NO: 163848 - RNA, 64 nt, Human; identical to SEQ ID NO: 85432

SEQ ID NO: 163849 - RNA, 64 nt, Human; identical to SEQ ID NO: 85433

SEQ ID NO: 163850 - RNA, 64 nt, Human; identical to SEQ ID NO: 85434

SEQ ID NO: 163851 - RNA, 64 nt, Human; identical to SEQ ID NO: 85435

SEQ ID NO: 163852 - RNA, 64 nt, Human; identical to SEQ ID NO: 85436

SEQ ID NO: 163853 - RNA, 64 nt, Human; identical to SEQ ID NO: 85437

SEQ ID NO: 163854 - RNA, 64 nt, Human; identical to SEQ ID NO: 85438

SEQ ID NO: 163855 - RNA, 64 nt, Human; identical to SEQ ID NO: 85439

SEQ ID NO: 163856 - RNA, 64 nt, Human; identical to SEQ ID NO: 85440

SEQ ID NO: 163857 - RNA, 64 nt, Human; identical to SEQ ID NO: 85441

SEQ ID NO: 163858 - RNA, 64 nt, Human; identical to SEQ ID NO: 85442

SEQ ID NO: 163859 - RNA, 64 nt, Human; identical to SEQ ID NO: 85443

SEQ ID NO: 163860 - RNA, 64 nt, Human; identical to SEQ ID NO: 85444

SEQ ID NO: 163861 - RNA, 64 nt, Human; identical to SEQ ID NO: 85445

SEQ ID NO: 163862 - RNA, 64 nt, Human; identical to SEQ ID NO: 85446

SEQ ID NO: 163863 - RNA, 64 nt, Human; identical to SEQ ID NO: 85447

SEQ ID NO: 163864 - RNA, 64 nt, Human; identical to SEQ ID NO: 85448

SEQ ID NO: 163865 - RNA, 64 nt, Human; identical to SEQ ID NO: 85449

SEQ ID NO: 163866 - RNA, 64 nt, Human; identical to SEQ ID NO: 85450

SEQ ID NO: 163867 - RNA, 64 nt, Human; identical to SEQ ID NO: 85451

SEQ ID NO: 163868 - RNA, 64 nt, Human; identical to SEQ ID NO: 85452

SEQ ID NO: 163869 - RNA, 64 nt, Human; identical to SEQ ID NO: 85453

SEQ ID NO: 163870 - RNA, 64 nt, Human; identical to SEQ ID NO: 85454

SEQ ID NO: 163871 - RNA, 64 nt, Human; identical to SEQ ID NO: 85455

SEQ ID NO: 163872 - RNA, 64 nt, Human; identical to SEQ ID NO: 85456

SEQ ID NO: 163873 - RNA, 64 nt, Human; identical to SEQ ID NO: 85457

SEQ ID NO: 163874 - RNA, 64 nt, Human; identical to SEQ ID NO: 85458

SEQ ID NO: 163875 - RNA, 64 nt, Human; identical to SEQ ID NO: 85459

SEQ ID NO: 163876 - RNA, 64 nt, Human; identical to SEQ ID NO: 85460

SEQ ID NO: 163877 - RNA, 64 nt, Human; identical to SEQ ID NO: 85461

SEQ ID NO: 163878 - RNA, 64 nt, Human; identical to SEQ ID NO: 85462

SEQ ID NO: 163879 - RNA, 64 nt, Human; identical to SEQ ID NO: 85463

SEQ ID NO: 163880 - RNA, 64 nt, Human; identical to SEQ ID NO: 85464

SEQ ID NO: 163881 - RNA, 64 nt, Human; identical to SEQ ID NO: 85465

SEQ ID NO: 163882 - RNA, 64 nt, Human; identical to SEQ ID NO: 85466

SEQ ID NO: 163883 - RNA, 64 nt, Human; identical to SEQ ID NO: 85467

SEQ ID NO: 163884 - RNA, 64 nt, Human; identical to SEQ ID NO: 85468

SEQ ID NO: 163885 - RNA, 64 nt, Human; identical to SEQ ID NO: 85469

SEQ ID NO: 163886 - RNA, 64 nt, Human; identical to SEQ ID NO: 85470

SEQ ID NO: 163887 - RNA, 64 nt, Human; identical to SEQ ID NO: 85471

SEQ ID NO: 163888 - RNA, 64 nt, Human; identical to SEQ ID NO: 85472

SEQ ID NO: 163889 - RNA, 64 nt, Human; identical to SEQ ID NO: 85473

SEQ ID NO: 163890 - RNA, 64 nt, Human; identical to SEQ ID NO: 85474

SEQ ID NO: 163891 - RNA, 64 nt, Human; identical to SEQ ID NO: 85475

SEQ ID NO: 163892 - RNA, 64 nt, Human; identical to SEQ ID NO: 85476

SEQ ID NO: 163893 - RNA, 64 nt, Human; identical to SEQ ID NO: 85477

SEQ ID NO: 163894 - RNA, 64 nt, Human; identical to SEQ ID NO: 85478

SEQ ID NO: 163895 - RNA, 64 nt, Human; identical to SEQ ID NO: 85479

SEQ ID NO: 163896 - RNA, 64 nt, Human; identical to SEQ ID NO: 85480

SEQ ID NO: 163897 - RNA, 64 nt, Human; identical to SEQ ID NO: 85481

SEQ ID NO: 163898 - RNA, 64 nt, Human; identical to SEQ ID NO: 85482

SEQ ID NO: 163899 - RNA, 64 nt, Human; identical to SEQ ID NO: 85483

SEQ ID NO: 163900 - RNA, 64 nt, Human; identical to SEQ ID NO: 85484

SEQ ID NO: 163901 - RNA, 64 nt, Human; identical to SEQ ID NO: 85485

SEQ ID NO: 163902 - RNA, 64 nt, Human; identical to SEQ ID NO: 85486

SEQ ID NO: 163903 - RNA, 64 nt, Human; identical to SEQ ID NO: 85487

SEQ ID NO: 163904 - RNA, 64 nt, Human; identical to SEQ ID NO: 85488

SEQ ID NO: 163905 - RNA, 64 nt, Human; identical to SEQ ID NO: 85489

SEQ ID NO: 163906 - RNA, 64 nt, Human; identical to SEQ ID NO: 85490

SEQ ID NO: 163907 - RNA, 64 nt, Human; identical to SEQ ID NO: 85491

SEQ ID NO: 163908 - RNA, 64 nt, Human; identical to SEQ ID NO: 85492

SEQ ID NO: 163909 - RNA, 64 nt, Human; identical to SEQ ID NO: 85493

SEQ ID NO: 163910 - RNA, 64 nt, Human; identical to SEQ ID NO: 85494

SEQ ID NO: 163911 - RNA, 64 nt, Human; identical to SEQ ID NO: 85495

SEQ ID NO: 163912 - RNA, 64 nt, Human; identical to SEQ ID NO: 85496

SEQ ID NO: 163913 - RNA, 64 nt, Human; identical to SEQ ID NO: 85497

SEQ ID NO: 163914 - RNA, 64 nt, Human; identical to SEQ ID NO: 85498

SEQ ID NO: 163915 - RNA, 64 nt, Human; identical to SEQ ID NO: 85499

SEQ ID NO: 163916 - RNA, 64 nt, Human; identical to SEQ ID NO: 85500

SEQ ID NO: 163917 - RNA, 64 nt, Human; identical to SEQ ID NO: 85501

SEQ ID NO: 163918 - RNA, 64 nt, Human; identical to SEQ ID NO: 85502

SEQ ID NO: 163919 - RNA, 64 nt, Human; identical to SEQ ID NO: 85503

SEQ ID NO: 163920 - RNA, 64 nt, Human; identical to SEQ ID NO: 85504

SEQ ID NO: 163921 - RNA, 64 nt, Human; identical to SEQ ID NO: 85505

SEQ ID NO: 163922 - RNA, 64 nt, Human; identical to SEQ ID NO: 85506

SEQ ID NO: 163923 - RNA, 64 nt, Human; identical to SEQ ID NO: 85507

SEQ ID NO: 163924 - RNA, 64 nt, Human; identical to SEQ ID NO: 85508

SEQ ID NO: 163925 - RNA, 64 nt, Human; identical to SEQ ID NO: 85509

SEQ ID NO: 163926 - RNA, 64 nt, Human; identical to SEQ ID NO: 85510

SEQ ID NO: 163927 - RNA, 64 nt, Human; identical to SEQ ID NO: 85511

SEQ ID NO: 163928 - RNA, 64 nt, Human; identical to SEQ ID NO: 85512

SEQ ID NO: 163929 - RNA, 64 nt, Human; identical to SEQ ID NO: 85513

SEQ ID NO: 163930 - RNA, 64 nt, Human; identical to SEQ ID NO: 85514

SEQ ID NO: 163931 - RNA, 64 nt, Human; identical to SEQ ID NO: 85515

SEQ ID NO: 163932 - RNA, 64 nt, Human; identical to SEQ ID NO: 85516

SEQ ID NO: 163933 - RNA, 64 nt, Human; identical to SEQ ID NO: 85517

SEQ ID NO: 163934 - RNA, 64 nt, Human; identical to SEQ ID NO: 85518

SEQ ID NO: 163935 - RNA, 64 nt, Human; identical to SEQ ID NO: 85519

SEQ ID NO: 163936 - RNA, 64 nt, Human; identical to SEQ ID NO: 85520

SEQ ID NO: 163937 - RNA, 64 nt, Human; identical to SEQ ID NO: 85521

SEQ ID NO: 163938 - RNA, 64 nt, Human; identical to SEQ ID NO: 85522

SEQ ID NO: 163939 - RNA, 64 nt, Human; identical to SEQ ID NO: 85523

SEQ ID NO: 163940 - RNA, 64 nt, Human; identical to SEQ ID NO: 85524

SEQ ID NO: 163941 - RNA, 64 nt, Human; identical to SEQ ID NO: 85525

SEQ ID NO: 163942 - RNA, 64 nt, Human; identical to SEQ ID NO: 85526

SEQ ID NO: 163943 - RNA, 64 nt, Human; identical to SEQ ID NO: 85527

SEQ ID NO: 163944 - RNA, 64 nt, Human; identical to SEQ ID NO: 85528

SEQ ID NO: 163945 - RNA, 64 nt, Human; identical to SEQ ID NO: 85529

SEQ ID NO: 163946 - RNA, 64 nt, Human; identical to SEQ ID NO: 85530

SEQ ID NO: 163947 - RNA, 64 nt, Human; identical to SEQ ID NO: 85531

SEQ ID NO: 163948 - RNA, 64 nt, Human; identical to SEQ ID NO: 85532

SEQ ID NO: 163949 - RNA, 64 nt, Human; identical to SEQ ID NO: 85533

SEQ ID NO: 163950 - RNA, 64 nt, Human; identical to SEQ ID NO: 85534

SEQ ID NO: 163951 - RNA, 64 nt, Human; identical to SEQ ID NO: 85535

SEQ ID NO: 163952 - RNA, 64 nt, Human; identical to SEQ ID NO: 85536

SEQ ID NO: 163953 - RNA, 64 nt, Human; identical to SEQ ID NO: 85537

SEQ ID NO: 163954 - RNA, 64 nt, Human; identical to SEQ ID NO: 85538

SEQ ID NO: 163955 - RNA, 64 nt, Human; identical to SEQ ID NO: 85539

SEQ ID NO: 163956 - RNA, 64 nt, Human; identical to SEQ ID NO: 85540

SEQ ID NO: 163957 - RNA, 64 nt, Human; identical to SEQ ID NO: 85541

SEQ ID NO: 163958 - RNA, 64 nt, Human; identical to SEQ ID NO: 85542

SEQ ID NO: 163959 - RNA, 64 nt, Human; identical to SEQ ID NO: 85543

SEQ ID NO: 163960 - RNA, 64 nt, Human; identical to SEQ ID NO: 85544

SEQ ID NO: 163961 - RNA, 64 nt, Human; identical to SEQ ID NO: 85545

SEQ ID NO: 163962 - RNA, 64 nt, Human; identical to SEQ ID NO: 85546

SEQ ID NO: 163963 - RNA, 64 nt, Human; identical to SEQ ID NO: 85547

SEQ ID NO: 163964 - RNA, 64 nt, Human; identical to SEQ ID NO: 85548

SEQ ID NO: 163965 - RNA, 64 nt, Human; identical to SEQ ID NO: 85549

SEQ ID NO: 163966 - RNA, 64 nt, Human; identical to SEQ ID NO: 85550

SEQ ID NO: 163967 - RNA, 51 nt, Human; identical to SEQ ID NO: 85551

SEQ ID NO: 163968 - RNA, 64 nt, Human; identical to SEQ ID NO: 85552

SEQ ID NO: 163969 - RNA, 64 nt, Human; identical to SEQ ID NO: 85553

SEQ ID NO: 163970 - RNA, 64 nt, Human; identical to SEQ ID NO: 85554

SEQ ID NO: 163971 - RNA, 64 nt, Human; identical to SEQ ID NO: 85555

SEQ ID NO: 163972 - RNA, 64 nt, Human; identical to SEQ ID NO: 85556

SEQ ID NO: 163973 - RNA, 64 nt, Human; identical to SEQ ID NO: 85557

SEQ ID NO: 163974 - RNA, 64 nt, Human; identical to SEQ ID NO: 85558

SEQ ID NO: 163975 - RNA, 64 nt, Human; identical to SEQ ID NO: 85559

SEQ ID NO: 163976 - RNA, 64 nt, Human; identical to SEQ ID NO: 85560

SEQ ID NO: 163977 - RNA, 64 nt, Human; identical to SEQ ID NO: 85561

SEQ ID NO: 163978 - RNA, 64 nt, Human; identical to SEQ ID NO: 85562

SEQ ID NO: 163979 - RNA, 64 nt, Human; identical to SEQ ID NO: 85563

SEQ ID NO: 163980 - RNA, 64 nt, Human; identical to SEQ ID NO: 85564

SEQ ID NO: 163981 - RNA, 64 nt, Human; identical to SEQ ID NO: 85565

SEQ ID NO: 163982 - RNA, 64 nt, Human; identical to SEQ ID NO: 85566

SEQ ID NO: 163983 - RNA, 64 nt, Human; identical to SEQ ID NO: 85567

SEQ ID NO: 163984 - RNA, 64 nt, Human; identical to SEQ ID NO: 85568

SEQ ID NO: 163985 - RNA, 64 nt, Human; identical to SEQ ID NO: 85569

SEQ ID NO: 163986 - RNA, 64 nt, Human; identical to SEQ ID NO: 85570

SEQ ID NO: 163987 - RNA, 64 nt, Human; identical to SEQ ID NO: 85571

SEQ ID NO: 163988 - RNA, 64 nt, Human; identical to SEQ ID NO: 85572

SEQ ID NO: 163989 - RNA, 64 nt, Human; identical to SEQ ID NO: 85573

SEQ ID NO: 163990 - RNA, 59 nt, Human; identical to SEQ ID NO: 85574

SEQ ID NO: 163991 - RNA, 64 nt, Human; identical to SEQ ID NO: 85575

SEQ ID NO: 163992 - RNA, 64 nt, Human; identical to SEQ ID NO: 85576

SEQ ID NO: 163993 - RNA, 64 nt, Human; identical to SEQ ID NO: 85577

SEQ ID NO: 163994 - RNA, 64 nt, Human; identical to SEQ ID NO: 85578

SEQ ID NO: 163995 - RNA, 64 nt, Human; identical to SEQ ID NO: 85579

SEQ ID NO: 163996 - RNA, 64 nt, Human; identical to SEQ ID NO: 85580

SEQ ID NO: 163997 - RNA, 64 nt, Human; identical to SEQ ID NO: 85581

SEQ ID NO: 163998 - RNA, 64 nt, Human; identical to SEQ ID NO: 85582

SEQ ID NO: 163999 - RNA, 64 nt, Human; identical to SEQ ID NO: 85583

SEQ ID NO: 164000 - RNA, 64 nt, Human; identical to SEQ ID NO: 85584

SEQ ID NO: 164001 - RNA, 64 nt, Human; identical to SEQ ID NO: 85585

SEQ ID NO: 164002 - RNA, 64 nt, Human; identical to SEQ ID NO: 85586

SEQ ID NO: 164003 - RNA, 64 nt, Human; identical to SEQ ID NO: 85587

SEQ ID NO: 164004 - RNA, 64 nt, Human; identical to SEQ ID NO: 85588

SEQ ID NO: 164005 - RNA, 64 nt, Human; identical to SEQ ID NO: 85589

SEQ ID NO: 164006 - RNA, 64 nt, Human; identical to SEQ ID NO: 85590

SEQ ID NO: 164007 - RNA, 64 nt, Human; identical to SEQ ID NO: 85591

SEQ ID NO: 164008 - RNA, 64 nt, Human; identical to SEQ ID NO: 85592

SEQ ID NO: 164009 - RNA, 64 nt, Human; identical to SEQ ID NO: 85593

SEQ ID NO: 164010 - RNA, 64 nt, Human; identical to SEQ ID NO: 85594

SEQ ID NO: 164011 - RNA, 64 nt, Human; identical to SEQ ID NO: 85595

SEQ ID NO: 164012 - RNA, 64 nt, Human; identical to SEQ ID NO: 85596

SEQ ID NO: 164013 - RNA, 64 nt, Human; identical to SEQ ID NO: 85597

SEQ ID NO: 164014 - RNA, 64 nt, Human; identical to SEQ ID NO: 85598

SEQ ID NO: 164015 - RNA, 64 nt, Human; identical to SEQ ID NO: 85599

SEQ ID NO: 164016 - RNA, 64 nt, Human; identical to SEQ ID NO: 85600

SEQ ID NO: 164017 - RNA, 64 nt, Human; identical to SEQ ID NO: 85601

SEQ ID NO: 164018 - RNA, 64 nt, Human; identical to SEQ ID NO: 85602

SEQ ID NO: 164019 - RNA, 64 nt, Human; identical to SEQ ID NO: 85603

SEQ ID NO: 164020 - RNA, 64 nt, Human; identical to SEQ ID NO: 85604

SEQ ID NO: 164021 - RNA, 64 nt, Human; identical to SEQ ID NO: 85605

SEQ ID NO: 164022 - RNA, 64 nt, Human; identical to SEQ ID NO: 85606

SEQ ID NO: 164023 - RNA, 51 nt, Human; identical to SEQ ID NO: 85607

SEQ ID NO: 164024 - RNA, 64 nt, Human; identical to SEQ ID NO: 85608

SEQ ID NO: 164025 - RNA, 64 nt, Human; identical to SEQ ID NO: 85609

SEQ ID NO: 164026 - RNA, 64 nt, Human; identical to SEQ ID NO: 85610

SEQ ID NO: 164027 - RNA, 64 nt, Human; identical to SEQ ID NO: 85611

SEQ ID NO: 164028 - RNA, 64 nt, Human; identical to SEQ ID NO: 85612

SEQ ID NO: 164029 - RNA, 64 nt, Human; identical to SEQ ID NO: 85613

SEQ ID NO: 164030 - RNA, 64 nt, Human; identical to SEQ ID NO: 85614

SEQ ID NO: 164031 - RNA, 64 nt, Human; identical to SEQ ID NO: 85615

SEQ ID NO: 164032 - RNA, 64 nt, Human; identical to SEQ ID NO: 85616

SEQ ID NO: 164033 - RNA, 64 nt, Human; identical to SEQ ID NO: 85617

SEQ ID NO: 164034 - RNA, 64 nt, Human; identical to SEQ ID NO: 85618

SEQ ID NO: 164035 - RNA, 64 nt, Human; identical to SEQ ID NO: 85619

SEQ ID NO: 164036 - RNA, 64 nt, Human; identical to SEQ ID NO: 85620

SEQ ID NO: 164037 - RNA, 64 nt, Human; identical to SEQ ID NO: 85621

SEQ ID NO: 164038 - RNA, 64 nt, Human; identical to SEQ ID NO: 85622

SEQ ID NO: 164039 - RNA, 64 nt, Human; identical to SEQ ID NO: 85623

SEQ ID NO: 164040 - RNA, 64 nt, Human; identical to SEQ ID NO: 85624

SEQ ID NO: 164041 - RNA, 64 nt, Human; identical to SEQ ID NO: 85625

SEQ ID NO: 164042 - RNA, 64 nt, Human; identical to SEQ ID NO: 85626

SEQ ID NO: 164043 - RNA, 64 nt, Human; identical to SEQ ID NO: 85627

SEQ ID NO: 164044 - RNA, 64 nt, Human; identical to SEQ ID NO: 85628

SEQ ID NO: 164045 - RNA, 64 nt, Human; identical to SEQ ID NO: 85629

SEQ ID NO: 164046 - RNA, 64 nt, Human; identical to SEQ ID NO: 85630

SEQ ID NO: 164047 - RNA, 64 nt, Human; identical to SEQ ID NO: 85631

SEQ ID NO: 164048 - RNA, 64 nt, Human; identical to SEQ ID NO: 85632

SEQ ID NO: 164049 - RNA, 64 nt, Human; identical to SEQ ID NO: 85633

SEQ ID NO: 164050 - RNA, 64 nt, Human; identical to SEQ ID NO: 85634

SEQ ID NO: 164051 - RNA, 64 nt, Human; identical to SEQ ID NO: 85635

SEQ ID NO: 164052 - RNA, 64 nt, Human; identical to SEQ ID NO: 85636

SEQ ID NO: 164053 - RNA, 64 nt, Human; identical to SEQ ID NO: 85637

SEQ ID NO: 164054 - RNA, 64 nt, Human; identical to SEQ ID NO: 85638

SEQ ID NO: 164055 - RNA, 64 nt, Human; identical to SEQ ID NO: 85639

SEQ ID NO: 164056 - RNA, 64 nt, Human; identical to SEQ ID NO: 85640

SEQ ID NO: 164057 - RNA, 64 nt, Human; identical to SEQ ID NO: 85641

SEQ ID NO: 164058 - RNA, 64 nt, Human; identical to SEQ ID NO: 85642

SEQ ID NO: 164059 - RNA, 64 nt, Human; identical to SEQ ID NO: 85643

SEQ ID NO: 164060 - RNA, 64 nt, Human; identical to SEQ ID NO: 85644

SEQ ID NO: 164061 - RNA, 64 nt, Human; identical to SEQ ID NO: 85645

SEQ ID NO: 164062 - RNA, 64 nt, Human; identical to SEQ ID NO: 85646

SEQ ID NO: 164063 - RNA, 64 nt, Human; identical to SEQ ID NO: 85647

SEQ ID NO: 164064 - RNA, 64 nt, Human; identical to SEQ ID NO: 85648

SEQ ID NO: 164065 - RNA, 64 nt, Human; identical to SEQ ID NO: 85649

SEQ ID NO: 164066 - RNA, 64 nt, Human; identical to SEQ ID NO: 85650

SEQ ID NO: 164067 - RNA, 64 nt, Human; identical to SEQ ID NO: 85651

SEQ ID NO: 164068 - RNA, 64 nt, Human; identical to SEQ ID NO: 85652

SEQ ID NO: 164069 - RNA, 64 nt, Human; identical to SEQ ID NO: 85653

SEQ ID NO: 164070 - RNA, 64 nt, Human; identical to SEQ ID NO: 85654

SEQ ID NO: 164071 - RNA, 64 nt, Human; identical to SEQ ID NO: 85655

SEQ ID NO: 164072 - RNA, 64 nt, Human; identical to SEQ ID NO: 85656

SEQ ID NO: 164073 - RNA, 64 nt, Human; identical to SEQ ID NO: 85657

SEQ ID NO: 164074 - RNA, 64 nt, Human; identical to SEQ ID NO: 85658

SEQ ID NO: 164075 - RNA, 64 nt, Human; identical to SEQ ID NO: 85659

SEQ ID NO: 164076 - RNA, 64 nt, Human; identical to SEQ ID NO: 85660

SEQ ID NO: 164077 - RNA, 64 nt, Human; identical to SEQ ID NO: 85661

SEQ ID NO: 164078 - RNA, 64 nt, Human; identical to SEQ ID NO: 85662

SEQ ID NO: 164079 - RNA, 62 nt, Human; identical to SEQ ID NO: 85663

SEQ ID NO: 164080 - RNA, 64 nt, Human; identical to SEQ ID NO: 85664

SEQ ID NO: 164081 - RNA, 64 nt, Human; identical to SEQ ID NO: 85665

SEQ ID NO: 164082 - RNA, 64 nt, Human; identical to SEQ ID NO: 85666

SEQ ID NO: 164083 - RNA, 64 nt, Human; identical to SEQ ID NO: 85667

SEQ ID NO: 164084 - RNA, 64 nt, Human; identical to SEQ ID NO: 85668

SEQ ID NO: 164085 - RNA, 64 nt, Human; identical to SEQ ID NO: 85669

SEQ ID NO: 164086 - RNA, 64 nt, Human; identical to SEQ ID NO: 85670

SEQ ID NO: 164087 - RNA, 64 nt, Human; identical to SEQ ID NO: 85671

SEQ ID NO: 164088 - RNA, 64 nt, Human; identical to SEQ ID NO: 85672

SEQ ID NO: 164089 - RNA, 64 nt, Human; identical to SEQ ID NO: 85673

SEQ ID NO: 164090 - RNA, 64 nt, Human; identical to SEQ ID NO: 85674

SEQ ID NO: 164091 - RNA, 64 nt, Human; identical to SEQ ID NO: 85675

SEQ ID NO: 164092 - RNA, 63 nt, Human; identical to SEQ ID NO: 85676

SEQ ID NO: 164093 - RNA, 52 nt, Human; identical to SEQ ID NO: 85677

SEQ ID NO: 164094 - RNA, 59 nt, Human; identical to SEQ ID NO: 85678

SEQ ID NO: 164095 - RNA, 64 nt, Human; identical to SEQ ID NO: 85679

SEQ ID NO: 164096 - RNA, 64 nt, Human; identical to SEQ ID NO: 85680

SEQ ID NO: 164097 - RNA, 64 nt, Human; identical to SEQ ID NO: 85681

SEQ ID NO: 164098 - RNA, 64 nt, Human; identical to SEQ ID NO: 85682

SEQ ID NO: 164099 - RNA, 64 nt, Human; identical to SEQ ID NO: 85683

SEQ ID NO: 164100 - RNA, 64 nt, Human; identical to SEQ ID NO: 85684

SEQ ID NO: 164101 - RNA, 64 nt, Human; identical to SEQ ID NO: 85685

SEQ ID NO: 164102 - RNA, 64 nt, Human; identical to SEQ ID NO: 85686

SEQ ID NO: 164103 - RNA, 64 nt, Human; identical to SEQ ID NO: 85687

SEQ ID NO: 164104 - RNA, 64 nt, Human; identical to SEQ ID NO: 85688

SEQ ID NO: 164105 - RNA, 64 nt, Human; identical to SEQ ID NO: 85689

SEQ ID NO: 164106 - RNA, 64 nt, Human; identical to SEQ ID NO: 85690

SEQ ID NO: 164107 - RNA, 64 nt, Human; identical to SEQ ID NO: 85691

SEQ ID NO: 164108 - RNA, 64 nt, Human; identical to SEQ ID NO: 85692

SEQ ID NO: 164109 - RNA, 64 nt, Human; identical to SEQ ID NO: 85693

SEQ ID NO: 164110 - RNA, 64 nt, Human; identical to SEQ ID NO: 85694

SEQ ID NO: 164111 - RNA, 64 nt, Human; identical to SEQ ID NO: 85695

SEQ ID NO: 164112 - RNA, 64 nt, Human; identical to SEQ ID NO: 85696

SEQ ID NO: 164113 - RNA, 64 nt, Human; identical to SEQ ID NO: 85697

SEQ ID NO: 164114 - RNA, 64 nt, Human; identical to SEQ ID NO: 85698

SEQ ID NO: 164115 - RNA, 64 nt, Human; identical to SEQ ID NO: 85699

SEQ ID NO: 164116 - RNA, 64 nt, Human; identical to SEQ ID NO: 85700

SEQ ID NO: 164117 - RNA, 64 nt, Human; identical to SEQ ID NO: 85701

SEQ ID NO: 164118 - RNA, 64 nt, Human; identical to SEQ ID NO: 85702

SEQ ID NO: 164119 - RNA, 64 nt, Human; identical to SEQ ID NO: 85703

SEQ ID NO: 164120 - RNA, 64 nt, Human; identical to SEQ ID NO: 85704

SEQ ID NO: 164121 - RNA, 64 nt, Human; identical to SEQ ID NO: 85705

SEQ ID NO: 164122 - RNA, 64 nt, Human; identical to SEQ ID NO: 85706

SEQ ID NO: 164123 - RNA, 64 nt, Human; identical to SEQ ID NO: 85707

SEQ ID NO: 164124 - RNA, 64 nt, Human; identical to SEQ ID NO: 85708

SEQ ID NO: 164125 - RNA, 64 nt, Human; identical to SEQ ID NO: 85709

SEQ ID NO: 164126 - RNA, 64 nt, Human; identical to SEQ ID NO: 85710

SEQ ID NO: 164127 - RNA, 64 nt, Human; identical to SEQ ID NO: 85711

SEQ ID NO: 164128 - RNA, 64 nt, Human; identical to SEQ ID NO: 85712

SEQ ID NO: 164129 - RNA, 64 nt, Human; identical to SEQ ID NO: 85713

SEQ ID NO: 164130 - RNA, 64 nt, Human; identical to SEQ ID NO: 85714

SEQ ID NO: 164131 - RNA, 64 nt, Human; identical to SEQ ID NO: 85715

SEQ ID NO: 164132 - RNA, 64 nt, Human; identical to SEQ ID NO: 85716

SEQ ID NO: 164133 - RNA, 64 nt, Human; identical to SEQ ID NO: 85717

SEQ ID NO: 164134 - RNA, 64 nt, Human; identical to SEQ ID NO: 85718

SEQ ID NO: 164135 - RNA, 64 nt, Human; identical to SEQ ID NO: 85719

SEQ ID NO: 164136 - RNA, 64 nt, Human; identical to SEQ ID NO: 85720

SEQ ID NO: 164137 - RNA, 64 nt, Human; identical to SEQ ID NO: 85721

SEQ ID NO: 164138 - RNA, 64 nt, Human; identical to SEQ ID NO: 85722

SEQ ID NO: 164139 - RNA, 64 nt, Human; identical to SEQ ID NO: 85723

SEQ ID NO: 164140 - RNA, 64 nt, Human; identical to SEQ ID NO: 85724

SEQ ID NO: 164141 - RNA, 64 nt, Human; identical to SEQ ID NO: 85725

SEQ ID NO: 164142 - RNA, 64 nt, Human; identical to SEQ ID NO: 85726

SEQ ID NO: 164143 - RNA, 64 nt, Human; identical to SEQ ID NO: 85727

SEQ ID NO: 164144 - RNA, 64 nt, Human; identical to SEQ ID NO: 85728

SEQ ID NO: 164145 - RNA, 64 nt, Human; identical to SEQ ID NO: 85729

SEQ ID NO: 164146 - RNA, 64 nt, Human; identical to SEQ ID NO: 85730

SEQ ID NO: 164147 - RNA, 64 nt, Human; identical to SEQ ID NO: 85731

SEQ ID NO: 164148 - RNA, 64 nt, Human; identical to SEQ ID NO: 85732

SEQ ID NO: 164149 - RNA, 64 nt, Human; identical to SEQ ID NO: 85733

SEQ ID NO: 164150 - RNA, 64 nt, Human; identical to SEQ ID NO: 85734

SEQ ID NO: 164151 - RNA, 64 nt, Human; identical to SEQ ID NO: 85735

SEQ ID NO: 164152 - RNA, 64 nt, Human; identical to SEQ ID NO: 85736

SEQ ID NO: 164153 - RNA, 64 nt, Human; identical to SEQ ID NO: 85737

SEQ ID NO: 164154 - RNA, 64 nt, Human; identical to SEQ ID NO: 85738

SEQ ID NO: 164155 - RNA, 64 nt, Human; identical to SEQ ID NO: 85739

SEQ ID NO: 164156 - RNA, 64 nt, Human; identical to SEQ ID NO: 85740

SEQ ID NO: 164157 - RNA, 64 nt, Human; identical to SEQ ID NO: 85741

SEQ ID NO: 164158 - RNA, 64 nt, Human; identical to SEQ ID NO: 85742

SEQ ID NO: 164159 - RNA, 64 nt, Human; identical to SEQ ID NO: 85743

SEQ ID NO: 164160 - RNA, 64 nt, Human; identical to SEQ ID NO: 85744

SEQ ID NO: 164161 - RNA, 64 nt, Human; identical to SEQ ID NO: 85745

SEQ ID NO: 164162 - RNA, 64 nt, Human; identical to SEQ ID NO: 85746

SEQ ID NO: 164163 - RNA, 64 nt, Human; identical to SEQ ID NO: 85747

SEQ ID NO: 164164 - RNA, 64 nt, Human; identical to SEQ ID NO: 85748

SEQ ID NO: 164165 - RNA, 64 nt, Human; identical to SEQ ID NO: 85749

SEQ ID NO: 164166 - RNA, 64 nt, Human; identical to SEQ ID NO: 85750

SEQ ID NO: 164167 - RNA, 64 nt, Human; identical to SEQ ID NO: 85751

SEQ ID NO: 164168 - RNA, 64 nt, Human; identical to SEQ ID NO: 85752

SEQ ID NO: 164169 - RNA, 64 nt, Human; identical to SEQ ID NO: 85753

SEQ ID NO: 164170 - RNA, 64 nt, Human; identical to SEQ ID NO: 85754

SEQ ID NO: 164171 - RNA, 64 nt, Human; identical to SEQ ID NO: 85755

SEQ ID NO: 164172 - RNA, 64 nt, Human; identical to SEQ ID NO: 85756

SEQ ID NO: 164173 - RNA, 64 nt, Human; identical to SEQ ID NO: 85757

SEQ ID NO: 164174 - RNA, 64 nt, Human; identical to SEQ ID NO: 85758

SEQ ID NO: 164175 - RNA, 64 nt, Human; identical to SEQ ID NO: 85759

SEQ ID NO: 164176 - RNA, 64 nt, Human; identical to SEQ ID NO: 85760

SEQ ID NO: 164177 - RNA, 64 nt, Human; identical to SEQ ID NO: 85761

SEQ ID NO: 164178 - RNA, 64 nt, Human; identical to SEQ ID NO: 85762

SEQ ID NO: 164179 - RNA, 64 nt, Human; identical to SEQ ID NO: 85763

SEQ ID NO: 164180 - RNA, 64 nt, Human; identical to SEQ ID NO: 85764

SEQ ID NO: 164181 - RNA, 64 nt, Human; identical to SEQ ID NO: 85765

SEQ ID NO: 164182 - RNA, 64 nt, Human; identical to SEQ ID NO: 85766

SEQ ID NO: 164183 - RNA, 64 nt, Human; identical to SEQ ID NO: 85767

SEQ ID NO: 164184 - RNA, 64 nt, Human; identical to SEQ ID NO: 85768

SEQ ID NO: 164185 - RNA, 64 nt, Human; identical to SEQ ID NO: 85769

SEQ ID NO: 164186 - RNA, 64 nt, Human; identical to SEQ ID NO: 85770

SEQ ID NO: 164187 - RNA, 64 nt, Human; identical to SEQ ID NO: 85771

SEQ ID NO: 164188 - RNA, 64 nt, Human; identical to SEQ ID NO: 85772

SEQ ID NO: 164189 - RNA, 64 nt, Human; identical to SEQ ID NO: 85773

SEQ ID NO: 164190 - RNA, 64 nt, Human; identical to SEQ ID NO: 85774

SEQ ID NO: 164191 - RNA, 64 nt, Human; identical to SEQ ID NO: 85775

SEQ ID NO: 164192 - RNA, 64 nt, Human; identical to SEQ ID NO: 85776

SEQ ID NO: 164193 - RNA, 64 nt, Human; identical to SEQ ID NO: 85777

SEQ ID NO: 164194 - RNA, 64 nt, Human; identical to SEQ ID NO: 85778

SEQ ID NO: 164195 - RNA, 64 nt, Human; identical to SEQ ID NO: 85779

SEQ ID NO: 164196 - RNA, 64 nt, Human; identical to SEQ ID NO: 85780

SEQ ID NO: 164197 - RNA, 64 nt, Human; identical to SEQ ID NO: 85781

SEQ ID NO: 164198 - RNA, 64 nt, Human; identical to SEQ ID NO: 85782

SEQ ID NO: 164199 - RNA, 64 nt, Human; identical to SEQ ID NO: 85783

SEQ ID NO: 164200 - RNA, 64 nt, Human; identical to SEQ ID NO: 85784

SEQ ID NO: 164201 - RNA, 64 nt, Human; identical to SEQ ID NO: 85785

SEQ ID NO: 164202 - RNA, 64 nt, Human; identical to SEQ ID NO: 85786

SEQ ID NO: 164203 - RNA, 64 nt, Human; identical to SEQ ID NO: 85787

SEQ ID NO: 164204 - RNA, 64 nt, Human; identical to SEQ ID NO: 85788

SEQ ID NO: 164205 - RNA, 64 nt, Human; identical to SEQ ID NO: 85789

SEQ ID NO: 164206 - RNA, 64 nt, Human; identical to SEQ ID NO: 85790

SEQ ID NO: 164207 - RNA, 64 nt, Human; identical to SEQ ID NO: 85791

SEQ ID NO: 164208 - RNA, 64 nt, Human; identical to SEQ ID NO: 85792

SEQ ID NO: 164209 - RNA, 64 nt, Human; identical to SEQ ID NO: 85793

SEQ ID NO: 164210 - RNA, 64 nt, Human; identical to SEQ ID NO: 85794

SEQ ID NO: 164211 - RNA, 64 nt, Human; identical to SEQ ID NO: 85795

SEQ ID NO: 164212 - RNA, 64 nt, Human; identical to SEQ ID NO: 85796

SEQ ID NO: 164213 - RNA, 64 nt, Human; identical to SEQ ID NO: 85797

SEQ ID NO: 164214 - RNA, 64 nt, Human; identical to SEQ ID NO: 85798

SEQ ID NO: 164215 - RNA, 64 nt, Human; identical to SEQ ID NO: 85799

SEQ ID NO: 164216 - RNA, 64 nt, Human; identical to SEQ ID NO: 85800

SEQ ID NO: 164217 - RNA, 64 nt, Human; identical to SEQ ID NO: 85801

SEQ ID NO: 164218 - RNA, 64 nt, Human; identical to SEQ ID NO: 85802

SEQ ID NO: 164219 - RNA, 64 nt, Human; identical to SEQ ID NO: 85803

SEQ ID NO: 164220 - RNA, 64 nt, Human; identical to SEQ ID NO: 85804

SEQ ID NO: 164221 - RNA, 64 nt, Human; identical to SEQ ID NO: 85805

SEQ ID NO: 164222 - RNA, 64 nt, Human; identical to SEQ ID NO: 85806

SEQ ID NO: 164223 - RNA, 64 nt, Human; identical to SEQ ID NO: 85807

SEQ ID NO: 164224 - RNA, 64 nt, Human; identical to SEQ ID NO: 85808

SEQ ID NO: 164225 - RNA, 64 nt, Human; identical to SEQ ID NO: 85809

SEQ ID NO: 164226 - RNA, 64 nt, Human; identical to SEQ ID NO: 85810

SEQ ID NO: 164227 - RNA, 64 nt, Human; identical to SEQ ID NO: 85811

SEQ ID NO: 164228 - RNA, 64 nt, Human; identical to SEQ ID NO: 85812

SEQ ID NO: 164229 - RNA, 64 nt, Human; identical to SEQ ID NO: 85813

SEQ ID NO: 164230 - RNA, 64 nt, Human; identical to SEQ ID NO: 85814

SEQ ID NO: 164231 - RNA, 64 nt, Human; identical to SEQ ID NO: 85815

SEQ ID NO: 164232 - RNA, 64 nt, Human; identical to SEQ ID NO: 85816

SEQ ID NO: 164233 - RNA, 64 nt, Human; identical to SEQ ID NO: 85817

SEQ ID NO: 164234 - RNA, 64 nt, Human; identical to SEQ ID NO: 85818

SEQ ID NO: 164235 - RNA, 64 nt, Human; identical to SEQ ID NO: 85819

SEQ ID NO: 164236 - RNA, 64 nt, Human; identical to SEQ ID NO: 85820

SEQ ID NO: 164237 - RNA, 64 nt, Human; identical to SEQ ID NO: 85821

SEQ ID NO: 164238 - RNA, 64 nt, Human; identical to SEQ ID NO: 85822

SEQ ID NO: 164239 - RNA, 64 nt, Human; identical to SEQ ID NO: 85823

SEQ ID NO: 164240 - RNA, 64 nt, Human; identical to SEQ ID NO: 85824

SEQ ID NO: 164241 - RNA, 64 nt, Human; identical to SEQ ID NO: 85825

SEQ ID NO: 164242 - RNA, 64 nt, Human; identical to SEQ ID NO: 85826

SEQ ID NO: 164243 - RNA, 64 nt, Human; identical to SEQ ID NO: 85827

SEQ ID NO: 164244 - RNA, 64 nt, Human; identical to SEQ ID NO: 85828

SEQ ID NO: 164245 - RNA, 64 nt, Human; identical to SEQ ID NO: 85829

SEQ ID NO: 164246 - RNA, 64 nt, Human; identical to SEQ ID NO: 85830

SEQ ID NO: 164247 - RNA, 64 nt, Human; identical to SEQ ID NO: 85831

SEQ ID NO: 164248 - RNA, 64 nt, Human; identical to SEQ ID NO: 85832

SEQ ID NO: 164249 - RNA, 64 nt, Human; identical to SEQ ID NO: 85833

SEQ ID NO: 164250 - RNA, 64 nt, Human; identical to SEQ ID NO: 85834

SEQ ID NO: 164251 - RNA, 64 nt, Human; identical to SEQ ID NO: 85835

SEQ ID NO: 164252 - RNA, 64 nt, Human; identical to SEQ ID NO: 85836

SEQ ID NO: 164253 - RNA, 64 nt, Human; identical to SEQ ID NO: 85837

SEQ ID NO: 164254 - RNA, 64 nt, Human; identical to SEQ ID NO: 85838

SEQ ID NO: 164255 - RNA, 64 nt, Human; identical to SEQ ID NO: 85839

SEQ ID NO: 164256 - RNA, 64 nt, Human; identical to SEQ ID NO: 85840

SEQ ID NO: 164257 - RNA, 64 nt, Human; identical to SEQ ID NO: 85841

SEQ ID NO: 164258 - RNA, 64 nt, Human; identical to SEQ ID NO: 85842

SEQ ID NO: 164259 - RNA, 64 nt, Human; identical to SEQ ID NO: 85843

SEQ ID NO: 164260 - RNA, 64 nt, Human; identical to SEQ ID NO: 85844

SEQ ID NO: 164261 - RNA, 64 nt, Human; identical to SEQ ID NO: 85845

SEQ ID NO: 164262 - RNA, 64 nt, Human; identical to SEQ ID NO: 85846

SEQ ID NO: 164263 - RNA, 64 nt, Human; identical to SEQ ID NO: 85847

SEQ ID NO: 164264 - RNA, 64 nt, Human; identical to SEQ ID NO: 85848

SEQ ID NO: 164265 - RNA, 50 nt, Human; identical to SEQ ID NO: 85849

SEQ ID NO: 164266 - RNA, 64 nt, Human; identical to SEQ ID NO: 85850

SEQ ID NO: 164267 - RNA, 64 nt, Human; identical to SEQ ID NO: 85851

SEQ ID NO: 164268 - RNA, 64 nt, Human; identical to SEQ ID NO: 85852

SEQ ID NO: 164269 - RNA, 64 nt, Human; identical to SEQ ID NO: 85853

SEQ ID NO: 164270 - RNA, 64 nt, Human; identical to SEQ ID NO: 85854

SEQ ID NO: 164271 - RNA, 64 nt, Human; identical to SEQ ID NO: 85855

SEQ ID NO: 164272 - RNA, 64 nt, Human; identical to SEQ ID NO: 85856

SEQ ID NO: 164273 - RNA, 64 nt, Human; identical to SEQ ID NO: 85857

SEQ ID NO: 164274 - RNA, 64 nt, Human; identical to SEQ ID NO: 85858

SEQ ID NO: 164275 - RNA, 64 nt, Human; identical to SEQ ID NO: 85859

SEQ ID NO: 164276 - RNA, 64 nt, Human; identical to SEQ ID NO: 85860

SEQ ID NO: 164277 - RNA, 64 nt, Human; identical to SEQ ID NO: 85861

SEQ ID NO: 164278 - RNA, 64 nt, Human; identical to SEQ ID NO: 85862

SEQ ID NO: 164279 - RNA, 64 nt, Human; identical to SEQ ID NO: 85863

SEQ ID NO: 164280 - RNA, 64 nt, Human; identical to SEQ ID NO: 85864

SEQ ID NO: 164281 - RNA, 64 nt, Human; identical to SEQ ID NO: 85865

SEQ ID NO: 164282 - RNA, 64 nt, Human; identical to SEQ ID NO: 85866

SEQ ID NO: 164283 - RNA, 64 nt, Human; identical to SEQ ID NO: 85867

SEQ ID NO: 164284 - RNA, 64 nt, Human; identical to SEQ ID NO: 85868

SEQ ID NO: 164285 - RNA, 64 nt, Human; identical to SEQ ID NO: 85869

SEQ ID NO: 164286 - RNA, 64 nt, Human; identical to SEQ ID NO: 85870

SEQ ID NO: 164287 - RNA, 64 nt, Human; identical to SEQ ID NO: 85871

SEQ ID NO: 164288 - RNA, 64 nt, Human; identical to SEQ ID NO: 85872

SEQ ID NO: 164289 - RNA, 64 nt, Human; identical to SEQ ID NO: 85873

SEQ ID NO: 164290 - RNA, 64 nt, Human; identical to SEQ ID NO: 85874

SEQ ID NO: 164291 - RNA, 64 nt, Human; identical to SEQ ID NO: 85875

SEQ ID NO: 164292 - RNA, 64 nt, Human; identical to SEQ ID NO: 85876

SEQ ID NO: 164293 - RNA, 64 nt, Human; identical to SEQ ID NO: 85877

SEQ ID NO: 164294 - RNA, 64 nt, Human; identical to SEQ ID NO: 85878

SEQ ID NO: 164295 - RNA, 64 nt, Human; identical to SEQ ID NO: 85879

SEQ ID NO: 164296 - RNA, 64 nt, Human; identical to SEQ ID NO: 85880

SEQ ID NO: 164297 - RNA, 64 nt, Human; identical to SEQ ID NO: 85881

SEQ ID NO: 164298 - RNA, 64 nt, Human; identical to SEQ ID NO: 85882

SEQ ID NO: 164299 - RNA, 64 nt, Human; identical to SEQ ID NO: 85883

SEQ ID NO: 164300 - RNA, 64 nt, Human; identical to SEQ ID NO: 85884

SEQ ID NO: 164301 - RNA, 64 nt, Human; identical to SEQ ID NO: 85885

SEQ ID NO: 164302 - RNA, 64 nt, Human; identical to SEQ ID NO: 85886

SEQ ID NO: 164303 - RNA, 64 nt, Human; identical to SEQ ID NO: 85887

SEQ ID NO: 164304 - RNA, 64 nt, Human; identical to SEQ ID NO: 85888

SEQ ID NO: 164305 - RNA, 64 nt, Human; identical to SEQ ID NO: 85889

SEQ ID NO: 164306 - RNA, 64 nt, Human; identical to SEQ ID NO: 85890

SEQ ID NO: 164307 - RNA, 55 nt, Human; identical to SEQ ID NO: 85891

SEQ ID NO: 164308 - RNA, 64 nt, Human; identical to SEQ ID NO: 85892

SEQ ID NO: 164309 - RNA, 64 nt, Human; identical to SEQ ID NO: 85885

SEQ ID NO: 164310 - RNA, 64 nt, Human; identical to SEQ ID NO: 85894

SEQ ID NO: 164311 - RNA, 64 nt, Human; identical to SEQ ID NO: 85895

SEQ ID NO: 164312 - RNA, 64 nt, Human; identical to SEQ ID NO: 85896

SEQ ID NO: 164313 - RNA, 64 nt, Human; identical to SEQ ID NO: 85897

SEQ ID NO: 164314 - RNA, 64 nt, Human; identical to SEQ ID NO: 85898

SEQ ID NO: 164315 - RNA, 64 nt, Human; identical to SEQ ID NO: 85899

SEQ ID NO: 164316 - RNA, 64 nt, Human; identical to SEQ ID NO: 85900

SEQ ID NO: 164317 - RNA, 64 nt, Human; identical to SEQ ID NO: 85901

SEQ ID NO: 164318 - RNA, 64 nt, Human; identical to SEQ ID NO: 85902

SEQ ID NO: 164319 - RNA, 64 nt, Human; identical to SEQ ID NO: 85903

SEQ ID NO: 164320 - RNA, 64 nt, Human; identical to SEQ ID NO: 85904

SEQ ID NO: 164321 - RNA, 64 nt, Human; identical to SEQ ID NO: 85905

SEQ ID NO: 164322 - RNA, 64 nt, Human; identical to SEQ ID NO: 85906

SEQ ID NO: 164323 - RNA, 64 nt, Human; identical to SEQ ID NO: 85907

SEQ ID NO: 164324 - RNA, 64 nt, Human; identical to SEQ ID NO: 85908

SEQ ID NO: 164325 - RNA, 64 nt, Human; identical to SEQ ID NO: 85909

SEQ ID NO: 164326 - RNA, 64 nt, Human; identical to SEQ ID NO: 85910

SEQ ID NO: 164327 - RNA, 64 nt, Human; identical to SEQ ID NO: 85911

SEQ ID NO: 164328 - RNA, 64 nt, Human; identical to SEQ ID NO: 85912

SEQ ID NO: 164329 - RNA, 64 nt, Human; identical to SEQ ID NO: 85913

SEQ ID NO: 164330 - RNA, 64 nt, Human; identical to SEQ ID NO: 85914

SEQ ID NO: 164331 - RNA, 64 nt, Human; identical to SEQ ID NO: 85915

SEQ ID NO: 164332 - RNA, 64 nt, Human; identical to SEQ ID NO: 85916

SEQ ID NO: 164333 - RNA, 64 nt, Human; identical to SEQ ID NO: 85917

SEQ ID NO: 164334 - RNA, 64 nt, Human; identical to SEQ ID NO: 85918

SEQ ID NO: 164335 - RNA, 64 nt, Human; identical to SEQ ID NO: 85919

SEQ ID NO: 164336 - RNA, 64 nt, Human; identical to SEQ ID NO: 85920

SEQ ID NO: 164337 - RNA, 64 nt, Human; identical to SEQ ID NO: 85921

SEQ ID NO: 164338 - RNA, 64 nt, Human; identical to SEQ ID NO: 85922

SEQ ID NO: 164339 - RNA, 64 nt, Human; identical to SEQ ID NO: 85923

SEQ ID NO: 164340 - RNA, 64 nt, Human; identical to SEQ ID NO: 85924

SEQ ID NO: 164341 - RNA, 64 nt, Human; identical to SEQ ID NO: 85925

SEQ ID NO: 164342 - RNA, 64 nt, Human; identical to SEQ ID NO: 85926

SEQ ID NO: 164343 - RNA, 64 nt, Human; identical to SEQ ID NO: 85927

SEQ ID NO: 164344 - RNA, 64 nt, Human; identical to SEQ ID NO: 85928

SEQ ID NO: 164345 - RNA, 64 nt, Human; identical to SEQ ID NO: 85929

SEQ ID NO: 164346 - RNA, 64 nt, Human; identical to SEQ ID NO: 85930

SEQ ID NO: 164347 - RNA, 64 nt, Human; identical to SEQ ID NO: 85931

SEQ ID NO: 164348 - RNA, 64 nt, Human; identical to SEQ ID NO: 85932

SEQ ID NO: 164349 - RNA, 64 nt, Human; identical to SEQ ID NO: 85933

SEQ ID NO: 164350 - RNA, 64 nt, Human; identical to SEQ ID NO: 85934

SEQ ID NO: 164351 - RNA, 64 nt, Human; identical to SEQ ID NO: 85935

SEQ ID NO: 164352 - RNA, 64 nt, Human; identical to SEQ ID NO: 85936

SEQ ID NO: 164353 - RNA, 64 nt, Human; identical to SEQ ID NO: 85937

SEQ ID NO: 164354 - RNA, 64 nt, Human; identical to SEQ ID NO: 85938

SEQ ID NO: 164355 - RNA, 64 nt, Human; identical to SEQ ID NO: 85939

SEQ ID NO: 164356 - RNA, 64 nt, Human; identical to SEQ ID NO: 85940

SEQ ID NO: 164357 - RNA, 64 nt, Human; identical to SEQ ID NO: 85941

SEQ ID NO: 164358 - RNA, 64 nt, Human; identical to SEQ ID NO: 85942

SEQ ID NO: 164359 - RNA, 64 nt, Human; identical to SEQ ID NO: 85943

SEQ ID NO: 164360 - RNA, 64 nt, Human; identical to SEQ ID NO: 85944

SEQ ID NO: 164361 - RNA, 64 nt, Human; identical to SEQ ID NO: 85945

SEQ ID NO: 164362 - RNA, 64 nt, Human; identical to SEQ ID NO: 85946

SEQ ID NO: 164363 - RNA, 64 nt, Human; identical to SEQ ID NO: 85947

SEQ ID NO: 164364 - RNA, 64 nt, Human; identical to SEQ ID NO: 85948

SEQ ID NO: 164365 - RNA, 64 nt, Human; identical to SEQ ID NO: 85949

SEQ ID NO: 164366 - RNA, 64 nt, Human; identical to SEQ ID NO: 85950

SEQ ID NO: 164367 - RNA, 64 nt, Human; identical to SEQ ID NO: 85951

SEQ ID NO: 164368 - RNA, 64 nt, Human; identical to SEQ ID NO: 85952

SEQ ID NO: 164369 - RNA, 64 nt, Human; identical to SEQ ID NO: 85953

SEQ ID NO: 164370 - RNA, 64 nt, Human; identical to SEQ ID NO: 85954

SEQ ID NO: 164371 - RNA, 64 nt, Human; identical to SEQ ID NO: 85955

SEQ ID NO: 164372 - RNA, 64 nt, Human; identical to SEQ ID NO: 85956

SEQ ID NO: 164373 - RNA, 64 nt, Human; identical to SEQ ID NO: 85957

SEQ ID NO: 164374 - RNA, 64 nt, Human; identical to SEQ ID NO: 85958

SEQ ID NO: 164375 - RNA, 64 nt, Human; identical to SEQ ID NO: 85959

SEQ ID NO: 164376 - RNA, 64 nt, Human; identical to SEQ ID NO: 85960

SEQ ID NO: 164377 - RNA, 64 nt, Human; identical to SEQ ID NO: 85961

SEQ ID NO: 164378 - RNA, 64 nt, Human; identical to SEQ ID NO: 85962

SEQ ID NO: 164379 - RNA, 64 nt, Human
agccaagugaagagugugguuugcauccaagagaaaacaccacacugugaugucaucgggaaau

SEQ ID NO: 164380 - RNA, 64 nt, Human
aagcccccaaggagggcucugacauucuuuuuaaaaacaccacaaagcaaaauucccaggacau

SEQ ID NO: 164381 - RNA, 64 nt, Human
cucugauggggugacauaaucccuuccuccugggaaacaccagcuuuuggggugauagcacuuu

SEQ ID NO: 164382 - RNA, 64 nt, Human
ggucaaaaugaacuccauugcuuaagaaacacauaaacaccauuuagucacugaacauagcuau

SEQ ID NO: 164383 - RNA, 64 nt, Human
ucagaccuugcauccacagaagcacaacccagccaaacaccacagccuucuccagagccggcac

SEQ ID NO: 164384 - RNA, 64 nt, Human
agcacagaguagagaacaacuggcagcuuugaaaaaacaccaugaagaagaaaucguucaucau

SEQ ID NO: 164385 - RNA, 64 nt, Human
uaguuuccugagugaacaagccauaaccuccccuaaacaccaccuagguauuuguuagaaguca

SEQ ID NO: 164386 - RNA, 64 nt, Human
cauucaaagggacggucaguuuggugucaacaugaaacaccaagaugucugucucugaagcgug

SEQ ID NO: 164387 - RNA, 64 nt, Human
gcccccauacugacagacggacagacagacaugcaaacaccagacugaagcacauguaauauag

SEQ ID NO: 164388 - RNA, 64 nt, Human
gagaugccuggccaggcuccacggaucccgccagaaacaccaacagagggucucccuuucugcc

SEQ ID NO: 164389 - RNA, 64 nt, Human
guuuugaaaaucagaugaugucuucuccuuuuccaaacaccacacguugaaagcauuuauaaau

SEQ ID NO: 164390 - RNA, 64 nt, Human
guuuccuuauugaaaaaucaguguauuagucauaaaacaccaucauuaagaauaauugaacaau

SEQ ID NO: 164391 - RNA, 64 nt, Human
uaguucuauagaugaagacauaaaagacacugguaaacaccaagguaaaagggcccccaaggug

SEQ ID NO: 164392 - RNA, 64 nt, Human
uaaaucaguauuacuggcagacguuauuuuaggaaaacaccagauaacuauaucaugucaauau

SEQ ID NO: 164393 - RNA, 64 nt, Human
uuuguuucuguguuuuagaggaauccuaaagucaaaacaccagagacuugaagaacuugcaaac

SEQ ID NO: 164394 - RNA, 64 nt, Human
cugagucaacccccuucaaccuccucaccucucuaaacaccauccauaguaacaugugcauuac

SEQ ID NO: 164395 - RNA, 64 nt, Human
guaacuuaaugugagagaauccauaucugcgugaaaacaccaaguauucuuuuuaaaugaagca

SEQ ID NO: 164396 - RNA, 64 nt, Human
caaccagauuguuucugguucccugccacuauaaaaacaccaugagagcauacucauacauguu

SEQ ID NO: 164397 - RNA, 64 nt, Human
caacccaugguugagaugggcaccguuuugcaggaaacaccauauuaauagacauccucaccau

SEQ ID NO: 164398 - RNA, 64 nt, Human
cauacuguuuccuaugacauuacuguauuuaagaaaacaccauggagaugaaaugccuuugauu

SEQ ID NO: 164399 - RNA, 64 nt, Human
auaauuuagaccuaaaaauccuuaugauuagaugaaacaccaaaaauauaaggaaaauaacaca

SEQ ID NO: 164400 - RNA, 64 nt, Human
aauaggacuugccuauuuucauuuuuaagaagaaaaacaccacucauuuuauaaaauauaguac

SEQ ID NO: 164401 - RNA, 64 nt, Human
acaugacauguagcucuccaugguccucccucugaaacaccacaugcuguuuaaacuagaagcu

SEQ ID NO: 164402 - RNA, 64 nt, Human
agcuuggcucacaaggcccaggagaccuccagcuaaacaccaaccccugaccuaccccagccag

SEQ ID NO: 164403 - RNA, 64 nt, Human
uuuuaaaguguaagggaaaaauuaauuuuuuaaaaaacaccaugcuuggaggguggggguagaa

SEQ ID NO: 164404 - RNA, 64 nt, Human
aauuaaacucaaauauuaaauaucuauaacuuauaaacaccaacuuucaauguaauaaauguau

SEQ ID NO: 164405 - RNA, 64 nt, Human
aaagaucuccaagcauagagaagagucuggagggaaacaccaaacucauaacagucuuacugca

SEQ ID NO: 164406 - RNA, 60 nt, Human
uguccgugcacaugguuuaaaggccaguccaaacaccacggagcauuuggcaaucaaggc

SEQ ID NO: 164407 - RNA, 64 nt, Human
agagcuaugcuuuaggucucaauuuuggaauuucaaacaccagcaaaaaauuggaaaucgagau

SEQ ID NO: 164408 - RNA, 64 nt, Human
ugcuauuaucauagacuaaugacauuuaucuucaaaacaccaaauugucuuuagaaaaauuaau

SEQ ID NO: 164409 - RNA, 64 nt, Human
aacaaaaugaagggauuaugacagguauuaccaaaaacaccaaaaggaacaaaggggccugcgu

SEQ ID NO: 164410 - RNA, 64 nt, Human; identical to SEQ ID NO: 84863

SEQ ID NO: 164411 - RNA, 64 nt, Human
gaaagcaagccauucaguuucuuguuuguaccuaaaacaccaaaaaagaaacacucaaauccag

SEQ ID NO: 164412 - RNA, 64 nt, Human
ucucuugggauccuguguagaagcuguucucauuaaacaccaaacaguuaaguccauucucugg

SEQ ID NO: 164413 - RNA, 64 nt, Human
gccuaauuaauuauggaaaaauaauucagaaucuaaacaccacugaaaacuuauaaaaaauguu

SEQ ID NO: 164414 - RNA, 64 nt, Human
caggaggcagcauuugccaauggaaagcucuaggaaacaccagucuugagagguggccagccag

SEQ ID NO: 164415 - RNA, 64 nt, Human
aaaaacauaaagucauuauauuaauuaaaagaaaaaacaccauuuaauauguucugaaaacauu

SEQ ID NO: 164416 - RNA, 64 nt, Human
gguaauucauuuuuuuuuaagaucauuaugugcaaaacaccaaguuuuaaaaauaacucacaga

SEQ ID NO: 164417 - RNA, 64 nt, Human
aaaccaaguuaacuuuuauuauagacagugaauaaaacaccaaaaacccaaaaaugcuuuaacc

SEQ ID NO: 164418 - RNA, 64 nt, Human
aaguaauuaauugcuggagacuacaauuccuggcaaacaccauuauuccagaugcaccaugcua

SEQ ID NO: 164419 - RNA, 64 nt, Human
acgccuuccucgcuaauuugaacuaauuguauaaaaacaccaaaccugcucacuaaacuuucug

SEQ ID NO: 164420 - RNA, 64 nt, Human
ggcagagaucggaguuuugcagccacaagcuaagaaacaccaaggauuguggcaaccaucagaa

SEQ ID NO: 164421 - RNA, 64 nt, Human
agcauuagauuuuaacuuguuuagauuuugucuuaaacaccaguaauauggcucuuguuuauca

SEQ ID NO: 164422 - RNA, 64 nt, Human
gaagacaacagcagaaaugcuaacaagcgugcagaaacaccagagagugcguauccugcucaga

SEQ ID NO: 164423 - RNA, 64 nt, Human
cguuucuccaccugaagugaugauggaugagaaaaaacaccaccaaaugacaagucacacccuc

SEQ ID NO: 164424 - RNA, 64 nt, Human
cgggacauaggcaugggcaaggacuucaugucuaaaacaccaaaagcaauggcaacaaaagcca

SEQ ID NO: 164425 - RNA, 64 nt, Human
agacuaguaaacaccgacuucuccuuuggguuacaaacaccauuucaaccuuucgggagaguca

SEQ ID NO: 164426 - RNA, 64 nt, Human
aagagaagucuuuaaaaagccugcauuguguauuaaacaccagguaauaugugcaaaaccgagg

SEQ ID NO: 164427 - RNA, 64 nt, Human
guagggucuccugucccaggggguugaggaaaaaaaacaccaguuguuuauauuuugugcuuau

SEQ ID NO: 164428 - RNA, 64 nt, Human; identical to SEQ ID NO: 84864

SEQ ID NO: 164429 - RNA, 64 nt, Human
ugcugagaagaggacugcaaugacugcuuucaaaaaacaccagaauaaauacauacguagugua

SEQ ID NO: 164430 - RNA, 64 nt, Human
ggaauuaacacaaauaaaagaugccuuuuuacuuaaacaccaagacagaaaacuugcccaauac

SEQ ID NO: 164431 - RNA, 64 nt, Human
cugugcugugugugacgugaccggacuuuucugcaaacaccaacauguugggaaacuuggcucg

SEQ ID NO: 164432 - RNA, 64 nt, Human
uuaaacaaacaaacaaaaaacacaaaacauaauaaaacaccaagaacaugaggauggagagaag

SEQ ID NO: 164433 - RNA, 64 nt, Human
uuguuuuuaaaaugaccuucaaaauaaacugucaaaacaccauuauuuuaaaguaguuuuuguu

SEQ ID NO: 164434 - RNA, 64 nt, Human
ugagcaggauucuacccuaguccgauuguauagaaaacaccauuuugauucagguauuauuuuu

SEQ ID NO: 164435 - RNA, 64 nt, Human
auaguacuccagaucucuuucggcuuccuaugagaaacaccagaagcauuacuuuccacuucua

SEQ ID NO: 164436 - RNA, 64 nt, Human
uuucuuacucuuuucuguuaguagauuuauuuauaaacaccacaagaagaucucuugggaucag

SEQ ID NO: 164437 - RNA, 64 nt, Human
ugaaauaguagcgaggaggauuuucuguuuuggaaaacaccauuagaaccagaccagcuuuguu

SEQ ID NO: 164438 - RNA, 64 nt, Human
guagucauuuguguuuaucaugcaacuuacuuacaaacaccaagauauuaauugcugcaacuug

SEQ ID NO: 164439 - RNA, 64 nt, Human
cuaauuauuaucuacguuucucucuagauauaaaaaacaccauagauccuauacacacaaaaau

SEQ ID NO: 164440 - RNA, 64 nt, Human
auucaccuucuaaaaacucaugugcagguuugauaaacaccagaacagaagacagugaugcugu

SEQ ID NO: 164441 - RNA, 64 nt, Human
ggcugggaacgggcaccaagcagccgccucuaacaaacaccaugguccguggaaguucaugcca

SEQ ID NO: 164442 - RNA, 64 nt, Human
caucucauauauauaaaauggacacguggcuauaaaacaccauauaagagaugaguagugcguu

SEQ ID NO: 164443 - RNA, 64 nt, Human
aaccuacauuaaggaaaauugcugugaauuaugaaaacaccaaguuugaauaagaggaucaugg

SEQ ID NO: 164444 - RNA, 64 nt, Human
uuacuuccgccucccucagagcagcagccugucaaaacaccagauuacaacaaauuuaguuuaa

SEQ ID NO: 164445 - RNA, 64 nt, Human
ugugcuaucacagggucaccucuuuuacaguuagaaacaccagccgaggccacagaaucccauc

SEQ ID NO: 164446 - RNA, 64 nt, Human
aguguuuugaucugggcucugagcacaagucaggaaacaccaacauauucacacucucccagua

SEQ ID NO: 164447 - RNA, 64 nt, Human
uuuccaaagauguggguggcaaaugccccuauagaaacaccaguaccugaaagcacuguagccc

SEQ ID NO: 164448 - RNA, 64 nt, Human
acaacacugcuggguuuuacauccagauaguaauaaacaccauuucaucauuuucucuuggcuc

SEQ ID NO: 164449 - RNA, 64 nt, Human
guuugaaccaccagguuuauuugugugucuaaauaaacaccaaauaguaccaaccugguuguca

SEQ ID NO: 164450 - RNA, 64 nt, Human
aauccugaaauagauguuuuaaagaugcaaccucaaacaccaaugcuguuguuaaagagccuau

SEQ ID NO: 164451 - RNA, 64 nt, Human
ugucaaucgucacuuccucguuuuaacucagcugaaacaccaggacccaauagagagggcaagc

SEQ ID NO: 164452 - RNA, 64 nt, Human
aaguauuuggcuguuuuuauuuuuuaaaagguauaaacaccaaaaaaaaaauuaacauuguaug

SEQ ID NO: 164453 - RNA, 64 nt, Human
gugcagaguuauuuggagauuaugucuuuuucuuaaacaccauggcugucacacuucaguucaa

SEQ ID NO: 164454 - RNA, 64 nt, Human
guuuuaaaaauuuccccagguaaguuuaagauucaaacaccaucuauugagcaccuacauugug

SEQ ID NO: 164455 - RNA, 64 nt, Human
cucuuaaaaaaaucacuaucuuggaaauaaaaauaaacaccaaagaguuacugucaucugaagu

SEQ ID NO: 164456 - RNA, 64 nt, Human
uucaaaauaauuaaagugcauguauuuuccuuguaaacaccaugagcucucuuagacaucuugu

SEQ ID NO: 164457 - RNA, 64 nt, Human
ccaugaugcauggaguguuugacgaagaaacaaaaaacaccaaaaauugcgagccuuuacccuc

SEQ ID NO: 164458 - RNA, 64 nt, Human
uucagggucacccagcaguccuccagcaagguagaaacaccaaaucaaugaguuuaugcuagaa

SEQ ID NO: 164459 - RNA, 64 nt, Human
aaguuuucuaguccauaccacagugccuugcaaaaaacaccacaugaauaaagcaauaaaauuu

SEQ ID NO: 164460 - RNA, 64 nt, Human
aagaucaccaucaauuuuaguugucaaugggaaaaaacaccaggauuuaaguuucacagcacuu

SEQ ID NO: 164461 - RNA, 60 nt, Human
agagccguucaaaagacuaaacagugugccaaacaccagcuaaaccaagagagaaagcaa

SEQ ID NO: 164462 - RNA, 64 nt, Human
ugaccaacaucacugcccggccccagccccagguaaacaccauucuacccucugcuucugugag

SEQ ID NO: 164463 - RNA, 63 nt, Human
gauaguuuuuauucaauguauauaagacagguagugccugauuuacuacuuuauauaaaauag

SEQ ID NO: 164464 - RNA, 64 nt, Human
cuauaaauuguccguguucauacauuugaggggaaaacaccauaagguuucguuucuguauaca

SEQ ID NO: 164465 - RNA, 50 nt, Human
uuacuccaccuacggcauaaaaacaccaaggaaauaucaaagaacacaac

SEQ ID NO: 164466 - RNA, 64 nt, Human
cucuaggguaagccagaaggcaagaucagauuaaaaacaccauguuucuaagcauccauuuuuc

SEQ ID NO: 164467 - RNA, 64 nt, Human
gaacugucccaaaauguaauuugcaaagagcuucaaacaccaaaaauauaccauuuuaaggcau

SEQ ID NO: 164468 - RNA, 64 nt, Human
uauuuuauuuuauuuuauuuuuuuacccuuccucaaacaccaguaacuauuauuaacucguuuu

SEQ ID NO: 164469 - RNA, 64 nt, Human
auuuggucuuagcuuuacauuuucaguaccaaagaaacaccacuuaaucuucucucuugauuga

SEQ ID NO: 164470 - RNA, 64 nt, Human
aguauaugguuuccgaggaagauuaucuacugcaaaacaccacuguuggaaaaauagguauuuu

SEQ ID NO: 164471 - RNA, 64 nt, Human
cuucucggugcuccucacccgugugcuguuuuccaaacaccaccuuuuugccucaaggucucug

SEQ ID NO: 164472 - RNA, 64 nt, Human
gugugcaguucgcugcucccugcuuggcuuaugaaaacaccacugaacagaaauuucuccaggg

SEQ ID NO: 164473 - RNA, 64 nt, Human
gaaacauaccuuugacuauaagaaauuaaaaaaaaaacaccaaaauaauauuuuucuuacuuga

SEQ ID NO: 164474 - RNA, 64 nt, Human
gcguguguucucuccggauggaaucacagccaauaaacaccagugauuucacaccguguggcca

SEQ ID NO: 164475 - RNA, 64 nt, Human
gacugugagguggguguucauucauuuccuccauaaacaccaacuucucgaagcgugccaggcu

SEQ ID NO: 164476 - RNA, 64 nt, Human
acaggaugcugauaagcgcgcugagagguggaugaaacaccaaagucuguuuccccguccgcag

SEQ ID NO: 164477 - RNA, 64 nt, Human
uaacuaucaauuguucacaaugugguggaaauuaaaacaccaucucagcuuuaacuuuuaaaua

SEQ ID NO: 164478 - RNA, 64 nt, Human
aucagacggaucaccuuaucucuacacagcuggcaaacaccaggcugcggcuuggauuaaccag

SEQ ID NO: 164479 - RNA, 64 nt, Human
uuaccuguauauuauaugccacccguaaccauaaaaacaccaggauuuagguuccuugaaggua

SEQ ID NO: 164480 - RNA, 64 nt, Human
uuaccugauuuuaaugaaaaucacauuuugauacaaacaccagauuugaaaguucaauguguuu

SEQ ID NO: 164481 - RNA, 55 nt, Human; identical to SEQ ID NO: 84866

SEQ ID NO: 164482 - RNA, 64 nt, Human
cccucugagauggcguaucuaucggaaggauuucaaacaccaauugcuuuaccugaacaaaugg

SEQ ID NO: 164483 - RNA, 64 nt, Human
uugcauaacugaucauauugcuugucucagaaaaaaacaccaucagcaaagugggccuccaaag

SEQ ID NO: 164484 - RNA, 64 nt, Human
ucgugucggcugguugucugacgagcaucguuacaaacaccaugaugagggguuugggguuuua

SEQ ID NO: 164485 - RNA, 64 nt, Human
ugagcacaggcaacauuacaaacaaaggauuugaaaacaccaagaguacaggucuucuuuaagg

SEQ ID NO: 164486 - RNA, 64 nt, Human
cagucacuaggaugcagauggaccacacuuugagaaacaccacccauuucuacuuuuugcaccu

SEQ ID NO: 164487 - RNA, 64 nt, Human
ugauuuuaauuaagacuuuuauaagacuagcuuaaaacaccaaccaacauuauuuuugcaaaag

SEQ ID NO: 164488 - RNA, 64 nt, Human
cacccucucacucaauuuccacucagaacccuauaaacaccagugggaagggcaacccacugca

SEQ ID NO: 164489 - RNA, 64 nt, Human
uguuugugucuuuugugcuuuuuuguuguuauuaaaacaccaacuaaaccuuauagucaagaca

SEQ ID NO: 164490 - RNA, 64 nt, Human
aggcaguuuuuaagaauauuaacaauauauuaacaaacaccaauacaacuaauccuauuugguu

SEQ ID NO: 164491 - RNA, 64 nt, Human
uguagauaguacccccucccuccuucaaaaaaccaaacaccauaucugaugugugaaaauaaug

SEQ ID NO: 164492 - RNA, 64 nt, Human
acucuuuggugcacaaguaacacauuuggccacaaaacaccaaagaauuguaggcaguggcccc

SEQ ID NO: 164493 - RNA, 64 nt, Human
aagcuaaaauuuucagaagucuguaaaaauggaaaaacaccauugaaagaggcagaaacaggua

SEQ ID NO: 164494 - RNA, 64 nt, Human
gaaucagagagaccugcuaaaaccagacagauauaaacaccaaagacggaagccaaauagguag

SEQ ID NO: 164495 - RNA, 64 nt, Human
auaggaaaacaaaguucuagauagguuaaaagaaaaacaccauaaaagugguaguauauuuaag

SEQ ID NO: 164496 - RNA, 64 nt, Human
ugcuuaaacuugacccagguggcuagcaaauuagaaacaccauucaucucuaacauaugauacu

SEQ ID NO: 164497 - RNA, 64 nt, Human
guaaaaugcugacaucuaaaacuaaauaaauagaaaacaccaggccagaacuauagucauacuc

SEQ ID NO: 164498 - RNA, 64 nt, Human
gagcgagacucugucucaaaaaaacaaaacaaaaaaacaccaaaaaaacccccaaaccugaaga

SEQ ID NO: 164499 - RNA, 64 nt, Human; identical to SEQ ID NO: 84867

SEQ ID NO: 164500 - RNA, 64 nt, Human
ccuucccuuccugcucccagacagucucacaaguaaacaccagcagcucauagauuacaaccaa

SEQ ID NO: 164501 - RNA, 64 nt, Human
ugugccuagaaacuacagcacauauaaaauauguaaacaccagccuguugcuguacuuuucugc

SEQ ID NO: 164502 - RNA, 64 nt, Human
gucuugaguuaagaaggaaagaggaaaaaagaaaaaacaccaauacccagauuuaaaaaaaaaa

SEQ ID NO: 164503 - RNA, 64 nt, Human
gaaaucuuuucagcuuauuaaguagcucuuugguaaacaccaaagaaguuucugauagugucug

SEQ ID NO: 164504 - RNA, 64 nt, Human
uuuagccaagaagacugauauguuuuuuauccccaaacaccaugaaucuuuuugagagaaccuu

SEQ ID NO: 164505 - RNA, 64 nt, Human
gcguuugcuaucugacugcugaucugcgugacagaaacaccagcauauuugcaacgccaaggau

SEQ ID NO: 164506 - RNA, 64 nt, Human
uuuuucuuucuuacagaucaaagguccaucaucaaaacaccaaagacucaagacacagaagaug

SEQ ID NO: 164507 - RNA, 64 nt, Human
cgccccuuggaauggagggucuucuagggaccagaaacaccagacacuucuucugccccaagca

SEQ ID NO: 164508 - RNA, 64 nt, Human
uccagaacaucuugcucuugaucagcacauccaaaaacaccaagacaaacauccaguggagcag

SEQ ID NO: 164509 - RNA, 64 nt, Human
gcacuccccaaaaagaauccgaaaaaccacaaagaaacaccaggcguaccuggugcgcgagagc

SEQ ID NO: 164510 - RNA, 64 nt, Human
auuagaacaagugacuguaggggggaccgucuagaaacaccaggcccagacacacggucccuca

SEQ ID NO: 164511 - RNA, 64 nt, Human
gccaguacaccaaggcuguagggaucaagcauguaaacaccaacugguccauacccauucauua

SEQ ID NO: 164512 - RNA, 64 nt, Human
guaauuaggaccccaggaagccuugcugcccagaaaacaccagcgcuguggauggucccagggc

SEQ ID NO: 164513 - RNA, 64 nt, Human
ccaauuuccugggcaguugaugcaucucugggaaaaacaccagaaagcuugcugaaauggaaaa

SEQ ID NO: 164514 - RNA, 64 nt, Human
aaauuuaccuccuuuccuuuucccuuuccccuuaaaacaccagacaaaucgauaacaacuuaua

SEQ ID NO: 164515 - RNA, 64 nt, Human
accuuggccccaaagauauuccucaauagauuucaaacaccacuccccuguagaacucucccag

SEQ ID NO: 164516 - RNA, 64 nt, Human
cauggugaccacagccagcuggaaccugaagucuaaacaccauuccugcucuccagcuuccuuu

SEQ ID NO: 164517 - RNA, 64 nt, Human; identical to SEQ ID NO: 84875

SEQ ID NO: 164518 - RNA, 64 nt, Human
cuccuaaaaaaaaaaaaaaaugagagaauuagggaaacaccaaaagcaaagagagcagcucuau

SEQ ID NO: 164519 - RNA, 64 nt, Human
caugaaccacgccuggugaaggagccugggugagaaacaccauccaaagcuggggcaaagauga

SEQ ID NO: 164520 - RNA, 64 nt, Human
gagcgacuuuucuuuguucagcuuuaguuuuagcaaacaccacaaauauguuuuaaguaacauc

SEQ ID NO: 164521 - RNA, 64 nt, Human
auuuuuuagaggugccaguucccaccucuaaaaaaaacaccaacaacaaaagaaaugaugcaac

SEQ ID NO: 164522 - RNA, 64 nt, Human
acucucauaauaugcuuuccagcuagaggggagaaaacaccaggaaagaggaacccugggucau

SEQ ID NO: 164523 - RNA, 64 nt, Human
aacuuguuuaauuuguuuaaaucaacauagcaugaaacaccaaauaaaauguuugacauaguuu

SEQ ID NO: 164524 - RNA, 64 nt, Human
ucucacauuuaauauccugccuuuuaccuucaguaaacaccaugaagaugccauugacaaggug

SEQ ID NO: 164525 - RNA, 64 nt, Human
cuuuaauggcccccaaaaucugucacuacaauuuaaacaccagucccgaaauuuggaucuucuu

SEQ ID NO: 164526 - RNA, 64 nt, Human
aaaacuucuuacaccuaaaauucaugcaggagagaaacaccacaaaugugaaaaauuugguaaa

SEQ ID NO: 164527 - RNA, 64 nt, Human
uaggcccugcauuccugucauccucauccgggggaaacaccaucaucccaguagcugcccuauu

SEQ ID NO: 164528 - RNA, 64 nt, Human
aguccccuuucucuccccaguuauuuuuuuuuccaaacaccaacuugaaccagauccccaauua

SEQ ID NO: 164529 - RNA, 64 nt, Human
guaguucuguguggcgguggucauuccccucauuaaacaccaguucuuggugacgccaggggcu

SEQ ID NO: 164530 - RNA, 64 nt, Human
agugauuuucuggaaagagaugugaucauggauuaaacaccagcucauuggaaacucauuggau

SEQ ID NO: 164531 - RNA, 64 nt, Human
cuuuuuaaagcuuguacaugaaccuuuguauaaaaaacaccagugcucuuucguuguauuuuuc

SEQ ID NO: 164532 - RNA, 64 nt, Human
uuuuuauuuuauuuuauuguuuuuuuuuuuagaaaaacaccacuuuuauuauguacaauaaaau

SEQ ID NO: 164533 - RNA, 64 nt, Human
agggcuacauguagaaaagucuuaaaauagagcuaaacaccacaguggucaacaaagccaucau

SEQ ID NO: 164534 - RNA, 64 nt, Human
acauggcacaaaacaccaaauauugguuaugaugaaacaccacauuuuagcaaaacuuuacuaa

SEQ ID NO: 164535 - RNA, 64 nt, Human; identical to SEQ ID NO: 84842

SEQ ID NO: 164536 - RNA, 64 nt, Human
ugugaaacugacaauccuguggccacauggcacaaaacaccaaauauugguuaugaugaaacac

SEQ ID NO: 164537 - RNA, 64 nt, Human
gcgcuccacucggaaaaagcggugccccuauacaaaacaccagacccuggaacuggagaaagag

SEQ ID NO: 164538 - RNA, 64 nt, Human
ggaucucgauuuccuuuuaauggaaaauaacauuaaacaccaaauauaagccucgcugucccac

SEQ ID NO: 164539 - RNA, 64 nt, Human
gggcauuuggaaggagcagugaagccaagccaggaaacaccaagauggcgagccagugugguug

SEQ ID NO: 164540 - RNA, 64 nt, Human
auauauuuuguuuuuaaaagggggggagcaaaagaaacaccaguguuagcuuaaucuuaauguc

SEQ ID NO: 164541 - RNA, 64 nt, Human
cauuaucuguccaguuugacuuuuuuuucagugaaaacaccaugucauggaguguaggaaagag

SEQ ID NO: 164542 - RNA, 64 nt, Human
ugagaagggaggauaaaaacuuucagaaugagcaaaacaccaucaacguuaauuccagagaugg

SEQ ID NO: 164543 - RNA, 64 nt, Human
uucaaaagcaauuuaagauauucauaguguuaggaaacaccaaaccugccuaugugccaucuca

SEQ ID NO: 164544 - RNA, 64 nt, Human
uucuacucugagcucuuguugccuagaccucagaaaacaccaauucaccacaguagaaccggga

SEQ ID NO: 164545 - RNA, 64 nt, Human
auuaauaaaguagcaagauccucaaaaaacccaaaaacaccauucucuaauagucaugacaaau

SEQ ID NO: 164546 - RNA, 64 nt, Human
caggucaugaggggccuaugccuuuacuccuuuuaaacaccagcacccgucuuuuccccaaccu

SEQ ID NO: 164547 - RNA, 64 nt, Human
aaaagccuuucuguugcaacuaugaaugaaaacaaaacaccacaaaacagacuucacuaacaca

SEQ ID NO: 164548 - RNA, 64 nt, Human
aauucuuacuucauuaugaauguauuuaaaaaacaaacaccaaauaauuggaauauauugcagg

SEQ ID NO: 164549 - RNA, 64 nt, Human
cguaacgugucagagaggaaggaucaccgaccugaaacaccaagcauuaagcaaaaaguuacuu

SEQ ID NO: 164550 - RNA, 64 nt, Human
agucuucuuuaaucaaucauauauugggcgggaaaaacaccagcuuugacccgaaguaguugaa

SEQ ID NO: 164551 - RNA, 64 nt, Human
cccuuuaguguacauuuauguuccuuuauuuaggaaacaccauuauaaaaacacuuauaguaaa

SEQ ID NO: 164552 - RNA, 64 nt, Human
cgucauggauaugcuuauacaagacuugauggacaaacaccaaucucucaaaggcagcagauug

SEQ ID NO: 164553 - RNA, 64 nt, Human; identical to SEQ ID NO: 84843

SEQ ID NO: 164554 - RNA, 64 nt, Human
acuaauauuuguuucaguauuuugucugaaaagaaaacaccacuaauuguguacauauguauua

SEQ ID NO: 164555 - RNA, 64 nt, Human
cacuuuacaaaauauuuccucaguacuuugcagaaaacaccaaacaaaaaugccauuuuaaaaa

SEQ ID NO: 164556 - RNA, 64 nt, Human
uuauauauuuuuaaauuucuguaccuuuauuguuaaacaccaaguuucacauacaagagguuuc

SEQ ID NO: 164557 - RNA, 64 nt, Human
gcaacauuaucuauguggacugcuuaaaucagcaaaacaccagaaguuugguuaacuugggcaa

SEQ ID NO: 164558 - RNA, 64 nt, Human
gucaugcccggagaucacccaggagaaauaauacaaacaccaccacuguccagagagaguaaag

SEQ ID NO: 164559 - RNA, 64 nt, Human
ggcgaggcggcugucugcgaccacagcagccucgaaacaccaggcagcagccuugcugggaguc

SEQ ID NO: 164560 - RNA, 64 nt, Human
cucaagggcaugucuuaacgaagaucagcaaagaaaacaccaggcacccucugccacuuagaca

SEQ ID NO: 164561 - RNA, 64 nt, Human
caaacacuuacugacaaaucggguccugaguugaaaacaccauuugucaaagaggccuuugaag

SEQ ID NO: 164562 - RNA, 64 nt, Human
gcuucacagaauuaucauuuuuucaacuggaauaaaacaccagguuuguuuguagaugucuuag

SEQ ID NO: 164563 - RNA, 64 nt, Human
auauuuuaucuuauucauucauuucauacucucaaaacaccaaacuucaaaaaguuaauuauug

SEQ ID NO: 164564 - RNA, 63 nt, Human
cccucgccccucccgggugaagcugugggcuguaaacaccagugccuugcucagccuccuggu

SEQ ID NO: 164565 - RNA, 64 nt, Human
augccuuacgugguaucacacuuagucuugaaaaaaacaccaaggugacguuuaaaauuuuuag

SEQ ID NO: 164566 - RNA, 64 nt, Human
ucaccaaaaccaacaugaaaguaccacugaaguaaaacaccaacuaccuaccuuacuauaaagg

SEQ ID NO: 164567 - RNA, 64 nt, Human
ggggagcaggaagcccagauauuuggaggaacagaaacaccagcugcucccucaccccccccca

SEQ ID NO: 164568 - RNA, 64 nt, Human
acuauuaguuaggaguugacuaacucaaccuguaaaacaccacuccuccuuccaaaguuguaua

SEQ ID NO: 164569 - RNA, 64 nt, Human
aacaaaauuauaaagcuguauuuggacaacuaaaaaacaccaaacuaucucauugcaauuugua

SEQ ID NO: 164570 - RNA, 64 nt, Human
acugacacagguggucuaaaaauuacuuuucuagaaacaccauucuggaaguuuggcugcccac

SEQ ID NO: 164571 - RNA, 64 nt, Human; identical to SEQ ID NO: 84869

SEQ ID NO: 164572 - RNA, 64 nt, Human
cacccagcccccacauccugugccuccaucagcuaaacaccacgucacuucaugcaggugaaac

SEQ ID NO: 164573 - RNA, 64 nt, Human
uaacuuuuuaccagcuguucuuggauuccaaacuaaacaccaagauacuuuucauuuuaaaaug

SEQ ID NO: 164574 - RNA, 64 nt, Human
uuaggccccuuuggagggagaaucaauaaauaacaaacaccaacuacaaacgccaguugguucc

SEQ ID NO: 164575 - RNA, 64 nt, Human
ucuuaucccuugcugcucagaaaaaguuuacggaaaacaccaguucacuaaaagcaccgaaauc

SEQ ID NO: 164576 - RNA, 64 nt, Human
aucuucagggaacugcauagauugaucaaaguguaaacaccauagggacccauucuacacagag

SEQ ID NO: 164577 - RNA, 56 nt, Human
gauggcgugggauguacugaaagcaaaaacaccaacauacaagucuugacaacagc

SEQ ID NO: 164578 - RNA, 64 nt, Human
cuucagaccgcuaguaaggcucaaagaagaagaaaaacaccaaaaccacaagggaaaagaaaaa

SEQ ID NO: 164579 - RNA, 64 nt, Human
caaaagucugaauuuuuuuuuaucaagagggauaaaacaccaugaaaauaaacuugaauaaacu

SEQ ID NO: 164580 - RNA, 64 nt, Human
uccuggcugccucccuuccucagcccauuagguuaaacaccaaagaaagacugguguguacuga

SEQ ID NO: 164581 - RNA, 64 nt, Human
ugaacgugcacucugacaaggggagcugucaaucaaacaccaaaccggggagacaagaugauug

SEQ ID NO: 164582 - RNA, 64 nt, Human
aagguaacauuguuuucucagguauaacacauagaaacaccaagauuuucagcaucugaaucaa

SEQ ID NO: 164583 - RNA, 64 nt, Human
gaccauggcugacuaccugcuguacacccucaacaaacaccagcgcuuugggugagugcaguga

SEQ ID NO: 164584 - RNA, 64 nt, Human
aaaucaaugcguacguuuccugagaagugucuaaaaacaccaaaaagggauccguacauucaau

SEQ ID NO: 164585 - RNA, 64 nt, Human
ucuaaaccugggacaggcuggggccaggaggcagaaacaccagccucugccaacaccggaacaa

SEQ ID NO: 164586 - RNA, 64 nt, Human
uaauauaaugcaguaggugauuaacaaugucuccaaacaccaaaggagguggcuaaagaguauu

SEQ ID NO: 164587 - RNA, 64 nt, Human
guuuguggauucuaaaauauauauauauuuauauaaacaccauauaagucaaauauguauuuaa

SEQ ID NO: 164588 - RNA, 64 nt, Human
uagauuacagaugggcauuuauuacuggcaguggaaacaccagauagaagaucuuaggagaggc

SEQ ID NO: 164589 - RNA, 64 nt, Human; identical to SEQ ID NO: 84845

SEQ ID NO: 164590 - RNA, 64 nt, Human
agggauggugacguauacuacagagacgcaaaugaaacaccaaacagucuugaauuacaagaaa

SEQ ID NO: 164591 - RNA, 64 nt, Human
cuacauugagacaguuacugugagaauaggacacaaacaccagcuauugccugcaucugggaaa

SEQ ID NO: 164592 - RNA, 64 nt, Human
ucuaauguucaguacaauaaauauaaggaagcuaaaacaccaauguggaauuccuguuuccaga

SEQ ID NO: 164593 - RNA, 52 nt, Human
cagucaccaaaauccagugaagaaacaccacccguccaguaccaccaaagua

SEQ ID NO: 164594 - RNA, 64 nt, Human
ggauuucauaaaggcuaauugcauaagaaagaguaaacaccacaggcuugagguuuuuggcugu

SEQ ID NO: 164595 - RNA, 64 nt, Human
cauacucuagcaauucauuggaacaccaaggcaaaaacaccaaccugcuaaaagagaucuuuuc

SEQ ID NO: 164596 - RNA, 64 nt, Human
cgcucagcaacaccaaaaagagaaagucugguuaaaacaccaugagucaaaugucgggccagcc

SEQ ID NO: 164597 - RNA, 64 nt, Human
uuacaaagcagaauuaaaauuauauuguagaaggaaacaccaagaaaagaauuuccagggaaaa

SEQ ID NO: 164598 - RNA, 64 nt, Human
aaauuauuuuuuauuccuuuuucuacugugucuuaaacaccaauuccugauaguccaaggaacc

SEQ ID NO: 164599 - RNA, 64 nt, Human
caggaacugccuccucccugcucuacagcuaagaaaacaccauuccaugacuucccaccgcgcc

SEQ ID NO: 164600 - RNA, 64 nt, Human
aaguacauggaaaccagaaaugcaacaguuacuaaaacaccauuuaauaguuauaacgucguua

SEQ ID NO: 164601 - RNA, 64 nt, Human
uuuggaugaugaaguuuaaagagucaauaaauagaaacaccagaugacugcauugguggccaca

SEQ ID NO: 164602 - RNA, 64 nt, Human
gacccugccuuuaaaaacaaacagaacaaaaacaaaacaccagggacacauuucucugucuuuu

SEQ ID NO: 164603 - RNA, 64 nt, Human
gggcuucuggggacagccauuuggcuggggugccaaacaccagaaggggagauaauaguuuuga

SEQ ID NO: 164604 - RNA, 64 nt, Human
ccacaaaugguaagggaugcccaccuacuuuuauaaacaccacugcaacuuaacaaguuuauuu

SEQ ID NO: 164605 - RNA, 64 nt, Human
ggguggccuggguggagacaagcucagucuaaucaaacaccagaacccuaucaagucaaaagag

SEQ ID NO: 164606 - RNA, 64 nt, Human
gggaggagaggggauagucuacagcuaaugagggaaacaccaaagaucacaucauuaaaaugau

SEQ ID NO: 164607 - RNA, 64 nt, Human; identical to SEQ ID NO: 84846

SEQ ID NO: 164608 - RNA, 64 nt, Human
uuuacaggugauagguaccuaaugucuccuacagaaacaccaucugauucagaucacaagaaga

SEQ ID NO: 164609 - RNA, 64 nt, Human
cccuaacuuuacuucccaaauggugcuuuuuaaaaaacaccaucacuacauuaggggcaauuuu

SEQ ID NO: 164610 - RNA, 64 nt, Human
aaguagcuuugggcauaggcugcccaaucugagcaaacaccagugaggcucuauugagccaaga

SEQ ID NO: 164611 - RNA, 64 nt, Human
aaguccaaggucacgaagacuuucuuggagcccgaaacaccacccucugcuccuccuucuccug

SEQ ID NO: 164612 - RNA, 64 nt, Human
agaaugcuuuaauccuuucuuuagaaugcuguuuaaacaccauuuacccuacuuaucccucaau

SEQ ID NO: 164613 - RNA, 64 nt, Human
cagauuuggggaaaugacauuuuuauacuaaaacaaacaccaaaauauuuuagaauaaauucuu

SEQ ID NO: 164614 - RNA, 64 nt, Human
gggagcaagcauuugauaauucauccuuuaagaaaaacaccaccguacacugcuugaagaguuc

SEQ ID NO: 164615 - RNA, 64 nt, Human
ccagggcuagaaguugaaacucacuaguaauguuaaacaccauuuuuuuuuucuuuuuggggag

SEQ ID NO: 164616 - RNA, 64 nt, Human
augaaucuauguuauuggacuaauuugcuucaagaaacaccagaauuuugaaaaucccgaauuu

SEQ ID NO: 164617 - RNA, 64 nt, Human
gacuuuaaauuaaacauuugguagagucaucauaaaacaccagaccacuuagacucaggcugaa

SEQ ID NO: 164618 - RNA, 64 nt, Human
aaauugagucuuaaauuuaaaugggaagggaagaaaacaccaaauaagaaaaaaauuugccuuu

SEQ ID NO: 164619 - RNA, 64 nt, Human
gcuccgucauggcacuuuuuaacgcuucagcaacaaacaccaggcagcuguugccacuggccuc

SEQ ID NO: 164620 - RNA, 64 nt, Human
acaaugaagacaaaaguuuaaaacuuucuaauacaaacaccauuuugggaaaugcuugauuuuu

SEQ ID NO: 164621 - RNA, 64 nt, Human
aguguuguucccucccucaaggcugggaggagauaaacaccaacccaggaauucucaauaaauu

SEQ ID NO: 164622 - RNA, 64 nt, Human
aauaaaauacaacuguucaauggaaauagaaaauaaacaccauaaaagagagaagagagguaau

SEQ ID NO: 164623 - RNA, 64 nt, Human
gcaugagccggaagaucuggcgaagcucaggcaaaaacaccaccaaucacguggaaguuaauuu

SEQ ID NO: 164624 - RNA, 64 nt, Human
cacuccagucaucauuuuccuaucucaccccccgaaacaccacccuaaaguuggauuuuuacau

SEQ ID NO: 164625 - RNA, 64 nt, Human
acuguuucuguuucuguaagguacaugaauggucaaacaccagucuagagcaucuuauugucaa

SEQ ID NO: 164626 - RNA, 64 nt, Human
guuccaucuccaauccaggcagugaggaauccugaaacaccaggagaggcgucagaaguaggaa

SEQ ID NO: 164627 - RNA, 64 nt, Human
aaaaauguuauaaugaaaauguaguaauuuaagaaaacaccagaugaguuaggaauaaaccuau

SEQ ID NO: 164628 - RNA, 64 nt, Human
gaaacgaaaaaagaaauuaauuaaggaauuucaaaaacaccauccagaagcuuugaauuaacau

SEQ ID NO: 164629 - RNA, 64 nt, Human
gaauauuguuuuaugagaggccuggcaauggguaaaacaccaaacuugaaaucagaacauaggu

SEQ ID NO: 164630 - RNA, 64 nt, Human
ggagccaaagaugacacaaggggaaggguacugaaaacaccauccauuugggaaagaaggcaaa

SEQ ID NO: 164631 - RNA, 64 nt, Human
auguuucguaaauauuuuauacuguuuaaguguuaaacaccaacccugucuuucuuuuggguug

SEQ ID NO: 164632 - RNA, 64 nt, Human
cagaaaaaccaacuccucaucuugaucugcaggaaaacaccaaacacacuauggaacucugcug

SEQ ID NO: 164633 - RNA, 64 nt, Human
uccuaguggaccugaugugaaauuccugucaaacaaacaccacuuuucaaugguuugcuaggag

SEQ ID NO: 164634 - RNA, 64 nt, Human
acauugaugacuuuuuuuuuuucuuuuaaugaagaaacaccaaagaaagcuguggaaaggaccu

SEQ ID NO: 164635 - RNA, 64 nt, Human
caucuuugucagagaagacuggcgucagcagccaaaacaccaggaaacacauuucuguggccuu

SEQ ID NO: 164636 - RNA, 64 nt, Human
guaaaauugaaaucaggcauuuaacauacuaugaaaacaccaggagucaaugauuaaugaaagg

SEQ ID NO: 164637 - RNA, 64 nt, Human
guugcuguuagagccucacguggaggagucacuuaaacaccaguuuuuuacugcuuaauuccuu

SEQ ID NO: 164638 - RNA, 64 nt, Human
aggauaaaaagcccugaagugcucaucacgaaugaaacaccaaaaccagagacuaucaucauac

SEQ ID NO: 164639 - RNA, 64 nt, Human
uugcucuuucugcagcauagcuugucaauaauggaaacaccaaaaacuguauuauuugcaacua

SEQ ID NO: 164640 - RNA, 64 nt, Human
gaugaucaacugaacacguuucuauucaaggagaaaacaccauucaguaagaagauggaguaga

SEQ ID NO: 164641 - RNA, 64 nt, Human
caagcaaacagcagaauucaacuuuuuaaacaauaaacaccaucaaccuuauugacuuuauugu

SEQ ID NO: 164642 - RNA, 64 nt, Human; identical to SEQ ID NO: 84870

SEQ ID NO: 164643 - RNA, 64 nt, Human
aagaauaaaaaguagcaguaaaauuauauacugaaaacaccaaaaauuuagaugccuuaauagu

SEQ ID NO: 164644 - RNA, 64 nt, Human
cagugaagaaguuucagugaacuuucaaaaccauaaacaccauuaucuaacuucaugaaccaga

SEQ ID NO: 164645 - RNA, 64 nt, Human
ugcugcuauaaauuuuguucuuguugcugccaguaaacaccaacuguucaagugaaauaguaaa

SEQ ID NO: 164646 - RNA, 64 nt, Human
uauugggaauggauuguggcugaacagcaaaucaaaacaccagaaauauuuuuauauguuaacg

SEQ ID NO: 164647 - RNA, 64 nt, Human
guggcaggaggugcaaagacagaaguauugagagaaacaccaagacucuaguggaggaauuaau

SEQ ID NO: 164648 - RNA, 64 nt, Human
ucuggugaccaggcugcuucauucaacacuguguaaacaccaaagccuuaacuuagcaaacagu

SEQ ID NO: 164649 - RNA, 64 nt, Human
acuaauacagugggucaaauauuauaaaauaggcaaacaccaaaaugguauuaaauauugaacu

SEQ ID NO: 164650 - RNA, 64 nt, Human
ggaggaguggaaaucuucaaugaagacuuggcccaaacaccaccugugauguauauuguucuaa

SEQ ID NO: 164651 - RNA, 64 nt, Human
ccuugagacauacaggucuuuuaaaauacaguagaaacaccacuguuuacgauuauacgaugga

SEQ ID NO: 164652 - RNA, 64 nt, Human
gcuauaguuguuacauagucuuacacuucaagcuaaacaccaaaugggugauauuuugaaaaaa

SEQ ID NO: 164653 - RNA, 64 nt, Human
cauucucaguaaacuaucgcaaggacaaaaaaccaaacaccacauguucucacucauagauagg

SEQ ID NO: 164654 - RNA, 64 nt, Human
cuuacuugcguguuuuguuuuugguuucauuuuaaaacaccaauaucuaauaccacagugggaa

SEQ ID NO: 164655 - RNA, 64 nt, Human
cuguauaggaaccaacaugaacaauuuuaauugaaaacaccagucauaaacuauuaccaccccc

SEQ ID NO: 164656 - RNA, 64 nt, Human
aacaacaaaaaaagaaaaaaguuaaaaaagaaaaaaacaccaaaaaacaaaaacaaacaaaaaa

SEQ ID NO: 164657 - RNA, 64 nt, Human
uuuccuauuaagcuuuaaaauaaaucauuguguaaaacaccaucauuucauuauuuuuuaauga

SEQ ID NO: 164658 - RNA, 64 nt, Human
cuuuuucaguugaaaaauaaauaaauaaauaaauaaacaccacacccagcuaauuuuuguauuu

SEQ ID NO: 164659 - RNA, 64 nt, Human
ucaccagccuacugcagaagugcagggcaccaguaaacaccauguauuauugaagaugaaucug

SEQ ID NO: 164660 - RNA, 64 nt, Human; identical to SEQ ID NO: 84848

SEQ ID NO: 164661 - RNA, 64 nt, Human
ggcugcuaugacaauuugcacagcccaguggcuuaaacaccauuuauaccacagguccagauga

SEQ ID NO: 164662 - RNA, 64 nt, Human
cacacacacguuaucccaugauguuccacugagaaaacaccaaaaaauuuugaaaaagaagaua

SEQ ID NO: 164663 - RNA, 64 nt, Human
aaagugaucaaaagcauucuagccaugugcaaccaaacaccaccaaaaauaaaaucaaacaaaa

SEQ ID NO: 164664 - RNA, 64 nt, Human
gccuuugaacaccacgcuguagucuccaacagaaaaacaccaccaaaacagauacccauguuga

SEQ ID NO: 164665 - RNA, 64 nt, Human
gaaagccagugugguaaacuagagagagcagcaaaaacaccagucuugccugagucuuucucca

SEQ ID NO: 164666 - RNA, 64 nt, Human
agggucccuuugucagccccgaguucagcuucccaaacaccaguguuggauauucugugauuga

SEQ ID NO: 164667 - RNA, 64 nt, Human
cacuaagggcucuauguuugugucaugccucuucaaacaccaaggaguugaacaugcuuccagu

SEQ ID NO: 164668 - RNA, 64 nt, Human
aaauagaaaacuacauuuuggcaggaauaauugaaaacaccagaagguugaaguuuaauuggaa

SEQ ID NO: 164669 - RNA, 64 nt, Human
guuaaaaaaacaaaaaaaacacaaaaauuucaaaaaacaccacccaccaaauugcacaauagau

SEQ ID NO: 164670 - RNA, 64 nt, Human
uuguggucuugaucauaccuauuaaaauaaugccaaacaccaaauaugaauuuuaugauguaca

SEQ ID NO: 164671 - RNA, 60 nt, Human
aggcacaggaggaucucuaaagcaguagccaaacaccacuuuguaaaaggacucuuccau

SEQ ID NO: 164672 - RNA, 64 nt, Human
ucagaguugaaguuggugaagacauucaugauuuaaacaccagauccugaaagggguuaaaucu

SEQ ID NO: 164673 - RNA, 64 nt, Human
gggagugccauagcaccuagcaggcagaagccagaaacaccaaaugucuuaacaaugcuugagg

SEQ ID NO: 164674 - RNA, 64 nt, Human
gaaggauccuggucccuguacgaccucauugaagaaacaccauaaguggcguggacuaucuacc

SEQ ID NO: 164675 - RNA, 64 nt, Human
cuagauucuauggaucaaacagagguugaugcaaaaacaccacuguuaagguguaaagugaaau

SEQ ID NO: 164676 - RNA, 64 nt, Human
guaaauauauguauaccuaagagaaugucaaaauaaacaccaaaccaaaagaagguaggagugc

SEQ ID NO: 164677 - RNA, 64 nt, Human
gaaaugcagcacagcuuucaagauacuauuuuaaaaacaccaugaaucagauagggaaagaaag

SEQ ID NO: 164678 - RNA, 64 nt, Human; identical to SEQ ID NO: 84849

SEQ ID NO: 164679 - RNA, 64 nt, Human
ucuaaaggaaaucaaaugaauggaggaacuuuccaaacaccacuuuacuuguguuauauagcca

SEQ ID NO: 164680 - RNA, 64 nt, Human
ggcggcgacuuggcaagacaaaugaugagcaggaaaacaccacuggaucucacaccuucaaucc

SEQ ID NO: 164681 - RNA, 64 nt, Human
aaugugacaguagcaaaaccacuuucuacuuuccaaacaccacagcaucagcaugguuuagggg

SEQ ID NO: 164682 - RNA, 64 nt, Human
aaucauuguuuuuauuuuacaaaggcagaaaaugaaacaccacuagguaaaagaauuaaaaauc

SEQ ID NO: 164683 - RNA, 64 nt, Human
ccugggucacuggaggaccaaccccugcuguccaaaacaccacugcuuccuacccagguggcga

SEQ ID NO: 164684 - RNA, 64 nt, Human
uguggccuugugauaaaaugugggaaaucacagaaaacaccagaaacaacaacugccagcccgg

SEQ ID NO: 164685 - RNA, 64 nt, Human
gaacacgcugcccgcacugcccagagagcagugcaaacaccacaacacgagcguguuucuugag

SEQ ID NO: 164686 - RNA, 64 nt, Human
aaaauucccuuuaugcacccaagagauauuuauuaaacaccaauuacguagcaggccauggcuc

SEQ ID NO: 164687 - RNA, 64 nt, Human
acaucuguaaacgguuucaaacagguagagagaaaaacaccacaauuaacacuguuacuuuuug

SEQ ID NO: 164688 - RNA, 64 nt, Human
cagauaguucuacuggacaauguuacgcuagaauaaacaccaaggcagucaguuaaggcagcua

SEQ ID NO: 164689 - RNA, 64 nt, Human
uggcugugggacagacagggaggggccuguacagaaacaccacacuguuuauuaaaucacaaug

SEQ ID NO: 164690 - RNA, 64 nt, Human
ccugggucacuggagagccagccccuccuguucaaaacaccacugcuuccuacccagguggcga

SEQ ID NO: 164691 - RNA, 64 nt, Human
cacccccagcuggaaauuaagaaaaagucgcccgaaacaccaagugaggccauagcaauucccc

SEQ ID NO: 164692 - RNA, 64 nt, Human
cccauagcaucaacucaguucagcucaaagcuagaaacaccaaggucuuugaaaauguuuauug

SEQ ID NO: 164693 - RNA, 64 nt, Human
uuuuauuuuucuuugacucgugugaguucaaaguaaacaccaccaccguggacaacucuugaau

SEQ ID NO: 164694 - RNA, 64 nt, Human
gcuuguaagaagaugcagcuugaugcagcuccucaaacaccaggcccccugggaacugggggug

SEQ ID NO: 164695 - RNA, 64 nt, Human
cauccuuuucuucugccucgccugaaucccccauaaacaccagaugauugagucuaccuucuuu

SEQ ID NO: 164696 - RNA, 64 nt, Human
ucccuuuuucuucugccucacuugaaucccccguaaacaccagacgauugagucuaccuucuuu

SEQ ID NO: 164697 - RNA, 64 nt, Human
accauuuggcaucaaguuaacaucacacaauaggaaacaccacuuccacaagucucaagccuca

SEQ ID NO: 164698 - RNA, 64 nt, Human
ucacacuuguaucuucagcagggacauuacaaucaaacaccaauuccugguuaaugaagggaga

SEQ ID NO: 164699 - RNA, 64 nt, Human
cuuuggucccucucugggggcaugaaugguuaacaaacaccagagcaguacuccaauauuggag

SEQ ID NO: 164700 - RNA, 64 nt, Human
ucugacauacaacugaggucaugacaaggaaaaaaaacaccacauuuaucuaagaagugauuuu

SEQ ID NO: 164701 - RNA, 64 nt, Human
gagaaugggggaggaggcggucaggcugcugaggaaacaccacaggcugaacgggggaggaaug

SEQ ID NO: 164702 - RNA, 64 nt, Human
cuuuguuacucuauuuauuuuagucacuuguauaaaacaccaaauaaagcaauagaggcaaacu

SEQ ID NO: 164703 - RNA, 64 nt, Human
ccccccuuucuugaccuccuccuccuucaagcucaaacaccaccucccuuauucaggaccggca

SEQ ID NO: 164704 - RNA, 64 nt, Human
cccugcucccccuuucccauaauucaugacaucaaaacaccagcuuuucaccuuuuccuugaga

SEQ ID NO: 164705 - RNA, 62 nt, Human
aaacaagcaaaaaacacaaaaaccucagagaccaaaacaccaaacaaacaaaaaaacaaaaa

SEQ ID NO: 164706 - RNA, 64 nt, Human
aacauuucucuacuucaagaccaccucucccugcaaacaccacacacacauggcaugcauguac

SEQ ID NO: 164707 - RNA, 64 nt, Human
ccaguaugcaaacacaccacggucugcccugcaaaaacaccaauggggucuagugcagguggac

SEQ ID NO: 164708 - RNA, 64 nt, Human
aguuuaauguccguuguaucacaaaucaguguuaaaacaccagaacuuuagccaaaauaaaugu

SEQ ID NO: 164709 - RNA, 64 nt, Human
uuucccccuuuugaauuaccaccaagaaguguugaaacaccaaauagauaucauguuauuuugg

SEQ ID NO: 164710 - RNA, 64 nt, Human
uucaccccuccucucacugccugccagaaaacaaaaacaccaagaaaccaagucaacuuuucac

SEQ ID NO: 164711 - RNA, 64 nt, Human
accauuaaccucuucccccaacuaacaccaaugaaaacaccauuccacgugacugggcugugug

SEQ ID NO: 164712 - RNA, 64 nt, Human
caaggugagaaaucacaaugagaaaaauaaauggaaacaccacugcuaggggagagcucuccuu

SEQ ID NO: 164713 - RNA, 64 nt, Human; identical to SEQ ID NO: 84876

SEQ ID NO: 164714 - RNA, 64 nt, Human
auguuguuaguuuugaaagacauucacucaaggaaaacaccaucucaacuuugcccgcucacca

SEQ ID NO: 164715 - RNA, 64 nt, Human
caucccacugggaaaacgucucagguggccucugaaacaccacuccuuuuugugugugugcacg

SEQ ID NO: 164716 - RNA, 64 nt, Human
caggacauaggcaugggcaaggacuucaugucuaaaacaccaaaagcaauggcaacaaaagcca

SEQ ID NO: 164717 - RNA, 64 nt, Human
ugaaaaagacgucaauaucugcucacaucuuacuaaacaccagagaguucaugcuuaauaaaag

SEQ ID NO: 164718 - RNA, 64 nt, Human
ugggaaaacaaauuuucaaaaacuacagcuuagaaaacaccagaguuuauacgaaaauauauuu

SEQ ID NO: 164719 - RNA, 64 nt, Human
uggaaaaacauuuuuucaaaaacuacaaauuauaaaacaccaaaguguucauacuaaaauauau

SEQ ID NO: 164720 - RNA, 64 nt, Human
ucuucaacacuccccugcguaccccgguucuagcaaacaccaauugauugacugagaaucugau

SEQ ID NO: 164721 - RNA, 64 nt, Human
caaccuuucagacgacaaggacaagaugagcagcaaacaccagcuccucagcuucgugucccug

SEQ ID NO: 164722 - RNA, 63 nt, Human
gaugcugugagcauuaaauaaagguacacauggaaaacaccaguccuggugcagugagaguuc

SEQ ID NO: 164723 - RNA, 64 nt, Human
caucaaauuuggacaccaggucacggagaaacacaaacaccacccaggaacacgcagacauaug

SEQ ID NO: 164724 - RNA, 64 nt, Human
ggggagcaggaagcccagauaaucagagggacagaaacaccagcugcucccccucauccccuuc

SEQ ID NO: 164725 - RNA, 64 nt, Human
uggaaaaauacuuuuucaaaaacuacagcuuagaaaacaccagagaguucauacuaaaacauau

SEQ ID NO: 164726 - RNA, 64 nt, Human
gaccgagugaccuccucucucccccgaguguaauaaacaccagauuccaugcgugaguuuucug

SEQ ID NO: 164727 - RNA, 64 nt, Human
caucuugugacaagagcuacccagggcgccugacaaacaccauggugugugcaggcgcggaggg

SEQ ID NO: 164728 - RNA, 64 nt, Human
guggaggacauuucugugagaagucaaaccuguuaaacaccauugaaaucauguuggguagaaa

SEQ ID NO: 164729 - RNA, 64 nt, Human
acauccugcaaugcaugggacaggcccugccuagaaacaccagcucagcauggcagcagugcgg

SEQ ID NO: 164730 - RNA, 64 nt, Human
cuccauacuccucccaccacaacacucaucugucaaacaccaagcacucucagccuccccgccu

SEQ ID NO: 164731 - RNA, 64 nt, Human
aguaauaaauuaguuaaaacugcaaauagaaagaaaacaccaaaaauaaagaaaagagcaaaag

SEQ ID NO: 164732 - RNA, 64 nt, Human
aauaagaauuugggaaccugaauagcucugcaaaaaacaccaaaggaccguuuuaucguuuucu

SEQ ID NO: 164733 - RNA, 64 nt, Human
acccccgccucuucagcaagaccacagccaugacaaacaccaggaugcaugcuccuuguccccu

SEQ ID NO: 164734 - RNA, 64 nt, Human
ugauaaacuaagucacauacagauaaagcacugaaaacaccacagugacccucccaccccccac

SEQ ID NO: 164735 - RNA, 64 nt, Human
cccugcugccuucagccuucccugggcccugaauaaacaccacagccaguuuccuucucauucu

SEQ ID NO: 164736 - RNA, 64 nt, Human
uuucagcucacugugaagccagacuccccaacugaaacaccagaagguuuggagugacagcucc

SEQ ID NO: 164737 - RNA, 64 nt, Human
ggaaacaaggaggaaaguuagccacugaaggccaaaacaccaugugggguggacagaggguuug

SEQ ID NO: 164738 - RNA, 64 nt, Human
cuauacaaaaugacugcuauggugggaacacaauaaacaccaguuuugacuuuuagugcauagu

SEQ ID NO: 164739 - RNA, 64 nt, Human
guuauucaacagcaagugugaauacugcuugaauaaacaccacuggauuaauggccuguagugu

SEQ ID NO: 164740 - RNA, 64 nt, Human
gauuuaggcaggguagcuugggauaccuuuuuaaaaacaccagauauuaaaaugucuggcaagg

SEQ ID NO: 164741 - RNA, 64 nt, Human
agccucuucaggaccaacuggagggagaguuaggaaacaccagcuccugccuggggcagugagg

SEQ ID NO: 164742 - RNA, 64 nt, Human
ggugaaaggguuaaaaugaguaaagcaguugagcaaacaccaacccgagcuucgggcgcagaau

SEQ ID NO: 164743 - RNA, 64 nt, Human
ggaauaaaaucaagacgugcaagaguggaagaagaaacaccaguuagaaguuuguuugcgauaa

SEQ ID NO: 164744 - RNA, 64 nt, Human
aguacuguaaggaagagggaccuccagcuuccacaaacaccaucuucagcuguaugaaagggac

SEQ ID NO: 164745 - RNA, 64 nt, Human
uccuagugggagaacccccuccuaguccaccugaaaacaccaaauucaaccaucaucugucaag

SEQ ID NO: 164746 - RNA, 64 nt, Human
ggaaagcuuuucuuuuucuuuuuuuuuuuuuuuuaaacaccaagagcacguauagcauggggga

SEQ ID NO: 164747 - RNA, 64 nt, Human
aauaagucauuguaagugcacugauaucuucacaaaacaccacuauuugauguguacagaguug

SEQ ID NO: 164748 - RNA, 64 nt, Human; identical to SEQ ID NO: 84851

SEQ ID NO: 164749 - RNA, 64 nt, Human
ucguauuaccaagaaagaaaauguuaucgauacuaaacaccaucaguucagagggaggaugugu

SEQ ID NO: 164750 - RNA, 64 nt, Human
gucuccauccaauggccuuuucugaaguuacagaaaacaccaacaugggagggaguuuaugaag

SEQ ID NO: 164751 - RNA, 64 nt, Human
uccggagggcagaccaggugccuugccgcagagaaaacaccaaagucuccuguucgcucauaaa

SEQ ID NO: 164752 - RNA, 64 nt, Human
guuuuguuuuuauauauauaaaaaaaaaaagugaaaacaccaaugugugaaaugccuuacaaug

SEQ ID NO: 164753 - RNA, 64 nt, Human
acacagacuggagaaaaccccucccacggugcccaaacaccagucaccucgucucccuggugcc

SEQ ID NO: 164754 - RNA, 64 nt, Human
uuucuacuuauccaguaaauaacaaugacaaaauaaacaccaaugacagaaaaauuucuacuuu

SEQ ID NO: 164755 - RNA, 64 nt, Human
gugagcuaccgcgccuggccaugaugauauuauuaaacaccauuauucacauuucaaauaauaa

SEQ ID NO: 164756 - RNA, 64 nt, Human
ugagcuggccaugcacuuugaccgccuugugcgaaaacaccaccuggggcgcguccugcgccgg

SEQ ID NO: 164757 - RNA, 64 nt, Human
ggaagaguagaauaucauauagggaagaaaccuuaaacaccacaguguuccauguuccagucac

SEQ ID NO: 164758 - RNA, 64 nt, Human
aucucuuuagaauuacacagcuaaaaaggaaaaaaaacaccaaaauaagauaaaauaaaacaaa

SEQ ID NO: 164759 - RNA, 64 nt, Human
aaaacaccaaaauaagauaaaauaaaacaaauuuaaacaccaaaauaagauauaauaaaacauu

SEQ ID NO: 164760 - RNA, 64 nt, Human
gaauguuuuaacagcaagaauuuuaagaaaagauaaacaccauuuuauuuauuuauaaaaacaa

SEQ ID NO: 164761 - RNA, 64 nt, Human
guuugcuuugaagaaaaagcaaaaacaagaacaaaaacaccaaaucauuugaaaucacugucca

SEQ ID NO: 164762 - RNA, 64 nt, Human
ucucagaagccaaaauacacaacuuuuagcacauaaacaccaacgauggccucuuuuugaggag

SEQ ID NO: 164763 - RNA, 64 nt, Human
ugauguuucauauuuaaguguauuuaaagaaaauaaacaccauuauucaagccauauaauuuua

SEQ ID NO: 164764 - RNA, 64 nt, Human
cuucacccggcggcgccuuggggcaggugccgagcgggcgcacuacgcccgggccccaaggccc

SEQ ID NO: 164765 - RNA, 64 nt, Human
aacuccaucucuacuaaaaauacaaaaaauuggccgggcgcagcggcucacgccuguaauccca

SEQ ID NO: 164766 - RNA, 64 nt, Human
cacagacuccauggauaauagguaaacuuggggccgggcgcaguggcucacgccuguaauccca

SEQ ID NO: 164767 - RNA, 64 nt, Human
agacugguugccucugggcaucgcaaacugcccccgggcgcaucuggcuuaucuggagaccugg

SEQ ID NO: 164768 - RNA, 64 nt, Human
ugaaaacuucuuuaaaaaucucuuguauuucauccgggcgcaguggcucacaccuguaauccca

SEQ ID NO: 164769 - RNA, 64 nt, Human
ugucuccuggcgguuccucguucucccugggaggcgggcgcacugccucucacagcugaguugu

SEQ ID NO: 164770 - RNA, 55 nt, Human
ccgggacccucguguccuaaaccaccgggcgcaccaucuuuccuucaugcuaccc

SEQ ID NO: 164771 - RNA, 64 nt, Human
acauaauguuagguuauaauuucucauuuggagccgggcgcaguggcucacgccuguaauccca

SEQ ID NO: 164772 - RNA, 64 nt, Human
ccuuuuccgagggugugggugggaguggauccuccgggcgcaggugccaggcaggugcaggcgg

SEQ ID NO: 164773 - RNA, 64 nt, Human
uugaauguagcagccccgggagggcggcacaggucgggcgcaggauucagccggagggaaggga

SEQ ID NO: 164774 - RNA, 64 nt, Human
aggcagcccuauugagaaaucuaccugucguggccgggcgcaguggcucacgccuguaauccca

SEQ ID NO: 164775 - RNA, 64 nt, Human
gccacugcgugcacucaccuggccgccgggccagcgggcgcagggcacaccuggccaggcuugg

SEQ ID NO: 164776 - RNA, 64 nt, Human
gccccauuccagcucucccauggagccccuccaccgggcgcaugccucccaggccaccucaguc

SEQ ID NO: 164777 - RNA, 64 nt, Human
gacauaccaauuuuaggauugaaauaguucaggccgggcgcaguggcucaugccuguaauccca

SEQ ID NO: 164778 - RNA, 64 nt, Human
gcggcugacacacacguucaagcccaggacugcccgggcgcaggauccaggcgcugcccgugcg

SEQ ID NO: 164779 - RNA, 64 nt, Human
gcggcugcccccaugaccuagugcuaggcguggacgggcgcaccugcauggagggguccccaga

SEQ ID NO: 164780 - RNA, 64 nt, Human
gacucucgacauccgaguccaagcgcaggccccucgggcgcaggcagcucacaccaggaagaga

SEQ ID NO: 164781 - RNA, 64 nt, Human
caucgacgcgcucaacuucuucugugagcagcugcgggcgcagcagcggaguucgcuccaggag

SEQ ID NO: 164782 - RNA, 64 nt, Human
gccggucucagucuuuaauccuggcagggauucacgggcgcacacacacacacucaggauucag

SEQ ID NO: 164783 - RNA, 64 nt, Human
cuugcggcacuuucuggaccgcgugcuggaggggcgggcgcagccacagcugucggagcgcaug

SEQ ID NO: 164784 - RNA, 64 nt, Human
ucuaagguacauuuuuaaagaguuguuuuuuggccgggcgcaguggcucaugccuguaauccca

SEQ ID NO: 164785 - RNA, 64 nt, Human
aaguauaagacuuuaaaauaauacaaaacagggccgggcgcaguggcucacaccuguaauccca

SEQ ID NO: 164786 - RNA, 64 nt, Human
ugaaaggauaaaaaaaaaaaaaaacaacuaauaccgggcgcagcaucuuuccagguguggcucu

SEQ ID NO: 164787 - RNA, 64 nt, Human
uucaaaacgaagacuagcuauuaaaauuucaugccgggcgcaguggcucacgccuguaauccca

SEQ ID NO: 164788 - RNA, 64 nt, Human
cuuuaauuuuuaguaaaaccuggaggugaugggccgggcgcaguggcucacgccuguaauccca

SEQ ID NO: 164789 - RNA, 64 nt, Human
cccagcccaggccagaagaccucccuucaggugccgggcgcaggaacuguguguguccuacaca

SEQ ID NO: 164790 - RNA, 64 nt, Human
cgguccagcgcggcccugcccaggaggcggcagccgggcgcacccucgccagcccugcuggagu

SEQ ID NO: 164791 - RNA, 64 nt, Human
aucgcaucccuuggaauuagaaagcaguggagaccgggcgcagugacucacaccugugaucggc

SEQ ID NO: 164792 - RNA, 64 nt, Human
aacccugucuccacaaaauuuaaaaauuagcggccgggcgcaguggcucacgccuguaauccca

SEQ ID NO: 164793 - RNA, 64 nt, Human
uuaguuuauguuuccaugccagaguuugugugggcgggcgcaugugcaccacagagugcacucg

SEQ ID NO: 164794 - RNA, 64 nt, Human
uuccccggggcccccccagccugcaagacaggcccgggcgcaggaccgcuggaggacgcagcgu

SEQ ID NO: 164795 - RNA, 64 nt, Human
cagcacuuugucuuaagaaaacaaggaaggaggccgggcgcaguggcucacgccuguaauccca

SEQ ID NO: 164796 - RNA, 64 nt, Human
cuuaugugcuuuccuacaaaauggaauuggaggccgggcgcaguggcucacgccuguaauccca

SEQ ID NO: 164797 - RNA, 64 nt, Human
cagaacugcccaucgggacgcccggccagccgcucgggcgcagcacaagggacaggggaccaag

SEQ ID NO: 164798 - RNA, 64 nt, Human
uaacuagcugaccacagacuccacaguggggggacgggcgcaguauguggcauggcggcaguua

SEQ ID NO: 164799 - RNA, 64 nt, Human
uccagagccuugccauaaaaaggcugaaggcagccgggcgcaguggcucacgccuguaauccca

SEQ ID NO: 164800 - RNA, 64 nt, Human
aaaaugaagagugaaagauaaaguagucaauggccgggcgcagugagauugcgccauugcauuc

SEQ ID NO: 164801 - RNA, 64 nt, Human
ucgaguggggacacuuuaacuacaguuuacaccucgggcgcauaaaguuuuucuucucuuucuc

SEQ ID NO: 164802 - RNA, 57 nt, Human
agccgcauuccaagaaguagucugucgcgggcgcagggacccaacccggugucgcug

SEQ ID NO: 164803 - RNA, 64 nt, Human
gucacgggcagcggcuccccggaccccgcgggcucgggcgcaacuucguggcguccugcacggc

SEQ ID NO: 164804 - RNA, 64 nt, Human
ccuggccccgggcaaccagccagagaaggagggccgggcgcaccagugccuggagugugaccgc

SEQ ID NO: 164805 - RNA, 64 nt, Human
cacgcagaagagcaacaugaagcugcacaugaagcgggcgcacagcuaugcuggugagaaugcu

SEQ ID NO: 164806 - RNA, 64 nt, Human
gcccugcagggccgggcagggggacagcagggaccgggcgcagcccuccccccucggccgcccg

SEQ ID NO: 164807 - RNA, 64 nt, Human
cauacaugguucagaaaauucacagcaggagggccgggcgcaguggcucacgccuguaauccca

SEQ ID NO: 164808 - RNA, 64 nt, Human
ggugcucaccacgcagaggggcacgggccagccucgggcgcagagggaggagugaccuuucuuu

SEQ ID NO: 164809 - RNA, 64 nt, Human
gauggguauguguuuaaaacaugcacggugaggccgggcgcaguggcucacgccuguaauccca

SEQ ID NO: 164810 - RNA, 64 nt, Human
gucaggcaccggcuggggaucuguggggcagcggcgggcgcaggcucgacccgggccaggaggc

SEQ ID NO: 164811 - RNA, 64 nt, Human
agccgcuggggcccggggguguggggcgguguggcgggcgcacacuguauguaccuauaauaaa

SEQ ID NO: 164812 - RNA, 64 nt, Human
ccugggaccccugaggggcaggccaggaggagcucgggcgcaggccaggcccccuuggugaagc

SEQ ID NO: 164813 - RNA, 64 nt, Human
uuguggcuugguuucucuggaaaugucaccuuuucgggcgcagccaucuugccggcaccgcccc

SEQ ID NO: 164814 - RNA, 64 nt, Human
acuaggacugcccccggacccugcgaugaugacccgggcgcaaccuggugggggcccccagcag

SEQ ID NO: 164815 - RNA, 64 nt, Human
agcucagcuauucggcgcgguuccccaacagcgccgggcgcagaaagcuuucgauuuuuuaaau

SEQ ID NO: 164816 - RNA, 64 nt, Human
acacagacugcgauuugucccagguccucacuaccgggcgcaggagggugagcguuauuggucg

SEQ ID NO: 164817 - RNA, 64 nt, Human
aguaaagcaguugagcaaacaccaacccgagcuucgggcgcagaauucuucaccuucucuuccc

SEQ ID NO: 164818 - RNA, 64 nt, Human
ugagaugauuaccucggacgucuacggaaacgagcgggcgcauuguuguccgcuugugugugug

SEQ ID NO: 164819 - RNA, 64 nt, Human
uaacuuaccucaucaagaaugugccccuacaggccgggcgcaguggcucacgccuguaauccca

SEQ ID NO: 164820 - RNA, 64 nt, Human
gagugagacaugccaaacauccaccuuugggaccauagcauaguuaaaauuaaauguaguugga

SEQ ID NO: 164821 - RNA, 64 nt, Human
uucauucagugauauguagggaggaaggagguugauagcauagauggcaacugauucccaguuu

SEQ ID NO: 164822 - RNA, 64 nt, Human
gauuucaaauaaaacugucuuuggcagugaguaaauagcauauuuugaaguagaguuguauacu

SEQ ID NO: 164823 - RNA, 64 nt, Human
caaacaaaaugcuaugguagcauuuuucaccuucauagcauacuccuucccccucaggugauac

SEQ ID NO: 164824 - RNA, 64 nt, Human
ucaaaaauaauuuuuaaaaagccugagguaugauauagcauaaaagauugagaugaaaauauau

SEQ ID NO: 164825 - RNA, 64 nt, Human
uaauauuaauauuaacaauauugauguuaauuacauagcauacuauuucaauaaauuauaugca

SEQ ID NO: 164826 - RNA, 64 nt, Human
auuuauuuaacaguuaucuugaaagcuauuggguauagcauaaaauaauaucacucuuuuaaua

SEQ ID NO: 164827 - RNA, 64 nt, Human
gcuuaaucaaaagacuggaaaacugcagucuguaauagcauaaggcuuccauuaugaaagaaaa

SEQ ID NO: 164828 - RNA, 64 nt, Human
uuacuauuuauuucagaaauguugacaauacaacauagcauaugucuucaucucacuaagaaaa

SEQ ID NO: 164829 - RNA, 64 nt, Human
ugagcaaaucuguaugugugaguauaaguugagcauagcauacuuccagagguggucuuaugga

SEQ ID NO: 164830 - RNA, 64 nt, Human
uuuucuuuuucaaaucuccuaaugguaguaugauauagcauaguagaaggagauuuggccuggg

SEQ ID NO: 164831 - RNA, 64 nt, Human
aaaauuugaaacauuauucuuguuguuguugguaauagcauaaugacagugggagggguacaag

SEQ ID NO: 164832 - RNA, 64 nt, Human
acaguaaaauauuucgugggaaccuaacacucacauagcauaugguuuauuaauaaugcauauc

SEQ ID NO: 164833 - RNA, 64 nt, Human
cucuccuggggccgacacguugggacagcacaccauagcauaaagcuaggggaugcauggaaau

SEQ ID NO: 164834 - RNA, 64 nt, Human
acaucugcuaaaaugcaaguauauguauaagguaauagcauauuacagcugaaaauuuugagaa

SEQ ID NO: 164835 - RNA, 64 nt, Human
cuuaaauuaccuuuaugaaauauaguuuuguauaauagcauagauuuuccuucaaaaaaugaac

SEQ ID NO: 164836 - RNA, 64 nt, Human
uuuuaauaaauuuaauuauuugcuuguccagacuauagcauauuagcuguuuagaagggauggc

SEQ ID NO: 164837 - RNA, 64 nt, Human
cuaguuaacaguuggaaaauauaauugcucuuugauagcauauacuccaauuuuuccauagucc

SEQ ID NO: 164838 - RNA, 64 nt, Human
ucuacuuuuaaguugcugaugaacucuuaaucaaauagcauaaguuucugggaccucaguuuua

SEQ ID NO: 164839 - RNA, 64 nt, Human
gaaucguaagagaacucuguaggaauuauugauuauagcauacaaaagugauucaguuuuuugg

SEQ ID NO: 164840 - RNA, 64 nt, Human
cuccuggccuggccugaauauuauacuacucuaaauagcauauuucauccaagugcaauaaugu

SEQ ID NO: 164841 - RNA, 64 nt, Human
auauuuuaaagcuuggugcuaaaccacaauauguauagcauauggagugccuguacaagcugau

SEQ ID NO: 164842 - RNA, 64 nt, Human
auugguuagggcucccacugccaaaugcaagcagauagcauaaccugacuguuaugugcccuca

SEQ ID NO: 164843 - RNA, 64 nt, Human
acauggcuaacaaucuucaaauacccaaauugugauagcauaaauaaaguauuuauuuuaugcc

SEQ ID NO: 164844 - RNA, 64 nt, Human
gaccuuaaugcuaauucaaugagaaaugaguuuaauagcauaacauuaccaagguaaucaaacu

SEQ ID NO: 164845 - RNA, 64 nt, Human
acaauucuuguguggaauuuaacuccaugacugaauagcauaaggaagagguuauuuaaaagca

SEQ ID NO: 164846 - RNA, 64 nt, Human
aagaauuauguaaaagccauucuuuaaaauauuuauagcauaaauauauguuauguaaagugug

SEQ ID NO: 164847 - RNA, 64 nt, Human
aguaaauagcuguagagucacauauaugaagugaauagcauaugugucauuuagucucccugaa

SEQ ID NO: 164848 - RNA, 64 nt, Human
ucaauaucucagaucucuucuacuguauuacugaauagcauacauacauagacaauguucgcca

SEQ ID NO: 164849 - RNA, 64 nt, Human
cgaacugugcagcuccugcagcaccauuuguaucauagcauaucuguuaugugucguugcuuuc

SEQ ID NO: 164850 - RNA, 64 nt, Human
caauauuuuugauacagcaagugucaaacuugcuauagcauaaaagccggggcuccugauuucc

SEQ ID NO: 164851 - RNA, 64 nt, Human
uugugauaugcuuauauuuuuaaggaaguaaguuauagcauacuuuuuuaaaaguaggaaccac

SEQ ID NO: 164852 - RNA, 64 nt, Human
aagaaacaucauuauaauuaauaaaaaguagguaauagcauauaaaugguucuugacauuuuaa

SEQ ID NO: 164853 - RNA, 64 nt, Human
uuaacuaauagaugcauagcacuuaacagagugcauagcauacacuguuuucaauaaaugcacc

SEQ ID NO: 164854 - RNA, 64 nt, Human
ugaaggaaauuguucuuuuugaguuaucuacuuaauagcauaucauucuuuuucuuaagcuaaa

SEQ ID NO: 164855 - RNA, 64 nt, Human
uaagcauucuuuccacugaaugcauaauguuuaaauagcauaaaaugaaaugcuacaaaaauug

SEQ ID NO: 164856 - RNA, 64 nt, Human
guuacauuuguaaagaaaauguaaaaauguaacuauagcauaugaauugcuuaaacugugcugc

SEQ ID NO: 164857 - RNA, 64 nt, Human
uuggguucacaaggcauuggguaaguuagauaaaauagcauauacuuucucugcaggguaggua

SEQ ID NO: 164858 - RNA, 64 nt, Human
agauuguuuucaaguguuuuauaauuaaaucauaauagcauauuuuaaaaucaaucuuccuaaa

SEQ ID NO: 164859 - RNA, 64 nt, Human
gggaagguaccacaaacauuaucuaccagggaacauagcauaaauuagucugaaauuuccugag

SEQ ID NO: 164860 - RNA, 64 nt, Human
agcuacuagcugccuacgugugugcauuugcuauauagcauacuucuuuuuuccaguuucaauc

SEQ ID NO: 164861 - RNA, 64 nt, Human
uauauuaaauaauaagaauauggcaauuagcgauauagcauacccaaacaaagauguucucgau

SEQ ID NO: 164862 - RNA, 64 nt, Human
acuauuguuuuaucauuuaugcugucuuuggauuauagcauauuuauaauaucuauuuuuuguu

SEQ ID NO: 164863 - RNA, 64 nt, Human
ucgcaauguaaacuuaacagcuacaguuuaaaugauagcauagaauuaugccuaaaauagacau

SEQ ID NO: 164864 - RNA, 64 nt, Human
caaaaugaaagaggaggaagucuggguuuuaugaauagcauagauucaaacaaucuuuuauuca

SEQ ID NO: 164865 - RNA, 64 nt, Human
gaaggcuuuaauaaaggccacaggagacauuacuauagcauagauugucaaauguaaauuuacu

SEQ ID NO: 164866 - RNA, 64 nt, Human
aguguaaaauggaaaauaagagaucaaaaugaauauagcauaggaauaaagauuucacuagaaa

SEQ ID NO: 164867 - RNA, 64 nt, Human
uagguuaauuaguuguuucuguaaaucauuuguaauagcauagugcuuuuuacucauugcugua

SEQ ID NO: 164868 - RNA, 64 nt, Human
aaaugggaugugaagaauugaggcaugcaacccaauagcauaaauguccuuuuuccccccaaau

SEQ ID NO: 164869 - RNA, 64 nt, Human
gaaugcagaugccugugcccaaauaauaauucauauagcauaaauuggaguuguguguuaaugu

SEQ ID NO: 164870 - RNA, 64 nt, Human
ugcucucccaugacaucuccaugcugguuucuccauagcauaaaugaaaaaaaaaaaaaaaaag

SEQ ID NO: 164871 - RNA, 64 nt, Human
aagaucauuuuguuguucauugugcaguauguauauagcauaauauacacagugaauuauaggu

SEQ ID NO: 164872 - RNA, 64 nt, Human
auauacaauauacaaacauaugcccauuccugugauagcauacaaauucaaacauacagaaaca

SEQ ID NO: 164873 - RNA, 64 nt, Human
uaugaggaguguguauguaccugugguauaccaaauagcauacauguacacacaaaaaugugug

SEQ ID NO: 164874 - RNA, 64 nt, Human
acacacagccaacauuuuaggaacuuucuagauuauagcauaaggacauguaauuuuugaagac

SEQ ID NO: 164875 - RNA, 64 nt, Human
ugcuucauuucauguauuuauucuuuguauaauuauagcauacauguuauguaauauaacuuau

SEQ ID NO: 164876 - RNA, 64 nt, Human
acaguuaaguguaaauauuguauguuuuguaucaauagcauaauuaacuuguuaagcaaguaug

SEQ ID NO: 164877 - RNA, 64 nt, Human
guuaaggauucuuagaaaaacagcaaccaccagaauagcauauaucugaaaguagucuucagcu

SEQ ID NO: 164878 - RNA, 64 nt, Human
cuaaauauaauuguuuuagucuuauggcaugaugauagcauauguguucagguuuauagcuguu

SEQ ID NO: 164879 - RNA, 64 nt, Human
ucucuaggggccuucccucccaggucugugucugauagcauacacacacacauauauauacaca

SEQ ID NO: 164880 - RNA, 64 nt, Human
guccagugguucucaaagugugauccauagacuaauagcauagcauuaccugagaacuugauaa

SEQ ID NO: 164881 - RNA, 64 nt, Human
cuuacgugccagugaggcccuaaggucucagugcauagcauaccugccacucuggauguuuucc

SEQ ID NO: 164882 - RNA, 64 nt, Human
cuucccuuuacagcucuccuccagcccugggcacauagcauaggcuggggacacaggauccugg

SEQ ID NO: 164883 - RNA, 64 nt, Human
uuucauugcaaaggcaguauaaaagauauauaaaauagcauaauaugagaaauuaagucccuaa

SEQ ID NO: 164884 - RNA, 64 nt, Human
aaauccacuaguauuuuuuuugcuuuuaugacaaauagcauacaccaaacauuucugugaaacu

SEQ ID NO: 164885 - RNA, 64 nt, Human
uacuagcccagccuagcagaaaagugcaauauguauagcauacuuugacauuuuaaacaugaua

SEQ ID NO: 164886 - RNA, 64 nt, Human
aaagcccucauaaauauuuauauuuacuaaacuaauagcauagacacuauauaaauccgcagug

SEQ ID NO: 164887 - RNA, 64 nt, Human
ggaaaaucuaauaaauuuuaggccaaauaagaauauagcauauuuaguaugguuauagucaaca

SEQ ID NO: 164888 - RNA, 64 nt, Human
gccacuucacuuuuuuucuuuucucugccuugguauagcauauguuuuuguaaguuuaugcaua

SEQ ID NO: 164889 - RNA, 64 nt, Human
ccacaggagaauucggggauuugaguuucucugaauagcauauauaugaugcaucggauagguc

SEQ ID NO: 164890 - RNA, 64 nt, Human
uuaaaacaagugcuugaguugucacuuaaaaauuauagcauauugcuauaauaaaaccuuauuu

SEQ ID NO: 164891 - RNA, 64 nt, Human
uuuuguuugaaauucauauaucuuauuucaaaggauagcauaauaucugcauuaugcuggaaaa

SEQ ID NO: 164892 - RNA, 64 nt, Human
gaaugcaagguuagugagauccuaagcucucaaaauagcauauucccuagagcucaagaaagcu

SEQ ID NO: 164893 - RNA, 64 nt, Human
uaguuaauuuguauauuuuauuaguauuuuggaaauagcauaucugagacugaagagaaauuga

SEQ ID NO: 164894 - RNA, 64 nt, Human
aaguuguauaguuuuguguaggaacucuauauucauagcauauuuguggaaaugauaccuaugg

SEQ ID NO: 164895 - RNA, 64 nt, Human
gaaaagucagaucuggccauuugucuuuccuagaauagcauaacuuuguucauuguuuuuuuug

SEQ ID NO: 164896 - RNA, 64 nt, Human
ugucgaaucgcugcagcagcuuucuuucaucuuuauagcauauauuuuauuuuuaaaaaaacua

SEQ ID NO: 164897 - RNA, 64 nt, Human
uugguauugggacaguggauaagcagguuaucacauagcauagaauucuuaaaagauacaugug

SEQ ID NO: 164898 - RNA, 64 nt, Human
ucaucacuauuuuauacguaacauauagucuacuauagcauaguaugcuacuauugcuacuucu

SEQ ID NO: 164899 - RNA, 64 nt, Human
cuugauuucuuggucauuucucaaccugaggugcauagcauauucccacauuccauuugguagc

SEQ ID NO: 164900 - RNA, 64 nt, Human
ugaagaaagcuaaguugugaacaagaguguuuuuauagcauauguguugaaguaacagcuugug

SEQ ID NO: 164901 - RNA, 64 nt, Human
uaaugaguagugcuguucauauuacuuuaguucuauagcauacuugcaucuuuaacaugcuauc

SEQ ID NO: 164902 - RNA, 64 nt, Human
uagcccagaacaguuuaaugguacuuacugagcuauagcauagcugcuuaguuguuuuugagau

SEQ ID NO: 164903 - RNA, 64 nt, Human
ccaaguccuaagagacuuuuggaagaggauauauauagcauaguaccauaccacuuauaaagug

SEQ ID NO: 164904 - RNA, 64 nt, Human
uuaaauguuauaaauuuggugaucagaacuauuaauagcauaaaucgaacucaaauggaagcaa

SEQ ID NO: 164905 - RNA, 64 nt, Human
gccuauaaaucuccuuauuuuauuucuuguuuuuauagcauaaagcuuuaguuuggccuguuuu

SEQ ID NO: 164906 - RNA, 64 nt, Human
auuuuauuugcuuauuuuuauaauuaaagaugccauagcauaauaugaagccuuuggugaauuc

SEQ ID NO: 164907 - RNA, 64 nt, Human
aauuccuauuuuuaaauaauuuccuacacaaaugauagcauaacauaugcaguguucuacaccu

SEQ ID NO: 164908 - RNA, 64 nt, Human
uguauaaucagaagucugaauuuuuauaaaacauauagcauaaaaacuuccaguacuuugguug

SEQ ID NO: 164909 - RNA, 64 nt, Human
aaucauagacuuugaggagagaaagcauaaaaauauagcauauaaucuaaaaauaaauauauaa

SEQ ID NO: 164910 - RNA, 64 nt, Human
aauauuuucuaggcuauguaagaguuagcagcccauagcauagaaguaaucaaguagcaucuga

SEQ ID NO: 164911 - RNA, 64 nt, Human
augugguguaaagguuuguuauacgugccacaauauagcauauaaauauuaugccaucauuccu

SEQ ID NO: 164912 - RNA, 64 nt, Human
gauaaaugcuacucauaagagcugguuuggggcuauagcauaugcuuuuuuuuuuuuaauuauu

SEQ ID NO: 164913 - RNA, 64 nt, Human
aauaauuauuuggggcugggaaacuuauuuauugauagcauaggacagaggaaggaggcgggga

SEQ ID NO: 164914 - RNA, 64 nt, Human
gacuaaauuuucuuuuaagcauuuguauauuaaaauagcauacuguguauguuuuauaucaaau

SEQ ID NO: 164915 - RNA, 64 nt, Human
aagaaacuaaauguaugucaguauggaaguaguuauagcauacugugugcuaauugaaaagaau

SEQ ID NO: 164916 - RNA, 64 nt, Human
aagcacucauuucacucucccugugugccaggcaauagcauaagcacuggaagaauacagaugu

SEQ ID NO: 164917 - RNA, 64 nt, Human
uugggacauuuuaaaauagaacuauccuuguucgauagcauaggaaaauguucuggugauuguc

SEQ ID NO: 164918 - RNA, 64 nt, Human
uuuguauuaugucaaauguuauggcagggcccaaauagcauagccacaaguuugguuuaugugg

SEQ ID NO: 164919 - RNA, 64 nt, Human
acaaaugagcaagguauuuguugcaacuuacuacauagcauauacccaaaaucacugaagaaaa

SEQ ID NO: 164920 - RNA, 64 nt, Human
uacugccaauuguauaccuuucuuauguccuuuaauagcauagacuggacaggugacuauuuau

SEQ ID NO: 164921 - RNA, 64 nt, Human
gauuauucuuuuaauuuuuauuugagcuguuucaauagcauaaugaaauaaaauuuugaauugg

SEQ ID NO: 164922 - RNA, 64 nt, Human
uguaguaauuacuuguuacugacaccacagcaguauagcauaugucacagcuccugugauucaa

SEQ ID NO: 164923 - RNA, 64 nt, Human
aucaggcuuuuuaaaugauguaauucccacuguaauagcauagggauuuuggaagcagcugcug

SEQ ID NO: 164924 - RNA, 64 nt, Human
uacccucaccucucccuaguucauaaauaggucuauagcauacuaauauccaccugauuuauug

SEQ ID NO: 164925 - RNA, 64 nt, Human
aaacauaauaaacaaucuucacacgaaaccaaaaauagcauacaccuaauguuggguuagggaa

SEQ ID NO: 164926 - RNA, 64 nt, Human
gccagcagguuccccucacagucaaugcagugguauagcauauccucacauuucuagugcccuu

SEQ ID NO: 164927 - RNA, 64 nt, Human
caauaaagauacaugauugaaaccaaguugaaaaauagcauaugccuuggaggaaaugugcuca

SEQ ID NO: 164928 - RNA, 64 nt, Human
uaugggcuuuguuaucuuccacuggaaaaguguaauagcauacaucaaugguguguuaaagcua

SEQ ID NO: 164929 - RNA, 64 nt, Human
uaauguauuauuuuuauaacuguaaaaaaaguaaauagcauauuuuaaagugaaaguuugggac

SEQ ID NO: 164930 - RNA, 64 nt, Human
gcuuccacuagaaccuggagacauagcaucuuugauagcauaagccagauuaucugugugugcg

SEQ ID NO: 164931 - RNA, 64 nt, Human
cuuauggauaaagaaagcauuagguaguugggcuauagcauaauuagauuuucuggcuuucaaa

SEQ ID NO: 164932 - RNA, 64 nt, Human
agaaaacgugucucagauggcuggcuuuaccucgauagcauaagagagaccuaagacauguaaa

SEQ ID NO: 164933 - RNA, 64 nt, Human
uuguacuugaauaguaggauuuuaaagggcauugauagcauaccaaacaaaaggcaaaauaaag

SEQ ID NO: 164934 - RNA, 64 nt, Human
cauuuuuuaaggugaaauaguacuaccuuacgugauagcauacaaagaagaaagcucuagaaag

SEQ ID NO: 164935 - RNA, 64 nt, Human
aaaaacaucugaaagccacguuccuuacugcagaauagcauauauaucgcuuaaucuuaaauuu

SEQ ID NO: 164936 - RNA, 64 nt, Human
gaauacacuuauuuuaauuaacaauagcacagauauagcauagggcaguggguuuuuuaguuaa

SEQ ID NO: 164937 - RNA, 64 nt, Human
auuucuuccuggacaguugauaaaaguuccauccauagcauauuuccagaauaucccuagauga

SEQ ID NO: 164938 - RNA, 64 nt, Human
cugagaugcaaggaauucuauaaauaacccauucauagcauagcuagagauuggugaauugaau

SEQ ID NO: 164939 - RNA, 64 nt, Human
uccaggguuuuguagucaccuagauuuuaagcugauagcauagugcuucagcgguucuucuaac

SEQ ID NO: 164940 - RNA, 64 nt, Human
acagaaauuuuguucgggaagggauaaacuagauauagcauacagagccuguuuuugaguuuua

SEQ ID NO: 164941 - RNA, 64 nt, Human
auucugcaaauacgguuuuucuaccugauugcauauagcauaugugucauuacaugugaugcug

SEQ ID NO: 164942 - RNA, 64 nt, Human
agaagcguauaccuaacuguaaauaaauguauguauagcauauguacauauguguguauaucuc

SEQ ID NO: 164943 - RNA, 64 nt, Human
uucgggaaugguuauugguaauuuguuuuguauuauagcauacaauaacuagaguuaccaaagg

SEQ ID NO: 164944 - RNA, 64 nt, Human
aagcauguuacuauuaaaugguugguuauuuuauauagcauauucuuuaucuuggauauuuuau

SEQ ID NO: 164945 - RNA, 64 nt, Human
uuugucaauguuuuccaaauacuuagaguuaugaauagcauaauuucuugauaccauaacuuug

SEQ ID NO: 164946 - RNA, 60 nt, Human
caagaucuguaucaagauaaaggaauucaaauagcauauauaugaccaugucugaaaugu

SEQ ID NO: 164947 - RNA, 64 nt, Human
gcuuuuggauuuuuuugaauuuuggaauauuugcauagcauaaugagauaucuugggaauggga

SEQ ID NO: 164948 - RNA, 64 nt, Human
gaaacaaugagguauuuaaagugaauauagaaaaauagcauagaaaucauauauuuauuucaua

SEQ ID NO: 164949 - RNA, 64 nt, Human
ggcucugacgaggcaguggagaguuccugacagcauagcauacugccuucugacagacuggguu

SEQ ID NO: 164950 - RNA, 64 nt, Human
aaauuuuggagaaaauguauuuguguucacuucuauagcauauaauguuuuaauauucuguguu

SEQ ID NO: 164951 - RNA, 64 nt, Human
cuugacagucuguaauuauuguacagauauuuuaauagcauauaaauaaguauauuccuuuuau

SEQ ID NO: 164952 - RNA, 64 nt, Human
gcauauauacauauuuccuuuguuuaaaauacaaauagcauacuaugcaugcuguucugcacuu

SEQ ID NO: 164953 - RNA, 64 nt, Human
gaaaaccaauauaugguggugcugggcuuugaagauagcauaucagacgccuugguucuguuug

SEQ ID NO: 164954 - RNA, 64 nt, Human
gauuucagaaauuuguaauaaaugucagcuuuugauagcauagcaguaauugacauuucaaaaa

SEQ ID NO: 164955 - RNA, 64 nt, Human
agcuacuguaguaccuaaaaagucaguguuguacauagcauaaaaacucugcagagaaguauuc

SEQ ID NO: 164956 - RNA, 64 nt, Human
acaggacaaaauaguuguacagguuauauguggcauagcauaaccacaguaagaacagaacaga

SEQ ID NO: 164957 - RNA, 64 nt, Human
uguacugagggggcuggaggcgaagggugggagcauagcauaggaacgcugcauagaccaugga

SEQ ID NO: 164958 - RNA, 64 nt, Human
uuuuuagugggauccuuacugucccuggaaagauauagcauagugguucucagcacagucucca

SEQ ID NO: 164959 - RNA, 64 nt, Human
uacuucaugcuccagcccaagccuauacccuguaauagcauacuauuauugaaaucgcuugacc

SEQ ID NO: 164960 - RNA, 64 nt, Human
uuuuuuauugcugaauaauguucauuguauggauauagcauaguauguuuauccauucgcccau

SEQ ID NO: 164961 - RNA, 64 nt, Human
cuuuugaagaguuucccagggacuagucaugguaauagcauauaauugaucugaaugagaugga

SEQ ID NO: 164962 - RNA, 64 nt, Human
acccucagucuccuuguuucucuguaucuguagcauagcauagaacccgguauacagggguuuc

SEQ ID NO: 164963 - RNA, 64 nt, Human
agaagauguucaagaucagcaucauccgauggaaauagcauaugagccauguauguaguuucaa

SEQ ID NO: 164964 - RNA, 64 nt, Human
accaaaucuggaucuuuggacuaaaguauucaaaauagcauagcaaagcucacuguauugggcu

SEQ ID NO: 164965 - RNA, 64 nt, Human
ggauaaagaacuguauuuuuagaacuaucucaucauagcauaucugcuuuggaauaacuauaaa

SEQ ID NO: 164966 - RNA, 64 nt, Human
uauuaauguuuuaugaaaucucaugcaucaguucauagcauaaaaucuagcuggacaacuaaga

SEQ ID NO: 164967 - RNA, 64 nt, Human
caagauuaugagguuaaaaauaaugugguuuuauauagcauagugguuuuauuuuguuaguuau

SEQ ID NO: 164968 - RNA, 64 nt, Human
ggagagcuggagaacaggauucuaggcggaagcgauagcauaggcaaaggcccuugggcaggaa

SEQ ID NO: 164969 - RNA, 64 nt, Human
cauuaccacuaaaauuuuauuugacuuauagagaauagcauauagagaauaaucauguugacuu

SEQ ID NO: 164970 - RNA, 64 nt, Human
aaaaccgcuuaaagggguuccugaaccacaaaccauagcauaagugaucugugccuuaacgaca

SEQ ID NO: 164971 - RNA, 64 nt, Human
uuccaguucuugcuuaguggcacgaccucuuuccauagcauaaaugcaggccagcguuuuagcc

SEQ ID NO: 164972 - RNA, 64 nt, Human
cucucggggcaccuggcaggaggcgggugugugaauagcauauauuuuuacauguacuauaucu

SEQ ID NO: 164973 - RNA, 64 nt, Human
ccgggguccaggcccgugggcgcaaaggugccucauagcauagccagcauucagcacacacaaa

SEQ ID NO: 164974 - RNA, 64 nt, Human
caugugguauaagcacauguacagaggaguacacauagcauauaaacaugucuguagcacauau

SEQ ID NO: 164975 - RNA, 64 nt, Human
agcagguuccugcccuugaaaaugccgguaagcuauagcauauguuuuuuaagacuuaagcauu

SEQ ID NO: 164976 - RNA, 64 nt, Human
guuuuguuugggguuuuuaauuuugcguguuugcauagcauaaaaucaguagacaacaccacug

SEQ ID NO: 164977 - RNA, 64 nt, Human
aguuagugaggauuauuaaccucugagcagugauauagcauaauaaagccccgggcauuauuau

SEQ ID NO: 164978 - RNA, 64 nt, Human
gaauaauuuuauugcagucuuccauuacauggaaauagcauaucuaauaucuagguuacuugag

SEQ ID NO: 164979 - RNA, 64 nt, Human
cgaagacaucaagauacacuuguaaauaaagcugauagcauauauucauaccuguuguacacuu

SEQ ID NO: 164980 - RNA, 64 nt, Human
uuucccucuuugcucuggaaauauuuguacucauauagcauauuucaaaaauguugucauucau

SEQ ID NO: 164981 - RNA, 64 nt, Human
ucuuuccaucuuguugcauuaucuagaaaagaauauagcauauagcuauagauauaggcuuuuc

SEQ ID NO: 164982 - RNA, 64 nt, Human
aaacuuuucuagucagcaagugccugauaugccaauagcauacaaacucaauagcaaucaugac

SEQ ID NO: 164983 - RNA, 64 nt, Human
auuuuagaguuuuaaugaauucaaggaagggagcauagcauaucuguggcaaacuauuuuccac

SEQ ID NO: 164984 - RNA, 64 nt, Human
auagauauacacacauauauauacucacacacauauagcauaaaauacucagcagggcuaguua

SEQ ID NO: 164985 - RNA, 64 nt, Human
cugaucaacaucauaggagauaaauauucauuauauagcauaggauauuauuacuugaauguuc

SEQ ID NO: 164986 - RNA, 64 nt, Human
uaacugauuaguaagucuugccuauauuuuccugauagcauaugacaaauguuucuaagguaac

SEQ ID NO: 164987 - RNA, 64 nt, Human
uuaauaaucacauuagguuuaauuuuuuuacaucauagcauauuaguaaacaucuggauaaagg

SEQ ID NO: 164988 - RNA, 64 nt, Human
gaagcaggcagagcucagaggaucuuggcaucacccaccaaaguuagcugaaagcagggcacuc

SEQ ID NO: 164989 - RNA, 64 nt, Human
uuguagcaugcuugaggaguuuuucccuuacuggccaccaaaguucugaaccacuugcagguuc

SEQ ID NO: 164990 - RNA, 64 nt, Human
guuuugcccugagauucaugguuauggcuggguaccaccaaauagaagaauggcuuaggggagu

SEQ ID NO: 164991 - RNA, 64 nt, Human
aucaguuuacauauauaacaaguguaauaagauuccaccaaaggacauucuaaauguuuucuug

SEQ ID NO: 164992 - RNA, 64 nt, Human
cuuuaaccuggcuuuuaaagcaguaguaacugccccaccaaaggucuuaaaagccauuuuugga

SEQ ID NO: 164993 - RNA, 64 nt, Human
gacucacuugucaacuaguggacuaauuaacccuccaccaaaaaaacacaaagugcuucuguga

SEQ ID NO: 164994 - RNA, 64 nt, Human
guagaagaaaagccacccccugcacccuccauagccaccaaaccuguuagaacuggaccaauca

SEQ ID NO: 164995 - RNA, 64 nt, Human
aggaaguaaaggacaaucagaacaccagucaaacccaccaaauugcuuuauuccccuuugcaag

SEQ ID NO: 164996 - RNA, 64 nt, Human
auguguuacguguuuuuuccaguauguuuauuugccaccaaaaaguaaaugcauuuucacccau

SEQ ID NO: 164997 - RNA, 64 nt, Human
uuuuuuuuguaaucugugccaugaaauuugaaaaccaccaaaaaucaagggaacuuuuauauau

SEQ ID NO: 164998 - RNA, 64 nt, Human
aaggaccuguguucagccacacccagugguagcuccaccaaaucaugaacagccuaauuuugag

SEQ ID NO: 164999 - RNA, 64 nt, Human
ccgcugacaucuagaacugaccuaccacaagcauccaccaaaggaguuugggauugaguuuugc

SEQ ID NO: 165000 - RNA, 64 nt, Human
uugcagggucgggcuugcggugggugacccagagccaccaaagucacauccacaacuaaugagg

SEQ ID NO: 165001 - RNA, 64 nt, Human
caagccccucagcccuugcccccaucccucggacccaccaaacugcacacacagcuccucuuac

SEQ ID NO: 165002 - RNA, 64 nt, Human
gaaguauuuggacaaaaaccuaauagaagagucaccaccaaaugaagaauaaaacucccagggu

SEQ ID NO: 165003 - RNA, 64 nt, Human
guuccaaaagaggguggagaguccugcaucauagccaccaaauagugaggaccggggcugaggc

SEQ ID NO: 165004 - RNA, 64 nt, Human
uuguagggauuuuauacucaacuauacagaguauccaccaaaguccuaaucuaaaguccugcuc

SEQ ID NO: 165005 - RNA, 64 nt, Human
ggauucguauuuuuuaaaguucaguugacuuuccccaccaaaugguccauuugaaugcaucccu

SEQ ID NO: 165006 - RNA, 64 nt, Human
agugcaauaguugacuuuuaaccaaccaccaccaccaccaaaaccaguuuaugcaguuggacuc

SEQ ID NO: 165007 - RNA, 59 nt, Human
ccgcgucaccaggaccauaaccguacaaaccaccaaauccucugcguccccacuccucc

SEQ ID NO: 165008 - RNA, 64 nt, Human
cagccugcugaguagcugggacuacaggcacaugccaccaaacuuggccauuuuuugucuuacg

SEQ ID NO: 165009 - RNA, 64 nt, Human
uuaccugaaagcugcaguucacaggcuccucucuccaccaaauuaggauagaauaauugcugga

SEQ ID NO: 165010 - RNA, 64 nt, Human
acagcuaagccuguuugaaugauacguagguuccccaccaaaagcaggcuuucugcccugaggg

SEQ ID NO: 165011 - RNA, 64 nt, Human
uugggggaguaccuuuaguauauuccuaaaauugccaccaaagaaugccaaaucugaauuucuc

SEQ ID NO: 165012 - RNA, 64 nt, Human
aaaaagagguugagcaccagaaucucagaauuuaccaccaaagaacucauccauguaaccaaaa

SEQ ID NO: 165013 - RNA, 64 nt, Human
gaagaagggcccguggggcuuugccugugcccguccaccaaaggcugucaugugucucgaaauc

SEQ ID NO: 165014 - RNA, 64 nt, Human
uuuaaacucaauaauuuugugaaaaaaaaaaccaccaccaaacuuuugguuguaaaagagaacc

SEQ ID NO: 165015 - RNA, 64 nt, Human
uugggcagcuuggguaaguacgcaacuuacuuuuccaccaaagaacugucagcagcugccugcu

SEQ ID NO: 165016 - RNA, 64 nt, Human
uaaaaaaugaggugggagggcuggaucuuuucccccaccaaaaggcuagagguaaagcuguauc

SEQ ID NO: 165017 - RNA, 64 nt, Human
gcauuacacuucaaaacaguggggagcaacuuuuccaccaaagcuacaaaccuaaaaugcugcu

SEQ ID NO: 165018 - RNA, 64 nt, Human
ccaacagcuugauagaccagugcagccagagagaccaccaaacagagcccccaaaagacagaca

SEQ ID NO: 165019 - RNA, 64 nt, Human
cuccaccugaagugaugauggaugagaaaaaacaccaccaaaugacaagucacacccuccccau

SEQ ID NO: 165020 - RNA, 64 nt, Human
gguuuuauauguguuaaauaaauguguaaaguaaccaccaaauguuauuagaauuuuucuucua

SEQ ID NO: 165021 - RNA, 64 nt, Human
caaagaaaaaugauacuucucuuuuuuugcuguuccaccaaauacaauucaaaugcuuuuuguu

SEQ ID NO: 165022 - RNA, 64 nt, Human
cgucucccaaagugcugggaauuacaggcgugagccaccaaacccggccugauuaaaguuaaau

SEQ ID NO: 165023 - RNA, 64 nt, Human
aagcccuauuuauaaacaaauacuuuuccugccuccaccaaaccccuacagaacaucaccugga

SEQ ID NO: 165024 - RNA, 64 nt, Human
caguugaagcgcuggauguuuccuagaacaagaaccaccaaagccuguucgcacagaagggcga

SEQ ID NO: 165025 - RNA, 64 nt, Human
cacguuuuguuuugugccaaccuauuuugaaguaccaccaaaaaagcuguauuuugaaaaugcu

SEQ ID NO: 165026 - RNA, 64 nt, Human
acguacuucaaugccaccgguaacuuagguuuuaccaccaaaugcuguuaacguuaaaucauuu

SEQ ID NO: 165027 - RNA, 64 nt, Human
ccucagggcuugugggggguaggcugagaccccaccaccaaagguuaagugagguccccuugau

SEQ ID NO: 165028 - RNA, 64 nt, Human
gggacucaguaccugagccucaaucaagccuuauccaccaaauacacagggaagggugaugcag

SEQ ID NO: 165029 - RNA, 64 nt, Human
cgugaugaaugugggaagggcuuugguggauguuccaccaaaacacguuagagaauuuguacau

SEQ ID NO: 165030 - RNA, 64 nt, Human
aaauugaagaagaaauguagcccccagccgguacccaccaaaggagagaagaagcaauagccga

SEQ ID NO: 165031 - RNA, 64 nt, Human
uuggaaauaaagaagugcucugaaaaaauaucagccaccaaaauaguuauguuggcacuguguu

SEQ ID NO: 165032 - RNA, 64 nt, Human
ccaacguagaccugcaggugcugccccaugaccuccaccaaagcccauauaaggagcggaguug

SEQ ID NO: 165033 - RNA, 64 nt, Human
aagcaggccuaguuucuucaucuauguuuaccggccaccaaacaccuuagggucuuagacucug

SEQ ID NO: 165034 - RNA, 64 nt, Human
aguggcccgucucaggcccugcucacucccggggccaccaaacgggccccucucucgggggaac

SEQ ID NO: 165035 - RNA, 64 nt, Human
ucucugacaugaucccauaacacugacugaaauuccaccaaauuacuguucuuugaaugcuuua

SEQ ID NO: 165036 - RNA, 64 nt, Human
guuuuauaguccucuaaaaucuaggugcucccacccaccaaaggcauauccugcaaagggcugu

SEQ ID NO: 165037 - RNA, 64 nt, Human
agcugggcggcguccacaccuaagaacagcagcuccaccaaaugaagucccucucacgcagcuc

SEQ ID NO: 165038 - RNA, 64 nt, Human
uaauuggauuuugauaugguuuggaucuguguccccaccaaaucucacguugaaguguaauccc

SEQ ID NO: 165039 - RNA, 64 nt, Human
aauguauagugggagugguuguguaaugaaaggaccaccaaaauaauaaaaggcagcuaaugga

SEQ ID NO: 165040 - RNA, 64 nt, Human
gggccuuguuuccuccuccccuuuccccuucuccccaccaaaggaaaauaucccucuuaaugau

SEQ ID NO: 165041 - RNA, 64 nt, Human
cuguuugggaauuuuccuugcugcuaccgcgcugccaccaaauggaauugaccagcggcuguua

SEQ ID NO: 165042 - RNA, 64 nt, Human
gaccuuuucuucagaaguugcuuuccuuuugaggccaccaaaguaauuuagggaaacagcagag

SEQ ID NO: 165043 - RNA, 58 nt, Human
accauuccaccgaaguguaaacuagcauccaccaaaugcaagaagaauaaacauggau

SEQ ID NO: 165044 - RNA, 64 nt, Human
ugguucauuuggguggggaucaaaguccuguccaccaccaaaacuaaguucuuagauuuugggg

SEQ ID NO: 165045 - RNA, 64 nt, Human
cguaaggaagcuguuucuuuuaaaacacaaaccaccaccaaaaauuuaaauguacauauugcuu

SEQ ID NO: 165046 - RNA, 64 nt, Human
gccaggcauuccaaacaauuucuuauacugcugcccaccaaagcagcuugccaacagucaaauc

SEQ ID NO: 165047 - RNA, 64 nt, Human
uuugcuuuugucacuaaacgguuuuguguuagaaccaccaaaauuauagcuuuuaagagcuucc

SEQ ID NO: 165048 - RNA, 64 nt, Human
uuuuuaugaaacuuagauuuaccucagauccaugccaccaaacaucucccaccgaguuauuugg

SEQ ID NO: 165049 - RNA, 64 nt, Human
ccucagaugugcuuauuggauuccaguacaaacgccaccaaagccagcccacugcucuccuaca

SEQ ID NO: 165050 - RNA, 64 nt, Human
acagcagccaacaacacccauguuuguagcucccccaccaaagacccagcggcuucuucacuca

SEQ ID NO: 165051 - RNA, 64 nt, Human
gaaaguaguuauuccuagcuccauuucuuauuuuccaccaaauuuaauugaagggcauuaauua

SEQ ID NO: 165052 - RNA, 64 nt, Human
uuuuucaggaugcuauagucaauuuaguaagugaccaccaaauuguuauuugcacuaacaaagc

SEQ ID NO: 165053 - RNA, 64 nt, Human
ggacugaaaugcuccaucaugaagacuugcuuccccaccaaagauguccugggauucugcugga

SEQ ID NO: 165054 - RNA, 64 nt, Human
ucauuuauuauuuuauaaauugagaacaaccacaccaccaaaugucacaccuucuuauaaagug

SEQ ID NO: 165055 - RNA, 64 nt, Human
aagaaauuugaauaguuccugcuuucugcaccucccaccaaaacaaacuuuucaaugaucaaaa

SEQ ID NO: 165056 - RNA, 64 nt, Human
ccagauaccaacugcugauguugcucuagaaaaaccaccaaacaugacuguucuuuccguguaa

SEQ ID NO: 165057 - RNA, 64 nt, Human
aaggaaauggccaguuaaguagugucuucucucuccaccaaaaagaggaagugccuccagcuuu

SEQ ID NO: 165058 - RNA, 64 nt, Human
uuguccuagcguuuuggaagaggaaaacaggaacccaccaaaccaaccaaucaaccaaacaaag

SEQ ID NO: 165059 - RNA, 64 nt, Human
uggcuggggagugggaacagggaggggcagaaaaccaccaaaaggccagugccucaacucuuga

SEQ ID NO: 165060 - RNA, 64 nt, Human
uuauguagcuuuuuauuauuuuaaguaacuagaaccaccaaauaucaaauaaaauuauuugguu

SEQ ID NO: 165061 - RNA, 64 nt, Human
uauuuuggcucuaauuugaauaagcugaguaaaaccaccaaagaucaguuauaggauaaaaugg

SEQ ID NO: 165062 - RNA, 64 nt, Human
aacuggcaaaaaagcaagcaucuaagaaaaaaaaccaccaaaguucuugaauuuacuauauuua

SEQ ID NO: 165063 - RNA, 64 nt, Human
cucucucucuccccuucucauacacaugccucccccaccaaagaauauaauguaaauuaaaucc

SEQ ID NO: 165064 - RNA, 64 nt, Human
uuuuuuuuuugggugauguaaaaccaacucccugccaccaaaauaauuaaaauagucacauugu

SEQ ID NO: 165065 - RNA, 64 nt, Human
ucuuuccaggacaacuaaacuaccucggaucaagccaccaaauauggcauauccuugcaguagu

SEQ ID NO: 165066 - RNA, 64 nt, Human
aauuuuuuuuucauuucaaauaaauaccuauuuaccaccaaaagaaagaaaaagaaaaguuguu

SEQ ID NO: 165067 - RNA, 64 nt, Human
uuacuugauucugucuucuguauaacucugaaguccaccaaaaguggacccucuauauuuccuc

SEQ ID NO: 165068 - RNA, 64 nt, Human
ccauuugauacuuugaauacucugagguccuuacccaccaaauggauggaauucagcugcucaa

SEQ ID NO: 165069 - RNA, 64 nt, Human
gcauuuguaagcacauggugaaaucagccccugcccaccaaaauaaucuuuauguuaccaagug

SEQ ID NO: 165070 - RNA, 64 nt, Human
acgguuuccaaugcgccgucaccaucuccaccugccaccaaaccaccagcagaguagccgccgc

SEQ ID NO: 165071 - RNA, 64 nt, Human
cuguguaccuccuccaugucugucugcguguuuuccaccaaagaaugcaaagcagacuuccagg

SEQ ID NO: 165072 - RNA, 64 nt, Human
auuucaccagaaguuacagaugaggcacuggaagccaccaaauuagcaggugcaccuucugugg

SEQ ID NO: 165073 - RNA, 64 nt, Human
uaucacgguacagcacgaagccaggcuccuuucuccaccaaagaagauggaaccagacuggaau

SEQ ID NO: 165074 - RNA, 64 nt, Human
ccagccuggucucccaggccugaggacaugccucccaccaaauguccccugcuccagucccacu

SEQ ID NO: 165075 - RNA, 64 nt, Human
agccucucuugacuacagaauaacugauauucacccaccaaacagaaaaagugaaggcuggguu

SEQ ID NO: 165076 - RNA, 64 nt, Human
caugccuuaaaaaaggaggggaggaaccacgcugccaccaaagcagccggaagugccuuaacuu

SEQ ID NO: 165077 - RNA, 64 nt, Human
uagcucuaaacucauuaaaaaaacuccaagccuuccaccaaaacagugccccaccuguauacau

SEQ ID NO: 165078 - RNA, 64 nt, Human
auuguuaaugggagacaagcugaacugccacaugccaccaaaugaaccuuuacuucaaucaaaa

SEQ ID NO: 165079 - RNA, 64 nt, Human
agaucaaucacuuguaugucucacgcaacuugguccaccaaacgccuguccccuguaacuccua

SEQ ID NO: 165080 - RNA, 64 nt, Human
accaaagccaaucugcucuagcugcccacagaugccaccaaaaccugcuaucucuucaucacca

SEQ ID NO: 165081 - RNA, 64 nt, Human
aagcaagggaccuucaugcccuucugauuccccuccaccaaaccccacuuccccucauaaguuu

SEQ ID NO: 165082 - RNA, 64 nt, Human
uuccccuggggcuccaggaccuucccuaccuccaccaccaaaccaagggauuuauagcaaaggc

SEQ ID NO: 165083 - RNA, 64 nt, Human
uggggaggugugcuuuagauuucucauuagaagaccaccaaacugguaauauuuuuauagcauu

SEQ ID NO: 165084 - RNA, 64 nt, Human
cgugaagcucuuccuacccuccucccccaaaaacccaccaaaauuaguuuuagcuguagaucaa

SEQ ID NO: 165085 - RNA, 64 nt, Human
gauuggugucucagcauuuauuuuccugucucuuccaccaaaagccagcuguagcuuuaucucg

SEQ ID NO: 165086 - RNA, 64 nt, Human
uuggccgacugugagcugcagauaaggcuaucagccaccaaagagcaaugaacaauggaaacuu

SEQ ID NO: 165087 - RNA, 64 nt, Human
uuagcccaacaucacaacaucugcucuucggguuccaccaaagagucuccugagcccugaggga

SEQ ID NO: 165088 - RNA, 64 nt, Human
uucacucuccaccaccuggauggcauggcgccugccaccaaacaucuuccuggccugcgcucug

SEQ ID NO: 165089 - RNA, 64 nt, Human
caaugaucaugcuuccauuuuuuuuaguuuuaaaccaccaaaccaauauuuuuccuuuaaauuu

SEQ ID NO: 165090 - RNA, 64 nt, Human
aaaacuaaauaaauuaccaaaaaggaaaaaaaauccaccaaaccaugauaaacacaaaaugcag

SEQ ID NO: 165091 - RNA, 64 nt, Human
agauauggcuuguggacuuccaauaucauccuauccaccaaaaucuuauuccuuaguauuaauu

SEQ ID NO: 165092 - RNA, 64 nt, Human
acaucauuguguagccgacuccuguucuacucucccaccaaauaacaguagugaggguuagagu

SEQ ID NO: 165093 - RNA, 64 nt, Human
cuuuuaugacaauauuggauuuguagguccugugccaccaaaacccaaagguuaguguauccau

SEQ ID NO: 165094 - RNA, 64 nt, Human
aucgugucucuuauucaguaagaugguuacucagccaccaaaauauauuucacucaaggcuugu

SEQ ID NO: 165095 - RNA, 64 nt, Human
cuucucccgcaaaggcggcagaacuacaucggggccaccaaaucaccacucuucagccccaucc

SEQ ID NO: 165096 - RNA, 64 nt, Human
auagaaccuguaacuucauuuuggaaaugcuucuccaccaaauaagggcuuuuuccccuauuua

SEQ ID NO: 165097 - RNA, 64 nt, Human
agcaagagaauuucaaggcaggggauuuuaucccccaccaaaaacacagugaaaggccugcuuu

SEQ ID NO: 165098 - RNA, 64 nt, Human
caggauuugcuauuuaaguggcuugacaacugggccaccaaagaacuugaacuucaccuuuuag

SEQ ID NO: 165099 - RNA, 64 nt, Human
uucugaguaaaaccagucugaaauaggauaaaagccaccaaauauuuucuuuuuuuuccagaau

SEQ ID NO: 165100 - RNA, 64 nt, Human
uaacauauuagcugcccuaaaugaucuuggagagccaccaaaacuuuaggacuacccaagucau

SEQ ID NO: 165101 - RNA, 64 nt, Human
aaaauaucugucuuugguagugcuucugcugcugccaccaaauugauaagaugcuauuaagagg

SEQ ID NO: 165102 - RNA, 64 nt, Human
gagcuauucaauagcagugacgcgcucuccucagccaccaaaugucccugacacccuccccagc

SEQ ID NO: 165103 - RNA, 64 nt, Human
auuuucuauuuugaaucuccuuguuaguuaauaaccaccaaauggaaaggucauucuuucugca

SEQ ID NO: 165104 - RNA, 64 nt, Human
uuccaaaacugaacucaucaccccucuucccccaccaccaaaacugcuccuccuccuguauucc

SEQ ID NO: 165105 - RNA, 64 nt, Human
cacaaagcuuccaaucuuaaggaugugaauaaaaccaccaaauggcauuucuagacaguuugac

SEQ ID NO: 165106 - RNA, 64 nt, Human
cuucuuuaccuucauuucauccuguuggcugcugccaccaaaucugucuagaauccugcuuuac

SEQ ID NO: 165107 - RNA, 64 nt, Human
ugaaagacccugagaccuggaugaugucuuugagccaccaaaccaagcagccuuguagccacuc

SEQ ID NO: 165108 - RNA, 64 nt, Human
aaguuuuaaacuaugugccuaaucaauguguuucccaccaaagauucagaaaacaaugcuugag

SEQ ID NO: 165109 - RNA, 64 nt, Human
uuuuugguccuucuuuccucuuaacguaaauccaccaccaaaauuauuaauccucuugagagaa

SEQ ID NO: 165110 - RNA, 64 nt, Human
agaauaggaucugaagagaucaaagcaauggagaccaccaaacugucuugaaggcaugucuaug

SEQ ID NO: 165111 - RNA, 64 nt, Human
cauugggguuuguagucccaacuugcugcugucaccaccaaacucaaucauuuuuuucccuugu

SEQ ID NO: 165112 - RNA, 64 nt, Human
agauagaccuguacauguauuuuaagcaggaaaaccaccaaaauucaaacgaacccuuaaaggg

SEQ ID NO: 165113 - RNA, 64 nt, Human
ggguaagauuugccuuaacaguacuauuuucucgccaccaaaaaaaaaaaaaaaaaaaaaaaaa

SEQ ID NO: 165114 - RNA, 64 nt, Human
ccuggccaccacaccggccugugccccuugaagcccaccaaagcggcccucacuuguggucagu

SEQ ID NO: 165115 - RNA, 64 nt, Human
auacucuuaaaaaaaaacaauaauuugugaauuaccaccaaaaggcaauggcaguccuacauuu

SEQ ID NO: 165116 - RNA, 64 nt, Human
aauagucaugcuuuaaauauggcuuuaaauuaugccaccaaaauggugcacuucacagauucac

SEQ ID NO: 165117 - RNA, 64 nt, Human
auuucacccuggagauauuuuuucuuauuugaguccaccaaaggauaaugccaacuuauauaag

SEQ ID NO: 165118 - RNA, 64 nt, Human
guuagaggagagcuugaugugauuaucuucaaacccaccaaaccaacaggauaauugacaaaua

SEQ ID NO: 165119 - RNA, 64 nt, Human
auccauggggagcugagaaaucagacucaaaguuccaccaaaaacaaauacaaggggacuucaa

SEQ ID NO: 165120 - RNA, 64 nt, Human
uaaaagucugugacuugaaguuuagucagcacccccaccaaacuuuauuuuucuauguguuuuu

SEQ ID NO: 165121 - RNA, 64 nt, Human
cuugaacccaacagucccuuaugagcgucacugcccaccaaaggucaaugucaagagaggaaga

SEQ ID NO: 165122 - RNA, 64 nt, Human
gaucauuucugccaugauguuuacaagauggcgaccaccaaagucaaacgacuaaccuaucuau

SEQ ID NO: 165123 - RNA, 64 nt, Human
gaaugaggaauuuuaaacacacauuugauuacagccaccaaaaaaauagacguaaaaauaaagg

SEQ ID NO: 165124 - RNA, 64 nt, Human
auuuaucuuucuaaauucuauuuuuaauacuguuccaccaaagugaugcagugguuaccaugac

SEQ ID NO: 165125 - RNA, 64 nt, Human
aauugccuuagguggagaacuuaauuccuaguauccaccaaacuuaacuccguaucuccauaug

SEQ ID NO: 165126 - RNA, 64 nt, Human
auaacuugaaaaaaaaaauuaaaaccguggccagccaccaaauuguggacacuguuuauauacu

SEQ ID NO: 165127 - RNA, 64 nt, Human
aaaauucaagaacucuuuuauuguugauuuggugccaccaaauucuuuuucuuuuuaaaucuuu

SEQ ID NO: 165128 - RNA, 64 nt, Human
uaggggcuguacaguauuguggcaucagauaaugccaccaaaggagacauaucacugcugcugg

SEQ ID NO: 165129 - RNA, 64 nt, Human
uccauggugccuccccaaaucauaagaccaaagaccaccaaacgcaggguggacucugcucauu

SEQ ID NO: 165130 - RNA, 64 nt, Human
uuuccuugccaacaggucccuuccucuccaucucccaccaaacuagggcaccauugauuagaca

SEQ ID NO: 165131 - RNA, 64 nt, Human
agaggagcuggcuagucaggaacuuauucauuaaccaccaaaccucuaccucuucucuccuuga

SEQ ID NO: 165132 - RNA, 64 nt, Human
aguacuuuuauacauaagauaaacaaaaaccuuaccaccaaacauaccaaaaugcaccucuuuc

SEQ ID NO: 165133 - RNA, 64 nt, Human
gccuuugcagaagcugaugguuacagagcuagucccaccaaagcuacucucucugcugcuuaga

SEQ ID NO: 165134 - RNA, 64 nt, Human
acugccccaacauagccuugaggaggcuucucagccaccaaaggguucuggccccuucucacuc

SEQ ID NO: 165135 - RNA, 64 nt, Human
gggauaaagguaauagagcccuucugccccccacccaccaaauuuacacaacaaaaugacaugu

SEQ ID NO: 165136 - RNA, 64 nt, Human
aacuguuccguuugucaucugucauggucuccuuccaccaaaucuucaucugggaauagcagcg

SEQ ID NO: 165137 - RNA, 64 nt, Human
auccguccuuggcucaggauuuggagagcuugcaccaccaaaaauggcaaacaucaccagcucc

SEQ ID NO: 165138 - RNA, 64 nt, Human
cccucaggggaggugggccaugcagcuaacccacccaccaaagacccccucacccuggccccuu

SEQ ID NO: 165139 - RNA, 64 nt, Human
ccuuuccauagcuccacagcuucccaccuccuccccaccaaaccgggguucuagaguuaaggau

SEQ ID NO: 165140 - RNA, 64 nt, Human
ucucccucuacuacuggaugaaaugucugcauuuccaccaaaaucuacccagucacccagggaa

SEQ ID NO: 165141 - RNA, 64 nt, Human
ugucucaaaaauaaaugaauaaaauaaaaaccugccaccaaauuauuucuggauucucuucacu

SEQ ID NO: 165142 - RNA, 64 nt, Human
cauauaauggaacagaagcucugguauggcuuuuccaccaaaagccugaaucugucaauccucu

SEQ ID NO: 165143 - RNA, 64 nt, Human
agcuugccuauuucugccuaaucauguacauuauccaccaaaaauuaggucaucauaguugagg

SEQ ID NO: 165144 - RNA, 64 nt, Human
aacauggaaauaucaccaaaaaauacuuaauaguccaccaaaaggcaagacugcccuuagaaau

SEQ ID NO: 165145 - RNA, 64 nt, Human
agguuggugguuuuuauuuuccucuaaguuccuuccaccaaauaaauauuacguaaaaaauuca

SEQ ID NO: 165146 - RNA, 64 nt, Human
aauggacaaaauaugugaaacaacgguuugcaagccaccaaauaccagggagugaaggauagug

SEQ ID NO: 165147 - RNA, 64 nt, Human
gucagugcacuuguccuuacgucaguuccuuacaccaccaaagcacuucaccuuucuggaaaua

SEQ ID NO: 165148 - RNA, 64 nt, Human
ugaagaugacacugacgugaaccaguaucuuuuaccaccaaagucauugcugcgauaugcucuu

SEQ ID NO: 165149 - RNA, 64 nt, Human
aaaaugguauucaaauucuggaauggaaaucuagccaccaaaacggguuaaucaaaagacgucc

SEQ ID NO: 165150 - RNA, 64 nt, Human
uuuaaaagccugagcaaggaccaccacccccuccccaccaaauuauucggucucuuucuggggg

SEQ ID NO: 165151 - RNA, 64 nt, Human
cuaagcaauucuguccucugauucccaccccuacccaccaaaaaaugguagacaugaaaggcag

SEQ ID NO: 165152 - RNA, 64 nt, Human
caaaauccagugaagaaacaccacccguccaguaccaccaaaguaguucucugucauguguguu

SEQ ID NO: 165153 - RNA, 64 nt, Human
ccugugaaccaaaguucucaggccaaggucucgcccaccaaagccagaaagugcaagcacccgu

SEQ ID NO: 165154 - RNA, 64 nt, Human
gcuuagugccacaugcaccccacucauuccaaagccaccaaacugccaggggcugccguccacc

SEQ ID NO: 165155 - RNA, 64 nt, Human
cugaaccagaggaaguggaagaagagaaagacagccaccaaaaagggcacggcggcccccuacu

SEQ ID NO: 165156 - RNA, 64 nt, Human
cacacuguguuaugccagcucaaaucuacaguagccaccaaaaccaugacuuaauauuuugagc

SEQ ID NO: 165157 - RNA, 64 nt, Human
guucuuucggagccauccuguugaucaugcagcuccaccaaaccuuagggggacgugaaaucac

SEQ ID NO: 165158 - RNA, 64 nt, Human
gccccugccaccuccugccucagguguccgcuauccaccaaaagggcucccugagggucugggc

SEQ ID NO: 165159 - RNA, 52 nt, Human
caccacuuaaugagguuugaggccaccaaaagaucaacagacaaaugcucca

SEQ ID NO: 165160 - RNA, 64 nt, Human
acugucacuuuauggacugucugugcaauuacguccaccaaagacccguguuggggguacugaa

SEQ ID NO: 165161 - RNA, 64 nt, Human
ugugaccgccgaacuccacugcaacagacgggcgccaccaaagccaggcccugaggccugggag

SEQ ID NO: 165162 - RNA, 64 nt, Human
cacauugccaagauuucacacaugugaccaggggccaccaaagucccugugaccuuugugacua

SEQ ID NO: 165163 - RNA, 64 nt, Human
aucucagcaaucacaagccaaggucugaacccuuccaccaaaaacuggguguucaaggcccuua

SEQ ID NO: 165164 - RNA, 64 nt, Human
ccaaaaucugugaaaagauuugaaucugauaucuccaccaaagccuugauguuuucucuguaca

SEQ ID NO: 165165 - RNA, 64 nt, Human
ucagccucucaaguagcgggauuacaggcgcccaccaccaaaaauuagcccagcuaauuuuugu

SEQ ID NO: 165166 - RNA, 64 nt, Human
uaaucugccuguaucuauaggugggcaucucacuccaccaaaggagcccagccucucuuugucc

SEQ ID NO: 165167 - RNA, 64 nt, Human
caggcacuaaucaccuggugaggauuuggcauauccaccaaaaaaugcauccgauuuaaccaac

SEQ ID NO: 165168 - RNA, 64 nt, Human
gugcucucuccacuaccccacaccagccuuggugccaccaaaagugcuccccaaaaggaaggag

SEQ ID NO: 165169 - RNA, 64 nt, Human
agcccugccucauaacuaaauaauaaaaauuauuccaccaaaaaauucuaaaacaaugaagaug

SEQ ID NO: 165170 - RNA, 64 nt, Human
ggagcaaagugguugggaaacucauuuacuggguccaccaaaggaaacccaauucugccauguu

SEQ ID NO: 165171 - RNA, 64 nt, Human
aaauagcugaggguuguuggcuuguuguagcugaccaccaaaagcagucacugcaaaucuuuua

SEQ ID NO: 165172 - RNA, 64 nt, Human
aaacucuugagaucuugguccuguguuuuuucugccaccaaaggccagggucacugaaggccug

SEQ ID NO: 165173 - RNA, 64 nt, Human
ccauauugugcuucacaguagagccagcuuggggccaccaaagcugcccacuguuucucuugag

SEQ ID NO: 165174 - RNA, 64 nt, Human
uauuuaaauuaauuauuuaaauguguauauauugccaccaaauuauuuauaguucugcgggugu

SEQ ID NO: 165175 - RNA, 64 nt, Human
ggacagauucucaaugccuuuuugaaguucugacccaccaaagaccuucugccuucacccuccu

SEQ ID NO: 165176 - RNA, 64 nt, Human
uggaggguggaagguccugugcaggacagggaggccaccaaaggggcugcugucuccugcacau

SEQ ID NO: 165177 - RNA, 64 nt, Human
accuguggccagagcaccucaggacccuccccacccaccaaaugccucugccuugauggagaag

SEQ ID NO: 165178 - RNA, 64 nt, Human
cuuccccuucccaaaacagaguucauaugcacuuccaccaaaguaaugccaaugaaagugcucg

SEQ ID NO: 165179 - RNA, 64 nt, Human
guucauggaauucugaucuuggcccauaggugaaccaccaaaauagugcucgagucuuagguua

SEQ ID NO: 165180 - RNA, 64 nt, Human
aucaggaaccucuccaccacacugcaaacaauagccaccaaauuaugucgugagcuauauagca

SEQ ID NO: 165181 - RNA, 64 nt, Human
uguuuauucuaguuaaggaaauguugagggcaagccaccaaauuaccuaggcugagguuagaga

SEQ ID NO: 165182 - RNA, 64 nt, Human
aguguucguguguuugucguagcacccagagccuccaccaaacccucuccaugucuuuaccucc

SEQ ID NO: 165183 - RNA, 64 nt, Human
cuccccagcuugcugcuccugccucauccccuucccaccaaaccccagacucugugaagugcag

SEQ ID NO: 165184 - RNA, 64 nt, Human
uaaaucacgucuuauuuuccugagguuuuucacuccaccaaaucuuacaaaucauugaaagaaa

SEQ ID NO: 165185 - RNA, 64 nt, Human
aacauuaaaccuuaaccaaagaagaacuuuaccgccaccaaaacagaaacaaccccaaacagcc

SEQ ID NO: 165186 - RNA, 64 nt, Human
gcgcuguucucccauccucccuaccccauccucuccaccaaaucgcucccaauuuugagagcca

SEQ ID NO: 165187 - RNA, 64 nt, Human
agucucccuccauggagacaaaggcuucccagagccaccaaaaaccuucuuagcaggacagcug

SEQ ID NO: 165188 - RNA, 64 nt, Human
auacuuguauagaguaauaacaacaguuguacuuccaccaaaggcauguggcauauuuaccaau

SEQ ID NO: 165189 - RNA, 64 nt, Human
uuuuuccauaagcuuuauuccuucucucuaccugccaccaaaaagaaagaaacccucaagaguu

SEQ ID NO: 165190 - RNA, 64 nt, Human
aaaagcaugagcuggccacacauguaauccauaaccaccaaaaauacuauggagagcuacacug

SEQ ID NO: 165191 - RNA, 64 nt, Human
augcacaaguuauaaauacagaagaaagagcaacccaccaaaccuaacaaggacccccgaacac

SEQ ID NO: 165192 - RNA, 64 nt, Human
cuuuuuauagcccagcacagaauuuaaagccauaccaccaaaaguaccuguguguguuaauaug

SEQ ID NO: 165193 - RNA, 64 nt, Human
aaaaagaaacuuugcacgguaugagcuucauaccccaccaaacaaagucuugaagguauuauuu

SEQ ID NO: 165194 - RNA, 64 nt, Human
uugaccagaaaacaaugauuuuauaauauuuaacccaccaaaaagucccuccaacagcaauauc

SEQ ID NO: 165195 - RNA, 64 nt, Human
acauucugacacaagaugcaagucugugcaaaacccaccaaaaugcuccuauccaacaauuauu

SEQ ID NO: 165196 - RNA, 64 nt, Human
cacagucaccaaaugacaaggauuugccacuuucccaccaaauugugagugcuuguaauuuagg

SEQ ID NO: 165197 - RNA, 64 nt, Human
accaaggaacuauguacaaaaacaaaccuaccaaccaccaaaaacuagacaaauaaagacaaac

SEQ ID NO: 165198 - RNA, 64 nt, Human
aagaggcggaacucuacaucauuaguaagagguuccaccaaagucuaaaguuguauucacuugu

SEQ ID NO: 165199 - RNA, 64 nt, Human
ccccacccagcccacccauugaagucuccuugggccaccaaaggugguggccaugguaccgggg

SEQ ID NO: 165200 - RNA, 64 nt, Human
gccugacagaaagcccguauuuguaagaugcuuaccaccaaauaaauguacauagacugugcuu

SEQ ID NO: 165201 - RNA, 64 nt, Human
acuguguugcuuaaauaucaaguauuguuuauaaccaccaaaaaaaaaaagcccugguaguuuu

SEQ ID NO: 165202 - RNA, 64 nt, Human
aagcaaaugcacucugcuuuuugcugcuguaagaccaccaaaaaugagucagaaacacagaaga

SEQ ID NO: 165203 - RNA, 64 nt, Human
auucucuaucauguugaagucaaauuuggauuuuccaccaaauucugaauuuguagacauacuu

SEQ ID NO: 165204 - RNA, 64 nt, Human
cccugcuggcugccucacugcuuacagacaggucccaccaaacccaaacaccugccuaggguaa

SEQ ID NO: 165205 - RNA, 64 nt, Human
uguauuguaauacugauacaguuuggcuguguccccaccaaauugaauuguguuaauaguuccc

SEQ ID NO: 165206 - RNA, 64 nt, Human
aaaacagauugugauaagaaaagccagucaaaacccaccaaaaccaagauggcgacaaaaguga

SEQ ID NO: 165207 - RNA, 64 nt, Human
agaagaauugguccaguuaagugcaugcaaaaagccaccaaaugaagggauucuauccagcaag

SEQ ID NO: 165208 - RNA, 64 nt, Human
gaucaaaagcauucuagccaugugcaaccaaacaccaccaaaaauaaaaucaaacaaaacuaag

SEQ ID NO: 165209 - RNA, 64 nt, Human
ugaacaccacgcuguagucuccaacagaaaaacaccaccaaaacagauacccauguugaggggu

SEQ ID NO: 165210 - RNA, 64 nt, Human
auauugaagucucaacugucucuguucacaagagccaccaaaaguuaggggacuucaguccuag

SEQ ID NO: 165211 - RNA, 64 nt, Human
uuagggugucuaaucccuuuacacaagauugaagccaccaaacugagaccuugauaccuuuuuu

SEQ ID NO: 165212 - RNA, 64 nt, Human
caugugcauaguuucuuuauuuuguguaaaaaaaccaccaaaaacaaaaaccaaauguuuauuu

SEQ ID NO: 165213 - RNA, 64 nt, Human
acaaaaaaaacacaaaaauuucaaaaaacaccacccaccaaauugcacaauagauacacccaca

SEQ ID NO: 165214 - RNA, 64 nt, Human
ggucucacuguguugcccaggcuggucucaaacuccaccaaauguacuucuuauucauuuuaug

SEQ ID NO: 165215 - RNA, 64 nt, Human
acuaaagaggacgccguccuuaaaaccugacgugccaccaaagccuuccuuuguuccucaaacc

SEQ ID NO: 165216 - RNA, 64 nt, Human
augauuuucuguugacaacuuuugcaaugcuuucccaccaaagugcuuacuuguaaagaaaacu

SEQ ID NO: 165217 - RNA, 64 nt, Human
cccaggugggagccaacugucagggaggucuuucccaccaaacaucuuucagcugcugggaggu

SEQ ID NO: 165218 - RNA, 64 nt, Human
auuaaaaaugugucugaauagcgauuuugcuuugccaccaaaaggcuuuucccugagaacagug

SEQ ID NO: 165219 - RNA, 64 nt, Human
auacaagauuauacaaucucuuuauuacugagggccaccaaauagccuaggaagugcccucgag

SEQ ID NO: 165220 - RNA, 64 nt, Human
guuaagaaaucgagaguggauuagacucccaguuccaccaaaccuaugagccuuccacugugga

SEQ ID NO: 165221 - RNA, 64 nt, Human
ucggugaagaaaccguauccauaaagacccgauuccaccaaaugugcuuugagaaggauaggcc

SEQ ID NO: 165222 - RNA, 64 nt, Human
agcugcuggugccuuagugugaaucaagguagugccaccaaaguguacuuguaguuucuguauu

SEQ ID NO: 165223 - RNA, 64 nt, Human
gaugaggugaagaucacugucaucuaaaagcaggccaccaaauuuaaaaaaaaaaaguuauggg

SEQ ID NO: 165224 - RNA, 64 nt, Human
uaguuuguuauuuuuaaaauguuuauacauaaaaccaccaaaauacauagcuucgacaagaugg

SEQ ID NO: 165225 - RNA, 64 nt, Human
uuuggaauagcauuagacccuggcuguccccuccccaccaaauaaacaugauauuucauucucu

SEQ ID NO: 165226 - RNA, 64 nt, Human
gccaaggaggugaggagcagagcaggcaauuucaccaccaaaugccaagaaaagggcugacauu

SEQ ID NO: 165227 - RNA, 64 nt, Human
auucggucagccugucaggucgugaguccaguuaccaccaaacaucugggaaacuucugggugc

SEQ ID NO: 165228 - RNA, 64 nt, Human
agggcagaagacacugcucuuuguaacccagccaccaccaaaaagcaaacagaaagaaggaagg

SEQ ID NO: 165229 - RNA, 64 nt, Human
auguagaagacacuaauugcacaaaauagcacauccaccaaacuccugccugagaauguuacca

SEQ ID NO: 165230 - RNA, 64 nt, Human
uucaccaguguucagcauggcagucgugcuuuagccaccaaagacaugaggaaaucacagggua

SEQ ID NO: 165231 - RNA, 64 nt, Human
gagucacagcgaauccccgccccgccccgggaagccaccaaaccuugcuuuuucucaucugcaa

SEQ ID NO: 165232 - RNA, 64 nt, Human
uucccagcaacacuccggucagccccuggcaaucccaccaaaucauccugaaucugaucuuuuu

SEQ ID NO: 165233 - RNA, 64 nt, Human
aggcccugcccggggcuggggccuaguccagcagccaccaaagucuggcagacuuucugcauuu

SEQ ID NO: 165234 - RNA, 64 nt, Human
ugugaaaaacgugauuccugggccccaccaagacccaccaaaaccaucucuggggcuuggugca

SEQ ID NO: 165235 - RNA, 64 nt, Human
ucaggaauucugccuaaguugucugccuuuucuaccaccaaaaagacuuuuaguuuucuaugcu

SEQ ID NO: 165236 - RNA, 64 nt, Human
ccacccuuuggaaacuccccauugucacugagaaccaccaaaucugacuuuuacauuuggucuc

SEQ ID NO: 165237 - RNA, 64 nt, Human
cuccugaagccucugggaacuccuccuguggccaccaccaaaggaugaggaaucugaguugcca

SEQ ID NO: 165238 - RNA, 64 nt, Human
ucacaccccaaaaugacccaacgauguccacacaccaccaaaacccagccaaugggccaccucu

SEQ ID NO: 165239 - RNA, 64 nt, Human
uuguguauuaauuuuuuuucuuguccauaucacaccaccaaaggcuuuuggaccauuuagcauc

SEQ ID NO: 165240 - RNA, 64 nt, Human
cauauuuuagugucaaggcagauuaguuauuuagccaccaaaaaaaaguauuguguacaauuug

SEQ ID NO: 165241 - RNA, 64 nt, Human
ucguuggaagcuuaacuuuuguugccucuuaacgccaccaaauuuuaggguaauuugauuauga

SEQ ID NO: 165242 - RNA, 64 nt, Human
cagccuccugaguagcugggacuacaggcacaggccaccaaaccuggcuaauguuuaaauuuua

SEQ ID NO: 165243 - RNA, 64 nt, Human
gcugguggcacugccccucccugacccagacaucccaccaaagcuaacuuucccccaccccuga

SEQ ID NO: 165244 - RNA, 64 nt, Human
agaccauccuggcuaacacggugaaacccugucuccaccaaaaauacaaaaaaucugccgggcg

SEQ ID NO: 165245 - RNA, 64 nt, Human
acgugagguuccuuggcguuguuuaaggucaacuccaccaaauacagcaaccagcuggggcuug

SEQ ID NO: 165246 - RNA, 64 nt, Human
caaccuauaucucccuugaaaauacuuucaggcuccaccaaaacguagaacugaaagcauguau

SEQ ID NO: 165247 - RNA, 64 nt, Human
accuaauccuaaggauccacaguuucagcagcauccaccaaaagucacuuuuccaacuuaugug

SEQ ID NO: 165248 - RNA, 64 nt, Human
guggagaccuugcaccuuguaaucaucaauacauccaccaaaaauauauaauguaccauauaua

SEQ ID NO: 165249 - RNA, 64 nt, Human
uaaauaccccacagcaaauagaguaacugacaaaccaccaaaaacugaaaccccagacccacca

SEQ ID NO: 165250 - RNA, 64 nt, Human
caauauucucucucagaaaucaauggcauuugaaccaccaaaaagaaauaaagggcugagugcg

SEQ ID NO: 165251 - RNA, 64 nt, Human
agauaagaggacagaagaauggagaugggaaaauccaccaaauuccaacccaaacccaacuuuc

SEQ ID NO: 165252 - RNA, 64 nt, Human
cuagacucuacauagaaacugaacaucaagaaccccaccaaaauauuacuuuuaaaaacaauga

SEQ ID NO: 165253 - RNA, 64 nt, Human
ucauuaaauuuguaaugauguuuaaugaacauuuccaccaaacauuauuuccucuaaaaauguu

SEQ ID NO: 165254 - RNA, 64 nt, Human
uguaaaguuucuguaaaucuauuucauaucugacccaccaaacagauuucucuuuaauaaaaau

SEQ ID NO: 165255 - RNA, 64 nt, Human
ggauauuguguucaagaaugauuccaaauuugagccaccaaaauacacugcauuacagaaauug

SEQ ID NO: 165256 - RNA, 64 nt, Human
ucuuguagcauggauuauucuucucauguuaaacccaccaaaauaaaggggacuaaauagguaa

SEQ ID NO: 165257 - RNA, 64 nt, Human
ccugauaggaagaggggaagcagaaauccaagcaccaccaaacacaguguaugaaggggggcgg

SEQ ID NO: 165258 - RNA, 64 nt, Human
cugaauggcuucauuucagauuuaguugauuucuccaccaaaugcaugucauguauucucaaua

SEQ ID NO: 165259 - RNA, 64 nt, Human
accacugaaacacuucgagcuauuuagcuaaagcccaccaaaccaaaacaaaauacugauuuuu

SEQ ID NO: 165260 - RNA, 64 nt, Human
ggguggccccgccgaggcuucaggggcccccuccccaccaaaggguucaccucacacuugaaug

SEQ ID NO: 165261 - RNA, 64 nt, Human
cgggccggaaauggcgugaccaccccauccuucuccaccaaagacaguugcgcgccugcuccac

SEQ ID NO: 165262 - RNA, 56 nt, Human
uggcugaccuucuugucugagccaggccaccaaagccaugccguaagcauacucuu

SEQ ID NO: 165263 - RNA, 64 nt, Human
ucucuauuaaaaaaaaaaaaucaacccuucuuccccaccaaaccacccaacuccucucuacucu

SEQ ID NO: 165264 - RNA, 64 nt, Human
aggggagaaaacuucagcacgucucaacagaagaccaccaaauggccaauaaguaagugaaaau

SEQ ID NO: 165265 - RNA, 64 nt, Human
ccuggucacucugggaaccuggauuucaccggcuccaccaaauuagugccucuuagaugaugug

SEQ ID NO: 165266 - RNA, 64 nt, Human
acccaaugaugcaaaaaacaaaaacaaaaaaaaaccaccaaauccccaaauucauuccagaucu

SEQ ID NO: 165267 - RNA, 64 nt, Human
ugaggacuggagcuguuugguuuucucgcauuuuccaccaaacuggaagcuguuuuugcagccu

SEQ ID NO: 165268 - RNA, 64 nt, Human
acuugcaaacaggcugauaccuuugugaaguugcccaccaaaacacagaaggaaaaaaacauga

SEQ ID NO: 165269 - RNA, 64 nt, Human
cugagaugaaaugugguaaaucaacuccacagaaccaccaaaaagaaaaugaggguaauucagc

SEQ ID NO: 165270 - RNA, 64 nt, Human
uaaaacagauugcaguaaagaagccaaccaaaucccaccaaaaccaaguuggccacgagaguga

SEQ ID NO: 165271 - RNA, 64 nt, Human
ugaaaugaggggacccugacuggagaggugggggccaccaaaaacccacaaaggccccggagcu

SEQ ID NO: 165272 - RNA, 64 nt, Human
caugaaaaaguauuccgcugggaauugagccaugccaccaaagccaagaggagcgcauggaaac

SEQ ID NO: 165273 - RNA, 64 nt, Human
cgaaugaacgaaacauuggggaucucugccgaaaccaccaaagggcaugucugaugggcacagg

SEQ ID NO: 165274 - RNA, 64 nt, Human
gggucuuggugucacugccgcucaugcauagaaaccaccaaaagccccaauaaagcauccagga

SEQ ID NO: 165275 - RNA, 64 nt, Human
uccuggguuugcuucugaccuugucaugugugugccaccaaacacguuauuggcaccuuuuuaa

SEQ ID NO: 165276 - RNA, 64 nt, Human
uuuuggcagagaaauuuucagcugugcuugauacccaccaaaagaauguaucucgaaagaauga

SEQ ID NO: 165277 - RNA, 64 nt, Human
aaaagaccugcaacauugaaaaaacucauuuuuuccaccaaaaccuuggccagguaaccuaccu

SEQ ID NO: 165278 - RNA, 64 nt, Human
aacauaaagauucauuucucucccacccucaacuccaccaaaguaaauccuuucgauaguaaaa

SEQ ID NO: 165279 - RNA, 64 nt, Human
aaccuccuuggacugcaaacaaucuaggacaccuccaccaaaccuccucuugcacuuucccucu

SEQ ID NO: 165280 - RNA, 64 nt, Human
gccacugagggaauccuccacguggcugucccagccaccaaaacccaugcacagugcugcagaa

SEQ ID NO: 165281 - RNA, 64 nt, Human
acgcuuucacaccaauccguacaugcugcuuccuccaccaaaaaugcccaauucaggcagaccc

SEQ ID NO: 165282 - RNA, 64 nt, Human
gagacuuggaauauggaagaagcaauacccaaccccaccaaagaaaaccugagcuugaaguccu

SEQ ID NO: 165283 - RNA, 64 nt, Human
ggcccuccuccuuuuccacagccacucacuggggccaccaaaacccagagauggcaggugugug

SEQ ID NO: 165284 - RNA, 64 nt, Human
uuuuaaaacuuggauggagagaugagaagcaauuccaccaaacucauguuuucacaggaggguu

SEQ ID NO: 165285 - RNA, 64 nt, Human
cuuuauuuuuuagauugcugcagcaaaaccaacuccaccaaaaagccagguaacauuaacaaaa

SEQ ID NO: 165286 - RNA, 64 nt, Human
uuuaacccuuguccccugaccucaguucugugccccaccaaaugcccaggggcaagaggccacc

SEQ ID NO: 165287 - RNA, 64 nt, Human
aauguugugaagguuaaagauaaauuaagauuauccaccaaaugcuaaaaauacugauguguaa

SEQ ID NO: 165288 - RNA, 64 nt, Human
gaggcugugagauguucugacccucacccacuguccaccaaaagccucuccugcugaugggcac

SEQ ID NO: 165289 - RNA, 64 nt, Human
cccagggcucugccagggccuugcucagucccuuccaccaaagucaucugaacuuccguuuccc

SEQ ID NO: 165290 - RNA, 64 nt, Human
gauuaguuagaauucacugccagguuucuucugcccaccaaaaugauccagucuggaauaacau

SEQ ID NO: 165291 - RNA, 64 nt, Human
cuugcccugggucagaggaccggggcagccccugccaccaaaggacuugaucugaguugggagu

SEQ ID NO: 165292 - RNA, 64 nt, Human
caggagcauuugcaugcaguggguggagagucggccaccaaaggaccgaguugcgcucggaauu

SEQ ID NO: 165293 - RNA, 64 nt, Human
ucuugcugcuccuggcguggaaacuuaagugagaccaccaaauacauugguccuguccaauucu

SEQ ID NO: 165294 - RNA, 64 nt, Human
uggcuugaaccuucaaagcuuuuguaaaauaaaaccaccaaaguccugaaauuguggguguguc

SEQ ID NO: 165295 - RNA, 64 nt, Human
caaaaauuuaaaaucuuaaauguguaagucacccccaccaaaaacaaaagagaagaaaaagaau

SEQ ID NO: 165296 - RNA, 64 nt, Human
cccccaaaagaugugcaauagcuguuguuacaaaccaccaaauaauacaguugugagccugaau

SEQ ID NO: 165297 - RNA, 64 nt, Human
uccaggugccuuaauauaaaguuugaagcuucauccaccaaaguuaaauagagcuauuuaaaaa

SEQ ID NO: 165298 - RNA, 64 nt, Human
gaacaugaaaauuuucaaauuuugaaucugaaagccaccaaauguaucuuuauguauaaauccu

SEQ ID NO: 165299 - RNA, 64 nt, Human
uauuggcuucuguuucauauggacccagagagccccaccaaaccuacgucaagauuaacaaugc

SEQ ID NO: 165300 - RNA, 64 nt, Human
aauaauguacucauguaaccaaaugcuaccuguuccaccaaaaccuauggaaauuuaaaaaaaa

SEQ ID NO: 165301 - RNA, 64 nt, Human
caccuugaugucugcugugacaucagaggugccaccaccaaagcacucuucccacccuagucuu

SEQ ID NO: 165302 - RNA, 64 nt, Human
uccauuuuuaauaaaacgccaaaaauaucacaacccaccaaaaauagaugccucucccccucca

SEQ ID NO: 165303 - RNA, 64 nt, Human
aucagacagcugcucugcaguacagauguguaucccaccaaacuaauguagauguacaaacacu

SEQ ID NO: 165304 - RNA, 64 nt, Human
agaaaauagaugaaaaauuaggguacacagcuggccaccaaaugcgaagucaaucugcuacuua

SEQ ID NO: 165305 - RNA, 64 nt, Human
cuuuaucuugcuuaacuuauccuccuuuccuuccccaccaaaauugggauuguucuaaacaauu

SEQ ID NO: 165306 - RNA, 64 nt, Human
gcaucaggcuccccaagccccacagcucuccuuuccaccaaagccagguuuccugguaagguca

SEQ ID NO: 165307 - RNA, 64 nt, Human
uacuguucuauuauuuguuuugacuugaauuuauccaccaaagacuucauuuguguaucaucaa

SEQ ID NO: 165308 - RNA, 64 nt, Human
cugaugcugauuuggccagagaugaccucaaggcccaccaaauagagcacaacuucccauuggg

SEQ ID NO: 165309 - RNA, 64 nt, Human
gggucaagcuuucaucagccccagcccccacacuccaccaaaguucucaugcacuaugcacuca

SEQ ID NO: 165310 - RNA, 64 nt, Human
aaguaaaguucuucugaagugcugcuccauguuuccaccaaaugaauuuuuuuuauccuccuga

SEQ ID NO: 165311 - RNA, 64 nt, Human
gacuagacagaaguggggcggccugaacccugcuuccagccauggccaggggccacggaacccg

SEQ ID NO: 165312 - RNA, 64 nt, Human
ggcagccucuagaguugcuuuacccaaauccuucuccagccaugacuuggugacucuaagcuug

SEQ ID NO: 165313 - RNA, 64 nt, Human
auaguaacaaauuaggaaaacagcuccccuccccuccagccauguaaguccuccugauucugua

SEQ ID NO: 165314 - RNA, 64 nt, Human
ugaguggacguguuggaagagagaagcaccaugguccagccaccaggcucccugugucccuucc

SEQ ID NO: 165315 - RNA, 64 nt, Human
aaggaccagcuggguccccuuugcuuucuuguguuccagccaccugccauuuccucccugccuc

SEQ ID NO: 165316 - RNA, 64 nt, Human
cugauugugagacccaaauguguaggcucuaaauuccagccaucaaauccaauuccuggugggg

SEQ ID NO: 165317 - RNA, 64 nt, Human
gucaagcaaacgagaaguacgaacaucugauucuuccagccauguuucccagucugaagaacaa

SEQ ID NO: 165318 - RNA, 64 nt, Human
cagacgcucugggagccaguuccuaguccucaacuccagccaccugccccagcucgacggcacu

SEQ ID NO: 165319 - RNA, 64 nt, Human
agauggggaagaaauaccccagacccaacaaaccuccagccagaaagccagcuauuuugcauuu

SEQ ID NO: 165320 - RNA, 64 nt, Human
auguuuccagugaagucaauugaguaaggacaccuccagccauacagaaaccaacacugugugg

SEQ ID NO: 165321 - RNA, 64 nt, Human
uuguuaagcagagucagcagugagguccucauucuccagccagccucucugcccuggagaauca

SEQ ID NO: 165322 - RNA, 57 nt, Human
ccacagcugaggaggccugagcugccauccagccagaacguggcucugcuggccgga

SEQ ID NO: 165323 - RNA, 64 nt, Human
caagagagugagacuccguuuugugccacugcacuccagccagggugacagagugagacucugu

SEQ ID NO: 165324 - RNA, 64 nt, Human
ccugccaccccucccugcagccuccgcggcucacuccagccaucccuucuguuucuccuucucu

SEQ ID NO: 165325 - RNA, 64 nt, Human
aaggaauuucuuuccuuucccuuggcuggcuggguccagccaucuccggccagcaacccuguca

SEQ ID NO: 165326 - RNA, 64 nt, Human
ucuacaggcacacuucugagguacgguaucucucuccagccacucugauaccaaguaauucaag

SEQ ID NO: 165327 - RNA, 64 nt, Human
ccugagccccaaacccuccucagggugguugaguuccagccaugcucccuauaaaugucaugug

SEQ ID NO: 165328 - RNA, 64 nt, Human
uuagagaaauugugaaacaagcaaaacaaaacuuuccagccauuuuacugcagcagucugugaa

SEQ ID NO: 165329 - RNA, 58 nt, Human
ccagcccccugguguucuaggugucaccuccagccacaccggacgggccugugccgug

SEQ ID NO: 165330 - RNA, 64 nt, Human
guggcuacauuacuucagauuccccuaaugucuuuccagccagacuuggaaucauggagggaaa

SEQ ID NO: 165331 - RNA, 64 nt, Human
cacaagcugcacccucaggcaggugggauggauuuccagccaaagccuccuccagccgccaugc

SEQ ID NO: 165332 - RNA, 64 nt, Human
acacagaagugugcauggcccaaggacaaggaccuccagccaggcuucauuuaugcacuugugc

SEQ ID NO: 165333 - RNA, 64 nt, Human
ugacuggcuaguagucucuggcacccuguccgucuccagccagccagcucauuucacuuuacac

SEQ ID NO: 165334 - RNA, 64 nt, Human
uaauucuacccucaggggccuguagauguugcuuuccagccaggaaucuaaagcuuuggguuuu

SEQ ID NO: 165335 - RNA, 64 nt, Human
ccaguagacuccccagucccauaauuguguaucuuccagccaggaauccuacacggccagcaug

SEQ ID NO: 165336 - RNA, 64 nt, Human
uuccucuguccggagaggcacaggugucaccaguuccagccaaaggcuccucacaggcgcugug

SEQ ID NO: 165337 - RNA, 64 nt, Human
cucacaguccugcacaccugcuggccuggggagcuccagccaggcagcgaguccugccccgccc

SEQ ID NO: 165338 - RNA, 64 nt, Human
gguguaugaucuuagccucguccugaugccugaauccagccagcuguugcucugacccacagca

SEQ ID NO: 165339 - RNA, 64 nt, Human
gcgagcccaaagugccagucugcgauuggaaauuuccagccacuuuaagccagugcugaguagg

SEQ ID NO: 165340 - RNA, 64 nt, Human
accagccggccccaccccugcucgccccuaucgcuccagccaaggcgaagaagcacgaacgaau

SEQ ID NO: 165341 - RNA, 64 nt, Human
uuucuuccauaaacuacuauugugaucuauuuuuuccagccaugucacuaauugugaauuccua

SEQ ID NO: 165342 - RNA, 64 nt, Human
cucccaaucugccauuuguguguggcuagcuguuuccagccagggggcugaggcaccugcaguc

SEQ ID NO: 165343 - RNA, 64 nt, Human
agcugugccccaucccccaagccuccugggaggauccagccaaaucuugcgacuccuggcacac

SEQ ID NO: 165344 - RNA, 64 nt, Human
ugggucagacaucaaugucccuguccccccuggguccagccaagcugugccccaucccccaagc

SEQ ID NO: 165345 - RNA, 64 nt, Human
gcaggaucauggcugccaucaagccuuuucuggauccagccaucaaggacauguuuguggugug

SEQ ID NO: 165346 - RNA, 64 nt, Human
gaugaucgagguccccaguagcucugaacaagaguccagccaacccucuucagccaggccucug

SEQ ID NO: 165347 - RNA, 64 nt, Human
agaaguuucuagcacugaaaguuggaauugacacuccagccaaugauccuuccuucuuucauaa

SEQ ID NO: 165348 - RNA, 64 nt, Human
cuucauggacuggcucauaugugaaggcacguucuccagccaucagaggcccccuccuccucca

SEQ ID NO: 165349 - RNA, 64 nt, Human
agcaucuggcuuccaguguccagcaacagacguuuccagccacuuuccucgaaucaucccacuu

SEQ ID NO: 165350 - RNA, 64 nt, Human
agaugucagccgagccgggccuggggcuccuuucuccagccagcaaugauguccagaagaauau

SEQ ID NO: 165351 - RNA, 64 nt, Human
cccucugcugccaacugcucaaaccugcuuuagcuccagccacuuguggcaaacaaccucguuu

SEQ ID NO: 165352 - RNA, 64 nt, Human
guaccugccuccuucccagccaucccugacacauuccagccaguuggaucucacagcacagcua

SEQ ID NO: 165353 - RNA, 64 nt, Human
aggguuacggaccacugugguuauccucuaaaguuccagccagcucuaggaguuucuaaauuca

SEQ ID NO: 165354 - RNA, 64 nt, Human
agauuugugcauuuuauuuuccugaccaccucauuccagccaauguaugguuauccacucugug

SEQ ID NO: 165355 - RNA, 64 nt, Human
gucagcauagacugaggcacacuggcuccucagcuccagccacccucacuccugccaugugccu

SEQ ID NO: 165356 - RNA, 64 nt, Human
ccuccauaccucgaacaucaguugggaucccuccuccagccaagaugauccuucuuagagaagg

SEQ ID NO: 165357 - RNA, 64 nt, Human
cuccagccccacuucugaaaguaucagcuacugauccagccacuggauauuuuauauccucccu

SEQ ID NO: 165358 - RNA, 51 nt, Human
ccagcuuccccaagaugugacuccagccagccaaauccauccugcucuucc

SEQ ID NO: 165359 - RNA, 64 nt, Human
gggggagcuggcggacucccacuccccgcucccuuccagccaagcugccuuaacucgccccucg

SEQ ID NO: 165360 - RNA, 64 nt, Human
gcucugaccuaggcuucuugucacacugaacacauccagccacaggcaccagcugguugggacc

SEQ ID NO: 165361 - RNA, 64 nt, Human
cucccuguggaggaggcaguuagggaaacuaggauccagccaaggcccggggggagacccgcau

SEQ ID NO: 165362 - RNA, 64 nt, Human
uggggcuucagugucacuauuuucuccuuaaagcuccagccaaaaacuggacaaggauagagag

SEQ ID NO: 165363 - RNA, 64 nt, Human; identical to SEQ ID NO: 165333

SEQ ID NO: 165364 - RNA, 64 nt, Human
agucucuuggcggucccugagaguccugcugaaauccagccaguguuuuuugugguaugagaac

SEQ ID NO: 165365 - RNA, 64 nt, Human
gggaaaaguaaugagagaaguuucuagaagccacuccagccacuccuuccuggggcugacaaaa

SEQ ID NO: 165366 - RNA, 64 nt, Human
acuccucugccccuaaggcugugucccuguggucuccagccaccccuaccccagucacucgccc

SEQ ID NO: 165367 - RNA, 57 nt, Human
ggaccaggaccaagaagugaccguggcuccagccaccccgggacauugcuaagaugg

SEQ ID NO: 165368 - RNA, 64 nt, Human
uguggggcaggcuccguccucccugggagaccccuccagccaccgggugccacuuaaugccaac

SEQ ID NO: 165369 - RNA, 64 nt, Human
acgacgaaucuucucaaugggggggcggcugagcuccagccaccccgcagucacuuucuuugua

SEQ ID NO: 165370 - RNA, 64 nt, Human
caaagugcugggauuacaggcgugagccacugcauccagccauauaaccguauucuaaauaaga

SEQ ID NO: 165371 - RNA, 64 nt, Human
ugagcccucagccugugauauguggaugcagcuguccagccacugcccuuuaacaugcccagca

SEQ ID NO: 165372 - RNA, 64 nt, Human
gaauggucgcacuggagguucaagcuaacuggccuccagccacauucucauagcagguaggacu

SEQ ID NO: 165373 - RNA, 64 nt, Human
acuucauaauauauaagugugcacuguaaaaccauccagccauuugacacccuuuaugauguca

SEQ ID NO: 165374 - RNA, 64 nt, Human
uaaacaaaauaccggcuuccagagaccccuuuucuccagccauauuacaucaggcuagaaguaa

SEQ ID NO: 165375 - RNA, 64 nt, Human
gccugcaccccaggaaaggagggggcucaggccauccagccaccaccuacagcccaguggguac

SEQ ID NO: 165376 - RNA, 64 nt, Human
uugggacagagcaggcccacaaugccccccuucuuccagccaagaagagcucacaggaguccag

SEQ ID NO: 165377 - RNA, 64 nt, Human
uguauaguguuucacaaagcuuagaccuuuaccuuccagccaccccacagugcuugauauuuca

SEQ ID NO: 165378 - RNA, 64 nt, Human
ggccucccagcucccugguaccucgaggcaccauuccagccagggacgcugccggguagacucu

SEQ ID NO: 165379 - RNA, 64 nt, Human
uagggcugggcuccccuucuggcuccagcuucccuccagccacuccccauuuaccaucagcuca

SEQ ID NO: 165380 - RNA, 64 nt, Human
gcuagacugggcuggcugccuucugcggagcuucuccagccaccaaggcugccugccccauccc

SEQ ID NO: 165381 - RNA, 64 nt, Human
ccuggaccuucugguagaagaguuugucccacauuccagccauaagugacucugagcugggaag

SEQ ID NO: 165382 - RNA, 64 nt, Human
auacuuugcugggcugaagcaggcugcagggcauuccagccaagggcacagcaggggacagugc

SEQ ID NO: 165383 - RNA, 64 nt, Human
uuucucacccaggcaaucuugccuucugguuucuuccagccacauugagacuuucuucuagugc

SEQ ID NO: 165384 - RNA, 64 nt, Human
guacaagugaagggcuuggucuucccugagacauuccagccauuggaauaggagaggagcauau

SEQ ID NO: 165385 - RNA, 64 nt, Human
cuuucccucacccccucccacccccagccccgacuccagccagcgccucccuccaccccaggac

SEQ ID NO: 165386 - RNA, 64 nt, Human
ugcacugggggauuucugacuugaggcccaucucuccagccagccacugccuucuuuguaauau

SEQ ID NO: 165387 - RNA, 64 nt, Human
aagauucaguauugauaugauauguauaccaaacuccagccaacuuacugccauuuuucauaau

SEQ ID NO: 165388 - RNA, 64 nt, Human
augcagauggcguggaaccaaaccaugagaaaacuccagccauccuggaguugauauucaccau

SEQ ID NO: 165389 - RNA, 64 nt, Human
caagcauacugaugaagaguuccuuaaacaagcuuccagccagaagccugccuggaaagauggg

SEQ ID NO: 165390 - RNA, 64 nt, Human
auuuuugguccagaguacuuguuuucccgauguguccagccagcuccgcagcagcuuuucaaaa

SEQ ID NO: 165391 - RNA, 64 nt, Human
uauauuuccugauaacauuauguggcccucuggauccagccaugccugaggucuaccccugggc

SEQ ID NO: 165392 - RNA, 64 nt, Human
ucucaguuguuucuucauuguugcuguuucuggauccagccaugugugcgcuuguguggaccug

SEQ ID NO: 165393 - RNA, 64 nt, Human
cuggcccuccugucgucugguugguguuggggccuccagccagggcccucuaggggaaccaagc

SEQ ID NO: 165394 - RNA, 61 nt, Human
ccgagguggaguguggcugaggcccugaguguccagccacaugguggcaccagcaccacuc

SEQ ID NO: 165395 - RNA, 64 nt, Human
uccacucagggccucugcucuauaucuauucccuuccagccagacuggcagaugggggcuuccc

SEQ ID NO: 165396 - RNA, 64 nt, Human
aaauuugagggugcugaagauguucccacuaauuuccagccaucaccuuugguggggugggcuu

SEQ ID NO: 165397 - RNA, 64 nt, Human
gaugccaucgucacauucauuuggucacccucaguccagccagugggcuugcucucauuuggcc

SEQ ID NO: 165398 - RNA, 64 nt, Human
agucaaacuuuuagaaugacaaguuagcauauuuuccagccacaugaucaaccuacaaaauuaa

SEQ ID NO: 165399 - RNA, 64 nt, Human
ggccucaagaauugguauguaugaugugaucugguccagccagggccuggcuugucagcucucu

SEQ ID NO: 165400 - RNA, 64 nt, Human
gaggcuacagugagccaagagugcacuacuguacuccagccagggcaagagagcgagacccugu

SEQ ID NO: 165401 - RNA, 64 nt, Human
acuacagaauccuacauuuuucagcaggccacaguccagccaaauccuauaauauccuugaaaa

SEQ ID NO: 165402 - RNA, 64 nt, Human
ggggcugcagugagccaugaucacaccacugcacuccagccaggugacauagcgagauccuguc

SEQ ID NO: 165403 - RNA, 64 nt, Human
aaagguucugugagcccaucggggagaagaagaguccagccaccaucuuccugacugucccagg

SEQ ID NO: 165404 - RNA, 64 nt, Human
gaucagcgcacuguccugugccacauggcuggacuccagccaggaggacacacggugagggcuc

SEQ ID NO: 165405 - RNA, 64 nt, Human
aguggaauauagacaggacucugaaaacacaacuuccagccauuuuuuuaguuaguaaaaaucc

SEQ ID NO: 165406 - RNA, 64 nt, Human
aaagucauguguuugcaugcuggaugcuauacuguccagccaggacacaagacuucugauuucu

SEQ ID NO: 165407 - RNA, 64 nt, Human
agagcugaggcccgggcgcuggcugcagcucacguccagccaugggaaucccacggaccucucg

SEQ ID NO: 165408 - RNA, 64 nt, Human
cccuuuugcagucagcagcaucuauggaugcaaauccagccacagcagacaaucauggauauac

SEQ ID NO: 165409 - RNA, 64 nt, Human
auggcugaaggcccaguccuggcuccaccacuccuccagccagagggucuggaccauccagugc

SEQ ID NO: 165410 - RNA, 64 nt, Human
ugauucagaacaaaucaugcuaacuuugaauccauccagccacuugcaaaugauaaucagaagu

SEQ ID NO: 165411 - RNA, 64 nt, Human
acagugggaugaaccagccggggccuuaucgggcuccagccaucucaugaggggagaggagacg

SEQ ID NO: 165412 - RNA, 64 nt, Human
guucacuuuucaggggucgucccaacucuguaucuccagccacuccaacuguggaggcuguaaa

SEQ ID NO: 165413 - RNA, 64 nt, Human
caaaaaagcuuaauuaaguacaaccaaccaccuuuccagccauagagauuuuaauuagcccaac

SEQ ID NO: 165414 - RNA, 64 nt, Human
aaggaagguuuucaccuguagaaagcccccugccuccagccaaauagucccaugcugacuuucu

SEQ ID NO: 165415 - RNA, 64 nt, Human
aagucagccauauuguucucuggcuaaguuugguuccagccaacgucaucugcucuucaguucc

SEQ ID NO: 165416 - RNA, 64 nt, Human
gaucccccucuuugcacagcaugaggcaaaaauguccagccacccccaggcaucuguuagcaga

SEQ ID NO: 165417 - RNA, 64 nt, Human
uucuauacagauaggcagugaaagaguuuuauuuuccagccaggcgcaguggcucaaaucccag

SEQ ID NO: 165418 - RNA, 64 nt, Human
cuggcaguagccaugacauuggagcaccuuccucuccagccagaggcugaccugagggccacug

SEQ ID NO: 165419 - RNA, 64 nt, Human
agugacgacaccugucuguuccugcccuguugcuuccagccacugugauguuugaaauauguga

SEQ ID NO: 165420 - RNA, 64 nt, Human
gcugcagagcugucugcuccccacguugggcaacuccagccaagauuccuacacccaaauguga

SEQ ID NO: 165421 - RNA, 64 nt, Human
gaagagcgagucgucgugagcgcggucggcgguuuccagccaauggauucuggucaacuggugg

SEQ ID NO: 165422 - RNA, 64 nt, Human
ucuguggucuacaguuaugugguaacucauguuguccagccaacucagaguuucgucagugaac

SEQ ID NO: 165423 - RNA, 64 nt, Human
ucuccggcucugagaagaacaccugagagcgcuuuccagccagugccccgagugccugugggaa

SEQ ID NO: 165424 - RNA, 64 nt, Human
gaaauaggcagcacucugaaagacagaagcuucguccagccacucuucagcacauuccuuuacu

SEQ ID NO: 165425 - RNA, 64 nt, Human
uuccuuaucaggaauaacaaagguacuacaucuuuccagccaucagcacguuguacaacuuaac

SEQ ID NO: 165426 - RNA, 60 nt, Human
acaaaaucaaaaugaaaugaauaaauaagcuccagccagagauguaugcaugauaaugau

SEQ ID NO: 165427 - RNA, 64 nt, Human
aauaaaaagcaacuuaugaaaguagacauucagauccagccauuacuaaccuauuccuuuuuug

SEQ ID NO: 165428 - RNA, 64 nt, Human
uuucacaauuccauuuccaguucaucuauggcaguccagccagcuccugggcagcuugagaggg

SEQ ID NO: 165429 - RNA, 64 nt, Human
cacccagagccaguguggucaguauuccaaacucuccagccacucucuucuacgcugccucaac

SEQ ID NO: 165430 - RNA, 64 nt, Human
ggcagaugucuccaguggggucagugagcacaauuccagccaggggccacuuggaccaagcucc

SEQ ID NO: 165431 - RNA, 64 nt, Human
aagauacuggugauucaaggaauuuuauuuaugguccagccaagagccaucucgugccaagacu

SEQ ID NO: 165432 - RNA, 64 nt, Human
uauguccucaggggacugacaacauccuccagauuccagccauaaaccaauaacuaggcuggac

SEQ ID NO: 165433 - RNA, 64 nt, Human
gcguggcucuuucagaagacccaggaagggcagcuccagccagaggaccuuccuggcuaugcag

SEQ ID NO: 165434 - RNA, 64 nt, Human
auguucagguugcgggugagcugcccucuccaaauccagccagagaugcacauuccucggccag

SEQ ID NO: 165435 - RNA, 64 nt, Human
augcugugaucaugccugugaauaaccacugcacuccagccagggcaacauaacaagacucuau

SEQ ID NO: 165436 - RNA, 64 nt, Human
cuggaacugacuucuucugucaggaggacugguuuccagccauaccuguucuggaagggagagg

SEQ ID NO: 165437 - RNA, 64 nt, Human
ugcagaggaugcagccaccugcuuaacugugcuguccagccagccagccagcugcagggccucu

SEQ ID NO: 165438 - RNA, 64 nt, Human
aaggcugaguguccggcugaggccugagcgaguguccagccaagggcugaguguccagcacacc

SEQ ID NO: 165439 - RNA, 64 nt, Human
agcuugcuaaacuuucagagugcccugagacacuuccagccaucccuccuccugccuucauugg

SEQ ID NO: 165440 - RNA, 64 nt, Human
aacaaguguauaacuaaacuaacaagauuaaauauccagccaguacaguauuuuuuaaggcaaa

SEQ ID NO: 165441 - RNA, 56 nt, Human
ugaaggacaugagcccaugauaacauuccagccacuggcugcuaacaagucaccaa

SEQ ID NO: 165442 - RNA, 64 nt, Human
aagaggugaggcuaggggagugcugugcugauucuccagccauggucagacaggucacccagga

SEQ ID NO: 165443 - RNA, 64 nt, Human
caaagcacugggauuacaggcgugagccaccacauccagccagugauccuuaaaagauuaagag

SEQ ID NO: 165444 - RNA, 64 nt, Human
accgggacccgacgcuuuucagggcauuucucccuccagccagggcccaacucccaccugccug

SEQ ID NO: 165445 - RNA, 64 nt, Human
ucuugaccagaccccuucucccugaccuggcucuuccagccagggcacgagcccuccuucuaua

SEQ ID NO: 165446 - RNA, 64 nt, Human
agaaaggaggagacagagggaggaccuguuguguuccagccauucugguauuccuuuauguauc

SEQ ID NO: 165447 - RNA, 64 nt, Human
aacuuuugaccaauaauuguuguuuugugucagcuccagccauuuuuguacauguuguauagac

SEQ ID NO: 165448 - RNA, 64 nt, Human
uaucauccaaaggaucucacuggacuguucaacuuccagccaaauucaaggagcuugcgggaac

SEQ ID NO: 165449 - RNA, 64 nt, Human
aagccaucuaaguguaaaaguggcucauaucuucuccagccaaaucagcuaggccauggccuug

SEQ ID NO: 165450 - RNA, 64 nt, Human
aaacaagaggugaccaccuuauugugagguuccauccagccaaguuuauguggccuauugucuc

SEQ ID NO: 165451 - RNA, 64 nt, Human
ucaacccaggcggguggacagggucccccugugguccagccaguaaaaaccaugguccccccac

SEQ ID NO: 165452 - RNA, 64 nt, Human
cagaggauugaggcuuaauucugagcuggcccuuuccagccaauaaaucaacuccagcucccuc

SEQ ID NO: 165453 - RNA, 64 nt, Human
ucaguauuugagcuaugucugcuuccugcccaccuccagccagagaagaaucaguauugagggu

SEQ ID NO: 165454 - RNA, 64 nt, Human
acccuucccacaaaucaccaaacugcuggaacucuccagccaaaugcugggagaaggaccugga

SEQ ID NO: 165455 - RNA, 64 nt, Human
aggaacgggcagccacaggacugagcccucucacuccagccaaagaaaugggccugccugccuc

SEQ ID NO: 165456 - RNA, 64 nt, Human
ccuccugcggcgccuugcccuccuccgaccccuuuccagccaaaguccccccaccccuucagag

SEQ ID NO: 165457 - RNA, 64 nt, Human
ccugucaucuaaccucaguccugccuacugcaguuccagccaaccugcucuuuccugaguucaa

SEQ ID NO: 165458 - RNA, 64 nt, Human
aaaggccuuagugugccccagcagucuggcugcguccagccaccaucacccggaaggaugccca

SEQ ID NO: 165459 - RNA, 64 nt, Human
cggcggaccaaggaggaggagcugcagugcuaaguccagccagcgugcagcugcauccagaaac

SEQ ID NO: 165460 - RNA, 64 nt, Human
uugugauuugaagagaagcagcagucuuuacuuuuccagccaaauccaguagcagaaucaucuu

SEQ ID NO: 165461 - RNA, 64 nt, Human
uggcugagguuuugucuauuuuacaguguuucaauccagccauaaaaauuaacuugugauuuuu

SEQ ID NO: 165462 - RNA, 64 nt, Human
ccuuugaccuauaggcuaaaaaagaaaggcucauuccagccacagggcagccuucccugggccu

SEQ ID NO: 165463 - RNA, 64 nt, Human
cuugaccuuuucuuaccuugcaacugucagugccuccagccaaaugccuagcacagagcucagu

SEQ ID NO: 165464 - RNA, 64 nt, Human
aacuggaggaugcauuuagagggagaaagcuacuuccagccauuagacuaugccuuuggaaggg

SEQ ID NO: 165465 - RNA, 64 nt, Human
gugccucaucacugcuccugucaccaugauucuguccagccagcaggaugcagccuuugccuuu

SEQ ID NO: 165466 - RNA, 64 nt, Human
gaauucuugagcaaaaggaggggaagagacaaucuccagccacccgccccacgcuugacuucuu

SEQ ID NO: 165467 - RNA, 64 nt, Human
ccucaucaucacaguuuaacacaagcuccccugcuccagccaaauugaucucccagucuugucc

SEQ ID NO: 165468 - RNA, 64 nt, Human
uucuagucccucauaccagcccuccuugccucccuccagccacuggaccccagccuuggcucuu

SEQ ID NO: 165469 - RNA, 64 nt, Human
cugcagcaaacuuugguguaaaauuccaccaguuuccagccaccuuccugacuucuaucugggc

SEQ ID NO: 165470 - RNA, 64 nt, Human
uuaaaccgugugauguauuugaaugucuguuauuuccagccacccuaacauucuucuuccugug

SEQ ID NO: 165471 - RNA, 64 nt, Human
ggcccugauccaggacugcaccccacccccaccguccagccauccaaccucacuucgccuuaca

SEQ ID NO: 165472 - RNA, 64 nt, Human
gccccguggugaggccauguucucauaaucaggcuccagccagaaaaauaagaaacaccgcaac

SEQ ID NO: 165473 - RNA, 64 nt, Human
guuuucuuuccuguucuccucugcuucauucucguccagccauugcuccccucucccugccacc

SEQ ID NO: 165474 - RNA, 64 nt, Human
ccauguucagggucuaagacccagaaugaguuucuccagccagguggccacuuuauggaaagga

SEQ ID NO: 165475 - RNA, 64 nt, Human
uaggcccacgaacccacgagaauguccucugacuuccagccacauccaucuggcaguugugcca

SEQ ID NO: 165476 - RNA, 64 nt, Human
uugaggauaucuuauaacucacagauugucagcauccagccauguccuaucuagauuaggaaaa

SEQ ID NO: 165477 - RNA, 64 nt, Human
ccuguagccccagugacagcuaggaugugcauucuccagccaucaagagacugagucaaguugu

SEQ ID NO: 165478 - RNA, 64 nt, Human
uuuuaaaggcuuaaaauauuauaaccacaggguauccagccaaauucaacauuacugcaagucu

SEQ ID NO: 165479 - RNA, 64 nt, Human
agccccugcugggcacggcggaagucacgaccucuccagccagggagucuggucucaaggccgg

SEQ ID NO: 165480 - RNA, 64 nt, Human
ucuuguggugcaagcccagcucugucaccugagauccagccagagacccuccuccaccauccac

SEQ ID NO: 165481 - RNA, 64 nt, Human
gcccaggcuccgcagagcagguguccaccgcccauccagccauuguguuuagagggcagagcga

SEQ ID NO: 165482 - RNA, 64 nt, Human
agcuggggcugcagggagacaacggguggcugcauccagccagagacaggcgcagguggguguc

SEQ ID NO: 165483 - RNA, 64 nt, Human
ugccaagccagcauaggggagcuagaagccacuuuccagccaccugccguuggguuuuuucaua

SEQ ID NO: 165484 - RNA, 64 nt, Human
cucccccugugccagcagccccacucccucaggguccagccaugccccacccuggacugaaguu

SEQ ID NO: 165485 - RNA, 64 nt, Human
gaaacacuaacagcugggagaggggagccagcuguccagccagcauguuccuguuguacagccc

SEQ ID NO: 165486 - RNA, 64 nt, Human
ggaaugcuccgggggugacacaggccacgguggcuccagccaggaccagccagaccagcagagc

SEQ ID NO: 165487 - RNA, 64 nt, Human
aagauugcagugagcugaaaucacaccacuacacuccagccaaagcaacaagagcaaaaacuuc

SEQ ID NO: 165488 - RNA, 64 nt, Human
aggguugggcucagggcuugcggccugcaggcacuccagccagcgcucaccuggccuuuccuca

SEQ ID NO: 165489 - RNA, 64 nt, Human
ugugucucaucucuugcagcagcagcugcugaacuccagccaucaacacggugggaggcagcgg

SEQ ID NO: 165490 - RNA, 64 nt, Human
caaccuuaaauguggauguaucagauuugguuuauccagccaugggagagaaaacaaaccuaag

SEQ ID NO: 165491 - RNA, 64 nt, Human
auuuugcugaaaauguuuuaaaaugcuauucucauccagccauauuagucuucuggcuuuucuu

SEQ ID NO: 165492 - RNA, 64 nt, Human
ccucugugccaccagggagugccuauacauccuguccagccacgacauugagcagcacgccccc

SEQ ID NO: 165493 - RNA, 64 nt, Human
uucuuuguggucugugucaccguaucucaggaaguccagccacuugacuggcacacaccccucc

SEQ ID NO: 165494 - RNA, 64 nt, Human
auaggacccugaccugccugggucucccugucucuccagccaguauauuuaaagguaaugagau

SEQ ID NO: 165495 - RNA, 64 nt, Human
ucccaaaagugccuccccagccucagcccccaccuccagccacacacacauuacacacacacac

SEQ ID NO: 165496 - RNA, 64 nt, Human
uauuugucagacauuuguucugcugucuuucuaauccagccaacgucugcucaggaaguggggc

SEQ ID NO: 165497 - RNA, 64 nt, Human
cucuggguuuguggagcacacaggccugccccucuccagccagcucccuggagucguguguccu

SEQ ID NO: 165498 - RNA, 64 nt, Human
ugagcuguucaugugggccccuugcugacuauauuccagccacuucaggguuguuuguaaugac

SEQ ID NO: 165499 - RNA, 64 nt, Human
cccacgcgagcccacaggacaccggccccuagauuccagccaccaagcggaagcaugagacccg

SEQ ID NO: 165500 - RNA, 64 nt, Human
ugaguagcugggacugcaguuguaagccaccguguccagccaguuucuguuguuugaagccccc

SEQ ID NO: 165501 - RNA, 64 nt, Human
caguguuaccuuacgcuucuagaagcagagccacuccagccagaacccauuuugcagucuucuc

SEQ ID NO: 165502 - RNA, 64 nt, Human
ccagcaccaaucucuccauguuuuccacagcuccuccagccaacccaaauagcgccugcuauag

SEQ ID NO: 165503 - RNA, 64 nt, Human
aagccuaugcccugagccauggcugcugacugacuccagccaaggugcaaagacgagauuauga

SEQ ID NO: 165504 - RNA, 64 nt, Human
ugucccucuggaaggggcuggcuggugcccuauuuccagccaccccagcagcuagggaggcaaa

SEQ ID NO: 165505 - RNA, 64 nt, Human
gaucuguguugccccucucgguggucccaggcgauccagccaugcccccugccccucugcccag

SEQ ID NO: 165506 - RNA, 64 nt, Human
aggugccugugcucccagcagguccaagugcagcuccagccaccuuugcgugucaccuucacgg

SEQ ID NO: 165507 - RNA, 64 nt, Human
agguuuuaaaacuauggcuguuaaauaagcuuuuuccagccaaaccaaacuacauguaaaguga

SEQ ID NO: 165508 - RNA, 64 nt, Human
gcaaaucuccugcuggcucaugaaacagcagaauuccagccaaggcaaauucaguuggaucuag

SEQ ID NO: 165509 - RNA, 64 nt, Human
aaccaguacuucuuuaagcucuauucaguaggguuccagccacugcuuuuuuguuguuucuagc

SEQ ID NO: 165510 - RNA, 64 nt, Human
ccagauagucacagucaagguuggagagucuccuuccagccagugaccuacccaaaccuuuugu

SEQ ID NO: 165511 - RNA, 64 nt, Human
ucguuuuggaggauagcucaaguugaauuuucuuuccagccaguuacccuuucaaccuacccau

SEQ ID NO: 165512 - RNA, 64 nt, Human
agaauuaagaaagguuuugaauucuuauaacauauccagccauuucaauuuugauugaaaugaa

SEQ ID NO: 165513 - RNA, 64 nt, Human
cauaggaacccauuacuuaauagaagucaguuacuccagccaggcagcucucccaauguuucuc

SEQ ID NO: 165514 - RNA, 64 nt, Human
uucugccacuuccgggucuaggcccugccccaaauccagccaguccugccccagcccaccccca

SEQ ID NO: 165515 - RNA, 64 nt, Human
gcuuuggagaauggauuuggagugucuugggcgauccagccagcgcaggccccccggcccgguu

SEQ ID NO: 165516 - RNA, 64 nt, Human
guccuucucuucccggauaagaagcagaggaccuuccagccacccgcgacaggugagagccgag

SEQ ID NO: 165517 - RNA, 64 nt, Human
aaggauccucuucacuucuuucuuaaacagcaaauccagccagguucagauuacacaaccagug

SEQ ID NO: 165518 - RNA, 64 nt, Human
ucuccuucuugugccuugaguggcagaggagccguccagccacaccagcuuuccucccaccgcu

SEQ ID NO: 165519 - RNA, 64 nt, Human
aagagcaggcaaaagaauccucgaagcuuauguauccagccacagacagcucccgaugcgcugc

SEQ ID NO: 165520 - RNA, 64 nt, Human
gaccacccccaaacacaaaacauucauguaacucuccagccauuguaauuugaagauguggauc

SEQ ID NO: 165521 - RNA, 64 nt, Human
agcagggcugaggggcgaagaggacauguggauauccagccagaaugcccucucuccagaggac

SEQ ID NO: 165522 - RNA, 64 nt, Human
agccagcauugaucacuuaauccuguuucucauguccagccagaaaaaagaacuucagugaagg

SEQ ID NO: 165523 - RNA, 64 nt, Human
aaaucagcugggggugguggcacaugccugugguuccagccacucaggaggucgagguggcagg

SEQ ID NO: 165524 - RNA, 64 nt, Human
aauuguagucucaguuaaaagggguagccucuacuccagccaacauuuuaaaauuaauggauaa

SEQ ID NO: 165525 - RNA, 64 nt, Human
gaucucacuuaauucucuaugacauugauuggaauccagccacugacauucagguaggaauauu

SEQ ID NO: 165526 - RNA, 64 nt, Human
uuuggaaaacacagaaucagcccucagggugcacuccagccaccucagugcucuaagcucacag

SEQ ID NO: 165527 - RNA, 64 nt, Human
ucccacgugcacagcuuccugagucaccccucuguccagccagcuccugcacaaauggaacucc

SEQ ID NO: 165528 - RNA, 64 nt, Human
guuaaugugccaaaaugucaauuuuuaacuuaucuccagccaauuucaaagaaaacagaccagc

SEQ ID NO: 165529 - RNA, 64 nt, Human
gacugcccugaucccugggacgugagacuuagcuuccagccagugugaaucauuguaucugucu

SEQ ID NO: 165530 - RNA, 64 nt, Human
acccuggcucugccacccaugaaccagcccagcauccagccagugagugggcacccaaugccuc

SEQ ID NO: 165531 - RNA, 64 nt, Human
ccagacacagagcccggaccaccuggaccuacccuccagccaugacccuucccugcucccaccc

SEQ ID NO: 165532 - RNA, 64 nt, Human
aucuuacugaugcacugggccuaucuuuuuguuuuccagccaguugaauagauuaguuuuucuc

SEQ ID NO: 165533 - RNA, 64 nt, Human
uagcagcccucucucucagcuuagcaguucgcucuccagccaccagagcagccucucugcacau

SEQ ID NO: 165534 - RNA, 64 nt, Human
gugcccagccaccggcugacccacaccugacacuuccagccagucugcugccugcucccucuuc

SEQ ID NO: 165535 - RNA, 64 nt, Human
gucuugugagcaugaagugaacgggcuguuuugcuccagccacuuuucuuguacaaccacaugg

SEQ ID NO: 165536 - RNA, 64 nt, Human
uugcacaaacccuaucaagagcugcugcuucccuuccagccagaaaagugguaagcggagcaag

SEQ ID NO: 165537 - RNA, 64 nt, Human
gaccuaagcaacccacugcuuaagaaaccugcguuccagccagaguuggccucagaaugaccug

SEQ ID NO: 165538 - RNA, 64 nt, Human
uuuauagcucucuuuagcucaaccacucuguccauccagccaauggaugucccuuccccuguac

SEQ ID NO: 165539 - RNA, 64 nt, Human
uccacagaagcccauccgcugccuccguggcuucuccagccauugaacuggucccacacgcacc

SEQ ID NO: 165540 - RNA, 64 nt, Human
acccagauuuccacagugcugcuaauaucccagcuccagccagcaccccaucugcaccugaauc

SEQ ID NO: 165541 - RNA, 64 nt, Human
cccagccaaucagggccuugaggaggauguauccuccagccaaucagggccuggggaaucuguu

SEQ ID NO: 165542 - RNA, 64 nt, Human
ucuaggagcagggcacccaguggcccugcugcuguccagccaggccugccugaggccacgcugc

SEQ ID NO: 165543 - RNA, 64 nt, Human
ccagacacagagccuggaccaccuggaccuacccuccagccaugacccuucccugcucccaccc

SEQ ID NO: 165544 - RNA, 64 nt, Human
gggugccccuggcucgggacagguagcacugcuguccagccacagccccagcccaggcagccca

SEQ ID NO: 165545 - RNA, 64 nt, Human
cccagugugagcacaaugccaaccuuaguguuucuccagccagacagaugccucagcaugaagg

SEQ ID NO: 165546 - RNA, 64 nt, Human
cuccacaggagggugaggaauugggacagguaauuccagccaauaccugguccauaguucuuca

SEQ ID NO: 165547 - RNA, 64 nt, Human
cgccuccuguagcaguagggcccccagccagcgcuccagccaaagcggcggccccaggguuaau

SEQ ID NO: 165548 - RNA, 64 nt, Human
uggaggcaaaaggcagcucacggggccuuccauuuccagccaggccucaucugggguagggcca

SEQ ID NO: 165549 - RNA, 64 nt, Human
aagauugaucuugccaagagugagggcagaugucuccagccaggacugcccugagccgcaaaau

SEQ ID NO: 165550 - RNA, 64 nt, Human
ugguccaggcugguccccgccgguccccuuccaguccagccaccaagaguccacuugucccggg

SEQ ID NO: 165551 - RNA, 64 nt, Human
cugccaacccuguucacaggcgcuuccagcccacuccagccaggggagcagggaagaagaaggg

SEQ ID NO: 165552 - RNA, 64 nt, Human
ugcccacagggugcaggacuccacugaugagagauccagccaaagagcugcccccagggguaug

SEQ ID NO: 165553 - RNA, 64 nt, Human
uuuggaaaaguuaggaaaccuuuaggauucugguuccagccaggguugaggaaaagaccuugga

SEQ ID NO: 165554 - RNA, 64 nt, Human
cugaggcagucauaaugcaguaucuuccccugacuccagccacaaagcucauacccagcccuac

SEQ ID NO: 165555 - RNA, 64 nt, Human
gcugagagccggccguggaaggagggaugcguguuccagccaaagcaugccguucugcacccua

SEQ ID NO: 165556 - RNA, 64 nt, Human
accucacucccagccaggcucccaaagggcucauuccagccauuccaaucucuucuucuuuaug

SEQ ID NO: 165557 - RNA, 64 nt, Human
augccugaaaaucagcacgugcagggccucccuauccagccagcauuuuccuuccagcugaggc

SEQ ID NO: 165558 - RNA, 64 nt, Human
uaauuagccaggcgugguggugggugccuguaauuccagccacucgagaggcugaggcaggaga

SEQ ID NO: 165559 - RNA, 64 nt, Human
aaaaaccuuaugaaugaauuggauauuagaaauuuccagccacaagucagccuccauaaugccu

SEQ ID NO: 165560 - RNA, 64 nt, Human
aaaccaacgugagcccugccugcucggacgccuuuccagccagugucucugacgucgggguuag

SEQ ID NO: 165561 - RNA, 64 nt, Human
aaauccuggauggcugaccaagacuggcacuuguuccagccauuagugaguugaagccaaagcc

SEQ ID NO: 165562 - RNA, 64 nt, Human
guugcugagggccacccggggcuucuugguccacuccagccaucagucagcacggcccuuucuc

SEQ ID NO: 165563 - RNA, 64 nt, Human
ugauaguuauauucaugagugaaauuguggggaguccagccauuugggaggcaaugacuuucug

SEQ ID NO: 165564 - RNA, 64 nt, Human
ccccccuuaggaaaggaguuagggucucagugccuccagccacacccccugccuuccccagcuu

SEQ ID NO: 165565 - RNA, 64 nt, Human
caagguggccgcagucugccuuugcauccuguccuccagccacccuugcuugccacuguucccc

SEQ ID NO: 165566 - RNA, 64 nt, Human
guaguaauuaugaaccucacauagaaaaauuucauccagccauaugccuguggaguggaauauu

SEQ ID NO: 165567 - RNA, 64 nt, Human
gccggcuggcacccuccauguacccaggggagauuccagccagacacccgccccccggcccugg

SEQ ID NO: 165568 - RNA, 64 nt, Human
uucuuuccagauuggguuuggugaaccugaaugguccagccaccuucugcagguggcccaaggu

SEQ ID NO: 165569 - RNA, 64 nt, Human
uugauggguacaggcugaguggggcgcccucaccuccagccagccucuuccugcagaggaguag

SEQ ID NO: 165570 - RNA, 64 nt, Human
accaaaggaacaccaggcccagcgcccucuuugguccagccagacccugggcccucucuccuca

SEQ ID NO: 165571 - RNA, 64 nt, Human
agcucuuaaagugaggguuauucucauacucgguuccagccaucagcagacuuccugcucaucg

SEQ ID NO: 165572 - RNA, 64 nt, Human
ccccagcaggagagccuaguccucccccagccccuccagccaccaggguguccucuaggaugca

SEQ ID NO: 165573 - RNA, 64 nt, Human
ggcaaccuugccccccacccaagaagcccugcccuccagccacagcaguccacagcagcagggu

SEQ ID NO: 165574 - RNA, 64 nt, Human
ucccuagcccacacgcagacuuugaccaggaguauccagccaggggcacacaugugccugcgug

SEQ ID NO: 165575 - RNA, 64 nt, Human
agcauucugaaaacagauauucuggcccagggaauccagccaugacccccaccccucugccaaa

SEQ ID NO: 165576 - RNA, 64 nt, Human
gggccggccucuggccuggcucaccuggccacuguccagccagccuugugacagacuccggccu

SEQ ID NO: 165577 - RNA, 64 nt, Human
caucucauuugccuuuugcaccuuuccugaugcuuccagccaggagaaguccuggaauaagagu

SEQ ID NO: 165578 - RNA, 64 nt, Human
ggcugugggagguacugggcccuagagcugugcguccagccaguccuggguccccacgauugac

SEQ ID NO: 165579 - RNA, 50 nt, Human
cugccguggccaguaaaugauccagccagcugccagggccacugccauga

SEQ ID NO: 165580 - RNA, 64 nt, Human
uuuucucccuggauuuuuaccagucucacaugauuccagccaucaccuuagaccaccaagccuu

SEQ ID NO: 165581 - RNA, 64 nt, Human
ggaggaucucuugagcccaggaguuggaguccaguccagccagggcaacacagccagacgcccu

SEQ ID NO: 165582 - RNA, 64 nt, Human
caaaagcugugauuuuugucuccccuucccacccuccagccaaggagcagcccugcccaggggg

SEQ ID NO: 165583 - RNA, 64 nt, Human
caggaguauggguccugcccugcccucccaggaguccagccaggggcugccuccauguccugcc

SEQ ID NO: 165584 - RNA, 64 nt, Human
ugucuugggaacaaaaggccuuugagcauauggguccagccacucagaaguguaggggccaugc

SEQ ID NO: 165585 - RNA, 64 nt, Human
ccagagaagucuggucagagccacagggucugccuccagccaaacgggagcuuuuggugagaag

SEQ ID NO: 165586 - RNA, 64 nt, Human
ucugggccuggaggugggggugggggcagccaaguccagccacucuucaccuggcucccugcuc

SEQ ID NO: 165587 - RNA, 64 nt, Human
aaaaagcgccagugaagaaaucuauacgagauacuccagccaaaaaugcacaaaagucaaauca

SEQ ID NO: 165588 - RNA, 64 nt, Human
uuugcaaauaagcauaucauaucaaauacaauauuccagccaaccaguuaauucucuuccuggu

SEQ ID NO: 165589 - RNA, 64 nt, Human
agaagccaaugauccccccucaggacaaaucuacuccagccacgaugagaagugggugagccag

SEQ ID NO: 165590 - RNA, 64 nt, Human
cccgcgacugagccgccucccaccacuccacuccuccagccaccacccacaaucacaagaagau

SEQ ID NO: 165591 - RNA, 64 nt, Human
agucaacauguggaaauccaaggaggacaaagacuccagccacgcugcuaaauagggcuccucu

SEQ ID NO: 165592 - RNA, 64 nt, Human
guccggacacugggccccgcaggcgaaagcacguuccagccaccaggaggccaccuauuguuuc

SEQ ID NO: 165593 - RNA, 64 nt, Human
guaaauaccucaguaauauggguccuuucauuuuuccagccaugcauuccuaacacaauucagu

SEQ ID NO: 165594 - RNA, 64 nt, Human
cagaugagucacuguaacucuagaagauuaaccuuccagccaaccuauuuuccuuucccuuguc

SEQ ID NO: 165595 - RNA, 64 nt, Human
ccaguagauaaugaaccaaauuaaguucccucccuccagccagaaguuaaacaucugggauaug

SEQ ID NO: 165596 - RNA, 64 nt, Human
aggccacagugagaaggaacagcccuaacaggccuccagccagguugaaugagcucauuuuugu

SEQ ID NO: 165597 - RNA, 64 nt, Human
gcuugccuugaugggauugguauugcugugugcuuccagccacagguucucacacucaauucca

SEQ ID NO: 165598 - RNA, 64 nt, Human
cucagccagcgucuccccuguggagagucggggcuccagccaggagcgcuccagguaaccccug

SEQ ID NO: 165599 - RNA, 64 nt, Human
gcucucccacagucuuugaggugaauuacaaaaguccagccauuaucauccuccugaguuauuu

SEQ ID NO: 165600 - RNA, 64 nt, Human
ggggauuggauguugauuuuagaagauggagaacuccagccaccuuuguaaagcacuaguguuu

SEQ ID NO: 165601 - RNA, 64 nt, Human
gucuguauguacuaucuggaaagauaacacauacuccagccaccucaccugauuggcuaucuug

SEQ ID NO: 165602 - RNA, 64 nt, Human
cucagacugccuuccugcuucugggcuaaccuguuccagccaggcuccucaugugaccucgcag

SEQ ID NO: 165603 - RNA, 64 nt, Human
cuccaccuucuggguggaggcgccauccuaaccauccagccaggccacccacaacccgagaauc

SEQ ID NO: 165604 - RNA, 64 nt, Human
agaccguagaucucaggccucuaacacuuccaacuccagccaccacuuuccugugcauuuucac

SEQ ID NO: 165605 - RNA, 64 nt, Human
gguacuccaggcacacaccuuucugaaauccuucuccagccagcugcugcagacaaaagaucac

SEQ ID NO: 165606 - RNA, 64 nt, Human
ucuaaaaagguggagucuuccgggauuccugggguccagccacacuucccugggaaaccuaagu

SEQ ID NO: 165607 - RNA, 64 nt, Human
agguuuagacauggcucccugucuccaguaaacauccagccauucagacaaagggggccuggag

SEQ ID NO: 165608 - RNA, 64 nt, Human
guaauguccguguagaaaaaggaccauguucuuauccagccaauacugggagugcugucuccac

SEQ ID NO: 165609 - RNA, 64 nt, Human
cuguuggcaaaucgcaccuuaucugaacauuuguuccagccaccuuuugcacauggauuccgua

SEQ ID NO: 165610 - RNA, 64 nt, Human
ucauccucucgaagaagaaaggagaggcucuguuuccagccaguuaguuuucucugggagacuu

SEQ ID NO: 165611 - RNA, 64 nt, Human
gucuuaucuccauaacuauagcugaugcagaaaguccagccaguuuacucauuucgauucagaa

SEQ ID NO: 165612 - RNA, 64 nt, Human
uuccgucuagucuaacuuuuugaguguguuucuauccagccacauagcccauaucuacucuaaa

SEQ ID NO: 165613 - RNA, 64 nt, Human
cugcaagccccugcccauggcccaauggggagccuccagccacaaguucccuguccuuaucagc

SEQ ID NO: 165614 - RNA, 64 nt, Human
cucuggauuucuuuucuaucaccuagaugcuucauccagccagaagauagccuucacguucccc

SEQ ID NO: 165615 - RNA, 64 nt, Human
cucgccuuucacaguccccuccugccugcuccuguccagccaggucuaccacccaccccacccc

SEQ ID NO: 165616 - RNA, 64 nt, Human
gcaaagccugcugcauuugcgugaucucaagaccuccagccagaagucccuuccaaauauaaga

SEQ ID NO: 165617 - RNA, 64 nt, Human
ggaugagaauggcagccaaucucuguggccaagcuccagccaaaaaggagggcacgaccagaaa

SEQ ID NO: 165618 - RNA, 64 nt, Human
augccaggaggaagcagucccuccucaccagcucuccagccaggacgaucacacagagaugaau

SEQ ID NO: 165619 - RNA, 64 nt, Human
guggaggagaggagacaaggcucuggacagccgguccagccacauccagugauucagcagggau

SEQ ID NO: 165620 - RNA, 64 nt, Human
acuucugaacuuuggcccugagcuccauucuuccuccagccaaccccugaaaauuuuacaugac

SEQ ID NO: 165621 - RNA, 64 nt, Human
ccugcuaguaagcagucacauaaguggguaccuauccagccauucucuuuucagagcauauaau

SEQ ID NO: 165622 - RNA, 64 nt, Human
gcuaggaggaaaaaaugugaaucuuaccagcaguuccagccaaccaagugauucuucuucauuc

SEQ ID NO: 165623 - RNA, 64 nt, Human
aggggagaaaagccaguguauguaaagaaaauguuccagccaggcgcgguggcucacgccugua

SEQ ID NO: 165624 - RNA, 64 nt, Human
aaggccccauggccucacacugcagacaccccuuuccagccacaauccaccaucauccugacga

SEQ ID NO: 165625 - RNA, 64 nt, Human
ggcuggugggaaggccggcagcgggcggaggggauccagccacuucccccucuucuucugaaga

SEQ ID NO: 165626 - RNA, 64 nt, Human
uggaggaagaagauguucgucagccaauucaaccuccagccagcuucuugagccuauuugguuu

SEQ ID NO: 165627 - RNA, 64 nt, Human
uaacccccaaaguacugcuuauuuguuugaagaauccagccaucguagugcuuuagucacuauc

SEQ ID NO: 165628 - RNA, 64 nt, Human
caguaugggacccccucaccaggccuggaacaccuccagccacaaagaagccaaaggucagucc

SEQ ID NO: 165629 - RNA, 64 nt, Human
ucauacucaccgguuugaccagaaauucuccaaauccagccauagauggcugcugggugugcag

SEQ ID NO: 165630 - RNA, 64 nt, Human
gaaguugcagugagucgagauugcacugcugcauuccagccagggugacagagugagaccaugu

SEQ ID NO: 165631 - RNA, 64 nt, Human
gagccuguaggugcagaggcccuggcucccgagguccagccacucucccuggggccucuggggu

SEQ ID NO: 165632 - RNA, 64 nt, Human
ccuccccagcucuccucugccagccacccuaaauuccagccaaccucaccuccucgggcccagc

SEQ ID NO: 165633 - RNA, 64 nt, Human
ggaaccugccccaggucacaaucauucuguccaauccagccaagguucccuccacauaugaaga

SEQ ID NO: 165634 - RNA, 64 nt, Human
accucaggagcgcugccagcuugacacuggggaauccagccaguccagcacacucuuccauccu

SEQ ID NO: 165635 - RNA, 64 nt, Human
cacagcuuugcaugcugagcugugccaggcaggauccagccaaggccucucccucugugaguca

SEQ ID NO: 165636 - RNA, 64 nt, Human
uacccuguguuuucugcaaacugacuuacuuuguuccagccaaagcuugcuaauaauagaaaac

SEQ ID NO: 165637 - RNA, 64 nt, Human
guggcgauuuugugcucugggcccuuucucuuuuuccagccaguuuccauucacuugccuuaca

SEQ ID NO: 165638 - RNA, 64 nt, Human
aauaggcagacuauucccaacuuucugucuaguuuccagccauugaagugaacugcuaaaaaaa

SEQ ID NO: 165639 - RNA, 64 nt, Human
aagcugcauuaguaaagaugcuccaggagugugguccagccagcgcucuuuccagcuguaaaua

SEQ ID NO: 165640 - RNA, 64 nt, Human
augguaacuuguucuguaccuccuaugccucauguccagccagguugagccuaggggccaguug

SEQ ID NO: 165641 - RNA, 64 nt, Human
ggcuacuccuguaccacucuauucacugguacaguccagccaguaaaaaacacuuccaaaaaga

SEQ ID NO: 165642 - RNA, 64 nt, Human
uugacccccucccugaccuccccgccagcuggacuccagccauccuccugccucagcuucccag

SEQ ID NO: 165643 - RNA, 64 nt, Human
uuguccgccugucacgcccucaccacccuccccuuccagccaccacccuuuccguuccgcucgg

SEQ ID NO: 165644 - RNA, 64 nt, Human
ggguucugccgcgggcuaccggccucugagugccuccagccagagcucccugcgcucgcucauc

SEQ ID NO: 165645 - RNA, 64 nt, Human
ccauggcaaugacagccgggacacuuuucuucccuccagccaggguuucucuaaaggagcuuug

SEQ ID NO: 165646 - RNA, 64 nt, Human
caguuaccgagcgaggcacucacugggcagcacauccagccagacccgaccagcuccgggaugg

SEQ ID NO: 165647 - RNA, 64 nt, Human
ccucggugcagagugcagaggcggcucugguuccuccagccaccucagucccucuuugggaggu

SEQ ID NO: 165648 - RNA, 58 nt, Human
agaacaaucugcggcacuagguccuaccuccagccaaugaaugggaucauucuggaug

SEQ ID NO: 165649 - RNA, 64 nt, Human
cucuucccgcagccuggcuccuguguucccucuauccagccaaugccuguuuacacagacaccu

SEQ ID NO: 165650 - RNA, 64 nt, Human
acccagcaugcuggaggugacguggccuucucccuccagccaccugcugccacgggcaggcccu

SEQ ID NO: 165651 - RNA, 64 nt, Human
gugccccggcagccugcuggacucccagaccccauccagccaggggaccgcaggccauuguuga

SEQ ID NO: 165652 - RNA, 53 nt, Human
acaucggggagaaacccugaaacuccagccaggucuuacuguggaaaacuccu

SEQ ID NO: 165653 - RNA, 64 nt, Human
ugccaacugcagauaauacacaccuccugcagcguccagccacggcuccagggcacugcucucc

SEQ ID NO: 165654 - RNA, 64 nt, Human
cuuuccucugucccuucuuucucugucccuuccuuccagccacacuccagggcggaguuggaug

SEQ ID NO: 165655 - RNA, 64 nt, Human
gggcagcuauggaaaccacuggguucuggaacguuccagccaggcagugguuguuccucauagg

SEQ ID NO: 165656 - RNA, 64 nt, Human
gcucagcucuugauacggaaacgagugucuucacuccagccagcaucauggucuucggugcuuc

SEQ ID NO: 165657 - RNA, 64 nt, Human
agugggaaagccuuuugauguggcauggccaagguccagccacaagugcaacugccaccugucc

SEQ ID NO: 165658 - RNA, 64 nt, Human
ccugcugggcagggggcaugaugcgggccagugcuccagccacagaaaagaaaguucaugcuuu

SEQ ID NO: 165659 - RNA, 64 nt, Human
aggacagcucacgacagugccaccuucucaccauuccagccaaggagagaugugacguuggaac

SEQ ID NO: 165660 - RNA, 64 nt, Human
cuaggagguuccugacaugggacccaucugcuccuccagccaacuccugucccucacaucccac

SEQ ID NO: 165661 - RNA, 64 nt, Human
uggggaaggaggaggcucccacuggauccauccguccagccaagagcucuucaucugcuacaag

SEQ ID NO: 165662 - RNA, 64 nt, Human
cuugagggccuuggaacugauuuuuuuuuuuuguuccagccaaauuagcaguguauaaauggca

SEQ ID NO: 165663 - RNA, 64 nt, Human
ccagccccuccagcuuuggagccaaggccaucguuccagccacuugacuguccucgacggccug

SEQ ID NO: 165664 - RNA, 64 nt, Human
uugaccagaacgcacaccucgucggggggcccaguccagccaccccccagcacuuuauguagag

SEQ ID NO: 165665 - RNA, 64 nt, Human
ccuuugggguagccacacuuugcugcuccuggacuccagccagccuucacagaggacgucccgu

SEQ ID NO: 165666 - RNA, 64 nt, Human
caugauuuucccuacacuucucccuggcccaggcuccagccacaggcaccucuccugcccccgc

SEQ ID NO: 165667 - RNA, 64 nt, Human
ccugccccugcugccaguguaccgugagcggggcuccagccaguucaagcucagagccagagcu

SEQ ID NO: 165668 - RNA, 64 nt, Human
uucucuggccuggcccaggccucuacauacuuacuccagccauuuggggugguugggucaugac

SEQ ID NO: 165669 - RNA, 64 nt, Human
ccaccugauaccucagggcaaggcccuuuuucccuccagccaggugaguguuuucuucaggcag

SEQ ID NO: 165670 - RNA, 64 nt, Human
cugcucuuugugauucucuugaguacccuuggcuuccagccaugcuguccucacauacgguaaa

SEQ ID NO: 165671 - RNA, 64 nt, Human
ccaagaacugcucagggacauuaaaggucaaaaguccagccacacucauucauccuuuccccag

SEQ ID NO: 165672 - RNA, 64 nt, Human
aaaguuuuuaaauccucauuuggugcaucuguauuccagccaauaggugugccaguuuucaugu

SEQ ID NO: 165673 - RNA, 64 nt, Human
ccuggauucacucacucacucauuccuucacucauccagccaccuaaaaacauuuacugaccau

SEQ ID NO: 165674 - RNA, 64 nt, Human
caaccagcccuggaggcugggaucugccgcucccuccagccaccagggggcaggagugcacuac

SEQ ID NO: 165675 - RNA, 64 nt, Human
ggcaucaaagaugagaagccaaagccccuacaacuccagccacccagccaggaggggcugucca

SEQ ID NO: 165676 - RNA, 64 nt, Human
accgucucggcccugaaccacgaggcugcccccauccagccacggagggaggcaccaugcaaau

SEQ ID NO: 165677 - RNA, 64 nt, Human
cagauguccugucugugagccaguuccagcuggcuccagccauccugcagggccagaccaaaga

SEQ ID NO: 165678 - RNA, 64 nt, Human
auucacugccuugccacuccaucucccuccgugcuccagccaccccugagcugaggcucccauu

SEQ ID NO: 165679 - RNA, 64 nt, Human
cccccgccccgccccacauuccgacaaccgaugcuccagccaaccccuguggagcccgcacccc

SEQ ID NO: 165680 - RNA, 64 nt, Human
ggucuuugaugucuugacagauugaccaucugucuccagccaggccaccccuuuccaaaauucc

SEQ ID NO: 165681 - RNA, 64 nt, Human
auguagaauaggcagggggcccugccccaccccauccagccagaccccacgcugaccaugcguc

SEQ ID NO: 165682 - RNA, 64 nt, Human
aguggaagaaccuuguuagaccgagagcuugccauccagccaagcugcucgaggcccugcagug

SEQ ID NO: 165683 - RNA, 64 nt, Human
uccuggacaaaggaguaguagcugaauuugauucuccagccaaccucauugcagcuagaggcau

SEQ ID NO: 165684 - RNA, 64 nt, Human
gauacacuggagaacaaagggaacucaagauucuuccagccacaugucaccuguagguagaagu

SEQ ID NO: 165685 - RNA, 64 nt, Human
cucagccagcagcugccuucguuuggaacugaaguccagccagcagacucucuagcuccaucuc

SEQ ID NO: 165686 - RNA, 64 nt, Human
ccagcacgugcuuuucagaggcugcggacuuucuuccagccauuguggcauuggccuuuccagu

SEQ ID NO: 165687 - RNA, 64 nt, Human
agcugaggaagugguuucuguguuuuacaguuuuuccagccauucuuuucuucccccuccugaa

SEQ ID NO: 165688 - RNA, 64 nt, Human
cagccuccugccaggaucaccucggcggucacacuccagccaaauaguguucucgggguggugg

SEQ ID NO: 165689 - RNA, 64 nt, Human
ucugguggcucauuguccucagagcccagacaguuccagccacuaggaggccgucuuggaacca

SEQ ID NO: 165690 - RNA, 64 nt, Human
ggaggacaaagaaaaggguuguuauuuuugucuuuccagccagccugcuggcucccaagagaga

SEQ ID NO: 165691 - RNA, 64 nt, Human
cggcucugccugugcugcaaguguuggccguggguccagccaacaacucccuacguccugugug

SEQ ID NO: 165692 - RNA, 64 nt, Human
guggacguucucgccacacucaaccccaugagcuuccagccaaggaugcccuggccgauuggaa

SEQ ID NO: 165693 - RNA, 64 nt, Human
gucccccacucucucacccaccagcuccacacauuccagccaggcccaggccagcccccccacc

SEQ ID NO: 165694 - RNA, 64 nt, Human
cuagcaaagaauguacucaggugacaccaccugcuccagccacguccagugccacaguccccag

SEQ ID NO: 165695 - RNA, 64 nt, Human
gugccaucuuucuuccuggccagagugaugggguuccagccauggggaagcaacccaauccucu

SEQ ID NO: 165696 - RNA, 64 nt, Human
uuuguacauguaauguauuauauggggucugggcuccagccagagaacaaucuuuuauuucugu

SEQ ID NO: 165697 - RNA, 64 nt, Human
caaacaucuucacccuaauagucccuccuccaauuccagccacuugucaggcucuccucuugac

SEQ ID NO: 165698 - RNA, 64 nt, Human
acagggacacagucuggugcccagacucaaggccuccagccacuuauuuccauggauuccccug

SEQ ID NO: 165699 - RNA, 64 nt, Human
gauuaagaagauguucuagaauguagauaccuuguccagccauaggaaucaaaauaaaaaacua

SEQ ID NO: 165700 - RNA, 64 nt, Human
cccuuaacuugaggccagggacccucucccuucuuccagccaagccucuccacuccuuccacuu

SEQ ID NO: 165701 - RNA, 64 nt, Human
ggggcaggagagagacacucuccaugaacacuucuccagccaccucauacccccuucccagggu

SEQ ID NO: 165702 - RNA, 64 nt, Human
ccuggccccacggacccgacucagcuugagacacuccagccaaggguccuccggacccgauccu

SEQ ID NO: 165703 - RNA, 64 nt, Human
ccccaggucccucccagaacugacuccuaaggucuccagccagggcuucugagaugcaaagguu

SEQ ID NO: 165704 - RNA, 64 nt, Human
cagauggugcuugagaaccgaggcccggugauccuccagccacaguccagcccaaccacugcca

SEQ ID NO: 165705 - RNA, 64 nt, Human
gggaguucugagccucugcaaacugugcgcauucuccagccagggaugcagaggccacccagag

SEQ ID NO: 165706 - RNA, 64 nt, Human
aggcguggccgagggaagaaaaagcuucuggauguccagccagcugcccccuuccagccccucc

SEQ ID NO: 165707 - RNA, 64 nt, Human
agcauguguccucugacguaugcccccaaagcucuccagccagacugaggucacagauguggga

SEQ ID NO: 165708 - RNA, 64 nt, Human
guauaaggacaacucuggaaacaagccuauuuccuccagccaguuucacugaaugcugcaccac

SEQ ID NO: 165709 - RNA, 64 nt, Human
uggcccuggcccaucugccuccuggccuuccuguuccagccacuggggugggggccagguucac

SEQ ID NO: 165710 - RNA, 64 nt, Human
cgccucucuagaccagaucuagccccacccucacuccagccaucucggagcccuuguguaggca

SEQ ID NO: 165711 - RNA, 64 nt, Human
cugccacccgacaucaaagcuggcgugugaccuuuccagccaugcgauauuccccuuggaagau

SEQ ID NO: 165712 - RNA, 64 nt, Human
ucccucgcuguugaggccaccaugccuuacugcauccagccaggcugcagggagugaggcacac

SEQ ID NO: 165713 - RNA, 63 nt, Human
ccaaagacaaagaugacugaaauaacuucaaauuccagccaaacguuccuuguugccacuuug

SEQ ID NO: 165714 - RNA, 64 nt, Human
gggaagggccagugcaacugggcgcuugggccacuccagccagcccgccuccggggcggacccu

SEQ ID NO: 165715 - RNA, 64 nt, Human
uucccccaacacucccaaagauacccacaggaaguccagccaguuuccagguagaggauuccac

SEQ ID NO: 165716 - RNA, 64 nt, Human
uuauuuauacagagcauuuguugccaacuguuguuccagccauccacacaggagucuguucuga

SEQ ID NO: 165717 - RNA, 64 nt, Human
gacugagggcaggaugcucucccacccggaccccuccagccaagcagcccuucaaguucuuuua

SEQ ID NO: 165718 - RNA, 64 nt, Human
acaaccugccccggccaggccugcagacccagacuccagccagaccugccucacccaccaaugc

SEQ ID NO: 165719 - RNA, 64 nt, Human
ggugccaacaggccuggcccuuuccuccccugcauccagccaugggggccucugcgauugccgg

SEQ ID NO: 165720 - RNA, 64 nt, Human
caauuagugcugauaauuccuauguggaaaugauuccagccaugguccccucacuugagcaugu

SEQ ID NO: 165721 - RNA, 64 nt, Human
cuccaucaagugguaauauguuugcagccugcuguccagccaagagugacagauacuucuagug

SEQ ID NO: 165722 - RNA, 64 nt, Human
cucacuucuuagaauccuccugcaagagggcaacuccagccaguguucagcgacugaacagcca

SEQ ID NO: 165723 - RNA, 64 nt, Human
ugggccugacggaggccgaggggcagaccggggcuccagccagaccccugaaaggaaggugcuc

SEQ ID NO: 165724 - RNA, 64 nt, Human
uguuaucauguuauacguacacuuagaauaaugauccagccaucucauucuaacagcaaugaga

SEQ ID NO: 165725 - RNA, 64 nt, Human
ggcaggccacagagggcucucguguggggugguguccagccagcucuugcuaagcaaucacgug

SEQ ID NO: 165726 - RNA, 64 nt, Human
uuaaagaaaagaauuuucaacccagaauuucauauccagccaaacuaagcuucauaagugaagg

SEQ ID NO: 165727 - RNA, 64 nt, Human
gagauaguuaagccaauuccauuuauagaccaccuccagccagugacgcuccgaguugaggaug

SEQ ID NO: 165728 - RNA, 64 nt, Human
aaauagauaacauccuguggauuuagggauauuuuccagccagaauggauccagaagaauugaa

SEQ ID NO: 165729 - RNA, 64 nt, Human
cgcgugugagugugcaugugugugugugcaaagguccagccaccccguccuccagccugcaagg

SEQ ID NO: 165730 - RNA, 64 nt, Human
auuaccccucucaacaggccagcugcugguuggcuccagccaguguggcccugggguaaagggg

SEQ ID NO: 165731 - RNA, 64 nt, Human
gaggcugcacugaccuaugguagugcuacugcacuccagccagggcaacagagugagacccugu

SEQ ID NO: 165732 - RNA, 64 nt, Human
ggacucaagggccaagauggaggggcugacucaguccagccaacauuuaaugagcaccuacuuu

SEQ ID NO: 165733 - RNA, 64 nt, Human
ggaggcgcugucugucccucugucccucuguguuuccagccaucucgcccugccagcccagcac

SEQ ID NO: 165734 - RNA, 64 nt, Human
ugcacagggggaaguuauuaaagaggcugcaaaguccagccacccugaagauacuccccagugc

SEQ ID NO: 165735 - RNA, 64 nt, Human
gcucagcggggggagcuggcaccuuccuggagccuccagccaguccuguccucccucgcccuac

SEQ ID NO: 165736 - RNA, 64 nt, Human
uaucaucccauggucccaaaagggcugcuacacauccagccaucacaugcagauaauuccuuuc

SEQ ID NO: 165737 - RNA, 64 nt, Human
uaccaggagccugggccucccugaaccccuggcuuccagccaucucaucgccagccuccuccug

SEQ ID NO: 165738 - RNA, 64 nt, Human
gcaaaguaauagggcuucugccuaagccucucccuccagccaauaggcagcuuucuuaacuauc

SEQ ID NO: 165739 - RNA, 64 nt, Human
aaggcugcagugaguugugaucacaccauugcaguccagccagguugacagaaugagacccugu

SEQ ID NO: 165740 - RNA, 64 nt, Human
uguccggccugagcgccucccuccuggagcggcguccagccagcccgcugggcccugcuggggg

SEQ ID NO: 165741 - RNA, 64 nt, Human
uaucaggaagauguccuuccugggaagaagaagcuccagccaguucugcugcaagucaaccagc

SEQ ID NO: 165742 - RNA, 64 nt, Human
cguuccuucaccccgcgugucgccagccucuggguccagccagagccccuggcuucuccgccac

SEQ ID NO: 165743 - RNA, 62 nt, Human
guccuuuccccagcuccuaauaccucuaccuuuccagccaaggcauggacccugacaccugc

SEQ ID NO: 165744 - RNA, 62 nt, Human
gcgccggggacuccggcuagaagccgggugguuccagccauuccugcagccaagggcacugg

SEQ ID NO: 165745 - RNA, 64 nt, Human
ccgaaucaugacagucagcaacaugauaccuggauccagccauuccugaagcccacccugcacc

SEQ ID NO: 165746 - RNA, 64 nt, Human
ugcuggagaacuaaucacccagagggagcuggucuccagccaggugagcaacaaccuuauggag

SEQ ID NO: 165747 - RNA, 64 nt, Human
ugcacauggggccugcucaccuugcccacacaucuccagccagccagggcccugcccagcuuca

SEQ ID NO: 165748 - RNA, 51 nt, Human
gcuaccgcguccaggugugaguccagccacgcggaugccgccucaaggguc

SEQ ID NO: 165749 - RNA, 64 nt, Human
accagaaaggugggaaaaucuuuaguaggaauccuccagccauuauaucccagagagcucauuu

SEQ ID NO: 165750 - RNA, 64 nt, Human
aaaaaggggcaucaaauagaagauuuacuauuauuccagccauguaaaaauaugugcacauaug

SEQ ID NO: 165751 - RNA, 64 nt, Human
gaaauccuuugauccgggagcccuagguuuccucuccagccaacggggcgucgcugccuuaaug

SEQ ID NO: 165752 - RNA, 64 nt, Human
uucugaaauguuuaccccauugaccaaacuuggcuccagccauugcggugguuucuagauagcc

SEQ ID NO: 165753 - RNA, 64 nt, Human
gcaaaguaauagggcuucugccuaagccucucccuccagccaauaggcagcuuucuuaacuacc

SEQ ID NO: 165754 - RNA, 64 nt, Human
cccagccuccuccagggcugcccaaggcaggguuuccagccaggccucggggucaucuuuucac

SEQ ID NO: 165755 - RNA, 64 nt, Human
ugauccuggagggaccagagucugagcugguccuuccagccaggccuggcagccagaggugcuc

SEQ ID NO: 165756 - RNA, 51 nt, Human
acuacuuugcaugugaauaguuccagccaggccccaagcccacuggggugu

SEQ ID NO: 165757 - RNA, 64 nt, Human
ccucuuccucccuugccccaacccugagaaaggguccagccacuacccuguuggcaaacauucc

SEQ ID NO: 165758 - RNA, 64 nt, Human
ccaguaggcaucugccaagaagggugcugaaggcuccagccagcuguccuggguuuccguuuug

SEQ ID NO: 165759 - RNA, 64 nt, Human
uuucacauccauccagagcucggaaucuacagcguccagccauuuccagcaagagcgcuuccca

SEQ ID NO: 165760 - RNA, 64 nt, Human
ggaagguguccugugucacucccaauuucugagguccagccaccaccaggcugagcagugagga

SEQ ID NO: 165761 - RNA, 64 nt, Human
ccaggcucuuacuccagccggggcugccagcgcauccagccagcccagcccugugaaagaugga

SEQ ID NO: 165762 - RNA, 64 nt, Human
auccauaucccuacaacuugguacucuaucagauuccagccacuagaagaaccucagugagaaa

SEQ ID NO: 165763 - RNA, 64 nt, Human
agggggcuguggggccagaagcugggccaagcccuccagccagaguugccagcaggcgagugcu

SEQ ID NO: 165764 - RNA, 64 nt, Human
gagguacucaaggguuugggggcaaaacccugaauccagccagucgugcacagagacacaccca

SEQ ID NO: 165765 - RNA, 64 nt, Human
uggaauauuuugagccaggagagcgccuucucucuccagccaucaccgcugugguuguucaggg

SEQ ID NO: 165766 - RNA, 64 nt, Human
gguccugcccucccauggggugacucaugaccccuccagccaggacucuccuacauguggcccc

SEQ ID NO: 165767 - RNA, 64 nt, Human
ugagugguccacauucugcugcccccagaccccauccagccagggguggggaugggguugggcu

SEQ ID NO: 165768 - RNA, 64 nt, Human
ggggugcacagguagccccgacccucucaggcauuccagccacagaacaucaaagugagcgagu

SEQ ID NO: 165769 - RNA, 64 nt, Human
uuaugggacugugacuggacucuuccguucuggcuccagccagaccuucagugguccugccugg

SEQ ID NO: 165770 - RNA, 64 nt, Human
gcgcaagcccaucaaccugaaggcauaaaccacauccagccaccuccuucugaucagcagcaaa

SEQ ID NO: 165771 - RNA, 64 nt, Human
ucucgucauuuaaagggaaaacaaaaucugagucuccagccaggaggcuucucccagagaggac

SEQ ID NO: 165772 - RNA, 64 nt, Human
ugggggcagucgccgagagccuccuuccccuccguccagccagcaaggcuuucccaagcguccu

SEQ ID NO: 165773 - RNA, 64 nt, Human
ggaccuucguguuuuuccggggcucaggucucacuccagccaucgcuguggccaguggagagcc

SEQ ID NO: 165774 - RNA, 64 nt, Human
gcaggaguguuugucaggcucccgcucuggccuuuccagccaccuuucaugucuucauauuuua

SEQ ID NO: 165775 - RNA, 64 nt, Human
aaggugagcuuucugugcuacccacuuguuagauuccagccaccucagggauucugauccaugu

SEQ ID NO: 165776 - RNA, 64 nt, Human
accuuaggagccgggugacagcacuaaccagaccuccagccacucacagcucuuuuuaaaaaac

SEQ ID NO: 165777 - RNA, 64 nt, Human
aggcagagcuggggccugaaggcucugagcagccuccagccagggggcuccuccagggcugaac

SEQ ID NO: 165778 - RNA, 64 nt, Human
uucgacuuuuuuagaaaaaugaucuccauuucuuuccagccaugauguuuaguaaauauuuuua

SEQ ID NO: 165779 - RNA, 64 nt, Human
ggcugugugccuccaacccuggucccccucugucuccagccacccucugcuugggcuucugagc

SEQ ID NO: 165780 - RNA, 64 nt, Human
accaaaaccuggguguccucacugcugcccugaguccagccaugguuuucagggggacagugga

SEQ ID NO: 165781 - RNA, 64 nt, Human
cugaggccccagaacucgucugugaaccaccuuuuccagccagaguucccaaagcuggaacgcu

SEQ ID NO: 165782 - RNA, 64 nt, Human
cagcuccacgugugccaucaguggauccgauccguccagccauggcuuccuauuccaagauggu

SEQ ID NO: 165783 - RNA, 64 nt, Human
ggguuccagggcugcugucuccuggcuaauaaucuccagccagcuggaggaaggaagggcgggc

SEQ ID NO: 165784 - RNA, 64 nt, Human
uccagggcugcuuucuccuggcuaauaauaaauauccagccagcuggaggaaggaagggcaggc

SEQ ID NO: 165785 - RNA, 64 nt, Human
ucuucagccuccaaccuccggggcgaccuucucuuccagccacagucccaugagggccccuagc

SEQ ID NO: 165786 - RNA, 64 nt, Human
guggccuucauggagggugguaacagcaccucaguccagccaaaauguuuagaaacacucaguc

SEQ ID NO: 165787 - RNA, 64 nt, Human
cguuccggagcuggguaucucaaaucugcuuucauccagccacugcccaaagccaucuuccugc

SEQ ID NO: 165788 - RNA, 64 nt, Human
ugcagaagcugcccuuucacccaucuugacaagauccagccacccaggacucacccaugccugg

SEQ ID NO: 165789 - RNA, 64 nt, Human
gugauggaccagagucacuucuccuccuccuuucuccagccagcccugaccccucaugcucucu

SEQ ID NO: 165790 - RNA, 64 nt, Human
aagcugcccucacuacagagaccuuggacaaggauccagccagucccucucugccccacaaccc

SEQ ID NO: 165791 - RNA, 64 nt, Human
acugccugaauacaggcuuuagguuccccuggacuccagccaaggcuguucaggugggaccaug

SEQ ID NO: 165792 - RNA, 64 nt, Human
gacggccccgaucccgccagaacggccuuuugcuuccagccaaagaacaccgccaacacgcaca

SEQ ID NO: 165793 - RNA, 64 nt, Human
cauggcugguuccugaguggcucuggugauacucuccagccaccugcugacauucagaaucuca

SEQ ID NO: 165794 - RNA, 64 nt, Human
cuguaaauaguccggccccgucagcgugugcugguccagccagcggcugcaggcgaguuucuag

SEQ ID NO: 165795 - RNA, 64 nt, Human
ugccaauuaaacccggucuaaauccaaaugcuucuccagccauccaggaguggcuguccuuuuc

SEQ ID NO: 165796 - RNA, 64 nt, Human
ggcaacaacccaguuggggagucuuaugaaucauuccagccaacucucugaucacaaagaauac

SEQ ID NO: 165797 - RNA, 64 nt, Human
ggaauagguugucucuuggauuaagucauaugccuccagccauuauaugagaacugugaaacca

SEQ ID NO: 165798 - RNA, 64 nt, Human
aaaaaaaccugaggaauggagugggccaacacuauccagccacucugaccagccgaaccaggaa

SEQ ID NO: 165799 - RNA, 64 nt, Human
aaaaaaaccugaggaauggagugggccaacacuauccagccacucugaccagccgaacgaggaa

SEQ ID NO: 165800 - RNA, 64 nt, Human
gaagaugaccucauguucauuguuccugguuuuuuccagccagcagccucuacacuccaucaua

SEQ ID NO: 165801 - RNA, 64 nt, Human
gugaccuuguucuuuacagacgucgugaucagccuccagccauacagaacaaaugagaaauuag

SEQ ID NO: 165802 - RNA, 64 nt, Human
uuuuuuggggggugguccccgucuggggggccccuccagccaguacuccaggucucccugucuc

SEQ ID NO: 165803 - RNA, 64 nt, Human
ccaccccuucuggggucacuccauccaugcucucuccagccagccaucucaaggagaaacauag

SEQ ID NO: 165804 - RNA, 64 nt, Human
cuagacaaaccaucuccuccuugccggcucccccuccagccagagacagaggauguggccuggu

SEQ ID NO: 165805 - RNA, 64 nt, Human
cuauuuuuuuuuuuuuguuauccuguauaccuccuccagccaugaaguagaggacuaaccaugu

SEQ ID NO: 165806 - RNA, 64 nt, Human
aguagaaaaauaacugguugcauguaaaauuccuuccagccagaaagaaagaaagacaaggagu

SEQ ID NO: 165807 - RNA, 64 nt, Human
uguguugguacaggcuucugcaugccugguaaaguccagccaaggcuggucaaggcaacaucuc

SEQ ID NO: 165808 - RNA, 64 nt, Human
gugaccuuguucuuuacagacaucaugaucagccuccagccauacagaacaaaugagaaauuag

SEQ ID NO: 165809 - RNA, 64 nt, Human; identical to SEQ ID NO: 42454

SEQ ID NO: 165810 - RNA, 64 nt, Human; identical to SEQ ID NO: 42455

SEQ ID NO: 165811 - RNA, 64 nt, Human; identical to SEQ ID NO: 42456

SEQ ID NO: 165812 - RNA, 64 nt, Human; identical to SEQ ID NO: 42457

SEQ ID NO: 165813 - RNA, 64 nt, Human; identical to SEQ ID NO: 42458

SEQ ID NO: 165814 - RNA, 64 nt, Human; identical to SEQ ID NO: 42459

SEQ ID NO: 165815 - RNA, 64 nt, Human; identical to SEQ ID NO: 42460

SEQ ID NO: 165816 - RNA, 64 nt, Human; identical to SEQ ID NO: 42461

SEQ ID NO: 165817 - RNA, 64 nt, Human; identical to SEQ ID NO: 42462

SEQ ID NO: 165818 - RNA, 64 nt, Human; identical to SEQ ID NO: 42463

SEQ ID NO: 165819 - RNA, 64 nt, Human; identical to SEQ ID NO: 42464

SEQ ID NO: 165820 - RNA, 64 nt, Human; identical to SEQ ID NO: 42465

SEQ ID NO: 165821 - RNA, 64 nt, Human; identical to SEQ ID NO: 42466

SEQ ID NO: 165822 - RNA, 64 nt, Human; identical to SEQ ID NO: 42467

SEQ ID NO: 165823 - RNA, 64 nt, Human; identical to SEQ ID NO: 42468

SEQ ID NO: 165824 - RNA, 64 nt, Human; identical to SEQ ID NO: 42469

SEQ ID NO: 165825 - RNA, 64 nt, Human; identical to SEQ ID NO: 42470

SEQ ID NO: 165826 - RNA, 64 nt, Human; identical to SEQ ID NO: 42471

SEQ ID NO: 165827 - RNA, 64 nt, Human; identical to SEQ ID NO: 42472

SEQ ID NO: 165828 - RNA, 64 nt, Human; identical to SEQ ID NO: 42473

SEQ ID NO: 165829 - RNA, 64 nt, Human; identical to SEQ ID NO: 42474

SEQ ID NO: 165830 - RNA, 64 nt, Human; identical to SEQ ID NO: 42475

SEQ ID NO: 165831 - RNA, 64 nt, Human; identical to SEQ ID NO: 42476

SEQ ID NO: 165832 - RNA, 64 nt, Human; identical to SEQ ID NO: 42477

SEQ ID NO: 165833 - RNA, 64 nt, Human; identical to SEQ ID NO: 42478

SEQ ID NO: 165834 - RNA, 64 nt, Human; identical to SEQ ID NO: 42479

SEQ ID NO: 165835 - RNA, 64 nt, Human; identical to SEQ ID NO: 42480

SEQ ID NO: 165836 - RNA, 64 nt, Human; identical to SEQ ID NO: 42481

SEQ ID NO: 165837 - RNA, 64 nt, Human; identical to SEQ ID NO: 42482

SEQ ID NO: 165838 - RNA, 64 nt, Human; identical to SEQ ID NO: 42483

SEQ ID NO: 165839 - RNA, 64 nt, Human; identical to SEQ ID NO: 42484

SEQ ID NO: 165840 - RNA, 64 nt, Human; identical to SEQ ID NO: 42485

SEQ ID NO: 165841 - RNA, 64 nt, Human; identical to SEQ ID NO: 42486

SEQ ID NO: 165842 - RNA, 64 nt, Human; identical to SEQ ID NO: 42487

SEQ ID NO: 165843 - RNA, 64 nt, Human; identical to SEQ ID NO: 42488

SEQ ID NO: 165844 - RNA, 64 nt, Human; identical to SEQ ID NO: 42489

SEQ ID NO: 165845 - RNA, 64 nt, Human; identical to SEQ ID NO: 42490

SEQ ID NO: 165846 - RNA, 64 nt, Human; identical to SEQ ID NO: 42491

SEQ ID NO: 165847 - RNA, 64 nt, Human; identical to SEQ ID NO: 42492

SEQ ID NO: 165848 - RNA, 64 nt, Human; identical to SEQ ID NO: 42493

SEQ ID NO: 165849 - RNA, 64 nt, Human; identical to SEQ ID NO: 42494

SEQ ID NO: 165850 - RNA, 64 nt, Human; identical to SEQ ID NO: 42495

SEQ ID NO: 165851 - RNA, 64 nt, Human; identical to SEQ ID NO: 42496

SEQ ID NO: 165852 - RNA, 64 nt, Human; identical to SEQ ID NO: 42497

SEQ ID NO: 165853 - RNA, 64 nt, Human; identical to SEQ ID NO: 42498

SEQ ID NO: 165854 - RNA, 64 nt, Human; identical to SEQ ID NO: 42499

SEQ ID NO: 165855 - RNA, 64 nt, Human; identical to SEQ ID NO: 42500

SEQ ID NO: 165856 - RNA, 64 nt, Human; identical to SEQ ID NO: 42501

SEQ ID NO: 165857 - RNA, 64 nt, Human; identical to SEQ ID NO: 42502

SEQ ID NO: 165858 - RNA, 64 nt, Human; identical to SEQ ID NO: 42503

SEQ ID NO: 165859 - RNA, 50 nt, Human; identical to SEQ ID NO: 42504

SEQ ID NO: 165860 - RNA, 64 nt, Human; identical to SEQ ID NO: 42505

SEQ ID NO: 165861 - RNA, 64 nt, Human; identical to SEQ ID NO: 42506

SEQ ID NO: 165862 - RNA, 64 nt, Human; identical to SEQ ID NO: 42507

SEQ ID NO: 165863 - RNA, 64 nt, Human; identical to SEQ ID NO: 42508

SEQ ID NO: 165864 - RNA, 64 nt, Human; identical to SEQ ID NO: 42509

SEQ ID NO: 165865 - RNA, 64 nt, Human; identical to SEQ ID NO: 42510

SEQ ID NO: 165866 - RNA, 64 nt, Human; identical to SEQ ID NO: 42511

SEQ ID NO: 165867 - RNA, 64 nt, Human; identical to SEQ ID NO: 42512

SEQ ID NO: 165868 - RNA, 64 nt, Human; identical to SEQ ID NO: 42513

SEQ ID NO: 165869 - RNA, 64 nt, Human; identical to SEQ ID NO: 42514

SEQ ID NO: 165870 - RNA, 64 nt, Human; identical to SEQ ID NO: 42515

SEQ ID NO: 165871 - RNA, 64 nt, Human; identical to SEQ ID NO: 42516

SEQ ID NO: 165872 - RNA, 64 nt, Human; identical to SEQ ID NO: 42517

SEQ ID NO: 165873 - RNA, 64 nt, Human; identical to SEQ ID NO: 42518

SEQ ID NO: 165874 - RNA, 64 nt, Human; identical to SEQ ID NO: 42519

SEQ ID NO: 165875 - RNA, 64 nt, Human; identical to SEQ ID NO: 42520

SEQ ID NO: 165876 - RNA, 64 nt, Human; identical to SEQ ID NO: 42521

SEQ ID NO: 165877 - RNA, 64 nt, Human; identical to SEQ ID NO: 42522

SEQ ID NO: 165878 - RNA, 64 nt, Human; identical to SEQ ID NO: 42523

SEQ ID NO: 165879 - RNA, 64 nt, Human; identical to SEQ ID NO: 42524

SEQ ID NO: 165880 - RNA, 64 nt, Human; identical to SEQ ID NO: 42525

SEQ ID NO: 165881 - RNA, 63 nt, Human
agcagaaccgaugagagccgcccuuaccguuggucuccggaucccccagucccaucccgccgu

SEQ ID NO: 165882 - RNA, 63 nt, Human
ugcaguaguccuguggugaagagacuuguuucaucuccggaaaugcaaaaccauuuauagcau

SEQ ID NO: 165883 - RNA, 63 nt, Human
gccuccgacaguguccucgcucuaccucugaccucuccggagguuccgcugccuccaagccgg

SEQ ID NO: 165884 - RNA, 63 nt, Human
gucucaguguccugcuagccagccgaacacuucucuccggaagcaggcugguucgacugugag

SEQ ID NO: 165885 - RNA, 63 nt, Human
acuucuagagcucuucuucuuccuucauuggccucuccggauguugaaacaaccacaggucaa

SEQ ID NO: 165886 - RNA, 63 nt, Human
cgccgucguccgccccgggcuuggacgcgcccuucuccggaaggcucuggccccaagcuggcc

SEQ ID NO: 165887 - RNA, 63 nt, Human
ccugcgccugcagcagacgcagagcuugcauucucuccggagcaucucagcaagcaaggccuc

SEQ ID NO: 165888 - RNA, 63 nt, Human
aagcccuggccccaacucggaguccuccagugaucuccggagcuaguucccugcccucacacc

SEQ ID NO: 165889 - RNA, 63 nt, Human
uuacugccuugccauucugccccuggacccuucucuccggaccagggaggcgucccucccuag

SEQ ID NO: 165890 - RNA, 63 nt, Human
ggaaaagccaagggaacggauucuccucuagagucuccggaaggaacacagcucuugacacau

SEQ ID NO: 165891 - RNA, 63 nt, Human
gucugagcggcccggguccugccgggcugaccaucuccggauccugggacacucugccugacc

SEQ ID NO: 165892 - RNA, 63 nt, Human
ccccacugugggcuggggacgccugcccuucugucuccggacgcucuaggcgaguucagcuug

SEQ ID NO: 165893 - RNA, 63 nt, Human
cugccucggagcugauugcagggcccuguguggucuccggacagcugcgggaaggcugccgca

SEQ ID NO: 165894 - RNA, 63 nt, Human
cauuuuagucuuuaaacccucaggaagucacagucuccggacaccacaccacaugagcccaac

SEQ ID NO: 165895 - RNA, 63 nt, Human
cugccagugugcagacucugggacugcgugcugucuccggaccaucaggguaggguggugggu

SEQ ID NO: 165896 - RNA, 63 nt, Human
ccagucugucccccuccagguucggcacccaggucuccggaggagacacaguuacccgaaccc

SEQ ID NO: 165897 - RNA, 63 nt, Human
ucuaaaucucagggcaaacauggugaaucuaucucuccggagauaauuucauacagagauuuu

SEQ ID NO: 165898 - RNA, 63 nt, Human
uuguacagaugauccugaaagucacuuccaaguucuccggauauucacaaaacugccuuccau

SEQ ID NO: 165899 - RNA, 63 nt, Human
uccuccugcaugucggggccccugcguguguucucuccggauggaaucacagccaauaaacac

SEQ ID NO: 165900 - RNA, 63 nt, Human
ggagagugcucccgacagguggccccagcuuccucuccggagccugcgcacagagagucacgc

SEQ ID NO: 165901 - RNA, 63 nt, Human
auagacucccacuccacaaaggugcuggguggcucuccggacaggagcuggccugacucucac

SEQ ID NO: 165902 - RNA, 63 nt, Human
ugaugcagaagcucccagaacacucaggaaacuucuccggacagagcccuccuugucaacuug

SEQ ID NO: 165903 - RNA, 63 nt, Human
aaaaaagaaaaucaaagaaggaugcagaaauugucuccggaguguuaagcauauuuuauucuu

SEQ ID NO: 165904 - RNA, 63 nt, Human
aguccgacaaccauugggguggggcugcaucagucuccggaguggcccgccaccuccugaagc

SEQ ID NO: 165905 - RNA, 63 nt, Human
agagaggccugagggagggauuccaugcugccuucuccggacucugcgucggguuuccucacc

SEQ ID NO: 165906 - RNA, 63 nt, Human
ggccacgacucugggcacuuccccugaagcuccucuccggagcuugacuucuuggaccuccuc

SEQ ID NO: 165907 - RNA, 63 nt, Human
ggcgcacacggagugacgggcgcccggccccacucuccggaucuggacgaugggcucacgcca

SEQ ID NO: 165908 - RNA, 63 nt, Human
cagccccgcgaccauguggccacaauccacgcuucuccggaucgcggugcgccggaaccacgg

SEQ ID NO: 165909 - RNA, 63 nt, Human
gucuccccuccgcagcagauaccucgguccagaucuccggauugucgggggacgcaggacucu

SEQ ID NO: 165910 - RNA, 63 nt, Human
gggggugggcgaggccugagcugcgggcugcccucuccggaagugccuugcacaaauaggcgc

SEQ ID NO: 165911 - RNA, 63 nt, Human
gccggccccaggugcuccccugacagucccuccucuccggagcauuuugauaccagaagggaa

SEQ ID NO: 165912 - RNA, 63 nt, Human
uaacgcaugcacggucucgugaugcucccucccucuccggagugacaggcacauacaugagaa

SEQ ID NO: 165913 - RNA, 63 nt, Human
cuuguuuguuuuucaaauuauuuagaaauaaguucuccggaugggcuguugugauaccacuua

SEQ ID NO: 165914 - RNA, 63 nt, Human
ggaugggcugcccccagccagcucccagcagcuucuccggaagcugcucuugccauaaucaac

SEQ ID NO: 165915 - RNA, 63 nt, Human
ugcccucuguccccacugccggcccauguucucucuccggaggucaccaaggaaugcacaggu

SEQ ID NO: 165916 - RNA, 63 nt, Human
guaccggcucucagaggguccgugcauuccugcucuccggacccccaaagggcccagcauugg

SEQ ID NO: 165917 - RNA, 63 nt, Human
gcuccaccacuuccgcaggccuggaaacuuccuucuccggaggaccuuuuacuaaaagguaga

SEQ ID NO: 165918 - RNA, 63 nt, Human
uugcaguccacagggaauggaugcuucacuugaucuccggaccuuggcugcagaggccaucgc

SEQ ID NO: 165919 - RNA, 63 nt, Human
acagauagcuccagcuuuuguuggugggaguggucuccggaggccucccagaaccaaggguag

SEQ ID NO: 165920 - RNA, 63 nt, Human
aacccuguggaccacgacagggcagaaggaguuucuccggagaugagccggcgaggccaggug

SEQ ID NO: 165921 - RNA, 63 nt, Human
acaaacccucaguggggcuuuguuuuuggauuuucuccggacucaucaguaaaccuguagaag

SEQ ID NO: 165922 - RNA, 63 nt, Human
aagcagcuauugacugguuugaugguaaagaauucuccggaaauccuaucaaggucucauuug

SEQ ID NO: 165923 - RNA, 63 nt, Human
cgggugcacacaaaugaguggguugcugugcugucuccggaagauucugucguugcccuuggc

SEQ ID NO: 165924 - RNA, 61 nt, Human
gcaauuuacugugcugcugagugugaggucaucuccggagcguuuucagcagccccuggcu

SEQ ID NO: 165925 - RNA, 63 nt, Human
cccacacaccugcacccuagcuucgugcuucucucuccggacucucauuauccaacccgcugc

SEQ ID NO: 165926 - RNA, 63 nt, Human
uaaaacccaggaugaggaggaacaggcagaagcucuccggaggauccagguggugcaugcauu

SEQ ID NO: 165927 - RNA, 63 nt, Human
cccagaggccaccucgccccucccucugggaccucuccggauggggaguccuuggccaggguc

SEQ ID NO: 165928 - RNA, 63 nt, Human
agggaagggggaguaccaccugagucuccagcuucuccggaggagccagcuguccugguggga

SEQ ID NO: 165929 - RNA, 59 nt, Human
cagaggagacaccaguaugaaugcugggcucuccggacccugcagcagagaggccagag

SEQ ID NO: 165930 - RNA, 63 nt, Human
guccuccccccacgaccuucuguacggauuugcucuccggaaggaauucugguuucgcgugau

SEQ ID NO: 165931 - RNA, 63 nt, Human
uucccgcuagagccccguccuccucugcggggcucuccggacccccuucccccucaccuccag

SEQ ID NO: 165932 - RNA, 63 nt, Human
ccuccccccaucuccuccuccgcugugcccgucucuccggagcccuccugccucauugcuccu

SEQ ID NO: 165933 - RNA, 63 nt, Human
ccgggagccugcggcccgggccagcccgggcuuucuccggagcagagcagcgcugcuggccug

SEQ ID NO: 165934 - RNA, 52 nt, Human
agguggccaccuucuccuaggaucuccggaugggcgcaccugcugcucaggg

SEQ ID NO: 165935 - RNA, 63 nt, Human
ggaccggagcccuggccucugcagcagccgcagucuccggauccaaagccaaagccgaaugag

SEQ ID NO: 165936 - RNA, 63 nt, Human
accuuguguccuggcccaccugaccuuugguguucuccggauccuuuucagcccgaggccuga

SEQ ID NO: 165937 - RNA, 63 nt, Human
ugagaucccagcucuauucuugguauaaaggcuucuccggaucaguacaugcaugucacauua

SEQ ID NO: 165938 - RNA, 63 nt, Human
caggaauuugaacauuuuccuuuacccaggaaaucuccggagccaacaccaccacccccaggg

SEQ ID NO: 165939 - RNA, 63 nt, Human
gcuacuacguuaccacguuccuaaaacgcaagcucuccggaccagacggacacagggagaagc

SEQ ID NO: 165940 - RNA, 63 nt, Human
aaauaaaaucacccugacuguggggugcaucggucuccggagagcacagccugcagaacuccu

SEQ ID NO: 165941 - RNA, 63 nt, Human
ggcugauguugcagccugcagcaagugcuuccgucuccggaauccuuggggagcacuugucca

SEQ ID NO: 165942 - RNA, 63 nt, Human
gccagaaggcucugagacauagcagcaguauccucuccggaucugucgauuuggagaccuucc

SEQ ID NO: 165943 - RNA, 63 nt, Human
ccuugaucccagaagcuagaggagcuauuuagaucuccggauuuacaugcauuacccucaugu

SEQ ID NO: 165944 - RNA, 64 nt, Human
acaggaaagacgaauuaaaaauaacauuuuuuaagcgacauaaggaugaaauacugaugaaucu

SEQ ID NO: 165945 - RNA, 64 nt, Human
agauucuggaaaugcaucaauaaccuaagaaaaagcgacauaaaaauauacuuauggcuugugu

SEQ ID NO: 165946 - RNA, 64 nt, Human
ccuccucacuggccaucccucgugguccccaacagcgacauagcccaucccugccuggucacag

SEQ ID NO: 165947 - RNA, 64 nt, Human
uuuuuuuaaguucuauuuuaaaagcuaucaaacagcgacauagccauacaucugacugccugac

SEQ ID NO: 165948 - RNA, 64 nt, Human
aagacugcauggauaagggcugcaucauuuaauugcgacauaccaguggaaauuguauguaugu

SEQ ID NO: 165949 - RNA, 64 nt, Human
ccuccucccugcauuuccucguggggcacuauuugcgacauaggccuacagaauuagacuuuca

SEQ ID NO: 165950 - RNA, 64 nt, Human
aguuaagccuguugucuguuguagucuguaagaugcgacauagcugugucugugccaguaugcc

SEQ ID NO: 165951 - RNA, 64 nt, Human
agaacaguugcuuaaagaguuaaggacauugaaagcgacauaaauagucacuuuaaaaaggaaa

SEQ ID NO: 165952 - RNA, 64 nt, Human
auuaacuauuugcaccgaaaugucuuguuuuguugcgacauaggaaaauaaccaagcacaaagu

SEQ ID NO: 165953 - RNA, 62 nt, Human
aaggggcauguggcuguugagaagucaaguaagcgacauaguaguucagguggcccaugccu

SEQ ID NO: 165954 - RNA, 64 nt, Human
acgcauuugucuuuguuugcaaaccuuucucagagcgacauaucuuuauauugauguaauaaau

SEQ ID NO: 165955 - RNA, 64 nt, Human
ggucccaaaucuaucaaacucagugcccucuuuagcgacauauuuugugacauuccuuccauua

SEQ ID NO: 165956 - RNA, 64 nt, Human
ugggagcagaggccccucacucaacgacguuugugcgacauaguauuguauccaccuuaguauu

SEQ ID NO: 165957 - RNA, 64 nt, Human; identical to SEQ ID NO: 120952

SEQ ID NO: 165958 - RNA, 64 nt, Human; identical to SEQ ID NO: 120953

SEQ ID NO: 165959 - RNA, 64 nt, Human; identical to SEQ ID NO: 120954

SEQ ID NO: 165960 - RNA, 64 nt, Human; identical to SEQ ID NO: 120955

SEQ ID NO: 165961 - RNA, 64 nt, Human; identical to SEQ ID NO: 120956

SEQ ID NO: 165962 - RNA, 64 nt, Human; identical to SEQ ID NO: 120957

SEQ ID NO: 165963 - RNA, 64 nt, Human; identical to SEQ ID NO: 120958

SEQ ID NO: 165964 - RNA, 64 nt, Human; identical to SEQ ID NO: 120959

SEQ ID NO: 165965 - RNA, 64 nt, Human; identical to SEQ ID NO: 120960

SEQ ID NO: 165966 - RNA, 64 nt, Human; identical to SEQ ID NO: 120961

SEQ ID NO: 165967 - RNA, 64 nt, Human; identical to SEQ ID NO: 120962

SEQ ID NO: 165968 - RNA, 64 nt, Human; identical to SEQ ID NO: 120963

SEQ ID NO: 165969 - RNA, 64 nt, Human; identical to SEQ ID NO: 120964

SEQ ID NO: 165970 - RNA, 64 nt, Human; identical to SEQ ID NO: 120965

SEQ ID NO: 165971 - RNA, 64 nt, Human; identical to SEQ ID NO: 120966

SEQ ID NO: 165972 - RNA, 64 nt, Human; identical to SEQ ID NO: 120967

SEQ ID NO: 165973 - RNA, 64 nt, Human; identical to SEQ ID NO: 120968

SEQ ID NO: 165974 - RNA, 64 nt, Human; identical to SEQ ID NO: 120969

SEQ ID NO: 165975 - RNA, 64 nt, Human; identical to SEQ ID NO: 120970

SEQ ID NO: 165976 - RNA, 64 nt, Human; identical to SEQ ID NO: 120971

SEQ ID NO: 165977 - RNA, 64 nt, Human; identical to SEQ ID NO: 120972

SEQ ID NO: 165978 - RNA, 64 nt, Human; identical to SEQ ID NO: 120973

SEQ ID NO: 165979 - RNA, 64 nt, Human; identical to SEQ ID NO: 120974

SEQ ID NO: 165980 - RNA, 64 nt, Human; identical to SEQ ID NO: 120975

SEQ ID NO: 165981 - RNA, 64 nt, Human; identical to SEQ ID NO: 120976

SEQ ID NO: 165982 - RNA, 64 nt, Human; identical to SEQ ID NO: 120977

SEQ ID NO: 165983 - RNA, 64 nt, Human; identical to SEQ ID NO: 120978

SEQ ID NO: 165984 - RNA, 64 nt, Human; identical to SEQ ID NO: 120979

SEQ ID NO: 165985 - RNA, 64 nt, Human; identical to SEQ ID NO: 120980

SEQ ID NO: 165986 - RNA, 60 nt, Human; identical to SEQ ID NO: 120981

SEQ ID NO: 165987 - RNA, 64 nt, Human; identical to SEQ ID NO: 120982

SEQ ID NO: 165988 - RNA, 64 nt, Human; identical to SEQ ID NO: 120983

SEQ ID NO: 165989 - RNA, 64 nt, Human; identical to SEQ ID NO: 120984

SEQ ID NO: 165990 - RNA, 64 nt, Human; identical to SEQ ID NO: 120985

SEQ ID NO: 165991 - RNA, 64 nt, Human; identical to SEQ ID NO: 120986

SEQ ID NO: 165992 - RNA, 64 nt, Human; identical to SEQ ID NO: 120987

SEQ ID NO: 165993 - RNA, 64 nt, Human; identical to SEQ ID NO: 120988

SEQ ID NO: 165994 - RNA, 64 nt, Human; identical to SEQ ID NO: 120989

SEQ ID NO: 165995 - RNA, 64 nt, Human; identical to SEQ ID NO: 120990

SEQ ID NO: 165996 - RNA, 64 nt, Human; identical to SEQ ID NO: 120991

SEQ ID NO: 165997 - RNA, 64 nt, Human; identical to SEQ ID NO: 120992

SEQ ID NO: 165998 - RNA, 64 nt, Human; identical to SEQ ID NO: 120993

SEQ ID NO: 165999 - RNA, 64 nt, Human; identical to SEQ ID NO: 120994

SEQ ID NO: 166000 - RNA, 64 nt, Human; identical to SEQ ID NO: 120995

SEQ ID NO: 166001 - RNA, 64 nt, Human; identical to SEQ ID NO: 120996

SEQ ID NO: 166002 - RNA, 64 nt, Human; identical to SEQ ID NO: 120997

SEQ ID NO: 166003 - RNA, 64 nt, Human; identical to SEQ ID NO: 120998

SEQ ID NO: 166004 - RNA, 64 nt, Human; identical to SEQ ID NO: 120999

SEQ ID NO: 166005 - RNA, 64 nt, Human; identical to SEQ ID NO: 121000

SEQ ID NO: 166006 - RNA, 64 nt, Human; identical to SEQ ID NO: 121001

SEQ ID NO: 166007 - RNA, 64 nt, Human; identical to SEQ ID NO: 121002

SEQ ID NO: 166008 - RNA, 64 nt, Human; identical to SEQ ID NO: 121003

SEQ ID NO: 166009 - RNA, 64 nt, Human; identical to SEQ ID NO: 121004

SEQ ID NO: 166010 - RNA, 64 nt, Human; identical to SEQ ID NO: 121005

SEQ ID NO: 166011 - RNA, 64 nt, Human; identical to SEQ ID NO: 121006

SEQ ID NO: 166012 - RNA, 56 nt, Human; identical to SEQ ID NO: 121007

SEQ ID NO: 166013 - RNA, 64 nt, Human; identical to SEQ ID NO: 121008

SEQ ID NO: 166014 - RNA, 64 nt, Human; identical to SEQ ID NO: 121009

SEQ ID NO: 166015 - RNA, 64 nt, Human; identical to SEQ ID NO: 121010

SEQ ID NO: 166016 - RNA, 64 nt, Human; identical to SEQ ID NO: 121011

SEQ ID NO: 166017 - RNA, 64 nt, Human; identical to SEQ ID NO: 121012

SEQ ID NO: 166018 - RNA, 64 nt, Human; identical to SEQ ID NO: 121013

SEQ ID NO: 166019 - RNA, 64 nt, Human; identical to SEQ ID NO: 121014

SEQ ID NO: 166020 - RNA, 64 nt, Human; identical to SEQ ID NO: 121015

SEQ ID NO: 166021 - RNA, 64 nt, Human; identical to SEQ ID NO: 121016

SEQ ID NO: 166022 - RNA, 64 nt, Human; identical to SEQ ID NO: 121017

SEQ ID NO: 166023 - RNA, 64 nt, Human; identical to SEQ ID NO: 121018

SEQ ID NO: 166024 - RNA, 64 nt, Human; identical to SEQ ID NO: 121019

SEQ ID NO: 166025 - RNA, 64 nt, Human; identical to SEQ ID NO: 121020

SEQ ID NO: 166026 - RNA, 64 nt, Human; identical to SEQ ID NO: 121021

SEQ ID NO: 166027 - RNA, 64 nt, Human; identical to SEQ ID NO: 121022

SEQ ID NO: 166028 - RNA, 64 nt, Human; identical to SEQ ID NO: 121023

SEQ ID NO: 166029 - RNA, 64 nt, Human; identical to SEQ ID NO: 121024

SEQ ID NO: 166030 - RNA, 64 nt, Human; identical to SEQ ID NO: 121025

SEQ ID NO: 166031 - RNA, 64 nt, Human; identical to SEQ ID NO: 121026

SEQ ID NO: 166032 - RNA, 64 nt, Human; identical to SEQ ID NO: 121027

SEQ ID NO: 166033 - RNA, 64 nt, Human; identical to SEQ ID NO: 121028

SEQ ID NO: 166034 - RNA, 64 nt, Human; identical to SEQ ID NO: 121029

SEQ ID NO: 166035 - RNA, 64 nt, Human; identical to SEQ ID NO: 121030

SEQ ID NO: 166036 - RNA, 64 nt, Human; identical to SEQ ID NO: 121031

SEQ ID NO: 166037 - RNA, 64 nt, Human; identical to SEQ ID NO: 121032

SEQ ID NO: 166038 - RNA, 64 nt, Human; identical to SEQ ID NO: 121033

SEQ ID NO: 166039 - RNA, 64 nt, Human; identical to SEQ ID NO: 121034

SEQ ID NO: 166040 - RNA, 64 nt, Human; identical to SEQ ID NO: 121035

SEQ ID NO: 166041 - RNA, 64 nt, Human; identical to SEQ ID NO: 121036

SEQ ID NO: 166042 - RNA, 64 nt, Human; identical to SEQ ID NO: 121037

SEQ ID NO: 166043 - RNA, 64 nt, Human; identical to SEQ ID NO: 121038

SEQ ID NO: 166044 - RNA, 64 nt, Human; identical to SEQ ID NO: 121039

SEQ ID NO: 166045 - RNA, 64 nt, Human; identical to SEQ ID NO: 121040

SEQ ID NO: 166046 - RNA, 64 nt, Human; identical to SEQ ID NO: 121041

SEQ ID NO: 166047 - RNA, 64 nt, Human; identical to SEQ ID NO: 121042

SEQ ID NO: 166048 - RNA, 64 nt, Human; identical to SEQ ID NO: 121043

SEQ ID NO: 166049 - RNA, 64 nt, Human; identical to SEQ ID NO: 121044

SEQ ID NO: 166050 - RNA, 64 nt, Human; identical to SEQ ID NO: 121045

SEQ ID NO: 166051 - RNA, 64 nt, Human; identical to SEQ ID NO: 121046

SEQ ID NO: 166052 - RNA, 64 nt, Human; identical to SEQ ID NO: 121047

SEQ ID NO: 166053 - RNA, 64 nt, Human; identical to SEQ ID NO: 121048

SEQ ID NO: 166054 - RNA, 64 nt, Human; identical to SEQ ID NO: 121049

SEQ ID NO: 166055 - RNA, 64 nt, Human; identical to SEQ ID NO: 121050

SEQ ID NO: 166056 - RNA, 64 nt, Human; identical to SEQ ID NO: 121051

SEQ ID NO: 166057 - RNA, 64 nt, Human; identical to SEQ ID NO: 121052

SEQ ID NO: 166058 - RNA, 59 nt, Human; identical to SEQ ID NO: 121053

SEQ ID NO: 166059 - RNA, 64 nt, Human; identical to SEQ ID NO: 121054

SEQ ID NO: 166060 - RNA, 64 nt, Human; identical to SEQ ID NO: 121055

SEQ ID NO: 166061 - RNA, 64 nt, Human; identical to SEQ ID NO: 121056

SEQ ID NO: 166062 - RNA, 64 nt, Human; identical to SEQ ID NO: 121057

SEQ ID NO: 166063 - RNA, 64 nt, Human; identical to SEQ ID NO: 121058

SEQ ID NO: 166064 - RNA, 64 nt, Human; identical to SEQ ID NO: 121059

SEQ ID NO: 166065 - RNA, 64 nt, Human; identical to SEQ ID NO: 121060

SEQ ID NO: 166066 - RNA, 64 nt, Human; identical to SEQ ID NO: 121061

SEQ ID NO: 166067 - RNA, 64 nt, Human; identical to SEQ ID NO: 121062

SEQ ID NO: 166068 - RNA, 64 nt, Human; identical to SEQ ID NO: 121063

SEQ ID NO: 166069 - RNA, 64 nt, Human; identical to SEQ ID NO: 121064

SEQ ID NO: 166070 - RNA, 64 nt, Human; identical to SEQ ID NO: 121065

SEQ ID NO: 166071 - RNA, 64 nt, Human; identical to SEQ ID NO: 121066

SEQ ID NO: 166072 - RNA, 64 nt, Human; identical to SEQ ID NO: 121067

SEQ ID NO: 166073 - RNA, 64 nt, Human; identical to SEQ ID NO: 121068

SEQ ID NO: 166074 - RNA, 64 nt, Human; identical to SEQ ID NO: 121069

SEQ ID NO: 166075 - RNA, 64 nt, Human; identical to SEQ ID NO: 121070

SEQ ID NO: 166076 - RNA, 64 nt, Human; identical to SEQ ID NO: 121071

SEQ ID NO: 166077 - RNA, 64 nt, Human; identical to SEQ ID NO: 121072

SEQ ID NO: 166078 - RNA, 64 nt, Human; identical to SEQ ID NO: 121073

SEQ ID NO: 166079 - RNA, 64 nt, Human; identical to SEQ ID NO: 121074

SEQ ID NO: 166080 - RNA, 64 nt, Human; identical to SEQ ID NO: 121075

SEQ ID NO: 166081 - RNA, 64 nt, Human; identical to SEQ ID NO: 121076

SEQ ID NO: 166082 - RNA, 64 nt, Human; identical to SEQ ID NO: 121077

SEQ ID NO: 166083 - RNA, 64 nt, Human; identical to SEQ ID NO: 121078

SEQ ID NO: 166084 - RNA, 64 nt, Human; identical to SEQ ID NO: 121079

SEQ ID NO: 166085 - RNA, 64 nt, Human; identical to SEQ ID NO: 121080

SEQ ID NO: 166086 - RNA, 64 nt, Human; identical to SEQ ID NO: 121081

SEQ ID NO: 166087 - RNA, 64 nt, Human; identical to SEQ ID NO: 121082

SEQ ID NO: 166088 - RNA, 60 nt, Human; identical to SEQ ID NO: 121083

SEQ ID NO: 166089 - RNA, 64 nt, Human; identical to SEQ ID NO: 121084

SEQ ID NO: 166090 - RNA, 64 nt, Human; identical to SEQ ID NO: 121085

SEQ ID NO: 166091 - RNA, 64 nt, Human; identical to SEQ ID NO: 121086

SEQ ID NO: 166092 - RNA, 64 nt, Human; identical to SEQ ID NO: 121087

SEQ ID NO: 166093 - RNA, 64 nt, Human; identical to SEQ ID NO: 121088

SEQ ID NO: 166094 - RNA, 64 nt, Human; identical to SEQ ID NO: 121089

SEQ ID NO: 166095 - RNA, 64 nt, Human; identical to SEQ ID NO: 121090

SEQ ID NO: 166096 - RNA, 64 nt, Human; identical to SEQ ID NO: 121091

SEQ ID NO: 166097 - RNA, 64 nt, Human; identical to SEQ ID NO: 121092

SEQ ID NO: 166098 - RNA, 64 nt, Human; identical to SEQ ID NO: 121093

SEQ ID NO: 166099 - RNA, 64 nt, Human; identical to SEQ ID NO: 121094

SEQ ID NO: 166100 - RNA, 64 nt, Human; identical to SEQ ID NO: 121095

SEQ ID NO: 166101 - RNA, 64 nt, Human; identical to SEQ ID NO: 121096

SEQ ID NO: 166102 - RNA, 64 nt, Human; identical to SEQ ID NO: 121097

SEQ ID NO: 166103 - RNA, 64 nt, Human; identical to SEQ ID NO: 121098

SEQ ID NO: 166104 - RNA, 64 nt, Human; identical to SEQ ID NO: 121099

SEQ ID NO: 166105 - RNA, 54 nt, Human; identical to SEQ ID NO: 121100

SEQ ID NO: 166106 - RNA, 64 nt, Human; identical to SEQ ID NO: 121101

SEQ ID NO: 166107 - RNA, 64 nt, Human; identical to SEQ ID NO: 121102

SEQ ID NO: 166108 - RNA, 64 nt, Human; identical to SEQ ID NO: 121103

SEQ ID NO: 166109 - RNA, 64 nt, Human; identical to SEQ ID NO: 121104

SEQ ID NO: 166110 - RNA, 64 nt, Human; identical to SEQ ID NO: 121105

SEQ ID NO: 166111 - RNA, 64 nt, Human; identical to SEQ ID NO: 121106

SEQ ID NO: 166112 - RNA, 64 nt, Human; identical to SEQ ID NO: 121107

SEQ ID NO: 166113 - RNA, 64 nt, Human; identical to SEQ ID NO: 121108

SEQ ID NO: 166114 - RNA, 64 nt, Human; identical to SEQ ID NO: 121109

SEQ ID NO: 166115 - RNA, 64 nt, Human; identical to SEQ ID NO: 121110

SEQ ID NO: 166116 - RNA, 64 nt, Human; identical to SEQ ID NO: 121111

SEQ ID NO: 166117 - RNA, 64 nt, Human; identical to SEQ ID NO: 121112

SEQ ID NO: 166118 - RNA, 53 nt, Human; identical to SEQ ID NO: 121113

SEQ ID NO: 166119 - RNA, 64 nt, Human; identical to SEQ ID NO: 121114

SEQ ID NO: 166120 - RNA, 64 nt, Human; identical to SEQ ID NO: 121115

SEQ ID NO: 166121 - RNA, 64 nt, Human; identical to SEQ ID NO: 121116

SEQ ID NO: 166122 - RNA, 64 nt, Human; identical to SEQ ID NO: 121117

SEQ ID NO: 166123 - RNA, 64 nt, Human; identical to SEQ ID NO: 121118

SEQ ID NO: 166124 - RNA, 64 nt, Human; identical to SEQ ID NO: 121119

SEQ ID NO: 166125 - RNA, 64 nt, Human; identical to SEQ ID NO: 121120

SEQ ID NO: 166126 - RNA, 64 nt, Human; identical to SEQ ID NO: 121121

SEQ ID NO: 166127 - RNA, 64 nt, Human; identical to SEQ ID NO: 121122

SEQ ID NO: 166128 - RNA, 64 nt, Human; identical to SEQ ID NO: 121123

SEQ ID NO: 166129 - RNA, 64 nt, Human; identical to SEQ ID NO: 121124

SEQ ID NO: 166130 - RNA, 64 nt, Human; identical to SEQ ID NO: 121125

SEQ ID NO: 166131 - RNA, 64 nt, Human; identical to SEQ ID NO: 121126

SEQ ID NO: 166132 - RNA, 64 nt, Human; identical to SEQ ID NO: 121127

SEQ ID NO: 166133 - RNA, 64 nt, Human; identical to SEQ ID NO: 121128

SEQ ID NO: 166134 - RNA, 64 nt, Human; identical to SEQ ID NO: 121129

SEQ ID NO: 166135 - RNA, 64 nt, Human; identical to SEQ ID NO: 121130

SEQ ID NO: 166136 - RNA, 64 nt, Human; identical to SEQ ID NO: 121131

SEQ ID NO: 166137 - RNA, 64 nt, Human; identical to SEQ ID NO: 121132

SEQ ID NO: 166138 - RNA, 64 nt, Human; identical to SEQ ID NO: 121133

SEQ ID NO: 166139 - RNA, 64 nt, Human; identical to SEQ ID NO: 121134

SEQ ID NO: 166140 - RNA, 64 nt, Human; identical to SEQ ID NO: 121135

SEQ ID NO: 166141 - RNA, 64 nt, Human; identical to SEQ ID NO: 121136

SEQ ID NO: 166142 - RNA, 64 nt, Human; identical to SEQ ID NO: 121137

SEQ ID NO: 166143 - RNA, 64 nt, Human; identical to SEQ ID NO: 121138

SEQ ID NO: 166144 - RNA, 64 nt, Human; identical to SEQ ID NO: 121139

SEQ ID NO: 166145 - RNA, 64 nt, Human; identical to SEQ ID NO: 121140

SEQ ID NO: 166146 - RNA, 64 nt, Human; identical to SEQ ID NO: 121141

SEQ ID NO: 166147 - RNA, 64 nt, Human; identical to SEQ ID NO: 121142

SEQ ID NO: 166148 - RNA, 64 nt, Human; identical to SEQ ID NO: 121143

SEQ ID NO: 166149 - RNA, 64 nt, Human; identical to SEQ ID NO: 121144

SEQ ID NO: 166150 - RNA, 64 nt, Human; identical to SEQ ID NO: 121145

SEQ ID NO: 166151 - RNA, 64 nt, Human; identical to SEQ ID NO: 121146

SEQ ID NO: 166152 - RNA, 64 nt, Human; identical to SEQ ID NO: 121147

SEQ ID NO: 166153 - RNA, 64 nt, Human; identical to SEQ ID NO: 121148

SEQ ID NO: 166154 - RNA, 64 nt, Human; identical to SEQ ID NO: 121149

SEQ ID NO: 166155 - RNA, 64 nt, Human; identical to SEQ ID NO: 121150

SEQ ID NO: 166156 - RNA, 64 nt, Human; identical to SEQ ID NO: 121151

SEQ ID NO: 166157 - RNA, 64 nt, Human; identical to SEQ ID NO: 121152

SEQ ID NO: 166158 - RNA, 64 nt, Human; identical to SEQ ID NO: 121153

SEQ ID NO: 166159 - RNA, 64 nt, Human; identical to SEQ ID NO: 121154

SEQ ID NO: 166160 - RNA, 64 nt, Human; identical to SEQ ID NO: 121155

SEQ ID NO: 166161 - RNA, 64 nt, Human; identical to SEQ ID NO: 121156

SEQ ID NO: 166162 - RNA, 64 nt, Human; identical to SEQ ID NO: 121157

SEQ ID NO: 166163 - RNA, 64 nt, Human; identical to SEQ ID NO: 121158

SEQ ID NO: 166164 - RNA, 64 nt, Human; identical to SEQ ID NO: 121159

SEQ ID NO: 166165 - RNA, 64 nt, Human; identical to SEQ ID NO: 121160

SEQ ID NO: 166166 - RNA, 64 nt, Human; identical to SEQ ID NO: 121161

SEQ ID NO: 166167 - RNA, 64 nt, Human; identical to SEQ ID NO: 121162

SEQ ID NO: 166168 - RNA, 64 nt, Human; identical to SEQ ID NO: 121163

SEQ ID NO: 166169 - RNA, 64 nt, Human; identical to SEQ ID NO: 121164

SEQ ID NO: 166170 - RNA, 64 nt, Human; identical to SEQ ID NO: 121165

SEQ ID NO: 166171 - RNA, 64 nt, Human; identical to SEQ ID NO: 121166

SEQ ID NO: 166172 - RNA, 64 nt, Human; identical to SEQ ID NO: 121167

SEQ ID NO: 166173 - RNA, 64 nt, Human; identical to SEQ ID NO: 121168

SEQ ID NO: 166174 - RNA, 64 nt, Human; identical to SEQ ID NO: 121169

SEQ ID NO: 166175 - RNA, 64 nt, Human; identical to SEQ ID NO: 121170

SEQ ID NO: 166176 - RNA, 64 nt, Human; identical to SEQ ID NO: 121171

SEQ ID NO: 166177 - RNA, 64 nt, Human; identical to SEQ ID NO: 121172

SEQ ID NO: 166178 - RNA, 64 nt, Human; identical to SEQ ID NO: 121173

SEQ ID NO: 166179 - RNA, 64 nt, Human; identical to SEQ ID NO: 121174

SEQ ID NO: 166180 - RNA, 64 nt, Human; identical to SEQ ID NO: 121175

SEQ ID NO: 166181 - RNA, 64 nt, Human; identical to SEQ ID NO: 121176

SEQ ID NO: 166182 - RNA, 64 nt, Human; identical to SEQ ID NO: 121177

SEQ ID NO: 166183 - RNA, 64 nt, Human; identical to SEQ ID NO: 121178

SEQ ID NO: 166184 - RNA, 64 nt, Human; identical to SEQ ID NO: 121179

SEQ ID NO: 166185 - RNA, 64 nt, Human; identical to SEQ ID NO: 121180

SEQ ID NO: 166186 - RNA, 64 nt, Human; identical to SEQ ID NO: 121181

SEQ ID NO: 166187 - RNA, 64 nt, Human; identical to SEQ ID NO: 121182

SEQ ID NO: 166188 - RNA, 64 nt, Human; identical to SEQ ID NO: 121183

SEQ ID NO: 166189 - RNA, 64 nt, Human; identical to SEQ ID NO: 121184

SEQ ID NO: 166190 - RNA, 64 nt, Human; identical to SEQ ID NO: 121185

SEQ ID NO: 166191 - RNA, 64 nt, Human; identical to SEQ ID NO: 121186

SEQ ID NO: 166192 - RNA, 64 nt, Human; identical to SEQ ID NO: 121187

SEQ ID NO: 166193 - RNA, 64 nt, Human; identical to SEQ ID NO: 121188

SEQ ID NO: 166194 - RNA, 64 nt, Human; identical to SEQ ID NO: 121189

SEQ ID NO: 166195 - RNA, 64 nt, Human; identical to SEQ ID NO: 121190

SEQ ID NO: 166196 - RNA, 64 nt, Human; identical to SEQ ID NO: 121191

SEQ ID NO: 166197 - RNA, 64 nt, Human; identical to SEQ ID NO: 121192

SEQ ID NO: 166198 - RNA, 64 nt, Human; identical to SEQ ID NO: 121193

SEQ ID NO: 166199 - RNA, 64 nt, Human; identical to SEQ ID NO: 121194

SEQ ID NO: 166200 - RNA, 64 nt, Human; identical to SEQ ID NO: 121195

SEQ ID NO: 166201 - RNA, 64 nt, Human; identical to SEQ ID NO: 121196

SEQ ID NO: 166202 - RNA, 64 nt, Human; identical to SEQ ID NO: 121197

SEQ ID NO: 166203 - RNA, 64 nt, Human; identical to SEQ ID NO: 121198

SEQ ID NO: 166204 - RNA, 64 nt, Human; identical to SEQ ID NO: 121199

SEQ ID NO: 166205 - RNA, 64 nt, Human; identical to SEQ ID NO: 121200

SEQ ID NO: 166206 - RNA, 64 nt, Human; identical to SEQ ID NO: 121201

SEQ ID NO: 166207 - RNA, 64 nt, Human; identical to SEQ ID NO: 121202

SEQ ID NO: 166208 - RNA, 64 nt, Human; identical to SEQ ID NO: 121203

SEQ ID NO: 166209 - RNA, 64 nt, Human; identical to SEQ ID NO: 121204

SEQ ID NO: 166210 - RNA, 64 nt, Human; identical to SEQ ID NO: 121205

SEQ ID NO: 166211 - RNA, 64 nt, Human; identical to SEQ ID NO: 121206

SEQ ID NO: 166212 - RNA, 64 nt, Human; identical to SEQ ID NO: 121207

SEQ ID NO: 166213 - RNA, 64 nt, Human; identical to SEQ ID NO: 121208

SEQ ID NO: 166214 - RNA, 51 nt, Human; identical to SEQ ID NO: 121209

SEQ ID NO: 166215 - RNA, 64 nt, Human; identical to SEQ ID NO: 121210

SEQ ID NO: 166216 - RNA, 64 nt, Human; identical to SEQ ID NO: 121211

SEQ ID NO: 166217 - RNA, 64 nt, Human; identical to SEQ ID NO: 121212

SEQ ID NO: 166218 - RNA, 64 nt, Human; identical to SEQ ID NO: 121213

SEQ ID NO: 166219 - RNA, 64 nt, Human; identical to SEQ ID NO: 121214

SEQ ID NO: 166220 - RNA, 64 nt, Human; identical to SEQ ID NO: 121215

SEQ ID NO: 166221 - RNA, 64 nt, Human; identical to SEQ ID NO: 121216

SEQ ID NO: 166222 - RNA, 64 nt, Human; identical to SEQ ID NO: 121217

SEQ ID NO: 166223 - RNA, 64 nt, Human; identical to SEQ ID NO: 121218

SEQ ID NO: 166224 - RNA, 64 nt, Human; identical to SEQ ID NO: 121219

SEQ ID NO: 166225 - RNA, 64 nt, Human; identical to SEQ ID NO: 121220

SEQ ID NO: 166226 - RNA, 64 nt, Human; identical to SEQ ID NO: 121221

SEQ ID NO: 166227 - RNA, 64 nt, Human; identical to SEQ ID NO: 121222

SEQ ID NO: 166228 - RNA, 64 nt, Human; identical to SEQ ID NO: 121223

SEQ ID NO: 166229 - RNA, 64 nt, Human; identical to SEQ ID NO: 121224

SEQ ID NO: 166230 - RNA, 64 nt, Human; identical to SEQ ID NO: 121225

SEQ ID NO: 166231 - RNA, 64 nt, Human; identical to SEQ ID NO: 121226

SEQ ID NO: 166232 - RNA, 64 nt, Human; identical to SEQ ID NO: 121227

SEQ ID NO: 166233 - RNA, 64 nt, Human; identical to SEQ ID NO: 121228

SEQ ID NO: 166234 - RNA, 64 nt, Human; identical to SEQ ID NO: 121229

SEQ ID NO: 166235 - RNA, 64 nt, Human; identical to SEQ ID NO: 121230

SEQ ID NO: 166236 - RNA, 64 nt, Human; identical to SEQ ID NO: 121231

SEQ ID NO: 166237 - RNA, 64 nt, Human; identical to SEQ ID NO: 121232

SEQ ID NO: 166238 - RNA, 64 nt, Human; identical to SEQ ID NO: 121233

SEQ ID NO: 166239 - RNA, 64 nt, Human; identical to SEQ ID NO: 121234

SEQ ID NO: 166240 - RNA, 64 nt, Human; identical to SEQ ID NO: 121235

SEQ ID NO: 166241 - RNA, 64 nt, Human; identical to SEQ ID NO: 121236

SEQ ID NO: 166242 - RNA, 64 nt, Human; identical to SEQ ID NO: 121237

SEQ ID NO: 166243 - RNA, 64 nt, Human; identical to SEQ ID NO: 121238

SEQ ID NO: 166244 - RNA, 64 nt, Human; identical to SEQ ID NO: 121239

SEQ ID NO: 166245 - RNA, 64 nt, Human; identical to SEQ ID NO: 121240

SEQ ID NO: 166246 - RNA, 64 nt, Human; identical to SEQ ID NO: 121241

SEQ ID NO: 166247 - RNA, 64 nt, Human; identical to SEQ ID NO: 121242

SEQ ID NO: 166248 - RNA, 64 nt, Human; identical to SEQ ID NO: 121243

SEQ ID NO: 166249 - RNA, 64 nt, Human; identical to SEQ ID NO: 121244

SEQ ID NO: 166250 - RNA, 64 nt, Human; identical to SEQ ID NO: 121245

SEQ ID NO: 166251 - RNA, 64 nt, Human; identical to SEQ ID NO: 121246

SEQ ID NO: 166252 - RNA, 64 nt, Human; identical to SEQ ID NO: 121247

SEQ ID NO: 166253 - RNA, 64 nt, Human; identical to SEQ ID NO: 121248

SEQ ID NO: 166254 - RNA, 64 nt, Human; identical to SEQ ID NO: 121249

SEQ ID NO: 166255 - RNA, 64 nt, Human; identical to SEQ ID NO: 121250

SEQ ID NO: 166256 - RNA, 64 nt, Human; identical to SEQ ID NO: 121251

SEQ ID NO: 166257 - RNA, 64 nt, Human; identical to SEQ ID NO: 121252

SEQ ID NO: 166258 - RNA, 64 nt, Human; identical to SEQ ID NO: 121253

SEQ ID NO: 166259 - RNA, 64 nt, Human; identical to SEQ ID NO: 121254

SEQ ID NO: 166260 - RNA, 64 nt, Human; identical to SEQ ID NO: 121255

SEQ ID NO: 166261 - RNA, 64 nt, Human; identical to SEQ ID NO: 121256

SEQ ID NO: 166262 - RNA, 64 nt, Human; identical to SEQ ID NO: 121257

SEQ ID NO: 166263 - RNA, 64 nt, Human; identical to SEQ ID NO: 121258

SEQ ID NO: 166264 - RNA, 64 nt, Human; identical to SEQ ID NO: 121259

SEQ ID NO: 166265 - RNA, 64 nt, Human; identical to SEQ ID NO: 121260

SEQ ID NO: 166266 - RNA, 64 nt, Human; identical to SEQ ID NO: 121261

SEQ ID NO: 166267 - RNA, 64 nt, Human; identical to SEQ ID NO: 121262

SEQ ID NO: 166268 - RNA, 64 nt, Human; identical to SEQ ID NO: 121263

SEQ ID NO: 166269 - RNA, 64 nt, Human; identical to SEQ ID NO: 121264

SEQ ID NO: 166270 - RNA, 64 nt, Human; identical to SEQ ID NO: 121265

SEQ ID NO: 166271 - RNA, 64 nt, Human; identical to SEQ ID NO: 121266

SEQ ID NO: 166272 - RNA, 64 nt, Human; identical to SEQ ID NO: 121267

SEQ ID NO: 166273 - RNA, 64 nt, Human; identical to SEQ ID NO: 121268

SEQ ID NO: 166274 - RNA, 64 nt, Human; identical to SEQ ID NO: 121269

SEQ ID NO: 166275 - RNA, 64 nt, Human; identical to SEQ ID NO: 121270

SEQ ID NO: 166276 - RNA, 64 nt, Human; identical to SEQ ID NO: 121271

SEQ ID NO: 166277 - RNA, 64 nt, Human; identical to SEQ ID NO: 121272

SEQ ID NO: 166278 - RNA, 64 nt, Human; identical to SEQ ID NO: 121273

SEQ ID NO: 166279 - RNA, 64 nt, Human; identical to SEQ ID NO: 121274

SEQ ID NO: 166280 - RNA, 64 nt, Human; identical to SEQ ID NO: 121275

SEQ ID NO: 166281 - RNA, 64 nt, Human; identical to SEQ ID NO: 121276

SEQ ID NO: 166282 - RNA, 64 nt, Human; identical to SEQ ID NO: 121277

SEQ ID NO: 166283 - RNA, 64 nt, Human; identical to SEQ ID NO: 121278

SEQ ID NO: 166284 - RNA, 64 nt, Human; identical to SEQ ID NO: 121279

SEQ ID NO: 166285 - RNA, 50 nt, Human; identical to SEQ ID NO: 121280

SEQ ID NO: 166286 - RNA, 64 nt, Human; identical to SEQ ID NO: 121281

SEQ ID NO: 166287 - RNA, 58 nt, Human; identical to SEQ ID NO: 121282

SEQ ID NO: 166288 - RNA, 64 nt, Human; identical to SEQ ID NO: 121283

SEQ ID NO: 166289 - RNA, 64 nt, Human; identical to SEQ ID NO: 121284

SEQ ID NO: 166290 - RNA, 64 nt, Human; identical to SEQ ID NO: 121285

SEQ ID NO: 166291 - RNA, 64 nt, Human; identical to SEQ ID NO: 121286

SEQ ID NO: 166292 - RNA, 64 nt, Human; identical to SEQ ID NO: 121287

SEQ ID NO: 166293 - RNA, 64 nt, Human; identical to SEQ ID NO: 121288

SEQ ID NO: 166294 - RNA, 64 nt, Human; identical to SEQ ID NO: 121289

SEQ ID NO: 166295 - RNA, 64 nt, Human; identical to SEQ ID NO: 121290

SEQ ID NO: 166296 - RNA, 64 nt, Human; identical to SEQ ID NO: 121291

SEQ ID NO: 166297 - RNA, 59 nt, Human; identical to SEQ ID NO: 121292

SEQ ID NO: 166298 - RNA, 64 nt, Human; identical to SEQ ID NO: 121293

SEQ ID NO: 166299 - RNA, 64 nt, Human; identical to SEQ ID NO: 121294

SEQ ID NO: 166300 - RNA, 64 nt, Human; identical to SEQ ID NO: 121295

SEQ ID NO: 166301 - RNA, 64 nt, Human; identical to SEQ ID NO: 121296

SEQ ID NO: 166302 - RNA, 64 nt, Human; identical to SEQ ID NO: 121297

SEQ ID NO: 166303 - RNA, 64 nt, Human; identical to SEQ ID NO: 121298

SEQ ID NO: 166304 - RNA, 64 nt, Human; identical to SEQ ID NO: 121299

SEQ ID NO: 166305 - RNA, 64 nt, Human; identical to SEQ ID NO: 121300

SEQ ID NO: 166306 - RNA, 64 nt, Human; identical to SEQ ID NO: 121301

SEQ ID NO: 166307 - RNA, 64 nt, Human; identical to SEQ ID NO: 121302

SEQ ID NO: 166308 - RNA, 64 nt, Human; identical to SEQ ID NO: 121303

SEQ ID NO: 166309 - RNA, 64 nt, Human; identical to SEQ ID NO: 121304

SEQ ID NO: 166310 - RNA, 64 nt, Human; identical to SEQ ID NO: 121305

SEQ ID NO: 166311 - RNA, 64 nt, Human; identical to SEQ ID NO: 121306

SEQ ID NO: 166312 - RNA, 64 nt, Human; identical to SEQ ID NO: 121307

SEQ ID NO: 166313 - RNA, 64 nt, Human; identical to SEQ ID NO: 121308

SEQ ID NO: 166314 - RNA, 64 nt, Human; identical to SEQ ID NO: 121309

SEQ ID NO: 166315 - RNA, 64 nt, Human; identical to SEQ ID NO: 121310

SEQ ID NO: 166316 - RNA, 64 nt, Human; identical to SEQ ID NO: 121311

SEQ ID NO: 166317 - RNA, 64 nt, Human; identical to SEQ ID NO: 121312

SEQ ID NO: 166318 - RNA, 64 nt, Human; identical to SEQ ID NO: 121313

SEQ ID NO: 166319 - RNA, 64 nt, Human; identical to SEQ ID NO: 121314

SEQ ID NO: 166320 - RNA, 64 nt, Human; identical to SEQ ID NO: 121315

SEQ ID NO: 166321 - RNA, 64 nt, Human; identical to SEQ ID NO: 121316

SEQ ID NO: 166322 - RNA, 64 nt, Human; identical to SEQ ID NO: 121317

SEQ ID NO: 166323 - RNA, 64 nt, Human; identical to SEQ ID NO: 121318

SEQ ID NO: 166324 - RNA, 64 nt, Human; identical to SEQ ID NO: 121319

SEQ ID NO: 166325 - RNA, 64 nt, Human; identical to SEQ ID NO: 121320

SEQ ID NO: 166326 - RNA, 64 nt, Human; identical to SEQ ID NO: 121321

SEQ ID NO: 166327 - RNA, 64 nt, Human; identical to SEQ ID NO: 121322

SEQ ID NO: 166328 - RNA, 64 nt, Human; identical to SEQ ID NO: 121323

SEQ ID NO: 166329 - RNA, 64 nt, Human; identical to SEQ ID NO: 121324

SEQ ID NO: 166330 - RNA, 64 nt, Human; identical to SEQ ID NO: 121325

SEQ ID NO: 166331 - RNA, 64 nt, Human; identical to SEQ ID NO: 121326

SEQ ID NO: 166332 - RNA, 64 nt, Human; identical to SEQ ID NO: 121327

SEQ ID NO: 166333 - RNA, 64 nt, Human; identical to SEQ ID NO: 121328

SEQ ID NO: 166334 - RNA, 64 nt, Human; identical to SEQ ID NO: 121329

SEQ ID NO: 166335 - RNA, 64 nt, Human; identical to SEQ ID NO: 121330

SEQ ID NO: 166336 - RNA, 64 nt, Human; identical to SEQ ID NO: 121331

SEQ ID NO: 166337 - RNA, 64 nt, Human; identical to SEQ ID NO: 121332

SEQ ID NO: 166338 - RNA, 64 nt, Human; identical to SEQ ID NO: 121333

SEQ ID NO: 166339 - RNA, 64 nt, Human; identical to SEQ ID NO: 121334

SEQ ID NO: 166340 - RNA, 64 nt, Human; identical to SEQ ID NO: 121335

SEQ ID NO: 166341 - RNA, 64 nt, Human; identical to SEQ ID NO: 121336

SEQ ID NO: 166342 - RNA, 64 nt, Human; identical to SEQ ID NO: 121337

SEQ ID NO: 166343 - RNA, 64 nt, Human; identical to SEQ ID NO: 121338

SEQ ID NO: 166344 - RNA, 64 nt, Human; identical to SEQ ID NO: 121339

SEQ ID NO: 166345 - RNA, 64 nt, Human
cugcaucucccaccccccgacacccugggacccucgaccccacccuucuuuccuaccagcccag

SEQ ID NO: 166346 - RNA, 64 nt, Human
cuuaggucugcccugcuugcaaauccacuagcaccgaccccaccaccugguuccggcucugcac

SEQ ID NO: 166347 - RNA, 64 nt, Human
cuuuuuucccccccuucucaccuucccuucuccccgaccccaccccccaaaaaagcuacuucuu

SEQ ID NO: 166348 - RNA, 64 nt, Human
gcccccaccccugcucuccgcacccgcuuccucccgaccccaggaccaggcuacuucuccccuc

SEQ ID NO: 166349 - RNA, 64 nt, Human
cucuggggcggauggcagaaggccugagccaccacgaccccaucaugaaggugcuguccauucg

SEQ ID NO: 166350 - RNA, 64 nt, Human
cgaagcccgauagaucgggggaaaauggggccuucgaccccagcgggcuaccugaaccaaggcg

SEQ ID NO: 166351 - RNA, 64 nt, Human
gccagccugugcagaaggcugcagcugacaacagcgaccccaccugccauuaccuucagggccu

SEQ ID NO: 166352 - RNA, 64 nt, Human
aggggagaaccccuucuuucauuccaacugccuccgaccccaaagggauucuuggcucucuggu

SEQ ID NO: 166353 - RNA, 64 nt, Human
cuggaaaguaugaccuggaauucaaguuucucgacgaccccaccagguacaucucaccugacug

SEQ ID NO: 166354 - RNA, 64 nt, Human
cuaaacacugcagcucccaccacauagaauuauccgaccccagaugucaaaagugccaagggcc

SEQ ID NO: 166355 - RNA, 64 nt, Human
ucccucuccuacuuggcccagcugcuuggaggaccgaccccauggcugagaauaugacggcaag

SEQ ID NO: 166356 - RNA, 64 nt, Human
cuugaugauugacaacacccauuuuuccuuuugccgaccccaagaguuuugggaguuguaguua

SEQ ID NO: 166357 - RNA, 64 nt, Human
ccaaggcaggcaaggcagccaggacaggggagcccgaccccagauaaugaucccgguagagaaa

SEQ ID NO: 166358 - RNA, 64 nt, Human
cgucugagauguggggagcaccucugcccggccgcgaccccauuugggaggugaggagcaacuc

SEQ ID NO: 166359 - RNA, 64 nt, Human
agcggggccccagggcuacccucccccaggaggucgaccccaaagccccuugcucuccccugcc

SEQ ID NO: 166360 - RNA, 64 nt, Human
gcagcuaaaacgagggcaguagagagcacuuacccgaccccaaggugccagagaugcccugagg

SEQ ID NO: 166361 - RNA, 64 nt, Human
ccccuuucguuuuccggagacuuguugagaaauacgaccccacagacugcgagacugaaccgcc

SEQ ID NO: 166362 - RNA, 64 nt, Human
uccuuaacaagacagcacuccagauaggcagccacgaccccaaaggugaggauaauguuacuga

SEQ ID NO: 166363 - RNA, 64 nt, Human
uagagaacguucacacuucgcuccuuuaaagaagcgaccccagaucugcaagguaaguccaaca

SEQ ID NO: 166364 - RNA, 64 nt, Human
cagcucccagcgacgacgccaccgcgcuuaugaccgaccccaagcucaucaccuggucuccggu

SEQ ID NO: 166365 - RNA, 64 nt, Human
guauaucucccaaugcuaucccucccccaucccccgaccccaccacaguccccagagugugaua

SEQ ID NO: 166366 - RNA, 64 nt, Human
uuuuuuuuuucuucaugccugaugaaagcuuuggcgaccccaauauauguauuuuuugaaucua

SEQ ID NO: 166367 - RNA, 64 nt, Human
ugaaaacccagacugucuccacggccugcccagucgaccccaaaggaacacugacaucaauuuu

SEQ ID NO: 166368 - RNA, 64 nt, Human
cgaagcucauucccaacgugcaaagccaaggcagcgaccccaggaccucuucuggagauggaag

SEQ ID NO: 166369 - RNA, 64 nt, Human
ggccugauggugggcggggccccgcccacagggccgaccccaauacaccagcgacucaaccuug

SEQ ID NO: 166370 - RNA, 64 nt, Human
aagagagcaaugggcagggaaggaaggggucugccgaccccagcucggggaauuucacuagccc

SEQ ID NO: 166371 - RNA, 61 nt, Human
aggccuccugcaccaccuagagccccacccccgaccccaccccgggagggcagagccagaa

SEQ ID NO: 166372 - RNA, 64 nt, Human
uacacagaaccacccucuccaaccccucccuucccgaccccaacaaaacguuuucaaaccccuu

SEQ ID NO: 166373 - RNA, 64 nt, Human
uucuuccauccuuagagggacccuuccaaggucccgaccccaucccuauccauaguccuggucc

SEQ ID NO: 166374 - RNA, 64 nt, Human
cccuuccacugcccauuuuaccagcucacauucccgaccccaucagcuuggaagggugcuagag

SEQ ID NO: 166375 - RNA, 64 nt, Human
ggcaucuaggaagguaaacuccaaucccggugaccgaccccaaaccagacuguuggugggcuga

SEQ ID NO: 166376 - RNA, 64 nt, Human
ccaugaaugaugguuuauugggaacugcuggggucgaccccauacagagaacucagcuugaagc

SEQ ID NO: 166377 - RNA, 64 nt, Human
agccccugcccacgggauccggccccccagacaccgaccccacaggccgucccggaucucagcg

SEQ ID NO: 166378 - RNA, 64 nt, Human
ccuggaccucccucaguggaugucuucccucccccgaccccagccugucaguccgagcacagug

SEQ ID NO: 166379 - RNA, 64 nt, Human
ccuuccucucuauuuauaaggucccugcuccacccgaccccaccugcggugccuucagccccaa

SEQ ID NO: 166380 - RNA, 64 nt, Human
uccccacacccuggaguggcaugguccugugccccgaccccaccugaggcaggagggcaugugc

SEQ ID NO: 166381 - RNA, 64 nt, Human
caggaaggggccaagggggcuugcccacccaccccgaccccagcccccagccucagccccgguc

SEQ ID NO: 166382 - RNA, 64 nt, Human
agcuccagugcugagaagucagugccccgagagacgaccccaccaguggggugcccgcugccug

SEQ ID NO: 166383 - RNA, 64 nt, Human
cagucuccugucaggcucggagaggucaggagaccgaccccaccacuaacuuuggagaaaaugu

SEQ ID NO: 166384 - RNA, 64 nt, Human
cccuggauguugccugcccugcaacucagcugcccgaccccaggagucgccauaccugugaggu

SEQ ID NO: 166385 - RNA, 64 nt, Human
uccaagucacacggcugcugcuggcacacggggccgaccccagcgagugcccagcccacgaguc

SEQ ID NO: 166386 - RNA, 64 nt, Human
ucuugccucugcugaugggggcuggcaaacuugacgaccccaacuccugccugcccccacugug

SEQ ID NO: 166387 - RNA, 64 nt, Human
uccuuggcccugcuggucccugucgccccauccccgaccccaccucacucuuucgugaauguuc

SEQ ID NO: 166388 - RNA, 64 nt, Human
acagccgcgccuggcccaacggugcggugguggccgaccccaugcagccgccaccaaucgcgga

SEQ ID NO: 166389 - RNA, 64 nt, Human
agaagaaggggcucccuccucuucacauuccccccgaccccaaagccagagaaagccagauggc

SEQ ID NO: 166390 - RNA, 64 nt, Human
gaaucuuccagaugauaaaccccagcagccgacucgaccccaggagcagaguacaggagacacc

SEQ ID NO: 166391 - RNA, 64 nt, Human
gugugacucaaagaucaagagugaggcuaaacugcgaccccaacaucacuuccuucauggaaag

SEQ ID NO: 166392 - RNA, 64 nt, Human
aucugaagcacaaggcccacccucaccuaucugucgaccccauuuccuaccaccuuuguggccg

SEQ ID NO: 166393 - RNA, 64 nt, Human
aucugucgaccccauuuccuaccaccuuuguggccgaccccaagcaccccagagauaugaggca

SEQ ID NO: 166394 - RNA, 64 nt, Human
cuggccugaggucucgcugaugcugggcugggugcgaccccaucugcccaggacggggccggcc

SEQ ID NO: 166395 - RNA, 64 nt, Human
ggcccgcagccccugcugcccaauaaaaccacuccgaccccacggccucuugucuugacucugg

SEQ ID NO: 166396 - RNA, 64 nt, Human
aggccaacugggcgcccguccccagccccacgcacgaccccaagcccgcggaggcaccgaugcc

SEQ ID NO: 166397 - RNA, 64 nt, Human
gaaggccaaguacagucucuguggugcguauugacgaccccauggagauuuugaaaaguguuau

SEQ ID NO: 166398 - RNA, 64 nt, Human
uaagugacccccgucaacccacugccucccaccccgaccccagcaucaaaaaaccaaugauuuu

SEQ ID NO: 166399 - RNA, 64 nt, Human
ggaaggcagugaacacacucagcagcccccugcccgaccccaucucauucagguguucucuucu

SEQ ID NO: 166400 - RNA, 64 nt, Human
ggcaggugcuuggagaguggcguuugagccagagcgaccccauuucccgugugaaccauaggca

SEQ ID NO: 166401 - RNA, 64 nt, Human
gaccugcccgauccagauucccaggccaggcucccgaccccauccaccuauccaccaccccacc

SEQ ID NO: 166402 - RNA, 64 nt, Human
auauggauaacucacugcuccaggacucagaccucgaccccagaggcucagaugaaagaccgac

SEQ ID NO: 166403 - RNA, 64 nt, Human
ugacucugggagaggugacaccucacuaaggggccgaccccauggaguaacgcgcccggccccg

SEQ ID NO: 166404 - RNA, 64 nt, Human
accccacgugaucuggccacuggggacccccacccgaccccacucccaaugaugaggggcauuu

SEQ ID NO: 166405 - RNA, 64 nt, Human
acagccuuucuguaucaagccccugucuaaccuacgaccccagagugacugacggcuguguauu

SEQ ID NO: 166406 - RNA, 64 nt, Human
cuuauuuaugaagucuuugaccgucccccccgcccgaccccaccgcccucccgcccccaccugg

SEQ ID NO: 166407 - RNA, 64 nt, Human
gggagucaccgcccagaccuccccagccaccaaccgaccccaccucuguuccuaacaaagcggu

SEQ ID NO: 166408 - RNA, 64 nt, Human
guggaggacagggacagagcccucugugguggaacgaccccaccucgaggagcuuccugagcag

SEQ ID NO: 166409 - RNA, 64 nt, Human
ccccucccacuuugcuucuuguaugcauugugaccgaccccacuuccucagaauguaacggggc

SEQ ID NO: 166410 - RNA, 64 nt, Human
accaaagcugcuguguggcagcucggccucucuacgaccccaucuugguggcugcacacucuuc

SEQ ID NO: 166411 - RNA, 64 nt, Human
acugugucucuguuuccugaaauauaaacuguagcgaccccagacuguagagauuuuuaugugu

SEQ ID NO: 166412 - RNA, 64 nt, Human
uaggagagaccugugcaaaucugagcuccggcuccgaccccacacacccugagggagcccuacc

SEQ ID NO: 166413 - RNA, 64 nt, Human
cugcaaaccacaagauaaagguaguggugugucucgaccccaucagccucucacccacucccag

SEQ ID NO: 166414 - RNA, 64 nt, Human
uucugauucuggcuuccuuccugccccacccucccgaccccagucccccugauccugcuagagg

SEQ ID NO: 166415 - RNA, 64 nt, Human
ccaaccacgcccacgucauuugcauacgcacucccgaccccagaaacccggauucugccucccg

SEQ ID NO: 166416 - RNA, 64 nt, Human
gccccaggccuuugcgaucuugcuucacccaccgcgaccccacacuauuucugugcuguccaca

SEQ ID NO: 166417 - RNA, 64 nt, Human
cccuucccauuggccuuagcccaagacuuggagucgaccccaagcgacagagugaccagaaacc

SEQ ID NO: 166418 - RNA, 64 nt, Human
ccaucccagaggagaugcuggcuaccagcuggggcgaccccaagggucgcuggagucaguaucg

SEQ ID NO: 166419 - RNA, 64 nt, Human
gcagcggcagcuccagauggccuccugagcuggacgaccccaggucuccagacaucuagggacc

SEQ ID NO: 166420 - RNA, 64 nt, Human
agcuggcaaggacgugggccuccagaguuggacccgaccccaauggaugaagacccccuccaaa

SEQ ID NO: 166421 - RNA, 64 nt, Human
cgacaaucacugaacgccgaagccugcagccaugcgaccccacgccaccccgugccuccugccu

SEQ ID NO: 166422 - RNA, 64 nt, Human
accauggacaccuccugaguuggaugucaucccccgaccccacccuguuuuccaccagaguucu

SEQ ID NO: 166423 - RNA, 64 nt, Human
auggaccuuguagguggagaugaauuuucagguccgaccccauggcccucucaguuugggccaa

SEQ ID NO: 166424 - RNA, 64 nt, Human
gggguccacauccacuccaaggggacuauucccccgaccccaccccagucuccccacacggacc

SEQ ID NO: 166425 - RNA, 64 nt, Human
ugcgacggcccagucccauccagagcauggagcccgaccccagccagcgccuuccacuccauca

SEQ ID NO: 166426 - RNA, 64 nt, Human
ugacacccucgcucucacacccccuccagcuuuccgaccccacaccgacaacuccccggcuucc

SEQ ID NO: 166427 - RNA, 64 nt, Human
aguuuuccagucagccuaauacauggguaucccccgaccccaucugccuccuuaagccacaguc

SEQ ID NO: 166428 - RNA, 64 nt, Human
uccaacccuccugcuugcuguacuugggaugaaacgaccccacaggucagguggaggguggggc

SEQ ID NO: 166429 - RNA, 64 nt, Human
ucugcuaucacagaacuccaccagcaacuccacccgaccccagcaguggugcaggacagcugcc

SEQ ID NO: 166430 - RNA, 63 nt, Human
ccacgcucagugcccguuuuaccaauaaacugagcgaccccagagccgugugcgccugcugcu

SEQ ID NO: 166431 - RNA, 64 nt, Human
cccacggaaaccagcccugcgggcuaagcaggugcgaccccagcaagaggggugcucugggacc

SEQ ID NO: 166432 - RNA, 64 nt, Human
gagaaaccgcuaugccagccaguggacccucaaccgaccccaccccaccaucucagcacacacc

SEQ ID NO: 166433 - RNA, 64 nt, Human
cccugaggguccccaggguccugaugaagaccuccgaccccagcgccaggcuccucggagccca

SEQ ID NO: 166434 - RNA, 64 nt, Human
cuucuuacgccguccaggccaaguauggugacuacgaccccaguguucacaagcggggauuuuu

SEQ ID NO: 166435 - RNA, 64 nt, Human
uucccgggauggguccuugcuucucagcuguguccgaccccaccauguaauaaaacccaaagga

SEQ ID NO: 166436 - RNA, 64 nt, Human
uggccccugcagaauguucauagguucccagccccgaccccacccaaaggggccuggagcugca

SEQ ID NO: 166437 - RNA, 64 nt, Human
accccugaaguuuuaaaaacuuucucgcuccccacgaccccagaaugaaacagcuuuaaaaaua

SEQ ID NO: 166438 - RNA, 64 nt, Human
gacacacagcgccuaccaugugcagcugccuguccgaccccaucuuacagacgagaaaaccagc

SEQ ID NO: 166439 - RNA, 64 nt, Human
guauaucucccagugcuaucccuccccccucccccgaccccaccacaguccccagagugugaua

SEQ ID NO: 166440 - RNA, 64 nt, Human; identical to SEQ ID NO: 52329

SEQ ID NO: 166441 - RNA, 64 nt, Human; identical to SEQ ID NO: 52330

SEQ ID NO: 166442 - RNA, 64 nt, Human; identical to SEQ ID NO: 52331

SEQ ID NO: 166443 - RNA, 64 nt, Human; identical to SEQ ID NO: 52332

SEQ ID NO: 166444 - RNA, 64 nt, Human; identical to SEQ ID NO: 52333

SEQ ID NO: 166445 - RNA, 64 nt, Human; identical to SEQ ID NO: 52334

SEQ ID NO: 166446 - RNA, 64 nt, Human; identical to SEQ ID NO: 52335

SEQ ID NO: 166447 - RNA, 64 nt, Human; identical to SEQ ID NO: 52336

SEQ ID NO: 166448 - RNA, 64 nt, Human; identical to SEQ ID NO: 52337

SEQ ID NO: 166449 - RNA, 64 nt, Human; identical to SEQ ID NO: 52338

SEQ ID NO: 166450 - RNA, 64 nt, Human; identical to SEQ ID NO: 52339

SEQ ID NO: 166451 - RNA, 64 nt, Human; identical to SEQ ID NO: 52340

SEQ ID NO: 166452 - RNA, 64 nt, Human; identical to SEQ ID NO: 52341

SEQ ID NO: 166453 - RNA, 64 nt, Human; identical to SEQ ID NO: 52342

SEQ ID NO: 166454 - RNA, 64 nt, Human
uuuauuuuaacaaaagaagauuaaaaaguaaaagaaccacgaguaagauauuauuuaaauguug

SEQ ID NO: 166455 - RNA, 64 nt, Human
auuccagccuuacccauugacucaaggggacauaaaccacgagagugacagucaucuuugccca

SEQ ID NO: 166456 - RNA, 64 nt, Human
acugacguuuggaaaacuugaucaaugagcuuuuaaccacgauuucucccgcaauuuguuccuu

SEQ ID NO: 166457 - RNA, 64 nt, Human
acaaagugagacuccaucucuauauaaaaacaaaaaccacgaaagcacacacaaaauaaaucag

SEQ ID NO: 166458 - RNA, 63 nt, Human
ggauacucuguuuaugaaaaagaauaaaaaacacaaccacgaagccacuagagccuuuuccag

SEQ ID NO: 166459 - RNA, 64 nt, Human
ccgugaagugagucccgucugccaggagcugacgaaccacgaaugcuucugccugugcugugca

SEQ ID NO: 166460 - RNA, 64 nt, Human
gaagacccuagcuuuaagagaagcuguauccucuaaccacgagacccucaaccagcccaacauc

SEQ ID NO: 166461 - RNA, 64 nt, Human
gaaggcaguguuauuuauuucuuucuauucuuggaaccacgaaugagguaggcacaaauacauu

SEQ ID NO: 166462 - RNA, 64 nt, Human
ugaugccauuguccuggaugaugccaccucguuuaaccacgaggagaguuugggccuggaacuc

SEQ ID NO: 166463 - RNA, 63 nt, Human
acuaacuaacuuuucccaauaaaguccacuaugaaaccacgacauccaagagcccaaagucgu

SEQ ID NO: 166464 - RNA, 64 nt, Human
aacagguaguuaaguuaggguuaacauucauuucaaccacgagguuguauaucaugacuagcuu

SEQ ID NO: 166465 - RNA, 64 nt, Human
ccagccgaugucaucaaaagcagaauaaugaaucaaccacgagauaaacaaggaagguagauaa

SEQ ID NO: 166466 - RNA, 64 nt, Human
cacgccgugauggcagcgcugccgaggacauaggaaccacgacuggaaagauaauuuaucgugu

SEQ ID NO: 166467 - RNA, 64 nt, Human
uguaacaggauacaggugacagugaagauagaagaaccacgaugaccacagacucaaugugcuc

SEQ ID NO: 166468 - RNA, 64 nt, Human
uuagugauaucuggaaauaauaauucaauuaagcaaccacgaauuucacccuggagauauuuuu

SEQ ID NO: 166469 - RNA, 64 nt, Human
aauuuuaaaugcauaaaggggguuggggcaggggaaccacgaaguaguuaauuuuagaaaagga

SEQ ID NO: 166470 - RNA, 64 nt, Human
gugaaauaaagaguucuccuuguacuugaauaauaaccacgauuccaacccaggucugcuuugg

SEQ ID NO: 166471 - RNA, 64 nt, Human
guccugggacagcucaguguuggagggccaccugaaccacgagccagggcuggggcuugcaugu

SEQ ID NO: 166472 - RNA, 64 nt, Human
caugaguucuuccauuucaaagacucacuucuauaaccacgacgcguugaaucaaaauuuucaa

SEQ ID NO: 166473 - RNA, 64 nt, Human
ccaaacacuagaugugugugugcacacacacagaaaccacgagguaguuuaaaucaccauuaaa

SEQ ID NO: 166474 - RNA, 64 nt, Human
gguaaauaccaauaagaaauuaaggaaagaaacaaaccacgacacccaaaugccguaaucuuaa

SEQ ID NO: 166475 - RNA, 64 nt, Human
ccagcaacuuggcaaagcaaccaggguaggggagaaccacgagagaagcauuaagugacuuuca

SEQ ID NO: 166476 - RNA, 64 nt, Human
cacaguccacuuaaaaaaugaugaugaugauaaaaaccacgacccaaccaggcacaggacuuuu

SEQ ID NO: 166477 - RNA, 64 nt, Human
gccagaaagucauuccuuccaucuuccuugcagaaaccacgagaacaaagccaguucccuguca

SEQ ID NO: 166478 - RNA, 64 nt, Human
gcaaacaacaggggaaaaaaauggggaaaagaaaaaccacgagagagggaaaaaaaauuauucu

SEQ ID NO: 166479 - RNA, 64 nt, Human
cauccagugugaugggugcugagaggcaaguacaaaccacgaugagaaaaaggagaggagggga

SEQ ID NO: 166480 - RNA, 64 nt, Human
gaggcaggagaagcaggcagccugccccuucuacaaccacgagcagaugggccuucuccgggau

SEQ ID NO: 166481 - RNA, 64 nt, Human
acuauaagacugaccaaaauuuagauaaccuuugaaccacgauuuuuuuccacaucugucugug

SEQ ID NO: 166482 - RNA, 64 nt, Human
uuaucuguauguuagaaauggauaugaacaacaaaaccacgagucucggguuaagggaagugac

SEQ ID NO: 166483 - RNA, 64 nt, Human
aaaugcacuuuugcacuaccaaccacuuuaaaccaaccacgagaacaaagaggagcgguugcuc

SEQ ID NO: 166484 - RNA, 64 nt, Human
gucagaacugcuggaacuaugaaaugggguauauaaccacgacucugguggggaaaaccguuuu

SEQ ID NO: 166485 - RNA, 64 nt, Human
uaagucaaauauuuaugaugauaaugagguacugaaccacgauggcuguugaggaauugguccu

SEQ ID NO: 166486 - RNA, 59 nt, Human
uggaagguaauuucaccugagucucagggaaccacgaagggauauggcaaugaguagag

SEQ ID NO: 166487 - RNA, 64 nt, Human
uucucuaaagaagaggacagaauauacuggacuuaaccacgaauacccuugaguguccaaauug

SEQ ID NO: 166488 - RNA, 64 nt, Human
ucauucucacaaagcugccuugacuguggccugcaaccacgagugccaugcuuucaggucuucu

SEQ ID NO: 166489 - RNA, 64 nt, Human
cccuccaagccuggcacccaccgucucggcccugaaccacgaggcugcccccauccagccacgg

SEQ ID NO: 166490 - RNA, 64 nt, Human
ggagacuccaacaaauggagaccagaaacaaggcaaccacgaccuugcuagguucucugaggag

SEQ ID NO: 166491 - RNA, 64 nt, Human
cccuccagaccuggcuggccccugcagccacagaaaccacgauggcaaaaaaucucauugguuc

SEQ ID NO: 166492 - RNA, 64 nt, Human
ggcucaggcaggccuggcccagagucacgcuggcaaccacgaguuugggaagcagucguauucu

SEQ ID NO: 166493 - RNA, 64 nt, Human
aaugccaguaaacuuaaauuacguaacuucuugcaaccacgaaaccuguaauacgcuguacagu

SEQ ID NO: 166494 - RNA, 64 nt, Human
cucuacagcacggccuguggccuguucaaggcagaaccacgacccuugacucccggguggggag

SEQ ID NO: 166495 - RNA, 64 nt, Human
accaguggcaaauuuggaaauucagaaacuuauaaaccacgagaaauauauaggcuugucucuu

SEQ ID NO: 166496 - RNA, 64 nt, Human
guacauguuuuaauguagugaacacaguuaggaaaaccacgaugauccauugacagacaauaau

SEQ ID NO: 166497 - RNA, 64 nt, Human
cagauauaaaggaaagguacuggcuugaagucacaaccacgacaggaguaaggauuuggaauaa

SEQ ID NO: 166498 - RNA, 63 nt, Human
cgcucuaauaaaggacuguaggccauggggccuaaaccacgaagcugugagcaccuggaucag

SEQ ID NO: 166499 - RNA, 64 nt, Human
ggcccagucacauccugagcugcuccuggcugauaaccacgauggagcccguguuuguccugcc

SEQ ID NO: 166500 - RNA, 64 nt, Human
accccugagcgaugcugaguuucacacguaccugaaccacgagggccagcucucccgacccgag

SEQ ID NO: 166501 - RNA, 64 nt, Human
uuugcucuccuaagagccuucaugcacaccccugaaccacgaggaaacaguacagucgcuaguc

SEQ ID NO: 166502 - RNA, 64 nt, Human
cuccccaacccaucggccaccccaagcccucugcaaccacgaaucgacugucucuguagauugg

SEQ ID NO: 166503 - RNA, 64 nt, Human
cccaacccuuacagacaccacugccaccaccaccaaccacgaccaccaccaccaccaccacuca

SEQ ID NO: 166504 - RNA, 64 nt, Human
cgcuccucagggacacaaaggccgagugggguaaaaccacgaagggagggaagggaagucagcu

SEQ ID NO: 166505 - RNA, 64 nt, Human
auucugguacagagaaaggagaggcgcugaguggaaccacgaugggcugaggccaggggagaca

SEQ ID NO: 166506 - RNA, 60 nt, Human
caggugcagacagccuuugcugguccccagcacguccagggugggugcucccuugcccga

SEQ ID NO: 166507 - RNA, 60 nt, Human
cuuuauucuguuucaggaaaccagucacgacacguccacauauguauuuguguauguuaa

SEQ ID NO: 166508 - RNA, 60 nt, Human
cuugggcuuggguagugagugacaugugcacacguccagcugcgccaucaccagcccugc

SEQ ID NO: 166509 - RNA, 60 nt, Human
aaccccaauccgcugacuggguggggacagcacguccagccuucccaccucuccugcagg

SEQ ID NO: 166510 - RNA, 60 nt, Human
auacguggaaacaauccuguuacucugucccacguccaaucaugggccacaaggcacagu

SEQ ID NO: 166511 - RNA, 60 nt, Human
uccuugggcccaagaaagucaagcauuauccacguccaaaggugacaagaugacucaaag

SEQ ID NO: 166512 - RNA, 60 nt, Human
uccugcugcacagagccgcagggcugagaccacguccaugcuggcugccuucaggaagcu

SEQ ID NO: 166513 - RNA, 60 nt, Human
guuuuauuccauucuggucucaggcaugaccacguccagugaagacauuugaggcagcac

SEQ ID NO: 166514 - RNA, 52 nt, Human
uguuugagaaugucaucuaggacacguccaaaggagugcauggccacagcca

SEQ ID NO: 166515 - RNA, 60 nt, Human
ucaagguccuuuaugaguguuaccccucuacacguccacaccacucaccacacauacaua

SEQ ID NO: 166516 - RNA, 60 nt, Human
ggaacggggcaggcaaggucacugcucagucacguccacgggggacgagccguggguucu

SEQ ID NO: 166517 - RNA, 60 nt, Human
ugcaccgagaccaggcaggggcccaacuuucacguccagcccuggccuggggucgggaga

SEQ ID NO: 166518 - RNA, 60 nt, Human
cuaccacuucugucuugggcugaaguugcccacguccacaaaaucuguacucccagcggg

SEQ ID NO: 166519 - RNA, 60 nt, Human
agauuagcuggugcuauaggcaugcaccaccacguccaucuaaauuucuuuauuauuugu

SEQ ID NO: 166520 - RNA, 60 nt, Human
ugaaguuagggaugacugugauuuucagaacacguccagaauuuuucaucaagaagguag

SEQ ID NO: 166521 - RNA, 60 nt, Human
uguaguugcgacuucuucgauaguuaccugcacguccauugcuggcaacugacuugucau

SEQ ID NO: 166522 - RNA, 60 nt, Human
agagcugaggcccgggcgcuggcugcagcucacguccagccaugggaaucccacggaccu

SEQ ID NO: 166523 - RNA, 60 nt, Human
gaaggcucuagugucuaugauucugcucuccacguccagguguacacauuguuuaucucc

SEQ ID NO: 166524 - RNA, 60 nt, Human
aaaagcaugccaaaccuaggcuccagaaaccacguccaucagcugcauacuuacuaccag

SEQ ID NO: 166525 - RNA, 60 nt, Human
ccuuguuuucagguggucuggaggcagcuccacguccacacaguggccggcccugugguc

SEQ ID NO: 166526 - RNA, 60 nt, Human
guaacaaaugaacgauauguagcagaaaggcacguccacucacaagggacgcuuugggag

SEQ ID NO: 166527 - RNA, 60 nt, Human
ucaaggugcuaaaggacucagaaggugcagcacguccaguggguagguacuuguugcaug

SEQ ID NO: 166528 - RNA, 60 nt, Human
uggccagccucucccugccuccacuugcuccacguccagcuccucaccuucccucuuuuu

SEQ ID NO: 166529 - RNA, 60 nt, Human
gcaugcugagucaugucuuuccuauuugcacacguccauguuuauccauguacuuucccu

SEQ ID NO: 166530 - RNA, 60 nt, Human
cacuggucaaaaccuacacagcuguuuccucacguccaucacuggcucucuaauuccacu

SEQ ID NO: 166531 - RNA, 60 nt, Human
ggugggacuuugcgagcucugugacugucccacguccaggagacaaggaagguagggcac

SEQ ID NO: 166532 - RNA, 60 nt, Human
ggcuacuggaaaaccaaacccaacagaauucacguccaaaaauccacauucuccaucgcu

SEQ ID NO: 166533 - RNA, 60 nt, Human
gggugcacgcuauggcgcacacacacagugcacguccacagugccauaccacggggcaug

SEQ ID NO: 166534 - RNA, 60 nt, Human
uggcuaugagaagccugaugacaucaagagcacguccagccgccucuggcucaaguucgu

SEQ ID NO: 166535 - RNA, 60 nt, Human
guuuguggggggaagcuuugauauccaugccacguccauccaccccaccccuuuucguca

SEQ ID NO: 166536 - RNA, 60 nt, Human
ggguccagcucuggcagggggugucuaagccacguccaaaugguggacaguagcuccaac

SEQ ID NO: 166537 - RNA, 60 nt, Human
augggcaccuggcacugggagucgggggagcacguccaggcguggugcauccuggggcag

SEQ ID NO: 166538 - RNA, 60 nt, Human
gguccccgagacacaggcacgggucccugccacguccauaguucugaggucccugugugu

SEQ ID NO: 166539 - RNA, 60 nt, Human
ggccucaucccucccaagaugccagugagccacguccaugcccauuccgugcaaggcaga

SEQ ID NO: 166540 - RNA, 60 nt, Human
uucaagaaguccugggaagcgcucuccuagcacguccauuuccaggaggagaagcaagca

SEQ ID NO: 166541 - RNA, 60 nt, Human
aguggggagacgccagaggagccucacggucacguccaacaacaccacugcaccagggaa

SEQ ID NO: 166542 - RNA, 60 nt, Human
ggcugccucccuucuuauucuuccuugcugcacguccaucucuuuuccugucuuugagau

SEQ ID NO: 166543 - RNA, 60 nt, Human
aagccuauccauaccaccauccuaaacccacacguccacgugauuggggaggacgcagcg

SEQ ID NO: 166544 - RNA, 60 nt, Human
ccagggagcugggagcgagcaagcugaggccacguccacaaggagcuuuucaugccccug

SEQ ID NO: 166545 - RNA, 60 nt, Human
guuuucuacccaacggcccugcagccagcucacguccagguucaacccacagcuacuugg

SEQ ID NO: 166546 - RNA, 54 nt, Human
gaggcuugucaaggacauaaaugucacguccagcucugauaugcuucgcacuga

SEQ ID NO: 166547 - RNA, 60 nt, Human
ggccauggaggcagcacugagccagcaccacacguccauccugggacagacgggccugga

SEQ ID NO: 166548 - RNA, 60 nt, Human
ucuugaacucccagccugaaaugauccacccacguccaccuaccaaagugcuggaauugc

SEQ ID NO: 166549 - RNA, 60 nt, Human
gaguuccagugcugcaugcgauuaucuacccacguccacgcggccaccucacccucuccg

SEQ ID NO: 166550 - RNA, 60 nt, Human
uguggguugcccugcugggaaggagggaaucacguccaccugggucccaagaucuucgcc

SEQ ID NO: 166551 - RNA, 60 nt, Human
gucccucucccggaggcccuuguagagggccacguccauaaauuuucuuauggaacucuc

SEQ ID NO: 166552 - RNA, 60 nt, Human
gucacaaguagccucugggaucugccaacacacguccacucccaagccacuagcccacuc

SEQ ID NO: 166553 - RNA, 60 nt, Human
augacagccucuaacauggccacuucucagcacguccaagaagucuaacuaucaaaaagg

SEQ ID NO: 166554 - RNA, 60 nt, Human
ucuuagggacgugccuggaaccaccucguccacguccacguccaccugggggccucggga

SEQ ID NO: 166555 - RNA, 60 nt, Human
ggacgugccuggaaccaccucguccacguccacguccaccugggggccucgggaggcuag

SEQ ID NO: 166556 - RNA, 60 nt, Human
ugccacggugcucugcugcccccuccugggcacguccaggugagggagggcuggggcugg

SEQ ID NO: 166557 - RNA, 60 nt, Human
ucugaggagaggccuggggggacagcugggcacguccacucgcagggaaacacgggguga

SEQ ID NO: 166558 - RNA, 60 nt, Human
acagaauuggaggcugguuucuuaaacacacacguccacauuuuuuaggguuguuuuccu

SEQ ID NO: 166559 - RNA, 60 nt, Human
accugcauacacacucgcaacaugucuacacacguccacacacacagacacacagauacc

SEQ ID NO: 166560 - RNA, 60 nt, Human
ucuguucaagcaaaguugaucugcuccuggcacguccaguaaauuccagaaucauucucc

SEQ ID NO: 166561 - RNA, 60 nt, Human
uugcaucuuauucgagcuggcaguucuguucacguccauugccggcaauggaugucuuug

SEQ ID NO: 166562 - RNA, 60 nt, Human
ugucccugucgcucccuucccugggugccgcacguccagccuguguccaggccuacuccc

SEQ ID NO: 166563 - RNA, 60 nt, Human
ugcccggugccugcagccuucauaagcacacacguccauucccuacuaaggcccagaccu

SEQ ID NO: 166564 - RNA, 60 nt, Human
aucugggaugcaaaccgucccuguguuccccacguccaggccguagaugcuccccgccgg

SEQ ID NO: 166565 - RNA, 60 nt, Human
ccccaucgugcugcaugaccuccacgcacgcacguccagggacagacuggaauguauguc

SEQ ID NO: 166566 - RNA, 60 nt, Human
cagagugcugggauuacaauugugagccaccacguccagcuggaagggucaacaucuuuu

SEQ ID NO: 166567 - RNA, 60 nt, Human
auguacucaggugacaccaccugcuccagccacguccagugccacaguccccaguagccu

SEQ ID NO: 166568 - RNA, 60 nt, Human
uuauuuuuguaaggacacucaucugugccccacguccagaucccuggaggcagcugacca

SEQ ID NO: 166569 - RNA, 60 nt, Human
gcagacuagcugccuagaccucgcuccggccacguccaacacgacgcauccuugggcccc

SEQ ID NO: 166570 - RNA, 60 nt, Human
gcagccuggaggccgggugcucagggcugacacguccaccccagugcacccacucugcuu

SEQ ID NO: 166571 - RNA, 60 nt, Human
gaaagugcugggauuacaggcgugagccaccacguccaacugccuuauuuuguucugaau

SEQ ID NO: 166572 - RNA, 60 nt, Human
gauggugacuccugaaaccucuuccuaggccacguccagguccguagcuccccuggcugg

SEQ ID NO: 166573 - RNA, 60 nt, Human
uugccacaagaguaggguaccgucuguuuacacguccaguuaggcuacaguucuauguac

SEQ ID NO: 166574 - RNA, 60 nt, Human
guccugccugucagcuccagguccuggagccacguccagcacagaguggacggauucacc

SEQ ID NO: 166575 - RNA, 60 nt, Human
ugaguagcugggauuacaggcacccgccaccacguccagcuaauuuuuauauuuuuagua

SEQ ID NO: 166576 - RNA, 60 nt, Human
cugugcccgcaggcacccgugugacauccgcacguccagcuccgugaccugugugugugu

SEQ ID NO: 166577 - RNA, 60 nt, Human
gacucugccaccaagucuggaagaaucguccacguccacgagcgagcagccuauggaggu

SEQ ID NO: 166578 - RNA, 60 nt, Human
aagucaucagcgucacccuuccagaauguucacguccacacccauucuuggcuaauguaa

SEQ ID NO: 166579 - RNA, 60 nt, Human
ugcccgaggcgccagcucaguuucaccguccacguccacaaggggcuuuucccaccuuca

SEQ ID NO: 166580 - RNA, 60 nt, Human
agagugugggauuuccgaggcccaggugagcacguccaucucaggaggcguggagggaaa

SEQ ID NO: 166581 - RNA, 60 nt, Human
ugugcacuuccucggagagccuugggcugccacguccaccccgggcucugcccguccugu

SEQ ID NO: 166582 - RNA, 60 nt, Human
uucugugcuuuccacaaauaaaguuccugacacguccagggccaggggcugugugacggc

SEQ ID NO: 166583 - RNA, 60 nt, Human
caccugugggggacugauucaauacauaugcacguccacagcagagaaugccaugcggcc

SEQ ID NO: 166584 - RNA, 60 nt, Human
cagaggcucuagaggagaaucuuuccuugccacguccaccuuuugguggcuauuggcauu

SEQ ID NO: 166585 - RNA, 60 nt, Human
cccccaggaagggacccuggacacggcucccacguccaggcuuaagguggaugcacuucc

SEQ ID NO: 166586 - RNA, 60 nt, Human
guguagcagcuuuaacccacguuugucugucacguccagucccgagacggcugagugacc

SEQ ID NO: 166587 - RNA, 60 nt, Human
ccugcggugucgcgcgccugcagcacgccccacguccagguggcagggaaagccgagcgg

SEQ ID NO: 166588 - RNA, 60 nt, Human
caucccgccaccaggacugcuccccgccagcacguccagagcaacuuaccccggccagcc

SEQ ID NO: 166589 - RNA, 60 nt, Human
acgcuccagcccucugggaacugaauccaacacguccaacacuuggcacugaacugaagc

SEQ ID NO: 166590 - RNA, 60 nt, Human
cacacacacacacacacacacacacacacgcacguccacacucacauuaaacgaaagcuu

SEQ ID NO: 166591 - RNA, 60 nt, Human
ccauagauuggucugcuucucuggaggccucacguccauucagcucucaccucgcaccug

SEQ ID NO: 166592 - RNA, 64 nt, Human
gucagugggucagugaccugcacggugauucucccaccuccaaaagguaggggugggacuggag

SEQ ID NO: 166593 - RNA, 64 nt, Human
acgcuccuguggugagggcagggugcuccacagacaccuccagacccagccaagaacuacaggg

SEQ ID NO: 166594 - RNA, 64 nt, Human
caaggaggagcuuagcaagucugcagcccagccccaccuccauaggguccugcaggccugugcu

SEQ ID NO: 166595 - RNA, 64 nt, Human
acguauguuuccagugaagucaauugaguaaggacaccuccagccauacagaaaccaacacugu

SEQ ID NO: 166596 - RNA, 64 nt, Human
uacccuacccccacaacacaagcaccccagaccucaccuccaucccccucugucugcccucaca

SEQ ID NO: 166597 - RNA, 64 nt, Human
ugugagcuggaagcugccugcaacccugccuggccaccuccaggccuggcuccccaccucacac

SEQ ID NO: 166598 - RNA, 64 nt, Human
ugcugacucugugcagcugcgcaccugugucccccaccuccacccucaacccaucuuccuagug

SEQ ID NO: 166599 - RNA, 64 nt, Human
uagcgucccuucauuuucccacaaguuugccccccaccuccacuuaccugucugcccucagcuu

SEQ ID NO: 166600 - RNA, 54 nt, Human
ccagcccccugguguucuaggugucaccuccagccacaccggacgggccugugc

SEQ ID NO: 166601 - RNA, 64 nt, Human
ggccucccugaucucucuccucauggcagcgacccaccuccaguccccuggacaaucggguaca

SEQ ID NO: 166602 - RNA, 64 nt, Human
uccaauguggugcuagcaggcaggaucccuucuccaccuccaaaggcccuaaaggguggggaga

SEQ ID NO: 166603 - RNA, 64 nt, Human
aagcccugguagggaagagguaagggggaugauucaccuccauauuuccuaagcagguuguaua

SEQ ID NO: 166604 - RNA, 64 nt, Human
cacauuagggugggcgugcugcggguggguaucccaccuccagcccacagugcucaguuguacu

SEQ ID NO: 166605 - RNA, 64 nt, Human
gaucggucccguuggucaccuccguccggaacaccaccuccaccgggcugcaguucccggcgag

SEQ ID NO: 166606 - RNA, 64 nt, Human
ugcagacuagugagucuguaccauaaguauuaaucaccuccacucauauuaaagugaucauuaa

SEQ ID NO: 166607 - RNA, 64 nt, Human
gugcaggaccucagggugccagcccucacccauacaccuccagggcugcaggucauuagccaga

SEQ ID NO: 166608 - RNA, 64 nt, Human
ugauccucuugcuggccauuguugcuucuguugucaccuccaacaaaagggcaacucagggaac

SEQ ID NO: 166609 - RNA, 64 nt, Human
gaacacagggaugggagggucccuagccuucgggcaccuccagggccagagagcaggcucagag

SEQ ID NO: 166610 - RNA, 64 nt, Human
agcuggccugugucccuccaccgccugcaccacccaccuccagagugcagugcugggcaagggc

SEQ ID NO: 166611 - RNA, 64 nt, Human
gcggacugucugugugucugucucucuggcguuccaccuccaagccuauaccagcuguguacag

SEQ ID NO: 166612 - RNA, 64 nt, Human
cuccugugugaugggcagccauggccuaggaccccaccuccaugccuggcuccuggaugguccu

SEQ ID NO: 166613 - RNA, 64 nt, Human
cauccccaccagcucguuuuucagcacccccacccaccuccacccagccccuggcaccuccucu

SEQ ID NO: 166614 - RNA, 64 nt, Human
aggagcuuuugccacugacucggccguguccugacaccuccagaacgcaggugcuggcgcccgu

SEQ ID NO: 166615 - RNA, 64 nt, Human
gggcaucacccuccgcaccccugacauuucucuccaccuccagaggcuuggaagggaacagggc

SEQ ID NO: 166616 - RNA, 64 nt, Human
uucugcuguugcuggauacuugcaguucugccaucaccuccacuguaccaagacuuggugggaa

SEQ ID NO: 166617 - RNA, 64 nt, Human
uaccacgaccuccccauauuccucacuucuccaucaccuccagccugacucccugucugcccuu

SEQ ID NO: 166618 - RNA, 64 nt, Human
caaccccugacugcuccucaaaagcuaacgguugcaccuccaaguggcugggucuguucuuacu

SEQ ID NO: 166619 - RNA, 64 nt, Human
uauuguuuggggguuuuauaaaagcaacuacugucaccuccauccagauucuuuuaaauuauug

SEQ ID NO: 166620 - RNA, 64 nt, Human
ucuuucauccuugacaggcugguaaugugcuggccaccuccagcuccugcaucgagucuguaaa

SEQ ID NO: 166621 - RNA, 63 nt, Human
uuccucagauaagcccuuaggcaccagcuuagacaccuccaagaaccaggccccgcugaugca

SEQ ID NO: 166622 - RNA, 64 nt, Human
auccccauuuuccuuuuauaaaacauucuacccucaccuccaauauaaacacauuaaaagagua

SEQ ID NO: 166623 - RNA, 64 nt, Human
uucgacagugagagcucgugcccaucuccgaaaccaccuccaacaccaugagaugugcagccaa

SEQ ID NO: 166624 - RNA, 57 nt, Human
acaugcagguuuaugcgugagagaguccaccuccaguguagagacauaacugacuuu

SEQ ID NO: 166625 - RNA, 64 nt, Human
gcucuucaggacguuucaccgcccccucgccccgcaccuccagccuucccgacucgcagagucu

SEQ ID NO: 166626 - RNA, 64 nt, Human
gccccuauugucucuggcuaccuccuugucccaccaccuccaggcugcaucccaccuucccucu

SEQ ID NO: 166627 - RNA, 64 nt, Human
aaauccaguuuccauggcccuggauggucuggcccaccuccagccucagcuagcauuacccuuc

SEQ ID NO: 166628 - RNA, 64 nt, Human
ggcaacagaauuugaauaucuaggauaggaugaucaccuccaguccuucggacuuaaaccugcc

SEQ ID NO: 166629 - RNA, 64 nt, Human
cuggcucccagcucccgccccuccccagggcccccaccuccacggcccacuucauuuucuguuc

SEQ ID NO: 166630 - RNA, 64 nt, Human
uccuuccuuacagccuuggggauggacuugcccacaccuccaccuccccugagcccugugagag

SEQ ID NO: 166631 - RNA, 64 nt, Human
ccucucaaagugcugggauucuguguguuuugugcaccuccacuuuagguaaucauagggagca

SEQ ID NO: 166632 - RNA, 64 nt, Human
ucauuuucuacccuuuaugacuuggaugccuccccaccuccauuuccccucuucugagcugugu

SEQ ID NO: 166633 - RNA, 64 nt, Human
uacagaaacccuuccaucuguagccucaagggcccaccuccaagggaaggcuuaggcaaugauc

SEQ ID NO: 166634 - RNA, 64 nt, Human
accgaggggcucaggaaaacgggaccggccaggccaccuccagaaacggccauucagcaagaca

SEQ ID NO: 166635 - RNA, 64 nt, Human
ggagggacccagcuccaucgcgcuggaggagagucaccuccagacaacaucugcuccccccaca

SEQ ID NO: 166636 - RNA, 58 nt, Human
uccaccgcaaaugcuucuagacacacuccaccuccagcacgcgacuucucaggacgac

SEQ ID NO: 166637 - RNA, 64 nt, Human
aagccaucagggaaaaaacaacaaaaaaagagaacaccuccagcuuuucuuuuucuguauauac

SEQ ID NO: 166638 - RNA, 64 nt, Human
auuuggaaauacuuuguguaaaccaucccccuuccaccuccauuugucuguugaaagauuuuaa

SEQ ID NO: 166639 - RNA, 64 nt, Human
aggaugcuggguggcccugcagccuccuccaccucaccuccaugacagcgcuaaacguugguga

SEQ ID NO: 166640 - RNA, 64 nt, Human
acgcccauguuugcagcugauacuuguuugggcacaccuccaaguucucgggauuagaaggaca

SEQ ID NO: 166641 - RNA, 64 nt, Human
gaggcaauucacuugccagcacagauggccaacccaccuccagauuccccagugcuuccacacc

SEQ ID NO: 166642 - RNA, 64 nt, Human
gcuauucucacauugcuuuuauuuccuccuccuucaccuccaaccacugucagcagcacucugg

SEQ ID NO: 166643 - RNA, 64 nt, Human
ggguuucuaaaaugcugccuuccugccucuacuccaccuccaucccuggacuuuggacccuugg

SEQ ID NO: 166644 - RNA, 64 nt, Human
cuaggacacguccaaaggagugcauggccacagccaccuccacccccaagaaaccuccauccug

SEQ ID NO: 166645 - RNA, 64 nt, Human
ggcaccugaagggggaggaugacaagccgcugcccaccuccaagcccaggaaacaguacaagau

SEQ ID NO: 166646 - RNA, 64 nt, Human
uggggguaugugaagcaaaaggggcaggugcacacaccuccacagugaccucugugcacacggu

SEQ ID NO: 166647 - RNA, 64 nt, Human
aguucaaaagcagccaugagaaggaaggauucaccaccuccaggaaaagguaaauuugccaaua

SEQ ID NO: 166648 - RNA, 64 nt, Human
aaaaauccucagcaguuguucuccaccccuucuccaccuccaccagcaaggagaagucaaucua

SEQ ID NO: 166649 - RNA, 64 nt, Human
cccuucccaugcuuguaaccagcucuggggcuugcaccuccacaaaguaagguuggcccuugga

SEQ ID NO: 166650 - RNA, 64 nt, Human
aacaccucaucauccuucucaucgcuaacaccaccaccuccaucggcacccaagcgggcaucau

SEQ ID NO: 166651 - RNA, 64 nt, Human
ucugggucccagaccuggcccgaccccucugcuucaccuccagcucugcugcuccucuacucuu

SEQ ID NO: 166652 - RNA, 64 nt, Human
gguggggugggggacuaggcucagccggaaccagcaccuccaaggaguccgggaggugccugug

SEQ ID NO: 166653 - RNA, 64 nt, Human
acacuucuugccuucacuuucccacuuccguggccaccuccaugcagaagcccuaagcccacau

SEQ ID NO: 166654 - RNA, 64 nt, Human
uccugcuuccccaucccggaguuccccugcuccccaccuccagucguccugccggaccuccacc

SEQ ID NO: 166655 - RNA, 64 nt, Human
gaaaaaucuucauguuaggauuaauuuucuuaaucaccuccacacuguacagaggaaacucaag

SEQ ID NO: 166656 - RNA, 64 nt, Human
cacuucacgagcucagugagaagggcccuguauucaccuccacugcccccaggggcuguggaca

SEQ ID NO: 166657 - RNA, 64 nt, Human
ggagcccugaggcuuuucuucuccugcccccaagcaccuccagcggugaugagcuccacacccc

SEQ ID NO: 166658 - RNA, 64 nt, Human
ugaagaaguggaagaagaccuaaggcucucccuucaccuccaggaucaggauucugucaaagau

SEQ ID NO: 166659 - RNA, 64 nt, Human
uuugugguucaugcaaacaaugugcagaugauagcaccuccauauuacuaauaaaaauaugaua

SEQ ID NO: 166660 - RNA, 64 nt, Human
gaugccggcuuuauuaacaaaaacucuaacaagucaccuccacuaugugggucuuccuuucccc

SEQ ID NO: 166661 - RNA, 64 nt, Human
gagagagcaccuuuuugcuuuucgagcucuugaccaccuccaauguguaggucccuccaggcug

SEQ ID NO: 166662 - RNA, 64 nt, Human
uuuuuccaucuucuccccacagccucuggcuccacaccuccaccguucaagcgccagaaagagc

SEQ ID NO: 166663 - RNA, 64 nt, Human
augguuccugcccgggcccaaggggugcacagggcaccuccauggcuccauuauuaacacaacu

SEQ ID NO: 166664 - RNA, 64 nt, Human
gucagaggagguguggucagaggugacuuguucccaccuccagggaggacgcuucgucuucggc

SEQ ID NO: 166665 - RNA, 64 nt, Human
uccacacccacaagcuaccuggagggacaggacccaccuccauccuucggaaggccuuccugga

SEQ ID NO: 166666 - RNA, 64 nt, Human
ggccagggccaugcagauggaggccucugggagccaccuccaaucccucaccacucacucaacc

SEQ ID NO: 166667 - RNA, 64 nt, Human
aggaauugagcucaugaagcaggcaaggaccgaacaccuccaccccaacguagaccugcaggug

SEQ ID NO: 166668 - RNA, 64 nt, Human
aauuaagauuuuuacuucaucuuucuugggccugcaccuccaagauaacaaagaagaagcaaug

SEQ ID NO: 166669 - RNA, 64 nt, Human
gaugucaggguggucagcucuggacuaagccacccaccuccaauuuguacaacaguauugauac

SEQ ID NO: 166670 - RNA, 64 nt, Human
guaaguuucucuuuucuucaggugcauuuuccuacaccuccaaaugaggaauggauuuucuuua

SEQ ID NO: 166671 - RNA, 64 nt, Human
gagcuguugagguaccuccaaggaccggccuuugcaccuccauggaaacgaagcaccaucauuc

SEQ ID NO: 166672 - RNA, 64 nt, Human
caccuuagagcuucugaguuuccaagcucugagucaccuccacauuugggcauggcaucuucaa

SEQ ID NO: 166673 - RNA, 64 nt, Human
cauagcccuguaauauucagauggaacccccaaccaccuccacccuguuuguucccacaugugu

SEQ ID NO: 166674 - RNA, 64 nt, Human
uuugucuuuuuuuuuuuuuuuuuuuuuaaaccuccaccuccaguggcugugacuggucccagug

SEQ ID NO: 166675 - RNA, 64 nt, Human
gcauuuuuuaucaggcaggaccagguggcacuuccaccuccagccucugguccuaccaauggau

SEQ ID NO: 166676 - RNA, 64 nt, Human
cuccucuccuccccccaagcucaguuaaaucccccaccuccaacuuucccuccaccagugugcu

SEQ ID NO: 166677 - RNA, 64 nt, Human
gaacggcagacccaggucggagugaggaagcuuccaccuccauccugacuaggccugcauccua

SEQ ID NO: 166678 - RNA, 64 nt, Human
uugcuuucucucuggccuggacauucucuggcagcaccuccaggauacauaaauucaauggauc

SEQ ID NO: 166679 - RNA, 64 nt, Human
gaaaagagugugaggagccagggaaaggcagaaccaccuccaugcuguagcaaacaauuucuag

SEQ ID NO: 166680 - RNA, 64 nt, Human
ugaaguuggccuccuuucacuggggauugaaaagcaccuccaccccuacccuagugaugucccc

SEQ ID NO: 166681 - RNA, 64 nt, Human
cuucaccuuuuuguuucugucaacuugucauauacaccuccagggaccaaaaacaaaagcagcu

SEQ ID NO: 166682 - RNA, 64 nt, Human
ugcauuagaugugagggcuauguugacauggcaucaccuccaaagaccugaccugccuaaagac

SEQ ID NO: 166683 - RNA, 64 nt, Human
aagauuaaaggaaggggcacaauucgcuaucacacaccuccaagaucaagauccuguucugagu

SEQ ID NO: 166684 - RNA, 64 nt, Human
ggggagcacaguagugcgggccugggcccugcuccaccuccagaaguggcuggauguacccugc

SEQ ID NO: 166685 - RNA, 64 nt, Human
ucccucccacacacaggccagcugcucacccugccaccuccaugugacaaguuugacaccuguc

SEQ ID NO: 166686 - RNA, 64 nt, Human
gaggaauaaugcggacacuuuugaggacaaguuacaccuccacucagcacucuggacuccacga

SEQ ID NO: 166687 - RNA, 64 nt, Human
uggcagaaagaguccuugaagcagagacaagccucaccuccacuucugucaagagaggggccug

SEQ ID NO: 166688 - RNA, 64 nt, Human
gagauaaauguucuuugcuucauauucacaguuucaccuccauuuaaauuuauggggaagaaua

SEQ ID NO: 166689 - RNA, 64 nt, Human
caccuuugugcuccaaacaccucccaccaggccccaccuccaguauuggggauuacauuucaac

SEQ ID NO: 166690 - RNA, 64 nt, Human
ugcccccaugacccagaccccucccguuaggcuucaccuccaacacugaggaucaaauuucaac

SEQ ID NO: 166691 - RNA, 64 nt, Human
cucaagucggucugggcccguugccaccgacucccaccuccagcacccaugcccgcugcaccgc

SEQ ID NO: 166692 - RNA, 64 nt, Human
gcuacagccaccuagcaugaacuaacccagcuuccaccuccauaaaguuaccuagaguuguuga

SEQ ID NO: 166693 - RNA, 64 nt, Human
agaccccuaacccuacuaaccagcaggcucaucucaccuccaggccugaaacauuucuuuucuu

SEQ ID NO: 166694 - RNA, 64 nt, Human
ggaaaugugacaccaccauccugaagccagcuugcaccuccaguuugcacagggauuuguucug

SEQ ID NO: 166695 - RNA, 64 nt, Human
cucagccuuccaaguagcugggacuacagaugcacaccuccaaaccuggguaguuuuugaaguu

SEQ ID NO: 166696 - RNA, 64 nt, Human
cucuguccccuucuccccagcuaagaauguguggcaccuccaucaguuauacuuagaaggagca

SEQ ID NO: 166697 - RNA, 64 nt, Human
ucauugagcuuaagcuccgcuuguucugagguuucaccuccauguguuucauuggugcaaaagu

SEQ ID NO: 166698 - RNA, 55 nt, Human
gcaagguccacugugacugagcccucaccuccacgccuaccucauagcuucacag

SEQ ID NO: 166699 - RNA, 64 nt, Human
ggucuugggcagggaugggggcuaggcuugccaucaccuccaguuuggcuucugagcagagacu

SEQ ID NO: 166700 - RNA, 64 nt, Human
aggccucgaaaaagcccaagacagcagaagcagacaccuccagugaacuagcaaagaaaagcaa

SEQ ID NO: 166701 - RNA, 64 nt, Human
gucagcacuaaaggaugggcagagguucaacccacaccuccacuuugcuucugaaggcccauuc

SEQ ID NO: 166702 - RNA, 64 nt, Human
gccucucgccgccucugagcacccugccccaccccaccuccacucccaccucacccggccucuu

SEQ ID NO: 166703 - RNA, 64 nt, Human
ccgaauagccgugagccggaauccugcacggugccaccuccacacucaccucaccucugccugc

SEQ ID NO: 166704 - RNA, 64 nt, Human
acugccuuggguuuuaucuuucccuuaccccuggcaccuccagagaacugggaccugaaauagu

SEQ ID NO: 166705 - RNA, 64 nt, Human
gugggaguuuuggggccuccagggcagcaggcaccaccuccauaucccggcccacauccagcug

SEQ ID NO: 166706 - RNA, 64 nt, Human
agcuauaggaccauguuauagaucagcguuuagucaccuccagguuauaugcaucgagaaccug

SEQ ID NO: 166707 - RNA, 64 nt, Human
gcagaagcaaggggcugaaaagaucugaaggucccaccuccauuugcaauugaccucuucuggg

SEQ ID NO: 166708 - RNA, 64 nt, Human
gcacuggugggugcucugaaaacccacaggaucccaccuccaggcccaccugggucccaucuca

SEQ ID NO: 166709 - RNA, 64 nt, Human
cugagacaggggcgcccccgccuugaccccugggcaccuccauccccucccaccuguccccaga

SEQ ID NO: 166710 - RNA, 64 nt, Human
uuugagguggcacuuuuucauuugccuauucccacaccuccacaguucaguggcagggcucagg

SEQ ID NO: 166711 - RNA, 64 nt, Human
ugacuggcgugugggagacccuguggccggcacccaccuccacacgaggacuaagcucugauuu

SEQ ID NO: 166712 - RNA, 64 nt, Human
aauccaugagccugugcugagccccaguggguugcaccuccaccggcagucagcgagcuggggc

SEQ ID NO: 166713 - RNA, 64 nt, Human
cgucccaacuccugcggguggcaccugccucucccaccuccagucuuuccccugugaugagcag

SEQ ID NO: 166714 - RNA, 64 nt, Human
ccuugugccugggguguuaguggcaccgccuccccaccuccaggcuuucccacuucccacccug

SEQ ID NO: 166715 - RNA, 64 nt, Human
aguaggaaaacaaaaaccucucuccucagccuuccaccuccaagagaggaggaaaaacaguugu

SEQ ID NO: 166716 - RNA, 64 nt, Human
acuuuguugugucugugcuaaccugggaacuggccaccuccauuguucuuugcuucugcacaag

SEQ ID NO: 166717 - RNA, 64 nt, Human
gcuggccagggcgugggcaggugguguccuguggcaccuccauccuccugcccagccggcugug

SEQ ID NO: 166718 - RNA, 64 nt, Human
ccaccucugguccacacuagaaagaagcucgccccaccuccaccugugagauccgugaauucuc

SEQ ID NO: 166719 - RNA, 64 nt, Human
ugugacucacaccuuguggcugccuucagagcgccaccuccagaucagauggggacacacaacc

SEQ ID NO: 166720 - RNA, 64 nt, Human
aaagcaaauaacuggacauaaucuuaaaggauuccaccuccaucgucuuuccuaacuuagaucu

SEQ ID NO: 166721 - RNA, 64 nt, Human
uuaugauccuuuuagggugaggacucacugagugcaccuccaucuccaagcacugcugcuggaa

SEQ ID NO: 166722 - RNA, 64 nt, Human
aagagugcuccaagacuuggaccaggcacacacacaccuccagaucaccuuggcaacuccaggg

SEQ ID NO: 166723 - RNA, 64 nt, Human
auuuggcgagaccagagcagucugaaggauuccccaccuccaaucccccagcgcuuagaaacau

SEQ ID NO: 166724 - RNA, 64 nt, Human
uucuugcauugcauuuaaugaucccuuuucuccccaccuccacacacuacauuuuuuuuagauu

SEQ ID NO: 166725 - RNA, 64 nt, Human
acuaaggaacaacauagauagugagcauaguccccaccuccaccccucacaauuuauuugaaua

SEQ ID NO: 166726 - RNA, 64 nt, Human
agucagcugucuccugcuuucuugcccuuaaaaucaccuccaucuuuauauucuucuguuauac

SEQ ID NO: 166727 - RNA, 64 nt, Human
aucuaaguccuaacuauuacaaugauggacucagcaccuccaaagcaguuaauuuuucacuaga

SEQ ID NO: 166728 - RNA, 64 nt, Human
guccagggcagccuguuuuacccagaugggccugcaccuccagcuucuuucugaagcaugaccc

SEQ ID NO: 166729 - RNA, 64 nt, Human
agcccuggagcaaucuucuucaggcagcugucuccaccuccaggauguccagcaggcugcaagg

SEQ ID NO: 166730 - RNA, 64 nt, Human
auuuucacauauugggcuuacccagaguggagcacaccuccagggcauguggcugacacugggu

SEQ ID NO: 166731 - RNA, 64 nt, Human
cccuucuccuaaacauuuuaaaacucuucccuuucaccuccaauucccgugaucccaaaagaag

SEQ ID NO: 166732 - RNA, 64 nt, Human
gggacuugagcauggguccuuguucuuccuauuucaccuccaggaaagcaaaagugggagcaga

SEQ ID NO: 166733 - RNA, 64 nt, Human
acccagagcuuaagccacaguccugcucaggcuacaccuccaagggugggaccaggcccaccuu

SEQ ID NO: 166734 - RNA, 64 nt, Human
aucaauucaucaguaaggucagaugcuguuugcacaccuccagcaauagggugcucacugccuc

SEQ ID NO: 166735 - RNA, 64 nt, Human
gucacgagaagagaaugccuucuagaugcaaaaucaccuccaaaccagaccacuuuucuugacu

SEQ ID NO: 166736 - RNA, 64 nt, Human
gccaucggguagcgauggucuaugccauggggaacaccuccauugguguggccaagcugccccc

SEQ ID NO: 166737 - RNA, 64 nt, Human
cuucccagcccugagaccacuggucacaguuggccaccuccaacgggagaccuuguccuuggcc

SEQ ID NO: 166738 - RNA, 64 nt, Human
guccagcgcucaggaauaucguaaccaguuuuuucaccuccaugucauccgagcaagguggaca

SEQ ID NO: 166739 - RNA, 56 nt, Human
guuaccuccacuuuuuuuaaucguaacaccuccauuuguauuacauaugguguaug

SEQ ID NO: 166740 - RNA, 64 nt, Human
uuugucuggaucagauccgcgcuauuccccaacccaccuccagauaaugugagaaaauagccau

SEQ ID NO: 166741 - RNA, 64 nt, Human
ugaaggaccaaagguuuuaaaagucaauugguaucaccuccacacugacuaggguaguggggug

SEQ ID NO: 166742 - RNA, 64 nt, Human
cauacauuccaaaaggaaguucaacaguaagcagcaccuccaagacugucuccuuuuggccaau

SEQ ID NO: 166743 - RNA, 64 nt, Human
auuucccuugccucauaggcuucugggaugucaucaccuccaguuuguugguuuuguuuccaac

SEQ ID NO: 166744 - RNA, 64 nt, Human
agccaaaagcuggaaucgcccuuauuuccacccucaccuccaaggguggaaacuugccccuucc

SEQ ID NO: 166745 - RNA, 64 nt, Human
cccuacuugcuuucugcuuccuucuggugaaguccaccuccaacauuaaccugcccaccccacc

SEQ ID NO: 166746 - RNA, 64 nt, Human
gagcggcugaaaaaccguagccauagauccuguccaccuccacuccccucugacccucaggcuu

SEQ ID NO: 166747 - RNA, 64 nt, Human
gggauggucggaucucacaggcugagaacucguucaccuccaagcauuucaugaaaaagcugcu

SEQ ID NO: 166748 - RNA, 64 nt, Human
cuuuuuguuuuguuuuguuuuauuauuuucauaucaccuccaucccauaaaguuguacugugaa

SEQ ID NO: 166749 - RNA, 64 nt, Human
ggggaaucauugguugggggaagggaggaaaccccaccuccagcccccgccaccgggcucccug

SEQ ID NO: 166750 - RNA, 64 nt, Human
cagcacaccggugcuggccacaccagcccccuuucaccuccagugccacaauaaaccuguaccc

SEQ ID NO: 166751 - RNA, 64 nt, Human
gccagccggccacgcccacgccgcugcagagccgcaccuccauugugcaggcagcugccggagg

SEQ ID NO: 166752 - RNA, 64 nt, Human
ccagacccacccacgcucugacgagaggcuuuuccaccuccagcaaguguucccagcaaccagc

SEQ ID NO: 166753 - RNA, 64 nt, Human
gguuuugagaaaguacagcaguagacuggggcgucaccuccaggccguuucucauacuacagga

SEQ ID NO: 166754 - RNA, 64 nt, Human
ugcccugaaucaaacuauaaauguggggagaaaucaccuccaucaaacaguugcauauuuacug

SEQ ID NO: 166755 - RNA, 64 nt, Human
cuguucuuucuguccugguguggugcugcucccucaccuccaaaagagcaaaaguacuuucacc

SEQ ID NO: 166756 - RNA, 64 nt, Human
cugcucaguauuugagcuaugucugcuuccugcccaccuccagccagagaagaaucaguauuga

SEQ ID NO: 166757 - RNA, 64 nt, Human
gggacagacccucacccccacccuggggguguggcaccuccaaacuuucaacuucagggugauu

SEQ ID NO: 166758 - RNA, 64 nt, Human
gcagggacucgaaacccccuccguccugagcagccaccuccagggcccuguuugggaccacucu

SEQ ID NO: 166759 - RNA, 64 nt, Human
cuggucucaaacucccagccucaagcgaugcucccaccuccaccucccaaagugcugggauuac

SEQ ID NO: 166760 - RNA, 64 nt, Human
agcacagaggaaguugccaggaagguggcuucagcaccuccagguugguucuggguguccugcu

SEQ ID NO: 166761 - RNA, 64 nt, Human
ugucuuaaguaucuuucccuuccuucucuacccucaccuccauccugucuacuaauccacaguc

SEQ ID NO: 166762 - RNA, 64 nt, Human
gcuacgcuuccccugcugagauagccccuacccccaccuccacaggcugggacagccccguccc

SEQ ID NO: 166763 - RNA, 64 nt, Human
ccauugaccgagugaccacuucuguguagaguuucaccuccaaguuuuaccuccugugucuucc

SEQ ID NO: 166764 - RNA, 64 nt, Human
cagccagcaggaggagcuucaucuguucccuucccaccuccaaccuagcccuacugcccacccc

SEQ ID NO: 166765 - RNA, 64 nt, Human
acauagaaaagcaagacaagccagagaucucccacaccuccagagaugugcaaacagcugggag

SEQ ID NO: 166766 - RNA, 64 nt, Human
cugcaggggagcacggagccgcgggacagccaagcaccuccaaccaaauaagacuuccacucga

SEQ ID NO: 166767 - RNA, 64 nt, Human
auucugaguuuuaggucccaccccauuggcccgucaccuccaucagcuccacuucucaaacuuu

SEQ ID NO: 166768 - RNA, 64 nt, Human
uaucaagauauccuagaaauaaaaaccagauguccaccuccaguguuucauacuuucugguuuu

SEQ ID NO: 166769 - RNA, 64 nt, Human
ggagaguaaugaagauguuauuuuggacuucggacaccuccacuggggacucuuccaggauggg

SEQ ID NO: 166770 - RNA, 64 nt, Human
acuuuucucccaccuucaguuuuuuuuuuuuuuccaccuccacuuuuuaaaagcaaaaaaaaaa

SEQ ID NO: 166771 - RNA, 64 nt, Human
uuccuuuccuccaaugaaccaaacgccucccgcccaccuccaggucccaguccucuguucccuu

SEQ ID NO: 166772 - RNA, 64 nt, Human
cugaagguccucacuguuugcauaucgcucaggccaccuccaaaccccaccuagguuuuauaau

SEQ ID NO: 166773 - RNA, 64 nt, Human
aaagugccaagccauuugugaaggcucugccagacaccuccaagcuugagagcucagcaccaug

SEQ ID NO: 166774 - RNA, 64 nt, Human
caguucauauaccugccugagauaggcugguccucaccuccagagccagccagccccgucaggg

SEQ ID NO: 166775 - RNA, 64 nt, Human
cuuagagcgagagcagagcaaacugcgcagcaggcaccuccagaaagguaaugguggcagaacc

SEQ ID NO: 166776 - RNA, 64 nt, Human
uuucagauuucuuuuucguuugguuugguuuuggcaccuccaaguggugucauuugagcauugu

SEQ ID NO: 166777 - RNA, 64 nt, Human
uggaaaggguauccacagcaggaaguccccaguucaccuccaugacuacagggcagcuuugcac

SEQ ID NO: 166778 - RNA, 64 nt, Human
guguucuuagaauucgcauuuugccagcucagcgcaccuccacaacgaaugaaaugcuccguau

SEQ ID NO: 166779 - RNA, 64 nt, Human
auggaagggggugccucucggaggagccuguguccaccuccagucucggcuuuccccggggggc

SEQ ID NO: 166780 - RNA, 64 nt, Human
gcugagugggguacugugucucauagacaugcgccaccuccacgugagaacaagggugaaggug

SEQ ID NO: 166781 - RNA, 64 nt, Human
cugcaugacucaguggguuuggugcacaggcacacaccuccacuuguuauauaaccuguuugug

SEQ ID NO: 166782 - RNA, 64 nt, Human
uggaccaacuuuuauguaacaaacagccccuccccaccuccaguuuuacaacaaucagaaaggg

SEQ ID NO: 166783 - RNA, 64 nt, Human
ggccaggugccugaggacagcacugaaggccgugcaccuccaccuccagccuccagucaccuca

SEQ ID NO: 166784 - RNA, 64 nt, Human
gugccugaggacagcacugaaggccgugcaccuccaccuccagccuccagucaccucaccuagc

SEQ ID NO: 166785 - RNA, 64 nt, Human
uaccucgcaagagugacuagaaaguuucuaggagcaccuccaggcuugcaaagaaagugaggcc

SEQ ID NO: 166786 - RNA, 64 nt, Human
aaccacguccucgccacugcaccucggcauaugccaccuccaugccacugccagagcuggccua

SEQ ID NO: 166787 - RNA, 64 nt, Human
ugaaucccaaaagugccuccccagccucagcccccaccuccagccacacacacauuacacacac

SEQ ID NO: 166788 - RNA, 64 nt, Human
ugggcccugcucgcaugccgccccgcccuccccccaccuccacgacuauuuauugagcgccugu

SEQ ID NO: 166789 - RNA, 64 nt, Human
cauggauacuuccugggucaagugcuaaccuuuucaccuccaacuggauguugacguauauaua

SEQ ID NO: 166790 - RNA, 64 nt, Human
gaacccggaggcggagguugcgguaagccgagaucaccuccagccuggacacucugucucgaaa

SEQ ID NO: 166791 - RNA, 64 nt, Human
ucucuaggccucacuguugcggugucuaucccuucaccuccauugaaaucagcauuuuggaucu

SEQ ID NO: 166792 - RNA, 64 nt, Human
gugagagagcaagagagaggcaugaacacacagucaccuccacuccccauucuuucaacccaag

SEQ ID NO: 166793 - RNA, 64 nt, Human
caacgguggaaagaggaggaugcuguuucucugucaccuccacuugcuccccgacagguggggc

SEQ ID NO: 166794 - RNA, 64 nt, Human
aaaaaucauaaccacucaucuaauuucuaagaggcaccuccaucgagggccggucuccugcuuc

SEQ ID NO: 166795 - RNA, 64 nt, Human
ggaaugaaauugccauuuuucgggugaaacgccacaccuccagggucuuaagagucaggcuccg

SEQ ID NO: 166796 - RNA, 64 nt, Human
cagauuuccugugugggguucagcguagaaaacgcaccuccaucccgcccuucccacagcauuc

SEQ ID NO: 166797 - RNA, 64 nt, Human
cuguguguuuuuucugugguugccgcauuuauuccaccuccagcuggaccccccacugcaaaua

SEQ ID NO: 166798 - RNA, 64 nt, Human
uuggaguuggaaguggacagccuaauuuuuaucucaccuccacuaggacuuugaccuucccagg

SEQ ID NO: 166799 - RNA, 64 nt, Human
ggcagggcuggggggacgaagggggaacccggagcaccuccacuucuagggaagauggacagcg

SEQ ID NO: 166800 - RNA, 64 nt, Human
uguuuuuuuuuuuuuuuuaucuuaaacacauacacaccuccaguuuuugcucuuuuguguugua

SEQ ID NO: 166801 - RNA, 64 nt, Human
gcagccaagcaaccucagcaguucccaucaaggccaccuccaccacaaccgaaaguaucaucuc

SEQ ID NO: 166802 - RNA, 64 nt, Human
acuagagucagacagcuuuaauugacauugucaacaccuccaguuaucaggaauacauuuuuuu

SEQ ID NO: 166803 - RNA, 64 nt, Human
cuggucucauacuccucaguucacgcauuccucccaccuccaccucccaaacugcugggauuac

SEQ ID NO: 166804 - RNA, 64 nt, Human
ugugcccuuggucccaggucaggcccacccccugcaccuccaccugccccagccccugccucug

SEQ ID NO: 166805 - RNA, 64 nt, Human
gucuaagguggauucagugucuggcacacugagacaccuccaagaaggagauugaugcaucagg

SEQ ID NO: 166806 - RNA, 64 nt, Human
ggcaccucgcuggccaggcucucccgagucguggcaccuccacaaugugaauuuucugaauccc

SEQ ID NO: 166807 - RNA, 64 nt, Human
uuucucuuggaagcagaaaugcuuuguaccagagcaccuccaaacugcauugaggagaaguucc

SEQ ID NO: 166808 - RNA, 64 nt, Human
auugccucucuggcagcaauuccuaguuaguuaccaccuccagcugaggggcuggaggaaaaca

SEQ ID NO: 166809 - RNA, 64 nt, Human
uauaaagagacauuuucauagguucagaguaacucaccuccaugggcugaccaaaggcuuuucu

SEQ ID NO: 166810 - RNA, 64 nt, Human
agcccggccacagcagcucagccagucacagcuccaccuccaacuucuacagcagcaauuuuua

SEQ ID NO: 166811 - RNA, 64 nt, Human
ugaggggagauacugcccuucucucugccugccucaccuccagcugucagagggugagcagggc

SEQ ID NO: 166812 - RNA, 64 nt, Human
gaauacugucuuguguaaauauauucaaggaaaacaccuccacuaccucacugacuucauaauu

SEQ ID NO: 166813 - RNA, 64 nt, Human
acgcugucccccgacaucccacuccaaagugugccaccuccagugagccuccuugucaugcccg

SEQ ID NO: 166814 - RNA, 64 nt, Human
uggacaaggccagaccaaagcaagcagggccuggcaccuccauccugaggugcugccccuccau

SEQ ID NO: 166815 - RNA, 64 nt, Human
cccagagcugcccaaguucacugggcuccacccccaccuccaggaggggaggagaggaccugac

SEQ ID NO: 166816 - RNA, 64 nt, Human
caggcagggccucucaguccuugugggucugugucaccuccaucucagucuuggccuggcuaug

SEQ ID NO: 166817 - RNA, 64 nt, Human
aacaugagcugcccucugugcaagguuucggggccaccuccaggcugcaggggcgggucacuca

SEQ ID NO: 166818 - RNA, 64 nt, Human
gcuccucuucccagcacagcagcccccgggucugcaccuccagagcccacccuaccaccagaca

SEQ ID NO: 166819 - RNA, 64 nt, Human
ccgccuccaggaagaccagacucccacccuuccacaccuccagagcagugggacuuccuccugc

SEQ ID NO: 166820 - RNA, 64 nt, Human
ccacauuaugcagagcacacaggacaggcuggugcaccuccaggcugugccaggaaacccgcug

SEQ ID NO: 166821 - RNA, 64 nt, Human
cacugaagcaggcccuguuugcaauucacguugccaccuccaacuuaaacauucuucauaugug

SEQ ID NO: 166822 - RNA, 64 nt, Human
uuuuaguugagaagucucuuaaagccaucuagcccaccuccaucaauucccuaugugaggaagc

SEQ ID NO: 166823 - RNA, 64 nt, Human
ggagcugggggagccaccccucggccauucccuccaccuccaagacagguggcggccgggcagg

SEQ ID NO: 166824 - RNA, 64 nt, Human
aauugcacagagguacugcccccacaccuccugacaccuccauauaccccagcuauaucugcuu

SEQ ID NO: 166825 - RNA, 64 nt, Human
gagacucuccagucagaaaugugucgcauaguuccaccuccacaccucucugcugccagcacau

SEQ ID NO: 166826 - RNA, 64 nt, Human
gaauguucuggguucaacucaagcaucucccuugcaccuccaggguccugcguggacucugggu

SEQ ID NO: 166827 - RNA, 64 nt, Human
cccugaguaauucacggcauuugggggcucaccccaccuccaggucugucaaguggccuuuguc

SEQ ID NO: 166828 - RNA, 64 nt, Human; identical to SEQ ID NO: 166818

SEQ ID NO: 166829 - RNA, 64 nt, Human
ugcucuguggcucugcccacggucaggugacagccaccuccagggcaccgucaggguggugcug

SEQ ID NO: 166830 - RNA, 64 nt, Human
gucccuggcgcccugccuuuagccguggggcccccaccuccacucucuggguuuccuaggaaug

SEQ ID NO: 166831 - RNA, 64 nt, Human
agugaugaaauaauuuguguuuuauaucccccuucaccuccauguauugguuagcacaguuuau

SEQ ID NO: 166832 - RNA, 64 nt, Human
ucuguuaaaaaccacacacacucguacaugcagacaccuccaaugagauauaguuaagagaugg

SEQ ID NO: 166833 - RNA, 64 nt, Human
gcaacagaugccuggccugggaacccagggauuucaccuccaccagugagaccacggggccacu

SEQ ID NO: 166834 - RNA, 64 nt, Human
cuaaauuguuuauauugcuauccauaaugggauucaccuccaaauuaucaaagaaauaacucag

SEQ ID NO: 166835 - RNA, 64 nt, Human
aggucggaggggcugggacuggggagggggcagccaccuccauccaaggcucuuccuaggggcc

SEQ ID NO: 166836 - RNA, 64 nt, Human
ccaggaaggcugugugggucuggagcccacgucccaccuccacacccuuggcuugggcccaugc

SEQ ID NO: 166837 - RNA, 64 nt, Human
ggacaucuucugagccaggacgucccugaggcuccaccuccaagcucagacagggcccaggcuu

SEQ ID NO: 166838 - RNA, 64 nt, Human
cacggguuuuuacugcccuucacccaaccucucccaccuccaccccacaaugaauguauuuauu

SEQ ID NO: 166839 - RNA, 64 nt, Human
accucuuuucuuucuugaggguugguccuguccccaccuccacccucccacccccuggaagagg

SEQ ID NO: 166840 - RNA, 64 nt, Human
ggggugccaugcacaggccacaggcccuccaccucaccuccagcucaggggccgcaccccgccg

SEQ ID NO: 166841 - RNA, 64 nt, Human
guagggaagaugaggaggcaagggcugccucucacaccuccagguucucuaaguucuggggagg

SEQ ID NO: 166842 - RNA, 64 nt, Human
ccugacaccgggaggccucauggccaacaauggacaccuccagagccuccaggggaccacacag

SEQ ID NO: 166843 - RNA, 64 nt, Human
gggacacagccaaaccauaucauucuaccccuggcaccuccaaaucucauguccucacauuuca

SEQ ID NO: 166844 - RNA, 64 nt, Human
cuugauuuuaagucacuggguuccauuguccuggcaccuccauuuccuuaguuucuguaagccu

SEQ ID NO: 166845 - RNA, 64 nt, Human
ccagggcagagugagacccagcccucaucccgagcaccuccacauccuccacguucugcucauc

SEQ ID NO: 166846 - RNA, 64 nt, Human
ugaauguuauacugaguuucuaccucuuuaacuccaccuccaauuucugucaaucuacaaacac

SEQ ID NO: 166847 - RNA, 64 nt, Human
ggggcuuggggcaauuuccaguggagggcauccacaccuccauuuuaugcuugugguucacaca

SEQ ID NO: 166848 - RNA, 64 nt, Human
ccauagugggcucuucacuccugcucguaauaaccaccuccaaauuuguuagagugauuugguc

SEQ ID NO: 166849 - RNA, 64 nt, Human
caucacugcaauaaagaauaaggguguuugagcucaccuccaugcaaagacuucaguuuuaaaa

SEQ ID NO: 166850 - RNA, 64 nt, Human
gagaaaauaggucaacaaucuguuguggggaaaccaccuccauguaacccacuggauacagucc

SEQ ID NO: 166851 - RNA, 64 nt, Human
cuguaccuaccaucuccugccucccuuaggcaggcaccuccaaccaccacacacucccugcugu

SEQ ID NO: 166852 - RNA, 55 nt, Human
gaauuaucccgaaaaguuaacaugucaccuccacgaggccauccucugugaccga

SEQ ID NO: 166853 - RNA, 64 nt, Human
gaggggucauggcacggaauaugaaagccuccuccaccuccaaacacccccaccuuggaaggag

SEQ ID NO: 166854 - RNA, 64 nt, Human
cuucuugauggguacaggcugaguggggcgcccucaccuccagccagccucuuccugcagagga

SEQ ID NO: 166855 - RNA, 64 nt, Human
aaguguucagaagguucuuuuuuauauuguccuccaccuccaucauuuucaauaaaagauaggg

SEQ ID NO: 166856 - RNA, 64 nt, Human
cuucucguccuugaggguuuagaacacacaccaacaccuccagcguccccgccccagcuuccgg

SEQ ID NO: 166857 - RNA, 64 nt, Human
caugacagagaaaguuacacucagggagcagcagcaccuccagacuggaaaaauauguuaaucu

SEQ ID NO: 166858 - RNA, 64 nt, Human
gccaacacgcccuggcagcaccagcagcucuugccaccuccagcugccaaacagcagccugccg

SEQ ID NO: 166859 - RNA, 64 nt, Human
gccacccacacuucaucugcucccucauaggccccaccuccacgucccggcugggccccagacc

SEQ ID NO: 166860 - RNA, 64 nt, Human
aggcuggaagggcuggcagaucgcuucccucauccaccuccaccgguccaggucuuugcugcug

SEQ ID NO: 166861 - RNA, 64 nt, Human
aaggcacugacccucggccucuacuuuguccccucaccuccacccccuccugucaccggccuug

SEQ ID NO: 166862 - RNA, 64 nt, Human
ggguuauacccaggacaugauuuucaccuacuaacaccuccacgugcucagcaauuuugcaugu

SEQ ID NO: 166863 - RNA, 64 nt, Human
guugggugggcagagccaccaggaacccagacaccaccuccaacucugagccuuccagagcuuc

SEQ ID NO: 166864 - RNA, 64 nt, Human
gagcuuuuuuuccccugucccccaaccccauccccaccuccacuucagaacauggcaccccacc

SEQ ID NO: 166865 - RNA, 64 nt, Human
gagguuucacccuuaacccaaggagcacaggucccaccuccagcccgggagccuaggaccacuc

SEQ ID NO: 166866 - RNA, 64 nt, Human
uuucgucagccuuggggacuaggccaguguugggcaccuccaggaggaggccugacugguucau

SEQ ID NO: 166867 - RNA, 64 nt, Human
ggaacugguugcugucagguuuaucucauccuaacaccuccauaauauuuucugcuaaaggagu

SEQ ID NO: 166868 - RNA, 64 nt, Human
cugcaucggggauuccaccuacuuauuucagauucaccuccauuaaccaagaaaaccaguggaa

SEQ ID NO: 166869 - RNA, 64 nt, Human
ccagcucaggggcagcucauagaguccccccucccaccuccagucccccuauccuuggcaccaa

SEQ ID NO: 166870 - RNA, 64 nt, Human
cugggcuaauggccaccgggcaccaucggacucccaccuccacugucugcugccucugugugug

SEQ ID NO: 166871 - RNA, 64 nt, Human
cagggcaguucccuggcugaggccuuuugcgccccaccuccaggaccaagggccauucuagaca

SEQ ID NO: 166872 - RNA, 64 nt, Human
cccauggagcaauuccaaggccccaguuacccaucaccuccacaccaggucaaguuuugucuca

SEQ ID NO: 166873 - RNA, 64 nt, Human
gaugcccguugcucuugggcugguuuccccugaacaccuccaagaggcugccugccuugccagc

SEQ ID NO: 166874 - RNA, 64 nt, Human
acaguugccaccaccucuguggcauugaaaugagcaccuccauuaaagucugaaucagugcacu

SEQ ID NO: 166875 - RNA, 64 nt, Human
gucucuuucuaugauaagaggguuguguugguggcaccuccacuacucuuuucuguuuguugag

SEQ ID NO: 166876 - RNA, 64 nt, Human
gcuaaauuuuguggcaucuuccucuaguccuucccaccuccagucaucagccccacucugucuu

SEQ ID NO: 166877 - RNA, 64 nt, Human
uuaagcauucagugugcccacuaaaugccagccacaccuccacuugccucuuauugucuuauuu

SEQ ID NO: 166878 - RNA, 64 nt, Human
uauugugcugggucccagccugguuugcaaagaccaccuccaacccaacccaaucccucuccac

SEQ ID NO: 166879 - RNA, 64 nt, Human
augucuaugucuccccaugagcauggaaaggagccaccuccaccccuuuccccacccauuagcc

SEQ ID NO: 166880 - RNA, 64 nt, Human
ucuguugcugaggaaaugguagaaugcugccuaucaccuccagcacaaucccagugaaaaaggu

SEQ ID NO: 166881 - RNA, 64 nt, Human
acacugcuucucagaaaugagcugcuugccuuuccaccuccagggcaugaacccugccccuuuc

SEQ ID NO: 166882 - RNA, 64 nt, Human
uccuuuuuuuaagagacggucuuuauugggucugcaccuccauccuugaucuuguuagcaaugc

SEQ ID NO: 166883 - RNA, 64 nt, Human
ugccuucucuggacuccgaguucuauaaaaaccucaccuccaucaaggugagcauggaauggug

SEQ ID NO: 166884 - RNA, 64 nt, Human
guucagauucuguggcagagauuuggaaggcacccaccuccagacugcuucccguccaaguuac

SEQ ID NO: 166885 - RNA, 64 nt, Human
ugccauucucacugacaaaauguauaucagcccccaccuccaccccccaauauuccuugaacuu

SEQ ID NO: 166886 - RNA, 64 nt, Human
cgcccccaaccacagcagagacuagcagcggggccaccuccacaaccaccaccacaagguaggu

SEQ ID NO: 166887 - RNA, 64 nt, Human
guagcccagcagcagugaagaugcagacugauaccaccuccaccgcugagcagugaccuuccuc

SEQ ID NO: 166888 - RNA, 64 nt, Human
aucucgcauaggcugccuaugaugaaggaccgugcaccuccacuccaacagagugcugaguuua

SEQ ID NO: 166889 - RNA, 64 nt, Human
gggccugaggcagauccagaggacaagccugccucaccuccagcaccuguaggaacucccggaa

SEQ ID NO: 166890 - RNA, 64 nt, Human
gcccagcacuggugucucugugcuuccuucacuucaccuccauccucugucucuggggcucauc

SEQ ID NO: 166891 - RNA, 64 nt, Human
acccccacccugggacuuuggaugcucccaucuccaccuccagugacuuuuaaagccgcuucgu

SEQ ID NO: 166892 - RNA, 64 nt, Human
uuccuagaccucauggcuguccccucccaccagucaccuccacugcacaacucgggcgggggug

SEQ ID NO: 166893 - RNA, 64 nt, Human
gaccucaacccugaaccccucccauucaacuccccaccuccagccgggacccaggcguccgggc

SEQ ID NO: 166894 - RNA, 64 nt, Human
gucuauaaauuaucagucugggugggaaagcccccaccuccauccauuuuccugcuuagggucc

SEQ ID NO: 166895 - RNA, 64 nt, Human
guccaaguggcugugacaucuacguauggcuccacaccuccaaugcugccugggagccagggug

SEQ ID NO: 166896 - RNA, 64 nt, Human
ggcuuuuuccuuugcuugaauaaacauuuuggaucaccuccaaagaaugaaaaccaguaguacg

SEQ ID NO: 166897 - RNA, 64 nt, Human
uuuaaaggugaaaucagagcagcacuaccccucccaccuccaaagcaucuguaaaaucauucua

SEQ ID NO: 166898 - RNA, 64 nt, Human
uuagcucacucugccaucuguuuuggcaagaccccaccuccacgggcucuccugggccaccccu

SEQ ID NO: 166899 - RNA, 64 nt, Human
cuugucuguuagccauguggcugccccauuuauccaccuccaucuucuuugcagccuggguggc

SEQ ID NO: 166900 - RNA, 64 nt, Human
agggcggccagggacccaaagcaggaugaccacgcaccuccacgccacugccucccccgaaugc

SEQ ID NO: 166901 - RNA, 64 nt, Human
accucacuuuuggcucacugcagcccuuguccuucaccuccacacaggaccagcuggaagcaga

SEQ ID NO: 166902 - RNA, 64 nt, Human
ucagcccugcagcuguaguacagugcugugcccucaccuccacccuuccuguuguucccacgug

SEQ ID NO: 166903 - RNA, 64 nt, Human
aauaaguuucugaauggaagcacuuccagaacuucaccuccauaucagaagugccaauaaucgu

SEQ ID NO: 166904 - RNA, 64 nt, Human
uaaauuaaguugugauuugaauguagauugguaucaccuccaacuccuagugcuuaguggucaa

SEQ ID NO: 166905 - RNA, 64 nt, Human
cccgaccucucagcgucugaaugaacagcgcucccaccuccaguccuggcauccgcugggggcg

SEQ ID NO: 166906 - RNA, 64 nt, Human
cagauccuauuacaauacuaaaaauagaaaauuucaccuccauauuccugagguguaauuucau

SEQ ID NO: 166907 - RNA, 64 nt, Human
uuuuuuuacuuuuauugggaauaaggaauguuugcaccuccacauuuuauugcuucuggaugug

SEQ ID NO: 166908 - RNA, 64 nt, Human
ccucggcucugcagccgguucuccgggcccuggucaccuccagacagcugccuggccggggcca

SEQ ID NO: 166909 - RNA, 64 nt, Human
ugugaaaagugucuuuuuggacaaacuauuuuuccaccuccaaaagaaauuaacacauggacau

SEQ ID NO: 166910 - RNA, 64 nt, Human
cgccacaaaucauccugcuuucuuuauccucucucaccuccaaguaauccugucaucuugcucc

SEQ ID NO: 166911 - RNA, 64 nt, Human
uuguucugucugcguguuuaauuuuucccucucucaccuccaccccauccauauccucuuuauu

SEQ ID NO: 166912 - RNA, 64 nt, Human
ugaccgccgggggcggcccggggccgcucggcggcaccuccacacccgccccaacgcguucucu

SEQ ID NO: 166913 - RNA, 64 nt, Human
ggggauuaguuccggagacugagacuguuggcuccaccuccaagcugagcuaggguggagggca

SEQ ID NO: 166914 - RNA, 64 nt, Human
gggcaggcacccccaggggcuuauccuggacaggcaccuccaggcgccuacccuggagcaccug

SEQ ID NO: 166915 - RNA, 64 nt, Human
gcaggugcaaaauaggaauguuguucucaagugucaccuccagcccagaggugguuccuuaggc

SEQ ID NO: 166916 - RNA, 64 nt, Human
ggaagccgguccguacguaggccuugcaucucgccaccuccacuucuguccucaagaacaaguc

SEQ ID NO: 166917 - RNA, 64 nt, Human
gacuguguccugguccauguggugcacgugucuccaccuccaaggagaggcuccucagugugca

SEQ ID NO: 166918 - RNA, 64 nt, Human
auggccugcccaugaagcccuggaauuccagcuccaccuccacuaccacuccaagccuggcccc

SEQ ID NO: 166919 - RNA, 64 nt, Human
ggaaacaaaaugagggguggcagggauaaaaagucaccuccauucucuaccucccaugcagcau

SEQ ID NO: 166920 - RNA, 64 nt, Human
uuaauugaauacaaacaagcaacagcaacaaauccaccuccaccccaucucccccucauauccc

SEQ ID NO: 166921 - RNA, 64 nt, Human
ccccuauauucagagcuccuugagaagugauaaacaccuccagcuuucuaacauccuccccaca

SEQ ID NO: 166922 - RNA, 64 nt, Human
aucuggccaaugagucugcugagacucuugacagcaccuccagcucugcugcuucaacaacagu

SEQ ID NO: 166923 - RNA, 64 nt, Human
cucagccaaucuguucugggcccugauuuugccacaccuccauccuguagcccauucucugacc

SEQ ID NO: 166924 - RNA, 64 nt, Human
cgugaaagacauugccucagcuacugaagguggccaccuccacucuaaaugacauuuuguaaau

SEQ ID NO: 166925 - RNA, 64 nt, Human
agaacaguaugggacccccucaccaggccuggaacaccuccagccacaaagaagccaaagguca

SEQ ID NO: 166926 - RNA, 64 nt, Human
guggcagcgcccaggagggcauagggcagccuaccaccuccaagggggcaggcgcccucaucug

SEQ ID NO: 166927 - RNA, 64 nt, Human
auggaagguggcugcaugccaaggggaggagcgacaccuccaggcuuccgggagcccagagagc

SEQ ID NO: 166928 - RNA, 64 nt, Human
ggcacuccgcccccacccgucggcagagcaaccccaccuccaggcauuauggcuccuccaccug

SEQ ID NO: 166929 - RNA, 64 nt, Human
uuucugcuguggugggaacuggcagggagagggucaccuccacucugguuggaugcggagcugg

SEQ ID NO: 166930 - RNA, 64 nt, Human
aacuggaacuugaaaguccuccuucuaccaacuccaccuccacccccucauuccccuucuccca

SEQ ID NO: 166931 - RNA, 64 nt, Human
ucccugcuauaguucccagcugcuguaacggagccaccuccaacucuaacaauaaaccaaguuc

SEQ ID NO: 166932 - RNA, 64 nt, Human
uguuuauaccuuugccuuggaaguugcauggcaucaccuccaccauacuccaucaguuagagcu

SEQ ID NO: 166933 - RNA, 64 nt, Human
ugucacccagggcucccgggccucaagcaguccccaccuccaagugccuggcaaccuaggcccu

SEQ ID NO: 166934 - RNA, 64 nt, Human
gaguuuugccuccuuacacaguggccuuugcuugcaccuccagcuggagaugggugugccccag

SEQ ID NO: 166935 - RNA, 64 nt, Human
aggcugcuuggagcuucccaugaacuggaaagcucaccuccacugcaucuuuuuacuggccauc

SEQ ID NO: 166936 - RNA, 64 nt, Human
cccaugggcucaaggauuccuggccagcuccugccaccuccagcagaccucagggaggguugag

SEQ ID NO: 166937 - RNA, 64 nt, Human
gcucaguuuccucaccuggaggguuggacccacucaccuccacucuagccccgaacccuccugc

SEQ ID NO: 166938 - RNA, 64 nt, Human
ggaggguggacacuggaaacuagaugacuucuuucaccuccaaaauucccuuaguuucuaugaa

SEQ ID NO: 166939 - RNA, 64 nt, Human
cccacaguggucaguccccagcccugugggcccccaccuccaucgcccagccuuuuauuacaca

SEQ ID NO: 166940 - RNA, 64 nt, Human
acccuccaccuuccauuuucccccacuacugcagcaccuccaggccuguugcuauagagccuac

SEQ ID NO: 166941 - RNA, 64 nt, Human
ggacgagccccacagcccccuccucaaaaacgaccaccuccaggacucagugaucccugggggg

SEQ ID NO: 166942 - RNA, 64 nt, Human
ccccugcagcugacccacgcuugggcaucaauggcaccuccacacagccgaagcacccggcauc

SEQ ID NO: 166943 - RNA, 64 nt, Human
cggcguuuccgcgguuggccuccuugcuuugccgcaccuccagguucugggcaugagaggccgu

SEQ ID NO: 166944 - RNA, 64 nt, Human
ccgcugcgcugccggcuucuccccaccacccugccaccuccacugugauguauguccgcucccu

SEQ ID NO: 166945 - RNA, 64 nt, Human
gcaugcuaugccaggcaugugcagucuggacuuccaccuccagugccagaaacuuccagaagga

SEQ ID NO: 166946 - RNA, 64 nt, Human
uccuuuccuucagccccucugcccugucccugcacaccuccacugccucccagcagaucugugg

SEQ ID NO: 166947 - RNA, 64 nt, Human
aauccaggagccuugagucuguguuguguccugacaccuccaaguucuagggccgucaggacac

SEQ ID NO: 166948 - RNA, 64 nt, Human
agcaaggcuuccucuccugcucaccccugucucucaccuccaccaaccccacucacuuuguaac

SEQ ID NO: 166949 - RNA, 64 nt, Human
auuucauucucuguccagcagucaugaaccccuucaccuccaaugaccugaucauuuaguuugg

SEQ ID NO: 166950 - RNA, 64 nt, Human
guccugagacccccugccagcaaagagugacagucaccuccaugcccugcccucauugcaaagc

SEQ ID NO: 166951 - RNA, 64 nt, Human
ggagaucaggagugacagaucacagggugagggccaccuccacacccacccccucuggagaagg

SEQ ID NO: 166952 - RNA, 64 nt, Human
ccccacugagcccugggcccccuccucccuuccucaccuccaccuucucccugccuucucucuu

SEQ ID NO: 166953 - RNA, 64 nt, Human
ggcagccugggccaggcccuuuuccugcaugugccaccuccagugggaaacaaaacuaaagaga

SEQ ID NO: 166954 - RNA, 64 nt, Human
ucuuuuucucuuuuuucucauguuuucuucccuccaccuccaccccuuucuuucuuucucucuc

SEQ ID NO: 166955 - RNA, 64 nt, Human
cuguugguuuagcacaaauacuucccuccuccggcaccuccaaaccuaccccacagucagugua

SEQ ID NO: 166956 - RNA, 64 nt, Human
ugagccucagcccccuccagcccacuggggcucucaccuccacauguggguagaagcuuuccug

SEQ ID NO: 166957 - RNA, 64 nt, Human
agcuaggacuagccaggacccgcagccgccucgucaccuccaguugggugccucuggguuccca

SEQ ID NO: 166958 - RNA, 64 nt, Human
agggccaggucccagcuauguagacccccgcccccaccuccaacacugcacccuucugcccugc

SEQ ID NO: 166959 - RNA, 63 nt, Human
guguuucgccccaggacuagccugcgcccccgucaccuccaccucaccugugcugccacuucc

SEQ ID NO: 166960 - RNA, 64 nt, Human
gcagagggaccccagcgccuaccaccucaacagacaccuccagcacagcuucaccaggggcuuu

SEQ ID NO: 166961 - RNA, 64 nt, Human
gaccuccugguaucugccccgggcucccucaucccaccuccauccggaguugccuaagaugcau

SEQ ID NO: 166962 - RNA, 64 nt, Human
ccuagugggcaucucuguggcuggugagaucggccaccuccacuuuugguugcagugcagagac

SEQ ID NO: 166963 - RNA, 64 nt, Human
ccuccacagagcccccuugcugggacagccagcucaccuccaaggacauccccuccuggcuucu

SEQ ID NO: 166964 - RNA, 64 nt, Human
uauugauuaaccugacuuuauagggacugaaguccaccuccagagacaaguccaaguucuugau

SEQ ID NO: 166965 - RNA, 64 nt, Human
agguucucucagcuuguucuugccuaaggcugagcaccuccagucucuccuugauuuggagcuc

SEQ ID NO: 166966 - RNA, 64 nt, Human
uacaucacugaaaugcccauuccuuccuccgucccaccuccagccgaauagaaggucugcuccc

SEQ ID NO: 166967 - RNA, 64 nt, Human
gcucucccucccccugucccccacccucauggcccaccuccaacccacuuuccucaguaucugg

SEQ ID NO: 166968 - RNA, 64 nt, Human
aaucaagcccuagacuccaaauguccucccagcucaccuccaucuaugcaucucaucucuggau

SEQ ID NO: 166969 - RNA, 64 nt, Human
uacucaugcucauaugugugcacgcuuggacacccaccuccauggacaccuagccacccuguug

SEQ ID NO: 166970 - RNA, 64 nt, Human
uguugcugucuggcuuucccgaaucuuuuuaggccaccuccaaggacucuaaaagggggcuauu

SEQ ID NO: 166971 - RNA, 64 nt, Human
cauucaccuagagaguaaguguugaagccagagccaccuccaacucuggagccuaccaagagaa

SEQ ID NO: 166972 - RNA, 64 nt, Human
ccuaugcuuccggccuccugucccucauccauagcaccuccacauaccuggcccugugccuugg

SEQ ID NO: 166973 - RNA, 64 nt, Human
gggcuuggcacccaccucuggagaaacucggggccaccuccacuccaugugcccagccccgcca

SEQ ID NO: 166974 - RNA, 64 nt, Human
aggucuuagggcaacuccuugcccuccugcucagcaccuccauuuccccauccuuggugagaua

SEQ ID NO: 166975 - RNA, 64 nt, Human
uauuaacugguuaauuauacugcagaaaccuuuucaccuccacuagucugauacaguacaucug

SEQ ID NO: 166976 - RNA, 64 nt, Human
cacgcagugcggauccgggaggaggagcgcuacccaccuccagggagcacccugcccaccaaga

SEQ ID NO: 166977 - RNA, 64 nt, Human
cugccccgcuuccuuuacagcucuucucaacccucaccuccaucccccgucacccaggcaccuu

SEQ ID NO: 166978 - RNA, 64 nt, Human
cuccuuuucugggcauagaacucgaagucauggccaccuccagggacaaagaggagcugcugug

SEQ ID NO: 166979 - RNA, 64 nt, Human
aaggccuucaccugcucuaggccagcccugucaccaccuccacugccaugaccaggccgaaggc

SEQ ID NO: 166980 - RNA, 64 nt, Human
ugaugcgcugacauucccuuagcaccagcugucccaccuccaggguccugaccaggucagagau

SEQ ID NO: 166981 - RNA, 64 nt, Human
cacugagcaggaagcgcacagcccacccuccccgcaccuccaggucucuggacuccaguuuugg

SEQ ID NO: 166982 - RNA, 64 nt, Human
aaccuuggccuccaggacaucugcacccccuccccaccuccacggaccucggaccuccaggcgg

SEQ ID NO: 166983 - RNA, 64 nt, Human
uccguguuacagcagcugccugaugaauuuuauccaccuccauuucagcauguggcucgcgugg

SEQ ID NO: 166984 - RNA, 64 nt, Human
uggcuucuuuuaaguacccccuuuccuccucacccaccuccaaacugacuagcacucagaggga

SEQ ID NO: 166985 - RNA, 64 nt, Human
cacauaucacuuuagcccuaacaagggcuccucccaccuccaccuguugccccaguugaaaagc

SEQ ID NO: 166986 - RNA, 64 nt, Human
cugaggacgccuccacgccauucgccaucccgcgcaccuccagccuagcucgggccaagcggcc

SEQ ID NO: 166987 - RNA, 64 nt, Human
acccccaagcacacacacaugguccgugccaugucaccuccauagggaaaggcuucucuccaag

SEQ ID NO: 166988 - RNA, 64 nt, Human
uccuccuaccagagugaagcccacagagucccuccaccuccacaccaggcccucucuccaguuu

SEQ ID NO: 166989 - RNA, 64 nt, Human
ugguauaacuuuucuucagaagacccaugugggacaccuccaaggcuggccuccucauaagccc

SEQ ID NO: 166990 - RNA, 59 nt, Human
agccugagaagacagacugagcagggcagcaccuccauaggaagccuuccuuucuggcc

SEQ ID NO: 166991 - RNA, 64 nt, Human
gccuacgcagacaaguguguguguggaccauccgcaccuccagcccccaccccacccucuuugu

SEQ ID NO: 166992 - RNA, 64 nt, Human
uaaagcaccugcaugcucagacuucuuguggcgccaccuccacgucugucuuguacaugacacu

SEQ ID NO: 166993 - RNA, 64 nt, Human
uauaauaauaaagagacaaaagaggccagccacccaccuccaacaccuccugugaguuucuugg

SEQ ID NO: 166994 - RNA, 64 nt, Human
ggagugagcggccgagacgcugcuccccaccccccaccuccaugccucagccuuugccuacccc

SEQ ID NO: 166995 - RNA, 64 nt, Human
auguaggggagagacugccugugcaccuaaccaacaccuccaggggcucgcuaaggagcccccc

SEQ ID NO: 166996 - RNA, 64 nt, Human
auuuuucuaaauugaaaacacgccccccuccccacaccuccaggaacuccacucccagucuuag

SEQ ID NO: 166997 - RNA, 64 nt, Human
cccuuuccuaggcccaggccuggguuuguacuuccaccuccaccacaucugccagaccuuaaua

SEQ ID NO: 166998 - RNA, 64 nt, Human
gagggccaagcuaugcccaggaaugugucagagucaccuccauaauggucaguacagagaagag

SEQ ID NO: 166999 - RNA, 64 nt, Human
cucugccuuccaccggagagacuacugaccuucucaccuccacccauaccuucuccccacagcc

SEQ ID NO: 167000 - RNA, 64 nt, Human
augcaguggugugcucugggcucacugcaaccuucaccuccagguucaagugauucuccugccu

SEQ ID NO: 167001 - RNA, 64 nt, Human
ccagaccaggacagcagccacucaguucuuccuccaccuccacccagugaucccaauaaacgaa

SEQ ID NO: 167002 - RNA, 64 nt, Human
ucugccucaaucacucugucuuuuauaaagauuccaccuccaguccucucuccuccccccuacu

SEQ ID NO: 167003 - RNA, 64 nt, Human
cugcgggggccuuggagcuccugcucuucucccgcaccuccauggaugcacugcugccgagcag

SEQ ID NO: 167004 - RNA, 64 nt, Human
uguuggcuucugaaguggucagggccauggcugacaccuccagguccgccuggcaugggacacc

SEQ ID NO: 167005 - RNA, 64 nt, Human
uguaggcauaugauggggagggggugccccuacccaccuccaagaggcuacagcccugugucug

SEQ ID NO: 167006 - RNA, 64 nt, Human
gugacucccugggcccccagauggcgagcagcaccaccuccaagccgucaucaucauccucagg

SEQ ID NO: 167007 - RNA, 64 nt, Human
agcucaugucucuucaggcugagacuggcgcugucaccuccacccagccuucuuucacuugggg

SEQ ID NO: 167008 - RNA, 64 nt, Human
ucccucauuugcacugcucuguaagccucccccucaccuccauucauaacccagucucaaugcc

SEQ ID NO: 167009 - RNA, 64 nt, Human
gaggcagggucaggccucagcaucucacauccaccaccuccaggaggggagaccacugguaagu

SEQ ID NO: 167010 - RNA, 64 nt, Human
cucuugaauagcucuaacuccaaaccucuguccacaccuccagagcaccaaguccagauuugug

SEQ ID NO: 167011 - RNA, 64 nt, Human
agcaugauggaaggacucucacuugggcacaagucaccuccaaaugaggacaacagauaccaaa

SEQ ID NO: 167012 - RNA, 64 nt, Human
ugucaaugacauuuuuauuuuugaaguacucugacaccuccacccucuacuuuauuagaauugg

SEQ ID NO: 167013 - RNA, 64 nt, Human
ugggcccccuucuuucggcuuucugcuaaagcaacaccuccagcagagauucccuuaagugacu

SEQ ID NO: 167014 - RNA, 64 nt, Human
cgaggauggccuggaacccaugucagucucucaccaccuccagcuucgaugauguggguguccu

SEQ ID NO: 167015 - RNA, 64 nt, Human
auaaucagggcaaucccaacacaugucuagcuuucaccuccaggaucuauugagugaacagaau

SEQ ID NO: 167016 - RNA, 64 nt, Human
cccucccacccaccgccacaauaaagaucgcccccaccuccacccucacccucuccuggcuccu

SEQ ID NO: 167017 - RNA, 64 nt, Human
ggcuggagugcaguggcgccaucuuggcucacugcaccuccaccuuccgggcucaagcgauucu

SEQ ID NO: 167018 - RNA, 64 nt, Human
ucccguccucggggccccugcagccacccaacgucaccuccagcccggucucacccauggucca

SEQ ID NO: 167019 - RNA, 64 nt, Human
auuccuguccucguguccccgacccccgagaggccaccuccaagccgcgggugcccccuagggc

SEQ ID NO: 167020 - RNA, 64 nt, Human
gagccagcagcuggaugcuguggcuggccagagacaccuccaggcuguggccugggggcugggg

SEQ ID NO: 167021 - RNA, 64 nt, Human
cugagaacacaggaaugauucauagcccaccccccaccuccaugcauacaccagagcucugugg

SEQ ID NO: 167022 - RNA, 64 nt, Human
gauaagagaaacaggcccggggggaccaggaugacaccuccauuucucuccaggaaguuuugag

SEQ ID NO: 167023 - RNA, 64 nt, Human
ucugagugagccccucacucagccggggcccucccaccuccaacgccccgcccacgccgcggcc

SEQ ID NO: 167024 - RNA, 64 nt, Human
ccgggccuggggcugucacuggcccugauccgaacaccuccagauuccggcuucuacaugggac

SEQ ID NO: 167025 - RNA, 64 nt, Human
ugaagagauaguuaagccaauuccauuuauagaccaccuccagccagugacgcuccgaguugag

SEQ ID NO: 167026 - RNA, 64 nt, Human
guuuuuuuuaaauaagugggucaaguacaccagccaccuccagacaccagugcgugcucccgau

SEQ ID NO: 167027 - RNA, 64 nt, Human
aaggguaugcgcgcuaaagcccagcucucgaucucaccuccauccccauccacccacacacuau

SEQ ID NO: 167028 - RNA, 64 nt, Human
auccccacuugcagcccugucuuccuaccuaucccaccuccaucccagacaggucccuccccuu

SEQ ID NO: 167029 - RNA, 64 nt, Human
aucaguggcugacucugcccgacuuccucuuuggcaccuccauucccuguugcugaaggcccuc

SEQ ID NO: 167030 - RNA, 64 nt, Human
acaucuuauccuccaccccacaucccaccacauccaccuccauccccaacccauccucaucccc

SEQ ID NO: 167031 - RNA, 64 nt, Human
cuccuggcccccgccuuccacgcccuuccgauuccaccuccaccuccaccucccccugccacag

SEQ ID NO: 167032 - RNA, 64 nt, Human
gcccccgccuuccacgcccuuccgauuccaccuccaccuccaccucccccugccacagagggga

SEQ ID NO: 167033 - RNA, 64 nt, Human
acgggagggacaaggcuucucuguccgcccuucacaccuccagccucacguucacuuaggcaca

SEQ ID NO: 167034 - RNA, 64 nt, Human
gaguuguccauuaccaaagccuggaaguucucaucaccuccagguggacugcuuggcagugcua

SEQ ID NO: 167035 - RNA, 64 nt, Human
cucaggaugacgcuaguuagcugacacagauggucaccuccauuaccaaguagagucaggauga

SEQ ID NO: 167036 - RNA, 64 nt, Human
agcccugagacuucuuucucuccuugccuccacccaccuccaaaggugcugagcucacauccac

SEQ ID NO: 167037 - RNA, 51 nt, Human
aguggcugaagaaacugugagcaccuccacugacagaggcggccccuccca

SEQ ID NO: 167038 - RNA, 64 nt, Human
ggaccccccgcacugucccaaucccacucaggcccaccuccagcuggccucacuccgcugguga

SEQ ID NO: 167039 - RNA, 64 nt, Human
aucuugaagguaacagauggaaauccguuagccacaccuccagucucauucaacacuggacagu

SEQ ID NO: 167040 - RNA, 64 nt, Human
acugucuuuuucaagacauacugguuucaugugacaccuccauggauuuuuuuccagccucuaa

SEQ ID NO: 167041 - RNA, 64 nt, Human
uggggacaggauuugccaguucacccacagaucacaccuccauccccaaagagguagcacugca

SEQ ID NO: 167042 - RNA, 64 nt, Human
ucagcagaccaggcccugucccuaccuggagccucaccuccaaggaaauucauguucuccuuaa

SEQ ID NO: 167043 - RNA, 64 nt, Human
uccucugcggggcucuccggacccccuucccccucaccuccaggcagggacagaauaaauguuu

SEQ ID NO: 167044 - RNA, 64 nt, Human
gcauguuuuaugggcguuuccaggagcgcgcgugcaccuccagacggggagcuggcgggcgggg

SEQ ID NO: 167045 - RNA, 64 nt, Human
cacccugauagcacaaucuccuuggggcccugcccaccuccaggccucucccaccucaggcccu

SEQ ID NO: 167046 - RNA, 64 nt, Human
accugccccacucaccaccucugcuaguuccagacaccuccacgcccaccugguccucucccau

SEQ ID NO: 167047 - RNA, 64 nt, Human
agucucccccgaccccgggucccagguaugcucccaccuccaccugccccacucaccaccucug

SEQ ID NO: 167048 - RNA, 64 nt, Human
gcaggcaggaaguccugugcggugucaccaugagcaccuccagcuguacuagugccauuggaau

SEQ ID NO: 167049 - RNA, 64 nt, Human
gccuacccugcugaggugggugacaggggccccccaccuccagggccuuagaaccaccgccccu

SEQ ID NO: 167050 - RNA, 64 nt, Human
gacacagaguuggaaauaacucuuaagagagacacaccuccaguaagaccuuaagacaguucug

SEQ ID NO: 167051 - RNA, 64 nt, Human
gggucuggcagcccucccgggaugggcccacauccaccuccagucccuggccaggggugagagg

SEQ ID NO: 167052 - RNA, 64 nt, Human
aaccaucaaccaccaggcagccaggccaucagcccaccuccaccucuggaggguccccagagac

SEQ ID NO: 167053 - RNA, 64 nt, Human
gcccacacgcugcguucacugccaaugcuguacucaccuccaucacccuccaacuuuggggccc

SEQ ID NO: 167054 - RNA, 64 nt, Human
aggccuccugauccaggacuggcaggauugaucccaccuccaagucuccgggccaccuucuccu

SEQ ID NO: 167055 - RNA, 64 nt, Human
gacuagagggcagagguaaaugagucccuguccccaccuccagucccucccucaccagccucac

SEQ ID NO: 167056 - RNA, 64 nt, Human
gugguagggggagggagggggaaguuaagggggucaccuccauucuggggaauuuauauuugaa

SEQ ID NO: 167057 - RNA, 64 nt, Human
cugguucccgccugguccuccagcuucaggaccccaccuccaaaggccccucugcucaaugccu

SEQ ID NO: 167058 - RNA, 64 nt, Human
uccaggaugguaccagcucccgccccucgccccccaccuccacaggugccuuaaagggcccucg

SEQ ID NO: 167059 - RNA, 64 nt, Human
ggaugaucaugaggaacaacugaccuguuuccuccaccuccacccccaccccuuaacuugggua

SEQ ID NO: 167060 - RNA, 64 nt, Human
ccggggguguccucccugcccucugcccagaggccaccuccacuccuacaaaaucaaaguauug

SEQ ID NO: 167061 - RNA, 64 nt, Human
acagccaaucagccgauuuccugagcagugaugccaccuccaagcuuguccuaggugucugcug

SEQ ID NO: 167062 - RNA, 64 nt, Human
cuggaguggcacgaucucagcucacugcagccuccaccuccaggguucaagcgauucuccugcc

SEQ ID NO: 167063 - RNA, 64 nt, Human
gggaggagaaaaucccaccuccccugaccuccaccaccuccaccaccaccaccaccaccaccac

SEQ ID NO: 167064 - RNA, 64 nt, Human
ccuucccuacggccuccucgcccugcacauuccccaccuccacauuccccuccuccaagaucuc

SEQ ID NO: 167065 - RNA, 64 nt, Human
uucucuuuuccccuuuccugucccaccauacgagcaccuccagccugaacagaagcucuuacuc

SEQ ID NO: 167066 - RNA, 64 nt, Human
cuguugauuaauuugacugcuucucguugcucgucaccuccaugccaggcacugugcuugcuaa

SEQ ID NO: 167067 - RNA, 64 nt, Human
caaugccugcaugcugcuugaauugcuccacccacaccuccaugaccaagggcgccagagugcu

SEQ ID NO: 167068 - RNA, 64 nt, Human
cuugggcacuucacagccagccuagggucuucggcaccuccaagagcugaaucucccuccaacc

SEQ ID NO: 167069 - RNA, 64 nt, Human
aggggccagccugccuccaccucccacccccuuccaccuccaucagucaugugugcagagucag

SEQ ID NO: 167070 - RNA, 64 nt, Human
gcugcuggaaggggagagguucucagcaucaggccaccuccaccccaaugccaggauagaugua

SEQ ID NO: 167071 - RNA, 64 nt, Human
gguuuucauuugccauucauguccuguaauacuucaccuccaggaacugucauggauguccaaa

SEQ ID NO: 167072 - RNA, 64 nt, Human
caacagcaacacauagccugacccuccuccacuccaccuccacccacuguccgccucugcccgc

SEQ ID NO: 167073 - RNA, 64 nt, Human
accccugcccagccuucccuuuccaaguuggugccaccuccagguagccauuggugguuuuccu

SEQ ID NO: 167074 - RNA, 64 nt, Human
agugacaucaugggacaggucaaagcauuagggccaccuccauggccccagacagacuaaagcu

SEQ ID NO: 167075 - RNA, 64 nt, Human
aucccaacucacccccaaacccccaucccuuccccaccuccagcaguauuacuuguaacgcaau

SEQ ID NO: 167076 - RNA, 64 nt, Human
cgcuuuugcaugcccgggcgaggaccgaagcacacaccuccacgcgcacgggcccuggcccccu

SEQ ID NO: 167077 - RNA, 64 nt, Human
accucagaguuaaaucccuauucuccacaccucucaccuccaccaccccucccugucccagcca

SEQ ID NO: 167078 - RNA, 64 nt, Human
ccuuccaccacccagggcuggcuuuccuauaagccaccuccaggguccaggggcuuucucucuc

SEQ ID NO: 167079 - RNA, 64 nt, Human
uccccaaccuccuuggacugcaaacaaucuaggacaccuccaccaaaccuccucuugcacuuuc

SEQ ID NO: 167080 - RNA, 64 nt, Human
gaccaggaaaaaaagugauguccccuuucccugccaccuccagccucugccagcaaugagcugu

SEQ ID NO: 167081 - RNA, 64 nt, Human
cacccagugccucaccuccagauccugcuggcaucaccuccagagcccugcaugcacuggcuga

SEQ ID NO: 167082 - RNA, 64 nt, Human
caucuccgggugucugagaaaccacccagugccucaccuccagauccugcuggcaucaccucca

SEQ ID NO: 167083 - RNA, 64 nt, Human
cuuaucccauaaagguuuguuacuucccucacuucaccuccauaagaaccuguguuuccauaag

SEQ ID NO: 167084 - RNA, 64 nt, Human
cuggguauucuuuaaaguucuggucaauguauaucaccuccacagagcugcuuacccugcacug

SEQ ID NO: 167085 - RNA, 64 nt, Human
cacccacccagcccaguucuaggucguuccccagcaccuccagguuggcccacacagguaccau

SEQ ID NO: 167086 - RNA, 64 nt, Human
aggcuggcccaacggacagacaggaccaggaucacaccuccaggcgccucugguuggacauucc

SEQ ID NO: 167087 - RNA, 64 nt, Human
ggugggcucccccgggauccccagugucucucugcaccuccacccaucccucgguucuuaacuc

SEQ ID NO: 167088 - RNA, 64 nt, Human
gugugcuccccacuguugcacucaggcacagcagcaccuccaggcugggugguuuugccacaca

SEQ ID NO: 167089 - RNA, 64 nt, Human
ucaggagcgcggcgggcgagggcccuguguggaccaccuccaccaagcucagagauuugcacca

SEQ ID NO: 167090 - RNA, 63 nt, Human
ccguggagcccugcacguagggccugaggucaucaccuccaagccagaagacgugcacccaug

SEQ ID NO: 167091 - RNA, 52 nt, Human
uugcagaaugcaccuucugaggcaccuccagcugcccccggccgggggaugc

SEQ ID NO: 167092 - RNA, 64 nt, Human
cccagcacggugauuagucccagagcucggcugccaccuccaccggacaccucagacacgcuuc

SEQ ID NO: 167093 - RNA, 64 nt, Human
ugauguggaaacaaagcaggaccagcaggcacagcaccuccagaacagugccccggaugaccag

SEQ ID NO: 167094 - RNA, 64 nt, Human
cacucugagaucucaucgcggacaccacugcccacaccuccaucccguccugcgcaggccaaca

SEQ ID NO: 167095 - RNA, 64 nt, Human
cacagguggcgcucaccuaggcugucacaggacccaccuccaugccaggcaacagagggccaca

SEQ ID NO: 167096 - RNA, 64 nt, Human
acgcaggugcugggcugucggggaggccucaggccaccuccaggaacagaacacaguuuuaagu

SEQ ID NO: 167097 - RNA, 64 nt, Human
cagugauggugggugggggcugggccuuccccgccaccuccaccccuguugugaccuguccuuc

SEQ ID NO: 167098 - RNA, 64 nt, Human
acugccccucacauuuucucaccuaaaccagcagcaccuccaucuuaacagccauaggcccaaa

SEQ ID NO: 167099 - RNA, 64 nt, Human
caaaggcaccugauacuuccccugccacccugcacaccuccaagucagggcaccacaacacgcc

SEQ ID NO: 167100 - RNA, 64 nt, Human
ggccugugaagccaaacaauaugcuccugccuugcaccuccaauagguuuuauuauuuuuuuua

SEQ ID NO: 167101 - RNA, 64 nt, Human
ccaaggggcugguaccucugcuucuugcuuugcccaccuccacucuaauucccauccauuagga

SEQ ID NO: 167102 - RNA, 64 nt, Human
ccuuucccuggccuuucccauagcuggugaaggacaccuccauccauuccacgcaguugcucaa

SEQ ID NO: 167103 - RNA, 64 nt, Human
augguggaaagcuucauguaauaugaucaggacccaccuccaguucuucugaaagugugacagu

SEQ ID NO: 167104 - RNA, 59 nt, Human
agaucucgccucugcagugaugcugccuacaccuccaccuccuuccccuucucccucag

SEQ ID NO: 167105 - RNA, 64 nt, Human
accuuugggcaaaggcccccucuaggccuugccccaccuccaucaaacgcagacacuguaguca

SEQ ID NO: 167106 - RNA, 64 nt, Human
ggcugugccucccauuuccccucaccuguacccacaccuccagaaugcccugcccugcgagugu

SEQ ID NO: 167107 - RNA, 64 nt, Human
auugggggacaguccccuccgggaugaccugauucaccuccagcccagggaauggaaucuagag

SEQ ID NO: 167108 - RNA, 64 nt, Human
gaucccugaaccccuggccagcucugaggggaggcaccuccaggcaggccaggcugccucggac

SEQ ID NO: 167109 - RNA, 64 nt, Human
gggaaagggcugugagcugcuccgccauuaaacucaccuccaccugagggcgcucugcugaucu

SEQ ID NO: 167110 - RNA, 64 nt, Human
uuugcuuccagccaaagaacaccgccaacacgcacaccuccaaccugggacaucccacgcuggg

SEQ ID NO: 167111 - RNA, 64 nt, Human
ugaaaucuaagacaccccucauaaauaucaaaaacaccuccaaagcuaacgucaggguaaaacu

SEQ ID NO: 167112 - RNA, 64 nt, Human
agcagccauggaaggagcuggcccucacaccauccaccuccacacugccuccuggccagcugcc

SEQ ID NO: 167113 - RNA, 64 nt, Human
ucuuuggucaccugaucacucaacugcuucuuaacaccuccaccagggggaaggcuggcacaag

SEQ ID NO: 167114 - RNA, 64 nt, Human
ggugucucugagacccaucuccugccuagacauccaccuccagagcaacacuggccccacagua

SEQ ID NO: 167115 - RNA, 64 nt, Human
ccaacgugcacuggcacccucagaaggcuugucucaccuccaccggcauccacacaaaaccaaa

SEQ ID NO: 167116 - RNA, 64 nt, Human
cccacguccaggcuuaagguggaugcacuucccgcaccuccagucuucuguguagcagcuuuaa

SEQ ID NO: 167117 - RNA, 64 nt, Human
ccccuggcucaaccccuaggcccggcuguggcuccaccuccagcucuccgugccuuaagggaaa

SEQ ID NO: 167118 - RNA, 64 nt, Human
gcaucugaagacucaggcagagcagcuccacaaccaccuccagccugggagauaggccuugcuu

SEQ ID NO: 167119 - RNA, 64 nt, Human
ugugauaaagugaauguacauguauauacacacacaccuccauauauacauguguguaucaguu

SEQ ID NO: 167120 - RNA, 64 nt, Human
ucuucccccuuccccugcgcccucccucccuccacaccuccacccguccuggggugguuggagg

SEQ ID NO: 167121 - RNA, 64 nt, Human
acuggcaaucuggacucgauggagaacauccccccaccuccauuuggcacuacccaaguggagu

SEQ ID NO: 167122 - RNA, 64 nt, Human
uuugccccauuuccccaguccaguggacaugccccaccuccagacuugcucaugggagaaggcu

SEQ ID NO: 167123 - RNA, 64 nt, Human
ucugcaacucuagcccuauauccagaagccugcccaccuccacccauucuguuugccccauuuc

SEQ ID NO: 167124 - RNA, 64 nt, Human
gaggcuaugagugggaugagugaugcccccacagcaccuccauguggacuuaggaagguggccu

SEQ ID NO: 167125 - RNA, 64 nt, Human
gcagucucuucccauuuucgcccaacuuaucccccaccuccaucccuuggcaaccacuaaucug

SEQ ID NO: 167126 - RNA, 64 nt, Human
cccucagugcauugccugaaacucagcaugacuucaccuccauccugguggacaugugguacca

SEQ ID NO: 167127 - RNA, 64 nt, Human
cuaagcauaugucuuaaaaggcauuuuugacuaucaccuccaagggaauagcuugagaaaccca

SEQ ID NO: 167128 - RNA, 64 nt, Human
aauucugagauccuccagaaagucgagcagcacccaccuccaaccucgggccagugucuucagg

SEQ ID NO: 167129 - RNA, 62 nt, Human
ugaacccccacaagcucugagcccugggcacccaccuccacccccgccacggccacccuccu

SEQ ID NO: 167130 - RNA, 58 nt, Human
ccgcgggccagcacugguaaccuagccggggcccgagggaagcggagauccccggcuu

SEQ ID NO: 167131 - RNA, 64 nt, Human
uaggcccugagaugugaggucugcugcuucacuggggcccgaugacuuuggcugggggaggggg

SEQ ID NO: 167132 - RNA, 64 nt, Human
agccggaugcugggcaggaucccugccuacgcccgggcccgauuugcgcuuugccggacuggau

SEQ ID NO: 167133 - RNA, 64 nt, Human
gccggcgcccgcccggcgugccggagaggagaaagggcccgacugcccgccggacccugcaccc

SEQ ID NO: 167134 - RNA, 64 nt, Human
cugauuugcugccaccagcguccccucccucagugggcccgaacucgccagccccagcuuucag

SEQ ID NO: 167135 - RNA, 64 nt, Human
gaagcccaggguggggggugucagggcaguggaggggcccgaggagccagguugcauuuauugg

SEQ ID NO: 167136 - RNA, 64 nt, Human
cuccagaccuacacaaucagaaacucuugggggagggcccgaaauaucuauguuuuaccaagcc

SEQ ID NO: 167137 - RNA, 64 nt, Human
auauacccaaaucagcccccccaguccgagggcugggcccgagguauggucggaggaggagcuc

SEQ ID NO: 167138 - RNA, 64 nt, Human
gacaggagaagugcucaaucuucaugagacaaaggggcccgauagggccagcagccacaaggcc

SEQ ID NO: 167139 - RNA, 64 nt, Human
ccgucaaauaaaaaaccacaagguucgagccgccgggcccgacaaacuccgggucggcgaaaca

SEQ ID NO: 167140 - RNA, 64 nt, Human
cugaugggcagcacagacacagacacacaccgcagggcccgacccuccugucauucacaguccc

SEQ ID NO: 167141 - RNA, 64 nt, Human
cccacccggugggacccccguggggcagggagcugggcccgacauggcuccggccucugccuuu

SEQ ID NO: 167142 - RNA, 64 nt, Human
uguccggggcagagcggaggcugggcuuggccaggggcccgaauuuccgccuggggaguguugg

SEQ ID NO: 167143 - RNA, 64 nt, Human
caggugcugcccuggcagcaccagagugugggccgggcccgagugucugccccucggcccucag

SEQ ID NO: 167144 - RNA, 64 nt, Human
gcggccacagacuggcgggccgcggaaggggguagggcccgagcuccgcgcggccgcacaaucc

SEQ ID NO: 167145 - RNA, 64 nt, Human
auuggccccacaccggacgugggaggugucuguggggcccgaggccuguccugugugcagcgga

SEQ ID NO: 167146 - RNA, 64 nt, Human
uccaguccgagguuggauauuguucaaaugagcagggcccgagcuggaagcgcaaggcagccgc

SEQ ID NO: 167147 - RNA, 64 nt, Human
ggaccucccuggaccccugcagggcaggcagcuugggcccgagcccaagcauuuggcucugcug

SEQ ID NO: 167148 - RNA, 64 nt, Human
gaccuuggccccagcucugcacucucuggaauaagggcccgaugcagcauuuucuugcccagug

SEQ ID NO: 167149 - RNA, 64 nt, Human
caaaagcuuccgucccugaggcaaaaggacacgagggcccgacugccagagggaggauggacag

SEQ ID NO: 167150 - RNA, 64 nt, Human
ccugcuccucagggcagcccggcgcggccagguagggcccgagcuucagcuuccaggaugcuuc

SEQ ID NO: 167151 - RNA, 64 nt, Human
cgaggaaagcggggugacucauuucccuuguccagggcccgaggagagugagguguccagccug

SEQ ID NO: 167152 - RNA, 64 nt, Human
cccacuuguccuguuuggagggacgcagucccuagggcccgagacugggugggagagggggagu

SEQ ID NO: 167153 - RNA, 64 nt, Human
cacagaguggacagcgcuaacuaaccugugagaggggcccgagagaaggaacagcuguggaaca

SEQ ID NO: 167154 - RNA, 64 nt, Human
gguuggguugagugagucccacaaagggcaaguggggcccgaggaagccucucuggggccaggg

SEQ ID NO: 167155 - RNA, 64 nt, Human
cggcccgccaccuuguacagaaccagcacucccagggcccgagcgcgugccuuccccgugcggc

SEQ ID NO: 167156 - RNA, 64 nt, Human
cuuauuaguauacauacuuaagaaaugguucauugggcccgaguuucuugauuuuauuuaauac

SEQ ID NO: 167157 - RNA, 64 nt, Human
aagugccuuccgugggucaucccagcaccugccagggcccgaccuggggcugagugcagaggcu

SEQ ID NO: 167158 - RNA, 64 nt, Human
cccggggcuugggagcggccggucacgcugcugugggcccgaguguguugcauguccacgcacc

SEQ ID NO: 167159 - RNA, 64 nt, Human
ccgcuguguguguugcagugugccucugccccaugggcccgagagaagcugacaauuacccaua

SEQ ID NO: 167160 - RNA, 64 nt, Human
ggccucgggccacccacgagggccucccggccuagggcccgaccgcgccggacgcgguguccgg

SEQ ID NO: 167161 - RNA, 64 nt, Human
acccccagcuuggccaacccucagccuugcgguggggcccgaagcaucuucccuuccgcuuggc

SEQ ID NO: 167162 - RNA, 64 nt, Human
gccugcggcugguggagacggggccugggcucccgggcccgaggaggaaaaggauugccaaggc

SEQ ID NO: 167163 - RNA, 64 nt, Human
uggugggcaucguuaguuggggcuauggcugcgggggcccgagcaccccaggaguauacaccaa

SEQ ID NO: 167164 - RNA, 64 nt, Human
gccccugcugccagcccuugagcagcccgugugggggcccgagggacccacacagugggggcca

SEQ ID NO: 167165 - RNA, 64 nt, Human
guuuccagagucggugggagaagggcgggagggugggcccgaguggcccagugggugggugggg

SEQ ID NO: 167166 - RNA, 64 nt, Human
gccuggaccuggguuauuuauugacacacccaaggggcccgaggggcugcgugugggaggcugg

SEQ ID NO: 167167 - RNA, 64 nt, Human
cugguuucuucuccucuaucucauaaugcauuaugggcccgaggaauaggggaggguuaauaag

SEQ ID NO: 167168 - RNA, 64 nt, Human
ccagaccuguuguucucuccauccagcgugaccagggcccgagagaccugauggccaggguggg

SEQ ID NO: 167169 - RNA, 64 nt, Human
agcagccuaggccuccagcuauaaauaguccggagggcccgagaggcucccgcccguccagcag

SEQ ID NO: 167170 - RNA, 64 nt, Human
caauccuugcuuaaugcuuuuguugacucaacaagggcccgaggccuuagguuuucuauuaagg

SEQ ID NO: 167171 - RNA, 64 nt, Human
auucucagcccuuugaaacucugcuucuccuccagggcccgauucccaaaccccauggcuuccc

SEQ ID NO: 167172 - RNA, 64 nt, Human
gaauaaaacacccccacauaacaugcauuugcaugggcccgaaccugugaaauguuacguuugu

SEQ ID NO: 167173 - RNA, 64 nt, Human
agggggugguuauuggacuccaggccugaccagggggcccgaacagggacuuguuuagagagcc

SEQ ID NO: 167174 - RNA, 64 nt, Human
ccacacccaccccauccucggucuuugcaaagaagggcccgagcuuaguuuccccaggacuggc

SEQ ID NO: 167175 - RNA, 64 nt, Human
gucaaaagcaaggcagguugguuaauuagaucuggggcccgaugaccucccuuucccacugcua

SEQ ID NO: 167176 - RNA, 64 nt, Human
cuggaagaucauggaccuggugccccugcucacugggcccgagccugaacugagccccagcggg

SEQ ID NO: 167177 - RNA, 64 nt, Human
gugauggccccugcagaggcagccugaggucaccgggcccgaccccccugggccuggggcagcc

SEQ ID NO: 167178 - RNA, 64 nt, Human
gcuccccagcccccacugugaaggggcuggccaggggcccgagcugcccccacccccggccuca

SEQ ID NO: 167179 - RNA, 64 nt, Human
aagugcugggauuacaagcgugagccacugugcugggcccgaggcccugacuucuugcuguaac

SEQ ID NO: 167180 - RNA, 64 nt, Human; identical to SEQ ID NO: 84852

SEQ ID NO: 167181 - RNA, 64 nt, Human
caccuacgugcgcagggcccuccaccgccacuaugggcccgagcucaucgaccugagggggccc

SEQ ID NO: 167182 - RNA, 64 nt, Human
gacccaccugguggccucugccccgucucaugaggggcccgagcagaagcaggauaguugcucc

SEQ ID NO: 167183 - RNA, 64 nt, Human
agguuuuaaggagcccccagcccuccucccuucugggcccgaccagcuuauacugcuccaucuu

SEQ ID NO: 167184 - RNA, 64 nt, Human
ccggagcagcggcuggauugaacgccccagauuggggcccgagauguggcccucgguuuccuuu

SEQ ID NO: 167185 - RNA, 64 nt, Human
ucacccuagguguugcuggagaacccugagggcagggcccgagccccgacacaucccuuccccc

SEQ ID NO: 167186 - RNA, 63 nt, Human
cguucacggccagcaagugagccgcuccaucaggggcccgaaacucucaagccccuuucugga

SEQ ID NO: 167187 - RNA, 64 nt, Human
cucugaccgguggcuucucgcugcgcagccuccagggcccgaggugaucccgguggugggaucc

SEQ ID NO: 167188 - RNA, 64 nt, Human
gcucacgccaggagggacuuggaguggcgagcuggggcccgauggggcuugggggcagaguaga

SEQ ID NO: 167189 - RNA, 64 nt, Human
gcuuagagaugaaugcccaggagcugaggauaaagggcccgaucuuucuuugggcaagguuaag

SEQ ID NO: 167190 - RNA, 64 nt, Human
guuccugcuggccugccugcacgggggugcgggcgggcccgagccccugucccacuucgaagug

SEQ ID NO: 167191 - RNA, 64 nt, Human
ugaaagagucggggcuggauggccgggggcuucugggcccgacgccuagugcagccccuggggu

SEQ ID NO: 167192 - RNA, 64 nt, Human
cgcacagcccccugggcacccggcauggggccuggggcccgauccgaggcccugggcugggggg

SEQ ID NO: 167193 - RNA, 64 nt, Human
caucaagaugcccucccuuggcaucggagugucagggcccgaggucaaggugcccaagggaccu

SEQ ID NO: 167194 - RNA, 64 nt, Human
cgagacggcagcacagaccccuggagguccaggggggcccgaggcaggguccaaaccugaguga

SEQ ID NO: 167195 - RNA, 64 nt, Human
uacuuaagucggggguggcaagggggcggggcgggggcccgaaagcugagacccucgccacggg

SEQ ID NO: 167196 - RNA, 64 nt, Human
uaaacaguuugccagauucaaguccgugugauuugggcccgagcugggugucccagggcaagcc

SEQ ID NO: 167197 - RNA, 64 nt, Human
ggaccagucccagagcaggaaugggaaggaugaagggcccgagaacauggccuaagggccacau

SEQ ID NO: 167198 - RNA, 64 nt, Human
accaucuacuccugagaaccaggaccugccacccgggcccgagcgcgcccggcccgcggcuccg

SEQ ID NO: 167199 - RNA, 64 nt, Human
ggucugaccgaugugucucccagaacuauucugggggcccgacaggugggccugggaggaagau

SEQ ID NO: 167200 - RNA, 64 nt, Human
ccucuggggguuguugggaggagggggcccggcugggcccgagggucccaaggcgugcaggggc

SEQ ID NO: 167201 - RNA, 64 nt, Human
uaugcuguauggagagugggcagacuucuguggagggcccgauaguaaccauuugaagcuuucu

SEQ ID NO: 167202 - RNA, 64 nt, Human
agagugggcaaagacagcaagagagcugcagccugggcccgagcucagaaacagcugucgccuc

SEQ ID NO: 167203 - RNA, 64 nt, Human
gggccauguugcacaaggccugagagacgggaaagggcccgaucgcucuuucccgccucucacu

SEQ ID NO: 167204 - RNA, 64 nt, Human
caaagcccagagccugccugucagcccagcuggagggcccgaggcugcaggguguccucccaca

SEQ ID NO: 167205 - RNA, 64 nt, Human
cucggggaggaccccucagcuuugcucucagcaggggcccgacaagcucagugggcaguggcag

SEQ ID NO: 167206 - RNA, 64 nt, Human
ggcaugugcauuaugggugccagguggccagugagggcccgaggaccacgcagcagaguccccc

SEQ ID NO: 167207 - RNA, 64 nt, Human
aagauguguacagcuggucuuuacuccaucggcagggcccgagcccagggaccagugacuuggc

SEQ ID NO: 167208 - RNA, 64 nt, Human
uggcaggagcugcgacugccacguaguggugccugggcccgacagcggggcucugggcaucccg

SEQ ID NO: 167209 - RNA, 64 nt, Human
cccucccaggcgaucuugugucuacucuaggacugggcccgagggugguuuaccugcaccguug

SEQ ID NO: 167210 - RNA, 64 nt, Human
ggggccgugucccaacuccgaacccagcggggcggggcccgagcgucgggcgaggccgggaccc

SEQ ID NO: 167211 - RNA, 64 nt, Human
ccugggguuucuuuucuguucuuuucggaggagagggcccgagaaggggccauaccagggcgcg

SEQ ID NO: 167212 - RNA, 64 nt, Human
caguuucccccaaaugagcaaaggggauaaagaggggcccgacuuuugccacccuccugaggaa

SEQ ID NO: 167213 - RNA, 64 nt, Human
cccuucuacucuagagaaguggacuggaggagcugggcccgauuugguaguugaggaaagcaca

SEQ ID NO: 167214 - RNA, 58 nt, Human; identical to SEQ ID NO: 167130

SEQ ID NO: 167215 - RNA, 64 nt, Human; identical to SEQ ID NO: 167131

SEQ ID NO: 167216 - RNA, 64 nt, Human; identical to SEQ ID NO: 167132

SEQ ID NO: 167217 - RNA, 64 nt, Human; identical to SEQ ID NO: 167133

SEQ ID NO: 167218 - RNA, 64 nt, Human; identical to SEQ ID NO: 167134

SEQ ID NO: 167219 - RNA, 64 nt, Human; identical to SEQ ID NO: 167135

SEQ ID NO: 167220 - RNA, 64 nt, Human; identical to SEQ ID NO: 167136

SEQ ID NO: 167221 - RNA, 64 nt, Human; identical to SEQ ID NO: 167137

SEQ ID NO: 167222 - RNA, 64 nt, Human; identical to SEQ ID NO: 167138

SEQ ID NO: 167223 - RNA, 64 nt, Human; identical to SEQ ID NO: 167139

SEQ ID NO: 167224 - RNA, 64 nt, Human; identical to SEQ ID NO: 167140

SEQ ID NO: 167225 - RNA, 64 nt, Human; identical to SEQ ID NO: 167141

SEQ ID NO: 167226 - RNA, 64 nt, Human; identical to SEQ ID NO: 167142

SEQ ID NO: 167227 - RNA, 64 nt, Human; identical to SEQ ID NO: 167143

SEQ ID NO: 167228 - RNA, 64 nt, Human; identical to SEQ ID NO: 167144

SEQ ID NO: 167229 - RNA, 64 nt, Human; identical to SEQ ID NO: 167145

SEQ ID NO: 167230 - RNA, 64 nt, Human; identical to SEQ ID NO: 167146

SEQ ID NO: 167231 - RNA, 64 nt, Human; identical to SEQ ID NO: 167147

SEQ ID NO: 167232 - RNA, 64 nt, Human; identical to SEQ ID NO: 167148

SEQ ID NO: 167233 - RNA, 64 nt, Human; identical to SEQ ID NO: 167149

SEQ ID NO: 167234 - RNA, 64 nt, Human; identical to SEQ ID NO: 167150

SEQ ID NO: 167235 - RNA, 64 nt, Human; identical to SEQ ID NO: 167151

SEQ ID NO: 167236 - RNA, 64 nt, Human; identical to SEQ ID NO: 167152

SEQ ID NO: 167237 - RNA, 64 nt, Human; identical to SEQ ID NO: 167153

SEQ ID NO: 167238 - RNA, 64 nt, Human; identical to SEQ ID NO: 167154

SEQ ID NO: 167239 - RNA, 64 nt, Human; identical to SEQ ID NO: 167155

SEQ ID NO: 167240 - RNA, 64 nt, Human; identical to SEQ ID NO: 167156

SEQ ID NO: 167241 - RNA, 64 nt, Human; identical to SEQ ID NO: 167157

SEQ ID NO: 167242 - RNA, 64 nt, Human; identical to SEQ ID NO: 167158

SEQ ID NO: 167243 - RNA, 64 nt, Human; identical to SEQ ID NO: 84827

SEQ ID NO: 167244 - RNA, 64 nt, Human; identical to SEQ ID NO: 167159

SEQ ID NO: 167245 - RNA, 64 nt, Human; identical to SEQ ID NO: 167160

SEQ ID NO: 167246 - RNA, 64 nt, Human; identical to SEQ ID NO: 167161

SEQ ID NO: 167247 - RNA, 64 nt, Human; identical to SEQ ID NO: 167162

SEQ ID NO: 167248 - RNA, 64 nt, Human; identical to SEQ ID NO: 167163

SEQ ID NO: 167249 - RNA, 64 nt, Human; identical to SEQ ID NO: 167164

SEQ ID NO: 167250 - RNA, 64 nt, Human; identical to SEQ ID NO: 167165

SEQ ID NO: 167251 - RNA, 64 nt, Human; identical to SEQ ID NO: 167166

SEQ ID NO: 167252 - RNA, 64 nt, Human; identical to SEQ ID NO: 167167

SEQ ID NO: 167253 - RNA, 64 nt, Human; identical to SEQ ID NO: 167168

SEQ ID NO: 167254 - RNA, 64 nt, Human; identical to SEQ ID NO: 167169

SEQ ID NO: 167255 - RNA, 64 nt, Human; identical to SEQ ID NO: 167170

SEQ ID NO: 167256 - RNA, 64 nt, Human; identical to SEQ ID NO: 167171

SEQ ID NO: 167257 - RNA, 64 nt, Human; identical to SEQ ID NO: 167172

SEQ ID NO: 167258 - RNA, 64 nt, Human; identical to SEQ ID NO: 167173

SEQ ID NO: 167259 - RNA, 64 nt, Human; identical to SEQ ID NO: 167174

SEQ ID NO: 167260 - RNA, 64 nt, Human; identical to SEQ ID NO: 167175

SEQ ID NO: 167261 - RNA, 64 nt, Human; identical to SEQ ID NO: 167176

SEQ ID NO: 167262 - RNA, 64 nt, Human; identical to SEQ ID NO: 84828

SEQ ID NO: 167263 - RNA, 64 nt, Human; identical to SEQ ID NO: 167177

SEQ ID NO: 167264 - RNA, 64 nt, Human; identical to SEQ ID NO: 167178

SEQ ID NO: 167265 - RNA, 64 nt, Human; identical to SEQ ID NO: 167179

SEQ ID NO: 167266 - RNA, 64 nt, Human; identical to SEQ ID NO: 167181

SEQ ID NO: 167267 - RNA, 64 nt, Human; identical to SEQ ID NO: 167182

SEQ ID NO: 167268 - RNA, 64 nt, Human; identical to SEQ ID NO: 167183

SEQ ID NO: 167269 - RNA, 64 nt, Human; identical to SEQ ID NO: 167184

SEQ ID NO: 167270 - RNA, 64 nt, Human; identical to SEQ ID NO: 167185

SEQ ID NO: 167271 - RNA, 63 nt, Human; identical to SEQ ID NO: 167186

SEQ ID NO: 167272 - RNA, 64 nt, Human; identical to SEQ ID NO: 167187

SEQ ID NO: 167273 - RNA, 64 nt, Human; identical to SEQ ID NO: 167188

SEQ ID NO: 167274 - RNA, 64 nt, Human; identical to SEQ ID NO: 167189

SEQ ID NO: 167275 - RNA, 64 nt, Human; identical to SEQ ID NO: 167190

SEQ ID NO: 167276 - RNA, 64 nt, Human; identical to SEQ ID NO: 167191

SEQ ID NO: 167277 - RNA, 64 nt, Human; identical to SEQ ID NO: 167192

SEQ ID NO: 167278 - RNA, 64 nt, Human; identical to SEQ ID NO: 167193

SEQ ID NO: 167279 - RNA, 64 nt, Human; identical to SEQ ID NO: 167194

SEQ ID NO: 167280 - RNA, 64 nt, Human; identical to SEQ ID NO: 167195

SEQ ID NO: 167281 - RNA, 64 nt, Human; identical to SEQ ID NO: 167196

SEQ ID NO: 167282 - RNA, 64 nt, Human; identical to SEQ ID NO: 167197

SEQ ID NO: 167283 - RNA, 64 nt, Human; identical to SEQ ID NO: 167198

SEQ ID NO: 167284 - RNA, 64 nt, Human; identical to SEQ ID NO: 167199

SEQ ID NO: 167285 - RNA, 64 nt, Human; identical to SEQ ID NO: 167200

SEQ ID NO: 167286 - RNA, 64 nt, Human; identical to SEQ ID NO: 167201

SEQ ID NO: 167287 - RNA, 64 nt, Human; identical to SEQ ID NO: 167202

SEQ ID NO: 167288 - RNA, 64 nt, Human; identical to SEQ ID NO: 167203

SEQ ID NO: 167289 - RNA, 64 nt, Human; identical to SEQ ID NO: 167204

SEQ ID NO: 167290 - RNA, 64 nt, Human; identical to SEQ ID NO: 167205

SEQ ID NO: 167291 - RNA, 64 nt, Human; identical to SEQ ID NO: 167206

SEQ ID NO: 167292 - RNA, 64 nt, Human; identical to SEQ ID NO: 167207

SEQ ID NO: 167293 - RNA, 64 nt, Human; identical to SEQ ID NO: 167208

SEQ ID NO: 167294 - RNA, 64 nt, Human; identical to SEQ ID NO: 167209

SEQ ID NO: 167295 - RNA, 64 nt, Human; identical to SEQ ID NO: 167210

SEQ ID NO: 167296 - RNA, 64 nt, Human; identical to SEQ ID NO: 167211

SEQ ID NO: 167297 - RNA, 64 nt, Human; identical to SEQ ID NO: 167212

SEQ ID NO: 167298 - RNA, 64 nt, Human; identical to SEQ ID NO: 167213

SEQ ID NO: 167299 - RNA, 64 nt, Human
cuggccacuguuuaggcacccagacauaauuuauggacgaaaugccuaaaaaugugccaggcau

SEQ ID NO: 167300 - RNA, 64 nt, Human
aucuuccagcucagcuccacacaaagcugcagaaggacgaaaugaaaagcauuuggaaguuuag

SEQ ID NO: 167301 - RNA, 64 nt, Human
agauggauuuaaaccaagaugccuccaggaaagaggacgaaaugaguauauucacagaggaauc

SEQ ID NO: 167302 - RNA, 64 nt, Human
aaaaauaagauccauucucuauucccaguauaagggacgaaacugcgaacuccuuaaagcucua

SEQ ID NO: 167303 - RNA, 64 nt, Human
uguccaagccugcuggaaacugggauguagcuggggacgaaaggacagacccaagcguucuccc

SEQ ID NO: 167304 - RNA, 64 nt, Human
ccucgcccacccuggcaaggacagcugcggccaaggacgaaagcccucccuuggcuggccucac

SEQ ID NO: 167305 - RNA, 64 nt, Human
cuuuaaauguucgucuauacccuaaguaaaaugaggacgaaagacaaauauuuugaaagccuag

SEQ ID NO: 167306 - RNA, 64 nt, Human
uucauauuugccaagucuucuguaaagaugucuaggacgaaauauuuuaugugcuaaugcaugu

SEQ ID NO: 167307 - RNA, 64 nt, Human
aaaccauauccuguaauuuaauaaaaaaaacuaaggacgaaaaaacccuccaauuuucccaaau

SEQ ID NO: 167308 - RNA, 64 nt, Human
uuaccauauguugugucuaaucuccuucugagaaggacgaaaaacuuucuuccaagugaagauc

SEQ ID NO: 167309 - RNA, 64 nt, Human
aagcauggagaguggcaucuucuuugcauccuaaggacgaaaaacacagugcacucagagcugc

SEQ ID NO: 167310 - RNA, 64 nt, Human
uuagggucucuaauugcaaagugacuguacaauaggacgaaaguugccucugugucugagaaag

SEQ ID NO: 167311 - RNA, 64 nt, Human
gcugugacucucucucuaaugcugcucucgggaaggacgaaagugaccugcaaggagagaaaug

SEQ ID NO: 167312 - RNA, 64 nt, Human
aggccaggggaaugaauucaagagagauguccacggacgaaacauacggugaauaauucacgcu

SEQ ID NO: 167313 - RNA, 64 nt, Human
gcgugggggcacaccugggccucccggaagcuguggacgaaagggagagcggguccuccagggc

SEQ ID NO: 167314 - RNA, 64 nt, Human
gccaugacuuuuagauaugagaugacgggaagcaggacgaaauaucggcguguggcuggagccu

SEQ ID NO: 167315 - RNA, 64 nt, Human
uccucagagcgccaggaagccagagccccaagcaggacgaaaaagaggcauacacacagcagug

SEQ ID NO: 167316 - RNA, 64 nt, Human
gacguauagucaucuaccaccugcgguccuggccggacgaaacacacguguugcaucucaagga

SEQ ID NO: 167317 - RNA, 60 nt, Human
gguucguguccgccaugugagccagcguagggacgaaaacucauagacacaucggcuguu

SEQ ID NO: 167318 - RNA, 64 nt, Human
auuaacauucaucuaaaaauguuaggcucuaaauggacgaaaaauucucucgccaucuuaauaa

SEQ ID NO: 167319 - RNA, 64 nt, Human
ccauccaagggcaagacuuggugcccagcuggaaggacgaaagcacacuuugugaccgccaucc

SEQ ID NO: 167320 - RNA, 64 nt, Human
ugaaguauuuacaguggacucaacgcagaagaauggacgaaaugaccauccaacgugauuaagg

SEQ ID NO: 167321 - RNA, 64 nt, Human
gcuaauaaacacauuuguaaauacauuguuugcaggacgaaaacuucugaguuacagcucagga

SEQ ID NO: 167322 - RNA, 64 nt, Human
augcagagagcccacccgugcagagggcagaagaggacgaaaugccuuugggugggcagggcau

SEQ ID NO: 167323 - RNA, 64 nt, Human
uagagaagagccuggagcucaaguuugacguccuggacgaaaaccagagcaagcucagcgagga

SEQ ID NO: 167324 - RNA, 62 nt, Human
acugcgaaccucacuucuagacuuucacggugggacgaaacggguucagaaacugccagggg

SEQ ID NO: 167325 - RNA, 64 nt, Human
ccccguacauacacacagcugcuuuuguggagguggacgaaaggcuguggccggcagacgugga

SEQ ID NO: 167326 - RNA, 64 nt, Human
gucuuaaauuuacgaugaauuucuugugagcagaggacgaaacaggugaauucucaccagacuc

SEQ ID NO: 167327 - RNA, 64 nt, Human
agacaacaccucagaccaucugaaccccaucaguggacgaaaauggggcuguuaauauacucua

SEQ ID NO: 167328 - RNA, 64 nt, Human
agacuaagauaaccaagaugaacauaaugucaaaggacgaaaucauggggacaauuuggauuuu

SEQ ID NO: 167329 - RNA, 64 nt, Human
aguccagcugggugcaggaggacuucaaguguguggacgaaagaaagacugauggcucaaaggg

SEQ ID NO: 167330 - RNA, 64 nt, Human
caagguguuuccccagcauaggcgcagacaguugggacgaaacuucagagcccaggcagucccu

SEQ ID NO: 167331 - RNA, 64 nt, Human
gugauuugguaccauuucacaccagcaggugucuggacgaaaacaucaaugugaauaagggcca

SEQ ID NO: 167332 - RNA, 59 nt, Human
ggcguuuguaguugugucuuuuaagaagugagugugauuguuuacuugauaaaucagcu

SEQ ID NO: 167333 - RNA, 59 nt, Human
aaaauuaagucauugaugcugcuguuacagagugugacagaggauccaugucugugaca

SEQ ID NO: 167334 - RNA, 59 nt, Human
aagacaaaaaucccaccuugggcagagcugagugugagaagauggaaaaccaguaucug

SEQ ID NO: 167335 - RNA, 59 nt, Human
gagacuucuucccuucaggcuuauuguuugagugugaaguuccagagcaaggagccaug

SEQ ID NO: 167336 - RNA, 59 nt, Human
gaugauccauuggaguguggauggcuaaugagugugagguaucacuuaagggaguuggu

SEQ ID NO: 167337 - RNA, 59 nt, Human
gggcuauuccgcagcuugcagcaagcacagagugugaccucccaggauuugcugacagc

SEQ ID NO: 167338 - RNA, 59 nt, Human
ggcugcagggacaaacaucguuggggggugagugugaaaggugcugauggcccucaucu

SEQ ID NO: 167339 - RNA, 59 nt, Human
gagugcucuguggacccacagccuaagcugagugugaccccagaagccacgaugugcuc

SEQ ID NO: 167340 - RNA, 59 nt, Human
ccgaggagaaugccagccagggcccgggagagugugagguuucaggaaaguauugagau

SEQ ID NO: 167341 - RNA, 59 nt, Human
aaaaauacuaguuaaaaugccacaagcaugagugugauuguaugugcacuguguguaua

SEQ ID NO: 167342 - RNA, 59 nt, Human
gccuuggacuugaauccaugcaauguuuagagugugaagucaguuacuuguugauguuu

SEQ ID NO: 167343 - RNA, 59 nt, Human
aucuguggacuugagcguccaaaaacccugagugugauucugggcagccggccuggcuu

SEQ ID NO: 167344 - RNA, 59 nt, Human
gccugggacccucagggucuuagguuggggagugugaauaggaguuugcagauggagaa

SEQ ID NO: 167345 - RNA, 59 nt, Human
uuugaccugaauguguuccugccccccaggagugugaccagguacauguggaagaugug

SEQ ID NO: 167346 - RNA, 59 nt, Human
ugugagugugagagugauaaugcaggggugagugugagagggacugcguuugcauuuuu

SEQ ID NO: 167347 - RNA, 59 nt, Human
gagggugggcaugagucuugccagaaugugagugugagagugauaaugcaggggugagu

SEQ ID NO: 167348 - RNA, 59 nt, Human
ccccaguggggaggugacuguguuucccagagugugagccgcucuccucccccuaaaaa

SEQ ID NO: 167349 - RNA, 59 nt, Human
caucugcaaagagccauguauucaacaucgagugugaaaagaucuauuggaaaacaaca

SEQ ID NO: 167350 - RNA, 59 nt, Human
ucuuuuugauacuggaggaacacuugauggagugugagccaccuaagaucucgguuugc

SEQ ID NO: 167351 - RNA, 59 nt, Human
cuccuggggcugucacauuuuauaggucagagugugacuucuuaauauggugcugaugu

SEQ ID NO: 167352 - RNA, 59 nt, Human
gagagcaggguugggggagaggcugaggagagugugacauguggggagaggaccagcug

SEQ ID NO: 167353 - RNA, 59 nt, Human
aagaggaggggugucuagggggacuggcagagugugagagggaccgugagggggcucuu

SEQ ID NO: 167354 - RNA, 59 nt, Human
aauacacucccccuauaaaggggaagggggagugugacacuuucuuuccauguucaagu

SEQ ID NO: 167355 - RNA, 59 nt, Human
guaauugccaaagcugcucuagccuugaggagugugagaaucaaaacucuccuacacuu

SEQ ID NO: 167356 - RNA, 59 nt, Human
uuuaagaacugaggaaccugagacucagagagugugagcuacuggcccaagauuauuca

SEQ ID NO: 167357 - RNA, 59 nt, Human
ccccuccccccaccccacaacaguccccagagugugauguuccccuuccuguguccaug

SEQ ID NO: 167358 - RNA, 59 nt, Human
cuauauuuaugggaaccccuucauccucugagugugaccaggcauccuccacaauagca

SEQ ID NO: 167359 - RNA, 59 nt, Human
agcaucagccuucuagaaucggagcuccggagugugaagauucaguauugauaugauau

SEQ ID NO: 167360 - RNA, 59 nt, Human
acacugugccuuguguuuggggcuugauagagugugaaagguguguugcuugaaaggug

SEQ ID NO: 167361 - RNA, 59 nt, Human
ccgcgguagaucauuuuuaucccgccagggagugugaugcaggaagaccacaugcgcuc

SEQ ID NO: 167362 - RNA, 59 nt, Human
uaaauucugaggccacagagaaaugcauugagugugaauguugucaucuguaaucccuc

SEQ ID NO: 167363 - RNA, 59 nt, Human
cugagcaaagcugggaauccugcagaaaagagugugaggagccagggaaaggcagaacc

SEQ ID NO: 167364 - RNA, 59 nt, Human
acagagcuccuggcccuggccagaagcaggagugugaggaggagacagccucagcggac

SEQ ID NO: 167365 - RNA, 59 nt, Human
uguacaggaauuugagcaaaaaauguauagagugugauguccaauugguauucagcacu

SEQ ID NO: 167366 - RNA, 59 nt, Human
ucugugcuguuacaguuuucuucaucaaugagugugauccaguuuuucauaagauauuu

SEQ ID NO: 167367 - RNA, 59 nt, Human
cucacccagcaucucuuuuaccaaccagagagugugaaacuaguuucauauauuaccua

SEQ ID NO: 167368 - RNA, 59 nt, Human
ucuuauucccuuuaagaauguuuauguaugagugugaagaugcuagcgaaccuaugcuc

SEQ ID NO: 167369 - RNA, 59 nt, Human
guggggaugggcuccugcagccuggggaggagugugacgacgguaacagcgaugugggu

SEQ ID NO: 167370 - RNA, 59 nt, Human
cagcaggcagcgccaagugcgugccgugugagugugacagggccaguggggccugugga

SEQ ID NO: 167371 - RNA, 59 nt, Human
cccaucccccgaccccaccacaguccccagagugugauauuccccuuccuguguccacg

SEQ ID NO: 167372 - RNA, 59 nt, Human
gcaggcuuuaaaugucaccugcuaccuuagagugugaaggugaugguaacugccacagc

SEQ ID NO: 167373 - RNA, 59 nt, Human
guaugugaaggaggcagugcugacuccgugagugugagacacgugcuuugaacugcuuu

SEQ ID NO: 167374 - RNA, 59 nt, Human
acagauuucuaggcccucaggguuuuguagagugugagcccuggugggcaggguugggg

SEQ ID NO: 167375 - RNA, 59 nt, Human
cauuucucaaaggaagcaggggauucagugagugugaaggugaacaggauggccuggca

SEQ ID NO: 167376 - RNA, 59 nt, Human
caaaaaucaguauuguuauuuuuuuccaagagugugaaggaaaauggggcauuccuuuc

SEQ ID NO: 167377 - RNA, 59 nt, Human
ugaauauacacacacacacacacacaggugagugugaauacuuccuuguuggcugaucc

SEQ ID NO: 167378 - RNA, 59 nt, Human
auauuccucuaaaacucucaagcagacgugagugugacuuuuugaaaaaaguauaggau

SEQ ID NO: 167379 - RNA, 59 nt, Human
cuguccuucaguuuguauaaaccuaaggagagugugaaauccagcaacugaauuguggu

SEQ ID NO: 167380 - RNA, 59 nt, Human
agcuuucuuccuggauuccucacuuugaagagugugaggaaaaccuauguuugccgcuu

SEQ ID NO: 167381 - RNA, 59 nt, Human
uaaaaauaugcuaaagauaggauaaaagugagugugagaucacccagggaagcaguaaa

SEQ ID NO: 167382 - RNA, 59 nt, Human
aaagcaagaggaggcgaguuaauuuggaugagugugauuuugcugauugaaugugaguu

SEQ ID NO: 167383 - RNA, 59 nt, Human
agaacugacacuagcuagauuuguauucagagugugagagcaagcucuacagauagacc

SEQ ID NO: 167384 - RNA, 59 nt, Human
gcccucaagagcaaaguagaucaugcauagagugugauguauguguaauaaauauguuu

SEQ ID NO: 167385 - RNA, 59 nt, Human
uguuuuacuccaaaagagagagagagagugagugugagugugugugugugugugugugu

SEQ ID NO: 167386 - RNA, 59 nt, Human
uauguauguauuuauuuauuuauugccuggagugugaacuguauuuauuuuagcagagg

SEQ ID NO: 167387 - RNA, 59 nt, Human
ccagagcagacccuuccuauggcggcccugagugugaguaucccugccaccaagagagc

SEQ ID NO: 167388 - RNA, 59 nt, Human
ucacagagcaacggagcaaaggcuuucgggagugugaggcugcaucugcuggagcaaag

SEQ ID NO: 167389 - RNA, 59 nt, Human
uccuccuaaaugcaggcacuugcuaggaagagugugagcuggcgucuucuguucacccu

SEQ ID NO: 167390 - RNA, 59 nt, Human
uaauucggagaugccuuucccagccaugggagugugaagugcuaggaugaaccuggcca

SEQ ID NO: 167391 - RNA, 59 nt, Human
auaaaaucuacuccaaauuauuuucaagagagugugacucaucaggcagcccaaaaguu

SEQ ID NO: 167392 - RNA, 59 nt, Human
ucuagaucaaccugggaacagucacaagggagugugacuucuuggccauaauaaacuca

SEQ ID NO: 167393 - RNA, 59 nt, Human
cagcaggauugcagaucauuugaggaucagagugugaaaacgaguuucucuuuuacaga

SEQ ID NO: 167394 - RNA, 59 nt, Human
caguguuguagguugagcgaaugcuaccagagugugagagaccauugucucguuggcug

SEQ ID NO: 167395 - RNA, 59 nt, Human
gagugguuuguggcugugugugugacugugagugugagugacagauacauaguuucauu

SEQ ID NO: 167396 - RNA, 59 nt, Human
gccacuggauuucccucacuggcucucaggagugugaccagaguagacuuggggcaugg

SEQ ID NO: 167397 - RNA, 59 nt, Human
gaggucucgggcagcacgugagguagaacgagugugagcgucuccacgcaguggcuggc

SEQ ID NO: 167398 - RNA, 59 nt, Human
guacguauguggcauuuccagguaugacugagugugagagacaugucagaggcucuuca

SEQ ID NO: 167399 - RNA, 59 nt, Human
ccuggcaaccauucaggcacaugaagguggagugugaccuugaugugaccgggauccca

SEQ ID NO: 167400 - RNA, 59 nt, Human
ggauuuuuuugacuucuacuuuacuggcugagugugagccgccaugccuggccauaauc

SEQ ID NO: 167401 - RNA, 59 nt, Human
auuggucuuaagugcaagagcacaaaugagagugugagagaaaguaccuucuauuuuaa

SEQ ID NO: 167402 - RNA, 59 nt, Human
aaagguguguguauagguguguguuuggagagugugagcgagaacuaacaugguaaaau

SEQ ID NO: 167403 - RNA, 59 nt, Human
uguuuauuuuauggggacuaagggauuaggagugugaacuaaaagguaacauuuuccac

SEQ ID NO: 167404 - RNA, 59 nt, Human
cccugaggcccuguguguuaucugugauggagugugaauguguaacgggcacuguguua

SEQ ID NO: 167405 - RNA, 59 nt, Human
auacaagugggaaaccuuagaaaugcacugagugugagagagcuuucuacuaaugcuca

SEQ ID NO: 167406 - RNA, 59 nt, Human
uauugguucaaaguaugcauauaagcauugagugugaggaauuugcuauuucacuuuaa

SEQ ID NO: 167407 - RNA, 59 nt, Human
gucuggaucaguaaaauuauacugugugugagugugaauauaaauguguguaugugugu

SEQ ID NO: 167408 - RNA, 59 nt, Human
gacuguuuuucggacaguuuauuuguugagagugugaccaaaaguuacauguuugcacc

SEQ ID NO: 167409 - RNA, 59 nt, Human
uuaauacuucccuaggauauccuguguuugagugugaaguuaauaucacacaaagcaug

SEQ ID NO: 167410 - RNA, 59 nt, Human
auuauuaagucuaacaaguccaaaagcuggagugugaggcaggaggcuggaaacccagg

SEQ ID NO: 167411 - RNA, 59 nt, Human
gcgagugugugugagaauggcuguguggugagugugaacuuuguucugugaucauagaa

SEQ ID NO: 167412 - RNA, 59 nt, Human
acgcuuccucaagcccagccuucuacagagagugugaacgguacagccccggccugacc

SEQ ID NO: 167413 - RNA, 59 nt, Human
guuuaaacuaccucaaaacacuuucccaugagugugauccacauuguuaggugcugacc

SEQ ID NO: 167414 - RNA, 59 nt, Human
gucgggagcagggagccaccuucaccugcgagugugaaguugguuacgggggaggccug

SEQ ID NO: 167415 - RNA, 59 nt, Human
acaaaaccuggcacaauggcuaauucccagagugugaaacuuccuaaguauaaaugguu

SEQ ID NO: 167416 - RNA, 59 nt, Human
augccaccaacucuggcuuaguuaagugagagugugaacuguguggcaagagagccuca

SEQ ID NO: 167417 - RNA, 59 nt, Human
uguguguauacuuauguguguguaugugugagugugaauauauguauauguguacauau

SEQ ID NO: 167418 - RNA, 59 nt, Human
acagaguuuugcucuuguugcccaggcuggagugugauggcucgaucuuggcucaccac

SEQ ID NO: 167419 - RNA, 59 nt, Human
cgucgccccuccuguuggguaaggguguugagugugacuugugcugaaaaccugguuca

SEQ ID NO: 167420 - RNA, 59 nt, Human
uaggugcucaaguguuucuguucgggacugagugugaaucuguaaaaggggaaaauccu

SEQ ID NO: 167421 - RNA, 59 nt, Human
cuguuuuugauaagaauaagaaagggagugagugugaagauggugguuagcaguuucac

SEQ ID NO: 167422 - RNA, 59 nt, Human
uugaugggugcguucccgcagaccaaagagagugugacucccuugccagcuccagagug

SEQ ID NO: 167423 - RNA, 59 nt, Human
auuucagacucaaugcucugaucucuagggagugugauuauucaaacuaaugagaggac

SEQ ID NO: 167424 - RNA, 59 nt, Human
ucucucuuuuguaauuuauguucccaauugagugugaauguccaaguaaugguguaugu

SEQ ID NO: 167425 - RNA, 59 nt, Human
cuccagccccuugcugguuaucuuacucugagugugaugcagucagaggcaccugcggg

SEQ ID NO: 167426 - RNA, 59 nt, Human
uugugcuguucuaggaacaucauccuagagagugugauguucacuauaaccccauaccu

SEQ ID NO: 167427 - RNA, 59 nt, Human
cuugcauacauauauauuuuuggcugggggagugugaguuuugccuuucuaagggaggg

SEQ ID NO: 167428 - RNA, 59 nt, Human
aacccuagaggguugcauagucuagaaaggagugugaccugacagugcuggagccuccu

SEQ ID NO: 167429 - RNA, 59 nt, Human
gacuucacuaacacagaaaaacagaaacugagugugagaguugugaaauacaaggaaau

SEQ ID NO: 167430 - RNA, 59 nt, Human
uuuccaaggaaaggaaauguuaugagcaagagugugaggcaagagaagcuggaaccaca

SEQ ID NO: 167431 - RNA, 59 nt, Human
ccccuccccccaccccacaacaguccccagagugugaugauccccuuccuguguccaug

SEQ ID NO: 167432 - RNA, 59 nt, Human
agaauaugcacagucugaauguauaccaggagugugagagacacaugcccacuucaugc

SEQ ID NO: 167433 - RNA, 59 nt, Human
aagaugagcaaagaaagguuugcacagaggagugugaauguguguuuguugcuggcuga

SEQ ID NO: 167434 - RNA, 59 nt, Human
agucaacccauccccagggccauaguguagagugugaaaagcuacccugaaacccagua

SEQ ID NO: 167435 - RNA, 59 nt, Human
ccuucugcccuccugccaaaagaucuggggagugugaggagaggguggcaucaggagcu

SEQ ID NO: 167436 - RNA, 59 nt, Human
ccaagcccuuugggagccaaagugucugagagugugacccucuccuguaaaguauuuau

SEQ ID NO: 167437 - RNA, 59 nt, Human
ccaucccacgccgccugcguguggagcuggagugugaggagggcgagcugucuuucuau

SEQ ID NO: 167438 - RNA, 59 nt, Human
gagcguguagaacuguggccagacuuuaggagugugagggaugcugaaucucccagaga

SEQ ID NO: 167439 - RNA, 59 nt, Human
uggcauuggcuacuccaucuguccuagcagagugugacuaaacuggaaauguauggagc

SEQ ID NO: 167440 - RNA, 59 nt, Human
ucuuguguuugacacuaagaaaauagcaagagugugaaaucucagauacuuaugaaauc

SEQ ID NO: 167441 - RNA, 59 nt, Human
cccuagcuuaguuucuaggacuuaucugagagugugauuucaugcagugguaauaagaa

SEQ ID NO: 167442 - RNA, 59 nt, Human
auuuauauaauuuuccuguuuaacaacaagagugugaccuaaaugcuuuugucuuguca

SEQ ID NO: 167443 - RNA, 59 nt, Human
gucucacugccuuuccuucccacagaccugagugugaaagacugagaguugaggaguua

SEQ ID NO: 167444 - RNA, 59 nt, Human
cggauacacacucgaaucauugaagauccgagugugauuugaauucugugauauuuuca

SEQ ID NO: 167445 - RNA, 59 nt, Human
agaggucuucugaccuuuccuuuccccgugagugugaagcuggcagaaaucacuaguaa

SEQ ID NO: 167446 - RNA, 59 nt, Human
aauacuagaaaagauuuaaaaaauaguaugagugugaguacuaggaaggauuagugggc

SEQ ID NO: 167447 - RNA, 59 nt, Human
gaaacgaugaaauaagauauauacaaggugagugugacuucccuucuaacccccucugc

SEQ ID NO: 167448 - RNA, 59 nt, Human
ggaguuugauggacagggcugccuuuaaugagugugaaggucacuaagucacuuagaca

SEQ ID NO: 167449 - RNA, 59 nt, Human
gugcuguacgugugugugugugugugagcgagugugaacucuucaagaaacaugcauuu

SEQ ID NO: 167450 - RNA, 59 nt, Human
uuuccuguguaauuuggguagauuuucaagagugugaacacaaauuuaaaauaagcuau

SEQ ID NO: 167451 - RNA, 59 nt, Human
cucugaaauucaggacacauacauuuauagagugugaggcugugcauacguacauucau

SEQ ID NO: 167452 - RNA, 59 nt, Human
aggacagggccuggggugugugugagugugagugugagcgagagggugaguguggucag

SEQ ID NO: 167453 - RNA, 59 nt, Human
ccagccaggacagggccuggggugugugugagugugagugugagcgagagggugagugu

SEQ ID NO: 167454 - RNA, 59 nt, Human; identical to SEQ ID NO: 167405

SEQ ID NO: 167455 - RNA, 59 nt, Human
cuucccugucugccagggccagucuugacgagugugaagcuuccuuggcuuuuacugaa

SEQ ID NO: 167456 - RNA, 59 nt, Human
gaaaauuuuaacugcaugguaugaauucagagugugacuuaagggucaauucaaagcag

SEQ ID NO: 167457 - RNA, 59 nt, Human
acugaguuucgcucuugucauccuggcuggagugugauggugcgaucuugacucacugc

SEQ ID NO: 167458 - RNA, 59 nt, Human
acugcucuuuauugcagaauguggguauugagugugauuugaaugauuuuucauuggcu

SEQ ID NO: 167459 - RNA, 59 nt, Human
uucccggggagaccuuuccagugucgguagagugugaggauggagaccgguucccggcg

SEQ ID NO: 167460 - RNA, 59 nt, Human
aacagaagccagugaagcaauggaagcuggagugugacuggaaaaauacucagcaaaca

SEQ ID NO: 167461 - RNA, 59 nt, Human
cagagucugcauggcacuccugaagaagggagugugaccugcagucaccaggagaugag

SEQ ID NO: 167462 - RNA, 59 nt, Human
aaggacccugcuccaccuggggggacugggagugugagugugcauggcauguguguggc

SEQ ID NO: 167463 - RNA, 59 nt, Human
aauuaagguuagcggaucauguacaagcugagugugaaaguagaaaucaccuacaccag

SEQ ID NO: 167464 - RNA, 59 nt, Human
uugucaagacauuaaaccaucuuagaucggagugugaaguaaauuaugguauauuuuau

SEQ ID NO: 167465 - RNA, 59 nt, Human
aauauccgugagagugagugacggagugagagugugagcgaguggauguggcugucagu

SEQ ID NO: 167466 - RNA, 59 nt, Human
ucuaauucuccugacuguucuucccaggggagugugaaggucuuggcccuguucccugu

SEQ ID NO: 167467 - RNA, 59 nt, Human
uaacuuaugaaaaaauuauuuggggacaggagugugauaccuuccuugguuuuuuuuug

SEQ ID NO: 167468 - RNA, 59 nt, Human
ugagauuccuuggccugaacucugugauagagugugacugagcugcugggggacaugug

SEQ ID NO: 167469 - RNA, 59 nt, Human
ccagaaagcaagcccaggagaggaaggcagagugugacagagcagagccagggccaggc

SEQ ID NO: 167470 - RNA, 59 nt, Human
acuguguuuuauuauuucauggcuuguaugagugugacuggguguguuucuuuaggguu

SEQ ID NO: 167471 - RNA, 59 nt, Human
uaccuuuucacaugacuuaccccucauccgagugugagguuacaagcaggugucauggc

SEQ ID NO: 167472 - RNA, 59 nt, Human
ucaccugugccaaccauggggugucccgugagugugaguguggcagugagaagaagcau

SEQ ID NO: 167473 - RNA, 59 nt, Human
gaaaagcuuccuugaugugagcucugggggagugugaaggaugcaucucuagcccccga

SEQ ID NO: 167474 - RNA, 59 nt, Human
ucugagaaccaugucuauuuuuauaacuggagugugaguucuguaucuucucacauucu

SEQ ID NO: 167475 - RNA, 59 nt, Human
acauccuggcuccaguguggaugcagagagagugugacagaggaucugccugugaacca

SEQ ID NO: 167476 - RNA, 59 nt, Human
ccuguuucuacaggaagucaugcucgagggagugugaagugguucagguuggugcagag

SEQ ID NO: 167477 - RNA, 59 nt, Human
ucugauuagggaaccuguauaaggguauugagugugagguugaggugggacauuugcug

SEQ ID NO: 167478 - RNA, 59 nt, Human
ccucuuuguuuuuguccaucaaggcacaugagugugaccucugccauggggaaacacac

SEQ ID NO: 167479 - RNA, 59 nt, Human
agugaacauuuauauccgauaaggggugggagugugauuuuaaaugcucuuuugggaga

SEQ ID NO: 167480 - RNA, 59 nt, Human
ugcauguaaaguaaaucauuuuguauuuggagugugacaagcuuuaccuuugaacucaa

SEQ ID NO: 167481 - RNA, 59 nt, Human
aaguaaauuccauguuguaauguuacagagagugugauuugguuugugauauauauaua

SEQ ID NO: 167482 - RNA, 59 nt, Human
uccucacaugcagaguugugcaugccccugagugugaacagguuugccuacguuggugc

SEQ ID NO: 167483 - RNA, 59 nt, Human
uuaauaaauguaugacacugaaaagauuugagugugaaucuacugaaaucacuauaaug

SEQ ID NO: 167484 - RNA, 59 nt, Human
ugucaucgcugcauuuuauuucacaagaggagugugagggucaaggggaugaaaugagg

SEQ ID NO: 167485 - RNA, 59 nt, Human
aggucaucaucgauucuacuuuagaaugagagugugaaauagacauuuguaaauguaaa

SEQ ID NO: 167486 - RNA, 59 nt, Human
cccauaaaaugauccugccaaucuaaugugagugugaagcuuugcacacuaguuuaugc

SEQ ID NO: 167487 - RNA, 59 nt, Human
aucucccaaaugacugucucuaucuucaugagugugacuugagguguugggauggguga

SEQ ID NO: 167488 - RNA, 59 nt, Human
uuucuuggcaguuaugucgaugaaaucaagagugugauguucuaguuauuuuuuuuuau

SEQ ID NO: 167489 - RNA, 59 nt, Human
uauguguaauuggaagagggcauuuguuugagugugaguuuggaggccuuuuuaacaug

SEQ ID NO: 167490 - RNA, 59 nt, Human
uucucgguucucagaggaaaaguaugaaugagugugaaguguaugugagaacuuuuguu

SEQ ID NO: 167491 - RNA, 59 nt, Human
ugaggcugaguguguuuaaguacgugagagagugugaguguguuuguaagugagugucc

SEQ ID NO: 167492 - RNA, 59 nt, Human
ugugacuccuuccagagccacagguaggggagugugaaguugagggggaggaaagcugg

SEQ ID NO: 167493 - RNA, 59 nt, Human
acuguuaaauauauguguguaaucagccugagugugaaaguuaauggaggccugggaac

SEQ ID NO: 167494 - RNA, 59 nt, Human
cucugcauucaguguucauugugaauugggagugugagucuuucuguaggguagaaaga

SEQ ID NO: 167495 - RNA, 59 nt, Human
gggcaucccagaaacguguaaaugaccccgagugugacugggaaggagaacuuauuccu

SEQ ID NO: 167496 - RNA, 59 nt, Human
agaguauuuuaauccuauuacuugacuaagagugugaagguaguacuuuuuagagugca

SEQ ID NO: 167497 - RNA, 59 nt, Human
guggcugcacuggcacagaauacuaaacugagugugacuauuuucacugcaacaaauga

SEQ ID NO: 167498 - RNA, 59 nt, Human
uggcuaaugagugaagaaggucacuguaggagugugaggaccaucaggagcuucauauu

SEQ ID NO: 167499 - RNA, 59 nt, Human
ugaacucaagggagaagguauaguggaaugagugugagcaucgggcuuugcagucccau

SEQ ID NO: 167500 - RNA, 59 nt, Human
gaauggcugacuugaagagcaacaucauagagugugaauuucuauuugggaaggagaaa

SEQ ID NO: 167501 - RNA, 59 nt, Human
ugccacugggggcacacugaacuuguagggagugugauuuuguuggaggugcacauggu

SEQ ID NO: 167502 - RNA, 59 nt, Human
uggaagguggcccaguaugagcccuagaagagugugaaaaggaauggcaaugguguuca

SEQ ID NO: 167503 - RNA, 59 nt, Human
aaguggggagaaaagucuguuugccucaggagugugaggacuacacuagugaaagcgcc

SEQ ID NO: 167504 - RNA, 59 nt, Human
cgagggcgugugucaguggcugugugcaggagugugagugagcaagagcaagagcgcau

SEQ ID NO: 167505 - RNA, 59 nt, Human
ccuuucugugcaaccaauuaaagaacaaugagugugaugcuccaugucugaauuucguc

SEQ ID NO: 167506 - RNA, 59 nt, Human
acgauuuuucacuuccaccaucaaguuaugagugugauuguuucccugcaguuuugcca

SEQ ID NO: 167507 - RNA, 59 nt, Human
acugcggagccugcuccacugccaccacggagugugagaccaucugaggccgcuagcug

SEQ ID NO: 167508 - RNA, 59 nt, Human
agacagauuuguccuuuacagaaauuacugagugugaauaaaaacuucagauccaagaa

SEQ ID NO: 167509 - RNA, 59 nt, Human
uggaaaauaaaaggcucugcccccagugugagugugaccgguuguacccuggaguagug

SEQ ID NO: 167510 - RNA, 59 nt, Human
ugccuuuuugggugccucacagagccccagagugugagaccugaaagaauguucagcau

SEQ ID NO: 167511 - RNA, 59 nt, Human
gagccuuccaugguagagauuucucuuaagagugugauuucucauagggcuaguaaggg

SEQ ID NO: 167512 - RNA, 59 nt, Human
gcccugcaucccuugccucaggccgggcugagugugacugcagcuccugaggaugggcc

SEQ ID NO: 167513 - RNA, 59 nt, Human
guagauuucacagcccuucuacuaauagugagugugaaggcaagcuugaugcaaaaccu

SEQ ID NO: 167514 - RNA, 59 nt, Human
ccacuauuuugaugauggcugaugugugugagugugauggcccugaagggcuguaggac

SEQ ID NO: 167515 - RNA, 59 nt, Human
uccccaaggauuuauugacauugcuacuugagugugaacaguuaccuggaaauacugau

SEQ ID NO: 167516 - RNA, 59 nt, Human
uuccucuucucucuggaacggcucacaaugagugugacauuagaaaacuccuugcagag

SEQ ID NO: 167517 - RNA, 59 nt, Human
gcugugcagacaccucuguggccccccaggagugugaguggccuggggagggggccgug

SEQ ID NO: 167518 - RNA, 59 nt, Human
ggcacgggcgcgggccgggccucaagggugagugugaaauaaacaaauccugcaguguu

SEQ ID NO: 167519 - RNA, 59 nt, Human
cuaggauacuuuuauaugaugggugcuuugagugugaaugcagcaggcucucuuguuuc

SEQ ID NO: 167520 - RNA, 59 nt, Human
cuuaacuacaugucuguggguaucacacugagugugaguuguguccacacgugcucaag

SEQ ID NO: 167521 - RNA, 59 nt, Human
guauauguuaggagguuauaaaucuuguggagugugaauuaaguauguggagugucuag

SEQ ID NO: 167522 - RNA, 59 nt, Human
aaaaaaaaaaaaacuucauuggcuuguccgagugugaaaugcacauuuaggaagguuac

SEQ ID NO: 167523 - RNA, 59 nt, Human
ggcccggguugggucaccagacggggcuggagugugaggguccugcagccugcaggacc

SEQ ID NO: 167524 - RNA, 59 nt, Human
uccagccaccccccagcacuuuauguagagagugugacauagaccugcauauuugucag

SEQ ID NO: 167525 - RNA, 59 nt, Human
acacaggggagaagccuuaugucugcagagagugugagcggggcuuuagccggaaguca

SEQ ID NO: 167526 - RNA, 59 nt, Human
augaaggcagccacagacaacauggaaaugagugugacuauguuccaauaaaacuuuau

SEQ ID NO: 167527 - RNA, 59 nt, Human
gucugcaggugucugacacgcaagugugugagugugagugugagagauggggcgggggu

SEQ ID NO: 167528 - RNA, 59 nt, Human
aggugucugacacgcaagugugugagugugagugugagagauggggcgggggugugucu

SEQ ID NO: 167529 - RNA, 59 nt, Human
uccugaccgugggccccucaggggucugggagugugacguuguaaucuucauccgucuc

SEQ ID NO: 167530 - RNA, 59 nt, Human
gccacaggcagacgaugucaaccuugugugagugugacggggguugggguggggcggga

SEQ ID NO: 167531 - RNA, 59 nt, Human
caggagaaggucagcgagaaggaguguaugagugugagugugugugcauggaaguuggg

SEQ ID NO: 167532 - RNA, 50 nt, Human; identical to SEQ ID NO: 97045

SEQ ID NO: 167533 - RNA, 59 nt, Human
aucuuccaaucccuggaaaagucuggucugagugugacuugggaagcuuucagugcugc

SEQ ID NO: 167534 - RNA, 59 nt, Human
ccaaauggaaauaagaggauauugaucacgagugugaugcugaguaccuuucugcauau

SEQ ID NO: 167535 - RNA, 59 nt, Human
ucauccuguguccccugaccuguccaggugagugugagggcagcacugggaagcuggag

SEQ ID NO: 167536 - RNA, 59 nt, Human
cagggaacugcuugcccagggugcagugugagugugaugggccaccggggcaagaggga

SEQ ID NO: 167537 - RNA, 59 nt, Human
agggccuucuccagaucuguuccaacuuggagugugaagggcuugagcauacgggggaa

SEQ ID NO: 167538 - RNA, 59 nt, Human
cuuggcaguuaauggaucugcuguugcuggagugugagcguggacuugaugcagugaug

SEQ ID NO: 167539 - RNA, 59 nt, Human
agaaggagggccgggcgcaccagugccuggagugugaccgcgccuucucaucggcggcg

SEQ ID NO: 167540 - RNA, 59 nt, Human
uuuuagcuuuuaaaauuuaaaguguuuuugagugugaaaaguugaguaaaacuauuugc

SEQ ID NO: 167541 - RNA, 59 nt, Human
ucuauuucuugguggagcagcacauuguggagugugauucuuaauucuucauugaguuu

SEQ ID NO: 167542 - RNA, 59 nt, Human
ucaucauuucacuugucaggagugugugugagugugagugugcggcugugugugcacgc

SEQ ID NO: 167543 - RNA, 59 nt, Human
acugugugccgggcacuagugauacaaaagagugugacaguuguucagucugcauuuuc

SEQ ID NO: 167544 - RNA, 59 nt, Human
agaacauucauacugaagaggaacccuaugagugugaagaauauggcaaagccuucaac

SEQ ID NO: 167545 - RNA, 59 nt, Human
aacacgaccagguccgaaaugcaggucaugagugugaaauucucaaauuuacauaaaaa

SEQ ID NO: 167546 - RNA, 59 nt, Human
aaaugacauauaaguuauacauauuuauggagugugaaauuugauacauguauauaaug

SEQ ID NO: 167547 - RNA, 59 nt, Human
augauggugaugaaucuauuaaucaugaugagugugauaggggugcucuucaagacuua

SEQ ID NO: 167548 - RNA, 59 nt, Human
caaucuguaucuuugacaauucugggugcgagugugagagugugagcagggcuugcucc

SEQ ID NO: 167549 - RNA, 59 nt, Human
aucuuugacaauucugggugcgagugugagagugugagcagggcuugcuccugccaacc

SEQ ID NO: 167550 - RNA, 59 nt, Human
ccaguagggaaacaaaauugauaaauauugagugugaguaauugggauuggggagauug

SEQ ID NO: 167551 - RNA, 59 nt, Human
agagaguucacaccagaucaagguguuaugagugugacaaauggggaauauucuuuagc

SEQ ID NO: 167552 - RNA, 59 nt, Human
uucuuuagcagcagagacugaggggugcagagugugagcugggaaagguuuguggcucc

SEQ ID NO: 167553 - RNA, 59 nt, Human
aagugggaaaaucuuccaacuguccucuagagugugaauauaugaaaggagucagagug

SEQ ID NO: 167554 - RNA, 59 nt, Human
uccacacucaagagaacgggaugauacaagagugugaauaaguccuggagacaggacca

SEQ ID NO: 167555 - RNA, 59 nt, Human
uuggcauuagagguuuuauaccauuaaaagagugugacaauguauuguaguccaucauc

SEQ ID NO: 167556 - RNA, 59 nt, Human
gugcccaugugauugaguucuagccaauggagugugagcaaaagugauauaagccacuu

SEQ ID NO: 167557 - RNA, 59 nt, Human
aacucccaggagacagcagccuaguuuucgagugugagcuugugcuugugaaagcuaac

SEQ ID NO: 167558 - RNA, 59 nt, Human
gugcauacauccaccuggugucccgugaggagugugagcaugccuacccuggccagauc

SEQ ID NO: 167559 - RNA, 59 nt, Human
ucccuaaguguucuagcaauaugauuauggagugugauucaguguacaugcugauuguc

SEQ ID NO: 167560 - RNA, 59 nt, Human
acauuauuggcuuccuccuagaguguugugagugugagaaggccuuucacuagccccac

SEQ ID NO: 167561 - RNA, 59 nt, Human
agaggguucuuacuggaucaggaccuuaugagugugacaaacgugggauauucuuuaug

SEQ ID NO: 167562 - RNA, 59 nt, Human
ugacuaacgguagaaaaguuauugccuaggagugugagacugauguugcuggacagaaa

SEQ ID NO: 167563 - RNA, 59 nt, Human
ccuccauaucucccucuucccuaggagaggagugugaagcaaggagcuuagauaagaca

SEQ ID NO: 167564 - RNA, 59 nt, Human
acuucugagucgcccaucuguugcugugggagugugaacggaucgcugaaggagaggga

SEQ ID NO: 167565 - RNA, 59 nt, Human
gagaaccaguucagaguggacuacauccugagugugaugaacgugccugacuuugacuu

SEQ ID NO: 167566 - RNA, 59 nt, Human
cacacuuccuuccuucuuuggugucugaggagugugaacuguuggggucaguuaagacc

SEQ ID NO: 167567 - RNA, 59 nt, Human
cccucagcaccaggguaccaggagcugaggagugugagcgugccgucaucgacuuugug

SEQ ID NO: 167568 - RNA, 59 nt, Human
ggugacaggguguguguguaucugugcgugagugugagugugugugagagagaauuggu

SEQ ID NO: 167569 - RNA, 59 nt, Human
gagagcccagugaacugacccuucaggcugagugugaagcgucucagaggcauuucaga

SEQ ID NO: 167570 - RNA, 59 nt, Human
gaagaggagagggcuuggauagaguugaggagugugaggcuguuagacuguuagauuua

SEQ ID NO: 167571 - RNA, 59 nt, Human
ggggauuccaauaagcuugcucgcucucugagugugacuugggcuaaaggcccccuuuu

SEQ ID NO: 167572 - RNA, 59 nt, Human
cacagcgccuccuggaccugaaggcaucugagugugagacccuguucuaacucuuagaa

SEQ ID NO: 167573 - RNA, 59 nt, Human
uccuccuuaaccacuuaucucccauaugagagugugaaaaauaggaacacgugcucuac

SEQ ID NO: 167574 - RNA, 59 nt, Human
ggugccacaaugcaaaugcuuaaggcacggagugugaaugugaagacacaagcucuuuc

SEQ ID NO: 167575 - RNA, 59 nt, Human
gcaaagacucuccugcuuuuuuucugucugagugugagcuccauccgccugggcaucug

SEQ ID NO: 167576 - RNA, 59 nt, Human
cucuuuuuuugccccccgcccucauccuggagugugagggugcucgcccguacucucag

SEQ ID NO: 167577 - RNA, 59 nt, Human
ucacacaaggaggaacuugggugaaggcugagugugaggcaccugaaguuucccugcgg

SEQ ID NO: 167578 - RNA, 59 nt, Human
acaggguaaggaagagagagugggaggcagagugugauggggaggagggacaggaagac

SEQ ID NO: 167579 - RNA, 59 nt, Human
guguggugccagcuugagugggagugugugagugugagcaggcgggcgagugcgugagu

SEQ ID NO: 167580 - RNA, 59 nt, Human
uggggaaggggcucacaugggcccaggcugagugugagugagcaugucaaguugucuga

SEQ ID NO: 167581 - RNA, 59 nt, Human
cuucccuuaacuccaagaacuugggauaagagugugagagagacugauggggucgcucu

SEQ ID NO: 167582 - RNA, 59 nt, Human
cuaugaucuugccauugcacuccagcugagagugugacccugucucuaaagaaaaacua

SEQ ID NO: 167583 - RNA, 59 nt, Human
ggggaagggaagagcggcgugagcggagggagugugaugauucccaaccgaaagcagcu

SEQ ID NO: 167584 - RNA, 59 nt, Human
gaaccaacaucaggggcaccugccaugaugagugugaagaaaucauuucucuaugcaag

SEQ ID NO: 167585 - RNA, 59 nt, Human
agucagagagaguguguaugggugugugugagugugaguguguguguacgcacacacac

SEQ ID NO: 167586 - RNA, 59 nt, Human
ugaggaccucauccaaacaauuuaaaaaugagugugaagggggaacaagucaaaauauu

SEQ ID NO: 167587 - RNA, 59 nt, Human
cagucaacaggggugugauggugaaggcagagugugaaaaacgugagagaggaagagaa

SEQ ID NO: 167588 - RNA, 59 nt, Human
uuaaggagaaagaaauuaauauacaagcugagugugaaaguagaaaucaccuacaccag

SEQ ID NO: 167589 - RNA, 59 nt, Human
ccuaccuuaccccucugccccuagccaaggagugugaauuuauagaucuaacuuucaua

SEQ ID NO: 167590 - RNA, 59 nt, Human
uuugucagugaacuagacuuuuuguuuuagagugugaggacuuggaagaguauaaugaa

SEQ ID NO: 167591 - RNA, 59 nt, Human
ccccucccccgaccccaccacaguccccagagugugauauuccccuuccuguguccaug

SEQ ID NO: 167592 - RNA, 59 nt, Human
uuuuuauucagcagacuuucucuguguaugagugugaaugaucaaguccuuugugaaua

SEQ ID NO: 167593 - RNA, 59 nt, Human
gucccugaggagaaaaucugggaggagcugagugugaugaagguguauguugggaggga

SEQ ID NO: 167594 - RNA, 59 nt, Human
acuuucacagaacaaagaguaaagaggcugagugugacuuuauaaagauacucauaaaa

SEQ ID NO: 167595 - RNA, 64 nt, Human
uaagauggaauguguccccagcucagggauugccugaaccaagaggccaggagcccccaugggc

SEQ ID NO: 167596 - RNA, 64 nt, Human
uucccaaaccuaauucuuguagaugcauuaguguugaaccaaugcuuucucaugucucaauucu

SEQ ID NO: 167597 - RNA, 64 nt, Human
ucagucuagggaucuggccacagacucccuccugugaaccaacacagacacccaagcagagcaa

SEQ ID NO: 167598 - RNA, 64 nt, Human
cccagaagaauacucaacaacccuuggccaagcaugaaccaaggaaagaguccauuaaaaagac

SEQ ID NO: 167599 - RNA, 64 nt, Human
uuagugugugucacaauucugagguuuucgcagaugaaccaaaaacuccaguaacauguuuuca

SEQ ID NO: 167600 - RNA, 64 nt, Human
cccugaacggugauggcaucugaaugaaaauaacugaaccaaauugcacugaaguuuuugaaau

SEQ ID NO: 167601 - RNA, 64 nt, Human
gggaaaauggggccuucgaccccagcgggcuaccugaaccaaggcgucucuuuaaguggggcgc

SEQ ID NO: 167602 - RNA, 64 nt, Human
caucgucuuauauaugaagcgccuugagugugcaugaaccaaaggaaauaacauugaagaagga

SEQ ID NO: 167603 - RNA, 64 nt, Human
auguuuguuaaauuguuuguaccuugcaaacuuaugaaccaaaccauauuggguuuucaaagug

SEQ ID NO: 167604 - RNA, 64 nt, Human
cuugggccugagguccucccucugaaaugcagagugaaccaacccucaucaccaugcuuccccu

SEQ ID NO: 167605 - RNA, 64 nt, Human
aacagcuauguaaaucauaaagaaaaacuaaaaaugaaccaaagugaaaggauaacuuccaggc

SEQ ID NO: 167606 - RNA, 64 nt, Human
agcuauguggaagguaaaaauaguggugugaucaugaaccaaaggaauuuauguuuuguaacuu

SEQ ID NO: 167607 - RNA, 64 nt, Human
gcucaucugaccacugggcaccuuagugccaaccugaaccaaagagaccuccuuguuucagcug

SEQ ID NO: 167608 - RNA, 64 nt, Human
auugacccagauacugcugugugcugcacagcagugaaccaacacuagagggagccacacaagc

SEQ ID NO: 167609 - RNA, 64 nt, Human
agugcuggucagccaaagaaacauucacugcuggugaaccaauaccauaagcauguauuaucua

SEQ ID NO: 167610 - RNA, 64 nt, Human
uucuuacaugcauuugaggucaaguaagaagacaugaaccaaguggaccuugagaccacagggu

SEQ ID NO: 167611 - RNA, 64 nt, Human
uacucaugcugaugcucugugagauauuugaaauugaaccaaugacuacuuaggauggguugug

SEQ ID NO: 167612 - RNA, 64 nt, Human
gaagcuuggcuuccucuucuuguugacccuuuuuugaaccaacaucuuuuuuauuauauucaga

SEQ ID NO: 167613 - RNA, 64 nt, Human
uaauuagcuuguuccuggacuucauuuucaaugaugaaccaaauuccugaauuauuuauaauug

SEQ ID NO: 167614 - RNA, 64 nt, Human
ccagagcuguacucuuaauuuuaaggaauuucaaugaaccaaaagauaacugucaauuuauuug

SEQ ID NO: 167615 - RNA, 64 nt, Human
ggcagaggccuccguggugaagacagaagcuccgugaaccaacucgaggcuggagccaagaucc

SEQ ID NO: 167616 - RNA, 64 nt, Human
aaugaaaagaacuacuguauauuaaaaguugguuugaaccaacuuucuagcugcuguugaagaa

SEQ ID NO: 167617 - RNA, 64 nt, Human
cccccacccacccugggaugugggugcucugggcugaaccaaggcuaugacuucuggagagagg

SEQ ID NO: 167618 - RNA, 64 nt, Human
ucacauagucaggaggugacacagggcuaagacuugaaccaaggcucuaagaggauuucuucuu

SEQ ID NO: 167619 - RNA, 64 nt, Human
gcaggaaagggccaucuccauugagaugauuaagugaaccaaacuaguucucagaauucuacag

SEQ ID NO: 167620 - RNA, 64 nt, Human
uauaaauaugacuuuauccuggcuauaaaauuauugaaccaaaaugaauucuuucuaaggcauu

SEQ ID NO: 167621 - RNA, 64 nt, Human
auuuuauuucauguaguauggcuaauacuauaguugaaccaaggauaugcauugauucuuugcu

SEQ ID NO: 167622 - RNA, 64 nt, Human
cagugaggagaugcggccaaagauucuuuauaucugaaccaagauguaaaacaagaaaugcuuu

SEQ ID NO: 167623 - RNA, 64 nt, Human
auuuucuuuauuugaaccuaccucuuuuauuuucugaaccaaagagaaagauggacugguguuu

SEQ ID NO: 167624 - RNA, 64 nt, Human
uacaaaugguuuuuucaguccuauccaaauuuauugaaccaacaaaaauaauuacuucugcccu

SEQ ID NO: 167625 - RNA, 64 nt, Human
aaagacaucccaggagaaggacaaaccagaggagugaaccaacaaagaguaccuaggaauggga

SEQ ID NO: 167626 - RNA, 64 nt, Human
ugugcuuugacucaccuguuacuugaaauaccagugaaccaaagagacuggagcaucugacuca

SEQ ID NO: 167627 - RNA, 64 nt, Human
gugguaagagaauagagaucaaaaccaaaaaaaaugaaccaaaggcuuggguggugagggugcu

SEQ ID NO: 167628 - RNA, 64 nt, Human
aaggagugggguuaugaaucugccaaaggugguaugaaccaaccccuggaagccaaagcggccu

SEQ ID NO: 167629 - RNA, 64 nt, Human
agagccucaggaauuuccaagucagaguccccuuugaaccaaguaucuagauccccugaggacu

SEQ ID NO: 167630 - RNA, 64 nt, Human
gaaaacaaaguguuucacuaggaacaccucuacuugaaccaauguuuuuauuucauauauuuua

SEQ ID NO: 167631 - RNA, 64 nt, Human
acauuauuccuucacacaguggauuuugaguaacugaaccaaaggaaaaagaagcucuuugcua

SEQ ID NO: 167632 - RNA, 64 nt, Human
auauucuuuuugucuccauggcaaccauaacuuuugaaccaaaaaaaauuguuuuuacaucuuu

SEQ ID NO: 167633 - RNA, 64 nt, Human
cuguggucucuccccuggcuugcuucauggccacugaaccaaucacuuuguaugcuaugcuccu

SEQ ID NO: 167634 - RNA, 64 nt, Human
ggcagcuuaauggaacaaaaauuacagacuuuggugaaccaagaauucaacaagaggaagggca

SEQ ID NO: 167635 - RNA, 64 nt, Human
ucaagugauuuagauaucuaucuaucuagauuucugaaccaagauauauuuauaguucacuuuu

SEQ ID NO: 167636 - RNA, 64 nt, Human
uguuauacagggaaguccguuuucacuauuaguaugaaccaagaaaugguucaaaaacaguggu

SEQ ID NO: 167637 - RNA, 64 nt, Human
agaauugcuggaaccugggaggcggagguugcagugaaccaagauugcaccacugcacuccagc

SEQ ID NO: 167638 - RNA, 64 nt, Human
aagcguggcacagccaugcugaccuuccaucuggugaaccaaguggcagccccaggggccugcc

SEQ ID NO: 167639 - RNA, 64 nt, Human
aagcucuuggaaaauacguuguaucucaguuugaugaaccaauucacaagaggcuaggcccucu

SEQ ID NO: 167640 - RNA, 64 nt, Human
aauuacaaaucugggcuccuuugaagcaacagguugaaccaacaaugauugguugauagacuaa

SEQ ID NO: 167641 - RNA, 64 nt, Human
accaaauaaaaauucucaaaauacauugguuuauugaaccaauuugcaauacacagugaggaac

SEQ ID NO: 167642 - RNA, 64 nt, Human
uagauugagaaauguguagcugcaaaaauaaucaugaaccaaucuggaugccucauuaugucaa

SEQ ID NO: 167643 - RNA, 64 nt, Human
gguucauuuuccuuuaaacugauccagcuggcccugaaccaauuguuuuugacugaguaucuag

SEQ ID NO: 167644 - RNA, 64 nt, Human
aaaaauguuauagucauuaaguuuuuauuuuacuugaaccaagagcacaugaaugaacaggaaa

SEQ ID NO: 167645 - RNA, 64 nt, Human
aguaccccuugagccugggaggcgcagguugcagugaaccaagaucacaucacugcacuucaac

SEQ ID NO: 167646 - RNA, 64 nt, Human
uaguccaaacaauagaguuuauuuuuucuucaucugaaccaacaugcuacaguagcuaagaagu

SEQ ID NO: 167647 - RNA, 64 nt, Human
cuuggcuuagugaagaagagagaugccaaaggaaugaaccaacccuucacauaaaggagacugg

SEQ ID NO: 167648 - RNA, 64 nt, Human
ucugacuuugcugacuuaauuuaaaugcucguucugaaccaauuuucuccuaucuucucuaggg

SEQ ID NO: 167649 - RNA, 64 nt, Human
ugaauuuuccucaaaggcucucuuuugauaaggcugaaccaaauauaaucccaaguauccucuc

SEQ ID NO: 167650 - RNA, 64 nt, Human
gacuaaaggauuuguuggguuuuugcuuaaguuuugaaccaaauccuagagccagcugauaaua

SEQ ID NO: 167651 - RNA, 64 nt, Human
uguucucuuggcaugcuaaaucauggauaaacugugaaccaaaauauggugcaacauacgagac

SEQ ID NO: 167652 - RNA, 64 nt, Human
cuuauguauguacaucaguuguuucuuuuuauuuugaaccaaaaaugugguuucuuuuguacac

SEQ ID NO: 167653 - RNA, 64 nt, Human
cuggcuccaauugccagaaggcucuuuuuaaugcugaaccaaaaugugccuuuuuuuuuuuuuu

SEQ ID NO: 167654 - RNA, 64 nt, Human
cccagccccuaugguuucacauagacgugcagugugaaccaaagcaagacugaaugugacugua

SEQ ID NO: 167655 - RNA, 64 nt, Human
gaauauugaaguuucagcuuaaaauaaacaguugugaaccaagaucuauaaagcgauauacaga

SEQ ID NO: 167656 - RNA, 64 nt, Human
ggggcaacucaggauuuuaaguuccauaaaguauugaaccaacucuaaaauguuaacuccuuaa

SEQ ID NO: 167657 - RNA, 64 nt, Human
aauuaccagaguuguucugucuuuagauaagguuugaaccaaagcucaaaacaaucaagacccu

SEQ ID NO: 167658 - RNA, 64 nt, Human
guuccauacaaaagcuauuuuucaaaaauuaauuugaaccaaaacuacuacuauagggaaaaga

SEQ ID NO: 167659 - RNA, 64 nt, Human
ggcccaaagaggcugcuaaccagcaggaauguccugaaccaaaaggaguggugaccauucucua

SEQ ID NO: 167660 - RNA, 53 nt, Human
augcugaaacuucauuauagaauugaaccaagaggcauuauacauauagauau

SEQ ID NO: 167661 - RNA, 64 nt, Human
uagucuuaaauuaucaacuccuuaaaugugcuuuugaaccaauuugcagaagcucacauagcaa

SEQ ID NO: 167662 - RNA, 64 nt, Human
uggacucagcagugaccacaccaacacugacccuugaaccaauaaaggaacaaaugacuauuaa

SEQ ID NO: 167663 - RNA, 64 nt, Human
ccuggccucccgggcaucccaccaccgggugugaugaaccaaggaguggccccuaugguaggga

SEQ ID NO: 167664 - RNA, 64 nt, Human
uggugaaguaacaugcauacuuuauugugggccaugaaccaaaugguucuuacuuuuccuggac

SEQ ID NO: 167665 - RNA, 64 nt, Human
auaauauauaccaacagauuguuugucacgcuucugaaccaaugacugaaugucaagauguucg

SEQ ID NO: 167666 - RNA, 64 nt, Human
cuugggaugcaaaucuuaaaacaguccuuuaauaugaaccaacaaucuggagcacaccgaaggg

SEQ ID NO: 167667 - RNA, 64 nt, Human
uguaugaucucacccagugugcaauuugugaaaaugaaccaaaugucauuacuuuugucuuaaa

SEQ ID NO: 167668 - RNA, 64 nt, Human
cagcuacucgggaggcugaggcaggagaauugcuugaaccaagguggcagagguugcaguaagc

SEQ ID NO: 167669 - RNA, 64 nt, Human
acucaaaaucuuccuuuguguaggacaagaaaauugaaccaaagcuugcuuguugcaauguggu

SEQ ID NO: 167670 - RNA, 64 nt, Human
gugugcuuauauaggucccugcacagauuggacuugaaccaaaauuaaguccaaagaacauaug

SEQ ID NO: 167671 - RNA, 64 nt, Human
uugagacuuuuugugguuuucucucaauaauaagugaaccaauuucaaaugugaucacaaaguu

SEQ ID NO: 167672 - RNA, 64 nt, Human
agaauugcuugaacccgggagguggagguugcagugaaccaagaucgcggcgcugcacucuagc

SEQ ID NO: 167673 - RNA, 64 nt, Human
cauuuuuauagaaacacuuuggaaacacuuuggaugaaccaaggccuuuuccuuauuuaaguag

SEQ ID NO: 167674 - RNA, 64 nt, Human
gauucugaagcacaguguauucagacagauacagugaaccaagugcaauauguaaggaugaaag

SEQ ID NO: 167675 - RNA, 64 nt, Human
cacauguguucucuauuuugccuuuaaauuuuugugaaccaauuuuaaauacauucuccuuuuu

SEQ ID NO: 167676 - RNA, 64 nt, Human
gggauuacaggugugagccaccacgccuggcccaugaaccaaguguuuuuaaggaaacaaaacu

SEQ ID NO: 167677 - RNA, 64 nt, Human
gauagcaaauaucuaucugcuauuaaaugguaaaugaaccaaguguuuuuuuuuguuuuuuuuu

SEQ ID NO: 167678 - RNA, 64 nt, Human
ccaucuauuuuaccugugguccacuuuccuacauugaaccaaugccuugggcuucucuaauuac

SEQ ID NO: 167679 - RNA, 55 nt, Human
cauccaccuuagaaagaugagaaagugaaccaaaaaggcuagaaaccagaggaaa

SEQ ID NO: 167680 - RNA, 64 nt, Human
aggagacugcgucaagcaaucgagauuugggagcugaaccaaagccucuucaaaaagcagagug

SEQ ID NO: 167681 - RNA, 64 nt, Human
ugaaccugccugguuaauuuauuaccugauuugaugaaccaaggaaagccaugaguuuaaacaa

SEQ ID NO: 167682 - RNA, 64 nt, Human
aagugaggaaugaggugugauuugcuguaucauuugaaccaaaaaguaugcagcaugagaauuu

SEQ ID NO: 167683 - RNA, 64 nt, Human
aaagaaaaauugcucaggaaacugaaccuuuuucugaaccaagcacugucagcaaaucucaggu

SEQ ID NO: 167684 - RNA, 64 nt, Human
aacuccgaugaaguguuccaacaaaaugagcgagugaaccaagaagaggaugacauuagaucca

SEQ ID NO: 167685 - RNA, 64 nt, Human
uucagaaucucucuacucagaugaccccagaaacugaaccaacagaagcagacuuuucagaaga

SEQ ID NO: 167686 - RNA, 64 nt, Human
aaaaaccauuuuuuuaaaacuaauaaauagugacugaaccaauuuaugcaguaaauagacuaaa

SEQ ID NO: 167687 - RNA, 64 nt, Human
auagaacuuuauaauaggacaguuauaaccugacugaaccaaauccaucagcauaaugacugug

SEQ ID NO: 167688 - RNA, 64 nt, Human
ucauacacacacacagcccagcaaaagccucuccugaaccaaacaaaccuguugguugggagac

SEQ ID NO: 167689 - RNA, 64 nt, Human
uuuuuguacauuguguuuaaaagaagacaaaaacugaaccaaaacucuuggggggaggggugau

SEQ ID NO: 167690 - RNA, 64 nt, Human
cuuggagucuguaccagguggugguuauggggucugaaccaaaggauagcagcucuucauuccu

SEQ ID NO: 167691 - RNA, 64 nt, Human
acagcuucuccaccuuauuuggacagugauaaauugaaccaagaguguagauuuacaaguguaa

SEQ ID NO: 167692 - RNA, 64 nt, Human
ucauuuccagcauuuuuauaaacuaccaaauuagugaaccaaaaauagaaauuagauuugugca

SEQ ID NO: 167693 - RNA, 64 nt, Human; identical to SEQ ID NO: 167684

SEQ ID NO: 167694 - RNA, 64 nt, Human
gguguggaacuagccuuaaugaguuucccauuccugaaccaaaauucaaagugagugagaugua

SEQ ID NO: 167695 - RNA, 64 nt, Human
caauuauaaguucaagugagggaugaugguugcuugaaccaaaggguugcauguaguaagaaau

SEQ ID NO: 167696 - RNA, 64 nt, Human
uauuuuuugaaccacagaugaguaaauuuaauaaugaaccaauuacacucuugagucuaacuaa

SEQ ID NO: 167697 - RNA, 64 nt, Human
cacacaucuuuuugcaguuaccucuucauagccaugaaccaaaacguucuaugaggagcaugca

SEQ ID NO: 167698 - RNA, 64 nt, Human
guaccucagguguuuuaggugugagauguuucagugaaccaaaguucugauaccuuguuuacau

SEQ ID NO: 167699 - RNA, 64 nt, Human
caggugauuccaaugugcagacaaauuugaaaacugaaccaaccacaggaacaucaaguacacu

SEQ ID NO: 167700 - RNA, 64 nt, Human
gguuuuauauuuuuuggauggccuuuuguaccucugaaccaaaauuagauucaacuauucauau

SEQ ID NO: 167701 - RNA, 64 nt, Human
uuaagguugcugauuucuccacagcuugcauuucugaaccaaaggcccuuuucagggccgccca

SEQ ID NO: 167702 - RNA, 64 nt, Human
uuguaauuauaucaguugauuuuuuuugaaaagaugaaccaaaggauuugacugcuaauauuuu

SEQ ID NO: 167703 - RNA, 64 nt, Human
uccauuauauacuuuuuaaaggucuagauaauuuugaaccaauuuauuauuguguacugaggag

SEQ ID NO: 167704 - RNA, 64 nt, Human
caccccagggcuaccggaagguaaaaucuucaccugaaccaauuaugagcagucuccuuacuga

SEQ ID NO: 167705 - RNA, 64 nt, Human
cucaaaugaauuuauucuuucgguaugguaaaauugaaccaaucacaguuaagaugagagauca

SEQ ID NO: 167706 - RNA, 64 nt, Human
acauucucuagaaccauuuaguuuguguuaacuaugaaccaagcagugugguggccacugguga

SEQ ID NO: 167707 - RNA, 64 nt, Human
gcucaucacacacagggcuauuccuuuccuccaaugaaccaaacgccucccgcccaccuccagg

SEQ ID NO: 167708 - RNA, 64 nt, Human
agaaucacuugaaccugggagguggaaguugcagugaaccaagaucacgccacugcacuccagc

SEQ ID NO: 167709 - RNA, 64 nt, Human
aucugacgggauuucuauauggacauagcacagaugaaccaaaaauguauuuauauucaccuga

SEQ ID NO: 167710 - RNA, 64 nt, Human
auacuuuguuuugccuagagaggggcaauaaaaaugaaccaaaggauauuuccagaaaggauua

SEQ ID NO: 167711 - RNA, 64 nt, Human
uguuacagauuaauuuuuccauaaaaccauuuuuugaaccaaucaguaauuuuaagguuuuguu

SEQ ID NO: 167712 - RNA, 64 nt, Human
gugccuucuuaaggaaaccauuugauaggaaagaugaaccaaauaacucaaugauggaugagcu

SEQ ID NO: 167713 - RNA, 64 nt, Human
augauggaugagcugguagaaaaaaagcugguggugaaccaaggucaaacuggaaauuauaguc

SEQ ID NO: 167714 - RNA, 64 nt, Human
aauguuuaaaucugaacaucacuccaauuauuaaugaaccaaaucauacgauaaguuacuguuu

SEQ ID NO: 167715 - RNA, 64 nt, Human
aggauuuuuuugccaauaguuuauagaaaauauaugaaccaaagugauuugaguuuguaaaaau

SEQ ID NO: 167716 - RNA, 64 nt, Human
ggaggacagacacuguggugucauuaaaguuguuugaaccaaaguggcggcugcaucuuugucc

SEQ ID NO: 167717 - RNA, 64 nt, Human
gacuguggcgaccuugcuuugguucuuguugaagugaaccaagcccggccaccacgcauggcau

SEQ ID NO: 167718 - RNA, 64 nt, Human
uacagccagaggcccugucuaggcucuauggcccugaaccaaaggguuauggggaucuuccuug

SEQ ID NO: 167719 - RNA, 64 nt, Human
caugacggguugugagacuucuguuugaucacugugaaccaacccccaucucccuagcccaccc

SEQ ID NO: 167720 - RNA, 64 nt, Human
gcuauuuguguaacugaaagguugcacucuagggugaaccaagcuauaaaagcccaugcuuaaa

SEQ ID NO: 167721 - RNA, 64 nt, Human
uaaauugaauaaaauacucucuuuuuuuuuaaggugaaccaaagaacacuugugugguuaaaga

SEQ ID NO: 167722 - RNA, 64 nt, Human
auuaucuguagcauuucacaaauaauguuugcuuugaaccaaaaugcucagugccuaucaacau

SEQ ID NO: 167723 - RNA, 64 nt, Human
ccaaaauccuacuggcuguagcagagaauaccuuugaaccaagauucuguuuuaaucaucauuu

SEQ ID NO: 167724 - RNA, 64 nt, Human
gucaaaccuaaacaccgagccucauuaacccaagugaaccaaccaaagucaccaguucagaagu

SEQ ID NO: 167725 - RNA, 64 nt, Human
aggguauuuuuuccaacugccccugcauugugccugaaccaauugaaucuuauguaugaguuuc

SEQ ID NO: 167726 - RNA, 64 nt, Human
ucuuaccuguuuaaauaaaccaaaguauaccgugugaaccaaacaaucucuuuucaaaacaggg

SEQ ID NO: 167727 - RNA, 64 nt, Human
auuggugacuucacuuuugggcucaaggacugugugaaccaacaaggggccaguuuuccauugu

SEQ ID NO: 167728 - RNA, 64 nt, Human
aagugauuuguaugucuauuuuuuucaguuuauuugaaccaauaaaauaauuuuaucucuuucu

SEQ ID NO: 167729 - RNA, 64 nt, Human
uuguuaguuugugcugagaauggucguccguauuugaaccaauuauuuauuuuaaaauauauuu

SEQ ID NO: 167730 - RNA, 64 nt, Human
auuggagagcaaggaauguggacuuguauggcuuugaaccaagagaggguuaugagccuacugg

SEQ ID NO: 167731 - RNA, 64 nt, Human
aauuuuacccaggaaggacucacauuggggcgaaugaaccaaguuucgccaugcuggaugauga

SEQ ID NO: 167732 - RNA, 64 nt, Human
ucugauauuuaaaaaauucaucgaucuuucaagaugaaccaagguuuuuuaaaagaaauauagg

SEQ ID NO: 167733 - RNA, 64 nt, Human
uuugaugguucucucuugaauuggcugccagaauugaaccaacccaaccccuagcucaccuccu

SEQ ID NO: 167734 - RNA, 64 nt, Human
aguuuggggcagugcaggggaccuguguggggugugaaccaaggcacuacugccaccugccaca

SEQ ID NO: 167735 - RNA, 64 nt, Human
guuuugggugcaaccucugcggcagccgacugcaugaaccaaaguucucaccuaaugguaucau

SEQ ID NO: 167736 - RNA, 64 nt, Human
ggcuuugauuaccuaaaauaagcuuggauaaaauugaaccaacuucaagaaugcagcacuucuu

SEQ ID NO: 167737 - RNA, 64 nt, Human
uuuucuucaacaauggcgaaauugacuguagugcugaaccaaaaguaucccuuucccuccuuau

SEQ ID NO: 167738 - RNA, 64 nt, Human
uaaaccuauuugaacuagcuucuugucuuaggccugaaccaaaaaacaacaaacaaacaaaaaa

SEQ ID NO: 167739 - RNA, 64 nt, Human
agauuccaacagagaugugagaagauaauacagaugaaccaaagaugucacacaguugccaucc

SEQ ID NO: 167740 - RNA, 64 nt, Human
uagaugcugaauagccuagacaucaaaguuggugugaaccaaaauagagucagcugacccagca

SEQ ID NO: 167741 - RNA, 64 nt, Human
ugauagcuguauuaaaaauagcaaagcaucggacugaaccaacuuuggaaauaauuuauuuuua

SEQ ID NO: 167742 - RNA, 64 nt, Human
uuggaaaugaauaagcuuugauaauauuuguaaaugaaccaaauuauuacugcuaccacuaaca

SEQ ID NO: 167743 - RNA, 64 nt, Human
guguggugcuccaagcagagucgacaucauggaaugaaccaaaucuggcaggaucugcucgggg

SEQ ID NO: 167744 - RNA, 64 nt, Human
uggauguagaaaauaaaauucaagaaaagaacguugaaccaaauauuagcuuugauggcagcau

SEQ ID NO: 167745 - RNA, 64 nt, Human
cauuauaaacuuuuuccauucauaaauacauaagugaaccaaagguuuuuguccuuuccuucac

SEQ ID NO: 167746 - RNA, 64 nt, Human
cacguagaacuuggauguaccugcccccaauccaugaaccaagaccauugaauucuugguugag

SEQ ID NO: 167747 - RNA, 64 nt, Human
gacuaaaacaucucuggugccaacguaauacuucugaaccaaaucacugugacucaaggaaagu

SEQ ID NO: 167748 - RNA, 64 nt, Human
aaagacgggauuuuaguuguccucagguucaauaugaaccaaguaguauucauguuguuauuau

SEQ ID NO: 167749 - RNA, 64 nt, Human
uaauaugcuuuggccaaauuugcuguuuauagagugaaccaagaugucaguuuuguauugggga

SEQ ID NO: 167750 - RNA, 64 nt, Human
auaaauaauagagcagaugguugccuuugggucuugaaccaaaauaagacuuacuaaaggaaga

SEQ ID NO: 167751 - RNA, 64 nt, Human
uuugcacucaaguauugucaagggaagcuuccugugaaccaaaguucucaggccaaggucucgc

SEQ ID NO: 167752 - RNA, 64 nt, Human
ccuggaguuguugggcaaggaugcugucauuuuuugaaccaaaagacaaacagguuaaaaggaa

SEQ ID NO: 167753 - RNA, 64 nt, Human
aaaacagguagugguaaccugacucuucuaaucuugaaccaaaaggaaaaccaugagacuguaa

SEQ ID NO: 167754 - RNA, 64 nt, Human
acauugauccucucucagccuuugcuugcuagucugaaccaaagaguuguuugggcauuugcug

SEQ ID NO: 167755 - RNA, 64 nt, Human
aagagcaagggccuccggagauccaaacugugauugaaccaagugcagacuccuaaugcucuug

SEQ ID NO: 167756 - RNA, 64 nt, Human
aaaguacauauuccauguugauuuaauucuaagaugaaccaauaaagacauaauucuugugacu

SEQ ID NO: 167757 - RNA, 64 nt, Human
acacaccggguugacagauagagaaaacuggguuugaaccaaaugccguagugacuugcugugg

SEQ ID NO: 167758 - RNA, 64 nt, Human
aggcaccacauacugaugacaauaaucuauacuuugaaccaaaaguugcagagugguggaaugc

SEQ ID NO: 167759 - RNA, 64 nt, Human
cagaaaaaaaacacacacacacacaacaaaaauuugaaccaaaacauuccguuuacauuuuaga

SEQ ID NO: 167760 - RNA, 64 nt, Human
cagcauuaaaaaauggugaaggggggaaauauuuugaaccaaagaccaaauguuaggccgccgu

SEQ ID NO: 167761 - RNA, 64 nt, Human
uaggccucguuagcucuaugguucauaugcuucuugaaccaagucacagggcacuucccagcca

SEQ ID NO: 167762 - RNA, 64 nt, Human
cguauacuugcucacuguucugauuuccuguuucugaaccaaguaaaaucaguccuagaggcua

SEQ ID NO: 167763 - RNA, 64 nt, Human
ggagcucacccaaggucaccaaacaacuugguugugaaccaacugccuuaaccuucugggggag

SEQ ID NO: 167764 - RNA, 64 nt, Human
acucauggaaaaauugucuccuaauuuggggagaugaaccaaccaaucaaugacaagaaaacgc

SEQ ID NO: 167765 - RNA, 64 nt, Human
uagcuuucagagugucucauugagucuagaucauugaaccaacacuuaaccaaaugucccacuc

SEQ ID NO: 167766 - RNA, 64 nt, Human
cccugguauccucaucaugauggaaaaaauacauugaaccaagggauccucccuccccuucaag

SEQ ID NO: 167767 - RNA, 64 nt, Human
guuuuuuuucugaguaugcauauaugugguugaaugaaccaaugugugauuguaucuuuuccau

SEQ ID NO: 167768 - RNA, 64 nt, Human
cccaaauauuaagcccuuaaaaaaauaaaaccucugaaccaaaaucuucccaggaauaguacuu

SEQ ID NO: 167769 - RNA, 64 nt, Human
agaagugggugagccagggucugaguuucacauuugaaccaaauaaaaugcugucaagagaaaa

SEQ ID NO: 167770 - RNA, 64 nt, Human
ucgaggacuuuaccugcugagccccgcaggccgcugaaccaaaggccuagauggggaggacuag

SEQ ID NO: 167771 - RNA, 64 nt, Human
gcagcuuucucuggaaaaugaaugcuaauuagugugaaccaaaagaguaaguaagagucugaag

SEQ ID NO: 167772 - RNA, 64 nt, Human
uccccuccgcacaggaaagguacccaguagauaaugaaccaaauuaaguucccucccuccagcc

SEQ ID NO: 167773 - RNA, 64 nt, Human
ugacagccuccaucccugucccccaucuuggugcugaaccaacgcuaagggcaccuucuuagac

SEQ ID NO: 167774 - RNA, 59 nt, Human
ucuggcuguugaagacaugagugacccacugaaccaagaacuuacuggaagugugccuc

SEQ ID NO: 167775 - RNA, 64 nt, Human
aguccucagugguuggcaauuguuucaaccaguuugaaccaagaacuuuccaggaaggcuaaag

SEQ ID NO: 167776 - RNA, 64 nt, Human
caaaucaagaucuauguagaauauaaaggaagccugaaccaauccuuccacauacuguuaagau

SEQ ID NO: 167777 - RNA, 64 nt, Human
uuuuaaaaggauaaaaaugcuuuauuuauacagaugaaccaaaauuacaaaaaguuaugaaaau

SEQ ID NO: 167778 - RNA, 64 nt, Human
ucaguguucauagucguuucguuuugauaauuguugaaccaauuuuguuuuuaaaaccuuuaga

SEQ ID NO: 167779 - RNA, 64 nt, Human
gugauaugguaauuuucauaacagaugucaguuuugaaccaagaauuggugauuuguuuauaag

SEQ ID NO: 167780 - RNA, 64 nt, Human
ggaccuugcauggcuucuggggcaaaaauaaaucugaaccaaacugacggcauuugaagccuuu

SEQ ID NO: 167781 - RNA, 64 nt, Human
caguauccuuuauacaguuguauaaacuguauuuugaaccaaaacauauagguuacuacuuaau

SEQ ID NO: 167782 - RNA, 64 nt, Human
ucuggagauuauccaugggugaugagggacuggcugaaccaaagaaacaauuuucuucuuccuu

SEQ ID NO: 167783 - RNA, 64 nt, Human
acuaaagugucaggauaugcauuagauucucuccugaaccaaaaacacaacagucauuaucugu

SEQ ID NO: 167784 - RNA, 64 nt, Human
uuuauuagaaaauauuugaaaguauuuuuauuaaugaaccaaaaugacauguucauuugacuac

SEQ ID NO: 167785 - RNA, 64 nt, Human
auaauuugccacaguaaugucgaaacuaggccuuugaaccaaggcagucuaggguaaaauauag

SEQ ID NO: 167786 - RNA, 64 nt, Human
uaaaaaauaaaaaaauaaaaacccacaaaaauguugaaccaaaccucccugcuaaucuccaugc

SEQ ID NO: 167787 - RNA, 64 nt, Human
uuuaucuaaauguguuucaaggaaacacaaucgcugaaccaaaacguacugcagccgagccccc

SEQ ID NO: 167788 - RNA, 64 nt, Human
aaccaacugaaggcuaaaaagcaacaggccauugugaaccaaugcaagacgcccucuaucaugg

SEQ ID NO: 167789 - RNA, 64 nt, Human
auuaacaaaaacagcuucaacuguucgaauuuuaugaaccaauguaacucuggccucaaucaua

SEQ ID NO: 167790 - RNA, 64 nt, Human
aauuuccuuuaccuuucuggaacacaagcugcugugaaccaaacugauaucaagugauuagcuc

SEQ ID NO: 167791 - RNA, 64 nt, Human
ggacuuaacggaaguugaaccaguugguucuagaugaaccaauuaucuggaaaaugaaagaacc

SEQ ID NO: 167792 - RNA, 64 nt, Human
ggagcugggggaggggaggucuguuacugaaagaugaaccaacuuaguaacuguuuaaacaaag

SEQ ID NO: 167793 - RNA, 64 nt, Human
aagggaaaaaguauguugaaaauuuagacauaaaugaaccaagaauauuccuuaucuggugaug

SEQ ID NO: 167794 - RNA, 64 nt, Human
ucucuggugcucagaaacccuguggauuucccucugaaccaagauuuuuaguaguaaaauaaac

SEQ ID NO: 167795 - RNA, 64 nt, Human
cugaaaaucaccauuuuaaaguuauuuuuucaguugaaccaaaguuuaagugaagaggacuuuu

SEQ ID NO: 167796 - RNA, 64 nt, Human
guucuuuggugaagccaucuaucugaaacuaaaaugaaccaaacccauauuucacuggugguug

SEQ ID NO: 167797 - RNA, 64 nt, Human
cugaggccagggacgaguguucagugggccacagugaaccaaccaaaccaaccccgaaucaucg

SEQ ID NO: 167798 - RNA, 64 nt, Human
caguuaauaugcugcacaccacacacuuguuuagugaaccaaaucuagaaaguaccaaggcaga

SEQ ID NO: 167799 - RNA, 64 nt, Human
accugacaggagggagaagaaaaaacaaaacacuugaaccaagaaacucaaauguaauccuacg

SEQ ID NO: 167800 - RNA, 64 nt, Human
ugagccuaaucugauucuuacaguuuuaccuucuugaaccaauguaaaaguuuuuuuaauguua

SEQ ID NO: 167801 - RNA, 64 nt, Human
guuucucuaaggaccccucaaacaugucgcaaaaugaaccaaacuucuggcuaggccucaaaac

SEQ ID NO: 167802 - RNA, 64 nt, Human
gcccaugugcaagaaaaugagggcuugagucgccugaaccaagagcaggaagagguugcuggag

SEQ ID NO: 167803 - RNA, 56 nt, Human
ggaagaaaaugagggcuugagucaccugaaccaagagcaggaagagguugcucagg

SEQ ID NO: 167804 - RNA, 63 nt, Human
caggucaugaacaacacugaagaaacgucaaagugaaccaaaucauuguuuuuauuuuacaaa

SEQ ID NO: 167805 - RNA, 64 nt, Human
uauguuugguugucuaauauucuuggauuugauaugaaccaacacauaguccuuguugucauug

SEQ ID NO: 167806 - RNA, 64 nt, Human
uuuuggggaaguggggcuugaagaagcagccuaaugaaccaacauaccguuuugugugugguuu

SEQ ID NO: 167807 - RNA, 64 nt, Human
guugcugcagucaccuuccucaucuugcaggugcugaaccaacaucaucaguuucuauucuaau

SEQ ID NO: 167808 - RNA, 64 nt, Human
ucuuguaauauccagagcuacuuuauaaauucucugaaccaaaaguauuuuccucaguguaucu

SEQ ID NO: 167809 - RNA, 64 nt, Human
ugccgcccgaccuugagggcugugccaauccuagugaaccaaaaugcaaacaacucacacaagu

SEQ ID NO: 167810 - RNA, 64 nt, Human
cacaaaugcaauaguuggucacugcauuuuuaccugaaccaaagcuaaacccgguguugccacc

SEQ ID NO: 167811 - RNA, 64 nt, Human
uguguguauauauacagagaaauguacauaugugugaaccaaauuguacgagaaaguaucuauu

SEQ ID NO: 167812 - RNA, 64 nt, Human
gcagaugcaaacaaguguccuccccugaauugugugaaccaaagcgucaggggcuuggggcaca

SEQ ID NO: 167813 - RNA, 64 nt, Human
ccagucaucuauaaacucaaccacauuuuaauguugaaccaaaaaaagauaauaaaauaaaaaa

SEQ ID NO: 167814 - RNA, 64 nt, Human
uuucagugaggacccuugggcuuuggaugcagcuugaaccaagaaaacgaggagggaaagggau

SEQ ID NO: 167815 - RNA, 64 nt, Human
ugaaagaugacaugaguaguaauucaccacuaucugaaccaagcaaggaucaaugugcugacug

SEQ ID NO: 167816 - RNA, 64 nt, Human
ccucuacugaauuauuccucuuuuaaaugguuaaugaaccaauaauuuuuaaaucauaccaaaa

SEQ ID NO: 167817 - RNA, 64 nt, Human
agcuguuauggcucaccucagaacaaaagagaauugaaccaaauuugggaguuugggguuuuau

SEQ ID NO: 167818 - RNA, 64 nt, Human
uggugcauuaguguggcacauuuguuacaaaugaugaaccaauauuaauuuauuauuaauuaua

SEQ ID NO: 167819 - RNA, 64 nt, Human
ugaucaggaagauauauuccugcauaacucaaucugaaccaaggauuguaguuuaguuuuccuc

SEQ ID NO: 167820 - RNA, 64 nt, Human
auuagucucaggcugcugauggauugauuugacaugaaccaaacacagccaaacucgauaccca

SEQ ID NO: 167821 - RNA, 64 nt, Human
caaugcaagcuccugggcccacccccagaccuccugaaccaaaagcuccagggcuggccguaug

SEQ ID NO: 167822 - RNA, 64 nt, Human
agaaucgcuugaaccugggaggcggagauugcagugaaccaagaucgggccacugcacuccagc

SEQ ID NO: 167823 - RNA, 64 nt, Human
auuuguguguuguaaaguguuuuguuaggugguaugaaccaaugugaggaggcuugagacaggg

SEQ ID NO: 167824 - RNA, 64 nt, Human
cgucucuuuaugaugaggauaagguucccagggaugaaccaauucacauucucaauguggcuau

SEQ ID NO: 167825 - RNA, 64 nt, Human
ggucaugcaguuaguaaguggcagaacagggacuugaaccaagcccucugcucugaagaccgcg

SEQ ID NO: 167826 - RNA, 64 nt, Human
cuccaaaacaacuccaaaaacaacucacaaagcaugaaccaaacuuucacagcauaauuucaag

SEQ ID NO: 167827 - RNA, 64 nt, Human
uagaagaauccauccaaaucccugccuuccucucugaaccaacaguucccuucucugacagggg

SEQ ID NO: 167828 - RNA, 64 nt, Human
uguaguugacuccaagucucugugagcagugacuugaaccaaacacaccaggaauaauccauuc

SEQ ID NO: 167829 - RNA, 64 nt, Human
ccacuguccuuagaagaaagggcauuuuuacuuuugaaccaaaaagagaaaaaaaaaucagaag

SEQ ID NO: 167830 - RNA, 64 nt, Human
cccagaagguaccauuaggugccaugauccaggcugaaccaauauacaguggggcugaagucug

SEQ ID NO: 167831 - RNA, 64 nt, Human
uugaaauauaauucuguuucugaccuguuuuaaaugaaccaaaccaaaucauacuuucucuuca

SEQ ID NO: 167832 - RNA, 64 nt, Human
uugaaauauaauucuguuugugaccuguuuuaaaugaaccaaaccaaaucauacuuuuucuuug

SEQ ID NO: 167833 - RNA, 64 nt, Human
accacucccagcuucucguguccagugaaaccccugaaccaagaucacugaauuuuuguuuuuu

SEQ ID NO: 167834 - RNA, 64 nt, Human
auauauaugggggaaauuaacuuuuuuuuuucauugaaccaagugcaaugcaucagagaguuuu

SEQ ID NO: 167835 - RNA, 64 nt, Human
aauaaauuccuugaaagauauaaccccccaagauugaaccaagaagaaauugcaucccugaaca

SEQ ID NO: 167836 - RNA, 64 nt, Human
guugcauuucuauacaccaguaauguccaagcuaugaaccaaaucaagaauggaaucccauuca

SEQ ID NO: 167837 - RNA, 64 nt, Human
cucacggcauggccucugccuuccccagagcaggugaaccaagggagaggaaggagcaagccac

SEQ ID NO: 167838 - RNA, 64 nt, Human
aggaaaaauugucauuuaguuuccuuuucccaugugaaccaaauuucagggucaccagaaguuc

SEQ ID NO: 167839 - RNA, 64 nt, Human
agaauugcuugagcccgggaggcagaggcugcagugaaccaagaucaugccacugcacuccagc

SEQ ID NO: 167840 - RNA, 64 nt, Human
ggucacagcaggggagggagggacaauuuuauaaugaaccaaaaauuccauguguuggggggug

SEQ ID NO: 167841 - RNA, 64 nt, Human
ugauucggauguuauauuaaaaacauagauagaaugaaccaauaugaacugcaggcaaagucug

SEQ ID NO: 167842 - RNA, 64 nt, Human
caggagaaucacuugaacccaggagguguugcagugaaccaagaucacaccacugcacuccagc

SEQ ID NO: 167843 - RNA, 64 nt, Human
aagcuguuugcagaaaacugggugguagcgugucugaaccaaacggaagaauagccagcggagc

SEQ ID NO: 167844 - RNA, 64 nt, Human
uugcugcagggggggacccccccccguccccaggugaaccaagggucugcuccggggcccauuu

SEQ ID NO: 167845 - RNA, 64 nt, Human
guuucugccacuugcucuccucagaguuggcuuuugaaccaaagugcccuggaccaggucaggg

SEQ ID NO: 167846 - RNA, 64 nt, Human
ccccaaaggcauccauagugcacuagcauuuucuugaaccaauaauguauuaaaauuuuuugau

SEQ ID NO: 167847 - RNA, 64 nt, Human
auuaaaugcuuugauauucucagaucagccaucuugaaccaaagcaaaaccacaaguuacacuu

SEQ ID NO: 167848 - RNA, 64 nt, Human
uuucugaagccccaugucccuggugaaggaggacugaaccaaggacucugugagggcaggugag

SEQ ID NO: 167849 - RNA, 64 nt, Human
acccuggcagugcacugguaagcagacacugcacugaaccaacugcuaugcucagaauguacca

SEQ ID NO: 167850 - RNA, 64 nt, Human
uuucaggaauuggcacacucucuuccacaaugguugaaccaauuuacauucccaacaguguaaa

SEQ ID NO: 167851 - RNA, 64 nt, Human
ggguggauauggauucuaaggauucuagccugucugaaccaauacaaaauuucacagauuauuu

SEQ ID NO: 167852 - RNA, 64 nt, Human
gcugcaacuuggagaaccucccugcccugaaaugugaaccaagcacacuuugguuccuucuccg

SEQ ID NO: 167853 - RNA, 64 nt, Human
gcugcguuuuccauaaaccugauuuugccucacaugaaccaaagacucucaaaacuccgcuucu

SEQ ID NO: 167854 - RNA, 64 nt, Human
cuaagcaaggaauauaagauuucaaauaaaauuuugaaccaaaaacauuuauaaugccguucug

SEQ ID NO: 167855 - RNA, 64 nt, Human
gugacuguugcccuuagccagccagaugcgccugugaaccaaagcuucgugcacauguguuccc

SEQ ID NO: 167856 - RNA, 64 nt, Human
ccauuggccuccaaaagugcugagauuacaggcaugaaccaauguuaccgcacccugccucuau

SEQ ID NO: 167857 - RNA, 64 nt, Human
ucaccuaucugugaccuggaagcucccuccccacugaaccaauguucuucuuacauauauugau

SEQ ID NO: 167858 - RNA, 64 nt, Human
uuuucgaucagcccagaccagaggcucugagcccugaaccaaagucccagagcugggcugggac

SEQ ID NO: 167859 - RNA, 64 nt, Human
ggcacccuccuuuaugacauccauccaucuguggugaaccaagugaagguggugacuucuggug

SEQ ID NO: 167860 - RNA, 64 nt, Human
caggagcuaccucauaggguuguugaggauuaagugaaccaauacauauacagugcuuagcacu

SEQ ID NO: 167861 - RNA, 64 nt, Human
auacaauggucacuuugugauagaauuccauugaugaaccaauuuucugcagccucuuuuugcc

SEQ ID NO: 167862 - RNA, 64 nt, Human
ucucagccuguuaucuggcuuauccaucaguuucugaaccaacaucaggggcaccugccaugau

SEQ ID NO: 167863 - RNA, 64 nt, Human
ccuuuguauuuuaaaauccuucagaauacauuuaugaaccaaugcgacuggacuuagccacaca

SEQ ID NO: 167864 - RNA, 64 nt, Human
uuuuuuccauaauuaauuuugauaccauagugugugaaccaagaauaaucuagucacgugaaac

SEQ ID NO: 167865 - RNA, 64 nt, Human
cguuuugacaccuuuccuauagaugauauaggaaugaaccaauacgcuuuuauuacccuuucua

SEQ ID NO: 167866 - RNA, 64 nt, Human
auguauguaguccuacaacugcaaaacgucuuacugaaccaacaaucaaaaaaugguucuguuu

SEQ ID NO: 167867 - RNA, 64 nt, Human
aaauauuuugcuauuucuucugcauaagugacagugaaccaauucaucaugaguaagcucccuu

SEQ ID NO: 167868 - RNA, 64 nt, Human
ucuuguuaucugcaucucauuguuuauuguauuuugaaccaaucuacaagucucugucuuuuaa

SEQ ID NO: 167869 - RNA, 64 nt, Human
uaccaaauggauauauuuucuuuaggauaaccuuugaaccaacaaucuucaauaacaauaguac

SEQ ID NO: 167870 - RNA, 64 nt, Human
aaagcaugguuuguggcuuuuugcaaaauuacuaugaaccaaaaguugacaaauguuccaaagu

SEQ ID NO: 167871 - RNA, 64 nt, Human
ugaaguuuugacaccuuuccuauagauauaggaaugaaccaauacgcuuuuauuacccuuucua

SEQ ID NO: 167872 - RNA, 52 nt, Human
cuuuucaauuacagaucuaaauugaaccaaguguuuuuacaugacaaguucu

SEQ ID NO: 167873 - RNA, 64 nt, Human
acacuccagccugagcaacagagugagacccugucucuuaaagaaaaaaaaagucagacugcug

SEQ ID NO: 167874 - RNA, 64 nt, Human
uugucaucaguaaccuacugccugagaucaugaucucuuaaaagaugagacucucggaaggguu

SEQ ID NO: 167875 - RNA, 64 nt, Human
aaacuaaacauuuauuuuaaacuuauuaaauugacucuuaaacuaaguuuuuagucuuuaauuu

SEQ ID NO: 167876 - RNA, 64 nt, Human
aaauuuggacuaaaagguuuuauugaaauaaagccucuuaaaaugaaaaaucauauacuuuuaa

SEQ ID NO: 167877 - RNA, 64 nt, Human
acauacacauuucaugcuuggagugucuccacaacucuuaaaugauguaugcaaaaauacugaa

SEQ ID NO: 167878 - RNA, 64 nt, Human
gacgguucuuuucuagauuuccucuaccuuuuugcucuuaaaacugcuucucugcucugagaag

SEQ ID NO: 167879 - RNA, 64 nt, Human
ccuuccccuguuguccaguccaacuccacagucacucuuaaaacuucucucuguuugccugccu

SEQ ID NO: 167880 - RNA, 64 nt, Human
uugauugauuuucuuguaugcuucuuuauacaugcucuuaaaacuugugguugaaaucugugcu

SEQ ID NO: 167881 - RNA, 64 nt, Human
uucaacaacuauugaaauaugaaaugccugugaacucuuaaagcuucaugagcagcugcuugag

SEQ ID NO: 167882 - RNA, 64 nt, Human
gacacugcgaaaccaagcugacucacaagaagaccucuuaaaaauagcaacccuucauuugcuc

SEQ ID NO: 167883 - RNA, 59 nt, Human
ugacaaauccaaaucuauagaguauuugccucuuaaaugauaccucauugauauauugc

SEQ ID NO: 167884 - RNA, 64 nt, Human
aaauuaauuuacaaugucccugauauugagcuaacucuuaaaaaaaccaaacaaaacucguauc

SEQ ID NO: 167885 - RNA, 64 nt, Human
cguccaacuaugcccaggcugaaguccucacccucucuuaaagcggcaccaacgugagagagac

SEQ ID NO: 167886 - RNA, 64 nt, Human
uuucaaguuuauucuggaaugugaugucuugguccucuuaaaagcagaucagccaugacugaaa

SEQ ID NO: 167887 - RNA, 64 nt, Human
agguucucuuuugacuaauagagcuccauuuccccucuuaaaugagaaagcauuucuuuucucu

SEQ ID NO: 167888 - RNA, 64 nt, Human
gagggucguuuugacuacuagagcuccauuucuacucuuaaaugagaaaggauuuccuuucuuu

SEQ ID NO: 167889 - RNA, 64 nt, Human
acaacaccagaacugugugucucaugguauguaacucuuaaagcaaauaaaugaacugacuuca

SEQ ID NO: 167890 - RNA, 64 nt, Human
uggcccacugcaucguuucaucuuccaacucaaacucuuaaaacccaagugccuuagcaaauuc

SEQ ID NO: 167891 - RNA, 64 nt, Human
gaaguucuccuuaaauuuuucaauaaaaauuuagcucuuaaaaaaauaacagugugacugagug

SEQ ID NO: 167892 - RNA, 64 nt, Human
gugauuuuguuuauauuauguaaaauauaacgaucucuuaaaaauaccacaguuuguauuuuuu

SEQ ID NO: 167893 - RNA, 64 nt, Human
aagagaugaacuguguauuuaacuuaagcuauugcucuuaaaaccagggagucagaauauauuu

SEQ ID NO: 167894 - RNA, 64 nt, Human
guaaggagaguuuuugaauaauucuaauaagugccucuuaaaauuguauguuacuuauuuccag

SEQ ID NO: 167895 - RNA, 64 nt, Human
uaggggugcaugccagcauaccuggcuacguugacucuuaaaaucuauguucucuuauuuuaaa

SEQ ID NO: 167896 - RNA, 64 nt, Human
agagagccuuaguuagauuaaagggagacccuaccucuuaaaaccaguuuucauuuaugcaaac

SEQ ID NO: 167897 - RNA, 64 nt, Human
guuucaguucugacauuauguguuuuuguuguugcucuuaaaauugagacggggucucacucug

SEQ ID NO: 167898 - RNA, 64 nt, Human
agguucuggcgucaaauagcgacauuuccaguuucucuuaaaaaccguguuugguuucaguugg

SEQ ID NO: 167899 - RNA, 64 nt, Human
cccacuuuuaugacaguuuucuuccgcagcuuggcucuuaaauuuuacuggcagguguaugguu

SEQ ID NO: 167900 - RNA, 64 nt, Human
uuuuguucaaggauaugcugacccauauaguuuacucuuaaaauugugucaagguauuucucac

SEQ ID NO: 167901 - RNA, 64 nt, Human
cuagggcuuccugggguucccuucuugggccugccucuuaaaggccugagcuagcuggagaaga

SEQ ID NO: 167902 - RNA, 64 nt, Human
aagaucugcuuuuucuauuucucccaaccaaauccucuuaaagacccuuugcuauguagucuca

SEQ ID NO: 167903 - RNA, 64 nt, Human
gcacuccacucugggcaacagaaugagauccugucucuuaaagaaaaaaaauaaacucaagaau

SEQ ID NO: 167904 - RNA, 64 nt, Human
ucuuuuuugcuacaaguaaucagccccauguguucucuuaaacugagaauugcaccugggcaau

SEQ ID NO: 167905 - RNA, 64 nt, Human
uucauguuuauuugagcucucuuuauagaauuuucucuuaaaguuucaaaccucuaaguuguag

SEQ ID NO: 167906 - RNA, 64 nt, Human
gacucugaagucucuauuuuccaaguuguccuuucucuuaaaauacccuuuacugauuuaauac

SEQ ID NO: 167907 - RNA, 64 nt, Human
uacuuccucugugagacaggccauaacugaaaaacucuuaaauauuuagcaaucaaauaggaaa

SEQ ID NO: 167908 - RNA, 64 nt, Human
gcacuccaaucugggugacugagcaagacccugucucuuaaaaaaauaaaaaagaucuccaagc

SEQ ID NO: 167909 - RNA, 64 nt, Human
aggauccacuugugcauguaguugagaccacugucucuuaaaauauagcacuuuucaauucucu

SEQ ID NO: 167910 - RNA, 64 nt, Human
aaccugaaaauguuucauguucucugcugugaaacucuuaaaacaaggaguguauuuuagagac

SEQ ID NO: 167911 - RNA, 64 nt, Human
caggugggccugugucuucaggugcuuugccaaacucuuaaaagaaaguguccagugaacuugg

SEQ ID NO: 167912 - RNA, 64 nt, Human
ggaugguugagcacaaaaaaccaccucuacauuucucuuaaagguagguuggcaacguucuuuu

SEQ ID NO: 167913 - RNA, 64 nt, Human
aagugguacuaugguuacuuccuuguguacauuucucuuaaaagugauauuauaucuguuugua

SEQ ID NO: 167914 - RNA, 64 nt, Human
ucuccuuuucuuacucuccccucaugguguuccccucuuaaaggagaggagcuuuuaauuuaca

SEQ ID NO: 167915 - RNA, 64 nt, Human
cugaaugauggucugggugccaccuguuuuuaaacucuuaaaccuggaacuccuuaaauggggu

SEQ ID NO: 167916 - RNA, 64 nt, Human
cauacauagucacugagcaccugcgguccauuuccucuuaaaaguuuuguuuugauuuguuucc

SEQ ID NO: 167917 - RNA, 64 nt, Human; identical to SEQ ID NO: 84872

SEQ ID NO: 167918 - RNA, 64 nt, Human
ugauuccuauggcaccagccaggaaaaauggcagcucuuaaaggagaaaauguuugagcccagu

SEQ ID NO: 167919 - RNA, 64 nt, Human
uaaggaguuaucaauacuucuggcuuuaugagagcucuuaaauuuugucuaaaaaaccaaaggg

SEQ ID NO: 167920 - RNA, 64 nt, Human
cauauacaugauuucagaagaugacauaagauuccucuuaaagaggaaaugucaggaaucaagc

SEQ ID NO: 167921 - RNA, 64 nt, Human
caauuuaaaugacacagaacuuuguacuuuucagcucuuaaaaauguaaauguuacauguauau

SEQ ID NO: 167922 - RNA, 64 nt, Human
uuagguuuacuucuugucucuccaaguggcuccucucuuaaaagacagaaacuaggguuuaguc

SEQ ID NO: 167923 - RNA, 64 nt, Human
uucaaugaguuauuggauuagaccaauuacugcacucuuaaacagcaccaccauuuaauuucau

SEQ ID NO: 167924 - RNA, 64 nt, Human
ggugcaucacaauggacacagaaugcugcugcuccucuuaaaaauuaaaugugucauauuauau

SEQ ID NO: 167925 - RNA, 64 nt, Human
uuccuuuccccuuuaggcacccucuaccuggcagcucuuaaaacuaagaaaaaauaugauauac

SEQ ID NO: 167926 - RNA, 64 nt, Human
cacauuguaaaacauugcccaucugucuugcucacucuuaaacucucccaagaacaaggccggg

SEQ ID NO: 167927 - RNA, 64 nt, Human
cuaacaaacgcagaaggcuuuggcucgucauuuccucuuaaaaaggaggagcugggcuucagcu

SEQ ID NO: 167928 - RNA, 64 nt, Human
uaguuucaaacacaacuugaaaauuaaaagugcccucuuaaaaauacaaaaaucaaaaagagga

SEQ ID NO: 167929 - RNA, 64 nt, Human
acucuuuagucuuuucugaauuaaagaauaagugcucuuaaauccauauuuuauccugucaaag

SEQ ID NO: 167930 - RNA, 64 nt, Human
aucuuuuuggaaucggaccugguugaguaaggaccucuuaaaagggaaaaauaaauuuugccgu

SEQ ID NO: 167931 - RNA, 64 nt, Human
ugauaaggaagaugaagggucuucagagaagaaccucuuaaaaggcccacgggugcaccagggc

SEQ ID NO: 167932 - RNA, 64 nt, Human
ugcagcaguugcuagcaacaacuuacuaaaucuacucuuaaauauacaacuuuggaauuugaag

SEQ ID NO: 167933 - RNA, 64 nt, Human
cuucagacucaccauaauugcugauaauuacccacucuuaaauuugucgagugauuuuuagccu

SEQ ID NO: 167934 - RNA, 64 nt, Human; identical to SEQ ID NO: 84830

SEQ ID NO: 167935 - RNA, 64 nt, Human
uggaaauuuaucauguuuaaaaauuauucaagcacucuuaaaaccacuuaaacagccuccaguc

SEQ ID NO: 167936 - RNA, 64 nt, Human
aagcaauuuucauaguaguaaaguuuuuuuucaucucuuaaacuaaauugaccaugcauauaau

SEQ ID NO: 167937 - RNA, 64 nt, Human
uaugggaguagaaaacaacaaagaauggaauggacucuuaaaacaaugaaagagcauuuaucgu

SEQ ID NO: 167938 - RNA, 64 nt, Human
ccaucagaagguucuggucaacagucaguauuaucucuuaaauguauauguuggucacuaauug

SEQ ID NO: 167939 - RNA, 64 nt, Human
gugaggagggaagacaauucugugaacucuguaacucuuaaaauuuuugaaaacuccaucguua

SEQ ID NO: 167940 - RNA, 64 nt, Human
acauuaaguauaaaauaaauuauguucuuaaugccucuuaaaccacuuacauucaaaggggaac

SEQ ID NO: 167941 - RNA, 64 nt, Human
ccauuacuaaacuauuacucuuucucaccugaugcucuuaaaagguugcuacagguuuuuugau

SEQ ID NO: 167942 - RNA, 64 nt, Human
caugcuaaauggaaagacuuuaugaaauccuucucucuuaaaaaggaauuuauuguaaaagaau

SEQ ID NO: 167943 - RNA, 64 nt, Human
ucuuucccuugcccugacuguuggaguaaaaaaccucuuaaauccauuguaucagagguccuua

SEQ ID NO: 167944 - RNA, 64 nt, Human
gagcucuuugaagccaaccaaggcaggcagaacccucuuaaauaugagacugauguauagguuc

SEQ ID NO: 167945 - RNA, 64 nt, Human
aaugucucucucacccccuagcuucaugaugugacucuuaaaaaacuauaauaguuaacaacug

SEQ ID NO: 167946 - RNA, 64 nt, Human
acauacugaaugcugaaguauacauaugcuauuucucuuaaaccucagagcaaccauaugagca

SEQ ID NO: 167947 - RNA, 64 nt, Human
uuuuauucacuaagcucgauaaaucuaacaguuacucuuaaaaaaaaaaaaaaaagacuaaggu

SEQ ID NO: 167948 - RNA, 64 nt, Human
cuguaacgccuucagucagucucuggggaugaaacucuuaaaugcuuuguauauuuucucaauu

SEQ ID NO: 167949 - RNA, 64 nt, Human
ccgucuaugucuucccagcucagccuuuuccccacucuuaaauacuguacuacuucacuguaag

SEQ ID NO: 167950 - RNA, 64 nt, Human
uaaauuaaucagccccagagugcuuuaaaaaauucucuuaaauaaaaauaauagacucgcuagu

SEQ ID NO: 167951 - RNA, 64 nt, Human; identical to SEQ ID NO: 84831

SEQ ID NO: 167952 - RNA, 64 nt, Human
ccuugugcagucaaagagcgcuuccagaaggaaucucuuaaaacauaaugagagguuugguaau

SEQ ID NO: 167953 - RNA, 64 nt, Human
caagucccaccugggcaacauaguaagaucuugucucuuaaagaaaaaaaaaaaagguacuuag

SEQ ID NO: 167954 - RNA, 64 nt, Human
cucccagccuggggggucguggcagauaaucagccucuuaaagcugccuguaguuaggaaauaa

SEQ ID NO: 167955 - RNA, 64 nt, Human
aaaccaaguaugcuugaguuuugcgaauguucuccucuuaaagaauagcuucaaauuuugagac

SEQ ID NO: 167956 - RNA, 64 nt, Human
auauugaagcuuguauuuuuaacuguugcuuguucucuuaaaagguaucaauguaccuuuuuug

SEQ ID NO: 167957 - RNA, 64 nt, Human
accugggguaggcugcaggggugggcagaagccccucuuaaauugugguugccaugguaccgag

SEQ ID NO: 167958 - RNA, 64 nt, Human
ccacuugcugugaccuuauacauguugggguuugcucuuaaagaggagagcaggaagaaagguu

SEQ ID NO: 167959 - RNA, 64 nt, Human
uuuccuucaaguguugacuagggagucgguuucucucuuaaagacacucacuguacaacugaaa

SEQ ID NO: 167960 - RNA, 64 nt, Human
auuacaggcgugagccaccgcgcccggccugauucucuuaaaauugaagaggugcugccaaggc

SEQ ID NO: 167961 - RNA, 64 nt, Human
uuuucauuauaggaaguuuuauugggcagugcugcucuuaaauccuaccuuccacucaacuccc

SEQ ID NO: 167962 - RNA, 64 nt, Human
ccagugucaguauuuacucugcuccaaaguagaacucuuaaauacuuuuucaguuguuuagauc

SEQ ID NO: 167963 - RNA, 64 nt, Human
uguguaaagguuaaauaacaaaacuaugcagaugcucuuaaaagcauugauaaccuuugugacg

SEQ ID NO: 167964 - RNA, 64 nt, Human
ggguuuuuuaaaacucucuguuguuuguaauauucucuuaaaagcuugaaaauaaaacuucuuu

SEQ ID NO: 167965 - RNA, 64 nt, Human
ggcugaugguuauugccuuauuuugacugcauuucucuuaaauggaucauuuaaauuaguucuu

SEQ ID NO: 167966 - RNA, 64 nt, Human
aguuuguggaguuccuuuauuuguaauauaugugcucuuaaaagcaaugggaugugaaauuaug

SEQ ID NO: 167967 - RNA, 64 nt, Human
aaagggcccagagauaucaaggaagcuuuucauucucuuaaagcuuuuggguccuuuacuugaa

SEQ ID NO: 167968 - RNA, 64 nt, Human; identical to SEQ ID NO: 84854

SEQ ID NO: 167969 - RNA, 64 nt, Human
agaguauuuucaguaauaaacgugccaucucuaucucuuaaacauuuauuacaacaauuguuuu

SEQ ID NO: 167970 - RNA, 64 nt, Human
cuuauuacaugagcaauuucaucaaaucuccaaacucuuaaaggaugcuuucggaaaacacgcu

SEQ ID NO: 167971 - RNA, 64 nt, Human
gguucuggucauuccccaagcaacaucucagcaucucuuaaaguugccugcaggaaugaagcau

SEQ ID NO: 167972 - RNA, 64 nt, Human
aaauauuugcuguguaaaguauuuuuuguuuauucucuuaaaagaucacuauauuuaaauaaaa

SEQ ID NO: 167973 - RNA, 64 nt, Human
aaaaguaggagaggcagauucccucagugucuuccucuuaaaccucaaucaucgagacauuagg

SEQ ID NO: 167974 - RNA, 64 nt, Human
cuuguuugacaacaagacagucuguaaaguauugcucuuaaaaacaauuaaaaagaacccuuuc

SEQ ID NO: 167975 - RNA, 64 nt, Human
aauaccagguuuaaggguauuuuaaacacagcuccucuuaaauccuccaaucucaguacccagu

SEQ ID NO: 167976 - RNA, 64 nt, Human
ucucaucaugauuuuaaacugugcgugauauaaacucuuaaagauauguugacaaaaaguuauc

SEQ ID NO: 167977 - RNA, 64 nt, Human
uggggacaaacagaaccauuuucuuccucuuuaccucuuaaaacagcagaaguacaagaauaca

SEQ ID NO: 167978 - RNA, 64 nt, Human
guaaugugugggauauaaauuaguuuuuauuauucucuuaaaaaucaaagaugaucucuaucac

SEQ ID NO: 167979 - RNA, 64 nt, Human
uauugcauugcuauccguggauacagacgcuuagcucuuaaaagauuuuuuuuuuauguaaacu

SEQ ID NO: 167980 - RNA, 64 nt, Human
agguguucuaauccaauugcaugauguaguaagccucuuaaauauguguguuaaauauauugag

SEQ ID NO: 167981 - RNA, 64 nt, Human
caagaccagccugggcaacacagcgagaccccaucucuuaaaaaauaacagacuugaggaaccc

SEQ ID NO: 167982 - RNA, 64 nt, Human
cacuccgugcaguucucugaauugagagauguaccucuuaaaccucgucagugguuauucaggg

SEQ ID NO: 167983 - RNA, 64 nt, Human
ugcucuugucuugaguggugaccaaagcaguuggcucuuaaaaggugggagagcagcccaacca

SEQ ID NO: 167984 - RNA, 64 nt, Human
cuucuaggcccugaaagcagauuugguuccauaccucuuaaaauuacucgaaggcauuggccuu

SEQ ID NO: 167985 - RNA, 51 nt, Human
aauucacagccuuaaaguagccucuuaaaaaaaucacuaucuuggaaauaa

SEQ ID NO: 167986 - RNA, 64 nt, Human
caguuauucauucugugaucauuuauuuuaagcacucuuaaagcaaaaaaugaaugucuaaaau

SEQ ID NO: 167987 - RNA, 64 nt, Human
caucuaaauauugauuucacguuuuaaagaaauucucuuaaauuacaauugugcccaaugcagg

SEQ ID NO: 167988 - RNA, 64 nt, Human
cagagaguccaauuuauugagggauagauuguaucucuuaaaguggucauauuauuauuaauuu

SEQ ID NO: 167989 - RNA, 64 nt, Human
cuuuuuuaugugaugccaaagauguuugaaaaugcucuuaaaauaucuuccuuuggggaaguuu

SEQ ID NO: 167990 - RNA, 64 nt, Human
cgaagcaauacacccagacacaccagucuuguaucucuuaaaaguauggaugcuucauccaaau

SEQ ID NO: 167991 - RNA, 64 nt, Human
ccccacucuccccguccccuuuuauucccuuuuccucuuaaagagcugcucugagcugugggau

SEQ ID NO: 167992 - RNA, 64 nt, Human
uuugacacuggcuaggagcagaggcugcgucaggcucuuaaagucauguguuugcaugcuggau

SEQ ID NO: 167993 - RNA, 64 nt, Human
acuuaaaaguagccuuaagaacaauaauaaagugcucuuaaaccacauaguguacgugugcagu

SEQ ID NO: 167994 - RNA, 64 nt, Human
uauaccccuuggggaaauaauacaacaaaaacaucucuuaaaaaugcugggauggggccauauc

SEQ ID NO: 167995 - RNA, 64 nt, Human
cuguagagaggguucuaauugguucugcaauuugcucuuaaacucuagcagggaacucuccucu

SEQ ID NO: 167996 - RNA, 64 nt, Human
cuguuucucuuaaaauaaaauccauuuccuauuucucuuaaaauaaaauccauuauucuuaaua

SEQ ID NO: 167997 - RNA, 64 nt, Human
aaaugugauuaugcuuaacagcuguuuccuguuucucuuaaaauaaaauccauuuccuauuucu

SEQ ID NO: 167998 - RNA, 64 nt, Human
caugaauguuuaaaucgaaaaagcaaaacaacuacucuuaaaacuuuuuuuaugucucaaguaa

SEQ ID NO: 167999 - RNA, 64 nt, Human
ggcuuagaaaagacccuggccagaccugacuccacucuuaaaccugggucuucuccuuggcggu

SEQ ID NO: 168000 - RNA, 64 nt, Human
guucaaaacuacugucuucugucaaaguuuucuccucuuaaauguuauuuugcuuuuacgucuc

SEQ ID NO: 168001 - RNA, 64 nt, Human
uuuuuguguaccucuacagagaccaaaacucauucucuuaaagagauuuuauggggcuacugca

SEQ ID NO: 168002 - RNA, 64 nt, Human
aguauccugcauaacuuugggugaggaaauuguucucuuaaagaucagccauguucaggaaaug

SEQ ID NO: 168003 - RNA, 64 nt, Human
uuuauuuaaagagaaaaguuaccaguaucuacaccucuuaaaaaacauugauuggucuaaaaaa

SEQ ID NO: 168004 - RNA, 64 nt, Human
uauuaguguccuuuuuuauuucuaaugccuuguccucuuaaaaguuauuuuauuuguuauuauu

SEQ ID NO: 168005 - RNA, 64 nt, Human
auuuucauguaacucauuggaaacucugccaugacucuuaaaguagucuuacuuguuuuuuaaa

SEQ ID NO: 168006 - RNA, 64 nt, Human
aaguugggcuggaugaucuccaaagucguuucaacucuuaaagacaucuuaauccugaauguaa

SEQ ID NO: 168007 - RNA, 64 nt, Human
gcuaggcagacuguuaaguauuaggggaaaauugcucuuaaacuuuccuagcuauaagcuuaag

SEQ ID NO: 168008 - RNA, 64 nt, Human
cuuuauauguuaguucuuuuuuccaaacucccaacucuuaaaaguauuguagucuguuggugcc

SEQ ID NO: 168009 - RNA, 64 nt, Human
agguuuggaaugucuugucccaguucuucaaacacucuuaaauuuuucuuaaguaauguaaaaa

SEQ ID NO: 168010 - RNA, 64 nt, Human
acaguuugugaaauuguugcaagggcaaagauaacucuuaaaaaaccgucgagauuacaaugcu

SEQ ID NO: 168011 - RNA, 64 nt, Human
uugguggggacacagauaaccccuucgcuuccagcucuuaaaauucuuuaucuuuuucuuggca

SEQ ID NO: 168012 - RNA, 64 nt, Human
cuggcuuucauuugcugacuugauuauucccuuucucuuaaaaaccauggcauuagacugcacu

SEQ ID NO: 168013 - RNA, 64 nt, Human
cauauuuauccuaagccaucaaaugggguagugccucuuaaaccauuaacaguacuuuagacau

SEQ ID NO: 168014 - RNA, 64 nt, Human
uucacccuccccccuucucagaagagugaguaugcucuuaaaugucaaacacauuuuuguuguu

SEQ ID NO: 168015 - RNA, 64 nt, Human
auuauuacccauauuaugaagaaauacucugcaacucuuaaaaauaaauguaaugugccaggcg

SEQ ID NO: 168016 - RNA, 64 nt, Human
ugcacuccagccuggugacagagcaagacuccggcucuuaaaaaaaaaaaaaaaaaaaaaaaaa

SEQ ID NO: 168017 - RNA, 64 nt, Human
auuaacaaaaugcaucauggaaaaaaaaaucuaccucuuaaaauuccauuugcuuuuaugguua

SEQ ID NO: 168018 - RNA, 64 nt, Human
auauaaccuauaaauuuguuucuuccaagcuuagcucuuaaauuuggagacucaaaguuaaaca

SEQ ID NO: 168019 - RNA, 64 nt, Human
ucucauuccacuuuagcaaucuuuuugguaagaacucuuaaagccaaaagucugcugaaaagau

SEQ ID NO: 168020 - RNA, 64 nt, Human
ugugcuuuuuaaaaaaagugauucucuaacagaccucuuaaauugugacaugaagguauguaau

SEQ ID NO: 168021 - RNA, 64 nt, Human
gcugccucuuugcugcuuuguuuuccuccugauucucuuaaauuuggguugcaaagcuaucccg

SEQ ID NO: 168022 - RNA, 64 nt, Human
ugagaaauaagaaacuuuuuuuuccuacuaucaucucuuaaauuuuguuuucuuuuucuuuugc

SEQ ID NO: 168023 - RNA, 64 nt, Human
auccucacucaguccagcuuaguucaaguccugccucuuaaauaaaccuuuuuggacacacaaa

SEQ ID NO: 168024 - RNA, 64 nt, Human
uaaagcugaaaauuaaauuuuagaucuuucaauacucuuaaauuuuauauguaagugguuuuua

SEQ ID NO: 168025 - RNA, 64 nt, Human
guaguuuuucauaggucuguuuuuccuuucaugccucuuaaaaacuucugugcuuacauaaaca

SEQ ID NO: 168026 - RNA, 64 nt, Human
auauuuguacuguuuaauguucugugauacagaacucuuaaaaauguuuuuucauguguuuuau

SEQ ID NO: 168027 - RNA, 64 nt, Human
auugucugucugcucuuauuuuuguaccauauugcucuuaaaaaucuugguuugguacaguuca

SEQ ID NO: 168028 - RNA, 64 nt, Human
cuucauucuugugagaugauaaaacugggcacagcucuuaaauaaaauauaaaugaacaaacuu

SEQ ID NO: 168029 - RNA, 64 nt, Human
aaguauugcugaguccaacaauguuguuuuaagacucuuaaaauacgguaccuggcaauguuua

SEQ ID NO: 168030 - RNA, 64 nt, Human
aagggucguuaacucucccuuacaggugcuuugacucuuaaacgcugaucuuaagaagcucucu

SEQ ID NO: 168031 - RNA, 64 nt, Human
uucuaaaaaucuuccucugaagaccugacccaagcucuuaaaugcuauuguaagagaaauuucu

SEQ ID NO: 168032 - RNA, 64 nt, Human
aauucagggcagggacauuuccauuagaauggugcucuuaaaaauagaaacugaaccggggcgg

SEQ ID NO: 168033 - RNA, 64 nt, Human
gugggucacaguacuguguucuuaguugcuuuagcucuuaaaacauacgaaguguugccuaaac

SEQ ID NO: 168034 - RNA, 64 nt, Human
gaaaaaucuuugagaccucagggaggcucugucucucuuaaaagguggagaaagaugccauucu

SEQ ID NO: 168035 - RNA, 64 nt, Human
aaaauaguaaaguaggcagagcuagguuuauuuucucuuaaacaauuuuuaaaauucagaaugu

SEQ ID NO: 168036 - RNA, 64 nt, Human
uuugaauaagagauggccagaggauaacacuugucucuuaaaaacuaagcuaaaaagaaccuag

SEQ ID NO: 168037 - RNA, 64 nt, Human
gacacauuaaugaaugaccagcagcagcuuucagcucuuaaaaagacacuuauauuuugauuuu

SEQ ID NO: 168038 - RNA, 64 nt, Human
acauggccguacaaagagauggagccccgguggccucuuaaauuucccuuccgccacggaguuc

SEQ ID NO: 168039 - RNA, 64 nt, Human
cacucuaaucaaucugagucuauugcuguuucaacucuuaaaaucaauaucuccuacauuagua

SEQ ID NO: 168040 - RNA, 64 nt, Human
gugaaagagauguauggcauuuuaauuuggcaaucucuuaaauaauauugcccugcaaguaccc

SEQ ID NO: 168041 - RNA, 64 nt, Human
cccaagaagggcccuagaaauugauguggcuuuccucuuaaauauuaauuauuaguccugaaag

SEQ ID NO: 168042 - RNA, 64 nt, Human
uaaacagcauguuugacuugauuccaucauggugcucuuaaauuacaugucagugcaucacaua

SEQ ID NO: 168043 - RNA, 64 nt, Human
uuuuaaguuuauuacagaaaaaaaugcagaugaucucuuaaaauaaaacuaaagauaaagcaac

SEQ ID NO: 168044 - RNA, 64 nt, Human
uaucccaaccuggguucacuuggcccuucucuugcucuuaaaccacaccgaggugucuaauuuc

SEQ ID NO: 168045 - RNA, 64 nt, Human
ccagaccagccuggccaccuuagugagaucccuucucuuaaaaauaauaacuuauugccagauu

SEQ ID NO: 168046 - RNA, 64 nt, Human
auggcaggcaccagcaaagaguugagggcuguugcucuuaaaaauuauuuuuuuuauuauuauu

SEQ ID NO: 168047 - RNA, 64 nt, Human
uuuuuuuuuuucuauuuuugccagacucuugauacucuuaaaacuuguuuguggucagcacaac

SEQ ID NO: 168048 - RNA, 64 nt, Human
aaauuaugagcacaaugccaucacuuaacuauaacucuuaaagauagcuuaaugacuguuuauu

SEQ ID NO: 168049 - RNA, 64 nt, Human
ucagcaucuagguaaauuauuauuuuaauaacaacucuuaaauugccaaccucugagaggugaa

SEQ ID NO: 168050 - RNA, 64 nt, Human
ggaauucaguugguguccaagacuuaucuugagacucuuaaaagcaucagucuguaacuagaac

SEQ ID NO: 168051 - RNA, 64 nt, Human
cugcuuaauaauccucaauuuacacuauucauaacucuuaaaauuauucucuuuuuuucuaaga

SEQ ID NO: 168052 - RNA, 57 nt, Human
gcacacaguuuugucuuugaucacaugcucuuaaaaagggaguaacaccuauaacau

SEQ ID NO: 168053 - RNA, 64 nt, Human
acguggaauucugacagugcagggagccccaacccucuuaaaugucaaagacccuuuuugauua

SEQ ID NO: 168054 - RNA, 64 nt, Human
aacaacuauuuuuguuguuguuguuuguaaaugccucuuaaauuauauauuuauuuuauucuau

SEQ ID NO: 168055 - RNA, 64 nt, Human
uucucuuccucuugcccucccugccucuuuggugcucuuaaaagccagcagcugagaacauagc

SEQ ID NO: 168056 - RNA, 64 nt, Human
uggcauggccagacucugaccccacugcccuaggcucuuaaauacucauugggaggguccgagu

SEQ ID NO: 168057 - RNA, 64 nt, Human
uuaaaugcaauacagccucugauuauugagcuuccucuuaaaaagauuuuuuuauuuuauguag

SEQ ID NO: 168058 - RNA, 64 nt, Human
uaauccaugucuauaaucuaccaacaaagauguacucuuaaacucaguaucaccaggcacuaua

SEQ ID NO: 168059 - RNA, 64 nt, Human
cuggugcccauuccauuuguccaguuaauacuuccucuuaaaaaucuccaagaagcugggucuc

SEQ ID NO: 168060 - RNA, 64 nt, Human
aaaaaaaaaaaagucuguacuaauuucaauauggcucuuaaaaggaaugacagagaaauaggau

SEQ ID NO: 168061 - RNA, 64 nt, Human
gcucagcacgcacaaacuccuucuccuucuaccacucuuaaauuuacucccuccccacccagaa

SEQ ID NO: 168062 - RNA, 64 nt, Human
uugauagaaaucuagguugguucaaaccuuuuuacucuuaaaacaaugcugcaguuaacacccu

SEQ ID NO: 168063 - RNA, 64 nt, Human
cucucaaguguuccacaacaucuaggaaagugagcucuuaaagacagacuaaaaagaguaauaa

SEQ ID NO: 168064 - RNA, 64 nt, Human
gcuugguggugaagccaccaagcugucuuugguacucuuaaagcuucaguggccuagcaagauc

SEQ ID NO: 168065 - RNA, 64 nt, Human
uauuguuuucagauuucaacuuguauguguuugucucuuaaagcauuggugaaaucacauauuu

SEQ ID NO: 168066 - RNA, 64 nt, Human
aaaaucuauaugggauguaauuuuuuuguucagucucuuaaaaaauacuuuguuuugguacauu

SEQ ID NO: 168067 - RNA, 64 nt, Human
aagacagaccacaccuaaaacugccuuucugcuucucuuaaaggagaaguagcugugaacauug

SEQ ID NO: 168068 - RNA, 64 nt, Human
gauaccaaauaaacuucaguguuuucaucuaauucucuuaaaguugauaucuuaauauuuugug

SEQ ID NO: 168069 - RNA, 64 nt, Human
aauaaaaagcuaaagcugccaaauuucuguugaacucuuaaaaacagcucauguuuguuugucc

SEQ ID NO: 168070 - RNA, 64 nt, Human; identical to SEQ ID NO: 84833

SEQ ID NO: 168071 - RNA, 64 nt, Human
gaauuaaguuaaucugauguucauguucaccuuucucuuaaaauaauuguacaacugacuugua

SEQ ID NO: 168072 - RNA, 64 nt, Human
uuuuuuuuuuuagcauagauugagaacaguugaacucuuaaauccucagaugccaggggucugc

SEQ ID NO: 168073 - RNA, 64 nt, Human
ucuuuugaauccaugcuuggguguaacaggucuccucuuaaaaaauaaaaacugacuccuuaga

SEQ ID NO: 168074 - RNA, 64 nt, Human
gacagugguucucaaaauuuuuuucucucaggaccucuuaaaaaucaucaaggaccccaaaaag

SEQ ID NO: 168075 - RNA, 64 nt, Human
uacaggcuuuuuuuuccuuuuuuucccccaaaaucucuuaaaaugaggaaucucuuagcagacu

SEQ ID NO: 168076 - RNA, 64 nt, Human
uauuaaugcauuauuuuuuaaaaaguuuugauaacucuuaaagcaucauuugcaccuauguggg

SEQ ID NO: 168077 - RNA, 64 nt, Human
gaaacuguaaagcuuuuaugacucuaauauuaaucucuuaaaugaaauuaaaaggcaaaagaac

SEQ ID NO: 168078 - RNA, 64 nt, Human
ucuuuauuuauaacagucauucuuugauagucaacucuuaaauggagacuugagaugcuuaaau

SEQ ID NO: 168079 - RNA, 64 nt, Human
cucagaaaguacauuuagcuuguaguguugaauucucuuaaaggaaugcuugaauuuuuucauu

SEQ ID NO: 168080 - RNA, 64 nt, Human
auguuuacuucccaguggaaggagcacugaaaaccucuuaaagaaaaagcauuuguguguuuuc

SEQ ID NO: 168081 - RNA, 64 nt, Human
aaaugugaauuaucuuuugugucuauauugauagcucuuaaaggagugaaaaucuaaaauagua

SEQ ID NO: 168082 - RNA, 64 nt, Human
uauuucuauaauuuuuaaggacucuucauaaggacucuuaaaauaauccugaacauuagaaccc

SEQ ID NO: 168083 - RNA, 64 nt, Human
uuuuuccccccagaagauaaagaggauagacaaccucuuaaaauauuuuuacaauuuaaugaga

SEQ ID NO: 168084 - RNA, 64 nt, Human
uuuucauuuucuuccccaccccaacccccaugagcucuuaaauuuagauuucuaucucuuguaa

SEQ ID NO: 168085 - RNA, 64 nt, Human
caggacacuacugcuuaauauuuaauaucagauacucuuaaaucacaggagcauaacuaaagua

SEQ ID NO: 168086 - RNA, 64 nt, Human
guaaaauggaagugagauggcaagacucccguuucucuuaaaauaaguaaaauuccaaggauau

SEQ ID NO: 168087 - RNA, 64 nt, Human
accaccaauaauacuuaucagcaucauaaaguaucucuuaaacacugaucuuggcagggacgga

SEQ ID NO: 168088 - RNA, 64 nt, Human
ugaugauucaguaagguuaacaaugaaaauuaaacucuuaaaaagugacugcaacaaauaaacc

SEQ ID NO: 168089 - RNA, 64 nt, Human
ucuacugaauugcaauuuauuaaauauucuuauccucuuaaauaaaacugcucaacaguuaauc

SEQ ID NO: 168090 - RNA, 64 nt, Human
cauucacagacuagaacacaaggagggagagagacucuuaaacguaaauaaaaaugcaauucac

SEQ ID NO: 168091 - RNA, 64 nt, Human
aaagcauugucagauguagagugcucagauguggcucuuaaagacuauauacaucugaauuuuu

SEQ ID NO: 168092 - RNA, 64 nt, Human
caaggccaaccugggcaauagagcgagacccugucucuuaaaaaacgaugaugaugaacacaga

SEQ ID NO: 168093 - RNA, 64 nt, Human
ucuuaucagccugggcaacacagugagacuccaucucuuaaaaaaaaaauuagcuggguauagu

SEQ ID NO: 168094 - RNA, 64 nt, Human
gcaauguauaugaaaaccaaucugagccuuguaucucuuaaauauuuauuuuuuuuaacgugug

SEQ ID NO: 168095 - RNA, 64 nt, Human
uaguuugccaaagaaguuucugaagucuucacagcucuuaaaagccaggccaguacugacugug

SEQ ID NO: 168096 - RNA, 64 nt, Human
aguuguguugcuguuuuccacccauuuuauuauacucuuaaaagauguaauuguugucauuuug

SEQ ID NO: 168097 - RNA, 64 nt, Human
gauucaccuguguuuuguguucauguucauuugccucuuaaaggcaaggguugaagauaaauaa

SEQ ID NO: 168098 - RNA, 64 nt, Human
uaacuacugagauauucagagcauuuuuaccucucucuuaaauguuauaaaaaacaauuguauu

SEQ ID NO: 168099 - RNA, 64 nt, Human
ucaugaacuccuugcaucauaauuaccuagaugccucuuaaaaaugaagauuucagagacccau

SEQ ID NO: 168100 - RNA, 64 nt, Human
ucuccagaauguacuauccaucuugaugagaaaacucuuaaauaguaccaaacauuuugaacuu

SEQ ID NO: 168101 - RNA, 64 nt, Human
gcucuucagaucuguacaugcaguauuuaauuuccucuuaaacauguuaugaguucuacaaaga

SEQ ID NO: 168102 - RNA, 64 nt, Human
gucccaguuacuugggugccugaggcaggagaaucucuuaaaccaggaaggcagagauugcagu

SEQ ID NO: 168103 - RNA, 64 nt, Human
cuuuaugaacacaggugucugagcuagaauuauucucuuaaaagacaacauaacuuuuuauguc

SEQ ID NO: 168104 - RNA, 64 nt, Human; identical to SEQ ID NO: 84816

SEQ ID NO: 168105 - RNA, 64 nt, Human
ugucaaaaagaaguaaccucagcacuacuauucucucuuaaaagauaagcuauuuaaccccaaa

SEQ ID NO: 168106 - RNA, 64 nt, Human
uaaacaucuaagcaguuucuaagucuaguuuuaccucuuaaauaucucuguucccuucuaaguu

SEQ ID NO: 168107 - RNA, 64 nt, Human
aggccaauauauuccuggccauguuugaaugagccucuuaaaauaaacuuagagccaugcaaau

SEQ ID NO: 168108 - RNA, 64 nt, Human
gagaauuucuuguaauggcaccucaaauuuuauacucuuaaaaaaaaacaauaauuugugaauu

SEQ ID NO: 168109 - RNA, 64 nt, Human
ugacagagggagcacuugagccuugccuucccuccucuuaaaucaggguguguuccgagauuac

SEQ ID NO: 168110 - RNA, 64 nt, Human
uaaauuuuacucuugcaacauaacuaccaucucucucuuaaaacgagaucagguuagcaaauga

SEQ ID NO: 168111 - RNA, 64 nt, Human
uuucucauguagcugucuuuucaguuaugguaaacucuuaaaguucagaacacucaacagauuc

SEQ ID NO: 168112 - RNA, 64 nt, Human
ggacaucuuuuuccuagaccauguuucugucuuacucuuaaaccugguaacacuugauuugccu

SEQ ID NO: 168113 - RNA, 64 nt, Human
gcaacagaagaauuugauuagucuaugaaagguucucuuaaaauucuaucgaaauaaucuucau

SEQ ID NO: 168114 - RNA, 64 nt, Human
ccgccggcucuauuacuggucaaguacaucuuuucucuuaaaauuauuuagccuccauuauuac

SEQ ID NO: 168115 - RNA, 64 nt, Human
auaauaccccccaacuuuuuuagagacagccugucucuuaaaaaaaaaauuaauuugguaguga

SEQ ID NO: 168116 - RNA, 64 nt, Human
ccuccuucagaacauaaguguaacuuuauaugaacucuuaaauaaaugauguuuuuaaaagcuu

SEQ ID NO: 168117 - RNA, 64 nt, Human
uaagaaaccacuuuuguaguuuuaaccagacuuucucuuaaaaacauuagauaaaauaaaagau

SEQ ID NO: 168118 - RNA, 64 nt, Human
uaaguaaaaagguuaauaucaaguaacuuauuagcucuuaaaguaaaauugaacuuauuaaaag

SEQ ID NO: 168119 - RNA, 64 nt, Human
uagggauuacagugggggcauuucuuuauaucaccucuuaaaaacauuguuuccacuuuaaaag

SEQ ID NO: 168120 - RNA, 64 nt, Human
auucauccauguguuaauggguuuccagucucggcucuuaaaacuaugagcauuuguguaaaag

SEQ ID NO: 168121 - RNA, 64 nt, Human; identical to SEQ ID NO: 84834

SEQ ID NO: 168122 - RNA, 64 nt, Human
cuccauaucuuugcuaacacuuggcauugucagucucuuaaaauuuaauccacucuagccuccu

SEQ ID NO: 168123 - RNA, 64 nt, Human
gucgagauauaaaaacugaacacgauaacacuuacucuuaaaucaagcaucaacacuuuuuccc

SEQ ID NO: 168124 - RNA, 64 nt, Human
uuuuuuuuaacaggauaacuugagcaggcuaggccucuuaaaaaaaaauuugagcuaaaacuca

SEQ ID NO: 168125 - RNA, 64 nt, Human
cuuugugguauuuuuauuucauggguuuuaauuucucuuaaagacuuaccuaaauauucaguua

SEQ ID NO: 168126 - RNA, 64 nt, Human
cugcacuccagccugggcaagaguuuuuuuaagacucuuaaaaaaagagccugggcaauuuuuu

SEQ ID NO: 168127 - RNA, 64 nt, Human
auacugagauuuuuuuucaguauguauccuccagcucuuaaagcuuaccugagaaagcuuuaaa

SEQ ID NO: 168128 - RNA, 64 nt, Human
cucaccuuccccagcuacaaaaaucuguauuauccucuuaaaguaaaacuggaguuacaaauuu

SEQ ID NO: 168129 - RNA, 64 nt, Human
gaagcccccucauaggcagugauccuagaccaaacucuuaaauagaaucacuuuuguuuccuag

SEQ ID NO: 168130 - RNA, 64 nt, Human
auuuaaaagcuauuaagaguacuuuguguuagcacucuuaaaaacgcuaacagagaucaucauu

SEQ ID NO: 168131 - RNA, 64 nt, Human
aucucuguauauuugauucuuaacuaaaauuguucucuuaaauauucugaauccugguaauuaa

SEQ ID NO: 168132 - RNA, 64 nt, Human
gaugugucugaggaauagaugucggaagugcaaacucuuaaaaaauuggccuucuaaaaaacau

SEQ ID NO: 168133 - RNA, 64 nt, Human
uuggaaaauaguccccaucuaauauguauaggagcucuuaaaaaacugugcaaucaccccugcc

SEQ ID NO: 168134 - RNA, 64 nt, Human
uucaguucagggcaaaauguucaugaaguuauuccucuuaaacaugguuaggaagcugaugacg

SEQ ID NO: 168135 - RNA, 64 nt, Human
uugugcucuaacaguaugacuauucuuucccccacucuuaaacagugugauguguguuauccua

SEQ ID NO: 168136 - RNA, 64 nt, Human
cuguuugcuuaguaugagauuuuuuccagccugucucuuaaacuccugugacaucuucaaugau

SEQ ID NO: 168137 - RNA, 64 nt, Human
uauuuucagugcuuugcccuugaauucuuuuccucucuuaaauucauaucauuuggccgaguca

SEQ ID NO: 168138 - RNA, 64 nt, Human; identical to SEQ ID NO: 84855

SEQ ID NO: 168139 - RNA, 64 nt, Human
cucuguuuuaguugcugaggccugaguuuucuggcucuuaaagcauagaucauuucaccugaug

SEQ ID NO: 168140 - RNA, 64 nt, Human
aauaaaauacaaaaaugauuguuaaugauuggugcucuuaaagugagcuuaaaauuuauccaag

SEQ ID NO: 168141 - RNA, 64 nt, Human
ccugcgggccaggcacugcccuuuucaggaagcucucuuaaaauacccauugccccagaccugg

SEQ ID NO: 168142 - RNA, 64 nt, Human
guggaaggaugggauggguuccagagguauuccucucuuaaaugcaagugccuagauuagguag

SEQ ID NO: 168143 - RNA, 64 nt, Human
aaaauggaaugacugcuuaguccuuucucagauacucuuaaaacaauuuuuuauuguuaaauuu

SEQ ID NO: 168144 - RNA, 64 nt, Human
uggcucucaguuaaaaugugaggaagaacuacagcucuuaaauguagcaauggcacuguugcaa

SEQ ID NO: 168145 - RNA, 64 nt, Human
aaaugcccugagugguaacuucuguguuauuuuacucuuaaaaccaaacucuaccuuuucuugu

SEQ ID NO: 168146 - RNA, 64 nt, Human
gccuuuggguucgaggcuuccagcugcccaguggcucuuaaacaguuuagcaacuaauaaccgg

SEQ ID NO: 168147 - RNA, 64 nt, Human
caccuguaacuaaaaaagugaagauaagaaaauacucuuaaagcugaguauuuccuaauuguau

SEQ ID NO: 168148 - RNA, 64 nt, Human
aucuugaaaaaauguaauuuauuuuugauaacggcucuuaaacuuuaaaauaccugcuuuauuu

SEQ ID NO: 168149 - RNA, 64 nt, Human
cucaagcugacuuugauucuuuuaguugagaagucucuuaaagccaucuagcccaccuccauca

SEQ ID NO: 168150 - RNA, 64 nt, Human
uuuagacguuuuuuuccuccaaggugguuuucuucucuuaaauaacucgaucuguacccagcug

SEQ ID NO: 168151 - RNA, 64 nt, Human
gaagugagugcugugucccaggaagcugcucacacucuuaaaauggaaguguccguuaagcccu

SEQ ID NO: 168152 - RNA, 64 nt, Human
cugcacuccagccugggcaacagagcgagaccaucucuuaaaaaaaggcauuguuaguguaauc

SEQ ID NO: 168153 - RNA, 64 nt, Human
augauguuuugagucccuauaguuuaaacucccucucuuaaauggagcagcugguugaggcuuu

SEQ ID NO: 168154 - RNA, 64 nt, Human
cgacucaaaaugcauugucauuuaauauaguagccucuuaaaaaaaaaaaaccugcuaggauuu

SEQ ID NO: 168155 - RNA, 64 nt, Human; identical to SEQ ID NO: 84809

SEQ ID NO: 168156 - RNA, 64 nt, Human
cgagccaugggucuacagggucauccuuaugagacucuuaaauauacuuagauccugguaagag

SEQ ID NO: 168157 - RNA, 64 nt, Human
cuauaaccaggucuuuccuggccugagaaauauucucuuaaaaugaccuuuguuuuaaucucau

SEQ ID NO: 168158 - RNA, 64 nt, Human
cguauagaugugauauaauuugcuugaugguugucucuuaaaaagaaagauagcaaauacuuuu

SEQ ID NO: 168159 - RNA, 64 nt, Human
uucuuagccccucagccagcugccauuagcuuggcucuuaaagggccaggccuccuuuucugcc

SEQ ID NO: 168160 - RNA, 64 nt, Human
ccaccugcguccaaaaagaauguuauagcgagugcucuuaaauguugaaccuggguguugcuuc

SEQ ID NO: 168161 - RNA, 64 nt, Human
uaugagugugucggaaucccgugcuuaaaauacgcucuuaaauuauuuucuagucuuauuuuac

SEQ ID NO: 168162 - RNA, 64 nt, Human
cauuuugaccuaauacaauuaauuuucuggauaacucuuaaagagaagucauuuuaacuguuuu

SEQ ID NO: 168163 - RNA, 64 nt, Human
uauuccuuugaaauaaacuuaugaaauguuuucucucuuaaaauauuucuccuguguaaaauaa

SEQ ID NO: 168164 - RNA, 64 nt, Human
ccaugugauuuaauucuccauuccuccaauguaacucuuaaaauuauuauguaugugugugugu

SEQ ID NO: 168165 - RNA, 64 nt, Human
aaaauauucacugggccaauucaauacaaacaaucucuuaaauuggguucaugaugcagucucc

SEQ ID NO: 168166 - RNA, 64 nt, Human
auugauucuuuauugggaguacauuuuuuuaggucucuuaaacuuuaauuucacacaguaaauu

SEQ ID NO: 168167 - RNA, 64 nt, Human
uuagggcuucaugugucuggaagggagccauuagcucuuaaauuauucacagaagucaccacgg

SEQ ID NO: 168168 - RNA, 64 nt, Human
augcggcuucccccuuucguacuucauuuguguucucuuaaaauagaguuugaacaaauauuuu

SEQ ID NO: 168169 - RNA, 64 nt, Human
ccagaggcagaaauaaaaauacugaauaucuuugcucuuaaaaaaaaaguaacacuauagauuu

SEQ ID NO: 168170 - RNA, 64 nt, Human
aacccaggguaguuuacacuuaaugcuagggaggcucuuaaaacauuauuagauuuugaggaaa

SEQ ID NO: 168171 - RNA, 64 nt, Human
gcacuccagccuaggcaacagagcaagacccugucucuuaaaacaaaaaaccucacacauaccu

SEQ ID NO: 168172 - RNA, 64 nt, Human; identical to SEQ ID NO: 84836

SEQ ID NO: 168173 - RNA, 64 nt, Human
aacaaaguggugauuuuugguuagggugaucgcccucuuaaaauuggcagugcuguuccuugug

SEQ ID NO: 168174 - RNA, 64 nt, Human
aacuggacuucccaagauaaaugguaccagcguccucuuaaaagaugccuuaauccauuccuug

SEQ ID NO: 168175 - RNA, 64 nt, Human
uuuuucuccauucugaaaauagcaggacauuuaccucuuaaauaaacuuagcauuuagagguaa

SEQ ID NO: 168176 - RNA, 64 nt, Human
uaaccuugaauaaggcccacuguaauacguagcucucuuaaauauaacacuuaggacuagaaga

SEQ ID NO: 168177 - RNA, 64 nt, Human
accagaaagguagacaaaaaagaagcagcagcagcucuuaaagugaggguuauucucauacucg

SEQ ID NO: 168178 - RNA, 64 nt, Human
aaggaucagaggacugaaaaaugauucugcaacucucuuaaaguuagaaauguuucuguucaua

SEQ ID NO: 168179 - RNA, 64 nt, Human
gaaacauuuaaaugcuaucuuucaaagauaacuacucuuaaaaccuugaguaucuuuucagacc

SEQ ID NO: 168180 - RNA, 64 nt, Human
gugggguucuuguugcuuuuuucucuuuuuuccucucuuaaaaaauguacuugcacaaggaagg

SEQ ID NO: 168181 - RNA, 64 nt, Human
agauaacggcauuaauccauucaugaggucucugcucuuaaaggagaucaccucuuaaaggacc

SEQ ID NO: 168182 - RNA, 64 nt, Human
cauucaugaggucucugcucuuaaaggagaucaccucuuaaaggacccaccuuucaaugccauu

SEQ ID NO: 168183 - RNA, 64 nt, Human
uguauuuccaauacaguuugucuugaaugucugucucuuaaaccaguuuuuacuugucaguuuu

SEQ ID NO: 168184 - RNA, 64 nt, Human
ugauauaucagcuuuugccuuucaauuuaucaaucucuuaaagagaauccaacuuuauuacgau

SEQ ID NO: 168185 - RNA, 64 nt, Human
ucugguuaagggaggugggggucacuguucaucacucuuaaaauauguguuuucucuauagaaa

SEQ ID NO: 168186 - RNA, 64 nt, Human
cuaaaaaucguaacuugaauaccuuguaauuuuucucuuaaaaaagaagacuuguguaagucuc

SEQ ID NO: 168187 - RNA, 64 nt, Human
aaauguuucaaagacaguuuuaaagggagccaugcucuuaaaggcaguugauuaaagaaccugu

SEQ ID NO: 168188 - RNA, 64 nt, Human
caggaucuuauggcuccuuccuccagcugggggacucuuaaaggggcugggguagagacuaaga

SEQ ID NO: 168189 - RNA, 64 nt, Human; identical to SEQ ID NO: 84812

SEQ ID NO: 168190 - RNA, 64 nt, Human
gggacgggguguagggcaucacccaagguuccuucucuuaaacuaagggugggggaucugaaug

SEQ ID NO: 168191 - RNA, 64 nt, Human
cuuccagcaaaauccaaacugcugucucuuaaaucucuuaaacucucuucuuccauuagaaugc

SEQ ID NO: 168192 - RNA, 64 nt, Human
aaauccuuacuuccagcaaaauccaaacugcugucucuuaaaucucuuaaacucucuucuucca

SEQ ID NO: 168193 - RNA, 64 nt, Human
ggguacccccagcagccucucgaaaauugcacuucucuuaaaacuguaacuggccuuucucuua

SEQ ID NO: 168194 - RNA, 64 nt, Human
agguauccaguggauuuuucuucucugucuuccucucuuaaauuucaacaucucucuucuuggc

SEQ ID NO: 168195 - RNA, 64 nt, Human
uaugacuaauuguuacugauuuagagacuaagcccucuuaaaaccuuuaguuaaauauaaaaag

SEQ ID NO: 168196 - RNA, 64 nt, Human
aauuuugaaacacaaaacaauuuugaaucuugcucucuuaaagaaagcaucuuguauauuaaaa

SEQ ID NO: 168197 - RNA, 64 nt, Human
agguacaccagagcuuacauauguuugaguuagacucuuaaaauccuuugccaaaauaagggau

SEQ ID NO: 168198 - RNA, 64 nt, Human
ggaaagccaagccauuucugucuccagaguuguucucuuaaacugauaugaguucugaaaggag

SEQ ID NO: 168199 - RNA, 64 nt, Human
agggcuuaucuagccaaagagcucuuuuuuagcucucuuaaaugaagugcccacuaagaaguuc

SEQ ID NO: 168200 - RNA, 64 nt, Human
gagacuugggaaggaccaaugguaauuuaaguggcucuuaaaaagucaugcaacauguuucugg

SEQ ID NO: 168201 - RNA, 64 nt, Human
uuuacuugcaaguacuaggaauucagaugaucagcucuuaaaagaaaaaaaaaagcaaaaagac

SEQ ID NO: 168202 - RNA, 64 nt, Human
ccucggcucuccuugaauaagaaagccagcagaacucuuaaagccaguuguaguacggaguugu

SEQ ID NO: 168203 - RNA, 64 nt, Human
cuaauaauuuauauauauaaauaucuauaugacgcucuuaaaaaaacaucccaaccaaaaccaa

SEQ ID NO: 168204 - RNA, 64 nt, Human
cucuuugucauuuuuccccuucucagacucuuagcucuuaaaauucaaagaugggauauucuaa

SEQ ID NO: 168205 - RNA, 64 nt, Human
cagguaagaauggauauggacaugcauuuauuaccucuuaaaauuauuauuuuaaguaaaagcc

SEQ ID NO: 168206 - RNA, 64 nt, Human; identical to SEQ ID NO: 84837

SEQ ID NO: 168207 - RNA, 64 nt, Human
uccaauuuugagaaucacuaucuucaaauuaccucucuuaaauaggguugggaaugaggacaua

SEQ ID NO: 168208 - RNA, 64 nt, Human
aaacaacaacacaauaacacuaaaauuuuaggcacucuuaaaugaucugccucuaaaagcguug

SEQ ID NO: 168209 - RNA, 64 nt, Human
aacagaaaccuauccucacugcccuccccagucucucuuaaaguuggaauuuaccaguuaauua

SEQ ID NO: 168210 - RNA, 64 nt, Human
cauuggagucucccauuuucauucucaaauuuaccucuuaaaguacgaaguaaguagaucaaag

SEQ ID NO: 168211 - RNA, 64 nt, Human
uaaaaucuauuugauuuuuuuuuuuuuuuuuugccucuuaaagucuaauuuuaggauggaugaa

SEQ ID NO: 168212 - RNA, 64 nt, Human
gauuuuuuuaaccuaauucagguguccuuugcaucucuuaaauguugggggugggggucagagc

SEQ ID NO: 168213 - RNA, 64 nt, Human
ugcaugccgguccaaauuguucuguauaaagaugcucuuaaaagacacaagaguuauccuagaa

SEQ ID NO: 168214 - RNA, 64 nt, Human
accuuagaaccguuauuucccucaguguagauugcucuuaaaauguauucaguuauuuaguggc

SEQ ID NO: 168215 - RNA, 64 nt, Human
uuuuuuuccuccucugaagaaauuuaggauuuuucucuuaaagcaaauacuaaagaggaaaaaa

SEQ ID NO: 168216 - RNA, 64 nt, Human
cuuguuuccuuuuauucuuccaucugaagccccacucuuaaaaaguugcacuguuccaguaguu

SEQ ID NO: 168217 - RNA, 64 nt, Human
aaauuuugcccccuuuuaggccauguuccauuaucucuuaaaauuggaaccuaauucgagagga

SEQ ID NO: 168218 - RNA, 64 nt, Human
ucaucaccguuuagauuguacacaguaauggugacucuuaaacccagucagaagcucaucauug

SEQ ID NO: 168219 - RNA, 64 nt, Human
cuauugcugcaacagguuuuucuuaaugguuauccucuuaaauacaccugcugguacuuggugu

SEQ ID NO: 168220 - RNA, 64 nt, Human
uguguuguuuuguucuuugaaauacaaccaaauucucuuaaaaugauugguaggaaaugaggua

SEQ ID NO: 168221 - RNA, 64 nt, Human
ccaguugagacugcuggagcugagacacaguacucucuuaaagaagguggggagcugcccaggg

SEQ ID NO: 168222 - RNA, 64 nt, Human
cauuaugacccacuacauuuuuucuuuccuaccccucuuaaaacucaguucagguagcagcucc

SEQ ID NO: 168223 - RNA, 64 nt, Human; identical to SEQ ID NO: 84815

SEQ ID NO: 168224 - RNA, 64 nt, Human
cuccuuccuacuucuuuucuuccuuccucuuccucucuuaaaacuaucuuagauguagaauccu

SEQ ID NO: 168225 - RNA, 64 nt, Human
uucuucaauacaauaauagaacaaguagccuauucucuuaaaaaguaugugaaaagaaaauuau

SEQ ID NO: 168226 - RNA, 64 nt, Human
ucccaaaaaugucaguauugacaacacagucuaacucuuaaauaaaauuaugcuaauuaguuac

SEQ ID NO: 168227 - RNA, 64 nt, Human
uggccaacuaguuguuaaaagcuaacagcucaaucucuuaaaacacuuuucaaaauauguggga

SEQ ID NO: 168228 - RNA, 64 nt, Human
auacacgacaaccacuuauggcucuuuuucaaaacucuuaaaucaguaguuugacuuuugccag

SEQ ID NO: 168229 - RNA, 64 nt, Human
cccauguguccccuaccccccaauuucuuguccccucuuaaagagcaguugucaccaccugaac

SEQ ID NO: 168230 - RNA, 64 nt, Human
uagauaauccauucagccagacaaacggggccagcucuuaaaauaagaaagcugagacugagga

SEQ ID NO: 168231 - RNA, 64 nt, Human
agaucacaauuagcuuuucacauggaaugaccaacucuuaaaagccugauaggcucucggcgag

SEQ ID NO: 168232 - RNA, 64 nt, Human
gcuucucucuuugauguuaccuguuagugcugaucucuuaaagcagacauuucuuguuuguuga

SEQ ID NO: 168233 - RNA, 64 nt, Human
ucggcaaaaugagauuugaaacucauuaguuuaacucuuaaaacauaguguuguuaaacaguau

SEQ ID NO: 168234 - RNA, 64 nt, Human
uuagaacagacgauccaugcuaauauuguauuuucucuuaaaacauagcuuuccuguaauuuaa

SEQ ID NO: 168235 - RNA, 64 nt, Human
uguauagcaagaaaaaaacagucaacuacagaaacucuuaaaaggaauaaaaacccaaaguucc

SEQ ID NO: 168236 - RNA, 64 nt, Human
acaggugugagccaccgugcccagccaaagacugcucuuaaagcaccuuuuugacagugaacau

SEQ ID NO: 168237 - RNA, 64 nt, Human
ggcucuuuucuaugaacuucguucucuaguugaucucuuaaacccauaccugcuacagccaaga

SEQ ID NO: 168238 - RNA, 64 nt, Human
ucauggcaaauuugguauccuguuacagccuuggcucuuaaacaacucaaaauauugggauagg

SEQ ID NO: 168239 - RNA, 64 nt, Human
ugauaaauuauaguuuuguuuguuagaaaaguugcucuuaaaagauguaaauagaugacaaacg

SEQ ID NO: 168240 - RNA, 64 nt, Human
gucuacucucacuuuaaacucaccaaagaagauucucuuaaagaaauuaugaaaaauguacaau

SEQ ID NO: 168241 - RNA, 64 nt, Human
cucauggauucugaauaaaagaaacacucuacaccucuuaaaucaaggucauguagauaaugac

SEQ ID NO: 168242 - RNA, 64 nt, Human
uucagggaauucauauuuuguuauguguaggauacucuuaaaauguaauucauuaaacuuuuac

SEQ ID NO: 168243 - RNA, 64 nt, Human
ggagugcuugccuuuccacgugacuuuuaaaaggcucuuaaagagcaaauguccucuucuccuu

SEQ ID NO: 168244 - RNA, 64 nt, Human
uauaaauagugaaaauuuuauugaauauaauggccucuuaaaaauuaucuuuaaaacuuacuau

SEQ ID NO: 168245 - RNA, 64 nt, Human
agccauuuugauuuguuccuucauuaaaaaaaaucucuuaaaguuauuuagugucuaaaaguga

SEQ ID NO: 168246 - RNA, 64 nt, Human
aaguugcaggaagaacaaaggaagcaggaaaaugcucuuaaacccaaaggggcuucacugaaga

SEQ ID NO: 168247 - RNA, 64 nt, Human
ggccagaacuguuugguugauuaaaauacaucagcucuuaaaaacucauuaacugaggguaauu

SEQ ID NO: 168248 - RNA, 64 nt, Human
uguuuuucucaucuuuaaaauacaacuacuuaugcucuuaaaucaaggcugucugcuuauuuau

SEQ ID NO: 168249 - RNA, 64 nt, Human
aguuugcuugaaacuaguucaccuaaagcuagaucucuuaaaaccaauuuacugaaaacuuguu

SEQ ID NO: 168250 - RNA, 64 nt, Human
aaaugaaacagugggguuuaguacuccaaaugaacucuuaaagaaaaaaacuaaucuuggcauc

SEQ ID NO: 168251 - RNA, 64 nt, Human
uggccuuguucauuuuaguaacgguuccugaauucucuuaaauucuuugagauccaaagauggc

SEQ ID NO: 168252 - RNA, 64 nt, Human
uugaaauggugaagaaacaaguauacacuagaggcucuuaaaaguauugaaagacaauacugcu

SEQ ID NO: 168253 - RNA, 64 nt, Human
aagcuuacuugcuuuaaacagccuuuucuucuuucucuuaaaaguuucauuuggggagcugguc

SEQ ID NO: 168254 - RNA, 64 nt, Human
caguaaaucccuuuaaauaguguuccuaagauaucucuuaaauccucccauaggaaauagaauu

SEQ ID NO: 168255 - RNA, 64 nt, Human
ugagugccucauuccacugaauauuuaaauuuuccucuuaaaugguaaacugacuuauugcaau

SEQ ID NO: 168256 - RNA, 64 nt, Human
caccucauaaaagugagcuuugaacuguagauaacucuuaaagaaaaugucauuuuagacaauu

SEQ ID NO: 168257 - RNA, 64 nt, Human
uagcuucuggugauaucuuuucaugauuuuauaucucuuaaaauggugauggaugugacaccuc

SEQ ID NO: 168258 - RNA, 64 nt, Human
aacucuagagucugggcaaaauguuugguuuuuucucuuaaaaaaaauaacaccccauuaccaa

SEQ ID NO: 168259 - RNA, 64 nt, Human
uaggauugcuuuucuguaucauaauuuuagaaugcucuuaaaaucuugaggaagaguuuuuauu

SEQ ID NO: 168260 - RNA, 64 nt, Human
gauggcaauuuuuaaacuuuaauuuuauugugaucucuuaaagcagagguuagacuuuaccuuu

SEQ ID NO: 168261 - RNA, 64 nt, Human
uuaauauuuuagugcuauaaaauacuaugugaaucucuuaaaaaucugacauuuuacagucugu

SEQ ID NO: 168262 - RNA, 64 nt, Human
caggagagaauccaguugaacuugcuccuaaaugcucuuaaauaugcauauuuucugccaacuc

SEQ ID NO: 168263 - RNA, 64 nt, Human
gcuaagauaacauuucugaggauucuagaugauccucuuaaagaauaaaagcacauccguggau

SEQ ID NO: 168264 - RNA, 64 nt, Human
uuuugcaguccuuccuaucuuacacuaauuugaacucuuaaagauugcugcuuuuuuuugauau

SEQ ID NO: 168265 - RNA, 64 nt, Human
uacaggaaaauuggaagcacacaguggacugugccucuuaaagaugccuuucccaacccuccau

SEQ ID NO: 168266 - RNA, 64 nt, Human
auucacaaauucauuugucagccucuuuuuaguucucuuaaaaaaaaaaaaaucauaugaucau

SEQ ID NO: 168267 - RNA, 64 nt, Human
cacagaauucaagccucauuugcuaucccagcaucucuuaaaacuuuguagucuuggaauucau

SEQ ID NO: 168268 - RNA, 64 nt, Human
ucauccuuauauuggaaugauuauauagaaaaugcucuuaaaaagauuaaaccuauuucucagu

SEQ ID NO: 168269 - RNA, 51 nt, Human
agaagaagccugcugcauaaacucuuaaauuugauuauuccauaaagguca

SEQ ID NO: 168270 - RNA, 64 nt, Human
uauuuauuuuuuuauaaaucaagacuucugugugcucuuaaauauauuaaaaacaauuuacauu

SEQ ID NO: 168271 - RNA, 64 nt, Human
ccccgggggcucacaugccacuggaaacaacagacucuuaaacuaacaauucaagcaggcgcca

SEQ ID NO: 168272 - RNA, 64 nt, Human
gaaggguacccgaagaaaugagaagucaaggacucucuuaaagggaccacauuuuuuaccuaaa

SEQ ID NO: 168273 - RNA, 64 nt, Human
ugcccauuacugugagggacccuugaagucuggacucuuaaauggguuuuugcugauuuccugg

SEQ ID NO: 168274 - RNA, 64 nt, Human
gggcuuucgguccaccaguaaauaagaucaaaugcucuuaaauguuccuguuaccauccuaaug

SEQ ID NO: 168275 - RNA, 64 nt, Human
uggacguccucucuccuuuagagaucugagcugucucuuaaaggggacaguugcccaaaauguu

SEQ ID NO: 168276 - RNA, 64 nt, Human
gggguauugcugaccuacuuuucuaggggaaaugcucuuaaacacuguaauuaugcauuucuaa

SEQ ID NO: 168277 - RNA, 64 nt, Human
uuggcaguugacauucccuuacucccaaucaacacucuuaaauauuuguacuguuuguaaaacu

SEQ ID NO: 168278 - RNA, 64 nt, Human
uuuuauuauugcccucaucauaguuccugauugucucuuaaaguaagugguuuauagacauuac

SEQ ID NO: 168279 - RNA, 64 nt, Human
gcacuacaaccuugguggcacagugagaaccugacucuuaaaaaaaaaaaaaaaaaaaaaaaaa

SEQ ID NO: 168280 - RNA, 64 nt, Human
agaaaagucuuaacuaggaaacuaaaagcuuucacucuuaaagcuuucauuuucuguuuauuca

SEQ ID NO: 168281 - RNA, 64 nt, Human
uuacaacagcuauuuaggggaauguuacguugaucucuuaaauuguaaacacuacaaaauguca

SEQ ID NO: 168282 - RNA, 64 nt, Human
agcuaggucugaaaguuacacagccaaguuugagcucuuaaaaguugaugaacagccucauuuc

SEQ ID NO: 168283 - RNA, 64 nt, Human
ugcugauagcugcuuagguucuugaguaguucugcucuuaaacguagggaggcccugagaacua

SEQ ID NO: 168284 - RNA, 64 nt, Human
ccauuuuucuuucuuuuuuuucccccuaaacaaccucuuaaagggguaagaaguuaggggguug

SEQ ID NO: 168285 - RNA, 63 nt, Human
auuaagaaccccugaagagcaacccuuuaccacucucuuaaauuugaaaaauuccaaaauaau

SEQ ID NO: 168286 - RNA, 64 nt, Human
uguuuaaagaaacaaagaaacucuaauauugaaucucuuaaauuuaguguauguaaacagcuua

SEQ ID NO: 168287 - RNA, 64 nt, Human
uuaguuacguauaaugcuuucugagugaguuuuacucuuaaaucauuugguuaaaucauuuggc

SEQ ID NO: 168288 - RNA, 64 nt, Human
uauaaaugaaauacucuucuucaucucuguuuugcucuuaaaaauauaaaaaggcaauuccccg

SEQ ID NO: 168289 - RNA, 64 nt, Human
aaagccuccaaccuugaaguccagugaagucucucucuuaaagucuuuugcaaacauuuuugua

SEQ ID NO: 168290 - RNA, 64 nt, Human
cuccuggaggaaaggcagucgggacugacccccucucuuaaaacacauucccgcccgcccacag

SEQ ID NO: 168291 - RNA, 64 nt, Human; identical to SEQ ID NO: 84873

SEQ ID NO: 168292 - RNA, 64 nt, Human
ugcacuggguggggaaaggauagugugucuuuaacucuuaaauuguuugguccuauuuuuuaaa

SEQ ID NO: 168293 - RNA, 64 nt, Human
uauucuuuacaggaacugguggugguuuuucguucucuuaaauaaucaggugcuuuguaaccaa

SEQ ID NO: 168294 - RNA, 64 nt, Human
aaccaaauguggcuugacgaagucgugguuucaucucuuaaacacaguguguaaauuuauucaa

SEQ ID NO: 168295 - RNA, 64 nt, Human
uguuuaaguacuguuuaccauuuuucauucacuucucuuaaacuugugaaugcuucucacuuuu

SEQ ID NO: 168296 - RNA, 64 nt, Human
ucccagcuuuuuagucuuaaccacaguucucacucucuuaaaugguaccucaaaaagcuggagc

SEQ ID NO: 168297 - RNA, 64 nt, Human
acacgucuccuugccugaauaagccauauauaugcucuuaaacaaaaguuugaaauuauccaua

SEQ ID NO: 168298 - RNA, 64 nt, Human
ugugagcugccgcacccagccaagaaaaauaauacucuuaaauacuuagauguucaccuaaagu

SEQ ID NO: 168299 - RNA, 64 nt, Human
uuugcacacaguaacauccacagaacuaguccaacucuuaaaaggagagaggaaaaacacaggc

SEQ ID NO: 168300 - RNA, 64 nt, Human
caauagaaaaaagagagagcuuccuaggccugggcucuuaaaugcugcauuauaacugagucua

SEQ ID NO: 168301 - RNA, 64 nt, Human
cacucccagugcuugcaagauuccaaguucucaccucuuaaagaaaacccaccccguagauucc

SEQ ID NO: 168302 - RNA, 64 nt, Human
gcuuuccagccugggcaacauaguaagaccccaucucuuaaaaaaugaauuuggccagacacag

SEQ ID NO: 168303 - RNA, 64 nt, Human
acagauuuuuuuuaaaagugaauaauguguucaacucuuaaauucaugcuguuucaucauugcu

SEQ ID NO: 168304 - RNA, 64 nt, Human
uugaaaguguaagguuuuaaccuuuaauuuauuucucuuaaauacaucuuuugauauuguuguu

SEQ ID NO: 168305 - RNA, 64 nt, Human
ugagagacaccaaguauauuaaaugaaagaaggccucuuaaauucaacccauguuuuacuuaaa

SEQ ID NO: 168306 - RNA, 64 nt, Human
caagaccagccugggaaacauagcaagaccccaucucuuaaaaaaaaagaaauauauagacaua

SEQ ID NO: 168307 - RNA, 64 nt, Human
gcacucuagcuugggcaacagagcaagacucugucucuuaaauaaauaaauaaauagauuacca

SEQ ID NO: 168308 - RNA, 64 nt, Human; identical to SEQ ID NO: 84839

SEQ ID NO: 168309 - RNA, 64 nt, Human
cuccccuugguucugcacuguugccaauaaaaagcucuuaaaaacgcauucgccaggcuacagu

SEQ ID NO: 168310 - RNA, 64 nt, Human
gcaguccagccagguugacagaaugagacccugucucuuaaaaaaaaaaaaaaaaauccuggug

SEQ ID NO: 168311 - RNA, 64 nt, Human
ccacagugaccuuucaaaaaugcaaauuaaguuacucuuaaaacucuaguuaaaauacuugaug

SEQ ID NO: 168312 - RNA, 64 nt, Human
ggcaucagaggccagaguucaaaugugacuccaccucuuaaaagccgugauuucuagcaguuga

SEQ ID NO: 168313 - RNA, 64 nt, Human
caagaccaaccuggacaacauagcaagaccccaucucuuaaaaaaaaaggaaagaaaacuugau

SEQ ID NO: 168314 - RNA, 64 nt, Human
gauuuuuugaaaagugaguaauaauguaauucaacucuuaaauuauuuccugccuuuucuucac

SEQ ID NO: 168315 - RNA, 64 nt, Human
uacucacccaguaagucucuuaaaauuuaucauucucuuaaaguaucacucuaaaauuugucaa

SEQ ID NO: 168316 - RNA, 64 nt, Human
uuaaauauuugauaaaacuacucacccaguaagucucuuaaaauuuaucauucucuuaaaguau

SEQ ID NO: 168317 - RNA, 64 nt, Human
uuaauagguaaucaaggcaauucaguaucucccucucuuaaagucuguuuuuagacuucauggu

SEQ ID NO: 168318 - RNA, 64 nt, Human
aggcuuggggaggggaaaauuuagcucuggguagcucuuaaaucuuagccucaguugugggguu

SEQ ID NO: 168319 - RNA, 64 nt, Human
auacuccauaacacaauagcaguacaccacuaggcucuuaaacgaucaagaacaauuuuuuuca

SEQ ID NO: 168320 - RNA, 64 nt, Human
aaauauuuauuagaugccuuuuguguaccaggaacucuuaaacacugaagauguagcaauaaac

SEQ ID NO: 168321 - RNA, 64 nt, Human
agaagaaaaaaaagauaggacaaaguauuugaagcucuuaaaauguacauauuuugguucuucu

SEQ ID NO: 168322 - RNA, 64 nt, Human
caaauccugccugggcaacauagcaagacccugucucuuaaaaaaacaaaaagacauauucagg

SEQ ID NO: 168323 - RNA, 64 nt, Human
guucauuguuuugccuacucagcagaagugaugacucuuaaaaauuggcuuugaccaaaguucu

SEQ ID NO: 168324 - RNA, 64 nt, Human
uugugucacuuuuuucugccuugcuagccaaaaucucuuaaauacacguaggugggccagagaa

SEQ ID NO: 168325 - RNA, 64 nt, Human; identical to SEQ ID NO: 84818

SEQ ID NO: 168326 - RNA, 64 nt, Human
uugguaggccuugguacaugaugcuggauuaccucucuuaaaaugacacccuuccucgccuguu

SEQ ID NO: 168327 - RNA, 64 nt, Human
guaaauuuuaauggcuuuuccauuguuuuugcuucucuuaaaaaguuuaagaagaauaugaccu

SEQ ID NO: 168328 - RNA, 64 nt, Human
uacuccauccugggugauggagcgaagaaccugucucuuaaaaaaaaaaauuuuuuuuuaauua

SEQ ID NO: 168329 - RNA, 64 nt, Human
ccaugaggaacauaaauucauguaaagccauuuucucuuaaacaaaacaaaacuuucuaaguac

SEQ ID NO: 168330 - RNA, 64 nt, Human
auuuuccugagagccuggcuuagugcugggccuucucuuaaaccucauuacaaugagguuagua

SEQ ID NO: 168331 - RNA, 64 nt, Human
caacaaucuuuguaagaaccacucaaauaaaagucucuuaaaaaggccacaggagaucuucauu

SEQ ID NO: 168332 - RNA, 64 nt, Human
aaagaagccugguuacugauuuguauaaaauguacucuuaaaguauaaaauauaagguaaggua

SEQ ID NO: 168333 - RNA, 64 nt, Human
ggauuuuuuuuuucaguaacugguauuauguuuucucuuaaaauaagguaaugaauggcuugcc

SEQ ID NO: 168334 - RNA, 64 nt, Human
ucuguaacagagagaacacaaaggccuguggauacucuuaaaggacaauuaaaucuuaacucau

SEQ ID NO: 168335 - RNA, 64 nt, Human
auaccuaauacaauauauuuaauuuuuaauuaaacucuuaaacuuuucuuccaagaaguuucag

SEQ ID NO: 168336 - RNA, 64 nt, Human
caccuucuccuucauuguuuucuuuaaaucuguccucuuaaaaagcuucuuaagagcucaguua

SEQ ID NO: 168337 - RNA, 64 nt, Human
cgcguauccaguguuuugucgcagagaguuuucgcucuuaaauccuggggguuucuuagaaagc

SEQ ID NO: 168338 - RNA, 64 nt, Human
auuuuacggagauaucccaggaaaauuaaggcuucucuuaaacacuaaaaaggcauguaauugc

SEQ ID NO: 168339 - RNA, 64 nt, Human
aaauacucuaaaaugauaaaauugagguacaacucucuuaaaagaguauggauaacuauauuuu

SEQ ID NO: 168340 - RNA, 64 nt, Human
uuuuuucuucuucguaaaauuuugauaaucuguucucuuaaaaaaguuaaugacacaauuaaga

SEQ ID NO: 168341 - RNA, 64 nt, Human
ugaaguggaguaagugaaaaccugccuuuugccacucuuaaaaauugugcccaaaauauaaaag

SEQ ID NO: 168342 - RNA, 64 nt, Human
gugcuccaaaugaucuggugguuauuuaacguaccucuuaaaauucguugaaacgauuucaggu

SEQ ID NO: 168343 - RNA, 64 nt, Human
uuauaauuaauccuuuaauauuaugguuauuaaccucuuaaacaugaaugaauucuugauuguu

SEQ ID NO: 168344 - RNA, 64 nt, Human
ggucugagaggacucccuccagaaaaucccugaucucuuaaaauuugguagagaucggaaguuu

SEQ ID NO: 168345 - RNA, 64 nt, Human
cuguguuggggucauggaugagcggcucucuuggcucuuaaaggcaggccucucucuucuugcc

SEQ ID NO: 168346 - RNA, 64 nt, Human
gggaagugcuauucacaggaccauauccaccacccucuuaaauuccuaaacaauaucaucuagg

SEQ ID NO: 168347 - RNA, 64 nt, Human
ucccuuuaaaaaaaaaaaaaaacuucuacuuuuccucuuaaaggcacuuuacucucuccccacu

SEQ ID NO: 168348 - RNA, 64 nt, Human
uuugacacuuccuuugguucauugagcuucaaggcucuuaaaaugccacugacaaugagaucuc

SEQ ID NO: 168349 - RNA, 64 nt, Human
cugcccugccaugcagagcccuggccgcuggagacucuuaaagcccccacagcccuccaggucc

SEQ ID NO: 168350 - RNA, 64 nt, Human
gcuguguguuaggcaauccuguaaucuuuuuugacucuuaaaagaaauucauuucugaaaugcu

SEQ ID NO: 168351 - RNA, 64 nt, Human
agcaaggcagacagugaccuccacccccgcagcccucuuaaaaggccaguacucuugggggugg

SEQ ID NO: 168352 - RNA, 64 nt, Human
gagacuaugaaagacucauugucuuuguauucagcucuuaaauaguguaacuauauccccaccu

SEQ ID NO: 168353 - RNA, 64 nt, Human
ggguccccaauguccgagcugcaucuggacgcugcucuuaaaggaccuccuggggcaggggagc

SEQ ID NO: 168354 - RNA, 64 nt, Human
ggacuaggaucggcucucauucgaucgagcuauucucuuaaaaugacaaaaaguguccauaaag

SEQ ID NO: 168355 - RNA, 64 nt, Human
agagaaugggaugugugaugcaaaugcucaaaaccucuuaaaucauagcugucugaccucuacg

SEQ ID NO: 168356 - RNA, 64 nt, Human
ccuguggaauguuauuguucaacguuguuuacagcucuuaaaacauggugaggaaugccuaagu

SEQ ID NO: 168357 - RNA, 64 nt, Human
caagaucagccugggcaauauagugaaaccccaucucuuaaagaaaaaguuagccaggugugau

SEQ ID NO: 168358 - RNA, 64 nt, Human
uuagucuagccugagcaauauaaugagacuccgucucuuaaaauauuugcccaaacauugaacc

SEQ ID NO: 168359 - RNA, 64 nt, Human
cuggaaaaaaaauguaucuuauuuuugauaauggcucuuaaaucuuuaaacacacacacaaaau

SEQ ID NO: 168360 - RNA, 64 nt, Human
agcauauuucaaaaauguugucauucauuaaggccucuuaaauagaccacuauuuuuugugucu

SEQ ID NO: 168361 - RNA, 64 nt, Human
uuguucaauuuuaauuuugcuacuacauucauaacucuuaaauuguuaggcuguuucauuuaca

SEQ ID NO: 168362 - RNA, 64 nt, Human
aaugggaagcaauaauauucaucugaccaguuuucucuuaaagccauuuccaugaugaugauga

SEQ ID NO: 168363 - RNA, 64 nt, Human
gcggauuguuguuuaacuuguaaaugaaaaaauucucuuaaaccacagcacuauugagugaaac

SEQ ID NO: 168364 - RNA, 64 nt, Human
aagaaaaucugaagacauuacaguugccuauugccucuuaaauguguccuagacacagcaugaa

SEQ ID NO: 168365 - RNA, 64 nt, Human
gaacaccaaagaauuugcuggcuuccaaauugggcucuuaaacaagguaaauugugacauaaau

SEQ ID NO: 168366 - RNA, 64 nt, Human
aguaucaagaaaauaaaugagcauagcaaugcuacucuuaaaaagaugcuaugccacacaacca

SEQ ID NO: 168367 - RNA, 64 nt, Human
ucacaaaugaaaccugaaagaaucuuuucugagccucuuaaaagaggaaaaugaugauaacauu

SEQ ID NO: 168368 - RNA, 64 nt, Human
gguuuguaagggaagccagguuggggaauaggagcucuuaaauaaugugucacagugcauggug

SEQ ID NO: 168369 - RNA, 64 nt, Human
acuguauguucacccucugaaguggguacccagucucuuaaaucuuuuguauuugcucacagug

SEQ ID NO: 168370 - RNA, 64 nt, Human
uacauuuauuaauuacuguauuugacaaaggaaacucuuaaauuauaaugugaaaccugguuuu

SEQ ID NO: 168371 - RNA, 64 nt, Human
ccuuuaggaacaggagaguagacuaggauuccuucucuuaaaaagguacauauauauggaaaaa

SEQ ID NO: 168372 - RNA, 62 nt, Human
uaaaguuuuaagucaauaaauaaauaaauauuuacucuuaaauaauauagaauccuguugug

SEQ ID NO: 168373 - RNA, 64 nt, Human
uuugcaaaauguuuggucuuaggacaccuuaacacucuuaaaaguuauugaaggccccaaggag

SEQ ID NO: 168374 - RNA, 64 nt, Human
gaugaaagauguauaauguagagaacugacuucucucuuaaaaaguacagagagccugugcugu

SEQ ID NO: 168375 - RNA, 64 nt, Human; identical to SEQ ID NO: 84785

SEQ ID NO: 168376 - RNA, 64 nt, Human; identical to SEQ ID NO: 35241

SEQ ID NO: 168377 - RNA, 64 nt, Human; identical to SEQ ID NO: 35242

SEQ ID NO: 168378 - RNA, 64 nt, Human; identical to SEQ ID NO: 35243

SEQ ID NO: 168379 - RNA, 64 nt, Human; identical to SEQ ID NO: 35244

SEQ ID NO: 168380 - RNA, 64 nt, Human; identical to SEQ ID NO: 35245

SEQ ID NO: 168381 - RNA, 64 nt, Human; identical to SEQ ID NO: 35246

SEQ ID NO: 168382 - RNA, 64 nt, Human; identical to SEQ ID NO: 35247

SEQ ID NO: 168383 - RNA, 64 nt, Human; identical to SEQ ID NO: 35248

SEQ ID NO: 168384 - RNA, 64 nt, Human; identical to SEQ ID NO: 35249

SEQ ID NO: 168385 - RNA, 64 nt, Human; identical to SEQ ID NO: 35250

SEQ ID NO: 168386 - RNA, 64 nt, Human; identical to SEQ ID NO: 35251

SEQ ID NO: 168387 - RNA, 64 nt, Human; identical to SEQ ID NO: 35252

SEQ ID NO: 168388 - RNA, 64 nt, Human; identical to SEQ ID NO: 35253

SEQ ID NO: 168389 - RNA, 64 nt, Human; identical to SEQ ID NO: 35254

SEQ ID NO: 168390 - RNA, 64 nt, Human; identical to SEQ ID NO: 35255

SEQ ID NO: 168391 - RNA, 64 nt, Human; identical to SEQ ID NO: 35256

SEQ ID NO: 168392 - RNA, 64 nt, Human; identical to SEQ ID NO: 35257

SEQ ID NO: 168393 - RNA, 64 nt, Human; identical to SEQ ID NO: 35258

SEQ ID NO: 168394 - RNA, 64 nt, Human; identical to SEQ ID NO: 35259

SEQ ID NO: 168395 - RNA, 64 nt, Human; identical to SEQ ID NO: 35260

SEQ ID NO: 168396 - RNA, 64 nt, Human; identical to SEQ ID NO: 35261

SEQ ID NO: 168397 - RNA, 64 nt, Human; identical to SEQ ID NO: 35262

SEQ ID NO: 168398 - RNA, 64 nt, Human; identical to SEQ ID NO: 35263

SEQ ID NO: 168399 - RNA, 64 nt, Human; identical to SEQ ID NO: 35264

SEQ ID NO: 168400 - RNA, 64 nt, Human; identical to SEQ ID NO: 35265

SEQ ID NO: 168401 - RNA, 64 nt, Human; identical to SEQ ID NO: 35266

SEQ ID NO: 168402 - RNA, 64 nt, Human; identical to SEQ ID NO: 35267

SEQ ID NO: 168403 - RNA, 64 nt, Human; identical to SEQ ID NO: 35268

SEQ ID NO: 168404 - RNA, 64 nt, Human; identical to SEQ ID NO: 35269

SEQ ID NO: 168405 - RNA, 64 nt, Human; identical to SEQ ID NO: 35270

SEQ ID NO: 168406 - RNA, 64 nt, Human; identical to SEQ ID NO: 35271

SEQ ID NO: 168407 - RNA, 64 nt, Human; identical to SEQ ID NO: 35272

SEQ ID NO: 168408 - RNA, 64 nt, Human; identical to SEQ ID NO: 35273

SEQ ID NO: 168409 - RNA, 64 nt, Human; identical to SEQ ID NO: 35274

SEQ ID NO: 168410 - RNA, 64 nt, Human; identical to SEQ ID NO: 35275

SEQ ID NO: 168411 - RNA, 64 nt, Human; identical to SEQ ID NO: 35276

SEQ ID NO: 168412 - RNA, 64 nt, Human; identical to SEQ ID NO: 35277

SEQ ID NO: 168413 - RNA, 64 nt, Human; identical to SEQ ID NO: 35278

SEQ ID NO: 168414 - RNA, 64 nt, Human; identical to SEQ ID NO: 35279

SEQ ID NO: 168415 - RNA, 64 nt, Human; identical to SEQ ID NO: 35280

SEQ ID NO: 168416 - RNA, 64 nt, Human; identical to SEQ ID NO: 35281

SEQ ID NO: 168417 - RNA, 64 nt, Human; identical to SEQ ID NO: 35282

SEQ ID NO: 168418 - RNA, 64 nt, Human; identical to SEQ ID NO: 35283

SEQ ID NO: 168419 - RNA, 64 nt, Human; identical to SEQ ID NO: 35284

SEQ ID NO: 168420 - RNA, 64 nt, Human; identical to SEQ ID NO: 35285

SEQ ID NO: 168421 - RNA, 64 nt, Human; identical to SEQ ID NO: 35286

SEQ ID NO: 168422 - RNA, 64 nt, Human; identical to SEQ ID NO: 35287

SEQ ID NO: 168423 - RNA, 64 nt, Human; identical to SEQ ID NO: 35288

SEQ ID NO: 168424 - RNA, 64 nt, Human; identical to SEQ ID NO: 35289

SEQ ID NO: 168425 - RNA, 64 nt, Human; identical to SEQ ID NO: 35290

SEQ ID NO: 168426 - RNA, 64 nt, Human; identical to SEQ ID NO: 35291

SEQ ID NO: 168427 - RNA, 64 nt, Human; identical to SEQ ID NO: 35292

SEQ ID NO: 168428 - RNA, 64 nt, Human; identical to SEQ ID NO: 35293

SEQ ID NO: 168429 - RNA, 64 nt, Human; identical to SEQ ID NO: 35294

SEQ ID NO: 168430 - RNA, 64 nt, Human; identical to SEQ ID NO: 35295

SEQ ID NO: 168431 - RNA, 64 nt, Human; identical to SEQ ID NO: 35296

SEQ ID NO: 168432 - RNA, 64 nt, Human; identical to SEQ ID NO: 35297

SEQ ID NO: 168433 - RNA, 64 nt, Human; identical to SEQ ID NO: 35298

SEQ ID NO: 168434 - RNA, 64 nt, Human; identical to SEQ ID NO: 35299

SEQ ID NO: 168435 - RNA, 64 nt, Human; identical to SEQ ID NO: 35300

SEQ ID NO: 168436 - RNA, 64 nt, Human; identical to SEQ ID NO: 35301

SEQ ID NO: 168437 - RNA, 64 nt, Human; identical to SEQ ID NO: 35302

SEQ ID NO: 168438 - RNA, 64 nt, Human; identical to SEQ ID NO: 35303

SEQ ID NO: 168439 - RNA, 64 nt, Human; identical to SEQ ID NO: 35304

SEQ ID NO: 168440 - RNA, 64 nt, Human; identical to SEQ ID NO: 35305

SEQ ID NO: 168441 - RNA, 64 nt, Human; identical to SEQ ID NO: 35306

SEQ ID NO: 168442 - RNA, 64 nt, Human; identical to SEQ ID NO: 35307

SEQ ID NO: 168443 - RNA, 64 nt, Human; identical to SEQ ID NO: 35308

SEQ ID NO: 168444 - RNA, 64 nt, Human; identical to SEQ ID NO: 35309

SEQ ID NO: 168445 - RNA, 64 nt, Human; identical to SEQ ID NO: 35310

SEQ ID NO: 168446 - RNA, 64 nt, Human; identical to SEQ ID NO: 35311

SEQ ID NO: 168447 - RNA, 64 nt, Human; identical to SEQ ID NO: 35312

SEQ ID NO: 168448 - RNA, 64 nt, Human; identical to SEQ ID NO: 35313

SEQ ID NO: 168449 - RNA, 64 nt, Human; identical to SEQ ID NO: 35314

SEQ ID NO: 168450 - RNA, 64 nt, Human; identical to SEQ ID NO: 35315

SEQ ID NO: 168451 - RNA, 64 nt, Human; identical to SEQ ID NO: 35316

SEQ ID NO: 168452 - RNA, 64 nt, Human; identical to SEQ ID NO: 35317

SEQ ID NO: 168453 - RNA, 64 nt, Human; identical to SEQ ID NO: 35318

SEQ ID NO: 168454 - RNA, 64 nt, Human; identical to SEQ ID NO: 35319

SEQ ID NO: 168455 - RNA, 64 nt, Human; identical to SEQ ID NO: 35320

SEQ ID NO: 168456 - RNA, 64 nt, Human; identical to SEQ ID NO: 35321

SEQ ID NO: 168457 - RNA, 64 nt, Human; identical to SEQ ID NO: 35322

SEQ ID NO: 168458 - RNA, 64 nt, Human; identical to SEQ ID NO: 35323

SEQ ID NO: 168459 - RNA, 64 nt, Human; identical to SEQ ID NO: 35324

SEQ ID NO: 168460 - RNA, 64 nt, Human; identical to SEQ ID NO: 35325

SEQ ID NO: 168461 - RNA, 64 nt, Human; identical to SEQ ID NO: 35326

SEQ ID NO: 168462 - RNA, 64 nt, Human; identical to SEQ ID NO: 35327

SEQ ID NO: 168463 - RNA, 64 nt, Human; identical to SEQ ID NO: 35328

SEQ ID NO: 168464 - RNA, 64 nt, Human; identical to SEQ ID NO: 35329

SEQ ID NO: 168465 - RNA, 64 nt, Human; identical to SEQ ID NO: 35330

SEQ ID NO: 168466 - RNA, 64 nt, Human; identical to SEQ ID NO: 35331

SEQ ID NO: 168467 - RNA, 64 nt, Human; identical to SEQ ID NO: 35332

SEQ ID NO: 168468 - RNA, 64 nt, Human; identical to SEQ ID NO: 35333

SEQ ID NO: 168469 - RNA, 64 nt, Human; identical to SEQ ID NO: 35334

SEQ ID NO: 168470 - RNA, 64 nt, Human; identical to SEQ ID NO: 35335

SEQ ID NO: 168471 - RNA, 64 nt, Human; identical to SEQ ID NO: 35336

SEQ ID NO: 168472 - RNA, 64 nt, Human; identical to SEQ ID NO: 35337

SEQ ID NO: 168473 - RNA, 64 nt, Human; identical to SEQ ID NO: 35338

SEQ ID NO: 168474 - RNA, 64 nt, Human; identical to SEQ ID NO: 35339

SEQ ID NO: 168475 - RNA, 64 nt, Human; identical to SEQ ID NO: 35340

SEQ ID NO: 168476 - RNA, 64 nt, Human; identical to SEQ ID NO: 35341

SEQ ID NO: 168477 - RNA, 64 nt, Human; identical to SEQ ID NO: 35342

SEQ ID NO: 168478 - RNA, 64 nt, Human; identical to SEQ ID NO: 35343

SEQ ID NO: 168479 - RNA, 64 nt, Human; identical to SEQ ID NO: 35344

SEQ ID NO: 168480 - RNA, 64 nt, Human; identical to SEQ ID NO: 35345

SEQ ID NO: 168481 - RNA, 64 nt, Human; identical to SEQ ID NO: 35346

SEQ ID NO: 168482 - RNA, 64 nt, Human; identical to SEQ ID NO: 35347

SEQ ID NO: 168483 - RNA, 64 nt, Human; identical to SEQ ID NO: 35348

SEQ ID NO: 168484 - RNA, 64 nt, Human; identical to SEQ ID NO: 35349

SEQ ID NO: 168485 - RNA, 64 nt, Human; identical to SEQ ID NO: 35350

SEQ ID NO: 168486 - RNA, 64 nt, Human; identical to SEQ ID NO: 35351

SEQ ID NO: 168487 - RNA, 64 nt, Human; identical to SEQ ID NO: 35352

SEQ ID NO: 168488 - RNA, 64 nt, Human; identical to SEQ ID NO: 35353

SEQ ID NO: 168489 - RNA, 64 nt, Human; identical to SEQ ID NO: 35354

SEQ ID NO: 168490 - RNA, 64 nt, Human; identical to SEQ ID NO: 35355

SEQ ID NO: 168491 - RNA, 64 nt, Human; identical to SEQ ID NO: 35356

SEQ ID NO: 168492 - RNA, 64 nt, Human; identical to SEQ ID NO: 35357

SEQ ID NO: 168493 - RNA, 64 nt, Human; identical to SEQ ID NO: 35358

SEQ ID NO: 168494 - RNA, 64 nt, Human; identical to SEQ ID NO: 35359

SEQ ID NO: 168495 - RNA, 64 nt, Human; identical to SEQ ID NO: 35360

SEQ ID NO: 168496 - RNA, 64 nt, Human; identical to SEQ ID NO: 35361

SEQ ID NO: 168497 - RNA, 64 nt, Human; identical to SEQ ID NO: 35362

SEQ ID NO: 168498 - RNA, 64 nt, Human; identical to SEQ ID NO: 35363

SEQ ID NO: 168499 - RNA, 64 nt, Human; identical to SEQ ID NO: 35364

SEQ ID NO: 168500 - RNA, 64 nt, Human; identical to SEQ ID NO: 35365

SEQ ID NO: 168501 - RNA, 64 nt, Human; identical to SEQ ID NO: 35366

SEQ ID NO: 168502 - RNA, 64 nt, Human; identical to SEQ ID NO: 35367

SEQ ID NO: 168503 - RNA, 64 nt, Human; identical to SEQ ID NO: 35368

SEQ ID NO: 168504 - RNA, 64 nt, Human; identical to SEQ ID NO: 35369

SEQ ID NO: 168505 - RNA, 64 nt, Human; identical to SEQ ID NO: 35370

SEQ ID NO: 168506 - RNA, 64 nt, Human; identical to SEQ ID NO: 35371

SEQ ID NO: 168507 - RNA, 64 nt, Human; identical to SEQ ID NO: 35372

SEQ ID NO: 168508 - RNA, 64 nt, Human; identical to SEQ ID NO: 35373

SEQ ID NO: 168509 - RNA, 64 nt, Human; identical to SEQ ID NO: 35374

SEQ ID NO: 168510 - RNA, 64 nt, Human; identical to SEQ ID NO: 35375

SEQ ID NO: 168511 - RNA, 64 nt, Human; identical to SEQ ID NO: 35376

SEQ ID NO: 168512 - RNA, 64 nt, Human; identical to SEQ ID NO: 35377

SEQ ID NO: 168513 - RNA, 64 nt, Human; identical to SEQ ID NO: 35378

SEQ ID NO: 168514 - RNA, 58 nt, Human; identical to SEQ ID NO: 35379

SEQ ID NO: 168515 - RNA, 64 nt, Human; identical to SEQ ID NO: 35380

SEQ ID NO: 168516 - RNA, 64 nt, Human; identical to SEQ ID NO: 35381

SEQ ID NO: 168517 - RNA, 64 nt, Human; identical to SEQ ID NO: 35382

SEQ ID NO: 168518 - RNA, 64 nt, Human; identical to SEQ ID NO: 35383

SEQ ID NO: 168519 - RNA, 64 nt, Human; identical to SEQ ID NO: 35384

SEQ ID NO: 168520 - RNA, 64 nt, Human; identical to SEQ ID NO: 35385

SEQ ID NO: 168521 - RNA, 64 nt, Human; identical to SEQ ID NO: 35386

SEQ ID NO: 168522 - RNA, 64 nt, Human; identical to SEQ ID NO: 35387

SEQ ID NO: 168523 - RNA, 64 nt, Human; identical to SEQ ID NO: 35388

SEQ ID NO: 168524 - RNA, 64 nt, Human; identical to SEQ ID NO: 35389

SEQ ID NO: 168525 - RNA, 64 nt, Human; identical to SEQ ID NO: 35390

SEQ ID NO: 168526 - RNA, 64 nt, Human; identical to SEQ ID NO: 35391

SEQ ID NO: 168527 - RNA, 64 nt, Human; identical to SEQ ID NO: 35392

SEQ ID NO: 168528 - RNA, 57 nt, Human; identical to SEQ ID NO: 35393

SEQ ID NO: 168529 - RNA, 64 nt, Human; identical to SEQ ID NO: 35394

SEQ ID NO: 168530 - RNA, 64 nt, Human; identical to SEQ ID NO: 35395

SEQ ID NO: 168531 - RNA, 64 nt, Human; identical to SEQ ID NO: 35396

SEQ ID NO: 168532 - RNA, 64 nt, Human; identical to SEQ ID NO: 35397

SEQ ID NO: 168533 - RNA, 64 nt, Human; identical to SEQ ID NO: 35398

SEQ ID NO: 168534 - RNA, 64 nt, Human; identical to SEQ ID NO: 35399

SEQ ID NO: 168535 - RNA, 64 nt, Human; identical to SEQ ID NO: 35400

SEQ ID NO: 168536 - RNA, 64 nt, Human; identical to SEQ ID NO: 35401

SEQ ID NO: 168537 - RNA, 64 nt, Human; identical to SEQ ID NO: 35402

SEQ ID NO: 168538 - RNA, 64 nt, Human; identical to SEQ ID NO: 35403

SEQ ID NO: 168539 - RNA, 64 nt, Human; identical to SEQ ID NO: 35404

SEQ ID NO: 168540 - RNA, 64 nt, Human; identical to SEQ ID NO: 35405

SEQ ID NO: 168541 - RNA, 64 nt, Human; identical to SEQ ID NO: 35406

SEQ ID NO: 168542 - RNA, 64 nt, Human; identical to SEQ ID NO: 35407

SEQ ID NO: 168543 - RNA, 64 nt, Human; identical to SEQ ID NO: 35408

SEQ ID NO: 168544 - RNA, 64 nt, Human; identical to SEQ ID NO: 35409

SEQ ID NO: 168545 - RNA, 64 nt, Human; identical to SEQ ID NO: 35410

SEQ ID NO: 168546 - RNA, 64 nt, Human; identical to SEQ ID NO: 35411

SEQ ID NO: 168547 - RNA, 64 nt, Human; identical to SEQ ID NO: 35412

SEQ ID NO: 168548 - RNA, 64 nt, Human; identical to SEQ ID NO: 35413

SEQ ID NO: 168549 - RNA, 64 nt, Human; identical to SEQ ID NO: 35414

SEQ ID NO: 168550 - RNA, 64 nt, Human; identical to SEQ ID NO: 35415

SEQ ID NO: 168551 - RNA, 64 nt, Human; identical to SEQ ID NO: 35416

SEQ ID NO: 168552 - RNA, 64 nt, Human; identical to SEQ ID NO: 35417

SEQ ID NO: 168553 - RNA, 64 nt, Human; identical to SEQ ID NO: 35418

SEQ ID NO: 168554 - RNA, 64 nt, Human; identical to SEQ ID NO: 35419

SEQ ID NO: 168555 - RNA, 64 nt, Human; identical to SEQ ID NO: 35420

SEQ ID NO: 168556 - RNA, 64 nt, Human; identical to SEQ ID NO: 35421

SEQ ID NO: 168557 - RNA, 64 nt, Human; identical to SEQ ID NO: 35422

SEQ ID NO: 168558 - RNA, 64 nt, Human; identical to SEQ ID NO: 35423

SEQ ID NO: 168559 - RNA, 64 nt, Human; identical to SEQ ID NO: 35424

SEQ ID NO: 168560 - RNA, 64 nt, Human; identical to SEQ ID NO: 35425

SEQ ID NO: 168561 - RNA, 64 nt, Human; identical to SEQ ID NO: 35426

SEQ ID NO: 168562 - RNA, 64 nt, Human; identical to SEQ ID NO: 35427

SEQ ID NO: 168563 - RNA, 64 nt, Human; identical to SEQ ID NO: 35428

SEQ ID NO: 168564 - RNA, 64 nt, Human; identical to SEQ ID NO: 35429

SEQ ID NO: 168565 - RNA, 64 nt, Human; identical to SEQ ID NO: 35430

SEQ ID NO: 168566 - RNA, 64 nt, Human; identical to SEQ ID NO: 35431

SEQ ID NO: 168567 - RNA, 64 nt, Human; identical to SEQ ID NO: 35432

SEQ ID NO: 168568 - RNA, 64 nt, Human; identical to SEQ ID NO: 35433

SEQ ID NO: 168569 - RNA, 64 nt, Human; identical to SEQ ID NO: 35434

SEQ ID NO: 168570 - RNA, 64 nt, Human; identical to SEQ ID NO: 35435

SEQ ID NO: 168571 - RNA, 64 nt, Human; identical to SEQ ID NO: 35436

SEQ ID NO: 168572 - RNA, 64 nt, Human; identical to SEQ ID NO: 35437

SEQ ID NO: 168573 - RNA, 51 nt, Human; identical to SEQ ID NO: 35438

SEQ ID NO: 168574 - RNA, 64 nt, Human; identical to SEQ ID NO: 35439

SEQ ID NO: 168575 - RNA, 64 nt, Human; identical to SEQ ID NO: 35440

SEQ ID NO: 168576 - RNA, 64 nt, Human; identical to SEQ ID NO: 35441

SEQ ID NO: 168577 - RNA, 64 nt, Human; identical to SEQ ID NO: 35442

SEQ ID NO: 168578 - RNA, 64 nt, Human; identical to SEQ ID NO: 35443

SEQ ID NO: 168579 - RNA, 64 nt, Human; identical to SEQ ID NO: 35444

SEQ ID NO: 168580 - RNA, 64 nt, Human; identical to SEQ ID NO: 35445

SEQ ID NO: 168581 - RNA, 64 nt, Human; identical to SEQ ID NO: 35446

SEQ ID NO: 168582 - RNA, 64 nt, Human; identical to SEQ ID NO: 35447

SEQ ID NO: 168583 - RNA, 64 nt, Human; identical to SEQ ID NO: 35448

SEQ ID NO: 168584 - RNA, 64 nt, Human; identical to SEQ ID NO: 35449

SEQ ID NO: 168585 - RNA, 64 nt, Human; identical to SEQ ID NO: 35450

SEQ ID NO: 168586 - RNA, 64 nt, Human; identical to SEQ ID NO: 35451

SEQ ID NO: 168587 - RNA, 64 nt, Human; identical to SEQ ID NO: 35452

SEQ ID NO: 168588 - RNA, 64 nt, Human; identical to SEQ ID NO: 35453

SEQ ID NO: 168589 - RNA, 64 nt, Human; identical to SEQ ID NO: 35454

SEQ ID NO: 168590 - RNA, 64 nt, Human; identical to SEQ ID NO: 35455

SEQ ID NO: 168591 - RNA, 64 nt, Human; identical to SEQ ID NO: 35456

SEQ ID NO: 168592 - RNA, 64 nt, Human; identical to SEQ ID NO: 35457

SEQ ID NO: 168593 - RNA, 64 nt, Human; identical to SEQ ID NO: 35458

SEQ ID NO: 168594 - RNA, 64 nt, Human; identical to SEQ ID NO: 35459

SEQ ID NO: 168595 - RNA, 64 nt, Human; identical to SEQ ID NO: 35460

SEQ ID NO: 168596 - RNA, 64 nt, Human; identical to SEQ ID NO: 35461

SEQ ID NO: 168597 - RNA, 64 nt, Human; identical to SEQ ID NO: 35462

SEQ ID NO: 168598 - RNA, 64 nt, Human; identical to SEQ ID NO: 35463

SEQ ID NO: 168599 - RNA, 64 nt, Human; identical to SEQ ID NO: 35464

SEQ ID NO: 168600 - RNA, 64 nt, Human; identical to SEQ ID NO: 35465

SEQ ID NO: 168601 - RNA, 64 nt, Human; identical to SEQ ID NO: 35466

SEQ ID NO: 168602 - RNA, 64 nt, Human; identical to SEQ ID NO: 35467

SEQ ID NO: 168603 - RNA, 64 nt, Human; identical to SEQ ID NO: 35468

SEQ ID NO: 168604 - RNA, 64 nt, Human; identical to SEQ ID NO: 35469

SEQ ID NO: 168605 - RNA, 64 nt, Human; identical to SEQ ID NO: 35470

SEQ ID NO: 168606 - RNA, 64 nt, Human; identical to SEQ ID NO: 35471

SEQ ID NO: 168607 - RNA, 64 nt, Human; identical to SEQ ID NO: 35472

SEQ ID NO: 168608 - RNA, 64 nt, Human; identical to SEQ ID NO: 35473

SEQ ID NO: 168609 - RNA, 64 nt, Human; identical to SEQ ID NO: 35474

SEQ ID NO: 168610 - RNA, 64 nt, Human; identical to SEQ ID NO: 35475

SEQ ID NO: 168611 - RNA, 64 nt, Human; identical to SEQ ID NO: 35476

SEQ ID NO: 168612 - RNA, 64 nt, Human; identical to SEQ ID NO: 35477

SEQ ID NO: 168613 - RNA, 64 nt, Human; identical to SEQ ID NO: 35478

SEQ ID NO: 168614 - RNA, 64 nt, Human; identical to SEQ ID NO: 35479

SEQ ID NO: 168615 - RNA, 64 nt, Human; identical to SEQ ID NO: 35480

SEQ ID NO: 168616 - RNA, 64 nt, Human; identical to SEQ ID NO: 35481

SEQ ID NO: 168617 - RNA, 64 nt, Human; identical to SEQ ID NO: 35482

SEQ ID NO: 168618 - RNA, 64 nt, Human; identical to SEQ ID NO: 35483

SEQ ID NO: 168619 - RNA, 64 nt, Human; identical to SEQ ID NO: 35484

SEQ ID NO: 168620 - RNA, 55 nt, Human; identical to SEQ ID NO: 35485

SEQ ID NO: 168621 - RNA, 64 nt, Human; identical to SEQ ID NO: 35486

SEQ ID NO: 168622 - RNA, 64 nt, Human; identical to SEQ ID NO: 35487

SEQ ID NO: 168623 - RNA, 64 nt, Human; identical to SEQ ID NO: 35488

SEQ ID NO: 168624 - RNA, 64 nt, Human; identical to SEQ ID NO: 35489

SEQ ID NO: 168625 - RNA, 64 nt, Human; identical to SEQ ID NO: 35490

SEQ ID NO: 168626 - RNA, 64 nt, Human; identical to SEQ ID NO: 35491

SEQ ID NO: 168627 - RNA, 64 nt, Human; identical to SEQ ID NO: 35492

SEQ ID NO: 168628 - RNA, 64 nt, Human; identical to SEQ ID NO: 35493

SEQ ID NO: 168629 - RNA, 64 nt, Human; identical to SEQ ID NO: 35494

SEQ ID NO: 168630 - RNA, 64 nt, Human; identical to SEQ ID NO: 35495

SEQ ID NO: 168631 - RNA, 64 nt, Human; identical to SEQ ID NO: 35496

SEQ ID NO: 168632 - RNA, 64 nt, Human; identical to SEQ ID NO: 35497

SEQ ID NO: 168633 - RNA, 64 nt, Human; identical to SEQ ID NO: 35498

SEQ ID NO: 168634 - RNA, 64 nt, Human; identical to SEQ ID NO: 35499

SEQ ID NO: 168635 - RNA, 64 nt, Human; identical to SEQ ID NO: 35500

SEQ ID NO: 168636 - RNA, 64 nt, Human; identical to SEQ ID NO: 35501

SEQ ID NO: 168637 - RNA, 64 nt, Human; identical to SEQ ID NO: 35502

SEQ ID NO: 168638 - RNA, 64 nt, Human; identical to SEQ ID NO: 35503

SEQ ID NO: 168639 - RNA, 64 nt, Human; identical to SEQ ID NO: 35504

SEQ ID NO: 168640 - RNA, 64 nt, Human; identical to SEQ ID NO: 35505

SEQ ID NO: 168641 - RNA, 64 nt, Human; identical to SEQ ID NO: 35506

SEQ ID NO: 168642 - RNA, 64 nt, Human; identical to SEQ ID NO: 35507

SEQ ID NO: 168643 - RNA, 64 nt, Human; identical to SEQ ID NO: 35508

SEQ ID NO: 168644 - RNA, 64 nt, Human; identical to SEQ ID NO: 35509

SEQ ID NO: 168645 - RNA, 64 nt, Human; identical to SEQ ID NO: 35510

SEQ ID NO: 168646 - RNA, 64 nt, Human; identical to SEQ ID NO: 35511

SEQ ID NO: 168647 - RNA, 64 nt, Human; identical to SEQ ID NO: 35512

SEQ ID NO: 168648 - RNA, 64 nt, Human; identical to SEQ ID NO: 35513

SEQ ID NO: 168649 - RNA, 64 nt, Human; identical to SEQ ID NO: 35514

SEQ ID NO: 168650 - RNA, 64 nt, Human; identical to SEQ ID NO: 35515

SEQ ID NO: 168651 - RNA, 64 nt, Human; identical to SEQ ID NO: 35516

SEQ ID NO: 168652 - RNA, 64 nt, Human; identical to SEQ ID NO: 35517

SEQ ID NO: 168653 - RNA, 64 nt, Human; identical to SEQ ID NO: 35518

SEQ ID NO: 168654 - RNA, 64 nt, Human; identical to SEQ ID NO: 35519

SEQ ID NO: 168655 - RNA, 64 nt, Human; identical to SEQ ID NO: 35520

SEQ ID NO: 168656 - RNA, 64 nt, Human; identical to SEQ ID NO: 35521

SEQ ID NO: 168657 - RNA, 64 nt, Human; identical to SEQ ID NO: 35522

SEQ ID NO: 168658 - RNA, 64 nt, Human; identical to SEQ ID NO: 35523

SEQ ID NO: 168659 - RNA, 64 nt, Human; identical to SEQ ID NO: 35524

SEQ ID NO: 168660 - RNA, 64 nt, Human; identical to SEQ ID NO: 35525

SEQ ID NO: 168661 - RNA, 64 nt, Human; identical to SEQ ID NO: 35526

SEQ ID NO: 168662 - RNA, 64 nt, Human; identical to SEQ ID NO: 35527

SEQ ID NO: 168663 - RNA, 64 nt, Human; identical to SEQ ID NO: 35528

SEQ ID NO: 168664 - RNA, 64 nt, Human; identical to SEQ ID NO: 35529

SEQ ID NO: 168665 - RNA, 64 nt, Human; identical to SEQ ID NO: 35530

SEQ ID NO: 168666 - RNA, 64 nt, Human; identical to SEQ ID NO: 35531

SEQ ID NO: 168667 - RNA, 64 nt, Human; identical to SEQ ID NO: 35532

SEQ ID NO: 168668 - RNA, 64 nt, Human; identical to SEQ ID NO: 35533

SEQ ID NO: 168669 - RNA, 64 nt, Human; identical to SEQ ID NO: 35534

SEQ ID NO: 168670 - RNA, 64 nt, Human; identical to SEQ ID NO: 35535

SEQ ID NO: 168671 - RNA, 64 nt, Human; identical to SEQ ID NO: 35536

SEQ ID NO: 168672 - RNA, 64 nt, Human; identical to SEQ ID NO: 35537

SEQ ID NO: 168673 - RNA, 64 nt, Human; identical to SEQ ID NO: 35538

SEQ ID NO: 168674 - RNA, 64 nt, Human; identical to SEQ ID NO: 35539

SEQ ID NO: 168675 - RNA, 64 nt, Human; identical to SEQ ID NO: 35540

SEQ ID NO: 168676 - RNA, 64 nt, Human; identical to SEQ ID NO: 35541

SEQ ID NO: 168677 - RNA, 64 nt, Human; identical to SEQ ID NO: 35542

SEQ ID NO: 168678 - RNA, 64 nt, Human; identical to SEQ ID NO: 35543

SEQ ID NO: 168679 - RNA, 64 nt, Human; identical to SEQ ID NO: 35544

SEQ ID NO: 168680 - RNA, 64 nt, Human; identical to SEQ ID NO: 35545

SEQ ID NO: 168681 - RNA, 64 nt, Human; identical to SEQ ID NO: 35546

SEQ ID NO: 168682 - RNA, 64 nt, Human; identical to SEQ ID NO: 35547

SEQ ID NO: 168683 - RNA, 64 nt, Human; identical to SEQ ID NO: 35548

SEQ ID NO: 168684 - RNA, 64 nt, Human; identical to SEQ ID NO: 35549

SEQ ID NO: 168685 - RNA, 64 nt, Human; identical to SEQ ID NO: 35550

SEQ ID NO: 168686 - RNA, 64 nt, Human; identical to SEQ ID NO: 35551

SEQ ID NO: 168687 - RNA, 64 nt, Human; identical to SEQ ID NO: 35552

SEQ ID NO: 168688 - RNA, 64 nt, Human; identical to SEQ ID NO: 35553

SEQ ID NO: 168689 - RNA, 64 nt, Human; identical to SEQ ID NO: 35554

SEQ ID NO: 168690 - RNA, 64 nt, Human; identical to SEQ ID NO: 35555

SEQ ID NO: 168691 - RNA, 64 nt, Human; identical to SEQ ID NO: 35556

SEQ ID NO: 168692 - RNA, 64 nt, Human; identical to SEQ ID NO: 35557

SEQ ID NO: 168693 - RNA, 64 nt, Human; identical to SEQ ID NO: 35558

SEQ ID NO: 168694 - RNA, 64 nt, Human; identical to SEQ ID NO: 35559

SEQ ID NO: 168695 - RNA, 64 nt, Human; identical to SEQ ID NO: 35560

SEQ ID NO: 168696 - RNA, 64 nt, Human; identical to SEQ ID NO: 35561

SEQ ID NO: 168697 - RNA, 64 nt, Human; identical to SEQ ID NO: 35562

SEQ ID NO: 168698 - RNA, 64 nt, Human; identical to SEQ ID NO: 35563

SEQ ID NO: 168699 - RNA, 64 nt, Human; identical to SEQ ID NO: 35564

SEQ ID NO: 168700 - RNA, 64 nt, Human; identical to SEQ ID NO: 35565

SEQ ID NO: 168701 - RNA, 64 nt, Human; identical to SEQ ID NO: 35566

SEQ ID NO: 168702 - RNA, 64 nt, Human; identical to SEQ ID NO: 35567

SEQ ID NO: 168703 - RNA, 64 nt, Human; identical to SEQ ID NO: 35568

SEQ ID NO: 168704 - RNA, 64 nt, Human; identical to SEQ ID NO: 35569

SEQ ID NO: 168705 - RNA, 64 nt, Human; identical to SEQ ID NO: 35570

SEQ ID NO: 168706 - RNA, 64 nt, Human; identical to SEQ ID NO: 35571

SEQ ID NO: 168707 - RNA, 64 nt, Human; identical to SEQ ID NO: 35572

SEQ ID NO: 168708 - RNA, 64 nt, Human; identical to SEQ ID NO: 35573

SEQ ID NO: 168709 - RNA, 64 nt, Human; identical to SEQ ID NO: 35574

SEQ ID NO: 168710 - RNA, 64 nt, Human; identical to SEQ ID NO: 35575

SEQ ID NO: 168711 - RNA, 64 nt, Human; identical to SEQ ID NO: 35576

SEQ ID NO: 168712 - RNA, 64 nt, Human; identical to SEQ ID NO: 35577

SEQ ID NO: 168713 - RNA, 64 nt, Human; identical to SEQ ID NO: 35578

SEQ ID NO: 168714 - RNA, 64 nt, Human; identical to SEQ ID NO: 35579

SEQ ID NO: 168715 - RNA, 64 nt, Human; identical to SEQ ID NO: 35580

SEQ ID NO: 168716 - RNA, 64 nt, Human; identical to SEQ ID NO: 35581

SEQ ID NO: 168717 - RNA, 64 nt, Human; identical to SEQ ID NO: 35582

SEQ ID NO: 168718 - RNA, 64 nt, Human; identical to SEQ ID NO: 35583

SEQ ID NO: 168719 - RNA, 64 nt, Human; identical to SEQ ID NO: 35584

SEQ ID NO: 168720 - RNA, 64 nt, Human; identical to SEQ ID NO: 35585

SEQ ID NO: 168721 - RNA, 64 nt, Human; identical to SEQ ID NO: 35586

SEQ ID NO: 168722 - RNA, 64 nt, Human; identical to SEQ ID NO: 35587

SEQ ID NO: 168723 - RNA, 64 nt, Human; identical to SEQ ID NO: 35588

SEQ ID NO: 168724 - RNA, 64 nt, Human; identical to SEQ ID NO: 35589

SEQ ID NO: 168725 - RNA, 64 nt, Human; identical to SEQ ID NO: 35590

SEQ ID NO: 168726 - RNA, 64 nt, Human; identical to SEQ ID NO: 35591

SEQ ID NO: 168727 - RNA, 64 nt, Human; identical to SEQ ID NO: 35592

SEQ ID NO: 168728 - RNA, 64 nt, Human; identical to SEQ ID NO: 35593

SEQ ID NO: 168729 - RNA, 64 nt, Human; identical to SEQ ID NO: 35594

SEQ ID NO: 168730 - RNA, 64 nt, Human; identical to SEQ ID NO: 35595

SEQ ID NO: 168731 - RNA, 64 nt, Human; identical to SEQ ID NO: 35596

SEQ ID NO: 168732 - RNA, 64 nt, Human; identical to SEQ ID NO: 35597

SEQ ID NO: 168733 - RNA, 64 nt, Human; identical to SEQ ID NO: 35598

SEQ ID NO: 168734 - RNA, 64 nt, Human; identical to SEQ ID NO: 35599

SEQ ID NO: 168735 - RNA, 64 nt, Human; identical to SEQ ID NO: 35600

SEQ ID NO: 168736 - RNA, 64 nt, Human; identical to SEQ ID NO: 35601

SEQ ID NO: 168737 - RNA, 64 nt, Human; identical to SEQ ID NO: 35602

SEQ ID NO: 168738 - RNA, 64 nt, Human; identical to SEQ ID NO: 35603

SEQ ID NO: 168739 - RNA, 64 nt, Human; identical to SEQ ID NO: 35604

SEQ ID NO: 168740 - RNA, 64 nt, Human; identical to SEQ ID NO: 35605

SEQ ID NO: 168741 - RNA, 64 nt, Human; identical to SEQ ID NO: 35606

SEQ ID NO: 168742 - RNA, 64 nt, Human; identical to SEQ ID NO: 35607

SEQ ID NO: 168743 - RNA, 64 nt, Human; identical to SEQ ID NO: 35608

SEQ ID NO: 168744 - RNA, 64 nt, Human; identical to SEQ ID NO: 35609

SEQ ID NO: 168745 - RNA, 64 nt, Human; identical to SEQ ID NO: 35610

SEQ ID NO: 168746 - RNA, 64 nt, Human; identical to SEQ ID NO: 35611

SEQ ID NO: 168747 - RNA, 64 nt, Human; identical to SEQ ID NO: 35612

SEQ ID NO: 168748 - RNA, 55 nt, Human; identical to SEQ ID NO: 35613

SEQ ID NO: 168749 - RNA, 64 nt, Human; identical to SEQ ID NO: 35614

SEQ ID NO: 168750 - RNA, 64 nt, Human; identical to SEQ ID NO: 35615

SEQ ID NO: 168751 - RNA, 64 nt, Human; identical to SEQ ID NO: 35616

SEQ ID NO: 168752 - RNA, 64 nt, Human
ggcuugcugagaaccccauggacaguggagagcgggauucgaaccaagggcuggacucccacac

SEQ ID NO: 168753 - RNA, 64 nt, Human
gacaguucuuugcacacaaguuuuacaccucucuggauucgaaguuuguauuguauucauaguu

SEQ ID NO: 168754 - RNA, 64 nt, Human
aagcaggggccggacuugggggaaauguugccauggauucgaugggacuuuggggaccuguguc

SEQ ID NO: 168755 - RNA, 64 nt, Human
cuguugccuguggagucucugcugaaaugaaucaggauucgagcucuaggaugagacagaaaau

SEQ ID NO: 168756 - RNA, 64 nt, Human
aacucccugaccccgaugugauuuuucuccccggggauucgagagccaugcgugggacacugga

SEQ ID NO: 168757 - RNA, 64 nt, Human
ugugcucuggcaccaucagccuguuccagaaggaggauucgagcaucaggcuaagacccugugu

SEQ ID NO: 168758 - RNA, 64 nt, Human
ugcaacuguagggaacaccauuuaugcagugggaggauucgauggcaaugaauuucugaauacg

SEQ ID NO: 168759 - RNA, 64 nt, Human
gcaguagcuagagggacagguuuccuuccaggaaggauucgaguuccugugccuguggguauua

SEQ ID NO: 168760 - RNA, 64 nt, Human
ucuuuugaguuguugaguauauuugagauugauuggauucgaccucuuguugaacugaaaacuu

SEQ ID NO: 168761 - RNA, 64 nt, Human
uuaccccugcacuauuucagugcaccacagaauaggauucgagauuuacauaugccuguuugug

SEQ ID NO: 168762 - RNA, 64 nt, Human
ggugggugcacacugcaugcuugggggugccaagggauucgagaccuccaacauacuugucuga

SEQ ID NO: 168763 - RNA, 64 nt, Human
ucccuucuaguucugagaugcuuugaggguaacuggauucgauuuugggauaucuuuucucaca

SEQ ID NO: 168764 - RNA, 55 nt, Human
uggaagacagcuuccuguaacuggcggauucgagggguuccuuccacuucugggg

SEQ ID NO: 168765 - RNA, 64 nt, Human
auggaugguuccaugagcccccagaugaaaaccuggauucgacagggaagagcuuggauccccg

SEQ ID NO: 168766 - RNA, 64 nt, Human
gcugacacggacuguaggugcuuuuuguucagguggauucgaaggaguuagagaugugauuucc

SEQ ID NO: 168767 - RNA, 64 nt, Human
uagggaccacaaaagggaacaagcaaaaaaguuuggauucgauaaagugauauguaauaguugc

SEQ ID NO: 168768 - RNA, 64 nt, Human
uaguaucuauguagguucagucagauccaaccauggauucgagguauuauacuguauaacccua

SEQ ID NO: 168769 - RNA, 64 nt, Human
ucaaaauugcacaaacauggugcucuaccaggaaggauucgagguagauaggcucaggccacac

SEQ ID NO: 168770 - RNA, 64 nt, Human
caaagcacaguacuguuagcuguuuuuguggacaggauucgauuaaguauucccucuugucaaa

SEQ ID NO: 168771 - RNA, 64 nt, Human
gaggcagcuaggcuguagauggaagaugguccugggauucgaacaccgcugggaucuggccagg

SEQ ID NO: 168772 - RNA, 64 nt, Human
gcacacaucaugggcuuuggaggcacacaagccuggauucgaaucugggcucuuucacauacua

SEQ ID NO: 168773 - RNA, 64 nt, Human
uucagccucuagaaugguaacaaaucagccaauuggauucgaaacaaagaagacuauguaaaac

SEQ ID NO: 168774 - RNA, 64 nt, Human
ggugggauauuugauaggauccauaucuaauaauggauucgaacucuccaaacuacaccaauua

SEQ ID NO: 168775 - RNA, 64 nt, Human
augcuccugcaccugcaccaccaagguugaugccggauucgaagccaggaaggcccagucccuc

SEQ ID NO: 168776 - RNA, 64 nt, Human
ucacccccgugaccucucccagccagggcugagaggauucgagguggcugggaggguuuccagg

SEQ ID NO: 168777 - RNA, 64 nt, Human
uacccauguguacagccuacccaugcagggacugggauucgaggacuuccaggcgcauagggua

SEQ ID NO: 168778 - RNA, 64 nt, Human
acaucacauaguaacugccgguccagaaugugacggauucgacucuauucauuuucaaauaaag

SEQ ID NO: 168779 - RNA, 64 nt, Human
ggagaggaggagcagagagcuggguccugggcugggauucgagcccugggcgggggucagucaa

SEQ ID NO: 168780 - RNA, 64 nt, Human
acggucaaccccaauuaccaauuuaguugaggcuggauucgauugcucaguucaccugccacgu

SEQ ID NO: 168781 - RNA, 64 nt, Human
uagaggugugcuguguuaaaagagccagauaaauggauucgagccacuuguaggcacauuagcu

SEQ ID NO: 168782 - RNA, 64 nt, Human
acccacggccccggaaccgcggcgacuggaggcuggauucgaggccggaaacgccgggaccccu

SEQ ID NO: 168783 - RNA, 64 nt, Human
agcgugcuucauuugacacccagagucugacuuuggauucgaacuaaacccaggcaacaggcga

SEQ ID NO: 168784 - RNA, 64 nt, Human
ccucaggaaaagccaaaaccgaggcccauugcccggauucgacacaaaagagggucccugcucu

SEQ ID NO: 168785 - RNA, 64 nt, Human
ggugucgcaugaagagcuugcuucacacacaacaggauucgauacuuugccaauucaaggcccu

SEQ ID NO: 168786 - RNA, 64 nt, Human
uaucuuugaaauuuugcaugaaaaggaaaugaauggauucgaaugaaauuguccuuuagagcau

SEQ ID NO: 168787 - RNA, 64 nt, Human
gcuguugguaccuguguauuuggaauauuuuaggggauucgaauuuuuuuuaacccacauuaca

SEQ ID NO: 168788 - RNA, 64 nt, Human
agccucgaccgagacaaggaggcccuuaaaugacagccugcauuugcuagacgguuggugagug

SEQ ID NO: 168789 - RNA, 64 nt, Human
uugcacacuuuccuucugagccuccauggagaccagccugcaagccggcccagccuguccagga

SEQ ID NO: 168790 - RNA, 64 nt, Human
ggcucgccuuggccuguugccacucuugcucccuagccugcaaggcuagcuccccuguggucuu

SEQ ID NO: 168791 - RNA, 64 nt, Human
cucuccuuccucgccagcacgccuuagcuuugcaagccugcaugcauucaggcuucucaggugu

SEQ ID NO: 168792 - RNA, 64 nt, Human
ucucaguagccuuaucauucacaggugccucucuagccugcacaaaugauugacaagagaucac

SEQ ID NO: 168793 - RNA, 64 nt, Human
uacuuggccuauuugccagagaacaucuuaaugcagccugcauagugaaaugguuauuuugaga

SEQ ID NO: 168794 - RNA, 64 nt, Human
ccacccccaccaagggcgcaagaguagcgguccaagccugcaacucaucuuucauuaaaggcuu

SEQ ID NO: 168795 - RNA, 64 nt, Human
aaccucaccagaugcccaacccgacugcccuaccagccugcacauggguagaagaggccaaauu

SEQ ID NO: 168796 - RNA, 64 nt, Human
ugggcagaggaugaggugggcugaagggaagcccagccugcaucuagcuggagccccgcaggga

SEQ ID NO: 168797 - RNA, 64 nt, Human
ucccuugaccaagaaauuggguuucuuuucccucagccugcacuuacucuucuauuaagaccag

SEQ ID NO: 168798 - RNA, 64 nt, Human
cccucuugggcugugugcccaucagagcaggcucagccugcaaaggcccugcauucagaggucu

SEQ ID NO: 168799 - RNA, 64 nt, Human
ccaccucugugugugauguagcuuucucucccucagccugcaaggguccgauuugccaucgaaa

SEQ ID NO: 168800 - RNA, 64 nt, Human
gucaucugucccaccugcugcugccccuuggagcagccugcaccuucucuccucccauccggca

SEQ ID NO: 168801 - RNA, 64 nt, Human
aggggcuacacuccccaucaggcagcaucccaccagccugcaccacaggcuccccugggaggac

SEQ ID NO: 168802 - RNA, 64 nt, Human
acaccaggcuaugugggcccccaccuuguuucccagccugcaccuuagaagccgaaggugcuuu

SEQ ID NO: 168803 - RNA, 64 nt, Human
ugguagggagguccaaguaugugcauaugagauaagccugcaaccucuugaccuucagcuccua

SEQ ID NO: 168804 - RNA, 64 nt, Human
uuuguuauuccccuuugacagaugagaaaacagaagccugcaaagguaaagacagaguuaggaa

SEQ ID NO: 168805 - RNA, 64 nt, Human
ccucuuagaaggaucagaggcaagaugagauggcagccugcagaguaaaugcuugaaaaaagag

SEQ ID NO: 168806 - RNA, 64 nt, Human
gccacacuauuaccaugagaagagggccugugggagccugcaaacucacugcucaagaagacau

SEQ ID NO: 168807 - RNA, 64 nt, Human
cucucaccgcuguagcuguggcggcuggggcugcagccugcagggagaagcaagaagcaucagu

SEQ ID NO: 168808 - RNA, 64 nt, Human
uucaagccccgccucuccucuuggaggacagggcagccugcagcuguguccaggcccaggcccc

SEQ ID NO: 168809 - RNA, 64 nt, Human
uaagugccuaacccugcuugucucuguacauagaagccugcacagauccaacccuugcuaggua

SEQ ID NO: 168810 - RNA, 64 nt, Human
cugcaccaaaaauuucagagaagggauaaauagaagccugcacagcaucgugaauuaacugaag

SEQ ID NO: 168811 - RNA, 64 nt, Human
cagcucaauggaacuaaugcagauguugcauaauagccugcauuguagucaguguguucuacag

SEQ ID NO: 168812 - RNA, 64 nt, Human
aaaacuugucuccucuaccaccacccuguacccuagccugcaccuguccucaucucugcaaagu

SEQ ID NO: 168813 - RNA, 64 nt, Human
acugcaguucccagugccacggaagugugauuggagccugcagauaaugcccagccauccuccc

SEQ ID NO: 168814 - RNA, 64 nt, Human
acuagccccuuacccagaguggcccacaggaaacagccugcaccauuuuuuuuucuguucucuc

SEQ ID NO: 168815 - RNA, 64 nt, Human
uuuucagggcagugggauggugacuucugagcuaagccugcaagggaaguggcuguucccagac

SEQ ID NO: 168816 - RNA, 64 nt, Human
aucccuucccaccucucccccacuucuucccuccagccugcaugcccuccucuggaacugggau

SEQ ID NO: 168817 - RNA, 64 nt, Human
ucugcccaaccagguugcaguagcaguggauguuagccugcaaacaacauuaggggauucuucu

SEQ ID NO: 168818 - RNA, 64 nt, Human
aaagaaccaaaacacuacccugaagggccagccuagccugcagcccucccuugcagggagccuu

SEQ ID NO: 168819 - RNA, 64 nt, Human
uggucuaagugugcugcauggagugagcaguagaagccugcagcggcacaaaugcaccucccag

SEQ ID NO: 168820 - RNA, 64 nt, Human
accaccagugugggguucugcugggaccuuggagagccugcaucccaggaugcuggguggcccu

SEQ ID NO: 168821 - RNA, 64 nt, Human
accugcccuccccacccccugccccucgggcaccagccugcauauguguucacuuuuauuuaaa

SEQ ID NO: 168822 - RNA, 64 nt, Human
cuuccaacuccucgcagaagugggagaggccggcagccugcaccgagaggggcuuuccucucuc

SEQ ID NO: 168823 - RNA, 64 nt, Human
ugccauggacagaaaaagaguuuuucucuuguucagccugcacguggccugaggaaggaguaga

SEQ ID NO: 168824 - RNA, 64 nt, Human
cauggugagguccauggcucuugucaucaggauaagccugcacaccuagagugucggugagcug

SEQ ID NO: 168825 - RNA, 64 nt, Human
ggggggcaggggggagaggggguaauggaggccaagccugcagcuuucuggaaauucuucccug

SEQ ID NO: 168826 - RNA, 64 nt, Human
uggaacugauuaaaagggcagagggucuguugccagccugcauugauauaccagucccauuugu

SEQ ID NO: 168827 - RNA, 64 nt, Human
agacauuuucccugaaagucagaagucaccauagagccugcaaauggauccuccugugagagug

SEQ ID NO: 168828 - RNA, 64 nt, Human
auucuggaucucuccugcuguaaccccacgcacaagccugcaacccccagagcucuuugacagg

SEQ ID NO: 168829 - RNA, 64 nt, Human
uuuauuucaggcauuggauauuuuuuacuuuagaagccugcauaauguuucuggauuucauacu

SEQ ID NO: 168830 - RNA, 64 nt, Human
agaaagcugguaaguccuagggauuuccagaaguagccugcagaagaagguaaguuugaaagcc

SEQ ID NO: 168831 - RNA, 64 nt, Human
aucuuagcuuuaaacacaagagaagucuuuaaaaagccugcauuguguauuaaacaccagguaa

SEQ ID NO: 168832 - RNA, 64 nt, Human
aguucucagaaacguggcuggggcccagcacagcagccugcaagggccccuguuuguugaugca

SEQ ID NO: 168833 - RNA, 64 nt, Human
ugucuugcugccuguacuuacugguguggaaaauagccugcagguaggaccauugcagugaugg

SEQ ID NO: 168834 - RNA, 64 nt, Human
caccuccuccucccgccccugcccccacccccggagccugcaaaaguguaaucccuguaucugc

SEQ ID NO: 168835 - RNA, 64 nt, Human
ccacagcucagccuggggccugggcagggcucccagccugcaccgccucccacugccagugggg

SEQ ID NO: 168836 - RNA, 59 nt, Human
aggugguggacaacuccugaauggccucgagccugcaacaguccaaaccggaagggaga

SEQ ID NO: 168837 - RNA, 64 nt, Human
uggaccagaacagacuggaaacugggcagcaagcagccugcaaccaccucagacauccuggacu

SEQ ID NO: 168838 - RNA, 64 nt, Human
augugagaaugaugaaacccgacagaaguaucucagccugcagucaguuauuauguauaggagg

SEQ ID NO: 168839 - RNA, 64 nt, Human
acuugcccaaggucacacagcuaguuagcggcagagccugcacucgaauucaggucuccugacu

SEQ ID NO: 168840 - RNA, 64 nt, Human
gcacaccaggauagacaaggcaggggauacuggcagccugcaucauccucccauugggcugaca

SEQ ID NO: 168841 - RNA, 64 nt, Human
aacauuugccaagucuuccugggcccggcaggagagccugcaggagcgcaagcaagcacuauau

SEQ ID NO: 168842 - RNA, 64 nt, Human
acugggacaguuuccugggaugagugccagccugagccugcauggugccgccgagcccggggug

SEQ ID NO: 168843 - RNA, 64 nt, Human
auugauagggaggcuauugaagcaguuuuucugaagccugcauuuugaguuaguuuauagugcu

SEQ ID NO: 168844 - RNA, 64 nt, Human
auuguuuguuuguaaguuugaauuuguauuaaaaagccugcauucugagcuggacaugguggcu

SEQ ID NO: 168845 - RNA, 64 nt, Human
acaccacaaauugaaacucagaacuauauuucuaagccugcauuuucacugaugcauaauuuuc

SEQ ID NO: 168846 - RNA, 64 nt, Human
agugcuuaaucuuugccucauguuauguaaaauuagccugcagauauuuucucucaauucugua

SEQ ID NO: 168847 - RNA, 64 nt, Human
agggacaagacuaugugcuccgcugcccaccuucagccugcaaugagggacugaggcccacgag

SEQ ID NO: 168848 - RNA, 64 nt, Human
uucauacaaagcaucucacuccccuccccaggagagccugcacagcuucuugcacucacaacgg

SEQ ID NO: 168849 - RNA, 64 nt, Human
ucaguagagaaagucuagcuaagcaguguugaaaagccugcaagauuucaguuuacauaucgac

SEQ ID NO: 168850 - RNA, 64 nt, Human
aagggaaguccgcagccgacgcccgcuacgaagcagccugcaacaggcuggccaacaaggcggu

SEQ ID NO: 168851 - RNA, 64 nt, Human
ccagagcuaagaucucuggguuguauuugcugacagccugcaagcuugcaugcucugaaagauu

SEQ ID NO: 168852 - RNA, 64 nt, Human
agaaaccaagacuagcuuuguaggagagaaugagagccugcaagccucucuuuggauuggcuga

SEQ ID NO: 168853 - RNA, 64 nt, Human
guggguggggcgcccauagcacugccgguaaaggagccugcauguucaggccccucgggggauu

SEQ ID NO: 168854 - RNA, 64 nt, Human
auggucugcuagagugauaagacucagaacaggaagccugcaugugacugagcaagucaccuac

SEQ ID NO: 168855 - RNA, 64 nt, Human
ucccauuucugcugccuuuggcccugccuggcccagccugcaccccugugggguggaaauguac

SEQ ID NO: 168856 - RNA, 64 nt, Human
guaccaagcauuuagugcacaguggccccaucauagccugcagccucaucauuucccaucugga

SEQ ID NO: 168857 - RNA, 64 nt, Human
aaaaaggaauccccagagcagacgcaaugguaggagccugcacaggauguguguguauggacau

SEQ ID NO: 168858 - RNA, 64 nt, Human
gacacagccuguaggaacauacacagcugggaucagccugcagccaucccccgacccugcugcu

SEQ ID NO: 168859 - RNA, 64 nt, Human
guccaagccaagaggacuggcaggcggggccucaagccugcagccacuggcuugauugggcccu

SEQ ID NO: 168860 - RNA, 64 nt, Human
uagcucauggggccuuggaggagccuggccucucagccugcauaacagacugaaaugugcucag

SEQ ID NO: 168861 - RNA, 62 nt, Human
acaacaagaagcuggacugaggccccgacugcagccugcauucugcacacagcaucugcucc

SEQ ID NO: 168862 - RNA, 64 nt, Human
acuguggcuaauucaacaguagauuuauucuuuuagccugcacaacaguugaucuuuuggcuau

SEQ ID NO: 168863 - RNA, 64 nt, Human
uuucccagugacucaucagucauucagaaaucaaagccugcacaagaaagggugggaugggaug

SEQ ID NO: 168864 - RNA, 64 nt, Human
aagauggagccacugacgagaugucacaguauagagccugcagucucaacucauugugauccua

SEQ ID NO: 168865 - RNA, 64 nt, Human
cggggagaccccacucugacagugggcacacggcagccugcaaagcacagggccaccgccacag

SEQ ID NO: 168866 - RNA, 56 nt, Human
ucuuggcaucugugggauaagaggccagccugcauaggaccucauacccuucccca

SEQ ID NO: 168867 - RNA, 64 nt, Human
auuauauauugggugcuaaauguuugauggggaaagccugcauauauuaucguacugguaaaau

SEQ ID NO: 168868 - RNA, 64 nt, Human
gugcccaaguuguggugcugacaaagcuuggaagagccugcaggugcugcugcguggcauagcc

SEQ ID NO: 168869 - RNA, 64 nt, Human
gguagcacaucuuuccagccucccagggcuuugcagccugcagaugccaccugucccugagaga

SEQ ID NO: 168870 - RNA, 64 nt, Human
ggggaggaggaggacuaaaugaaaaguuguucccagccugcacaugaacacauucaugacacac

SEQ ID NO: 168871 - RNA, 64 nt, Human
cuuuugccucagccaccugacuagcugggauugcagccugcaccaccacaccuggcuaaauuuu

SEQ ID NO: 168872 - RNA, 64 nt, Human
caaugugaucucaaauuuaaagacugcuccagauagccugcauuugcaauggaauaacugacaa

SEQ ID NO: 168873 - RNA, 64 nt, Human
uugguuccuucagcccucuaaaagcauagggcuuagccugcaggcuuccuugggcuuucucugu

SEQ ID NO: 168874 - RNA, 64 nt, Human
cucucacacaccucggcucugggguugauaccugagccugcaauagagcccugaaaucaagagc

SEQ ID NO: 168875 - RNA, 64 nt, Human
gccagggcucugggggcagauuuguggggaccucagccugcacccucuucuccucuggcuuccc

SEQ ID NO: 168876 - RNA, 64 nt, Human
uggcaggcacaggcgcugacuuucucuuccuuugagccugcaucaguucuugguuuugccuauc

SEQ ID NO: 168877 - RNA, 64 nt, Human
ccagcaccaaugucgcgccugucccgcggcacucagccugcacgcccuccgcgccccgcugcuu

SEQ ID NO: 168878 - RNA, 64 nt, Human
cagacugacgugcuuuugggagggugugccgugaagccugcaguacgugugccgugaggcucau

SEQ ID NO: 168879 - RNA, 64 nt, Human
gggugggccucggccccucccacacccaaagcugagccugcagggaagccccacauguccagca

SEQ ID NO: 168880 - RNA, 64 nt, Human
ccagaagcagacgcuggcaccgugcugcuuguacagccugcagagccgugagccaaguaaaccu

SEQ ID NO: 168881 - RNA, 64 nt, Human
ugauguguguuuguggauaccugggcaucgacccagccugcaggugagcucugggccauguugc

SEQ ID NO: 168882 - RNA, 64 nt, Human
acagucuaagacuucagggccgggaccuuuguccagccugcacaguagagugaggcugccucuc

SEQ ID NO: 168883 - RNA, 64 nt, Human
gugaggggcgcauuccuccagcgccaagcgucagagccugcagacaacggagggcagcgccccc

SEQ ID NO: 168884 - RNA, 64 nt, Human
gggaagcuucuccuccccaaggcggccauggggcagccugcagaggacaguggacguggagcug

SEQ ID NO: 168885 - RNA, 64 nt, Human
auguucuccagucauuauguuaauauuucugaggagccugcaacaugccagccacugugauaga

SEQ ID NO: 168886 - RNA, 64 nt, Human
ucccacaggaggaacacaaagggcccaugaugaaagccugcacacaguggguuauguuguaagc

SEQ ID NO: 168887 - RNA, 64 nt, Human
ccuuugaaagacugaauaauuacacuaccaaguaagccugcaaaucauugauggcaugcaguga

SEQ ID NO: 168888 - RNA, 64 nt, Human
gcaccaggagccaggugcggcgcagccaacccugagccugcagggagaccugcaggaagcccac

SEQ ID NO: 168889 - RNA, 64 nt, Human
aacugaugucauuagacaccauccaaggaugggcagccugcaguguggccggcgacugccaucc

SEQ ID NO: 168890 - RNA, 64 nt, Human
cggcuccggaccggcgcugacagcuguaggcuguagccugcacggggcgccccgccaaggaggc

SEQ ID NO: 168891 - RNA, 64 nt, Human
aaacauuauuccacuuacuguuuuugcuuuaagcagccugcauauauugguuaguuuguucaga

SEQ ID NO: 168892 - RNA, 64 nt, Human
ggaagggagggguagugucuggggcagugcugguagccugcauguguuguaaaucauccugcca

SEQ ID NO: 168893 - RNA, 64 nt, Human
aagacuaacguuaccuugcuuuggagaguacuggagccugcaaaugcauuguguuugcucuggu

SEQ ID NO: 168894 - RNA, 64 nt, Human
augaaccagcuuggcugaugaggaucagcuuguuagccugcagauuccuuuucauuuggaggaa

SEQ ID NO: 168895 - RNA, 64 nt, Human
gaucuucgagcugcauggaccuaaucacagaugcagccugcagucucgccuaauggagcugcca

SEQ ID NO: 168896 - RNA, 64 nt, Human
aagcaguuggacuagaaguguauugaaaugguaaagccugcaaaguauaauaguuaaggcuugu

SEQ ID NO: 168897 - RNA, 64 nt, Human
gaagggaaugucacaggaggaaaaggaagacuaaagccugcauacuaaaugcucucauaacuau

SEQ ID NO: 168898 - RNA, 64 nt, Human
ugguagcuugcuugcugugcgucuuccaaacuaaagccugcaagcgccacaauucuaagugccg

SEQ ID NO: 168899 - RNA, 64 nt, Human
uaguuugaguggaguuaucaagugagguccagguagccugcaacacuggaaaugaguucugggu

SEQ ID NO: 168900 - RNA, 64 nt, Human
ggcccugcccgggaccucacagucccuucuuagaagccugcaaaggucagcugugcccucuggg

SEQ ID NO: 168901 - RNA, 64 nt, Human
gcaaacaucaugaaacuugaucccugaaagcuucagccugcaucuccuaagaguuagggcauug

SEQ ID NO: 168902 - RNA, 64 nt, Human
gcauauuggagaaggguaaugccagaagccaggaagccugcaagggaugaggccaugggaaugg

SEQ ID NO: 168903 - RNA, 64 nt, Human
uaagauuaaaaaaauauauuauuugcaaugcuuaagccugcagauacguaaugugaccacuguu

SEQ ID NO: 168904 - RNA, 64 nt, Human
uuguaugaaauuauaaucuguggauuggccuuuaagccugcauucuuaacaaacucuucaguua

SEQ ID NO: 168905 - RNA, 64 nt, Human
cuggguaggggcacgucugaggggcccugcuccaagccugcaggaccgagggccacagccggac

SEQ ID NO: 168906 - RNA, 64 nt, Human
acagaggugcggugacuugcccggggcuccagguagccugcagguuaacuggcgguaagugcua

SEQ ID NO: 168907 - RNA, 64 nt, Human
uaccccaggacgcaugcagggcccccaugcaggcagccugcagaccacacucugccuggccuug

SEQ ID NO: 168908 - RNA, 64 nt, Human
gagaaugcguaaagauucauuuuucaaggagaagagccugcaaauggccaaugaaggagguaaa

SEQ ID NO: 168909 - RNA, 64 nt, Human
uugaagaauuucagaaccacugguauccagagaaagccugcagcucuccacaggagcuguaaaa

SEQ ID NO: 168910 - RNA, 64 nt, Human
uucgagucuucaaauauuguuuaauggaaugaugagccugcauaaagugaagcugcaauguaac

SEQ ID NO: 168911 - RNA, 64 nt, Human
cacaagggaaagugaucuagccuuugauguuauuagccugcaguuggcuagguuuuuuuaauau

SEQ ID NO: 168912 - RNA, 64 nt, Human
aaaguccuuuuuugcacuaacaguuggcucuuguagccugcaggcugaggaagucucuucucug

SEQ ID NO: 168913 - RNA, 64 nt, Human
caccaccaaaccaagggauuuauagcaaaggcuaagccugcaguuuacucgggggguucaggga

SEQ ID NO: 168914 - RNA, 64 nt, Human
augcuggaggcugagccaaguacaggacacccccagccugcagcccuugcccagggcacuugga

SEQ ID NO: 168915 - RNA, 64 nt, Human
gccaagguucuggcagggccugcugguguguuggagccugcagggcaggucaggcugguucaga

SEQ ID NO: 168916 - RNA, 64 nt, Human
uggcagaguugaauaguugggacagggacaguauagccugcaaagccuaaaagauuuacuacuu

SEQ ID NO: 168917 - RNA, 64 nt, Human
gcuacucgugaggccaaggcaggagaauugcuugagccugcagcagcugcaguaagccaagauc

SEQ ID NO: 168918 - RNA, 55 nt, Human
ucuuagcugaacgugagugacacgcagccugcagacucacugugggaaggagaca

SEQ ID NO: 168919 - RNA, 64 nt, Human
gcacgggugccuccagccugagacaucaggggagagccugcagcugaguucagcagaaaggagg

SEQ ID NO: 168920 - RNA, 64 nt, Human
cugggcuccucagagccugaagcaagcuuuuggaagccugcaguccucccagcuccagugcaga

SEQ ID NO: 168921 - RNA, 64 nt, Human
agaggacaggggagcugagguugguucagaggccagccugcauagccucuguccucaggacgga

SEQ ID NO: 168922 - RNA, 64 nt, Human
auggaagaagaaucaaguccaugcccaagcccaaagccugcacacauucugcccuuaauccaag

SEQ ID NO: 168923 - RNA, 63 nt, Human
ucuccaagaggaagcccuaauccgcccacaggaagccugcaguccuggaagcgcgagggccuc

SEQ ID NO: 168924 - RNA, 64 nt, Human
agcuucaaggcagaagccacagcagccucuguccagccugcagguggccacuuggaaccaugug

SEQ ID NO: 168925 - RNA, 64 nt, Human
ggccaggcuggaccccggcuccacacccacauccagccugcaggccucucugcaguccucucac

SEQ ID NO: 168926 - RNA, 64 nt, Human
uggccccugacaccucccccagccccagcacaccagccugcaccucuuaucccguguuaagucc

SEQ ID NO: 168927 - RNA, 64 nt, Human
cacugagaccauuugcaagaggcuccuggauuauagccugcacaaggagaggaccggcagcaau

SEQ ID NO: 168928 - RNA, 64 nt, Human
ugagaguucuaaauuuugucuuuaacucauaaaaagccugcaauuucauaugcuguauauccuu

SEQ ID NO: 168929 - RNA, 64 nt, Human
uggggaaggugggaaggauccagcgaggccccugagccugcaccuggacagguguacgucugca

SEQ ID NO: 168930 - RNA, 64 nt, Human
ugauuugacauagucuggcuguacccaggaauggagccugcacggugaauggcuuuguauagaa

SEQ ID NO: 168931 - RNA, 64 nt, Human
uugcucagagcucagaauucaguggggaccagagagccugcaauuggaaauaugagaaauucuu

SEQ ID NO: 168932 - RNA, 64 nt, Human
agggggucuggauagggccccacaggugacagggagccugcagggcggaucuggugaucauggg

SEQ ID NO: 168933 - RNA, 64 nt, Human
aaagcccaggagaagucccaccagggaccagcccagccugcauacuugccacuuggccaccagg

SEQ ID NO: 168934 - RNA, 64 nt, Human
cggacagcggaauacgaggacuacggcgcagacgagccugcagaggagccuccugagccccacc

SEQ ID NO: 168935 - RNA, 64 nt, Human
uuuucauagugggaaucaggauugugcuuuauugagccugcaguuacauugaauuguagguguu

SEQ ID NO: 168936 - RNA, 64 nt, Human
uucccugcuccuaacaaaugaagaagcaggcugcagccugcauuguggaagaucuccagccucc

SEQ ID NO: 168937 - RNA, 64 nt, Human
uagugagcagaggucuguauauuguccuugccccagccugcaaucuguggaugcccaggggaag

SEQ ID NO: 168938 - RNA, 64 nt, Human
gaaauuacugucaaaagaucuuucagacaauauaagccugcaaagugcagcagaguauuuauuu

SEQ ID NO: 168939 - RNA, 64 nt, Human
gugucuagaggaagccagagacagaaauaggcuaagccugcaguaggaucucagccacaagggc

SEQ ID NO: 168940 - RNA, 64 nt, Human
uuuccugaggccuccccagccaugcuuccuguacagccugcagaacugugagucaauuaaaccu

SEQ ID NO: 168941 - RNA, 64 nt, Human
aauccauggauggacauggucgaggaauucggaaagccugcaguugacauucagucuucacuug

SEQ ID NO: 168942 - RNA, 64 nt, Human
aauuuuuuaucaugcauguccuguaaagguuacaagccugcacaauaaaaauguuuaacgguua

SEQ ID NO: 168943 - RNA, 64 nt, Human
cucggagccccgcccugacauccuggacaugccuagccugcacguagcuuuuccgucuucaccc

SEQ ID NO: 168944 - RNA, 64 nt, Human
agggaggacugcuugaagccagaaguucaagaccagccugcacaucacgagacccgcccucccc

SEQ ID NO: 168945 - RNA, 64 nt, Human
agaggcagcuugucccccgaccuucaggaauggcagccugcagcaacuggaacaaggccccacc

SEQ ID NO: 168946 - RNA, 64 nt, Human
gacagguuugggaccccuggugguucacucuuggagccugcagagcugcgggcugggugugguc

SEQ ID NO: 168947 - RNA, 64 nt, Human
cucuagaacaauccccuuuuuuccaucaagcuguagccugcagagaauggaaacgugggaaagg

SEQ ID NO: 168948 - RNA, 64 nt, Human
cccuuguccagggcccgaggagagugagguguccagccugcaaagcuauuccagcuccuuggug

SEQ ID NO: 168949 - RNA, 64 nt, Human
cguugcugggguaagggcaagcacuggggucaagagccugcacacaugagccuuccgggcugga

SEQ ID NO: 168950 - RNA, 64 nt, Human; identical to SEQ ID NO: 168940

SEQ ID NO: 168951 - RNA, 64 nt, Human
cagggcagccacagcggcguggaccgagggucccagccugcaggcuccccgcagagagcacagg

SEQ ID NO: 168952 - RNA, 64 nt, Human
ucccccugguccaugccccuccugugcagaagggagccugcaucccucccuuccuuucucuuac

SEQ ID NO: 168953 - RNA, 64 nt, Human
uggccuuuugagagggccugaaagcagaugccccagccugcagagggcgcgccucugcacuaac

SEQ ID NO: 168954 - RNA, 64 nt, Human
gaccccaaguucacaagauuuuuaaggugaugagagccugcagacauucugccuagauuuacua

SEQ ID NO: 168955 - RNA, 64 nt, Human
aaaacauuugaauucuaaacauguaaaaugugacagccugcaauuuuguagacagugaaguaau

SEQ ID NO: 168956 - RNA, 64 nt, Human
uauccugacgugugacaggucccugauccgccccagccugcaggccagaagcaguguuacacac

SEQ ID NO: 168957 - RNA, 64 nt, Human
agcaaaaaaccaaccacuguauuaaagcaaacuaagccugcauuuauaucugaauuauuaccuc

SEQ ID NO: 168958 - RNA, 64 nt, Human
ggggccccuggggugcccucggcagcuucgguccagccugcaucugccccucggccuuccgacg

SEQ ID NO: 168959 - RNA, 64 nt, Human
ccagaccugguucaaaaaguuguuccccaucuucagccugcaggcauacccggaggcgggcacg

SEQ ID NO: 168960 - RNA, 64 nt, Human
ucucuggacccuucugaagcagagaccggacaagagccugcagcggaagggacucugggcugug

SEQ ID NO: 168961 - RNA, 64 nt, Human
aauugcuugagccuggcuguccaaccagacuuugagccugcaucuucuugcaucuaaugaaaaa

SEQ ID NO: 168962 - RNA, 64 nt, Human
gguacacacgcucaucaggagaaucccuacuggaagccugcaagucuaagaucuccaucuggug

SEQ ID NO: 168963 - RNA, 64 nt, Human
cucaggugaucuguuugaggagagcacccuaggcagccugcagggaauaacauacuggccguuc

SEQ ID NO: 168964 - RNA, 64 nt, Human
cucccagagugaacuuggugcucuaaguccaggcagccugcaggcuggggacccugggugcagg

SEQ ID NO: 168965 - RNA, 64 nt, Human
cacacacacacacacacacacaaguaagagacucagccugcaguuaauuagcauucuggcaguu

SEQ ID NO: 168966 - RNA, 64 nt, Human
auucccagauagucaaaaacaugaacuuucccccagccugcaccaguauuguuuucaaacauug

SEQ ID NO: 168967 - RNA, 64 nt, Human
uuuuugcugaaauacauuauggucaaucaagccaagccugcauguacagaauuuguuuuuuuuu

SEQ ID NO: 168968 - RNA, 64 nt, Human
aaaaaugcagggugauuucuuauuauuauauguuagccugcaugguuaaauucgacaacuugua

SEQ ID NO: 168969 - RNA, 64 nt, Human
guacgauugcacucacuagaguuguauaaugugcagccugcacaacuguacaguccagcuguag

SEQ ID NO: 168970 - RNA, 64 nt, Human
ccauccccugcuggcaccauagacccacacaaggagccugcacagcaagccagcggugacacac

SEQ ID NO: 168971 - RNA, 64 nt, Human
uuagucaugugaccacucugucuuguguuuccacagccugcaagucaguccaggaugcuaacau

SEQ ID NO: 168972 - RNA, 64 nt, Human
agccaagccuaccuuaaauguucucagaacauuuagccugcaguugggcaaaaccauuuaacac

SEQ ID NO: 168973 - RNA, 64 nt, Human
gaugugggcgguguuuggaggcuguacuauaugaagccugcauauacugugagcugugauuggg

SEQ ID NO: 168974 - RNA, 64 nt, Human
cccagcauauggaugcccuccccuuggagggcccagccugcaaaccccaucugauaccacacau

SEQ ID NO: 168975 - RNA, 64 nt, Human
ggguaaggauuuaggaauaucuggagagaaagagagccugcaguuauguacauuuuguccuuuc

SEQ ID NO: 168976 - RNA, 64 nt, Human
ugcucuuacacagcauuguuuugucaaucaacacagccugcacugaaaggaccugcauagacua

SEQ ID NO: 168977 - RNA, 64 nt, Human
gauguuagacuugcucccucuccaagacagcagcagccugcaccugccccguguguguggccgg

SEQ ID NO: 168978 - RNA, 64 nt, Human
aagucacuuagacaucucaccguggaaguuugugagccugcauuaggagauagacugauuacca

SEQ ID NO: 168979 - RNA, 64 nt, Human
cccguacuccuccacccagaugagggcccuccagagccugcaggcaucuguggggaaucccagc

SEQ ID NO: 168980 - RNA, 64 nt, Human
ccuccagagccugcaggcaucuguggggaaucccagccugcagguucuuggagaagcaggugaa

SEQ ID NO: 168981 - RNA, 64 nt, Human
ugucccuaagacaauaaucgcuuucugacaaaggagccugcacauuugggugagcagacccaag

SEQ ID NO: 168982 - RNA, 64 nt, Human
gccaggccccagcuuuguucccuggucccccugaagccugcaaacguugucaucgaagggaagg

SEQ ID NO: 168983 - RNA, 64 nt, Human
ugggagugugcguggacugggauaucaucucuacagccugcaaauaaaccagacaaacuuacca

SEQ ID NO: 168984 - RNA, 64 nt, Human
guccauuuaaacccggcugacucagugcagggacagccugcacagugguccaggguccagcccu

SEQ ID NO: 168985 - RNA, 64 nt, Human
ucccagccagagcugagcuuaggcacccgaguggagccugcagcugagucugugcccgagacag

SEQ ID NO: 168986 - RNA, 64 nt, Human
cucugggugggaaagcagccugccccaugcuuccagccugcagaacacagaaugaaacaugcug

SEQ ID NO: 168987 - RNA, 64 nt, Human
aaggcugccaacggggagcggcggaaagccuguaagccugcaagccugucugagacucacagga

SEQ ID NO: 168988 - RNA, 64 nt, Human
acccccaccccaucugccuucaggucuucuucacagccugcacugcccagugggccacuagggg

SEQ ID NO: 168989 - RNA, 64 nt, Human
agagcaccugcagaggagcaggaggccggagcugagccugcagaccccgguuucuauuuugcac

SEQ ID NO: 168990 - RNA, 64 nt, Human
augucagcacuagaaagcaguuuuaggagguuccagccugcagcauagguacgaccucagagga

SEQ ID NO: 168991 - RNA, 64 nt, Human; identical to SEQ ID NO: 168931

SEQ ID NO: 168992 - RNA, 64 nt, Human
aaucacuuuuugggauagguugaaauuuuuaaagagccugcaucauuugguucccucaaaggga

SEQ ID NO: 168993 - RNA, 64 nt, Human
cucccugcucccagcucucucuccuggagucugaagccugcagguccggggaggagguucggga

SEQ ID NO: 168994 - RNA, 64 nt, Human
cugcuuccccuccagcacagggaccaagugggggagccugcagaaccuguccaggcacaguggc

SEQ ID NO: 168995 - RNA, 64 nt, Human
ccuccccccggcaaauguccucccgcugccuugcagccugcacuuugcacaugcucacccccag

SEQ ID NO: 168996 - RNA, 64 nt, Human
cccugugccgccugguuccguggccuccagcaugagccugcaggcagggcgcugcgggaaccca

SEQ ID NO: 168997 - RNA, 64 nt, Human
gguaagucugguuuugucccuuccaggaggacauagccugcaaagcugguugucuuuacaugaa

SEQ ID NO: 168998 - RNA, 64 nt, Human
agcuccucggagggaacagagcggcuguguaugcagccugcagguuuccauacacugaagcuuu

SEQ ID NO: 168999 - RNA, 64 nt, Human
ccguggcccugcugacgagagacagcccacccccagccugcaagagaggcagccagaggccagg

SEQ ID NO: 169000 - RNA, 64 nt, Human
ccugggcugaccccgguggcggccccagcaccucagccugcacagugucccccagguuccgaag

SEQ ID NO: 169001 - RNA, 64 nt, Human
aaauuauucuuuguuuuucuuuuucuuuuaauaaagccugcaaguuacuaaauuguaguuucau

SEQ ID NO: 169002 - RNA, 64 nt, Human
agaggcuuugcugcugugaaucccaccugccaccagccugcagcacaccccacagccaaguaga

SEQ ID NO: 169003 - RNA, 64 nt, Human
acccugaguccccaccugcggcuccccuguguagagccugcaucugucuguccuuccuuccauu

SEQ ID NO: 169004 - RNA, 64 nt, Human
uuacugaccagcaacuugucuuuuucuggacugaagccugcaggaguuaaaaagggcagggcau

SEQ ID NO: 169005 - RNA, 64 nt, Human
uuccggcuggcucugaaccgugcguggugccuacagccugcagucuggagacaagcucuuccgg

SEQ ID NO: 169006 - RNA, 64 nt, Human
ucccucauauacacagacccaggauuaugcugugagccugcaggcuuuggaaguggcccuguca

SEQ ID NO: 169007 - RNA, 64 nt, Human
gaacugagacagaggaggaaaacagagcaucagaagccugcaguggugguugugacggguagga

SEQ ID NO: 169008 - RNA, 64 nt, Human
aacagauacauggaaguggacuccuugccuguagagccugcaugcuuuuuuguuuuuuuuuguu

SEQ ID NO: 169009 - RNA, 64 nt, Human
acuccuuauuuggcgugacccgaccuggccgcggagccugcauuuccucgcagccucucagugc

SEQ ID NO: 169010 - RNA, 64 nt, Human
ugcaggguacugggccaggcccucagccucagagagccugcagaagggcuugggagugccacac

SEQ ID NO: 169011 - RNA, 64 nt, Human
agugagugggcaaaugcggacccucccugccugcagccugcacagauucugguuugagguuuga

SEQ ID NO: 169012 - RNA, 64 nt, Human
gcccuuuggucuguguucacaggugacccgugucagccugcaucgcaagcacacacccugcggg

SEQ ID NO: 169013 - RNA, 64 nt, Human
ucaguaauguuauuuucuucuaagugaaauuucuagccugcacuuugaugucauguguucccuu

SEQ ID NO: 169014 - RNA, 64 nt, Human
ggugugcaguauuuuagguacaucgugagcaaggagccugcauucccagggggcggcagggaca

SEQ ID NO: 169015 - RNA, 64 nt, Human
gcaggcagugcggggugcccaggcagacggguucagccugcagaacuggaggcgaccugugaaa

SEQ ID NO: 169016 - RNA, 64 nt, Human
aacagguaguguguauuugcaccuggcaucgugcagccugcacgucaacacguuguuuugugua

SEQ ID NO: 169017 - RNA, 64 nt, Human
gccuacaugucccuggcuguugaggcgcugcuucagccugcaccccucccuugucucauagaug

SEQ ID NO: 169018 - RNA, 64 nt, Human
ccccgcagaggggcuuccccaagcucuguuuugaagccugcaauguggaaaagugagaagucag

SEQ ID NO: 169019 - RNA, 64 nt, Human
gagucaugcucccccaggaguuccaggagaacucagccugcagcuucagcaccugccaccugag

SEQ ID NO: 169020 - RNA, 64 nt, Human
aucugugaucuucccagcucugcaucaacacagcagccugcagauaacacuuggggggaccuca

SEQ ID NO: 169021 - RNA, 64 nt, Human
ucugccugcucaugggguccuaaagcgcgggcuaagccugcaggaaagccggggcggugggggg

SEQ ID NO: 169022 - RNA, 64 nt, Human
aaucagagaaauguaucaguugcucaaguuaucaagccugcauuuugcagcuauggucuucuac

SEQ ID NO: 169023 - RNA, 61 nt, Human
aggaaaaacgggguuacuaguagccgcccauagccugcaaccuuugcacuccacugugcaa

SEQ ID NO: 169024 - RNA, 64 nt, Human
gcagccuggccacugccuagcuggaaugggaggaagccugcagguggcaccgguggcccuggcu

SEQ ID NO: 169025 - RNA, 64 nt, Human
gccccaauaccccauggaccaugcugucuggcacagccugcacuugggggcucagcaaggccac

SEQ ID NO: 169026 - RNA, 64 nt, Human
uagacuucuagugccucugaggcagaaccaaaggagccugcacugggggaaaucccuuuuccug

SEQ ID NO: 169027 - RNA, 64 nt, Human
ugguauuaugaagacuauauagaugauucaaccaagccugcaaaucucccucuuguggaauucc

SEQ ID NO: 169028 - RNA, 64 nt, Human
uguacuaugaaggaaaauacucagugucagcuugagccugcauuccaagcuuuuuuuuuaauuu

SEQ ID NO: 169029 - RNA, 64 nt, Human
guaucccucacagcaccucacgacugugccucaaagccugcaucaauaaaugaaaacggucugc

SEQ ID NO: 169030 - RNA, 64 nt, Human
acagucacauggccagaugagaacuugcgauacuagccugcacccacuggcugggaagaucucu

SEQ ID NO: 169031 - RNA, 64 nt, Human
ugugaguguccacuuuugagguuccuuaguucagagccugcaaaugaucacuguaaacuggcuc

SEQ ID NO: 169032 - RNA, 64 nt, Human
aaaccucagcagcacacaauauacucauguaacaagccugcacauguaccccagaaucuaaaau

SEQ ID NO: 169033 - RNA, 64 nt, Human
ucaugggguugugccaauuaauuaccaaacauugagccugcaggcuuugagugggaguguugcc

SEQ ID NO: 169034 - RNA, 64 nt, Human
ucccuaaaaacacagacauucugccaggcccccaagccugcagucaucuugaccaagcaggaag

SEQ ID NO: 169035 - RNA, 64 nt, Human
ugccacacugccucguucacugauguuuuuaauaagccugcaccauuuguaugucaauucuucc

SEQ ID NO: 169036 - RNA, 64 nt, Human
aaggagugagaggggacaaaacccaccuuguuggagccugcaggguggugcugggacugagcca

SEQ ID NO: 169037 - RNA, 64 nt, Human
cgugccccaccgcaucccuaccuggaaacugaccagccugcacuguggaaaagcuggcccugug

SEQ ID NO: 169038 - RNA, 64 nt, Human
ugcuguuuccagccgcugaaucugcugagugugcagccugcaucaccugcuguaugccgaucau

SEQ ID NO: 169039 - RNA, 54 nt, Human
ucagcacuucagaagcauaacuacagccugcagcaugucugcacgugugcaugc

SEQ ID NO: 169040 - RNA, 64 nt, Human
ccaggcaggaggaucacuugggcccaggaggucaagccugcagcgagcugagaucacaccacug

SEQ ID NO: 169041 - RNA, 64 nt, Human
cgggaccccgcucccagcucugagaggucgccaaagccugcagccuggccugggccuggccacc

SEQ ID NO: 169042 - RNA, 64 nt, Human
agcccagcugggccugggccccagggccacagcuagccugcauguguguacugcacuuuacagu

SEQ ID NO: 169043 - RNA, 64 nt, Human
gaaagccaggaguggccuucucugcaggccagcaagccugcagcagcaggugcccccacgucag

SEQ ID NO: 169044 - RNA, 64 nt, Human
ccucuccaauuggguugugaaauacucuuccaaaagccugcaucggggauuccaccuacuuauu

SEQ ID NO: 169045 - RNA, 64 nt, Human
gacccuuuuccuaccagcaaccaaacuuacuacuagccugcaaugcaaugaacacaagugguug

SEQ ID NO: 169046 - RNA, 64 nt, Human
caggucuugaauggcaccucucccuaggauacacagccugcagguccccaggaccuggaugaca

SEQ ID NO: 169047 - RNA, 64 nt, Human
aauuaaacuccaugcggguccauaacagccaagaagccugcaggagaaagccaagggcaguucc

SEQ ID NO: 169048 - RNA, 64 nt, Human
gcccaaacuggcuggguuucagcaauuccugcagagccugcagcccaggacgacugaaggugag

SEQ ID NO: 169049 - RNA, 64 nt, Human
gaggcaggugggugguaagagggaaacucuggagagccugcacccagguacugaguggggagug

SEQ ID NO: 169050 - RNA, 64 nt, Human
uuccccuccccccauuuccagaaggguagauaggagccugcagucgccucuaaaauccuaccua

SEQ ID NO: 169051 - RNA, 64 nt, Human
cagcuuaugagcucaaaguacuacagcaaagccuagccugcauaucauucacccaaaacaaagu

SEQ ID NO: 169052 - RNA, 64 nt, Human
ucugagcugggcucagcugggcuguucuucugccagccugcagguggccacucauguggucagc

SEQ ID NO: 169053 - RNA, 64 nt, Human
agggccuugcugccagggggcagggaugcuuuccagccugcagcaacagaacacuugaccuuaa

SEQ ID NO: 169054 - RNA, 64 nt, Human
ggaucaauguccucaaggccccuggcccuuacugagccugcaggguccugggccaugugggugg

SEQ ID NO: 169055 - RNA, 57 nt, Human
cucagcacaccaaugugugagcaguucagccugcagcagaggagggcacggcagcag

SEQ ID NO: 169056 - RNA, 64 nt, Human
ccugucuguuggagcaaaggcacaguucacccuuagccugcacuaagggccguggaagcuugac

SEQ ID NO: 169057 - RNA, 64 nt, Human
guuccaaaucucuauaaccaccugcuucccacucagccugcaauaguguuucccacucucugcu

SEQ ID NO: 169058 - RNA, 64 nt, Human
auucaaagaugcuuuugccaguuacaugcaucacagccugcauuaauuugcuuuucuuuuaauu

SEQ ID NO: 169059 - RNA, 64 nt, Human
ccacugaagcaggggacgguggcaggagcgccccagccugcagcugacugaggaccacgaguga

SEQ ID NO: 169060 - RNA, 64 nt, Human
cccucccauuugguagcagcuccaacagggguccagccugcaucuuguuaacucgaguuucuca

SEQ ID NO: 169061 - RNA, 64 nt, Human
guugcagugagcugagaucgugccacugcucuccagccugcaugacgggagugagacaccaucu

SEQ ID NO: 169062 - RNA, 64 nt, Human
gaaagcuggcuuuaauuuuuaggaggaaaagaaaagccugcauguguucuuuauugguaucauu

SEQ ID NO: 169063 - RNA, 64 nt, Human
uaguuugaagacacacugacuccugacaaaaugcagccugcaacuuccuggagaacaacucagu

SEQ ID NO: 169064 - RNA, 64 nt, Human
agccuaugcuauaaguuuaaugagaaccgaauucagccugcauucgagaauagcuuuaaguaua

SEQ ID NO: 169065 - RNA, 64 nt, Human
cagucaagcuguugaagucucaggagucucugguagccugcagaaguaagccucaucaucagag

SEQ ID NO: 169066 - RNA, 64 nt, Human
acugcccaaauaggaggaaaacacagccucccugagccugcauucugcacgcugcccaggggcu

SEQ ID NO: 169067 - RNA, 64 nt, Human
agaaagugcuccuuagaauacuacagagaggaagagccugcaugucgcuggcccaaggcuggac

SEQ ID NO: 169068 - RNA, 64 nt, Human
gagggcagcagggacaggacuggaagggaccugcagccugcagaccccgccuggcccccgcugg

SEQ ID NO: 169069 - RNA, 64 nt, Human
agugcugggauuacaggcaugagccaccgcacccagccugcauuccuguuuuuuuaaugguuuu

SEQ ID NO: 169070 - RNA, 64 nt, Human
aggaucccgggacaggauggggggcuuuggggaaagccugcacuucugcacauuuugaaaagag

SEQ ID NO: 169071 - RNA, 64 nt, Human
uuaauaucuaagcaggggaggggacaggacagaaagccugcacugaggggugcggugccaacag

SEQ ID NO: 169072 - RNA, 64 nt, Human
ucaguuugggagugcccuugagccccuuuuccuuagccugcaggugcuucaauggaucaugggg

SEQ ID NO: 169073 - RNA, 64 nt, Human
uggaagcccuuuguuccuucccggguuuguccugagccugcacuguccucgccugcagccucag

SEQ ID NO: 169074 - RNA, 64 nt, Human
ccauguuaacgugagcaaauuccucucaugaaauagccugcagcuauuaagaagcacgugugug

SEQ ID NO: 169075 - RNA, 64 nt, Human
ccuucacugaucccagccaccccagaaaagcugcagccugcaggcaccagccgggccauaugcc

SEQ ID NO: 169076 - RNA, 64 nt, Human
gccugaaugucaugcucccuggggcaggaccuugagccugcagcacacacuaggccaccugcag

SEQ ID NO: 169077 - RNA, 64 nt, Human
ugaagagcaccggggaauuuguaaccccuauuuaagccugcaagugccuaaguuagcugugauu

SEQ ID NO: 169078 - RNA, 64 nt, Human
ucucauccuauuguacucucuucugcuuuuuagaagccugcacuuaagcuuagauuugugaagg

SEQ ID NO: 169079 - RNA, 64 nt, Human
gagucuuaccuccccuggcccuccuuucuggcucagccugcagcgacugugaggccacagcucc

SEQ ID NO: 169080 - RNA, 64 nt, Human
gccuccacgcugugcucccucccaacaacggccgagccugcaccgacaacccccuggaggagga

SEQ ID NO: 169081 - RNA, 64 nt, Human
aaauuuuuuuucaaauuucuucauuaccuaagggagccugcaucuaaauuucucaacuaguuca

SEQ ID NO: 169082 - RNA, 64 nt, Human
guccugagcauagcucuguaggcagugcgggcauagccugcauaguguccuggcgcugggaguu

SEQ ID NO: 169083 - RNA, 64 nt, Human
gauuuuuaugaagugagccuggacaacaacguggagccugcaccaggagcggccagggaggguu

SEQ ID NO: 169084 - RNA, 64 nt, Human
ggauggccuuccuuccucuuacccuuccucccucagccugcaaccucuauccuggaaccugucc

SEQ ID NO: 169085 - RNA, 64 nt, Human
ccccaucucccgagggcugaccuccucuggccucagccugcagggugugggcagagaagggcau

SEQ ID NO: 169086 - RNA, 64 nt, Human
acccaaugaacagugcaaugugaaggaaggcaggagccugcaggggagcagacuuggugcccag

SEQ ID NO: 169087 - RNA, 64 nt, Human
cccagcgggcuggcgggccuuuuuccugcgucccagccugcaccccuccggccccgucucucuu

SEQ ID NO: 169088 - RNA, 64 nt, Human
ccacuggugagaggaggaccuugugccugcccagagccugcaggacagcacgccuugaggucag

SEQ ID NO: 169089 - RNA, 64 nt, Human
cagcuaccacuuaaaaaacuugcaggacaguuagagccugcauuucuaguuaagauggaucuug

SEQ ID NO: 169090 - RNA, 64 nt, Human
acuccuaagaaggccaagaaggaggaugaagcccagccugcacgucugucccucucugcuuucu

SEQ ID NO: 169091 - RNA, 64 nt, Human
uuuuaauguuuguacacaacaauccuucuauucuagccugcauugagcuugcaugcuugcauaa

SEQ ID NO: 169092 - RNA, 64 nt, Human
ccuguggcgcccaaagcuggcaggucaggcaagcagccugcaccacccugccacuggcgaccag

SEQ ID NO: 169093 - RNA, 64 nt, Human
guucccugugagcccgaguccgcuucaggaggggagccugcaggugccggcuggugaggggaug

SEQ ID NO: 169094 - RNA, 64 nt, Human
ucuccagcgaccaaagcuuccccggggcccccccagccugcaagacaggugaguggcugugcuc

SEQ ID NO: 169095 - RNA, 64 nt, Human
acccaagccaggcugcacacuccuggacugggcuagccugcacugccugggaaagucggccgag

SEQ ID NO: 169096 - RNA, 64 nt, Human
gcuuuuggucugugugaugaugaaaugaggucagagccugcaguuauuaacacuaacgauuugu

SEQ ID NO: 169097 - RNA, 64 nt, Human
uugguuggguccucacaucuuucacacuuccaccagccugcacuacucccucaaagcacacguc

SEQ ID NO: 169098 - RNA, 64 nt, Human
ucaggccugcccacuaugggcagaccucucgcucagccugcagaacccagcugggacuuacuuc

SEQ ID NO: 169099 - RNA, 64 nt, Human
cugagcccgggacuggacgagcaguagauccagcagccugcagcuccaaggaacauugccucuc

SEQ ID NO: 169100 - RNA, 64 nt, Human
ucagagaccgugagcgccccgcccccaccccuacagccugcacacaccugccugcagagcagga

SEQ ID NO: 169101 - RNA, 64 nt, Human
auuggguggaugcgggcuggccguggcccagugaagccugcagagccccgcuguccuugccccu

SEQ ID NO: 169102 - RNA, 64 nt, Human
cccacugcuaaggcugcuggcuucagggaggguuagccugcaccgccgccacccugccccuaag

SEQ ID NO: 169103 - RNA, 64 nt, Human
ggccuuucuccuucuaagugccccccacccccauagccugcauguccacucccagacgauggcc

SEQ ID NO: 169104 - RNA, 64 nt, Human
agccuuuucaucuguaaugcagcuuguaaugaccagccugcagucaauucuugaaaauguggau

SEQ ID NO: 169105 - RNA, 64 nt, Human; identical to SEQ ID NO: 169104

SEQ ID NO: 169106 - RNA, 64 nt, Human
ugaggggcaaggauugcuugaggcugagagauugagccugcagugagcuaugacgaugccacuc

SEQ ID NO: 169107 - RNA, 64 nt, Human
uuugaaucucagucuucagccugcacugauuuguagccugcacugucuuacugauuuacaaacu

SEQ ID NO: 169108 - RNA, 64 nt, Human
uuuuaaguggaagaucauuugaaucucagucuucagccugcacugauuuguagccugcacuguc

SEQ ID NO: 169109 - RNA, 64 nt, Human
gucaccagacggggcuggagugugaggguccugcagccugcaggaccucgugccaccccgaggg

SEQ ID NO: 169110 - RNA, 64 nt, Human
ggagcgcaccucaccggacugagcucacaggaggagccugcacccgcgcagaaggggagccggg

SEQ ID NO: 169111 - RNA, 64 nt, Human
uguauauauguguucacgugugcuauguguguuaagccugcaugcauggguguggggguaugug

SEQ ID NO: 169112 - RNA, 64 nt, Human
uuccugagacaugacacccucauggcaggauucuagccugcacuuuggguuuuuaacucaucuu

SEQ ID NO: 169113 - RNA, 64 nt, Human
ugaaacauuugcauagaauucacuggacgaauuaagccugcacucauauggcauagaauuguga

SEQ ID NO: 169114 - RNA, 64 nt, Human
gcccucucauggggguuuugaguuuguagugcugagccugcaucugugccucccagcccccugc

SEQ ID NO: 169115 - RNA, 64 nt, Human
uguguauuuuugggccacuccacggcaggucccuagccugcaacauuuaugucgcaugucaauc

SEQ ID NO: 169116 - RNA, 56 nt, Human
ccucugagccuggcacauaggcacccagccugcaucucccaggaggaaguggaggg

SEQ ID NO: 169117 - RNA, 64 nt, Human
cacauugcaaaacacugcccagaacaguaaaaagagccugcaugccaugauguucuuccucauu

SEQ ID NO: 169118 - RNA, 64 nt, Human
auagaaacagggauuuaaaccuggcuuuggcaagagccugcagccuccaucaccccaaguccuu

SEQ ID NO: 169119 - RNA, 64 nt, Human
uagccauuucuuguugugccccuuuccaagauacagccugcaagugguagcaagaagugauuag

SEQ ID NO: 169120 - RNA, 64 nt, Human
ccagccacgcucaguggcugaacagcauucccacagccugcaagugugugugugugugaaagag

SEQ ID NO: 169121 - RNA, 64 nt, Human
accccugagcugaggcucccauugucuccaucagagccugcauguguaugccguccuccccugg

SEQ ID NO: 169122 - RNA, 64 nt, Human
ccccaguuuagguucugagcaguauuggacuuguagccugcaguugucuuuugacuugcaggcc

SEQ ID NO: 169123 - RNA, 64 nt, Human
gagcauuggaauccucuucuuccagggaggaauuagccugcaagguuaggacuugaagagggaa

SEQ ID NO: 169124 - RNA, 64 nt, Human
cuggggagagcaaagcacuaaggaauucagcaucagccugcagagggcugagucuggguuaguc

SEQ ID NO: 169125 - RNA, 64 nt, Human
cugaagcagguuagcguugaaggugguauggaaaagccugcaugccuguucaauucuuuuguuu

SEQ ID NO: 169126 - RNA, 64 nt, Human
cuaagcuccugagcgggagucagacuuagcccugagccugcacuuccuguucaggugcagacac

SEQ ID NO: 169127 - RNA, 64 nt, Human
aacccuuucuccuguuggacuacaguucagaggcagccugcaguccucccaugauagccaggga

SEQ ID NO: 169128 - RNA, 64 nt, Human
ggaggccugugggucacacguaggggcuagagccagccugcauccugcccaccgggcuccacuu

SEQ ID NO: 169129 - RNA, 64 nt, Human
aagguugcaaagugggggccggggaucugcaucuagccugcauaucacauugacccacacaaaa

SEQ ID NO: 169130 - RNA, 64 nt, Human
ggagaggcaccugccaacuacuugcuuucccuggagccugcaugugccugugggguggggaggc

SEQ ID NO: 169131 - RNA, 64 nt, Human
cagaaccaauaacuucugcaucaaaacauguuacagccugcaucaagggcuuuaccccaaccug

SEQ ID NO: 169132 - RNA, 64 nt, Human
gaaggggcaagacguggccuguaggcacugucucagccugcagagaagaaagugaggccgggag

SEQ ID NO: 169133 - RNA, 64 nt, Human
ccugcuucucuuccaggcuuugcuguuccccagcagccugcagaggccccacagacagcuugag

SEQ ID NO: 169134 - RNA, 64 nt, Human
aaaaaguuuuaaacagaagcacaugacauaugaaagccugcaggacuggucguuuuuuuggcaa

SEQ ID NO: 169135 - RNA, 64 nt, Human
agagccgggguuccaggacagggaagggagcaggagccugcagucacuggcuuggcuuuacuuu

SEQ ID NO: 169136 - RNA, 64 nt, Human
gagcgguuggccccaugggugguggggugugagaagccugcaauaccccaagaccccagagggc

SEQ ID NO: 169137 - RNA, 64 nt, Human
acuguaugugugugugugaaccacuguguacuggagccugcauuaugcacgugucuggguaucu

SEQ ID NO: 169138 - RNA, 64 nt, Human
ugucugguaagaugaccacugucucacuaucaagagccugcagagccauuuuccagaccuguga

SEQ ID NO: 169139 - RNA, 64 nt, Human
caguguugguagacaaagucauaccacccagggcagccugcaugcagcgagucugcguggcuuc

SEQ ID NO: 169140 - RNA, 64 nt, Human
acuuugccuucugagccauuugacguagaggaaaagccugcaagcacauuuuguggaaagagga

SEQ ID NO: 169141 - RNA, 64 nt, Human
uacuggacaaaagcagaaaaaccuguuacaggauagccugcauuugcauguguguacauaucua

SEQ ID NO: 169142 - RNA, 64 nt, Human
gggaaaaucugaggccacacaggagagaauauacagccugcagagagugcguggcaauccuuac

SEQ ID NO: 169143 - RNA, 64 nt, Human
ggaccuggagcccgcgcuggccucuccccagcggagccugcacguuacggagaccaucacaugu

SEQ ID NO: 169144 - RNA, 64 nt, Human
cucaguauuguguuuaguucuuugaaaacauaaaagccugcaauuucucgacaaaacaacacaa

SEQ ID NO: 169145 - RNA, 63 nt, Human
acggugcugucaccucugccugggccucacugacagccugcagggggcucuuggggacuggga

SEQ ID NO: 169146 - RNA, 64 nt, Human
gugugugugcaaagguccagccaccccguccuccagccugcaaggggugucuggcgccuugccu

SEQ ID NO: 169147 - RNA, 57 nt, Human
ugcccagcgacaaucacugaacgccgaagccugcagccaugcgaccccacgccaccc

SEQ ID NO: 169148 - RNA, 64 nt, Human
accccacgccaccccgugccuccugccuccgcgcagccugcagcgggagacccuguccccgccc

SEQ ID NO: 169149 - RNA, 64 nt, Human
ugggcucugaccacuaacacucuuggccauggacagccugcacaggaccgccucccugcucuug

SEQ ID NO: 169150 - RNA, 64 nt, Human
ccgucuucuacagaugcugcuguaauggaccaagagccugcagggaacagaacagugaacagcg

SEQ ID NO: 169151 - RNA, 64 nt, Human
aucuugccuucagaaugcucagaaaauuuacauuagccugcaguugggcaaaaucaucuaacac

SEQ ID NO: 169152 - RNA, 64 nt, Human
uauuucaccuugaggagggugcugcugcugugacagccugcaguguuuugaaacagcauggauu

SEQ ID NO: 169153 - RNA, 64 nt, Human
cucaugccagcggcuuuggcugggguuggucugaagccugcacgcggcaguucuuuguuaaaga

SEQ ID NO: 169154 - RNA, 64 nt, Human
aauccaggcgucgaccugguggggcccggggccaagccugcauucuggcugcccagcuucggac

SEQ ID NO: 169155 - RNA, 64 nt, Human
gcuccccccgaccuccagccgagcauccuucaugagccugcagaacugcuuuccuauguuuacc

SEQ ID NO: 169156 - RNA, 64 nt, Human
ccaaggugugagcccugugccugccgggaccuccagccugcagaaugcguccagaaauaaauuc

SEQ ID NO: 169157 - RNA, 64 nt, Human
guauccccagcucagguggugaguccuccuguccagccugcaucaauaaaauggggcagugaug

SEQ ID NO: 169158 - RNA, 64 nt, Human
auuuuuauuuuaagcuguucaugcugggacugacagccugcaggguuuccuugggcgcggcccc

SEQ ID NO: 169159 - RNA, 64 nt, Human
cccagccuugccucucugacccaugggcuccuugagccugcagcucuguaaccacagggcuccu

SEQ ID NO: 169160 - RNA, 64 nt, Human
agcaaaagacagggacacugccaucgauaaugucagccugcagcacugaagugugccaggcaag

SEQ ID NO: 169161 - RNA, 64 nt, Human
ccaaaccaggugggagcguuuuguugagcaugacagccugcagcaggaauauaugugugccuau

SEQ ID NO: 169162 - RNA, 64 nt, Human
gaugcccuguugggucaccggcuggaccugcugcagccugcagagccacagucagccugcccac

SEQ ID NO: 169163 - RNA, 64 nt, Human
uuugucaauuugaauucagggaaaaguuggucacagccugcaaaugacuucauuuggaagucug

SEQ ID NO: 169164 - RNA, 64 nt, Human
cccuuuugaguucccgccucacccaggggcucccagccugcacuugcaggaguggugaugcccc

SEQ ID NO: 169165 - RNA, 64 nt, Human
agacuuucaaacauauauagaaagagcauaaugaagccugcaugugcccagcuucaauaauuac

SEQ ID NO: 169166 - RNA, 64 nt, Human
accccgccugcccuccguauuuccugcaccugucagccugcaccgacugaugagccaguugcuc

SEQ ID NO: 169167 - RNA, 64 nt, Human
acccgggagccuugaugggggucaggcagaggccagccugcacuggagucugaggccugggacc

SEQ ID NO: 169168 - RNA, 64 nt, Human
ggaaagcugccgucucuuuggcagucugaugcagagccugcacucuggcacucgcugaagaauc

SEQ ID NO: 169169 - RNA, 64 nt, Human
cauccuggagaagccaggagaaaagcucaggaagagccugcagguggaaggagagggaagcagc

SEQ ID NO: 169170 - RNA, 64 nt, Human
cccccgcgucucgggagaaacccacccucuucagagccugcacucgcuaaggaaggggacucga

SEQ ID NO: 169171 - RNA, 64 nt, Human
uuggauugcaggcaugagccacuucgccuagccaagccugcauuuuuuugaguuccuacaucau

SEQ ID NO: 169172 - RNA, 64 nt, Human
ggcuuuccuucaccaagaauaagguucuuucuggagccugcaagaagacaguugcccaacacuu

SEQ ID NO: 169173 - RNA, 64 nt, Human
cggcuccagcccaaugccccagcuggccuuccccagccugcaaggagccuguagcauggcaaau

SEQ ID NO: 169174 - RNA, 64 nt, Human
ccaugggccccagccaggacaugcugggugccccagccugcaggcaggcuuugggagagaaauu

SEQ ID NO: 169175 - RNA, 64 nt, Human
ugggucucagcugcugacacgcagccugcucuggagccugcagaugagauccgggagacugaca

SEQ ID NO: 169176 - RNA, 64 nt, Human
caccccaccccaccccacccucugaaaugugaaaagccugcacucuuccugugggcugcgcagu

SEQ ID NO: 169177 - RNA, 64 nt, Human
cuggcgugagguggacacccugggccuuccuggaagccugcaguugggggccugcccugagucu

SEQ ID NO: 169178 - RNA, 64 nt, Human
uuagucccaccuguagcugaauccacagacccaaagccugcacaacccaaccucgcuuagggac

SEQ ID NO: 169179 - RNA, 64 nt, Human
augacucuguuuugaauguaaauauuuguaauuaagccugcacauauuuuuuuauugcccuaga

SEQ ID NO: 169180 - RNA, 64 nt, Human
acaagggccugucugccgccagcgcuguggccacagccugcauaggugacaaggggccgcugcg

SEQ ID NO: 169181 - RNA, 64 nt, Human
agggcucagauggggccugggcuguugugucuggagccugcaggcaggugggggcugcgucccu

SEQ ID NO: 169182 - RNA, 64 nt, Human
guguauauuacuuguccauuccuuuaaggggagcagccugcacucuuuuguagauuacuuuugg

SEQ ID NO: 169183 - RNA, 64 nt, Human
uagcacuuuaaacgccgaagacagcccugcagcaagccugcacacgggcuuggguggguuccuu

SEQ ID NO: 169184 - RNA, 64 nt, Human
ugccccaaaccggccuagacacgaagaccaaagcagccugcacagggcaaggcccccgcggaau

SEQ ID NO: 169185 - RNA, 64 nt, Human
ugcugcuuugggcagguggagcaccccccgaggaagccugcaaguccagggcacaggcugccuu

SEQ ID NO: 169186 - RNA, 64 nt, Human
ggcaaguugcuuagcuaacaggagauccauaggcagccugcaggcuaggaaguggccuagugca

SEQ ID NO: 169187 - RNA, 64 nt, Human
uggcagugcagcaaggagaaggcaggaacauuggagccugcaauaagggaaaaaugggaacugg

SEQ ID NO: 169188 - RNA, 64 nt, Human
gcuauccauccacccaccaagacccuguucccugagccugcaugccccuaaccugccuuuuccc

SEQ ID NO: 169189 - RNA, 64 nt, Human
guagcgggggaggguaggcaggauuggggaagagagccugcaggaucucaccaggcagccucug

SEQ ID NO: 169190 - RNA, 64 nt, Human
ggagggcggggguggguggagcaggaguggaggcagccugcagaggaagggugcgggagacuga

SEQ ID NO: 169191 - RNA, 64 nt, Human
agcagaggaagccgggcuggcugaggguccgaaaagccugcaggggcccggcgagccccaggaa

SEQ ID NO: 169192 - RNA, 64 nt, Human
ccaggccugggcugggcucauagacgcuucacagagccugcagggcagcuguacacccagcaga

SEQ ID NO: 169193 - RNA, 64 nt, Human
ggggugcugcucagcuguuacaaaggcaggguccagccugcagggaggccccaggaggggaucu

SEQ ID NO: 169194 - RNA, 64 nt, Human
caggagcuuguggaaauaccuuggcugauguugcagccugcagcaagugcuuccgucuccggaa

SEQ ID NO: 169195 - RNA, 64 nt, Human
gaagauggagcaugcaguggaagaggugaagaacagccugcagcucuuugaggaguauuuucug

SEQ ID NO: 169196 - RNA, 64 nt, Human
cuaaggccugugcuccaaagcaacgggcuggggcagccugcagcugcccacccaaccuggucuu

SEQ ID NO: 169197 - RNA, 64 nt, Human
agccuuuggucugcaugggggauggugugcucccagccugcagucuuuggagcaaggcugcugc

SEQ ID NO: 169198 - RNA, 64 nt, Human
auuuggaucuuuuuaaacacuguauagacggaagagccugcauuccugaccgaaccuucaguug

SEQ ID NO: 169199 - RNA, 64 nt, Human
ggcaagugcaccaaggagaaggcaggaacacuggagccugcaauaagggaggagagaggacugg

SEQ ID NO: 169200 - RNA, 64 nt, Human
aaaucccuucuucccugguucccaaaccaaagacagccugcagcccuuucugcauggggugcuc

SEQ ID NO: 169201 - RNA, 64 nt, Human
ucaugcugacagagcagcaugcucucuuggcaccagccugcaccucagccaguagggcagccuc

SEQ ID NO: 169202 - RNA, 64 nt, Human
gcugaacucugugcugagcaaggcccugcagugcagccugcauggggacaccccgcacgccucc

SEQ ID NO: 169203 - RNA, 64 nt, Human
cuagacaaauguuuucaaauaaauuucacugcccagccugcacagauuuccauuugaaguacuu

SEQ ID NO: 169204 - RNA, 64 nt, Human
uggcuggguuuuuuaaaaauagaaucucacugauagccugcaagaaacagaugcagugccugcu

SEQ ID NO: 169205 - RNA, 64 nt, Human
auccauaaauaauauaaggaaaaacuuaugcgguagccugcauuagggcuuuuugauacuugca

SEQ ID NO: 169206 - RNA, 64 nt, Human
agauagccugaauccugcccggaguggaagcugaagccugcacaguguccacccuguucccacu

SEQ ID NO: 169207 - RNA, 64 nt, Human
ucuugagagcacucaguggaugacuauggagaagagccugcaagcagagaccaacuacccuuag

SEQ ID NO: 169208 - RNA, 64 nt, Human
ccaacucucucuguguccguguggagggcugcagagccugcagggugaccugcuuccccaaagg

SEQ ID NO: 169209 - RNA, 64 nt, Human
uuucacaaaauauacaacuuucaccauauauauaagccugcaaaauuagaguagugaaagucau

SEQ ID NO: 169210 - RNA, 64 nt, Human
uccagaauucucucauauuugugggcugggaucaagccugcagcuugaggaaagcacaaggaaa

SEQ ID NO: 169211 - RNA, 64 nt, Human
auucuaauuuauuaacuuugacccacccuuucugagccugcagccuucccguguggccugaggg

SEQ ID NO: 169212 - RNA, 64 nt, Human
acaguggccucaaggagcugcagguggggggcucagccugcacccacuuggagccccugcaagg

SEQ ID NO: 169213 - RNA, 64 nt, Human
cguccagugcaggacgggggacccaagggucucaagccugcaaguccagaaggugacaaaccca

SEQ ID NO: 169214 - RNA, 64 nt, Human; identical to SEQ ID NO: 52312

SEQ ID NO: 169215 - RNA, 64 nt, Human; identical to SEQ ID NO: 52313

SEQ ID NO: 169216 - RNA, 64 nt, Human; identical to SEQ ID NO: 52314

SEQ ID NO: 169217 - RNA, 64 nt, Human; identical to SEQ ID NO: 52315

SEQ ID NO: 169218 - RNA, 64 nt, Human; identical to SEQ ID NO: 52316

SEQ ID NO: 169219 - RNA, 64 nt, Human; identical to SEQ ID NO: 52317

SEQ ID NO: 169220 - RNA, 64 nt, Human; identical to SEQ ID NO: 52318

SEQ ID NO: 169221 - RNA, 64 nt, Human; identical to SEQ ID NO: 52319

SEQ ID NO: 169222 - RNA, 64 nt, Human; identical to SEQ ID NO: 52320

SEQ ID NO: 169223 - RNA, 64 nt, Human; identical to SEQ ID NO: 52321

SEQ ID NO: 169224 - RNA, 64 nt, Human; identical to SEQ ID NO: 52322

SEQ ID NO: 169225 - RNA, 64 nt, Human; identical to SEQ ID NO: 52323

SEQ ID NO: 169226 - RNA, 64 nt, Human; identical to SEQ ID NO: 52324

SEQ ID NO: 169227 - RNA, 64 nt, Human; identical to SEQ ID NO: 52325

SEQ ID NO: 169228 - RNA, 64 nt, Human; identical to SEQ ID NO: 52326

SEQ ID NO: 169229 - RNA, 64 nt, Human; identical to SEQ ID NO: 52327

SEQ ID NO: 169230 - RNA, 64 nt, Human; identical to SEQ ID NO: 52328

SEQ ID NO: 169231 - RNA, 64 nt, Human; identical to SEQ ID NO: 32996

SEQ ID NO: 169232 - RNA, 64 nt, Human; identical to SEQ ID NO: 32997

SEQ ID NO: 169233 - RNA, 64 nt, Human; identical to SEQ ID NO: 32998

SEQ ID NO: 169234 - RNA, 64 nt, Human; identical to SEQ ID NO: 32999

SEQ ID NO: 169235 - RNA, 64 nt, Human; identical to SEQ ID NO: 33000

SEQ ID NO: 169236 - RNA, 64 nt, Human; identical to SEQ ID NO: 33001

SEQ ID NO: 169237 - RNA, 64 nt, Human; identical to SEQ ID NO: 33002

SEQ ID NO: 169238 - RNA, 64 nt, Human; identical to SEQ ID NO: 33003

SEQ ID NO: 169239 - RNA, 64 nt, Human; identical to SEQ ID NO: 33004

SEQ ID NO: 169240 - RNA, 64 nt, Human; identical to SEQ ID NO: 33005

SEQ ID NO: 169241 - RNA, 64 nt, Human; identical to SEQ ID NO: 33006

SEQ ID NO: 169242 - RNA, 64 nt, Human; identical to SEQ ID NO: 33007

SEQ ID NO: 169243 - RNA, 64 nt, Human; identical to SEQ ID NO: 33008

SEQ ID NO: 169244 - RNA, 64 nt, Human; identical to SEQ ID NO: 33009

SEQ ID NO: 169245 - RNA, 64 nt, Human; identical to SEQ ID NO: 33010

SEQ ID NO: 169246 - RNA, 64 nt, Human; identical to SEQ ID NO: 33011

SEQ ID NO: 169247 - RNA, 64 nt, Human; identical to SEQ ID NO: 33012

SEQ ID NO: 169248 - RNA, 64 nt, Human; identical to SEQ ID NO: 33013

SEQ ID NO: 169249 - RNA, 55 nt, Human; identical to SEQ ID NO: 33014

SEQ ID NO: 169250 - RNA, 64 nt, Human; identical to SEQ ID NO: 33015

SEQ ID NO: 169251 - RNA, 64 nt, Human; identical to SEQ ID NO: 33016

SEQ ID NO: 169252 - RNA, 64 nt, Human; identical to SEQ ID NO: 33017

SEQ ID NO: 169253 - RNA, 64 nt, Human; identical to SEQ ID NO: 33018

SEQ ID NO: 169254 - RNA, 64 nt, Human; identical to SEQ ID NO: 33019

SEQ ID NO: 169255 - RNA, 64 nt, Human; identical to SEQ ID NO: 33020

SEQ ID NO: 169256 - RNA, 64 nt, Human; identical to SEQ ID NO: 33021

SEQ ID NO: 169257 - RNA, 64 nt, Human; identical to SEQ ID NO: 33022

SEQ ID NO: 169258 - RNA, 64 nt, Human; identical to SEQ ID NO: 33023

SEQ ID NO: 169259 - RNA, 64 nt, Human; identical to SEQ ID NO: 33024

SEQ ID NO: 169260 - RNA, 56 nt, Human; identical to SEQ ID NO: 33025

SEQ ID NO: 169261 - RNA, 64 nt, Human; identical to SEQ ID NO: 33026

SEQ ID NO: 169262 - RNA, 64 nt, Human; identical to SEQ ID NO: 33027

SEQ ID NO: 169263 - RNA, 64 nt, Human; identical to SEQ ID NO: 33028

SEQ ID NO: 169264 - RNA, 64 nt, Human; identical to SEQ ID NO: 33029

SEQ ID NO: 169265 - RNA, 64 nt, Human; identical to SEQ ID NO: 33030

SEQ ID NO: 169266 - RNA, 61 nt, Human; identical to SEQ ID NO: 33031

SEQ ID NO: 169267 - RNA, 64 nt, Human; identical to SEQ ID NO: 33032

SEQ ID NO: 169268 - RNA, 64 nt, Human; identical to SEQ ID NO: 33033

SEQ ID NO: 169269 - RNA, 64 nt, Human; identical to SEQ ID NO: 33034

SEQ ID NO: 169270 - RNA, 64 nt, Human; identical to SEQ ID NO: 33035

SEQ ID NO: 169271 - RNA, 64 nt, Human; identical to SEQ ID NO: 33036

SEQ ID NO: 169272 - RNA, 64 nt, Human; identical to SEQ ID NO: 33037

SEQ ID NO: 169273 - RNA, 64 nt, Human; identical to SEQ ID NO: 33038

SEQ ID NO: 169274 - RNA, 64 nt, Human; identical to SEQ ID NO: 33039

SEQ ID NO: 169275 - RNA, 64 nt, Human; identical to SEQ ID NO: 33040

SEQ ID NO: 169276 - RNA, 64 nt, Human; identical to SEQ ID NO: 33041

SEQ ID NO: 169277 - RNA, 64 nt, Human; identical to SEQ ID NO: 33042

SEQ ID NO: 169278 - RNA, 64 nt, Human; identical to SEQ ID NO: 33043

SEQ ID NO: 169279 - RNA, 64 nt, Human; identical to SEQ ID NO: 33044

SEQ ID NO: 169280 - RNA, 64 nt, Human; identical to SEQ ID NO: 33045

SEQ ID NO: 169281 - RNA, 64 nt, Human; identical to SEQ ID NO: 33046

SEQ ID NO: 169282 - RNA, 64 nt, Human; identical to SEQ ID NO: 33047

SEQ ID NO: 169283 - RNA, 64 nt, Human; identical to SEQ ID NO: 33048

SEQ ID NO: 169284 - RNA, 64 nt, Human; identical to SEQ ID NO: 33049

SEQ ID NO: 169285 - RNA, 64 nt, Human; identical to SEQ ID NO: 33050

SEQ ID NO: 169286 - RNA, 64 nt, Human; identical to SEQ ID NO: 33051

SEQ ID NO: 169287 - RNA, 64 nt, Human; identical to SEQ ID NO: 33052

SEQ ID NO: 169288 - RNA, 64 nt, Human; identical to SEQ ID NO: 33053

SEQ ID NO: 169289 - RNA, 64 nt, Human; identical to SEQ ID NO: 33054

SEQ ID NO: 169290 - RNA, 64 nt, Human; identical to SEQ ID NO: 33055

SEQ ID NO: 169291 - RNA, 64 nt, Human; identical to SEQ ID NO: 33056

SEQ ID NO: 169292 - RNA, 64 nt, Human; identical to SEQ ID NO: 33057

SEQ ID NO: 169293 - RNA, 64 nt, Human; identical to SEQ ID NO: 33058

SEQ ID NO: 169294 - RNA, 59 nt, Human; identical to SEQ ID NO: 33059

SEQ ID NO: 169295 - RNA, 64 nt, Human; identical to SEQ ID NO: 33060

SEQ ID NO: 169296 - RNA, 64 nt, Human; identical to SEQ ID NO: 33061

SEQ ID NO: 169297 - RNA, 64 nt, Human; identical to SEQ ID NO: 33062

SEQ ID NO: 169298 - RNA, 64 nt, Human; identical to SEQ ID NO: 33063

SEQ ID NO: 169299 - RNA, 64 nt, Human; identical to SEQ ID NO: 33064

SEQ ID NO: 169300 - RNA, 64 nt, Human; identical to SEQ ID NO: 33065

SEQ ID NO: 169301 - RNA, 64 nt, Human; identical to SEQ ID NO: 33066

SEQ ID NO: 169302 - RNA, 64 nt, Human; identical to SEQ ID NO: 33067

SEQ ID NO: 169303 - RNA, 64 nt, Human; identical to SEQ ID NO: 33068

SEQ ID NO: 169304 - RNA, 64 nt, Human; identical to SEQ ID NO: 33069

SEQ ID NO: 169305 - RNA, 64 nt, Human; identical to SEQ ID NO: 33070

SEQ ID NO: 169306 - RNA, 64 nt, Human; identical to SEQ ID NO: 33071

SEQ ID NO: 169307 - RNA, 64 nt, Human; identical to SEQ ID NO: 33072

SEQ ID NO: 169308 - RNA, 64 nt, Human; identical to SEQ ID NO: 33073

SEQ ID NO: 169309 - RNA, 64 nt, Human; identical to SEQ ID NO: 33074

SEQ ID NO: 169310 - RNA, 64 nt, Human; identical to SEQ ID NO: 33075

SEQ ID NO: 169311 - RNA, 63 nt, Human; identical to SEQ ID NO: 33076

SEQ ID NO: 169312 - RNA, 64 nt, Human; identical to SEQ ID NO: 33077

SEQ ID NO: 169313 - RNA, 64 nt, Human; identical to SEQ ID NO: 33078

SEQ ID NO: 169314 - RNA, 64 nt, Human; identical to SEQ ID NO: 33079

SEQ ID NO: 169315 - RNA, 64 nt, Human; identical to SEQ ID NO: 33080

SEQ ID NO: 169316 - RNA, 64 nt, Human; identical to SEQ ID NO: 33081

SEQ ID NO: 169317 - RNA, 64 nt, Human; identical to SEQ ID NO: 33082

SEQ ID NO: 169318 - RNA, 50 nt, Human; identical to SEQ ID NO: 33083

SEQ ID NO: 169319 - RNA, 64 nt, Human; identical to SEQ ID NO: 33084

SEQ ID NO: 169320 - RNA, 64 nt, Human; identical to SEQ ID NO: 33085

SEQ ID NO: 169321 - RNA, 64 nt, Human; identical to SEQ ID NO: 33086

SEQ ID NO: 169322 - RNA, 64 nt, Human; identical to SEQ ID NO: 33087

SEQ ID NO: 169323 - RNA, 64 nt, Human; identical to SEQ ID NO: 33088

SEQ ID NO: 169324 - RNA, 64 nt, Human; identical to SEQ ID NO: 33089

SEQ ID NO: 169325 - RNA, 64 nt, Human; identical to SEQ ID NO: 33090

SEQ ID NO: 169326 - RNA, 64 nt, Human; identical to SEQ ID NO: 33091

SEQ ID NO: 169327 - RNA, 64 nt, Human; identical to SEQ ID NO: 33092

SEQ ID NO: 169328 - RNA, 64 nt, Human; identical to SEQ ID NO: 33093

SEQ ID NO: 169329 - RNA, 64 nt, Human; identical to SEQ ID NO: 33094

SEQ ID NO: 169330 - RNA, 64 nt, Human; identical to SEQ ID NO: 33095

SEQ ID NO: 169331 - RNA, 64 nt, Human; identical to SEQ ID NO: 33096

SEQ ID NO: 169332 - RNA, 64 nt, Human; identical to SEQ ID NO: 33097

SEQ ID NO: 169333 - RNA, 64 nt, Human; identical to SEQ ID NO: 33098

SEQ ID NO: 169334 - RNA, 64 nt, Human; identical to SEQ ID NO: 33099

SEQ ID NO: 169335 - RNA, 64 nt, Human; identical to SEQ ID NO: 33100

SEQ ID NO: 169336 - RNA, 64 nt, Human; identical to SEQ ID NO: 33101

SEQ ID NO: 169337 - RNA, 64 nt, Human; identical to SEQ ID NO: 33102

SEQ ID NO: 169338 - RNA, 64 nt, Human; identical to SEQ ID NO: 33103

SEQ ID NO: 169339 - RNA, 64 nt, Human; identical to SEQ ID NO: 33104

SEQ ID NO: 169340 - RNA, 64 nt, Human; identical to SEQ ID NO: 33105

SEQ ID NO: 169341 - RNA, 56 nt, Human; identical to SEQ ID NO: 33106

SEQ ID NO: 169342 - RNA, 64 nt, Human; identical to SEQ ID NO: 33107

SEQ ID NO: 169343 - RNA, 64 nt, Human; identical to SEQ ID NO: 33108

SEQ ID NO: 169344 - RNA, 64 nt, Human; identical to SEQ ID NO: 33109

SEQ ID NO: 169345 - RNA, 64 nt, Human; identical to SEQ ID NO: 33110

SEQ ID NO: 169346 - RNA, 52 nt, Human; identical to SEQ ID NO: 33111

SEQ ID NO: 169347 - RNA, 64 nt, Human; identical to SEQ ID NO: 33112

SEQ ID NO: 169348 - RNA, 64 nt, Human; identical to SEQ ID NO: 33113

SEQ ID NO: 169349 - RNA, 57 nt, Human; identical to SEQ ID NO: 33114

SEQ ID NO: 169350 - RNA, 64 nt, Human; identical to SEQ ID NO: 33115

SEQ ID NO: 169351 - RNA, 64 nt, Human; identical to SEQ ID NO: 33116

SEQ ID NO: 169352 - RNA, 64 nt, Human; identical to SEQ ID NO: 33117

SEQ ID NO: 169353 - RNA, 64 nt, Human; identical to SEQ ID NO: 33118

SEQ ID NO: 169354 - RNA, 64 nt, Human; identical to SEQ ID NO: 33119

SEQ ID NO: 169355 - RNA, 64 nt, Human; identical to SEQ ID NO: 33120

SEQ ID NO: 169356 - RNA, 64 nt, Human; identical to SEQ ID NO: 33121

SEQ ID NO: 169357 - RNA, 64 nt, Human; identical to SEQ ID NO: 33122

SEQ ID NO: 169358 - RNA, 64 nt, Human; identical to SEQ ID NO: 33123

SEQ ID NO: 169359 - RNA, 64 nt, Human; identical to SEQ ID NO: 33124

SEQ ID NO: 169360 - RNA, 64 nt, Human; identical to SEQ ID NO: 33125

SEQ ID NO: 169361 - RNA, 64 nt, Human; identical to SEQ ID NO: 33126

SEQ ID NO: 169362 - RNA, 64 nt, Human; identical to SEQ ID NO: 33127

SEQ ID NO: 169363 - RNA, 64 nt, Human; identical to SEQ ID NO: 33128

SEQ ID NO: 169364 - RNA, 64 nt, Human; identical to SEQ ID NO: 33129

SEQ ID NO: 169365 - RNA, 64 nt, Human; identical to SEQ ID NO: 33130

SEQ ID NO: 169366 - RNA, 64 nt, Human; identical to SEQ ID NO: 33131

SEQ ID NO: 169367 - RNA, 64 nt, Human; identical to SEQ ID NO: 33132

SEQ ID NO: 169368 - RNA, 64 nt, Human; identical to SEQ ID NO: 33133

SEQ ID NO: 169369 - RNA, 64 nt, Human; identical to SEQ ID NO: 33134

SEQ ID NO: 169370 - RNA, 64 nt, Human; identical to SEQ ID NO: 33135

SEQ ID NO: 169371 - RNA, 64 nt, Human; identical to SEQ ID NO: 33136

SEQ ID NO: 169372 - RNA, 64 nt, Human; identical to SEQ ID NO: 33137

SEQ ID NO: 169373 - RNA, 64 nt, Human; identical to SEQ ID NO: 33138

SEQ ID NO: 169374 - RNA, 64 nt, Human; identical to SEQ ID NO: 33139

SEQ ID NO: 169375 - RNA, 64 nt, Human; identical to SEQ ID NO: 33140

SEQ ID NO: 169376 - RNA, 64 nt, Human; identical to SEQ ID NO: 33141

SEQ ID NO: 169377 - RNA, 64 nt, Human; identical to SEQ ID NO: 33142

SEQ ID NO: 169378 - RNA, 64 nt, Human; identical to SEQ ID NO: 33143

SEQ ID NO: 169379 - RNA, 64 nt, Human; identical to SEQ ID NO: 33144

SEQ ID NO: 169380 - RNA, 64 nt, Human; identical to SEQ ID NO: 33145

SEQ ID NO: 169381 - RNA, 64 nt, Human; identical to SEQ ID NO: 33146

SEQ ID NO: 169382 - RNA, 64 nt, Human; identical to SEQ ID NO: 33147

SEQ ID NO: 169383 - RNA, 58 nt, Human; identical to SEQ ID NO: 33148

SEQ ID NO: 169384 - RNA, 64 nt, Human; identical to SEQ ID NO: 33149

SEQ ID NO: 169385 - RNA, 64 nt, Human; identical to SEQ ID NO: 33150

SEQ ID NO: 169386 - RNA, 64 nt, Human; identical to SEQ ID NO: 33151

SEQ ID NO: 169387 - RNA, 64 nt, Human; identical to SEQ ID NO: 33152

SEQ ID NO: 169388 - RNA, 64 nt, Human; identical to SEQ ID NO: 33153

SEQ ID NO: 169389 - RNA, 64 nt, Human; identical to SEQ ID NO: 33154

SEQ ID NO: 169390 - RNA, 64 nt, Human; identical to SEQ ID NO: 33155

SEQ ID NO: 169391 - RNA, 64 nt, Human; identical to SEQ ID NO: 33156

SEQ ID NO: 169392 - RNA, 64 nt, Human; identical to SEQ ID NO: 33157

SEQ ID NO: 169393 - RNA, 64 nt, Human; identical to SEQ ID NO: 33158

SEQ ID NO: 169394 - RNA, 64 nt, Human; identical to SEQ ID NO: 33159

SEQ ID NO: 169395 - RNA, 64 nt, Human; identical to SEQ ID NO: 33160

SEQ ID NO: 169396 - RNA, 64 nt, Human; identical to SEQ ID NO: 33161

SEQ ID NO: 169397 - RNA, 64 nt, Human; identical to SEQ ID NO: 33162

SEQ ID NO: 169398 - RNA, 64 nt, Human; identical to SEQ ID NO: 33163

SEQ ID NO: 169399 - RNA, 64 nt, Human; identical to SEQ ID NO: 33164

SEQ ID NO: 169400 - RNA, 64 nt, Human; identical to SEQ ID NO: 33165

SEQ ID NO: 169401 - RNA, 64 nt, Human; identical to SEQ ID NO: 33166

SEQ ID NO: 169402 - RNA, 64 nt, Human; identical to SEQ ID NO: 33167

SEQ ID NO: 169403 - RNA, 64 nt, Human; identical to SEQ ID NO: 33168

SEQ ID NO: 169404 - RNA, 64 nt, Human; identical to SEQ ID NO: 33169

SEQ ID NO: 169405 - RNA, 64 nt, Human; identical to SEQ ID NO: 33170

SEQ ID NO: 169406 - RNA, 64 nt, Human; identical to SEQ ID NO: 33171

SEQ ID NO: 169407 - RNA, 64 nt, Human; identical to SEQ ID NO: 33172

SEQ ID NO: 169408 - RNA, 64 nt, Human; identical to SEQ ID NO: 33173

SEQ ID NO: 169409 - RNA, 64 nt, Human; identical to SEQ ID NO: 33174

SEQ ID NO: 169410 - RNA, 64 nt, Human; identical to SEQ ID NO: 33175

SEQ ID NO: 169411 - RNA, 64 nt, Human; identical to SEQ ID NO: 33176

SEQ ID NO: 169412 - RNA, 64 nt, Human; identical to SEQ ID NO: 33177

SEQ ID NO: 169413 - RNA, 64 nt, Human; identical to SEQ ID NO: 33178

SEQ ID NO: 169414 - RNA, 64 nt, Human; identical to SEQ ID NO: 33179

SEQ ID NO: 169415 - RNA, 64 nt, Human; identical to SEQ ID NO: 33180

SEQ ID NO: 169416 - RNA, 64 nt, Human; identical to SEQ ID NO: 33181

SEQ ID NO: 169417 - RNA, 64 nt, Human; identical to SEQ ID NO: 33182

SEQ ID NO: 169418 - RNA, 64 nt, Human; identical to SEQ ID NO: 33183

SEQ ID NO: 169419 - RNA, 64 nt, Human; identical to SEQ ID NO: 33184

SEQ ID NO: 169420 - RNA, 64 nt, Human; identical to SEQ ID NO: 33185

SEQ ID NO: 169421 - RNA, 64 nt, Human; identical to SEQ ID NO: 33186

SEQ ID NO: 169422 - RNA, 64 nt, Human; identical to SEQ ID NO: 33187

SEQ ID NO: 169423 - RNA, 64 nt, Human; identical to SEQ ID NO: 33188

SEQ ID NO: 169424 - RNA, 64 nt, Human; identical to SEQ ID NO: 33189

SEQ ID NO: 169425 - RNA, 64 nt, Human; identical to SEQ ID NO: 33190

SEQ ID NO: 169426 - RNA, 64 nt, Human; identical to SEQ ID NO: 33191

SEQ ID NO: 169427 - RNA, 64 nt, Human; identical to SEQ ID NO: 33192

SEQ ID NO: 169428 - RNA, 64 nt, Human; identical to SEQ ID NO: 33193

SEQ ID NO: 169429 - RNA, 64 nt, Human; identical to SEQ ID NO: 33194

SEQ ID NO: 169430 - RNA, 64 nt, Human; identical to SEQ ID NO: 33195

SEQ ID NO: 169431 - RNA, 60 nt, Human; identical to SEQ ID NO: 33196

SEQ ID NO: 169432 - RNA, 64 nt, Human; identical to SEQ ID NO: 33197

SEQ ID NO: 169433 - RNA, 64 nt, Human; identical to SEQ ID NO: 33198

SEQ ID NO: 169434 - RNA, 64 nt, Human; identical to SEQ ID NO: 33199

SEQ ID NO: 169435 - RNA, 64 nt, Human; identical to SEQ ID NO: 33200

SEQ ID NO: 169436 - RNA, 64 nt, Human; identical to SEQ ID NO: 33201

SEQ ID NO: 169437 - RNA, 64 nt, Human; identical to SEQ ID NO: 33202

SEQ ID NO: 169438 - RNA, 64 nt, Human; identical to SEQ ID NO: 33203

SEQ ID NO: 169439 - RNA, 64 nt, Human; identical to SEQ ID NO: 33204

SEQ ID NO: 169440 - RNA, 64 nt, Human; identical to SEQ ID NO: 33205

SEQ ID NO: 169441 - RNA, 64 nt, Human; identical to SEQ ID NO: 33206

SEQ ID NO: 169442 - RNA, 64 nt, Human; identical to SEQ ID NO: 33207

SEQ ID NO: 169443 - RNA, 64 nt, Human; identical to SEQ ID NO: 33208

SEQ ID NO: 169444 - RNA, 64 nt, Human; identical to SEQ ID NO: 33209

SEQ ID NO: 169445 - RNA, 64 nt, Human; identical to SEQ ID NO: 33210

SEQ ID NO: 169446 - RNA, 64 nt, Human; identical to SEQ ID NO: 33211

SEQ ID NO: 169447 - RNA, 64 nt, Human; identical to SEQ ID NO: 33212

SEQ ID NO: 169448 - RNA, 64 nt, Human; identical to SEQ ID NO: 33213

SEQ ID NO: 169449 - RNA, 64 nt, Human; identical to SEQ ID NO: 33214

SEQ ID NO: 169450 - RNA, 64 nt, Human; identical to SEQ ID NO: 33215

SEQ ID NO: 169451 - RNA, 64 nt, Human; identical to SEQ ID NO: 33216

SEQ ID NO: 169452 - RNA, 64 nt, Human; identical to SEQ ID NO: 33217

SEQ ID NO: 169453 - RNA, 64 nt, Human; identical to SEQ ID NO: 33218

SEQ ID NO: 169454 - RNA, 64 nt, Human; identical to SEQ ID NO: 33219

SEQ ID NO: 169455 - RNA, 64 nt, Human; identical to SEQ ID NO: 33220

SEQ ID NO: 169456 - RNA, 64 nt, Human; identical to SEQ ID NO: 33221

SEQ ID NO: 169457 - RNA, 64 nt, Human; identical to SEQ ID NO: 33222

SEQ ID NO: 169458 - RNA, 64 nt, Human; identical to SEQ ID NO: 33223

SEQ ID NO: 169459 - RNA, 64 nt, Human; identical to SEQ ID NO: 33224

SEQ ID NO: 169460 - RNA, 64 nt, Human; identical to SEQ ID NO: 33225

SEQ ID NO: 169461 - RNA, 64 nt, Human; identical to SEQ ID NO: 33226

SEQ ID NO: 169462 - RNA, 64 nt, Human; identical to SEQ ID NO: 33227

SEQ ID NO: 169463 - RNA, 64 nt, Human; identical to SEQ ID NO: 33228

SEQ ID NO: 169464 - RNA, 64 nt, Human; identical to SEQ ID NO: 33229

SEQ ID NO: 169465 - RNA, 64 nt, Human; identical to SEQ ID NO: 33230

SEQ ID NO: 169466 - RNA, 64 nt, Human; identical to SEQ ID NO: 33231

SEQ ID NO: 169467 - RNA, 64 nt, Human; identical to SEQ ID NO: 33232

SEQ ID NO: 169468 - RNA, 64 nt, Human; identical to SEQ ID NO: 33233

SEQ ID NO: 169469 - RNA, 64 nt, Human; identical to SEQ ID NO: 33234

SEQ ID NO: 169470 - RNA, 64 nt, Human; identical to SEQ ID NO: 33235

SEQ ID NO: 169471 - RNA, 64 nt, Human; identical to SEQ ID NO: 33236

SEQ ID NO: 169472 - RNA, 64 nt, Human; identical to SEQ ID NO: 33237

SEQ ID NO: 169473 - RNA, 64 nt, Human; identical to SEQ ID NO: 33238

SEQ ID NO: 169474 - RNA, 64 nt, Human; identical to SEQ ID NO: 33239

SEQ ID NO: 169475 - RNA, 64 nt, Human; identical to SEQ ID NO: 33240

SEQ ID NO: 169476 - RNA, 64 nt, Human; identical to SEQ ID NO: 33241

SEQ ID NO: 169477 - RNA, 64 nt, Human; identical to SEQ ID NO: 33242

SEQ ID NO: 169478 - RNA, 64 nt, Human; identical to SEQ ID NO: 33243

SEQ ID NO: 169479 - RNA, 64 nt, Human; identical to SEQ ID NO: 33244

SEQ ID NO: 169480 - RNA, 64 nt, Human; identical to SEQ ID NO: 33245

SEQ ID NO: 169481 - RNA, 64 nt, Human; identical to SEQ ID NO: 33246

SEQ ID NO: 169482 - RNA, 64 nt, Human; identical to SEQ ID NO: 33247

SEQ ID NO: 169483 - RNA, 64 nt, Human; identical to SEQ ID NO: 33248

SEQ ID NO: 169484 - RNA, 64 nt, Human; identical to SEQ ID NO: 33249

SEQ ID NO: 169485 - RNA, 64 nt, Human; identical to SEQ ID NO: 33250

SEQ ID NO: 169486 - RNA, 64 nt, Human; identical to SEQ ID NO: 33251

SEQ ID NO: 169487 - RNA, 64 nt, Human; identical to SEQ ID NO: 33252

SEQ ID NO: 169488 - RNA, 64 nt, Human; identical to SEQ ID NO: 33253

SEQ ID NO: 169489 - RNA, 64 nt, Human; identical to SEQ ID NO: 33254

SEQ ID NO: 169490 - RNA, 64 nt, Human; identical to SEQ ID NO: 33255

SEQ ID NO: 169491 - RNA, 64 nt, Human; identical to SEQ ID NO: 33256

SEQ ID NO: 169492 - RNA, 64 nt, Human; identical to SEQ ID NO: 33257

SEQ ID NO: 169493 - RNA, 64 nt, Human; identical to SEQ ID NO: 33258

SEQ ID NO: 169494 - RNA, 64 nt, Human; identical to SEQ ID NO: 33259

SEQ ID NO: 169495 - RNA, 64 nt, Human; identical to SEQ ID NO: 33260

SEQ ID NO: 169496 - RNA, 64 nt, Human; identical to SEQ ID NO: 33261

SEQ ID NO: 169497 - RNA, 64 nt, Human; identical to SEQ ID NO: 33262

SEQ ID NO: 169498 - RNA, 64 nt, Human; identical to SEQ ID NO: 33263

SEQ ID NO: 169499 - RNA, 64 nt, Human; identical to SEQ ID NO: 33264

SEQ ID NO: 169500 - RNA, 64 nt, Human; identical to SEQ ID NO: 33265

SEQ ID NO: 169501 - RNA, 64 nt, Human; identical to SEQ ID NO: 33266

SEQ ID NO: 169502 - RNA, 64 nt, Human; identical to SEQ ID NO: 33267

SEQ ID NO: 169503 - RNA, 64 nt, Human; identical to SEQ ID NO: 33268

SEQ ID NO: 169504 - RNA, 64 nt, Human; identical to SEQ ID NO: 33269

SEQ ID NO: 169505 - RNA, 64 nt, Human; identical to SEQ ID NO: 33270

SEQ ID NO: 169506 - RNA, 64 nt, Human; identical to SEQ ID NO: 33271

SEQ ID NO: 169507 - RNA, 64 nt, Human; identical to SEQ ID NO: 33272

SEQ ID NO: 169508 - RNA, 64 nt, Human; identical to SEQ ID NO: 33273

SEQ ID NO: 169509 - RNA, 64 nt, Human; identical to SEQ ID NO: 33274

SEQ ID NO: 169510 - RNA, 64 nt, Human; identical to SEQ ID NO: 33275

SEQ ID NO: 169511 - RNA, 64 nt, Human; identical to SEQ ID NO: 33276

SEQ ID NO: 169512 - RNA, 64 nt, Human; identical to SEQ ID NO: 33277

SEQ ID NO: 169513 - RNA, 53 nt, Human; identical to SEQ ID NO: 33278

SEQ ID NO: 169514 - RNA, 64 nt, Human; identical to SEQ ID NO: 33279

SEQ ID NO: 169515 - RNA, 64 nt, Human; identical to SEQ ID NO: 33280

SEQ ID NO: 169516 - RNA, 64 nt, Human; identical to SEQ ID NO: 33281

SEQ ID NO: 169517 - RNA, 64 nt, Human; identical to SEQ ID NO: 33282

SEQ ID NO: 169518 - RNA, 64 nt, Human; identical to SEQ ID NO: 33283

SEQ ID NO: 169519 - RNA, 64 nt, Human; identical to SEQ ID NO: 33284

SEQ ID NO: 169520 - RNA, 64 nt, Human; identical to SEQ ID NO: 33285

SEQ ID NO: 169521 - RNA, 64 nt, Human; identical to SEQ ID NO: 33286

SEQ ID NO: 169522 - RNA, 64 nt, Human; identical to SEQ ID NO: 33287

SEQ ID NO: 169523 - RNA, 64 nt, Human; identical to SEQ ID NO: 33288

SEQ ID NO: 169524 - RNA, 64 nt, Human; identical to SEQ ID NO: 33289

SEQ ID NO: 169525 - RNA, 64 nt, Human; identical to SEQ ID NO: 33290

SEQ ID NO: 169526 - RNA, 64 nt, Human; identical to SEQ ID NO: 33291

SEQ ID NO: 169527 - RNA, 64 nt, Human; identical to SEQ ID NO: 33292

SEQ ID NO: 169528 - RNA, 64 nt, Human; identical to SEQ ID NO: 33293

SEQ ID NO: 169529 - RNA, 64 nt, Human; identical to SEQ ID NO: 33294

SEQ ID NO: 169530 - RNA, 64 nt, Human; identical to SEQ ID NO: 33295

SEQ ID NO: 169531 - RNA, 64 nt, Human; identical to SEQ ID NO: 33296

SEQ ID NO: 169532 - RNA, 64 nt, Human; identical to SEQ ID NO: 33297

SEQ ID NO: 169533 - RNA, 64 nt, Human; identical to SEQ ID NO: 33298

SEQ ID NO: 169534 - RNA, 64 nt, Human; identical to SEQ ID NO: 33299

SEQ ID NO: 169535 - RNA, 64 nt, Human; identical to SEQ ID NO: 33300

SEQ ID NO: 169536 - RNA, 64 nt, Human; identical to SEQ ID NO: 33301

SEQ ID NO: 169537 - RNA, 64 nt, Human; identical to SEQ ID NO: 33302

SEQ ID NO: 169538 - RNA, 64 nt, Human; identical to SEQ ID NO: 33303

SEQ ID NO: 169539 - RNA, 64 nt, Human; identical to SEQ ID NO: 33304

SEQ ID NO: 169540 - RNA, 64 nt, Human; identical to SEQ ID NO: 33305

SEQ ID NO: 169541 - RNA, 64 nt, Human; identical to SEQ ID NO: 33306

SEQ ID NO: 169542 - RNA, 64 nt, Human; identical to SEQ ID NO: 33307

SEQ ID NO: 169543 - RNA, 64 nt, Human; identical to SEQ ID NO: 33308

SEQ ID NO: 169544 - RNA, 64 nt, Human; identical to SEQ ID NO: 33309

SEQ ID NO: 169545 - RNA, 64 nt, Human; identical to SEQ ID NO: 33310

SEQ ID NO: 169546 - RNA, 64 nt, Human; identical to SEQ ID NO: 33311

SEQ ID NO: 169547 - RNA, 64 nt, Human; identical to SEQ ID NO: 33312

SEQ ID NO: 169548 - RNA, 64 nt, Human; identical to SEQ ID NO: 33313

SEQ ID NO: 169549 - RNA, 64 nt, Human; identical to SEQ ID NO: 33314

SEQ ID NO: 169550 - RNA, 64 nt, Human; identical to SEQ ID NO: 33315

SEQ ID NO: 169551 - RNA, 64 nt, Human; identical to SEQ ID NO: 33316

SEQ ID NO: 169552 - RNA, 64 nt, Human; identical to SEQ ID NO: 33317

SEQ ID NO: 169553 - RNA, 64 nt, Human; identical to SEQ ID NO: 33318

SEQ ID NO: 169554 - RNA, 64 nt, Human; identical to SEQ ID NO: 33319

SEQ ID NO: 169555 - RNA, 64 nt, Human; identical to SEQ ID NO: 33320

SEQ ID NO: 169556 - RNA, 64 nt, Human; identical to SEQ ID NO: 33321

SEQ ID NO: 169557 - RNA, 64 nt, Human; identical to SEQ ID NO: 33322

SEQ ID NO: 169558 - RNA, 64 nt, Human; identical to SEQ ID NO: 33323

SEQ ID NO: 169559 - RNA, 64 nt, Human; identical to SEQ ID NO: 33324

SEQ ID NO: 169560 - RNA, 61 nt, Human; identical to SEQ ID NO: 33325

SEQ ID NO: 169561 - RNA, 64 nt, Human; identical to SEQ ID NO: 33326

SEQ ID NO: 169562 - RNA, 64 nt, Human; identical to SEQ ID NO: 33327

SEQ ID NO: 169563 - RNA, 64 nt, Human; identical to SEQ ID NO: 33328

SEQ ID NO: 169564 - RNA, 64 nt, Human; identical to SEQ ID NO: 33329

SEQ ID NO: 169565 - RNA, 64 nt, Human; identical to SEQ ID NO: 33330

SEQ ID NO: 169566 - RNA, 64 nt, Human; identical to SEQ ID NO: 33331

SEQ ID NO: 169567 - RNA, 64 nt, Human; identical to SEQ ID NO: 33332

SEQ ID NO: 169568 - RNA, 64 nt, Human; identical to SEQ ID NO: 33333

SEQ ID NO: 169569 - RNA, 64 nt, Human; identical to SEQ ID NO: 33334

SEQ ID NO: 169570 - RNA, 64 nt, Human; identical to SEQ ID NO: 33335

SEQ ID NO: 169571 - RNA, 64 nt, Human; identical to SEQ ID NO: 33336

SEQ ID NO: 169572 - RNA, 64 nt, Human; identical to SEQ ID NO: 33337

SEQ ID NO: 169573 - RNA, 64 nt, Human; identical to SEQ ID NO: 33338

SEQ ID NO: 169574 - RNA, 64 nt, Human; identical to SEQ ID NO: 33339

SEQ ID NO: 169575 - RNA, 64 nt, Human; identical to SEQ ID NO: 33340

SEQ ID NO: 169576 - RNA, 64 nt, Human; identical to SEQ ID NO: 33341

SEQ ID NO: 169577 - RNA, 64 nt, Human; identical to SEQ ID NO: 33342

SEQ ID NO: 169578 - RNA, 64 nt, Human; identical to SEQ ID NO: 33343

SEQ ID NO: 169579 - RNA, 64 nt, Human; identical to SEQ ID NO: 33344

SEQ ID NO: 169580 - RNA, 64 nt, Human; identical to SEQ ID NO: 33345

SEQ ID NO: 169581 - RNA, 64 nt, Human; identical to SEQ ID NO: 33346

SEQ ID NO: 169582 - RNA, 64 nt, Human; identical to SEQ ID NO: 33347

SEQ ID NO: 169583 - RNA, 64 nt, Human; identical to SEQ ID NO: 33348

SEQ ID NO: 169584 - RNA, 64 nt, Human; identical to SEQ ID NO: 33349

SEQ ID NO: 169585 - RNA, 64 nt, Human; identical to SEQ ID NO: 33350

SEQ ID NO: 169586 - RNA, 64 nt, Human; identical to SEQ ID NO: 33351

SEQ ID NO: 169587 - RNA, 64 nt, Human; identical to SEQ ID NO: 33352

SEQ ID NO: 169588 - RNA, 64 nt, Human; identical to SEQ ID NO: 33353

SEQ ID NO: 169589 - RNA, 64 nt, Human; identical to SEQ ID NO: 33354

SEQ ID NO: 169590 - RNA, 64 nt, Human; identical to SEQ ID NO: 33355

SEQ ID NO: 169591 - RNA, 64 nt, Human; identical to SEQ ID NO: 33356

SEQ ID NO: 169592 - RNA, 64 nt, Human; identical to SEQ ID NO: 33357

SEQ ID NO: 169593 - RNA, 64 nt, Human; identical to SEQ ID NO: 33358

SEQ ID NO: 169594 - RNA, 64 nt, Human; identical to SEQ ID NO: 33359

SEQ ID NO: 169595 - RNA, 64 nt, Human; identical to SEQ ID NO: 33360

SEQ ID NO: 169596 - RNA, 64 nt, Human; identical to SEQ ID NO: 33361

SEQ ID NO: 169597 - RNA, 64 nt, Human; identical to SEQ ID NO: 33362

SEQ ID NO: 169598 - RNA, 64 nt, Human; identical to SEQ ID NO: 33363

SEQ ID NO: 169599 - RNA, 64 nt, Human; identical to SEQ ID NO: 33364

SEQ ID NO: 169600 - RNA, 64 nt, Human; identical to SEQ ID NO: 33365

SEQ ID NO: 169601 - RNA, 64 nt, Human; identical to SEQ ID NO: 33366

SEQ ID NO: 169602 - RNA, 64 nt, Human; identical to SEQ ID NO: 33367

SEQ ID NO: 169603 - RNA, 64 nt, Human; identical to SEQ ID NO: 33368

SEQ ID NO: 169604 - RNA, 64 nt, Human; identical to SEQ ID NO: 33369

SEQ ID NO: 169605 - RNA, 51 nt, Human; identical to SEQ ID NO: 33370

SEQ ID NO: 169606 - RNA, 64 nt, Human; identical to SEQ ID NO: 33371

SEQ ID NO: 169607 - RNA, 64 nt, Human; identical to SEQ ID NO: 33372

SEQ ID NO: 169608 - RNA, 64 nt, Human; identical to SEQ ID NO: 33373

SEQ ID NO: 169609 - RNA, 64 nt, Human; identical to SEQ ID NO: 33374

SEQ ID NO: 169610 - RNA, 64 nt, Human; identical to SEQ ID NO: 33375

SEQ ID NO: 169611 - RNA, 64 nt, Human; identical to SEQ ID NO: 33376

SEQ ID NO: 169612 - RNA, 64 nt, Human; identical to SEQ ID NO: 33377

SEQ ID NO: 169613 - RNA, 64 nt, Human; identical to SEQ ID NO: 33378

SEQ ID NO: 169614 - RNA, 64 nt, Human; identical to SEQ ID NO: 33379

SEQ ID NO: 169615 - RNA, 64 nt, Human; identical to SEQ ID NO: 33380

SEQ ID NO: 169616 - RNA, 64 nt, Human; identical to SEQ ID NO: 33381

SEQ ID NO: 169617 - RNA, 64 nt, Human; identical to SEQ ID NO: 33382

SEQ ID NO: 169618 - RNA, 64 nt, Human; identical to SEQ ID NO: 33383

SEQ ID NO: 169619 - RNA, 64 nt, Human; identical to SEQ ID NO: 33384

SEQ ID NO: 169620 - RNA, 64 nt, Human; identical to SEQ ID NO: 33385

SEQ ID NO: 169621 - RNA, 64 nt, Human; identical to SEQ ID NO: 33386

SEQ ID NO: 169622 - RNA, 64 nt, Human; identical to SEQ ID NO: 33387

SEQ ID NO: 169623 - RNA, 64 nt, Human; identical to SEQ ID NO: 33388

SEQ ID NO: 169624 - RNA, 64 nt, Human; identical to SEQ ID NO: 33389

SEQ ID NO: 169625 - RNA, 64 nt, Human; identical to SEQ ID NO: 33390

SEQ ID NO: 169626 - RNA, 64 nt, Human; identical to SEQ ID NO: 33391

SEQ ID NO: 169627 - RNA, 64 nt, Human; identical to SEQ ID NO: 33392

SEQ ID NO: 169628 - RNA, 64 nt, Human; identical to SEQ ID NO: 33393

SEQ ID NO: 169629 - RNA, 64 nt, Human; identical to SEQ ID NO: 33394

SEQ ID NO: 169630 - RNA, 64 nt, Human; identical to SEQ ID NO: 33395

SEQ ID NO: 169631 - RNA, 64 nt, Human; identical to SEQ ID NO: 33396

SEQ ID NO: 169632 - RNA, 64 nt, Human; identical to SEQ ID NO: 33397

SEQ ID NO: 169633 - RNA, 64 nt, Human; identical to SEQ ID NO: 33398

SEQ ID NO: 169634 - RNA, 64 nt, Human; identical to SEQ ID NO: 33399

SEQ ID NO: 169635 - RNA, 64 nt, Human; identical to SEQ ID NO: 33400

SEQ ID NO: 169636 - RNA, 64 nt, Human; identical to SEQ ID NO: 33401

SEQ ID NO: 169637 - RNA, 64 nt, Human; identical to SEQ ID NO: 33402

SEQ ID NO: 169638 - RNA, 64 nt, Human; identical to SEQ ID NO: 33403

SEQ ID NO: 169639 - RNA, 64 nt, Human; identical to SEQ ID NO: 33404

SEQ ID NO: 169640 - RNA, 64 nt, Human; identical to SEQ ID NO: 33405

SEQ ID NO: 169641 - RNA, 64 nt, Human; identical to SEQ ID NO: 33406

SEQ ID NO: 169642 - RNA, 64 nt, Human; identical to SEQ ID NO: 33407

SEQ ID NO: 169643 - RNA, 64 nt, Human; identical to SEQ ID NO: 33408

SEQ ID NO: 169644 - RNA, 51 nt, Human; identical to SEQ ID NO: 33409

SEQ ID NO: 169645 - RNA, 64 nt, Human; identical to SEQ ID NO: 33410

SEQ ID NO: 169646 - RNA, 64 nt, Human; identical to SEQ ID NO: 33411

SEQ ID NO: 169647 - RNA, 64 nt, Human; identical to SEQ ID NO: 33412

SEQ ID NO: 169648 - RNA, 64 nt, Human; identical to SEQ ID NO: 33413

SEQ ID NO: 169649 - RNA, 64 nt, Human; identical to SEQ ID NO: 33414

SEQ ID NO: 169650 - RNA, 64 nt, Human; identical to SEQ ID NO: 33415

SEQ ID NO: 169651 - RNA, 64 nt, Human; identical to SEQ ID NO: 33416

SEQ ID NO: 169652 - RNA, 64 nt, Human; identical to SEQ ID NO: 33417

SEQ ID NO: 169653 - RNA, 64 nt, Human; identical to SEQ ID NO: 33418

SEQ ID NO: 169654 - RNA, 64 nt, Human; identical to SEQ ID NO: 33419

SEQ ID NO: 169655 - RNA, 54 nt, Human; identical to SEQ ID NO: 33420

SEQ ID NO: 169656 - RNA, 64 nt, Human; identical to SEQ ID NO: 33421

SEQ ID NO: 169657 - RNA, 64 nt, Human; identical to SEQ ID NO: 33422

SEQ ID NO: 169658 - RNA, 64 nt, Human; identical to SEQ ID NO: 33423

SEQ ID NO: 169659 - RNA, 64 nt, Human; identical to SEQ ID NO: 33424

SEQ ID NO: 169660 - RNA, 64 nt, Human; identical to SEQ ID NO: 33425

SEQ ID NO: 169661 - RNA, 64 nt, Human; identical to SEQ ID NO: 33426

SEQ ID NO: 169662 - RNA, 64 nt, Human; identical to SEQ ID NO: 33427

SEQ ID NO: 169663 - RNA, 64 nt, Human; identical to SEQ ID NO: 33428

SEQ ID NO: 169664 - RNA, 64 nt, Human; identical to SEQ ID NO: 33429

SEQ ID NO: 169665 - RNA, 64 nt, Human; identical to SEQ ID NO: 33430

SEQ ID NO: 169666 - RNA, 64 nt, Human; identical to SEQ ID NO: 33431

SEQ ID NO: 169667 - RNA, 64 nt, Human; identical to SEQ ID NO: 33432

SEQ ID NO: 169668 - RNA, 64 nt, Human; identical to SEQ ID NO: 33433

SEQ ID NO: 169669 - RNA, 64 nt, Human; identical to SEQ ID NO: 33434

SEQ ID NO: 169670 - RNA, 54 nt, Human; identical to SEQ ID NO: 33435

SEQ ID NO: 169671 - RNA, 64 nt, Human; identical to SEQ ID NO: 33436

SEQ ID NO: 169672 - RNA, 64 nt, Human; identical to SEQ ID NO: 33437

SEQ ID NO: 169673 - RNA, 64 nt, Human; identical to SEQ ID NO: 33438

SEQ ID NO: 169674 - RNA, 64 nt, Human; identical to SEQ ID NO: 33439

SEQ ID NO: 169675 - RNA, 64 nt, Human; identical to SEQ ID NO: 33440

SEQ ID NO: 169676 - RNA, 64 nt, Human; identical to SEQ ID NO: 33441

SEQ ID NO: 169677 - RNA, 64 nt, Human; identical to SEQ ID NO: 33442

SEQ ID NO: 169678 - RNA, 64 nt, Human; identical to SEQ ID NO: 33443

SEQ ID NO: 169679 - RNA, 64 nt, Human; identical to SEQ ID NO: 33444

SEQ ID NO: 169680 - RNA, 64 nt, Human; identical to SEQ ID NO: 33445

SEQ ID NO: 169681 - RNA, 64 nt, Human; identical to SEQ ID NO: 33446

SEQ ID NO: 169682 - RNA, 64 nt, Human; identical to SEQ ID NO: 33447

SEQ ID NO: 169683 - RNA, 64 nt, Human; identical to SEQ ID NO: 33448

SEQ ID NO: 169684 - RNA, 64 nt, Human; identical to SEQ ID NO: 33449

SEQ ID NO: 169685 - RNA, 64 nt, Human; identical to SEQ ID NO: 33450

SEQ ID NO: 169686 - RNA, 64 nt, Human; identical to SEQ ID NO: 33451

SEQ ID NO: 169687 - RNA, 64 nt, Human; identical to SEQ ID NO: 33452

SEQ ID NO: 169688 - RNA, 64 nt, Human; identical to SEQ ID NO: 33453

SEQ ID NO: 169689 - RNA, 64 nt, Human; identical to SEQ ID NO: 33454

SEQ ID NO: 169690 - RNA, 64 nt, Human; identical to SEQ ID NO: 33455

SEQ ID NO: 169691 - RNA, 64 nt, Human; identical to SEQ ID NO: 33456

SEQ ID NO: 169692 - RNA, 59 nt, Human; identical to SEQ ID NO: 33457

SEQ ID NO: 169693 - RNA, 64 nt, Human; identical to SEQ ID NO: 33458

SEQ ID NO: 169694 - RNA, 64 nt, Human; identical to SEQ ID NO: 33459

SEQ ID NO: 169695 - RNA, 64 nt, Human; identical to SEQ ID NO: 33460

SEQ ID NO: 169696 - RNA, 64 nt, Human; identical to SEQ ID NO: 33461

SEQ ID NO: 169697 - RNA, 64 nt, Human; identical to SEQ ID NO: 33462

SEQ ID NO: 169698 - RNA, 64 nt, Human; identical to SEQ ID NO: 33463

SEQ ID NO: 169699 - RNA, 64 nt, Human; identical to SEQ ID NO: 33464

SEQ ID NO: 169700 - RNA, 64 nt, Human; identical to SEQ ID NO: 33465

SEQ ID NO: 169701 - RNA, 64 nt, Human; identical to SEQ ID NO: 33466

SEQ ID NO: 169702 - RNA, 64 nt, Human; identical to SEQ ID NO: 33467

SEQ ID NO: 169703 - RNA, 64 nt, Human; identical to SEQ ID NO: 33468

SEQ ID NO: 169704 - RNA, 64 nt, Human; identical to SEQ ID NO: 33469

SEQ ID NO: 169705 - RNA, 61 nt, Human; identical to SEQ ID NO: 33470

SEQ ID NO: 169706 - RNA, 64 nt, Human; identical to SEQ ID NO: 33471

SEQ ID NO: 169707 - RNA, 64 nt, Human; identical to SEQ ID NO: 33472

SEQ ID NO: 169708 - RNA, 64 nt, Human; identical to SEQ ID NO: 33473

SEQ ID NO: 169709 - RNA, 64 nt, Human; identical to SEQ ID NO: 33474

SEQ ID NO: 169710 - RNA, 64 nt, Human; identical to SEQ ID NO: 33475

SEQ ID NO: 169711 - RNA, 64 nt, Human; identical to SEQ ID NO: 33476

SEQ ID NO: 169712 - RNA, 64 nt, Human; identical to SEQ ID NO: 33477

SEQ ID NO: 169713 - RNA, 64 nt, Human; identical to SEQ ID NO: 33478

SEQ ID NO: 169714 - RNA, 64 nt, Human; identical to SEQ ID NO: 33479

SEQ ID NO: 169715 - RNA, 64 nt, Human; identical to SEQ ID NO: 33480

SEQ ID NO: 169716 - RNA, 64 nt, Human; identical to SEQ ID NO: 33481

SEQ ID NO: 169717 - RNA, 64 nt, Human; identical to SEQ ID NO: 33482

SEQ ID NO: 169718 - RNA, 64 nt, Human; identical to SEQ ID NO: 33483

SEQ ID NO: 169719 - RNA, 64 nt, Human; identical to SEQ ID NO: 33484

SEQ ID NO: 169720 - RNA, 64 nt, Human; identical to SEQ ID NO: 33485

SEQ ID NO: 169721 - RNA, 64 nt, Human; identical to SEQ ID NO: 33486

SEQ ID NO: 169722 - RNA, 64 nt, Human; identical to SEQ ID NO: 33487

SEQ ID NO: 169723 - RNA, 64 nt, Human; identical to SEQ ID NO: 33488

SEQ ID NO: 169724 - RNA, 64 nt, Human; identical to SEQ ID NO: 33489

SEQ ID NO: 169725 - RNA, 64 nt, Human; identical to SEQ ID NO: 33490

SEQ ID NO: 169726 - RNA, 64 nt, Human; identical to SEQ ID NO: 33491

SEQ ID NO: 169727 - RNA, 64 nt, Human; identical to SEQ ID NO: 33492

SEQ ID NO: 169728 - RNA, 64 nt, Human; identical to SEQ ID NO: 33493

SEQ ID NO: 169729 - RNA, 64 nt, Human; identical to SEQ ID NO: 33494

SEQ ID NO: 169730 - RNA, 64 nt, Human; identical to SEQ ID NO: 33495

SEQ ID NO: 169731 - RNA, 64 nt, Human; identical to SEQ ID NO: 33496

SEQ ID NO: 169732 - RNA, 64 nt, Human; identical to SEQ ID NO: 33497

SEQ ID NO: 169733 - RNA, 64 nt, Human; identical to SEQ ID NO: 33498

SEQ ID NO: 169734 - RNA, 64 nt, Human; identical to SEQ ID NO: 33499

SEQ ID NO: 169735 - RNA, 64 nt, Human; identical to SEQ ID NO: 33500

SEQ ID NO: 169736 - RNA, 64 nt, Human; identical to SEQ ID NO: 33501

SEQ ID NO: 169737 - RNA, 64 nt, Human; identical to SEQ ID NO: 33502

SEQ ID NO: 169738 - RNA, 64 nt, Human; identical to SEQ ID NO: 33503

SEQ ID NO: 169739 - RNA, 64 nt, Human; identical to SEQ ID NO: 33504

SEQ ID NO: 169740 - RNA, 64 nt, Human; identical to SEQ ID NO: 33505

SEQ ID NO: 169741 - RNA, 64 nt, Human; identical to SEQ ID NO: 33506

SEQ ID NO: 169742 - RNA, 64 nt, Human; identical to SEQ ID NO: 33507

SEQ ID NO: 169743 - RNA, 64 nt, Human; identical to SEQ ID NO: 33508

SEQ ID NO: 169744 - RNA, 64 nt, Human; identical to SEQ ID NO: 33509

SEQ ID NO: 169745 - RNA, 64 nt, Human; identical to SEQ ID NO: 33510

SEQ ID NO: 169746 - RNA, 64 nt, Human
uggaggcagaaccggagucggguuuggggaaguugucaaggaaugagggaaaguaaauccucau

SEQ ID NO: 169747 - RNA, 64 nt, Human
aggaaggacuucaaacuucugcugagaccuuggggucaaggaacauuucauugguuuuuuuugu

SEQ ID NO: 169748 - RNA, 64 nt, Human
gaaauggacucuacuccuguuggcuaucaguacggucaaggaucugaugucacauccaaaagcu

SEQ ID NO: 169749 - RNA, 64 nt, Human
gugaaugucccuaaguguuuacuguuuuuauccagucaaggauuugcuuuuccuugaacauuug

SEQ ID NO: 169750 - RNA, 64 nt, Human
uuaaaggcaaagggaaggguaaagucggaccagugucaaggaaaguuuguuuuauugaggugga

SEQ ID NO: 169751 - RNA, 64 nt, Human
uuguauugagccaaauuaggaaacagacaguaacgucaaggaaguagauacuggcuggcauugu

SEQ ID NO: 169752 - RNA, 64 nt, Human
auuuuaggacugguucuguguagauagagauggugucaaggaggugcaggauggagaugggaga

SEQ ID NO: 169753 - RNA, 64 nt, Human
gauuugauuucauccaauauuccuucgaaagagugucaaggaauaggguggggcaaugugucau

SEQ ID NO: 169754 - RNA, 64 nt, Human
cugccuaguaggcugaagcuucaggacucugcaggucaaggauaugugaugagcaccggccuaa

SEQ ID NO: 169755 - RNA, 64 nt, Human
cagccuuccaugcugugcagcacuucuguccucagucaaggagauggccaugcuuaagccagca

SEQ ID NO: 169756 - RNA, 64 nt, Human
aggggggaguaugagcagagugccugaguuuagggucaaggacaaaaaaccucaggccuggagg

SEQ ID NO: 169757 - RNA, 64 nt, Human
acauaauuagugauuuuuaacuugcgugucugcagucaaggauucuucauuuuuagaaaugccu

SEQ ID NO: 169758 - RNA, 64 nt, Human
ggucacccaaaauggagauggcaucaaacuaguggucaaggacuaacuccuaaaaaaaaaaagc

SEQ ID NO: 169759 - RNA, 64 nt, Human
gggaagagguggacaucugcaucuuccauugguggucaaggaugggugugggagaaccacaccu

SEQ ID NO: 169760 - RNA, 64 nt, Human
ggaaggaaaggugacugugugaucugauucuguggucaaggacuugcaucuuguguuucuaucc

SEQ ID NO: 169761 - RNA, 64 nt, Human
uuuagaaauguggguaaugaauucuaucuaauaagucaaggaaaccagaauuugacacacucca

SEQ ID NO: 169762 - RNA, 64 nt, Human
uacacuugauuuauauuauauguggcuuugcugagucaaggaaguaucaugcaauaaggcuuaa

SEQ ID NO: 169763 - RNA, 64 nt, Human
uaauguauaauuugaggugaaauucaguuauaaagucaaggacgaauuugcacagugauauauu

SEQ ID NO: 169764 - RNA, 64 nt, Human
uguccccuuaauuguauugucagaguauuacuaugucaaggaugacuguucuguuaaccuaauu

SEQ ID NO: 169765 - RNA, 64 nt, Human
cacauauuaaaugucuauguucuuguugcuaugagucaaggaguguaaccuucuccuuuacuau

SEQ ID NO: 169766 - RNA, 64 nt, Human
agauuggcaugccauugaaacuaagagcucucaagucaaggaagcugggcugggcaguaucccc

SEQ ID NO: 169767 - RNA, 64 nt, Human
cacaucuccuugauggccuuagaucucuugacuagucaaggacugggaacgugccagggggaac

SEQ ID NO: 169768 - RNA, 64 nt, Human
guuucauuugauaugugaaugcucauaaaaaaaugucaaggaaugaagaacaacaacucucagu

SEQ ID NO: 169769 - RNA, 64 nt, Human
gggauuaauauggggaugcagcauuaugaugugggucaaggaauuaaguuagggaauggcacag

SEQ ID NO: 169770 - RNA, 64 nt, Human
gaaggagaagaaaaaggaaaagggcaaauugaaagucaaggagaaaaagcgcaaagaggagaau

SEQ ID NO: 169771 - RNA, 64 nt, Human
gcccugguacucugccaccuguguugcugauggugucaaggaaggaggacuuggccuaggguug

SEQ ID NO: 169772 - RNA, 64 nt, Human
caccgcuuuccaauuugcccuucagagaacuuaagucaaggagaguugaaauucacaggccagg

SEQ ID NO: 169773 - RNA, 64 nt, Human
auguuggcaugaaauuaauuuuucccuccuuauagucaaggaccguagaggaagaaaaacuuuu

SEQ ID NO: 169774 - RNA, 64 nt, Human
aaaucaugauuucuuuucuaauguuaucaccugagucaaggaaacauguuacgccuucuuguug

SEQ ID NO: 169775 - RNA, 64 nt, Human
aauacagugauagaaguucagaaagcucaccaaggucaaggagcagaucuucuaggaguagauc

SEQ ID NO: 169776 - RNA, 64 nt, Human
caagaaagguaggaguuacuauucacauccuagagucaaggaaaaagagaagauguuugacuug

SEQ ID NO: 169777 - RNA, 64 nt, Human
uuucacgcaugguacucuugauguuuuucacucugucaaggauuuuguuggcuaucaaugaaug

SEQ ID NO: 169778 - RNA, 64 nt, Human
gacucgaacagccuccccaccaccaccagcauaugucaaggagcacuugcaggcagaaugggag

SEQ ID NO: 169779 - RNA, 64 nt, Human
auguuuuuuuaaagccuuuuuuccuccuuucggagucaaggaaagccuuucuauaagcaaauua

SEQ ID NO: 169780 - RNA, 64 nt, Human
aaagaaagaaagaaagaaagaaagaaaucuaccugucaaggaacuaagguauuuugcuaacaag

SEQ ID NO: 169781 - RNA, 64 nt, Human
gauaaaaacaauauauguaaauuauaaguaacuugucaaggaauguuaucaguauuaagcuaau

SEQ ID NO: 169782 - RNA, 64 nt, Human
acugcagcccucuccacccuccggccagcgaguggucaaggauuuuuauaaaaaucacgauaag

SEQ ID NO: 169783 - RNA, 64 nt, Human
gaccaauggccagacacaugccugcaacuuguaggucaaggacuguccaggcagggguuuugug

SEQ ID NO: 169784 - RNA, 64 nt, Human
uaguaaaauucuaggcaaguguguggucauguuugucaaggaauacuuuaaguuaugcccagaa

SEQ ID NO: 169785 - RNA, 64 nt, Human
gugguccuuuccugggauuuuuaaaagguccuuugucaaggaaaaaaauucuguugugauauaa

SEQ ID NO: 169786 - RNA, 64 nt, Human
guaagacgaaugauuuagguacgucaaagcaguagucaaggaggaaagggauaguccaaagacu

SEQ ID NO: 169787 - RNA, 64 nt, Human
uaacagaaaaguccacauaacccuagaauucuuagucaaggaauaauucaagucagccuagaga

SEQ ID NO: 169788 - RNA, 64 nt, Human
cugugaauucuaaccucuaaaggcaugcuuagaggucaaggaccuuccuguguaguuggugcaa

SEQ ID NO: 169789 - RNA, 64 nt, Human
uugaaagcuauuaaaaaucuauggcagaaaaauggucaaggaauaggaacuacaacuucauaaa

SEQ ID NO: 169790 - RNA, 64 nt, Human
auucaauucaguuauuauauucauuuagcauuaagucaaggagacugagaaugacucaagggac

SEQ ID NO: 169791 - RNA, 64 nt, Human
uuuuauuugauucaugcauaacuccugauggagugucaaggaagacucauucacuuuucuuucc

SEQ ID NO: 169792 - RNA, 64 nt, Human
caaacauaggugaaaaaaacacugccauucacaagucaaggaacccagggccagcuggaagugu

SEQ ID NO: 169793 - RNA, 64 nt, Human
ccuacaacccaggcccuaaguugaugaagaaaaagucaaggaaggaggugauacaauuggaaau

SEQ ID NO: 169794 - RNA, 64 nt, Human
aggcagauauuguaaacuacaaccaggaaccuaugucaaggacuguuaacccuccuagaagcuc

SEQ ID NO: 169795 - RNA, 64 nt, Human
gauuuuugaauugagaauuucaugggaauauucagucaaggagcagacuuuggucugaacuagc

SEQ ID NO: 169796 - RNA, 64 nt, Human
uuuaguaccuguuuaaccauuagaaauauuucaugucaaggaggaaaacauuagggaaaacaaa

SEQ ID NO: 169797 - RNA, 64 nt, Human
caagagcuucuuagaguaguauauuuugggggcagucaaggaauaaacuacaguguaaacauau

SEQ ID NO: 169798 - RNA, 64 nt, Human
ucagacugguguaaaggacaaauaugacaacgacgucaaggacucgcauccgucgcuuucugca

SEQ ID NO: 169799 - RNA, 64 nt, Human
agucauacugccacuuaaaaaaaaaaagaccuuugucaaggagagugcagucaaccaguaaauu

SEQ ID NO: 169800 - RNA, 64 nt, Human
cauacugucacuuaaaaaaaaaaaaaagaccuuugucaaggagagugcagucaaccaguaaacu

SEQ ID NO: 169801 - RNA, 64 nt, Human
gcuaaaagaagcagaagcaaguuucgaagucacagucaaggaaaucaauaccuaccaauuuaac

SEQ ID NO: 169802 - RNA, 64 nt, Human
aaauggauugguaagaugucuugaaaacauguuagucaaggacugguaaaauacauauaaagau

SEQ ID NO: 169803 - RNA, 64 nt, Human
ugucuuucugggucuagggcucgggguaguuugggucaaggacugucccuccagcagucgccuc

SEQ ID NO: 169804 - RNA, 64 nt, Human
gguaauguauaauuugguauugcacaggugauuagucaaggaagucuggaaaagcuuugguccc

SEQ ID NO: 169805 - RNA, 64 nt, Human
uuuccauaucauauuucauuaaugaucaguuagugucaaggagucaaaacagauuaaaauuaau

SEQ ID NO: 169806 - RNA, 64 nt, Human
ccuagcacagccagucugcagaagcauuugaaaagucaaggacuaauuuuaaagaggaaaaaua

SEQ ID NO: 169807 - RNA, 64 nt, Human
guggagcuacuaggaugucuuccagccuccugcagucaaggaguaccacuguauugauuagccu

SEQ ID NO: 169808 - RNA, 64 nt, Human
ggugggcaaagggaaguaacagacacacgauguugucaaggaugguuuugggacuagaggcuca

SEQ ID NO: 169809 - RNA, 64 nt, Human
gaaagcauaguguuuuccauuguuggugaaaaaugucaaggaggaaagaacaauaaugauucca

SEQ ID NO: 169810 - RNA, 64 nt, Human
gccugaggaaccggcggugagcgagcuagagucggucaaggagaauaacugugcuuccaacugc

SEQ ID NO: 169811 - RNA, 64 nt, Human
uaaaauacaaauguuggccccagauucuuuuaacgucaaggaaaugaauaacagcuugucagag

SEQ ID NO: 169812 - RNA, 64 nt, Human
ccuaaguucacuuagcuuauuagcaggaguagaagucaaggauucugguucuuauucuaggacu

SEQ ID NO: 169813 - RNA, 64 nt, Human
guaugucuccuggccucuuaugaugagauuucuggucaaggagcgagcucucaggauacgaaga

SEQ ID NO: 169814 - RNA, 64 nt, Human
gacugguggagucggagggaggaagugaggaagggucaaggauggaagaguucuuucacuuacc

SEQ ID NO: 169815 - RNA, 64 nt, Human
acuguugugcauggugcuuuuuaacuuucaucgagucaaggauguucacugucuguuaucugaa

SEQ ID NO: 169816 - RNA, 64 nt, Human
cagacccagguguaagguacauggaugugcuuuggucaaggaauaggccaaggcagagauccau

SEQ ID NO: 169817 - RNA, 64 nt, Human
aggaauaaaaccuugucuuccauuacaauuaacagucaaggauaaaacaagcacgcgcacaauc

SEQ ID NO: 169818 - RNA, 64 nt, Human
ucucagccacaagggccccgcaggauggagcugggucaaggaccagggagcccugacucccaga

SEQ ID NO: 169819 - RNA, 57 nt, Human
agaagauucuugaauguugaauucauagucaaggaaaguuagguaauucugaggaaa

SEQ ID NO: 169820 - RNA, 64 nt, Human
auuugacuccuccaagguuuuguggaaaguuaaugucaaggaaaggaugcaccacgggcuuuua

SEQ ID NO: 169821 - RNA, 64 nt, Human
acuucacugggagccuucuggaauccugcagagggucaaggagcagggauguuggaugcccacc

SEQ ID NO: 169822 - RNA, 64 nt, Human
uccucaugguaauauguguucucaaguuuucagugucaaggaaugccaucccagaagcucauuc

SEQ ID NO: 169823 - RNA, 64 nt, Human
aacguauuguuguauauuuccauuuuugaauagggucaaggagcccaagcaaaucauuucuacu

SEQ ID NO: 169824 - RNA, 64 nt, Human
ucuguguccacucuccaaacagcauucuagagcagucaaggagacagcuaaucucucuagggac

SEQ ID NO: 169825 - RNA, 64 nt, Human
aggguugccaacccauuuguaugacuucaacaacgucaaggagggcauuuagaauuuagaaucu

SEQ ID NO: 169826 - RNA, 64 nt, Human
uuuuaacuugcuauucacaaucaggacaaccaaagucaaggacccagaugaaccacaaggcagc

SEQ ID NO: 169827 - RNA, 64 nt, Human
ccccaugggaacccugaccaggucccucuuuucugucaaggacuuucugggaauaauacugggg

SEQ ID NO: 169828 - RNA, 64 nt, Human
aaaagaaagaaagaugggaagaaaaugaaugucagucaaggaaaggccacuuaaggaucugcuc

SEQ ID NO: 169829 - RNA, 64 nt, Human
agaaugaaaaugcaaaucaggaaaccacauuaaagucaaggaaauaaaauaauuugaccagagg

SEQ ID NO: 169830 - RNA, 64 nt, Human
agagccuuugcgcaucugccccuugcacaucagugucaaggaagaacuggauggcugagcuggc

SEQ ID NO: 169831 - RNA, 64 nt, Human
agcuuauguccaagguaaguauuuuagcauggcugucaaggaaauucagaguaaagucagugug

SEQ ID NO: 169832 - RNA, 64 nt, Human
cguuucugugacuucacuuucaccugcuccaggggucaaggacuugccuugccugauaaccagc

SEQ ID NO: 169833 - RNA, 64 nt, Human
aaccugcuccuuggaccucugaaggaauagaacggucaaggagauuaugucuacguuuacaggu

SEQ ID NO: 169834 - RNA, 64 nt, Human
guuggagcccugaccuagguccuuggucuaagaagucaaggauguaagucuauuaggacugagu

SEQ ID NO: 169835 - RNA, 64 nt, Human
augccaaaguccagugauuaagcauauauaaguugucaaggaaacaaagcccaaauguuuuuaa

SEQ ID NO: 169836 - RNA, 64 nt, Human
cagagucuuccaggugggcauuucaaccaacucagucaaggaacccaugacaaagaaagucauu

SEQ ID NO: 169837 - RNA, 64 nt, Human
uggguccuguguguucaaaaccauagagcacaaggucaaggaagcuagagucugaaaaacgaac

SEQ ID NO: 169838 - RNA, 64 nt, Human
gccuuggugcugcuuccccgagugcugccuccuggucaaggagaagugcagagaguaagguguc

SEQ ID NO: 169839 - RNA, 64 nt, Human
ucagagggcacaaaccuuauuaggaggcuagagagucaaggagaaccucaaauaugaucagaga

SEQ ID NO: 169840 - RNA, 64 nt, Human
gguauuuaaaaauuaacucauuaguaucauaaacgucaaggauugauuggaccaggcaagagcc

SEQ ID NO: 169841 - RNA, 64 nt, Human
cagaucccuaccugccuggcuaagacccguggccgucaaggacugguucgggguggauucaaca

SEQ ID NO: 169842 - RNA, 60 nt, Human
uuuuacaguacaaauggugaugaucaucaggucaaggauagucuggagcaauugagaugu

SEQ ID NO: 169843 - RNA, 64 nt, Human
ggcucccugggggaugacacucaguucugucacugucaaggaugcagagagcuggugguaggug

SEQ ID NO: 169844 - RNA, 64 nt, Human
agagggcuguucucacaaccucagcccacucucagucaaggagggcagaaaauaaaagaugaca

SEQ ID NO: 169845 - RNA, 64 nt, Human
guuaauauaaauguguacauaauccacauuuguagucaaggacgcaaucucuuccacacaugug

SEQ ID NO: 169846 - RNA, 63 nt, Human
aaaagaagagccacucguaacagcgaacggucagucaaggaucauaaguuuuuacugccagua

SEQ ID NO: 169847 - RNA, 64 nt, Human
aauaucaaacaucagcuaaccgaaagagcuuucugucaaggaccguaucaggguaaugugcuug

SEQ ID NO: 169848 - RNA, 64 nt, Human
gaugucuucuuggaugguucugcuuagaaugagugucaaggaggaaagagagggagauggagga

SEQ ID NO: 169849 - RNA, 59 nt, Human
ccagacugagccuggaaugaugcagcucagucaaggagcagcagaccuggcacuggaac

SEQ ID NO: 169850 - RNA, 64 nt, Human
uuacugugugcuucucauccccugguugugguaggucaaggaaaagagccccuuugauccacca

SEQ ID NO: 169851 - RNA, 64 nt, Human
ggccauuuccaagaggcuguagaaaggggagaaugucaaggaagacuuuugguagagaaggagc

SEQ ID NO: 169852 - RNA, 64 nt, Human
agaaacuugcuguacuuuuucuuuucuuuuaggggucaaggacccucuuuauagcuaccauuug

SEQ ID NO: 169853 - RNA, 64 nt, Human
caccguggcgcguggcgcuggagcgggcguuguggucaaggaugcagcugccccuucucagccu

SEQ ID NO: 169854 - RNA, 64 nt, Human
aaagguuacacaaaauuacugucacguggauuuugucaaggagaaucauaaaagcaggagacca

SEQ ID NO: 169855 - RNA, 64 nt, Human
gccuccacuuaguuuugggaggggauggcagacagucaaggagaugagcguccuaaggcauguu

SEQ ID NO: 169856 - RNA, 64 nt, Human
cucagugccaggcaaaacacuagcucaaaggagagucaaggaaaccgcuggcagacgauaacca

SEQ ID NO: 169857 - RNA, 64 nt, Human
cagucccagaagacaagucucaccaacccagggagucaaggaccagcaaaccaaaguggauaau

SEQ ID NO: 169858 - RNA, 64 nt, Human
aaauaaaaggggagaagaacaaacuagcugucaagucaaggacuggcuuucaccuugcccuggu

SEQ ID NO: 169859 - RNA, 64 nt, Human
agaaagggagauuagaucaguuuucucuuaauaugucaaggaagguagccgggcauggugccag

SEQ ID NO: 169860 - RNA, 64 nt, Human
gcaggaacuugcacaaaaucacacagccaagccagucaaggauggaugcagauccagagguuuc

SEQ ID NO: 169861 - RNA, 64 nt, Human
cuccccucccccuuuguuugccccugugugguuggucaaggagggaugugagggaaauagggac

SEQ ID NO: 169862 - RNA, 64 nt, Human
cuucacacagaccuuuugccuuuuuuagcugcaagucaaggacuagguugaugaugcccaugac

SEQ ID NO: 169863 - RNA, 64 nt, Human
auuguuaaggagguuuuuuguuuuuaaauggugggucaaggagcuaguuuacaggcuuacugug

SEQ ID NO: 169864 - RNA, 64 nt, Human
gggcgaguggcacguuuauuuaacuuuuaguaaagucaaggagaaaugcgguggaaacuucuug

SEQ ID NO: 169865 - RNA, 64 nt, Human
aggaguaacagggccaaaguuauuucuguuagacgucaaggaaugguaucacagucuauugacc

SEQ ID NO: 169866 - RNA, 64 nt, Human
agacuuucauugauuucacuuccaaaucucgguggucaaggaagcuuuauucuuuuuugcagga

SEQ ID NO: 169867 - RNA, 63 nt, Human
cugaaaaaaacauaggcugaaauggggaacgcugucaaggacauuaucaggauaucugcaaag

SEQ ID NO: 169868 - RNA, 64 nt, Human
caggcaccugcagaagaggaaaaucacuguuuuugucaaggaugguuguguauguguuuaaaau

SEQ ID NO: 169869 - RNA, 64 nt, Human
aauagaagauguugccuuuauggcccuagagaaagucaaggaacauggggaccaacaaagcauu

SEQ ID NO: 169870 - RNA, 64 nt, Human
ugggcagaggggaggagaauuccaggacaagagugucaaggacagggauuuagcauauggaagu

SEQ ID NO: 169871 - RNA, 64 nt, Human
aagguuguuugaauuucaauaaucagggguuugggucaaggaagaaaaaucaugggacuugcca

SEQ ID NO: 169872 - RNA, 64 nt, Human
aaaaugcuuggguacacuucucuuaaguggucuagucaaggaaccucaagucaugcuuuugcua

SEQ ID NO: 169873 - RNA, 64 nt, Human
aacauugugauuauugaaguucaugaaucuugcugucaaggaagaaagguaagaaagcugauag

SEQ ID NO: 169874 - RNA, 64 nt, Human
aaagcauugaauguucugaucagaugugacuaaggucaaggaaaaaaaauugaaauaucuuauu

SEQ ID NO: 169875 - RNA, 64 nt, Human
cucggugcagaaacuaccagauuugagggacgaggucaaggagauaugauaggcccggaaguug

SEQ ID NO: 169876 - RNA, 64 nt, Human
cuaaaauacuuuccuacagcuguguaaaauacuggucaaggagaacuuuuuccuuuuaccucau

SEQ ID NO: 169877 - RNA, 64 nt, Human
ucuuacugugauaaucauuggcaugccaccugaggucaaggagugccaaauaggacuuuccacu

SEQ ID NO: 169878 - RNA, 64 nt, Human
uagagaaaagcugccuugcaauuaggcuaaagaagucaaggaaauguugcuuucuguacucccu

SEQ ID NO: 169879 - RNA, 64 nt, Human
cccagagcuuuggccagagcagagaacagaaugugucaaggagaagaaucauuuguuuacaaac

SEQ ID NO: 169880 - RNA, 64 nt, Human
uuuugccaaacugaauggucucuuugacagcccugucaaggaauaccaacagaauauugauucu

SEQ ID NO: 169881 - RNA, 64 nt, Human
guuauuguacugucacuuuguucuugagguaguagucaaggaucaggaggggcagaugucuucu

SEQ ID NO: 169882 - RNA, 64 nt, Human
uggagaaaauuggaacucuacucaacccauuguugucaaggaagaagaaaucuuucucccucaa

SEQ ID NO: 169883 - RNA, 64 nt, Human
cagggagcuaaacaucaccaucaucuaagagcgggucaaggaauuaaaaaaaaacaacaaaacg

SEQ ID NO: 169884 - RNA, 64 nt, Human
uuaccagccugccugacuucugcaaaccuacccugucaaggagaucaaagggacgcagguuucu

SEQ ID NO: 169885 - RNA, 64 nt, Human
cccugcguuuugucuucaccauugucaaccagcagucaaggaugagcaccagguauaguccugg

SEQ ID NO: 169886 - RNA, 64 nt, Human
gagggaugggggcaggaaugagggaaggucuugggucaaggacauggaccuacauccccagcag

SEQ ID NO: 169887 - RNA, 64 nt, Human
acugcagagcccagagcccuucaucucucugagggucaaggauaccaggggucccaagucacag

SEQ ID NO: 169888 - RNA, 64 nt, Human
caggggucucucauguguguccaucugcguguaugucaaggaagugagaugccaauuugggguc

SEQ ID NO: 169889 - RNA, 64 nt, Human
cagugccacagaaggguacccgaagaaaugagaagucaaggacucucuuaaagggaccacauuu

SEQ ID NO: 169890 - RNA, 64 nt, Human
ugcccagaugucuacagagacccuuuuuguaaaugucaaggacauuuggauuuacuuuuacaga

SEQ ID NO: 169891 - RNA, 64 nt, Human
uugggguucuccaggcucaggugccaagugaguugucaaggaaccaaauggggauguaaaccua

SEQ ID NO: 169892 - RNA, 64 nt, Human
cuaacaaacaaacaaacagugaccuucuccaugggucaaggacuuccuuacaauuucuccugag

SEQ ID NO: 169893 - RNA, 64 nt, Human
caucuuauuuauaaagauaaaaucaccuggaagugucaaggaguggggcgggguggcgggggag

SEQ ID NO: 169894 - RNA, 64 nt, Human
ucuuccgagcuugucuuaucucaaaccccuuccagucaaggaacuagaaucagcaacgagaguu

SEQ ID NO: 169895 - RNA, 64 nt, Human
ccuucaggcugcaaaccgguuaaucaagaauuuggucaaggaggaacaagaaaaaucggagaag

SEQ ID NO: 169896 - RNA, 64 nt, Human
gaggggcuguucaccaccauccucguucuccagggucaaggaaguguuuuaacaugucguguuu

SEQ ID NO: 169897 - RNA, 64 nt, Human
agcugcugcuuuggcacuggcauggaggugagcagucaaggaugcuggugaggcugcaguuucu

SEQ ID NO: 169898 - RNA, 64 nt, Human
cuggccggccgcccacaucgggcucaccuuaaaggucaaggaaggaaaauacuaccuguccccu

SEQ ID NO: 169899 - RNA, 64 nt, Human
gaaggggacuagccagcucucugcauggcacauggucaaggaaacuguccuuggcucagacaga

SEQ ID NO: 169900 - RNA, 64 nt, Human
agauuuggaaucuaacaucguggcuguggagagggucaaggaguacuccaagacagagacagag

SEQ ID NO: 169901 - RNA, 64 nt, Human
uacuuuguuuuaauuaaacugcuaguauuucuuugucaaggauguuucuaguuuuuugcuuuau

SEQ ID NO: 169902 - RNA, 64 nt, Human
cagcaccuuucucugagaagagguccuugguugggucaaggacagggcugagcguggaaggggg

SEQ ID NO: 169903 - RNA, 64 nt, Human
uccuggacuucggagauggccucucccaagccaggucaaggagguuugggggaggguugccccu

SEQ ID NO: 169904 - RNA, 64 nt, Human
cugagcaguguccaggggaggugcgcagugaacugucaaggacuuuccagacugucuucucuuc

SEQ ID NO: 169905 - RNA, 64 nt, Human
ucccgaaaccccaagaaaaaucagaaugaggagagucaaggacagcaacucagcugcugcaagc

SEQ ID NO: 169906 - RNA, 64 nt, Human
aucagcuggcacgggcuccuuccugagagcaaaggucaaggacccccucugugaaggcucagca

SEQ ID NO: 169907 - RNA, 64 nt, Human
guuauguugaacacagccagcacaguuucgacaugucaaggaagagcuguuucaguaaagaaug

SEQ ID NO: 169908 - RNA, 64 nt, Human
ucugcucaauuaaagauguuugaauccaaaggaagucaaggaagaaaaagcauggaaaggaaga

SEQ ID NO: 169909 - RNA, 64 nt, Human
gaaagguuuggaugacugaaauauuuccucuacagucaaggacuuuggcaugugguggcugaaa

SEQ ID NO: 169910 - RNA, 64 nt, Human
uguauuuccuuacuaguuuuuccagaaaggaggagucaaggaagcccuuagugaacgagaacuc

SEQ ID NO: 169911 - RNA, 64 nt, Human
cuuaauguggggccucaguuaaaucuccuguggagucaaggauucuucugauucuagugugugu

SEQ ID NO: 169912 - RNA, 64 nt, Human
aaguagacuucauuuuuccuaacaggauuagacagucaaggaguggcuuacuacaugugggagc

SEQ ID NO: 169913 - RNA, 64 nt, Human
cuccccauuccaagcgguccacccaacauggacagucaaggaagggcccugauuuucaagggcu

SEQ ID NO: 169914 - RNA, 64 nt, Human
gggguugcaggacuccacucacaagccuccugaugucaaggacaggcggacagggcuggccucc

SEQ ID NO: 169915 - RNA, 64 nt, Human
aaucaggauucuguggcuguagacugaucacagagucaaggaagcaguggcaauucuagauauc

SEQ ID NO: 169916 - RNA, 64 nt, Human
uuaguaguaucaaagauggaaaacaagaaauacugucaaggauguggaauguuggagaacauug

SEQ ID NO: 169917 - RNA, 64 nt, Human
gagccggagggcaccagggacucggcccagggccgucaaggaaagggcaguggacgugcugcgc

SEQ ID NO: 169918 - RNA, 64 nt, Human
gaggccugcacugauuggggccuggggcaggggggucaaggagaggguuuuggccgcucccucc

SEQ ID NO: 169919 - RNA, 64 nt, Human
ggguucagguccgcccauuacuccuugucgugcggucaaggauacaccuuggccccgauuccgg

SEQ ID NO: 169920 - RNA, 64 nt, Human
cuccauuccacucaucucuggccugagugacagugucaaggaacccugcuccucucuguccugc

SEQ ID NO: 169921 - RNA, 64 nt, Human
uccggaggaccacaucuuucaagacuucugaugggucaaggaaaaagaugccaacauacccgua

SEQ ID NO: 169922 - RNA, 64 nt, Human
ugcuaccauacuuacuucaaacccaaugacuacugucaaggacauauuuucaguacauaaauac

SEQ ID NO: 169923 - RNA, 64 nt, Human
ggcugaagugggaggaucaccugagcccagggaggucaaggaugcagugagccauggucucacc

SEQ ID NO: 169924 - RNA, 64 nt, Human
ccagacaguugacaagcaucgcagccccugucaggucaaggaauuuuaaccugggagacuccug

SEQ ID NO: 169925 - RNA, 64 nt, Human
acaguccucucuguucauagaaacaccugccagugucaaggauuccagucaggugucuauccca

SEQ ID NO: 169926 - RNA, 64 nt, Human
uggggccagccacacuacucucuaggccucaggggucaaggagcucagaggagggcccugaggu

SEQ ID NO: 169927 - RNA, 64 nt, Human
cggcacccagcagaauuccagucuugagaaacaggucaaggacagcuucaaaagagauucuaaa

SEQ ID NO: 169928 - RNA, 64 nt, Human
uuauauuacaaaccuaaguguuuuauauccuagagucaaggaacaaauuuccuuaggauuauag

SEQ ID NO: 169929 - RNA, 64 nt, Human
cucgcccaucugagugucaagcggggauuucgcugucaaggaaccguuucuauacauuuuuacc

SEQ ID NO: 169930 - RNA, 64 nt, Human
uaaaccuaggcuggucuacacgcagugcugguacgucaaggagccuaaacacccugaaauugug

SEQ ID NO: 169931 - RNA, 64 nt, Human
ccugaccaaggugcccagcagccugucuucaccagucaaggaauccgccaucuuggcuguagac

SEQ ID NO: 169932 - RNA, 64 nt, Human
ggccgacugggacuuuucaacauuggauucaauggucaaggagaauauuucugaguugcugaag

SEQ ID NO: 169933 - RNA, 64 nt, Human
ugcuuagcuuauucuaucaaucacggaagaggcagucaaggaggaaggagagacauuaggagcc

SEQ ID NO: 169934 - RNA, 64 nt, Human
agucuagagcccccuuuggccccuuucccugacugucaaggacaacugacucccccaucagcuc

SEQ ID NO: 169935 - RNA, 64 nt, Human
ugacugcgauucugaagaaccgcugccuugcaaggucaaggacauucagugguugcuggggucc

SEQ ID NO: 169936 - RNA, 64 nt, Human
agaccacuauuuuuugugucuggcagaugaguaugucaaggauugagaugaacacauaagucuu

SEQ ID NO: 169937 - RNA, 64 nt, Human
uggcaugcauuagcucacuuucauuuaauccauugucaaggaugacaugcuuucuucacaguaa

SEQ ID NO: 169938 - RNA, 64 nt, Human
auuccaucacaaccaagucagacuuguauuauaagucaaggaugagccugaucuggggagaggg

SEQ ID NO: 169939 - RNA, 64 nt, Human
uacuuuugaucuauaauaagagcucaauaacuuugucaaggaaagcucuaauauaugcagugau

SEQ ID NO: 169940 - RNA, 64 nt, Human
ucucuccugaguacccacuaccacaaugucuucugucaaggaauuacaaguagcaagggaaggu

SEQ ID NO: 169941 - RNA, 50 nt, Human
uucugcuccucaaguauuaagucaaggagccggucacaaaggcagaaaug

SEQ ID NO: 169942 - RNA, 64 nt, Human
guaaacuaagagccaugaaaaucacuuggccagggucaaggacucgugacuccuagcucuuuuc

SEQ ID NO: 169943 - RNA, 64 nt, Human
ugaugcuccuucaaaaacauucacuuuuuacaacgucaaggaauuaagcauaaaaaagauuggu

SEQ ID NO: 169944 - RNA, 64 nt, Human
gcugaugccaguuuaaaauucccagguuacgucugaggaucaguugguguaaagcugagauguu

SEQ ID NO: 169945 - RNA, 64 nt, Human
cagugacgugcaccuguacucaggaggcugaggggaggaucacuggagcccaggaguuugaggc

SEQ ID NO: 169946 - RNA, 64 nt, Human
cuuguaaucccaacacuuuggaaggcugaggcgggaggaucaguauaucgguacgucugagccc

SEQ ID NO: 169947 - RNA, 64 nt, Human
cagaaccaccuggcuagacccuaggaagccaggagaggaucagguuccaaaggggaaugcuaug

SEQ ID NO: 169948 - RNA, 64 nt, Human
ccuguaaucccaacacuuugggaggcugaggcgggaggaucacuugagcccaggaguucaagac

SEQ ID NO: 169949 - RNA, 64 nt, Human
ccuguggucccagcuacucaggaggcugaggcaggaggaucacuugagcacaggaguuugaggc

SEQ ID NO: 169950 - RNA, 64 nt, Human
gggccaauaaccagacugcugagguugcccacaggaggaucacaaacucacagcacagugugug

SEQ ID NO: 169951 - RNA, 64 nt, Human
augguggcccacgcacuucgggaggucgaggcaggaggaucacuugaguccagaaguuugagau

SEQ ID NO: 169952 - RNA, 64 nt, Human
ccuguggucccagcuauucaggaggcugaggugggaggaucauuugagcccagagguagaggcu

SEQ ID NO: 169953 - RNA, 64 nt, Human
aggcuggcgcccguaaucccagcuacuaaggcuggaggaucacuucagcccaggaguuuaaggc

SEQ ID NO: 169954 - RNA, 64 nt, Human
aggcugcggugauugcaauuaccauccgguguucgaggaucauuggugaagucagcagauauuu

SEQ ID NO: 169955 - RNA, 64 nt, Human
acuccaaucagugauaccagaccacauugacagggaggaucaaauuccugacuuacauuugcac

SEQ ID NO: 169956 - RNA, 64 nt, Human
uuugggaguggggagggaaaaaagcucagucagugaggaucauuuuaucacauuagacuggggc

SEQ ID NO: 169957 - RNA, 64 nt, Human
ucuguagucccagcuacuugggaagcugaagugggaggaucaccugagcucuggagguggaggc

SEQ ID NO: 169958 - RNA, 64 nt, Human
ccaacuguuacuugauucugcuuuuaguucuuaagaggaucaggcuuuuaaauacucauuuaca

SEQ ID NO: 169959 - RNA, 64 nt, Human
ccuauagucccagcuacucaggaagcugagacaagaggaucaauugagcccaggaguucaaagc

SEQ ID NO: 169960 - RNA, 64 nt, Human
acuguaaucccaguuauaggggaggcugaagcaggaggaucacuugaggccaggaguuugagac

SEQ ID NO: 169961 - RNA, 64 nt, Human
ugcauagucccagcuacccaggaggcugaggugggaggaucacuugagcccaggaauuugaagc

SEQ ID NO: 169962 - RNA, 64 nt, Human
gcuguaauaacaacaccuucagaggcugaggugagaggaucaguugaggccaggaguuuaagac

SEQ ID NO: 169963 - RNA, 63 nt, Human
cagaugaccuaucagugugacccuccuuuaugggaggaucaggaccaggugggaacaaaggag

SEQ ID NO: 169964 - RNA, 64 nt, Human
guuauuacggaaauggacaccaagaauaucuccugaggaucacuccaagaaaagagauccacau

SEQ ID NO: 169965 - RNA, 64 nt, Human
ccuguggucccugcuaugcagaugucuaagacaggaggaucacaagagcccaggagguugagaa

SEQ ID NO: 169966 - RNA, 64 nt, Human
aaggaaaaugagugcaggggccaggggaacccgugaggaucacucucaaaugagauuaaaaaca

SEQ ID NO: 169967 - RNA, 64 nt, Human
ugcuuucuagcagaggucaccugaagugugugaggaggaucaucauuuuccucauccccccucu

SEQ ID NO: 169968 - RNA, 64 nt, Human
ccuguagucccugcuacuugggaggcucaggugggaggaucacuugagccccaaagaugguggc

SEQ ID NO: 169969 - RNA, 64 nt, Human
ccuguaaucccagcacuuugggaggcugagaugggaggaucacuugaagccaggaguuuaaaac

SEQ ID NO: 169970 - RNA, 64 nt, Human
gcauucucucacugauugcuacauacacuucucugaggaucaccugcugucaaauugccaucua

SEQ ID NO: 169971 - RNA, 64 nt, Human
gaaaguaguuauauuuuuaaaugcuauuauugcagaggaucaucaaaaaagagguaaucuacgu

SEQ ID NO: 169972 - RNA, 64 nt, Human
ccuguggucccagcugcucgggaggcugaggugggaggaucacuugagccuuggaggucaaggc

SEQ ID NO: 169973 - RNA, 64 nt, Human
ccuguaaccucagcacuuugggaggcagaggugggaggaucacuuagguccaggaguucgagac

SEQ ID NO: 169974 - RNA, 64 nt, Human
ucuauagucccugcuauuugagaggcugaggugggaggaucauuugagugcaggaguucaagga

SEQ ID NO: 169975 - RNA, 64 nt, Human
augaacccuucuuacaucauucaaguucugcucugaggaucaagcuugggucugauuuaacuca

SEQ ID NO: 169976 - RNA, 64 nt, Human
guugaaauccucuguuggcuuuggguuguauaaggaggaucaaaacaacagaggaaaugcugac

SEQ ID NO: 169977 - RNA, 64 nt, Human
gagaggauuuagaaguuccaauugcccugcuaaggaggaucaagacccguaauccggcauaaca

SEQ ID NO: 169978 - RNA, 64 nt, Human
aauuucccaccaacgaauguaguacauacugugagaggaucauaaugagguccugaauauuuaa

SEQ ID NO: 169979 - RNA, 64 nt, Human
agcugagguagaaaaacgucuccgagaaggggaggaggaucauguacgcccggaaguaggaccu

SEQ ID NO: 169980 - RNA, 64 nt, Human
ucuuguguccucaaagggccacgaggccugaaaggaggaucagaaugcuuugggauuaauuggg

SEQ ID NO: 169981 - RNA, 64 nt, Human
cuucuaaucccagcacuuugguaggcaaaggugggaggaucauuugagcucaggaguuccagac

SEQ ID NO: 169982 - RNA, 64 nt, Human
aacugaaguuccucauagugucauuuguaugagagaggaucauggacaaugaauaaaugcacac

SEQ ID NO: 169983 - RNA, 64 nt, Human
ccuauaaucccaacacuuugggaggccgaggugggaggaucacuugagcacaggaguuugagac

SEQ ID NO: 169984 - RNA, 64 nt, Human
uggaacccuggacuucacugggagggccaacuuggaggaucagugcuggcugacaagcccuccg

SEQ ID NO: 169985 - RNA, 64 nt, Human
ccuguaauuccagcacuuugggaggcagaguugggaggaucaccugaugucagggguuugagac

SEQ ID NO: 169986 - RNA, 64 nt, Human
ugcugugaauuaugaaaacaccaaguuugaauaagaggaucauggagaaaaaaugagacccuaa

SEQ ID NO: 169987 - RNA, 64 nt, Human
ugcauguccuaaagcacuggcugaaggaagccaagaggaucacugcugcuccuuuuuucuagag

SEQ ID NO: 169988 - RNA, 64 nt, Human
aauguaucauuuugucaucaauggcagcauuccagaggaucaugaagacugggcuuccaauggg

SEQ ID NO: 169989 - RNA, 64 nt, Human
aaauaaaagcaucugauccuucaaggauaaaguugaggaucacaugguacguggcauuuguugu

SEQ ID NO: 169990 - RNA, 64 nt, Human
cauuguuuuaaauguugugcaucuguaacuucaggaggaucacuugagcuuuaaaaccugugcc

SEQ ID NO: 169991 - RNA, 64 nt, Human
caaaacuaggauugggacaccuuuuuuucccccugaggaucacugacaaaaaacacugcaccag

SEQ ID NO: 169992 - RNA, 64 nt, Human
cagaccccucccguuaggcuucaccuccaacacugaggaucaaauuucaacaugagauuuggag

SEQ ID NO: 169993 - RNA, 64 nt, Human
cauuauuuuauuugcaaacuaggaauugcagucugaggaucauuuagaagggcaaguucaagag

SEQ ID NO: 169994 - RNA, 64 nt, Human
gccuauagucccacuacuuguggggcuaaggcaggaggaucacuugagccccggaggucgaggc

SEQ ID NO: 169995 - RNA, 64 nt, Human
ccuguaauccuugcauuuuggaaggcugaggcaggaggaucacuuuaggccugguguguucaag

SEQ ID NO: 169996 - RNA, 64 nt, Human
ccuguagucccagcauuccgggaggcugaggugggaggaucacuugagcccagggagguugggg

SEQ ID NO: 169997 - RNA, 64 nt, Human
ugguguuuccccccucuuucugguuuuacaucaugaggaucaguuagcugcugacaagaaaagu

SEQ ID NO: 169998 - RNA, 64 nt, Human
aggcaaauucacaaauacggaauccaugaauaacgaggaucaacuguacuuaacuauauuuuaa

SEQ ID NO: 169999 - RNA, 64 nt, Human
uaauggcagcaucugagcuguuggcauauuggaugaggaucaguauggcuugcugcuuuuauuu

SEQ ID NO: 170000 - RNA, 64 nt, Human
gcuguggucccaguuacucaggaggcugaggcaggaggaucacuugagcccaggagguugaggc

SEQ ID NO: 170001 - RNA, 64 nt, Human
gaagcaaacugcauuaucaggaguaccuuggugagaggaucaguguaaauccuaauagguacaa

SEQ ID NO: 170002 - RNA, 64 nt, Human
ggacaauuucucauuccucucagugacuauccuagaggaucaguguauuugagaaauauuuaga

SEQ ID NO: 170003 - RNA, 64 nt, Human
cuugcccucaaugcacgaaagguggcccaggagagaggaucaaugccauaggaggcagaagucu

SEQ ID NO: 170004 - RNA, 64 nt, Human
guagaaggaagagaggcaaaggaaacuggguggggaggaucaauuagagaggaggcaccuggga

SEQ ID NO: 170005 - RNA, 64 nt, Human
ggugcaugccuguaaucucggaaggcugaggcaggaggaucauuugagcucaugagggcccagg

SEQ ID NO: 170006 - RNA, 64 nt, Human
ccuguaaucccaccacuuugggagggugaugcaggaggaucacuugaggccaggaguuggagac

SEQ ID NO: 170007 - RNA, 64 nt, Human
gcacacagccuucggaaacccccaaggugucgaggaggaucagauccagauaagagaagaugau

SEQ ID NO: 170008 - RNA, 64 nt, Human
augaaggcagcacucagggccaggggagagagaagaggaucagcagugcagccccaggaugccu

SEQ ID NO: 170009 - RNA, 64 nt, Human
ccugcaggcccagcuacacgggaggccaaggcaggaggaucacuugaaaucaagaguucaaguc

SEQ ID NO: 170010 - RNA, 64 nt, Human
uccuaccaaaguaaccugggcuuaaguuuuacuugaggaucauaugaauuagccaaaagaaugg

SEQ ID NO: 170011 - RNA, 64 nt, Human
cugugcuuucuugaugcguagaaacacgugcauggaggaucaaacacugucagaauugcugaaa

SEQ ID NO: 170012 - RNA, 64 nt, Human
ccuguaaccccagcacuuugggaggccaaggagggaggaucacaaggucaggagaucgagacca

SEQ ID NO: 170013 - RNA, 51 nt, Human
auaugaaccagcuuggcugaugaggaucagcuuguuagccugcagauuccu

SEQ ID NO: 170014 - RNA, 64 nt, Human
cuuuauaagagaauagaggcaaaaguauagaacugaggaucauuuguauuuuugaguuggaaau

SEQ ID NO: 170015 - RNA, 64 nt, Human
ccuauaaucccagcacuuugggaggcagaggagggaggaucacuugaacccaggaauucaaggc

SEQ ID NO: 170016 - RNA, 64 nt, Human
ccuauaaucccaauauuuugggaggccgaggagagaggaucacuuaagcccaggagucugagac

SEQ ID NO: 170017 - RNA, 64 nt, Human
ccuguagucccagcuacaugggaggcugaggugggaggaucacuugagcccaggaaguccagaa

SEQ ID NO: 170018 - RNA, 64 nt, Human
cuguuuuagggacaugauuuuccugaaauugggugaggaucagugaaauaauuacucuauuacu

SEQ ID NO: 170019 - RNA, 64 nt, Human
ccuguagucccagcacuuugggaggcaaaggcgggaggaucacuugaggccaggacuuugagac

SEQ ID NO: 170020 - RNA, 64 nt, Human
ccugucaucccagcacuuugggaggccgaggcaggaggaucaccugaggucaggaguuugagac

SEQ ID NO: 170021 - RNA, 64 nt, Human
ccuuguuuauggggagucugguuggaugucauuugaggaucauugugccccuagaggugccauu

SEQ ID NO: 170022 - RNA, 64 nt, Human
cagcagauuuuaugaacuauaagaugcagucucagaggaucagcaaguggaggccaucaguauu

SEQ ID NO: 170023 - RNA, 64 nt, Human
ucucuguuugaaccagcaggauugcagaucauuugaggaucagagugugaaaacgaguuucucu

SEQ ID NO: 170024 - RNA, 64 nt, Human
gcccagcgugccucucacuuuccagaaagggugagaggaucauuagagaguucauuagagagua

SEQ ID NO: 170025 - RNA, 64 nt, Human
accaccaaguaaagcauccugggcuagccuaccggaggaucagagaccauguggaacauaaaug

SEQ ID NO: 170026 - RNA, 64 nt, Human
ucuguggucccaggugcucaggaagcugaggugggaggaucacuugagcccaauucaaagcugc

SEQ ID NO: 170027 - RNA, 64 nt, Human
gugcuuuuguuaaagccccuauaugggcagcauggaggaucauaagauagcaaaaccauuucaa

SEQ ID NO: 170028 - RNA, 64 nt, Human
ugacucaguugucauucuucacaaaagaauaguagaggaucauguaaaccugagccuaacucuu

SEQ ID NO: 170029 - RNA, 64 nt, Human
acauuauggcucucauaaucugcauagguauaaagaggaucauuucuaccuagggauagccaaa

SEQ ID NO: 170030 - RNA, 64 nt, Human
acucagguccccaugguuguccauugaauggagugaggaucaaggugggaaugacuggguggug

SEQ ID NO: 170031 - RNA, 64 nt, Human
cauggcuugagccuauaauccgaggcugaggugggaggaucacuugagcccaggaguuugaggu

SEQ ID NO: 170032 - RNA, 64 nt, Human
ccuguaauuccagugcuuugggaggccaagaugggaggaucauuugagcccaggaguuugagac

SEQ ID NO: 170033 - RNA, 64 nt, Human
cugcaccaaugcacugagugaaggaagagagacagaggaucaagggcuuuagacagcacuccuu

SEQ ID NO: 170034 - RNA, 64 nt, Human
ccuguaguaccagcuacucuggaggcugaggcaggaggaucacuugagcccaggagauuaagac

SEQ ID NO: 170035 - RNA, 64 nt, Human
agucauuagucucacaaacacacuuuggacugaagaggaucauuucuuuuuguucgugagguca

SEQ ID NO: 170036 - RNA, 64 nt, Human
gcugucaaggucaggcaagugagcaccggggacugaggaucagggcgggaccccgugaggcuca

SEQ ID NO: 170037 - RNA, 64 nt, Human
ccuguaaucccagcaccuugggaggcugaggugggaggaucauuugaggccaggaguuugagac

SEQ ID NO: 170038 - RNA, 64 nt, Human
ucuguaaucccagcgcucugggaggcugaggcaggaggaucacuugaggucaggaguucaaugu

SEQ ID NO: 170039 - RNA, 64 nt, Human
ugugcagucccagcuacucaggaggcugaggcaggaggaucacagugaccuauaaugagccguu

SEQ ID NO: 170040 - RNA, 63 nt, Human
cuguaaucccagcauuuuaggaggccaaggcaggaggaucacuuggagccaggaguuugagac

SEQ ID NO: 170041 - RNA, 64 nt, Human
gcugugaagggagaaagggagagaaaacucuucugaggaucauuugucuugguaguauaguaaa

SEQ ID NO: 170042 - RNA, 64 nt, Human
ggggaccgagcccuguuacauggaugugaacagugaggaucagagguuuuaucagaacacauuc

SEQ ID NO: 170043 - RNA, 64 nt, Human
acacucaggcuuucuucccuuagggucacagggugaggaucaaagacacaaaugucugagauac

SEQ ID NO: 170044 - RNA, 64 nt, Human
cucauuucuuggggucguauuccugauuucagaagaggaucauaacugaaacaacauaagacaa

SEQ ID NO: 170045 - RNA, 64 nt, Human
ccuguagucacagguacuugggaggcugaggugggaggaucacuugagcccaggagauagaggc

SEQ ID NO: 170046 - RNA, 64 nt, Human
acuguaagcucaucaccuugggaggccacuguaggaggaucaauugagccuagaaguucaagac

SEQ ID NO: 170047 - RNA, 64 nt, Human
ccuguaaucccaacacuguggaaggccgaggcaggaggaucacuugaguccaggaguuugaaac

SEQ ID NO: 170048 - RNA, 64 nt, Human
uaauuucuuguucuuuuggaauaucuuaguaacugaggaucauuuucuaacaaugugguugaca

SEQ ID NO: 170049 - RNA, 64 nt, Human
uauaaaauuccagcacuuugggaggccaaggcaggaggaucacuugagccuaugaguucaagac

SEQ ID NO: 170050 - RNA, 64 nt, Human
gcacuccaaccagcagcuggauuccugggaacuggaggaucagagugcuguggacuggacccag

SEQ ID NO: 170051 - RNA, 64 nt, Human
cuuauauuugcacaaguauguaaaauaucguguugaggaucauucuuuguuggaaacacugcuc

SEQ ID NO: 170052 - RNA, 64 nt, Human
ccaucucuagggauugggggauuggcuagccugggaggaucagucuguccaggucagcgaggcc

SEQ ID NO: 170053 - RNA, 64 nt, Human
accccgagccgcucuccuuggaguagccucucgggaggaucacaccucgacacccaaccccuga

SEQ ID NO: 170054 - RNA, 64 nt, Human
ccuguaaucugaacacuuugggaggccgaggcgggaggaucacuugagcccaggaguucaagac

SEQ ID NO: 170055 - RNA, 64 nt, Human
caaagaucacagcagccagcuccugguggcugaugaggaucagagcauuuguucccccaugaaa

SEQ ID NO: 170056 - RNA, 64 nt, Human
caaagaucucagcagccagcuccugguagcugaugaggaucagagcguuuguucccccaugaaa

SEQ ID NO: 170057 - RNA, 64 nt, Human
uuuaagggaguuacaucuuuauucugcuaaagaagaggaucauugauuucuguacagucagaac

SEQ ID NO: 170058 - RNA, 64 nt, Human
agcauuuaaucuguauuuuacaaguuaggaagcagaggaucagagaugggaaaggacuagccca

SEQ ID NO: 170059 - RNA, 64 nt, Human
uuccccuccucucuccagggagccggggcugugagaggaucaucuggggcaggcccuccacuuc

SEQ ID NO: 170060 - RNA, 64 nt, Human
auauucuuuggaagcaggaagaaaugcucauaaagaggaucagaccuucuuucccgugaaacca

SEQ ID NO: 170061 - RNA, 64 nt, Human
ccagucacaauggucuccauugcauuucaaaggagaggaucagacuaucugaauauaaacacaa

SEQ ID NO: 170062 - RNA, 64 nt, Human
aagaauuacucauuaaccagcauaaauacugccugaggaucaaaacucagaggcaaagagggag

SEQ ID NO: 170063 - RNA, 64 nt, Human
uagcccuuccuguucucuccagcccagcauacaggaggaucaaaggaggugacggagcaucgug

SEQ ID NO: 170064 - RNA, 64 nt, Human
gagaauuuaaagguauuuuuuaaaauucuaauaagaggaucagccgggugcaaugacucaugcc

SEQ ID NO: 170065 - RNA, 64 nt, Human
ccugugaucccagcacuuugggaggcugagguaggaggaucacgugaggucgggaguucaagac

SEQ ID NO: 170066 - RNA, 64 nt, Human
ucgguaguccuggcuacuagagagguugaggugggaggaucacuugaaccugggaggugggggu

SEQ ID NO: 170067 - RNA, 64 nt, Human
ucaugcaaacuuuauuuuguguuuaggaacuacugaggaucagaguaauccaagcaaaugugaa

SEQ ID NO: 170068 - RNA, 64 nt, Human
caguauuugcagaagggcaaagcugcuuaagagagaggaucagggugaaguuuggcacacaggg

SEQ ID NO: 170069 - RNA, 64 nt, Human
ccuguaaucccagcacuuugggaggccgaggcgggaggaucaugaggucaggagaucgagacca

SEQ ID NO: 170070 - RNA, 64 nt, Human
ccaggcaugguggugggcuacucuggaggcccuugaggaucacuugagcccaggagauugaggc

SEQ ID NO: 170071 - RNA, 64 nt, Human
cauguggucccagcuacucuggaagcugaggugagaggaucacuugagcccuggaauuccaugc

SEQ ID NO: 170072 - RNA, 64 nt, Human
ccuguaaucccagcuacuugggaggcugaggugggaggaucacuugaacucaggaguuugagag

SEQ ID NO: 170073 - RNA, 64 nt, Human
aauggaaucauaagcaaagguuguguucuggggugaggaucaugagagagauauuuaucacaug

SEQ ID NO: 170074 - RNA, 64 nt, Human
acuuauucaaccuguccuuucagggaguuuauuggaggaucaaagaacugaaagcacuagagca

SEQ ID NO: 170075 - RNA, 64 nt, Human
ccuguagucccagcuacuugggaugcugaggugggaggaucacuugaaccugggagacacaggc

SEQ ID NO: 170076 - RNA, 64 nt, Human
cuguguaucucuuucacauuguuugcugcuauuggaggaucaguuuuuuguuuuacaaugucau

SEQ ID NO: 170077 - RNA, 64 nt, Human
uguaguucuucacuaucuguuccagggcuagucggaggaucauaagcaagcucagaccugcccc

SEQ ID NO: 170078 - RNA, 62 nt, Human
aaaugcagguuuaugaaugauguggacuuuuagaggaucaaaucaauaaauuggauuuuuua

SEQ ID NO: 170079 - RNA, 64 nt, Human
ccuguaaucccagcacuuugggaggucgaggugggaggaucacuugaggccacgaguucaagac

SEQ ID NO: 170080 - RNA, 64 nt, Human
caccuguagucccggccacucggggcugaggcaggaggaucacuggaaccugggagguugccac

SEQ ID NO: 170081 - RNA, 64 nt, Human
ccuauaaucccaggacuuugggaggccaaggcaggaggaucacuugaguccagaaauucaagac

SEQ ID NO: 170082 - RNA, 64 nt, Human
caucccaugagggaagcacgacagggcugauggugaggaucagagcaguucuaaggugacucgu

SEQ ID NO: 170083 - RNA, 64 nt, Human
ggagcuauucauacacagugacuugauguucuuggaggaucaacaaaacugcccugggaaagca

SEQ ID NO: 170084 - RNA, 64 nt, Human
cuggucagagggugaccugaaccagagcuggagugaggaucaaacaggcccaggagccugagga

SEQ ID NO: 170085 - RNA, 64 nt, Human
ccuguaaucccaacccuuuggaagguaaagacgggaggaucacuugaggccaggaguucaagac

SEQ ID NO: 170086 - RNA, 64 nt, Human
ugagaaauauccccugugcaacccacccuugguugaggaucacaaauugaggugccuuccuugu

SEQ ID NO: 170087 - RNA, 64 nt, Human
cuguaaucccaacacuuuugggagguccaggcaggaggaucacuugggcccaggaggucaagcc

SEQ ID NO: 170088 - RNA, 64 nt, Human
aaaauaaaaauaaaagccuuuggguucuugaauggaggaucauggaacacauuugcugccauau

SEQ ID NO: 170089 - RNA, 64 nt, Human
aaaaaaaaaaaaagguggcaggagaggcuuuggggaggaucagccagcagacaugagcacugcu

SEQ ID NO: 170090 - RNA, 64 nt, Human
auuuuugaggaaguuuugucuaauuaucaauauugaggaucagggcuccuaggcucagugguag

SEQ ID NO: 170091 - RNA, 62 nt, Human
gcgaauaucgucaucguuagaagcugaaggaagaggaucaccuuccaagacaaaacagucuu

SEQ ID NO: 170092 - RNA, 64 nt, Human
ccuguagucucagcuacucggaaggcugaggcaggaggaucacuugagccugggaauucgaagc

SEQ ID NO: 170093 - RNA, 64 nt, Human
cuuugaugcauggcuauaaucccagccgaggugggaggaucacuugaguccagguucaagacua

SEQ ID NO: 170094 - RNA, 64 nt, Human
ccugcagucccagcuacuugggaggcugaguugggaggaucacuugagccugggagguugaggc

SEQ ID NO: 170095 - RNA, 64 nt, Human
ccuauaaucccagcacuuugggaggcugaggcaggaggaucacuugagcccaggaguucaagac

SEQ ID NO: 170096 - RNA, 64 nt, Human
ucacugacaaauaguggauauagguuucauuucugaggaucaauaaacagcuuguaauguugua

SEQ ID NO: 170097 - RNA, 64 nt, Human
gagagcagaagguagauccuaaaaagcauggugagaggaucaaauguuuuuauaucaacauccu

SEQ ID NO: 170098 - RNA, 64 nt, Human
gcuauaauccuagcacuuugggaggcugaagcaggaggaucacuugagcccaggaguucaagac

SEQ ID NO: 170099 - RNA, 64 nt, Human
uuuucagaaagcacaaagagauucaauuucccuggaggaucaggacagaggaaggaaucucuaa

SEQ ID NO: 170100 - RNA, 64 nt, Human
agggcuuugcaguuccuaaggagugaugagguuagaggaucacuucugcauuugauuuucaagg

SEQ ID NO: 170101 - RNA, 64 nt, Human
ggauggacagcuguucuuuggccauaugguauaagaggaucauucuugucacuacuuaaguuag

SEQ ID NO: 170102 - RNA, 64 nt, Human
aaggaagagaaagccuuugucuagcauuuauuaggaggaucagagugagugggaaguuucacaa

SEQ ID NO: 170103 - RNA, 64 nt, Human
caugguggcccaagucugagucccaguuacuugggaggaucacuugaauguaggaucacuugag

SEQ ID NO: 170104 - RNA, 64 nt, Human
cauguaauccuagcacuuugggaggcugagaugggaggaucacuugaggccaagaguuugagac

SEQ ID NO: 170105 - RNA, 64 nt, Human
uuuggguggcuguuuuuaaaaaguaaaguucuuagaggaucauaggucuggacacuccauccuu

SEQ ID NO: 170106 - RNA, 64 nt, Human
ccuguaguccuagcuacucaggaggcugaggugggaggaucaccuaaggccaggaggucaaggc

SEQ ID NO: 170107 - RNA, 64 nt, Human
ccuauagucccaacuacuagggaggcugaggugggaggaucacuugagccugggggacugaggc

SEQ ID NO: 170108 - RNA, 64 nt, Human
gccuguaacccuggcacuuaaggggccaaggcaggaggaucacuugaggccagugagcugugau

SEQ ID NO: 170109 - RNA, 64 nt, Human
acuuagguugguuaaguugacaagauuuacuccagaggaucaucucuuuguauuugccaaauaa

SEQ ID NO: 170110 - RNA, 64 nt, Human
aaauauuuggggcauguuugugcacugcuguugugaggaucagcauaugaaauugacaucaugg

SEQ ID NO: 170111 - RNA, 64 nt, Human
ggcagaggaagauauuucuaaucggucuugcccagaggaucacagugcugagaccccccaccac

SEQ ID NO: 170112 - RNA, 64 nt, Human
cugugaucccagcuacuuaggagguugaggcugggaggaucacuugagcccaggagucugaggc

SEQ ID NO: 170113 - RNA, 64 nt, Human
aacauguuuuuggcaagacaacagauugagguuagaggaucaguaggacauuuuuauuccaucu

SEQ ID NO: 170114 - RNA, 64 nt, Human
uucagucgcucccuggaggcaggugggcacugcagaggaucacuggaauccagaucgagcgcag

SEQ ID NO: 170115 - RNA, 64 nt, Human
ccugucaucccagcacuuugggaggccgagacgggaggaucaguugaggucaggaguuugagac

SEQ ID NO: 170116 - RNA, 64 nt, Human
acugcaaucccagcuacuuuggaggcagggaugggaggaucacuugaggccaggaucucaggac

SEQ ID NO: 170117 - RNA, 64 nt, Human
cccccugggauauaagaugaucuagcucccgguagaggaucaccggugacaacuauagcaguug

SEQ ID NO: 170118 - RNA, 64 nt, Human
ccuguaaucccagcauuuuaggaggccaagguuggaggaucauuugagcccaggaauuggaaag

SEQ ID NO: 170119 - RNA, 64 nt, Human
uuuuaaguacaaguuuguuuaagugccagacuuugaggaucaguuuuaauuucuccauuuguaa

SEQ ID NO: 170120 - RNA, 64 nt, Human
gucugggaggaccaggaaacagccucaguggccagaggaucaccagugcauccuucaucacagc

SEQ ID NO: 170121 - RNA, 64 nt, Human
uuaaaauauuuaaauagaagugaaaagguccucugaggaucagaucaugcaugcgccauuuuuu

SEQ ID NO: 170122 - RNA, 64 nt, Human
cuguagucuuugggucuuugggaggccagggugggaggaucacuugagcucaggaguuugagac

SEQ ID NO: 170123 - RNA, 64 nt, Human
uagucccagcuacucgggaggcugagugaggcaggaggaucacuugagaccaggagguuguggc

SEQ ID NO: 170124 - RNA, 64 nt, Human
cccuuggguccagcuacucaggaggccaaggugggaggaucacuugagcccaggaguuuuagac

SEQ ID NO: 170125 - RNA, 64 nt, Human
ccuguagucccagcuacuugggaagcagaggcuggaggaucauuucagcccaggagguugugga

SEQ ID NO: 170126 - RNA, 64 nt, Human
gucauuuucaguuguaccuuagaugucugguguugaggaucaagugccauagccuuuauucagg

SEQ ID NO: 170127 - RNA, 64 nt, Human
gggaaaaauuacccaguauaguucagguuaugaggaggaucagccacacaauccagugcuucag

SEQ ID NO: 170128 - RNA, 64 nt, Human
ccugugaucccagcuacuuggaaggcugaggugagaggaucacucgaggagauuggggcugcca

SEQ ID NO: 170129 - RNA, 64 nt, Human
ccuguaauuccagcacuuugggaggccgaggagggaggaucaccugaggucaggaguuugagac

SEQ ID NO: 170130 - RNA, 64 nt, Human
ccuguauucccagcuacucaggagguugaggugggaggaucacuugagcccagaaguucaaggc

SEQ ID NO: 170131 - RNA, 64 nt, Human
auugugaugagucucgacugucaaaucuucuucagaggaucacccgggaaaacgaccgagaccg

SEQ ID NO: 170132 - RNA, 64 nt, Human
accuguaaucccagcauuuugggaggcugagugagaggaucacuugagcucaggaguucgagac

SEQ ID NO: 170133 - RNA, 64 nt, Human
gucuguaaucccagcaauuuggaggcugaggugggaggaucauuugagcccaggaguucgagac

SEQ ID NO: 170134 - RNA, 64 nt, Human
auugugaugagucucgacugucaaaucuucuucggaggaucacccgggaagacgacagagacug

SEQ ID NO: 170135 - RNA, 64 nt, Human
cuuguaaucgcagcacuuugggaggcugaggcaggaggaucacuugagcccaggaguucaagac

SEQ ID NO: 170136 - RNA, 64 nt, Human
aauuucucauuaaacuucuaaaauucuuauaggugaggaucauuuuuccccccaccuuaggaug

SEQ ID NO: 170137 - RNA, 64 nt, Human
ccuauaaucccagugcuuugggaagccgaagcaggaggaucacuggaggccaagaguuggagag

SEQ ID NO: 170138 - RNA, 64 nt, Human
gggccuaccugaggucggagcauggaaggagggugaggaucaaaaaacuaccuaucugguacua

SEQ ID NO: 170139 - RNA, 64 nt, Human
acaucauaugcagaggaagcuucuacgcgcuagagaggaucaaggggccacacuggaccaugug

SEQ ID NO: 170140 - RNA, 64 nt, Human
caggggcucuggggaaacugcuggaacucgaggugaggaucagccuuuuccagcauccugugag

SEQ ID NO: 170141 - RNA, 64 nt, Human
ccuguagucccagcuacuccggacacugaugugagaggaucacuugagccagggaggucauggc

SEQ ID NO: 170142 - RNA, 64 nt, Human
uugcuuuaaaacucucauguauguuaucuacagagaggaucauuacagagacagacucucccga

SEQ ID NO: 170143 - RNA, 64 nt, Human
cucuaccuuaguagauacaaguagagaauauggagaggaucauuacauugaaaaguaaauguuu

SEQ ID NO: 170144 - RNA, 64 nt, Human
uaauccaguaagucuuuccucguuccuacuuguggaggaucaguagcuguuaugaugccagacc

SEQ ID NO: 170145 - RNA, 64 nt, Human
ccuguaaucccaguacuuugagacgcugaggugggaggaucacuugagcccaggaguucaaaac

SEQ ID NO: 170146 - RNA, 64 nt, Human
uccuccagcuggcucccuugucuccagggcuuuggaggaucaggguagggagggcucugucucu

SEQ ID NO: 170147 - RNA, 64 nt, Human
acccaaagucucccaggaagcuguggggagaccagaggaucaagcugaagugaagccagugaag

SEQ ID NO: 170148 - RNA, 64 nt, Human
ccuguagucccagcuacuagggaggcugagccaggaggaucacuugagcccgggagguugaggc

SEQ ID NO: 170149 - RNA, 64 nt, Human
caaucauuuuaggauugucaaaaggaggauugaggaggaucagaucaauaauggaggcaauggu

SEQ ID NO: 170150 - RNA, 64 nt, Human
uguaccgggaccggaaacuucuuggugcugaagagaggaucaugcaaacuguggagaucacuaa

SEQ ID NO: 170151 - RNA, 64 nt, Human
gagcaugaccgcucucugacuucacauguuaauagaggaucagagcagaguugggaguauauug

SEQ ID NO: 170152 - RNA, 64 nt, Human
aguguccuuaaaacucuggagugagaggaugccagaggaucaagaaaaggaucacaguuucuug

SEQ ID NO: 170153 - RNA, 64 nt, Human
uugguaaauucacaaauacauaaccuugaauaaugaggaucaacuguaccauauuuaauaaagc

SEQ ID NO: 170154 - RNA, 64 nt, Human
accuauaaucgagcacuuugggaggccaagacaggaggaucacuugaggccaggagucugagac

SEQ ID NO: 170155 - RNA, 64 nt, Human
caccuacuauaugcagaaggggaggccgaggugggaggaucauuggaucucaggaguucgagau

SEQ ID NO: 170156 - RNA, 64 nt, Human
ccuucucgcucauaaugacacccagcuccuuugagaggaucagagcccauugcacaagaagagc

SEQ ID NO: 170157 - RNA, 64 nt, Human
ccuguaaucccagcacuuugggaggcugaggcaggaggaucacuugaggucaggaguuugagac

SEQ ID NO: 170158 - RNA, 64 nt, Human
ccuauagucccagccacucaagaggcacaggcgggaggaucacuugagccugggagguuguggu

SEQ ID NO: 170159 - RNA, 64 nt, Human
ccuguagucccagcuaacugggaggcugaggcaggaggaucacuugagcccaggagauugaggc

SEQ ID NO: 170160 - RNA, 64 nt, Human
gggcuagggggcuggugccgccucauaggcagacgaggaucaucgcugggggaccuuucccgug

SEQ ID NO: 170161 - RNA, 64 nt, Human
aguugguagaaaaguuauuuguauagaacuuuaagaggaucagaagguuuuuugcagaguuaua

SEQ ID NO: 170162 - RNA, 64 nt, Human
ccuguagcaccagcuacuugggagguuaaggugggaggaucacuugagccugggagauagaggc

SEQ ID NO: 170163 - RNA, 64 nt, Human
cuugcaaucccagugcuuugggagacugaggcaggaggaucacuuaaggccaggaguucgagac

SEQ ID NO: 170164 - RNA, 64 nt, Human
ccuguaauccgagugcuuugggaggcugaggcaggaggaucacucgagcucaagaauucaagac

SEQ ID NO: 170165 - RNA, 64 nt, Human
ugcccggcuccucccagaaccagucccagccugggaggaucaaggccuggaucccgggccguua

SEQ ID NO: 170166 - RNA, 64 nt, Human
aggacugcccucucuuguucuuggaaacuuuguugaggaucaauucaccauaaauauguguguu

SEQ ID NO: 170167 - RNA, 64 nt, Human
ccuauaaucccagcacuuuaggagccccagacaggaggaucacuuaagcgcagaagaucaagac

SEQ ID NO: 170168 - RNA, 64 nt, Human
gccuguaaucccagcugcuggggggcugaggcaggaggaucaguugaacgugggaggcagaggu

SEQ ID NO: 170169 - RNA, 64 nt, Human
ccuguaguccuagcuacucaggaggcugaggugggaggaucacuugagcuugggaggcgguggu

SEQ ID NO: 170170 - RNA, 64 nt, Human
uauguaaucccagcacuuugggaagccaaggagggaggaucacuugaacucaggaauucgagac

SEQ ID NO: 170171 - RNA, 64 nt, Human
gguggcacacaccuguagucccaggcugaggugggaggaucacuugaacccaagaggcagaguu

SEQ ID NO: 170172 - RNA, 64 nt, Human
uguggaaucccagcacuucaggaggccgaggugggaggaucacuggagcucgggaguucaagac

SEQ ID NO: 170173 - RNA, 64 nt, Human
ccuguaguccaagcuacuugggaggcugaagugggaggaucauuugugcccagguugaggcuau

SEQ ID NO: 170174 - RNA, 64 nt, Human
ccuguaaucccugcacuuugggaggccaaggugggaggaucaguugagccccagaguucaagac

SEQ ID NO: 170175 - RNA, 64 nt, Human
agaacauugaccauuagcugauacaugcagacaagaggaucaggaaggaugagucugaucugga

SEQ ID NO: 170176 - RNA, 64 nt, Human
ccuguagucccagcuacuggugaggcugaggcuggaggaucacuggaguucgaggcugcaguga

SEQ ID NO: 170177 - RNA, 64 nt, Human
aaucccagcacuuugggaggucgggggggugggggaggaucacggggucaggagaucgagacca

SEQ ID NO: 170178 - RNA, 64 nt, Human
ccuauaaucccaguacuuuaggacauggaagggggaggaucacuugagaccaggaguugugagg

SEQ ID NO: 170179 - RNA, 64 nt, Human
ccuguaaucccagcuugucaggaggcugaagugggaggaucaccugagcccagggaggucaagg

SEQ ID NO: 170180 - RNA, 64 nt, Human
cacuucucccacaggcccagcaggacgcaguccugaggaucagggauucuacagcugcauuaaa

SEQ ID NO: 170181 - RNA, 64 nt, Human
uuacaaaccccugaaggaaagugacccuuuaagagaggaucaucuuuuuuuauauuuauuuuca

SEQ ID NO: 170182 - RNA, 64 nt, Human
cccgggccaaguacuucauucgagaugaguuucugaggaucagcacugccaguggagaugggcg

SEQ ID NO: 170183 - RNA, 64 nt, Human
gaaaguggaggggacacuccagaggcugucgugggaggaucaugugagccugggaggucaaggc

SEQ ID NO: 170184 - RNA, 64 nt, Human
ccuguaggccuagcugcucaggaggcugaagcaggaggaucacuugagccugaguucaacacug

SEQ ID NO: 170185 - RNA, 64 nt, Human
ccuauaaucccagcacuuugggaagccgggguaggaggaucaccagaggccagcagguccacac

SEQ ID NO: 170186 - RNA, 64 nt, Human
aucuccuuuuuugccucuacuggugaggaaacaugaggaucagaggccacauuuuuaauuauug

SEQ ID NO: 170187 - RNA, 64 nt, Human
cggguuccaucaccugugguuccagcugaggugggaggaucacuugagccuaugaggucgaggc

SEQ ID NO: 170188 - RNA, 64 nt, Human
ccuguagucccagcuacuucggggacugaggugggaggaucacuugaaccuaggaggucgaggc

SEQ ID NO: 170189 - RNA, 64 nt, Human
cuauaaucucagcacuuuugggaggccaagacaggaggaucacuucaggccaggaguucaagau

SEQ ID NO: 170190 - RNA, 64 nt, Human
auaagaauugagcgcuauggguguuaacgugcaugaggaucaguuugcagcagcaaguacaaaa

SEQ ID NO: 170191 - RNA, 64 nt, Human
aaaaauuagccaggcaugcgaaacgcugaggugggaggaucagaugagcuugggagguugaggc

SEQ ID NO: 170192 - RNA, 64 nt, Human
ccuguaaucccagcacuuuaagaggcugaggcaggaggaucacuugagcucaggaauucgagac

SEQ ID NO: 170193 - RNA, 64 nt, Human
acuuaugaguccuagcacugauuuugaggaaaaggaggaucagaaguucaagggaccgugaaag

SEQ ID NO: 170194 - RNA, 64 nt, Human
ccuguggucccagcuacucaggaggcugaggugggaggaucauuugagccuaggaggucaaggc

SEQ ID NO: 170195 - RNA, 64 nt, Human
acuguaaucccagcacuuugggaggccaaggugggaggaucaauugaggccagaguuugaaacc

SEQ ID NO: 170196 - RNA, 64 nt, Human
ccuguagucccagcuacuugggaggcugaggcaggaggaucacuuaagcccagaaggcagaggu

SEQ ID NO: 170197 - RNA, 64 nt, Human
cauggaaucccagcacuuugggaggccgaggugggaggaucacuugagcccaggaguucgagac

SEQ ID NO: 170198 - RNA, 64 nt, Human
acuguaaucccagcuacucaggaggcugaggcaggaggaucacuugaaccugggaggcggaggu

SEQ ID NO: 170199 - RNA, 64 nt, Human
ccugugguccuggcuacuugggaggcugaggauggaggaucauuugagcccaggaggucgaggc

SEQ ID NO: 170200 - RNA, 64 nt, Human
ccuguauucccagagcuuugggaggcugaggcgagaggaucacuugagcacaggaguucgagac

SEQ ID NO: 170201 - RNA, 64 nt, Human
guaacuagaacuacccagcgagucguccagaggagaggaucagguuugagucaggaggcucccu

SEQ ID NO: 170202 - RNA, 64 nt, Human
gacacagugguucaugccugugagacuggggcaggaggaucacuugaggccaggaguucaagau

SEQ ID NO: 170203 - RNA, 64 nt, Human
cuaacaauccauuaacauguguagggguuacggugaggaucacuguguuguauucagaaaaacg

SEQ ID NO: 170204 - RNA, 64 nt, Human
ccccaucccaaacugcauuuauaauuuugugacugaggaucauuuguuuguuaauguacugugc

SEQ ID NO: 170205 - RNA, 64 nt, Human
gggcaugagugugcaggguggucacuuucugugggaggaucacaguggggaguuggggguggga

SEQ ID NO: 170206 - RNA, 64 nt, Human
auggaggcucuaauugaauuuucaagcaucuccugaggaucagaaaguaauuucuucucaaagg

SEQ ID NO: 170207 - RNA, 64 nt, Human
ucuguagucccaccuauucaggagauuaaggcaggaggaucacuugagcccaggaggucaaggc

SEQ ID NO: 170208 - RNA, 64 nt, Human
acagagacacacacacauacuacuuuaagggggugaggaucauuaauucagauaauuuuuaagu

SEQ ID NO: 170209 - RNA, 64 nt, Human
acauauguauauacacauaucauuuuaagaagcugaggaucacuaauucagauaauguauaagu

SEQ ID NO: 170210 - RNA, 64 nt, Human
uuaugcccaugaugucauuucaggcucaaccaaagaggaucaaacaggaauuccaucuuggcuu

SEQ ID NO: 170211 - RNA, 64 nt, Human
cacacaccaguagucccagcuacuagggaggcaggaggaucacuugagcccaggaguuugaggc

SEQ ID NO: 170212 - RNA, 64 nt, Human
aguguagucucagcuacucaggaggcugagaugagaggaucacuugagccuggggagguccagg

SEQ ID NO: 170213 - RNA, 64 nt, Human
ucauuaaaguccaguauuacuaagguaagggauugaggaucagggguuagaagacauaaaccaa

SEQ ID NO: 170214 - RNA, 64 nt, Human
aucagcuaagaaaauggacuuuagacaaaagcaagaggaucagaugaagaaaaggagagguaga

SEQ ID NO: 170215 - RNA, 64 nt, Human
ccuguggucccagcuacucaggaggcugaggugggaggaucauuugagcccaggaggucaaggc

SEQ ID NO: 170216 - RNA, 64 nt, Human
ccuguggucccagcugcuggggaggcugaaguaggaggaucauuuaugcuugggaggucgaggc

SEQ ID NO: 170217 - RNA, 64 nt, Human
ccuguagucucagcuacucaggaggcugagaugagaggaucacuugagccugaggagguccagg

SEQ ID NO: 170218 - RNA, 64 nt, Human; identical to SEQ ID NO: 42454

SEQ ID NO: 170219 - RNA, 64 nt, Human; identical to SEQ ID NO: 42455

SEQ ID NO: 170220 - RNA, 64 nt, Human; identical to SEQ ID NO: 42456

SEQ ID NO: 170221 - RNA, 64 nt, Human; identical to SEQ ID NO: 42457

SEQ ID NO: 170222 - RNA, 64 nt, Human; identical to SEQ ID NO: 42458

SEQ ID NO: 170223 - RNA, 64 nt, Human; identical to SEQ ID NO: 42459

SEQ ID NO: 170224 - RNA, 64 nt, Human; identical to SEQ ID NO: 42460

SEQ ID NO: 170225 - RNA, 64 nt, Human; identical to SEQ ID NO: 42461

SEQ ID NO: 170226 - RNA, 64 nt, Human; identical to SEQ ID NO: 42462

SEQ ID NO: 170227 - RNA, 64 nt, Human; identical to SEQ ID NO: 42463

SEQ ID NO: 170228 - RNA, 64 nt, Human; identical to SEQ ID NO: 42464

SEQ ID NO: 170229 - RNA, 64 nt, Human; identical to SEQ ID NO: 42465

SEQ ID NO: 170230 - RNA, 64 nt, Human; identical to SEQ ID NO: 42466

SEQ ID NO: 170231 - RNA, 64 nt, Human; identical to SEQ ID NO: 42467

SEQ ID NO: 170232 - RNA, 64 nt, Human; identical to SEQ ID NO: 42468

SEQ ID NO: 170233 - RNA, 64 nt, Human; identical to SEQ ID NO: 42469

SEQ ID NO: 170234 - RNA, 64 nt, Human; identical to SEQ ID NO: 42470

SEQ ID NO: 170235 - RNA, 64 nt, Human; identical to SEQ ID NO: 42471

SEQ ID NO: 170236 - RNA, 64 nt, Human; identical to SEQ ID NO: 42472

SEQ ID NO: 170237 - RNA, 64 nt, Human; identical to SEQ ID NO: 42473

SEQ ID NO: 170238 - RNA, 64 nt, Human; identical to SEQ ID NO: 42474

SEQ ID NO: 170239 - RNA, 64 nt, Human; identical to SEQ ID NO: 42475

SEQ ID NO: 170240 - RNA, 64 nt, Human; identical to SEQ ID NO: 42476

SEQ ID NO: 170241 - RNA, 64 nt, Human; identical to SEQ ID NO: 42477

SEQ ID NO: 170242 - RNA, 64 nt, Human; identical to SEQ ID NO: 42478

SEQ ID NO: 170243 - RNA, 64 nt, Human; identical to SEQ ID NO: 42479

SEQ ID NO: 170244 - RNA, 64 nt, Human; identical to SEQ ID NO: 42480

SEQ ID NO: 170245 - RNA, 64 nt, Human; identical to SEQ ID NO: 42481

SEQ ID NO: 170246 - RNA, 64 nt, Human; identical to SEQ ID NO: 42482

SEQ ID NO: 170247 - RNA, 64 nt, Human; identical to SEQ ID NO: 42483

SEQ ID NO: 170248 - RNA, 64 nt, Human; identical to SEQ ID NO: 42484

SEQ ID NO: 170249 - RNA, 64 nt, Human; identical to SEQ ID NO: 42485

SEQ ID NO: 170250 - RNA, 64 nt, Human; identical to SEQ ID NO: 42486

SEQ ID NO: 170251 - RNA, 64 nt, Human; identical to SEQ ID NO: 42487

SEQ ID NO: 170252 - RNA, 64 nt, Human; identical to SEQ ID NO: 42488

SEQ ID NO: 170253 - RNA, 64 nt, Human; identical to SEQ ID NO: 42489

SEQ ID NO: 170254 - RNA, 64 nt, Human; identical to SEQ ID NO: 42490

SEQ ID NO: 170255 - RNA, 64 nt, Human; identical to SEQ ID NO: 42491

SEQ ID NO: 170256 - RNA, 64 nt, Human; identical to SEQ ID NO: 42492

SEQ ID NO: 170257 - RNA, 64 nt, Human; identical to SEQ ID NO: 42493

SEQ ID NO: 170258 - RNA, 64 nt, Human; identical to SEQ ID NO: 42494

SEQ ID NO: 170259 - RNA, 64 nt, Human; identical to SEQ ID NO: 42495

SEQ ID NO: 170260 - RNA, 64 nt, Human; identical to SEQ ID NO: 42496

SEQ ID NO: 170261 - RNA, 64 nt, Human; identical to SEQ ID NO: 42497

SEQ ID NO: 170262 - RNA, 64 nt, Human; identical to SEQ ID NO: 42498

SEQ ID NO: 170263 - RNA, 64 nt, Human; identical to SEQ ID NO: 42499

SEQ ID NO: 170264 - RNA, 64 nt, Human; identical to SEQ ID NO: 42500

SEQ ID NO: 170265 - RNA, 64 nt, Human; identical to SEQ ID NO: 42501

SEQ ID NO: 170266 - RNA, 64 nt, Human; identical to SEQ ID NO: 42502

SEQ ID NO: 170267 - RNA, 64 nt, Human; identical to SEQ ID NO: 42503

SEQ ID NO: 170268 - RNA, 50 nt, Human; identical to SEQ ID NO: 42504

SEQ ID NO: 170269 - RNA, 64 nt, Human; identical to SEQ ID NO: 42505

SEQ ID NO: 170270 - RNA, 64 nt, Human; identical to SEQ ID NO: 42506

SEQ ID NO: 170271 - RNA, 64 nt, Human; identical to SEQ ID NO: 42507

SEQ ID NO: 170272 - RNA, 64 nt, Human; identical to SEQ ID NO: 42508

SEQ ID NO: 170273 - RNA, 64 nt, Human; identical to SEQ ID NO: 42509

SEQ ID NO: 170274 - RNA, 64 nt, Human; identical to SEQ ID NO: 42510

SEQ ID NO: 170275 - RNA, 64 nt, Human; identical to SEQ ID NO: 42511

SEQ ID NO: 170276 - RNA, 64 nt, Human; identical to SEQ ID NO: 42512

SEQ ID NO: 170277 - RNA, 64 nt, Human; identical to SEQ ID NO: 42513

SEQ ID NO: 170278 - RNA, 64 nt, Human; identical to SEQ ID NO: 42514

SEQ ID NO: 170279 - RNA, 64 nt, Human; identical to SEQ ID NO: 42515

SEQ ID NO: 170280 - RNA, 64 nt, Human; identical to SEQ ID NO: 42516

SEQ ID NO: 170281 - RNA, 64 nt, Human; identical to SEQ ID NO: 42517

SEQ ID NO: 170282 - RNA, 64 nt, Human; identical to SEQ ID NO: 42518

SEQ ID NO: 170283 - RNA, 64 nt, Human; identical to SEQ ID NO: 42519

SEQ ID NO: 170284 - RNA, 64 nt, Human; identical to SEQ ID NO: 42520

SEQ ID NO: 170285 - RNA, 64 nt, Human; identical to SEQ ID NO: 42521

SEQ ID NO: 170286 - RNA, 64 nt, Human; identical to SEQ ID NO: 42522

SEQ ID NO: 170287 - RNA, 64 nt, Human; identical to SEQ ID NO: 42523

SEQ ID NO: 170288 - RNA, 64 nt, Human; identical to SEQ ID NO: 42524

SEQ ID NO: 170289 - RNA, 64 nt, Human; identical to SEQ ID NO: 42525

SEQ ID NO: 170290 - RNA, 64 nt, Human; identical to SEQ ID NO: 42454

SEQ ID NO: 170291 - RNA, 64 nt, Human; identical to SEQ ID NO: 42455

SEQ ID NO: 170292 - RNA, 64 nt, Human; identical to SEQ ID NO: 42456

SEQ ID NO: 170293 - RNA, 64 nt, Human; identical to SEQ ID NO: 42457

SEQ ID NO: 170294 - RNA, 64 nt, Human; identical to SEQ ID NO: 42458

SEQ ID NO: 170295 - RNA, 64 nt, Human; identical to SEQ ID NO: 42459

SEQ ID NO: 170296 - RNA, 64 nt, Human; identical to SEQ ID NO: 42460

SEQ ID NO: 170297 - RNA, 64 nt, Human; identical to SEQ ID NO: 42461

SEQ ID NO: 170298 - RNA, 64 nt, Human; identical to SEQ ID NO: 42462

SEQ ID NO: 170299 - RNA, 64 nt, Human; identical to SEQ ID NO: 42463

SEQ ID NO: 170300 - RNA, 64 nt, Human; identical to SEQ ID NO: 42464

SEQ ID NO: 170301 - RNA, 64 nt, Human; identical to SEQ ID NO: 42465

SEQ ID NO: 170302 - RNA, 64 nt, Human; identical to SEQ ID NO: 42466

SEQ ID NO: 170303 - RNA, 64 nt, Human; identical to SEQ ID NO: 42467

SEQ ID NO: 170304 - RNA, 64 nt, Human; identical to SEQ ID NO: 42468

SEQ ID NO: 170305 - RNA, 64 nt, Human; identical to SEQ ID NO: 42469

SEQ ID NO: 170306 - RNA, 64 nt, Human; identical to SEQ ID NO: 42470

SEQ ID NO: 170307 - RNA, 64 nt, Human; identical to SEQ ID NO: 42471

SEQ ID NO: 170308 - RNA, 64 nt, Human; identical to SEQ ID NO: 42472

SEQ ID NO: 170309 - RNA, 64 nt, Human; identical to SEQ ID NO: 42473

SEQ ID NO: 170310 - RNA, 64 nt, Human; identical to SEQ ID NO: 42474

SEQ ID NO: 170311 - RNA, 64 nt, Human; identical to SEQ ID NO: 42475

SEQ ID NO: 170312 - RNA, 64 nt, Human; identical to SEQ ID NO: 42476

SEQ ID NO: 170313 - RNA, 64 nt, Human; identical to SEQ ID NO: 42477

SEQ ID NO: 170314 - RNA, 64 nt, Human; identical to SEQ ID NO: 42478

SEQ ID NO: 170315 - RNA, 64 nt, Human; identical to SEQ ID NO: 42479

SEQ ID NO: 170316 - RNA, 64 nt, Human; identical to SEQ ID NO: 42480

SEQ ID NO: 170317 - RNA, 64 nt, Human; identical to SEQ ID NO: 42481

SEQ ID NO: 170318 - RNA, 64 nt, Human; identical to SEQ ID NO: 42482

SEQ ID NO: 170319 - RNA, 64 nt, Human; identical to SEQ ID NO: 42483

SEQ ID NO: 170320 - RNA, 64 nt, Human; identical to SEQ ID NO: 42484

SEQ ID NO: 170321 - RNA, 64 nt, Human; identical to SEQ ID NO: 42485

SEQ ID NO: 170322 - RNA, 64 nt, Human; identical to SEQ ID NO: 42486

SEQ ID NO: 170323 - RNA, 64 nt, Human; identical to SEQ ID NO: 42487

SEQ ID NO: 170324 - RNA, 64 nt, Human; identical to SEQ ID NO: 42488

SEQ ID NO: 170325 - RNA, 64 nt, Human; identical to SEQ ID NO: 42489

SEQ ID NO: 170326 - RNA, 64 nt, Human; identical to SEQ ID NO: 42490

SEQ ID NO: 170327 - RNA, 64 nt, Human; identical to SEQ ID NO: 42491

SEQ ID NO: 170328 - RNA, 64 nt, Human; identical to SEQ ID NO: 42492

SEQ ID NO: 170329 - RNA, 64 nt, Human; identical to SEQ ID NO: 42493

SEQ ID NO: 170330 - RNA, 64 nt, Human; identical to SEQ ID NO: 42494

SEQ ID NO: 170331 - RNA, 64 nt, Human; identical to SEQ ID NO: 42495

SEQ ID NO: 170332 - RNA, 64 nt, Human; identical to SEQ ID NO: 42496

SEQ ID NO: 170333 - RNA, 64 nt, Human; identical to SEQ ID NO: 42497

SEQ ID NO: 170334 - RNA, 64 nt, Human; identical to SEQ ID NO: 42498

SEQ ID NO: 170335 - RNA, 64 nt, Human; identical to SEQ ID NO: 42499

SEQ ID NO: 170336 - RNA, 64 nt, Human; identical to SEQ ID NO: 42500

SEQ ID NO: 170337 - RNA, 64 nt, Human; identical to SEQ ID NO: 42501

SEQ ID NO: 170338 - RNA, 64 nt, Human; identical to SEQ ID NO: 42502

SEQ ID NO: 170339 - RNA, 64 nt, Human; identical to SEQ ID NO: 42503

SEQ ID NO: 170340 - RNA, 50 nt, Human; identical to SEQ ID NO: 42504

SEQ ID NO: 170341 - RNA, 64 nt, Human; identical to SEQ ID NO: 42505

SEQ ID NO: 170342 - RNA, 64 nt, Human; identical to SEQ ID NO: 42506

SEQ ID NO: 170343 - RNA, 64 nt, Human; identical to SEQ ID NO: 42507

SEQ ID NO: 170344 - RNA, 64 nt, Human; identical to SEQ ID NO: 42508

SEQ ID NO: 170345 - RNA, 64 nt, Human; identical to SEQ ID NO: 42509

SEQ ID NO: 170346 - RNA, 64 nt, Human; identical to SEQ ID NO: 42510

SEQ ID NO: 170347 - RNA, 64 nt, Human; identical to SEQ ID NO: 42511

SEQ ID NO: 170348 - RNA, 64 nt, Human; identical to SEQ ID NO: 42512

SEQ ID NO: 170349 - RNA, 64 nt, Human; identical to SEQ ID NO: 42513

SEQ ID NO: 170350 - RNA, 64 nt, Human; identical to SEQ ID NO: 42514

SEQ ID NO: 170351 - RNA, 64 nt, Human; identical to SEQ ID NO: 42515

SEQ ID NO: 170352 - RNA, 64 nt, Human; identical to SEQ ID NO: 42516

SEQ ID NO: 170353 - RNA, 64 nt, Human; identical to SEQ ID NO: 42517

SEQ ID NO: 170354 - RNA, 64 nt, Human; identical to SEQ ID NO: 42518

SEQ ID NO: 170355 - RNA, 64 nt, Human; identical to SEQ ID NO: 42519

SEQ ID NO: 170356 - RNA, 64 nt, Human; identical to SEQ ID NO: 42520

SEQ ID NO: 170357 - RNA, 64 nt, Human; identical to SEQ ID NO: 42521

SEQ ID NO: 170358 - RNA, 64 nt, Human; identical to SEQ ID NO: 42522

SEQ ID NO: 170359 - RNA, 64 nt, Human; identical to SEQ ID NO: 42523

SEQ ID NO: 170360 - RNA, 64 nt, Human; identical to SEQ ID NO: 42524

SEQ ID NO: 170361 - RNA, 64 nt, Human; identical to SEQ ID NO: 42525

SEQ ID NO: 170362 - RNA, 64 nt, Human
aguuuuuccaggguggccuaucauugggguaugaguggcugacugccaucuccaugccugagag

SEQ ID NO: 170363 - RNA, 64 nt, Human
cuggggggaguggggaagagggaguggaaggacaguggcugaggggcuuccuguugcagccuuc

SEQ ID NO: 170364 - RNA, 64 nt, Human
augcugcuucuguuuaacagugaugcaacauuauguggcugaaaaagaauauaaaaagcuagac

SEQ ID NO: 170365 - RNA, 64 nt, Human
cucugaucguaggaauugaggagugucccgccuuguggcugagaacuggacaguggcaggggcu

SEQ ID NO: 170366 - RNA, 64 nt, Human
gacuaguccugagauggaaacagcaacuuguacaguggcugagaaaauaggauauaguuuugau

SEQ ID NO: 170367 - RNA, 64 nt, Human
cgaaccugggaccccuccucugaugaacacuacaguggcugaggcaucagcccccgcccaggcc

SEQ ID NO: 170368 - RNA, 64 nt, Human
cauauaaaugucagcacuaaguaaugucuuguuuguggcugaauauuuuucguagauguuuuug

SEQ ID NO: 170369 - RNA, 64 nt, Human
gacaaacaauaugauuugcuguuaccaaaucucaguggcugauucugaacaauuguggucucuc

SEQ ID NO: 170370 - RNA, 64 nt, Human
gcugugguuuuuaaaggagcgcccacgaaguguaguggcugacgauuucaaccucacacagcag

SEQ ID NO: 170371 - RNA, 64 nt, Human
agguaaggaugaagaagaacaggaacucucacugguggcugaugggauugcaaagcgucagggc

SEQ ID NO: 170372 - RNA, 64 nt, Human
ccccgggugccaccagugugggagagcuggagccguggcugagcucagcuggagggagccuggc

SEQ ID NO: 170373 - RNA, 64 nt, Human
uugcugaccccucggagcaagcgccgcacaggugguggcugagacagcuggcgcggggggcccc

SEQ ID NO: 170374 - RNA, 64 nt, Human
gacacaucccggccucuuccacccauucccccauguggcugaagacauuccaacaauggggugg

SEQ ID NO: 170375 - RNA, 64 nt, Human
cagacuauuauucggccauuaaaaaaaaaaaagaguggcugacaccuguaaucucagcacuuug

SEQ ID NO: 170376 - RNA, 64 nt, Human
augguggcucaugccuguaaucccaacacuuaggguggcugaggcaggcagaucaccugggguc

SEQ ID NO: 170377 - RNA, 64 nt, Human
aacucccaucuccagaagcaccucaacaaugucaguggcugaggcugcacucagagggaugacu

SEQ ID NO: 170378 - RNA, 64 nt, Human
aaagaccuggcagguccugaaucaaaacaacagaguggcugaaagucacaccucuccagcuccu

SEQ ID NO: 170379 - RNA, 64 nt, Human
auaauagaaacagcaggucuugucagcuccuuguguggcugaugugucuggaaaugauguaguu

SEQ ID NO: 170380 - RNA, 64 nt, Human
aggcuuaggugaccccccaaccucauccucccagguggcugaaacuacaggcacaugccaccau

SEQ ID NO: 170381 - RNA, 64 nt, Human
guggcuccuugggucuguuucauucuaaaacgaaguggcugaguucggcugucauuuaagagaa

SEQ ID NO: 170382 - RNA, 64 nt, Human
accagcaaaaaaugucucucccauuuuucugaaaguggcugauguaagaacaggcagaaggaaa

SEQ ID NO: 170383 - RNA, 64 nt, Human
gucuucucacauagagauuaaccaacaaacuuguguggcugacuuuuguguaagaaucauaguu

SEQ ID NO: 170384 - RNA, 64 nt, Human
cuccagaaacggccauucagcaagacaacacgugguggcugauaccgaauugugacucggcuag

SEQ ID NO: 170385 - RNA, 64 nt, Human
auccaaaaauaaaugcgaacaugcauacauaaauguggcugagggccacuuuugccaucacugu

SEQ ID NO: 170386 - RNA, 64 nt, Human
cucuagagauucugauucgguugaucugggguguguggcugaggcaucaguacuuuuuaaagcu

SEQ ID NO: 170387 - RNA, 64 nt, Human
cgagcugcggcgcccgcagcggaggagguuuucaguggcugauugaaacucacugcaaaaucac

SEQ ID NO: 170388 - RNA, 64 nt, Human
auugucugcaauacuaucccguugguauuucccaguggcugaaaaccugauuuucugcugcacg

SEQ ID NO: 170389 - RNA, 64 nt, Human
agccugcuggggggacccagcugcucuuggacaaguggcugagcuccuaucuggccuccucuuu

SEQ ID NO: 170390 - RNA, 64 nt, Human
ugaccccgcagccaguaugauuuuugauuacucaguggcugacuguuuugcucucuggauuacu

SEQ ID NO: 170391 - RNA, 64 nt, Human
uggguuuugucucugcaucucauuguagagcuugguggcugagcuuggcccuauuaagauaaau

SEQ ID NO: 170392 - RNA, 64 nt, Human
gaaggaggcgucuagggcuuugcucccaagggcuguggcugaugaugguaaauaagaacacaga

SEQ ID NO: 170393 - RNA, 64 nt, Human
ugaugaccugcugugucccucugagcacuacccaguggcugaaaacucugcaaaugggccacac

SEQ ID NO: 170394 - RNA, 64 nt, Human
cccaggccagcgaggcgaggcugccucugggugaguggcugacagagcaggucugcaggccacc

SEQ ID NO: 170395 - RNA, 64 nt, Human
uaauuuaacuuucuggguugccuuuauuuuuggcguggcugacuuacaucauguguuggggaag

SEQ ID NO: 170396 - RNA, 64 nt, Human
augguggcauauaccuguaaccccaacuacuuggguggcugaggcaggagaauuguuugaaccu

SEQ ID NO: 170397 - RNA, 60 nt, Human
aaacugaggauguucucugaauggacauuuguggcugacuuucaugggcugguccaaugg

SEQ ID NO: 170398 - RNA, 64 nt, Human
gcggugacucacgccugaaaucccagcacuuuggguggcugaggcagguggauuacuugaggcc

SEQ ID NO: 170399 - RNA, 64 nt, Human
uguaguuuggacccaacugaauccugagugcucuguggcugacgcugucuacccgugggagaga

SEQ ID NO: 170400 - RNA, 64 nt, Human
ucaccagccaaguucaugccccucucgggccuuuguggcugagaagugggacagaaagaugauu

SEQ ID NO: 170401 - RNA, 64 nt, Human
cacacacagacccacagcuuugaaugaucauguuguggcugagcagccgcuuuuuagacguuau

SEQ ID NO: 170402 - RNA, 64 nt, Human
ugguuggauccguuuuguagcugcuucccaucagguggcugaacugguaaaggagcuucguugc

SEQ ID NO: 170403 - RNA, 64 nt, Human
uccaaguaaccaaauucccccaaagacaggagguguggcugauggguacacaugcuugguaaga

SEQ ID NO: 170404 - RNA, 64 nt, Human
aaagccugaacccguucuucucugguucaagucaguggcugacacggacuuguaucuccuucag

SEQ ID NO: 170405 - RNA, 64 nt, Human
aaggguauaggaaaauauaccuaaaagcgaauuuguggcugagaggauaaacagaagcuguuug

SEQ ID NO: 170406 - RNA, 64 nt, Human
agacuaaagaguuauguuggauaguuuuauuucuguggcugaaaauaaaaucuugucuagcaca

SEQ ID NO: 170407 - RNA, 64 nt, Human
gucuuaauauuaaauauaugauuagccaggcacgguggcugacaccuguaaucccagcacuuug

SEQ ID NO: 170408 - RNA, 64 nt, Human
agccucuucggugaucuuuggucugaagggcuauguggcugagcggaagggugagagggaggag

SEQ ID NO: 170409 - RNA, 64 nt, Human
aaagguagggcugagugauuaccuuagccacaggguggcugagcaggaacuuuagaagaaaauc

SEQ ID NO: 170410 - RNA, 64 nt, Human
ucauccuccuucucaaaaaggaucacgcgaaaggguggcugaggcucuugaaacaggacguccg

SEQ ID NO: 170411 - RNA, 64 nt, Human
acugaagcagaaacccugcacacgggcccaggauguggcugauuuugugguuccggggaguaug

SEQ ID NO: 170412 - RNA, 64 nt, Human
acacuuguauuauuaaagcacucaauaaaucacuguggcugauaacugcacuucugguaacccg

SEQ ID NO: 170413 - RNA, 64 nt, Human
ugaaucccccuugccaccccacccucccuggaguguggcugaggaggccuccaucucauguauc

SEQ ID NO: 170414 - RNA, 64 nt, Human
ggcuagugcuggagaaaguaccgggaagaaggagguggcugagaagagccagaucaaccucauu

SEQ ID NO: 170415 - RNA, 64 nt, Human
cugaguccucugagguucugcuguugaguccuggguggcugauggaaugauugaggaggucugg

SEQ ID NO: 170416 - RNA, 64 nt, Human
ucuaggacaccuggauuggcuccaucacaucagaguggcugagggcaguugcucuguguuggug

SEQ ID NO: 170417 - RNA, 64 nt, Human
agaucuaaaauucguaacaaccuaaauuugagagguggcugaaaugugaugaaaagcaauacga

SEQ ID NO: 170418 - RNA, 64 nt, Human
ggugccuguagugugaugugucugaacuaauaaaguggcugaagaggcaggauggcuuggggcu

SEQ ID NO: 170419 - RNA, 64 nt, Human
agccucccaauagggauaaauuuagggugacuguguggcugacuauucugcuuccucaggcaac

SEQ ID NO: 170420 - RNA, 64 nt, Human
cgucuuuggcuauuuguaugguuuaagaacacugguggcugagaugcuauaaaaacagcucggc

SEQ ID NO: 170421 - RNA, 64 nt, Human
ggccuagccaugggccagagauggaggagccccaguggcugacaggccagccucacucaggcac

SEQ ID NO: 170422 - RNA, 64 nt, Human
guuucucuaaagauuuuggcaagacucaagcaauguggcugacuguaacuuuauuaauuuaaaa

SEQ ID NO: 170423 - RNA, 64 nt, Human
uuauaccacugucuugggcuaaaauaaacagguuguggcugaugguguugaagauaaauaagcu

SEQ ID NO: 170424 - RNA, 64 nt, Human
ggcagccuugucuuaugggcgcauaugugcguguguggcugagucucugacagcugugagugug

SEQ ID NO: 170425 - RNA, 64 nt, Human
ggccaggagguggcucuggcucagagccgucaguguggcugaauaaaggcucucuuggguaugg

SEQ ID NO: 170426 - RNA, 64 nt, Human
gccacuacuuugagcagcuccauuacaaugacauguggcugaagguuggcgacugugucuucau

SEQ ID NO: 170427 - RNA, 64 nt, Human
cuagcacacuaggacccaggugguacccuacucaguggcugagaauuggauaaagucuugggaa

SEQ ID NO: 170428 - RNA, 64 nt, Human
uuuucugcuaugguaugaaucaucuguuuaugaaguggcugaacaagcagaaacagcccuucau

SEQ ID NO: 170429 - RNA, 64 nt, Human
cuuuuucaaaggaacauauucaauuuggcuuuuuguggcugaaaaaacauaacuguuagaccca

SEQ ID NO: 170430 - RNA, 64 nt, Human
gcauuugcaaauuucccauuguuuuaacagcuguguggcugacuuucaauuuuaagacgugaau

SEQ ID NO: 170431 - RNA, 64 nt, Human
ccugcagaguggcaggggugaaaggaagaaggaaguggcugaguuauuaauagccagagccacu

SEQ ID NO: 170432 - RNA, 64 nt, Human
gagcuguguagugagggauacugagggcaguccuguggcugaggggcacagauugaacugcuga

SEQ ID NO: 170433 - RNA, 64 nt, Human
gaugaaugacuggcaugaacacgucuuugaaguuguggcugagaagaugagaggaauauuuaaa

SEQ ID NO: 170434 - RNA, 64 nt, Human
aaguagagcaagcccccuuucucuucccaaucacguggcugaguguggaugacuuuuauuuuag

SEQ ID NO: 170435 - RNA, 64 nt, Human
aagaaaggcccaacuaccgucucgagugccugcaguggcugaagagccagccucgguggcccag

SEQ ID NO: 170436 - RNA, 64 nt, Human
gacuuucauuguucuuggcugaggagaagcgggaguggcugauggaagcaccuaaaugaugccu

SEQ ID NO: 170437 - RNA, 64 nt, Human
ggcacuuggacucacucagaacugucgcucaccuguggcugacacacccagcccuggaaacggg

SEQ ID NO: 170438 - RNA, 64 nt, Human
ggccagccccgagccagccccagacccagccccgguggcugaagaggcugcccccucagcuguc

SEQ ID NO: 170439 - RNA, 64 nt, Human
uucagugccuuggagcagaaagccaggguccugaguggcugaaauaaaagccucugguggaacc

SEQ ID NO: 170440 - RNA, 64 nt, Human
uugcuuccuaggccuggcugaguugugccuaaggguggcugaaauacuaaaacacuuaucuuac

SEQ ID NO: 170441 - RNA, 64 nt, Human
augguaaccuuuuuaauagaguaugugaaagguaguggcugaugaauccuuaacguucauaggg

SEQ ID NO: 170442 - RNA, 64 nt, Human
cuaguuuauggcaaaaauagccauuuuccaagugguggcugacuguugcagggaaugagaauuu

SEQ ID NO: 170443 - RNA, 64 nt, Human
caccagcagcucuugcccagagcugugcagugcaguggcugauucuauuagagaacguaugcgu

SEQ ID NO: 170444 - RNA, 64 nt, Human
uguuacuaggguggccucucucccauuucccgcuguggcugagccaaacuucauuacuuuccuu

SEQ ID NO: 170445 - RNA, 64 nt, Human
uauuggauuccaaacugcuaugcccucuauaccaguggcugacaaggcauauagggauauaugc

SEQ ID NO: 170446 - RNA, 64 nt, Human
caaacucaucuucuaaaaucugugcauuuccaugguggcugacacacuugucauguggucuguu

SEQ ID NO: 170447 - RNA, 64 nt, Human
guuguaaaaacaaauaauuuuaauaguauauucaguggcugaagugauagggaguauuaaucau

SEQ ID NO: 170448 - RNA, 64 nt, Human
ggcuuacccagaguggagcacaccuccagggcauguggcugacacugggucaaugucugcaucu

SEQ ID NO: 170449 - RNA, 64 nt, Human
cagaaauguaugggugcaccgggccgagggaaggguggcugagugagaggcguauaaaaugggg

SEQ ID NO: 170450 - RNA, 64 nt, Human
ccgcggguaaacuagcuuugcucuuuagaugcaaguggcugaggccaauaggugccuaguaaau

SEQ ID NO: 170451 - RNA, 64 nt, Human
aaggggauuguuugaggggggcacucagucacauguggcugaggccaaagagaaugaagauaua

SEQ ID NO: 170452 - RNA, 64 nt, Human
uuuguggcacccagcuccaugcuuugaauacuauguggcugaaugaauuuuuaaaaucucaaag

SEQ ID NO: 170453 - RNA, 64 nt, Human
aucuauccugccauuuaaccccacaguuaauaaaguggcugaaaauaauaguagcucuggcuug

SEQ ID NO: 170454 - RNA, 64 nt, Human
cucuuccucagcauccaccccgugacacguagugguggcugaugucgccacaguaccaugaggu

SEQ ID NO: 170455 - RNA, 64 nt, Human
cagcucugagucuuuuggaggacagggacgguuuguggcugagauaaguguuuccuggcaaaac

SEQ ID NO: 170456 - RNA, 64 nt, Human
ugccaugagagcacauguccucuggccaggaguaguggcugagcucugugaucgcugugaugug

SEQ ID NO: 170457 - RNA, 64 nt, Human
caguuggcaaggagucaguacucagucccugaguguggcugaaauuugagguccuggcugagcc

SEQ ID NO: 170458 - RNA, 64 nt, Human
ugggccgggaggggacuagaagagcugcaugaugguggcugagacagggucaccuugggaaggc

SEQ ID NO: 170459 - RNA, 64 nt, Human
gcccgugccgccugaagagcugcagccagaacagguggcugagcuguggggccggggugaccgg

SEQ ID NO: 170460 - RNA, 64 nt, Human
ugcauggccacucuugcccccaagggcccaggcuguggcugacacauagaagguggccacauag

SEQ ID NO: 170461 - RNA, 64 nt, Human
cugacaccacagucaauuaauuccucaggggccuguggcugaagaaaaggugcccagcccccac

SEQ ID NO: 170462 - RNA, 64 nt, Human
caacugaguaagaaggggcuggugcccagucgggguggcugagcugguccuuaauagguuguuu

SEQ ID NO: 170463 - RNA, 64 nt, Human
ccccuaugagcuguggaacgagacuucugcagagguggcugaccucaagaagcagguacaggcc

SEQ ID NO: 170464 - RNA, 64 nt, Human
ccuucuucugagugaauguuaacaugcgcauuuuguggcugauuucaaaugcaguccagugaga

SEQ ID NO: 170465 - RNA, 64 nt, Human
gacuuccauaagaguaaauaaaaaugaauaugcaguggcugacauuguuuuaaagucacuggua

SEQ ID NO: 170466 - RNA, 64 nt, Human
aaaacucucucuauaaaaaauuuccauagaguauguggcugauaaacaacagaaauuuguuucu

SEQ ID NO: 170467 - RNA, 64 nt, Human
guuccguuucuuuaaugugguugaagagcaauguguggcugaagacuuuuguuaugaggagcug

SEQ ID NO: 170468 - RNA, 64 nt, Human
cacggacuucggagcauagaguggcgcugagugaguggcugagaccgaccacgguucuugacuu

SEQ ID NO: 170469 - RNA, 64 nt, Human
cgcuguccgaggagcuccaugcggcacugagugaguggcugacagcgauccgggcuugguuuug

SEQ ID NO: 170470 - RNA, 64 nt, Human
gcuuuucuucucacuucaugugaaaacuacuccaguggcugacugaauugcugacccuucaagc

SEQ ID NO: 170471 - RNA, 64 nt, Human
gacccagcagccuccaggaaguccauacccugggguggcugagaccuuggcucuguauggaggc

SEQ ID NO: 170472 - RNA, 64 nt, Human
ccagcagggaaaaugcagcagggaugcccuggagguggcugagccccugucuagagagggaggc

SEQ ID NO: 170473 - RNA, 64 nt, Human
guucuggggauugggcccugagagggcuaguucuguggcugaaaauaaagcaugucccgccccc

SEQ ID NO: 170474 - RNA, 64 nt, Human
gguguauuuuuuagugguuauuuuagaaguugaaguggcugaaauuuugucuauugucuuagaa

SEQ ID NO: 170475 - RNA, 64 nt, Human
auuaacguuuuuuauuuaguuucuuuagccaauaguggcugaguuucgcacuugauuuucaaua

SEQ ID NO: 170476 - RNA, 64 nt, Human
agugaauauuugcauuuccauuaucuaugaauuaguggcugaguucuuucuuagcugcuuuaag

SEQ ID NO: 170477 - RNA, 64 nt, Human
auccacccuacugguuaucugauagaacaagcugguggcugaugggugacugcuaggcgugacu

SEQ ID NO: 170478 - RNA, 64 nt, Human
ugaagcucuaacaccacacuccagcuacuguguaguggcugaaauauaucagcccauguuagac

SEQ ID NO: 170479 - RNA, 61 nt, Human
cccugacuaaugugaucuaaagugcagcagaguggcugaugcugcaaguuaugucuaaggc

SEQ ID NO: 170480 - RNA, 64 nt, Human
agcacggcugaaaggagcugccugggcaccugagguggcugaggcucaucuuugaggagcaugg

SEQ ID NO: 170481 - RNA, 64 nt, Human
ucgggugccaggacaaugaaauacuccagcaccuguggcugacgaauuuguuucuacagaaaua

SEQ ID NO: 170482 - RNA, 64 nt, Human
ucuuuuaaaauacauuuuauuuggggaggaacauguggcugagcagacuuuuguauaauauuac

SEQ ID NO: 170483 - RNA, 64 nt, Human
cccggcuucaccuucccagaacaagaauguggugguggcugacuucgggcuggcgcgucucaug

SEQ ID NO: 170484 - RNA, 64 nt, Human
agagagggcugaucccauggggcggagguccccaguggcugagcaaacagccccuucucucgcu

SEQ ID NO: 170485 - RNA, 64 nt, Human
aaaauagacuguuuuaaaguuucagggaaaguugguggcugauuuaaaguugugcaggaaacau

SEQ ID NO: 170486 - RNA, 64 nt, Human
augauggcacaugcugguaauagcagcuacugagguggcugaggcacaagaauugcuuggaccc

SEQ ID NO: 170487 - RNA, 64 nt, Human
gaguaaguuugugguuuguuucugguuuacagugguggcugacaccccuuguaagaaagcauuc

SEQ ID NO: 170488 - RNA, 64 nt, Human
aaggugcggggccagcugcuaugugguggccgcuguggcugacacugagugaagguguuugaaa

SEQ ID NO: 170489 - RNA, 64 nt, Human
aaugaguaauauacaaaaagguuuucauguauuuguggcugagagggcgggaaauaauugugua

SEQ ID NO: 170490 - RNA, 64 nt, Human
gccagggcaugcccgaguccugcaaggguggcggguggcugaggucacaccaccacuggagugg

SEQ ID NO: 170491 - RNA, 64 nt, Human
acgggagcaucaacucacaguuaggggacugggcguggcugauugaggguuuggaacugguggc

SEQ ID NO: 170492 - RNA, 64 nt, Human
guguuggcacacgccuguaauaccagcuacucagguggcugaggcauaagaauugcuugagccu

SEQ ID NO: 170493 - RNA, 64 nt, Human
uuuccuugucuaaagaucuuuuuuuaaguguucuguggcugauuuacuaacaguaacugccauu

SEQ ID NO: 170494 - RNA, 64 nt, Human
cugcaaaaagccaugaggaggccaagaagcugcuguggcugaugcggauucagaaagggcuccc

SEQ ID NO: 170495 - RNA, 64 nt, Human
ggguggcugcuggggggaugcuuagcucagagcaguggcugauggggacacugagauaagaucg

SEQ ID NO: 170496 - RNA, 64 nt, Human
gcagcgagagcgagaccugggagccagggcagggguggcugaccccaugcucagccucuagggg

SEQ ID NO: 170497 - RNA, 64 nt, Human
cucuacaaaaaaauuuaaaaauuaacugggcaugguggcugagguggaagaauggaagaaucac

SEQ ID NO: 170498 - RNA, 64 nt, Human
aaguuuuggcgagagugauauaaaaaaacugacuguggcugaaagaauugcauuuaaaaauauu

SEQ ID NO: 170499 - RNA, 64 nt, Human
ucacugugauuuccaccagagaaauuauagcagaguggcugagcaugugcucugaggccaggcc

SEQ ID NO: 170500 - RNA, 64 nt, Human
gugcccagccagcccugggagaacuggguagcagguggcugacuucuuuaagcaccuuucuaaa

SEQ ID NO: 170501 - RNA, 52 nt, Human
ccauuuggaaaggcgaauaaacguggcugagucugccaaguggaacugugcc

SEQ ID NO: 170502 - RNA, 64 nt, Human
uaccuccagucaggcuggacgggaggguagccuuguggcugagaggggucagacuagguggcac

SEQ ID NO: 170503 - RNA, 64 nt, Human
ggccccuggcugaacaacguccugugucuggcagguggcugagguccugugcucuggugugugg

SEQ ID NO: 170504 - RNA, 64 nt, Human
gacgggcagcgugggugggaccuggcacuucgugguggcugagccauccacccagcagcggccu

SEQ ID NO: 170505 - RNA, 64 nt, Human
uauguacccaccuaaaaccaucuuuaaaaugcuaguggcugauaugggugugggggaugcuaac

SEQ ID NO: 170506 - RNA, 64 nt, Human
aaagggucuccucucucaguugggggacaggccgguggcugacccaggauugcaccagcauguc

SEQ ID NO: 170507 - RNA, 64 nt, Human
agaguagagaaugcacagguguuggugagggcguguggcugagcacuacaugucaaguccagag

SEQ ID NO: 170508 - RNA, 64 nt, Human
auuggaaucuucuuccuauauuuuacaaacaucaguggcugaaauagcucagaguaagagcuca

SEQ ID NO: 170509 - RNA, 64 nt, Human
gucggggugggggugggaacucacguggggagcgguggcugagaaaauguaaggauucuggaau

SEQ ID NO: 170510 - RNA, 64 nt, Human
cuugguagaguuccuuucugggaagaaaguaggaguggcugaccaggcccugcucaucacccgg

SEQ ID NO: 170511 - RNA, 64 nt, Human
ucaucagggcaaagaucacagcagccagcuccugguggcugaugaggaucagagcauuuguucc

SEQ ID NO: 170512 - RNA, 64 nt, Human
augcuucaggacuacauaugacccagagagcaagguggcugaacuauagucuggaagcccucag

SEQ ID NO: 170513 - RNA, 64 nt, Human
gggaauaguugcauaugggaauuuaaaccaacauguggcugagccuuuuuuuuuuuaaucuucg

SEQ ID NO: 170514 - RNA, 64 nt, Human
caugaccacacuuagugagaaggagccacaaguuguggcugagaguucccugugaacuugagua

SEQ ID NO: 170515 - RNA, 64 nt, Human
ccaaugggacugacacuguuguacaaccugaccuguggcugagggugucugggcuuaagcaugu

SEQ ID NO: 170516 - RNA, 64 nt, Human
ugcagcacaugcgggcucgcccauacccgugacaguggcugacaagggacuagugagucagcac

SEQ ID NO: 170517 - RNA, 64 nt, Human
guggaaacccuccccucugagacuccacugagacguggcugagugaaaucuuccucgucagugg

SEQ ID NO: 170518 - RNA, 64 nt, Human
ugaggguugccacacacagugagggcggagcaggguggcugagggcacaggugccugggucugu

SEQ ID NO: 170519 - RNA, 64 nt, Human
cagugcagacauccaccguuccaccacagaaccaguggcugagcggaccaacguugccaugugc

SEQ ID NO: 170520 - RNA, 64 nt, Human
gcagccuuccagauuuagaggcacugggaggacaguggcugaguggaggcgcccagaccugggc

SEQ ID NO: 170521 - RNA, 64 nt, Human
gucauuuuuuuuuuaagacagucauuuuaaaaugguggcugaauuucccaacccacccccaaac

SEQ ID NO: 170522 - RNA, 64 nt, Human
gaaagcuauguaugaagaauccuguucauacgggguggcugaaaguaaagaggaacuagacuuu

SEQ ID NO: 170523 - RNA, 64 nt, Human
cgaugugaaggaugaaucuggcuugaccuucuggguggcugaugggccauuuacugagaugggg

SEQ ID NO: 170524 - RNA, 64 nt, Human
gucaacccuuuucaguguaagaucagcacauuugguggcugaugcuguucuccuuugacuguac

SEQ ID NO: 170525 - RNA, 64 nt, Human
ggacaugcagcggcuccuaaauguagagaugccuguggcugagggggccucucuaccugugucc

SEQ ID NO: 170526 - RNA, 64 nt, Human
guauguuucuuagccccuuggauuccugcacgaaguggcugaugggaaccauuucaagacagau

SEQ ID NO: 170527 - RNA, 64 nt, Human
ugcagaggccacucuugaagagcagacucccucuguggcugaugggacuaauuauucccacuag

SEQ ID NO: 170528 - RNA, 64 nt, Human
agcagacaugaggcagcauuuccuccacacuaggguggcugagagggguccugggguguuucag

SEQ ID NO: 170529 - RNA, 64 nt, Human
ggcaccgacagcgcugcgagccaggcucuggguaguggcugaggccagaggcccaucgccugcc

SEQ ID NO: 170530 - RNA, 64 nt, Human
ggacacuguguuauaagaggcgugggcuccccugguggcugaccaggucagcugcccuggccuu

SEQ ID NO: 170531 - RNA, 64 nt, Human
cagcacagccaucccuugcaaaccaccaagguguguggcugaccuccagggaggagcacucacu

SEQ ID NO: 170532 - RNA, 64 nt, Human
gcugggacaccgcuugggcuuugguauugacugaguggcugacaguuaucuuccaaccccaacu

SEQ ID NO: 170533 - RNA, 64 nt, Human
uagaauucuuuucaaaaguuaacuuaucuccaaaguggcugaaaauauuguuuaccauuacaug

SEQ ID NO: 170534 - RNA, 64 nt, Human
gcugccuuugugugugggguaccugggaaaggguguggcugaggcagucauaaugcaguaucuu

SEQ ID NO: 170535 - RNA, 64 nt, Human
ucuuuaugccuuauuuagcucuugccaaacugcaguggcugagcaauuggacaagauaaagaaa

SEQ ID NO: 170536 - RNA, 64 nt, Human
cccacagcccugagagaugguguugcuagcucagguggcugacacaugggguaugccgggcacu

SEQ ID NO: 170537 - RNA, 64 nt, Human
uuggggcaggguuagcagauggcagcccuucucuguggcugacaggucacugagugauaagcau

SEQ ID NO: 170538 - RNA, 64 nt, Human
gcagcucgugugggcgcucguccacaaacacuccguggcugagaggcagcggauccaggcagcg

SEQ ID NO: 170539 - RNA, 64 nt, Human
ugccuggacuugagucucacccuacagaugagagguggcugaggcaccagggcuaagcaauuaa

SEQ ID NO: 170540 - RNA, 64 nt, Human
uaagacaccaaccuuuacauucuucccugagguuguggcugacagagccugcuuggccccacug

SEQ ID NO: 170541 - RNA, 64 nt, Human
cauuuuuucuucugaagauucuuaaaaauugaauguggcugaaguugaacaugggagcuuauug

SEQ ID NO: 170542 - RNA, 64 nt, Human
cugagcucauguggugcccccuuuccuugucugaguggcugaggcugauaccccugaccuaucu

SEQ ID NO: 170543 - RNA, 64 nt, Human
agccguggccgaguggacagcguggccgucugcuguggcugaaggcagcuuccacagcucacuc

SEQ ID NO: 170544 - RNA, 64 nt, Human
uugcugugacauugauucagauguuuggcaagagguggcugagcacuggggugggcuuggcacu

SEQ ID NO: 170545 - RNA, 64 nt, Human
guucucuaugcaagauggagagaggaugcacccuguggcugaucccauccgucccucggagcaa

SEQ ID NO: 170546 - RNA, 64 nt, Human
gccuuggagggguggcagcggaaggacagcccagguggcugaggccugaugggaagccggggaa

SEQ ID NO: 170547 - RNA, 64 nt, Human
ccauggaagggggugugcacgugccucuguguguguggcugaguguauucugcgcgugugugug

SEQ ID NO: 170548 - RNA, 64 nt, Human
agacuuuccaucgccuuuuccuuccaucaguugaguggcugagagagaagugccucaucccuga

SEQ ID NO: 170549 - RNA, 64 nt, Human
agccuagucucuggauuuggggagcuugucuucaguggcugagacugugagcugggagcaguuc

SEQ ID NO: 170550 - RNA, 64 nt, Human
ccaugagcuagguggaguaacugguuuuucuuggguggcugaugacauggaugcagcacagacu

SEQ ID NO: 170551 - RNA, 64 nt, Human
uggguacgugaagguagcagcugccuccuucucuguggcugaucuggcguccacaccccaggug

SEQ ID NO: 170552 - RNA, 60 nt, Human
agucaucguuugugaucugagacccgcgguguggcugagagcgcacagagcgcacgugca

SEQ ID NO: 170553 - RNA, 64 nt, Human
ggccauggagggcugaccuccguuucuggggaauguggcugagcugugguaaccagcuacaccc

SEQ ID NO: 170554 - RNA, 64 nt, Human
aaugugucuuguacugaauaauagaucauuggucguggcugaaacaucugucaauaaaauggcu

SEQ ID NO: 170555 - RNA, 64 nt, Human
agauagcagggcaugaaaacuuagagagguacaaguggcugaaaaucgaguuuuuccucugucu

SEQ ID NO: 170556 - RNA, 64 nt, Human
gccucuccucccucacuacugggugcugcccugcguggcugaccagcuggcccaggauuucaca

SEQ ID NO: 170557 - RNA, 64 nt, Human
uggagaguguuuaugguuucaggaaaagaacuuuguggcugaggggucaguuaccagugaccuu

SEQ ID NO: 170558 - RNA, 64 nt, Human
gucuuuaccugcuucguauccuuucccugcugauguggcugaccccucucccaccccucccugc

SEQ ID NO: 170559 - RNA, 64 nt, Human
ccuuugccuguggguaggaagagaauggcugccaguggcugaugggucccggugaugggaaggg

SEQ ID NO: 170560 - RNA, 64 nt, Human
aaagagaaguucaacucauaaacgugauugauagguggcugauuuauuuagguuuugucaagcu

SEQ ID NO: 170561 - RNA, 64 nt, Human
ucuucucucuguucccuuccucacccccgacgguguggcugaugaugucuucuggugucauggu

SEQ ID NO: 170562 - RNA, 50 nt, Human
ggguucgggaggagcugugaguggcugagccagcuccuugaggauguggc

SEQ ID NO: 170563 - RNA, 64 nt, Human
ucucuuccagacucauagcaucaguggauaccauguggcugagaaaagaacuguuugagugcca

SEQ ID NO: 170564 - RNA, 64 nt, Human
guuguacuuuagacuuugugagaaauucauaaagguggcugaguggauuugcaugcuuuagaac

SEQ ID NO: 170565 - RNA, 64 nt, Human
auagacccucaugcacgauucaaguuucacucuuguggcugaugccauuauugcacauuggcca

SEQ ID NO: 170566 - RNA, 64 nt, Human
gaguuggaggccaagggaaggggcagggaggggaguggcugaggcgaaguacccaugaagcugc

SEQ ID NO: 170567 - RNA, 64 nt, Human
aaagggauuugaccuaaucacuaauuuucaggugguggcugaugcuuugaacaucucuuugcug

SEQ ID NO: 170568 - RNA, 64 nt, Human
ccuaauucgagaggaaguaagaagggucuguucuguggcugagcuaggugaaccccgggguagg

SEQ ID NO: 170569 - RNA, 64 nt, Human
ugccucagcagagcucccaguuuuauucccaguuguggcugaaaagcaaagccauggcaucagu

SEQ ID NO: 170570 - RNA, 64 nt, Human
acaauugauauauugcuuuauucacacuuuuauuguggcugaauuuuugugccuaucuauaaaa

SEQ ID NO: 170571 - RNA, 64 nt, Human
uguuugagcucagacccccacucucauuccccagguggcugacccagucccugggggaagcccu

SEQ ID NO: 170572 - RNA, 64 nt, Human
cuuuugucccagggagggguccuguucggaagcaguggcugaauuuauccccugaaagugguuu

SEQ ID NO: 170573 - RNA, 64 nt, Human
gaaggauugggucuugucccccaacacagcuucuguggcugacuguaauacuguacaacuguuu

SEQ ID NO: 170574 - RNA, 64 nt, Human
gugguggugcacaccuguagucccuuacucccugguggcugaggcauuaucccuugaaccuggg

SEQ ID NO: 170575 - RNA, 64 nt, Human
ucggcacggacaccccugucuccaggaggggcagguggcugaggcucuucggagcugucagcgc

SEQ ID NO: 170576 - RNA, 64 nt, Human
ugcagagcccucaguuugucucccuuguuccucuguggcugaggugggagggggaggguggggu

SEQ ID NO: 170577 - RNA, 64 nt, Human
gcggccaggacagcagaggcugaggggccgggguguggcugagugaccagggugucacccacug

SEQ ID NO: 170578 - RNA, 64 nt, Human
cacagaccucgggaaggcgcugggccgagccaguguggcugagugaccggggugugcccggcag

SEQ ID NO: 170579 - RNA, 64 nt, Human
gccgaugucaggagggcugugucggguaaugcguguggcugaaugggcauaaccacuguggcuu

SEQ ID NO: 170580 - RNA, 64 nt, Human
accugccugcccuuucucccaaaaggacaaagagguggcugagagaguuuuggaauuugacauu

SEQ ID NO: 170581 - RNA, 64 nt, Human
guauccaaauagugcugcuagaaacugcacugaaguggcugaggauagguuccagugauagagu

SEQ ID NO: 170582 - RNA, 64 nt, Human
gcaacauuuaugguuauagguugauuuccuaaguguggcugaugguagccucuaguuugaagug

SEQ ID NO: 170583 - RNA, 64 nt, Human
guuccagucacugauugugguuuuagaaucuucuguggcugacuucuuguauucaacucugguu

SEQ ID NO: 170584 - RNA, 64 nt, Human
accagagagggauaucucaugaaauuugcaucugguggcugaacaguaccuauguucucuguuu

SEQ ID NO: 170585 - RNA, 64 nt, Human
cuagugccccaagcugcacuauugggaauggauuguggcugaacagcaaaucaaaacaccagaa

SEQ ID NO: 170586 - RNA, 64 nt, Human
ccccaccacaagcuggguuuuuuuccagcuuucuguggcugaggggcuggugagauuuuuuguu

SEQ ID NO: 170587 - RNA, 64 nt, Human
acuuuaaacauacauaaagagacaguaggacauuguggcugagucuacccagcucaagguaaag

SEQ ID NO: 170588 - RNA, 64 nt, Human
ugagugauuuauccucaccagacauuccugcuccguggcugaagagcagcaggaaguaagcuaa

SEQ ID NO: 170589 - RNA, 64 nt, Human
ugagauucugauucaugaagaaaagcagauagaaguggcugaaaaugaauucugagguauuuag

SEQ ID NO: 170590 - RNA, 64 nt, Human; identical to SEQ ID NO: 170589

SEQ ID NO: 170591 - RNA, 64 nt, Human
ggugacagguggguggagagcccuguuugagguuguggcugaucccucucugguauuaguuuuu

SEQ ID NO: 170592 - RNA, 64 nt, Human
acacauuuccaaaugugauuucuaauagcucaguguggcugagaaagugcggaacuccacuaaa

SEQ ID NO: 170593 - RNA, 64 nt, Human
uccuugagggaugaaccugggagcccaagagccaguggcugagcucugagaaggcuccaucucc

SEQ ID NO: 170594 - RNA, 64 nt, Human
agcaaagcagguggcccacagugaccuccaggagguggcugauuuuccuuugugccuucuuauu

SEQ ID NO: 170595 - RNA, 64 nt, Human
auuaccauugcuuccuccagcuugucagaaaccuguggcugaauccgcagggaugucaacguca

SEQ ID NO: 170596 - RNA, 64 nt, Human
guguugguguggcccauggcuguuggugggacccguggcugaugguguggccuguggcugucgg

SEQ ID NO: 170597 - RNA, 64 nt, Human
ugaggagaagucagugaagaacaccagcauccgaguggcugacuuuggcagugccacauuugac

SEQ ID NO: 170598 - RNA, 64 nt, Human
augacucugaacauuuauuuccauugcaauuucuguggcugaggagacuuaaacuuuacaagua

SEQ ID NO: 170599 - RNA, 64 nt, Human
gcaccacugcaaggggugggagccuggcuuggguguggcugagacucuggacagaggcuggggu

SEQ ID NO: 170600 - RNA, 64 nt, Human
gccgggugggcacuuugcugcuucuuucuggguuguggcugaugaggcccuaaguaaauaugug

SEQ ID NO: 170601 - RNA, 64 nt, Human
uucacuuuauauuguaaagaagguagguauauugguggcugaggucucuugaaauugcuaaagg

SEQ ID NO: 170602 - RNA, 64 nt, Human
gagccuccagacaggacaacccucuucaucacugguggcugagcuuuuucccagcaggaauggg

SEQ ID NO: 170603 - RNA, 64 nt, Human
gcuccugccggacccccagggugggccguggcagguggcugagcaggagcucccaagugccggc

SEQ ID NO: 170604 - RNA, 64 nt, Human
cccagugugugugaccagggcgggaggggccccaguggcugagcuccaagugccugcugaaguc

SEQ ID NO: 170605 - RNA, 64 nt, Human
ccaggcagaugauaccgaaaugcuuaaaggggcuguggcugaggcuguagcaucucugcuggag

SEQ ID NO: 170606 - RNA, 64 nt, Human
accucugcuugggcuucuccccagaaugcacuuuguggcugagugcuccaggacuccuagggag

SEQ ID NO: 170607 - RNA, 64 nt, Human
gcaaggccugggugagaauguuacaauugagucuguggcugauuacuucaagcagauugguauu

SEQ ID NO: 170608 - RNA, 64 nt, Human
agacuugagcagauguuucauuuuggccuggccaguggcugaaagccaggccuccaaugcacug

SEQ ID NO: 170609 - RNA, 64 nt, Human
aacauugccucucuggaucugcugugaccaggguguggcugacaccugggcuaccuccaaccua

SEQ ID NO: 170610 - RNA, 64 nt, Human
guggaacccaggacacagcaccugacugcacacaguggcugaaauccagcauuuuuacauagga

SEQ ID NO: 170611 - RNA, 64 nt, Human
cggacuggggacaacaguauuaauucgauugaauguggcugaugaugcaguugcuuagcuucuu

SEQ ID NO: 170612 - RNA, 64 nt, Human
ggcucuggaggcugccuguggucuccuuccggcuguggcugacaguggcucuggccaggguugc

SEQ ID NO: 170613 - RNA, 64 nt, Human
cuggggccugugcacuguugcguccaugcucagaguggcugagacuuguguccugaccaggccc

SEQ ID NO: 170614 - RNA, 64 nt, Human
aaaaaaaaucagagaaaagcccaccuuugaauacguggcugaagauaacagccaagaauugguc

SEQ ID NO: 170615 - RNA, 64 nt, Human
ggaugaggacgggugccugagcuuagguuguggaguggcugagagggcccaggagggcucggga

SEQ ID NO: 170616 - RNA, 64 nt, Human
gccuuucuucaugugugcgugcauaucagcccguguggcugacugauguauaggucccuggcau

SEQ ID NO: 170617 - RNA, 64 nt, Human
acuggucaaaguggcuguugggcuugucaagcccguggcugaaugacagugagcucucuugcug

SEQ ID NO: 170618 - RNA, 64 nt, Human
gugguggcacgcaccuguaguccccgcuacgcagguggcugaagcagaagaaucacuugaaccu

SEQ ID NO: 170619 - RNA, 64 nt, Human
uggugcaguaccugacaugagccagccacgcucaguggcugaacagcauucccacagccugcaa

SEQ ID NO: 170620 - RNA, 64 nt, Human
uacauaauaauccacguuuaaaaggagcgcacuuguggcugaucuaugccagaucaccaucuuc

SEQ ID NO: 170621 - RNA, 64 nt, Human
gggccucaugccccauucugggccuguggugcucguggcugaggcuccacagggcugcaagugc

SEQ ID NO: 170622 - RNA, 64 nt, Human
cugccccauuuccuccucaucugaucccccauagguggcugagcaucggaguggaguucguggg

SEQ ID NO: 170623 - RNA, 64 nt, Human
uggccaccggcggcccccacuugguggccggacaguggcugagcacguggaagccauugagggc

SEQ ID NO: 170624 - RNA, 64 nt, Human
uugggggaggguugccccucugccccucuguucuguggcugagcacuuucccaguccagggcag

SEQ ID NO: 170625 - RNA, 64 nt, Human
ugugcccagaauggaugaccaggaaccuuaaagaguggcugaaaagauugcagaguuaucauaa

SEQ ID NO: 170626 - RNA, 64 nt, Human
cucucccugccgugccucgguggugcuccugaauguggcugaccugggcugcugguuccguuga

SEQ ID NO: 170627 - RNA, 64 nt, Human
ucggcugcagguagagcacccuuguacagagaugguggcugaugucaaucucccugcagcacag

SEQ ID NO: 170628 - RNA, 64 nt, Human
uaaacuuaaaaucacaaacaugacauugcugauaguggcugagaaauucagaugagaagacaaa

SEQ ID NO: 170629 - RNA, 64 nt, Human
aaaaucuuaguacuuuuucugcggccuuugguuuguggcugaaagcuguugagugacucaucgc

SEQ ID NO: 170630 - RNA, 64 nt, Human
agaugcaaucaggaagguugggggacuugggacuguggcugaauugagaccuugcugauguauu

SEQ ID NO: 170631 - RNA, 61 nt, Human
cacagcuccuggacuucuagggaucucagccguggcugaggccacccccagaggagccccu

SEQ ID NO: 170632 - RNA, 64 nt, Human
auauuuccucuacagucaaggacuuuggcaugugguggcugaaacugagcuuuuuugugugggc

SEQ ID NO: 170633 - RNA, 64 nt, Human
aaggugauuuagaucaguagcucuuuugaagguuguggcugaccuguucauaccgugucgccuc

SEQ ID NO: 170634 - RNA, 64 nt, Human
cacugugacugacguuucucaaaguucauauuguguggcugaucugaagucagucggaauuugu

SEQ ID NO: 170635 - RNA, 64 nt, Human
aaauacauauguacauagauauaugggccucuguguggcugaacaguauauuuuguaaauauaa

SEQ ID NO: 170636 - RNA, 64 nt, Human
aauuauuuuaucaaagggcugaguugagaacacuguggcugaaauauaauuuuucuccccccua

SEQ ID NO: 170637 - RNA, 64 nt, Human
cacugcucaccugaggauaacucaauauaacuauguggcugaaaaugcaaagcugaagaccaug

SEQ ID NO: 170638 - RNA, 64 nt, Human
gggggcagugcugauggcauccagagucauugcuguggcugagcuggaaggaaaucaccaggug

SEQ ID NO: 170639 - RNA, 64 nt, Human
ucccccagcuguaagacagggacggggcggcccaguggcugagaggagccggcuguggagcccc

SEQ ID NO: 170640 - RNA, 64 nt, Human
gacguacgcauacuccaucgauguuguauuugcaguggcugaggaauucuuguacgcaguuuuc

SEQ ID NO: 170641 - RNA, 64 nt, Human
ccccgaaaccaaaggggaaggcagggguggggccguggcugaagccggcuccccaaccaaaaug

SEQ ID NO: 170642 - RNA, 64 nt, Human
ggcaggcucuggcacagugccugggacuggcaggguggcugagcggcugucuugccucuuguca

SEQ ID NO: 170643 - RNA, 64 nt, Human
ucugggcggagagaacaggaggaauggcugggaaguggcugagggagccaggaggccggggggc

SEQ ID NO: 170644 - RNA, 64 nt, Human
aauaugaaacaaucuggggaaauggccauacaugguggcugacgccuguaaucccagcacuuug

SEQ ID NO: 170645 - RNA, 64 nt, Human
uccgggucaagugaaggagcugggggcagccugcguggcugaccccccucaggacccucgcugg

SEQ ID NO: 170646 - RNA, 64 nt, Human
cuggacagggguggugggaagagcuugggcagaaguggcugaaaaacuaaggcaguggcaaagg

SEQ ID NO: 170647 - RNA, 64 nt, Human
gugagguccgggacucuugggucaucgucccacaguggcugaucggcugccaagcacagugggg

SEQ ID NO: 170648 - RNA, 64 nt, Human
gggcccccagccccuccccuggcugagcagcccuguggcugaaaugacuagcagauaaacagac

SEQ ID NO: 170649 - RNA, 64 nt, Human
ccgcuggaggccgaucccggugcacacggugcccguggcugaggauaaggucagggggcuggac

SEQ ID NO: 170650 - RNA, 64 nt, Human
ccauacggcacugaacaaggaagccucggcagauguggcugaaccgagcuggagccaacagaug

SEQ ID NO: 170651 - RNA, 64 nt, Human
gguagcacugcagcaacaucagggggaggacgugguggcugaacucuaguggggccgagacuau

SEQ ID NO: 170652 - RNA, 64 nt, Human
ucagagccgagacaccgcauuccugcuguuccgcguggcugagucugcauucguucguuacgcg

SEQ ID NO: 170653 - RNA, 64 nt, Human
agggcgagcuguucuggagagaaaaccaucugucguggcugagcggggagcuugaacacccagg

SEQ ID NO: 170654 - RNA, 64 nt, Human
ggcugacguugccuuguccggaggggcuugcaggguggcugaagcccuggggcagagaacagag

SEQ ID NO: 170655 - RNA, 64 nt, Human
ugaagacccccaaccacggccuaaaagccucuuuguggcugaaaggucccugugacauuuucug

SEQ ID NO: 170656 - RNA, 64 nt, Human
guauaauccagucucucuucucacuucugucaagguggcugauauaguccaugaaucccacuca

SEQ ID NO: 170657 - RNA, 64 nt, Human
ugacggcuacuguggagaugcaguggaggaccugguggcugagccaggagaugcacaccuucgc

SEQ ID NO: 170658 - RNA, 64 nt, Human
gggucuagaaagcggcuccugaaggucccuuauuguggcugauauuaacugucaaugguuaugg

SEQ ID NO: 170659 - RNA, 64 nt, Human
gaauagcagggaauuccucuacuacaggaagaagguggcugagauaagaaaggaagcacagaag

SEQ ID NO: 170660 - RNA, 64 nt, Human
uccugaagaagaccuggucccucuggagguugcaguggcugaaggaugcaucaugugcuccuac

SEQ ID NO: 170661 - RNA, 64 nt, Human
ccgggacacugaggcagcagaacuagugccagggguggcugaguuggagggcaagggcuggggc

SEQ ID NO: 170662 - RNA, 64 nt, Human
agcagagaaauauggccaacuccaccuuaaccaaguggcugaaagucacugcaccaguaauggc

SEQ ID NO: 170663 - RNA, 64 nt, Human
gugauuuuuuuucugaaacucacacaacuaggaaguggcugagucaggacuugaacccaggucu

SEQ ID NO: 170664 - RNA, 64 nt, Human
ucucccuggaucagaacaggagcucuuaacuacaguggcugaauagcuucuccaaaggcucccu

SEQ ID NO: 170665 - RNA, 64 nt, Human
cuuggcagcccuccuccaaagcccucuuccucacguggcugaggccaccgcugggacugcuccu

SEQ ID NO: 170666 - RNA, 64 nt, Human
ugucccagccccagguccugugcagggcaccugcguggcugacagccaggcucuuacuccagcc

SEQ ID NO: 170667 - RNA, 64 nt, Human
uauaaaagugaugaccuaucaugaggaaaugaaaguggcugauuugcugguaggauuuuguaca

SEQ ID NO: 170668 - RNA, 64 nt, Human
uggacaucagcacuacucuccugaggacucuucaguggcugagcagcuuuggacuuguuuguua

SEQ ID NO: 170669 - RNA, 64 nt, Human
uggacaccagcuguucccaggaguugacauaucaguggcugagcagcuccgugcauauuuguuc

SEQ ID NO: 170670 - RNA, 64 nt, Human
uuuccaguaggaaguuagauggggguucucagaaguggcugauuggaaggggacaagcuucguu

SEQ ID NO: 170671 - RNA, 64 nt, Human
gaacaccgcguuucauucuauuggucaauuccauguggcugacuaggucaauuuuuuuucugaa

SEQ ID NO: 170672 - RNA, 64 nt, Human
cuugucuguuuacuagcugcguggccuuggacggguggcugacaucuguaaagaauccuccugu

SEQ ID NO: 170673 - RNA, 64 nt, Human
gcgacgcgacgcagcagaggccggccuucccugaguggcugacgguccuccuacucugccucua

SEQ ID NO: 170674 - RNA, 64 nt, Human
gcacugugguuaacaggagggcugccuggaggcaguggcugagccagaaaguaacacagagcuc

SEQ ID NO: 170675 - RNA, 64 nt, Human
cucaucuuuuacugguuugaauuuuuucaaaccaguggcugauaccugccuuguacuuaguacc

SEQ ID NO: 170676 - RNA, 64 nt, Human
gaagaccccagagacauuuauuggggaguaggauguggcugagugcuuuuuuuuuggccagacu

SEQ ID NO: 170677 - RNA, 64 nt, Human
ucuaaaguuuuucuccugccugaucauuucauugguggcugaaggauucuagagaaccuuuugu

SEQ ID NO: 170678 - RNA, 64 nt, Human
gggaggcaggaggaugccugccuggacccuguugguggcugaagaccucuggccagcuggcuuc

SEQ ID NO: 170679 - RNA, 56 nt, Human
agcaucaggagcccagcugaucugcaguggcugacagcagggaggccaugugcuca

SEQ ID NO: 170680 - RNA, 64 nt, Human
uugugccauaaaggguugcuucauugcaggagggguggcugaaaccaccauccugggcugcauc

SEQ ID NO: 170681 - RNA, 64 nt, Human
caaaagcuggggaagcagggccugccuuacagguguggcugacucugagcccaggccugcaggg

SEQ ID NO: 170682 - RNA, 64 nt, Human
acccccacagacuggcaaacccugcaggacuuccguggcugaggcugugaccggaggccaggaa

SEQ ID NO: 170683 - RNA, 64 nt, Human
auccugcucuuuagaaaaagcagucuuugugcuuguggcugaacgcaucacccuggacucugcu

SEQ ID NO: 170684 - RNA, 64 nt, Human
agauacgcacagccccacccacucugagaugacaguggcugacuucccgugcugggcuuuucca

SEQ ID NO: 170685 - RNA, 64 nt, Human
cuuccucacagggggaugaccaagaaaucauuuuguggcugaguuuggccacgcccuuuggacu

SEQ ID NO: 170686 - RNA, 64 nt, Human
agucccagcuacuugggaggcugcagcuguggcuguggcugaagcuggcggaucgcuugaggcc

SEQ ID NO: 170687 - RNA, 50 nt, Human
augaugaaugggaugacugaguggcugaguuacuugcugcccugugcucc

SEQ ID NO: 170688 - RNA, 64 nt, Human
aaagaaggguccucaucuacauucucaaacaucuguggcugauaugauaugauucuuggaauuu

SEQ ID NO: 170689 - RNA, 64 nt, Human
aaaucagaguucuagcaauagaguccucucccaaguggcugaggcaggcuuaggggaaagaacc

SEQ ID NO: 170690 - RNA, 64 nt, Human
uugccaugacaucucaaagcaacagguaauugaaguggcugaguggauaccacguugugagguc

SEQ ID NO: 170691 - RNA, 64 nt, Human
agaauagcacuuuaccuuuugguuggcuagauaaguggcugacuaccuguuuuucucacugugg

SEQ ID NO: 170692 - RNA, 64 nt, Human
accugcacaccugcaaaacgagggaacaacuaagguggcugaagaccuuucuggcagggcauuu

SEQ ID NO: 170693 - RNA, 64 nt, Human
guucccuguccccagcacuguccccauggagcugguggcugacaaagauguaguuuccaucagu

SEQ ID NO: 170694 - RNA, 52 nt, Human
cgccucagcaacaguugugacaguggcugagccuagcacagacccugacaga

SEQ ID NO: 170695 - RNA, 64 nt, Human
ggggaccagcagucugccuggaggccagggagcaguggcugaguagcucugccuuugcucuggu

SEQ ID NO: 170696 - RNA, 64 nt, Human
acccaccugcgucucauacucaccucaccccacuguggcugauuuggaauuuugugcccccaug

SEQ ID NO: 170697 - RNA, 64 nt, Human
cucggcccuuuaaucccugacagaccuggacuguguggcugaagggggaccugcagcacugcag

SEQ ID NO: 170698 - RNA, 64 nt, Human
agguuuaaaaauauucagcauaaauccagcagagguggcugagcuuaauugcuuaaauaaguuc

SEQ ID NO: 170699 - RNA, 64 nt, Human
uuuauucauagaaaugaaaaggaaaauaaaaacuguggcugaccaaaaggucuucuuguugucc

SEQ ID NO: 170700 - RNA, 64 nt, Human
caaaaacacaaaaacucugaggggaucuggugaaucuccaaauuauuguggguguacuuuggcu

SEQ ID NO: 170701 - RNA, 64 nt, Human
guuagaaaggguaggacugagaaacagccuauaaucuccaaagaaagaauaagucuccaaggag

SEQ ID NO: 170702 - RNA, 64 nt, Human
gccuaagcagguaagcagaugccuaagcuguauuucuccaaauaaaucaagaugaaguacugcc

SEQ ID NO: 170703 - RNA, 64 nt, Human
uuugggggaaggggcauaugucacuaauagaaugucuccaaagcuggauugauguggagaaaac

SEQ ID NO: 170704 - RNA, 64 nt, Human
acugcacuccagccugggugacaaagccagacucucuccaaaaacaaaccagaaacagaaaaga

SEQ ID NO: 170705 - RNA, 64 nt, Human
aguuucaggcccccaaaccguuuccaccggcgggucuccaaaacaacccacggcucaacuccuc

SEQ ID NO: 170706 - RNA, 64 nt, Human
gagaggaaucaacauggcugcuuugcugcuuccuucuccaaagugacauauggagggaacuuua

SEQ ID NO: 170707 - RNA, 64 nt, Human
uugaggcaaagcauucauccuacaucauaaaaaaucuccaaagaucucuuuaagggcugggcau

SEQ ID NO: 170708 - RNA, 64 nt, Human; identical to SEQ ID NO: 84819

SEQ ID NO: 170709 - RNA, 64 nt, Human
auuucucauugauaaggaauguggauguuugguuucuccaaaguucccaccauaaaagauccaa

SEQ ID NO: 170710 - RNA, 64 nt, Human
uucaaauuucuauuuuauaggcccaagguguguuucuccaaacauuacauucucauugccaagu

SEQ ID NO: 170711 - RNA, 64 nt, Human
agugcccuggcuacaggaauuacacaguucucuuucuccaaagggcaagaucucauuucaauuu

SEQ ID NO: 170712 - RNA, 64 nt, Human
ugucauuccaggaagaacugcagagccuucagccucuccaaacauguaggaggaaaugaggaaa

SEQ ID NO: 170713 - RNA, 64 nt, Human
cucuucuugcuuuuuauaucugcacauucauaccucuccaaagaccagcuuuuccccagccagg

SEQ ID NO: 170714 - RNA, 64 nt, Human
gggaucaaagaggacagccuuuccucccucaccuucuccaaaucuaggugaaaucacagaguac

SEQ ID NO: 170715 - RNA, 64 nt, Human
gccaugacagugacauugcccucaccaugaucccucuccaaagugguugucuuucuuuaccuug

SEQ ID NO: 170716 - RNA, 55 nt, Human
uguccgccuauccauacuaaggaacucuccaaagccuauuccacauauuuaaacc

SEQ ID NO: 170717 - RNA, 64 nt, Human
ggccucuaacucuuucugcccuuucauucaaaccucuccaaaguucuuugucuuuugucuuccc

SEQ ID NO: 170718 - RNA, 64 nt, Human
gaaaaucaaaaauuuucacauuugauuaugaaaaucuccaaacauaugcacaagcagagaucau

SEQ ID NO: 170719 - RNA, 64 nt, Human
ugcacaaaucauacccuugucugcuccaauucagucuccaaaccuggugccugugcuccuggcc

SEQ ID NO: 170720 - RNA, 64 nt, Human
cuggaguaaauaucauuagugccaaagggauucuucuccaaaacuuuagaugauaaaauggaau

SEQ ID NO: 170721 - RNA, 64 nt, Human
caacuuucugaaauuucaaaacugaauugauccuucuccaaauuaguauauacuauuggaaacu

SEQ ID NO: 170722 - RNA, 53 nt, Human
ggcgccacacuaaacuauaaaugucuccaaagucacacauucagaacugucuc

SEQ ID NO: 170723 - RNA, 64 nt, Human
ugagcccccggcuaguacccuauagagagggggcucuccaaaggggcugcuggggcaugugugc

SEQ ID NO: 170724 - RNA, 64 nt, Human
cuucagagcguggagguguggaaggaguggcugcucuccaaacuaugccaaggcggcggcagag

SEQ ID NO: 170725 - RNA, 64 nt, Human
ccucaccaggccauccugucaaacgagcccauuuucuccaaaguggaaucugaccaagcaugag

SEQ ID NO: 170726 - RNA, 64 nt, Human
guuccuugccaacccuccuccccugcccacaacuucuccaaacaaagcaggcuguuugcucacu

SEQ ID NO: 170727 - RNA, 64 nt, Human
aucugcgccuccauuuucuaucugcacuuuuugaucuccaaacaaccuucagccaaagaaucug

SEQ ID NO: 170728 - RNA, 64 nt, Human
gacaaggggaacuugauccuucagggaagaaucaucuccaaaaugacuccccaucugguuucuu

SEQ ID NO: 170729 - RNA, 64 nt, Human
agaauaguagcuuuaucuuugauauaauacauagucuccaaauagguaauacuucgcaauugau

SEQ ID NO: 170730 - RNA, 64 nt, Human
ccuaaaucacccugacucugaccagucuuucaguucuccaaaagcccaauuuaauuguauaguu

SEQ ID NO: 170731 - RNA, 64 nt, Human
aauaaacuguuacagucaagaccauuaauggucuucuccaaaauauuuugagauauaaaaguag

SEQ ID NO: 170732 - RNA, 64 nt, Human
uccguuuuuuucuucacuauuauuuuucaucauuucuccaaagcaaagcauuuuuauuguaaag

SEQ ID NO: 170733 - RNA, 64 nt, Human
ccucaaagggacuuuuaugucaaacucuucuguuucuccaaauauaaggaaaaaagacuaaagc

SEQ ID NO: 170734 - RNA, 64 nt, Human
uaauauuguuaaacuucugugcuguuccugugaaucuccaaauuuuguaccuuguucuaagcua

SEQ ID NO: 170735 - RNA, 64 nt, Human
ccauauaaaugaggcucaguagggcugcacauaaucuccaaacaauucuuuauucaguguuuug

SEQ ID NO: 170736 - RNA, 64 nt, Human
ccgucagcuggaaaaggccuguggcccagaggcuucuccaaagggagggugacaugcuggcuuu

SEQ ID NO: 170737 - RNA, 64 nt, Human
acacaaauauaaaauuaaaaacuuaaguaccaacucuccaaaacuaaauuugaacuuaaaauau

SEQ ID NO: 170738 - RNA, 64 nt, Human
agcuggcuguccugguucacucagaagauaagucucuccaaagcaaauucacaugcauuaugag

SEQ ID NO: 170739 - RNA, 64 nt, Human
cagcagaagaagcagccaugcccaguauucccacucuccaaaaggaacugaccagcuuauauuu

SEQ ID NO: 170740 - RNA, 64 nt, Human
gucagaguuguggcucucagccauguagacacacucuccaaauggaguguuggaaaauguucuu

SEQ ID NO: 170741 - RNA, 64 nt, Human
uaacuuggguuaggaagaaaauaauuagguauuuucuccaaauguucacugguacucugccacu

SEQ ID NO: 170742 - RNA, 64 nt, Human
gcagauaaguagcaguucaacuggaugucucucuucuccaaaugcuacaguacaaagcccuaag

SEQ ID NO: 170743 - RNA, 64 nt, Human
ucucuucucacuuuccuuuucuugucucugaggcucuccaaauuuugcuuuaguacauggagcu

SEQ ID NO: 170744 - RNA, 64 nt, Human
caugaguaacugaggggagggguacucagcuccaucuccaaagauaaaccuacuccccacaaga

SEQ ID NO: 170745 - RNA, 64 nt, Human
ccccagcagccaccuccucugagaucccucaccuucuccaaaccagauccaaucaaaccucagc

SEQ ID NO: 170746 - RNA, 64 nt, Human
gcgacucuauagacucuaggacauaaauuagaggucuccaaaaucggaucuggggcucugggau

SEQ ID NO: 170747 - RNA, 64 nt, Human
ucucuuuucucuaacaguguuagaaguuugugauucuccaaauaugccuagauuuaaagcugau

SEQ ID NO: 170748 - RNA, 64 nt, Human
uuguacaauuuaccucauaagagaaccacacccuucuccaaaagugcugguacugcaucaguga

SEQ ID NO: 170749 - RNA, 64 nt, Human
uacauuggauaggaaagaauuuccuucuuuuguuucuccaaaucuuuccgccuuauuuagcuug

SEQ ID NO: 170750 - RNA, 64 nt, Human
gaaguuacaugagcuacauguuaaauauuuaaagucuccaaaauaaaacaccccaacguugacc

SEQ ID NO: 170751 - RNA, 64 nt, Human
uaaccuaacugcuggaaaacaagggaaauuuaaaucuccaaauaaggcauuuuaauagacugua

SEQ ID NO: 170752 - RNA, 64 nt, Human
cgcgcuguggcagaccugugggugcggucuccccucuccaaaugccaccucuuccugcucccuc

SEQ ID NO: 170753 - RNA, 64 nt, Human
uaugcagccgggugaaugcgaaugaacuucacguucuccaaagcacuuuaacuccaaacuagau

SEQ ID NO: 170754 - RNA, 64 nt, Human
uuuuuaauuuagggggaaaaaaugggagccuugcucuccaaauccuuaaaacaugcuauuaagc

SEQ ID NO: 170755 - RNA, 64 nt, Human
uugaauacccaaauaaaacgaacugauacauauuucuccaaaaccuucacaagaagucgacugu

SEQ ID NO: 170756 - RNA, 64 nt, Human
ccaaaugauaaugauacugacuucuguugggagcucuccaaagaaacugguugguuuuaagaaa

SEQ ID NO: 170757 - RNA, 64 nt, Human
uagcauaugacuggaaacuauauucagugcacuuucuccaaaagacuacccagaaaaauagacu

SEQ ID NO: 170758 - RNA, 63 nt, Human
aggaauccagcucugccugacauccaggcauccucuccaaauugcauaggucagugagaacgu

SEQ ID NO: 170759 - RNA, 64 nt, Human
cuccaggucccacuccuguucauugccccuuaggucuccaaaauguaaauucuaauguuuaccu

SEQ ID NO: 170760 - RNA, 64 nt, Human
ugcugcugcugcaccgcccgccuuugccucgucuucuccaaaacugaauuuucaccccccaaaa

SEQ ID NO: 170761 - RNA, 64 nt, Human
caauuuuugacccugaccacuaacuagugauucuucuccaaaauugagaaagacagcacccauu

SEQ ID NO: 170762 - RNA, 64 nt, Human
aaaauaaauauacauuuaguggcuugggcuauggucuccaaagauccuucaaaaauacaucaag

SEQ ID NO: 170763 - RNA, 64 nt, Human
uaagugugaagguauagcuauugcacuuaugccaucuccaaaauuucuuaaguauucuuucacu

SEQ ID NO: 170764 - RNA, 64 nt, Human
acaggcggacagggggugagggggccagggggcaucuccaaaggaagcuuuuaaacucagcagc

SEQ ID NO: 170765 - RNA, 64 nt, Human
acuuuugaaaaaguguacaugaagaauguagcccucuccaaaucaaggaucuuuuggaccuggc

SEQ ID NO: 170766 - RNA, 64 nt, Human
acauguguucuauuuauguauauauauguauguuucuccaaaaagugauaaaaccaaaauauca

SEQ ID NO: 170767 - RNA, 64 nt, Human
aaaauagagaagaaauugagggcaaaguaauaugucuccaaaacugaacugauugcuuguugag

SEQ ID NO: 170768 - RNA, 64 nt, Human
guuggccacagacagcuuagaagccauucgguugucuccaaaaggccuuuggaaagacuugaau

SEQ ID NO: 170769 - RNA, 64 nt, Human
auaauaaacuaaugauaacuaaugacauccagugucuccaaaauuguuuccuuguacugauaua

SEQ ID NO: 170770 - RNA, 64 nt, Human
ccuguacuguauguuuggaauugaucauaaaacaucuccaaaagaaaauaaucaguuuguaguc

SEQ ID NO: 170771 - RNA, 64 nt, Human
auaauaccuggaagcaucauagugguuucuuaacucuccaaaauaagauuucuucucuguagcc

SEQ ID NO: 170772 - RNA, 64 nt, Human
ugaugcugucaugcucagugagccauuuuacaguucuccaaagucuagcccuguuucggaccug

SEQ ID NO: 170773 - RNA, 64 nt, Human
ccacugcacuuuauuuagccaggacaacacucugucuccaaaaaaaaguuucugaagguaaaag

SEQ ID NO: 170774 - RNA, 64 nt, Human
ccagccggugccuggcgccccugccccccgccccucuccaaacaccggcagaaaacggagagug

SEQ ID NO: 170775 - RNA, 58 nt, Human
uccuggcugugagcccauaacuggccucucuccaaaagccucugcccaggagcauggg

SEQ ID NO: 170776 - RNA, 64 nt, Human
ucacaagaggugugaagaguagcagccgaugcucucuccaaagcagggcagcagcccauaccag

SEQ ID NO: 170777 - RNA, 64 nt, Human
agaucccacuggaggguaggggugguaauaaacuucuccaaacgaucguugucauuuuagacag

SEQ ID NO: 170778 - RNA, 64 nt, Human
gauaacacagcuagccagauagaagacacuuuuuucuccaaaaugaugccuugggguggggagu

SEQ ID NO: 170779 - RNA, 64 nt, Human
ugaccuccguggguuuauaugucggaaacucuucucuccaaaucccaggccuggcuuccagcac

SEQ ID NO: 170780 - RNA, 64 nt, Human
ccagcaccuggcaucgcaccauucugacucgguuucuccaaacugaagcagccucuccccaggu

SEQ ID NO: 170781 - RNA, 64 nt, Human
cuggcaauauaguguuguauaauguaaauuuauuucuccaaaucgagagugauuuuuuaaaaau

SEQ ID NO: 170782 - RNA, 64 nt, Human
auguuuugacagccgaucaaaguccagaucuccaucuccaaaaagaagguaagcuaaauguuuu

SEQ ID NO: 170783 - RNA, 64 nt, Human
auucacaguaaauauguaaagcuaaauacuuuccucuccaaagaucauuaucuuuauugauuag

SEQ ID NO: 170784 - RNA, 64 nt, Human
aagaccagccugggcaacauagcaagauccugucucuccaaaaaaaaaaaaaaaaaaaaaaaaa

SEQ ID NO: 170785 - RNA, 50 nt, Human
agcgcagcuuucaguauuaaucuccaaacaucacugcugcucggagaaac

SEQ ID NO: 170786 - RNA, 64 nt, Human
ugcacuccagccugggcaacagagugagacccugucuccaaagagaaagagaaacuugagaagg

SEQ ID NO: 170787 - RNA, 64 nt, Human
auaagaaagaaucaaauaucuugcuuuugggucuucuccaaaguaaauugcauggacuucuuaa

SEQ ID NO: 170788 - RNA, 64 nt, Human
cuuauuaauauuaagagacaguuuuucuauggcaucuccaaaacugcaugacaucacuagucuu

SEQ ID NO: 170789 - RNA, 64 nt, Human
gugguucaagccaaacuggcagcauuuggcccaaucuccaaauuagagcaaguuaaauaauaua

SEQ ID NO: 170790 - RNA, 64 nt, Human
guagaucaaggcgagcugccuacaaauuacucugucuccaaaggcaacgugaaaagaaaugaug

SEQ ID NO: 170791 - RNA, 64 nt, Human
aguucuagaagcaauauuuucacuuauuuaacauucuccaaacaacaucaagcauugauacaca

SEQ ID NO: 170792 - RNA, 64 nt, Human
acuaacugcuuauuacaugagcaauuucaucaaaucuccaaacucuuaaaggaugcuuucggaa

SEQ ID NO: 170793 - RNA, 64 nt, Human
ccaggcuguugauaccucagagccuucucuuuacucuccaaagugaaagggaagcccccgucuc

SEQ ID NO: 170794 - RNA, 64 nt, Human
gagugcagaaauguggcuuuugccccacuuugcaucuccaaaauuacaacgguuggccgauccc

SEQ ID NO: 170795 - RNA, 64 nt, Human
gaagcugagcuuucuuuauucaaccucauucccuucuccaaauaagccacuuguguaguugggc

SEQ ID NO: 170796 - RNA, 64 nt, Human
uuggggaaagaaaaggaagcugcaggaauauuuaucuccaaagucgaaugagaaagaacuccag

SEQ ID NO: 170797 - RNA, 64 nt, Human
cagcuauauucauuugccaagaucaacagcuccuucuccaaacaacucaagcccccaauuccca

SEQ ID NO: 170798 - RNA, 64 nt, Human
ugaguuucauagcuaagaaauaaaacuguuaaagucuccaaacuacuuuuacacuucggcacau

SEQ ID NO: 170799 - RNA, 64 nt, Human
uguccccaggaccuaugcucccugcucacccccuucuccaaagcccaagcgucccgcugcucau

SEQ ID NO: 170800 - RNA, 64 nt, Human
uuggugccuuggaaaguagagagcaacagacacaucuccaaaugggcaaggagucucuagcaug

SEQ ID NO: 170801 - RNA, 64 nt, Human
uucuuacuagcaaaauagaaaauugaauuauuuuucuccaaauugagacucucagaaaaggaag

SEQ ID NO: 170802 - RNA, 64 nt, Human
gugaccuguuuucccagcaacucacccucuuccaucuccaaacgccugaagcuuaaccaagagu

SEQ ID NO: 170803 - RNA, 64 nt, Human
gacacaagagaaaagcaggaggaaaaggggccauucuccaaaggaccugaaagagcaaaagagg

SEQ ID NO: 170804 - RNA, 64 nt, Human
ggagaaucacaaggauugaaacuaugcaguguguucuccaaacaugauggaacgaaauuagaaa

SEQ ID NO: 170805 - RNA, 64 nt, Human
aaacuugugcaguguugcuggagcuggccuggugucuccaaaugaccaugaaaauacacacgua

SEQ ID NO: 170806 - RNA, 64 nt, Human
cucuacugggugcaauucgagguugcugagcuucucuccaaagucuaaaaugguggggcaguag

SEQ ID NO: 170807 - RNA, 61 nt, Human
auggagauacaagccugugaaggcacaagaaucuccaaacaccucucuguuguaauauggu

SEQ ID NO: 170808 - RNA, 64 nt, Human
cacugaugguauaucaguaucugagaccccaaacucuccaaauacugauggugcauuuuauucu

SEQ ID NO: 170809 - RNA, 59 nt, Human
aagcaacuccugacaauuaagcauuuuuuucuccaaauacaaaguauauucucuuuauu

SEQ ID NO: 170810 - RNA, 64 nt, Human
ugcacuacagccugggcgacagaacgagacccugucuccaaaggaaaaacaaaaaagaagaaua

SEQ ID NO: 170811 - RNA, 64 nt, Human
ugaccaaguuggagcagaugguuuguuacuugaaucuccaaacacuuaguugaauuuuuacaga

SEQ ID NO: 170812 - RNA, 64 nt, Human
uuuaaaaaaugggcuaacgguuugaauagacauuucuccaaagaagauaugcaaauggcuacua

SEQ ID NO: 170813 - RNA, 64 nt, Human
cacauaccugauguuuaaauuuugucacgguuagucuccaaacuucucaacuuugccagcuuuc

SEQ ID NO: 170814 - RNA, 64 nt, Human
cacccuguauuucuuuagcccuaaauugacacucucuccaaaaauccauuccauugucugugga

SEQ ID NO: 170815 - RNA, 64 nt, Human
uacuuucugcugacagcugcacacauuacagcugucuccaaacccacagugaugcuuagggaaa

SEQ ID NO: 170816 - RNA, 64 nt, Human
ugguuuuuuggccuuauuuucacuggcuuuuccuucuccaaacuuugaggcgugauuucauuca

SEQ ID NO: 170817 - RNA, 64 nt, Human
uagccagaguuuaauacaucuucauucucaacacucuccaaagaacuugaccuaccuuaugggu

SEQ ID NO: 170818 - RNA, 64 nt, Human
ucaaaguacacagauaaagcaugguuuguuucagucuccaaauucaaaccuuugaguaauaaau

SEQ ID NO: 170819 - RNA, 64 nt, Human
ggcgugauaucuggauggaaguugggcuggaugaucuccaaagucguuucaacucuuaaagaca

SEQ ID NO: 170820 - RNA, 64 nt, Human
acauccuuaggugcuaacggccaugagcuccgacucuccaaagugagcuccacuuugggucuga

SEQ ID NO: 170821 - RNA, 64 nt, Human
gaugcuaaauaggagauaccagguugaaagaccuucuccaaaugagaucuaagccuuuccauaa

SEQ ID NO: 170822 - RNA, 64 nt, Human
cuuccuucaguuccucacccaucagccagugggcucuccaaaguuaaccaacagcucccucuug

SEQ ID NO: 170823 - RNA, 64 nt, Human
acagggccacaaucucauauccacaauuccaaaaucuccaaaccucugaaaacugaaauauuuu

SEQ ID NO: 170824 - RNA, 64 nt, Human
gaaugagcauggcagugccacucaagaaaaugaaucuccaaaguaucuucaaagaauaaauacu

SEQ ID NO: 170825 - RNA, 64 nt, Human
ucacugcuguuucugaguaauagaaauucauuccucuccaaaagcaauaaaauucaagcacauu

SEQ ID NO: 170826 - RNA, 64 nt, Human
ucacugcuguuucugaguaauagaaauucauuccucuccaaaagcaauaaauuucuagcacauu

SEQ ID NO: 170827 - RNA, 64 nt, Human
gacugcaugucacucucuuccuuuuuguauccacucuccaaaucguacccuaaauuuuucuuga

SEQ ID NO: 170828 - RNA, 64 nt, Human
uuaugugagauuuccuuaucacagaaauaaaauaucuccaaauguuuccuuuuccaaguuugcu

SEQ ID NO: 170829 - RNA, 64 nt, Human
uuuauauuuuuaacuuuaagauguuuuuaugugcucuccaaauuuuuuuuacuguuucugauug

SEQ ID NO: 170830 - RNA, 64 nt, Human
ccacugcauuccaaccugggugaugaagugagacucuccaaaaaaaaaaaagaaauuauuaauc

SEQ ID NO: 170831 - RNA, 64 nt, Human
ccaacuuaggcucuuuauuaauugguuaagguuuucuccaaaaagggcauuucaacaaugggaa

SEQ ID NO: 170832 - RNA, 63 nt, Human
ucugugguggagaugacugaaccaagaagauaaucuccaaagguccacgaugggcuuucccaa

SEQ ID NO: 170833 - RNA, 64 nt, Human
aucuuuuuccauguugugcagaucaguuucacuaucuccaaagcauuugcaucaugaccuuaua

SEQ ID NO: 170834 - RNA, 64 nt, Human
uuuguagucauguaaaacuuaagugcuucaugccucuccaaaugugguuauucuaauaaaugga

SEQ ID NO: 170835 - RNA, 64 nt, Human
cauaguauggacaacuuuuugccacuaacugaauucuccaaauacucacacgugaaauuucaaa

SEQ ID NO: 170836 - RNA, 64 nt, Human
ugcacuccagccugggugacagagugagacucugucuccaaaaaaaaacuuugcuuguauauua

SEQ ID NO: 170837 - RNA, 64 nt, Human
ucuacauauuauucaugaagcauaauguugcauuucuccaaauuuuaugccugaaaggguagug

SEQ ID NO: 170838 - RNA, 64 nt, Human
acuuguaagcacuaaguuaucuuuauccaacauuucuccaaauggacugaaagaaacuuuucaa

SEQ ID NO: 170839 - RNA, 64 nt, Human
uuugaaucauuagguaauuuauucuggaugauauucuccaaaauucaauucaguuauuauauuc

SEQ ID NO: 170840 - RNA, 64 nt, Human
ugugugccuguuuacagcacuaucuaucuuucucucuccaaaugucacugagcccuuuagaugu

SEQ ID NO: 170841 - RNA, 64 nt, Human
aaucaguguauguuuacaauuguuuauacacuguucuccaaagguaccuuauccuuccaaagau

SEQ ID NO: 170842 - RNA, 64 nt, Human
acaaauuuugcuguauugcuguucucuuugaggcucuccaaagucuugaguucuguauauggcc

SEQ ID NO: 170843 - RNA, 64 nt, Human
gcacuccagccugggcgacagagcaagaccaccaucuccaaaaauuauauauauaaaaauaauu

SEQ ID NO: 170844 - RNA, 64 nt, Human
acaggucuaaacucagcaugcuuuggugaguuuuucuccaaaaggggcauauuagcaauuagag

SEQ ID NO: 170845 - RNA, 64 nt, Human
augcaaagauuauuccugguaaaggagguagcugucuccaaaaaugcuauuguugcaauaucua

SEQ ID NO: 170846 - RNA, 64 nt, Human
ugaccucaucuugacuacauccgcaaagacccugucuccaaauaaggucacauuuacaggguac

SEQ ID NO: 170847 - RNA, 64 nt, Human
uguuguuaauaaaggcauuuaauagauaaaaacaucuccaaaaaggauuuugaagcugauccua

SEQ ID NO: 170848 - RNA, 64 nt, Human
agcaaguaucguuuauccuuucuuaaacaccgagucuccaaaaauacuuaguuuagcuuuaguu

SEQ ID NO: 170849 - RNA, 64 nt, Human
aucacaacucagcauuggccuuaauauaccuaaaucuccaaaaacagugauuaaagcaagagaa

SEQ ID NO: 170850 - RNA, 64 nt, Human
aaucuuguugagggagagagacagaauccuggacucuccaaaguauuuaacugaaaguagggcc

SEQ ID NO: 170851 - RNA, 64 nt, Human
cuuuuaaaaaauauaauaagaaaaaaguagagauucuccaaacucuagccugguuuccuagauu

SEQ ID NO: 170852 - RNA, 64 nt, Human
auccuggagccaauguccaggcuguguguuucauucuccaaaggacaggaagugagcaaagccu

SEQ ID NO: 170853 - RNA, 64 nt, Human
uguucauguucuguucuauauuuucuucaccuacucuccaaauauuguaaugcaaaaagucuca

SEQ ID NO: 170854 - RNA, 64 nt, Human
cugggucacuuccaccacugguaaagccagaacuucuccaaaaagaaccuugcaaaaaguccag

SEQ ID NO: 170855 - RNA, 64 nt, Human
uauuuggaccuugaaagguaagaaaaaaccagguucuccaaaguuaggaauagggaacuaauuu

SEQ ID NO: 170856 - RNA, 64 nt, Human
cagaaccuauguucagguugcgggugagcugcccucuccaaauccagccagagaugcacauucc

SEQ ID NO: 170857 - RNA, 64 nt, Human
ucgcccugggcugggcaccagugacaggucaggaucuccaaacauggacguccuccccuccaaa

SEQ ID NO: 170858 - RNA, 64 nt, Human
ucuuauguuuuuuuuuuuucuccuuuuagaaaauucuccaaaagguuuugauguugaaucuugg

SEQ ID NO: 170859 - RNA, 64 nt, Human
gggugucugaggccccaagauuagaugccacuaaucuccaaagauucccuccaauuaugaaaua

SEQ ID NO: 170860 - RNA, 64 nt, Human
aaaaaaaaaaaaaaaaaaaaaaaaaaaagauacuucuccaaaguguucucauguggccucaccc

SEQ ID NO: 170861 - RNA, 64 nt, Human
aaaauauccagcuuugggggaccuggaagaaaugucuccaaaggaagcaaggcauguuuuaguu

SEQ ID NO: 170862 - RNA, 64 nt, Human
gauagcuugcugcguccuaucucggucacugaugucuccaaauacgccuucuuugcuguguggg

SEQ ID NO: 170863 - RNA, 64 nt, Human
gagcuccucccacccuccuccaggaaccuccacaucuccaaaaaucucccuguugacucagugc

SEQ ID NO: 170864 - RNA, 64 nt, Human
uacucaugagccuuccuuugaggaaggauguggaucuccaaauaaagauuuaguguuuauuuug

SEQ ID NO: 170865 - RNA, 64 nt, Human
uaagaauuugcugaaagcauuuucagcuuugaaaucuccaaaugaaacuuuaaaauuuauuuug

SEQ ID NO: 170866 - RNA, 64 nt, Human
aaacagagcaguuaacuuuacucuugguucugagucuccaaauaauaauagccgacguuuauug

SEQ ID NO: 170867 - RNA, 64 nt, Human
gaacaacauucucccugcuggcagcccuuccaugucuccaaaccugggucagagugaaaggacc

SEQ ID NO: 170868 - RNA, 64 nt, Human
gcugaggauacagcucuucucagugucugaacaaucuccaaaauugaaauguauauuuuugcua

SEQ ID NO: 170869 - RNA, 64 nt, Human
cuucacugugaggggaaggccuuuucacgggaacucuccaaauauuauucaagugccucuuguu

SEQ ID NO: 170870 - RNA, 64 nt, Human
gaaauacuugaacuugccucuuuuaccugcugcuucuccaaaaaucugccuggguuuuguuccc

SEQ ID NO: 170871 - RNA, 62 nt, Human
cagccagcucagauuuuauaaaaauuaauuaaaaucuccaaacguguuguguguuuuugugg

SEQ ID NO: 170872 - RNA, 64 nt, Human
uugcaggcuaugagguuuuaugcuauuccuguguucuccaaaacaagaaaauaaaaagacauga

SEQ ID NO: 170873 - RNA, 64 nt, Human
aucucaaguauuuuuuaaaaauauaugaauucucucuccaaauauuaacuaauuauuagauuau

SEQ ID NO: 170874 - RNA, 64 nt, Human
uauuugaacuauauguugaagacaucuaccaguuucuccaaaugccuuuuuuaaaacucaucac

SEQ ID NO: 170875 - RNA, 64 nt, Human
agcacaaggacgguuauaacuccuaagugagaagucuccaaaacucaaaagagcaacacuaucg

SEQ ID NO: 170876 - RNA, 64 nt, Human
gugauuuuguaaaaucuacacuacggucucuguuucuccaaaguaaguguuugugauuuguucc

SEQ ID NO: 170877 - RNA, 64 nt, Human
uuuuuauuuuauauauuuuuucauuagggccauaucuccaaaaaaagaaagaaaaaauacaaaa

SEQ ID NO: 170878 - RNA, 64 nt, Human
ccagaucaagaugacaugacaucacucccaauucucuccaaaccccagagaaauacugacgaag

SEQ ID NO: 170879 - RNA, 64 nt, Human
uaacagucaucauuuaucaucacaaauggcuacaucuccaaauaucagugggcucucuuaccag

SEQ ID NO: 170880 - RNA, 64 nt, Human
ccaggaaacguggagcauuguuucucacagagagucuccaaauaaaaaggguuuuguucagauu

SEQ ID NO: 170881 - RNA, 64 nt, Human
cucucuccuccucaaccugggaauacuucagacaucuccaaacucauccuuguguauagucuca

SEQ ID NO: 170882 - RNA, 64 nt, Human
aauugguucuucucuuuucccagagaccuucugaucuccaaaaagaggagaugacuacauuuag

SEQ ID NO: 170883 - RNA, 64 nt, Human
cgccacugcacuccaaccugggugacagacucugucuccaaaacaaaacaaacaaacaaaaaga

SEQ ID NO: 170884 - RNA, 64 nt, Human
uucugugguccagcccuacuccuauaagucaugaucuccaaagcuuucugucuuccaacugcag

SEQ ID NO: 170885 - RNA, 64 nt, Human
ucucuaacuuaauccucucaucccuguuccccuuucuccaaagagaugaagcucaaauaaaaug

SEQ ID NO: 170886 - RNA, 64 nt, Human
aaccacgggcuguuuaggaggaugccugcuugggucuccaaauggcugggguaggaaugguugu

SEQ ID NO: 170887 - RNA, 64 nt, Human
cugacacaggcugacacauucuuucuccuuuccuucuccaaaggcuuggaguuuucuucugagg

SEQ ID NO: 170888 - RNA, 64 nt, Human
gcuguguaacuguuuuaauacagcaaauaguaacucuccaaauccuguugcuuuuauguuaaau

SEQ ID NO: 170889 - RNA, 64 nt, Human
ugcacuccagccugggggacagagcaagacucuaucuccaaaaaacaaaaaagauaagcagcuu

SEQ ID NO: 170890 - RNA, 64 nt, Human
ugccuaguaagggaacuauggaaagguuuggauuucuccaaaucugggagaauuuucaaaauaa

SEQ ID NO: 170891 - RNA, 64 nt, Human
uucuccgguuugccaauccucuuaaguauuccugucuccaaaggaccggcucuccauggcuccu

SEQ ID NO: 170892 - RNA, 64 nt, Human
aagguguuucucuguaaaaugaacugcaguggguucuccaaacuagauucauggcuuuaacagu

SEQ ID NO: 170893 - RNA, 64 nt, Human
gacaucccugaaacucaguuaaccgaauuuccagucuccaaagcggaaggguaggcaucgccag

SEQ ID NO: 170894 - RNA, 64 nt, Human
gacagggugagucagagcucagcauuuaaucuccucuccaaaguagagagcaagucgcccacag

SEQ ID NO: 170895 - RNA, 64 nt, Human
cugcacuccagccuggcaauagaccgagacuccgucuccaaaaaaaaaaaaaauacaauuuuua

SEQ ID NO: 170896 - RNA, 64 nt, Human
cuggagcugaugggccgugaagggggccuauuuuucuccaaaggccauccuuuuggggccaccu

SEQ ID NO: 170897 - RNA, 64 nt, Human
agauucccucaccugucgcuuccuagaauccccuucuccaaacgauuagucuaaauuuucagag

SEQ ID NO: 170898 - RNA, 64 nt, Human
agggggugucuagguagcaacagguaucgaggacucuccaaacccccaaagcagagagagggcu

SEQ ID NO: 170899 - RNA, 64 nt, Human
ugggagagaaguuugaagcacaacucccuuaaggucuccaaaccagacggugacgccugcggga

SEQ ID NO: 170900 - RNA, 64 nt, Human
uuuagccaugcuagccuaggccucuauuuccuugucuccaaaaugagaauaauaaaauuuaggu

SEQ ID NO: 170901 - RNA, 64 nt, Human
gggaagcccacagacgcuggaggaaucuugaguuucuccaaacugccgcuccaccagugccuuu

SEQ ID NO: 170902 - RNA, 64 nt, Human
aaugaggaugcuguuacuuggccauuucuucccaucuccaaaaauccagagacauuacgagagc

SEQ ID NO: 170903 - RNA, 64 nt, Human
ucugaaaugggauaauggccagaguagcugaaaaucuccaaaugggcauuugcaugccuaucuc

SEQ ID NO: 170904 - RNA, 64 nt, Human
cacugcacucaagccugggugacgagugaaacugucuccaaaaaaaaaaaaaaaucuagaauuc

SEQ ID NO: 170905 - RNA, 64 nt, Human
auggaacucagcugucuguggcuucccaugucuuucuccaaaguuauccagaggguugugauuu

SEQ ID NO: 170906 - RNA, 64 nt, Human
uugcucgcgucugcgcccgugggcccagcucccgucuccaaacagccuccuucgacucggcucc

SEQ ID NO: 170907 - RNA, 64 nt, Human
auuuuauuagaauaauuucauacugaaauuauuuucuccaaauaaaaauuagauggaaaaaugu

SEQ ID NO: 170908 - RNA, 64 nt, Human
ugcacuccagccugggcgacaaaucaagaccccgucuccaaaaaaaaaaaaaacaaaacuugau

SEQ ID NO: 170909 - RNA, 64 nt, Human
auucagugaagaaauaauucaugauucaacugcaucuccaaacauuacucaugaccuugaaaua

SEQ ID NO: 170910 - RNA, 64 nt, Human
cacuaaacacuuuuuaaaaagcuuaucuuugccuucuccaaacaagaagcaauagucuccaagu

SEQ ID NO: 170911 - RNA, 64 nt, Human
cccacagcauuccuccaucuuagauagaugguacucuccaaaggcccuaccagagggaacacgg

SEQ ID NO: 170912 - RNA, 64 nt, Human
gccauuuuauccaaagcuuuuucucuguguccacucuccaaacagcauucuagagcagucaagg

SEQ ID NO: 170913 - RNA, 64 nt, Human
aguucugguuuauuaaucaacggggaaaacaucuucuccaaaaaacuuggaauaaauccaagga

SEQ ID NO: 170914 - RNA, 64 nt, Human
aaaaaaaaaagaaaccguaauuuuauuauuagauucuccaaaugauuuucaucaauuuaaaauc

SEQ ID NO: 170915 - RNA, 64 nt, Human
acguauugggauuccugugucuuacagcucucccucuccaaauaauacacagaauccugcaacu

SEQ ID NO: 170916 - RNA, 64 nt, Human
caccacagagacuguuuggaaucccgccccacauucuccaaauucagggcgcgaucuggcaaag

SEQ ID NO: 170917 - RNA, 64 nt, Human
cccaccuggcugcagugggcagcucaugucuguaucuccaaagugauguuuguuugcaaaacac

SEQ ID NO: 170918 - RNA, 64 nt, Human
aaauaucccccauucgaacuuaacagaugccuccucuccaaagagaauuaaaaucguagcuugu

SEQ ID NO: 170919 - RNA, 64 nt, Human
gagugaccucuagucgcucagcauccacuuugugucuccaaauuguguaggacucuguaaucuu

SEQ ID NO: 170920 - RNA, 64 nt, Human
gagcagcgcuuggugacagccuguccucuccugcucuccaaaggcccugcucccuguccucucu

SEQ ID NO: 170921 - RNA, 64 nt, Human
ugagugcagccguuugagaagaaaacaucuauucucuccaaaaaugcacccaacuagcucuaug

SEQ ID NO: 170922 - RNA, 64 nt, Human
gcacuccugccugggcaacaagagugaaacuccaucuccaaaaaaaaaaagaaaaaguaacaaa

SEQ ID NO: 170923 - RNA, 64 nt, Human
ugugccccccagauuucaugugugugaaacuuaaucuccaaauuuguauguugauggcauuugg

SEQ ID NO: 170924 - RNA, 64 nt, Human
auagaguaguuguuaaagguuuuaaauuguacuuucuccaaaauuagcaugcagcuauuuaaua

SEQ ID NO: 170925 - RNA, 64 nt, Human
uaaagacuguagaaguguguucuggaggguuugcucuccaaaaagaauuguaauauagaguaga

SEQ ID NO: 170926 - RNA, 64 nt, Human
caccgugcccagccagaauggguaguuuuuauucucuccaaacacuuuuggauuaggguacaau

SEQ ID NO: 170927 - RNA, 64 nt, Human
uacucuguguaccuugugucuuucuaaauuucucucuccaaaauaaaguucaagcauuaaacuu

SEQ ID NO: 170928 - RNA, 64 nt, Human
uguuaccuacacuucaaucaguaauauuagcaaaucuccaaauguuagucacauugguuugucu

SEQ ID NO: 170929 - RNA, 64 nt, Human
gcucugcaguucugcagauuuucuagcagugccaucuccaaaauguguuuuaaacucuuuauuu

SEQ ID NO: 170930 - RNA, 64 nt, Human
uuuuuaauuugagguaguuuguuuguauacuguuucuccaaacacuuaauauuucuuacaucaa

SEQ ID NO: 170931 - RNA, 64 nt, Human
auaaaauuaucaccuuugucagaccauaagaguuucuccaaaaguggucaguuuggcugggcaa

SEQ ID NO: 170932 - RNA, 64 nt, Human
cagcugcgccggaucugggcgaccacguuuugccucuccaaaaagagcuuccuuucgugacgag

SEQ ID NO: 170933 - RNA, 64 nt, Human
acaucaaguucuguguaaugaggcuauuuccaagucuccaaagauggucacuguaacagcacuu

SEQ ID NO: 170934 - RNA, 64 nt, Human
uuccaggaaagugugaagacccaaaacagcuuugucuccaaagaagauagcucucugacugcuu

SEQ ID NO: 170935 - RNA, 64 nt, Human
guggagacaaaugaggucuauuacgugggugcccucuccaaaggcgggguggcgguggaccaaa

SEQ ID NO: 170936 - RNA, 64 nt, Human
augacugucuaaccagaccucagaaucagaaacgucuccaaagccaggauucugaggaaagucc

SEQ ID NO: 170937 - RNA, 64 nt, Human
uauuuguggugaauguguuuuuuaaauggaacuaucuccaaauuuuucuaagacuacuaugaac

SEQ ID NO: 170938 - RNA, 64 nt, Human
ugaagagcagcuggucaaccugcucacuguucuaucuccaaaugagacacauuaaaggguagcc

SEQ ID NO: 170939 - RNA, 64 nt, Human
ccacaccagccugggugacagagugaaacucguaucuccaaacaaacaaacaaaaaguccuuaa

SEQ ID NO: 170940 - RNA, 64 nt, Human
ugucuucuggcaggcaggugccacugucagcuuuucuccaaaaagcagccaacaucagccuccc

SEQ ID NO: 170941 - RNA, 64 nt, Human
gagaaugaaguaaaccaauagauacucuuuugauucuccaaagaaauauaauuuugguuuuugu

SEQ ID NO: 170942 - RNA, 64 nt, Human
cugccuguuucuucuccucuucuaauauaucagaucuccaaaauggaagcuaaaugguggacuu

SEQ ID NO: 170943 - RNA, 64 nt, Human
guucaaaaaugggcaaagauuuugaacagauauuucuccaaagaagauauacaaauggcaaaua

SEQ ID NO: 170944 - RNA, 64 nt, Human
accgccuccccuuucucucuggaaaguugaaguaucuccaaaggccuuggaaauggcacaaagg

SEQ ID NO: 170945 - RNA, 64 nt, Human
agcaauugagagugagaaagaggagagagacuauucuccaaaccuuuuuuguuuuguuuuguuu

SEQ ID NO: 170946 - RNA, 64 nt, Human
ugguacucuuggaggaagaaaaacuguccuuccuucuccaaaaaaggaaaaauuauaauaauau

SEQ ID NO: 170947 - RNA, 64 nt, Human
aucuacccugugccagcccuacucguacgcucugucuccaaagaugaaaaaggacuucucugcc

SEQ ID NO: 170948 - RNA, 64 nt, Human
uguauggcaugcaugguugugaauuauucucuguucuccaaauacuguuucuuuaacucagaua

SEQ ID NO: 170949 - RNA, 64 nt, Human
cugcuccuucuuuuggauuauucccuuaggaauaucuccaaagagggauuacaaggucaaagag

SEQ ID NO: 170950 - RNA, 64 nt, Human
auauuauuuauuccuguucaguagcacggaaugaucuccaaacauuccuaggagagugucuguu

SEQ ID NO: 170951 - RNA, 64 nt, Human
uagucuuuuuaggagugauuuugcuaguuugacuucuccaaagccucuguguaggugguaggga

SEQ ID NO: 170952 - RNA, 64 nt, Human
ccacgcucucaggcugacuagaguccgcaucucaucuccaaacuacacuucccuggagaacaag

SEQ ID NO: 170953 - RNA, 64 nt, Human
ugcaggucacuugggacggacgccaccagacuugucuccaaaaaucaccaccuuuaauacuccc

SEQ ID NO: 170954 - RNA, 64 nt, Human
gagaggacaugagggggaaaguccuuuuugcccuucuccaaaaaauaaccuuccacagagacaa

SEQ ID NO: 170955 - RNA, 64 nt, Human
aauccucacuaugcuauuugguaccuaaaaauauucuccaaacccuugcugccaguuccucuuu

SEQ ID NO: 170956 - RNA, 64 nt, Human
uguguucuaaccagaaagaaaggauuuguauuacucuccaaaucuacuguacugucagcuucac

SEQ ID NO: 170957 - RNA, 64 nt, Human
acaagaaauucacuguguacacucucuaagacauucuccaaauugauuuuaucucuuuaaauaa

SEQ ID NO: 170958 - RNA, 64 nt, Human
guguuuuaaaaugagaaaucuaaaaaacgaaaagucuccaaagucucuggaauuugaaacacuu

SEQ ID NO: 170959 - RNA, 64 nt, Human
accccuucagcacuugaccgaaauaccaaaaaugucuccaaaaaauugauaguugcagguuauc

SEQ ID NO: 170960 - RNA, 64 nt, Human
guugcugacuguacugacaggcucuaagucauuuucuccaaaaacuaucuauucaauuaucagg

SEQ ID NO: 170961 - RNA, 64 nt, Human
uuugugguuauuauuuuugucacggaaagcauccucuccaaaguuggagcuucuauugccauga

SEQ ID NO: 170962 - RNA, 64 nt, Human
acgacuacuagaauucuuuucaaaaguuaacuuaucuccaaaguggcugaaaauauuguuuacc

SEQ ID NO: 170963 - RNA, 64 nt, Human
cacugaacucauugaucgagugcugucugcuaaaucuccaaaccauucccaaaccuuuccccgu

SEQ ID NO: 170964 - RNA, 64 nt, Human
gaccuagggauccugagagggagagacugcaauuucuccaaagcuugccacuuuccagccuguu

SEQ ID NO: 170965 - RNA, 64 nt, Human
cuacuuccuccuagcaaccaacuuuaccucuucuucuccaaaggaucuuuguuccucugagcca

SEQ ID NO: 170966 - RNA, 64 nt, Human
cagggugacaagauauguauaacagugacagaaaucuccaaagcugcuguauaugauauagcuu

SEQ ID NO: 170967 - RNA, 64 nt, Human
acugcacuccagccugagcaacagagcgacucugucuccaaaaaagaaaaaaaguaccccaugu

SEQ ID NO: 170968 - RNA, 64 nt, Human
ucuagguuucaauugucuuguaucuuucccuaauucuccaaacaguucaaucuccagcuuuauu

SEQ ID NO: 170969 - RNA, 64 nt, Human
agacaagcuguugggaccugacgcuuuuauuuauucuccaaauuaagugggaauuagauccucu

SEQ ID NO: 170970 - RNA, 64 nt, Human
caggcagacgcaccauugaggcaaugauacacccucuccaaaaaacagggcaaaaggggcacuu

SEQ ID NO: 170971 - RNA, 64 nt, Human
aaauacaauuuugguugccagaguaaagacucagucuccaaaaaagaucugaagaauccuccuu

SEQ ID NO: 170972 - RNA, 64 nt, Human
ugcacuccagccugggcaacagagcaagacuccgucuccaaaaaaaaaaaaaaaaaaaaagaau

SEQ ID NO: 170973 - RNA, 64 nt, Human
ugcacuggcccccaaggucagcucccugggucugucuccaaaaaugguugcugaugacaucacc

SEQ ID NO: 170974 - RNA, 64 nt, Human
aauuuuaauauaaugcaguaggugauuaacaaugucuccaaacaccaaaggagguggcuaaaga

SEQ ID NO: 170975 - RNA, 64 nt, Human
ugaguuaccuggucagcacugugaucuuuuuuucucuccaaaggaccugcguuggacaacaaua

SEQ ID NO: 170976 - RNA, 64 nt, Human
aggugggaugaagucaccuauagcuuucauguauucuccaaaguagucugugugugaccugucc

SEQ ID NO: 170977 - RNA, 64 nt, Human
ugggccugcucauucuaggucaccacauuuuccaucuccaaauagccaggcccucucucccuca

SEQ ID NO: 170978 - RNA, 64 nt, Human
cagagcaccuggcuggaguuuaaggccaaggcuuucuccaaaagugagcccggauccuccuggg

SEQ ID NO: 170979 - RNA, 64 nt, Human
cugccccauccugcuggaaucaacacagacuugcucuccaaagagacuaaaugucauagcguga

SEQ ID NO: 170980 - RNA, 64 nt, Human
ugacguguucaauaacuucacauaaacuuccuguucuccaaaaccucaaagagauagaguuaau

SEQ ID NO: 170981 - RNA, 64 nt, Human
ggaggggccuccagcacuuuuuauauuuacguauucuccaaagcaguguucacacgggagccag

SEQ ID NO: 170982 - RNA, 64 nt, Human
aguggcccacauaauauacauugaguacuccaucucuccaaauguauuuccauaauguguugaa

SEQ ID NO: 170983 - RNA, 64 nt, Human
auagaaacugaauguacuggguugaaugguguccucuccaaaauucauguacuuccuggagccu

SEQ ID NO: 170984 - RNA, 64 nt, Human
auuucaugucuuacugaaacauuuugccagacuuucuccaaaugaaaccugaaucaauuuuucu

SEQ ID NO: 170985 - RNA, 64 nt, Human
auacuuggcuuggaaauuuaacacaguccuuuugucuccaaagcccuucuucuuuccaccacaa

SEQ ID NO: 170986 - RNA, 64 nt, Human
cuucuauuagcccuucuccauggcccugccaugcucuccaaaccacuuuuugcagcuuucucua

SEQ ID NO: 170987 - RNA, 64 nt, Human
uuccauucucauuuuucuaaaauacaauuuuguuucuccaaauuugacagcagaauaaaaaccc

SEQ ID NO: 170988 - RNA, 64 nt, Human
ccugagguccaagauucuggagcaaucugacccuucuccaaaggcucuguuaucagcugggcag

SEQ ID NO: 170989 - RNA, 64 nt, Human
guugacaucaaauaaaguaugugguuuaaaaaaaucuccaaauaccuuuuuuuccccccaaaua

SEQ ID NO: 170990 - RNA, 64 nt, Human
acaagagggaaagaaggcaaaaacggcacagcuaucuccaaacacaucugaguucauuucaaaa

SEQ ID NO: 170991 - RNA, 64 nt, Human
gcuucugugaaauggggagacaaagcacuuuugcucuccaaagcacuuuuggauacucaggagg

SEQ ID NO: 170992 - RNA, 64 nt, Human
uguccagaugugcaggcuccuccucucuggacuuucuccaaaggcacugacccucggccucuac

SEQ ID NO: 170993 - RNA, 64 nt, Human
uguguuugcaccagcuuaaaauugaagcugcuuaucuccaaagcagcauaagcugcacauggca

SEQ ID NO: 170994 - RNA, 64 nt, Human
ucuuuuuccaccugccacugcuccccccucagcaucuccaaauauauuuaugcauagagagugc

SEQ ID NO: 170995 - RNA, 64 nt, Human
ugcuuuuucugaccaagccuuguggcaccagcaaucuccaaaguccuguggugggagggcugaa

SEQ ID NO: 170996 - RNA, 64 nt, Human
gauguuuaccaagugcuguguuggacacuggcuuucuccaaacaggauuugccuccuccacgcu

SEQ ID NO: 170997 - RNA, 64 nt, Human
cuaacgaagagguggguucagcuucuaucaaacaucuccaaaggaugggugaaauuuuuuccac

SEQ ID NO: 170998 - RNA, 64 nt, Human
gcuccuaaguguugcugcuguggcuuuuuugccuucuccaaagacgcacugccaggucccaagc

SEQ ID NO: 170999 - RNA, 64 nt, Human
caggggcagggacagaccagaccagacccaggagucuccaaagcacagaguggcaaacaaaacc

SEQ ID NO: 171000 - RNA, 64 nt, Human
cuucaaagugguuacaauucauaaugcagcaguuucuccaaaaacaaaaacaaaacacacacca

SEQ ID NO: 171001 - RNA, 64 nt, Human
ggucacacagugauccgggaucccagaacucuggucuccaaauuacagcccaggacaccuuucu

SEQ ID NO: 171002 - RNA, 64 nt, Human
cuaaugguccaaaucuuuuggucacaauaaagagucuccaaauuagagacugcauguuaguucu

SEQ ID NO: 171003 - RNA, 64 nt, Human
auuuuccucucccaggucacugucucaccugcacucuccaaacucagguuccgggaagcuugug

SEQ ID NO: 171004 - RNA, 64 nt, Human
uuggaucaugcuucuuuccaacacguguucacaaucuccaaagggacuguauuucuucucugug

SEQ ID NO: 171005 - RNA, 64 nt, Human
uugauaggauccauaucuaauaauggauucgaacucuccaaacuacaccaauuaauuuaaugua

SEQ ID NO: 171006 - RNA, 64 nt, Human
cugcauacuuaccuauguggacuauaauaaccugucuccaaaaccaugccauaauaauauaagu

SEQ ID NO: 171007 - RNA, 64 nt, Human
cugcuaugcuguagugcuaggauugauuauguguucuccaaagaugcugcucccaagggcugcc

SEQ ID NO: 171008 - RNA, 64 nt, Human
gaguaacacugaggcgcucgcucccaugcacaacucuccaaaacacuuauccuccugcaagagu

SEQ ID NO: 171009 - RNA, 64 nt, Human
uuuaagaaaugaaaauacggguauuuuuaaagauucuccaaaaaguccagaagccuugacagcu

SEQ ID NO: 171010 - RNA, 64 nt, Human
uuuaaagcacagggagauucuugucacauuggggucuccaaagcuagaaugggauuucaugugc

SEQ ID NO: 171011 - RNA, 64 nt, Human
caaauucaacagaacaccaggaaggucaagacgcucuccaaagggcaggaaguacagcacuucc

SEQ ID NO: 171012 - RNA, 64 nt, Human
aauuauugauuuuuaaauuaugggagcaaauccaucuccaaacaugauacucuugggccaauga

SEQ ID NO: 171013 - RNA, 64 nt, Human
ugcacuccagccugggcgacagugcaagacucugucuccaaaaaaaaaaaaagaaaaaagaaaa

SEQ ID NO: 171014 - RNA, 64 nt, Human
gccaaagauuuccuuucuguggugagggagaaccucuccaaagaggaagcaggcauaugagugc

SEQ ID NO: 171015 - RNA, 64 nt, Human
aaaucccauccuuuggguuguggguuuuuuguuuucuccaaauaaaucugaucuuuaaaguuca

SEQ ID NO: 171016 - RNA, 64 nt, Human
ugaacuuaaccugggaaaggagaggaagacaccaucuccaaagcuauuaaugucacuccuuuug

SEQ ID NO: 171017 - RNA, 64 nt, Human
augaaggcaucugaugccuucaucuguucagucaucuccaaaaacaguaaaaauaaccacuuuu

SEQ ID NO: 171018 - RNA, 64 nt, Human
guuuuuaaaugguauucucacccaguaggccagcucuccaaacguugcuuagaugcuucaaaau

SEQ ID NO: 171019 - RNA, 64 nt, Human
guucguaaccucugauucuguggacuugccacuuucuccaaacgcucgguuccuuugaagauuu

SEQ ID NO: 171020 - RNA, 64 nt, Human
aguaagauuugcuaauguucuacauuaagugccuucuccaaagacaucccucuuugccucauau

SEQ ID NO: 171021 - RNA, 64 nt, Human
guugcacuggccacccaaggaugucugccacaccucuccaaagcccucccuaccuaccaagaua

SEQ ID NO: 171022 - RNA, 64 nt, Human
gguccaagugucuuccuacucaagguaaacauuaucuccaaaauuacauuuaugauucuaauau

SEQ ID NO: 171023 - RNA, 64 nt, Human
cggacuccagccugggugaaggagugagacccugucuccaaaaacaaacaaaaaaggagcagag

SEQ ID NO: 171024 - RNA, 64 nt, Human
ucuuugcagggugguccguguaaauaguauaaauucuccaaauuauccucuaauuauaaaugua

SEQ ID NO: 171025 - RNA, 64 nt, Human
agaggugcuggaggguaggccucagaccagggggucuccaaaacuuuguaaaucaugcaucuuu

SEQ ID NO: 171026 - RNA, 64 nt, Human
ugaaguccagccuaagcaacauagugaaaccccaucuccaaaaauauaauaauaauucucucaa

SEQ ID NO: 171027 - RNA, 64 nt, Human
gagaguaucugggugauugugaccccaaaccaucucuccaaagcauuaauauccaaucaugcgc

SEQ ID NO: 171028 - RNA, 64 nt, Human
ucagaucagaaccacagcuacccaagaaaacccaucuccaaauuguguauggauucacguguca

SEQ ID NO: 171029 - RNA, 64 nt, Human
auuuauuugccaucaacacauuuuauacuuugcaucuccaaauuuauuguggcgagacuugucc

SEQ ID NO: 171030 - RNA, 64 nt, Human
aauguugaguuuuaaaaaucaggauugacuuuuuucuccaaaaccauacauuuaugggcaaauu

SEQ ID NO: 171031 - RNA, 64 nt, Human
uauuuuguauaaagcaccacugauagcaaaucucucuccaaaauucuuaaaguugauuuuuuua

SEQ ID NO: 171032 - RNA, 64 nt, Human
ccugacacagcacucuuccugugggcugagggcaucuccaaagcugccugaugccuguuuuuca

SEQ ID NO: 171033 - RNA, 64 nt, Human
cuucauaucugccucuuccccuuaccaucguaauucuccaaacuggucauaaaggcacucugug

SEQ ID NO: 171034 - RNA, 64 nt, Human
aagaauguccacauacaguuuuugaaagaucuucucuccaaaccaguuaguuagagccagugac

SEQ ID NO: 171035 - RNA, 64 nt, Human
cuucacugugaguagcaugggaaaaggguccacgucuccaaaagacucuuccacuuguuugucc

SEQ ID NO: 171036 - RNA, 64 nt, Human
ugcuuuuuauacuacugagauccuaaguuaagacucuccaaagcaaacauuugguuuaaaucau

SEQ ID NO: 171037 - RNA, 64 nt, Human
cuugucccucaggcuuguugcccucugcaguugaucuccaaaguuuuaaaccuguuaaauuaau

SEQ ID NO: 171038 - RNA, 64 nt, Human
ucaaaagcuuauuagcaucaaucaagauucuaggucuccaaaaguacaggcuuuuucuucauua

SEQ ID NO: 171039 - RNA, 64 nt, Human
gcuugcccagcgacacugcuggacaggaauuaacucuccaaaggucuccccugcucccuaccua

SEQ ID NO: 171040 - RNA, 64 nt, Human
guguccaacaucuacggcaaguacuacaagaggcucuccaaagagguccagaaugcccuggcca

SEQ ID NO: 171041 - RNA, 64 nt, Human
acugcacuccagccugggagauacagcgagacugucuccaaaaacaaaaacaaaaacaaaaaac

SEQ ID NO: 171042 - RNA, 64 nt, Human
aauggagaagaaacauccaaaagcacauuucauuucuccaaacuuuguguuuuaaauuauaguu

SEQ ID NO: 171043 - RNA, 64 nt, Human
uuguauccuuguguccaucuucauucacucauagucuccaaaugacuuuguauuuacaucacuc

SEQ ID NO: 171044 - RNA, 64 nt, Human
ugcacuccagccugggugaaaaagacaggcugugucuccaaaaagaaaaaaaaaagucaaauuc

SEQ ID NO: 171045 - RNA, 64 nt, Human
uugauagaaauggagagguagggauacaguuuauucuccaaaaauggacugcccacuuccaugc

SEQ ID NO: 171046 - RNA, 64 nt, Human
uguuccuugccauuuuuuaaucacacauguauguucuccaaacauacuguuucauuuuuugaag

SEQ ID NO: 171047 - RNA, 64 nt, Human
uuuuaaaaguugauuuauaaauacaaaaauacauucuccaaagauaguauuuccaaacuguuau

SEQ ID NO: 171048 - RNA, 64 nt, Human
ugcaauauacuugaaaaaaaugaauguauuuuuuucuccaaagaacagcauguuucacucaaug

SEQ ID NO: 171049 - RNA, 64 nt, Human
cuugccccaacacucaccccuucuuuuuuuccccucuccaaaugcagcagugaaucccuuuauu

SEQ ID NO: 171050 - RNA, 64 nt, Human
gaccacuaggccugaaaugacauuucacuaaaagucuccaaaacauuucuaagacuacuaaggc

SEQ ID NO: 171051 - RNA, 64 nt, Human
guucuggacgugagugguggguccugcuccuaucucuccaaaccccauacccuucaaugcugug

SEQ ID NO: 171052 - RNA, 64 nt, Human
agaagguaguggcauggguggaguguguguucuuucuccaaaucuauuaugauguuuauuaaac

SEQ ID NO: 171053 - RNA, 64 nt, Human
ccagguuccaaagugcuucugucucuguuuugauucuccaaacugcucugugauguauguaggg

SEQ ID NO: 171054 - RNA, 64 nt, Human
guuuuuacaacugcauguuuauuaugauacuuucucuccaaaggaaacuuuuaaaucaauggga

SEQ ID NO: 171055 - RNA, 64 nt, Human
aucauuauucaugaccccucugcaaaugugucagucuccaaagagaguaucuccccccaaauuu

SEQ ID NO: 171056 - RNA, 64 nt, Human
agcuacagaggaaaauaaguacauagauuugauuucuccaaaauacagaaaugcugcugggcac

SEQ ID NO: 171057 - RNA, 64 nt, Human
aacaauaaaaaggauguaugguuuuuaucaacugucuccaaaauaaucucuuguuaugcaggga

SEQ ID NO: 171058 - RNA, 64 nt, Human
uaaauauuuauauaugauguauguuugucuccccucuccaaaguaaggaacccagcugggcgug

SEQ ID NO: 171059 - RNA, 64 nt, Human
aaggggaauuuaguuucucuacaugucauuucggucuccaaacucccuguuggcuuuuuaaugc

SEQ ID NO: 171060 - RNA, 59 nt, Human
agaagaggaggaaggaauaggcacaggucucuccaaagugaaugaacucuuacccauaa

SEQ ID NO: 171061 - RNA, 64 nt, Human
agcaaauuggcaauuuaacgagccacuuccaugaucuccaaagaaaccaaaauacaaacacaau

SEQ ID NO: 171062 - RNA, 64 nt, Human
uaagacaucacauuaucccuuuguaagcuacuuaucuccaaaaaacuucagaaauagaaaacua

SEQ ID NO: 171063 - RNA, 64 nt, Human
agaauuuuuacccaauuggauuggaaugcagaggucuccaaacugauuaaauauuugaagagag

SEQ ID NO: 171064 - RNA, 64 nt, Human
caggaaagcguggcuggccucuugcacugcuuugucuccaaaauaaacuacugaaaucaaaccg

SEQ ID NO: 171065 - RNA, 64 nt, Human
ucuggaaaacucaccacuugacuucagagcuuucucuccaaagacuaagaugaagacguggccc

SEQ ID NO: 171066 - RNA, 64 nt, Human
ggcaggacuugccugccuccuccucucaguauucucuccaaagauugaaaugugaagccccagc

SEQ ID NO: 171067 - RNA, 64 nt, Human
ugcucuccucauacucaccgguuugaccagaaauucuccaaauccagccauagauggcugcugg

SEQ ID NO: 171068 - RNA, 64 nt, Human
ccauccugcagcugaaaugggaacacuggcugccucuccaaacccgcucuuggacagaggaucu

SEQ ID NO: 171069 - RNA, 64 nt, Human
ugcacuccagccuuggugacagagcaagacuccgucuccaaaaaaaagaaaaaaaaauuucuug

SEQ ID NO: 171070 - RNA, 64 nt, Human
acaaugcuugaggcggugcuacaaaugaaguccuucuccaaaugcauugagccccaagaaaaau

SEQ ID NO: 171071 - RNA, 64 nt, Human
cgcuaugcuacuggauuuguauaaauacugauauucuccaaaccuagugguguagggagcaaga

SEQ ID NO: 171072 - RNA, 64 nt, Human
gauccuggucuagcugaaucuucagagugggaggucuccaaaaagauauuaccuuauugggcuu

SEQ ID NO: 171073 - RNA, 64 nt, Human
gcaacuggccugagcaacacagggagacucaguuucuccaaaaaaauaaaaaauuagccgauca

SEQ ID NO: 171074 - RNA, 64 nt, Human
uauuguuguagaaguauuuuacauuuucaucccuucuccaaaagccgaaugcacuaaugacagu

SEQ ID NO: 171075 - RNA, 64 nt, Human
cuuuugccguuauuaaaaaucucaaauuucuaaaucuccaaaauaaaacuuuuuaaaauaaagu

SEQ ID NO: 171076 - RNA, 64 nt, Human
auuucuuagaauuuucuguagacagaucaugccaucuccaaauagagaugguuuuacuucuucc

SEQ ID NO: 171077 - RNA, 64 nt, Human
cuacucuauuuuuugcaaauuuguaaacuuugcuucuccaaauacaaguacuagguuguccauu

SEQ ID NO: 171078 - RNA, 64 nt, Human
uguaucuauagcaacaacccagaacuuacaaacuucuccaaagauuuuauugauuguuauauca

SEQ ID NO: 171079 - RNA, 64 nt, Human
acuucacuccaaagagaaaccuauuaagucaucaucuccaaacuaaacccucacaaguaacagu

SEQ ID NO: 171080 - RNA, 64 nt, Human
guguguuuagucuguuuuauuugcaguaaaccgaucuccaaagauuuccuuuuggaaacgcuuu

SEQ ID NO: 171081 - RNA, 64 nt, Human
ggcaguuugugguuccugauuuggaaauuaacauucuccaaacauuccaguccaaugaaaguuu

SEQ ID NO: 171082 - RNA, 64 nt, Human
aaauaggguuugaaacaugccacaggaagguugcucuccaaaaauacacagugcagugcaagaa

SEQ ID NO: 171083 - RNA, 64 nt, Human
caaucgaaaugaagauuuaauaaccagauuucuuucuccaaaacauacacaauuuguuauuuua

SEQ ID NO: 171084 - RNA, 64 nt, Human
agacuguugcccgaggccucacuguauggugcccucuccaaagggucgggaggguagcucucca

SEQ ID NO: 171085 - RNA, 64 nt, Human
augcaucauuugacauaaagcacuuguucacagaucuccaaaaccaggaauuguucuaguaaaa

SEQ ID NO: 171086 - RNA, 64 nt, Human
ugcacuccagccugggugauagagcgagacucugucuccaaagaagaaacaaaggaaagaaaga

SEQ ID NO: 171087 - RNA, 64 nt, Human
caggacuccugggcccugcuucccugaacccuguucuccaaaacccugccccaggcuaagggug

SEQ ID NO: 171088 - RNA, 58 nt, Human
accucagcuucucccucugaacuucaagucuccaaagaucagaaucugggggagggag

SEQ ID NO: 171089 - RNA, 64 nt, Human
uucccuucaugaauguuggguucuagcucccuguucuccaaacccauacuacacaucccacuuc

SEQ ID NO: 171090 - RNA, 64 nt, Human
aucaucucgcccuguuccuacacuuacggguguaucuccaaauccucucccaauuuuauucccu

SEQ ID NO: 171091 - RNA, 64 nt, Human
acccagugccucugacucuguccccaugggcuggucuccaaagcucuuuccauugcccagggag

SEQ ID NO: 171092 - RNA, 64 nt, Human
cuugggcucaaaagccaagcugugcccagccacgucuccaaaugcuuccuggcccccaugcagc

SEQ ID NO: 171093 - RNA, 64 nt, Human
uugagaguuugccagcagcgagcucggaugcaucucuccaaaagccaccaaggucggcgcgucu

SEQ ID NO: 171094 - RNA, 64 nt, Human
uuuucugauccuuuccccugccuggucuagcuccucuccaaacagccaugcccuccaaaugcua

SEQ ID NO: 171095 - RNA, 64 nt, Human
agguaugggaaacuaggccgcccggucgcgcgccucuccaaaacguucuucccagacugcgagg

SEQ ID NO: 171096 - RNA, 64 nt, Human
gcagcuuucauuacagauuccuugauugguaagcucuccaaaugaugaguucuaguaaacucug

SEQ ID NO: 171097 - RNA, 64 nt, Human
auguucgaagagaacugaugacacugagaacagaucuccaaagcuuuccuggagagucucacuc

SEQ ID NO: 171098 - RNA, 64 nt, Human
ugcucguuuuauagcaaccucucucuacccuaguucuccaaauucacuucugccuuccucaggu

SEQ ID NO: 171099 - RNA, 64 nt, Human
ucuguuauuuguccucaugugagaaagcagaucaucuccaaaucuugccauuuguauacuuuug

SEQ ID NO: 171100 - RNA, 64 nt, Human
ucaccuuucucaaugaaagucucauucuauccucucuccaaacccguuuuccaacauuuguuaa

SEQ ID NO: 171101 - RNA, 64 nt, Human
gagaauuccuuccuccucauccuugguguugcuuucuccaaaugauuguuuuagacuagccaaa

SEQ ID NO: 171102 - RNA, 64 nt, Human
agugaagucaguuuccucucaucaaaucuaaaauucuccaaaauacucucaggcauaacauacu

SEQ ID NO: 171103 - RNA, 64 nt, Human
agccugguccacgugcaucccaccuugggaagccucuccaaagagcuuucggagcugacacuga

SEQ ID NO: 171104 - RNA, 64 nt, Human
aaagcagcccacucuuguguucucaggcaggggaucuccaaaugcaaaaggaagcuuguagagg

SEQ ID NO: 171105 - RNA, 64 nt, Human
ucccaggccugggguguuuguggagaucugucuuucuccaaagauuucauccaacuccccuuuc

SEQ ID NO: 171106 - RNA, 64 nt, Human
auuaugugaacuuuugagagagaugaaaggauggucuccaaaaaauuaaugaugguuauuucug

SEQ ID NO: 171107 - RNA, 64 nt, Human
cuguuaauguaugugauuuucccccuauuuucucucuccaaaaugauaaaaacaauaauuuuau

SEQ ID NO: 171108 - RNA, 64 nt, Human
uuuggcaguucugaaaacaucaccaugacaucucucuccaaaguaacgaccuuuguaagugaag

SEQ ID NO: 171109 - RNA, 64 nt, Human
gguauacuggaagcccauaaagcauucuugcucaucuccaaauaaaacguguuuuauuccuuua

SEQ ID NO: 171110 - RNA, 64 nt, Human
uugguacuuuuaguucuauuccaguguuucagaaucuccaaaaauguaacuggguucccugcau

SEQ ID NO: 171111 - RNA, 64 nt, Human
cggguaaggccuaaaaggucaccccucggcccccucuccaaaagaagggcaugggcacccccag

SEQ ID NO: 171112 - RNA, 64 nt, Human
aacucagcugcugcaagccagaaacacaucccugucuccaaauuuguuggcuaaguggagacac

SEQ ID NO: 171113 - RNA, 64 nt, Human
accaguaagugcuacccaccccucugcagcaacaucuccaaacugucaaguuuagauaaucccc

SEQ ID NO: 171114 - RNA, 64 nt, Human
caguaaguuggcaguuuuggugccaaaccccaaaucuccaaagagacauaccaggcaagacaaa

SEQ ID NO: 171115 - RNA, 64 nt, Human
cuuuaugcggcauuuaugaccaaucuguacuaauucuccaaaccaguauuauuucaauuauggc

SEQ ID NO: 171116 - RNA, 64 nt, Human
ugagucgguggcuucuggacugaagcuauuuucuucuccaaacugcugucucuaauuuggccuc

SEQ ID NO: 171117 - RNA, 64 nt, Human
aguacccagccagguucucuggguccagggugacucuccaaagaaauuggccuucagcuggaga

SEQ ID NO: 171118 - RNA, 64 nt, Human
ccauuguuaccguugcuauggcccuuugccugucucuccaaauccccugguggcucuucuuauc

SEQ ID NO: 171119 - RNA, 64 nt, Human
gagcacccuggcgaccucgugcagaccgaggccuucuccaaagaaagguggugagggcggaggg

SEQ ID NO: 171120 - RNA, 64 nt, Human
gcguuguggcagcaauuuggaaacuacagcaaagucuccaaaaaaauugaagucacccacaauu

SEQ ID NO: 171121 - RNA, 64 nt, Human
auuucagaauguuguaggccucauuagagcuuggucuccaaaaaucuguuugaaaaaagcaaca

SEQ ID NO: 171122 - RNA, 64 nt, Human
aauuuuccaugugauguuuauagucuguauuacuucuccaaauaaugaacuaccugauucauug

SEQ ID NO: 171123 - RNA, 64 nt, Human
guucugcaaauaguucuuuuaacaauuugaccucucuccaaaacagagacacauauaaguagug

SEQ ID NO: 171124 - RNA, 64 nt, Human
gagauaaaugcuguuaauuuaacaaguagauucuucuccaaagaaugaugagugauucuuggga

SEQ ID NO: 171125 - RNA, 64 nt, Human
cuuggaaagaugagguauuaauccccuccauugcucuccaaaagccaauaaagugauuacaccc

SEQ ID NO: 171126 - RNA, 64 nt, Human
ugcacuccagccugggcaacagagcgagacccugucuccaaaaaaaaaaaaaagcaauguuuau

SEQ ID NO: 171127 - RNA, 64 nt, Human
ugcacuccagccugggggacagagcacgacccugucuccaaaaauaaaauaaaaauaaaaauaa

SEQ ID NO: 171128 - RNA, 64 nt, Human
aggaccccucccaccaccucccagugcuuccacgucuccaaaagcgccuuccugucacccucgu

SEQ ID NO: 171129 - RNA, 64 nt, Human
aaaauggcccccacuccuucguguccucccgcuaucuccaaaucggacguucuuucuagcugag

SEQ ID NO: 171130 - RNA, 64 nt, Human
acugcacuccagccugggcgaaagagcgacucugucuccaaaaaaaagagaagaggagaggaca

SEQ ID NO: 171131 - RNA, 64 nt, Human
cauuauacugaaguacucauguuuuaauagugccucuccaaaggccucaccuuggacagagguc

SEQ ID NO: 171132 - RNA, 64 nt, Human
gggcacccucacacaucuccuuaaccacacuuaaucuccaaauaaguacgauaacauagucaua

SEQ ID NO: 171133 - RNA, 64 nt, Human
ugcacuccagccagggcaacagagugagacccugucuccaaaaaaaaaaauuaaauaaauaccu

SEQ ID NO: 171134 - RNA, 64 nt, Human
guugaaaguuggaaacuaucccauugcaaguuucucuccaaauaaaugcaucuaaagauugauu

SEQ ID NO: 171135 - RNA, 64 nt, Human
uaagcauauuauuauauacagguugaguaucccuucuccaaaaugccugggaucagaagcauuu

SEQ ID NO: 171136 - RNA, 64 nt, Human
cugggaaccuccguguguucacgucucaugaagcucuccaaauccaguccucuuggguuuuuau

SEQ ID NO: 171137 - RNA, 64 nt, Human
aggacuggauguugggaaaucaugugaacaucuaucuccaaaucugcaagcuccuguuuuacug

SEQ ID NO: 171138 - RNA, 64 nt, Human
uuuuaaaauggaggaaaggacuugaauagacauuucuccaaagaagauacccagauggccaaua

SEQ ID NO: 171139 - RNA, 64 nt, Human
uugcuacacucgguuacucuggccuugauucugaucuccaaauacauuauauuuuuuauuuggg

SEQ ID NO: 171140 - RNA, 64 nt, Human
ugauagaagccaugucagcaccacacacugcagcucuccaaagaguguguccaccacuccacug

SEQ ID NO: 171141 - RNA, 64 nt, Human
ggugcauccugggguuggcuuuagaaacuaaacuucuccaaaaggacagggcagauuguaaacg

SEQ ID NO: 171142 - RNA, 64 nt, Human
uggcuaauuuuguauuuuuaguagagaugggguuucuccaaaggcuggucuugaacucccgacc

SEQ ID NO: 171143 - RNA, 64 nt, Human
agagaaaguaaaggcaguaaugccuucuccuauuucuccaaagccuugugugaacucaccaaac

SEQ ID NO: 171144 - RNA, 64 nt, Human
uuggucccagccagggucgugggggcagccacucucuccaaagcauagucauaggugucaugaa

SEQ ID NO: 171145 - RNA, 64 nt, Human
gcacuccagccugggcaacaggagugaaacuccaucuccaaaaaaaaaaaaaaaaaaaaaguaa

SEQ ID NO: 171146 - RNA, 64 nt, Human
gcagaaauucauagggcaauguuaaguguuugugucuccaaaaaagauguuggagucguuaccc

SEQ ID NO: 171147 - RNA, 64 nt, Human
ugcugcaggauggacuggccccugacccagggacucuccaaacgggauacaggagagaagcugg

SEQ ID NO: 171148 - RNA, 64 nt, Human
guagugguagccauguguuaauuguuaaauaaauucuccaaagggcuaaaaguaaauuacuuau

SEQ ID NO: 171149 - RNA, 64 nt, Human
acagcuuucgugcucaugguggcuuggcuuugacucuccaaagagcaauaaaugccacuuggag

SEQ ID NO: 171150 - RNA, 64 nt, Human
aacaggagcucuuaacuacaguggcugaauagcuucuccaaaggcucccuguguucucaccgug

SEQ ID NO: 171151 - RNA, 64 nt, Human
ugcacuccagccugggcaacauagcgagaccucaucuccaaaaaagaaaacaaaaaacaaaaaa

SEQ ID NO: 171152 - RNA, 64 nt, Human
gcaaaaaggauucacagaaauggaccaguucuguucuccaaagacugcagcaaugauauuucag

SEQ ID NO: 171153 - RNA, 55 nt, Human
auccuccagggcccaugugagcagaucuccaaaguguuccuaauggagaaggacc

SEQ ID NO: 171154 - RNA, 64 nt, Human
uugccaauuuucugauuuuuuguguggaaaaaaaucuccaaauuguaguuuuuaaauuugggga

SEQ ID NO: 171155 - RNA, 64 nt, Human
gaccugaaucgggagccacacuuggcccucuuccucuccaaagcgccagaaccuccuucucuuu

SEQ ID NO: 171156 - RNA, 64 nt, Human
ugcauuugaaaagcagguugaauccuugcucucuucuccaaauuuggugugguauaaagacaca

SEQ ID NO: 171157 - RNA, 64 nt, Human
ugcacuccagcuuagguggcaaagugagacccugucuccaaaaaaagaaaauagagcuuuauaa

SEQ ID NO: 171158 - RNA, 64 nt, Human
cacugcacuccagcugugugacagaaugagaccaucuccaaaaaaaaaaaaaaguagauuucag

SEQ ID NO: 171159 - RNA, 64 nt, Human
aaauaaguguuguauguauuaaaccuuuuccaguucuccaaagcgauguauuuuuguacacuug

SEQ ID NO: 171160 - RNA, 64 nt, Human
aggggugcucugcuggucuucaauuaccaagaauucuccaaaacaauuuucugcaggaugauug

SEQ ID NO: 171161 - RNA, 64 nt, Human
gccaagucugaagaaucagaggcaacuucaugguucuccaaagaagagcccguuacuaucaguc

SEQ ID NO: 171162 - RNA, 64 nt, Human
agcucggagucaaucccaggaaaauaugcgaaguucuccaaacccauuuauuacuggcuugacc

SEQ ID NO: 171163 - RNA, 64 nt, Human
acaaacaaacaaaaaacacaaaaaaaaccacucuucuccaaaugcccaagccuucuuucaaaau

SEQ ID NO: 171164 - RNA, 64 nt, Human
gaaguguucuugacaguuuaauaugauucacuuuucuccaaagacauguaaaaggcuguuacga

SEQ ID NO: 171165 - RNA, 64 nt, Human
uguguuggcaucaucuuuuugcucuagcccuuccucuccaaaauaaaaucaaauaaaggaaaau

SEQ ID NO: 171166 - RNA, 64 nt, Human
uuggccuucucuccucccugccuagaucaguccuucuccaaaaggaccugggagcuggcagccu

SEQ ID NO: 171167 - RNA, 64 nt, Human
ugcuuuucaaccuuucucucccgaacaucuuccuucuccaaagcugggagucauguugccugca

SEQ ID NO: 171168 - RNA, 64 nt, Human
uacauacagacauacugaagggauuaguacaauuucuccaaaguacuguaccuaucuucagcaa

SEQ ID NO: 171169 - RNA, 64 nt, Human
cuuucugcucuggcccacaugugacucuugauauucuccaaagacaccagccaauuaaaaagcg

SEQ ID NO: 171170 - RNA, 64 nt, Human
uuuugauucuguuuuaaaauuaucucguuaaagaucuccaaauuuguuccgaugacaagugaaa

SEQ ID NO: 171171 - RNA, 64 nt, Human
gcagcccugcagccacccacgcaccaucugugggucuccaaaggcaccuuguagcauguacucc

SEQ ID NO: 171172 - RNA, 64 nt, Human
cgguggagucugccuuucucaggcccuaaaucccucuccaaaggguacuugcgaugccggauuu

SEQ ID NO: 171173 - RNA, 64 nt, Human
aggcccugggaggagcggggacacugaggaccucucuccaaauuggccucucaacucacagguu

SEQ ID NO: 171174 - RNA, 64 nt, Human
gaccagccgugaauguguaggguugcagcucuauucuccaaaacuguaggaacuugacuugcgu

SEQ ID NO: 171175 - RNA, 64 nt, Human
guaggacuuucuugcacuaguuccuaugacugagucuccaaacugguuuccuaguaguccccca

SEQ ID NO: 171176 - RNA, 64 nt, Human
gagucuuaacuuaauuacaucugcaaggcccccuucuccaaauaagauaaauucaugguuuugg

SEQ ID NO: 171177 - RNA, 64 nt, Human
guucuuccuuuccuaacccgggccccugcccagcucuccaaagucuuucagaaaaguaaauccu

SEQ ID NO: 171178 - RNA, 64 nt, Human
uagaaaaggcaagcacuuuguucugagucuuuuaucuccaaauacauaguugucucaaaccaag

SEQ ID NO: 171179 - RNA, 64 nt, Human
auucaucagcauuaucucauagauuggaaaauuuucuccaaauacaauagaggagaauauguaa

SEQ ID NO: 171180 - RNA, 64 nt, Human
gaaaugagaugguuuggccaugcaccaccucagaucuccaaacugaugucccugugaacaccug

SEQ ID NO: 171181 - RNA, 64 nt, Human
gugauauuccuuccaguaaugccacuguauuuugucuccaaauaaaagaagcuuauuguaguau

SEQ ID NO: 171182 - RNA, 64 nt, Human
augaaaauggauauuuaguguauuuuguagaagaucuccaaagaucuuuugugacuacaacuuc

SEQ ID NO: 171183 - RNA, 64 nt, Human
ugaacuccagccugggccacauagcaagacccugucuccaaaaaaaaaaagaaauaaaagacga

SEQ ID NO: 171184 - RNA, 64 nt, Human
cccuuuuccucaacucagugaggccaggauuugcucuccaaaaggcuuugcuaguguguucaau

SEQ ID NO: 171185 - RNA, 53 nt, Human
ucccaaagucaagacccugaaucucuccaaaaauaaggugagaagggggagcc

SEQ ID NO: 171186 - RNA, 64 nt, Human
cauaucuuaacauauuuuuuucuccaguuggcucucuccaaaaaugccuuuuguuuuucucugc

SEQ ID NO: 171187 - RNA, 64 nt, Human
gaaucuuaccgagcuguagaaaauaaaaaauuccucuccaaacauggguaguuuuaugucaaaa

SEQ ID NO: 171188 - RNA, 64 nt, Human
gaggacucgaagaucauggucucugacuuuggacucuccaaaauccaggcugggaacaugcuag

SEQ ID NO: 171189 - RNA, 64 nt, Human
cagcagcgugccggaccccucccuuccauccuccucuccaaagaacagaggucaggaaaaacac

SEQ ID NO: 171190 - RNA, 64 nt, Human
auguuauuuagucauuaugaggggcacauucuuaucuccaaaacuagcauucuuaaacugagaa

SEQ ID NO: 171191 - RNA, 64 nt, Human
gcaauguaaaagagacaaauaaggagaaagaaaaucuccaaaccaggaauguuuuugugccacu

SEQ ID NO: 171192 - RNA, 64 nt, Human
cgcaccugugccugagacuccggauggacgacacagucgucacgucgcucuuccugcggguucu

SEQ ID NO: 171193 - RNA, 64 nt, Human
cugcagaaacugguagguuucaucaggugguuaaagucgucaaaguuguaagugacuaaccaag

SEQ ID NO: 171194 - RNA, 64 nt, Human
caguuggaaucuagacacuaugcuggguucccugagucgucaggccagacauuucaacaaggcu

SEQ ID NO: 171195 - RNA, 64 nt, Human
aaagacuuuaccugucuaauggaaaaccuggagaagucgucaggaaccagacuacaguggaccc

SEQ ID NO: 171196 - RNA, 64 nt, Human
guacccagucaccucugucuucagcacccucauaagucgucacuaauacacaguuuuguacaug

SEQ ID NO: 171197 - RNA, 64 nt, Human
ccaccuccugucguccugccuggccuccagcccgagucgucauccccggagucccuauacagag

SEQ ID NO: 171198 - RNA, 64 nt, Human
augugcuauaaucuguuuuuacguauguaggcccagucgucaucagaugcuugcggcaaaagga

SEQ ID NO: 171199 - RNA, 64 nt, Human
caguuuauuggcucuucuacauucauugccaucaagucgucagcuuguucuggaaacucuuuau

SEQ ID NO: 171200 - RNA, 64 nt, Human
acugcacauuuuguacaaagauaugcuaagcaguagucgucaaguugcagaucuuuuugugaaa

SEQ ID NO: 171201 - RNA, 64 nt, Human
gaaccgcaugauacgguggaaggagcacuggacuagucgucacuacccuuuuuggauucagggc

SEQ ID NO: 171202 - RNA, 64 nt, Human
auagagggccaagacuuggcaacagaagcaguugagucgucaucacuuuucagugaugggagag

SEQ ID NO: 171203 - RNA, 64 nt, Human
aaaaagaaugacucaaauguauuauugccaaccaagucgucaaaucuaaugucaaguucucuua

SEQ ID NO: 171204 - RNA, 64 nt, Human
cucuguucccaaauggugguggcacuuauccugaagucgucaaugauuucccuuugaaacuacu

SEQ ID NO: 171205 - RNA, 64 nt, Human
acaguggaugggggggcacccacaccuuccgcgcagucgucauaggccuucccagaaggagcug

SEQ ID NO: 171206 - RNA, 64 nt, Human
ucaugccuuccgcuuagucucauuuuauucauucagucgucaugaguugagugcuuacuacaug

SEQ ID NO: 171207 - RNA, 64 nt, Human
ccccaaggaaagccuacauccuugaaaacugcacagucgucaugggugaauuugccuagaccac

SEQ ID NO: 171208 - RNA, 64 nt, Human
cagcugggcuggacuguugccaacaucaccuuaaagucgucaguaaaaguaaaaaggaaaaagg

SEQ ID NO: 171209 - RNA, 64 nt, Human
auugaauacaauuuaaauucuacuugaugacugcagucgucaaggggcuccugaugcaagaugc

SEQ ID NO: 171210 - RNA, 64 nt, Human
ucaaggcuuugaaaucuccccuugcacugagauuagucgucagaucucuccccgucucccuccc

SEQ ID NO: 171211 - RNA, 64 nt, Human
augcaaaaauuguuauauaugaacauauaacuggagucgucaaaaagcaaauuaagaaagaauu

SEQ ID NO: 171212 - RNA, 64 nt, Human
ugaagaacguugacccauuugaguacccggucucagucgucauuuuuaaguccagugagcauug

SEQ ID NO: 171213 - RNA, 64 nt, Human
cugugccaguccccaguucaccagcuuuguauccagucgucaucucauucaaguauggcuuuac

SEQ ID NO: 171214 - RNA, 64 nt, Human
ggcauuuuguugacugucagguuaggugucccuuagucgucaucagaagcugaagccuuccuuu

SEQ ID NO: 171215 - RNA, 64 nt, Human
uuugccgaauuuggccuccucaaaagcagcagcaagucgucaagaagcacaccaauucuaaccc

SEQ ID NO: 171216 - RNA, 55 nt, Human
ucaccaagaaaugguccuaauccugagucgucacccuuggauuuuauggaucacg

SEQ ID NO: 171217 - RNA, 64 nt, Human
aucuggacagacggccagagaguaugcuguuucuagucgucauaauguguaaguguuuacauua

SEQ ID NO: 171218 - RNA, 64 nt, Human
cgucaaugggacgcauuuuucuguugagcuaugcagucgucaaaacagcgauagacagcauagg

SEQ ID NO: 171219 - RNA, 64 nt, Human
uaauuucuaaggguccaagucccagagaauccauagucgucaaagcuuugagaguaucuuucuu

SEQ ID NO: 171220 - RNA, 64 nt, Human
aagguggggauaaaguagaguggaaauaauguagagucgucagacugaaaggccagguuguagu

SEQ ID NO: 171221 - RNA, 64 nt, Human
gaggaggacuuggcaacuggcuuuucuccuguggagucgucacacgccauccagcagcgcuaag

SEQ ID NO: 171222 - RNA, 64 nt, Human
caggccguagaugcuccccgccggucagucacuuagucgucagaucgcccguccugguaucaca

SEQ ID NO: 171223 - RNA, 64 nt, Human
gccucccaagccugcuucuuuguccucgccacauagucgucagcguaggcaccugggagcugcu

SEQ ID NO: 171224 - RNA, 64 nt, Human
cucuuucuuuaaauguuuuuggccaucaaguagcagucgucaguaggaguuuauaauaccaaga

SEQ ID NO: 171225 - RNA, 64 nt, Human
ugcuaggaaagagugaugugugagauucccagagagucgucacaccaguguuaugccugggagu

SEQ ID NO: 171226 - RNA, 64 nt, Human
augcuuucuacccuauagguucuaggcuagacagagucgucauuucuguguccucaauuuuauc

SEQ ID NO: 171227 - RNA, 64 nt, Human
guuuccuuuaccaucugcaucuuauuauaaauguagucgucauaaagugugguuuauuuuauuu

SEQ ID NO: 171228 - RNA, 64 nt, Human
uggaguagguccacgugaaaacaaugaguggagaagucgucacgggucuuucaucccuucauug

SEQ ID NO: 171229 - RNA, 64 nt, Human
uuaaguagaacaaaaaacccagcgcaccuguuagagucgucacucucuauugucauggggauca

SEQ ID NO: 171230 - RNA, 64 nt, Human
acugugugcugggacgcuguacagagaccagcucagucgucagagaaaccaugagguggugucc

SEQ ID NO: 171231 - RNA, 64 nt, Human
uucauuggcaacagcagaaccugccucuccgugaagucgucagccuaaaauuuguuucucucuu

SEQ ID NO: 171232 - RNA, 64 nt, Human
cagacugaggccuuuugguagucggagcccccgcagucgucagccucccugacgucugccacca

SEQ ID NO: 171233 - RNA, 64 nt, Human
gcuugcgacuuauuuauaaauauuguaaguuugugucgaugaguguaaguuggcagugcgcacg

SEQ ID NO: 171234 - RNA, 64 nt, Human
uaggcaguuuguaagauuccuccuaacuuucacagucgaugacaagauugucuuuuuaucugau

SEQ ID NO: 171235 - RNA, 64 nt, Human
cacaacuggccugaaauucuuaaaggaugggagugucgaugacagcaccuuggcaucguugugc

SEQ ID NO: 171236 - RNA, 64 nt, Human
ccucauuacagaugacacacuggaguguggaggggucgaugacuugugcagggucauaugguac

SEQ ID NO: 171237 - RNA, 64 nt, Human
aaguuaagcuaaaguuuuaaaguggcaguuuucugucgaugacuuuuucaagugcuaacacugu

SEQ ID NO: 171238 - RNA, 64 nt, Human
gguuuguauauaacccucuaagccccuaucccuugucgaugacagucauccuaaugauaauaaa

SEQ ID NO: 171239 - RNA, 64 nt, Human
ucacacaccucaaauacaaaaagugccugggaacgucgaugagguauuaaaggaaaccacuggu

SEQ ID NO: 171240 - RNA, 64 nt, Human
aagcauuuuugugcccccucugcuuacugugacagucgaugaugaaucuugcguugccauuuuc

SEQ ID NO: 171241 - RNA, 64 nt, Human
agucuugaugccucgacgggaccccuugaaggcugucgaugauagguuagaaauagcaaaccug

SEQ ID NO: 171242 - RNA, 64 nt, Human
acuaaggaguaaucuguguacaaagaaauaacaagucgaugaacuauuccccagcagggucuuu

SEQ ID NO: 171243 - RNA, 64 nt, Human
aaacacaucagaauugaauacgaauaaucuauuugucgaugaaauaaacacaacucuuugagga

SEQ ID NO: 171244 - RNA, 64 nt, Human
ugaccucuauagcaugugaguaguagauaaucaugucgaugaccuuuuuuucuuuagaguaaca

SEQ ID NO: 171245 - RNA, 64 nt, Human
caucaaguaacaaacauaccacucuguggagaaugucgaugaugggcagugggggguggaaugc

SEQ ID NO: 171246 - RNA, 64 nt, Human
uucacagugucuguaaaucaagaccaaagagccugucgaugagacuguuuauuaccagauucac

SEQ ID NO: 171247 - RNA, 64 nt, Human
auauccccccgacaagaaggucaaagccaaggacgucgaugaguacaaacugaaagaccacuau

SEQ ID NO: 171248 - RNA, 64 nt, Human
cccuuaagguugaaacuguaaugacauaaaaagggucgaugauauuucacugaugguagaucgc

SEQ ID NO: 171249 - RNA, 64 nt, Human
cuccaucugggaaagcugaugauguguucaugcagucgaugacccucacugcuuuuucagccag

SEQ ID NO: 171250 - RNA, 64 nt, Human
ugagcugaaagcacagucuacucuccuucguuuugucgaugagaaaguugaggccagaggggag

SEQ ID NO: 171251 - RNA, 64 nt, Human
acccuaauggcccaacagggaaauucucauuuuggucgaugauauucugauggacugguuuggu

SEQ ID NO: 171252 - RNA, 64 nt, Human
uaaauaugcuacccucacuuuucuuggcaguuaugucgaugaaaucaagagugugauguucuag

SEQ ID NO: 171253 - RNA, 64 nt, Human
uugucaaguaucacauuguacaucuugccuagaugucgaugacugcaaguaauaauacaguuua

SEQ ID NO: 171254 - RNA, 64 nt, Human
gguauggaaugaaugcaguacaucuggaauuguagucgaugaauugcuuuuuugacuuagaagc

SEQ ID NO: 171255 - RNA, 64 nt, Human
agagccugauugcugacccagucucaggccuguggucgaugaccucucgguaguuucaaagggg

SEQ ID NO: 171256 - RNA, 64 nt, Human
agugggaaacuucauggguuuccucaucugucaugucgaugauuauauauggauacauuuacaa

SEQ ID NO: 171257 - RNA, 64 nt, Human
acguaugucugagucccugagaucacaugcuaaagucgaugaaaaguaaccacugccacugucu

SEQ ID NO: 171258 - RNA, 64 nt, Human
accugggcuccggccagcgcccaacagcguggaugucgaugacuucaucaacacgagaauacag

SEQ ID NO: 171259 - RNA, 64 nt, Human
cuuugugagaccugggcaaaggauggggcagcucgucgaugauuuuuuuguguuuccaggcuuc

SEQ ID NO: 171260 - RNA, 64 nt, Human
guugacacuuggcacuuugcuggccccgagaaaggucgaugacacagccgcaaaucuaauccac

SEQ ID NO: 171261 - RNA, 64 nt, Human
auucauuguuccagcaguuugaaaauaaauuguugucgaugauagucaccuuuagugcugcaga

SEQ ID NO: 171262 - RNA, 64 nt, Human
ugcagucacugcagcuugccaggcugucauuccugucgaugaccugaaaggacacaaacuggaa

SEQ ID NO: 171263 - RNA, 64 nt, Human
augguuuagcaggucaccuaguugggucagaagagucgaugaucaccaagcaggaaagggaggg

SEQ ID NO: 171264 - RNA, 64 nt, Human
caaggugggggcuguggccauguguggccgugaugucgaugauacucguuuucccugauccgug

SEQ ID NO: 171265 - RNA, 64 nt, Human
uucuggaaauaugucuuuaaguauuuuagacauuccucgucaguauuaggaauuuccaugggaa

SEQ ID NO: 171266 - RNA, 64 nt, Human
uaucaggaacauuccuuccugaacauauucugcaccucgucagccuucaggacugaucugccau

SEQ ID NO: 171267 - RNA, 64 nt, Human
ucauccaguuucuguuaagacacaccaugagccuccucgucacccuucuccuuuuggggugaga

SEQ ID NO: 171268 - RNA, 64 nt, Human
gugccuggcuucuaccugggugcucaggaauguuccucgucaccccugccacucuguggucggu

SEQ ID NO: 171269 - RNA, 64 nt, Human
aacauuaacuacaauucacuguugugagaauauuccucgucacagcaaaaacacuuuccuuucu

SEQ ID NO: 171270 - RNA, 64 nt, Human
aggccacaguaccaccccaccugcccaggcagccccucgucaccuacuccccgaaguuaccagc

SEQ ID NO: 171271 - RNA, 64 nt, Human
gugucagcacggaugcugugacugccaccugcguccucgucaagugcccgagcucgccgccgug

SEQ ID NO: 171272 - RNA, 64 nt, Human
agugggauaaauaagaaauggaaucauuuggcugccucgucacuugugcuaauggucaguugua

SEQ ID NO: 171273 - RNA, 64 nt, Human
ugacaccaaggacagcacuugucaucaucccuauccucgucagccccacccuacugccucagcu

SEQ ID NO: 171274 - RNA, 64 nt, Human
guauauaacccagccccuggcucugggguggucaccucgucagugccuuuuguucuggaggaga

SEQ ID NO: 171275 - RNA, 64 nt, Human
gcccuggcagccuggaagaccgugccugcccagcccucgucaccacagggacuccuuggguccu

SEQ ID NO: 171276 - RNA, 64 nt, Human
gcuuuugcaaagauaugugggugcuccucuucugccucgucauggccagcugccaguacucccu

SEQ ID NO: 171277 - RNA, 64 nt, Human
ccccccuccccuuuuaguagguuuuccugcuauuccucgucaaguccucuuguuuuuuuaucuu

SEQ ID NO: 171278 - RNA, 64 nt, Human
ccaucuucaccagcgagcacggggagaagcucuaccucgucagggcccugcagugacggcgccc

SEQ ID NO: 171279 - RNA, 64 nt, Human
gaaagggcagcgccacagaagccccuaaacgccgccucgucauacgccccuccuccuucucucu

SEQ ID NO: 171280 - RNA, 64 nt, Human
gcaguucucugaauugagagauguaccucuuaaaccucgucagugguuauucagggucugagca

SEQ ID NO: 171281 - RNA, 64 nt, Human
ccuuucaaccgagacuauuucuggauugugugcuccucgucaguugacuuguuuugcacacuuu

SEQ ID NO: 171282 - RNA, 64 nt, Human
accaggaguucccagcggggugacagucugaagaccucgucaccugugaguugauguagaggag

SEQ ID NO: 171283 - RNA, 64 nt, Human
ugccugugugagccgacaucugcucaguccuaucccucgucagcguguggagacccagcuccug

SEQ ID NO: 171284 - RNA, 64 nt, Human
gugucuuggcguacccucuccacgugcccgucccccucgucaucagagguaaaggcaugagaaa

SEQ ID NO: 171285 - RNA, 64 nt, Human
ccgcuccuuuccugcauuucucccucccuccuucccucgucacaucucuuauaugagcacagua

SEQ ID NO: 171286 - RNA, 64 nt, Human
acccuugcccucccugggucgcagacgaggucggccucgucauuccccgcagaccgccgcgcgu

SEQ ID NO: 171287 - RNA, 64 nt, Human
cacgugcauggaacccgagccaacuucaccccacccucgucauuaccugggagaugcacaagac

SEQ ID NO: 171288 - RNA, 64 nt, Human
gccacccuuccgcacuggggagaaucuaugcaagccucgucaacaccacuuugcagcauucagc

SEQ ID NO: 171289 - RNA, 64 nt, Human
uccagauuaucaaagcuaauuugacuaguuugaaccucgucagacauucauuccuuuggccauu

SEQ ID NO: 171290 - RNA, 64 nt, Human
gaagguaccgcagaaauugaugugugcucccugcccucgucacugcccaagcccgggccugcac

SEQ ID NO: 171291 - RNA, 64 nt, Human
uacuuacuuaaucacaguuuaguuuuuuucuuaaccucgucaggcccagaguucacuucuuugu

SEQ ID NO: 171292 - RNA, 64 nt, Human
gcacagaaaaguauuuuaaccuaccuguagagauccucgucauggaaaggugccaaacuguuuu

SEQ ID NO: 171293 - RNA, 64 nt, Human
aucccuguuaaugaugguuguguuuaagaaucuuccucgucacguuuguguucagaucucuuau

SEQ ID NO: 171294 - RNA, 64 nt, Human
gagacuccacugagacguggcugagugaaaucuuccucgucaguggucaaggugugucauccau

SEQ ID NO: 171295 - RNA, 64 nt, Human
gagcggcuuccagagcagaugcuguuuccauccuccucgucaaaaccauucucgcugcugagcu

SEQ ID NO: 171296 - RNA, 64 nt, Human
uuugucccugcucagcccggaggcugugcacggcccucgucacaaggugacccuugcagcacag

SEQ ID NO: 171297 - RNA, 64 nt, Human
gauuuauaugcauuaucuucuucagucacaacaaccucgucaucauccccacuuuaaaccccag

SEQ ID NO: 171298 - RNA, 64 nt, Human
gcucgcccccuuccuccugccguccacugcgcggccucgucagucccggggcugacugucccuc

SEQ ID NO: 171299 - RNA, 64 nt, Human
ugagugagccccagcccgccccugcaguucccggccucgucaagugaacucggcagacccuggg

SEQ ID NO: 171300 - RNA, 64 nt, Human
ugccucccucacagccaugcccagaagccucacaccucgucaccaccaccaccccccaccccau

SEQ ID NO: 171301 - RNA, 64 nt, Human
caggucacgugaucccuccagacaacauccugccccucgucaucugcagcgggaucuccaacca

SEQ ID NO: 171302 - RNA, 64 nt, Human
ugugcagucucauggggagaggcuucuuucguuuccucgucaaacaucugauugacgcuugcaa

SEQ ID NO: 171303 - RNA, 64 nt, Human
caaagccaaaauagcuccuacaauuucuuauaucccucgucauguggcaguauuuauuuauuua

SEQ ID NO: 171304 - RNA, 64 nt, Human
cacggcuugggacuuggucucuguccugccccauccucgucacuugggaccacgagcccugguu

SEQ ID NO: 171305 - RNA, 64 nt, Human
uauccuauguaaaccauaagugaagggaaauaaaccucgucaugcuccaugcugugaggugucc

SEQ ID NO: 171306 - RNA, 64 nt, Human
cagauucccauucuuagccuaacguucgucauugccucgucacaucaaugcaaaagguccugau

SEQ ID NO: 171307 - RNA, 64 nt, Human
ucccugugggcgggugccucccacgcccuugcccccucgucagcucccagccagcacccuacuc

SEQ ID NO: 171308 - RNA, 64 nt, Human
uugaggguacccaucuagcuacuuggggucaggaccucgucagaccagguucggauacaaucau

SEQ ID NO: 171309 - RNA, 64 nt, Human
cgaucugguugugacuguggccccugccgugucuccucgucaggggagacuuuuaggaggccgc

SEQ ID NO: 171310 - RNA, 64 nt, Human
accccaucuuugcugccagcucucaggaccgugcccucgucagcugggaugugaagucucuggg

SEQ ID NO: 171311 - RNA, 64 nt, Human
aguaggagcuaggacuagccaggacccgcagccgccucgucaccuccaguugggugccucuggg

SEQ ID NO: 171312 - RNA, 64 nt, Human
auucugacauccacaugcucugcaguccuggcccccucgucauuuucuuucccagaagcgcccu

SEQ ID NO: 171313 - RNA, 64 nt, Human
cuuuggcugguagcagcaggcucaggcacauacaccucgucaagagcaugcacaugcugucugg

SEQ ID NO: 171314 - RNA, 64 nt, Human
cagaguaucuaauccuuuaaugaucugguggucuccucgucaauccaucagcaaugcuucucuc

SEQ ID NO: 171315 - RNA, 64 nt, Human
cucaugaauaaacaucuccgugaaacgccaaggcccucgucaaacccugagucaugacugggag

SEQ ID NO: 171316 - RNA, 64 nt, Human
ccucccugauccccuucauuucuucaccgcgguuccucgucauagggguucucacucugaacuu

SEQ ID NO: 171317 - RNA, 64 nt, Human
acgucauaaugaagaauggaaguuuggaucugcuccucgucaggcgcagcaucucugaagcuug

SEQ ID NO: 171318 - RNA, 64 nt, Human
ucuccugccucccagccucucccaagaccuccccccucgucaccagccaucccucuggaccagg

SEQ ID NO: 171319 - RNA, 64 nt, Human
gccguguggcgggcaccgcccuggccuuccgcacccucgucacccgcaucuccaacgaccucga

SEQ ID NO: 171320 - RNA, 64 nt, Human
accccaggcucugcucugcccugcccugcaccccccucgucagaaguacaugaggggcgcagag

SEQ ID NO: 171321 - RNA, 64 nt, Human
uguccucauuucccugugcauauucagggacaugccucgucaggguuuggcaagaaaauggggc

SEQ ID NO: 171322 - RNA, 64 nt, Human
gugugucucaccaagacagugagaccgacuccccccucgucaugguguuuugugccuggacucg

SEQ ID NO: 171323 - RNA, 64 nt, Human
ucccacugcacuguggugcuucaguggccaccagccucgucacauacaccagcaucuuucugua

SEQ ID NO: 171324 - RNA, 64 nt, Human
gcgggacaaaugauggucuucacggugggauggaccucgucagcugcccaggcccuccucucuc

SEQ ID NO: 171325 - RNA, 64 nt, Human
aaugaaaagagucagaucccauuuccgucugcccccucgucaccaggugugauagccccagcca

SEQ ID NO: 171326 - RNA, 64 nt, Human
acgaggcuggacuuccucgaguggccacugugagccucgucacagcagaaaccaacuuuucuaa

SEQ ID NO: 171327 - RNA, 64 nt, Human
ugauaaggccaucuuggcuuugaguagcaguguuccucgucacccauuucccccucaggauuac

SEQ ID NO: 171328 - RNA, 64 nt, Human
uugucaaagucacgagugcgucugccuugacagcccucgucaacagaacuuccaguggguugug

SEQ ID NO: 171329 - RNA, 64 nt, Human
aggcugccugaugaccacuagagguaugucugccccucgucacccugcugcacaccaaucugug

SEQ ID NO: 171330 - RNA, 64 nt, Human
uuuuuacugcgucccgucccgccagcccuaucggccucgucacuggccuuggucacuuuguauu

SEQ ID NO: 171331 - RNA, 64 nt, Human
gaacugccaaaacaaaaaaacaaauacaaacaaaccucgucaccacggucaggaggagguucag

SEQ ID NO: 171332 - RNA, 64 nt, Human
ugaccuuucacgaacgugggcauggcugcggaccccucgucaucagguguauagcaagugaaag

SEQ ID NO: 171333 - RNA, 64 nt, Human
ugaccuuucacgaacaugggcauggcugcggcucccucgucaucaggugcauagcaagugaaag

SEQ ID NO: 171334 - RNA, 64 nt, Human
gugaccuuucacgaacaugggcauggcugcggacccucgucaucaggugcauagcaagugaaag

SEQ ID NO: 171335 - RNA, 64 nt, Human
ugaccuuucacgaacaugggcauggcugcggaccccucgucaucaggugcauagcaagugaaag

SEQ ID NO: 171336 - RNA, 64 nt, Human
cucccuccagagacucgaguccccaugauucccuccucgucagucucucaaagaccccaugguc

SEQ ID NO: 171337 - RNA, 64 nt, Human
ugaccuuucacgaacaugggcauggcugcggaucccucgucaucagguguauagcaagugaaag

SEQ ID NO: 171338 - RNA, 64 nt, Human
ugaccuuucacgaacgugggcauggcugcggaccccucgucaucaggugcauagcaagugaaag

SEQ ID NO: 171339 - RNA, 64 nt, Human
ugaccuuucacgaacaugggcauggcuguggaccccucgucaucaggugcauagcaagugaaag

SEQ ID NO: 171340 - RNA, 64 nt, Human; identical to SEQ ID NO: 171335

SEQ ID NO: 171341 - RNA, 64 nt, Human; identical to SEQ ID NO: 171335

SEQ ID NO: 171342 - RNA, 64 nt, Human
uuugagcaccugccauuuugccuugcaucguuucccucgucaugcauuuccacauauccacaaa

SEQ ID NO: 171343 - RNA, 64 nt, Human
caacaauucuguagccucaaguaagaccaccugugaacuugaucauuaucuggcccaaauauga

SEQ ID NO: 171344 - RNA, 64 nt, Human
uagccggaaaaggccucgggcuuggcaaauggaagaacuugagugagaguucagucugcagucc

SEQ ID NO: 171345 - RNA, 64 nt, Human
uucuuuuguuuugcagauagauccacccacugaggaacuugaaaauuuuuuucaaacauaacuc

SEQ ID NO: 171346 - RNA, 64 nt, Human
cucaaggaacaaagaagauaaagcacaaaucgcagaacuugaauccaggcugcugcucaucaua

SEQ ID NO: 171347 - RNA, 64 nt, Human
cuuguguuauaaguaacacagaagaagaauggaugaacuugauucguuuuccauugauugugau

SEQ ID NO: 171348 - RNA, 64 nt, Human
ugucuuuuggucaagagaacuaacaaauauaaaggaacuugaaauguggggagugauaauaguc

SEQ ID NO: 171349 - RNA, 64 nt, Human
auuucggguccgcuagguggcccgucucaucugugaacuugacucugucccucuacaugucucu

SEQ ID NO: 171350 - RNA, 64 nt, Human
uucuuuuuguacuuuggaacgacaaaaugaaacagaacuugacccugagcuuaaauaacaaaac

SEQ ID NO: 171351 - RNA, 64 nt, Human
cguccucuccugucacccauuuugaagaguggcagaacuugaaguucaacuuccucuguaaaua

SEQ ID NO: 171352 - RNA, 64 nt, Human
aaauagugcauuuuuuucucagggaauuuuagaugaacuugaauaaacucuccuagcaaaugaa

SEQ ID NO: 171353 - RNA, 64 nt, Human
gucaggagaaggagggcucccgaguggaaauguggaacuugaugccacccccugcaauggagag

SEQ ID NO: 171354 - RNA, 64 nt, Human
gcugaauuuuuagggcacuuuuccuuaagaaauagaacuugauuuuuauuuguuacagguuucc

SEQ ID NO: 171355 - RNA, 64 nt, Human
uguaauugauuacaugggcugggggggugucaaagaacuugacagguuguguugaugcucuuag

SEQ ID NO: 171356 - RNA, 64 nt, Human
agccccauuuccucacacuaagagggcagacugugaacuugacugggugagacccaaagcgguc

SEQ ID NO: 171357 - RNA, 64 nt, Human
acaucaagggcggacaccaccaaggggcccucuggaacuugagaccacuggaggcacaccugcu

SEQ ID NO: 171358 - RNA, 64 nt, Human
cguauuuucugauguggcuuuacauuucaaaagugaacuugauucaaccugagaaaacugauua

SEQ ID NO: 171359 - RNA, 64 nt, Human
caguaaauggagccaagucuugguuugacaaggggaacuugauccuucagggaagaaucaucuc

SEQ ID NO: 171360 - RNA, 64 nt, Human
cugugugccuugaaggccagagcauuuagggacagaacuugaaagagaagauggcgaaaagggc

SEQ ID NO: 171361 - RNA, 64 nt, Human
gcacaaaauaaucuccccguccaaggagcuuguggaacuugaauugggaacuuuggagucuugu

SEQ ID NO: 171362 - RNA, 64 nt, Human
augugccuuuaaaagaucuaacuaugggaugggagaacuugagggugaucgggaaccuccccug

SEQ ID NO: 171363 - RNA, 64 nt, Human
gaagaaaaaaaauaacacagagagacagacuugagaacuugacaaguugcgacggagagaaaaa

SEQ ID NO: 171364 - RNA, 64 nt, Human
ugguacuucaacagcaauccccugucaaaccucagaacuugaggcugaaacauugcuuccaccc

SEQ ID NO: 171365 - RNA, 64 nt, Human
cccaccaagaguccacagaccuuucaucuuucacgaacuugauccuguuagcaggugguaauac

SEQ ID NO: 171366 - RNA, 64 nt, Human
gcucuuguuguggagagcauaguaaauuuucagagaacuugaagccaaaaggauuuaaaaccgc

SEQ ID NO: 171367 - RNA, 64 nt, Human
aauuuaaggaugacuuuuuuucugauucaaaagugaacuugauuuuaaaaaccagucaagagca

SEQ ID NO: 171368 - RNA, 64 nt, Human
ucacaucugcaacauccuucaauugcgggaaaaggaacuugauuuaacagaagaacaugguaga

SEQ ID NO: 171369 - RNA, 64 nt, Human
aaggaaguaugcuuuggugagucaauuaguaugggaacuugacuaaagacccccaguguuguaa

SEQ ID NO: 171370 - RNA, 64 nt, Human
gcggcaguauccagaacaauaagcagguccugcggaacuugauuaacuccuccugcgaucagcc

SEQ ID NO: 171371 - RNA, 64 nt, Human
ugucuauuauaaaaccaaaacucauucguuuaaugaacuugacugucauaccucuauuuaguaa

SEQ ID NO: 171372 - RNA, 64 nt, Human
aaauaagccaaaauaauccuaaaauucauuagaagaacuugauaaaagacucaaauaaauguua

SEQ ID NO: 171373 - RNA, 64 nt, Human
uaugggucuauuucuuccaugauuagaggagagagaacuugauucaagauacugaaaaauagag

SEQ ID NO: 171374 - RNA, 64 nt, Human
uuagcugcacggcauuaccccacacaggguggcagaacuugaaggguuacugacguguaaaugc

SEQ ID NO: 171375 - RNA, 64 nt, Human
uuuucaauauggaccaggaaggcauauguauuuugaacuugagugaaaagguugaaguuacaga

SEQ ID NO: 171376 - RNA, 64 nt, Human
uugcucuuuuguuauaggguauggaucauugucagaacuugauuggagggguuuaaagagauug

SEQ ID NO: 171377 - RNA, 64 nt, Human
uacuauuaaaauauucaguuuuuuaaaugaaguagaacuugaguucauguuuuauaugaaauau

SEQ ID NO: 171378 - RNA, 60 nt, Human
ucagauggaagucuucauaaagccgcaguagaacuugagcugaaaacccagaugguguua

SEQ ID NO: 171379 - RNA, 64 nt, Human
cugaagagaaaaaaugguaaugugugccuuuauugaacuugaaugacagaacuugaaauuuuua

SEQ ID NO: 171380 - RNA, 64 nt, Human
ugguaaugugugccuuuauugaacuugaaugacagaacuugaaauuuuuaacacauccuucuug

SEQ ID NO: 171381 - RNA, 64 nt, Human
aaauuuuuauaaauacagcuaccccaucaaagcugaacuugaaacguuuuagcagaauuuuaaa

SEQ ID NO: 171382 - RNA, 64 nt, Human
ugacaucucuaguaaauacuguuacaggauucaugaacuugaauaauucuacaguuugaaacuc

SEQ ID NO: 171383 - RNA, 64 nt, Human
uguuucaaagauaggaagcuauugcuuggacagagaacuugaaauaaguggacccauguauaaa

SEQ ID NO: 171384 - RNA, 64 nt, Human
auccuaacuguauaccagaauuaggucacugaaagaacuugauuugaauuacguuuagacaaaa

SEQ ID NO: 171385 - RNA, 64 nt, Human
uauucgaccauucacuggcugagccagaucacgggaacuugagagcuuuuacugugauucuuca

SEQ ID NO: 171386 - RNA, 64 nt, Human
acuuauuuaugaaaguauuaaaaugcuuacauuugaacuugauggcuaacuuacaaagauucuc

SEQ ID NO: 171387 - RNA, 64 nt, Human
uccuggcaagagaaaaagacuuaacuagacuucugaacuugaacaguuucagguuauauuuuaa

SEQ ID NO: 171388 - RNA, 64 nt, Human
acaucuuuuauuuauuucauuauguuggccaacagaacuugauuguaaauaauaauaaagaaau

SEQ ID NO: 171389 - RNA, 64 nt, Human
uguaaaaaugaaaaugugacucacauaaaaucaggaacuugacacaguguugcauuaauaacuu

SEQ ID NO: 171390 - RNA, 64 nt, Human
ggaagacugagccaugugacuuuaguccuugggagaacuugagccagcggcugucuugcugccu

SEQ ID NO: 171391 - RNA, 64 nt, Human
gggccggggcauggagaagaccagggaagaagcagaacuugaggccaacaguguguuucgucaa

SEQ ID NO: 171392 - RNA, 64 nt, Human
uaagucauaaugaugacucuuuaggauaaguuuagaacuugaauauuugcaugcuuaaggcacu

SEQ ID NO: 171393 - RNA, 64 nt, Human
uuagguggcugaacugguaaaggagcuucguugcgaacuugaucagcuucuccaggauaaaauu

SEQ ID NO: 171394 - RNA, 64 nt, Human
caagaauauuagauaauuggagcugaguacucaggaacuugacuguaguagaauacugcuaguu

SEQ ID NO: 171395 - RNA, 64 nt, Human
aagagagcauguuuaaauugaaauggaacuuagagaacuugagcuuacuuacguacuucaaugc

SEQ ID NO: 171396 - RNA, 64 nt, Human
auauauaucaaguuuuuauuauuaauaugcugaggaacuugaagauuaauaaaauaugcucuuc

SEQ ID NO: 171397 - RNA, 64 nt, Human
gauuggggaugguuucaucaacauaagaggccaggaacuugaccccuuugaauugugcaucuca

SEQ ID NO: 171398 - RNA, 64 nt, Human
aguuacucacucugauucuuccuucagugacacagaacuugaccgaagguaaacacuguuaggu

SEQ ID NO: 171399 - RNA, 64 nt, Human
gcuccaccagcucuucaucaugccacucauuucagaacuugagcaaaacagggcagucaggauc

SEQ ID NO: 171400 - RNA, 64 nt, Human
ggaggaaagguuuuuuuuguuguuuuuuuuuuaagaacuugaaacuuguaaacugagaugucug

SEQ ID NO: 171401 - RNA, 64 nt, Human
cacugucuauuuaagugcaauuaacauaugucacgaacuugaaaguuuucuaaacucaauaagg

SEQ ID NO: 171402 - RNA, 64 nt, Human
acacaugugugguaccucacugcugcuguuuagggaacuugagggacgcguuucaagggguugg

SEQ ID NO: 171403 - RNA, 64 nt, Human
aauuuuuuauauuuaaucuuuuuuucccuuacaagaacuugaaguuuuuuuuuuuaauuuuuau

SEQ ID NO: 171404 - RNA, 64 nt, Human
acugagggaggguaggguuaccuugaacgaaacagaacuugaggggcccaagccuuaucucagc

SEQ ID NO: 171405 - RNA, 64 nt, Human
uuuuaggccucaauuuuuuuuuuuuucugugaaggaacuugaagugaugcaugugugaauuuaa

SEQ ID NO: 171406 - RNA, 64 nt, Human
cuguuucccccuaaaaugucauaagagcacugaagaacuugaaauauuuuuuucagaguuucuc

SEQ ID NO: 171407 - RNA, 64 nt, Human
gugugguuacauuacuuuaaaugacauugaauuggaacuugauggcaauuaguucuagauacaa

SEQ ID NO: 171408 - RNA, 64 nt, Human
gcucuuaacuugcucaaacuggggcagguuccaggaacuugaacuaaaaauaucuauuuaagcc

SEQ ID NO: 171409 - RNA, 64 nt, Human
uucagaggacugugugaaguaguuacuggaaaaagaacuugaauuaugcauuuauuggcauuaa

SEQ ID NO: 171410 - RNA, 64 nt, Human
uuccuccucuucuucagaaucaucuucagaaagugaacuugaacaugagagaagcagaaggagg

SEQ ID NO: 171411 - RNA, 64 nt, Human
uuauuuguuguagcuacauuuuaaaaaaaagauugaacuugaugacuuagguuugcauugaucu

SEQ ID NO: 171412 - RNA, 64 nt, Human
guuuauuagcuaguuccuguaagcauuuccaccagaacuugaggcaaaucguaaggaagcuguu

SEQ ID NO: 171413 - RNA, 59 nt, Human
auaaacaagacaaggacugaaagugcucugaacuugaaacucacuggagagcugaaggg

SEQ ID NO: 171414 - RNA, 64 nt, Human
uucacuugcagaaaacuugagucagaaaauucuggaacuugaaaaaguaguaagggccuccaga

SEQ ID NO: 171415 - RNA, 64 nt, Human
caacccaccucucuucccuccggacucuaaacaggaacuugaauacugggagagaagaggacuu

SEQ ID NO: 171416 - RNA, 64 nt, Human
gaccagcuguuguuacauguaauauuuuaguucagaacuugaccugaaggaagggaagaaaagu

SEQ ID NO: 171417 - RNA, 64 nt, Human
ccccaggucgucagcagugugguauuaucuaugagaacuugagcgacagaguauuucuugauga

SEQ ID NO: 171418 - RNA, 64 nt, Human
gcuggcauuuaaauagugaaaagaguguauaugugaacuugacacuccaaacuccugucauggc

SEQ ID NO: 171419 - RNA, 64 nt, Human
cagucuuauaugaaguauguuccaauccaugugggaacuugacucucucaucugucuaaagagu

SEQ ID NO: 171420 - RNA, 64 nt, Human
ugucacaugaaacgauucucugcuuuuugguucugaacuugaagucccuaaacugcaaaaucua

SEQ ID NO: 171421 - RNA, 64 nt, Human
guuuaauacaucuucauucucaacacucuccaaagaacuugaccuaccuuauggguuccauauu

SEQ ID NO: 171422 - RNA, 64 nt, Human
cccccgucgcauaaccaguuccaucauccugguggaacuugaacauuuagaguuuaucuagaga

SEQ ID NO: 171423 - RNA, 64 nt, Human
aauuguuauguguuuagaaucagaauuugauuuugaacuugaguaauucauccuuacagcuauc

SEQ ID NO: 171424 - RNA, 64 nt, Human
uaaauuauaggaaaaaaauuaacuguuuuaaaaagaacuugauuauguuuuaugauuucaggca

SEQ ID NO: 171425 - RNA, 64 nt, Human
gcuuccaugcuucauacaucaggaaaugaggccagaacuugaguauuuacuaacacguuuuuca

SEQ ID NO: 171426 - RNA, 64 nt, Human
ugcagugugaugaaccuagagguaacuaccaugugaacuugaacucuucuaaaauaguucugug

SEQ ID NO: 171427 - RNA, 64 nt, Human
aacuccaguaaaaguugugccucaaauuagaauagaacuugaaccugaagacaaugauuauuuc

SEQ ID NO: 171428 - RNA, 64 nt, Human
ugaaagacucaaaaagcugccugggaggcagauggaacuugagccugucaagaggcaaaggaau

SEQ ID NO: 171429 - RNA, 64 nt, Human
gccuuacucuuuguggguuuuuuuuuuuuucucugaacuugauauaaagauuuuauuugucccu

SEQ ID NO: 171430 - RNA, 64 nt, Human
ucugaggcuuugguaaaaaguaaaggggaagaaagaacuugacagaucuuuuucaacucaaauu

SEQ ID NO: 171431 - RNA, 64 nt, Human
acuugaaucaggauuuuaugccccacauacucuggaacuugaaguauaauauacuuaauauaac

SEQ ID NO: 171432 - RNA, 64 nt, Human
cacauaaaaaacccaacaggucaaaauaaaaguugaacuugaguuacauuuaauuuaaauauaa

SEQ ID NO: 171433 - RNA, 64 nt, Human
cuuaaaauaaauagccucuuagguaaaaauauaagaacuugauauauuucauucucuuauauag

SEQ ID NO: 171434 - RNA, 64 nt, Human
auguaauuaaaacacaaguucacagauuuacagugaacuugaucuacaaguucacagauccauu

SEQ ID NO: 171435 - RNA, 64 nt, Human
acugaaugcaggagugggugauuagcugcuccuugaacuugaggcugccuuggcagcaggggca

SEQ ID NO: 171436 - RNA, 64 nt, Human
uacaacacgaauuggaagcugcuugaguccaccugaacuugaauugauugcaaagccaucugcu

SEQ ID NO: 171437 - RNA, 64 nt, Human
uggggaguuauauaauaauuuauugaauuuauuggaacuugauuuuccuggaugcuuucaaugu

SEQ ID NO: 171438 - RNA, 64 nt, Human
gcuuacaaauguuugccauucucauaaguguuuugaacuugaucuuugugacuugugcuuuuuu

SEQ ID NO: 171439 - RNA, 64 nt, Human
agcucaccuguuuuuuguguuaggugcuuuggcugaacuugauuccagcccccuuuucccuuug

SEQ ID NO: 171440 - RNA, 64 nt, Human
agaagcagaaccagcucuacgagagugagacugggaacuugauggcucagagagcaucuuuucc

SEQ ID NO: 171441 - RNA, 64 nt, Human
uaguauugaucguuucuuuuaaaaaugauuuggggaacuugaucuguacuguaauuuuacuaau

SEQ ID NO: 171442 - RNA, 64 nt, Human
gaucucuuaggaagccuuuuauucgugggaacucgaacuugaagcacaaguuccugguuugaau

SEQ ID NO: 171443 - RNA, 64 nt, Human
uaaagagcccagaaacagguccauguuuauaugggaacuugauuuuugacagauacggcaagcu

SEQ ID NO: 171444 - RNA, 64 nt, Human
aagaacuccaggagacaggccugaacucuagagggaacuugaaauccagggucaaagguuaagg

SEQ ID NO: 171445 - RNA, 64 nt, Human
acagccauguccaaguucuucaccucuauccaaagaacuugauuugcauggauuuuggauaaau

SEQ ID NO: 171446 - RNA, 64 nt, Human
gcauuuccaugaaacaacacaugcagcauuccaggaacuugauuguuaaauucaauaagaaauu

SEQ ID NO: 171447 - RNA, 64 nt, Human
auaaacuucagaauaugagccaaugaguaggaaggaacuugaagacuaaagauuuuacucucuc

SEQ ID NO: 171448 - RNA, 64 nt, Human
ggguagguucuaacucugccacugcuagccggaugaacuugagcaagucauuucacaucuccga

SEQ ID NO: 171449 - RNA, 64 nt, Human
cuugacaaaguaugugggaggggaaggaaggacagaacuugacuggcuccauuucauggaccaa

SEQ ID NO: 171450 - RNA, 64 nt, Human
gguuauaugcaaauacugugccauuuuauaucaggaacuugagcaucugcagauauugguaucg

SEQ ID NO: 171451 - RNA, 64 nt, Human
gcaguacacaacuauggaauagauuauuaaaacugaacuugaagcuaacguuagaauagugguu

SEQ ID NO: 171452 - RNA, 64 nt, Human
gugaaaaauaaaaaagguguuguauugcuugugagaacuugaacuguuuacuaguuaauugaag

SEQ ID NO: 171453 - RNA, 64 nt, Human
uuugaacucuccaucuaguuuacuucuaaaaugggaacuugaggcaauucagguauccaggcaa

SEQ ID NO: 171454 - RNA, 64 nt, Human
aaagaaucguguucauagugucuguauguaaacugaacuugaagaaaauauauugaaauuaaag

SEQ ID NO: 171455 - RNA, 64 nt, Human
cuggcacuucauuguacagacuuuuauaauaaaagaacuugaaaguucuaagucauuguaaaug

SEQ ID NO: 171456 - RNA, 64 nt, Human
uuuuuucuuuucuuuuuuaaaaauauguggcugugaacuugaaugaacacugcucaaacuuucu

SEQ ID NO: 171457 - RNA, 64 nt, Human
uugaaucucuaauuuuauacuuucuuuuccugaggaacuugauuuuucugucccuggaucgccu

SEQ ID NO: 171458 - RNA, 64 nt, Human
agaaaagugcaauuucaugcugaaugaagcguaggaacuugacaagcccauagguagcuauagu

SEQ ID NO: 171459 - RNA, 64 nt, Human
ugagcaaaucuguuuuacuguuaacuucaauuaugaacuugaaauugugccacaugacuuuuuc

SEQ ID NO: 171460 - RNA, 64 nt, Human
gaaaggccuaauaucccaaguugcuuaccuagaagaacuugacaggauaguuaauaauaaaccu

SEQ ID NO: 171461 - RNA, 64 nt, Human
gguugaggacuuggggcaggaaaggaaugcugcugaacuugaauuucccuuuacaaggggaaga

SEQ ID NO: 171462 - RNA, 64 nt, Human
gcucagagggggguaaggaauggaggggccaucagaacuugaauccuuuaacauccaccaggaa

SEQ ID NO: 171463 - RNA, 64 nt, Human
cgaauuaccacaaaccugguggauugaaacagcagaacuugauucccuuacaguucuggaggcu

SEQ ID NO: 171464 - RNA, 64 nt, Human
accgcuuugccacugauaggaaugacuuccggaggaacuugauacuaaauuugggacucuuugc

SEQ ID NO: 171465 - RNA, 64 nt, Human
ugggacucuuugcugcgggaguuuggcuggccaggaacuugagugacauugaccucauggcacc

SEQ ID NO: 171466 - RNA, 64 nt, Human
agccaauggcuuacaguuucugucuggucaucuggaacuugaaaaauccucaaaugccuucacu

SEQ ID NO: 171467 - RNA, 64 nt, Human
aauaaaauuggggugccuaaugcuacuggaaguggaacuugagauagggccuaauuuguuauac

SEQ ID NO: 171468 - RNA, 64 nt, Human
gugauccauagacuaauagcauagcauuaccugagaacuugauaaugcauauuugcaggcccca

SEQ ID NO: 171469 - RNA, 64 nt, Human
uuacuguugaugaaaaaggaugaucauauauauagaacuugauuagucagagcauugggcauuc

SEQ ID NO: 171470 - RNA, 64 nt, Human
acaccagaaggccagaauggaacgacuucaaagagaacuugagauucaaaagaaaaagcuggau

SEQ ID NO: 171471 - RNA, 64 nt, Human
agucuuagcagggggagcccucgacccugaaugugaacuugaacuggagugccucugcugcgcu

SEQ ID NO: 171472 - RNA, 50 nt, Human
cgaaauuuucaaccuuuuaagaacuugaaccacaacaaucacaaacuaau

SEQ ID NO: 171473 - RNA, 64 nt, Human
uguuucuguacuuuuuggcauaacauaaaucugugaacuugaaauuugaauuuuguguuagaga

SEQ ID NO: 171474 - RNA, 64 nt, Human
gacagggucucacuuuguugcccacgcugauguugaacuugacgugaggccucaagcaguccuc

SEQ ID NO: 171475 - RNA, 64 nt, Human
uuuuuucuuacugagauucuuacuuuggggucaggaacuugaagggaugcuuggagugaguaga

SEQ ID NO: 171476 - RNA, 64 nt, Human
caugagacuuucugacuaggaaaccaugugguuugaacuugaagaaaaauguagacccaucugg

SEQ ID NO: 171477 - RNA, 64 nt, Human
gcuauuuaaguggcuugacaacugggccaccaaagaacuugaacuucaccuuuuaggauuugag

SEQ ID NO: 171478 - RNA, 64 nt, Human
gcaaauaaaaauguacuuuggauuauuuauuguugaacuugagagauagaaauaacaucagaua

SEQ ID NO: 171479 - RNA, 64 nt, Human
gccagagagugagagacauuaacucauuagacuggaacuugaacugauucacaucucauuuuuc

SEQ ID NO: 171480 - RNA, 64 nt, Human
agugccuggcccggagcccccagugaugaagcaggaacuugagucucaggacucccagcggcuc

SEQ ID NO: 171481 - RNA, 64 nt, Human
cugauacuaaaaaccuuucuuucaggcagcaaaugaacuugaaagguugccuggacucgcugga

SEQ ID NO: 171482 - RNA, 64 nt, Human
guagcaaguuuccuaagguacaauaguggauucagaacuugacguucugaggcacauccucacu

SEQ ID NO: 171483 - RNA, 64 nt, Human
cacauuugguguucacacuucuucaguaaugucugaacuugaaagccacagaguggcauaaaac

SEQ ID NO: 171484 - RNA, 57 nt, Human
auguuggagaauucuucuagauuuucagaacuugaagacuauuuucuaauuucuauu

SEQ ID NO: 171485 - RNA, 64 nt, Human
uaaaggauuuacauagacaauccuauaagaucuugaacuugaauuuuauggguuguauuuuaau

SEQ ID NO: 171486 - RNA, 64 nt, Human
ggagacaggugcaaaucagaagauugacaaggaagaacuugagcuugcuaaauaagacuuccua

SEQ ID NO: 171487 - RNA, 64 nt, Human
agccaagguucuggcuucauuggcaacccacuaggaacuugaaugugagauucagcucuaguuu

SEQ ID NO: 171488 - RNA, 64 nt, Human
uguaguuuuauauagaaaugauccugaacacucugaacuugacguaguccugcggugauauucu

SEQ ID NO: 171489 - RNA, 64 nt, Human
uguguuuuaugaauuaaacagggaacggcaugcugaacuugaaacuagauuuguuccugcuuuu

SEQ ID NO: 171490 - RNA, 64 nt, Human
auuccagcaucauuuauucuuuuaaaauuuuuaagaacuugauccauuguaucaguaccucaca

SEQ ID NO: 171491 - RNA, 64 nt, Human
caccuucuagaagagagcgugccucagguuacuugaacuugaacggagacuguagacucccgga

SEQ ID NO: 171492 - RNA, 64 nt, Human
uaaauggaaauaguaugcaagaaacucaggcauugaacuugaagauaagaguauuauugcuuua

SEQ ID NO: 171493 - RNA, 64 nt, Human
caugguaacuuucguuuuggaguguucauuuucugaacuugacccucacauuguaggggugcag

SEQ ID NO: 171494 - RNA, 64 nt, Human
agugaccgccgugaauguagacgcccuaggaggagaacuugaacaaagucucugggucacguuu

SEQ ID NO: 171495 - RNA, 64 nt, Human
aguauuuacuuuaaaaaauuuaauggcuuaacucgaacuugaagacacauacuucaacuguccu

SEQ ID NO: 171496 - RNA, 64 nt, Human
cugugaagugguguauugucacaguagcuuauuugaacuugagaccauuguaagcaugacccaa

SEQ ID NO: 171497 - RNA, 62 nt, Human
caacaaauguacagcaauaacaccauccagaagaacuugauggaaugcuuuuauuuuuuauu

SEQ ID NO: 171498 - RNA, 64 nt, Human
uuggaccuaauaugaaucgacaauuuggauuguugaacuugaaggcuugcaaaauaugguacau

SEQ ID NO: 171499 - RNA, 64 nt, Human
cacauaacaauagggucuaugucauaucccaagugaacuugagcccuguuugggcucaggagau

SEQ ID NO: 171500 - RNA, 64 nt, Human
guuuuuuucuuuccuguaaagaaacauuuccuuugaacuugauugccuauggaucaaagaaauu

SEQ ID NO: 171501 - RNA, 64 nt, Human
aaucagagacugguguacaguaugacuuccaucugaacuugaaaaguauuaaaaugggucaaua

SEQ ID NO: 171502 - RNA, 64 nt, Human
aaugggaaauauauguuaaaugacaucacuggaugaacuugaagaucuuuuacuuguuaacaaa

SEQ ID NO: 171503 - RNA, 64 nt, Human
ugugacauucuuacugaaucaaaucaugauucuagaacuugagaucuuaaauagaauuucgguu

SEQ ID NO: 171504 - RNA, 64 nt, Human
aauauaugacuuuuuauaaaaaggguaucuauaugaacuugacacaguauuuucagcuuuugua

SEQ ID NO: 171505 - RNA, 64 nt, Human
agauccagcagccuucaccauccaggagacuucagaacuugaagguaauuuuugguuguuaugg

SEQ ID NO: 171506 - RNA, 64 nt, Human
uucuuaucacauaaugugcaggccaugugccugugaacuugaaguuugcgcaaaauguggaaag

SEQ ID NO: 171507 - RNA, 64 nt, Human
aaucuucagcuuuaucacucaaccccugccaaaggaacuugauuacauggugucuaaccaaaug

SEQ ID NO: 171508 - RNA, 64 nt, Human
cugguugaccugggcugguuuucccugucucugagaacuugagaccuagcuccgaguugaacug

SEQ ID NO: 171509 - RNA, 64 nt, Human
aaggagccacaaguuguggcugagaguucccugugaacuugaguaguucauagagugcuaaggu

SEQ ID NO: 171510 - RNA, 64 nt, Human
caguucauuggucaaauauuuguuaccuggaauggaacuugaaagcaaauacauuuggauuuca

SEQ ID NO: 171511 - RNA, 64 nt, Human
gggggucugagaugaggccuuauggcccagaggggaacuugauucaaaaauuugggauucaugu

SEQ ID NO: 171512 - RNA, 64 nt, Human
agucuucccugcuacaggaccaguucugugcaaugaacuugagacuccugauguacacugugau

SEQ ID NO: 171513 - RNA, 64 nt, Human
ccagcacuggugaacugagcugggcaggaagggagaacuugaaacagauucaggccagcccagc

SEQ ID NO: 171514 - RNA, 64 nt, Human
uaaaacagcuauguguaugaaauaggucacaacagaacuugaacaccagguuggugucugagca

SEQ ID NO: 171515 - RNA, 64 nt, Human
agugcuggaaguccagaacaagaagcuuauagaggaacuugaaaccuugaaagacauuuguucu

SEQ ID NO: 171516 - RNA, 64 nt, Human
uccacuucuggcuauagggaagaaccugaauacugaacuugauucaggcagaggaccauaaccu

SEQ ID NO: 171517 - RNA, 64 nt, Human
uaaagaaaacuuaaaaauaaaaccugaaaccccagaacuugagccuuguguauagauuuuaaaa

SEQ ID NO: 171518 - RNA, 64 nt, Human
uuaaacucuuugucucauugaaaguuugguuaaagaacuugaacauauuucuaaauuugauuau

SEQ ID NO: 171519 - RNA, 64 nt, Human
ccugaguauuuuuuauaauaggaauguccaccaugaacuugauacguccgugugucccagaugc

SEQ ID NO: 171520 - RNA, 64 nt, Human
uuucuuauccuagcacaugcuucaauaguucaaggaacuugaaaaauacuuuuccuuaccuuua

SEQ ID NO: 171521 - RNA, 64 nt, Human
ccuucgcuugcauuauuugggccuucauucagaugaacuugaggugccauuuuguugcauaugu

SEQ ID NO: 171522 - RNA, 64 nt, Human
aaacggguugugaugguaauggugugggggaaaugaacuugagcuuuaaacuugauuugaguuu

SEQ ID NO: 171523 - RNA, 64 nt, Human
uuauaaguaguauacacagauuuacccugcccuugaacuugaaggacauuaaauuauuaaugau

SEQ ID NO: 171524 - RNA, 64 nt, Human
cuuguuggauaauaguguuugacuagcguuuuaagaacuugagaguaaaagcaacaauaagauu

SEQ ID NO: 171525 - RNA, 64 nt, Human
ggggugugggggaccccagaaccaggcagagugggaacuugaaacuguugcugagggccacccg

SEQ ID NO: 171526 - RNA, 64 nt, Human
acuuaacuguuuaaagccucugucagacauuaaugaacuugacaguucauaacugauauauuau

SEQ ID NO: 171527 - RNA, 64 nt, Human
uuguaaguuguaacuugaaauuuucagaugcuuugaacuugacacauacucuagcaauucauug

SEQ ID NO: 171528 - RNA, 64 nt, Human
gaaauugcugccaaauguuauguaguuuaauagagaacuugaaaaaauaaaacauuaaaaugga

SEQ ID NO: 171529 - RNA, 64 nt, Human
caccaggauagagacuggaacacuagacaagccagaacuugacccugagcugaccagccgugag

SEQ ID NO: 171530 - RNA, 64 nt, Human
gcaggaaggcuuguugugcuuuuaguauuuuagugaacuugaaauauccugcuugaugggauuc

SEQ ID NO: 171531 - RNA, 64 nt, Human
caagggcuugugguuacuuguaucuccucuaugugaacuugacuuugaaagacagagcucuagu

SEQ ID NO: 171532 - RNA, 64 nt, Human
uguaccacagaaguucugucugcaucuuggaccugaacuugaucauuaucagcuugauaagaga

SEQ ID NO: 171533 - RNA, 64 nt, Human
uaaaggcagagucacucccaaaugggucucuuuagaacuugauggcugggcacugccaucucua

SEQ ID NO: 171534 - RNA, 64 nt, Human
guuuuuuucuucaccuucaauaugagaauucagcgaacuugaaagaaaaaucaucugugaguuc

SEQ ID NO: 171535 - RNA, 64 nt, Human
acuacuuauguuuauaauuuuuuuuuuuuuuaaugaacuugagccgggugcaguggcucacacc

SEQ ID NO: 171536 - RNA, 64 nt, Human
gggauuaacaugagcuucuuuagcaaccaagcaugaacuugauuaagaccagaaguuugggaga

SEQ ID NO: 171537 - RNA, 64 nt, Human
uuaaacuaauucauauguaaaaagugauuaggaagaacuugaaguaucauuugaugcuuaauaa

SEQ ID NO: 171538 - RNA, 64 nt, Human
cucuugcugaaauuaugauaguuaagauuccuaagaacuugacaaugcuccccuggcuugcagg

SEQ ID NO: 171539 - RNA, 64 nt, Human
guguaguugguagguggacaccacuuucauaagugaacuugagcucacuacucaauugugcagc

SEQ ID NO: 171540 - RNA, 64 nt, Human
aaaaauuuugaauguacaccacaugcuauugucugaacuugaguauaagauaaaauaaaauuuu

SEQ ID NO: 171541 - RNA, 64 nt, Human
uucuccagccugugugauacaaguuugaucccaggaacuugaguucuaagcagugcucgugaaa

SEQ ID NO: 171542 - RNA, 64 nt, Human
ugugagacagauuaaguuuucccugauuuuucaugaacuugaguuuuuuguuguuauuguuauu

SEQ ID NO: 171543 - RNA, 64 nt, Human
gcaauaaagugacuuguccuaaucuauggauugagaacuugaaaauguagaguagaauuuauaa

SEQ ID NO: 171544 - RNA, 64 nt, Human
gcggucuagggcaauaggagagcagagaaugggggaacuugaggguggggggagggcaccggag

SEQ ID NO: 171545 - RNA, 64 nt, Human
ugucaugagucugucugagcaugauacuuaacaugaacuugauguaguaggugcacauuugccu

SEQ ID NO: 171546 - RNA, 64 nt, Human
aauauucuuaggcagaucugcccacaucuuuauugaacuugaaaucuaauauuucuaguauuug

SEQ ID NO: 171547 - RNA, 64 nt, Human
ccugccugugcugugacucgagucacacucaagggaacuugagcgugaaucuguaucuugccgg

SEQ ID NO: 171548 - RNA, 64 nt, Human
ugcccgggcauccgcugcugcuacaucuuagccagaacuugaagucuuuugucccaguuuggga

SEQ ID NO: 171549 - RNA, 64 nt, Human
cauguaguuguuccccaauguuugaguacuaagagaacuugagaaaauuacuucauaaacauau

SEQ ID NO: 171550 - RNA, 64 nt, Human
ucaggaaccuauggcuggcuuuccuuagcagcaagaacuugagagaaaaacacaucugucucug

SEQ ID NO: 171551 - RNA, 64 nt, Human
uauuuuuuugccuuagaucauccagccccucuuagaacuugaccaaaauagaaguaaauuaaag

SEQ ID NO: 171552 - RNA, 64 nt, Human
cuaggaagaaagaauccaguguagaaguugagaagaacuugaacguuuugguucuggauaaggu

SEQ ID NO: 171553 - RNA, 64 nt, Human
gacugaaagaagacacgagcgaaugauuuaaauagaacuugauuguugagacgccuugcuagag

SEQ ID NO: 171554 - RNA, 64 nt, Human
accuuaaucuuggaucccuuuaccucauauggaagaacuugagggacauuaguauacuuuuuuu

SEQ ID NO: 171555 - RNA, 64 nt, Human
aaugacauugaacugaauuuuuugucuguuaaaugaacuugauagcuaauaaaaagacaacuag

SEQ ID NO: 171556 - RNA, 64 nt, Human
uucauuuggaaagauuaaaaaaacaaguuugauugaacuugauaaaucagaaauauuuaccagc

SEQ ID NO: 171557 - RNA, 64 nt, Human
aagaguauucucuggcuguauuuccagcaguuaugaacuugaguuuguaaauuguucuuaaaau

SEQ ID NO: 171558 - RNA, 64 nt, Human
agcaguugcuguugcuuauucugaaaggaauguagaacuugacagcagccuucugagucugggu

SEQ ID NO: 171559 - RNA, 64 nt, Human
ucccuggggcuggucacagcuggcucaugaugcugaacuugaaaguuuuuuuguuuuuguuuuu

SEQ ID NO: 171560 - RNA, 64 nt, Human
uuuaaauucaucuguuugacauuugguuuuuugugaacuugagucaguccuauugaacauuuug

SEQ ID NO: 171561 - RNA, 64 nt, Human
uugggcaacuguuuuuaccugaugguuuuaagcugaacuugaaggacugguuccuauucugaaa

SEQ ID NO: 171562 - RNA, 64 nt, Human
gaguuuccaagauuaauuuuaagaauaucuucacgaacuugacccuccuacuccacauugcaac

SEQ ID NO: 171563 - RNA, 64 nt, Human
accuggaaaagaaaagaaaugaauagacuaucuagaacuugagaagauuuuauucuuauuucau

SEQ ID NO: 171564 - RNA, 64 nt, Human
aaucugagccagugcuuuaauggcaugucagacagaacuugaaugugucaggugacccugauga

SEQ ID NO: 171565 - RNA, 64 nt, Human
uuucccuuauuucuacuucuuugguugaaucuaugaacuugauuguauaauuuucuuauaaauu

SEQ ID NO: 171566 - RNA, 64 nt, Human
uuauaaugcaguuuuugauggaauuaaacacaaagaacuugaaagcagucaguuacaaaaaggu

SEQ ID NO: 171567 - RNA, 64 nt, Human
caauccauguuauucugaugacucuuugaagaaagaacuugaaccuaaguaauaugauacaauu

SEQ ID NO: 171568 - RNA, 64 nt, Human
auucuuccaaaauggcauacaucuuuuguacaaagaacuugaaauguaaauacuguguuugugc

SEQ ID NO: 171569 - RNA, 64 nt, Human
uuagcaaaauuagcaauauauuauccaaucuucugaacuugaucaagagcauggagaauaaacg

SEQ ID NO: 171570 - RNA, 64 nt, Human
aguguaauuaaaaauaauugaaaguguuaaaugugaacuugagcuguuugaccagucacauuuu

SEQ ID NO: 171571 - RNA, 64 nt, Human
gagauuagauacagaaaaagaagaaaaaaucaaugaacuugaagaguaagaauaaaaacuacca

SEQ ID NO: 171572 - RNA, 64 nt, Human
uaacagugcuuaccauucaccucccaaagccaaggaacuugagugagcuuccuuggcaagccuc

SEQ ID NO: 171573 - RNA, 64 nt, Human
uauaaccagaauuguuccugccuuuagcuuuucagaacuugagauguggcagcacuggacuggg

SEQ ID NO: 171574 - RNA, 64 nt, Human
uguaauacaagucacuaaucauacucugaugccugaacuugaggaggaaaauacauguauauuu

SEQ ID NO: 171575 - RNA, 64 nt, Human
gggaacucaguacucuguauguauccacaaaagggaacuugagacccacaguuauucuuaauuu

SEQ ID NO: 171576 - RNA, 64 nt, Human
uggacucgccucucuccucuccuccccccaggaggaacuugaaaggaggguaaaaagacuaaaa

SEQ ID NO: 171577 - RNA, 64 nt, Human
uacuuauccaaugguguuuuauuucauuaagguagaacuugagaacucaaguuuaaauuguccc

SEQ ID NO: 171578 - RNA, 64 nt, Human
ccuaacuuucuugcaauaaaugcaaaagaaacuggaacuugacaauuauaaauaguaauaguga

SEQ ID NO: 171579 - RNA, 64 nt, Human
guggcaguucucgcagauguuaccuaaaacugcugaacuugaccggcagaauguucugccguuu

SEQ ID NO: 171580 - RNA, 64 nt, Human
cugaucagcagauacugacuuguugccauuaagugaacuugacuucuuaugugugcucuaugag

SEQ ID NO: 171581 - RNA, 64 nt, Human
uuuaaauuuuauuuuuauuacuuuuuuuguagaugaacuugagcucuguaacuuacaccuggaa

SEQ ID NO: 171582 - RNA, 64 nt, Human
uugauuuacugugcaauuuacuuuuggacauugagaacuugaaauuauuuccugaucccuuccc

SEQ ID NO: 171583 - RNA, 64 nt, Human
cuagaauugucucuagaaaacauagcuucuuacugaacuugaacauuuuuacaacauucacugg

SEQ ID NO: 171584 - RNA, 64 nt, Human
uuagagacaagguuuugcuguguugcccaagcuggaacuugaacgacugggcugaagugaucuu

SEQ ID NO: 171585 - RNA, 64 nt, Human
auuuaguugacucuauaauucuaaggucaaaauggaacuugauaguuuuuuaaauuaaaaaaug

SEQ ID NO: 171586 - RNA, 64 nt, Human
ccuaagaccuuuucuagucugucuuccugccuucgaacuugaugacaguaaaacccuguuuagu

SEQ ID NO: 171587 - RNA, 64 nt, Human
ccaucuugaagacuucacacauuaauuuggugaagaacuugacauucuuuuagaagacuuauga

SEQ ID NO: 171588 - RNA, 64 nt, Human
cagaggugucucauauuucccagcacaugauucugaacuugaugcuucguggaaugcugcauuu

SEQ ID NO: 171589 - RNA, 64 nt, Human
ucccaucccuuuuuuguguguuucagaaaauagugaacuugauuccccugcuuccacuaaaucc

SEQ ID NO: 171590 - RNA, 64 nt, Human
gcacuuaaaguccuguccuugccuuuuauuuucugaacuugauguuuuugcauucuuugaguuc

SEQ ID NO: 171591 - RNA, 64 nt, Human
uggccuuuccuuuuguaauaagaaagaagagagagaacuugaugcaaaguccacgaaaaaacaa

SEQ ID NO: 171592 - RNA, 64 nt, Human
aaacuguuccuugcggucuaguauuuaagaacuggaacuugaaaguccuccuucuaccaacucc

SEQ ID NO: 171593 - RNA, 64 nt, Human
uguauuucccugugaccccuuacucuccuggccagaacuugagccagcugugggauguugcugc

SEQ ID NO: 171594 - RNA, 64 nt, Human
cauggaagccugucacuguauguaggacauaauagaacuugaucacuugaagcucagaccuauu

SEQ ID NO: 171595 - RNA, 64 nt, Human
uuaaaauugaguagcagaugaaaaauuaaaauuugaacuugauuauuaauaucaauuaaaaugu

SEQ ID NO: 171596 - RNA, 64 nt, Human
uuaguagagggugggacuauaaccuuagaggccagaacuugauccagaaguugcuguccacaga

SEQ ID NO: 171597 - RNA, 64 nt, Human; identical to SEQ ID NO: 171590

SEQ ID NO: 171598 - RNA, 64 nt, Human
cagggaagcucugggccaccucccuggauagcaggaacuugaccugccaugugugcccugccuu

SEQ ID NO: 171599 - RNA, 64 nt, Human
gauggggcucugaaagauuuguaucucugugcuugaacuugaauggccuuaaaccuguuucagc

SEQ ID NO: 171600 - RNA, 64 nt, Human
gggaacugauuugaccucgaaugcuccuaaaagagaacuugauagccugacagcagagaaguau

SEQ ID NO: 171601 - RNA, 64 nt, Human
ugcuugcggcagggagccggggcagggcagaggugaacuugaaguucaggacuugacucuccca

SEQ ID NO: 171602 - RNA, 64 nt, Human
gagugaaacacagaauaugggaauggcagcugcugaacuugaacccagagccuucaggugccaa

SEQ ID NO: 171603 - RNA, 64 nt, Human
cagauucugguuaagcagaggcuucagaaccacugaacuugaaacuuacccucuagggaugcag

SEQ ID NO: 171604 - RNA, 64 nt, Human
ugccucccaucucuuaucuccuugauauaauuuugaacuugaccuacuuuaaacuuuuuugcuc

SEQ ID NO: 171605 - RNA, 64 nt, Human
ccucugcuaucugcaucugcagugggcuucccaggaacuugacugucuuucauuugaucuuuau

SEQ ID NO: 171606 - RNA, 57 nt, Human
ccuggucaucugguaaauaaaacaaaggaacuugauguugagauggaugcuugagga

SEQ ID NO: 171607 - RNA, 64 nt, Human
aaucaauucccacuuagcaccuacugugugcuaggaacuugaauguguauguuugacaaguccu

SEQ ID NO: 171608 - RNA, 64 nt, Human
acagagacaacaccccccuuguucucgacagccugaacuugaacauacaaagugggcagacagu

SEQ ID NO: 171609 - RNA, 64 nt, Human
gcacucuacagaugaagaaagcugggagcacuuugaacuugaaaaucauuucucuuagaacuac

SEQ ID NO: 171610 - RNA, 64 nt, Human
caacccggaugggugacaggcuggauggccuugugaacuugagcucaguguaugcuaggcaaca

SEQ ID NO: 171611 - RNA, 64 nt, Human
uaaagaaauuuaaaauucucauuguaagaaguaugaacuugaagcuagaauugguuuauuucug

SEQ ID NO: 171612 - RNA, 64 nt, Human
guacuacauguaucuauccacacacugcugaagggaacuugacccuacgcauuccaaaagccuu

SEQ ID NO: 171613 - RNA, 64 nt, Human
agcagaacugaaccggcuuuaccaaaccgccagcgaacuugacaauuguauugcgauggcgugg

SEQ ID NO: 171614 - RNA, 64 nt, Human
cuauugugauuuaaaacagguggguuaucaagaggaacuugagaucucuuuauuacauggacau

SEQ ID NO: 171615 - RNA, 64 nt, Human
ucugaaacggauccagcaauuccugagccaagaggaacuugacccccagaguguggaaagaaag

SEQ ID NO: 171616 - RNA, 64 nt, Human
auuuaggcucucaacaucauguagacaaagcgcugaacuugauugggaagaaguucaaagagcu

SEQ ID NO: 171617 - RNA, 64 nt, Human
aaaauuaaaaagaaaaacugguuccauguacugugaacuugaaaacuugcagacucaggggggu

SEQ ID NO: 171618 - RNA, 64 nt, Human
uagcaaggagcccuugcucccugggaaaggcggugaacuugagucuaaagaugcagugccuggc

SEQ ID NO: 171619 - RNA, 64 nt, Human
ugugugggaaguagucuuuggcuuauaagggauagaacuugagacaguagcagaugggacaugg

SEQ ID NO: 171620 - RNA, 64 nt, Human
ggccuugaaaccaccuuuuauuacauggggucuagaacuugacccccuugagggugcuuguucc

SEQ ID NO: 171621 - RNA, 64 nt, Human
uugguguaugggguaaaagccccaggagcauacagaacuugagcugaaccuggucaguagaaag

SEQ ID NO: 171622 - RNA, 64 nt, Human
gaacaacugccgcaagaccacuacaugacuuagggaacuugaaaccaacuggcucauggagaaa

SEQ ID NO: 171623 - RNA, 64 nt, Human
cagucgggaaacaagcauagaaauggaagaaagugaacuugaugcucaguauuugcagaauaca

SEQ ID NO: 171624 - RNA, 64 nt, Human
gugaauuaauaaaguaguaauaguaaaaugaaaggaacuugacuguacaguuuguagccagguu

SEQ ID NO: 171625 - RNA, 64 nt, Human
gcuacaguucuauguacugagaaaccuuuaagcugaacuugagauauguaaagagacuuuaggc

SEQ ID NO: 171626 - RNA, 64 nt, Human
ucacuauauuugaguucuuagagaaguaugaguggaacuugaguacaguugaauuauuaaauau

SEQ ID NO: 171627 - RNA, 64 nt, Human
cuggcucugucugaguaagaaacagaauccucuggaacuugaggaagugaacauuucggugacu

SEQ ID NO: 171628 - RNA, 64 nt, Human
uuaggccaauugggauucucauucgccugggaaagaacuugauucucaaauagugaagcaacac

SEQ ID NO: 171629 - RNA, 64 nt, Human
ggaauagaaggcuacacagaagcacacuguuuuugaacuugacaacagcucucccuuuacccug

SEQ ID NO: 171630 - RNA, 64 nt, Human
gcaacucaggcccccacccaagccugcgucagcggaacuugagugaggggcguugugcaauuug

SEQ ID NO: 171631 - RNA, 64 nt, Human
agcaaggauuucagccagaugccauagacccucagaacuugaccuggaaguccagacacugaac

SEQ ID NO: 171632 - RNA, 64 nt, Human
uaacugcuuuuuguauuuggagagagugacuauugaacuugaaaccuuuuauuccgggcgucuu

SEQ ID NO: 171633 - RNA, 64 nt, Human
gaagaaggggagguuggggggcuccuucccuucagaacuugaaguuucucccacugccuccucu

SEQ ID NO: 171634 - RNA, 64 nt, Human
ggguguccaaggagcagagaaaacuacuagaugugaacuugaagaagguugucagcugcagcca

SEQ ID NO: 171635 - RNA, 64 nt, Human
gggacaaacaaauauucgggacuuucgaagcccugaacuugagacaccaaguuugucuccaugg

SEQ ID NO: 171636 - RNA, 64 nt, Human
aagaccucguggagaauuuuuacuggggauucuugaacuugaaaaaaaaaaacacaaaaaaaga

SEQ ID NO: 171637 - RNA, 64 nt, Human
ucccuccccuuagccaucacuucugggaaguaaagaacuugacuuagugccggagcugugugcu

SEQ ID NO: 171638 - RNA, 64 nt, Human
cauggcuauguuuuaauaaaacuuuacagacacugaacuugaacuuccauugugauaugaaaac

SEQ ID NO: 171639 - RNA, 64 nt, Human
acgcugaguuauuaggacuggaaggcuaugaaaagaacuugaaauugucggaauaugugcucuc

SEQ ID NO: 171640 - RNA, 64 nt, Human
aaaaugacagugagguugaaaagugaaaacccuagaacuugaauaggugccuguucuuguaggg

SEQ ID NO: 171641 - RNA, 64 nt, Human
uugagcaugcuucaggauuuuuuuuuaaaccacagaacuugaauacaugagggaaccagaguuc

SEQ ID NO: 171642 - RNA, 64 nt, Human
uccaguccaaaggacccucuugauuacagcacaggaacuugaucguuggggaaccccagccccu

SEQ ID NO: 171643 - RNA, 64 nt, Human
uugucaauauugccuuugccucuuggcagcccuugaacuugaguaaauaacaacucccugaacc

SEQ ID NO: 171644 - RNA, 64 nt, Human
gggccucuucccucauuuucaucagucugucuaagaacuugacucggcacuguuucucguguaa

SEQ ID NO: 171645 - RNA, 64 nt, Human
agccacacccacaccugagcuguucucagugcuggaacuugaccauccuggaacacccuggaag

SEQ ID NO: 171646 - RNA, 64 nt, Human
uuuaaagacagguggccacugacagccacuccaggaacuugaacugcaggggcagagccaguga

SEQ ID NO: 171647 - RNA, 64 nt, Human
uuaggcauuuggaaaaucugguucacaucauaaagaacuugauuugaaauguuuucuauagaaa

SEQ ID NO: 171648 - RNA, 64 nt, Human
guuuauauaauauauguaugcuaucuugauucaugaacuugauccuauuaauuuauaugcugau

SEQ ID NO: 171649 - RNA, 64 nt, Human
cguuguggacuguaauuaaaugcuuugcccucuggaacuugauuuuuguguaucugagauuuau

SEQ ID NO: 171650 - RNA, 64 nt, Human
guuuucagaaagaugaagaagaaaacaugucugugaacuugauguuccugggauguuuaaucaa

SEQ ID NO: 171651 - RNA, 64 nt, Human
acucuuaauuuacugggcaaaugugcuuggaauugaacuugacaagauuagcucaagcagauag

SEQ ID NO: 171652 - RNA, 64 nt, Human
uccaguuuuggaucuuuuuaaaacuaaugaguaugaacuugagaucuguauaaauaagagcaug

SEQ ID NO: 171653 - RNA, 64 nt, Human
uuugacagcugugcuguaacacaaguagaugccugaacuugaauuaauccacacaucaguaaug

SEQ ID NO: 171654 - RNA, 64 nt, Human
ccacaggauuuuaggucagggagcaaaaaucucagaacuugaccaugaagauacacaacagacu

SEQ ID NO: 171655 - RNA, 64 nt, Human
ggaagaauuuuaauauuuucuguuaguacaaguugaacuugauugugccaacugaaaccccaga

SEQ ID NO: 171656 - RNA, 64 nt, Human
uguaggaagucaucuaccuuugauauuagccauagaacuugaacacuaacuauauccuaugcau

SEQ ID NO: 171657 - RNA, 64 nt, Human
guaaaauguuuuaauauauucuuuguuaaucugagaacuugauacugaaucguuuaugugggag

SEQ ID NO: 171658 - RNA, 64 nt, Human
agauuuuuuuguuguuguucuggagagcuucuaggaacuugaaaaauacauaugccacacucuu

SEQ ID NO: 171659 - RNA, 64 nt, Human
uucuuugcuacacacuuugguaccuaugaaccuagaacuugaagugacuccuacuuaucacgua

SEQ ID NO: 171660 - RNA, 64 nt, Human
ucacaaucccauuggauggaaaggacuuggcuaugaacuugacuggaaacacgcagccugcucc

SEQ ID NO: 171661 - RNA, 64 nt, Human
uguguaccaguuuccugagccacgcccagugugugaacuugacaucuccauccccaggcucuca

SEQ ID NO: 171662 - RNA, 64 nt, Human
uguaggguugcagcucuauucuccaaaacuguaggaacuugacuugcguuagaguguacucuga

SEQ ID NO: 171663 - RNA, 64 nt, Human
agaaaaaaagcaugugucaugcaugaaggaaacugaacuugagguggccuccuugcuuguuaca

SEQ ID NO: 171664 - RNA, 64 nt, Human
cccugacaucugccaucgaucuugcaccaagacugaacuugaacacugacauuuuguuaguaaa

SEQ ID NO: 171665 - RNA, 64 nt, Human
auucuuaaccuggauagaagccagggguaaccaugaacuugauggaagaaaauguuacaucuuu

SEQ ID NO: 171666 - RNA, 64 nt, Human
ucucuccucacacacagacucauauuacugguaggaacuugagaacuuuauuuccaaguuguuc

SEQ ID NO: 171667 - RNA, 64 nt, Human
guaaaaaguagauuaaaauauuugccuccauguagaacuugaacuaacauaaucuuaaacucuu

SEQ ID NO: 171668 - RNA, 64 nt, Human
ucuucaaccucuguuauucugaugacugaagaaagaacuugaaccuauguuauaugauacgagc

SEQ ID NO: 171669 - RNA, 64 nt, Human
ucuucaaccucuguuauucugaugacugaagaaagaacuugaaccuauguuauaugauacaagc

SEQ ID NO: 171670 - RNA, 64 nt, Human
ucuucaaccucuguuauucuggugacugacaaaagaacuugaaccuauguuauaugauacaugc

SEQ ID NO: 171671 - RNA, 64 nt, Human
ccauucaaagaggacauaugauucuuuccaagaugaacuugaagauuacauaaaagugcagaaa

SEQ ID NO: 171672 - RNA, 64 nt, Human
ucauucaaagaagacauaugacucuuuccaagaugaacuugaagauuacaucaaaguacagaaa

SEQ ID NO: 171673 - RNA, 64 nt, Human
uucaguuguuauugcagugucugcuucauccguggaacuugaggcucagaugcccccugcucug

SEQ ID NO: 171674 - RNA, 64 nt, Human
guucaaacacaauucuaucagcuccaaaaugugugaacuugacuuguguuagaguauauucuga

SEQ ID NO: 171675 - RNA, 62 nt, Human
uaauacuaaaaucacgagaacaccuaaacaacaaccaaaaaucuauugugguaugcacuuga

SEQ ID NO: 171676 - RNA, 62 nt, Human
auuuuucuuuuaagcccugcucuuucucugagaaccaaaagaugccuugaauauuuauucag

SEQ ID NO: 171677 - RNA, 62 nt, Human
uccuuuucuucuagcuuuguuguccucccaggaaccaaaaaaccccagcuauuuucugacca

SEQ ID NO: 171678 - RNA, 62 nt, Human
uuuuuauuuuuuuaagaagccaucaccugagcaaccaaaaauuccucugcgcugggguccga

SEQ ID NO: 171679 - RNA, 62 nt, Human
guccugguuggcccuggcuuugccuacuagaaaaccaaaacuuccccccugggguuuugugc

SEQ ID NO: 171680 - RNA, 62 nt, Human
cuagacaucagaagcacucccccaguugugacaaccaaaaauaucuccagaccuuggcaaau

SEQ ID NO: 171681 - RNA, 62 nt, Human
aggaggcauucaaugaacauuuuuugcauauaaaccaaaaaauaacuuguuaucaauaaaaa

SEQ ID NO: 171682 - RNA, 62 nt, Human
ugugugucacaauucugagguuuucgcagaugaaccaaaaacuccaguaacauguuuucagu

SEQ ID NO: 171683 - RNA, 62 nt, Human
gugcagaaauguuccaaaaggacaaaauugaaaaccaaaaacuauguuauuaaaacaaaaaa

SEQ ID NO: 171684 - RNA, 62 nt, Human
aaagaaugaacuaccacuacacuaugguguuaaaccaaaauauagggaaaauaaacacuaac

SEQ ID NO: 171685 - RNA, 62 nt, Human
ugagacuuuuucuuugcuuguuuguguaauucaaccaaaagaauuucaauacccauucaaau

SEQ ID NO: 171686 - RNA, 62 nt, Human
gcauuccugaaaaccuacacguguauaucaguaaccaaaaugcuaugccuuuuuugcaccuu

SEQ ID NO: 171687 - RNA, 62 nt, Human
ggauuuuuaaaaauucuugucucuacuauuauaaccaaaaaauauuucuuguaugucccaua

SEQ ID NO: 171688 - RNA, 62 nt, Human
uaauuuugaaaucauguauguuuaaauuagaaaaccaaaaaucaugaacauucuaagagaaa

SEQ ID NO: 171689 - RNA, 62 nt, Human
ccggagauggauugaugucuccauuguauuuaaaccaaaaugaacugauacuuguuggaaug

SEQ ID NO: 171690 - RNA, 62 nt, Human
ggauguggacuuuuuuguacauaaauaagaaaaaccaaaauacuccaaagaugacuuccccu

SEQ ID NO: 171691 - RNA, 62 nt, Human
gggagccagccccacucggggaccagaaguggaaccaaaaacaagaaaaaacugugagagau

SEQ ID NO: 171692 - RNA, 62 nt, Human
gaucauauauuaccuuuguaauaaaacauuauaaccaaaacauucuguuuaccuuuucaggg

SEQ ID NO: 171693 - RNA, 62 nt, Human
ugaggacguggcaagaagaugacauguaugagaaccaaaaaacagcugucgccaaacaccga

SEQ ID NO: 171694 - RNA, 62 nt, Human
ucaggauugcuucauggauuggagaacuuucuaaccaaaaauuaaaaaaaaaaaaaaaaaaa

SEQ ID NO: 171695 - RNA, 62 nt, Human
uuuaaaaaaaaaaaauuuagacuuaguaccagaaccaaaaauaccuagauuuuuggagaacu

SEQ ID NO: 171696 - RNA, 62 nt, Human
uaaagaauuagcagaauuaggcauauguacaaaaccaaaauuuugucaugaaauuuugccuu

SEQ ID NO: 171697 - RNA, 62 nt, Human
cagagauuggacuuuuucuuguuuaaaaccccaaccaaaaaaaauaauaaggcaugauuggu

SEQ ID NO: 171698 - RNA, 62 nt, Human
cggugaaugauggcugcuucuaaaacaaauacaaccaaaacucagcagugugaucuauagca

SEQ ID NO: 171699 - RNA, 62 nt, Human
cccccaccccucuuuuccaguccuugccuuccaaccaaaagaaauggauguuuugguggaag

SEQ ID NO: 171700 - RNA, 62 nt, Human
auauuauuuuuuuuuaagaaaggaggaaaagaaaccaaaaguuuuuuuuaagaaaaaaaauc

SEQ ID NO: 171701 - RNA, 62 nt, Human
guucccuccacgaaagcauucagaaacccuacaaccaaaaguccauccacagcuucaugacc

SEQ ID NO: 171702 - RNA, 62 nt, Human
agcacaaaauauaaauaaaagcugggaaaguaaaccaaaauucuucagauuguuccucauga

SEQ ID NO: 171703 - RNA, 62 nt, Human
uaagcaacuacuuuccuagaguaucauuugccaaccaaaaggcuuucagaggugugaaugga

SEQ ID NO: 171704 - RNA, 62 nt, Human
agcuguacucuuaauuuuaaggaauuucaaugaaccaaaagauaacugucaauuuauuugga

SEQ ID NO: 171705 - RNA, 62 nt, Human
agcugguagccuaccuacacagcugcuacaaaaaccaaaauacagaauggcuucugugauac

SEQ ID NO: 171706 - RNA, 62 nt, Human
uaugcuauuaaaaaaaaagaagguaacugauaaaccaaaauugagcauaguaauuacccaca

SEQ ID NO: 171707 - RNA, 62 nt, Human
cuaaauuaaacucagacccaaucaccucuaaaaaccaaaacccuaccccucucucucccucu

SEQ ID NO: 171708 - RNA, 62 nt, Human
uuagcuuuuaaaaaccugaaaggggaagcaaaaaccaaaaugugugacugggcuuuggagga

SEQ ID NO: 171709 - RNA, 62 nt, Human
ugcucacggguggcccugcccaccccuggcacaaccaaaaucccacugaugcccaucaugcc

SEQ ID NO: 171710 - RNA, 62 nt, Human
gcaggauauugauuacaaaguuuuucuucuuuaaccaaaaaggaaagacaacgguuugugug

SEQ ID NO: 171711 - RNA, 62 nt, Human
aauuuuguaugaguucuugaauaaaacuugggaaccaaaauggugguuuauccuuguaucuc

SEQ ID NO: 171712 - RNA, 62 nt, Human
guaaacuucaaaccuuagggcgggagcacuaaaaccaaaauacauguauuauuuauagaaaa

SEQ ID NO: 171713 - RNA, 62 nt, Human
uuaaagaauguaucuugccuuguguugacccaaaccaaaaacauuuuugaggggcacaugug

SEQ ID NO: 171714 - RNA, 62 nt, Human
acccguggagcaaugcccugucuggccuccaaaaccaaaauaaaacugggucacuuuacagu

SEQ ID NO: 171715 - RNA, 62 nt, Human
cuaaaauuucaguguguucugagugucuuuuaaaccaaaauggaaauacagauacagggcug

SEQ ID NO: 171716 - RNA, 62 nt, Human
ucaaacccuuucauaccuuuauucuuuuuuuuaaccaaaaaaguuuuucuuauaaaauaaau

SEQ ID NO: 171717 - RNA, 62 nt, Human
augccagcagccucugucgcccuuagucauauaaccaaaauccagaccuuauccacaacccg

SEQ ID NO: 171718 - RNA, 62 nt, Human
aagcgaaacuuggaaauuaauagaaucacuuaaaccaaaaucuuuauaagacacaauucuau

SEQ ID NO: 171719 - RNA, 62 nt, Human
gguuggaacagcagcacuauacaugaaauauaaaccaaaaaccuuuacuguuucuaaauuuc

SEQ ID NO: 171720 - RNA, 62 nt, Human
uacuuuacuaaucuuuaaacuaucaggaaaaaaaccaaaacuuuauaccaaugauuuaguaa

SEQ ID NO: 171721 - RNA, 62 nt, Human
aauaugacuuuauccuggcuauaaaauuauugaaccaaaaugaauucuuucuaaggcauuug

SEQ ID NO: 171722 - RNA, 62 nt, Human
acaaaguaaaaagacagauauuuaagaggcauaaccaaaaaagcaaaacuuguaaacagagu

SEQ ID NO: 171723 - RNA, 62 nt, Human
gagcaacacuuugucucagaaaaaaaaaaaaaaaccaaaaagccaagugugguggugugcac

SEQ ID NO: 171724 - RNA, 62 nt, Human
accuugauucacuguauguggaaaaauaauguaaccaaaagggaagagcuuuaauaauacuu

SEQ ID NO: 171725 - RNA, 62 nt, Human
gcguggacugaagcucuucaugaugagauggaaaccaaaagggagucucccaugauggggug

SEQ ID NO: 171726 - RNA, 62 nt, Human
uucucucucaacuuaucagaacugccuauaguaaccaaaauuggauucaugaagaaaaaaau

SEQ ID NO: 171727 - RNA, 62 nt, Human
cuucauaauuuaaccauuagcaucuuuggccaaaccaaaauaaagaaaagcaucuucuccua

SEQ ID NO: 171728 - RNA, 62 nt, Human
guauacauauauauuuauaucacaauuuacgaaaccaaaaaguugaguuuccaauggaaccc

SEQ ID NO: 171729 - RNA, 62 nt, Human
uagcagcaacccuggcccacucuaguuaugacaaccaaaaaugucucuauacauugccagau

SEQ ID NO: 171730 - RNA, 62 nt, Human
gauuuuuuuaauuguauguacucaugguuguaaaccaaaacguacuguaccguacagagaaa

SEQ ID NO: 171731 - RNA, 62 nt, Human
uauuugggcacccuacccuuuaccuggggucuaaccaaaaauggaugggaugaggaugagag

SEQ ID NO: 171732 - RNA, 62 nt, Human
cccucccaccccacccccagauagagggaaauaaccaaaaaacuaccaaacaacagaaaccc

SEQ ID NO: 171733 - RNA, 62 nt, Human
uugaguguaaacauaacuuauaugcacugggaaaccaaaaaaucugugugacuugcuuuauu

SEQ ID NO: 171734 - RNA, 62 nt, Human
caacaaagggacuuucugaaggaaaauggaaaaaccaaaaugaacacugaacuuggccacag

SEQ ID NO: 171735 - RNA, 62 nt, Human
gaugggaccagaagcaucuaaagcaaaaaaaaaaccaaaaaaaaaucuagagauguggcugu

SEQ ID NO: 171736 - RNA, 62 nt, Human
gcaugucauugugguaagagaauagagaucaaaaccaaaaaaaaugaaccaaaggcuugggu

SEQ ID NO: 171737 - RNA, 62 nt, Human
gguaguuuagaacucugaucagguacuacaucaaccaaaagaggaaauacuuuaaaaauucc

SEQ ID NO: 171738 - RNA, 62 nt, Human
auguuuuaaacgcaaaaaaaaagacaaaaaaaaaccaaaaaaaaaaaaccuacaaaaaaaac

SEQ ID NO: 171739 - RNA, 62 nt, Human
uuuauucaucacaggacagaauaaucaaggacaaccaaaauccuuuuguuaguuucaguacc

SEQ ID NO: 171740 - RNA, 62 nt, Human
ugcuccaagcgaggccuccugcuucaggaaagaaccaaaacacuacccugaagggccagccu

SEQ ID NO: 171741 - RNA, 62 nt, Human
ucagaauuuaccaccaaagaacucauccauguaaccaaaaaccacuuguacccccaaaaacu

SEQ ID NO: 171742 - RNA, 62 nt, Human
aaaaaaagguugcuguuuucuauuuuuaaauaaaccaaaaaaaaacagaaaagaugugaauu

SEQ ID NO: 171743 - RNA, 62 nt, Human
aagauacuacacacuuuaaaccaauuaaaaagaaccaaaaguaaauagaaaagacauugaau

SEQ ID NO: 171744 - RNA, 62 nt, Human
gugguaguagaggauuagguugucuauuauaaaaccaaaacucauucguuuaaugaacuuga

SEQ ID NO: 171745 - RNA, 62 nt, Human
gcagagaaaugaugguuguaaguggacaugcaaaccaaaauuggggauuggagaagucagac

SEQ ID NO: 171746 - RNA, 62 nt, Human
gcuucuuaucuggaugaaggcuuuuggaggagaaccaaaacgacaaguuccaagaagaagau

SEQ ID NO: 171747 - RNA, 62 nt, Human
ucuuuuugucuccauggcaaccauaacuuuugaaccaaaaaaaauuguuuuuacaucuuuau

SEQ ID NO: 171748 - RNA, 62 nt, Human
accccuuguagccuugacaaauuuuaccuuaaaaccaaaaugaaacacaaaaauuaauccuu

SEQ ID NO: 171749 - RNA, 62 nt, Human
uacuagaggguaagggaaucaaaggagacauaaaccaaaauaguuaauuuucccucuuucuu

SEQ ID NO: 171750 - RNA, 62 nt, Human
gucuuaaggagacugguaggaggaggcauggaaaccaaaaggccguguguuuagaagccuaa

SEQ ID NO: 171751 - RNA, 62 nt, Human
uuuuuuuaaauuguaucuaauccucaacaacaaaccaaaacagaacaauuaaacagccaaau

SEQ ID NO: 171752 - RNA, 62 nt, Human
agugaaaacccaucucaaaaaaaaaaaaaaaaaaccaaaaaaacuguccagcuguggacuuu

SEQ ID NO: 171753 - RNA, 62 nt, Human
cauuuuagauugaagguuggaaugguguacuaaaccaaaaaagcugacaacugagaguuuua

SEQ ID NO: 171754 - RNA, 62 nt, Human
uguuucaaauggguguaguagauauuacugaaaaccaaaaaagagugagauugucaguguaa

SEQ ID NO: 171755 - RNA, 62 nt, Human
gaugauucaauuuucucaauuuucuuugcuuuaaccaaaauucuaaaugcaguuuugccuag

SEQ ID NO: 171756 - RNA, 62 nt, Human
acaagcagauacugcuguguaaugguuacacuaaccaaaagacaccagccacucagaguucu

SEQ ID NO: 171757 - RNA, 62 nt, Human
uuauauggcaaccacugcuagaacccuaaaagaaccaaaaaucugccacagccugccuccau

SEQ ID NO: 171758 - RNA, 62 nt, Human
uagguaucuuuuuacaccaguauguuauuuuuaaccaaaauguaaaguucuuauuaaacuca

SEQ ID NO: 171759 - RNA, 62 nt, Human
cuccuagaguuuauguuggauacucaauucuuaaccaaaaucuuggucuccacaaacucuac

SEQ ID NO: 171760 - RNA, 62 nt, Human
aucuguggguuaauaguuaaaagaauguucccaaccaaaaaauucuuaccguaauauuauau

SEQ ID NO: 171761 - RNA, 62 nt, Human
auauauauguauguuucuccaaaaagugauaaaaccaaaauaucacugacucaucccuaccc

SEQ ID NO: 171762 - RNA, 62 nt, Human
gugagaugucagaaagcgcuuguauuuuaaacaaccaaaaagaauuguaaggguggcuugcu

SEQ ID NO: 171763 - RNA, 62 nt, Human
aauuagaaaggagugucauuauuugacuguuaaaccaaaauauuuuuggugggucuuuuuau

SEQ ID NO: 171764 - RNA, 62 nt, Human
cuuguuugggagauuagagaauaagauaaaagaaccaaaaccuuaggauauacuguuucugg

SEQ ID NO: 171765 - RNA, 62 nt, Human
uuguuauuuuuauuguuuguacuaauguugacaaccaaaauuugcaaaaaaauuaaaguuuu

SEQ ID NO: 171766 - RNA, 62 nt, Human
aaacuucuguggcuaugcagaaauagagaucgaaccaaaaaaaaucauuuaaacuuuaaaaa

SEQ ID NO: 171767 - RNA, 52 nt, Human
uuauccucuccuacacauaagaaaccaaaaggcugggcguaguggcucacac

SEQ ID NO: 171768 - RNA, 62 nt, Human
gccagucgcuguaacacugagccucagagacgaaccaaaaccagcugggcugagcucagauc

SEQ ID NO: 171769 - RNA, 62 nt, Human
ccaugagaauuugcaacaggggaggaaaaaagaaccaaaacuuccaaggcccugcuuuuuuu

SEQ ID NO: 171770 - RNA, 62 nt, Human
ucagaagaccaguacuggagcugucagaaugcaaccaaaaucagcugaguugaaguuuguca

SEQ ID NO: 171771 - RNA, 62 nt, Human
uuuuauuuuuguaucugugguaacaaaacauuaaccaaaagauuuucuguccagaagccucc

SEQ ID NO: 171772 - RNA, 62 nt, Human
aaaacauguaauauaaagauguuaaaaaaaaaaaccaaaacugugcagagucuagaaguugu

SEQ ID NO: 171773 - RNA, 62 nt, Human
auacauaauucucuucaaagacuucagcagcaaaccaaaacagcagguuaaaaaaaaagaug

SEQ ID NO: 171774 - RNA, 62 nt, Human
agcuuugagcucugugggggaacacacuagagaaccaaaaaugugauuauauggugauauaa

SEQ ID NO: 171775 - RNA, 62 nt, Human
gcugugcaacugaccagcuccagguuugaucaaaccaaaagcaacauuugucauguggucug

SEQ ID NO: 171776 - RNA, 62 nt, Human
gauccuccacgauuacgugaauaaaaugauggaaccaaaaaucacugucacuuuacaacuua

SEQ ID NO: 171777 - RNA, 62 nt, Human
gcugaaacgaguaauuuuccucaccaucaauaaaccaaaaacaggaaagauaaagaauguau

SEQ ID NO: 171778 - RNA, 62 nt, Human
cuaacaugauauaaauuuuuguuuuuugcacaaaccaaaaguuuaauguuaauucuuuuuac

SEQ ID NO: 171779 - RNA, 62 nt, Human
caagauuuucuuuuaauagcacuauccuugagaaccaaaaaguuuauguuuugauuuucaaa

SEQ ID NO: 171780 - RNA, 62 nt, Human
auggcauccgcauuugguaucuuuuacacuucaaccaaaaauuuauuagguauuuuucaaug

SEQ ID NO: 171781 - RNA, 62 nt, Human
aacaaccagcuuucauaauuuuuaauugucaaaaccaaaaggaaucagaauaaggaucacug

SEQ ID NO: 171782 - RNA, 62 nt, Human
ugccauggagcagcauuacccuaauggauugcaaccaaaacuuuaaacaaguagaaagauaa

SEQ ID NO: 171783 - RNA, 62 nt, Human
uugaugcgggagcaacaaacagcucagggccaaaccaaaagacaaaaauuggaguaacguag

SEQ ID NO: 171784 - RNA, 62 nt, Human
aaaaagagaaacuguccuuaaaacaaaacaaaaaccaaaaaagucacccuaucagguuucaa

SEQ ID NO: 171785 - RNA, 62 nt, Human
ggugguagauccuugagggucaguaguuucaaaaccaaaaauauucuaagaagucuuaggau

SEQ ID NO: 171786 - RNA, 62 nt, Human
agcuuuucauuaguggggauuuugucaauuauaaccaaaaacaaugugacggauacccaaga

SEQ ID NO: 171787 - RNA, 62 nt, Human
cacacugaauguuagacuuuuucaucugccaaaaccaaaaaccauuuugaucucccuguggu

SEQ ID NO: 171788 - RNA, 62 nt, Human
auuuuugcauaggaaaaauugagaaggaaguaaaccaaaauguuaacagugaucaucucugg

SEQ ID NO: 171789 - RNA, 62 nt, Human
cucuuggcaugcuaaaucauggauaaacugugaaccaaaauauggugcaacauacgagacau

SEQ ID NO: 171790 - RNA, 62 nt, Human
aaacauaguaauuacacaauuucagugcagucaaccaaaauguugagucaauuggaauguaa

SEQ ID NO: 171791 - RNA, 62 nt, Human
aaauguaaaguuuaauugaaagaauguaaagcaaccaaaaagaaaaaaaaaaagaaagaaag

SEQ ID NO: 171792 - RNA, 62 nt, Human
ugcacauagaagggggacuucuaggaauuuauaaccaaaauuuuaaaacuauuuuuauauuu

SEQ ID NO: 171793 - RNA, 62 nt, Human
uguauguacaucaguuguuucuuuuuauuuugaaccaaaaaugugguuucuuuuguacacau

SEQ ID NO: 171794 - RNA, 62 nt, Human
caccauaguuuuuauacaaacagcaauaacaaaaccaaaaagaugccccuuuuuuuguaggg

SEQ ID NO: 171795 - RNA, 62 nt, Human
cacuuuuaacugaaaaaaacaaaagcacaacaaaccaaaacaugggaugaagcuaaaucaau

SEQ ID NO: 171796 - RNA, 62 nt, Human
acuagugagauggccuggggaagcugugaaagaaccaaaagagaucacaauacucaaaagag

SEQ ID NO: 171797 - RNA, 62 nt, Human
cuccaauugccagaaggcucuuuuuaaugcugaaccaaaaugugccuuuuuuuuuuuuuuuu

SEQ ID NO: 171798 - RNA, 62 nt, Human
uguucuuucauauuuacucugcaaauacaaaaaaccaaaaccugcagccaguggucauuuca

SEQ ID NO: 171799 - RNA, 62 nt, Human
gguaaguaagcucugacuuggcuccuuccacaaaccaaaaagcuggaacuuaccacucaaaa

SEQ ID NO: 171800 - RNA, 62 nt, Human
cauccagaaaacuccaguucaugcuggaucuuaaccaaaaaugauucaauacuguuaucacu

SEQ ID NO: 171801 - RNA, 62 nt, Human
cauguuacuaugugauggaaccagcacaccucaaccaaaauuuuuuuaaucuuagacauuuu

SEQ ID NO: 171802 - RNA, 62 nt, Human
cacugcaaguguguagacccuuggcuaacuaaaaccaaaaaaaccuguccagugugcaagca

SEQ ID NO: 171803 - RNA, 62 nt, Human
aagaaagcagcacugucaucagaugcaugauaaaccaaaauaugaaaaugggaaauguuuaa

SEQ ID NO: 171804 - RNA, 62 nt, Human
agucuugacaaagggauuuacacccuugacaaaaccaaaagaaauuaacaggccacagguuu

SEQ ID NO: 171805 - RNA, 62 nt, Human
gauggauguuuccaugaagaaaucucugaagaaaccaaaagagcugaaacugaaaaaagagc

SEQ ID NO: 171806 - RNA, 62 nt, Human
gcaaaccucuugacuuuaccccacauuacugaaaccaaaauauauuugcuucaucugccccu

SEQ ID NO: 171807 - RNA, 62 nt, Human
cauacaaaagcuauuuuucaaaaauuaauuugaaccaaaacuacuacuauagggaaaagaug

SEQ ID NO: 171808 - RNA, 62 nt, Human
caaagaggcugcuaaccagcaggaauguccugaaccaaaaggaguggugaccauucucuaga

SEQ ID NO: 171809 - RNA, 62 nt, Human
cuuucuaaauacaaucauauuaggggaaaaauaaccaaaaguaggagaaacagugagaugua

SEQ ID NO: 171810 - RNA, 62 nt, Human
aauagggaauacucccaguccaggcccagcaaaaccaaaaugcuaagcaaugaauauuaagg

SEQ ID NO: 171811 - RNA, 62 nt, Human
ucucuuggaucugccgccccccucuccucccaaaccaaaaaccauugucuuaccucccaacu

SEQ ID NO: 171812 - RNA, 62 nt, Human
uguuuuaaaggagagcauccuaaguuaauaggaaccaaaaaauaaugaugggcagaaggggg

SEQ ID NO: 171813 - RNA, 62 nt, Human
aguauuugucacuuuauuuuuuuuaaugacaaaaccaaaaacagacaugggguggguagcug

SEQ ID NO: 171814 - RNA, 62 nt, Human
gaaggauuugauuuucuacauuuaaaaugaagaaccaaaacucucuucuugauuuucagcua

SEQ ID NO: 171815 - RNA, 62 nt, Human
caauuaacuuuugaugcuuucuguuccccuaaaaccaaaaaaugaaccccuugugucguugu

SEQ ID NO: 171816 - RNA, 62 nt, Human
uuacaccccuuaagggugcuuaauucuguugaaaccaaaaagauuugucuacaaaugcuauc

SEQ ID NO: 171817 - RNA, 62 nt, Human
uauuguuaguguucuuaacucaaguaggaguaaaccaaaaagugugauuuuucuuuuguaug

SEQ ID NO: 171818 - RNA, 62 nt, Human
uagguucauucuaagagucuaaaaauuucaaaaaccaaaacaacauuauaaaugguguuucu

SEQ ID NO: 171819 - RNA, 62 nt, Human
uagucauuuuuguauuuuuucuauguugugaaaaccaaaauuguaauuuuauaagucuuuga

SEQ ID NO: 171820 - RNA, 62 nt, Human
caagauuguuugggauuggaaguaaagauuaaaaccaaaagaauuuguguuugucugauacu

SEQ ID NO: 171821 - RNA, 62 nt, Human
auuuuuaaugucgaauuuuuuucuaacacaauaaccaaaagcuuuuauuuauaaaaaggcuu

SEQ ID NO: 171822 - RNA, 62 nt, Human
uauauuuuugaugguaagacuguaauuaaguaaaccaaaaaggcuaguuuauuuuguuacac

SEQ ID NO: 171823 - RNA, 62 nt, Human
aaaccucuaugcaaucugaguagagcagccacaaccaaaaaauucuacaacacacacuguuc

SEQ ID NO: 171824 - RNA, 62 nt, Human
uucccccugauaagaugagguaaagccaauguaaccaaaaggcaaaaauuacaaucgguuca

SEQ ID NO: 171825 - RNA, 60 nt, Human
aacuugauuauaaauacaccugucacuaccagaaccaaaaaaaaaaagaaaaaaauccca

SEQ ID NO: 171826 - RNA, 62 nt, Human
uuugaagauacauuugcaagagauauuuguuuaaccaaaauauuuggaaaguaacaaauaaa

SEQ ID NO: 171827 - RNA, 62 nt, Human
uagaaguuauauaaaaaauuaauuuaaaagcaaaccaaaagagguuuccauuaacauuauga

SEQ ID NO: 171828 - RNA, 62 nt, Human
aacuaagauuauaaauuagcaucuaguuccaaaaccaaaaaaagugccuguggauguauaua

SEQ ID NO: 171829 - RNA, 62 nt, Human
uuuaagucuuuaaaagguuguauuuugaauguaaccaaaaguuuacaguuuuuuguccaaau

SEQ ID NO: 171830 - RNA, 62 nt, Human
aacaaaucaugaacuaugcaaacucugcauaaaaccaaaaugaaacuuugcauauaagccaa

SEQ ID NO: 171831 - RNA, 62 nt, Human
gaagcuaucugcucuguuaaauuaagcagaagaaccaaaauuucaaggguaggaagauggaa

SEQ ID NO: 171832 - RNA, 62 nt, Human
gcuuauauaggucccugcacagauuggacuugaaccaaaauuaaguccaaagaacauauguu

SEQ ID NO: 171833 - RNA, 62 nt, Human
uccugcuaauuuauuuugaguuuuaagaaaacaaccaaaacaauuccaaugaaaauuuuagu

SEQ ID NO: 171834 - RNA, 62 nt, Human
accucuccacuuuaaccucuucuaaaauacccaaccaaaagaucacuguuucucucaacacu

SEQ ID NO: 171835 - RNA, 62 nt, Human
cauuuucaauaacaaaacgaaacuauggcacuaaccaaaaacuugcauucuggcauaauuuu

SEQ ID NO: 171836 - RNA, 62 nt, Human
gagaguaaccuguauuuuaauuguugaaacuuaaccaaaauaagauacugucucagcuaggg

SEQ ID NO: 171837 - RNA, 62 nt, Human
uaauuaagaagcaaacaaaaagagagcaacccaaccaaaacaaaucacauucuugcacaaaa

SEQ ID NO: 171838 - RNA, 62 nt, Human
aacguuacauuuuugaauguaguaaguaaauuaaccaaaaaaguuacaacuuccuaauuuua

SEQ ID NO: 171839 - RNA, 62 nt, Human
uuccuuacuucuguuuuaaacuuuggguaccaaaccaaaaagaagaaaaaagaaaggaaaag

SEQ ID NO: 171840 - RNA, 62 nt, Human
uuuuuaaaacaagagacucagggaaaguacuaaaccaaaaucucugauuuuacuuugcguuu

SEQ ID NO: 171841 - RNA, 57 nt, Human
cauccaccuuagaaagaugagaaagugaaccaaaaaggcuagaaaccagaggaaaac

SEQ ID NO: 171842 - RNA, 62 nt, Human
uuugaaaaauucugugauaguugcuauuaauaaaccaaaauuguauagaaucaucguuaauu

SEQ ID NO: 171843 - RNA, 62 nt, Human
uucuaacagaacuuccauaacuagaagguggaaaccaaaacccucaugguaguauuuccucu

SEQ ID NO: 171844 - RNA, 62 nt, Human
gcccacaguaucuccacuuaaacuaggcuaguaaccaaaauaauguggaccuucuuuaggaa

SEQ ID NO: 171845 - RNA, 62 nt, Human
caaaaaaaagccagugccuauugaguauaucaaaccaaaaaagaaaaaaaaaaguuuuaaga

SEQ ID NO: 171846 - RNA, 62 nt, Human
uagaggugacuuuaaggaaaaugaagaaaaagaaccaaaaugacuuuauuaaaauaauuucc

SEQ ID NO: 171847 - RNA, 62 nt, Human
uuuauuucauugguuaauuuuuacauggagaaaaccaaaaugauacuuacugaacugugugu

SEQ ID NO: 171848 - RNA, 62 nt, Human
ugccuacauuuagagucuguagaugcauaugcaaccaaaaaaaagucuuacuuuuaacaaga

SEQ ID NO: 171849 - RNA, 62 nt, Human
gaggaaugaggugugauuugcuguaucauuugaaccaaaaaguaugcagcaugagaauuugc

SEQ ID NO: 171850 - RNA, 62 nt, Human
ucuaaauuggauguaucuuacuuagucuaaagaaccaaaaccaucccugaaaugccuugcua

SEQ ID NO: 171851 - RNA, 62 nt, Human
accaaaacaaaauuuccaaaaacaaugaaggaaaccaaaauaaauauuucugcauuucaggu

SEQ ID NO: 171852 - RNA, 62 nt, Human
gcuuuaaguguuggcuauuucuauguuuuauaaaccaaaacaaaauuuccaaaaacaaugaa

SEQ ID NO: 171853 - RNA, 62 nt, Human
guguaacggggaccuucugcauaccuguuuagaaccaaaaccaccaugacacaguuuuuaua

SEQ ID NO: 171854 - RNA, 62 nt, Human
uuuaaaagaaaguagcguuaagauagaucaguaaccaaaaucauaggcuuuuucugugcauu

SEQ ID NO: 171855 - RNA, 62 nt, Human
ugugcuuuuguuugacugucucuagauuuugaaaccaaaaaacugaacugaaaucaucuaaa

SEQ ID NO: 171856 - RNA, 62 nt, Human
gaugagaguuaauaccugagauguuuuucugcaaccaaaauucauuaaauuuggcugccuua

SEQ ID NO: 171857 - RNA, 62 nt, Human; identical to SEQ ID NO: 171854

SEQ ID NO: 171858 - RNA, 62 nt, Human
uuagugguuggauuucaucccuuacuggucucaaccaaaauauuccuguuggaaucaugaug

SEQ ID NO: 171859 - RNA, 62 nt, Human
aacaagcaagaacuaaauaaucaaauguugucaaccaaaaguaauaguuggguauuggagau

SEQ ID NO: 171860 - RNA, 62 nt, Human
agguuaaucaaaaauggggaaggggaaaugguaaccaaaaaguaaccccaugguaagguuua

SEQ ID NO: 171861 - RNA, 62 nt, Human
gggcgaagacaaacggaugcacccgucuuuagaaccaaaaauauucucucacagauuucauu

SEQ ID NO: 171862 - RNA, 62 nt, Human
aaccagcauagaaagacccaaaacuauacagaaaccaaaaccagaaugccaugugguggagg

SEQ ID NO: 171863 - RNA, 62 nt, Human
auuaagcguguguaaaugggcuuuagucuggaaaccaaaaaaaaaaaaaaaauuuagucauu

SEQ ID NO: 171864 - RNA, 62 nt, Human
uaaccacggcaacccaaccuacucuaaaaccaaaccaaaaaaauaaaauaacacauccucuu

SEQ ID NO: 171865 - RNA, 62 nt, Human
uauuuucagcauuccucaugcauuucagugguaaccaaaaaauaauuugucaauuaauaguu

SEQ ID NO: 171866 - RNA, 62 nt, Human
uuuugaaugacuacaguauggacaauuucaaaaaccaaaacccacuuuggauugguggaagu

SEQ ID NO: 171867 - RNA, 62 nt, Human
uuaaaagcuguucuguucucacuucugacuuuaaccaaaagauuucaacccacaaugaucag

SEQ ID NO: 171868 - RNA, 62 nt, Human
uguugaaacuaguacuuuucccuuuaaaaacaaaccaaaaaaaaaaacaaaaaaaaacuuuu

SEQ ID NO: 171869 - RNA, 62 nt, Human
uguacauuguguuuaaaagaagacaaaaacugaaccaaaacucuuggggggaggggugauaa

SEQ ID NO: 171870 - RNA, 58 nt, Human
aagccgauuugcaugugugaaagccuuaaaccaaaacucaucagagaauacaugcuug

SEQ ID NO: 171871 - RNA, 62 nt, Human
guacaugaacaguuggaacugcugacuuuccuaaccaaaacaacuuccuucucuccuuuguu

SEQ ID NO: 171872 - RNA, 62 nt, Human
uuccagcauuuuuauaaacuaccaaauuagugaaccaaaaauagaaauuagauuugugcaaa

SEQ ID NO: 171873 - RNA, 62 nt, Human
ucagcuugagaagcacuucgaagccagagcagaaccaaaacucacuuccauggggucaccgg

SEQ ID NO: 171874 - RNA, 62 nt, Human
uggaacuagccuuaaugaguuucccauuccugaaccaaaauucaaagugagugagauguaaa

SEQ ID NO: 171875 - RNA, 62 nt, Human
ugccuuaccagaaaagaaaaaaaaaacccuaaaaccaaaaacuccuuuucccuaggaaguca

SEQ ID NO: 171876 - RNA, 62 nt, Human
cuuauaucaaauuauucuugucuuucaaaaagaaccaaaaaaaaaaaauucaucauggauaa

SEQ ID NO: 171877 - RNA, 62 nt, Human
gcuucgcuaauauuuuaaacaguccuguaaaaaaccaaaaaggacuuuuuguauagaaagca

SEQ ID NO: 171878 - RNA, 62 nt, Human
gccauuauuuuuauaucaauagcacaaaggaaaaccaaaaguccuuaaccacugaccauuuu

SEQ ID NO: 171879 - RNA, 62 nt, Human
aauuuuaaagagcauaauaaauuauauuaaagaaccaaaaguuuuccugagaauaagaaagu

SEQ ID NO: 171880 - RNA, 62 nt, Human
uauggaaugcuuuugacauguuuuaacaggguaaccaaaacuuuuaggccuguuuuuuuugg

SEQ ID NO: 171881 - RNA, 62 nt, Human
caucuuuuugcaguuaccucuucauagccaugaaccaaaacguucuaugaggagcaugcaag

SEQ ID NO: 171882 - RNA, 62 nt, Human
uuagaaaaguacaugauccccagaccacaacaaaccaaaacauaaacucaugucuguguccc

SEQ ID NO: 171883 - RNA, 62 nt, Human
cauacgcaacuguguucucuguuuuccuagaaaaccaaaaucaaacugagauuucaagucgu

SEQ ID NO: 171884 - RNA, 61 nt, Human
aaaauagaugaguaauugucaauaaaccugggaaccaaaagacuaccauucucauucauuc

SEQ ID NO: 171885 - RNA, 62 nt, Human
uuauauuuuuuggauggccuuuuguaccucugaaccaaaauuagauucaacuauucauauua

SEQ ID NO: 171886 - RNA, 62 nt, Human
uuaucaaguaauuaaaauaaaucuacauaaagaaccaaaaaggcuguuuuauaaaagugaaa

SEQ ID NO: 171887 - RNA, 62 nt, Human
ucuaaaaugacuuguuccuggggaaugccuucaaccaaaacacagcuaguauuucuaugccc

SEQ ID NO: 171888 - RNA, 62 nt, Human
cucccauuaaccucgagaaccuuuuuuuuuuuaaccaaaaccaggagccaggcugugccaug

SEQ ID NO: 171889 - RNA, 62 nt, Human
uuauuauuaacucuagauaagcagguacuagaaaccaaaacucagaaaauguuuacuguuag

SEQ ID NO: 171890 - RNA, 62 nt, Human
gagaacucugggaaaacuugggaauggcaaccaaccaaaaucauuuuuaaucauuuauuaga

SEQ ID NO: 171891 - RNA, 62 nt, Human
ccacuuuggcacggaagccuuacaguguggggaaccaaaacuucgugucuccccuuuccccg

SEQ ID NO: 171892 - RNA, 62 nt, Human
aucacaugcaaauacacagaauggauuguuacaaccaaaaugcaggcucuauuguuuucaau

SEQ ID NO: 171893 - RNA, 62 nt, Human
uuggcccagaauuguuauagcaaaaauuuuagaaccaaaaaauaagucuguacuaauuucaa

SEQ ID NO: 171894 - RNA, 62 nt, Human
caaaagccugaauguacuauguuuaaaagacaaaccaaaaauuaacccaaacuugcauuauu

SEQ ID NO: 171895 - RNA, 62 nt, Human
cagccaucucagcagggaagaacaaccuucucaaccaaaacugcaaucaggaaagcagcagc

SEQ ID NO: 171896 - RNA, 62 nt, Human
ugaccaaagaccuuucuuaugccggaagcaaaaaccaaaacuuuuuguuggcuuuuuccuuu

SEQ ID NO: 171897 - RNA, 62 nt, Human
uaaucaguaaucuaccugguggauuuguuuuuaaccaaaaagaugaauuaucaaugauuugu

SEQ ID NO: 171898 - RNA, 62 nt, Human
ggaacgagcuguagguuugcagaaaugugugaaaccaaaaugaucacugccuacuugugauu

SEQ ID NO: 171899 - RNA, 62 nt, Human
uuauucagaaaaaugcauguauuuaccucuucaaccaaaagggcaguaaagaauagggauaa

SEQ ID NO: 171900 - RNA, 62 nt, Human
cagagacuucagacuucucaguguguugggaaaaccaaaaaccacaacuacagaaauucauc

SEQ ID NO: 171901 - RNA, 62 nt, Human
guucaucuguauguuuuccagcuaaggucacaaaccaaaacugaauaaagucuuugaggaaa

SEQ ID NO: 171902 - RNA, 62 nt, Human
agaggauaaagaaguuaauggcaugguggaauaaccaaaauguguaucauucuacaaaaaaa

SEQ ID NO: 171903 - RNA, 62 nt, Human
uuauagauccucuugcuguucugaggccuuaaaaccaaaaaaauaauggaaugauugcauca

SEQ ID NO: 171904 - RNA, 62 nt, Human
gaggaguccaguuugugcaagacacccaguggaaccaaaacccaucgugguaugugaauuga

SEQ ID NO: 171905 - RNA, 62 nt, Human
uuccccuauuauucagaaaaaaaaggaaacaaaaccaaaaagaaagaguugcaaaaaacugc

SEQ ID NO: 171906 - RNA, 62 nt, Human
acuacaaaugcuuucuaucaaauuagaaauguaaccaaaaaaauguuaaguguucaccaggg

SEQ ID NO: 171907 - RNA, 62 nt, Human
ugaacaaagagcaugaaaauguugaagaccacaaccaaaauuuacucaaaucaaaguuaagu

SEQ ID NO: 171908 - RNA, 62 nt, Human
cucugacuucgaaaauuguugguauacauuucaaccaaaaugaccucauuugaaaugcccag

SEQ ID NO: 171909 - RNA, 62 nt, Human
uccaaaaauuguucuuaagugcuugagacuggaaccaaaauuaaauuguacuucauaaaauc

SEQ ID NO: 171910 - RNA, 62 nt, Human
uuaaccugucguuaaguguuguaacuucaaaaaaccaaaaugcuuauuuuaaugugauuuuu

SEQ ID NO: 171911 - RNA, 62 nt, Human
ucacaaauccuuuaaaacaauuaccuaaaagaaaccaaaaauccugccuucuuuguggggga

SEQ ID NO: 171912 - RNA, 62 nt, Human
agagggcguaaauugucuugugaaugugugcuaaccaaaacccaaaggcucuuuucagagcc

SEQ ID NO: 171913 - RNA, 62 nt, Human
cuggagcaguucauuacucauaccucgguccaaaccaaaaagguucuuuucagagccaccua

SEQ ID NO: 171914 - RNA, 62 nt, Human
cagucguuuaucuguuguuugagauagaaauuaaccaaaaaugacauaaauauucaugagau

SEQ ID NO: 171915 - RNA, 62 nt, Human
guuucuaucacugugacaacacuaagauaauaaaccaaaacacuaccugaauucuacucccc

SEQ ID NO: 171916 - RNA, 62 nt, Human
caguaaaugaggaaccguaacucuuuggaacaaaccaaaauauagcagauguaauuguacag

SEQ ID NO: 171917 - RNA, 62 nt, Human
caggggauauuuuuugagaugauuuaaauguaaaccaaaagauggaagacaaaaagacaaac

SEQ ID NO: 171918 - RNA, 62 nt, Human
uuacaccacgauucaaauaauuccccuccuaaaaccaaaaaggagggaaacgucaacuccau

SEQ ID NO: 171919 - RNA, 62 nt, Human
gacgggauuucuauauggacauagcacagaugaaccaaaaauguauuuauauucaccugagu

SEQ ID NO: 171920 - RNA, 62 nt, Human
aauaaaagaagacaaacccagauagauauguaaaccaaaauacuaugccccuuaauacuuua

SEQ ID NO: 171921 - RNA, 62 nt, Human
aaaagacaagcggugggacagagggaaccuacaaccaaaaacugccuagaucuuugcaguua

SEQ ID NO: 171922 - RNA, 62 nt, Human
acaggcuccagcaauaugucugcauugaaaagaaccaaaaaaaugcaaacuaugaugccauu

SEQ ID NO: 171923 - RNA, 62 nt, Human
aaggcaaaggccuuugugaugugagcaaaggcaaccaaaacuuagccucacuccacuuuucu

SEQ ID NO: 171924 - RNA, 62 nt, Human
gagaccuugucuuuaaaaaaaaaaugcugcaaaaccaaaaauaaauagccauaauuugccau

SEQ ID NO: 171925 - RNA, 62 nt, Human
acauuucaugugaucgugcaccacuggaacaaaaccaaaaugugaccauaacuguuuaggcu

SEQ ID NO: 171926 - RNA, 62 nt, Human
agaaguacaaaacaaaaaaaccaauggauuuuaaccaaaaugauuugaaauauaggugagga

SEQ ID NO: 171927 - RNA, 62 nt, Human
aaaaaaaauuuagccauuucuuuacuaaaaaaaaccaaaaaacaaaucuguuuuauaaucac

SEQ ID NO: 171928 - RNA, 62 nt, Human
ucagaaauguugccagaaaaaguaucuccuccaaccaaaacaucucaauaaaaccauuuuag

SEQ ID NO: 171929 - RNA, 62 nt, Human
uucauggggaacccagcaggaaauuagaauagaaccaaaaacgccagucaugggaggcagag

SEQ ID NO: 171930 - RNA, 62 nt, Human
ccuguuauggaaaaugucaaccuuuguaagaaaaccaaaauaaaaauugaaaaauaaaaacc

SEQ ID NO: 171931 - RNA, 62 nt, Human
aaacauuuuuuauacauuugguuauguugauaaaccaaaaacauuugauuaauaaaauaucu

SEQ ID NO: 171932 - RNA, 62 nt, Human
cuucucagcugcuguuuacaacaaacuucccuaaccaaaacagaaccucuaauuuagggcua

SEQ ID NO: 171933 - RNA, 62 nt, Human
ggaguucuauaaacucauaccucaguggacuuaaccaaaauuguguuagucucaauuccuac

SEQ ID NO: 171934 - RNA, 62 nt, Human
ugacaacgccaacugcccaagccuacagaacaaaccaaaaauguucuucauccaggccugcc

SEQ ID NO: 171935 - RNA, 62 nt, Human
ccaugucuacaaaaaugaaaaaccaaaaagcaaaccaaaagaaaaaucugaaauuuccaucu

SEQ ID NO: 171936 - RNA, 62 nt, Human
uagcaacaccccccaugucuacaaaaaugaaaaaccaaaaagcaaaccaaaagaaaaaucug

SEQ ID NO: 171937 - RNA, 62 nt, Human
gucucucucucucuuucucucucucucuuuuuaaccaaaaagagaugacaaaacuaaguuca

SEQ ID NO: 171938 - RNA, 62 nt, Human
uucuugccucauaaagaagaaaggaccaagaaaaccaaaacggaagaggagaaacucaauac

SEQ ID NO: 171939 - RNA, 62 nt, Human
cacacaaaaugcucaaggaagggacaagacaaaaccaaaacuaguucaaaugaugaagacca

SEQ ID NO: 171940 - RNA, 62 nt, Human
guucucugaaaacaaguuucuuuuguaguuuuaaccaaaaaagugcccuuuuugucacugga

SEQ ID NO: 171941 - RNA, 62 nt, Human
aguuuucaacacaucaacucacauauguucaaaaccaaaauaauaccuucauuaucaaacug

SEQ ID NO: 171942 - RNA, 62 nt, Human
cuguauggcaccaaaaaucaaagugaaaaccaaaccaaaaacccaaacacccuauguaacua

SEQ ID NO: 171943 - RNA, 62 nt, Human
uggauauacauccucacagaaaaguuggaaauaaccaaaacugaagucuuaauuuaccuuca

SEQ ID NO: 171944 - RNA, 62 nt, Human
cagugaaagcuccugugguuuugcucagccaaaaccaaaacgaggggaagaggaugauuccu

SEQ ID NO: 171945 - RNA, 62 nt, Human
uucccuugugggggcuuuggcagcuauggaagaaccaaaauaacgugaagaacaucacagag

SEQ ID NO: 171946 - RNA, 62 nt, Human
uaaccuuauugggaauggauaauuuagaaacaaaccaaaaaaaaaaaaagauauuugaagug

SEQ ID NO: 171947 - RNA, 62 nt, Human
acaaaaaccugguuuucuuuuuugguuucuucaaccaaaaaagaaagaaauugcaaaggacc

SEQ ID NO: 171948 - RNA, 62 nt, Human
caacuaaaaauuacgcuaucuagaauuguaccaaccaaaaucucguauuggcagaucuugac

SEQ ID NO: 171949 - RNA, 62 nt, Human
aaacuccauuauaacauauguaacuccuuuguaaccaaaauuuagguaagcaggcuuccuuu

SEQ ID NO: 171950 - RNA, 62 nt, Human
cccagcuucaaacuauacuacaaggcuacaguaaccaaaacagcauaguacuggcacaaaaa

SEQ ID NO: 171951 - RNA, 62 nt, Human
ucuguagcauuucacaaauaauguuugcuuugaaccaaaaugcucagugccuaucaacauuu

SEQ ID NO: 171952 - RNA, 62 nt, Human
guuuguauauuuaacaguaaggaggaaacuguaaccaaaauuaguauuucucuauacguauu

SEQ ID NO: 171953 - RNA, 62 nt, Human
uuaaaggaauacuaauuaauuguaacuuguaaaaccaaaaguucuaaugguuuuuaaaaacc

SEQ ID NO: 171954 - RNA, 62 nt, Human
ucuguucccucucuuuugaaaauguaaaauaaaaccaaaaauagacaacuuuuucuucagcc

SEQ ID NO: 171955 - RNA, 62 nt, Human
accaccaccaccuguguaaccaccaccgccagaaccaaaaacguuucugucacccaaagaag

SEQ ID NO: 171956 - RNA, 62 nt, Human
agacuggauuuggaaagaauauugagaaaaaaaaccaaaaaaaauuuugacuagaaauagau

SEQ ID NO: 171957 - RNA, 62 nt, Human
cauaaauaucgugucauauuuuccccaagauuaaccaaaaauaaucugcuuaucuuuuuggu

SEQ ID NO: 171958 - RNA, 62 nt, Human
gaucucugucacauccaacuggaaauuccaggaaccaaaaagagcaucccuaugggcuugga

SEQ ID NO: 171959 - RNA, 62 nt, Human
acagucaucacaagcauaggaagauacuucaaaaccaaaaaaaccaaggugcaucauuaaua

SEQ ID NO: 171960 - RNA, 62 nt, Human
gcauuuauaguuaauacuacuacuaauauguaaaccaaaaguuaaauauucuaguuaaggau

SEQ ID NO: 171961 - RNA, 62 nt, Human
ugggcuuugucagccagcgugugagaaaggagaaccaaaaccaauaccuccuuauagaagcc

SEQ ID NO: 171962 - RNA, 62 nt, Human
cagcuuugucucugucacaucagcaauuucagaaccaaaagggaggcucucuguaggcacag

SEQ ID NO: 171963 - RNA, 62 nt, Human
aggauucuuaagguaccagagauuugcuagggaaccaaaagugcuugagaaucugccugagg

SEQ ID NO: 171964 - RNA, 62 nt, Human
uaccugugaguuccuuuauuuauaauucuugaaaccaaaauguauaauguacaguuuucaca

SEQ ID NO: 171965 - RNA, 62 nt, Human
ugaaguaaaaaggagaucacuuuuuaccaaauaaccaaaaauuuuuagucugucaaagugca

SEQ ID NO: 171966 - RNA, 62 nt, Human
auucaacacuuauuuucugaauucauaaaaauaaccaaaaaaugugagcuauaauguuuccc

SEQ ID NO: 171967 - RNA, 62 nt, Human
ucauagagauggaaaacuguauaguaaccaaaaaccaaaacagugauauuuccagaacuuuu

SEQ ID NO: 171968 - RNA, 62 nt, Human
cacgagaucauagagauggaaaacuguauaguaaccaaaaaccaaaacagugauauuuccag

SEQ ID NO: 171969 - RNA, 62 nt, Human
gaaggguggcauucugcugaccacagcacuccaaccaaaagccaaaaaccaaagcaagacuu

SEQ ID NO: 171970 - RNA, 62 nt, Human
ggugucuuccucccaaguggugccuaaaguuuaaccaaaaagaccagacuaauauauuaaua

SEQ ID NO: 171971 - RNA, 62 nt, Human
uuuuugcuugaaacaacgcacacauuuucaacaaccaaaaaaugacaauuucuaguuuaguu

SEQ ID NO: 171972 - RNA, 62 nt, Human
caauguauguuuguuaaaaauaauaauaauaaaaccaaaagccuuuguggaaacccacucuu

SEQ ID NO: 171973 - RNA, 62 nt, Human
ccgcaacuccacacaguguguaaaauauauacaaccaaaaaucagcuuuugcaggucuuuau

SEQ ID NO: 171974 - RNA, 62 nt, Human
cugccaaggaccucauuuaguuuguguauuaaaaccaaaaagcuuuugucuuuaagaaauaa

SEQ ID NO: 171975 - RNA, 62 nt, Human
uccccgcucccugugcagaagggcugacaucaaaccaaaaacuagagggggcagggccaggg

SEQ ID NO: 171976 - RNA, 62 nt, Human
caaaacacauacacccagaaagaaacaacagaaaccaaaacucacaaggcgcaugauuacuu

SEQ ID NO: 171977 - RNA, 62 nt, Human
uguuguuuauaugaaaacacucaaaaugaugcaaccaaaagggaaaaaauaaaaaucaaaca

SEQ ID NO: 171978 - RNA, 62 nt, Human
cguguaccucuguguguucauggagcuggagaaaccaaaacugggucucucuccacccggga

SEQ ID NO: 171979 - RNA, 62 nt, Human
aauguuggaaaacuaaucacaagcaguuucuaaaccaaaaaaugacauguuguaaaaggaca

SEQ ID NO: 171980 - RNA, 62 nt, Human
cagguuuagauuaccguuuucgacgacagauuaaccaaaaaugccccacacagguuuuauua

SEQ ID NO: 171981 - RNA, 62 nt, Human
uuaguuacagguuaggaagauggucuuuaaauaaccaaaaauauguuuauuuuuuauuauag

SEQ ID NO: 171982 - RNA, 62 nt, Human
agucaaccugauucacuaacacacagaugaacaaccaaaauauaccuaaaagguauagucuc

SEQ ID NO: 171983 - RNA, 62 nt, Human
gucauuuuuauggauuguagacccaguuuugaaaccaaaaaagaaaccuagaaucuaaugca

SEQ ID NO: 171984 - RNA, 62 nt, Human
gaccagacugaagaacacgguugaguccccagaaccaaaagggggccuuucugcuucuuagc

SEQ ID NO: 171985 - RNA, 62 nt, Human
uagcagugguagguugggaaggagauagcugcaaccaaaaaagaaauaaauauucuauaaac

SEQ ID NO: 171986 - RNA, 62 nt, Human
ccaacauucaaauucugccucaucuggagggaaaccaaaauugggagggggaagaggacccc

SEQ ID NO: 171987 - RNA, 62 nt, Human
cuguuaagacuuaaaagccauauaauuccaccaaccaaaauuaaucccuuuugucauauuuc

SEQ ID NO: 171988 - RNA, 62 nt, Human
uuguuuacaugauuggacccucagauucuguuaaccaaaauugcagaauggggggccaggcc

SEQ ID NO: 171989 - RNA, 62 nt, Human
uggaauacacuuuguuugcuucaugugcagauaaccaaaaaucauuuuaaaagauaucaaac

SEQ ID NO: 171990 - RNA, 62 nt, Human
cuucaacaauggcgaaauugacuguagugcugaaccaaaaguaucccuuucccuccuuauuc

SEQ ID NO: 171991 - RNA, 62 nt, Human
ccugacuuccaauuauucaacagagcuacaguaaccaaaacagcaugauacuggcauaacaa

SEQ ID NO: 171992 - RNA, 62 nt, Human
ccuauuugaacuagcuucuugucuuaggccugaaccaaaaaacaacaaacaaacaaaaaaca

SEQ ID NO: 171993 - RNA, 62 nt, Human
caaugaaaaaauaguuauaucaucuuauaguaaaccaaaagauuagcaauaauacuauggac

SEQ ID NO: 171994 - RNA, 62 nt, Human
aagcaaauacuuggugagugauuuaaaaauaaaaccaaaacaaaacacaaaaagauauucca

SEQ ID NO: 171995 - RNA, 62 nt, Human
auuuuaucuacuuguuccagaaauaauacauuaaccaaaaaggauuuaauuguucagacuug

SEQ ID NO: 171996 - RNA, 62 nt, Human
ugaucgcaaauacacuaaauguggaguguaggaaccaaaaugaaaccugcuguauggaaacu

SEQ ID NO: 171997 - RNA, 62 nt, Human
cauuuugagcugaaaugcugcauuuuaauuuuaaccaaaacaugucuccuauccugguuuuu

SEQ ID NO: 171998 - RNA, 62 nt, Human
aaauguuccaccaguagggauaggggaaaaguaaccaaaagagagaaagagaaaggaaugcu

SEQ ID NO: 171999 - RNA, 62 nt, Human
ugcugaauagccuagacaucaaaguuggugugaaccaaaauagagucagcugacccagcauc

SEQ ID NO: 172000 - RNA, 62 nt, Human
ggaaauguaaauuaaauuaguuauaaauaaauaaccaaaaauguauguaaacauucaaauga

SEQ ID NO: 172001 - RNA, 62 nt, Human
auuucuggaaguugagauguuucagcuugaagaaccaaaacagaaggaauauguacaaagaa

SEQ ID NO: 172002 - RNA, 62 nt, Human
uuggugagaggagagcucauuguuugaagaaaaaccaaaacauuuuauggcuaguaauauuu

SEQ ID NO: 172003 - RNA, 62 nt, Human
acuaaauaaacacuacucaaguacagacugcaaaccaaaauguaucuguguuacgacauuaa

SEQ ID NO: 172004 - RNA, 62 nt, Human
ugagaaagguggucaggcccuucuaaaugcuuaaccaaaaacaaacauuauuggaguuucag

SEQ ID NO: 172005 - RNA, 62 nt, Human
gguccucauuuccaaagucccaaugcucugaaaaccaaaaguauuuucauaacccauuugaa

SEQ ID NO: 172006 - RNA, 62 nt, Human
gguaaacgagugucugcauuuagauuccacaaaaccaaaauccauguugaacaaaguuaagu

SEQ ID NO: 172007 - RNA, 62 nt, Human
ucagauuuugauaacuguuuauauguguugaaaaccaaaaugacaucuuuuuaaagcuuauc

SEQ ID NO: 172008 - RNA, 62 nt, Human
agaacaacuuuugucauagauuugauuuauuaaaccaaaauuauacauauuaaaauuauauc

SEQ ID NO: 172009 - RNA, 62 nt, Human
aaggaaaauauuuucacaaaggguuaucugauaaccaaaaaaaaaaaagacauuucaucuaa

SEQ ID NO: 172010 - RNA, 52 nt, Human
agaguagaagaacaaucuagaaaaccaaaagaacaagaauuucuugguaaga

SEQ ID NO: 172011 - RNA, 62 nt, Human
aauagccaucugcuauaacucuuucaacagaaaaccaaaaccaaacgaaaugucuaaggaaa

SEQ ID NO: 172012 - RNA, 62 nt, Human
aaccguaaaaaaaggagcagguaaugaaucguaaccaaaacuacaguugauccuccgcaaag

SEQ ID NO: 172013 - RNA, 62 nt, Human
caaacacaggagcgcuacuuggccaagaagaaaaccaaaaucuccucgguaacugcccauca

SEQ ID NO: 172014 - RNA, 57 nt, Human
aggaggaggaggaagaauaaggaggaaaaccaaaaccccaagcacccauuaaacaag

SEQ ID NO: 172015 - RNA, 62 nt, Human
agaaacacagaaaauguaguuuuguuuuaauaaaccaaaaauugaacauacucuugaugugu

SEQ ID NO: 172016 - RNA, 62 nt, Human
gcauaggggccauaucauucauggccaaaaaaaaccaaaaagcaaaaaacaaaaacaagucc

SEQ ID NO: 172017 - RNA, 62 nt, Human
auaauagagcagaugguugccuuugggucuugaaccaaaauaagacuuacuaaaggaagagu

SEQ ID NO: 172018 - RNA, 62 nt, Human
gaguuguugggcaaggaugcugucauuuuuugaaccaaaagacaaacagguuaaaaggaaaa

SEQ ID NO: 172019 - RNA, 62 nt, Human
uuaaucuucaucuuuaaaaaaaagaaaaaagaaaccaaaaugagaaucaacacuucauaggc

SEQ ID NO: 172020 - RNA, 62 nt, Human
aauaaaagcauuauugggugccuuuguuuguaaaccaaaaaguaauaaaugaaucccuauau

SEQ ID NO: 172021 - RNA, 62 nt, Human
gcacuuucacaggaacuagaaaacuauucuuaaaccaaaaauaccauccguguugacccaug

SEQ ID NO: 172022 - RNA, 62 nt, Human
acacagaaacauaauaaacaaucuucacacgaaaccaaaaauagcauacaccuaauguuggg

SEQ ID NO: 172023 - RNA, 62 nt, Human
guugaagaguugcacaucaccuuuaguagucaaaccaaaaaucuaagauuccaaaaagaaca

SEQ ID NO: 172024 - RNA, 62 nt, Human
ugaaaacugaagcugccaauacuuuggacacaaaccaaaacacacaccaaauaaucagaaac

SEQ ID NO: 172025 - RNA, 62 nt, Human
agauaaauuggaauugcuguuggugaaauaacaaccaaaauacugaaucugauguacauaca

SEQ ID NO: 172026 - RNA, 62 nt, Human
ucaucagcucagcacaugcuuuaagaaagcaaaaccaaaaaaaaaaaaaaaaagaugcagca

SEQ ID NO: 172027 - RNA, 62 nt, Human
cagguagugguaaccugacucuucuaaucuugaaccaaaaggaaaaccaugagacuguaauu

SEQ ID NO: 172028 - RNA, 62 nt, Human
uuauaaaaaacacuaaacauucaauuccagagaaccaaaaaucccaccuucccaccgaacac

SEQ ID NO: 172029 - RNA, 62 nt, Human
ucuuugccuaaauucauuugcuacagugcaggaaccaaaacuuguucaucucaugauucccu

SEQ ID NO: 172030 - RNA, 62 nt, Human
ccucaaagcaaccauggccuacuuaaaaaccaaaccaaaaauaaagaguuuaguugaggaga

SEQ ID NO: 172031 - RNA, 62 nt, Human
auggcucccacauuuuaagauuuuaaaaaugaaaccaaaaaauaaauugaagaaaacuguaa

SEQ ID NO: 172032 - RNA, 62 nt, Human
gggaccggguaugccaacuggaaugauucuagaaccaaaauaaaguuggggcaggaagaggg

SEQ ID NO: 172033 - RNA, 62 nt, Human
uacaucauuuguuuuuccugaccaguauuuaaaaccaaaaggauauucugaaaaauggccaa

SEQ ID NO: 172034 - RNA, 62 nt, Human
gcugugugccccggucaccuagcaagcugccgaaccaaaagaauuugcaccccgcugcgggc

SEQ ID NO: 172035 - RNA, 62 nt, Human
auccugugagguuuauacuauuucugguuuuuaaccaaaaggaaaucaucuggaagcaggag

SEQ ID NO: 172036 - RNA, 62 nt, Human
guauucaauaaguagccuuuguacaaauuuaaaaccaaaaacuauucuguuguuuuucuuca

SEQ ID NO: 172037 - RNA, 62 nt, Human
ucacaguauuuguucccaaauauauuaaagguaaccaaaauguuaaaaucugauuuuauuuc

SEQ ID NO: 172038 - RNA, 55 nt, Human
uucguacauuucuuucaugaagaagaaccaaaacaucgucuaaacuuuagaauua

SEQ ID NO: 172039 - RNA, 62 nt, Human
gagcaacuugaauagauacugugaacuaaccaaaccaaaaccaaccccagagugcagauaaa

SEQ ID NO: 172040 - RNA, 62 nt, Human
agaagcuuuuuggaucagcauuuuguaaaaacaaccaaaaucaggaagguaaauugguugcu

SEQ ID NO: 172041 - RNA, 62 nt, Human
gguuugcugacuguaaucccugacaccaguaaaaccaaaaggacucuugggggcucagugug

SEQ ID NO: 172042 - RNA, 62 nt, Human
cuccuuauauuuggcccaaacucaucuugaucaaccaaaaacauguuucugccuucuuuaug

SEQ ID NO: 172043 - RNA, 62 nt, Human
accacauacugaugacaauaaucuauacuuugaaccaaaaguugcagagugguggaaugcua

SEQ ID NO: 172044 - RNA, 62 nt, Human
cuugaauuuguuagcaaauauuaauggcagaaaaccaaaaacuaaauuuaugguaucgagag

SEQ ID NO: 172045 - RNA, 62 nt, Human
gaacuacuguguguguaaccguuucccccgucaaccaaaaucaguguuuauagagugaaccc

SEQ ID NO: 172046 - RNA, 62 nt, Human
aaaaaaacacacacacacacaacaaaaauuugaaccaaaacauuccguuuacauuuuagaca

SEQ ID NO: 172047 - RNA, 62 nt, Human
gcuuuccuguuucuaaacuuucgcuacuauaaaaccaaaaaaaggaauugagauuucaccaa

SEQ ID NO: 172048 - RNA, 62 nt, Human
ggaccuggaugacaggcaaucaaggccugagcaaccaaaaggagugccccauauggcuuuuc

SEQ ID NO: 172049 - RNA, 62 nt, Human
gagccucaguuuccuuaugugaaaguugcuggaaccaaaauggagucacuuaugccaaacuc

SEQ ID NO: 172050 - RNA, 62 nt, Human
cuuucucccaauccuuaaaucucuuguauggcaaccaaaauuacuguaaaaaaauaaauaua

SEQ ID NO: 172051 - RNA, 62 nt, Human
ccuccccccaacuuuuuuuuuuuaaaccaacaaaccaaaaaaggccacaaaauuaauuagag

SEQ ID NO: 172052 - RNA, 62 nt, Human
cugggggcccugguuuucuugucuaccagauaaaccaaaacugggaaggccaaguacagucu

SEQ ID NO: 172053 - RNA, 62 nt, Human
uauauauauauacauauauauauauauauauaaaccaaaaguaguuggaaagauuauuugaa

SEQ ID NO: 172054 - RNA, 62 nt, Human
guccaguucuaguaaccuaaaguaaauuuguuaaccaaaaugauagguaaaaagaucuauac

SEQ ID NO: 172055 - RNA, 62 nt, Human
uaccacaggaaccugggggccugugaaacuacaaccaaaaggcacacaaaaccguuuccagu

SEQ ID NO: 172056 - RNA, 62 nt, Human
gagaacugagcaucuccagcauucucagccacaaccaaaaaaaaauaaaaagggcagcccuc

SEQ ID NO: 172057 - RNA, 62 nt, Human
gcuggacaguggacuguucuauuuuuuucaauaaccaaaaagauuaaacaaaaaauacuaua

SEQ ID NO: 172058 - RNA, 62 nt, Human
ugaaacccaacacuaaauuuugcaagucaaguaaccaaaaaagggggaggcauuuugaagau

SEQ ID NO: 172059 - RNA, 62 nt, Human
cuaucuaauggggaaauguagcuaugggccauaaccaaaacucacaugaaacggaggcagau

SEQ ID NO: 172060 - RNA, 62 nt, Human
auaucuauaugacgcucuuaaaaaaacaucccaaccaaaaccaaccaaacaaaaacauccuc

SEQ ID NO: 172061 - RNA, 62 nt, Human
cccccacccccccucaaaaaaacagaacaguaaaccaaaaugugggccaugaaauuagcaac

SEQ ID NO: 172062 - RNA, 62 nt, Human
ggcaauucuggaagcugauuaaaacacacauaaaccaaaaccaaacaacaggcccuugggug

SEQ ID NO: 172063 - RNA, 62 nt, Human
aaaaagacaugagcuggauuggacacuccuaaaaccaaaaacaacagugacaauagagucuc

SEQ ID NO: 172064 - RNA, 62 nt, Human
aauauuaagcccuuaaaaaaauaaaaccucugaaccaaaaucuucccaggaauaguacuuaa

SEQ ID NO: 172065 - RNA, 62 nt, Human
agaggagugaaagaauuaaguggguagacaccaaccaaaaugacuuugaaagcagugagcug

SEQ ID NO: 172066 - RNA, 62 nt, Human
guaucucuuuucucucuucuaauuuucaguauaaccaaaaauuaucccagcaugagcacggg

SEQ ID NO: 172067 - RNA, 62 nt, Human
cuuuuaaaacaauuuguaauuauuucuuuacaaaccaaaacagaacagaaagguguggugcu

SEQ ID NO: 172068 - RNA, 62 nt, Human
ucugaccgccuacuggaaauauuuuuaaguggaaccaaaauaggcauccuuacaaaucagga

SEQ ID NO: 172069 - RNA, 62 nt, Human
guguuuuuaaagcugcucauuucauuuuguccaaccaaaaagaaaagggagauaacuaauga

SEQ ID NO: 172070 - RNA, 62 nt, Human
agaguaucuccgaaugcagcuauguaaaagagaaccaaaacuugagugcucuggauaacuau

SEQ ID NO: 172071 - RNA, 62 nt, Human
uauuuaucccauuuuaugcaauuaaccaaaucaaccaaaaaaagugaccaugaaguccugua

SEQ ID NO: 172072 - RNA, 62 nt, Human
aagaauucccuugcguauucucucucuaaaacaaccaaaaaaaaauggagaggcuuuuuaua

SEQ ID NO: 172073 - RNA, 62 nt, Human
cuuucucuggaaaaugaaugcuaauuagugugaaccaaaagaguaaguaagagucugaaguu

SEQ ID NO: 172074 - RNA, 62 nt, Human
guagaugccacuagcccuccucucccagugacaaccaaaagucuucagacauugucaaacgu

SEQ ID NO: 172075 - RNA, 62 nt, Human
ugaaauaaaguggaaaaaaaaaaaaaggaaaaaaccaaaagcauaaaaaaccacagcaaauu

SEQ ID NO: 172076 - RNA, 62 nt, Human
uccuugauauccucuuugagugaagcugggagaaccaaaaagaggcuaugugagcacaaagg

SEQ ID NO: 172077 - RNA, 62 nt, Human
acacuuguuucaugaagagaaaggacuugcauaaccaaaauaaacaaagcaagacaaauuaa

SEQ ID NO: 172078 - RNA, 62 nt, Human
cuuucuuggauccaaauuuaaauaucuuccuaaaccaaaacuguaaauaugguuguugcaug

SEQ ID NO: 172079 - RNA, 62 nt, Human
agggauauggaauguuuacuggacaguuggaaaaccaaaaacagauaccauuuucucaaugg

SEQ ID NO: 172080 - RNA, 62 nt, Human
cuaaccuggaugcagcucucuauuggccucucaaccaaaagguguuccucuuuaagguauaa

SEQ ID NO: 172081 - RNA, 62 nt, Human
uguuuuuacugaaauuaacugaaaaaauaugaaaccaaaaguacaaacuguguugucuuuuc

SEQ ID NO: 172082 - RNA, 62 nt, Human
aaaaggauaaaaaugcuuuauuuauacagaugaaccaaaauuacaaaaaguuaugaaaauuu

SEQ ID NO: 172083 - RNA, 62 nt, Human
uaacaauuagaugccccaaagcgauuuuuuuuaaccaaaaggaagaugggaagccaaacucc

SEQ ID NO: 172084 - RNA, 62 nt, Human
guacuuaaguagccuggagguagguucuagaaaaccaaaaugagaguuuugcuaaaaucauc

SEQ ID NO: 172085 - RNA, 62 nt, Human
aucugguaauuugugcagcagcaauagaugauaaccaaaaaaaacucauaauaaucugaaua

SEQ ID NO: 172086 - RNA, 62 nt, Human
acagaccacagugauuuagccaaauaagucuuaaccaaaaaaaggaaucugaaaaacauaca

SEQ ID NO: 172087 - RNA, 62 nt, Human
uacuccucuguucugaaucuggggaaguaguaaaccaaaaagacagggaaaaccagauauuu

SEQ ID NO: 172088 - RNA, 62 nt, Human
ucagcucagugaucaaagucuucaaauaguuaaaccaaaagaagaauagggcugcuuugugu

SEQ ID NO: 172089 - RNA, 62 nt, Human
guaauucaaucacuuuuucucuuuuauccucuaaccaaaaaauuguuuaauuuugcauccca

SEQ ID NO: 172090 - RNA, 62 nt, Human
agacgcuguagauggacaagcuugauuguuggaaccaaaaugggaacauuaaacaaacauca

SEQ ID NO: 172091 - RNA, 62 nt, Human
agcagaaugacucagauuucauagaaaggagcaaccaaaaugucacaacccaaaacuuuaca

SEQ ID NO: 172092 - RNA, 62 nt, Human
uuaccuuugauacauaugauccacaauauaaaaaccaaaaacuacugugugcaaauuauacc

SEQ ID NO: 172093 - RNA, 62 nt, Human
uuuuauauuucuuucuuuuuuaauguugccaaaaccaaaaguagcuuuguuuuccuuuguau

SEQ ID NO: 172094 - RNA, 62 nt, Human
cccgggggccccgccccgaagcagccuccugaaaccaaaacgcccgacgcagacgcgguggg

SEQ ID NO: 172095 - RNA, 62 nt, Human
auccuuuauacaguuguauaaacuguauuuugaaccaaaacauauagguuacuacuuaaugc

SEQ ID NO: 172096 - RNA, 62 nt, Human
agcaucagaacagauacugaagauaaaggaagaaccaaaagccaaguuaaagcugagagcac

SEQ ID NO: 172097 - RNA, 62 nt, Human
gaccucaguuauauaaauuucaguuuaauaucaaccaaaaaauuaaaauuuuaaucuaaccc

SEQ ID NO: 172098 - RNA, 62 nt, Human
aaggucuuguugauauuauauaguaaaaauaaaaccaaaaauaaauauuauucaaguggcuc

SEQ ID NO: 172099 - RNA, 62 nt, Human
aagugucaggauaugcauuagauucucuccugaaccaaaaacacaacagucauuaucuguga

SEQ ID NO: 172100 - RNA, 62 nt, Human
caauuuccucccccuccucacucucacaagaaaaccaaaaguuucucuucagaguuguugac

SEQ ID NO: 172101 - RNA, 62 nt, Human
aagugucaucuuuuaagagucaguguauagcaaaccaaaagaucacauuuauacccaaagcu

SEQ ID NO: 172102 - RNA, 62 nt, Human
uuagaaaauauuugaaaguauuuuuauuaaugaaccaaaaugacauguucauuugacuacua

SEQ ID NO: 172103 - RNA, 62 nt, Human
ucuaaauguguuucaaggaaacacaaucgcugaaccaaaacguacugcagccgagcccccuc

SEQ ID NO: 172104 - RNA, 62 nt, Human
aaaggauuauugugaggauggucuguaagcauaaccaaaaggaauuugucuaauaacaauuu

SEQ ID NO: 172105 - RNA, 62 nt, Human
uucuauaaggaaauaauacuuuuuuaaacaacaaccaaaaaaugccuugcugauucacuagg

SEQ ID NO: 172106 - RNA, 62 nt, Human
cuucuugucuguaagccagcugaucuaguaguaaccaaaaauuccaguuuugagaauaggaa

SEQ ID NO: 172107 - RNA, 62 nt, Human
gugaaacaguaucauccucguuaguagaggaaaaccaaaacccuuuuuuccgucaaaauugg

SEQ ID NO: 172108 - RNA, 62 nt, Human
uuucugucaauauugaaugugaugguacaguaaaccaaaacccaacaauguggccagaaaga

SEQ ID NO: 172109 - RNA, 54 nt, Human
uuuucgagacagcacugugaauccaaccaaaaugucaaguccguuccgaaggca

SEQ ID NO: 172110 - RNA, 62 nt, Human
augaauuacagucaugacaggcacauguaagaaaccaaaauuugcuaaauauguacaugagu

SEQ ID NO: 172111 - RNA, 62 nt, Human
cucaaacaacccuugaaauauuucauuuacuuaaccaaaaacaaauacuugcugauacuuua

SEQ ID NO: 172112 - RNA, 62 nt, Human
cagucuuccugcaaucccaugccugaguauguaaccaaaagaauugaaauccggaucucaaa

SEQ ID NO: 172113 - RNA, 62 nt, Human
uauuuacauuuuuaauuuaguuuacagaauggaaccaaaauguauaaauguuauguuugcua

SEQ ID NO: 172114 - RNA, 62 nt, Human
ugcucuccugaaucuugggcaugccuuucuguaaccaaaaaucccuguaggcgugcuagcaa

SEQ ID NO: 172115 - RNA, 62 nt, Human
ugugaaacauccguuuucauuguucacuucuaaaccaaaaauuauguguugccaaaaccaaa

SEQ ID NO: 172116 - RNA, 62 nt, Human
acauccucuuuagagguaauuuuuguuaacauaaccaaaaauuaaauugaaacaaaaugucc

SEQ ID NO: 172117 - RNA, 62 nt, Human
cguccggcuuccuugguggaggccgucuaggaaaccaaaaacucccaggaugccccggugug

SEQ ID NO: 172118 - RNA, 62 nt, Human
gcugguuuuaaaaauucuuuccacaccugucaaaccaaaaaucuaucagcccacguggugug

SEQ ID NO: 172119 - RNA, 62 nt, Human
ccuccgaacagccaggaaaagccaugaguugcaaccaaaacgcggcugaggauggaacucag

SEQ ID NO: 172120 - RNA, 62 nt, Human
ggagugaauuuugugucuaauuauaaaccuguaaccaaaacucagacaucugguacuggucu

SEQ ID NO: 172121 - RNA, 62 nt, Human
aaggaugaaaaaagguauaguagacauacacuaaccaaaaauguagcucuuugaaucucaga

SEQ ID NO: 172122 - RNA, 62 nt, Human
caaaguucuuucaaaaaaaaaaacugaaacacaaccaaaaaagcaagagcgagagagaguac

SEQ ID NO: 172123 - RNA, 62 nt, Human
gaugaagggacauucugccaugacauacacuuaaccaaaacuauucaaaaugaaaaccggau

SEQ ID NO: 172124 - RNA, 62 nt, Human
aagaacuggguguugaguauucaucaacuaagaaccaaaauccagggcacucauaugugaag

SEQ ID NO: 172125 - RNA, 62 nt, Human
cagggauucccuguccccaacaggaauuuuuaaaccaaaacaccccaacuuggcagcuuuuu

SEQ ID NO: 172126 - RNA, 62 nt, Human
uucugcaaaaaagaaaaaaaaguuacguuaaaaaccaaaaaacuacauauuuuauuauagaa

SEQ ID NO: 172127 - RNA, 62 nt, Human
aagcggacaguuugaaacuuggggcauaugccaaccaaaacuucguuucugcaugucagaaa

SEQ ID NO: 172128 - RNA, 62 nt, Human
uuaacuuugagaccagaauuacagagaagaaaaaccaaaacccaacccugcauggucaagug

SEQ ID NO: 172129 - RNA, 62 nt, Human
cuucuguuuuuggaggcauacacauuaugcauaaccaaaacaauggcucaauuguguuuaac

SEQ ID NO: 172130 - RNA, 62 nt, Human
auuuaacgagccacuuccaugaucuccaaagaaaccaaaauacaaacacaauauuuaaucuu

SEQ ID NO: 172131 - RNA, 62 nt, Human
uucucaugcuuucucuaacuuccucaccccuuaaccaaaaagguguguuuucuuuugugcau

SEQ ID NO: 172132 - RNA, 62 nt, Human
gugggcuugccuucucugccaaacgacugggaaaccaaaaugagcccaccuuguguucuucc

SEQ ID NO: 172133 - RNA, 62 nt, Human
guacauacaauacuaauuguauauaagguagcaaccaaaagagguuguuaauuagcacauau

SEQ ID NO: 172134 - RNA, 57 nt, Human
gcagggcaaagcacaacuagagcucacaaccaaaacugcacuucagccucugcugua

SEQ ID NO: 172135 - RNA, 62 nt, Human
agaggaaugcagagaagaaaacuauaaaacagaaccaaaaacuuguugcacagccuacauaa

SEQ ID NO: 172136 - RNA, 62 nt, Human
acuuccuauaaccuaauauuuucgguaucauuaaccaaaauuucacacucauaguugcuaaa

SEQ ID NO: 172137 - RNA, 62 nt, Human
auauaauaagggaaaagauaagcagauuucgcaaccaaaaaauaucgaaagucucuguguga

SEQ ID NO: 172138 - RNA, 62 nt, Human
uucuuaaaaaaagaaaaaaagguuccaaaaaaaaccaaaacucaguacacacacacaggcac

SEQ ID NO: 172139 - RNA, 62 nt, Human
ugaagaggucgccauaaaauauuagagucaacaaccaaaauuauuaagcucugugcgaggcu

SEQ ID NO: 172140 - RNA, 62 nt, Human
guauaccuaagagaaugucaaaauaaacaccaaaccaaaagaagguaggagugccauuuuua

SEQ ID NO: 172141 - RNA, 62 nt, Human
aguauuacuugaaugcauccagaggauauuuaaaccaaaaugaaaaaccagaaggccauuug

SEQ ID NO: 172142 - RNA, 62 nt, Human
cccaagaaaaacagcuuuaaucuccagaagaaaaccaaaauaccaugggauuuaugcuguau

SEQ ID NO: 172143 - RNA, 62 nt, Human
uaaugugauaucuauaggucacaauuuuuuaaaaccaaaauuuucaagucugggauaaucuu

SEQ ID NO: 172144 - RNA, 62 nt, Human
aaucuguaguguuuuuacugccauaguuuuauaaccaaaaucuugacuuaaaauuuuccggg

SEQ ID NO: 172145 - RNA, 62 nt, Human
acaguuugaacuggguauagauuaauaucuaaaaccaaaaaaugaacauguguauagugaug

SEQ ID NO: 172146 - RNA, 62 nt, Human
auaagaucuuuuccaaaguuuuucuuagaaccaaccaaaaaacaauccgaguaggcccaaga

SEQ ID NO: 172147 - RNA, 62 nt, Human
gggacuccucuuugggggaggguggauauccaaaccaaaaagaagaaaacagaugcccccag

SEQ ID NO: 172148 - RNA, 62 nt, Human
guaaacaauaaggagacuuugcucuucauuuaaaccaaaaucauauuucauauuuuacgcuc

SEQ ID NO: 172149 - RNA, 62 nt, Human
ucaccugcauagucacucuuuugaugcuggggaaccaaaauggugaugauauauagacuuua

SEQ ID NO: 172150 - RNA, 62 nt, Human
agcugauuggaugucuaggaaugacugaaagaaaccaaaacagccuguccacugcugcugug

SEQ ID NO: 172151 - RNA, 62 nt, Human
guaccccugguaaaccaagccucccacacugaaaccaaaacauaaaaaccaaacccagacaa

SEQ ID NO: 172152 - RNA, 62 nt, Human
cugaaaccaaaacauaaaaaccaaacccagacaaccaaaacauauucaaagcagcagccacc

SEQ ID NO: 172153 - RNA, 62 nt, Human
acaaacaaaaaacaacaaaccaaaccaaaccaaaccaaaaaaaucucaaagcgauuggaccu

SEQ ID NO: 172154 - RNA, 62 nt, Human
cucuucauuuauguuaaguauuaauaggucaaaaccaaaaugaccuaacccuccuggaccua

SEQ ID NO: 172155 - RNA, 62 nt, Human
guaauauccagagcuacuuuauaaauucucugaaccaaaaguauuuuccucaguguaucucu

SEQ ID NO: 172156 - RNA, 62 nt, Human
ucacaaaucauguauuggaaauuauaaauggcaaccaaaaacuggcuuuuaaaaaauauuuu

SEQ ID NO: 172157 - RNA, 62 nt, Human
gcccgaccuugagggcugugccaauccuagugaaccaaaaugcaaacaacucacacaaguga

SEQ ID NO: 172158 - RNA, 62 nt, Human
gagcauggcagacaccagauaggugaguccuuaaccaaaaauaacuaacuacauaagggcaa

SEQ ID NO: 172159 - RNA, 62 nt, Human
cuacaguuuugcaccacggcaagaaaaccaaaaaccaaaacaaacaaacaaaaaaaacccaa

SEQ ID NO: 172160 - RNA, 62 nt, Human
caacuuucuacaguuuugcaccacggcaagaaaaccaaaaaccaaaacaaacaaacaaaaaa

SEQ ID NO: 172161 - RNA, 62 nt, Human
ccaugcaauccagugaggcuucaguguacagcaaccaaaaugguagggaggucuugaagcca

SEQ ID NO: 172162 - RNA, 62 nt, Human
ucaucuauaaacucaaccacauuuuaauguugaaccaaaaaaagauaauaaaauaaaaaagu

SEQ ID NO: 172163 - RNA, 62 nt, Human
aacugauucuuaugauuacuaucauggcauauaaccaaaauccgacugggcucaagaggcca

SEQ ID NO: 172164 - RNA, 62 nt, Human
aaaaauagacuaacugcaauuccaaagcuucuaaccaaaaaacaaaaaaaaaaaaaaaaaga

SEQ ID NO: 172165 - RNA, 62 nt, Human
cgcagaugagguuccugccccuuccuccucguaaccaaaacccucacugcucccaggacggu

SEQ ID NO: 172166 - RNA, 62 nt, Human
acaacucucuuaggucauuuuucaauguguguaaccaaaaguuaaucagaauaaagcggaag

SEQ ID NO: 172167 - RNA, 62 nt, Human
uauauugugcgugcaccagccccagcuggagcaaccaaaacugcuucugguuuaggcacacg

SEQ ID NO: 172168 - RNA, 62 nt, Human
auuucaucucccguuguggaucaauuuggaaaaaccaaaauauguaauuuuaaaaaacuaaa

SEQ ID NO: 172169 - RNA, 62 nt, Human
cagcaaucaggcaagagaaagaaauaaaaggcaaccaaaaagaaaggaagucgaaguaucuc

SEQ ID NO: 172170 - RNA, 62 nt, Human
aucagaaaaaaaaagcauuaaaauuuauuugaaaccaaaaaagagcccaaaaagccaaagca

SEQ ID NO: 172171 - RNA, 62 nt, Human
cccaacuucaaacuauacuacagggcuacaguaaccaaaacugcaugauacugguacaaaag

SEQ ID NO: 172172 - RNA, 62 nt, Human
uuuuacuguaaaagggaaauuugaacaacaaaaaccaaaaaaaauaaaaauaaaaaacuuca

SEQ ID NO: 172173 - RNA, 62 nt, Human
uagaguguaauuucuuuuauauuagccuuaaaaaccaaaaaugcuggguucaaaguccuuag

SEQ ID NO: 172174 - RNA, 62 nt, Human
uccagcuucuuccccugggaaaaaacccaaagaaccaaaaacaaaccaccccaaggauaaua

SEQ ID NO: 172175 - RNA, 62 nt, Human
auaauguauugugucugugcagaaaaaaaaaaaaccaaaaaggauugcuuuacuccaagagg

SEQ ID NO: 172176 - RNA, 62 nt, Human
ucgaagacaagucauuccuauuauuauagaauaaccaaaaccuuauuuauguuuuaccuuug

SEQ ID NO: 172177 - RNA, 62 nt, Human
auauaaaggcguguauauuaucuuuguauuagaaccaaaaaaguuauuuauuuuggucccua

SEQ ID NO: 172178 - RNA, 62 nt, Human
uucuuuuucuuuuuuuuaacaaaacagaacaaaaccaaaaaauguccagaugauuguguuug

SEQ ID NO: 172179 - RNA, 62 nt, Human
aggugaaaguagcaggaacaacaacaaaagccaaccaaaaacaagguagccagugcaagaca

SEQ ID NO: 172180 - RNA, 62 nt, Human
acuucaaaaacaaaaaaaucacaacccaaacaaaccaaaauuuaaaugaucagaauuggcag

SEQ ID NO: 172181 - RNA, 62 nt, Human
caagucauucauagcagccaggaaacaauaggaaccaaaagccucugccugcugcuauugca

SEQ ID NO: 172182 - RNA, 62 nt, Human
uaggauauauuuuuaaauucuuugaaacacauaaccaaaaugguuugauucacugacugacu

SEQ ID NO: 172183 - RNA, 62 nt, Human
aaagucauuaggcuuucccuuugugucagugaaaccaaaagugcuucuuacaacguucgcuc

SEQ ID NO: 172184 - RNA, 62 nt, Human
ucagaagucacugcuaaagaccuuauccuuguaaccaaaagccaucugcuccccaaaaacua

SEQ ID NO: 172185 - RNA, 62 nt, Human
gcaagcuccugggcccacccccagaccuccugaaccaaaagcuccagggcuggccguaugau

SEQ ID NO: 172186 - RNA, 62 nt, Human
agccugggagcaccucuuugcuuuucacaccaaaccaaaacuggcgagagccccuccuagcc

SEQ ID NO: 172187 - RNA, 62 nt, Human
uuucuguccuugagcccagugaguucaauaaaaaccaaaauauuuggcucucauuuuguuuu

SEQ ID NO: 172188 - RNA, 62 nt, Human
uugucacuuuucucuuguucuugaaacauugcaaccaaaaaggucagcacaaaggccuucac

SEQ ID NO: 172189 - RNA, 62 nt, Human
cuguuuuggauggggauguuacccuugcguucaaccaaaauugauucuuggaacuguaaaga

SEQ ID NO: 172190 - RNA, 62 nt, Human
ccccaugaggcugcuuuugugaguguuggaaaaaccaaaaacugcauugaaauguuucuggg

SEQ ID NO: 172191 - RNA, 62 nt, Human
guaggaaggcaaaacaaaaaaaagccucucaaaaccaaaaaaaccucuguagcauuccagcg

SEQ ID NO: 172192 - RNA, 62 nt, Human
gaguagaggcuuagagacaguugggugagaacaaccaaaaucuuaucauggucucagucaua

SEQ ID NO: 172193 - RNA, 62 nt, Human
ugccucuccggguuuuagucaaccuaacaccaaaccaaaauagaauguuagcuguucaagaa

SEQ ID NO: 172194 - RNA, 62 nt, Human
gcccauggaacacucugguccgccucauuuuaaaccaaaaaacugcuccuucacccucaccc

SEQ ID NO: 172195 - RNA, 62 nt, Human
gagcccgccuuuagaguuaaauauaauagaaaaaccaaaaugauauuuuuauuuuaggaggg

SEQ ID NO: 172196 - RNA, 62 nt, Human
caacacugggaaacagaggcuauuguccccuaaaccaaaaacugaaagugaaaguccagaaa

SEQ ID NO: 172197 - RNA, 62 nt, Human
cagagugggauggucaggaccugggccauugcaaccaaaauggggacuuccuggguagggag

SEQ ID NO: 172198 - RNA, 62 nt, Human
ccuucacaguguccuuuauguaagaaugauauaaccaaaaggagccuacaagaaaguacgag

SEQ ID NO: 172199 - RNA, 62 nt, Human
uuuuuaucuuugaccaaccgaacaugaccaaaaaccaaaagugcauucaaccuuaccaaaaa

SEQ ID NO: 172200 - RNA, 62 nt, Human
gcaagauauuuuaucucuguacauaaaguagaaaccaaaagcuagggaaacagauacucuuu

SEQ ID NO: 172201 - RNA, 62 nt, Human
uuuuuucaucuuaauauguaccaguggcacuuaaccaaaagauacagugauauagccaugua

SEQ ID NO: 172202 - RNA, 62 nt, Human
caacaucugcuaucacuuaucuuuuuaaaacuaaccaaaaaaggccgggugcaguggauccc

SEQ ID NO: 172203 - RNA, 62 nt, Human
agcacuguuuacaauagcaaagacuuggaaccaaccaaaauacccacaaaugauagaccgga

SEQ ID NO: 172204 - RNA, 62 nt, Human
cuuuugaggccaggguuggccagauuuagcaaaaccaaaacagagugcugaguuaaacgcaa

SEQ ID NO: 172205 - RNA, 62 nt, Human
gagcaccuuucucaaggacaagaaaugguagcaaccaaaagguugguugaaggaaacaaucc

SEQ ID NO: 172206 - RNA, 62 nt, Human
agucagcauuuuccuugagcuaaauaccuaauaaccaaaacugugaggaagguuaucgggac

SEQ ID NO: 172207 - RNA, 62 nt, Human
aacuauuuuaacccuugaguggcuucuuuuuaaaccaaaaaccgucuuucuuugcuuuuuua

SEQ ID NO: 172208 - RNA, 62 nt, Human
uguccuuagaagaaagggcauuuuuacuuuugaaccaaaaagagaaaaaaaaaucagaagug

SEQ ID NO: 172209 - RNA, 62 nt, Human
aauucagagaaaauaugugaaguuuacaaaggaaccaaaaugauaaugggagaauuuagucu

SEQ ID NO: 172210 - RNA, 62 nt, Human
ugguaaaaaaugugaaauugggauuagggaccaaccaaaauauuucauuaaugcuuucaauu

SEQ ID NO: 172211 - RNA, 62 nt, Human
augauuacucacagcgaucuauuguuccauauaaccaaaaagcaugguuuauucauugaaac

SEQ ID NO: 172212 - RNA, 62 nt, Human
aaacaaaguaguauguacaugaaauugcacuuaaccaaaacuauuguguaaaacaaauuuua

SEQ ID NO: 172213 - RNA, 62 nt, Human
aucauacgaauuggaucaaucuugaaauacucaaccaaaagacagucgagaagccaggggga

SEQ ID NO: 172214 - RNA, 62 nt, Human
ucaggauagcaugagauagucucaauguggccaaccaaaaggacaaaacugacaggaaugca

SEQ ID NO: 172215 - RNA, 62 nt, Human
aacacuucgagcuauuuagcuaaagcccaccaaaccaaaacaaaauacugauuuuuuuuuuu

SEQ ID NO: 172216 - RNA, 62 nt, Human
gguagauucuugaccuuaaauuuaacaacaacaaccaaaaucagauuuuuuuugugagucuu

SEQ ID NO: 172217 - RNA, 62 nt, Human
cagauguuaauuuguucuuuguguaacaauguaaccaaaauauugaugauaaaagucauaau

SEQ ID NO: 172218 - RNA, 62 nt, Human
agggguggggccguggcugaagccggcuccccaaccaaaaugcugcaccaaagcucgggcgc

SEQ ID NO: 172219 - RNA, 62 nt, Human
ugagcaacaaagcgagaucccaucucuacaaaaaccaaaaaguuaaaaaucagcuggguacg

SEQ ID NO: 172220 - RNA, 62 nt, Human
ggcuaaugagaaccccugguucucagaauuuuaaccaaaaggaguuggcuccaaccaauggg

SEQ ID NO: 172221 - RNA, 62 nt, Human
gggacaccaaaaaagaaaaaaaaaaaaacccaaaccaaaaacgcaaaccaaagcaggcaggc

SEQ ID NO: 172222 - RNA, 62 nt, Human
ucugggguugaggugauaaucaauagcuuaccaaccaaaaagaguccaggaccagauggauu

SEQ ID NO: 172223 - RNA, 62 nt, Human
aucuuccuguuaccaaagcugggcagagacaaaaccaaaaaagagaauuuuagaccaauauc

SEQ ID NO: 172224 - RNA, 62 nt, Human
aauugaaaaacacuacuuuaaaguucauauggaaccaaaaaagagcccacauugccaaguca

SEQ ID NO: 172225 - RNA, 62 nt, Human
accugacuucaaacuaugcuacaaggcuacauaaccaaaauagcaugguacugguaccaaaa

SEQ ID NO: 172226 - RNA, 62 nt, Human
ugucuggccucacgugucucagauuuucuaagaaccaaaaaaaaaaaaggaaaaaaaacaca

SEQ ID NO: 172227 - RNA, 62 nt, Human
aaaaaaaaggaaaaaaaacacaaaacaacaaaaaccaaaaaaaaaaaaaaucacaaaaacaa

SEQ ID NO: 172228 - RNA, 62 nt, Human
gagcacugagcaccauuuggaagcuugagagaaaccaaaauuaaagagagaaagagagagcg

SEQ ID NO: 172229 - RNA, 62 nt, Human
gucuguuggccuggaaauuggaaaaccaguuaaaccaaaaacaugauauuaagaaaacaggc

SEQ ID NO: 172230 - RNA, 62 nt, Human
ugaaagcaguauggcagucauaaaaauuuuggaaccaaaacaguaucuuuuuuuaagcuaaa

SEQ ID NO: 172231 - RNA, 62 nt, Human
ucaccucaacaauuuucuagaggucaauuuggaaccaaaaaugaaauaagacauguagcuaa

SEQ ID NO: 172232 - RNA, 62 nt, Human
cuuaucagugcagugaauguggaagagucuuuaaccaaaauucucaucucauucagcaccag

SEQ ID NO: 172233 - RNA, 51 nt, Human
ucacagccggacucgccuaaaaaccaaaaagagaaaacagaaacccgagaa

SEQ ID NO: 172234 - RNA, 62 nt, Human
gaaaaguacuuacuucuugccaguuaucuauuaaccaaaaccuuugauuuguaguuuuaaag

SEQ ID NO: 172235 - RNA, 62 nt, Human
ccaucuccauccucugggcaccuuuuuauaagaaccaaaacauuacagagcauugcuuuguc

SEQ ID NO: 172236 - RNA, 62 nt, Human
cucccuacaaauacgaauccuucuaucccacuaaccaaaauaccuccuucauuauaaaauuu

SEQ ID NO: 172237 - RNA, 62 nt, Human
guuugucuuuucuguuuuuuaaaugaucaugaaaccaaaaagagacugaucauccaggccuc

SEQ ID NO: 172238 - RNA, 62 nt, Human
cuggacaauguuucuuugcaaagcaacacucgaaccaaaagaugccucaaucccauuuugau

SEQ ID NO: 172239 - RNA, 62 nt, Human
ugaaauuucaauaauaaaauguuuaaaaucaaaaccaaaauuauagacuauguagaaaugaa

SEQ ID NO: 172240 - RNA, 62 nt, Human
agaauucuugcccuccccucucuucuccucccaaccaaaacccuccgauccagccccaggcc

SEQ ID NO: 172241 - RNA, 62 nt, Human
ccucaugccugagaugugggccacucagagcuaaccaaaauguucaacaccauaacuagaga

SEQ ID NO: 172242 - RNA, 62 nt, Human
ggugaaaaacaaacaaaaaaaaaccaaaaacaaaccaaaaaaaaaaaaaacccacaaaauca

SEQ ID NO: 172243 - RNA, 62 nt, Human
aaggaaccagaggugaaaaacaaacaaaaaaaaaccaaaaacaaaccaaaaaaaaaaaaaac

SEQ ID NO: 172244 - RNA, 62 nt, Human
aaaaaggaaagaaacuaaccaacaaaagagaaaaccaaaaauaaucacaacagaaaccagcu

SEQ ID NO: 172245 - RNA, 62 nt, Human
gugacaagggaggaaagaccaaaaaaacaaccaaccaaaaaaaaaaaaaaaaaggaaagaaa

SEQ ID NO: 172246 - RNA, 62 nt, Human
acagcaggggagggagggacaauuuuauaaugaaccaaaaauuccauguguugggggguggg

SEQ ID NO: 172247 - RNA, 62 nt, Human
caccaagaucaauguauacaauaugucuauuaaaccaaaaaguuuucuugugcccauuucca

SEQ ID NO: 172248 - RNA, 62 nt, Human
agccugggcaacagagcaagacaccgucuuaaaaccaaaaguuaaccgggcguggugguggg

SEQ ID NO: 172249 - RNA, 62 nt, Human
cggugaaaccccaucucuacuaaaaauacaaaaaccaaaaaaaauuagccaggcgcauuggc

SEQ ID NO: 172250 - RNA, 62 nt, Human
ucucccuagcuuagcauaaugucuggggaaacaaccaaaaucgcaauuuuaacaauaugccu

SEQ ID NO: 172251 - RNA, 60 nt, Human
guauguugcuuuucuaaauaaauguauugugaaaccaaaacagcugcuguuaauauggau

SEQ ID NO: 172252 - RNA, 62 nt, Human
uugauaaaccaaucaaauugguaaagaccuaaaaccaaaacaaauaaagaaacacaaaaccc

SEQ ID NO: 172253 - RNA, 62 nt, Human
gacugaaagugaaauauagauauuuuaaggaaaaccaaaauaugugaguguuaauaaagaaa

SEQ ID NO: 172254 - RNA, 62 nt, Human
ugacacguacugacuucuaucugagaagaacaaaccaaaacacucaggccuaaauaauuaaa

SEQ ID NO: 172255 - RNA, 62 nt, Human
uagucuuuguuuuggaauuggaccauucuugcaaccaaaaggacuuagagcaguuugcucau

SEQ ID NO: 172256 - RNA, 62 nt, Human
uuccaacucuggagugucuguaguucuugugaaaccaaaacguugacuaccugccucuuucc

SEQ ID NO: 172257 - RNA, 62 nt, Human
gaaaagaaaaauuuaugcacugauuuaaaacaaaccaaaaaaaaagaaaaaaacaaaaaaaa

SEQ ID NO: 172258 - RNA, 62 nt, Human
auauccuuuagcuaacuuuccuguaacugucaaaccaaaaugucaguauuuuuagggcauug

SEQ ID NO: 172259 - RNA, 62 nt, Human
uuuaaaauuuuugcacugcauuuucuacuguaaaccaaaagagguuacuaagcaaaaccacc

SEQ ID NO: 172260 - RNA, 62 nt, Human
aucuacuuacagugguguaauuaaaguuauuuaaccaaaaauagguauguguccaucucagc

SEQ ID NO: 172261 - RNA, 62 nt, Human
caauggacuuuaaugaaaaaaaaaauaaaaacaaccaaaaaaauugaaggaauaucaccagc

SEQ ID NO: 172262 - RNA, 62 nt, Human
aauguuuaacaauggacuuucugaaagggaaaaaccaaaagcuguuuugcagugcuugccaa

SEQ ID NO: 172263 - RNA, 62 nt, Human
cucuuuaaagaaaccaccaccaacaacaaaacaaccaaaaaccauguuuuaugucaaagcuc

SEQ ID NO: 172264 - RNA, 62 nt, Human
ugauggugauggugugcacguuucauuaauccaaccaaaaauaaugaaauaaaauuugagcc

SEQ ID NO: 172265 - RNA, 62 nt, Human
auaccuaaaggagauucagagcuaucgcucaaaaccaaaagucuugguuuuuaaaugugcuu

SEQ ID NO: 172266 - RNA, 62 nt, Human
guccuaaucuauggguacauuguugugucccaaaccaaaauuuuccuuauccacaauguccc

SEQ ID NO: 172267 - RNA, 62 nt, Human
cuucugccuuccaggagaggucuugcuuuugaaaccaaaaucauguucuucuaaagugucau

SEQ ID NO: 172268 - RNA, 62 nt, Human
gagcuggguugcacaggaagaaugucacagggaaccaaaaagcacagaaaaaggaagugcug

SEQ ID NO: 172269 - RNA, 62 nt, Human
cuaccauaaugcuuuuaauuaguucuaaauucaaccaaaaaauguuuuacucuuauaaaaag

SEQ ID NO: 172270 - RNA, 62 nt, Human
cuucuaggaagagucagauuuauagcauuuucaaccaaaauaauggugagugccuaggcuuc

SEQ ID NO: 172271 - RNA, 62 nt, Human
acuccagccugagugacagagugagacuuugcaaccaaaaaauaaaauaauaauaauaauga

SEQ ID NO: 172272 - RNA, 62 nt, Human
agaaaaauaauuaaaaaaaaaacuucauucuaaaccaaaacagaguggauugggcugcaggc

SEQ ID NO: 172273 - RNA, 62 nt, Human
ugcauuagauaggauccucacaucccauucagaaccaaaacugauacagugaaacaauuaag

SEQ ID NO: 172274 - RNA, 62 nt, Human
acagcgcccucaucuuuuuagcaagguaaaaaaaccaaaauggguguuaucucugauaucuu

SEQ ID NO: 172275 - RNA, 62 nt, Human
gcagaccuuuaccccuagucuaugaaaaaacaaaccaaaauaugcucuugcgcccaggccag

SEQ ID NO: 172276 - RNA, 62 nt, Human
caagaucuccugguuuccauuguaagggauuuaaccaaaaucuugcucuuccauaaucuuac

SEQ ID NO: 172277 - RNA, 62 nt, Human
uuuuuuucuuuuuuaguaaaaaccuguauaaaaaccaaaauuauaggauuuuuuuuucuucu

SEQ ID NO: 172278 - RNA, 62 nt, Human
auuuuuucuuuuuuaguaaaaaccuauaugaaaaccaaaauuauaggauuuuuuucuuuuuu

SEQ ID NO: 172279 - RNA, 62 nt, Human
uuuuuuucuuuuuuaguaaaaaccuauauaaaaaccaaaauuauaggauuuuuucuuuuuua

SEQ ID NO: 172280 - RNA, 62 nt, Human
auuuuuucuuuuuuaguaaaaaccgguaucaaaaccaaaauuauaggauuuuuuucuuuuuu

SEQ ID NO: 172281 - RNA, 62 nt, Human
uagagccacuggugaguaaaaaccuauauaaaaaccaaaauuauaggauuuuuucuuuuuua

SEQ ID NO: 172282 - RNA, 62 nt, Human
gcaaggaauauaagauuucaaauaaaauuuugaaccaaaaacauuuauaaugccguucuggu

SEQ ID NO: 172283 - RNA, 62 nt, Human
ccuggcguugguacacaggcaaggauuggcacaaccaaaauuggccuuuuucucccucuuaa

SEQ ID NO: 172284 - RNA, 62 nt, Human
cuucaccugaauucuucaaugccaggguaauaaaccaaaauaguccuaaucaguauaugcua

SEQ ID NO: 172285 - RNA, 62 nt, Human
ccucuguuuuucuuuuugauuuuuguuuuuuaaaccaaaacagacaauagcuuauuuucuuu

SEQ ID NO: 172286 - RNA, 62 nt, Human
agcaagcuggcgaacagcccuggcugcuccaaaaccaaaaagcuggguccucuggaggaggg

SEQ ID NO: 172287 - RNA, 62 nt, Human
auugggaauacagagaaacaggauuguuugagaaccaaaaucaagaggaacagaaaucuuaa

SEQ ID NO: 172288 - RNA, 62 nt, Human
cagcggcgggcagucugcccaagugucuuaggaaccaaaagcaaauaaaaguguuuccauau

SEQ ID NO: 172289 - RNA, 62 nt, Human
auuuucucacugcguugggcauugguggggacaaccaaaacaggucugcagagcaaaggcag

SEQ ID NO: 172290 - RNA, 62 nt, Human
acccuuugauucugguucaucucgauacagagaaccaaaacagcuaagagagguauuaucag

SEQ ID NO: 172291 - RNA, 58 nt, Human
aagggaaaccacagcuuuaaacgaagacaaccaaaagaaugcaaacuggauuuauccg

SEQ ID NO: 172292 - RNA, 62 nt, Human
auauuacaguagaaucugaguguaauauguguaaccaaaaugagaaagaauacaagaaaugu

SEQ ID NO: 172293 - RNA, 62 nt, Human
uaaaucuacagcuagacccuuagucaauaguuaaccaaaaaauugcaauuuguuuaauucag

SEQ ID NO: 172294 - RNA, 62 nt, Human
uauaaucuaguuggagagauaagaaacguacaaaccaaaagauaacagaauaucugaagcau

SEQ ID NO: 172295 - RNA, 62 nt, Human
uagugggaaaauaauuuucaaacuaccugguuaaccaaaauacaaaagcagcugacuaugug

SEQ ID NO: 172296 - RNA, 62 nt, Human
agcuagauaugccagcuuuguuucuacauugcaaccaaaaacuguuucuuuucacuuaauua

SEQ ID NO: 172297 - RNA, 62 nt, Human
auuucuuaaccuaggcuucagggagcauaugaaaccaaaauuauauggaacauuuucugugu

SEQ ID NO: 172298 - RNA, 62 nt, Human
gaacuguaauaagugaauuacaggucacaugaaaccaaaacgggcccugcuccauaagagcu

SEQ ID NO: 172299 - RNA, 62 nt, Human
cauuccaucuucccgaucuucuuugcuucuccaaccaaaacaucaauguuuauuaguucugu

SEQ ID NO: 172300 - RNA, 62 nt, Human
cuuucaagggaaauuuuaaucuaaaaggaaaaaaccaaaauauugaugagaaggaguccucc

SEQ ID NO: 172301 - RNA, 62 nt, Human
gaugccaguugcacccucccccaaguugagacaaccaaaaaugucuccagauauugccagcu

SEQ ID NO: 172302 - RNA, 62 nt, Human
aaccuuugauuuugguuaaccuuuauaucuagaaccaaaacagcuaaaucccaaaggggaaa

SEQ ID NO: 172303 - RNA, 62 nt, Human
aucauucuaaagauagaguaaaaagaaaacaaaaccaaaaguuauuaaaauuguuguccggu

SEQ ID NO: 172304 - RNA, 62 nt, Human
acaaaacaaacaaacaaacaaaacuugcaucuaaccaaaaagucuugguuuuaucuuaaucc

SEQ ID NO: 172305 - RNA, 62 nt, Human
caugguuuguggcuuuuugcaaaauuacuaugaaccaaaaguugacaaauguuccaaaguua

SEQ ID NO: 172306 - RNA, 62 nt, Human
auuugaacaugcuucuaaauaaaauaaaacaaaaccaaaacuauacuuuugaucuauaauaa

SEQ ID NO: 172307 - RNA, 62 nt, Human
ggcaugggcuggacaguugcuugaaaugaccuaaccaaaaacauucaaggguucugccccca

SEQ ID NO: 172308 - RNA, 62 nt, Human
ucucauuuguaucuucugauauucuuuauacaaaccaaaaguccccuucaacauuuuuuaug

SEQ ID NO: 172309 - RNA, 62 nt, Human
agaaaaaaaacaaacaaacaaacagaaaaaaaaaccaaaaaaaaccacccugaguuucucug

SEQ ID NO: 172310 - RNA, 62 nt, Human; identical to SEQ ID NO: 172293

SEQ ID NO: 172311 - RNA, 64 nt, Human; identical to SEQ ID NO: 130024

SEQ ID NO: 172312 - RNA, 64 nt, Human; identical to SEQ ID NO: 130025

SEQ ID NO: 172313 - RNA, 64 nt, Human; identical to SEQ ID NO: 130026

SEQ ID NO: 172314 - RNA, 64 nt, Human; identical to SEQ ID NO: 130027

SEQ ID NO: 172315 - RNA, 64 nt, Human; identical to SEQ ID NO: 130028

SEQ ID NO: 172316 - RNA, 64 nt, Human; identical to SEQ ID NO: 130029

SEQ ID NO: 172317 - RNA, 64 nt, Human; identical to SEQ ID NO: 130030

SEQ ID NO: 172318 - RNA, 64 nt, Human; identical to SEQ ID NO: 130031

SEQ ID NO: 172319 - RNA, 64 nt, Human; identical to SEQ ID NO: 130032

SEQ ID NO: 172320 - RNA, 64 nt, Human; identical to SEQ ID NO: 130033

SEQ ID NO: 172321 - RNA, 64 nt, Human; identical to SEQ ID NO: 130034

SEQ ID NO: 172322 - RNA, 64 nt, Human; identical to SEQ ID NO: 130035

SEQ ID NO: 172323 - RNA, 64 nt, Human; identical to SEQ ID NO: 130036

SEQ ID NO: 172324 - RNA, 64 nt, Human; identical to SEQ ID NO: 130037

SEQ ID NO: 172325 - RNA, 64 nt, Human; identical to SEQ ID NO: 130038

SEQ ID NO: 172326 - RNA, 64 nt, Human; identical to SEQ ID NO: 130039

SEQ ID NO: 172327 - RNA, 64 nt, Human; identical to SEQ ID NO: 130040

SEQ ID NO: 172328 - RNA, 64 nt, Human; identical to SEQ ID NO: 130041

SEQ ID NO: 172329 - RNA, 64 nt, Human; identical to SEQ ID NO: 130042

SEQ ID NO: 172330 - RNA, 64 nt, Human; identical to SEQ ID NO: 130043

SEQ ID NO: 172331 - RNA, 56 nt, Human; identical to SEQ ID NO: 130044

SEQ ID NO: 172332 - RNA, 61 nt, Human; identical to SEQ ID NO: 84788

SEQ ID NO: 172333 - RNA, 64 nt, Human; identical to SEQ ID NO: 130045

SEQ ID NO: 172334 - RNA, 64 nt, Human; identical to SEQ ID NO: 130046

SEQ ID NO: 172335 - RNA, 64 nt, Human; identical to SEQ ID NO: 130047

SEQ ID NO: 172336 - RNA, 64 nt, Human; identical to SEQ ID NO: 130048

SEQ ID NO: 172337 - RNA, 64 nt, Human; identical to SEQ ID NO: 130049

SEQ ID NO: 172338 - RNA, 64 nt, Human; identical to SEQ ID NO: 130050

SEQ ID NO: 172339 - RNA, 64 nt, Human; identical to SEQ ID NO: 130051

SEQ ID NO: 172340 - RNA, 64 nt, Human; identical to SEQ ID NO: 130052

SEQ ID NO: 172341 - RNA, 64 nt, Human; identical to SEQ ID NO: 130053

SEQ ID NO: 172342 - RNA, 64 nt, Human; identical to SEQ ID NO: 130054

SEQ ID NO: 172343 - RNA, 64 nt, Human; identical to SEQ ID NO: 130055

SEQ ID NO: 172344 - RNA, 64 nt, Human; identical to SEQ ID NO: 130056

SEQ ID NO: 172345 - RNA, 64 nt, Human; identical to SEQ ID NO: 130057

SEQ ID NO: 172346 - RNA, 64 nt, Human; identical to SEQ ID NO: 130058

SEQ ID NO: 172347 - RNA, 64 nt, Human; identical to SEQ ID NO: 130059

SEQ ID NO: 172348 - RNA, 64 nt, Human; identical to SEQ ID NO: 130060

SEQ ID NO: 172349 - RNA, 64 nt, Human; identical to SEQ ID NO: 130061

SEQ ID NO: 172350 - RNA, 64 nt, Human; identical to SEQ ID NO: 130062

SEQ ID NO: 172351 - RNA, 64 nt, Human; identical to SEQ ID NO: 130063

SEQ ID NO: 172352 - RNA, 64 nt, Human; identical to SEQ ID NO: 130064

SEQ ID NO: 172353 - RNA, 64 nt, Human; identical to SEQ ID NO: 130065

SEQ ID NO: 172354 - RNA, 64 nt, Human; identical to SEQ ID NO: 130066

SEQ ID NO: 172355 - RNA, 64 nt, Human; identical to SEQ ID NO: 130067

SEQ ID NO: 172356 - RNA, 64 nt, Human; identical to SEQ ID NO: 130068

SEQ ID NO: 172357 - RNA, 51 nt, Human; identical to SEQ ID NO: 130069

SEQ ID NO: 172358 - RNA, 64 nt, Human; identical to SEQ ID NO: 130070

SEQ ID NO: 172359 - RNA, 64 nt, Human; identical to SEQ ID NO: 130071

SEQ ID NO: 172360 - RNA, 64 nt, Human; identical to SEQ ID NO: 130072

SEQ ID NO: 172361 - RNA, 64 nt, Human; identical to SEQ ID NO: 130073

SEQ ID NO: 172362 - RNA, 64 nt, Human; identical to SEQ ID NO: 130074

SEQ ID NO: 172363 - RNA, 64 nt, Human; identical to SEQ ID NO: 130075

SEQ ID NO: 172364 - RNA, 64 nt, Human; identical to SEQ ID NO: 130076

SEQ ID NO: 172365 - RNA, 64 nt, Human; identical to SEQ ID NO: 130077

SEQ ID NO: 172366 - RNA, 64 nt, Human; identical to SEQ ID NO: 130078

SEQ ID NO: 172367 - RNA, 64 nt, Human; identical to SEQ ID NO: 84840

SEQ ID NO: 172368 - RNA, 64 nt, Human; identical to SEQ ID NO: 130079

SEQ ID NO: 172369 - RNA, 64 nt, Human; identical to SEQ ID NO: 130080

SEQ ID NO: 172370 - RNA, 64 nt, Human; identical to SEQ ID NO: 130081

SEQ ID NO: 172371 - RNA, 64 nt, Human; identical to SEQ ID NO: 130082

SEQ ID NO: 172372 - RNA, 64 nt, Human; identical to SEQ ID NO: 130083

SEQ ID NO: 172373 - RNA, 64 nt, Human; identical to SEQ ID NO: 130084

SEQ ID NO: 172374 - RNA, 64 nt, Human; identical to SEQ ID NO: 130085

SEQ ID NO: 172375 - RNA, 64 nt, Human; identical to SEQ ID NO: 130086

SEQ ID NO: 172376 - RNA, 64 nt, Human; identical to SEQ ID NO: 130087

SEQ ID NO: 172377 - RNA, 64 nt, Human; identical to SEQ ID NO: 130088

SEQ ID NO: 172378 - RNA, 64 nt, Human; identical to SEQ ID NO: 130089

SEQ ID NO: 172379 - RNA, 64 nt, Human; identical to SEQ ID NO: 130090

SEQ ID NO: 172380 - RNA, 64 nt, Human; identical to SEQ ID NO: 130091

SEQ ID NO: 172381 - RNA, 64 nt, Human; identical to SEQ ID NO: 130092

SEQ ID NO: 172382 - RNA, 64 nt, Human; identical to SEQ ID NO: 130093

SEQ ID NO: 172383 - RNA, 64 nt, Human; identical to SEQ ID NO: 130094

SEQ ID NO: 172384 - RNA, 64 nt, Human; identical to SEQ ID NO: 130095

SEQ ID NO: 172385 - RNA, 64 nt, Human; identical to SEQ ID NO: 84791

SEQ ID NO: 172386 - RNA, 64 nt, Human; identical to SEQ ID NO: 130096

SEQ ID NO: 172387 - RNA, 64 nt, Human; identical to SEQ ID NO: 130097

SEQ ID NO: 172388 - RNA, 64 nt, Human; identical to SEQ ID NO: 130098

SEQ ID NO: 172389 - RNA, 64 nt, Human; identical to SEQ ID NO: 130099

SEQ ID NO: 172390 - RNA, 64 nt, Human; identical to SEQ ID NO: 130100

SEQ ID NO: 172391 - RNA, 64 nt, Human; identical to SEQ ID NO: 130101

SEQ ID NO: 172392 - RNA, 64 nt, Human; identical to SEQ ID NO: 130102

SEQ ID NO: 172393 - RNA, 64 nt, Human; identical to SEQ ID NO: 130103

SEQ ID NO: 172394 - RNA, 64 nt, Human; identical to SEQ ID NO: 130104

SEQ ID NO: 172395 - RNA, 64 nt, Human; identical to SEQ ID NO: 130105

SEQ ID NO: 172396 - RNA, 64 nt, Human; identical to SEQ ID NO: 130106

SEQ ID NO: 172397 - RNA, 64 nt, Human; identical to SEQ ID NO: 130107

SEQ ID NO: 172398 - RNA, 64 nt, Human; identical to SEQ ID NO: 130108

SEQ ID NO: 172399 - RNA, 64 nt, Human; identical to SEQ ID NO: 130109

SEQ ID NO: 172400 - RNA, 64 nt, Human; identical to SEQ ID NO: 130110

SEQ ID NO: 172401 - RNA, 64 nt, Human; identical to SEQ ID NO: 130111

SEQ ID NO: 172402 - RNA, 64 nt, Human; identical to SEQ ID NO: 130112

SEQ ID NO: 172403 - RNA, 64 nt, Human; identical to SEQ ID NO: 84821

SEQ ID NO: 172404 - RNA, 64 nt, Human; identical to SEQ ID NO: 130113

SEQ ID NO: 172405 - RNA, 64 nt, Human; identical to SEQ ID NO: 130114

SEQ ID NO: 172406 - RNA, 64 nt, Human; identical to SEQ ID NO: 130115

SEQ ID NO: 172407 - RNA, 64 nt, Human; identical to SEQ ID NO: 130116

SEQ ID NO: 172408 - RNA, 64 nt, Human; identical to SEQ ID NO: 130117

SEQ ID NO: 172409 - RNA, 64 nt, Human; identical to SEQ ID NO: 130118

SEQ ID NO: 172410 - RNA, 64 nt, Human; identical to SEQ ID NO: 130119

SEQ ID NO: 172411 - RNA, 64 nt, Human; identical to SEQ ID NO: 130120

SEQ ID NO: 172412 - RNA, 64 nt, Human; identical to SEQ ID NO: 130121

SEQ ID NO: 172413 - RNA, 64 nt, Human; identical to SEQ ID NO: 130122

SEQ ID NO: 172414 - RNA, 64 nt, Human; identical to SEQ ID NO: 130123

SEQ ID NO: 172415 - RNA, 64 nt, Human; identical to SEQ ID NO: 130124

SEQ ID NO: 172416 - RNA, 64 nt, Human; identical to SEQ ID NO: 130125

SEQ ID NO: 172417 - RNA, 64 nt, Human; identical to SEQ ID NO: 130126

SEQ ID NO: 172418 - RNA, 64 nt, Human; identical to SEQ ID NO: 130127

SEQ ID NO: 172419 - RNA, 64 nt, Human; identical to SEQ ID NO: 130128

SEQ ID NO: 172420 - RNA, 64 nt, Human; identical to SEQ ID NO: 130129

SEQ ID NO: 172421 - RNA, 64 nt, Human; identical to SEQ ID NO: 84794

SEQ ID NO: 172422 - RNA, 64 nt, Human; identical to SEQ ID NO: 130130

SEQ ID NO: 172423 - RNA, 64 nt, Human; identical to SEQ ID NO: 130131

SEQ ID NO: 172424 - RNA, 64 nt, Human; identical to SEQ ID NO: 130132

SEQ ID NO: 172425 - RNA, 64 nt, Human; identical to SEQ ID NO: 130133

SEQ ID NO: 172426 - RNA, 64 nt, Human; identical to SEQ ID NO: 130134

SEQ ID NO: 172427 - RNA, 64 nt, Human; identical to SEQ ID NO: 130135

SEQ ID NO: 172428 - RNA, 64 nt, Human; identical to SEQ ID NO: 130136

SEQ ID NO: 172429 - RNA, 64 nt, Human; identical to SEQ ID NO: 130137

SEQ ID NO: 172430 - RNA, 64 nt, Human; identical to SEQ ID NO: 130138

SEQ ID NO: 172431 - RNA, 64 nt, Human; identical to SEQ ID NO: 130139

SEQ ID NO: 172432 - RNA, 64 nt, Human; identical to SEQ ID NO: 130140

SEQ ID NO: 172433 - RNA, 64 nt, Human; identical to SEQ ID NO: 130141

SEQ ID NO: 172434 - RNA, 64 nt, Human; identical to SEQ ID NO: 130142

SEQ ID NO: 172435 - RNA, 64 nt, Human; identical to SEQ ID NO: 130143

SEQ ID NO: 172436 - RNA, 64 nt, Human; identical to SEQ ID NO: 130144

SEQ ID NO: 172437 - RNA, 64 nt, Human; identical to SEQ ID NO: 130145

SEQ ID NO: 172438 - RNA, 64 nt, Human; identical to SEQ ID NO: 130146

SEQ ID NO: 172439 - RNA, 64 nt, Human; identical to SEQ ID NO: 84822

SEQ ID NO: 172440 - RNA, 64 nt, Human; identical to SEQ ID NO: 130147

SEQ ID NO: 172441 - RNA, 64 nt, Human; identical to SEQ ID NO: 130148

SEQ ID NO: 172442 - RNA, 64 nt, Human; identical to SEQ ID NO: 130149

SEQ ID NO: 172443 - RNA, 64 nt, Human; identical to SEQ ID NO: 130150

SEQ ID NO: 172444 - RNA, 64 nt, Human; identical to SEQ ID NO: 130151

SEQ ID NO: 172445 - RNA, 64 nt, Human; identical to SEQ ID NO: 130152

SEQ ID NO: 172446 - RNA, 64 nt, Human; identical to SEQ ID NO: 130153

SEQ ID NO: 172447 - RNA, 64 nt, Human; identical to SEQ ID NO: 130154

SEQ ID NO: 172448 - RNA, 64 nt, Human; identical to SEQ ID NO: 130155

SEQ ID NO: 172449 - RNA, 64 nt, Human; identical to SEQ ID NO: 130156

SEQ ID NO: 172450 - RNA, 64 nt, Human; identical to SEQ ID NO: 130157

SEQ ID NO: 172451 - RNA, 64 nt, Human; identical to SEQ ID NO: 130158

SEQ ID NO: 172452 - RNA, 64 nt, Human; identical to SEQ ID NO: 130159

SEQ ID NO: 172453 - RNA, 64 nt, Human; identical to SEQ ID NO: 130160

SEQ ID NO: 172454 - RNA, 64 nt, Human; identical to SEQ ID NO: 130161

SEQ ID NO: 172455 - RNA, 64 nt, Human; identical to SEQ ID NO: 130162

SEQ ID NO: 172456 - RNA, 64 nt, Human; identical to SEQ ID NO: 130163

SEQ ID NO: 172457 - RNA, 64 nt, Human; identical to SEQ ID NO: 84758

SEQ ID NO: 172458 - RNA, 64 nt, Human; identical to SEQ ID NO: 130164

SEQ ID NO: 172459 - RNA, 64 nt, Human; identical to SEQ ID NO: 130165

SEQ ID NO: 172460 - RNA, 64 nt, Human; identical to SEQ ID NO: 130166

SEQ ID NO: 172461 - RNA, 64 nt, Human; identical to SEQ ID NO: 130167

SEQ ID NO: 172462 - RNA, 64 nt, Human; identical to SEQ ID NO: 130168

SEQ ID NO: 172463 - RNA, 64 nt, Human; identical to SEQ ID NO: 130169

SEQ ID NO: 172464 - RNA, 64 nt, Human; identical to SEQ ID NO: 130170

SEQ ID NO: 172465 - RNA, 64 nt, Human; identical to SEQ ID NO: 130171

SEQ ID NO: 172466 - RNA, 64 nt, Human; identical to SEQ ID NO: 130172

SEQ ID NO: 172467 - RNA, 64 nt, Human; identical to SEQ ID NO: 130173

SEQ ID NO: 172468 - RNA, 64 nt, Human; identical to SEQ ID NO: 130174

SEQ ID NO: 172469 - RNA, 64 nt, Human; identical to SEQ ID NO: 130175

SEQ ID NO: 172470 - RNA, 64 nt, Human; identical to SEQ ID NO: 130176

SEQ ID NO: 172471 - RNA, 64 nt, Human; identical to SEQ ID NO: 130177

SEQ ID NO: 172472 - RNA, 64 nt, Human; identical to SEQ ID NO: 130178

SEQ ID NO: 172473 - RNA, 64 nt, Human; identical to SEQ ID NO: 130179

SEQ ID NO: 172474 - RNA, 64 nt, Human; identical to SEQ ID NO: 130180

SEQ ID NO: 172475 - RNA, 64 nt, Human; identical to SEQ ID NO: 84797

SEQ ID NO: 172476 - RNA, 64 nt, Human; identical to SEQ ID NO: 130181

SEQ ID NO: 172477 - RNA, 64 nt, Human; identical to SEQ ID NO: 130182

SEQ ID NO: 172478 - RNA, 64 nt, Human; identical to SEQ ID NO: 130183

SEQ ID NO: 172479 - RNA, 64 nt, Human; identical to SEQ ID NO: 130184

SEQ ID NO: 172480 - RNA, 64 nt, Human; identical to SEQ ID NO: 130185

SEQ ID NO: 172481 - RNA, 64 nt, Human; identical to SEQ ID NO: 130186

SEQ ID NO: 172482 - RNA, 64 nt, Human; identical to SEQ ID NO: 130187

SEQ ID NO: 172483 - RNA, 64 nt, Human; identical to SEQ ID NO: 130188

SEQ ID NO: 172484 - RNA, 64 nt, Human; identical to SEQ ID NO: 130189

SEQ ID NO: 172485 - RNA, 64 nt, Human; identical to SEQ ID NO: 130190

SEQ ID NO: 172486 - RNA, 64 nt, Human; identical to SEQ ID NO: 130191

SEQ ID NO: 172487 - RNA, 64 nt, Human; identical to SEQ ID NO: 130192

SEQ ID NO: 172488 - RNA, 64 nt, Human; identical to SEQ ID NO: 130193

SEQ ID NO: 172489 - RNA, 64 nt, Human; identical to SEQ ID NO: 130194

SEQ ID NO: 172490 - RNA, 64 nt, Human; identical to SEQ ID NO: 130195

SEQ ID NO: 172491 - RNA, 64 nt, Human; identical to SEQ ID NO: 130196

SEQ ID NO: 172492 - RNA, 64 nt, Human; identical to SEQ ID NO: 130197

SEQ ID NO: 172493 - RNA, 64 nt, Human; identical to SEQ ID NO: 130198

SEQ ID NO: 172494 - RNA, 64 nt, Human; identical to SEQ ID NO: 130199

SEQ ID NO: 172495 - RNA, 64 nt, Human; identical to SEQ ID NO: 130200

SEQ ID NO: 172496 - RNA, 64 nt, Human; identical to SEQ ID NO: 130201

SEQ ID NO: 172497 - RNA, 64 nt, Human; identical to SEQ ID NO: 130202

SEQ ID NO: 172498 - RNA, 64 nt, Human; identical to SEQ ID NO: 130203

SEQ ID NO: 172499 - RNA, 64 nt, Human; identical to SEQ ID NO: 130204

SEQ ID NO: 172500 - RNA, 64 nt, Human; identical to SEQ ID NO: 130205

SEQ ID NO: 172501 - RNA, 64 nt, Human; identical to SEQ ID NO: 130206

SEQ ID NO: 172502 - RNA, 64 nt, Human; identical to SEQ ID NO: 130207

SEQ ID NO: 172503 - RNA, 64 nt, Human; identical to SEQ ID NO: 130208

SEQ ID NO: 172504 - RNA, 64 nt, Human; identical to SEQ ID NO: 130209

SEQ ID NO: 172505 - RNA, 64 nt, Human; identical to SEQ ID NO: 130210

SEQ ID NO: 172506 - RNA, 64 nt, Human; identical to SEQ ID NO: 130211

SEQ ID NO: 172507 - RNA, 64 nt, Human; identical to SEQ ID NO: 130212

SEQ ID NO: 172508 - RNA, 64 nt, Human; identical to SEQ ID NO: 130213

SEQ ID NO: 172509 - RNA, 64 nt, Human; identical to SEQ ID NO: 130214

SEQ ID NO: 172510 - RNA, 64 nt, Human; identical to SEQ ID NO: 84762

SEQ ID NO: 172511 - RNA, 64 nt, Human; identical to SEQ ID NO: 130215

SEQ ID NO: 172512 - RNA, 64 nt, Human; identical to SEQ ID NO: 130216

SEQ ID NO: 172513 - RNA, 64 nt, Human; identical to SEQ ID NO: 130217

SEQ ID NO: 172514 - RNA, 64 nt, Human; identical to SEQ ID NO: 130218

SEQ ID NO: 172515 - RNA, 64 nt, Human; identical to SEQ ID NO: 130219

SEQ ID NO: 172516 - RNA, 64 nt, Human; identical to SEQ ID NO: 130220

SEQ ID NO: 172517 - RNA, 64 nt, Human; identical to SEQ ID NO: 130221

SEQ ID NO: 172518 - RNA, 64 nt, Human; identical to SEQ ID NO: 130222

SEQ ID NO: 172519 - RNA, 64 nt, Human; identical to SEQ ID NO: 130223

SEQ ID NO: 172520 - RNA, 64 nt, Human; identical to SEQ ID NO: 130224

SEQ ID NO: 172521 - RNA, 64 nt, Human; identical to SEQ ID NO: 130225

SEQ ID NO: 172522 - RNA, 64 nt, Human; identical to SEQ ID NO: 130226

SEQ ID NO: 172523 - RNA, 64 nt, Human; identical to SEQ ID NO: 130227

SEQ ID NO: 172524 - RNA, 64 nt, Human; identical to SEQ ID NO: 130228

SEQ ID NO: 172525 - RNA, 64 nt, Human; identical to SEQ ID NO: 130229

SEQ ID NO: 172526 - RNA, 64 nt, Human; identical to SEQ ID NO: 130230

SEQ ID NO: 172527 - RNA, 64 nt, Human; identical to SEQ ID NO: 130231

SEQ ID NO: 172528 - RNA, 64 nt, Human; identical to SEQ ID NO: 130232

SEQ ID NO: 172529 - RNA, 64 nt, Human; identical to SEQ ID NO: 130233

SEQ ID NO: 172530 - RNA, 64 nt, Human; identical to SEQ ID NO: 130234

SEQ ID NO: 172531 - RNA, 64 nt, Human; identical to SEQ ID NO: 130235

SEQ ID NO: 172532 - RNA, 64 nt, Human; identical to SEQ ID NO: 130236

SEQ ID NO: 172533 - RNA, 64 nt, Human; identical to SEQ ID NO: 130237

SEQ ID NO: 172534 - RNA, 64 nt, Human; identical to SEQ ID NO: 130238

SEQ ID NO: 172535 - RNA, 64 nt, Human; identical to SEQ ID NO: 130239

SEQ ID NO: 172536 - RNA, 64 nt, Human; identical to SEQ ID NO: 130240

SEQ ID NO: 172537 - RNA, 64 nt, Human; identical to SEQ ID NO: 130241

SEQ ID NO: 172538 - RNA, 64 nt, Human; identical to SEQ ID NO: 130242

SEQ ID NO: 172539 - RNA, 64 nt, Human; identical to SEQ ID NO: 130243

SEQ ID NO: 172540 - RNA, 64 nt, Human; identical to SEQ ID NO: 130244

SEQ ID NO: 172541 - RNA, 64 nt, Human; identical to SEQ ID NO: 130245

SEQ ID NO: 172542 - RNA, 64 nt, Human; identical to SEQ ID NO: 130246

SEQ ID NO: 172543 - RNA, 64 nt, Human; identical to SEQ ID NO: 130247

SEQ ID NO: 172544 - RNA, 64 nt, Human; identical to SEQ ID NO: 130248

SEQ ID NO: 172545 - RNA, 64 nt, Human; identical to SEQ ID NO: 130249

SEQ ID NO: 172546 - RNA, 64 nt, Human; identical to SEQ ID NO: 130250

SEQ ID NO: 172547 - RNA, 64 nt, Human; identical to SEQ ID NO: 130251

SEQ ID NO: 172548 - RNA, 64 nt, Human; identical to SEQ ID NO: 130252

SEQ ID NO: 172549 - RNA, 64 nt, Human; identical to SEQ ID NO: 130253

SEQ ID NO: 172550 - RNA, 64 nt, Human; identical to SEQ ID NO: 130254

SEQ ID NO: 172551 - RNA, 64 nt, Human; identical to SEQ ID NO: 130255

SEQ ID NO: 172552 - RNA, 64 nt, Human; identical to SEQ ID NO: 130256

SEQ ID NO: 172553 - RNA, 64 nt, Human; identical to SEQ ID NO: 130257

SEQ ID NO: 172554 - RNA, 64 nt, Human; identical to SEQ ID NO: 130258

SEQ ID NO: 172555 - RNA, 64 nt, Human; identical to SEQ ID NO: 130259

SEQ ID NO: 172556 - RNA, 64 nt, Human; identical to SEQ ID NO: 130260

SEQ ID NO: 172557 - RNA, 64 nt, Human; identical to SEQ ID NO: 130261

SEQ ID NO: 172558 - RNA, 64 nt, Human; identical to SEQ ID NO: 130262

SEQ ID NO: 172559 - RNA, 64 nt, Human; identical to SEQ ID NO: 130263

SEQ ID NO: 172560 - RNA, 64 nt, Human; identical to SEQ ID NO: 130264

SEQ ID NO: 172561 - RNA, 64 nt, Human; identical to SEQ ID NO: 130265

SEQ ID NO: 172562 - RNA, 64 nt, Human; identical to SEQ ID NO: 84857

SEQ ID NO: 172563 - RNA, 64 nt, Human; identical to SEQ ID NO: 130266

SEQ ID NO: 172564 - RNA, 64 nt, Human; identical to SEQ ID NO: 130267

SEQ ID NO: 172565 - RNA, 64 nt, Human; identical to SEQ ID NO: 130268

SEQ ID NO: 172566 - RNA, 64 nt, Human; identical to SEQ ID NO: 130269

SEQ ID NO: 172567 - RNA, 64 nt, Human; identical to SEQ ID NO: 130270

SEQ ID NO: 172568 - RNA, 64 nt, Human; identical to SEQ ID NO: 130271

SEQ ID NO: 172569 - RNA, 64 nt, Human; identical to SEQ ID NO: 130272

SEQ ID NO: 172570 - RNA, 64 nt, Human; identical to SEQ ID NO: 130273

SEQ ID NO: 172571 - RNA, 64 nt, Human; identical to SEQ ID NO: 130274

SEQ ID NO: 172572 - RNA, 64 nt, Human; identical to SEQ ID NO: 130275

SEQ ID NO: 172573 - RNA, 64 nt, Human; identical to SEQ ID NO: 130276

SEQ ID NO: 172574 - RNA, 64 nt, Human; identical to SEQ ID NO: 130277

SEQ ID NO: 172575 - RNA, 64 nt, Human; identical to SEQ ID NO: 130278

SEQ ID NO: 172576 - RNA, 64 nt, Human; identical to SEQ ID NO: 130279

SEQ ID NO: 172577 - RNA, 64 nt, Human; identical to SEQ ID NO: 130280

SEQ ID NO: 172578 - RNA, 64 nt, Human; identical to SEQ ID NO: 130281

SEQ ID NO: 172579 - RNA, 64 nt, Human; identical to SEQ ID NO: 130282

SEQ ID NO: 172580 - RNA, 64 nt, Human; identical to SEQ ID NO: 84766

SEQ ID NO: 172581 - RNA, 64 nt, Human; identical to SEQ ID NO: 130283

SEQ ID NO: 172582 - RNA, 64 nt, Human; identical to SEQ ID NO: 130284

SEQ ID NO: 172583 - RNA, 64 nt, Human; identical to SEQ ID NO: 130285

SEQ ID NO: 172584 - RNA, 64 nt, Human; identical to SEQ ID NO: 130286

SEQ ID NO: 172585 - RNA, 64 nt, Human; identical to SEQ ID NO: 130287

SEQ ID NO: 172586 - RNA, 64 nt, Human; identical to SEQ ID NO: 130288

SEQ ID NO: 172587 - RNA, 64 nt, Human; identical to SEQ ID NO: 130289

SEQ ID NO: 172588 - RNA, 64 nt, Human; identical to SEQ ID NO: 130290

SEQ ID NO: 172589 - RNA, 64 nt, Human; identical to SEQ ID NO: 130291

SEQ ID NO: 172590 - RNA, 64 nt, Human; identical to SEQ ID NO: 130292

SEQ ID NO: 172591 - RNA, 64 nt, Human; identical to SEQ ID NO: 130293

SEQ ID NO: 172592 - RNA, 64 nt, Human; identical to SEQ ID NO: 130294

SEQ ID NO: 172593 - RNA, 64 nt, Human; identical to SEQ ID NO: 130295

SEQ ID NO: 172594 - RNA, 64 nt, Human; identical to SEQ ID NO: 130296

SEQ ID NO: 172595 - RNA, 64 nt, Human; identical to SEQ ID NO: 130297

SEQ ID NO: 172596 - RNA, 64 nt, Human; identical to SEQ ID NO: 130298

SEQ ID NO: 172597 - RNA, 64 nt, Human; identical to SEQ ID NO: 130299

SEQ ID NO: 172598 - RNA, 64 nt, Human; identical to SEQ ID NO: 84800

SEQ ID NO: 172599 - RNA, 64 nt, Human; identical to SEQ ID NO: 130300

SEQ ID NO: 172600 - RNA, 64 nt, Human; identical to SEQ ID NO: 130301

SEQ ID NO: 172601 - RNA, 64 nt, Human; identical to SEQ ID NO: 130302

SEQ ID NO: 172602 - RNA, 64 nt, Human; identical to SEQ ID NO: 130303

SEQ ID NO: 172603 - RNA, 64 nt, Human; identical to SEQ ID NO: 130304

SEQ ID NO: 172604 - RNA, 64 nt, Human; identical to SEQ ID NO: 130305

SEQ ID NO: 172605 - RNA, 64 nt, Human; identical to SEQ ID NO: 130306

SEQ ID NO: 172606 - RNA, 64 nt, Human; identical to SEQ ID NO: 130307

SEQ ID NO: 172607 - RNA, 64 nt, Human; identical to SEQ ID NO: 130308

SEQ ID NO: 172608 - RNA, 64 nt, Human; identical to SEQ ID NO: 130309

SEQ ID NO: 172609 - RNA, 64 nt, Human; identical to SEQ ID NO: 130310

SEQ ID NO: 172610 - RNA, 64 nt, Human; identical to SEQ ID NO: 130311

SEQ ID NO: 172611 - RNA, 64 nt, Human; identical to SEQ ID NO: 130312

SEQ ID NO: 172612 - RNA, 64 nt, Human; identical to SEQ ID NO: 130313

SEQ ID NO: 172613 - RNA, 64 nt, Human; identical to SEQ ID NO: 130314

SEQ ID NO: 172614 - RNA, 64 nt, Human; identical to SEQ ID NO: 130315

SEQ ID NO: 172615 - RNA, 64 nt, Human; identical to SEQ ID NO: 130316

SEQ ID NO: 172616 - RNA, 64 nt, Human; identical to SEQ ID NO: 84770

SEQ ID NO: 172617 - RNA, 64 nt, Human; identical to SEQ ID NO: 130317

SEQ ID NO: 172618 - RNA, 64 nt, Human; identical to SEQ ID NO: 130318

SEQ ID NO: 172619 - RNA, 64 nt, Human; identical to SEQ ID NO: 130319

SEQ ID NO: 172620 - RNA, 64 nt, Human; identical to SEQ ID NO: 130320

SEQ ID NO: 172621 - RNA, 64 nt, Human; identical to SEQ ID NO: 130321

SEQ ID NO: 172622 - RNA, 64 nt, Human; identical to SEQ ID NO: 130322

SEQ ID NO: 172623 - RNA, 64 nt, Human; identical to SEQ ID NO: 130323

SEQ ID NO: 172624 - RNA, 64 nt, Human; identical to SEQ ID NO: 130324

SEQ ID NO: 172625 - RNA, 64 nt, Human; identical to SEQ ID NO: 130325

SEQ ID NO: 172626 - RNA, 64 nt, Human; identical to SEQ ID NO: 130326

SEQ ID NO: 172627 - RNA, 64 nt, Human; identical to SEQ ID NO: 130327

SEQ ID NO: 172628 - RNA, 64 nt, Human; identical to SEQ ID NO: 130328

SEQ ID NO: 172629 - RNA, 64 nt, Human; identical to SEQ ID NO: 130329

SEQ ID NO: 172630 - RNA, 64 nt, Human; identical to SEQ ID NO: 130330

SEQ ID NO: 172631 - RNA, 64 nt, Human; identical to SEQ ID NO: 130331

SEQ ID NO: 172632 - RNA, 64 nt, Human; identical to SEQ ID NO: 130332

SEQ ID NO: 172633 - RNA, 64 nt, Human; identical to SEQ ID NO: 130333

SEQ ID NO: 172634 - RNA, 64 nt, Human; identical to SEQ ID NO: 84824

SEQ ID NO: 172635 - RNA, 64 nt, Human; identical to SEQ ID NO: 130334

SEQ ID NO: 172636 - RNA, 64 nt, Human; identical to SEQ ID NO: 130335

SEQ ID NO: 172637 - RNA, 64 nt, Human; identical to SEQ ID NO: 130336

SEQ ID NO: 172638 - RNA, 64 nt, Human; identical to SEQ ID NO: 130337

SEQ ID NO: 172639 - RNA, 64 nt, Human; identical to SEQ ID NO: 130338

SEQ ID NO: 172640 - RNA, 64 nt, Human; identical to SEQ ID NO: 130339

SEQ ID NO: 172641 - RNA, 64 nt, Human; identical to SEQ ID NO: 130340

SEQ ID NO: 172642 - RNA, 64 nt, Human; identical to SEQ ID NO: 130341

SEQ ID NO: 172643 - RNA, 64 nt, Human; identical to SEQ ID NO: 130342

SEQ ID NO: 172644 - RNA, 64 nt, Human; identical to SEQ ID NO: 130343

SEQ ID NO: 172645 - RNA, 64 nt, Human; identical to SEQ ID NO: 130344

SEQ ID NO: 172646 - RNA, 64 nt, Human; identical to SEQ ID NO: 130345

SEQ ID NO: 172647 - RNA, 64 nt, Human; identical to SEQ ID NO: 130346

SEQ ID NO: 172648 - RNA, 64 nt, Human; identical to SEQ ID NO: 130347

SEQ ID NO: 172649 - RNA, 64 nt, Human; identical to SEQ ID NO: 130348

SEQ ID NO: 172650 - RNA, 64 nt, Human; identical to SEQ ID NO: 130349

SEQ ID NO: 172651 - RNA, 64 nt, Human; identical to SEQ ID NO: 130350

SEQ ID NO: 172652 - RNA, 64 nt, Human; identical to SEQ ID NO: 130351

SEQ ID NO: 172653 - RNA, 64 nt, Human; identical to SEQ ID NO: 130352

SEQ ID NO: 172654 - RNA, 64 nt, Human; identical to SEQ ID NO: 130353

SEQ ID NO: 172655 - RNA, 64 nt, Human; identical to SEQ ID NO: 130354

SEQ ID NO: 172656 - RNA, 64 nt, Human; identical to SEQ ID NO: 130355

SEQ ID NO: 172657 - RNA, 64 nt, Human; identical to SEQ ID NO: 130356

SEQ ID NO: 172658 - RNA, 64 nt, Human; identical to SEQ ID NO: 130357

SEQ ID NO: 172659 - RNA, 64 nt, Human; identical to SEQ ID NO: 130358

SEQ ID NO: 172660 - RNA, 64 nt, Human; identical to SEQ ID NO: 130359

SEQ ID NO: 172661 - RNA, 64 nt, Human; identical to SEQ ID NO: 130360

SEQ ID NO: 172662 - RNA, 64 nt, Human; identical to SEQ ID NO: 130361

SEQ ID NO: 172663 - RNA, 64 nt, Human; identical to SEQ ID NO: 130362

SEQ ID NO: 172664 - RNA, 64 nt, Human; identical to SEQ ID NO: 130363

SEQ ID NO: 172665 - RNA, 64 nt, Human; identical to SEQ ID NO: 130364

SEQ ID NO: 172666 - RNA, 64 nt, Human; identical to SEQ ID NO: 130365

SEQ ID NO: 172667 - RNA, 64 nt, Human; identical to SEQ ID NO: 130366

SEQ ID NO: 172668 - RNA, 64 nt, Human; identical to SEQ ID NO: 130367

SEQ ID NO: 172669 - RNA, 64 nt, Human; identical to SEQ ID NO: 130368

SEQ ID NO: 172670 - RNA, 64 nt, Human; identical to SEQ ID NO: 130369

SEQ ID NO: 172671 - RNA, 64 nt, Human; identical to SEQ ID NO: 130370

SEQ ID NO: 172672 - RNA, 64 nt, Human; identical to SEQ ID NO: 130371

SEQ ID NO: 172673 - RNA, 64 nt, Human; identical to SEQ ID NO: 130372

SEQ ID NO: 172674 - RNA, 64 nt, Human; identical to SEQ ID NO: 130373

SEQ ID NO: 172675 - RNA, 64 nt, Human; identical to SEQ ID NO: 130374

SEQ ID NO: 172676 - RNA, 64 nt, Human; identical to SEQ ID NO: 130375

SEQ ID NO: 172677 - RNA, 64 nt, Human; identical to SEQ ID NO: 130376

SEQ ID NO: 172678 - RNA, 64 nt, Human; identical to SEQ ID NO: 130377

SEQ ID NO: 172679 - RNA, 64 nt, Human; identical to SEQ ID NO: 130378

SEQ ID NO: 172680 - RNA, 64 nt, Human; identical to SEQ ID NO: 130379

SEQ ID NO: 172681 - RNA, 64 nt, Human; identical to SEQ ID NO: 130380

SEQ ID NO: 172682 - RNA, 64 nt, Human; identical to SEQ ID NO: 130381

SEQ ID NO: 172683 - RNA, 64 nt, Human; identical to SEQ ID NO: 130382

SEQ ID NO: 172684 - RNA, 64 nt, Human; identical to SEQ ID NO: 130383

SEQ ID NO: 172685 - RNA, 64 nt, Human; identical to SEQ ID NO: 130384

SEQ ID NO: 172686 - RNA, 64 nt, Human; identical to SEQ ID NO: 130385

SEQ ID NO: 172687 - RNA, 64 nt, Human; identical to SEQ ID NO: 130386

SEQ ID NO: 172688 - RNA, 64 nt, Human; identical to SEQ ID NO: 130387

SEQ ID NO: 172689 - RNA, 64 nt, Human; identical to SEQ ID NO: 130388

SEQ ID NO: 172690 - RNA, 64 nt, Human; identical to SEQ ID NO: 130389

SEQ ID NO: 172691 - RNA, 64 nt, Human; identical to SEQ ID NO: 130390

SEQ ID NO: 172692 - RNA, 64 nt, Human; identical to SEQ ID NO: 130391

SEQ ID NO: 172693 - RNA, 64 nt, Human; identical to SEQ ID NO: 130392

SEQ ID NO: 172694 - RNA, 64 nt, Human; identical to SEQ ID NO: 84726

SEQ ID NO: 172695 - RNA, 64 nt, Human; identical to SEQ ID NO: 130393

SEQ ID NO: 172696 - RNA, 64 nt, Human; identical to SEQ ID NO: 130394

SEQ ID NO: 172697 - RNA, 64 nt, Human; identical to SEQ ID NO: 130395

SEQ ID NO: 172698 - RNA, 64 nt, Human; identical to SEQ ID NO: 130396

SEQ ID NO: 172699 - RNA, 64 nt, Human; identical to SEQ ID NO: 130397

SEQ ID NO: 172700 - RNA, 64 nt, Human; identical to SEQ ID NO: 130398

SEQ ID NO: 172701 - RNA, 64 nt, Human; identical to SEQ ID NO: 130399

SEQ ID NO: 172702 - RNA, 64 nt, Human; identical to SEQ ID NO: 130400

SEQ ID NO: 172703 - RNA, 64 nt, Human; identical to SEQ ID NO: 130401

SEQ ID NO: 172704 - RNA, 64 nt, Human; identical to SEQ ID NO: 130402

SEQ ID NO: 172705 - RNA, 64 nt, Human; identical to SEQ ID NO: 130403

SEQ ID NO: 172706 - RNA, 64 nt, Human; identical to SEQ ID NO: 130404

SEQ ID NO: 172707 - RNA, 64 nt, Human; identical to SEQ ID NO: 130405

SEQ ID NO: 172708 - RNA, 64 nt, Human; identical to SEQ ID NO: 130406

SEQ ID NO: 172709 - RNA, 64 nt, Human; identical to SEQ ID NO: 130407

SEQ ID NO: 172710 - RNA, 64 nt, Human; identical to SEQ ID NO: 130408

SEQ ID NO: 172711 - RNA, 64 nt, Human; identical to SEQ ID NO: 130409

SEQ ID NO: 172712 - RNA, 64 nt, Human; identical to SEQ ID NO: 84773

SEQ ID NO: 172713 - RNA, 64 nt, Human; identical to SEQ ID NO: 130410

SEQ ID NO: 172714 - RNA, 64 nt, Human; identical to SEQ ID NO: 130411

SEQ ID NO: 172715 - RNA, 64 nt, Human; identical to SEQ ID NO: 130412

SEQ ID NO: 172716 - RNA, 64 nt, Human; identical to SEQ ID NO: 130413

SEQ ID NO: 172717 - RNA, 64 nt, Human; identical to SEQ ID NO: 130414

SEQ ID NO: 172718 - RNA, 64 nt, Human; identical to SEQ ID NO: 130415

SEQ ID NO: 172719 - RNA, 64 nt, Human; identical to SEQ ID NO: 130416

SEQ ID NO: 172720 - RNA, 64 nt, Human; identical to SEQ ID NO: 130417

SEQ ID NO: 172721 - RNA, 64 nt, Human; identical to SEQ ID NO: 130418

SEQ ID NO: 172722 - RNA, 64 nt, Human; identical to SEQ ID NO: 130419

SEQ ID NO: 172723 - RNA, 64 nt, Human; identical to SEQ ID NO: 130420

SEQ ID NO: 172724 - RNA, 64 nt, Human; identical to SEQ ID NO: 130421

SEQ ID NO: 172725 - RNA, 64 nt, Human; identical to SEQ ID NO: 130422

SEQ ID NO: 172726 - RNA, 64 nt, Human; identical to SEQ ID NO: 130423

SEQ ID NO: 172727 - RNA, 64 nt, Human; identical to SEQ ID NO: 130424

SEQ ID NO: 172728 - RNA, 64 nt, Human; identical to SEQ ID NO: 130425

SEQ ID NO: 172729 - RNA, 64 nt, Human; identical to SEQ ID NO: 130426

SEQ ID NO: 172730 - RNA, 64 nt, Human; identical to SEQ ID NO: 130427

SEQ ID NO: 172731 - RNA, 64 nt, Human; identical to SEQ ID NO: 130428

SEQ ID NO: 172732 - RNA, 64 nt, Human; identical to SEQ ID NO: 130429

SEQ ID NO: 172733 - RNA, 64 nt, Human; identical to SEQ ID NO: 130430

SEQ ID NO: 172734 - RNA, 64 nt, Human; identical to SEQ ID NO: 130431

SEQ ID NO: 172735 - RNA, 64 nt, Human; identical to SEQ ID NO: 130432

SEQ ID NO: 172736 - RNA, 64 nt, Human; identical to SEQ ID NO: 130433

SEQ ID NO: 172737 - RNA, 64 nt, Human; identical to SEQ ID NO: 130434

SEQ ID NO: 172738 - RNA, 64 nt, Human; identical to SEQ ID NO: 130435

SEQ ID NO: 172739 - RNA, 64 nt, Human; identical to SEQ ID NO: 130436

SEQ ID NO: 172740 - RNA, 64 nt, Human; identical to SEQ ID NO: 130437

SEQ ID NO: 172741 - RNA, 64 nt, Human; identical to SEQ ID NO: 130438

SEQ ID NO: 172742 - RNA, 64 nt, Human; identical to SEQ ID NO: 130439

SEQ ID NO: 172743 - RNA, 64 nt, Human; identical to SEQ ID NO: 130440

SEQ ID NO: 172744 - RNA, 64 nt, Human; identical to SEQ ID NO: 130441

SEQ ID NO: 172745 - RNA, 64 nt, Human; identical to SEQ ID NO: 130442

SEQ ID NO: 172746 - RNA, 64 nt, Human; identical to SEQ ID NO: 130443

SEQ ID NO: 172747 - RNA, 64 nt, Human; identical to SEQ ID NO: 130444

SEQ ID NO: 172748 - RNA, 64 nt, Human; identical to SEQ ID NO: 130445

SEQ ID NO: 172749 - RNA, 64 nt, Human; identical to SEQ ID NO: 130446

SEQ ID NO: 172750 - RNA, 64 nt, Human; identical to SEQ ID NO: 130447

SEQ ID NO: 172751 - RNA, 64 nt, Human; identical to SEQ ID NO: 130448

SEQ ID NO: 172752 - RNA, 64 nt, Human; identical to SEQ ID NO: 130449

SEQ ID NO: 172753 - RNA, 64 nt, Human; identical to SEQ ID NO: 130450

SEQ ID NO: 172754 - RNA, 64 nt, Human; identical to SEQ ID NO: 130451

SEQ ID NO: 172755 - RNA, 64 nt, Human; identical to SEQ ID NO: 130452

SEQ ID NO: 172756 - RNA, 64 nt, Human; identical to SEQ ID NO: 130453

SEQ ID NO: 172757 - RNA, 64 nt, Human; identical to SEQ ID NO: 130454

SEQ ID NO: 172758 - RNA, 64 nt, Human; identical to SEQ ID NO: 130455

SEQ ID NO: 172759 - RNA, 64 nt, Human; identical to SEQ ID NO: 130456

SEQ ID NO: 172760 - RNA, 64 nt, Human; identical to SEQ ID NO: 130457

SEQ ID NO: 172761 - RNA, 64 nt, Human; identical to SEQ ID NO: 130458

SEQ ID NO: 172762 - RNA, 64 nt, Human; identical to SEQ ID NO: 130459

SEQ ID NO: 172763 - RNA, 64 nt, Human; identical to SEQ ID NO: 130460

SEQ ID NO: 172764 - RNA, 64 nt, Human; identical to SEQ ID NO: 130461

SEQ ID NO: 172765 - RNA, 64 nt, Human; identical to SEQ ID NO: 130462

SEQ ID NO: 172766 - RNA, 64 nt, Human; identical to SEQ ID NO: 130463

SEQ ID NO: 172767 - RNA, 64 nt, Human; identical to SEQ ID NO: 130464

SEQ ID NO: 172768 - RNA, 64 nt, Human; identical to SEQ ID NO: 130465

SEQ ID NO: 172769 - RNA, 64 nt, Human; identical to SEQ ID NO: 130466

SEQ ID NO: 172770 - RNA, 64 nt, Human; identical to SEQ ID NO: 130467

SEQ ID NO: 172771 - RNA, 64 nt, Human; identical to SEQ ID NO: 130468

SEQ ID NO: 172772 - RNA, 64 nt, Human; identical to SEQ ID NO: 130469

SEQ ID NO: 172773 - RNA, 64 nt, Human; identical to SEQ ID NO: 130470

SEQ ID NO: 172774 - RNA, 64 nt, Human; identical to SEQ ID NO: 130471

SEQ ID NO: 172775 - RNA, 64 nt, Human; identical to SEQ ID NO: 130472

SEQ ID NO: 172776 - RNA, 64 nt, Human; identical to SEQ ID NO: 130473

SEQ ID NO: 172777 - RNA, 51 nt, Human; identical to SEQ ID NO: 130474

SEQ ID NO: 172778 - RNA, 64 nt, Human; identical to SEQ ID NO: 130475

SEQ ID NO: 172779 - RNA, 64 nt, Human; identical to SEQ ID NO: 130476

SEQ ID NO: 172780 - RNA, 64 nt, Human; identical to SEQ ID NO: 130477

SEQ ID NO: 172781 - RNA, 64 nt, Human; identical to SEQ ID NO: 84730

SEQ ID NO: 172782 - RNA, 64 nt, Human; identical to SEQ ID NO: 130478

SEQ ID NO: 172783 - RNA, 64 nt, Human; identical to SEQ ID NO: 130479

SEQ ID NO: 172784 - RNA, 64 nt, Human; identical to SEQ ID NO: 130480

SEQ ID NO: 172785 - RNA, 64 nt, Human; identical to SEQ ID NO: 130481

SEQ ID NO: 172786 - RNA, 64 nt, Human; identical to SEQ ID NO: 130482

SEQ ID NO: 172787 - RNA, 64 nt, Human; identical to SEQ ID NO: 130483

SEQ ID NO: 172788 - RNA, 64 nt, Human; identical to SEQ ID NO: 130484

SEQ ID NO: 172789 - RNA, 50 nt, Human; identical to SEQ ID NO: 130485

SEQ ID NO: 172790 - RNA, 64 nt, Human; identical to SEQ ID NO: 130486

SEQ ID NO: 172791 - RNA, 64 nt, Human; identical to SEQ ID NO: 130487

SEQ ID NO: 172792 - RNA, 64 nt, Human; identical to SEQ ID NO: 130488

SEQ ID NO: 172793 - RNA, 64 nt, Human; identical to SEQ ID NO: 130489

SEQ ID NO: 172794 - RNA, 64 nt, Human; identical to SEQ ID NO: 130490

SEQ ID NO: 172795 - RNA, 64 nt, Human; identical to SEQ ID NO: 130491

SEQ ID NO: 172796 - RNA, 64 nt, Human; identical to SEQ ID NO: 130492

SEQ ID NO: 172797 - RNA, 64 nt, Human; identical to SEQ ID NO: 130493

SEQ ID NO: 172798 - RNA, 64 nt, Human; identical to SEQ ID NO: 130494

SEQ ID NO: 172799 - RNA, 64 nt, Human; identical to SEQ ID NO: 84803

SEQ ID NO: 172800 - RNA, 64 nt, Human; identical to SEQ ID NO: 130495

SEQ ID NO: 172801 - RNA, 64 nt, Human; identical to SEQ ID NO: 130496

SEQ ID NO: 172802 - RNA, 64 nt, Human; identical to SEQ ID NO: 130497

SEQ ID NO: 172803 - RNA, 64 nt, Human; identical to SEQ ID NO: 130498

SEQ ID NO: 172804 - RNA, 64 nt, Human; identical to SEQ ID NO: 130499

SEQ ID NO: 172805 - RNA, 64 nt, Human; identical to SEQ ID NO: 130500

SEQ ID NO: 172806 - RNA, 64 nt, Human; identical to SEQ ID NO: 130501

SEQ ID NO: 172807 - RNA, 64 nt, Human; identical to SEQ ID NO: 130502

SEQ ID NO: 172808 - RNA, 64 nt, Human; identical to SEQ ID NO: 130503

SEQ ID NO: 172809 - RNA, 64 nt, Human; identical to SEQ ID NO: 130504

SEQ ID NO: 172810 - RNA, 64 nt, Human; identical to SEQ ID NO: 130505

SEQ ID NO: 172811 - RNA, 64 nt, Human; identical to SEQ ID NO: 130506

SEQ ID NO: 172812 - RNA, 64 nt, Human; identical to SEQ ID NO: 130507

SEQ ID NO: 172813 - RNA, 64 nt, Human; identical to SEQ ID NO: 130508

SEQ ID NO: 172814 - RNA, 64 nt, Human; identical to SEQ ID NO: 130509

SEQ ID NO: 172815 - RNA, 64 nt, Human; identical to SEQ ID NO: 130510

SEQ ID NO: 172816 - RNA, 64 nt, Human; identical to SEQ ID NO: 130511

SEQ ID NO: 172817 - RNA, 64 nt, Human; identical to SEQ ID NO: 130512

SEQ ID NO: 172818 - RNA, 64 nt, Human; identical to SEQ ID NO: 130513

SEQ ID NO: 172819 - RNA, 64 nt, Human; identical to SEQ ID NO: 130514

SEQ ID NO: 172820 - RNA, 64 nt, Human; identical to SEQ ID NO: 130515

SEQ ID NO: 172821 - RNA, 64 nt, Human; identical to SEQ ID NO: 130516

SEQ ID NO: 172822 - RNA, 64 nt, Human; identical to SEQ ID NO: 130517

SEQ ID NO: 172823 - RNA, 64 nt, Human; identical to SEQ ID NO: 130518

SEQ ID NO: 172824 - RNA, 64 nt, Human; identical to SEQ ID NO: 130519

SEQ ID NO: 172825 - RNA, 64 nt, Human; identical to SEQ ID NO: 130520

SEQ ID NO: 172826 - RNA, 64 nt, Human; identical to SEQ ID NO: 130521

SEQ ID NO: 172827 - RNA, 64 nt, Human; identical to SEQ ID NO: 130522

SEQ ID NO: 172828 - RNA, 64 nt, Human; identical to SEQ ID NO: 130523

SEQ ID NO: 172829 - RNA, 64 nt, Human; identical to SEQ ID NO: 130524

SEQ ID NO: 172830 - RNA, 64 nt, Human; identical to SEQ ID NO: 130525

SEQ ID NO: 172831 - RNA, 64 nt, Human; identical to SEQ ID NO: 130526

SEQ ID NO: 172832 - RNA, 64 nt, Human; identical to SEQ ID NO: 130527

SEQ ID NO: 172833 - RNA, 64 nt, Human; identical to SEQ ID NO: 130528

SEQ ID NO: 172834 - RNA, 64 nt, Human; identical to SEQ ID NO: 84734

SEQ ID NO: 172835 - RNA, 64 nt, Human; identical to SEQ ID NO: 130529

SEQ ID NO: 172836 - RNA, 64 nt, Human; identical to SEQ ID NO: 130530

SEQ ID NO: 172837 - RNA, 64 nt, Human; identical to SEQ ID NO: 130531

SEQ ID NO: 172838 - RNA, 64 nt, Human; identical to SEQ ID NO: 130532

SEQ ID NO: 172839 - RNA, 64 nt, Human; identical to SEQ ID NO: 130533

SEQ ID NO: 172840 - RNA, 64 nt, Human; identical to SEQ ID NO: 130534

SEQ ID NO: 172841 - RNA, 64 nt, Human; identical to SEQ ID NO: 130535

SEQ ID NO: 172842 - RNA, 64 nt, Human; identical to SEQ ID NO: 130536

SEQ ID NO: 172843 - RNA, 64 nt, Human; identical to SEQ ID NO: 130537

SEQ ID NO: 172844 - RNA, 64 nt, Human; identical to SEQ ID NO: 130538

SEQ ID NO: 172845 - RNA, 64 nt, Human; identical to SEQ ID NO: 130539

SEQ ID NO: 172846 - RNA, 64 nt, Human; identical to SEQ ID NO: 130540

SEQ ID NO: 172847 - RNA, 64 nt, Human; identical to SEQ ID NO: 130541

SEQ ID NO: 172848 - RNA, 64 nt, Human; identical to SEQ ID NO: 130542

SEQ ID NO: 172849 - RNA, 64 nt, Human; identical to SEQ ID NO: 130543

SEQ ID NO: 172850 - RNA, 64 nt, Human; identical to SEQ ID NO: 130544

SEQ ID NO: 172851 - RNA, 64 nt, Human; identical to SEQ ID NO: 130545

SEQ ID NO: 172852 - RNA, 64 nt, Human; identical to SEQ ID NO: 84776

SEQ ID NO: 172853 - RNA, 64 nt, Human; identical to SEQ ID NO: 130546

SEQ ID NO: 172854 - RNA, 64 nt, Human; identical to SEQ ID NO: 130547

SEQ ID NO: 172855 - RNA, 54 nt, Human; identical to SEQ ID NO: 130548

SEQ ID NO: 172856 - RNA, 64 nt, Human; identical to SEQ ID NO: 130549

SEQ ID NO: 172857 - RNA, 64 nt, Human; identical to SEQ ID NO: 130550

SEQ ID NO: 172858 - RNA, 64 nt, Human; identical to SEQ ID NO: 130551

SEQ ID NO: 172859 - RNA, 64 nt, Human; identical to SEQ ID NO: 130552

SEQ ID NO: 172860 - RNA, 64 nt, Human; identical to SEQ ID NO: 130553

SEQ ID NO: 172861 - RNA, 64 nt, Human; identical to SEQ ID NO: 130554

SEQ ID NO: 172862 - RNA, 64 nt, Human; identical to SEQ ID NO: 130555

SEQ ID NO: 172863 - RNA, 64 nt, Human; identical to SEQ ID NO: 130556

SEQ ID NO: 172864 - RNA, 64 nt, Human; identical to SEQ ID NO: 130557

SEQ ID NO: 172865 - RNA, 64 nt, Human; identical to SEQ ID NO: 130558

SEQ ID NO: 172866 - RNA, 64 nt, Human; identical to SEQ ID NO: 130559

SEQ ID NO: 172867 - RNA, 64 nt, Human; identical to SEQ ID NO: 130560

SEQ ID NO: 172868 - RNA, 64 nt, Human; identical to SEQ ID NO: 130561

SEQ ID NO: 172869 - RNA, 64 nt, Human; identical to SEQ ID NO: 130562

SEQ ID NO: 172870 - RNA, 64 nt, Human; identical to SEQ ID NO: 84738

SEQ ID NO: 172871 - RNA, 64 nt, Human; identical to SEQ ID NO: 130563

SEQ ID NO: 172872 - RNA, 64 nt, Human; identical to SEQ ID NO: 130564

SEQ ID NO: 172873 - RNA, 64 nt, Human; identical to SEQ ID NO: 130565

SEQ ID NO: 172874 - RNA, 64 nt, Human; identical to SEQ ID NO: 130566

SEQ ID NO: 172875 - RNA, 64 nt, Human; identical to SEQ ID NO: 130567

SEQ ID NO: 172876 - RNA, 64 nt, Human; identical to SEQ ID NO: 130568

SEQ ID NO: 172877 - RNA, 64 nt, Human; identical to SEQ ID NO: 130569

SEQ ID NO: 172878 - RNA, 64 nt, Human; identical to SEQ ID NO: 130570

SEQ ID NO: 172879 - RNA, 64 nt, Human; identical to SEQ ID NO: 130571

SEQ ID NO: 172880 - RNA, 64 nt, Human; identical to SEQ ID NO: 130572

SEQ ID NO: 172881 - RNA, 64 nt, Human; identical to SEQ ID NO: 130573

SEQ ID NO: 172882 - RNA, 64 nt, Human; identical to SEQ ID NO: 130574

SEQ ID NO: 172883 - RNA, 64 nt, Human; identical to SEQ ID NO: 130575

SEQ ID NO: 172884 - RNA, 64 nt, Human; identical to SEQ ID NO: 130576

SEQ ID NO: 172885 - RNA, 64 nt, Human; identical to SEQ ID NO: 130577

SEQ ID NO: 172886 - RNA, 64 nt, Human; identical to SEQ ID NO: 130578

SEQ ID NO: 172887 - RNA, 64 nt, Human; identical to SEQ ID NO: 130579

SEQ ID NO: 172888 - RNA, 64 nt, Human; identical to SEQ ID NO: 84825

SEQ ID NO: 172889 - RNA, 64 nt, Human; identical to SEQ ID NO: 130580

SEQ ID NO: 172890 - RNA, 64 nt, Human; identical to SEQ ID NO: 130581

SEQ ID NO: 172891 - RNA, 64 nt, Human; identical to SEQ ID NO: 130582

SEQ ID NO: 172892 - RNA, 64 nt, Human; identical to SEQ ID NO: 130583

SEQ ID NO: 172893 - RNA, 64 nt, Human; identical to SEQ ID NO: 130584

SEQ ID NO: 172894 - RNA, 61 nt, Human; identical to SEQ ID NO: 130585

SEQ ID NO: 172895 - RNA, 64 nt, Human; identical to SEQ ID NO: 130586

SEQ ID NO: 172896 - RNA, 64 nt, Human; identical to SEQ ID NO: 130587

SEQ ID NO: 172897 - RNA, 64 nt, Human; identical to SEQ ID NO: 130588

SEQ ID NO: 172898 - RNA, 64 nt, Human; identical to SEQ ID NO: 130589

SEQ ID NO: 172899 - RNA, 64 nt, Human; identical to SEQ ID NO: 130590

SEQ ID NO: 172900 - RNA, 64 nt, Human; identical to SEQ ID NO: 130591

SEQ ID NO: 172901 - RNA, 64 nt, Human; identical to SEQ ID NO: 130592

SEQ ID NO: 172902 - RNA, 64 nt, Human; identical to SEQ ID NO: 130593

SEQ ID NO: 172903 - RNA, 64 nt, Human; identical to SEQ ID NO: 130594

SEQ ID NO: 172904 - RNA, 64 nt, Human; identical to SEQ ID NO: 130595

SEQ ID NO: 172905 - RNA, 64 nt, Human; identical to SEQ ID NO: 130596

SEQ ID NO: 172906 - RNA, 64 nt, Human; identical to SEQ ID NO: 84694

SEQ ID NO: 172907 - RNA, 64 nt, Human; identical to SEQ ID NO: 130597

SEQ ID NO: 172908 - RNA, 64 nt, Human; identical to SEQ ID NO: 130598

SEQ ID NO: 172909 - RNA, 56 nt, Human; identical to SEQ ID NO: 130599

SEQ ID NO: 172910 - RNA, 64 nt, Human; identical to SEQ ID NO: 130600

SEQ ID NO: 172911 - RNA, 64 nt, Human; identical to SEQ ID NO: 130601

SEQ ID NO: 172912 - RNA, 64 nt, Human; identical to SEQ ID NO: 130602

SEQ ID NO: 172913 - RNA, 64 nt, Human; identical to SEQ ID NO: 130603

SEQ ID NO: 172914 - RNA, 64 nt, Human; identical to SEQ ID NO: 130604

SEQ ID NO: 172915 - RNA, 55 nt, Human; identical to SEQ ID NO: 130605

SEQ ID NO: 172916 - RNA, 64 nt, Human; identical to SEQ ID NO: 130606

SEQ ID NO: 172917 - RNA, 64 nt, Human; identical to SEQ ID NO: 130607

SEQ ID NO: 172918 - RNA, 64 nt, Human; identical to SEQ ID NO: 130608

SEQ ID NO: 172919 - RNA, 64 nt, Human; identical to SEQ ID NO: 130609

SEQ ID NO: 172920 - RNA, 64 nt, Human; identical to SEQ ID NO: 130610

SEQ ID NO: 172921 - RNA, 64 nt, Human; identical to SEQ ID NO: 130611

SEQ ID NO: 172922 - RNA, 64 nt, Human; identical to SEQ ID NO: 130612

SEQ ID NO: 172923 - RNA, 64 nt, Human; identical to SEQ ID NO: 130613

SEQ ID NO: 172924 - RNA, 64 nt, Human; identical to SEQ ID NO: 84742

SEQ ID NO: 172925 - RNA, 64 nt, Human; identical to SEQ ID NO: 130614

SEQ ID NO: 172926 - RNA, 64 nt, Human; identical to SEQ ID NO: 130615

SEQ ID NO: 172927 - RNA, 64 nt, Human; identical to SEQ ID NO: 130616

SEQ ID NO: 172928 - RNA, 64 nt, Human; identical to SEQ ID NO: 130617

SEQ ID NO: 172929 - RNA, 64 nt, Human; identical to SEQ ID NO: 130618

SEQ ID NO: 172930 - RNA, 64 nt, Human; identical to SEQ ID NO: 130619

SEQ ID NO: 172931 - RNA, 64 nt, Human; identical to SEQ ID NO: 130620

SEQ ID NO: 172932 - RNA, 64 nt, Human; identical to SEQ ID NO: 130621

SEQ ID NO: 172933 - RNA, 64 nt, Human; identical to SEQ ID NO: 130622

SEQ ID NO: 172934 - RNA, 64 nt, Human; identical to SEQ ID NO: 130623

SEQ ID NO: 172935 - RNA, 64 nt, Human; identical to SEQ ID NO: 130624

SEQ ID NO: 172936 - RNA, 64 nt, Human; identical to SEQ ID NO: 130625

SEQ ID NO: 172937 - RNA, 64 nt, Human; identical to SEQ ID NO: 130626

SEQ ID NO: 172938 - RNA, 64 nt, Human; identical to SEQ ID NO: 130627

SEQ ID NO: 172939 - RNA, 64 nt, Human; identical to SEQ ID NO: 130628

SEQ ID NO: 172940 - RNA, 64 nt, Human; identical to SEQ ID NO: 130629

SEQ ID NO: 172941 - RNA, 64 nt, Human; identical to SEQ ID NO: 130630

SEQ ID NO: 172942 - RNA, 64 nt, Human; identical to SEQ ID NO: 130631

SEQ ID NO: 172943 - RNA, 64 nt, Human; identical to SEQ ID NO: 130632

SEQ ID NO: 172944 - RNA, 64 nt, Human; identical to SEQ ID NO: 130633

SEQ ID NO: 172945 - RNA, 64 nt, Human; identical to SEQ ID NO: 130634

SEQ ID NO: 172946 - RNA, 64 nt, Human; identical to SEQ ID NO: 130635

SEQ ID NO: 172947 - RNA, 64 nt, Human; identical to SEQ ID NO: 130636

SEQ ID NO: 172948 - RNA, 64 nt, Human; identical to SEQ ID NO: 130637

SEQ ID NO: 172949 - RNA, 64 nt, Human; identical to SEQ ID NO: 130638

SEQ ID NO: 172950 - RNA, 64 nt, Human; identical to SEQ ID NO: 130639

SEQ ID NO: 172951 - RNA, 64 nt, Human; identical to SEQ ID NO: 130640

SEQ ID NO: 172952 - RNA, 64 nt, Human; identical to SEQ ID NO: 130641

SEQ ID NO: 172953 - RNA, 64 nt, Human; identical to SEQ ID NO: 130642

SEQ ID NO: 172954 - RNA, 64 nt, Human; identical to SEQ ID NO: 130643

SEQ ID NO: 172955 - RNA, 64 nt, Human; identical to SEQ ID NO: 130644

SEQ ID NO: 172956 - RNA, 64 nt, Human; identical to SEQ ID NO: 130645

SEQ ID NO: 172957 - RNA, 64 nt, Human; identical to SEQ ID NO: 130646

SEQ ID NO: 172958 - RNA, 64 nt, Human; identical to SEQ ID NO: 130647

SEQ ID NO: 172959 - RNA, 64 nt, Human; identical to SEQ ID NO: 84698

SEQ ID NO: 172960 - RNA, 64 nt, Human; identical to SEQ ID NO: 130648

SEQ ID NO: 172961 - RNA, 64 nt, Human; identical to SEQ ID NO: 130649

SEQ ID NO: 172962 - RNA, 64 nt, Human; identical to SEQ ID NO: 130650

SEQ ID NO: 172963 - RNA, 64 nt, Human; identical to SEQ ID NO: 130651

SEQ ID NO: 172964 - RNA, 64 nt, Human; identical to SEQ ID NO: 130652

SEQ ID NO: 172965 - RNA, 64 nt, Human; identical to SEQ ID NO: 130653

SEQ ID NO: 172966 - RNA, 64 nt, Human; identical to SEQ ID NO: 130654

SEQ ID NO: 172967 - RNA, 64 nt, Human; identical to SEQ ID NO: 130655

SEQ ID NO: 172968 - RNA, 64 nt, Human; identical to SEQ ID NO: 130656

SEQ ID NO: 172969 - RNA, 64 nt, Human; identical to SEQ ID NO: 130657

SEQ ID NO: 172970 - RNA, 64 nt, Human; identical to SEQ ID NO: 130658

SEQ ID NO: 172971 - RNA, 64 nt, Human; identical to SEQ ID NO: 130659

SEQ ID NO: 172972 - RNA, 64 nt, Human; identical to SEQ ID NO: 130660

SEQ ID NO: 172973 - RNA, 64 nt, Human; identical to SEQ ID NO: 130661

SEQ ID NO: 172974 - RNA, 64 nt, Human; identical to SEQ ID NO: 130662

SEQ ID NO: 172975 - RNA, 64 nt, Human; identical to SEQ ID NO: 130663

SEQ ID NO: 172976 - RNA, 64 nt, Human; identical to SEQ ID NO: 130664

SEQ ID NO: 172977 - RNA, 64 nt, Human; identical to SEQ ID NO: 84779

SEQ ID NO: 172978 - RNA, 64 nt, Human; identical to SEQ ID NO: 130665

SEQ ID NO: 172979 - RNA, 64 nt, Human; identical to SEQ ID NO: 130666

SEQ ID NO: 172980 - RNA, 64 nt, Human; identical to SEQ ID NO: 130667

SEQ ID NO: 172981 - RNA, 64 nt, Human; identical to SEQ ID NO: 130668

SEQ ID NO: 172982 - RNA, 64 nt, Human; identical to SEQ ID NO: 130669

SEQ ID NO: 172983 - RNA, 64 nt, Human; identical to SEQ ID NO: 130670

SEQ ID NO: 172984 - RNA, 64 nt, Human; identical to SEQ ID NO: 130671

SEQ ID NO: 172985 - RNA, 64 nt, Human; identical to SEQ ID NO: 130672

SEQ ID NO: 172986 - RNA, 64 nt, Human; identical to SEQ ID NO: 130024

SEQ ID NO: 172987 - RNA, 64 nt, Human; identical to SEQ ID NO: 130025

SEQ ID NO: 172988 - RNA, 64 nt, Human; identical to SEQ ID NO: 130026

SEQ ID NO: 172989 - RNA, 64 nt, Human; identical to SEQ ID NO: 130027

SEQ ID NO: 172990 - RNA, 64 nt, Human; identical to SEQ ID NO: 130028

SEQ ID NO: 172991 - RNA, 64 nt, Human; identical to SEQ ID NO: 130029

SEQ ID NO: 172992 - RNA, 64 nt, Human; identical to SEQ ID NO: 130030

SEQ ID NO: 172993 - RNA, 64 nt, Human; identical to SEQ ID NO: 130031

SEQ ID NO: 172994 - RNA, 64 nt, Human; identical to SEQ ID NO: 130032

SEQ ID NO: 172995 - RNA, 64 nt, Human; identical to SEQ ID NO: 130033

SEQ ID NO: 172996 - RNA, 64 nt, Human; identical to SEQ ID NO: 130034

SEQ ID NO: 172997 - RNA, 64 nt, Human; identical to SEQ ID NO: 130035

SEQ ID NO: 172998 - RNA, 64 nt, Human; identical to SEQ ID NO: 130036

SEQ ID NO: 172999 - RNA, 64 nt, Human; identical to SEQ ID NO: 130037

SEQ ID NO: 173000 - RNA, 64 nt, Human; identical to SEQ ID NO: 130038

SEQ ID NO: 173001 - RNA, 64 nt, Human; identical to SEQ ID NO: 130039

SEQ ID NO: 173002 - RNA, 64 nt, Human; identical to SEQ ID NO: 130040

SEQ ID NO: 173003 - RNA, 64 nt, Human; identical to SEQ ID NO: 130041

SEQ ID NO: 173004 - RNA, 64 nt, Human; identical to SEQ ID NO: 130042

SEQ ID NO: 173005 - RNA, 64 nt, Human; identical to SEQ ID NO: 130043

SEQ ID NO: 173006 - RNA, 56 nt, Human; identical to SEQ ID NO: 130044

SEQ ID NO: 173007 - RNA, 64 nt, Human; identical to SEQ ID NO: 130045

SEQ ID NO: 173008 - RNA, 64 nt, Human; identical to SEQ ID NO: 130046

SEQ ID NO: 173009 - RNA, 64 nt, Human; identical to SEQ ID NO: 130047

SEQ ID NO: 173010 - RNA, 64 nt, Human; identical to SEQ ID NO: 130048

SEQ ID NO: 173011 - RNA, 64 nt, Human; identical to SEQ ID NO: 130049

SEQ ID NO: 173012 - RNA, 64 nt, Human; identical to SEQ ID NO: 130050

SEQ ID NO: 173013 - RNA, 64 nt, Human; identical to SEQ ID NO: 130051

SEQ ID NO: 173014 - RNA, 64 nt, Human; identical to SEQ ID NO: 130052

SEQ ID NO: 173015 - RNA, 64 nt, Human; identical to SEQ ID NO: 130053

SEQ ID NO: 173016 - RNA, 64 nt, Human; identical to SEQ ID NO: 130054

SEQ ID NO: 173017 - RNA, 64 nt, Human; identical to SEQ ID NO: 84702

SEQ ID NO: 173018 - RNA, 64 nt, Human; identical to SEQ ID NO: 130055

SEQ ID NO: 173019 - RNA, 64 nt, Human; identical to SEQ ID NO: 130056

SEQ ID NO: 173020 - RNA, 64 nt, Human; identical to SEQ ID NO: 130057

SEQ ID NO: 173021 - RNA, 64 nt, Human; identical to SEQ ID NO: 130058

SEQ ID NO: 173022 - RNA, 64 nt, Human; identical to SEQ ID NO: 130059

SEQ ID NO: 173023 - RNA, 64 nt, Human; identical to SEQ ID NO: 130060

SEQ ID NO: 173024 - RNA, 64 nt, Human; identical to SEQ ID NO: 130061

SEQ ID NO: 173025 - RNA, 64 nt, Human; identical to SEQ ID NO: 130062

SEQ ID NO: 173026 - RNA, 64 nt, Human; identical to SEQ ID NO: 130063

SEQ ID NO: 173027 - RNA, 64 nt, Human; identical to SEQ ID NO: 130064

SEQ ID NO: 173028 - RNA, 64 nt, Human; identical to SEQ ID NO: 130065

SEQ ID NO: 173029 - RNA, 64 nt, Human; identical to SEQ ID NO: 130066

SEQ ID NO: 173030 - RNA, 64 nt, Human; identical to SEQ ID NO: 130067

SEQ ID NO: 173031 - RNA, 64 nt, Human; identical to SEQ ID NO: 130068

SEQ ID NO: 173032 - RNA, 51 nt, Human; identical to SEQ ID NO: 130069

SEQ ID NO: 173033 - RNA, 64 nt, Human; identical to SEQ ID NO: 130070

SEQ ID NO: 173034 - RNA, 64 nt, Human; identical to SEQ ID NO: 130071

SEQ ID NO: 173035 - RNA, 64 nt, Human; identical to SEQ ID NO: 84746

SEQ ID NO: 173036 - RNA, 64 nt, Human; identical to SEQ ID NO: 130072

SEQ ID NO: 173037 - RNA, 64 nt, Human; identical to SEQ ID NO: 130073

SEQ ID NO: 173038 - RNA, 64 nt, Human; identical to SEQ ID NO: 130074

SEQ ID NO: 173039 - RNA, 64 nt, Human; identical to SEQ ID NO: 130075

SEQ ID NO: 173040 - RNA, 64 nt, Human; identical to SEQ ID NO: 130076

SEQ ID NO: 173041 - RNA, 64 nt, Human; identical to SEQ ID NO: 130077

SEQ ID NO: 173042 - RNA, 64 nt, Human; identical to SEQ ID NO: 130078

SEQ ID NO: 173043 - RNA, 64 nt, Human; identical to SEQ ID NO: 130079

SEQ ID NO: 173044 - RNA, 64 nt, Human; identical to SEQ ID NO: 130080

SEQ ID NO: 173045 - RNA, 64 nt, Human; identical to SEQ ID NO: 130081

SEQ ID NO: 173046 - RNA, 64 nt, Human; identical to SEQ ID NO: 130082

SEQ ID NO: 173047 - RNA, 64 nt, Human; identical to SEQ ID NO: 130083

SEQ ID NO: 173048 - RNA, 64 nt, Human; identical to SEQ ID NO: 130084

SEQ ID NO: 173049 - RNA, 64 nt, Human; identical to SEQ ID NO: 130085

SEQ ID NO: 173050 - RNA, 64 nt, Human; identical to SEQ ID NO: 130086

SEQ ID NO: 173051 - RNA, 64 nt, Human; identical to SEQ ID NO: 130087

SEQ ID NO: 173052 - RNA, 64 nt, Human; identical to SEQ ID NO: 130088

SEQ ID NO: 173053 - RNA, 64 nt, Human; identical to SEQ ID NO: 84706

SEQ ID NO: 173054 - RNA, 64 nt, Human; identical to SEQ ID NO: 130089

SEQ ID NO: 173055 - RNA, 64 nt, Human; identical to SEQ ID NO: 130090

SEQ ID NO: 173056 - RNA, 64 nt, Human; identical to SEQ ID NO: 130091

SEQ ID NO: 173057 - RNA, 64 nt, Human; identical to SEQ ID NO: 130092

SEQ ID NO: 173058 - RNA, 64 nt, Human; identical to SEQ ID NO: 130093

SEQ ID NO: 173059 - RNA, 64 nt, Human; identical to SEQ ID NO: 130094

SEQ ID NO: 173060 - RNA, 64 nt, Human; identical to SEQ ID NO: 130095

SEQ ID NO: 173061 - RNA, 64 nt, Human; identical to SEQ ID NO: 130096

SEQ ID NO: 173062 - RNA, 64 nt, Human; identical to SEQ ID NO: 130097

SEQ ID NO: 173063 - RNA, 64 nt, Human; identical to SEQ ID NO: 130098

SEQ ID NO: 173064 - RNA, 64 nt, Human; identical to SEQ ID NO: 130099

SEQ ID NO: 173065 - RNA, 64 nt, Human; identical to SEQ ID NO: 130100

SEQ ID NO: 173066 - RNA, 64 nt, Human; identical to SEQ ID NO: 130101

SEQ ID NO: 173067 - RNA, 64 nt, Human; identical to SEQ ID NO: 130102

SEQ ID NO: 173068 - RNA, 64 nt, Human; identical to SEQ ID NO: 130103

SEQ ID NO: 173069 - RNA, 64 nt, Human; identical to SEQ ID NO: 130104

SEQ ID NO: 173070 - RNA, 64 nt, Human; identical to SEQ ID NO: 130105

SEQ ID NO: 173071 - RNA, 64 nt, Human; identical to SEQ ID NO: 84806

SEQ ID NO: 173072 - RNA, 64 nt, Human; identical to SEQ ID NO: 130106

SEQ ID NO: 173073 - RNA, 64 nt, Human; identical to SEQ ID NO: 130107

SEQ ID NO: 173074 - RNA, 64 nt, Human; identical to SEQ ID NO: 130108

SEQ ID NO: 173075 - RNA, 64 nt, Human; identical to SEQ ID NO: 130109

SEQ ID NO: 173076 - RNA, 64 nt, Human; identical to SEQ ID NO: 130110

SEQ ID NO: 173077 - RNA, 64 nt, Human; identical to SEQ ID NO: 130111

SEQ ID NO: 173078 - RNA, 64 nt, Human; identical to SEQ ID NO: 130112

SEQ ID NO: 173079 - RNA, 64 nt, Human; identical to SEQ ID NO: 130113

SEQ ID NO: 173080 - RNA, 64 nt, Human; identical to SEQ ID NO: 130114

SEQ ID NO: 173081 - RNA, 64 nt, Human; identical to SEQ ID NO: 130115

SEQ ID NO: 173082 - RNA, 64 nt, Human; identical to SEQ ID NO: 130116

SEQ ID NO: 173083 - RNA, 64 nt, Human; identical to SEQ ID NO: 130117

SEQ ID NO: 173084 - RNA, 64 nt, Human; identical to SEQ ID NO: 130118

SEQ ID NO: 173085 - RNA, 64 nt, Human; identical to SEQ ID NO: 130119

SEQ ID NO: 173086 - RNA, 64 nt, Human; identical to SEQ ID NO: 130120

SEQ ID NO: 173087 - RNA, 64 nt, Human; identical to SEQ ID NO: 130121

SEQ ID NO: 173088 - RNA, 64 nt, Human; identical to SEQ ID NO: 130122

SEQ ID NO: 173089 - RNA, 64 nt, Human; identical to SEQ ID NO: 84660

SEQ ID NO: 173090 - RNA, 64 nt, Human; identical to SEQ ID NO: 130123

SEQ ID NO: 173091 - RNA, 64 nt, Human; identical to SEQ ID NO: 130124

SEQ ID NO: 173092 - RNA, 64 nt, Human; identical to SEQ ID NO: 130125

SEQ ID NO: 173093 - RNA, 64 nt, Human; identical to SEQ ID NO: 130126

SEQ ID NO: 173094 - RNA, 64 nt, Human; identical to SEQ ID NO: 130127

SEQ ID NO: 173095 - RNA, 64 nt, Human; identical to SEQ ID NO: 130128

SEQ ID NO: 173096 - RNA, 64 nt, Human; identical to SEQ ID NO: 130129

SEQ ID NO: 173097 - RNA, 64 nt, Human; identical to SEQ ID NO: 130130

SEQ ID NO: 173098 - RNA, 64 nt, Human; identical to SEQ ID NO: 130131

SEQ ID NO: 173099 - RNA, 64 nt, Human; identical to SEQ ID NO: 130132

SEQ ID NO: 173100 - RNA, 64 nt, Human; identical to SEQ ID NO: 130133

SEQ ID NO: 173101 - RNA, 64 nt, Human; identical to SEQ ID NO: 130134

SEQ ID NO: 173102 - RNA, 64 nt, Human; identical to SEQ ID NO: 130135

SEQ ID NO: 173103 - RNA, 64 nt, Human; identical to SEQ ID NO: 130136

SEQ ID NO: 173104 - RNA, 64 nt, Human; identical to SEQ ID NO: 130137

SEQ ID NO: 173105 - RNA, 64 nt, Human; identical to SEQ ID NO: 130138

SEQ ID NO: 173106 - RNA, 64 nt, Human; identical to SEQ ID NO: 130139

SEQ ID NO: 173107 - RNA, 64 nt, Human; identical to SEQ ID NO: 84710

SEQ ID NO: 173108 - RNA, 64 nt, Human; identical to SEQ ID NO: 130140

SEQ ID NO: 173109 - RNA, 64 nt, Human; identical to SEQ ID NO: 130141

SEQ ID NO: 173110 - RNA, 64 nt, Human; identical to SEQ ID NO: 130142

SEQ ID NO: 173111 - RNA, 64 nt, Human; identical to SEQ ID NO: 130143

SEQ ID NO: 173112 - RNA, 64 nt, Human; identical to SEQ ID NO: 130144

SEQ ID NO: 173113 - RNA, 64 nt, Human; identical to SEQ ID NO: 130145

SEQ ID NO: 173114 - RNA, 64 nt, Human; identical to SEQ ID NO: 130146

SEQ ID NO: 173115 - RNA, 64 nt, Human; identical to SEQ ID NO: 130147

SEQ ID NO: 173116 - RNA, 64 nt, Human; identical to SEQ ID NO: 130148

SEQ ID NO: 173117 - RNA, 64 nt, Human; identical to SEQ ID NO: 130149

SEQ ID NO: 173118 - RNA, 64 nt, Human; identical to SEQ ID NO: 130150

SEQ ID NO: 173119 - RNA, 64 nt, Human; identical to SEQ ID NO: 130151

SEQ ID NO: 173120 - RNA, 64 nt, Human; identical to SEQ ID NO: 130152

SEQ ID NO: 173121 - RNA, 64 nt, Human; identical to SEQ ID NO: 130153

SEQ ID NO: 173122 - RNA, 64 nt, Human; identical to SEQ ID NO: 130154

SEQ ID NO: 173123 - RNA, 64 nt, Human; identical to SEQ ID NO: 130155

SEQ ID NO: 173124 - RNA, 64 nt, Human; identical to SEQ ID NO: 130156

SEQ ID NO: 173125 - RNA, 64 nt, Human; identical to SEQ ID NO: 55060

SEQ ID NO: 173126 - RNA, 64 nt, Human; identical to SEQ ID NO: 130157

SEQ ID NO: 173127 - RNA, 64 nt, Human; identical to SEQ ID NO: 130158

SEQ ID NO: 173128 - RNA, 64 nt, Human; identical to SEQ ID NO: 130159

SEQ ID NO: 173129 - RNA, 64 nt, Human; identical to SEQ ID NO: 130160

SEQ ID NO: 173130 - RNA, 64 nt, Human; identical to SEQ ID NO: 130161

SEQ ID NO: 173131 - RNA, 64 nt, Human; identical to SEQ ID NO: 130162

SEQ ID NO: 173132 - RNA, 64 nt, Human; identical to SEQ ID NO: 130163

SEQ ID NO: 173133 - RNA, 64 nt, Human; identical to SEQ ID NO: 130164

SEQ ID NO: 173134 - RNA, 64 nt, Human; identical to SEQ ID NO: 130165

SEQ ID NO: 173135 - RNA, 64 nt, Human; identical to SEQ ID NO: 130166

SEQ ID NO: 173136 - RNA, 64 nt, Human; identical to SEQ ID NO: 130167

SEQ ID NO: 173137 - RNA, 64 nt, Human; identical to SEQ ID NO: 130168

SEQ ID NO: 173138 - RNA, 64 nt, Human; identical to SEQ ID NO: 130169

SEQ ID NO: 173139 - RNA, 64 nt, Human; identical to SEQ ID NO: 130170

SEQ ID NO: 173140 - RNA, 64 nt, Human; identical to SEQ ID NO: 130171

SEQ ID NO: 173141 - RNA, 64 nt, Human; identical to SEQ ID NO: 130172

SEQ ID NO: 173142 - RNA, 64 nt, Human; identical to SEQ ID NO: 130173

SEQ ID NO: 173143 - RNA, 64 nt, Human; identical to SEQ ID NO: 84750

SEQ ID NO: 173144 - RNA, 64 nt, Human; identical to SEQ ID NO: 130174

SEQ ID NO: 173145 - RNA, 64 nt, Human; identical to SEQ ID NO: 130175

SEQ ID NO: 173146 - RNA, 64 nt, Human; identical to SEQ ID NO: 130176

SEQ ID NO: 173147 - RNA, 64 nt, Human; identical to SEQ ID NO: 130177

SEQ ID NO: 173148 - RNA, 64 nt, Human; identical to SEQ ID NO: 130178

SEQ ID NO: 173149 - RNA, 64 nt, Human; identical to SEQ ID NO: 130179

SEQ ID NO: 173150 - RNA, 64 nt, Human; identical to SEQ ID NO: 130180

SEQ ID NO: 173151 - RNA, 64 nt, Human; identical to SEQ ID NO: 130181

SEQ ID NO: 173152 - RNA, 64 nt, Human; identical to SEQ ID NO: 130182

SEQ ID NO: 173153 - RNA, 64 nt, Human; identical to SEQ ID NO: 130183

SEQ ID NO: 173154 - RNA, 64 nt, Human; identical to SEQ ID NO: 130184

SEQ ID NO: 173155 - RNA, 64 nt, Human; identical to SEQ ID NO: 130185

SEQ ID NO: 173156 - RNA, 64 nt, Human; identical to SEQ ID NO: 130186

SEQ ID NO: 173157 - RNA, 64 nt, Human; identical to SEQ ID NO: 130187

SEQ ID NO: 173158 - RNA, 64 nt, Human; identical to SEQ ID NO: 130188

SEQ ID NO: 173159 - RNA, 64 nt, Human; identical to SEQ ID NO: 130189

SEQ ID NO: 173160 - RNA, 64 nt, Human; identical to SEQ ID NO: 130190

SEQ ID NO: 173161 - RNA, 64 nt, Human; identical to SEQ ID NO: 130191

SEQ ID NO: 173162 - RNA, 64 nt, Human; identical to SEQ ID NO: 130192

SEQ ID NO: 173163 - RNA, 64 nt, Human; identical to SEQ ID NO: 130193

SEQ ID NO: 173164 - RNA, 64 nt, Human; identical to SEQ ID NO: 130194

SEQ ID NO: 173165 - RNA, 64 nt, Human; identical to SEQ ID NO: 130195

SEQ ID NO: 173166 - RNA, 64 nt, Human; identical to SEQ ID NO: 130196

SEQ ID NO: 173167 - RNA, 64 nt, Human; identical to SEQ ID NO: 130197

SEQ ID NO: 173168 - RNA, 64 nt, Human; identical to SEQ ID NO: 130198

SEQ ID NO: 173169 - RNA, 64 nt, Human; identical to SEQ ID NO: 130199

SEQ ID NO: 173170 - RNA, 64 nt, Human; identical to SEQ ID NO: 130200

SEQ ID NO: 173171 - RNA, 64 nt, Human; identical to SEQ ID NO: 130201

SEQ ID NO: 173172 - RNA, 64 nt, Human; identical to SEQ ID NO: 130202

SEQ ID NO: 173173 - RNA, 64 nt, Human; identical to SEQ ID NO: 130203

SEQ ID NO: 173174 - RNA, 64 nt, Human; identical to SEQ ID NO: 130204

SEQ ID NO: 173175 - RNA, 64 nt, Human; identical to SEQ ID NO: 130205

SEQ ID NO: 173176 - RNA, 64 nt, Human; identical to SEQ ID NO: 130206

SEQ ID NO: 173177 - RNA, 64 nt, Human; identical to SEQ ID NO: 130207

SEQ ID NO: 173178 - RNA, 64 nt, Human; identical to SEQ ID NO: 84668

SEQ ID NO: 173179 - RNA, 64 nt, Human; identical to SEQ ID NO: 130208

SEQ ID NO: 173180 - RNA, 64 nt, Human; identical to SEQ ID NO: 130209

SEQ ID NO: 173181 - RNA, 64 nt, Human; identical to SEQ ID NO: 130210

SEQ ID NO: 173182 - RNA, 64 nt, Human; identical to SEQ ID NO: 130211

SEQ ID NO: 173183 - RNA, 64 nt, Human; identical to SEQ ID NO: 130212

SEQ ID NO: 173184 - RNA, 64 nt, Human; identical to SEQ ID NO: 130213

SEQ ID NO: 173185 - RNA, 64 nt, Human; identical to SEQ ID NO: 130214

SEQ ID NO: 173186 - RNA, 64 nt, Human; identical to SEQ ID NO: 130215

SEQ ID NO: 173187 - RNA, 64 nt, Human; identical to SEQ ID NO: 130216

SEQ ID NO: 173188 - RNA, 64 nt, Human; identical to SEQ ID NO: 130217

SEQ ID NO: 173189 - RNA, 64 nt, Human; identical to SEQ ID NO: 130218

SEQ ID NO: 173190 - RNA, 64 nt, Human; identical to SEQ ID NO: 130219

SEQ ID NO: 173191 - RNA, 64 nt, Human; identical to SEQ ID NO: 130220

SEQ ID NO: 173192 - RNA, 64 nt, Human; identical to SEQ ID NO: 130221

SEQ ID NO: 173193 - RNA, 64 nt, Human; identical to SEQ ID NO: 130222

SEQ ID NO: 173194 - RNA, 64 nt, Human; identical to SEQ ID NO: 130223

SEQ ID NO: 173195 - RNA, 64 nt, Human; identical to SEQ ID NO: 130224

SEQ ID NO: 173196 - RNA, 64 nt, Human; identical to SEQ ID NO: 84714

SEQ ID NO: 173197 - RNA, 64 nt, Human; identical to SEQ ID NO: 130225

SEQ ID NO: 173198 - RNA, 64 nt, Human; identical to SEQ ID NO: 130226

SEQ ID NO: 173199 - RNA, 64 nt, Human; identical to SEQ ID NO: 130227

SEQ ID NO: 173200 - RNA, 64 nt, Human; identical to SEQ ID NO: 130228

SEQ ID NO: 173201 - RNA, 64 nt, Human; identical to SEQ ID NO: 130229

SEQ ID NO: 173202 - RNA, 64 nt, Human; identical to SEQ ID NO: 130230

SEQ ID NO: 173203 - RNA, 64 nt, Human; identical to SEQ ID NO: 130231

SEQ ID NO: 173204 - RNA, 64 nt, Human; identical to SEQ ID NO: 130232

SEQ ID NO: 173205 - RNA, 64 nt, Human; identical to SEQ ID NO: 130233

SEQ ID NO: 173206 - RNA, 64 nt, Human; identical to SEQ ID NO: 130234

SEQ ID NO: 173207 - RNA, 64 nt, Human; identical to SEQ ID NO: 130235

SEQ ID NO: 173208 - RNA, 64 nt, Human; identical to SEQ ID NO: 130236

SEQ ID NO: 173209 - RNA, 64 nt, Human; identical to SEQ ID NO: 130237

SEQ ID NO: 173210 - RNA, 64 nt, Human; identical to SEQ ID NO: 130238

SEQ ID NO: 173211 - RNA, 64 nt, Human; identical to SEQ ID NO: 130239

SEQ ID NO: 173212 - RNA, 64 nt, Human; identical to SEQ ID NO: 130240

SEQ ID NO: 173213 - RNA, 64 nt, Human; identical to SEQ ID NO: 130241

SEQ ID NO: 173214 - RNA, 64 nt, Human; identical to SEQ ID NO: 130242

SEQ ID NO: 173215 - RNA, 64 nt, Human; identical to SEQ ID NO: 130243

SEQ ID NO: 173216 - RNA, 64 nt, Human; identical to SEQ ID NO: 130244

SEQ ID NO: 173217 - RNA, 64 nt, Human; identical to SEQ ID NO: 130245

SEQ ID NO: 173218 - RNA, 64 nt, Human; identical to SEQ ID NO: 130246

SEQ ID NO: 173219 - RNA, 64 nt, Human; identical to SEQ ID NO: 130247

SEQ ID NO: 173220 - RNA, 64 nt, Human; identical to SEQ ID NO: 130248

SEQ ID NO: 173221 - RNA, 64 nt, Human; identical to SEQ ID NO: 130249

SEQ ID NO: 173222 - RNA, 64 nt, Human; identical to SEQ ID NO: 130250

SEQ ID NO: 173223 - RNA, 64 nt, Human; identical to SEQ ID NO: 130251

SEQ ID NO: 173224 - RNA, 64 nt, Human; identical to SEQ ID NO: 130252

SEQ ID NO: 173225 - RNA, 64 nt, Human; identical to SEQ ID NO: 130253

SEQ ID NO: 173226 - RNA, 64 nt, Human; identical to SEQ ID NO: 130254

SEQ ID NO: 173227 - RNA, 64 nt, Human; identical to SEQ ID NO: 130255

SEQ ID NO: 173228 - RNA, 64 nt, Human; identical to SEQ ID NO: 130256

SEQ ID NO: 173229 - RNA, 64 nt, Human; identical to SEQ ID NO: 130257

SEQ ID NO: 173230 - RNA, 64 nt, Human; identical to SEQ ID NO: 130258

SEQ ID NO: 173231 - RNA, 64 nt, Human; identical to SEQ ID NO: 84672

SEQ ID NO: 173232 - RNA, 64 nt, Human; identical to SEQ ID NO: 130259

SEQ ID NO: 173233 - RNA, 64 nt, Human; identical to SEQ ID NO: 130260

SEQ ID NO: 173234 - RNA, 64 nt, Human; identical to SEQ ID NO: 130261

SEQ ID NO: 173235 - RNA, 64 nt, Human; identical to SEQ ID NO: 130262

SEQ ID NO: 173236 - RNA, 64 nt, Human; identical to SEQ ID NO: 130263

SEQ ID NO: 173237 - RNA, 64 nt, Human; identical to SEQ ID NO: 130264

SEQ ID NO: 173238 - RNA, 64 nt, Human; identical to SEQ ID NO: 130265

SEQ ID NO: 173239 - RNA, 64 nt, Human; identical to SEQ ID NO: 130266

SEQ ID NO: 173240 - RNA, 64 nt, Human; identical to SEQ ID NO: 130267

SEQ ID NO: 173241 - RNA, 64 nt, Human; identical to SEQ ID NO: 130268

SEQ ID NO: 173242 - RNA, 64 nt, Human; identical to SEQ ID NO: 130269

SEQ ID NO: 173243 - RNA, 64 nt, Human; identical to SEQ ID NO: 130270

SEQ ID NO: 173244 - RNA, 64 nt, Human; identical to SEQ ID NO: 130271

SEQ ID NO: 173245 - RNA, 64 nt, Human; identical to SEQ ID NO: 130272

SEQ ID NO: 173246 - RNA, 64 nt, Human; identical to SEQ ID NO: 130273

SEQ ID NO: 173247 - RNA, 64 nt, Human; identical to SEQ ID NO: 130274

SEQ ID NO: 173248 - RNA, 64 nt, Human; identical to SEQ ID NO: 130275

SEQ ID NO: 173249 - RNA, 64 nt, Human; identical to SEQ ID NO: 84782

SEQ ID NO: 173250 - RNA, 64 nt, Human; identical to SEQ ID NO: 130276

SEQ ID NO: 173251 - RNA, 64 nt, Human; identical to SEQ ID NO: 130277

SEQ ID NO: 173252 - RNA, 64 nt, Human; identical to SEQ ID NO: 130278

SEQ ID NO: 173253 - RNA, 64 nt, Human; identical to SEQ ID NO: 130279

SEQ ID NO: 173254 - RNA, 64 nt, Human; identical to SEQ ID NO: 130280

SEQ ID NO: 173255 - RNA, 64 nt, Human; identical to SEQ ID NO: 130281

SEQ ID NO: 173256 - RNA, 64 nt, Human; identical to SEQ ID NO: 130282

SEQ ID NO: 173257 - RNA, 64 nt, Human; identical to SEQ ID NO: 130283

SEQ ID NO: 173258 - RNA, 64 nt, Human; identical to SEQ ID NO: 130284

SEQ ID NO: 173259 - RNA, 64 nt, Human; identical to SEQ ID NO: 130285

SEQ ID NO: 173260 - RNA, 64 nt, Human; identical to SEQ ID NO: 130286

SEQ ID NO: 173261 - RNA, 64 nt, Human; identical to SEQ ID NO: 130287

SEQ ID NO: 173262 - RNA, 64 nt, Human; identical to SEQ ID NO: 130288

SEQ ID NO: 173263 - RNA, 64 nt, Human; identical to SEQ ID NO: 130289

SEQ ID NO: 173264 - RNA, 64 nt, Human; identical to SEQ ID NO: 130290

SEQ ID NO: 173265 - RNA, 64 nt, Human; identical to SEQ ID NO: 130291

SEQ ID NO: 173266 - RNA, 64 nt, Human; identical to SEQ ID NO: 130292

SEQ ID NO: 173267 - RNA, 64 nt, Human; identical to SEQ ID NO: 84626

SEQ ID NO: 173268 - RNA, 64 nt, Human; identical to SEQ ID NO: 130293

SEQ ID NO: 173269 - RNA, 64 nt, Human; identical to SEQ ID NO: 130294

SEQ ID NO: 173270 - RNA, 64 nt, Human; identical to SEQ ID NO: 130295

SEQ ID NO: 173271 - RNA, 64 nt, Human; identical to SEQ ID NO: 130296

SEQ ID NO: 173272 - RNA, 64 nt, Human; identical to SEQ ID NO: 130297

SEQ ID NO: 173273 - RNA, 64 nt, Human; identical to SEQ ID NO: 130298

SEQ ID NO: 173274 - RNA, 64 nt, Human; identical to SEQ ID NO: 130299

SEQ ID NO: 173275 - RNA, 64 nt, Human; identical to SEQ ID NO: 130300

SEQ ID NO: 173276 - RNA, 64 nt, Human; identical to SEQ ID NO: 130301

SEQ ID NO: 173277 - RNA, 64 nt, Human; identical to SEQ ID NO: 130302

SEQ ID NO: 173278 - RNA, 64 nt, Human; identical to SEQ ID NO: 130303

SEQ ID NO: 173279 - RNA, 64 nt, Human; identical to SEQ ID NO: 130304

SEQ ID NO: 173280 - RNA, 64 nt, Human; identical to SEQ ID NO: 130305

SEQ ID NO: 173281 - RNA, 64 nt, Human; identical to SEQ ID NO: 130306

SEQ ID NO: 173282 - RNA, 64 nt, Human; identical to SEQ ID NO: 130307

SEQ ID NO: 173283 - RNA, 64 nt, Human; identical to SEQ ID NO: 130308

SEQ ID NO: 173284 - RNA, 64 nt, Human; identical to SEQ ID NO: 130309

SEQ ID NO: 173285 - RNA, 64 nt, Human; identical to SEQ ID NO: 84676

SEQ ID NO: 173286 - RNA, 64 nt, Human; identical to SEQ ID NO: 130310

SEQ ID NO: 173287 - RNA, 64 nt, Human; identical to SEQ ID NO: 130311

SEQ ID NO: 173288 - RNA, 64 nt, Human; identical to SEQ ID NO: 130312

SEQ ID NO: 173289 - RNA, 64 nt, Human; identical to SEQ ID NO: 130313

SEQ ID NO: 173290 - RNA, 64 nt, Human; identical to SEQ ID NO: 130314

SEQ ID NO: 173291 - RNA, 64 nt, Human; identical to SEQ ID NO: 130315

SEQ ID NO: 173292 - RNA, 64 nt, Human; identical to SEQ ID NO: 130316

SEQ ID NO: 173293 - RNA, 64 nt, Human; identical to SEQ ID NO: 130317

SEQ ID NO: 173294 - RNA, 64 nt, Human; identical to SEQ ID NO: 130318

SEQ ID NO: 173295 - RNA, 64 nt, Human; identical to SEQ ID NO: 130319

SEQ ID NO: 173296 - RNA, 64 nt, Human; identical to SEQ ID NO: 130320

SEQ ID NO: 173297 - RNA, 64 nt, Human; identical to SEQ ID NO: 130321

SEQ ID NO: 173298 - RNA, 64 nt, Human; identical to SEQ ID NO: 130322

SEQ ID NO: 173299 - RNA, 64 nt, Human; identical to SEQ ID NO: 130323

SEQ ID NO: 173300 - RNA, 64 nt, Human; identical to SEQ ID NO: 130324

SEQ ID NO: 173301 - RNA, 64 nt, Human; identical to SEQ ID NO: 130325

SEQ ID NO: 173302 - RNA, 64 nt, Human; identical to SEQ ID NO: 130326

SEQ ID NO: 173303 - RNA, 64 nt, Human; identical to SEQ ID NO: 84630

SEQ ID NO: 173304 - RNA, 64 nt, Human; identical to SEQ ID NO: 130327

SEQ ID NO: 173305 - RNA, 64 nt, Human; identical to SEQ ID NO: 130328

SEQ ID NO: 173306 - RNA, 64 nt, Human; identical to SEQ ID NO: 130329

SEQ ID NO: 173307 - RNA, 64 nt, Human; identical to SEQ ID NO: 130330

SEQ ID NO: 173308 - RNA, 64 nt, Human; identical to SEQ ID NO: 130331

SEQ ID NO: 173309 - RNA, 64 nt, Human; identical to SEQ ID NO: 130332

SEQ ID NO: 173310 - RNA, 64 nt, Human; identical to SEQ ID NO: 130333

SEQ ID NO: 173311 - RNA, 64 nt, Human; identical to SEQ ID NO: 130334

SEQ ID NO: 173312 - RNA, 64 nt, Human; identical to SEQ ID NO: 130335

SEQ ID NO: 173313 - RNA, 64 nt, Human; identical to SEQ ID NO: 130336

SEQ ID NO: 173314 - RNA, 64 nt, Human; identical to SEQ ID NO: 130337

SEQ ID NO: 173315 - RNA, 64 nt, Human; identical to SEQ ID NO: 130338

SEQ ID NO: 173316 - RNA, 64 nt, Human; identical to SEQ ID NO: 130339

SEQ ID NO: 173317 - RNA, 64 nt, Human; identical to SEQ ID NO: 130340

SEQ ID NO: 173318 - RNA, 64 nt, Human; identical to SEQ ID NO: 130341

SEQ ID NO: 173319 - RNA, 64 nt, Human; identical to SEQ ID NO: 130342

SEQ ID NO: 173320 - RNA, 64 nt, Human; identical to SEQ ID NO: 130343

SEQ ID NO: 173321 - RNA, 64 nt, Human; identical to SEQ ID NO: 84718

SEQ ID NO: 173322 - RNA, 64 nt, Human; identical to SEQ ID NO: 130344

SEQ ID NO: 173323 - RNA, 64 nt, Human; identical to SEQ ID NO: 130345

SEQ ID NO: 173324 - RNA, 64 nt, Human; identical to SEQ ID NO: 130346

SEQ ID NO: 173325 - RNA, 64 nt, Human; identical to SEQ ID NO: 130347

SEQ ID NO: 173326 - RNA, 64 nt, Human; identical to SEQ ID NO: 130348

SEQ ID NO: 173327 - RNA, 64 nt, Human; identical to SEQ ID NO: 130349

SEQ ID NO: 173328 - RNA, 64 nt, Human; identical to SEQ ID NO: 130350

SEQ ID NO: 173329 - RNA, 64 nt, Human; identical to SEQ ID NO: 130351

SEQ ID NO: 173330 - RNA, 64 nt, Human; identical to SEQ ID NO: 130352

SEQ ID NO: 173331 - RNA, 64 nt, Human; identical to SEQ ID NO: 130353

SEQ ID NO: 173332 - RNA, 64 nt, Human; identical to SEQ ID NO: 130354

SEQ ID NO: 173333 - RNA, 64 nt, Human; identical to SEQ ID NO: 130355

SEQ ID NO: 173334 - RNA, 64 nt, Human; identical to SEQ ID NO: 130356

SEQ ID NO: 173335 - RNA, 64 nt, Human; identical to SEQ ID NO: 130357

SEQ ID NO: 173336 - RNA, 64 nt, Human; identical to SEQ ID NO: 130358

SEQ ID NO: 173337 - RNA, 64 nt, Human; identical to SEQ ID NO: 130359

SEQ ID NO: 173338 - RNA, 64 nt, Human; identical to SEQ ID NO: 130360

SEQ ID NO: 173339 - RNA, 64 nt, Human; identical to SEQ ID NO: 130361

SEQ ID NO: 173340 - RNA, 64 nt, Human; identical to SEQ ID NO: 130362

SEQ ID NO: 173341 - RNA, 64 nt, Human; identical to SEQ ID NO: 130363

SEQ ID NO: 173342 - RNA, 64 nt, Human; identical to SEQ ID NO: 130364

SEQ ID NO: 173343 - RNA, 64 nt, Human; identical to SEQ ID NO: 130365

SEQ ID NO: 173344 - RNA, 64 nt, Human; identical to SEQ ID NO: 130366

SEQ ID NO: 173345 - RNA, 64 nt, Human; identical to SEQ ID NO: 130367

SEQ ID NO: 173346 - RNA, 64 nt, Human; identical to SEQ ID NO: 130368

SEQ ID NO: 173347 - RNA, 64 nt, Human; identical to SEQ ID NO: 130369

SEQ ID NO: 173348 - RNA, 64 nt, Human; identical to SEQ ID NO: 130370

SEQ ID NO: 173349 - RNA, 64 nt, Human; identical to SEQ ID NO: 130371

SEQ ID NO: 173350 - RNA, 64 nt, Human; identical to SEQ ID NO: 130372

SEQ ID NO: 173351 - RNA, 64 nt, Human; identical to SEQ ID NO: 130373

SEQ ID NO: 173352 - RNA, 64 nt, Human; identical to SEQ ID NO: 130374

SEQ ID NO: 173353 - RNA, 64 nt, Human; identical to SEQ ID NO: 130375

SEQ ID NO: 173354 - RNA, 64 nt, Human; identical to SEQ ID NO: 130376

SEQ ID NO: 173355 - RNA, 64 nt, Human; identical to SEQ ID NO: 130377

SEQ ID NO: 173356 - RNA, 64 nt, Human; identical to SEQ ID NO: 130378

SEQ ID NO: 173357 - RNA, 64 nt, Human; identical to SEQ ID NO: 130379

SEQ ID NO: 173358 - RNA, 64 nt, Human; identical to SEQ ID NO: 130380

SEQ ID NO: 173359 - RNA, 64 nt, Human; identical to SEQ ID NO: 130381

SEQ ID NO: 173360 - RNA, 64 nt, Human; identical to SEQ ID NO: 130382

SEQ ID NO: 173361 - RNA, 64 nt, Human; identical to SEQ ID NO: 130383

SEQ ID NO: 173362 - RNA, 64 nt, Human; identical to SEQ ID NO: 130384

SEQ ID NO: 173363 - RNA, 64 nt, Human; identical to SEQ ID NO: 130385

SEQ ID NO: 173364 - RNA, 64 nt, Human; identical to SEQ ID NO: 84634

SEQ ID NO: 173365 - RNA, 64 nt, Human; identical to SEQ ID NO: 130386

SEQ ID NO: 173366 - RNA, 64 nt, Human; identical to SEQ ID NO: 130387

SEQ ID NO: 173367 - RNA, 64 nt, Human; identical to SEQ ID NO: 130388

SEQ ID NO: 173368 - RNA, 64 nt, Human; identical to SEQ ID NO: 130389

SEQ ID NO: 173369 - RNA, 64 nt, Human; identical to SEQ ID NO: 130390

SEQ ID NO: 173370 - RNA, 64 nt, Human; identical to SEQ ID NO: 130391

SEQ ID NO: 173371 - RNA, 64 nt, Human; identical to SEQ ID NO: 130392

SEQ ID NO: 173372 - RNA, 64 nt, Human; identical to SEQ ID NO: 130393

SEQ ID NO: 173373 - RNA, 64 nt, Human; identical to SEQ ID NO: 130394

SEQ ID NO: 173374 - RNA, 64 nt, Human; identical to SEQ ID NO: 130395

SEQ ID NO: 173375 - RNA, 64 nt, Human; identical to SEQ ID NO: 130396

SEQ ID NO: 173376 - RNA, 64 nt, Human; identical to SEQ ID NO: 130397

SEQ ID NO: 173377 - RNA, 64 nt, Human; identical to SEQ ID NO: 130398

SEQ ID NO: 173378 - RNA, 64 nt, Human; identical to SEQ ID NO: 130399

SEQ ID NO: 173379 - RNA, 64 nt, Human; identical to SEQ ID NO: 130400

SEQ ID NO: 173380 - RNA, 64 nt, Human; identical to SEQ ID NO: 130401

SEQ ID NO: 173381 - RNA, 64 nt, Human; identical to SEQ ID NO: 130402

SEQ ID NO: 173382 - RNA, 64 nt, Human; identical to SEQ ID NO: 84680

SEQ ID NO: 173383 - RNA, 64 nt, Human; identical to SEQ ID NO: 130403

SEQ ID NO: 173384 - RNA, 64 nt, Human; identical to SEQ ID NO: 130404

SEQ ID NO: 173385 - RNA, 64 nt, Human; identical to SEQ ID NO: 130405

SEQ ID NO: 173386 - RNA, 64 nt, Human; identical to SEQ ID NO: 130406

SEQ ID NO: 173387 - RNA, 64 nt, Human; identical to SEQ ID NO: 130407

SEQ ID NO: 173388 - RNA, 64 nt, Human; identical to SEQ ID NO: 130408

SEQ ID NO: 173389 - RNA, 64 nt, Human; identical to SEQ ID NO: 130409

SEQ ID NO: 173390 - RNA, 64 nt, Human; identical to SEQ ID NO: 130410

SEQ ID NO: 173391 - RNA, 64 nt, Human; identical to SEQ ID NO: 130411

SEQ ID NO: 173392 - RNA, 64 nt, Human; identical to SEQ ID NO: 130412

SEQ ID NO: 173393 - RNA, 64 nt, Human; identical to SEQ ID NO: 130413

SEQ ID NO: 173394 - RNA, 64 nt, Human; identical to SEQ ID NO: 130414

SEQ ID NO: 173395 - RNA, 64 nt, Human; identical to SEQ ID NO: 130415

SEQ ID NO: 173396 - RNA, 64 nt, Human; identical to SEQ ID NO: 130416

SEQ ID NO: 173397 - RNA, 64 nt, Human; identical to SEQ ID NO: 130417

SEQ ID NO: 173398 - RNA, 64 nt, Human; identical to SEQ ID NO: 130418

SEQ ID NO: 173399 - RNA, 64 nt, Human; identical to SEQ ID NO: 130419

SEQ ID NO: 173400 - RNA, 64 nt, Human; identical to SEQ ID NO: 130420

SEQ ID NO: 173401 - RNA, 64 nt, Human; identical to SEQ ID NO: 130421

SEQ ID NO: 173402 - RNA, 64 nt, Human; identical to SEQ ID NO: 130422

SEQ ID NO: 173403 - RNA, 64 nt, Human; identical to SEQ ID NO: 130423

SEQ ID NO: 173404 - RNA, 64 nt, Human; identical to SEQ ID NO: 130424

SEQ ID NO: 173405 - RNA, 64 nt, Human; identical to SEQ ID NO: 130425

SEQ ID NO: 173406 - RNA, 64 nt, Human; identical to SEQ ID NO: 130426

SEQ ID NO: 173407 - RNA, 64 nt, Human; identical to SEQ ID NO: 130427

SEQ ID NO: 173408 - RNA, 64 nt, Human; identical to SEQ ID NO: 130428

SEQ ID NO: 173409 - RNA, 64 nt, Human; identical to SEQ ID NO: 130429

SEQ ID NO: 173410 - RNA, 64 nt, Human; identical to SEQ ID NO: 130430

SEQ ID NO: 173411 - RNA, 64 nt, Human; identical to SEQ ID NO: 130431

SEQ ID NO: 173412 - RNA, 64 nt, Human; identical to SEQ ID NO: 130432

SEQ ID NO: 173413 - RNA, 64 nt, Human; identical to SEQ ID NO: 130433

SEQ ID NO: 173414 - RNA, 64 nt, Human; identical to SEQ ID NO: 130434

SEQ ID NO: 173415 - RNA, 64 nt, Human; identical to SEQ ID NO: 130435

SEQ ID NO: 173416 - RNA, 64 nt, Human; identical to SEQ ID NO: 130436

SEQ ID NO: 173417 - RNA, 64 nt, Human; identical to SEQ ID NO: 130437

SEQ ID NO: 173418 - RNA, 64 nt, Human; identical to SEQ ID NO: 130438

SEQ ID NO: 173419 - RNA, 64 nt, Human; identical to SEQ ID NO: 130439

SEQ ID NO: 173420 - RNA, 64 nt, Human; identical to SEQ ID NO: 130440

SEQ ID NO: 173421 - RNA, 64 nt, Human; identical to SEQ ID NO: 130441

SEQ ID NO: 173422 - RNA, 64 nt, Human; identical to SEQ ID NO: 130442

SEQ ID NO: 173423 - RNA, 64 nt, Human; identical to SEQ ID NO: 130443

SEQ ID NO: 173424 - RNA, 64 nt, Human; identical to SEQ ID NO: 130444

SEQ ID NO: 173425 - RNA, 64 nt, Human; identical to SEQ ID NO: 130445

SEQ ID NO: 173426 - RNA, 64 nt, Human; identical to SEQ ID NO: 130446

SEQ ID NO: 173427 - RNA, 64 nt, Human; identical to SEQ ID NO: 130447

SEQ ID NO: 173428 - RNA, 64 nt, Human; identical to SEQ ID NO: 130448

SEQ ID NO: 173429 - RNA, 64 nt, Human; identical to SEQ ID NO: 130449

SEQ ID NO: 173430 - RNA, 64 nt, Human; identical to SEQ ID NO: 130450

SEQ ID NO: 173431 - RNA, 64 nt, Human; identical to SEQ ID NO: 130451

SEQ ID NO: 173432 - RNA, 64 nt, Human; identical to SEQ ID NO: 130452

SEQ ID NO: 173433 - RNA, 64 nt, Human; identical to SEQ ID NO: 130453

SEQ ID NO: 173434 - RNA, 64 nt, Human; identical to SEQ ID NO: 130454

SEQ ID NO: 173435 - RNA, 64 nt, Human; identical to SEQ ID NO: 130455

SEQ ID NO: 173436 - RNA, 64 nt, Human; identical to SEQ ID NO: 130456

SEQ ID NO: 173437 - RNA, 64 nt, Human; identical to SEQ ID NO: 130457

SEQ ID NO: 173438 - RNA, 64 nt, Human; identical to SEQ ID NO: 130458

SEQ ID NO: 173439 - RNA, 64 nt, Human; identical to SEQ ID NO: 130459

SEQ ID NO: 173440 - RNA, 64 nt, Human; identical to SEQ ID NO: 130460

SEQ ID NO: 173441 - RNA, 64 nt, Human; identical to SEQ ID NO: 130461

SEQ ID NO: 173442 - RNA, 64 nt, Human; identical to SEQ ID NO: 130462

SEQ ID NO: 173443 - RNA, 64 nt, Human; identical to SEQ ID NO: 130463

SEQ ID NO: 173444 - RNA, 64 nt, Human; identical to SEQ ID NO: 130464

SEQ ID NO: 173445 - RNA, 64 nt, Human; identical to SEQ ID NO: 130465

SEQ ID NO: 173446 - RNA, 64 nt, Human; identical to SEQ ID NO: 130466

SEQ ID NO: 173447 - RNA, 64 nt, Human; identical to SEQ ID NO: 130467

SEQ ID NO: 173448 - RNA, 64 nt, Human; identical to SEQ ID NO: 130468

SEQ ID NO: 173449 - RNA, 64 nt, Human; identical to SEQ ID NO: 130469

SEQ ID NO: 173450 - RNA, 64 nt, Human; identical to SEQ ID NO: 130470

SEQ ID NO: 173451 - RNA, 64 nt, Human; identical to SEQ ID NO: 84638

SEQ ID NO: 173452 - RNA, 64 nt, Human; identical to SEQ ID NO: 130471

SEQ ID NO: 173453 - RNA, 64 nt, Human; identical to SEQ ID NO: 130472

SEQ ID NO: 173454 - RNA, 64 nt, Human; identical to SEQ ID NO: 130473

SEQ ID NO: 173455 - RNA, 51 nt, Human; identical to SEQ ID NO: 130474

SEQ ID NO: 173456 - RNA, 64 nt, Human; identical to SEQ ID NO: 130475

SEQ ID NO: 173457 - RNA, 64 nt, Human; identical to SEQ ID NO: 130476

SEQ ID NO: 173458 - RNA, 64 nt, Human; identical to SEQ ID NO: 130477

SEQ ID NO: 173459 - RNA, 64 nt, Human; identical to SEQ ID NO: 130478

SEQ ID NO: 173460 - RNA, 64 nt, Human; identical to SEQ ID NO: 130479

SEQ ID NO: 173461 - RNA, 64 nt, Human; identical to SEQ ID NO: 130480

SEQ ID NO: 173462 - RNA, 64 nt, Human; identical to SEQ ID NO: 130481

SEQ ID NO: 173463 - RNA, 64 nt, Human; identical to SEQ ID NO: 130482

SEQ ID NO: 173464 - RNA, 64 nt, Human; identical to SEQ ID NO: 130483

SEQ ID NO: 173465 - RNA, 64 nt, Human; identical to SEQ ID NO: 130484

SEQ ID NO: 173466 - RNA, 50 nt, Human; identical to SEQ ID NO: 130485

SEQ ID NO: 173467 - RNA, 64 nt, Human; identical to SEQ ID NO: 130486

SEQ ID NO: 173468 - RNA, 64 nt, Human; identical to SEQ ID NO: 130487

SEQ ID NO: 173469 - RNA, 64 nt, Human; identical to SEQ ID NO: 84754

SEQ ID NO: 173470 - RNA, 64 nt, Human; identical to SEQ ID NO: 130488

SEQ ID NO: 173471 - RNA, 64 nt, Human; identical to SEQ ID NO: 130489

SEQ ID NO: 173472 - RNA, 64 nt, Human; identical to SEQ ID NO: 130490

SEQ ID NO: 173473 - RNA, 64 nt, Human; identical to SEQ ID NO: 130491

SEQ ID NO: 173474 - RNA, 64 nt, Human; identical to SEQ ID NO: 130492

SEQ ID NO: 173475 - RNA, 64 nt, Human; identical to SEQ ID NO: 130493

SEQ ID NO: 173476 - RNA, 64 nt, Human; identical to SEQ ID NO: 130494

SEQ ID NO: 173477 - RNA, 64 nt, Human; identical to SEQ ID NO: 130495

SEQ ID NO: 173478 - RNA, 64 nt, Human; identical to SEQ ID NO: 130496

SEQ ID NO: 173479 - RNA, 64 nt, Human; identical to SEQ ID NO: 130497

SEQ ID NO: 173480 - RNA, 64 nt, Human; identical to SEQ ID NO: 130498

SEQ ID NO: 173481 - RNA, 64 nt, Human; identical to SEQ ID NO: 130499

SEQ ID NO: 173482 - RNA, 64 nt, Human; identical to SEQ ID NO: 130500

SEQ ID NO: 173483 - RNA, 64 nt, Human; identical to SEQ ID NO: 130501

SEQ ID NO: 173484 - RNA, 64 nt, Human; identical to SEQ ID NO: 130502

SEQ ID NO: 173485 - RNA, 64 nt, Human; identical to SEQ ID NO: 130503

SEQ ID NO: 173486 - RNA, 64 nt, Human; identical to SEQ ID NO: 130504

SEQ ID NO: 173487 - RNA, 64 nt, Human; identical to SEQ ID NO: 130505

SEQ ID NO: 173488 - RNA, 64 nt, Human; identical to SEQ ID NO: 130506

SEQ ID NO: 173489 - RNA, 64 nt, Human; identical to SEQ ID NO: 130507

SEQ ID NO: 173490 - RNA, 64 nt, Human; identical to SEQ ID NO: 130508

SEQ ID NO: 173491 - RNA, 64 nt, Human; identical to SEQ ID NO: 130509

SEQ ID NO: 173492 - RNA, 64 nt, Human; identical to SEQ ID NO: 130510

SEQ ID NO: 173493 - RNA, 64 nt, Human; identical to SEQ ID NO: 130511

SEQ ID NO: 173494 - RNA, 64 nt, Human; identical to SEQ ID NO: 130512

SEQ ID NO: 173495 - RNA, 64 nt, Human; identical to SEQ ID NO: 130513

SEQ ID NO: 173496 - RNA, 64 nt, Human; identical to SEQ ID NO: 130514

SEQ ID NO: 173497 - RNA, 64 nt, Human; identical to SEQ ID NO: 130515

SEQ ID NO: 173498 - RNA, 64 nt, Human; identical to SEQ ID NO: 130516

SEQ ID NO: 173499 - RNA, 64 nt, Human; identical to SEQ ID NO: 130517

SEQ ID NO: 173500 - RNA, 64 nt, Human; identical to SEQ ID NO: 130518

SEQ ID NO: 173501 - RNA, 64 nt, Human; identical to SEQ ID NO: 130519

SEQ ID NO: 173502 - RNA, 64 nt, Human; identical to SEQ ID NO: 130520

SEQ ID NO: 173503 - RNA, 64 nt, Human; identical to SEQ ID NO: 130521

SEQ ID NO: 173504 - RNA, 64 nt, Human; identical to SEQ ID NO: 84588

SEQ ID NO: 173505 - RNA, 64 nt, Human; identical to SEQ ID NO: 130522

SEQ ID NO: 173506 - RNA, 64 nt, Human; identical to SEQ ID NO: 130523

SEQ ID NO: 173507 - RNA, 64 nt, Human; identical to SEQ ID NO: 130524

SEQ ID NO: 173508 - RNA, 64 nt, Human; identical to SEQ ID NO: 130525

SEQ ID NO: 173509 - RNA, 64 nt, Human; identical to SEQ ID NO: 130526

SEQ ID NO: 173510 - RNA, 64 nt, Human; identical to SEQ ID NO: 130527

SEQ ID NO: 173511 - RNA, 64 nt, Human; identical to SEQ ID NO: 130528

SEQ ID NO: 173512 - RNA, 64 nt, Human; identical to SEQ ID NO: 130529

SEQ ID NO: 173513 - RNA, 64 nt, Human; identical to SEQ ID NO: 130530

SEQ ID NO: 173514 - RNA, 64 nt, Human; identical to SEQ ID NO: 130531

SEQ ID NO: 173515 - RNA, 64 nt, Human; identical to SEQ ID NO: 130532

SEQ ID NO: 173516 - RNA, 64 nt, Human; identical to SEQ ID NO: 130533

SEQ ID NO: 173517 - RNA, 64 nt, Human; identical to SEQ ID NO: 130534

SEQ ID NO: 173518 - RNA, 64 nt, Human; identical to SEQ ID NO: 130535

SEQ ID NO: 173519 - RNA, 64 nt, Human; identical to SEQ ID NO: 130536

SEQ ID NO: 173520 - RNA, 64 nt, Human; identical to SEQ ID NO: 130537

SEQ ID NO: 173521 - RNA, 64 nt, Human; identical to SEQ ID NO: 130538

SEQ ID NO: 173522 - RNA, 64 nt, Human; identical to SEQ ID NO: 84642

SEQ ID NO: 173523 - RNA, 64 nt, Human; identical to SEQ ID NO: 130539

SEQ ID NO: 173524 - RNA, 64 nt, Human; identical to SEQ ID NO: 130540

SEQ ID NO: 173525 - RNA, 64 nt, Human; identical to SEQ ID NO: 130541

SEQ ID NO: 173526 - RNA, 64 nt, Human; identical to SEQ ID NO: 130542

SEQ ID NO: 173527 - RNA, 64 nt, Human; identical to SEQ ID NO: 130543

SEQ ID NO: 173528 - RNA, 64 nt, Human; identical to SEQ ID NO: 130544

SEQ ID NO: 173529 - RNA, 64 nt, Human; identical to SEQ ID NO: 130545

SEQ ID NO: 173530 - RNA, 64 nt, Human; identical to SEQ ID NO: 130546

SEQ ID NO: 173531 - RNA, 64 nt, Human; identical to SEQ ID NO: 130547

SEQ ID NO: 173532 - RNA, 54 nt, Human; identical to SEQ ID NO: 130548

SEQ ID NO: 173533 - RNA, 64 nt, Human; identical to SEQ ID NO: 130549

SEQ ID NO: 173534 - RNA, 64 nt, Human; identical to SEQ ID NO: 130550

SEQ ID NO: 173535 - RNA, 64 nt, Human; identical to SEQ ID NO: 130551

SEQ ID NO: 173536 - RNA, 64 nt, Human; identical to SEQ ID NO: 130552

SEQ ID NO: 173537 - RNA, 64 nt, Human; identical to SEQ ID NO: 130553

SEQ ID NO: 173538 - RNA, 64 nt, Human; identical to SEQ ID NO: 130554

SEQ ID NO: 173539 - RNA, 64 nt, Human; identical to SEQ ID NO: 130555

SEQ ID NO: 173540 - RNA, 64 nt, Human; identical to SEQ ID NO: 84592

SEQ ID NO: 173541 - RNA, 64 nt, Human; identical to SEQ ID NO: 130556

SEQ ID NO: 173542 - RNA, 64 nt, Human; identical to SEQ ID NO: 130557

SEQ ID NO: 173543 - RNA, 64 nt, Human; identical to SEQ ID NO: 130558

SEQ ID NO: 173544 - RNA, 64 nt, Human; identical to SEQ ID NO: 130559

SEQ ID NO: 173545 - RNA, 64 nt, Human; identical to SEQ ID NO: 130560

SEQ ID NO: 173546 - RNA, 64 nt, Human; identical to SEQ ID NO: 130561

SEQ ID NO: 173547 - RNA, 64 nt, Human; identical to SEQ ID NO: 130562

SEQ ID NO: 173548 - RNA, 64 nt, Human; identical to SEQ ID NO: 130563

SEQ ID NO: 173549 - RNA, 64 nt, Human; identical to SEQ ID NO: 130564

SEQ ID NO: 173550 - RNA, 64 nt, Human; identical to SEQ ID NO: 130565

SEQ ID NO: 173551 - RNA, 64 nt, Human; identical to SEQ ID NO: 130566

SEQ ID NO: 173552 - RNA, 64 nt, Human; identical to SEQ ID NO: 130567

SEQ ID NO: 173553 - RNA, 64 nt, Human; identical to SEQ ID NO: 130568

SEQ ID NO: 173554 - RNA, 64 nt, Human; identical to SEQ ID NO: 130569

SEQ ID NO: 173555 - RNA, 64 nt, Human; identical to SEQ ID NO: 130570

SEQ ID NO: 173556 - RNA, 64 nt, Human; identical to SEQ ID NO: 130571

SEQ ID NO: 173557 - RNA, 64 nt, Human; identical to SEQ ID NO: 130572

SEQ ID NO: 173558 - RNA, 64 nt, Human; identical to SEQ ID NO: 84684

SEQ ID NO: 173559 - RNA, 64 nt, Human; identical to SEQ ID NO: 130573

SEQ ID NO: 173560 - RNA, 64 nt, Human; identical to SEQ ID NO: 130574

SEQ ID NO: 173561 - RNA, 64 nt, Human; identical to SEQ ID NO: 130575

SEQ ID NO: 173562 - RNA, 64 nt, Human; identical to SEQ ID NO: 130576

SEQ ID NO: 173563 - RNA, 64 nt, Human; identical to SEQ ID NO: 130577

SEQ ID NO: 173564 - RNA, 64 nt, Human; identical to SEQ ID NO: 130578

SEQ ID NO: 173565 - RNA, 64 nt, Human; identical to SEQ ID NO: 130579

SEQ ID NO: 173566 - RNA, 64 nt, Human; identical to SEQ ID NO: 130580

SEQ ID NO: 173567 - RNA, 64 nt, Human; identical to SEQ ID NO: 130581

SEQ ID NO: 173568 - RNA, 64 nt, Human; identical to SEQ ID NO: 130582

SEQ ID NO: 173569 - RNA, 64 nt, Human; identical to SEQ ID NO: 130583

SEQ ID NO: 173570 - RNA, 64 nt, Human; identical to SEQ ID NO: 130584

SEQ ID NO: 173571 - RNA, 61 nt, Human; identical to SEQ ID NO: 130585

SEQ ID NO: 173572 - RNA, 64 nt, Human; identical to SEQ ID NO: 130586

SEQ ID NO: 173573 - RNA, 64 nt, Human; identical to SEQ ID NO: 130587

SEQ ID NO: 173574 - RNA, 64 nt, Human; identical to SEQ ID NO: 130588

SEQ ID NO: 173575 - RNA, 64 nt, Human; identical to SEQ ID NO: 130589

SEQ ID NO: 173576 - RNA, 64 nt, Human; identical to SEQ ID NO: 84596

SEQ ID NO: 173577 - RNA, 64 nt, Human; identical to SEQ ID NO: 130590

SEQ ID NO: 173578 - RNA, 64 nt, Human; identical to SEQ ID NO: 130591

SEQ ID NO: 173579 - RNA, 64 nt, Human; identical to SEQ ID NO: 130592

SEQ ID NO: 173580 - RNA, 64 nt, Human; identical to SEQ ID NO: 130593

SEQ ID NO: 173581 - RNA, 64 nt, Human; identical to SEQ ID NO: 130594

SEQ ID NO: 173582 - RNA, 64 nt, Human; identical to SEQ ID NO: 130595

SEQ ID NO: 173583 - RNA, 64 nt, Human; identical to SEQ ID NO: 130596

SEQ ID NO: 173584 - RNA, 64 nt, Human; identical to SEQ ID NO: 130597

SEQ ID NO: 173585 - RNA, 64 nt, Human; identical to SEQ ID NO: 130598

SEQ ID NO: 173586 - RNA, 56 nt, Human; identical to SEQ ID NO: 130599

SEQ ID NO: 173587 - RNA, 64 nt, Human; identical to SEQ ID NO: 130600

SEQ ID NO: 173588 - RNA, 64 nt, Human; identical to SEQ ID NO: 130601

SEQ ID NO: 173589 - RNA, 64 nt, Human; identical to SEQ ID NO: 130602

SEQ ID NO: 173590 - RNA, 64 nt, Human; identical to SEQ ID NO: 130603

SEQ ID NO: 173591 - RNA, 64 nt, Human; identical to SEQ ID NO: 130604

SEQ ID NO: 173592 - RNA, 55 nt, Human; identical to SEQ ID NO: 130605

SEQ ID NO: 173593 - RNA, 64 nt, Human; identical to SEQ ID NO: 130606

SEQ ID NO: 173594 - RNA, 64 nt, Human
cuuugggauggcaccuauauuggcugauaauugaggaugcaaacauuccauucauuagugugau

SEQ ID NO: 173595 - RNA, 64 nt, Human; identical to SEQ ID NO: 130607

SEQ ID NO: 173596 - RNA, 64 nt, Human; identical to SEQ ID NO: 130608

SEQ ID NO: 173597 - RNA, 64 nt, Human; identical to SEQ ID NO: 130609

SEQ ID NO: 173598 - RNA, 64 nt, Human; identical to SEQ ID NO: 130610

SEQ ID NO: 173599 - RNA, 64 nt, Human; identical to SEQ ID NO: 130611

SEQ ID NO: 173600 - RNA, 64 nt, Human; identical to SEQ ID NO: 130612

SEQ ID NO: 173601 - RNA, 64 nt, Human; identical to SEQ ID NO: 130613

SEQ ID NO: 173602 - RNA, 64 nt, Human; identical to SEQ ID NO: 130614

SEQ ID NO: 173603 - RNA, 64 nt, Human; identical to SEQ ID NO: 130615

SEQ ID NO: 173604 - RNA, 64 nt, Human; identical to SEQ ID NO: 130616

SEQ ID NO: 173605 - RNA, 64 nt, Human; identical to SEQ ID NO: 130617

SEQ ID NO: 173606 - RNA, 64 nt, Human; identical to SEQ ID NO: 130618

SEQ ID NO: 173607 - RNA, 64 nt, Human; identical to SEQ ID NO: 130619

SEQ ID NO: 173608 - RNA, 64 nt, Human; identical to SEQ ID NO: 130620

SEQ ID NO: 173609 - RNA, 64 nt, Human; identical to SEQ ID NO: 130621

SEQ ID NO: 173610 - RNA, 64 nt, Human; identical to SEQ ID NO: 130622

SEQ ID NO: 173611 - RNA, 64 nt, Human; identical to SEQ ID NO: 130623

SEQ ID NO: 173612 - RNA, 64 nt, Human; identical to SEQ ID NO: 84646

SEQ ID NO: 173613 - RNA, 64 nt, Human; identical to SEQ ID NO: 130624

SEQ ID NO: 173614 - RNA, 64 nt, Human; identical to SEQ ID NO: 130625

SEQ ID NO: 173615 - RNA, 64 nt, Human; identical to SEQ ID NO: 130626

SEQ ID NO: 173616 - RNA, 64 nt, Human; identical to SEQ ID NO: 130627

SEQ ID NO: 173617 - RNA, 64 nt, Human; identical to SEQ ID NO: 130628

SEQ ID NO: 173618 - RNA, 64 nt, Human; identical to SEQ ID NO: 130629

SEQ ID NO: 173619 - RNA, 64 nt, Human; identical to SEQ ID NO: 130630

SEQ ID NO: 173620 - RNA, 64 nt, Human; identical to SEQ ID NO: 130631

SEQ ID NO: 173621 - RNA, 64 nt, Human; identical to SEQ ID NO: 130632

SEQ ID NO: 173622 - RNA, 64 nt, Human; identical to SEQ ID NO: 130633

SEQ ID NO: 173623 - RNA, 64 nt, Human; identical to SEQ ID NO: 130634

SEQ ID NO: 173624 - RNA, 64 nt, Human; identical to SEQ ID NO: 130635

SEQ ID NO: 173625 - RNA, 64 nt, Human; identical to SEQ ID NO: 130636

SEQ ID NO: 173626 - RNA, 64 nt, Human; identical to SEQ ID NO: 130637

SEQ ID NO: 173627 - RNA, 64 nt, Human; identical to SEQ ID NO: 130638

SEQ ID NO: 173628 - RNA, 64 nt, Human; identical to SEQ ID NO: 130639

SEQ ID NO: 173629 - RNA, 64 nt, Human; identical to SEQ ID NO: 130640

SEQ ID NO: 173630 - RNA, 64 nt, Human
ccucuguguuagggaaaauauggaacuucucccuggaugcaaaaccuaugaguauauuaauauu

SEQ ID NO: 173631 - RNA, 64 nt, Human; identical to SEQ ID NO: 130641

SEQ ID NO: 173632 - RNA, 64 nt, Human; identical to SEQ ID NO: 130642

SEQ ID NO: 173633 - RNA, 64 nt, Human; identical to SEQ ID NO: 130643

SEQ ID NO: 173634 - RNA, 64 nt, Human; identical to SEQ ID NO: 130644

SEQ ID NO: 173635 - RNA, 64 nt, Human; identical to SEQ ID NO: 130645

SEQ ID NO: 173636 - RNA, 64 nt, Human; identical to SEQ ID NO: 130646

SEQ ID NO: 173637 - RNA, 64 nt, Human; identical to SEQ ID NO: 130647

SEQ ID NO: 173638 - RNA, 64 nt, Human; identical to SEQ ID NO: 130648

SEQ ID NO: 173639 - RNA, 64 nt, Human; identical to SEQ ID NO: 130649

SEQ ID NO: 173640 - RNA, 64 nt, Human; identical to SEQ ID NO: 130650

SEQ ID NO: 173641 - RNA, 64 nt, Human; identical to SEQ ID NO: 130651

SEQ ID NO: 173642 - RNA, 64 nt, Human; identical to SEQ ID NO: 130652

SEQ ID NO: 173643 - RNA, 64 nt, Human; identical to SEQ ID NO: 130653

SEQ ID NO: 173644 - RNA, 64 nt, Human; identical to SEQ ID NO: 130654

SEQ ID NO: 173645 - RNA, 64 nt, Human; identical to SEQ ID NO: 130655

SEQ ID NO: 173646 - RNA, 64 nt, Human; identical to SEQ ID NO: 130656

SEQ ID NO: 173647 - RNA, 64 nt, Human; identical to SEQ ID NO: 130657

SEQ ID NO: 173648 - RNA, 64 nt, Human; identical to SEQ ID NO: 130658

SEQ ID NO: 173649 - RNA, 64 nt, Human; identical to SEQ ID NO: 130659

SEQ ID NO: 173650 - RNA, 64 nt, Human; identical to SEQ ID NO: 130660

SEQ ID NO: 173651 - RNA, 64 nt, Human; identical to SEQ ID NO: 130661

SEQ ID NO: 173652 - RNA, 64 nt, Human; identical to SEQ ID NO: 130662

SEQ ID NO: 173653 - RNA, 64 nt, Human; identical to SEQ ID NO: 130663

SEQ ID NO: 173654 - RNA, 64 nt, Human; identical to SEQ ID NO: 130664

SEQ ID NO: 173655 - RNA, 64 nt, Human; identical to SEQ ID NO: 130665

SEQ ID NO: 173656 - RNA, 64 nt, Human; identical to SEQ ID NO: 130666

SEQ ID NO: 173657 - RNA, 64 nt, Human; identical to SEQ ID NO: 130667

SEQ ID NO: 173658 - RNA, 64 nt, Human; identical to SEQ ID NO: 130668

SEQ ID NO: 173659 - RNA, 64 nt, Human; identical to SEQ ID NO: 130669

SEQ ID NO: 173660 - RNA, 64 nt, Human; identical to SEQ ID NO: 130670

SEQ ID NO: 173661 - RNA, 64 nt, Human; identical to SEQ ID NO: 130671

SEQ ID NO: 173662 - RNA, 64 nt, Human; identical to SEQ ID NO: 130672

SEQ ID NO: 173663 - RNA, 64 nt, Human
agcucuuuaaauagcugcccaucuccugugauugcacaaccaagcacuuugacauuugcaccuu

SEQ ID NO: 173664 - RNA, 64 nt, Human
caguucacuuccuagagcaucugucccacugggacacaaccacuaauuugucacuggaaccucc

SEQ ID NO: 173665 - RNA, 64 nt, Human
caguuccagucagccccugccacugugagaaugacacaaccauuuccuacacaguuugcacccc

SEQ ID NO: 173666 - RNA, 64 nt, Human
cuaauugugccaggggcuguuauauacauauauacacaaccaaggugugaucugaauuuaaucc

SEQ ID NO: 173667 - RNA, 64 nt, Human
gccuuugcucacggguggcccugcccaccccuggcacaaccaaaaucccacugaugcccaucau

SEQ ID NO: 173668 - RNA, 64 nt, Human
auaauucaaguguucuuccacacagcguugcccccacaaccacgccggacgugcccccucgcca

SEQ ID NO: 173669 - RNA, 64 nt, Human
ccccgaguggggagcaggguucuccucaaagccucacaaccauaggaucauaggaaaggggccc

SEQ ID NO: 173670 - RNA, 64 nt, Human
gaccccaggccggggcauugccagggaggacccucacaaccacguacaugacccuuucuccuuc

SEQ ID NO: 173671 - RNA, 64 nt, Human
uuauguuaagaggcuuuaagauuuaaaaguuucacacaaccauaaguauaguauuucaugccag

SEQ ID NO: 173672 - RNA, 64 nt, Human
aucauuccuuuccaguucauaaacaacaggcacccacaaccagaggaaucuauaguuuaagcuc

SEQ ID NO: 173673 - RNA, 64 nt, Human
gauccaagugcagugguauuuacaacuaauugaucacaaccaguuuguagauuucuuuguuccu

SEQ ID NO: 173674 - RNA, 64 nt, Human
ccugcauugcucucccucgugcuccccaaaucaccacaaccaaccaauaccgcgauccaugagg

SEQ ID NO: 173675 - RNA, 64 nt, Human
uguucagccugaccccgccucaccaauacacggacacaaccaaaucauaacauauagcagacca

SEQ ID NO: 173676 - RNA, 64 nt, Human
cauuaacagcaucuuuaaaacuguguagcuaccucacaaccaguccugucuguuuauagugcug

SEQ ID NO: 173677 - RNA, 64 nt, Human
gggggauacucuguuuaugaaaaagaauaaaaaacacaaccacgaagccacuagagccuuuucc

SEQ ID NO: 173678 - RNA, 64 nt, Human
cauuuuacuuuugcauccaguuuuuauaguuuuccacaaccaagccacccuucacagauaaaau

SEQ ID NO: 173679 - RNA, 64 nt, Human
ggagauacaauucaaguugagauuuguggggggacacaaccaaaccauaucagcauccuuucaa

SEQ ID NO: 173680 - RNA, 64 nt, Human
uugguguucuugacaaguaccaggcuuucucagccacaaccaguggauucauucaaaaucuagg

SEQ ID NO: 173681 - RNA, 64 nt, Human
acaaagaagaagcaauggucgugccaaagagguccacaaccaggugugcacuguucacugcagc

SEQ ID NO: 173682 - RNA, 64 nt, Human
auuuuuacaguucucccaagggaguuaggcuauucacaaccacucauucaaaaguugaaauuaa

SEQ ID NO: 173683 - RNA, 64 nt, Human
ccaacaaggccauggcucuguguccuugagugggcacaaccauuccuagccaaguuuaagaggc

SEQ ID NO: 173684 - RNA, 64 nt, Human
cagagguuagugaaauucacaucaaagucaaacccacaaccaagucguccacaaauacuucacu

SEQ ID NO: 173685 - RNA, 64 nt, Human
gcuggucaagacggucacgggagcucuaggugggcacaaccaaccccucuccugggaggccccu

SEQ ID NO: 173686 - RNA, 64 nt, Human
ucauagucugugaugaagaguagugaauacaacacacaaccaggcagccuucuugacuauacuu

SEQ ID NO: 173687 - RNA, 63 nt, Human
acuaccuaggcuucaucuuuucaacauaugucuacacaaccagaaaaaaaugaaauugaaaca

SEQ ID NO: 173688 - RNA, 64 nt, Human
gcagauucaagagccagcaggucaaaaaggccaacacaaccauaagcagccagacccacaaggc

SEQ ID NO: 173689 - RNA, 64 nt, Human
agaaggaaccuggguggggagggcgaagggggugcacaaccagggcaaggcuccccacuuccuu

SEQ ID NO: 173690 - RNA, 64 nt, Human
agaguuuuagccgucuuguguuucuuguuuacuucacaaccaaauuuguccccucuucucucug

SEQ ID NO: 173691 - RNA, 64 nt, Human
ggcaggugucacaaagaagagggcccuaagggcucacaaccaaagugauccgccaagcagggca

SEQ ID NO: 173692 - RNA, 64 nt, Human
ggaggcgagggaagagcccuagcagggcggccaucacaaccacucacugagaguugcccuucuu

SEQ ID NO: 173693 - RNA, 64 nt, Human
gcuguuggaggagucuucuugaggaucuuuauugcacaaccagccuggguucuaagaaagccua

SEQ ID NO: 173694 - RNA, 64 nt, Human
cugcuucugauacuaaggacguauccaggaguaccacaaccaccaccagugcuaccaccguugc

SEQ ID NO: 173695 - RNA, 64 nt, Human
uguaugugaaaauaaagaaauacaucauuguauucacaaccaugugucuucauuuauaacuuuu

SEQ ID NO: 173696 - RNA, 64 nt, Human
caacuguggauacccuuacccuuuccuccuuuaucacaaccaccguuacaaguauacuuauauu

SEQ ID NO: 173697 - RNA, 64 nt, Human
cugcugucgcuaccacugugcacaucugaaaacucacaaccaagaaaauccauucuauuuucuu

SEQ ID NO: 173698 - RNA, 64 nt, Human
cugagcacuuaccauguaccagaauuuuacuaggcacaaccaugaauaaaaauacaauucucuu

SEQ ID NO: 173699 - RNA, 64 nt, Human
agaaguuaaauacaugcaugcacaugaaaacaugcacaaccacagccucaaucuuguauuuagu

SEQ ID NO: 173700 - RNA, 64 nt, Human
gcaagaacuuaagguccucaccuaauuccuccaucacaaccauuaacucuuauuggacaagcuc

SEQ ID NO: 173701 - RNA, 64 nt, Human
cucagcuguggccaccaacacacaaccacacacacacaaccacacacacaaaugggggcaacca

SEQ ID NO: 173702 - RNA, 64 nt, Human
ucuggugacagaggcucagcuguggccaccaacacacaaccacacacacacaaccacacacaca

SEQ ID NO: 173703 - RNA, 64 nt, Human
gguacuaagacuagcaggggacaccaagacucugcacaaccagauugcuugugcagagggccac

SEQ ID NO: 173704 - RNA, 64 nt, Human
cccccugaggcccagagacaugcagcucucuguccacaaccaugccacuugcaugggagcccug

SEQ ID NO: 173705 - RNA, 64 nt, Human
uuaccccaaaacaagugucaauuaagaauuugaacacaaccacauuuuuuaaaaugaaacuucu

SEQ ID NO: 173706 - RNA, 64 nt, Human
caaaaaaaccucuaugcaaucugaguagagcagccacaaccaaaaaauucuacaacacacacug

SEQ ID NO: 173707 - RNA, 64 nt, Human
gaguugcaguaauuuguuugcuuguuuguuuaaccacaaccacuauuuuaaugauauacuaaag

SEQ ID NO: 173708 - RNA, 64 nt, Human
auagucaugugcgaggucaaaacugagucaccaccacaaccaaguuccagcuggcaagaagagg

SEQ ID NO: 173709 - RNA, 64 nt, Human
augcaauuuucugccaccacuccaaauacuccuccacaaccagcgucccugucacuaauugcga

SEQ ID NO: 173710 - RNA, 64 nt, Human
uauuuauuuuccauaugguucauguucaaauguucacaaccacaaugcaucugacugcaauaau

SEQ ID NO: 173711 - RNA, 64 nt, Human
uacaaugugugguuaaaugaugcuaaaauauuuucacaaccagaguagaaaacgugcuggaaca

SEQ ID NO: 173712 - RNA, 64 nt, Human
uccuuccacugaguccgcugaagggauuuaugugcacaaccaccaugugucuucuaggugcugg

SEQ ID NO: 173713 - RNA, 64 nt, Human
gaauuuugaaaagaggaauauauaacucaauuuucacaaccacauuuaccaaaaaaagagauca

SEQ ID NO: 173714 - RNA, 64 nt, Human
gagcaaaggaguugaccuucugauugaauauaagcacaaccauauuaaaugaaucaauacaaga

SEQ ID NO: 173715 - RNA, 64 nt, Human
aacauauuaaaggauguggcuuuauuuuauaaaucacaaccaucccaacaguggauuuaaacaa

SEQ ID NO: 173716 - RNA, 64 nt, Human
gcuuccccaucuggugcuuuucccauggagaacacacaaccaguaagugagguugccccacaca

SEQ ID NO: 173717 - RNA, 64 nt, Human
ucuuuugucuacaaaaugcuucuaguccaggaggcacaaccaagaacugggauuaaugaagcau

SEQ ID NO: 173718 - RNA, 64 nt, Human
ucuuuuucuuuuuuucuuugguuuaauuuaaagccacaaccacauacaacacaaagagaaaaag

SEQ ID NO: 173719 - RNA, 64 nt, Human
cuuuuuggggggagccuguccccacacaccuuagcacaaccagaaucuugaguugggcagggaa

SEQ ID NO: 173720 - RNA, 64 nt, Human
gcugcuuuuacuuugaugugaucucauugauguacacaaccaaguuccaauaaagugcuagaau

SEQ ID NO: 173721 - RNA, 64 nt, Human
uuuggaguuauucaguuaaugacccuuuaauucucacaaccaaccagucauguugcuugaagcc

SEQ ID NO: 173722 - RNA, 64 nt, Human
uagaaaaauuguuuccaaagugcaugucacaugccacaaccacggucacaccucacugucaucu

SEQ ID NO: 173723 - RNA, 64 nt, Human
uaucaccagacacaccaggcaacagaaguugaagcacaaccacuguagcaaaauaccuugacug

SEQ ID NO: 173724 - RNA, 64 nt, Human
guugcuccuggccucaucagccuccaaacucaaccacaaccagcugccucugcaguuggacaag

SEQ ID NO: 173725 - RNA, 64 nt, Human
cgucacaaaggcuugaucacugccugggcaguggcacaaccaucccccaugucgcuacagaaca

SEQ ID NO: 173726 - RNA, 64 nt, Human
agagcugagggccucccccuccacagcaaccaaucacaaccauaaagcuacaagcacgcacuga

SEQ ID NO: 173727 - RNA, 64 nt, Human
uuaccugggaugaagaauaaagagagcaaacuaccacaaccaaugguugagccccugucaagug

SEQ ID NO: 173728 - RNA, 64 nt, Human
agcuugaaauugcccauggugggagaguuuacaucacaaccacuacaaaucagcacuugcuuuc

SEQ ID NO: 173729 - RNA, 64 nt, Human
uggagugaacaaagagcaugaaaauguugaagaccacaaccaaaauuuacucaaaucaaaguua

SEQ ID NO: 173730 - RNA, 64 nt, Human
uuucuguaagccagagucuugucuaucagauucccacaaccacuccugauucuaaauuuaguga

SEQ ID NO: 173731 - RNA, 64 nt, Human
uugcaucccagggaucccagaguggccugccuaucacaaccacaucccuuccccccacaaggca

SEQ ID NO: 173732 - RNA, 64 nt, Human
uggaguucucaggggggcccugugacccccucuccacaaccauggccagcaucggcuucuugcu

SEQ ID NO: 173733 - RNA, 64 nt, Human
agcgccagucagcaaggaagccgggugucgcucacacaaccagaaggagcugaguuuggcaaca

SEQ ID NO: 173734 - RNA, 64 nt, Human
ugaagggacauaucacugaccuucauaaccacuccacaaccaugaauauuugacaaauuuuuac

SEQ ID NO: 173735 - RNA, 64 nt, Human
ugagagcugcucuggaaaaugugacccagauccucacaaccaccuaaucaggcugaggugucuu

SEQ ID NO: 173736 - RNA, 64 nt, Human
ugacgagcaaaacuccaucucaaaacaaaaguuccacaaccagccuggaguguguagccccuuu

SEQ ID NO: 173737 - RNA, 64 nt, Human
cauuguaaugacaaaauaaauucccgugaaguuccacaaccaggccgggcaugguggcucaugc

SEQ ID NO: 173738 - RNA, 64 nt, Human
cuuacugauauuuuauggaugcagacaauccaugcacaaccacuucuuaugauacuaguuuauu

SEQ ID NO: 173739 - RNA, 64 nt, Human
agaugcccccgugaaugcuuaccugugagauaaccacaaccaggaagaacaaaucugggcauug

SEQ ID NO: 173740 - RNA, 64 nt, Human
gcuuugugauuuuccucugggauaguguacuguacacaaccagauguguuccacacuccgugac

SEQ ID NO: 173741 - RNA, 64 nt, Human
uccucugaaugaaauuaucacagguugucucaagcacaaccaacugaaugucucuuaacugugg

SEQ ID NO: 173742 - RNA, 64 nt, Human
gagguuacuuuguugccuagaaaguucuggaauccacaaccaggggcuggcacuggagccagca

SEQ ID NO: 173743 - RNA, 64 nt, Human
gagaaucagacugacaguuuacagacgcugcugucacaaccaagaauguuaugugcaaguuuau

SEQ ID NO: 173744 - RNA, 64 nt, Human
uucuuaaacagcaaauccagccagguucagauuacacaaccagugucucacucaaaggagcagu

SEQ ID NO: 173745 - RNA, 64 nt, Human
gaagugcgauagugacauuauggaagagucaaaccacaaccauucuuucuugucauaguuccca

SEQ ID NO: 173746 - RNA, 64 nt, Human
agcggguagggcacagggaagagggagggugucucacaaccaaccaguucagaaugauacggaa

SEQ ID NO: 173747 - RNA, 64 nt, Human
agacgugaacucagaacugucggaggaaagacaacacaaccaacgcgaaaccaauuccucaucc

SEQ ID NO: 173748 - RNA, 64 nt, Human
cugacacauuugaguguccaaaauagccaauuaacacaaccaaauacaacugggccaauauaaa

SEQ ID NO: 173749 - RNA, 64 nt, Human
ucucccaugauuccucuggacugcacacagcacccacaaccagccccaugcaugcugcugccuc

SEQ ID NO: 173750 - RNA, 64 nt, Human
acgguccccaccacgacacaaucacguucacaaccacaaccacgcagccacagcuauaaccagc

SEQ ID NO: 173751 - RNA, 64 nt, Human
acaaccacgguccccaccacgacacaaucacguucacaaccacaaccacgcagccacagcuaua

SEQ ID NO: 173752 - RNA, 64 nt, Human
cugucagggaggcccagucacaguccagcaauuccacaaccaccuugacgaaugcuugccaagc

SEQ ID NO: 173753 - RNA, 64 nt, Human
ggcuuugauuuuuaugauuaugaaagaaauaaggcacaaccacaguuuuucuuucuuaaauuuc

SEQ ID NO: 173754 - RNA, 64 nt, Human
uauuuguaguccuaugugaaugagcuuaucccuccacaaccaggugcauaugaaaguguacaua

SEQ ID NO: 173755 - RNA, 64 nt, Human
cucccaaagugcugggauuacagacgugaggcaccacaaccagccuggaugauucuuaagggcc

SEQ ID NO: 173756 - RNA, 64 nt, Human
ucccagagccuccuaaaauucuagccauuugucacacaaccacagcaagaaacguguucuauau

SEQ ID NO: 173757 - RNA, 64 nt, Human
ccaagaugguagaacuagguuaggaaaaauuccacacaaccaaacagucugccuuaaaagugac

SEQ ID NO: 173758 - RNA, 64 nt, Human
gcuaauuccuaaggaaaccugauuaacacaugcucacaaccauccuggucauucucgagcaugu

SEQ ID NO: 173759 - RNA, 64 nt, Human
ccagcacucagcuggccucuggggauucuagcuccacaaccaggccgugaggcuggagaaacug

SEQ ID NO: 173760 - RNA, 64 nt, Human
cccaaacuuaccucagggggugccuccccugcugcacaaccaguaccucguaggucccggagga

SEQ ID NO: 173761 - RNA, 64 nt, Human
ugggggauggauccuccccacacaucugaggacacacaaccacuugguacauuuucucagaugu

SEQ ID NO: 173762 - RNA, 64 nt, Human
gggccucuccguauuugugcauugggcuccgugccacaaccaagcuucauuagucuuaaauuuc

SEQ ID NO: 173763 - RNA, 64 nt, Human
gcuaaaugcuuugcagaaagugaugaccuuacaccacaaccagcuucuccaggucauaugugcc

SEQ ID NO: 173764 - RNA, 64 nt, Human
cccugggccagggugauuggacugagaauuuggccacaaccaaauugaugcuggcuggaaccag

SEQ ID NO: 173765 - RNA, 64 nt, Human
cuuuguacaaaugguuacuguagucacauaguggcacaaccaggccuagcacccaaggcccuca

SEQ ID NO: 173766 - RNA, 64 nt, Human
cucucaccaugcacgcauccauuguccacacacacacaaccagauaaucuucugaaaguguaac

SEQ ID NO: 173767 - RNA, 63 nt, Human
acugucauauuuuguuaauaaaauuuuauuggaacacaaccacauucauuuguuuacuuacug

SEQ ID NO: 173768 - RNA, 64 nt, Human
cugcugguccucaguaccagcgcccggggguguccacaaccacuugggacagaagaagguggaa

SEQ ID NO: 173769 - RNA, 64 nt, Human
ucaguauacuuuaguucuacuuuuuuauuugacucacaaccauucuuaggucucaaguauuccc

SEQ ID NO: 173770 - RNA, 64 nt, Human
uuuggguuauugaacuauuuuuuacuuuugagaccacaaccauauucaauaucauaccauaaug

SEQ ID NO: 173771 - RNA, 64 nt, Human
aaaagagucccagaauguugcuucuauuauugugcacaaccauugagagguguuacaagaaugc

SEQ ID NO: 173772 - RNA, 64 nt, Human
aguuagaauaguuagaacaauucuuauuuaugcccacaaccauugcuauauuuuguauggaugu

SEQ ID NO: 173773 - RNA, 58 nt, Human
agauaaugcuggcugcauaaaacuagggcacaaccauaauggcauuacugacuuccgu

SEQ ID NO: 173774 - RNA, 64 nt, Human
ucagcaggguauuuaagugcuagggcuggucacacacaaccaacugaaaaagacuagagggauu

SEQ ID NO: 173775 - RNA, 64 nt, Human
uacuuuguagccuuggccagaggcucaaaaaggacacaaccaguuuggggaagggguggcuaag

SEQ ID NO: 173776 - RNA, 64 nt, Human
ugcgugcuuuaaaugacaucugccugggauguaccacaaccauauguuaccuguaucuuagggg

SEQ ID NO: 173777 - RNA, 64 nt, Human
cucagccuuccgaguagcugggaccacaggcaugcacaaccacgccuggcuaauuuuuguauuu

SEQ ID NO: 173778 - RNA, 64 nt, Human
cacuagaucccuggaguucaggaaccaacacaagcacaaccacgggcauaaguuggccuuggcc

SEQ ID NO: 173779 - RNA, 64 nt, Human
cuccuuuuuucuuaaagcaaagucacuucuccaucacaaccagauuugaggcugguuuugaugg

SEQ ID NO: 173780 - RNA, 64 nt, Human
gugggcaguauaaagaaaucugucuccacagccacacaaccagagggugcacaugacuugaucc

SEQ ID NO: 173781 - RNA, 64 nt, Human
guuaacaaaguaugccccauuccugugacaaaagcacaaccauucugaaguuacuggagcaugg

SEQ ID NO: 173782 - RNA, 64 nt, Human
ggaauagugggaucaaagcuaggaaaggcagaaacacaaccacucaccaguccuaguuuuagac

SEQ ID NO: 173783 - RNA, 64 nt, Human
agggagagaacugagcaucuccagcauucucagccacaaccaaaaaaaaauaaaaagggcagcc

SEQ ID NO: 173784 - RNA, 64 nt, Human
cucuucucgucauuggagcucaagucaccagccacacaaccagaugagaggucaucuaaguagc

SEQ ID NO: 173785 - RNA, 64 nt, Human
uaccaguaggacauaauuuuuggcucucccuauucacaaccagugcacaguuugacacaguggc

SEQ ID NO: 173786 - RNA, 64 nt, Human
aguuaaguggggggccacuagucuaacagacggucacaaccagugccauggaaaaccaaggaua

SEQ ID NO: 173787 - RNA, 64 nt, Human
caaccacagcagagacuagcagcggggccaccuccacaaccaccaccacaagguaggugcagcg

SEQ ID NO: 173788 - RNA, 64 nt, Human
cuuuccuaagaaaccgcugauaaccaggacaaaacacaaccaaggguacacgcaggcaugcacg

SEQ ID NO: 173789 - RNA, 64 nt, Human
cacucaggaagguaguacaagauacuccauacaacacaaccaugugcuauuuaucauggcauuu

SEQ ID NO: 173790 - RNA, 64 nt, Human
uuucuuagguaauucacugcagguuaagaauccacacaaccaaguucaugggaauuuuguguaa

SEQ ID NO: 173791 - RNA, 64 nt, Human
uuuaaggaugugcaaguacauuuccaacugcuagcacaaccaguauuuuguaauuaaacaaauc

SEQ ID NO: 173792 - RNA, 64 nt, Human
agccggcagaguaggcuguggcuguggacuucagcacaaccaucaacauugcuguucaaagaaa

SEQ ID NO: 173793 - RNA, 64 nt, Human
gagaccaagguuccagcucaaccaauaacuauugcacaaccaucugucccugccucaguucccu

SEQ ID NO: 173794 - RNA, 64 nt, Human
uguguaaacagcagcagucacguuccucggccgccacaaccaacaccaaagcaggaaaaccauu

SEQ ID NO: 173795 - RNA, 64 nt, Human
aaauccaaaguucuuucaaaaaaaaaaacugaaacacaaccaaaaaagcaagagcgagagagag

SEQ ID NO: 173796 - RNA, 64 nt, Human
uucuguagucaucaaggugaacagaagcauccuacacaaccacuaagggcucuauguuuguguc

SEQ ID NO: 173797 - RNA, 54 nt, Human
gcagggcaaagcacaacuagagcucacaaccaaaacugcacuucagccucugcu

SEQ ID NO: 173798 - RNA, 64 nt, Human
cucacuauuuucaugaacaguuacccucuguccccacaaccaaagacaacucauggccuccuuu

SEQ ID NO: 173799 - RNA, 64 nt, Human
gagaaaucaacuucgugguuggauggggccggaacacaaccagucuuuuuguauuuauuguuac

SEQ ID NO: 173800 - RNA, 64 nt, Human
ugguucucggaguccaaaggguuuuaagccagggcacaaccagaaaaguggcucucuuugguag

SEQ ID NO: 173801 - RNA, 64 nt, Human
accugcggaaggagguucucccagcccaucugaacacaaccagagguggcaggagaauuucuac

SEQ ID NO: 173802 - RNA, 64 nt, Human
acuucuccacugucccguucagucugaaugcugccacaaccagccaggcagguccacagagagg

SEQ ID NO: 173803 - RNA, 64 nt, Human
aauacuucaucuacauagcagcccuucagauaaucacaaccacuuugcccccaaguuuucaggu

SEQ ID NO: 173804 - RNA, 64 nt, Human
cuuuuuguuuuugccauuguguuuacguuugagacacaaccagucauugguggcaggggcauag

SEQ ID NO: 173805 - RNA, 64 nt, Human
uccagcugcugcgcacggcggccuaccuccacaccacaaccaccuucaccuggaugugcagccc

SEQ ID NO: 173806 - RNA, 64 nt, Human
cuccucuggcuguuugccugaaguucacagaacacacaaccaugaaaggcuuuuugaggugaga

SEQ ID NO: 173807 - RNA, 64 nt, Human
cgcagggcguguaugagcaguuuugcaaacagaacacaaccacaaugaugguauuuugaaaagu

SEQ ID NO: 173808 - RNA, 64 nt, Human
acacuguguaugugaacagcuugggcccugcaaacacaaccaucuacacacaucuacaccccca

SEQ ID NO: 173809 - RNA, 64 nt, Human
agucauagcucauccccaucucuaaauguguccacacaaccacaucugccuuuuccacaagcuu

SEQ ID NO: 173810 - RNA, 64 nt, Human
cagcagacauccacacacaguaauggggugagcucacaaccaccauucagucaagugaggugac

SEQ ID NO: 173811 - RNA, 64 nt, Human
agaacuuucagacagguuuuacgaauauuuuuuacacaaccaaguuauggaguggcugccagca

SEQ ID NO: 173812 - RNA, 64 nt, Human
cuuuuuguuuuugccguuguauuuauguuugagacacaaccagucauugguggcaggggcauau

SEQ ID NO: 173813 - RNA, 64 nt, Human
caagcagaccuacagcaaguuugacacaaacucacacaaccaugacgcacugcucaagaacuac

SEQ ID NO: 173814 - RNA, 60 nt, Human
cagaccuacagcaaguuugacacaaacucgcacaaccaugacgcacugcucaagaacuac

SEQ ID NO: 173815 - RNA, 64 nt, Human
gcuagacuagaaaucaaacaacuuggaaaucgaucacaaccaggcauuaaguucacaguaagau

SEQ ID NO: 173816 - RNA, 64 nt, Human
auggacauauuucuuaugcaaaaaggaaaacacacacaaccaauaacucaaacaaaaaagggac

SEQ ID NO: 173817 - RNA, 64 nt, Human
cuugcuugcaaucucaucugauuuugcuagaaaucacaaccauauuguuuaugcauauugcaug

SEQ ID NO: 173818 - RNA, 64 nt, Human
gcucagauauaaaggaaagguacuggcuugaagucacaaccacgacaggaguaaggauuuggaa

SEQ ID NO: 173819 - RNA, 64 nt, Human
guauuucuagaagcagaaauagacugggaagaugcacaaccaagggguuacaggcaucgcccau

SEQ ID NO: 173820 - RNA, 64 nt, Human
aaggauuguuggagaguccagugagauggaaccacacaaccaguucccuaccagugucuuguca

SEQ ID NO: 173821 - RNA, 64 nt, Human
ggaagucuguaccaaaucuguaggggguuuuucccacaaccaagcaauagacaccagcugggug

SEQ ID NO: 173822 - RNA, 64 nt, Human
ucuaccaaauaauuuauauacaucucaguccucacacaaccaucccuguuuuauagaggaggaa

SEQ ID NO: 173823 - RNA, 64 nt, Human
cgcggaguggggggcccccuccgccacaaggaagcacaaccagcucgcccucccccuacccggg

SEQ ID NO: 173824 - RNA, 64 nt, Human
cuccugaguagcugggacuauaggcgcgugccaccacaaccagcuaaauuuuuuuguauuuuua

SEQ ID NO: 173825 - RNA, 51 nt, Human
gcggccucagccacuucuaagcacaaccagaggcccaacgacuaagccagc

SEQ ID NO: 173826 - RNA, 64 nt, Human
uuccaccaccaggagggcagacccagccacauaccacaaccacccccaagccucacacucccuu

SEQ ID NO: 173827 - RNA, 64 nt, Human
cauguaacagauuaauaacuuauaugaaaaccaacacaaccauauguuuagggcuggaaagggc

SEQ ID NO: 173828 - RNA, 64 nt, Human
cuaagggcuucucucucaggaccucuaauuugaccacaaccaaccugggcuucagccacaucag

SEQ ID NO: 173829 - RNA, 64 nt, Human
ugaacugaagcagagucaagcugaugaaguuaagcacaaccauguucuugagcagcugaauugg

SEQ ID NO: 173830 - RNA, 64 nt, Human
ccuucccagcagcccuugagccaaguaaaaccagcacaaccagccaccagugguuggugaggca

SEQ ID NO: 173831 - RNA, 53 nt, Human
acaacccauacccugugugagggcacaaccaggccacgggaccuucuauccuc

SEQ ID NO: 173832 - RNA, 64 nt, Human
uggugaaugacuggugugccuucuguggccuggacacaaccagcacagagcugucaguggugga

SEQ ID NO: 173833 - RNA, 64 nt, Human
gcuggucuggccccuccugccucaccaacccgugcacaaccagacaccuuguuacaccuagugg

SEQ ID NO: 173834 - RNA, 64 nt, Human
ccauccucacaccuaaccugcauggggcuucgcccacaaccauucuguaccccuuccccagccu

SEQ ID NO: 173835 - RNA, 64 nt, Human
gcugcaauguuccaacccaguuguuccagcuguucacaaccagugugugauuuugcuuaguugg

SEQ ID NO: 173836 - RNA, 64 nt, Human
aauaggcaagaaauuucugcuuuaucagucaucacacaaccauuccugggcauugagacugucc

SEQ ID NO: 173837 - RNA, 64 nt, Human
aggaaguuaauuucagagccauacaaaaauaagccacaaccagcuucagaauuaauucccaauc

SEQ ID NO: 173838 - RNA, 64 nt, Human
acauuaccauucauaguaagaauucugguguuuacacaaccaaauuugaugcgaucugcucagu

SEQ ID NO: 173839 - RNA, 64 nt, Human
caguaccuggcguugguacacaggcaaggauuggcacaaccaaaauuggccuuuuucucccucu

SEQ ID NO: 173840 - RNA, 64 nt, Human
cugggauuacaggcgugagccacuggcccggcggcacaaccaaaucuuauuaaacucacccuag

SEQ ID NO: 173841 - RNA, 64 nt, Human
ccggccuugugccugggcuguuccugcucucaugcacaaccagcccuuccacgugccugccugu

SEQ ID NO: 173842 - RNA, 64 nt, Human
uuugguaaugugauguugauguucucccccuacccacaaccaugcccuugaggguagcagggca

SEQ ID NO: 173843 - RNA, 64 nt, Human
gggcuggggccaccaucccugauggcagaacucccacaaccacauguauuuauuccucuguccu

SEQ ID NO: 173844 - RNA, 64 nt, Human
agcccacaucauacaguuugaaaugaaacuuugccacaaccagccuuugcuguagcacacacau

SEQ ID NO: 173845 - RNA, 64 nt, Human
auuauuaugauuuuggugguaacgaucccccacacacaaccacuaugaagaaauaaugccgcau

SEQ ID NO: 173846 - RNA, 64 nt, Human
auagcaaugcuacucuuaaaaagaugcuaugccacacaaccagaggacuuucuuguuagcaucc

SEQ ID NO: 173847 - RNA, 64 nt, Human
acagcucccaccacccugcugggcgccaguucuccacaaccacagggcagagagacgcuggagc

SEQ ID NO: 173848 - RNA, 64 nt, Human
auuccagcaucugaagacucaggcagagcagcuccacaaccaccuccagccugggagauaggcc

SEQ ID NO: 173849 - RNA, 64 nt, Human
auaggcauugauaaagccaggaaggaaauaaagucacaaccaaauaguauacacugucucuacu

SEQ ID NO: 173850 - RNA, 64 nt, Human
gaccaccagguggcccauuacucgagaugaucaucacaaccagaugaugcuaaccuauauccuc

SEQ ID NO: 173851 - RNA, 64 nt, Human
cccccagucgagcccugcagccaaacagagccuucacaaccagccacacagagccugccucagc

SEQ ID NO: 173852 - RNA, 64 nt, Human
cugugaucugaagaaagcuuuuggugcuuguccucacaaccaccucaguccucccucccugucc

SEQ ID NO: 173853 - RNA, 64 nt, Human
aucaaauuacaagcuauuuaaguuuauauuccaucacaaccaagucagacuuguauuauaaguc

SEQ ID NO: 173854 - RNA, 60 nt, Human
cauacaaccauuauuccugacacugagccgcacaaccagucacugggccucucugcagac

SEQ ID NO: 173855 - RNA, 64 nt, Human
cuuuguuuggccuagaauguuuauaaagugguaacacaaccauucuggaaauguaucccauaga

SEQ ID NO: 173856 - RNA, 64 nt, Human
uaugcaucuuuguugcuuauuacauauuuacacacacaaccacaaauuuuaaacuuaugaugaa

SEQ ID NO: 173857 - RNA, 64 nt, Human
agcaauaguguguaucccgaugugugugugugcucacaaccacucucaccuguucgugagcgca

SEQ ID NO: 173858 - RNA, 64 nt, Human
gugcggaggcucaggaggaauuccugcggguccucggcuccaugugccagaggcuccgguccau

SEQ ID NO: 173859 - RNA, 64 nt, Human
uccaggccuccauucaggacuacacgaggcgcugcggcuccaccugaccagugggucagcaggc

SEQ ID NO: 173860 - RNA, 64 nt, Human
caacauuaucucuaaagaagguuauacauuaugucggcuccacuggcugaugggaucaaagacc

SEQ ID NO: 173861 - RNA, 64 nt, Human
cugcuaugacuccucucugcagagacgcgacuggcggcuccagcagggacuaccuuucuuauaa

SEQ ID NO: 173862 - RNA, 64 nt, Human
ccuccugauuaaggcguggcuucugcaggaaucccggcuccagagcaggaaauucagcccacca

SEQ ID NO: 173863 - RNA, 64 nt, Human
augcuauauguacuguauguccuguagcccagugcggcuccacagcauggaaucugauguauga

SEQ ID NO: 173864 - RNA, 64 nt, Human
aauccgcgagcuggccaccuggccacccucuacacggcuccacccugccauggccguggggccc

SEQ ID NO: 173865 - RNA, 64 nt, Human
agagcuggcucugcucagaagccauuucauuccccggcuccacccuaggccacuuuuucuaaca

SEQ ID NO: 173866 - RNA, 64 nt, Human
cccuggggccaacucacugccauguucagugucccggcuccaaaugcccccuugcccagaugaa

SEQ ID NO: 173867 - RNA, 64 nt, Human
agcaaugauguccagaagaauauucaggacuuaacggcuccaggauuuuaacaaaagcaagacu

SEQ ID NO: 173868 - RNA, 64 nt, Human
caugcgugugcaggacuggcugugugcuuggacucggcuccagguggaagcaugcuuucccuug

SEQ ID NO: 173869 - RNA, 64 nt, Human
caaggccccccacccaucugguauggaaaccugccggcuccaggccagacccaggagccaagag

SEQ ID NO: 173870 - RNA, 61 nt, Human
auuccuacaccuuuuccuagggggcuggucccggcuccacccccuccaagcucaguggaca

SEQ ID NO: 173871 - RNA, 64 nt, Human
gugaacuuuauuuaaggacauucuuuuuuauuggcggcuccauggcccucggccgcuugcaccc

SEQ ID NO: 173872 - RNA, 64 nt, Human
auccuccaccagaaagggggagcuccuuccgcugcggcuccagauagauggggaugccgggcuc

SEQ ID NO: 173873 - RNA, 64 nt, Human
ggcccugcagcagccucgcgccccgcguuccgggcggcuccaagagagagcggagcaagugucc

SEQ ID NO: 173874 - RNA, 64 nt, Human
cuagcacgugugaacucaggcuuuucauugggcccggcuccacuucuaggccauguuuugacuc

SEQ ID NO: 173875 - RNA, 64 nt, Human
guucuccuucuuugugcacaauguggccacugagcggcuccaucugaagguuugauggaagaag

SEQ ID NO: 173876 - RNA, 64 nt, Human
cacucagcccugcccuauccccucacccccaucccggcuccaucuguagccguccacacccuac

SEQ ID NO: 173877 - RNA, 64 nt, Human
cugggggcgccggcggugugcuggugggugccgucggcuccaugcgcggagagucuggcuacuc

SEQ ID NO: 173878 - RNA, 64 nt, Human
gagagcugaccucccugcggacgcccccgcuccucggcuccagagcgcccgcauucccgggaga

SEQ ID NO: 173879 - RNA, 64 nt, Human
accuucuccuggugucuacauguuugcuuagaggcggcuccaagagcccccagagcugccugca

SEQ ID NO: 173880 - RNA, 64 nt, Human
cgagcucgcguccagguggccaggccucugccggcggcuccaguggcugcgauuaucggguucg

SEQ ID NO: 173881 - RNA, 64 nt, Human
cagagccugucuuucagcauucaguccgccuggccggcuccaguuuccccauggggcugcggga

SEQ ID NO: 173882 - RNA, 64 nt, Human
acuccugcccuccucggccucccuggccccagcgcggcuccacccugggcugcgucuccugguc

SEQ ID NO: 173883 - RNA, 64 nt, Human
accugccgucuucacuuccccacaggcuggcgcucggcuccaccccagggccagcuuuuccuca

SEQ ID NO: 173884 - RNA, 64 nt, Human
ugggcacauaauccacaagccagaaaguugugcacggcuccaguguugagauggguagggccaa

SEQ ID NO: 173885 - RNA, 64 nt, Human
gacaccgggaucgggcugagcaggagaacaucaccggcuccaguuccccugauccauucucaca

SEQ ID NO: 173886 - RNA, 64 nt, Human
ggccgggagcccaggggaaggccaggcuggaccccggcuccacacccacauccagccugcaggc

SEQ ID NO: 173887 - RNA, 64 nt, Human
ggggauguuauagauguugcugggauccugcccucggcuccaaauucuggccucucaucccagg

SEQ ID NO: 173888 - RNA, 64 nt, Human
ccugcgucuaccuuccaucuguguccagcggccccggcuccagcccagccagcacucugcaggg

SEQ ID NO: 173889 - RNA, 64 nt, Human
ccccucacuagauaaggggccgccggcuggcugccggcuccaugacgcccguggggucaccccc

SEQ ID NO: 173890 - RNA, 64 nt, Human
guccgccccgcccaggugggaccugacauacaggcggcuccagcccugggcagcggcuucaaga

SEQ ID NO: 173891 - RNA, 57 nt, Human
cugccagcaacuacguguaaggugccacggcuccacucuguuccucucugcuuuguu

SEQ ID NO: 173892 - RNA, 64 nt, Human
ggcucuuucuaaaaguauguaguucgcugugugucggcuccagcaguaaccguccucacugcgc

SEQ ID NO: 173893 - RNA, 64 nt, Human
cagcccagcguaccccaggccugcucugggaagucggcuccaugcucaccagcagccgcccagg

SEQ ID NO: 173894 - RNA, 64 nt, Human
cuaccucagacacucugacuaccucccacugaggcggcuccagccccagacaacagcccaggca

SEQ ID NO: 173895 - RNA, 64 nt, Human
cuggcaucuugcucaccgcccugauucuguuccucggcuccacugcuucaggucacuucccaug

SEQ ID NO: 173896 - RNA, 64 nt, Human
uugggucagagaaaaugagaaaggacagagccagcggcuccaacuccuuucagccacaugcccc

SEQ ID NO: 173897 - RNA, 64 nt, Human
cagcugcuuguggcggauuccucaccaagcucaacggcuccaucaccagcccgggcuggcccaa

SEQ ID NO: 173898 - RNA, 64 nt, Human
aaucgcuagaauggccggcgugagccaccaugcccggcuccacggccccuacuuuucacaacuu

SEQ ID NO: 173899 - RNA, 64 nt, Human
cccuguccugcacccaucccccgccugaagccaccggcuccaauugccagcaaccucugcuugu

SEQ ID NO: 173900 - RNA, 64 nt, Human
cacccauccgugcccggacccuugggaaugcccgcggcuccagaggaaaaagcccagggacggg

SEQ ID NO: 173901 - RNA, 64 nt, Human
gaccucugcccuccucacccucagggacaccacucggcuccauggggagguuuagaaccaaacc

SEQ ID NO: 173902 - RNA, 64 nt, Human
ggcucgucauuggaggugaacaagcaaacccagacggcuccacuaggacuucaaauuggggguu

SEQ ID NO: 173903 - RNA, 58 nt, Human
uagaccacgcucaguucugacccaggcccggcuccacccugcaccucacacgagggag

SEQ ID NO: 173904 - RNA, 64 nt, Human
ccguaaugcugcagaccacgugugcugugcacagcggcuccagugggggaccccucuucuccaa

SEQ ID NO: 173905 - RNA, 64 nt, Human
uuucuaaguauuuggugguuuauguuuacuugaacggcuccauguugccggugcccagccccug

SEQ ID NO: 173906 - RNA, 64 nt, Human
ccucggugggcauucacaccaccccccaugccaccggcuccacuuuccccuuuuauuaauacau

SEQ ID NO: 173907 - RNA, 64 nt, Human
cggucuugcggagcugcccgccugccuguucuggcggcuccagcgcaggcugucccugcugcuu

SEQ ID NO: 173908 - RNA, 64 nt, Human
uugcugcucugugucugcauguauugugaccgugcggcuccaccucuuccagcugcugcuacag

SEQ ID NO: 173909 - RNA, 64 nt, Human
agauagacgggccggcccugccuccacguggcuccggcuccacucucgugcacucggaugcuua

SEQ ID NO: 173910 - RNA, 64 nt, Human
ugucucggaucugguguuguuaggugggccacggcggcuccagcagggucugguuaaggggucc

SEQ ID NO: 173911 - RNA, 64 nt, Human
acccugggaugaccacaauuccuuccaauuucugcggcuccauccuaagccaaauaaauuauac

SEQ ID NO: 173912 - RNA, 64 nt, Human
gccuguccuucaaaaucaacaacagauugucucucggcuccagggaggugucauuucuauagaa

SEQ ID NO: 173913 - RNA, 64 nt, Human
cagguuguugacauuggccaacggggaacgcauccggcuccaagcacacugugcccugcucuuu

SEQ ID NO: 173914 - RNA, 64 nt, Human
aagcccagucacgagaauuucaggcucuucucuccggcuccagccugugccugugauuguccag

SEQ ID NO: 173915 - RNA, 64 nt, Human
cuuccacugccuucugcugaaggcaugauguaugcggcuccacuugagaccagguaucaggaug

SEQ ID NO: 173916 - RNA, 64 nt, Human
ugaaaaaaaguuggaaaaccacugacuagaccaucggcuccaaauuggagucugugcuuccuuc

SEQ ID NO: 173917 - RNA, 64 nt, Human
uucuguagccggaagaucuccguuccgcucccagcggcuccaguguaaauuccccuucccccug

SEQ ID NO: 173918 - RNA, 64 nt, Human
ggagccuccgcaagcaucuuuagaaaucugaucucggcuccaaccaacagccaccuuccaggga

SEQ ID NO: 173919 - RNA, 64 nt, Human
ggagccugguucagacacagcucuuccagggcagcggcuccacuuucucauccgaagauggugg

SEQ ID NO: 173920 - RNA, 64 nt, Human
uuucguuaucuugacauagaaggaagcaaugccacggcuccaggguuucagaugagaucccauc

SEQ ID NO: 173921 - RNA, 64 nt, Human
gguggccucugcaggccuaggugcagcuccucagcggcuccagcucauaugcugacagcucuuc

SEQ ID NO: 173922 - RNA, 64 nt, Human
ggggacuucugucugccugugcuccauggggggacggcuccacccagccugcgccacuguguuc

SEQ ID NO: 173923 - RNA, 64 nt, Human
cguucugccuccagcuuuccugguuagcgcaacgcggcuccacgaccacacgcacuucagggug

SEQ ID NO: 173924 - RNA, 64 nt, Human
ggcacuggugucccacuccauugucacuaacguccggcuccaucggcacuaccaccccgcucca

SEQ ID NO: 173925 - RNA, 64 nt, Human
gaaccacaucuugcucugcugacagacacaggcccggcuccaggcuccuuuagcgcccaguugg

SEQ ID NO: 173926 - RNA, 64 nt, Human
gcagauaauacacaccuccugcagcguccagccacggcuccagggcacugcucuccuccuugca

SEQ ID NO: 173927 - RNA, 64 nt, Human
ucccagcccgugcacccuggaagggcaggucuggcggcuccauccguggcugcaggggucucau

SEQ ID NO: 173928 - RNA, 64 nt, Human
aagccacagcccaguaagucaggcgcuucugcggcggcuccaguguggggugaggcagugaggu

SEQ ID NO: 173929 - RNA, 59 nt, Human
accaggugagcggccucugauggcauucacggcuccaucccgcagggugccugggcgga

SEQ ID NO: 173930 - RNA, 64 nt, Human
cuggaggccagaggggucaguggcccugcugucccggcuccaucuugguucuagccgccaccug

SEQ ID NO: 173931 - RNA, 64 nt, Human
ugugcccgggacaaccgcagcgucgccacaguggcggcuccaccucucggcggccucaccuggc

SEQ ID NO: 173932 - RNA, 64 nt, Human
ccaggcaguccuggguguggacacgaugaagcaccggcuccauaagacaccuuuuggggaagug

SEQ ID NO: 173933 - RNA, 64 nt, Human
ugcuggagucagggacggccgcaccugccuccgccggcuccagugugcggggagccucugccug

SEQ ID NO: 173934 - RNA, 64 nt, Human
uuuguagccaggggacccuagaagugggguggggcggcuccagggcuuuccagcauacccugcc

SEQ ID NO: 173935 - RNA, 64 nt, Human
ggguggcggcagggcgucccagggugcggcaccgcggcuccaguccuuggaaauaauuaggcaa

SEQ ID NO: 173936 - RNA, 64 nt, Human
cuugugguucucuagcgcggcgggggccuccugccggcuccacgggcacuuucuacuugugcau

SEQ ID NO: 173937 - RNA, 64 nt, Human
ccacagugcuccaaaugcacaugaacaacagugacggcuccagccuucgacccagagccccgug

SEQ ID NO: 173938 - RNA, 64 nt, Human
cuggagaacaggcccuaacccugcccuccaccgccggcuccacacugccggaagcagccuuccu

SEQ ID NO: 173939 - RNA, 64 nt, Human
ucucccagcccugguaggguuccccaaccaaagacggcuccauuaaaaacggagugcgucaugc

SEQ ID NO: 173940 - RNA, 64 nt, Human
aaaggugcuauuuaacaugggaggagagcgugugcggcuccagcccagcccgcugcucacuuuc

SEQ ID NO: 173941 - RNA, 64 nt, Human
gcccccaggccucagaguucuggaugcuuccgugcggcuccaacaggcaucgucuucccuuccg

SEQ ID NO: 173942 - RNA, 64 nt, Human
aguccucgcuguccccgccauccccugaucugugcggcuccagccucgcccccuccccacgugc

SEQ ID NO: 173943 - RNA, 64 nt, Human
gucgcgcgcagcgcgugcacagcgcgggcggaggcggcuccagguccggagggguugcggggga

SEQ ID NO: 173944 - RNA, 64 nt, Human
uuguaauaagaagacaucagagaugcugcuaagucggcuccagcacacaggagccccccacaac

SEQ ID NO: 173945 - RNA, 64 nt, Human
uugagccccucagccguuugcccugcccccaccucggcuccauggugggagggggcucuggucu

SEQ ID NO: 173946 - RNA, 64 nt, Human
gcuuccuccugcccagccaggcaacacccucaaccggcuccaucacauccucaggucucgggac

SEQ ID NO: 173947 - RNA, 64 nt, Human
agaaguggcccagguccagggucaguuaauuuagcggcuccacaaagucaucagucaccugagc

SEQ ID NO: 173948 - RNA, 64 nt, Human
ccuucugaguagcgugaugaaaucucucgcuguccggcuccagccggccggggaugugagucau

SEQ ID NO: 173949 - RNA, 64 nt, Human
cuccacguggagacauggccuagggggccaggcccggcuccacaggagucuccuucaggacugg

SEQ ID NO: 173950 - RNA, 64 nt, Human
ugccgccuggucacucugggaaccuggauuucaccggcuccaccaaauuagugccucuuagaug

SEQ ID NO: 173951 - RNA, 64 nt, Human
aaaaagcuaccuagacuaggcauguccaaaauggcggcuccaaguucccuucucuuugccagcc

SEQ ID NO: 173952 - RNA, 64 nt, Human
agcgagagagagugaggacaccgaacugggcuggcggcuccaaagcacagccuucccuguuccg

SEQ ID NO: 173953 - RNA, 64 nt, Human
auuauaauuauuauuauggagucgaguugacucucggcuccacuagggaggcgccgggagguug

SEQ ID NO: 173954 - RNA, 64 nt, Human
gggacccacccccacugggccugcuggccucccucggcuccagcccaaugccccagcuggccuu

SEQ ID NO: 173955 - RNA, 64 nt, Human
guguaccuuuucuaaagacgguuuccagcugcaacggcuccacuuugcaggcuugcagggugua

SEQ ID NO: 173956 - RNA, 64 nt, Human
cuccguccacguuccagccgagucacugccugaccggcuccauggcagcuccccaucuucccua

SEQ ID NO: 173957 - RNA, 64 nt, Human
cggggcucacuacugacugugcccucaggcugggcggcuccaguccauagacguuccccccaga

SEQ ID NO: 173958 - RNA, 64 nt, Human
cagacggccagccagccagcuguggccgggggcccggcuccaugugucccgugucugugugcug

SEQ ID NO: 173959 - RNA, 64 nt, Human
gaguuagaacaguuggauacaggagaagaaacagcggcuccacuacagacccagccccagguuc

SEQ ID NO: 173960 - RNA, 64 nt, Human
guuggggagccacacagggugaacgggcagcagccggcuccaugccccacugcccuggcugaug

SEQ ID NO: 173961 - RNA, 64 nt, Human
gaguuagaacuuuuggauacagcagaagaaacagcggcuccacuaccgaccugcccccgguucg

SEQ ID NO: 173962 - RNA, 64 nt, Human
caguuagaacuguuggauacaggagaagaaacagcggcuccacuaaagacccgccccccgguug

SEQ ID NO: 173963 - RNA, 64 nt, Human
aauggacguccuucugccagagacuuccagcgggcggcuccaaaggcccaaugcagaggagccc

SEQ ID NO: 173964 - RNA, 64 nt, Human
gguuccugaugccuugagggguguuucagacuggcggcuccagugggccaaagggcaaccacau

SEQ ID NO: 173965 - RNA, 64 nt, Human
acaguagccaaagauauuugaagaucauguuccucggcuccauuguggguuauucuagaaaucc

SEQ ID NO: 173966 - RNA, 64 nt, Human
uuacaccuguguugccacaagcagucauucuugacggcuccaguuuuuauuugacacuugaguu

SEQ ID NO: 173967 - RNA, 64 nt, Human
cuuccaggcagccgcggugcccaaccacacuugucggcuccaguccccagaacucugccugccc

SEQ ID NO: 173968 - RNA, 64 nt, Human
cccaccuugggagaggacgaugacuugggagggacgcgugaagggagaagggguccucccauga

SEQ ID NO: 173969 - RNA, 64 nt, Human
uguaauuuguaagaccaaauucauacuaauuacccgcgugaaagguguuuguuuuuaacaacau

SEQ ID NO: 173970 - RNA, 52 nt, Human
cagccuaugccucccacuaggccgcgugaagguucccggaggaugggucuca

SEQ ID NO: 173971 - RNA, 64 nt, Human
guucacauguucuggcucuguacuccacgcuuaucgcgugaacccucacauguuggacuuucac

SEQ ID NO: 173972 - RNA, 64 nt, Human
ccccgaaaggagaaaaguacucccaggaaacagacgcgugaaaacugagccccagaagaggcac

SEQ ID NO: 173973 - RNA, 64 nt, Human
ccagcaggauugcuccaggauuuuguguuuaccucgcgugaaguucagcacgugcugucgugua

SEQ ID NO: 173974 - RNA, 64 nt, Human
uucuccgcagugcagagcagcuugccgaggaccccgcgugaagaaagccagcgaggggggcuuc

SEQ ID NO: 173975 - RNA, 64 nt, Human
cuucuuccacggggcuugacaccagagcagcccccgcgugaaaugagaaggcaugcuuagcacu

SEQ ID NO: 173976 - RNA, 64 nt, Human
cacacacacagaaauaucgaccaucacccucccccgcgugaacugggaugcaaguugcuaaccg

SEQ ID NO: 173977 - RNA, 64 nt, Human
caacuacucuucaaaucagugcguaccugcucuacgcgugaagguacagaaaaccuccacggcc

SEQ ID NO: 173978 - RNA, 64 nt, Human
ccaucccccaccagacugcuuagcgucugagauccgcgugaaaaguccucugcccacgagagca

SEQ ID NO: 173979 - RNA, 64 nt, Human
uccggagagacagugacagccuccgucagacucccgcgugaagaugucacaagggauuggcaau

SEQ ID NO: 173980 - RNA, 64 nt, Human
gcccagaacuggcugauuucagggauacccaggacgcgugaaacacagaagaaacgugauccca

SEQ ID NO: 173981 - RNA, 64 nt, Human
ccaugucuguguuguggacauuccgcggcaugaccgcgugaacugcacgguggagcugccucag

SEQ ID NO: 173982 - RNA, 64 nt, Human; identical to SEQ ID NO: 173858

SEQ ID NO: 173983 - RNA, 64 nt, Human; identical to SEQ ID NO: 173859

SEQ ID NO: 173984 - RNA, 64 nt, Human; identical to SEQ ID NO: 173860

SEQ ID NO: 173985 - RNA, 64 nt, Human; identical to SEQ ID NO: 173861

SEQ ID NO: 173986 - RNA, 64 nt, Human; identical to SEQ ID NO: 173862

SEQ ID NO: 173987 - RNA, 64 nt, Human; identical to SEQ ID NO: 173863

SEQ ID NO: 173988 - RNA, 64 nt, Human; identical to SEQ ID NO: 173864

SEQ ID NO: 173989 - RNA, 64 nt, Human; identical to SEQ ID NO: 173865

SEQ ID NO: 173990 - RNA, 64 nt, Human; identical to SEQ ID NO: 173866

SEQ ID NO: 173991 - RNA, 64 nt, Human; identical to SEQ ID NO: 173867

SEQ ID NO: 173992 - RNA, 64 nt, Human; identical to SEQ ID NO: 173868

SEQ ID NO: 173993 - RNA, 64 nt, Human; identical to SEQ ID NO: 173869

SEQ ID NO: 173994 - RNA, 61 nt, Human; identical to SEQ ID NO: 173870

SEQ ID NO: 173995 - RNA, 64 nt, Human; identical to SEQ ID NO: 173871

SEQ ID NO: 173996 - RNA, 64 nt, Human; identical to SEQ ID NO: 173872

SEQ ID NO: 173997 - RNA, 64 nt, Human; identical to SEQ ID NO: 173873

SEQ ID NO: 173998 - RNA, 64 nt, Human; identical to SEQ ID NO: 173874

SEQ ID NO: 173999 - RNA, 64 nt, Human; identical to SEQ ID NO: 173875

SEQ ID NO: 174000 - RNA, 64 nt, Human; identical to SEQ ID NO: 173876

SEQ ID NO: 174001 - RNA, 64 nt, Human; identical to SEQ ID NO: 173877

SEQ ID NO: 174002 - RNA, 64 nt, Human; identical to SEQ ID NO: 173878

SEQ ID NO: 174003 - RNA, 64 nt, Human; identical to SEQ ID NO: 173879

SEQ ID NO: 174004 - RNA, 64 nt, Human; identical to SEQ ID NO: 173880

SEQ ID NO: 174005 - RNA, 64 nt, Human; identical to SEQ ID NO: 173881

SEQ ID NO: 174006 - RNA, 64 nt, Human; identical to SEQ ID NO: 173882

SEQ ID NO: 174007 - RNA, 64 nt, Human; identical to SEQ ID NO: 173883

SEQ ID NO: 174008 - RNA, 64 nt, Human; identical to SEQ ID NO: 173884

SEQ ID NO: 174009 - RNA, 64 nt, Human; identical to SEQ ID NO: 173885

SEQ ID NO: 174010 - RNA, 64 nt, Human; identical to SEQ ID NO: 173886

SEQ ID NO: 174011 - RNA, 64 nt, Human; identical to SEQ ID NO: 173887

SEQ ID NO: 174012 - RNA, 64 nt, Human; identical to SEQ ID NO: 173888

SEQ ID NO: 174013 - RNA, 64 nt, Human; identical to SEQ ID NO: 173889

SEQ ID NO: 174014 - RNA, 64 nt, Human; identical to SEQ ID NO: 173890

SEQ ID NO: 174015 - RNA, 57 nt, Human; identical to SEQ ID NO: 173891

SEQ ID NO: 174016 - RNA, 64 nt, Human; identical to SEQ ID NO: 173892

SEQ ID NO: 174017 - RNA, 64 nt, Human; identical to SEQ ID NO: 173893

SEQ ID NO: 174018 - RNA, 64 nt, Human; identical to SEQ ID NO: 173894

SEQ ID NO: 174019 - RNA, 64 nt, Human; identical to SEQ ID NO: 173895

SEQ ID NO: 174020 - RNA, 64 nt, Human; identical to SEQ ID NO: 173896

SEQ ID NO: 174021 - RNA, 64 nt, Human; identical to SEQ ID NO: 173897

SEQ ID NO: 174022 - RNA, 64 nt, Human; identical to SEQ ID NO: 173898

SEQ ID NO: 174023 - RNA, 64 nt, Human; identical to SEQ ID NO: 173899

SEQ ID NO: 174024 - RNA, 64 nt, Human; identical to SEQ ID NO: 173900

SEQ ID NO: 174025 - RNA, 64 nt, Human; identical to SEQ ID NO: 173901

SEQ ID NO: 174026 - RNA, 64 nt, Human; identical to SEQ ID NO: 173902

SEQ ID NO: 174027 - RNA, 58 nt, Human; identical to SEQ ID NO: 173903

SEQ ID NO: 174028 - RNA, 64 nt, Human; identical to SEQ ID NO: 173904

SEQ ID NO: 174029 - RNA, 64 nt, Human; identical to SEQ ID NO: 173905

SEQ ID NO: 174030 - RNA, 64 nt, Human; identical to SEQ ID NO: 173906

SEQ ID NO: 174031 - RNA, 64 nt, Human; identical to SEQ ID NO: 173907

SEQ ID NO: 174032 - RNA, 64 nt, Human; identical to SEQ ID NO: 173908

SEQ ID NO: 174033 - RNA, 64 nt, Human; identical to SEQ ID NO: 173909

SEQ ID NO: 174034 - RNA, 64 nt, Human; identical to SEQ ID NO: 173910

SEQ ID NO: 174035 - RNA, 64 nt, Human; identical to SEQ ID NO: 173911

SEQ ID NO: 174036 - RNA, 64 nt, Human; identical to SEQ ID NO: 173912

SEQ ID NO: 174037 - RNA, 64 nt, Human; identical to SEQ ID NO: 173913

SEQ ID NO: 174038 - RNA, 64 nt, Human; identical to SEQ ID NO: 173914

SEQ ID NO: 174039 - RNA, 64 nt, Human; identical to SEQ ID NO: 173915

SEQ ID NO: 174040 - RNA, 64 nt, Human; identical to SEQ ID NO: 173916

SEQ ID NO: 174041 - RNA, 64 nt, Human; identical to SEQ ID NO: 173917

SEQ ID NO: 174042 - RNA, 64 nt, Human; identical to SEQ ID NO: 173918

SEQ ID NO: 174043 - RNA, 64 nt, Human; identical to SEQ ID NO: 173919

SEQ ID NO: 174044 - RNA, 64 nt, Human; identical to SEQ ID NO: 173920

SEQ ID NO: 174045 - RNA, 64 nt, Human; identical to SEQ ID NO: 173921

SEQ ID NO: 174046 - RNA, 64 nt, Human; identical to SEQ ID NO: 173922

SEQ ID NO: 174047 - RNA, 64 nt, Human; identical to SEQ ID NO: 173923

SEQ ID NO: 174048 - RNA, 64 nt, Human; identical to SEQ ID NO: 173924

SEQ ID NO: 174049 - RNA, 64 nt, Human; identical to SEQ ID NO: 173925

SEQ ID NO: 174050 - RNA, 64 nt, Human; identical to SEQ ID NO: 173926

SEQ ID NO: 174051 - RNA, 64 nt, Human; identical to SEQ ID NO: 173927

SEQ ID NO: 174052 - RNA, 64 nt, Human; identical to SEQ ID NO: 173928

SEQ ID NO: 174053 - RNA, 59 nt, Human; identical to SEQ ID NO: 173929

SEQ ID NO: 174054 - RNA, 64 nt, Human; identical to SEQ ID NO: 173930

SEQ ID NO: 174055 - RNA, 64 nt, Human; identical to SEQ ID NO: 173931

SEQ ID NO: 174056 - RNA, 64 nt, Human; identical to SEQ ID NO: 173932

SEQ ID NO: 174057 - RNA, 64 nt, Human; identical to SEQ ID NO: 173933

SEQ ID NO: 174058 - RNA, 64 nt, Human; identical to SEQ ID NO: 173934

SEQ ID NO: 174059 - RNA, 64 nt, Human; identical to SEQ ID NO: 173935

SEQ ID NO: 174060 - RNA, 64 nt, Human; identical to SEQ ID NO: 173936

SEQ ID NO: 174061 - RNA, 64 nt, Human; identical to SEQ ID NO: 173937

SEQ ID NO: 174062 - RNA, 64 nt, Human; identical to SEQ ID NO: 173938

SEQ ID NO: 174063 - RNA, 64 nt, Human; identical to SEQ ID NO: 173939

SEQ ID NO: 174064 - RNA, 64 nt, Human; identical to SEQ ID NO: 173940

SEQ ID NO: 174065 - RNA, 64 nt, Human; identical to SEQ ID NO: 173941

SEQ ID NO: 174066 - RNA, 64 nt, Human; identical to SEQ ID NO: 173942

SEQ ID NO: 174067 - RNA, 64 nt, Human; identical to SEQ ID NO: 173943

SEQ ID NO: 174068 - RNA, 64 nt, Human; identical to SEQ ID NO: 173944

SEQ ID NO: 174069 - RNA, 64 nt, Human; identical to SEQ ID NO: 173945

SEQ ID NO: 174070 - RNA, 64 nt, Human; identical to SEQ ID NO: 173946

SEQ ID NO: 174071 - RNA, 64 nt, Human; identical to SEQ ID NO: 173947

SEQ ID NO: 174072 - RNA, 64 nt, Human; identical to SEQ ID NO: 173948

SEQ ID NO: 174073 - RNA, 64 nt, Human; identical to SEQ ID NO: 173949

SEQ ID NO: 174074 - RNA, 64 nt, Human; identical to SEQ ID NO: 173950

SEQ ID NO: 174075 - RNA, 64 nt, Human; identical to SEQ ID NO: 173951

SEQ ID NO: 174076 - RNA, 64 nt, Human; identical to SEQ ID NO: 173952

SEQ ID NO: 174077 - RNA, 64 nt, Human; identical to SEQ ID NO: 173953

SEQ ID NO: 174078 - RNA, 64 nt, Human; identical to SEQ ID NO: 173954

SEQ ID NO: 174079 - RNA, 64 nt, Human; identical to SEQ ID NO: 173955

SEQ ID NO: 174080 - RNA, 64 nt, Human; identical to SEQ ID NO: 173956

SEQ ID NO: 174081 - RNA, 64 nt, Human; identical to SEQ ID NO: 173957

SEQ ID NO: 174082 - RNA, 64 nt, Human; identical to SEQ ID NO: 173958

SEQ ID NO: 174083 - RNA, 64 nt, Human; identical to SEQ ID NO: 173959

SEQ ID NO: 174084 - RNA, 64 nt, Human; identical to SEQ ID NO: 173960

SEQ ID NO: 174085 - RNA, 64 nt, Human; identical to SEQ ID NO: 173961

SEQ ID NO: 174086 - RNA, 64 nt, Human; identical to SEQ ID NO: 173962

SEQ ID NO: 174087 - RNA, 64 nt, Human; identical to SEQ ID NO: 173963

SEQ ID NO: 174088 - RNA, 64 nt, Human; identical to SEQ ID NO: 173964

SEQ ID NO: 174089 - RNA, 64 nt, Human; identical to SEQ ID NO: 173965

SEQ ID NO: 174090 - RNA, 64 nt, Human; identical to SEQ ID NO: 173966

SEQ ID NO: 174091 - RNA, 64 nt, Human; identical to SEQ ID NO: 173967

SEQ ID NO: 174092 - RNA, 64 nt, Human
uuucaguucaagugcucuucagcacugucuugucucccaauauaccaacccacuggcacauuuu

SEQ ID NO: 174093 - RNA, 64 nt, Human
guggaguugucuccagauaagaggagaugugccuucccaauaacucuuuuuuuuuuuccuuuca

SEQ ID NO: 174094 - RNA, 64 nt, Human
gccuguggugaugguuugcauccuuccuccuuugucccaauaaaguaugggaguugaaugugug

SEQ ID NO: 174095 - RNA, 64 nt, Human
ucgucugcagugagggaagguggguggguauucuucccaauaaagacuuagagccccucucuuc

SEQ ID NO: 174096 - RNA, 64 nt, Human
aaaagucuagguuuuaaggcugugccagaacccaucccaauaaagagaccgagucugaagucac

SEQ ID NO: 174097 - RNA, 64 nt, Human
accaaccgauugccuuuauuuugcuuccacauuuucccaauaaauacuugccugugacauuuug

SEQ ID NO: 174098 - RNA, 64 nt, Human
uuccuucccagcccuuguggcucuguccaccugaucccaauaccagcuucccccagccccugcc

SEQ ID NO: 174099 - RNA, 64 nt, Human
ugagacuguguuguacagcuagaaaaggccuucuucccaauagcaaggcugugcaucuagccuc

SEQ ID NO: 174100 - RNA, 64 nt, Human
auuugugcaagucaguguuuuugaaaauucagugucccaauaaaaaguggacugcacacuaagg

SEQ ID NO: 174101 - RNA, 64 nt, Human
uauauuuagugggucagugccaagugcuaccacuucccaauaaaggaauggggacccagaggcu

SEQ ID NO: 174102 - RNA, 64 nt, Human
uuguaaauauugauagcacuggcuuccuccaaagucccaauacucuagccccgcucucuucccc

SEQ ID NO: 174103 - RNA, 64 nt, Human
auugguuuuauuugauguacccaagucuuacguuucccaauaaagaaaaaaaaucuccauaaaa

SEQ ID NO: 174104 - RNA, 64 nt, Human
uuggccggcccaccuguuuaacucuguauuuauuucccaauaaagaagggcuuccaaaggcaug

SEQ ID NO: 174105 - RNA, 64 nt, Human
uccucccaaucuuuugacuuaugcacauauuuuuucccaauauggagaucauauggaauguacu

SEQ ID NO: 174106 - RNA, 64 nt, Human
auuugggcacugguuuggccaaguguacaaugggucccaauaucagaaacaaccauccuagcuu

SEQ ID NO: 174107 - RNA, 64 nt, Human
auauuugggcauuggucuggccaagucuacaaugucccaauaucaaggacaaccacccuagcuu

SEQ ID NO: 174108 - RNA, 64 nt, Human
caagaccccugucuuugcugagagcuuuccuuuuucccaauaaauucuacucugcccuacucac

SEQ ID NO: 174109 - RNA, 64 nt, Human
acguauuauugauauuauugucuguuuuccuucuucccaauagaagaauaagucauggagccug

SEQ ID NO: 174110 - RNA, 64 nt, Human
agcuaaucauuuauccaaaggcuuuccauucuucucccaauauuuuuuuacuuuaauuuuuccc

SEQ ID NO: 174111 - RNA, 64 nt, Human
guaaauucacauuuuccuuccuccuguuacauuuucccaauaucuuuucuauuccuuggaccaa

SEQ ID NO: 174112 - RNA, 64 nt, Human
gacgugccucuccuacuguguaggagccuccgcuucccaauacagccgugucugcagccacugc

SEQ ID NO: 174113 - RNA, 64 nt, Human
ggcuucaccucccuaugugaacuguagacucagaucccaauaaagugcuguugcagcuaugaug

SEQ ID NO: 174114 - RNA, 64 nt, Human
uguggggcugugaauucuuucuucauccccgcauucccaauauacccaggccacaagaguggac

SEQ ID NO: 174115 - RNA, 64 nt, Human
ccauucuccucuccacuucucguggaccgcguguucccaauauucauuaacauuugcagccauu

SEQ ID NO: 174116 - RNA, 64 nt, Human
gauuacaugcccaucccaguguccuaggaccuuuucccaauacuagccccccaguggugaacag

SEQ ID NO: 174117 - RNA, 64 nt, Human
aagcuaugaugauauaaauaaaaacagcucucuaucccaauacgcaccuuuguauuuucaagaa

SEQ ID NO: 174118 - RNA, 64 nt, Human
uggcuuggcaacaaugacauugucaugcuuauugucccaauauccauccugucguagaucuuaa

SEQ ID NO: 174119 - RNA, 64 nt, Human
uuuauuugcugcuguuuaaguugccaaccuccccucccaauaaaaauucacuuacaccuccugc

SEQ ID NO: 174120 - RNA, 64 nt, Human
auucccauuugucccagugcugacaacccaaucuucccaauacuuucaggccugcucuacaaaa

SEQ ID NO: 174121 - RNA, 64 nt, Human
gagaggaggucccgcuauguuguccaggcuacuuucccaauauuugagaauaaagucgagacuc

SEQ ID NO: 174122 - RNA, 64 nt, Human
aauauagguuaaaacaaugauuuaaauauguuucucccaauaauuaucucuuucccuggaauca

SEQ ID NO: 174123 - RNA, 64 nt, Human
uguguauuacaugggacugucuagagguuccauuucccaauaggguggguugccuuuccuuguc

SEQ ID NO: 174124 - RNA, 64 nt, Human
uuugagaugguguguccuggauuaauacuuugucucccaauaucacagaaaaauacaugccagu

SEQ ID NO: 174125 - RNA, 64 nt, Human
aauuacccuuuuguugggggggguggggcaguggucccaauaggagacaaaggagagugauuga

SEQ ID NO: 174126 - RNA, 64 nt, Human
auguacccaauguguauauuuuucuuuuuaaucuucccaauagcugaauaaaguauagauacua

SEQ ID NO: 174127 - RNA, 64 nt, Human
ccacaugagaaaauuuuuguacuccaaauuuacuucccaauaaauauucagcaaaguaguaaaa

SEQ ID NO: 174128 - RNA, 64 nt, Human
ucucugcuggcuucuuuuuccaugcguuaacuuuucccaauagcagaggaggcaaauaugagca

SEQ ID NO: 174129 - RNA, 64 nt, Human
uaugguuucauaggcaaaaauaauggucuaagccucccaauagggauaaauuuagggugacugu

SEQ ID NO: 174130 - RNA, 64 nt, Human
cgaaaaaaaaaaacagaaaaaucuaccgguaauuucccaauagcuuugaauauucacagcagag

SEQ ID NO: 174131 - RNA, 64 nt, Human
gaaccagccauuuuuaaaaagguuauuauugacaucccaauauuuugucuuggugggcuuacuc

SEQ ID NO: 174132 - RNA, 64 nt, Human
uuuuucuucucauccuggagcguauucaagaucuucccaauacaagaaaauuaauaaaaaauuu

SEQ ID NO: 174133 - RNA, 64 nt, Human
caugacagaccuccagcauccacgcaucucuuggucccaauaacugccucuagauacauagcca

SEQ ID NO: 174134 - RNA, 64 nt, Human
ucaaugaucaaaaaaugcugcagauuuuuugaguucccaauacguuucauagaaaauaaguaag

SEQ ID NO: 174135 - RNA, 64 nt, Human
ccugaaaaucauuuguguccuacuauuggacuuaucccaauacagauguguguguuuuucugga

SEQ ID NO: 174136 - RNA, 64 nt, Human
augccaaagacuacguuuugcaguuuugcuuuccucccaauaaauauuaauguauguaauucua

SEQ ID NO: 174137 - RNA, 64 nt, Human
auucuuuuuagacaucagaaauguuaaaguugauucccaauauuuguuguacuuuuuuguagca

SEQ ID NO: 174138 - RNA, 64 nt, Human
accauccuauugcaaagguuccaacuguauauauucccaauagcaacguagcuucuaccaugaa

SEQ ID NO: 174139 - RNA, 64 nt, Human
ucagugauuuuuauuuuggucauuauuucuaucuucccaauaacccagagguacaucaaguaaa

SEQ ID NO: 174140 - RNA, 64 nt, Human
auccucucagcucucuucccugggggcagauauuucccaauacauaccacuuugaauaggauga

SEQ ID NO: 174141 - RNA, 64 nt, Human
ugcaaaggcuuccucagacaugccacucuguggcucccaauauagggugcagacaagagcaauc

SEQ ID NO: 174142 - RNA, 64 nt, Human
aacaucaucaggccgggugcaguggcuccuauaaucccaauauuuugggaggccgaggagagag

SEQ ID NO: 174143 - RNA, 64 nt, Human
gacuuuucacagucguuaaauguguauggcucuuucccaauaugaauuuuuuugauguuaacua

SEQ ID NO: 174144 - RNA, 64 nt, Human
uucaucuuaaccccgcaaacaagaauuaagaugaucccaauaaaagaaaaauugcucaggaaac

SEQ ID NO: 174145 - RNA, 64 nt, Human
aaauaaccccauucuuugcuugaacacaguauuuucccaauagcacuuucauugccagugucuu

SEQ ID NO: 174146 - RNA, 64 nt, Human
caccuucacccucaccuguguucucuucccucucucccaauaaaagggcucccauuauaaaugc

SEQ ID NO: 174147 - RNA, 64 nt, Human
gaucaaaaagggaauaagaaacccuucuucuguaucccaauaauccaccaggauaaaggagaaa

SEQ ID NO: 174148 - RNA, 64 nt, Human
auuaauuugaauguuuuuuacacuaacuaacuuuucccaauaaaguccacuaugaaaccacgac

SEQ ID NO: 174149 - RNA, 64 nt, Human
aucacuggagucacaggacccugcccaccugaguucccaauaaagaaaaaccuccccuucugag

SEQ ID NO: 174150 - RNA, 64 nt, Human
auguucacuccgggucaaguugugauaaauuugaucccaauagaauaccucccucauuuaagaa

SEQ ID NO: 174151 - RNA, 64 nt, Human
cuggcuggagagcugcuaugcuaaaccuccugccucccaauaccagcaggagguucugggccuc

SEQ ID NO: 174152 - RNA, 64 nt, Human
aagcauuauaagcaucaaauuuacaacauugguuucccaauauuuaauauaaauauaccauaua

SEQ ID NO: 174153 - RNA, 64 nt, Human
aaacccaauuaauuugauaagcuuggggacaacaucccaauagauaaaaauuuuuaagggaauu

SEQ ID NO: 174154 - RNA, 64 nt, Human
cagccuccuggguuuccccaguccucauuuuuccucccaauacccacccuucucucucgaggga

SEQ ID NO: 174155 - RNA, 64 nt, Human
auaaacugagccuguucauucugauguccauuugucccaauagcucuacugcccuccccuuccc

SEQ ID NO: 174156 - RNA, 64 nt, Human
aucccaaacuucggaaacaaguuauucucuucacucccaauaacuaaugcuaagaaaugcugaa

SEQ ID NO: 174157 - RNA, 64 nt, Human
agaguuggccagguguggugacucacaccuauaaucccaauacuuugggaggccaaggcaggag

SEQ ID NO: 174158 - RNA, 64 nt, Human
caauuuguugugauuuucagcaccugggaaguaaucccaauaauacuuuagaaaaucuaagaca

SEQ ID NO: 174159 - RNA, 64 nt, Human
caaugcuuaagguggacuuuguucguaaacaauaucccaauagauuuguugacuugaggucugg

SEQ ID NO: 174160 - RNA, 64 nt, Human
uuuauggauauugacuauauguaaugcagugcuaucccaauauuuucaauaaaggacuuuaugc

SEQ ID NO: 174161 - RNA, 64 nt, Human
auggauaauucucaauauguuaacaccuagguguucccaauaccuuuuuccccucaugucacua

SEQ ID NO: 174162 - RNA, 64 nt, Human
gggcucaagucaagcagucggugacagauuucauucccaauaacagaaucgguuugcaugacuc

SEQ ID NO: 174163 - RNA, 64 nt, Human
aucccugugugcugcagcaucaccacggccuacuucccaauauccacaaagcuucgccuuugcu

SEQ ID NO: 174164 - RNA, 64 nt, Human
cuuuacuaaguaaucucacagcauuugccaagucucccaauauccaauuuuaaaaugaaaugca

SEQ ID NO: 174165 - RNA, 64 nt, Human
aaugaguggcagcuggcgccagggaacgauggccucccaauagauaggaaacaccugaagcugg

SEQ ID NO: 174166 - RNA, 64 nt, Human
aauacauagauaaaaacauguuugcugccaaaguucccaauaagaugcuuccuguguuuuuugg

SEQ ID NO: 174167 - RNA, 64 nt, Human
gaaaaagcuaauuguaguuuucauuaugaaguuuucccaauaaaccagguauucuaaacuuguu

SEQ ID NO: 174168 - RNA, 64 nt, Human
auacagaugguccucgauuuacauugugguuaauucccaauaaacccaucauaaguuaaaaaug

SEQ ID NO: 174169 - RNA, 64 nt, Human
gcacgucgccucuugaaacucgagauuucuuaaaucccaauauaaaaaugauaaccaguuacuu

SEQ ID NO: 174170 - RNA, 64 nt, Human
cagaguauuucccuuggccgagauggaaguuuugucccaauagaugagcugcugagcaucaaca

SEQ ID NO: 174171 - RNA, 64 nt, Human
caagaaaaaaaauagaaaagcacuugaagaauauucccaauauucccggucagcaguaucaagg

SEQ ID NO: 174172 - RNA, 64 nt, Human
aucuuguagauuacauugagcaguauagacaucuucccaauauuucaacuuuugaacaaaagca

SEQ ID NO: 174173 - RNA, 64 nt, Human
agaaugagagcggcggagacaagccccccaucgaucccaauaacccagcagccaacuggcuuca

SEQ ID NO: 174174 - RNA, 64 nt, Human
gaacacaauucguuuuuucauuugaauuggcauuucccaauauuugcuaaacauuugcuggaga

SEQ ID NO: 174175 - RNA, 64 nt, Human; identical to SEQ ID NO: 174170

SEQ ID NO: 174176 - RNA, 64 nt, Human
ucgcauugauguauuaaauuuauaauuuuagcauucccaauagauccuaucauuccuuaaacau

SEQ ID NO: 174177 - RNA, 64 nt, Human
ccacuguacuccugccuuaaaaaaaaaaaaaaaaucccaauaguccaugaaggcuuugaucucu

SEQ ID NO: 174178 - RNA, 64 nt, Human
gccugcauaggagccucgcuuccgauuauucccuucccaauauuauucauccagacuuagccac

SEQ ID NO: 174179 - RNA, 64 nt, Human
cuccuuuccaauagaaagaaacuaaacagaaaacucccaauacaaagaugacuggucccucaua

SEQ ID NO: 174180 - RNA, 64 nt, Human
acuccugacgucaagugaucugccugccuuggucucccaauacaggcaugaaccacugcaccca

SEQ ID NO: 174181 - RNA, 64 nt, Human
ugaacuaagggaauuuaaggcauaagaaccauuaucccaauaaaaucuuacauuccaaauaaag

SEQ ID NO: 174182 - RNA, 64 nt, Human
ccagaggccaagccacagagaggauaauaguucuucccaauaaaggugauauuaaucagacuaa

SEQ ID NO: 174183 - RNA, 64 nt, Human
aaaaauaacuuuaggaaccaccauauuauaucacucccaauagcacugaccuggugaucaaaaa

SEQ ID NO: 174184 - RNA, 64 nt, Human
uguguguguauguauauauauauauaaauaucuuucccaauaugccccguugacaguguuuaaa

SEQ ID NO: 174185 - RNA, 64 nt, Human
uccuuuuucauuaggcucauaguuuguggaaaaaucccaauaugccguuuauucagguggggcu

SEQ ID NO: 174186 - RNA, 64 nt, Human
agcguuccuggaauuaauuuauaaauuuaauaaaucccaauauaaucccagcuagugcuuuuuc

SEQ ID NO: 174187 - RNA, 64 nt, Human
caguucccuuguccugaucucauccucucuggucucccaauaacucacccuugggauguguuua

SEQ ID NO: 174188 - RNA, 64 nt, Human
aggccucugccccuaaccacugugccauaccaccucccaauaaucaacagcaaaauuauagguc

SEQ ID NO: 174189 - RNA, 64 nt, Human
cacuacugcagucgguacagaacaguuccuucacucccaauagcucucuuaugcugucccuuug

SEQ ID NO: 174190 - RNA, 64 nt, Human
uguccaaaugccugugucaucuugucccguuuccucccaauauuccuucucaaacuuggagagg

SEQ ID NO: 174191 - RNA, 64 nt, Human
ucuauuccccagacuccucauuauucaguacauuucccaauaaucucuuuuucucaucucuugc

SEQ ID NO: 174192 - RNA, 64 nt, Human
auucucaaacacaguuacacuugugcacccucuaucccaauaggcagacuggguuucuagccca

SEQ ID NO: 174193 - RNA, 64 nt, Human
gaaccaauccgucucucuuucuuuucuuugaaguucccaauaaaaugaaaacaggaaauguauu

SEQ ID NO: 174194 - RNA, 64 nt, Human
auuuauggggauuuuaauugaaaauaaacuugagucccaauagagcuguuuuuuucucacuucc

SEQ ID NO: 174195 - RNA, 64 nt, Human; identical to SEQ ID NO: 174190

SEQ ID NO: 174196 - RNA, 64 nt, Human
ggauucauuccucagccucugcuucucccuuuuaucccaauaaguuauugcuacugcugugagg

SEQ ID NO: 174197 - RNA, 64 nt, Human
uuuuuuacuacaucaaaaggauggugguucaaguucccaauauguggguggcacuucuuaaaaa

SEQ ID NO: 174198 - RNA, 64 nt, Human
aagcagacuggcuccaauagauaucaggcagcaaucccaauaaauucugacauguccuuggcaa

SEQ ID NO: 174199 - RNA, 64 nt, Human
gaaagaauuauuuuuguguuucuaaaacuaugguucccaauaaaagugacucucagcgagccuc

SEQ ID NO: 174200 - RNA, 64 nt, Human
gcucucaauggugcucacuugcuuggaagcaggcucccaauagggagggggcugcccucuacag

SEQ ID NO: 174201 - RNA, 64 nt, Human
ggguuccucugcccuggaagggcuccaggacccgucccaauaaccacccacggccaggagggcc

SEQ ID NO: 174202 - RNA, 64 nt, Human
uuaacagauaauucagcauuggcguauuugcuugucccaauacaagaaugccaaaggaggaaac

SEQ ID NO: 174203 - RNA, 64 nt, Human
ccucaugccuggccccccuccaggcaugcuggccucccaauaaagcuggacaagaagcugcuau

SEQ ID NO: 174204 - RNA, 64 nt, Human
ugauguguuaauauaaaauguugggagggaauauucccaauaaaggucuuaagagaaaagucac

SEQ ID NO: 174205 - RNA, 64 nt, Human
ucucaugaccuaaucaccucccaaaggccccaccucccaauaccaucacauuagggguuaggau

SEQ ID NO: 174206 - RNA, 64 nt, Human
agauacagucuucaggacaccauuagaugggcuuucccaauaggccaaaaaaaugcugcgcaua

SEQ ID NO: 174207 - RNA, 64 nt, Human
cuguaaagugauaucuuucauacuugaccaaaguucccaauaacuucccaaccacuguucaaaa

SEQ ID NO: 174208 - RNA, 64 nt, Human
cccuaauagaguaaaauuugguuuugguccaaguucccaauaauguauuuaauguuucuguugu

SEQ ID NO: 174209 - RNA, 64 nt, Human
uuccauucucuuuuuuagggaacauuaagcaaaaucccaauacacagagucugucacagacagg

SEQ ID NO: 174210 - RNA, 64 nt, Human
gggauuacaggcgugagccaccgugcccggccucucccaauaggucuuuauuccucaauccucc

SEQ ID NO: 174211 - RNA, 64 nt, Human
cucgcgccaccagaacgcgccgcccgcgccggccucccaauagccgccgcccgcugccugcacu

SEQ ID NO: 174212 - RNA, 64 nt, Human
cucuaggguagccaugcagaggagggcuucauauucccaauaaaccccacguuguggcaggugc

SEQ ID NO: 174213 - RNA, 64 nt, Human
gauagauagaaaaacggaaggguucagcugcugcucccaauaccucagcaugguaaggggacag

SEQ ID NO: 174214 - RNA, 64 nt, Human
uucaccgccuuccucacuccauauagaacaccuuucccaauaggaaaccccaacagguaaacua

SEQ ID NO: 174215 - RNA, 64 nt, Human
gaagcaagccagacaugguggcucacaccuguaaucccaauacugggaagccaaggugggagua

SEQ ID NO: 174216 - RNA, 64 nt, Human
ucauuuugugcugcuccaacaccagcaggguaucucccaauaaaguguuccuaagcagccugua

SEQ ID NO: 174217 - RNA, 64 nt, Human
ucuauuuucuuuaccagaaauguugcuaaguaauucccaauagaaagcugcuuauuuucauuaa

SEQ ID NO: 174218 - RNA, 64 nt, Human
aaagguacuaugugauaugguacugaaauuuugaucccaauagaauucauuucucuuacguuga

SEQ ID NO: 174219 - RNA, 64 nt, Human
aaauuaagaaugucaauuuaaguuaauaaaaaucucccaauaugauuuggguucauggcuuuug

SEQ ID NO: 174220 - RNA, 64 nt, Human
ggguggccuguuggucacugugcagcagucugcuucccaauaaagcgugcucuuucacaaacac

SEQ ID NO: 174221 - RNA, 64 nt, Human
cccuucucuuugauagcaguuauaaugcccuuguucccaauaaaacugggcagauggaauccua

SEQ ID NO: 174222 - RNA, 64 nt, Human
auaacuaaacauaguauaguccaacauucguugaucccaauacaggcaaacaaccuggucaacc

SEQ ID NO: 174223 - RNA, 64 nt, Human
ucaauauuaauaacacugaaacaggaaaucuaacucccaauauuggaauuuugguacuuuuuuu

SEQ ID NO: 174224 - RNA, 64 nt, Human
uuguacauagcauaaaaacucugcagagaaguauucccaauaaggaaauagcauugaaauguua

SEQ ID NO: 174225 - RNA, 64 nt, Human
uaguguucagcugcuucagcaguguccccaaccaucccaauagggugggggccugugggccaga

SEQ ID NO: 174226 - RNA, 64 nt, Human
uguaaggcuuuuuuauuuuaaaaaaacagaguuaucccaauacauuauccugugauuuaccuua

SEQ ID NO: 174227 - RNA, 64 nt, Human
ucaugguuccaagcaaugaguguaauguauuuucucccaauaguaauuguuuauauucauaauu

SEQ ID NO: 174228 - RNA, 64 nt, Human
accuuaggccucagcuggagggcugcagagccccucccaauauugggagaauauugacccagac

SEQ ID NO: 174229 - RNA, 64 nt, Human
uuuuguuucucuggggaaauccgccucagcucauucccaauaaauuaauacucuugauagcuua

SEQ ID NO: 174230 - RNA, 64 nt, Human
uauccgagacgcgauuauugcuaauuggaaauuuucccaauaccccaccgugaugacuugaaau

SEQ ID NO: 174231 - RNA, 64 nt, Human
cgacgcuucuguucggcccgaccuccaccccggcucccaauaaaauuuaacugaucuuuguuuc

SEQ ID NO: 174232 - RNA, 64 nt, Human
agacucaaguggacccuacaaugaagccuacacaucccaauagaagccccuucuuaugcugagg

SEQ ID NO: 174233 - RNA, 64 nt, Human
cuaggcacucacgcuguuuccuccucccuccucuucccaauacuauucccacuccuccagaugc

SEQ ID NO: 174234 - RNA, 64 nt, Human
ccccucucaaauacccuuauuuuauuuauguuucucccaauaaaaacccagccugugugccagc

SEQ ID NO: 174235 - RNA, 64 nt, Human
gaaauuggaggccauuuuucagucaauuucccuuucccaauaaaagccuuuaguuguguacugg

SEQ ID NO: 174236 - RNA, 64 nt, Human
caagaaauucuucacuucucacuucuucacuucuucccaauauacaguaaguacgugagccagu

SEQ ID NO: 174237 - RNA, 64 nt, Human
ggagagcuggcagugugcggagcugauaacauuuucccaauauugagcaguucccaaggacagu

SEQ ID NO: 174238 - RNA, 64 nt, Human
uaaauaauucauuucugggcuaauuucaaaagaaucccaauauugcuguauagaaagagaacua

SEQ ID NO: 174239 - RNA, 64 nt, Human
cugaacuuggauuucuaguucaugaagaaaucucucccaauacccauuuauccuauuuuuagca

SEQ ID NO: 174240 - RNA, 64 nt, Human
aauaauauuuccaccggggaugcaucauuuuuacucccaauauucuguagagagggagucagga

SEQ ID NO: 174241 - RNA, 64 nt, Human
cgaacauuucuauuuuccguauuuugagcucucuucccaauauuuccuuuuggugugagucugg

SEQ ID NO: 174242 - RNA, 64 nt, Human
cuccgggggcucccuggaggcaccccucccccauucccaauaucuucgcugagguuuccuccuc

SEQ ID NO: 174243 - RNA, 64 nt, Human
uucucuggaaugcaaggaggagacuucauuuacuucccaauaaacuucauuucucuggcauaau

SEQ ID NO: 174244 - RNA, 64 nt, Human
cuucaaagagcaucuccacaacccacagccuucuucccaauaguguuaacucugcauuuuuaca

SEQ ID NO: 174245 - RNA, 64 nt, Human
gccacucaguucuuccuccaccuccacccagugaucccaauaaacgaauucugucuccccgugc

SEQ ID NO: 174246 - RNA, 64 nt, Human
guuucuugguagauuauucauaaugugagaugguucccaauaucaugugauuuuuuuuuuccuc

SEQ ID NO: 174247 - RNA, 64 nt, Human
gacacuggaauaacagcacagaaaaaucuaugacucccaauaucuucuagaauaaagaauuuuc

SEQ ID NO: 174248 - RNA, 64 nt, Human
aagaaagguggcaagguaaacuaacagcucaaauucccaauauaaguggaccaguuccucauaa

SEQ ID NO: 174249 - RNA, 64 nt, Human
uauauucauauauuuuggauacgcaccccccaacucccaauacuggcucugucugaguaagaaa

SEQ ID NO: 174250 - RNA, 64 nt, Human
gaugagugauucuugggaagauaaauguuaauguucccaauagucaagcuuguuuugcaguagu

SEQ ID NO: 174251 - RNA, 64 nt, Human
ccacugggcugugggggaaggggucaaggccauaucccaauacguguagggcgagggucccugc

SEQ ID NO: 174252 - RNA, 64 nt, Human
ucaguagccugggcauaguggcucacaccuguaaucccaauacuuuagaaggccaaggcuggag

SEQ ID NO: 174253 - RNA, 64 nt, Human
cuggaauucacccucucauguuucccuacuaacaucccaauaaaguccucuucccuaccaggcc

SEQ ID NO: 174254 - RNA, 64 nt, Human
ugaaggugggggguagguugguuguucagagucuucccaauaaagaugaguuuuugagccuccg

SEQ ID NO: 174255 - RNA, 64 nt, Human
ugcaccuaagaauaaaugguauuugggcauguauucccaauauguguauauuuauuuauaaaua

SEQ ID NO: 174256 - RNA, 64 nt, Human
acaccugggacuuuccccuucugguuccugugucucccaauaaacucucugaccaacccuagcu

SEQ ID NO: 174257 - RNA, 64 nt, Human
caccuccacugacagaggcggccccucccacggcucccaauaaaaaugugaaaaccaacccccg

SEQ ID NO: 174258 - RNA, 64 nt, Human
acuacuucguaucaaggguuguauuuucuuuauuucccaauagcauguuccucauuccccaaug

SEQ ID NO: 174259 - RNA, 64 nt, Human
accacuuuauaucaaggguugucuuuucuucauuucccaauagcauguuccucauuccccaaug

SEQ ID NO: 174260 - RNA, 64 nt, Human
cuugcuucacaucacaaggcaaggugaacucaacucccaauaaacugcuugcuggagccuccga

SEQ ID NO: 174261 - RNA, 62 nt, Human
cuggggcacccagcuccugaggcuuugucccuucccaauaaagccugcuaccuggcaguacc

SEQ ID NO: 174262 - RNA, 64 nt, Human
gccaccacucccuuagucuuucccaggcuuacucucccaauaaaugugcuagagcucugccaac

SEQ ID NO: 174263 - RNA, 64 nt, Human
gugggcaaagggggcuccccuggguuauuuauuuucccaauaauuuugugugagcuacagaaga

SEQ ID NO: 174264 - RNA, 64 nt, Human
auagacacacuaguggucauggcauguccucaucucccaauaaacaugacuuuagccucugcug

SEQ ID NO: 174265 - RNA, 64 nt, Human
ggaaauguggcucucuccaucuugcauacagggcucccaauagaaaugaacacagagauauugc

SEQ ID NO: 174266 - RNA, 64 nt, Human; identical to SEQ ID NO: 174265

SEQ ID NO: 174267 - RNA, 64 nt, Human
ugucucugugacuguaaauccugcccugccccacucccaauaaaagcuuugguguauaggcuca

SEQ ID NO: 174268 - RNA, 64 nt, Human
cuuggccuaugacaggucaccguguguaaaucuuucccaauaaaguguugcacaaaggcauccu

SEQ ID NO: 174269 - RNA, 64 nt, Human
gugcccggcacgagcugaaccucauguguuccacucccaauaaaagguugacaggggcuucucc

SEQ ID NO: 174270 - RNA, 64 nt, Human
cugcuccugccccugaaccuaugacauacccaagucccaauacuuucgagccaucugccacugc

SEQ ID NO: 174271 - RNA, 64 nt, Human
agcugggaaaguuuuacauugucuguuuuucuucucccaauagcuuucaauuguucuuucugga

SEQ ID NO: 174272 - RNA, 64 nt, Human
uuuacauagcauuuguguaaagacuaugaucucaucccaauaaaaugauauauuaaaccuucag

SEQ ID NO: 174273 - RNA, 64 nt, Human
ccagcauagacuguaugauuucugcuauuuugcaucccaauauaggaguagaauaauaucuacu

SEQ ID NO: 174274 - RNA, 64 nt, Human
uguucuucuaaagugucaucuucugcccucccugucccaauagggaccacaucuuauuugucuc

SEQ ID NO: 174275 - RNA, 64 nt, Human
guguucaguggcacccccagccuggguccccuccucccaauagaggcugagccggagccagggc

SEQ ID NO: 174276 - RNA, 64 nt, Human
ucuuccuaaauuucauuguguugauuucuuuccuucccaauaggugaucuuaauuacuuucaga

SEQ ID NO: 174277 - RNA, 64 nt, Human
ucuugucgccgcccaggauugaccuguguguaagucccaauaaacucaccuacucaucaagcug

SEQ ID NO: 174278 - RNA, 64 nt, Human
cugaucaccugacagggcaccccaaacccccaacucccaauaaaagccgugacguucggacaaa

SEQ ID NO: 174279 - RNA, 64 nt, Human
ggugccucuggcuggaggcucccucccuuggccgucccaauagagcccggggcuacuuccacug

SEQ ID NO: 174280 - RNA, 64 nt, Human
uccugucgcugcccaggauugaccuguguguaagucccaauaaacucaccuacucaccaagcug

SEQ ID NO: 174281 - RNA, 64 nt, Human
caagcguugagccacuaagcagaggaccuuggguucccaauacaaaaauaccuacugcugagag

SEQ ID NO: 174282 - RNA, 64 nt, Human
uuguguccauucuuacaagcccuggucagucaagucccaauaaauggucagcacaaaaaagaua

SEQ ID NO: 174283 - RNA, 64 nt, Human
ugcuccuauguuggaaauuuguucauuaaaauucucccaauaaagcuuuacagccuucugcaaa

SEQ ID NO: 174284 - RNA, 64 nt, Human; identical to SEQ ID NO: 174283

SEQ ID NO: 174285 - RNA, 64 nt, Human
ugcuccuauguuggaaaauucuucauugaaguucucccaauaaagcuuuacagccuucugcaaa

SEQ ID NO: 174286 - RNA, 64 nt, Human
cagaaggcucgccucuccccguggacccuguuaaucccaauaaaauucugagcaaguucagagu

SEQ ID NO: 174287 - RNA, 64 nt, Human
ccacccucuaguguauuucacagaaaacaaaaccucccaauaaaacgguugaaaccugaaucuc

SEQ ID NO: 174288 - RNA, 64 nt, Human
ugcuccuguguuggaaauuugaccauuaaaauucucccaauaaagcuuuacagccuucugcaaa

SEQ ID NO: 174289 - RNA, 64 nt, Human
caggccagucaacugcacaauacacaacuguauuucccaauacacuugagcaguugccugugaa

SEQ ID NO: 174290 - RNA, 64 nt, Human
uguaacuugcauuuaugugcacucugcauagguuucccaauaauacuguaauguugcugaacac

SEQ ID NO: 174291 - RNA, 64 nt, Human
cucgggggguaauuuccggaagggcuccauacugucccaauaaggugaggccaguagcaggaau

SEQ ID NO: 174292 - RNA, 64 nt, Human
aaguccuuugucacuucucuugccuuagugugccucccaauacucccuucuuccugcccccaca

SEQ ID NO: 174293 - RNA, 64 nt, Human; identical to SEQ ID NO: 84600

SEQ ID NO: 174294 - RNA, 63 nt, Human
gaaaucuagccccagacauacuguguugagagauacuuagagggagggaguagguuuugaaga

SEQ ID NO: 174295 - RNA, 57 nt, Human
uauauucucuuauuucuuaaauaauuauacuuagaacuuaccaaacuaagaauuauu

SEQ ID NO: 174296 - RNA, 63 nt, Human
gcauuaaauaaacagaggaggggggucaagugauacuuagauauuggcacacacaaggaacaa

SEQ ID NO: 174297 - RNA, 63 nt, Human
cuauaccugcuucagugaaauaauuacagaauauacuuagaaaggcaaaguacauuguaaaau

SEQ ID NO: 174298 - RNA, 63 nt, Human
gauuugucauauucaucuuugguuuacuaaauuuacuuagaaauauuugaaaugcaaaauugu

SEQ ID NO: 174299 - RNA, 63 nt, Human
aagcacuugccuaacagaaaucaguauuucuucuacuuagaaggcuuggggcccaggguaaug

SEQ ID NO: 174300 - RNA, 63 nt, Human
uauucuuaaaguaagcuagagaaaagaaaauguuacuuagaaaaucauaaggaagagaaaaua

SEQ ID NO: 174301 - RNA, 63 nt, Human
aaagcaagucugcaguuccuugcuaaucugagcuacuuagaguguggucuccccaccaacucc

SEQ ID NO: 174302 - RNA, 63 nt, Human
acuuugaggauaaaaggaccaaagaaaaagcuuuacuuagaugauugauuggggccuaggaga

SEQ ID NO: 174303 - RNA, 63 nt, Human
uacuuacacauuuccucuuuuggaaaaaugagauacuuagaauaacaagaaaauuaagacaua

SEQ ID NO: 174304 - RNA, 63 nt, Human
cgcuaauucuguaugggagcacucaaaaggcauuacuuagagauugaaauuucaaacuaucuc

SEQ ID NO: 174305 - RNA, 63 nt, Human
cugggcaugguggccugugccuauagucccaacuacuuagaggaggaucgcuugaucucagga

SEQ ID NO: 174306 - RNA, 63 nt, Human
uauuuugaaauuguaaauacauguacagacaaauacuuagacaguaugcauacugguguuaac

SEQ ID NO: 174307 - RNA, 63 nt, Human
cucacaccagccucauuuccaacuccgacuuccuacuuagaauguggcaguggcuuugugagu

SEQ ID NO: 174308 - RNA, 63 nt, Human
gaaagaggcuuuacauacuuucuauguacuauuuacuuagaagggagcccccuuccagucaug

SEQ ID NO: 174309 - RNA, 63 nt, Human
agguuuaauuguaccuuuaauuugcuuauucaguacuuagaauuuguuuaacugguacuuuua

SEQ ID NO: 174310 - RNA, 63 nt, Human
acuuaauguuguuauuguauguuguuacugaaguacuuagauuuuuaaaauuucaaauccuaa

SEQ ID NO: 174311 - RNA, 63 nt, Human
aagaccaaaggaaggaacgcuaacaauuucucauacuuagaaacaaaaagagcuuuccuucuc

SEQ ID NO: 174312 - RNA, 63 nt, Human
uguguguaaugggcuggcccaagaguguucuuuuacuuagaacuccuuuugauuuugcuuuuc

SEQ ID NO: 174313 - RNA, 63 nt, Human
acauucaccaacuauuauuuucccuuguuuaucuacuuagauaucuguuuaaucuuacuaaga

SEQ ID NO: 174314 - RNA, 63 nt, Human
uaaaagugaaacuuagauacaauugugauuggauacuuagauacuaagugaaacuuaguguaa

SEQ ID NO: 174315 - RNA, 63 nt, Human
uaacuauacaguuaaugguuuagaacuuagaacuacuuagaauuaaugcuaaagugucaggaa

SEQ ID NO: 174316 - RNA, 63 nt, Human
aaaauacaucaagccagcuucauucacucacuuuacuuagaacagagauauaagggccuggga

SEQ ID NO: 174317 - RNA, 63 nt, Human
gccaugacuauuuuuauuaucauuauuaaugauuacuuagaucaauuauuuagcaguggacua

SEQ ID NO: 174318 - RNA, 63 nt, Human
gugccuaccuuuaauggaaaaauacaugucagauacuuagauguuuauugauaugagacuaug

SEQ ID NO: 174319 - RNA, 63 nt, Human
guugauaaagugaggacgaucauagacauggaguacuuagacauauuaauaaacaauaaagac

SEQ ID NO: 174320 - RNA, 63 nt, Human
uuuggauuugguaagccuuugcacucuguagaguacuuagaagacaagggcaacuuacuugga

SEQ ID NO: 174321 - RNA, 63 nt, Human
uguccagaauuauucuugagcacugauguaaauuacuuagaucuucuuugaggucagaauuca

SEQ ID NO: 174322 - RNA, 63 nt, Human
cuugccuuugcuauaugguagaaucacagaacuuacuuagagaauaaauaugucuauuguuca

SEQ ID NO: 174323 - RNA, 63 nt, Human
caaaucuaagcaaucauuuuuccccccagaaguuacuuagaaggagaacugggaacacuuggg

SEQ ID NO: 174324 - RNA, 63 nt, Human
uucucccaacaaugcguaucagcuauucauugauacuuagagugggugugauuuauuugacau

SEQ ID NO: 174325 - RNA, 63 nt, Human
gcucuugcuuaucuuuguuuugcaaaauuguucuacuuagaaaacaguccuuaaaauaguuug

SEQ ID NO: 174326 - RNA, 63 nt, Human
ugacuauccuggcaucacauuuaacauguuaucuacuuagaaagcauuuguagagcugcugaa

SEQ ID NO: 174327 - RNA, 63 nt, Human
aagaucuugucucuuaaagaaaaaaaaaaaagguacuuagaggucgcacuuaaagauuaugca

SEQ ID NO: 174328 - RNA, 63 nt, Human
uuucuuacuccacuaaacuauaaagaaaauaauuacuuagaaacuccauuuuaaauaaucauu

SEQ ID NO: 174329 - RNA, 63 nt, Human
uuugacucccagaagguaccccaguccccaguguacuuagaaaggaucucgaacauugcugga

SEQ ID NO: 174330 - RNA, 63 nt, Human
cuauuuggaacuggauguuuuugaauuauuuuauacuuagagauauucugaauuuuuugaggg

SEQ ID NO: 174331 - RNA, 63 nt, Human
uucauucaguucccuuccauuaucauuuacuuuuacuuagaaguauccaaggaagucuuuuaa

SEQ ID NO: 174332 - RNA, 63 nt, Human
ucucuaaugcauuugaagacuuauuacauggcuuacuuagagcauuuaagauuaucacagccu

SEQ ID NO: 174333 - RNA, 63 nt, Human
aaauauauuuaagucuuuauagauauaaagcuuuacuuagauauaacuugagugaguagggaa

SEQ ID NO: 174334 - RNA, 63 nt, Human
gauuuccuuguuuuuguaauaggugagauaaaguacuuagauuuauaaggcagcuuccccugu

SEQ ID NO: 174335 - RNA, 63 nt, Human
uuguaaugugaugaagugaugaugucuuaacucuacuuagagaguguaugucugucuaacaga

SEQ ID NO: 174336 - RNA, 63 nt, Human
uuggcauuggaguguuuuacccucuagcuguuuuacuuagaauguaacauaugcugccuaccc

SEQ ID NO: 174337 - RNA, 63 nt, Human
uuaaggcagcaaguccuggguugugaaaaaugauacuuagagaugaggcgacaugaggagaua

SEQ ID NO: 174338 - RNA, 63 nt, Human
ccagcuaagaauguguggcaccuccaucaguuauacuuagaaggagcagaaauaguuauuuuc

SEQ ID NO: 174339 - RNA, 63 nt, Human
uauagcuguauaaacaucgugauuauauucaucuacuuagaaauuguuuuauuuuuaaauuaa

SEQ ID NO: 174340 - RNA, 63 nt, Human
auuccucaucagguuuuagaagcgggguaaaaauacuuagaugcuuaucagacuugaaauuau

SEQ ID NO: 174341 - RNA, 63 nt, Human
uacuuuuuauaaaguuuuuuuuccuuagucuccuacuuagagauauucuagaaaaugucacuu

SEQ ID NO: 174342 - RNA, 63 nt, Human
uacugacaguguuuaagcuuuacuccaccuccuuacuuagaaaucacuuuacgauuuauuucc

SEQ ID NO: 174343 - RNA, 63 nt, Human
ccagggcccgccaaccgcugccuuucucgggaguacuuagagccucgaacccgcgucccuggg

SEQ ID NO: 174344 - RNA, 63 nt, Human
gaacugccuuguguucugugagaaacaaauauuuacuuagaguggaaggacugauugagaaug

SEQ ID NO: 174345 - RNA, 63 nt, Human
aaaauacaguuagcuagcaaauauggacagguuuacuuagaaauccuguuucuaaaugcaagu

SEQ ID NO: 174346 - RNA, 63 nt, Human
cuaaggucuaggguugauauuaacaaaggaauguacuuagaauagcaguacauuuuaugcaaa

SEQ ID NO: 174347 - RNA, 63 nt, Human
cuuccuccuuagaauuuagagauacaagaguucuacuuagaacuuuucauggacacaauuucc

SEQ ID NO: 174348 - RNA, 63 nt, Human
cccuuggguaaaccaaugggaaaaucuucuaauuacuuagaaccugaccagauguggcucgga

SEQ ID NO: 174349 - RNA, 63 nt, Human
auuuuuuuguuuccagaauaaauauguguguauuacuuagaugguuaguuuucaccugaaauu

SEQ ID NO: 174350 - RNA, 63 nt, Human
cucuuaauccugggguaaaaggagagauugccauacuuagacucacugugagucuccccggcc

SEQ ID NO: 174351 - RNA, 63 nt, Human
uuagaauaaaaaccauuugccaaagcaacacucuacuuagaagcacauguacauacauggacc

SEQ ID NO: 174352 - RNA, 63 nt, Human
aagauuuuuucuccuuuucuuuguccucaaccauacuuagaggaaagaaggaauggucuucca

SEQ ID NO: 174353 - RNA, 63 nt, Human
aaaaggaugaauuuccuccaucacccagauuuauacuuagagucagacgaagucgccugguua

SEQ ID NO: 174354 - RNA, 63 nt, Human
agagaggauuuuauagagucugugagaaggagauacuuagacauuucuacccugaagaacuaa

SEQ ID NO: 174355 - RNA, 63 nt, Human
ggcagaauaguuuuaaauuuugcuguauuugauuacuuagagauaggaauuuuuaaaaaucaa

SEQ ID NO: 174356 - RNA, 63 nt, Human
auucuuuuuuauaaugcuuacaggaauguuaaauacuuagacagaucuuaaguacacuagaau

SEQ ID NO: 174357 - RNA, 63 nt, Human
auccgcaugugucuguauucauacagcacuacuuacuuagagaugcuacugucaguguccuca

SEQ ID NO: 174358 - RNA, 63 nt, Human
auaaaucaauuguuuugcaaagaaguuauggccuacuuagaaucuaaaauuuguuauucaaau

SEQ ID NO: 174359 - RNA, 63 nt, Human
ucucccagggaaucccuucugcaaaccaaacguuacuuagacugcaagcuagaaagccaccaa

SEQ ID NO: 174360 - RNA, 63 nt, Human
cauugggaguuggguuucaguggggcaugucuauacuuagagaaaaaaaguccaaaugaagau

SEQ ID NO: 174361 - RNA, 63 nt, Human
aaggagaugguagggauugguucaacauuuggguacuuagaggauaaagcuucguggucguau

SEQ ID NO: 174362 - RNA, 63 nt, Human
auguaaaagcaagcuguguguugcuuagucacuuacuuagaaguagauggugggggacagcgg

SEQ ID NO: 174363 - RNA, 63 nt, Human
agagagugggagacuguccccaucaguuguccuuacuuagaggagacagagaggccaaucagg

SEQ ID NO: 174364 - RNA, 63 nt, Human
ggugggucucaugguuucauuuugcuuugggcuuacuuagaguuuuggcaaaugcagaguuau

SEQ ID NO: 174365 - RNA, 63 nt, Human
ucuaauauaagcaaguaaaaauacaaauuuaauuacuuagaaaugauaacuaagaucacaaug

SEQ ID NO: 174366 - RNA, 63 nt, Human
uuuugaucauuucuauaaaagaaauggucauuuuacuuagaugccagucuacuuuauaaagac

SEQ ID NO: 174367 - RNA, 63 nt, Human
cgugcuauccaguaauauacuuaaauaagccaauacuuagaucuacuguaaggcagaugcuaa

SEQ ID NO: 174368 - RNA, 63 nt, Human
augucuuaugagauuguucugcuuuuucuaaguuacuuagauguuggauauguacauagcugu

SEQ ID NO: 174369 - RNA, 63 nt, Human
gacuuuacguguuaauucuuuauucuugauguguacuuagagaaacuuaagagguccuguggu

SEQ ID NO: 174370 - RNA, 63 nt, Human
caaauucuuauuuuuguacaguuuugaaguuuauacuuagaacugaccaccuccccggccacg

SEQ ID NO: 174371 - RNA, 63 nt, Human
uguuuuguaaaucaacugaauugagguacuauuuacuuagauuuauugcacccuuuuuacgug

SEQ ID NO: 174372 - RNA, 63 nt, Human
uguuuuagcauuaaacuguugaacuuuuuuuuguacuuagaaaaccuagauacugcagucaga

SEQ ID NO: 174373 - RNA, 63 nt, Human
aacaaaagcaaacuaguccaguuuaauuuuuuguacuuagaauauugcacauuuucuauauau

SEQ ID NO: 174374 - RNA, 63 nt, Human
uuaugucaagauucaaguuauaaauuaacguuuuacuuagacuuugaaagagauuucaugagu

SEQ ID NO: 174375 - RNA, 63 nt, Human
gccaggcacguuccaggcaccugugaucccagcuacuuagaggcugaggcagaagaauugcuu

SEQ ID NO: 174376 - RNA, 63 nt, Human
uuacuuuuuaaaauacacuggguaaaucaccuauacuuagaguaacaguuuguuaucaaaaug

SEQ ID NO: 174377 - RNA, 63 nt, Human
gcuaaugggucaguggguucuuuuuaauguuuauacuuagauuuucuuuuaaaaaaauuaaaa

SEQ ID NO: 174378 - RNA, 63 nt, Human
uguuuaaaucaucaggucuuauaaaauauaauguacuuagagcuggauucauggcuguuuauu

SEQ ID NO: 174379 - RNA, 63 nt, Human
gaggagucagauuaucuacuuagauuuggcaucuacuuagauuuaacauauacuagcugagaa

SEQ ID NO: 174380 - RNA, 63 nt, Human
gaguagggcuauguagagaggagucagauuaucuacuuagauuuggcaucuacuuagauuuaa

SEQ ID NO: 174381 - RNA, 63 nt, Human
ccaaguaacagugauagaaguuagaaaaaccuuuacuuagaauuguccaccuagucagagccc

SEQ ID NO: 174382 - RNA, 63 nt, Human
uauuuuuauaucucugugguuuugaaacuuuaguacuuagaauuuuggccuucugcacuacuc

SEQ ID NO: 174383 - RNA, 63 nt, Human
uuuaguuuagcugcuuuaacauggagucauacauacuuagagguaagucauuuauuauuuuuu

SEQ ID NO: 174384 - RNA, 63 nt, Human
ucauucagcuuccugaguaccacauuccccagcuacuuagacacggguuaaaauauuaagaug

SEQ ID NO: 174385 - RNA, 63 nt, Human
uaauuggacgggagacagagugaagcaucaaccuacuuagaagcugaaacguggguaaggauu

SEQ ID NO: 174386 - RNA, 63 nt, Human
auuaagaugccuugaauugucuaggguguucuguacuuagaaaguaagagcucuaaguaccuu

SEQ ID NO: 174387 - RNA, 63 nt, Human
ugaaacaucacuuguuugcuuaauucuacacaguacuuagauuuuuuuuacuuuccaguccca

SEQ ID NO: 174388 - RNA, 63 nt, Human
cgguaccaauccuaggaacuguauacuaguuccuacuuagaacaaaaguaucaaguuugcaca

SEQ ID NO: 174389 - RNA, 63 nt, Human
uucuaaguacuuuacuuguauuaucccauuuaauacuuagaacaaccccgugagauaaguagu

SEQ ID NO: 174390 - RNA, 63 nt, Human
cauucgccaacgcgggaaaggcaaggccuggcuuacuuagagcuuccagagagcauagcugcu

SEQ ID NO: 174391 - RNA, 63 nt, Human
guaugaugauuuggggauuuucugaaucauuuguacuuagauacuggaguucagaagauguga

SEQ ID NO: 174392 - RNA, 63 nt, Human
uucuugggccuuuuguucaauuguguauuggcguacuuagaauuuuuuuuauuugaaagagaa

SEQ ID NO: 174393 - RNA, 63 nt, Human
acaacagauuuuuuuguuguuguuagucacaaauacuuagaacuggaaggcucuuuguuauua

SEQ ID NO: 174394 - RNA, 63 nt, Human
uuuuagaguuuuuucuaucuaaaauuaguuaaauacuuagaauguuuguaaugaguguucgau

SEQ ID NO: 174395 - RNA, 63 nt, Human
ggauggaucuucucugaacucagggagggcacauacuuagauaccuacaagacuuggaggaau

SEQ ID NO: 174396 - RNA, 63 nt, Human
aggagagaaaaaaaaaucaaagggcagucucaauacuuagaaaauuauuguuugucuguugcg

SEQ ID NO: 174397 - RNA, 63 nt, Human
cacacacgucaucugcauuguuauuggagccuguacuuagagggauuaagcccacacccuggc

SEQ ID NO: 174398 - RNA, 63 nt, Human
uggauuauguggaauuguagugccaucgguuuuuacuuagagcccuugacgugcuuggaccaa

SEQ ID NO: 174399 - RNA, 63 nt, Human
cugacuuguagaaauggggugccauuuaugcucuacuuagacaaggguaaucagaaauggaau

SEQ ID NO: 174400 - RNA, 63 nt, Human
acaauauuugaaaugucccagauauuucuaugcuacuuagauauuuguggcaaagcagaaagc

SEQ ID NO: 174401 - RNA, 63 nt, Human
ggacccagaugaaccacaaggcagcuagucagcuacuuagagguugguuacauucgaauaaaa

SEQ ID NO: 174402 - RNA, 63 nt, Human
accuacccauacuuuguacaacucuuacacaaauacuuagauauuuauuagauagcccugaau

SEQ ID NO: 174403 - RNA, 63 nt, Human
uguuacaaaccaagccuaagacacaucugugaauacuuagauuuguagcuuaaucacauucua

SEQ ID NO: 174404 - RNA, 63 nt, Human
uaucuucucagcccugcuacugucugcugcuccuacuuagaaguugcaggcaauauccugugc

SEQ ID NO: 174405 - RNA, 63 nt, Human
ccgaccugaaacaccaagcauuaagcaaaaaguuacuuagaguccaucugcggccaggaagug

SEQ ID NO: 174406 - RNA, 63 nt, Human
auauuuuuugaaagacuuuuguauaaaguugaguacuuagaaaaaagacaaaccagauguaau

SEQ ID NO: 174407 - RNA, 63 nt, Human
gaugcuuuuauauauuuuucuuuuccccagaauuacuuagauuaauuagauguauaguaaaau

SEQ ID NO: 174408 - RNA, 63 nt, Human
uuugcgacauaggccuacagaauuagacuuucauacuuagaagauaagguacacucuucuucu

SEQ ID NO: 174409 - RNA, 63 nt, Human
cucccaauacaggcaugaaccacugcacccaccuacuuagauauuucaugugcuauagacauu

SEQ ID NO: 174410 - RNA, 63 nt, Human
aagcuuaaugcagcucauuugcuaccauuuggauacuuagacacuuugagcaagauuguggca

SEQ ID NO: 174411 - RNA, 63 nt, Human
guguguuugccacaaaacauugcuugaagcacauacuuagauagaaauuggucuuaauuuaua

SEQ ID NO: 174412 - RNA, 63 nt, Human
uuaaaaugucaucuuugcuuguacuagauuucuuacuuagaauuuuuaaaaaucauuuucuug

SEQ ID NO: 174413 - RNA, 63 nt, Human
cauaaacauuuaaacaauguucuaagguacauauacuuagaacauugagauauauacuacaag

SEQ ID NO: 174414 - RNA, 63 nt, Human
ucucuauguagacagggauccauuuuaaagagcuacuuagagaaauaauuuuccacaguucca

SEQ ID NO: 174415 - RNA, 63 nt, Human
uauguauuuugugauucugauaggauguauaaauacuuagaugcauacaagccgauggauaga

SEQ ID NO: 174416 - RNA, 63 nt, Human
ucuuguucgcggcuaaaugacaguuucugucauuacuuagauuccgaucuuucccaaaggugu

SEQ ID NO: 174417 - RNA, 63 nt, Human
acccguagcagucuguuuaccuuguaaagggauuacuuagaagacauuuuuguacaugcucuu

SEQ ID NO: 174418 - RNA, 63 nt, Human
cacuacggaucuggaaaauacuggaaaaugugauacuuagaauacuuuggcugcuaaggaaac

SEQ ID NO: 174419 - RNA, 63 nt, Human
ccaugguugaaauaaaacagggugacugggaguuacuuagaauucaugaagauuuuaaaaugg

SEQ ID NO: 174420 - RNA, 63 nt, Human
cauuaucuguuugguccuuauacaguuuuaacuuacuuagauuuauucuaguuaagccauaag

SEQ ID NO: 174421 - RNA, 63 nt, Human
guacccuaccauauacuuuuguauuuaauagauuacuuagaaaccacaaaaauaggaauccuu

SEQ ID NO: 174422 - RNA, 63 nt, Human
ucuacagggucauccuuaugagacucuuaaauauacuuagauccugguaagaggcaaagaauc

SEQ ID NO: 174423 - RNA, 63 nt, Human
auucauagcuggucuuauuuguaaagcucacuuuacuuagaauuaguggcacuugcuuuuauu

SEQ ID NO: 174424 - RNA, 63 nt, Human
aggcaaugguuugugucaaaacugguuuaggauuacuuagauuguguuccugaagaaaagagu

SEQ ID NO: 174425 - RNA, 63 nt, Human
cuuacacuccucuugccaccccccaucccugcuuacuuagaccucagccggcgccggacccgg

SEQ ID NO: 174426 - RNA, 63 nt, Human
ugaaauaaaacuguaaauuugcauaacuggauguacuuagauaaugugaaauaaacauuaaag

SEQ ID NO: 174427 - RNA, 63 nt, Human
gugauuuugcugaaaugaaagggauaaaaugaauacuuagagaauaauacuucauuuuugcag

SEQ ID NO: 174428 - RNA, 63 nt, Human
caaagaucacuuguuguuuuacuaaagaaagauuacuuagaggaaauaagaaaaaucauguuu

SEQ ID NO: 174429 - RNA, 63 nt, Human
caaauuauuuauaugcauuaauuuaagagcaucuacuuagaagaaaccaaauagucuaucgcc

SEQ ID NO: 174430 - RNA, 63 nt, Human
aaggagucaccugcagucuuuuguuuuuuuaaauacuuagaacuuagcacuuguguuauugau

SEQ ID NO: 174431 - RNA, 63 nt, Human
uguguauaaguaauuaugauauugcaaaagugauacuuagauuuuacagccucaguagucugc

SEQ ID NO: 174432 - RNA, 63 nt, Human
ggaacaggcgaagugucagcccucaauguuggguacuuagacccaaaccaauaaauggugagu

SEQ ID NO: 174433 - RNA, 63 nt, Human
ucaaagauggcucaccaaucaccugccuguuuuuacuuagaaagcaggcuugggcaggagggg

SEQ ID NO: 174434 - RNA, 63 nt, Human
aacuguuuuuuauuuggucuuagggcugucugauacuuagagcugaaggcauuccagcugaca

SEQ ID NO: 174435 - RNA, 63 nt, Human
agaucuagcacuuuacaaaguaaguuuuucuguuacuuagagcugaaaauaaaagcaauguag

SEQ ID NO: 174436 - RNA, 63 nt, Human
uuuuuuuuuuuucuaauuucagacuuggcuuuuuacuuagaggacauucugauuugcucucag

SEQ ID NO: 174437 - RNA, 63 nt, Human
ugaaaaaugccuccaaacauuuuucuguacucauacuuagauucacaaugguuguguaucucu

SEQ ID NO: 174438 - RNA, 63 nt, Human
ugagaccaucucuuccuuucuuuccccuucuuuuacuuagaaugucuuuguauucauuugcua

SEQ ID NO: 174439 - RNA, 63 nt, Human
aaaggagagagaaggacuggauuuaagccaguuuacuuagaguauaugauaaagaaggcagag

SEQ ID NO: 174440 - RNA, 63 nt, Human
aucuaugauugaguguccguguaaauaaauuccuacuuagacuuaccacuuugugugugcuug

SEQ ID NO: 174441 - RNA, 63 nt, Human
ccagguguugcugacacuggaugacgaccuggauacuuagaaaggggcuucaggaagggaugu

SEQ ID NO: 174442 - RNA, 63 nt, Human
uguauagagcuuuggguguaggauaugaaauuguacuuagauuuaagaaaaagagaaaaucag

SEQ ID NO: 174443 - RNA, 63 nt, Human
guuuugcagggcaggaguauucuggaaucuuuuuacuuagauauaaaauaaaccucgaauauu

SEQ ID NO: 174444 - RNA, 63 nt, Human
gacuuacugugugcaggaagucucgugagaauauacuuagaaaaucacacuuaucuggaaauu

SEQ ID NO: 174445 - RNA, 63 nt, Human
aguccuuuugcucucggaggccagggaagaugguacuuagaggcuuuuccccuaucgcucugg

SEQ ID NO: 174446 - RNA, 63 nt, Human
aucuucaaaaugaguccuaaagaacauacugaguacuuagaaguagaagaacauaagauguau

SEQ ID NO: 174447 - RNA, 63 nt, Human
uauugcauauuugcuauguccucaguguaccacuacuuagagauauguaucauaaaaauaaaa

SEQ ID NO: 174448 - RNA, 63 nt, Human
uaaagucccaguguuagaugagugaccuaaauauacuuagauuucuaaguauggugcucucag

SEQ ID NO: 174449 - RNA, 63 nt, Human
augcuuauucauuuaacaccuaucucaaaaacuuacuuagaagguuuuuuauuauaguccuac

SEQ ID NO: 174450 - RNA, 63 nt, Human
uccuacaauggguauguuaaauaacuauaucuauacuuagauauagugcauugucuguguccc

SEQ ID NO: 174451 - RNA, 63 nt, Human
augaaaacucuuugcugcugcccauguuucaaauacuuagagcagugaagacuagaaaauuag

SEQ ID NO: 174452 - RNA, 63 nt, Human
uuuuuaaagaugcuuaggcaccuaagcaaauaauacuuagagguugaauuuggucuacaggcu

SEQ ID NO: 174453 - RNA, 63 nt, Human
gcacaguaaauaaguuuuuucauuguguagaaauacuuagaugucaaaaccagauuucgugau

SEQ ID NO: 174454 - RNA, 63 nt, Human
uauuucauuuaacaaguuguaaaacucugauuguacuuagagaugugacuaccaaucaguuug

SEQ ID NO: 174455 - RNA, 63 nt, Human
ucuguuaaucucaaaguguggccaacucccauuuacuuagaggcugauuaucuaguuuuguag

SEQ ID NO: 174456 - RNA, 63 nt, Human
ccauauuuucuuugcauuugaauaauugucuuguacuuagaaaaaaggcgucuaugaaugacc

SEQ ID NO: 174457 - RNA, 63 nt, Human
guauauuuugguggauucucuguccuauacauuuacuuagaaggaauggaguuauuugucucu

SEQ ID NO: 174458 - RNA, 63 nt, Human
acuuuuuaaaaaacaugaucacacuguauaagcuacuuagaacuuugaagggcauuaugaucc

SEQ ID NO: 174459 - RNA, 63 nt, Human
guaguauuuccuucucacuaccuuguaccuuuauacuuagauuggaauucuuaauaaauaaaa

SEQ ID NO: 174460 - RNA, 63 nt, Human
uccuucauuaacuuggugguagaaaaaaauauauacuuagaaauccuuaaauuaaagccaugu

SEQ ID NO: 174461 - RNA, 63 nt, Human
aaaaagcagugaauuguaagugugagguguguuuacuuagaugugaagaguucuccuuacugc

SEQ ID NO: 174462 - RNA, 63 nt, Human
cuuaccuguuaauggaagaauuugcauaauaucuacuuagaaagguaaguuaaaaguaguuuu

SEQ ID NO: 174463 - RNA, 63 nt, Human
aaaauguuuguugaaaaaauagucuucuccacuuacuuagauaucugcaggggugucuaaaag

SEQ ID NO: 174464 - RNA, 63 nt, Human
accacuaauagcagucauagugaagauuagcacuacuuagaauuaaauuaggaagucuuuuau

SEQ ID NO: 174465 - RNA, 63 nt, Human
aggauuuagauguauagaaaaguaagaaaaucuuacuuagaaaaaagccccuugaaacuugca

SEQ ID NO: 174466 - RNA, 63 nt, Human
gaaucuauugcgcaaaagaaguuucauuuugguuacuuagaccuaagaucacuuauuaaaaau

SEQ ID NO: 174467 - RNA, 63 nt, Human
auacauugaccguaguagcuguucaacuccuaguacuuagaaauacacguaugguuaauguuc

SEQ ID NO: 174468 - RNA, 63 nt, Human
uuuuauaauauccauauagaaaucuagaauuuuuacuuagauacuaauaaaauacauuuagaa

SEQ ID NO: 174469 - RNA, 63 nt, Human
cccgcuuacauuuaugugucaguguuuuccaacuacuuagaguuuauguaccucgugauuucu

SEQ ID NO: 174470 - RNA, 63 nt, Human
cccucuugcauuuauuugucaauguuuuccaaauacuuagaguuaugaauagcauaauuucuu

SEQ ID NO: 174471 - RNA, 63 nt, Human
augcaaauuccauagcucaauaaaagaaucugauacuuagaccaaaagcaacauucguucucu

SEQ ID NO: 174472 - RNA, 63 nt, Human
auuuuauucauuaucccuagauagcuauuaagauacuuagauuagaccuaacccaccauaguc

SEQ ID NO: 174473 - RNA, 63 nt, Human
uugugaggguuaaaggcaguaacagguauaaaguacuuagaaaagcaaagggugcuacguaca

SEQ ID NO: 174474 - RNA, 63 nt, Human
uacagcaaggcaugugccgcacgugcuccgugguacuuagagcccugggggccccgcucggac

SEQ ID NO: 174475 - RNA, 63 nt, Human
cauuuacaacugauuuugaucacagggaacacuuacuuagaacccugauuagaggcaauguua

SEQ ID NO: 174476 - RNA, 63 nt, Human
uucuggaugguucuuugacucuauuuuuauuuuuacuuagagacagggucuugcucuguugcc

SEQ ID NO: 174477 - RNA, 63 nt, Human
uauauuauguuuucgcuuuuguauuuuaagcuuuacuuagauauucaaaaccugguauaucaa

SEQ ID NO: 174478 - RNA, 63 nt, Human
cuauauuuuaauugaauucaaacuaucaagcacuacuuagaaacuggaaaacauauauauguu

SEQ ID NO: 174479 - RNA, 63 nt, Human
ugguuaguuguuacaugauagcagagauauuuuuacuuagauuacuuugggaaugagagauug

SEQ ID NO: 174480 - RNA, 63 nt, Human
uuaaaagaccaggaccucaagauagcagguuuauacuuagaaauauuugaagaaaaaaaagcg

SEQ ID NO: 174481 - RNA, 63 nt, Human
gcugaggguuucugucugggccuaucagguccauacuuagacccugagcaucuucuucauuca

SEQ ID NO: 174482 - RNA, 63 nt, Human
ccauaaacuccacaauucacaccaaaaugucuguacuuagagcuaauucgcauauauacagga

SEQ ID NO: 174483 - RNA, 63 nt, Human
uguagaguuuauuggauccugaaaccaaucaauuacuuagaacuaggcaaagaugaaaguaua

SEQ ID NO: 174484 - RNA, 63 nt, Human
aucuggagguuccacuguugcuucagucucaguuacuuagaauggaacccagaguccugcccc

SEQ ID NO: 174485 - RNA, 63 nt, Human
ccgaguugugcagagugacgucuguacuuuuuauacuuagaacauuuggucaaguuuuguaac

SEQ ID NO: 174486 - RNA, 63 nt, Human
agcacaagaaacuuuggaagcacuuuuucugcauacuuagaugaucuucaugggcccacaggg

SEQ ID NO: 174487 - RNA, 63 nt, Human
uaguaucacugcuuuuuccuuagcuuaaugacuuacuuagaauuuauccuuuauuuuaaauga

SEQ ID NO: 174488 - RNA, 59 nt, Human
uacauaacuuuucagcauagaaaaagagguacuuagaaguauugaaggaaaaaaugaag

SEQ ID NO: 174489 - RNA, 63 nt, Human
gaaggcugaacauaagagguuucuacucagcaauacuuagaugucuaacuguuuaauugcuac

SEQ ID NO: 174490 - RNA, 63 nt, Human
uuuguuuaaaugccaaaauguacuuaaaugaguuacuuagaaugccauaaaauugcaguuuca

SEQ ID NO: 174491 - RNA, 63 nt, Human
caucucuuugaauuguauuucuuguauauuacauacuuagagagagacucuuuuagccaggca

SEQ ID NO: 174492 - RNA, 63 nt, Human
gaacaagucauugaagagaaaaaaaaagcccaauacuuagagucccaauuuugucucauuugc

SEQ ID NO: 174493 - RNA, 63 nt, Human
ucccuuuuuuuguuauuuuuucagacugugcaauacuuagagaaccuauagcaucuucucauu

SEQ ID NO: 174494 - RNA, 63 nt, Human
ccgcacccagccaagaaaaauaauacucuuaaauacuuagauguucaccuaaaguugauauua

SEQ ID NO: 174495 - RNA, 63 nt, Human
agcuccauucuuuugguucaaaacguugauacuuacuuagauguucccugagaggaguguuua

SEQ ID NO: 174496 - RNA, 63 nt, Human
uccuguucugggugcuacugccaaacguuaugguacuuagagucgggaugcacaacuucaacc

SEQ ID NO: 174497 - RNA, 63 nt, Human
aauaaagaaguaauuauugacacauuucuuuuuuacuuagagaaucguucuaguguuuuugcc

SEQ ID NO: 174498 - RNA, 63 nt, Human
uuuucaaaaucauguuacaagauagacauauucuacuuagacguuaaacuguacaagugcgua

SEQ ID NO: 174499 - RNA, 63 nt, Human
gaaacugacuuuaaaagccuccuugaaguuuuuuacuuagaaauauaaggaauaagucuuuga

SEQ ID NO: 174500 - RNA, 63 nt, Human
gccaaugagucaaacauaguaucuuuauguagauacuuagauuacuaaauauauauuucaucu

SEQ ID NO: 174501 - RNA, 63 nt, Human
uuagagcaguagcuugcaguuucaguugaguucuacuuagaaauucuuuuuagcuagugggca

SEQ ID NO: 174502 - RNA, 63 nt, Human
aaugugugacauuauuuugcuacuacuccacacuacuuagacaucauguaguucacacuggaa

SEQ ID NO: 174503 - RNA, 63 nt, Human
ccccuguaucacucuccaggggacucuugauauuacuuagaucugacugugucacuccaaggu

SEQ ID NO: 174504 - RNA, 63 nt, Human
gacaucagucaaaugcaaugaaacagugguuuuuacuuagaucaugaguugaacaaacaugua

SEQ ID NO: 174505 - RNA, 63 nt, Human
cccacaaugauauuacaaaccuauuaaaaaugauacuuagacagaauugucaguauuauucaa

SEQ ID NO: 174506 - RNA, 63 nt, Human
auuuagcuccauggccacucacuguuguggucauacuuagaagagugggaugcaguggauggc

SEQ ID NO: 174507 - RNA, 63 nt, Human
ugaacauauggaaauagauuuauuguaaguauuuacuuagagcuuuuucuuaaaucugaacua

SEQ ID NO: 174508 - RNA, 63 nt, Human
uguauggaugagugucaaagugaauuugauuuguacuuagacacacgcguuuacacacacaca

SEQ ID NO: 174509 - RNA, 63 nt, Human
aaggagaacuuucagacccuaaaacaguuauauuacuuagauguuaaaauuuucuagugggcu

SEQ ID NO: 174510 - RNA, 63 nt, Human
auuuaauucaugaaaauaucauuaauccugcauuacuuagaucccauaugauauucaggaaua

SEQ ID NO: 174511 - RNA, 63 nt, Human
cauuaagugugauauaaaccuccucaaacauuuuacuuagaggcaaggauugucuaauuucaa

SEQ ID NO: 174512 - RNA, 63 nt, Human
guaagugacaaguauuuuuucugaacagaaguuuacuuagaaauaccaugcacuuggggguac

SEQ ID NO: 174513 - RNA, 63 nt, Human
uauuauucauuacugcauccccaguaaugaaaguacuuagaaaauaauuauugaaugaaugaa

SEQ ID NO: 174514 - RNA, 63 nt, Human
gacgccgggaacgcaggccgcuuuauuccucuguacuuagaucaacuugaccguacuaaaauc

SEQ ID NO: 174515 - RNA, 63 nt, Human
gacacucagcuguguguuccugggcuugugugguacuuagaaccucaguucuauuacguuaua

SEQ ID NO: 174516 - RNA, 63 nt, Human
ggaaagagggauucccuuugguguuuggucuucuacuuagaaaaaccuauugcaguuaguuua

SEQ ID NO: 174517 - RNA, 63 nt, Human
ccaguccacgccgggucgccugcccugucucccuacuuagacccagucauucuagagggaucc

SEQ ID NO: 174518 - RNA, 63 nt, Human
uggaaucuuaugucagaaauauaagcagcuauguacuuagaauagguuuugaaugggagaggu

SEQ ID NO: 174519 - RNA, 63 nt, Human
gagucauuuaaauguguacaauguacacacugguacuuagaguuucuguuugauucuuuuuua

SEQ ID NO: 174520 - RNA, 63 nt, Human
auaacuugaaauagguuuuuaggagaauucaucuacuuagacuuuuuaaaugccugccauaaa

SEQ ID NO: 174521 - RNA, 63 nt, Human
aauaaagaaacuguuuaucugucuccuugugaauacuuagaguaggggagcgccguaauugac

SEQ ID NO: 174522 - RNA, 63 nt, Human
ggauugauaauuuagauguuuauacauguaauguacuuagaucagugucugcucuuuucacuu

SEQ ID NO: 174523 - RNA, 63 nt, Human
aguccuugcacuucuaaucuuacauagcauccauacuuagaauuuggcauaucaucugggauu

SEQ ID NO: 174524 - RNA, 63 nt, Human
ucaccauggaugaaacuauaacuuaaagaauaauacuuagaaggguuaauuggaaaucagagu

SEQ ID NO: 174525 - RNA, 63 nt, Human
ugggagaaauauuuuguagcagaguauuuaguauacuuagaaguugauuuagcaauuaggcuu

SEQ ID NO: 174526 - RNA, 63 nt, Human
aguuaagaauuauaugaaaguugaaagcaagaauacuuagaauucuggcuuuaguuagaguaa

SEQ ID NO: 174527 - RNA, 63 nt, Human
ugugaauugggauaauaacagcaguggaauaaguacuuagaaaugugaaaaaugagcaguaaa

SEQ ID NO: 174528 - RNA, 63 nt, Human
uaaucuguuuacagucuuuugguauguuucaguuacuuagauggucucauaagguuucugaua

SEQ ID NO: 174529 - RNA, 64 nt, Human
cggguaccaggaagugcagagccgcacaggagcugccccggagcugaggggacggucuucggcu

SEQ ID NO: 174530 - RNA, 64 nt, Human
agggcaccagccacgaaggacggaggcgggcggggccccggagaacccugucccugcguguggc

SEQ ID NO: 174531 - RNA, 64 nt, Human
gcaggccccucugucuggccaccccucuguccuggccccggaaggcccuguggucaugugcucc

SEQ ID NO: 174532 - RNA, 64 nt, Human
ggcgucaggcuucccagacagagagugcggaugggccccggacccgguguccugucuacaucua

SEQ ID NO: 174533 - RNA, 64 nt, Human
cugcgccgcgcgggcaggcaccugugcgaccugugccccggaccugcggcgccgcccucgagcg

SEQ ID NO: 174534 - RNA, 64 nt, Human
cgccccccaccccagcgcugucugugggucccuugccccggagcugacucgccuccagugaguc

SEQ ID NO: 174535 - RNA, 64 nt, Human
ccucccagcuggccuugucccaggggcgacggcugccccggacgacugcgcugggcaccgcaug

SEQ ID NO: 174536 - RNA, 64 nt, Human
acuuuaccaagcugaugcauuccuacagaagugggccccggauuucugcaagucgacuaucaug

SEQ ID NO: 174537 - RNA, 64 nt, Human
uuaauuuaaaucgcaguauacuguauuuaucggggccccggaggggaggucgcgagagccgcgu

SEQ ID NO: 174538 - RNA, 64 nt, Human
caccacgcccuccccgcgcgccggcucaggggcugccccggaaucagcuccccggggccgccgc

SEQ ID NO: 174539 - RNA, 64 nt, Human
gaggcugggaggccgcucggggcccagcgugccagccccggaguucagccucccgagcugcggc

SEQ ID NO: 174540 - RNA, 64 nt, Human
agucuccugugccccagcggacagcacugagcaggccccggagaggaggggcugcagccacaca

SEQ ID NO: 174541 - RNA, 64 nt, Human
augccuccugucucaacacugacagcugugccuagccccggaugccagcaccugccaggugccg

SEQ ID NO: 174542 - RNA, 64 nt, Human
ugugccaggacaggagggucccggcggaaagccagccccggacucaucgugacauugagauccc

SEQ ID NO: 174543 - RNA, 64 nt, Human
ucccggcagcagagaucugcaggcugccucuucugccccggagcuggggugcacuggggacccc

SEQ ID NO: 174544 - RNA, 64 nt, Human
gaacugaaaaugggccccuuguacaagcugagcugccccggagggagggaggaguucccugggc

SEQ ID NO: 174545 - RNA, 64 nt, Human
cuacuuguggggcuaaggcaggaggaucacuugagccccggaggucgaggcuacagugagccaa

SEQ ID NO: 174546 - RNA, 64 nt, Human
acaaggcagccacccugucaccuagcucaauggagccccggaucccaagcccugcauuguaagc

SEQ ID NO: 174547 - RNA, 64 nt, Human
gauagagggacggccaagaauguacguccagccugccccggagcuggaggauccccuccaagcc

SEQ ID NO: 174548 - RNA, 64 nt, Human
auuauugugaaccauuuaacccuuuugauccaaggccccggaccaaggggauacuguaaucagg

SEQ ID NO: 174549 - RNA, 64 nt, Human
ccgucacccaccagcuuccucaccaggcaaggaggccccggagccuuagcagggacuugcccaa

SEQ ID NO: 174550 - RNA, 64 nt, Human
gaagcugcuguuaaacgaaacugagaaaaacuuugccccggaauagcacuuuaauagucaaaaa

SEQ ID NO: 174551 - RNA, 64 nt, Human
gucgccacggaucgccgcccccacccagccgggcgccccggaccccccaggcgggcugcggggg

SEQ ID NO: 174552 - RNA, 64 nt, Human
ggaagcagagggagggacugggcagggacugccggccccggagucucccacagggaggccauuc

SEQ ID NO: 174553 - RNA, 64 nt, Human
cccggcgcgccugguagagccucgcuggccccgcgccccggagcccuauauuaaggccacggag

SEQ ID NO: 174554 - RNA, 64 nt, Human
cgggauggcgcgggugguguguguguucccacgggccccggaggcccacuccgcggagggcacg

SEQ ID NO: 174555 - RNA, 64 nt, Human
cugggcuguggacccugcguuugccgagcgcuaugccccggacaaaacgagcacagugcugacc

SEQ ID NO: 174556 - RNA, 53 nt, Human
ggaggaacagcgggcccugagcagccccggaagcaagugccgcauucuucagg

SEQ ID NO: 174557 - RNA, 64 nt, Human
ccaacgugcagcccuccgcaucuaucagcagguugccccggauggaucucagagaugaggauug

SEQ ID NO: 174558 - RNA, 64 nt, Human
uacagagaccacuuaggauggcacaggguggcuggccccggaugcugagagcuugguuucauuu

SEQ ID NO: 174559 - RNA, 64 nt, Human
gcccgcccucgccguguccguguuuucuuuuucagccccggagaggguccugaccugggggcuu

SEQ ID NO: 174560 - RNA, 64 nt, Human
ucccuuccaagccagggcuuccaaagaccccacugccccggagcugaagccgacucugcuccca

SEQ ID NO: 174561 - RNA, 64 nt, Human
gccuuucaugccugaugccguagaguagaacacagccccggaaugcuuccaguugcuugcaagg

SEQ ID NO: 174562 - RNA, 64 nt, Human
aaagcaaaccccuguucucugacuugacaacuuggccccggacuguggggccccaccuguugcu

SEQ ID NO: 174563 - RNA, 64 nt, Human
accaacagaguguggggagaagggauguguauuagccccggaggacgugaugugagacccgcuu

SEQ ID NO: 174564 - RNA, 64 nt, Human
caggaggcagcugcugacagguuugcuacacacagccccggacuguguugccugggugcucauu

SEQ ID NO: 174565 - RNA, 64 nt, Human
ggaaccugagccugacauuggggggaagugggaggccccggacgggguagcaccccccauuggg

SEQ ID NO: 174566 - RNA, 64 nt, Human
ccgcugaacacguccucgcucccgcgcuccccgcgccccggacacagcgggacgcggccggcgg

SEQ ID NO: 174567 - RNA, 64 nt, Human
acgacccaggccugcaccccacccccaacucccagccccggaauaaaaccauuuuccugcaaau

SEQ ID NO: 174568 - RNA, 64 nt, Human
cgguguggcuuuggcugccucugcauggaaucuugccccggacuccugaagacugcacaaggaa

SEQ ID NO: 174569 - RNA, 64 nt, Human
acuccugucugcuaucgagcccuggugcuauguggccccggagccacagcacaaucaucucagu

SEQ ID NO: 174570 - RNA, 64 nt, Human
ggccuuggaccuccuuaggcgacuccugguguucgccccggacaagcgguuaagcgcgacccag

SEQ ID NO: 174571 - RNA, 64 nt, Human
gaugguggucucaccugcggagccgcacucuuuagccccggagcuccaggcccagcggaugcug

SEQ ID NO: 174572 - RNA, 52 nt, Human
aggaccccacugucuccuagaggccccggaggagcugggccagccgcccacc

SEQ ID NO: 174573 - RNA, 64 nt, Human
ggcgccgccgcggagccccgcgcgcugggguugcgccccggaggcggaucucaggcacccccgc

SEQ ID NO: 174574 - RNA, 64 nt, Human
gccagcuuggguccugggucuacagagggcccuggccccggagcccagccagcucugccucucu

SEQ ID NO: 174575 - RNA, 64 nt, Human
cagacggacgggacagcggcccggcccacgcagagccccggagcaccacggggucgggggagga

SEQ ID NO: 174576 - RNA, 64 nt, Human
ggagaccagaacagcauggcccgaagcgugcggggccccggaugacuuggggacaccccagaau

SEQ ID NO: 174577 - RNA, 64 nt, Human
ucccuuuccuuucccagaaaaacugaggaaacuggccccggaaaagcaugucuuugggguuggu

SEQ ID NO: 174578 - RNA, 64 nt, Human
ccggccgggccggccgccaccagcggccuccgccgccccggaagcccucgccgugcaauucugu

SEQ ID NO: 174579 - RNA, 64 nt, Human
guucccacccagccuggcuggcggugcccacagugccccggacacauuucacaccucaggcucg

SEQ ID NO: 174580 - RNA, 64 nt, Human
auucugcaauuuucuaccaaacagagcgcugguggccccggagcagggcugugacauuggcugg

SEQ ID NO: 174581 - RNA, 64 nt, Human
gccagaggggcucugaugaucagcccagccaguggccccggaaggugaauggccugcucucccu

SEQ ID NO: 174582 - RNA, 64 nt, Human
uggaccaauaccgcgugcuggagccugugccccugccccggaccaagugagcagcccugucacc

SEQ ID NO: 174583 - RNA, 64 nt, Human
cggcccuuagggcaucaggaagacuagcuccccugccccggaggaucugcucagugcugauggc

SEQ ID NO: 174584 - RNA, 64 nt, Human
ugcaaugcaagaugguguccucggauaaugaucugccccggagcuagggcagcaacaugaggac

SEQ ID NO: 174585 - RNA, 64 nt, Human
ggggcuacugagcgcccucgaccuaugagccucagccccggaagccgagcgagcggccggcgcg

SEQ ID NO: 174586 - RNA, 64 nt, Human
cauccugagccccgcccucuuccugacgaaacuggccccggaucagagcaggaccucccuuccg

SEQ ID NO: 174587 - RNA, 64 nt, Human
uuugcacaaaaagugacuguaggaucaggugauagccccggaauguacagugucuuggugcacc

SEQ ID NO: 174588 - RNA, 64 nt, Human
ggccugugucucaggcucucuggaagguggcccugccccggacccucuugcagguguccugguu

SEQ ID NO: 174589 - RNA, 64 nt, Human
gcggcaugaacccucuugccauccugauggaccugccccggaccuaccucccucccucuccgcg

SEQ ID NO: 174590 - RNA, 64 nt, Human
cuauuaaugucacuccuuuugcgagcaugauuaggccccggagauuuccaaguccccccaucua

SEQ ID NO: 174591 - RNA, 64 nt, Human
aggauggguaugcuuugggcuuucuccuucuguggccccggaggaaggagagacugaggcaagg

SEQ ID NO: 174592 - RNA, 64 nt, Human
gcugcccuuugccucccccgacgccccagccugugccccggagaggcaggaucgcaguggucag

SEQ ID NO: 174593 - RNA, 64 nt, Human
ggcgugggugccaccacccucuagccccagggcagccccggaggacaggcaagggccugagacc

SEQ ID NO: 174594 - RNA, 64 nt, Human
cacaccuauggcuccuucgguaucaccuggggaagccccggaaucuuaguucuuccauucccua

SEQ ID NO: 174595 - RNA, 64 nt, Human
uguccagguguggccuaggccgccaccuucugcugccccggaguccccucccugggugggaugc

SEQ ID NO: 174596 - RNA, 64 nt, Human
auguacguuugacaccugugcugggggccucccagccccggagccucauagaucaucccccagg

SEQ ID NO: 174597 - RNA, 64 nt, Human
uagcccuuccuuuugcaguugcgucugggaaggggccccggacucccucgagagaaugugcuag

SEQ ID NO: 174598 - RNA, 64 nt, Human
uaccacagccccccacgccccauagggaggccaagccccggaccaugcaccaggcugcacccug

SEQ ID NO: 174599 - RNA, 64 nt, Human
accacucguaggaggucucagcucuggcauggcugccccggauguggccgagggggcuucaccc

SEQ ID NO: 174600 - RNA, 64 nt, Human
ccguucuuccgggaaaauggcgacucccgcucgugccccggagucaccgccguccgcggauccg

SEQ ID NO: 174601 - RNA, 64 nt, Human
ucccucuuucgucccacccccucuucccucagcagccccggaagccugccucacccgacgagga

SEQ ID NO: 174602 - RNA, 64 nt, Human
aaccucccagccacucgggcuuguaacugucugagccccggauccgguggggugaaagcagcca

SEQ ID NO: 174603 - RNA, 64 nt, Human
ggacucguagcaccaggguuuggaggcugcgaccgccccggagagcagcuucacacuggcgcca

SEQ ID NO: 174604 - RNA, 64 nt, Human
cuuugcucccugcugaccagguccccggacucaagccccggacucaggcccccaccuggcucac

SEQ ID NO: 174605 - RNA, 51 nt, Human
cgggcuacgaacaccccugaggccccggacgcccccggacacaauaaaggu

SEQ ID NO: 174606 - RNA, 64 nt, Human
aacagugaagguggcuuccggcacacuccccgcugccccggaagagacauccuuugacccucuc

SEQ ID NO: 174607 - RNA, 54 nt, Human
ugaccgacgaggucgugugaccucgccccggaccugcccucccgccaggugcac

SEQ ID NO: 174608 - RNA, 64 nt, Human
ugagaguaauugccugcagggaaggaugaugccagccccggauccgggcugcucucuggaggac

SEQ ID NO: 174609 - RNA, 63 nt, Human
ggccgggccaguucucuugagaagugaggcccggccccggacagguacugcccccucagcccc

SEQ ID NO: 174610 - RNA, 64 nt, Human
gcugcaugcaguggcggcuacugggcccugcccagccccggaacucugcgcgauaucaauacug

SEQ ID NO: 174611 - RNA, 64 nt, Human
cgcuuugggaggcggaggcaggaggaucgcucaagccccggaguuggagaccagccagagcaac

SEQ ID NO: 174612 - RNA, 64 nt, Human
uucagggacuacaaccuuuuuccuucugugaccagccccggauucaggcuguacuaauaccagg

SEQ ID NO: 174613 - RNA, 64 nt, Human
acgcacccgaauuucuguccguucccaaagaucggccccggaaaaagucugccccagaaacucu

SEQ ID NO: 174614 - RNA, 64 nt, Human
ggacuggcuucauucuaauuauggcccacagacugccccggagaccuggaggacagcagugcug

SEQ ID NO: 174615 - RNA, 64 nt, Human
gggacgucuucccaugccuucccuagaaccggaggccccggacuucucuggaaaaccgccuguc

SEQ ID NO: 174616 - RNA, 64 nt, Human
cgcucgggcucugacucugacgucggcacacacggccccggacggccagaggggaaccgccggg

SEQ ID NO: 174617 - RNA, 64 nt, Human
gccucggagcucugugguggaaggacgggagagggccccggacacgcgcguuuucuccugccga

SEQ ID NO: 174618 - RNA, 64 nt, Human
gaucuccagguguacugcacuuacccucaauccagccccggagaagcaagugaaaagggugggu

SEQ ID NO: 174619 - RNA, 64 nt, Human
ggguggggggacaggagggggcccuggggccugggccccggaaaaaucuaucugcccuccccca

SEQ ID NO: 174620 - RNA, 64 nt, Human
ugaggaugcugccgccacccugcgacggagcggcgccccggacugccugacugccagccccaug

SEQ ID NO: 174621 - RNA, 64 nt, Human
gugucagagcugaaauucaaaccccauccagcuggccccggagccagagcuucuuguacuacac

SEQ ID NO: 174622 - RNA, 64 nt, Human
gcagaagacgcuuuuccccagcaggucacccacggccccggaaccgcggcgacuggaggcugga

SEQ ID NO: 174623 - RNA, 64 nt, Human
cgcaccccagcccagggcggcggggacuccgagagccccggagagaacguggcccagcccugga

SEQ ID NO: 174624 - RNA, 64 nt, Human
gcucgggaaggacagacgccggccgcccgcccgcgccccggaggcccuggcucuguccggagac

SEQ ID NO: 174625 - RNA, 64 nt, Human
ggaggaggaagccgccgagacugcagggagccuggccccggagccccgggugcgcccuggucuu

SEQ ID NO: 174626 - RNA, 64 nt, Human
uuugcacagcccagggguguccggccucuggcccgccccggagcagggaggguggcuggggcca

SEQ ID NO: 174627 - RNA, 64 nt, Human
caggcucugagaggccguguccuaaccugcccuggccccggagaagcuacguugccaccugucc

SEQ ID NO: 174628 - RNA, 64 nt, Human
uccuccagccucacuucgcugccacuucgccgcugccccggagacuuuucaaucccaccccacu

SEQ ID NO: 174629 - RNA, 64 nt, Human
ccgaugggagccagcaccagcaggauccgagggcgccccggacagaggucugccccacccacuu

SEQ ID NO: 174630 - RNA, 64 nt, Human
aucccuugccugccacugugccuucgccuccauggccccggagccccauccugggccugcccug

SEQ ID NO: 174631 - RNA, 64 nt, Human
aaagccaugguuccccccaggcccgacaccacuggccccggaugccucugccccucccgggcgg

SEQ ID NO: 174632 - RNA, 64 nt, Human
ggcgccgcggggccaggacugcgcucaggaucccgccccggagcccccagcccgggggagaggg

SEQ ID NO: 174633 - RNA, 64 nt, Human
agagaugggggcuugaacacggggcuuccuuacagccccggaugcagauuuuagagggagggca

SEQ ID NO: 174634 - RNA, 64 nt, Human
ccaaggggcgggcucgcgggggggugucgugggcgccccggacuuggagagggugcggcccugg

SEQ ID NO: 174635 - RNA, 64 nt, Human
ccuggagcugcguuucgcggcggcggcggcggcagccccggagggcggcugggagcugagcgug

SEQ ID NO: 174636 - RNA, 64 nt, Human
cgcagcgggcgcgggacaggacuugugcgccggcgccccggacgccgcgauuuugccuuugguu

SEQ ID NO: 174637 - RNA, 57 nt, Human
uuggaggccgcuggaagugaggaugccgccccggacaguggcaccugggaagccugg

SEQ ID NO: 174638 - RNA, 64 nt, Human
cuggagaggugggggccaccaaaaacccacaaaggccccggagcugggggaccacaaacaaaca

SEQ ID NO: 174639 - RNA, 50 nt, Human
ucgacaccaacggacucugagccccggacucugcuuacccugauggcugc

SEQ ID NO: 174640 - RNA, 64 nt, Human
uagguaagggccgccggaccgcguagagagccgggccccggacggacguugguucugcacuaaa

SEQ ID NO: 174641 - RNA, 57 nt, Human
cccgcgagacgcuguacuaggcugugcgccccggaacguguccaggaggagccuggc

SEQ ID NO: 174642 - RNA, 64 nt, Human
ucguaucacuagcuugcggccaggucaugauguggccccggaagcuggcccugcgugccaugag

SEQ ID NO: 174643 - RNA, 64 nt, Human
caagaggcugcagcggcugcugcaggcccucgaggccccggagggcugggguccgacaccaagg

SEQ ID NO: 174644 - RNA, 64 nt, Human
ucccgagggaccccagguuccagggaccgacugagccccggacccgcuggggccucuggccugc

SEQ ID NO: 174645 - RNA, 64 nt, Human
cuuugcagggcuaaggcccccaaacauagccccugccccggaggaagcuuggggaacccaugag

SEQ ID NO: 174646 - RNA, 64 nt, Human
aaggcccguccacaggcccggcucugggccacgugccccggaagcagguguguccagagucagc

SEQ ID NO: 174647 - RNA, 64 nt, Human
gcaggaccagcaggcacagcaccuccagaacagugccccggaugaccagaggccccuugaaaag

SEQ ID NO: 174648 - RNA, 64 nt, Human
gaaugccccacaucauuggcacaggaguggggcagccccggaaggaaccagggauuaggcugua

SEQ ID NO: 174649 - RNA, 64 nt, Human
cauuggccuuaacuggcccucgggcccucucuccgccccggacaggguggcacccaccacucuc

SEQ ID NO: 174650 - RNA, 64 nt, Human
uuguccaggagcaggagcugcugggacugcgcuggccccggaccuagugggccuucuccuggcu

SEQ ID NO: 174651 - RNA, 64 nt, Human
ucucaaguaccugcccgagguguuugcccccaacgccccggaugugcugagcugccuggagcuc

SEQ ID NO: 174652 - RNA, 64 nt, Human
guccugggagaggacagggacuucgcagaggcaagcgaccgaggcccucccaaagaggcccgcc

SEQ ID NO: 174653 - RNA, 64 nt, Human
gggcagaaaguugggacugagcagcugggagcaggcgaccgagcuccuuccccaucauuucucc

SEQ ID NO: 174654 - RNA, 64 nt, Human
agaaauguauaccguaucuaucuacccgacagcagcgaccgagacccggugggacacuccccuu

SEQ ID NO: 174655 - RNA, 64 nt, Human
cccuucccaaccccgaggggcuugcagggacaaggcgaccgacugcgcugagcugcuuauuuau

SEQ ID NO: 174656 - RNA, 64 nt, Human
ccgggucccugcagcgcuuccucccgcagcccccgcgaccgauccgaccgcgucgcugccgcuc

SEQ ID NO: 174657 - RNA, 63 nt, Human
ucuccucccgagggaaccuucuucccaggccucccgccagacugccuggguccuggcgccugg

SEQ ID NO: 174658 - RNA, 63 nt, Human
ggaguggggcaguagaaggucggaggcuugggaccgccagauggggccucuguuucggagacg

SEQ ID NO: 174659 - RNA, 63 nt, Human
ccgggagagaugccuggccaggcuccacggaucccgccagaaacaccaacagagggucucccu

SEQ ID NO: 174660 - RNA, 63 nt, Human
acauggguguccagggagaaggcucugucccugccgccagaccccagugguugccacugaaga

SEQ ID NO: 174661 - RNA, 63 nt, Human
gcugaguccagccucguggucuucuccaagaugccgccagaugcccagccuacagccucucag

SEQ ID NO: 174662 - RNA, 63 nt, Human
caggaccuaucuaggcagaccccagccagacccccgccagacagacucccaaccagacugacc

SEQ ID NO: 174663 - RNA, 63 nt, Human
guuuuuggaggaagggauuagauagugacuaagccgccagaauugagguggccauuccuuuuu

SEQ ID NO: 174664 - RNA, 63 nt, Human
gccaugucucagaugaggagggagagaaggaggccgccagacucgagaggugggaggaacucc

SEQ ID NO: 174665 - RNA, 63 nt, Human
gugccugcaccugcacucuagugacccugggugccgccagacccuucucuucuacaaagaccc

SEQ ID NO: 174666 - RNA, 63 nt, Human
uuagcuucucaaaggccuaaccaagccuuggcaccgccagauccuuucuguaggcuaauuccu

SEQ ID NO: 174667 - RNA, 63 nt, Human
uuauguggguugccuggugaauggccuuccuucccgccagagggcuugugaacagaccggaga

SEQ ID NO: 174668 - RNA, 63 nt, Human
gcaggacacgccaccauuccaggguagcugguaccgccagaaacaggagugggucuuguccug

SEQ ID NO: 174669 - RNA, 63 nt, Human
cuaucuaauucaaacauaucuccccaugauacaccgccagagugacauugcagacagucugug

SEQ ID NO: 174670 - RNA, 63 nt, Human
ccuccgccagauccugcagaaguacuccuauugccgccagaagauccaagaggcccugcacgc

SEQ ID NO: 174671 - RNA, 63 nt, Human
acguauccugcagcgggaggaggaggagcaccuccgccagauccugcagaaguacuccuauug

SEQ ID NO: 174672 - RNA, 63 nt, Human
ggcagcaguuucucugguaacggaagagaccguccgccagaucugcaggcuguuucugcucca

SEQ ID NO: 174673 - RNA, 63 nt, Human
agcauauuagcacaucacuccaagcaacaaccuccgccagaagaaagcaaaugcuguuuuacu

SEQ ID NO: 174674 - RNA, 63 nt, Human
ggagaaucgccugcagguggggcccuuuccuucccgccagaguggggcugagugggcgcugag

SEQ ID NO: 174675 - RNA, 63 nt, Human
ccccacuuccacauggcccucgucccuuccugcccgccagaugcugccugcacuuccgcagcc

SEQ ID NO: 174676 - RNA, 63 nt, Human
acgcaccguguccccacccaggacagcagacacccgccagagugugcgcgcccagugacugca

SEQ ID NO: 174677 - RNA, 63 nt, Human
gggccaccugaagcgggccuccaacgagagcacccgccagaggcugcagcagcagcugaccca

SEQ ID NO: 174678 - RNA, 63 nt, Human
cgggaugguguccacggcaagugugcacacccuccgccagaccucacuggccuggcuggacca

SEQ ID NO: 174679 - RNA, 63 nt, Human
uggcagaggggccuucaccgccaccagggugucccgccagacagggagagacuccagccuucu

SEQ ID NO: 174680 - RNA, 63 nt, Human
ccuguguaaccaccaccaccuguguaaccaccaccgccagaaccaaaaacguuucugucaccc

SEQ ID NO: 174681 - RNA, 63 nt, Human
cacaggccacgacagacgcuggaugcccuccuaccgccagacaccuccccagaggccuuggac

SEQ ID NO: 174682 - RNA, 63 nt, Human
aguucgcuccaggagaaggcugcgcacccacacccgccagagcccuacacgguggcgccggug

SEQ ID NO: 174683 - RNA, 63 nt, Human
gagcugcagggcgagcccggacggcugccgucuccgccagaggccaccccggcccggccucca

SEQ ID NO: 174684 - RNA, 63 nt, Human
gcugugggacuggcccugcuccuguacugcuauccgccagaccccaagggccugccagggacc

SEQ ID NO: 174685 - RNA, 63 nt, Human
aaagugaaaagaugcuguggcaguuccugaagcccgccagagacagcucaggugcaaggagau

SEQ ID NO: 174686 - RNA, 63 nt, Human
gacagcccugccuauccucuguauauaggccuuccgccagaugaagcuuuggcccucaguggg

SEQ ID NO: 174687 - RNA, 63 nt, Human
gauguggcacugcuugaggaggggcaccugccaccgccagaggacaaggaagugggggccgcu

SEQ ID NO: 174688 - RNA, 63 nt, Human
gagggcgaguggcugcgagagagaaugagccucccgccagacaggagggaggugcguguggau

SEQ ID NO: 174689 - RNA, 63 nt, Human
agagaaaagguaguguuuuuguacaaggucauaccgccagaagccccaaauccuauuuuggcu

SEQ ID NO: 174690 - RNA, 63 nt, Human
guguccacuccugaggaugguuccagggaaauaccgccagaaaacaagaaggucagcccacuc

SEQ ID NO: 174691 - RNA, 63 nt, Human
cgagugcguguaccuggugcgggacucacccggccgccagacugccugggccugcccagaugg

SEQ ID NO: 174692 - RNA, 63 nt, Human
aggccagugcgcacuagcugggccugguggccaccgccagagcuccuggcgacaucuuggcgu

SEQ ID NO: 174693 - RNA, 63 nt, Human
gaaagggcaguuacccggccagggucacaucaaccgccagaaguggaguugggcaggucagcg

SEQ ID NO: 174694 - RNA, 63 nt, Human
uucauucaaaccugacaagucuaucucuaagagccgccagauuuccaugugugcaguauuaua

SEQ ID NO: 174695 - RNA, 63 nt, Human
gggaaaaucaagaugguaccucucugcauuaucccgccagacacuguauuuuaugcauucaug

SEQ ID NO: 174696 - RNA, 63 nt, Human
uggugcugggggaggcaccccacagacucagcgccgccagagauaggguuuuuggagggcucc

SEQ ID NO: 174697 - RNA, 63 nt, Human
ggcaggaggggggcugugaccccugcccuuuccccgccagagaccucaggcucucagcacauu

SEQ ID NO: 174698 - RNA, 63 nt, Human
agaagccgcgucugugggacgaagaccgggcacccgccagagaggggaagguaccagguugcg

SEQ ID NO: 174699 - RNA, 63 nt, Human
cccuccccugcccccuccacuccggggccugugccgccagaaccgggcucugcccccauacgc

SEQ ID NO: 174700 - RNA, 63 nt, Human
cugcuucgagugcgugcggggccgcuaugaggcccgccagaggaagugccccaagugcaacgc

SEQ ID NO: 174701 - RNA, 63 nt, Human
ggagcccuaccucccugccauuauagcugcuccccgccagaagccugugccaacucucugcau

SEQ ID NO: 174702 - RNA, 63 nt, Human
ugugccugcagacggcccgggagcugugugucuccgccagagucacagcagugccgagguguc

SEQ ID NO: 174703 - RNA, 63 nt, Human
cucuuuaggaccugccuccugccugccccucucccgccagacuguuagaaaauggacacugug

SEQ ID NO: 174704 - RNA, 63 nt, Human
ccuccgggccugaauacgggccagccgccgaggccgccagagcagggccgccuggucccaccg

SEQ ID NO: 174705 - RNA, 63 nt, Human
agugacccagcuacugaaccagccacgaacagcccgccagaggccugaagcugagcguguacg

SEQ ID NO: 174706 - RNA, 63 nt, Human
cagaaucaacagcuccagcccucugcgcuacaaccgccagaucggggaguuuauagucacccg

SEQ ID NO: 174707 - RNA, 63 nt, Human
ccacgacaaggagacagaggagcugguagccagccgccagaugagcuuccuaaagcugacccu

SEQ ID NO: 174708 - RNA, 63 nt, Human
aacagucagugagaguggaggcuccagucagacccgccagauccuugggcaccuggcacucaa

SEQ ID NO: 174709 - RNA, 63 nt, Human
gugggccuggcagggcuggcaggaugccgugggccgccagaucugcaccaccuucgagcacua

SEQ ID NO: 174710 - RNA, 63 nt, Human
cugagcccuguacccaccccagcacagccaccuccgccagaccccguggcucugggagagcca

SEQ ID NO: 174711 - RNA, 63 nt, Human
gagaaccgccagaaacugagccgccccaggaugccgccagaaucacuggucccugggagcuug

SEQ ID NO: 174712 - RNA, 63 nt, Human
agguuccuccuuugggcccagcggccggcgaggccgccagacauacacacguuaccagacgcu

SEQ ID NO: 174713 - RNA, 63 nt, Human
ccuccuaccugugccuuucucugaggggacaccccgccagagagggccccgggagccgggggu

SEQ ID NO: 174714 - RNA, 63 nt, Human
ccacucccuguccauccccaguuggggcugcgaccgccagauucucccuuaaggaauugacuu

SEQ ID NO: 174715 - RNA, 63 nt, Human
uucuggacucaccccucauccgggcccccagccccgccagagccuccguggcugcggguguug

SEQ ID NO: 174716 - RNA, 63 nt, Human
accuaugggcuugaggaggucacgaugccgacuccgccagagcuuuuccacugauuguacuca

SEQ ID NO: 174717 - RNA, 63 nt, Human
ccaccagcgccugccucggccccuccucugcccccgccagaucccguggugcuggggaugggg

SEQ ID NO: 174718 - RNA, 63 nt, Human
agcuguaaggaccgggggucucccuccucacuaccgccagacaccccgguggaagcauuuaga

SEQ ID NO: 174719 - RNA, 63 nt, Human
gcaggauguuggcgaacugacaaacucugucugccgccagaaggaaugcugggggcagucaug

SEQ ID NO: 174720 - RNA, 63 nt, Human
cgugcauccccaguccccgccggggcgggcgggccgccagagcagcuuuuuacaauccagaga

SEQ ID NO: 174721 - RNA, 63 nt, Human
uaagcaguccccaccgggaguuccccccugcuaccgccagagagguggacccacuccggauuc

SEQ ID NO: 174722 - RNA, 63 nt, Human
uacuaaaagucuucauacagaguacaagugcagccgccagaggagaaaauugagauucuugac

SEQ ID NO: 174723 - RNA, 63 nt, Human
cgggggcggaggggugguucuuuuccuucuccuccgccagaggccacgggcgcccuuguuccc

SEQ ID NO: 174724 - RNA, 63 nt, Human
gcuuuuuguauuaauugccuuugagguuauuuuccgccagaccucaaccugggucaaaguggu

SEQ ID NO: 174725 - RNA, 63 nt, Human
acugucauuguguuucccagccucuccacucccccgccagaaaggagccugagugauucucuu

SEQ ID NO: 174726 - RNA, 63 nt, Human
acagccuccuucgaggcugugcugggugcagaaccgccagagccacccaaaagguguuucucu

SEQ ID NO: 174727 - RNA, 63 nt, Human
ccuagagaggccgcaaggggaccgccccaggcaccgccagaguguccugcuaccuuugucuca

SEQ ID NO: 174728 - RNA, 63 nt, Human
gagcaucugggcgccgggacgcugcagugauccccgccagagccugugcccuuccugcuccgu

SEQ ID NO: 174729 - RNA, 63 nt, Human
gaaaggccuccagcugagcagacggccccgaucccgccagaacggccuuuugcuuccagccaa

SEQ ID NO: 174730 - RNA, 63 nt, Human
aucuccgagagcagcgacuaaguucaggcccagccgccagaccucagagaucucaccagcggg

SEQ ID NO: 174731 - RNA, 63 nt, Human
aggcccagcaucccgcgcagaugacaccaucaaccgccagagucccagacaccgguuuuccua

SEQ ID NO: 174732 - RNA, 63 nt, Human; identical to SEQ ID NO: 174730

SEQ ID NO: 174733 - RNA, 62 nt, Human
ucuccgagagcaccgacuaaguucaggcccagccgccagaccucagagaucucaccagcggg

SEQ ID NO: 174734 - RNA, 63 nt, Human
caccagaggaugccaccuccgcccccacccccgccgccagaggaguacaagagccagaggccc

SEQ ID NO: 174735 - RNA, 63 nt, Human
uagggcuugggcuguuugugugauaccggccccccgccagacaauagccuuugcugacacccc

SEQ ID NO: 174736 - RNA, 64 nt, Human
gggacucuagccucuguguucauaaagacauuaagaaguggauggauguuguuccuuuuuugaa

SEQ ID NO: 174737 - RNA, 64 nt, Human
acugguggaagcaauuaaggaacaagauggaagagaaguggacugggaguauuuuuauggccug

SEQ ID NO: 174738 - RNA, 64 nt, Human
cagggaggugaccauguaacucugaccaaucugggaaguggagggugggcucaugggccgugcu

SEQ ID NO: 174739 - RNA, 57 nt, Human
uucuuauuucuauaggaugaaucccuagaaguggaauugcuggguaaaguauauaaa

SEQ ID NO: 174740 - RNA, 64 nt, Human
agaggccugcuuggugaccuagcauuuucaccaagaaguggacguggagaggaccagagugauc

SEQ ID NO: 174741 - RNA, 64 nt, Human
uuacuuuacacaugugccuacauagacacaccaagaaguggauguauauaauauagaaaguaua

SEQ ID NO: 174742 - RNA, 64 nt, Human
uuccuccuaaacuaagaaggauccuggacagggagaaguggaggaggauaagguaccaggacuc

SEQ ID NO: 174743 - RNA, 64 nt, Human
ugaggcacggggagccagccccacucggggaccagaaguggaaccaaaaacaagaaaaaacugu

SEQ ID NO: 174744 - RNA, 64 nt, Human
ccauccccaccuucaccucggagggauggagaaagaaguggagacaguccuuucccaccauucc

SEQ ID NO: 174745 - RNA, 64 nt, Human
uggggagggauguggaggggaaaaagaugacagagaaguggacuccaaaccucauuuuaguugu

SEQ ID NO: 174746 - RNA, 64 nt, Human
uuccccauguugucgauggggccagagaugaagggaaguggacuaaaguauuaaacccucuagc

SEQ ID NO: 174747 - RNA, 64 nt, Human
cgaccagaauguugugauuuaaagagaacuaauggaaguggauugaauacagcagucucaacug

SEQ ID NO: 174748 - RNA, 64 nt, Human
aaaguguuuaaugagaguuuacagacagaagcccgaaguggaaagaccuuaugguuuuguagau

SEQ ID NO: 174749 - RNA, 64 nt, Human
cggguauucuccuccccaccuaagucucugggaagaaguggagaggacugaugcucuucuuuuu

SEQ ID NO: 174750 - RNA, 64 nt, Human
gguggggaggggagauuguugagagauggacuaggaaguggaagcaggcuggaaagacacauau

SEQ ID NO: 174751 - RNA, 64 nt, Human
ugagucugggcagguccaaggccugcaccuucaagaaguggaauaaauguggccuuugcuucug

SEQ ID NO: 174752 - RNA, 64 nt, Human
cuuccuccaucaguagcccuuuauuugauauucagaaguggaaagcuuuuucauucuccaguag

SEQ ID NO: 174753 - RNA, 64 nt, Human
caaaauugagcauaguaauuacccacagaaggaggaaguggaagggacaggagcacauagguag

SEQ ID NO: 174754 - RNA, 64 nt, Human
auuuuuccauugcagguuuuaaaguggagauucugaaguggaaaauagguacugucagaacaaa

SEQ ID NO: 174755 - RNA, 64 nt, Human
uuagccgggcgugguccuagcuacucgggagacugaaguggaaggcuugcuugagcccaggagg

SEQ ID NO: 174756 - RNA, 64 nt, Human
gaacagcccugcugcccuuuugagccgagauuuugaaguggaugcccgucuugccagaaaugcu

SEQ ID NO: 174757 - RNA, 64 nt, Human
uugcagaaaccuuggggaaaagggcccuuucaaagaaguggauaagagggaggagaucauugag

SEQ ID NO: 174758 - RNA, 64 nt, Human
uccuuuguuggcaugggcagggguugagucagcagaaguggaccaaaggauuccucugaauaaa

SEQ ID NO: 174759 - RNA, 64 nt, Human
gcuuguuuugcacaagaagugauuuugugaaugugaaguggagaggccgagcagcagccggccg

SEQ ID NO: 174760 - RNA, 64 nt, Human
gaaggggagagcaucuaggcaggcaaacagaagggaaguggaguuaaaccucuggcaugaaguc

SEQ ID NO: 174761 - RNA, 64 nt, Human
uuaggcaucucuggcaugccacuguuuaugcauugaaguggaauuuuugguauaaagcuaaaug

SEQ ID NO: 174762 - RNA, 53 nt, Human
cuucugcacagggccaauaauaagaaguggacaauacaguauuugcuucauug

SEQ ID NO: 174763 - RNA, 64 nt, Human
gaaucaaugcugauuuuuaaaauauguauaaucugaaguggaaauuguuugcuuagaguuuuua

SEQ ID NO: 174764 - RNA, 64 nt, Human
auauaucuauucagcaguaugccauauuuaauuugaaguggacuuugaaagucauggggguuuu

SEQ ID NO: 174765 - RNA, 64 nt, Human
ucuuaguaaccugaaauuucuuuuuuaauugcaugaaguggauugaucaugagcaaaugaugug

SEQ ID NO: 174766 - RNA, 64 nt, Human
auuuccagaccauucaucaaggaaaggaccugaagaaguggaaagcacacuucauucucccucu

SEQ ID NO: 174767 - RNA, 64 nt, Human
ugucuccuuuuccaggcucagcagcgugcugauggaaguggaagugccugaagucuuacaggac

SEQ ID NO: 174768 - RNA, 64 nt, Human
gucugaacuuauugcagaaauugaaaaguaccaagaaguggaagaagaccaagacccaucaugc

SEQ ID NO: 174769 - RNA, 64 nt, Human
ccuuaaccaccagcaucccuccucuccccaaggugaaguggagggugcuguggugagcuggcca

SEQ ID NO: 174770 - RNA, 64 nt, Human
uccacaugugugcauacacucuuaaguugggugggaaguggauuccuuguugguuucugguuca

SEQ ID NO: 174771 - RNA, 64 nt, Human
auggagagagacugugaggacagaagccaaacuggaaguggaggagccaagggauugacaaaca

SEQ ID NO: 174772 - RNA, 64 nt, Human
uggaggcugagacaggagaaucgcuugaacccaggaaguggagguugcagugagcugagaucac

SEQ ID NO: 174773 - RNA, 64 nt, Human
acuuguggggaugagagugaccagguugaacugggaaguggaaaaaggaguuugagucacuggc

SEQ ID NO: 174774 - RNA, 64 nt, Human
aaggagggugaggcugccgaugccuuccugcccagaaguggaugaugugggaguugacaggcca

SEQ ID NO: 174775 - RNA, 64 nt, Human
acccuuaggauauaucuuuaugagucuuggcuuugaaguggagaagggcuuuaucuuagagaag

SEQ ID NO: 174776 - RNA, 58 nt, Human
cugcaagaaaaacuguguagucuggcaggaaguggauuaucugccucgggagugggaa

SEQ ID NO: 174777 - RNA, 64 nt, Human
cagcagucacaggcccaggaaggcggcaggcagagaaguggagugacuauuuggagaauagcac

SEQ ID NO: 174778 - RNA, 64 nt, Human
aaguaacacucccaaacacagacauacuuuuguagaaguggaccaacuucaaagcucuggacag

SEQ ID NO: 174779 - RNA, 64 nt, Human
uccccuuucuuuuaauauauaaauuauguauggugaaguggaguguauuguguaggucccguau

SEQ ID NO: 174780 - RNA, 64 nt, Human
uucccccacccacacccccauuuggacaucuggggaaguggagauuaaccccucccccagacuc

SEQ ID NO: 174781 - RNA, 64 nt, Human
aguaaucggagccccugcacaaaaugaaauaaaggaaguggaaauugguaagaaaauuuaucag

SEQ ID NO: 174782 - RNA, 64 nt, Human
uagaguacuuuuuaaaaguacagcagaaagaaaagaaguggaacauaagcauucaagauuaaua

SEQ ID NO: 174783 - RNA, 64 nt, Human
uaguugauaggaugugaggguguuaccuuggggugaaguggagaaggucccaggugaauuggcu

SEQ ID NO: 174784 - RNA, 64 nt, Human
cuuuaagauuucuggcagugugggauggaugaaugaaguggaaugugaacuuugggcaaguuaa

SEQ ID NO: 174785 - RNA, 64 nt, Human
cucccucacuuggacacucaggggaccacacagagaaguggauggacacuucgccauccaggca

SEQ ID NO: 174786 - RNA, 64 nt, Human
caucuugcugauuugaugauugaaaugugaaagugaaguggaaggaaugaaugaaguguguuuu

SEQ ID NO: 174787 - RNA, 64 nt, Human
aggguauccuuaaacugauuuucuauuacaauuggaaguggagaauaugugcaucuacacuaaa

SEQ ID NO: 174788 - RNA, 64 nt, Human
cacaguguaguuaugaaaauauauugaaggacaggaaguggacacgaagugauuuuuguaaccu

SEQ ID NO: 174789 - RNA, 64 nt, Human
caguauacuaauucaaaagacaaauauuucagaggaaguggaguacaguauuuaacauuuuguu

SEQ ID NO: 174790 - RNA, 64 nt, Human
agaggcagaagaggagaaugacuuuuccagaauagaaguggagcagugaucauuauucuccgcu

SEQ ID NO: 174791 - RNA, 64 nt, Human
gagcaccaacggaccuaucgaugucuauuugugugaaguggagcagggucagaccaguaacaaa

SEQ ID NO: 174792 - RNA, 64 nt, Human
gcuuaaagcaaggcggaacagaacugcauuugaagaaguggaagaagaccuaaggcucucccuu

SEQ ID NO: 174793 - RNA, 64 nt, Human
aggcuuugccaaguggaugcuuuucaguaacagugaaguggagugaauaccaaauguuugcccu

SEQ ID NO: 174794 - RNA, 64 nt, Human
augggcagacugaagacuguguccaaauucagcagaaguggaaugacaugaccugugacacccc

SEQ ID NO: 174795 - RNA, 64 nt, Human
guuuuuggcaaagcacaucaauguuagacuaguugaaguggaauuguauaauucaauucgauaa

SEQ ID NO: 174796 - RNA, 64 nt, Human
ccuguuaugagucaugaggaaacugaaucaccuagaaguggaauaaugugcucagggucaccau

SEQ ID NO: 174797 - RNA, 64 nt, Human
cacugguuuucaacaacaugcuuagagaacucaugaaguggauugggugucaacccagugaaca

SEQ ID NO: 174798 - RNA, 64 nt, Human
acagaaaagcaaauagcaauugacuugaaaauaagaaguggagccgaagguggauacaagaaau

SEQ ID NO: 174799 - RNA, 64 nt, Human
gaagggugaggaagagagcgucaaugaagggguggaaguggauguggaggagugaccagaccag

SEQ ID NO: 174800 - RNA, 64 nt, Human
cacugggaaugugacguugagcagagacguuagggaaguggauccuggacaaggcauuccaggc

SEQ ID NO: 174801 - RNA, 64 nt, Human
ccugugggggaagaucagcgacugccacaucauugaaguggagcccggcacaggggucauaggu

SEQ ID NO: 174802 - RNA, 64 nt, Human
aaauauaccuucagagacugucaguaggcuggaagaaguggauauugaaguuuugacaucaaug

SEQ ID NO: 174803 - RNA, 64 nt, Human
gcuguguagugggucaguggcuagguagguuagugaaguggaauuugggguugcucuuggaagu

SEQ ID NO: 174804 - RNA, 64 nt, Human
uuggagagcacaccuaucuuagugguuccccaccgaaguggacuggccccugggucagucuggu

SEQ ID NO: 174805 - RNA, 64 nt, Human
uguuuuaacuguaccuuaagcggucauguucucugaaguggaauguggcuuuccuaggaauggg

SEQ ID NO: 174806 - RNA, 64 nt, Human
accacucccuuggguauacaauuugcuguguagugaaguggaaccaggcucaggcugcuggucc

SEQ ID NO: 174807 - RNA, 64 nt, Human
guuuaagacuguaaugaaucuaagcagcauuucugaaguggacucuuugguggcuuugcauuuu

SEQ ID NO: 174808 - RNA, 64 nt, Human
guguuagagcuuccgagaauagcuccacuggagagaaguggaauccuauauagaaugcugcacu

SEQ ID NO: 174809 - RNA, 64 nt, Human
uaagggacuuaaucugcuaggaacaccuguacuugaaguggaggaggcuagggggccacaguug

SEQ ID NO: 174810 - RNA, 64 nt, Human
cugguuaauucagcuugagcugaaaagcuuccuggaaguggagaggauccuucugcuuuaaucu

SEQ ID NO: 174811 - RNA, 64 nt, Human
cuauaccugaacugcuauaagcaaggucgauagggaaguggauagauugcuucagcaaagugaa

SEQ ID NO: 174812 - RNA, 64 nt, Human
aagagcaggagggaacucucacugggggcggaaggaaguggagcuggagcaguaacugccaaca

SEQ ID NO: 174813 - RNA, 64 nt, Human
ucuauggagcagccggaagucuguucucaaagcagaaguggaauccaguguggcucccacaggu

SEQ ID NO: 174814 - RNA, 64 nt, Human
aggacucacagugaggaagcaaaaacugugcacagaaguggaucaccugcugguggaaaugugg

SEQ ID NO: 174815 - RNA, 64 nt, Human
gacaugcgcauucauagcagaaggaaaccaucaagaaguggaaggcugaccaugaugagcagua

SEQ ID NO: 174816 - RNA, 64 nt, Human
ucucuaaaacugccuuccacaauucacuagaccagaaguggacgcaacuuaagcugggauaauc

SEQ ID NO: 174817 - RNA, 64 nt, Human
guaaaccaaccaagaggaggagaaagaugacccagaaguggauucagccauugugccugaaauc

SEQ ID NO: 174818 - RNA, 64 nt, Human
acaagaaaguacuuuauaaaagguauccuuauuugaaguggauaaaucuuguaacucgaaaagu

SEQ ID NO: 174819 - RNA, 64 nt, Human
uuugcaggcccagaggagccaagucauuaaaauggaaguggauucuggauggccgggcugcugc

SEQ ID NO: 174820 - RNA, 64 nt, Human
gaucacacacuaauguaaccauuuuaugaagguugaaguggauuuaugcaggcaguucuauaua

SEQ ID NO: 174821 - RNA, 64 nt, Human
guagcuuaccagaagcuuccauaguggugcagaggaaguggaaggcaucagucccuauguauuu

SEQ ID NO: 174822 - RNA, 64 nt, Human
aguccaaagaacauauguuuagaccaacuucauggaaguggaagauccugugcucuugaacuua

SEQ ID NO: 174823 - RNA, 64 nt, Human
gaauaaaagaauaguuuccugaugucacuauuuugaaguggaaauuaucacuuggauguggagg

SEQ ID NO: 174824 - RNA, 64 nt, Human
auagagagaaagggagaggcauguacgguguggggaaguggaagagaagcuggcgggggagaag

SEQ ID NO: 174825 - RNA, 64 nt, Human
ugauuuuaguuuuuacuuuuuguagaugugggaugaaguggacucugucguguauauugaggaa

SEQ ID NO: 174826 - RNA, 64 nt, Human
ucacaagugaaaacugauuucccauuuuaaagaagaaguggaucuaaauggaagcaucugcugu

SEQ ID NO: 174827 - RNA, 64 nt, Human
gagaaauugccuguagcaucuagucuacuugaaggaaguggagacauaaggagagacaaaaaca

SEQ ID NO: 174828 - RNA, 64 nt, Human
gaagaagaaaagggauuaguuauaucaaaagccugaaguggaaugaccaaaagaugggacuccu

SEQ ID NO: 174829 - RNA, 64 nt, Human
gaagaagaaaagagauuaguuauaucaaaagccugaaguggaaugacugaaagaugggacuccu

SEQ ID NO: 174830 - RNA, 64 nt, Human
aacuuguagaaccaguguuacuguuuguaucagggaaguggagaaucuaaguguaaaaaagaaa

SEQ ID NO: 174831 - RNA, 64 nt, Human
gugggaaugggagcacucugucuucuuugcuagagaaguggagagaaaauacaaaagguaaagc

SEQ ID NO: 174832 - RNA, 64 nt, Human
ccaaguaagaaagugaagcaaaucagaaacuugugaaguggaaauguucuaaagguggugaggc

SEQ ID NO: 174833 - RNA, 64 nt, Human
gaacccacuuguuucccuaucagagggacacagugaaguggagguuaaaguaaauuacaggaaa

SEQ ID NO: 174834 - RNA, 64 nt, Human
ucuuuaaaauauuugucuuuaaacagcaacuacagaaguggaagugcuugauauguaaguacuu

SEQ ID NO: 174835 - RNA, 64 nt, Human
ucuucaaaauaucaaguguugggaaagaaaaaaggaaguggaauggguaacucuucuugauuaa

SEQ ID NO: 174836 - RNA, 64 nt, Human; identical to SEQ ID NO: 174835

SEQ ID NO: 174837 - RNA, 64 nt, Human
gauaugaagagcauuuuaagaggugcagccucuggaaguggaucaaacuagaacucauaugcca

SEQ ID NO: 174838 - RNA, 64 nt, Human
guugcugcuuuguacagagguuacugcaauaaaggaaguggauucauuaaaccuauuuaauguc

SEQ ID NO: 174839 - RNA, 64 nt, Human
gguagaagacuaguuaacuacugcucaagauauggaaguggauuguuuuucccuaaucuuccgu

SEQ ID NO: 174840 - RNA, 64 nt, Human
auucagaugcauaauuuuuaauuauaauuauugugaaguggagagccucaagauaaaacucugu

SEQ ID NO: 174841 - RNA, 64 nt, Human
agccccucaggccccacagguggguccugguugugaaguggaguuagugcacauggaugucagg

SEQ ID NO: 174842 - RNA, 64 nt, Human
ugaccaucuagugacucaggauauuaggccaguugaaguggaguuauaggauuuucacacauuc

SEQ ID NO: 174843 - RNA, 64 nt, Human
aaaguaagauuuggggagauguccauuggagacagaaguggagagagggagaaguucauuuguu

SEQ ID NO: 174844 - RNA, 64 nt, Human
cccaggauaccugcccuggacuuaaauugugauugaaguggagagguacucuaggaauuuaaaa

SEQ ID NO: 174845 - RNA, 64 nt, Human
ggacagagaaguaucuuggagacacguuucagaggaaguggaauuacuuuugcccagaaaaaug

SEQ ID NO: 174846 - RNA, 64 nt, Human
ggggugagaaggccgcgaagccaugggcagacaggaaguggaggugaaugucucugccuccugu

SEQ ID NO: 174847 - RNA, 64 nt, Human
aguagagcuauuucuuguacuucuaaguuuucuagaaguggaaggauuguagucauccugaaaa

SEQ ID NO: 174848 - RNA, 64 nt, Human
cuccuguccacugugucacucuccaagugccagagaaguggaggcagaucgcuaccccaggcug

SEQ ID NO: 174849 - RNA, 64 nt, Human
gguucagaggcccaugcugaggggugggugcucugaaguggagugaagccucaagcccaugaau

SEQ ID NO: 174850 - RNA, 64 nt, Human
ccugucccaacagcagggaugcuacaugggaagagaaguggacaucccacauguucugcgugcu

SEQ ID NO: 174851 - RNA, 64 nt, Human
aauugacugcccucuuacuguuuugaggaauucagaaguggagauuucaguucagcgguugagg

SEQ ID NO: 174852 - RNA, 64 nt, Human
agccagaacuaacccuggaugggcuacggcagcugaaguggacgccucacuuaguggauaaccc

SEQ ID NO: 174853 - RNA, 64 nt, Human
cuuauuguaaagugaagauuguucuacugcaugugaaguggaccaugcagauuucuguauguuc

SEQ ID NO: 174854 - RNA, 64 nt, Human
gagagggaaccagauaugcagaucagagauagaggaaguggaaccagagagcugggagggacca

SEQ ID NO: 174855 - RNA, 64 nt, Human; identical to SEQ ID NO: 174854

SEQ ID NO: 174856 - RNA, 64 nt, Human
ccccaccccuucagagaagcagccucaaauuccagaaguggaggcuccagccuccccgcgaggg

SEQ ID NO: 174857 - RNA, 64 nt, Human
ccccacaguuccuccugggaucuggcccuccagggaaguggagccuccagccccuaggggaugc

SEQ ID NO: 174858 - RNA, 64 nt, Human
gggaggcuggggcaggagaauugccugagccugggaaguggaaguugcagugagccaagaucgu

SEQ ID NO: 174859 - RNA, 64 nt, Human
gcauucaauaaaauuggggugccuaaugcuacuggaaguggaacuugagauagggccuaauuug

SEQ ID NO: 174860 - RNA, 64 nt, Human
uuucaggaaauauaauuugagaauacuuuaaagggaaguggaaguauaagugaaugauauuuuu

SEQ ID NO: 174861 - RNA, 64 nt, Human
auuuugauaaucacagucuuaaaauacuaggaaagaaguggaugggaauuguaggcauagauuu

SEQ ID NO: 174862 - RNA, 64 nt, Human
uagaggcugagacgggagcaucucuugagccugagaaguggagauugcaauugagcuaggauca

SEQ ID NO: 174863 - RNA, 58 nt, Human
ugccacuuuuagauagcuaaauccccaggaaguggacuuuacauguauauauucauca

SEQ ID NO: 174864 - RNA, 64 nt, Human
cuuucccuucaggaaaggcuacuaggaaaaaccagaaguggagaggaccagaugaaaacauuag

SEQ ID NO: 174865 - RNA, 64 nt, Human
augugauuuaucuggggggcucagguaugguggggaaguggauucaggaaucuggggaauggca

SEQ ID NO: 174866 - RNA, 64 nt, Human
uguaaucauggaccguaggccaugugaugggccugaaguggaggcugcucagcacagagcccuu

SEQ ID NO: 174867 - RNA, 64 nt, Human
ugauuuggugcccccauaucagacaaugaauuuggaaguggagaggggccuucauuucuuaucu

SEQ ID NO: 174868 - RNA, 64 nt, Human
ccaguccacugacaagaggguuuccccgagagccgaaguggacugaagcuacaguuuuuagcug

SEQ ID NO: 174869 - RNA, 64 nt, Human
agccuaauguuacuuugaaguggauuugcauauugaaguggagauuccauaauuaugucagugu

SEQ ID NO: 174870 - RNA, 59 nt, Human
aaccauuauuacaagccuaauguuacuuugaaguggauuugcauauugaaguggagauu

SEQ ID NO: 174871 - RNA, 64 nt, Human
acuuccgguuucuucauauugaggggcaacuccagaaguggaguuuucugugagaauaaagcau

SEQ ID NO: 174872 - RNA, 64 nt, Human
cucuuccccggagaccuccacacacccuggcuuugaaguggagucugugacugcucugcauucu

SEQ ID NO: 174873 - RNA, 64 nt, Human
uauaauuuacacugaggguuucaaaauucgacuagaaguggagauauauuauuuauuuaugcac

SEQ ID NO: 174874 - RNA, 64 nt, Human
ggaaugagagagaaaaccauggcugcucaggaaggaaguggagaaucucucagcacacguagau

SEQ ID NO: 174875 - RNA, 64 nt, Human
uuaauuauuucacuucuuuuuagaaacuuaggaagaaguggauaauccugaggucacacaaucu

SEQ ID NO: 174876 - RNA, 64 nt, Human
aucaaaggacaaagacaguauuuugacaaaauacgaaguggagauuuacacuacauuguacaag

SEQ ID NO: 174877 - RNA, 64 nt, Human
uuuauggaccucuggccaaaugguacauguacuggaaguggauaaccaguaucacuuacacaaa

SEQ ID NO: 174878 - RNA, 64 nt, Human
uccagcucuuccgcccucucuggaugagggaacagaaguggaggaaacaaaagaagcagcagca

SEQ ID NO: 174879 - RNA, 64 nt, Human
aaugacggcaguauuguuuucuuauaugugcaaugaaguggaaugauaaacaguaugccuuuaa

SEQ ID NO: 174880 - RNA, 64 nt, Human
gggguucucucaccaacagcugugauuucaucccgaaguggaagggggucuaaacagaacaggc

SEQ ID NO: 174881 - RNA, 64 nt, Human
ccuguggugaauguuaguauuuaccauagggagugaaguggaguuaugguuucauucaauagag

SEQ ID NO: 174882 - RNA, 64 nt, Human
ugaaggaaaggagugaaagggaaguaggaccagagaaguggaaggaagcaaaauggaggugaug

SEQ ID NO: 174883 - RNA, 64 nt, Human
ggcuggcugcaggguccuaccucuggguuuccuggaaguggauuugggccaagaaggagaggga

SEQ ID NO: 174884 - RNA, 64 nt, Human
cuagucugaaagugaccuuacuuucggaaguagggaaguggaacuuugguaaaugacuguuugc

SEQ ID NO: 174885 - RNA, 64 nt, Human
ucucagcagcggagacuguucuuugaguugccuugaaguggaggccgagcggcugcgggcccuu

SEQ ID NO: 174886 - RNA, 64 nt, Human
cagacugaaaccuuuauaggaguuaugcaguucagaaguggacuuuagguaagucauuuauuuu

SEQ ID NO: 174887 - RNA, 64 nt, Human
gguuuucucaaaggcccaaggauucaagcaaagggaaguggaaucuuguggugaacaguaccuu

SEQ ID NO: 174888 - RNA, 64 nt, Human
ggccuuacgaaauccuuugugucgauuucaccaagaaguggagacuuuucggcaucgggccauc

SEQ ID NO: 174889 - RNA, 64 nt, Human
aguggguuggagccucccacuuugucccuccuuugaaguggaugggaacucaaggugcaaagaa

SEQ ID NO: 174890 - RNA, 64 nt, Human
guuuaaaaaaaucuuuccucuuucauauaaauaagaaguggaaauugccuuuuuauuguguaau

SEQ ID NO: 174891 - RNA, 64 nt, Human
auaaagauacuaugcaagaaaauguacaguugucgaaguggagaaaaugaggauauauucuugc

SEQ ID NO: 174892 - RNA, 64 nt, Human
auucaucauguguucagaauucgauuuggaguuggaaguggacagccuaauuuuuaucucaccu

SEQ ID NO: 174893 - RNA, 64 nt, Human
gaacaaagaacggcaugugaauucugugaagaaugaaguggaggaaguaacuuuuacaaaacau

SEQ ID NO: 174894 - RNA, 64 nt, Human
agcccaugacguguuucuugaacccuacuuucuggaaguggaguugacucuggaaguuuucuag

SEQ ID NO: 174895 - RNA, 64 nt, Human
accccugccagcacacccugcagccaagggccaggaaguggacaagaacgaacccuuccuuccg

SEQ ID NO: 174896 - RNA, 64 nt, Human
augucuacaugguuaauggaaagcacugugcucugaaguggaucagucucaagugucugguaac

SEQ ID NO: 174897 - RNA, 64 nt, Human
aaguggcaacuuugguggcagccuagaccgcgaggaaguggaaucuuccuuaaaggugaaacau

SEQ ID NO: 174898 - RNA, 64 nt, Human
uaauauuacgcaacauaaaccauagguguuauuagaaguggagaacugccuuuuucaucugggg

SEQ ID NO: 174899 - RNA, 64 nt, Human
uguauacuuguauuaguauuucuguaagaucugagaaguggaauuuguagggucauagguuaug

SEQ ID NO: 174900 - RNA, 64 nt, Human
caggcacucaggagggcccgguaaaggcugagaugaaguggacugaguagaacuggaggacagg

SEQ ID NO: 174901 - RNA, 64 nt, Human
ugcugauuccauuucagccaagcaagggaaagaggaaguggagucauuuugccuuugaaggcug

SEQ ID NO: 174902 - RNA, 64 nt, Human
ccugccagcccuucucguacaggguggcuccuuugaaguggaguaauagggaagguugcucucu

SEQ ID NO: 174903 - RNA, 64 nt, Human
cuccccugugcugcuuucagggccgacugccugugaaguggauggcacccgaggcauuauuuga

SEQ ID NO: 174904 - RNA, 64 nt, Human
ucacagagucacugugaggauucuauacugauuugaaguggagcuguucagaacugaaccuugu

SEQ ID NO: 174905 - RNA, 64 nt, Human
ugcucuguguuauggacauuuucagacaugcacagaaguggagaggaugguccuuggaccccau

SEQ ID NO: 174906 - RNA, 64 nt, Human
gcguagcucuaauauucacauaaacugaaauaaagaaguggaaugaggagcuuugacauucaaa

SEQ ID NO: 174907 - RNA, 64 nt, Human
gggcuuccuccgugcaguuuucugcaacucuggagaaguggaggcauacuugugugucuggguu

SEQ ID NO: 174908 - RNA, 64 nt, Human
caggaauucuuggauauuuaguuuucuggguacugaaguggaugggagggggaaugauuaaaga

SEQ ID NO: 174909 - RNA, 64 nt, Human
gauugcaagguagauuuuuguuuuaaaauggagagaaguggacagauaaggccauuuaauauau

SEQ ID NO: 174910 - RNA, 64 nt, Human
ggcuauaagagaaaguggaaugaaucugaacccagaaguggaagggacgcuaauucggguaccc

SEQ ID NO: 174911 - RNA, 64 nt, Human
aagggcugugguaaacgggagagcuuguguuuuugaaguggaaaaaaacccaagaguuuguaca

SEQ ID NO: 174912 - RNA, 64 nt, Human
gacuccacgccggagaguaacuaggaacaugguagaaguggagagagucccggacaugccgacu

SEQ ID NO: 174913 - RNA, 64 nt, Human
gggcuacacccaauuccaaaagccugagaagagagaaguggagggggaggcgagugugugaaua

SEQ ID NO: 174914 - RNA, 64 nt, Human
uggaugcaucugagggacaaggggggcggucuccgaaguggaauaaaauaggccgggcguggug

SEQ ID NO: 174915 - RNA, 64 nt, Human
auuugauaaggugauuauaaaagauacauggaaggaaguggaaccagaugcagaagaggaaaug

SEQ ID NO: 174916 - RNA, 64 nt, Human
cuuuauugcaaagagagucuauuauagaaggaaagaaguggaggccugcuguguggaucccuuc

SEQ ID NO: 174917 - RNA, 64 nt, Human
uuuggauucuuaauguguaacuuaaacauacuuugaaguggaggagagucauaagacagaacau

SEQ ID NO: 174918 - RNA, 64 nt, Human
uacaggggccauggauguggacaccauggagggggaaguggagcguuuucaguggaguuggcuc

SEQ ID NO: 174919 - RNA, 64 nt, Human
aagccacgcuccaggccauggacgagaagcugcggaaguggaagguggaacucuagcccugaag

SEQ ID NO: 174920 - RNA, 64 nt, Human
acagguguuuacaaaaaagugguugucgcacugggaaguggagugauggccucgucuccagugc

SEQ ID NO: 174921 - RNA, 64 nt, Human
ccccacugucagcaacagcacuuccuucguggaggaaguggacucgaauccuggaggaggaaau

SEQ ID NO: 174922 - RNA, 64 nt, Human
ugaacgggccaaggccugcuuugaaaaggugcuugaaguggacccugaaaacccugaauccagc

SEQ ID NO: 174923 - RNA, 64 nt, Human
agaauugaguuaccucacagagaacagauacauggaaguggacuccuugccuguagagccugca

SEQ ID NO: 174924 - RNA, 64 nt, Human
gaacuuucagcccagcguuucugcaaugcagagugaaguggauacugggcaguucgagacaggu

SEQ ID NO: 174925 - RNA, 64 nt, Human
ccaucaauugauggggaaggcuggcacccaccaagaaguggaaguccucagaaauucucggcac

SEQ ID NO: 174926 - RNA, 64 nt, Human
uccacaguggaaccagcccagacccuucuccuuagaaguggaaguaguggagccccugcucugg

SEQ ID NO: 174927 - RNA, 64 nt, Human
cagaguaauuuuguuuugcacauucauguuuauugaaguggacuaauuucuauaaugcaaauca

SEQ ID NO: 174928 - RNA, 64 nt, Human
gcgaaacagcagagaaagaaagacuguggucggggaaguggaaugcuucgaugcaggccagagu

SEQ ID NO: 174929 - RNA, 64 nt, Human
caacaugucacagaaaacgaacgaaggacaacaagaaguggaugagaauauuuuguugaccuuc

SEQ ID NO: 174930 - RNA, 64 nt, Human
gaacuuucuuauuuugcuacugagucacacaagggaaguggaaggaagaacaguuaauuuaaga

SEQ ID NO: 174931 - RNA, 64 nt, Human
aggcagacagagaugaaaagacagucaaaggacggaaguggaaggacgggagugagcuggggag

SEQ ID NO: 174932 - RNA, 64 nt, Human
agcuauuagguauagaaaaacauuuuauaaugaagaaguggauuucucuuuuacuccugauuug

SEQ ID NO: 174933 - RNA, 64 nt, Human
ggcuccuugcucugacgcaggccuccuggaggaggaaguggaggccgcugcguagacccaacag

SEQ ID NO: 174934 - RNA, 64 nt, Human
agagaaagauuuuuuuuuuuuuuaauggcagaccgaaguggagaucuuguagccuagauaggau

SEQ ID NO: 174935 - RNA, 64 nt, Human
ccuacgugaagguccagcucaugcugaaccagaggaaguggaagaagagaaagacagccaccaa

SEQ ID NO: 174936 - RNA, 64 nt, Human
uuuguucauuauauuuuccgucauauaacuagaggaaguggaaugcagauaagugccgaauuca

SEQ ID NO: 174937 - RNA, 64 nt, Human
uauguuauaggaaaacaacuugguauuuaaguaugaaguggaugaaauguuuauuuauuuaagg

SEQ ID NO: 174938 - RNA, 64 nt, Human
ggccggauggcugaggccugguggcugccuccuagaaguggaacagacugagaagggcaaacau

SEQ ID NO: 174939 - RNA, 64 nt, Human
cuaccuauggggaccaaagugcuuuuuccuucaggaaguggagaugcauggccaucucccccuc

SEQ ID NO: 174940 - RNA, 64 nt, Human
cuuggacaacccagcagggaguuccggggaguccgaaguggagaaaggcuggugggaacaugga

SEQ ID NO: 174941 - RNA, 64 nt, Human
agaauuguguucgggaggugggggaucugagaccgaaguggacagugguuaagauuguggggcc

SEQ ID NO: 174942 - RNA, 64 nt, Human
aaaguucccugagccuguaagcacuccagguggggaaguggacaggagccauuggucauaacca

SEQ ID NO: 174943 - RNA, 64 nt, Human
aagcccugguggguagaggccaagcagaagcccugaaguggacucuugcuuccccuaguagugu

SEQ ID NO: 174944 - RNA, 64 nt, Human
ccucaaagucccuuuagguccuucugguuuggaggaaguggagccuccacgaacucucucuuac

SEQ ID NO: 174945 - RNA, 64 nt, Human
gcacuggcuagaaccuccaguacaauguugaauagaaguggagagaggacauccuugucuuguu

SEQ ID NO: 174946 - RNA, 64 nt, Human
agaccuaaguguccaggagacagaaggagaagaggaaguggaucuggaauugggaggagccucc

SEQ ID NO: 174947 - RNA, 64 nt, Human
gccugcugcucuucccccaccauuuggaucacaggaaguggaggagccagaggugccuuugugg

SEQ ID NO: 174948 - RNA, 64 nt, Human
acaauggguggugaauucugaaguuuuggagagggaaguggagcagccagcaaguaagcuagcc

SEQ ID NO: 174949 - RNA, 64 nt, Human
cucaaaaucuggaacugaggaggcuggagaaagggaaguggaaggcagugaacacacucagcag

SEQ ID NO: 174950 - RNA, 64 nt, Human
aaggugccaguagugccaggcacuacacagagaggaaguggauuuguuccaaaucagauauaca

SEQ ID NO: 174951 - RNA, 64 nt, Human
ggguggggaggaggaagccguugaaucugggagggaaguggagguugcuguacaggaaaaaccg

SEQ ID NO: 174952 - RNA, 64 nt, Human
cucauuuugccagggccaagcuaccagaaaaguagaaguggagauuaccugguauguaucucuc

SEQ ID NO: 174953 - RNA, 64 nt, Human
auuugugcuggagugaggggaagaagcuguuacagaaguggaaugguuucuggugguauuucug

SEQ ID NO: 174954 - RNA, 64 nt, Human
uaguggaguuacugcagcuuagggaugguuccuggaaguggacacauuuuacaaaaacguuuuu

SEQ ID NO: 174955 - RNA, 64 nt, Human
auggagcuccuuccuagcuagggagaccuuaugagaaguggaugguaggaggagucacuaaugu

SEQ ID NO: 174956 - RNA, 64 nt, Human
aucacuaaauaagcuuccacgccaguugccucuugaaguggauuuaacuaaagcgaagagacaa

SEQ ID NO: 174957 - RNA, 64 nt, Human
augagccuagucaccaagaacuccacccccagaggaaguggaucugcuucuccaguuuuugagg

SEQ ID NO: 174958 - RNA, 64 nt, Human
ccaaccuggacaacaagagcgaaacuccgucuuagaaguggaccaggacaggaccagauuuugg

SEQ ID NO: 174959 - RNA, 64 nt, Human
cuuccccucuaaggaggcagcaacggagaguggggaaguggagcggcagcucccuugggggcuu

SEQ ID NO: 174960 - RNA, 64 nt, Human
augaugacgggucagguagagugagcuggggagggaaguggauccauuucugcuaaggaaauuc

SEQ ID NO: 174961 - RNA, 64 nt, Human
gcacugcccuguggucuuccccagguugaggagagaaguggaagccccauggaagacagugcuc

SEQ ID NO: 174962 - RNA, 64 nt, Human
ggcaguuacccggccagggucacaucaaccgccagaaguggaguugggcaggucagcguuuaug

SEQ ID NO: 174963 - RNA, 64 nt, Human
cuuuuuagaucuuuguguggcuccuauuuuuauagaaguggagggaugcacuauuucacaaggu

SEQ ID NO: 174964 - RNA, 64 nt, Human
ccauugucuuuugguugccauggucaccaaacaggaaguggacauucuaagggaggaguacuga

SEQ ID NO: 174965 - RNA, 64 nt, Human
gguuuuguguguguguauguauguguuuaauauugaaguggaucaugagauguaaagaaaacaa

SEQ ID NO: 174966 - RNA, 64 nt, Human
uaaugaugccauugagugagugaaaaacuugauggaaguggaagauucagaguucauuucuauc

SEQ ID NO: 174967 - RNA, 64 nt, Human
auugagaguuuuuggucugguccuugagccacaagaaguggaggggagaccaugccugggaaca

SEQ ID NO: 174968 - RNA, 64 nt, Human
auuuguauuugcuagucucugauuuccucaaaacgaaguggaauuuacuacuguugucaguauc

SEQ ID NO: 174969 - RNA, 64 nt, Human
gagcuugaaaggccgcgguuggcacuucgagaaggaaguggagaguaaagacagcgccuggagc

SEQ ID NO: 174970 - RNA, 64 nt, Human
ggggccaauuugugguuaagagguggugagauaagaaguggaacgugacaucuuugccaguugu

SEQ ID NO: 174971 - RNA, 64 nt, Human
cuuugaaugaaauuccacuuuguccagauugggagaaguggaaauuuauuuggauuuagagcag

SEQ ID NO: 174972 - RNA, 64 nt, Human
ggguuggucccuggucaugugccccuucgcagcugaaguggagagggugucaucuagcgcaauu

SEQ ID NO: 174973 - RNA, 64 nt, Human
aggagguugaggcagaagaaucgcuugaacccaggaaguggagguugcagugagccgagauugu

SEQ ID NO: 174974 - RNA, 64 nt, Human
aguugauuccaggcuuauuugacuuaaagucacugaaguggaaacuaagaaguggcaguuagug

SEQ ID NO: 174975 - RNA, 64 nt, Human
cugccaucacauuuacauuuaagauaguagagaggaaguggagggaaguugcacauauugcuuc

SEQ ID NO: 174976 - RNA, 64 nt, Human
uuauuauuuucaccuauuggcugcugcauuuuacgaaguggacuucccgguguuuguuuguuug

SEQ ID NO: 174977 - RNA, 64 nt, Human
ccuauagaccacuggguuuggcaaaacucaggcagaaguggagaccuuucuagacaucauuguc

SEQ ID NO: 174978 - RNA, 64 nt, Human
auaaauagcaugcaacaaaaugucuuuauugaaagaaguggaaguuaucuuaaugccacgguuc

SEQ ID NO: 174979 - RNA, 64 nt, Human
guucaguuuacuaaagguuuuacuauuaugguuugaaguggagucucaugaccucucagaauaa

SEQ ID NO: 174980 - RNA, 64 nt, Human
agagcaggaacagaacagagaaaugcccuuggaagaaguggaguugguggaugggugggcaugg

SEQ ID NO: 174981 - RNA, 64 nt, Human
aggucuuuucuuugggacccugggggcgggcauggaaguggaaguaggggcaagcucuugcccc

SEQ ID NO: 174982 - RNA, 64 nt, Human
uagaauuauaaggaugccauaucaugacauuuuagaaguggagagugcaucauauguagaaaau

SEQ ID NO: 174983 - RNA, 64 nt, Human
uguggccccuguuuauuccccuccugucaagaaugaaguggauucaguucagguacuuuugagg

SEQ ID NO: 174984 - RNA, 64 nt, Human
gccgcagcugucccaucauccccagcaaauccuagaaguggagucuggauacuucaaggauaga

SEQ ID NO: 174985 - RNA, 64 nt, Human
gccuccucagcucugcaaguaguuuaguaggaaugaaguggaaguccaggcuuggauugccuaa

SEQ ID NO: 174986 - RNA, 64 nt, Human
cacaaaaaaagcaaggugauguauuuuaaaaaaggaaguggaaauaaaaaaaucucaaagcuau

SEQ ID NO: 174987 - RNA, 64 nt, Human
aucagaacugcacacuccuucccugaugauagaggaaguggaagugccuuuaggauggugauac

SEQ ID NO: 174988 - RNA, 64 nt, Human
agugcuugaugaagccaccagugcccugacagaggaaguggagagcgagcucuaucgcaucggc

SEQ ID NO: 174989 - RNA, 64 nt, Human
uuagucuugggcugcaagccagcccagcugaggcgaaguggacuccaggcagggaauggguugc

SEQ ID NO: 174990 - RNA, 64 nt, Human
cuccgucuccaaaaaaaagaaaaaaaaauuucuugaaguggaaugauguacaccaaauacccac

SEQ ID NO: 174991 - RNA, 64 nt, Human
cugacaaucuuugccaaaucuuccuugcuagccagaaguggaauuggcagcuucuagaauaugu

SEQ ID NO: 174992 - RNA, 64 nt, Human
agaacagacucccuuuuucaaacauggaagcaaugaaguggagacacaugcaggaccuaacucg

SEQ ID NO: 174993 - RNA, 64 nt, Human
auagggaugguaggauucaaaugugugucauuuagaaguggaagcuauuagcaccaaugacaua

SEQ ID NO: 174994 - RNA, 64 nt, Human
uugucgaagaugauccguuagugauguucucugggaaguggacugugguuuuuccagaggaacu

SEQ ID NO: 174995 - RNA, 64 nt, Human
gcuugccccgugcagcaucuugcauccugagucagaaguggaaauguccagcaggggaaggaca

SEQ ID NO: 174996 - RNA, 64 nt, Human
gguauuaauguuuccauguucccaacuauguugagaaguggaaaaaaacccagguucuagaugg

SEQ ID NO: 174997 - RNA, 64 nt, Human
caaagccagucccagccugaccucucaccacacggaaguggaagacuccccuuuccuagggccu

SEQ ID NO: 174998 - RNA, 64 nt, Human
ggcucuggacuucuuuguaccugcccugcacuaugaaguggaugcccagcggaaggaggcaauu

SEQ ID NO: 174999 - RNA, 64 nt, Human
ggggaccugcccugccccucuuagguuuggagcagaaguggaggugcccacagcagguacccac

SEQ ID NO: 175000 - RNA, 64 nt, Human
auagcacuagaagaauuuuucuguugugaaauuagaaguggaguugguuuuuuucuuuuuucuu

SEQ ID NO: 175001 - RNA, 64 nt, Human
gugucuugugcccaccucuuccugagaagagauggaaguggagcugugacuaguacaagcagcc

SEQ ID NO: 175002 - RNA, 64 nt, Human
aggaggcugaggcaggagaaucgcuugaacccaggaaguggagguugcagugagcugauggugc

SEQ ID NO: 175003 - RNA, 64 nt, Human
gcuggugaccuggcauccucaauuguuuccuccugaaguggaagcuggggccuuagacucugcc

SEQ ID NO: 175004 - RNA, 64 nt, Human
ucuguagggacagacaugaggugagugguugccagaaguggaaaugggaguuaacuauaaauug

SEQ ID NO: 175005 - RNA, 64 nt, Human
cgcgugcccucgcugcuucuguguguggugagcagaaguggagcuggggggcguggagagcccg

SEQ ID NO: 175006 - RNA, 64 nt, Human
ucgccuggaggagacgcuggacuucggcgagguggaaguggagcccagugagguggaagacuuc

SEQ ID NO: 175007 - RNA, 64 nt, Human
agcugcguccuucagcuauuccuuuagauuggaggaaguggauaugaagauggauugauucagc

SEQ ID NO: 175008 - RNA, 64 nt, Human
agguuucuuggagaccacuuuuauuuacucaugagaaguggaagcuccuaguaucagaagaagc

SEQ ID NO: 175009 - RNA, 64 nt, Human
uccuagccaagcgagcaaaccugcaggggguuuggaaguggacuuggucaccgcagaagcgugu

SEQ ID NO: 175010 - RNA, 64 nt, Human
ccguuucccugcagaaucagcucugucucauguggaaguggagaaucagccuugccuggccuuu

SEQ ID NO: 175011 - RNA, 64 nt, Human
uucccaggcccugucuucuggaaagcauuacugggaaguggacacuaggaauugcagccacugg

SEQ ID NO: 175012 - RNA, 64 nt, Human
uucaggcugggcauggaccagccuucagauggcagaaguggaagaugagccuacuugugagcga

SEQ ID NO: 175013 - RNA, 64 nt, Human
ugucacaugaaauggaucagcacuugaauggggagaaguggagggagaggcccugggccugucc

SEQ ID NO: 175014 - RNA, 64 nt, Human
ggcacauaggcacccagccugcaucucccaggaggaaguggaggggacaucgcuguuccccaga

SEQ ID NO: 175015 - RNA, 64 nt, Human
guuuucuucccuagcuuauuuuguggcuuuuaaagaaguggauuguauugugagauccugugau

SEQ ID NO: 175016 - RNA, 64 nt, Human
uuggccuugcacaacccauuugugagcaaaagcagaaguggaccaccaucagcucccacccacc

SEQ ID NO: 175017 - RNA, 63 nt, Human
uccccaaccagaaaaguugaugguuuuccuuaggaaguggagcuacauggaugaugugagcag

SEQ ID NO: 175018 - RNA, 64 nt, Human
agcccaagugguugccuccuacgaggagaccaacgaaguggagauucgauacguggacuacggc

SEQ ID NO: 175019 - RNA, 64 nt, Human
agguuucuucucuuuggcuuuguuuucccuuugugaaguggagagggagcuacuaccuuugcuc

SEQ ID NO: 175020 - RNA, 64 nt, Human
accccuucccccauccaagcauccuucgauuagggaaguggagagcacaucccuguaaggccca

SEQ ID NO: 175021 - RNA, 64 nt, Human
gggaggcugaggcaggagaaucacuugaacccgggaaguggagguugcagugagccaagaguac

SEQ ID NO: 175022 - RNA, 64 nt, Human
uugaguuagggcuccgcaagagacuuuggggagugaaguggaucucuuccucaucuuuuggucc

SEQ ID NO: 175023 - RNA, 64 nt, Human
ugauggcagcaguuauacuacguauaugaaagaggaaguggauagguaaguggcuguuugaggu

SEQ ID NO: 175024 - RNA, 64 nt, Human
uguauccucagacuuugaaauacucgugggauaugaaguggaggugccuagaggguugaagaua

SEQ ID NO: 175025 - RNA, 64 nt, Human
ccaacaguuaguggccagcauccuccugcugcaggaaguggaucccccucagccaccucaauuc

SEQ ID NO: 175026 - RNA, 64 nt, Human
ucugacuggagucuaggaagggcgugucccaugggaaguggauacucuggggugccccugaagu

SEQ ID NO: 175027 - RNA, 64 nt, Human
uccgcguuuugcgauuuuaauuuuggcgggaggggaaguggauugagaggaaagagagaggcca

SEQ ID NO: 175028 - RNA, 64 nt, Human
ggcagaucaagauaugguuccagaaccgacgcaugaaguggaaaaaggagagcaaacugcucag

SEQ ID NO: 175029 - RNA, 64 nt, Human
aguucggggucgacucuaccccuggggcaucguggaaguggaaaacccagggcacugcgacuuu

SEQ ID NO: 175030 - RNA, 64 nt, Human
uauccuggcuaaggcagacacacugacaccucccgaaguggaccacaagaaacgcaaagugagg

SEQ ID NO: 175031 - RNA, 64 nt, Human
aguacaaaguuuuugggguuuuaucuuugcuuuagaaguggauguguacuucaccucuuggcug

SEQ ID NO: 175032 - RNA, 64 nt, Human
ugggugaucuugaagaggacuuugaucccucggugaaguggaaacuccuccugcaggaagagcc

SEQ ID NO: 175033 - RNA, 64 nt, Human
agaaggucaaagagguagagacaaagugaugauggaaguggacgugggugugacgugagcaggg

SEQ ID NO: 175034 - RNA, 64 nt, Human
gggagccugaggcaggagaaucgcuugaaccugggaaguggagguugagugagccgggaccgug

SEQ ID NO: 175035 - RNA, 64 nt, Human
aggcuuggucggucuccacucccagggagaacgggaaguggaccccagcccgggagccugcugg

SEQ ID NO: 175036 - RNA, 64 nt, Human
gaguauguagcaacaacuguuuaacauccgagaugaaguggaccugaugcuguauuuggguauu

SEQ ID NO: 175037 - RNA, 64 nt, Human
ugcccucaccucacccuuuuccaacuugcccagggaaguggagguucccucuuuccuuucccuc

SEQ ID NO: 175038 - RNA, 64 nt, Human
caggaucucaaacuugauuaaauguuagaccacagaaguggaauuugaaaguauaaugcaguac

SEQ ID NO: 175039 - RNA, 64 nt, Human
cgagcaucguucccugagccccagaaagggagaugaaguggaaagcuguuucaaaaacagacuc

SEQ ID NO: 175040 - RNA, 64 nt, Human
gggaggcugaggcaggaggaucgcuugaacccaggaaguggagacugcagugagccgauaucgc

SEQ ID NO: 175041 - RNA, 64 nt, Human
ugccauccugcaacagcuggacucaaguuuccaggaaguggagauguguuucuagaaguuuccu

SEQ ID NO: 175042 - RNA, 64 nt, Human
uaucagauggugagaaaacagaaaaaugagaucagaaguggagauguuggggccaggcacagug

SEQ ID NO: 175043 - RNA, 64 nt, Human
cuugguucauggagacccuguuuuuuuaaaaaaagaaguggagguguuuacaccagcaaaauac

SEQ ID NO: 175044 - RNA, 64 nt, Human
cacccccauccccuuggcccuuccucaugcuucugaaguggacauauucagccuuggcgagaag

SEQ ID NO: 175045 - RNA, 64 nt, Human
gggugcgggcgggcccgagccccugucccacuucgaaguggaggucugccagcugccccggcca

SEQ ID NO: 175046 - RNA, 64 nt, Human
ccuagagcucacuguuuucuaguuaguccaucuggaaguggagccuuuuuccaguuugcacaaa

SEQ ID NO: 175047 - RNA, 64 nt, Human
uucccccccaagcacagaggggagaggggccagggaaguggaugucuccuccccucccacccca

SEQ ID NO: 175048 - RNA, 64 nt, Human
agccugcuguguacaccaagguggugcauuaccggaaguggaucaaggacaccaucgcagccaa

SEQ ID NO: 175049 - RNA, 64 nt, Human
uaucucguguucaaucgucugaucucuacagagagaaguggaaaaugcuguaucaagggugggc

SEQ ID NO: 175050 - RNA, 64 nt, Human
aagugcucagaccgaggaacagggacugaguuaagaaguggacaccacguggcaugauccuuga

SEQ ID NO: 175051 - RNA, 64 nt, Human
agacaugguuaugccuaauuuauuuauaaaaggggaaguggaaucauuaaaguaauaauaauua

SEQ ID NO: 175052 - RNA, 64 nt, Human
caguggucaacuacucaagcaucaauagacucaugaaguggaucauguucccagucggcuaugg

SEQ ID NO: 175053 - RNA, 64 nt, Human
uacauguguaauauaucuuuaagguaaauuccuagaaguggaaaugcuagauaaaaauguaaau

SEQ ID NO: 175054 - RNA, 64 nt, Human
aguuucuuguaaaugugacugaugagcgagguuagaaguggaagaaauuccugugcauguucua

SEQ ID NO: 175055 - RNA, 64 nt, Human
gagguggggcccauugggaggugauugaaucauggaaguggauuucucaaacugagaaagaugu

SEQ ID NO: 175056 - RNA, 64 nt, Human
ggcagaaaaacccugugccguaggaaagugacuggaaguggacuccagagggacagguguggug

SEQ ID NO: 175057 - RNA, 64 nt, Human
cuuagguuggagaugacagaaauaugauugauuugaaguggaaaaagaaauucuguuaauguua

SEQ ID NO: 175058 - RNA, 64 nt, Human
uguaauagacuuguuuuucuccuauuuaugauuugaaguggauucuguaaaauaucucuuguuc

SEQ ID NO: 175059 - RNA, 64 nt, Human
ccaucagcagucuugcuuccaugcaccucaguaagaaguggaucugccuuugggaccugcucag

SEQ ID NO: 175060 - RNA, 64 nt, Human
ucugucaagcugggucaggggccuugaaacuggagaaguggaagucuaugguuggucugaguaa

SEQ ID NO: 175061 - RNA, 64 nt, Human
acagaucacugugcuguccuuccuaggggugcaggaaguggacagggcggaggguuugaaagaa

SEQ ID NO: 175062 - RNA, 64 nt, Human
augcagguauuuucuacggguguuugauguuccugaaguggaagcuguguguuggcgugccacg

SEQ ID NO: 175063 - RNA, 64 nt, Human
cugaauaauauuuuucuuagaauugaccaaauaagaaguggaauuuuugcauacuugagcgcug

SEQ ID NO: 175064 - RNA, 64 nt, Human
uuuguacacgacucccaucuaggcugaaaaccuagaaguggaccuugugugugugcaugguguc

SEQ ID NO: 175065 - RNA, 64 nt, Human
gugcaucaacucuguuggauacgagaacacuguagaaguggacgauuuguucuagcaccuuuga

SEQ ID NO: 175066 - RNA, 64 nt, Human
uuuuagcacuagguaaaauucaguauaauaggcugaaguggaguaagugaaaaccugccuuuug

SEQ ID NO: 175067 - RNA, 64 nt, Human
uggaauaaaaaaugcagcuggcccugaguacagggaaguggaacauaggcaggauuuuggauua

SEQ ID NO: 175068 - RNA, 64 nt, Human
aaucuuaaccauguucuuaaguccaaaauaggaagaaguggaguaguuugcaguauugauuuau

SEQ ID NO: 175069 - RNA, 64 nt, Human
aggaccauggcuggggaggauaugucagcaccuggaaguggagugcaggcugcagcgcccagcc

SEQ ID NO: 175070 - RNA, 64 nt, Human
cugucugcuucccuggaauccaagaugcugaguggaaguggacccugggugggcccggcccugu

SEQ ID NO: 175071 - RNA, 64 nt, Human
uuucccaccccagcugaccaugagacuuugcugagaaguggaggccccaggacaggcuggcugg

SEQ ID NO: 175072 - RNA, 64 nt, Human
guuuuauguggaacgagguaccuugucuggggaagaaguggagcugggcaggcuugacugcucc

SEQ ID NO: 175073 - RNA, 64 nt, Human
uuagaguuaccuaagaauuauuaaguuugacuuggaaguggagcagcaggacuuuguaguugua

SEQ ID NO: 175074 - RNA, 64 nt, Human
cgacuugucugaaauccacauuccagaggcucaggaaguggaaauggccucaggucauuuugcc

SEQ ID NO: 175075 - RNA, 64 nt, Human
guguaucuggugcugaaugacugggggacaagcagaaguggaagagaucuuucugcaacaggau

SEQ ID NO: 175076 - RNA, 64 nt, Human
ucuguacaucuuuuguaaaugaugagaaauaaaggaaguggacgcaaagugaugcggcagcagg

SEQ ID NO: 175077 - RNA, 64 nt, Human
cucagaccuuggagcccaaggggccacugcccuugaaguggagugggcccagaguguggcgguc

SEQ ID NO: 175078 - RNA, 64 nt, Human
cuguagggucucuucuucagggcugcauaucugagaaguggaugcccacaugccacuggaaggg

SEQ ID NO: 175079 - RNA, 64 nt, Human
aaaaugaagauuauuuucuaaagccuucaaauuagaaguggauuucuguuucauuacuuccguu

SEQ ID NO: 175080 - RNA, 64 nt, Human
uaugggaugucagcacaauauaacacucugggaagaaguggaguuuuuugguuauuagguuaau

SEQ ID NO: 175081 - RNA, 64 nt, Human
auuuuaacauagcagcugguuaaccgggacuacagaaguggaaggauaaugagauguaauacac

SEQ ID NO: 175082 - RNA, 64 nt, Human
auaaguaucaugucuccuuuaacuagcauaccccgaaguggagaagggugcagcaggcucaaag

SEQ ID NO: 175083 - RNA, 64 nt, Human
uuuaaucuuaauguguuguuuccauaagugacaugaaguggauagauucucaauuguuaugucc

SEQ ID NO: 175084 - RNA, 64 nt, Human
auauguaugaaaguuuaccuaggguugauuccuagaaguggaauugcaaagucauaggauauuu

SEQ ID NO: 175085 - RNA, 64 nt, Human
cuauuuucuauccucacugcaguaaugugaaagugaaguggaaauauugucacaauggucaaua

SEQ ID NO: 175086 - RNA, 64 nt, Human
aagucaaaggugaugauuaauuucauuuagcagggaaguggaauaauaucuuuugaaauaacua

SEQ ID NO: 175087 - RNA, 64 nt, Human
cucauuuaguccaucaccuuuauuuuaaguugaggaaguggaggcugguaaagagcaggaccag

SEQ ID NO: 175088 - RNA, 64 nt, Human
cugggggcuggcagcuccuucaggcagccuggcagaaguggaacuccccucuccacugauggcu

SEQ ID NO: 175089 - RNA, 64 nt, Human
ugaacaacgagccuuuucacccuucuacucuagagaaguggacuggaggagcugggcccgauuu

SEQ ID NO: 175090 - RNA, 64 nt, Human; identical to SEQ ID NO: 174736

SEQ ID NO: 175091 - RNA, 64 nt, Human; identical to SEQ ID NO: 174737

SEQ ID NO: 175092 - RNA, 64 nt, Human; identical to SEQ ID NO: 174738

SEQ ID NO: 175093 - RNA, 57 nt, Human; identical to SEQ ID NO: 174739

SEQ ID NO: 175094 - RNA, 64 nt, Human; identical to SEQ ID NO: 174740

SEQ ID NO: 175095 - RNA, 64 nt, Human; identical to SEQ ID NO: 174741

SEQ ID NO: 175096 - RNA, 64 nt, Human; identical to SEQ ID NO: 174742

SEQ ID NO: 175097 - RNA, 64 nt, Human; identical to SEQ ID NO: 174743

SEQ ID NO: 175098 - RNA, 64 nt, Human; identical to SEQ ID NO: 174744

SEQ ID NO: 175099 - RNA, 64 nt, Human; identical to SEQ ID NO: 174745

SEQ ID NO: 175100 - RNA, 64 nt, Human; identical to SEQ ID NO: 174746

SEQ ID NO: 175101 - RNA, 64 nt, Human; identical to SEQ ID NO: 174747

SEQ ID NO: 175102 - RNA, 64 nt, Human; identical to SEQ ID NO: 174748

SEQ ID NO: 175103 - RNA, 64 nt, Human; identical to SEQ ID NO: 174749

SEQ ID NO: 175104 - RNA, 64 nt, Human; identical to SEQ ID NO: 174750

SEQ ID NO: 175105 - RNA, 64 nt, Human; identical to SEQ ID NO: 174751

SEQ ID NO: 175106 - RNA, 64 nt, Human; identical to SEQ ID NO: 174752

SEQ ID NO: 175107 - RNA, 64 nt, Human; identical to SEQ ID NO: 174753

SEQ ID NO: 175108 - RNA, 64 nt, Human; identical to SEQ ID NO: 174754

SEQ ID NO: 175109 - RNA, 64 nt, Human; identical to SEQ ID NO: 174755

SEQ ID NO: 175110 - RNA, 64 nt, Human; identical to SEQ ID NO: 174756

SEQ ID NO: 175111 - RNA, 64 nt, Human; identical to SEQ ID NO: 174757

SEQ ID NO: 175112 - RNA, 64 nt, Human; identical to SEQ ID NO: 174758

SEQ ID NO: 175113 - RNA, 64 nt, Human; identical to SEQ ID NO: 174759

SEQ ID NO: 175114 - RNA, 64 nt, Human; identical to SEQ ID NO: 174760

SEQ ID NO: 175115 - RNA, 64 nt, Human; identical to SEQ ID NO: 174761

SEQ ID NO: 175116 - RNA, 53 nt, Human; identical to SEQ ID NO: 174762

SEQ ID NO: 175117 - RNA, 64 nt, Human; identical to SEQ ID NO: 174763

SEQ ID NO: 175118 - RNA, 64 nt, Human; identical to SEQ ID NO: 174764

SEQ ID NO: 175119 - RNA, 64 nt, Human; identical to SEQ ID NO: 174765

SEQ ID NO: 175120 - RNA, 64 nt, Human; identical to SEQ ID NO: 174766

SEQ ID NO: 175121 - RNA, 64 nt, Human; identical to SEQ ID NO: 174767

SEQ ID NO: 175122 - RNA, 64 nt, Human; identical to SEQ ID NO: 174768

SEQ ID NO: 175123 - RNA, 64 nt, Human; identical to SEQ ID NO: 174769

SEQ ID NO: 175124 - RNA, 64 nt, Human; identical to SEQ ID NO: 174770

SEQ ID NO: 175125 - RNA, 64 nt, Human; identical to SEQ ID NO: 174771

SEQ ID NO: 175126 - RNA, 64 nt, Human; identical to SEQ ID NO: 174772

SEQ ID NO: 175127 - RNA, 64 nt, Human; identical to SEQ ID NO: 174773

SEQ ID NO: 175128 - RNA, 64 nt, Human; identical to SEQ ID NO: 174774

SEQ ID NO: 175129 - RNA, 64 nt, Human; identical to SEQ ID NO: 174775

SEQ ID NO: 175130 - RNA, 58 nt, Human; identical to SEQ ID NO: 174776

SEQ ID NO: 175131 - RNA, 64 nt, Human; identical to SEQ ID NO: 174777

SEQ ID NO: 175132 - RNA, 64 nt, Human; identical to SEQ ID NO: 174778

SEQ ID NO: 175133 - RNA, 64 nt, Human; identical to SEQ ID NO: 174779

SEQ ID NO: 175134 - RNA, 64 nt, Human; identical to SEQ ID NO: 174780

SEQ ID NO: 175135 - RNA, 64 nt, Human; identical to SEQ ID NO: 174781

SEQ ID NO: 175136 - RNA, 64 nt, Human; identical to SEQ ID NO: 174782

SEQ ID NO: 175137 - RNA, 64 nt, Human; identical to SEQ ID NO: 174783

SEQ ID NO: 175138 - RNA, 64 nt, Human; identical to SEQ ID NO: 174784

SEQ ID NO: 175139 - RNA, 64 nt, Human; identical to SEQ ID NO: 174785

SEQ ID NO: 175140 - RNA, 64 nt, Human; identical to SEQ ID NO: 174786

SEQ ID NO: 175141 - RNA, 64 nt, Human; identical to SEQ ID NO: 174787

SEQ ID NO: 175142 - RNA, 64 nt, Human; identical to SEQ ID NO: 174788

SEQ ID NO: 175143 - RNA, 64 nt, Human; identical to SEQ ID NO: 174789

SEQ ID NO: 175144 - RNA, 64 nt, Human; identical to SEQ ID NO: 174790

SEQ ID NO: 175145 - RNA, 64 nt, Human; identical to SEQ ID NO: 174791

SEQ ID NO: 175146 - RNA, 64 nt, Human; identical to SEQ ID NO: 174792

SEQ ID NO: 175147 - RNA, 64 nt, Human; identical to SEQ ID NO: 174793

SEQ ID NO: 175148 - RNA, 64 nt, Human; identical to SEQ ID NO: 174794

SEQ ID NO: 175149 - RNA, 64 nt, Human; identical to SEQ ID NO: 174795

SEQ ID NO: 175150 - RNA, 64 nt, Human; identical to SEQ ID NO: 174796

SEQ ID NO: 175151 - RNA, 64 nt, Human; identical to SEQ ID NO: 174797

SEQ ID NO: 175152 - RNA, 64 nt, Human; identical to SEQ ID NO: 174798

SEQ ID NO: 175153 - RNA, 64 nt, Human; identical to SEQ ID NO: 174799

SEQ ID NO: 175154 - RNA, 64 nt, Human; identical to SEQ ID NO: 174800

SEQ ID NO: 175155 - RNA, 64 nt, Human; identical to SEQ ID NO: 174801

SEQ ID NO: 175156 - RNA, 64 nt, Human; identical to SEQ ID NO: 174802

SEQ ID NO: 175157 - RNA, 64 nt, Human; identical to SEQ ID NO: 174803

SEQ ID NO: 175158 - RNA, 64 nt, Human; identical to SEQ ID NO: 174804

SEQ ID NO: 175159 - RNA, 64 nt, Human; identical to SEQ ID NO: 174805

SEQ ID NO: 175160 - RNA, 64 nt, Human; identical to SEQ ID NO: 174806

SEQ ID NO: 175161 - RNA, 64 nt, Human; identical to SEQ ID NO: 174807

SEQ ID NO: 175162 - RNA, 64 nt, Human; identical to SEQ ID NO: 174808

SEQ ID NO: 175163 - RNA, 64 nt, Human; identical to SEQ ID NO: 174809

SEQ ID NO: 175164 - RNA, 64 nt, Human; identical to SEQ ID NO: 174810

SEQ ID NO: 175165 - RNA, 64 nt, Human; identical to SEQ ID NO: 174811

SEQ ID NO: 175166 - RNA, 64 nt, Human; identical to SEQ ID NO: 174812

SEQ ID NO: 175167 - RNA, 64 nt, Human; identical to SEQ ID NO: 174813

SEQ ID NO: 175168 - RNA, 64 nt, Human; identical to SEQ ID NO: 174814

SEQ ID NO: 175169 - RNA, 64 nt, Human; identical to SEQ ID NO: 174815

SEQ ID NO: 175170 - RNA, 64 nt, Human; identical to SEQ ID NO: 174816

SEQ ID NO: 175171 - RNA, 64 nt, Human; identical to SEQ ID NO: 174817

SEQ ID NO: 175172 - RNA, 64 nt, Human; identical to SEQ ID NO: 174818

SEQ ID NO: 175173 - RNA, 64 nt, Human; identical to SEQ ID NO: 174819

SEQ ID NO: 175174 - RNA, 64 nt, Human; identical to SEQ ID NO: 174820

SEQ ID NO: 175175 - RNA, 64 nt, Human; identical to SEQ ID NO: 174821

SEQ ID NO: 175176 - RNA, 64 nt, Human; identical to SEQ ID NO: 174822

SEQ ID NO: 175177 - RNA, 64 nt, Human; identical to SEQ ID NO: 174823

SEQ ID NO: 175178 - RNA, 64 nt, Human; identical to SEQ ID NO: 174824

SEQ ID NO: 175179 - RNA, 64 nt, Human; identical to SEQ ID NO: 174825

SEQ ID NO: 175180 - RNA, 64 nt, Human; identical to SEQ ID NO: 174826

SEQ ID NO: 175181 - RNA, 64 nt, Human; identical to SEQ ID NO: 174827

SEQ ID NO: 175182 - RNA, 64 nt, Human; identical to SEQ ID NO: 174828

SEQ ID NO: 175183 - RNA, 64 nt, Human; identical to SEQ ID NO: 174829

SEQ ID NO: 175184 - RNA, 64 nt, Human; identical to SEQ ID NO: 174830

SEQ ID NO: 175185 - RNA, 64 nt, Human; identical to SEQ ID NO: 174831

SEQ ID NO: 175186 - RNA, 64 nt, Human; identical to SEQ ID NO: 174832

SEQ ID NO: 175187 - RNA, 64 nt, Human; identical to SEQ ID NO: 174833

SEQ ID NO: 175188 - RNA, 64 nt, Human; identical to SEQ ID NO: 174834

SEQ ID NO: 175189 - RNA, 64 nt, Human; identical to SEQ ID NO: 174835

SEQ ID NO: 175190 - RNA, 64 nt, Human; identical to SEQ ID NO: 174835

SEQ ID NO: 175191 - RNA, 64 nt, Human; identical to SEQ ID NO: 174837

SEQ ID NO: 175192 - RNA, 64 nt, Human; identical to SEQ ID NO: 174838

SEQ ID NO: 175193 - RNA, 64 nt, Human; identical to SEQ ID NO: 174839

SEQ ID NO: 175194 - RNA, 64 nt, Human; identical to SEQ ID NO: 174840

SEQ ID NO: 175195 - RNA, 64 nt, Human; identical to SEQ ID NO: 174841

SEQ ID NO: 175196 - RNA, 64 nt, Human; identical to SEQ ID NO: 174842

SEQ ID NO: 175197 - RNA, 64 nt, Human; identical to SEQ ID NO: 174843

SEQ ID NO: 175198 - RNA, 64 nt, Human; identical to SEQ ID NO: 174844

SEQ ID NO: 175199 - RNA, 64 nt, Human; identical to SEQ ID NO: 174845

SEQ ID NO: 175200 - RNA, 64 nt, Human; identical to SEQ ID NO: 174846

SEQ ID NO: 175201 - RNA, 64 nt, Human; identical to SEQ ID NO: 174847

SEQ ID NO: 175202 - RNA, 64 nt, Human; identical to SEQ ID NO: 174848

SEQ ID NO: 175203 - RNA, 64 nt, Human; identical to SEQ ID NO: 174849

SEQ ID NO: 175204 - RNA, 64 nt, Human; identical to SEQ ID NO: 174850

SEQ ID NO: 175205 - RNA, 64 nt, Human; identical to SEQ ID NO: 174851

SEQ ID NO: 175206 - RNA, 64 nt, Human; identical to SEQ ID NO: 174852

SEQ ID NO: 175207 - RNA, 64 nt, Human; identical to SEQ ID NO: 174853

SEQ ID NO: 175208 - RNA, 64 nt, Human; identical to SEQ ID NO: 174854

SEQ ID NO: 175209 - RNA, 64 nt, Human; identical to SEQ ID NO: 174854

SEQ ID NO: 175210 - RNA, 64 nt, Human; identical to SEQ ID NO: 174856

SEQ ID NO: 175211 - RNA, 64 nt, Human; identical to SEQ ID NO: 174857

SEQ ID NO: 175212 - RNA, 64 nt, Human; identical to SEQ ID NO: 174858

SEQ ID NO: 175213 - RNA, 64 nt, Human; identical to SEQ ID NO: 174859

SEQ ID NO: 175214 - RNA, 64 nt, Human; identical to SEQ ID NO: 174860

SEQ ID NO: 175215 - RNA, 64 nt, Human; identical to SEQ ID NO: 174861

SEQ ID NO: 175216 - RNA, 64 nt, Human; identical to SEQ ID NO: 174862

SEQ ID NO: 175217 - RNA, 58 nt, Human; identical to SEQ ID NO: 174863

SEQ ID NO: 175218 - RNA, 64 nt, Human; identical to SEQ ID NO: 174864

SEQ ID NO: 175219 - RNA, 64 nt, Human; identical to SEQ ID NO: 174865

SEQ ID NO: 175220 - RNA, 64 nt, Human; identical to SEQ ID NO: 174866

SEQ ID NO: 175221 - RNA, 64 nt, Human; identical to SEQ ID NO: 174867

SEQ ID NO: 175222 - RNA, 64 nt, Human; identical to SEQ ID NO: 174868

SEQ ID NO: 175223 - RNA, 64 nt, Human; identical to SEQ ID NO: 174869

SEQ ID NO: 175224 - RNA, 59 nt, Human; identical to SEQ ID NO: 174870

SEQ ID NO: 175225 - RNA, 64 nt, Human; identical to SEQ ID NO: 174871

SEQ ID NO: 175226 - RNA, 64 nt, Human; identical to SEQ ID NO: 174872

SEQ ID NO: 175227 - RNA, 64 nt, Human; identical to SEQ ID NO: 174873

SEQ ID NO: 175228 - RNA, 64 nt, Human; identical to SEQ ID NO: 174874

SEQ ID NO: 175229 - RNA, 64 nt, Human; identical to SEQ ID NO: 174875

SEQ ID NO: 175230 - RNA, 64 nt, Human; identical to SEQ ID NO: 174876

SEQ ID NO: 175231 - RNA, 64 nt, Human; identical to SEQ ID NO: 174877

SEQ ID NO: 175232 - RNA, 64 nt, Human; identical to SEQ ID NO: 174878

SEQ ID NO: 175233 - RNA, 64 nt, Human; identical to SEQ ID NO: 174879

SEQ ID NO: 175234 - RNA, 64 nt, Human; identical to SEQ ID NO: 174880

SEQ ID NO: 175235 - RNA, 64 nt, Human; identical to SEQ ID NO: 174881

SEQ ID NO: 175236 - RNA, 64 nt, Human; identical to SEQ ID NO: 174882

SEQ ID NO: 175237 - RNA, 64 nt, Human; identical to SEQ ID NO: 174883

SEQ ID NO: 175238 - RNA, 64 nt, Human; identical to SEQ ID NO: 174884

SEQ ID NO: 175239 - RNA, 64 nt, Human; identical to SEQ ID NO: 174885

SEQ ID NO: 175240 - RNA, 64 nt, Human; identical to SEQ ID NO: 174886

SEQ ID NO: 175241 - RNA, 64 nt, Human; identical to SEQ ID NO: 174887

SEQ ID NO: 175242 - RNA, 64 nt, Human; identical to SEQ ID NO: 174888

SEQ ID NO: 175243 - RNA, 64 nt, Human; identical to SEQ ID NO: 174889

SEQ ID NO: 175244 - RNA, 64 nt, Human; identical to SEQ ID NO: 174890

SEQ ID NO: 175245 - RNA, 64 nt, Human; identical to SEQ ID NO: 174891

SEQ ID NO: 175246 - RNA, 64 nt, Human; identical to SEQ ID NO: 174892

SEQ ID NO: 175247 - RNA, 64 nt, Human; identical to SEQ ID NO: 174893

SEQ ID NO: 175248 - RNA, 64 nt, Human; identical to SEQ ID NO: 174894

SEQ ID NO: 175249 - RNA, 64 nt, Human; identical to SEQ ID NO: 174895

SEQ ID NO: 175250 - RNA, 64 nt, Human; identical to SEQ ID NO: 174896

SEQ ID NO: 175251 - RNA, 64 nt, Human; identical to SEQ ID NO: 174897

SEQ ID NO: 175252 - RNA, 64 nt, Human; identical to SEQ ID NO: 174898

SEQ ID NO: 175253 - RNA, 64 nt, Human; identical to SEQ ID NO: 174899

SEQ ID NO: 175254 - RNA, 64 nt, Human; identical to SEQ ID NO: 174900

SEQ ID NO: 175255 - RNA, 64 nt, Human; identical to SEQ ID NO: 174901

SEQ ID NO: 175256 - RNA, 64 nt, Human; identical to SEQ ID NO: 174902

SEQ ID NO: 175257 - RNA, 64 nt, Human; identical to SEQ ID NO: 174903

SEQ ID NO: 175258 - RNA, 64 nt, Human; identical to SEQ ID NO: 174904

SEQ ID NO: 175259 - RNA, 64 nt, Human; identical to SEQ ID NO: 174905

SEQ ID NO: 175260 - RNA, 64 nt, Human; identical to SEQ ID NO: 174906

SEQ ID NO: 175261 - RNA, 64 nt, Human; identical to SEQ ID NO: 174907

SEQ ID NO: 175262 - RNA, 64 nt, Human; identical to SEQ ID NO: 174908

SEQ ID NO: 175263 - RNA, 64 nt, Human; identical to SEQ ID NO: 174909

SEQ ID NO: 175264 - RNA, 64 nt, Human; identical to SEQ ID NO: 174910

SEQ ID NO: 175265 - RNA, 64 nt, Human; identical to SEQ ID NO: 174911

SEQ ID NO: 175266 - RNA, 64 nt, Human; identical to SEQ ID NO: 174912

SEQ ID NO: 175267 - RNA, 64 nt, Human; identical to SEQ ID NO: 174913

SEQ ID NO: 175268 - RNA, 64 nt, Human; identical to SEQ ID NO: 174914

SEQ ID NO: 175269 - RNA, 64 nt, Human; identical to SEQ ID NO: 174915

SEQ ID NO: 175270 - RNA, 64 nt, Human; identical to SEQ ID NO: 174916

SEQ ID NO: 175271 - RNA, 64 nt, Human; identical to SEQ ID NO: 174917

SEQ ID NO: 175272 - RNA, 64 nt, Human; identical to SEQ ID NO: 174918

SEQ ID NO: 175273 - RNA, 64 nt, Human; identical to SEQ ID NO: 174919

SEQ ID NO: 175274 - RNA, 64 nt, Human; identical to SEQ ID NO: 174920

SEQ ID NO: 175275 - RNA, 64 nt, Human; identical to SEQ ID NO: 174921

SEQ ID NO: 175276 - RNA, 64 nt, Human; identical to SEQ ID NO: 174922

SEQ ID NO: 175277 - RNA, 64 nt, Human; identical to SEQ ID NO: 174923

SEQ ID NO: 175278 - RNA, 64 nt, Human; identical to SEQ ID NO: 174924

SEQ ID NO: 175279 - RNA, 64 nt, Human; identical to SEQ ID NO: 174925

SEQ ID NO: 175280 - RNA, 64 nt, Human; identical to SEQ ID NO: 174926

SEQ ID NO: 175281 - RNA, 64 nt, Human; identical to SEQ ID NO: 174927

SEQ ID NO: 175282 - RNA, 64 nt, Human; identical to SEQ ID NO: 174928

SEQ ID NO: 175283 - RNA, 64 nt, Human; identical to SEQ ID NO: 174929

SEQ ID NO: 175284 - RNA, 64 nt, Human; identical to SEQ ID NO: 174930

SEQ ID NO: 175285 - RNA, 64 nt, Human; identical to SEQ ID NO: 174931

SEQ ID NO: 175286 - RNA, 64 nt, Human; identical to SEQ ID NO: 174932

SEQ ID NO: 175287 - RNA, 64 nt, Human; identical to SEQ ID NO: 174933

SEQ ID NO: 175288 - RNA, 64 nt, Human; identical to SEQ ID NO: 174934

SEQ ID NO: 175289 - RNA, 64 nt, Human; identical to SEQ ID NO: 174935

SEQ ID NO: 175290 - RNA, 64 nt, Human; identical to SEQ ID NO: 174936

SEQ ID NO: 175291 - RNA, 64 nt, Human; identical to SEQ ID NO: 174937

SEQ ID NO: 175292 - RNA, 64 nt, Human; identical to SEQ ID NO: 174938

SEQ ID NO: 175293 - RNA, 64 nt, Human; identical to SEQ ID NO: 174939

SEQ ID NO: 175294 - RNA, 64 nt, Human; identical to SEQ ID NO: 174940

SEQ ID NO: 175295 - RNA, 64 nt, Human; identical to SEQ ID NO: 174941

SEQ ID NO: 175296 - RNA, 64 nt, Human; identical to SEQ ID NO: 174942

SEQ ID NO: 175297 - RNA, 64 nt, Human; identical to SEQ ID NO: 174943

SEQ ID NO: 175298 - RNA, 64 nt, Human; identical to SEQ ID NO: 174944

SEQ ID NO: 175299 - RNA, 64 nt, Human; identical to SEQ ID NO: 174945

SEQ ID NO: 175300 - RNA, 64 nt, Human; identical to SEQ ID NO: 174946

SEQ ID NO: 175301 - RNA, 64 nt, Human; identical to SEQ ID NO: 174947

SEQ ID NO: 175302 - RNA, 64 nt, Human; identical to SEQ ID NO: 174948

SEQ ID NO: 175303 - RNA, 64 nt, Human; identical to SEQ ID NO: 174949

SEQ ID NO: 175304 - RNA, 64 nt, Human; identical to SEQ ID NO: 174950

SEQ ID NO: 175305 - RNA, 64 nt, Human; identical to SEQ ID NO: 174951

SEQ ID NO: 175306 - RNA, 64 nt, Human; identical to SEQ ID NO: 174952

SEQ ID NO: 175307 - RNA, 64 nt, Human; identical to SEQ ID NO: 174953

SEQ ID NO: 175308 - RNA, 64 nt, Human; identical to SEQ ID NO: 174954

SEQ ID NO: 175309 - RNA, 64 nt, Human; identical to SEQ ID NO: 174955

SEQ ID NO: 175310 - RNA, 64 nt, Human; identical to SEQ ID NO: 174956

SEQ ID NO: 175311 - RNA, 64 nt, Human; identical to SEQ ID NO: 174957

SEQ ID NO: 175312 - RNA, 64 nt, Human; identical to SEQ ID NO: 174958

SEQ ID NO: 175313 - RNA, 64 nt, Human; identical to SEQ ID NO: 174959

SEQ ID NO: 175314 - RNA, 64 nt, Human; identical to SEQ ID NO: 174960

SEQ ID NO: 175315 - RNA, 64 nt, Human; identical to SEQ ID NO: 174961

SEQ ID NO: 175316 - RNA, 64 nt, Human; identical to SEQ ID NO: 174962

SEQ ID NO: 175317 - RNA, 64 nt, Human; identical to SEQ ID NO: 174963

SEQ ID NO: 175318 - RNA, 64 nt, Human; identical to SEQ ID NO: 174964

SEQ ID NO: 175319 - RNA, 64 nt, Human; identical to SEQ ID NO: 174965

SEQ ID NO: 175320 - RNA, 64 nt, Human; identical to SEQ ID NO: 174966

SEQ ID NO: 175321 - RNA, 64 nt, Human; identical to SEQ ID NO: 174967

SEQ ID NO: 175322 - RNA, 64 nt, Human; identical to SEQ ID NO: 174968

SEQ ID NO: 175323 - RNA, 64 nt, Human; identical to SEQ ID NO: 174969

SEQ ID NO: 175324 - RNA, 64 nt, Human; identical to SEQ ID NO: 174970

SEQ ID NO: 175325 - RNA, 64 nt, Human; identical to SEQ ID NO: 174971

SEQ ID NO: 175326 - RNA, 64 nt, Human; identical to SEQ ID NO: 174972

SEQ ID NO: 175327 - RNA, 64 nt, Human; identical to SEQ ID NO: 174973

SEQ ID NO: 175328 - RNA, 64 nt, Human; identical to SEQ ID NO: 174974

SEQ ID NO: 175329 - RNA, 64 nt, Human; identical to SEQ ID NO: 174975

SEQ ID NO: 175330 - RNA, 64 nt, Human; identical to SEQ ID NO: 174976

SEQ ID NO: 175331 - RNA, 64 nt, Human; identical to SEQ ID NO: 174977

SEQ ID NO: 175332 - RNA, 64 nt, Human; identical to SEQ ID NO: 174978

SEQ ID NO: 175333 - RNA, 64 nt, Human; identical to SEQ ID NO: 174979

SEQ ID NO: 175334 - RNA, 64 nt, Human; identical to SEQ ID NO: 174980

SEQ ID NO: 175335 - RNA, 64 nt, Human; identical to SEQ ID NO: 174981

SEQ ID NO: 175336 - RNA, 64 nt, Human; identical to SEQ ID NO: 174982

SEQ ID NO: 175337 - RNA, 64 nt, Human; identical to SEQ ID NO: 174983

SEQ ID NO: 175338 - RNA, 64 nt, Human; identical to SEQ ID NO: 174984

SEQ ID NO: 175339 - RNA, 64 nt, Human; identical to SEQ ID NO: 174985

SEQ ID NO: 175340 - RNA, 64 nt, Human; identical to SEQ ID NO: 174986

SEQ ID NO: 175341 - RNA, 64 nt, Human; identical to SEQ ID NO: 174987

SEQ ID NO: 175342 - RNA, 64 nt, Human; identical to SEQ ID NO: 174988

SEQ ID NO: 175343 - RNA, 64 nt, Human; identical to SEQ ID NO: 174989

SEQ ID NO: 175344 - RNA, 64 nt, Human; identical to SEQ ID NO: 174990

SEQ ID NO: 175345 - RNA, 64 nt, Human; identical to SEQ ID NO: 174991

SEQ ID NO: 175346 - RNA, 64 nt, Human; identical to SEQ ID NO: 174992

SEQ ID NO: 175347 - RNA, 64 nt, Human; identical to SEQ ID NO: 174993

SEQ ID NO: 175348 - RNA, 64 nt, Human; identical to SEQ ID NO: 174994

SEQ ID NO: 175349 - RNA, 64 nt, Human; identical to SEQ ID NO: 174995

SEQ ID NO: 175350 - RNA, 64 nt, Human; identical to SEQ ID NO: 174996

SEQ ID NO: 175351 - RNA, 64 nt, Human; identical to SEQ ID NO: 174997

SEQ ID NO: 175352 - RNA, 64 nt, Human; identical to SEQ ID NO: 174998

SEQ ID NO: 175353 - RNA, 64 nt, Human; identical to SEQ ID NO: 174999

SEQ ID NO: 175354 - RNA, 64 nt, Human; identical to SEQ ID NO: 175000

SEQ ID NO: 175355 - RNA, 64 nt, Human; identical to SEQ ID NO: 175001

SEQ ID NO: 175356 - RNA, 64 nt, Human; identical to SEQ ID NO: 175002

SEQ ID NO: 175357 - RNA, 64 nt, Human; identical to SEQ ID NO: 175003

SEQ ID NO: 175358 - RNA, 64 nt, Human; identical to SEQ ID NO: 175004

SEQ ID NO: 175359 - RNA, 64 nt, Human; identical to SEQ ID NO: 175005

SEQ ID NO: 175360 - RNA, 64 nt, Human; identical to SEQ ID NO: 175006

SEQ ID NO: 175361 - RNA, 64 nt, Human; identical to SEQ ID NO: 175007

SEQ ID NO: 175362 - RNA, 64 nt, Human; identical to SEQ ID NO: 175008

SEQ ID NO: 175363 - RNA, 64 nt, Human; identical to SEQ ID NO: 175009

SEQ ID NO: 175364 - RNA, 64 nt, Human; identical to SEQ ID NO: 175010

SEQ ID NO: 175365 - RNA, 64 nt, Human; identical to SEQ ID NO: 175011

SEQ ID NO: 175366 - RNA, 64 nt, Human; identical to SEQ ID NO: 175012

SEQ ID NO: 175367 - RNA, 64 nt, Human; identical to SEQ ID NO: 175013

SEQ ID NO: 175368 - RNA, 64 nt, Human; identical to SEQ ID NO: 175014

SEQ ID NO: 175369 - RNA, 64 nt, Human; identical to SEQ ID NO: 175015

SEQ ID NO: 175370 - RNA, 64 nt, Human; identical to SEQ ID NO: 175016

SEQ ID NO: 175371 - RNA, 63 nt, Human; identical to SEQ ID NO: 175017

SEQ ID NO: 175372 - RNA, 64 nt, Human; identical to SEQ ID NO: 175018

SEQ ID NO: 175373 - RNA, 64 nt, Human; identical to SEQ ID NO: 175019

SEQ ID NO: 175374 - RNA, 64 nt, Human; identical to SEQ ID NO: 175020

SEQ ID NO: 175375 - RNA, 64 nt, Human; identical to SEQ ID NO: 175021

SEQ ID NO: 175376 - RNA, 64 nt, Human; identical to SEQ ID NO: 175022

SEQ ID NO: 175377 - RNA, 64 nt, Human; identical to SEQ ID NO: 175023

SEQ ID NO: 175378 - RNA, 64 nt, Human; identical to SEQ ID NO: 175024

SEQ ID NO: 175379 - RNA, 64 nt, Human; identical to SEQ ID NO: 175025

SEQ ID NO: 175380 - RNA, 64 nt, Human; identical to SEQ ID NO: 175026

SEQ ID NO: 175381 - RNA, 64 nt, Human; identical to SEQ ID NO: 175027

SEQ ID NO: 175382 - RNA, 64 nt, Human; identical to SEQ ID NO: 175028

SEQ ID NO: 175383 - RNA, 64 nt, Human; identical to SEQ ID NO: 175029

SEQ ID NO: 175384 - RNA, 64 nt, Human; identical to SEQ ID NO: 175030

SEQ ID NO: 175385 - RNA, 64 nt, Human; identical to SEQ ID NO: 175031

SEQ ID NO: 175386 - RNA, 64 nt, Human; identical to SEQ ID NO: 175032

SEQ ID NO: 175387 - RNA, 64 nt, Human; identical to SEQ ID NO: 175033

SEQ ID NO: 175388 - RNA, 64 nt, Human; identical to SEQ ID NO: 175034

SEQ ID NO: 175389 - RNA, 64 nt, Human; identical to SEQ ID NO: 175035

SEQ ID NO: 175390 - RNA, 64 nt, Human; identical to SEQ ID NO: 175036

SEQ ID NO: 175391 - RNA, 64 nt, Human; identical to SEQ ID NO: 175037

SEQ ID NO: 175392 - RNA, 64 nt, Human; identical to SEQ ID NO: 175038

SEQ ID NO: 175393 - RNA, 64 nt, Human; identical to SEQ ID NO: 175039

SEQ ID NO: 175394 - RNA, 64 nt, Human; identical to SEQ ID NO: 175040

SEQ ID NO: 175395 - RNA, 64 nt, Human; identical to SEQ ID NO: 175041

SEQ ID NO: 175396 - RNA, 64 nt, Human; identical to SEQ ID NO: 175042

SEQ ID NO: 175397 - RNA, 64 nt, Human; identical to SEQ ID NO: 175043

SEQ ID NO: 175398 - RNA, 64 nt, Human; identical to SEQ ID NO: 175044

SEQ ID NO: 175399 - RNA, 64 nt, Human; identical to SEQ ID NO: 175045

SEQ ID NO: 175400 - RNA, 64 nt, Human; identical to SEQ ID NO: 175046

SEQ ID NO: 175401 - RNA, 64 nt, Human; identical to SEQ ID NO: 175047

SEQ ID NO: 175402 - RNA, 64 nt, Human; identical to SEQ ID NO: 175048

SEQ ID NO: 175403 - RNA, 64 nt, Human; identical to SEQ ID NO: 175049

SEQ ID NO: 175404 - RNA, 64 nt, Human; identical to SEQ ID NO: 175050

SEQ ID NO: 175405 - RNA, 64 nt, Human; identical to SEQ ID NO: 175051

SEQ ID NO: 175406 - RNA, 64 nt, Human; identical to SEQ ID NO: 175052

SEQ ID NO: 175407 - RNA, 64 nt, Human; identical to SEQ ID NO: 175053

SEQ ID NO: 175408 - RNA, 64 nt, Human; identical to SEQ ID NO: 175054

SEQ ID NO: 175409 - RNA, 64 nt, Human; identical to SEQ ID NO: 175055

SEQ ID NO: 175410 - RNA, 64 nt, Human; identical to SEQ ID NO: 175056

SEQ ID NO: 175411 - RNA, 64 nt, Human; identical to SEQ ID NO: 175057

SEQ ID NO: 175412 - RNA, 64 nt, Human; identical to SEQ ID NO: 175058

SEQ ID NO: 175413 - RNA, 64 nt, Human; identical to SEQ ID NO: 175059

SEQ ID NO: 175414 - RNA, 64 nt, Human; identical to SEQ ID NO: 175060

SEQ ID NO: 175415 - RNA, 64 nt, Human; identical to SEQ ID NO: 175061

SEQ ID NO: 175416 - RNA, 64 nt, Human; identical to SEQ ID NO: 175062

SEQ ID NO: 175417 - RNA, 64 nt, Human; identical to SEQ ID NO: 175063

SEQ ID NO: 175418 - RNA, 64 nt, Human; identical to SEQ ID NO: 175064

SEQ ID NO: 175419 - RNA, 64 nt, Human; identical to SEQ ID NO: 175065

SEQ ID NO: 175420 - RNA, 64 nt, Human; identical to SEQ ID NO: 175066

SEQ ID NO: 175421 - RNA, 64 nt, Human; identical to SEQ ID NO: 175067

SEQ ID NO: 175422 - RNA, 64 nt, Human; identical to SEQ ID NO: 175068

SEQ ID NO: 175423 - RNA, 64 nt, Human; identical to SEQ ID NO: 175069

SEQ ID NO: 175424 - RNA, 64 nt, Human; identical to SEQ ID NO: 175070

SEQ ID NO: 175425 - RNA, 64 nt, Human; identical to SEQ ID NO: 175071

SEQ ID NO: 175426 - RNA, 64 nt, Human; identical to SEQ ID NO: 175072

SEQ ID NO: 175427 - RNA, 64 nt, Human; identical to SEQ ID NO: 175073

SEQ ID NO: 175428 - RNA, 64 nt, Human; identical to SEQ ID NO: 175074

SEQ ID NO: 175429 - RNA, 64 nt, Human; identical to SEQ ID NO: 175075

SEQ ID NO: 175430 - RNA, 64 nt, Human; identical to SEQ ID NO: 175076

SEQ ID NO: 175431 - RNA, 64 nt, Human; identical to SEQ ID NO: 175077

SEQ ID NO: 175432 - RNA, 64 nt, Human; identical to SEQ ID NO: 175078

SEQ ID NO: 175433 - RNA, 64 nt, Human; identical to SEQ ID NO: 175079

SEQ ID NO: 175434 - RNA, 64 nt, Human; identical to SEQ ID NO: 175080

SEQ ID NO: 175435 - RNA, 64 nt, Human; identical to SEQ ID NO: 175081

SEQ ID NO: 175436 - RNA, 64 nt, Human; identical to SEQ ID NO: 175082

SEQ ID NO: 175437 - RNA, 64 nt, Human; identical to SEQ ID NO: 175083

SEQ ID NO: 175438 - RNA, 64 nt, Human; identical to SEQ ID NO: 175084

SEQ ID NO: 175439 - RNA, 64 nt, Human; identical to SEQ ID NO: 175085

SEQ ID NO: 175440 - RNA, 64 nt, Human; identical to SEQ ID NO: 175086

SEQ ID NO: 175441 - RNA, 64 nt, Human; identical to SEQ ID NO: 175087

SEQ ID NO: 175442 - RNA, 64 nt, Human; identical to SEQ ID NO: 175088

SEQ ID NO: 175443 - RNA, 64 nt, Human; identical to SEQ ID NO: 175089

SEQ ID NO: 175444 - RNA, 64 nt, Human
cugccuggucuccacaguagccucccugcccgggucccagcacccuggaugcccgucucugucc

SEQ ID NO: 175445 - RNA, 64 nt, Human
gugaacagugaaggcguuugugaggucuuucuggucccagcaugaaauaaagccuuggccuggg

SEQ ID NO: 175446 - RNA, 64 nt, Human
cguaucaggccagcaugguggcucaugccuguaaucccagcauuuugggaggcucaggcagaca

SEQ ID NO: 175447 - RNA, 64 nt, Human
cacccgcggggcaccucccuggccacacgccuguucccagcaagugcugaaacucacuagaccg

SEQ ID NO: 175448 - RNA, 64 nt, Human
aaaaaagaccgggugugguggcucacaccuguaaucccagcacuuugggaggccuaagugggug

SEQ ID NO: 175449 - RNA, 64 nt, Human
agauucaaccgggugugguggcucacgccuguaaucccagcacauugggaggccaaggcaggug

SEQ ID NO: 175450 - RNA, 64 nt, Human
uuuucaggccgggcacuguggcucacgccuguaaucccagcacuuugggagaccgaggcaggug

SEQ ID NO: 175451 - RNA, 64 nt, Human
ugcuuaucuucccccaccuucuacaugguauuagucccagcaggcaucccuggggcagacgugc

SEQ ID NO: 175452 - RNA, 64 nt, Human
gcuuguacagaagagacaguccaaggggacuggaucccagcagugauguugguugaggcagcaa

SEQ ID NO: 175453 - RNA, 64 nt, Human
accucaggccaggugcaguggcucacgccuaugaucccagcacuuugggaggcugaggcgggug

SEQ ID NO: 175454 - RNA, 64 nt, Human
uuuagaggcugggcaugguggcucacgcuuguaaucccagcacuuugggaggccaaggugggug

SEQ ID NO: 175455 - RNA, 64 nt, Human
ggacggguacuccagcuccaggccuggagaggcuucccagcaacaccugcaguccagccccccu

SEQ ID NO: 175456 - RNA, 64 nt, Human
gugaauauuguggcucccugggggcggccagcccucccagcaguggcuugcuuucuucuccugu

SEQ ID NO: 175457 - RNA, 64 nt, Human
acugugggccgggcgcgguggcucacgccuggaaucccagcacuuugggaagccgaggugggca

SEQ ID NO: 175458 - RNA, 64 nt, Human
auagccgugaucaagaugagcacggaggcucgugucccagcaccuggcacacaguaagugccug

SEQ ID NO: 175459 - RNA, 64 nt, Human
aggccaagggacaguggucuaauucaacucugugucccagcaccuggcacaccagaagugccau

SEQ ID NO: 175460 - RNA, 64 nt, Human
ugguggggggucuggcaccaucucauugcuuuaaucccagcaacacagguggcagcuucucccc

SEQ ID NO: 175461 - RNA, 64 nt, Human
aaaccgggccaagcgcaguggcucacaccucuaaucccagcacuuugggaggcugagguaggug

SEQ ID NO: 175462 - RNA, 64 nt, Human
cuccaaagugacauauggagggaacuuuagcacuucccagcacagccagaauugcauccucugg

SEQ ID NO: 175463 - RNA, 64 nt, Human
auaaggggccgggugcaguggcucacaccuguaaucccagcacuuugggaggccaaggugagug

SEQ ID NO: 175464 - RNA, 64 nt, Human
acgguccaaaucucauaaacuagccuucucaaaaucccagcaauauaaagcacuguuuuucuuc

SEQ ID NO: 175465 - RNA, 64 nt, Human
caaauguccauagggagcagguggcagccucuacucccagcaacaaguuuguguucucuccuuu

SEQ ID NO: 175466 - RNA, 64 nt, Human
aaauugggcccggcgcgauggcucacgccuguaaucccagcacuuuuggaggccgaggcaggcg

SEQ ID NO: 175467 - RNA, 64 nt, Human
gugaccggcugggcaugguggcucacaccuguaaucccagcacuuugggaggccaaggcaggca

SEQ ID NO: 175468 - RNA, 64 nt, Human
gagaaaagugauggaaugacuucugcaacuguagucccagcaggaacugugaagaccagcugcc

SEQ ID NO: 175469 - RNA, 64 nt, Human
cugggaggccgggcaugguggcucaugccuguaaucccagcauuuugagaggcugaggcgggug

SEQ ID NO: 175470 - RNA, 64 nt, Human
ucauuaggccaggcgugguggcucaugcuuguaaucccagcacuuugguaggcugagguaggug

SEQ ID NO: 175471 - RNA, 64 nt, Human
uuuucuggccgggcgugguagcucaugccuguaaucccagcacuuugggaggcugaggcaggcg

SEQ ID NO: 175472 - RNA, 64 nt, Human
cgggggucugauauggccaucacaggcuggguguucccagcagcccuggcuugggggcuugacg

SEQ ID NO: 175473 - RNA, 64 nt, Human
cugcccaggcugugcagcgcagcuggacucugcaucccagcaccugccuccucguuccuuucuc

SEQ ID NO: 175474 - RNA, 64 nt, Human; identical to SEQ ID NO: 175473

SEQ ID NO: 175475 - RNA, 64 nt, Human; identical to SEQ ID NO: 175473

SEQ ID NO: 175476 - RNA, 64 nt, Human
uauuugccaggggcacgaugugacauaucugcagucccagcacagugggacaaaaagaauuuag

SEQ ID NO: 175477 - RNA, 64 nt, Human
aaaauuggccgggcgcagcggcucacgccuguaaucccagcacuuucggaggcagaggcaggcg

SEQ ID NO: 175478 - RNA, 64 nt, Human
uccucaaggacucagaaaccaggcucgaggccuaucccagcaagugcugcucugcucugcccac

SEQ ID NO: 175479 - RNA, 64 nt, Human
gagccugaaaacuguuuucacuggguuccaccagucccagcaaaauccucuuuguauuuauuuu

SEQ ID NO: 175480 - RNA, 64 nt, Human
aggagaggcagcaugcuugggcugacccagcaucucccagcaagaccucaucuguggagcugcc

SEQ ID NO: 175481 - RNA, 64 nt, Human
uuaaaaggccgggcgcgguggcucacgccuguaaucccagcacuuugggaggccaaggugggcg

SEQ ID NO: 175482 - RNA, 64 nt, Human
aauacuggggccugcccucagcaucccccauagcucccagcagccccagggugaucucaaagua

SEQ ID NO: 175483 - RNA, 64 nt, Human
ugcuuuuucugggugcgguggcucaugccuguaaucccagcacuuugggaggccgaggcaggug

SEQ ID NO: 175484 - RNA, 64 nt, Human
gccgaguugugcacuuugggguagagugaggggcucccagcagcucuagcugggucucucuugc

SEQ ID NO: 175485 - RNA, 64 nt, Human
cuaugcggcccggcaugguggcucacaccuguaaucccagcacuuugggaggccaaggugggug

SEQ ID NO: 175486 - RNA, 61 nt, Human
uggggcuggcagccaugugaagaaaggaggcucccagcaucaucuuccuacacauuauuac

SEQ ID NO: 175487 - RNA, 52 nt, Human
acucugauaccuccaacugaucucccagcaaucgcaucccggcugacccugu

SEQ ID NO: 175488 - RNA, 64 nt, Human
uugcuaccaaggaccagcagggagaaaugucuucucccagcagugaauucuguuaugcaauuua

SEQ ID NO: 175489 - RNA, 64 nt, Human
uuauguugauacaaaagaccuuggcagccauuucucccagcaguuuuaaaggaugaacauugga

SEQ ID NO: 175490 - RNA, 64 nt, Human
uucuagguccuuagaacugcccagaaacucugagucccagcagcugggagccagaacuuugccu

SEQ ID NO: 175491 - RNA, 64 nt, Human
caauuccaccaggugcaguggcucaugccuguaaucccagcacuucaggaggccgagguggaca

SEQ ID NO: 175492 - RNA, 64 nt, Human
cagaacagaucuaaccaugcauugcuagcucugcucccagcaucccuuccccuucucuccuccu

SEQ ID NO: 175493 - RNA, 64 nt, Human
gcucccggccgggcgcgguggcucacgccuguaaucccagcacuuugggaggccgaggcgggca

SEQ ID NO: 175494 - RNA, 64 nt, Human
cuugccagccaggcgugguggaucacgccuguaaucccagcacucugggaggccaaagcgggca

SEQ ID NO: 175495 - RNA, 64 nt, Human
uaggcaggccaggugcaguggcucaugccuguaaucccagcauuuugguaggccgaggagggca

SEQ ID NO: 175496 - RNA, 64 nt, Human
acacauggccaggcgcgguggcucacacccguaaucccagcacuuugcggggccgaggcagggg

SEQ ID NO: 175497 - RNA, 64 nt, Human
cggccuccccgaccugcagccccagacucugcucucccagcacugacucacuccugccugggag

SEQ ID NO: 175498 - RNA, 64 nt, Human
cauuggagagcugucuuccuguguaccucuagaaucccagcagcagagaaccaucaaggcggga

SEQ ID NO: 175499 - RNA, 64 nt, Human
cuauuucgccaggcacgguggcucaugccuauaaucccagcacuuugggaggccaaggugggug

SEQ ID NO: 175500 - RNA, 64 nt, Human
aguuuaggcugggcgugguggcucacgccuguaaucccagcacuuugggaggccgagguaggca

SEQ ID NO: 175501 - RNA, 64 nt, Human
ccuuaaggcugggugcaguggcucacgccuguaaucccagcacuuugggaggcugaggcgggug

SEQ ID NO: 175502 - RNA, 64 nt, Human
cccuucugauuuggcccccugcccgcuuggagccucccagcaccagacagggcagguuugggga

SEQ ID NO: 175503 - RNA, 64 nt, Human
cugcuggcgcugaccacacagcuccuuccuccucucccagcacuggcacgaagugcucccugua

SEQ ID NO: 175504 - RNA, 64 nt, Human
aagccaggccgagcguguuggcucacgcuuguaaucccagcacuuugggaggccgaggcgggug

SEQ ID NO: 175505 - RNA, 64 nt, Human
gugauuggccaggcgcaguggcucacgccuguaaucccagcacugggaggccgaggggggcgga

SEQ ID NO: 175506 - RNA, 64 nt, Human
auggcaggcugggcgcgguggcucacgccuguaaucccagcacuuugggaggccaaggugggcg

SEQ ID NO: 175507 - RNA, 64 nt, Human
gcacacagcugagcacuuagcaggcaccgccacgucccagcaucccuggagcaggagccccgcc

SEQ ID NO: 175508 - RNA, 64 nt, Human
ggacguggccaggcacgguggcucaugccuguaaucccagcacuuugggaggccgaggcaggcg

SEQ ID NO: 175509 - RNA, 64 nt, Human
aggcccggcugggcgugguggcucacaccuguaaucccagcacuuugggaggccgaggcgggcg

SEQ ID NO: 175510 - RNA, 64 nt, Human
ccacuggaggcacaccugcuauaccucaugccuuucccagcagccacugaacucccccauccca

SEQ ID NO: 175511 - RNA, 64 nt, Human
uugggggagugggcgcaguggcucacaccuguaaucccagcacuuugggaggccgaggugggca

SEQ ID NO: 175512 - RNA, 64 nt, Human
ccaggccucccacgguuggugcuggcuccuuggcucccagcagccgcugaccauagccagcaaa

SEQ ID NO: 175513 - RNA, 64 nt, Human
cagagcucccaguggacaugucagagacaacacuucccagcaucugagaccaaacugcagaggg

SEQ ID NO: 175514 - RNA, 64 nt, Human
gauuggggccaggcgcaguggcucacgccuguaaucccagcacuuugggaggcugaggcgggug

SEQ ID NO: 175515 - RNA, 64 nt, Human
uucuaacagaggaaacaaaugguccagcagucguucccagcagaacagcggagccuggacugac

SEQ ID NO: 175516 - RNA, 64 nt, Human
acugggggcccagcagagccugcucccacccuccucccagcagcagacacccacccucucacug

SEQ ID NO: 175517 - RNA, 64 nt, Human
ucuccugcagaaagggccacccaugauacuccacucccagcagcucaaccuacccugguccagu

SEQ ID NO: 175518 - RNA, 64 nt, Human
gguggaggucaggcacgguggcucacgcuuguaaucccagcacuuugggaggccgaggugggua

SEQ ID NO: 175519 - RNA, 64 nt, Human
gugugagucgccccagaucaccagcccggccugcucccagcagcccuaaggaucucucaggagc

SEQ ID NO: 175520 - RNA, 64 nt, Human
cggaaggucuugucaaaagagugcugggcaccacucccagcauuucuggcacguuagauuuggg

SEQ ID NO: 175521 - RNA, 64 nt, Human
uuuuuaggcugggcaugguggcucacaccuguaaucccagcacuuugagaggccgaggugagac

SEQ ID NO: 175522 - RNA, 64 nt, Human
aacgaggcugggcgcaguggccucaugccuauaaucccagcacuuuggaaggcugaggcagaag

SEQ ID NO: 175523 - RNA, 64 nt, Human
acuugaauugggaacuuuggagucuugucucccaucccagcacauugaggauguaguuggugaa

SEQ ID NO: 175524 - RNA, 64 nt, Human
aggauuggccgggcgcgguggcucacgccuguaaucccagcacuuugggaggccgaggcgggug

SEQ ID NO: 175525 - RNA, 64 nt, Human
acccuuggccuggcacagugguucacaccuguaaucccagcacuuugggaggccuaggcaggca

SEQ ID NO: 175526 - RNA, 64 nt, Human
acccaguaguuaaaaaucaacucauugccuguaaucccagcacuuugggaggccgagacgggug

SEQ ID NO: 175527 - RNA, 64 nt, Human
caguuucaaucuucugcauauggcuagccaguaaucccagcaccauuuauuaaauggggacuuc

SEQ ID NO: 175528 - RNA, 64 nt, Human
ccaaaguguggggauuacaggugcgagcuacugcucccagcaagagccaagauuuuaaccuaga

SEQ ID NO: 175529 - RNA, 64 nt, Human
gugaaaucugcccgggcacaccucaugccuguaaucccagcacucugggaggccaaggcagaug

SEQ ID NO: 175530 - RNA, 64 nt, Human
uauuucauccgggcgcaguggcucacaccuguaaucccagcacuuugggaggccgaggugggca

SEQ ID NO: 175531 - RNA, 64 nt, Human
uuuuuaaaauuagccugguggcucacgccuguaaucccagcacuuugggaggccgagguggcca

SEQ ID NO: 175532 - RNA, 64 nt, Human
aaauuaggccgggcaugguggcucacgccuguaaucccagcacuuugggaggcccaggugggcg

SEQ ID NO: 175533 - RNA, 64 nt, Human
augguacaaagaagcagaaguguaauuuuccuuuucccagcaugacgaaaaauuggaguucugc

SEQ ID NO: 175534 - RNA, 64 nt, Human
cucagaaaagaacuguuuauaccacucaccuuucucccagcauguacucacugugggcagaugc

SEQ ID NO: 175535 - RNA, 64 nt, Human
auccauggccgggcuugguggcucacgccuguaaucccagcacuuugggaggcugaggugggca

SEQ ID NO: 175536 - RNA, 64 nt, Human
uccagccacccucacuccugccaugugccugcacucccagcaugccaugcagucaucuuccccu

SEQ ID NO: 175537 - RNA, 64 nt, Human
cccgcaggcugggcgcuguggcucacgccuguaaucccagcacuuugggagggcaaggcaggcg

SEQ ID NO: 175538 - RNA, 64 nt, Human
ggagucaagauaucuggguucucacucuacucagucccagcagagcuguuguauaaccuugauu

SEQ ID NO: 175539 - RNA, 64 nt, Human
uaggccucuaaucuucuguuucuguuuaccagcuucccagcaacuuuccuuuuuuaaaauauua

SEQ ID NO: 175540 - RNA, 64 nt, Human
cucucgggccaggcgcuguggcucacaccuauaaucccagcacuuuaggaggccgaggcaggcg

SEQ ID NO: 175541 - RNA, 50 nt, Human
gcuguggcucacgccuauaaucccagcacuuugggaggccaaggcaggcg

SEQ ID NO: 175542 - RNA, 64 nt, Human
cuccuugggaaccccaguccugagcuugguuucuucccagcacccagagaauccuuccucagcu

SEQ ID NO: 175543 - RNA, 64 nt, Human
gguauucccagauacuucuuccuccugccccuuuucccagcagcucugagaccagauguuggcu

SEQ ID NO: 175544 - RNA, 64 nt, Human
acucugggcuggguggaguggcucauaccuguaaucccagcacuuugggaggcuacggugggca

SEQ ID NO: 175545 - RNA, 64 nt, Human
uuuguacaacaggaaaaugccucaaagccuugcuucccagcaaccuggggcugguucccagugc

SEQ ID NO: 175546 - RNA, 64 nt, Human
caugguauugccagccucacuggucagccucgccucccagcaggucgcgggucaucaguggucc

SEQ ID NO: 175547 - RNA, 64 nt, Human
gcaugcucuggggaggcggcucuggcucuugccuucccagcaugcccuuuacuacaaagggcua

SEQ ID NO: 175548 - RNA, 64 nt, Human
gcaugcucuagagaggcggcucuggugccccuccucccagcaugcucuggggaggcggcucugg

SEQ ID NO: 175549 - RNA, 64 nt, Human
gcacgcucuggggaggcggcucuggugcccauccucccagcaugcucuagagaggcggcucugg

SEQ ID NO: 175550 - RNA, 64 nt, Human
gcaugcucuagagaggcggcucuggugcccauccucccagcacgcucuggggaggcggcucugg

SEQ ID NO: 175551 - RNA, 64 nt, Human
aagugcaguccuuggagauguacugguguccgucucccagcaugcucuagagaggcggcucugg

SEQ ID NO: 175552 - RNA, 64 nt, Human
uuuuugggcuggaugugguagcuuacaccuauaaucccagcacuuugggaggcugaggugagag

SEQ ID NO: 175553 - RNA, 64 nt, Human
ccucaagaacuccagagucaccugucucaucggcucccagcaagugccucuuugucuaugaugu

SEQ ID NO: 175554 - RNA, 64 nt, Human
gugggaggaaggggaaagggcugggccucaccgcucccagcaacugaaaggacaacacuaucug

SEQ ID NO: 175555 - RNA, 64 nt, Human
cugcccacuccugcgcuuuucaucgccauuccauucccagcagcuuuggagaccuccaggauua

SEQ ID NO: 175556 - RNA, 64 nt, Human
gcugccuuugucccaucacccagcccugccucccucccagcagcccugggccacagcccccgcc

SEQ ID NO: 175557 - RNA, 64 nt, Human
uuggugagccgggcguggugggucacgccuguaaucccagcacuuugggaggccaaggcggguu

SEQ ID NO: 175558 - RNA, 64 nt, Human
guccugagccagccgugguggcucacaccuguaaucccagcacuuugggaggcugaggcaggug

SEQ ID NO: 175559 - RNA, 64 nt, Human
uuuuuuggccgggcaugguggcucaugccuguaaucccagcacuuggggaggccaaggcaggcg

SEQ ID NO: 175560 - RNA, 64 nt, Human
guucuaggccgggcgcgguggcucacgccuguaaucccagcacuuugggaggcugaggcgggug

SEQ ID NO: 175561 - RNA, 64 nt, Human
ucugacagcugggcgugguugcucacgccuguaaucccagcacuuugggaggcugaggugggcg

SEQ ID NO: 175562 - RNA, 64 nt, Human
ucauuuggccgggcgcgguggcucaugccuguaaucccagcacuuugggaggccgaggcaggug

SEQ ID NO: 175563 - RNA, 64 nt, Human
cuaauccucauggcacaguggcucacgccuguaaucccagcacuugggaggacaaugugggugg

SEQ ID NO: 175564 - RNA, 64 nt, Human
aauuguggccgggugcaauggcucaugccuguaaucccagcacuuugggaggcugagaugggag

SEQ ID NO: 175565 - RNA, 64 nt, Human
gcagguguccuuuccccucucugccccugaucacucccagcacuccccuugccuuccccugucu

SEQ ID NO: 175566 - RNA, 64 nt, Human
uuucagcuuuucucccugauauauccauuuugcuucccagcacuuuuuaggaguagugagagca

SEQ ID NO: 175567 - RNA, 64 nt, Human
ucacacacuugucugugcuaugauguaugcaggaucccagcauugauacccaaugacaaacuau

SEQ ID NO: 175568 - RNA, 64 nt, Human
agcaaaccgugccuucuggcucugcgccccauauucccagcaucauagacauccaacagcacca

SEQ ID NO: 175569 - RNA, 64 nt, Human
acaugcggcugggcgugguggcucaugccuguaaucccagcacuuugggaggcugaggugggca

SEQ ID NO: 175570 - RNA, 64 nt, Human
aguugaggccgggcacgguggcucacgccuguaaucccagcacuuuggaaggccgaggcaggcg

SEQ ID NO: 175571 - RNA, 64 nt, Human
aauuuaggcugggcgcaguggcucacgccuguaaucccagcacuuugggaggccaaggcaaacg

SEQ ID NO: 175572 - RNA, 64 nt, Human
ccucagggacaacauuuuugguguauuugagcccucccagcaaguuucaccuuggguuuguauu

SEQ ID NO: 175573 - RNA, 64 nt, Human
aaauggggcugagugcaguggcucaugccuguaaucccagcacuuagggugccaauguggauua

SEQ ID NO: 175574 - RNA, 64 nt, Human
uugaccuagccagcgcaguggcucaugccuguaaucccagcacuuugggaggcugaggcgggcg

SEQ ID NO: 175575 - RNA, 64 nt, Human
aacgugggcugggcaugguggcucaugccuguaaucccagcacucugggaggcugaggugggcg

SEQ ID NO: 175576 - RNA, 64 nt, Human
cauuuucaggccgggcacgguggcucaccuguaaucccagcacuuugggaggccaaggcgggca

SEQ ID NO: 175577 - RNA, 64 nt, Human
gcaguaggcccggugugguggcucacgccuauaaucccagcacuuugggaggcugaagugggug

SEQ ID NO: 175578 - RNA, 64 nt, Human
augaaaggccaggcaugguggcucaugccuguaaucccagcacuuugggaggccgaggcaggug

SEQ ID NO: 175579 - RNA, 64 nt, Human
aauacuggccaggugcaguggcucaugccuguaaucccagcacuaugggaggcugaggcgggca

SEQ ID NO: 175580 - RNA, 64 nt, Human
aagucaggccgggcgugguggcucacaccuguaaucccagcacacugggaggccgaggcagggg

SEQ ID NO: 175581 - RNA, 64 nt, Human
gaagcuggcugggcgcgguggcucacgccuguaaucccagcacuuugagagaccgaggcgggcg

SEQ ID NO: 175582 - RNA, 64 nt, Human
ggugaucaggaaucaaaccagcaucggaaagacuucccagcaccaagcuugagcugugucguuu

SEQ ID NO: 175583 - RNA, 64 nt, Human
aagaaaagccgggugcgguggcucaggccuguaaucccagcacuuugggaggccaagaugggcg

SEQ ID NO: 175584 - RNA, 64 nt, Human
gggaccugugagcccucccggagguggacccccuucccagcaccucugcgagagauccggggac

SEQ ID NO: 175585 - RNA, 64 nt, Human
aaaaggggcagggcacgguggcucacgccuguaaucccagcacuuugggaggccaaggugggcg

SEQ ID NO: 175586 - RNA, 64 nt, Human
agcuacucucuuucuacauauggcuagccaguuuucccagcaccauuuauuaaauagggaaucc

SEQ ID NO: 175587 - RNA, 64 nt, Human
ccaaaaggcugggcguaguggcucacaccuguaaucccagcacuuugggaggccaaggagggca

SEQ ID NO: 175588 - RNA, 64 nt, Human
gaaaguagccacguaugguggcucaugucuauaaucccagcacuuugggagguugaggugggag

SEQ ID NO: 175589 - RNA, 64 nt, Human
uucagcuuugggaccaaagggauuguugacguuuucccagcaaucuuaaucucaugacuauguu

SEQ ID NO: 175590 - RNA, 64 nt, Human
cuaugggaccuggcgcaguggcucaugcuuguaaucccagcacuuugggaggccgaggugggca

SEQ ID NO: 175591 - RNA, 64 nt, Human
auuuggagccgggcgcaguggcucacgccuguaaucccagcacuuugggaggccaaggugggug

SEQ ID NO: 175592 - RNA, 64 nt, Human
cggccauucaaggggagccaaaaucucaagaaauucccagcagguuaccuggaggcggaucauc

SEQ ID NO: 175593 - RNA, 64 nt, Human
ugucuaggcugggugcggugacucacgccugaaaucccagcacuuuggguggcugaggcaggug

SEQ ID NO: 175594 - RNA, 64 nt, Human
aaagaucucuuccuuucuggagcuccuuuaaucuucccagcagguuuuugccuuagacgugcug

SEQ ID NO: 175595 - RNA, 64 nt, Human
gacacacaggccuggcaggcaggacuccuugugcucccagcagcucagacagggaaaggauagu

SEQ ID NO: 175596 - RNA, 64 nt, Human
gagacaaagcaauaauaaaaggaaguguuuguaaucccagcacuuugggaggccgaggugggcg

SEQ ID NO: 175597 - RNA, 64 nt, Human
uguagaauaguguuugucaacugucuuuucucugucccagcacaugccguacucuuauauguac

SEQ ID NO: 175598 - RNA, 64 nt, Human
guuggaggccuacuaauuucccuguagggaagacucccagcacuucuggaacugugcuucucuu

SEQ ID NO: 175599 - RNA, 64 nt, Human
cugugccuuccuccccgccuccucccacugggacucccagcagagcccaccagccagcccuggc

SEQ ID NO: 175600 - RNA, 64 nt, Human
agucagcaggaggcugccggaacaacagcggcuuucccagcaaccccaaauucuggcugcgggu

SEQ ID NO: 175601 - RNA, 64 nt, Human
gcucaggugacuggagcccgagggccugacagguucccagcagcugggccggccagccuugcac

SEQ ID NO: 175602 - RNA, 64 nt, Human
acuauuggcugggagugguggcucaugccuguaaucccagcacuuggagaggcugagguugcgc

SEQ ID NO: 175603 - RNA, 64 nt, Human
uucuugguuuuaagcugucuaccuaauugcugucucccagcagacugguggcaugcccaguggc

SEQ ID NO: 175604 - RNA, 64 nt, Human
uuucauacagaaugggaaacauaauccucagguaucccagcaucucuuguugaauugaagauua

SEQ ID NO: 175605 - RNA, 64 nt, Human
gaaccuucaugaccuuaucaacuuuacacccauaucccagcaaaugccacucauccccacucuu

SEQ ID NO: 175606 - RNA, 64 nt, Human
cccuuagggccauuucuaacaaagccuuggccacucccagcacaauuuggagugucaaggguga

SEQ ID NO: 175607 - RNA, 64 nt, Human
gagaccggcugggugugguggcucacgccuguaaucccagcacuuugggaggccgaggugggca

SEQ ID NO: 175608 - RNA, 64 nt, Human
uuugggggcugggugccguggcucacgccuguaaucccagcauuuugggaggcugaggugggca

SEQ ID NO: 175609 - RNA, 64 nt, Human
caguauggccagacgugguggcucacaccugcaaucccagcaccuuaggaggccgaggcaggag

SEQ ID NO: 175610 - RNA, 64 nt, Human
gugaagccacccugggcuacagaaaccacagucuucccagcaauuauuacaauucuugaauucc

SEQ ID NO: 175611 - RNA, 64 nt, Human
cgaaggcugggcacugcugugggacagccagucuucccagcagacacccuguguccuccuucag

SEQ ID NO: 175612 - RNA, 64 nt, Human
cauucugagcuggacaugguggcucagcuucuaaucccagcacuuugguaggcaaaggugggag

SEQ ID NO: 175613 - RNA, 64 nt, Human
caguuacagggguuguuuuuaaagaaaaaaacaaucccagcaggagggauugcugggauuguuu

SEQ ID NO: 175614 - RNA, 64 nt, Human
aacuuuggcugggcaugguggcucacgccuguaaucccagcacuuugggaggccauggcgggug

SEQ ID NO: 175615 - RNA, 64 nt, Human
uugacuggcugggugcgguggcucacgcuuguaaucccagcacuuugggaggcugaggcaggcg

SEQ ID NO: 175616 - RNA, 64 nt, Human
agcagcuccuaaacaagagaauaaaaaugggccaucccagcacuuauaaggggagcacaucuug

SEQ ID NO: 175617 - RNA, 64 nt, Human
augauuagccaggcacgguggcugacaccuguaaucccagcacuuugggaggccaagguggggg

SEQ ID NO: 175618 - RNA, 64 nt, Human
ucagccuucagcuccugggagucccagcuguuguucccagcaacgucgccacugcccuccuacu

SEQ ID NO: 175619 - RNA, 64 nt, Human
agaccgggcuggagggugaccuuggcugugugcgucccagcaaaagagcucuggcccgcaucuc

SEQ ID NO: 175620 - RNA, 64 nt, Human
aagguaggccgggcaugguggcucaugccuguaaucccagcacuuugggaggcugagacgggug

SEQ ID NO: 175621 - RNA, 64 nt, Human
cuuguaggccgggagugguggcuuacaccuguaaucccagcacuuugggaggccgaggcaggug

SEQ ID NO: 175622 - RNA, 64 nt, Human
uauuaaggcuggaagcuguggcucacaccuguaaucccagcauuuugggaggcugaagugagag

SEQ ID NO: 175623 - RNA, 64 nt, Human
uccucccugaccuccccaugcccuccccagccucucccagcacaaguggggcaaagccagcaug

SEQ ID NO: 175624 - RNA, 64 nt, Human
cccagaccagggcaggggacaggucucaaguccuucccagcauacacacagggaacaaacacau

SEQ ID NO: 175625 - RNA, 64 nt, Human
ggcccggggaccugugccacacgaccagcugugcucccagcagaggcugugcgugucaguucuu

SEQ ID NO: 175626 - RNA, 64 nt, Human
cugagaucccggggcugggcagucgccccccacuucccagcagcucugugguaguggggcggga

SEQ ID NO: 175627 - RNA, 64 nt, Human
acuuuagaagaaaauccugagcuuuccuguccauucccagcauccagcuccuauucuagugccu

SEQ ID NO: 175628 - RNA, 64 nt, Human
aaauaaaccugggugcgguggcucacaccuguaaucccagcacuuugggaggccgaugugggca

SEQ ID NO: 175629 - RNA, 64 nt, Human
ccuuuuggccgggcaugguagcucaagccuauaaucccagcauguugagaggcugaggugggca

SEQ ID NO: 175630 - RNA, 64 nt, Human
uccauuaauucauaaguuuuaaagggcauggugcucccagcaccagaaaacuaucaguguuuuu

SEQ ID NO: 175631 - RNA, 64 nt, Human
guacugggcuggcuguggugacucaugccuguaaucccagcacuuugggaggcugaggugggag

SEQ ID NO: 175632 - RNA, 64 nt, Human
gaagggaaguaaguauucaggggguaaacaggucucccagcauucugaguguuccaaaccagua

SEQ ID NO: 175633 - RNA, 64 nt, Human
gguuuggggcugagaugagugauccugccucuggucccagcauccagcugccucguugucuauc

SEQ ID NO: 175634 - RNA, 64 nt, Human
aguaggugagaugaucagacaccggaguucaacgucccagcagucuugguaaaaggagggagcc

SEQ ID NO: 175635 - RNA, 64 nt, Human
aagcggggccaggcgcgguggcucgugccuguaaucccagcacuuugggaggcugaggcgggug

SEQ ID NO: 175636 - RNA, 64 nt, Human
cuuaaacccccaccacuccccgacacuauugccuucccagcauggcuggagugggaagaggcuu

SEQ ID NO: 175637 - RNA, 64 nt, Human
uuaauaggccgggcuugguggcucaugccuguaaucccagcacuuugagaggccgaagcgagug

SEQ ID NO: 175638 - RNA, 64 nt, Human
ugacaccugucuacccagagccagugacugucccucccagcagccuccaaaggguccaaagucc

SEQ ID NO: 175639 - RNA, 64 nt, Human
agucccugucucccccacagagaccugugggugcucccagcagaguugagacuggcuccguuga

SEQ ID NO: 175640 - RNA, 64 nt, Human
gcugaaauggaagucagaagugagugaccuguuuucccagcaacucacccucuuccaucuccaa

SEQ ID NO: 175641 - RNA, 64 nt, Human
ugucguggccgggcgcaguggcucacgccuguaaucccagcacuuugggaggccgaggugggug

SEQ ID NO: 175642 - RNA, 64 nt, Human
agugugggcugggcgugggggcucaugccuguaaucccagcacuuugggaggccgaggugggca

SEQ ID NO: 175643 - RNA, 64 nt, Human
augguagagaguuugacuuuuaugccagaaacuuucccagcaagguagggugcugagaauccua

SEQ ID NO: 175644 - RNA, 64 nt, Human
cauaagggcugggggugguggcucaugccuguaaucccagcacuuugggaggccgaggcgggcg

SEQ ID NO: 175645 - RNA, 64 nt, Human
ugaauaggccaggcgcaguggcucacaccuguaaucccagcacguugggaggccaaggcgggca

SEQ ID NO: 175646 - RNA, 64 nt, Human
ggaagccaccugcucuuuugcucuagcaccugggucccagcaucuagagcauggagccucuaga

SEQ ID NO: 175647 - RNA, 64 nt, Human
auuuaaggccaggcauggugguuuacgccuauaaucccagcauuuugggaguccgaggugggca

SEQ ID NO: 175648 - RNA, 64 nt, Human
aaaaucagccagucaugguggccuacaccuguagucccagcauuccgggaggcugaggugggag

SEQ ID NO: 175649 - RNA, 64 nt, Human
ccuccccauucgcauggccgcccaagaggcuggcucccagcauguccucgcucaacuccuuggc

SEQ ID NO: 175650 - RNA, 64 nt, Human
uuuuuuuuuuuuuuuuuuugcuaugcacaguuccucccagcaaccuucccucucugaccaaugg

SEQ ID NO: 175651 - RNA, 64 nt, Human
aaaguaaacuauuuagaauguaguuuuguuauauucccagcauuucaauauuuauuaguuacuu

SEQ ID NO: 175652 - RNA, 64 nt, Human
caucugggccgggcaugguggcucacgccuguaaucccagcacucugggaggucgaggugggug

SEQ ID NO: 175653 - RNA, 64 nt, Human
uuccuuggacgggugcgguggcucacgucuguaaucccagcacuuugggaggcugagacaggug

SEQ ID NO: 175654 - RNA, 64 nt, Human
agauccaccccacccccagacucaucccacucucucccagcauuuugucugggaagagagacua

SEQ ID NO: 175655 - RNA, 64 nt, Human
ucccaucagggcugccaaagcugggcuuuguuuuucccagcagaaugaugccauucucacaaac

SEQ ID NO: 175656 - RNA, 64 nt, Human
aaauaaggccagguguggugacucacacuuguaaucccagcaauuugggaggcugagacaggag

SEQ ID NO: 175657 - RNA, 64 nt, Human
uaaauaaauaaucgacucaaaaauaagucaugugucccagcauaaggcaucagguuguuagaug

SEQ ID NO: 175658 - RNA, 64 nt, Human
cagccaucgggcauuaauugauuuccuacuauauucccagcagacacauuuagaaacuaagcua

SEQ ID NO: 175659 - RNA, 64 nt, Human
aaaauaggccaggcacaguggcucacaccuguaaucccagcacuuugggaggccgaggugggcg

SEQ ID NO: 175660 - RNA, 64 nt, Human
uggcagcucaucaggcgcagggccccagacagcuucccagcaggcccuagagcccggccugggc

SEQ ID NO: 175661 - RNA, 64 nt, Human
uagcuaggcugggugugguggcucaugccuguaaucccagcacuuugggaggcugaugugggcg

SEQ ID NO: 175662 - RNA, 64 nt, Human
acuugaaacaaccugaucacugaagccaacuuugucccagcacauuccuuaaguccuaauuggg

SEQ ID NO: 175663 - RNA, 64 nt, Human
aguucaggccgggcgcaguggcucaugccuguaaucccagcacuuugagaggccaaggcaggug

SEQ ID NO: 175664 - RNA, 64 nt, Human
agcuuucuucuauccccagacccacaugggagucucccagcaccucugacucagcuuggccaau

SEQ ID NO: 175665 - RNA, 64 nt, Human
caagagggccgggcgcggugacucacgccuauaaucccagcacuuugggaggccgagaugggug

SEQ ID NO: 175666 - RNA, 64 nt, Human
aacuuuggccgggcacgguggcucacaccuauaaucccagcacuaugggaggcugaggcaagca

SEQ ID NO: 175667 - RNA, 64 nt, Human
uaaaggggccgggugugguggcucacaccuguaaucccagcacuuugggaggccgaagugggug

SEQ ID NO: 175668 - RNA, 64 nt, Human
acccaccagguuaucccaugcaggccuauguggaucccagcaacccuaaugcuggaaaggugcu

SEQ ID NO: 175669 - RNA, 64 nt, Human
uugccaggccgggcacgguggcucacgccuauaaucccagcacuuugggaggccgaggcaggcg

SEQ ID NO: 175670 - RNA, 64 nt, Human
augaaccuggccucccggggagcugagacuagggucccagcacagcccagaaaccuuuggccac

SEQ ID NO: 175671 - RNA, 64 nt, Human
aguuacauaaaaagugugaaagaacacugugaggucccagcaacgccagacuauauuaagguaa

SEQ ID NO: 175672 - RNA, 64 nt, Human
aauucuaggccggugcgguggcucaugccuguaaucccagcacuguaggcggccgaggugggug

SEQ ID NO: 175673 - RNA, 64 nt, Human
gcuuugggccaggugcgguggcucaugccuguaaucccagcacuaugggaggccagggagggag

SEQ ID NO: 175674 - RNA, 64 nt, Human
agaucuaaugaggaggcacagaccagugucuggaucccagcaucuucuccacuucagcgcugag

SEQ ID NO: 175675 - RNA, 64 nt, Human
gauuguaauucugccuuuuuggaagaauuuuuucucccagcauguuagcugagaauauucucua

SEQ ID NO: 175676 - RNA, 64 nt, Human
ccaaguguggucuuucagcuucaguguguuagcaucccagcaccugggaugggguuugugggca

SEQ ID NO: 175677 - RNA, 64 nt, Human
auaccaccccagcccugcccuuggccucacuuuuucccagcaauaagugggguucaccacccgc

SEQ ID NO: 175678 - RNA, 64 nt, Human
aucucuacucuuuuugguuaggacacuagguucuucccagcauaugagugagaauauugguggu

SEQ ID NO: 175679 - RNA, 64 nt, Human
aguuuuauuuuccagccaggcgcaguggcucaaaucccagcacuucgggaggcuaaggcaggcg

SEQ ID NO: 175680 - RNA, 64 nt, Human
aagcuaagcugggugcaguggcucaugccaguuaucccagcacuuugggaggccgaggugggca

SEQ ID NO: 175681 - RNA, 64 nt, Human
aaauagggccgggcgcgguggcucacgccuguaaucccagcacuuugggaggccgaagcaggcg

SEQ ID NO: 175682 - RNA, 64 nt, Human
cuuuuuggcugggcagaguggcuuacaccuauaaucccagcaauuugggaggccaaggugggca

SEQ ID NO: 175683 - RNA, 64 nt, Human
gcgggggccgcagacugggagcucccgguccgccucccagcaucccugcgagcguucauggggu

SEQ ID NO: 175684 - RNA, 64 nt, Human
auaaagggccaggcacaguggcucacaccuguaaucccagcacuuugggaggcugaggcaggag

SEQ ID NO: 175685 - RNA, 64 nt, Human
guuuguggccgggcgcgguggcucacgccuguaaucccagcacuuugggaggccgaggccggug

SEQ ID NO: 175686 - RNA, 64 nt, Human
gagucaggcuucucuugcuaccugugagcauccuucccagcagacauccucaucgggcuuuguc

SEQ ID NO: 175687 - RNA, 64 nt, Human
cgugagccacaaauaccagaaacugaggcgaggcucccagcagccgguagggaaagguguuucc

SEQ ID NO: 175688 - RNA, 64 nt, Human
gguugcugagccaguggcugccccgugcccuccuucccagcacuaucaugugucacguuucccg

SEQ ID NO: 175689 - RNA, 64 nt, Human
gucaauagccaggcauaguggcucacgccuguaaucccagcacuuuaggaggccaaggcgggug

SEQ ID NO: 175690 - RNA, 64 nt, Human
auaauuggccuggugugguggcccacgccuguaaucccagcacuuugggaggccgagguaggug

SEQ ID NO: 175691 - RNA, 64 nt, Human
uaacaggcugggugcaauggcucacaccuguuaaucccagcacuucgggaggccaaggugggca

SEQ ID NO: 175692 - RNA, 64 nt, Human
gggguaggccgggugcaguggcucacgccuguaaucccagcacuuugggaggccgaggcgagug

SEQ ID NO: 175693 - RNA, 64 nt, Human
uauugauuggauugacuuuuuugcauuaaauuuuucccagcaaaauaaaucauauggcgaguca

SEQ ID NO: 175694 - RNA, 64 nt, Human
aauccaggccaggugugguggcucaugccuguaaucccagcacuuugagaggccgaggugggca

SEQ ID NO: 175695 - RNA, 64 nt, Human
agugggaaggacuaaagacugagccccagagugcucccagcaaccgccacguacaaggucugaa

SEQ ID NO: 175696 - RNA, 64 nt, Human
guacucggucagguaugacggcucacgccuguaaucccagcacuuugggaggccgaaacaggcg

SEQ ID NO: 175697 - RNA, 64 nt, Human
cuuguaggcugagcgcgguggcucacgccuguaaucccagcacuuugggaggccaaggugggug

SEQ ID NO: 175698 - RNA, 64 nt, Human
auagagggccaggugugguggcucacgccugugaucccagcacuuugggaggccaagacgggcg

SEQ ID NO: 175699 - RNA, 64 nt, Human
ucugucucccagccuuucuucucucuuugugugcucccagcacuuccuucuuuucuaacauggc

SEQ ID NO: 175700 - RNA, 64 nt, Human
uuccauuuuauuaaaaaaaaaaaauugccuguaaucccagcacuucaggaggccgagaugggca

SEQ ID NO: 175701 - RNA, 64 nt, Human
acuugcccaacggcacagcugauuggugcucgacucccagcaugcauauuuuguuguaaaaacc

SEQ ID NO: 175702 - RNA, 64 nt, Human
gaaauaggccauggacgguggcucacgccuguaaucccagcacuuuaggaggccaagguaggug

SEQ ID NO: 175703 - RNA, 64 nt, Human
aauuuguaguccugaauaucccagugguggggguucccagcauugugggugcuacuugcaaggc

SEQ ID NO: 175704 - RNA, 64 nt, Human
uaaauaggccaggcaugguggcucacgccugugaucccagcacuuugggaggccgaggugggug

SEQ ID NO: 175705 - RNA, 64 nt, Human
uaauuuggccaggcacaguggcucaugccuguaaucccagcacuuugagaggccaaggugggua

SEQ ID NO: 175706 - RNA, 64 nt, Human
uuucucagccaggcgugguuacucacaccuguaaucccagcacuuugggaguccaaggugggcg

SEQ ID NO: 175707 - RNA, 64 nt, Human
acugugagccgggcaugguggcuuacaucuguaaucccagcacuuugggaggcugagggggugg

SEQ ID NO: 175708 - RNA, 64 nt, Human
uuguauuccaucucugagauauguggucuugaccucccagcaugaagugugcauggcuuugaga

SEQ ID NO: 175709 - RNA, 64 nt, Human
cacaagucauuagugaaaguggucuuuuauguccucccagcagacagacaucaaggaugaguua

SEQ ID NO: 175710 - RNA, 64 nt, Human
aaacuagguugggcaugguggcucacaccuauaaucccagcacuuugggaggcagaggagggag

SEQ ID NO: 175711 - RNA, 64 nt, Human
aaucuuagcccggcgcaguggcucacgucuguaaucccagcacuuugggaggcugaggcgggca

SEQ ID NO: 175712 - RNA, 64 nt, Human
acccguccuagcgccacugccaagcacaccucgcucccagcacaccacagcccgcgaccucagg

SEQ ID NO: 175713 - RNA, 64 nt, Human
aauuuuggcuggucgcgguggcucacgccuguaaucccagcacuuugggaggccgaggcgggcg

SEQ ID NO: 175714 - RNA, 64 nt, Human
ucuuuugggcugguguggcagcuuaugucuauaaucccagcacuuuugagaggccaaggcagga

SEQ ID NO: 175715 - RNA, 64 nt, Human
ucuaaacacacaaguagauugaucuaaggcaugcucccagcauuuguccacccacuuaguccac

SEQ ID NO: 175716 - RNA, 64 nt, Human
agagcaggccaggcgcgguggcucacgccuguaaucccagcacuuugggaggcugaggcgggug

SEQ ID NO: 175717 - RNA, 64 nt, Human
aggucuggccaggcgaagugacucacaccugcaaucccagcacuuugggaggccgaggcgggcg

SEQ ID NO: 175718 - RNA, 64 nt, Human
agaauuggccaggcaugguggcucaugccuguaaucccagcacuuugggaggccaagguaggca

SEQ ID NO: 175719 - RNA, 64 nt, Human
acauuaggucaggcaugguggcucaggccuguaaucccagcauuuugggaggcugaggcaagug

SEQ ID NO: 175720 - RNA, 64 nt, Human
aaaguaggcugggcgcgguggcucacgccuguaaucccagcacuuugggaggcugagaagggcg

SEQ ID NO: 175721 - RNA, 64 nt, Human
ugcuugggucucuucgagccauauuuauaguuggucccagcauuccagacuucugguaaauugu

SEQ ID NO: 175722 - RNA, 64 nt, Human
uuacauaugccggcgcaguggcucauguguguaaucccagcacucugggaggcugagacaggua

SEQ ID NO: 175723 - RNA, 64 nt, Human
aaaauuagccgggcgcgguggcucacaccuguaaucccagcacuuugggagguggaggcgggug

SEQ ID NO: 175724 - RNA, 64 nt, Human
cugccgggccaggcgcgguggcucacgccuguaaucccagcacuuuggcaggccgaggcaggug

SEQ ID NO: 175725 - RNA, 64 nt, Human
cuuauaggcugggccagguggcucccaccuguagucccagcacuuugggaggcaaaggcgggag

SEQ ID NO: 175726 - RNA, 64 nt, Human
uuuuugaggcugggcgcagugacucacaccuguaucccagcaauuugggaggccgaggugggca

SEQ ID NO: 175727 - RNA, 64 nt, Human
cuaagcagcaugcauuaauugaaccuuaaaauguucccagcaggcuggucucaaacugcugacu

SEQ ID NO: 175728 - RNA, 64 nt, Human
acacucggcugggcacaguggcucacaccuguaaucccagcacuuugggaggcugaggcaggca

SEQ ID NO: 175729 - RNA, 64 nt, Human
agcaggucugccgaccaccagcaccauccucuccucccagcagccuccagaaccaugcccaggu

SEQ ID NO: 175730 - RNA, 64 nt, Human
cuuugaggcagggcucaguggcucauuccuguaaucccagcacuuugggaggccaaggcgggca

SEQ ID NO: 175731 - RNA, 64 nt, Human
ugccauggccgggugcaguggcucacgccuauaaucccagcacuuugggaggccgaggcgggcg

SEQ ID NO: 175732 - RNA, 64 nt, Human
cagggccuagaccucccaagggcugugcuccugcucccagcagcccucucuuagaauauuucag

SEQ ID NO: 175733 - RNA, 64 nt, Human
ccaggcucaagcaauccuucacucaugccuguaaucccagcacguugggaggccgaggcgggug

SEQ ID NO: 175734 - RNA, 64 nt, Human
cugggagugaggcucagagaaguugagggaccugucccagcaucacauggcugaugacaagugg

SEQ ID NO: 175735 - RNA, 64 nt, Human
agugcuucugggcccagcuaaggaagccaucuguucccagcagaggagagcugcugcgcugacc

SEQ ID NO: 175736 - RNA, 64 nt, Human
gagagcugcugcgcugaccugcagagguugguggucccagcacagagcugugcccaugggcuug

SEQ ID NO: 175737 - RNA, 64 nt, Human
aaccagggccgggugucguggcucacgccugucaucccagcacuuugggaggccgaggcaggag

SEQ ID NO: 175738 - RNA, 64 nt, Human
uuaagaggcugggugcgguggcucacgucuguaaucccagcaccuugggaggcccaggcaggca

SEQ ID NO: 175739 - RNA, 64 nt, Human
ucugguggccgggcgcgguggcucaaaccuguaaucccagcacuuugggaggccgaggugggug

SEQ ID NO: 175740 - RNA, 64 nt, Human
gugauuggccaggugcaguggcucacaccuguaaucccagcacuuugggaggccaaagugggug

SEQ ID NO: 175741 - RNA, 64 nt, Human
caaauucaugcaaaguccuuucccgaugcguggcucccagcagaggccguaaauugagcguuca

SEQ ID NO: 175742 - RNA, 64 nt, Human
gggcacccuggugcuucccagacccuguggagccucccagcaccaacuugcuuaauguguuuuu

SEQ ID NO: 175743 - RNA, 64 nt, Human
gacaaaggcugggugcaguggcucaugccuauaaucccagcacuuugggaggccaaggugggcg

SEQ ID NO: 175744 - RNA, 64 nt, Human
auuugaggccgggugugguggcucacgccuguaaucccagcacuuugggaggcucaggugggcg

SEQ ID NO: 175745 - RNA, 64 nt, Human
agagucuaaagguggccgggugugguggcuuuaaucccagcacuuugggaagccgaggugggcg

SEQ ID NO: 175746 - RNA, 64 nt, Human
gggaggccauuccccuucuacucaccgacaucccucccagcaccacacaccccgccccugaaag

SEQ ID NO: 175747 - RNA, 64 nt, Human
aaaauuggccgggcguggugggucacgccgguaaucccagcacuuugggaggccgaggcgggca

SEQ ID NO: 175748 - RNA, 64 nt, Human
acuuaugacugggugcgguggcucacaccuguaaucccagcacuuugggaggcugaggcgggcg

SEQ ID NO: 175749 - RNA, 64 nt, Human
gaaaucuugcuagugaagacguauuuuuucuucuucccagcagccaggcuagcaccaguucugg

SEQ ID NO: 175750 - RNA, 64 nt, Human
cccuuccucaaggaauuaacuugugcaagcugacucccagcacaucaaagaaugcaauuaacug

SEQ ID NO: 175751 - RNA, 64 nt, Human
cauuuaaaauaugcauuauuuaauuuaaucuuacucccagcaccaaaagguaauugaccagccu

SEQ ID NO: 175752 - RNA, 64 nt, Human
auuccagaucaggcaugguggcuuacaccuguaaucccagcacuuuggaaggcugagguguggg

SEQ ID NO: 175753 - RNA, 64 nt, Human
uccuccagccgggcgcgguggcucacgccuguaaucccagcacuuugggaggccgaggcgggcg

SEQ ID NO: 175754 - RNA, 64 nt, Human
cugaaugggcaugcagagccugugucaggccccaucccagcaggccuggguggccacuuucuga

SEQ ID NO: 175755 - RNA, 64 nt, Human
gacauaggcugggcaugguggcucaugccuguaaucccagcacauugggaagaucacuugaggc

SEQ ID NO: 175756 - RNA, 64 nt, Human
aaaauuagcuuggcgugguggugggcgccuguagucccagcagcuugggaggcugaggcuggag

SEQ ID NO: 175757 - RNA, 64 nt, Human
guuuuaguccaggcacaguggcucacgccuguaaucccagcacuuugggaggccgaggugggug

SEQ ID NO: 175758 - RNA, 64 nt, Human
gaguuugcuguauacaaacaggugcuaacacuguucccagcaaaguuuucagauuguaaaggua

SEQ ID NO: 175759 - RNA, 64 nt, Human
ucugacgagaggcuuuuccaccuccagcaaguguucccagcaaccagcuccauccuggcugcuu

SEQ ID NO: 175760 - RNA, 64 nt, Human
aaccuuggccaggcaugguggcucacaccuguaaucccagcacuuugggaggccgaggcaggug

SEQ ID NO: 175761 - RNA, 64 nt, Human
uauuuccauauucuguauuaggagaaaauuacccucccagcaccagccccccucucaaaccccc

SEQ ID NO: 175762 - RNA, 64 nt, Human
gaaguaggccgggcacgguggcucacgccuguaaucccagcaugcugagauuacaggugugagc

SEQ ID NO: 175763 - RNA, 64 nt, Human
uugagcaucuguacauauccuucaccacccccagucccagcaccugugucaguaaagaaagugg

SEQ ID NO: 175764 - RNA, 64 nt, Human
aguuuuggccgggugcgguggcucacgccuguaaucccagcacuuugggaggccgaggcgggcg

SEQ ID NO: 175765 - RNA, 64 nt, Human
agccuuucucaguguccguggcauuuuugugacuucccagcacuagaauaaguuuuccugccaa

SEQ ID NO: 175766 - RNA, 64 nt, Human
aagagaggccaggcgugguggcucacuccuguaaucccagcacuuugggaagccaaggugggcu

SEQ ID NO: 175767 - RNA, 64 nt, Human
caucugcucuucccguuccccuuaaggagguagcucccagcacucaaccaaccuccccgcagag

SEQ ID NO: 175768 - RNA, 64 nt, Human
ggggccugggcucccccucucugugccagcggcuucccagcaccugggaggggcugcagcccca

SEQ ID NO: 175769 - RNA, 64 nt, Human
gcccaguagcaguggagcaggcccuguccugcccucccagcaauaaccaccucccuggaggcca

SEQ ID NO: 175770 - RNA, 64 nt, Human
uggacaggccaggcaugguggcucaugccuguaaucccagcacuuugggaggcugagguaggug

SEQ ID NO: 175771 - RNA, 64 nt, Human
caucucaggacagcagugacgagguuucugauugucccagcacagccuugucccaggacccuug

SEQ ID NO: 175772 - RNA, 64 nt, Human
auugcuggccgggcgcgguggcucacgccuguaaucccagcacuuugggaggccaaggcgggca

SEQ ID NO: 175773 - RNA, 64 nt, Human
gccccccacccgcagccggccacacuggagcagcucccagcacagccuuacgcgcccgacgcgc

SEQ ID NO: 175774 - RNA, 64 nt, Human
cauacagaccaggcgugguggcucaugccuauaaucccagcacuuugggaggcuaagacaggca

SEQ ID NO: 175775 - RNA, 64 nt, Human
cuuuuaggcugggugcaguggcucacaccuguaaucccagcacuuugggaggccaaggcgagcg

SEQ ID NO: 175776 - RNA, 64 nt, Human
aagauaguccggacgcgguggcacaugccuguaaucccagcacuuugggaggcugaggcaggug

SEQ ID NO: 175777 - RNA, 64 nt, Human
auaaagguccaggcauaguggcucuugccuguaaucccagcacuuugggaggccgaggcaggug

SEQ ID NO: 175778 - RNA, 64 nt, Human
aauaccagcugggcacgguggcucacgccuguaaucccagcacuuacuuugggaggccaaggug

SEQ ID NO: 175779 - RNA, 64 nt, Human
aacaucucaggccacucauuaccuucgcucaugaucccagcagccauuuuucuuaacaccuucu

SEQ ID NO: 175780 - RNA, 64 nt, Human
ggaacuccugcacaaguuuuaacugaacaagaaaucccagcaaaaggcauuuuuuuuucuacuu

SEQ ID NO: 175781 - RNA, 64 nt, Human
uggaauaaacuugugguuguccuuuaacuggaggucccagcacauguguuuucaagaggccacu

SEQ ID NO: 175782 - RNA, 64 nt, Human
aaacauggccaggcgcaguggcucaugccuguaaucccagcacuuugggaggccgaggugggca

SEQ ID NO: 175783 - RNA, 64 nt, Human
uguccgggcuggucacagugguucaugccuguaaucccagcacuuugggaguccaaggcaggca

SEQ ID NO: 175784 - RNA, 64 nt, Human
gucaugggcuaggcaugguggcucacaccuguaaucccagcauuuugggaagcuaagaugggug

SEQ ID NO: 175785 - RNA, 64 nt, Human
ggcucagcaggggaggcugcuacggcugcccacuucccagcaccgucugucacgcuugaacccc

SEQ ID NO: 175786 - RNA, 64 nt, Human
uugcaucaccuuauaacuguucugucuuguucucucccagcaauuuauuuuaaaacaagggcua

SEQ ID NO: 175787 - RNA, 64 nt, Human
guucuuugggcugggucaaggcaaagcucagucgucccagcagcaccucagccaucuguagaag

SEQ ID NO: 175788 - RNA, 64 nt, Human
uguggcuuccucagcuccugcccuuggccugaagucccagcauugauggcagugccucaucuuc

SEQ ID NO: 175789 - RNA, 64 nt, Human
uguggcuuccucagcuccugcccuuggccugaagucccagcauugauggcagcgccucaucuuc

SEQ ID NO: 175790 - RNA, 64 nt, Human
ggcauuggccuggugcaguggcucauuccuguaaucccagcacuuugggaggccaaggggacag

SEQ ID NO: 175791 - RNA, 64 nt, Human
ucccaggcccuugacauggcuuaccugccuucacucccagcaccuugcccaacaggauaagcug

SEQ ID NO: 175792 - RNA, 64 nt, Human
ucuucugcccaacacugggugccccuucccaguuucccagcaggggcuucaugggccaccguca

SEQ ID NO: 175793 - RNA, 64 nt, Human
uuuuagggaauaauauucaauacacaguacuuccucccagcauugcuacugcucagcuucuucu

SEQ ID NO: 175794 - RNA, 64 nt, Human
agggaccgagucucccaugaaggcagacuccuccucccagcagagcagcaggauccccagccag

SEQ ID NO: 175795 - RNA, 64 nt, Human
gacggugccagggccgcccgcguccucgccagccucccagcagcaggcgcgcccuuccggccgc

SEQ ID NO: 175796 - RNA, 64 nt, Human
aaagcaggccaggcacgguggcucacgccuguaaucccagcauuuugggaggccgaggcaggcg

SEQ ID NO: 175797 - RNA, 64 nt, Human
aaccacggguugaggaagucaggcuguuggcgugucccagcaccacaccaccccuaaagugcca

SEQ ID NO: 175798 - RNA, 64 nt, Human
uucuauuaccuuuaaaaaagaguaguuuugccccucccagcaaccuaagaccagucugaacuca

SEQ ID NO: 175799 - RNA, 64 nt, Human
ucagaucguuaacauggguaacccagcaaauauuucccagcagugacaaucuacacccuuuauc

SEQ ID NO: 175800 - RNA, 64 nt, Human
aauuacggccggacgcaguagcuuacgccuguuaucccagcacuuugggaggucgaggugggca

SEQ ID NO: 175801 - RNA, 64 nt, Human
ugcccucugcuuuuucccccacauuguuugggguucccagcaccucagccacauugcaugcugg

SEQ ID NO: 175802 - RNA, 64 nt, Human
cgaagcggccgggcacgguggcucaugccuguaaucccagcacuuuggggggcugaggugggcg

SEQ ID NO: 175803 - RNA, 64 nt, Human
ugcuauggucuugauacauccucaaacuuucccuucccagcacagaggaauauuggcuggcaug

SEQ ID NO: 175804 - RNA, 59 nt, Human
uucccaagaagcaggagugacuucagucaucccagcaaucgcuugguucaguuucauuc

SEQ ID NO: 175805 - RNA, 64 nt, Human
guuacgaggccauccugcuauuuaucuucugaguucccagcaaugacucaggcaucagagauga

SEQ ID NO: 175806 - RNA, 64 nt, Human
caaugacgccgggcguggaggcucaugccuguaaucccagcacuuugggaggccaaggugggcg

SEQ ID NO: 175807 - RNA, 64 nt, Human
uaauuuuuauagaaucauucauauggaacugaguucccagcaucaucuuauucugaauagcauu

SEQ ID NO: 175808 - RNA, 64 nt, Human
cauugugacuucucugauaaagcgucugaucuaaucccagcacuucuguaaccuucagcauuuc

SEQ ID NO: 175809 - RNA, 64 nt, Human
aguuuugggccagcacgguagcucacccuuguaaucccagcacuuugggaggcugaggugggua

SEQ ID NO: 175810 - RNA, 64 nt, Human
uguaauaaaaaugcacaacauaaaauguuuaugaucccagcaauacacuuuuuaaaaaauguga

SEQ ID NO: 175811 - RNA, 64 nt, Human
auaugcaaucaggcacagugccucaugccuauaaucccagcacuuugggaggccaaggugggug

SEQ ID NO: 175812 - RNA, 64 nt, Human
uaccccggccaggcacgguggcucacgccuguaaucccagcacuuugggagguggguggaucac

SEQ ID NO: 175813 - RNA, 64 nt, Human
uuugacucagcacuguuuucaucacaacuuguuuucccagcaucauguagugcauuuaguuuug

SEQ ID NO: 175814 - RNA, 64 nt, Human
uucuagacagaggaaauccaaaucguuucuuuccucccagcauaagggaacgguccgguaagag

SEQ ID NO: 175815 - RNA, 64 nt, Human
aacacugacccggugcgguggcucaugccuguaaucccagcacuuugggaggccgaggcaggcg

SEQ ID NO: 175816 - RNA, 64 nt, Human
aauuaaggcugggcgcgguggcucacaccuguaaucccagcacuuugagaggaugagguaggcg

SEQ ID NO: 175817 - RNA, 64 nt, Human
ggagagucaaagggcuugcuugccccagcagaguucccagcagacagccauggcucuucccagc

SEQ ID NO: 175818 - RNA, 64 nt, Human
cccagcagaguucccagcagacagccauggcucuucccagcagccugugcaaauucugaugaug

SEQ ID NO: 175819 - RNA, 64 nt, Human
gcaccaggagugggugccagccggccccgaggauucccagcaccccaccuauggucuugccagc

SEQ ID NO: 175820 - RNA, 64 nt, Human
cucagagugcauugcagcucugucagggccccauucccagcagaggcuucaggugcuuugugua

SEQ ID NO: 175821 - RNA, 64 nt, Human
guugagaggauuguuuauuugauuuuuauccucaucccagcaggccuggcuuugugguuaguug

SEQ ID NO: 175822 - RNA, 64 nt, Human
ucucugggccgggcgugguggcucacaccuguaaucccagcaccuugggaggcugaggugggag

SEQ ID NO: 175823 - RNA, 64 nt, Human
uuuccuucuguccuuuuucuccugcuccuuguuuucccagcagcacaugggguuccucggagga

SEQ ID NO: 175824 - RNA, 64 nt, Human
gggauaggcugggugccgugggucacgccuguaaucccagcacuuugggaggcugaggcaggug

SEQ ID NO: 175825 - RNA, 64 nt, Human
ccccccaccagcacaccccguacccugccuggaaucccagcaccagccccccugccucuccucu

SEQ ID NO: 175826 - RNA, 64 nt, Human
aaaaguugacucuccuguggcucaugccacaggaucccagcacuuugggaggccgaggcaggcu

SEQ ID NO: 175827 - RNA, 64 nt, Human
accaguggccaggcaugguggcucaugccuguaaucccagcacuuuucggaggccgaggagggc

SEQ ID NO: 175828 - RNA, 64 nt, Human
aaggaguuggaccaaggcgaauuacgaguccuggucccagcaguaugugugcugacuucugggu

SEQ ID NO: 175829 - RNA, 64 nt, Human
uacacaggccgggcaugguggcucacaccuguaaucccagcacuuugggaggcugaggcggaug

SEQ ID NO: 175830 - RNA, 64 nt, Human
aacugaggccaggugcgguggcucacgccuguaaucccagcacuuugggaggccgaggugagcg

SEQ ID NO: 175831 - RNA, 64 nt, Human
agaccgugcugggcgcgguggcucuugccuguaaucccagcacuuugggaggcugaggcgggca

SEQ ID NO: 175832 - RNA, 64 nt, Human
aauguaggccaggcgcgguggcucaugccuguaaucccagcacuuugggaggccgaggcgggug

SEQ ID NO: 175833 - RNA, 64 nt, Human
uuucugggccgggcaugguggcucaccccuguaaucccagcacuuugggaggccaaggcgggug

SEQ ID NO: 175834 - RNA, 64 nt, Human
guuccaugaagaccacauccacacacgcaggaacucccagcaacacaagcuggaagcacauguu

SEQ ID NO: 175835 - RNA, 64 nt, Human
aaguuuggccgggugcgguggcucacgccuguaaucccagcacuuugggaggccaagguggggg

SEQ ID NO: 175836 - RNA, 64 nt, Human
uuuauuggccgggugcgguggcucaugccuauaaucccagcacuuugggaggccaaggugggca

SEQ ID NO: 175837 - RNA, 64 nt, Human
gcuuuugcugugagaguagccgucacgugucucuucccagcagcgccgggcaagugggugcuag

SEQ ID NO: 175838 - RNA, 64 nt, Human
ucgggccuggguccgccuuaaucuggaaggccccucccagcagcgguaccccagggccuacugc

SEQ ID NO: 175839 - RNA, 64 nt, Human
agauauggccgagcgugauggcucaccccuguaaucccagcacuuugugaggccaaggugggcg

SEQ ID NO: 175840 - RNA, 64 nt, Human
auacagggcugggcacgguggcucacgccuguaaucccagcacuuugggagguugcggguggau

SEQ ID NO: 175841 - RNA, 64 nt, Human
aucaagugcagcacaugggugaugucagaauucuucccagcacaguguucugggcagccaguac

SEQ ID NO: 175842 - RNA, 64 nt, Human
cugcugggcgugguggcucacaccugugaguggcucccagcacuuugagaggccgaggagggag

SEQ ID NO: 175843 - RNA, 64 nt, Human
uaagauggcccggcgcgguggcucccgccuguaaucccagcacuuugggaggccgaggcgggcg

SEQ ID NO: 175844 - RNA, 64 nt, Human
gaugcaagcgacaggaaaggcccucugcuuuucuucccagcaaagguguguggccuuuaguggg

SEQ ID NO: 175845 - RNA, 64 nt, Human
auguguguaccuaggugcuauuuaagccuguaaaucccagcacuuugggaggccagggcgggug

SEQ ID NO: 175846 - RNA, 64 nt, Human
agaauuagccgggcauggucgcucaugccuguaaucccagcacuuugggaggccaaggcaggca

SEQ ID NO: 175847 - RNA, 64 nt, Human
cacccugagccagcccuucccuggacugccggaaucccagcauuagcuuccugcugaauguagu

SEQ ID NO: 175848 - RNA, 64 nt, Human
gaaguuagcugggugugguggcucaugccuguaaucccagcacuuugggggccaaggagggugg

SEQ ID NO: 175849 - RNA, 64 nt, Human
guuaauagccaggcaugguggcucaugccuguaaucccagcacuuugggaggcugaggcgggcg

SEQ ID NO: 175850 - RNA, 64 nt, Human
cugagugaagguguuugaaaugcaggagaggauaucccagcaaauugggaucacaugcuuuugu

SEQ ID NO: 175851 - RNA, 64 nt, Human; identical to SEQ ID NO: 175818

SEQ ID NO: 175852 - RNA, 64 nt, Human; identical to SEQ ID NO: 175817

SEQ ID NO: 175853 - RNA, 64 nt, Human
aagggggcccaggcgagguggcucacaccuguaaucccagcacuuugggaggucgaggugggag

SEQ ID NO: 175854 - RNA, 64 nt, Human
guaugcugggcacgguggugacucaagccuauaaucccagcacuucggaaggcggaggcaggag

SEQ ID NO: 175855 - RNA, 64 nt, Human
gaaagaggccagacauggugucucacacguuuaaucccagcacuuugggaggcaggggcgggug

SEQ ID NO: 175856 - RNA, 64 nt, Human
agggguggccgggcacaguggcucacgccuguaaucccagcacuuugagaggcugaggugguag

SEQ ID NO: 175857 - RNA, 64 nt, Human
ugaccuggccgggcgcgguggcucacgccuguaaucccagcacuuugggaggccgaggcgggug

SEQ ID NO: 175858 - RNA, 64 nt, Human
auaucuuaucagagcucagauuccagauuucacaucccagcagccgguucuggguagcagauca

SEQ ID NO: 175859 - RNA, 64 nt, Human
caaccaggccgggcaugguggcucaugccuguaaucccagcacuuugggaggugaggugggugg

SEQ ID NO: 175860 - RNA, 64 nt, Human
gugaggacacacacuaggcccaaggugccugugcucccagcagguccaagugcagcuccagcca

SEQ ID NO: 175861 - RNA, 50 nt, Human
gugguggcucacgccuauaaucccagcacuuugggaggccaaggcaggca

SEQ ID NO: 175862 - RNA, 64 nt, Human
guguauagccaggugugguggcuuacgccuguaaucccagcagugggagaccgaggugggcaga

SEQ ID NO: 175863 - RNA, 64 nt, Human
cuuugucccgaugcaagcccccucuucgcugggcucccagcagugcuucccuccuccacccucc

SEQ ID NO: 175864 - RNA, 64 nt, Human
guucugggcccagcgcagugccucaugccuguaaucccagcacuuugggaggccaaggugggag

SEQ ID NO: 175865 - RNA, 64 nt, Human
ccauaccacggggcaugguggcucaugccuguaaucccagcacuuugguaggcugaggugggug

SEQ ID NO: 175866 - RNA, 64 nt, Human
gugccuggcugggcgugguggcucacgccuguaaucccagcacuuugggaggccgaggcaggcg

SEQ ID NO: 175867 - RNA, 64 nt, Human
guucuagcccaggagcgguggcucacacuuguaaucccagcacuuugggaugcuaaggcaggcg

SEQ ID NO: 175868 - RNA, 64 nt, Human
guucuaggcggggcgugguggcucacacuuguaaucccagcacuuugggaggccaaggugggcg

SEQ ID NO: 175869 - RNA, 64 nt, Human
gcagcuggccgggugcgguggcucacgccuguaaucccagcacuuugggaggccgaggcgggcg

SEQ ID NO: 175870 - RNA, 64 nt, Human
cuaagcugggugggguggcucacacccgacguaaucccagcacguugggaggccgaggcaggug

SEQ ID NO: 175871 - RNA, 64 nt, Human
cauucaggccaggcacggugacucacgccuguaaucccagcacuuugggaggccgaggcgggug

SEQ ID NO: 175872 - RNA, 64 nt, Human
auuauaggcugggcaugguggcuuacgccuguaaucccagcacuuugggaggccaaggcgggcg

SEQ ID NO: 175873 - RNA, 64 nt, Human
gaagaaccuaaacaugaaaggaaagggugccucaucccagcaaccuguccuugugggugaugau

SEQ ID NO: 175874 - RNA, 64 nt, Human
ccccgcccacauccuccuuccccaggaccugagcucccagcaucugcagacgacccccgcagcc

SEQ ID NO: 175875 - RNA, 64 nt, Human
gagaccaaaggccgcccccgccugcugggguuccucccagcaccccagcuugcuggcugcccuc

SEQ ID NO: 175876 - RNA, 64 nt, Human
uugguugcugcucuggccagggaggcagccccacucccagcaagcagaagugauccucgagggu

SEQ ID NO: 175877 - RNA, 64 nt, Human
gccugaaaacagaggggagggaggaaggaaggagucccagcaggagcacagcccugguuuccug

SEQ ID NO: 175878 - RNA, 64 nt, Human
cuguagcuccccugcugaggcagugugguuauguucccagcagugggggucagacgcccuuccu

SEQ ID NO: 175879 - RNA, 64 nt, Human
guaauggaccaggcgcagugccucacgccugucaucccagcacuuugggaggcugaggcaggcg

SEQ ID NO: 175880 - RNA, 64 nt, Human
ucccuuggccgggcgcgguggcucacaccuguaaucccagcacuuugggaggccaaggcaggcg

SEQ ID NO: 175881 - RNA, 64 nt, Human
guugcuggccaggcauggugacucaugccuguaaucccagcaauuugggagacagaggcggaag

SEQ ID NO: 175882 - RNA, 64 nt, Human
auaaacagccaggcauggugacucaagccuguaaucccagcacuuugggaggccgaggcgggcg

SEQ ID NO: 175883 - RNA, 64 nt, Human
uaugcuggccgggcgcgguggcucacaccuguaaucccagcacuuugggaggccaaugugggug

SEQ ID NO: 175884 - RNA, 64 nt, Human
guaacaggccgggcgcgguggcucacgccuguaaucccagcacuuugggaggcugaggcgggca

SEQ ID NO: 175885 - RNA, 64 nt, Human
gauggaggccaggcacgguaucucaugccuauaaucccagcacuuugggaggcugaggcaguug

SEQ ID NO: 175886 - RNA, 63 nt, Human
ggauugcuauugaggugugaaugcgugcuuguaucccagcagggcauagauaauacguuauua

SEQ ID NO: 175887 - RNA, 64 nt, Human
augagaguagguacagacugcauaagguuuagaaucccagcauaugucugaaacgacgggacuu

SEQ ID NO: 175888 - RNA, 64 nt, Human
cuucaggccaggcccguggcucaugccuguauaaucccagcacuuugggaggccgaggcaggcg

SEQ ID NO: 175889 - RNA, 64 nt, Human
cgagaccuucagcaguugaggcuggggcuaguggucccagcagcccagcccccacccuccuggc

SEQ ID NO: 175890 - RNA, 64 nt, Human
ugcuaccucccagggcaugcagucuggaagggggucccagcaguggagugccgggacccucaga

SEQ ID NO: 175891 - RNA, 64 nt, Human
aacaaaaucauucauaguuccauucacugugcuaucccagcaucucaguccuuccuccaugcag

SEQ ID NO: 175892 - RNA, 64 nt, Human
acuuugggucggaugcaggggcucacaccgguaaucccagcacuuugagaggcugaggcgggaa

SEQ ID NO: 175893 - RNA, 64 nt, Human
uuuuggggccgggcgcgguggcuuaugccuguaaucccagcacuuugggaggccgaggcaggug

SEQ ID NO: 175894 - RNA, 64 nt, Human
agucuaggccgggcacgguggcucacgccuguaaucccagcacuuugggaggccgaggcaugug

SEQ ID NO: 175895 - RNA, 64 nt, Human
ugguccuccagcccuggcaggcccucagccagcuucccagcaagacaaagggcacccuuguggc

SEQ ID NO: 175896 - RNA, 64 nt, Human
guuuuaggccacaugcgguggcucaugccuguaaucccagcacuuugauaggcugaggcaggug

SEQ ID NO: 175897 - RNA, 64 nt, Human
auucuuagccagguguaguggcucaugccuguaaucccagcacuuugggaggcugaggcgggug

SEQ ID NO: 175898 - RNA, 64 nt, Human
aaugcaggccgagcgcgguggcucacgccuguaaucccagcacuuugggaggccgaggcgggcg

SEQ ID NO: 175899 - RNA, 64 nt, Human
ccacguuccaggcagccucgcccgccggcugcgcucccagcacugggguuuggggggagggggg

SEQ ID NO: 175900 - RNA, 64 nt, Human
gagguggcucuugagggaaauggucuggacuuauucccagcacuguuucaggcaagaacuuucc

SEQ ID NO: 175901 - RNA, 64 nt, Human
gucaccucugccuugcccuuuaacucaacccgcuucccagcacagcggcuuucuuuuuaaaacc

SEQ ID NO: 175902 - RNA, 64 nt, Human
gagccgcccugggggccccagaaccagagcuggcucccagcaaggguaggacgggccgcaugcg

SEQ ID NO: 175903 - RNA, 64 nt, Human
gggggcuucccucugcuuguggagugguuggcauucccagcaguaucaacccucagaggagcgg

SEQ ID NO: 175904 - RNA, 64 nt, Human
auguauggcuggacgcgguggcucacgccuguaaucccagcacuuugggaggcugaggcgggug

SEQ ID NO: 175905 - RNA, 64 nt, Human
ccuucaggccagucgugguggcucaugccuguaaucccagcacuuugcaaggccgaggagggug

SEQ ID NO: 175906 - RNA, 64 nt, Human
cuaugcagcugggugcaguggcucacgccuguaaucccagcauuuugggaggcugagguaggcg

SEQ ID NO: 175907 - RNA, 64 nt, Human
uagcccugccaggcacaaugacucacgccuguaaucccagcacuuugggaggcagaggugggug

SEQ ID NO: 175908 - RNA, 64 nt, Human
cauugauguggugaacaaggaucuagugagacucucccagcauguuucuaccaaagcuuuaucu

SEQ ID NO: 175909 - RNA, 51 nt, Human
ucaacuuguucaaguucugaaucccagcacaugacaacacuucagaagggu

SEQ ID NO: 175910 - RNA, 64 nt, Human
aagguaggccgggcacaguggcucaugccuguaaucccagcacuuugggaggcugaggcaggua

SEQ ID NO: 175911 - RNA, 64 nt, Human
gagccacugcagcaggagucgggcccugccucccucccagcagggaaaccccgcccgcugccag

SEQ ID NO: 175912 - RNA, 64 nt, Human
ccccugcgcagacugucagagucauuaagcgggaucccagcaucucagaguccagucaaguucc

SEQ ID NO: 175913 - RNA, 64 nt, Human
ucugugcagacagugucagagucauuaagcgggaucccagcaucucagaguccagucaaguucc

SEQ ID NO: 175914 - RNA, 64 nt, Human
cccuccccuccccuccagggugcccccggcuuucucccagcaauagggucgacgagaccuagaa

SEQ ID NO: 175915 - RNA, 64 nt, Human
uuuguuggccgggcacaguugcucauccauguaaucccagcacugugggaggccgagacgggug

SEQ ID NO: 175916 - RNA, 64 nt, Human
uuucacucuucaaacucccaaacacaugacuucuucccagcagcccuucccggccucuaaaguu

SEQ ID NO: 175917 - RNA, 64 nt, Human
uucccagcagcccuucccggccucuaaaguuuggucccagcagcccuucccagccucuaaaguu

SEQ ID NO: 175918 - RNA, 64 nt, Human
cucuaggaaacaguuuaagaaaucauuggccccuucccagcacauugaauggguaagcagacag

SEQ ID NO: 175919 - RNA, 64 nt, Human
uagcacccagcaugugaccccacuccugaucaggucccagcaucuucccuucuuguucuguucc

SEQ ID NO: 175920 - RNA, 64 nt, Human
ccagcaucuucccuucuuguucuguuccuuaaggucccagcaccuuaccccaggacuuggucuu

SEQ ID NO: 175921 - RNA, 64 nt, Human
uaccaucggccgggugugguggcucaugccuuaaucccagcacuuugggaggucaagaugggag

SEQ ID NO: 175922 - RNA, 64 nt, Human
gaaaagguccggggaugguggcucacaccugaaaucccagcacuuugggaggccgaggcaggaa

SEQ ID NO: 175923 - RNA, 64 nt, Human
uuaauguggugggugcaguggcucacgccuguaaucccagcacuuugggaggcugaggugagug

SEQ ID NO: 175924 - RNA, 64 nt, Human
cuacucggccaggcgcaguggcucaugccuguaaucccagcacuuugggaggccgaggugggug

SEQ ID NO: 175925 - RNA, 64 nt, Human
caucuguuaaaugagagaauagaguaugguugauucccagcauucagugguccugucaagcaac

SEQ ID NO: 175926 - RNA, 64 nt, Human
auccuuggccuggcgcgguggcucacaccuguaaucccagcacuuuuggaggccaaggugggug

SEQ ID NO: 175927 - RNA, 64 nt, Human
gagauaauugauucagggguuuucucucccagucucccagcagggacugauuucauuucugacc

SEQ ID NO: 175928 - RNA, 64 nt, Human
acaacaggcugggcgcaguggcucacaccuguaaucccagcacuuugggaggcugaggcgggug

SEQ ID NO: 175929 - RNA, 64 nt, Human
uccgugagcuccgugcacuucaccaaagcccccaucccagcacacaggacccguguguaugaga

SEQ ID NO: 175930 - RNA, 62 nt, Human
auuucccugcgcugucuugaaagagcccuguuucccagcaccgcggagcugcacugcacacc

SEQ ID NO: 175931 - RNA, 64 nt, Human
gaaauugcuaacaaagcacuuuuggacaaugcuaucccagcaggaaaaaaaaggauaauauaac

SEQ ID NO: 175932 - RNA, 64 nt, Human
uuacugaccagucaagagaauuucucaagaaaaaucccagcaacguucccucuuuccuccuugu

SEQ ID NO: 175933 - RNA, 64 nt, Human
gaaacuggcuggguaugguggcucaugccuauaaucccagcacuuugggaggccgaggugggca

SEQ ID NO: 175934 - RNA, 64 nt, Human
acucuuggccaggugugguggcucaugccuauaaucccagcacuuugggaggccaaggcaggug

SEQ ID NO: 175935 - RNA, 64 nt, Human
guccagggccggacacaguggcccaugccuguaaucccagcacuuuggggggccaaggcaggcu

SEQ ID NO: 175936 - RNA, 64 nt, Human
uagaaaucucagcaugagcugcuauagaauacccucccagcaacaaaaccuaaucaguaaggcc

SEQ ID NO: 175937 - RNA, 64 nt, Human
cuuaggugccgucucuagucugugagggaggaacucccagcauccccauugcccacaaauggaa

SEQ ID NO: 175938 - RNA, 64 nt, Human
agagcacagggaccaggccuugguuaggcugagcucccagcaggacaccgccugcagaaaggac

SEQ ID NO: 175939 - RNA, 64 nt, Human
gagcugaugcuaaagaagacagacuuucccuuccucccagcagcagcagugcagagcccaccug

SEQ ID NO: 175940 - RNA, 64 nt, Human
caagcaggccaggcacgguggcucacgccuauaaucccagcacuuagggaggccaaggcgggca

SEQ ID NO: 175941 - RNA, 64 nt, Human
auggcccuaggaggcccucugaggagagcuagagucccagcaaagggugcagcugacccuagca

SEQ ID NO: 175942 - RNA, 64 nt, Human
ugcauagacauuuggcugugaugguaggauggacucccagcagguaugggacaggugccaggug

SEQ ID NO: 175943 - RNA, 64 nt, Human
gccaagcugcuagaagaugcugcugucccugugaucccagcagcccucccuucaccgugacccc

SEQ ID NO: 175944 - RNA, 64 nt, Human
cugugguggcauuggccgagggucuucgggugcuucccagcacaagcugcccuugcuguccugu

SEQ ID NO: 175945 - RNA, 64 nt, Human
gcccugggugggggacacucagagugggagcacaucccagcagugcccauguagcaggagcaca

SEQ ID NO: 175946 - RNA, 64 nt, Human
caccaccuccugcacugcacuucugccguccacaucccagcacacuggcgaccugacuagcagc

SEQ ID NO: 175947 - RNA, 64 nt, Human
acagucccuccacugugaacaagcuuuugcagcuucccagcacgaccauugaaaauaucucugu

SEQ ID NO: 175948 - RNA, 64 nt, Human
cggagggagaaaggcccagggcaguggggacgggucccagcaccucggagcccccuucacacgc

SEQ ID NO: 175949 - RNA, 64 nt, Human
aaaauaggccgggcguggugacuugcaccuauaaucccagcacuuugggaggcagaggugggag

SEQ ID NO: 175950 - RNA, 64 nt, Human
cuuccaggccgggcacaguggcucacgccuguaaucccagcacuuugggaggccgaggcgggcg

SEQ ID NO: 175951 - RNA, 64 nt, Human
cauuaaggccaagugcaguggcucacaccgguaaucccagcacuuugggaggccgaggugggag

SEQ ID NO: 175952 - RNA, 64 nt, Human
auucagaggaaaaacagaggaugcugaaguacagucccagcacauuuccucucuaucuuuuuuu

SEQ ID NO: 175953 - RNA, 64 nt, Human
uguauagaaucuuacagcaucuuugacaaacaucucccagcaaaagugccgguuagucagguuu

SEQ ID NO: 175954 - RNA, 64 nt, Human
aguggagaggaagcagugaccuggccagcacugcucccagcacugcgcaccaggucaggaggac

SEQ ID NO: 175955 - RNA, 64 nt, Human
uugccaguagugccuucaucaguuaagggaggugucccagcacagaucauucucaaaagcgagc

SEQ ID NO: 175956 - RNA, 64 nt, Human
gucuucucuucugccaacuaacgugcucgcgcccucccagcacguggagagcuucaauugucag

SEQ ID NO: 175957 - RNA, 64 nt, Human
gugaccgggcagagcccaacccccuccacgggggucccagcacccacuuuucuaaucaugaaug

SEQ ID NO: 175958 - RNA, 64 nt, Human
uggccuggcugggugcaguggcucacaccugugaucccagcacuuugggaggccaaggcagggg

SEQ ID NO: 175959 - RNA, 64 nt, Human
agacugggccagacgcaguggcucaugccuguaaucccagcacucugggaggcugaggugggcg

SEQ ID NO: 175960 - RNA, 64 nt, Human
gggggaccacccgagcuaaucauggaaugucuguucccagcaaacacgauaaagaaagauugug

SEQ ID NO: 175961 - RNA, 64 nt, Human
cccugagcucuccugcaggguggagggcauuguuucccagcacccaggcagugucuugcuggug

SEQ ID NO: 175962 - RNA, 64 nt, Human
ggaggccaggaugugcagucuccacauaguggcuucccagcaacaacuuuugacuuagaugggg

SEQ ID NO: 175963 - RNA, 64 nt, Human
ugaacuguccucagaagagcagggcuaggacuugucccagcaucugugccuccauaccaauccu

SEQ ID NO: 175964 - RNA, 64 nt, Human
caauugagaccggacacccacagagcuguuguccucccagcaacaagauggugugguuaucuug

SEQ ID NO: 175965 - RNA, 64 nt, Human
uucagggcugggcgcgguggcuaacaccuauaauucccagcacuuugggaggccaagaugggca

SEQ ID NO: 175966 - RNA, 64 nt, Human
ucaccuagagaagucuaagcauaacagcuuucuuucccagcacgagccuuuauagcucucuuua

SEQ ID NO: 175967 - RNA, 64 nt, Human
gggggaggcccaaugagguggcucaugccuguaaucccagcacuuugggaagcugaggcaggag

SEQ ID NO: 175968 - RNA, 64 nt, Human
aaaaaaggccaggugcaguggcucacgccuguaaucccagcacuuuugggaggcugagguuggg

SEQ ID NO: 175969 - RNA, 64 nt, Human
cugcaggccccagccaagugccuuccgugggucaucccagcaccugccagggcccgaccugggg

SEQ ID NO: 175970 - RNA, 64 nt, Human
cuuccuggccgggcgugguggcuccugccuguaaucccagcacuuugggaggccgaggugggcg

SEQ ID NO: 175971 - RNA, 64 nt, Human
gcuucuggcuguggcacgcacuggaucacccaggucccagcagacauggccgcccaaagucagc

SEQ ID NO: 175972 - RNA, 64 nt, Human
cgcagccgcugugggcaggggguguggcaggagcucccagcacuggagacccacggacucaacc

SEQ ID NO: 175973 - RNA, 64 nt, Human
agggcaggccgggcacaguggcucacgccuguaaucccagcacuuugggaggccaaagcaggug

SEQ ID NO: 175974 - RNA, 64 nt, Human
cuccucugacacagggcuggcccgccagguggccucccagcaagccagccuuuuuuguaagcaa

SEQ ID NO: 175975 - RNA, 64 nt, Human
gaacucugcuguccaggcacugcuuggcuuacuaucccagcaaagacugcaguuuuguggacuu

SEQ ID NO: 175976 - RNA, 64 nt, Human
uucagcuuuuaccagccucaguguggaggcuccaucccagcacacaggccuggggcuuggcagg

SEQ ID NO: 175977 - RNA, 64 nt, Human
cauuaaggccgggugggguggcacaugccuguaaucccagcacuuugggaggccaaggcuggug

SEQ ID NO: 175978 - RNA, 64 nt, Human
ugugauggcugggugcaguggcucacgccuguaaucccagcacuuugggaggcuuaggcggcug

SEQ ID NO: 175979 - RNA, 64 nt, Human
aggaucagccgggugcaaugacucaugccuguaaucccagcacguugggaggccaagucgggcg

SEQ ID NO: 175980 - RNA, 64 nt, Human
aaaacaggccgggcacaguggcucaugccuguaaucccagcacuuugggaggucgaggugggug

SEQ ID NO: 175981 - RNA, 64 nt, Human
ggggccaggccugugugguggcucacaccugugaucccagcacuuugggaggcugagguaggag

SEQ ID NO: 175982 - RNA, 64 nt, Human
uuccaaggccagguacagugguucaugccuguaaucccagcacuucacuuugggaggcugaggc

SEQ ID NO: 175983 - RNA, 64 nt, Human
gucacaccagugcuagaaguuucaugauuuuauuucccagcagugcugaugacaagacugaaug

SEQ ID NO: 175984 - RNA, 64 nt, Human
cguagaggccaggugcgguggcucauaccuguaaucccagcaguuggggaggccaaggugggag

SEQ ID NO: 175985 - RNA, 64 nt, Human
auuggagacugggcacaguggcucccaccuuuaaucccagcaccuggggaggcugaggugagug

SEQ ID NO: 175986 - RNA, 64 nt, Human
agcuggguucagacuucacacugugaguucagacucccagcaccaacucacucugauucugguc

SEQ ID NO: 175987 - RNA, 64 nt, Human
agggcagaguagccaggguguggcccugccaucuucccagcagggccacucccggcacuccaug

SEQ ID NO: 175988 - RNA, 64 nt, Human
guuuccuuuuugguacuuauuacugcuaaguauuucccagcacaugaaaccuuauuuuuuccca

SEQ ID NO: 175989 - RNA, 64 nt, Human
ucaagguguuggaggcaacuucuguuccaagaacucccagcagcuuugaaagcagacugagaug

SEQ ID NO: 175990 - RNA, 64 nt, Human
uuuuuuggccgggcgcaguggcucaugccuguaaucccagcacuuugggaggccgaggugggcg

SEQ ID NO: 175991 - RNA, 64 nt, Human
uauaucagccgggcgcgguggcucaugccuguaaucccagcacuuugggaggcugaggcgggug

SEQ ID NO: 175992 - RNA, 64 nt, Human
agucuuagcauuuauauuuuaauaggaaguugacucccagcauguaaaagugauccacgcagcc

SEQ ID NO: 175993 - RNA, 64 nt, Human
uccugggccuggagcaguauucccaccuuaagauucccagcaucccugugcugucccggcucuc

SEQ ID NO: 175994 - RNA, 64 nt, Human
uuuaagggcugggcacgguggcucaugccuguaaucccagcacuuugggaggccgaggugggcg

SEQ ID NO: 175995 - RNA, 64 nt, Human
uuuucaggccgggugugguggcucaugccuguaaucccagcacuuugggaggcgaggcgggggu

SEQ ID NO: 175996 - RNA, 64 nt, Human
gugccaggcugggcacaauggcucgugcuuguaaucccagcacuuugggaggcggaggcaggcg

SEQ ID NO: 175997 - RNA, 64 nt, Human
uguucaggccgggugcuguggcucacgccuguaaucccagcacuuugggaggccgaggcgagug

SEQ ID NO: 175998 - RNA, 64 nt, Human
ggggaccccauggggacaggcagagcuggucuccucccagcagacggagccaggacgggcacaa

SEQ ID NO: 175999 - RNA, 64 nt, Human
ccagcaggccgggcgcgguggcucaccucuguaaucccagcacuuuuagaggccgaggcaggcg

SEQ ID NO: 176000 - RNA, 64 nt, Human
cacuuacaggcacacacagacacagaccagagacucccagcagcagagcccaagcacuggcuuc

SEQ ID NO: 176001 - RNA, 64 nt, Human
ccugggggccgguugcgguggcucaugccuguaaucccagcacuuugggaggccgaggcgggag

SEQ ID NO: 176002 - RNA, 64 nt, Human
gcuccaggagcaagcucaccaggccucucagaagucccagcaggaucucacggacugccggguc

SEQ ID NO: 176003 - RNA, 64 nt, Human
uaaccugguugggugugguggcucacacuuguaaucccagcacuuugaggugggcaauggcuug

SEQ ID NO: 176004 - RNA, 64 nt, Human
gccugaggccgggcgugguggcucacgccuguaaucccagcacuuugggaggccaaggugggca

SEQ ID NO: 176005 - RNA, 64 nt, Human
uuugggggcuacucgcuuuacagcuaccugauuuucccagcaucguucuagcuauuucugacuu

SEQ ID NO: 176006 - RNA, 64 nt, Human
aaauagggcugggcgcgguugcucacgccuguaaucccagcacuuuucagaggccaaggcgggc

SEQ ID NO: 176007 - RNA, 64 nt, Human
ccuuuuggcauggugccauggcucacaucuguaaucccagcacuuuuggaggcugaggcgggug

SEQ ID NO: 176008 - RNA, 64 nt, Human
ugaacuccugaguucagcuugauuucugacuacaucccagcaagcucuggcaucuguggauuaa

SEQ ID NO: 176009 - RNA, 64 nt, Human
acaaucuuuauaaucauuagaagggcuuauuaaaucccagcauuauccagggcaaacucacugg

SEQ ID NO: 176010 - RNA, 64 nt, Human
uaauuugaauaaacucuccccuuucuuugcaacuucccagcaacaauaaugauuuucuugccag

SEQ ID NO: 176011 - RNA, 64 nt, Human
ggugcuggcuggccaugguggcacacaccuguccucccagcacuuugcagggcugagguggaag

SEQ ID NO: 176012 - RNA, 64 nt, Human
accacagaaggagacccagacaucccgaggaaguucccagcagagcaaacugcuuuccagccug

SEQ ID NO: 176013 - RNA, 64 nt, Human
cugggugaggcucccaaccuggcaguccccagccucccagcaucugugagcgucuguuggacuu

SEQ ID NO: 176014 - RNA, 64 nt, Human
acugugggccgggcgcgguggcucacaccuguaaucccagcacuuugggaggcugaggcgggug

SEQ ID NO: 176015 - RNA, 64 nt, Human
aucugaggccgggcacgguggcucacgccgguaaucccagcacuuugggaggccgaggcgggcg

SEQ ID NO: 176016 - RNA, 64 nt, Human
aguuugggcugggugcuguggcucauaccuauaaucccagcacuuugggaggccgaggggggca

SEQ ID NO: 176017 - RNA, 64 nt, Human
cacugaccagccuugacacuccccuugcaaaccaucccagcacugcaccccaggcagccacucc

SEQ ID NO: 176018 - RNA, 64 nt, Human
augugaggcaggcaugguggcucauguuuguaaaucccagcacuuugggaggccgaguuggguu

SEQ ID NO: 176019 - RNA, 64 nt, Human
agucaaggccaggcacggcggcucacgccuguaaucccagcacuuugggaggccgagacaggcg

SEQ ID NO: 176020 - RNA, 64 nt, Human
aaaguagaccaggugcaguagcucacgccuguaaucccagcacuuugggaagccaaggcaggag

SEQ ID NO: 176021 - RNA, 64 nt, Human
aaaccauaaugcagagugggcccccuacuccauuucccagcaaaaggcuccagcuggagggaug

SEQ ID NO: 176022 - RNA, 64 nt, Human
ccuuaccugucaauaacaaugguggccaccugggucccagcacuuggcugguggagagauuuuu

SEQ ID NO: 176023 - RNA, 64 nt, Human
aaggggccuugcugaguggcgcaaggccgagcguucccagcagggggagaaacccuucacaccc

SEQ ID NO: 176024 - RNA, 64 nt, Human
guggaaacagagacacccugcggcaccagagccuucccagcaggccaggccgcugggcugggau

SEQ ID NO: 176025 - RNA, 64 nt, Human
acucgcugccccuacgccugccccggugcccggcucccagcagaacauacuagggagaugcacc

SEQ ID NO: 176026 - RNA, 64 nt, Human
ugcguggggcucccgccuccaaccccucgcccagucccagcagccagccaaacacacagaaggg

SEQ ID NO: 176027 - RNA, 64 nt, Human
uuugggggccgggcgugguggcucacgccuguaaucccagcacuuugggaggccgaggcgggug

SEQ ID NO: 176028 - RNA, 64 nt, Human
caugcauaggaauggccacagguuuacacugccuucccagcaauuauaagcacaccagauucag

SEQ ID NO: 176029 - RNA, 64 nt, Human
aaccugaaggguggcccuccucagacaauuuaucucccagcaaugacccuacuacacucgcgua

SEQ ID NO: 176030 - RNA, 64 nt, Human
aagauagggcgggcaugguggcucacgccuguaaucccagcacugugggaggccaagccaggca

SEQ ID NO: 176031 - RNA, 64 nt, Human
uugauaggccgggcaugguggcucaugccuguaaucccagcacuuugggaggccaggaguucga

SEQ ID NO: 176032 - RNA, 64 nt, Human
aagucaggcugggcgcaguggcucacgccuguaaucccagcacuuugggagggauaggugggcg

SEQ ID NO: 176033 - RNA, 64 nt, Human
ugcuuuacaagaaggccaaagaacuauggggccuucccagcauuugacuguucauugcauagaa

SEQ ID NO: 176034 - RNA, 64 nt, Human
guucccauuccauguguucugaauucagcucaucucccagcauauagauauauccuccuuuaac

SEQ ID NO: 176035 - RNA, 64 nt, Human
augugaggcugggacagagggagagaacaaggccucccagcacucugaugucagaguaguaggu

SEQ ID NO: 176036 - RNA, 64 nt, Human
ggagggggccgggcgcgguggcucacgccuguaaucccagcacuuugggaggccgaggcgggug

SEQ ID NO: 176037 - RNA, 64 nt, Human
ccucuggcccugaguggcaccugucccucuggucucccagcaccuggcccagguaacagccuuc

SEQ ID NO: 176038 - RNA, 64 nt, Human
ucaggcggggaggaggagcugccgcaaggcccugucccagcagaagagggaggcuuccugacug

SEQ ID NO: 176039 - RNA, 64 nt, Human
aaggauauauggggaccaccucccccuucuuugaucccagcaucucagucccccucccaacccu

SEQ ID NO: 176040 - RNA, 64 nt, Human
cuucuuggcugggcgcgguggcucacuccuguaaucccagcacuuugguaggccgagguggacg

SEQ ID NO: 176041 - RNA, 64 nt, Human
uaacaaggcugggugcgguggcucacgccuguaaucccagcaccuugggaggcugaggcgggca

SEQ ID NO: 176042 - RNA, 64 nt, Human
cugcgcuguuugugccgccgcugccucugggcccucccagcacacgcauggucucuucaccgcu

SEQ ID NO: 176043 - RNA, 64 nt, Human
aauacuucuguagcuucccauucauguucucuucucccagcaggccucauugugugcagaaacu

SEQ ID NO: 176044 - RNA, 64 nt, Human
ccuccuggcugggugaggcggcucacaccuguaaucccagcacuuugggaggccgaggcaggcg

SEQ ID NO: 176045 - RNA, 64 nt, Human
accuguggcugugcaggugacguccgggcugccgucccagcaggggcggcaggagagagaggcu

SEQ ID NO: 176046 - RNA, 64 nt, Human
ugggucugugcauuucugguugcaccgcggcgcuucccagcaccaacauguaaccggcauguuu

SEQ ID NO: 176047 - RNA, 64 nt, Human
uuguggggccgggcgagguggcucacgccuguaaucccagcacuuugggaggcugaggaggucg

SEQ ID NO: 176048 - RNA, 64 nt, Human
uaaucagggcuuaauuagaacaggcuguauuuccucccagcaaacaguuguggccacacuaaaa

SEQ ID NO: 176049 - RNA, 64 nt, Human
ggccccuuguacaccccaggagagaaguucucaaucccagcaguucuuuguagucauuccaagu

SEQ ID NO: 176050 - RNA, 64 nt, Human
gaaucaagccagggccguuggcuuaugccuguaaucccagcacuuugcaggccgagguagacag

SEQ ID NO: 176051 - RNA, 64 nt, Human
aaacagggccgggcgcaguggcucacaccuguaaucccagcacuuuggggagcugaggcgggcg

SEQ ID NO: 176052 - RNA, 64 nt, Human
aauuagggcaaggugugguagcucacaccuauaaucccagcacuuugggagguugagguaggua

SEQ ID NO: 176053 - RNA, 64 nt, Human
caacuuggccagccgugguggcucacgucuguaaucccagcacuuugggaggcugaggcaggca

SEQ ID NO: 176054 - RNA, 64 nt, Human
aagucagcagcccuagcucggccacacuuggugcucccagcaucccagggagagacacagccca

SEQ ID NO: 176055 - RNA, 64 nt, Human
ggaaaaugggcacaaaaacucagaaggcagcuauucccagcagcuuccuaguuaacaaccccca

SEQ ID NO: 176056 - RNA, 64 nt, Human
gccuuaacacuaagcccaccuccccugcucuccuucccagcauugagcccuugguugccugggc

SEQ ID NO: 176057 - RNA, 64 nt, Human
aacaagaauacugcuguugacacuccaguggaaaucccagcagccuuguuagugcacuugaaag

SEQ ID NO: 176058 - RNA, 64 nt, Human
uuacgucugguggcacguuggcucaugccuguaaucccagcacuuugggaggucgaggugggag

SEQ ID NO: 176059 - RNA, 64 nt, Human
uugaaaagcugggcacgguggcucacgccuguaaucccagcacuuugggaggcugaggcgggug

SEQ ID NO: 176060 - RNA, 64 nt, Human
augggugggugcccuccagagaggggcugcuaccucccagcaggcaugggaagagcacuggugu

SEQ ID NO: 176061 - RNA, 64 nt, Human
uguggggaggaaccauaaacccagcccucacagcucccagcacagggccucccugagccagugg

SEQ ID NO: 176062 - RNA, 64 nt, Human
caucugggccaggcaagauggcucacgccugugaucccagcauuuugggaggccgaggcgggug

SEQ ID NO: 176063 - RNA, 64 nt, Human
cugaaccaccuuugucucugcagaggcauccggaucccagcaagcgagcuuuagcagggaaguc

SEQ ID NO: 176064 - RNA, 64 nt, Human
agaccuggccaggugcgguggcucacuccuguaaucccagcacuuugggaggccgaggcgggcg

SEQ ID NO: 176065 - RNA, 64 nt, Human
cagauauuuugguaaauugaacuugguuuuucuuucccagcaucguggauguagacugagaaug

SEQ ID NO: 176066 - RNA, 52 nt, Human
ucaagggcaucgacaucugaccucccagcaccagccagcagcaggacugaga

SEQ ID NO: 176067 - RNA, 64 nt, Human
gacaagaggccagugcagugguucacaccuguaaucccagcacuuugggaggccgaggugggug

SEQ ID NO: 176068 - RNA, 64 nt, Human
aagucuggccgggcaugguggcucaagccuguaaucccagcacuuugggaggccgaggcgggcg

SEQ ID NO: 176069 - RNA, 64 nt, Human
cagggacugguagcuuggaugacauggcucagagucccagcauccacuugaaaccucccucucc

SEQ ID NO: 176070 - RNA, 64 nt, Human
uuugaggaccucgugucccaaaagacuuugccuaucccagcaaaacacacacacacacacacac

SEQ ID NO: 176071 - RNA, 64 nt, Human
agagagacugaauuggacuaaacccguccucuguucccagcacguuucucauauagcccucagu

SEQ ID NO: 176072 - RNA, 64 nt, Human
aaacccggccgggcgcgguggcucacgccuguaaucccagcacuuugggaggcugaggcgggca

SEQ ID NO: 176073 - RNA, 64 nt, Human
ggccugggcugggugcgguggcucaugccuguaaucccagcacuuugagaggcugcggcgggug

SEQ ID NO: 176074 - RNA, 64 nt, Human
cccccuuccugccagaccggaggggcuggggggaucccagcagggggagggcaaucccuucacc

SEQ ID NO: 176075 - RNA, 64 nt, Human
accggaacuuuuguggccccuaccgcucagcccuucccagcacuucucccacuuugucccgagc

SEQ ID NO: 176076 - RNA, 64 nt, Human
gugcucugccuggagucugcagaccucagagaggucccagcaccggcuguggccuuucaggugu

SEQ ID NO: 176077 - RNA, 64 nt, Human
ucaaugucuaaaauagcucuaucgcucugcggagucccagcagaggcuauggaauguuucugca

SEQ ID NO: 176078 - RNA, 64 nt, Human
cuuuugggcugggcgcaguggcucacgccuguaaucccagcacuuugggaggcugaggcaggug

SEQ ID NO: 176079 - RNA, 64 nt, Human
uguccuggcccgaugcaguggcucaugccuguaaucccagcacuuugagaggcugaggcagggc

SEQ ID NO: 176080 - RNA, 64 nt, Human
uacucuggccgguugcaguggcucacgccuguaaucccagcacuuuggcaggccgagaugggcg

SEQ ID NO: 176081 - RNA, 64 nt, Human
auuguaggccaggcacaguggcucacgccuguaaucccagcacuuugggaggccaaggcgggug

SEQ ID NO: 176082 - RNA, 64 nt, Human
cagcaucgugcaagcucugucauaaucugcaucuucccagcagccugguaccccagguuccugu

SEQ ID NO: 176083 - RNA, 64 nt, Human
ugccggggccaggugugguggcucacgccuguaaucccagcacuuugggaggccgaggcgggcg

SEQ ID NO: 176084 - RNA, 64 nt, Human
gagaaaugguggggggaggaggaggcuuauugcuucccagcauuuggggggaacaugauccaac

SEQ ID NO: 176085 - RNA, 64 nt, Human
aggaggggguaaggaugcaggggccaugcauucaucccagcacaggcagcgcauggcuccggaa

SEQ ID NO: 176086 - RNA, 64 nt, Human
guucauugcagugcccguaaaccauguagaaagcucccagcacugaaaggcaggaguguuagca

SEQ ID NO: 176087 - RNA, 64 nt, Human
aaaaaaggccgggcacuguggcucacgccuguaaucccagcacuuugcgauaccaaggcgggug

SEQ ID NO: 176088 - RNA, 64 nt, Human
gcuuuguggccagcagcacagaaucaaacccgcaucccagcauugggccacccaucugagggag

SEQ ID NO: 176089 - RNA, 64 nt, Human
uaauuggaccaggcgcgguggcucuugccuguaaucccagcacuuugggaggccgaggcaggca

SEQ ID NO: 176090 - RNA, 64 nt, Human
acauuggcuggaugugguggcucauaccuguaaaucccagcacuuugggaggccgaggcaggca

SEQ ID NO: 176091 - RNA, 64 nt, Human
ugcaggggcugggcgugguggcucaugccuguaaucccagcacuuugggaggccgaggcgggca

SEQ ID NO: 176092 - RNA, 64 nt, Human
aaaaaagguugggcguuguggcucaugccuguaaucccagcacuuugggaggcugaggcgggug

SEQ ID NO: 176093 - RNA, 64 nt, Human
ucuguagugccuugugggguauccaggaacacccucccagcaggggaugggaacccugucccau

SEQ ID NO: 176094 - RNA, 64 nt, Human
cacaagcucagagcccacaucaacacugccccccucccagcaccccacagcccucacauccccu

SEQ ID NO: 176095 - RNA, 64 nt, Human
guuuggccucaaaacagaagcagcuucuuuugucucccagcaguagugagccacucagucucuu

SEQ ID NO: 176096 - RNA, 64 nt, Human
uuuuucauucuucuugcaguucugggaguaaagcucccagcauauuuagauaauagggcagggg

SEQ ID NO: 176097 - RNA, 64 nt, Human
uuuugcuuauguuuuuccuuuuuaucuucucucaucccagcauacugaguuauuuauuaauuag

SEQ ID NO: 176098 - RNA, 64 nt, Human
cagccccucagucaugcugccuucugcugcucccucccagcaggauucacccucucauucccgg

SEQ ID NO: 176099 - RNA, 64 nt, Human
ucucucuucuaauuuucaguauaaccaaaaauuaucccagcaugagcacgggcacgugcccuuc

SEQ ID NO: 176100 - RNA, 64 nt, Human
auuggaggcccagugcaauggcucacgccugugaucccagcacuuugggaggccaaggcgggug

SEQ ID NO: 176101 - RNA, 64 nt, Human
aaauugggccaggcacgguggcucacgccuguaaucccagcacuuugggaggccaaggccagcg

SEQ ID NO: 176102 - RNA, 64 nt, Human
ggauaugguuauauauaugggaugguuugguuggucccagcaaaguauaugaaaauuaaaguuc

SEQ ID NO: 176103 - RNA, 64 nt, Human
uaacccggggugccaggaacacacacauccuccaucccagcauagagaauggggacucccugag

SEQ ID NO: 176104 - RNA, 64 nt, Human
uuggcaggacggcuacgagcagcuuaggcagcucucccagcacgccaugaagggggucauccgu

SEQ ID NO: 176105 - RNA, 64 nt, Human
uauccuggccaggugugguggcucacaccuguaaucccagcacuuugggagaccaaggcgggcg

SEQ ID NO: 176106 - RNA, 64 nt, Human
agucuuggccgggugcgguggcuccugccuauaaucccagcacuuugggaggcugaggcaggag

SEQ ID NO: 176107 - RNA, 64 nt, Human
gaaagaggccaggcgcaauggcucaugccuguaaucccagcacuuugggaggcugaggugggug

SEQ ID NO: 176108 - RNA, 64 nt, Human
agcugaggccggaugcgguggcucacgccuguaaucccagcacuuugggaggccuaggcgggcg

SEQ ID NO: 176109 - RNA, 64 nt, Human
agagagggccgggcgugguggcucacgccuguaaucccagcacuuugggaggccgagccgggcg

SEQ ID NO: 176110 - RNA, 64 nt, Human
ccauggagccgggugcgguggcucacgccuaugaucccagcacuuugggaggccgaggcaggcg

SEQ ID NO: 176111 - RNA, 64 nt, Human
aagauaggccgggugugauggcucaugccaguaaucccagcacuuugggcugaagcaggcagau

SEQ ID NO: 176112 - RNA, 64 nt, Human
ucaaugcucaagugaagucacaucuaccuauuacucccagcauugauugacuauaagaaaggau

SEQ ID NO: 176113 - RNA, 64 nt, Human
aggacaggcccggcgcgguggcucacgccuguaaucccagcaguuugggaggucgagguaggug

SEQ ID NO: 176114 - RNA, 64 nt, Human
agccuccagacccugcuaaccacaaaagggaacaucccagcaggcugugcuuggaucaugcucg

SEQ ID NO: 176115 - RNA, 64 nt, Human
caaugcucaagugaagucacaucugccuguuacuucccagcauugacugacuauaagaaaggac

SEQ ID NO: 176116 - RNA, 64 nt, Human
cccuuugucaaaaugugaugcacauaagcagguaucccagcaugaaauguaauuuacuuggaag

SEQ ID NO: 176117 - RNA, 64 nt, Human
guagucagaacuggaugggcugcccccagccagcucccagcagcuucuccggaagcugcucuug

SEQ ID NO: 176118 - RNA, 64 nt, Human
cuuugaggccgggugcaguggcucacgccuguaaucccagcacuuugggaggccgaggcgggug

SEQ ID NO: 176119 - RNA, 64 nt, Human
ccagagugcugggauuacaggcgugagccacuguucccagcaggaauuucuuuuuuauaguauu

SEQ ID NO: 176120 - RNA, 64 nt, Human
gcuauuagccaggugcgguggcucacgccuguaaucccagcacugugagaggcugaggcgggau

SEQ ID NO: 176121 - RNA, 64 nt, Human
gggaggcugcuccaccccuacucuccucccuugcucccagcagcggaagcgccucugacccuug

SEQ ID NO: 176122 - RNA, 64 nt, Human
agcagcagucaggcacgguggcucaugccuguaaucccagcacuuugggaggcugaggcaggcg

SEQ ID NO: 176123 - RNA, 64 nt, Human
gguguuggccaggcaugguggcucaugccuguaaucccagcauuuugggaggccaaggcgggcg

SEQ ID NO: 176124 - RNA, 64 nt, Human
cauaaggccaggagcaguggcucacaccuuguaaucccagcacuuugggaggccaaggugggcg

SEQ ID NO: 176125 - RNA, 64 nt, Human
auccagugucugaugcuauugguuaguaaugaugucccagcauuugauguucccucucuaauga

SEQ ID NO: 176126 - RNA, 64 nt, Human
ccgauagucacaaauuugaaaccgugcuucagaaucccagcacauaguaaaagacaacacugau

SEQ ID NO: 176127 - RNA, 64 nt, Human
aggggaggccgggugcgguggcucacgcauguaaucccagcacuuugggaggccaaggcaggug

SEQ ID NO: 176128 - RNA, 64 nt, Human
aaguuaggccgggcgcgguggcucaugccuguaaucccagcacuuugggaggccgagacaggca

SEQ ID NO: 176129 - RNA, 64 nt, Human
aggggagugagcuagucaaaugugaaaaaugcucucccagcaaagcugagacaaaauuggagaa

SEQ ID NO: 176130 - RNA, 64 nt, Human
caugauggcugggcaccguggcucacgccuguaaucccagcacuuugggaggcugaggcgggug

SEQ ID NO: 176131 - RNA, 64 nt, Human
uauauauauucuuacaugaguaaaaagcacccucucccagcaaucguaugccauugguauuuga

SEQ ID NO: 176132 - RNA, 64 nt, Human
gcucuccaggagccucagcccaccgccaguacucucccagcaaccgcgagcaauuucuugggac

SEQ ID NO: 176133 - RNA, 64 nt, Human
aagcagggcugggugugacggcacaugccuguaaucccagcacuuugggaggcugaggugggag

SEQ ID NO: 176134 - RNA, 64 nt, Human
ucuggggguugggcaugguggcucacgcuugugaucccagcacuuugggagacugaggcggauc

SEQ ID NO: 176135 - RNA, 64 nt, Human
aaaaauugccgggcgcgguggcaaaugccuguaaucccagcacuuugggaggccgaggcaggug

SEQ ID NO: 176136 - RNA, 64 nt, Human
auauauggccaggcgggauggcucacgccuguaaucccagcacuuugggaggcugaggcgggca

SEQ ID NO: 176137 - RNA, 64 nt, Human
aaaauuagccgggcgugguggcuuacgccuguaaucccagcacuuugggaggccaaggugggcg

SEQ ID NO: 176138 - RNA, 64 nt, Human
augcaaggcugggugcuguggcucaugccuguaaucccagcacuuugggaggccaaggcaggug

SEQ ID NO: 176139 - RNA, 64 nt, Human
uauuuacgccaggcgugguggcucacgccuguaaucccagcacuuugggaggccgaggcaggcg

SEQ ID NO: 176140 - RNA, 64 nt, Human
ucuuaaaaaacaguaaugaagacuauaucuccuuucccagcacugaauguuuuacuagcacugg

SEQ ID NO: 176141 - RNA, 64 nt, Human
aggagucaugggcguuaguucuguaguaauaacuucccagcaccuggacaucucuuccagaguu

SEQ ID NO: 176142 - RNA, 64 nt, Human
uauggaggcugggcgugguggcucacaccuguaaucccagcacuuugggaggcccagacuggcg

SEQ ID NO: 176143 - RNA, 64 nt, Human
ugcacacucuuguguuuuuugcucacugucacauucccagcaccuaguaugcucaguaaauguu

SEQ ID NO: 176144 - RNA, 64 nt, Human
aaugcuggcuuggcccgguggcucaugccuguaaucccagcacugugggagaccacgguggggg

SEQ ID NO: 176145 - RNA, 64 nt, Human
guuaagggcugggugcggugucucacaccuguaaucccagcacuuugggaggccgagaugggug

SEQ ID NO: 176146 - RNA, 64 nt, Human
agauggggcuacuguuguuacagucucauauguaucccagcacauguaauuuuuuaaauaguuu

SEQ ID NO: 176147 - RNA, 64 nt, Human
gaugguuaucacaggaguuuagaaagacucugccucccagcaucuugaauaucuccagccuguu

SEQ ID NO: 176148 - RNA, 64 nt, Human
aauuaacaccugucugaaaaucaaaaacauggcuucccagcagcucuccugucuccacagccgc

SEQ ID NO: 176149 - RNA, 64 nt, Human
cucagaagaaugcagggcccauucagcauggggaucccagcacaucacuguagaauuugaguga

SEQ ID NO: 176150 - RNA, 64 nt, Human
cuucaacuuucugaaaaaguaaacuucgacaaguucccagcaacugcuuguuugugcaugagua

SEQ ID NO: 176151 - RNA, 64 nt, Human
cauguuggccgggcgcgguggcucacgccugcagucccagcacuuugggaggccaaggcgugug

SEQ ID NO: 176152 - RNA, 64 nt, Human
aaucaaggccgggcgugguggcucacaccuguaaucccagcauuuugggaggccgaggcaggug

SEQ ID NO: 176153 - RNA, 64 nt, Human
ccuccuagcugggugcgguggcucacgccuguaaucccagcacuuugggaggcugaggcgggca

SEQ ID NO: 176154 - RNA, 64 nt, Human
ucuuuagaccgggcacaguggcucacgccaguaaucccagcacuuuggagggcugaagcaggag

SEQ ID NO: 176155 - RNA, 64 nt, Human
uguagaaugcaggugauaaacauuuucucuaccuucccagcaguuugcugccauggacauaaau

SEQ ID NO: 176156 - RNA, 64 nt, Human
uagagauucuccaggaauuuccucuaugggaccuucccagcaucagccuuagaacaagaaccuu

SEQ ID NO: 176157 - RNA, 64 nt, Human
uaagggauuuaaaguuuggguugcaugccuguaaucccagcauuuugggaggccgaggugggcg

SEQ ID NO: 176158 - RNA, 64 nt, Human
auaacuugccgggugcgguggcucaccccuguaaucccagcacuuugggaggccaaagcaggcg

SEQ ID NO: 176159 - RNA, 64 nt, Human
aaaauuagccagggguggugguaugcaccugcagucccagcaacaugggaggcugaacaggaga

SEQ ID NO: 176160 - RNA, 64 nt, Human
acccucuccacacccagccugucccacuggcuccucccagcacaggcaccuauguggcaugugg

SEQ ID NO: 176161 - RNA, 64 nt, Human
acgggaacugucacgacuggaagggcgugaggccucccagcagugccgcagcguuucgaggggc

SEQ ID NO: 176162 - RNA, 64 nt, Human
ugugucugcguguccgaauccccgugugacccugucccagcauuuucccgccgacccugcgugu

SEQ ID NO: 176163 - RNA, 64 nt, Human
ggccugaggccucgcggugaccccucucucugguucccagcaccugccugagaccugccccagg

SEQ ID NO: 176164 - RNA, 64 nt, Human
agaggaggccgggcaugguggcucacgcuuguaaucccagcacuuugggaggccgaggugggca

SEQ ID NO: 176165 - RNA, 64 nt, Human
ggaaggagcaguccccugcuaucccugcagccacucccagcacacccgcacacagccagcacca

SEQ ID NO: 176166 - RNA, 64 nt, Human
gaacccagcugggcgugguggcucacuccuguaaucccagcauuuugggaggccgaggugggug

SEQ ID NO: 176167 - RNA, 64 nt, Human
ugguaaggccgggugcaguggcucacgccuguaaucccagcacuuugggaggcugaggugggca

SEQ ID NO: 176168 - RNA, 64 nt, Human
cgcccuccauccuccccacaucccugcagccaccucccagcagagcaggcuacguccucacuga

SEQ ID NO: 176169 - RNA, 64 nt, Human
uuagcaaguaugccuuccauccuuggcagaggcuucccagcauccuaggcucagcuuaccgggu

SEQ ID NO: 176170 - RNA, 64 nt, Human
acugagacugggagagguggcucaugccuguaaaucccagcacuuugguagccugaagugggag

SEQ ID NO: 176171 - RNA, 64 nt, Human
auauuaggccggaugugguggcucacgccuguaaucccagcacuuugggaggccauggcgggug

SEQ ID NO: 176172 - RNA, 64 nt, Human
aacauccuccccacaccaucucaccauauccaucucccagcauccaucugcauucagcuaaggg

SEQ ID NO: 176173 - RNA, 64 nt, Human
uauugcauuugggcagcuucugugguguaaauucucccagcagugucccaugucaugcugccag

SEQ ID NO: 176174 - RNA, 64 nt, Human
cugucucuggcuaaccacacaggccauuccccucucccagcaccuugcagacuugggcccauca

SEQ ID NO: 176175 - RNA, 64 nt, Human
auggucaggauaaaaaccaaaucugggugccagaucccagcacuacuuuuuauuacuggagaaa

SEQ ID NO: 176176 - RNA, 64 nt, Human
aguuuaagaaagcugagcagaggugucucauauuucccagcacaugauucugaacuugaugcuu

SEQ ID NO: 176177 - RNA, 64 nt, Human
cccacacuguagagucacgaagcucagagauuauucccagcagcagccagcaccuggccuggcu

SEQ ID NO: 176178 - RNA, 64 nt, Human
aaagcacaaggcagggcagugcucacgccugucaucccagcacuuugggaggccgagacgggag

SEQ ID NO: 176179 - RNA, 64 nt, Human
acagucagccuggcacagucgcucaugccucuaaucccagcacgaugggaggccaagacaggca

SEQ ID NO: 176180 - RNA, 64 nt, Human
auuggcaggcccuguccgaggaguugggggaccaucccagcagguaaugacuccacagggaaga

SEQ ID NO: 176181 - RNA, 64 nt, Human
ggggucacaccugccaggacuccgcuucuccgugucccagcagaaggcaugcaggacccuguca

SEQ ID NO: 176182 - RNA, 64 nt, Human
uuucugggccgggcacaguggcucacgccuguaaucccagcacuuuggaaggccgagaugggcg

SEQ ID NO: 176183 - RNA, 64 nt, Human
cuuccccuucagccugggaccaggcuuuccuagaucccagcacagcucugagcuuguuccuuug

SEQ ID NO: 176184 - RNA, 64 nt, Human
cauuucaggccaguguggugucuugcgccuguacucccagcacuuugggaggccgaggcaggug

SEQ ID NO: 176185 - RNA, 64 nt, Human
guucugggccaggugugguggcucaagccuguaaucccagcacuuugggaggccgaggcgggug

SEQ ID NO: 176186 - RNA, 64 nt, Human
uucuuaggccgggcaugguggcucacaccuguaaucccagcacuuugggaggccgaggcgggcg

SEQ ID NO: 176187 - RNA, 64 nt, Human
uaauuuggcugggugcuguggcucacaccucuaaucccagcacuuugggaggucgaggcaggua

SEQ ID NO: 176188 - RNA, 64 nt, Human
auuuugggccgggcucaguggcucaugccuguaaucccagcacuuugggaggccgaggcgggcg

SEQ ID NO: 176189 - RNA, 64 nt, Human
gaagucagccaggcgcgguggcucaugccuguaaucccagcacuuugggaggccaagaugggug

SEQ ID NO: 176190 - RNA, 64 nt, Human
aacuauagcaguuguauuguguaacaaguacugcucccagcagcaauuagggagaaaacuaguc

SEQ ID NO: 176191 - RNA, 64 nt, Human
aucuguggcuggaugcaguggcucaugccuguaaucccagcacuuugggaggcugaagugggag

SEQ ID NO: 176192 - RNA, 64 nt, Human
aaauagcagcuuuagccaagugcagggccuguaaucccagcauuuuaggaggccaagguuggag

SEQ ID NO: 176193 - RNA, 64 nt, Human
cuugagaacuuggcucagggcuccugaggaccuuucccagcauuaccuucccuucccuugaaag

SEQ ID NO: 176194 - RNA, 64 nt, Human
acuaaaggccaggugcaguggcccaugccuguaaucccagcacuuugggaggugggacaauugc

SEQ ID NO: 176195 - RNA, 64 nt, Human
uaauguggccgggcacgguggcucacaccuguaaucccagcacuuugggaggucgaggugggcg

SEQ ID NO: 176196 - RNA, 64 nt, Human
uucuccaggguccacaggaagugaagaaucuguuucccagcaguggacucaaaacccaucuggg

SEQ ID NO: 176197 - RNA, 64 nt, Human
aacuuagguagguuauggugccucacaccuguaaucccagcacuuuggggggcugaggcaggug

SEQ ID NO: 176198 - RNA, 64 nt, Human
ccgaggacgaugcagaagagggacuugggggucuucccagcaacaucagcucugucagcuccuu

SEQ ID NO: 176199 - RNA, 64 nt, Human
ggaagaccucaagaaaaauucacaguugagugcaucccagcauucuguuccgggcaggcauuuc

SEQ ID NO: 176200 - RNA, 64 nt, Human
acuacccauauuccaaaaguagauuuccucuguaucccagcauacuuugugaaccuggcuccuu

SEQ ID NO: 176201 - RNA, 64 nt, Human
aggcuagaggaagucuauccacaggcaguuguguucccagcaauuccucccauccugcaugguu

SEQ ID NO: 176202 - RNA, 64 nt, Human
gaacguggccgggcgugguggcucacgccuguaaucccagcacuuugggaggcugaggcaggca

SEQ ID NO: 176203 - RNA, 64 nt, Human
aacacaggccgggucugguggcucaugccuguaaucccagcacuuugagaggccugaggucggc

SEQ ID NO: 176204 - RNA, 64 nt, Human
gcuugucaacacagaauucaagccucauuugcuaucccagcaucucuuaaaacuuuguagucuu

SEQ ID NO: 176205 - RNA, 64 nt, Human
caaauuggccgggugcgguggcucacgccuguaaucccagcacuuugggaagccgagggggaug

SEQ ID NO: 176206 - RNA, 64 nt, Human
auucauggccgggcgcgguggcucacgcuuguaaucccagcacuuugggaggccgaggcgggcg

SEQ ID NO: 176207 - RNA, 64 nt, Human
aggguuggccaggcgcgguggcucacaccuguaaucccagcacuuugggaggccgaggagggcg

SEQ ID NO: 176208 - RNA, 64 nt, Human
agggggggccaggugcaguggcucacgccuguaaucccagcaguuugggaggccaaggcaagug

SEQ ID NO: 176209 - RNA, 64 nt, Human
ugccuuaucagaaaccaagcuuaugaagaucuucucccagcagguccauagcaguaggcuuagg

SEQ ID NO: 176210 - RNA, 64 nt, Human
auuagcggccgggcgcaguggcucacgccuguaaucccagcacuuugggaggccgaggcaggcg

SEQ ID NO: 176211 - RNA, 64 nt, Human
ugcucuaguguucugucucccagucaccucgcucucccagcaccagugcccuucuccugcuccc

SEQ ID NO: 176212 - RNA, 64 nt, Human
aaaaguugccgggggugguggcucaugccuguaaucccagcacuuugggaggcugagggaggua

SEQ ID NO: 176213 - RNA, 64 nt, Human
ugaagaccaccuucuaguucaggacuccuguucuucccagcauggccacuauuuugaugauggc

SEQ ID NO: 176214 - RNA, 64 nt, Human
ccugccuaccauccuccucccuccccggcucuccucccagcaucacaccagccaugcagccagc

SEQ ID NO: 176215 - RNA, 64 nt, Human
cgcugaagccauggaucaacuucuuucuugugucucccagcacacgugugcacgcaaggcagcc

SEQ ID NO: 176216 - RNA, 64 nt, Human
auuaccucauuuccagccucccaggcuccauccaucccagcaucuuuuauucugccauuuuccu

SEQ ID NO: 176217 - RNA, 64 nt, Human
cccccucugaugaacauccucugaugaucuaggcucccagcaggcuacuuugaagggaacaauc

SEQ ID NO: 176218 - RNA, 64 nt, Human
gacaacccucuucaucacugguggcugagcuuuuucccagcaggaauggguccucgaaucaucg

SEQ ID NO: 176219 - RNA, 64 nt, Human
gaaggaggccgggcgcaguggcucacgccuguaaucccagcacuuugggaggccgaggcgggcg

SEQ ID NO: 176220 - RNA, 64 nt, Human
caggagccccaggucaagccuugucccuuccuccucccagcaacagucccaacaagcaggcuuc

SEQ ID NO: 176221 - RNA, 64 nt, Human
cugaucuccaucuuucugcccugcauaccagcccucccagcagccacaagcuugcccgcccugg

SEQ ID NO: 176222 - RNA, 64 nt, Human
uagugcuuccuggagcugaggcugugggcggcugucccagcaaccaugcgagggguugccccag

SEQ ID NO: 176223 - RNA, 64 nt, Human
ggaguuggccaggcgcaguggcucacaccuguaaucccagcacuuugggacaccaaggugggug

SEQ ID NO: 176224 - RNA, 64 nt, Human
ucagaauuguuuuggugauaccucaccccuguaaucccagcacuuugggugggugaggcaggcg

SEQ ID NO: 176225 - RNA, 64 nt, Human
ucaacuggccaggcaggguggcucacgccuguacucccagcauuuugugaggccaaggugggug

SEQ ID NO: 176226 - RNA, 64 nt, Human
ucucuuuccccuccaaccaguucaaucucaucccucccagcagcuccccuuccaccccccgggg

SEQ ID NO: 176227 - RNA, 64 nt, Human
cauauuugggcuggguauggagguucacugguaaucccagcacuuugggaggcccaggcagaag

SEQ ID NO: 176228 - RNA, 64 nt, Human
aauuuuggcuaggcgugauggcucaggucuguaaucccagcacuuucgguggccggggugggug

SEQ ID NO: 176229 - RNA, 64 nt, Human
ugggacagccgggcacgauggcucacaccuguaaucccagcacuuugggaggcugaggcgggaa

SEQ ID NO: 176230 - RNA, 64 nt, Human
acccagcccggcgcacagugacucacgccuguaaucccagcacuuugggagggcgaggcuagca

SEQ ID NO: 176231 - RNA, 64 nt, Human
gggcugggcugggcgcggugguucacgccuguaaucccagcacuuugggaggccaaggagggug

SEQ ID NO: 176232 - RNA, 64 nt, Human
ucucugucgcccaggcuggggugcaguggcgcgaucccagcacugcagccucaaccuccugggc

SEQ ID NO: 176233 - RNA, 64 nt, Human
ccccucugcccugucccugcacaccuccacugccucccagcagaucuguggagacaaaacaagc

SEQ ID NO: 176234 - RNA, 64 nt, Human
ugcuuucacuucccaccucucuaccuaaguuccuucccagcacaucgccagcccugggccuggg

SEQ ID NO: 176235 - RNA, 64 nt, Human
uaggagcaccaggaacccagggccuggccuucucucccagcagccuggggggcagggcagagcc

SEQ ID NO: 176236 - RNA, 64 nt, Human
auuggaggccgggcgcaguggcucacgccuguaaucccagcacuuugggaggccaaggugggug

SEQ ID NO: 176237 - RNA, 64 nt, Human
ugagccaggcugcaggaggaacugggccuccgcuucccagcaacgcagccaggccugagaauuc

SEQ ID NO: 176238 - RNA, 64 nt, Human
cuucuuggcugggugcaguaguuuacgccuguaaucccagcacugugggaggccgaggcggaug

SEQ ID NO: 176239 - RNA, 64 nt, Human
auaauaggccaggcacuguggcucaugccccuaaucccagcacuuuugggaggucaaggugagc

SEQ ID NO: 176240 - RNA, 64 nt, Human
gcuggggcaaaccacucuucaagugguggcagagucccagcacggcagcccgccucucccccug

SEQ ID NO: 176241 - RNA, 64 nt, Human
auuguaggcugggcacaguggcucgcgccuguaaucccagcacuuugggaggccaaggcggacg

SEQ ID NO: 176242 - RNA, 64 nt, Human
uggauaggccgggcgugguggcucaugccuauaaucccagcacguugggaggcugaggcgggcg

SEQ ID NO: 176243 - RNA, 64 nt, Human
cauaagggcggggugugguggcucaugccuguaaucccagcacuuugggaggccgaggcgggcg

SEQ ID NO: 176244 - RNA, 64 nt, Human
gcagcgggccaggugugguggcuuaccccuguaaucccagcacuuugggaggccaaagcaggac

SEQ ID NO: 176245 - RNA, 64 nt, Human
agugucaggugauuuccuagggagagguucccagucccagcaggcagaaugcccaaaaccagga

SEQ ID NO: 176246 - RNA, 64 nt, Human
aaaaucugaaaagccagauaugccuguuuccuuuucccagcaccaugccuguggaggggacagu

SEQ ID NO: 176247 - RNA, 64 nt, Human
agaggcaagguugggcuggugcucacagcuguaaucccagcacuuugagguuggcugggaguuc

SEQ ID NO: 176248 - RNA, 64 nt, Human
acugcgaugccuuuuccucccuuuuccuguacacucccagcaacaaacuccucaugauaacugc

SEQ ID NO: 176249 - RNA, 64 nt, Human
uaaguaguccaggggcgguggcucacgccuguaaucccagcacuuugggaggccgaggcaggcg

SEQ ID NO: 176250 - RNA, 64 nt, Human
auuguuggcugggcacaguggcucacgccuguaaucccagcacuuugggaggccgaggcgggcg

SEQ ID NO: 176251 - RNA, 64 nt, Human
cagcuuagcugggcacaguggcucaugccgauaaucccagcaauucagaaagcugaggcaggag

SEQ ID NO: 176252 - RNA, 64 nt, Human
acucucggcugggcgcaguggcucaugccuguaaucccagcauuuugggaggcugaggcaggug

SEQ ID NO: 176253 - RNA, 64 nt, Human
ugguucagcuggucacgguggcucacgccuguaaucccagcacuuugggaggccaagccagaug

SEQ ID NO: 176254 - RNA, 64 nt, Human
guuauuggcugugcacaguggcucacgccuauaaucccagcauuuugggaggcugagugggaug

SEQ ID NO: 176255 - RNA, 64 nt, Human
gaaucaggcugggugcaguggcucacaccuguaaucccagcauuuugggaggcugagugagagg

SEQ ID NO: 176256 - RNA, 64 nt, Human
auugagggcccgggacgguaggucaugucuguaaucccagcaauuuggaggcugaggugggagg

SEQ ID NO: 176257 - RNA, 64 nt, Human
aagagagaccaggugugguggcucacgcauguaaucccagcacucugggaggcugaggcgggca

SEQ ID NO: 176258 - RNA, 64 nt, Human
uucuaaaaggucucuauuuaaaugccacugucaaucccagcacuuugggaggccuaggcgggcg

SEQ ID NO: 176259 - RNA, 60 nt, Human
cucuccugauccagagcugaggggcuagggucccagcaccacuucccccuucuccacccu

SEQ ID NO: 176260 - RNA, 57 nt, Human
aggaccuggagcggagcugaggcuccuucccagcaacacuccggucagccccuggca

SEQ ID NO: 176261 - RNA, 64 nt, Human
cuaaggccgggcuccaccuacuccugugggacucucccagcacccugugugcacugagcuucag

SEQ ID NO: 176262 - RNA, 64 nt, Human
acauaacaagcuguggucugggguaacagccucuucccagcacccaccugccagcccugcuugc

SEQ ID NO: 176263 - RNA, 64 nt, Human
acaggaauuagaaaauauaaugaaaagauuucguucccagcagcaucaagaaaaguagauuuuc

SEQ ID NO: 176264 - RNA, 64 nt, Human
ggagccuuugguucaguaaacgacccagggugguucccagcaaagcugcuuccucucugcuccu

SEQ ID NO: 176265 - RNA, 64 nt, Human
gugaaauguuuuacaguguuucucaucaucuguuucccagcaaggucuuuuuuuuuucuacauu

SEQ ID NO: 176266 - RNA, 64 nt, Human
gugccaggccgggugcgguggcucaugccuguaaucccagcauuuugagaggcugaggcgggug

SEQ ID NO: 176267 - RNA, 64 nt, Human
aaagguggccaggcuugguggcucaggccuguaaucccagcacuuugggaagcccaggcaggca

SEQ ID NO: 176268 - RNA, 64 nt, Human
aauaggggccgagugcgguggcucacaccuguaaucccagcaguuuggaaggccagggcaggug

SEQ ID NO: 176269 - RNA, 64 nt, Human
agguagaugaguuccgacacugucacggcuguguucccagcagcgaaggccucugcggagcugc

SEQ ID NO: 176270 - RNA, 64 nt, Human
aaaucccagcaccccagccacaggcuguggcugcucccagcagaggcggggccggcagagaagg

SEQ ID NO: 176271 - RNA, 64 nt, Human
guuuguacguuucucuuugaugaccaggaagaaaucccagcaccccagccacaggcuguggcug

SEQ ID NO: 176272 - RNA, 64 nt, Human
ccuucaggccaggcgcgguggcucacgccuguaaucccagcacuuugggaggccgagacgggcg

SEQ ID NO: 176273 - RNA, 64 nt, Human
cugauugcauccacauucauuccuccauuuccuuucccagcaaccccccauuucuguuugggaa

SEQ ID NO: 176274 - RNA, 64 nt, Human
ugugguggcagggagugguggcucaugucuguaaucccagcacuuugggaggcugaggcgggug

SEQ ID NO: 176275 - RNA, 64 nt, Human
uaaggcccugguuugucccgaaggggccuaguguucccagcacugugccugcucucaagagcac

SEQ ID NO: 176276 - RNA, 64 nt, Human
gguugggaccuggguacguggaucccugaguagaucccagcaucugggccauggagagguuggg

SEQ ID NO: 176277 - RNA, 64 nt, Human
gauguguguuuccccaggcagacggccccucucuucccagcacuucccugccucccccaggccu

SEQ ID NO: 176278 - RNA, 64 nt, Human
ugacuuggccgggcgcgguggcucacgccuguaaucccagcacuuugggaggccaaggcgggcg

SEQ ID NO: 176279 - RNA, 64 nt, Human
aaagaaagccgggcaugacggcucaugccuguaaucccagcacuuugggaggcugaggcaggug

SEQ ID NO: 176280 - RNA, 64 nt, Human
caaagagacugggcgcaguggcucaugcccauaaucccagcacuuugggagauggaggcgggaa

SEQ ID NO: 176281 - RNA, 64 nt, Human
uacuguggccgggcgugguggcucaugccuguaaucccagcacuuugggaggccgaggugggag

SEQ ID NO: 176282 - RNA, 64 nt, Human
uggcuggcaugcccaucagcugaggacagcaaacucccagcagccccuacagagguggcacaug

SEQ ID NO: 176283 - RNA, 64 nt, Human
gaaggcagccgggcgcaguggcucacgccuguaaucccagcacuuugggaggcugaggcgggcg

SEQ ID NO: 176284 - RNA, 64 nt, Human
ucuagcaaacauugaaaaacacauuuugcauaucucccagcauaaguaccaagcaaaauuacag

SEQ ID NO: 176285 - RNA, 64 nt, Human
uaacaagaagcccaguggugaggaaagugcguucucccagcacugccuccuguuuucucccucu

SEQ ID NO: 176286 - RNA, 64 nt, Human
accccuggcugggcucaguggcucaccccuguaaucccagcacuuugggaggccaaggcggguc

SEQ ID NO: 176287 - RNA, 64 nt, Human
cugccaggccgggcgcgguggcucacaccuguaaucccagcacuuugggaggccgaggcgggcg

SEQ ID NO: 176288 - RNA, 64 nt, Human
cuccgagggcaggcaugguggcucaugccuguaaucccagcacuuugggaggccgaggcaggug

SEQ ID NO: 176289 - RNA, 64 nt, Human
acucuaggcugggugugguggcucacgccuauaaucccagcacuuugggaggcugaggugggug

SEQ ID NO: 176290 - RNA, 64 nt, Human
accacuggccaggcgagguggcucacaccuguaaucccagcacuuugggaggccaaggcgggug

SEQ ID NO: 176291 - RNA, 64 nt, Human
ggccuuggcaaugucugugccaccuccugagcccucccagcauguccucacaugcucaugccca

SEQ ID NO: 176292 - RNA, 64 nt, Human
agccgccucccucgcucccugcuccuccaggaauucccagcaggcucucugguguucagggucc

SEQ ID NO: 176293 - RNA, 64 nt, Human
ccuggcucucccagucacccuccccuagccagucucccagcaaggguuuaagagauggccgcug

SEQ ID NO: 176294 - RNA, 64 nt, Human
uuaccauccccgaccaucugauuaaaaugcuuccucccagcauaggauucauugaguugguuac

SEQ ID NO: 176295 - RNA, 64 nt, Human
gggaaauagcaguucagagagaggaagcucucugucccagcaccgagacucacuccuaagucuu

SEQ ID NO: 176296 - RNA, 64 nt, Human
acaagauggaagccuaaagcccaagucgagcagcucccagcacugcugugcagaccuagagguc

SEQ ID NO: 176297 - RNA, 64 nt, Human
gaaaagaauuccccaggagaaaauggaaacacuaucccagcaaucugaauuccuuacuugggga

SEQ ID NO: 176298 - RNA, 64 nt, Human
gcauugggcugagugugguggcucaugccuguaaucccagcacuuugggaggcugagacaggcg

SEQ ID NO: 176299 - RNA, 64 nt, Human
aaaauuaaccaugcguggugguacacgucugucaucccagcagcucuuaaggcugaggcacaag

SEQ ID NO: 176300 - RNA, 64 nt, Human
uaguuccgccaggcacgguggcucacaccuguaaucccagcacuuugggaggccaaggcgggcg

SEQ ID NO: 176301 - RNA, 64 nt, Human
ggggagguggccgggugcaguggcucgccuguaaucccagcacuuugggaggccgaggcgggcg

SEQ ID NO: 176302 - RNA, 64 nt, Human
gggcgaggaugggugugguggcucacaccuguaaucccagcauuuugggaggcugagguggcca

SEQ ID NO: 176303 - RNA, 64 nt, Human
ggcagugagugccaugcuuuuuggugagggcagaucccagcaccuauugaauuaccauagagua

SEQ ID NO: 176304 - RNA, 64 nt, Human
augcauggccgggcgugguggcuuacaccuguaaucccagcacuuugggaggccgaggugggug

SEQ ID NO: 176305 - RNA, 64 nt, Human
augcggguaguauuagccaccccccuccaucuguucccagcaccggagaagggggugcucaggu

SEQ ID NO: 176306 - RNA, 64 nt, Human
ugaaccggcugggcgcgguggcucacgucuguaaucccagcacuuugggaggccgaggcgggug

SEQ ID NO: 176307 - RNA, 64 nt, Human
auacuuaaggauuuaguuagugauaagauguucaucccagcauugcaauggagaaaaaugggaa

SEQ ID NO: 176308 - RNA, 64 nt, Human
auaagaggccgggugcgguggcucaagccuguaaucccagcacuuugggaggccgaggcaggca

SEQ ID NO: 176309 - RNA, 64 nt, Human
uuugcuggccagguaugguggcucacgccuguaaucccagcacuuugggaggcuaaggugggcg

SEQ ID NO: 176310 - RNA, 64 nt, Human
aaaugggguggggcgcaguggcucacgccuguaaucccagcacuuugggaggccgaggugggcg

SEQ ID NO: 176311 - RNA, 64 nt, Human
auucuuggccgggcauguuggcucccgccuguaaucccagcacuuugggaagcccaagugggug

SEQ ID NO: 176312 - RNA, 64 nt, Human
aacaucucacgagcuuuccuacaucuuccgugguucccagcacagcccaagauuauuuggcagc

SEQ ID NO: 176313 - RNA, 64 nt, Human
agcuguggucgggcacgguggcucacgccuauaaucccagcacuuugggaggccgaggcgggug

SEQ ID NO: 176314 - RNA, 64 nt, Human
augagagccgcucuccugcuaccucccaccacugucccagcagucccucggcacacaggcauau

SEQ ID NO: 176315 - RNA, 64 nt, Human
gagggccaggaccauccuccuaccccucauacccucccagcauauacaaaaggggagguuuuag

SEQ ID NO: 176316 - RNA, 64 nt, Human
cacagccagugcauuccugccugcggacaggcccucccagcagcuuugccgccucuccaucguc

SEQ ID NO: 176317 - RNA, 64 nt, Human
cccuugaguuucucaacugcuggaaggagcugugucccagcaaggaagggaaaccaucagggcu

SEQ ID NO: 176318 - RNA, 64 nt, Human
aacccaggccgggugcaguggcucaugccuguaaucccagcacuuugggaggcuguggggggcg

SEQ ID NO: 176319 - RNA, 64 nt, Human
uccccaggcuggacgugguggcucacgccuguaaucccagcacuuugggaggccaaggugggug

SEQ ID NO: 176320 - RNA, 64 nt, Human
accccagaucacaaagccaaccaugcccagccccucccagcacccccagccccacgaccaucgu

SEQ ID NO: 176321 - RNA, 64 nt, Human; identical to SEQ ID NO: 176320

SEQ ID NO: 176322 - RNA, 64 nt, Human
uuaaaaauacugucccagaaauguaauuuuaugaucccagcaugaauguuauuuucauggaaua

SEQ ID NO: 176323 - RNA, 64 nt, Human
accccagaucacaaagccaaccaugcccggccccucccagcacccccagccccacgaccaucgu

SEQ ID NO: 176324 - RNA, 64 nt, Human
uuauuuggccaagccugauggcucgugccuguacucccagcacuuugggaggcugaggugggag

SEQ ID NO: 176325 - RNA, 64 nt, Human
guccuuggccaggugcaguggcucacgccuguaaucccagcacuuugggaggcugaggcaggcg

SEQ ID NO: 176326 - RNA, 64 nt, Human
aaagcaaagaagagaagugacuuuuccuggccucucccagcaugcccugggcugagaugagaug

SEQ ID NO: 176327 - RNA, 64 nt, Human
agagcuggccaggugugguggcucaugccuguaaucccagcacuuugggaggcugaggugggca

SEQ ID NO: 176328 - RNA, 64 nt, Human
cucaccagccuuggagucuguucuagggaaggccucccagcaucugggacucgagagugggcag

SEQ ID NO: 176329 - RNA, 64 nt, Human
acucuugcucuacgaggagcaagugccugcccccucccagcagccagcccugccaaaguugcau

SEQ ID NO: 176330 - RNA, 64 nt, Human
cauuuaauaccacucauuuuucccauggaucucuucccagcagcauucagaccucagaugcaug

SEQ ID NO: 176331 - RNA, 64 nt, Human
caagacgggccggcacgguggcucacgccuguaaucccagcacugagaggccgaucacuugagg

SEQ ID NO: 176332 - RNA, 64 nt, Human
aagaugggccaggugcgguggcucacaccuguaaucccagcauuuugggaggccaaggugggug

SEQ ID NO: 176333 - RNA, 64 nt, Human
uuaagcagccgggcaugguggcucacgccuguaaucccagcacuuugggaggccgaggcggauc

SEQ ID NO: 176334 - RNA, 64 nt, Human
cuggaaguaaggaaacauguaaugauaggcggacucccagcacagaaaaaaagguagaucugaa

SEQ ID NO: 176335 - RNA, 64 nt, Human
agcugccauguuuaggaaacacacuguacccugcucccagcaucacaaggcacuugucuacaag

SEQ ID NO: 176336 - RNA, 64 nt, Human
uagcccccauaucuggcuguccuuggguaacagcucccagcaggcccuaagucuggcuucagca

SEQ ID NO: 176337 - RNA, 64 nt, Human
agcaggauugagggagccaggggaggggcaggagucccagcaccaucgguucauagugugcuug

SEQ ID NO: 176338 - RNA, 64 nt, Human
cgugcuggaagacuuagaucugagcccucccucuucccagcacaggcagggguagaagcaaagg

SEQ ID NO: 176339 - RNA, 64 nt, Human
cccgggggaggggggaguugggggcuggauagcuucccagcacccucagagcccccgcccggcu

SEQ ID NO: 176340 - RNA, 64 nt, Human
cccugugguugccugcccuccugagccuccgccuucccagcagcggcaccaaggggccuuaggg

SEQ ID NO: 176341 - RNA, 64 nt, Human
uugguguuaauagaccaaauaaauaaauaaauauucccagcagcuugaaguucuguuaaauauu

SEQ ID NO: 176342 - RNA, 64 nt, Human
auuagcagccaggugcaguggcucacgccuguaaucccagcacuuuaggaggccgaggcuggca

SEQ ID NO: 176343 - RNA, 64 nt, Human
aucagcuucaucaaaacagaagaaaaaggcuaagucccagcaauacaaaggacauaagaaaagu

SEQ ID NO: 176344 - RNA, 64 nt, Human
aucuccuccucuucuuccuguccaugccggccccucccagcaccagcucugcucaggccccuuc

SEQ ID NO: 176345 - RNA, 64 nt, Human
ccagagcccgcaaauggacucggagccgagggccucccagcagagcuugggaagggccauggac

SEQ ID NO: 176346 - RNA, 64 nt, Human
auagccagccaggggcgguggcucaugccuguaaucccagcacuuugggaggccaaggcgggug

SEQ ID NO: 176347 - RNA, 64 nt, Human
caccugggcugggcgcgguggcucacgccuguaaucccagcacuuugggaggccaaggugggcg

SEQ ID NO: 176348 - RNA, 64 nt, Human
ugccuccagcccuggcugcaaugucucuaccacaucccagcaccagggggagcaaacccugccc

SEQ ID NO: 176349 - RNA, 64 nt, Human
gcuuuuggccaggcgcaguggcucacgcuuguaaucccagcacuuugggaggccgaggcaggcg

SEQ ID NO: 176350 - RNA, 64 nt, Human
gagauucugacucuuaaucuguauugugagaaaaucccagcaaguuccaugauauuaaauccag

SEQ ID NO: 176351 - RNA, 64 nt, Human
gcucuuggccgggcgcgguggcucacgccuguaaucccagcacuuugggaggccgaggcgggug

SEQ ID NO: 176352 - RNA, 64 nt, Human
gggcuuucuggcugcucuucauugaccuguguguucccagcacacgaacagugccccuaacgga

SEQ ID NO: 176353 - RNA, 64 nt, Human
gugggagagaaucaagcuccuguggccaccugugucccagcagcagugaguggagcugcucagg

SEQ ID NO: 176354 - RNA, 64 nt, Human
aagugcucccaucgccccggugcccaccaugagcucccagcaccugacuccccccacauccaag

SEQ ID NO: 176355 - RNA, 64 nt, Human
caggggacacaguuguccuugugucugaaccaugucccagcacgggaauucuagacauacgugg

SEQ ID NO: 176356 - RNA, 64 nt, Human
gguccuuuuugggggacuuugacagccauaucccucccagcacaccaggcgccaggugagcugg

SEQ ID NO: 176357 - RNA, 64 nt, Human
aaucuuggcugggcacgguggcucacgccuguaaucccagcacuuugggaggcugaggcaggug

SEQ ID NO: 176358 - RNA, 64 nt, Human
ucaguucugcagggcugcucaguucacaggaggcucccagcagccaccccacauccagccuaca

SEQ ID NO: 176359 - RNA, 64 nt, Human
uuugggggccaggcacgauggcucaaaccuguaaucccagcacuuugggagaccaaggcgggug

SEQ ID NO: 176360 - RNA, 64 nt, Human
uuuguuggccgggcaugguggcucacgccugaaaucccagcacuuugggaggccaaggugggcg

SEQ ID NO: 176361 - RNA, 64 nt, Human
cauuuaggccggacgcgguggcuuacgcuuguaaucccagcacuuugggaggcugaagcaggcg

SEQ ID NO: 176362 - RNA, 64 nt, Human
gucaccggccgggcacgguggcucacgccuguaaucccagcacuuugggaggccgaggcgggug

SEQ ID NO: 176363 - RNA, 64 nt, Human
auaaagggcugagugcgguggcucacgccuguaaucccagcacuuuggggagcccaggcgggca

SEQ ID NO: 176364 - RNA, 64 nt, Human
aaagugggggaaguggcuccuggcaggagauuucucccagcacuaauauccugguguucuauaa

SEQ ID NO: 176365 - RNA, 64 nt, Human
aaaauuccuauaaggaagauuuggaagcucuucuucccagcacuaugcuuuccuucuuugggau

SEQ ID NO: 176366 - RNA, 64 nt, Human
cccccagcgggcuggccccagcaccuucugcccuucccagcaccuugugcccuugccagugaac

SEQ ID NO: 176367 - RNA, 64 nt, Human
agauguggccgggcacaguggcucacaccuguaaucccagcacuuugggaggcugaggcgggug

SEQ ID NO: 176368 - RNA, 64 nt, Human
cucuuuuacacuuuuguacuccucagagcagugcucccagcauuguuuucuuucaggauccuuc

SEQ ID NO: 176369 - RNA, 64 nt, Human
uaacagauguugaaaacuaaauuuucuacuguauucccagcacgggugacuucuuuuucucuuc

SEQ ID NO: 176370 - RNA, 64 nt, Human
cagaggcaguaccugggcaagcuggcggcuggggucccagcagcugccaggagcacggcucugu

SEQ ID NO: 176371 - RNA, 64 nt, Human
caaaugcaugucauguauucucaauaggcuguauucccagcagucaauaaaugaacacccguaa

SEQ ID NO: 176372 - RNA, 64 nt, Human
ccucuuggccgggugugguagcccacgccucuaaucccagcacuuugggaggcugaggcgggga

SEQ ID NO: 176373 - RNA, 64 nt, Human
agcuuuggcugggcaugguggcuuaugccuguaaucccagcacuuugggaggcuacgaugggug

SEQ ID NO: 176374 - RNA, 64 nt, Human
gccuuagaaacagaauuccuaaggggauugacucucccagcauguucccagguccugcacccuu

SEQ ID NO: 176375 - RNA, 64 nt, Human
guuggcggccgggugcaguggcucacgccuguaaucccagcacuucgggaggccgaggcgggug

SEQ ID NO: 176376 - RNA, 64 nt, Human
ccggcccgaggcgcccaggccugagccccaugccucccagcaaccagggcccgcggguguggcc

SEQ ID NO: 176377 - RNA, 53 nt, Human
aggaggaggccggcuacugaggcucccagcacgcucucuccccacaucgucug

SEQ ID NO: 176378 - RNA, 64 nt, Human
ucaccuccagcccggucucacccaugguccagucucccagcagcagcaacauccccacgcagcc

SEQ ID NO: 176379 - RNA, 64 nt, Human
uccccaaacccagcaaaccggcagagagccgguuucccagcagccggagcccugcaggagaggc

SEQ ID NO: 176380 - RNA, 56 nt, Human
ucucucuucaggaacgcugaggcccuucccagcagcagaaucuguugaguugcugc

SEQ ID NO: 176381 - RNA, 64 nt, Human
caggagggccgggcgcaguggcucacgccuguaaucccagcacuuugggaggccgaggcaggcg

SEQ ID NO: 176382 - RNA, 64 nt, Human
aaaauaaucagggcacaguggcucaugccuguaaucccagcacucugggaggcugaggugggug

SEQ ID NO: 176383 - RNA, 64 nt, Human
ggaaauggccauacaugguggcugacgccuguaaucccagcacuuugggaggccgaggcaggag

SEQ ID NO: 176384 - RNA, 64 nt, Human
gcugggagaagagguggccuggaguaccccgagaucccagcagcgcacacaguggagggaugag

SEQ ID NO: 176385 - RNA, 64 nt, Human
cggugaggccgggcgcaguggcucacgccuguaaucccagcacuuugggaggccgaggcgggug

SEQ ID NO: 176386 - RNA, 64 nt, Human
aauuuggccagacacaggugccucacgccuguaaucccagcacuuugggaggcugagcuggauc

SEQ ID NO: 176387 - RNA, 64 nt, Human
ggccuuggcugggcaugguggcucacgccuguaaucccagcacuuugggaggccgaggucagga

SEQ ID NO: 176388 - RNA, 64 nt, Human
ccuuagggccgagugcgguggcucacgccuauaaucccagcacuuugggaggccgaggcgggcg

SEQ ID NO: 176389 - RNA, 64 nt, Human
ggcauuggcugggcaugguggcucacgccuguaaucccagcacuuugggaggccgaggucagga

SEQ ID NO: 176390 - RNA, 64 nt, Human
acuugucuggcaaacaggagaugcuggauuucaaucccagcagggccucacuaguugagguauu

SEQ ID NO: 176391 - RNA, 64 nt, Human
ggcucuggcugggugugguggcucacaccuguaaucccagcacuuugggaggcugaggcaggag

SEQ ID NO: 176392 - RNA, 64 nt, Human
auuuggaccccagcacaguggcucacgccuguaaucccagcacuuuggcaggccaagguggaag

SEQ ID NO: 176393 - RNA, 64 nt, Human
ucucccggcugggcacgguggcucaugccucuaaucccagcacuuugggaggcugaggcugggg

SEQ ID NO: 176394 - RNA, 64 nt, Human
auccuuggcagggcacgguagcucacaccuguaaucccagcacuuuaggaggucaaggugggca

SEQ ID NO: 176395 - RNA, 64 nt, Human
acugcaagccgggcucaguggcucaugccuguagucccagcacucuguggggccgaggcaggca

SEQ ID NO: 176396 - RNA, 64 nt, Human
aggagaggccaggccugguggcucacgccuguaaucccagcacuuuaagaggccaaggcggaug

SEQ ID NO: 176397 - RNA, 64 nt, Human
gagagauagugggugugguggcucacaccugcaaucccagcacuuuggaaggccgaggugggca

SEQ ID NO: 176398 - RNA, 64 nt, Human
acuggggcacugcccguggccuggguaggacauuucccagcaagggcuggaggaguugccgugc

SEQ ID NO: 176399 - RNA, 64 nt, Human
cucgcaggccaggcacgguggcucaugccuguaaucccagcacuuugggaggccaagacgggcg

SEQ ID NO: 176400 - RNA, 64 nt, Human
gaaguaauggcgcuagugugggacgaagcacagaucccagcacuuuucccagcuuucucuccag

SEQ ID NO: 176401 - RNA, 64 nt, Human
aauucuggcugggugcgguggcucacaccuguaaucccagcacuuugggaggcugagacgggug

SEQ ID NO: 176402 - RNA, 64 nt, Human
uauuggccgggugcgguggcuuaugcaaaauggcucccagcauuuugggaggcugaggugggug

SEQ ID NO: 176403 - RNA, 64 nt, Human
aaaagaggcugggcgugguggcucacgccuguaaucccagcacuuugggaggccgaggcaggug

SEQ ID NO: 176404 - RNA, 64 nt, Human
uuccaaaauuccaucccuaagaauucccagauagucccagcagccuccccacguggcaccuccu

SEQ ID NO: 176405 - RNA, 64 nt, Human
uugaggccuugccguccaccgucucuccuuuguuucccagcaucuggcugggaugugaagggca

SEQ ID NO: 176406 - RNA, 64 nt, Human
aguucuggccaggugcgguggcucacgccuguaaucccagcacuuugggaggccgaggcaggca

SEQ ID NO: 176407 - RNA, 64 nt, Human
uucacacacccuuaagcgguggacuccagcauuuucccagcacugucugagccccaugagggcg

SEQ ID NO: 176408 - RNA, 64 nt, Human
gcuccuagcggggcgcaguggcucacgccuguaaucccagcacuuugggaggcugaggugggug

SEQ ID NO: 176409 - RNA, 64 nt, Human
auaaugggccaggugaaguggcucacaccuguaaucccagcacuguggaaagacaggaguucga

SEQ ID NO: 176410 - RNA, 64 nt, Human
aaugcgggccaggcacaguggcucacaccuguaaucccagcacuaugggaggcccaggugagca

SEQ ID NO: 176411 - RNA, 64 nt, Human
cuccugccugacccccaggcuucucucuccuuucucccagcaaacugcaguggcagaaaggagg

SEQ ID NO: 176412 - RNA, 64 nt, Human
acugguggcugggcgugguggcucacgccuguaaucccagcacuuugggaggccgaggcgggca

SEQ ID NO: 176413 - RNA, 64 nt, Human
cccagccucacaggccuguggccccacacaccagucccagcaaggugaccacggcugcuggacc

SEQ ID NO: 176414 - RNA, 64 nt, Human
gcuuucugcagcagaaagacccucauugucaguuucccagcaaaagucccagggcagacucuca

SEQ ID NO: 176415 - RNA, 64 nt, Human
ugcaugcaaccagcccugugauuccacgugcagaucccagcagccuguuggggcaggggugcca

SEQ ID NO: 176416 - RNA, 64 nt, Human
gugcugggccgggcgcgggggcucacgccuguaaucccagcacuuugggaggccgaggugggag

SEQ ID NO: 176417 - RNA, 64 nt, Human
gcguccggcucaggacccaguuuuggcugcugguucccagcaggggacucgggggauauacagu

SEQ ID NO: 176418 - RNA, 64 nt, Human
ccucucggccgggugcaguggcuuaugcuuguaaucccagcacuuugggaggccaaggcaggag

SEQ ID NO: 176419 - RNA, 64 nt, Human
ggauugggccaggugcaguggaucacgccuguaaucccagcacauugggaggccaaggcacaua

SEQ ID NO: 176420 - RNA, 64 nt, Human
acucagggcccggagcgguggcucacaccuguaaucccagcacuuugagaggccaaggagggag

SEQ ID NO: 176421 - RNA, 64 nt, Human
gacuuaguagccgucuuggugaucagaucaacuaucccagcaucacagugccugugcccaagca

SEQ ID NO: 176422 - RNA, 64 nt, Human
ucucuaggcugggcaugguggcucaugccuauaaucccagcacuuuaggagccccagacaggag

SEQ ID NO: 176423 - RNA, 64 nt, Human
cccugacccccaugccuccugacggggagacaccucccagcagggguccacagacaccucauac

SEQ ID NO: 176424 - RNA, 64 nt, Human
caugaauuguuuauuugcagugaugcuucauauuucccagcacuguucaugguaucuuauuucc

SEQ ID NO: 176425 - RNA, 64 nt, Human
uguauaggcugggugcgguggcucaugccuguaaucccagcacuuugggaggccaaggcaggug

SEQ ID NO: 176426 - RNA, 64 nt, Human
ugcaagggucaggcgcaguggcucacaccuguaaucccagcacuuugggaggccgaggugggug

SEQ ID NO: 176427 - RNA, 64 nt, Human
agauggagccgggugcaguugccaacacuuguaaucccagcaguuugcgaggccgaggcaggug

SEQ ID NO: 176428 - RNA, 64 nt, Human
acaggugagugggcaugguggcucaugccuguaaucccagcacuuuggaaggcugaggugggug

SEQ ID NO: 176429 - RNA, 64 nt, Human
gccaggggccgggcacggugccucacaccuguaaucccagcacuuagguaggccaaggugggug

SEQ ID NO: 176430 - RNA, 64 nt, Human
caggguguccccucgggcccaucugugucccaugucccagcacccaggccucucuccaggucuc

SEQ ID NO: 176431 - RNA, 64 nt, Human
ugccacuaugcgcaccaagguuuccccacauccuucccagcacccuuaggaaggcccaggcagg

SEQ ID NO: 176432 - RNA, 64 nt, Human
ugccgugcgugucacuccugccauuaugucagaaucccagcagaggggauguugcagcugugau

SEQ ID NO: 176433 - RNA, 64 nt, Human
ccuggggguggcagacgagcccacggcgccguggucccagcagcaggguugucagucggagcau

SEQ ID NO: 176434 - RNA, 64 nt, Human
ccgacccuccucgggaaccggccagccgcguggcucccagcauccaucaggacaagcccacgug

SEQ ID NO: 176435 - RNA, 64 nt, Human
aaaauuagccaggcgugguggugggcaccuguagucccagcaacucgggaggcugaggcaggag

SEQ ID NO: 176436 - RNA, 64 nt, Human
gccuuuggccgggugcgggggcucacgccuguaaucccagcacuuugggaggcccaggugggcg

SEQ ID NO: 176437 - RNA, 64 nt, Human
aagacaggccgggcgcgguggcucacgucuguaaucccagcacuuugggaggcugaggcgggcg

SEQ ID NO: 176438 - RNA, 64 nt, Human
aauauaggccgggugcgguggcucacaccuguaaucccagcacuuugggaggcugaggcgggcg

SEQ ID NO: 176439 - RNA, 64 nt, Human
acagccggccaggcgcgguggcucacgccuguaaucccagcacuuugggaggacgaggcaggcg

SEQ ID NO: 176440 - RNA, 64 nt, Human
ugaugaggccgggugcgguggcucacaccuguaaucccagcacuuugggaggccgaggcaggcg

SEQ ID NO: 176441 - RNA, 64 nt, Human
aaggguggacaggcgcuguggcucacgccuguaaucccagcacuuugggaggcugagguaggag

SEQ ID NO: 176442 - RNA, 64 nt, Human
uagacuccuaugccccaaccauugggucaugggaucccagcauccagauccuggauccuagacu

SEQ ID NO: 176443 - RNA, 64 nt, Human
agcagaggcugggcgugguggcucucgccuguaaucccagcacuuugggaggccaaggcaggcg

SEQ ID NO: 176444 - RNA, 64 nt, Human
aagaagcugcaugaaaauuacuuaauuccuguaaucccagcauuuugagaggcugaggugggug

SEQ ID NO: 176445 - RNA, 64 nt, Human
auugccuguuuauggccagauuuggggggccuguucccagcacauuuuccuguaagcacucagg

SEQ ID NO: 176446 - RNA, 64 nt, Human
agauccucucaucuguggccaggcacgccuguaaucccagcacuuugggaggccgaggugaaag

SEQ ID NO: 176447 - RNA, 64 nt, Human
gugagggcagguccuggacuuggcaguuucuugcucccagcacccgccccuuccucaccucuuc

SEQ ID NO: 176448 - RNA, 64 nt, Human
uaaggaggccaggugugguggcucaugccugcaaucccagcacuguagaaggcagaggccggca

SEQ ID NO: 176449 - RNA, 64 nt, Human
auuaccggccaggcguggugacucacgucuguaaucccagcacuuugggagggcaaggcaagag

SEQ ID NO: 176450 - RNA, 64 nt, Human
agguuuggccgggugcaguggcucaugccuauaaucccagcacuuugggaggccgaggcaggcg

SEQ ID NO: 176451 - RNA, 64 nt, Human
acaugaggcugggcacaguggcucacgccuguaaucccagcacuuagggugggcaaauugcuug

SEQ ID NO: 176452 - RNA, 64 nt, Human
ccuuauggccaggugcaguggcucacguauguaaucccagcacuuugggaagccaaggagggag

SEQ ID NO: 176453 - RNA, 64 nt, Human
agacagagggggagccccaagcccaagucuuuccucccagcagcguuuccccccaacuccuuaa

SEQ ID NO: 176454 - RNA, 64 nt, Human
cauggacugcaucuaacugcaggaacccagagugucccagcacgccgggaggggcaaccaggcc

SEQ ID NO: 176455 - RNA, 64 nt, Human
gcuccuggccaggcacaguggcucacgccuauaaucccagcacuuugggaggcugaggugguca

SEQ ID NO: 176456 - RNA, 64 nt, Human
gaauuuggccaggcacggugaugcauaccuauaaucccagcacuucgggaggccguggugagag

SEQ ID NO: 176457 - RNA, 64 nt, Human
uuccccggccaggcacaguggcucacaccuguaaucccagcacuuugggaggccaagaugggcg

SEQ ID NO: 176458 - RNA, 64 nt, Human
ccuccacccccaccccacccccgcacgccuguaaucccagcacuuggggaggccaaggcgggag

SEQ ID NO: 176459 - RNA, 64 nt, Human
cucugaggccgagcacaguggcccaugccuauaaucccagcacuuugggaggcugaggcaggug

SEQ ID NO: 176460 - RNA, 64 nt, Human
cuggaaggccaggugcagugucucaccccugucaucccagcacuuugagaggccaaggcgggcg

SEQ ID NO: 176461 - RNA, 64 nt, Human
aaaaaaggccaagcuuguuggcucaugccuauagucccagcacuuugggaggccaaggugcaag

SEQ ID NO: 176462 - RNA, 64 nt, Human
aaaugcugccgggugcggugacucacgccuauaaucccagcacuuugggaggcugaggcgggug

SEQ ID NO: 176463 - RNA, 64 nt, Human
gcugggcgcagcggcucacaccuguaaucccuaaucccagcacuuugggaggcugaggcagggg

SEQ ID NO: 176464 - RNA, 64 nt, Human
ccaaguggccaggugcgguggcucaugccuguaaucccagcacuuugggaggccauggcaggug

SEQ ID NO: 176465 - RNA, 64 nt, Human
ugaauuuggccuggcacaggggucacaccuguaaucccagcacuuugggaggacaaggugggug

SEQ ID NO: 176466 - RNA, 64 nt, Human
aaaauuggccaggcuugguggcucaugccuguaaucccagcacuuugggaggccgaggcgggcg

SEQ ID NO: 176467 - RNA, 64 nt, Human
auuucuggcugggcccgguggcucaugccuguaaucccagcacuuugggaggccggugggcaga

SEQ ID NO: 176468 - RNA, 64 nt, Human
ugguggagacacgcccaguggaugauccuacugcucccagcaaccucuacauccaggaaugagu

SEQ ID NO: 176469 - RNA, 64 nt, Human
ccaaucucuuacagcucccuccccaaaacuggggucccagcaacccuggcccccaaccccagca

SEQ ID NO: 176470 - RNA, 64 nt, Human
uugcagccaggugcaguggcucacaccuguggaaucccagcacuucaggaggccgaggugggag

SEQ ID NO: 176471 - RNA, 64 nt, Human
aguuugggccaggcacaguggcucaugccuguaaucccagcacuuugggaggcugaggcaggcg

SEQ ID NO: 176472 - RNA, 64 nt, Human
ugagaucuucccugggccucugcccuggccugcuucccagcacacacuucuuuggccuaagggc

SEQ ID NO: 176473 - RNA, 64 nt, Human
aagcucggccgggcucgguggcucacuccuguaaucccagcacuuugggaggccgaggcaggca

SEQ ID NO: 176474 - RNA, 64 nt, Human
ccaccccaaccaggagcucuaguuaauggagagcucccagcacacucggagcuugugcuuuguc

SEQ ID NO: 176475 - RNA, 64 nt, Human
ggauauuccugggagucacugcugacaccaucucucccagcagucuuggggucugggugggaaa

SEQ ID NO: 176476 - RNA, 64 nt, Human
gcuguuggccgggcacgguggcucacgccuguaaucccagcacuuugggaggcugaggcagguc

SEQ ID NO: 176477 - RNA, 64 nt, Human
cagcugcugcccuccacagcgguucuucacaggaucccagcaaugaacuguucuagggaaagug

SEQ ID NO: 176478 - RNA, 64 nt, Human
aaaauuagccaggcgcauuggcucaugucuguaaucccagcacuuugggaggucgggggggugg

SEQ ID NO: 176479 - RNA, 64 nt, Human
aggguuggccaggcacggugguucaugccuguaaucccagcacuaugggaggccgagacgggcg

SEQ ID NO: 176480 - RNA, 64 nt, Human
caucuggccagggcacaguggcucacgccuguaaucccagcacuuugggagguugaggugggca

SEQ ID NO: 176481 - RNA, 64 nt, Human
agaucaggccaggcacggaggcucauguaaguaaucccagcacuuugggaggccgagacgggcc

SEQ ID NO: 176482 - RNA, 64 nt, Human
aaaauagaccaggugcucuggcucaugccuguaaucccagcacuuugggaggccaaggugggca

SEQ ID NO: 176483 - RNA, 64 nt, Human
ugcacaggacaggugugguggcucacaccuguaaucccagcacuuugggaggccgaggcaagag

SEQ ID NO: 176484 - RNA, 64 nt, Human
ggauugggccaggcguggugucucacaccuguaaucccagcacuuugagaggccaagacaggua

SEQ ID NO: 176485 - RNA, 64 nt, Human
gagagaggccaggcgcgguggcucacaccuguaaucccagcacuuugggaggcugaggcaggug

SEQ ID NO: 176486 - RNA, 64 nt, Human
aaaggacgccgggcgugguggcucacgccuguaaucccagcacuuugggaggccgaggcggggg

SEQ ID NO: 176487 - RNA, 64 nt, Human
uaagacuuccaagccagaagacagaggguucgaaucccagcacugccgucuacucacuguagua

SEQ ID NO: 176488 - RNA, 64 nt, Human
aaaauuagccaggugugguggugcaucccuauacucccagcaacucagggggcugaggugggag

SEQ ID NO: 176489 - RNA, 64 nt, Human
gaugcuggcuggguggggugacucacgccuguaaucccagcacuuugggaggccgaggcaggug

SEQ ID NO: 176490 - RNA, 64 nt, Human
aaucucagcuggguguuuuggcucaggccuguaaucccagcacuuugggaggcugaggugggug

SEQ ID NO: 176491 - RNA, 64 nt, Human
ugcugccucuuacucccugggcaccucggccuggucccagcagguaugggcaguugcuugaggc

SEQ ID NO: 176492 - RNA, 64 nt, Human
aauccaacaugggacggacacugacagacaguacucccagcaggcccaggccagccagggcuuc

SEQ ID NO: 176493 - RNA, 64 nt, Human
aggacccaagcccagcucacucugggaacuguguucccagcaucucuguccucuugauuaagag

SEQ ID NO: 176494 - RNA, 64 nt, Human
acaacagauauuccagaccaaaauaauacaacaaucccagcaucugauugagucaguguuugcu

SEQ ID NO: 176495 - RNA, 64 nt, Human
ucauagacggcaggugcccaccuuucagggagucucccagcaugggcggaugccgggcaugagc

SEQ ID NO: 176496 - RNA, 64 nt, Human
caauaugaggccaggugguggcucaugccuguaaucccagcacuuugggaggccaaggcaggcg

SEQ ID NO: 176497 - RNA, 64 nt, Human
aauuuaggccaagugugguggcucaugccuguaaucccagcacuuugcgaggccgaggugggca

SEQ ID NO: 176498 - RNA, 64 nt, Human
cuggcuggugggaugggggaggguggggagcagcucccagcaccccugcugugugguucaucuu

SEQ ID NO: 176499 - RNA, 64 nt, Human
acuaucagcugggugcaguggcucacgucuguaaucccagcacuuugggaggccgaggcaggug

SEQ ID NO: 176500 - RNA, 64 nt, Human
caacuuggauuagaggggcccauaugucagaagcucccagcaccuccuacuugggagaaaagug

SEQ ID NO: 176501 - RNA, 64 nt, Human
aucugugauaggcaugaagaaucgagaggaaagaucccagcauuuuuucgacacaucaguacca

SEQ ID NO: 176502 - RNA, 64 nt, Human
aaguaauucuuggcguggugguucacgccuguaaucccagcacuuugggaggccgaagcgggcg

SEQ ID NO: 176503 - RNA, 64 nt, Human
agaacauucugggcacgguggcucaugccuguagucccagcacuuugggaggccgaggcuggug

SEQ ID NO: 176504 - RNA, 64 nt, Human
cagcauggccgggcaugguggcucaugccuauuaucccagcacuuugggaggccaaggugggug

SEQ ID NO: 176505 - RNA, 64 nt, Human
uguuggcuauaggcgugguggcucaugccuauaaucccagcacuuugggaagccgggguaggag

SEQ ID NO: 176506 - RNA, 64 nt, Human
uguaggccaugcaggccuuugucgcagcaaaccuucccagcagcccuugagccaaguaaaacca

SEQ ID NO: 176507 - RNA, 64 nt, Human
cgugcauggcuggcacaguggcuuacgccuguaaucccagcacuuugggaggcugaggcuggcg

SEQ ID NO: 176508 - RNA, 64 nt, Human
uuuuuuggcugggugugguggcucaugccuguaaucccagcacugugggaggcugaggugguug

SEQ ID NO: 176509 - RNA, 64 nt, Human
uggggacagugauaggcccaagguccccuccacaucccagcagcccaagcuuaauagcccuccc

SEQ ID NO: 176510 - RNA, 64 nt, Human
gacggaaauuucucccugcaagcgcucagucucaucccagcaagucaaagaccuccuggccaag

SEQ ID NO: 176511 - RNA, 64 nt, Human
ccucuguggcugcaaggcggucaguugcugcuugucccagcagguggccuugaucucuccaugc

SEQ ID NO: 176512 - RNA, 64 nt, Human
augaaaauuugccuuugccccggcuugccuguaaucccagcacuuugggaggccgaggugggcg

SEQ ID NO: 176513 - RNA, 64 nt, Human
aaucccuauacaaugugaauauguggaaauaauuucccagcaggaagagcauuauauucucuuu

SEQ ID NO: 176514 - RNA, 64 nt, Human
aaucccaacugggugcaguggcucacgccuguaaucccagcacuuugggaggccgaggcgggcg

SEQ ID NO: 176515 - RNA, 64 nt, Human
agaauaggcggggcacgguggcucaugccuguaaucccagcacuuugggaggcugaggcaggug

SEQ ID NO: 176516 - RNA, 64 nt, Human
cuuuuaggccaggugugguggcucacaccuguaaucccagcacuuugggaggccgaggcaggug

SEQ ID NO: 176517 - RNA, 64 nt, Human
aaauauggcugggcacaauggcucaggccuguaaucccagcauuuggaagaccaagacaggcag

SEQ ID NO: 176518 - RNA, 64 nt, Human
uuacaggcccgggcacgguggcucacaccuguaaucccagcacuuugggaggcugaggcaggca

SEQ ID NO: 176519 - RNA, 64 nt, Human
gacuuuauuacuuaacuagcggacaucccuggagucccagcagcgagcuggucuggcgagggca

SEQ ID NO: 176520 - RNA, 64 nt, Human
caaaacgcggccaguccccuucuccacugcugccucccagcagagggccccaggaucuccaagg

SEQ ID NO: 176521 - RNA, 64 nt, Human
gcgggucuggguggacaccguccccacuccggacucccagcacaggggaggauaccugagccug

SEQ ID NO: 176522 - RNA, 64 nt, Human
aagcguggccaggcacaguggcucacaccuguaaucccagcacuuugggaggccgagguggcca

SEQ ID NO: 176523 - RNA, 64 nt, Human
ucaggugaagucuucagccucccacagcgcagggucccagcaucuccacgcgcgcccgugggag

SEQ ID NO: 176524 - RNA, 64 nt, Human
cuagguuguaacagucucucccugaggagcagacucccagcaugguguagcguggcccugucau

SEQ ID NO: 176525 - RNA, 64 nt, Human
ugugcuggcuggccacgguggcuuacaccuguaaucccagcacuuugggaggccgaggcgagca

SEQ ID NO: 176526 - RNA, 64 nt, Human
uuuggaggcugggugcuguggcucacgccugcaaucccagcacuuugggagacugaggcgggcg

SEQ ID NO: 176527 - RNA, 64 nt, Human
uaaagaaguaggggugcauggcucaugccuguaaucccagcacuuuaagaggcugaggcaggag

SEQ ID NO: 176528 - RNA, 64 nt, Human
aggaugggccgggcacgguggcucacgccuguaaucccagcacacugggaggccgaggcaggug

SEQ ID NO: 176529 - RNA, 64 nt, Human
cuucuuugcugggcauggugacucacgccuguaaucccagcacuuuggaagggugaggugggug

SEQ ID NO: 176530 - RNA, 64 nt, Human
auucucggcugggcgcgguggcgcaugccuguaaucccagcacuuugggaggccaaggugggug

SEQ ID NO: 176531 - RNA, 64 nt, Human
gugaaggaaggggagcaagggguggugccccuggucccagcaugccccgcgccugagacuggcu

SEQ ID NO: 176532 - RNA, 64 nt, Human
auuacaggcugguuguggcagcucaugacuguaaucccagcacuuugggaggccaaggugggag

SEQ ID NO: 176533 - RNA, 64 nt, Human
uucaggggcugggugcggcggcucacgcauguaaucccagcacuuugggaggccaaggcgggcg

SEQ ID NO: 176534 - RNA, 64 nt, Human
gugaggaccuuagggcaugaagccuuuuuccuggucccagcagcaucugcccugugaaguuugu

SEQ ID NO: 176535 - RNA, 64 nt, Human
aguucuugcugggcacaguggcucacaccuguaaucccagcacuuugggaggcugaggugggug

SEQ ID NO: 176536 - RNA, 64 nt, Human
ccacacaacugggcauagugguucaugccuguaaucccagcacuuugggaggcugaggagggug

SEQ ID NO: 176537 - RNA, 64 nt, Human
uucccugggggccagccagggcccuuugugccccucccagcacaggccugaugcagguguccac

SEQ ID NO: 176538 - RNA, 64 nt, Human
aggcugguuagcugguagccccugagcucccucaucccagcagccucgcacacucccuaggcuu

SEQ ID NO: 176539 - RNA, 64 nt, Human
guuugcaagcuugcuuuagggcugagcccuggacucccagcagcagcacaguucagcauugugu

SEQ ID NO: 176540 - RNA, 64 nt, Human
guuuuugcuuuggggguagaggcuucuuagauucucccagcauccgccuuucccuuuagccagu

SEQ ID NO: 176541 - RNA, 64 nt, Human
gcagucccauggugauaaagggcagcccggcgggucccagcaucucgagacccucugcagaagu

SEQ ID NO: 176542 - RNA, 64 nt, Human
aaaaauaggccgggcugguggcucacgccuguaaucccagcacuuuggcaggcugaggcgggca

SEQ ID NO: 176543 - RNA, 64 nt, Human
acccggggaagguuugagggcccuugcaacccccucccagcaguggcugggcacucuuugcugc

SEQ ID NO: 176544 - RNA, 64 nt, Human
uguuuaagccgggcgcgguggcucacaucuguaaucccagcacuuugggaguccaaggaggggg

SEQ ID NO: 176545 - RNA, 64 nt, Human
agagugggccgggcgcgguggcucacgccuguaaucccagcacuuuggaggccaaggcgggugg

SEQ ID NO: 176546 - RNA, 64 nt, Human
gaaggaggcugggugcgguggcucaugcuuguaaucccagcacugggaagcuaaggcgggugga

SEQ ID NO: 176547 - RNA, 64 nt, Human
acaucagggcugggcacagcgguuccgccuguaaucccagcacuuugggagguccaggcaggug

SEQ ID NO: 176548 - RNA, 64 nt, Human
auuucuggccgggcgugguggcucaagccuguaaucccagcacuuugggaggccgaggugggcg

SEQ ID NO: 176549 - RNA, 64 nt, Human
ugaggccuagaagggaggagugguccacccacggucccagcacaaggcagagcugggaugaaaa

SEQ ID NO: 176550 - RNA, 64 nt, Human
guucagccuagguguuucacugguccucuaugaaucccagcacuuauaaucccagucuuuuauc

SEQ ID NO: 176551 - RNA, 64 nt, Human
aaaaucgguugggugcaguggcacacggcuguaaucccagcacuuugggaggccaagguuggca

SEQ ID NO: 176552 - RNA, 64 nt, Human
agugacgggggagcuguggaugguggcaggagugucccagcaagaaaggcggcauccgucugug

SEQ ID NO: 176553 - RNA, 64 nt, Human
cugagcuuccuuagaaccuuccaugguugucuuuucccagcagaugaagcauagccuccuugga

SEQ ID NO: 176554 - RNA, 64 nt, Human
uguuugggccaggcacagucgcucauacuuguaaucccagcacuuugggaggccgaggcgggug

SEQ ID NO: 176555 - RNA, 64 nt, Human
uaaucaggcuaggcacaguggcucacacauggaaucccagcacuuugggaggccgaggugggag

SEQ ID NO: 176556 - RNA, 64 nt, Human
ggcaggaggccugaccccaccccaucagucccucucccagcauugcugugcauggcucccucag

SEQ ID NO: 176557 - RNA, 64 nt, Human
aacuggggccgggugcgguggcucacgccuguaaucccagcacuuugggaggccaagaugggug

SEQ ID NO: 176558 - RNA, 64 nt, Human
ccucaguguaugggaaacccuuuccccaggcuugucccagcacugccgcuccccaccccugagc

SEQ ID NO: 176559 - RNA, 64 nt, Human
gaaauggacugggcgugguggcucacgccuauaaucccagcaguuugggaggcugaguugggca

SEQ ID NO: 176560 - RNA, 64 nt, Human
acagccccggcccccugugcagggccguaguaccucccagcagggugaagaguccaagaagcca

SEQ ID NO: 176561 - RNA, 64 nt, Human
aaguaaggucagguacaguagcucaugccuguaaucccagcacuuugggaggccgaggcaggcg

SEQ ID NO: 176562 - RNA, 64 nt, Human
auuuauggcugggcgugguggcucacaccuguaaucccagcacuuugggaggccgaggcaggug

SEQ ID NO: 176563 - RNA, 64 nt, Human
ucuccccagcacugaguccccccuccuuugugugucccagcacccuuggccugaguaaacuugg

SEQ ID NO: 176564 - RNA, 64 nt, Human
cugagaggccgggcacgguggcucacgccuguaaucccagcacuuugggaggcugagacaggca

SEQ ID NO: 176565 - RNA, 64 nt, Human
uauuggggcugggcgcaguggcucacgccuguaaucccagcacuuugggaggcugagaugggug

SEQ ID NO: 176566 - RNA, 64 nt, Human
aucaauggcugggcgcgguggcucacaccuguaaucccagcacuuugggagaccgaggcaggug

SEQ ID NO: 176567 - RNA, 64 nt, Human
uuucccggcugggcgcgguggcucacgccuguaaucccagcacuuugggaggccgaggcgggug

SEQ ID NO: 176568 - RNA, 64 nt, Human
ugugcaggccaugcgugguggcucaggccuguaaucccagcacuuugggaggccgaggugggca

SEQ ID NO: 176569 - RNA, 64 nt, Human
ugugccugaugugccuuccacuggauuuugggguucccagcaccccauguggauuuuggggggu

SEQ ID NO: 176570 - RNA, 64 nt, Human
aaaccaggccaggcgugguggcucacgccuguaaucccagcacuuugggaggccgaggcuggug

SEQ ID NO: 176571 - RNA, 64 nt, Human
uugaaauaacuccuccccaccccaacaacaacauucccagcagaccaacucccacccccucuuu

SEQ ID NO: 176572 - RNA, 64 nt, Human
ggagauauccucaggaagcacaucuguagugcacucccagcaggccauggacuagucacuaacc

SEQ ID NO: 176573 - RNA, 64 nt, Human
aauauuggccgggcgcgguggcucacgccuguaaucccagcacuuugggaggccgaggcgggcg

SEQ ID NO: 176574 - RNA, 64 nt, Human
aaucuuacaguccaaggcauuaaccucaaggcccucccagcaccccauucuuguauacacaugg

SEQ ID NO: 176575 - RNA, 64 nt, Human
aauugcccaaagauuguauguaugaggcuguucaucccagcacugucuaagcuaguaaaaauug

SEQ ID NO: 176576 - RNA, 64 nt, Human
agucugggcuggguccgguggcucacgccuguaaucccagcaauuugggaguccgaggcgggcg

SEQ ID NO: 176577 - RNA, 64 nt, Human
uccauauggcugugcagccuugcucuguggcuuuucccagcacaaucagugcuagugcugggga

SEQ ID NO: 176578 - RNA, 64 nt, Human
aaauggggcugggcucaguggcucacgccuguaaucccagcacuuugggaggcugaggcaggug

SEQ ID NO: 176579 - RNA, 64 nt, Human
uccccaggccgccacugcccuugccccuuucaucucccagcagcccucaggagcgucaggauca

SEQ ID NO: 176580 - RNA, 64 nt, Human
uaaaucuucccaaguggguuuuaggguguauagaucccagcaggauuaaggagguggaaaagca

SEQ ID NO: 176581 - RNA, 64 nt, Human
gacuguccugugcgggccauagggcagggcccugucccagcagaugggcuugggagggggcucc

SEQ ID NO: 176582 - RNA, 64 nt, Human
ccaccaacucucgcguguuggagagaaggggcccucccagcacaaaguugcauuccuccccccu

SEQ ID NO: 176583 - RNA, 64 nt, Human
uuuucagguggggcaagguggcucaugccuuuaaucccagcauuuugggaggcuaaggcaggga

SEQ ID NO: 176584 - RNA, 64 nt, Human
uuaccuggccaggcaugguggcucacgccuguaaucccagcacuuugggaggccgaggcaggug

SEQ ID NO: 176585 - RNA, 64 nt, Human
caucugagcuggaugcaguggcuuguuccuauagucccagcacuuugggaggcugaggugggug

SEQ ID NO: 176586 - RNA, 64 nt, Human
ccuacaggccgggcgcaguggcucacgccuguaaucccagcauuuugggaggccgaggcaggug

SEQ ID NO: 176587 - RNA, 64 nt, Human
uuaggccaggcacagugguggcucaugccuguaaucccagcacuuugggagacugagaugggag

SEQ ID NO: 176588 - RNA, 64 nt, Human
cacccccagcccauaauugggacccagagcccuuucccagcacuuaaaacaggagccuagagcc

SEQ ID NO: 176589 - RNA, 64 nt, Human
ugacauccuagcuccugacugaacacuauagacuucccagcagcauuucacccagcagccagag

SEQ ID NO: 176590 - RNA, 64 nt, Human
uggcucgcagaugcauccugcaucccagucccccucccagcacccccagccauccccccugucu

SEQ ID NO: 176591 - RNA, 64 nt, Human
caucuaggcugggcguggcggcucacgccuguaaucccagcacuuugggaggccgaagugggug

SEQ ID NO: 176592 - RNA, 64 nt, Human
aguauccccuaaaggccacuuccuaucugauuuuucccagcaaaugaggcaggcaauucuaaga

SEQ ID NO: 176593 - RNA, 64 nt, Human
cuggggaaccugagagugccuaguccccauccugucccagcaccggcaccgcgucaggacugac

SEQ ID NO: 176594 - RNA, 64 nt, Human
gggaggccaucuggagagcccagaguccccccacucccagcaucgcacucuggcagcaccgccu

SEQ ID NO: 176595 - RNA, 64 nt, Human
ggaacacccgccagggcccaccccucccaccccgucccagcauucgcacuucacccucgcgagc

SEQ ID NO: 176596 - RNA, 64 nt, Human
aaguguggccgggugcgguggcucacgccuguaaucccagcacuuugggaggccaaggcaggag

SEQ ID NO: 176597 - RNA, 64 nt, Human
cuuccuaggucaugccuccuccccuagggaauggucccagcacgaguggccaguucauuguggg

SEQ ID NO: 176598 - RNA, 64 nt, Human; identical to SEQ ID NO: 176597

SEQ ID NO: 176599 - RNA, 64 nt, Human
caucuaggcuaggugcaguggcuuguuccuguagucccagcacucugggaaccuggguugggag

SEQ ID NO: 176600 - RNA, 64 nt, Human
agaguuuaccuggcagagugugucaugccugcaaucccagcacuuugggaggccaaggcaggca

SEQ ID NO: 176601 - RNA, 64 nt, Human
cuuuagauaaaaaugcaaaagggcagucauccugucccagcagacccuucucauuggcauuuuc

SEQ ID NO: 176602 - RNA, 64 nt, Human
auuuggggccaggcgcgguggcucacgccuguaaucccagcacuuugggaggccaaggcaggcg

SEQ ID NO: 176603 - RNA, 63 nt, Human
aaugccuuaaacugcaacgucccgucccuuccccacccccaucccauccccacccccagcccc

SEQ ID NO: 176604 - RNA, 63 nt, Human
cgucccgucccuuccccacccccaucccauccccacccccagccccagcccaguccuccuagg

SEQ ID NO: 176605 - RNA, 63 nt, Human
ucacggaaggaagaucacauguccccagagaggcacccccaggcaagcucgagggggccacac

SEQ ID NO: 176606 - RNA, 63 nt, Human
cuaccaagcucgagcuggcccuugacccccacccacccccacccuugcuggcaggggcaggga

SEQ ID NO: 176607 - RNA, 63 nt, Human
uugggguuuucugugcccaugacuugggggcugcacccccacagcacccccacaauguaggaa

SEQ ID NO: 176608 - RNA, 63 nt, Human
ugugcccaugacuugggggcugcacccccacagcacccccacaauguaggaaaagaccucagg

SEQ ID NO: 176609 - RNA, 63 nt, Human
ugcagaccacgcggggcagggcuccacugaagccacccccaccccucgccagcuagcuccaua

SEQ ID NO: 176610 - RNA, 63 nt, Human
gccucauggaagccuuugaggguaucacacagacacccccaccuuccuccagccugugcgcac

SEQ ID NO: 176611 - RNA, 63 nt, Human
cuguugugcccuuuaagagacauguuuccaccccacccccaaccuugucccaagugcccugga

SEQ ID NO: 176612 - RNA, 63 nt, Human
ggagaggggcuugggagcccacuuuuaauuucucacccccauuuuacaaagagugcuuagauu

SEQ ID NO: 176613 - RNA, 63 nt, Human
ccucugcagcuuccuccucagccucccuccuugcacccccacagguuuggcuugugguuuuug

SEQ ID NO: 176614 - RNA, 63 nt, Human
aaggcucugggggucggagacaccgcugcuuagcacccccagccagaacacccugagggucuc

SEQ ID NO: 176615 - RNA, 63 nt, Human
ggcccagccuguccaggauacaguggggcugagcacccccaggccuuccacuccucuacccuc

SEQ ID NO: 176616 - RNA, 63 nt, Human
cugggcaccagaaggcuccuggaccaugagcuucacccccagaauucccugcugacccugccc

SEQ ID NO: 176617 - RNA, 63 nt, Human
gggucaaggaacauuucauugguuuuuuuuguccacccccaucucccuugcucauuuggaugc

SEQ ID NO: 176618 - RNA, 63 nt, Human
auuucaaaacacaaaugaaaacucacacccacccacccccaagugcaugucuccaucacuuaa

SEQ ID NO: 176619 - RNA, 63 nt, Human
ccaaaggggacccaaggcugugacacuuaccuccacccccauccagcacccuucagcugugug

SEQ ID NO: 176620 - RNA, 63 nt, Human
auggacuucuccuccagggagcccacccugacccacccccacugcacccccuccccauggguu

SEQ ID NO: 176621 - RNA, 63 nt, Human
uggacugagguucaggucuccccccagcugucucacccccacuuuguccccacucuagagcag

SEQ ID NO: 176622 - RNA, 63 nt, Human
aaacuugucuucuacccugcccucuuuucuguucacccccaaaagaaaacuuacacacccaca

SEQ ID NO: 176623 - RNA, 63 nt, Human
cacacaguacugauugcucacugaaagacucagcacccccaauggugcgcggaagccaggcgg

SEQ ID NO: 176624 - RNA, 63 nt, Human
auccaggccauaccaggguaucccuugucccuucacccccauuucugaccucaguuccuggag

SEQ ID NO: 176625 - RNA, 63 nt, Human
ucacacugcaugggagauuuuguuaacgucugccacccccacucucacccccaagcucuaagc

SEQ ID NO: 176626 - RNA, 63 nt, Human
ggagauuuuguuaacgucugccacccccacucucacccccaagcucuaagcccccgggaggcc

SEQ ID NO: 176627 - RNA, 63 nt, Human
ucccgcguggaguucuccucaggucgugcgaaacacccccagauucuucgcacagugucuaga

SEQ ID NO: 176628 - RNA, 63 nt, Human
gccagugucuccugggugccuucugaggacucccacccccaucccaguaucucaucugucccc

SEQ ID NO: 176629 - RNA, 63 nt, Human
ggugggaaggucucuuuaaaauggggcaggccacacccccauuccgugccucaauuuccccau

SEQ ID NO: 176630 - RNA, 63 nt, Human
gaccagcuguggagcugaaggcacagucugccccacccccaccuccccacugugguuagucag

SEQ ID NO: 176631 - RNA, 63 nt, Human
uuuggcuucauggguuuuucugcuuccugcccccacccccacaugugcaauccucaagauuug

SEQ ID NO: 176632 - RNA, 61 nt, Human; identical to SEQ ID NO: 9105

SEQ ID NO: 176633 - RNA, 63 nt, Human
cauuguguggccacacuugggguuugccucaugcacccccaaguccugguccucucagcccug

SEQ ID NO: 176634 - RNA, 63 nt, Human
gagcuuacccaagcuguggcagccgucccaggccacccccauggaagcaauaaagcucuuccc

SEQ ID NO: 176635 - RNA, 63 nt, Human
ugcucugguccccucucuucguccugaucccuccacccccauguggcagcccauggguaugac

SEQ ID NO: 176636 - RNA, 63 nt, Human
caacuacccuccaaaccaccacagucucugucacacccccacuaccgcugccacgcccucuga

SEQ ID NO: 176637 - RNA, 63 nt, Human
guuaauagugauuuagucuccccgccucauucccacccccaacaaagcacuaucauuuucauu

SEQ ID NO: 176638 - RNA, 63 nt, Human
uugcuacuaacauaggaaacacacacauacagacacccccacucagacaguguacaaacuaag

SEQ ID NO: 176639 - RNA, 63 nt, Human
ggaccagguccccaagucccuucacaggguccccacccccacuggcuuuggugcuguccacac

SEQ ID NO: 176640 - RNA, 63 nt, Human
accaggcggaggggcugcuuuucugcccuuccucacccccacgccccaccccacucccccaga

SEQ ID NO: 176641 - RNA, 63 nt, Human
uagcccauaccccaaauaacugucuauauuagacacccccagccaguuucuggcugccugucu

SEQ ID NO: 176642 - RNA, 63 nt, Human
accuagccuuuccuuauccccuucccuucccuucacccccauccucuuacuccuuucaugucc

SEQ ID NO: 176643 - RNA, 63 nt, Human
aauuccagguuaacuuuguuggagaauuucccccacccccauccagugggucacccaggagua

SEQ ID NO: 176644 - RNA, 63 nt, Human
uaucccucuccauaaccccacccuugcccaccccacccccacccccaccaagggcgcaagagu

SEQ ID NO: 176645 - RNA, 63 nt, Human
ucuccauaaccccacccuugcccaccccacccccacccccaccaagggcgcaagaguagcggu

SEQ ID NO: 176646 - RNA, 63 nt, Human
gagaaaggaaugugggggguuuccgcugccccccacccccagcggcccaccccaugccucagc

SEQ ID NO: 176647 - RNA, 63 nt, Human
gcccccagagagagcaaaucgaagcgugggaggcacccccauugcucuccuccaggggcagaa

SEQ ID NO: 176648 - RNA, 63 nt, Human
cccguucucuccauugcuuguuagccaggcccccacccccacugagucugcccuaugaccugc

SEQ ID NO: 176649 - RNA, 63 nt, Human
uuuccuuccugcccuguaccucucucugcuccucacccccaccccuguacccagccaccuucc

SEQ ID NO: 176650 - RNA, 63 nt, Human
acuugacuucugugaguuuagaccugccccucccacccccacccugccacuaugagcuagugc

SEQ ID NO: 176651 - RNA, 63 nt, Human
agaggcuuguuugcuuugcccucuuuuccuggucacccccacucccuaccccugacucauaua

SEQ ID NO: 176652 - RNA, 63 nt, Human
acuccaggcuucuucagauagguucagcccacccacccccaugauuguaugaaguuuuaaaaa

SEQ ID NO: 176653 - RNA, 63 nt, Human
uggauguucuagaaaugaguaagacacagugcccacccccaaguuaggaugaaaaaaguucca

SEQ ID NO: 176654 - RNA, 63 nt, Human
aaaaagaaagcaaugauaauagcgguggauacccacccccacaaaugcacccaagagacaagc

SEQ ID NO: 176655 - RNA, 63 nt, Human
aggagggucucaaacuccugaccucaggcgauccacccccaccucggcuucccaaagugcuga

SEQ ID NO: 176656 - RNA, 63 nt, Human
ccucccuuacucuccccccccaccaccacccuccacccccaacucaugaaaagauucuaugga

SEQ ID NO: 176657 - RNA, 63 nt, Human
uggagggaaguuuauaauagccuaacacuaccccacccccaacuaggaggaaccucuguuuuc

SEQ ID NO: 176658 - RNA, 63 nt, Human
gaaguaaugggguguggggugccaccagaccaacacccccagacuuccccaccuucagccacc

SEQ ID NO: 176659 - RNA, 63 nt, Human
uccugccagcacauguuucugggucuuggaggucacccccaccccgcggaucacagcucaccc

SEQ ID NO: 176660 - RNA, 63 nt, Human
gguuggcgacugucuacacuccucccccgagaccacccccacccuggggaagcguugacuacu

SEQ ID NO: 176661 - RNA, 63 nt, Human
accugggaucagggaagcugcuggcaucguccccacccccagccugggggucugggcuggggc

SEQ ID NO: 176662 - RNA, 63 nt, Human
ggcgguccccauccccaccagcucguuuuucagcacccccacccaccuccacccagccccugg

SEQ ID NO: 176663 - RNA, 63 nt, Human
caccagcugggcgacgucacccugcucccaccccacccccaaguucuaaggucucuucagagc

SEQ ID NO: 176664 - RNA, 63 nt, Human
gugggcugaggucagagguugguggggugucaucacccccauugucccuagggugacaggcca

SEQ ID NO: 176665 - RNA, 63 nt, Human
cacagauuugagucagaacuggaaagugucccccacccccaccacccucgagcgggguucccc

SEQ ID NO: 176666 - RNA, 63 nt, Human
gcagccacauccuuguacagaggcauagguuaccacccccaccccggcccgggauacugcccc

SEQ ID NO: 176667 - RNA, 63 nt, Human
uccuaggguugccugagagccaaccucuccugccacccccacaccaagaacuauaugguuccu

SEQ ID NO: 176668 - RNA, 63 nt, Human
gcaccuuucugagcuuauucuauuccccacccacacccccaggcaggguuggaaaugaaggac

SEQ ID NO: 176669 - RNA, 63 nt, Human
aggaauccacagcccacacgugagcucccuccucacccccaggcagggaagccccuccugcca

SEQ ID NO: 176670 - RNA, 63 nt, Human
ccaaggaugcgccucucuggaguucacgugcugcacccccagggaggggccuggggaaagcug

SEQ ID NO: 176671 - RNA, 63 nt, Human
gaucuggcugagggcucaggacacaggcccagccacccccaggggccuccacaggccgcugca

SEQ ID NO: 176672 - RNA, 63 nt, Human
aucaccuccagccugacucccugucugcccuuucacccccaagauuuugcacagguuaaggcc

SEQ ID NO: 176673 - RNA, 63 nt, Human
uuuucucacugcuuugacucugccggacuuugucacccccacgaccugguguugggucugaac

SEQ ID NO: 176674 - RNA, 63 nt, Human
aaauuugauucuaaguugaauugcuucauucaacacccccacccucccuccccucgagguggu

SEQ ID NO: 176675 - RNA, 63 nt, Human
gaagccuaaauucagcaucuccccuuccacccucacccccaggucccagccucccacucagca

SEQ ID NO: 176676 - RNA, 63 nt, Human
augagaaguacaggcaagugguuugucuuuauccacccccacuguuguggucagccccagaga

SEQ ID NO: 176677 - RNA, 63 nt, Human
ucauuaaacaugacauuagcauugugguuuuagcacccccauggguuuugcuuaggcacucau

SEQ ID NO: 176678 - RNA, 63 nt, Human
gcuccuuggggcaaagguacuaaucccuuucagcacccccacuccauuccccuuuuuaaugua

SEQ ID NO: 176679 - RNA, 63 nt, Human
aacacaggcucucacaagaucagaacccccacucacccccaagaucuuaucuagcaagccugu

SEQ ID NO: 176680 - RNA, 63 nt, Human
ccucacacuaaaacggcguagauggcaaccccccacccccaccccgcugcucaacucuugugu

SEQ ID NO: 176681 - RNA, 63 nt, Human
aagggaggggcaggaugggccauggaggugccccacccccacaccugacaaucacccacacuc

SEQ ID NO: 176682 - RNA, 63 nt, Human
gugccacaccugcgcugauucuugugugugcugcacccccaaggugugugggugcuggcugag

SEQ ID NO: 176683 - RNA, 63 nt, Human
gugccgagcccugcauguggagcccucccaccccacccccagauagagggaaauaaccaaaaa

SEQ ID NO: 176684 - RNA, 63 nt, Human
cugugguugcuguucugaguacugcucucaucacacccccacagagggggucuuaccacacaa

SEQ ID NO: 176685 - RNA, 63 nt, Human
aauuauaugaguguaugaauuugucacauguaucacccccaaaaaaagagaaaaagaaaaaua

SEQ ID NO: 176686 - RNA, 63 nt, Human
uuuuuaaaaguuuaugacaguuggcuccccccccacccccagcaaccccaucccagaauccua

SEQ ID NO: 176687 - RNA, 63 nt, Human
cacacaauguggacgugcacugacagccuugcccacccccaccaugcagccccugggcccuug

SEQ ID NO: 176688 - RNA, 63 nt, Human
gagauuuuagcucaucuugggggccuccuuaaacacccccauuucuugcggaagaugcucccc

SEQ ID NO: 176689 - RNA, 63 nt, Human
agggcugugcugcuaguggguaccucagucacacacccccaaccccaggcagccucuagagcc

SEQ ID NO: 176690 - RNA, 63 nt, Human
gacuuagcugucagugugacuuccuuucccacccacccccagaaaaacagaaagagcaucugg

SEQ ID NO: 176691 - RNA, 63 nt, Human
uacccuccuuccccacaagcccccuccaacccccacccccaugcucuggaccucauggcuccu

SEQ ID NO: 176692 - RNA, 63 nt, Human
cucccacaaccggccaaguuaugucuuauuauacacccccagaaagagagaaagcugccuucu

SEQ ID NO: 176693 - RNA, 63 nt, Human
gccucccucacccugagccccuuccuugcucugcacccccauauggucauagcccagaucagc

SEQ ID NO: 176694 - RNA, 63 nt, Human
cagauaacaaccccggacaaaucagcgaugugucacccccagucucccaccuuuucuucuaau

SEQ ID NO: 176695 - RNA, 63 nt, Human
ccccgcacaacaucccucaccacucucccccagcacccccaucuccgacugugccugcuugca

SEQ ID NO: 176696 - RNA, 63 nt, Human
augcuggaccagggggauuacuucccccacccacacccccauuuggacaucuggggaagugga

SEQ ID NO: 176697 - RNA, 63 nt, Human
ugcuuccccagccagccucuccucacugugacccacccccaugggcccccgucccaggcagcc

SEQ ID NO: 176698 - RNA, 63 nt, Human
acguccaaaggagugcauggccacagccaccuccacccccaagaaaccuccauccugccagga

SEQ ID NO: 176699 - RNA, 63 nt, Human
aaagagauggugcuaaaccauucaugaugaacucacccccaugauccaaucaccucccaccag

SEQ ID NO: 176700 - RNA, 63 nt, Human
cugaagcuuuccuaauauugcugugcuccccaccacccccauggcagucccuccgcagcccca

SEQ ID NO: 176701 - RNA, 63 nt, Human
gcugugguggguucgauuuaucccugcccaccccacccccacaacuucccuuuugcuacuucc

SEQ ID NO: 176702 - RNA, 63 nt, Human
ccugcugaacagauacacagaguucucagaccccacccccacccucaggugggcuggcuggcu

SEQ ID NO: 176703 - RNA, 63 nt, Human
auguuucugaaaagugcuguaguuuaguccccucacccccagcacugcccaaacaggggccaa

SEQ ID NO: 176704 - RNA, 63 nt, Human
uauccagacagccaccaggauggucccucgccccacccccaccgccucuccccaccuuuucca

SEQ ID NO: 176705 - RNA, 63 nt, Human
cucuuggacucaccaggcuccuauugaaggaaccacccccauuccuaaauaugugaaaagucg

SEQ ID NO: 176706 - RNA, 63 nt, Human
ucugcauuuuguccuggagugccagcgagugugcacccccaguuuccuucccuggaccccugc

SEQ ID NO: 176707 - RNA, 63 nt, Human
cucaggucccagaggguggaaggagccaggacgcacccccacugcugcugcaggagccgcugc

SEQ ID NO: 176708 - RNA, 63 nt, Human
ucagagacccccgggauggggccucacacuugccacccccagaaccagcucaccuggccagag

SEQ ID NO: 176709 - RNA, 63 nt, Human
ucggcacugaccggcccaccugguagcagaggacacccccagccccccaagcauugaagacau

SEQ ID NO: 176710 - RNA, 63 nt, Human
aagggacugggcccugcagggucagaaccuccccacccccaggggaggccaggcagaagccug

SEQ ID NO: 176711 - RNA, 63 nt, Human
ugcccccauucuacuacccaccacugcccaccccacccccacaucacacacucuucgaugcuu

SEQ ID NO: 176712 - RNA, 63 nt, Human
cauggagggcuuucuaaaacagacugcucagcccacccccaggguuucugaguucauagguua

SEQ ID NO: 176713 - RNA, 63 nt, Human
gcccccaagcaccuccagcggugaugagcuccacacccccacacccauugcagcuguggcgcc

SEQ ID NO: 176714 - RNA, 63 nt, Human
agccucaucucuuuguucuaaagauggaaaaaccacccccaaauuuucuuuuuauacuauuaa

SEQ ID NO: 176715 - RNA, 63 nt, Human
uguccaguggucagguuuccccugaccuucccucacccccagaaacacuugcuuacagaccga

SEQ ID NO: 176716 - RNA, 63 nt, Human
auccucccugguggcccugggcaggugcacugacacccccaccuucccauccccugcugaacc

SEQ ID NO: 176717 - RNA, 63 nt, Human
agucuuuccauuuuccuugcuucucuuauugcacacccccagcccauuuugcuucucucuugg

SEQ ID NO: 176718 - RNA, 63 nt, Human
acagaauuacagucaacguugguacauuuucaucacccccaguaaaaccccguacccuugguc

SEQ ID NO: 176719 - RNA, 63 nt, Human
auguuggcacuguguucacacgcaugguccccacacccccagguuggguggguuuuuuuguuu

SEQ ID NO: 176720 - RNA, 63 nt, Human
auguacuugaaggaaggagguggagugaaaguucacccccaugucuguguaaccggagucaag

SEQ ID NO: 176721 - RNA, 63 nt, Human
gagggcccggagcaggguggggaggugcaguggcacccccagagccaacagagggagcaggca

SEQ ID NO: 176722 - RNA, 63 nt, Human
gcguccccccccaaccuuucccucacccccucccacccccagccccgacuccagccagcgccu

SEQ ID NO: 176723 - RNA, 63 nt, Human
agggaacuggagaacucagccuucaucuucccccacccccauuugcugguucagcuaugauuc

SEQ ID NO: 176724 - RNA, 63 nt, Human
ucugauuuaccggccuacucucgaccugccccccacccccagcucaggggaccuuuugucuga

SEQ ID NO: 176725 - RNA, 63 nt, Human
gacggggugcuauuccaucgcagggugcucacacacccccacacccacccacccacacacaac

SEQ ID NO: 176726 - RNA, 63 nt, Human
agcaaaccuuuaacuaauuauguaucugaaagucacccccacauaccaacucaacuuuuuucc

SEQ ID NO: 176727 - RNA, 63 nt, Human
auuuugugguuccggggaguaugugaugauaaucacccccagcagauuccauuaccucagcag

SEQ ID NO: 176728 - RNA, 63 nt, Human
gguacuauaccuuucaaauccccagggcagacacacccccacccagccccuauuuggaccuaa

SEQ ID NO: 176729 - RNA, 63 nt, Human
acagugggcugcuagaagcacgauccgccaaugcacccccaaccuccaucgccuugcagguuu

SEQ ID NO: 176730 - RNA, 63 nt, Human
aaggucauuuguauucagaguaaaucagugguccacccccauaaaacuguaagacaagccucc

SEQ ID NO: 176731 - RNA, 63 nt, Human
caucuuggaggguuuggggagaaguuggcgugccacccccacaaccccugaggagguguagac

SEQ ID NO: 176732 - RNA, 63 nt, Human
cucugcacgucccaccccauuuugcugugugcucacccccaggauguguacccgguuguagua

SEQ ID NO: 176733 - RNA, 63 nt, Human
cugcccuguugucccgucugcucuccucuuacccacccccaugcuguaaauacuugucaucau

SEQ ID NO: 176734 - RNA, 63 nt, Human
gggagccagagaggcuugcacucaggagagaaccacccccaagucuccguucuacugccguga

SEQ ID NO: 176735 - RNA, 63 nt, Human
guuugguauuagaaguaggaggcuggacgacuucacccccaaaggguccugaagccccagaac

SEQ ID NO: 176736 - RNA, 63 nt, Human
cacuagcacugcuuuaccgcuccucaucgccaacacccccaugcucuguggccuucuuacacu

SEQ ID NO: 176737 - RNA, 63 nt, Human
cuagcauuccucaggaaggacaugggugccccccacccccaguucagucuguagggagugaag

SEQ ID NO: 176738 - RNA, 63 nt, Human
uucggccuucuucuuccccaaaaucuuuauccccacccccaccucuaucuuucucucucucuc

SEQ ID NO: 176739 - RNA, 63 nt, Human
cuaaugcaacuggcuaaaggauaguaccacccucacccccaccauaggcaggcuggaucgugg

SEQ ID NO: 176740 - RNA, 63 nt, Human
agucucucccugcaguccugcagcagcagcccccacccccaagcuuggugcugagcccuggug

SEQ ID NO: 176741 - RNA, 63 nt, Human
cccaaccuggcaggauucuccauguguaaacuucacccccaggacccaggaucuucuccuuuc

SEQ ID NO: 176742 - RNA, 63 nt, Human
auguuauuuucugcuguuugaauuuugucuccccacccccaacuuggcuaguaauaaacacuu

SEQ ID NO: 176743 - RNA, 63 nt, Human
caaauguauaucauuucacuccccuccccuccccacccccaauagauucaaauaaauaaaauc

SEQ ID NO: 176744 - RNA, 63 nt, Human
aaaggacucgccuugcaaccgacaggccauucccacccccacacacaaccuccccuguuuuca

SEQ ID NO: 176745 - RNA, 63 nt, Human
ucucuuucccucucaacaguggggucgggggcccacccccagcugggggaccccaugcaggcu

SEQ ID NO: 176746 - RNA, 63 nt, Human
agugccuuugcuccucuguccugccucuacucccacccccacuaccucugggaaccacagcuc

SEQ ID NO: 176747 - RNA, 63 nt, Human
ucucgugacuauacuggcauuucagauccaccccacccccagacucaucccacucucucccag

SEQ ID NO: 176748 - RNA, 63 nt, Human
uucccggaggaugggucucagccgagccucgugcacccccaagauggaacaucccugcugcau

SEQ ID NO: 176749 - RNA, 63 nt, Human
uuuauucuggaaagacaucuccaaggugagguccacccccacagcagaccucaaguagaaauu

SEQ ID NO: 176750 - RNA, 63 nt, Human
gagagagagagaaauuauauacuaugaaaagugcacccccacacucugcuagaggaaugaauu

SEQ ID NO: 176751 - RNA, 63 nt, Human
ccuccaucucugaccacccccacccuaaccccccacccccaccauccuauuaaacauuuuuaa

SEQ ID NO: 176752 - RNA, 63 nt, Human
ucauuuucuucccucucucccuccaucucugaccacccccacccuaaccccccacccccacca

SEQ ID NO: 176753 - RNA, 63 nt, Human
cuuuuucagggaaaaauauuuuacuaguccaaucacccccaggaccucuucagcugcugacaa

SEQ ID NO: 176754 - RNA, 63 nt, Human
ucccccaugccacucagcccugcccuauccccucacccccaucccggcuccaucuguagccgu

SEQ ID NO: 176755 - RNA, 63 nt, Human
ggcaugggcucugguucugccaggagccugugacacccccaggaaggggguggaacugaggaa

SEQ ID NO: 176756 - RNA, 63 nt, Human
auaaguuaucggacagaaagcuaggugcucugucacccccaggaggcgcugugguacuggggc

SEQ ID NO: 176757 - RNA, 63 nt, Human
augggugggacacaugccuuccucccccuauuccacccccaaguugaucugaguaucgucagg

SEQ ID NO: 176758 - RNA, 63 nt, Human
cccuggccagugagcuggaccucaugcccuacacacccccacaggugaaggugacagguuccu

SEQ ID NO: 176759 - RNA, 63 nt, Human
gggguaaaugaagucaucccuucucccccaguccacccccaagugcucuuagauacugaagga

SEQ ID NO: 176760 - RNA, 63 nt, Human
acuauauauuauaguaaaacccucgaaagggaucacccccacacuccuuucccuuccccucuc

SEQ ID NO: 176761 - RNA, 63 nt, Human
augauuugaaagcuuuaaaggagauucuucucccacccccaacuuuauuugcaaugggauuuu

SEQ ID NO: 176762 - RNA, 63 nt, Human
ucagucccaggaguccacacugguccauccugccacccccaaccauuugcacuacaagggcgg

SEQ ID NO: 176763 - RNA, 63 nt, Human
gagcacucggugacccagagcagggacuggaggcacccccagcccugccccaggccacagcag

SEQ ID NO: 176764 - RNA, 63 nt, Human
ccugugugggccaguguccccccaccaugggcacacccccaaguggugcuuguuggaagagug

SEQ ID NO: 176765 - RNA, 63 nt, Human
ccccaggggagaggagagcugugagagcaccggcacccccagaagacucugcuucuuagccca

SEQ ID NO: 176766 - RNA, 63 nt, Human
cucuuugcacagcaugaggcaaaaauguccagccacccccaggcaucuguuagcagagucugu

SEQ ID NO: 176767 - RNA, 63 nt, Human
aaauucucucuuugagaugggguggacuaagaccacccccaaaguuuaaaaauaugcucauuc

SEQ ID NO: 176768 - RNA, 63 nt, Human
aauauuguguaaaaagggaaggaaaaaaaaaaccacccccagcuucuuucuuuuucaagccaa

SEQ ID NO: 176769 - RNA, 63 nt, Human
gcuugggaaaagggccccaguggcuuugggaagcacccccagcccagggugaaacaugcuucu

SEQ ID NO: 176770 - RNA, 63 nt, Human
ucagaacaccccgcucuggcaguaggugucccccacccccaaagaccugccugugugcuccgg

SEQ ID NO: 176771 - RNA, 63 nt, Human
aucugcugcacaguugaacgaugggcaguggcucacccccacuccuuuauuucagcaaaagcu

SEQ ID NO: 176772 - RNA, 63 nt, Human
cgugcuuggcuugaguaacugucucucuuuccccacccccaucacagggcuuucaguuuggca

SEQ ID NO: 176773 - RNA, 63 nt, Human
uguuuuguaagaucaaauggggugugucuuccccacccccauuccuucauucuagagcuagag

SEQ ID NO: 176774 - RNA, 63 nt, Human
uguuucaaaaaguguggccucagcucuggaggccacccccaggaaggaguuugagguucauug

SEQ ID NO: 176775 - RNA, 63 nt, Human
cucucgcccaacacgaucuuguaagauggauuucacccccaggccaaugcagcuaauuuugau

SEQ ID NO: 176776 - RNA, 63 nt, Human; identical to SEQ ID NO: 9249

SEQ ID NO: 176777 - RNA, 63 nt, Human
ugaagaaccaucgaaaccuguuuguucccagcccacccccaguggaugggaugcauaaugcca

SEQ ID NO: 176778 - RNA, 63 nt, Human
gcaggucaccuuaguucaccuacccugagugaacacccccagcugggugguccaccaaguucu

SEQ ID NO: 176779 - RNA, 63 nt, Human
cccaaggccgcccuuucccucgcacacaggccccacccccacaguuccacgccccccccccaa

SEQ ID NO: 176780 - RNA, 63 nt, Human
cuuccaaucaaaugucuaggcuuguuugacuuccacccccaaugguuuuucacucuuuuuauu

SEQ ID NO: 176781 - RNA, 63 nt, Human
uuuuguggcaugggguaguggagcuucccuccccacccccauauguaucagugaagccuuuga

SEQ ID NO: 176782 - RNA, 63 nt, Human
guggguuugguuaaggaaaugcuuaccaucccccacccccaaccaaguucuuccagacuaaag

SEQ ID NO: 176783 - RNA, 63 nt, Human
auucuugacacucuuucuauaauuagcguucuucacccccacccccacccccaccccccuuau

SEQ ID NO: 176784 - RNA, 63 nt, Human
gacacucuuucuauaauuagcguucuucacccccacccccacccccaccccccuuauuuuccu

SEQ ID NO: 176785 - RNA, 63 nt, Human
cuuucuauaauuagcguucuucacccccacccccacccccaccccccuuauuuuccuuuuguc

SEQ ID NO: 176786 - RNA, 63 nt, Human
guagauccguguucuaaaccugggguccacagacacccccaagaagagcggauugaaugcaag

SEQ ID NO: 176787 - RNA, 63 nt, Human
gaggaaccccagguagggacgccccuuguuccucacccccaccccacuuagguccugggcccc

SEQ ID NO: 176788 - RNA, 63 nt, Human
gccauuggaucuaguaugucugucuugaccccucacccccaccccauucagaccucaguaguc

SEQ ID NO: 176789 - RNA, 63 nt, Human
cacagcugccaccgccuugucccucaacaagcucacccccaaucccuugcagccaggccacaa

SEQ ID NO: 176790 - RNA, 63 nt, Human
uaguggggagggcugaacaggacaaccucucaucacccccacuuuuguuccuuccugcugggc

SEQ ID NO: 176791 - RNA, 63 nt, Human
uguucaccccucgcccugcccuccuuugccuuccacccccaccauccagguggagacccugag

SEQ ID NO: 176792 - RNA, 63 nt, Human
cguucuccuagaucugagcaagcugucaguucucacccccaccguguauauacaugagcuaac

SEQ ID NO: 176793 - RNA, 63 nt, Human
uagcacaucacaauacugcugcuacucuguagccacccccauggcuacaugaugcccuauucc

SEQ ID NO: 176794 - RNA, 63 nt, Human
acaauuugucagagcugaagccagcccacuacccacccccacuacagcauugugcuugggucu

SEQ ID NO: 176795 - RNA, 63 nt, Human
cgaagcugcucuuucugguccuccccaccaccccacccccaagacuuguguuuguuaauagaa

SEQ ID NO: 176796 - RNA, 63 nt, Human
acuuguuccugccucccucaccccaccccgccccacccccagcccuggcccuuggcuucucuc

SEQ ID NO: 176797 - RNA, 63 nt, Human
agaccugugucaaaacuuacauccacauuccuacacccccacaacccaucacuucugguguua

SEQ ID NO: 176798 - RNA, 63 nt, Human
caugagccaaaagcacauaccuaccccaucccccacccccacacacacacacacacacacaug

SEQ ID NO: 176799 - RNA, 63 nt, Human
ucagacugcugccuggguuagaauucuuguccccacccccacuuacuauaguucugugauccu

SEQ ID NO: 176800 - RNA, 63 nt, Human
ugggcuuccaugccuguagcuuuccuggucccucacccccauggccccaggcccacagcgugg

SEQ ID NO: 176801 - RNA, 63 nt, Human
gacccagugaucuuccauggccguuccuugucccacccccacccgaucauaccuuccccccuc

SEQ ID NO: 176802 - RNA, 63 nt, Human
aaauaauaauaaaacaacuuguuuccuuuuggccacccccaggaagggcugauuucaaaaucu

SEQ ID NO: 176803 - RNA, 63 nt, Human
ggaaggcuuguuaaaacccaaggcugcuaggcccacccccagaguuugauacaguagaccuca

SEQ ID NO: 176804 - RNA, 63 nt, Human
uacgccgccuucacuccacagccucaccccucccacccccauacugguacugcuguaaugagc

SEQ ID NO: 176805 - RNA, 63 nt, Human
uaauuaaugcuggaggcugagccaaguacaggacacccccagccugcagcccuugcccagggc

SEQ ID NO: 176806 - RNA, 63 nt, Human
cuucagagcgaacggccacaucuccccaccucucacccccacccucuccccugccaggcuggg

SEQ ID NO: 176807 - RNA, 63 nt, Human
auacauuaagagaaagagaaauauauauauauccacccccagcccaaccgagggcggcccuug

SEQ ID NO: 176808 - RNA, 63 nt, Human
guucuguagaauccaagcccacauuuccaaagucacccccaacgcguccucucacaccgucca

SEQ ID NO: 176809 - RNA, 63 nt, Human
uuaaaauucagcuuuagcuuccauggcaguccucacccccaccucucuaaaagacacaggagg

SEQ ID NO: 176810 - RNA, 63 nt, Human
cccagccugccguggggcccgucagccuggucccacccccauggagaacccaaagucuuacug

SEQ ID NO: 176811 - RNA, 63 nt, Human
cucccccuuccaacgagcuuccggacuugucugcacccccagcaagaaggcgaguuaguuuuc

SEQ ID NO: 176812 - RNA, 63 nt, Human
ucccaaguagcugggacuacaggcaccugccaccacccccaguuaauauuuuuuuuaauuuuu

SEQ ID NO: 176813 - RNA, 63 nt, Human
gcuuuauucucuucuuuuucuuuauuucgcccccacccccauccccugccuuuuuuuuuuuuu

SEQ ID NO: 176814 - RNA, 63 nt, Human
uugagucauugagcaucuguacauauccuucaccacccccagucccagcaccugugucaguaa

SEQ ID NO: 176815 - RNA, 63 nt, Human
uaggcauaaugugaggagguggggagaccaccccacccccauguccaccaugacccucuuccc

SEQ ID NO: 176816 - RNA, 63 nt, Human
ggaccuggggguagccccgccccagcccucagucacccccacuucccacuugcagucuuguag

SEQ ID NO: 176817 - RNA, 63 nt, Human
ggcucaucucugaguucucaggacccuugcccccacccccauuuuuuuaaugaaaaaaaaaaa

SEQ ID NO: 176818 - RNA, 63 nt, Human
ccgaaugccucccugggaggcacacugauugcccacccccaccacugcaccauuuccaggagg

SEQ ID NO: 176819 - RNA, 63 nt, Human
caucguuccccugagcacugggggacagacccucacccccacccuggggguguggcaccucca

SEQ ID NO: 176820 - RNA, 63 nt, Human
cccaggcccaccaucaccaccgccucuggccgccacccccaucuuccaccugugcccucacca

SEQ ID NO: 176821 - RNA, 63 nt, Human
cacaugcguauaugugcgucucucuuucucccucacccccagguguugccauuucucugcuua

SEQ ID NO: 176822 - RNA, 63 nt, Human
ucucagcuccagguggcucugaggugccugucccacccccacccccagcucaauggacuggaa

SEQ ID NO: 176823 - RNA, 63 nt, Human
cuccagguggcucugaggugccugucccacccccacccccagcucaauggacuggaaggggaa

SEQ ID NO: 176824 - RNA, 63 nt, Human
cugacaaaaacacguaggggcagggacgguccccacccccagggacacaaccccuggucuugg

SEQ ID NO: 176825 - RNA, 63 nt, Human
aaccugagacagaaccaggcugagccaggccuccacccccacccccguuugcugggggcuccu

SEQ ID NO: 176826 - RNA, 63 nt, Human
uucaacccggcccccaggucugcuggguccccccacccccacagcccucacagcauuccccau

SEQ ID NO: 176827 - RNA, 63 nt, Human
gaggggcccuggaggccacauccugccccaccccacccccacucccacggacacuaaaacgcu

SEQ ID NO: 176828 - RNA, 63 nt, Human
ggcagcagcuccgcucccggcgccacccaccgacacccccagaacccucugggggccugccca

SEQ ID NO: 176829 - RNA, 63 nt, Human
cauggguccuggcgauuauuuuaaugcuggcuacacccccacaggugacuuggauucagaaau

SEQ ID NO: 176830 - RNA, 63 nt, Human
cccucuacuguguggaaaugguccauugaguaacacccccaucagcuucucaacugggaaacc

SEQ ID NO: 176831 - RNA, 63 nt, Human
agaugcugugauccaccacccagcuucaccccucacccccagcggcucaccauggggauggca

SEQ ID NO: 176832 - RNA, 63 nt, Human
ugacagcuccggcccugauccaggacugcaccccacccccaccguccagccauccaaccucac

SEQ ID NO: 176833 - RNA, 63 nt, Human
aauccaguuccucaggaaccccuccaaaacccacacccccagggacgccgcuuuccgggaucc

SEQ ID NO: 176834 - RNA, 63 nt, Human
gggugcuguugcagggucaccugccuguuaccacacccccauccagcuggguggugggugagg

SEQ ID NO: 176835 - RNA, 63 nt, Human
caacaugugaagacagugaugggcacgugcccacacccccacuucucuagccguuugcagagg

SEQ ID NO: 176836 - RNA, 63 nt, Human
ugccugucuggcagccuguggggucaggagaagcacccccagggcagcccucuugacuggcgc

SEQ ID NO: 176837 - RNA, 63 nt, Human
agacccacacucacgcacacgcgcuucuucucccacccccacccccuucaaacuuuauucgga

SEQ ID NO: 176838 - RNA, 63 nt, Human
uuucaaguuggcugucccccccgccgccccccccacccccauauguacagaugauaauagggu

SEQ ID NO: 176839 - RNA, 63 nt, Human
auucucucugaacacacauugcuauucccaucccacccccaaugcacagggcugcaacaccac

SEQ ID NO: 176840 - RNA, 63 nt, Human
ugugaggcaucauagacacugagcaaccaggaccacccccacguucagaaaucagcuggccaa

SEQ ID NO: 176841 - RNA, 63 nt, Human
augcuuaugcaagugacggugcugcucuuguuccacccccacccagauggucucugagugcgc

SEQ ID NO: 176842 - RNA, 63 nt, Human
cugcucugggagggcccugaggacucccacccucacccccacccccacagggucagcaacugc

SEQ ID NO: 176843 - RNA, 63 nt, Human
ugggagggcccugaggacucccacccucacccccacccccacagggucagcaacugcuuccgg

SEQ ID NO: 176844 - RNA, 63 nt, Human
cugcuguccccccuugggacuaaccacuaaccucacccccaaacuccacgggugccccuagcu

SEQ ID NO: 176845 - RNA, 63 nt, Human
cucagcugccccuguccccaccucuggagaauccacccccaccagauuccuccgcgggaggug

SEQ ID NO: 176846 - RNA, 63 nt, Human
gugggaccaugacuuagggaggugggacccacccacccccauccaggaaccgugacguccaag

SEQ ID NO: 176847 - RNA, 63 nt, Human
ccucuaaacuuaucuggugcauucuccccaccccacccccauuauauaagggcuauuuuagau

SEQ ID NO: 176848 - RNA, 61 nt, Human; identical to SEQ ID NO: 9321

SEQ ID NO: 176849 - RNA, 63 nt, Human
gauuccacaaagccucucuccccucccucgucccacccccacccaggcaggaagcccaggagg

SEQ ID NO: 176850 - RNA, 56 nt, Human; identical to SEQ ID NO: 9323

SEQ ID NO: 176851 - RNA, 63 nt, Human
gcuuccuuccaggacagcaggcuuugaguccagcacccccagccugccuuugccaccagcccc

SEQ ID NO: 176852 - RNA, 63 nt, Human
cucugaaauauuuagaagugcuaauuucuggcccacccccaacaggaauucuauaguaaggag

SEQ ID NO: 176853 - RNA, 63 nt, Human
gcugacacagaaggcugccggguggggggagggcacccccaaauucaaagaaaacccuaagug

SEQ ID NO: 176854 - RNA, 63 nt, Human
uuccugcccuuuuccugggccuucucagcucuccacccccaccacucuugacucagguggugu

SEQ ID NO: 176855 - RNA, 63 nt, Human
ucuauuuacaacugugcuuaucaaaauugugaacacccccacccccgcauuuuuguguguuga

SEQ ID NO: 176856 - RNA, 63 nt, Human
gcaaucacuagaccggacuugaggcacgcggugcacccccagacgcuggcgcuccaccgugcu

SEQ ID NO: 176857 - RNA, 63 nt, Human
aaaagcaacccaguccccaaccugcacucuacccacccccaucaccuacuccagcucccaacu

SEQ ID NO: 176858 - RNA, 63 nt, Human
cuguccgucccccuuccgccuucucccuucucucacccccacccuagccuccaccauccccgc

SEQ ID NO: 176859 - RNA, 63 nt, Human
cccaccacacccucccucuacugggagccuacccacccccaggaccccugaguaaaaaagcug

SEQ ID NO: 176860 - RNA, 63 nt, Human
ggcggcuguguugccuauguagagaacacgcuucacccccacuccccguacagugcgcacagg

SEQ ID NO: 176861 - RNA, 63 nt, Human
auccagcgugcagccuugccucggaggccagcccacccccagaagccaggaagcccccgcgcu

SEQ ID NO: 176862 - RNA, 63 nt, Human
uggcuucucugcuucucauaggacuaucuccaccacccccaguuagcaccauuaacuccuccu

SEQ ID NO: 176863 - RNA, 63 nt, Human
uggcuccucugcuucucacgggacuauuuccaccacccccaguuagcaccauuaacuccuccu

SEQ ID NO: 176864 - RNA, 63 nt, Human
acuuggacccaaaaaaucaucucaccuugagcccacccccaccccauugucuaaucuguagaa

SEQ ID NO: 176865 - RNA, 63 nt, Human
uugggggagucggaggcuccccggcagacaccccacccccaucuuguucccuugaggugccuc

SEQ ID NO: 176866 - RNA, 63 nt, Human
gcgccggagcggacgcccccagggagcuggggacacccccaugggacaggugaggggcucgga

SEQ ID NO: 176867 - RNA, 63 nt, Human
acacauuguagacagguagcaaaauaucacauacacccccaaaauauguacaaauauuauaua

SEQ ID NO: 176868 - RNA, 63 nt, Human
gaauuugagcacaguccagaaauggagacaucccacccccaguugaauaauggcccauucaug

SEQ ID NO: 176869 - RNA, 63 nt, Human
ucugucucuccuucucucucuccccccaccacccacccccacacacgucaucugcauuguuau

SEQ ID NO: 176870 - RNA, 63 nt, Human
uggcucucacauacuaaaugcuaguagcgcccccacccccacgcccagucacggugacaacca

SEQ ID NO: 176871 - RNA, 63 nt, Human
uuuguuucucagcucuguacaaacacaaauacacacccccacaaaacuaaaaucaaaguuuca

SEQ ID NO: 176872 - RNA, 63 nt, Human
ggcuguuccuccccuguaggguuuggacagacccacccccagccuugcccagcuuucaaagga

SEQ ID NO: 176873 - RNA, 63 nt, Human
cagggguguugcgggggcaacaugagagccccucacccccaacucuccacuuucaggaggccc

SEQ ID NO: 176874 - RNA, 63 nt, Human
acuccucacauuccacgacccaggccugcaccccacccccaacucccagccccggaauaaaac

SEQ ID NO: 176875 - RNA, 63 nt, Human
gcugcuuuccucaccugccccugcccuaccuuacacccccagcuugacuucuuuccaguccac

SEQ ID NO: 176876 - RNA, 63 nt, Human
ccaggccuuauugagaccagaccccaagucccccacccccauccugcuccagcguuuccucua

SEQ ID NO: 176877 - RNA, 63 nt, Human
cucuuuaaacucuggggagucggauucaggaaacacccccaggaggccaagccugaaaacaga

SEQ ID NO: 176878 - RNA, 63 nt, Human
aaauuuguugaacccugccacauuuaguauccccacccccaaauccuguuccaaugaaaaaau

SEQ ID NO: 176879 - RNA, 63 nt, Human
ucagccuccaaaguagcuggcacuacaaguguacacccccacacaaggcuaaguuuuguauuu

SEQ ID NO: 176880 - RNA, 63 nt, Human
cuuggcccggccggccuggcaccguuuuuuaaacacccccaucccucgggaagcagccagcuc

SEQ ID NO: 176881 - RNA, 63 nt, Human
ccugccccaaauccagccaguccugccccagcccacccccacauuggagcccuccugcugcuu

SEQ ID NO: 176882 - RNA, 63 nt, Human
ggggccaggagacccugacccacggccccuccccacccccacccggcucacccccggcccugc

SEQ ID NO: 176883 - RNA, 63 nt, Human
auuucucauccuuuucaggcugguagagcagaucacccccaaagcaagaaguuccagaugaaa

SEQ ID NO: 176884 - RNA, 63 nt, Human
ccuagaggccccggaggagcugggccagccgcccacccccacccccagugcagggcuggucuu

SEQ ID NO: 176885 - RNA, 63 nt, Human
ggccccggaggagcugggccagccgcccacccccacccccagugcagggcuggucuuggggag

SEQ ID NO: 176886 - RNA, 63 nt, Human
uugccucucugcuuggagggggcccccucugcucacccccagcgugccccccccggaacugau

SEQ ID NO: 176887 - RNA, 63 nt, Human
cacauaaaagucugugacuugaaguuuagucagcacccccaccaaacuuuauuuuucuaugug

SEQ ID NO: 176888 - RNA, 63 nt, Human
aaguuagacucuuccccucccucccacacuucccacccccaggcaaggcugacuucucugaau

SEQ ID NO: 176889 - RNA, 63 nt, Human
cucugccauguuuuuccccugcuccccugagaccacccccaaacacaaaacauucauguaacu

SEQ ID NO: 176890 - RNA, 63 nt, Human
ggaguauuucucugaggcccacacaaagcuggacacccccaggcucuacuccaucccauugga

SEQ ID NO: 176891 - RNA, 63 nt, Human
uaauuuucauguguacaccucuuugccuguucccacccccagacuugaaauaacacuucagag

SEQ ID NO: 176892 - RNA, 63 nt, Human
cccucuccgccccgcuccugcuccuaccugcagcacccccagcuccgacuccagacucucugc

SEQ ID NO: 176893 - RNA, 63 nt, Human
aaucaaguaaggauguauguggugaaaacuuaccacccccauacuaugguuuucauuuacucu

SEQ ID NO: 176894 - RNA, 60 nt, Human; identical to SEQ ID NO: 9367

SEQ ID NO: 176895 - RNA, 63 nt, Human
cuuaagacaggggccacuccucccucccgcucccacccccaccuuguugacagggagccaagg

SEQ ID NO: 176896 - RNA, 63 nt, Human
aacaaaggugccaugaugggcuguucuaacccccacccccacugccagguaagggugucaggg

SEQ ID NO: 176897 - RNA, 63 nt, Human
guccuuaucaccagccucacaaucccacaggcccacccccagugggccuguggcauucauauu

SEQ ID NO: 176898 - RNA, 63 nt, Human
aaaagacuagaaaggacauugcuuucucagccccacccccagguccacaguguccaagguaau

SEQ ID NO: 176899 - RNA, 63 nt, Human
uuuuuccccacaccucugaacucagggccuagccacccccaaacuuccaaaucccacuuuugu

SEQ ID NO: 176900 - RNA, 63 nt, Human
uuccagcccuuuuaugccugugugaucccaccccacccccauaguuguauaaaggucauagug

SEQ ID NO: 176901 - RNA, 63 nt, Human
cugguagcacuuugcucugucauccuuuuuguucacccccauccccgcaucuaaaaccaagga

SEQ ID NO: 176902 - RNA, 63 nt, Human
gaaaaggaagccaguauauugaagagguaucugcacccccauguuuauugcagcacuguucac

SEQ ID NO: 176903 - RNA, 63 nt, Human
uuugggggcucuucaggcagcaccucagccuggcacccccacuccccugcgcagcccccaggc

SEQ ID NO: 176904 - RNA, 63 nt, Human
cuuacgaaaaacuuugccucugaugcucagccccacccccaaauagcacacaagcuuguuaac

SEQ ID NO: 176905 - RNA, 63 nt, Human
guagccccagagcugcccaaguucacugggcuccacccccaccuccaggaggggaggagagga

SEQ ID NO: 176906 - RNA, 63 nt, Human
cgccggguguacauacgcgucucugccacuccccacccccagccucugccggcuccccuaggc

SEQ ID NO: 176907 - RNA, 51 nt, Human; identical to SEQ ID NO: 9380

SEQ ID NO: 176908 - RNA, 63 nt, Human
gagccccggagcaccacggggucgggggaggagcacccccagccucccccaggcugcgccugc

SEQ ID NO: 176909 - RNA, 63 nt, Human
cccacaacgacuuuauuuucuuacccaauuucccacccccacccaccuaauucgaugaaggcu

SEQ ID NO: 176910 - RNA, 63 nt, Human
auucaagccccuucuccacuguagcaaaauaagcacccccaccccaucugccuucaggucuuc

SEQ ID NO: 176911 - RNA, 63 nt, Human
ggccccuggccucgggagcggccccuggcuaugcacccccaccauuccuacacaucuugccag

SEQ ID NO: 176912 - RNA, 63 nt, Human
gcagggccgcgcccuuggugaccucaggcaaagcacccccaaacuuaccucagggggugccuc

SEQ ID NO: 176913 - RNA, 63 nt, Human
gagagggugaguguggucagaguaaagcugcuccacccccagauugcaaugcuaccaauaaag

SEQ ID NO: 176914 - RNA, 63 nt, Human
cucucuucaccguuuuuugauacuaucuucccccacccccagcuacccauaggggcugcagag

SEQ ID NO: 176915 - RNA, 63 nt, Human
cgagaucaccgcgucacgacuuuuggggagacucacccccaccaacaccguccagagaggccu

SEQ ID NO: 176916 - RNA, 63 nt, Human
gucauuuuaaaaugguggcugaauuucccaacccacccccaaacuaaacacuaaguuuaauuu

SEQ ID NO: 176917 - RNA, 63 nt, Human
cuccacgcguauucacgccccgcuccucgccugcacccccaccccgucuggggccugcccucc

SEQ ID NO: 176918 - RNA, 63 nt, Human
uucugaccaacacacacacgaccccucccccaacacccccaaauucaagaguggauguggccc

SEQ ID NO: 176919 - RNA, 63 nt, Human
cugaagcaaagaggccaaagauuggaaaccccccacccccaccucuuuccagaacugcuugaa

SEQ ID NO: 176920 - RNA, 63 nt, Human
auauaggggggccagacgugugccccguucacccacccccaggcaagcaucugaccugucccc

SEQ ID NO: 176921 - RNA, 63 nt, Human
uuacuugauuuaucuucucaggacucauuguuccacccccaaccaauuugaaugccuacaaua

SEQ ID NO: 176922 - RNA, 63 nt, Human
agcacacaucugcugacucuccuucaacauccucacccccaccccugggcaccauuuaggaca

SEQ ID NO: 176923 - RNA, 63 nt, Human
uagaggugagcucagaaaccuacuguuaaccaacacccccaagugacugacacagguggucua

SEQ ID NO: 176924 - RNA, 63 nt, Human
gagucucuguauggaagaacaaaugugugcauucacccccagucacaauggucuccauugcau

SEQ ID NO: 176925 - RNA, 63 nt, Human
ccuggugauggaaaaacguucucagcuuuaagacacccccauuaggcagacacuggguucugu

SEQ ID NO: 176926 - RNA, 63 nt, Human
cccuggggaccccaaggccccagcuucccucugcacccccagccuaucccagaggccuugcag

SEQ ID NO: 176927 - RNA, 63 nt, Human
gccacaaauaagcaucgagcaccuccccauucacacccccauuccuccuggcuccuuaucccc

SEQ ID NO: 176928 - RNA, 63 nt, Human
uuuccaauucuaaaacagacucaaugucccccucacccccaccucaaggucaggaugagaaca

SEQ ID NO: 176929 - RNA, 63 nt, Human
ccgcugccuugcagccugcacuuugcacaugcucacccccagcacagucccacuggccccuca

SEQ ID NO: 176930 - RNA, 63 nt, Human
uugggggcaggaucauucugccccuuguccacgcacccccaccagcccucucgcuucuaacac

SEQ ID NO: 176931 - RNA, 63 nt, Human
uaacuugugaagaaugcccagaagaaccucagacacccccacaacuuuguacaaaugguuacu

SEQ ID NO: 176932 - RNA, 63 nt, Human
gaaaagaaacaacacucaguccuuccacacuuccacccccagcuccuuucccuggaagaggaa

SEQ ID NO: 176933 - RNA, 63 nt, Human
uaagcugcaguaauuugcucuuugaaugaccgucacccccaguauaggauaugcuuguauccc

SEQ ID NO: 176934 - RNA, 63 nt, Human
gccaccucgugggggacaagucucgccagcgcccacccccauggcucgggucaguccucaucg

SEQ ID NO: 176935 - RNA, 63 nt, Human
cacucauuuugcggaggccaugcgggugcucaccacccccaugcacacgccaucuguguaacu

SEQ ID NO: 176936 - RNA, 63 nt, Human
agaagcccguggcccugcugacgagagacagcccacccccagccugcaagagaggcagccaga

SEQ ID NO: 176937 - RNA, 63 nt, Human
cgugucccagaaugcacugcugaggagcaugcccacccccacccccgcagugugcagauuaaa

SEQ ID NO: 176938 - RNA, 63 nt, Human
gcaggcaggcgggaagggccaaguacaggcaaucacccccaucuucuugguuugaagcuuuau

SEQ ID NO: 176939 - RNA, 63 nt, Human
caucagcccuacguccagagggagaggagccgacacccccagagccagugccccaucuuaagc

SEQ ID NO: 176940 - RNA, 63 nt, Human
uuuugccuuggugcucaucuuaauggccuaaugcacccccaaacauggaaauaucaccaaaaa

SEQ ID NO: 176941 - RNA, 63 nt, Human
cuuuagugacucuuaguagaggguaauggcugacacccccauucccucucuucuuccaccagc

SEQ ID NO: 176942 - RNA, 63 nt, Human
uccaugugucuuuuccccugcugccucacuccccacccccacuugccagguguuugagccauu

SEQ ID NO: 176943 - RNA, 63 nt, Human
uucucggcacacccuagaguauuguacaaccaacacccccacauaacuuuguccccucuuccc

SEQ ID NO: 176944 - RNA, 63 nt, Human
aaguggcaugccuccucugcugcagggcucccccacccccacacggccucuaaagauguuuau

SEQ ID NO: 176945 - RNA, 63 nt, Human
uggcauccuggccucucgugguccucagccccucacccccaguacugcagaucucacaguuug

SEQ ID NO: 176946 - RNA, 63 nt, Human
augguuuuguuucacuuuucuuaauuugccccccacccccaccuugaaagguuuuguuuugua

SEQ ID NO: 176947 - RNA, 63 nt, Human
ucaaacauaccccaaguuaaaaugaagcucccccacccccacucccggccccgguucccacag

SEQ ID NO: 176948 - RNA, 63 nt, Human
uugcuuguuguucugcagcccugucuacuugggcacccccaccaccuguuagcugugguugug

SEQ ID NO: 176949 - RNA, 63 nt, Human
ucuguuucaucugacauccggauagaugccagccacccccacauuccaaggugagauuucuga

SEQ ID NO: 176950 - RNA, 63 nt, Human
caacaauaagauuuuuucaccucuuccugcuuccacccccaaacugagaacaucacucaauug

SEQ ID NO: 176951 - RNA, 63 nt, Human
ccaguuuaaaucugcacucugcugcuccucccccacccccaccuuccacuccauacaaucugg

SEQ ID NO: 176952 - RNA, 63 nt, Human
acaguaaccccacacugcaagaggggaccccuccacccccaguacccuggacccccuccgcag

SEQ ID NO: 176953 - RNA, 63 nt, Human
aagggacugaacugaccccuguuugcacuaagccacccccaccccccacucugcuuucccaag

SEQ ID NO: 176954 - RNA, 63 nt, Human
aaaccaguaucugucccgagaggaaauuccccccacccccagaaguuuacagaaaacugccuc

SEQ ID NO: 176955 - RNA, 63 nt, Human
uguaugaaacuugacggcgcuuuuguaaggugccacccccaaacuuuaagguagcuaaaccaa

SEQ ID NO: 176956 - RNA, 63 nt, Human
uacuguaaaccaugguuccagcagccuguuccacacccccacaccaucaggauagcacaggga

SEQ ID NO: 176957 - RNA, 63 nt, Human
cgcuucagugggccuugcccuuuguacagccuccacccccauuaaaacugcucuggacuugcu

SEQ ID NO: 176958 - RNA, 63 nt, Human
aggccugaugccguuucugcuuucugcugagaccacccccacccugacaccaucagucccccu

SEQ ID NO: 176959 - RNA, 63 nt, Human
cauccuaggcugggcuggccccacccucacccccacccccagggugcccugaggccccaggca

SEQ ID NO: 176960 - RNA, 63 nt, Human
gcugaccauccuaggcugggcuggccccacccucacccccacccccagggugcccugaggccc

SEQ ID NO: 176961 - RNA, 63 nt, Human
caugggacccagugucucagugccuucaaaacccacccccaccccuacccuaccccaccacac

SEQ ID NO: 176962 - RNA, 63 nt, Human
accagcugaggaggacaaagauaagguggcauucacccccaggcucugacuuucagcaucaug

SEQ ID NO: 176963 - RNA, 63 nt, Human
auugguguccccaugggcagcaggcagacagcucacccccaccagcaugauggccccagcugg

SEQ ID NO: 176964 - RNA, 63 nt, Human
gcuuaagggaggcuucuugccuguggguucccucacccccaugccuguccuccaggcuggggc

SEQ ID NO: 176965 - RNA, 63 nt, Human
gcacggaauaugaaagccuccuccaccuccaaacacccccaccuuggaaggagauaaggaggg

SEQ ID NO: 176966 - RNA, 63 nt, Human
accauccaugcuaccuagguaguccauaggaaccacccccaugaccaccaccaacaucaacua

SEQ ID NO: 176967 - RNA, 63 nt, Human
ccggucccaaauguagcagguguaaccguaacccacccccaacccguuucccgguucaggacc

SEQ ID NO: 176968 - RNA, 63 nt, Human
augggaauuuccauuguagguuuuugcuagucccacccccauuuuagccuaauuuggcuuaaa

SEQ ID NO: 176969 - RNA, 63 nt, Human
ucaacgcaccccacucacagacaccccuuaccccacccccacuguacagagaccaagaacaga

SEQ ID NO: 176970 - RNA, 63 nt, Human
uuccucugagggccccaccucaccccuuggugucacccccaccacgccuaggcagcucugggc

SEQ ID NO: 176971 - RNA, 63 nt, Human
ggcacccuccugggagcaggccuuccucccucccacccccaauguccuguugguaggaggugg

SEQ ID NO: 176972 - RNA, 63 nt, Human
caccccaggacgagccaucagggacagaccccccacccccaaggcugcagccacaccauguuu

SEQ ID NO: 176973 - RNA, 63 nt, Human
uggcacugggccuccaguucuuccacaugugugcacccccagcuuggccaacccucagccuug

SEQ ID NO: 176974 - RNA, 63 nt, Human
guccuguuaggccaacugccuccuugccagccccacccccagguuuuugcccauccucccaau

SEQ ID NO: 176975 - RNA, 63 nt, Human
agcuuuccugaauggauucccggccccaucccucacccccacccucacuuucaauccguuuga

SEQ ID NO: 176976 - RNA, 63 nt, Human
ucuccccccaccacccgugcacgacuuccucaccacccccagguucccugcagaugucgugug

SEQ ID NO: 176977 - RNA, 63 nt, Human
ucccucuucuagugguaccgcccaggccuuaaucacccccauuccgugcggugguaucuccca

SEQ ID NO: 176978 - RNA, 63 nt, Human
uuggaacgagggcucuucugucggugucccucccacccccauguaugcugcacuggguucucu

SEQ ID NO: 176979 - RNA, 63 nt, Human
gggagcgagcccagaacggaccggacgccugugcacccccagcccugccccuuggccgcagag

SEQ ID NO: 176980 - RNA, 63 nt, Human
gcuugacccuggaaauucugggccaucccccuccacccccacccugaggcucccccugcaggu

SEQ ID NO: 176981 - RNA, 63 nt, Human
cgucuccccucucuuaagcacccgcuuccucaccacccccacuguugggccuauaguagcagg

SEQ ID NO: 176982 - RNA, 63 nt, Human
aagagacuguccuugggccuccucuggaagcagcacccccagaggacagggcuccuccugcuu

SEQ ID NO: 176983 - RNA, 63 nt, Human
acaucgcuugaagucuucacaucuaccacuagacacccccaaaaucuguuauagacauuuaug

SEQ ID NO: 176984 - RNA, 63 nt, Human
auaaaacuaggugcugcagccccugggaccaggcacccccagaaugaccuggccgcagugagg

SEQ ID NO: 176985 - RNA, 63 nt, Human
uaauggccuaguuggguccugcccgccaauaaucacccccacgggucagagacaggcuccuug

SEQ ID NO: 176986 - RNA, 63 nt, Human
caugccuuuucagcgaaagccugucuccucacccacccccagcccuagcauaggaaaagcuuc

SEQ ID NO: 176987 - RNA, 63 nt, Human
aacuggguguucaaggcccuuacacccuugucccacccccagcagcucaccauggcuuuaaaa

SEQ ID NO: 176988 - RNA, 63 nt, Human
ugcacgauucucugcgcgcaaggacccucgacucacccccauguuucagugucacagagacau

SEQ ID NO: 176989 - RNA, 63 nt, Human
gaguugacuuuccucccauuuuaccacuuuaaacacccccauaacaauucccccauccuucag

SEQ ID NO: 176990 - RNA, 63 nt, Human
caccccagccugccugcugccucggaacugugacacccccaucuucgacuucagagucuucuu

SEQ ID NO: 176991 - RNA, 63 nt, Human
gcccugcucuggagggagggccaggagcugccacacccccaaguccucucagggcccacccuc

SEQ ID NO: 176992 - RNA, 63 nt, Human
cuagccccugccccaauccugcccuggccugaacacccccagggacagagcuggucucugggc

SEQ ID NO: 176993 - RNA, 63 nt, Human
uggaaaagcuggcccuguggcgugacgggggagcacccccauccagacugcgaagcugcucug

SEQ ID NO: 176994 - RNA, 63 nt, Human
ggagccccacagaggcagguccuggaaccaccccacccccacaccuggacgcucgcucuggug

SEQ ID NO: 176995 - RNA, 63 nt, Human
ugggugcacccggugcccucccucuccuacccccacccccacgguugcacuuuauuuauucgg

SEQ ID NO: 176996 - RNA, 63 nt, Human
cccuccgagauggucagugugucaugggaagcccacccccagcucugccagugcucucugggc

SEQ ID NO: 176997 - RNA, 63 nt, Human
uucugaacgcauuuguuauugaaggaaagacaccacccccaaauccugccaucuuauuggggc

SEQ ID NO: 176998 - RNA, 63 nt, Human
auguuugauuuguaaauuacaaauauaaauuaucacccccauuuccauuuauuuucuugauau

SEQ ID NO: 176999 - RNA, 63 nt, Human
ucucaaaaugacccacccagcuagagcacuguacacccccaguggagagccaauucaguccug

SEQ ID NO: 177000 - RNA, 63 nt, Human
ccuccccuucucacucuguugauguaauccucccacccccaguguccauccuaagacaggcau

SEQ ID NO: 177001 - RNA, 63 nt, Human
gcccauaccgaaauuuucugaaauuaaaucgcacacccccaccauuuccucucccugggaucu

SEQ ID NO: 177002 - RNA, 63 nt, Human
aagcugguuguggguuuuucaaggugccauagccacccccaaagauguuuguuuaaagcgugg

SEQ ID NO: 177003 - RNA, 63 nt, Human
augacagucagaggcgcaggagcccucccuccccacccccacccuguaacuccagcugccacu

SEQ ID NO: 177004 - RNA, 63 nt, Human
cagagccucugaggcagcgcaggggucaguucccacccccacccgucccaggcccaggccgaa

SEQ ID NO: 177005 - RNA, 63 nt, Human
aucccaccugugugcagugcccuugccugccuucacccccaccaccacuucuccaauaaagcc

SEQ ID NO: 177006 - RNA, 63 nt, Human
gugacaguggaugacgugaagccacaggagccccacccccaugcagccucuuccccacccccc

SEQ ID NO: 177007 - RNA, 63 nt, Human
aaccaaccaugaaugaaccccuggcuccuucaccacccccacgauugguaugaugcugccggc

SEQ ID NO: 177008 - RNA, 63 nt, Human
agagaugggaccuaagggucccaccccucaccccacccccaccucuucuguauguuugaauuc

SEQ ID NO: 177009 - RNA, 63 nt, Human
caccugcgggagcugcacuacagcccuggccuccacccccaccccgccgaccauccaagggag

SEQ ID NO: 177010 - RNA, 63 nt, Human
aucaggagcagaacagcaagcucucugucccugcacccccaccaucuuggggaccuacaaggg

SEQ ID NO: 177011 - RNA, 63 nt, Human
agagcaccauggcuccuacauuggaccuuggagcacccccacccuccccccaccgugcccuug

SEQ ID NO: 177012 - RNA, 63 nt, Human
acacuguuauuuggagcaugccauuggaaaacccacccccacccccccucaaaaaaacagaac

SEQ ID NO: 177013 - RNA, 63 nt, Human
cccuucacucccagcccagagcccccggccaggcacccccagggaaggcucugguggagaacc

SEQ ID NO: 177014 - RNA, 63 nt, Human
accauaucaacacuuagcccuacccauuaguaucacccccaguucuuacaguaaucccugaga

SEQ ID NO: 177015 - RNA, 63 nt, Human
ucuggucuguguccacuuuuucuaaaguaaccccacccccagcacaccauuguuggcaccucu

SEQ ID NO: 177016 - RNA, 63 nt, Human
gugcuguaggcuacauccugauaccuauaaguucacccccaccccacagcugcuggagagaaa

SEQ ID NO: 177017 - RNA, 63 nt, Human
ccuguuauccucuucuuucacccuaucucuucccacccccagcuucccuuugccccacaaagu

SEQ ID NO: 177018 - RNA, 63 nt, Human
cuuccccacccccuccucaggcuccugcgagcacacccccacccccaaaucccucccuguucu

SEQ ID NO: 177019 - RNA, 63 nt, Human
cacccccuccucaggcuccugcgagcacacccccacccccaaaucccucccuguucuacacug

SEQ ID NO: 177020 - RNA, 63 nt, Human
cccugaggcucagucucucucguauuuuguccccacccccaauuccuugagugguuuuugcuc

SEQ ID NO: 177021 - RNA, 63 nt, Human
ccauccccaacucccuaucccauccccagccuccacccccauccagaugggacucacguggcu

SEQ ID NO: 177022 - RNA, 63 nt, Human
uacugcuuucugcuuuucucccaccccuccuagcacccccacaucccccaucuaguaacaucu

SEQ ID NO: 177023 - RNA, 63 nt, Human
gggaaaccacuuccccaggcuucucccuccccccacccccauaggaacaggauuuggccuuag

SEQ ID NO: 177024 - RNA, 63 nt, Human
uauuucuccauccccucccugccugcuccuuggcacccccaugcugccuucagggagacaggc

SEQ ID NO: 177025 - RNA, 63 nt, Human
ggacagauggccuucuuugucaucuucacucuccacccccagagaggagucagagccauaacu

SEQ ID NO: 177026 - RNA, 63 nt, Human
ucaaucaauauaaaauauuuaugaggucucccccacccccaggagguuauaugauugcucuuc

SEQ ID NO: 177027 - RNA, 63 nt, Human
caugcuaaucgugguuucggggugagaauaaaacacccccacauaacaugcauuugcaugggc

SEQ ID NO: 177028 - RNA, 63 nt, Human
cugcagcgccucggucugugacaguccuccuagcacccccauggcuuugagccucggggacuc

SEQ ID NO: 177029 - RNA, 63 nt, Human
cuuggaacugaagggggcggccuaugacuugggcacccccagccugggccuauggagagcccu

SEQ ID NO: 177030 - RNA, 63 nt, Human
aguccugaaacaggcuccccucaccaggacagucacccccaaacuugacccccaacauuucaa

SEQ ID NO: 177031 - RNA, 63 nt, Human
cuggcacuuccucucuauugcccccaccaccaccacccccaucacugcuuucucccagaccuc

SEQ ID NO: 177032 - RNA, 63 nt, Human
agugaguuuccauuuccagcuggaaucugcagccacccccauuuccuguuuuccauucccccg

SEQ ID NO: 177033 - RNA, 63 nt, Human
ggggguggagguuggggucaccggccugcuuggcacccccaucugaaagagcagcacuucuca

SEQ ID NO: 177034 - RNA, 63 nt, Human
uguagugggaccagaaauuacuuaccugacauccacccccauucccccucauccugcuggggu

SEQ ID NO: 177035 - RNA, 63 nt, Human
cccuggguuaacaaaugagccauccccagggcccacccccaggaaggccacagugcugggcgg

SEQ ID NO: 177036 - RNA, 63 nt, Human
caauccugcugggaaccucuggagagccacaggcacccccagcuggaggccagacuccucucu

SEQ ID NO: 177037 - RNA, 63 nt, Human
gguccacugggagggaagcucuaucugggaacucacccccagcgcacacacaucucccccagg

SEQ ID NO: 177038 - RNA, 63 nt, Human
uacaaagacccuauacucucagucuccccaacccacccccaaggagcugugggaggcuuugug

SEQ ID NO: 177039 - RNA, 63 nt, Human
aggguaagaaaugagccuagucaccaagaacuccacccccagaggaaguggaucugcuucucc

SEQ ID NO: 177040 - RNA, 63 nt, Human
gggaggaaggggagccccguccuccaagggcagcacccccacuuucaacugaaucaagugagg

SEQ ID NO: 177041 - RNA, 63 nt, Human
ugaaacaugcacacugcaaauaucaaaaggagacacccccaaaucccacucuaaauuccaaag

SEQ ID NO: 177042 - RNA, 63 nt, Human
ugaaggacaaacaaccaagaguggcccaguccccacccccacaucuagcucagucucaaaucu

SEQ ID NO: 177043 - RNA, 63 nt, Human
caccucagcacuuggaagaagaggugacuuugccacccccaaaggugucugccacacccaagu

SEQ ID NO: 177044 - RNA, 63 nt, Human
uccccuccgcuccccacgcccccauauuggcaacacccccagcgccaccccaugcuccccaag

SEQ ID NO: 177045 - RNA, 63 nt, Human
aggcccccaagcugaucugguggugcauccacgcacccccacccugggacuuuggaugcuccc

SEQ ID NO: 177046 - RNA, 63 nt, Human
accacuggagcagcccacacuggcuugauggaucacccccaggaggggaaaaugguggcaaug

SEQ ID NO: 177047 - RNA, 63 nt, Human
ugguacccaaugucaugggaaugaugugccugucacccccauuggacaagcuggggaacagcc

SEQ ID NO: 177048 - RNA, 63 nt, Human
cagauccaguacucuguguaccugcuccagccccacccccacagagagaacuuguggcucugg

SEQ ID NO: 177049 - RNA, 63 nt, Human
gguugcgcugguauaguugcccagcgggagagacacccccauccccacgcgggccgggcacga

SEQ ID NO: 177050 - RNA, 63 nt, Human
ucaaacucugaauaugauuaaaccagaacaccccacccccaacugccaaaaaaaaaaaaaaaa

SEQ ID NO: 177051 - RNA, 56 nt, Human; identical to SEQ ID NO: 9524

SEQ ID NO: 177052 - RNA, 63 nt, Human
guugucgggacucgcaagugcccucaucacagccacccccaccacgagugucuccccagugca

SEQ ID NO: 177053 - RNA, 63 nt, Human
agucgacugccaaagaggcccagcagagggcagcacccccaucauuuuuuugaauuucucccu

SEQ ID NO: 177054 - RNA, 63 nt, Human
ggcccaguccugccgccguguccaggcgccccucacccccacaccugcugcauggcuggccac

SEQ ID NO: 177055 - RNA, 63 nt, Human
ggggagggugugguggguucuccacuccacugccacccccagcguggcugcuuucaaguucuu

SEQ ID NO: 177056 - RNA, 62 nt, Human; identical to SEQ ID NO: 9529

SEQ ID NO: 177057 - RNA, 63 nt, Human
cucugcaagugggagagacccgagcauccuccccacccccauagcuccagugcacgccacccc

SEQ ID NO: 177058 - RNA, 63 nt, Human
aauaauaauacaauauuuaaacaucaucucacccacccccacaaggggagaaaaaguagggga

SEQ ID NO: 177059 - RNA, 63 nt, Human
cugaaccgagagaacccagaggaacccccaccccacccccaccuaccacuccaugcuuucucu

SEQ ID NO: 177060 - RNA, 63 nt, Human
ccagaaaagaggaagacagauuuaaagugcccccacccccauuuguuucaaagaggucugcau

SEQ ID NO: 177061 - RNA, 63 nt, Human
uagcuccucuucccucgcccccacccucuaccccacccccaccuucgcucagacuuuaccggc

SEQ ID NO: 177062 - RNA, 63 nt, Human
cugaaggcagaagccacaagaggccuugagugccacccccagggaagaacauaaaggguugca

SEQ ID NO: 177063 - RNA, 63 nt, Human
ggcgaaagggcagcagcauguggcccauggcaccacccccacggcccagcacaaccccuagag

SEQ ID NO: 177064 - RNA, 63 nt, Human
ggcagcucuuuugcccagagcguucccuguagccacccccaccccacuugcccuugguucuuu

SEQ ID NO: 177065 - RNA, 63 nt, Human
gggcuuccuauccuggggccuaccccgggcaggcacccccaggggcuuauccuggacaggcac

SEQ ID NO: 177066 - RNA, 63 nt, Human
uuuuaauugaaaacaccagucauaaacuauuaccacccccacucucuuuugaucagaaauggc

SEQ ID NO: 177067 - RNA, 63 nt, Human
aguucccuguugcaugagccugcgacaggaccucacccccaccaccaggcuucuauuugggau

SEQ ID NO: 177068 - RNA, 63 nt, Human
cuuccugugaggcccucccggggcgccuccccucacccccaggcgcacgucuggccccgccuc

SEQ ID NO: 177069 - RNA, 63 nt, Human
cccaccaggaugugugcccagccaggccuccagcacccccagugcagcucgugauuggaaacu

SEQ ID NO: 177070 - RNA, 63 nt, Human
gcucagccacccucugccccauuccuagacccucacccccaccacuguuccugugucuucacg

SEQ ID NO: 177071 - RNA, 63 nt, Human
cagcacccuacucacccuguccagccccauggccacccccaccccugccucgcccccuacagg

SEQ ID NO: 177072 - RNA, 63 nt, Human
cugcacacggggccgcugggcaggugccccucacacccccaggaugucagugcucaccucgag

SEQ ID NO: 177073 - RNA, 63 nt, Human
gagugacgccacagcccaucccggugacaugcucacccccaacccccguguccgggaccccgg

SEQ ID NO: 177074 - RNA, 63 nt, Human
agagcuaaggaccaaggagaagaacagccucuccacccccaagccaggcgguugaggaacaua

SEQ ID NO: 177075 - RNA, 63 nt, Human
aaaauauauauuuacuaccauaauuucuaccaccacccccauuuugcucugcauuauacacag

SEQ ID NO: 177076 - RNA, 63 nt, Human
ccaaaggcuacagggugcuucuuccucuucccccacccccacugucccucaugugccaugggc

SEQ ID NO: 177077 - RNA, 63 nt, Human
guggcaggggagcagguuccccaagggcccuggcacccccacaagcugucccugcagggccau

SEQ ID NO: 177078 - RNA, 63 nt, Human
ccucccccaacccaacucgacccucccuccccucacccccaagguguagaauugugaauauaa

SEQ ID NO: 177079 - RNA, 63 nt, Human
acuauugcagaccugucacccugcaggacuugccacccccaguuccuaugacacaguuaucaa

SEQ ID NO: 177080 - RNA, 63 nt, Human
uucuggcuugacggcuucucucuuuuuuuaaaucacccccaccacauaaaucucaaauccuau

SEQ ID NO: 177081 - RNA, 63 nt, Human
cugcauccagauaccugccucguccgaggcagacacccccaccccugccuccuccagaccccc

SEQ ID NO: 177082 - RNA, 63 nt, Human
ugguccuggaggugcccuaccugcauccugcugcacccccacccacgacacucgagugcaaga

SEQ ID NO: 177083 - RNA, 63 nt, Human
gccaggagaagcucagcugcauuccgcagcccccacccccaagguucuccaacaucacagccc

SEQ ID NO: 177084 - RNA, 63 nt, Human
acagccuaguaugaaccguggaggauauaugcccacccccacuggggcgaagguggacuauau

SEQ ID NO: 177085 - RNA, 63 nt, Human
ggaaacaaugaccacuucucuaccauugucccccacccccaccccccagaauaacgcugacug

SEQ ID NO: 177086 - RNA, 63 nt, Human
cagggguucaggugguggagcaggaagccaccgcacccccaaagucacugggcccugagaaaa

SEQ ID NO: 177087 - RNA, 63 nt, Human
uuuuaucguagcaccaaagaaaugaaaacagaucacccccaaagccaagcaagugauugggua

SEQ ID NO: 177088 - RNA, 63 nt, Human
aacuguaccaguucugaagaccguuuucugccacacccccacccccagcugaccagggaggca

SEQ ID NO: 177089 - RNA, 63 nt, Human
accaguucugaagaccguuuucugccacacccccacccccagcugaccagggaggcagaggac

SEQ ID NO: 177090 - RNA, 63 nt, Human
aacugcgucuucucucagcccuccacacacacucacccccacucccacacacauacacacaca

SEQ ID NO: 177091 - RNA, 63 nt, Human
ugcuagauguguguuuagagcuaaaccagcccccacccccacccuccaccugccccucuugcc

SEQ ID NO: 177092 - RNA, 63 nt, Human
ccguuuuccccaugacaauguuguagugucccccacccccaccccccaggccuuggugccucu

SEQ ID NO: 177093 - RNA, 55 nt, Human; identical to SEQ ID NO: 9566

SEQ ID NO: 177094 - RNA, 63 nt, Human
ugaauuagcaccccacccccauaccccuucuuccacccccagacuaaaggaagauacuuacuc

SEQ ID NO: 177095 - RNA, 63 nt, Human
aaauguuucaaguacuguaacugugucaugauucacccccaaacagugacauuuauuuuucuc

SEQ ID NO: 177096 - RNA, 63 nt, Human
ugcuucucaagcugcagagaagcuuuucauucccacccccacccggaaccuccccuugccuaa

SEQ ID NO: 177097 - RNA, 63 nt, Human
caucucugcagggagagguuccaauguccaccccacccccagguacccgccucuucccacaga

SEQ ID NO: 177098 - RNA, 63 nt, Human
agagcagugcucagucaagggcuaaugauugcccacccccaagguaaagagccucauugcacu

SEQ ID NO: 177099 - RNA, 63 nt, Human
guguuucagaccuacaagaugggguacuaacaccacccccaccgcccccaccaccacccccag

SEQ ID NO: 177100 - RNA, 63 nt, Human
ggguacuaacaccacccccaccgcccccaccaccacccccagcuccugaggugcuggccagug

SEQ ID NO: 177101 - RNA, 63 nt, Human
caccacccccagcuccugaggugcuggccagugcacccccacucccacccucaaccgcggccc

SEQ ID NO: 177102 - RNA, 63 nt, Human
uuuaauccucugacaaguugacucuucgacccccacccccacccaagacauuuuaauaguaaa

SEQ ID NO: 177103 - RNA, 63 nt, Human
cugccucuguucacggggaugcuuggcuggagucacccccaggacuuauccaugcaucacuau

SEQ ID NO: 177104 - RNA, 63 nt, Human
cccccgaccuccacccccucagacuccaucccccacccccaggagccuggcugucucuagcga

SEQ ID NO: 177105 - RNA, 63 nt, Human
ucuuucaaaagaccccaccgacagaccgcauuccacccccaacaucggcacugagggacaucg

SEQ ID NO: 177106 - RNA, 61 nt, Human; identical to SEQ ID NO: 9579

SEQ ID NO: 177107 - RNA, 63 nt, Human
gaccuagcuagggaugcaagagugagcaagcagcacccccaccugcuggcuuggccucaaggu

SEQ ID NO: 177108 - RNA, 63 nt, Human
augugugaaacauccccucaggcugaagccccccacccccaccagagacacacugggaaccgu

SEQ ID NO: 177109 - RNA, 63 nt, Human
ccuggggcaggggcugugcacagacggaccccccacccccacacgcacuuuaugagggagacc

SEQ ID NO: 177110 - RNA, 63 nt, Human
aggcccuuaugagggcagcccagcccccgcacccacccccaaccagagaagcacagaucuugg

SEQ ID NO: 177111 - RNA, 63 nt, Human
cccaaagcugcugaggggucugaggcuggugcccacccccaagcuaguguguucucugccccu

SEQ ID NO: 177112 - RNA, 63 nt, Human
gaggaaugccucgcacaaaaggucuuccccacccacccccagcccccuagucuaauacccacc

SEQ ID NO: 177113 - RNA, 63 nt, Human
cuuucuuucccucuuuuucugcacugccauauucacccccaaccauccaaucuguggauaauu

SEQ ID NO: 177114 - RNA, 63 nt, Human
agacaccuugaggaggccgcuccuucccagacacacccccacgcccccacuggacggcauugg

SEQ ID NO: 177115 - RNA, 63 nt, Human
guucccccaacauguucccguucacucugcccccacccccaaaggcucagccucuaaaucuca

SEQ ID NO: 177116 - RNA, 63 nt, Human
accgggccggugggcgcccauuugggacugcgccacccccaggcuuguucuuguuuuacugua

SEQ ID NO: 177117 - RNA, 63 nt, Human
agcacgcugaccugugaaccccagccucaccaucacccccagcacugccagggacugcccugu

SEQ ID NO: 177118 - RNA, 63 nt, Human
uuagugaccucagcuuugauauuucacuuacagcacccccaacccuggcacccagggugggaa

SEQ ID NO: 177119 - RNA, 63 nt, Human
gauccccuuuuuuauuuuuuacaaccggaccuccacccccaacuuccuccagcccagcugggc

SEQ ID NO: 177120 - RNA, 63 nt, Human
agacagcugccugggaucccucauccucauacccacccccacccaagggccuggccugagcug

SEQ ID NO: 177121 - RNA, 63 nt, Human
cagcaucaguuuucuccacuucuuucucccacucacccccagcaaggugccuggggagacuug

SEQ ID NO: 177122 - RNA, 63 nt, Human
agcuaagggguggggcugcggggguuccguguccacccccauacauuuauuucuguaaauaau

SEQ ID NO: 177123 - RNA, 63 nt, Human
cccaaguguccuggacccuggccuaaagaaucccacccccacuucaugcccacugccgaugcc

SEQ ID NO: 177124 - RNA, 63 nt, Human
uugacuggcucaagaauuagggccccaacuacacacccccaagccacagggaagcauguacug

SEQ ID NO: 177125 - RNA, 63 nt, Human
ucuacugagcgagcugggccgguuaguguaugucacccccaccccaccccuaaguagucauca

SEQ ID NO: 177126 - RNA, 63 nt, Human
cuauuccaggcucuaggggcuggugcucauccccacccccagcgacuuccguccuaccuggca

SEQ ID NO: 177127 - RNA, 63 nt, Human
ucuccaguccaccccgguaaaagagcuguuccccacccccagggagcuccugucccugucagc

SEQ ID NO: 177128 - RNA, 63 nt, Human
aagucucugaguaggcaggguccuccugggaggcacccccaccuguuugaaaggucuggccag

SEQ ID NO: 177129 - RNA, 63 nt, Human
gaggagggagggcuccuuucuagccugcccccccacccccacuucaccccuccccagcuuccc

SEQ ID NO: 177130 - RNA, 63 nt, Human
ggggaccaaggucagggccccccugccccaccgcacccccagaauauaagcuaucaagaguau

SEQ ID NO: 177131 - RNA, 63 nt, Human
caguuuuaggccuuucuccuucuaagugccccccacccccauagccugcauguccacucccag

SEQ ID NO: 177132 - RNA, 63 nt, Human
gggaggggugggagcaugggaagggaggcaucccacccccaagaagaacugaauaaagauugc

SEQ ID NO: 177133 - RNA, 63 nt, Human
acaugcagaaggcacuaagcuuccugggccccucacccccagcuggaaauuaagaaaaagucg

SEQ ID NO: 177134 - RNA, 63 nt, Human
acaucaaggacaccugaggggucaggauauccccacccccacccugggaaagacgccuuuccc

SEQ ID NO: 177135 - RNA, 57 nt, Human; identical to SEQ ID NO: 9608

SEQ ID NO: 177136 - RNA, 63 nt, Human
ugugaugugugugaugcaccagagcacccccuccacccccaccuugggugugugugcgugguc

SEQ ID NO: 177137 - RNA, 63 nt, Human
caggcucacucccaaaacagacccaggcagccccacccccacggcagacccuggugucccugg

SEQ ID NO: 177138 - RNA, 63 nt, Human
auccuucugccuacugaaaucugauauauuacacacccccaaccuuuuuuuuuucaguuugga

SEQ ID NO: 177139 - RNA, 63 nt, Human
cagacucugggucccucggagcugccagccgggcacccccaaccucauggucauggacagaua

SEQ ID NO: 177140 - RNA, 63 nt, Human
acaaaauguuggcuacaacuugaggagaaaaaucacccccaaaggaguggacauuuccuaaca

SEQ ID NO: 177141 - RNA, 63 nt, Human
aggcaccagcacaaagaucugaaugaugcaccccacccccaccccaauaaagaaauaacagaa

SEQ ID NO: 177142 - RNA, 63 nt, Human
agagcuaauaggaacaaauacucuccccccgcccacccccauugguuuuaaugcugagaagaa

SEQ ID NO: 177143 - RNA, 63 nt, Human
gggugcaugugugugcacacacacacacacacacacccccacaccccuuugccgguuccucga

SEQ ID NO: 177144 - RNA, 63 nt, Human
cugggugugggucagacccugugacccacaugccacccccacccuccacagagcccccuugcu

SEQ ID NO: 177145 - RNA, 63 nt, Human
ugcagagaagccacccacguggggugugccaggcacccccagauacaaaugcagccacgcaca

SEQ ID NO: 177146 - RNA, 63 nt, Human
ugcugugcaguucuugccucccucacggggcgucacccccagcccagcuccguuguacauaaa

SEQ ID NO: 177147 - RNA, 63 nt, Human
gugccucuccugggacaaccagacucuguaacucacccccaccaccauacacacacacaaaaa

SEQ ID NO: 177148 - RNA, 63 nt, Human
cucaagcuggacugccagccccuguccucccuucacccccauugcguaugagcauuucagaac

SEQ ID NO: 177149 - RNA, 63 nt, Human
gcuccucuuugcuuccuucccucucucuccucccacccccauaggaucaguguguaccaggua

SEQ ID NO: 177150 - RNA, 63 nt, Human
ugaggguccugggggagcugaggcucugugcugcacccccagcccacagcuggggcaucucac

SEQ ID NO: 177151 - RNA, 63 nt, Human
ugcagagcuggggggaaggcgauguggugaccccacccccacccguuaauuuaaagcuguuuc

SEQ ID NO: 177152 - RNA, 63 nt, Human
accucaacccaggucuuggauuucaggucccuccacccccauucugagucucuguccuucucc

SEQ ID NO: 177153 - RNA, 63 nt, Human
cucccagaauuagccagcuugccuccugcaccccacccccaccaaccaggggagccacuaagc

SEQ ID NO: 177154 - RNA, 63 nt, Human
ggaguucucuuccgcagccccuuuccccacgcccacccccagucuccagggacccuugccugc

SEQ ID NO: 177155 - RNA, 63 nt, Human
uccuguccuaaaaauaggggccguuuucuuacacacccccagagagaggagggacugucacac

SEQ ID NO: 177156 - RNA, 63 nt, Human
acucugccccuggauggugcggggugcuuucuccacccccacacucccugcucagcuccucgu

SEQ ID NO: 177157 - RNA, 63 nt, Human
cgagcugcccccacccccggccucagccaccagcacccccauagggcccccagacaccacaca

SEQ ID NO: 177158 - RNA, 63 nt, Human
gcccgaguuccuccauuucccuggccugccccccacccccaaccugucccacccccgugcccc

SEQ ID NO: 177159 - RNA, 63 nt, Human
acgggccuacaggggggucuccccucaccccugcacccccagcugggggagcuggcucugccc

SEQ ID NO: 177160 - RNA, 63 nt, Human
gcucuucccugauggagacccugagaucuuccccacccccaaucaugaugucuucaguguggg

SEQ ID NO: 177161 - RNA, 63 nt, Human
gagcuucucaacaaccauguuacuccacuuccccacccccaccaggccucccuccuccccucc

SEQ ID NO: 177162 - RNA, 63 nt, Human
aaacaugugaaagauagguauggaaaaagcauacacccccaaacagaaaggaguuauuaaagu

SEQ ID NO: 177163 - RNA, 63 nt, Human
cauugguguugacauacauccaacauuaaaagccacccccaaaugcccaagaaaaaaagaaag

SEQ ID NO: 177164 - RNA, 63 nt, Human
acccuguucugguuuuuuuccucccuuuaguuccacccccaacccccauucccugguguccuu

SEQ ID NO: 177165 - RNA, 63 nt, Human
ccacccacuggcuguuucuccguccucuccuaucacccccaaacacucacuuugaaugcugca

SEQ ID NO: 177166 - RNA, 63 nt, Human
cucaccucuugguuagcgggagugugcugcccccacccccacccccgcacccccauucuacac

SEQ ID NO: 177167 - RNA, 63 nt, Human
agcgggagugugcugcccccacccccacccccgcacccccauucuacacaaggcagaagaggc

SEQ ID NO: 177168 - RNA, 63 nt, Human
aaccgaugcuccagccaaccccuguggagcccgcacccccacccuuuggggggggcccgccug

SEQ ID NO: 177169 - RNA, 63 nt, Human
ucuccuggcaaaaauucacugccacagacaaaccacccccacuccuacccagccagcccucaa

SEQ ID NO: 177170 - RNA, 63 nt, Human
aggcaggggcuuuuguauuuccugccucugccccacccccaaaguaagaagaaacauguuucc

SEQ ID NO: 177171 - RNA, 63 nt, Human
ccaucuugguggcugcacacucuuccuggcccgcacccccauccccagucccuguuccccaag

SEQ ID NO: 177172 - RNA, 63 nt, Human
ugccacuacucaccaguguuguucaccaacacccacccccacacacaccaacauuuugcugcc

SEQ ID NO: 177173 - RNA, 63 nt, Human
cagucuugggaggagcgcgcugcuuuggugagacacccccaugcaagguccucagaguagccg

SEQ ID NO: 177174 - RNA, 63 nt, Human
gucuuuauaggaggauaggccucugcccugccccacccccaccaccuguccccacccaguguc

SEQ ID NO: 177175 - RNA, 63 nt, Human
cccuccccacccaagagaggaaggaccccucaccacccccacuggugagacaguuuacuuugc

SEQ ID NO: 177176 - RNA, 63 nt, Human
cugaagucccucgcuuuuggggggggggucucucacccccaggccacauagggccagugguag

SEQ ID NO: 177177 - RNA, 63 nt, Human
gacccccccccgcccccgcuccacccuggagcccacccccaugggcaccgcgugccgccugca

SEQ ID NO: 177178 - RNA, 63 nt, Human
cacggacauuccaaagaccuccagagaccaccccacccccacauuccuuugaccagccuugug

SEQ ID NO: 177179 - RNA, 63 nt, Human
gcccccgaccuuauuuauuacccuccccucccacacccccaaucuaccuggugaugauuuuaa

SEQ ID NO: 177180 - RNA, 63 nt, Human
cugagaaaugcaaaggcucauauuuauaaaucccacccccagaguggggagggucaggugcca

SEQ ID NO: 177181 - RNA, 63 nt, Human
gaccccuguccugccccuccagaguaccccacgcacccccaggaccuucgccgucuccgugcc

SEQ ID NO: 177182 - RNA, 63 nt, Human
gaaacagcugcuucuccccccaucccagggucccacccccaacccccagagguggcccuuguu

SEQ ID NO: 177183 - RNA, 63 nt, Human
cauuccagccaggcccaggccagcccccccacccacccccaggccuccuaggggaagggggug

SEQ ID NO: 177184 - RNA, 63 nt, Human
ggcccugcaaacacaaccaucuacacacaucuacacccccaagcacacacacaugguccgugc

SEQ ID NO: 177185 - RNA, 63 nt, Human
ggggaacuuaucgacaaugcaagcuccugggcccacccccagaccuccugaaccaaaagcucc

SEQ ID NO: 177186 - RNA, 63 nt, Human
gcuggcagcauacccagagauccggggcccccccacccccaaaucacgagugcagcuggagcu

SEQ ID NO: 177187 - RNA, 63 nt, Human
cuuuauccucuaaugccccaaucucucucugaacacccccauucuccaccuguuggugggggg

SEQ ID NO: 177188 - RNA, 63 nt, Human
uucuccacuucuuguuccccacugacagccucccacccccaucucucccuccccugccauuuu

SEQ ID NO: 177189 - RNA, 63 nt, Human
gugccaacuaagggcccccacuguaagcccccgcacccccacccccugcccagagcaacagcc

SEQ ID NO: 177190 - RNA, 51 nt, Human; identical to SEQ ID NO: 9663

SEQ ID NO: 177191 - RNA, 63 nt, Human
guugaagagccccagggcuccugugaguggauucacccccaaggucagaauggcaacuccugg

SEQ ID NO: 177192 - RNA, 63 nt, Human
auuccccacccccggucccccauugaggcccgccacccccauaacuuugggagcgagggccca

SEQ ID NO: 177193 - RNA, 63 nt, Human
uuuacaggaacugagguccagagaggacauggacacccccagcucugucagagucacacgggg

SEQ ID NO: 177194 - RNA, 63 nt, Human
cuccaaguggggcagcucuccguacaugcgccccacccccaugagccaguucagcccuacugg

SEQ ID NO: 177195 - RNA, 63 nt, Human
uugaaaaacggugucauauuuagucagaggccccacccccaggaagcauggauggggaugaag

SEQ ID NO: 177196 - RNA, 63 nt, Human
aucacaaagccaaccaugcccagccccucccagcacccccagccccacgaccaucguucugaa

SEQ ID NO: 177197 - RNA, 63 nt, Human; identical to SEQ ID NO: 177196

SEQ ID NO: 177198 - RNA, 63 nt, Human
ugaagaaacuaacaagaaagcagggggaccugccacccccagccaaacccgagcaagggucgu

SEQ ID NO: 177199 - RNA, 63 nt, Human
aucacaaagccaaccaugcccggccccucccagcacccccagccccacgaccaucguucugaa

SEQ ID NO: 177200 - RNA, 63 nt, Human
cacaagaagacagaaaccuguaagcucugaccccacccccaccccuugagaggucagcggacc

SEQ ID NO: 177201 - RNA, 63 nt, Human
ugccagaggcaaacagccuuccaauugccccuccacccccagcugaggcccggucaccugguc

SEQ ID NO: 177202 - RNA, 63 nt, Human
ggagggcuaaggcuuuagcauugugaagcgcugcacccccaccaaccuuacccucaccgggga

SEQ ID NO: 177203 - RNA, 63 nt, Human
uccucuuaugcccuugauugugccagcccaugccacccccauccugggcacaguuacacccuc

SEQ ID NO: 177204 - RNA, 63 nt, Human
uuagggcgccggagcccgggccuggaacgcccucacccccaaccuccagucuccgcguuuugc

SEQ ID NO: 177205 - RNA, 63 nt, Human
gccccccuguccccagcccccagagcgcagggacacccccauccuaccccggcgccgggcgcg

SEQ ID NO: 177206 - RNA, 63 nt, Human
gagcugggcucuaucccacacccacccccaccccacccccacccagccuccagaagcuggaac

SEQ ID NO: 177207 - RNA, 63 nt, Human
gaggcuuggaggagcugggcucuaucccacacccacccccaccccacccccacccagccucca

SEQ ID NO: 177208 - RNA, 63 nt, Human
acccgauccugcagcucuuucuggaccuucaggcacccccaagcgugcagcucugucccagcc

SEQ ID NO: 177209 - RNA, 63 nt, Human
cccucggcccccucuccaaaagaagggcaugggcacccccaggagaggauggccccaaaaacc

SEQ ID NO: 177210 - RNA, 63 nt, Human
ccccacccgaucccucaaaugggcucuuggaggcacccccaggggcagcccauuucucaaagu

SEQ ID NO: 177211 - RNA, 63 nt, Human
cccuuuuaaguaucuuuuguacgcuuuucaccccacccccaaguccugggagaaaugcaggca

SEQ ID NO: 177212 - RNA, 52 nt, Human; identical to SEQ ID NO: 9685

SEQ ID NO: 177213 - RNA, 63 nt, Human
ccagcacccagcaacuccaacuaacaagaaacucacccccaaggggcagucuggaggggcaug

SEQ ID NO: 177214 - RNA, 63 nt, Human
uggagagccgcaugucacugucagagaugagcccacccccacccuucccugggggcgauuagc

SEQ ID NO: 177215 - RNA, 63 nt, Human
cuacgugagucacccaugaaauccagacauucucacccccagcggaugcacaggagccacuca

SEQ ID NO: 177216 - RNA, 63 nt, Human
cccucugcuggccagagggucugcaucucagcccacccccaaccccaccguuuggggugagaa

SEQ ID NO: 177217 - RNA, 63 nt, Human
cccagaggagcccagcggcccaagagcccgugccacccccagcccuggccccuccaauccucc

SEQ ID NO: 177218 - RNA, 63 nt, Human
cucuugccucccgacccccgcacucccuucuagcacccccaaaggaaaagccagaggaacaau

SEQ ID NO: 177219 - RNA, 63 nt, Human
gcccccacccucagcccgcuccugcccgcccagcacccccaggcccugggggaccugggguuc

SEQ ID NO: 177220 - RNA, 63 nt, Human
cucagaggcuuugcccgaauugcuucguccugucacccccaucaccaauuuugagggcagcca

SEQ ID NO: 177221 - RNA, 63 nt, Human
acaccuggacgugugggccacuuaagcccuccccacccccauccuauuccugaauaaaaccag

SEQ ID NO: 177222 - RNA, 63 nt, Human
cuucucccuguucucugggccugagccuggggccacccccaagugccgacuuguuucucccag

SEQ ID NO: 177223 - RNA, 52 nt, Human; identical to SEQ ID NO: 9696

SEQ ID NO: 177224 - RNA, 63 nt, Human
auguggccuuuuggcuggucccgucccugaugucacccccaccccaccagccccuuucauccc

SEQ ID NO: 177225 - RNA, 63 nt, Human
uggacuucuagggaucucagccguggcugaggccacccccagaggagccccugguccacagaa

SEQ ID NO: 177226 - RNA, 63 nt, Human
gggcagugcccuggccugaaggcccacaacccccacccccaggacugcugcuggagccuggac

SEQ ID NO: 177227 - RNA, 63 nt, Human
ggacagcggcugccugucccuucuucacccccucacccccauaauuugucuagaucuauuucc

SEQ ID NO: 177228 - RNA, 63 nt, Human
uguugucauugaauacggccucccgcagcaucccacccccaaaccaccgacucucauugccga

SEQ ID NO: 177229 - RNA, 59 nt, Human; identical to SEQ ID NO: 9702

SEQ ID NO: 177230 - RNA, 63 nt, Human
ugacuacuguuuuuauuaaaacauaagaaacuacacccccaaaauaagacuuucauucacauu

SEQ ID NO: 177231 - RNA, 63 nt, Human
ugagcuaaccuugguuuuaaaaauuagcauuagcacccccauuauauuaauuuucagggauag

SEQ ID NO: 177232 - RNA, 63 nt, Human
gagucuacagacuccagggcaaucaaaggucaccacccccaccccucaccucuaggauccuug

SEQ ID NO: 177233 - RNA, 63 nt, Human
acgaaaaugaucuuuacaauguaucccagcuuucacccccacauggcaaugcagaguuguauu

SEQ ID NO: 177234 - RNA, 63 nt, Human
gcccccggccguccccccucaucgccccgcgcccacccccaucgccccugcccccggcggcgg

SEQ ID NO: 177235 - RNA, 63 nt, Human
ccaccguggccccccacgccccauuaacccccacacccccauuccgcgcaauaaacgacagca

SEQ ID NO: 177236 - RNA, 63 nt, Human
agggccgcugugagcaaagcugaccccagcccccacccccaguuaacacugcugcuucucuga

SEQ ID NO: 177237 - RNA, 63 nt, Human
aaggugcgcaacauggcugccagccccgccucccacccccaccccgaguccugagcucacuuu

SEQ ID NO: 177238 - RNA, 63 nt, Human
caccucgggcaagucccagucccaguccucggccacccccagcucuggaucccagggccagcu

SEQ ID NO: 177239 - RNA, 63 nt, Human
gacaccccaggcugccaccccuccccacccguucacccccaggaugcuguugcuguaggacgc

SEQ ID NO: 177240 - RNA, 56 nt, Human; identical to SEQ ID NO: 9713

SEQ ID NO: 177241 - RNA, 63 nt, Human
ccaaggccgcaggacuggagggccaggccccgccacccccacgggagacccgggacagggcgu

SEQ ID NO: 177242 - RNA, 63 nt, Human
agggagggagggugggcacugcugggcugaguucacccccagggcuggccagauggggccagg

SEQ ID NO: 177243 - RNA, 63 nt, Human
ucggcugagaccuguguaaccugcugcccccuccacccccaacccaguccuaccugucacacc

SEQ ID NO: 177244 - RNA, 63 nt, Human
agagagggcauggaggcuccauacaaccucuuccacccccacaucuuucuuuguccuauacau

SEQ ID NO: 177245 - RNA, 63 nt, Human
cuuuauuuucuguuuuaugaguguguguccgcccacccccacccccuucaguguuaagugggg

SEQ ID NO: 177246 - RNA, 63 nt, Human
uuaaucccugcaccugaguugguccucccucugcacccccaccaccuccugcccgucuggcaa

SEQ ID NO: 177247 - RNA, 63 nt, Human
augggcccucugagcaacugugcagcacccuuucacccccaauuaaacccagaaccacugcuc

SEQ ID NO: 177248 - RNA, 63 nt, Human
uucauuuauuuauguauucaacuccaagggcgucacccccauuuucuacccauccccucaaua

SEQ ID NO: 177249 - RNA, 63 nt, Human
ccaggagccagggggugacuggagagacagacccacccccaagcagggcuccucuccccaggg

SEQ ID NO: 177250 - RNA, 63 nt, Human
gcccuugccccugccccuaccccugccagcgcccacccccagccagggccccucgccuuccuc

SEQ ID NO: 177251 - RNA, 63 nt, Human
cccugggccccccaccuuggugacucgccccaccacccccagcccugucccugccaccccucc

SEQ ID NO: 177252 - RNA, 63 nt, Human
ggagaagggcuaacaucagcucauugucaaggccacccccaccccagaacagaaccgugucuc

SEQ ID NO: 177253 - RNA, 63 nt, Human
uagcccccagccggccugagugggggauauugacacccccagcuaaagcacaagcaccuuagu

SEQ ID NO: 177254 - RNA, 63 nt, Human
ugggggggccagcuccugggccuggggucuucucacccccacccccuuguccuggguaggccc

SEQ ID NO: 177255 - RNA, 63 nt, Human
ggcuuugggaugucucuugagcaaccagaauagcacccccaacucugcuccccaaaacccauc

SEQ ID NO: 177256 - RNA, 63 nt, Human
gcuuuuuagccaacaacaaaaguguuuuccccccacccccacucgcccaccagggugaugcca

SEQ ID NO: 177257 - RNA, 63 nt, Human
caagggcaggguggguccagccuugagccccuccacccccaaauccuuccucuccucccaguc

SEQ ID NO: 177258 - RNA, 63 nt, Human
uuucucucccuccagagcucccacgagcugaugcacccccaggcuucaaaccaccuggaaugc

SEQ ID NO: 177259 - RNA, 63 nt, Human
ugugcuuugccgggaggagcggcggccgcagcccacccccacugcuguucgaaucaagcagga

SEQ ID NO: 177260 - RNA, 63 nt, Human
acuggggugggagggggcagggggcuuggcucgcacccccacuuucgccuccuccagcuccug

SEQ ID NO: 177261 - RNA, 63 nt, Human
gcuccugggauccgggaguccaucccggcccagcacccccagcauccccguguauggcccccc

SEQ ID NO: 177262 - RNA, 63 nt, Human
ucccccuccuucccagcugccccucccugccagcacccccacgcccucauuacggcuccucuc

SEQ ID NO: 177263 - RNA, 63 nt, Human
cccccugcccccaccacggccacuggccaucuccacccccagcugcuugugucccuccuggga

SEQ ID NO: 177264 - RNA, 63 nt, Human
ccugggggcucccuagccccucccagagcaucucacccccacccucauguucaggguggaugu

SEQ ID NO: 177265 - RNA, 52 nt, Human; identical to SEQ ID NO: 9738

SEQ ID NO: 177266 - RNA, 63 nt, Human
ccagcuuagcugacacacccccagcuggcccuccacccccaccucaagugccuuauucucaca

SEQ ID NO: 177267 - RNA, 63 nt, Human
caccacaccacucaggggcuggggcuucucucgcacccccagcaccucugucccaaaaccuca

SEQ ID NO: 177268 - RNA, 63 nt, Human
aggcucucuccccugcucucccaccucuaccuccacccccaccggccugacgcuguggccccg

SEQ ID NO: 177269 - RNA, 63 nt, Human
augggggugcaugcugggccuggcccccuggcccacccccacuuuccagggcaaaaagggccc

SEQ ID NO: 177270 - RNA, 55 nt, Human; identical to SEQ ID NO: 9743

SEQ ID NO: 177271 - RNA, 63 nt, Human
ccuauagccauaucucggccccuucccacucaccacccccaccccaggugcugggggucccuu

SEQ ID NO: 177272 - RNA, 63 nt, Human
cacucucccagccugugaccaccgauguccacacacccccaaccacuuguccacacagcuacc

SEQ ID NO: 177273 - RNA, 63 nt, Human; identical to SEQ ID NO: 9746

SEQ ID NO: 177274 - RNA, 63 nt, Human
aaggagaggaaugggggagaggacgugagggaccacccccacccacacagcugccgcagcauc

SEQ ID NO: 177275 - RNA, 63 nt, Human
ccaucucaguauugccugugggggccaccccuccacccccacccccaagugccuucgcucugu

SEQ ID NO: 177276 - RNA, 63 nt, Human
caguauugccugugggggccaccccuccacccccacccccaagugccuucgcucuguuuuuau

SEQ ID NO: 177277 - RNA, 63 nt, Human
gaggagccgugcaaucccaaccaggaugucuagcacccccauccccuuggcccuuccucaugc

SEQ ID NO: 177278 - RNA, 63 nt, Human
cugaaggugcccaccugggccaccagaaggugacacccccagaaucccuccccagagacugca

SEQ ID NO: 177279 - RNA, 63 nt, Human
gacuuuggggacagggggugggaaggggauggacacccccagcugacuguuggcucucugacg

SEQ ID NO: 177280 - RNA, 63 nt, Human
ggugucagugcggagaggcucugggccagaccucacccccagugacuuccgauugaggccaaa

SEQ ID NO: 177281 - RNA, 63 nt, Human
uuggucugucucuucccaccuuccaucugcacacacccccaagguaaggguacagcccggcug

SEQ ID NO: 177282 - RNA, 63 nt, Human
accacagggauccccaggaugcccacuucccuccacccccacaccccagccgugucccuaacc

SEQ ID NO: 177283 - RNA, 63 nt, Human
agggacccccugggucggcuucugucccugucacacccccaaccccagggaggggcugucaua

SEQ ID NO: 177284 - RNA, 63 nt, Human
ccuuuggaaauggugcagcacucuggcauuuaucacccccaccuggguccccugcaaccuccc

SEQ ID NO: 177285 - RNA, 63 nt, Human
guccccuccgccgugccggcggcagccccacuucacccccaacuucaccacccccugucccau

SEQ ID NO: 177286 - RNA, 63 nt, Human
gaaaaaucacucgcccuucugagaggcccaagacacccccaacagauaccagcauguacauag

SEQ ID NO: 177287 - RNA, 63 nt, Human
auagcucugacccuggaaugggguugguuuggacacccccagggaucugagcccugacccuuu

SEQ ID NO: 177288 - RNA, 63 nt, Human
gcccugacccuuugugacugcugaccccugagccacccccacucccacagggagccccggcca

SEQ ID NO: 177289 - RNA, 63 nt, Human
aguguugugagugcaugugaaaugggggauccccacccccagugcccuuccccuuccuggggc

SEQ ID NO: 177290 - RNA, 63 nt, Human
uuuauccauuuaucuuaauugaugucuguacuccacccccauuuuuaaauauuaaaaagcugc

SEQ ID NO: 177291 - RNA, 63 nt, Human
gcugcucacuuuugccggguuugguggccacuucacccccaacccugucucacccccauuauc

SEQ ID NO: 177292 - RNA, 63 nt, Human
gguuugguggccacuucacccccaacccugucucacccccauuaucccuccucaauuggaggc

SEQ ID NO: 177293 - RNA, 63 nt, Human
accguuccggaagagcuggcaaaaggagccucacacccccaaggaggggacggugccacuucc

SEQ ID NO: 177294 - RNA, 63 nt, Human
cuguugcccuagcccaccuggugccgugggagccacccccaggugcugggggcacagccccuc

SEQ ID NO: 177295 - RNA, 63 nt, Human
cugagcccagaccccggggucuggccgaauccucacccccagggcaguguuuuuggucugcca

SEQ ID NO: 177296 - RNA, 63 nt, Human
gcuacgccaggggaaaagagaguuaaggacacucacccccacccacgcacacacacaaggcag

SEQ ID NO: 177297 - RNA, 63 nt, Human
augugagcccggaacgcccgccugcccgccgcccacccccacugacccccgcugccuccccca

SEQ ID NO: 177298 - RNA, 63 nt, Human
ggaccugggagacgccccgagguguuugugcuucacccccagacgucagccucgaaggcagga

SEQ ID NO: 177299 - RNA, 63 nt, Human
cuccuucucaggccuccaacugugccccauuuccacccccaaauaccuccccaggaggcaccu

SEQ ID NO: 177300 - RNA, 63 nt, Human
aacaccucccucugaacuaaucccggagcaccccacccccagcgagucccaccuggaccucuu

SEQ ID NO: 177301 - RNA, 63 nt, Human
gccagaucccugcauuucaagcacuacgccuuccacccccaggcacuggaucccagauuccca

SEQ ID NO: 177302 - RNA, 63 nt, Human
agagagggcauggaggcuccacgcaaccccuuccacccccacaucuuccuuugucuuauacau

SEQ ID NO: 177303 - RNA, 63 nt, Human
ccauuccucaucccucacucccacccccacccccacccccaggaguugagugcauggaucugu

SEQ ID NO: 177304 - RNA, 63 nt, Human
ucccacccauuccucaucccucacucccacccccacccccacccccaggaguugagugcaugg

SEQ ID NO: 177305 - RNA, 63 nt, Human
cuugcuucccacccauuccucaucccucacucccacccccacccccacccccaggaguugagu

SEQ ID NO: 177306 - RNA, 63 nt, Human
uucuaacucagagcugaugaacaaaagcccccccacccccaaugccugccuccucacuccucc

SEQ ID NO: 177307 - RNA, 63 nt, Human
auaaaguuaucaaggacaaugccaaggguggggcacccccaaauuugacucugggagacucag

SEQ ID NO: 177308 - RNA, 63 nt, Human
acaccccccccccaccgaggccuaggccccugccacccccaagacugggaggggacuucuuuu

SEQ ID NO: 177309 - RNA, 63 nt, Human
uuuucggcuaaaaagaaugcagagaugugcccccacccccacccucgaccacccccgauggga

SEQ ID NO: 177310 - RNA, 63 nt, Human
gaggggcucacgcuuaacuccagcccccacccacacccccaucccacccaaccacaggcccca

SEQ ID NO: 177311 - RNA, 63 nt, Human
ccagagggccccagaguuccuugcaucuaauuucacccccaccccacccuccaggguuagggg

SEQ ID NO: 177312 - RNA, 63 nt, Human
ccaggagugucucuaagagauccaggagggagccacccccaaggacccugccagccacagacc

SEQ ID NO: 177313 - RNA, 63 nt, Human
accaggagggcagacccagccacauaccacaaccacccccaagccucacacucccuugucuuu

SEQ ID NO: 177314 - RNA, 63 nt, Human
uccuccagccuccuggccucccagccacuuccucacccccagugccuggacccggaggugaga

SEQ ID NO: 177315 - RNA, 63 nt, Human
ggaggagaggagugggguuuguugaugaaccuccacccccaccccacccccgcacgccuguaa

SEQ ID NO: 177316 - RNA, 63 nt, Human
cagaggccuuaugaggguccucuacuucaggaacacccccaugacauugcauuugggggggcu

SEQ ID NO: 177317 - RNA, 63 nt, Human
cugaaccccccccccccgccuuuuuuuaaaauucacccccauccacaguugucaguugugaag

SEQ ID NO: 177318 - RNA, 63 nt, Human
gcauccccucugggggcaggagcccacccccagcacccccaucuguuaauaaauaucucaacu

SEQ ID NO: 177319 - RNA, 63 nt, Human
cauccaccugcauccccucugggggcaggagcccacccccagcacccccaucuguuaauaaau

SEQ ID NO: 177320 - RNA, 63 nt, Human
gcccacuccaguuccagaccacccuccaugcuccacccccaggcgguuuggaccccaccacug

SEQ ID NO: 177321 - RNA, 63 nt, Human
aacagggcacaccccucuaguuucaugggcgagcacccccaucugccaccucagacugacaca

SEQ ID NO: 177322 - RNA, 63 nt, Human
cacagaagucgcaggcagccucucagaaaguuucacccccagaggacgaagaggucaagaacc

SEQ ID NO: 177323 - RNA, 63 nt, Human
ugaaccccaguacugacagccuccuuaaaguuucacccccagagggagccgagacucggaaag

SEQ ID NO: 177324 - RNA, 63 nt, Human
ccccuuaaguccucuugaaauaaacauaggucacacccccaaagcaaaagaguaacagacauu

SEQ ID NO: 177325 - RNA, 63 nt, Human
gcaauuuucccuucgccugccaugggcuucacccacccccacgccagggguaagugguuguga

SEQ ID NO: 177326 - RNA, 63 nt, Human
uaaacuugccuguucagagcacucauuccuucccacccccaguccuguccuaucacucuaauu

SEQ ID NO: 177327 - RNA, 63 nt, Human
uggcccaccugaggccccaggugggaacauggucacccccacucugcauacccucaucaaaaa

SEQ ID NO: 177328 - RNA, 63 nt, Human
aacccaggguccgaaugagcccugugaggcccacacccccaggugaaccugagccagagccgu

SEQ ID NO: 177329 - RNA, 63 nt, Human
gcaagccgggccguccguguuccauccuccacgcacccccaccuaucguugguucgcaaagug

SEQ ID NO: 177330 - RNA, 63 nt, Human
gaaauuuccaccccaguccccuccccagggaaccacccccaguaaccauccuggggaguuuaa

SEQ ID NO: 177331 - RNA, 63 nt, Human
uguccauuuauuuaagcccccauaggugcccuucacccccaaaaccagcuguacagaaucuuu

SEQ ID NO: 177332 - RNA, 63 nt, Human
auggaaauaggaagcgugggaggguccaguugccacccccaaaaauuccaaugauucuugaca

SEQ ID NO: 177333 - RNA, 63 nt, Human
cuuccccaggccccucggcucccucccagaucccacccccagccccacugguugccaaacacu

SEQ ID NO: 177334 - RNA, 63 nt, Human
agcacuggcuuuucuuuucagccccugacaggccacccccacuccucugcaugucuuggagag

SEQ ID NO: 177335 - RNA, 63 nt, Human
gccgagaggccugccuuuugccuggcccaggcucacccccaccuugggccucaccuccuccag

SEQ ID NO: 177336 - RNA, 63 nt, Human
caugaggaacaacugaccuguuuccuccaccuccacccccaccccuuaacuuggguaccccuc

SEQ ID NO: 177337 - RNA, 63 nt, Human
uaagagaacuccaaauagcccaagaggguggugcacccccaacuucauagggguagaggcucc

SEQ ID NO: 177338 - RNA, 50 nt, Human; identical to SEQ ID NO: 9811

SEQ ID NO: 177339 - RNA, 63 nt, Human
ccaccccaaccaucugaaccauuccugucuucucacccccaacgaugccaaucacgacaacuu

SEQ ID NO: 177340 - RNA, 63 nt, Human
caggaggcuggugccagggagacaggcccaacccacccccauuugcacugagaagagaaguuu

SEQ ID NO: 177341 - RNA, 63 nt, Human
ccacgauggcccccauugcccucaucacccugacacccccacauucucuccucuggaccccca

SEQ ID NO: 177342 - RNA, 63 nt, Human
uugcccaguagaauggacugaucuaugugcacacacccccaucacauggaaugggcuggucua

SEQ ID NO: 177343 - RNA, 63 nt, Human
ucuugagagcccuaauacuaaaagaugggcacccacccccaccaagggaagacugccccauuc

SEQ ID NO: 177344 - RNA, 63 nt, Human
ccauaggaucuugacuccaacagcggcaacccccacccccauugugguccguccuuaacccau

SEQ ID NO: 177345 - RNA, 63 nt, Human
ggccaacccacugggguagggaucaaagccagccacccccaccccaacacacucggugucccu

SEQ ID NO: 177346 - RNA, 63 nt, Human
agcaaguucucuugaaaggaaaucuaaacagugcacccccauggcugccacggaguauaagga

SEQ ID NO: 177347 - RNA, 63 nt, Human
auucccagagagccacgggggagggaucacccucacccccaacacccucuuccugagggcugu

SEQ ID NO: 177348 - RNA, 63 nt, Human
cuaguaggucugcacacauaacacacaucaguccacccccauugugaauguuguccuguguca

SEQ ID NO: 177349 - RNA, 63 nt, Human
gccugagcgaguuuguagugacucacugcacagcacccccagacuagcaugugguucuauauu

SEQ ID NO: 177350 - RNA, 63 nt, Human
ccuccacgaggugugacuaacuaugcaauaauccacccccaggugcagccccagggccugcgg

SEQ ID NO: 177351 - RNA, 63 nt, Human
aggguaggcacgaagcaauuuguugcugcuugucacccccaaguccccguggagguucuguau

SEQ ID NO: 177352 - RNA, 63 nt, Human
aauccccacguugagcugucuagcaugagcacccacccccacagcgcccugcacccggccgcu

SEQ ID NO: 177353 - RNA, 63 nt, Human
uggugacggcacagcccucacagcucaaacgcccacccccacucccaccaucugcagguggug

SEQ ID NO: 177354 - RNA, 63 nt, Human
ccugucacccccuccgugccacgcacugaaggccacccccacccaccugggaaacuaagaacu

SEQ ID NO: 177355 - RNA, 63 nt, Human
guguccaccuggugccggcgugauugccccgggcacccccagccagaacacgcagugccagcc

SEQ ID NO: 177356 - RNA, 63 nt, Human
acgagaacuuguccaugugccaagaggguggcgcacccccacuccauggggacagaagcucca

SEQ ID NO: 177357 - RNA, 63 nt, Human
cgcuuggcgcuccuccuccguccuaucccaacucacccccaaacccccaucccuuccccaccu

SEQ ID NO: 177358 - RNA, 63 nt, Human
caggccuuaggucuggccauucacacacacacacacccccacaccccacucccacacacaguu

SEQ ID NO: 177359 - RNA, 63 nt, Human
aguggcaggcccuguccuggguacagguggagccacccccaggaguugcguguguuuuucuua

SEQ ID NO: 177360 - RNA, 63 nt, Human
cuuauaucucucucuuuuucacucucuuccucccacccccaagacugaguuuuggggggcaag

SEQ ID NO: 177361 - RNA, 63 nt, Human
ccugucuucuccccuaggugguuccugagcccccacccccaaucccagugcuacaccugaggu

SEQ ID NO: 177362 - RNA, 63 nt, Human
ccagccuaggcccccugcaaggcuggcagcccccacccccaccccccaggccgccuugagaag

SEQ ID NO: 177363 - RNA, 63 nt, Human
aagaagggaacuaagagcaggucuuucaagccacacccccaccugcggauggauggguuucuc

SEQ ID NO: 177364 - RNA, 63 nt, Human
ugaaaagcaguuuagcugcaucugucuccccaccacccccaccccgggaggggcuuauguuac

SEQ ID NO: 177365 - RNA, 63 nt, Human
agggagaagaaauccauaacacccccaccccaacacccccaagacagcagucuucuucacccg

SEQ ID NO: 177366 - RNA, 63 nt, Human
guugcagagacgcaagggagaagaaauccauaacacccccaccccaacacccccaagacagca

SEQ ID NO: 177367 - RNA, 63 nt, Human
gagccuggcuccguccaggagccugugccuccucacccccagcuuugcuaccaaagcaccuua

SEQ ID NO: 177368 - RNA, 63 nt, Human
cuugcuucucauagccccggugugcggugcauacacccccaccuccugcaauaaaauaguagc

SEQ ID NO: 177369 - RNA, 63 nt, Human
cuugcuucuaauagaccugguacaugguacacacacccccaccuccugcaauuaaacaguagc

SEQ ID NO: 177370 - RNA, 63 nt, Human
uuugcuucucauagcccugguacaugguacacacacccccaccuccugcaauuaaacaguagc

SEQ ID NO: 177371 - RNA, 63 nt, Human
gcucccaacccauucacuacaggugaaggcucucacccccaucccugggggccuugggugagu

SEQ ID NO: 177372 - RNA, 63 nt, Human
cugagcugccgggccuccucgaggccccuaagccacccccagaggucccaucugaagcuggag

SEQ ID NO: 177373 - RNA, 63 nt, Human
cuuuacccaggaaaucuccggagccaacaccaccacccccagggggucuccccaccccacccc

SEQ ID NO: 177374 - RNA, 63 nt, Human
uccccagguguauuucagcagaccccggggacccacccccacugggccugcuggccucccucg

SEQ ID NO: 177375 - RNA, 63 nt, Human
agccaccccuggagucaccuguguguucaguggcacccccagccuggguccccuccucccaau

SEQ ID NO: 177376 - RNA, 63 nt, Human
guuugggggcuucccugggccucagccuccaggcacccccaggauucccagagagacgcugug

SEQ ID NO: 177377 - RNA, 63 nt, Human
cuccagacagcaagagcccaggugcacugcucacacccccaccugcauuuugaagucauauua

SEQ ID NO: 177378 - RNA, 63 nt, Human
gagaauccuggaggaauacacaauucaucguugcacccccaccucagaguguaaucgcauuuc

SEQ ID NO: 177379 - RNA, 63 nt, Human
gucccacugaagccccgcgccuccuccugccagcacccccagcaccugcuagcaggaggcacc

SEQ ID NO: 177380 - RNA, 63 nt, Human
auugcccacaccugccucugaacugcugcuggucacccccacccccgggugccugugaccggg

SEQ ID NO: 177381 - RNA, 63 nt, Human
cgcaaugaccagcaggaaccggaagcccugggucacccccacucugccucauuucugccucca

SEQ ID NO: 177382 - RNA, 63 nt, Human
auagaacacagcaauaacugggcuuccuguccccacccccaccccagcagugcucucuggcac

SEQ ID NO: 177383 - RNA, 63 nt, Human
cucccucuuaacccauguaggugccagagaaaccacccccacuccaugagaagaggcucagac

SEQ ID NO: 177384 - RNA, 63 nt, Human
cagcugccucucagggacugcacuguuccucuucacccccagguuccugcuaagaucccacgg

SEQ ID NO: 177385 - RNA, 63 nt, Human
uccccagccucgaagccaugggggcccccucgccacccccagccccuugggcuaucgaaguau

SEQ ID NO: 177386 - RNA, 63 nt, Human
caccuuccuccaggugugggagccuugccuuaucacccccaucaggucugcaugccagggugc

SEQ ID NO: 177387 - RNA, 63 nt, Human
gcugccuggguccuggcccuccucccccaucugcacccccaucauagguagagaccccacccu

SEQ ID NO: 177388 - RNA, 63 nt, Human
gcagggcucagggagcaggaggcugcauccguccacccccaggcgugggggacaaaagccaaa

SEQ ID NO: 177389 - RNA, 63 nt, Human
agcuucugagcuagagcuguacugccucacguacacccccaccucuguaaaugguccuugauu

SEQ ID NO: 177390 - RNA, 63 nt, Human
uagagcgggaaccuuccugagguguccuugggccacccccaaguguugggccaucugccaaga

SEQ ID NO: 177391 - RNA, 63 nt, Human
accuccaugccaggcaacagagggccacagaaccacccccacggcucacuccuuggucugggg

SEQ ID NO: 177392 - RNA, 63 nt, Human
agaauaagagugcacuacagcccaggcuuaugccacccccagcccaccugccucaccacccug

SEQ ID NO: 177393 - RNA, 63 nt, Human
auaucaaguccucgaugguaucugagcugcccacacccccaccugccaaggccccacagagcc

SEQ ID NO: 177394 - RNA, 63 nt, Human
uccuucagguccccuggcccuuccuucacccaccacccccaucaucaccgauucuuccuugcc

SEQ ID NO: 177395 - RNA, 63 nt, Human
acgcucugguucagcugccucugcacccccucccacccccagcacacacacaaguuggccccc

SEQ ID NO: 177396 - RNA, 63 nt, Human
ggguaguuggcuuggccuucucuuuggugaucccacccccagccauuugcauugcuggcccag

SEQ ID NO: 177397 - RNA, 63 nt, Human
gcagcucgcgaggcaccucuccucguccccacccacccccacauuugcacaccuuccacaggg

SEQ ID NO: 177398 - RNA, 63 nt, Human
ccuaauagcuguuccuuaggccccacuccaugccacccccaccagcuggaggacccagccuca

SEQ ID NO: 177399 - RNA, 63 nt, Human
cucaggccacagccggagccuccgcauugcccccacccccauuuuccagggggguuguaauuu

SEQ ID NO: 177400 - RNA, 63 nt, Human
guguguguguguguguguguggugcaggagugccacccccagggcccugucaaccucucuuuu

SEQ ID NO: 177401 - RNA, 63 nt, Human
agaggcuccuuucugccuccauggcuauccauccacccccacagaccccguuccuccagccug

SEQ ID NO: 177402 - RNA, 63 nt, Human
ccagcuccugagcacuucugaggggguggguuccacccccaggagggcggggguggguggagc

SEQ ID NO: 177403 - RNA, 63 nt, Human
gaggccccgcugaaaccugggcugcccuucccccacccccacggcucuccugguugaggaggg

SEQ ID NO: 177404 - RNA, 63 nt, Human
cuccccaggcccaacucugcuagcuucccagaccacccccaucgagugcggagagagugggag

SEQ ID NO: 177405 - RNA, 63 nt, Human
ugaggccccggcggcucagggcggggcuggccccacccccaugaccacugcccuggagguggc

SEQ ID NO: 177406 - RNA, 63 nt, Human
cucuuaucuaccuaugaccugcgagcugcccaccacccccaguuguugcgccuuuccagacag

SEQ ID NO: 177407 - RNA, 63 nt, Human
ugugucagagccugggggacgagucacccagcucacccccacaugcucaaaacagucaccaag

SEQ ID NO: 177408 - RNA, 63 nt, Human
ccagguccucccugauggacgccugccgcccgccacccccaucuccaccccaucauguuuaca

SEQ ID NO: 177409 - RNA, 63 nt, Human
uggaagaguuuuccgccucuuugugaugcugaacacccccaagguucuccccuccccccgcug

SEQ ID NO: 177410 - RNA, 63 nt, Human
gagaggagcugaggugcuacccggagccccauucacccccaccugcccacuugggaaucugag

SEQ ID NO: 177411 - RNA, 63 nt, Human
acucagaccaggaagcugugggcccuccugcuccacccccaucccacucccacccaugucugg

SEQ ID NO: 177412 - RNA, 63 nt, Human
ggagcagugggcaguucaugguguuagggcacucacccccacagacuggcaaacccugcagga

SEQ ID NO: 177413 - RNA, 63 nt, Human
uuucacugcuaggacaagcucagcuguugaggacacccccaccccaaauuucaguucuuacgu

SEQ ID NO: 177414 - RNA, 63 nt, Human
gcugggcuuccagggcuaggccccugccgcucccacccccacccaucugggccccggguucaa

SEQ ID NO: 177415 - RNA, 63 nt, Human
cucucagaugcagggcccuuggcucuggccucucacccccaaggcugucucuggcccugccga

SEQ ID NO: 177416 - RNA, 63 nt, Human
aucaacuguaucugauuucacuaauuuugacagcacccccaguaggguaggauuguguaugag

SEQ ID NO: 177417 - RNA, 63 nt, Human
ggauggagagaguugcucugggaguugggguaccacccccagggcaggauggggacaggauca

SEQ ID NO: 177418 - RNA, 63 nt, Human
auuccucuguccuaaaccguccccuccuucccucacccccagcacagggggauucugagcagu

SEQ ID NO: 177419 - RNA, 63 nt, Human
gcaggugccagggcccaccccagccucgccugucacccccacucccgccucagggccaggccc

SEQ ID NO: 177420 - RNA, 63 nt, Human
cuagacaacaggcaggaaggaugaaccucagggcacccccagguggugcggaaagccaggcag

SEQ ID NO: 177421 - RNA, 63 nt, Human
gaggcagaggaguugcucagaggcucacaugggcacccccauugguucgugugagcagcugcc

SEQ ID NO: 177422 - RNA, 63 nt, Human
guaccggaugcagaccccacccugucugcaggccacccccaccucccugcagcuuugaggcug

SEQ ID NO: 177423 - RNA, 63 nt, Human
cccucuccugggcgacgucaguggaccuuccugcacccccagccuggaauguaaaucagcugu

SEQ ID NO: 177424 - RNA, 63 nt, Human
uuauaaaggccugacccucuauugucccaucuucacccccauuccagagcagaggagucucug

SEQ ID NO: 177425 - RNA, 63 nt, Human
caaucucccaaagccaaguuuaccugcuguucucacccccaaugaggucuuaggcagauucuu

SEQ ID NO: 177426 - RNA, 63 nt, Human
gauuuucuguuacacuguauaguaguccuauggcacccccaccccaucccuuucgugccacuc

SEQ ID NO: 177427 - RNA, 63 nt, Human
cccaccccaucccuuucgugccacucccguccccacccccaccccaguguguauaagcuggca

SEQ ID NO: 177428 - RNA, 63 nt, Human
gguacuguuuuguuuguuaauaaagugcacugccacccccaaugcagacucgacuccuguauu

SEQ ID NO: 177429 - RNA, 63 nt, Human
gagcugcuggggauucuggccuagucccuuccacacccccaccccuugcucucaacccaggag

SEQ ID NO: 177430 - RNA, 63 nt, Human
uggggcaggaugauuuuggccucauuacuuuaccacccccacaccuggaaagcauauacuaua

SEQ ID NO: 177431 - RNA, 63 nt, Human
aaaaagagaauuuaggcaacuccacucccccuucacccccaacccuguauucuacucucccga

SEQ ID NO: 177432 - RNA, 63 nt, Human
agguggcuauuugcccugcagagcugggaguuucacccccaccccccacccuguucucuccuu

SEQ ID NO: 177433 - RNA, 63 nt, Human
cagucaaaaauuuaaaaucuuaaauguguaagucacccccaccaaaaacaaaagagaagaaaa

SEQ ID NO: 177434 - RNA, 55 nt, Human; identical to SEQ ID NO: 9907

SEQ ID NO: 177435 - RNA, 63 nt, Human
agauacugagccucucaccucccagcccucagccacccccaucccugccccuucugagacuca

SEQ ID NO: 177436 - RNA, 63 nt, Human
gcuacacaguaucaaaugaaugggucaauucagcacccccaaauuuaauucuguggggaaaaa

SEQ ID NO: 177437 - RNA, 63 nt, Human
gagucccagacaccgguuuuccuagaagccccucacccccacuggcccacugguggcuagguc

SEQ ID NO: 177438 - RNA, 63 nt, Human
agggccccguggccggcaggccggccccugccccacccccacccacgggugucccugcccacu

SEQ ID NO: 177439 - RNA, 63 nt, Human
agccgagcugguccuaggccccgccuagugccccacccccacccacagugcugcacuccuccu

SEQ ID NO: 177440 - RNA, 63 nt, Human
ggccugcucaggcuucccacccugugcggggcacacccccaggaagggacccuggacacggcu

SEQ ID NO: 177441 - RNA, 63 nt, Human
cuuucccgggcccucagcccucgggccgggcaccacccccaguccccccaguaaaagccucca

SEQ ID NO: 177442 - RNA, 63 nt, Human
aaaagaaaaguguuuuuagaaaugcguacaagucacccccaaauccuauugcuuaucuugggu

SEQ ID NO: 177443 - RNA, 63 nt, Human
ugagacaguaggaaggggggcuuggcuuuggcucacccccacuagagcauuuuuucaugcauu

SEQ ID NO: 177444 - RNA, 63 nt, Human
cugauggggugacuucugcuuugguccuuccaccacccccaccaaguaaaccaccuguggcag

SEQ ID NO: 177445 - RNA, 63 nt, Human
ggaucuguacccaggaccuggagaauaccaccccacccccagcccauaauugggacccagagc

SEQ ID NO: 177446 - RNA, 63 nt, Human
ccagucagaguagaugaugaggcccaugccccucacccccacgccccgccccuacaaccuaag

SEQ ID NO: 177447 - RNA, 63 nt, Human
agccccccuagcagcauuccaucccagccagagcacccccaccaucaggccagucaacugcac

SEQ ID NO: 177448 - RNA, 63 nt, Human
cccauguccucccugccuugggacccguccucucacccccagcaguugccaugggguuuccuu

SEQ ID NO: 177449 - RNA, 63 nt, Human
cggccaccagggggcuccuacucccacccccaccacccccagucaccauugucaccacacuca

SEQ ID NO: 177450 - RNA, 63 nt, Human
ccuggaucccggccaccagggggcuccuacucccacccccaccacccccagucaccauuguca

SEQ ID NO: 177451 - RNA, 63 nt, Human
ggcuuauaaugagaagcagcaguucccugcuugcacccccacauccaaaggauguggagcucu

SEQ ID NO: 177452 - RNA, 63 nt, Human
ccugaguuuugguuuguaaucuuuugucccucccacccccacagaagauuucuaaguagggug

SEQ ID NO: 177453 - RNA, 63 nt, Human
ucucgcucaucccugggcgcgccucccaccuuccacccccaacucccuuccaggguucgccuc

SEQ ID NO: 177454 - RNA, 63 nt, Human
ugagugcauguacuaucuuaucucagauauuugcacccccaaucugcccccaacucccaaaag

SEQ ID NO: 177455 - RNA, 63 nt, Human
caguucaucaguucauucccaaguauuuauugucacccccaaacaucucuggaguacuacugc

SEQ ID NO: 177456 - RNA, 63 nt, Human
cagaugcauccugcaucccagucccccucccagcacccccagccauccccccugucuuccccc

SEQ ID NO: 177457 - RNA, 63 nt, Human
ugcggcuaguccggcagcgaccuagaugggguccacccccauuccugcucaagcaugggcacc

SEQ ID NO: 177458 - RNA, 63 nt, Human
uauauguauauaucugguuauucaaagcuuccccacccccagucaucuaaauuuuucagguau

SEQ ID NO: 177459 - RNA, 63 nt, Human
uuguuccccacccccacccccacucccgccccgcacccccaaguugggacgccuuguuuagcu

SEQ ID NO: 177460 - RNA, 63 nt, Human
ggccugcgcucguccacccuuguuccccacccccacccccacucccgccccgcacccccaagu

SEQ ID NO: 177461 - RNA, 63 nt, Human
agcaccggccugcgcucguccacccuuguuccccacccccacccccacucccgccccgcaccc

SEQ ID NO: 177462 - RNA, 63 nt, Human
gguguggcgcauggcgcugggguuggaauggggcacccccaagucuguccccaggcucugccc

SEQ ID NO: 177463 - RNA, 63 nt, Human
caggcugagugccugggucagccaaaccccuggcacccccagggugacggguggcgagcuguu

SEQ ID NO: 177464 - RNA, 63 nt, Human
ucaccacacaauaggaucccccuucuugcccuccacccccauaagauugugaaggguuuacug

SEQ ID NO: 177465 - RNA, 64 nt, Human; identical to SEQ ID NO: 76682

SEQ ID NO: 177466 - RNA, 64 nt, Human; identical to SEQ ID NO: 76683

SEQ ID NO: 177467 - RNA, 64 nt, Human; identical to SEQ ID NO: 76684

SEQ ID NO: 177468 - RNA, 64 nt, Human; identical to SEQ ID NO: 76685

SEQ ID NO: 177469 - RNA, 64 nt, Human; identical to SEQ ID NO: 76686

SEQ ID NO: 177470 - RNA, 64 nt, Human; identical to SEQ ID NO: 76687

SEQ ID NO: 177471 - RNA, 64 nt, Human; identical to SEQ ID NO: 76688

SEQ ID NO: 177472 - RNA, 64 nt, Human; identical to SEQ ID NO: 76689

SEQ ID NO: 177473 - RNA, 64 nt, Human; identical to SEQ ID NO: 76690

SEQ ID NO: 177474 - RNA, 64 nt, Human; identical to SEQ ID NO: 76691

SEQ ID NO: 177475 - RNA, 64 nt, Human; identical to SEQ ID NO: 76692

SEQ ID NO: 177476 - RNA, 64 nt, Human; identical to SEQ ID NO: 76693

SEQ ID NO: 177477 - RNA, 64 nt, Human; identical to SEQ ID NO: 76694

SEQ ID NO: 177478 - RNA, 62 nt, Human; identical to SEQ ID NO: 76695

SEQ ID NO: 177479 - RNA, 64 nt, Human; identical to SEQ ID NO: 76696

SEQ ID NO: 177480 - RNA, 64 nt, Human; identical to SEQ ID NO: 76697

SEQ ID NO: 177481 - RNA, 64 nt, Human; identical to SEQ ID NO: 76698

SEQ ID NO: 177482 - RNA, 64 nt, Human; identical to SEQ ID NO: 76699

SEQ ID NO: 177483 - RNA, 64 nt, Human; identical to SEQ ID NO: 76700

SEQ ID NO: 177484 - RNA, 64 nt, Human; identical to SEQ ID NO: 76701

SEQ ID NO: 177485 - RNA, 64 nt, Human; identical to SEQ ID NO: 76702

SEQ ID NO: 177486 - RNA, 64 nt, Human; identical to SEQ ID NO: 76703

SEQ ID NO: 177487 - RNA, 64 nt, Human; identical to SEQ ID NO: 76704

SEQ ID NO: 177488 - RNA, 64 nt, Human; identical to SEQ ID NO: 76705

SEQ ID NO: 177489 - RNA, 64 nt, Human; identical to SEQ ID NO: 76706

SEQ ID NO: 177490 - RNA, 64 nt, Human; identical to SEQ ID NO: 76707

SEQ ID NO: 177491 - RNA, 64 nt, Human; identical to SEQ ID NO: 76708

SEQ ID NO: 177492 - RNA, 64 nt, Human; identical to SEQ ID NO: 76709

SEQ ID NO: 177493 - RNA, 64 nt, Human; identical to SEQ ID NO: 76710

SEQ ID NO: 177494 - RNA, 64 nt, Human; identical to SEQ ID NO: 76711

SEQ ID NO: 177495 - RNA, 64 nt, Human; identical to SEQ ID NO: 76712

SEQ ID NO: 177496 - RNA, 64 nt, Human; identical to SEQ ID NO: 76713

SEQ ID NO: 177497 - RNA, 64 nt, Human; identical to SEQ ID NO: 76714

SEQ ID NO: 177498 - RNA, 64 nt, Human; identical to SEQ ID NO: 76715

SEQ ID NO: 177499 - RNA, 64 nt, Human; identical to SEQ ID NO: 76716

SEQ ID NO: 177500 - RNA, 64 nt, Human; identical to SEQ ID NO: 76717

SEQ ID NO: 177501 - RNA, 64 nt, Human; identical to SEQ ID NO: 76718

SEQ ID NO: 177502 - RNA, 64 nt, Human; identical to SEQ ID NO: 76719

SEQ ID NO: 177503 - RNA, 64 nt, Human; identical to SEQ ID NO: 76720

SEQ ID NO: 177504 - RNA, 64 nt, Human; identical to SEQ ID NO: 76721

SEQ ID NO: 177505 - RNA, 64 nt, Human; identical to SEQ ID NO: 76722

SEQ ID NO: 177506 - RNA, 64 nt, Human; identical to SEQ ID NO: 76723

SEQ ID NO: 177507 - RNA, 64 nt, Human; identical to SEQ ID NO: 76724

SEQ ID NO: 177508 - RNA, 64 nt, Human; identical to SEQ ID NO: 76725

SEQ ID NO: 177509 - RNA, 64 nt, Human; identical to SEQ ID NO: 76726

SEQ ID NO: 177510 - RNA, 64 nt, Human; identical to SEQ ID NO: 76727

SEQ ID NO: 177511 - RNA, 64 nt, Human; identical to SEQ ID NO: 76728

SEQ ID NO: 177512 - RNA, 64 nt, Human; identical to SEQ ID NO: 76729

SEQ ID NO: 177513 - RNA, 64 nt, Human; identical to SEQ ID NO: 76730

SEQ ID NO: 177514 - RNA, 64 nt, Human; identical to SEQ ID NO: 76731

SEQ ID NO: 177515 - RNA, 50 nt, Human; identical to SEQ ID NO: 76732

SEQ ID NO: 177516 - RNA, 64 nt, Human; identical to SEQ ID NO: 76733

SEQ ID NO: 177517 - RNA, 64 nt, Human; identical to SEQ ID NO: 76734

SEQ ID NO: 177518 - RNA, 64 nt, Human; identical to SEQ ID NO: 76735

SEQ ID NO: 177519 - RNA, 64 nt, Human; identical to SEQ ID NO: 76736

SEQ ID NO: 177520 - RNA, 64 nt, Human; identical to SEQ ID NO: 76737

SEQ ID NO: 177521 - RNA, 64 nt, Human; identical to SEQ ID NO: 76738

SEQ ID NO: 177522 - RNA, 64 nt, Human; identical to SEQ ID NO: 76739

SEQ ID NO: 177523 - RNA, 64 nt, Human; identical to SEQ ID NO: 76740

SEQ ID NO: 177524 - RNA, 64 nt, Human; identical to SEQ ID NO: 76741

SEQ ID NO: 177525 - RNA, 64 nt, Human; identical to SEQ ID NO: 76742

SEQ ID NO: 177526 - RNA, 64 nt, Human; identical to SEQ ID NO: 76743

SEQ ID NO: 177527 - RNA, 64 nt, Human; identical to SEQ ID NO: 76744

SEQ ID NO: 177528 - RNA, 64 nt, Human; identical to SEQ ID NO: 76745

SEQ ID NO: 177529 - RNA, 64 nt, Human; identical to SEQ ID NO: 76746

SEQ ID NO: 177530 - RNA, 64 nt, Human; identical to SEQ ID NO: 76747

SEQ ID NO: 177531 - RNA, 64 nt, Human; identical to SEQ ID NO: 76748

SEQ ID NO: 177532 - RNA, 64 nt, Human; identical to SEQ ID NO: 76749

SEQ ID NO: 177533 - RNA, 64 nt, Human; identical to SEQ ID NO: 76750

SEQ ID NO: 177534 - RNA, 64 nt, Human; identical to SEQ ID NO: 76751

SEQ ID NO: 177535 - RNA, 64 nt, Human; identical to SEQ ID NO: 76752

SEQ ID NO: 177536 - RNA, 64 nt, Human; identical to SEQ ID NO: 76753

SEQ ID NO: 177537 - RNA, 64 nt, Human; identical to SEQ ID NO: 76754

SEQ ID NO: 177538 - RNA, 64 nt, Human; identical to SEQ ID NO: 76755

SEQ ID NO: 177539 - RNA, 64 nt, Human; identical to SEQ ID NO: 76756

SEQ ID NO: 177540 - RNA, 63 nt, Human; identical to SEQ ID NO: 76757

SEQ ID NO: 177541 - RNA, 64 nt, Human; identical to SEQ ID NO: 76758

SEQ ID NO: 177542 - RNA, 64 nt, Human; identical to SEQ ID NO: 76759

SEQ ID NO: 177543 - RNA, 64 nt, Human; identical to SEQ ID NO: 76760

SEQ ID NO: 177544 - RNA, 64 nt, Human; identical to SEQ ID NO: 76761

SEQ ID NO: 177545 - RNA, 64 nt, Human; identical to SEQ ID NO: 76762

SEQ ID NO: 177546 - RNA, 64 nt, Human; identical to SEQ ID NO: 76763

SEQ ID NO: 177547 - RNA, 64 nt, Human; identical to SEQ ID NO: 76764

SEQ ID NO: 177548 - RNA, 64 nt, Human; identical to SEQ ID NO: 76765

SEQ ID NO: 177549 - RNA, 64 nt, Human; identical to SEQ ID NO: 76766

SEQ ID NO: 177550 - RNA, 64 nt, Human; identical to SEQ ID NO: 76767

SEQ ID NO: 177551 - RNA, 64 nt, Human; identical to SEQ ID NO: 76768

SEQ ID NO: 177552 - RNA, 64 nt, Human; identical to SEQ ID NO: 76769

SEQ ID NO: 177553 - RNA, 64 nt, Human; identical to SEQ ID NO: 76770

SEQ ID NO: 177554 - RNA, 64 nt, Human; identical to SEQ ID NO: 76771

SEQ ID NO: 177555 - RNA, 64 nt, Human; identical to SEQ ID NO: 76772

SEQ ID NO: 177556 - RNA, 64 nt, Human; identical to SEQ ID NO: 76773

SEQ ID NO: 177557 - RNA, 64 nt, Human; identical to SEQ ID NO: 76774

SEQ ID NO: 177558 - RNA, 64 nt, Human; identical to SEQ ID NO: 76775

SEQ ID NO: 177559 - RNA, 64 nt, Human; identical to SEQ ID NO: 76776

SEQ ID NO: 177560 - RNA, 64 nt, Human; identical to SEQ ID NO: 76777

SEQ ID NO: 177561 - RNA, 64 nt, Human; identical to SEQ ID NO: 76778

SEQ ID NO: 177562 - RNA, 64 nt, Human; identical to SEQ ID NO: 76779

SEQ ID NO: 177563 - RNA, 64 nt, Human; identical to SEQ ID NO: 76780

SEQ ID NO: 177564 - RNA, 64 nt, Human; identical to SEQ ID NO: 76781

SEQ ID NO: 177565 - RNA, 64 nt, Human; identical to SEQ ID NO: 76782

SEQ ID NO: 177566 - RNA, 64 nt, Human; identical to SEQ ID NO: 76783

SEQ ID NO: 177567 - RNA, 64 nt, Human; identical to SEQ ID NO: 76784

SEQ ID NO: 177568 - RNA, 64 nt, Human; identical to SEQ ID NO: 76785

SEQ ID NO: 177569 - RNA, 64 nt, Human; identical to SEQ ID NO: 76786

SEQ ID NO: 177570 - RNA, 64 nt, Human; identical to SEQ ID NO: 76787

SEQ ID NO: 177571 - RNA, 64 nt, Human; identical to SEQ ID NO: 76788

SEQ ID NO: 177572 - RNA, 64 nt, Human; identical to SEQ ID NO: 76789

SEQ ID NO: 177573 - RNA, 64 nt, Human; identical to SEQ ID NO: 76790

SEQ ID NO: 177574 - RNA, 64 nt, Human; identical to SEQ ID NO: 76791

SEQ ID NO: 177575 - RNA, 64 nt, Human; identical to SEQ ID NO: 76792

SEQ ID NO: 177576 - RNA, 57 nt, Human; identical to SEQ ID NO: 76793

SEQ ID NO: 177577 - RNA, 64 nt, Human; identical to SEQ ID NO: 76794

SEQ ID NO: 177578 - RNA, 64 nt, Human; identical to SEQ ID NO: 76795

SEQ ID NO: 177579 - RNA, 64 nt, Human; identical to SEQ ID NO: 76796

SEQ ID NO: 177580 - RNA, 64 nt, Human; identical to SEQ ID NO: 76797

SEQ ID NO: 177581 - RNA, 64 nt, Human; identical to SEQ ID NO: 76798

SEQ ID NO: 177582 - RNA, 64 nt, Human; identical to SEQ ID NO: 76799

SEQ ID NO: 177583 - RNA, 64 nt, Human; identical to SEQ ID NO: 76800

SEQ ID NO: 177584 - RNA, 64 nt, Human; identical to SEQ ID NO: 76801

SEQ ID NO: 177585 - RNA, 64 nt, Human; identical to SEQ ID NO: 76802

SEQ ID NO: 177586 - RNA, 64 nt, Human; identical to SEQ ID NO: 76803

SEQ ID NO: 177587 - RNA, 64 nt, Human; identical to SEQ ID NO: 76804

SEQ ID NO: 177588 - RNA, 64 nt, Human; identical to SEQ ID NO: 76805

SEQ ID NO: 177589 - RNA, 64 nt, Human; identical to SEQ ID NO: 76806

SEQ ID NO: 177590 - RNA, 64 nt, Human; identical to SEQ ID NO: 76807

SEQ ID NO: 177591 - RNA, 64 nt, Human; identical to SEQ ID NO: 76808

SEQ ID NO: 177592 - RNA, 64 nt, Human; identical to SEQ ID NO: 76809

SEQ ID NO: 177593 - RNA, 64 nt, Human; identical to SEQ ID NO: 76810

SEQ ID NO: 177594 - RNA, 64 nt, Human; identical to SEQ ID NO: 76811

SEQ ID NO: 177595 - RNA, 64 nt, Human; identical to SEQ ID NO: 76812

SEQ ID NO: 177596 - RNA, 64 nt, Human; identical to SEQ ID NO: 76813

SEQ ID NO: 177597 - RNA, 64 nt, Human; identical to SEQ ID NO: 76814

SEQ ID NO: 177598 - RNA, 64 nt, Human; identical to SEQ ID NO: 76815

SEQ ID NO: 177599 - RNA, 64 nt, Human; identical to SEQ ID NO: 76816

SEQ ID NO: 177600 - RNA, 64 nt, Human; identical to SEQ ID NO: 76817

SEQ ID NO: 177601 - RNA, 64 nt, Human; identical to SEQ ID NO: 76818

SEQ ID NO: 177602 - RNA, 64 nt, Human; identical to SEQ ID NO: 76819

SEQ ID NO: 177603 - RNA, 64 nt, Human; identical to SEQ ID NO: 76820

SEQ ID NO: 177604 - RNA, 62 nt, Human; identical to SEQ ID NO: 76821

SEQ ID NO: 177605 - RNA, 64 nt, Human; identical to SEQ ID NO: 76822

SEQ ID NO: 177606 - RNA, 64 nt, Human; identical to SEQ ID NO: 76823

SEQ ID NO: 177607 - RNA, 59 nt, Human; identical to SEQ ID NO: 76824

SEQ ID NO: 177608 - RNA, 64 nt, Human; identical to SEQ ID NO: 76825

SEQ ID NO: 177609 - RNA, 64 nt, Human; identical to SEQ ID NO: 76826

SEQ ID NO: 177610 - RNA, 64 nt, Human; identical to SEQ ID NO: 76827

SEQ ID NO: 177611 - RNA, 64 nt, Human; identical to SEQ ID NO: 76828

SEQ ID NO: 177612 - RNA, 64 nt, Human; identical to SEQ ID NO: 76829

SEQ ID NO: 177613 - RNA, 64 nt, Human; identical to SEQ ID NO: 76830

SEQ ID NO: 177614 - RNA, 64 nt, Human; identical to SEQ ID NO: 76831

SEQ ID NO: 177615 - RNA, 61 nt, Human; identical to SEQ ID NO: 76832

SEQ ID NO: 177616 - RNA, 64 nt, Human; identical to SEQ ID NO: 76833

SEQ ID NO: 177617 - RNA, 64 nt, Human; identical to SEQ ID NO: 76834

SEQ ID NO: 177618 - RNA, 64 nt, Human; identical to SEQ ID NO: 76835

SEQ ID NO: 177619 - RNA, 64 nt, Human; identical to SEQ ID NO: 76836

SEQ ID NO: 177620 - RNA, 64 nt, Human; identical to SEQ ID NO: 76837

SEQ ID NO: 177621 - RNA, 64 nt, Human; identical to SEQ ID NO: 76838

SEQ ID NO: 177622 - RNA, 64 nt, Human; identical to SEQ ID NO: 76839

SEQ ID NO: 177623 - RNA, 64 nt, Human; identical to SEQ ID NO: 76840

SEQ ID NO: 177624 - RNA, 64 nt, Human; identical to SEQ ID NO: 76841

SEQ ID NO: 177625 - RNA, 64 nt, Human; identical to SEQ ID NO: 76842

SEQ ID NO: 177626 - RNA, 64 nt, Human; identical to SEQ ID NO: 76843

SEQ ID NO: 177627 - RNA, 64 nt, Human; identical to SEQ ID NO: 76844

SEQ ID NO: 177628 - RNA, 64 nt, Human; identical to SEQ ID NO: 76845

SEQ ID NO: 177629 - RNA, 64 nt, Human; identical to SEQ ID NO: 76846

SEQ ID NO: 177630 - RNA, 64 nt, Human; identical to SEQ ID NO: 76847

SEQ ID NO: 177631 - RNA, 64 nt, Human; identical to SEQ ID NO: 76848

SEQ ID NO: 177632 - RNA, 64 nt, Human; identical to SEQ ID NO: 76849

SEQ ID NO: 177633 - RNA, 64 nt, Human; identical to SEQ ID NO: 76850

SEQ ID NO: 177634 - RNA, 64 nt, Human; identical to SEQ ID NO: 76851

SEQ ID NO: 177635 - RNA, 64 nt, Human; identical to SEQ ID NO: 76852

SEQ ID NO: 177636 - RNA, 64 nt, Human; identical to SEQ ID NO: 76853

SEQ ID NO: 177637 - RNA, 64 nt, Human; identical to SEQ ID NO: 76854

SEQ ID NO: 177638 - RNA, 64 nt, Human; identical to SEQ ID NO: 76855

SEQ ID NO: 177639 - RNA, 64 nt, Human; identical to SEQ ID NO: 76856

SEQ ID NO: 177640 - RNA, 64 nt, Human; identical to SEQ ID NO: 76857

SEQ ID NO: 177641 - RNA, 64 nt, Human; identical to SEQ ID NO: 76858

SEQ ID NO: 177642 - RNA, 64 nt, Human; identical to SEQ ID NO: 76859

SEQ ID NO: 177643 - RNA, 64 nt, Human; identical to SEQ ID NO: 76860

SEQ ID NO: 177644 - RNA, 64 nt, Human; identical to SEQ ID NO: 76861

SEQ ID NO: 177645 - RNA, 64 nt, Human; identical to SEQ ID NO: 76862

SEQ ID NO: 177646 - RNA, 64 nt, Human; identical to SEQ ID NO: 76863

SEQ ID NO: 177647 - RNA, 64 nt, Human; identical to SEQ ID NO: 76864

SEQ ID NO: 177648 - RNA, 64 nt, Human; identical to SEQ ID NO: 76865

SEQ ID NO: 177649 - RNA, 64 nt, Human; identical to SEQ ID NO: 76866

SEQ ID NO: 177650 - RNA, 64 nt, Human; identical to SEQ ID NO: 76867

SEQ ID NO: 177651 - RNA, 64 nt, Human; identical to SEQ ID NO: 76868

SEQ ID NO: 177652 - RNA, 64 nt, Human; identical to SEQ ID NO: 76869

SEQ ID NO: 177653 - RNA, 64 nt, Human; identical to SEQ ID NO: 76870

SEQ ID NO: 177654 - RNA, 64 nt, Human; identical to SEQ ID NO: 76871

SEQ ID NO: 177655 - RNA, 64 nt, Human; identical to SEQ ID NO: 76872

SEQ ID NO: 177656 - RNA, 64 nt, Human; identical to SEQ ID NO: 76873

SEQ ID NO: 177657 - RNA, 64 nt, Human; identical to SEQ ID NO: 76874

SEQ ID NO: 177658 - RNA, 64 nt, Human; identical to SEQ ID NO: 76875

SEQ ID NO: 177659 - RNA, 64 nt, Human; identical to SEQ ID NO: 76876

SEQ ID NO: 177660 - RNA, 64 nt, Human; identical to SEQ ID NO: 76877

SEQ ID NO: 177661 - RNA, 64 nt, Human; identical to SEQ ID NO: 76878

SEQ ID NO: 177662 - RNA, 64 nt, Human; identical to SEQ ID NO: 76879

SEQ ID NO: 177663 - RNA, 64 nt, Human; identical to SEQ ID NO: 76880

SEQ ID NO: 177664 - RNA, 64 nt, Human; identical to SEQ ID NO: 76881

SEQ ID NO: 177665 - RNA, 64 nt, Human; identical to SEQ ID NO: 76882

SEQ ID NO: 177666 - RNA, 64 nt, Human; identical to SEQ ID NO: 76883

SEQ ID NO: 177667 - RNA, 64 nt, Human; identical to SEQ ID NO: 76884

SEQ ID NO: 177668 - RNA, 64 nt, Human; identical to SEQ ID NO: 76885

SEQ ID NO: 177669 - RNA, 64 nt, Human; identical to SEQ ID NO: 76886

SEQ ID NO: 177670 - RNA, 64 nt, Human; identical to SEQ ID NO: 76887

SEQ ID NO: 177671 - RNA, 64 nt, Human; identical to SEQ ID NO: 76888

SEQ ID NO: 177672 - RNA, 64 nt, Human; identical to SEQ ID NO: 76889

SEQ ID NO: 177673 - RNA, 64 nt, Human; identical to SEQ ID NO: 76890

SEQ ID NO: 177674 - RNA, 64 nt, Human; identical to SEQ ID NO: 76891

SEQ ID NO: 177675 - RNA, 64 nt, Human; identical to SEQ ID NO: 76892

SEQ ID NO: 177676 - RNA, 64 nt, Human; identical to SEQ ID NO: 76893

SEQ ID NO: 177677 - RNA, 64 nt, Human; identical to SEQ ID NO: 76894

SEQ ID NO: 177678 - RNA, 64 nt, Human; identical to SEQ ID NO: 76895

SEQ ID NO: 177679 - RNA, 64 nt, Human; identical to SEQ ID NO: 76896

SEQ ID NO: 177680 - RNA, 64 nt, Human; identical to SEQ ID NO: 76897

SEQ ID NO: 177681 - RNA, 64 nt, Human; identical to SEQ ID NO: 76898

SEQ ID NO: 177682 - RNA, 64 nt, Human; identical to SEQ ID NO: 76899

SEQ ID NO: 177683 - RNA, 64 nt, Human; identical to SEQ ID NO: 76900

SEQ ID NO: 177684 - RNA, 64 nt, Human; identical to SEQ ID NO: 76901

SEQ ID NO: 177685 - RNA, 64 nt, Human; identical to SEQ ID NO: 76902

SEQ ID NO: 177686 - RNA, 64 nt, Human; identical to SEQ ID NO: 76903

SEQ ID NO: 177687 - RNA, 64 nt, Human; identical to SEQ ID NO: 76904

SEQ ID NO: 177688 - RNA, 64 nt, Human; identical to SEQ ID NO: 76905

SEQ ID NO: 177689 - RNA, 64 nt, Human; identical to SEQ ID NO: 76906

SEQ ID NO: 177690 - RNA, 64 nt, Human; identical to SEQ ID NO: 76907

SEQ ID NO: 177691 - RNA, 64 nt, Human; identical to SEQ ID NO: 76908

SEQ ID NO: 177692 - RNA, 54 nt, Human; identical to SEQ ID NO: 76909

SEQ ID NO: 177693 - RNA, 64 nt, Human; identical to SEQ ID NO: 76910

SEQ ID NO: 177694 - RNA, 64 nt, Human; identical to SEQ ID NO: 76911

SEQ ID NO: 177695 - RNA, 64 nt, Human; identical to SEQ ID NO: 76912

SEQ ID NO: 177696 - RNA, 64 nt, Human; identical to SEQ ID NO: 76913

SEQ ID NO: 177697 - RNA, 64 nt, Human; identical to SEQ ID NO: 76914

SEQ ID NO: 177698 - RNA, 64 nt, Human; identical to SEQ ID NO: 76915

SEQ ID NO: 177699 - RNA, 64 nt, Human; identical to SEQ ID NO: 76916

SEQ ID NO: 177700 - RNA, 64 nt, Human; identical to SEQ ID NO: 76917

SEQ ID NO: 177701 - RNA, 64 nt, Human; identical to SEQ ID NO: 76918

SEQ ID NO: 177702 - RNA, 64 nt, Human; identical to SEQ ID NO: 76919

SEQ ID NO: 177703 - RNA, 64 nt, Human; identical to SEQ ID NO: 76920

SEQ ID NO: 177704 - RNA, 64 nt, Human; identical to SEQ ID NO: 76921

SEQ ID NO: 177705 - RNA, 64 nt, Human; identical to SEQ ID NO: 76922

SEQ ID NO: 177706 - RNA, 64 nt, Human; identical to SEQ ID NO: 76923

SEQ ID NO: 177707 - RNA, 64 nt, Human; identical to SEQ ID NO: 76924

SEQ ID NO: 177708 - RNA, 64 nt, Human; identical to SEQ ID NO: 76925

SEQ ID NO: 177709 - RNA, 64 nt, Human; identical to SEQ ID NO: 76926

SEQ ID NO: 177710 - RNA, 64 nt, Human; identical to SEQ ID NO: 76927

SEQ ID NO: 177711 - RNA, 64 nt, Human; identical to SEQ ID NO: 76928

SEQ ID NO: 177712 - RNA, 64 nt, Human; identical to SEQ ID NO: 76929

SEQ ID NO: 177713 - RNA, 64 nt, Human; identical to SEQ ID NO: 76930

SEQ ID NO: 177714 - RNA, 64 nt, Human; identical to SEQ ID NO: 76931

SEQ ID NO: 177715 - RNA, 64 nt, Human; identical to SEQ ID NO: 76932

SEQ ID NO: 177716 - RNA, 64 nt, Human; identical to SEQ ID NO: 76933

SEQ ID NO: 177717 - RNA, 64 nt, Human; identical to SEQ ID NO: 76934

SEQ ID NO: 177718 - RNA, 64 nt, Human; identical to SEQ ID NO: 76935

SEQ ID NO: 177719 - RNA, 64 nt, Human; identical to SEQ ID NO: 76936

SEQ ID NO: 177720 - RNA, 64 nt, Human; identical to SEQ ID NO: 76937

SEQ ID NO: 177721 - RNA, 64 nt, Human; identical to SEQ ID NO: 76938

SEQ ID NO: 177722 - RNA, 64 nt, Human; identical to SEQ ID NO: 76939

SEQ ID NO: 177723 - RNA, 64 nt, Human; identical to SEQ ID NO: 76940

SEQ ID NO: 177724 - RNA, 64 nt, Human; identical to SEQ ID NO: 76941

SEQ ID NO: 177725 - RNA, 64 nt, Human; identical to SEQ ID NO: 76942

SEQ ID NO: 177726 - RNA, 64 nt, Human; identical to SEQ ID NO: 76943

SEQ ID NO: 177727 - RNA, 64 nt, Human; identical to SEQ ID NO: 76944

SEQ ID NO: 177728 - RNA, 64 nt, Human; identical to SEQ ID NO: 76945

SEQ ID NO: 177729 - RNA, 64 nt, Human; identical to SEQ ID NO: 76946

SEQ ID NO: 177730 - RNA, 64 nt, Human; identical to SEQ ID NO: 76947

SEQ ID NO: 177731 - RNA, 64 nt, Human; identical to SEQ ID NO: 76948

SEQ ID NO: 177732 - RNA, 64 nt, Human; identical to SEQ ID NO: 76949

SEQ ID NO: 177733 - RNA, 64 nt, Human; identical to SEQ ID NO: 76950

SEQ ID NO: 177734 - RNA, 64 nt, Human; identical to SEQ ID NO: 76951

SEQ ID NO: 177735 - RNA, 64 nt, Human; identical to SEQ ID NO: 76952

SEQ ID NO: 177736 - RNA, 64 nt, Human; identical to SEQ ID NO: 76953

SEQ ID NO: 177737 - RNA, 64 nt, Human; identical to SEQ ID NO: 76954

SEQ ID NO: 177738 - RNA, 64 nt, Human; identical to SEQ ID NO: 76955

SEQ ID NO: 177739 - RNA, 64 nt, Human; identical to SEQ ID NO: 76956

SEQ ID NO: 177740 - RNA, 64 nt, Human; identical to SEQ ID NO: 76957

SEQ ID NO: 177741 - RNA, 64 nt, Human; identical to SEQ ID NO: 76958

SEQ ID NO: 177742 - RNA, 64 nt, Human; identical to SEQ ID NO: 76959

SEQ ID NO: 177743 - RNA, 64 nt, Human; identical to SEQ ID NO: 76960

SEQ ID NO: 177744 - RNA, 64 nt, Human; identical to SEQ ID NO: 76961

SEQ ID NO: 177745 - RNA, 64 nt, Human; identical to SEQ ID NO: 76962

SEQ ID NO: 177746 - RNA, 64 nt, Human; identical to SEQ ID NO: 76963

SEQ ID NO: 177747 - RNA, 64 nt, Human; identical to SEQ ID NO: 76964

SEQ ID NO: 177748 - RNA, 64 nt, Human; identical to SEQ ID NO: 76965

SEQ ID NO: 177749 - RNA, 55 nt, Human; identical to SEQ ID NO: 76966

SEQ ID NO: 177750 - RNA, 64 nt, Human; identical to SEQ ID NO: 76967

SEQ ID NO: 177751 - RNA, 64 nt, Human; identical to SEQ ID NO: 76968

SEQ ID NO: 177752 - RNA, 64 nt, Human; identical to SEQ ID NO: 76969

SEQ ID NO: 177753 - RNA, 64 nt, Human; identical to SEQ ID NO: 76970

SEQ ID NO: 177754 - RNA, 64 nt, Human; identical to SEQ ID NO: 76971

SEQ ID NO: 177755 - RNA, 64 nt, Human; identical to SEQ ID NO: 76972

SEQ ID NO: 177756 - RNA, 64 nt, Human; identical to SEQ ID NO: 76973

SEQ ID NO: 177757 - RNA, 64 nt, Human; identical to SEQ ID NO: 76974

SEQ ID NO: 177758 - RNA, 64 nt, Human; identical to SEQ ID NO: 76975

SEQ ID NO: 177759 - RNA, 64 nt, Human; identical to SEQ ID NO: 76976

SEQ ID NO: 177760 - RNA, 64 nt, Human; identical to SEQ ID NO: 76977

SEQ ID NO: 177761 - RNA, 64 nt, Human; identical to SEQ ID NO: 76978

SEQ ID NO: 177762 - RNA, 64 nt, Human; identical to SEQ ID NO: 76979

SEQ ID NO: 177763 - RNA, 64 nt, Human; identical to SEQ ID NO: 76980

SEQ ID NO: 177764 - RNA, 64 nt, Human; identical to SEQ ID NO: 76981

SEQ ID NO: 177765 - RNA, 64 nt, Human; identical to SEQ ID NO: 76982

SEQ ID NO: 177766 - RNA, 64 nt, Human; identical to SEQ ID NO: 76983

SEQ ID NO: 177767 - RNA, 64 nt, Human; identical to SEQ ID NO: 76984

SEQ ID NO: 177768 - RNA, 64 nt, Human; identical to SEQ ID NO: 76985

SEQ ID NO: 177769 - RNA, 62 nt, Human; identical to SEQ ID NO: 76986

SEQ ID NO: 177770 - RNA, 61 nt, Human; identical to SEQ ID NO: 76987

SEQ ID NO: 177771 - RNA, 64 nt, Human; identical to SEQ ID NO: 76988

SEQ ID NO: 177772 - RNA, 64 nt, Human; identical to SEQ ID NO: 76989

SEQ ID NO: 177773 - RNA, 64 nt, Human; identical to SEQ ID NO: 76990

SEQ ID NO: 177774 - RNA, 64 nt, Human; identical to SEQ ID NO: 76991

SEQ ID NO: 177775 - RNA, 64 nt, Human; identical to SEQ ID NO: 76992

SEQ ID NO: 177776 - RNA, 64 nt, Human; identical to SEQ ID NO: 76993

SEQ ID NO: 177777 - RNA, 64 nt, Human; identical to SEQ ID NO: 76994

SEQ ID NO: 177778 - RNA, 64 nt, Human; identical to SEQ ID NO: 76995

SEQ ID NO: 177779 - RNA, 64 nt, Human; identical to SEQ ID NO: 76996

SEQ ID NO: 177780 - RNA, 64 nt, Human; identical to SEQ ID NO: 76997

SEQ ID NO: 177781 - RNA, 64 nt, Human; identical to SEQ ID NO: 76998

SEQ ID NO: 177782 - RNA, 64 nt, Human; identical to SEQ ID NO: 76999

SEQ ID NO: 177783 - RNA, 64 nt, Human; identical to SEQ ID NO: 77000

SEQ ID NO: 177784 - RNA, 64 nt, Human; identical to SEQ ID NO: 77001

SEQ ID NO: 177785 - RNA, 64 nt, Human; identical to SEQ ID NO: 77002

SEQ ID NO: 177786 - RNA, 64 nt, Human; identical to SEQ ID NO: 77003

SEQ ID NO: 177787 - RNA, 64 nt, Human; identical to SEQ ID NO: 77004

SEQ ID NO: 177788 - RNA, 64 nt, Human; identical to SEQ ID NO: 77005

SEQ ID NO: 177789 - RNA, 64 nt, Human; identical to SEQ ID NO: 77006

SEQ ID NO: 177790 - RNA, 64 nt, Human; identical to SEQ ID NO: 77007

SEQ ID NO: 177791 - RNA, 64 nt, Human; identical to SEQ ID NO: 77008

SEQ ID NO: 177792 - RNA, 64 nt, Human; identical to SEQ ID NO: 77009

SEQ ID NO: 177793 - RNA, 64 nt, Human; identical to SEQ ID NO: 77010

SEQ ID NO: 177794 - RNA, 64 nt, Human; identical to SEQ ID NO: 77011

SEQ ID NO: 177795 - RNA, 64 nt, Human; identical to SEQ ID NO: 77012

SEQ ID NO: 177796 - RNA, 64 nt, Human; identical to SEQ ID NO: 77013

SEQ ID NO: 177797 - RNA, 64 nt, Human; identical to SEQ ID NO: 77014

SEQ ID NO: 177798 - RNA, 64 nt, Human; identical to SEQ ID NO: 77015

SEQ ID NO: 177799 - RNA, 64 nt, Human; identical to SEQ ID NO: 77016

SEQ ID NO: 177800 - RNA, 64 nt, Human; identical to SEQ ID NO: 77017

SEQ ID NO: 177801 - RNA, 64 nt, Human; identical to SEQ ID NO: 77018

SEQ ID NO: 177802 - RNA, 64 nt, Human; identical to SEQ ID NO: 77019

SEQ ID NO: 177803 - RNA, 64 nt, Human; identical to SEQ ID NO: 77020

SEQ ID NO: 177804 - RNA, 64 nt, Human; identical to SEQ ID NO: 77021

SEQ ID NO: 177805 - RNA, 64 nt, Human; identical to SEQ ID NO: 77022

SEQ ID NO: 177806 - RNA, 64 nt, Human; identical to SEQ ID NO: 77023

SEQ ID NO: 177807 - RNA, 64 nt, Human; identical to SEQ ID NO: 77024

SEQ ID NO: 177808 - RNA, 64 nt, Human; identical to SEQ ID NO: 77025

SEQ ID NO: 177809 - RNA, 64 nt, Human; identical to SEQ ID NO: 77026

SEQ ID NO: 177810 - RNA, 64 nt, Human; identical to SEQ ID NO: 77027

SEQ ID NO: 177811 - RNA, 64 nt, Human; identical to SEQ ID NO: 77028

SEQ ID NO: 177812 - RNA, 62 nt, Human; identical to SEQ ID NO: 77029

SEQ ID NO: 177813 - RNA, 64 nt, Human; identical to SEQ ID NO: 77030

SEQ ID NO: 177814 - RNA, 64 nt, Human; identical to SEQ ID NO: 77031

SEQ ID NO: 177815 - RNA, 64 nt, Human; identical to SEQ ID NO: 77032

SEQ ID NO: 177816 - RNA, 64 nt, Human; identical to SEQ ID NO: 77033

SEQ ID NO: 177817 - RNA, 64 nt, Human; identical to SEQ ID NO: 77034

SEQ ID NO: 177818 - RNA, 64 nt, Human; identical to SEQ ID NO: 77035

SEQ ID NO: 177819 - RNA, 64 nt, Human; identical to SEQ ID NO: 77036

SEQ ID NO: 177820 - RNA, 64 nt, Human; identical to SEQ ID NO: 77037

SEQ ID NO: 177821 - RNA, 64 nt, Human; identical to SEQ ID NO: 77038

SEQ ID NO: 177822 - RNA, 64 nt, Human; identical to SEQ ID NO: 77039

SEQ ID NO: 177823 - RNA, 64 nt, Human; identical to SEQ ID NO: 77040

SEQ ID NO: 177824 - RNA, 64 nt, Human; identical to SEQ ID NO: 77041

SEQ ID NO: 177825 - RNA, 64 nt, Human; identical to SEQ ID NO: 77042

SEQ ID NO: 177826 - RNA, 64 nt, Human; identical to SEQ ID NO: 77043

SEQ ID NO: 177827 - RNA, 64 nt, Human; identical to SEQ ID NO: 77044

SEQ ID NO: 177828 - RNA, 64 nt, Human; identical to SEQ ID NO: 77045

SEQ ID NO: 177829 - RNA, 64 nt, Human; identical to SEQ ID NO: 77046

SEQ ID NO: 177830 - RNA, 64 nt, Human; identical to SEQ ID NO: 77047

SEQ ID NO: 177831 - RNA, 64 nt, Human; identical to SEQ ID NO: 77048

SEQ ID NO: 177832 - RNA, 64 nt, Human; identical to SEQ ID NO: 77049

SEQ ID NO: 177833 - RNA, 64 nt, Human; identical to SEQ ID NO: 77050

SEQ ID NO: 177834 - RNA, 64 nt, Human; identical to SEQ ID NO: 77051

SEQ ID NO: 177835 - RNA, 64 nt, Human; identical to SEQ ID NO: 77052

SEQ ID NO: 177836 - RNA, 64 nt, Human; identical to SEQ ID NO: 77053

SEQ ID NO: 177837 - RNA, 64 nt, Human; identical to SEQ ID NO: 77054

SEQ ID NO: 177838 - RNA, 64 nt, Human; identical to SEQ ID NO: 77055

SEQ ID NO: 177839 - RNA, 64 nt, Human; identical to SEQ ID NO: 77056

SEQ ID NO: 177840 - RNA, 64 nt, Human; identical to SEQ ID NO: 77057

SEQ ID NO: 177841 - RNA, 64 nt, Human; identical to SEQ ID NO: 77058

SEQ ID NO: 177842 - RNA, 64 nt, Human; identical to SEQ ID NO: 77059

SEQ ID NO: 177843 - RNA, 64 nt, Human; identical to SEQ ID NO: 77060

SEQ ID NO: 177844 - RNA, 64 nt, Human; identical to SEQ ID NO: 77061

SEQ ID NO: 177845 - RNA, 64 nt, Human; identical to SEQ ID NO: 77062

SEQ ID NO: 177846 - RNA, 64 nt, Human; identical to SEQ ID NO: 77063

SEQ ID NO: 177847 - RNA, 64 nt, Human; identical to SEQ ID NO: 77064

SEQ ID NO: 177848 - RNA, 64 nt, Human; identical to SEQ ID NO: 77065

SEQ ID NO: 177849 - RNA, 64 nt, Human; identical to SEQ ID NO: 77066

SEQ ID NO: 177850 - RNA, 64 nt, Human; identical to SEQ ID NO: 77067

SEQ ID NO: 177851 - RNA, 64 nt, Human; identical to SEQ ID NO: 77068

SEQ ID NO: 177852 - RNA, 64 nt, Human; identical to SEQ ID NO: 77069

SEQ ID NO: 177853 - RNA, 64 nt, Human; identical to SEQ ID NO: 77070

SEQ ID NO: 177854 - RNA, 64 nt, Human; identical to SEQ ID NO: 77071

SEQ ID NO: 177855 - RNA, 64 nt, Human; identical to SEQ ID NO: 77072

SEQ ID NO: 177856 - RNA, 64 nt, Human; identical to SEQ ID NO: 77073

SEQ ID NO: 177857 - RNA, 64 nt, Human; identical to SEQ ID NO: 77074

SEQ ID NO: 177858 - RNA, 64 nt, Human; identical to SEQ ID NO: 77075

SEQ ID NO: 177859 - RNA, 64 nt, Human; identical to SEQ ID NO: 77076

SEQ ID NO: 177860 - RNA, 64 nt, Human; identical to SEQ ID NO: 77077

SEQ ID NO: 177861 - RNA, 64 nt, Human; identical to SEQ ID NO: 77078

SEQ ID NO: 177862 - RNA, 64 nt, Human; identical to SEQ ID NO: 77079

SEQ ID NO: 177863 - RNA, 64 nt, Human; identical to SEQ ID NO: 77080

SEQ ID NO: 177864 - RNA, 64 nt, Human; identical to SEQ ID NO: 77081

SEQ ID NO: 177865 - RNA, 64 nt, Human; identical to SEQ ID NO: 77082

SEQ ID NO: 177866 - RNA, 64 nt, Human; identical to SEQ ID NO: 77083

SEQ ID NO: 177867 - RNA, 64 nt, Human; identical to SEQ ID NO: 77084

SEQ ID NO: 177868 - RNA, 64 nt, Human; identical to SEQ ID NO: 77085

SEQ ID NO: 177869 - RNA, 64 nt, Human; identical to SEQ ID NO: 77086

SEQ ID NO: 177870 - RNA, 64 nt, Human; identical to SEQ ID NO: 77087

SEQ ID NO: 177871 - RNA, 64 nt, Human; identical to SEQ ID NO: 77088

SEQ ID NO: 177872 - RNA, 64 nt, Human; identical to SEQ ID NO: 77089

SEQ ID NO: 177873 - RNA, 64 nt, Human; identical to SEQ ID NO: 77090

SEQ ID NO: 177874 - RNA, 64 nt, Human; identical to SEQ ID NO: 77091

SEQ ID NO: 177875 - RNA, 64 nt, Human; identical to SEQ ID NO: 77092

SEQ ID NO: 177876 - RNA, 64 nt, Human; identical to SEQ ID NO: 77093

SEQ ID NO: 177877 - RNA, 60 nt, Human; identical to SEQ ID NO: 77094

SEQ ID NO: 177878 - RNA, 64 nt, Human; identical to SEQ ID NO: 77095

SEQ ID NO: 177879 - RNA, 64 nt, Human; identical to SEQ ID NO: 77096

SEQ ID NO: 177880 - RNA, 64 nt, Human; identical to SEQ ID NO: 77097

SEQ ID NO: 177881 - RNA, 64 nt, Human; identical to SEQ ID NO: 77098

SEQ ID NO: 177882 - RNA, 64 nt, Human; identical to SEQ ID NO: 77099

SEQ ID NO: 177883 - RNA, 64 nt, Human; identical to SEQ ID NO: 77100

SEQ ID NO: 177884 - RNA, 64 nt, Human; identical to SEQ ID NO: 77101

SEQ ID NO: 177885 - RNA, 64 nt, Human; identical to SEQ ID NO: 77102

SEQ ID NO: 177886 - RNA, 64 nt, Human; identical to SEQ ID NO: 77103

SEQ ID NO: 177887 - RNA, 64 nt, Human; identical to SEQ ID NO: 77104

SEQ ID NO: 177888 - RNA, 64 nt, Human; identical to SEQ ID NO: 77105

SEQ ID NO: 177889 - RNA, 64 nt, Human; identical to SEQ ID NO: 77106

SEQ ID NO: 177890 - RNA, 64 nt, Human; identical to SEQ ID NO: 77107

SEQ ID NO: 177891 - RNA, 64 nt, Human; identical to SEQ ID NO: 77108

SEQ ID NO: 177892 - RNA, 64 nt, Human; identical to SEQ ID NO: 77109

SEQ ID NO: 177893 - RNA, 64 nt, Human; identical to SEQ ID NO: 77110

SEQ ID NO: 177894 - RNA, 64 nt, Human; identical to SEQ ID NO: 77111

SEQ ID NO: 177895 - RNA, 64 nt, Human; identical to SEQ ID NO: 77112

SEQ ID NO: 177896 - RNA, 64 nt, Human; identical to SEQ ID NO: 77113

SEQ ID NO: 177897 - RNA, 64 nt, Human; identical to SEQ ID NO: 77114

SEQ ID NO: 177898 - RNA, 64 nt, Human; identical to SEQ ID NO: 77115

SEQ ID NO: 177899 - RNA, 64 nt, Human; identical to SEQ ID NO: 77116

SEQ ID NO: 177900 - RNA, 64 nt, Human; identical to SEQ ID NO: 77117

SEQ ID NO: 177901 - RNA, 64 nt, Human; identical to SEQ ID NO: 77118

SEQ ID NO: 177902 - RNA, 64 nt, Human; identical to SEQ ID NO: 77119

SEQ ID NO: 177903 - RNA, 64 nt, Human; identical to SEQ ID NO: 77120

SEQ ID NO: 177904 - RNA, 64 nt, Human; identical to SEQ ID NO: 77121

SEQ ID NO: 177905 - RNA, 64 nt, Human; identical to SEQ ID NO: 77122

SEQ ID NO: 177906 - RNA, 64 nt, Human; identical to SEQ ID NO: 77123

SEQ ID NO: 177907 - RNA, 64 nt, Human; identical to SEQ ID NO: 77124

SEQ ID NO: 177908 - RNA, 64 nt, Human; identical to SEQ ID NO: 77125

SEQ ID NO: 177909 - RNA, 64 nt, Human; identical to SEQ ID NO: 77126

SEQ ID NO: 177910 - RNA, 64 nt, Human; identical to SEQ ID NO: 77127

SEQ ID NO: 177911 - RNA, 64 nt, Human; identical to SEQ ID NO: 77128

SEQ ID NO: 177912 - RNA, 64 nt, Human; identical to SEQ ID NO: 77129

SEQ ID NO: 177913 - RNA, 64 nt, Human; identical to SEQ ID NO: 77130

SEQ ID NO: 177914 - RNA, 64 nt, Human; identical to SEQ ID NO: 77131

SEQ ID NO: 177915 - RNA, 64 nt, Human; identical to SEQ ID NO: 77132

SEQ ID NO: 177916 - RNA, 64 nt, Human; identical to SEQ ID NO: 77133

SEQ ID NO: 177917 - RNA, 64 nt, Human; identical to SEQ ID NO: 77134

SEQ ID NO: 177918 - RNA, 64 nt, Human; identical to SEQ ID NO: 77135

SEQ ID NO: 177919 - RNA, 64 nt, Human; identical to SEQ ID NO: 77136

SEQ ID NO: 177920 - RNA, 64 nt, Human; identical to SEQ ID NO: 77137

SEQ ID NO: 177921 - RNA, 64 nt, Human; identical to SEQ ID NO: 77138

SEQ ID NO: 177922 - RNA, 64 nt, Human; identical to SEQ ID NO: 77139

SEQ ID NO: 177923 - RNA, 64 nt, Human; identical to SEQ ID NO: 77140

SEQ ID NO: 177924 - RNA, 64 nt, Human; identical to SEQ ID NO: 77141

SEQ ID NO: 177925 - RNA, 60 nt, Human; identical to SEQ ID NO: 77142

SEQ ID NO: 177926 - RNA, 64 nt, Human; identical to SEQ ID NO: 77143

SEQ ID NO: 177927 - RNA, 64 nt, Human; identical to SEQ ID NO: 77144

SEQ ID NO: 177928 - RNA, 64 nt, Human; identical to SEQ ID NO: 77145

SEQ ID NO: 177929 - RNA, 64 nt, Human; identical to SEQ ID NO: 77146

SEQ ID NO: 177930 - RNA, 64 nt, Human; identical to SEQ ID NO: 77147

SEQ ID NO: 177931 - RNA, 64 nt, Human; identical to SEQ ID NO: 77148

SEQ ID NO: 177932 - RNA, 64 nt, Human; identical to SEQ ID NO: 77149

SEQ ID NO: 177933 - RNA, 64 nt, Human; identical to SEQ ID NO: 77150

SEQ ID NO: 177934 - RNA, 64 nt, Human; identical to SEQ ID NO: 77151

SEQ ID NO: 177935 - RNA, 64 nt, Human; identical to SEQ ID NO: 77152

SEQ ID NO: 177936 - RNA, 64 nt, Human; identical to SEQ ID NO: 77153

SEQ ID NO: 177937 - RNA, 64 nt, Human; identical to SEQ ID NO: 77154

SEQ ID NO: 177938 - RNA, 64 nt, Human; identical to SEQ ID NO: 77155

SEQ ID NO: 177939 - RNA, 64 nt, Human; identical to SEQ ID NO: 77156

SEQ ID NO: 177940 - RNA, 64 nt, Human; identical to SEQ ID NO: 77157

SEQ ID NO: 177941 - RNA, 64 nt, Human; identical to SEQ ID NO: 77158

SEQ ID NO: 177942 - RNA, 64 nt, Human; identical to SEQ ID NO: 77159

SEQ ID NO: 177943 - RNA, 64 nt, Human; identical to SEQ ID NO: 77160

SEQ ID NO: 177944 - RNA, 64 nt, Human; identical to SEQ ID NO: 77161

SEQ ID NO: 177945 - RNA, 64 nt, Human; identical to SEQ ID NO: 77162

SEQ ID NO: 177946 - RNA, 64 nt, Human; identical to SEQ ID NO: 77163

SEQ ID NO: 177947 - RNA, 64 nt, Human; identical to SEQ ID NO: 77164

SEQ ID NO: 177948 - RNA, 64 nt, Human; identical to SEQ ID NO: 77165

SEQ ID NO: 177949 - RNA, 64 nt, Human; identical to SEQ ID NO: 77166

SEQ ID NO: 177950 - RNA, 64 nt, Human; identical to SEQ ID NO: 77167

SEQ ID NO: 177951 - RNA, 64 nt, Human; identical to SEQ ID NO: 77168

SEQ ID NO: 177952 - RNA, 64 nt, Human; identical to SEQ ID NO: 77169

SEQ ID NO: 177953 - RNA, 64 nt, Human; identical to SEQ ID NO: 77170

SEQ ID NO: 177954 - RNA, 64 nt, Human; identical to SEQ ID NO: 77171

SEQ ID NO: 177955 - RNA, 64 nt, Human; identical to SEQ ID NO: 77172

SEQ ID NO: 177956 - RNA, 64 nt, Human; identical to SEQ ID NO: 77173

SEQ ID NO: 177957 - RNA, 64 nt, Human; identical to SEQ ID NO: 77174

SEQ ID NO: 177958 - RNA, 64 nt, Human; identical to SEQ ID NO: 77175

SEQ ID NO: 177959 - RNA, 64 nt, Human; identical to SEQ ID NO: 77176

SEQ ID NO: 177960 - RNA, 64 nt, Human; identical to SEQ ID NO: 77177

SEQ ID NO: 177961 - RNA, 64 nt, Human; identical to SEQ ID NO: 77178

SEQ ID NO: 177962 - RNA, 64 nt, Human; identical to SEQ ID NO: 77179

SEQ ID NO: 177963 - RNA, 64 nt, Human; identical to SEQ ID NO: 77180

SEQ ID NO: 177964 - RNA, 64 nt, Human; identical to SEQ ID NO: 77181

SEQ ID NO: 177965 - RNA, 64 nt, Human; identical to SEQ ID NO: 77182

SEQ ID NO: 177966 - RNA, 64 nt, Human; identical to SEQ ID NO: 77183

SEQ ID NO: 177967 - RNA, 64 nt, Human; identical to SEQ ID NO: 77184

SEQ ID NO: 177968 - RNA, 64 nt, Human; identical to SEQ ID NO: 77185

SEQ ID NO: 177969 - RNA, 64 nt, Human; identical to SEQ ID NO: 77186

SEQ ID NO: 177970 - RNA, 64 nt, Human; identical to SEQ ID NO: 77187

SEQ ID NO: 177971 - RNA, 64 nt, Human; identical to SEQ ID NO: 77188

SEQ ID NO: 177972 - RNA, 64 nt, Human; identical to SEQ ID NO: 77189

SEQ ID NO: 177973 - RNA, 64 nt, Human; identical to SEQ ID NO: 77190

SEQ ID NO: 177974 - RNA, 64 nt, Human; identical to SEQ ID NO: 77191

SEQ ID NO: 177975 - RNA, 64 nt, Human; identical to SEQ ID NO: 77192

SEQ ID NO: 177976 - RNA, 64 nt, Human; identical to SEQ ID NO: 77193

SEQ ID NO: 177977 - RNA, 64 nt, Human; identical to SEQ ID NO: 77194

SEQ ID NO: 177978 - RNA, 64 nt, Human; identical to SEQ ID NO: 77195

SEQ ID NO: 177979 - RNA, 64 nt, Human; identical to SEQ ID NO: 77196

SEQ ID NO: 177980 - RNA, 64 nt, Human; identical to SEQ ID NO: 77197

SEQ ID NO: 177981 - RNA, 64 nt, Human; identical to SEQ ID NO: 77198

SEQ ID NO: 177982 - RNA, 64 nt, Human; identical to SEQ ID NO: 77199

SEQ ID NO: 177983 - RNA, 64 nt, Human; identical to SEQ ID NO: 77200

SEQ ID NO: 177984 - RNA, 64 nt, Human; identical to SEQ ID NO: 77201

SEQ ID NO: 177985 - RNA, 64 nt, Human; identical to SEQ ID NO: 77202

SEQ ID NO: 177986 - RNA, 64 nt, Human; identical to SEQ ID NO: 77203

SEQ ID NO: 177987 - RNA, 64 nt, Human; identical to SEQ ID NO: 77204

SEQ ID NO: 177988 - RNA, 64 nt, Human; identical to SEQ ID NO: 77205

SEQ ID NO: 177989 - RNA, 64 nt, Human; identical to SEQ ID NO: 77206

SEQ ID NO: 177990 - RNA, 64 nt, Human; identical to SEQ ID NO: 77207

SEQ ID NO: 177991 - RNA, 64 nt, Human; identical to SEQ ID NO: 77208

SEQ ID NO: 177992 - RNA, 64 nt, Human; identical to SEQ ID NO: 77209

SEQ ID NO: 177993 - RNA, 64 nt, Human; identical to SEQ ID NO: 77210

SEQ ID NO: 177994 - RNA, 64 nt, Human; identical to SEQ ID NO: 77211

SEQ ID NO: 177995 - RNA, 64 nt, Human; identical to SEQ ID NO: 77212

SEQ ID NO: 177996 - RNA, 64 nt, Human; identical to SEQ ID NO: 77213

SEQ ID NO: 177997 - RNA, 64 nt, Human; identical to SEQ ID NO: 77214

SEQ ID NO: 177998 - RNA, 64 nt, Human; identical to SEQ ID NO: 77215

SEQ ID NO: 177999 - RNA, 64 nt, Human; identical to SEQ ID NO: 77216

SEQ ID NO: 178000 - RNA, 64 nt, Human; identical to SEQ ID NO: 77217

SEQ ID NO: 178001 - RNA, 64 nt, Human; identical to SEQ ID NO: 77218

SEQ ID NO: 178002 - RNA, 64 nt, Human; identical to SEQ ID NO: 77219

SEQ ID NO: 178003 - RNA, 64 nt, Human; identical to SEQ ID NO: 77220

SEQ ID NO: 178004 - RNA, 64 nt, Human; identical to SEQ ID NO: 77221

SEQ ID NO: 178005 - RNA, 64 nt, Human; identical to SEQ ID NO: 77222

SEQ ID NO: 178006 - RNA, 64 nt, Human; identical to SEQ ID NO: 77223

SEQ ID NO: 178007 - RNA, 64 nt, Human; identical to SEQ ID NO: 77224

SEQ ID NO: 178008 - RNA, 64 nt, Human; identical to SEQ ID NO: 77225

SEQ ID NO: 178009 - RNA, 64 nt, Human; identical to SEQ ID NO: 77226

SEQ ID NO: 178010 - RNA, 64 nt, Human; identical to SEQ ID NO: 77227

SEQ ID NO: 178011 - RNA, 64 nt, Human; identical to SEQ ID NO: 77228

SEQ ID NO: 178012 - RNA, 64 nt, Human; identical to SEQ ID NO: 77229

SEQ ID NO: 178013 - RNA, 64 nt, Human; identical to SEQ ID NO: 77230

SEQ ID NO: 178014 - RNA, 64 nt, Human; identical to SEQ ID NO: 77231

SEQ ID NO: 178015 - RNA, 64 nt, Human; identical to SEQ ID NO: 77232

SEQ ID NO: 178016 - RNA, 64 nt, Human; identical to SEQ ID NO: 77233

SEQ ID NO: 178017 - RNA, 64 nt, Human; identical to SEQ ID NO: 77234

SEQ ID NO: 178018 - RNA, 64 nt, Human; identical to SEQ ID NO: 77235

SEQ ID NO: 178019 - RNA, 64 nt, Human; identical to SEQ ID NO: 77236

SEQ ID NO: 178020 - RNA, 64 nt, Human; identical to SEQ ID NO: 77237

SEQ ID NO: 178021 - RNA, 64 nt, Human; identical to SEQ ID NO: 77238

SEQ ID NO: 178022 - RNA, 64 nt, Human; identical to SEQ ID NO: 77239

SEQ ID NO: 178023 - RNA, 64 nt, Human; identical to SEQ ID NO: 77240

SEQ ID NO: 178024 - RNA, 64 nt, Human; identical to SEQ ID NO: 77241

SEQ ID NO: 178025 - RNA, 64 nt, Human; identical to SEQ ID NO: 77242

SEQ ID NO: 178026 - RNA, 64 nt, Human; identical to SEQ ID NO: 77243

SEQ ID NO: 178027 - RNA, 64 nt, Human; identical to SEQ ID NO: 77244

SEQ ID NO: 178028 - RNA, 64 nt, Human; identical to SEQ ID NO: 77245

SEQ ID NO: 178029 - RNA, 64 nt, Human; identical to SEQ ID NO: 77246

SEQ ID NO: 178030 - RNA, 64 nt, Human; identical to SEQ ID NO: 77247

SEQ ID NO: 178031 - RNA, 64 nt, Human; identical to SEQ ID NO: 77248

SEQ ID NO: 178032 - RNA, 64 nt, Human; identical to SEQ ID NO: 77249

SEQ ID NO: 178033 - RNA, 64 nt, Human; identical to SEQ ID NO: 77250

SEQ ID NO: 178034 - RNA, 64 nt, Human; identical to SEQ ID NO: 77251

SEQ ID NO: 178035 - RNA, 64 nt, Human; identical to SEQ ID NO: 77252

SEQ ID NO: 178036 - RNA, 64 nt, Human; identical to SEQ ID NO: 77253

SEQ ID NO: 178037 - RNA, 64 nt, Human; identical to SEQ ID NO: 77254

SEQ ID NO: 178038 - RNA, 64 nt, Human; identical to SEQ ID NO: 77255

SEQ ID NO: 178039 - RNA, 64 nt, Human; identical to SEQ ID NO: 77256

SEQ ID NO: 178040 - RNA, 64 nt, Human; identical to SEQ ID NO: 77257

SEQ ID NO: 178041 - RNA, 64 nt, Human; identical to SEQ ID NO: 77258

SEQ ID NO: 178042 - RNA, 64 nt, Human; identical to SEQ ID NO: 77259

SEQ ID NO: 178043 - RNA, 64 nt, Human; identical to SEQ ID NO: 77260

SEQ ID NO: 178044 - RNA, 64 nt, Human; identical to SEQ ID NO: 77261

SEQ ID NO: 178045 - RNA, 64 nt, Human; identical to SEQ ID NO: 77262

SEQ ID NO: 178046 - RNA, 64 nt, Human; identical to SEQ ID NO: 77263

SEQ ID NO: 178047 - RNA, 64 nt, Human; identical to SEQ ID NO: 77264

SEQ ID NO: 178048 - RNA, 64 nt, Human; identical to SEQ ID NO: 77265

SEQ ID NO: 178049 - RNA, 64 nt, Human; identical to SEQ ID NO: 77266

SEQ ID NO: 178050 - RNA, 64 nt, Human; identical to SEQ ID NO: 77267

SEQ ID NO: 178051 - RNA, 64 nt, Human; identical to SEQ ID NO: 77268

SEQ ID NO: 178052 - RNA, 64 nt, Human; identical to SEQ ID NO: 77269

SEQ ID NO: 178053 - RNA, 64 nt, Human; identical to SEQ ID NO: 77270

SEQ ID NO: 178054 - RNA, 64 nt, Human; identical to SEQ ID NO: 77271

SEQ ID NO: 178055 - RNA, 64 nt, Human; identical to SEQ ID NO: 77272

SEQ ID NO: 178056 - RNA, 64 nt, Human; identical to SEQ ID NO: 77273

SEQ ID NO: 178057 - RNA, 64 nt, Human; identical to SEQ ID NO: 77274

SEQ ID NO: 178058 - RNA, 64 nt, Human; identical to SEQ ID NO: 77275

SEQ ID NO: 178059 - RNA, 64 nt, Human; identical to SEQ ID NO: 77276

SEQ ID NO: 178060 - RNA, 64 nt, Human; identical to SEQ ID NO: 77277

SEQ ID NO: 178061 - RNA, 64 nt, Human; identical to SEQ ID NO: 77278

SEQ ID NO: 178062 - RNA, 64 nt, Human; identical to SEQ ID NO: 77279

SEQ ID NO: 178063 - RNA, 64 nt, Human; identical to SEQ ID NO: 77280

SEQ ID NO: 178064 - RNA, 64 nt, Human; identical to SEQ ID NO: 77281

SEQ ID NO: 178065 - RNA, 64 nt, Human; identical to SEQ ID NO: 77282

SEQ ID NO: 178066 - RNA, 64 nt, Human; identical to SEQ ID NO: 77283

SEQ ID NO: 178067 - RNA, 64 nt, Human; identical to SEQ ID NO: 77284

SEQ ID NO: 178068 - RNA, 64 nt, Human; identical to SEQ ID NO: 77285

SEQ ID NO: 178069 - RNA, 64 nt, Human; identical to SEQ ID NO: 77286

SEQ ID NO: 178070 - RNA, 64 nt, Human; identical to SEQ ID NO: 77287

SEQ ID NO: 178071 - RNA, 64 nt, Human; identical to SEQ ID NO: 77288

SEQ ID NO: 178072 - RNA, 64 nt, Human; identical to SEQ ID NO: 77289

SEQ ID NO: 178073 - RNA, 64 nt, Human; identical to SEQ ID NO: 77290

SEQ ID NO: 178074 - RNA, 64 nt, Human; identical to SEQ ID NO: 77291

SEQ ID NO: 178075 - RNA, 64 nt, Human; identical to SEQ ID NO: 77292

SEQ ID NO: 178076 - RNA, 64 nt, Human; identical to SEQ ID NO: 77293

SEQ ID NO: 178077 - RNA, 64 nt, Human; identical to SEQ ID NO: 77294

SEQ ID NO: 178078 - RNA, 64 nt, Human; identical to SEQ ID NO: 77295

SEQ ID NO: 178079 - RNA, 64 nt, Human; identical to SEQ ID NO: 77296

SEQ ID NO: 178080 - RNA, 64 nt, Human; identical to SEQ ID NO: 77297

SEQ ID NO: 178081 - RNA, 64 nt, Human; identical to SEQ ID NO: 77298

SEQ ID NO: 178082 - RNA, 64 nt, Human; identical to SEQ ID NO: 77299

SEQ ID NO: 178083 - RNA, 64 nt, Human; identical to SEQ ID NO: 77300

SEQ ID NO: 178084 - RNA, 64 nt, Human; identical to SEQ ID NO: 77301

SEQ ID NO: 178085 - RNA, 64 nt, Human; identical to SEQ ID NO: 77302

SEQ ID NO: 178086 - RNA, 64 nt, Human; identical to SEQ ID NO: 77303

SEQ ID NO: 178087 - RNA, 64 nt, Human; identical to SEQ ID NO: 77304

SEQ ID NO: 178088 - RNA, 64 nt, Human; identical to SEQ ID NO: 77305

SEQ ID NO: 178089 - RNA, 64 nt, Human; identical to SEQ ID NO: 77306

SEQ ID NO: 178090 - RNA, 64 nt, Human; identical to SEQ ID NO: 77307

SEQ ID NO: 178091 - RNA, 64 nt, Human; identical to SEQ ID NO: 77308

SEQ ID NO: 178092 - RNA, 64 nt, Human; identical to SEQ ID NO: 77309

SEQ ID NO: 178093 - RNA, 64 nt, Human; identical to SEQ ID NO: 77310

SEQ ID NO: 178094 - RNA, 64 nt, Human; identical to SEQ ID NO: 77311

SEQ ID NO: 178095 - RNA, 64 nt, Human; identical to SEQ ID NO: 77312

SEQ ID NO: 178096 - RNA, 64 nt, Human; identical to SEQ ID NO: 77313

SEQ ID NO: 178097 - RNA, 64 nt, Human; identical to SEQ ID NO: 77314

SEQ ID NO: 178098 - RNA, 64 nt, Human; identical to SEQ ID NO: 77315

SEQ ID NO: 178099 - RNA, 64 nt, Human; identical to SEQ ID NO: 77316

SEQ ID NO: 178100 - RNA, 64 nt, Human; identical to SEQ ID NO: 77317

SEQ ID NO: 178101 - RNA, 64 nt, Human; identical to SEQ ID NO: 77318

SEQ ID NO: 178102 - RNA, 64 nt, Human; identical to SEQ ID NO: 77319

SEQ ID NO: 178103 - RNA, 64 nt, Human; identical to SEQ ID NO: 77320

SEQ ID NO: 178104 - RNA, 64 nt, Human; identical to SEQ ID NO: 77321

SEQ ID NO: 178105 - RNA, 64 nt, Human; identical to SEQ ID NO: 77322

SEQ ID NO: 178106 - RNA, 64 nt, Human; identical to SEQ ID NO: 77323

SEQ ID NO: 178107 - RNA, 64 nt, Human; identical to SEQ ID NO: 77324

SEQ ID NO: 178108 - RNA, 64 nt, Human; identical to SEQ ID NO: 77325

SEQ ID NO: 178109 - RNA, 64 nt, Human; identical to SEQ ID NO: 77326

SEQ ID NO: 178110 - RNA, 61 nt, Human; identical to SEQ ID NO: 77327

SEQ ID NO: 178111 - RNA, 64 nt, Human; identical to SEQ ID NO: 77328

SEQ ID NO: 178112 - RNA, 64 nt, Human; identical to SEQ ID NO: 77329

SEQ ID NO: 178113 - RNA, 64 nt, Human; identical to SEQ ID NO: 77330

SEQ ID NO: 178114 - RNA, 64 nt, Human; identical to SEQ ID NO: 77331

SEQ ID NO: 178115 - RNA, 64 nt, Human; identical to SEQ ID NO: 77332

SEQ ID NO: 178116 - RNA, 64 nt, Human; identical to SEQ ID NO: 77333

SEQ ID NO: 178117 - RNA, 64 nt, Human; identical to SEQ ID NO: 77334

SEQ ID NO: 178118 - RNA, 64 nt, Human; identical to SEQ ID NO: 77335

SEQ ID NO: 178119 - RNA, 64 nt, Human; identical to SEQ ID NO: 77336

SEQ ID NO: 178120 - RNA, 64 nt, Human; identical to SEQ ID NO: 77337

SEQ ID NO: 178121 - RNA, 64 nt, Human; identical to SEQ ID NO: 77338

SEQ ID NO: 178122 - RNA, 64 nt, Human; identical to SEQ ID NO: 77339

SEQ ID NO: 178123 - RNA, 64 nt, Human; identical to SEQ ID NO: 77340

SEQ ID NO: 178124 - RNA, 64 nt, Human; identical to SEQ ID NO: 77341

SEQ ID NO: 178125 - RNA, 64 nt, Human; identical to SEQ ID NO: 77342

SEQ ID NO: 178126 - RNA, 64 nt, Human; identical to SEQ ID NO: 77343

SEQ ID NO: 178127 - RNA, 64 nt, Human; identical to SEQ ID NO: 77344

SEQ ID NO: 178128 - RNA, 64 nt, Human; identical to SEQ ID NO: 77345

SEQ ID NO: 178129 - RNA, 64 nt, Human; identical to SEQ ID NO: 77346

SEQ ID NO: 178130 - RNA, 64 nt, Human; identical to SEQ ID NO: 77347

SEQ ID NO: 178131 - RNA, 64 nt, Human; identical to SEQ ID NO: 77348

SEQ ID NO: 178132 - RNA, 64 nt, Human; identical to SEQ ID NO: 77349

SEQ ID NO: 178133 - RNA, 64 nt, Human; identical to SEQ ID NO: 77350

SEQ ID NO: 178134 - RNA, 64 nt, Human; identical to SEQ ID NO: 77351

SEQ ID NO: 178135 - RNA, 64 nt, Human; identical to SEQ ID NO: 77352

SEQ ID NO: 178136 - RNA, 64 nt, Human; identical to SEQ ID NO: 77353

SEQ ID NO: 178137 - RNA, 64 nt, Human; identical to SEQ ID NO: 77354

SEQ ID NO: 178138 - RNA, 64 nt, Human; identical to SEQ ID NO: 77355

SEQ ID NO: 178139 - RNA, 64 nt, Human; identical to SEQ ID NO: 77356

SEQ ID NO: 178140 - RNA, 64 nt, Human; identical to SEQ ID NO: 77357

SEQ ID NO: 178141 - RNA, 64 nt, Human; identical to SEQ ID NO: 77358

SEQ ID NO: 178142 - RNA, 64 nt, Human; identical to SEQ ID NO: 77359

SEQ ID NO: 178143 - RNA, 64 nt, Human; identical to SEQ ID NO: 77360

SEQ ID NO: 178144 - RNA, 64 nt, Human; identical to SEQ ID NO: 77361

SEQ ID NO: 178145 - RNA, 64 nt, Human; identical to SEQ ID NO: 77362

SEQ ID NO: 178146 - RNA, 64 nt, Human; identical to SEQ ID NO: 77363

SEQ ID NO: 178147 - RNA, 64 nt, Human; identical to SEQ ID NO: 77364

SEQ ID NO: 178148 - RNA, 64 nt, Human; identical to SEQ ID NO: 77365

SEQ ID NO: 178149 - RNA, 64 nt, Human; identical to SEQ ID NO: 77366

SEQ ID NO: 178150 - RNA, 64 nt, Human; identical to SEQ ID NO: 77367

SEQ ID NO: 178151 - RNA, 64 nt, Human; identical to SEQ ID NO: 77368

SEQ ID NO: 178152 - RNA, 64 nt, Human; identical to SEQ ID NO: 77369

SEQ ID NO: 178153 - RNA, 64 nt, Human; identical to SEQ ID NO: 77370

SEQ ID NO: 178154 - RNA, 64 nt, Human; identical to SEQ ID NO: 77371

SEQ ID NO: 178155 - RNA, 64 nt, Human; identical to SEQ ID NO: 77372

SEQ ID NO: 178156 - RNA, 64 nt, Human; identical to SEQ ID NO: 77373

SEQ ID NO: 178157 - RNA, 64 nt, Human; identical to SEQ ID NO: 77374

SEQ ID NO: 178158 - RNA, 64 nt, Human; identical to SEQ ID NO: 77375

SEQ ID NO: 178159 - RNA, 64 nt, Human; identical to SEQ ID NO: 77376

SEQ ID NO: 178160 - RNA, 64 nt, Human; identical to SEQ ID NO: 77377

SEQ ID NO: 178161 - RNA, 64 nt, Human; identical to SEQ ID NO: 77378

SEQ ID NO: 178162 - RNA, 64 nt, Human; identical to SEQ ID NO: 77379

SEQ ID NO: 178163 - RNA, 64 nt, Human; identical to SEQ ID NO: 77380

SEQ ID NO: 178164 - RNA, 64 nt, Human; identical to SEQ ID NO: 77381

SEQ ID NO: 178165 - RNA, 64 nt, Human; identical to SEQ ID NO: 77382

SEQ ID NO: 178166 - RNA, 64 nt, Human; identical to SEQ ID NO: 77383

SEQ ID NO: 178167 - RNA, 64 nt, Human; identical to SEQ ID NO: 77384

SEQ ID NO: 178168 - RNA, 64 nt, Human; identical to SEQ ID NO: 77385

SEQ ID NO: 178169 - RNA, 64 nt, Human; identical to SEQ ID NO: 77386

SEQ ID NO: 178170 - RNA, 57 nt, Human; identical to SEQ ID NO: 77387

SEQ ID NO: 178171 - RNA, 64 nt, Human; identical to SEQ ID NO: 77388

SEQ ID NO: 178172 - RNA, 64 nt, Human; identical to SEQ ID NO: 77389

SEQ ID NO: 178173 - RNA, 64 nt, Human; identical to SEQ ID NO: 77390

SEQ ID NO: 178174 - RNA, 64 nt, Human; identical to SEQ ID NO: 77391

SEQ ID NO: 178175 - RNA, 55 nt, Human; identical to SEQ ID NO: 77392

SEQ ID NO: 178176 - RNA, 64 nt, Human; identical to SEQ ID NO: 77393

SEQ ID NO: 178177 - RNA, 64 nt, Human; identical to SEQ ID NO: 77394

SEQ ID NO: 178178 - RNA, 64 nt, Human; identical to SEQ ID NO: 77395

SEQ ID NO: 178179 - RNA, 64 nt, Human; identical to SEQ ID NO: 77396

SEQ ID NO: 178180 - RNA, 64 nt, Human; identical to SEQ ID NO: 77397

SEQ ID NO: 178181 - RNA, 64 nt, Human; identical to SEQ ID NO: 77398

SEQ ID NO: 178182 - RNA, 64 nt, Human; identical to SEQ ID NO: 77399

SEQ ID NO: 178183 - RNA, 64 nt, Human; identical to SEQ ID NO: 77400

SEQ ID NO: 178184 - RNA, 64 nt, Human; identical to SEQ ID NO: 77401

SEQ ID NO: 178185 - RNA, 64 nt, Human; identical to SEQ ID NO: 77402

SEQ ID NO: 178186 - RNA, 64 nt, Human; identical to SEQ ID NO: 77403

SEQ ID NO: 178187 - RNA, 64 nt, Human; identical to SEQ ID NO: 77404

SEQ ID NO: 178188 - RNA, 64 nt, Human; identical to SEQ ID NO: 77405

SEQ ID NO: 178189 - RNA, 64 nt, Human; identical to SEQ ID NO: 77406

SEQ ID NO: 178190 - RNA, 64 nt, Human; identical to SEQ ID NO: 77407

SEQ ID NO: 178191 - RNA, 64 nt, Human; identical to SEQ ID NO: 77408

SEQ ID NO: 178192 - RNA, 64 nt, Human; identical to SEQ ID NO: 77409

SEQ ID NO: 178193 - RNA, 64 nt, Human; identical to SEQ ID NO: 77410

SEQ ID NO: 178194 - RNA, 64 nt, Human; identical to SEQ ID NO: 77411

SEQ ID NO: 178195 - RNA, 64 nt, Human; identical to SEQ ID NO: 77412

SEQ ID NO: 178196 - RNA, 64 nt, Human; identical to SEQ ID NO: 77413

SEQ ID NO: 178197 - RNA, 64 nt, Human; identical to SEQ ID NO: 77414

SEQ ID NO: 178198 - RNA, 64 nt, Human; identical to SEQ ID NO: 77415

SEQ ID NO: 178199 - RNA, 64 nt, Human; identical to SEQ ID NO: 77416

SEQ ID NO: 178200 - RNA, 64 nt, Human; identical to SEQ ID NO: 77417

SEQ ID NO: 178201 - RNA, 64 nt, Human; identical to SEQ ID NO: 77418

SEQ ID NO: 178202 - RNA, 64 nt, Human; identical to SEQ ID NO: 77419

SEQ ID NO: 178203 - RNA, 64 nt, Human; identical to SEQ ID NO: 77420

SEQ ID NO: 178204 - RNA, 64 nt, Human; identical to SEQ ID NO: 77421

SEQ ID NO: 178205 - RNA, 64 nt, Human; identical to SEQ ID NO: 77422

SEQ ID NO: 178206 - RNA, 64 nt, Human; identical to SEQ ID NO: 77423

SEQ ID NO: 178207 - RNA, 64 nt, Human; identical to SEQ ID NO: 77424

SEQ ID NO: 178208 - RNA, 64 nt, Human; identical to SEQ ID NO: 77425

SEQ ID NO: 178209 - RNA, 64 nt, Human; identical to SEQ ID NO: 77426

SEQ ID NO: 178210 - RNA, 64 nt, Human; identical to SEQ ID NO: 77427

SEQ ID NO: 178211 - RNA, 64 nt, Human; identical to SEQ ID NO: 77428

SEQ ID NO: 178212 - RNA, 64 nt, Human; identical to SEQ ID NO: 77429

SEQ ID NO: 178213 - RNA, 64 nt, Human; identical to SEQ ID NO: 77430

SEQ ID NO: 178214 - RNA, 64 nt, Human; identical to SEQ ID NO: 77431

SEQ ID NO: 178215 - RNA, 64 nt, Human; identical to SEQ ID NO: 77432

SEQ ID NO: 178216 - RNA, 64 nt, Human; identical to SEQ ID NO: 77433

SEQ ID NO: 178217 - RNA, 64 nt, Human; identical to SEQ ID NO: 77434

SEQ ID NO: 178218 - RNA, 64 nt, Human; identical to SEQ ID NO: 77435

SEQ ID NO: 178219 - RNA, 64 nt, Human; identical to SEQ ID NO: 77436

SEQ ID NO: 178220 - RNA, 64 nt, Human; identical to SEQ ID NO: 77437

SEQ ID NO: 178221 - RNA, 64 nt, Human; identical to SEQ ID NO: 77438

SEQ ID NO: 178222 - RNA, 64 nt, Human; identical to SEQ ID NO: 77439

SEQ ID NO: 178223 - RNA, 64 nt, Human; identical to SEQ ID NO: 77440

SEQ ID NO: 178224 - RNA, 64 nt, Human; identical to SEQ ID NO: 77441

SEQ ID NO: 178225 - RNA, 64 nt, Human; identical to SEQ ID NO: 77442

SEQ ID NO: 178226 - RNA, 64 nt, Human; identical to SEQ ID NO: 77443

SEQ ID NO: 178227 - RNA, 64 nt, Human; identical to SEQ ID NO: 77444

SEQ ID NO: 178228 - RNA, 64 nt, Human; identical to SEQ ID NO: 77445

SEQ ID NO: 178229 - RNA, 64 nt, Human; identical to SEQ ID NO: 77446

SEQ ID NO: 178230 - RNA, 64 nt, Human; identical to SEQ ID NO: 77447

SEQ ID NO: 178231 - RNA, 64 nt, Human; identical to SEQ ID NO: 77448

SEQ ID NO: 178232 - RNA, 64 nt, Human; identical to SEQ ID NO: 77449

SEQ ID NO: 178233 - RNA, 64 nt, Human; identical to SEQ ID NO: 77450

SEQ ID NO: 178234 - RNA, 64 nt, Human; identical to SEQ ID NO: 77451

SEQ ID NO: 178235 - RNA, 64 nt, Human; identical to SEQ ID NO: 77452

SEQ ID NO: 178236 - RNA, 64 nt, Human; identical to SEQ ID NO: 77453

SEQ ID NO: 178237 - RNA, 64 nt, Human; identical to SEQ ID NO: 77454

SEQ ID NO: 178238 - RNA, 64 nt, Human; identical to SEQ ID NO: 77455

SEQ ID NO: 178239 - RNA, 64 nt, Human; identical to SEQ ID NO: 77456

SEQ ID NO: 178240 - RNA, 64 nt, Human; identical to SEQ ID NO: 77457

SEQ ID NO: 178241 - RNA, 64 nt, Human; identical to SEQ ID NO: 77458

SEQ ID NO: 178242 - RNA, 64 nt, Human; identical to SEQ ID NO: 77459

SEQ ID NO: 178243 - RNA, 64 nt, Human; identical to SEQ ID NO: 77460

SEQ ID NO: 178244 - RNA, 64 nt, Human; identical to SEQ ID NO: 77461

SEQ ID NO: 178245 - RNA, 64 nt, Human; identical to SEQ ID NO: 77462

SEQ ID NO: 178246 - RNA, 64 nt, Human; identical to SEQ ID NO: 77463

SEQ ID NO: 178247 - RNA, 64 nt, Human; identical to SEQ ID NO: 77464

SEQ ID NO: 178248 - RNA, 64 nt, Human; identical to SEQ ID NO: 77465

SEQ ID NO: 178249 - RNA, 64 nt, Human; identical to SEQ ID NO: 77466

SEQ ID NO: 178250 - RNA, 64 nt, Human; identical to SEQ ID NO: 77467

SEQ ID NO: 178251 - RNA, 64 nt, Human; identical to SEQ ID NO: 77468

SEQ ID NO: 178252 - RNA, 64 nt, Human; identical to SEQ ID NO: 77469

SEQ ID NO: 178253 - RNA, 64 nt, Human; identical to SEQ ID NO: 77470

SEQ ID NO: 178254 - RNA, 64 nt, Human; identical to SEQ ID NO: 77471

SEQ ID NO: 178255 - RNA, 64 nt, Human; identical to SEQ ID NO: 77472

SEQ ID NO: 178256 - RNA, 64 nt, Human; identical to SEQ ID NO: 77473

SEQ ID NO: 178257 - RNA, 64 nt, Human; identical to SEQ ID NO: 77474

SEQ ID NO: 178258 - RNA, 64 nt, Human; identical to SEQ ID NO: 77475

SEQ ID NO: 178259 - RNA, 64 nt, Human; identical to SEQ ID NO: 77476

SEQ ID NO: 178260 - RNA, 64 nt, Human; identical to SEQ ID NO: 77477

SEQ ID NO: 178261 - RNA, 64 nt, Human; identical to SEQ ID NO: 77478

SEQ ID NO: 178262 - RNA, 64 nt, Human; identical to SEQ ID NO: 77479

SEQ ID NO: 178263 - RNA, 64 nt, Human; identical to SEQ ID NO: 77480

SEQ ID NO: 178264 - RNA, 64 nt, Human; identical to SEQ ID NO: 77481

SEQ ID NO: 178265 - RNA, 64 nt, Human; identical to SEQ ID NO: 77482

SEQ ID NO: 178266 - RNA, 64 nt, Human; identical to SEQ ID NO: 77483

SEQ ID NO: 178267 - RNA, 64 nt, Human; identical to SEQ ID NO: 77484

SEQ ID NO: 178268 - RNA, 64 nt, Human; identical to SEQ ID NO: 77485

SEQ ID NO: 178269 - RNA, 64 nt, Human; identical to SEQ ID NO: 77486

SEQ ID NO: 178270 - RNA, 64 nt, Human; identical to SEQ ID NO: 77487

SEQ ID NO: 178271 - RNA, 64 nt, Human; identical to SEQ ID NO: 77488

SEQ ID NO: 178272 - RNA, 64 nt, Human; identical to SEQ ID NO: 77489

SEQ ID NO: 178273 - RNA, 64 nt, Human; identical to SEQ ID NO: 77490

SEQ ID NO: 178274 - RNA, 64 nt, Human; identical to SEQ ID NO: 77491

SEQ ID NO: 178275 - RNA, 64 nt, Human; identical to SEQ ID NO: 77073

SEQ ID NO: 178276 - RNA, 64 nt, Human; identical to SEQ ID NO: 77493

SEQ ID NO: 178277 - RNA, 64 nt, Human; identical to SEQ ID NO: 77494

SEQ ID NO: 178278 - RNA, 64 nt, Human; identical to SEQ ID NO: 77495

SEQ ID NO: 178279 - RNA, 64 nt, Human; identical to SEQ ID NO: 77496

SEQ ID NO: 178280 - RNA, 64 nt, Human; identical to SEQ ID NO: 77497

SEQ ID NO: 178281 - RNA, 64 nt, Human; identical to SEQ ID NO: 77498

SEQ ID NO: 178282 - RNA, 64 nt, Human; identical to SEQ ID NO: 77499

SEQ ID NO: 178283 - RNA, 64 nt, Human; identical to SEQ ID NO: 77500

SEQ ID NO: 178284 - RNA, 64 nt, Human; identical to SEQ ID NO: 77501

SEQ ID NO: 178285 - RNA, 64 nt, Human; identical to SEQ ID NO: 77502

SEQ ID NO: 178286 - RNA, 64 nt, Human; identical to SEQ ID NO: 77503

SEQ ID NO: 178287 - RNA, 64 nt, Human; identical to SEQ ID NO: 77504

SEQ ID NO: 178288 - RNA, 64 nt, Human; identical to SEQ ID NO: 77505

SEQ ID NO: 178289 - RNA, 64 nt, Human; identical to SEQ ID NO: 77506

SEQ ID NO: 178290 - RNA, 64 nt, Human; identical to SEQ ID NO: 77507

SEQ ID NO: 178291 - RNA, 64 nt, Human; identical to SEQ ID NO: 77508

SEQ ID NO: 178292 - RNA, 64 nt, Human; identical to SEQ ID NO: 77509

SEQ ID NO: 178293 - RNA, 64 nt, Human; identical to SEQ ID NO: 77510

SEQ ID NO: 178294 - RNA, 64 nt, Human; identical to SEQ ID NO: 77511

SEQ ID NO: 178295 - RNA, 64 nt, Human; identical to SEQ ID NO: 77512

SEQ ID NO: 178296 - RNA, 64 nt, Human; identical to SEQ ID NO: 77513

SEQ ID NO: 178297 - RNA, 64 nt, Human; identical to SEQ ID NO: 77514

SEQ ID NO: 178298 - RNA, 64 nt, Human; identical to SEQ ID NO: 77515

SEQ ID NO: 178299 - RNA, 64 nt, Human; identical to SEQ ID NO: 77516

SEQ ID NO: 178300 - RNA, 64 nt, Human; identical to SEQ ID NO: 77517

SEQ ID NO: 178301 - RNA, 64 nt, Human; identical to SEQ ID NO: 77518

SEQ ID NO: 178302 - RNA, 64 nt, Human; identical to SEQ ID NO: 77519

SEQ ID NO: 178303 - RNA, 64 nt, Human; identical to SEQ ID NO: 77520

SEQ ID NO: 178304 - RNA, 64 nt, Human; identical to SEQ ID NO: 77521

SEQ ID NO: 178305 - RNA, 64 nt, Human; identical to SEQ ID NO: 77522

SEQ ID NO: 178306 - RNA, 64 nt, Human; identical to SEQ ID NO: 77523

SEQ ID NO: 178307 - RNA, 64 nt, Human; identical to SEQ ID NO: 77524

SEQ ID NO: 178308 - RNA, 64 nt, Human; identical to SEQ ID NO: 77525

SEQ ID NO: 178309 - RNA, 64 nt, Human; identical to SEQ ID NO: 77526

SEQ ID NO: 178310 - RNA, 64 nt, Human; identical to SEQ ID NO: 77527

SEQ ID NO: 178311 - RNA, 64 nt, Human; identical to SEQ ID NO: 77528

SEQ ID NO: 178312 - RNA, 64 nt, Human; identical to SEQ ID NO: 77529

SEQ ID NO: 178313 - RNA, 64 nt, Human; identical to SEQ ID NO: 77530

SEQ ID NO: 178314 - RNA, 64 nt, Human; identical to SEQ ID NO: 77531

SEQ ID NO: 178315 - RNA, 64 nt, Human; identical to SEQ ID NO: 77532

SEQ ID NO: 178316 - RNA, 64 nt, Human; identical to SEQ ID NO: 77533

SEQ ID NO: 178317 - RNA, 64 nt, Human; identical to SEQ ID NO: 77534

SEQ ID NO: 178318 - RNA, 64 nt, Human; identical to SEQ ID NO: 77535

SEQ ID NO: 178319 - RNA, 64 nt, Human; identical to SEQ ID NO: 77536

SEQ ID NO: 178320 - RNA, 64 nt, Human; identical to SEQ ID NO: 77537

SEQ ID NO: 178321 - RNA, 64 nt, Human
ggccccguccuucucacugccuggucacauggugccuagggaugcagggcuggaggccagaggu

SEQ ID NO: 178322 - RNA, 64 nt, Human
gagagaguggggcgggaggaagaauuggcaccuuccuagggaaggagacgagcgcuucgccuug

SEQ ID NO: 178323 - RNA, 64 nt, Human
caauguuagcauguuccagaauggcugugggaggccuagggagaugggccccacuuagaauugc

SEQ ID NO: 178324 - RNA, 64 nt, Human
aguggccuggcuugucggagcaaguuucaucagcccuagggaaaacacggcccuccugggaacc

SEQ ID NO: 178325 - RNA, 64 nt, Human
aaaaaguaggcuguucauaagcacugaugcagucccuagggaauagaauggugcuucugaucac

SEQ ID NO: 178326 - RNA, 64 nt, Human
cauguccccuucucccucuucucagaucaaaaucccuagggaguucuauuuuuaaaauuaugaa

SEQ ID NO: 178327 - RNA, 64 nt, Human
uccccagaccagcagccugacuugacuuuugaguccuagggaugcugcuggcuagagaugaggc

SEQ ID NO: 178328 - RNA, 64 nt, Human
ugagaggcuccuauuucccaucauagcucccuacccuagggaggccuccaucuggaaaugggag

SEQ ID NO: 178329 - RNA, 64 nt, Human
gaaauggggguacccagggaugggcaggcuuuggccuagggacaugaaguaugggagugggugg

SEQ ID NO: 178330 - RNA, 64 nt, Human
ucaguuguuccuacucagacuguugcacucuaaaccuagggagguugaagaaugagacccuuag

SEQ ID NO: 178331 - RNA, 64 nt, Human
ucaaccucugccugcaucugccacuuucugcuacccuagggaggccaggaggagcuucggagga

SEQ ID NO: 178332 - RNA, 64 nt, Human
agguggcaccguacucaguguugugaugcccccaccuagggaggacucaaugcucuuuguaugc

SEQ ID NO: 178333 - RNA, 64 nt, Human
ggaaaaggaaccaacuguaggcaccucuccagggccuagggagacaaguguccucucuucugca

SEQ ID NO: 178334 - RNA, 64 nt, Human
caccgaaaagccaaaaggagcuggccauccagggccuagggagaccagccuuccucagcuaugc

SEQ ID NO: 178335 - RNA, 64 nt, Human
aagauaacagccagggaggacaagcagggcugggccuagggacagacugcaagaggcuccuguc

SEQ ID NO: 178336 - RNA, 64 nt, Human
aggggugguccucaccuuccuaauggaagcugggccuagggaggcccauccagucuucugacuu

SEQ ID NO: 178337 - RNA, 64 nt, Human
ugggucccaauaucagaaacaaccauccuagcuuccuagggaagacaguguacaguucuccauu

SEQ ID NO: 178338 - RNA, 64 nt, Human
cuaaauaaaacuaauuuugcucaaguuuucucaaccuagggaaaaagaacuaugguuccauauu

SEQ ID NO: 178339 - RNA, 64 nt, Human
accccauguaugucuccccacuaaccacauccuaccuagggacacacaggcagcugaagaacau

SEQ ID NO: 178340 - RNA, 64 nt, Human
cuaguaaaugugugaucuucggcaaguaaccuaaccuagggacaucaguuuacucaucugcgaa

SEQ ID NO: 178341 - RNA, 64 nt, Human
cccaugaugcgcaguguucagaaagcugguaaguccuagggauuuccagaaguagccugcagaa

SEQ ID NO: 178342 - RNA, 64 nt, Human
caggcccaaguaaagguuaaaaauaaggucuaugccuagggaaacucagggcuucuaguuucuc

SEQ ID NO: 178343 - RNA, 64 nt, Human
aaguguaaucccuguaucugcuucagccuccugcccuagggaccgcggggcagcccccucccag

SEQ ID NO: 178344 - RNA, 64 nt, Human
acaguagggucuuucaggguucugcugugggcucccuagggaagcccauccaucuggaugguuu

SEQ ID NO: 178345 - RNA, 64 nt, Human
cacaccugcguuucacuggccuucauuagguggcccuagggagauggcuuucugcuuuggauca

SEQ ID NO: 178346 - RNA, 64 nt, Human
acuguugacguuauuuucuauugagauucuggagccuagggagcuauguguucuuuuuguucau

SEQ ID NO: 178347 - RNA, 64 nt, Human
ucaguuaaugguucagcccauacaaaggugcuauccuagggauuuuaugaauuccugaaaggaa

SEQ ID NO: 178348 - RNA, 64 nt, Human
uggcuucuugaaaaguucgcucugccagaaaccaccuagggaccacguuagcugccuuccuuga

SEQ ID NO: 178349 - RNA, 64 nt, Human
cugagagucuggucauaggagucauguccagaggccuagggagguuuuagggcccuccccaccc

SEQ ID NO: 178350 - RNA, 64 nt, Human
aggauggacgugggagaaagcaagcaaaagcuacccuagggaagagccggugacgugcacaggc

SEQ ID NO: 178351 - RNA, 64 nt, Human
agggcucugugguauaugacugcuucgaggcugcccuagggagugagguacgaaucugguccua

SEQ ID NO: 178352 - RNA, 64 nt, Human
gauggaaaucauaaaauauuucaugggaaucgaaccuagggauagugcuccacuucugacgaug

SEQ ID NO: 178353 - RNA, 64 nt, Human
aagccuggauuugccccuccauguaggagcugggccuagggaccuguugaacucucucagcuga

SEQ ID NO: 178354 - RNA, 64 nt, Human
acuauacuugggaaaaggucaguaggaugugcauccuagggaagauaaaaucguauaugguaaa

SEQ ID NO: 178355 - RNA, 64 nt, Human
cugaggccaggauuaaggggaggcaaucaaugcaccuagggaaaaaauuuaaggagguauucac

SEQ ID NO: 178356 - RNA, 64 nt, Human
gccaagagccgacaaugcccugcuggccugucucccuagggaauuccugcuaugacagcuggcu

SEQ ID NO: 178357 - RNA, 64 nt, Human
uuauuggaaucaagaccaauaccaaggagaaauuccuagggaacaaaaauuccaaugaggaauu

SEQ ID NO: 178358 - RNA, 64 nt, Human
gggauguggaaguggggcuggaacaaagcuucugccuagggaggagcuaagcaggcccggcagu

SEQ ID NO: 178359 - RNA, 64 nt, Human
ggguaucagagcugcagccagcucugcccucuacccuagggaggccagaaagacacaaacagcc

SEQ ID NO: 178360 - RNA, 64 nt, Human
acaucucuguguggaaguugagacuaagaauaauccuagggaugucaugaauuuaggcaauguu

SEQ ID NO: 178361 - RNA, 64 nt, Human
gugugguaagagguuugaguaguccuauaugucaccuagggaacagacauuauagcuuacuagc

SEQ ID NO: 178362 - RNA, 64 nt, Human
agaggccuggugguuuaacagccgaagacacacgccuagggaugagcacccucuuugugacacu

SEQ ID NO: 178363 - RNA, 64 nt, Human
cagcuguuugucauagggcaguuggaaacggccuccuagggaaaaguucauagggucucuucag

SEQ ID NO: 178364 - RNA, 64 nt, Human
ggagaagggaaggcaggauacccagaacuagcagccuagggaaaaggcuuaggaagauggagaa

SEQ ID NO: 178365 - RNA, 64 nt, Human
ccaauaaauaaaaauaccacuuucuuuaaaaaagccuagggaauugaagcucuguacauauacu

SEQ ID NO: 178366 - RNA, 64 nt, Human
auuuuuaaaaagaagaaagccuaaagacucucggccuagggacguccgugugugccgccucugu

SEQ ID NO: 178367 - RNA, 64 nt, Human
auuuugacacugugacaguuuugguaacuaggauccuagggagggaaauguuugccuguugaac

SEQ ID NO: 178368 - RNA, 64 nt, Human
cuuuguaggcugugcugugucugaagggguaacaccuagggaaacaugaggccccuuaugggac

SEQ ID NO: 178369 - RNA, 64 nt, Human
cauguucauuuguaccucgaguuuuaaacugguuccuagggaugugugagaauaaacuagacuc

SEQ ID NO: 178370 - RNA, 64 nt, Human
cccucuuuuuggcacaaguucuaucacuccuuuaccuagggaaggaaaaaaaaaauauauauau

SEQ ID NO: 178371 - RNA, 64 nt, Human
ggaaagaccagauaagaaaccugcccuuugucucccuagggacaugagacaccacauuccauuu

SEQ ID NO: 178372 - RNA, 64 nt, Human
ugccucuguuuuucuuguuuuauucccuugaugaccuagggaaaaaaaggcauguagaguauua

SEQ ID NO: 178373 - RNA, 64 nt, Human
gacuuuuuaaaauucugagugauccaggguaugaccuagggaaugaacuagcuaugaaauacuc

SEQ ID NO: 178374 - RNA, 51 nt, Human
augcagaggcccucaagugacccuagggaagaagcaagaaacuucggggcu

SEQ ID NO: 178375 - RNA, 64 nt, Human
ccgggggccuauggcagugaugcuguguugguuuccuagggaugcucuaacgaauuaccacaaa

SEQ ID NO: 178376 - RNA, 64 nt, Human
cuccuugagggcagaaaggagucccaggccugucccuagggacaaggcccagggaagaguguau

SEQ ID NO: 178377 - RNA, 64 nt, Human
cucaugcuuuuaggcauaucuauguugaauuucaccuagggaauguucuguucuuaguuacagc

SEQ ID NO: 178378 - RNA, 64 nt, Human
auaaucugcauagguauaaagaggaucauuucuaccuagggauagccaaagcauggguuucaac

SEQ ID NO: 178379 - RNA, 64 nt, Human
aggaggccgggugccuguuugguggcagcuucagccuagggauaccugaagcuguugagcaaca

SEQ ID NO: 178380 - RNA, 64 nt, Human
agccauaaaucauaacccagggaccacacucaacccuagggaaauugucuuccugaucaguuga

SEQ ID NO: 178381 - RNA, 64 nt, Human
gggcugcacccaguggauugggucacccggcagaccuagggaaggugaggcgagguggggaguu

SEQ ID NO: 178382 - RNA, 64 nt, Human
gcuuccucugagugagaugcccaggaggaggagcccuagggaagaagucagggacagggaccag

SEQ ID NO: 178383 - RNA, 64 nt, Human
caguuugggcccaggcuaugugcucuucuggugcccuagggacugcuguggccagagccugggg

SEQ ID NO: 178384 - RNA, 64 nt, Human
ggcgaugacugucugccuuggugaugaaucucuuccuagggagaagcaggauacuuucccucag

SEQ ID NO: 178385 - RNA, 64 nt, Human
auuaaaaagacacuauuguuaguuagcugaaaauccuagggaaugagguugauugggagcgcuu

SEQ ID NO: 178386 - RNA, 64 nt, Human
caucugaugauagauucccagagcuggauggaucccuagggacuaccuaaucugacuuucuguc

SEQ ID NO: 178387 - RNA, 64 nt, Human
aaauuacaaauccaaaacucuaugaugaugucuuccuagggaguagagaaaggcagugaaaugg

SEQ ID NO: 178388 - RNA, 64 nt, Human
aguuuggcccagcaaacauguggguacuucuccaccuagggaagccacugaagaugaguuugac

SEQ ID NO: 178389 - RNA, 64 nt, Human
aaauuaaauuguaguuauaagcaaaaguugguugccuagggaacaauuguauauucaguuuaac

SEQ ID NO: 178390 - RNA, 64 nt, Human
aaauccuuuucagcagacgcuucccuucccuuccccuagggaaugugucccuacuauaguaaac

SEQ ID NO: 178391 - RNA, 64 nt, Human
cagugguagaaaaaaaagguuuuaaaaauuguauccuagggaacaguuugccauaagucagaau

SEQ ID NO: 178392 - RNA, 64 nt, Human
uggucccuugcccuggcuacagaacauggaagccccuagggaugcaaguggacuugggcagagg

SEQ ID NO: 178393 - RNA, 64 nt, Human
caaaauucagugaaacaaacuuuuugccaauagaccuagggaucuaagaaauagaauuagggag

SEQ ID NO: 178394 - RNA, 64 nt, Human
ccaagcuguuucuccagcugccuugaggacaugcccuagggaacagugcucugaaucguaccug

SEQ ID NO: 178395 - RNA, 64 nt, Human
ggcagaacuccgcuccccugcuccaaacugcucuccuagggaauggggaaaggcccccuggggc

SEQ ID NO: 178396 - RNA, 64 nt, Human
cuguacuuccccucucucuuguccccaggcacagccuagggaaaaggaugccucucuccaaccc

SEQ ID NO: 178397 - RNA, 64 nt, Human
aaugaaggucuuuuuuuaaaagcuucucagccuuccuagggaacagaaauugggugagccaauc

SEQ ID NO: 178398 - RNA, 64 nt, Human
cuuucccuaauacaggguugcgcuugcauuggacccuagggauuugcacuaaaauuauaucaag

SEQ ID NO: 178399 - RNA, 64 nt, Human
ccggccucugcagccaccguccagcaccgcuuguccuagggaaguccugcguggagucuugccu

SEQ ID NO: 178400 - RNA, 64 nt, Human
ucuccuauuccaauaugucaucuuuacucagaauccuagggauagguagaagaauucaucuuuu

SEQ ID NO: 178401 - RNA, 64 nt, Human
ggccauuuaauauaucaaagaucaguugacaucuccuagggaaugaugaaaacagcaggcuauu

SEQ ID NO: 178402 - RNA, 64 nt, Human
ugugcuaggcaauaacucuugcagcccugaaggaccuagggagcccagcccaccuucccacgga

SEQ ID NO: 178403 - RNA, 50 nt, Human
gcccguuccuggcgaggugaccuagggaugaagguacucaucuuccuuca

SEQ ID NO: 178404 - RNA, 64 nt, Human
aauugccaacauugcacagccaggcugggagcagccuagggagagcccccaucaugcccaccac

SEQ ID NO: 178405 - RNA, 64 nt, Human
cucaaauguauuccuuuuuuguaugguggguuugccuagggacguguaacuacaggcuuuuacu

SEQ ID NO: 178406 - RNA, 64 nt, Human
cagggcaugggauuaaagagauugugcguucaaaccuagggaagccugugcccauuuguccuga

SEQ ID NO: 178407 - RNA, 64 nt, Human
guccacgcaugugaguugggucaagugcauuggaccuagggaaagagaaagaaagaauaaaagc

SEQ ID NO: 178408 - RNA, 64 nt, Human
gagaggccccaacacuggaugguucuguagggagccuagggagccuggucaucaacuugcaaua

SEQ ID NO: 178409 - RNA, 64 nt, Human
uuggcuuccuuuagagaccccgguaauuguggaaccuagggaauggggaacccgcucucccaga

SEQ ID NO: 178410 - RNA, 64 nt, Human
ggaaccuagggaauggggaacccgcucucccagaccuagggauccugagagggagagacugcaa

SEQ ID NO: 178411 - RNA, 64 nt, Human
caggaugggcccaugaaggcaaaggugccugucuccuagggaagccuuaaugugguauucccuc

SEQ ID NO: 178412 - RNA, 64 nt, Human
ucgaagcugguuggcaaggugaaggccucagcauccuagggaacaaggaaccagcaguaagugg

SEQ ID NO: 178413 - RNA, 64 nt, Human
agccagcuggccugcacuggguguggagagaacaccuagggaaggcagccuggcccugcccgcc

SEQ ID NO: 178414 - RNA, 64 nt, Human
ugacuuggaccaguuagaugauucacuuuuugccccuagggaugagaggcgaaagccacuucuc

SEQ ID NO: 178415 - RNA, 64 nt, Human
acaugccuacucugccagacacugagcuuggggcccuagggaagauagagaauuauacaaggca

SEQ ID NO: 178416 - RNA, 64 nt, Human
ucugaagaaaucagacugauuuccucuuaagacuccuagggauguggugaagagcugggacuca

SEQ ID NO: 178417 - RNA, 64 nt, Human
ggauaagcccaggccccauggagagaggcucagcccuagggaaaggcugcucuugcucucccuc

SEQ ID NO: 178418 - RNA, 58 nt, Human
ugcugccuggaaucuucuaagggcacgcccuagggagaagcccuguggggcugucaag

SEQ ID NO: 178419 - RNA, 64 nt, Human
cuguccgcuccuguagaagguagggagcacaauaccuagggacuaagggauguucgccgguugu

SEQ ID NO: 178420 - RNA, 64 nt, Human
cuagguugggggcccccgacccaccauaccuacgccuagggagcccguccuccaguauuccguc

SEQ ID NO: 178421 - RNA, 64 nt, Human
gcaucuauucauguggcaggccccuguccuaggcccuagggauccaacuggcugucugccucua

SEQ ID NO: 178422 - RNA, 64 nt, Human
aguaaccuaacccccgugacuauccugugcucuuccuagggagcuguguuguuucccacccacc

SEQ ID NO: 178423 - RNA, 64 nt, Human
aguugccauguagaccccuugaagaggggaggggccuagggagccgcaccuugucauguaccau

SEQ ID NO: 178424 - RNA, 64 nt, Human
uuucucagauauggcauuagaugcaagacaaccuccuagggauugaugccuaacugauggauuc

SEQ ID NO: 178425 - RNA, 64 nt, Human
ccaccccccagccccuuggcccucuccugucugcccuagggagaaggcagguggacaagggccc

SEQ ID NO: 178426 - RNA, 64 nt, Human
cuggaacccagucuagcaaaaugagaggaaaggcccuagggagauuuauuucuguuaaauaguu

SEQ ID NO: 178427 - RNA, 64 nt, Human
augccagccaagcucugcagucccagcggugggaccuagggaggcauggucugcccucugcauc

SEQ ID NO: 178428 - RNA, 64 nt, Human
uuugcuccaccuucauauuggcuagguagggucaccuagggaagcacuugcucaaaaucuguga

SEQ ID NO: 178429 - RNA, 64 nt, Human
aauccucuggcuauuuaagguucaaaaucaagugccuagggaaaauuccaauggaugauuuucu

SEQ ID NO: 178430 - RNA, 64 nt, Human
ugcuuuguguuccucucccagcuccaucucuuucccuagggaccaggcacucauauggcggggu

SEQ ID NO: 178431 - RNA, 64 nt, Human
gaacuugugcuugggagcugguuauuggugugguccuagggagggcggaaagggaggcacugcc

SEQ ID NO: 178432 - RNA, 64 nt, Human
uaaugucuccuaagcuuuucucucauagcguagaccuagggaagggaugggaagauugcccagu

SEQ ID NO: 178433 - RNA, 64 nt, Human
aggaagauccuuggguugugaagagaguagaaacccuagggagcagugcuuuuggguccuagaa

SEQ ID NO: 178434 - RNA, 64 nt, Human
auucuacugcuuuaagagaaauaaaacaaauaagccuagggaaauauuagagucuaaaaaaccc

SEQ ID NO: 178435 - RNA, 64 nt, Human
ucuccgaccgauuaaugguuugcugcuugacuagccuagggaaauaauaauaaagguaaaguaa

SEQ ID NO: 178436 - RNA, 64 nt, Human
gagaaacacaucuucccuagaggguuccuguagaccuagggaggaccuuaucugugcgugaaac

SEQ ID NO: 178437 - RNA, 64 nt, Human
aaagaggaaagccccacaaacuaaaacagccuuuccuagggaagaggaaggggaggugggcugg

SEQ ID NO: 178438 - RNA, 64 nt, Human
gcgguuugcaugggauggggugggggcgggcuccccuagggacaggugccucgagugcccgugc

SEQ ID NO: 178439 - RNA, 64 nt, Human
uuggguguccauggugcccugggcuguguccuccccuagggaugagggucgggccuccacgaug

SEQ ID NO: 178440 - RNA, 64 nt, Human
uugcauuuaagcaggaguaaaggaagaaagugacccuagggaaguaauggauuuuuuuuuacuc

SEQ ID NO: 178441 - RNA, 64 nt, Human
acgaucccacaacugggacagaggcuacaucugcccuagggagguccuucagaaucuguggagc

SEQ ID NO: 178442 - RNA, 64 nt, Human
gcuccgcagccuggauacuuaccuggcccuccucccuagggagcaagugccuuccacuuacuuc

SEQ ID NO: 178443 - RNA, 64 nt, Human
gcuuuuguuuugcaugauuuuuaaaagcaguacuccuagggaaauggccucugaaguauaucag

SEQ ID NO: 178444 - RNA, 64 nt, Human
uacaagaacuucagugagacuaagggacccccauccuagggaucuugucaggguuccuuacuga

SEQ ID NO: 178445 - RNA, 64 nt, Human
ccguuaccaccagaauggcugcucugacaauaugccuagggacuuucucauggcuuuuauuuaa

SEQ ID NO: 178446 - RNA, 64 nt, Human
gaaacauccaguaagcuugugacaaaugcagacuccuagggaaaaccaggggguucugcuucac

SEQ ID NO: 178447 - RNA, 64 nt, Human
gcaaaauuguuuuugguuggauuggagaaguaauccuagggaagggugguggagccaguaaaca

SEQ ID NO: 178448 - RNA, 64 nt, Human
ggggaguccuuccaucugcuccuucuuaaacuguccuagggaguuggcuuuucagccagggcca

SEQ ID NO: 178449 - RNA, 64 nt, Human
cuacugggagacugggacaccuuuaacacagaccccuagggauuuaaagggacaccccuacaca

SEQ ID NO: 178450 - RNA, 64 nt, Human
gguuuaagaagcccaagccuuguuccugcccuggccuagggagcacucaggaggguuccuuggu

SEQ ID NO: 178451 - RNA, 64 nt, Human
gccccaggaguggcaggagaggauccccgaccacccuagggaaacuucgugcgauaauugcugc

SEQ ID NO: 178452 - RNA, 64 nt, Human
ugcuggacagauggcuggccaagugggagcagacccuagggaguuugcaccucggcugggccgg

SEQ ID NO: 178453 - RNA, 64 nt, Human
aguugacgugguguuugguuccauggcgggguacccuagggauucaucuguuuucuucacuucc

SEQ ID NO: 178454 - RNA, 64 nt, Human
cagaaugcacuuuguggcugagugcuccaggacuccuagggagcaagguccucccucuaaggug

SEQ ID NO: 178455 - RNA, 64 nt, Human
cugaucuaaauguggagaaacuguagucucaggaccuagggauguucuggcccucaccccugcc

SEQ ID NO: 178456 - RNA, 64 nt, Human
ccccuccguaaacucaggaagugucaggugauuuccuagggagagguucccagucccagcaggc

SEQ ID NO: 178457 - RNA, 64 nt, Human
aguugaugugguguuugguuccauggcgggguacccuagggauucaucuguuuucuucacuucc

SEQ ID NO: 178458 - RNA, 64 nt, Human
uucugacucugcccagucucuaugaauguuauggccuagggaagaaucaugaaacucuuuagcu

SEQ ID NO: 178459 - RNA, 64 nt, Human
aguggccuugucuuuguccuccccaccccccagcccuagggacaccccaggcaguccugggugu

SEQ ID NO: 178460 - RNA, 64 nt, Human
accccucugccuuccuccccaauccugacuggcuccuagggaaggggaaggcuccuggagggca

SEQ ID NO: 178461 - RNA, 64 nt, Human
cgagccagcgaaccccagcaguaggaauccguacccuagggaucugucugucauuucucuguug

SEQ ID NO: 178462 - RNA, 64 nt, Human
cuugcccagucccaggcagaguaagcagggcccaccuagggaccaagaaagaguaggaagaagg

SEQ ID NO: 178463 - RNA, 64 nt, Human
cuuugacucaguuccccacacccaaagaucccagccuagggaugggguacagggacuuuaaaua

SEQ ID NO: 178464 - RNA, 64 nt, Human
cugcgagccucgucugggacucggcuggagcuggccuagggaggccugggguaaccuggggggc

SEQ ID NO: 178465 - RNA, 64 nt, Human
cugccauucccuucuuccuccucaucaccaucgcccuagggaccaagacugaauccuccucacg

SEQ ID NO: 178466 - RNA, 52 nt, Human
gcaauuccuucgugcgcuagaaccuagggaaugccagaggagcaaggaugca

SEQ ID NO: 178467 - RNA, 64 nt, Human
gguuguuucuaacauuggcagccuggauuauggcccuagggagagggaaauagaaucagaauug

SEQ ID NO: 178468 - RNA, 64 nt, Human
caaagcuggccccugaaccacugugugcccauuuccuagggaaggggaaggagaauaaacagaa

SEQ ID NO: 178469 - RNA, 64 nt, Human
uauuugagagacugccauacauaauauaugacuuccuagggaucugaaauccauaaacuaagag

SEQ ID NO: 178470 - RNA, 64 nt, Human
gccuuugccccagcacagaagaggccccugccacccuagggacgggccaagggcuggucaggcu

SEQ ID NO: 178471 - RNA, 64 nt, Human
cuuaaaugacaaagauuaccuagcuaagaaacuuccuagggaacuagggaaccuauguguuccc

SEQ ID NO: 178472 - RNA, 64 nt, Human
ucaacuuccuagcagaaaugaacuuggcccuagaccuagggauaagcaauguucuuuauguagc

SEQ ID NO: 178473 - RNA, 64 nt, Human
ucccuagggcgggucugggcgucugcaccuggggccuagggaacugacacgugggaagcgcagu

SEQ ID NO: 178474 - RNA, 64 nt, Human
agugcucaacugguaaggagaacguagaaguagcccuagggauccuuuuugaaacucuacaguu

SEQ ID NO: 178475 - RNA, 64 nt, Human
acaugccuggaacccccgccgccugcugcucccuccuagggaacccauuuccggggaacgccgu

SEQ ID NO: 178476 - RNA, 64 nt, Human
gcuuuggacaaccaggccccaacuuggucccugcccuagggaccuccagccuggugcccagugc

SEQ ID NO: 178477 - RNA, 64 nt, Human
acaaugguucucauuuggcuaagcaucaaaaucaccuagggagucggugcaaaacaaaauaucc

SEQ ID NO: 178478 - RNA, 64 nt, Human
ccacccagaccgagagacacagugaugaccucagccuagggacaccaaaaaagaaaaaaaaaaa

SEQ ID NO: 178479 - RNA, 64 nt, Human
aggggaaccccacccuccacacagccggagcugcccuagggagccuggagggccagcuuguaaa

SEQ ID NO: 178480 - RNA, 64 nt, Human
uggugggggcaguaauuccugccccccucucugcccuagggaugggcacgggggcgcuggugag

SEQ ID NO: 178481 - RNA, 64 nt, Human
ggaaacugaaagccccagguugagagaacagaggccuagggaccuccagaccauuggaaucacu

SEQ ID NO: 178482 - RNA, 64 nt, Human
ucugggagcuugacuauggaccaaacagcucuggccuagggauugggccacccuacccaggauc

SEQ ID NO: 178483 - RNA, 64 nt, Human
ccucccucaagggccuggguucuaccaccccacuccuagggaucucuugaaccuuaggggugac

SEQ ID NO: 178484 - RNA, 64 nt, Human
gacugagcgacagcagcccuggggcccgcaggucccuagggaguucaugaggggaaugcgcccu

SEQ ID NO: 178485 - RNA, 64 nt, Human
ucuuuucuuugggguucaggaggaaaaacacaguccuagggacaaaagccagguccacagcagu

SEQ ID NO: 178486 - RNA, 64 nt, Human
guucaaaacagaaauguuuuuuggcauuccaccuccuagggauauaauucuggagacauggagu

SEQ ID NO: 178487 - RNA, 64 nt, Human
ugcagugugaggacagcgucucgggaggcaggacccuagggagacccgggugugcgccgccugc

SEQ ID NO: 178488 - RNA, 64 nt, Human
agccugggcccuucagccccugugcucgucccacccuagggacucagccacuugcagaacagga

SEQ ID NO: 178489 - RNA, 64 nt, Human
caaugccacuugcuuuaagaggacagaugagugaccuagggaaaauucuauuucauucuagaau

SEQ ID NO: 178490 - RNA, 64 nt, Human
agcugggcugcaugugccaacuacgucuuaucucccuagggaaugcuccagcaacccugugggg

SEQ ID NO: 178491 - RNA, 64 nt, Human
gggugagaacuucucugugccugcucagaggcgcccuagggaagggccauguuugaguuuugcu

SEQ ID NO: 178492 - RNA, 64 nt, Human
cuggaggagggccagcucgcugcccgagcucuggccuagggaccuugccgcugaccaagaggga

SEQ ID NO: 178493 - RNA, 64 nt, Human
cuccuucuggacauacugccuggcagccugccuuccuagggagcuggcgccaaggccucucccu

SEQ ID NO: 178494 - RNA, 64 nt, Human
caccagcccccaacccagggaggaacuggccccuccuagggagccucuucgacuuuuuuagaaa

SEQ ID NO: 178495 - RNA, 64 nt, Human
aaugagaaagcugcccauucucaagacucaucugccuagggagggucacagaggcaggauguaa

SEQ ID NO: 178496 - RNA, 64 nt, Human
cugcccagcucuccuacaagguuagugcccuccaccuagggaagcaugaaccacagggucccug

SEQ ID NO: 178497 - RNA, 64 nt, Human
caaugcagugaguuauagauucucuaguuuucucccuagggaugggaagggggcauugaggcaa

SEQ ID NO: 178498 - RNA, 64 nt, Human
auaaggcaaaaagaucuguauuuacacuccuucaccuagggauguguuuguugcccuccuaccc

SEQ ID NO: 178499 - RNA, 64 nt, Human
ggagagugaggagggaguguuauuuccuugggaaccuagggaggagagguuccuuuguugggaa

SEQ ID NO: 178500 - RNA, 64 nt, Human
gaauggaaauuauucacccauuuuaaauuggugaccuagggaucagagauuugucuuuccaaca

SEQ ID NO: 178501 - RNA, 64 nt, Human
gggaaggagacaggaugaggucucgacccuguccccuagggacuguccuagccaggucuccugg

SEQ ID NO: 178502 - RNA, 64 nt, Human
aaacuaagauaucccucacacccagcccccauuaccuagggacaagagucuuccccagccuuga

SEQ ID NO: 178503 - RNA, 64 nt, Human
ccgcauagguagagccucuuguuccuaggcaugaccuagggaaaaacccagcugccuucucugc

SEQ ID NO: 178504 - RNA, 64 nt, Human
cauaaacucaagggagugauuucgguuccuaaguccuagggaguucuauuccauuuauucugau

SEQ ID NO: 178505 - RNA, 64 nt, Human
aaguagcaagggaaggucugaauguaaggacaggccuagggaccuugcaagcacuugauaucuc

SEQ ID NO: 178506 - RNA, 64 nt, Human
agccuggcgccccuuccuaggucaugccuccuccccuagggaauggucccagcacgaguggcca

SEQ ID NO: 178507 - RNA, 64 nt, Human; identical to SEQ ID NO: 178506

SEQ ID NO: 178508 - RNA, 64 nt, Human
cggaguggggguggcggccgccccacccuccccacccggggaagccaucacagcucaucugccc

SEQ ID NO: 178509 - RNA, 64 nt, Human
aaacugccucaggaggcaggaccuucgggcugugcccggggaaaggcaagguccggcccauccc

SEQ ID NO: 178510 - RNA, 64 nt, Human
agguuuccugggggaggugauccuugaacuggcucccggggaacauucagagcaugauugguag

SEQ ID NO: 178511 - RNA, 64 nt, Human
ccgaggcccuaggccccucagcagggaagggauccccggggaggcaggucccaggagcagaccc

SEQ ID NO: 178512 - RNA, 64 nt, Human
cgcaaaacucccugaccccgaugugauuuuucuccccggggauucgagagccaugcgugggaca

SEQ ID NO: 178513 - RNA, 64 nt, Human
gcuucugcuuuucugcccuggcugcugcccccaccccggggacccugugacauggugccugaga

SEQ ID NO: 178514 - RNA, 64 nt, Human
uucagccaccaucagagccucuccccaggugccccccggggauucagggcugaaucugcccagu

SEQ ID NO: 178515 - RNA, 64 nt, Human
gccucaggccccgcguuugugucuggagucuccccccggggagaggacacuggccccucgcacu

SEQ ID NO: 178516 - RNA, 64 nt, Human
gcucaaccuacccugguccagucgggaggagcagcccggggaggaacugggugacuggaggccu

SEQ ID NO: 178517 - RNA, 64 nt, Human
cagggugccguggggcugcagccugagaggcuggcccggggaggaguucccaucaccgccugug

SEQ ID NO: 178518 - RNA, 64 nt, Human
accaacagagccacggagcgcgagcacaugcccgcccggggagcacaauggcgcugcacaaaac

SEQ ID NO: 178519 - RNA, 64 nt, Human
uggccaggaccgucgagaccaccagagcuaccuccccggggacagcccacuaagguucugccuc

SEQ ID NO: 178520 - RNA, 64 nt, Human
ccucggggcugcggggugagaggaagaaagcaaacccggggagcaggcggcugccgcacccgcg

SEQ ID NO: 178521 - RNA, 64 nt, Human
ccaucacagccagcccagcuccacucagggcuggcccggggaguccccgugugccccaagaggc

SEQ ID NO: 178522 - RNA, 64 nt, Human
cccauauccugagguggaucaggcaggcucucuccccggggacaugaggcacccauaccuagga

SEQ ID NO: 178523 - RNA, 64 nt, Human
gcacgccuagagucucgcccgaucccaucggcaucccggggagggcccgggagccuccgucaac

SEQ ID NO: 178524 - RNA, 64 nt, Human
ccgggucgaccccccaggggacgcccaugccaggcccggggaccugugccacacgaccagcugu

SEQ ID NO: 178525 - RNA, 64 nt, Human
cccuucagccagcccuggauagcuacuuccaucccccggggacucccgcgccgggacgcggggu

SEQ ID NO: 178526 - RNA, 64 nt, Human
gucagggcccacuccaggagggacccacugccuucccggggagcacaguagugcgggccugggc

SEQ ID NO: 178527 - RNA, 64 nt, Human
ggccacgcggggcaagugccuuuccgacaagacccccggggaaugcaggugcugccggccccag

SEQ ID NO: 178528 - RNA, 64 nt, Human
gggcugggucaggggccuggcaugaaccuggccucccggggagcugagacuagggucccagcac

SEQ ID NO: 178529 - RNA, 64 nt, Human
accaacugugaauagcugccgcuugcgcagaggacccggggaggggucccgagaggcuccccau

SEQ ID NO: 178530 - RNA, 64 nt, Human
ucaaacucuuaggcucaggcgauccuucaagccucccggggagcugggaccacaggcacgugcc

SEQ ID NO: 178531 - RNA, 64 nt, Human
auccaguccuggaggacccgcugcuccugcugcucccggggauggagcaaggccaaggcugcgg

SEQ ID NO: 178532 - RNA, 64 nt, Human
aggggcggcccggacgggggagcuuucccagagacccggggauggauuggccuccagggcgcag

SEQ ID NO: 178533 - RNA, 64 nt, Human
acaugggcccucugcacagaguccgauggcuccucccggggaagccugauuuugugacgugugu

SEQ ID NO: 178534 - RNA, 64 nt, Human
gagccgggaaagaagagccggagccuccagcugccccggggaggggcgcucgcuuccgcauccu

SEQ ID NO: 178535 - RNA, 64 nt, Human
gccccgcagcccagacgcagcugagucggaagcucccggggacgacgcugacugcccuggaggc

SEQ ID NO: 178536 - RNA, 64 nt, Human
cgucccucucccagaccucuccucuuccaguguccccggggaagggcagaugacacucccuucc

SEQ ID NO: 178537 - RNA, 64 nt, Human
cccggacaagacucgcccagcacuugcggcugggcccggggagcagugaguggaaaucccccac

SEQ ID NO: 178538 - RNA, 64 nt, Human
gggaggcuuccccaucuuuaguuuuccacucugccccggggagcacccuucuacuccuagccac

SEQ ID NO: 178539 - RNA, 64 nt, Human
ggcaggccucccucagggccaggggcgauggcaccccggggacaggcagaccuccuuccugccg

SEQ ID NO: 178540 - RNA, 64 nt, Human
gucaggccggccagccucacaucagucucuccgccccggggaaggcucagccacuuuucaucga

SEQ ID NO: 178541 - RNA, 64 nt, Human
gaaggggaggcgggagggaggggaagcucgcaagcccggggagagauuuauaaaaguaaacaaa

SEQ ID NO: 178542 - RNA, 64 nt, Human
gggcacagcaggagcggucagggcuccaggcauccccggggaagaaaggaacggggcuucacag

SEQ ID NO: 178543 - RNA, 64 nt, Human
gcacccucccagggacacuggaugcgcugggagccccggggaccccauggggugcuguaaucau

SEQ ID NO: 178544 - RNA, 64 nt, Human
aacuaagaacaggauaauccaaccuacgugaccucccggggacaguggcugugcuuuuaaaaag

SEQ ID NO: 178545 - RNA, 64 nt, Human
ugcgccucgugcuuuccgcguacagaagugcuugcccggggagucccgccugaccugccuucau

SEQ ID NO: 178546 - RNA, 64 nt, Human
gcuccaauagugcaguuaucguggccucucgcagcccggggagcacgucgccucuugaaacucg

SEQ ID NO: 178547 - RNA, 64 nt, Human
ggagccccucacugcccugaccgacuccgcaguccccggggaggagcauggauggugugucggc

SEQ ID NO: 178548 - RNA, 64 nt, Human
uucggacugacugaacuugaccugugaccucugacccggggagcagagaacacuggcuucacag

SEQ ID NO: 178549 - RNA, 64 nt, Human
uacagagagugugaacgguacagccccggccugacccggggaccuucagccuggacacccggca

SEQ ID NO: 178550 - RNA, 64 nt, Human
uccuugggaggcugaggcgggagaauugcuugaacccggggacggagguugcagugagccgaga

SEQ ID NO: 178551 - RNA, 64 nt, Human
ucacaugcacugcguguggcgcaucucugucacacccggggagaagguacgugugggcucagcc

SEQ ID NO: 178552 - RNA, 64 nt, Human
cagcccaccccagggacugggggcagcaccaggucccggggagagggauugagccaagagguga

SEQ ID NO: 178553 - RNA, 64 nt, Human
ugcccgaagcaauaacaacagcagcagaagcaaucccggggagcugccaggggugucugucucu

SEQ ID NO: 178554 - RNA, 64 nt, Human
gcucuccugccacccugcuggccgggagccccuccccggggaguucuuggugaaguccuucccg

SEQ ID NO: 178555 - RNA, 58 nt, Human
ucauggagggugugcuguagcgggggcgcccggggacaggagggauguccugccgccc

SEQ ID NO: 178556 - RNA, 64 nt, Human
aaaguugcuaagaagcagggcuugccucuguccucccggggacuccacagggauauucgugcag

SEQ ID NO: 178557 - RNA, 64 nt, Human
acaaugauggacaaagacgcaugcaagacucagacccggggaaugguguggugcuaaucucaac

SEQ ID NO: 178558 - RNA, 64 nt, Human
uuccucccuuacagagcauacaacagagggggcacccggggaggagagcacauacuguguucca

SEQ ID NO: 178559 - RNA, 64 nt, Human
caauagcuccaggugccucagccccgugcccugacccggggaccacagggacacccucugagac

SEQ ID NO: 178560 - RNA, 64 nt, Human
aauuguugaugaccgugugacaauagagcgaagccccggggagugaacgguccaaccucugcau

SEQ ID NO: 178561 - RNA, 64 nt, Human
gacagacgcccaccugcuccccgaccucgaggcccccggggaggggcagggccuggagcuuccc

SEQ ID NO: 178562 - RNA, 64 nt, Human
ggcucaacacagugauggacugauccagauggcucccggggaugaauguggguggguagcuucu

SEQ ID NO: 178563 - RNA, 64 nt, Human
cacugggcacgguggucggccuggugugaggccccccggggaccggcaguguguccagggaggg

SEQ ID NO: 178564 - RNA, 64 nt, Human
ggaagugcccagaaugggaggcacggaagccccucccggggaggacucccgcguugauggaccg

SEQ ID NO: 178565 - RNA, 64 nt, Human
ccacuggaacggguccuuccaggaggcagccuuucccggggagaccuuuccagugucgguagag

SEQ ID NO: 178566 - RNA, 64 nt, Human
gcugagaucuguugaauaauguuuacauucgucccccggggaaauguaugcucagccaccauuc

SEQ ID NO: 178567 - RNA, 64 nt, Human
gccgagggcugaggccaggcaaucacgggcuaugcccggggagcugucgggaguggcgggaauc

SEQ ID NO: 178568 - RNA, 64 nt, Human
ggagcugucgggaguggcgggaaucggggccaugcccggggagcugucgggaguggcgggaauc

SEQ ID NO: 178569 - RNA, 64 nt, Human
ggagcugucgggaguggcgggaaucggggccaugcccggggagcugucgggaguggcgggaaau

SEQ ID NO: 178570 - RNA, 64 nt, Human
gagaaggccucaucucucuauauuuauacauaaccccggggaagacacagagacucguaccugc

SEQ ID NO: 178571 - RNA, 64 nt, Human
cuaguggcuguccagugcccauuccucaccuuuucccggggaggagagagcagcuucugccacu

SEQ ID NO: 178572 - RNA, 64 nt, Human
gagaggccacucccucuccagcccccgauguggacccggggaggggaggcugaggcguuuggcc

SEQ ID NO: 178573 - RNA, 64 nt, Human
uccagacuucgcuauucccaggcagggagggaaacccggggaacugguuuuucuguucccugcu

SEQ ID NO: 178574 - RNA, 64 nt, Human
agcagcccugcccagggggcauuagguguggguacccggggagcaccccguuccuggaccccag

SEQ ID NO: 178575 - RNA, 64 nt, Human
ugcccuaugacugugcagacucuggcucgagcaacccggggaacuucacccucaggggccuccc

SEQ ID NO: 178576 - RNA, 64 nt, Human
ggaguccccaucugccccgccccuucacagagcgcccggggauuccaggcccagggcuucuacu

SEQ ID NO: 178577 - RNA, 64 nt, Human
aggcugcguggacguuauacugucuucccccacccccggggaggggaagcuugagcugcugcug

SEQ ID NO: 178578 - RNA, 64 nt, Human
ugcccacgugggauucacaggggccugaguagggcccggggaagcagagcccuaagggauuaag

SEQ ID NO: 178579 - RNA, 64 nt, Human
ccagauggcaggugccugggacaggggcaggugccccggggagggcaaguacagccacuguaaa

SEQ ID NO: 178580 - RNA, 64 nt, Human
ccaggauguacuggcggauggggccugccugcaccccggggaggcgcccaccccggacccccac

SEQ ID NO: 178581 - RNA, 64 nt, Human
cccauuccuuccccugucucagccuucagccccucccggggagaagggccuugcuucccuggaa

SEQ ID NO: 178582 - RNA, 64 nt, Human
ggaaauuaucuguaugaacuaaaaguaagggaaccccggggaaugggaggacaggauuuuucaa

SEQ ID NO: 178583 - RNA, 64 nt, Human
ccuucucuccuuaucuugggaaccaggccuuccucccggggacuguucugggauugaaauugug

SEQ ID NO: 178584 - RNA, 64 nt, Human
cagcugccuucacaagcagggaucagagcaacuccccggggauccccaauccacgcccuucuag

SEQ ID NO: 178585 - RNA, 54 nt, Human
agcucauuuucuaugccugaggugcccggggaggcugcagcaggucagcgagug

SEQ ID NO: 178586 - RNA, 56 nt, Human
cgucaggcuauagcagcugagggggacccggggaggcuggacagggcgcggaaccc

SEQ ID NO: 178587 - RNA, 64 nt, Human
ugggaugcugcaucuccaggcaacuaugcacuuucccggggagagaaccaguaugagaaguggg

SEQ ID NO: 178588 - RNA, 64 nt, Human
accugaagcugagcccagcccagacccagcugcucccggggacaugugcuagaugauacuguac

SEQ ID NO: 178589 - RNA, 64 nt, Human
gacccugacuugggucccgucgugagcagaaaggcccggggaggaugacggcccaggcccuggu

SEQ ID NO: 178590 - RNA, 64 nt, Human
ccaacagccccgagggguggccuugcccugcucccccggggacccccaggcugaggguucugcc

SEQ ID NO: 178591 - RNA, 64 nt, Human
gccgccagggggcggucggaccccgccucccgagcccggggaggggcggggaggacaaggggcg

SEQ ID NO: 178592 - RNA, 64 nt, Human
gccucugcgggcuucgucaucgcaugcacugaugcccggggaccuggcuguccugggcuucccc

SEQ ID NO: 178593 - RNA, 64 nt, Human
aaucucaucccucccagcagcuccccuuccaccccccggggaacugaagauuguccuggccgcg

SEQ ID NO: 178594 - RNA, 64 nt, Human
ccccuuccucgagcgcgggguggggcuucgggaccccggggaugagccgggccaggucccgccc

SEQ ID NO: 178595 - RNA, 64 nt, Human
uuggguugcuggucccccuucccuaguggguuuucccggggacucuauaggcagcugcuccugc

SEQ ID NO: 178596 - RNA, 64 nt, Human
aucccugcuggaugcaggacccguccaaagaugccccggggaggggugucagcccacguugcug

SEQ ID NO: 178597 - RNA, 64 nt, Human
ggguccgggcacggccauacgcaggaccccugugcccggggaggcgcugcagggauuccccauc

SEQ ID NO: 178598 - RNA, 64 nt, Human
ucccugccaggcccuuugcacugaggacacagaucccggggagcugugagggccaccggugggc

SEQ ID NO: 178599 - RNA, 64 nt, Human
gcauggugucgggggguggcacugagcuaugagucccggggauggugaggaacgccacagacag

SEQ ID NO: 178600 - RNA, 64 nt, Human
ggagguggugcagucagccucgcucucaacgugacccggggaaugaccacccagagggaugagc

SEQ ID NO: 178601 - RNA, 64 nt, Human
ucaagagucguuucuauucuaguuucugccccaucccggggaauccuaaaggagaauuaauuca

SEQ ID NO: 178602 - RNA, 64 nt, Human
cugcagagugcccugagcuacguggagcugcugccccggggaggccuggccaaguaguacagcu

SEQ ID NO: 178603 - RNA, 64 nt, Human
aggcccuuguucgccuccccacccuccucagaggcccggggaagggaagagcaggucaguacag

SEQ ID NO: 178604 - RNA, 64 nt, Human
cuucgaccacagcaagccaucauccuccauugcucccggggacucaagaggaaucuguuucucu

SEQ ID NO: 178605 - RNA, 64 nt, Human
cugccaguggggucgugaggcaagauccccgccacccggggacaucuucaaucuaggcgaggcg

SEQ ID NO: 178606 - RNA, 64 nt, Human
cgggcguaguggcacaugccuguaaucccagcuacccggggaggcugaggcaggagaauugcuu

SEQ ID NO: 178607 - RNA, 64 nt, Human
cucccucugcugacccccugcagccuggagccagcccggggacuguccuggguggagggcaggu

SEQ ID NO: 178608 - RNA, 64 nt, Human
acgcaggggcugcccugacuuugcucugccgccccccggggacccggggccuggggucucugug

SEQ ID NO: 178609 - RNA, 64 nt, Human
agaagcccccgaguccuuuccggcggcugccagucccggggauucagccacuggccaccggcgg

SEQ ID NO: 178610 - RNA, 64 nt, Human
ugcuucucccggggacgcuuuugagugggcccugcccggggagcugcagagcagcagcaccuuu

SEQ ID NO: 178611 - RNA, 64 nt, Human
cucuguccucccauccccucaacacccugcuucucccggggacgcuuuugagugggcccugccc

SEQ ID NO: 178612 - RNA, 64 nt, Human
cuuuguccagcuguccacauugagucagacugcucccggggagagagccccggcccccagcaca

SEQ ID NO: 178613 - RNA, 64 nt, Human
accgucugcccccugcuccccucaucaggaccaacccggggacuggugccucugccugaucagc

SEQ ID NO: 178614 - RNA, 64 nt, Human
uuccuucaggcucugcccaccaaggugcccucuccccggggaccuuagggugagcuugcuuuug

SEQ ID NO: 178615 - RNA, 64 nt, Human
ucuguggcguggccaggccggggccuggcucuuacccggggaguggugggcaucucgaugcuuc

SEQ ID NO: 178616 - RNA, 64 nt, Human
accaguggacaauggagucugggggagggggaaccccggggacaugcccccacccgggaggggc

SEQ ID NO: 178617 - RNA, 64 nt, Human
gggugcggguggaguacugggaggcaggagguggcccggggaggccuuguggcuccuccccucg

SEQ ID NO: 178618 - RNA, 64 nt, Human
caacgcuagagcagcccuucucagcuccacccugcccggggagggaggaggagcucugguuuca

SEQ ID NO: 178619 - RNA, 64 nt, Human
acgucgucagccacucagcccuucucuccuccagcccggggacccccgcgggccccagaagcag

SEQ ID NO: 178620 - RNA, 64 nt, Human
cgggcugcugagaggcccggagagggacucuguccccggggagccaucgccuucagugugcagg

SEQ ID NO: 178621 - RNA, 64 nt, Human
gacucuccccaggcccccggugggcauggagcagcccggggagggguccgugcugguucugaau

SEQ ID NO: 178622 - RNA, 64 nt, Human
cugccgcucagccgucccgacggcgccuccccagcccggggacggccgugcuccgucccucgcc

SEQ ID NO: 178623 - RNA, 64 nt, Human
aguggcgugaucucggcucacugcaaccuccacccccggggaucaagcaacucuccugccucag

SEQ ID NO: 178624 - RNA, 64 nt, Human
uggacuucucccgucucuagggcugcauggggagcccggggagcugaguaguggggauccagag

SEQ ID NO: 178625 - RNA, 64 nt, Human
gcagucaucaucauccauggaguggcugcuggugcccggggaggagcagcuauccuugccccca

SEQ ID NO: 178626 - RNA, 64 nt, Human
cccacugcagccucugccugcucugccgccgaggcccggggaugggaugcgguggguugcccaa

SEQ ID NO: 178627 - RNA, 64 nt, Human
cccagucaggcggcugguagggagcuuugccugccccggggauacccucugccagccgcuggaa

SEQ ID NO: 178628 - RNA, 64 nt, Human
cccugucccuccgaaggacacccagcaggcaccccccggggaggcaggggcagaggucagaagg

SEQ ID NO: 178629 - RNA, 64 nt, Human
aauuguaggcggcccuuccugcagcgccugccgccccggggacucgcagcacccacagcaccac

SEQ ID NO: 178630 - RNA, 64 nt, Human
cucaccgccucccgggccugcugucagcuugcagcccggggacagaggccagcugggaucugcc

SEQ ID NO: 178631 - RNA, 64 nt, Human
ggggugggagggucugcagggaauugggggggugcccggggaucccccgccccauccuccugcc

SEQ ID NO: 178632 - RNA, 64 nt, Human
aaccuccccgcugcuaaucuccccugggccccuccccggggaauccucucugccaauccugcga

SEQ ID NO: 178633 - RNA, 64 nt, Human
gacccuuuuugcugcuagaaagccccucccuucucccggggagcuggggcuggcuuguccccau

SEQ ID NO: 178634 - RNA, 64 nt, Human
cgagugugcccaggaacucagagagggcgcggcccccggggauuccccccccccgagggugccc

SEQ ID NO: 178635 - RNA, 64 nt, Human
cuucggcauuugaucagaccaaacagugcuguuucccggggaggaaacacuuuuuuaauuaccc

SEQ ID NO: 178636 - RNA, 64 nt, Human
guggaccuggccuugccgggugcagagguggaggcccggggagaggcaccugagguggcccuga

SEQ ID NO: 178637 - RNA, 64 nt, Human
gcugcucgggcccacagcgccgucccaucacaagcccggggagggaucccgccuuugaaaauaa

SEQ ID NO: 178638 - RNA, 64 nt, Human
gcgggaaucuggugcugggggcagccggugcagccccggggagcccuggccuggugaccucgcc

SEQ ID NO: 178639 - RNA, 64 nt, Human
cugggggggccuuccccaucucuccuccaggccccccggggagggggaaaggaguuuggggagg

SEQ ID NO: 178640 - RNA, 64 nt, Human
acauggguuaguuaaggcggagguacgaggccgacccggggagggggacgggguggggaaacgg

SEQ ID NO: 178641 - RNA, 64 nt, Human
cuccaggguucaagcgauucuccugccucagccucccggggaucucaagggcauuucccuuugc

SEQ ID NO: 178642 - RNA, 64 nt, Human
ccucgcugcuuagcagcggccucuagcuccgucucccggggaccugggccugagggagggcugg

SEQ ID NO: 178643 - RNA, 64 nt, Human
ugaugagccucuccccagguguauuucagcagaccccggggacccacccccacugggccugcug

SEQ ID NO: 178644 - RNA, 64 nt, Human
agccugucugucacacgacggaauggauacugggcccggggaccacuuucauacucacguccuc

SEQ ID NO: 178645 - RNA, 64 nt, Human
aucaccacucgggugucccgggaggugcccugggcccggggaccucacaggcaggacggcgaca

SEQ ID NO: 178646 - RNA, 64 nt, Human
aguuuuaagcuugagagagcugaccacagggccccccggggaacagggauggcacuucccugag

SEQ ID NO: 178647 - RNA, 64 nt, Human
cgguccugcugcuaaccuggcaccagagccucugcccggggagccucaggcaguccucuccugc

SEQ ID NO: 178648 - RNA, 64 nt, Human
ggcugggcaggggcgguggaggacucaggaacugcccggggagaguggguauggcggcugagcc

SEQ ID NO: 178649 - RNA, 64 nt, Human
cucccucuuaccccagaaaggucagguaugaccucccggggaggaaucccaccugccuguauac

SEQ ID NO: 178650 - RNA, 64 nt, Human
cuugguccaguucugcaccgggguggggcugggacccggggaagguuugagggcccuugcaacc

SEQ ID NO: 178651 - RNA, 64 nt, Human
ugaggacugacucccauuuccuaaaggaaaugcccccggggaggacauugggaggaagauggcc

SEQ ID NO: 178652 - RNA, 64 nt, Human
ccguggcgucggcgucccggaugugucggucgugcccggggaggccggguuccccucgcugcgg

SEQ ID NO: 178653 - RNA, 64 nt, Human
uuccucucccaugugggaacccagccuccgaugccccggggacuaggggaaacaguuggagguu

SEQ ID NO: 178654 - RNA, 64 nt, Human
aguagacauagugugugggguuggagcucuggcacccggggagguagcauuucccugcagaugg

SEQ ID NO: 178655 - RNA, 64 nt, Human
aaagcacaagauguugaggcgagcagggcaggcccccggggaggggccagaguuuucuaugaau

SEQ ID NO: 178656 - RNA, 64 nt, Human
ugcacugcugugaagcaggaaggccagggagguccccggggaccuggcauucuggggagacccu

SEQ ID NO: 178657 - RNA, 64 nt, Human
ucccugagggccuucgacaaaaguguguauuugucccggggaggguagcagugggccauggggc

SEQ ID NO: 178658 - RNA, 64 nt, Human
caaagcccucauuuuacagaugaggaagcugaagcccggggaggggagcgacccucaaggccac

SEQ ID NO: 178659 - RNA, 64 nt, Human
gggaagggggcauugaggcaagccuggagaggagcccggggagcagggucaugaacuuuuuucu

SEQ ID NO: 178660 - RNA, 64 nt, Human
caaccugcuccugauggggcacugggccgcccuucccggggaggcaagauugagggcccgggag

SEQ ID NO: 178661 - RNA, 64 nt, Human
cugauuuuuaguuauagcucuuuaauucuuuuuccccggggaggggggagguuuuauuuccaag

SEQ ID NO: 178662 - RNA, 64 nt, Human
uggaggaggaacaggagggcccugggaccaggcucccggggaaccugagcucagaggaugugcu

SEQ ID NO: 178663 - RNA, 64 nt, Human; identical to SEQ ID NO: 70019

SEQ ID NO: 178664 - RNA, 64 nt, Human; identical to SEQ ID NO: 70020

SEQ ID NO: 178665 - RNA, 64 nt, Human; identical to SEQ ID NO: 70021

SEQ ID NO: 178666 - RNA, 64 nt, Human; identical to SEQ ID NO: 70022

SEQ ID NO: 178667 - RNA, 64 nt, Human; identical to SEQ ID NO: 70023

SEQ ID NO: 178668 - RNA, 64 nt, Human; identical to SEQ ID NO: 70024

SEQ ID NO: 178669 - RNA, 64 nt, Human; identical to SEQ ID NO: 70025

SEQ ID NO: 178670 - RNA, 64 nt, Human; identical to SEQ ID NO: 70026

SEQ ID NO: 178671 - RNA, 64 nt, Human; identical to SEQ ID NO: 70027

SEQ ID NO: 178672 - RNA, 64 nt, Human; identical to SEQ ID NO: 70028

SEQ ID NO: 178673 - RNA, 64 nt, Human; identical to SEQ ID NO: 70029

SEQ ID NO: 178674 - RNA, 64 nt, Human; identical to SEQ ID NO: 70030

SEQ ID NO: 178675 - RNA, 64 nt, Human; identical to SEQ ID NO: 70031

SEQ ID NO: 178676 - RNA, 64 nt, Human; identical to SEQ ID NO: 70032

SEQ ID NO: 178677 - RNA, 64 nt, Human; identical to SEQ ID NO: 70033

SEQ ID NO: 178678 - RNA, 64 nt, Human; identical to SEQ ID NO: 70034

SEQ ID NO: 178679 - RNA, 64 nt, Human; identical to SEQ ID NO: 70035

SEQ ID NO: 178680 - RNA, 64 nt, Human; identical to SEQ ID NO: 70036

SEQ ID NO: 178681 - RNA, 64 nt, Human
ccuaaaucuauagaaauacaaaaugaaauaaaaaggaugcaaaucagucacagagcuggaaaca

SEQ ID NO: 178682 - RNA, 64 nt, Human; identical to SEQ ID NO: 70037

SEQ ID NO: 178683 - RNA, 64 nt, Human; identical to SEQ ID NO: 70038

SEQ ID NO: 178684 - RNA, 64 nt, Human; identical to SEQ ID NO: 70039

SEQ ID NO: 178685 - RNA, 64 nt, Human; identical to SEQ ID NO: 70040

SEQ ID NO: 178686 - RNA, 64 nt, Human; identical to SEQ ID NO: 70041

SEQ ID NO: 178687 - RNA, 64 nt, Human; identical to SEQ ID NO: 70042

SEQ ID NO: 178688 - RNA, 64 nt, Human; identical to SEQ ID NO: 70043

SEQ ID NO: 178689 - RNA, 64 nt, Human; identical to SEQ ID NO: 70044

SEQ ID NO: 178690 - RNA, 64 nt, Human; identical to SEQ ID NO: 70045

SEQ ID NO: 178691 - RNA, 64 nt, Human; identical to SEQ ID NO: 70046

SEQ ID NO: 178692 - RNA, 64 nt, Human; identical to SEQ ID NO: 70047

SEQ ID NO: 178693 - RNA, 64 nt, Human; identical to SEQ ID NO: 70048

SEQ ID NO: 178694 - RNA, 64 nt, Human; identical to SEQ ID NO: 70049

SEQ ID NO: 178695 - RNA, 64 nt, Human; identical to SEQ ID NO: 70050

SEQ ID NO: 178696 - RNA, 64 nt, Human; identical to SEQ ID NO: 70051

SEQ ID NO: 178697 - RNA, 64 nt, Human; identical to SEQ ID NO: 70052

SEQ ID NO: 178698 - RNA, 64 nt, Human; identical to SEQ ID NO: 70053

SEQ ID NO: 178699 - RNA, 64 nt, Human; identical to SEQ ID NO: 70054

SEQ ID NO: 178700 - RNA, 64 nt, Human; identical to SEQ ID NO: 70055

SEQ ID NO: 178701 - RNA, 64 nt, Human; identical to SEQ ID NO: 70056

SEQ ID NO: 178702 - RNA, 64 nt, Human; identical to SEQ ID NO: 70057

SEQ ID NO: 178703 - RNA, 64 nt, Human; identical to SEQ ID NO: 70058

SEQ ID NO: 178704 - RNA, 64 nt, Human; identical to SEQ ID NO: 70059

SEQ ID NO: 178705 - RNA, 64 nt, Human; identical to SEQ ID NO: 70060

SEQ ID NO: 178706 - RNA, 64 nt, Human; identical to SEQ ID NO: 70061

SEQ ID NO: 178707 - RNA, 64 nt, Human; identical to SEQ ID NO: 70062

SEQ ID NO: 178708 - RNA, 64 nt, Human; identical to SEQ ID NO: 70063

SEQ ID NO: 178709 - RNA, 64 nt, Human; identical to SEQ ID NO: 70064

SEQ ID NO: 178710 - RNA, 64 nt, Human; identical to SEQ ID NO: 70065

SEQ ID NO: 178711 - RNA, 64 nt, Human; identical to SEQ ID NO: 70066

SEQ ID NO: 178712 - RNA, 64 nt, Human; identical to SEQ ID NO: 70067

SEQ ID NO: 178713 - RNA, 64 nt, Human; identical to SEQ ID NO: 70068

SEQ ID NO: 178714 - RNA, 64 nt, Human; identical to SEQ ID NO: 70069

SEQ ID NO: 178715 - RNA, 64 nt, Human; identical to SEQ ID NO: 84722

SEQ ID NO: 178716 - RNA, 64 nt, Human; identical to SEQ ID NO: 70070

SEQ ID NO: 178717 - RNA, 64 nt, Human; identical to SEQ ID NO: 70071

SEQ ID NO: 178718 - RNA, 64 nt, Human; identical to SEQ ID NO: 70072

SEQ ID NO: 178719 - RNA, 64 nt, Human; identical to SEQ ID NO: 70073

SEQ ID NO: 178720 - RNA, 64 nt, Human; identical to SEQ ID NO: 70074

SEQ ID NO: 178721 - RNA, 64 nt, Human; identical to SEQ ID NO: 70075

SEQ ID NO: 178722 - RNA, 64 nt, Human; identical to SEQ ID NO: 70076

SEQ ID NO: 178723 - RNA, 64 nt, Human; identical to SEQ ID NO: 70077

SEQ ID NO: 178724 - RNA, 58 nt, Human; identical to SEQ ID NO: 70078

SEQ ID NO: 178725 - RNA, 64 nt, Human; identical to SEQ ID NO: 70079

SEQ ID NO: 178726 - RNA, 64 nt, Human; identical to SEQ ID NO: 70080

SEQ ID NO: 178727 - RNA, 64 nt, Human; identical to SEQ ID NO: 70081

SEQ ID NO: 178728 - RNA, 64 nt, Human; identical to SEQ ID NO: 70082

SEQ ID NO: 178729 - RNA, 64 nt, Human; identical to SEQ ID NO: 70083

SEQ ID NO: 178730 - RNA, 64 nt, Human; identical to SEQ ID NO: 70084

SEQ ID NO: 178731 - RNA, 64 nt, Human; identical to SEQ ID NO: 70085

SEQ ID NO: 178732 - RNA, 64 nt, Human; identical to SEQ ID NO: 70086

SEQ ID NO: 178733 - RNA, 64 nt, Human; identical to SEQ ID NO: 70087

SEQ ID NO: 178734 - RNA, 64 nt, Human; identical to SEQ ID NO: 70088

SEQ ID NO: 178735 - RNA, 64 nt, Human; identical to SEQ ID NO: 70089

SEQ ID NO: 178736 - RNA, 64 nt, Human; identical to SEQ ID NO: 70090

SEQ ID NO: 178737 - RNA, 64 nt, Human; identical to SEQ ID NO: 70091

SEQ ID NO: 178738 - RNA, 64 nt, Human; identical to SEQ ID NO: 70092

SEQ ID NO: 178739 - RNA, 64 nt, Human; identical to SEQ ID NO: 70093

SEQ ID NO: 178740 - RNA, 64 nt, Human; identical to SEQ ID NO: 70094

SEQ ID NO: 178741 - RNA, 64 nt, Human; identical to SEQ ID NO: 70095

SEQ ID NO: 178742 - RNA, 64 nt, Human; identical to SEQ ID NO: 70096

SEQ ID NO: 178743 - RNA, 64 nt, Human; identical to SEQ ID NO: 70097

SEQ ID NO: 178744 - RNA, 64 nt, Human; identical to SEQ ID NO: 70098

SEQ ID NO: 178745 - RNA, 60 nt, Human; identical to SEQ ID NO: 70099

SEQ ID NO: 178746 - RNA, 64 nt, Human; identical to SEQ ID NO: 70100

SEQ ID NO: 178747 - RNA, 64 nt, Human; identical to SEQ ID NO: 70101

SEQ ID NO: 178748 - RNA, 64 nt, Human; identical to SEQ ID NO: 70102

SEQ ID NO: 178749 - RNA, 64 nt, Human; identical to SEQ ID NO: 70103

SEQ ID NO: 178750 - RNA, 64 nt, Human; identical to SEQ ID NO: 70104

SEQ ID NO: 178751 - RNA, 64 nt, Human; identical to SEQ ID NO: 70105

SEQ ID NO: 178752 - RNA, 64 nt, Human; identical to SEQ ID NO: 70106

SEQ ID NO: 178753 - RNA, 64 nt, Human; identical to SEQ ID NO: 70107

SEQ ID NO: 178754 - RNA, 64 nt, Human; identical to SEQ ID NO: 70108

SEQ ID NO: 178755 - RNA, 64 nt, Human; identical to SEQ ID NO: 70109

SEQ ID NO: 178756 - RNA, 64 nt, Human; identical to SEQ ID NO: 70110

SEQ ID NO: 178757 - RNA, 64 nt, Human; identical to SEQ ID NO: 70111

SEQ ID NO: 178758 - RNA, 64 nt, Human; identical to SEQ ID NO: 70112

SEQ ID NO: 178759 - RNA, 64 nt, Human; identical to SEQ ID NO: 70113

SEQ ID NO: 178760 - RNA, 64 nt, Human; identical to SEQ ID NO: 70114

SEQ ID NO: 178761 - RNA, 64 nt, Human; identical to SEQ ID NO: 70115

SEQ ID NO: 178762 - RNA, 64 nt, Human; identical to SEQ ID NO: 70116

SEQ ID NO: 178763 - RNA, 64 nt, Human; identical to SEQ ID NO: 70117

SEQ ID NO: 178764 - RNA, 64 nt, Human; identical to SEQ ID NO: 70118

SEQ ID NO: 178765 - RNA, 64 nt, Human; identical to SEQ ID NO: 70119

SEQ ID NO: 178766 - RNA, 64 nt, Human
gaagucugguuuaaggcacagguaaacugaguguggaugcaaaaguaccaggagcuagcuuuua

SEQ ID NO: 178767 - RNA, 64 nt, Human; identical to SEQ ID NO: 70120

SEQ ID NO: 178768 - RNA, 64 nt, Human; identical to SEQ ID NO: 70121

SEQ ID NO: 178769 - RNA, 64 nt, Human; identical to SEQ ID NO: 70122

SEQ ID NO: 178770 - RNA, 64 nt, Human; identical to SEQ ID NO: 70123

SEQ ID NO: 178771 - RNA, 64 nt, Human; identical to SEQ ID NO: 70124

SEQ ID NO: 178772 - RNA, 64 nt, Human; identical to SEQ ID NO: 70125

SEQ ID NO: 178773 - RNA, 64 nt, Human; identical to SEQ ID NO: 70126

SEQ ID NO: 178774 - RNA, 64 nt, Human; identical to SEQ ID NO: 70127

SEQ ID NO: 178775 - RNA, 64 nt, Human; identical to SEQ ID NO: 70128

SEQ ID NO: 178776 - RNA, 64 nt, Human; identical to SEQ ID NO: 70129

SEQ ID NO: 178777 - RNA, 64 nt, Human; identical to SEQ ID NO: 70130

SEQ ID NO: 178778 - RNA, 64 nt, Human; identical to SEQ ID NO: 70131

SEQ ID NO: 178779 - RNA, 64 nt, Human; identical to SEQ ID NO: 70132

SEQ ID NO: 178780 - RNA, 64 nt, Human; identical to SEQ ID NO: 70133

SEQ ID NO: 178781 - RNA, 64 nt, Human; identical to SEQ ID NO: 70134

SEQ ID NO: 178782 - RNA, 64 nt, Human; identical to SEQ ID NO: 70135

SEQ ID NO: 178783 - RNA, 64 nt, Human; identical to SEQ ID NO: 70136

SEQ ID NO: 178784 - RNA, 64 nt, Human; identical to SEQ ID NO: 70137

SEQ ID NO: 178785 - RNA, 64 nt, Human; identical to SEQ ID NO: 70138

SEQ ID NO: 178786 - RNA, 64 nt, Human; identical to SEQ ID NO: 70139

SEQ ID NO: 178787 - RNA, 64 nt, Human; identical to SEQ ID NO: 70140

SEQ ID NO: 178788 - RNA, 56 nt, Human; identical to SEQ ID NO: 70141

SEQ ID NO: 178789 - RNA, 64 nt, Human; identical to SEQ ID NO: 70142

SEQ ID NO: 178790 - RNA, 64 nt, Human; identical to SEQ ID NO: 70143

SEQ ID NO: 178791 - RNA, 64 nt, Human; identical to SEQ ID NO: 70144

SEQ ID NO: 178792 - RNA, 64 nt, Human; identical to SEQ ID NO: 70145

SEQ ID NO: 178793 - RNA, 64 nt, Human; identical to SEQ ID NO: 70146

SEQ ID NO: 178794 - RNA, 64 nt, Human; identical to SEQ ID NO: 70147

SEQ ID NO: 178795 - RNA, 64 nt, Human; identical to SEQ ID NO: 70148

SEQ ID NO: 178796 - RNA, 64 nt, Human; identical to SEQ ID NO: 70149

SEQ ID NO: 178797 - RNA, 64 nt, Human; identical to SEQ ID NO: 70150

SEQ ID NO: 178798 - RNA, 64 nt, Human; identical to SEQ ID NO: 70151

SEQ ID NO: 178799 - RNA, 64 nt, Human; identical to SEQ ID NO: 70152

SEQ ID NO: 178800 - RNA, 64 nt, Human; identical to SEQ ID NO: 70153

SEQ ID NO: 178801 - RNA, 64 nt, Human; identical to SEQ ID NO: 70154

SEQ ID NO: 178802 - RNA, 63 nt, Human; identical to SEQ ID NO: 70155

SEQ ID NO: 178803 - RNA, 64 nt, Human; identical to SEQ ID NO: 70156

SEQ ID NO: 178804 - RNA, 64 nt, Human; identical to SEQ ID NO: 70157

SEQ ID NO: 178805 - RNA, 64 nt, Human; identical to SEQ ID NO: 70158

SEQ ID NO: 178806 - RNA, 64 nt, Human; identical to SEQ ID NO: 70159

SEQ ID NO: 178807 - RNA, 64 nt, Human; identical to SEQ ID NO: 70160

SEQ ID NO: 178808 - RNA, 64 nt, Human; identical to SEQ ID NO: 70161

SEQ ID NO: 178809 - RNA, 64 nt, Human; identical to SEQ ID NO: 70162

SEQ ID NO: 178810 - RNA, 64 nt, Human; identical to SEQ ID NO: 70163

SEQ ID NO: 178811 - RNA, 64 nt, Human; identical to SEQ ID NO: 70164

SEQ ID NO: 178812 - RNA, 64 nt, Human; identical to SEQ ID NO: 70165

SEQ ID NO: 178813 - RNA, 64 nt, Human; identical to SEQ ID NO: 70166

SEQ ID NO: 178814 - RNA, 64 nt, Human; identical to SEQ ID NO: 70167

SEQ ID NO: 178815 - RNA, 64 nt, Human; identical to SEQ ID NO: 70168

SEQ ID NO: 178816 - RNA, 64 nt, Human; identical to SEQ ID NO: 70169

SEQ ID NO: 178817 - RNA, 64 nt, Human; identical to SEQ ID NO: 84546

SEQ ID NO: 178818 - RNA, 64 nt, Human; identical to SEQ ID NO: 70170

SEQ ID NO: 178819 - RNA, 64 nt, Human; identical to SEQ ID NO: 70171

SEQ ID NO: 178820 - RNA, 64 nt, Human; identical to SEQ ID NO: 70172

SEQ ID NO: 178821 - RNA, 64 nt, Human; identical to SEQ ID NO: 70173

SEQ ID NO: 178822 - RNA, 64 nt, Human; identical to SEQ ID NO: 70174

SEQ ID NO: 178823 - RNA, 64 nt, Human; identical to SEQ ID NO: 70175

SEQ ID NO: 178824 - RNA, 64 nt, Human; identical to SEQ ID NO: 70176

SEQ ID NO: 178825 - RNA, 64 nt, Human; identical to SEQ ID NO: 70177

SEQ ID NO: 178826 - RNA, 64 nt, Human; identical to SEQ ID NO: 70178

SEQ ID NO: 178827 - RNA, 64 nt, Human; identical to SEQ ID NO: 70179

SEQ ID NO: 178828 - RNA, 64 nt, Human; identical to SEQ ID NO: 70180

SEQ ID NO: 178829 - RNA, 64 nt, Human; identical to SEQ ID NO: 70181

SEQ ID NO: 178830 - RNA, 64 nt, Human; identical to SEQ ID NO: 70182

SEQ ID NO: 178831 - RNA, 64 nt, Human; identical to SEQ ID NO: 70183

SEQ ID NO: 178832 - RNA, 64 nt, Human; identical to SEQ ID NO: 70184

SEQ ID NO: 178833 - RNA, 64 nt, Human
guuuuucaugaucaucauuaacaguuuguccuuaggaugcaaaugaaaaugugaauacauaccu

SEQ ID NO: 178834 - RNA, 64 nt, Human; identical to SEQ ID NO: 70185

SEQ ID NO: 178835 - RNA, 64 nt, Human; identical to SEQ ID NO: 70186

SEQ ID NO: 178836 - RNA, 64 nt, Human; identical to SEQ ID NO: 70187

SEQ ID NO: 178837 - RNA, 64 nt, Human; identical to SEQ ID NO: 70188

SEQ ID NO: 178838 - RNA, 64 nt, Human; identical to SEQ ID NO: 70189

SEQ ID NO: 178839 - RNA, 64 nt, Human; identical to SEQ ID NO: 70190

SEQ ID NO: 178840 - RNA, 64 nt, Human; identical to SEQ ID NO: 70191

SEQ ID NO: 178841 - RNA, 64 nt, Human; identical to SEQ ID NO: 70192

SEQ ID NO: 178842 - RNA, 64 nt, Human; identical to SEQ ID NO: 70193

SEQ ID NO: 178843 - RNA, 64 nt, Human; identical to SEQ ID NO: 70194

SEQ ID NO: 178844 - RNA, 64 nt, Human; identical to SEQ ID NO: 70195

SEQ ID NO: 178845 - RNA, 64 nt, Human; identical to SEQ ID NO: 70196

SEQ ID NO: 178846 - RNA, 64 nt, Human; identical to SEQ ID NO: 70197

SEQ ID NO: 178847 - RNA, 64 nt, Human; identical to SEQ ID NO: 70198

SEQ ID NO: 178848 - RNA, 64 nt, Human; identical to SEQ ID NO: 70199

SEQ ID NO: 178849 - RNA, 64 nt, Human; identical to SEQ ID NO: 70200

SEQ ID NO: 178850 - RNA, 64 nt, Human
caaguccugauggagcaagaggcccacgccuaggggaugcaagaacaacccguuucuuaaaugu

SEQ ID NO: 178851 - RNA, 64 nt, Human; identical to SEQ ID NO: 70201

SEQ ID NO: 178852 - RNA, 64 nt, Human; identical to SEQ ID NO: 70202

SEQ ID NO: 178853 - RNA, 64 nt, Human; identical to SEQ ID NO: 70203

SEQ ID NO: 178854 - RNA, 56 nt, Human; identical to SEQ ID NO: 70204

SEQ ID NO: 178855 - RNA, 64 nt, Human; identical to SEQ ID NO: 70205

SEQ ID NO: 178856 - RNA, 64 nt, Human; identical to SEQ ID NO: 70206

SEQ ID NO: 178857 - RNA, 58 nt, Human; identical to SEQ ID NO: 70207

SEQ ID NO: 178858 - RNA, 64 nt, Human; identical to SEQ ID NO: 70208

SEQ ID NO: 178859 - RNA, 64 nt, Human; identical to SEQ ID NO: 70209

SEQ ID NO: 178860 - RNA, 64 nt, Human; identical to SEQ ID NO: 70210

SEQ ID NO: 178861 - RNA, 64 nt, Human; identical to SEQ ID NO: 70211

SEQ ID NO: 178862 - RNA, 64 nt, Human; identical to SEQ ID NO: 70212

SEQ ID NO: 178863 - RNA, 64 nt, Human; identical to SEQ ID NO: 70213

SEQ ID NO: 178864 - RNA, 64 nt, Human; identical to SEQ ID NO: 70214

SEQ ID NO: 178865 - RNA, 64 nt, Human; identical to SEQ ID NO: 70215

SEQ ID NO: 178866 - RNA, 64 nt, Human; identical to SEQ ID NO: 70216

SEQ ID NO: 178867 - RNA, 64 nt, Human; identical to SEQ ID NO: 70217

SEQ ID NO: 178868 - RNA, 64 nt, Human; identical to SEQ ID NO: 70218

SEQ ID NO: 178869 - RNA, 64 nt, Human; identical to SEQ ID NO: 70219

SEQ ID NO: 178870 - RNA, 64 nt, Human; identical to SEQ ID NO: 70220

SEQ ID NO: 178871 - RNA, 64 nt, Human; identical to SEQ ID NO: 70221

SEQ ID NO: 178872 - RNA, 64 nt, Human; identical to SEQ ID NO: 70222

SEQ ID NO: 178873 - RNA, 64 nt, Human; identical to SEQ ID NO: 70223

SEQ ID NO: 178874 - RNA, 64 nt, Human; identical to SEQ ID NO: 70224

SEQ ID NO: 178875 - RNA, 64 nt, Human; identical to SEQ ID NO: 70225

SEQ ID NO: 178876 - RNA, 64 nt, Human; identical to SEQ ID NO: 70226

SEQ ID NO: 178877 - RNA, 64 nt, Human; identical to SEQ ID NO: 70227

SEQ ID NO: 178878 - RNA, 64 nt, Human; identical to SEQ ID NO: 70228

SEQ ID NO: 178879 - RNA, 64 nt, Human; identical to SEQ ID NO: 70229

SEQ ID NO: 178880 - RNA, 64 nt, Human; identical to SEQ ID NO: 70230

SEQ ID NO: 178881 - RNA, 64 nt, Human; identical to SEQ ID NO: 70231

SEQ ID NO: 178882 - RNA, 64 nt, Human; identical to SEQ ID NO: 70232

SEQ ID NO: 178883 - RNA, 52 nt, Human; identical to SEQ ID NO: 70233

SEQ ID NO: 178884 - RNA, 64 nt, Human; identical to SEQ ID NO: 70234

SEQ ID NO: 178885 - RNA, 64 nt, Human; identical to SEQ ID NO: 70235

SEQ ID NO: 178886 - RNA, 64 nt, Human; identical to SEQ ID NO: 70236

SEQ ID NO: 178887 - RNA, 64 nt, Human; identical to SEQ ID NO: 70237

SEQ ID NO: 178888 - RNA, 64 nt, Human; identical to SEQ ID NO: 70238

SEQ ID NO: 178889 - RNA, 64 nt, Human; identical to SEQ ID NO: 70239

SEQ ID NO: 178890 - RNA, 64 nt, Human; identical to SEQ ID NO: 70240

SEQ ID NO: 178891 - RNA, 64 nt, Human; identical to SEQ ID NO: 70241

SEQ ID NO: 178892 - RNA, 64 nt, Human; identical to SEQ ID NO: 70242

SEQ ID NO: 178893 - RNA, 64 nt, Human; identical to SEQ ID NO: 70243

SEQ ID NO: 178894 - RNA, 64 nt, Human; identical to SEQ ID NO: 70244

SEQ ID NO: 178895 - RNA, 64 nt, Human; identical to SEQ ID NO: 70245

SEQ ID NO: 178896 - RNA, 64 nt, Human; identical to SEQ ID NO: 70246

SEQ ID NO: 178897 - RNA, 64 nt, Human; identical to SEQ ID NO: 70247

SEQ ID NO: 178898 - RNA, 64 nt, Human; identical to SEQ ID NO: 70248

SEQ ID NO: 178899 - RNA, 64 nt, Human; identical to SEQ ID NO: 70249

SEQ ID NO: 178900 - RNA, 64 nt, Human; identical to SEQ ID NO: 70250

SEQ ID NO: 178901 - RNA, 64 nt, Human
auugggucaggaguugaauuuggggugggaggauggaugcaacugaagcagagugugggugccc

SEQ ID NO: 178902 - RNA, 64 nt, Human; identical to SEQ ID NO: 70251

SEQ ID NO: 178903 - RNA, 64 nt, Human; identical to SEQ ID NO: 70252

SEQ ID NO: 178904 - RNA, 64 nt, Human; identical to SEQ ID NO: 70253

SEQ ID NO: 178905 - RNA, 64 nt, Human; identical to SEQ ID NO: 70254

SEQ ID NO: 178906 - RNA, 64 nt, Human; identical to SEQ ID NO: 70255

SEQ ID NO: 178907 - RNA, 64 nt, Human; identical to SEQ ID NO: 70256

SEQ ID NO: 178908 - RNA, 64 nt, Human; identical to SEQ ID NO: 70257

SEQ ID NO: 178909 - RNA, 64 nt, Human; identical to SEQ ID NO: 70258

SEQ ID NO: 178910 - RNA, 64 nt, Human; identical to SEQ ID NO: 70259

SEQ ID NO: 178911 - RNA, 64 nt, Human; identical to SEQ ID NO: 70260

SEQ ID NO: 178912 - RNA, 64 nt, Human; identical to SEQ ID NO: 70261

SEQ ID NO: 178913 - RNA, 64 nt, Human; identical to SEQ ID NO: 70262

SEQ ID NO: 178914 - RNA, 64 nt, Human; identical to SEQ ID NO: 70263

SEQ ID NO: 178915 - RNA, 64 nt, Human; identical to SEQ ID NO: 70264

SEQ ID NO: 178916 - RNA, 64 nt, Human; identical to SEQ ID NO: 70265

SEQ ID NO: 178917 - RNA, 64 nt, Human; identical to SEQ ID NO: 70266

SEQ ID NO: 178918 - RNA, 61 nt, Human; identical to SEQ ID NO: 70267

SEQ ID NO: 178919 - RNA, 64 nt, Human; identical to SEQ ID NO: 70268

SEQ ID NO: 178920 - RNA, 64 nt, Human; identical to SEQ ID NO: 70269

SEQ ID NO: 178921 - RNA, 64 nt, Human; identical to SEQ ID NO: 70270

SEQ ID NO: 178922 - RNA, 64 nt, Human; identical to SEQ ID NO: 70271

SEQ ID NO: 178923 - RNA, 64 nt, Human; identical to SEQ ID NO: 70272

SEQ ID NO: 178924 - RNA, 64 nt, Human; identical to SEQ ID NO: 70273

SEQ ID NO: 178925 - RNA, 64 nt, Human; identical to SEQ ID NO: 70274

SEQ ID NO: 178926 - RNA, 64 nt, Human; identical to SEQ ID NO: 70275

SEQ ID NO: 178927 - RNA, 64 nt, Human; identical to SEQ ID NO: 70276

SEQ ID NO: 178928 - RNA, 64 nt, Human; identical to SEQ ID NO: 70277

SEQ ID NO: 178929 - RNA, 64 nt, Human; identical to SEQ ID NO: 70278

SEQ ID NO: 178930 - RNA, 64 nt, Human; identical to SEQ ID NO: 70279

SEQ ID NO: 178931 - RNA, 64 nt, Human; identical to SEQ ID NO: 70280

SEQ ID NO: 178932 - RNA, 64 nt, Human; identical to SEQ ID NO: 70281

SEQ ID NO: 178933 - RNA, 64 nt, Human; identical to SEQ ID NO: 70282

SEQ ID NO: 178934 - RNA, 64 nt, Human; identical to SEQ ID NO: 70283

SEQ ID NO: 178935 - RNA, 64 nt, Human; identical to SEQ ID NO: 70284

SEQ ID NO: 178936 - RNA, 64 nt, Human; identical to SEQ ID NO: 70285

SEQ ID NO: 178937 - RNA, 64 nt, Human; identical to SEQ ID NO: 70286

SEQ ID NO: 178938 - RNA, 64 nt, Human; identical to SEQ ID NO: 70287

SEQ ID NO: 178939 - RNA, 64 nt, Human; identical to SEQ ID NO: 70288

SEQ ID NO: 178940 - RNA, 64 nt, Human; identical to SEQ ID NO: 70289

SEQ ID NO: 178941 - RNA, 64 nt, Human; identical to SEQ ID NO: 70290

SEQ ID NO: 178942 - RNA, 64 nt, Human; identical to SEQ ID NO: 70291

SEQ ID NO: 178943 - RNA, 63 nt, Human
cuuuuccacccugggccccaaugccguccuuuccccgcagagacuggucuuggaaacccucag

SEQ ID NO: 178944 - RNA, 63 nt, Human
cccuuaccgguggcucuuccugccugggacccucccgcagagucccacuagccagcggccuca

SEQ ID NO: 178945 - RNA, 63 nt, Human
cagagcagccaggcuggggccccucugucucaacccgcagacccuugacugaaugagagaggc

SEQ ID NO: 178946 - RNA, 63 nt, Human
gcuggcauggucagguaacacuaguggcccagccccgcagacccacaagcccuacccgugcug

SEQ ID NO: 178947 - RNA, 63 nt, Human
gggacaugaggggcagcuagacuucacccccuucccgcagaccugccuccagagcaaggagaa

SEQ ID NO: 178948 - RNA, 63 nt, Human
gcaucaccugucaaaaauggaguuccacuucuccccgcagaccuaggucagacuuuuccuuuc

SEQ ID NO: 178949 - RNA, 63 nt, Human
gagaggcaguacgcauccuuacccaggggaggacccgcagauccuguagacuaucugccagca

SEQ ID NO: 178950 - RNA, 63 nt, Human
ggguguugggauacugcagggccaggacugagccccgcagaccuccccagccccuagcccagg

SEQ ID NO: 178951 - RNA, 63 nt, Human
gagaggcccgcccgcccaccgugggcagugccacccgcagaugacacgcgcucuccaccaccc

SEQ ID NO: 178952 - RNA, 63 nt, Human
uggucacagcggagguguggagccgaggccuaccccgcagacaccuuggacauccuccuccca

SEQ ID NO: 178953 - RNA, 63 nt, Human
cgguagggcguggaaaggggcaggccagagcuacccgcagaguucucagaaucaugcugagag

SEQ ID NO: 178954 - RNA, 63 nt, Human
uggggcccagacaccagccuagccuggcucugccccgcagacggucugugugcuguuugaaaa

SEQ ID NO: 178955 - RNA, 63 nt, Human
cagagcuggcugcuggacgcaccgugcucgcugcccgcagaagcggcacugugcuggcgggcu

SEQ ID NO: 178956 - RNA, 63 nt, Human
ugagacucuguuuaucacuagccuucugucccucccgcagaagacuguuggauugaacaaaau

SEQ ID NO: 178957 - RNA, 63 nt, Human
gagucccuggcaguagccuuggggcagagggcacccgcagagucccagagaugaugugggcag

SEQ ID NO: 178958 - RNA, 63 nt, Human
gacccguucagacacugcguugcgggcuccuuccccgcagaggccggggccucccugacuuug

SEQ ID NO: 178959 - RNA, 63 nt, Human
ugccaguagccuaggugucucaggccccugggccccgcagauggccauuuccggugccugccc

SEQ ID NO: 178960 - RNA, 63 nt, Human
cagugugaaguuucuggcauagaguccuggcuucccgcagacgacuuucacacucugccaugu

SEQ ID NO: 178961 - RNA, 63 nt, Human
agcgcugagcugagggacgaggaagagcuggagcccgcagaagccguccacagcccugccuca

SEQ ID NO: 178962 - RNA, 63 nt, Human
augcaccauguccugaaagauggcacccucccacccgcagagugcuuccugcaagcuggcguu

SEQ ID NO: 178963 - RNA, 63 nt, Human
uaaggagguagcucccagcacucaaccaaccuccccgcagagcucccuuccugacccuccgcu

SEQ ID NO: 178964 - RNA, 63 nt, Human
ccucggagcccggcccgcccuccggcuacaauccccgcagagucuccggugcagacgcgcugc

SEQ ID NO: 178965 - RNA, 63 nt, Human
acggaauaguguggggugugugcagggcugcaucccgcagauggcuggaauauuaaaauucuu

SEQ ID NO: 178966 - RNA, 63 nt, Human
auccuggccugagaauugaggggagguggccagcccgcagagguggggugcuggggcugcaug

SEQ ID NO: 178967 - RNA, 63 nt, Human
ccugggucgcagacgaggucggccucgucauuccccgcagaccgccgcgcgucccucuugugc

SEQ ID NO: 178968 - RNA, 63 nt, Human
uuuaucuuccgaggccaccguuuaacaggaguccccgcagauggguucugcccuguggaguau

SEQ ID NO: 178969 - RNA, 63 nt, Human
uuguuuagcuuaccuuucugcuaggauuggcuucccgcagagggcagggcccauccuaagcag

SEQ ID NO: 178970 - RNA, 63 nt, Human
ugcgcuuguuggcgcgacuguggcucgagcuggcccgcagacacguggguuucaucacucuga

SEQ ID NO: 178971 - RNA, 63 nt, Human
agcauugcucaggguggggggcugggaccauggcccgcagaggcacugccacagcugugaggg

SEQ ID NO: 178972 - RNA, 63 nt, Human
ccuggcaccaugcacggccagcaagaaucaaggcccgcagaugcuaagagggccuauugucag

SEQ ID NO: 178973 - RNA, 63 nt, Human
uuacaagccuuuuuaagauaugaaauaugccuacccgcagagcuuggcacaaaguggagucaa

SEQ ID NO: 178974 - RNA, 63 nt, Human
cggcguggaccgagggucccagccugcaggcuccccgcagagagcacaggaagaggcaggggc

SEQ ID NO: 178975 - RNA, 63 nt, Human
cccaggugccccccucaccuugaugggugcguucccgcagaccaaagagagugugacucccuu

SEQ ID NO: 178976 - RNA, 63 nt, Human
aggccccaggaguggcaccuuagugugggucggcccgcagauggcacccaaggccgggaaggg

SEQ ID NO: 178977 - RNA, 63 nt, Human
acccaggguggggaggccacccuuccugcccuacccgcagaauggugcucuccuuugcccucc

SEQ ID NO: 178978 - RNA, 63 nt, Human
ucagcagaaugacucuggaaccauccucuguuacccgcagauccugucccaugggcucuggcc

SEQ ID NO: 178979 - RNA, 63 nt, Human
agcagguggugguggaaauuccagcaggugggucccgcagaggcccugaggccucacuuuucg

SEQ ID NO: 178980 - RNA, 63 nt, Human
gagacuccccgcccgcccuccucugcccccucccccgcagacagacagacagacggacgggac

SEQ ID NO: 178981 - RNA, 63 nt, Human
gaagucacgccuuggcccugacauccccacaugcccgcagagauccucuuugagugucugucu

SEQ ID NO: 178982 - RNA, 63 nt, Human
ccugcccauauauuauaccaguugcuucugcagcccgcagaugccagcgaugccaggaaacaa

SEQ ID NO: 178983 - RNA, 63 nt, Human
cuucuggccccucugaggauucccuagggcugccccgcagaggggcuuccccaagcucuguuu

SEQ ID NO: 178984 - RNA, 63 nt, Human
gaucaugucccauccaguccagugaauccacgacccgcagaccuguccccccgcaacagcuua

SEQ ID NO: 178985 - RNA, 63 nt, Human
ggcaugccccccagcuacuguaugcccccgacccccgcagaggcagaaugaacccauagggag

SEQ ID NO: 178986 - RNA, 63 nt, Human
acgcacgaccccaagcccgcggaggcaccgaugcccgcagagcccgcaccccccggcccugcc

SEQ ID NO: 178987 - RNA, 63 nt, Human
cgacuuguggcucggacccagggaccuucagggcccgcagacccucccggcgccuugagaccc

SEQ ID NO: 178988 - RNA, 63 nt, Human
ccucauuucauccuugcaacagcucugcagggccccgcagaugaggaaauccguaggcaggag

SEQ ID NO: 178989 - RNA, 63 nt, Human
gaaaaacuucaagaagaaaagaaucgucacgaccccgcagacuguccuccggauaaacagcau

SEQ ID NO: 178990 - RNA, 63 nt, Human
agcaaagaggcucuuuagaggcagcgggggaggcccgcagagcgcgccccuagccgguuccug

SEQ ID NO: 178991 - RNA, 63 nt, Human
cugucuugcugccggccuugauaccaccccucacccgcagagucacugcauucccucccagcc

SEQ ID NO: 178992 - RNA, 63 nt, Human
cuuccaugcugagugaugcucagggaagugaugcccgcagaaggcgucugggccuaaggaucc

SEQ ID NO: 178993 - RNA, 61 nt, Human
gcucaggaccaaccgcauagcugccuaugcccccgcagaacuggcugcugcgugugaacug

SEQ ID NO: 178994 - RNA, 63 nt, Human
gaaggucaggaggcaaguggaggauggacugggcccgcagaugcccugaccucugcccccagg

SEQ ID NO: 178995 - RNA, 63 nt, Human
ggggcacacagacuguggcagagcugcgcccaucccgcagaggccccuguccaccuggagacc

SEQ ID NO: 178996 - RNA, 63 nt, Human
ugggccucggcccuucccgcaccgccgccagcgcccgcagacacccuggcaucucaagaggga

SEQ ID NO: 178997 - RNA, 63 nt, Human
cccuccuaccccugggcagguguccagcgcagccccgcagagcuccaggguggccaaguggau

SEQ ID NO: 178998 - RNA, 63 nt, Human
ggggugcagaucuccuggcguguccaccauggccccgcagaacgccagggaccgccugcugcc

SEQ ID NO: 178999 - RNA, 63 nt, Human
ucucugagccgcggacaugcccucgcauugcuucccgcagagugcagagacaggaagcuggag

SEQ ID NO: 179000 - RNA, 63 nt, Human
cugaggauggagccgcccccagccgacuccaagcccgcagagggcagacgccacccuggacug

SEQ ID NO: 179001 - RNA, 63 nt, Human
ggaggauuccagaacagcagcacugagcucccacccgcagagccucuggacggccuuggcaac

SEQ ID NO: 179002 - RNA, 63 nt, Human
caaggacgccuaccccgaaaccggccccgacgccccgcagaggcccgccugaagccagcccgg

SEQ ID NO: 179003 - RNA, 61 nt, Human
ucacccaguggcucugcugacacagucgguccccgcagaggucacuguggcaaagccucac

SEQ ID NO: 179004 - RNA, 63 nt, Human
caaaccacucaggacaguacccguggcacugggcccgcagaagcaagggaugacuugguucuu

SEQ ID NO: 179005 - RNA, 63 nt, Human
agaggcccccgagguguguguaggaggcggaggcccgcagagcacagagcaggagaagggcuu

SEQ ID NO: 179006 - RNA, 63 nt, Human
cgaguuggggggaggggguguggcaacgugccccccgcagaggccacgcauguuugaccaaag

SEQ ID NO: 179007 - RNA, 63 nt, Human
cugagucuuuuggaggcuccaagccucaaagugcccgcagagcccaccuugaggguuuugcua

SEQ ID NO: 179008 - RNA, 63 nt, Human
auaguguagauggacauuugccacaacacacugcccgcagaaauggacuuaccgugaagccaa

SEQ ID NO: 179009 - RNA, 63 nt, Human
gguggcgcuucucagccggcugucccagccagccccgcagagcgcccacggacaguguccacu

SEQ ID NO: 179010 - RNA, 63 nt, Human
uuuccaggagccccaggcccggaggaggcgaagcccgcagagcaaagguggaaacacgugccu

SEQ ID NO: 179011 - RNA, 63 nt, Human
agggccaaggacaauugggagggcagcaggcagcccgcagaugguggccauguggcacgcugc

SEQ ID NO: 179012 - RNA, 63 nt, Human
gccccuccuucugcugccuggccaagccccacacccgcagacccuccuucccauccucugaaa

SEQ ID NO: 179013 - RNA, 63 nt, Human
cgguacccggccgccguucugcaaugcaucacucccgcagaggggggugcagaucaggcgccg

SEQ ID NO: 179014 - RNA, 63 nt, Human
acugaacagaacgucgcugauggagaaagggcucccgcagaaggaacggccuguaccgugcgc

SEQ ID NO: 179015 - RNA, 63 nt, Human
guguaugcgagcgcccgccucccagccccggugcccgcagaagacgcuuuuccccagcagguc

SEQ ID NO: 179016 - RNA, 63 nt, Human
ggcccucgggaagccuuggacagaacccuccaccccgcagaccaggcgucguguguguguggg

SEQ ID NO: 179017 - RNA, 63 nt, Human
uacgggggcgcggcagggguccccggccccucccccgcagaggucaaugccaacgaacaaacg

SEQ ID NO: 179018 - RNA, 63 nt, Human
cgcccccuccgccgccccuuccccagcccugcccccgcagacucccccugccgccaagacuuc

SEQ ID NO: 179019 - RNA, 63 nt, Human
cgguuucggggcucccccuuccucucccucccucccgcagaaggggguuuuaggggccugggc

SEQ ID NO: 179020 - RNA, 63 nt, Human
ggcugggccccuccaggagucacagaugaggcccccgcagagacuggugaguggugacccugu

SEQ ID NO: 179021 - RNA, 63 nt, Human
gguccggaagggugaucaucgacccccaagggacccgcagacccuuaaaaaaaucacccacaa

SEQ ID NO: 179022 - RNA, 56 nt, Human
acucccuguccuuuucauagcuccugcccgcagaccucuggauuaggucucuguug

SEQ ID NO: 179023 - RNA, 63 nt, Human
uggaggucagaguggaagcaggugugagagggucccgcagaagaaaacauggcugccaaagug

SEQ ID NO: 179024 - RNA, 63 nt, Human
ccgggagcugauggccccucucucccggcuccgcccgcagacucuggcuccuccgacuacacc

SEQ ID NO: 179025 - RNA, 63 nt, Human
cccauccccccucagauccagacaugccccucccccgcagacacaccccaaggcagcccaacc

SEQ ID NO: 179026 - RNA, 63 nt, Human
cuccacuccaccuccacccacuguccgccucugcccgcagagcccacgcccgacuagcaggca

SEQ ID NO: 179027 - RNA, 63 nt, Human
gugugaggggcuuggccugcgccccgccagcugcccgcagaggugcagccucgaggaaucuga

SEQ ID NO: 179028 - RNA, 63 nt, Human
acuaggcguggaccugcccauggugccugucagcccgcagagcccaucuacgcccaacacaga

SEQ ID NO: 179029 - RNA, 63 nt, Human
ugggacaucugaggauugggauucuuuguucaccccgcagauaguuaaugaauggucugcccu

SEQ ID NO: 179030 - RNA, 63 nt, Human
gauuaacggugcuaaccccgucugcuccucccucccgcagagacuggggccuggacuggacau

SEQ ID NO: 179031 - RNA, 63 nt, Human
ccccguccucugcugcuggccucugggucgugccccgcagacugagcugcgcuuggggguccu

SEQ ID NO: 179032 - RNA, 60 nt, Human
gcagagaucggcccuacuagaugcagagaccccgcagagcugcauugacuaccagauuua

SEQ ID NO: 179033 - RNA, 63 nt, Human
cccacgccucggggcccccgccgccccuccggacccgcagagcuggggacauggcaugcccug

SEQ ID NO: 179034 - RNA, 63 nt, Human
gugagcuagcccuuagagaaggcugucccggggcccgcagaggugcccuuacugaggugacag

SEQ ID NO: 179035 - RNA, 63 nt, Human
gcuaccugagccugacgcccgagcaguggaggucccgcagaagcuacagcugccaggucaugc

SEQ ID NO: 179036 - RNA, 63 nt, Human
gccccucuccaauagguguggccccuaccagaccccgcagacccgggcacuucucagcauggc

SEQ ID NO: 179037 - RNA, 63 nt, Human
gccuaaguauguggagcucugcuuuggcacugccccgcagaggccacgccuauuuauucuguu

SEQ ID NO: 179038 - RNA, 63 nt, Human
cuguccccaaauuggccucgguggcaggggagccccgcagagcuggacagcgacacgcagggg

SEQ ID NO: 179039 - RNA, 63 nt, Human
uuccugaccauccucagaaucucaugccauuuucccgcagagcugagggauguggucagcagu

SEQ ID NO: 179040 - RNA, 64 nt, Human; identical to SEQ ID NO: 81980

SEQ ID NO: 179041 - RNA, 64 nt, Human; identical to SEQ ID NO: 81981

SEQ ID NO: 179042 - RNA, 64 nt, Human; identical to SEQ ID NO: 84604

SEQ ID NO: 179043 - RNA, 64 nt, Human; identical to SEQ ID NO: 81982

SEQ ID NO: 179044 - RNA, 64 nt, Human; identical to SEQ ID NO: 81983

SEQ ID NO: 179045 - RNA, 64 nt, Human; identical to SEQ ID NO: 81984

SEQ ID NO: 179046 - RNA, 64 nt, Human; identical to SEQ ID NO: 81985

SEQ ID NO: 179047 - RNA, 50 nt, Human; identical to SEQ ID NO: 81986

SEQ ID NO: 179048 - RNA, 64 nt, Human; identical to SEQ ID NO: 81987

SEQ ID NO: 179049 - RNA, 64 nt, Human; identical to SEQ ID NO: 81988

SEQ ID NO: 179050 - RNA, 64 nt, Human; identical to SEQ ID NO: 81989

SEQ ID NO: 179051 - RNA, 64 nt, Human; identical to SEQ ID NO: 81990

SEQ ID NO: 179052 - RNA, 64 nt, Human; identical to SEQ ID NO: 81991

SEQ ID NO: 179053 - RNA, 64 nt, Human; identical to SEQ ID NO: 81992

SEQ ID NO: 179054 - RNA, 64 nt, Human; identical to SEQ ID NO: 81993

SEQ ID NO: 179055 - RNA, 64 nt, Human; identical to SEQ ID NO: 81994

SEQ ID NO: 179056 - RNA, 64 nt, Human; identical to SEQ ID NO: 81995

SEQ ID NO: 179057 - RNA, 64 nt, Human; identical to SEQ ID NO: 81996

SEQ ID NO: 179058 - RNA, 64 nt, Human; identical to SEQ ID NO: 81997

SEQ ID NO: 179059 - RNA, 64 nt, Human; identical to SEQ ID NO: 81998

SEQ ID NO: 179060 - RNA, 64 nt, Human; identical to SEQ ID NO: 81999

SEQ ID NO: 179061 - RNA, 64 nt, Human; identical to SEQ ID NO: 82000

SEQ ID NO: 179062 - RNA, 64 nt, Human; identical to SEQ ID NO: 82001

SEQ ID NO: 179063 - RNA, 64 nt, Human; identical to SEQ ID NO: 82002

SEQ ID NO: 179064 - RNA, 64 nt, Human; identical to SEQ ID NO: 82003

SEQ ID NO: 179065 - RNA, 64 nt, Human; identical to SEQ ID NO: 82004

SEQ ID NO: 179066 - RNA, 64 nt, Human; identical to SEQ ID NO: 82005

SEQ ID NO: 179067 - RNA, 64 nt, Human; identical to SEQ ID NO: 82006

SEQ ID NO: 179068 - RNA, 64 nt, Human; identical to SEQ ID NO: 82007

SEQ ID NO: 179069 - RNA, 64 nt, Human; identical to SEQ ID NO: 82008

SEQ ID NO: 179070 - RNA, 64 nt, Human; identical to SEQ ID NO: 82009

SEQ ID NO: 179071 - RNA, 64 nt, Human; identical to SEQ ID NO: 82010

SEQ ID NO: 179072 - RNA, 64 nt, Human; identical to SEQ ID NO: 82011

SEQ ID NO: 179073 - RNA, 64 nt, Human; identical to SEQ ID NO: 82012

SEQ ID NO: 179074 - RNA, 64 nt, Human; identical to SEQ ID NO: 82013

SEQ ID NO: 179075 - RNA, 64 nt, Human; identical to SEQ ID NO: 82014

SEQ ID NO: 179076 - RNA, 50 nt, Human; identical to SEQ ID NO: 82015

SEQ ID NO: 179077 - RNA, 64 nt, Human; identical to SEQ ID NO: 82016

SEQ ID NO: 179078 - RNA, 64 nt, Human; identical to SEQ ID NO: 82017

SEQ ID NO: 179079 - RNA, 64 nt, Human; identical to SEQ ID NO: 82018

SEQ ID NO: 179080 - RNA, 64 nt, Human; identical to SEQ ID NO: 82019

SEQ ID NO: 179081 - RNA, 64 nt, Human; identical to SEQ ID NO: 82020

SEQ ID NO: 179082 - RNA, 64 nt, Human; identical to SEQ ID NO: 82021

SEQ ID NO: 179083 - RNA, 64 nt, Human; identical to SEQ ID NO: 82022

SEQ ID NO: 179084 - RNA, 61 nt, Human; identical to SEQ ID NO: 82023

SEQ ID NO: 179085 - RNA, 64 nt, Human; identical to SEQ ID NO: 82024

SEQ ID NO: 179086 - RNA, 62 nt, Human; identical to SEQ ID NO: 82025

SEQ ID NO: 179087 - RNA, 64 nt, Human; identical to SEQ ID NO: 82026

SEQ ID NO: 179088 - RNA, 64 nt, Human; identical to SEQ ID NO: 82027

SEQ ID NO: 179089 - RNA, 64 nt, Human; identical to SEQ ID NO: 82028

SEQ ID NO: 179090 - RNA, 64 nt, Human; identical to SEQ ID NO: 82029

SEQ ID NO: 179091 - RNA, 64 nt, Human; identical to SEQ ID NO: 82030

SEQ ID NO: 179092 - RNA, 64 nt, Human; identical to SEQ ID NO: 82031

SEQ ID NO: 179093 - RNA, 64 nt, Human; identical to SEQ ID NO: 82032

SEQ ID NO: 179094 - RNA, 64 nt, Human; identical to SEQ ID NO: 82033

SEQ ID NO: 179095 - RNA, 64 nt, Human; identical to SEQ ID NO: 82034

SEQ ID NO: 179096 - RNA, 64 nt, Human
guggccaaaccagcagaacauucuucucuucaaaggaugcaauaguagaaagcuacuuauuuua

SEQ ID NO: 179097 - RNA, 64 nt, Human; identical to SEQ ID NO: 82035

SEQ ID NO: 179098 - RNA, 64 nt, Human; identical to SEQ ID NO: 82036

SEQ ID NO: 179099 - RNA, 64 nt, Human; identical to SEQ ID NO: 82037

SEQ ID NO: 179100 - RNA, 64 nt, Human; identical to SEQ ID NO: 82038

SEQ ID NO: 179101 - RNA, 64 nt, Human; identical to SEQ ID NO: 82039

SEQ ID NO: 179102 - RNA, 64 nt, Human; identical to SEQ ID NO: 82040

SEQ ID NO: 179103 - RNA, 64 nt, Human; identical to SEQ ID NO: 82041

SEQ ID NO: 179104 - RNA, 64 nt, Human; identical to SEQ ID NO: 82042

SEQ ID NO: 179105 - RNA, 64 nt, Human; identical to SEQ ID NO: 82043

SEQ ID NO: 179106 - RNA, 64 nt, Human; identical to SEQ ID NO: 82044

SEQ ID NO: 179107 - RNA, 64 nt, Human; identical to SEQ ID NO: 82045

SEQ ID NO: 179108 - RNA, 64 nt, Human; identical to SEQ ID NO: 82046

SEQ ID NO: 179109 - RNA, 64 nt, Human; identical to SEQ ID NO: 82047

SEQ ID NO: 179110 - RNA, 64 nt, Human; identical to SEQ ID NO: 82048

SEQ ID NO: 179111 - RNA, 64 nt, Human; identical to SEQ ID NO: 82049

SEQ ID NO: 179112 - RNA, 62 nt, Human; identical to SEQ ID NO: 82050

SEQ ID NO: 179113 - RNA, 64 nt, Human; identical to SEQ ID NO: 82051

SEQ ID NO: 179114 - RNA, 64 nt, Human; identical to SEQ ID NO: 82052

SEQ ID NO: 179115 - RNA, 64 nt, Human; identical to SEQ ID NO: 82053

SEQ ID NO: 179116 - RNA, 64 nt, Human; identical to SEQ ID NO: 82054

SEQ ID NO: 179117 - RNA, 64 nt, Human; identical to SEQ ID NO: 82055

SEQ ID NO: 179118 - RNA, 64 nt, Human; identical to SEQ ID NO: 82056

SEQ ID NO: 179119 - RNA, 64 nt, Human; identical to SEQ ID NO: 82057

SEQ ID NO: 179120 - RNA, 64 nt, Human; identical to SEQ ID NO: 82058

SEQ ID NO: 179121 - RNA, 64 nt, Human; identical to SEQ ID NO: 82059

SEQ ID NO: 179122 - RNA, 64 nt, Human; identical to SEQ ID NO: 82060

SEQ ID NO: 179123 - RNA, 64 nt, Human; identical to SEQ ID NO: 82061

SEQ ID NO: 179124 - RNA, 64 nt, Human; identical to SEQ ID NO: 82062

SEQ ID NO: 179125 - RNA, 64 nt, Human; identical to SEQ ID NO: 82063

SEQ ID NO: 179126 - RNA, 64 nt, Human; identical to SEQ ID NO: 82064

SEQ ID NO: 179127 - RNA, 64 nt, Human; identical to SEQ ID NO: 82065

SEQ ID NO: 179128 - RNA, 64 nt, Human; identical to SEQ ID NO: 82066

SEQ ID NO: 179129 - RNA, 64 nt, Human; identical to SEQ ID NO: 82067

SEQ ID NO: 179130 - RNA, 62 nt, Human; identical to SEQ ID NO: 82068

SEQ ID NO: 179131 - RNA, 64 nt, Human; identical to SEQ ID NO: 82069

SEQ ID NO: 179132 - RNA, 64 nt, Human
auguaugaguguauguguuuauguaacuuccuguggaugcaaauagauucagagaaauuuagag

SEQ ID NO: 179133 - RNA, 64 nt, Human; identical to SEQ ID NO: 82070

SEQ ID NO: 179134 - RNA, 64 nt, Human; identical to SEQ ID NO: 82071

SEQ ID NO: 179135 - RNA, 64 nt, Human; identical to SEQ ID NO: 82072

SEQ ID NO: 179136 - RNA, 64 nt, Human; identical to SEQ ID NO: 82073

SEQ ID NO: 179137 - RNA, 64 nt, Human; identical to SEQ ID NO: 82074

SEQ ID NO: 179138 - RNA, 64 nt, Human; identical to SEQ ID NO: 82075

SEQ ID NO: 179139 - RNA, 64 nt, Human; identical to SEQ ID NO: 82076

SEQ ID NO: 179140 - RNA, 57 nt, Human; identical to SEQ ID NO: 82077

SEQ ID NO: 179141 - RNA, 64 nt, Human; identical to SEQ ID NO: 82078

SEQ ID NO: 179142 - RNA, 64 nt, Human; identical to SEQ ID NO: 82079

SEQ ID NO: 179143 - RNA, 64 nt, Human; identical to SEQ ID NO: 82080

SEQ ID NO: 179144 - RNA, 64 nt, Human; identical to SEQ ID NO: 82081

SEQ ID NO: 179145 - RNA, 64 nt, Human; identical to SEQ ID NO: 82082

SEQ ID NO: 179146 - RNA, 64 nt, Human; identical to SEQ ID NO: 82083

SEQ ID NO: 179147 - RNA, 64 nt, Human; identical to SEQ ID NO: 82084

SEQ ID NO: 179148 - RNA, 64 nt, Human; identical to SEQ ID NO: 82085

SEQ ID NO: 179149 - RNA, 64 nt, Human; identical to SEQ ID NO: 82086

SEQ ID NO: 179150 - RNA, 64 nt, Human; identical to SEQ ID NO: 82087

SEQ ID NO: 179151 - RNA, 64 nt, Human; identical to SEQ ID NO: 82088

SEQ ID NO: 179152 - RNA, 64 nt, Human; identical to SEQ ID NO: 82089

SEQ ID NO: 179153 - RNA, 64 nt, Human; identical to SEQ ID NO: 82090

SEQ ID NO: 179154 - RNA, 64 nt, Human; identical to SEQ ID NO: 82091

SEQ ID NO: 179155 - RNA, 64 nt, Human; identical to SEQ ID NO: 82092

SEQ ID NO: 179156 - RNA, 64 nt, Human; identical to SEQ ID NO: 82093

SEQ ID NO: 179157 - RNA, 64 nt, Human; identical to SEQ ID NO: 82094

SEQ ID NO: 179158 - RNA, 64 nt, Human; identical to SEQ ID NO: 82095

SEQ ID NO: 179159 - RNA, 64 nt, Human; identical to SEQ ID NO: 82096

SEQ ID NO: 179160 - RNA, 64 nt, Human; identical to SEQ ID NO: 82097

SEQ ID NO: 179161 - RNA, 64 nt, Human; identical to SEQ ID NO: 82098

SEQ ID NO: 179162 - RNA, 64 nt, Human; identical to SEQ ID NO: 82099

SEQ ID NO: 179163 - RNA, 64 nt, Human; identical to SEQ ID NO: 82100

SEQ ID NO: 179164 - RNA, 64 nt, Human; identical to SEQ ID NO: 82101

SEQ ID NO: 179165 - RNA, 64 nt, Human; identical to SEQ ID NO: 82102

SEQ ID NO: 179166 - RNA, 64 nt, Human; identical to SEQ ID NO: 82103

SEQ ID NO: 179167 - RNA, 64 nt, Human; identical to SEQ ID NO: 82104

SEQ ID NO: 179168 - RNA, 64 nt, Human
agucuccaagcccacuugaaaagucacacugaaaggaugcaaauagccgucugcgauuuuggcg

SEQ ID NO: 179169 - RNA, 64 nt, Human; identical to SEQ ID NO: 82105

SEQ ID NO: 179170 - RNA, 64 nt, Human; identical to SEQ ID NO: 82106

SEQ ID NO: 179171 - RNA, 64 nt, Human; identical to SEQ ID NO: 82107

SEQ ID NO: 179172 - RNA, 64 nt, Human; identical to SEQ ID NO: 82108

SEQ ID NO: 179173 - RNA, 64 nt, Human; identical to SEQ ID NO: 82109

SEQ ID NO: 179174 - RNA, 64 nt, Human; identical to SEQ ID NO: 82110

SEQ ID NO: 179175 - RNA, 64 nt, Human; identical to SEQ ID NO: 82111

SEQ ID NO: 179176 - RNA, 64 nt, Human; identical to SEQ ID NO: 82112

SEQ ID NO: 179177 - RNA, 64 nt, Human; identical to SEQ ID NO: 82113

SEQ ID NO: 179178 - RNA, 64 nt, Human; identical to SEQ ID NO: 82114

SEQ ID NO: 179179 - RNA, 61 nt, Human; identical to SEQ ID NO: 82115

SEQ ID NO: 179180 - RNA, 64 nt, Human; identical to SEQ ID NO: 82116

SEQ ID NO: 179181 - RNA, 64 nt, Human; identical to SEQ ID NO: 82117

SEQ ID NO: 179182 - RNA, 64 nt, Human; identical to SEQ ID NO: 82118

SEQ ID NO: 179183 - RNA, 64 nt, Human; identical to SEQ ID NO: 82119

SEQ ID NO: 179184 - RNA, 64 nt, Human; identical to SEQ ID NO: 82120

SEQ ID NO: 179185 - RNA, 64 nt, Human; identical to SEQ ID NO: 82121

SEQ ID NO: 179186 - RNA, 64 nt, Human; identical to SEQ ID NO: 84550

SEQ ID NO: 179187 - RNA, 64 nt, Human; identical to SEQ ID NO: 82122

SEQ ID NO: 179188 - RNA, 64 nt, Human; identical to SEQ ID NO: 82123

SEQ ID NO: 179189 - RNA, 64 nt, Human; identical to SEQ ID NO: 82124

SEQ ID NO: 179190 - RNA, 57 nt, Human; identical to SEQ ID NO: 82125

SEQ ID NO: 179191 - RNA, 64 nt, Human; identical to SEQ ID NO: 82126

SEQ ID NO: 179192 - RNA, 64 nt, Human; identical to SEQ ID NO: 82127

SEQ ID NO: 179193 - RNA, 64 nt, Human; identical to SEQ ID NO: 82128

SEQ ID NO: 179194 - RNA, 61 nt, Human; identical to SEQ ID NO: 82129

SEQ ID NO: 179195 - RNA, 64 nt, Human; identical to SEQ ID NO: 82130

SEQ ID NO: 179196 - RNA, 64 nt, Human; identical to SEQ ID NO: 82131

SEQ ID NO: 179197 - RNA, 64 nt, Human; identical to SEQ ID NO: 82132

SEQ ID NO: 179198 - RNA, 64 nt, Human; identical to SEQ ID NO: 82133

SEQ ID NO: 179199 - RNA, 64 nt, Human; identical to SEQ ID NO: 82134

SEQ ID NO: 179200 - RNA, 64 nt, Human; identical to SEQ ID NO: 82135

SEQ ID NO: 179201 - RNA, 64 nt, Human; identical to SEQ ID NO: 82136

SEQ ID NO: 179202 - RNA, 64 nt, Human; identical to SEQ ID NO: 82137

SEQ ID NO: 179203 - RNA, 64 nt, Human; identical to SEQ ID NO: 82138

SEQ ID NO: 179204 - RNA, 64 nt, Human; identical to SEQ ID NO: 82139

SEQ ID NO: 179205 - RNA, 55 nt, Human; identical to SEQ ID NO: 82140

SEQ ID NO: 179206 - RNA, 64 nt, Human; identical to SEQ ID NO: 82141

SEQ ID NO: 179207 - RNA, 64 nt, Human; identical to SEQ ID NO: 82142

SEQ ID NO: 179208 - RNA, 64 nt, Human; identical to SEQ ID NO: 82143

SEQ ID NO: 179209 - RNA, 61 nt, Human; identical to SEQ ID NO: 82144

SEQ ID NO: 179210 - RNA, 64 nt, Human; identical to SEQ ID NO: 82145

SEQ ID NO: 179211 - RNA, 64 nt, Human; identical to SEQ ID NO: 82146

SEQ ID NO: 179212 - RNA, 64 nt, Human; identical to SEQ ID NO: 82147

SEQ ID NO: 179213 - RNA, 64 nt, Human; identical to SEQ ID NO: 82148

SEQ ID NO: 179214 - RNA, 64 nt, Human; identical to SEQ ID NO: 82149

SEQ ID NO: 179215 - RNA, 64 nt, Human; identical to SEQ ID NO: 82150

SEQ ID NO: 179216 - RNA, 64 nt, Human; identical to SEQ ID NO: 82151

SEQ ID NO: 179217 - RNA, 64 nt, Human; identical to SEQ ID NO: 82152

SEQ ID NO: 179218 - RNA, 64 nt, Human; identical to SEQ ID NO: 82153

SEQ ID NO: 179219 - RNA, 64 nt, Human; identical to SEQ ID NO: 82154

SEQ ID NO: 179220 - RNA, 64 nt, Human; identical to SEQ ID NO: 82155

SEQ ID NO: 179221 - RNA, 64 nt, Human; identical to SEQ ID NO: 82156

SEQ ID NO: 179222 - RNA, 64 nt, Human; identical to SEQ ID NO: 82157

SEQ ID NO: 179223 - RNA, 64 nt, Human; identical to SEQ ID NO: 82158

SEQ ID NO: 179224 - RNA, 64 nt, Human; identical to SEQ ID NO: 82159

SEQ ID NO: 179225 - RNA, 64 nt, Human; identical to SEQ ID NO: 82160

SEQ ID NO: 179226 - RNA, 64 nt, Human; identical to SEQ ID NO: 82161

SEQ ID NO: 179227 - RNA, 64 nt, Human; identical to SEQ ID NO: 82162

SEQ ID NO: 179228 - RNA, 64 nt, Human; identical to SEQ ID NO: 82163

SEQ ID NO: 179229 - RNA, 64 nt, Human; identical to SEQ ID NO: 82164

SEQ ID NO: 179230 - RNA, 64 nt, Human; identical to SEQ ID NO: 82165

SEQ ID NO: 179231 - RNA, 64 nt, Human; identical to SEQ ID NO: 82166

SEQ ID NO: 179232 - RNA, 64 nt, Human; identical to SEQ ID NO: 82167

SEQ ID NO: 179233 - RNA, 64 nt, Human; identical to SEQ ID NO: 82168

SEQ ID NO: 179234 - RNA, 64 nt, Human; identical to SEQ ID NO: 82169

SEQ ID NO: 179235 - RNA, 64 nt, Human; identical to SEQ ID NO: 82170

SEQ ID NO: 179236 - RNA, 64 nt, Human; identical to SEQ ID NO: 82171

SEQ ID NO: 179237 - RNA, 64 nt, Human; identical to SEQ ID NO: 82172

SEQ ID NO: 179238 - RNA, 64 nt, Human; identical to SEQ ID NO: 82173

SEQ ID NO: 179239 - RNA, 64 nt, Human
uucaaagaggcacagagccaaauugguagaggaaggaugcaaaguauaaauuuguguaauauua

SEQ ID NO: 179240 - RNA, 64 nt, Human; identical to SEQ ID NO: 107743

SEQ ID NO: 179241 - RNA, 64 nt, Human; identical to SEQ ID NO: 107744

SEQ ID NO: 179242 - RNA, 64 nt, Human; identical to SEQ ID NO: 107745

SEQ ID NO: 179243 - RNA, 64 nt, Human; identical to SEQ ID NO: 107746

SEQ ID NO: 179244 - RNA, 64 nt, Human; identical to SEQ ID NO: 107747

SEQ ID NO: 179245 - RNA, 64 nt, Human; identical to SEQ ID NO: 107748

SEQ ID NO: 179246 - RNA, 64 nt, Human; identical to SEQ ID NO: 107749

SEQ ID NO: 179247 - RNA, 64 nt, Human; identical to SEQ ID NO: 107750

SEQ ID NO: 179248 - RNA, 64 nt, Human; identical to SEQ ID NO: 107751

SEQ ID NO: 179249 - RNA, 64 nt, Human; identical to SEQ ID NO: 107752

SEQ ID NO: 179250 - RNA, 64 nt, Human; identical to SEQ ID NO: 107753

SEQ ID NO: 179251 - RNA, 64 nt, Human; identical to SEQ ID NO: 107754

SEQ ID NO: 179252 - RNA, 64 nt, Human; identical to SEQ ID NO: 107755

SEQ ID NO: 179253 - RNA, 64 nt, Human; identical to SEQ ID NO: 107756

SEQ ID NO: 179254 - RNA, 64 nt, Human; identical to SEQ ID NO: 107757

SEQ ID NO: 179255 - RNA, 64 nt, Human; identical to SEQ ID NO: 107758

SEQ ID NO: 179256 - RNA, 64 nt, Human; identical to SEQ ID NO: 107759

SEQ ID NO: 179257 - RNA, 51 nt, Human; identical to SEQ ID NO: 107760

SEQ ID NO: 179258 - RNA, 64 nt, Human; identical to SEQ ID NO: 107761

SEQ ID NO: 179259 - RNA, 64 nt, Human; identical to SEQ ID NO: 107762

SEQ ID NO: 179260 - RNA, 64 nt, Human; identical to SEQ ID NO: 107763

SEQ ID NO: 179261 - RNA, 64 nt, Human; identical to SEQ ID NO: 107764

SEQ ID NO: 179262 - RNA, 64 nt, Human; identical to SEQ ID NO: 107765

SEQ ID NO: 179263 - RNA, 64 nt, Human; identical to SEQ ID NO: 107766

SEQ ID NO: 179264 - RNA, 64 nt, Human; identical to SEQ ID NO: 107767

SEQ ID NO: 179265 - RNA, 64 nt, Human; identical to SEQ ID NO: 107768

SEQ ID NO: 179266 - RNA, 64 nt, Human; identical to SEQ ID NO: 107769

SEQ ID NO: 179267 - RNA, 64 nt, Human; identical to SEQ ID NO: 107770

SEQ ID NO: 179268 - RNA, 64 nt, Human; identical to SEQ ID NO: 107771

SEQ ID NO: 179269 - RNA, 64 nt, Human; identical to SEQ ID NO: 107772

SEQ ID NO: 179270 - RNA, 64 nt, Human; identical to SEQ ID NO: 107773

SEQ ID NO: 179271 - RNA, 64 nt, Human; identical to SEQ ID NO: 107774

SEQ ID NO: 179272 - RNA, 64 nt, Human; identical to SEQ ID NO: 107775

SEQ ID NO: 179273 - RNA, 64 nt, Human; identical to SEQ ID NO: 107776

SEQ ID NO: 179274 - RNA, 64 nt, Human; identical to SEQ ID NO: 107777

SEQ ID NO: 179275 - RNA, 64 nt, Human; identical to SEQ ID NO: 107778

SEQ ID NO: 179276 - RNA, 64 nt, Human; identical to SEQ ID NO: 107779

SEQ ID NO: 179277 - RNA, 64 nt, Human; identical to SEQ ID NO: 107780

SEQ ID NO: 179278 - RNA, 64 nt, Human; identical to SEQ ID NO: 107781

SEQ ID NO: 179279 - RNA, 64 nt, Human; identical to SEQ ID NO: 107782

SEQ ID NO: 179280 - RNA, 64 nt, Human; identical to SEQ ID NO: 107783

SEQ ID NO: 179281 - RNA, 64 nt, Human
ugcccuguauccggagcugugcugggcacugaggggaugcaacaaaauuaggagaggauccuug

SEQ ID NO: 179282 - RNA, 64 nt, Human; identical to SEQ ID NO: 107784

SEQ ID NO: 179283 - RNA, 64 nt, Human; identical to SEQ ID NO: 107785

SEQ ID NO: 179284 - RNA, 64 nt, Human; identical to SEQ ID NO: 107786

SEQ ID NO: 179285 - RNA, 64 nt, Human; identical to SEQ ID NO: 107787

SEQ ID NO: 179286 - RNA, 64 nt, Human; identical to SEQ ID NO: 107788

SEQ ID NO: 179287 - RNA, 61 nt, Human; identical to SEQ ID NO: 107789

SEQ ID NO: 179288 - RNA, 64 nt, Human; identical to SEQ ID NO: 107790

SEQ ID NO: 179289 - RNA, 64 nt, Human; identical to SEQ ID NO: 107791

SEQ ID NO: 179290 - RNA, 64 nt, Human; identical to SEQ ID NO: 107792

SEQ ID NO: 179291 - RNA, 64 nt, Human; identical to SEQ ID NO: 107793

SEQ ID NO: 179292 - RNA, 64 nt, Human; identical to SEQ ID NO: 107794

SEQ ID NO: 179293 - RNA, 64 nt, Human; identical to SEQ ID NO: 107795

SEQ ID NO: 179294 - RNA, 64 nt, Human; identical to SEQ ID NO: 107796

SEQ ID NO: 179295 - RNA, 64 nt, Human; identical to SEQ ID NO: 107797

SEQ ID NO: 179296 - RNA, 64 nt, Human; identical to SEQ ID NO: 107798

SEQ ID NO: 179297 - RNA, 64 nt, Human; identical to SEQ ID NO: 107799

SEQ ID NO: 179298 - RNA, 64 nt, Human; identical to SEQ ID NO: 107800

SEQ ID NO: 179299 - RNA, 64 nt, Human
cuucucacccauggcccacccaggccuggagcugggaugcaauguaggcugagggaaagacguc

SEQ ID NO: 179300 - RNA, 64 nt, Human; identical to SEQ ID NO: 107801

SEQ ID NO: 179301 - RNA, 64 nt, Human; identical to SEQ ID NO: 107802

SEQ ID NO: 179302 - RNA, 64 nt, Human; identical to SEQ ID NO: 107803

SEQ ID NO: 179303 - RNA, 64 nt, Human; identical to SEQ ID NO: 107804

SEQ ID NO: 179304 - RNA, 64 nt, Human; identical to SEQ ID NO: 107805

SEQ ID NO: 179305 - RNA, 64 nt, Human; identical to SEQ ID NO: 107806

SEQ ID NO: 179306 - RNA, 64 nt, Human; identical to SEQ ID NO: 107807

SEQ ID NO: 179307 - RNA, 64 nt, Human; identical to SEQ ID NO: 107808

SEQ ID NO: 179308 - RNA, 64 nt, Human; identical to SEQ ID NO: 107809

SEQ ID NO: 179309 - RNA, 64 nt, Human; identical to SEQ ID NO: 107810

SEQ ID NO: 179310 - RNA, 64 nt, Human; identical to SEQ ID NO: 107811

SEQ ID NO: 179311 - RNA, 64 nt, Human; identical to SEQ ID NO: 107812

SEQ ID NO: 179312 - RNA, 64 nt, Human; identical to SEQ ID NO: 107813

SEQ ID NO: 179313 - RNA, 64 nt, Human; identical to SEQ ID NO: 107814

SEQ ID NO: 179314 - RNA, 64 nt, Human; identical to SEQ ID NO: 107815

SEQ ID NO: 179315 - RNA, 64 nt, Human; identical to SEQ ID NO: 107816

SEQ ID NO: 179316 - RNA, 64 nt, Human; identical to SEQ ID NO: 107817

SEQ ID NO: 179317 - RNA, 64 nt, Human
uaugugaucauuugcacuuguuaccucuuaauauggaugcaacuuauuaaaaauguuggccugg

SEQ ID NO: 179318 - RNA, 64 nt, Human; identical to SEQ ID NO: 107818

SEQ ID NO: 179319 - RNA, 64 nt, Human; identical to SEQ ID NO: 107819

SEQ ID NO: 179320 - RNA, 64 nt, Human; identical to SEQ ID NO: 107820

SEQ ID NO: 179321 - RNA, 64 nt, Human; identical to SEQ ID NO: 107821

SEQ ID NO: 179322 - RNA, 64 nt, Human; identical to SEQ ID NO: 107822

SEQ ID NO: 179323 - RNA, 64 nt, Human; identical to SEQ ID NO: 107823

SEQ ID NO: 179324 - RNA, 64 nt, Human; identical to SEQ ID NO: 107824

SEQ ID NO: 179325 - RNA, 64 nt, Human; identical to SEQ ID NO: 107825

SEQ ID NO: 179326 - RNA, 64 nt, Human; identical to SEQ ID NO: 107826

SEQ ID NO: 179327 - RNA, 64 nt, Human; identical to SEQ ID NO: 107827

SEQ ID NO: 179328 - RNA, 64 nt, Human; identical to SEQ ID NO: 107828

SEQ ID NO: 179329 - RNA, 64 nt, Human; identical to SEQ ID NO: 107829

SEQ ID NO: 179330 - RNA, 64 nt, Human; identical to SEQ ID NO: 107830

SEQ ID NO: 179331 - RNA, 64 nt, Human; identical to SEQ ID NO: 107831

SEQ ID NO: 179332 - RNA, 64 nt, Human; identical to SEQ ID NO: 107832

SEQ ID NO: 179333 - RNA, 64 nt, Human; identical to SEQ ID NO: 107833

SEQ ID NO: 179334 - RNA, 64 nt, Human; identical to SEQ ID NO: 107834

SEQ ID NO: 179335 - RNA, 64 nt, Human
cagcgcggggagugaggaggggucagggggcuaaggaugcaaccucugacguucugcgccuucc

SEQ ID NO: 179336 - RNA, 64 nt, Human; identical to SEQ ID NO: 107835

SEQ ID NO: 179337 - RNA, 64 nt, Human; identical to SEQ ID NO: 107836

SEQ ID NO: 179338 - RNA, 64 nt, Human; identical to SEQ ID NO: 107837

SEQ ID NO: 179339 - RNA, 64 nt, Human; identical to SEQ ID NO: 107838

SEQ ID NO: 179340 - RNA, 64 nt, Human; identical to SEQ ID NO: 107839

SEQ ID NO: 179341 - RNA, 64 nt, Human; identical to SEQ ID NO: 107840

SEQ ID NO: 179342 - RNA, 64 nt, Human; identical to SEQ ID NO: 107841

SEQ ID NO: 179343 - RNA, 64 nt, Human; identical to SEQ ID NO: 107842

SEQ ID NO: 179344 - RNA, 64 nt, Human; identical to SEQ ID NO: 107843

SEQ ID NO: 179345 - RNA, 64 nt, Human; identical to SEQ ID NO: 107844

SEQ ID NO: 179346 - RNA, 64 nt, Human; identical to SEQ ID NO: 107845

SEQ ID NO: 179347 - RNA, 64 nt, Human; identical to SEQ ID NO: 107846

SEQ ID NO: 179348 - RNA, 64 nt, Human; identical to SEQ ID NO: 107847

SEQ ID NO: 179349 - RNA, 64 nt, Human; identical to SEQ ID NO: 107848

SEQ ID NO: 179350 - RNA, 64 nt, Human; identical to SEQ ID NO: 107849

SEQ ID NO: 179351 - RNA, 64 nt, Human; identical to SEQ ID NO: 107850

SEQ ID NO: 179352 - RNA, 64 nt, Human; identical to SEQ ID NO: 107851

SEQ ID NO: 179353 - RNA, 54 nt, Human
gcccggaaguccacggcugagccaggaugcaaggcuccugguccuguuugcagc

SEQ ID NO: 179354 - RNA, 64 nt, Human; identical to SEQ ID NO: 107852

SEQ ID NO: 179355 - RNA, 64 nt, Human; identical to SEQ ID NO: 107853

SEQ ID NO: 179356 - RNA, 64 nt, Human; identical to SEQ ID NO: 107854

SEQ ID NO: 179357 - RNA, 64 nt, Human; identical to SEQ ID NO: 107855

SEQ ID NO: 179358 - RNA, 64 nt, Human; identical to SEQ ID NO: 107856

SEQ ID NO: 179359 - RNA, 64 nt, Human; identical to SEQ ID NO: 107857

SEQ ID NO: 179360 - RNA, 64 nt, Human; identical to SEQ ID NO: 107858

SEQ ID NO: 179361 - RNA, 64 nt, Human; identical to SEQ ID NO: 107859

SEQ ID NO: 179362 - RNA, 64 nt, Human; identical to SEQ ID NO: 107860

SEQ ID NO: 179363 - RNA, 64 nt, Human; identical to SEQ ID NO: 107861

SEQ ID NO: 179364 - RNA, 64 nt, Human; identical to SEQ ID NO: 107862

SEQ ID NO: 179365 - RNA, 64 nt, Human; identical to SEQ ID NO: 107863

SEQ ID NO: 179366 - RNA, 64 nt, Human; identical to SEQ ID NO: 107864

SEQ ID NO: 179367 - RNA, 64 nt, Human; identical to SEQ ID NO: 107865

SEQ ID NO: 179368 - RNA, 64 nt, Human; identical to SEQ ID NO: 107866

SEQ ID NO: 179369 - RNA, 64 nt, Human; identical to SEQ ID NO: 107867

SEQ ID NO: 179370 - RNA, 64 nt, Human; identical to SEQ ID NO: 107868

SEQ ID NO: 179371 - RNA, 50 nt, Human
ggagaagcacggccagcuagcacggccagugccaggaccgggccgaggga

SEQ ID NO: 179372 - RNA, 64 nt, Human; identical to SEQ ID NO: 107869

SEQ ID NO: 179373 - RNA, 64 nt, Human; identical to SEQ ID NO: 107870

SEQ ID NO: 179374 - RNA, 64 nt, Human; identical to SEQ ID NO: 107871

SEQ ID NO: 179375 - RNA, 64 nt, Human; identical to SEQ ID NO: 107872

SEQ ID NO: 179376 - RNA, 64 nt, Human; identical to SEQ ID NO: 107873

SEQ ID NO: 179377 - RNA, 64 nt, Human; identical to SEQ ID NO: 107874

SEQ ID NO: 179378 - RNA, 64 nt, Human; identical to SEQ ID NO: 107875

SEQ ID NO: 179379 - RNA, 64 nt, Human; identical to SEQ ID NO: 107876

SEQ ID NO: 179380 - RNA, 64 nt, Human; identical to SEQ ID NO: 107877

SEQ ID NO: 179381 - RNA, 64 nt, Human; identical to SEQ ID NO: 107878

SEQ ID NO: 179382 - RNA, 64 nt, Human; identical to SEQ ID NO: 107879

SEQ ID NO: 179383 - RNA, 64 nt, Human; identical to SEQ ID NO: 107880

SEQ ID NO: 179384 - RNA, 64 nt, Human; identical to SEQ ID NO: 107881

SEQ ID NO: 179385 - RNA, 64 nt, Human; identical to SEQ ID NO: 107882

SEQ ID NO: 179386 - RNA, 64 nt, Human; identical to SEQ ID NO: 107883

SEQ ID NO: 179387 - RNA, 64 nt, Human; identical to SEQ ID NO: 107884

SEQ ID NO: 179388 - RNA, 64 nt, Human; identical to SEQ ID NO: 107885

SEQ ID NO: 179389 - RNA, 64 nt, Human
cauucuugauugcuagaguuuuuguuaguacuuuggaugcaauuaaaacuaugugcuaucacau

SEQ ID NO: 179390 - RNA, 64 nt, Human; identical to SEQ ID NO: 107886

SEQ ID NO: 179391 - RNA, 64 nt, Human; identical to SEQ ID NO: 107887

SEQ ID NO: 179392 - RNA, 64 nt, Human; identical to SEQ ID NO: 107888

SEQ ID NO: 179393 - RNA, 64 nt, Human; identical to SEQ ID NO: 107889

SEQ ID NO: 179394 - RNA, 64 nt, Human; identical to SEQ ID NO: 107890

SEQ ID NO: 179395 - RNA, 64 nt, Human; identical to SEQ ID NO: 107891

SEQ ID NO: 179396 - RNA, 64 nt, Human; identical to SEQ ID NO: 107892

SEQ ID NO: 179397 - RNA, 64 nt, Human; identical to SEQ ID NO: 107893

SEQ ID NO: 179398 - RNA, 64 nt, Human; identical to SEQ ID NO: 107894

SEQ ID NO: 179399 - RNA, 64 nt, Human; identical to SEQ ID NO: 107895

SEQ ID NO: 179400 - RNA, 64 nt, Human; identical to SEQ ID NO: 107896

SEQ ID NO: 179401 - RNA, 64 nt, Human; identical to SEQ ID NO: 107897

SEQ ID NO: 179402 - RNA, 64 nt, Human; identical to SEQ ID NO: 107898

SEQ ID NO: 179403 - RNA, 64 nt, Human; identical to SEQ ID NO: 107899

SEQ ID NO: 179404 - RNA, 64 nt, Human; identical to SEQ ID NO: 107900

SEQ ID NO: 179405 - RNA, 64 nt, Human; identical to SEQ ID NO: 107901

SEQ ID NO: 179406 - RNA, 64 nt, Human; identical to SEQ ID NO: 107902

SEQ ID NO: 179407 - RNA, 64 nt, Human; identical to SEQ ID NO: 84650

SEQ ID NO: 179408 - RNA, 64 nt, Human; identical to SEQ ID NO: 107903

SEQ ID NO: 179409 - RNA, 64 nt, Human; identical to SEQ ID NO: 107904

SEQ ID NO: 179410 - RNA, 64 nt, Human; identical to SEQ ID NO: 107905

SEQ ID NO: 179411 - RNA, 64 nt, Human; identical to SEQ ID NO: 107906

SEQ ID NO: 179412 - RNA, 64 nt, Human; identical to SEQ ID NO: 107907

SEQ ID NO: 179413 - RNA, 64 nt, Human; identical to SEQ ID NO: 107908

SEQ ID NO: 179414 - RNA, 64 nt, Human; identical to SEQ ID NO: 107909

SEQ ID NO: 179415 - RNA, 64 nt, Human; identical to SEQ ID NO: 107910

SEQ ID NO: 179416 - RNA, 64 nt, Human; identical to SEQ ID NO: 107911

SEQ ID NO: 179417 - RNA, 64 nt, Human; identical to SEQ ID NO: 107912

SEQ ID NO: 179418 - RNA, 64 nt, Human; identical to SEQ ID NO: 107913

SEQ ID NO: 179419 - RNA, 64 nt, Human; identical to SEQ ID NO: 107914

SEQ ID NO: 179420 - RNA, 64 nt, Human; identical to SEQ ID NO: 107915

SEQ ID NO: 179421 - RNA, 64 nt, Human; identical to SEQ ID NO: 107916

SEQ ID NO: 179422 - RNA, 64 nt, Human; identical to SEQ ID NO: 107917

SEQ ID NO: 179423 - RNA, 64 nt, Human; identical to SEQ ID NO: 107918

SEQ ID NO: 179424 - RNA, 64 nt, Human; identical to SEQ ID NO: 107919

SEQ ID NO: 179425 - RNA, 64 nt, Human
uuauuacuggccacaagcccuguauucucaacagggaugcaaauugguucuucaguaaggauaa

SEQ ID NO: 179426 - RNA, 64 nt, Human; identical to SEQ ID NO: 107920

SEQ ID NO: 179427 - RNA, 64 nt, Human; identical to SEQ ID NO: 107921

SEQ ID NO: 179428 - RNA, 64 nt, Human; identical to SEQ ID NO: 107922

SEQ ID NO: 179429 - RNA, 64 nt, Human; identical to SEQ ID NO: 107923

SEQ ID NO: 179430 - RNA, 64 nt, Human; identical to SEQ ID NO: 107924

SEQ ID NO: 179431 - RNA, 64 nt, Human; identical to SEQ ID NO: 107925

SEQ ID NO: 179432 - RNA, 64 nt, Human; identical to SEQ ID NO: 107926

SEQ ID NO: 179433 - RNA, 64 nt, Human; identical to SEQ ID NO: 107927

SEQ ID NO: 179434 - RNA, 64 nt, Human; identical to SEQ ID NO: 107928

SEQ ID NO: 179435 - RNA, 64 nt, Human; identical to SEQ ID NO: 107929

SEQ ID NO: 179436 - RNA, 64 nt, Human; identical to SEQ ID NO: 107930

SEQ ID NO: 179437 - RNA, 64 nt, Human; identical to SEQ ID NO: 107931

SEQ ID NO: 179438 - RNA, 64 nt, Human; identical to SEQ ID NO: 107932

SEQ ID NO: 179439 - RNA, 64 nt, Human; identical to SEQ ID NO: 107933

SEQ ID NO: 179440 - RNA, 64 nt, Human; identical to SEQ ID NO: 107934

SEQ ID NO: 179441 - RNA, 64 nt, Human; identical to SEQ ID NO: 107935

SEQ ID NO: 179442 - RNA, 64 nt, Human; identical to SEQ ID NO: 107936

SEQ ID NO: 179443 - RNA, 64 nt, Human
ccaccagaaugaccugaugaggaaaucuucaauaggaugcaaagaucaaugcaaaaauuguuau

SEQ ID NO: 179444 - RNA, 64 nt, Human; identical to SEQ ID NO: 107937

SEQ ID NO: 179445 - RNA, 64 nt, Human; identical to SEQ ID NO: 107938

SEQ ID NO: 179446 - RNA, 64 nt, Human; identical to SEQ ID NO: 107939

SEQ ID NO: 179447 - RNA, 64 nt, Human; identical to SEQ ID NO: 107940

SEQ ID NO: 179448 - RNA, 64 nt, Human; identical to SEQ ID NO: 107941

SEQ ID NO: 179449 - RNA, 64 nt, Human; identical to SEQ ID NO: 107942

SEQ ID NO: 179450 - RNA, 64 nt, Human; identical to SEQ ID NO: 107943

SEQ ID NO: 179451 - RNA, 64 nt, Human; identical to SEQ ID NO: 107944

SEQ ID NO: 179452 - RNA, 64 nt, Human; identical to SEQ ID NO: 107945

SEQ ID NO: 179453 - RNA, 64 nt, Human; identical to SEQ ID NO: 107946

SEQ ID NO: 179454 - RNA, 64 nt, Human; identical to SEQ ID NO: 107947

SEQ ID NO: 179455 - RNA, 64 nt, Human; identical to SEQ ID NO: 107948

SEQ ID NO: 179456 - RNA, 64 nt, Human; identical to SEQ ID NO: 107949

SEQ ID NO: 179457 - RNA, 64 nt, Human; identical to SEQ ID NO: 107950

SEQ ID NO: 179458 - RNA, 64 nt, Human; identical to SEQ ID NO: 107951

SEQ ID NO: 179459 - RNA, 64 nt, Human; identical to SEQ ID NO: 107952

SEQ ID NO: 179460 - RNA, 64 nt, Human; identical to SEQ ID NO: 107953

SEQ ID NO: 179461 - RNA, 64 nt, Human
auuggcaauaagauacccgcuacaaacugugauuggaugcaaaaucucuuagcuucuuucacga

SEQ ID NO: 179462 - RNA, 64 nt, Human; identical to SEQ ID NO: 107954

SEQ ID NO: 179463 - RNA, 64 nt, Human; identical to SEQ ID NO: 107955

SEQ ID NO: 179464 - RNA, 64 nt, Human; identical to SEQ ID NO: 107956

SEQ ID NO: 179465 - RNA, 64 nt, Human; identical to SEQ ID NO: 107957

SEQ ID NO: 179466 - RNA, 64 nt, Human; identical to SEQ ID NO: 107958

SEQ ID NO: 179467 - RNA, 64 nt, Human; identical to SEQ ID NO: 107959

SEQ ID NO: 179468 - RNA, 64 nt, Human; identical to SEQ ID NO: 107960

SEQ ID NO: 179469 - RNA, 64 nt, Human; identical to SEQ ID NO: 107961

SEQ ID NO: 179470 - RNA, 64 nt, Human; identical to SEQ ID NO: 107962

SEQ ID NO: 179471 - RNA, 64 nt, Human; identical to SEQ ID NO: 107963

SEQ ID NO: 179472 - RNA, 64 nt, Human; identical to SEQ ID NO: 107964

SEQ ID NO: 179473 - RNA, 64 nt, Human; identical to SEQ ID NO: 107965

SEQ ID NO: 179474 - RNA, 64 nt, Human; identical to SEQ ID NO: 107966

SEQ ID NO: 179475 - RNA, 64 nt, Human; identical to SEQ ID NO: 107967

SEQ ID NO: 179476 - RNA, 64 nt, Human; identical to SEQ ID NO: 107968

SEQ ID NO: 179477 - RNA, 64 nt, Human; identical to SEQ ID NO: 107969

SEQ ID NO: 179478 - RNA, 64 nt, Human; identical to SEQ ID NO: 107970

SEQ ID NO: 179479 - RNA, 64 nt, Human
aauguuuuauaaaauaaauuugccacauaauaugggaugcaauaaccaacaaagcugcuaagug

SEQ ID NO: 179480 - RNA, 64 nt, Human; identical to SEQ ID NO: 107971

SEQ ID NO: 179481 - RNA, 64 nt, Human; identical to SEQ ID NO: 107972

SEQ ID NO: 179482 - RNA, 64 nt, Human; identical to SEQ ID NO: 107973

SEQ ID NO: 179483 - RNA, 64 nt, Human; identical to SEQ ID NO: 107974

SEQ ID NO: 179484 - RNA, 64 nt, Human; identical to SEQ ID NO: 107975

SEQ ID NO: 179485 - RNA, 64 nt, Human; identical to SEQ ID NO: 107976

SEQ ID NO: 179486 - RNA, 64 nt, Human; identical to SEQ ID NO: 107977

SEQ ID NO: 179487 - RNA, 64 nt, Human; identical to SEQ ID NO: 107978

SEQ ID NO: 179488 - RNA, 64 nt, Human; identical to SEQ ID NO: 107979

SEQ ID NO: 179489 - RNA, 64 nt, Human; identical to SEQ ID NO: 107980

SEQ ID NO: 179490 - RNA, 64 nt, Human; identical to SEQ ID NO: 107981

SEQ ID NO: 179491 - RNA, 64 nt, Human; identical to SEQ ID NO: 107982

SEQ ID NO: 179492 - RNA, 64 nt, Human; identical to SEQ ID NO: 107983

SEQ ID NO: 179493 - RNA, 64 nt, Human; identical to SEQ ID NO: 107984

SEQ ID NO: 179494 - RNA, 64 nt, Human; identical to SEQ ID NO: 107985

SEQ ID NO: 179495 - RNA, 64 nt, Human; identical to SEQ ID NO: 107986

SEQ ID NO: 179496 - RNA, 64 nt, Human; identical to SEQ ID NO: 107987

SEQ ID NO: 179497 - RNA, 64 nt, Human
cugagcagcuccaaagcacuggcuugggguccgagaccuucaaaguaaagcaggcggaaugggg

SEQ ID NO: 179498 - RNA, 64 nt, Human; identical to SEQ ID NO: 107988

SEQ ID NO: 179499 - RNA, 64 nt, Human; identical to SEQ ID NO: 107989

SEQ ID NO: 179500 - RNA, 64 nt, Human; identical to SEQ ID NO: 107990

SEQ ID NO: 179501 - RNA, 64 nt, Human; identical to SEQ ID NO: 107991

SEQ ID NO: 179502 - RNA, 64 nt, Human; identical to SEQ ID NO: 107992

SEQ ID NO: 179503 - RNA, 64 nt, Human; identical to SEQ ID NO: 107993

SEQ ID NO: 179504 - RNA, 64 nt, Human; identical to SEQ ID NO: 107994

SEQ ID NO: 179505 - RNA, 64 nt, Human; identical to SEQ ID NO: 107995

SEQ ID NO: 179506 - RNA, 64 nt, Human; identical to SEQ ID NO: 107996

SEQ ID NO: 179507 - RNA, 64 nt, Human; identical to SEQ ID NO: 107997

SEQ ID NO: 179508 - RNA, 64 nt, Human; identical to SEQ ID NO: 107998

SEQ ID NO: 179509 - RNA, 64 nt, Human; identical to SEQ ID NO: 107999

SEQ ID NO: 179510 - RNA, 64 nt, Human; identical to SEQ ID NO: 108000

SEQ ID NO: 179511 - RNA, 64 nt, Human; identical to SEQ ID NO: 108001

SEQ ID NO: 179512 - RNA, 64 nt, Human; identical to SEQ ID NO: 108002

SEQ ID NO: 179513 - RNA, 64 nt, Human; identical to SEQ ID NO: 108003

SEQ ID NO: 179514 - RNA, 64 nt, Human; identical to SEQ ID NO: 108004

SEQ ID NO: 179515 - RNA, 64 nt, Human
ugauuugaaccuguugugguaaagaucuuguacaggaugcaaacuaaaaaccuaaucccugcca

SEQ ID NO: 179516 - RNA, 64 nt, Human; identical to SEQ ID NO: 108005

SEQ ID NO: 179517 - RNA, 64 nt, Human; identical to SEQ ID NO: 108006

SEQ ID NO: 179518 - RNA, 64 nt, Human; identical to SEQ ID NO: 108007

SEQ ID NO: 179519 - RNA, 64 nt, Human; identical to SEQ ID NO: 108008

SEQ ID NO: 179520 - RNA, 64 nt, Human; identical to SEQ ID NO: 108009

SEQ ID NO: 179521 - RNA, 64 nt, Human; identical to SEQ ID NO: 108010

SEQ ID NO: 179522 - RNA, 64 nt, Human; identical to SEQ ID NO: 108011

SEQ ID NO: 179523 - RNA, 64 nt, Human; identical to SEQ ID NO: 108012

SEQ ID NO: 179524 - RNA, 64 nt, Human; identical to SEQ ID NO: 108013

SEQ ID NO: 179525 - RNA, 64 nt, Human; identical to SEQ ID NO: 108014

SEQ ID NO: 179526 - RNA, 64 nt, Human; identical to SEQ ID NO: 107991

SEQ ID NO: 179527 - RNA, 64 nt, Human; identical to SEQ ID NO: 108016

SEQ ID NO: 179528 - RNA, 64 nt, Human; identical to SEQ ID NO: 108017

SEQ ID NO: 179529 - RNA, 64 nt, Human; identical to SEQ ID NO: 108018

SEQ ID NO: 179530 - RNA, 64 nt, Human; identical to SEQ ID NO: 108019

SEQ ID NO: 179531 - RNA, 64 nt, Human; identical to SEQ ID NO: 108020

SEQ ID NO: 179532 - RNA, 64 nt, Human; identical to SEQ ID NO: 108021

SEQ ID NO: 179533 - RNA, 64 nt, Human
ugugcauuuaucuguuuucuguucuguaagucuagaccuucaaaccauuuguaaacuaaccccu

SEQ ID NO: 179534 - RNA, 64 nt, Human; identical to SEQ ID NO: 108022

SEQ ID NO: 179535 - RNA, 64 nt, Human; identical to SEQ ID NO: 108023

SEQ ID NO: 179536 - RNA, 59 nt, Human; identical to SEQ ID NO: 108024

SEQ ID NO: 179537 - RNA, 64 nt, Human; identical to SEQ ID NO: 108025

SEQ ID NO: 179538 - RNA, 64 nt, Human; identical to SEQ ID NO: 108026

SEQ ID NO: 179539 - RNA, 64 nt, Human; identical to SEQ ID NO: 108027

SEQ ID NO: 179540 - RNA, 64 nt, Human; identical to SEQ ID NO: 108028

SEQ ID NO: 179541 - RNA, 64 nt, Human; identical to SEQ ID NO: 108029

SEQ ID NO: 179542 - RNA, 64 nt, Human; identical to SEQ ID NO: 108030

SEQ ID NO: 179543 - RNA, 64 nt, Human; identical to SEQ ID NO: 108031

SEQ ID NO: 179544 - RNA, 64 nt, Human; identical to SEQ ID NO: 108032

SEQ ID NO: 179545 - RNA, 64 nt, Human; identical to SEQ ID NO: 108033

SEQ ID NO: 179546 - RNA, 64 nt, Human; identical to SEQ ID NO: 108034

SEQ ID NO: 179547 - RNA, 64 nt, Human; identical to SEQ ID NO: 108035

SEQ ID NO: 179548 - RNA, 64 nt, Human; identical to SEQ ID NO: 108036

SEQ ID NO: 179549 - RNA, 64 nt, Human; identical to SEQ ID NO: 108037

SEQ ID NO: 179550 - RNA, 64 nt, Human; identical to SEQ ID NO: 108038

SEQ ID NO: 179551 - RNA, 64 nt, Human; identical to SEQ ID NO: 108039

SEQ ID NO: 179552 - RNA, 64 nt, Human; identical to SEQ ID NO: 108040

SEQ ID NO: 179553 - RNA, 64 nt, Human; identical to SEQ ID NO: 108041

SEQ ID NO: 179554 - RNA, 64 nt, Human; identical to SEQ ID NO: 108042

SEQ ID NO: 179555 - RNA, 64 nt, Human; identical to SEQ ID NO: 108043

SEQ ID NO: 179556 - RNA, 64 nt, Human; identical to SEQ ID NO: 108044

SEQ ID NO: 179557 - RNA, 64 nt, Human; identical to SEQ ID NO: 108045

SEQ ID NO: 179558 - RNA, 64 nt, Human; identical to SEQ ID NO: 108046

SEQ ID NO: 179559 - RNA, 64 nt, Human; identical to SEQ ID NO: 108047

SEQ ID NO: 179560 - RNA, 64 nt, Human; identical to SEQ ID NO: 108048

SEQ ID NO: 179561 - RNA, 64 nt, Human; identical to SEQ ID NO: 108049

SEQ ID NO: 179562 - RNA, 64 nt, Human; identical to SEQ ID NO: 108050

SEQ ID NO: 179563 - RNA, 64 nt, Human; identical to SEQ ID NO: 108051

SEQ ID NO: 179564 - RNA, 64 nt, Human; identical to SEQ ID NO: 108052

SEQ ID NO: 179565 - RNA, 64 nt, Human; identical to SEQ ID NO: 108053

SEQ ID NO: 179566 - RNA, 64 nt, Human; identical to SEQ ID NO: 108054

SEQ ID NO: 179567 - RNA, 64 nt, Human; identical to SEQ ID NO: 108055

SEQ ID NO: 179568 - RNA, 64 nt, Human; identical to SEQ ID NO: 108056

SEQ ID NO: 179569 - RNA, 64 nt, Human
agccugagguccccucgucccauccagcuaccaccacggccaccacugcagccgggggcuggcc

SEQ ID NO: 179570 - RNA, 64 nt, Human; identical to SEQ ID NO: 108057

SEQ ID NO: 179571 - RNA, 64 nt, Human; identical to SEQ ID NO: 108058

SEQ ID NO: 179572 - RNA, 64 nt, Human; identical to SEQ ID NO: 108059

SEQ ID NO: 179573 - RNA, 64 nt, Human; identical to SEQ ID NO: 108060

SEQ ID NO: 179574 - RNA, 64 nt, Human; identical to SEQ ID NO: 108061

SEQ ID NO: 179575 - RNA, 64 nt, Human; identical to SEQ ID NO: 108062

SEQ ID NO: 179576 - RNA, 64 nt, Human; identical to SEQ ID NO: 108063

SEQ ID NO: 179577 - RNA, 64 nt, Human; identical to SEQ ID NO: 108064

SEQ ID NO: 179578 - RNA, 64 nt, Human; identical to SEQ ID NO: 108065

SEQ ID NO: 179579 - RNA, 64 nt, Human; identical to SEQ ID NO: 108066

SEQ ID NO: 179580 - RNA, 64 nt, Human; identical to SEQ ID NO: 108067

SEQ ID NO: 179581 - RNA, 64 nt, Human; identical to SEQ ID NO: 108068

SEQ ID NO: 179582 - RNA, 64 nt, Human; identical to SEQ ID NO: 108069

SEQ ID NO: 179583 - RNA, 64 nt, Human; identical to SEQ ID NO: 108070

SEQ ID NO: 179584 - RNA, 64 nt, Human; identical to SEQ ID NO: 108071

SEQ ID NO: 179585 - RNA, 64 nt, Human; identical to SEQ ID NO: 108072

SEQ ID NO: 179586 - RNA, 64 nt, Human; identical to SEQ ID NO: 108073

SEQ ID NO: 179587 - RNA, 64 nt, Human
auucaaaaguauuagacccacacagccuuggagagaccuucagaaacuaaggaggaguuuuaua

SEQ ID NO: 179588 - RNA, 64 nt, Human; identical to SEQ ID NO: 108074

SEQ ID NO: 179589 - RNA, 64 nt, Human; identical to SEQ ID NO: 108075

SEQ ID NO: 179590 - RNA, 64 nt, Human; identical to SEQ ID NO: 108076

SEQ ID NO: 179591 - RNA, 64 nt, Human; identical to SEQ ID NO: 108077

SEQ ID NO: 179592 - RNA, 64 nt, Human; identical to SEQ ID NO: 108078

SEQ ID NO: 179593 - RNA, 64 nt, Human; identical to SEQ ID NO: 108079

SEQ ID NO: 179594 - RNA, 64 nt, Human; identical to SEQ ID NO: 108080

SEQ ID NO: 179595 - RNA, 64 nt, Human; identical to SEQ ID NO: 108081

SEQ ID NO: 179596 - RNA, 64 nt, Human; identical to SEQ ID NO: 108082

SEQ ID NO: 179597 - RNA, 64 nt, Human; identical to SEQ ID NO: 108083

SEQ ID NO: 179598 - RNA, 64 nt, Human; identical to SEQ ID NO: 108084

SEQ ID NO: 179599 - RNA, 64 nt, Human; identical to SEQ ID NO: 108085

SEQ ID NO: 179600 - RNA, 64 nt, Human; identical to SEQ ID NO: 108086

SEQ ID NO: 179601 - RNA, 64 nt, Human; identical to SEQ ID NO: 108087

SEQ ID NO: 179602 - RNA, 64 nt, Human; identical to SEQ ID NO: 108088

SEQ ID NO: 179603 - RNA, 64 nt, Human; identical to SEQ ID NO: 108089

SEQ ID NO: 179604 - RNA, 64 nt, Human; identical to SEQ ID NO: 108090

SEQ ID NO: 179605 - RNA, 64 nt, Human
acucggggccucaggcuucucagcugggaagagaggaugcaagaccagacugaagaacacgguu

SEQ ID NO: 179606 - RNA, 64 nt, Human; identical to SEQ ID NO: 108091

SEQ ID NO: 179607 - RNA, 64 nt, Human; identical to SEQ ID NO: 108092

SEQ ID NO: 179608 - RNA, 64 nt, Human; identical to SEQ ID NO: 108093

SEQ ID NO: 179609 - RNA, 64 nt, Human; identical to SEQ ID NO: 108094

SEQ ID NO: 179610 - RNA, 64 nt, Human; identical to SEQ ID NO: 108095

SEQ ID NO: 179611 - RNA, 64 nt, Human; identical to SEQ ID NO: 108096

SEQ ID NO: 179612 - RNA, 64 nt, Human; identical to SEQ ID NO: 108097

SEQ ID NO: 179613 - RNA, 64 nt, Human; identical to SEQ ID NO: 108098

SEQ ID NO: 179614 - RNA, 64 nt, Human; identical to SEQ ID NO: 108099

SEQ ID NO: 179615 - RNA, 64 nt, Human; identical to SEQ ID NO: 108100

SEQ ID NO: 179616 - RNA, 64 nt, Human; identical to SEQ ID NO: 108101

SEQ ID NO: 179617 - RNA, 64 nt, Human; identical to SEQ ID NO: 108102

SEQ ID NO: 179618 - RNA, 64 nt, Human; identical to SEQ ID NO: 108103

SEQ ID NO: 179619 - RNA, 64 nt, Human; identical to SEQ ID NO: 108104

SEQ ID NO: 179620 - RNA, 64 nt, Human; identical to SEQ ID NO: 108105

SEQ ID NO: 179621 - RNA, 64 nt, Human; identical to SEQ ID NO: 108106

SEQ ID NO: 179622 - RNA, 64 nt, Human; identical to SEQ ID NO: 108107

SEQ ID NO: 179623 - RNA, 64 nt, Human; identical to SEQ ID NO: 108108

SEQ ID NO: 179624 - RNA, 64 nt, Human; identical to SEQ ID NO: 108109

SEQ ID NO: 179625 - RNA, 64 nt, Human; identical to SEQ ID NO: 108110

SEQ ID NO: 179626 - RNA, 64 nt, Human; identical to SEQ ID NO: 108111

SEQ ID NO: 179627 - RNA, 64 nt, Human; identical to SEQ ID NO: 108112

SEQ ID NO: 179628 - RNA, 64 nt, Human; identical to SEQ ID NO: 108113

SEQ ID NO: 179629 - RNA, 64 nt, Human; identical to SEQ ID NO: 108114

SEQ ID NO: 179630 - RNA, 64 nt, Human; identical to SEQ ID NO: 108115

SEQ ID NO: 179631 - RNA, 64 nt, Human; identical to SEQ ID NO: 108116

SEQ ID NO: 179632 - RNA, 64 nt, Human; identical to SEQ ID NO: 108117

SEQ ID NO: 179633 - RNA, 64 nt, Human; identical to SEQ ID NO: 108118

SEQ ID NO: 179634 - RNA, 64 nt, Human; identical to SEQ ID NO: 108119

SEQ ID NO: 179635 - RNA, 64 nt, Human; identical to SEQ ID NO: 108120

SEQ ID NO: 179636 - RNA, 64 nt, Human; identical to SEQ ID NO: 108121

SEQ ID NO: 179637 - RNA, 64 nt, Human; identical to SEQ ID NO: 108122

SEQ ID NO: 179638 - RNA, 64 nt, Human; identical to SEQ ID NO: 108123

SEQ ID NO: 179639 - RNA, 64 nt, Human; identical to SEQ ID NO: 108124

SEQ ID NO: 179640 - RNA, 64 nt, Human
ucugggaggcaggucccgagcccccuguccuucccacggccacugcagucaccccugucugcgc

SEQ ID NO: 179641 - RNA, 64 nt, Human; identical to SEQ ID NO: 108125

SEQ ID NO: 179642 - RNA, 64 nt, Human; identical to SEQ ID NO: 108126

SEQ ID NO: 179643 - RNA, 64 nt, Human; identical to SEQ ID NO: 108127

SEQ ID NO: 179644 - RNA, 64 nt, Human; identical to SEQ ID NO: 108128

SEQ ID NO: 179645 - RNA, 64 nt, Human; identical to SEQ ID NO: 108129

SEQ ID NO: 179646 - RNA, 64 nt, Human; identical to SEQ ID NO: 108130

SEQ ID NO: 179647 - RNA, 64 nt, Human; identical to SEQ ID NO: 108131

SEQ ID NO: 179648 - RNA, 64 nt, Human; identical to SEQ ID NO: 108132

SEQ ID NO: 179649 - RNA, 64 nt, Human; identical to SEQ ID NO: 108133

SEQ ID NO: 179650 - RNA, 64 nt, Human; identical to SEQ ID NO: 108134

SEQ ID NO: 179651 - RNA, 64 nt, Human; identical to SEQ ID NO: 108135

SEQ ID NO: 179652 - RNA, 64 nt, Human; identical to SEQ ID NO: 108136

SEQ ID NO: 179653 - RNA, 64 nt, Human; identical to SEQ ID NO: 108137

SEQ ID NO: 179654 - RNA, 64 nt, Human; identical to SEQ ID NO: 108138

SEQ ID NO: 179655 - RNA, 64 nt, Human; identical to SEQ ID NO: 108139

SEQ ID NO: 179656 - RNA, 64 nt, Human; identical to SEQ ID NO: 108140

SEQ ID NO: 179657 - RNA, 64 nt, Human; identical to SEQ ID NO: 108141

SEQ ID NO: 179658 - RNA, 64 nt, Human
gaccuucugaagauucacuacugguguauccuuggaccuucacauuuuacuuuaggauuaauuu

SEQ ID NO: 179659 - RNA, 64 nt, Human; identical to SEQ ID NO: 108142

SEQ ID NO: 179660 - RNA, 64 nt, Human; identical to SEQ ID NO: 108143

SEQ ID NO: 179661 - RNA, 64 nt, Human; identical to SEQ ID NO: 108144

SEQ ID NO: 179662 - RNA, 64 nt, Human; identical to SEQ ID NO: 108145

SEQ ID NO: 179663 - RNA, 64 nt, Human; identical to SEQ ID NO: 108146

SEQ ID NO: 179664 - RNA, 64 nt, Human; identical to SEQ ID NO: 108147

SEQ ID NO: 179665 - RNA, 64 nt, Human; identical to SEQ ID NO: 108148

SEQ ID NO: 179666 - RNA, 64 nt, Human; identical to SEQ ID NO: 108149

SEQ ID NO: 179667 - RNA, 64 nt, Human; identical to SEQ ID NO: 108150

SEQ ID NO: 179668 - RNA, 64 nt, Human; identical to SEQ ID NO: 108151

SEQ ID NO: 179669 - RNA, 64 nt, Human; identical to SEQ ID NO: 108152

SEQ ID NO: 179670 - RNA, 64 nt, Human; identical to SEQ ID NO: 108153

SEQ ID NO: 179671 - RNA, 64 nt, Human; identical to SEQ ID NO: 108154

SEQ ID NO: 179672 - RNA, 64 nt, Human; identical to SEQ ID NO: 108155

SEQ ID NO: 179673 - RNA, 64 nt, Human; identical to SEQ ID NO: 108156

SEQ ID NO: 179674 - RNA, 64 nt, Human; identical to SEQ ID NO: 108157

SEQ ID NO: 179675 - RNA, 64 nt, Human; identical to SEQ ID NO: 108158

SEQ ID NO: 179676 - RNA, 64 nt, Human
gagguauuuacccagaggauuuuccuaugguuggggaugcaaauauuagaaaacagauuguauu

SEQ ID NO: 179677 - RNA, 64 nt, Human; identical to SEQ ID NO: 108159

SEQ ID NO: 179678 - RNA, 64 nt, Human; identical to SEQ ID NO: 108160

SEQ ID NO: 179679 - RNA, 64 nt, Human; identical to SEQ ID NO: 108161

SEQ ID NO: 179680 - RNA, 64 nt, Human; identical to SEQ ID NO: 108162

SEQ ID NO: 179681 - RNA, 64 nt, Human; identical to SEQ ID NO: 108163

SEQ ID NO: 179682 - RNA, 64 nt, Human; identical to SEQ ID NO: 108164

SEQ ID NO: 179683 - RNA, 64 nt, Human; identical to SEQ ID NO: 108165

SEQ ID NO: 179684 - RNA, 64 nt, Human; identical to SEQ ID NO: 108166

SEQ ID NO: 179685 - RNA, 64 nt, Human; identical to SEQ ID NO: 108167

SEQ ID NO: 179686 - RNA, 64 nt, Human; identical to SEQ ID NO: 108168

SEQ ID NO: 179687 - RNA, 64 nt, Human; identical to SEQ ID NO: 108169

SEQ ID NO: 179688 - RNA, 64 nt, Human; identical to SEQ ID NO: 108170

SEQ ID NO: 179689 - RNA, 64 nt, Human; identical to SEQ ID NO: 108171

SEQ ID NO: 179690 - RNA, 64 nt, Human; identical to SEQ ID NO: 108172

SEQ ID NO: 179691 - RNA, 64 nt, Human; identical to SEQ ID NO: 108173

SEQ ID NO: 179692 - RNA, 64 nt, Human; identical to SEQ ID NO: 108174

SEQ ID NO: 179693 - RNA, 64 nt, Human; identical to SEQ ID NO: 108175

SEQ ID NO: 179694 - RNA, 64 nt, Human
uuacucuacuuggccaggccacaguaaaacaagugaccuucagagcagcugccacaacuggcca

SEQ ID NO: 179695 - RNA, 64 nt, Human; identical to SEQ ID NO: 108176

SEQ ID NO: 179696 - RNA, 64 nt, Human; identical to SEQ ID NO: 108177

SEQ ID NO: 179697 - RNA, 64 nt, Human; identical to SEQ ID NO: 108178

SEQ ID NO: 179698 - RNA, 64 nt, Human; identical to SEQ ID NO: 108179

SEQ ID NO: 179699 - RNA, 64 nt, Human; identical to SEQ ID NO: 108180

SEQ ID NO: 179700 - RNA, 64 nt, Human; identical to SEQ ID NO: 108181

SEQ ID NO: 179701 - RNA, 64 nt, Human; identical to SEQ ID NO: 108182

SEQ ID NO: 179702 - RNA, 64 nt, Human; identical to SEQ ID NO: 108183

SEQ ID NO: 179703 - RNA, 64 nt, Human; identical to SEQ ID NO: 108184

SEQ ID NO: 179704 - RNA, 64 nt, Human; identical to SEQ ID NO: 108185

SEQ ID NO: 179705 - RNA, 64 nt, Human; identical to SEQ ID NO: 108186

SEQ ID NO: 179706 - RNA, 64 nt, Human; identical to SEQ ID NO: 108187

SEQ ID NO: 179707 - RNA, 64 nt, Human; identical to SEQ ID NO: 108188

SEQ ID NO: 179708 - RNA, 50 nt, Human; identical to SEQ ID NO: 108189

SEQ ID NO: 179709 - RNA, 64 nt, Human; identical to SEQ ID NO: 108190

SEQ ID NO: 179710 - RNA, 64 nt, Human; identical to SEQ ID NO: 108191

SEQ ID NO: 179711 - RNA, 64 nt, Human; identical to SEQ ID NO: 108192

SEQ ID NO: 179712 - RNA, 64 nt, Human; identical to SEQ ID NO: 108193

SEQ ID NO: 179713 - RNA, 64 nt, Human; identical to SEQ ID NO: 108194

SEQ ID NO: 179714 - RNA, 64 nt, Human; identical to SEQ ID NO: 108195

SEQ ID NO: 179715 - RNA, 64 nt, Human; identical to SEQ ID NO: 108196

SEQ ID NO: 179716 - RNA, 64 nt, Human; identical to SEQ ID NO: 108197

SEQ ID NO: 179717 - RNA, 64 nt, Human; identical to SEQ ID NO: 108198

SEQ ID NO: 179718 - RNA, 64 nt, Human; identical to SEQ ID NO: 108199

SEQ ID NO: 179719 - RNA, 64 nt, Human; identical to SEQ ID NO: 108200

SEQ ID NO: 179720 - RNA, 64 nt, Human; identical to SEQ ID NO: 108201

SEQ ID NO: 179721 - RNA, 64 nt, Human; identical to SEQ ID NO: 108202

SEQ ID NO: 179722 - RNA, 64 nt, Human; identical to SEQ ID NO: 108203

SEQ ID NO: 179723 - RNA, 64 nt, Human; identical to SEQ ID NO: 108204

SEQ ID NO: 179724 - RNA, 64 nt, Human; identical to SEQ ID NO: 108205

SEQ ID NO: 179725 - RNA, 64 nt, Human; identical to SEQ ID NO: 108206

SEQ ID NO: 179726 - RNA, 64 nt, Human; identical to SEQ ID NO: 108207

SEQ ID NO: 179727 - RNA, 64 nt, Human; identical to SEQ ID NO: 108208

SEQ ID NO: 179728 - RNA, 64 nt, Human; identical to SEQ ID NO: 108209

SEQ ID NO: 179729 - RNA, 64 nt, Human; identical to SEQ ID NO: 108210

SEQ ID NO: 179730 - RNA, 64 nt, Human
cccagacaauaaaccauccucuuccaacccacgccacggccaugcugugggggaccugcuccuc

SEQ ID NO: 179731 - RNA, 64 nt, Human; identical to SEQ ID NO: 108211

SEQ ID NO: 179732 - RNA, 64 nt, Human; identical to SEQ ID NO: 108212

SEQ ID NO: 179733 - RNA, 64 nt, Human; identical to SEQ ID NO: 108213

SEQ ID NO: 179734 - RNA, 64 nt, Human; identical to SEQ ID NO: 108214

SEQ ID NO: 179735 - RNA, 64 nt, Human; identical to SEQ ID NO: 108215

SEQ ID NO: 179736 - RNA, 64 nt, Human; identical to SEQ ID NO: 108216

SEQ ID NO: 179737 - RNA, 64 nt, Human; identical to SEQ ID NO: 108217

SEQ ID NO: 179738 - RNA, 64 nt, Human; identical to SEQ ID NO: 108218

SEQ ID NO: 179739 - RNA, 64 nt, Human; identical to SEQ ID NO: 108219

SEQ ID NO: 179740 - RNA, 64 nt, Human; identical to SEQ ID NO: 108220

SEQ ID NO: 179741 - RNA, 64 nt, Human; identical to SEQ ID NO: 108221

SEQ ID NO: 179742 - RNA, 64 nt, Human; identical to SEQ ID NO: 108222

SEQ ID NO: 179743 - RNA, 64 nt, Human; identical to SEQ ID NO: 108223

SEQ ID NO: 179744 - RNA, 64 nt, Human; identical to SEQ ID NO: 108224

SEQ ID NO: 179745 - RNA, 64 nt, Human; identical to SEQ ID NO: 108225

SEQ ID NO: 179746 - RNA, 64 nt, Human; identical to SEQ ID NO: 108226

SEQ ID NO: 179747 - RNA, 64 nt, Human; identical to SEQ ID NO: 108227

SEQ ID NO: 179748 - RNA, 64 nt, Human
gagagaaaccuuacgaauguauuaaaugugggaagaccuucagcuguaguucaaaccuuacugu

SEQ ID NO: 179749 - RNA, 64 nt, Human; identical to SEQ ID NO: 108228

SEQ ID NO: 179750 - RNA, 64 nt, Human; identical to SEQ ID NO: 108229

SEQ ID NO: 179751 - RNA, 64 nt, Human; identical to SEQ ID NO: 108230

SEQ ID NO: 179752 - RNA, 64 nt, Human; identical to SEQ ID NO: 108231

SEQ ID NO: 179753 - RNA, 64 nt, Human; identical to SEQ ID NO: 108232

SEQ ID NO: 179754 - RNA, 64 nt, Human; identical to SEQ ID NO: 108233

SEQ ID NO: 179755 - RNA, 64 nt, Human; identical to SEQ ID NO: 108234

SEQ ID NO: 179756 - RNA, 64 nt, Human; identical to SEQ ID NO: 108235

SEQ ID NO: 179757 - RNA, 64 nt, Human; identical to SEQ ID NO: 108236

SEQ ID NO: 179758 - RNA, 64 nt, Human; identical to SEQ ID NO: 108237

SEQ ID NO: 179759 - RNA, 64 nt, Human; identical to SEQ ID NO: 108238

SEQ ID NO: 179760 - RNA, 64 nt, Human; identical to SEQ ID NO: 108239

SEQ ID NO: 179761 - RNA, 64 nt, Human; identical to SEQ ID NO: 108240

SEQ ID NO: 179762 - RNA, 64 nt, Human; identical to SEQ ID NO: 108241

SEQ ID NO: 179763 - RNA, 64 nt, Human; identical to SEQ ID NO: 108242

SEQ ID NO: 179764 - RNA, 64 nt, Human; identical to SEQ ID NO: 108243

SEQ ID NO: 179765 - RNA, 64 nt, Human; identical to SEQ ID NO: 108244

SEQ ID NO: 179766 - RNA, 64 nt, Human; identical to SEQ ID NO: 84554

SEQ ID NO: 179767 - RNA, 64 nt, Human; identical to SEQ ID NO: 108245

SEQ ID NO: 179768 - RNA, 64 nt, Human; identical to SEQ ID NO: 108246

SEQ ID NO: 179769 - RNA, 64 nt, Human; identical to SEQ ID NO: 108247

SEQ ID NO: 179770 - RNA, 64 nt, Human; identical to SEQ ID NO: 108248

SEQ ID NO: 179771 - RNA, 64 nt, Human; identical to SEQ ID NO: 108249

SEQ ID NO: 179772 - RNA, 64 nt, Human; identical to SEQ ID NO: 108250

SEQ ID NO: 179773 - RNA, 64 nt, Human; identical to SEQ ID NO: 108251

SEQ ID NO: 179774 - RNA, 64 nt, Human; identical to SEQ ID NO: 108252

SEQ ID NO: 179775 - RNA, 64 nt, Human; identical to SEQ ID NO: 108253

SEQ ID NO: 179776 - RNA, 64 nt, Human; identical to SEQ ID NO: 108254

SEQ ID NO: 179777 - RNA, 64 nt, Human; identical to SEQ ID NO: 108255

SEQ ID NO: 179778 - RNA, 64 nt, Human; identical to SEQ ID NO: 108256

SEQ ID NO: 179779 - RNA, 64 nt, Human; identical to SEQ ID NO: 108257

SEQ ID NO: 179780 - RNA, 64 nt, Human; identical to SEQ ID NO: 108258

SEQ ID NO: 179781 - RNA, 64 nt, Human; identical to SEQ ID NO: 108259

SEQ ID NO: 179782 - RNA, 64 nt, Human; identical to SEQ ID NO: 108260

SEQ ID NO: 179783 - RNA, 64 nt, Human; identical to SEQ ID NO: 108261

SEQ ID NO: 179784 - RNA, 64 nt, Human
auaguagggaaacguggagauaaucaacacucaggaccuucagccuugaacgcccauuagugcu

SEQ ID NO: 179785 - RNA, 64 nt, Human; identical to SEQ ID NO: 108262

SEQ ID NO: 179786 - RNA, 64 nt, Human; identical to SEQ ID NO: 108263

SEQ ID NO: 179787 - RNA, 64 nt, Human; identical to SEQ ID NO: 108264

SEQ ID NO: 179788 - RNA, 64 nt, Human; identical to SEQ ID NO: 108265

SEQ ID NO: 179789 - RNA, 64 nt, Human; identical to SEQ ID NO: 108266

SEQ ID NO: 179790 - RNA, 64 nt, Human; identical to SEQ ID NO: 108267

SEQ ID NO: 179791 - RNA, 64 nt, Human; identical to SEQ ID NO: 108268

SEQ ID NO: 179792 - RNA, 64 nt, Human; identical to SEQ ID NO: 108269

SEQ ID NO: 179793 - RNA, 64 nt, Human; identical to SEQ ID NO: 108270

SEQ ID NO: 179794 - RNA, 64 nt, Human; identical to SEQ ID NO: 108271

SEQ ID NO: 179795 - RNA, 64 nt, Human; identical to SEQ ID NO: 108272

SEQ ID NO: 179796 - RNA, 64 nt, Human; identical to SEQ ID NO: 108273

SEQ ID NO: 179797 - RNA, 64 nt, Human; identical to SEQ ID NO: 108274

SEQ ID NO: 179798 - RNA, 64 nt, Human; identical to SEQ ID NO: 108275

SEQ ID NO: 179799 - RNA, 64 nt, Human; identical to SEQ ID NO: 108276

SEQ ID NO: 179800 - RNA, 64 nt, Human; identical to SEQ ID NO: 108277

SEQ ID NO: 179801 - RNA, 64 nt, Human; identical to SEQ ID NO: 108278

SEQ ID NO: 179802 - RNA, 64 nt, Human
ucgguacugggcccccaggccauccaggcuuugccacggccaguugguccucccuggggaacug

SEQ ID NO: 179803 - RNA, 64 nt, Human; identical to SEQ ID NO: 108279

SEQ ID NO: 179804 - RNA, 64 nt, Human; identical to SEQ ID NO: 108280

SEQ ID NO: 179805 - RNA, 64 nt, Human; identical to SEQ ID NO: 108281

SEQ ID NO: 179806 - RNA, 64 nt, Human; identical to SEQ ID NO: 108282

SEQ ID NO: 179807 - RNA, 64 nt, Human; identical to SEQ ID NO: 108283

SEQ ID NO: 179808 - RNA, 64 nt, Human; identical to SEQ ID NO: 108284

SEQ ID NO: 179809 - RNA, 64 nt, Human; identical to SEQ ID NO: 108285

SEQ ID NO: 179810 - RNA, 64 nt, Human; identical to SEQ ID NO: 108286

SEQ ID NO: 179811 - RNA, 64 nt, Human; identical to SEQ ID NO: 108287

SEQ ID NO: 179812 - RNA, 64 nt, Human; identical to SEQ ID NO: 108288

SEQ ID NO: 179813 - RNA, 64 nt, Human; identical to SEQ ID NO: 108289

SEQ ID NO: 179814 - RNA, 64 nt, Human; identical to SEQ ID NO: 108290

SEQ ID NO: 179815 - RNA, 64 nt, Human; identical to SEQ ID NO: 108291

SEQ ID NO: 179816 - RNA, 64 nt, Human; identical to SEQ ID NO: 108292

SEQ ID NO: 179817 - RNA, 64 nt, Human; identical to SEQ ID NO: 108293

SEQ ID NO: 179818 - RNA, 64 nt, Human; identical to SEQ ID NO: 108294

SEQ ID NO: 179819 - RNA, 64 nt, Human; identical to SEQ ID NO: 108295

SEQ ID NO: 179820 - RNA, 64 nt, Human
uuaugcaugugugugcacaugcauguaaaccagggaccuucagcucacggccuccaggccuggg

SEQ ID NO: 179821 - RNA, 64 nt, Human; identical to SEQ ID NO: 108296

SEQ ID NO: 179822 - RNA, 64 nt, Human; identical to SEQ ID NO: 108297

SEQ ID NO: 179823 - RNA, 64 nt, Human; identical to SEQ ID NO: 108298

SEQ ID NO: 179824 - RNA, 64 nt, Human; identical to SEQ ID NO: 108299

SEQ ID NO: 179825 - RNA, 64 nt, Human; identical to SEQ ID NO: 108300

SEQ ID NO: 179826 - RNA, 64 nt, Human; identical to SEQ ID NO: 108301

SEQ ID NO: 179827 - RNA, 64 nt, Human; identical to SEQ ID NO: 108302

SEQ ID NO: 179828 - RNA, 64 nt, Human; identical to SEQ ID NO: 108303

SEQ ID NO: 179829 - RNA, 64 nt, Human; identical to SEQ ID NO: 108304

SEQ ID NO: 179830 - RNA, 64 nt, Human; identical to SEQ ID NO: 108305

SEQ ID NO: 179831 - RNA, 64 nt, Human; identical to SEQ ID NO: 108306

SEQ ID NO: 179832 - RNA, 64 nt, Human; identical to SEQ ID NO: 108307

SEQ ID NO: 179833 - RNA, 64 nt, Human; identical to SEQ ID NO: 108308

SEQ ID NO: 179834 - RNA, 64 nt, Human; identical to SEQ ID NO: 108309

SEQ ID NO: 179835 - RNA, 64 nt, Human; identical to SEQ ID NO: 108310

SEQ ID NO: 179836 - RNA, 64 nt, Human; identical to SEQ ID NO: 108311

SEQ ID NO: 179837 - RNA, 64 nt, Human; identical to SEQ ID NO: 108312

SEQ ID NO: 179838 - RNA, 64 nt, Human
gagagaaaccuugaaaguguaaugaguguggcaagaccuucagucagaugucaaaccuuguaua

SEQ ID NO: 179839 - RNA, 64 nt, Human; identical to SEQ ID NO: 108313

SEQ ID NO: 179840 - RNA, 64 nt, Human; identical to SEQ ID NO: 108314

SEQ ID NO: 179841 - RNA, 64 nt, Human; identical to SEQ ID NO: 108315

SEQ ID NO: 179842 - RNA, 64 nt, Human; identical to SEQ ID NO: 108316

SEQ ID NO: 179843 - RNA, 64 nt, Human; identical to SEQ ID NO: 108317

SEQ ID NO: 179844 - RNA, 64 nt, Human; identical to SEQ ID NO: 108318

SEQ ID NO: 179845 - RNA, 64 nt, Human; identical to SEQ ID NO: 108319

SEQ ID NO: 179846 - RNA, 64 nt, Human; identical to SEQ ID NO: 108320

SEQ ID NO: 179847 - RNA, 64 nt, Human; identical to SEQ ID NO: 108321

SEQ ID NO: 179848 - RNA, 64 nt, Human; identical to SEQ ID NO: 108322

SEQ ID NO: 179849 - RNA, 64 nt, Human; identical to SEQ ID NO: 108323

SEQ ID NO: 179850 - RNA, 64 nt, Human; identical to SEQ ID NO: 108324

SEQ ID NO: 179851 - RNA, 64 nt, Human; identical to SEQ ID NO: 108325

SEQ ID NO: 179852 - RNA, 64 nt, Human; identical to SEQ ID NO: 108326

SEQ ID NO: 179853 - RNA, 64 nt, Human; identical to SEQ ID NO: 108327

SEQ ID NO: 179854 - RNA, 64 nt, Human; identical to SEQ ID NO: 108328

SEQ ID NO: 179855 - RNA, 64 nt, Human; identical to SEQ ID NO: 108329

SEQ ID NO: 179856 - RNA, 64 nt, Human
gaaucauguuuuguuaauccgcuucacuaaauuggaccuucacauaucuaaaaagcucugaagu

SEQ ID NO: 179857 - RNA, 64 nt, Human; identical to SEQ ID NO: 108330

SEQ ID NO: 179858 - RNA, 64 nt, Human; identical to SEQ ID NO: 108331

SEQ ID NO: 179859 - RNA, 64 nt, Human; identical to SEQ ID NO: 108332

SEQ ID NO: 179860 - RNA, 64 nt, Human; identical to SEQ ID NO: 108333

SEQ ID NO: 179861 - RNA, 64 nt, Human; identical to SEQ ID NO: 108334

SEQ ID NO: 179862 - RNA, 64 nt, Human; identical to SEQ ID NO: 108335

SEQ ID NO: 179863 - RNA, 64 nt, Human; identical to SEQ ID NO: 108336

SEQ ID NO: 179864 - RNA, 64 nt, Human; identical to SEQ ID NO: 108337

SEQ ID NO: 179865 - RNA, 64 nt, Human; identical to SEQ ID NO: 108338

SEQ ID NO: 179866 - RNA, 64 nt, Human; identical to SEQ ID NO: 108339

SEQ ID NO: 179867 - RNA, 64 nt, Human; identical to SEQ ID NO: 108340

SEQ ID NO: 179868 - RNA, 64 nt, Human; identical to SEQ ID NO: 108341

SEQ ID NO: 179869 - RNA, 64 nt, Human; identical to SEQ ID NO: 108342

SEQ ID NO: 179870 - RNA, 64 nt, Human; identical to SEQ ID NO: 108343

SEQ ID NO: 179871 - RNA, 64 nt, Human; identical to SEQ ID NO: 108344

SEQ ID NO: 179872 - RNA, 64 nt, Human; identical to SEQ ID NO: 108345

SEQ ID NO: 179873 - RNA, 64 nt, Human; identical to SEQ ID NO: 108346

SEQ ID NO: 179874 - RNA, 64 nt, Human; identical to SEQ ID NO: 108347

SEQ ID NO: 179875 - RNA, 64 nt, Human; identical to SEQ ID NO: 108348

SEQ ID NO: 179876 - RNA, 64 nt, Human; identical to SEQ ID NO: 108349

SEQ ID NO: 179877 - RNA, 64 nt, Human; identical to SEQ ID NO: 108350

SEQ ID NO: 179878 - RNA, 64 nt, Human; identical to SEQ ID NO: 108351

SEQ ID NO: 179879 - RNA, 64 nt, Human; identical to SEQ ID NO: 108352

SEQ ID NO: 179880 - RNA, 64 nt, Human; identical to SEQ ID NO: 108353

SEQ ID NO: 179881 - RNA, 64 nt, Human; identical to SEQ ID NO: 108354

SEQ ID NO: 179882 - RNA, 64 nt, Human; identical to SEQ ID NO: 108355

SEQ ID NO: 179883 - RNA, 64 nt, Human; identical to SEQ ID NO: 108356

SEQ ID NO: 179884 - RNA, 64 nt, Human; identical to SEQ ID NO: 108357

SEQ ID NO: 179885 - RNA, 64 nt, Human; identical to SEQ ID NO: 108358

SEQ ID NO: 179886 - RNA, 64 nt, Human; identical to SEQ ID NO: 108359

SEQ ID NO: 179887 - RNA, 64 nt, Human; identical to SEQ ID NO: 108360

SEQ ID NO: 179888 - RNA, 64 nt, Human; identical to SEQ ID NO: 108361

SEQ ID NO: 179889 - RNA, 64 nt, Human; identical to SEQ ID NO: 108362

SEQ ID NO: 179890 - RNA, 64 nt, Human; identical to SEQ ID NO: 108363

SEQ ID NO: 179891 - RNA, 64 nt, Human; identical to SEQ ID NO: 108364

SEQ ID NO: 179892 - RNA, 64 nt, Human
uucuuggagcccuuuugcagucagcagcaucuauggaugcaaauccagccacagcagacaauca

SEQ ID NO: 179893 - RNA, 64 nt, Human; identical to SEQ ID NO: 108365

SEQ ID NO: 179894 - RNA, 64 nt, Human; identical to SEQ ID NO: 108366

SEQ ID NO: 179895 - RNA, 64 nt, Human; identical to SEQ ID NO: 108367

SEQ ID NO: 179896 - RNA, 64 nt, Human; identical to SEQ ID NO: 108368

SEQ ID NO: 179897 - RNA, 64 nt, Human; identical to SEQ ID NO: 108369

SEQ ID NO: 179898 - RNA, 64 nt, Human; identical to SEQ ID NO: 108370

SEQ ID NO: 179899 - RNA, 64 nt, Human; identical to SEQ ID NO: 108371

SEQ ID NO: 179900 - RNA, 64 nt, Human; identical to SEQ ID NO: 108372

SEQ ID NO: 179901 - RNA, 58 nt, Human; identical to SEQ ID NO: 108373

SEQ ID NO: 179902 - RNA, 64 nt, Human; identical to SEQ ID NO: 108374

SEQ ID NO: 179903 - RNA, 64 nt, Human; identical to SEQ ID NO: 108375

SEQ ID NO: 179904 - RNA, 64 nt, Human; identical to SEQ ID NO: 108376

SEQ ID NO: 179905 - RNA, 64 nt, Human; identical to SEQ ID NO: 108377

SEQ ID NO: 179906 - RNA, 64 nt, Human; identical to SEQ ID NO: 108378

SEQ ID NO: 179907 - RNA, 64 nt, Human; identical to SEQ ID NO: 108379

SEQ ID NO: 179908 - RNA, 64 nt, Human; identical to SEQ ID NO: 108380

SEQ ID NO: 179909 - RNA, 64 nt, Human; identical to SEQ ID NO: 108381

SEQ ID NO: 179910 - RNA, 51 nt, Human
acgcuaucacaacagcaugacgaccuucaccaggaccugacuucaaaccug

SEQ ID NO: 179911 - RNA, 64 nt, Human; identical to SEQ ID NO: 108382

SEQ ID NO: 179912 - RNA, 64 nt, Human; identical to SEQ ID NO: 108383

SEQ ID NO: 179913 - RNA, 64 nt, Human; identical to SEQ ID NO: 108384

SEQ ID NO: 179914 - RNA, 64 nt, Human; identical to SEQ ID NO: 108385

SEQ ID NO: 179915 - RNA, 64 nt, Human; identical to SEQ ID NO: 108386

SEQ ID NO: 179916 - RNA, 60 nt, Human; identical to SEQ ID NO: 108387

SEQ ID NO: 179917 - RNA, 64 nt, Human; identical to SEQ ID NO: 108388

SEQ ID NO: 179918 - RNA, 64 nt, Human; identical to SEQ ID NO: 108389

SEQ ID NO: 179919 - RNA, 64 nt, Human; identical to SEQ ID NO: 108390

SEQ ID NO: 179920 - RNA, 64 nt, Human; identical to SEQ ID NO: 108391

SEQ ID NO: 179921 - RNA, 64 nt, Human; identical to SEQ ID NO: 108392

SEQ ID NO: 179922 - RNA, 64 nt, Human; identical to SEQ ID NO: 108393

SEQ ID NO: 179923 - RNA, 64 nt, Human; identical to SEQ ID NO: 108394

SEQ ID NO: 179924 - RNA, 64 nt, Human; identical to SEQ ID NO: 108395

SEQ ID NO: 179925 - RNA, 64 nt, Human; identical to SEQ ID NO: 108396

SEQ ID NO: 179926 - RNA, 64 nt, Human; identical to SEQ ID NO: 108397

SEQ ID NO: 179927 - RNA, 64 nt, Human; identical to SEQ ID NO: 108398

SEQ ID NO: 179928 - RNA, 64 nt, Human
gcugagaacaucucugccuaauuuaccaaagccagaccuucaguucaacaugcuuccuuagcuu

SEQ ID NO: 179929 - RNA, 64 nt, Human; identical to SEQ ID NO: 108399

SEQ ID NO: 179930 - RNA, 64 nt, Human; identical to SEQ ID NO: 108400

SEQ ID NO: 179931 - RNA, 64 nt, Human; identical to SEQ ID NO: 108401

SEQ ID NO: 179932 - RNA, 64 nt, Human; identical to SEQ ID NO: 108402

SEQ ID NO: 179933 - RNA, 64 nt, Human; identical to SEQ ID NO: 108403

SEQ ID NO: 179934 - RNA, 64 nt, Human; identical to SEQ ID NO: 108404

SEQ ID NO: 179935 - RNA, 64 nt, Human; identical to SEQ ID NO: 108405

SEQ ID NO: 179936 - RNA, 64 nt, Human; identical to SEQ ID NO: 108406

SEQ ID NO: 179937 - RNA, 64 nt, Human; identical to SEQ ID NO: 108407

SEQ ID NO: 179938 - RNA, 64 nt, Human; identical to SEQ ID NO: 108408

SEQ ID NO: 179939 - RNA, 64 nt, Human; identical to SEQ ID NO: 108409

SEQ ID NO: 179940 - RNA, 64 nt, Human; identical to SEQ ID NO: 108410

SEQ ID NO: 179941 - RNA, 64 nt, Human; identical to SEQ ID NO: 108411

SEQ ID NO: 179942 - RNA, 64 nt, Human; identical to SEQ ID NO: 108412

SEQ ID NO: 179943 - RNA, 64 nt, Human; identical to SEQ ID NO: 108413

SEQ ID NO: 179944 - RNA, 64 nt, Human; identical to SEQ ID NO: 108414

SEQ ID NO: 179945 - RNA, 64 nt, Human; identical to SEQ ID NO: 108415

SEQ ID NO: 179946 - RNA, 64 nt, Human
cacggacuccaggcgguccccacccacagaagcagaccuucagcucagguaagagggcgcccac

SEQ ID NO: 179947 - RNA, 64 nt, Human; identical to SEQ ID NO: 108416

SEQ ID NO: 179948 - RNA, 64 nt, Human; identical to SEQ ID NO: 108417

SEQ ID NO: 179949 - RNA, 64 nt, Human; identical to SEQ ID NO: 108418

SEQ ID NO: 179950 - RNA, 64 nt, Human; identical to SEQ ID NO: 108419

SEQ ID NO: 179951 - RNA, 64 nt, Human; identical to SEQ ID NO: 108420

SEQ ID NO: 179952 - RNA, 64 nt, Human; identical to SEQ ID NO: 108421

SEQ ID NO: 179953 - RNA, 64 nt, Human; identical to SEQ ID NO: 108422

SEQ ID NO: 179954 - RNA, 64 nt, Human; identical to SEQ ID NO: 108423

SEQ ID NO: 179955 - RNA, 64 nt, Human; identical to SEQ ID NO: 108424

SEQ ID NO: 179956 - RNA, 64 nt, Human; identical to SEQ ID NO: 108425

SEQ ID NO: 179957 - RNA, 64 nt, Human; identical to SEQ ID NO: 108426

SEQ ID NO: 179958 - RNA, 64 nt, Human; identical to SEQ ID NO: 108427

SEQ ID NO: 179959 - RNA, 64 nt, Human; identical to SEQ ID NO: 108428

SEQ ID NO: 179960 - RNA, 64 nt, Human; identical to SEQ ID NO: 108429

SEQ ID NO: 179961 - RNA, 64 nt, Human; identical to SEQ ID NO: 108430

SEQ ID NO: 179962 - RNA, 64 nt, Human; identical to SEQ ID NO: 108431

SEQ ID NO: 179963 - RNA, 64 nt, Human; identical to SEQ ID NO: 108432

SEQ ID NO: 179964 - RNA, 64 nt, Human
ccuuucuguccgugggcagcccaguccccacagucacggccaagccacgcagaacgaacaugac

SEQ ID NO: 179965 - RNA, 64 nt, Human; identical to SEQ ID NO: 108433

SEQ ID NO: 179966 - RNA, 64 nt, Human; identical to SEQ ID NO: 108434

SEQ ID NO: 179967 - RNA, 64 nt, Human; identical to SEQ ID NO: 108435

SEQ ID NO: 179968 - RNA, 64 nt, Human; identical to SEQ ID NO: 108436

SEQ ID NO: 179969 - RNA, 64 nt, Human; identical to SEQ ID NO: 108437

SEQ ID NO: 179970 - RNA, 64 nt, Human; identical to SEQ ID NO: 108438

SEQ ID NO: 179971 - RNA, 64 nt, Human; identical to SEQ ID NO: 108439

SEQ ID NO: 179972 - RNA, 64 nt, Human; identical to SEQ ID NO: 108440

SEQ ID NO: 179973 - RNA, 64 nt, Human; identical to SEQ ID NO: 108441

SEQ ID NO: 179974 - RNA, 64 nt, Human; identical to SEQ ID NO: 108442

SEQ ID NO: 179975 - RNA, 64 nt, Human; identical to SEQ ID NO: 108443

SEQ ID NO: 179976 - RNA, 64 nt, Human; identical to SEQ ID NO: 108444

SEQ ID NO: 179977 - RNA, 64 nt, Human; identical to SEQ ID NO: 108445

SEQ ID NO: 179978 - RNA, 64 nt, Human; identical to SEQ ID NO: 108446

SEQ ID NO: 179979 - RNA, 64 nt, Human; identical to SEQ ID NO: 108447

SEQ ID NO: 179980 - RNA, 64 nt, Human; identical to SEQ ID NO: 108448

SEQ ID NO: 179981 - RNA, 64 nt, Human; identical to SEQ ID NO: 108449

SEQ ID NO: 179982 - RNA, 64 nt, Human
uucuaaauucaacuugaagauguguauuuccccugaccuucaaaaaauguuccaagguaagccu

SEQ ID NO: 179983 - RNA, 64 nt, Human; identical to SEQ ID NO: 108450

SEQ ID NO: 179984 - RNA, 64 nt, Human; identical to SEQ ID NO: 108451

SEQ ID NO: 179985 - RNA, 64 nt, Human; identical to SEQ ID NO: 108452

SEQ ID NO: 179986 - RNA, 64 nt, Human; identical to SEQ ID NO: 108453

SEQ ID NO: 179987 - RNA, 64 nt, Human; identical to SEQ ID NO: 108454

SEQ ID NO: 179988 - RNA, 64 nt, Human; identical to SEQ ID NO: 108455

SEQ ID NO: 179989 - RNA, 64 nt, Human; identical to SEQ ID NO: 108456

SEQ ID NO: 179990 - RNA, 64 nt, Human; identical to SEQ ID NO: 108457

SEQ ID NO: 179991 - RNA, 64 nt, Human; identical to SEQ ID NO: 108458

SEQ ID NO: 179992 - RNA, 64 nt, Human; identical to SEQ ID NO: 108459

SEQ ID NO: 179993 - RNA, 64 nt, Human; identical to SEQ ID NO: 108460

SEQ ID NO: 179994 - RNA, 64 nt, Human; identical to SEQ ID NO: 108461

SEQ ID NO: 179995 - RNA, 64 nt, Human; identical to SEQ ID NO: 108462

SEQ ID NO: 179996 - RNA, 64 nt, Human; identical to SEQ ID NO: 108463

SEQ ID NO: 179997 - RNA, 64 nt, Human; identical to SEQ ID NO: 108464

SEQ ID NO: 179998 - RNA, 64 nt, Human; identical to SEQ ID NO: 108465

SEQ ID NO: 179999 - RNA, 64 nt, Human; identical to SEQ ID NO: 108466

SEQ ID NO: 180000 - RNA, 64 nt, Human
ggucccaggaccucugguggagggccauggcguggaccuucacccuucuggacuguguggccau

SEQ ID NO: 180001 - RNA, 64 nt, Human; identical to SEQ ID NO: 108467

SEQ ID NO: 180002 - RNA, 64 nt, Human; identical to SEQ ID NO: 108468

SEQ ID NO: 180003 - RNA, 64 nt, Human; identical to SEQ ID NO: 108469

SEQ ID NO: 180004 - RNA, 64 nt, Human; identical to SEQ ID NO: 108470

SEQ ID NO: 180005 - RNA, 64 nt, Human; identical to SEQ ID NO: 108471

SEQ ID NO: 180006 - RNA, 64 nt, Human; identical to SEQ ID NO: 108472

SEQ ID NO: 180007 - RNA, 64 nt, Human; identical to SEQ ID NO: 108473

SEQ ID NO: 180008 - RNA, 64 nt, Human; identical to SEQ ID NO: 108474

SEQ ID NO: 180009 - RNA, 64 nt, Human; identical to SEQ ID NO: 108475

SEQ ID NO: 180010 - RNA, 64 nt, Human; identical to SEQ ID NO: 108476

SEQ ID NO: 180011 - RNA, 64 nt, Human; identical to SEQ ID NO: 108477

SEQ ID NO: 180012 - RNA, 64 nt, Human; identical to SEQ ID NO: 108478

SEQ ID NO: 180013 - RNA, 64 nt, Human; identical to SEQ ID NO: 108479

SEQ ID NO: 180014 - RNA, 64 nt, Human; identical to SEQ ID NO: 108480

SEQ ID NO: 180015 - RNA, 64 nt, Human; identical to SEQ ID NO: 108481

SEQ ID NO: 180016 - RNA, 64 nt, Human; identical to SEQ ID NO: 108482

SEQ ID NO: 180017 - RNA, 64 nt, Human; identical to SEQ ID NO: 108483

SEQ ID NO: 180018 - RNA, 64 nt, Human
gggaacggacccugaccaucggcagcgccggcaagaccuucagcgccacuggcuggaaggugag

SEQ ID NO: 180019 - RNA, 64 nt, Human; identical to SEQ ID NO: 108484

SEQ ID NO: 180020 - RNA, 64 nt, Human; identical to SEQ ID NO: 108485

SEQ ID NO: 180021 - RNA, 64 nt, Human; identical to SEQ ID NO: 108486

SEQ ID NO: 180022 - RNA, 64 nt, Human; identical to SEQ ID NO: 108487

SEQ ID NO: 180023 - RNA, 64 nt, Human; identical to SEQ ID NO: 108488

SEQ ID NO: 180024 - RNA, 64 nt, Human; identical to SEQ ID NO: 108489

SEQ ID NO: 180025 - RNA, 64 nt, Human; identical to SEQ ID NO: 108490

SEQ ID NO: 180026 - RNA, 64 nt, Human; identical to SEQ ID NO: 108491

SEQ ID NO: 180027 - RNA, 64 nt, Human; identical to SEQ ID NO: 108492

SEQ ID NO: 180028 - RNA, 64 nt, Human; identical to SEQ ID NO: 108493

SEQ ID NO: 180029 - RNA, 64 nt, Human; identical to SEQ ID NO: 108494

SEQ ID NO: 180030 - RNA, 64 nt, Human; identical to SEQ ID NO: 108495

SEQ ID NO: 180031 - RNA, 64 nt, Human; identical to SEQ ID NO: 108496

SEQ ID NO: 180032 - RNA, 64 nt, Human; identical to SEQ ID NO: 108497

SEQ ID NO: 180033 - RNA, 64 nt, Human; identical to SEQ ID NO: 108498

SEQ ID NO: 180034 - RNA, 64 nt, Human; identical to SEQ ID NO: 108499

SEQ ID NO: 180035 - RNA, 64 nt, Human; identical to SEQ ID NO: 108500

SEQ ID NO: 180036 - RNA, 64 nt, Human
gaacucugaaccugcuguggaaggaauuggccaugaccuucaccucuggagaguagggucuaug

SEQ ID NO: 180037 - RNA, 64 nt, Human; identical to SEQ ID NO: 108501

SEQ ID NO: 180038 - RNA, 62 nt, Human; identical to SEQ ID NO: 108502

SEQ ID NO: 180039 - RNA, 64 nt, Human; identical to SEQ ID NO: 108503

SEQ ID NO: 180040 - RNA, 64 nt, Human; identical to SEQ ID NO: 108504

SEQ ID NO: 180041 - RNA, 64 nt, Human; identical to SEQ ID NO: 108505

SEQ ID NO: 180042 - RNA, 64 nt, Human; identical to SEQ ID NO: 108506

SEQ ID NO: 180043 - RNA, 64 nt, Human; identical to SEQ ID NO: 108507

SEQ ID NO: 180044 - RNA, 64 nt, Human; identical to SEQ ID NO: 108508

SEQ ID NO: 180045 - RNA, 64 nt, Human; identical to SEQ ID NO: 108509

SEQ ID NO: 180046 - RNA, 61 nt, Human; identical to SEQ ID NO: 108510

SEQ ID NO: 180047 - RNA, 64 nt, Human; identical to SEQ ID NO: 108511

SEQ ID NO: 180048 - RNA, 64 nt, Human; identical to SEQ ID NO: 108512

SEQ ID NO: 180049 - RNA, 64 nt, Human; identical to SEQ ID NO: 108513

SEQ ID NO: 180050 - RNA, 64 nt, Human; identical to SEQ ID NO: 108514

SEQ ID NO: 180051 - RNA, 63 nt, Human; identical to SEQ ID NO: 108515

SEQ ID NO: 180052 - RNA, 64 nt, Human; identical to SEQ ID NO: 108516

SEQ ID NO: 180053 - RNA, 64 nt, Human; identical to SEQ ID NO: 108517

SEQ ID NO: 180054 - RNA, 64 nt, Human
aucacagaugaguuaucuaagaauacagcuuucugaccuucagcucacgcuucacagugaucga

SEQ ID NO: 180055 - RNA, 64 nt, Human; identical to SEQ ID NO: 108518

SEQ ID NO: 180056 - RNA, 64 nt, Human; identical to SEQ ID NO: 108519

SEQ ID NO: 180057 - RNA, 64 nt, Human; identical to SEQ ID NO: 108520

SEQ ID NO: 180058 - RNA, 64 nt, Human; identical to SEQ ID NO: 108521

SEQ ID NO: 180059 - RNA, 64 nt, Human; identical to SEQ ID NO: 108522

SEQ ID NO: 180060 - RNA, 64 nt, Human; identical to SEQ ID NO: 108523

SEQ ID NO: 180061 - RNA, 64 nt, Human; identical to SEQ ID NO: 108524

SEQ ID NO: 180062 - RNA, 64 nt, Human; identical to SEQ ID NO: 108525

SEQ ID NO: 180063 - RNA, 64 nt, Human; identical to SEQ ID NO: 108526

SEQ ID NO: 180064 - RNA, 64 nt, Human; identical to SEQ ID NO: 108527

SEQ ID NO: 180065 - RNA, 64 nt, Human; identical to SEQ ID NO: 108528

SEQ ID NO: 180066 - RNA, 64 nt, Human; identical to SEQ ID NO: 108529

SEQ ID NO: 180067 - RNA, 64 nt, Human; identical to SEQ ID NO: 108530

SEQ ID NO: 180068 - RNA, 64 nt, Human; identical to SEQ ID NO: 108531

SEQ ID NO: 180069 - RNA, 64 nt, Human; identical to SEQ ID NO: 108532

SEQ ID NO: 180070 - RNA, 64 nt, Human; identical to SEQ ID NO: 108533

SEQ ID NO: 180071 - RNA, 64 nt, Human; identical to SEQ ID NO: 108534

SEQ ID NO: 180072 - RNA, 64 nt, Human
ugggcaaucuuaacaucuuuacucuuauugucuggaccuucaaagggcuuuguauuuuacaccu

SEQ ID NO: 180073 - RNA, 64 nt, Human; identical to SEQ ID NO: 108535

SEQ ID NO: 180074 - RNA, 64 nt, Human; identical to SEQ ID NO: 108536

SEQ ID NO: 180075 - RNA, 64 nt, Human; identical to SEQ ID NO: 108537

SEQ ID NO: 180076 - RNA, 50 nt, Human; identical to SEQ ID NO: 108538

SEQ ID NO: 180077 - RNA, 64 nt, Human; identical to SEQ ID NO: 108539

SEQ ID NO: 180078 - RNA, 64 nt, Human; identical to SEQ ID NO: 108540

SEQ ID NO: 180079 - RNA, 64 nt, Human; identical to SEQ ID NO: 108541

SEQ ID NO: 180080 - RNA, 64 nt, Human; identical to SEQ ID NO: 108542

SEQ ID NO: 180081 - RNA, 64 nt, Human; identical to SEQ ID NO: 108543

SEQ ID NO: 180082 - RNA, 64 nt, Human; identical to SEQ ID NO: 108544

SEQ ID NO: 180083 - RNA, 64 nt, Human; identical to SEQ ID NO: 108545

SEQ ID NO: 180084 - RNA, 64 nt, Human; identical to SEQ ID NO: 108546

SEQ ID NO: 180085 - RNA, 64 nt, Human; identical to SEQ ID NO: 108547

SEQ ID NO: 180086 - RNA, 64 nt, Human; identical to SEQ ID NO: 108548

SEQ ID NO: 180087 - RNA, 64 nt, Human; identical to SEQ ID NO: 108549

SEQ ID NO: 180088 - RNA, 64 nt, Human; identical to SEQ ID NO: 108550

SEQ ID NO: 180089 - RNA, 64 nt, Human; identical to SEQ ID NO: 108551

SEQ ID NO: 180090 - RNA, 64 nt, Human
agaacccuucuuccuguggcacuccccacccauagaccuucagaucaucucccacacccuggau

SEQ ID NO: 180091 - RNA, 64 nt, Human; identical to SEQ ID NO: 107914

SEQ ID NO: 180092 - RNA, 64 nt, Human; identical to SEQ ID NO: 108553

SEQ ID NO: 180093 - RNA, 64 nt, Human; identical to SEQ ID NO: 108554

SEQ ID NO: 180094 - RNA, 64 nt, Human; identical to SEQ ID NO: 108555

SEQ ID NO: 180095 - RNA, 64 nt, Human; identical to SEQ ID NO: 108556

SEQ ID NO: 180096 - RNA, 64 nt, Human; identical to SEQ ID NO: 108557

SEQ ID NO: 180097 - RNA, 64 nt, Human; identical to SEQ ID NO: 108558

SEQ ID NO: 180098 - RNA, 64 nt, Human; identical to SEQ ID NO: 108559

SEQ ID NO: 180099 - RNA, 64 nt, Human; identical to SEQ ID NO: 108560

SEQ ID NO: 180100 - RNA, 64 nt, Human; identical to SEQ ID NO: 108561

SEQ ID NO: 180101 - RNA, 64 nt, Human; identical to SEQ ID NO: 108562

SEQ ID NO: 180102 - RNA, 64 nt, Human; identical to SEQ ID NO: 108563

SEQ ID NO: 180103 - RNA, 64 nt, Human; identical to SEQ ID NO: 108564

SEQ ID NO: 180104 - RNA, 64 nt, Human; identical to SEQ ID NO: 108565

SEQ ID NO: 180105 - RNA, 64 nt, Human; identical to SEQ ID NO: 108566

SEQ ID NO: 180106 - RNA, 64 nt, Human; identical to SEQ ID NO: 108567

SEQ ID NO: 180107 - RNA, 64 nt, Human; identical to SEQ ID NO: 108568

SEQ ID NO: 180108 - RNA, 64 nt, Human
uccaacgccccgcccacgccgcggccaccgggcccacggccaccagaaugcaauugagaaaucg

SEQ ID NO: 180109 - RNA, 64 nt, Human; identical to SEQ ID NO: 108569

SEQ ID NO: 180110 - RNA, 64 nt, Human; identical to SEQ ID NO: 108570

SEQ ID NO: 180111 - RNA, 64 nt, Human; identical to SEQ ID NO: 108571

SEQ ID NO: 180112 - RNA, 64 nt, Human; identical to SEQ ID NO: 108572

SEQ ID NO: 180113 - RNA, 64 nt, Human; identical to SEQ ID NO: 108573

SEQ ID NO: 180114 - RNA, 64 nt, Human; identical to SEQ ID NO: 108574

SEQ ID NO: 180115 - RNA, 64 nt, Human; identical to SEQ ID NO: 108575

SEQ ID NO: 180116 - RNA, 64 nt, Human; identical to SEQ ID NO: 108576

SEQ ID NO: 180117 - RNA, 64 nt, Human; identical to SEQ ID NO: 108577

SEQ ID NO: 180118 - RNA, 64 nt, Human; identical to SEQ ID NO: 108578

SEQ ID NO: 180119 - RNA, 64 nt, Human; identical to SEQ ID NO: 108579

SEQ ID NO: 180120 - RNA, 64 nt, Human; identical to SEQ ID NO: 108580

SEQ ID NO: 180121 - RNA, 64 nt, Human; identical to SEQ ID NO: 108581

SEQ ID NO: 180122 - RNA, 64 nt, Human; identical to SEQ ID NO: 108582

SEQ ID NO: 180123 - RNA, 64 nt, Human; identical to SEQ ID NO: 108583

SEQ ID NO: 180124 - RNA, 64 nt, Human; identical to SEQ ID NO: 108584

SEQ ID NO: 180125 - RNA, 64 nt, Human; identical to SEQ ID NO: 108585

SEQ ID NO: 180126 - RNA, 64 nt, Human
uguucagagaggucccccucugccacuugacagggaccuucaaaccucgacagugaugcaagga

SEQ ID NO: 180127 - RNA, 64 nt, Human; identical to SEQ ID NO: 108586

SEQ ID NO: 180128 - RNA, 64 nt, Human; identical to SEQ ID NO: 108587

SEQ ID NO: 180129 - RNA, 64 nt, Human; identical to SEQ ID NO: 108588

SEQ ID NO: 180130 - RNA, 64 nt, Human; identical to SEQ ID NO: 108589

SEQ ID NO: 180131 - RNA, 64 nt, Human; identical to SEQ ID NO: 108590

SEQ ID NO: 180132 - RNA, 64 nt, Human; identical to SEQ ID NO: 108591

SEQ ID NO: 180133 - RNA, 64 nt, Human; identical to SEQ ID NO: 108592

SEQ ID NO: 180134 - RNA, 64 nt, Human; identical to SEQ ID NO: 108593

SEQ ID NO: 180135 - RNA, 64 nt, Human; identical to SEQ ID NO: 108594

SEQ ID NO: 180136 - RNA, 64 nt, Human; identical to SEQ ID NO: 108595

SEQ ID NO: 180137 - RNA, 64 nt, Human; identical to SEQ ID NO: 108596

SEQ ID NO: 180138 - RNA, 64 nt, Human; identical to SEQ ID NO: 108597

SEQ ID NO: 180139 - RNA, 64 nt, Human; identical to SEQ ID NO: 108598

SEQ ID NO: 180140 - RNA, 64 nt, Human; identical to SEQ ID NO: 108599

SEQ ID NO: 180141 - RNA, 64 nt, Human; identical to SEQ ID NO: 108600

SEQ ID NO: 180142 - RNA, 64 nt, Human; identical to SEQ ID NO: 108601

SEQ ID NO: 180143 - RNA, 64 nt, Human; identical to SEQ ID NO: 108602

SEQ ID NO: 180144 - RNA, 64 nt, Human
auguucccaccuucagugcuccacgcccuccauagaccuucagagaaggugaaaccagguuauc

SEQ ID NO: 180145 - RNA, 64 nt, Human; identical to SEQ ID NO: 108603

SEQ ID NO: 180146 - RNA, 64 nt, Human; identical to SEQ ID NO: 108604

SEQ ID NO: 180147 - RNA, 64 nt, Human; identical to SEQ ID NO: 108605

SEQ ID NO: 180148 - RNA, 64 nt, Human; identical to SEQ ID NO: 108606

SEQ ID NO: 180149 - RNA, 64 nt, Human; identical to SEQ ID NO: 108607

SEQ ID NO: 180150 - RNA, 64 nt, Human; identical to SEQ ID NO: 108608

SEQ ID NO: 180151 - RNA, 64 nt, Human; identical to SEQ ID NO: 108609

SEQ ID NO: 180152 - RNA, 64 nt, Human; identical to SEQ ID NO: 108610

SEQ ID NO: 180153 - RNA, 64 nt, Human; identical to SEQ ID NO: 108611

SEQ ID NO: 180154 - RNA, 64 nt, Human; identical to SEQ ID NO: 108612

SEQ ID NO: 180155 - RNA, 64 nt, Human; identical to SEQ ID NO: 108613

SEQ ID NO: 180156 - RNA, 64 nt, Human; identical to SEQ ID NO: 108614

SEQ ID NO: 180157 - RNA, 64 nt, Human; identical to SEQ ID NO: 108615

SEQ ID NO: 180158 - RNA, 64 nt, Human; identical to SEQ ID NO: 108616

SEQ ID NO: 180159 - RNA, 64 nt, Human; identical to SEQ ID NO: 108617

SEQ ID NO: 180160 - RNA, 64 nt, Human; identical to SEQ ID NO: 108618

SEQ ID NO: 180161 - RNA, 50 nt, Human; identical to SEQ ID NO: 108619

SEQ ID NO: 180162 - RNA, 54 nt, Human; identical to SEQ ID NO: 108620

SEQ ID NO: 180163 - RNA, 64 nt, Human; identical to SEQ ID NO: 108621

SEQ ID NO: 180164 - RNA, 64 nt, Human; identical to SEQ ID NO: 108622

SEQ ID NO: 180165 - RNA, 64 nt, Human; identical to SEQ ID NO: 108623

SEQ ID NO: 180166 - RNA, 64 nt, Human; identical to SEQ ID NO: 108624

SEQ ID NO: 180167 - RNA, 64 nt, Human; identical to SEQ ID NO: 108625

SEQ ID NO: 180168 - RNA, 64 nt, Human; identical to SEQ ID NO: 108626

SEQ ID NO: 180169 - RNA, 64 nt, Human; identical to SEQ ID NO: 108627

SEQ ID NO: 180170 - RNA, 64 nt, Human; identical to SEQ ID NO: 108628

SEQ ID NO: 180171 - RNA, 64 nt, Human; identical to SEQ ID NO: 108629

SEQ ID NO: 180172 - RNA, 64 nt, Human; identical to SEQ ID NO: 108630

SEQ ID NO: 180173 - RNA, 64 nt, Human; identical to SEQ ID NO: 108631

SEQ ID NO: 180174 - RNA, 64 nt, Human; identical to SEQ ID NO: 108632

SEQ ID NO: 180175 - RNA, 64 nt, Human; identical to SEQ ID NO: 108633

SEQ ID NO: 180176 - RNA, 64 nt, Human; identical to SEQ ID NO: 108634

SEQ ID NO: 180177 - RNA, 64 nt, Human; identical to SEQ ID NO: 108635

SEQ ID NO: 180178 - RNA, 64 nt, Human; identical to SEQ ID NO: 108636

SEQ ID NO: 180179 - RNA, 64 nt, Human; identical to SEQ ID NO: 108637

SEQ ID NO: 180180 - RNA, 64 nt, Human
augguaucuggguaagaagaaagcaaaagcaagggaccuucaugcccuucugauuccccuccac

SEQ ID NO: 180181 - RNA, 64 nt, Human; identical to SEQ ID NO: 108638

SEQ ID NO: 180182 - RNA, 64 nt, Human; identical to SEQ ID NO: 108639

SEQ ID NO: 180183 - RNA, 64 nt, Human; identical to SEQ ID NO: 108640

SEQ ID NO: 180184 - RNA, 64 nt, Human; identical to SEQ ID NO: 108641

SEQ ID NO: 180185 - RNA, 64 nt, Human; identical to SEQ ID NO: 108642

SEQ ID NO: 180186 - RNA, 64 nt, Human; identical to SEQ ID NO: 108643

SEQ ID NO: 180187 - RNA, 64 nt, Human; identical to SEQ ID NO: 108644

SEQ ID NO: 180188 - RNA, 64 nt, Human; identical to SEQ ID NO: 108645

SEQ ID NO: 180189 - RNA, 64 nt, Human; identical to SEQ ID NO: 108646

SEQ ID NO: 180190 - RNA, 64 nt, Human; identical to SEQ ID NO: 108647

SEQ ID NO: 180191 - RNA, 64 nt, Human; identical to SEQ ID NO: 108648

SEQ ID NO: 180192 - RNA, 64 nt, Human; identical to SEQ ID NO: 108649

SEQ ID NO: 180193 - RNA, 64 nt, Human; identical to SEQ ID NO: 108650

SEQ ID NO: 180194 - RNA, 64 nt, Human; identical to SEQ ID NO: 108651

SEQ ID NO: 180195 - RNA, 64 nt, Human; identical to SEQ ID NO: 108652

SEQ ID NO: 180196 - RNA, 64 nt, Human; identical to SEQ ID NO: 108653

SEQ ID NO: 180197 - RNA, 64 nt, Human; identical to SEQ ID NO: 108654

SEQ ID NO: 180198 - RNA, 64 nt, Human
aucgcggauguaaacuaagaccccgaaaacuccagaccuucaggagagcagucagcagagcccc

SEQ ID NO: 180199 - RNA, 64 nt, Human; identical to SEQ ID NO: 108655

SEQ ID NO: 180200 - RNA, 64 nt, Human; identical to SEQ ID NO: 108656

SEQ ID NO: 180201 - RNA, 64 nt, Human; identical to SEQ ID NO: 108657

SEQ ID NO: 180202 - RNA, 64 nt, Human; identical to SEQ ID NO: 108658

SEQ ID NO: 180203 - RNA, 64 nt, Human; identical to SEQ ID NO: 108659

SEQ ID NO: 180204 - RNA, 64 nt, Human; identical to SEQ ID NO: 108660

SEQ ID NO: 180205 - RNA, 64 nt, Human; identical to SEQ ID NO: 108661

SEQ ID NO: 180206 - RNA, 64 nt, Human; identical to SEQ ID NO: 108662

SEQ ID NO: 180207 - RNA, 64 nt, Human; identical to SEQ ID NO: 108663

SEQ ID NO: 180208 - RNA, 64 nt, Human; identical to SEQ ID NO: 108664

SEQ ID NO: 180209 - RNA, 64 nt, Human; identical to SEQ ID NO: 108665

SEQ ID NO: 180210 - RNA, 64 nt, Human; identical to SEQ ID NO: 108666

SEQ ID NO: 180211 - RNA, 64 nt, Human; identical to SEQ ID NO: 108667

SEQ ID NO: 180212 - RNA, 64 nt, Human; identical to SEQ ID NO: 108668

SEQ ID NO: 180213 - RNA, 64 nt, Human; identical to SEQ ID NO: 108669

SEQ ID NO: 180214 - RNA, 64 nt, Human; identical to SEQ ID NO: 108670

SEQ ID NO: 180215 - RNA, 64 nt, Human; identical to SEQ ID NO: 108671

SEQ ID NO: 180216 - RNA, 64 nt, Human
uuucuaucuggacagugugacuaucuuaugucaggaccuucaugugccaaacgucagugguguu

SEQ ID NO: 180217 - RNA, 64 nt, Human; identical to SEQ ID NO: 108672

SEQ ID NO: 180218 - RNA, 64 nt, Human; identical to SEQ ID NO: 108673

SEQ ID NO: 180219 - RNA, 64 nt, Human; identical to SEQ ID NO: 108674

SEQ ID NO: 180220 - RNA, 64 nt, Human; identical to SEQ ID NO: 108675

SEQ ID NO: 180221 - RNA, 64 nt, Human; identical to SEQ ID NO: 108676

SEQ ID NO: 180222 - RNA, 64 nt, Human; identical to SEQ ID NO: 108677

SEQ ID NO: 180223 - RNA, 53 nt, Human; identical to SEQ ID NO: 108678

SEQ ID NO: 180224 - RNA, 64 nt, Human; identical to SEQ ID NO: 108679

SEQ ID NO: 180225 - RNA, 64 nt, Human; identical to SEQ ID NO: 108680

SEQ ID NO: 180226 - RNA, 64 nt, Human; identical to SEQ ID NO: 108681

SEQ ID NO: 180227 - RNA, 64 nt, Human; identical to SEQ ID NO: 108682

SEQ ID NO: 180228 - RNA, 64 nt, Human; identical to SEQ ID NO: 108683

SEQ ID NO: 180229 - RNA, 64 nt, Human; identical to SEQ ID NO: 108684

SEQ ID NO: 180230 - RNA, 64 nt, Human; identical to SEQ ID NO: 108685

SEQ ID NO: 180231 - RNA, 64 nt, Human; identical to SEQ ID NO: 108686

SEQ ID NO: 180232 - RNA, 64 nt, Human; identical to SEQ ID NO: 108687

SEQ ID NO: 180233 - RNA, 64 nt, Human; identical to SEQ ID NO: 108688

SEQ ID NO: 180234 - RNA, 64 nt, Human; identical to SEQ ID NO: 108689

SEQ ID NO: 180235 - RNA, 64 nt, Human; identical to SEQ ID NO: 108690

SEQ ID NO: 180236 - RNA, 64 nt, Human; identical to SEQ ID NO: 108691

SEQ ID NO: 180237 - RNA, 64 nt, Human; identical to SEQ ID NO: 108692

SEQ ID NO: 180238 - RNA, 60 nt, Human; identical to SEQ ID NO: 108693

SEQ ID NO: 180239 - RNA, 64 nt, Human; identical to SEQ ID NO: 108694

SEQ ID NO: 180240 - RNA, 64 nt, Human; identical to SEQ ID NO: 108695

SEQ ID NO: 180241 - RNA, 64 nt, Human; identical to SEQ ID NO: 108696

SEQ ID NO: 180242 - RNA, 64 nt, Human; identical to SEQ ID NO: 108697

SEQ ID NO: 180243 - RNA, 64 nt, Human; identical to SEQ ID NO: 108698

SEQ ID NO: 180244 - RNA, 64 nt, Human; identical to SEQ ID NO: 108699

SEQ ID NO: 180245 - RNA, 64 nt, Human; identical to SEQ ID NO: 108700

SEQ ID NO: 180246 - RNA, 64 nt, Human; identical to SEQ ID NO: 108701

SEQ ID NO: 180247 - RNA, 64 nt, Human; identical to SEQ ID NO: 108702

SEQ ID NO: 180248 - RNA, 64 nt, Human; identical to SEQ ID NO: 108703

SEQ ID NO: 180249 - RNA, 64 nt, Human; identical to SEQ ID NO: 108704

SEQ ID NO: 180250 - RNA, 64 nt, Human; identical to SEQ ID NO: 108705

SEQ ID NO: 180251 - RNA, 64 nt, Human; identical to SEQ ID NO: 108706

SEQ ID NO: 180252 - RNA, 64 nt, Human
ucacuucugccccgacuuguggcucggacccagggaccuucagggcccgcagacccucccggcg

SEQ ID NO: 180253 - RNA, 64 nt, Human; identical to SEQ ID NO: 108707

SEQ ID NO: 180254 - RNA, 64 nt, Human; identical to SEQ ID NO: 108708

SEQ ID NO: 180255 - RNA, 64 nt, Human; identical to SEQ ID NO: 108709

SEQ ID NO: 180256 - RNA, 64 nt, Human; identical to SEQ ID NO: 108710

SEQ ID NO: 180257 - RNA, 64 nt, Human; identical to SEQ ID NO: 108711

SEQ ID NO: 180258 - RNA, 64 nt, Human; identical to SEQ ID NO: 108712

SEQ ID NO: 180259 - RNA, 64 nt, Human; identical to SEQ ID NO: 108713

SEQ ID NO: 180260 - RNA, 64 nt, Human; identical to SEQ ID NO: 108714

SEQ ID NO: 180261 - RNA, 64 nt, Human; identical to SEQ ID NO: 108715

SEQ ID NO: 180262 - RNA, 64 nt, Human; identical to SEQ ID NO: 108716

SEQ ID NO: 180263 - RNA, 64 nt, Human; identical to SEQ ID NO: 108717

SEQ ID NO: 180264 - RNA, 64 nt, Human; identical to SEQ ID NO: 108718

SEQ ID NO: 180265 - RNA, 64 nt, Human; identical to SEQ ID NO: 108719

SEQ ID NO: 180266 - RNA, 64 nt, Human; identical to SEQ ID NO: 108720

SEQ ID NO: 180267 - RNA, 64 nt, Human; identical to SEQ ID NO: 108721

SEQ ID NO: 180268 - RNA, 64 nt, Human; identical to SEQ ID NO: 108722

SEQ ID NO: 180269 - RNA, 64 nt, Human; identical to SEQ ID NO: 108723

SEQ ID NO: 180270 - RNA, 64 nt, Human
gccagcucaugcugcugaccacugacucagcucugaccuucacauuugcucugaagcaagugcg

SEQ ID NO: 180271 - RNA, 64 nt, Human; identical to SEQ ID NO: 108724

SEQ ID NO: 180272 - RNA, 64 nt, Human; identical to SEQ ID NO: 108725

SEQ ID NO: 180273 - RNA, 64 nt, Human; identical to SEQ ID NO: 108726

SEQ ID NO: 180274 - RNA, 64 nt, Human; identical to SEQ ID NO: 108727

SEQ ID NO: 180275 - RNA, 64 nt, Human; identical to SEQ ID NO: 108728

SEQ ID NO: 180276 - RNA, 64 nt, Human; identical to SEQ ID NO: 108729

SEQ ID NO: 180277 - RNA, 64 nt, Human; identical to SEQ ID NO: 108730

SEQ ID NO: 180278 - RNA, 64 nt, Human; identical to SEQ ID NO: 108731

SEQ ID NO: 180279 - RNA, 64 nt, Human; identical to SEQ ID NO: 108732

SEQ ID NO: 180280 - RNA, 64 nt, Human; identical to SEQ ID NO: 108733

SEQ ID NO: 180281 - RNA, 64 nt, Human; identical to SEQ ID NO: 108734

SEQ ID NO: 180282 - RNA, 64 nt, Human; identical to SEQ ID NO: 108735

SEQ ID NO: 180283 - RNA, 64 nt, Human; identical to SEQ ID NO: 108736

SEQ ID NO: 180284 - RNA, 64 nt, Human; identical to SEQ ID NO: 108737

SEQ ID NO: 180285 - RNA, 64 nt, Human; identical to SEQ ID NO: 108738

SEQ ID NO: 180286 - RNA, 64 nt, Human; identical to SEQ ID NO: 108739

SEQ ID NO: 180287 - RNA, 64 nt, Human; identical to SEQ ID NO: 108740

SEQ ID NO: 180288 - RNA, 64 nt, Human
gacauuaggaggaaucuacaaaaagcagcaaugggaccuucaaguccuaugaaacgacgcuuaa

SEQ ID NO: 180289 - RNA, 64 nt, Human; identical to SEQ ID NO: 108741

SEQ ID NO: 180290 - RNA, 64 nt, Human; identical to SEQ ID NO: 108742

SEQ ID NO: 180291 - RNA, 64 nt, Human; identical to SEQ ID NO: 108743

SEQ ID NO: 180292 - RNA, 64 nt, Human; identical to SEQ ID NO: 108744

SEQ ID NO: 180293 - RNA, 64 nt, Human; identical to SEQ ID NO: 108745

SEQ ID NO: 180294 - RNA, 64 nt, Human; identical to SEQ ID NO: 108746

SEQ ID NO: 180295 - RNA, 64 nt, Human; identical to SEQ ID NO: 108747

SEQ ID NO: 180296 - RNA, 64 nt, Human; identical to SEQ ID NO: 108748

SEQ ID NO: 180297 - RNA, 64 nt, Human; identical to SEQ ID NO: 108749

SEQ ID NO: 180298 - RNA, 64 nt, Human; identical to SEQ ID NO: 108750

SEQ ID NO: 180299 - RNA, 64 nt, Human; identical to SEQ ID NO: 108751

SEQ ID NO: 180300 - RNA, 64 nt, Human; identical to SEQ ID NO: 108752

SEQ ID NO: 180301 - RNA, 64 nt, Human; identical to SEQ ID NO: 108753

SEQ ID NO: 180302 - RNA, 64 nt, Human; identical to SEQ ID NO: 108754

SEQ ID NO: 180303 - RNA, 64 nt, Human; identical to SEQ ID NO: 108755

SEQ ID NO: 180304 - RNA, 64 nt, Human; identical to SEQ ID NO: 108756

SEQ ID NO: 180305 - RNA, 50 nt, Human; identical to SEQ ID NO: 108757

SEQ ID NO: 180306 - RNA, 64 nt, Human; identical to SEQ ID NO: 108758

SEQ ID NO: 180307 - RNA, 64 nt, Human; identical to SEQ ID NO: 108759

SEQ ID NO: 180308 - RNA, 64 nt, Human; identical to SEQ ID NO: 108760

SEQ ID NO: 180309 - RNA, 64 nt, Human; identical to SEQ ID NO: 108761

SEQ ID NO: 180310 - RNA, 64 nt, Human; identical to SEQ ID NO: 108762

SEQ ID NO: 180311 - RNA, 64 nt, Human; identical to SEQ ID NO: 108763

SEQ ID NO: 180312 - RNA, 64 nt, Human; identical to SEQ ID NO: 108764

SEQ ID NO: 180313 - RNA, 64 nt, Human; identical to SEQ ID NO: 108765

SEQ ID NO: 180314 - RNA, 64 nt, Human; identical to SEQ ID NO: 108766

SEQ ID NO: 180315 - RNA, 64 nt, Human; identical to SEQ ID NO: 108767

SEQ ID NO: 180316 - RNA, 64 nt, Human; identical to SEQ ID NO: 108768

SEQ ID NO: 180317 - RNA, 64 nt, Human; identical to SEQ ID NO: 108769

SEQ ID NO: 180318 - RNA, 64 nt, Human; identical to SEQ ID NO: 108770

SEQ ID NO: 180319 - RNA, 64 nt, Human; identical to SEQ ID NO: 108771

SEQ ID NO: 180320 - RNA, 64 nt, Human; identical to SEQ ID NO: 108772

SEQ ID NO: 180321 - RNA, 64 nt, Human; identical to SEQ ID NO: 108773

SEQ ID NO: 180322 - RNA, 64 nt, Human; identical to SEQ ID NO: 108774

SEQ ID NO: 180323 - RNA, 64 nt, Human; identical to SEQ ID NO: 108775

SEQ ID NO: 180324 - RNA, 64 nt, Human
aggagcugagccugccucucuccuuuagaugacagaccuucaucugggaacgugcugagccagc

SEQ ID NO: 180325 - RNA, 64 nt, Human; identical to SEQ ID NO: 108776

SEQ ID NO: 180326 - RNA, 64 nt, Human; identical to SEQ ID NO: 108777

SEQ ID NO: 180327 - RNA, 64 nt, Human; identical to SEQ ID NO: 108778

SEQ ID NO: 180328 - RNA, 64 nt, Human; identical to SEQ ID NO: 108779

SEQ ID NO: 180329 - RNA, 64 nt, Human; identical to SEQ ID NO: 108780

SEQ ID NO: 180330 - RNA, 64 nt, Human; identical to SEQ ID NO: 108781

SEQ ID NO: 180331 - RNA, 64 nt, Human; identical to SEQ ID NO: 108782

SEQ ID NO: 180332 - RNA, 64 nt, Human; identical to SEQ ID NO: 108783

SEQ ID NO: 180333 - RNA, 64 nt, Human; identical to SEQ ID NO: 108784

SEQ ID NO: 180334 - RNA, 64 nt, Human; identical to SEQ ID NO: 108785

SEQ ID NO: 180335 - RNA, 64 nt, Human; identical to SEQ ID NO: 108786

SEQ ID NO: 180336 - RNA, 64 nt, Human; identical to SEQ ID NO: 108787

SEQ ID NO: 180337 - RNA, 64 nt, Human; identical to SEQ ID NO: 108788

SEQ ID NO: 180338 - RNA, 64 nt, Human; identical to SEQ ID NO: 108789

SEQ ID NO: 180339 - RNA, 64 nt, Human; identical to SEQ ID NO: 108790

SEQ ID NO: 180340 - RNA, 64 nt, Human; identical to SEQ ID NO: 108791

SEQ ID NO: 180341 - RNA, 64 nt, Human; identical to SEQ ID NO: 108792

SEQ ID NO: 180342 - RNA, 62 nt, Human
ucaccauuaaaagaauugcagcuuugugccccaugaccuucagcucaguuguugacugucau

SEQ ID NO: 180343 - RNA, 64 nt, Human; identical to SEQ ID NO: 108793

SEQ ID NO: 180344 - RNA, 64 nt, Human; identical to SEQ ID NO: 108794

SEQ ID NO: 180345 - RNA, 64 nt, Human; identical to SEQ ID NO: 142056

SEQ ID NO: 180346 - RNA, 64 nt, Human; identical to SEQ ID NO: 142057

SEQ ID NO: 180347 - RNA, 64 nt, Human; identical to SEQ ID NO: 142058

SEQ ID NO: 180348 - RNA, 64 nt, Human; identical to SEQ ID NO: 142059

SEQ ID NO: 180349 - RNA, 64 nt, Human; identical to SEQ ID NO: 142060

SEQ ID NO: 180350 - RNA, 57 nt, Human; identical to SEQ ID NO: 142061

SEQ ID NO: 180351 - RNA, 64 nt, Human; identical to SEQ ID NO: 142062

SEQ ID NO: 180352 - RNA, 64 nt, Human
acagaaagaagaaaggaaagaaaggaaccagaggcagagagacgaggauacccagcgaaaggga

SEQ ID NO: 180353 - RNA, 64 nt, Human
gaguucuggugugugcucccgccuccuggguauacagagagaaggcaggaaucaggaguuccag

SEQ ID NO: 180354 - RNA, 64 nt, Human
acuaccuguugggaaggacaaagggaugaggcuccagagagaguuggcugccacagccucugcc

SEQ ID NO: 180355 - RNA, 64 nt, Human
ccaguggauccccugcggucaggcugggcagccccagagagaggauguggaaagcacuuuuugg

SEQ ID NO: 180356 - RNA, 64 nt, Human
gucacuuuacguuugaauuucugagcuaaagagucagagagauuagucacauaguugccuaaau

SEQ ID NO: 180357 - RNA, 64 nt, Human
uaccccuuucuggcucucccauuuccugagaccacagagagaggggagaagccugggauugaca

SEQ ID NO: 180358 - RNA, 64 nt, Human
ggccccaguggacucuuuguacccuuccuacucucagagagaagugggcaggagggguccucaa

SEQ ID NO: 180359 - RNA, 64 nt, Human
accugcacacuugacaaguggagaaacagaagcccagagagagcacuggguuuguucaggacca

SEQ ID NO: 180360 - RNA, 64 nt, Human
gauauauaucuauauguauauagauauauaaauacagagagauaucuggcuugguuuuaauuau

SEQ ID NO: 180361 - RNA, 64 nt, Human
gguaucccagccuggacaggcauggaccugucuccagagagaggagccugaaguucguggggcg

SEQ ID NO: 180362 - RNA, 64 nt, Human
ccagggaggaaccugacccaagaguaaaugucugcagagagauggauggauggauggauagaug

SEQ ID NO: 180363 - RNA, 64 nt, Human
cuuucagaacauuuuccagauggcgaggucacagcagagagauguggccaccuagccuuuccuu

SEQ ID NO: 180364 - RNA, 64 nt, Human
cccugacuccuggugcccucucccuuuguccccccagagagacauaugcccccagagagagcaa

SEQ ID NO: 180365 - RNA, 64 nt, Human
ucucccuuuguccccccagagagacauaugcccccagagagagcaaaucgaagcgugggaggca

SEQ ID NO: 180366 - RNA, 64 nt, Human
guggagggggugucuggaagcugagcaggcccgacagagagaugaagccaucagaaggacuuga

SEQ ID NO: 180367 - RNA, 64 nt, Human
acauguaccacugagccugagauggggaugagggcagagagaggggagcccccucuuccacuca

SEQ ID NO: 180368 - RNA, 64 nt, Human
aaugaaaaggggugagauaacgcucauugcucuucagagagagugguuggagccccccccgccc

SEQ ID NO: 180369 - RNA, 64 nt, Human
gcgcagaguugaagaagcauaagcaagacaaaaacagagagaccgcagaaggaggaagauacug

SEQ ID NO: 180370 - RNA, 64 nt, Human
ggugaauuugauuauuuccagugguuagauuuagcagagagauuuacuuucuuagaaauuaaua

SEQ ID NO: 180371 - RNA, 64 nt, Human
uaagcugaaucccaaauuugaguuugggaagaaccagagagaaauggaucccugagcucugagc

SEQ ID NO: 180372 - RNA, 64 nt, Human
auuaaguuuuccccaagcaaggaaggcagguggucagagagaucaaacgcugaggcguggggau

SEQ ID NO: 180373 - RNA, 64 nt, Human
ggccuccccgucgaccucagugccuuuuuguuuucagagagaaauaggaguagggcgaguuugc

SEQ ID NO: 180374 - RNA, 64 nt, Human
aaguucccuuagcuauaugaauuuuggcauguuucagagagaucaguaaauaaaauauuagaua

SEQ ID NO: 180375 - RNA, 64 nt, Human
agaccuaaggacacguggaagucaguuuaauugccagagagaaggaugcaaucacuagguaaaa

SEQ ID NO: 180376 - RNA, 64 nt, Human
agcacaucccccaggacuugaugaccacacggggcagagagaaaccaaccaaggccagcaccuc

SEQ ID NO: 180377 - RNA, 64 nt, Human
cacuccuuuuuucccagguauacugaaggggugacagagagaggucuucauggcagaccaggcc

SEQ ID NO: 180378 - RNA, 64 nt, Human
cccaugucuccugggacagaggccaucucucuuccagagagaggcagcauuggcccacaggaua

SEQ ID NO: 180379 - RNA, 64 nt, Human
gucccuugaagcccagccacaaguguuggagcugcagagagaccccaaagguaguagauugugc

SEQ ID NO: 180380 - RNA, 64 nt, Human
guaaggagcuggaugaaugagaggcccccagaugcagagagacuggagaggguggggaggggcc

SEQ ID NO: 180381 - RNA, 64 nt, Human
guuuugaugcccucacuaguguugaagccuguuccagagagaggugggacugcaaggagaggau

SEQ ID NO: 180382 - RNA, 64 nt, Human
ggggucauuguugcuuuacaauaaugcuuagaugcagagagaggaaaaaacagcaacaaaguca

SEQ ID NO: 180383 - RNA, 64 nt, Human
uuaucucuauuucacagaugaagaaacagagccucagagagauuaguaccucacuugcaaaguu

SEQ ID NO: 180384 - RNA, 64 nt, Human
gcagagucucuagagguagaaauuugccuugcugcagagagagaaggaauggcgugggaugggg

SEQ ID NO: 180385 - RNA, 64 nt, Human
acuuuucuugauaagaauuuacagauaagacacucagagagacauugugucauucucuaucauc

SEQ ID NO: 180386 - RNA, 64 nt, Human
gggggcugaggggcaacgaagaaaaaaaauaacacagagagacagacuugagaacuugacaagu

SEQ ID NO: 180387 - RNA, 64 nt, Human
accccagccccucuaacuagaguggggagcaugccagagagagcucaauguacaaaugaaugcc

SEQ ID NO: 180388 - RNA, 64 nt, Human
accaucucaucagagaugaauaauaucuuuuuaccagagagagaacgaauguuagccacaugcc

SEQ ID NO: 180389 - RNA, 64 nt, Human
ucgguugugauuucauucacguggaugcugcaagcagagagacugccaccuggaguuaggagua

SEQ ID NO: 180390 - RNA, 64 nt, Human
gucaccagaucugauuuguaacccacugagaggacagagagaaauaagugcccucucccacccu

SEQ ID NO: 180391 - RNA, 64 nt, Human
guugcagauuaaagaacccaucuggaaugguuuacagagagaggaauuuaaaagaggacaucag

SEQ ID NO: 180392 - RNA, 64 nt, Human
augaacucaagguuagugacucugcaggacuucacagagagagcugugcccaucauucagucca

SEQ ID NO: 180393 - RNA, 64 nt, Human
gagaagcugaggccuaugcagacaucucuggagccagagagaacaacaggcaggggcccacuug

SEQ ID NO: 180394 - RNA, 64 nt, Human
acuguucugggacuccaggucuugaggagagagacagagagagagaauggauccucauagguca

SEQ ID NO: 180395 - RNA, 64 nt, Human
aagcgucucacucugggagccuuggcccugcucacagagagagacaauagaaaauugaggaagg

SEQ ID NO: 180396 - RNA, 64 nt, Human
auaugugauauuuacaaagcaauuggcccauuuacagagagacauauauaauuucuccacaaag

SEQ ID NO: 180397 - RNA, 64 nt, Human
gugggaauuaggagagaagguagggguugggaaucagagagaauggcuuuggucucuugcuugu

SEQ ID NO: 180398 - RNA, 64 nt, Human
uguaaccaagauggaugcaaagaggcuagugccucagagagaacuguacgggguuugugacugg

SEQ ID NO: 180399 - RNA, 64 nt, Human
guuuggaaaacaguuuuuauucuguuuuauaaaccagagagaaaugaguuuugacgucuuuuua

SEQ ID NO: 180400 - RNA, 63 nt, Human
gaagcaaugguagaaauugaccaguacagaaugcagagagauaaagaguuucgacuaaaacaa

SEQ ID NO: 180401 - RNA, 64 nt, Human
ccuggugucugccucgccauccugggguaaggggcagagagaaggacuugucuuauguagggug

SEQ ID NO: 180402 - RNA, 64 nt, Human
ugugcagugucugagggcagguugggaaggguagcagagagagagagacagaaagagagagaga

SEQ ID NO: 180403 - RNA, 64 nt, Human
gggaaaauccacuaugacaucuaaguuuuguguacagagagauauuuuugcaacuauuuccacc

SEQ ID NO: 180404 - RNA, 64 nt, Human
ccucucuccucccuuccuucccuccccgcaucuccagagagagccucucagcagcaggggggug

SEQ ID NO: 180405 - RNA, 54 nt, Human
agagaaauccaggacccugagggacagagagaugaacugcucaguuaccauggg

SEQ ID NO: 180406 - RNA, 64 nt, Human
ggaagaauuaggaggcagccauaauaagagucuucagagagaugaugggaggggccagugagga

SEQ ID NO: 180407 - RNA, 64 nt, Human
cuaaugcuugggucuguuuauauguguauauaugcagagagagagcuuauauauuauuuauauu

SEQ ID NO: 180408 - RNA, 64 nt, Human
aagaaacagccuccaagaacauucaagcagcagucagagagaaaaauguuucgacagccaaguu

SEQ ID NO: 180409 - RNA, 64 nt, Human
cugggagccuggcgcgucaucauuggccugacagcagagagaauugagaagcauuucuccccug

SEQ ID NO: 180410 - RNA, 64 nt, Human
aggugcuguguuucuuauuucauacgagauaaaacagagagaaguucucucuucuccagcuugu

SEQ ID NO: 180411 - RNA, 64 nt, Human
uauaguuaucuucuuaaaaaccauuauaacaauucagagagaguucuuuacaaagccaugaaua

SEQ ID NO: 180412 - RNA, 55 nt, Human
uaccaucugauaacucuugaagauacagagagaaauccaucuuuucccaggucuc

SEQ ID NO: 180413 - RNA, 64 nt, Human
ggguauugcuccauaucaaagcagauuugcaggacagagagaguaaauuagccuucagucuugg

SEQ ID NO: 180414 - RNA, 64 nt, Human
cuaaauuccauuucuucuucuuguuuaaauggugcagagagaaagguugcccagacauccacca

SEQ ID NO: 180415 - RNA, 64 nt, Human
guuuaaucacaagaaggaggcaggaagggagagucagagagagaauggaagauaccaugcuucu

SEQ ID NO: 180416 - RNA, 64 nt, Human
uggaaggaagagaguagggccagugaaggcugcccagagagaaugucacagaugaggcugcccc

SEQ ID NO: 180417 - RNA, 64 nt, Human
cagaagucuuguuagcagaauuauuuaucagucacagagagaaaaaucugcuauuuuucuaagu

SEQ ID NO: 180418 - RNA, 64 nt, Human
gaucauucaguuacuugucaggauuucuccucuucagagagauuuuuuuuuauagcacagauuc

SEQ ID NO: 180419 - RNA, 64 nt, Human
uccgagcacacauaaaagcacaaagacagagacgcagagagagagagagagccacggagaggaa

SEQ ID NO: 180420 - RNA, 64 nt, Human
cccaucgcccagcaccccugcugauaccaccagacagagagagagagcacuugauucuucccga

SEQ ID NO: 180421 - RNA, 64 nt, Human
auacaguccacagguggacaaagggauccccagccagagagagagagaccagccaacagcuuga

SEQ ID NO: 180422 - RNA, 64 nt, Human
gagaccagccaacagcuugauagaccagugcagccagagagaccaccaaacagagcccccaaaa

SEQ ID NO: 180423 - RNA, 64 nt, Human
auuuacugcaaaaagaaaaucuuuauaaauguaccagagagaguuguuuuaauaacuuaucuau

SEQ ID NO: 180424 - RNA, 64 nt, Human
uuauauccagaaagucuucucuauguagagaagucagagagacuagaugcuuucacuagggaau

SEQ ID NO: 180425 - RNA, 64 nt, Human
gaguguguguguguguguguguguguguguguggcagagagagagaaagagagagagagagaga

SEQ ID NO: 180426 - RNA, 64 nt, Human
gaugggagguggggaaugaauggaagcugacgggcagagagaggaggauuaaaaaaaagaaaua

SEQ ID NO: 180427 - RNA, 64 nt, Human
ugguguugccagacgggccucauggucugcugugcagagagaggcaggaaggaucccugaagag

SEQ ID NO: 180428 - RNA, 60 nt, Human
ugguggcccaccaguccuaacgggacaggacagagagacagagcagcccugcacuguuuu

SEQ ID NO: 180429 - RNA, 64 nt, Human
aaugacuugacaugaaaugucagcugugcuggggcagagagaccuuggaaggaagcucuuggaa

SEQ ID NO: 180430 - RNA, 64 nt, Human
acgccuauuuaaucuuaaguguaggaaugggcuccagagagaagacauuuauauuaugaaauau

SEQ ID NO: 180431 - RNA, 64 nt, Human
auugucaguguaacuauuaccuaccaguauuguucagagagauugaaacagaauaaacgggcug

SEQ ID NO: 180432 - RNA, 64 nt, Human
uuaccaggcuuucugaaagaucuagugguucacacagagagagagagaguacugaaaaagcaac

SEQ ID NO: 180433 - RNA, 64 nt, Human
caagcacuauaugaauacgcaagaaggagauucacagagagacgagcccaggaggcugacugag

SEQ ID NO: 180434 - RNA, 64 nt, Human
ggaaucugagaguguaaaaaagguggccauaagacagagagagaauaaucgugcuuuguuuuau

SEQ ID NO: 180435 - RNA, 64 nt, Human
gugcagacaucacuggaacuuaaagaauucauaucagagagagauccuaaagguguaauguaug

SEQ ID NO: 180436 - RNA, 64 nt, Human
uuuuuuuuaauuuuuauaauguacugaugugguucagagagauaaagcacuuuaguacauaguc

SEQ ID NO: 180437 - RNA, 64 nt, Human
agaacuuuccagagugugcccauauuuaccugaucagagagaaaagaaaaucugcagaggaagc
